United States Patent 11,254,933 (CRISPR/CAS TRANSCRIPTIONAL MODULATION) - sequence listing, part 13

SEQ ID NO: 557419 - DNA, 20 bp, mouse
gcgggaagcggcagggtcac

SEQ ID NO: 557420 - DNA, 20 bp, mouse
gtcacacaggacactaaaca

SEQ ID NO: 557421 - DNA, 20 bp, mouse
ggctgatctcaactatccct

SEQ ID NO: 557422 - DNA, 20 bp, mouse
gatctgcgagggggttaagt

SEQ ID NO: 557423 - DNA, 20 bp, mouse
ggggggttaagtgggaatcg

SEQ ID NO: 557424 - DNA, 20 bp, mouse
gggcaggagaaagacgagag

SEQ ID NO: 557425 - DNA, 20 bp, mouse
ggatcagctgccatagcttc

SEQ ID NO: 557426 - DNA, 20 bp, mouse
gcgggatggacgatcaatcc

SEQ ID NO: 557427 - DNA, 20 bp, mouse
ggccagagtctgcagcatcc

SEQ ID NO: 557428 - DNA, 20 bp, mouse
gatgctgcagactctggccg

SEQ ID NO: 557429 - DNA, 20 bp, mouse
gccccctcacggccacgaag

SEQ ID NO: 557430 - DNA, 20 bp, mouse
gccggccactcggtccaggg

SEQ ID NO: 557431 - DNA, 20 bp, mouse
gactctggccggggtgaacc

SEQ ID NO: 557432 - DNA, 20 bp, mouse
gcatacccccctggaccgag

SEQ ID NO: 557433 - DNA, 20 bp, mouse
ggacgaggcgcaagcaaagt

SEQ ID NO: 557434 - DNA, 20 bp, mouse
ggtcggtgatggtcatgatc

SEQ ID NO: 557435 - DNA, 20 bp, mouse
gcggcagagccatacccccc

SEQ ID NO: 557436 - DNA, 20 bp, mouse
gggcggcacgggacgcagag

SEQ ID NO: 557437 - DNA, 20 bp, mouse
gcgctcgggactgtagccca

SEQ ID NO: 557438 - DNA, 20 bp, mouse
gggcacgggacgcagagggg

SEQ ID NO: 557439 - DNA, 20 bp, mouse
gcgcaagcgcgagagcccgg

SEQ ID NO: 557440 - DNA, 20 bp, mouse
gggcctagtggagctgtggt

SEQ ID NO: 557441 - DNA, 20 bp, mouse
gcgagcgagcgcagagggac

SEQ ID NO: 557442 - DNA, 20 bp, mouse
ggcggaggcgggatgaggat

SEQ ID NO: 557443 - DNA, 20 bp, mouse
gcagtcccgagcgagcgcag

SEQ ID NO: 557444 - DNA, 20 bp, mouse
ggacgcagaggggcggccat

SEQ ID NO: 557445 - DNA, 20 bp, mouse
gccctgggaacaggagacat

SEQ ID NO: 557446 - DNA, 20 bp, mouse
ggaggagctgggtcaggtaa

SEQ ID NO: 557447 - DNA, 20 bp, mouse
gcagcccaggaagacaagag

SEQ ID NO: 557448 - DNA, 20 bp, mouse
gaggagtccttgccgggaag

SEQ ID NO: 557449 - DNA, 20 bp, mouse
gggaagttagagacaatcaa

SEQ ID NO: 557450 - DNA, 20 bp, mouse
gtaagctgaagactgaagcg

SEQ ID NO: 557451 - DNA, 20 bp, mouse
gaggtaaaggagtccttgcc

SEQ ID NO: 557452 - DNA, 20 bp, mouse
gaagactgaagcgaggagct

SEQ ID NO: 557453 - DNA, 20 bp, mouse
ggattccgaagcaggaactc

SEQ ID NO: 557454 - DNA, 20 bp, mouse
gtgcccaacacaggaccgaa

SEQ ID NO: 557455 - DNA, 20 bp, mouse
gggaagggtggcagctaagt

SEQ ID NO: 557456 - DNA, 20 bp, mouse
gaagtctggtggaccctgag

SEQ ID NO: 557457 - DNA, 20 bp, mouse
ggtaagcgcaggaagtctgg

SEQ ID NO: 557458 - DNA, 20 bp, mouse
gaagcaggtggcggcagcga

SEQ ID NO: 557459 - DNA, 20 bp, mouse
gatggtaagcgcaggaagtc

SEQ ID NO: 557460 - DNA, 20 bp, mouse
gctgcttcccgcactggaca

SEQ ID NO: 557461 - DNA, 20 bp, mouse
gaagcagcaggccaccgcgg

SEQ ID NO: 557462 - DNA, 20 bp, mouse
ggcgcttaccatgtccagtg

SEQ ID NO: 557463 - DNA, 20 bp, mouse
gtggaccctgagaggagacc

SEQ ID NO: 557464 - DNA, 20 bp, mouse
gtggtgtggagagacgacta

SEQ ID NO: 557465 - DNA, 20 bp, mouse
gccgccagcagactaggcct

SEQ ID NO: 557466 - DNA, 20 bp, mouse
gcagcccgggaccatggtgg

SEQ ID NO: 557467 - DNA, 20 bp, mouse
ggggcagcccgggaccatgg

SEQ ID NO: 557468 - DNA, 20 bp, mouse
gaccagccagggctccgtag

SEQ ID NO: 557469 - DNA, 20 bp, mouse
ggggaccatggtggcggcag

SEQ ID NO: 557470 - DNA, 20 bp, mouse
ggggagcgcgtagcgcgggg

SEQ ID NO: 557471 - DNA, 20 bp, mouse
gccccgcgcgggggaggacg

SEQ ID NO: 557472 - DNA, 20 bp, mouse
gcggtggctgtagcggcggt

SEQ ID NO: 557473 - DNA, 20 bp, mouse
ggccgggcagcccgggacca

SEQ ID NO: 557474 - DNA, 20 bp, mouse
ggcaccgaaggcccccgaag

SEQ ID NO: 557475 - DNA, 20 bp, mouse
gtgagcacgctcaaaaacta

SEQ ID NO: 557476 - DNA, 20 bp, mouse
ggagcggtcgacgggcgggt

SEQ ID NO: 557477 - DNA, 20 bp, mouse
gggcgcggcggtggcgactc

SEQ ID NO: 557478 - DNA, 20 bp, mouse
gtacgtggtcaagtcctggg

SEQ ID NO: 557479 - DNA, 20 bp, mouse
gggcggcgtcgcaggactgg

SEQ ID NO: 557480 - DNA, 20 bp, mouse
gcggctgctgatgcacggaa

SEQ ID NO: 557481 - DNA, 20 bp, mouse
gaccgggagcggtcgacggg

SEQ ID NO: 557482 - DNA, 20 bp, mouse
gcgccccgcccagaccgccg

SEQ ID NO: 557483 - DNA, 20 bp, mouse
gtgatgcacggaaaggaagt

SEQ ID NO: 557484 - DNA, 20 bp, mouse
gcgttacgtggtcaagtcct

SEQ ID NO: 557485 - DNA, 20 bp, mouse
gggcgtcgcaggactggcgg

SEQ ID NO: 557486 - DNA, 20 bp, mouse
ggaggcgcgagtcgactgag

SEQ ID NO: 557487 - DNA, 20 bp, mouse
gaggccgaggctccagaata

SEQ ID NO: 557488 - DNA, 20 bp, mouse
gccaagaaggatgtcacgag

SEQ ID NO: 557489 - DNA, 20 bp, mouse
ggccgggggcggaacaatag

SEQ ID NO: 557490 - DNA, 20 bp, mouse
gctgctgcctctgctggtct

SEQ ID NO: 557491 - DNA, 20 bp, mouse
ggggcctcgcgtgaatgccc

SEQ ID NO: 557492 - DNA, 20 bp, mouse
ggagtcgactgaggggaaaa

SEQ ID NO: 557493 - DNA, 20 bp, mouse
ggctctgcgcgaggcctact

SEQ ID NO: 557494 - DNA, 20 bp, mouse
gagaccccggggcgggtgga

SEQ ID NO: 557495 - DNA, 20 bp, mouse
ggctcatgcgggtctacgag

SEQ ID NO: 557496 - DNA, 20 bp, mouse
ggaagcccgatgcgacccag

SEQ ID NO: 557497 - DNA, 20 bp, mouse
ggcccgatgcgacccagcgg

SEQ ID NO: 557498 - DNA, 20 bp, mouse
gcctgagctaggagacgccg

SEQ ID NO: 557499 - DNA, 20 bp, mouse
ggtgcttcggccagagctcg

SEQ ID NO: 557500 - DNA, 20 bp, mouse
gcgtctcctagctcaggcga

SEQ ID NO: 557501 - DNA, 20 bp, mouse
gctatgctgccggtcgggtg

SEQ ID NO: 557502 - DNA, 20 bp, mouse
gaggcgagggtcccaagctg

SEQ ID NO: 557503 - DNA, 20 bp, mouse
ggccgccgctgggtcgcatc

SEQ ID NO: 557504 - DNA, 20 bp, mouse
gccggccgagacccctccaa

SEQ ID NO: 557505 - DNA, 20 bp, mouse
ggtactagggccgggatcct

SEQ ID NO: 557506 - DNA, 20 bp, mouse
gcctttcccggggacaatgt

SEQ ID NO: 557507 - DNA, 20 bp, mouse
gtgtcactcgcagttgtgag

SEQ ID NO: 557508 - DNA, 20 bp, mouse
gtgagcggccgcctttcccg

SEQ ID NO: 557509 - DNA, 20 bp, mouse
ggggacaatgtgggactgag

SEQ ID NO: 557510 - DNA, 20 bp, mouse
gatcagctgcgaacaatgag

SEQ ID NO: 557511 - DNA, 20 bp, mouse
gtgaggcctgtacaggtggg

SEQ ID NO: 557512 - DNA, 20 bp, mouse
ggaacagccccagcgaggta

SEQ ID NO: 557513 - DNA, 20 bp, mouse
gcgctggggctgttctgcgg

SEQ ID NO: 557514 - DNA, 20 bp, mouse
gacccgatcgcggtcctggg

SEQ ID NO: 557515 - DNA, 20 bp, mouse
gtggggctgttctgcggcgg

SEQ ID NO: 557516 - DNA, 20 bp, mouse
gaagtctgcggggtggacga

SEQ ID NO: 557517 - DNA, 20 bp, mouse
gagccggcaagtctgcgggg

SEQ ID NO: 557518 - DNA, 20 bp, mouse
ggggcagtgggtcaggaccg

SEQ ID NO: 557519 - DNA, 20 bp, mouse
gagcagccggcaagtctgcg

SEQ ID NO: 557520 - DNA, 20 bp, mouse
gtctgcggggtggacgatgg

SEQ ID NO: 557521 - DNA, 20 bp, mouse
gagggtgagaggtcagcagc

SEQ ID NO: 557522 - DNA, 20 bp, mouse
gctggccgccaacagcgcca

SEQ ID NO: 557523 - DNA, 20 bp, mouse
ggccccttgacgagggtgag

SEQ ID NO: 557524 - DNA, 20 bp, mouse
gcttccccgccccttgacga

SEQ ID NO: 557525 - DNA, 20 bp, mouse
gccaggcccgggccctgacc

SEQ ID NO: 557526 - DNA, 20 bp, mouse
ggcggcgattaggattcggg

SEQ ID NO: 557527 - DNA, 20 bp, mouse
gagcccggcgcgctgtgata

SEQ ID NO: 557528 - DNA, 20 bp, mouse
gattaggattcgggcggtgg

SEQ ID NO: 557529 - DNA, 20 bp, mouse
ggcacaagcgagtgagtcac

SEQ ID NO: 557530 - DNA, 20 bp, mouse
ggcgattaggattcgggcgg

SEQ ID NO: 557531 - DNA, 20 bp, mouse
ggcggcggcgattaggattc

SEQ ID NO: 557532 - DNA, 20 bp, mouse
gtgtctactgacacccgagg

SEQ ID NO: 557533 - DNA, 20 bp, mouse
gtaggcgctgcgcctgggag

SEQ ID NO: 557534 - DNA, 20 bp, mouse
gcgctgtgatagggcgggag

SEQ ID NO: 557535 - DNA, 20 bp, mouse
gggaggtccccaggcggtgg

SEQ ID NO: 557536 - DNA, 20 bp, mouse
ggctccgctagtgtgtgagg

SEQ ID NO: 557537 - DNA, 20 bp, mouse
gcactagcggagcgggagcg

SEQ ID NO: 557538 - DNA, 20 bp, mouse
ggcgaggacgcgaagccgcc

SEQ ID NO: 557539 - DNA, 20 bp, mouse
ggaggcgggtaaggatctag

SEQ ID NO: 557540 - DNA, 20 bp, mouse
gcggcggagccagcagagag

SEQ ID NO: 557541 - DNA, 20 bp, mouse
gcccgctccgctagtgtgtg

SEQ ID NO: 557542 - DNA, 20 bp, mouse
ggcccacagccagccggagc

SEQ ID NO: 557543 - DNA, 20 bp, mouse
gcgcgggctgcggctctaca

SEQ ID NO: 557544 - DNA, 20 bp, mouse
gtccggctccggctggctgt

SEQ ID NO: 557545 - DNA, 20 bp, mouse
gggcgctgcggttcaggctc

SEQ ID NO: 557546 - DNA, 20 bp, mouse
ggagcgctcactgaccgaga

SEQ ID NO: 557547 - DNA, 20 bp, mouse
gaccgagaaggtgaggacta

SEQ ID NO: 557548 - DNA, 20 bp, mouse
gctcactgaccgagaaggtg

SEQ ID NO: 557549 - DNA, 20 bp, mouse
gccttccagctctaagtcct

SEQ ID NO: 557550 - DNA, 20 bp, mouse
ggccctagtcctcaccttct

SEQ ID NO: 557551 - DNA, 20 bp, mouse
gaggaccaggtagctcgtga

SEQ ID NO: 557552 - DNA, 20 bp, mouse
gtaggagaggaggctagatg

SEQ ID NO: 557553 - DNA, 20 bp, mouse
gctagtgtgtgagagcacct

SEQ ID NO: 557554 - DNA, 20 bp, mouse
gcctgtgggaggaggcgctc

SEQ ID NO: 557555 - DNA, 20 bp, mouse
ggctgaccgagagcaggtgc

SEQ ID NO: 557556 - DNA, 20 bp, mouse
ggccgagatcacaagcattg

SEQ ID NO: 557557 - DNA, 20 bp, mouse
gcaagcattggggctgaagc

SEQ ID NO: 557558 - DNA, 20 bp, mouse
ggccccaatgcttgtgatct

SEQ ID NO: 557559 - DNA, 20 bp, mouse
ggccagccgttgatatcaag

SEQ ID NO: 557560 - DNA, 20 bp, mouse
gtatcaagaggcatgttcag

SEQ ID NO: 557561 - DNA, 20 bp, mouse
ggacaagaggaacgtccatc

SEQ ID NO: 557562 - DNA, 20 bp, mouse
gaacagagaagcggagcgct

SEQ ID NO: 557563 - DNA, 20 bp, mouse
gttgtcttcctgctgatggg

SEQ ID NO: 557564 - DNA, 20 bp, mouse
gacatgcctcttgatatcaa

SEQ ID NO: 557565 - DNA, 20 bp, mouse
gttctcttcatttctccgga

SEQ ID NO: 557566 - DNA, 20 bp, mouse
gtgcagtcgacgaactgtca

SEQ ID NO: 557567 - DNA, 20 bp, mouse
gagcggcccgcgcagcaaag

SEQ ID NO: 557568 - DNA, 20 bp, mouse
gagtcgacgaactgtcaggg

SEQ ID NO: 557569 - DNA, 20 bp, mouse
ggcagtctctgtggagcggg

SEQ ID NO: 557570 - DNA, 20 bp, mouse
gcggaagggagggcaccagt

SEQ ID NO: 557571 - DNA, 20 bp, mouse
ggctaggctaccagagtgca

SEQ ID NO: 557572 - DNA, 20 bp, mouse
gtggcgcagcaccaactgat

SEQ ID NO: 557573 - DNA, 20 bp, mouse
gcgcagcaaagcggaaagct

SEQ ID NO: 557574 - DNA, 20 bp, mouse
gccctcccagcaggcggcta

SEQ ID NO: 557575 - DNA, 20 bp, mouse
gtgcggactgcgagctgtgg

SEQ ID NO: 557576 - DNA, 20 bp, mouse
gtggtccacttagcagtgat

SEQ ID NO: 557577 - DNA, 20 bp, mouse
gcctagtaaagcaggatgta

SEQ ID NO: 557578 - DNA, 20 bp, mouse
gctaagagccctagcaggaa

SEQ ID NO: 557579 - DNA, 20 bp, mouse
gggaccagctggtgctgtgg

SEQ ID NO: 557580 - DNA, 20 bp, mouse
gctggactggagtttttcaa

SEQ ID NO: 557581 - DNA, 20 bp, mouse
gggtcaagtctctcttagac

SEQ ID NO: 557582 - DNA, 20 bp, mouse
gggcagctgcagaatctgga

SEQ ID NO: 557583 - DNA, 20 bp, mouse
gtcccaagaactaagagtgg

SEQ ID NO: 557584 - DNA, 20 bp, mouse
gccccagtctactaactgtt

SEQ ID NO: 557585 - DNA, 20 bp, mouse
ggtaacagcaggtctgaagt

SEQ ID NO: 557586 - DNA, 20 bp, mouse
ggagccgccctcctccgctg

SEQ ID NO: 557587 - DNA, 20 bp, mouse
gctgccgcagcggaggaggg

SEQ ID NO: 557588 - DNA, 20 bp, mouse
gcggctgccgcagcggagga

SEQ ID NO: 557589 - DNA, 20 bp, mouse
ggaggagggcggctcggaga

SEQ ID NO: 557590 - DNA, 20 bp, mouse
gatccggactgcgagcccgg

SEQ ID NO: 557591 - DNA, 20 bp, mouse
gctaagactgagagatttgg

SEQ ID NO: 557592 - DNA, 20 bp, mouse
ggtcagtcagcaagagacgc

SEQ ID NO: 557593 - DNA, 20 bp, mouse
ggctttggggtgatcctgac

SEQ ID NO: 557594 - DNA, 20 bp, mouse
gctgcgaagggaggaccgtg

SEQ ID NO: 557595 - DNA, 20 bp, mouse
gctccgctgcggcagccgcc

SEQ ID NO: 557596 - DNA, 20 bp, mouse
gtccgctgcagactaaacac

SEQ ID NO: 557597 - DNA, 20 bp, mouse
gaccggtgtttagtctgcag

SEQ ID NO: 557598 - DNA, 20 bp, mouse
gcggccacccctaccaggaa

SEQ ID NO: 557599 - DNA, 20 bp, mouse
gcgtttggcgacttccagat

SEQ ID NO: 557600 - DNA, 20 bp, mouse
gggagcgtgaagtcccttcc

SEQ ID NO: 557601 - DNA, 20 bp, mouse
gtgaagtcccttcctggtag

SEQ ID NO: 557602 - DNA, 20 bp, mouse
gagagctctgagtggctggg

SEQ ID NO: 557603 - DNA, 20 bp, mouse
gaagactctgagacccgatg

SEQ ID NO: 557604 - DNA, 20 bp, mouse
gagtcccttcctggtagggg

SEQ ID NO: 557605 - DNA, 20 bp, mouse
ggttgtagagattttcagac

SEQ ID NO: 557606 - DNA, 20 bp, mouse
gagtagtttgcggcatcggg

SEQ ID NO: 557607 - DNA, 20 bp, mouse
ggctggctgagaggggagac

SEQ ID NO: 557608 - DNA, 20 bp, mouse
gagtttgcggcatcgggagg

SEQ ID NO: 557609 - DNA, 20 bp, mouse
gcggcagctcgggctctctc

SEQ ID NO: 557610 - DNA, 20 bp, mouse
gagggaggaagccctaagca

SEQ ID NO: 557611 - DNA, 20 bp, mouse
gaactactggccacagagtc

SEQ ID NO: 557612 - DNA, 20 bp, mouse
gtgcggcgcagtgtcctccc

SEQ ID NO: 557613 - DNA, 20 bp, mouse
gacgggcgagcgggtgcaga

SEQ ID NO: 557614 - DNA, 20 bp, mouse
gcagggtcgagggcttctgt

SEQ ID NO: 557615 - DNA, 20 bp, mouse
ggcggcagcggctggctgag

SEQ ID NO: 557616 - DNA, 20 bp, mouse
gttggtgggttgtccaggag

SEQ ID NO: 557617 - DNA, 20 bp, mouse
gcagagcgctccagaaggga

SEQ ID NO: 557618 - DNA, 20 bp, mouse
gtaaggagcgaggcttgtca

SEQ ID NO: 557619 - DNA, 20 bp, mouse
gcagtcagagcgctccagaa

SEQ ID NO: 557620 - DNA, 20 bp, mouse
ggctaacaacctgtagactt

SEQ ID NO: 557621 - DNA, 20 bp, mouse
gaaagagccagaataaggac

SEQ ID NO: 557622 - DNA, 20 bp, mouse
ggacctgttcccacaaaacc

SEQ ID NO: 557623 - DNA, 20 bp, mouse
ggctctggtccccaacctgg

SEQ ID NO: 557624 - DNA, 20 bp, mouse
gcggccgcgcattccctggg

SEQ ID NO: 557625 - DNA, 20 bp, mouse
ggcacccgtgcctggatatg

SEQ ID NO: 557626 - DNA, 20 bp, mouse
ggccgaatgcaggtgaggga

SEQ ID NO: 557627 - DNA, 20 bp, mouse
ggcgggccgaatgcaggtga

SEQ ID NO: 557628 - DNA, 20 bp, mouse
gcaacacgcgggccgaatgc

SEQ ID NO: 557629 - DNA, 20 bp, mouse
gtcccactgctccaacacgc

SEQ ID NO: 557630 - DNA, 20 bp, mouse
ggcccgcgtgttggagcagt

SEQ ID NO: 557631 - DNA, 20 bp, mouse
ggtgagaagcgaccgactct

SEQ ID NO: 557632 - DNA, 20 bp, mouse
gcgctgtgcgcgattcaggg

SEQ ID NO: 557633 - DNA, 20 bp, mouse
ggcgtctctgaagatggctc

SEQ ID NO: 557634 - DNA, 20 bp, mouse
ggagaaaccggagctcttcg

SEQ ID NO: 557635 - DNA, 20 bp, mouse
gaccgcgcggtgcccaagtt

SEQ ID NO: 557636 - DNA, 20 bp, mouse
gtgctgaggatgcggaccac

SEQ ID NO: 557637 - DNA, 20 bp, mouse
gcagccgcgcgcccatcccg

SEQ ID NO: 557638 - DNA, 20 bp, mouse
ggaggatgcggaccacggga

SEQ ID NO: 557639 - DNA, 20 bp, mouse
gggaccacgggatgggcgcg

SEQ ID NO: 557640 - DNA, 20 bp, mouse
ggctgaagcagagcggcaga

SEQ ID NO: 557641 - DNA, 20 bp, mouse
ggcaccggcgacgggaaggt

SEQ ID NO: 557642 - DNA, 20 bp, mouse
gtaccggagcagctgcttgg

SEQ ID NO: 557643 - DNA, 20 bp, mouse
gtgaagattgacaacctcac

SEQ ID NO: 557644 - DNA, 20 bp, mouse
gcggacctgggcatcgtgac

SEQ ID NO: 557645 - DNA, 20 bp, mouse
ggcaatgtggcctcggacct

SEQ ID NO: 557646 - DNA, 20 bp, mouse
gggaggcgccgagtgagggt

SEQ ID NO: 557647 - DNA, 20 bp, mouse
ggcgggaaaagctgcagctc

SEQ ID NO: 557648 - DNA, 20 bp, mouse
gtgagtcctgcgaagcgctg

SEQ ID NO: 557649 - DNA, 20 bp, mouse
gaaaagctgcagctccggct

SEQ ID NO: 557650 - DNA, 20 bp, mouse
gccggctcgggctggctcgg

SEQ ID NO: 557651 - DNA, 20 bp, mouse
gcgcctccgcctcctttccc

SEQ ID NO: 557652 - DNA, 20 bp, mouse
gctctgctccgggtacgcga

SEQ ID NO: 557653 - DNA, 20 bp, mouse
gggctctgcgagccccgtgc

SEQ ID NO: 557654 - DNA, 20 bp, mouse
gtccaggcccgcatccccga

SEQ ID NO: 557655 - DNA, 20 bp, mouse
gacgccggggaagactcttt

SEQ ID NO: 557656 - DNA, 20 bp, mouse
gaagagtacgcgaggtagga

SEQ ID NO: 557657 - DNA, 20 bp, mouse
ggccatcggatgcaaatggt

SEQ ID NO: 557658 - DNA, 20 bp, mouse
ggtcgtcacgccctccctct

SEQ ID NO: 557659 - DNA, 20 bp, mouse
gttaagcgcgaaaggactca

SEQ ID NO: 557660 - DNA, 20 bp, mouse
gtttcgcgcttaagagactg

SEQ ID NO: 557661 - DNA, 20 bp, mouse
gagaagagcccagacccagt

SEQ ID NO: 557662 - DNA, 20 bp, mouse
gaacgaagagtacgcgaggt

SEQ ID NO: 557663 - DNA, 20 bp, mouse
ggaagtctctaacttctagt

SEQ ID NO: 557664 - DNA, 20 bp, mouse
gagtaggaaacgtcagagtt

SEQ ID NO: 557665 - DNA, 20 bp, mouse
gtctcaataagcccagaggg

SEQ ID NO: 557666 - DNA, 20 bp, mouse
gctgggccccctctcaaaga

SEQ ID NO: 557667 - DNA, 20 bp, mouse
gcagagagtgatctctctct

SEQ ID NO: 557668 - DNA, 20 bp, mouse
gcctttcctcgcagcctggg

SEQ ID NO: 557669 - DNA, 20 bp, mouse
gcgacaccctgtggctaaac

SEQ ID NO: 557670 - DNA, 20 bp, mouse
gttactccagataaaacgac

SEQ ID NO: 557671 - DNA, 20 bp, mouse
gtaatttgatcaactcacgg

SEQ ID NO: 557672 - DNA, 20 bp, mouse
gctccactactccgtccccg

SEQ ID NO: 557673 - DNA, 20 bp, mouse
gatttaatttgatcaactca

SEQ ID NO: 557674 - DNA, 20 bp, mouse
gcttctcctgtcgttttatc

SEQ ID NO: 557675 - DNA, 20 bp, mouse
ggtgatgccttctttgagag

SEQ ID NO: 557676 - DNA, 20 bp, mouse
gctttgcagaacaggcaggt

SEQ ID NO: 557677 - DNA, 20 bp, mouse
gtgcactggtgaggaatcat

SEQ ID NO: 557678 - DNA, 20 bp, mouse
ggccacaatccgctattcgg

SEQ ID NO: 557679 - DNA, 20 bp, mouse
gctcctccgccaccgaatag

SEQ ID NO: 557680 - DNA, 20 bp, mouse
gaatcatgggagctgcgcgc

SEQ ID NO: 557681 - DNA, 20 bp, mouse
gcaggaagcctttgcagaac

SEQ ID NO: 557682 - DNA, 20 bp, mouse
gtaatgtggctaaggaccta

SEQ ID NO: 557683 - DNA, 20 bp, mouse
gaagcctttgcagaacaggc

SEQ ID NO: 557684 - DNA, 20 bp, mouse
gggaaagcgtgagcccaagg

SEQ ID NO: 557685 - DNA, 20 bp, mouse
gttccagagagcaccccctt

SEQ ID NO: 557686 - DNA, 20 bp, mouse
gggtatttgagcgtgatcta

SEQ ID NO: 557687 - DNA, 20 bp, mouse
gctaggggagaaatctccgc

SEQ ID NO: 557688 - DNA, 20 bp, mouse
gtctactccctagaagaaga

SEQ ID NO: 557689 - DNA, 20 bp, mouse
gggagagctggctattaggg

SEQ ID NO: 557690 - DNA, 20 bp, mouse
gcgccctgcacagcacctca

SEQ ID NO: 557691 - DNA, 20 bp, mouse
gaagatctggggctccgagt

SEQ ID NO: 557692 - DNA, 20 bp, mouse
gtcaaataccttcttcttct

SEQ ID NO: 557693 - DNA, 20 bp, mouse
gatagaatatataattgcat

SEQ ID NO: 557694 - DNA, 20 bp, mouse
ggaccgtgaggtgctgtgca

SEQ ID NO: 557695 - DNA, 20 bp, mouse
gtttaatgtcttactgcccg

SEQ ID NO: 557696 - DNA, 20 bp, mouse
gttaagtcgagacagaacga

SEQ ID NO: 557697 - DNA, 20 bp, mouse
gagaagaaggtaataagtta

SEQ ID NO: 557698 - DNA, 20 bp, mouse
gtattggagtaaatccgact

SEQ ID NO: 557699 - DNA, 20 bp, mouse
gtgagtgtccgcggagatat

SEQ ID NO: 557700 - DNA, 20 bp, mouse
gcttaatgagatggcttcct

SEQ ID NO: 557701 - DNA, 20 bp, mouse
gttgtggaagtctggctctg

SEQ ID NO: 557702 - DNA, 20 bp, mouse
gctgtctcgacttaatgaga

SEQ ID NO: 557703 - DNA, 20 bp, mouse
gatttactccaatatctccg

SEQ ID NO: 557704 - DNA, 20 bp, mouse
gggcagctgcttgaagaaga

SEQ ID NO: 557705 - DNA, 20 bp, mouse
gatagaagaatctaagaaga

SEQ ID NO: 557706 - DNA, 20 bp, mouse
gtttggaggtggaagtaatt

SEQ ID NO: 557707 - DNA, 20 bp, mouse
gagaatttcggaagctttgg

SEQ ID NO: 557708 - DNA, 20 bp, mouse
gtattggagtaaatccaatt

SEQ ID NO: 557709 - DNA, 20 bp, mouse
gagggtttgtgtgatcattt

SEQ ID NO: 557710 - DNA, 20 bp, mouse
gtgagggtccgtgcaaatat

SEQ ID NO: 557711 - DNA, 20 bp, mouse
gagcagaatttcggaagctt

SEQ ID NO: 557712 - DNA, 20 bp, mouse
gggattgcaaccactcgtga

SEQ ID NO: 557713 - DNA, 20 bp, mouse
gttgcacggaccctcacgag

SEQ ID NO: 557714 - DNA, 20 bp, mouse
gaagaaggcgtctccctaat

SEQ ID NO: 557715 - DNA, 20 bp, mouse
gcagaaggtgctgcttcaag

SEQ ID NO: 557716 - DNA, 20 bp, mouse
gcccggtgactcctcttctc

SEQ ID NO: 557717 - DNA, 20 bp, mouse
gagatgctgaagcaaaaata

SEQ ID NO: 557718 - DNA, 20 bp, mouse
gattgtggaattgatcgtac

SEQ ID NO: 557719 - DNA, 20 bp, mouse
gctaggtgaaccggagtctg

SEQ ID NO: 557720 - DNA, 20 bp, mouse
gaattgatcgtacaggttcc

SEQ ID NO: 557721 - DNA, 20 bp, mouse
ggctgctcgggatgctagag

SEQ ID NO: 557722 - DNA, 20 bp, mouse
ggacagcacacaaggttctg

SEQ ID NO: 557723 - DNA, 20 bp, mouse
ggatgtcacacgcaaaaatg

SEQ ID NO: 557724 - DNA, 20 bp, mouse
gttcatcaccgaggtaactt

SEQ ID NO: 557725 - DNA, 20 bp, mouse
gcccaagtgcttagtcaggt

SEQ ID NO: 557726 - DNA, 20 bp, mouse
gcctctctgaaaggatcgat

SEQ ID NO: 557727 - DNA, 20 bp, mouse
ggcttatccacctctctgaa

SEQ ID NO: 557728 - DNA, 20 bp, mouse
gccacaaggcaccacagaaa

SEQ ID NO: 557729 - DNA, 20 bp, mouse
gtaagggagttgattaccag

SEQ ID NO: 557730 - DNA, 20 bp, mouse
gtctagaacggaatacgtga

SEQ ID NO: 557731 - DNA, 20 bp, mouse
ggtgaacagctcaggaatcc

SEQ ID NO: 557732 - DNA, 20 bp, mouse
gcgttctagaggagacagac

SEQ ID NO: 557733 - DNA, 20 bp, mouse
ggatttggggttgagtttaa

SEQ ID NO: 557734 - DNA, 20 bp, mouse
gtagtaacacctggaaatgt

SEQ ID NO: 557735 - DNA, 20 bp, mouse
gttttggagcagaggaacga

SEQ ID NO: 557736 - DNA, 20 bp, mouse
gcggtagcaagccctggaga

SEQ ID NO: 557737 - DNA, 20 bp, mouse
gagctagcggtagcaagccc

SEQ ID NO: 557738 - DNA, 20 bp, mouse
gggcacccctctcttctcac

SEQ ID NO: 557739 - DNA, 20 bp, mouse
ggcaattcctgtgagaagag

SEQ ID NO: 557740 - DNA, 20 bp, mouse
ggaacagcttcagtattctg

SEQ ID NO: 557741 - DNA, 20 bp, mouse
gagacttccgacaaagccat

SEQ ID NO: 557742 - DNA, 20 bp, mouse
gagagaggggtgccttctcc

SEQ ID NO: 557743 - DNA, 20 bp, mouse
ggctaggaaagtccctctct

SEQ ID NO: 557744 - DNA, 20 bp, mouse
gtggcagaggaaaccgagag

SEQ ID NO: 557745 - DNA, 20 bp, mouse
gttagcctcaagcagctccc

SEQ ID NO: 557746 - DNA, 20 bp, mouse
gagcccagagaagcccggac

SEQ ID NO: 557747 - DNA, 20 bp, mouse
gaggtctcagccctcggaaa

SEQ ID NO: 557748 - DNA, 20 bp, mouse
ggaactgaggcgctattctg

SEQ ID NO: 557749 - DNA, 20 bp, mouse
gaaggactgaaagaattctc

SEQ ID NO: 557750 - DNA, 20 bp, mouse
gcgttagagggaagcctaat

SEQ ID NO: 557751 - DNA, 20 bp, mouse
gtctttcagtccttttccga

SEQ ID NO: 557752 - DNA, 20 bp, mouse
gactggatgcttcagaaagg

SEQ ID NO: 557753 - DNA, 20 bp, mouse
gctctcccggagaggagcta

SEQ ID NO: 557754 - DNA, 20 bp, mouse
gaacgactgcaggggaactg

SEQ ID NO: 557755 - DNA, 20 bp, mouse
gctacagtaccagatactag

SEQ ID NO: 557756 - DNA, 20 bp, mouse
gtctttttcggccaaagcat

SEQ ID NO: 557757 - DNA, 20 bp, mouse
gtctcaccacctagaatcaa

SEQ ID NO: 557758 - DNA, 20 bp, mouse
gctgagacaaaggcaagtcc

SEQ ID NO: 557759 - DNA, 20 bp, mouse
gctgcatgtgtcaggggcag

SEQ ID NO: 557760 - DNA, 20 bp, mouse
gcacaccctttgattctagg

SEQ ID NO: 557761 - DNA, 20 bp, mouse
ggagaaactggccctgacaa

SEQ ID NO: 557762 - DNA, 20 bp, mouse
gttcacactcgcctatgctt

SEQ ID NO: 557763 - DNA, 20 bp, mouse
gaacgccgaggaaagagcca

SEQ ID NO: 557764 - DNA, 20 bp, mouse
gctgggcccctattccatag

SEQ ID NO: 557765 - DNA, 20 bp, mouse
ggttttgctgcatgtgtcag

SEQ ID NO: 557766 - DNA, 20 bp, mouse
gcagctaggtggaacatctg

SEQ ID NO: 557767 - DNA, 20 bp, mouse
gcctcagctttccccctcat

SEQ ID NO: 557768 - DNA, 20 bp, mouse
gaaaattctgaccgatgagg

SEQ ID NO: 557769 - DNA, 20 bp, mouse
ggaacctagcaaaggatcta

SEQ ID NO: 557770 - DNA, 20 bp, mouse
gatcatgtgtctccagacaa

SEQ ID NO: 557771 - DNA, 20 bp, mouse
gctagatccttccagctagg

SEQ ID NO: 557772 - DNA, 20 bp, mouse
gtatttctcttcctgctcgg

SEQ ID NO: 557773 - DNA, 20 bp, mouse
gaaggatctagggctagggg

SEQ ID NO: 557774 - DNA, 20 bp, mouse
gagcaaaattctgaccgatg

SEQ ID NO: 557775 - DNA, 20 bp, mouse
gcaaacacagacccccgagc

SEQ ID NO: 557776 - DNA, 20 bp, mouse
ggaggctgggagactttcag

SEQ ID NO: 557777 - DNA, 20 bp, mouse
ggattccgtggacaaatcaa

SEQ ID NO: 557778 - DNA, 20 bp, mouse
gcggaatcctcagaatccga

SEQ ID NO: 557779 - DNA, 20 bp, mouse
gtcagaatccgaaggacaaa

SEQ ID NO: 557780 - DNA, 20 bp, mouse
ggtgccccttgatttgtcca

SEQ ID NO: 557781 - DNA, 20 bp, mouse
gtttctacgtagcaccctcc

SEQ ID NO: 557782 - DNA, 20 bp, mouse
ggctgagtggggccttggta

SEQ ID NO: 557783 - DNA, 20 bp, mouse
gcctgtccagcggttcacta

SEQ ID NO: 557784 - DNA, 20 bp, mouse
ggccttctggaaagcaacta

SEQ ID NO: 557785 - DNA, 20 bp, mouse
gacagctcctccctgtccag

SEQ ID NO: 557786 - DNA, 20 bp, mouse
gggggagaggaaaccttcta

SEQ ID NO: 557787 - DNA, 20 bp, mouse
gccactaaagggaggcgttg

SEQ ID NO: 557788 - DNA, 20 bp, mouse
gccggaacgaatgccttaga

SEQ ID NO: 557789 - DNA, 20 bp, mouse
gccagaagccagaccactaa

SEQ ID NO: 557790 - DNA, 20 bp, mouse
gccccaggcccaagactttc

SEQ ID NO: 557791 - DNA, 20 bp, mouse
gtcaggctgggtccacaatt

SEQ ID NO: 557792 - DNA, 20 bp, mouse
gattcgttccggaaagtctt

SEQ ID NO: 557793 - DNA, 20 bp, mouse
gacaattaggcgctattccg

SEQ ID NO: 557794 - DNA, 20 bp, mouse
gattaggcgctattccgtgg

SEQ ID NO: 557795 - DNA, 20 bp, mouse
gaactacgtgaaccacgact

SEQ ID NO: 557796 - DNA, 20 bp, mouse
gggtattacaggagcttcac

SEQ ID NO: 557797 - DNA, 20 bp, mouse
gtcaccggcagagctgccaa

SEQ ID NO: 557798 - DNA, 20 bp, mouse
gtgtgggctccagtatctaa

SEQ ID NO: 557799 - DNA, 20 bp, mouse
gatgagaagagaggtattac

SEQ ID NO: 557800 - DNA, 20 bp, mouse
gagtcacctgaaggaaccat

SEQ ID NO: 557801 - DNA, 20 bp, mouse
gactcgcctgagacaatccc

SEQ ID NO: 557802 - DNA, 20 bp, mouse
gatttctattgaaagtccct

SEQ ID NO: 557803 - DNA, 20 bp, mouse
gatactggagcccacagggc

SEQ ID NO: 557804 - DNA, 20 bp, mouse
gactaccctggcctccctgg

SEQ ID NO: 557805 - DNA, 20 bp, mouse
gcatggaatcgtctgttctc

SEQ ID NO: 557806 - DNA, 20 bp, mouse
gcctttctggagggtcttgt

SEQ ID NO: 557807 - DNA, 20 bp, mouse
gcgggctttctacaaaggtg

SEQ ID NO: 557808 - DNA, 20 bp, mouse
ggcactcgggctttctacaa

SEQ ID NO: 557809 - DNA, 20 bp, mouse
gccatcggaagcaaaggcac

SEQ ID NO: 557810 - DNA, 20 bp, mouse
ggatttgcaatcctttctgg

SEQ ID NO: 557811 - DNA, 20 bp, mouse
gcaggtcgtggcaagaaccg

SEQ ID NO: 557812 - DNA, 20 bp, mouse
gttttaaccatcggaagcaa

SEQ ID NO: 557813 - DNA, 20 bp, mouse
gcactggataaaacagcact

SEQ ID NO: 557814 - DNA, 20 bp, mouse
gacagaatatctccaggtcg

SEQ ID NO: 557815 - DNA, 20 bp, mouse
gtgcggttagaactggagac

SEQ ID NO: 557816 - DNA, 20 bp, mouse
gatgctgctaatctacactt

SEQ ID NO: 557817 - DNA, 20 bp, mouse
gtgatggaggaaacacccag

SEQ ID NO: 557818 - DNA, 20 bp, mouse
ggcattctctggagtctcaa

SEQ ID NO: 557819 - DNA, 20 bp, mouse
ggtagattagcagcattctc

SEQ ID NO: 557820 - DNA, 20 bp, mouse
gttctgcacccagggtacaa

SEQ ID NO: 557821 - DNA, 20 bp, mouse
ggagcaggctattaactgac

SEQ ID NO: 557822 - DNA, 20 bp, mouse
gaagtgcttcttcagatccc

SEQ ID NO: 557823 - DNA, 20 bp, mouse
gtgacaggtcgaccactgtc

SEQ ID NO: 557824 - DNA, 20 bp, mouse
gaactcccagccctaggtcc

SEQ ID NO: 557825 - DNA, 20 bp, mouse
gcaaaggtctgagctctgcc

SEQ ID NO: 557826 - DNA, 20 bp, mouse
gccactgcttgtgtgaacct

SEQ ID NO: 557827 - DNA, 20 bp, mouse
gatgtctaggcgctattctg

SEQ ID NO: 557828 - DNA, 20 bp, mouse
gtgtgcttaaaaatctaccc

SEQ ID NO: 557829 - DNA, 20 bp, mouse
gctggaaaacattagttgtt

SEQ ID NO: 557830 - DNA, 20 bp, mouse
gttctgcggtgtatttccag

SEQ ID NO: 557831 - DNA, 20 bp, mouse
gatacaccgcagaaatacaa

SEQ ID NO: 557832 - DNA, 20 bp, mouse
gcaatttagcgacggatctg

SEQ ID NO: 557833 - DNA, 20 bp, mouse
gcaggggcttgtcaccaaga

SEQ ID NO: 557834 - DNA, 20 bp, mouse
gtctgggtgggtctcttgct

SEQ ID NO: 557835 - DNA, 20 bp, mouse
gcaccgcagaaatacaatgg

SEQ ID NO: 557836 - DNA, 20 bp, mouse
ggagaaggcacagctccaac

SEQ ID NO: 557837 - DNA, 20 bp, mouse
gttactcgctggcttcccgt

SEQ ID NO: 557838 - DNA, 20 bp, mouse
gaagaaggtagcattcactt

SEQ ID NO: 557839 - DNA, 20 bp, mouse
gtacaccactccctaaaaga

SEQ ID NO: 557840 - DNA, 20 bp, mouse
gagcattcactttggatcta

SEQ ID NO: 557841 - DNA, 20 bp, mouse
ggattcggtaatggcttcca

SEQ ID NO: 557842 - DNA, 20 bp, mouse
gctggatcccctgtgaacaa

SEQ ID NO: 557843 - DNA, 20 bp, mouse
gagtggtgtaagttctgatt

SEQ ID NO: 557844 - DNA, 20 bp, mouse
gagcaaaaatgtcacagcaa

SEQ ID NO: 557845 - DNA, 20 bp, mouse
gcgccccgcaaagcccctca

SEQ ID NO: 557846 - DNA, 20 bp, mouse
gcccggcccaaacccattca

SEQ ID NO: 557847 - DNA, 20 bp, mouse
gggaatacccgaccttgaat

SEQ ID NO: 557848 - DNA, 20 bp, mouse
gccaagacagagtaccgagt

SEQ ID NO: 557849 - DNA, 20 bp, mouse
ggcccaaacccattcaaggt

SEQ ID NO: 557850 - DNA, 20 bp, mouse
gatcaaaaacacacaagtac

SEQ ID NO: 557851 - DNA, 20 bp, mouse
gctgagggagaaactagaca

SEQ ID NO: 557852 - DNA, 20 bp, mouse
ggtaccgagtaggcaccatg

SEQ ID NO: 557853 - DNA, 20 bp, mouse
gttgttcacgtagtataccc

SEQ ID NO: 557854 - DNA, 20 bp, mouse
gcccgaccttgaatgggttt

SEQ ID NO: 557855 - DNA, 20 bp, mouse
gattctgtcttgcaacacaa

SEQ ID NO: 557856 - DNA, 20 bp, mouse
gaatgcttccccgaaaaggg

SEQ ID NO: 557857 - DNA, 20 bp, mouse
gggtatttacataagatccg

SEQ ID NO: 557858 - DNA, 20 bp, mouse
gttcaggagtcctttctccc

SEQ ID NO: 557859 - DNA, 20 bp, mouse
gatcccaggaatggcgtctt

SEQ ID NO: 557860 - DNA, 20 bp, mouse
ggggctcgaatccatcacag

SEQ ID NO: 557861 - DNA, 20 bp, mouse
ggtaaataccccccttttcg

SEQ ID NO: 557862 - DNA, 20 bp, mouse
ggctgaatgcttccccgaaa

SEQ ID NO: 557863 - DNA, 20 bp, mouse
gacataagatccggggagaa

SEQ ID NO: 557864 - DNA, 20 bp, mouse
ggagctcttgcagctagatg

SEQ ID NO: 557865 - DNA, 20 bp, mouse
gttggatcatagctcaacaa

SEQ ID NO: 557866 - DNA, 20 bp, mouse
ggacattacggagctatgaa

SEQ ID NO: 557867 - DNA, 20 bp, mouse
gaagagcttggcagacatta

SEQ ID NO: 557868 - DNA, 20 bp, mouse
gacggagctatgaaagggtt

SEQ ID NO: 557869 - DNA, 20 bp, mouse
gggtttggacaaagatatac

SEQ ID NO: 557870 - DNA, 20 bp, mouse
gaatactgaacaaaagacgc

SEQ ID NO: 557871 - DNA, 20 bp, mouse
gggagaaagctcacccaaaa

SEQ ID NO: 557872 - DNA, 20 bp, mouse
gagcactcaatgggacctca

SEQ ID NO: 557873 - DNA, 20 bp, mouse
gtgggacctcatggagaagc

SEQ ID NO: 557874 - DNA, 20 bp, mouse
gttggttgcaagcactcaat

SEQ ID NO: 557875 - DNA, 20 bp, mouse
gagatagagtattgagttgt

SEQ ID NO: 557876 - DNA, 20 bp, mouse
gcccttctgattcccaggaa

SEQ ID NO: 557877 - DNA, 20 bp, mouse
gttcccaggaatggcgtcct

SEQ ID NO: 557878 - DNA, 20 bp, mouse
gggggaactgaccactagag

SEQ ID NO: 557879 - DNA, 20 bp, mouse
gtgtctcccttctgattccc

SEQ ID NO: 557880 - DNA, 20 bp, mouse
gtggattcgtgcccctctag

SEQ ID NO: 557881 - DNA, 20 bp, mouse
gttgtttagaagttatccag

SEQ ID NO: 557882 - DNA, 20 bp, mouse
gtagaagaagcagagccccc

SEQ ID NO: 557883 - DNA, 20 bp, mouse
gtgcttcttctaaatcttgt

SEQ ID NO: 557884 - DNA, 20 bp, mouse
gcaaaagcaacaatatagca

SEQ ID NO: 557885 - DNA, 20 bp, mouse
ggacatttacttaagatatt

SEQ ID NO: 557886 - DNA, 20 bp, mouse
gagcactatggagctataga

SEQ ID NO: 557887 - DNA, 20 bp, mouse
gctgttgcaatacagaacaa

SEQ ID NO: 557888 - DNA, 20 bp, mouse
gtatggagctatagagggtt

SEQ ID NO: 557889 - DNA, 20 bp, mouse
gcacctaaacaggcaagtaa

SEQ ID NO: 557890 - DNA, 20 bp, mouse
ggtttggggcaagaatataa

SEQ ID NO: 557891 - DNA, 20 bp, mouse
gtatgagattatgagcaaca

SEQ ID NO: 557892 - DNA, 20 bp, mouse
gttggagactgctacaggat

SEQ ID NO: 557893 - DNA, 20 bp, mouse
ggtattgcaacagtgattcc

SEQ ID NO: 557894 - DNA, 20 bp, mouse
gccccagcttctccatgatg

SEQ ID NO: 557895 - DNA, 20 bp, mouse
gagcatgcatttcctcatca

SEQ ID NO: 557896 - DNA, 20 bp, mouse
gcagcgggcgaacaaatcag

SEQ ID NO: 557897 - DNA, 20 bp, mouse
gctgggcgccgagtccgaca

SEQ ID NO: 557898 - DNA, 20 bp, mouse
gcagaaagccatgtcggact

SEQ ID NO: 557899 - DNA, 20 bp, mouse
gtggcagagaaactttcagc

SEQ ID NO: 557900 - DNA, 20 bp, mouse
gtcgcagaggcccggagcag

SEQ ID NO: 557901 - DNA, 20 bp, mouse
gtaagcccctggagaacggt

SEQ ID NO: 557902 - DNA, 20 bp, mouse
gatggtggaagcctcggtta

SEQ ID NO: 557903 - DNA, 20 bp, mouse
gaggatctcatagtgaatga

SEQ ID NO: 557904 - DNA, 20 bp, mouse
gattcactatgagatcctgg

SEQ ID NO: 557905 - DNA, 20 bp, mouse
gctgctagctgccttaaccg

SEQ ID NO: 557906 - DNA, 20 bp, mouse
gaccagggctaggtccactc

SEQ ID NO: 557907 - DNA, 20 bp, mouse
gaacgccggaggagtcagaa

SEQ ID NO: 557908 - DNA, 20 bp, mouse
gtatcgtcctgccctcggcg

SEQ ID NO: 557909 - DNA, 20 bp, mouse
ggcccgagtggacctagccc

SEQ ID NO: 557910 - DNA, 20 bp, mouse
ggggtgcccaggttagctgt

SEQ ID NO: 557911 - DNA, 20 bp, mouse
gtgggagccatgagcatctg

SEQ ID NO: 557912 - DNA, 20 bp, mouse
gtgctgaagtcggaccacag

SEQ ID NO: 557913 - DNA, 20 bp, mouse
ggcgaggttggccgctgtgg

SEQ ID NO: 557914 - DNA, 20 bp, mouse
gtgggcacccgggctctgtg

SEQ ID NO: 557915 - DNA, 20 bp, mouse
gtctgaggcacagatgctgg

SEQ ID NO: 557916 - DNA, 20 bp, mouse
gaagccgcagcggctcggag

SEQ ID NO: 557917 - DNA, 20 bp, mouse
gggctcggagaggccgccga

SEQ ID NO: 557918 - DNA, 20 bp, mouse
gcagccgagcgagagagccg

SEQ ID NO: 557919 - DNA, 20 bp, mouse
gggcttcccagcgctgtgag

SEQ ID NO: 557920 - DNA, 20 bp, mouse
gccgagcgcaccgccgtcgg

SEQ ID NO: 557921 - DNA, 20 bp, mouse
ggagtggtcggctagaccga

SEQ ID NO: 557922 - DNA, 20 bp, mouse
gcggcgcggccgagctccgg

SEQ ID NO: 557923 - DNA, 20 bp, mouse
gggagccgcccagcccggta

SEQ ID NO: 557924 - DNA, 20 bp, mouse
gggcggcagcctctcaactt

SEQ ID NO: 557925 - DNA, 20 bp, mouse
ggagcgcgcggggcgcaaac

SEQ ID NO: 557926 - DNA, 20 bp, mouse
gctccacagacacaaaatgg

SEQ ID NO: 557927 - DNA, 20 bp, mouse
ggtggagaaagaagccccgg

SEQ ID NO: 557928 - DNA, 20 bp, mouse
gcgcagccgccggagacccg

SEQ ID NO: 557929 - DNA, 20 bp, mouse
gcgaggccgaggcgtcggaa

SEQ ID NO: 557930 - DNA, 20 bp, mouse
gccccggcggcggctggaag

SEQ ID NO: 557931 - DNA, 20 bp, mouse
gttcgcacgacgcagcggtt

SEQ ID NO: 557932 - DNA, 20 bp, mouse
gtcgctccccgggtctccgg

SEQ ID NO: 557933 - DNA, 20 bp, mouse
ggaaacgccgcagcctcacg

SEQ ID NO: 557934 - DNA, 20 bp, mouse
ggcggcggcggacctcggag

SEQ ID NO: 557935 - DNA, 20 bp, mouse
gcgagcggcttcagcttcgg

SEQ ID NO: 557936 - DNA, 20 bp, mouse
gtcgcaatctggcccccctg

SEQ ID NO: 557937 - DNA, 20 bp, mouse
gagatggcgtctcctcaggg

SEQ ID NO: 557938 - DNA, 20 bp, mouse
gtgaggagacgccatcttaa

SEQ ID NO: 557939 - DNA, 20 bp, mouse
gctgggatcagcctttaaga

SEQ ID NO: 557940 - DNA, 20 bp, mouse
gccgcaggcggtaccggaag

SEQ ID NO: 557941 - DNA, 20 bp, mouse
gggcccccgagaagagacgg

SEQ ID NO: 557942 - DNA, 20 bp, mouse
gcccaaacgaaggagaggac

SEQ ID NO: 557943 - DNA, 20 bp, mouse
gtcgggagaccagacgctgt

SEQ ID NO: 557944 - DNA, 20 bp, mouse
gcagagggctccgcgcacag

SEQ ID NO: 557945 - DNA, 20 bp, mouse
gactacggaacgaggtgcag

SEQ ID NO: 557946 - DNA, 20 bp, mouse
ggccgaccgagcgagcgaca

SEQ ID NO: 557947 - DNA, 20 bp, mouse
ggccctgtcgctcgctcggt

SEQ ID NO: 557948 - DNA, 20 bp, mouse
ggctcgctcggtcggcggga

SEQ ID NO: 557949 - DNA, 20 bp, mouse
gcgagcgagcgacagggctg

SEQ ID NO: 557950 - DNA, 20 bp, mouse
ggagaaacctatgataagaa

SEQ ID NO: 557951 - DNA, 20 bp, mouse
gaagctccccagctagggta

SEQ ID NO: 557952 - DNA, 20 bp, mouse
ggtgctcgggcggagaagaa

SEQ ID NO: 557953 - DNA, 20 bp, mouse
gcgcttacgaggtagcaagg

SEQ ID NO: 557954 - DNA, 20 bp, mouse
gctgctgcacaaagaggagg

SEQ ID NO: 557955 - DNA, 20 bp, mouse
gaccgggcgagcttggacag

SEQ ID NO: 557956 - DNA, 20 bp, mouse
gcagccgagtgcggagtcgg

SEQ ID NO: 557957 - DNA, 20 bp, mouse
gcctctgggtcccccccaag

SEQ ID NO: 557958 - DNA, 20 bp, mouse
ggcgcccccgactccgcact

SEQ ID NO: 557959 - DNA, 20 bp, mouse
gaggcccgcggcctgaggag

SEQ ID NO: 557960 - DNA, 20 bp, mouse
ggcgggcctcggcccatggg

SEQ ID NO: 557961 - DNA, 20 bp, mouse
gacccagccgagtgcggagt

SEQ ID NO: 557962 - DNA, 20 bp, mouse
gccttgaccaggctagaccg

SEQ ID NO: 557963 - DNA, 20 bp, mouse
ggtgggcagaatcctagacc

SEQ ID NO: 557964 - DNA, 20 bp, mouse
ggcgcgggccaggccaggcg

SEQ ID NO: 557965 - DNA, 20 bp, mouse
gactgcgcatgctccagccg

SEQ ID NO: 557966 - DNA, 20 bp, mouse
ggcgcgctcccgcctgctgg

SEQ ID NO: 557967 - DNA, 20 bp, mouse
gccagagccgagtggccccg

SEQ ID NO: 557968 - DNA, 20 bp, mouse
gctatcgcgccagagccgag

SEQ ID NO: 557969 - DNA, 20 bp, mouse
gagggcgcgggggaccagac

SEQ ID NO: 557970 - DNA, 20 bp, mouse
gccgcgcggtacctacccag

SEQ ID NO: 557971 - DNA, 20 bp, mouse
gaggccggtgccgcctccaa

SEQ ID NO: 557972 - DNA, 20 bp, mouse
gccggcgcggcaggtgtctg

SEQ ID NO: 557973 - DNA, 20 bp, mouse
ggagggcggacagggcgcgg

SEQ ID NO: 557974 - DNA, 20 bp, mouse
gtggagccggagccgctcgg

SEQ ID NO: 557975 - DNA, 20 bp, mouse
ggctctggcgcgatagggcg

SEQ ID NO: 557976 - DNA, 20 bp, mouse
gatggcggggatcagaaatc

SEQ ID NO: 557977 - DNA, 20 bp, mouse
ggggcgggcggagagatggg

SEQ ID NO: 557978 - DNA, 20 bp, mouse
ggccatggacgaggctgaga

SEQ ID NO: 557979 - DNA, 20 bp, mouse
gcgaggcaaggcgagtcgga

SEQ ID NO: 557980 - DNA, 20 bp, mouse
gtccgtctcagcctcgtcca

SEQ ID NO: 557981 - DNA, 20 bp, mouse
gctgcgtctggagtccggac

SEQ ID NO: 557982 - DNA, 20 bp, mouse
gctgatccccgccatggacg

SEQ ID NO: 557983 - DNA, 20 bp, mouse
gtgcgcactggtacgaaagg

SEQ ID NO: 557984 - DNA, 20 bp, mouse
gggccgagagcgagagcagc

SEQ ID NO: 557985 - DNA, 20 bp, mouse
ggcgagttgagagcgaggca

SEQ ID NO: 557986 - DNA, 20 bp, mouse
gaccagtacctacagcaggt

SEQ ID NO: 557987 - DNA, 20 bp, mouse
gacccacctgctgtaggtac

SEQ ID NO: 557988 - DNA, 20 bp, mouse
ggtgatgtgcgccatagcgg

SEQ ID NO: 557989 - DNA, 20 bp, mouse
ggtgaggcactcaacacccg

SEQ ID NO: 557990 - DNA, 20 bp, mouse
gggccgtgacgaggacaccc

SEQ ID NO: 557991 - DNA, 20 bp, mouse
gtgctgcccggtggaccagg

SEQ ID NO: 557992 - DNA, 20 bp, mouse
gggaggaggatccgaggtgg

SEQ ID NO: 557993 - DNA, 20 bp, mouse
gctggcctacgggccacgag

SEQ ID NO: 557994 - DNA, 20 bp, mouse
gtgcaaggggcagccagata

SEQ ID NO: 557995 - DNA, 20 bp, mouse
gaccccggcgaggacttgag

SEQ ID NO: 557996 - DNA, 20 bp, mouse
gggcccgggacacaagatgg

SEQ ID NO: 557997 - DNA, 20 bp, mouse
gcccggcccgggacacaaga

SEQ ID NO: 557998 - DNA, 20 bp, mouse
gggcggcgacgaaagagacc

SEQ ID NO: 557999 - DNA, 20 bp, mouse
gacccgcggctctaagatgg

SEQ ID NO: 558000 - DNA, 20 bp, mouse
gtgcccgaagcggactcgag

SEQ ID NO: 558001 - DNA, 20 bp, mouse
ggaggcggaggcggcaaaac

SEQ ID NO: 558002 - DNA, 20 bp, mouse
gagcagcgaagggaccctag

SEQ ID NO: 558003 - DNA, 20 bp, mouse
gcagtcctgctgcccacccg

SEQ ID NO: 558004 - DNA, 20 bp, mouse
gcccacccgcggctctaaga

SEQ ID NO: 558005 - DNA, 20 bp, mouse
gggcggtcgagcagaacgtg

SEQ ID NO: 558006 - DNA, 20 bp, mouse
gaccgagggtgtgttcccag

SEQ ID NO: 558007 - DNA, 20 bp, mouse
gccctctgggaacacaccct

SEQ ID NO: 558008 - DNA, 20 bp, mouse
gtcggtcaacaggggaaatc

SEQ ID NO: 558009 - DNA, 20 bp, mouse
gacacaccctcggtcaacag

SEQ ID NO: 558010 - DNA, 20 bp, mouse
ggcctccgggtccagctgag

SEQ ID NO: 558011 - DNA, 20 bp, mouse
gtctctgccaaggtcatcca

SEQ ID NO: 558012 - DNA, 20 bp, mouse
gcacagttggccttccctct

SEQ ID NO: 558013 - DNA, 20 bp, mouse
gcaacaggggaaatccggca

SEQ ID NO: 558014 - DNA, 20 bp, mouse
gggctcgcctctgacgtaag

SEQ ID NO: 558015 - DNA, 20 bp, mouse
gtggctccgaggaggagtac

SEQ ID NO: 558016 - DNA, 20 bp, mouse
ggagcgcagtcggggagaca

SEQ ID NO: 558017 - DNA, 20 bp, mouse
gacaggaacgagcgcagtcg

SEQ ID NO: 558018 - DNA, 20 bp, mouse
gagtgagccggcctacagaa

SEQ ID NO: 558019 - DNA, 20 bp, mouse
gcggggagacaaggaaggcg

SEQ ID NO: 558020 - DNA, 20 bp, mouse
ggcccaacctcaactccctc

SEQ ID NO: 558021 - DNA, 20 bp, mouse
gcactcaccgcaggccgggg

SEQ ID NO: 558022 - DNA, 20 bp, mouse
gatcagtgtgggtctcacgg

SEQ ID NO: 558023 - DNA, 20 bp, mouse
gaggaggcgggcagtccccg

SEQ ID NO: 558024 - DNA, 20 bp, mouse
gggcgctgcgggatggccac

SEQ ID NO: 558025 - DNA, 20 bp, mouse
gaggcgggcagtccccgggg

SEQ ID NO: 558026 - DNA, 20 bp, mouse
gtgaggtcctaagatggcgg

SEQ ID NO: 558027 - DNA, 20 bp, mouse
gcaatgaggtcctaagatgg

SEQ ID NO: 558028 - DNA, 20 bp, mouse
gccacaatgaggtcctaaga

SEQ ID NO: 558029 - DNA, 20 bp, mouse
gcgcgggccggagcacaggg

SEQ ID NO: 558030 - DNA, 20 bp, mouse
gactcggcccttggcaggag

SEQ ID NO: 558031 - DNA, 20 bp, mouse
ggggcgagcggtcctcacat

SEQ ID NO: 558032 - DNA, 20 bp, mouse
gcgactgcccaaagccccaa

SEQ ID NO: 558033 - DNA, 20 bp, mouse
gcctgccaagggccgagtgg

SEQ ID NO: 558034 - DNA, 20 bp, mouse
gtagttagctaatgtagaga

SEQ ID NO: 558035 - DNA, 20 bp, mouse
gcaccgcgggccggagcaca

SEQ ID NO: 558036 - DNA, 20 bp, mouse
gagcggggcggtgaccgtgt

SEQ ID NO: 558037 - DNA, 20 bp, mouse
ggctcgagcggggacaccag

SEQ ID NO: 558038 - DNA, 20 bp, mouse
gagcggggacaccagcgggg

SEQ ID NO: 558039 - DNA, 20 bp, mouse
ggagcgcgcattggcggcag

SEQ ID NO: 558040 - DNA, 20 bp, mouse
gtgccgggagcgcgcattgg

SEQ ID NO: 558041 - DNA, 20 bp, mouse
ggtaacagcggccgctcgag

SEQ ID NO: 558042 - DNA, 20 bp, mouse
ggagtgacaggtcccgggag

SEQ ID NO: 558043 - DNA, 20 bp, mouse
ggcggtgaccgtgtgggagg

SEQ ID NO: 558044 - DNA, 20 bp, mouse
ggctgctgcgggtgggacac

SEQ ID NO: 558045 - DNA, 20 bp, mouse
gggatgccgggagcgcgcat

SEQ ID NO: 558046 - DNA, 20 bp, mouse
gggccagtcggctgtctctg

SEQ ID NO: 558047 - DNA, 20 bp, mouse
gcaaagcagcggcggaccgg

SEQ ID NO: 558048 - DNA, 20 bp, mouse
ggacgctgtgccgggccagt

SEQ ID NO: 558049 - DNA, 20 bp, mouse
gggccaaagcagcggcggac

SEQ ID NO: 558050 - DNA, 20 bp, mouse
gcgccgcagagacagccgac

SEQ ID NO: 558051 - DNA, 20 bp, mouse
gcaggaggcggtggcgacta

SEQ ID NO: 558052 - DNA, 20 bp, mouse
gctccaggccaaagcagcgg

SEQ ID NO: 558053 - DNA, 20 bp, mouse
gcaccagccgggagaacgga

SEQ ID NO: 558054 - DNA, 20 bp, mouse
gacgcgcagctcccaggagg

SEQ ID NO: 558055 - DNA, 20 bp, mouse
gcgcggaccgcacttaccga

SEQ ID NO: 558056 - DNA, 20 bp, mouse
gtctccgagactcaatacgg

SEQ ID NO: 558057 - DNA, 20 bp, mouse
gtagcagcggatgtttacag

SEQ ID NO: 558058 - DNA, 20 bp, mouse
gcagcccccgtattgagtct

SEQ ID NO: 558059 - DNA, 20 bp, mouse
gtatggagggaagggccgag

SEQ ID NO: 558060 - DNA, 20 bp, mouse
gggcagagacggctctacct

SEQ ID NO: 558061 - DNA, 20 bp, mouse
gtgctctccgagactcaata

SEQ ID NO: 558062 - DNA, 20 bp, mouse
ggcacgcgcagaggtagcag

SEQ ID NO: 558063 - DNA, 20 bp, mouse
gacgcttctgtcgcttcgga

SEQ ID NO: 558064 - DNA, 20 bp, mouse
gaaggcagagtatcctacag

SEQ ID NO: 558065 - DNA, 20 bp, mouse
gtcagacgcttctgtcgctt

SEQ ID NO: 558066 - DNA, 20 bp, mouse
gaggaagccgcggcattaga

SEQ ID NO: 558067 - DNA, 20 bp, mouse
ggcgcgcgcctaggaagccg

SEQ ID NO: 558068 - DNA, 20 bp, mouse
ggtcacagccccgccaagag

SEQ ID NO: 558069 - DNA, 20 bp, mouse
gccgcaaccgtctaatgccg

SEQ ID NO: 558070 - DNA, 20 bp, mouse
gagcggaagcgggaagagtg

SEQ ID NO: 558071 - DNA, 20 bp, mouse
gatgacctcgcgcagggaaa

SEQ ID NO: 558072 - DNA, 20 bp, mouse
gagggaaaaggcgcgcgcct

SEQ ID NO: 558073 - DNA, 20 bp, mouse
gggtgggtggatcagcgctg

SEQ ID NO: 558074 - DNA, 20 bp, mouse
gcatgggcgtgaacctcacc

SEQ ID NO: 558075 - DNA, 20 bp, mouse
ggccccgccaagagcggaag

SEQ ID NO: 558076 - DNA, 20 bp, mouse
gcaagtgaccaagacggttg

SEQ ID NO: 558077 - DNA, 20 bp, mouse
gtctgcgcccgcaaccgtct

SEQ ID NO: 558078 - DNA, 20 bp, mouse
gctgaaactttctcttgatt

SEQ ID NO: 558079 - DNA, 20 bp, mouse
gaattttggacatgctggtg

SEQ ID NO: 558080 - DNA, 20 bp, mouse
gaaagatcaagtgaccaaga

SEQ ID NO: 558081 - DNA, 20 bp, mouse
ggaagacatcattacattaa

SEQ ID NO: 558082 - DNA, 20 bp, mouse
ggcttcgaatactagtgcta

SEQ ID NO: 558083 - DNA, 20 bp, mouse
gaagttaatggacttagatg

SEQ ID NO: 558084 - DNA, 20 bp, mouse
gacttagatgtggagcaact

SEQ ID NO: 558085 - DNA, 20 bp, mouse
ggactatgaaatgaagttaa

SEQ ID NO: 558086 - DNA, 20 bp, mouse
gagcccgggcaagaacgtca

SEQ ID NO: 558087 - DNA, 20 bp, mouse
ggcgtgcccggcactcatca

SEQ ID NO: 558088 - DNA, 20 bp, mouse
gggccgtgacgttcttgccc

SEQ ID NO: 558089 - DNA, 20 bp, mouse
gctcatcagggcccagcccc

SEQ ID NO: 558090 - DNA, 20 bp, mouse
gccagcgtcgcgggctacgg

SEQ ID NO: 558091 - DNA, 20 bp, mouse
ggttcccagggcgggttggg

SEQ ID NO: 558092 - DNA, 20 bp, mouse
gaccggcggcctctctgatt

SEQ ID NO: 558093 - DNA, 20 bp, mouse
ggggttgtgttcacctccgg

SEQ ID NO: 558094 - DNA, 20 bp, mouse
gctggcgctcgcccggccag

SEQ ID NO: 558095 - DNA, 20 bp, mouse
gctgggccctgatgagtgcc

SEQ ID NO: 558096 - DNA, 20 bp, mouse
ggccacacggggctccggat

SEQ ID NO: 558097 - DNA, 20 bp, mouse
ggcgtgcgcaaggccacacg

SEQ ID NO: 558098 - DNA, 20 bp, mouse
ggccaatccggagccccgtg

SEQ ID NO: 558099 - DNA, 20 bp, mouse
ggagtcgctcggaggtgaca

SEQ ID NO: 558100 - DNA, 20 bp, mouse
gcaggagcagcggcgcagga

SEQ ID NO: 558101 - DNA, 20 bp, mouse
gtcgctcggaggtgacaggg

SEQ ID NO: 558102 - DNA, 20 bp, mouse
gcaagcggcggtctgagcac

SEQ ID NO: 558103 - DNA, 20 bp, mouse
gcgctccgctgacgctccaa

SEQ ID NO: 558104 - DNA, 20 bp, mouse
gtccgcccttggagcgtcag

SEQ ID NO: 558105 - DNA, 20 bp, mouse
gtccgctgacgctccaaggg

SEQ ID NO: 558106 - DNA, 20 bp, mouse
ggcgggcgcccggcaggacg

SEQ ID NO: 558107 - DNA, 20 bp, mouse
gcccggcggagcaggcgagc

SEQ ID NO: 558108 - DNA, 20 bp, mouse
gccggccgccagcctcggcc

SEQ ID NO: 558109 - DNA, 20 bp, mouse
gctggtgctgctgcacgagg

SEQ ID NO: 558110 - DNA, 20 bp, mouse
gtccgccgggccgaggctgg

SEQ ID NO: 558111 - DNA, 20 bp, mouse
ggcagacgctgcagatcctc

SEQ ID NO: 558112 - DNA, 20 bp, mouse
gcgagcggcagggcggagag

SEQ ID NO: 558113 - DNA, 20 bp, mouse
ggaggaagccgcgccccctc

SEQ ID NO: 558114 - DNA, 20 bp, mouse
ggcggcagcgctggcggact

SEQ ID NO: 558115 - DNA, 20 bp, mouse
gcccgcggagcggtccccac

SEQ ID NO: 558116 - DNA, 20 bp, mouse
gaggtgcgcgccatgtccaa

SEQ ID NO: 558117 - DNA, 20 bp, mouse
gcggtagacgctgaacagta

SEQ ID NO: 558118 - DNA, 20 bp, mouse
ggacatggcgcgcacctgcc

SEQ ID NO: 558119 - DNA, 20 bp, mouse
ggcgcgccatgtccaaggga

SEQ ID NO: 558120 - DNA, 20 bp, mouse
ggccgccaccgcccaaaccg

SEQ ID NO: 558121 - DNA, 20 bp, mouse
gagtacggaccggcacagcg

SEQ ID NO: 558122 - DNA, 20 bp, mouse
gacgccatgcccgcagagtc

SEQ ID NO: 558123 - DNA, 20 bp, mouse
gcgccatgtccaagggaagg

SEQ ID NO: 558124 - DNA, 20 bp, mouse
ggccgacgtactgagctcca

SEQ ID NO: 558125 - DNA, 20 bp, mouse
gcgcggtgctggagccggct

SEQ ID NO: 558126 - DNA, 20 bp, mouse
gcggtgccggcgcaaagggg

SEQ ID NO: 558127 - DNA, 20 bp, mouse
ggagccaagggacctatcac

SEQ ID NO: 558128 - DNA, 20 bp, mouse
gtaccggtgccggcgcaaag

SEQ ID NO: 558129 - DNA, 20 bp, mouse
gacggtctcgcactaaggag

SEQ ID NO: 558130 - DNA, 20 bp, mouse
gagtgcaggctggcagctcg

SEQ ID NO: 558131 - DNA, 20 bp, mouse
ggagaggcggcccaagtcgg

SEQ ID NO: 558132 - DNA, 20 bp, mouse
ggtcggcggcatccagaggt

SEQ ID NO: 558133 - DNA, 20 bp, mouse
gcaaaggggaggccggaaga

SEQ ID NO: 558134 - DNA, 20 bp, mouse
gagggctgggcacccgtcgg

SEQ ID NO: 558135 - DNA, 20 bp, mouse
gaccctgaggtccacttccg

SEQ ID NO: 558136 - DNA, 20 bp, mouse
gcccgccagcagctgaccgg

SEQ ID NO: 558137 - DNA, 20 bp, mouse
ggtgcgcactgacccctggg

SEQ ID NO: 558138 - DNA, 20 bp, mouse
gtacccaggggtggaaacta

SEQ ID NO: 558139 - DNA, 20 bp, mouse
gttagccatgggaacgggag

SEQ ID NO: 558140 - DNA, 20 bp, mouse
gggaacccagtagtacccag

SEQ ID NO: 558141 - DNA, 20 bp, mouse
gcagctgaccggaggcctcc

SEQ ID NO: 558142 - DNA, 20 bp, mouse
gggaacgggagcggtcctgg

SEQ ID NO: 558143 - DNA, 20 bp, mouse
gatgggaacgggagcggtcc

SEQ ID NO: 558144 - DNA, 20 bp, mouse
gtcctgcccgaggatggatg

SEQ ID NO: 558145 - DNA, 20 bp, mouse
gctgcgctcgtgcctcccag

SEQ ID NO: 558146 - DNA, 20 bp, mouse
gagcaggcagcattgtgtag

SEQ ID NO: 558147 - DNA, 20 bp, mouse
gcagcagcagcaggataatc

SEQ ID NO: 558148 - DNA, 20 bp, mouse
gccccacgcccacacacccg

SEQ ID NO: 558149 - DNA, 20 bp, mouse
gaagagcttgcaagacccac

SEQ ID NO: 558150 - DNA, 20 bp, mouse
gatgcttgtgagtcctggga

SEQ ID NO: 558151 - DNA, 20 bp, mouse
gtggccccagaaaggaggtt

SEQ ID NO: 558152 - DNA, 20 bp, mouse
gcagctaacagacaaggtca

SEQ ID NO: 558153 - DNA, 20 bp, mouse
ggcacccaggccaaaaggaa

SEQ ID NO: 558154 - DNA, 20 bp, mouse
gtctttcagatggcttccac

SEQ ID NO: 558155 - DNA, 20 bp, mouse
gcacccggggctgcttcatc

SEQ ID NO: 558156 - DNA, 20 bp, mouse
gagtgagctgccggccatgg

SEQ ID NO: 558157 - DNA, 20 bp, mouse
gcaggcgctcgcgcccccca

SEQ ID NO: 558158 - DNA, 20 bp, mouse
gtggtggcccgggagccgta

SEQ ID NO: 558159 - DNA, 20 bp, mouse
gccgcggcgcactctgtacc

SEQ ID NO: 558160 - DNA, 20 bp, mouse
ggtagggccagcgctcgggg

SEQ ID NO: 558161 - DNA, 20 bp, mouse
gctcactgcagcatcccgcc

SEQ ID NO: 558162 - DNA, 20 bp, mouse
gagcaggcagagcgggatgc

SEQ ID NO: 558163 - DNA, 20 bp, mouse
gccggccgcagacgccagag

SEQ ID NO: 558164 - DNA, 20 bp, mouse
gggagcaccgcagtccgcgg

SEQ ID NO: 558165 - DNA, 20 bp, mouse
gggcgagccgcgccacgtgg

SEQ ID NO: 558166 - DNA, 20 bp, mouse
gagtaggtactaggatttag

SEQ ID NO: 558167 - DNA, 20 bp, mouse
gctgtcccccaagagatagt

SEQ ID NO: 558168 - DNA, 20 bp, mouse
gtgcagacccgtgaggacta

SEQ ID NO: 558169 - DNA, 20 bp, mouse
gctctcaccatagtcctcac

SEQ ID NO: 558170 - DNA, 20 bp, mouse
gagtacctactatctcttgg

SEQ ID NO: 558171 - DNA, 20 bp, mouse
gcctcctcagggcaaatgaa

SEQ ID NO: 558172 - DNA, 20 bp, mouse
gcctagtacctactatctct

SEQ ID NO: 558173 - DNA, 20 bp, mouse
gggacacttaccagggaaat

SEQ ID NO: 558174 - DNA, 20 bp, mouse
gccaagcctggtctcaatct

SEQ ID NO: 558175 - DNA, 20 bp, mouse
gggatgctgtctggaagaca

SEQ ID NO: 558176 - DNA, 20 bp, mouse
gctcagaaggcaatgctcag

SEQ ID NO: 558177 - DNA, 20 bp, mouse
ggttctgtgggacctagctg

SEQ ID NO: 558178 - DNA, 20 bp, mouse
gagaaggcaatgctcagggg

SEQ ID NO: 558179 - DNA, 20 bp, mouse
gagtcaggccaacatgagtg

SEQ ID NO: 558180 - DNA, 20 bp, mouse
gtcccacagaacagctcaga

SEQ ID NO: 558181 - DNA, 20 bp, mouse
gttgctcacctcactcatgt

SEQ ID NO: 558182 - DNA, 20 bp, mouse
gttggcctgactccgcagct

SEQ ID NO: 558183 - DNA, 20 bp, mouse
gcacgtgaggacgcactccc

SEQ ID NO: 558184 - DNA, 20 bp, mouse
ggcagagccttctcactctg

SEQ ID NO: 558185 - DNA, 20 bp, mouse
gacccaaaaggtgcccagtg

SEQ ID NO: 558186 - DNA, 20 bp, mouse
gccggctgcagcgctgctca

SEQ ID NO: 558187 - DNA, 20 bp, mouse
ggctgcagccggagcatttg

SEQ ID NO: 558188 - DNA, 20 bp, mouse
gggccctggagggctcggag

SEQ ID NO: 558189 - DNA, 20 bp, mouse
gcagggagccccttctgacc

SEQ ID NO: 558190 - DNA, 20 bp, mouse
gtaaaaggtggagccggtca

SEQ ID NO: 558191 - DNA, 20 bp, mouse
gcagctccgggcgccttgac

SEQ ID NO: 558192 - DNA, 20 bp, mouse
gaagcgggaactgagctctc

SEQ ID NO: 558193 - DNA, 20 bp, mouse
gctgacaggaccaggtcaga

SEQ ID NO: 558194 - DNA, 20 bp, mouse
gggcgtggcaggcgcaggtg

SEQ ID NO: 558195 - DNA, 20 bp, mouse
gccggccgccgggatgagcg

SEQ ID NO: 558196 - DNA, 20 bp, mouse
ggctagaggctcactgggag

SEQ ID NO: 558197 - DNA, 20 bp, mouse
gactagagctagaggctcac

SEQ ID NO: 558198 - DNA, 20 bp, mouse
ggttgctctactagagctag

SEQ ID NO: 558199 - DNA, 20 bp, mouse
gggcggcggagatccccgga

SEQ ID NO: 558200 - DNA, 20 bp, mouse
gtgccatcgccgaagaactg

SEQ ID NO: 558201 - DNA, 20 bp, mouse
ggggcttaaggactctggta

SEQ ID NO: 558202 - DNA, 20 bp, mouse
gagccatggagcaaagaggt

SEQ ID NO: 558203 - DNA, 20 bp, mouse
gaatgggcggcggagatccc

SEQ ID NO: 558204 - DNA, 20 bp, mouse
ggttctcacacaagtaggaa

SEQ ID NO: 558205 - DNA, 20 bp, mouse
gtttaagctgctgggtggaa

SEQ ID NO: 558206 - DNA, 20 bp, mouse
gaacgagccgggctccggac

SEQ ID NO: 558207 - DNA, 20 bp, mouse
gcccgcggcccgcagagcag

SEQ ID NO: 558208 - DNA, 20 bp, mouse
ggagccgggctccggacggg

SEQ ID NO: 558209 - DNA, 20 bp, mouse
ggtgcgcagcgatgggtatt

SEQ ID NO: 558210 - DNA, 20 bp, mouse
gctgtcagcgaggcccgtga

SEQ ID NO: 558211 - DNA, 20 bp, mouse
gagtattgtagggcattcag

SEQ ID NO: 558212 - DNA, 20 bp, mouse
gctgtcaagtgcgcagcgat

SEQ ID NO: 558213 - DNA, 20 bp, mouse
gacagccccgcgcaggccag

SEQ ID NO: 558214 - DNA, 20 bp, mouse
ggtgcgacctcagtcagcag

SEQ ID NO: 558215 - DNA, 20 bp, mouse
ggcacagcagcagcgctctg

SEQ ID NO: 558216 - DNA, 20 bp, mouse
gctggctgccagggaagccg

SEQ ID NO: 558217 - DNA, 20 bp, mouse
ggccgggctgcgcgactccc

SEQ ID NO: 558218 - DNA, 20 bp, mouse
ggtcgcgcagcccggctggc

SEQ ID NO: 558219 - DNA, 20 bp, mouse
gtctagaattggagccgagg

SEQ ID NO: 558220 - DNA, 20 bp, mouse
ggagttgcataaagacggag

SEQ ID NO: 558221 - DNA, 20 bp, mouse
ggccaagttgcagcagaaca

SEQ ID NO: 558222 - DNA, 20 bp, mouse
gccctctagaattggagccg

SEQ ID NO: 558223 - DNA, 20 bp, mouse
gggtggagcaggggacgaag

SEQ ID NO: 558224 - DNA, 20 bp, mouse
gttcgtgaagacgggtctct

SEQ ID NO: 558225 - DNA, 20 bp, mouse
gggttgtggatcccagtgga

SEQ ID NO: 558226 - DNA, 20 bp, mouse
gggaatgcgacggacaacag

SEQ ID NO: 558227 - DNA, 20 bp, mouse
gtgggagggccgcatagcgg

SEQ ID NO: 558228 - DNA, 20 bp, mouse
ggccctcctggctgtgaggt

SEQ ID NO: 558229 - DNA, 20 bp, mouse
gcagatctggacaaatggga

SEQ ID NO: 558230 - DNA, 20 bp, mouse
gtggtcgtcagggaagatct

SEQ ID NO: 558231 - DNA, 20 bp, mouse
gctgggtctgactttgactt

SEQ ID NO: 558232 - DNA, 20 bp, mouse
ggtcgtggagatcctatcaa

SEQ ID NO: 558233 - DNA, 20 bp, mouse
ggacaggtgggtgggacgtg

SEQ ID NO: 558234 - DNA, 20 bp, mouse
ggtctgggagggccgcatag

SEQ ID NO: 558235 - DNA, 20 bp, mouse
gggactgctgggccacaccc

SEQ ID NO: 558236 - DNA, 20 bp, mouse
gccggagggagcgcagcgag

SEQ ID NO: 558237 - DNA, 20 bp, mouse
gagcgcgccgggactgtgag

SEQ ID NO: 558238 - DNA, 20 bp, mouse
gaagccgggagagcccgcgg

SEQ ID NO: 558239 - DNA, 20 bp, mouse
ggagccgggttcagcagagg

SEQ ID NO: 558240 - DNA, 20 bp, mouse
ggcgcgcagccgggagcggt

SEQ ID NO: 558241 - DNA, 20 bp, mouse
gccgtcgccactcacagtcc

SEQ ID NO: 558242 - DNA, 20 bp, mouse
ggcagccgggagcggtcggt

SEQ ID NO: 558243 - DNA, 20 bp, mouse
gcgcgctgctcggagccgga

SEQ ID NO: 558244 - DNA, 20 bp, mouse
gcggcttgcacgggaggcgg

SEQ ID NO: 558245 - DNA, 20 bp, mouse
gccggccggagcgcaagcag

SEQ ID NO: 558246 - DNA, 20 bp, mouse
ggcgcgcggaggcatggcag

SEQ ID NO: 558247 - DNA, 20 bp, mouse
gggctcgcgcggcgcccgag

SEQ ID NO: 558248 - DNA, 20 bp, mouse
ggcgccccgcgcgacatcgg

SEQ ID NO: 558249 - DNA, 20 bp, mouse
gcagcacttgcactgcccag

SEQ ID NO: 558250 - DNA, 20 bp, mouse
gccagtggttggtgtagacg

SEQ ID NO: 558251 - DNA, 20 bp, mouse
gcccggcgcactcgccgctc

SEQ ID NO: 558252 - DNA, 20 bp, mouse
ggcgcgacatcggcggcccg

SEQ ID NO: 558253 - DNA, 20 bp, mouse
gtcggcgggaaggacgtggt

SEQ ID NO: 558254 - DNA, 20 bp, mouse
gcgcacggctacctcaactt

SEQ ID NO: 558255 - DNA, 20 bp, mouse
gggcagcgcggagcaggcgg

SEQ ID NO: 558256 - DNA, 20 bp, mouse
ggcagcgacagtagcaacag

SEQ ID NO: 558257 - DNA, 20 bp, mouse
gggaagccgagagtttccgt

SEQ ID NO: 558258 - DNA, 20 bp, mouse
gtgagtccgcgtgggagtgg

SEQ ID NO: 558259 - DNA, 20 bp, mouse
ggagagtttccgtagggtgg

SEQ ID NO: 558260 - DNA, 20 bp, mouse
gatcggtcctaaggagagag

SEQ ID NO: 558261 - DNA, 20 bp, mouse
gggagcagctgagtccgcgt

SEQ ID NO: 558262 - DNA, 20 bp, mouse
gcggagacccggtccctctg

SEQ ID NO: 558263 - DNA, 20 bp, mouse
ggcggacagcgaccggacaa

SEQ ID NO: 558264 - DNA, 20 bp, mouse
gggacaacggagccgctgag

SEQ ID NO: 558265 - DNA, 20 bp, mouse
gtggcgtgggcgaccccaga

SEQ ID NO: 558266 - DNA, 20 bp, mouse
gagagagaacgggagcccac

SEQ ID NO: 558267 - DNA, 20 bp, mouse
gggacgcgcaggctgccggt

SEQ ID NO: 558268 - DNA, 20 bp, mouse
ggagcagtgggtgcccatcg

SEQ ID NO: 558269 - DNA, 20 bp, mouse
gctgcgcgtccacgtgaagg

SEQ ID NO: 558270 - DNA, 20 bp, mouse
ggaaggcttccaccttcacg

SEQ ID NO: 558271 - DNA, 20 bp, mouse
gccgcagccacgcagagcag

SEQ ID NO: 558272 - DNA, 20 bp, mouse
gtgcccatcggggcgaggag

SEQ ID NO: 558273 - DNA, 20 bp, mouse
gcagagaggatcttccgatg

SEQ ID NO: 558274 - DNA, 20 bp, mouse
gctggtgcccaggacgagga

SEQ ID NO: 558275 - DNA, 20 bp, mouse
gtcagccaggccatcctcct

SEQ ID NO: 558276 - DNA, 20 bp, mouse
gcctggctgcggaaggatgg

SEQ ID NO: 558277 - DNA, 20 bp, mouse
gtcggacgagcagttccggg

SEQ ID NO: 558278 - DNA, 20 bp, mouse
gcgctccgggcgctgtatcc

SEQ ID NO: 558279 - DNA, 20 bp, mouse
gtggcccttagagagatcgg

SEQ ID NO: 558280 - DNA, 20 bp, mouse
gtatcctggctgcggaagga

SEQ ID NO: 558281 - DNA, 20 bp, mouse
gcagagcagtggagtaccct

SEQ ID NO: 558282 - DNA, 20 bp, mouse
gtcgtccgagaagcagcatg

SEQ ID NO: 558283 - DNA, 20 bp, mouse
gggctgcggaaggatggcgg

SEQ ID NO: 558284 - DNA, 20 bp, mouse
gcggagcgcaggtcactcac

SEQ ID NO: 558285 - DNA, 20 bp, mouse
gggggccgcatgctgcttct

SEQ ID NO: 558286 - DNA, 20 bp, mouse
gcggcggccacggctagagg

SEQ ID NO: 558287 - DNA, 20 bp, mouse
gtggaggcaggggccgtcag

SEQ ID NO: 558288 - DNA, 20 bp, mouse
gaggcaggggccgtcagagg

SEQ ID NO: 558289 - DNA, 20 bp, mouse
ggccacggctagaggcggca

SEQ ID NO: 558290 - DNA, 20 bp, mouse
gaggcggcggccacggctag

SEQ ID NO: 558291 - DNA, 20 bp, mouse
ggctagaggcggcagggcgg

SEQ ID NO: 558292 - DNA, 20 bp, mouse
gcaggggccgtcagaggcgg

SEQ ID NO: 558293 - DNA, 20 bp, mouse
gacttgcaccaggaagagta

SEQ ID NO: 558294 - DNA, 20 bp, mouse
gagctgttccctgtcagtgg

SEQ ID NO: 558295 - DNA, 20 bp, mouse
ggccctgccgcctctagccg

SEQ ID NO: 558296 - DNA, 20 bp, mouse
ggcttcgccgctgcattggt

SEQ ID NO: 558297 - DNA, 20 bp, mouse
gagtgagcccaccaatgcag

SEQ ID NO: 558298 - DNA, 20 bp, mouse
ggcagcggcgaagcgcccca

SEQ ID NO: 558299 - DNA, 20 bp, mouse
ggccctgggaagaccgacct

SEQ ID NO: 558300 - DNA, 20 bp, mouse
gtgcagctgcgggaggccat

SEQ ID NO: 558301 - DNA, 20 bp, mouse
ggtaggtgcgggggatacag

SEQ ID NO: 558302 - DNA, 20 bp, mouse
ggcagctgcagactgaccgc

SEQ ID NO: 558303 - DNA, 20 bp, mouse
gtctggaggagtgccactgg

SEQ ID NO: 558304 - DNA, 20 bp, mouse
gtagctccagggacagctag

SEQ ID NO: 558305 - DNA, 20 bp, mouse
gatagagcagggtctgctgg

SEQ ID NO: 558306 - DNA, 20 bp, mouse
ggccagcacggcgagcagcg

SEQ ID NO: 558307 - DNA, 20 bp, mouse
gcaaccgctagaggccgatc

SEQ ID NO: 558308 - DNA, 20 bp, mouse
ggacgaactgggtgtaggag

SEQ ID NO: 558309 - DNA, 20 bp, mouse
gtactgggcacagaagaaga

SEQ ID NO: 558310 - DNA, 20 bp, mouse
gggagaggctaggggctact

SEQ ID NO: 558311 - DNA, 20 bp, mouse
gcgggcagcacgctccggat

SEQ ID NO: 558312 - DNA, 20 bp, mouse
gccggagacgaactgggtgt

SEQ ID NO: 558313 - DNA, 20 bp, mouse
ggtcgagcgccaaccgctag

SEQ ID NO: 558314 - DNA, 20 bp, mouse
ggctgctccggagacgaact

SEQ ID NO: 558315 - DNA, 20 bp, mouse
gagggttcgcagctgaccgg

SEQ ID NO: 558316 - DNA, 20 bp, mouse
gagtgggccagtgacagcta

SEQ ID NO: 558317 - DNA, 20 bp, mouse
ggcgcggggaagggatccga

SEQ ID NO: 558318 - DNA, 20 bp, mouse
ggcctggaggagttgaggta

SEQ ID NO: 558319 - DNA, 20 bp, mouse
gacttcgctagtcggtgacg

SEQ ID NO: 558320 - DNA, 20 bp, mouse
gtccaggctccggtccccct

SEQ ID NO: 558321 - DNA, 20 bp, mouse
ggtccggtcagatgtttccc

SEQ ID NO: 558322 - DNA, 20 bp, mouse
gccctgggtcacagtcctct

SEQ ID NO: 558323 - DNA, 20 bp, mouse
gccgactagcgaagtcaaat

SEQ ID NO: 558324 - DNA, 20 bp, mouse
gcgcccgggaaacatctgac

SEQ ID NO: 558325 - DNA, 20 bp, mouse
gctcggagagcacgaggcag

SEQ ID NO: 558326 - DNA, 20 bp, mouse
gctttctcggagaagcccag

SEQ ID NO: 558327 - DNA, 20 bp, mouse
ggcttctccgagaaagaaaa

SEQ ID NO: 558328 - DNA, 20 bp, mouse
gaaactgaggccctgcctct

SEQ ID NO: 558329 - DNA, 20 bp, mouse
gcagcatcagtggtaagtac

SEQ ID NO: 558330 - DNA, 20 bp, mouse
gcagagggtgtagagctgga

SEQ ID NO: 558331 - DNA, 20 bp, mouse
gagctggagggagcattcac

SEQ ID NO: 558332 - DNA, 20 bp, mouse
gttgttatagtgataaactg

SEQ ID NO: 558333 - DNA, 20 bp, mouse
gctcccagagggtgtagagc

SEQ ID NO: 558334 - DNA, 20 bp, mouse
gagcacgggagcgtctggtg

SEQ ID NO: 558335 - DNA, 20 bp, mouse
ggtttctgactcagcatcag

SEQ ID NO: 558336 - DNA, 20 bp, mouse
gggccccccgcaaatcctgg

SEQ ID NO: 558337 - DNA, 20 bp, mouse
gggaggccccccgcaaatcc

SEQ ID NO: 558338 - DNA, 20 bp, mouse
gcggtgccatgatccggaac

SEQ ID NO: 558339 - DNA, 20 bp, mouse
gggcctccggtgccatgatc

SEQ ID NO: 558340 - DNA, 20 bp, mouse
ggagccgccaggatttgcgg

SEQ ID NO: 558341 - DNA, 20 bp, mouse
ggtgcggcctcggaagactc

SEQ ID NO: 558342 - DNA, 20 bp, mouse
gccgtgcccgttccggatca

SEQ ID NO: 558343 - DNA, 20 bp, mouse
ggagcacgcgcaagcgtcga

SEQ ID NO: 558344 - DNA, 20 bp, mouse
gcgcgcaagcgtcgagggcg

SEQ ID NO: 558345 - DNA, 20 bp, mouse
ggagtgtagcgtacagacac

SEQ ID NO: 558346 - DNA, 20 bp, mouse
ggagccgagatgcctaaagg

SEQ ID NO: 558347 - DNA, 20 bp, mouse
gccggagccgagatgcctaa

SEQ ID NO: 558348 - DNA, 20 bp, mouse
gcggcgcctcgaactgacac

SEQ ID NO: 558349 - DNA, 20 bp, mouse
gatgcctaaaggaggtgagg

SEQ ID NO: 558350 - DNA, 20 bp, mouse
ggagatgcctaaaggaggtg

SEQ ID NO: 558351 - DNA, 20 bp, mouse
gcggttccggtgtcagttcg

SEQ ID NO: 558352 - DNA, 20 bp, mouse
ggagaggccctcaaccactg

SEQ ID NO: 558353 - DNA, 20 bp, mouse
gaggcccacgcatggctggg

SEQ ID NO: 558354 - DNA, 20 bp, mouse
gtcgcctcccagccatgcgt

SEQ ID NO: 558355 - DNA, 20 bp, mouse
ggtccgcggcagcccgccta

SEQ ID NO: 558356 - DNA, 20 bp, mouse
ggtgttctagaatatgtcca

SEQ ID NO: 558357 - DNA, 20 bp, mouse
ggacagcgattctcactccc

SEQ ID NO: 558358 - DNA, 20 bp, mouse
gtacttgtagactcacagtt

SEQ ID NO: 558359 - DNA, 20 bp, mouse
gaacataaatagctttagga

SEQ ID NO: 558360 - DNA, 20 bp, mouse
gtgagtgcaagaagaactga

SEQ ID NO: 558361 - DNA, 20 bp, mouse
ggacatcaaacgtgctataa

SEQ ID NO: 558362 - DNA, 20 bp, mouse
gcttgcactcacaggagaac

SEQ ID NO: 558363 - DNA, 20 bp, mouse
gtagcacgtttgatgtcagt

SEQ ID NO: 558364 - DNA, 20 bp, mouse
gaaacacacaagtgtgagtc

SEQ ID NO: 558365 - DNA, 20 bp, mouse
gcactctgtgtttgagaatt

SEQ ID NO: 558366 - DNA, 20 bp, mouse
gctctgcctgagcagcgggg

SEQ ID NO: 558367 - DNA, 20 bp, mouse
ggacaactctgcctgagcag

SEQ ID NO: 558368 - DNA, 20 bp, mouse
gcgacactgccaggggctct

SEQ ID NO: 558369 - DNA, 20 bp, mouse
gctccagtaataggaaccga

SEQ ID NO: 558370 - DNA, 20 bp, mouse
gactgaaggcgacactgcca

SEQ ID NO: 558371 - DNA, 20 bp, mouse
ggaatgaccagggtacctgc

SEQ ID NO: 558372 - DNA, 20 bp, mouse
gaaactgtcccaggtcatgt

SEQ ID NO: 558373 - DNA, 20 bp, mouse
gtctaggtatgtggctccta

SEQ ID NO: 558374 - DNA, 20 bp, mouse
gagagttgtctgtagcggaa

SEQ ID NO: 558375 - DNA, 20 bp, mouse
gctctctgtgaagcgatggt

SEQ ID NO: 558376 - DNA, 20 bp, mouse
ggacgccggaaggacccgaa

SEQ ID NO: 558377 - DNA, 20 bp, mouse
gcggtcagtggagacccggg

SEQ ID NO: 558378 - DNA, 20 bp, mouse
gaggcggaggtgctgaggct

SEQ ID NO: 558379 - DNA, 20 bp, mouse
gctcgccttaccggcaactg

SEQ ID NO: 558380 - DNA, 20 bp, mouse
gctaggcctggagggagcgt

SEQ ID NO: 558381 - DNA, 20 bp, mouse
ggggtctccactgaccgagg

SEQ ID NO: 558382 - DNA, 20 bp, mouse
ggagtcgcgcaaggcccgat

SEQ ID NO: 558383 - DNA, 20 bp, mouse
ggtgaggtcccgggcaggtg

SEQ ID NO: 558384 - DNA, 20 bp, mouse
gaagtgctaacggaaatgga

SEQ ID NO: 558385 - DNA, 20 bp, mouse
gaaaggaaccaggcgttgtc

SEQ ID NO: 558386 - DNA, 20 bp, mouse
gacgagtcgcgtggagctgt

SEQ ID NO: 558387 - DNA, 20 bp, mouse
gcaatcgcacgcgcagaaca

SEQ ID NO: 558388 - DNA, 20 bp, mouse
gacgagcgtaggtaagacca

SEQ ID NO: 558389 - DNA, 20 bp, mouse
ggcgactcgtccacgagcgt

SEQ ID NO: 558390 - DNA, 20 bp, mouse
ggtcagacccgacgtcagaa

SEQ ID NO: 558391 - DNA, 20 bp, mouse
gcccaccgccgcatacctca

SEQ ID NO: 558392 - DNA, 20 bp, mouse
gcgctccgtgaggtatgcgg

SEQ ID NO: 558393 - DNA, 20 bp, mouse
ggtcagaacggaagtagccc

SEQ ID NO: 558394 - DNA, 20 bp, mouse
gctagctccgaggggattga

SEQ ID NO: 558395 - DNA, 20 bp, mouse
gagacgctccgtgaggtatg

SEQ ID NO: 558396 - DNA, 20 bp, mouse
gcacttacggctcctgtccc

SEQ ID NO: 558397 - DNA, 20 bp, mouse
gactagagagaacacactta

SEQ ID NO: 558398 - DNA, 20 bp, mouse
gtctctagttgggagacaga

SEQ ID NO: 558399 - DNA, 20 bp, mouse
gaaccaaacctgcccgggac

SEQ ID NO: 558400 - DNA, 20 bp, mouse
gctcctgtcccgggcaggtt

SEQ ID NO: 558401 - DNA, 20 bp, mouse
gtcggtgtgattggcttcca

SEQ ID NO: 558402 - DNA, 20 bp, mouse
gtacggctcctgtcccgggc

SEQ ID NO: 558403 - DNA, 20 bp, mouse
gctccttgtatcaggttccc

SEQ ID NO: 558404 - DNA, 20 bp, mouse
gccgacaaccaaacctgccc

SEQ ID NO: 558405 - DNA, 20 bp, mouse
gttccagggaacctgataca

SEQ ID NO: 558406 - DNA, 20 bp, mouse
gcggcgaagcccaactccac

SEQ ID NO: 558407 - DNA, 20 bp, mouse
gctgccaccaggccggaaga

SEQ ID NO: 558408 - DNA, 20 bp, mouse
gctccaggccggtgcctcct

SEQ ID NO: 558409 - DNA, 20 bp, mouse
gccgccctcttccggcctgg

SEQ ID NO: 558410 - DNA, 20 bp, mouse
ggagttgggcttcgccgagg

SEQ ID NO: 558411 - DNA, 20 bp, mouse
gcagagtcctgctgcgagca

SEQ ID NO: 558412 - DNA, 20 bp, mouse
ggcaggccggcgcagcacgg

SEQ ID NO: 558413 - DNA, 20 bp, mouse
gggcttcgccgaggaggcac

SEQ ID NO: 558414 - DNA, 20 bp, mouse
gcgtcgtcccggcccggcag

SEQ ID NO: 558415 - DNA, 20 bp, mouse
ggcagcaggactctgccacc

SEQ ID NO: 558416 - DNA, 20 bp, mouse
gctgggacttcgagacacgg

SEQ ID NO: 558417 - DNA, 20 bp, mouse
gcgtgggagcccagtagtta

SEQ ID NO: 558418 - DNA, 20 bp, mouse
gctgctgggacttcgagaca

SEQ ID NO: 558419 - DNA, 20 bp, mouse
ggacggccgccataactact

SEQ ID NO: 558420 - DNA, 20 bp, mouse
gctcgaagtcccagcagtac

SEQ ID NO: 558421 - DNA, 20 bp, mouse
gagcttgctagaggtccagg

SEQ ID NO: 558422 - DNA, 20 bp, mouse
ggggagcccagtagttatgg

SEQ ID NO: 558423 - DNA, 20 bp, mouse
gtcaggaagcctgtactgct

SEQ ID NO: 558424 - DNA, 20 bp, mouse
ggtagctcgcgctgtcacgt

SEQ ID NO: 558425 - DNA, 20 bp, mouse
gttcgagacacggcggtgaa

SEQ ID NO: 558426 - DNA, 20 bp, mouse
gaggcgctccgaggcagcgg

SEQ ID NO: 558427 - DNA, 20 bp, mouse
gcggcggaggctgaggaacg

SEQ ID NO: 558428 - DNA, 20 bp, mouse
gcggggccagaggcgctccg

SEQ ID NO: 558429 - DNA, 20 bp, mouse
ggcccggcggaccggagacc

SEQ ID NO: 558430 - DNA, 20 bp, mouse
gggcctcggagagcgagcac

SEQ ID NO: 558431 - DNA, 20 bp, mouse
ggaacggggtcggggcccgg

SEQ ID NO: 558432 - DNA, 20 bp, mouse
gccacagtactgaccccctc

SEQ ID NO: 558433 - DNA, 20 bp, mouse
ggggtcggggcccggcggac

SEQ ID NO: 558434 - DNA, 20 bp, mouse
gcggtggccggagggctcca

SEQ ID NO: 558435 - DNA, 20 bp, mouse
gtcgtcccttaggcccgggt

SEQ ID NO: 558436 - DNA, 20 bp, mouse
gtgctgggtgaggctcagac

SEQ ID NO: 558437 - DNA, 20 bp, mouse
gctgctggggtagctggggt

SEQ ID NO: 558438 - DNA, 20 bp, mouse
gcaccacagcctgcagacaa

SEQ ID NO: 558439 - DNA, 20 bp, mouse
ggtccattcctccagctatg

SEQ ID NO: 558440 - DNA, 20 bp, mouse
ggcttctccagccacatagc

SEQ ID NO: 558441 - DNA, 20 bp, mouse
ggtagctggggtaggctgct

SEQ ID NO: 558442 - DNA, 20 bp, mouse
gcacagacgactaagtgggc

SEQ ID NO: 558443 - DNA, 20 bp, mouse
ggccccagctggggtagctg

SEQ ID NO: 558444 - DNA, 20 bp, mouse
gctccaagacagcaaaggga

SEQ ID NO: 558445 - DNA, 20 bp, mouse
gtgttggccatcgtgctagg

SEQ ID NO: 558446 - DNA, 20 bp, mouse
gtccaaccgagtgtaccgga

SEQ ID NO: 558447 - DNA, 20 bp, mouse
ggtgtaccggagggcggctg

SEQ ID NO: 558448 - DNA, 20 bp, mouse
ggccctccggtacactcggt

SEQ ID NO: 558449 - DNA, 20 bp, mouse
gagcctcacgcgggacccta

SEQ ID NO: 558450 - DNA, 20 bp, mouse
ggcggctgcgcgacccccga

SEQ ID NO: 558451 - DNA, 20 bp, mouse
gaggatcgcctgaggctcga

SEQ ID NO: 558452 - DNA, 20 bp, mouse
gcgcagccgcagccgccctc

SEQ ID NO: 558453 - DNA, 20 bp, mouse
ggcaggcgcagcggccgtcg

SEQ ID NO: 558454 - DNA, 20 bp, mouse
gggcgccgggctcgagtctc

SEQ ID NO: 558455 - DNA, 20 bp, mouse
gcgattccaaccgagtgtac

SEQ ID NO: 558456 - DNA, 20 bp, mouse
gggtaggagtaggcagccat

SEQ ID NO: 558457 - DNA, 20 bp, mouse
ggccatgggctgatgcacag

SEQ ID NO: 558458 - DNA, 20 bp, mouse
ggggcctgggcggtaggagt

SEQ ID NO: 558459 - DNA, 20 bp, mouse
gtggtcctgccccataactg

SEQ ID NO: 558460 - DNA, 20 bp, mouse
ggccgctgtgcatcagccca

SEQ ID NO: 558461 - DNA, 20 bp, mouse
gctgatgcacagcggcaacg

SEQ ID NO: 558462 - DNA, 20 bp, mouse
gtcctgccccataactgagg

SEQ ID NO: 558463 - DNA, 20 bp, mouse
gcctaccgcccaggcccggg

SEQ ID NO: 558464 - DNA, 20 bp, mouse
gaaggaggtcgggggatgaa

SEQ ID NO: 558465 - DNA, 20 bp, mouse
ggcaagcacctgaccctgta

SEQ ID NO: 558466 - DNA, 20 bp, mouse
gagcggaggagcggaccgac

SEQ ID NO: 558467 - DNA, 20 bp, mouse
ggcctaggcgcgctcggcac

SEQ ID NO: 558468 - DNA, 20 bp, mouse
ggcgcgctcggcaccggcag

SEQ ID NO: 558469 - DNA, 20 bp, mouse
ggacggagggacagcgacca

SEQ ID NO: 558470 - DNA, 20 bp, mouse
ggggacagcgaccacggcct

SEQ ID NO: 558471 - DNA, 20 bp, mouse
gcgtcgggccgcacagacgg

SEQ ID NO: 558472 - DNA, 20 bp, mouse
ggcccagtccgtcggcccgt

SEQ ID NO: 558473 - DNA, 20 bp, mouse
gagcagacgtacccgagcgg

SEQ ID NO: 558474 - DNA, 20 bp, mouse
gtccagcagacgtacccgag

SEQ ID NO: 558475 - DNA, 20 bp, mouse
gcagctgaagaagacctcgg

SEQ ID NO: 558476 - DNA, 20 bp, mouse
gggctctgggcgaaaaaagg

SEQ ID NO: 558477 - DNA, 20 bp, mouse
gtgtctgtagtgcagcggtt

SEQ ID NO: 558478 - DNA, 20 bp, mouse
gcgaatggagcggaaggcgg

SEQ ID NO: 558479 - DNA, 20 bp, mouse
ggacggctctgggcgaaaaa

SEQ ID NO: 558480 - DNA, 20 bp, mouse
gcgccagccgaggcctcccg

SEQ ID NO: 558481 - DNA, 20 bp, mouse
gagggcggcccgggacctgg

SEQ ID NO: 558482 - DNA, 20 bp, mouse
gggcggacagccgaatggag

SEQ ID NO: 558483 - DNA, 20 bp, mouse
gcagccgaggcctcccgcgg

SEQ ID NO: 558484 - DNA, 20 bp, mouse
gagccgaatggagcggaagg

SEQ ID NO: 558485 - DNA, 20 bp, mouse
gggggctgcagggccagcgg

SEQ ID NO: 558486 - DNA, 20 bp, mouse
gtcgcctagagaaagagaag

SEQ ID NO: 558487 - DNA, 20 bp, mouse
gcggccacttctctttctct

SEQ ID NO: 558488 - DNA, 20 bp, mouse
ggattggtccgcagagtcca

SEQ ID NO: 558489 - DNA, 20 bp, mouse
gcggagtagcgaggaggaca

SEQ ID NO: 558490 - DNA, 20 bp, mouse
gctaggcgagcgtcctttgt

SEQ ID NO: 558491 - DNA, 20 bp, mouse
gcaggagctgctagtctaga

SEQ ID NO: 558492 - DNA, 20 bp, mouse
gaagcggcgggcctagacat

SEQ ID NO: 558493 - DNA, 20 bp, mouse
gaagagggcggtactgagga

SEQ ID NO: 558494 - DNA, 20 bp, mouse
gggacgctccgagtctccaa

SEQ ID NO: 558495 - DNA, 20 bp, mouse
gcggagccataaggaaggtg

SEQ ID NO: 558496 - DNA, 20 bp, mouse
ggtggtctctaacgctccag

SEQ ID NO: 558497 - DNA, 20 bp, mouse
gaccagccagctctggctag

SEQ ID NO: 558498 - DNA, 20 bp, mouse
gagagaccactagccagagc

SEQ ID NO: 558499 - DNA, 20 bp, mouse
gtggtgtgggccgtccgcag

SEQ ID NO: 558500 - DNA, 20 bp, mouse
ggggcagaccaagagcgaac

SEQ ID NO: 558501 - DNA, 20 bp, mouse
ggacctctgcgcatgtgcaa

SEQ ID NO: 558502 - DNA, 20 bp, mouse
ggccagctagctccaatctc

SEQ ID NO: 558503 - DNA, 20 bp, mouse
gggactccaaggtcacccta

SEQ ID NO: 558504 - DNA, 20 bp, mouse
gcagaggtcctgttcgctct

SEQ ID NO: 558505 - DNA, 20 bp, mouse
gccaatctcagggatgtgaa

SEQ ID NO: 558506 - DNA, 20 bp, mouse
ggccaaacgaccgcagactt

SEQ ID NO: 558507 - DNA, 20 bp, mouse
gggctggtttgagtgactga

SEQ ID NO: 558508 - DNA, 20 bp, mouse
ggctcgggaccccaagtctg

SEQ ID NO: 558509 - DNA, 20 bp, mouse
gaaagtccggtgcctaccaa

SEQ ID NO: 558510 - DNA, 20 bp, mouse
gggagaacgagcccaaagtc

SEQ ID NO: 558511 - DNA, 20 bp, mouse
gcaggtgagtgtggcgagct

SEQ ID NO: 558512 - DNA, 20 bp, mouse
ggcgcaggcgcactgcgaga

SEQ ID NO: 558513 - DNA, 20 bp, mouse
ggtgcgcggagaggagcgga

SEQ ID NO: 558514 - DNA, 20 bp, mouse
gtgcggtcgtttggcttggt

SEQ ID NO: 558515 - DNA, 20 bp, mouse
gcaaatctctgtcctttggt

SEQ ID NO: 558516 - DNA, 20 bp, mouse
gtgtagccatggcgtccgag

SEQ ID NO: 558517 - DNA, 20 bp, mouse
ggcccctgcggctcactcgg

SEQ ID NO: 558518 - DNA, 20 bp, mouse
gaggcctgcgtgtctcctgg

SEQ ID NO: 558519 - DNA, 20 bp, mouse
gtggccaccaggagacacgc

SEQ ID NO: 558520 - DNA, 20 bp, mouse
ggccctgcgcgcctcacctt

SEQ ID NO: 558521 - DNA, 20 bp, mouse
gtggccagcggcgcttccga

SEQ ID NO: 558522 - DNA, 20 bp, mouse
gctcgcacaaatatccgcct

SEQ ID NO: 558523 - DNA, 20 bp, mouse
gggcagccgctcggacgcca

SEQ ID NO: 558524 - DNA, 20 bp, mouse
gggaagcgccgctggccacc

SEQ ID NO: 558525 - DNA, 20 bp, mouse
gtccgaaggtgaggcgcgca

SEQ ID NO: 558526 - DNA, 20 bp, mouse
ggtagtcaccgcagcagcgg

SEQ ID NO: 558527 - DNA, 20 bp, mouse
ggcagtagtcaccgcagcag

SEQ ID NO: 558528 - DNA, 20 bp, mouse
ggccttgaatcgcaggcgag

SEQ ID NO: 558529 - DNA, 20 bp, mouse
gccgagaagggagggcgcag

SEQ ID NO: 558530 - DNA, 20 bp, mouse
gcaaagagttcggccaccgg

SEQ ID NO: 558531 - DNA, 20 bp, mouse
ggcagcaagccttgaatcgc

SEQ ID NO: 558532 - DNA, 20 bp, mouse
gaagggcagcggccaaacgg

SEQ ID NO: 558533 - DNA, 20 bp, mouse
gctcccttgagcgtcccccc

SEQ ID NO: 558534 - DNA, 20 bp, mouse
gtgcctggggggacgctcaa

SEQ ID NO: 558535 - DNA, 20 bp, mouse
gcgcgtctcccgagaaggga

SEQ ID NO: 558536 - DNA, 20 bp, mouse
gactcagccggctccagtgg

SEQ ID NO: 558537 - DNA, 20 bp, mouse
ggctcgcgccacctctgctc

SEQ ID NO: 558538 - DNA, 20 bp, mouse
gtccactcagccggctccag

SEQ ID NO: 558539 - DNA, 20 bp, mouse
gaccactgtgagcccgaggt

SEQ ID NO: 558540 - DNA, 20 bp, mouse
ggtggagcagcgactggctg

SEQ ID NO: 558541 - DNA, 20 bp, mouse
ggtcgctgctccaccgccac

SEQ ID NO: 558542 - DNA, 20 bp, mouse
ggccgcggcaggcacctgtg

SEQ ID NO: 558543 - DNA, 20 bp, mouse
gggaaggtagtgccgagctg

SEQ ID NO: 558544 - DNA, 20 bp, mouse
gctccttccgcggctcagag

SEQ ID NO: 558545 - DNA, 20 bp, mouse
gagcgactggctgcgggagc

SEQ ID NO: 558546 - DNA, 20 bp, mouse
gtcaagtccaccgggaggag

SEQ ID NO: 558547 - DNA, 20 bp, mouse
gcgctgtcaagtccaccggg

SEQ ID NO: 558548 - DNA, 20 bp, mouse
ggccgccgaccggaagtcca

SEQ ID NO: 558549 - DNA, 20 bp, mouse
gggaagtccacggtctgaat

SEQ ID NO: 558550 - DNA, 20 bp, mouse
ggaggcagggactcacgagg

SEQ ID NO: 558551 - DNA, 20 bp, mouse
gcagaccgtggacttccggt

SEQ ID NO: 558552 - DNA, 20 bp, mouse
ggcccgctgtcaagtccacc

SEQ ID NO: 558553 - DNA, 20 bp, mouse
gtgggtcttgtacccggcca

SEQ ID NO: 558554 - DNA, 20 bp, mouse
gcggcggcaagcagaagccg

SEQ ID NO: 558555 - DNA, 20 bp, mouse
ggccgcgccaccgctcgagt

SEQ ID NO: 558556 - DNA, 20 bp, mouse
gctctctagcagctgaagca

SEQ ID NO: 558557 - DNA, 20 bp, mouse
gctggggtctgtctcctgta

SEQ ID NO: 558558 - DNA, 20 bp, mouse
ggtcacacatagagccgtac

SEQ ID NO: 558559 - DNA, 20 bp, mouse
gctctctcaataacaacctg

SEQ ID NO: 558560 - DNA, 20 bp, mouse
gctcttaattgatctggaag

SEQ ID NO: 558561 - DNA, 20 bp, mouse
ggatgtaataagaaaccaga

SEQ ID NO: 558562 - DNA, 20 bp, mouse
gttctggcagagccttcctt

SEQ ID NO: 558563 - DNA, 20 bp, mouse
gtgtgtggattgctcccgtg

SEQ ID NO: 558564 - DNA, 20 bp, mouse
ggtaactgccaatttaacca

SEQ ID NO: 558565 - DNA, 20 bp, mouse
gcgattccagcatcacttga

SEQ ID NO: 558566 - DNA, 20 bp, mouse
gttctggcagagccttcctt

SEQ ID NO: 558567 - DNA, 20 bp, mouse
gctgtcaaagacggcagttc

SEQ ID NO: 558568 - DNA, 20 bp, mouse
gttcagggacgcaaagccga

SEQ ID NO: 558569 - DNA, 20 bp, mouse
gtagccatccaaacagttca

SEQ ID NO: 558570 - DNA, 20 bp, mouse
gagaacagaccgagaagatg

SEQ ID NO: 558571 - DNA, 20 bp, mouse
gagatgtggcagcgcctgaa

SEQ ID NO: 558572 - DNA, 20 bp, mouse
gcgtccctgaactgtttgga

SEQ ID NO: 558573 - DNA, 20 bp, mouse
gtcctaggaacatcatcatg

SEQ ID NO: 558574 - DNA, 20 bp, mouse
gtaacgcttgagatttgtaa

SEQ ID NO: 558575 - DNA, 20 bp, mouse
ggatgttcctaggacaacac

SEQ ID NO: 558576 - DNA, 20 bp, mouse
gggagcgcaagagagcctag

SEQ ID NO: 558577 - DNA, 20 bp, mouse
gcacaggcgcccagtacgag

SEQ ID NO: 558578 - DNA, 20 bp, mouse
gcacactcagaagcgcccaa

SEQ ID NO: 558579 - DNA, 20 bp, mouse
gcaagggcgagcgcgctcac

SEQ ID NO: 558580 - DNA, 20 bp, mouse
gtctgagtgtgtgcacccct

SEQ ID NO: 558581 - DNA, 20 bp, mouse
gcggctgtggcagcgcacgg

SEQ ID NO: 558582 - DNA, 20 bp, mouse
gcgcagcagccactcgtact

SEQ ID NO: 558583 - DNA, 20 bp, mouse
gccactcctccccctcgcct

SEQ ID NO: 558584 - DNA, 20 bp, mouse
gaggcggctgtggcagcgca

SEQ ID NO: 558585 - DNA, 20 bp, mouse
gccgcaggtgggaagggtct

SEQ ID NO: 558586 - DNA, 20 bp, mouse
gtaagtgaggggcactgagg

SEQ ID NO: 558587 - DNA, 20 bp, mouse
ggggcttgctggtaagtgag

SEQ ID NO: 558588 - DNA, 20 bp, mouse
gaggggcactgaggcggagc

SEQ ID NO: 558589 - DNA, 20 bp, mouse
gggctccccagaggatttgg

SEQ ID NO: 558590 - DNA, 20 bp, mouse
gaagccaaagaagctaccgg

SEQ ID NO: 558591 - DNA, 20 bp, mouse
ggagccgccggtagcttctt

SEQ ID NO: 558592 - DNA, 20 bp, mouse
gcagttcttgcatgtcagca

SEQ ID NO: 558593 - DNA, 20 bp, mouse
gaagaacaggaacagagtcg

SEQ ID NO: 558594 - DNA, 20 bp, mouse
gggcggctccccagaggatt

SEQ ID NO: 558595 - DNA, 20 bp, mouse
gggctggacccagcaaggag

SEQ ID NO: 558596 - DNA, 20 bp, mouse
gcaggagagagtagaccgtg

SEQ ID NO: 558597 - DNA, 20 bp, mouse
ggcagcgggccgggctggag

SEQ ID NO: 558598 - DNA, 20 bp, mouse
gcggaccggcgaagctgttg

SEQ ID NO: 558599 - DNA, 20 bp, mouse
gacgcgctgaccgagtgcag

SEQ ID NO: 558600 - DNA, 20 bp, mouse
gagaagaccgggccctcacc

SEQ ID NO: 558601 - DNA, 20 bp, mouse
ggcggctgcgagcatggtcc

SEQ ID NO: 558602 - DNA, 20 bp, mouse
gagggagaagcgggtgtcca

SEQ ID NO: 558603 - DNA, 20 bp, mouse
gaccagggcggaccctcgcg

SEQ ID NO: 558604 - DNA, 20 bp, mouse
gggcggaccctcgcgcggac

SEQ ID NO: 558605 - DNA, 20 bp, mouse
ggaggatgtggtgcaacacc

SEQ ID NO: 558606 - DNA, 20 bp, mouse
ggccagaggcaggcgcaccc

SEQ ID NO: 558607 - DNA, 20 bp, mouse
gccaacagcgcgacggccag

SEQ ID NO: 558608 - DNA, 20 bp, mouse
gcaggcggccaacagcgcga

SEQ ID NO: 558609 - DNA, 20 bp, mouse
gcatccagaagaaggcgcac

SEQ ID NO: 558610 - DNA, 20 bp, mouse
ggagccggcccggagcactg

SEQ ID NO: 558611 - DNA, 20 bp, mouse
ggccaagccgggcctcggag

SEQ ID NO: 558612 - DNA, 20 bp, mouse
ggctagtccaggcgaccatg

SEQ ID NO: 558613 - DNA, 20 bp, mouse
gacagcgccgaggagagttg

SEQ ID NO: 558614 - DNA, 20 bp, mouse
gcgagctgaagacttcaagt

SEQ ID NO: 558615 - DNA, 20 bp, mouse
ggtcctaagcacgctagtcc

SEQ ID NO: 558616 - DNA, 20 bp, mouse
gggctcgggacgggagacgg

SEQ ID NO: 558617 - DNA, 20 bp, mouse
gcctcaagcgcggctcggga

SEQ ID NO: 558618 - DNA, 20 bp, mouse
gcgcggctcgggacgggaga

SEQ ID NO: 558619 - DNA, 20 bp, mouse
gagccgcgcttgagggaaaa

SEQ ID NO: 558620 - DNA, 20 bp, mouse
ggagcttcgcagagcggtca

SEQ ID NO: 558621 - DNA, 20 bp, mouse
gcgcccaacggaccaggctg

SEQ ID NO: 558622 - DNA, 20 bp, mouse
ggagctgcgtgagcccgctg

SEQ ID NO: 558623 - DNA, 20 bp, mouse
gatcgcgcgcccaacggacc

SEQ ID NO: 558624 - DNA, 20 bp, mouse
gggtaactgttgcagcgcgc

SEQ ID NO: 558625 - DNA, 20 bp, mouse
gccactgagagcggcgagaa

SEQ ID NO: 558626 - DNA, 20 bp, mouse
gcaggcagggtaagcgccct

SEQ ID NO: 558627 - DNA, 20 bp, mouse
ggaatcaaactgtgctgagg

SEQ ID NO: 558628 - DNA, 20 bp, mouse
gaactgtgctgaggaggctt

SEQ ID NO: 558629 - DNA, 20 bp, mouse
gtgggaatcaaactgtgctg

SEQ ID NO: 558630 - DNA, 20 bp, mouse
gttaccctgcctgtccccat

SEQ ID NO: 558631 - DNA, 20 bp, mouse
gaggaggggacaaggtccaa

SEQ ID NO: 558632 - DNA, 20 bp, mouse
gcgcagaagaagtcaaccag

SEQ ID NO: 558633 - DNA, 20 bp, mouse
gtccaaggggagccgcggag

SEQ ID NO: 558634 - DNA, 20 bp, mouse
ggctggcccaggcccctccg

SEQ ID NO: 558635 - DNA, 20 bp, mouse
ggtccctctgcagcagaggt

SEQ ID NO: 558636 - DNA, 20 bp, mouse
gcgcccaaggacggagaacg

SEQ ID NO: 558637 - DNA, 20 bp, mouse
gggacggagaacgcggacgg

SEQ ID NO: 558638 - DNA, 20 bp, mouse
ggggccatggcgcccaagga

SEQ ID NO: 558639 - DNA, 20 bp, mouse
gcggagaacgcggacggcgg

SEQ ID NO: 558640 - DNA, 20 bp, mouse
gggagctcctggcctcagtg

SEQ ID NO: 558641 - DNA, 20 bp, mouse
gtgaggccaggagctcccgt

SEQ ID NO: 558642 - DNA, 20 bp, mouse
gagtggggccatggcgccca

SEQ ID NO: 558643 - DNA, 20 bp, mouse
gccgggttccgagagcgcag

SEQ ID NO: 558644 - DNA, 20 bp, mouse
ggacaggctcctctccgagg

SEQ ID NO: 558645 - DNA, 20 bp, mouse
ggtccgcgttctccgtcctt

SEQ ID NO: 558646 - DNA, 20 bp, mouse
gacaaaccccatccacaagg

SEQ ID NO: 558647 - DNA, 20 bp, mouse
ggcagtcttgaacatagcaa

SEQ ID NO: 558648 - DNA, 20 bp, mouse
gcactttggcgcattttcag

SEQ ID NO: 558649 - DNA, 20 bp, mouse
gagagcaagaggagcatact

SEQ ID NO: 558650 - DNA, 20 bp, mouse
gcaccagcctccttgtggat

SEQ ID NO: 558651 - DNA, 20 bp, mouse
gtgtcacaaggagctttatc

SEQ ID NO: 558652 - DNA, 20 bp, mouse
gcagcggcgtcgcttcacgg

SEQ ID NO: 558653 - DNA, 20 bp, mouse
gcagacaaaccccatccaca

SEQ ID NO: 558654 - DNA, 20 bp, mouse
gaccccatccacaaggaggc

SEQ ID NO: 558655 - DNA, 20 bp, mouse
gggcactgacgcgggttaaa

SEQ ID NO: 558656 - DNA, 20 bp, mouse
gagccgcgcagggactcccg

SEQ ID NO: 558657 - DNA, 20 bp, mouse
gcccctcgggagtccctgcg

SEQ ID NO: 558658 - DNA, 20 bp, mouse
gatggcgcctggctcccctc

SEQ ID NO: 558659 - DNA, 20 bp, mouse
gaccaactgcgagagagaca

SEQ ID NO: 558660 - DNA, 20 bp, mouse
gccctaggcgtgcatcgaag

SEQ ID NO: 558661 - DNA, 20 bp, mouse
gccacagccacgctaggatc

SEQ ID NO: 558662 - DNA, 20 bp, mouse
gccgagggcgagacatcgga

SEQ ID NO: 558663 - DNA, 20 bp, mouse
gggctcaacccagccatgca

SEQ ID NO: 558664 - DNA, 20 bp, mouse
gtgtaccgagggcgagacat

SEQ ID NO: 558665 - DNA, 20 bp, mouse
gcggatgggccaccgtgaag

SEQ ID NO: 558666 - DNA, 20 bp, mouse
gacccagctgggagtgggat

SEQ ID NO: 558667 - DNA, 20 bp, mouse
ggtgtgctctgtgacctccc

SEQ ID NO: 558668 - DNA, 20 bp, mouse
gaaagaacccagctgggagt

SEQ ID NO: 558669 - DNA, 20 bp, mouse
gtcacagcgcaggtccccac

SEQ ID NO: 558670 - DNA, 20 bp, mouse
gcctaccctggccagcccta

SEQ ID NO: 558671 - DNA, 20 bp, mouse
gccctagggactagaatcct

SEQ ID NO: 558672 - DNA, 20 bp, mouse
gggcgctgaacggttctcct

SEQ ID NO: 558673 - DNA, 20 bp, mouse
gtagtccctagggctggcca

SEQ ID NO: 558674 - DNA, 20 bp, mouse
gagactagacccgagccagg

SEQ ID NO: 558675 - DNA, 20 bp, mouse
ggcccagagccacatcagca

SEQ ID NO: 558676 - DNA, 20 bp, mouse
gccacccccccaccccctac

SEQ ID NO: 558677 - DNA, 20 bp, mouse
gactctattatgaagactac

SEQ ID NO: 558678 - DNA, 20 bp, mouse
gaagactacaggcaccctgt

SEQ ID NO: 558679 - DNA, 20 bp, mouse
ggcagatggctgagtaggtc

SEQ ID NO: 558680 - DNA, 20 bp, mouse
ggggcatggtcaaggagttg

SEQ ID NO: 558681 - DNA, 20 bp, mouse
ggctgtaaacacctgcagta

SEQ ID NO: 558682 - DNA, 20 bp, mouse
ggcaccctgtagggggtggg

SEQ ID NO: 558683 - DNA, 20 bp, mouse
gccggggcggggcatggtca

SEQ ID NO: 558684 - DNA, 20 bp, mouse
ggtgtttacagctacagtag

SEQ ID NO: 558685 - DNA, 20 bp, mouse
gatggacaatcaagctgtag

SEQ ID NO: 558686 - DNA, 20 bp, mouse
gggactacatctcccagagg

SEQ ID NO: 558687 - DNA, 20 bp, mouse
ggtctccccaagcctcctct

SEQ ID NO: 558688 - DNA, 20 bp, mouse
gaagatggcgccgggatagg

SEQ ID NO: 558689 - DNA, 20 bp, mouse
ggtcggactacatctcccag

SEQ ID NO: 558690 - DNA, 20 bp, mouse
gcgcatgcgcggagccgcag

SEQ ID NO: 558691 - DNA, 20 bp, mouse
gcccgcgggagagacagctg

SEQ ID NO: 558692 - DNA, 20 bp, mouse
gagatgtagtccgaccgctg

SEQ ID NO: 558693 - DNA, 20 bp, mouse
ggcgggagagacagctgtgg

SEQ ID NO: 558694 - DNA, 20 bp, mouse
gattgggatgctgagtgaca

SEQ ID NO: 558695 - DNA, 20 bp, mouse
gatctcccagaggaggcttg

SEQ ID NO: 558696 - DNA, 20 bp, mouse
ggacttgagagtggagcgga

SEQ ID NO: 558697 - DNA, 20 bp, mouse
ggctcgcgcagacttgagag

SEQ ID NO: 558698 - DNA, 20 bp, mouse
gagtggagcggagggacgag

SEQ ID NO: 558699 - DNA, 20 bp, mouse
ggcgactcctcgagcttcgg

SEQ ID NO: 558700 - DNA, 20 bp, mouse
gggtggagcggagtgcgtgg

SEQ ID NO: 558701 - DNA, 20 bp, mouse
gcgctcgggcgagtccccac

SEQ ID NO: 558702 - DNA, 20 bp, mouse
gtaggatccgactgctgcac

SEQ ID NO: 558703 - DNA, 20 bp, mouse
ggcgggtcccccgaagctcg

SEQ ID NO: 558704 - DNA, 20 bp, mouse
gtggactcgggagactctgg

SEQ ID NO: 558705 - DNA, 20 bp, mouse
gggcagtaggggagccggtc

SEQ ID NO: 558706 - DNA, 20 bp, mouse
gtaggccccacgtcaatctg

SEQ ID NO: 558707 - DNA, 20 bp, mouse
gttagctgctcccaaggagg

SEQ ID NO: 558708 - DNA, 20 bp, mouse
gagaacctcagattgacgtg

SEQ ID NO: 558709 - DNA, 20 bp, mouse
ggtctgagatgaccttcccc

SEQ ID NO: 558710 - DNA, 20 bp, mouse
ggacgttcaggagaacttac

SEQ ID NO: 558711 - DNA, 20 bp, mouse
gtgcctccttggccccgagg

SEQ ID NO: 558712 - DNA, 20 bp, mouse
ggtcatctcagacctcctcg

SEQ ID NO: 558713 - DNA, 20 bp, mouse
ggacctcctcggggccaagg

SEQ ID NO: 558714 - DNA, 20 bp, mouse
gcaagcaaattgagttcaat

SEQ ID NO: 558715 - DNA, 20 bp, mouse
gcacgatgtgaacagcgtag

SEQ ID NO: 558716 - DNA, 20 bp, mouse
ggcgtacctgttcctcactg

SEQ ID NO: 558717 - DNA, 20 bp, mouse
gggtacgcagcttcctggat

SEQ ID NO: 558718 - DNA, 20 bp, mouse
gaaacgtggggttcccatcc

SEQ ID NO: 558719 - DNA, 20 bp, mouse
gagtattgatgggcaaacgt

SEQ ID NO: 558720 - DNA, 20 bp, mouse
gttcttcccaaagtattgat

SEQ ID NO: 558721 - DNA, 20 bp, mouse
ggcgctggcggtacataaag

SEQ ID NO: 558722 - DNA, 20 bp, mouse
gagacgatctcagagtcagg

SEQ ID NO: 558723 - DNA, 20 bp, mouse
gaagccccgggcacagcagc

SEQ ID NO: 558724 - DNA, 20 bp, mouse
gctgcgagagctgtgccagg

SEQ ID NO: 558725 - DNA, 20 bp, mouse
gcagcggtcggcatgcagga

SEQ ID NO: 558726 - DNA, 20 bp, mouse
gtcgccaaggaagccccagg

SEQ ID NO: 558727 - DNA, 20 bp, mouse
gccaggtggctatgtgaagc

SEQ ID NO: 558728 - DNA, 20 bp, mouse
gaaggtcttgtgttacatac

SEQ ID NO: 558729 - DNA, 20 bp, mouse
gatcctggtcaaaatcgcca

SEQ ID NO: 558730 - DNA, 20 bp, mouse
gcaagaccttggcttatggt

SEQ ID NO: 558731 - DNA, 20 bp, mouse
ggccatgcaggggtccagac

SEQ ID NO: 558732 - DNA, 20 bp, mouse
gctgctgctacccagagtgg

SEQ ID NO: 558733 - DNA, 20 bp, mouse
gtaccctgagcaccatacca

SEQ ID NO: 558734 - DNA, 20 bp, mouse
gggctcaccgggcactgcag

SEQ ID NO: 558735 - DNA, 20 bp, mouse
gttgctgctgctacccagag

SEQ ID NO: 558736 - DNA, 20 bp, mouse
gagctccacgactagaggga

SEQ ID NO: 558737 - DNA, 20 bp, mouse
gggacacctcaggtgaacag

SEQ ID NO: 558738 - DNA, 20 bp, mouse
gcacctcaggtgaacagcgg

SEQ ID NO: 558739 - DNA, 20 bp, mouse
ggtggcggccagacccgaac

SEQ ID NO: 558740 - DNA, 20 bp, mouse
gcgggagctccacgactaga

SEQ ID NO: 558741 - DNA, 20 bp, mouse
gctcaggtgaacagcggtgg

SEQ ID NO: 558742 - DNA, 20 bp, mouse
gaggagaagggatcaggagc

SEQ ID NO: 558743 - DNA, 20 bp, mouse
ggggccagggatatcctgag

SEQ ID NO: 558744 - DNA, 20 bp, mouse
gcagcccggccggacacctc

SEQ ID NO: 558745 - DNA, 20 bp, mouse
gtgtatccgcccgggagcag

SEQ ID NO: 558746 - DNA, 20 bp, mouse
gcaagcactggacagatctc

SEQ ID NO: 558747 - DNA, 20 bp, mouse
gtcagaaaggaccacagcat

SEQ ID NO: 558748 - DNA, 20 bp, mouse
gacctgggtcagcagaacac

SEQ ID NO: 558749 - DNA, 20 bp, mouse
gtccagataaccggcgcctg

SEQ ID NO: 558750 - DNA, 20 bp, mouse
ggcgccggttatctggacct

SEQ ID NO: 558751 - DNA, 20 bp, mouse
ggagctcccccccagtctag

SEQ ID NO: 558752 - DNA, 20 bp, mouse
gaggcatagaggctgaatct

SEQ ID NO: 558753 - DNA, 20 bp, mouse
ggccagtgttctgctgaccc

SEQ ID NO: 558754 - DNA, 20 bp, mouse
gagggcgaatgagcagtcag

SEQ ID NO: 558755 - DNA, 20 bp, mouse
gaggcaataacaacaactgg

SEQ ID NO: 558756 - DNA, 20 bp, mouse
gcagcgactagacaacttac

SEQ ID NO: 558757 - DNA, 20 bp, mouse
gcaacttacgggaacacatt

SEQ ID NO: 558758 - DNA, 20 bp, mouse
gggaacacattcggctctgg

SEQ ID NO: 558759 - DNA, 20 bp, mouse
gaataactaactaaatgagt

SEQ ID NO: 558760 - DNA, 20 bp, mouse
gacgggaacacattcggctc

SEQ ID NO: 558761 - DNA, 20 bp, mouse
gtgccaggaagccacaaaca

SEQ ID NO: 558762 - DNA, 20 bp, mouse
gtcagcctcaaggccatccc

SEQ ID NO: 558763 - DNA, 20 bp, mouse
gctggaaaaggatggatctg

SEQ ID NO: 558764 - DNA, 20 bp, mouse
gactaactaaatgagttgga

SEQ ID NO: 558765 - DNA, 20 bp, mouse
ggggtctgacctgagtttag

SEQ ID NO: 558766 - DNA, 20 bp, mouse
gcgcggagcgtagagcagtt

SEQ ID NO: 558767 - DNA, 20 bp, mouse
ggcggagcggagtgaggctc

SEQ ID NO: 558768 - DNA, 20 bp, mouse
ggaagctgatggctcctcgg

SEQ ID NO: 558769 - DNA, 20 bp, mouse
gcgggccgcgagcacgggcg

SEQ ID NO: 558770 - DNA, 20 bp, mouse
ggcggagtgaggctcggggg

SEQ ID NO: 558771 - DNA, 20 bp, mouse
gccgcccctgcgctacgagg

SEQ ID NO: 558772 - DNA, 20 bp, mouse
ggcggagggccgggaggcgt

SEQ ID NO: 558773 - DNA, 20 bp, mouse
gaattacgccgggctcgcgc

SEQ ID NO: 558774 - DNA, 20 bp, mouse
gcgggcgccgcgcggatcca

SEQ ID NO: 558775 - DNA, 20 bp, mouse
ggcgccgcgcggatccaagg

SEQ ID NO: 558776 - DNA, 20 bp, mouse
gccagccagtcgctagctct

SEQ ID NO: 558777 - DNA, 20 bp, mouse
gcgctcggctgggagaaaag

SEQ ID NO: 558778 - DNA, 20 bp, mouse
gagtgcccagagctagcgac

SEQ ID NO: 558779 - DNA, 20 bp, mouse
ggaatccagcaacctcatcc

SEQ ID NO: 558780 - DNA, 20 bp, mouse
gtagctctgggcactgcagc

SEQ ID NO: 558781 - DNA, 20 bp, mouse
gagcgactggctgggtgagc

SEQ ID NO: 558782 - DNA, 20 bp, mouse
gagcaggcagccggcctggg

SEQ ID NO: 558783 - DNA, 20 bp, mouse
gcagggtttagcaggagagt

SEQ ID NO: 558784 - DNA, 20 bp, mouse
gcgcagggagacaggcgcca

SEQ ID NO: 558785 - DNA, 20 bp, mouse
gatgctgtgaaatctctgag

SEQ ID NO: 558786 - DNA, 20 bp, mouse
ggatgtgagggagacagcgg

SEQ ID NO: 558787 - DNA, 20 bp, mouse
ggcggctcccgcctcaggaa

SEQ ID NO: 558788 - DNA, 20 bp, mouse
gggcgcgcgcggcgatgtga

SEQ ID NO: 558789 - DNA, 20 bp, mouse
gaggaagggcatgttcggag

SEQ ID NO: 558790 - DNA, 20 bp, mouse
gcgctcaggccgcgatgaca

SEQ ID NO: 558791 - DNA, 20 bp, mouse
gcagcggcggctcccgcctc

SEQ ID NO: 558792 - DNA, 20 bp, mouse
ggcttccggggaaatgtcgg

SEQ ID NO: 558793 - DNA, 20 bp, mouse
gatgttcggaggggcgtccg

SEQ ID NO: 558794 - DNA, 20 bp, mouse
ggtgccgccgccgccagtat

SEQ ID NO: 558795 - DNA, 20 bp, mouse
gcatttccccggaagcgcgg

SEQ ID NO: 558796 - DNA, 20 bp, mouse
gaagggtctggtcgctccaa

SEQ ID NO: 558797 - DNA, 20 bp, mouse
gtctctctgcaagaagggtc

SEQ ID NO: 558798 - DNA, 20 bp, mouse
ggtctagtgcgctccatgag

SEQ ID NO: 558799 - DNA, 20 bp, mouse
gagcgaggttaatggtgcaa

SEQ ID NO: 558800 - DNA, 20 bp, mouse
ggcagagagagcgaggttaa

SEQ ID NO: 558801 - DNA, 20 bp, mouse
gtccgcagatcgctgtccta

SEQ ID NO: 558802 - DNA, 20 bp, mouse
gggcagtggaggagattggc

SEQ ID NO: 558803 - DNA, 20 bp, mouse
gcatgagcggctgctgctag

SEQ ID NO: 558804 - DNA, 20 bp, mouse
gctcgctctctctgcaagaa

SEQ ID NO: 558805 - DNA, 20 bp, mouse
ggccctaggacagcgatctg

SEQ ID NO: 558806 - DNA, 20 bp, mouse
gccccctggcgagcgtccgg

SEQ ID NO: 558807 - DNA, 20 bp, mouse
gcgcgctctgccgctccggg

SEQ ID NO: 558808 - DNA, 20 bp, mouse
gctccgggaggaagatggcc

SEQ ID NO: 558809 - DNA, 20 bp, mouse
gcgctcgccagggggcacgg

SEQ ID NO: 558810 - DNA, 20 bp, mouse
gggaggcgagcccgacagag

SEQ ID NO: 558811 - DNA, 20 bp, mouse
ggggaggaagatggcccggg

SEQ ID NO: 558812 - DNA, 20 bp, mouse
ggggagcccggctgagggat

SEQ ID NO: 558813 - DNA, 20 bp, mouse
gagcgtgtcgcagggcccca

SEQ ID NO: 558814 - DNA, 20 bp, mouse
gtgcgagacatggatgctgg

SEQ ID NO: 558815 - DNA, 20 bp, mouse
gggcgagcccgacagagcgg

SEQ ID NO: 558816 - DNA, 20 bp, mouse
gcggctcgccccgggaggta

SEQ ID NO: 558817 - DNA, 20 bp, mouse
gcggccgcggcgagaaagta

SEQ ID NO: 558818 - DNA, 20 bp, mouse
ggatgcgtccatcgatgtct

SEQ ID NO: 558819 - DNA, 20 bp, mouse
gtgcagctgcgggcgcgatg

SEQ ID NO: 558820 - DNA, 20 bp, mouse
ggccttgggccggtagcttg

SEQ ID NO: 558821 - DNA, 20 bp, mouse
gggccggctcctcaagctac

SEQ ID NO: 558822 - DNA, 20 bp, mouse
gcaggctgccgtacctcccg

SEQ ID NO: 558823 - DNA, 20 bp, mouse
gtgtctaggtagatggcctt

SEQ ID NO: 558824 - DNA, 20 bp, mouse
gccatctacctagacatcga

SEQ ID NO: 558825 - DNA, 20 bp, mouse
ggcactctgtgcccagagaa

SEQ ID NO: 558826 - DNA, 20 bp, mouse
gaggctgccgcggccggcgt

SEQ ID NO: 558827 - DNA, 20 bp, mouse
ggtgcgcgccgggccctcca

SEQ ID NO: 558828 - DNA, 20 bp, mouse
ggcggccggcgtgggttccg

SEQ ID NO: 558829 - DNA, 20 bp, mouse
gggctccccggaacccacgc

SEQ ID NO: 558830 - DNA, 20 bp, mouse
gacctctgcgcccggctccc

SEQ ID NO: 558831 - DNA, 20 bp, mouse
gttggcgctagcggaaggaa

SEQ ID NO: 558832 - DNA, 20 bp, mouse
gacagggcccgcgctatcct

SEQ ID NO: 558833 - DNA, 20 bp, mouse
ggcagaagcgcgtaccctca

SEQ ID NO: 558834 - DNA, 20 bp, mouse
gagctgctcgggttccaccg

SEQ ID NO: 558835 - DNA, 20 bp, mouse
ggcctggggagcagccctga

SEQ ID NO: 558836 - DNA, 20 bp, mouse
gctcagggagcgcggcccgg

SEQ ID NO: 558837 - DNA, 20 bp, mouse
gtgcaaagccagcgaggagg

SEQ ID NO: 558838 - DNA, 20 bp, mouse
ggagtgcaaagccagcgagg

SEQ ID NO: 558839 - DNA, 20 bp, mouse
ggagggtggcgcggagagca

SEQ ID NO: 558840 - DNA, 20 bp, mouse
gcgggacgcgatgaggacct

SEQ ID NO: 558841 - DNA, 20 bp, mouse
ggggagcgcggcccggagga

SEQ ID NO: 558842 - DNA, 20 bp, mouse
gagccgcgaggtgaacccgt

SEQ ID NO: 558843 - DNA, 20 bp, mouse
gggagcctgcggagcgcgct

SEQ ID NO: 558844 - DNA, 20 bp, mouse
gtccctcagggagcgcggcc

SEQ ID NO: 558845 - DNA, 20 bp, mouse
ggtggcacccacctcggcca

SEQ ID NO: 558846 - DNA, 20 bp, mouse
ggggccccagcggcagtaaa

SEQ ID NO: 558847 - DNA, 20 bp, mouse
ggagcactggatccttacag

SEQ ID NO: 558848 - DNA, 20 bp, mouse
ggcagctggcactgaagggt

SEQ ID NO: 558849 - DNA, 20 bp, mouse
gcgggccgcttcccactgta

SEQ ID NO: 558850 - DNA, 20 bp, mouse
ggaagggtgggcaagctcga

SEQ ID NO: 558851 - DNA, 20 bp, mouse
gggtgggcaagctcgaggga

SEQ ID NO: 558852 - DNA, 20 bp, mouse
gtgggaagcggcccgagcgc

SEQ ID NO: 558853 - DNA, 20 bp, mouse
ggagagaggcgagccagaga

SEQ ID NO: 558854 - DNA, 20 bp, mouse
gaagggcatgagagtcggct

SEQ ID NO: 558855 - DNA, 20 bp, mouse
gagtgccagctgcaatcctg

SEQ ID NO: 558856 - DNA, 20 bp, mouse
gcggagggaagccctcaggg

SEQ ID NO: 558857 - DNA, 20 bp, mouse
ggccctcagggaggcagcgg

SEQ ID NO: 558858 - DNA, 20 bp, mouse
gcccagagtggcgagcgagt

SEQ ID NO: 558859 - DNA, 20 bp, mouse
gagcggcggcccgaacaccc

SEQ ID NO: 558860 - DNA, 20 bp, mouse
gggccggaacagctgaaggg

SEQ ID NO: 558861 - DNA, 20 bp, mouse
gcggccggagggaagccctc

SEQ ID NO: 558862 - DNA, 20 bp, mouse
gcgaacacccgggcagggag

SEQ ID NO: 558863 - DNA, 20 bp, mouse
gtgcaacgaagctagagggt

SEQ ID NO: 558864 - DNA, 20 bp, mouse
ggaggcaggcaggctgctcc

SEQ ID NO: 558865 - DNA, 20 bp, mouse
gagactgtggatgctcgcgt

SEQ ID NO: 558866 - DNA, 20 bp, mouse
gcgctcggatgcctgcccta

SEQ ID NO: 558867 - DNA, 20 bp, mouse
gcgggaagccgggagagctt

SEQ ID NO: 558868 - DNA, 20 bp, mouse
gagggcaggacgcagggctg

SEQ ID NO: 558869 - DNA, 20 bp, mouse
gggacacaggcgaggactcg

SEQ ID NO: 558870 - DNA, 20 bp, mouse
gctaaggcagggcaggacgc

SEQ ID NO: 558871 - DNA, 20 bp, mouse
gtggccaccgaagttccctc

SEQ ID NO: 558872 - DNA, 20 bp, mouse
ggaggccgcggggacgactc

SEQ ID NO: 558873 - DNA, 20 bp, mouse
ggggtcccgccaagccagac

SEQ ID NO: 558874 - DNA, 20 bp, mouse
gaccgactgcagcaaggagg

SEQ ID NO: 558875 - DNA, 20 bp, mouse
gccggtacccgagggaactt

SEQ ID NO: 558876 - DNA, 20 bp, mouse
gtgggcggccgggacaacac

SEQ ID NO: 558877 - DNA, 20 bp, mouse
gagcagcgccagtaactggg

SEQ ID NO: 558878 - DNA, 20 bp, mouse
ggcggccgggacaacacagg

SEQ ID NO: 558879 - DNA, 20 bp, mouse
ggagagcagcgccagtaact

SEQ ID NO: 558880 - DNA, 20 bp, mouse
gacacaggcggtgaaggcga

SEQ ID NO: 558881 - DNA, 20 bp, mouse
ggtcccggccgcccagttac

SEQ ID NO: 558882 - DNA, 20 bp, mouse
ggggacaacacaggcggtga

SEQ ID NO: 558883 - DNA, 20 bp, mouse
ggcccaaagggttgagtcgg

SEQ ID NO: 558884 - DNA, 20 bp, mouse
gaaagcccaaagggttgagt

SEQ ID NO: 558885 - DNA, 20 bp, mouse
gcgccagtaactgggcggcc

SEQ ID NO: 558886 - DNA, 20 bp, mouse
gcttgagggagagaaacaaa

SEQ ID NO: 558887 - DNA, 20 bp, mouse
gaacaaacggaggagctgcg

SEQ ID NO: 558888 - DNA, 20 bp, mouse
gggggaaggactggaagctt

SEQ ID NO: 558889 - DNA, 20 bp, mouse
gcctcaagctccaacagtaa

SEQ ID NO: 558890 - DNA, 20 bp, mouse
ggcaaagaaaatccgatacc

SEQ ID NO: 558891 - DNA, 20 bp, mouse
ggaaggctataggattgtgt

SEQ ID NO: 558892 - DNA, 20 bp, mouse
ggttttgagcccattactgt

SEQ ID NO: 558893 - DNA, 20 bp, mouse
gggtccctgatcataacttg

SEQ ID NO: 558894 - DNA, 20 bp, mouse
ggccttccaaagaaattgtt

SEQ ID NO: 558895 - DNA, 20 bp, mouse
gtaaacttcactggaatggg

SEQ ID NO: 558896 - DNA, 20 bp, mouse
gcaatcctaggtcccagata

SEQ ID NO: 558897 - DNA, 20 bp, mouse
gctgtctgtggccacagtcc

SEQ ID NO: 558898 - DNA, 20 bp, mouse
gagtcccggctaccctatct

SEQ ID NO: 558899 - DNA, 20 bp, mouse
gtgagctctggggctgtctg

SEQ ID NO: 558900 - DNA, 20 bp, mouse
gctgggacctaggattgctc

SEQ ID NO: 558901 - DNA, 20 bp, mouse
gctgtagcccggtaagtcca

SEQ ID NO: 558902 - DNA, 20 bp, mouse
ggctaccctatctgggacct

SEQ ID NO: 558903 - DNA, 20 bp, mouse
gccagagctcacaccactgt

SEQ ID NO: 558904 - DNA, 20 bp, mouse
ggctgctccgctcctcccgg

SEQ ID NO: 558905 - DNA, 20 bp, mouse
gtgcctgccagctagaccta

SEQ ID NO: 558906 - DNA, 20 bp, mouse
gcggcgcgacaggctgtcca

SEQ ID NO: 558907 - DNA, 20 bp, mouse
ggtgacctgcagaatagttc

SEQ ID NO: 558908 - DNA, 20 bp, mouse
gaatagttcaggactgcaga

SEQ ID NO: 558909 - DNA, 20 bp, mouse
gtaggacgagccaggtacac

SEQ ID NO: 558910 - DNA, 20 bp, mouse
gggactgcagacggcgcgac

SEQ ID NO: 558911 - DNA, 20 bp, mouse
gacgagccaggtacaccgga

SEQ ID NO: 558912 - DNA, 20 bp, mouse
gcggaaggtgaccagcgctg

SEQ ID NO: 558913 - DNA, 20 bp, mouse
gaggctagagaagtcctgat

SEQ ID NO: 558914 - DNA, 20 bp, mouse
ggagttcttcagggcgatgg

SEQ ID NO: 558915 - DNA, 20 bp, mouse
ggaagaaaggggacccttct

SEQ ID NO: 558916 - DNA, 20 bp, mouse
ggccaacacgcgggatacag

SEQ ID NO: 558917 - DNA, 20 bp, mouse
ggcgcagcagactcacgcgg

SEQ ID NO: 558918 - DNA, 20 bp, mouse
gggagcgcagcagactcacg

SEQ ID NO: 558919 - DNA, 20 bp, mouse
ggagtctgctgcgctccatg

SEQ ID NO: 558920 - DNA, 20 bp, mouse
gcccaggcactcaaaaggag

SEQ ID NO: 558921 - DNA, 20 bp, mouse
gcgcggcggccgcggcaccc

SEQ ID NO: 558922 - DNA, 20 bp, mouse
gaagtcagcggagtccagag

SEQ ID NO: 558923 - DNA, 20 bp, mouse
gcgagctgcgggacttgggt

SEQ ID NO: 558924 - DNA, 20 bp, mouse
gggcgcctcaaggagacttg

SEQ ID NO: 558925 - DNA, 20 bp, mouse
gcggcacccaggcactcaaa

SEQ ID NO: 558926 - DNA, 20 bp, mouse
gtcagaggagcaggccccgt

SEQ ID NO: 558927 - DNA, 20 bp, mouse
ggcctagtgtctgagattac

SEQ ID NO: 558928 - DNA, 20 bp, mouse
gactaggcattgaggtttgt

SEQ ID NO: 558929 - DNA, 20 bp, mouse
ggcttccagcttgctgacgt

SEQ ID NO: 558930 - DNA, 20 bp, mouse
gttaaataggaggaaagtgt

SEQ ID NO: 558931 - DNA, 20 bp, mouse
gttggcctcaaaatgagggg

SEQ ID NO: 558932 - DNA, 20 bp, mouse
gagttactgtctgagtttag

SEQ ID NO: 558933 - DNA, 20 bp, mouse
gtctttggcctcaaaatgag

SEQ ID NO: 558934 - DNA, 20 bp, mouse
gactcaaaaaagtcctggca

SEQ ID NO: 558935 - DNA, 20 bp, mouse
gctgatgcttctaactggaa

SEQ ID NO: 558936 - DNA, 20 bp, mouse
ggtcattcggcagctagtag

SEQ ID NO: 558937 - DNA, 20 bp, mouse
gaagggcacagggcctacag

SEQ ID NO: 558938 - DNA, 20 bp, mouse
ggagcaggcctgagagatcg

SEQ ID NO: 558939 - DNA, 20 bp, mouse
gccttgcggcaggtaggtag

SEQ ID NO: 558940 - DNA, 20 bp, mouse
gaagatgccacctggccctg

SEQ ID NO: 558941 - DNA, 20 bp, mouse
gggtaaccggtcccgacgtc

SEQ ID NO: 558942 - DNA, 20 bp, mouse
gggggacccttgcggcaggt

SEQ ID NO: 558943 - DNA, 20 bp, mouse
gcctacagtggacgcgctag

SEQ ID NO: 558944 - DNA, 20 bp, mouse
ggtctgacgcagccaatagt

SEQ ID NO: 558945 - DNA, 20 bp, mouse
gacgtcgggcaaggccggga

SEQ ID NO: 558946 - DNA, 20 bp, mouse
gccagaaggtaccgaagcag

SEQ ID NO: 558947 - DNA, 20 bp, mouse
gagccagtcccaggcttcga

SEQ ID NO: 558948 - DNA, 20 bp, mouse
gaaggtaccgaagcagcggc

SEQ ID NO: 558949 - DNA, 20 bp, mouse
gacggctgctaaatcccaga

SEQ ID NO: 558950 - DNA, 20 bp, mouse
ggcaatggggcctgggtcag

SEQ ID NO: 558951 - DNA, 20 bp, mouse
gagctttcccggagaaagcc

SEQ ID NO: 558952 - DNA, 20 bp, mouse
gagccgtcgaagcctgggac

SEQ ID NO: 558953 - DNA, 20 bp, mouse
gcatcttcccggctttctcc

SEQ ID NO: 558954 - DNA, 20 bp, mouse
gtagccctgaaggcaggcca

SEQ ID NO: 558955 - DNA, 20 bp, mouse
gcgaccgtggagcaagttgg

SEQ ID NO: 558956 - DNA, 20 bp, mouse
gctgggtgtctcaggctcat

SEQ ID NO: 558957 - DNA, 20 bp, mouse
ggcacctctgaaggaccccc

SEQ ID NO: 558958 - DNA, 20 bp, mouse
ggccagtgggctgaaaaccg

SEQ ID NO: 558959 - DNA, 20 bp, mouse
gtgctcctgctgggtgtctc

SEQ ID NO: 558960 - DNA, 20 bp, mouse
gttccccagtgggctcctca

SEQ ID NO: 558961 - DNA, 20 bp, mouse
gctccctgaggagcccactg

SEQ ID NO: 558962 - DNA, 20 bp, mouse
gggccaagtctaggaagtag

SEQ ID NO: 558963 - DNA, 20 bp, mouse
gggcagaagctgcttgtcca

SEQ ID NO: 558964 - DNA, 20 bp, mouse
gaaccgtggtggtagcctag

SEQ ID NO: 558965 - DNA, 20 bp, mouse
gagcagggtgcccacaagaa

SEQ ID NO: 558966 - DNA, 20 bp, mouse
gtgatggctatcacccctgt

SEQ ID NO: 558967 - DNA, 20 bp, mouse
gttgatcagacgcagggtgg

SEQ ID NO: 558968 - DNA, 20 bp, mouse
gcctgtaggtgcatacttct

SEQ ID NO: 558969 - DNA, 20 bp, mouse
gaccccctgactgggaccag

SEQ ID NO: 558970 - DNA, 20 bp, mouse
gaggtctgtagccctgagag

SEQ ID NO: 558971 - DNA, 20 bp, mouse
ggccacagaagctgcagtga

SEQ ID NO: 558972 - DNA, 20 bp, mouse
ggaggaggaacagcagtcct

SEQ ID NO: 558973 - DNA, 20 bp, mouse
ggctctgcacatgaccccac

SEQ ID NO: 558974 - DNA, 20 bp, mouse
gtctgtagccctgagagggg

SEQ ID NO: 558975 - DNA, 20 bp, mouse
gctgcacatgaccccactgg

SEQ ID NO: 558976 - DNA, 20 bp, mouse
gacgcgcgagcgcaggcaag

SEQ ID NO: 558977 - DNA, 20 bp, mouse
gcgggaccggagaaatgaga

SEQ ID NO: 558978 - DNA, 20 bp, mouse
gggcaagcggctgcagattg

SEQ ID NO: 558979 - DNA, 20 bp, mouse
gaggcagctgaagcgcatgg

SEQ ID NO: 558980 - DNA, 20 bp, mouse
gcgcaaagtggcctcaccag

SEQ ID NO: 558981 - DNA, 20 bp, mouse
ggcggtcggagggccgggac

SEQ ID NO: 558982 - DNA, 20 bp, mouse
gagccccgccgagcccgtgt

SEQ ID NO: 558983 - DNA, 20 bp, mouse
gcagctgaagcgcatggcgg

SEQ ID NO: 558984 - DNA, 20 bp, mouse
gagccaggcctgctagatag

SEQ ID NO: 558985 - DNA, 20 bp, mouse
ggggccagacgcgcgagcgc

SEQ ID NO: 558986 - DNA, 20 bp, mouse
ggagctgggcctgcagacac

SEQ ID NO: 558987 - DNA, 20 bp, mouse
ggaggtcggcgagtgctctg

SEQ ID NO: 558988 - DNA, 20 bp, mouse
ggtcggcgagtgctctgcgg

SEQ ID NO: 558989 - DNA, 20 bp, mouse
gaccttgctggggcctgaca

SEQ ID NO: 558990 - DNA, 20 bp, mouse
gccggcgtcgctcgggaggt

SEQ ID NO: 558991 - DNA, 20 bp, mouse
gtttccggagcttcatgatt

SEQ ID NO: 558992 - DNA, 20 bp, mouse
gcatgattgggtgcagagct

SEQ ID NO: 558993 - DNA, 20 bp, mouse
gagtgtagggccgaatctag

SEQ ID NO: 558994 - DNA, 20 bp, mouse
gcgggtcactaattccgcag

SEQ ID NO: 558995 - DNA, 20 bp, mouse
ggcgccggagatgcacacga

SEQ ID NO: 558996 - DNA, 20 bp, mouse
gccacctcggccaacagcta

SEQ ID NO: 558997 - DNA, 20 bp, mouse
gctgttggccgaggtggagc

SEQ ID NO: 558998 - DNA, 20 bp, mouse
gcgtggcaccgggaactcgg

SEQ ID NO: 558999 - DNA, 20 bp, mouse
gtcacccggcccggccccag

SEQ ID NO: 559000 - DNA, 20 bp, mouse
ggcctcctgccgtctgcacc

SEQ ID NO: 559001 - DNA, 20 bp, mouse
ggtgaagtggccgtagctgt

SEQ ID NO: 559002 - DNA, 20 bp, mouse
gtgctcgccgggtggcaata

SEQ ID NO: 559003 - DNA, 20 bp, mouse
ggccgggtgcagacggcagg

SEQ ID NO: 559004 - DNA, 20 bp, mouse
ggagcgcgaacccggagaga

SEQ ID NO: 559005 - DNA, 20 bp, mouse
gggagccgggtgcagacggc

SEQ ID NO: 559006 - DNA, 20 bp, mouse
gggcagagccgaggcagcgg

SEQ ID NO: 559007 - DNA, 20 bp, mouse
gcggcggcacggacagaatg

SEQ ID NO: 559008 - DNA, 20 bp, mouse
gagaatgcgggtgatcggca

SEQ ID NO: 559009 - DNA, 20 bp, mouse
gcgcggcagagccgaggcag

SEQ ID NO: 559010 - DNA, 20 bp, mouse
ggtaagcgcgggcctgtggt

SEQ ID NO: 559011 - DNA, 20 bp, mouse
gcgtgggcgcggcagagccg

SEQ ID NO: 559012 - DNA, 20 bp, mouse
gcggacagaatgcgggtgat

SEQ ID NO: 559013 - DNA, 20 bp, mouse
ggaagccgagggcgggacgt

SEQ ID NO: 559014 - DNA, 20 bp, mouse
gccttcaggctgcctccgac

SEQ ID NO: 559015 - DNA, 20 bp, mouse
gcctgtggtgggaagccggt

SEQ ID NO: 559016 - DNA, 20 bp, mouse
gtcatgagagggagaagcgg

SEQ ID NO: 559017 - DNA, 20 bp, mouse
ggcgagctgcgcgataatgg

SEQ ID NO: 559018 - DNA, 20 bp, mouse
gggcgcgagctgcgcgataa

SEQ ID NO: 559019 - DNA, 20 bp, mouse
gcctgtcacggacctctcag

SEQ ID NO: 559020 - DNA, 20 bp, mouse
ggccagagcccgcggaggag

SEQ ID NO: 559021 - DNA, 20 bp, mouse
ggcgcgcgccggcttctgac

SEQ ID NO: 559022 - DNA, 20 bp, mouse
gcagctcgcgccctcggccg

SEQ ID NO: 559023 - DNA, 20 bp, mouse
gttctgactggaggccgccg

SEQ ID NO: 559024 - DNA, 20 bp, mouse
gagagcccgcggaggagagg

SEQ ID NO: 559025 - DNA, 20 bp, mouse
gtctgactgcggggcatccg

SEQ ID NO: 559026 - DNA, 20 bp, mouse
ggagtgagcccaagaaaccc

SEQ ID NO: 559027 - DNA, 20 bp, mouse
gttcctgcttgagcacatgg

SEQ ID NO: 559028 - DNA, 20 bp, mouse
ggggagggtgcagaagtctg

SEQ ID NO: 559029 - DNA, 20 bp, mouse
ggacctccatgtgctcaagc

SEQ ID NO: 559030 - DNA, 20 bp, mouse
gtacaaaaggaaggtcacca

SEQ ID NO: 559031 - DNA, 20 bp, mouse
ggattctagagggccaggtg

SEQ ID NO: 559032 - DNA, 20 bp, mouse
gaggcttgtcaatcagagag

SEQ ID NO: 559033 - DNA, 20 bp, mouse
ggtcagccctgtggcaatca

SEQ ID NO: 559034 - DNA, 20 bp, mouse
ggtcctgctctcaacacaag

SEQ ID NO: 559035 - DNA, 20 bp, mouse
gggctcactcattagcagac

SEQ ID NO: 559036 - DNA, 20 bp, mouse
gagctccgggcgccaacctg

SEQ ID NO: 559037 - DNA, 20 bp, mouse
ggcacgtagcgcccgggcag

SEQ ID NO: 559038 - DNA, 20 bp, mouse
gtcataccgagccccgccgg

SEQ ID NO: 559039 - DNA, 20 bp, mouse
gcgtcccgcacgtagcgccc

SEQ ID NO: 559040 - DNA, 20 bp, mouse
ggcggcatacagccgcaggt

SEQ ID NO: 559041 - DNA, 20 bp, mouse
ggcctcataccgagccccgc

SEQ ID NO: 559042 - DNA, 20 bp, mouse
gagctccggctcctccggcg

SEQ ID NO: 559043 - DNA, 20 bp, mouse
ggcttcatggagagtggcga

SEQ ID NO: 559044 - DNA, 20 bp, mouse
ggcgcccgctccctccgagg

SEQ ID NO: 559045 - DNA, 20 bp, mouse
gcagaggcccgacggcccag

SEQ ID NO: 559046 - DNA, 20 bp, mouse
ggctgggccgagctgacggc

SEQ ID NO: 559047 - DNA, 20 bp, mouse
ggcatcgccagggcaagggt

SEQ ID NO: 559048 - DNA, 20 bp, mouse
gcgccagggcaagggtaggg

SEQ ID NO: 559049 - DNA, 20 bp, mouse
gcggcgtaggcgggcaccgg

SEQ ID NO: 559050 - DNA, 20 bp, mouse
gcgcatggcgacggcgcctg

SEQ ID NO: 559051 - DNA, 20 bp, mouse
ggatcccggccactgagagt

SEQ ID NO: 559052 - DNA, 20 bp, mouse
gctcgctgctgtcccggggc

SEQ ID NO: 559053 - DNA, 20 bp, mouse
gaagaatgcgtccctggcag

SEQ ID NO: 559054 - DNA, 20 bp, mouse
gcagtttctagacttcggta

SEQ ID NO: 559055 - DNA, 20 bp, mouse
ggcggccgaagcccgtctcc

SEQ ID NO: 559056 - DNA, 20 bp, mouse
gcgacacctacacaagtacc

SEQ ID NO: 559057 - DNA, 20 bp, mouse
gtgctgcccggtacttgtgt

SEQ ID NO: 559058 - DNA, 20 bp, mouse
gcaagtaccgggcagcagtt

SEQ ID NO: 559059 - DNA, 20 bp, mouse
ggtaccgggcagcagttggg

SEQ ID NO: 559060 - DNA, 20 bp, mouse
gaaggccgagccccaggtag

SEQ ID NO: 559061 - DNA, 20 bp, mouse
gatgcctgagggccctcctg

SEQ ID NO: 559062 - DNA, 20 bp, mouse
gagccgcgggcagccggcca

SEQ ID NO: 559063 - DNA, 20 bp, mouse
gccgcctagccgcgaggagg

SEQ ID NO: 559064 - DNA, 20 bp, mouse
gcaaggccccacgggagtga

SEQ ID NO: 559065 - DNA, 20 bp, mouse
gcagtggcgacggggagaag

SEQ ID NO: 559066 - DNA, 20 bp, mouse
ggtcaggagcgcggtcgaga

SEQ ID NO: 559067 - DNA, 20 bp, mouse
ggtgctcgagcctgggtgaa

SEQ ID NO: 559068 - DNA, 20 bp, mouse
gcaagtgcgttgtggtccca

SEQ ID NO: 559069 - DNA, 20 bp, mouse
gagagggagcaagtgcgttg

SEQ ID NO: 559070 - DNA, 20 bp, mouse
ggtcccgggtgctcgagcct

SEQ ID NO: 559071 - DNA, 20 bp, mouse
ggctcgagcacccgggaccc

SEQ ID NO: 559072 - DNA, 20 bp, mouse
gggatccgtagggttggcga

SEQ ID NO: 559073 - DNA, 20 bp, mouse
ggaacagctcgacctccctg

SEQ ID NO: 559074 - DNA, 20 bp, mouse
gtaaaaggcaagacatcggg

SEQ ID NO: 559075 - DNA, 20 bp, mouse
ggcggtggttaggatccgta

SEQ ID NO: 559076 - DNA, 20 bp, mouse
ggcgggagttgggagatcct

SEQ ID NO: 559077 - DNA, 20 bp, mouse
gagttgggagatcctgggac

SEQ ID NO: 559078 - DNA, 20 bp, mouse
gctgtcggagaaagagcgcg

SEQ ID NO: 559079 - DNA, 20 bp, mouse
gtcccgggtaagagcgtctt

SEQ ID NO: 559080 - DNA, 20 bp, mouse
gagtcaccccgacctccata

SEQ ID NO: 559081 - DNA, 20 bp, mouse
ggcctgggcgtggagacctg

SEQ ID NO: 559082 - DNA, 20 bp, mouse
ggacgcgcgtgggaacgggg

SEQ ID NO: 559083 - DNA, 20 bp, mouse
gagagcgcgcggcgggagtt

SEQ ID NO: 559084 - DNA, 20 bp, mouse
gtgcgtccctatggaggtcg

SEQ ID NO: 559085 - DNA, 20 bp, mouse
ggcgcgctgcgtccctatgg

SEQ ID NO: 559086 - DNA, 20 bp, mouse
gaacggagggagtaaggacg

SEQ ID NO: 559087 - DNA, 20 bp, mouse
ggacggctgcggtggaacgg

SEQ ID NO: 559088 - DNA, 20 bp, mouse
gctccctagagtcggacaga

SEQ ID NO: 559089 - DNA, 20 bp, mouse
gaggccagccaggaaaggga

SEQ ID NO: 559090 - DNA, 20 bp, mouse
gggcgagctctccctagagt

SEQ ID NO: 559091 - DNA, 20 bp, mouse
ggtcggacagacggctgcgg

SEQ ID NO: 559092 - DNA, 20 bp, mouse
gggctgcggtggaacggcgg

SEQ ID NO: 559093 - DNA, 20 bp, mouse
gtctagggagagctcgcccg

SEQ ID NO: 559094 - DNA, 20 bp, mouse
gagccgtctgtccgactcta

SEQ ID NO: 559095 - DNA, 20 bp, mouse
gggactgggactgggactag

SEQ ID NO: 559096 - DNA, 20 bp, mouse
gaagcaaagggagaagacgg

SEQ ID NO: 559097 - DNA, 20 bp, mouse
ggcctggcgggtggtgacag

SEQ ID NO: 559098 - DNA, 20 bp, mouse
gatcattgtgaccaaggtaa

SEQ ID NO: 559099 - DNA, 20 bp, mouse
gtggctgccggcaggtgtga

SEQ ID NO: 559100 - DNA, 20 bp, mouse
ggagctagctaccccctgaa

SEQ ID NO: 559101 - DNA, 20 bp, mouse
gaaagggagaagacggtggc

SEQ ID NO: 559102 - DNA, 20 bp, mouse
gagggcctgggcctggcggg

SEQ ID NO: 559103 - DNA, 20 bp, mouse
ggaacaagaccccctttcag

SEQ ID NO: 559104 - DNA, 20 bp, mouse
gtggggtgtactgtggaagt

SEQ ID NO: 559105 - DNA, 20 bp, mouse
gggggcttccgaattagcgg

SEQ ID NO: 559106 - DNA, 20 bp, mouse
gcgagtgggtccagcgacgg

SEQ ID NO: 559107 - DNA, 20 bp, mouse
gcctcgagtgggtccagcga

SEQ ID NO: 559108 - DNA, 20 bp, mouse
ggcagccccaggagctaagt

SEQ ID NO: 559109 - DNA, 20 bp, mouse
gatggtgccttccctcgagt

SEQ ID NO: 559110 - DNA, 20 bp, mouse
gccgggagaactacgttctg

SEQ ID NO: 559111 - DNA, 20 bp, mouse
gaggagctaagtaggttgtc

SEQ ID NO: 559112 - DNA, 20 bp, mouse
ggctggacccactcgaggga

SEQ ID NO: 559113 - DNA, 20 bp, mouse
gagccccagggcgcaggacc

SEQ ID NO: 559114 - DNA, 20 bp, mouse
gctctgcaaagcgcttgtct

SEQ ID NO: 559115 - DNA, 20 bp, mouse
gaaagcgcttgtctcggaac

SEQ ID NO: 559116 - DNA, 20 bp, mouse
gccagagctggagccggaca

SEQ ID NO: 559117 - DNA, 20 bp, mouse
gggccaggcggcggcaacag

SEQ ID NO: 559118 - DNA, 20 bp, mouse
ggagctggagccggacacgg

SEQ ID NO: 559119 - DNA, 20 bp, mouse
gccgcgcagggtcaccgagt

SEQ ID NO: 559120 - DNA, 20 bp, mouse
gtcaccgagtgggtcatcgc

SEQ ID NO: 559121 - DNA, 20 bp, mouse
gcggcccgcgatgacccact

SEQ ID NO: 559122 - DNA, 20 bp, mouse
ggcggaagccccagggtgaa

SEQ ID NO: 559123 - DNA, 20 bp, mouse
gccaccaggcggaagcccca

SEQ ID NO: 559124 - DNA, 20 bp, mouse
ggtcccggccgcccaccagg

SEQ ID NO: 559125 - DNA, 20 bp, mouse
gtgcgcggcccttcaccctg

SEQ ID NO: 559126 - DNA, 20 bp, mouse
gcggccactcacctcctgac

SEQ ID NO: 559127 - DNA, 20 bp, mouse
gcccaccggcttgagaggga

SEQ ID NO: 559128 - DNA, 20 bp, mouse
gtcagaccagcgctgacaag

SEQ ID NO: 559129 - DNA, 20 bp, mouse
ggtgcgccgcgccggtcagg

SEQ ID NO: 559130 - DNA, 20 bp, mouse
gcgcgggacgagaggaggac

SEQ ID NO: 559131 - DNA, 20 bp, mouse
gactcacctcctgaccggcg

SEQ ID NO: 559132 - DNA, 20 bp, mouse
gagggtgcgccgcgccggtc

SEQ ID NO: 559133 - DNA, 20 bp, mouse
ggaggtgtgagaagcgcccg

SEQ ID NO: 559134 - DNA, 20 bp, mouse
gagaagcgcccggggcaggg

SEQ ID NO: 559135 - DNA, 20 bp, mouse
gggaggcggaagttccccac

SEQ ID NO: 559136 - DNA, 20 bp, mouse
gagcctccgggagcagcgat

SEQ ID NO: 559137 - DNA, 20 bp, mouse
gcaggcgggcactcaggtac

SEQ ID NO: 559138 - DNA, 20 bp, mouse
gcaggccaggaaccccctcg

SEQ ID NO: 559139 - DNA, 20 bp, mouse
gatcccatcgctgctcccgg

SEQ ID NO: 559140 - DNA, 20 bp, mouse
ggcgtccccaccgcacacag

SEQ ID NO: 559141 - DNA, 20 bp, mouse
gtgccaggcagcggcccagg

SEQ ID NO: 559142 - DNA, 20 bp, mouse
ggcggcccaggcgggcactc

SEQ ID NO: 559143 - DNA, 20 bp, mouse
gcttcgccgcaggaaggcgg

SEQ ID NO: 559144 - DNA, 20 bp, mouse
gcgggccataggaccccgta

SEQ ID NO: 559145 - DNA, 20 bp, mouse
gaaaggcgcggcgtccgcgg

SEQ ID NO: 559146 - DNA, 20 bp, mouse
ggctgcgtggtgctgagtga

SEQ ID NO: 559147 - DNA, 20 bp, mouse
ggggaaggacgcgcacggag

SEQ ID NO: 559148 - DNA, 20 bp, mouse
gcacccggggcagaccgcag

SEQ ID NO: 559149 - DNA, 20 bp, mouse
ggtggacgaggataccaacc

SEQ ID NO: 559150 - DNA, 20 bp, mouse
gagacacgcccgggccacag

SEQ ID NO: 559151 - DNA, 20 bp, mouse
gtccaggcacagcccgccgt

SEQ ID NO: 559152 - DNA, 20 bp, mouse
gcacagtcgagcacccgctg

SEQ ID NO: 559153 - DNA, 20 bp, mouse
ggccgagctgcagcgcgccg

SEQ ID NO: 559154 - DNA, 20 bp, mouse
gacccacccggcaggcgagg

SEQ ID NO: 559155 - DNA, 20 bp, mouse
ggagtcgtgagggggcgtca

SEQ ID NO: 559156 - DNA, 20 bp, mouse
gggatcctctcggctcactc

SEQ ID NO: 559157 - DNA, 20 bp, mouse
gggcactcggcggatcctct

SEQ ID NO: 559158 - DNA, 20 bp, mouse
gcaaccgcggaactgtgctc

SEQ ID NO: 559159 - DNA, 20 bp, mouse
gggtcctgagcacagttccg

SEQ ID NO: 559160 - DNA, 20 bp, mouse
gaggaccagagtgagccgag

SEQ ID NO: 559161 - DNA, 20 bp, mouse
gtcgactgggggcctctcca

SEQ ID NO: 559162 - DNA, 20 bp, mouse
gaggatccgccgagtgccag

SEQ ID NO: 559163 - DNA, 20 bp, mouse
ggtggggtgaccatgaccag

SEQ ID NO: 559164 - DNA, 20 bp, mouse
gaacccagtcgcagcaaccg

SEQ ID NO: 559165 - DNA, 20 bp, mouse
gttccgcggttgctgcgact

SEQ ID NO: 559166 - DNA, 20 bp, mouse
gcgcggcggagccccagcaa

SEQ ID NO: 559167 - DNA, 20 bp, mouse
gatgagggcggccattgctg

SEQ ID NO: 559168 - DNA, 20 bp, mouse
gagcgtcctcctccccgcgg

SEQ ID NO: 559169 - DNA, 20 bp, mouse
gcggggcgggcgcaggatga

SEQ ID NO: 559170 - DNA, 20 bp, mouse
gctggggctccgccgcgggg

SEQ ID NO: 559171 - DNA, 20 bp, mouse
gctggccatgagccccaagt

SEQ ID NO: 559172 - DNA, 20 bp, mouse
ggcctcgcccagcagaaccc

SEQ ID NO: 559173 - DNA, 20 bp, mouse
ggccgagcagcgcaacgctg

SEQ ID NO: 559174 - DNA, 20 bp, mouse
ggagcagcgcaacgctgcgg

SEQ ID NO: 559175 - DNA, 20 bp, mouse
gtgagcgcgcggctgctgta

SEQ ID NO: 559176 - DNA, 20 bp, mouse
gtcagggcaacgaacaggag

SEQ ID NO: 559177 - DNA, 20 bp, mouse
gagtctggctgcccacctca

SEQ ID NO: 559178 - DNA, 20 bp, mouse
gcaacgaacaggaggggaga

SEQ ID NO: 559179 - DNA, 20 bp, mouse
ggaggggagacggtcttacc

SEQ ID NO: 559180 - DNA, 20 bp, mouse
gccacctcagggcaacgaac

SEQ ID NO: 559181 - DNA, 20 bp, mouse
ggtgcaggtgactagagcag

SEQ ID NO: 559182 - DNA, 20 bp, mouse
gctggtacccaagttgaggg

SEQ ID NO: 559183 - DNA, 20 bp, mouse
gtgtagacccaagggattct

SEQ ID NO: 559184 - DNA, 20 bp, mouse
gctcactggtacccaagttg

SEQ ID NO: 559185 - DNA, 20 bp, mouse
gcagtccccctccctcaact

SEQ ID NO: 559186 - DNA, 20 bp, mouse
ggggctttctggactcgcag

SEQ ID NO: 559187 - DNA, 20 bp, mouse
gtcagcgccagagagtgccc

SEQ ID NO: 559188 - DNA, 20 bp, mouse
ggcccagccgggaagagctc

SEQ ID NO: 559189 - DNA, 20 bp, mouse
gcagccgggaagagctcggg

SEQ ID NO: 559190 - DNA, 20 bp, mouse
gaaatgccgactgtgccgag

SEQ ID NO: 559191 - DNA, 20 bp, mouse
gccaaaacccagaacaacac

SEQ ID NO: 559192 - DNA, 20 bp, mouse
gggcaacctctcggcacagt

SEQ ID NO: 559193 - DNA, 20 bp, mouse
gcggtggggtagcttagatg

SEQ ID NO: 559194 - DNA, 20 bp, mouse
gccgggaagagctcgggagg

SEQ ID NO: 559195 - DNA, 20 bp, mouse
gctgtacccctaccacctgt

SEQ ID NO: 559196 - DNA, 20 bp, mouse
gagtcgcgggcccgtgaggt

SEQ ID NO: 559197 - DNA, 20 bp, mouse
gcgcgagtcgcgggcccgtg

SEQ ID NO: 559198 - DNA, 20 bp, mouse
ggcgcgctgcccgcgagtcg

SEQ ID NO: 559199 - DNA, 20 bp, mouse
ggaaggtcgcaggccccccg

SEQ ID NO: 559200 - DNA, 20 bp, mouse
gatcccgaggtgcgagtcca

SEQ ID NO: 559201 - DNA, 20 bp, mouse
ggtcaccccaagtcacccac

SEQ ID NO: 559202 - DNA, 20 bp, mouse
gagtcccgggacggcgggcg

SEQ ID NO: 559203 - DNA, 20 bp, mouse
gggtttccagtgggtgactt

SEQ ID NO: 559204 - DNA, 20 bp, mouse
ggaccgtggactcgcacctc

SEQ ID NO: 559205 - DNA, 20 bp, mouse
gcgcaggccccccgcggtcc

SEQ ID NO: 559206 - DNA, 20 bp, mouse
ggcgtgcgcggaaggagcca

SEQ ID NO: 559207 - DNA, 20 bp, mouse
gaccatgctgtcccccgagg

SEQ ID NO: 559208 - DNA, 20 bp, mouse
gagcacccgctccgcctcgg

SEQ ID NO: 559209 - DNA, 20 bp, mouse
gcggcaggtgagagacgtgg

SEQ ID NO: 559210 - DNA, 20 bp, mouse
gccagtgacgccggaagacc

SEQ ID NO: 559211 - DNA, 20 bp, mouse
gcaggagaccagcaatgacc

SEQ ID NO: 559212 - DNA, 20 bp, mouse
gcaggttactgagacatggg

SEQ ID NO: 559213 - DNA, 20 bp, mouse
gccggcgtcactggtcccag

SEQ ID NO: 559214 - DNA, 20 bp, mouse
gcactgctacaacttcacct

SEQ ID NO: 559215 - DNA, 20 bp, mouse
gtccgcctcgggggacagca

SEQ ID NO: 559216 - DNA, 20 bp, mouse
gtcctcagcccgacggagag

SEQ ID NO: 559217 - DNA, 20 bp, mouse
ggcgacgctcaggctccgcg

SEQ ID NO: 559218 - DNA, 20 bp, mouse
gccggagcccgtcacgcgag

SEQ ID NO: 559219 - DNA, 20 bp, mouse
gggctccgcggggcacgggc

SEQ ID NO: 559220 - DNA, 20 bp, mouse
gccggcccgcccgtgccccg

SEQ ID NO: 559221 - DNA, 20 bp, mouse
gcgtcgggctgcacacaaag

SEQ ID NO: 559222 - DNA, 20 bp, mouse
ggctcggccggcggaagaag

SEQ ID NO: 559223 - DNA, 20 bp, mouse
ggacactgccgctctccgtc

SEQ ID NO: 559224 - DNA, 20 bp, mouse
gacggaaggggagaccgcag

SEQ ID NO: 559225 - DNA, 20 bp, mouse
gcggcccgcttctccccccg

SEQ ID NO: 559226 - DNA, 20 bp, mouse
gggaggagcgcgaggagtgt

SEQ ID NO: 559227 - DNA, 20 bp, mouse
gccggaggtaggagcgactc

SEQ ID NO: 559228 - DNA, 20 bp, mouse
ggtaggagccgggcgaccgg

SEQ ID NO: 559229 - DNA, 20 bp, mouse
gggcggcggatccccgagat

SEQ ID NO: 559230 - DNA, 20 bp, mouse
ggggcgctgaggcgatgaag

SEQ ID NO: 559231 - DNA, 20 bp, mouse
gagcgactcgggtaacggaa

SEQ ID NO: 559232 - DNA, 20 bp, mouse
ggtaggagcgactcgggtaa

SEQ ID NO: 559233 - DNA, 20 bp, mouse
gagtgtaggagccgggcgac

SEQ ID NO: 559234 - DNA, 20 bp, mouse
ggcgcgaggagtgtaggagc

SEQ ID NO: 559235 - DNA, 20 bp, mouse
gccgagatcggaggagcgcg

SEQ ID NO: 559236 - DNA, 20 bp, mouse
gtgctcctggaggccgaccg

SEQ ID NO: 559237 - DNA, 20 bp, mouse
gggttcaagtctgaaagtcg

SEQ ID NO: 559238 - DNA, 20 bp, mouse
gcacgaccagcgcatagcca

SEQ ID NO: 559239 - DNA, 20 bp, mouse
ggcccgcggcgggaacgacc

SEQ ID NO: 559240 - DNA, 20 bp, mouse
gcgccgcgggctcccgaccg

SEQ ID NO: 559241 - DNA, 20 bp, mouse
gcagccggcgatccaatgaa

SEQ ID NO: 559242 - DNA, 20 bp, mouse
gtcaagtctgaaagtcgcgg

SEQ ID NO: 559243 - DNA, 20 bp, mouse
gctggaggccgaccgcggtc

SEQ ID NO: 559244 - DNA, 20 bp, mouse
gaggcggcacgtgttccgag

SEQ ID NO: 559245 - DNA, 20 bp, mouse
ggctggtcgtgctggcggcg

SEQ ID NO: 559246 - DNA, 20 bp, mouse
gaacatggcgccccccatgt

SEQ ID NO: 559247 - DNA, 20 bp, mouse
gcagactggcgtaaccccag

SEQ ID NO: 559248 - DNA, 20 bp, mouse
gtgacacgggaagcaaacaa

SEQ ID NO: 559249 - DNA, 20 bp, mouse
ggcgccccccatgtaggcac

SEQ ID NO: 559250 - DNA, 20 bp, mouse
gccacagccagtgcctacat

SEQ ID NO: 559251 - DNA, 20 bp, mouse
gcggctgctcagaactgcac

SEQ ID NO: 559252 - DNA, 20 bp, mouse
gcggcctgccgtaaagatag

SEQ ID NO: 559253 - DNA, 20 bp, mouse
gccgaggcggagaagatcgt

SEQ ID NO: 559254 - DNA, 20 bp, mouse
gtggctgtggttaccagcgc

SEQ ID NO: 559255 - DNA, 20 bp, mouse
ggcatttcatgcctccaaca

SEQ ID NO: 559256 - DNA, 20 bp, mouse
ggaactgtcaaagcgatctg

SEQ ID NO: 559257 - DNA, 20 bp, mouse
gctgtcaaagcgatctgggg

SEQ ID NO: 559258 - DNA, 20 bp, mouse
gccacccagcgcctaaggcc

SEQ ID NO: 559259 - DNA, 20 bp, mouse
ggcgagccacccagcgccta

SEQ ID NO: 559260 - DNA, 20 bp, mouse
gggcttgtagctccgacccg

SEQ ID NO: 559261 - DNA, 20 bp, mouse
gtgctcctcactgttcatgg

SEQ ID NO: 559262 - DNA, 20 bp, mouse
ggggctggcggcccatgtac

SEQ ID NO: 559263 - DNA, 20 bp, mouse
gcccctgcgtgcctgtacat

SEQ ID NO: 559264 - DNA, 20 bp, mouse
gaaaggtccgggaggtggat

SEQ ID NO: 559265 - DNA, 20 bp, mouse
gacaagctcgctgggatcac

SEQ ID NO: 559266 - DNA, 20 bp, mouse
ggcaagccgcaggatacctg

SEQ ID NO: 559267 - DNA, 20 bp, mouse
gtccctggagaaggtacgga

SEQ ID NO: 559268 - DNA, 20 bp, mouse
gagcaccgcgggcccagcac

SEQ ID NO: 559269 - DNA, 20 bp, mouse
ggccccggtggcgaagaccc

SEQ ID NO: 559270 - DNA, 20 bp, mouse
gatggacgcgtccctggaga

SEQ ID NO: 559271 - DNA, 20 bp, mouse
ggcaccggacgcctcagcca

SEQ ID NO: 559272 - DNA, 20 bp, mouse
gtaggactaaggagtctcgt

SEQ ID NO: 559273 - DNA, 20 bp, mouse
ggaggccccgcccacccgac

SEQ ID NO: 559274 - DNA, 20 bp, mouse
gggagaaggtacggaaggag

SEQ ID NO: 559275 - DNA, 20 bp, mouse
gacggggaaaccagtcgccc

SEQ ID NO: 559276 - DNA, 20 bp, mouse
gtagtggcgcgtggtccagg

SEQ ID NO: 559277 - DNA, 20 bp, mouse
gccaggtggtgtcacaggct

SEQ ID NO: 559278 - DNA, 20 bp, mouse
ggcgcgcccagcgctcaata

SEQ ID NO: 559279 - DNA, 20 bp, mouse
gcgtctgcctgaccaacagt

SEQ ID NO: 559280 - DNA, 20 bp, mouse
ggctctggatggagagcacc

SEQ ID NO: 559281 - DNA, 20 bp, mouse
gacagctttcccggcatgga

SEQ ID NO: 559282 - DNA, 20 bp, mouse
gtgctcacttgcgggtctac

SEQ ID NO: 559283 - DNA, 20 bp, mouse
gcgctcaatagggacccaaa

SEQ ID NO: 559284 - DNA, 20 bp, mouse
gggcatggagggcgaatgcc

SEQ ID NO: 559285 - DNA, 20 bp, mouse
gtggggagcttacagcgggg

SEQ ID NO: 559286 - DNA, 20 bp, mouse
gcagccccgcgaagcccagg

SEQ ID NO: 559287 - DNA, 20 bp, mouse
gcgcgctgcgagcggctgcg

SEQ ID NO: 559288 - DNA, 20 bp, mouse
gtggcccagcacgtcgcgca

SEQ ID NO: 559289 - DNA, 20 bp, mouse
gcgaagcgcagcgccagctc

SEQ ID NO: 559290 - DNA, 20 bp, mouse
gcgctccctccgtggacaag

SEQ ID NO: 559291 - DNA, 20 bp, mouse
ggcgcagccccgcgaagccc

SEQ ID NO: 559292 - DNA, 20 bp, mouse
gtcgcagcgcgccatgcagc

SEQ ID NO: 559293 - DNA, 20 bp, mouse
gaggcgcgcggcacacagcg

SEQ ID NO: 559294 - DNA, 20 bp, mouse
ggacgtgctgggccaggcgc

SEQ ID NO: 559295 - DNA, 20 bp, mouse
gcggcgcgcgcggcccgagc

SEQ ID NO: 559296 - DNA, 20 bp, mouse
ggccacagaggaagcgacga

SEQ ID NO: 559297 - DNA, 20 bp, mouse
ggccctcgtcgcttcctctg

SEQ ID NO: 559298 - DNA, 20 bp, mouse
gcttctctgagctagagtca

SEQ ID NO: 559299 - DNA, 20 bp, mouse
gtctggctgatcaggtggta

SEQ ID NO: 559300 - DNA, 20 bp, mouse
ggctccagaactgccatagg

SEQ ID NO: 559301 - DNA, 20 bp, mouse
gtgctcctggtgctatgcag

SEQ ID NO: 559302 - DNA, 20 bp, mouse
gggccgatccaagattcaga

SEQ ID NO: 559303 - DNA, 20 bp, mouse
gggctgatcaggtggtaggg

SEQ ID NO: 559304 - DNA, 20 bp, mouse
gccggtgggagcttggacgg

SEQ ID NO: 559305 - DNA, 20 bp, mouse
ggggctaccaaatcccccta

SEQ ID NO: 559306 - DNA, 20 bp, mouse
ggaggtggccctgagttaag

SEQ ID NO: 559307 - DNA, 20 bp, mouse
gctgaccgaggccttcttac

SEQ ID NO: 559308 - DNA, 20 bp, mouse
gcggtcagcgacagccaatt

SEQ ID NO: 559309 - DNA, 20 bp, mouse
gcgaggccttcttaccggtg

SEQ ID NO: 559310 - DNA, 20 bp, mouse
gggccacctcaccggtaaga

SEQ ID NO: 559311 - DNA, 20 bp, mouse
gctcgcgaccacttaactca

SEQ ID NO: 559312 - DNA, 20 bp, mouse
gctatgggatagttaagagt

SEQ ID NO: 559313 - DNA, 20 bp, mouse
gtccggttccgacgccgaat

SEQ ID NO: 559314 - DNA, 20 bp, mouse
gtgtctggccccaatcccta

SEQ ID NO: 559315 - DNA, 20 bp, mouse
gtgcaggacctggatctaga

SEQ ID NO: 559316 - DNA, 20 bp, mouse
ggcagccactcgtacaggag

SEQ ID NO: 559317 - DNA, 20 bp, mouse
gtgcagaacagcctgcggga

SEQ ID NO: 559318 - DNA, 20 bp, mouse
ggttctgcagccactcgtac

SEQ ID NO: 559319 - DNA, 20 bp, mouse
ggaacagcctgcgggagggt

SEQ ID NO: 559320 - DNA, 20 bp, mouse
gcctgcccctcctgtacgag

SEQ ID NO: 559321 - DNA, 20 bp, mouse
gtggggacagtcccgagcag

SEQ ID NO: 559322 - DNA, 20 bp, mouse
ggtggctgcagaacagcctg

SEQ ID NO: 559323 - DNA, 20 bp, mouse
gtgcagcaaagcattgtcct

SEQ ID NO: 559324 - DNA, 20 bp, mouse
gagcaccatgcccatcaccc

SEQ ID NO: 559325 - DNA, 20 bp, mouse
gtccagcactggcccctggt

SEQ ID NO: 559326 - DNA, 20 bp, mouse
ggtcagtgatccaactatgg

SEQ ID NO: 559327 - DNA, 20 bp, mouse
gcagctgcaggtaggaagta

SEQ ID NO: 559328 - DNA, 20 bp, mouse
gtgggtcagtgatccaacta

SEQ ID NO: 559329 - DNA, 20 bp, mouse
gctgcagctgcctccatagt

SEQ ID NO: 559330 - DNA, 20 bp, mouse
ggacccaggacttaagagta

SEQ ID NO: 559331 - DNA, 20 bp, mouse
ggcccacaccttctgctgat

SEQ ID NO: 559332 - DNA, 20 bp, mouse
ggcctatcagcagaaggtgt

SEQ ID NO: 559333 - DNA, 20 bp, mouse
ggtccctactcttaagtcct

SEQ ID NO: 559334 - DNA, 20 bp, mouse
ggtaaggcgatatccttgaa

SEQ ID NO: 559335 - DNA, 20 bp, mouse
ggagagtcccgtctctgggt

SEQ ID NO: 559336 - DNA, 20 bp, mouse
ggtcccgcttctctagctca

SEQ ID NO: 559337 - DNA, 20 bp, mouse
gacgacagcggcaaaggcag

SEQ ID NO: 559338 - DNA, 20 bp, mouse
ggagacaagcgaccggctgt

SEQ ID NO: 559339 - DNA, 20 bp, mouse
ggcgccgtgagctagagaag

SEQ ID NO: 559340 - DNA, 20 bp, mouse
gctggagacgacagcggcaa

SEQ ID NO: 559341 - DNA, 20 bp, mouse
ggctggccgaggccagacac

SEQ ID NO: 559342 - DNA, 20 bp, mouse
ggccacgtcgccaagcccag

SEQ ID NO: 559343 - DNA, 20 bp, mouse
gcgcgcgcccgcagcaacag

SEQ ID NO: 559344 - DNA, 20 bp, mouse
ggcgcgcgttccggtgttcc

SEQ ID NO: 559345 - DNA, 20 bp, mouse
gagagaagcgggaccctgcg

SEQ ID NO: 559346 - DNA, 20 bp, mouse
ggcccgccagcgggcgacaa

SEQ ID NO: 559347 - DNA, 20 bp, mouse
gcggcacacgggaccaggtg

SEQ ID NO: 559348 - DNA, 20 bp, mouse
ggaggcaggaggtcctacat

SEQ ID NO: 559349 - DNA, 20 bp, mouse
gagcggcggcacacgggacc

SEQ ID NO: 559350 - DNA, 20 bp, mouse
gcagcagctgcgcggagcgt

SEQ ID NO: 559351 - DNA, 20 bp, mouse
gcctcgctacctctaggact

SEQ ID NO: 559352 - DNA, 20 bp, mouse
gtcaggacctgggatagctg

SEQ ID NO: 559353 - DNA, 20 bp, mouse
gactgtatcgcgcccgccag

SEQ ID NO: 559354 - DNA, 20 bp, mouse
gggcgcgatacagtgaacta

SEQ ID NO: 559355 - DNA, 20 bp, mouse
gcaagggcagcggcggcaca

SEQ ID NO: 559356 - DNA, 20 bp, mouse
gtcctcagacgctcccccgg

SEQ ID NO: 559357 - DNA, 20 bp, mouse
gccgctcgggccgcccccgg

SEQ ID NO: 559358 - DNA, 20 bp, mouse
ggcagtccgacgctgcctgg

SEQ ID NO: 559359 - DNA, 20 bp, mouse
gggcggcccgagcggcggac

SEQ ID NO: 559360 - DNA, 20 bp, mouse
ggcccccgggggagcgtctg

SEQ ID NO: 559361 - DNA, 20 bp, mouse
gaggcgccgccaggcagcgt

SEQ ID NO: 559362 - DNA, 20 bp, mouse
gcacggccgacgccaggatc

SEQ ID NO: 559363 - DNA, 20 bp, mouse
gaatgagcgcaggctctgtg

SEQ ID NO: 559364 - DNA, 20 bp, mouse
gcggcgggcgagggcgggaa

SEQ ID NO: 559365 - DNA, 20 bp, mouse
ggaactgtgcgagcagcgtg

SEQ ID NO: 559366 - DNA, 20 bp, mouse
gagagccctgctctgagcaa

SEQ ID NO: 559367 - DNA, 20 bp, mouse
gttccagcctaggctttggg

SEQ ID NO: 559368 - DNA, 20 bp, mouse
gttgggacagattccagcct

SEQ ID NO: 559369 - DNA, 20 bp, mouse
gaaacggggaaacaggacga

SEQ ID NO: 559370 - DNA, 20 bp, mouse
gggtgagagactccgacgtg

SEQ ID NO: 559371 - DNA, 20 bp, mouse
gtgggcagtcagccacacgt

SEQ ID NO: 559372 - DNA, 20 bp, mouse
gaaagcaaaaatggtaaacg

SEQ ID NO: 559373 - DNA, 20 bp, mouse
gctcgaggattccaaactgt

SEQ ID NO: 559374 - DNA, 20 bp, mouse
gagattccagcctaggcttt

SEQ ID NO: 559375 - DNA, 20 bp, mouse
gacaaagctacaagaaatgg

SEQ ID NO: 559376 - DNA, 20 bp, mouse
gagactagtagtgttcacag

SEQ ID NO: 559377 - DNA, 20 bp, mouse
ggagaatttccagtgcggag

SEQ ID NO: 559378 - DNA, 20 bp, mouse
gacttcatgaaggcattggt

SEQ ID NO: 559379 - DNA, 20 bp, mouse
gcgaaggatccgctccgcac

SEQ ID NO: 559380 - DNA, 20 bp, mouse
gggagcggatccttcgccac

SEQ ID NO: 559381 - DNA, 20 bp, mouse
gggtgaggatggccttccag

SEQ ID NO: 559382 - DNA, 20 bp, mouse
gaggagcacaggttaagtgg

SEQ ID NO: 559383 - DNA, 20 bp, mouse
gtactagtcttggaactcac

SEQ ID NO: 559384 - DNA, 20 bp, mouse
ggaactgtgacacccctgga

SEQ ID NO: 559385 - DNA, 20 bp, mouse
gctgtcttgggaaacagaag

SEQ ID NO: 559386 - DNA, 20 bp, mouse
ggggtacctgggcttcaggg

SEQ ID NO: 559387 - DNA, 20 bp, mouse
gacaaggtagcacaggacag

SEQ ID NO: 559388 - DNA, 20 bp, mouse
gggagaggttggattgggta

SEQ ID NO: 559389 - DNA, 20 bp, mouse
gctggagctgctggaggtct

SEQ ID NO: 559390 - DNA, 20 bp, mouse
ggagagcagtctgactctaa

SEQ ID NO: 559391 - DNA, 20 bp, mouse
gctgggtctgctcgcggaag

SEQ ID NO: 559392 - DNA, 20 bp, mouse
gcagtgactgaggttggatg

SEQ ID NO: 559393 - DNA, 20 bp, mouse
ggcacaggacaggggtacct

SEQ ID NO: 559394 - DNA, 20 bp, mouse
gcccagcacgagcagactga

SEQ ID NO: 559395 - DNA, 20 bp, mouse
gggccacagtcctctgactt

SEQ ID NO: 559396 - DNA, 20 bp, mouse
gatctaggtggactccaaga

SEQ ID NO: 559397 - DNA, 20 bp, mouse
gtggactccaagaaggactt

SEQ ID NO: 559398 - DNA, 20 bp, mouse
gtcctatgttatgagaggct

SEQ ID NO: 559399 - DNA, 20 bp, mouse
gtgctcttctgctgcagtaa

SEQ ID NO: 559400 - DNA, 20 bp, mouse
ggtgggaatgattcaggctg

SEQ ID NO: 559401 - DNA, 20 bp, mouse
ggcccagcctctcataacat

SEQ ID NO: 559402 - DNA, 20 bp, mouse
ggggttggagttgacatcaa

SEQ ID NO: 559403 - DNA, 20 bp, mouse
gtttggggtgggaatgattc

SEQ ID NO: 559404 - DNA, 20 bp, mouse
gcctgttggagaggataaag

SEQ ID NO: 559405 - DNA, 20 bp, mouse
gttatcctctccaacagggt

SEQ ID NO: 559406 - DNA, 20 bp, mouse
gcgaggcggcccagacacgc

SEQ ID NO: 559407 - DNA, 20 bp, mouse
ggccgcctcgcagggaggga

SEQ ID NO: 559408 - DNA, 20 bp, mouse
ggaggaagtctggagcaatt

SEQ ID NO: 559409 - DNA, 20 bp, mouse
gtccctccctccctgcgagg

SEQ ID NO: 559410 - DNA, 20 bp, mouse
gctgggccgcctcgcaggga

SEQ ID NO: 559411 - DNA, 20 bp, mouse
gcggcgtagccggcgtgtct

SEQ ID NO: 559412 - DNA, 20 bp, mouse
gagcaattaggctcagtcct

SEQ ID NO: 559413 - DNA, 20 bp, mouse
ggtgtctgggccgcctcgca

SEQ ID NO: 559414 - DNA, 20 bp, mouse
gagagagcgggcggcgtagc

SEQ ID NO: 559415 - DNA, 20 bp, mouse
gaatacgtggccgcacgggg

SEQ ID NO: 559416 - DNA, 20 bp, mouse
gctactgtgtggccaggtac

SEQ ID NO: 559417 - DNA, 20 bp, mouse
gcaagctgcgccagggccag

SEQ ID NO: 559418 - DNA, 20 bp, mouse
gtcacccccaagctgcgcca

SEQ ID NO: 559419 - DNA, 20 bp, mouse
ggcgtgcagtgcaactacag

SEQ ID NO: 559420 - DNA, 20 bp, mouse
gagcgtctccccgccgccca

SEQ ID NO: 559421 - DNA, 20 bp, mouse
ggctggaccaggctgcgcag

SEQ ID NO: 559422 - DNA, 20 bp, mouse
gtccctcccaccactagcat

SEQ ID NO: 559423 - DNA, 20 bp, mouse
gtcagcagcggtaagaccgc

SEQ ID NO: 559424 - DNA, 20 bp, mouse
ggacagcaggcgacaaccag

SEQ ID NO: 559425 - DNA, 20 bp, mouse
ggcggtaagaccgctggccc

SEQ ID NO: 559426 - DNA, 20 bp, mouse
ggcggcggcggcaggatcgg

SEQ ID NO: 559427 - DNA, 20 bp, mouse
gccacgggcggaagaggcgg

SEQ ID NO: 559428 - DNA, 20 bp, mouse
ggaggcggcggcggcaggat

SEQ ID NO: 559429 - DNA, 20 bp, mouse
gggctcaagctctgctccac

SEQ ID NO: 559430 - DNA, 20 bp, mouse
gtcaagctctgctccacggg

SEQ ID NO: 559431 - DNA, 20 bp, mouse
gtctgctccacgggcggaag

SEQ ID NO: 559432 - DNA, 20 bp, mouse
ggctccggaggcggtgagag

SEQ ID NO: 559433 - DNA, 20 bp, mouse
gcggacgcaggggacaaata

SEQ ID NO: 559434 - DNA, 20 bp, mouse
gtcagggtgcgggcactccc

SEQ ID NO: 559435 - DNA, 20 bp, mouse
gagctaaagcgaggagggag

SEQ ID NO: 559436 - DNA, 20 bp, mouse
gcggagctcggagctcagag

SEQ ID NO: 559437 - DNA, 20 bp, mouse
ggtcggccagcaggacccgt

SEQ ID NO: 559438 - DNA, 20 bp, mouse
ggagcggcgtgttgtaccga

SEQ ID NO: 559439 - DNA, 20 bp, mouse
gctggctgcgcgggcaggaa

SEQ ID NO: 559440 - DNA, 20 bp, mouse
gtgcctcggggctcggagct

SEQ ID NO: 559441 - DNA, 20 bp, mouse
gtcctgctggccgacagagc

SEQ ID NO: 559442 - DNA, 20 bp, mouse
gttgtaccgacgggtcctgc

SEQ ID NO: 559443 - DNA, 20 bp, mouse
gtctggagcccgagaccgct

SEQ ID NO: 559444 - DNA, 20 bp, mouse
gtgaaacctgaagagaggaa

SEQ ID NO: 559445 - DNA, 20 bp, mouse
gctgcgtagctctgaggata

SEQ ID NO: 559446 - DNA, 20 bp, mouse
ggctaacgcccacccaggta

SEQ ID NO: 559447 - DNA, 20 bp, mouse
gccgccgccggggagaccgg

SEQ ID NO: 559448 - DNA, 20 bp, mouse
ggctcccgtccggtatacaa

SEQ ID NO: 559449 - DNA, 20 bp, mouse
gtgtcccccggtctccccgg

SEQ ID NO: 559450 - DNA, 20 bp, mouse
ggcccacaccgtacctgggt

SEQ ID NO: 559451 - DNA, 20 bp, mouse
gctttacgttaacagcgctc

SEQ ID NO: 559452 - DNA, 20 bp, mouse
ggcgggcccacaccgtacct

SEQ ID NO: 559453 - DNA, 20 bp, mouse
gcctgcggttggtcccgggg

SEQ ID NO: 559454 - DNA, 20 bp, mouse
gagaccgggggacagcgggg

SEQ ID NO: 559455 - DNA, 20 bp, mouse
ggcccacccaggtacggtgt

SEQ ID NO: 559456 - DNA, 20 bp, mouse
gattccccaggagagaacaa

SEQ ID NO: 559457 - DNA, 20 bp, mouse
ggctggcaggggtcccttcg

SEQ ID NO: 559458 - DNA, 20 bp, mouse
gatgtttgcagagggagcac

SEQ ID NO: 559459 - DNA, 20 bp, mouse
gtatttgtctaatgggatga

SEQ ID NO: 559460 - DNA, 20 bp, mouse
gtactgtgagggtaccccga

SEQ ID NO: 559461 - DNA, 20 bp, mouse
gtggctcctgatgtgacata

SEQ ID NO: 559462 - DNA, 20 bp, mouse
gcattagacaaatactgtga

SEQ ID NO: 559463 - DNA, 20 bp, mouse
gaagcagttggctgttgggg

SEQ ID NO: 559464 - DNA, 20 bp, mouse
gacaggacaggggaagcagt

SEQ ID NO: 559465 - DNA, 20 bp, mouse
gacccctgccagcttcaaaa

SEQ ID NO: 559466 - DNA, 20 bp, mouse
gggtctctgcgcgcctggag

SEQ ID NO: 559467 - DNA, 20 bp, mouse
gtctggtacttgtcaggtaa

SEQ ID NO: 559468 - DNA, 20 bp, mouse
gacctgacaagtaccagagc

SEQ ID NO: 559469 - DNA, 20 bp, mouse
gtcttccggccatgcctcag

SEQ ID NO: 559470 - DNA, 20 bp, mouse
gagctgaggtgggcctcagt

SEQ ID NO: 559471 - DNA, 20 bp, mouse
gaccagctctggtacttgtc

SEQ ID NO: 559472 - DNA, 20 bp, mouse
gggtacttgtcaggtaatgg

SEQ ID NO: 559473 - DNA, 20 bp, mouse
gacagcaggcttctggtctg

SEQ ID NO: 559474 - DNA, 20 bp, mouse
ggagctggtctctgcgcgcc

SEQ ID NO: 559475 - DNA, 20 bp, mouse
gcagcgtgagtcccagagcc

SEQ ID NO: 559476 - DNA, 20 bp, mouse
gactggtcagagctacctag

SEQ ID NO: 559477 - DNA, 20 bp, mouse
gccatgggctcttggaagac

SEQ ID NO: 559478 - DNA, 20 bp, mouse
gggtccagctcgggtaaact

SEQ ID NO: 559479 - DNA, 20 bp, mouse
ggtacgtgagcaggcctctg

SEQ ID NO: 559480 - DNA, 20 bp, mouse
gtacccgagctggacctctg

SEQ ID NO: 559481 - DNA, 20 bp, mouse
ggctacttctgaggaacacg

SEQ ID NO: 559482 - DNA, 20 bp, mouse
gtcagagctacctagcggcc

SEQ ID NO: 559483 - DNA, 20 bp, mouse
ggctgggctagtgtccgcag

SEQ ID NO: 559484 - DNA, 20 bp, mouse
ggggttgctgaagaaccaag

SEQ ID NO: 559485 - DNA, 20 bp, mouse
gaggggagtgctggcggacc

SEQ ID NO: 559486 - DNA, 20 bp, mouse
ggccagctatccaaacggac

SEQ ID NO: 559487 - DNA, 20 bp, mouse
gccatggccagctatccaaa

SEQ ID NO: 559488 - DNA, 20 bp, mouse
ggacgtcacacaactgtggt

SEQ ID NO: 559489 - DNA, 20 bp, mouse
gcgaggatggagagtggtac

SEQ ID NO: 559490 - DNA, 20 bp, mouse
ggtcacataggaccactcga

SEQ ID NO: 559491 - DNA, 20 bp, mouse
gggacggtgctgagagagtc

SEQ ID NO: 559492 - DNA, 20 bp, mouse
gggcccctgcgtcaatattt

SEQ ID NO: 559493 - DNA, 20 bp, mouse
gaagtggggagaaagagccg

SEQ ID NO: 559494 - DNA, 20 bp, mouse
gtgtgacgtcataaccgcca

SEQ ID NO: 559495 - DNA, 20 bp, mouse
gagcccaaatattgacgcag

SEQ ID NO: 559496 - DNA, 20 bp, mouse
gcagcccgcgcagcagacct

SEQ ID NO: 559497 - DNA, 20 bp, mouse
ggctctccccaggtcgtagt

SEQ ID NO: 559498 - DNA, 20 bp, mouse
gcctgaccaactacgacctg

SEQ ID NO: 559499 - DNA, 20 bp, mouse
gagacctaggcgaggctcgg

SEQ ID NO: 559500 - DNA, 20 bp, mouse
gggagagcagccaaccgaga

SEQ ID NO: 559501 - DNA, 20 bp, mouse
gctcggtggaccttctcggt

SEQ ID NO: 559502 - DNA, 20 bp, mouse
gcgcgcagcagacctaggcg

SEQ ID NO: 559503 - DNA, 20 bp, mouse
ggaggctcggtggaccttct

SEQ ID NO: 559504 - DNA, 20 bp, mouse
ggacacacaccaactcaagt

SEQ ID NO: 559505 - DNA, 20 bp, mouse
gagcagacctaggcgaggct

SEQ ID NO: 559506 - DNA, 20 bp, mouse
ggagcgcacagcctgcccag

SEQ ID NO: 559507 - DNA, 20 bp, mouse
ggctgcggaggaggatactg

SEQ ID NO: 559508 - DNA, 20 bp, mouse
ggtctatccgggtcaccggg

SEQ ID NO: 559509 - DNA, 20 bp, mouse
gttgagtacaaatgtccact

SEQ ID NO: 559510 - DNA, 20 bp, mouse
gatttggaagagacatgcgt

SEQ ID NO: 559511 - DNA, 20 bp, mouse
ggtacaaatgtccactgggc

SEQ ID NO: 559512 - DNA, 20 bp, mouse
ggtgcagggtctcccatatt

SEQ ID NO: 559513 - DNA, 20 bp, mouse
gctaacattgagatgattcc

SEQ ID NO: 559514 - DNA, 20 bp, mouse
gctgcacacctggcaagcta

SEQ ID NO: 559515 - DNA, 20 bp, mouse
gcagtaggacgagatgtaca

SEQ ID NO: 559516 - DNA, 20 bp, mouse
gctgggtggaggccaagtct

SEQ ID NO: 559517 - DNA, 20 bp, mouse
gcgcggaagctgggacctcc

SEQ ID NO: 559518 - DNA, 20 bp, mouse
gggaggccaagtctgggacg

SEQ ID NO: 559519 - DNA, 20 bp, mouse
ggcgcgctgtccctgcccgg

SEQ ID NO: 559520 - DNA, 20 bp, mouse
ggccgcgggagccggaacct

SEQ ID NO: 559521 - DNA, 20 bp, mouse
ggcagagccccccagagtca

SEQ ID NO: 559522 - DNA, 20 bp, mouse
gggcgggacgcgtctgggaa

SEQ ID NO: 559523 - DNA, 20 bp, mouse
gaagctgggacctccgggca

SEQ ID NO: 559524 - DNA, 20 bp, mouse
gatgccgtgccggagggaag

SEQ ID NO: 559525 - DNA, 20 bp, mouse
ggctgtgcgggcgtcactgg

SEQ ID NO: 559526 - DNA, 20 bp, mouse
ggcgggaggacgagcatcgg

SEQ ID NO: 559527 - DNA, 20 bp, mouse
gacgagcatcggaggagaag

SEQ ID NO: 559528 - DNA, 20 bp, mouse
ggtcgcgggaggacgagcat

SEQ ID NO: 559529 - DNA, 20 bp, mouse
gctggggagtcaggagtcgc

SEQ ID NO: 559530 - DNA, 20 bp, mouse
ggcggagagatgtccaccct

SEQ ID NO: 559531 - DNA, 20 bp, mouse
gctgcagacgctggggagtc

SEQ ID NO: 559532 - DNA, 20 bp, mouse
gctgcagacggtatctaaga

SEQ ID NO: 559533 - DNA, 20 bp, mouse
gcgggcgcccggttcagtgt

SEQ ID NO: 559534 - DNA, 20 bp, mouse
gggggcggcagaccatatca

SEQ ID NO: 559535 - DNA, 20 bp, mouse
gcacacaccccgaccagggt

SEQ ID NO: 559536 - DNA, 20 bp, mouse
gttgctggcgctggagaagg

SEQ ID NO: 559537 - DNA, 20 bp, mouse
gacccaaaggcggttcgagg

SEQ ID NO: 559538 - DNA, 20 bp, mouse
ggaggcggagggaccgtcgg

SEQ ID NO: 559539 - DNA, 20 bp, mouse
gtgtgtcagtgacccaaagg

SEQ ID NO: 559540 - DNA, 20 bp, mouse
gttcgaggcggagggaccgt

SEQ ID NO: 559541 - DNA, 20 bp, mouse
ggggctgcaggcagatccgg

SEQ ID NO: 559542 - DNA, 20 bp, mouse
ggtgacccaaaggcggttcg

SEQ ID NO: 559543 - DNA, 20 bp, mouse
gcccgccgcacggacacccg

SEQ ID NO: 559544 - DNA, 20 bp, mouse
gtcactgacacacactggga

SEQ ID NO: 559545 - DNA, 20 bp, mouse
gcccgggctgcaggcagatc

SEQ ID NO: 559546 - DNA, 20 bp, mouse
ggctcgtagcggccaacgta

SEQ ID NO: 559547 - DNA, 20 bp, mouse
gacccggcacggaaagcgag

SEQ ID NO: 559548 - DNA, 20 bp, mouse
gctacgagcgggacccggca

SEQ ID NO: 559549 - DNA, 20 bp, mouse
gcccggagctatccgtacgt

SEQ ID NO: 559550 - DNA, 20 bp, mouse
gagcggcgaccagagccccg

SEQ ID NO: 559551 - DNA, 20 bp, mouse
ggccaacgtacggatagctc

SEQ ID NO: 559552 - DNA, 20 bp, mouse
gtagctccggggaagccggc

SEQ ID NO: 559553 - DNA, 20 bp, mouse
ggcgacgcgcacagccacga

SEQ ID NO: 559554 - DNA, 20 bp, mouse
gtcccgcggctgctccgtcg

SEQ ID NO: 559555 - DNA, 20 bp, mouse
gaccagagccccgcgggagg

SEQ ID NO: 559556 - DNA, 20 bp, mouse
gctcggtgcagcctcgtcac

SEQ ID NO: 559557 - DNA, 20 bp, mouse
gtcccgccgcggcagtcccg

SEQ ID NO: 559558 - DNA, 20 bp, mouse
gctcgggtgtccccgtgacg

SEQ ID NO: 559559 - DNA, 20 bp, mouse
ggcatacccaagaactccta

SEQ ID NO: 559560 - DNA, 20 bp, mouse
gctgcgccccgggactgccg

SEQ ID NO: 559561 - DNA, 20 bp, mouse
gacacccgaggcccggagga

SEQ ID NO: 559562 - DNA, 20 bp, mouse
gcagtagaggtgaggcgggt

SEQ ID NO: 559563 - DNA, 20 bp, mouse
gggggacacccgaggcccgg

SEQ ID NO: 559564 - DNA, 20 bp, mouse
ggttaagagagcgggtctga

SEQ ID NO: 559565 - DNA, 20 bp, mouse
gccgcgggcagtgcctagac

SEQ ID NO: 559566 - DNA, 20 bp, mouse
gagcttcatgacctcagcag

SEQ ID NO: 559567 - DNA, 20 bp, mouse
ggaacaggggacgctagggg

SEQ ID NO: 559568 - DNA, 20 bp, mouse
gcgaggagcccgaggacatg

SEQ ID NO: 559569 - DNA, 20 bp, mouse
gcccgcgaaaccggctgacg

SEQ ID NO: 559570 - DNA, 20 bp, mouse
ggccccggccccccctcctg

SEQ ID NO: 559571 - DNA, 20 bp, mouse
gggggctcagttcagaacag

SEQ ID NO: 559572 - DNA, 20 bp, mouse
ggtcgccggccccgcgaaac

SEQ ID NO: 559573 - DNA, 20 bp, mouse
gtccagaccgagtcctccac

SEQ ID NO: 559574 - DNA, 20 bp, mouse
gacgctgcctgtggaggact

SEQ ID NO: 559575 - DNA, 20 bp, mouse
gaggccccgcctctctggta

SEQ ID NO: 559576 - DNA, 20 bp, mouse
gagatcgccctctcagtgaa

SEQ ID NO: 559577 - DNA, 20 bp, mouse
gtgtttaggctaaagtccac

SEQ ID NO: 559578 - DNA, 20 bp, mouse
gcggctgcagcgccctggag

SEQ ID NO: 559579 - DNA, 20 bp, mouse
gcagcaaagcaaaccttaaa

SEQ ID NO: 559580 - DNA, 20 bp, mouse
gtgtccggcagcggccccag

SEQ ID NO: 559581 - DNA, 20 bp, mouse
gacttcgcgggaccgtgttt

SEQ ID NO: 559582 - DNA, 20 bp, mouse
ggagatgtggcaatccatct

SEQ ID NO: 559583 - DNA, 20 bp, mouse
gaaaggcagatgtcccttta

SEQ ID NO: 559584 - DNA, 20 bp, mouse
gacatctgcctttcactgag

SEQ ID NO: 559585 - DNA, 20 bp, mouse
gcagcgacgtactggttcgt

SEQ ID NO: 559586 - DNA, 20 bp, mouse
gctcgagcctgtgaagatgg

SEQ ID NO: 559587 - DNA, 20 bp, mouse
gccgccaggagccccagctg

SEQ ID NO: 559588 - DNA, 20 bp, mouse
ggcggcggccgttcttagtg

SEQ ID NO: 559589 - DNA, 20 bp, mouse
gcccaccgcagagagacccc

SEQ ID NO: 559590 - DNA, 20 bp, mouse
gtcttcacaggctcgagcaa

SEQ ID NO: 559591 - DNA, 20 bp, mouse
gttattgaggctgcatggga

SEQ ID NO: 559592 - DNA, 20 bp, mouse
ggcgagcgccagcgttgggg

SEQ ID NO: 559593 - DNA, 20 bp, mouse
gagagacccccgggcccgcc

SEQ ID NO: 559594 - DNA, 20 bp, mouse
gacaggctcgagcaatggcg

SEQ ID NO: 559595 - DNA, 20 bp, mouse
gtggggcgcaggtaagtctg

SEQ ID NO: 559596 - DNA, 20 bp, mouse
gatagcagttctaccacact

SEQ ID NO: 559597 - DNA, 20 bp, mouse
ggctgggaggcaggacgtag

SEQ ID NO: 559598 - DNA, 20 bp, mouse
gagaacccccacaagctgaa

SEQ ID NO: 559599 - DNA, 20 bp, mouse
gtgacctcaagggagaactt

SEQ ID NO: 559600 - DNA, 20 bp, mouse
gccttcctttcagcttgtgg

SEQ ID NO: 559601 - DNA, 20 bp, mouse
gcagcctccagggacagctc

SEQ ID NO: 559602 - DNA, 20 bp, mouse
gtgacctgagctgtccctgg

SEQ ID NO: 559603 - DNA, 20 bp, mouse
gtaggagtcaagcctcctga

SEQ ID NO: 559604 - DNA, 20 bp, mouse
gattaggcatctgacctcaa

SEQ ID NO: 559605 - DNA, 20 bp, mouse
gagccatcccagcaaaggag

SEQ ID NO: 559606 - DNA, 20 bp, mouse
gcgcgtcggggagctctgcg

SEQ ID NO: 559607 - DNA, 20 bp, mouse
ggtgtaaagcggccgcgtcg

SEQ ID NO: 559608 - DNA, 20 bp, mouse
ggcaccgagggaacaggcga

SEQ ID NO: 559609 - DNA, 20 bp, mouse
gtgaggaaccccgagaaagt

SEQ ID NO: 559610 - DNA, 20 bp, mouse
gggcgccgggcagcgtcgct

SEQ ID NO: 559611 - DNA, 20 bp, mouse
gaaagaaggcaagtgtaaag

SEQ ID NO: 559612 - DNA, 20 bp, mouse
gtggccgccgccagcaaggc

SEQ ID NO: 559613 - DNA, 20 bp, mouse
ggaacaggcgacggtcgcca

SEQ ID NO: 559614 - DNA, 20 bp, mouse
gggacgaacgcatgcaccga

SEQ ID NO: 559615 - DNA, 20 bp, mouse
gcgcttgggggaataggacc

SEQ ID NO: 559616 - DNA, 20 bp, mouse
ggagcgggcgacccacgttg

SEQ ID NO: 559617 - DNA, 20 bp, mouse
gtgcggacagaacactagaa

SEQ ID NO: 559618 - DNA, 20 bp, mouse
gtcagacgggatgcagaaag

SEQ ID NO: 559619 - DNA, 20 bp, mouse
gtagccaggagagtccgtag

SEQ ID NO: 559620 - DNA, 20 bp, mouse
gctggagttggggttcagac

SEQ ID NO: 559621 - DNA, 20 bp, mouse
gcacgtctactacccctcta

SEQ ID NO: 559622 - DNA, 20 bp, mouse
gagtgttctgtccgcaacgt

SEQ ID NO: 559623 - DNA, 20 bp, mouse
ggagtgcctgtgagcgctgg

SEQ ID NO: 559624 - DNA, 20 bp, mouse
gccgtaaaggacctagagat

SEQ ID NO: 559625 - DNA, 20 bp, mouse
ggagaggcgtagacgcgaaa

SEQ ID NO: 559626 - DNA, 20 bp, mouse
gcgggccgcaggcagggcaa

SEQ ID NO: 559627 - DNA, 20 bp, mouse
gtctacgcgggccgcaggca

SEQ ID NO: 559628 - DNA, 20 bp, mouse
gcgctagcgccgagtgaaca

SEQ ID NO: 559629 - DNA, 20 bp, mouse
gtgttcagctaggaataccg

SEQ ID NO: 559630 - DNA, 20 bp, mouse
gggcagccgcaagcatgcag

SEQ ID NO: 559631 - DNA, 20 bp, mouse
ggcgtcagctgaaccagcta

SEQ ID NO: 559632 - DNA, 20 bp, mouse
gaggcaggccacctctacgc

SEQ ID NO: 559633 - DNA, 20 bp, mouse
gccgccccacgagggccagt

SEQ ID NO: 559634 - DNA, 20 bp, mouse
gcggaaccgagagccgggct

SEQ ID NO: 559635 - DNA, 20 bp, mouse
gtgccacactcgggactcca

SEQ ID NO: 559636 - DNA, 20 bp, mouse
gtcgacggctccagagtaag

SEQ ID NO: 559637 - DNA, 20 bp, mouse
gggcctcgaggactctgtgg

SEQ ID NO: 559638 - DNA, 20 bp, mouse
gcccaaaaacacaagttcga

SEQ ID NO: 559639 - DNA, 20 bp, mouse
gcagatctctcaccactcta

SEQ ID NO: 559640 - DNA, 20 bp, mouse
gggaagagaccgccccggta

SEQ ID NO: 559641 - DNA, 20 bp, mouse
gaggtgcgctcgaccaaaag

SEQ ID NO: 559642 - DNA, 20 bp, mouse
gcgctaggcattagtgtcca

SEQ ID NO: 559643 - DNA, 20 bp, mouse
gaccacaagttcaactctag

SEQ ID NO: 559644 - DNA, 20 bp, mouse
ggttcccgcccgccctaccg

SEQ ID NO: 559645 - DNA, 20 bp, mouse
ggaagcccctagccatccga

SEQ ID NO: 559646 - DNA, 20 bp, mouse
ggcgctcgaacggccaggta

SEQ ID NO: 559647 - DNA, 20 bp, mouse
gtgcagcagggatccctacc

SEQ ID NO: 559648 - DNA, 20 bp, mouse
gtctgggttgcgggccgaaa

SEQ ID NO: 559649 - DNA, 20 bp, mouse
ggaaacggcaagcggatgga

SEQ ID NO: 559650 - DNA, 20 bp, mouse
ggatccctgctgcaatccta

SEQ ID NO: 559651 - DNA, 20 bp, mouse
gcggatggagggcgctcgaa

SEQ ID NO: 559652 - DNA, 20 bp, mouse
gcgggacaaagactaaccct

SEQ ID NO: 559653 - DNA, 20 bp, mouse
gggccgaaacggcaagcgga

SEQ ID NO: 559654 - DNA, 20 bp, mouse
gggagggcgctcgaacggcc

SEQ ID NO: 559655 - DNA, 20 bp, mouse
ggaagctccgcgaggctggg

SEQ ID NO: 559656 - DNA, 20 bp, mouse
ggcggcgctactgggactag

SEQ ID NO: 559657 - DNA, 20 bp, mouse
gacagcggagggcgacgcgg

SEQ ID NO: 559658 - DNA, 20 bp, mouse
gtgggactagcggctccggg

SEQ ID NO: 559659 - DNA, 20 bp, mouse
ggccgagcgcaccaagtgac

SEQ ID NO: 559660 - DNA, 20 bp, mouse
ggtgacagcggagggcgacg

SEQ ID NO: 559661 - DNA, 20 bp, mouse
ggccctccgctgtcacatag

SEQ ID NO: 559662 - DNA, 20 bp, mouse
gtagcggctccgggcggctg

SEQ ID NO: 559663 - DNA, 20 bp, mouse
gtactgggactagcggctcc

SEQ ID NO: 559664 - DNA, 20 bp, mouse
gcggcggcagcggcgctact

SEQ ID NO: 559665 - DNA, 20 bp, mouse
gttccactatgtgacagcgg

SEQ ID NO: 559666 - DNA, 20 bp, mouse
gagcaacgtccggcgtgacc

SEQ ID NO: 559667 - DNA, 20 bp, mouse
gtacagcgacagctcgatgg

SEQ ID NO: 559668 - DNA, 20 bp, mouse
gggcttcccagcaaggacgg

SEQ ID NO: 559669 - DNA, 20 bp, mouse
ggactggactgcccgcgggt

SEQ ID NO: 559670 - DNA, 20 bp, mouse
gcacctcagagagcaacgtc

SEQ ID NO: 559671 - DNA, 20 bp, mouse
gtggctggacggaccaccag

SEQ ID NO: 559672 - DNA, 20 bp, mouse
ggccggcttcccagcaagga

SEQ ID NO: 559673 - DNA, 20 bp, mouse
gggacgcctgcgagcccgca

SEQ ID NO: 559674 - DNA, 20 bp, mouse
gcagcagcgcccggccgtgc

SEQ ID NO: 559675 - DNA, 20 bp, mouse
ggtcaccccagcagagtctg

SEQ ID NO: 559676 - DNA, 20 bp, mouse
gcagcgcagcatgtcgtcgg

SEQ ID NO: 559677 - DNA, 20 bp, mouse
gcgcggagcggaggaacgcc

SEQ ID NO: 559678 - DNA, 20 bp, mouse
gccgcagcgcagcatgtcgt

SEQ ID NO: 559679 - DNA, 20 bp, mouse
gcaggagcagcggccaagag

SEQ ID NO: 559680 - DNA, 20 bp, mouse
ggcgctcgcaggaccactct

SEQ ID NO: 559681 - DNA, 20 bp, mouse
gcgcagcatgtcgtcggtgg

SEQ ID NO: 559682 - DNA, 20 bp, mouse
ggagcggaggaacgccgggc

SEQ ID NO: 559683 - DNA, 20 bp, mouse
gccgcgactaaaggaagagg

SEQ ID NO: 559684 - DNA, 20 bp, mouse
gagcatgtcgtcggtggcgg

SEQ ID NO: 559685 - DNA, 20 bp, mouse
ggcagcggctcctacgacga

SEQ ID NO: 559686 - DNA, 20 bp, mouse
gctccacgttgagaaattca

SEQ ID NO: 559687 - DNA, 20 bp, mouse
ggtgcgggaggaagtagctc

SEQ ID NO: 559688 - DNA, 20 bp, mouse
gtccttcagggccctaggca

SEQ ID NO: 559689 - DNA, 20 bp, mouse
gagccgggaagaactgtgac

SEQ ID NO: 559690 - DNA, 20 bp, mouse
gtaggcagggcacgtgcggg

SEQ ID NO: 559691 - DNA, 20 bp, mouse
gccggagctccgacctccgc

SEQ ID NO: 559692 - DNA, 20 bp, mouse
gagttcttcccggcttccag

SEQ ID NO: 559693 - DNA, 20 bp, mouse
ggccctaggcagggcacgtg

SEQ ID NO: 559694 - DNA, 20 bp, mouse
ggagcgaaccttctgcacgt

SEQ ID NO: 559695 - DNA, 20 bp, mouse
gtaagtgcgctcctgagaaa

SEQ ID NO: 559696 - DNA, 20 bp, mouse
gaaaccgaagagcgagatgg

SEQ ID NO: 559697 - DNA, 20 bp, mouse
ggaaggagcactagatgtgg

SEQ ID NO: 559698 - DNA, 20 bp, mouse
gagtcgactttgggcggaag

SEQ ID NO: 559699 - DNA, 20 bp, mouse
gcccttgggcagcaccaatg

SEQ ID NO: 559700 - DNA, 20 bp, mouse
gagggaagcgtctcagagat

SEQ ID NO: 559701 - DNA, 20 bp, mouse
gtatatgagatgctacgggt

SEQ ID NO: 559702 - DNA, 20 bp, mouse
gagggtggttcaaggaaggg

SEQ ID NO: 559703 - DNA, 20 bp, mouse
gtgctgcccaagggccaata

SEQ ID NO: 559704 - DNA, 20 bp, mouse
ggtaaaaccgaagagcgaga

SEQ ID NO: 559705 - DNA, 20 bp, mouse
gagagaagcgcaaggcaggg

SEQ ID NO: 559706 - DNA, 20 bp, mouse
gggaaacccaagcgcagcat

SEQ ID NO: 559707 - DNA, 20 bp, mouse
gtaaagcccagcgtcttcca

SEQ ID NO: 559708 - DNA, 20 bp, mouse
gagtctgagagccacttcgg

SEQ ID NO: 559709 - DNA, 20 bp, mouse
gggtttccctggaagacgct

SEQ ID NO: 559710 - DNA, 20 bp, mouse
ggacttcggcgacgctatgg

SEQ ID NO: 559711 - DNA, 20 bp, mouse
ggagcctcgcggcagaggga

SEQ ID NO: 559712 - DNA, 20 bp, mouse
gaagacgctgggctttaaca

SEQ ID NO: 559713 - DNA, 20 bp, mouse
gggtcacctgaccgggactt

SEQ ID NO: 559714 - DNA, 20 bp, mouse
gcgggacttcggcgacgcta

SEQ ID NO: 559715 - DNA, 20 bp, mouse
gcggcgcccatgctgcgctt

SEQ ID NO: 559716 - DNA, 20 bp, mouse
ggccacgaggcgggagactg

SEQ ID NO: 559717 - DNA, 20 bp, mouse
ggccgggagcgggaatgtcg

SEQ ID NO: 559718 - DNA, 20 bp, mouse
gggtcgagcctggcccgttg

SEQ ID NO: 559719 - DNA, 20 bp, mouse
gacgcgcgcagggacagctg

SEQ ID NO: 559720 - DNA, 20 bp, mouse
gggaatgtcgaggagttcga

SEQ ID NO: 559721 - DNA, 20 bp, mouse
gtctgaagcagcggcaggac

SEQ ID NO: 559722 - DNA, 20 bp, mouse
gctcggcgccccggaagacg

SEQ ID NO: 559723 - DNA, 20 bp, mouse
gcaacggctctgcgctcgag

SEQ ID NO: 559724 - DNA, 20 bp, mouse
ggccgcagccgcaacgggcc

SEQ ID NO: 559725 - DNA, 20 bp, mouse
ggcgacgatagcacttgcaa

SEQ ID NO: 559726 - DNA, 20 bp, mouse
gtgaagaagcacgcagcaag

SEQ ID NO: 559727 - DNA, 20 bp, mouse
gcactcggcacagctgtcac

SEQ ID NO: 559728 - DNA, 20 bp, mouse
gatgagagccctgtaaaacg

SEQ ID NO: 559729 - DNA, 20 bp, mouse
ggaccagaaactgcgtgctg

SEQ ID NO: 559730 - DNA, 20 bp, mouse
gtacatcacggtagctgatg

SEQ ID NO: 559731 - DNA, 20 bp, mouse
gaactccacaaggtcgtcac

SEQ ID NO: 559732 - DNA, 20 bp, mouse
gacggtctccccgttttaca

SEQ ID NO: 559733 - DNA, 20 bp, mouse
gagcactccacaactccaca

SEQ ID NO: 559734 - DNA, 20 bp, mouse
gtatgctaagttacccagag

SEQ ID NO: 559735 - DNA, 20 bp, mouse
gtacgttgctgtcaattacc

SEQ ID NO: 559736 - DNA, 20 bp, mouse
gaccggagagcggagtccac

SEQ ID NO: 559737 - DNA, 20 bp, mouse
gtcacctgacgagaagccgg

SEQ ID NO: 559738 - DNA, 20 bp, mouse
ggttgaaccttgggacaatg

SEQ ID NO: 559739 - DNA, 20 bp, mouse
ggccggtggactccgctctc

SEQ ID NO: 559740 - DNA, 20 bp, mouse
gtagtcccacgagacgtcag

SEQ ID NO: 559741 - DNA, 20 bp, mouse
gccacctccgaagctctagg

SEQ ID NO: 559742 - DNA, 20 bp, mouse
gccggtgagagttgaacctt

SEQ ID NO: 559743 - DNA, 20 bp, mouse
ggccgggcgtgggaagaggg

SEQ ID NO: 559744 - DNA, 20 bp, mouse
gtctcgtcaggtgagagcgt

SEQ ID NO: 559745 - DNA, 20 bp, mouse
gcgctgcaccggcaactcgt

SEQ ID NO: 559746 - DNA, 20 bp, mouse
ggctgcccggatcacttcag

SEQ ID NO: 559747 - DNA, 20 bp, mouse
gggtgcccctgaagtgatcc

SEQ ID NO: 559748 - DNA, 20 bp, mouse
ggggcgtctggagaataaat

SEQ ID NO: 559749 - DNA, 20 bp, mouse
gagaaggacgagtactacct

SEQ ID NO: 559750 - DNA, 20 bp, mouse
gaaagcggggatcaaaacag

SEQ ID NO: 559751 - DNA, 20 bp, mouse
gccgcgcctgcgcacctcgt

SEQ ID NO: 559752 - DNA, 20 bp, mouse
ggtgatccgggcagcgcaga

SEQ ID NO: 559753 - DNA, 20 bp, mouse
gaggacgagtactacctggg

SEQ ID NO: 559754 - DNA, 20 bp, mouse
gatggagcccaggaaagtct

SEQ ID NO: 559755 - DNA, 20 bp, mouse
gttccgggcacccagacagg

SEQ ID NO: 559756 - DNA, 20 bp, mouse
gcgtcccaggggacccacga

SEQ ID NO: 559757 - DNA, 20 bp, mouse
ggctccctcgtgggtcccct

SEQ ID NO: 559758 - DNA, 20 bp, mouse
ggttgcgcccgctccctcgt

SEQ ID NO: 559759 - DNA, 20 bp, mouse
ggggaccggcgacgtcccag

SEQ ID NO: 559760 - DNA, 20 bp, mouse
gacctcccgagacaccgagg

SEQ ID NO: 559761 - DNA, 20 bp, mouse
ggcaacgcgtggctgtgggt

SEQ ID NO: 559762 - DNA, 20 bp, mouse
ggtcacagcccggtaaatcg

SEQ ID NO: 559763 - DNA, 20 bp, mouse
gggtgtgcccacccccgtgt

SEQ ID NO: 559764 - DNA, 20 bp, mouse
gtcccgctgtcccccgggac

SEQ ID NO: 559765 - DNA, 20 bp, mouse
ggccggtcccgggggacagc

SEQ ID NO: 559766 - DNA, 20 bp, mouse
gacccaggcgtccatgacag

SEQ ID NO: 559767 - DNA, 20 bp, mouse
gtcagagccaagcccgggag

SEQ ID NO: 559768 - DNA, 20 bp, mouse
gttggctctgagcactgaag

SEQ ID NO: 559769 - DNA, 20 bp, mouse
gtgagcactgaagcggaccc

SEQ ID NO: 559770 - DNA, 20 bp, mouse
gagcccgggagcggctgtgt

SEQ ID NO: 559771 - DNA, 20 bp, mouse
gcggagaccatcccagagaa

SEQ ID NO: 559772 - DNA, 20 bp, mouse
gggacgcgaagcgagatcgt

SEQ ID NO: 559773 - DNA, 20 bp, mouse
ggcccaggaggcgtgacttg

SEQ ID NO: 559774 - DNA, 20 bp, mouse
ggcccgggctgccgctgtca

SEQ ID NO: 559775 - DNA, 20 bp, mouse
gcgcgctacggggtccctaa

SEQ ID NO: 559776 - DNA, 20 bp, mouse
gaggcggtcccggacccggt

SEQ ID NO: 559777 - DNA, 20 bp, mouse
gacccggtgggactccagcg

SEQ ID NO: 559778 - DNA, 20 bp, mouse
gttccgcgctggagtcccac

SEQ ID NO: 559779 - DNA, 20 bp, mouse
gtcggtcgtgacgtcaccca

SEQ ID NO: 559780 - DNA, 20 bp, mouse
gcaccaggcggtcccggacc

SEQ ID NO: 559781 - DNA, 20 bp, mouse
gcgtcacgaccgagttgcca

SEQ ID NO: 559782 - DNA, 20 bp, mouse
gatggctctgctgaaccgtc

SEQ ID NO: 559783 - DNA, 20 bp, mouse
gtccgggaccgcctggtgag

SEQ ID NO: 559784 - DNA, 20 bp, mouse
gtcctctcaccaggcggtcc

SEQ ID NO: 559785 - DNA, 20 bp, mouse
ggtgctgaggaaggacctaa

SEQ ID NO: 559786 - DNA, 20 bp, mouse
gagctccgaggacctccaca

SEQ ID NO: 559787 - DNA, 20 bp, mouse
gtgacgccacctgcgaaagg

SEQ ID NO: 559788 - DNA, 20 bp, mouse
gtccgaggacctccacacgg

SEQ ID NO: 559789 - DNA, 20 bp, mouse
gcccgccgtgtggaggtcct

SEQ ID NO: 559790 - DNA, 20 bp, mouse
gagggcagagcgtgactcgg

SEQ ID NO: 559791 - DNA, 20 bp, mouse
ggacctcgggcacggagcag

SEQ ID NO: 559792 - DNA, 20 bp, mouse
gcccggaaacagaagctccg

SEQ ID NO: 559793 - DNA, 20 bp, mouse
gccgtgacgccacctgcgaa

SEQ ID NO: 559794 - DNA, 20 bp, mouse
ggaggtcagcaagcaaggac

SEQ ID NO: 559795 - DNA, 20 bp, mouse
gcacacggcgggcggaagac

SEQ ID NO: 559796 - DNA, 20 bp, mouse
gctcagggaagcgactgcga

SEQ ID NO: 559797 - DNA, 20 bp, mouse
gctctccgccagctccgctc

SEQ ID NO: 559798 - DNA, 20 bp, mouse
gtgagccggagcggagctgg

SEQ ID NO: 559799 - DNA, 20 bp, mouse
gggttgaagccgttattggg

SEQ ID NO: 559800 - DNA, 20 bp, mouse
gggaagcgactgcgacggct

SEQ ID NO: 559801 - DNA, 20 bp, mouse
ggggcgcccgggggaagaac

SEQ ID NO: 559802 - DNA, 20 bp, mouse
gcgacgcctccccccaataa

SEQ ID NO: 559803 - DNA, 20 bp, mouse
ggactgcgacggctgggtga

SEQ ID NO: 559804 - DNA, 20 bp, mouse
ggaattctgcgagactccca

SEQ ID NO: 559805 - DNA, 20 bp, mouse
gcccggggcgagtgcagagc

SEQ ID NO: 559806 - DNA, 20 bp, mouse
gagcagccgaaccaggtgag

SEQ ID NO: 559807 - DNA, 20 bp, mouse
gctgaggaagatggcgtcgt

SEQ ID NO: 559808 - DNA, 20 bp, mouse
gaagatggcgtcgtcggagc

SEQ ID NO: 559809 - DNA, 20 bp, mouse
gacccctgacagtcgcgacg

SEQ ID NO: 559810 - DNA, 20 bp, mouse
gggtcgactagtcaggcctg

SEQ ID NO: 559811 - DNA, 20 bp, mouse
ggccccgtcgcgactgtcag

SEQ ID NO: 559812 - DNA, 20 bp, mouse
ggagaaacttgggccagcgg

SEQ ID NO: 559813 - DNA, 20 bp, mouse
gcagcggcggtcgactagtc

SEQ ID NO: 559814 - DNA, 20 bp, mouse
ggaagccagggcctgagacc

SEQ ID NO: 559815 - DNA, 20 bp, mouse
ggtgagagcggggtcaccgg

SEQ ID NO: 559816 - DNA, 20 bp, mouse
gtggccactgacagtcccac

SEQ ID NO: 559817 - DNA, 20 bp, mouse
gcggccggtgggactgtcag

SEQ ID NO: 559818 - DNA, 20 bp, mouse
ggagcaggatggagaagcta

SEQ ID NO: 559819 - DNA, 20 bp, mouse
ggtcccaccggccgacagca

SEQ ID NO: 559820 - DNA, 20 bp, mouse
gaaggagggctcaggacgca

SEQ ID NO: 559821 - DNA, 20 bp, mouse
gcttagggccggaagcagga

SEQ ID NO: 559822 - DNA, 20 bp, mouse
gagccttgctgtcggccggt

SEQ ID NO: 559823 - DNA, 20 bp, mouse
gagtcacatactcctggtag

SEQ ID NO: 559824 - DNA, 20 bp, mouse
gcagcaggcaaagagccata

SEQ ID NO: 559825 - DNA, 20 bp, mouse
gccaagacagccaaccaagg

SEQ ID NO: 559826 - DNA, 20 bp, mouse
ggtcggaggcagtaagatgg

SEQ ID NO: 559827 - DNA, 20 bp, mouse
gacctcctacggcaagtcgg

SEQ ID NO: 559828 - DNA, 20 bp, mouse
gcaagtcggaggcagtaaga

SEQ ID NO: 559829 - DNA, 20 bp, mouse
ggaagacgaccgggaactgg

SEQ ID NO: 559830 - DNA, 20 bp, mouse
ggttggggtcgaagacgacc

SEQ ID NO: 559831 - DNA, 20 bp, mouse
gcccttcgcagggagatgtg

SEQ ID NO: 559832 - DNA, 20 bp, mouse
ggaggaaggttgcggtgttg

SEQ ID NO: 559833 - DNA, 20 bp, mouse
ggtcgaagacgaccgggaac

SEQ ID NO: 559834 - DNA, 20 bp, mouse
gccgtaggaggtggaaccac

SEQ ID NO: 559835 - DNA, 20 bp, mouse
gtccacctcctacggcaagt

SEQ ID NO: 559836 - DNA, 20 bp, mouse
gccgcagattccggaagtga

SEQ ID NO: 559837 - DNA, 20 bp, mouse
gcggaaagctgggcattccg

SEQ ID NO: 559838 - DNA, 20 bp, mouse
ggcattccgtggccgcatct

SEQ ID NO: 559839 - DNA, 20 bp, mouse
gaaacaatctccggaaagct

SEQ ID NO: 559840 - DNA, 20 bp, mouse
ggagcggacactgacctgcg

SEQ ID NO: 559841 - DNA, 20 bp, mouse
gccgtttctcaaacaatctc

SEQ ID NO: 559842 - DNA, 20 bp, mouse
gtccggagcgacggaagacc

SEQ ID NO: 559843 - DNA, 20 bp, mouse
ggcggtggctcagtctgtct

SEQ ID NO: 559844 - DNA, 20 bp, mouse
ggcgacggaagacccggaag

SEQ ID NO: 559845 - DNA, 20 bp, mouse
gtgtttgagaaacggccgtg

SEQ ID NO: 559846 - DNA, 20 bp, mouse
gctgcacggggaacccacga

SEQ ID NO: 559847 - DNA, 20 bp, mouse
gtcgtagtggctaagagggg

SEQ ID NO: 559848 - DNA, 20 bp, mouse
gaggaggtgtccaccgtcgt

SEQ ID NO: 559849 - DNA, 20 bp, mouse
gcacggggaacccacgacgg

SEQ ID NO: 559850 - DNA, 20 bp, mouse
ggcgtcgtagtggctaagag

SEQ ID NO: 559851 - DNA, 20 bp, mouse
gttagcaccggtccagggac

SEQ ID NO: 559852 - DNA, 20 bp, mouse
ggcaccggtccagggacagg

SEQ ID NO: 559853 - DNA, 20 bp, mouse
gttgtcgcgctctctactct

SEQ ID NO: 559854 - DNA, 20 bp, mouse
ggttcctcctgtccctggac

SEQ ID NO: 559855 - DNA, 20 bp, mouse
gcttaggaacagacctggag

SEQ ID NO: 559856 - DNA, 20 bp, mouse
gtccacctggcctggacctc

SEQ ID NO: 559857 - DNA, 20 bp, mouse
gtcctgggcacagtcctcgg

SEQ ID NO: 559858 - DNA, 20 bp, mouse
gctgctcagagaaacgtctg

SEQ ID NO: 559859 - DNA, 20 bp, mouse
gtggacctccggcagcagcg

SEQ ID NO: 559860 - DNA, 20 bp, mouse
gtggcagaaaggagtgacag

SEQ ID NO: 559861 - DNA, 20 bp, mouse
ggccaccgcgctgctgccgg

SEQ ID NO: 559862 - DNA, 20 bp, mouse
gtgttgtgtgggttgcctag

SEQ ID NO: 559863 - DNA, 20 bp, mouse
ggccggaggtccaggccagg

SEQ ID NO: 559864 - DNA, 20 bp, mouse
ggcagaggttgtggcttaag

SEQ ID NO: 559865 - DNA, 20 bp, mouse
gggcgtcccggatcagtaag

SEQ ID NO: 559866 - DNA, 20 bp, mouse
gcggacggtgcggcccgcga

SEQ ID NO: 559867 - DNA, 20 bp, mouse
gggtgcctcggccggtcgga

SEQ ID NO: 559868 - DNA, 20 bp, mouse
gccggccgaggcacccggag

SEQ ID NO: 559869 - DNA, 20 bp, mouse
gggcccgcgacggcgagcat

SEQ ID NO: 559870 - DNA, 20 bp, mouse
ggcgggccgcaccgtccgac

SEQ ID NO: 559871 - DNA, 20 bp, mouse
gcgcagcggcggggacttac

SEQ ID NO: 559872 - DNA, 20 bp, mouse
gctcggccggtcggacggtg

SEQ ID NO: 559873 - DNA, 20 bp, mouse
gcggcgagcattggagcctg

SEQ ID NO: 559874 - DNA, 20 bp, mouse
ggcagctggcgcctgaccgg

SEQ ID NO: 559875 - DNA, 20 bp, mouse
gcccttcccccagcccactc

SEQ ID NO: 559876 - DNA, 20 bp, mouse
ggtcagaggagtgaactagg

SEQ ID NO: 559877 - DNA, 20 bp, mouse
gagcccagaatgcaagtccc

SEQ ID NO: 559878 - DNA, 20 bp, mouse
gtcagtcagaggagtgaact

SEQ ID NO: 559879 - DNA, 20 bp, mouse
gagccagggacttgcattct

SEQ ID NO: 559880 - DNA, 20 bp, mouse
ggcactagatatcagtaagt

SEQ ID NO: 559881 - DNA, 20 bp, mouse
gcagtaagtgggtgactgta

SEQ ID NO: 559882 - DNA, 20 bp, mouse
ggcaaggtcttgcagaagcc

SEQ ID NO: 559883 - DNA, 20 bp, mouse
gtgagtgtccctgggtcatg

SEQ ID NO: 559884 - DNA, 20 bp, mouse
ggagctgaagatccccgcct

SEQ ID NO: 559885 - DNA, 20 bp, mouse
gctcctctgactgatgtgca

SEQ ID NO: 559886 - DNA, 20 bp, mouse
ggacgctgcagcctcgtgag

SEQ ID NO: 559887 - DNA, 20 bp, mouse
ggccctgcgctcggcagctg

SEQ ID NO: 559888 - DNA, 20 bp, mouse
ggtccggacggaggcgggag

SEQ ID NO: 559889 - DNA, 20 bp, mouse
ggcgcgggctggcgtccgga

SEQ ID NO: 559890 - DNA, 20 bp, mouse
ggctggcgtccggacggagg

SEQ ID NO: 559891 - DNA, 20 bp, mouse
gggagagtggggcacaggac

SEQ ID NO: 559892 - DNA, 20 bp, mouse
gaggacgccggcgggcgaga

SEQ ID NO: 559893 - DNA, 20 bp, mouse
ggccgcagctgccgagcgca

SEQ ID NO: 559894 - DNA, 20 bp, mouse
gcaggaccggcgagttggag

SEQ ID NO: 559895 - DNA, 20 bp, mouse
ggccggagcagaatgtacca

SEQ ID NO: 559896 - DNA, 20 bp, mouse
gcgcaggacagccaacgcca

SEQ ID NO: 559897 - DNA, 20 bp, mouse
ggtcctggaccccttcccga

SEQ ID NO: 559898 - DNA, 20 bp, mouse
ggtggtgtctccgtcgggaa

SEQ ID NO: 559899 - DNA, 20 bp, mouse
gctccgtcgggaaggggtcc

SEQ ID NO: 559900 - DNA, 20 bp, mouse
gcaacggtggtgtctccgtc

SEQ ID NO: 559901 - DNA, 20 bp, mouse
ggaaggggtccaggacgcgc

SEQ ID NO: 559902 - DNA, 20 bp, mouse
ggcgcgcggctcaccagcag

SEQ ID NO: 559903 - DNA, 20 bp, mouse
gctggccacgggcccccggg

SEQ ID NO: 559904 - DNA, 20 bp, mouse
gtgggcgccggacccttcca

SEQ ID NO: 559905 - DNA, 20 bp, mouse
gctccacttccggaaatagg

SEQ ID NO: 559906 - DNA, 20 bp, mouse
gctttcagtgagccgcagtg

SEQ ID NO: 559907 - DNA, 20 bp, mouse
gccgggaggccgagtgacgg

SEQ ID NO: 559908 - DNA, 20 bp, mouse
gtgcggctcactgaaagtcc

SEQ ID NO: 559909 - DNA, 20 bp, mouse
ggtgccgcggcgcagcacta

SEQ ID NO: 559910 - DNA, 20 bp, mouse
gcggcctcccggcccgagcg

SEQ ID NO: 559911 - DNA, 20 bp, mouse
ggctcactgaaagtccagga

SEQ ID NO: 559912 - DNA, 20 bp, mouse
gagttggcattggagcccag

SEQ ID NO: 559913 - DNA, 20 bp, mouse
gcgtcctacgcccgccccgg

SEQ ID NO: 559914 - DNA, 20 bp, mouse
gccgctcgcccgccgtcact

SEQ ID NO: 559915 - DNA, 20 bp, mouse
gtgccaactccgcagaaagg

SEQ ID NO: 559916 - DNA, 20 bp, mouse
gccctagacccatttcctca

SEQ ID NO: 559917 - DNA, 20 bp, mouse
gactttatctttgggtccag

SEQ ID NO: 559918 - DNA, 20 bp, mouse
gagcgacgctcatgtcaaga

SEQ ID NO: 559919 - DNA, 20 bp, mouse
gaggtccagaggtaccacac

SEQ ID NO: 559920 - DNA, 20 bp, mouse
gagttcaggagcctcaggtg

SEQ ID NO: 559921 - DNA, 20 bp, mouse
gagttctaccttgaggaaat

SEQ ID NO: 559922 - DNA, 20 bp, mouse
gagcctgtggaaaggtccag

SEQ ID NO: 559923 - DNA, 20 bp, mouse
gtaaacggggagaagaagag

SEQ ID NO: 559924 - DNA, 20 bp, mouse
gattgggtgaagggatgcta

SEQ ID NO: 559925 - DNA, 20 bp, mouse
gtgtcaccagcggtgagatt

SEQ ID NO: 559926 - DNA, 20 bp, mouse
ggcgcgcgccaaggactcgt

SEQ ID NO: 559927 - DNA, 20 bp, mouse
gaactcagggaaggacgcgt

SEQ ID NO: 559928 - DNA, 20 bp, mouse
gcaggaagcgaactcaggga

SEQ ID NO: 559929 - DNA, 20 bp, mouse
gggtctctggcgcaaactgg

SEQ ID NO: 559930 - DNA, 20 bp, mouse
ggcatcaggaagcgaactca

SEQ ID NO: 559931 - DNA, 20 bp, mouse
gccagagacccacgagtcct

SEQ ID NO: 559932 - DNA, 20 bp, mouse
ggtgggtctctggcgcaaac

SEQ ID NO: 559933 - DNA, 20 bp, mouse
gccttgggtagagcatctgt

SEQ ID NO: 559934 - DNA, 20 bp, mouse
gttctgcaggcactcggtgt

SEQ ID NO: 559935 - DNA, 20 bp, mouse
gtgcaggcactcggtgtagg

SEQ ID NO: 559936 - DNA, 20 bp, mouse
gttcaactccagatccacgg

SEQ ID NO: 559937 - DNA, 20 bp, mouse
gcgcagagagtgctccaata

SEQ ID NO: 559938 - DNA, 20 bp, mouse
gtccacggaggcggccatat

SEQ ID NO: 559939 - DNA, 20 bp, mouse
gttcaggtggagcctcttgg

SEQ ID NO: 559940 - DNA, 20 bp, mouse
gcgagtgaggaggagaacgg

SEQ ID NO: 559941 - DNA, 20 bp, mouse
gtccaatatggccgcctccg

SEQ ID NO: 559942 - DNA, 20 bp, mouse
gcagaacaggtcccgtctca

SEQ ID NO: 559943 - DNA, 20 bp, mouse
gctagaggcaagccggaaag

SEQ ID NO: 559944 - DNA, 20 bp, mouse
gggagttgaagaaggtaaag

SEQ ID NO: 559945 - DNA, 20 bp, mouse
gatggccgcctccgtggatc

SEQ ID NO: 559946 - DNA, 20 bp, mouse
gcggacagcagcggtcgtgt

SEQ ID NO: 559947 - DNA, 20 bp, mouse
ggtcgtgtgggcaagagcgg

SEQ ID NO: 559948 - DNA, 20 bp, mouse
gctagagcctgggtaggtag

SEQ ID NO: 559949 - DNA, 20 bp, mouse
gtcctttccacggtctccat

SEQ ID NO: 559950 - DNA, 20 bp, mouse
gacctacccaggctctagaa

SEQ ID NO: 559951 - DNA, 20 bp, mouse
gggtgtcggcggaacaggtg

SEQ ID NO: 559952 - DNA, 20 bp, mouse
gggcacgcacgggggagagg

SEQ ID NO: 559953 - DNA, 20 bp, mouse
gggtgtgggtgggtagtcaa

SEQ ID NO: 559954 - DNA, 20 bp, mouse
gtctccatgggcacgcacgg

SEQ ID NO: 559955 - DNA, 20 bp, mouse
gacctttctagagcctgggt

SEQ ID NO: 559956 - DNA, 20 bp, mouse
gcccgtggttcagtccaaga

SEQ ID NO: 559957 - DNA, 20 bp, mouse
gccggggtccgaggagccgt

SEQ ID NO: 559958 - DNA, 20 bp, mouse
gatggcggccaccatgaaga

SEQ ID NO: 559959 - DNA, 20 bp, mouse
ggcactcaccgccttcttca

SEQ ID NO: 559960 - DNA, 20 bp, mouse
gaagaaggcggtgagtgcgg

SEQ ID NO: 559961 - DNA, 20 bp, mouse
ggggcccgcgctgggtacag

SEQ ID NO: 559962 - DNA, 20 bp, mouse
ggagatgcacgaccctgagc

SEQ ID NO: 559963 - DNA, 20 bp, mouse
gtagcagacggcccgggatg

SEQ ID NO: 559964 - DNA, 20 bp, mouse
ggccctgacggcgagcggag

SEQ ID NO: 559965 - DNA, 20 bp, mouse
gatctcctcgggcaccgggt

SEQ ID NO: 559966 - DNA, 20 bp, mouse
ggctagagcgtcactcgccc

SEQ ID NO: 559967 - DNA, 20 bp, mouse
gacggaggtaacgcggaggg

SEQ ID NO: 559968 - DNA, 20 bp, mouse
gcgggacccgggaccggata

SEQ ID NO: 559969 - DNA, 20 bp, mouse
ggaagccgggaaaaaacaag

SEQ ID NO: 559970 - DNA, 20 bp, mouse
gaccacggaggtaacgcgga

SEQ ID NO: 559971 - DNA, 20 bp, mouse
gtcccagggaaacccctatc

SEQ ID NO: 559972 - DNA, 20 bp, mouse
gaccgcccgcccggtcgggg

SEQ ID NO: 559973 - DNA, 20 bp, mouse
gaccggataggggtttccct

SEQ ID NO: 559974 - DNA, 20 bp, mouse
gaggagaagccggcatcccc

SEQ ID NO: 559975 - DNA, 20 bp, mouse
gtcccggcttctgtaggaag

SEQ ID NO: 559976 - DNA, 20 bp, mouse
gtaggcgggagacggaacta

SEQ ID NO: 559977 - DNA, 20 bp, mouse
ggcgggagacggaactaagg

SEQ ID NO: 559978 - DNA, 20 bp, mouse
gtggaggctgtaggaaaacc

SEQ ID NO: 559979 - DNA, 20 bp, mouse
ggaactaaggtggaggctgt

SEQ ID NO: 559980 - DNA, 20 bp, mouse
gagttctcttaggcgggaga

SEQ ID NO: 559981 - DNA, 20 bp, mouse
gcggcaggacgcaagcaggg

SEQ ID NO: 559982 - DNA, 20 bp, mouse
gagcatgcggccagaagaga

SEQ ID NO: 559983 - DNA, 20 bp, mouse
gagtaacctggcgcatcagg

SEQ ID NO: 559984 - DNA, 20 bp, mouse
ggagaggcgcgtctctggtt

SEQ ID NO: 559985 - DNA, 20 bp, mouse
ggagttcagttctcttaggc

SEQ ID NO: 559986 - DNA, 20 bp, mouse
gtacagcagggaggacgaat

SEQ ID NO: 559987 - DNA, 20 bp, mouse
gcgacactgggtctacagca

SEQ ID NO: 559988 - DNA, 20 bp, mouse
ggagcaccgggtaccaaagc

SEQ ID NO: 559989 - DNA, 20 bp, mouse
ggtgctccggtggcgacact

SEQ ID NO: 559990 - DNA, 20 bp, mouse
gcactgggtctacagcaggg

SEQ ID NO: 559991 - DNA, 20 bp, mouse
ggtagacccagtgtcgccac

SEQ ID NO: 559992 - DNA, 20 bp, mouse
gttggtacccggtgctccgg

SEQ ID NO: 559993 - DNA, 20 bp, mouse
gacgaataggacaggtcata

SEQ ID NO: 559994 - DNA, 20 bp, mouse
ggcagctgcggagtgaggac

SEQ ID NO: 559995 - DNA, 20 bp, mouse
gcagggaggacgaataggac

SEQ ID NO: 559996 - DNA, 20 bp, mouse
gcatcccgacagaactggag

SEQ ID NO: 559997 - DNA, 20 bp, mouse
ggtgctgggtgttgggaccg

SEQ ID NO: 559998 - DNA, 20 bp, mouse
gtgtggcatcccgacagaac

SEQ ID NO: 559999 - DNA, 20 bp, mouse
gccggaacaaaggacaggaa

SEQ ID NO: 560000 - DNA, 20 bp, mouse
gggctctgttcaaaagctca

SEQ ID NO: 560001 - DNA, 20 bp, mouse
ggaggagcaagtggcagtgc

SEQ ID NO: 560002 - DNA, 20 bp, mouse
gacgagggtcggtgatcgac

SEQ ID NO: 560003 - DNA, 20 bp, mouse
gggctctgggtcagttccaa

SEQ ID NO: 560004 - DNA, 20 bp, mouse
gtccccccggaacaaaggac

SEQ ID NO: 560005 - DNA, 20 bp, mouse
gaaaggccgggcagtgcgtg

SEQ ID NO: 560006 - DNA, 20 bp, mouse
ggattctgggtcagttcccg

SEQ ID NO: 560007 - DNA, 20 bp, mouse
gtccgattcatcccagccca

SEQ ID NO: 560008 - DNA, 20 bp, mouse
ggaatcccctgaagaagatc

SEQ ID NO: 560009 - DNA, 20 bp, mouse
gtctggatgccgtacagcaa

SEQ ID NO: 560010 - DNA, 20 bp, mouse
gtaactggtgggcggagtcg

SEQ ID NO: 560011 - DNA, 20 bp, mouse
gacgagggtctcgagtgaaa

SEQ ID NO: 560012 - DNA, 20 bp, mouse
ggggtagacggcctagacga

SEQ ID NO: 560013 - DNA, 20 bp, mouse
gtgggtctgacccagtggat

SEQ ID NO: 560014 - DNA, 20 bp, mouse
gggtaagaccggggtcctaa

SEQ ID NO: 560015 - DNA, 20 bp, mouse
gccagttacaatagcctcac

SEQ ID NO: 560016 - DNA, 20 bp, mouse
gaggtccacggtagccatgg

SEQ ID NO: 560017 - DNA, 20 bp, mouse
gagcggcgcggaacgcagag

SEQ ID NO: 560018 - DNA, 20 bp, mouse
gggcgcggaacgcagagcgg

SEQ ID NO: 560019 - DNA, 20 bp, mouse
ggaacgcagagcggcgggag

SEQ ID NO: 560020 - DNA, 20 bp, mouse
ggggcggggacaggcgacag

SEQ ID NO: 560021 - DNA, 20 bp, mouse
gcccgaagggttccgaggac

SEQ ID NO: 560022 - DNA, 20 bp, mouse
gcccctcgcctagggatctg

SEQ ID NO: 560023 - DNA, 20 bp, mouse
gacaagcccgaagggttccg

SEQ ID NO: 560024 - DNA, 20 bp, mouse
ggggacaggcgacagcggcg

SEQ ID NO: 560025 - DNA, 20 bp, mouse
gcacgtacgccagctacccg

SEQ ID NO: 560026 - DNA, 20 bp, mouse
ggaggagagctaaaactaca

SEQ ID NO: 560027 - DNA, 20 bp, mouse
gtgcaagaaagcagcggcgg

SEQ ID NO: 560028 - DNA, 20 bp, mouse
ggccttgggtggagagcgag

SEQ ID NO: 560029 - DNA, 20 bp, mouse
gtgctgggcggttaaccgag

SEQ ID NO: 560030 - DNA, 20 bp, mouse
gttgcacgctcagatcccag

SEQ ID NO: 560031 - DNA, 20 bp, mouse
gctaaaactacaaggcaaga

SEQ ID NO: 560032 - DNA, 20 bp, mouse
ggcgaagccaagagtgaggt

SEQ ID NO: 560033 - DNA, 20 bp, mouse
gctgggcactcgtgaagaag

SEQ ID NO: 560034 - DNA, 20 bp, mouse
gtgagcgtgcaagtgctggg

SEQ ID NO: 560035 - DNA, 20 bp, mouse
ggagcttggcgaacacgggg

SEQ ID NO: 560036 - DNA, 20 bp, mouse
gactctagaattcaagacaa

SEQ ID NO: 560037 - DNA, 20 bp, mouse
gtgggagtcgagaaactcaa

SEQ ID NO: 560038 - DNA, 20 bp, mouse
gatggtcggttaagatgcac

SEQ ID NO: 560039 - DNA, 20 bp, mouse
gcagacatttcttgagccag

SEQ ID NO: 560040 - DNA, 20 bp, mouse
ggttaagatgcactggatca

SEQ ID NO: 560041 - DNA, 20 bp, mouse
gcactggatcaaggtgccac

SEQ ID NO: 560042 - DNA, 20 bp, mouse
gagttccagcctacagactt

SEQ ID NO: 560043 - DNA, 20 bp, mouse
gtctcgactcccaagtctgt

SEQ ID NO: 560044 - DNA, 20 bp, mouse
ggctgcatgatgctcttcat

SEQ ID NO: 560045 - DNA, 20 bp, mouse
gagatgcccaaggtaagcag

SEQ ID NO: 560046 - DNA, 20 bp, mouse
gtgctgagtacgggagtgtc

SEQ ID NO: 560047 - DNA, 20 bp, mouse
gcaagtcactcatgatgagg

SEQ ID NO: 560048 - DNA, 20 bp, mouse
gctctctcgctggtctccaa

SEQ ID NO: 560049 - DNA, 20 bp, mouse
gtgctccaggtacttcggat

SEQ ID NO: 560050 - DNA, 20 bp, mouse
gaggcggggcagcggttcca

SEQ ID NO: 560051 - DNA, 20 bp, mouse
ggagagccgaggagaaccgg

SEQ ID NO: 560052 - DNA, 20 bp, mouse
gcttcagtgcttgctgagta

SEQ ID NO: 560053 - DNA, 20 bp, mouse
gatccaagtcactcatgatg

SEQ ID NO: 560054 - DNA, 20 bp, mouse
gttccaaggctggcgcgcgt

SEQ ID NO: 560055 - DNA, 20 bp, mouse
ggctgcagaggagggtaatc

SEQ ID NO: 560056 - DNA, 20 bp, mouse
gaacagagccgcgttccgga

SEQ ID NO: 560057 - DNA, 20 bp, mouse
gggacggcggcccagacgga

SEQ ID NO: 560058 - DNA, 20 bp, mouse
ggcaggaagtggcggtgcga

SEQ ID NO: 560059 - DNA, 20 bp, mouse
gcgcgctgccgtccggaacg

SEQ ID NO: 560060 - DNA, 20 bp, mouse
ggtcaggacgcggccatcgt

SEQ ID NO: 560061 - DNA, 20 bp, mouse
gagctaacagagccgcgttc

SEQ ID NO: 560062 - DNA, 20 bp, mouse
gtacatcgacagccttatgg

SEQ ID NO: 560063 - DNA, 20 bp, mouse
ggctaacgaaggtcttcccg

SEQ ID NO: 560064 - DNA, 20 bp, mouse
ggagtccttgtagcctacga

SEQ ID NO: 560065 - DNA, 20 bp, mouse
ggggctgttgctgggatcgc

SEQ ID NO: 560066 - DNA, 20 bp, mouse
ggcgtcgcagtagccgacaa

SEQ ID NO: 560067 - DNA, 20 bp, mouse
gcggagagccgagggagctg

SEQ ID NO: 560068 - DNA, 20 bp, mouse
ggtccccgctgcagtgcgaa

SEQ ID NO: 560069 - DNA, 20 bp, mouse
ggggctcgaagatggccggt

SEQ ID NO: 560070 - DNA, 20 bp, mouse
ggcggcgggcctctgagaag

SEQ ID NO: 560071 - DNA, 20 bp, mouse
gcgaggaagggatgcggcta

SEQ ID NO: 560072 - DNA, 20 bp, mouse
gcgcggggctcaggagccgg

SEQ ID NO: 560073 - DNA, 20 bp, mouse
gcgaagggctcgaagatggc

SEQ ID NO: 560074 - DNA, 20 bp, mouse
ggtggctgcccagacgtatt

SEQ ID NO: 560075 - DNA, 20 bp, mouse
gccggcgagggtccccggga

SEQ ID NO: 560076 - DNA, 20 bp, mouse
gcttgtgcttgcattagggg

SEQ ID NO: 560077 - DNA, 20 bp, mouse
gcattcagagctaagaacac

SEQ ID NO: 560078 - DNA, 20 bp, mouse
gtgtgctcaccgggccagac

SEQ ID NO: 560079 - DNA, 20 bp, mouse
gtgcagtgctgcgggatcag

SEQ ID NO: 560080 - DNA, 20 bp, mouse
ggtgcttgcattaggggggg

SEQ ID NO: 560081 - DNA, 20 bp, mouse
gccatctccccgcaggaggt

SEQ ID NO: 560082 - DNA, 20 bp, mouse
gctcggccagcaggtagtca

SEQ ID NO: 560083 - DNA, 20 bp, mouse
ggcagacgaggcgtgcatgg

SEQ ID NO: 560084 - DNA, 20 bp, mouse
gaatgcaagcacaagttgct

SEQ ID NO: 560085 - DNA, 20 bp, mouse
gctcagacccgtctgcagaa

SEQ ID NO: 560086 - DNA, 20 bp, mouse
gaggagacgaggctccgcta

SEQ ID NO: 560087 - DNA, 20 bp, mouse
gcgggaactaaacacagagt

SEQ ID NO: 560088 - DNA, 20 bp, mouse
gggggctacaagaggagacg

SEQ ID NO: 560089 - DNA, 20 bp, mouse
gacagagtaggggctacaag

SEQ ID NO: 560090 - DNA, 20 bp, mouse
gcaggactcaggattcagtt

SEQ ID NO: 560091 - DNA, 20 bp, mouse
gcttcggaggactaattgat

SEQ ID NO: 560092 - DNA, 20 bp, mouse
gcggaggactaattgatggg

SEQ ID NO: 560093 - DNA, 20 bp, mouse
gagtcctccgaaggcagcgg

SEQ ID NO: 560094 - DNA, 20 bp, mouse
ggacgaggctccgctagggg

SEQ ID NO: 560095 - DNA, 20 bp, mouse
gctctaaagagcctccaagg

SEQ ID NO: 560096 - DNA, 20 bp, mouse
gcggcaaaagaatctggcac

SEQ ID NO: 560097 - DNA, 20 bp, mouse
gctcaggcttgttacaatct

SEQ ID NO: 560098 - DNA, 20 bp, mouse
ggctggggtgaagaaaacag

SEQ ID NO: 560099 - DNA, 20 bp, mouse
gcattttcggcaaaagaatc

SEQ ID NO: 560100 - DNA, 20 bp, mouse
ggttgcagggtaaacagctg

SEQ ID NO: 560101 - DNA, 20 bp, mouse
ggagtatatggtcaggaata

SEQ ID NO: 560102 - DNA, 20 bp, mouse
gacatccaccagagagcctg

SEQ ID NO: 560103 - DNA, 20 bp, mouse
gctggggcaaacagaaagat

SEQ ID NO: 560104 - DNA, 20 bp, mouse
gtggagtatctaagaccact

SEQ ID NO: 560105 - DNA, 20 bp, mouse
gatgacttgtggagagtata

SEQ ID NO: 560106 - DNA, 20 bp, mouse
gctgagaagggatcatgaag

SEQ ID NO: 560107 - DNA, 20 bp, mouse
gggtgctagggagaagttct

SEQ ID NO: 560108 - DNA, 20 bp, mouse
gagcaccttaagcctgagaa

SEQ ID NO: 560109 - DNA, 20 bp, mouse
ggaagaccgctgatagctgt

SEQ ID NO: 560110 - DNA, 20 bp, mouse
gttctgggcctgaagctgtg

SEQ ID NO: 560111 - DNA, 20 bp, mouse
gtgatcccttctcaggctta

SEQ ID NO: 560112 - DNA, 20 bp, mouse
ggcagcagaagtcacatcat

SEQ ID NO: 560113 - DNA, 20 bp, mouse
gagggatcatgaagtggctc

SEQ ID NO: 560114 - DNA, 20 bp, mouse
ggatagcttgccaagaacac

SEQ ID NO: 560115 - DNA, 20 bp, mouse
ggacactgagactctcagag

SEQ ID NO: 560116 - DNA, 20 bp, mouse
ggcctctcgagagggcccgg

SEQ ID NO: 560117 - DNA, 20 bp, mouse
ggcccccgggccctctcgag

SEQ ID NO: 560118 - DNA, 20 bp, mouse
gtggcgtactgggccagcac

SEQ ID NO: 560119 - DNA, 20 bp, mouse
ggtcctgggcgccacaggtg

SEQ ID NO: 560120 - DNA, 20 bp, mouse
gggcgttgcgaggtacgagc

SEQ ID NO: 560121 - DNA, 20 bp, mouse
gcaggtggggctgctcggac

SEQ ID NO: 560122 - DNA, 20 bp, mouse
ggagaggcgggcacttcggt

SEQ ID NO: 560123 - DNA, 20 bp, mouse
ggaagtgcccgcctctcgag

SEQ ID NO: 560124 - DNA, 20 bp, mouse
ggagcgggacgagcgctgtg

SEQ ID NO: 560125 - DNA, 20 bp, mouse
gagagtctgtgccagaaaga

SEQ ID NO: 560126 - DNA, 20 bp, mouse
gaccgtggcgaaccattact

SEQ ID NO: 560127 - DNA, 20 bp, mouse
ggggacacaggaactctagg

SEQ ID NO: 560128 - DNA, 20 bp, mouse
gaggcggtgggtggtcatgg

SEQ ID NO: 560129 - DNA, 20 bp, mouse
gactaggcggtgggtggtca

SEQ ID NO: 560130 - DNA, 20 bp, mouse
ggcctagtaatggttcgcca

SEQ ID NO: 560131 - DNA, 20 bp, mouse
gaccacccaccgcctagtaa

SEQ ID NO: 560132 - DNA, 20 bp, mouse
ggttccataagctctcaccg

SEQ ID NO: 560133 - DNA, 20 bp, mouse
ggcgaaccattactaggcgg

SEQ ID NO: 560134 - DNA, 20 bp, mouse
gtcatggtggcgggggacac

SEQ ID NO: 560135 - DNA, 20 bp, mouse
gggagcaggtgaagatctgg

SEQ ID NO: 560136 - DNA, 20 bp, mouse
ggagccaccggccagaccac

SEQ ID NO: 560137 - DNA, 20 bp, mouse
gcggcaggcgcttcagctgg

SEQ ID NO: 560138 - DNA, 20 bp, mouse
gcagctggcggcctgtggtc

SEQ ID NO: 560139 - DNA, 20 bp, mouse
gagaacagcggccgagccac

SEQ ID NO: 560140 - DNA, 20 bp, mouse
gaaatcgcgcgacctgacgg

SEQ ID NO: 560141 - DNA, 20 bp, mouse
gggcgtctgggacaccaact

SEQ ID NO: 560142 - DNA, 20 bp, mouse
gttccggcaggcgcttcagc

SEQ ID NO: 560143 - DNA, 20 bp, mouse
gcggagatcggtgctctgaa

SEQ ID NO: 560144 - DNA, 20 bp, mouse
ggccgctgttctcttctcgg

SEQ ID NO: 560145 - DNA, 20 bp, mouse
gacaccaactgggacaggtg

SEQ ID NO: 560146 - DNA, 20 bp, mouse
gggcagcctagacagagcga

SEQ ID NO: 560147 - DNA, 20 bp, mouse
gtaggctgccgagcttctcc

SEQ ID NO: 560148 - DNA, 20 bp, mouse
gctctacaccaggagaagct

SEQ ID NO: 560149 - DNA, 20 bp, mouse
gagacgagcgcctctacacc

SEQ ID NO: 560150 - DNA, 20 bp, mouse
gggtgtgggcgcgcaggtaa

SEQ ID NO: 560151 - DNA, 20 bp, mouse
gtgccaggagagctccgagt

SEQ ID NO: 560152 - DNA, 20 bp, mouse
gtctttccctcgctctgtct

SEQ ID NO: 560153 - DNA, 20 bp, mouse
gagcccgagagaagcccggg

SEQ ID NO: 560154 - DNA, 20 bp, mouse
gggagggtccgggaagtata

SEQ ID NO: 560155 - DNA, 20 bp, mouse
ggtaccccgagtaccaggta

SEQ ID NO: 560156 - DNA, 20 bp, mouse
ggagccccagcccggcccgg

SEQ ID NO: 560157 - DNA, 20 bp, mouse
gggccgtaccccgtagccag

SEQ ID NO: 560158 - DNA, 20 bp, mouse
gtagccaggggcgcggaacc

SEQ ID NO: 560159 - DNA, 20 bp, mouse
gcccgggggcgagtggaagg

SEQ ID NO: 560160 - DNA, 20 bp, mouse
ggggcgggtcgcagcagcaa

SEQ ID NO: 560161 - DNA, 20 bp, mouse
gtaccccgtagccaggggcg

SEQ ID NO: 560162 - DNA, 20 bp, mouse
gttccactcgcccccgggcc

SEQ ID NO: 560163 - DNA, 20 bp, mouse
gctccaggcactgcagatgg

SEQ ID NO: 560164 - DNA, 20 bp, mouse
gttccgcgcccctggctacg

SEQ ID NO: 560165 - DNA, 20 bp, mouse
gaggccctgcggaataaatg

SEQ ID NO: 560166 - DNA, 20 bp, mouse
gggagcgcggagactcgcta

SEQ ID NO: 560167 - DNA, 20 bp, mouse
gcaatcagaaggaagtccca

SEQ ID NO: 560168 - DNA, 20 bp, mouse
gctccgcgctccaaggaagg

SEQ ID NO: 560169 - DNA, 20 bp, mouse
gagactcgctacggaagctc

SEQ ID NO: 560170 - DNA, 20 bp, mouse
ggaaggatagaacaattacc

SEQ ID NO: 560171 - DNA, 20 bp, mouse
gtattctagagattcagagg

SEQ ID NO: 560172 - DNA, 20 bp, mouse
gcttgcgctggaaagaacag

SEQ ID NO: 560173 - DNA, 20 bp, mouse
gttcagagggggaaagtgta

SEQ ID NO: 560174 - DNA, 20 bp, mouse
gcgcgctccaaggaaggggg

SEQ ID NO: 560175 - DNA, 20 bp, mouse
gcctgtctgcgggcaatgat

SEQ ID NO: 560176 - DNA, 20 bp, mouse
ggccgctgagggaggagctt

SEQ ID NO: 560177 - DNA, 20 bp, mouse
gaggcggagccaagacgaac

SEQ ID NO: 560178 - DNA, 20 bp, mouse
ggacagaatggccaagcgga

SEQ ID NO: 560179 - DNA, 20 bp, mouse
gcactgtgcccggccgctga

SEQ ID NO: 560180 - DNA, 20 bp, mouse
gtgtgcccggccgctgaggg

SEQ ID NO: 560181 - DNA, 20 bp, mouse
gcccgcgagtcccactgcca

SEQ ID NO: 560182 - DNA, 20 bp, mouse
gaacagcagggcacagtagg

SEQ ID NO: 560183 - DNA, 20 bp, mouse
ggaacaggcggggctttcac

SEQ ID NO: 560184 - DNA, 20 bp, mouse
ggagccaagacgaacaggcg

SEQ ID NO: 560185 - DNA, 20 bp, mouse
gaccttggcagtgggactcg

SEQ ID NO: 560186 - DNA, 20 bp, mouse
gagcccgcgacgatgaaggt

SEQ ID NO: 560187 - DNA, 20 bp, mouse
gccagagcgccacagcctgg

SEQ ID NO: 560188 - DNA, 20 bp, mouse
gtcggcgggaaggagtccaa

SEQ ID NO: 560189 - DNA, 20 bp, mouse
gagcaagaaccgccaggctg

SEQ ID NO: 560190 - DNA, 20 bp, mouse
gtccgagcccgcgacgatga

SEQ ID NO: 560191 - DNA, 20 bp, mouse
ggccctggcgaaggcactac

SEQ ID NO: 560192 - DNA, 20 bp, mouse
gccgcgacgatgaaggtcgg

SEQ ID NO: 560193 - DNA, 20 bp, mouse
gacgatgaaggtcggcggga

SEQ ID NO: 560194 - DNA, 20 bp, mouse
gcaggttagagccctggcga

SEQ ID NO: 560195 - DNA, 20 bp, mouse
gacggagtacgtgcacccag

SEQ ID NO: 560196 - DNA, 20 bp, mouse
ggaaggtcggcggcgcaacg

SEQ ID NO: 560197 - DNA, 20 bp, mouse
gttgcgccgccgaccttccc

SEQ ID NO: 560198 - DNA, 20 bp, mouse
ggcccgagcggccaagacgg

SEQ ID NO: 560199 - DNA, 20 bp, mouse
gccacggctcgcgcccggga

SEQ ID NO: 560200 - DNA, 20 bp, mouse
gcagcggcgcccgagctcca

SEQ ID NO: 560201 - DNA, 20 bp, mouse
gtggaggcgggcccggtcca

SEQ ID NO: 560202 - DNA, 20 bp, mouse
ggcggcccgagcggccaaga

SEQ ID NO: 560203 - DNA, 20 bp, mouse
ggctatggccgagggcggtg

SEQ ID NO: 560204 - DNA, 20 bp, mouse
ggcggagacgcagcgggtgg

SEQ ID NO: 560205 - DNA, 20 bp, mouse
gaggaggacgagaccggtgg

SEQ ID NO: 560206 - DNA, 20 bp, mouse
gggtttgcagctggtctcac

SEQ ID NO: 560207 - DNA, 20 bp, mouse
ggctctccactccaccgcaa

SEQ ID NO: 560208 - DNA, 20 bp, mouse
gcaaagctgcctccaggagt

SEQ ID NO: 560209 - DNA, 20 bp, mouse
gaccggcatcatgaagtgga

SEQ ID NO: 560210 - DNA, 20 bp, mouse
gtcgagctcgaccgttgcgg

SEQ ID NO: 560211 - DNA, 20 bp, mouse
ggcaaaccggcatcatgaag

SEQ ID NO: 560212 - DNA, 20 bp, mouse
gggcatcatgaagtggatgg

SEQ ID NO: 560213 - DNA, 20 bp, mouse
gacttcgagctcgaccgttg

SEQ ID NO: 560214 - DNA, 20 bp, mouse
gctcgaccgttgcggtggag

SEQ ID NO: 560215 - DNA, 20 bp, mouse
gtctaggctcggagaccctc

SEQ ID NO: 560216 - DNA, 20 bp, mouse
gggcagacgaagcagagtcg

SEQ ID NO: 560217 - DNA, 20 bp, mouse
gagacgaagcagagtcgagg

SEQ ID NO: 560218 - DNA, 20 bp, mouse
gactcactgggccatggcgg

SEQ ID NO: 560219 - DNA, 20 bp, mouse
gcgaaggaccgagcgctccg

SEQ ID NO: 560220 - DNA, 20 bp, mouse
gcgaggaggaagaaacgcga

SEQ ID NO: 560221 - DNA, 20 bp, mouse
ggagacccaggcgaccaccg

SEQ ID NO: 560222 - DNA, 20 bp, mouse
ggccgcaagctcccacgaag

SEQ ID NO: 560223 - DNA, 20 bp, mouse
gaggcaagtacagtgaagtc

SEQ ID NO: 560224 - DNA, 20 bp, mouse
gtcggtcactcactgggcca

SEQ ID NO: 560225 - DNA, 20 bp, mouse
ggcaagctcccacgaagggg

SEQ ID NO: 560226 - DNA, 20 bp, mouse
gacttctgctcactcacgag

SEQ ID NO: 560227 - DNA, 20 bp, mouse
gcgagaggagctagggtcat

SEQ ID NO: 560228 - DNA, 20 bp, mouse
gggggagacgctgataccag

SEQ ID NO: 560229 - DNA, 20 bp, mouse
gtagcctaggacagcagtga

SEQ ID NO: 560230 - DNA, 20 bp, mouse
ggactgcagagacctagcct

SEQ ID NO: 560231 - DNA, 20 bp, mouse
gcgactagcttcagttcgta

SEQ ID NO: 560232 - DNA, 20 bp, mouse
gcgatgtgaaaggatcttag

SEQ ID NO: 560233 - DNA, 20 bp, mouse
gcgagtcggagcgatgtgaa

SEQ ID NO: 560234 - DNA, 20 bp, mouse
gaagtccggagctcacaggt

SEQ ID NO: 560235 - DNA, 20 bp, mouse
gatcagcgtctcccccaagg

SEQ ID NO: 560236 - DNA, 20 bp, mouse
ggccagcctgtcgtcctcgg

SEQ ID NO: 560237 - DNA, 20 bp, mouse
gggccaccaccgaggacgac

SEQ ID NO: 560238 - DNA, 20 bp, mouse
gaccaccgaggacgacaggc

SEQ ID NO: 560239 - DNA, 20 bp, mouse
gacgacaggctggcggggag

SEQ ID NO: 560240 - DNA, 20 bp, mouse
ggcccggcggcagcgcaacc

SEQ ID NO: 560241 - DNA, 20 bp, mouse
gagcggagaaggagaacggc

SEQ ID NO: 560242 - DNA, 20 bp, mouse
gacggaggcagtgagagtag

SEQ ID NO: 560243 - DNA, 20 bp, mouse
gcagccaggggaggccggga

SEQ ID NO: 560244 - DNA, 20 bp, mouse
gccagcgaggaataccgctc

SEQ ID NO: 560245 - DNA, 20 bp, mouse
gtcggacaaggcagagatcg

SEQ ID NO: 560246 - DNA, 20 bp, mouse
gcgggcgcccgaaggtcctc

SEQ ID NO: 560247 - DNA, 20 bp, mouse
gcgaaggtcctccggaggcc

SEQ ID NO: 560248 - DNA, 20 bp, mouse
ggggcttgagggcagcagta

SEQ ID NO: 560249 - DNA, 20 bp, mouse
gcacagtctccgccccaatg

SEQ ID NO: 560250 - DNA, 20 bp, mouse
gagagagaatgtggccccga

SEQ ID NO: 560251 - DNA, 20 bp, mouse
gtccgccccaatgaggtgag

SEQ ID NO: 560252 - DNA, 20 bp, mouse
gtcctctcacctcattgggg

SEQ ID NO: 560253 - DNA, 20 bp, mouse
gagttgatcccactgataaa

SEQ ID NO: 560254 - DNA, 20 bp, mouse
ggtgcagaatgccgggcctc

SEQ ID NO: 560255 - DNA, 20 bp, mouse
gtaagtgcaacttaaggtga

SEQ ID NO: 560256 - DNA, 20 bp, mouse
gcgtgcgctttttttctgga

SEQ ID NO: 560257 - DNA, 20 bp, mouse
gtggatggaagatttaagca

SEQ ID NO: 560258 - DNA, 20 bp, mouse
gcagacgtgcgctttttttc

SEQ ID NO: 560259 - DNA, 20 bp, mouse
ggaggaagaggagaacagcg

SEQ ID NO: 560260 - DNA, 20 bp, mouse
gaggtggctcataaggacaa

SEQ ID NO: 560261 - DNA, 20 bp, mouse
ggctctaaggagtacttgtc

SEQ ID NO: 560262 - DNA, 20 bp, mouse
gaccatcaggccggcccagg

SEQ ID NO: 560263 - DNA, 20 bp, mouse
gctcataaggacaacggact

SEQ ID NO: 560264 - DNA, 20 bp, mouse
gccggcccaggtggctcata

SEQ ID NO: 560265 - DNA, 20 bp, mouse
gaatgcctgtgccaacccag

SEQ ID NO: 560266 - DNA, 20 bp, mouse
ggcagaaagagccatcttga

SEQ ID NO: 560267 - DNA, 20 bp, mouse
gaggtgactcatgagaacta

SEQ ID NO: 560268 - DNA, 20 bp, mouse
ggttgtgcataccatcaaga

SEQ ID NO: 560269 - DNA, 20 bp, mouse
gcagtgcttgatacttggga

SEQ ID NO: 560270 - DNA, 20 bp, mouse
ggataccatcaggccgaccg

SEQ ID NO: 560271 - DNA, 20 bp, mouse
gctggcatagggataccatc

SEQ ID NO: 560272 - DNA, 20 bp, mouse
gctcatgagaactacggact

SEQ ID NO: 560273 - DNA, 20 bp, mouse
ggctctaatgaatacttgtc

SEQ ID NO: 560274 - DNA, 20 bp, mouse
gatagacccattatctgggt

SEQ ID NO: 560275 - DNA, 20 bp, mouse
gaagttgactctggacaaag

SEQ ID NO: 560276 - DNA, 20 bp, mouse
gcgggtgctgccatggcggt

SEQ ID NO: 560277 - DNA, 20 bp, mouse
gaccgagatgagactgggcg

SEQ ID NO: 560278 - DNA, 20 bp, mouse
gcgacgcgcccagctcttgc

SEQ ID NO: 560279 - DNA, 20 bp, mouse
gcatggcggtggggaggcgg

SEQ ID NO: 560280 - DNA, 20 bp, mouse
gctggctggtccagcgggag

SEQ ID NO: 560281 - DNA, 20 bp, mouse
gtgctctcggcgtggtcgaa

SEQ ID NO: 560282 - DNA, 20 bp, mouse
gtctccagcccgcaagagct

SEQ ID NO: 560283 - DNA, 20 bp, mouse
gcgcagcgctcacccggtag

SEQ ID NO: 560284 - DNA, 20 bp, mouse
gagcacgtacggcctctacc

SEQ ID NO: 560285 - DNA, 20 bp, mouse
gtcgggctagcatggagacc

SEQ ID NO: 560286 - DNA, 20 bp, mouse
gaggagggcaaggagagcac

SEQ ID NO: 560287 - DNA, 20 bp, mouse
gacagccctgcagtcctgtg

SEQ ID NO: 560288 - DNA, 20 bp, mouse
gggaggttgccagacccagg

SEQ ID NO: 560289 - DNA, 20 bp, mouse
gcgtgccgcacaggactgca

SEQ ID NO: 560290 - DNA, 20 bp, mouse
gggcacgatgaaactgcagg

SEQ ID NO: 560291 - DNA, 20 bp, mouse
gcatgctggacgtgccgcac

SEQ ID NO: 560292 - DNA, 20 bp, mouse
gggcggctagagcactcgga

SEQ ID NO: 560293 - DNA, 20 bp, mouse
gcggggcacgatgaaactgc

SEQ ID NO: 560294 - DNA, 20 bp, mouse
ggggccctccactcactgcg

SEQ ID NO: 560295 - DNA, 20 bp, mouse
gctacaagtgagtatggagt

SEQ ID NO: 560296 - DNA, 20 bp, mouse
gtcggaggccctaggaggat

SEQ ID NO: 560297 - DNA, 20 bp, mouse
ggaacctcggaggccctagg

SEQ ID NO: 560298 - DNA, 20 bp, mouse
gacccagcagagaacctcgg

SEQ ID NO: 560299 - DNA, 20 bp, mouse
gagagaacctcggaggccct

SEQ ID NO: 560300 - DNA, 20 bp, mouse
gcagtcaccccagcgaggta

SEQ ID NO: 560301 - DNA, 20 bp, mouse
gcagcgaggtaaggttgtgt

SEQ ID NO: 560302 - DNA, 20 bp, mouse
gcagacccagcagagaacct

SEQ ID NO: 560303 - DNA, 20 bp, mouse
gctcatgctcctatcctcct

SEQ ID NO: 560304 - DNA, 20 bp, mouse
gtggtgggtctccagttcca

SEQ ID NO: 560305 - DNA, 20 bp, mouse
ggtgtgggagtagagagcct

SEQ ID NO: 560306 - DNA, 20 bp, mouse
gaggagagaggaacttctgt

SEQ ID NO: 560307 - DNA, 20 bp, mouse
ggaagttcctctctcctcaa

SEQ ID NO: 560308 - DNA, 20 bp, mouse
gtggttggcctggacactct

SEQ ID NO: 560309 - DNA, 20 bp, mouse
gaacggagatgcaagaatgg

SEQ ID NO: 560310 - DNA, 20 bp, mouse
gagctgcttacctcacataa

SEQ ID NO: 560311 - DNA, 20 bp, mouse
ggctaggctggctaaggtgg

SEQ ID NO: 560312 - DNA, 20 bp, mouse
gtggacactctgggcctttg

SEQ ID NO: 560313 - DNA, 20 bp, mouse
gcttgcatctccgttatgtg

SEQ ID NO: 560314 - DNA, 20 bp, mouse
gcataacggagatgcaagaa

SEQ ID NO: 560315 - DNA, 20 bp, mouse
gtgcaagaatgggggaacga

SEQ ID NO: 560316 - DNA, 20 bp, mouse
gtggtcccaggacaccaaca

SEQ ID NO: 560317 - DNA, 20 bp, mouse
gaagcctgggcaacatctta

SEQ ID NO: 560318 - DNA, 20 bp, mouse
gcaccaacatggagtctgac

SEQ ID NO: 560319 - DNA, 20 bp, mouse
gtccagagcagtacaacaag

SEQ ID NO: 560320 - DNA, 20 bp, mouse
gggagtctgactggcagtcc

SEQ ID NO: 560321 - DNA, 20 bp, mouse
gaacatcttagggtggtccc

SEQ ID NO: 560322 - DNA, 20 bp, mouse
gctctagaaaagacaatact

SEQ ID NO: 560323 - DNA, 20 bp, mouse
gagactccatgttggtgtcc

SEQ ID NO: 560324 - DNA, 20 bp, mouse
gaagaaagagaacttaccac

SEQ ID NO: 560325 - DNA, 20 bp, mouse
ggaaaatcacaacagctggc

SEQ ID NO: 560326 - DNA, 20 bp, mouse
gaagccaggacagcatcctc

SEQ ID NO: 560327 - DNA, 20 bp, mouse
gtccccgtgtaggtgtcctg

SEQ ID NO: 560328 - DNA, 20 bp, mouse
ggccccaggacacctacacg

SEQ ID NO: 560329 - DNA, 20 bp, mouse
ggggaatgataagcaaccct

SEQ ID NO: 560330 - DNA, 20 bp, mouse
gtgcttatcattccccgtgt

SEQ ID NO: 560331 - DNA, 20 bp, mouse
gggcagtaagaaccaatcag

SEQ ID NO: 560332 - DNA, 20 bp, mouse
gttctctatcttggttcttc

SEQ ID NO: 560333 - DNA, 20 bp, mouse
gacagtccatgtaggagcat

SEQ ID NO: 560334 - DNA, 20 bp, mouse
gttgtggagtctatagacct

SEQ ID NO: 560335 - DNA, 20 bp, mouse
gtcttggttcttctggcaca

SEQ ID NO: 560336 - DNA, 20 bp, mouse
ggcgacaccgacagagacac

SEQ ID NO: 560337 - DNA, 20 bp, mouse
gcgcagcagtcacaaccggg

SEQ ID NO: 560338 - DNA, 20 bp, mouse
gccggagccggtgtctctgt

SEQ ID NO: 560339 - DNA, 20 bp, mouse
ggactgctgcgggatggcgg

SEQ ID NO: 560340 - DNA, 20 bp, mouse
gtgtgactgctgcgggatgg

SEQ ID NO: 560341 - DNA, 20 bp, mouse
gggttgtgactgctgcggga

SEQ ID NO: 560342 - DNA, 20 bp, mouse
gcaccggctccggaaggcag

SEQ ID NO: 560343 - DNA, 20 bp, mouse
ggaaggcagtggcttgggta

SEQ ID NO: 560344 - DNA, 20 bp, mouse
gcccctccagaagggtgacc

SEQ ID NO: 560345 - DNA, 20 bp, mouse
gagtcacaaccgggcggagg

SEQ ID NO: 560346 - DNA, 20 bp, mouse
ggttggctgcgaggcgacag

SEQ ID NO: 560347 - DNA, 20 bp, mouse
gtgcgaggcgacagtggctg

SEQ ID NO: 560348 - DNA, 20 bp, mouse
gtgcctcagcgccggctcca

SEQ ID NO: 560349 - DNA, 20 bp, mouse
gatcagaagccgggcaccag

SEQ ID NO: 560350 - DNA, 20 bp, mouse
gtcgcagccaaccgccacca

SEQ ID NO: 560351 - DNA, 20 bp, mouse
gtcttcaccatggtggcggt

SEQ ID NO: 560352 - DNA, 20 bp, mouse
gcacggtagagacgatgctc

SEQ ID NO: 560353 - DNA, 20 bp, mouse
gggattgcggaagcgagtga

SEQ ID NO: 560354 - DNA, 20 bp, mouse
ggctcttgccctggaaacga

SEQ ID NO: 560355 - DNA, 20 bp, mouse
ggcgcacgctcccttgacct

SEQ ID NO: 560356 - DNA, 20 bp, mouse
gagcgaacccggagagaggg

SEQ ID NO: 560357 - DNA, 20 bp, mouse
ggtcagttcgagctgagatc

SEQ ID NO: 560358 - DNA, 20 bp, mouse
gtctcagctcgaactgactg

SEQ ID NO: 560359 - DNA, 20 bp, mouse
gcctcccagcagactagctc

SEQ ID NO: 560360 - DNA, 20 bp, mouse
gcagctcgaactgactgagg

SEQ ID NO: 560361 - DNA, 20 bp, mouse
gctccagcgaacccggagag

SEQ ID NO: 560362 - DNA, 20 bp, mouse
gactgactgaggcgggcgtg

SEQ ID NO: 560363 - DNA, 20 bp, mouse
ggggtccccagtgaggtagg

SEQ ID NO: 560364 - DNA, 20 bp, mouse
gcgacggggacaccaggtgg

SEQ ID NO: 560365 - DNA, 20 bp, mouse
ggctctaggtgcgctcacca

SEQ ID NO: 560366 - DNA, 20 bp, mouse
gaggtctgagagagttggtt

SEQ ID NO: 560367 - DNA, 20 bp, mouse
ggcaagaacgttctctccac

SEQ ID NO: 560368 - DNA, 20 bp, mouse
ggagcaggatgcatccccaa

SEQ ID NO: 560369 - DNA, 20 bp, mouse
gcgcggccgcgtctcgcctg

SEQ ID NO: 560370 - DNA, 20 bp, mouse
gacgcccgctcacctagatc

SEQ ID NO: 560371 - DNA, 20 bp, mouse
gcaggatgcatccccaaggg

SEQ ID NO: 560372 - DNA, 20 bp, mouse
gactacagcgcgaggacctc

SEQ ID NO: 560373 - DNA, 20 bp, mouse
gtcgggccggaagcaaagct

SEQ ID NO: 560374 - DNA, 20 bp, mouse
gaagctgggccacgtctgcg

SEQ ID NO: 560375 - DNA, 20 bp, mouse
ggcgaggacctcaggcacct

SEQ ID NO: 560376 - DNA, 20 bp, mouse
gcggccagcggcgccatgga

SEQ ID NO: 560377 - DNA, 20 bp, mouse
gggagggcggcagatccccg

SEQ ID NO: 560378 - DNA, 20 bp, mouse
gcaccgtcagcactgggatg

SEQ ID NO: 560379 - DNA, 20 bp, mouse
gccgtgggcaccgtcagcac

SEQ ID NO: 560380 - DNA, 20 bp, mouse
gcccgaggctcccgcagccg

SEQ ID NO: 560381 - DNA, 20 bp, mouse
gggcgccctatgaggaccag

SEQ ID NO: 560382 - DNA, 20 bp, mouse
gccgctggccggtcctgccg

SEQ ID NO: 560383 - DNA, 20 bp, mouse
gagaccgcgggggcccggga

SEQ ID NO: 560384 - DNA, 20 bp, mouse
gggaccggccagcggcgcca

SEQ ID NO: 560385 - DNA, 20 bp, mouse
gggtcctcatagggcgccgt

SEQ ID NO: 560386 - DNA, 20 bp, mouse
gagcggtcagcggtcgacca

SEQ ID NO: 560387 - DNA, 20 bp, mouse
gcagcggtcgaccatggcag

SEQ ID NO: 560388 - DNA, 20 bp, mouse
gcggcggcggcagcggtcag

SEQ ID NO: 560389 - DNA, 20 bp, mouse
gcggcaggagcggcgggtgg

SEQ ID NO: 560390 - DNA, 20 bp, mouse
gccggtggtggcggcaggag

SEQ ID NO: 560391 - DNA, 20 bp, mouse
gggctggcggctgcgaggag

SEQ ID NO: 560392 - DNA, 20 bp, mouse
ggcagagcccgcagagtctc

SEQ ID NO: 560393 - DNA, 20 bp, mouse
ggggcccgcggcaagcgact

SEQ ID NO: 560394 - DNA, 20 bp, mouse
gggcctacgcggagaagcta

SEQ ID NO: 560395 - DNA, 20 bp, mouse
gcagcgggcttcgtcgccac

SEQ ID NO: 560396 - DNA, 20 bp, mouse
ggccttccgcggctgctcca

SEQ ID NO: 560397 - DNA, 20 bp, mouse
gggcggtagtggtaaccggt

SEQ ID NO: 560398 - DNA, 20 bp, mouse
gccggtccagatgcacctac

SEQ ID NO: 560399 - DNA, 20 bp, mouse
gttaccactaccgccttccg

SEQ ID NO: 560400 - DNA, 20 bp, mouse
gcagccgcggaaggcggtag

SEQ ID NO: 560401 - DNA, 20 bp, mouse
gtagagagtgcattccacca

SEQ ID NO: 560402 - DNA, 20 bp, mouse
gaccatggagcagccgcgga

SEQ ID NO: 560403 - DNA, 20 bp, mouse
gaggtgcatctggaccgggg

SEQ ID NO: 560404 - DNA, 20 bp, mouse
gttccaccatggagcagccg

SEQ ID NO: 560405 - DNA, 20 bp, mouse
gtcggagtgcgcggggacta

SEQ ID NO: 560406 - DNA, 20 bp, mouse
gaccggtcaccaccacgcag

SEQ ID NO: 560407 - DNA, 20 bp, mouse
gccggaacgcagggaaactt

SEQ ID NO: 560408 - DNA, 20 bp, mouse
gctagcgcagccgggtctca

SEQ ID NO: 560409 - DNA, 20 bp, mouse
gactgcgaatccatgagacc

SEQ ID NO: 560410 - DNA, 20 bp, mouse
ggtccagccgagatccagga

SEQ ID NO: 560411 - DNA, 20 bp, mouse
gcccgctgcgtggtggtgac

SEQ ID NO: 560412 - DNA, 20 bp, mouse
ggagaacctaagccacaagt

SEQ ID NO: 560413 - DNA, 20 bp, mouse
gagctctcccaggggaacac

SEQ ID NO: 560414 - DNA, 20 bp, mouse
gtctcccaggggaacacggg

SEQ ID NO: 560415 - DNA, 20 bp, mouse
gccctaagcctaggacccag

SEQ ID NO: 560416 - DNA, 20 bp, mouse
gcagacgtgtggagaacctg

SEQ ID NO: 560417 - DNA, 20 bp, mouse
ggggcgaagcgccagacgtg

SEQ ID NO: 560418 - DNA, 20 bp, mouse
gctgcaggcaaaggatccgc

SEQ ID NO: 560419 - DNA, 20 bp, mouse
gtccaagcgtgcaagcaagg

SEQ ID NO: 560420 - DNA, 20 bp, mouse
gggggacccgatgtgtgggg

SEQ ID NO: 560421 - DNA, 20 bp, mouse
gcgtccagggagatcggtat

SEQ ID NO: 560422 - DNA, 20 bp, mouse
ggctcccagacggaaagaca

SEQ ID NO: 560423 - DNA, 20 bp, mouse
gcaagggggacccgatgtgt

SEQ ID NO: 560424 - DNA, 20 bp, mouse
ggagaaagctccctccacgt

SEQ ID NO: 560425 - DNA, 20 bp, mouse
gtcctcccctgtctcctggg

SEQ ID NO: 560426 - DNA, 20 bp, mouse
gtctgaagtgggcacagacc

SEQ ID NO: 560427 - DNA, 20 bp, mouse
gccgcctggcctgtccgtcc

SEQ ID NO: 560428 - DNA, 20 bp, mouse
ggacaggccaggcggctagg

SEQ ID NO: 560429 - DNA, 20 bp, mouse
ggacacctcaggctctgaag

SEQ ID NO: 560430 - DNA, 20 bp, mouse
gggcacagacctggacggac

SEQ ID NO: 560431 - DNA, 20 bp, mouse
ggtgcgcacgactctgcctg

SEQ ID NO: 560432 - DNA, 20 bp, mouse
ggaaaggctggagatatgtg

SEQ ID NO: 560433 - DNA, 20 bp, mouse
gagacctggacggacaggcc

SEQ ID NO: 560434 - DNA, 20 bp, mouse
gcaccacagccaactgccgc

SEQ ID NO: 560435 - DNA, 20 bp, mouse
gatacaggatgaggaatctg

SEQ ID NO: 560436 - DNA, 20 bp, mouse
ggcccggctaggcagagctc

SEQ ID NO: 560437 - DNA, 20 bp, mouse
ggcaaaggttgggcccggct

SEQ ID NO: 560438 - DNA, 20 bp, mouse
ggatctctggagcaaaggtt

SEQ ID NO: 560439 - DNA, 20 bp, mouse
gcctcggcagccatgatctc

SEQ ID NO: 560440 - DNA, 20 bp, mouse
gatggctgccgaggatgtgg

SEQ ID NO: 560441 - DNA, 20 bp, mouse
gctgttcgctgggagggcgg

SEQ ID NO: 560442 - DNA, 20 bp, mouse
gacccgagcgagctagaggg

SEQ ID NO: 560443 - DNA, 20 bp, mouse
ggcgccactgttcgctggga

SEQ ID NO: 560444 - DNA, 20 bp, mouse
gccactgttcgctgggaggg

SEQ ID NO: 560445 - DNA, 20 bp, mouse
gcggaggaagcggactgttc

SEQ ID NO: 560446 - DNA, 20 bp, mouse
gggagcggcggggagagtgg

SEQ ID NO: 560447 - DNA, 20 bp, mouse
gctctccccgccgctcccca

SEQ ID NO: 560448 - DNA, 20 bp, mouse
gtaagcaccctggggagcgg

SEQ ID NO: 560449 - DNA, 20 bp, mouse
ggtgatggcggcgggtgatg

SEQ ID NO: 560450 - DNA, 20 bp, mouse
gtggcgggcagtgatggcgg

SEQ ID NO: 560451 - DNA, 20 bp, mouse
gggaggaggaaggcgctggc

SEQ ID NO: 560452 - DNA, 20 bp, mouse
gctgtgctcgggacccgggg

SEQ ID NO: 560453 - DNA, 20 bp, mouse
gggccccggtgaggagtgag

SEQ ID NO: 560454 - DNA, 20 bp, mouse
gcagcgcacccacagccggt

SEQ ID NO: 560455 - DNA, 20 bp, mouse
gacggcggcgaggagcagtt

SEQ ID NO: 560456 - DNA, 20 bp, mouse
gaagcggcgggtctccatgg

SEQ ID NO: 560457 - DNA, 20 bp, mouse
gagcgggcccggtgttctgg

SEQ ID NO: 560458 - DNA, 20 bp, mouse
gcggaagcggcgggtctcca

SEQ ID NO: 560459 - DNA, 20 bp, mouse
gaccgtgcaggagccacccg

SEQ ID NO: 560460 - DNA, 20 bp, mouse
gtccatggcggcgccggcag

SEQ ID NO: 560461 - DNA, 20 bp, mouse
gcagccgcctccagaacacc

SEQ ID NO: 560462 - DNA, 20 bp, mouse
gcctgcccagacggtcggag

SEQ ID NO: 560463 - DNA, 20 bp, mouse
ggcccagacggtcggagagg

SEQ ID NO: 560464 - DNA, 20 bp, mouse
gagaacaccgggcccgctgc

SEQ ID NO: 560465 - DNA, 20 bp, mouse
gcggctcctgcccagacggt

SEQ ID NO: 560466 - DNA, 20 bp, mouse
gtcaagagcactgggtggag

SEQ ID NO: 560467 - DNA, 20 bp, mouse
gacaggacgctgtcagtgag

SEQ ID NO: 560468 - DNA, 20 bp, mouse
ggagggtctgcgttataatg

SEQ ID NO: 560469 - DNA, 20 bp, mouse
ggccttgggtgggctaggta

SEQ ID NO: 560470 - DNA, 20 bp, mouse
gggacgctgtcagtgagcgg

SEQ ID NO: 560471 - DNA, 20 bp, mouse
gggtaggggttgtctcccag

SEQ ID NO: 560472 - DNA, 20 bp, mouse
ggacagcgtcctgttgaagg

SEQ ID NO: 560473 - DNA, 20 bp, mouse
gggcgtggagaggctggaac

SEQ ID NO: 560474 - DNA, 20 bp, mouse
gcttaaagcggagatctcac

SEQ ID NO: 560475 - DNA, 20 bp, mouse
gtctgatagagaaagtccag

SEQ ID NO: 560476 - DNA, 20 bp, mouse
gcgcgcgcggggagaaggtg

SEQ ID NO: 560477 - DNA, 20 bp, mouse
gggaatgacaggcatccgct

SEQ ID NO: 560478 - DNA, 20 bp, mouse
gatctgcatagaggaatgac

SEQ ID NO: 560479 - DNA, 20 bp, mouse
gatccgctgggccggcttgg

SEQ ID NO: 560480 - DNA, 20 bp, mouse
gacccgcgcgcgcggggaga

SEQ ID NO: 560481 - DNA, 20 bp, mouse
ggccggcttggcggctgcca

SEQ ID NO: 560482 - DNA, 20 bp, mouse
gaggccggcggcgagcggac

SEQ ID NO: 560483 - DNA, 20 bp, mouse
ggcctcccgcgcgctcatcg

SEQ ID NO: 560484 - DNA, 20 bp, mouse
gcccggcagcggtgagtccc

SEQ ID NO: 560485 - DNA, 20 bp, mouse
ggccctggcagccgccaagc

SEQ ID NO: 560486 - DNA, 20 bp, mouse
gccccgaaaaaaagggaaaa

SEQ ID NO: 560487 - DNA, 20 bp, mouse
ggagatgtccaggaatgtct

SEQ ID NO: 560488 - DNA, 20 bp, mouse
gggaatataagcagaagaat

SEQ ID NO: 560489 - DNA, 20 bp, mouse
gcaggaaagaaaaagaacgg

SEQ ID NO: 560490 - DNA, 20 bp, mouse
ggctgcagccaggcgcatcc

SEQ ID NO: 560491 - DNA, 20 bp, mouse
gcgagcggccccgcgacaca

SEQ ID NO: 560492 - DNA, 20 bp, mouse
gtcttctgcttatattccag

SEQ ID NO: 560493 - DNA, 20 bp, mouse
gtcggatgcggccatgggaa

SEQ ID NO: 560494 - DNA, 20 bp, mouse
ggccaaggtcaccggcgagg

SEQ ID NO: 560495 - DNA, 20 bp, mouse
gtgcggaatcagagcatcct

SEQ ID NO: 560496 - DNA, 20 bp, mouse
gagccaggcggccagagacc

SEQ ID NO: 560497 - DNA, 20 bp, mouse
gaggcggccagagaccaggt

SEQ ID NO: 560498 - DNA, 20 bp, mouse
gagtgctggggaacccgagg

SEQ ID NO: 560499 - DNA, 20 bp, mouse
gttctcccggaaatcctacc

SEQ ID NO: 560500 - DNA, 20 bp, mouse
gcccctggggccgaaggctc

SEQ ID NO: 560501 - DNA, 20 bp, mouse
ggaaagtgctggggaacccg

SEQ ID NO: 560502 - DNA, 20 bp, mouse
gttcggccccaggggagggg

SEQ ID NO: 560503 - DNA, 20 bp, mouse
gaagtcgccgctgcctcctc

SEQ ID NO: 560504 - DNA, 20 bp, mouse
gtggggccgaaggctctggc

SEQ ID NO: 560505 - DNA, 20 bp, mouse
gtttccgggagaaagtgctg

SEQ ID NO: 560506 - DNA, 20 bp, mouse
ggtcatgtcggaatccgagt

SEQ ID NO: 560507 - DNA, 20 bp, mouse
ggcgctggaagctggcgaca

SEQ ID NO: 560508 - DNA, 20 bp, mouse
gaagctggcgacatggaaga

SEQ ID NO: 560509 - DNA, 20 bp, mouse
gctggggacgaccgtcatgt

SEQ ID NO: 560510 - DNA, 20 bp, mouse
ggaagcgcggccggaatgag

SEQ ID NO: 560511 - DNA, 20 bp, mouse
gttgcagaggcctatcgctg

SEQ ID NO: 560512 - DNA, 20 bp, mouse
gggaagatggcgctggaagc

SEQ ID NO: 560513 - DNA, 20 bp, mouse
ggctcgaaggtggatggagg

SEQ ID NO: 560514 - DNA, 20 bp, mouse
gtcccgcggcgcgcagggtc

SEQ ID NO: 560515 - DNA, 20 bp, mouse
ggataggcctctgcaaatgg

SEQ ID NO: 560516 - DNA, 20 bp, mouse
gcaggtaagcgtggtaggag

SEQ ID NO: 560517 - DNA, 20 bp, mouse
gcgcgcagtatccggagctg

SEQ ID NO: 560518 - DNA, 20 bp, mouse
ggaaagcaggtaagcgtggt

SEQ ID NO: 560519 - DNA, 20 bp, mouse
ggagtgaaagcaggtaagcg

SEQ ID NO: 560520 - DNA, 20 bp, mouse
gctggcgcacgcgcagtatc

SEQ ID NO: 560521 - DNA, 20 bp, mouse
gtgtaccaagggtgacgcag

SEQ ID NO: 560522 - DNA, 20 bp, mouse
gtgaagtctgagaaagggga

SEQ ID NO: 560523 - DNA, 20 bp, mouse
gcagagcggtgaaggactgg

SEQ ID NO: 560524 - DNA, 20 bp, mouse
ggttaggaatgtgcaagggg

SEQ ID NO: 560525 - DNA, 20 bp, mouse
gtctcggtccagaaggagtt

SEQ ID NO: 560526 - DNA, 20 bp, mouse
gaggtctgtaagctggagcg

SEQ ID NO: 560527 - DNA, 20 bp, mouse
gggcaccagcggtcaggagg

SEQ ID NO: 560528 - DNA, 20 bp, mouse
gaggctccaaaggtaaacgt

SEQ ID NO: 560529 - DNA, 20 bp, mouse
gttagagctcgcgggagaaa

SEQ ID NO: 560530 - DNA, 20 bp, mouse
gcaaggcgaggtctgtaagc

SEQ ID NO: 560531 - DNA, 20 bp, mouse
ggatcctcgtgtgcaaggcg

SEQ ID NO: 560532 - DNA, 20 bp, mouse
ggaacaggcccaaggacgag

SEQ ID NO: 560533 - DNA, 20 bp, mouse
gacgtccggccagcggaagg

SEQ ID NO: 560534 - DNA, 20 bp, mouse
gccactgcggagagaggggt

SEQ ID NO: 560535 - DNA, 20 bp, mouse
gccttccactgcggagagag

SEQ ID NO: 560536 - DNA, 20 bp, mouse
ggccgggcgcgaaggtaacc

SEQ ID NO: 560537 - DNA, 20 bp, mouse
gccccgcgaggactcgggtg

SEQ ID NO: 560538 - DNA, 20 bp, mouse
gggcgcggccagcacccgga

SEQ ID NO: 560539 - DNA, 20 bp, mouse
gagcacccggacggcgggag

SEQ ID NO: 560540 - DNA, 20 bp, mouse
ggggcgcgaaggtaaccggg

SEQ ID NO: 560541 - DNA, 20 bp, mouse
gacgccccccgcgaggactc

SEQ ID NO: 560542 - DNA, 20 bp, mouse
gccgcggcgcggccagcacc

SEQ ID NO: 560543 - DNA, 20 bp, mouse
gcggggggcgtccacctcag

SEQ ID NO: 560544 - DNA, 20 bp, mouse
gccgcatcccggggtctcgg

SEQ ID NO: 560545 - DNA, 20 bp, mouse
gcgcggctccgccaggccgg

SEQ ID NO: 560546 - DNA, 20 bp, mouse
gggttgcggcgagagctcaa

SEQ ID NO: 560547 - DNA, 20 bp, mouse
gagggcggcaggcgacggcc

SEQ ID NO: 560548 - DNA, 20 bp, mouse
ggcaggcgacggccgggttg

SEQ ID NO: 560549 - DNA, 20 bp, mouse
ggcccggcggcctggacaaa

SEQ ID NO: 560550 - DNA, 20 bp, mouse
gacggcaagatccctccccg

SEQ ID NO: 560551 - DNA, 20 bp, mouse
ggcctccgcgaggcccaggg

SEQ ID NO: 560552 - DNA, 20 bp, mouse
gggcggcccgggagccggtc

SEQ ID NO: 560553 - DNA, 20 bp, mouse
gcagaggccccgagcgggag

SEQ ID NO: 560554 - DNA, 20 bp, mouse
gatccgaccgcagggcccgg

SEQ ID NO: 560555 - DNA, 20 bp, mouse
gaccttcgcttggcacggga

SEQ ID NO: 560556 - DNA, 20 bp, mouse
gcacttcgtgttagtgatgg

SEQ ID NO: 560557 - DNA, 20 bp, mouse
ggactgatgtcgtaaccggg

SEQ ID NO: 560558 - DNA, 20 bp, mouse
gcgcagcacgcactcccgag

SEQ ID NO: 560559 - DNA, 20 bp, mouse
ggcgcacttcgtgttagtga

SEQ ID NO: 560560 - DNA, 20 bp, mouse
ggccccaagagctgcctcgg

SEQ ID NO: 560561 - DNA, 20 bp, mouse
gggtggagaagcccgactgt

SEQ ID NO: 560562 - DNA, 20 bp, mouse
gtaagcgcacagctacccgg

SEQ ID NO: 560563 - DNA, 20 bp, mouse
gagcacgcactcccgagggg

SEQ ID NO: 560564 - DNA, 20 bp, mouse
gacacagccccgggaccgca

SEQ ID NO: 560565 - DNA, 20 bp, mouse
gagcggagtgagtgacttgc

SEQ ID NO: 560566 - DNA, 20 bp, mouse
ggacgacgacagttcagaca

SEQ ID NO: 560567 - DNA, 20 bp, mouse
gtccctctcaagcaattgtt

SEQ ID NO: 560568 - DNA, 20 bp, mouse
gctaaccatgataagttagg

SEQ ID NO: 560569 - DNA, 20 bp, mouse
gtcatggttagggggagggt

SEQ ID NO: 560570 - DNA, 20 bp, mouse
gcccctaaccatgataagtt

SEQ ID NO: 560571 - DNA, 20 bp, mouse
gtctagtcaaaggcgagcca

SEQ ID NO: 560572 - DNA, 20 bp, mouse
gactaattgagatcttgaat

SEQ ID NO: 560573 - DNA, 20 bp, mouse
gcgaggggaagtttcctgac

SEQ ID NO: 560574 - DNA, 20 bp, mouse
gctagtaaaacatgtatact

SEQ ID NO: 560575 - DNA, 20 bp, mouse
gtttgagaaagggtgtcgag

SEQ ID NO: 560576 - DNA, 20 bp, mouse
gcagagccgccaggacggag

SEQ ID NO: 560577 - DNA, 20 bp, mouse
ggaggagacgacagagggac

SEQ ID NO: 560578 - DNA, 20 bp, mouse
gcagcaggaaataaccttct

SEQ ID NO: 560579 - DNA, 20 bp, mouse
gggcaggaggagtcgacaga

SEQ ID NO: 560580 - DNA, 20 bp, mouse
gtcggatgggaggcttgctc

SEQ ID NO: 560581 - DNA, 20 bp, mouse
gtggagggtggggagcacca

SEQ ID NO: 560582 - DNA, 20 bp, mouse
gtccttaccggtgacagccg

SEQ ID NO: 560583 - DNA, 20 bp, mouse
gaccctaagctgagaccagg

SEQ ID NO: 560584 - DNA, 20 bp, mouse
ggctgtcaccggtaaggagg

SEQ ID NO: 560585 - DNA, 20 bp, mouse
gcgccccagagccgccagga

SEQ ID NO: 560586 - DNA, 20 bp, mouse
gagcaagtcagtgaatatct

SEQ ID NO: 560587 - DNA, 20 bp, mouse
gccttcaagcggaaatatcc

SEQ ID NO: 560588 - DNA, 20 bp, mouse
ggggtgtgacctccttcaag

SEQ ID NO: 560589 - DNA, 20 bp, mouse
gggaaatatccaggtactta

SEQ ID NO: 560590 - DNA, 20 bp, mouse
ggtgtcaccaggttcttaag

SEQ ID NO: 560591 - DNA, 20 bp, mouse
gttacggcttagtgtattaa

SEQ ID NO: 560592 - DNA, 20 bp, mouse
gacactaagccgtaagtacc

SEQ ID NO: 560593 - DNA, 20 bp, mouse
gactcagaagcctactatag

SEQ ID NO: 560594 - DNA, 20 bp, mouse
gtgacattggacttacaaca

SEQ ID NO: 560595 - DNA, 20 bp, mouse
gtaagcacttaactacatta

SEQ ID NO: 560596 - DNA, 20 bp, mouse
gagtgcctctgcaaggttct

SEQ ID NO: 560597 - DNA, 20 bp, mouse
gaagggaaagtagactattg

SEQ ID NO: 560598 - DNA, 20 bp, mouse
gaaggttcagggcagtagga

SEQ ID NO: 560599 - DNA, 20 bp, mouse
gttctaaggttcagggcagt

SEQ ID NO: 560600 - DNA, 20 bp, mouse
gtgaaacatttatgttgtgt

SEQ ID NO: 560601 - DNA, 20 bp, mouse
gagtagactattgtggatgc

SEQ ID NO: 560602 - DNA, 20 bp, mouse
gtgtaggcactggtgacctc

SEQ ID NO: 560603 - DNA, 20 bp, mouse
gcagtctccctggggagaag

SEQ ID NO: 560604 - DNA, 20 bp, mouse
gttgtgtaggttgatgtttt

SEQ ID NO: 560605 - DNA, 20 bp, mouse
ggagcaccctggcttctctt

SEQ ID NO: 560606 - DNA, 20 bp, mouse
ggcaagacaacacccagcca

SEQ ID NO: 560607 - DNA, 20 bp, mouse
gtctccctggggagaagtga

SEQ ID NO: 560608 - DNA, 20 bp, mouse
gcctggggagaagtgatggt

SEQ ID NO: 560609 - DNA, 20 bp, mouse
gagtgatggtgggaccttcc

SEQ ID NO: 560610 - DNA, 20 bp, mouse
gttctaaggttcagggcgcc

SEQ ID NO: 560611 - DNA, 20 bp, mouse
gcacaatccaggcttttgtc

SEQ ID NO: 560612 - DNA, 20 bp, mouse
gtgaaacatttgtgttgtgc

SEQ ID NO: 560613 - DNA, 20 bp, mouse
gcctggcttctcttggtcca

SEQ ID NO: 560614 - DNA, 20 bp, mouse
gacactgctgagggtggggt

SEQ ID NO: 560615 - DNA, 20 bp, mouse
gaaggttcagggcgccagga

SEQ ID NO: 560616 - DNA, 20 bp, mouse
gaatattaatgggaagtcag

SEQ ID NO: 560617 - DNA, 20 bp, mouse
gtatgtgagtaaaatattaa

SEQ ID NO: 560618 - DNA, 20 bp, mouse
gttggtaagaggagtacact

SEQ ID NO: 560619 - DNA, 20 bp, mouse
gtaattcgatagaaaaaatg

SEQ ID NO: 560620 - DNA, 20 bp, mouse
gttgttagtgcaacaaagtt

SEQ ID NO: 560621 - DNA, 20 bp, mouse
gatggtgtttttacatatat

SEQ ID NO: 560622 - DNA, 20 bp, mouse
gtgcaacaaagtttggtaag

SEQ ID NO: 560623 - DNA, 20 bp, mouse
gtttttataatgattagata

SEQ ID NO: 560624 - DNA, 20 bp, mouse
gatatatggggggaggttac

SEQ ID NO: 560625 - DNA, 20 bp, mouse
gtataaaaacaagagtaaac

SEQ ID NO: 560626 - DNA, 20 bp, mouse
ggagtacaggcgcccagtca

SEQ ID NO: 560627 - DNA, 20 bp, mouse
gttgagactgggccacacgg

SEQ ID NO: 560628 - DNA, 20 bp, mouse
gcccttgagactgggccaca

SEQ ID NO: 560629 - DNA, 20 bp, mouse
ggtcgtgcttataggagtac

SEQ ID NO: 560630 - DNA, 20 bp, mouse
gctgtctcttgggccatgac

SEQ ID NO: 560631 - DNA, 20 bp, mouse
gaagagacagcaccaccgtg

SEQ ID NO: 560632 - DNA, 20 bp, mouse
gaggagctagaagtagaatc

SEQ ID NO: 560633 - DNA, 20 bp, mouse
ggacatgctcgtgggaaagg

SEQ ID NO: 560634 - DNA, 20 bp, mouse
gcagtatctgggaaagctgt

SEQ ID NO: 560635 - DNA, 20 bp, mouse
ggtactcaccccttgagact

SEQ ID NO: 560636 - DNA, 20 bp, mouse
ggccgggacgcagacggcag

SEQ ID NO: 560637 - DNA, 20 bp, mouse
ggcggcagccgggacgcaga

SEQ ID NO: 560638 - DNA, 20 bp, mouse
ggggacgcagacggcagcgg

SEQ ID NO: 560639 - DNA, 20 bp, mouse
gactctggggaggatgatgg

SEQ ID NO: 560640 - DNA, 20 bp, mouse
ggcggcgagcggcgatcccg

SEQ ID NO: 560641 - DNA, 20 bp, mouse
ggaagagagaaggggaccgg

SEQ ID NO: 560642 - DNA, 20 bp, mouse
gggttcgtgaggtgactctg

SEQ ID NO: 560643 - DNA, 20 bp, mouse
gacggcagcgtcctccccac

SEQ ID NO: 560644 - DNA, 20 bp, mouse
gtagcgggcgctgccatccc

SEQ ID NO: 560645 - DNA, 20 bp, mouse
gaggccgccggctgtcactg

SEQ ID NO: 560646 - DNA, 20 bp, mouse
gcagcgagcgggaacccgac

SEQ ID NO: 560647 - DNA, 20 bp, mouse
ggacccgcgctgtggagagg

SEQ ID NO: 560648 - DNA, 20 bp, mouse
gtccacagcgaactgagtgg

SEQ ID NO: 560649 - DNA, 20 bp, mouse
ggtgtccacagcgaactgag

SEQ ID NO: 560650 - DNA, 20 bp, mouse
gcacgacccgcgctgtggag

SEQ ID NO: 560651 - DNA, 20 bp, mouse
gcccgggctggaggtgacgg

SEQ ID NO: 560652 - DNA, 20 bp, mouse
gtcaggtcggggagccggtc

SEQ ID NO: 560653 - DNA, 20 bp, mouse
gggcgggagaggcactgtgg

SEQ ID NO: 560654 - DNA, 20 bp, mouse
gccgagacacgagccgaact

SEQ ID NO: 560655 - DNA, 20 bp, mouse
ggctcgtgtctcgggaggga

SEQ ID NO: 560656 - DNA, 20 bp, mouse
gccttctgtcagagacaata

SEQ ID NO: 560657 - DNA, 20 bp, mouse
gccttgtcggagctgtatcc

SEQ ID NO: 560658 - DNA, 20 bp, mouse
gagacccagaatttgcacag

SEQ ID NO: 560659 - DNA, 20 bp, mouse
gggtcggagagcagctaccg

SEQ ID NO: 560660 - DNA, 20 bp, mouse
gaatagggagaacagcgacc

SEQ ID NO: 560661 - DNA, 20 bp, mouse
ggaggaccaaggagaccggt

SEQ ID NO: 560662 - DNA, 20 bp, mouse
gcccagaatttgcacagcgg

SEQ ID NO: 560663 - DNA, 20 bp, mouse
gggacagtagcccacccccg

SEQ ID NO: 560664 - DNA, 20 bp, mouse
gcgctgcgccgaccgagcag

SEQ ID NO: 560665 - DNA, 20 bp, mouse
gagggacgcgcagaggacca

SEQ ID NO: 560666 - DNA, 20 bp, mouse
ggccgcccggagggccccgg

SEQ ID NO: 560667 - DNA, 20 bp, mouse
gcgcccagatcccgcaggac

SEQ ID NO: 560668 - DNA, 20 bp, mouse
gccgcagccgttgaccccgg

SEQ ID NO: 560669 - DNA, 20 bp, mouse
gggagactcgacctgtcctg

SEQ ID NO: 560670 - DNA, 20 bp, mouse
gctccagccgccggggtcaa

SEQ ID NO: 560671 - DNA, 20 bp, mouse
ggacctgtcctgcgggatct

SEQ ID NO: 560672 - DNA, 20 bp, mouse
gcgcctggcagctccctccg

SEQ ID NO: 560673 - DNA, 20 bp, mouse
gagctgccaggcgcctctgc

SEQ ID NO: 560674 - DNA, 20 bp, mouse
gcgcgccgcccggagggccc

SEQ ID NO: 560675 - DNA, 20 bp, mouse
gctggaccaaaaagagatgg

SEQ ID NO: 560676 - DNA, 20 bp, mouse
gagctggtgccactaggagt

SEQ ID NO: 560677 - DNA, 20 bp, mouse
gcaactgcgatggccgcggt

SEQ ID NO: 560678 - DNA, 20 bp, mouse
gtgggcgcaaagtaactcca

SEQ ID NO: 560679 - DNA, 20 bp, mouse
gcctccaactgcgatggccg

SEQ ID NO: 560680 - DNA, 20 bp, mouse
gcgtgcaagtcccatcaggt

SEQ ID NO: 560681 - DNA, 20 bp, mouse
gtggtgaatggtgccgaccg

SEQ ID NO: 560682 - DNA, 20 bp, mouse
gcccgaagccaggagctcct

SEQ ID NO: 560683 - DNA, 20 bp, mouse
gtccgcggtgccctcccgag

SEQ ID NO: 560684 - DNA, 20 bp, mouse
gtacacagggggttggtgaa

SEQ ID NO: 560685 - DNA, 20 bp, mouse
gagggcagcgcccctcggga

SEQ ID NO: 560686 - DNA, 20 bp, mouse
gcggaggtaggcgctctcga

SEQ ID NO: 560687 - DNA, 20 bp, mouse
ggagacgctgcgccggaggt

SEQ ID NO: 560688 - DNA, 20 bp, mouse
gaggtaggcgctctcgaggg

SEQ ID NO: 560689 - DNA, 20 bp, mouse
ggagcgagacgctgcgccgg

SEQ ID NO: 560690 - DNA, 20 bp, mouse
gcggaacacagagcgtgtgt

SEQ ID NO: 560691 - DNA, 20 bp, mouse
ggcgctctcgagggtggcct

SEQ ID NO: 560692 - DNA, 20 bp, mouse
gtgagggggccctcagtgtg

SEQ ID NO: 560693 - DNA, 20 bp, mouse
gctctggacaggctgctggg

SEQ ID NO: 560694 - DNA, 20 bp, mouse
ggctggagcgaccccgaggg

SEQ ID NO: 560695 - DNA, 20 bp, mouse
gtcggcaccagcgaggttgt

SEQ ID NO: 560696 - DNA, 20 bp, mouse
ggccgcacgccctaccggga

SEQ ID NO: 560697 - DNA, 20 bp, mouse
ggcgcccaggccctcccggt

SEQ ID NO: 560698 - DNA, 20 bp, mouse
ggccagccgcacgccctacc

SEQ ID NO: 560699 - DNA, 20 bp, mouse
gggctgcaggacgagccgag

SEQ ID NO: 560700 - DNA, 20 bp, mouse
ggtgcgcagcaggtacgcgg

SEQ ID NO: 560701 - DNA, 20 bp, mouse
gtcggtggcccggacccatg

SEQ ID NO: 560702 - DNA, 20 bp, mouse
gcgccctaccgggagggcct

SEQ ID NO: 560703 - DNA, 20 bp, mouse
ggcaacaaaaccatcaaata

SEQ ID NO: 560704 - DNA, 20 bp, mouse
gtctgtagcgcggagggagg

SEQ ID NO: 560705 - DNA, 20 bp, mouse
ggccctcccggtagggcgtg

SEQ ID NO: 560706 - DNA, 20 bp, mouse
gagcccgagcggtaccctca

SEQ ID NO: 560707 - DNA, 20 bp, mouse
gccaccaggcacatcggcgg

SEQ ID NO: 560708 - DNA, 20 bp, mouse
ggccagactccaagtgggac

SEQ ID NO: 560709 - DNA, 20 bp, mouse
gcgcgtcagccggtcccact

SEQ ID NO: 560710 - DNA, 20 bp, mouse
gcccccgcccggggatccta

SEQ ID NO: 560711 - DNA, 20 bp, mouse
ggatagagatggagcccgag

SEQ ID NO: 560712 - DNA, 20 bp, mouse
gggatcctagggctcaatct

SEQ ID NO: 560713 - DNA, 20 bp, mouse
gcagcgcgggacttaccgcg

SEQ ID NO: 560714 - DNA, 20 bp, mouse
ggagccctaggatccccggg

SEQ ID NO: 560715 - DNA, 20 bp, mouse
gacactcggccaggcagccc

SEQ ID NO: 560716 - DNA, 20 bp, mouse
ggagccgcggccccaccgaa

SEQ ID NO: 560717 - DNA, 20 bp, mouse
gacccggggcgctgacgtag

SEQ ID NO: 560718 - DNA, 20 bp, mouse
ggcggaggcggcgccacccg

SEQ ID NO: 560719 - DNA, 20 bp, mouse
gtgacgtagcggccgctcgg

SEQ ID NO: 560720 - DNA, 20 bp, mouse
ggccggcagacgcagtacac

SEQ ID NO: 560721 - DNA, 20 bp, mouse
gagcccgcgccggcattgtg

SEQ ID NO: 560722 - DNA, 20 bp, mouse
ggccgggggtcccttcggtg

SEQ ID NO: 560723 - DNA, 20 bp, mouse
ggccgcggccggagcggacg

SEQ ID NO: 560724 - DNA, 20 bp, mouse
ggcgcgggacacaaagcgaa

SEQ ID NO: 560725 - DNA, 20 bp, mouse
gcccgacccgggcagcgcag

SEQ ID NO: 560726 - DNA, 20 bp, mouse
gtcgccacgagctcacctca

SEQ ID NO: 560727 - DNA, 20 bp, mouse
ggcgcgcacagtccttctgt

SEQ ID NO: 560728 - DNA, 20 bp, mouse
ggggccgtgaggtgagctcg

SEQ ID NO: 560729 - DNA, 20 bp, mouse
ggagcggcgcagcaggagcg

SEQ ID NO: 560730 - DNA, 20 bp, mouse
ggtgagctcgtggcgaggcg

SEQ ID NO: 560731 - DNA, 20 bp, mouse
ggagcgtcgcccaatcactg

SEQ ID NO: 560732 - DNA, 20 bp, mouse
ggcacagtccttctgtcggt

SEQ ID NO: 560733 - DNA, 20 bp, mouse
gaccgctgctgagagcgtgg

SEQ ID NO: 560734 - DNA, 20 bp, mouse
ggtgatccgggggccagtcg

SEQ ID NO: 560735 - DNA, 20 bp, mouse
ggtgagccagggtcccgcag

SEQ ID NO: 560736 - DNA, 20 bp, mouse
gaggccgagtcggtaagagg

SEQ ID NO: 560737 - DNA, 20 bp, mouse
ggaagccctcaagcccactc

SEQ ID NO: 560738 - DNA, 20 bp, mouse
gcccggccggcgtcgcgtca

SEQ ID NO: 560739 - DNA, 20 bp, mouse
gcggcggcgcgcagacaata

SEQ ID NO: 560740 - DNA, 20 bp, mouse
ggcgtcggcccgaggaaacg

SEQ ID NO: 560741 - DNA, 20 bp, mouse
gatggtagcggagccggagt

SEQ ID NO: 560742 - DNA, 20 bp, mouse
gtgcggagacgaggccgagt

SEQ ID NO: 560743 - DNA, 20 bp, mouse
gcggctgctgtgcggagacg

SEQ ID NO: 560744 - DNA, 20 bp, mouse
ggcccgggcagactcgaacg

SEQ ID NO: 560745 - DNA, 20 bp, mouse
ggcctcgttcgagtctgccc

SEQ ID NO: 560746 - DNA, 20 bp, mouse
gccggggccgggtggtgaat

SEQ ID NO: 560747 - DNA, 20 bp, mouse
gcctgggcggagggatcccc

SEQ ID NO: 560748 - DNA, 20 bp, mouse
gggccgggtggtgaatgggc

SEQ ID NO: 560749 - DNA, 20 bp, mouse
gctccaggagagacacacac

SEQ ID NO: 560750 - DNA, 20 bp, mouse
gctcttccccaggcaagggg

SEQ ID NO: 560751 - DNA, 20 bp, mouse
gcgggtggtgaatgggctgg

SEQ ID NO: 560752 - DNA, 20 bp, mouse
gcaggccccgggccggaatg

SEQ ID NO: 560753 - DNA, 20 bp, mouse
gtgtcccccctggcagctgg

SEQ ID NO: 560754 - DNA, 20 bp, mouse
ggccccgggccggaatgggg

SEQ ID NO: 560755 - DNA, 20 bp, mouse
gattagtgtgttaagatggt

SEQ ID NO: 560756 - DNA, 20 bp, mouse
gttgcgagcgtggtcaaggg

SEQ ID NO: 560757 - DNA, 20 bp, mouse
gccattgcgagcgtggtcaa

SEQ ID NO: 560758 - DNA, 20 bp, mouse
gttgtggcttgcaccccggg

SEQ ID NO: 560759 - DNA, 20 bp, mouse
gaggccacatgccgattgtg

SEQ ID NO: 560760 - DNA, 20 bp, mouse
gtgttgagatgagggtacga

SEQ ID NO: 560761 - DNA, 20 bp, mouse
gctctctttattctgctgag

SEQ ID NO: 560762 - DNA, 20 bp, mouse
ggtcttgtggcttgcacccc

SEQ ID NO: 560763 - DNA, 20 bp, mouse
ggccacaagacaaagttgaa

SEQ ID NO: 560764 - DNA, 20 bp, mouse
gcacatctacaccccacaat

SEQ ID NO: 560765 - DNA, 20 bp, mouse
gctggggcaccgggcgagag

SEQ ID NO: 560766 - DNA, 20 bp, mouse
ggcgcgcctggatctcgctg

SEQ ID NO: 560767 - DNA, 20 bp, mouse
ggccccggcccgctccatcc

SEQ ID NO: 560768 - DNA, 20 bp, mouse
gggcacccggcgcaacttag

SEQ ID NO: 560769 - DNA, 20 bp, mouse
gcgcggccccagcgagatcc

SEQ ID NO: 560770 - DNA, 20 bp, mouse
gccgcggcaaagttgtgcct

SEQ ID NO: 560771 - DNA, 20 bp, mouse
gagcggcagccggaagagtt

SEQ ID NO: 560772 - DNA, 20 bp, mouse
ggcccgcgccagctgaccgc

SEQ ID NO: 560773 - DNA, 20 bp, mouse
gcctgcagcgccgataggaa

SEQ ID NO: 560774 - DNA, 20 bp, mouse
ggcagggactatatttcctc

SEQ ID NO: 560775 - DNA, 20 bp, mouse
gcgccagctgaccgccggca

SEQ ID NO: 560776 - DNA, 20 bp, mouse
gtggtccgccaggcagtggg

SEQ ID NO: 560777 - DNA, 20 bp, mouse
ggggggccgaggccacccgg

SEQ ID NO: 560778 - DNA, 20 bp, mouse
gctcactcgcacccgcaccc

SEQ ID NO: 560779 - DNA, 20 bp, mouse
gcccgggagctgccccaatg

SEQ ID NO: 560780 - DNA, 20 bp, mouse
ggggagctgccccaatgagg

SEQ ID NO: 560781 - DNA, 20 bp, mouse
gggcgggggccgaggccacc

SEQ ID NO: 560782 - DNA, 20 bp, mouse
gcgccaggcagtgggtggtg

SEQ ID NO: 560783 - DNA, 20 bp, mouse
ggcgcgaagcagcttacctg

SEQ ID NO: 560784 - DNA, 20 bp, mouse
gtgtggctgccgcctcattg

SEQ ID NO: 560785 - DNA, 20 bp, mouse
ggagcgtgcgacgaccgtac

SEQ ID NO: 560786 - DNA, 20 bp, mouse
gcccggtccgggagtgcggg

SEQ ID NO: 560787 - DNA, 20 bp, mouse
gccgggagtgcgggaggcag

SEQ ID NO: 560788 - DNA, 20 bp, mouse
gcgccaagcggacacttcgg

SEQ ID NO: 560789 - DNA, 20 bp, mouse
gtggagggaggtggcggtag

SEQ ID NO: 560790 - DNA, 20 bp, mouse
gccgcgccaagcggacactt

SEQ ID NO: 560791 - DNA, 20 bp, mouse
gtgcgggaggcagtggtgga

SEQ ID NO: 560792 - DNA, 20 bp, mouse
gccgaaggtaagcactccat

SEQ ID NO: 560793 - DNA, 20 bp, mouse
ggagcgaggcggtagaaaca

SEQ ID NO: 560794 - DNA, 20 bp, mouse
ggagtctcaaccgcgccaag

SEQ ID NO: 560795 - DNA, 20 bp, mouse
gggtacagcgtggagagtgg

SEQ ID NO: 560796 - DNA, 20 bp, mouse
gcccccggaacggtaaacag

SEQ ID NO: 560797 - DNA, 20 bp, mouse
gcgccgccgccgcaagccga

SEQ ID NO: 560798 - DNA, 20 bp, mouse
gcacgaggcgagcgaccccc

SEQ ID NO: 560799 - DNA, 20 bp, mouse
gcgcgagagcccgcagccat

SEQ ID NO: 560800 - DNA, 20 bp, mouse
gcgcagccatcggcttgcgg

SEQ ID NO: 560801 - DNA, 20 bp, mouse
gcgtctgcggagcgggtgag

SEQ ID NO: 560802 - DNA, 20 bp, mouse
gcgcagacgagcgctgccac

SEQ ID NO: 560803 - DNA, 20 bp, mouse
gcgccgcgacgggcactcgg

SEQ ID NO: 560804 - DNA, 20 bp, mouse
gactgcagctcggacgggga

SEQ ID NO: 560805 - DNA, 20 bp, mouse
gacggcccgggaatatcagg

SEQ ID NO: 560806 - DNA, 20 bp, mouse
ggagcgctgctagaataccc

SEQ ID NO: 560807 - DNA, 20 bp, mouse
gctccagcttccacacccaa

SEQ ID NO: 560808 - DNA, 20 bp, mouse
gagaatacccaggcaccgta

SEQ ID NO: 560809 - DNA, 20 bp, mouse
gcggcttggaaaaagagtta

SEQ ID NO: 560810 - DNA, 20 bp, mouse
gccgtaggttaaaggtcggg

SEQ ID NO: 560811 - DNA, 20 bp, mouse
gacgccgtaggttaaaggtc

SEQ ID NO: 560812 - DNA, 20 bp, mouse
ggcaaaccagagccctaaag

SEQ ID NO: 560813 - DNA, 20 bp, mouse
gcccaagggcaaaggtgaca

SEQ ID NO: 560814 - DNA, 20 bp, mouse
gtgccgcaagcaggctggtg

SEQ ID NO: 560815 - DNA, 20 bp, mouse
ggttgcgccgaacgccgagt

SEQ ID NO: 560816 - DNA, 20 bp, mouse
gacggagggaggcaacgtaa

SEQ ID NO: 560817 - DNA, 20 bp, mouse
ggcgcccacgagggaagacg

SEQ ID NO: 560818 - DNA, 20 bp, mouse
ggtcgtgtgcgtacggaggg

SEQ ID NO: 560819 - DNA, 20 bp, mouse
gtaggtcgccagcctctgta

SEQ ID NO: 560820 - DNA, 20 bp, mouse
ggggaggacagcgcccacga

SEQ ID NO: 560821 - DNA, 20 bp, mouse
gctttcattcgaggagagac

SEQ ID NO: 560822 - DNA, 20 bp, mouse
gcgcggggaactcaccagtg

SEQ ID NO: 560823 - DNA, 20 bp, mouse
gccgccagagagagaatggg

SEQ ID NO: 560824 - DNA, 20 bp, mouse
gaaggcgggagtcggttctc

SEQ ID NO: 560825 - DNA, 20 bp, mouse
gctggcgggagaagacgaag

SEQ ID NO: 560826 - DNA, 20 bp, mouse
gccctcggcgacagctgggt

SEQ ID NO: 560827 - DNA, 20 bp, mouse
gcagcctgggctgaaagcgg

SEQ ID NO: 560828 - DNA, 20 bp, mouse
gcttccgtgagagcgagcag

SEQ ID NO: 560829 - DNA, 20 bp, mouse
ggcacgctcgcctccttcga

SEQ ID NO: 560830 - DNA, 20 bp, mouse
ggacgtggtaactacttcac

SEQ ID NO: 560831 - DNA, 20 bp, mouse
ggggcagcctgggctgaaag

SEQ ID NO: 560832 - DNA, 20 bp, mouse
gtagtcgttgacacaagacg

SEQ ID NO: 560833 - DNA, 20 bp, mouse
gaggaggcgagcgtgctgag

SEQ ID NO: 560834 - DNA, 20 bp, mouse
ggcggactgtggccaaaacg

SEQ ID NO: 560835 - DNA, 20 bp, mouse
gtcgctctcacggaagctac

SEQ ID NO: 560836 - DNA, 20 bp, mouse
gagcggcaggcgagtctctg

SEQ ID NO: 560837 - DNA, 20 bp, mouse
gtgccccggagcgagcccag

SEQ ID NO: 560838 - DNA, 20 bp, mouse
gtgcagggggcaagtcctca

SEQ ID NO: 560839 - DNA, 20 bp, mouse
gtgccgctgggctcgctccg

SEQ ID NO: 560840 - DNA, 20 bp, mouse
ggcgcagagctgggttgccc

SEQ ID NO: 560841 - DNA, 20 bp, mouse
gaggcagttgaggcggagag

SEQ ID NO: 560842 - DNA, 20 bp, mouse
gcccgagcctcgtaagatgg

SEQ ID NO: 560843 - DNA, 20 bp, mouse
ggctctgagggccagacggt

SEQ ID NO: 560844 - DNA, 20 bp, mouse
ggcggcgaggagattctagt

SEQ ID NO: 560845 - DNA, 20 bp, mouse
gaatcgcgaggcagttgagg

SEQ ID NO: 560846 - DNA, 20 bp, mouse
gggaccaactgataagatag

SEQ ID NO: 560847 - DNA, 20 bp, mouse
ggagattcgggaccagcagt

SEQ ID NO: 560848 - DNA, 20 bp, mouse
gggacacaagcgtaatcacc

SEQ ID NO: 560849 - DNA, 20 bp, mouse
gagaggaacgaatggcctgg

SEQ ID NO: 560850 - DNA, 20 bp, mouse
ggctgaccccagtggttcca

SEQ ID NO: 560851 - DNA, 20 bp, mouse
gccaactgataagatagggg

SEQ ID NO: 560852 - DNA, 20 bp, mouse
gaggacagccctggaaccac

SEQ ID NO: 560853 - DNA, 20 bp, mouse
gggcatcccgcaggaccaga

SEQ ID NO: 560854 - DNA, 20 bp, mouse
gagataggggaggacagccc

SEQ ID NO: 560855 - DNA, 20 bp, mouse
gaactccaggtaaggcgagc

SEQ ID NO: 560856 - DNA, 20 bp, mouse
ggtgtagagtaggaacagga

SEQ ID NO: 560857 - DNA, 20 bp, mouse
gtactctacactctcaggta

SEQ ID NO: 560858 - DNA, 20 bp, mouse
gtgcttgctgagggtggtaa

SEQ ID NO: 560859 - DNA, 20 bp, mouse
ggcacacctggcccagacac

SEQ ID NO: 560860 - DNA, 20 bp, mouse
gctgcagagtagaggtacag

SEQ ID NO: 560861 - DNA, 20 bp, mouse
ggagagtgtagagtaggaac

SEQ ID NO: 560862 - DNA, 20 bp, mouse
gacactctcaggtaaggatc

SEQ ID NO: 560863 - DNA, 20 bp, mouse
gatctggccctgcttgctga

SEQ ID NO: 560864 - DNA, 20 bp, mouse
gcacatgcccagcgagtcta

SEQ ID NO: 560865 - DNA, 20 bp, mouse
ggaggtcactcgagagttat

SEQ ID NO: 560866 - DNA, 20 bp, mouse
gggctccaccattcaagcaa

SEQ ID NO: 560867 - DNA, 20 bp, mouse
ggtgctcacgagccgagcct

SEQ ID NO: 560868 - DNA, 20 bp, mouse
gtccaccattcaagcaacgg

SEQ ID NO: 560869 - DNA, 20 bp, mouse
gacagctacagggcaggcgg

SEQ ID NO: 560870 - DNA, 20 bp, mouse
ggagaaggacggggagacac

SEQ ID NO: 560871 - DNA, 20 bp, mouse
gaccattcaagcaacggcgg

SEQ ID NO: 560872 - DNA, 20 bp, mouse
gtccgccgccgttgcttgaa

SEQ ID NO: 560873 - DNA, 20 bp, mouse
gctgcgcgggagagaaggac

SEQ ID NO: 560874 - DNA, 20 bp, mouse
gctgacagctacagggcagg

SEQ ID NO: 560875 - DNA, 20 bp, mouse
ggcctctcggagctgcgatc

SEQ ID NO: 560876 - DNA, 20 bp, mouse
ggcttgactgaaggagaccg

SEQ ID NO: 560877 - DNA, 20 bp, mouse
gtgactgaaggagaccgggg

SEQ ID NO: 560878 - DNA, 20 bp, mouse
gtcgccggccttcagtctca

SEQ ID NO: 560879 - DNA, 20 bp, mouse
gccaagggaggcggcacccg

SEQ ID NO: 560880 - DNA, 20 bp, mouse
ggcacgctcgccaagggagg

SEQ ID NO: 560881 - DNA, 20 bp, mouse
gtggtccccgggtggcgcac

SEQ ID NO: 560882 - DNA, 20 bp, mouse
ggcatcctccgcttgactga

SEQ ID NO: 560883 - DNA, 20 bp, mouse
ggtctccttcagtcaagcgg

SEQ ID NO: 560884 - DNA, 20 bp, mouse
gttcagtctcagggccgccc

SEQ ID NO: 560885 - DNA, 20 bp, mouse
ggcccccgcacgctcgccaa

SEQ ID NO: 560886 - DNA, 20 bp, mouse
ggctcgacagaacctagact

SEQ ID NO: 560887 - DNA, 20 bp, mouse
ggccgcctcccaaaacagag

SEQ ID NO: 560888 - DNA, 20 bp, mouse
gagcggcgcgacactctggt

SEQ ID NO: 560889 - DNA, 20 bp, mouse
gggtgagctcccaagcaacc

SEQ ID NO: 560890 - DNA, 20 bp, mouse
gaaacagaggggtaccgcca

SEQ ID NO: 560891 - DNA, 20 bp, mouse
gagagtccgccccacgaggg

SEQ ID NO: 560892 - DNA, 20 bp, mouse
gccagcctagtgcccagtct

SEQ ID NO: 560893 - DNA, 20 bp, mouse
gagaacctagactgggcact

SEQ ID NO: 560894 - DNA, 20 bp, mouse
ggcggagcctagtaaagctt

SEQ ID NO: 560895 - DNA, 20 bp, mouse
ggtgggactagaaaccctcg

SEQ ID NO: 560896 - DNA, 20 bp, mouse
ggcgggggctgagggactca

SEQ ID NO: 560897 - DNA, 20 bp, mouse
ggggcactgtgcgatggcgg

SEQ ID NO: 560898 - DNA, 20 bp, mouse
gggtggtgggcactgtgcga

SEQ ID NO: 560899 - DNA, 20 bp, mouse
gcgctgactggcagctgggg

SEQ ID NO: 560900 - DNA, 20 bp, mouse
gcctcgctgactggcagctg

SEQ ID NO: 560901 - DNA, 20 bp, mouse
gggtgggcactgtgcgatgg

SEQ ID NO: 560902 - DNA, 20 bp, mouse
ggaagtaagctggaagctct

SEQ ID NO: 560903 - DNA, 20 bp, mouse
gccgcaagtcccctggaggg

SEQ ID NO: 560904 - DNA, 20 bp, mouse
gctcttggaacgaagagccc

SEQ ID NO: 560905 - DNA, 20 bp, mouse
ggctttctggagccaactta

SEQ ID NO: 560906 - DNA, 20 bp, mouse
gcaaaggtcctggagccctt

SEQ ID NO: 560907 - DNA, 20 bp, mouse
ggtcctgagcagacacttat

SEQ ID NO: 560908 - DNA, 20 bp, mouse
ggattctcagagcacctgtc

SEQ ID NO: 560909 - DNA, 20 bp, mouse
ggtccttgtaggcccttgaa

SEQ ID NO: 560910 - DNA, 20 bp, mouse
ggtgctctcccaggattaag

SEQ ID NO: 560911 - DNA, 20 bp, mouse
gacacagcttcagccctttg

SEQ ID NO: 560912 - DNA, 20 bp, mouse
gctcaccgtgaggtccttgt

SEQ ID NO: 560913 - DNA, 20 bp, mouse
gagactccctaggggtgtgg

SEQ ID NO: 560914 - DNA, 20 bp, mouse
gagggcctacaaggacctca

SEQ ID NO: 560915 - DNA, 20 bp, mouse
ggcagtagatgggagcaatg

SEQ ID NO: 560916 - DNA, 20 bp, mouse
gaaggtggctcggaagaagg

SEQ ID NO: 560917 - DNA, 20 bp, mouse
ggaagaggatagggaagggc

SEQ ID NO: 560918 - DNA, 20 bp, mouse
gcctgggaggaggaaacgga

SEQ ID NO: 560919 - DNA, 20 bp, mouse
gcacaacgaagggcctaggg

SEQ ID NO: 560920 - DNA, 20 bp, mouse
ggaaatggcacaagtgcggg

SEQ ID NO: 560921 - DNA, 20 bp, mouse
gacccccgcgcccctcccag

SEQ ID NO: 560922 - DNA, 20 bp, mouse
gtgcacatcgtggctcccgg

SEQ ID NO: 560923 - DNA, 20 bp, mouse
gtgagggcaaggaggcccac

SEQ ID NO: 560924 - DNA, 20 bp, mouse
gtctgagaggatgcacatcg

SEQ ID NO: 560925 - DNA, 20 bp, mouse
gggaaaggtggctcggaaga

SEQ ID NO: 560926 - DNA, 20 bp, mouse
ggcagagagcagcccgctca

SEQ ID NO: 560927 - DNA, 20 bp, mouse
ggtgagcgctcgccggagga

SEQ ID NO: 560928 - DNA, 20 bp, mouse
gagatcccggagccgtgagc

SEQ ID NO: 560929 - DNA, 20 bp, mouse
gccggcgagcgctcactgaa

SEQ ID NO: 560930 - DNA, 20 bp, mouse
gctgactcgccacaagatcc

SEQ ID NO: 560931 - DNA, 20 bp, mouse
ggctgctctctgccgtcctc

SEQ ID NO: 560932 - DNA, 20 bp, mouse
gagcagcccgctcacggctc

SEQ ID NO: 560933 - DNA, 20 bp, mouse
gtgactcgcaggagacagag

SEQ ID NO: 560934 - DNA, 20 bp, mouse
gtggctcggggtcccggcag

SEQ ID NO: 560935 - DNA, 20 bp, mouse
gctcgcaggagacagagcgg

SEQ ID NO: 560936 - DNA, 20 bp, mouse
gccctcgcaaaggatctcgt

SEQ ID NO: 560937 - DNA, 20 bp, mouse
gtcgcaaaggatctcgtcgg

SEQ ID NO: 560938 - DNA, 20 bp, mouse
gttggtgcaacctttcgaaa

SEQ ID NO: 560939 - DNA, 20 bp, mouse
gatctcgtcggaggtcttca

SEQ ID NO: 560940 - DNA, 20 bp, mouse
ggcagcagagcgagcgcatt

SEQ ID NO: 560941 - DNA, 20 bp, mouse
gctcggggctcccgtcagag

SEQ ID NO: 560942 - DNA, 20 bp, mouse
gcccggagaagaggcgcagg

SEQ ID NO: 560943 - DNA, 20 bp, mouse
gtggaacgcggccatcacca

SEQ ID NO: 560944 - DNA, 20 bp, mouse
gttatcggaggacggagggt

SEQ ID NO: 560945 - DNA, 20 bp, mouse
gctccagctcgccctcgcaa

SEQ ID NO: 560946 - DNA, 20 bp, mouse
gcgagcggtggaacatgtaa

SEQ ID NO: 560947 - DNA, 20 bp, mouse
ggctcgcagacggagcgcag

SEQ ID NO: 560948 - DNA, 20 bp, mouse
ggctccgtctgcgagctggg

SEQ ID NO: 560949 - DNA, 20 bp, mouse
ggcaaggccaaccagctcca

SEQ ID NO: 560950 - DNA, 20 bp, mouse
gcggcgcaggaggcgagcgg

SEQ ID NO: 560951 - DNA, 20 bp, mouse
ggcagacagcgggtaccggg

SEQ ID NO: 560952 - DNA, 20 bp, mouse
gccagccagggtcttcgagg

SEQ ID NO: 560953 - DNA, 20 bp, mouse
gaggctcggggaggtcgaag

SEQ ID NO: 560954 - DNA, 20 bp, mouse
ggcgcagggttccaagccgg

SEQ ID NO: 560955 - DNA, 20 bp, mouse
gcagacggagcgcaggggag

SEQ ID NO: 560956 - DNA, 20 bp, mouse
gaggccgccgcggcccactt

SEQ ID NO: 560957 - DNA, 20 bp, mouse
gccccgaggcatagtgggag

SEQ ID NO: 560958 - DNA, 20 bp, mouse
gcgctggcaacgactcagga

SEQ ID NO: 560959 - DNA, 20 bp, mouse
gtggaaccccgaggcatagt

SEQ ID NO: 560960 - DNA, 20 bp, mouse
gccggcccctttgcccaagt

SEQ ID NO: 560961 - DNA, 20 bp, mouse
gcagagtcttcgccagcctg

SEQ ID NO: 560962 - DNA, 20 bp, mouse
ggacggcgaatggaaccccg

SEQ ID NO: 560963 - DNA, 20 bp, mouse
ggcggcccacttgggcaaag

SEQ ID NO: 560964 - DNA, 20 bp, mouse
gcgccagcctgaggccgccg

SEQ ID NO: 560965 - DNA, 20 bp, mouse
gggccgcggcggcctcaggc

SEQ ID NO: 560966 - DNA, 20 bp, mouse
gggcgcggtgcgagcagcca

SEQ ID NO: 560967 - DNA, 20 bp, mouse
gagccgccaatgcccgggag

SEQ ID NO: 560968 - DNA, 20 bp, mouse
gcgcccctcccgggcattgg

SEQ ID NO: 560969 - DNA, 20 bp, mouse
gccgccctgggcctttgagg

SEQ ID NO: 560970 - DNA, 20 bp, mouse
gggccggccaccacaggcgg

SEQ ID NO: 560971 - DNA, 20 bp, mouse
ggacgggtgggcgcaatgag

SEQ ID NO: 560972 - DNA, 20 bp, mouse
ggcctcaggctcccattggg

SEQ ID NO: 560973 - DNA, 20 bp, mouse
gttggcggctgctcgctccc

SEQ ID NO: 560974 - DNA, 20 bp, mouse
gtagacggtccagctgggag

SEQ ID NO: 560975 - DNA, 20 bp, mouse
ggagctgttggctgacctgg

SEQ ID NO: 560976 - DNA, 20 bp, mouse
gcagcggcggggaccggact

SEQ ID NO: 560977 - DNA, 20 bp, mouse
ggggaccggactaggacaca

SEQ ID NO: 560978 - DNA, 20 bp, mouse
gtggctgcagcctgcggcag

SEQ ID NO: 560979 - DNA, 20 bp, mouse
gcggagtgcgcggtgtgcgg

SEQ ID NO: 560980 - DNA, 20 bp, mouse
gggtgtgcggcggcagggtc

SEQ ID NO: 560981 - DNA, 20 bp, mouse
gctctccctgtgtcctagtc

SEQ ID NO: 560982 - DNA, 20 bp, mouse
gagagcactctaggactgta

SEQ ID NO: 560983 - DNA, 20 bp, mouse
ggggaaggggtgtccagtag

SEQ ID NO: 560984 - DNA, 20 bp, mouse
gccaagggcagcgggacccg

SEQ ID NO: 560985 - DNA, 20 bp, mouse
ggcatcgccgtgcacaatgg

SEQ ID NO: 560986 - DNA, 20 bp, mouse
ggacgaggagccctcctcta

SEQ ID NO: 560987 - DNA, 20 bp, mouse
ggggacacccagcaccctag

SEQ ID NO: 560988 - DNA, 20 bp, mouse
ggagggctcctcgtctccaa

SEQ ID NO: 560989 - DNA, 20 bp, mouse
gccttgaggctggacctcga

SEQ ID NO: 560990 - DNA, 20 bp, mouse
gcggcgcattccgaaacctt

SEQ ID NO: 560991 - DNA, 20 bp, mouse
gaggaatccgaagcggccat

SEQ ID NO: 560992 - DNA, 20 bp, mouse
gacaccacaggaatccgaag

SEQ ID NO: 560993 - DNA, 20 bp, mouse
gaagttgccccggagctggg

SEQ ID NO: 560994 - DNA, 20 bp, mouse
gtccgaaacctttggagacg

SEQ ID NO: 560995 - DNA, 20 bp, mouse
ggaggctgcacagccccttg

SEQ ID NO: 560996 - DNA, 20 bp, mouse
gtggaacaccgagacaccga

SEQ ID NO: 560997 - DNA, 20 bp, mouse
gagcgactcgcggaccccac

SEQ ID NO: 560998 - DNA, 20 bp, mouse
ggcgatccggagcattccgt

SEQ ID NO: 560999 - DNA, 20 bp, mouse
gagacaccgacggaatgctc

SEQ ID NO: 561000 - DNA, 20 bp, mouse
gcggccgcgccgaacgccat

SEQ ID NO: 561001 - DNA, 20 bp, mouse
ggaggaggtgaggcgaaggt

SEQ ID NO: 561002 - DNA, 20 bp, mouse
gttcggcgcggccgctccag

SEQ ID NO: 561003 - DNA, 20 bp, mouse
ggtcgctcccccagctccgg

SEQ ID NO: 561004 - DNA, 20 bp, mouse
gccccgagcggcgggaacgg

SEQ ID NO: 561005 - DNA, 20 bp, mouse
ggaggaccaagccctggcgg

SEQ ID NO: 561006 - DNA, 20 bp, mouse
ggcgacagcgcgagcctcgg

SEQ ID NO: 561007 - DNA, 20 bp, mouse
gacagcgccggggaccaggg

SEQ ID NO: 561008 - DNA, 20 bp, mouse
gaatccttggccgccaatgg

SEQ ID NO: 561009 - DNA, 20 bp, mouse
ggggcgtctctgtaaatcct

SEQ ID NO: 561010 - DNA, 20 bp, mouse
gcaagcggcccagggacgca

SEQ ID NO: 561011 - DNA, 20 bp, mouse
gctgctcgcgcgcgcctccg

SEQ ID NO: 561012 - DNA, 20 bp, mouse
gtttacagagacgcccggcc

SEQ ID NO: 561013 - DNA, 20 bp, mouse
gccttggccgccaatggggg

SEQ ID NO: 561014 - DNA, 20 bp, mouse
gcccccggagccacctgaag

SEQ ID NO: 561015 - DNA, 20 bp, mouse
gtggccgccaatgggggagg

SEQ ID NO: 561016 - DNA, 20 bp, mouse
ggcggtgggcccgggtgctg

SEQ ID NO: 561017 - DNA, 20 bp, mouse
gggctccccggcatttaaag

SEQ ID NO: 561018 - DNA, 20 bp, mouse
gtagggacaggatggagcaa

SEQ ID NO: 561019 - DNA, 20 bp, mouse
gtgacgtgcggggactgcgg

SEQ ID NO: 561020 - DNA, 20 bp, mouse
gggtggtggggtagtcccag

SEQ ID NO: 561021 - DNA, 20 bp, mouse
ggcatttaaaggggacgcgg

SEQ ID NO: 561022 - DNA, 20 bp, mouse
gggtgcttacgggatttggg

SEQ ID NO: 561023 - DNA, 20 bp, mouse
gcacctgccccccatcctcg

SEQ ID NO: 561024 - DNA, 20 bp, mouse
gcggcggcggccccgaggat

SEQ ID NO: 561025 - DNA, 20 bp, mouse
ggcgtcccctttaaatgccg

SEQ ID NO: 561026 - DNA, 20 bp, mouse
ggccggcgctagcagttcac

SEQ ID NO: 561027 - DNA, 20 bp, mouse
ggtaaggcacgagaaccaac

SEQ ID NO: 561028 - DNA, 20 bp, mouse
gagcggccgagcgggaccga

SEQ ID NO: 561029 - DNA, 20 bp, mouse
ggcgcagcgagtgagaaaag

SEQ ID NO: 561030 - DNA, 20 bp, mouse
gcccgctgcgacccaggcct

SEQ ID NO: 561031 - DNA, 20 bp, mouse
gccagcatcagcaccagcgt

SEQ ID NO: 561032 - DNA, 20 bp, mouse
ggcagttcaccggctgcgta

SEQ ID NO: 561033 - DNA, 20 bp, mouse
gacccaggcctgggtcgcag

SEQ ID NO: 561034 - DNA, 20 bp, mouse
ggccccgctggctgaggtga

SEQ ID NO: 561035 - DNA, 20 bp, mouse
gagaaccaaccggccgacgc

SEQ ID NO: 561036 - DNA, 20 bp, mouse
gggcgcagaggacctgagac

SEQ ID NO: 561037 - DNA, 20 bp, mouse
gcagagtgcgggccgcgacg

SEQ ID NO: 561038 - DNA, 20 bp, mouse
gcaggcgccgaagtcaccgt

SEQ ID NO: 561039 - DNA, 20 bp, mouse
ggagtccgcccgccccgtcg

SEQ ID NO: 561040 - DNA, 20 bp, mouse
gttgcaccggggcagagtgc

SEQ ID NO: 561041 - DNA, 20 bp, mouse
gctgcacttgcgttgcaccg

SEQ ID NO: 561042 - DNA, 20 bp, mouse
gagtgcgggccgcgacgggg

SEQ ID NO: 561043 - DNA, 20 bp, mouse
gactctcgggcgctcagagc

SEQ ID NO: 561044 - DNA, 20 bp, mouse
gcgcggcccgcactctgccc

SEQ ID NO: 561045 - DNA, 20 bp, mouse
ggcgccgaagtcaccgtagg

SEQ ID NO: 561046 - DNA, 20 bp, mouse
gagtaaggaggccagtgtgg

SEQ ID NO: 561047 - DNA, 20 bp, mouse
gaagatggatgtggagacgg

SEQ ID NO: 561048 - DNA, 20 bp, mouse
gccggccatacaggactcgt

SEQ ID NO: 561049 - DNA, 20 bp, mouse
gtggagacggtggctggagt

SEQ ID NO: 561050 - DNA, 20 bp, mouse
gggctcggctggtagtaagg

SEQ ID NO: 561051 - DNA, 20 bp, mouse
gctaggctcggctggtagta

SEQ ID NO: 561052 - DNA, 20 bp, mouse
gccagtgccagcccaataga

SEQ ID NO: 561053 - DNA, 20 bp, mouse
gggatcccggcgtgagggac

SEQ ID NO: 561054 - DNA, 20 bp, mouse
gtgcagcctgggcaccctca

SEQ ID NO: 561055 - DNA, 20 bp, mouse
gctgcaggatcccggcgtga

SEQ ID NO: 561056 - DNA, 20 bp, mouse
gagcgcttcggggaacatgg

SEQ ID NO: 561057 - DNA, 20 bp, mouse
gtacatcaggaatctgaccg

SEQ ID NO: 561058 - DNA, 20 bp, mouse
gtcgagcgcttcggggaaca

SEQ ID NO: 561059 - DNA, 20 bp, mouse
ggaggcgggacgaaggttag

SEQ ID NO: 561060 - DNA, 20 bp, mouse
gaccttcgtcccgcctccaa

SEQ ID NO: 561061 - DNA, 20 bp, mouse
gggaacatggcggcggacct

SEQ ID NO: 561062 - DNA, 20 bp, mouse
ggggctgagtaccacggtga

SEQ ID NO: 561063 - DNA, 20 bp, mouse
gggccccacactgaactcta

SEQ ID NO: 561064 - DNA, 20 bp, mouse
ggcccagagatcgagcgctt

SEQ ID NO: 561065 - DNA, 20 bp, mouse
gggcccgcctccctacgcat

SEQ ID NO: 561066 - DNA, 20 bp, mouse
gggtcgtgttcggacagagg

SEQ ID NO: 561067 - DNA, 20 bp, mouse
gtcgtctaggagcgtccggg

SEQ ID NO: 561068 - DNA, 20 bp, mouse
gggatcgtctaggagcgtcc

SEQ ID NO: 561069 - DNA, 20 bp, mouse
gcggctgaccggcctacttg

SEQ ID NO: 561070 - DNA, 20 bp, mouse
gtccgaacacgaccgcaagt

SEQ ID NO: 561071 - DNA, 20 bp, mouse
gtgcggtcgtgttcggacag

SEQ ID NO: 561072 - DNA, 20 bp, mouse
ggtcggtccggaggacgaga

SEQ ID NO: 561073 - DNA, 20 bp, mouse
ggacggcggcggcggctgac

SEQ ID NO: 561074 - DNA, 20 bp, mouse
ggcctacttgcggtcgtgtt

SEQ ID NO: 561075 - DNA, 20 bp, mouse
gcccgcggccagagcgacgt

SEQ ID NO: 561076 - DNA, 20 bp, mouse
gagctgcggcccgtccctca

SEQ ID NO: 561077 - DNA, 20 bp, mouse
gcggccccgggccggagcaa

SEQ ID NO: 561078 - DNA, 20 bp, mouse
gtgcggcccgtccctcacgg

SEQ ID NO: 561079 - DNA, 20 bp, mouse
gcggcgcgcgtcctccgtga

SEQ ID NO: 561080 - DNA, 20 bp, mouse
ggcgcgtcctccgtgaggga

SEQ ID NO: 561081 - DNA, 20 bp, mouse
ggccacctcggcacccgcaa

SEQ ID NO: 561082 - DNA, 20 bp, mouse
gagccacagacgcccgacct

SEQ ID NO: 561083 - DNA, 20 bp, mouse
ggaagccagcagacggcccc

SEQ ID NO: 561084 - DNA, 20 bp, mouse
gtcgagagcttgtggagctg

SEQ ID NO: 561085 - DNA, 20 bp, mouse
gcacagacgcccgacctagg

SEQ ID NO: 561086 - DNA, 20 bp, mouse
gtctcctagccgcttcccag

SEQ ID NO: 561087 - DNA, 20 bp, mouse
ggagacgcgcagagtcgcga

SEQ ID NO: 561088 - DNA, 20 bp, mouse
ggctctttgggctccagcgg

SEQ ID NO: 561089 - DNA, 20 bp, mouse
gcggcgccggcggctacggt

SEQ ID NO: 561090 - DNA, 20 bp, mouse
gtgctcggcgggccatgtgg

SEQ ID NO: 561091 - DNA, 20 bp, mouse
ggtagctctttgggctccag

SEQ ID NO: 561092 - DNA, 20 bp, mouse
gcccgccgagcatggagctg

SEQ ID NO: 561093 - DNA, 20 bp, mouse
gggcgcggcgccggcggcta

SEQ ID NO: 561094 - DNA, 20 bp, mouse
ggtccccagagggcgtgtgg

SEQ ID NO: 561095 - DNA, 20 bp, mouse
gcgcgccccggcgaagggag

SEQ ID NO: 561096 - DNA, 20 bp, mouse
gatgggccaggcacctacag

SEQ ID NO: 561097 - DNA, 20 bp, mouse
gtacaaggatggctcaacaa

SEQ ID NO: 561098 - DNA, 20 bp, mouse
gtggcagaattccccttggg

SEQ ID NO: 561099 - DNA, 20 bp, mouse
ggattggcagaattcccctt

SEQ ID NO: 561100 - DNA, 20 bp, mouse
ggtgtgtaactaaatgggcc

SEQ ID NO: 561101 - DNA, 20 bp, mouse
gtgattctgccaccacccaa

SEQ ID NO: 561102 - DNA, 20 bp, mouse
gggtctatatgatacaagga

SEQ ID NO: 561103 - DNA, 20 bp, mouse
gatcctctggtacaggacag

SEQ ID NO: 561104 - DNA, 20 bp, mouse
ggaatcaagttgctagcagc

SEQ ID NO: 561105 - DNA, 20 bp, mouse
gggaaagtggcagtacatat

SEQ ID NO: 561106 - DNA, 20 bp, mouse
gtggagactgtgatccatac

SEQ ID NO: 561107 - DNA, 20 bp, mouse
ggactgtgatccatactgga

SEQ ID NO: 561108 - DNA, 20 bp, mouse
ggacatggtaggtagcactt

SEQ ID NO: 561109 - DNA, 20 bp, mouse
ggacaacagccctccacctc

SEQ ID NO: 561110 - DNA, 20 bp, mouse
ggtgctacctaccatgtcaa

SEQ ID NO: 561111 - DNA, 20 bp, mouse
gtttagtccgttgacatggt

SEQ ID NO: 561112 - DNA, 20 bp, mouse
ggcatgcccatagaaaaact

SEQ ID NO: 561113 - DNA, 20 bp, mouse
gaaaggaaagcttatcatta

SEQ ID NO: 561114 - DNA, 20 bp, mouse
gattctatgtgttgatcagc

SEQ ID NO: 561115 - DNA, 20 bp, mouse
gttaaataacaaggtagaaa

SEQ ID NO: 561116 - DNA, 20 bp, mouse
gccggcgcgcgtaagattca

SEQ ID NO: 561117 - DNA, 20 bp, mouse
gcctccacccgggaacccta

SEQ ID NO: 561118 - DNA, 20 bp, mouse
ggcgcgcgtaagattcatgg

SEQ ID NO: 561119 - DNA, 20 bp, mouse
gcccggctgcaggtccttct

SEQ ID NO: 561120 - DNA, 20 bp, mouse
ggagcccttccagaagacga

SEQ ID NO: 561121 - DNA, 20 bp, mouse
gtcggccgaggtgtcccaga

SEQ ID NO: 561122 - DNA, 20 bp, mouse
gcgcgtaagattcatggtgg

SEQ ID NO: 561123 - DNA, 20 bp, mouse
gcacccgggaaccctaggga

SEQ ID NO: 561124 - DNA, 20 bp, mouse
gtctctggtgggacttctct

SEQ ID NO: 561125 - DNA, 20 bp, mouse
gtctggaagggctctctggt

SEQ ID NO: 561126 - DNA, 20 bp, mouse
gccccggtcagatacagtgg

SEQ ID NO: 561127 - DNA, 20 bp, mouse
ggctggagaggagaaagttc

SEQ ID NO: 561128 - DNA, 20 bp, mouse
gaggccatggggaatactgc

SEQ ID NO: 561129 - DNA, 20 bp, mouse
gagtcctgcagtattcccca

SEQ ID NO: 561130 - DNA, 20 bp, mouse
ggaatactgcaggactcagc

SEQ ID NO: 561131 - DNA, 20 bp, mouse
ggtactagtgtgtctagtgt

SEQ ID NO: 561132 - DNA, 20 bp, mouse
gtcacaactcaagaaggtag

SEQ ID NO: 561133 - DNA, 20 bp, mouse
gcccaaccacagctccagga

SEQ ID NO: 561134 - DNA, 20 bp, mouse
gctgcgaacaaagcccaaga

SEQ ID NO: 561135 - DNA, 20 bp, mouse
gctaatccagctagccccag

SEQ ID NO: 561136 - DNA, 20 bp, mouse
gagtaagcgcgcaagaagag

SEQ ID NO: 561137 - DNA, 20 bp, mouse
gggccctgcagagggatact

SEQ ID NO: 561138 - DNA, 20 bp, mouse
ggctcccggcaagaaaacgg

SEQ ID NO: 561139 - DNA, 20 bp, mouse
gactgctcccggcaagaaaa

SEQ ID NO: 561140 - DNA, 20 bp, mouse
gcgaaatcaaagcagcgtgg

SEQ ID NO: 561141 - DNA, 20 bp, mouse
gagaggcagagaaatcgaga

SEQ ID NO: 561142 - DNA, 20 bp, mouse
ggacagtggcgagaccctgg

SEQ ID NO: 561143 - DNA, 20 bp, mouse
gtgatgatctctccaggcag

SEQ ID NO: 561144 - DNA, 20 bp, mouse
ggagcgaaatcaaagcagcg

SEQ ID NO: 561145 - DNA, 20 bp, mouse
gccattggtggagccagatt

SEQ ID NO: 561146 - DNA, 20 bp, mouse
gtcgggagtcgcggccgagg

SEQ ID NO: 561147 - DNA, 20 bp, mouse
gtgaggacgagggcaacctc

SEQ ID NO: 561148 - DNA, 20 bp, mouse
gctacgagccgcgcactcga

SEQ ID NO: 561149 - DNA, 20 bp, mouse
gctcctcacacggactactg

SEQ ID NO: 561150 - DNA, 20 bp, mouse
gaacctccggtcgggagtcg

SEQ ID NO: 561151 - DNA, 20 bp, mouse
gacgagggcaacctccggtc

SEQ ID NO: 561152 - DNA, 20 bp, mouse
gcgaccgtgatggtgaggaa

SEQ ID NO: 561153 - DNA, 20 bp, mouse
gcggctcgtagactgaacgc

SEQ ID NO: 561154 - DNA, 20 bp, mouse
gtgagggcatggtccaggcg

SEQ ID NO: 561155 - DNA, 20 bp, mouse
gcgcgggagaaggctaccgg

SEQ ID NO: 561156 - DNA, 20 bp, mouse
gcgtctcaggtccagagtga

SEQ ID NO: 561157 - DNA, 20 bp, mouse
gaggtccagagtgacggcct

SEQ ID NO: 561158 - DNA, 20 bp, mouse
gccgcggccatggcgccgag

SEQ ID NO: 561159 - DNA, 20 bp, mouse
gcgcgccaaggccgtcactc

SEQ ID NO: 561160 - DNA, 20 bp, mouse
ggttcacggccgcttctagt

SEQ ID NO: 561161 - DNA, 20 bp, mouse
gagctcgctccacgggacag

SEQ ID NO: 561162 - DNA, 20 bp, mouse
gttatgcaggtggctgccag

SEQ ID NO: 561163 - DNA, 20 bp, mouse
ggcttctagtaggctgaggg

SEQ ID NO: 561164 - DNA, 20 bp, mouse
gctgctcaggtaccgggtgt

SEQ ID NO: 561165 - DNA, 20 bp, mouse
gtgggtactggctgaccgct

SEQ ID NO: 561166 - DNA, 20 bp, mouse
gctgcataccgagtgacata

SEQ ID NO: 561167 - DNA, 20 bp, mouse
gctcggtatgcagaatgtct

SEQ ID NO: 561168 - DNA, 20 bp, mouse
gcccccttagcagtgagact

SEQ ID NO: 561169 - DNA, 20 bp, mouse
gagtttgcaaagtccagaaa

SEQ ID NO: 561170 - DNA, 20 bp, mouse
gtcattctcagggtcagctt

SEQ ID NO: 561171 - DNA, 20 bp, mouse
gtgtactaccctatgtcact

SEQ ID NO: 561172 - DNA, 20 bp, mouse
gtgtgcagaggtaagctact

SEQ ID NO: 561173 - DNA, 20 bp, mouse
gaggagcagtgtattcattt

SEQ ID NO: 561174 - DNA, 20 bp, mouse
gaaacccagtctcactgcta

SEQ ID NO: 561175 - DNA, 20 bp, mouse
gaagattcctggctggaaac

SEQ ID NO: 561176 - DNA, 20 bp, mouse
gcggcggcaacatcacccac

SEQ ID NO: 561177 - DNA, 20 bp, mouse
gccagacccctgatcaggag

SEQ ID NO: 561178 - DNA, 20 bp, mouse
gctgcaggaaccgtgcatgg

SEQ ID NO: 561179 - DNA, 20 bp, mouse
gcacggttcctgcagcccgt

SEQ ID NO: 561180 - DNA, 20 bp, mouse
gagctgccagacccctgatc

SEQ ID NO: 561181 - DNA, 20 bp, mouse
ggaggctggcggggacacct

SEQ ID NO: 561182 - DNA, 20 bp, mouse
gccacggggaggcgaggaga

SEQ ID NO: 561183 - DNA, 20 bp, mouse
gactgctgtgtggggagcca

SEQ ID NO: 561184 - DNA, 20 bp, mouse
gactctgtcactgaccagag

SEQ ID NO: 561185 - DNA, 20 bp, mouse
gcgcacccttcaggcccagg

SEQ ID NO: 561186 - DNA, 20 bp, mouse
ggagccggcggcctgaggga

SEQ ID NO: 561187 - DNA, 20 bp, mouse
gcccgctcgggggacactag

SEQ ID NO: 561188 - DNA, 20 bp, mouse
ggcgcgccgggtccccgagc

SEQ ID NO: 561189 - DNA, 20 bp, mouse
gccccgagccggcggcctga

SEQ ID NO: 561190 - DNA, 20 bp, mouse
gacgggaaggtgtactccgg

SEQ ID NO: 561191 - DNA, 20 bp, mouse
ggcccggccacgaccgggag

SEQ ID NO: 561192 - DNA, 20 bp, mouse
ggcctgcaccgccaccgtgt

SEQ ID NO: 561193 - DNA, 20 bp, mouse
gcccgagcgggcccaacccc

SEQ ID NO: 561194 - DNA, 20 bp, mouse
gcaattggcagacagatctt

SEQ ID NO: 561195 - DNA, 20 bp, mouse
gtgctcgcccggccacgacc

SEQ ID NO: 561196 - DNA, 20 bp, mouse
ggcatcacgccaaaccgcgg

SEQ ID NO: 561197 - DNA, 20 bp, mouse
gctggtgaggtggcgtcggt

SEQ ID NO: 561198 - DNA, 20 bp, mouse
gtggactggtgaggtggcgt

SEQ ID NO: 561199 - DNA, 20 bp, mouse
gggagcagtcccccgcggtt

SEQ ID NO: 561200 - DNA, 20 bp, mouse
ggcgggctggtggactggtg

SEQ ID NO: 561201 - DNA, 20 bp, mouse
gccagcatcacgccaaaccg

SEQ ID NO: 561202 - DNA, 20 bp, mouse
gcggtgggagcagtcccccg

SEQ ID NO: 561203 - DNA, 20 bp, mouse
ggagccgccccgggacatca

SEQ ID NO: 561204 - DNA, 20 bp, mouse
ggtcccagtccggagcccgg

SEQ ID NO: 561205 - DNA, 20 bp, mouse
gtcccgggcgcgaccctccg

SEQ ID NO: 561206 - DNA, 20 bp, mouse
ggcgcctgcgcagtaaggac

SEQ ID NO: 561207 - DNA, 20 bp, mouse
gcctgcgcagtaaggaccgg

SEQ ID NO: 561208 - DNA, 20 bp, mouse
ggccatcacagcgcacgccc

SEQ ID NO: 561209 - DNA, 20 bp, mouse
ggcgcagtaaggaccggtgg

SEQ ID NO: 561210 - DNA, 20 bp, mouse
gtgcgtactgacaggaggag

SEQ ID NO: 561211 - DNA, 20 bp, mouse
ggccggggcgtgcgctgtga

SEQ ID NO: 561212 - DNA, 20 bp, mouse
ggctacttgcgactagagag

SEQ ID NO: 561213 - DNA, 20 bp, mouse
gacagcgcacgccccggcgc

SEQ ID NO: 561214 - DNA, 20 bp, mouse
ggtgcagagaccagcatcct

SEQ ID NO: 561215 - DNA, 20 bp, mouse
ggagaggggctcctgaatag

SEQ ID NO: 561216 - DNA, 20 bp, mouse
gggccaatggaacccgggag

SEQ ID NO: 561217 - DNA, 20 bp, mouse
gggccgctcccgggttccat

SEQ ID NO: 561218 - DNA, 20 bp, mouse
gggtgcagctgccaccaggg

SEQ ID NO: 561219 - DNA, 20 bp, mouse
ggccgccgcggccgctgtca

SEQ ID NO: 561220 - DNA, 20 bp, mouse
ggcttccctgacagcggccg

SEQ ID NO: 561221 - DNA, 20 bp, mouse
gtgtagtcgaacccaggtcg

SEQ ID NO: 561222 - DNA, 20 bp, mouse
gtacggaacagaggcaacag

SEQ ID NO: 561223 - DNA, 20 bp, mouse
ggggaagcgcaggcggccaa

SEQ ID NO: 561224 - DNA, 20 bp, mouse
gccccgggcccgagaggaaa

SEQ ID NO: 561225 - DNA, 20 bp, mouse
ggcaggcggccaatggaacc

SEQ ID NO: 561226 - DNA, 20 bp, mouse
gggagacgctcgcttcggct

SEQ ID NO: 561227 - DNA, 20 bp, mouse
gggcatgcaggtgagcgagg

SEQ ID NO: 561228 - DNA, 20 bp, mouse
ggagtctgctccctacgggt

SEQ ID NO: 561229 - DNA, 20 bp, mouse
gcggcgggagacgctcgctt

SEQ ID NO: 561230 - DNA, 20 bp, mouse
gctggagaccgcgccaggag

SEQ ID NO: 561231 - DNA, 20 bp, mouse
gacccaaagcccctacccgt

SEQ ID NO: 561232 - DNA, 20 bp, mouse
gaggcgctcggagctacgcg

SEQ ID NO: 561233 - DNA, 20 bp, mouse
gcatggtcgggaggtttggc

SEQ ID NO: 561234 - DNA, 20 bp, mouse
gggggtcgcagaaacgggtg

SEQ ID NO: 561235 - DNA, 20 bp, mouse
gacgcggagctggcactggg

SEQ ID NO: 561236 - DNA, 20 bp, mouse
ggcggacagtgcggaactaa

SEQ ID NO: 561237 - DNA, 20 bp, mouse
gagagtgagtcgggacgtgg

SEQ ID NO: 561238 - DNA, 20 bp, mouse
gtgcgctgacagacgcaaga

SEQ ID NO: 561239 - DNA, 20 bp, mouse
gagggtccgacccatccccc

SEQ ID NO: 561240 - DNA, 20 bp, mouse
gcgcaagatggcggacagtg

SEQ ID NO: 561241 - DNA, 20 bp, mouse
gagccaggccccctccacta

SEQ ID NO: 561242 - DNA, 20 bp, mouse
ggagcccgggacggcgaaag

SEQ ID NO: 561243 - DNA, 20 bp, mouse
gccgagtctggagttgtagg

SEQ ID NO: 561244 - DNA, 20 bp, mouse
ggcgctccgggccttagtgg

SEQ ID NO: 561245 - DNA, 20 bp, mouse
ggaggcgctccgggccttag

SEQ ID NO: 561246 - DNA, 20 bp, mouse
gcacgtgaggggcccggtgg

SEQ ID NO: 561247 - DNA, 20 bp, mouse
ggcggccgcggcgtctagag

SEQ ID NO: 561248 - DNA, 20 bp, mouse
ggtgaggggcccggtggagg

SEQ ID NO: 561249 - DNA, 20 bp, mouse
ggccccggcgacgaccgcga

SEQ ID NO: 561250 - DNA, 20 bp, mouse
gggtcacgtgaggggcccgg

SEQ ID NO: 561251 - DNA, 20 bp, mouse
gctgggtaggaggccgacta

SEQ ID NO: 561252 - DNA, 20 bp, mouse
gcgcgcggcgccggaccgta

SEQ ID NO: 561253 - DNA, 20 bp, mouse
gggcgccgctctagacgccg

SEQ ID NO: 561254 - DNA, 20 bp, mouse
gcccgcgcaggtcacgtgag

SEQ ID NO: 561255 - DNA, 20 bp, mouse
gggtggtggaggtgtcggcg

SEQ ID NO: 561256 - DNA, 20 bp, mouse
ggcacggctggagttcagtc

SEQ ID NO: 561257 - DNA, 20 bp, mouse
ggaaagggctcgcgcagctc

SEQ ID NO: 561258 - DNA, 20 bp, mouse
ggctccggcagtctgctgca

SEQ ID NO: 561259 - DNA, 20 bp, mouse
ggagttgcgggggtgagccc

SEQ ID NO: 561260 - DNA, 20 bp, mouse
gacgagaaggcggacccgaa

SEQ ID NO: 561261 - DNA, 20 bp, mouse
gccggcggcgggagacacgg

SEQ ID NO: 561262 - DNA, 20 bp, mouse
gtcaggcccgggcggtgctg

SEQ ID NO: 561263 - DNA, 20 bp, mouse
gagctcctctagaggcgtag

SEQ ID NO: 561264 - DNA, 20 bp, mouse
gcttacccgcagagttgcgg

SEQ ID NO: 561265 - DNA, 20 bp, mouse
ggctcacccccgcaactctg

SEQ ID NO: 561266 - DNA, 20 bp, mouse
ggggacgctagtggccaaga

SEQ ID NO: 561267 - DNA, 20 bp, mouse
gactgtgggaacccctgcta

SEQ ID NO: 561268 - DNA, 20 bp, mouse
gtagacggcggggacacccc

SEQ ID NO: 561269 - DNA, 20 bp, mouse
gccggcgcgggggacgctag

SEQ ID NO: 561270 - DNA, 20 bp, mouse
gacggcggggacaccccagg

SEQ ID NO: 561271 - DNA, 20 bp, mouse
ggagtgagcgagagtggctc

SEQ ID NO: 561272 - DNA, 20 bp, mouse
ggggccctcacgtgacgcga

SEQ ID NO: 561273 - DNA, 20 bp, mouse
ggtgagggccctcgactaaa

SEQ ID NO: 561274 - DNA, 20 bp, mouse
gcaaagtgagtgagcgagag

SEQ ID NO: 561275 - DNA, 20 bp, mouse
ggggtcgccagctccctcct

SEQ ID NO: 561276 - DNA, 20 bp, mouse
ggccgtgccccagaagaagt

SEQ ID NO: 561277 - DNA, 20 bp, mouse
ggttcttccgacttcttctg

SEQ ID NO: 561278 - DNA, 20 bp, mouse
gtccgggaaggagtgagctt

SEQ ID NO: 561279 - DNA, 20 bp, mouse
gaagaagtcggaagaacctg

SEQ ID NO: 561280 - DNA, 20 bp, mouse
gggagttactgaccattgag

SEQ ID NO: 561281 - DNA, 20 bp, mouse
ggcgccgcgtgagaaagaaa

SEQ ID NO: 561282 - DNA, 20 bp, mouse
gcctggaagctacctctcaa

SEQ ID NO: 561283 - DNA, 20 bp, mouse
gcccctcaacaggtatctcg

SEQ ID NO: 561284 - DNA, 20 bp, mouse
gcccggaagccagtcggaag

SEQ ID NO: 561285 - DNA, 20 bp, mouse
ggctaccggaccgttaggat

SEQ ID NO: 561286 - DNA, 20 bp, mouse
ggctccagctgaccagggaa

SEQ ID NO: 561287 - DNA, 20 bp, mouse
gggtcagctggagcccgacc

SEQ ID NO: 561288 - DNA, 20 bp, mouse
gcagctgaccagggaagggg

SEQ ID NO: 561289 - DNA, 20 bp, mouse
gggagcccgaccgggtaaga

SEQ ID NO: 561290 - DNA, 20 bp, mouse
ggctgcctggccctcttacc

SEQ ID NO: 561291 - DNA, 20 bp, mouse
gagcccggaaagctccgagg

SEQ ID NO: 561292 - DNA, 20 bp, mouse
gctggccctcttacccggtc

SEQ ID NO: 561293 - DNA, 20 bp, mouse
gggcagcccggaaagctccg

SEQ ID NO: 561294 - DNA, 20 bp, mouse
ggggctcccacaccaagtcg

SEQ ID NO: 561295 - DNA, 20 bp, mouse
gccaagtcggggccactccc

SEQ ID NO: 561296 - DNA, 20 bp, mouse
gcggtcgccgccaggtggaa

SEQ ID NO: 561297 - DNA, 20 bp, mouse
ggcagtgggaccgactctct

SEQ ID NO: 561298 - DNA, 20 bp, mouse
gcacctgccgttccacctgg

SEQ ID NO: 561299 - DNA, 20 bp, mouse
gccggagcctcaggctagaa

SEQ ID NO: 561300 - DNA, 20 bp, mouse
gagtcgctcaccgagagagt

SEQ ID NO: 561301 - DNA, 20 bp, mouse
gtaactgcccagctcgggag

SEQ ID NO: 561302 - DNA, 20 bp, mouse
ggcgcggagctggggtactg

SEQ ID NO: 561303 - DNA, 20 bp, mouse
gtgccagcctggcccgggcc

SEQ ID NO: 561304 - DNA, 20 bp, mouse
gggaagtgacgcgacagtcg

SEQ ID NO: 561305 - DNA, 20 bp, mouse
gtccgggtcccgggccagag

SEQ ID NO: 561306 - DNA, 20 bp, mouse
gggctgagagcgggacgagg

SEQ ID NO: 561307 - DNA, 20 bp, mouse
gcgcagcccggtgggcgcaa

SEQ ID NO: 561308 - DNA, 20 bp, mouse
gtccgctgccggcaacttgt

SEQ ID NO: 561309 - DNA, 20 bp, mouse
gaagggctgagagcgggacg

SEQ ID NO: 561310 - DNA, 20 bp, mouse
gtgagctgcgcaccgactgg

SEQ ID NO: 561311 - DNA, 20 bp, mouse
gagcggagcccacaagttgc

SEQ ID NO: 561312 - DNA, 20 bp, mouse
ggcccacaagttgccggcag

SEQ ID NO: 561313 - DNA, 20 bp, mouse
ggcgccggccgcagcccggt

SEQ ID NO: 561314 - DNA, 20 bp, mouse
ggtctgagctgcgcaccgac

SEQ ID NO: 561315 - DNA, 20 bp, mouse
gccggaaggagagagatctg

SEQ ID NO: 561316 - DNA, 20 bp, mouse
gcccggctcggaactcacgg

SEQ ID NO: 561317 - DNA, 20 bp, mouse
gaactcacggcggctcgtgg

SEQ ID NO: 561318 - DNA, 20 bp, mouse
gccgcccggctcggaactca

SEQ ID NO: 561319 - DNA, 20 bp, mouse
gcgccgccgtggctaaaggg

SEQ ID NO: 561320 - DNA, 20 bp, mouse
ggctgggccggacggcgacg

SEQ ID NO: 561321 - DNA, 20 bp, mouse
gaggcccgcaggcgggagca

SEQ ID NO: 561322 - DNA, 20 bp, mouse
ggaggccgagctgggccgga

SEQ ID NO: 561323 - DNA, 20 bp, mouse
gccgcgcgccatggcactct

SEQ ID NO: 561324 - DNA, 20 bp, mouse
gtcgcgccgccgtggctaaa

SEQ ID NO: 561325 - DNA, 20 bp, mouse
gtaaagggaggtgcgagggc

SEQ ID NO: 561326 - DNA, 20 bp, mouse
ggggctgcttggctcgggag

SEQ ID NO: 561327 - DNA, 20 bp, mouse
ggaggtccccgcgtccccaa

SEQ ID NO: 561328 - DNA, 20 bp, mouse
ggggagaggctgctccgttg

SEQ ID NO: 561329 - DNA, 20 bp, mouse
gagctcctcacggggaggac

SEQ ID NO: 561330 - DNA, 20 bp, mouse
gtattggccctgggacacgt

SEQ ID NO: 561331 - DNA, 20 bp, mouse
gtgtcccagggccaatagga

SEQ ID NO: 561332 - DNA, 20 bp, mouse
ggaggagctcgcgccctccg

SEQ ID NO: 561333 - DNA, 20 bp, mouse
gtgcaaagtttcattgaagg

SEQ ID NO: 561334 - DNA, 20 bp, mouse
gcgcacagctcctcacgggg

SEQ ID NO: 561335 - DNA, 20 bp, mouse
gaaagtttcattgaaggtgg

SEQ ID NO: 561336 - DNA, 20 bp, mouse
gtctatcggatccttgaggt

SEQ ID NO: 561337 - DNA, 20 bp, mouse
gcgagtctatcggatccttg

SEQ ID NO: 561338 - DNA, 20 bp, mouse
gctgaaagcaacgagtctat

SEQ ID NO: 561339 - DNA, 20 bp, mouse
gtagtgatcctcgctgggag

SEQ ID NO: 561340 - DNA, 20 bp, mouse
gactggctggaagtgaaaac

SEQ ID NO: 561341 - DNA, 20 bp, mouse
gaaagctgatctgaaccggc

SEQ ID NO: 561342 - DNA, 20 bp, mouse
ggggagaggtacagattcgt

SEQ ID NO: 561343 - DNA, 20 bp, mouse
gccttcaataaccaattagt

SEQ ID NO: 561344 - DNA, 20 bp, mouse
ggccaacaggggactcgtta

SEQ ID NO: 561345 - DNA, 20 bp, mouse
ggattcgtgggtcagacgga

SEQ ID NO: 561346 - DNA, 20 bp, mouse
gtgcttcagcagaataggta

SEQ ID NO: 561347 - DNA, 20 bp, mouse
gggatgtgcttcagcagaat

SEQ ID NO: 561348 - DNA, 20 bp, mouse
gtgctgaagcacatcctgca

SEQ ID NO: 561349 - DNA, 20 bp, mouse
gaaactccaggtgagcacgt

SEQ ID NO: 561350 - DNA, 20 bp, mouse
gcaggtgtaactccacggag

SEQ ID NO: 561351 - DNA, 20 bp, mouse
ggctaatcctagcaccctgc

SEQ ID NO: 561352 - DNA, 20 bp, mouse
gcgtgggtggagggaagcat

SEQ ID NO: 561353 - DNA, 20 bp, mouse
gtactacgttgccaagggaa

SEQ ID NO: 561354 - DNA, 20 bp, mouse
ggcaggagagatgaacacgg

SEQ ID NO: 561355 - DNA, 20 bp, mouse
ggaagaagggtaagaagagc

SEQ ID NO: 561356 - DNA, 20 bp, mouse
gacagtggcggccatgggac

SEQ ID NO: 561357 - DNA, 20 bp, mouse
gccgcgggaggtccggacag

SEQ ID NO: 561358 - DNA, 20 bp, mouse
gcgggaggtccggacagtgg

SEQ ID NO: 561359 - DNA, 20 bp, mouse
gggagggtaagtacgcgtct

SEQ ID NO: 561360 - DNA, 20 bp, mouse
ggagaccgagaacgttagaa

SEQ ID NO: 561361 - DNA, 20 bp, mouse
gtccgggcctcagatagagt

SEQ ID NO: 561362 - DNA, 20 bp, mouse
gtacttaccctccagtccca

SEQ ID NO: 561363 - DNA, 20 bp, mouse
gtgccacggtcctgtgagaa

SEQ ID NO: 561364 - DNA, 20 bp, mouse
ggaaccagttccaaccctca

SEQ ID NO: 561365 - DNA, 20 bp, mouse
gcttagagggggctcggaca

SEQ ID NO: 561366 - DNA, 20 bp, mouse
gcgtgggctgcaggtagccg

SEQ ID NO: 561367 - DNA, 20 bp, mouse
gccgcctacaagaaagtgag

SEQ ID NO: 561368 - DNA, 20 bp, mouse
gtcgcggggcccaatcttag

SEQ ID NO: 561369 - DNA, 20 bp, mouse
gcgggaggccgggttatagt

SEQ ID NO: 561370 - DNA, 20 bp, mouse
gagtgaggggcgggcaccgt

SEQ ID NO: 561371 - DNA, 20 bp, mouse
ggaggccgggttatagtcgg

SEQ ID NO: 561372 - DNA, 20 bp, mouse
gcctacaagaaagtgagggg

SEQ ID NO: 561373 - DNA, 20 bp, mouse
gcggcctcccgcaatctcca

SEQ ID NO: 561374 - DNA, 20 bp, mouse
gcggagcagcgaagggacgg

SEQ ID NO: 561375 - DNA, 20 bp, mouse
gcaggccgccgactataacc

SEQ ID NO: 561376 - DNA, 20 bp, mouse
gggtgcacgaccgagaagag

SEQ ID NO: 561377 - DNA, 20 bp, mouse
gctgcaccaagctctttagg

SEQ ID NO: 561378 - DNA, 20 bp, mouse
gccggaagcgctcacagcga

SEQ ID NO: 561379 - DNA, 20 bp, mouse
gtaaagagcttggtgcaggt

SEQ ID NO: 561380 - DNA, 20 bp, mouse
gggatgtagaagtagctagg

SEQ ID NO: 561381 - DNA, 20 bp, mouse
gtgcgtgagggccgactcca

SEQ ID NO: 561382 - DNA, 20 bp, mouse
ggctaggcggccgctcttct

SEQ ID NO: 561383 - DNA, 20 bp, mouse
gcccggatgtagaagtagct

SEQ ID NO: 561384 - DNA, 20 bp, mouse
gagcgcttccggctgatcca

SEQ ID NO: 561385 - DNA, 20 bp, mouse
gcgctcacagcgaaggacgc

SEQ ID NO: 561386 - DNA, 20 bp, mouse
ggccagcctgtagcacctga

SEQ ID NO: 561387 - DNA, 20 bp, mouse
gccgcccgccgaagggaagg

SEQ ID NO: 561388 - DNA, 20 bp, mouse
gaccgctgcggtgacttcca

SEQ ID NO: 561389 - DNA, 20 bp, mouse
gttcggcgggcgggagagtt

SEQ ID NO: 561390 - DNA, 20 bp, mouse
gatagacgccggcatctcag

SEQ ID NO: 561391 - DNA, 20 bp, mouse
gggagagttaggtaagccgg

SEQ ID NO: 561392 - DNA, 20 bp, mouse
gaccaccgcctcccaccctc

SEQ ID NO: 561393 - DNA, 20 bp, mouse
gctcccgcccgccgaaggga

SEQ ID NO: 561394 - DNA, 20 bp, mouse
ggtgagaagcaacccgccac

SEQ ID NO: 561395 - DNA, 20 bp, mouse
ggccctggaagtcaccgcag

SEQ ID NO: 561396 - DNA, 20 bp, mouse
gagggagctcttgacagtcc

SEQ ID NO: 561397 - DNA, 20 bp, mouse
gctcttgacagtccgggtgt

SEQ ID NO: 561398 - DNA, 20 bp, mouse
ggtctagcagaggaacgaac

SEQ ID NO: 561399 - DNA, 20 bp, mouse
gacagtccgggtgtgggctc

SEQ ID NO: 561400 - DNA, 20 bp, mouse
gccgaaacttagtgtaacag

SEQ ID NO: 561401 - DNA, 20 bp, mouse
ggccgaccggcccagcggca

SEQ ID NO: 561402 - DNA, 20 bp, mouse
gggtacgaatcactgaacag

SEQ ID NO: 561403 - DNA, 20 bp, mouse
gggggctggcgaggcaggct

SEQ ID NO: 561404 - DNA, 20 bp, mouse
ggtagcgattgaggtgatcg

SEQ ID NO: 561405 - DNA, 20 bp, mouse
gcacaggaagtacgtcagag

SEQ ID NO: 561406 - DNA, 20 bp, mouse
gaggcggccgccgcagatat

SEQ ID NO: 561407 - DNA, 20 bp, mouse
gcaggtgtgtgcggccatgg

SEQ ID NO: 561408 - DNA, 20 bp, mouse
ggcagtacggtgagtagtag

SEQ ID NO: 561409 - DNA, 20 bp, mouse
gagacttcgagcctccgggt

SEQ ID NO: 561410 - DNA, 20 bp, mouse
ggcctccgggtgggctagag

SEQ ID NO: 561411 - DNA, 20 bp, mouse
ggcggcaccgcagggctagg

SEQ ID NO: 561412 - DNA, 20 bp, mouse
ggtagcggcaccgcagggct

SEQ ID NO: 561413 - DNA, 20 bp, mouse
gagagcttctccgatatctg

SEQ ID NO: 561414 - DNA, 20 bp, mouse
ggccgctctagcccacccgg

SEQ ID NO: 561415 - DNA, 20 bp, mouse
ggagtagtagcggcaccgca

SEQ ID NO: 561416 - DNA, 20 bp, mouse
gggtagccacccgcagagtg

SEQ ID NO: 561417 - DNA, 20 bp, mouse
gagagacaagagcgccaagg

SEQ ID NO: 561418 - DNA, 20 bp, mouse
ggagaagccggcaaacatgg

SEQ ID NO: 561419 - DNA, 20 bp, mouse
gcaggacgcacggcccctga

SEQ ID NO: 561420 - DNA, 20 bp, mouse
gcgtgagaagccggcaaaca

SEQ ID NO: 561421 - DNA, 20 bp, mouse
gtgcaggcggctgccctcag

SEQ ID NO: 561422 - DNA, 20 bp, mouse
gcctacctcgatgtgtccag

SEQ ID NO: 561423 - DNA, 20 bp, mouse
gcacgccccgaagagcaaag

SEQ ID NO: 561424 - DNA, 20 bp, mouse
gtcttcggggcgtgagaagc

SEQ ID NO: 561425 - DNA, 20 bp, mouse
gccacaacacagcccgggga

SEQ ID NO: 561426 - DNA, 20 bp, mouse
gtacccggcatggaattggt

SEQ ID NO: 561427 - DNA, 20 bp, mouse
gaggcgcagtgccacttacc

SEQ ID NO: 561428 - DNA, 20 bp, mouse
ggtgccaagcctagcatggt

SEQ ID NO: 561429 - DNA, 20 bp, mouse
gtcctcaggtaggagactgt

SEQ ID NO: 561430 - DNA, 20 bp, mouse
gccggaggaagccccaagtc

SEQ ID NO: 561431 - DNA, 20 bp, mouse
gcgctgagttccaaacccgg

SEQ ID NO: 561432 - DNA, 20 bp, mouse
gatggtgggagcaaagaaca

SEQ ID NO: 561433 - DNA, 20 bp, mouse
ggccgtggctgtcctgactt

SEQ ID NO: 561434 - DNA, 20 bp, mouse
gcaggtaggagactgtagga

SEQ ID NO: 561435 - DNA, 20 bp, mouse
gaggcgtgccaagcctagca

SEQ ID NO: 561436 - DNA, 20 bp, mouse
gagaggcgtcagcccgagga

SEQ ID NO: 561437 - DNA, 20 bp, mouse
ggatgctcccggcggctgag

SEQ ID NO: 561438 - DNA, 20 bp, mouse
gcgaggacggttagcgagag

SEQ ID NO: 561439 - DNA, 20 bp, mouse
ggctgagaggcgtcagcccg

SEQ ID NO: 561440 - DNA, 20 bp, mouse
ggaggccggaagtaccgtgg

SEQ ID NO: 561441 - DNA, 20 bp, mouse
ggccggaagtgatcattcct

SEQ ID NO: 561442 - DNA, 20 bp, mouse
gaaggccacgccgaacaccc

SEQ ID NO: 561443 - DNA, 20 bp, mouse
ggccacgccgaacaccccgg

SEQ ID NO: 561444 - DNA, 20 bp, mouse
gattcctcggttcttcctgt

SEQ ID NO: 561445 - DNA, 20 bp, mouse
ggacgccgcgcgcttcgtca

SEQ ID NO: 561446 - DNA, 20 bp, mouse
gcctggagcagtagaggtgg

SEQ ID NO: 561447 - DNA, 20 bp, mouse
gagaggtggaggtcgctgag

SEQ ID NO: 561448 - DNA, 20 bp, mouse
gttccctggagcagtagagg

SEQ ID NO: 561449 - DNA, 20 bp, mouse
ggcgttccctggagcagtag

SEQ ID NO: 561450 - DNA, 20 bp, mouse
ggtcgctgaggggtacgatt

SEQ ID NO: 561451 - DNA, 20 bp, mouse
gccagggcggtgaaagatgt

SEQ ID NO: 561452 - DNA, 20 bp, mouse
gggcggtgaaagatgtcggg

SEQ ID NO: 561453 - DNA, 20 bp, mouse
gcgggacctcctcagaacga

SEQ ID NO: 561454 - DNA, 20 bp, mouse
ggccgtcgccagatctccag

SEQ ID NO: 561455 - DNA, 20 bp, mouse
ggcagatggctgggaaacta

SEQ ID NO: 561456 - DNA, 20 bp, mouse
gctaggggtgacagtaacag

SEQ ID NO: 561457 - DNA, 20 bp, mouse
ggctgagacacccgtcctag

SEQ ID NO: 561458 - DNA, 20 bp, mouse
ggacagtaacagaggtaaca

SEQ ID NO: 561459 - DNA, 20 bp, mouse
gttactgtcacccctaggac

SEQ ID NO: 561460 - DNA, 20 bp, mouse
gcacttccgggcgcggatcc

SEQ ID NO: 561461 - DNA, 20 bp, mouse
ggggaaccgaggaaacgacg

SEQ ID NO: 561462 - DNA, 20 bp, mouse
gcctctgatactgggcaccc

SEQ ID NO: 561463 - DNA, 20 bp, mouse
ggcccggaagtgcagcggca

SEQ ID NO: 561464 - DNA, 20 bp, mouse
ggagcctggccgcccggaag

SEQ ID NO: 561465 - DNA, 20 bp, mouse
gtatcagagggagcatgtcc

SEQ ID NO: 561466 - DNA, 20 bp, mouse
gcagccttcgtgaggctcag

SEQ ID NO: 561467 - DNA, 20 bp, mouse
gtcggtgctcgcaggactca

SEQ ID NO: 561468 - DNA, 20 bp, mouse
gctgaagggtggggacgggt

SEQ ID NO: 561469 - DNA, 20 bp, mouse
gccctgtcccagccttcgtg

SEQ ID NO: 561470 - DNA, 20 bp, mouse
gcgtgaggctcagaggaaac

SEQ ID NO: 561471 - DNA, 20 bp, mouse
gggacagggcccatcatgag

SEQ ID NO: 561472 - DNA, 20 bp, mouse
gtcgcaggactcaaggtccc

SEQ ID NO: 561473 - DNA, 20 bp, mouse
gcaccgcgaccgcagcgagg

SEQ ID NO: 561474 - DNA, 20 bp, mouse
ggcctcacgaaggctgggac

SEQ ID NO: 561475 - DNA, 20 bp, mouse
gcgcgccactgcagctgagg

SEQ ID NO: 561476 - DNA, 20 bp, mouse
gggcctgggagccgcaagca

SEQ ID NO: 561477 - DNA, 20 bp, mouse
ggccgcggagccggcggaaa

SEQ ID NO: 561478 - DNA, 20 bp, mouse
gcaagcacggtcgtcctccc

SEQ ID NO: 561479 - DNA, 20 bp, mouse
gtggtgctgatgtcccgcgg

SEQ ID NO: 561480 - DNA, 20 bp, mouse
gagcaggcccagacccacaa

SEQ ID NO: 561481 - DNA, 20 bp, mouse
ggacaacgccgcggagccgg

SEQ ID NO: 561482 - DNA, 20 bp, mouse
gcgagcggtagggaaggaac

SEQ ID NO: 561483 - DNA, 20 bp, mouse
gggaagaggaggaaatcccg

SEQ ID NO: 561484 - DNA, 20 bp, mouse
ggcctggaggtcagctgcgt

SEQ ID NO: 561485 - DNA, 20 bp, mouse
gccgtcgcgcgacaacgccg

SEQ ID NO: 561486 - DNA, 20 bp, mouse
ggcttccaggaaggcactac

SEQ ID NO: 561487 - DNA, 20 bp, mouse
gatcccagtggaccaagaaa

SEQ ID NO: 561488 - DNA, 20 bp, mouse
gggtatcagcctcacagaaa

SEQ ID NO: 561489 - DNA, 20 bp, mouse
gtgcaggctgtgcccgaaac

SEQ ID NO: 561490 - DNA, 20 bp, mouse
gcttcctggaagcttctaga

SEQ ID NO: 561491 - DNA, 20 bp, mouse
gagtacagggcatatcccag

SEQ ID NO: 561492 - DNA, 20 bp, mouse
ggtgtgtcacagggagtaca

SEQ ID NO: 561493 - DNA, 20 bp, mouse
gtgcccgaaactggatcacc

SEQ ID NO: 561494 - DNA, 20 bp, mouse
gagtaactgtaggaagataa

SEQ ID NO: 561495 - DNA, 20 bp, mouse
gtagctacttccttctctcc

SEQ ID NO: 561496 - DNA, 20 bp, mouse
gcagccggaagggaccatgg

SEQ ID NO: 561497 - DNA, 20 bp, mouse
ggggcagccggaagggacca

SEQ ID NO: 561498 - DNA, 20 bp, mouse
ggcggccacggacctaggtg

SEQ ID NO: 561499 - DNA, 20 bp, mouse
ggagctgcggccacggacct

SEQ ID NO: 561500 - DNA, 20 bp, mouse
ggcgacctgggcagccggaa

SEQ ID NO: 561501 - DNA, 20 bp, mouse
gcccgccccatcggcgacct

SEQ ID NO: 561502 - DNA, 20 bp, mouse
gtccaccgcacctaggtccg

SEQ ID NO: 561503 - DNA, 20 bp, mouse
gatggcggccgcaggagctg

SEQ ID NO: 561504 - DNA, 20 bp, mouse
ggccacggacctaggtgcgg

SEQ ID NO: 561505 - DNA, 20 bp, mouse
ggactaagacgcgggaacta

SEQ ID NO: 561506 - DNA, 20 bp, mouse
gaccgcaacggcaaaccgag

SEQ ID NO: 561507 - DNA, 20 bp, mouse
ggaagcggccgcaggtatgg

SEQ ID NO: 561508 - DNA, 20 bp, mouse
gacagcaccagtaaccgcaa

SEQ ID NO: 561509 - DNA, 20 bp, mouse
ggcggaagcggccgcaggta

SEQ ID NO: 561510 - DNA, 20 bp, mouse
gcgatgctgggaggcggaag

SEQ ID NO: 561511 - DNA, 20 bp, mouse
gatggcagccgccatacctg

SEQ ID NO: 561512 - DNA, 20 bp, mouse
gaacggcaaaccgagcggca

SEQ ID NO: 561513 - DNA, 20 bp, mouse
gcggatctgcagcgggaagg

SEQ ID NO: 561514 - DNA, 20 bp, mouse
ggggcgcgggcgatgctggg

SEQ ID NO: 561515 - DNA, 20 bp, mouse
gcgcgtgcggaactggaatg

SEQ ID NO: 561516 - DNA, 20 bp, mouse
gccacaagcaccagggccaa

SEQ ID NO: 561517 - DNA, 20 bp, mouse
gggagccgccatgataactg

SEQ ID NO: 561518 - DNA, 20 bp, mouse
ggtggtggccgtgaccgtga

SEQ ID NO: 561519 - DNA, 20 bp, mouse
ggcgcccgcctcagttatca

SEQ ID NO: 561520 - DNA, 20 bp, mouse
gcccgcctcagttatcatgg

SEQ ID NO: 561521 - DNA, 20 bp, mouse
gccacggaggtactacagtg

SEQ ID NO: 561522 - DNA, 20 bp, mouse
gaaggccgccctcacggtca

SEQ ID NO: 561523 - DNA, 20 bp, mouse
ggccgccatgataactgagg

SEQ ID NO: 561524 - DNA, 20 bp, mouse
ggccaaactggagcgaaaca

SEQ ID NO: 561525 - DNA, 20 bp, mouse
gtagggatgggtatccgagg

SEQ ID NO: 561526 - DNA, 20 bp, mouse
gcggggccggaagcagacga

SEQ ID NO: 561527 - DNA, 20 bp, mouse
gtgaagttggagctccgcgg

SEQ ID NO: 561528 - DNA, 20 bp, mouse
gggcacggacgggacccgga

SEQ ID NO: 561529 - DNA, 20 bp, mouse
gacggacgggacccggatgg

SEQ ID NO: 561530 - DNA, 20 bp, mouse
gcgagggccggaggctgcaa

SEQ ID NO: 561531 - DNA, 20 bp, mouse
gcggatggaggcgctgaagt

SEQ ID NO: 561532 - DNA, 20 bp, mouse
gcgcgtccagaccacccccg

SEQ ID NO: 561533 - DNA, 20 bp, mouse
gggaagcagacgagggccgg

SEQ ID NO: 561534 - DNA, 20 bp, mouse
ggccggaagcagacgagggc

SEQ ID NO: 561535 - DNA, 20 bp, mouse
gcgctgaagttggagctccg

SEQ ID NO: 561536 - DNA, 20 bp, mouse
gccccagggcgaggcgggtt

SEQ ID NO: 561537 - DNA, 20 bp, mouse
gggagccggcggcctgggac

SEQ ID NO: 561538 - DNA, 20 bp, mouse
ggccggagaccctcagtcgt

SEQ ID NO: 561539 - DNA, 20 bp, mouse
ggcgggctgttcgcgaggtg

SEQ ID NO: 561540 - DNA, 20 bp, mouse
ggacgcacgtggcccgtccc

SEQ ID NO: 561541 - DNA, 20 bp, mouse
ggcctcgccctggggcggag

SEQ ID NO: 561542 - DNA, 20 bp, mouse
gtctccggcgtggacagaac

SEQ ID NO: 561543 - DNA, 20 bp, mouse
gctcgcgaggcggaagcgga

SEQ ID NO: 561544 - DNA, 20 bp, mouse
ggtgaggtctattgagtccg

SEQ ID NO: 561545 - DNA, 20 bp, mouse
ggagcagcgcaagggctctc

SEQ ID NO: 561546 - DNA, 20 bp, mouse
ggagttgtagggagatccta

SEQ ID NO: 561547 - DNA, 20 bp, mouse
gcgatgacccgaacagaact

SEQ ID NO: 561548 - DNA, 20 bp, mouse
gcggctaacacttccaccct

SEQ ID NO: 561549 - DNA, 20 bp, mouse
gctgttcgggtcatcgggaa

SEQ ID NO: 561550 - DNA, 20 bp, mouse
gccccggccgggatgacgag

SEQ ID NO: 561551 - DNA, 20 bp, mouse
ggtgttagccgagttctgtt

SEQ ID NO: 561552 - DNA, 20 bp, mouse
gggggcgtcgctgaagtccg

SEQ ID NO: 561553 - DNA, 20 bp, mouse
ggaccagccaggctgcccaa

SEQ ID NO: 561554 - DNA, 20 bp, mouse
gggcaagctgcggtcaccga

SEQ ID NO: 561555 - DNA, 20 bp, mouse
gggagcccgacgcccgaaag

SEQ ID NO: 561556 - DNA, 20 bp, mouse
gcgccaggcgccgaagggac

SEQ ID NO: 561557 - DNA, 20 bp, mouse
ggaagggaccggactcctac

SEQ ID NO: 561558 - DNA, 20 bp, mouse
gactcctacaggcctgcaaa

SEQ ID NO: 561559 - DNA, 20 bp, mouse
ggcctgcaaacggtgagttg

SEQ ID NO: 561560 - DNA, 20 bp, mouse
ggagggtctcgaaatacgag

SEQ ID NO: 561561 - DNA, 20 bp, mouse
ggtcaccgccaggcgccgaa

SEQ ID NO: 561562 - DNA, 20 bp, mouse
ggggctgtcccgccttcgtg

SEQ ID NO: 561563 - DNA, 20 bp, mouse
ggacagtcaccgccccacga

SEQ ID NO: 561564 - DNA, 20 bp, mouse
gggtctcgaaatacgagcgg

SEQ ID NO: 561565 - DNA, 20 bp, mouse
ggagccgagcggggcaagac

SEQ ID NO: 561566 - DNA, 20 bp, mouse
gccgcaggcgcagggcgtta

SEQ ID NO: 561567 - DNA, 20 bp, mouse
gcagtcccgcaggagagctg

SEQ ID NO: 561568 - DNA, 20 bp, mouse
gctttcgctccaggcgacca

SEQ ID NO: 561569 - DNA, 20 bp, mouse
gcctgccgcgctggcaaccc

SEQ ID NO: 561570 - DNA, 20 bp, mouse
gcgcagggcgttagggccgc

SEQ ID NO: 561571 - DNA, 20 bp, mouse
gtgcgggacagagggctgca

SEQ ID NO: 561572 - DNA, 20 bp, mouse
gggcaggtgcagcaccgctc

SEQ ID NO: 561573 - DNA, 20 bp, mouse
gtgacccgcaagaatctagg

SEQ ID NO: 561574 - DNA, 20 bp, mouse
gggtgagtcagacccagcct

SEQ ID NO: 561575 - DNA, 20 bp, mouse
gcctctgtcccgcaggcgca

SEQ ID NO: 561576 - DNA, 20 bp, mouse
gccaagcggccgagaggact

SEQ ID NO: 561577 - DNA, 20 bp, mouse
gcacgcatgcgcactggtga

SEQ ID NO: 561578 - DNA, 20 bp, mouse
gacgacgctggagtacggac

SEQ ID NO: 561579 - DNA, 20 bp, mouse
gcgcgccccaagcggccgag

SEQ ID NO: 561580 - DNA, 20 bp, mouse
gggagcccgcgcgccccaag

SEQ ID NO: 561581 - DNA, 20 bp, mouse
ggcttccgagaaggccgcag

SEQ ID NO: 561582 - DNA, 20 bp, mouse
gaacttggaggtccgaaggg

SEQ ID NO: 561583 - DNA, 20 bp, mouse
ggaaggccgcagtggatgac

SEQ ID NO: 561584 - DNA, 20 bp, mouse
gctggtgagggcttgccccg

SEQ ID NO: 561585 - DNA, 20 bp, mouse
gaggaacttggaggtccgaa

SEQ ID NO: 561586 - DNA, 20 bp, mouse
gacacttaatccaaacgtgg

SEQ ID NO: 561587 - DNA, 20 bp, mouse
gaaccggagtcgcagtttgt

SEQ ID NO: 561588 - DNA, 20 bp, mouse
gctctgtgggagtctccggt

SEQ ID NO: 561589 - DNA, 20 bp, mouse
gctgacgggtgcaggaagga

SEQ ID NO: 561590 - DNA, 20 bp, mouse
gggtcgccgtggaagctgac

SEQ ID NO: 561591 - DNA, 20 bp, mouse
ggtaccgggactggttacca

SEQ ID NO: 561592 - DNA, 20 bp, mouse
ggaagctgacgggtgcagga

SEQ ID NO: 561593 - DNA, 20 bp, mouse
gctgcacccgtcagcttcca

SEQ ID NO: 561594 - DNA, 20 bp, mouse
gactgcgactccggttacca

SEQ ID NO: 561595 - DNA, 20 bp, mouse
ggctctcccgagagacaagc

SEQ ID NO: 561596 - DNA, 20 bp, mouse
gcagcactgaccaagcacct

SEQ ID NO: 561597 - DNA, 20 bp, mouse
gagataagagtgtacctcaa

SEQ ID NO: 561598 - DNA, 20 bp, mouse
gcagagcaacgcacagcgag

SEQ ID NO: 561599 - DNA, 20 bp, mouse
ggatagtgcttgaagggacc

SEQ ID NO: 561600 - DNA, 20 bp, mouse
gagactggatagtgcttgaa

SEQ ID NO: 561601 - DNA, 20 bp, mouse
gtcaatcccgaagaagagga

SEQ ID NO: 561602 - DNA, 20 bp, mouse
gtcttcgggattgaggagac

SEQ ID NO: 561603 - DNA, 20 bp, mouse
gcagtttattttcggctcct

SEQ ID NO: 561604 - DNA, 20 bp, mouse
ggcgagtggcagtttatttt

SEQ ID NO: 561605 - DNA, 20 bp, mouse
gagcaagcactctacccttg

SEQ ID NO: 561606 - DNA, 20 bp, mouse
gagagagcctcaaggaccag

SEQ ID NO: 561607 - DNA, 20 bp, mouse
gcggtgcccacagccgcggt

SEQ ID NO: 561608 - DNA, 20 bp, mouse
gtatccggtgcccacagccg

SEQ ID NO: 561609 - DNA, 20 bp, mouse
gccgcggtaggcgacgtcgc

SEQ ID NO: 561610 - DNA, 20 bp, mouse
gctcaggacagtggcgactc

SEQ ID NO: 561611 - DNA, 20 bp, mouse
ggacaggtctcaagactggg

SEQ ID NO: 561612 - DNA, 20 bp, mouse
gaggcgacgtcgctggcgcg

SEQ ID NO: 561613 - DNA, 20 bp, mouse
gcgtcgcctaccgcggctgt

SEQ ID NO: 561614 - DNA, 20 bp, mouse
gatgcgagctgctcccggga

SEQ ID NO: 561615 - DNA, 20 bp, mouse
gggcaccggagcacggtatc

SEQ ID NO: 561616 - DNA, 20 bp, mouse
gcagtcgaagctctcctcag

SEQ ID NO: 561617 - DNA, 20 bp, mouse
gcagccgccgagggactcag

SEQ ID NO: 561618 - DNA, 20 bp, mouse
gacatggctcggaccttgga

SEQ ID NO: 561619 - DNA, 20 bp, mouse
gtcccctctgagtccctcgg

SEQ ID NO: 561620 - DNA, 20 bp, mouse
gagagcttcgactgactccg

SEQ ID NO: 561621 - DNA, 20 bp, mouse
gcgagccttcgcgccctcca

SEQ ID NO: 561622 - DNA, 20 bp, mouse
ggagtgaccaaggggcacgg

SEQ ID NO: 561623 - DNA, 20 bp, mouse
gggaagtgacgtgcagagct

SEQ ID NO: 561624 - DNA, 20 bp, mouse
gggtcccgctccgcacgcac

SEQ ID NO: 561625 - DNA, 20 bp, mouse
ggcgggagaaaaacatggct

SEQ ID NO: 561626 - DNA, 20 bp, mouse
gcccgcagcaggagacacac

SEQ ID NO: 561627 - DNA, 20 bp, mouse
gcacggcgcgcgaggctcac

SEQ ID NO: 561628 - DNA, 20 bp, mouse
gccagcgccggggccaacaa

SEQ ID NO: 561629 - DNA, 20 bp, mouse
gggacagccggcgcactgca

SEQ ID NO: 561630 - DNA, 20 bp, mouse
gagacacacgggcaagcgac

SEQ ID NO: 561631 - DNA, 20 bp, mouse
ggcggggagaagccatctcc

SEQ ID NO: 561632 - DNA, 20 bp, mouse
gccgcggtcctggcaggagc

SEQ ID NO: 561633 - DNA, 20 bp, mouse
gctcgctcggaagatccagg

SEQ ID NO: 561634 - DNA, 20 bp, mouse
gcacgacagtcagggtgtcg

SEQ ID NO: 561635 - DNA, 20 bp, mouse
gcggctcgctcggaagatcc

SEQ ID NO: 561636 - DNA, 20 bp, mouse
gcatcccgtagcagcctggg

SEQ ID NO: 561637 - DNA, 20 bp, mouse
gtggaggctcgttagctatc

SEQ ID NO: 561638 - DNA, 20 bp, mouse
gcccatcgagaattgaaatg

SEQ ID NO: 561639 - DNA, 20 bp, mouse
gagtttagcagctcaaaaca

SEQ ID NO: 561640 - DNA, 20 bp, mouse
gttaaagtaggcttcacctt

SEQ ID NO: 561641 - DNA, 20 bp, mouse
gtagaggaatctctctgtgt

SEQ ID NO: 561642 - DNA, 20 bp, mouse
gggcttctcctgcacagaac

SEQ ID NO: 561643 - DNA, 20 bp, mouse
gcctgcacagaactggagag

SEQ ID NO: 561644 - DNA, 20 bp, mouse
gggctgctacgggatgccca

SEQ ID NO: 561645 - DNA, 20 bp, mouse
ggtgaccctcagagaaaggt

SEQ ID NO: 561646 - DNA, 20 bp, mouse
gacagagacagcccgcgagg

SEQ ID NO: 561647 - DNA, 20 bp, mouse
gcccacggcgaagcccccga

SEQ ID NO: 561648 - DNA, 20 bp, mouse
ggccacagagacagcccgcg

SEQ ID NO: 561649 - DNA, 20 bp, mouse
ggaatcggcagaacaaccca

SEQ ID NO: 561650 - DNA, 20 bp, mouse
gctcggctatggcagatggg

SEQ ID NO: 561651 - DNA, 20 bp, mouse
ggggctccgagctgtcatgg

SEQ ID NO: 561652 - DNA, 20 bp, mouse
gctccgagctgtcatggggg

SEQ ID NO: 561653 - DNA, 20 bp, mouse
gctggagtcttcctcctcgc

SEQ ID NO: 561654 - DNA, 20 bp, mouse
gggctgtctctgtggcgtct

SEQ ID NO: 561655 - DNA, 20 bp, mouse
gagaggggctgctccttgaa

SEQ ID NO: 561656 - DNA, 20 bp, mouse
gggccggcgaggcagcgctc

SEQ ID NO: 561657 - DNA, 20 bp, mouse
ggagagagcgttcgagcgag

SEQ ID NO: 561658 - DNA, 20 bp, mouse
ggaaggcccggcgagagtga

SEQ ID NO: 561659 - DNA, 20 bp, mouse
gggcagttccggtgccgcgg

SEQ ID NO: 561660 - DNA, 20 bp, mouse
gaagccggagcgtgagtaga

SEQ ID NO: 561661 - DNA, 20 bp, mouse
gcgcgcgatggaggaggacc

SEQ ID NO: 561662 - DNA, 20 bp, mouse
gggagcgtgagtagatggca

SEQ ID NO: 561663 - DNA, 20 bp, mouse
gaggccgggtacgaggagag

SEQ ID NO: 561664 - DNA, 20 bp, mouse
ggcgcccgcgagccgacacc

SEQ ID NO: 561665 - DNA, 20 bp, mouse
ggcggggccgggacccgatg

SEQ ID NO: 561666 - DNA, 20 bp, mouse
gcggagccggccatggtcgt

SEQ ID NO: 561667 - DNA, 20 bp, mouse
gcgcccaccgcccacgacca

SEQ ID NO: 561668 - DNA, 20 bp, mouse
ggcgcgcgtgctccgtcggg

SEQ ID NO: 561669 - DNA, 20 bp, mouse
gcagccgctgcaccgcccga

SEQ ID NO: 561670 - DNA, 20 bp, mouse
gcccgaaggcagcaagagac

SEQ ID NO: 561671 - DNA, 20 bp, mouse
gtgtcggagccaggcgggca

SEQ ID NO: 561672 - DNA, 20 bp, mouse
gggcgcgcgcgtgctccgtc

SEQ ID NO: 561673 - DNA, 20 bp, mouse
gcgcgcaggcgcgggcacgg

SEQ ID NO: 561674 - DNA, 20 bp, mouse
gcggagagcccggaatcgtg

SEQ ID NO: 561675 - DNA, 20 bp, mouse
gcgggcgtccgcaccgacac

SEQ ID NO: 561676 - DNA, 20 bp, mouse
gaccggtccagcagctgggt

SEQ ID NO: 561677 - DNA, 20 bp, mouse
gggtccagcagctgggtcgg

SEQ ID NO: 561678 - DNA, 20 bp, mouse
gtcctgtggagagcacttac

SEQ ID NO: 561679 - DNA, 20 bp, mouse
gacttctgcgataaatcctg

SEQ ID NO: 561680 - DNA, 20 bp, mouse
gctaggcgcgagtgagccag

SEQ ID NO: 561681 - DNA, 20 bp, mouse
gggcggagctggcagcccca

SEQ ID NO: 561682 - DNA, 20 bp, mouse
gagctggcagccccaaggct

SEQ ID NO: 561683 - DNA, 20 bp, mouse
ggctccgccgacccagctgc

SEQ ID NO: 561684 - DNA, 20 bp, mouse
gaccggtaagtgctctccac

SEQ ID NO: 561685 - DNA, 20 bp, mouse
gacttaccggtccagcagct

SEQ ID NO: 561686 - DNA, 20 bp, mouse
ggagacgaggtgccccgggt

SEQ ID NO: 561687 - DNA, 20 bp, mouse
gacgaatctagacctacccg

SEQ ID NO: 561688 - DNA, 20 bp, mouse
gggaagagacgaggtgcccc

SEQ ID NO: 561689 - DNA, 20 bp, mouse
gggcagccctggaggtgatg

SEQ ID NO: 561690 - DNA, 20 bp, mouse
gagccctggaggtgatgcgg

SEQ ID NO: 561691 - DNA, 20 bp, mouse
gctcctccgcatcacctcca

SEQ ID NO: 561692 - DNA, 20 bp, mouse
ggtctaagcgcgccgagaca

SEQ ID NO: 561693 - DNA, 20 bp, mouse
ggcggccacagagcccgtga

SEQ ID NO: 561694 - DNA, 20 bp, mouse
gcagaaagcagtcgtacctg

SEQ ID NO: 561695 - DNA, 20 bp, mouse
gaggaaactcagacgctcgg

SEQ ID NO: 561696 - DNA, 20 bp, mouse
gtaccagaagagcataacag

SEQ ID NO: 561697 - DNA, 20 bp, mouse
gcagaagcctatggatctgg

SEQ ID NO: 561698 - DNA, 20 bp, mouse
gcagccagtgtccaaatggg

SEQ ID NO: 561699 - DNA, 20 bp, mouse
gagaagagcataacaggggc

SEQ ID NO: 561700 - DNA, 20 bp, mouse
gatctcacctccagatccat

SEQ ID NO: 561701 - DNA, 20 bp, mouse
gttaagttgctgcagaaagg

SEQ ID NO: 561702 - DNA, 20 bp, mouse
gccactcgtgtgaaaggaaa

SEQ ID NO: 561703 - DNA, 20 bp, mouse
gaaacgtggtcaggccgaca

SEQ ID NO: 561704 - DNA, 20 bp, mouse
gcggctgcagcaagctagct

SEQ ID NO: 561705 - DNA, 20 bp, mouse
ggagctgcaagcctctggca

SEQ ID NO: 561706 - DNA, 20 bp, mouse
gctagcagctggagccgagt

SEQ ID NO: 561707 - DNA, 20 bp, mouse
ggcagcggtagcggtgagga

SEQ ID NO: 561708 - DNA, 20 bp, mouse
ggccgctgcttcctccaact

SEQ ID NO: 561709 - DNA, 20 bp, mouse
ggcagctggagccgagttgg

SEQ ID NO: 561710 - DNA, 20 bp, mouse
ggagaggagtagctagcagc

SEQ ID NO: 561711 - DNA, 20 bp, mouse
ggagccgacccggaggtagg

SEQ ID NO: 561712 - DNA, 20 bp, mouse
gaaccgggacagcgaagcga

SEQ ID NO: 561713 - DNA, 20 bp, mouse
ggctgtgcagccaaggaacc

SEQ ID NO: 561714 - DNA, 20 bp, mouse
gagcgagccgacccggaggt

SEQ ID NO: 561715 - DNA, 20 bp, mouse
ggctggagctgcgccgctca

SEQ ID NO: 561716 - DNA, 20 bp, mouse
gggctgacgcagggatcccg

SEQ ID NO: 561717 - DNA, 20 bp, mouse
ggcccgaaggcttggaaccg

SEQ ID NO: 561718 - DNA, 20 bp, mouse
ggccggagtgggtgagtcga

SEQ ID NO: 561719 - DNA, 20 bp, mouse
gcttggaaccgcggcgacgg

SEQ ID NO: 561720 - DNA, 20 bp, mouse
ggatcccgcggctgcggcga

SEQ ID NO: 561721 - DNA, 20 bp, mouse
ggtcgtggtggtggcgacgg

SEQ ID NO: 561722 - DNA, 20 bp, mouse
gcgcagggatcccgcggctg

SEQ ID NO: 561723 - DNA, 20 bp, mouse
gggagtgggtgagtcgatgg

SEQ ID NO: 561724 - DNA, 20 bp, mouse
gggcgacggtggctgacgca

SEQ ID NO: 561725 - DNA, 20 bp, mouse
ggggaggacccgaggagaga

SEQ ID NO: 561726 - DNA, 20 bp, mouse
ggactgtgcccgagtagtaa

SEQ ID NO: 561727 - DNA, 20 bp, mouse
gagccagggcagagcgtgag

SEQ ID NO: 561728 - DNA, 20 bp, mouse
gactctagtggttggagcca

SEQ ID NO: 561729 - DNA, 20 bp, mouse
gagctgactggactctccaa

SEQ ID NO: 561730 - DNA, 20 bp, mouse
gcgggcacagtcgagctgac

SEQ ID NO: 561731 - DNA, 20 bp, mouse
gagcttccgcagcttcggga

SEQ ID NO: 561732 - DNA, 20 bp, mouse
gacgcgttgggagaaagctg

SEQ ID NO: 561733 - DNA, 20 bp, mouse
gaaagctggggaagtgacaa

SEQ ID NO: 561734 - DNA, 20 bp, mouse
gctcccctcacgctctgccc

SEQ ID NO: 561735 - DNA, 20 bp, mouse
gtccttcggagaagagagaa

SEQ ID NO: 561736 - DNA, 20 bp, mouse
ggcagccctggacagggaca

SEQ ID NO: 561737 - DNA, 20 bp, mouse
gacagggacagtgcccgtcc

SEQ ID NO: 561738 - DNA, 20 bp, mouse
gaggaagacgacttcacctg

SEQ ID NO: 561739 - DNA, 20 bp, mouse
gcggcaaacgctgaactccc

SEQ ID NO: 561740 - DNA, 20 bp, mouse
ggtccgagatctagagctgg

SEQ ID NO: 561741 - DNA, 20 bp, mouse
gtgaagtcgtcttcctggac

SEQ ID NO: 561742 - DNA, 20 bp, mouse
ggagctgggggtgaacaact

SEQ ID NO: 561743 - DNA, 20 bp, mouse
gtcaacccggaggctttccc

SEQ ID NO: 561744 - DNA, 20 bp, mouse
gacaggaagtgaggtcaacc

SEQ ID NO: 561745 - DNA, 20 bp, mouse
ggtcttggcagagctccgag

SEQ ID NO: 561746 - DNA, 20 bp, mouse
ggcccccgaccaccgctcag

SEQ ID NO: 561747 - DNA, 20 bp, mouse
gcggcgactctcagcagttg

SEQ ID NO: 561748 - DNA, 20 bp, mouse
gaaaggccccgcctccccta

SEQ ID NO: 561749 - DNA, 20 bp, mouse
ggtctctacaaccctagggg

SEQ ID NO: 561750 - DNA, 20 bp, mouse
gcccggttccagccgctgag

SEQ ID NO: 561751 - DNA, 20 bp, mouse
gacccatgggacaaacccag

SEQ ID NO: 561752 - DNA, 20 bp, mouse
gcgggtctctacaaccctag

SEQ ID NO: 561753 - DNA, 20 bp, mouse
ggtagagacccggcagatgc

SEQ ID NO: 561754 - DNA, 20 bp, mouse
gttcactccagagcacacgg

SEQ ID NO: 561755 - DNA, 20 bp, mouse
gtgctccaactgcagccggt

SEQ ID NO: 561756 - DNA, 20 bp, mouse
gcaaggaccagatgtcccaa

SEQ ID NO: 561757 - DNA, 20 bp, mouse
gcaggacgacaagctctctt

SEQ ID NO: 561758 - DNA, 20 bp, mouse
gacagggctggacccagatg

SEQ ID NO: 561759 - DNA, 20 bp, mouse
gctgagacgtgggctcctta

SEQ ID NO: 561760 - DNA, 20 bp, mouse
gacccagatgaggttcaaca

SEQ ID NO: 561761 - DNA, 20 bp, mouse
gagctcctgaggtcctgttc

SEQ ID NO: 561762 - DNA, 20 bp, mouse
ggaccagccttctgagacgt

SEQ ID NO: 561763 - DNA, 20 bp, mouse
gtccatgttgaacctcatct

SEQ ID NO: 561764 - DNA, 20 bp, mouse
ggagttgggagagacagggc

SEQ ID NO: 561765 - DNA, 20 bp, mouse
ggaggacccaagatcttgtg

SEQ ID NO: 561766 - DNA, 20 bp, mouse
ggtcgcgccgagaagcccag

SEQ ID NO: 561767 - DNA, 20 bp, mouse
ggcacagcgccggctttctc

SEQ ID NO: 561768 - DNA, 20 bp, mouse
gggctttctcaggcagccgg

SEQ ID NO: 561769 - DNA, 20 bp, mouse
gttcccggccgagagtggtg

SEQ ID NO: 561770 - DNA, 20 bp, mouse
ggcctccgcctcaccactct

SEQ ID NO: 561771 - DNA, 20 bp, mouse
gagaagcccagaggcttacg

SEQ ID NO: 561772 - DNA, 20 bp, mouse
ggaggcttacgcggtaactg

SEQ ID NO: 561773 - DNA, 20 bp, mouse
gcggagcaccgccggaggga

SEQ ID NO: 561774 - DNA, 20 bp, mouse
gggcttctcggcgcgaccgc

SEQ ID NO: 561775 - DNA, 20 bp, mouse
ggccctcgccatccctccgg

SEQ ID NO: 561776 - DNA, 20 bp, mouse
gggactgtccctaacgctag

SEQ ID NO: 561777 - DNA, 20 bp, mouse
gagaagggagtcatgtgtac

SEQ ID NO: 561778 - DNA, 20 bp, mouse
gcactcaccagcatgcagac

SEQ ID NO: 561779 - DNA, 20 bp, mouse
gtgctgatctcgcttcctgg

SEQ ID NO: 561780 - DNA, 20 bp, mouse
gtcctgtcccactagcgtta

SEQ ID NO: 561781 - DNA, 20 bp, mouse
ggcaatgttaacagactctt

SEQ ID NO: 561782 - DNA, 20 bp, mouse
gtaacagactcttggggcag

SEQ ID NO: 561783 - DNA, 20 bp, mouse
gtagggacactggagtgctc

SEQ ID NO: 561784 - DNA, 20 bp, mouse
gcaggagtccagagagaacc

SEQ ID NO: 561785 - DNA, 20 bp, mouse
gcatgtggaggactgagttg

SEQ ID NO: 561786 - DNA, 20 bp, mouse
ggggactccagccatggctc

SEQ ID NO: 561787 - DNA, 20 bp, mouse
gtcctgcttctgctctcatc

SEQ ID NO: 561788 - DNA, 20 bp, mouse
gcctccacatgtgaatgcct

SEQ ID NO: 561789 - DNA, 20 bp, mouse
ggatctgtttcactttaccc

SEQ ID NO: 561790 - DNA, 20 bp, mouse
gtgctctgtctagggacact

SEQ ID NO: 561791 - DNA, 20 bp, mouse
gatccccaggcattcacatg

SEQ ID NO: 561792 - DNA, 20 bp, mouse
gggactgtccctaacgctag

SEQ ID NO: 561793 - DNA, 20 bp, mouse
gtgctgatctcgcttcctgg

SEQ ID NO: 561794 - DNA, 20 bp, mouse
ggcaatgttaacagactctt

SEQ ID NO: 561795 - DNA, 20 bp, mouse
gtcctgtcccactagcgtta

SEQ ID NO: 561796 - DNA, 20 bp, mouse
gagacttcttgcacaggcag

SEQ ID NO: 561797 - DNA, 20 bp, mouse
ggactgtccccaaagctagt

SEQ ID NO: 561798 - DNA, 20 bp, mouse
gggaagagtagggagtcatg

SEQ ID NO: 561799 - DNA, 20 bp, mouse
ggcaatgtcaactgactctt

SEQ ID NO: 561800 - DNA, 20 bp, mouse
gtttcctgtcccactagctt

SEQ ID NO: 561801 - DNA, 20 bp, mouse
gctgaatttcctgggaagga

SEQ ID NO: 561802 - DNA, 20 bp, mouse
gctcagtcctccacatgaga

SEQ ID NO: 561803 - DNA, 20 bp, mouse
gcaaggaggtggagatggaa

SEQ ID NO: 561804 - DNA, 20 bp, mouse
gtaacctcaggaggggacaa

SEQ ID NO: 561805 - DNA, 20 bp, mouse
gctcttggggcagagagtcc

SEQ ID NO: 561806 - DNA, 20 bp, mouse
gcgcaaggccgagggcgagt

SEQ ID NO: 561807 - DNA, 20 bp, mouse
gctactgccgatcccgccgc

SEQ ID NO: 561808 - DNA, 20 bp, mouse
gaaggccgagggcgagtcgg

SEQ ID NO: 561809 - DNA, 20 bp, mouse
gcccgccgccaggagtaaag

SEQ ID NO: 561810 - DNA, 20 bp, mouse
gggaggggagtcggcagtgc

SEQ ID NO: 561811 - DNA, 20 bp, mouse
ggcgagtcggaggacgactg

SEQ ID NO: 561812 - DNA, 20 bp, mouse
gggggagtcggcagtgccgg

SEQ ID NO: 561813 - DNA, 20 bp, mouse
gggtcaggcagtgcgggagg

SEQ ID NO: 561814 - DNA, 20 bp, mouse
gggcagtgcgggaggcggca

SEQ ID NO: 561815 - DNA, 20 bp, mouse
gggctggcgcgcaaggccga

SEQ ID NO: 561816 - DNA, 20 bp, mouse
ggcccggaagcgcctgcaga

SEQ ID NO: 561817 - DNA, 20 bp, mouse
gcagagcggccggagagcca

SEQ ID NO: 561818 - DNA, 20 bp, mouse
gggctgcgtgggggtcacag

SEQ ID NO: 561819 - DNA, 20 bp, mouse
ggttgaccaagcctctgcag

SEQ ID NO: 561820 - DNA, 20 bp, mouse
gagcggaggcgaggaagtca

SEQ ID NO: 561821 - DNA, 20 bp, mouse
gccagggctggggggcgcca

SEQ ID NO: 561822 - DNA, 20 bp, mouse
gccccaacgctactgagccg

SEQ ID NO: 561823 - DNA, 20 bp, mouse
gggcagggaatctggcggcc

SEQ ID NO: 561824 - DNA, 20 bp, mouse
gtcacctggaggctgcgtgg

SEQ ID NO: 561825 - DNA, 20 bp, mouse
gaacctgcttgtgacagagg

SEQ ID NO: 561826 - DNA, 20 bp, mouse
ggcgcggcgcagttgcccgg

SEQ ID NO: 561827 - DNA, 20 bp, mouse
gcacctccgcgactctacta

SEQ ID NO: 561828 - DNA, 20 bp, mouse
ggacagcgcggcggatccca

SEQ ID NO: 561829 - DNA, 20 bp, mouse
gcacgccgccaggcccgcag

SEQ ID NO: 561830 - DNA, 20 bp, mouse
gggcccgcagaggtgcgcca

SEQ ID NO: 561831 - DNA, 20 bp, mouse
gccgcgcgaaagcgcgtaga

SEQ ID NO: 561832 - DNA, 20 bp, mouse
gtcgagaaggtgtaccaggt

SEQ ID NO: 561833 - DNA, 20 bp, mouse
gtccgtggtccaaaaccccg

SEQ ID NO: 561834 - DNA, 20 bp, mouse
gccaaaaccccggggcgagg

SEQ ID NO: 561835 - DNA, 20 bp, mouse
gtccttgccggacgggtcag

SEQ ID NO: 561836 - DNA, 20 bp, mouse
gtacgcttctcccagcctgg

SEQ ID NO: 561837 - DNA, 20 bp, mouse
gagcaggcgctgcggcagga

SEQ ID NO: 561838 - DNA, 20 bp, mouse
ggccccgggcgacccccaag

SEQ ID NO: 561839 - DNA, 20 bp, mouse
gggagaagctgccaccaggc

SEQ ID NO: 561840 - DNA, 20 bp, mouse
gagcaccggagcccagcggt

SEQ ID NO: 561841 - DNA, 20 bp, mouse
gcagctcaggtacctcttgg

SEQ ID NO: 561842 - DNA, 20 bp, mouse
gtgcgggagaactcagatca

SEQ ID NO: 561843 - DNA, 20 bp, mouse
ggacaggcgagtctcatcac

SEQ ID NO: 561844 - DNA, 20 bp, mouse
gcgcggggtcagagccgcgg

SEQ ID NO: 561845 - DNA, 20 bp, mouse
gtctgagcaccggagcccag

SEQ ID NO: 561846 - DNA, 20 bp, mouse
gacggtaacagctgtcccgg

SEQ ID NO: 561847 - DNA, 20 bp, mouse
ggatcctgtgtgtcccaagg

SEQ ID NO: 561848 - DNA, 20 bp, mouse
ggtaagggaattcgttataa

SEQ ID NO: 561849 - DNA, 20 bp, mouse
gtcagcgccagactgcagtg

SEQ ID NO: 561850 - DNA, 20 bp, mouse
ggtgacaacagtctacctcc

SEQ ID NO: 561851 - DNA, 20 bp, mouse
gtcacccccttgggacacac

SEQ ID NO: 561852 - DNA, 20 bp, mouse
ggactagatctaaaacacaa

SEQ ID NO: 561853 - DNA, 20 bp, mouse
gagactgttgtcaccccctt

SEQ ID NO: 561854 - DNA, 20 bp, mouse
gagaaacaaggaacagttag

SEQ ID NO: 561855 - DNA, 20 bp, mouse
ggatctttgactgtaaggac

SEQ ID NO: 561856 - DNA, 20 bp, mouse
ggcccaaacataaaccacag

SEQ ID NO: 561857 - DNA, 20 bp, mouse
gtgcggaggacatacctgtg

SEQ ID NO: 561858 - DNA, 20 bp, mouse
gaggacccctcaggccccac

SEQ ID NO: 561859 - DNA, 20 bp, mouse
gggagcaccctgagccgctg

SEQ ID NO: 561860 - DNA, 20 bp, mouse
gacatacctgtggggcctga

SEQ ID NO: 561861 - DNA, 20 bp, mouse
gagacctgccgagacagtca

SEQ ID NO: 561862 - DNA, 20 bp, mouse
gagccggacagcagggccac

SEQ ID NO: 561863 - DNA, 20 bp, mouse
gtcccggtggccctgctgtc

SEQ ID NO: 561864 - DNA, 20 bp, mouse
gagtgcagggaccctcgtgg

SEQ ID NO: 561865 - DNA, 20 bp, mouse
gcatggagcgagcgtagggg

SEQ ID NO: 561866 - DNA, 20 bp, mouse
gggtcaccgcgccaccatgg

SEQ ID NO: 561867 - DNA, 20 bp, mouse
gtccggtcaccgcgccacca

SEQ ID NO: 561868 - DNA, 20 bp, mouse
ggcctgtcgcaccgccatgg

SEQ ID NO: 561869 - DNA, 20 bp, mouse
ggccaccgccacaaacgtct

SEQ ID NO: 561870 - DNA, 20 bp, mouse
gttgtcccagacgtttgtgg

SEQ ID NO: 561871 - DNA, 20 bp, mouse
gtcccagacgtttgtggcgg

SEQ ID NO: 561872 - DNA, 20 bp, mouse
gagtgcctgtcgcaccgcca

SEQ ID NO: 561873 - DNA, 20 bp, mouse
gtaccgactggcggaagaag

SEQ ID NO: 561874 - DNA, 20 bp, mouse
gtcgcaccgccatggtggcg

SEQ ID NO: 561875 - DNA, 20 bp, mouse
gtggcggtggcagctggctc

SEQ ID NO: 561876 - DNA, 20 bp, mouse
gcacttaccgagacccagga

SEQ ID NO: 561877 - DNA, 20 bp, mouse
gcactgctctgtaccctcct

SEQ ID NO: 561878 - DNA, 20 bp, mouse
ggttctgaggcccttcctag

SEQ ID NO: 561879 - DNA, 20 bp, mouse
gagacacaggaccttcctgc

SEQ ID NO: 561880 - DNA, 20 bp, mouse
gtgtcttctaaacagaatca

SEQ ID NO: 561881 - DNA, 20 bp, mouse
gatggtctgtcctctaggaa

SEQ ID NO: 561882 - DNA, 20 bp, mouse
gtctgtaccctcctgggtct

SEQ ID NO: 561883 - DNA, 20 bp, mouse
ggagagagcttggccatcaa

SEQ ID NO: 561884 - DNA, 20 bp, mouse
gaatgccctctgaggtactg

SEQ ID NO: 561885 - DNA, 20 bp, mouse
ggggtctcggtaagtgacaa

SEQ ID NO: 561886 - DNA, 20 bp, mouse
gctgacgcccagcggttatg

SEQ ID NO: 561887 - DNA, 20 bp, mouse
ggcgcggttaaggaagaagc

SEQ ID NO: 561888 - DNA, 20 bp, mouse
gcctctggcctgacgcccag

SEQ ID NO: 561889 - DNA, 20 bp, mouse
gggaacctgaagcgcggtta

SEQ ID NO: 561890 - DNA, 20 bp, mouse
gttatgaggaacctgaagcg

SEQ ID NO: 561891 - DNA, 20 bp, mouse
ggttaaggaagaagccggct

SEQ ID NO: 561892 - DNA, 20 bp, mouse
ggtgactgccgggcccgcga

SEQ ID NO: 561893 - DNA, 20 bp, mouse
gcccggcgtgctttccgagc

SEQ ID NO: 561894 - DNA, 20 bp, mouse
gccgggtgatgggatgacgg

SEQ ID NO: 561895 - DNA, 20 bp, mouse
ggccggctcggaaagcacgc

SEQ ID NO: 561896 - DNA, 20 bp, mouse
ggatccccagctgcagacat

SEQ ID NO: 561897 - DNA, 20 bp, mouse
gctgacttctccactatgca

SEQ ID NO: 561898 - DNA, 20 bp, mouse
gcacccagtggaaacatgag

SEQ ID NO: 561899 - DNA, 20 bp, mouse
ggaaacatgaggggaatcta

SEQ ID NO: 561900 - DNA, 20 bp, mouse
gaccagaccagtactgtcct

SEQ ID NO: 561901 - DNA, 20 bp, mouse
gtgcaagcctatacacccag

SEQ ID NO: 561902 - DNA, 20 bp, mouse
gggtcctatgtctgcagctg

SEQ ID NO: 561903 - DNA, 20 bp, mouse
gatgtttccactgggtgtat

SEQ ID NO: 561904 - DNA, 20 bp, mouse
gggggaatctatggaggcta

SEQ ID NO: 561905 - DNA, 20 bp, mouse
ggtttacttactcatcatcc

SEQ ID NO: 561906 - DNA, 20 bp, mouse
gcctacacgccagcccgggg

SEQ ID NO: 561907 - DNA, 20 bp, mouse
gagcgcagctgcagcctaag

SEQ ID NO: 561908 - DNA, 20 bp, mouse
gctgtgcgccgagccgcgac

SEQ ID NO: 561909 - DNA, 20 bp, mouse
ggaggcagctgcatcccccg

SEQ ID NO: 561910 - DNA, 20 bp, mouse
gcgccggctcccgcccgtcg

SEQ ID NO: 561911 - DNA, 20 bp, mouse
gccgggctggcgtgtaggga

SEQ ID NO: 561912 - DNA, 20 bp, mouse
gtgcgccgagccgcgacggg

SEQ ID NO: 561913 - DNA, 20 bp, mouse
gtccgcgcgctcggccgctt

SEQ ID NO: 561914 - DNA, 20 bp, mouse
ggaggaccccaggttgccag

SEQ ID NO: 561915 - DNA, 20 bp, mouse
ggcagctgcatcccccgggg

SEQ ID NO: 561916 - DNA, 20 bp, mouse
ggcgcgaccatggctcggtg

SEQ ID NO: 561917 - DNA, 20 bp, mouse
gtggctcggtgaggcagcgg

SEQ ID NO: 561918 - DNA, 20 bp, mouse
ggagacagcgcaccagcgag

SEQ ID NO: 561919 - DNA, 20 bp, mouse
ggacgggcgcgaccatggct

SEQ ID NO: 561920 - DNA, 20 bp, mouse
gaacgggacgggcgcgacca

SEQ ID NO: 561921 - DNA, 20 bp, mouse
gcagttggacgacatgcccg

SEQ ID NO: 561922 - DNA, 20 bp, mouse
gttggacgacatgcccgggg

SEQ ID NO: 561923 - DNA, 20 bp, mouse
gggtggggaggtaacgggac

SEQ ID NO: 561924 - DNA, 20 bp, mouse
gggcggcggcggcgaaaggg

SEQ ID NO: 561925 - DNA, 20 bp, mouse
gagcgaaggggaaacgacga

SEQ ID NO: 561926 - DNA, 20 bp, mouse
gccgaagcccgacccggaag

SEQ ID NO: 561927 - DNA, 20 bp, mouse
ggcgactccgaagcccgacc

SEQ ID NO: 561928 - DNA, 20 bp, mouse
gtcccgcgcacccgagcgag

SEQ ID NO: 561929 - DNA, 20 bp, mouse
ggcggtggcgggagggacgg

SEQ ID NO: 561930 - DNA, 20 bp, mouse
gcgggcctccggtcacatga

SEQ ID NO: 561931 - DNA, 20 bp, mouse
ggcacccgagcgagtggaag

SEQ ID NO: 561932 - DNA, 20 bp, mouse
gctcccgcttccactcgctc

SEQ ID NO: 561933 - DNA, 20 bp, mouse
ggtgagcaccgcttccgggt

SEQ ID NO: 561934 - DNA, 20 bp, mouse
gggtccagccccaggctaca

SEQ ID NO: 561935 - DNA, 20 bp, mouse
gggtgaagatggaactctag

SEQ ID NO: 561936 - DNA, 20 bp, mouse
gccgcccaccctgagccgag

SEQ ID NO: 561937 - DNA, 20 bp, mouse
gggtggagttggggataaac

SEQ ID NO: 561938 - DNA, 20 bp, mouse
gtccaccgctcggctcaggg

SEQ ID NO: 561939 - DNA, 20 bp, mouse
gtgggcggccaaggaaaccc

SEQ ID NO: 561940 - DNA, 20 bp, mouse
gtgagccgagcggtggagtt

SEQ ID NO: 561941 - DNA, 20 bp, mouse
ggttggggataaacaggcag

SEQ ID NO: 561942 - DNA, 20 bp, mouse
gtatccccaactccaccgct

SEQ ID NO: 561943 - DNA, 20 bp, mouse
gcgttcggcgggcttctcac

SEQ ID NO: 561944 - DNA, 20 bp, mouse
gtggcgcatgcgcaataccg

SEQ ID NO: 561945 - DNA, 20 bp, mouse
gaggaaaacctaggcacctg

SEQ ID NO: 561946 - DNA, 20 bp, mouse
ggttctgccgaccagaggag

SEQ ID NO: 561947 - DNA, 20 bp, mouse
gcagcgagcaggctgcacgg

SEQ ID NO: 561948 - DNA, 20 bp, mouse
gcggcgcgccggagtccgag

SEQ ID NO: 561949 - DNA, 20 bp, mouse
ggcagccacgggcccccgca

SEQ ID NO: 561950 - DNA, 20 bp, mouse
gcgcggcgaggcgagatcgg

SEQ ID NO: 561951 - DNA, 20 bp, mouse
gcaggcgcggcggcaaggga

SEQ ID NO: 561952 - DNA, 20 bp, mouse
gactccggcgcgccgtgcgg

SEQ ID NO: 561953 - DNA, 20 bp, mouse
gctgcagcctcccggagtcg

SEQ ID NO: 561954 - DNA, 20 bp, mouse
gcggcggcaagggagggtgt

SEQ ID NO: 561955 - DNA, 20 bp, mouse
ggaggagcggcgggaaggaa

SEQ ID NO: 561956 - DNA, 20 bp, mouse
gcgagctcgggtgcatcctc

SEQ ID NO: 561957 - DNA, 20 bp, mouse
gccatggccgaacgctccgg

SEQ ID NO: 561958 - DNA, 20 bp, mouse
ggctccatggccgaacgctc

SEQ ID NO: 561959 - DNA, 20 bp, mouse
gaagcgccgcctgcactaca

SEQ ID NO: 561960 - DNA, 20 bp, mouse
gggcggcgcttgttgttcag

SEQ ID NO: 561961 - DNA, 20 bp, mouse
gtccggcacctctagctcca

SEQ ID NO: 561962 - DNA, 20 bp, mouse
gcggtcgagaccacgcgcca

SEQ ID NO: 561963 - DNA, 20 bp, mouse
ggagctagaggtgccggacg

SEQ ID NO: 561964 - DNA, 20 bp, mouse
gcaccgcagcgcgaagcagg

SEQ ID NO: 561965 - DNA, 20 bp, mouse
gtggccgaacgctccggcgg

SEQ ID NO: 561966 - DNA, 20 bp, mouse
gccagagaagcggcacctgg

SEQ ID NO: 561967 - DNA, 20 bp, mouse
gacctacctcgtgggaccta

SEQ ID NO: 561968 - DNA, 20 bp, mouse
ggtaggtgcggaccagagag

SEQ ID NO: 561969 - DNA, 20 bp, mouse
gtggtccgcacctacctcgt

SEQ ID NO: 561970 - DNA, 20 bp, mouse
ggccttaggtcccacgaggt

SEQ ID NO: 561971 - DNA, 20 bp, mouse
ggccccacggaggtatgaaa

SEQ ID NO: 561972 - DNA, 20 bp, mouse
gtggtgtggccatcgccccc

SEQ ID NO: 561973 - DNA, 20 bp, mouse
gccaagccttaggtcccacg

SEQ ID NO: 561974 - DNA, 20 bp, mouse
gatcaagacacgccccacgg

SEQ ID NO: 561975 - DNA, 20 bp, mouse
gaaactgaggaagacctccg

SEQ ID NO: 561976 - DNA, 20 bp, mouse
gtgattggagcaggcatcca

SEQ ID NO: 561977 - DNA, 20 bp, mouse
gggcacctccaggctacagg

SEQ ID NO: 561978 - DNA, 20 bp, mouse
ggctgctcagacagatttct

SEQ ID NO: 561979 - DNA, 20 bp, mouse
gagtgggctttgtggcatca

SEQ ID NO: 561980 - DNA, 20 bp, mouse
gggaaagccctccctaggag

SEQ ID NO: 561981 - DNA, 20 bp, mouse
gggcaaacaaaggcacctcc

SEQ ID NO: 561982 - DNA, 20 bp, mouse
gctcacgtggacttaagggt

SEQ ID NO: 561983 - DNA, 20 bp, mouse
gtctgggatgctattgtgat

SEQ ID NO: 561984 - DNA, 20 bp, mouse
gacagtcttatatagcagaa

SEQ ID NO: 561985 - DNA, 20 bp, mouse
gtccaggctacagggggagg

SEQ ID NO: 561986 - DNA, 20 bp, mouse
gaggtgcctagactccacag

SEQ ID NO: 561987 - DNA, 20 bp, mouse
ggacacagcaaagggaggac

SEQ ID NO: 561988 - DNA, 20 bp, mouse
ggctgagtcacgctgactga

SEQ ID NO: 561989 - DNA, 20 bp, mouse
gccctgccgctgtggagtct

SEQ ID NO: 561990 - DNA, 20 bp, mouse
gagtcacgctgactgacggc

SEQ ID NO: 561991 - DNA, 20 bp, mouse
gtcactactggggctcggag

SEQ ID NO: 561992 - DNA, 20 bp, mouse
ggcagtagcgcaggcccagg

SEQ ID NO: 561993 - DNA, 20 bp, mouse
ggtctaggcacctccgactg

SEQ ID NO: 561994 - DNA, 20 bp, mouse
ggtgtatagggcctaaatgt

SEQ ID NO: 561995 - DNA, 20 bp, mouse
gggaagaagccagaaaaatt

SEQ ID NO: 561996 - DNA, 20 bp, mouse
gctcagtcggctctcgcgta

SEQ ID NO: 561997 - DNA, 20 bp, mouse
gtctcgcgtagggaggaagc

SEQ ID NO: 561998 - DNA, 20 bp, mouse
gacgtcccgggggaagactg

SEQ ID NO: 561999 - DNA, 20 bp, mouse
gtccagggagacatagcaaa

SEQ ID NO: 562000 - DNA, 20 bp, mouse
gagggtgcctttctccagct

SEQ ID NO: 562001 - DNA, 20 bp, mouse
ggctcagagctccacaggca

SEQ ID NO: 562002 - DNA, 20 bp, mouse
ggcagcacactgatgtggcc

SEQ ID NO: 562003 - DNA, 20 bp, mouse
gaccgtgcacaacgtcccgg

SEQ ID NO: 562004 - DNA, 20 bp, mouse
gtctctgaagtagagttgga

SEQ ID NO: 562005 - DNA, 20 bp, mouse
gcactgagcaggctccggct

SEQ ID NO: 562006 - DNA, 20 bp, mouse
ggaagcgttagcctcagagc

SEQ ID NO: 562007 - DNA, 20 bp, mouse
ggttagcctcagagcaggca

SEQ ID NO: 562008 - DNA, 20 bp, mouse
gtcctgaggctgggaggtct

SEQ ID NO: 562009 - DNA, 20 bp, mouse
gtcagagcaggcaggggctc

SEQ ID NO: 562010 - DNA, 20 bp, mouse
ggggctctggttcaagctga

SEQ ID NO: 562011 - DNA, 20 bp, mouse
gtccctgtcctgaggctggg

SEQ ID NO: 562012 - DNA, 20 bp, mouse
gtcagggagaccaagtgcgg

SEQ ID NO: 562013 - DNA, 20 bp, mouse
gctggagtgaggctggtctc

SEQ ID NO: 562014 - DNA, 20 bp, mouse
gctctcctgcgcccccccca

SEQ ID NO: 562015 - DNA, 20 bp, mouse
gtggggactagagaagctat

SEQ ID NO: 562016 - DNA, 20 bp, mouse
ggcggtgccgagggagtcac

SEQ ID NO: 562017 - DNA, 20 bp, mouse
gcgagtgagctccgggtgag

SEQ ID NO: 562018 - DNA, 20 bp, mouse
gcgcggagccgagtgagctc

SEQ ID NO: 562019 - DNA, 20 bp, mouse
ggcctcaacgagagccgcga

SEQ ID NO: 562020 - DNA, 20 bp, mouse
gaggcggcgagggcatgtga

SEQ ID NO: 562021 - DNA, 20 bp, mouse
gtggctgtggccgtgcgaca

SEQ ID NO: 562022 - DNA, 20 bp, mouse
gcggcgcttggcggtcgtcg

SEQ ID NO: 562023 - DNA, 20 bp, mouse
ggccctcgcggctctcgttg

SEQ ID NO: 562024 - DNA, 20 bp, mouse
gcgggccgcccaccttggag

SEQ ID NO: 562025 - DNA, 20 bp, mouse
ggagggagtcacaggcgagc

SEQ ID NO: 562026 - DNA, 20 bp, mouse
ggcgggaggtggtgaggcca

SEQ ID NO: 562027 - DNA, 20 bp, mouse
gctccgggcggcgtcggcag

SEQ ID NO: 562028 - DNA, 20 bp, mouse
ggccgagccgcgaagcgaca

SEQ ID NO: 562029 - DNA, 20 bp, mouse
gggagtagtgagtgtcgggt

SEQ ID NO: 562030 - DNA, 20 bp, mouse
ggcggcgtcggcagaggcgc

SEQ ID NO: 562031 - DNA, 20 bp, mouse
gggctcctgtcgccctgccc

SEQ ID NO: 562032 - DNA, 20 bp, mouse
ggaccgcagcgagagcagcg

SEQ ID NO: 562033 - DNA, 20 bp, mouse
gcctcccgcccgctacccgg

SEQ ID NO: 562034 - DNA, 20 bp, mouse
ggaccacgacgaaggcgcac

SEQ ID NO: 562035 - DNA, 20 bp, mouse
ggttccgcagcgccacgcgg

SEQ ID NO: 562036 - DNA, 20 bp, mouse
ggtgttgcgaggcccggcgg

SEQ ID NO: 562037 - DNA, 20 bp, mouse
gtgcgtgttgcgaggcccgg

SEQ ID NO: 562038 - DNA, 20 bp, mouse
gggtctgagagcgaccgcag

SEQ ID NO: 562039 - DNA, 20 bp, mouse
gggcggctgtgaggggttcc

SEQ ID NO: 562040 - DNA, 20 bp, mouse
ggtgaggggttcccggaaga

SEQ ID NO: 562041 - DNA, 20 bp, mouse
gccgcagtcagcgccagggt

SEQ ID NO: 562042 - DNA, 20 bp, mouse
gtggcgctgactgcggaggg

SEQ ID NO: 562043 - DNA, 20 bp, mouse
ggcgccgcacagggccttgg

SEQ ID NO: 562044 - DNA, 20 bp, mouse
gcgctgactgcggagggcgg

SEQ ID NO: 562045 - DNA, 20 bp, mouse
gccggccgcaccgccgaccc

SEQ ID NO: 562046 - DNA, 20 bp, mouse
gtcagagccgagggactcgg

SEQ ID NO: 562047 - DNA, 20 bp, mouse
gctctccagtcgcggcgagg

SEQ ID NO: 562048 - DNA, 20 bp, mouse
gtgagctccggagagactcg

SEQ ID NO: 562049 - DNA, 20 bp, mouse
gcgaggtggctgcaaactca

SEQ ID NO: 562050 - DNA, 20 bp, mouse
gggcgcggactctccagtcg

SEQ ID NO: 562051 - DNA, 20 bp, mouse
gctttcggaggaggatccag

SEQ ID NO: 562052 - DNA, 20 bp, mouse
gctctcagagccgagggact

SEQ ID NO: 562053 - DNA, 20 bp, mouse
gacggcgctctcagagccga

SEQ ID NO: 562054 - DNA, 20 bp, mouse
gtaacccacggtagacgggt

SEQ ID NO: 562055 - DNA, 20 bp, mouse
gtcgatgggctcctctcccc

SEQ ID NO: 562056 - DNA, 20 bp, mouse
gatggagcccgaccctctgg

SEQ ID NO: 562057 - DNA, 20 bp, mouse
gcggcggggagggacagcag

SEQ ID NO: 562058 - DNA, 20 bp, mouse
gcagatggagcccgaccctc

SEQ ID NO: 562059 - DNA, 20 bp, mouse
gccggctccgcgcctccaga

SEQ ID NO: 562060 - DNA, 20 bp, mouse
gcagaccgggaaaaaggtcg

SEQ ID NO: 562061 - DNA, 20 bp, mouse
gctccgcgcctccagagggt

SEQ ID NO: 562062 - DNA, 20 bp, mouse
gaaaccgaggccgggactgg

SEQ ID NO: 562063 - DNA, 20 bp, mouse
gggacagcaggggcgccggc

SEQ ID NO: 562064 - DNA, 20 bp, mouse
ggaggccagagggataccag

SEQ ID NO: 562065 - DNA, 20 bp, mouse
gacctcgtgggaagatgatg

SEQ ID NO: 562066 - DNA, 20 bp, mouse
gtgccccccacgcgcctcag

SEQ ID NO: 562067 - DNA, 20 bp, mouse
gccggctcgcattccctcag

SEQ ID NO: 562068 - DNA, 20 bp, mouse
gctgccgccgccgccactga

SEQ ID NO: 562069 - DNA, 20 bp, mouse
gcggccgctgaggcgcgtgg

SEQ ID NO: 562070 - DNA, 20 bp, mouse
gactggagcgctctgagccg

SEQ ID NO: 562071 - DNA, 20 bp, mouse
gtcccgcgcgagcgtccgga

SEQ ID NO: 562072 - DNA, 20 bp, mouse
gaggcgcgtggggggcacgg

SEQ ID NO: 562073 - DNA, 20 bp, mouse
gattccctcagtggcggcgg

SEQ ID NO: 562074 - DNA, 20 bp, mouse
ggtggcggcggcgcacgtgt

SEQ ID NO: 562075 - DNA, 20 bp, mouse
gtcccccgcgcggcctgaag

SEQ ID NO: 562076 - DNA, 20 bp, mouse
gcaccacgcagggacaacag

SEQ ID NO: 562077 - DNA, 20 bp, mouse
gcccgcagcagcgctatagg

SEQ ID NO: 562078 - DNA, 20 bp, mouse
ggtgccagcacacggtcccc

SEQ ID NO: 562079 - DNA, 20 bp, mouse
gcagccaggggaccgtgtgc

SEQ ID NO: 562080 - DNA, 20 bp, mouse
gcagcccgcagcagcgctat

SEQ ID NO: 562081 - DNA, 20 bp, mouse
ggtgtgaggagccaccacgc

SEQ ID NO: 562082 - DNA, 20 bp, mouse
ggctataggcggctcatgcc

SEQ ID NO: 562083 - DNA, 20 bp, mouse
gctttcaggaagccaacatg

SEQ ID NO: 562084 - DNA, 20 bp, mouse
gctctcctgagtagctccca

SEQ ID NO: 562085 - DNA, 20 bp, mouse
gtgcctgagcaggccagtcc

SEQ ID NO: 562086 - DNA, 20 bp, mouse
gcggccggagcggactctcc

SEQ ID NO: 562087 - DNA, 20 bp, mouse
ggcgcccggagagtccgctc

SEQ ID NO: 562088 - DNA, 20 bp, mouse
ggtgagccccccaaccaggt

SEQ ID NO: 562089 - DNA, 20 bp, mouse
gagcagcgccggcagcacag

SEQ ID NO: 562090 - DNA, 20 bp, mouse
gtgtcccacgaggtgactgg

SEQ ID NO: 562091 - DNA, 20 bp, mouse
ggccttggccatgtcccggg

SEQ ID NO: 562092 - DNA, 20 bp, mouse
gtggaggcggccgagcgagc

SEQ ID NO: 562093 - DNA, 20 bp, mouse
gctgccctccgggagaccgg

SEQ ID NO: 562094 - DNA, 20 bp, mouse
ggcgcccccagtcacctcgt

SEQ ID NO: 562095 - DNA, 20 bp, mouse
gagaccgggggagtagaccc

SEQ ID NO: 562096 - DNA, 20 bp, mouse
ggggactctgcgctgtacag

SEQ ID NO: 562097 - DNA, 20 bp, mouse
ggcgggtgagacactcctgg

SEQ ID NO: 562098 - DNA, 20 bp, mouse
ggctgcgggtgagacactcc

SEQ ID NO: 562099 - DNA, 20 bp, mouse
gatgccatgtggcgcttcag

SEQ ID NO: 562100 - DNA, 20 bp, mouse
gcatgtggcgcttcagcggt

SEQ ID NO: 562101 - DNA, 20 bp, mouse
gcctggtggcaacagcgaac

SEQ ID NO: 562102 - DNA, 20 bp, mouse
ggtggcgcttcagcggtcgg

SEQ ID NO: 562103 - DNA, 20 bp, mouse
gcaggccctctggtataagt

SEQ ID NO: 562104 - DNA, 20 bp, mouse
gaggccccagaagggaaagt

SEQ ID NO: 562105 - DNA, 20 bp, mouse
ggctgtaccccgccacagag

SEQ ID NO: 562106 - DNA, 20 bp, mouse
ggattcgaggccggtttcta

SEQ ID NO: 562107 - DNA, 20 bp, mouse
gcggtttctaaggctcgggt

SEQ ID NO: 562108 - DNA, 20 bp, mouse
gcctaagcggctgcccccca

SEQ ID NO: 562109 - DNA, 20 bp, mouse
gcctgttggggacaagagag

SEQ ID NO: 562110 - DNA, 20 bp, mouse
gcctggagaggctaccggag

SEQ ID NO: 562111 - DNA, 20 bp, mouse
gcccagtcccgattcgaggc

SEQ ID NO: 562112 - DNA, 20 bp, mouse
ggggaggcatgagcctggag

SEQ ID NO: 562113 - DNA, 20 bp, mouse
ggggccccagtcccgattcg

SEQ ID NO: 562114 - DNA, 20 bp, mouse
gcaagagagtggcgcctaag

SEQ ID NO: 562115 - DNA, 20 bp, mouse
ggttttcagacagactctgc

SEQ ID NO: 562116 - DNA, 20 bp, mouse
ggagagaccggcaagatctg

SEQ ID NO: 562117 - DNA, 20 bp, mouse
gctggaactgagctgcggca

SEQ ID NO: 562118 - DNA, 20 bp, mouse
gccagctcgactgcccgagg

SEQ ID NO: 562119 - DNA, 20 bp, mouse
gagacaccccagcgagagac

SEQ ID NO: 562120 - DNA, 20 bp, mouse
gtcttgccggtctctcgctg

SEQ ID NO: 562121 - DNA, 20 bp, mouse
gactgagctgcggcagggtc

SEQ ID NO: 562122 - DNA, 20 bp, mouse
gtccctaaagaggctcgcag

SEQ ID NO: 562123 - DNA, 20 bp, mouse
gaacgcagacgtggggacgt

SEQ ID NO: 562124 - DNA, 20 bp, mouse
gcggcagccgaaaggcaggg

SEQ ID NO: 562125 - DNA, 20 bp, mouse
ggctcgcacgcacaccccct

SEQ ID NO: 562126 - DNA, 20 bp, mouse
gggctctcccaggctagcgg

SEQ ID NO: 562127 - DNA, 20 bp, mouse
gcgctccgctgggctctccc

SEQ ID NO: 562128 - DNA, 20 bp, mouse
ggggccgcccccctgctctg

SEQ ID NO: 562129 - DNA, 20 bp, mouse
ggagcggccgccccagagca

SEQ ID NO: 562130 - DNA, 20 bp, mouse
gtaggggctcaggggaccga

SEQ ID NO: 562131 - DNA, 20 bp, mouse
gactctgaggaaggacgtgg

SEQ ID NO: 562132 - DNA, 20 bp, mouse
gcgttctggagcgcaggcag

SEQ ID NO: 562133 - DNA, 20 bp, mouse
gctctctcctccgctagcct

SEQ ID NO: 562134 - DNA, 20 bp, mouse
gagactccgggtggtggctg

SEQ ID NO: 562135 - DNA, 20 bp, mouse
gtcaggggaccgagggacca

SEQ ID NO: 562136 - DNA, 20 bp, mouse
gcagcagcagtgcgaggtgg

SEQ ID NO: 562137 - DNA, 20 bp, mouse
ggtgcagcagcagtgcgagg

SEQ ID NO: 562138 - DNA, 20 bp, mouse
gtcgaggtcaagacacaggt

SEQ ID NO: 562139 - DNA, 20 bp, mouse
gaggcttctcgcgggcgcag

SEQ ID NO: 562140 - DNA, 20 bp, mouse
gcaggtgcagcagcagtgcg

SEQ ID NO: 562141 - DNA, 20 bp, mouse
gcggagggatctggcagttg

SEQ ID NO: 562142 - DNA, 20 bp, mouse
gccctgcagcaggcttctcg

SEQ ID NO: 562143 - DNA, 20 bp, mouse
gcttaggtccgcagtccctg

SEQ ID NO: 562144 - DNA, 20 bp, mouse
gaaagctcgagcatagagag

SEQ ID NO: 562145 - DNA, 20 bp, mouse
ggcggtggggcggagggatc

SEQ ID NO: 562146 - DNA, 20 bp, mouse
gacctggcctagggtcgtca

SEQ ID NO: 562147 - DNA, 20 bp, mouse
ggtgtgtgggaggaacgcag

SEQ ID NO: 562148 - DNA, 20 bp, mouse
ggcacgaggctcattccaag

SEQ ID NO: 562149 - DNA, 20 bp, mouse
gtgtgttctgcctagacagg

SEQ ID NO: 562150 - DNA, 20 bp, mouse
gagagggcgagactcagatg

SEQ ID NO: 562151 - DNA, 20 bp, mouse
gaccctgacgaccctaggcc

SEQ ID NO: 562152 - DNA, 20 bp, mouse
gtcaggaccctgacgaccct

SEQ ID NO: 562153 - DNA, 20 bp, mouse
gcgctcgcatcggggctcag

SEQ ID NO: 562154 - DNA, 20 bp, mouse
gatccggaaatcaggacctc

SEQ ID NO: 562155 - DNA, 20 bp, mouse
gcgcaggggctggaatagga

SEQ ID NO: 562156 - DNA, 20 bp, mouse
gcggtcctcaagagacctca

SEQ ID NO: 562157 - DNA, 20 bp, mouse
gtgtttgtagtaactatctt

SEQ ID NO: 562158 - DNA, 20 bp, mouse
gagacggtgtggctgtgact

SEQ ID NO: 562159 - DNA, 20 bp, mouse
gcagcaacccgagcgtgggt

SEQ ID NO: 562160 - DNA, 20 bp, mouse
gtggctgtgactcggagttt

SEQ ID NO: 562161 - DNA, 20 bp, mouse
gtttggcaaaagagacggtg

SEQ ID NO: 562162 - DNA, 20 bp, mouse
gagggctggtgagcctcaac

SEQ ID NO: 562163 - DNA, 20 bp, mouse
ggcccaggatagccaaagga

SEQ ID NO: 562164 - DNA, 20 bp, mouse
ggccacagtgctagggaagt

SEQ ID NO: 562165 - DNA, 20 bp, mouse
gagcctcaaaggagttagac

SEQ ID NO: 562166 - DNA, 20 bp, mouse
gcgggggaggagccgagacc

SEQ ID NO: 562167 - DNA, 20 bp, mouse
gtgcagagctgtcggacctc

SEQ ID NO: 562168 - DNA, 20 bp, mouse
gcccccgctaaagagcacta

SEQ ID NO: 562169 - DNA, 20 bp, mouse
gctcggagctgcagagctgt

SEQ ID NO: 562170 - DNA, 20 bp, mouse
ggctgtcggacctccggacg

SEQ ID NO: 562171 - DNA, 20 bp, mouse
gcagtccccgaagaggccat

SEQ ID NO: 562172 - DNA, 20 bp, mouse
gtggtggtggccgcgtccgg

SEQ ID NO: 562173 - DNA, 20 bp, mouse
gtgggcgagtgctgcagggt

SEQ ID NO: 562174 - DNA, 20 bp, mouse
ggtgggcacggggagaaatc

SEQ ID NO: 562175 - DNA, 20 bp, mouse
gggcaggggctgggcagcta

SEQ ID NO: 562176 - DNA, 20 bp, mouse
gtcggaggcggagaagaagg

SEQ ID NO: 562177 - DNA, 20 bp, mouse
gccgcggcgggcctgagggt

SEQ ID NO: 562178 - DNA, 20 bp, mouse
ggccgctgcgcgttcggcgg

SEQ ID NO: 562179 - DNA, 20 bp, mouse
gtcccccgccgaacgcgcag

SEQ ID NO: 562180 - DNA, 20 bp, mouse
ggcagccgctgcgcgttcgg

SEQ ID NO: 562181 - DNA, 20 bp, mouse
gggcgccgggtccttgacca

SEQ ID NO: 562182 - DNA, 20 bp, mouse
ggctagagcgcggccccggg

SEQ ID NO: 562183 - DNA, 20 bp, mouse
gccgctgcacatctcggtga

SEQ ID NO: 562184 - DNA, 20 bp, mouse
gtgggcctcggtgacaatcg

SEQ ID NO: 562185 - DNA, 20 bp, mouse
gtgcgctgcgaaggaggcgg

SEQ ID NO: 562186 - DNA, 20 bp, mouse
gtggggcaggccgcacctca

SEQ ID NO: 562187 - DNA, 20 bp, mouse
gggagagcaggcgcgccgag

SEQ ID NO: 562188 - DNA, 20 bp, mouse
ggcccgcggacctcatggtg

SEQ ID NO: 562189 - DNA, 20 bp, mouse
gcgcagggccgcaaaagcag

SEQ ID NO: 562190 - DNA, 20 bp, mouse
gggcggccgtggcccgtctg

SEQ ID NO: 562191 - DNA, 20 bp, mouse
gccgctggctgcagacgcta

SEQ ID NO: 562192 - DNA, 20 bp, mouse
gatgcgcgagcaggcggcca

SEQ ID NO: 562193 - DNA, 20 bp, mouse
gagccacaggcccaggccta

SEQ ID NO: 562194 - DNA, 20 bp, mouse
gagcgctggccggagaccct

SEQ ID NO: 562195 - DNA, 20 bp, mouse
gggcacggggctgaatgccg

SEQ ID NO: 562196 - DNA, 20 bp, mouse
gggatgctgagtgagaggac

SEQ ID NO: 562197 - DNA, 20 bp, mouse
ggaactctcaggatgatacc

SEQ ID NO: 562198 - DNA, 20 bp, mouse
gtgagaggactggaactctc

SEQ ID NO: 562199 - DNA, 20 bp, mouse
gcaggatgcagagaggttgc

SEQ ID NO: 562200 - DNA, 20 bp, mouse
gtgcaggtgtgagaaatgcc

SEQ ID NO: 562201 - DNA, 20 bp, mouse
gtgtgagaaatgccaggagg

SEQ ID NO: 562202 - DNA, 20 bp, mouse
gaggtgtgagaaatgccagg

SEQ ID NO: 562203 - DNA, 20 bp, mouse
gtcaggctgtgtcaccaagg

SEQ ID NO: 562204 - DNA, 20 bp, mouse
gcatcctcccagggccacct

SEQ ID NO: 562205 - DNA, 20 bp, mouse
gggctccagagggtggactg

SEQ ID NO: 562206 - DNA, 20 bp, mouse
ggccctggctcaggaatact

SEQ ID NO: 562207 - DNA, 20 bp, mouse
gggtgtagaagttcgagcta

SEQ ID NO: 562208 - DNA, 20 bp, mouse
gtatgaccctgacaacccag

SEQ ID NO: 562209 - DNA, 20 bp, mouse
gagccagggcttgaaaaagt

SEQ ID NO: 562210 - DNA, 20 bp, mouse
gctctctcaggttcagatca

SEQ ID NO: 562211 - DNA, 20 bp, mouse
gataggactgggcccctctg

SEQ ID NO: 562212 - DNA, 20 bp, mouse
gccccactggcatctgacta

SEQ ID NO: 562213 - DNA, 20 bp, mouse
ggcccctctgaggatgatga

SEQ ID NO: 562214 - DNA, 20 bp, mouse
gtcctagtattcctgagcca

SEQ ID NO: 562215 - DNA, 20 bp, mouse
gctgtcagcgtcatctctga

SEQ ID NO: 562216 - DNA, 20 bp, mouse
gctgtggctaagtcagaagg

SEQ ID NO: 562217 - DNA, 20 bp, mouse
gtggggctcgcactgagcag

SEQ ID NO: 562218 - DNA, 20 bp, mouse
gcacctggctccttgagcag

SEQ ID NO: 562219 - DNA, 20 bp, mouse
ggtcctaggatgaccatggc

SEQ ID NO: 562220 - DNA, 20 bp, mouse
gagcatctctgaagaacacc

SEQ ID NO: 562221 - DNA, 20 bp, mouse
gggtggatcggactcacggg

SEQ ID NO: 562222 - DNA, 20 bp, mouse
gctgcaaaggcacattaccc

SEQ ID NO: 562223 - DNA, 20 bp, mouse
gcatcctaggaccactgccg

SEQ ID NO: 562224 - DNA, 20 bp, mouse
gtcttactcagaaccccagg

SEQ ID NO: 562225 - DNA, 20 bp, mouse
gaggaacaccaagcctgcca

SEQ ID NO: 562226 - DNA, 20 bp, mouse
gtgagaagagagatgtacgg

SEQ ID NO: 562227 - DNA, 20 bp, mouse
gaacggggctttacagtcgg

SEQ ID NO: 562228 - DNA, 20 bp, mouse
gcaacctgccaaggagataa

SEQ ID NO: 562229 - DNA, 20 bp, mouse
gctgggcgtgtagacacaga

SEQ ID NO: 562230 - DNA, 20 bp, mouse
gtgcaaatgaatagcaaacg

SEQ ID NO: 562231 - DNA, 20 bp, mouse
gaagcatccgggagcaacat

SEQ ID NO: 562232 - DNA, 20 bp, mouse
gtgggctaggcgtcctctct

SEQ ID NO: 562233 - DNA, 20 bp, mouse
gagcttggggttccacgtgt

SEQ ID NO: 562234 - DNA, 20 bp, mouse
gggttgggaacaacctgcca

SEQ ID NO: 562235 - DNA, 20 bp, mouse
ggggataaatcagacaggta

SEQ ID NO: 562236 - DNA, 20 bp, mouse
gagagggcggcggcactccc

SEQ ID NO: 562237 - DNA, 20 bp, mouse
gacgcgtctggagttaacca

SEQ ID NO: 562238 - DNA, 20 bp, mouse
gggagcagcaggccgactcc

SEQ ID NO: 562239 - DNA, 20 bp, mouse
gaacatggctcctgcggcag

SEQ ID NO: 562240 - DNA, 20 bp, mouse
gagttaaccatggcgctcac

SEQ ID NO: 562241 - DNA, 20 bp, mouse
gcggggcctggagatcgaga

SEQ ID NO: 562242 - DNA, 20 bp, mouse
gagcgtcccgcgtccccggg

SEQ ID NO: 562243 - DNA, 20 bp, mouse
gtggagcaggacgaaagcgg

SEQ ID NO: 562244 - DNA, 20 bp, mouse
gtgggcgccagtgagcgcca

SEQ ID NO: 562245 - DNA, 20 bp, mouse
ggcctggagcaggacgaaag

SEQ ID NO: 562246 - DNA, 20 bp, mouse
gcactggtagcagagagccc

SEQ ID NO: 562247 - DNA, 20 bp, mouse
gcacaggtgcccactctcac

SEQ ID NO: 562248 - DNA, 20 bp, mouse
gccacccagacaggaggccg

SEQ ID NO: 562249 - DNA, 20 bp, mouse
gacaggaggccgaggttgaa

SEQ ID NO: 562250 - DNA, 20 bp, mouse
gctgctaccagtgtcagtct

SEQ ID NO: 562251 - DNA, 20 bp, mouse
gcgtcctgttcggggaagga

SEQ ID NO: 562252 - DNA, 20 bp, mouse
gcaacctcggcctcctgtct

SEQ ID NO: 562253 - DNA, 20 bp, mouse
gctcttagacaatactgcct

SEQ ID NO: 562254 - DNA, 20 bp, mouse
gtcaggagctacaaaccctg

SEQ ID NO: 562255 - DNA, 20 bp, mouse
gtcggagcatcagaggtacg

SEQ ID NO: 562256 - DNA, 20 bp, mouse
gcatagtggaacggaccgtg

SEQ ID NO: 562257 - DNA, 20 bp, mouse
gggtggtaccgaggaggtga

SEQ ID NO: 562258 - DNA, 20 bp, mouse
ggtatgctccgcgatgtctg

SEQ ID NO: 562259 - DNA, 20 bp, mouse
gcgacttggtggtaccgagg

SEQ ID NO: 562260 - DNA, 20 bp, mouse
gcaagtcgcctcagacatcg

SEQ ID NO: 562261 - DNA, 20 bp, mouse
gccgaagcgaagttcagagg

SEQ ID NO: 562262 - DNA, 20 bp, mouse
gaagcgacccacacccacgg

SEQ ID NO: 562263 - DNA, 20 bp, mouse
gcagaacgggcatagtggaa

SEQ ID NO: 562264 - DNA, 20 bp, mouse
gaggcgacttggtggtaccg

SEQ ID NO: 562265 - DNA, 20 bp, mouse
ggagaggctgtcacctccgt

SEQ ID NO: 562266 - DNA, 20 bp, mouse
gcagcccgcgcgcatggccc

SEQ ID NO: 562267 - DNA, 20 bp, mouse
gcgggagggaggcaagtgtc

SEQ ID NO: 562268 - DNA, 20 bp, mouse
gtggctccgggccttataag

SEQ ID NO: 562269 - DNA, 20 bp, mouse
gatccgggagcgctacgagg

SEQ ID NO: 562270 - DNA, 20 bp, mouse
ggcccgggcagccccgaccc

SEQ ID NO: 562271 - DNA, 20 bp, mouse
gccgatgtgccgcccgccgg

SEQ ID NO: 562272 - DNA, 20 bp, mouse
gctcaggctccgaggcgact

SEQ ID NO: 562273 - DNA, 20 bp, mouse
gcggtgcgaagagcacgttg

SEQ ID NO: 562274 - DNA, 20 bp, mouse
gagcgggccggccagagcgg

SEQ ID NO: 562275 - DNA, 20 bp, mouse
gctgcccgggccatgcgcgc

SEQ ID NO: 562276 - DNA, 20 bp, mouse
gctcctggcggggagtcatg

SEQ ID NO: 562277 - DNA, 20 bp, mouse
gcgcccgagggacacctacg

SEQ ID NO: 562278 - DNA, 20 bp, mouse
gccgagggacacctacgggg

SEQ ID NO: 562279 - DNA, 20 bp, mouse
ggcagcccgcgagggccggt

SEQ ID NO: 562280 - DNA, 20 bp, mouse
gcaggagctgccgggcgcaa

SEQ ID NO: 562281 - DNA, 20 bp, mouse
ggcggcccagcccagcgtca

SEQ ID NO: 562282 - DNA, 20 bp, mouse
gcgagcgagcgtaccgggag

SEQ ID NO: 562283 - DNA, 20 bp, mouse
gcggagagcagcgtccgggg

SEQ ID NO: 562284 - DNA, 20 bp, mouse
gcacgcccggcagcccgcga

SEQ ID NO: 562285 - DNA, 20 bp, mouse
ggcagccagccgccacccac

SEQ ID NO: 562286 - DNA, 20 bp, mouse
gggcctgtcaccgaataacg

SEQ ID NO: 562287 - DNA, 20 bp, mouse
ggccaggacacaagcgagtt

SEQ ID NO: 562288 - DNA, 20 bp, mouse
gagctagctagctaagatgc

SEQ ID NO: 562289 - DNA, 20 bp, mouse
gacgcggcttcgtttagaag

SEQ ID NO: 562290 - DNA, 20 bp, mouse
gtagctagctagctgcaggc

SEQ ID NO: 562291 - DNA, 20 bp, mouse
gaggtgagttccagtccaac

SEQ ID NO: 562292 - DNA, 20 bp, mouse
gcaggtagctcacttcctgt

SEQ ID NO: 562293 - DNA, 20 bp, mouse
gggcttcgtttagaagggga

SEQ ID NO: 562294 - DNA, 20 bp, mouse
gggagatgcagcgctagaaa

SEQ ID NO: 562295 - DNA, 20 bp, mouse
gctctcagcatcccctcctc

SEQ ID NO: 562296 - DNA, 20 bp, mouse
ggccaagcaagcttcagctc

SEQ ID NO: 562297 - DNA, 20 bp, mouse
gggcgacttctgcaatcaag

SEQ ID NO: 562298 - DNA, 20 bp, mouse
gctctactggtcacagggag

SEQ ID NO: 562299 - DNA, 20 bp, mouse
gctctgcgatgggacacctg

SEQ ID NO: 562300 - DNA, 20 bp, mouse
gccagaagggcgtctgccca

SEQ ID NO: 562301 - DNA, 20 bp, mouse
ggcccgagctgaagcttgct

SEQ ID NO: 562302 - DNA, 20 bp, mouse
gacctagggtcctggaaggt

SEQ ID NO: 562303 - DNA, 20 bp, mouse
gccaggtccctgagagccac

SEQ ID NO: 562304 - DNA, 20 bp, mouse
gggaccctaggttcccagaa

SEQ ID NO: 562305 - DNA, 20 bp, mouse
ggcagcaccagctctgcgat

SEQ ID NO: 562306 - DNA, 20 bp, mouse
gcgggcaggactgcagccag

SEQ ID NO: 562307 - DNA, 20 bp, mouse
gggccgctgcagctgcaggt

SEQ ID NO: 562308 - DNA, 20 bp, mouse
ggcccagagcccagcacacg

SEQ ID NO: 562309 - DNA, 20 bp, mouse
gccagcacacgcggccaggc

SEQ ID NO: 562310 - DNA, 20 bp, mouse
gcagcggcttaccttcagga

SEQ ID NO: 562311 - DNA, 20 bp, mouse
gaggatggagagacgcgtcc

SEQ ID NO: 562312 - DNA, 20 bp, mouse
gagcggccgctggctactcc

SEQ ID NO: 562313 - DNA, 20 bp, mouse
ggagcccagcacacgcggcc

SEQ ID NO: 562314 - DNA, 20 bp, mouse
gtgcagctgcaggtggggcg

SEQ ID NO: 562315 - DNA, 20 bp, mouse
ggaagcaaggaggacgtgta

SEQ ID NO: 562316 - DNA, 20 bp, mouse
gcctgctgccggcctctctg

SEQ ID NO: 562317 - DNA, 20 bp, mouse
ggcggcacggagctgcgacg

SEQ ID NO: 562318 - DNA, 20 bp, mouse
gcgggccaggtccctcacgg

SEQ ID NO: 562319 - DNA, 20 bp, mouse
gctccgtgccgcagagaggc

SEQ ID NO: 562320 - DNA, 20 bp, mouse
gcgccgggccaggtccctca

SEQ ID NO: 562321 - DNA, 20 bp, mouse
gccactgagagtggactcag

SEQ ID NO: 562322 - DNA, 20 bp, mouse
gtgccggcctctctgcggca

SEQ ID NO: 562323 - DNA, 20 bp, mouse
gccctgggcatgtgcagacc

SEQ ID NO: 562324 - DNA, 20 bp, mouse
ggcagcaggcgccaccgtga

SEQ ID NO: 562325 - DNA, 20 bp, mouse
gctggtggcagcaatgtgtg

SEQ ID NO: 562326 - DNA, 20 bp, mouse
gtgggagggacagaacatct

SEQ ID NO: 562327 - DNA, 20 bp, mouse
gtagtgggtctactcccctt

SEQ ID NO: 562328 - DNA, 20 bp, mouse
gcatgcctctgagggtagtc

SEQ ID NO: 562329 - DNA, 20 bp, mouse
ggataacaccatgcctctga

SEQ ID NO: 562330 - DNA, 20 bp, mouse
ggggtctactccccttggga

SEQ ID NO: 562331 - DNA, 20 bp, mouse
gggagtatcaaagtagtagt

SEQ ID NO: 562332 - DNA, 20 bp, mouse
gtactccatggaggctgatg

SEQ ID NO: 562333 - DNA, 20 bp, mouse
gggtgccacatcagcctcca

SEQ ID NO: 562334 - DNA, 20 bp, mouse
gggggaaagacacatagaag

SEQ ID NO: 562335 - DNA, 20 bp, mouse
gctactttgatactccatgg

SEQ ID NO: 562336 - DNA, 20 bp, mouse
gcaaggcggcaggtaagcgg

SEQ ID NO: 562337 - DNA, 20 bp, mouse
gcggcggccggggctctacg

SEQ ID NO: 562338 - DNA, 20 bp, mouse
gaacgtgacccggagaggag

SEQ ID NO: 562339 - DNA, 20 bp, mouse
gcaggtaagcggcggtagag

SEQ ID NO: 562340 - DNA, 20 bp, mouse
gtgaggctccagagatacat

SEQ ID NO: 562341 - DNA, 20 bp, mouse
gagtcgcgtcgcctaggcaa

SEQ ID NO: 562342 - DNA, 20 bp, mouse
gtcgcgggcccaagggacaa

SEQ ID NO: 562343 - DNA, 20 bp, mouse
gaccccggccgagttcgggt

SEQ ID NO: 562344 - DNA, 20 bp, mouse
gcgacaaggcggcaggtaag

SEQ ID NO: 562345 - DNA, 20 bp, mouse
gagagcgggtgaacgtgacc

SEQ ID NO: 562346 - DNA, 20 bp, mouse
ggatcctaggtcagatggga

SEQ ID NO: 562347 - DNA, 20 bp, mouse
ggcactgcccttctgagtcc

SEQ ID NO: 562348 - DNA, 20 bp, mouse
ggaaggtagaacaagaagcc

SEQ ID NO: 562349 - DNA, 20 bp, mouse
gccttccctgcagctgtcca

SEQ ID NO: 562350 - DNA, 20 bp, mouse
gagcctgtatgtgggcaagt

SEQ ID NO: 562351 - DNA, 20 bp, mouse
gttttcatttaggagacaca

SEQ ID NO: 562352 - DNA, 20 bp, mouse
gagcaggctagggtgacaga

SEQ ID NO: 562353 - DNA, 20 bp, mouse
gacagccttggacagctgca

SEQ ID NO: 562354 - DNA, 20 bp, mouse
ggcagggaaggctgtaatgt

SEQ ID NO: 562355 - DNA, 20 bp, mouse
gccagggatcctaggtcaga

SEQ ID NO: 562356 - DNA, 20 bp, mouse
gcagccccagtcccacactt

SEQ ID NO: 562357 - DNA, 20 bp, mouse
gcttccaaagtgtgggactg

SEQ ID NO: 562358 - DNA, 20 bp, mouse
ggccagagtccaggaaccac

SEQ ID NO: 562359 - DNA, 20 bp, mouse
gtttgggacttaaagatcca

SEQ ID NO: 562360 - DNA, 20 bp, mouse
gggccccatcccactgacaa

SEQ ID NO: 562361 - DNA, 20 bp, mouse
gctggggtagctcgttctct

SEQ ID NO: 562362 - DNA, 20 bp, mouse
ggacttgagggaggcttctg

SEQ ID NO: 562363 - DNA, 20 bp, mouse
gtgaacagagaggagaatta

SEQ ID NO: 562364 - DNA, 20 bp, mouse
gcagcaggtacgcagcagta

SEQ ID NO: 562365 - DNA, 20 bp, mouse
ggggctgggtcaagctacgg

SEQ ID NO: 562366 - DNA, 20 bp, mouse
gcctgctgcgatacctagag

SEQ ID NO: 562367 - DNA, 20 bp, mouse
gggttctccccgctcacctc

SEQ ID NO: 562368 - DNA, 20 bp, mouse
ggagcagggcgagaacaggg

SEQ ID NO: 562369 - DNA, 20 bp, mouse
gtagccggccaccctcaatt

SEQ ID NO: 562370 - DNA, 20 bp, mouse
ggaagtacgcccgaggtgag

SEQ ID NO: 562371 - DNA, 20 bp, mouse
gggagggcaccgaattatga

SEQ ID NO: 562372 - DNA, 20 bp, mouse
gaggaaccgaagtacgcccg

SEQ ID NO: 562373 - DNA, 20 bp, mouse
gtaagacttggactcaagtg

SEQ ID NO: 562374 - DNA, 20 bp, mouse
ggcctgcgttacacaccagt

SEQ ID NO: 562375 - DNA, 20 bp, mouse
gtggcgcctgagtcccgcgt

SEQ ID NO: 562376 - DNA, 20 bp, mouse
gcgaagcaccctccaagaag

SEQ ID NO: 562377 - DNA, 20 bp, mouse
ggccgctggggacctcacag

SEQ ID NO: 562378 - DNA, 20 bp, mouse
gcagcggggcctctggacac

SEQ ID NO: 562379 - DNA, 20 bp, mouse
gggcggttccccttcttgga

SEQ ID NO: 562380 - DNA, 20 bp, mouse
gctccgcgcgcgttcacggg

SEQ ID NO: 562381 - DNA, 20 bp, mouse
gcttggagggtgcttcgtcc

SEQ ID NO: 562382 - DNA, 20 bp, mouse
ggcttcgtcccggtgtccag

SEQ ID NO: 562383 - DNA, 20 bp, mouse
gtggctccgcgcgcgttcac

SEQ ID NO: 562384 - DNA, 20 bp, mouse
gcacgggcggttccccttct

SEQ ID NO: 562385 - DNA, 20 bp, mouse
gcagggcgccggcggaagag

SEQ ID NO: 562386 - DNA, 20 bp, mouse
ggccggagggcgcagctcgg

SEQ ID NO: 562387 - DNA, 20 bp, mouse
ggggtcccagcgccaaggaa

SEQ ID NO: 562388 - DNA, 20 bp, mouse
gcgcggaggaccccaggcac

SEQ ID NO: 562389 - DNA, 20 bp, mouse
gctgcgccctccggccccag

SEQ ID NO: 562390 - DNA, 20 bp, mouse
ggcggcgcccagaccctccc

SEQ ID NO: 562391 - DNA, 20 bp, mouse
gccggcgacgccgtacaggt

SEQ ID NO: 562392 - DNA, 20 bp, mouse
gccaggcacgggtagagtcc

SEQ ID NO: 562393 - DNA, 20 bp, mouse
ggccccagcggctgcagggt

SEQ ID NO: 562394 - DNA, 20 bp, mouse
gacgctgcaggacccagagt

SEQ ID NO: 562395 - DNA, 20 bp, mouse
gcccgatggggacctcgtcc

SEQ ID NO: 562396 - DNA, 20 bp, mouse
gccagctccgaatccaaagg

SEQ ID NO: 562397 - DNA, 20 bp, mouse
gaccagacctacgacccaga

SEQ ID NO: 562398 - DNA, 20 bp, mouse
gcagctgccatctgggtcgt

SEQ ID NO: 562399 - DNA, 20 bp, mouse
gcctccagctccgaatccaa

SEQ ID NO: 562400 - DNA, 20 bp, mouse
gcagtccagaggccctggca

SEQ ID NO: 562401 - DNA, 20 bp, mouse
ggccatctgggtcgtaggtc

SEQ ID NO: 562402 - DNA, 20 bp, mouse
gatggcagctgatccccctt

SEQ ID NO: 562403 - DNA, 20 bp, mouse
gcggagctggaggtagggct

SEQ ID NO: 562404 - DNA, 20 bp, mouse
ggggggatcagctgccatct

SEQ ID NO: 562405 - DNA, 20 bp, mouse
ggacgtggggtcacatgggg

SEQ ID NO: 562406 - DNA, 20 bp, mouse
gcggcgtcgccctgagggag

SEQ ID NO: 562407 - DNA, 20 bp, mouse
gcgcaccgagagctccgagt

SEQ ID NO: 562408 - DNA, 20 bp, mouse
ggcgaggaccggagagaaag

SEQ ID NO: 562409 - DNA, 20 bp, mouse
ggcgacgccgggagccgact

SEQ ID NO: 562410 - DNA, 20 bp, mouse
gctctcggtgcggggcgcag

SEQ ID NO: 562411 - DNA, 20 bp, mouse
gacaggaggagctgccgccg

SEQ ID NO: 562412 - DNA, 20 bp, mouse
ggcgcggccgagggagaagg

SEQ ID NO: 562413 - DNA, 20 bp, mouse
gcggctgagggaacagagtc

SEQ ID NO: 562414 - DNA, 20 bp, mouse
gagcggcagctagggagtca

SEQ ID NO: 562415 - DNA, 20 bp, mouse
gagagctccgagtcggctcc

SEQ ID NO: 562416 - DNA, 20 bp, mouse
gccgcagtggaggagaggac

SEQ ID NO: 562417 - DNA, 20 bp, mouse
ggcttccggaaccgcagtgg

SEQ ID NO: 562418 - DNA, 20 bp, mouse
gaggcgccatggagccggag

SEQ ID NO: 562419 - DNA, 20 bp, mouse
gcctggcgcacagccccctc

SEQ ID NO: 562420 - DNA, 20 bp, mouse
gcccccggtggcatattcca

SEQ ID NO: 562421 - DNA, 20 bp, mouse
gacagccccctccggctcca

SEQ ID NO: 562422 - DNA, 20 bp, mouse
gggccgagaaggatctccgg

SEQ ID NO: 562423 - DNA, 20 bp, mouse
gacaggccgagaaggatctc

SEQ ID NO: 562424 - DNA, 20 bp, mouse
gagccttccaagaggactgg

SEQ ID NO: 562425 - DNA, 20 bp, mouse
gaagtgacggagatccagcc

SEQ ID NO: 562426 - DNA, 20 bp, mouse
gcccgcggcggaagaggcag

SEQ ID NO: 562427 - DNA, 20 bp, mouse
gacaagcggctgcagcaatc

SEQ ID NO: 562428 - DNA, 20 bp, mouse
gccggtgtgattgataggga

SEQ ID NO: 562429 - DNA, 20 bp, mouse
ggtgtgattgatagggacgg

SEQ ID NO: 562430 - DNA, 20 bp, mouse
ggtgtcgcgtggcccggcgt

SEQ ID NO: 562431 - DNA, 20 bp, mouse
gccggcgtcggcgtgacggt

SEQ ID NO: 562432 - DNA, 20 bp, mouse
ggcctggcccgcggcggaag

SEQ ID NO: 562433 - DNA, 20 bp, mouse
gtcggcgtgacggttggacg

SEQ ID NO: 562434 - DNA, 20 bp, mouse
gtcggccggtgtgattgata

SEQ ID NO: 562435 - DNA, 20 bp, mouse
ggggacggcggcagcgagag

SEQ ID NO: 562436 - DNA, 20 bp, mouse
ggcactgctcgggacgtcag

SEQ ID NO: 562437 - DNA, 20 bp, mouse
gataggctgtgttgtcacgc

SEQ ID NO: 562438 - DNA, 20 bp, mouse
ggccgggtccgggagcgggt

SEQ ID NO: 562439 - DNA, 20 bp, mouse
gtattcattgcgacagggca

SEQ ID NO: 562440 - DNA, 20 bp, mouse
gtgcaaaagcgtctctgaca

SEQ ID NO: 562441 - DNA, 20 bp, mouse
gagtattattcattgcgaca

SEQ ID NO: 562442 - DNA, 20 bp, mouse
ggcctcgccccgctcccctc

SEQ ID NO: 562443 - DNA, 20 bp, mouse
ggggagcagagagggacggc

SEQ ID NO: 562444 - DNA, 20 bp, mouse
ggagaagctggggaagcgcc

SEQ ID NO: 562445 - DNA, 20 bp, mouse
gtcgggacgtcagcggcaca

SEQ ID NO: 562446 - DNA, 20 bp, mouse
gagagcgctggtccgcgtga

SEQ ID NO: 562447 - DNA, 20 bp, mouse
ggcagccgggagccctcacg

SEQ ID NO: 562448 - DNA, 20 bp, mouse
gtccggccagtgcctactga

SEQ ID NO: 562449 - DNA, 20 bp, mouse
gccccggctcgtccctcagt

SEQ ID NO: 562450 - DNA, 20 bp, mouse
ggcgcctgttctcctctcag

SEQ ID NO: 562451 - DNA, 20 bp, mouse
gacgccagcgcggtcttgag

SEQ ID NO: 562452 - DNA, 20 bp, mouse
ggctcctggcgcctccgccc

SEQ ID NO: 562453 - DNA, 20 bp, mouse
gtggtccgcgtgagggctcc

SEQ ID NO: 562454 - DNA, 20 bp, mouse
ggccaaagggagccgctgag

SEQ ID NO: 562455 - DNA, 20 bp, mouse
gagcggagagtggttcatgg

SEQ ID NO: 562456 - DNA, 20 bp, mouse
gccggggacggccatcgcgt

SEQ ID NO: 562457 - DNA, 20 bp, mouse
gacactcggccagtgagccg

SEQ ID NO: 562458 - DNA, 20 bp, mouse
gtcggccagtgagccgggga

SEQ ID NO: 562459 - DNA, 20 bp, mouse
gggccgagtgtggctacatc

SEQ ID NO: 562460 - DNA, 20 bp, mouse
gcgtcggcggagtgaccagg

SEQ ID NO: 562461 - DNA, 20 bp, mouse
gggtaaggtgagcaacaggt

SEQ ID NO: 562462 - DNA, 20 bp, mouse
gatggccgtccccggctcac

SEQ ID NO: 562463 - DNA, 20 bp, mouse
gcggctttgcgggcaggtcc

SEQ ID NO: 562464 - DNA, 20 bp, mouse
ggtccggatgtagccacact

SEQ ID NO: 562465 - DNA, 20 bp, mouse
ggcgagccgagaatacgtgg

SEQ ID NO: 562466 - DNA, 20 bp, mouse
gggcctcgagggacaagacc

SEQ ID NO: 562467 - DNA, 20 bp, mouse
gaccgggagaggcccaggac

SEQ ID NO: 562468 - DNA, 20 bp, mouse
gcgagggacaagaccgggag

SEQ ID NO: 562469 - DNA, 20 bp, mouse
gtagccagcccacctgtcct

SEQ ID NO: 562470 - DNA, 20 bp, mouse
gctctggaaccgggcctcga

SEQ ID NO: 562471 - DNA, 20 bp, mouse
gacctgtcctgggcctctcc

SEQ ID NO: 562472 - DNA, 20 bp, mouse
gccttcctgcatagtgacag

SEQ ID NO: 562473 - DNA, 20 bp, mouse
gacaagaccgggagaggccc

SEQ ID NO: 562474 - DNA, 20 bp, mouse
gcggggtgcggagggaccgg

SEQ ID NO: 562475 - DNA, 20 bp, mouse
ggatccagctgtaggtccga

SEQ ID NO: 562476 - DNA, 20 bp, mouse
gagcagtctagagggctccg

SEQ ID NO: 562477 - DNA, 20 bp, mouse
ggtccacgcgcactcagccc

SEQ ID NO: 562478 - DNA, 20 bp, mouse
gcggcctctgagcagtctag

SEQ ID NO: 562479 - DNA, 20 bp, mouse
gagccctctagactgctcag

SEQ ID NO: 562480 - DNA, 20 bp, mouse
gggctctcccaccaccccgg

SEQ ID NO: 562481 - DNA, 20 bp, mouse
ggccgcggcggcggcactat

SEQ ID NO: 562482 - DNA, 20 bp, mouse
gtgcgcgtggacgccggccg

SEQ ID NO: 562483 - DNA, 20 bp, mouse
gcactatgggcacggggtag

SEQ ID NO: 562484 - DNA, 20 bp, mouse
ggcgtcgagccgggacctgg

SEQ ID NO: 562485 - DNA, 20 bp, mouse
gggaggccgtcgtcgctcca

SEQ ID NO: 562486 - DNA, 20 bp, mouse
gcagaggccaggacgcatcg

SEQ ID NO: 562487 - DNA, 20 bp, mouse
gccagctccacgatgcgtcc

SEQ ID NO: 562488 - DNA, 20 bp, mouse
gttatcataacgggaattag

SEQ ID NO: 562489 - DNA, 20 bp, mouse
ggagacatgcttctggttgt

SEQ ID NO: 562490 - DNA, 20 bp, mouse
gtggtgtcccaagaaggcac

SEQ ID NO: 562491 - DNA, 20 bp, mouse
gctgggccatgtgacatccc

SEQ ID NO: 562492 - DNA, 20 bp, mouse
ggttgtggggaccactttta

SEQ ID NO: 562493 - DNA, 20 bp, mouse
gcatgtgacatcccaggctt

SEQ ID NO: 562494 - DNA, 20 bp, mouse
gaaggttccacccaagccct

SEQ ID NO: 562495 - DNA, 20 bp, mouse
ggaaaacagtagccgttagt

SEQ ID NO: 562496 - DNA, 20 bp, mouse
gataggagagtgacaggtgt

SEQ ID NO: 562497 - DNA, 20 bp, mouse
gttattgcccgtcacagagg

SEQ ID NO: 562498 - DNA, 20 bp, mouse
ggcattattgcccgtcacag

SEQ ID NO: 562499 - DNA, 20 bp, mouse
gtgtgggccacctctgtgac

SEQ ID NO: 562500 - DNA, 20 bp, mouse
gctgtcactctcctatgtgt

SEQ ID NO: 562501 - DNA, 20 bp, mouse
gtcactcaggaactcagaag

SEQ ID NO: 562502 - DNA, 20 bp, mouse
gtcaagggttgtcccaagtc

SEQ ID NO: 562503 - DNA, 20 bp, mouse
gggtgtaggactgaccagaa

SEQ ID NO: 562504 - DNA, 20 bp, mouse
ggcggtgaggaaaaaatccc

SEQ ID NO: 562505 - DNA, 20 bp, mouse
ggcgggtaactgctcctgtg

SEQ ID NO: 562506 - DNA, 20 bp, mouse
gagggtggccctccagtcgg

SEQ ID NO: 562507 - DNA, 20 bp, mouse
ggagctcgcgagcgcggagg

SEQ ID NO: 562508 - DNA, 20 bp, mouse
gccctcaagaccatccgcaa

SEQ ID NO: 562509 - DNA, 20 bp, mouse
gtcggcgcagctcagtgacg

SEQ ID NO: 562510 - DNA, 20 bp, mouse
ggctgctggccactgcgcgt

SEQ ID NO: 562511 - DNA, 20 bp, mouse
gacaggaccagaccaccgac

SEQ ID NO: 562512 - DNA, 20 bp, mouse
ggccgcggagtcaccatctg

SEQ ID NO: 562513 - DNA, 20 bp, mouse
gcccgggcgggcccaccgtt

SEQ ID NO: 562514 - DNA, 20 bp, mouse
gacggtgagccgcgacaagg

SEQ ID NO: 562515 - DNA, 20 bp, mouse
gcgcgagctcgcgagcgcgg

SEQ ID NO: 562516 - DNA, 20 bp, mouse
gtcgtccccaaccccagcca

SEQ ID NO: 562517 - DNA, 20 bp, mouse
gagggctgtgtatgtcccca

SEQ ID NO: 562518 - DNA, 20 bp, mouse
gaccgataagcccggacaca

SEQ ID NO: 562519 - DNA, 20 bp, mouse
gacgcacaagtagaccctcg

SEQ ID NO: 562520 - DNA, 20 bp, mouse
ggggacgagagcagccgcga

SEQ ID NO: 562521 - DNA, 20 bp, mouse
gcatacacagccctgtgtcc

SEQ ID NO: 562522 - DNA, 20 bp, mouse
gaggagtcctactctgactg

SEQ ID NO: 562523 - DNA, 20 bp, mouse
ggccctgtgtccgggcttat

SEQ ID NO: 562524 - DNA, 20 bp, mouse
ggtcagtaccggtgtcgata

SEQ ID NO: 562525 - DNA, 20 bp, mouse
gcctgtggcttggcctggta

SEQ ID NO: 562526 - DNA, 20 bp, mouse
gctgtggtcgcaggtccaag

SEQ ID NO: 562527 - DNA, 20 bp, mouse
ggtgcagagatggcgatcca

SEQ ID NO: 562528 - DNA, 20 bp, mouse
gagggatcgtgcctaggccc

SEQ ID NO: 562529 - DNA, 20 bp, mouse
ggatccatggcgtgagactg

SEQ ID NO: 562530 - DNA, 20 bp, mouse
gggggctgctttagagatta

SEQ ID NO: 562531 - DNA, 20 bp, mouse
gctggtatctgcgagcggtg

SEQ ID NO: 562532 - DNA, 20 bp, mouse
ggagattagggatcgtgcct

SEQ ID NO: 562533 - DNA, 20 bp, mouse
ggcccaacgtcaccccccgg

SEQ ID NO: 562534 - DNA, 20 bp, mouse
gtctcacccagcaccaccgg

SEQ ID NO: 562535 - DNA, 20 bp, mouse
ggaggcgggtcttaattgac

SEQ ID NO: 562536 - DNA, 20 bp, mouse
gacctcctcgcgccccaagt

SEQ ID NO: 562537 - DNA, 20 bp, mouse
ggccccaagtaggcaagtgg

SEQ ID NO: 562538 - DNA, 20 bp, mouse
ggcctacttggggcgcgagg

SEQ ID NO: 562539 - DNA, 20 bp, mouse
gcgcggagaaaaggagccag

SEQ ID NO: 562540 - DNA, 20 bp, mouse
gttttctgggacccaagcaa

SEQ ID NO: 562541 - DNA, 20 bp, mouse
gggcctccacttgcctactt

SEQ ID NO: 562542 - DNA, 20 bp, mouse
gtagggcagaagcggctcac

SEQ ID NO: 562543 - DNA, 20 bp, mouse
ggcctcccagacagccctcg

SEQ ID NO: 562544 - DNA, 20 bp, mouse
gtccccgagggctgtctggg

SEQ ID NO: 562545 - DNA, 20 bp, mouse
gacggcggatggcagacagg

SEQ ID NO: 562546 - DNA, 20 bp, mouse
gtcagagagaggcgacagag

SEQ ID NO: 562547 - DNA, 20 bp, mouse
gcatcttcagaaggagtgag

SEQ ID NO: 562548 - DNA, 20 bp, mouse
gggctgctctgctcacaggt

SEQ ID NO: 562549 - DNA, 20 bp, mouse
gtataaaagagggaagtcac

SEQ ID NO: 562550 - DNA, 20 bp, mouse
ggccccacgctcccaagata

SEQ ID NO: 562551 - DNA, 20 bp, mouse
gtccagcgtgaccagtggga

SEQ ID NO: 562552 - DNA, 20 bp, mouse
ggggccccatgtataaaaga

SEQ ID NO: 562553 - DNA, 20 bp, mouse
gtgcttgggtaggcaaatga

SEQ ID NO: 562554 - DNA, 20 bp, mouse
ggagggaggcattggagaag

SEQ ID NO: 562555 - DNA, 20 bp, mouse
gcagaggctattagacccta

SEQ ID NO: 562556 - DNA, 20 bp, mouse
gtagggcacggagggcggag

SEQ ID NO: 562557 - DNA, 20 bp, mouse
gcgcaagctgaattggacta

SEQ ID NO: 562558 - DNA, 20 bp, mouse
gtggactagggcacggaggg

SEQ ID NO: 562559 - DNA, 20 bp, mouse
gaattggactagggcacgga

SEQ ID NO: 562560 - DNA, 20 bp, mouse
gagccctgccctggagtcgg

SEQ ID NO: 562561 - DNA, 20 bp, mouse
ggctgaattggactagggca

SEQ ID NO: 562562 - DNA, 20 bp, mouse
gcctggaccgcaagctgaat

SEQ ID NO: 562563 - DNA, 20 bp, mouse
gtcagcttgcggtccaggtc

SEQ ID NO: 562564 - DNA, 20 bp, mouse
ggaggggcagaggtggttca

SEQ ID NO: 562565 - DNA, 20 bp, mouse
gaggcaggttccggtcccac

SEQ ID NO: 562566 - DNA, 20 bp, mouse
gctggccggtgagtgaggac

SEQ ID NO: 562567 - DNA, 20 bp, mouse
ggagactcgccctgctgtgt

SEQ ID NO: 562568 - DNA, 20 bp, mouse
gaccagccaggagccatcag

SEQ ID NO: 562569 - DNA, 20 bp, mouse
gtgctgctggccggtgagtg

SEQ ID NO: 562570 - DNA, 20 bp, mouse
ggcttcagtcagagagctgg

SEQ ID NO: 562571 - DNA, 20 bp, mouse
gagagcagcccagcctaggg

SEQ ID NO: 562572 - DNA, 20 bp, mouse
gcagtggttgccaggcacct

SEQ ID NO: 562573 - DNA, 20 bp, mouse
gttccagcccagagcaaggc

SEQ ID NO: 562574 - DNA, 20 bp, mouse
gcctccctgccaatgagaga

SEQ ID NO: 562575 - DNA, 20 bp, mouse
gatagttccagcccagagca

SEQ ID NO: 562576 - DNA, 20 bp, mouse
ggggagcctgctgcaatggg

SEQ ID NO: 562577 - DNA, 20 bp, mouse
gctcctgaggcagcactgac

SEQ ID NO: 562578 - DNA, 20 bp, mouse
gcacccacctggccatccta

SEQ ID NO: 562579 - DNA, 20 bp, mouse
gatgggaggtttcatcctgg

SEQ ID NO: 562580 - DNA, 20 bp, mouse
gagccttaggatggccaggt

SEQ ID NO: 562581 - DNA, 20 bp, mouse
ggcatgggagcctgctgcaa

SEQ ID NO: 562582 - DNA, 20 bp, mouse
gatcctgggggaggtaggca

SEQ ID NO: 562583 - DNA, 20 bp, mouse
gtcacttacccaggaggcaa

SEQ ID NO: 562584 - DNA, 20 bp, mouse
gcaaaggcaagccagggcaa

SEQ ID NO: 562585 - DNA, 20 bp, mouse
gggccatcctaaggctcctg

SEQ ID NO: 562586 - DNA, 20 bp, mouse
gcagagctgcagggtgtacc

SEQ ID NO: 562587 - DNA, 20 bp, mouse
gtacctctgccacctcccag

SEQ ID NO: 562588 - DNA, 20 bp, mouse
ggctgcagggtgtaccaggc

SEQ ID NO: 562589 - DNA, 20 bp, mouse
gccacctcccaggggcatct

SEQ ID NO: 562590 - DNA, 20 bp, mouse
gtcatgggaggaggcacctg

SEQ ID NO: 562591 - DNA, 20 bp, mouse
ggtccctgttgcaaaggtga

SEQ ID NO: 562592 - DNA, 20 bp, mouse
ggtacccagatgcccctggg

SEQ ID NO: 562593 - DNA, 20 bp, mouse
gagtcaccgtctactgagag

SEQ ID NO: 562594 - DNA, 20 bp, mouse
gtcacatagccgagggagtc

SEQ ID NO: 562595 - DNA, 20 bp, mouse
gagagacctctctcagtaga

SEQ ID NO: 562596 - DNA, 20 bp, mouse
ggcgtgacagcgtgaagctg

SEQ ID NO: 562597 - DNA, 20 bp, mouse
ggcagcaagcacctacctgg

SEQ ID NO: 562598 - DNA, 20 bp, mouse
gtaatatgcccaaaagtctc

SEQ ID NO: 562599 - DNA, 20 bp, mouse
gcctggaacggaccattcca

SEQ ID NO: 562600 - DNA, 20 bp, mouse
ggcagatgctgagtgaccac

SEQ ID NO: 562601 - DNA, 20 bp, mouse
gtttagagggagaggccctg

SEQ ID NO: 562602 - DNA, 20 bp, mouse
gctgtcacgcacaacaagca

SEQ ID NO: 562603 - DNA, 20 bp, mouse
gcggaagagcccaagcctca

SEQ ID NO: 562604 - DNA, 20 bp, mouse
gccctctaaaacctccaggt

SEQ ID NO: 562605 - DNA, 20 bp, mouse
gaacaagcagggtagtgccg

SEQ ID NO: 562606 - DNA, 20 bp, mouse
ggcctcagcagctgcctcag

SEQ ID NO: 562607 - DNA, 20 bp, mouse
ggcagctgctgaggctccag

SEQ ID NO: 562608 - DNA, 20 bp, mouse
gctgcctcaggggcagtcaa

SEQ ID NO: 562609 - DNA, 20 bp, mouse
gtcattggccctgacaccca

SEQ ID NO: 562610 - DNA, 20 bp, mouse
gccagagggttaccagggat

SEQ ID NO: 562611 - DNA, 20 bp, mouse
ggtcaaaggcaggcatcccg

SEQ ID NO: 562612 - DNA, 20 bp, mouse
gctccctaggctccattcat

SEQ ID NO: 562613 - DNA, 20 bp, mouse
gctcaggggcagtcaaaggc

SEQ ID NO: 562614 - DNA, 20 bp, mouse
gggccaatgaatggagccta

SEQ ID NO: 562615 - DNA, 20 bp, mouse
ggaggtactgtcccagtgac

SEQ ID NO: 562616 - DNA, 20 bp, mouse
gctcccgactgagagccaga

SEQ ID NO: 562617 - DNA, 20 bp, mouse
gtagaagtcggaactgtgaa

SEQ ID NO: 562618 - DNA, 20 bp, mouse
ggagttaaatgagaatcctc

SEQ ID NO: 562619 - DNA, 20 bp, mouse
gtgccttctggctctcagtc

SEQ ID NO: 562620 - DNA, 20 bp, mouse
gagcatcacgtgggacacaa

SEQ ID NO: 562621 - DNA, 20 bp, mouse
gcttctccggctggtaggag

SEQ ID NO: 562622 - DNA, 20 bp, mouse
ggtaggaggggctaagaagt

SEQ ID NO: 562623 - DNA, 20 bp, mouse
gtcactgggtagcatcacgt

SEQ ID NO: 562624 - DNA, 20 bp, mouse
gtcaggagtcaggaatcact

SEQ ID NO: 562625 - DNA, 20 bp, mouse
gacttctagaaagtcttctc

SEQ ID NO: 562626 - DNA, 20 bp, mouse
ggctctggaggcagttcgga

SEQ ID NO: 562627 - DNA, 20 bp, mouse
ggcgttgcaagagttcccgg

SEQ ID NO: 562628 - DNA, 20 bp, mouse
gtgtcccgcggccgtcatgg

SEQ ID NO: 562629 - DNA, 20 bp, mouse
ggtcatggcggaggcggctc

SEQ ID NO: 562630 - DNA, 20 bp, mouse
ggcggtgagtgcactctcac

SEQ ID NO: 562631 - DNA, 20 bp, mouse
ggatcctggagcggaaatag

SEQ ID NO: 562632 - DNA, 20 bp, mouse
gtcttgtcccgcggccgtca

SEQ ID NO: 562633 - DNA, 20 bp, mouse
ggcggccgtcatggcggagg

SEQ ID NO: 562634 - DNA, 20 bp, mouse
gagggcgttgcaagagttcc

SEQ ID NO: 562635 - DNA, 20 bp, mouse
gggcgtgcgatcctgagcta

SEQ ID NO: 562636 - DNA, 20 bp, mouse
ggccatgagaccaagtccac

SEQ ID NO: 562637 - DNA, 20 bp, mouse
gatgggagcccagtgctcta

SEQ ID NO: 562638 - DNA, 20 bp, mouse
ggggagctccacatagtcag

SEQ ID NO: 562639 - DNA, 20 bp, mouse
gtaaggctccatagagcact

SEQ ID NO: 562640 - DNA, 20 bp, mouse
gagccaccaggccctggatg

SEQ ID NO: 562641 - DNA, 20 bp, mouse
gggggagccaagtcagaaat

SEQ ID NO: 562642 - DNA, 20 bp, mouse
gctgcctggaacctattccc

SEQ ID NO: 562643 - DNA, 20 bp, mouse
gggtatgtggggagccccag

SEQ ID NO: 562644 - DNA, 20 bp, mouse
gaccaaaaggaagggccagg

SEQ ID NO: 562645 - DNA, 20 bp, mouse
gctccccatccagggcctgg

SEQ ID NO: 562646 - DNA, 20 bp, mouse
gtgcacagaggaaagataga

SEQ ID NO: 562647 - DNA, 20 bp, mouse
ggagaaactcagctagtaca

SEQ ID NO: 562648 - DNA, 20 bp, mouse
gagtacagggatggaacaat

SEQ ID NO: 562649 - DNA, 20 bp, mouse
gtagcaaacaaatgcctgga

SEQ ID NO: 562650 - DNA, 20 bp, mouse
gtcctttaaatgcaccatcc

SEQ ID NO: 562651 - DNA, 20 bp, mouse
gtgctgatggtcactgagaa

SEQ ID NO: 562652 - DNA, 20 bp, mouse
gctgctaactgctcactgtt

SEQ ID NO: 562653 - DNA, 20 bp, mouse
ggcctggatggtgcatttaa

SEQ ID NO: 562654 - DNA, 20 bp, mouse
gttaaaggaagcccagccta

SEQ ID NO: 562655 - DNA, 20 bp, mouse
ggaagttgctaagagatagg

SEQ ID NO: 562656 - DNA, 20 bp, mouse
gtccagccaggagttggatg

SEQ ID NO: 562657 - DNA, 20 bp, mouse
gaccacaattcctccaggat

SEQ ID NO: 562658 - DNA, 20 bp, mouse
gggagatagaagagtaggca

SEQ ID NO: 562659 - DNA, 20 bp, mouse
gcctggctggatgcgaagtc

SEQ ID NO: 562660 - DNA, 20 bp, mouse
gggtgggatgagtctctgtg

SEQ ID NO: 562661 - DNA, 20 bp, mouse
gtccacatccaactcctggc

SEQ ID NO: 562662 - DNA, 20 bp, mouse
ggccccacactagagaacag

SEQ ID NO: 562663 - DNA, 20 bp, mouse
ggcaggcaagagcatcctaa

SEQ ID NO: 562664 - DNA, 20 bp, mouse
ggccactgttctctagtgtg

SEQ ID NO: 562665 - DNA, 20 bp, mouse
gagtagagacctggggacca

SEQ ID NO: 562666 - DNA, 20 bp, mouse
gcactacgtagtgctagacg

SEQ ID NO: 562667 - DNA, 20 bp, mouse
gagcactacgtagtgcgggg

SEQ ID NO: 562668 - DNA, 20 bp, mouse
gcctcagggaagttcaggag

SEQ ID NO: 562669 - DNA, 20 bp, mouse
gagagggtcagcacgcaaca

SEQ ID NO: 562670 - DNA, 20 bp, mouse
gactacgtagtgcggggcgg

SEQ ID NO: 562671 - DNA, 20 bp, mouse
ggaggtttgggagaaaggaa

SEQ ID NO: 562672 - DNA, 20 bp, mouse
gtctagcactacgtagtgcg

SEQ ID NO: 562673 - DNA, 20 bp, mouse
gacgtagtgcggggcggcgg

SEQ ID NO: 562674 - DNA, 20 bp, mouse
gacatttcgagcaacctggt

SEQ ID NO: 562675 - DNA, 20 bp, mouse
gggagggcacagcagtctgt

SEQ ID NO: 562676 - DNA, 20 bp, mouse
gtagcagctcaggtcccagt

SEQ ID NO: 562677 - DNA, 20 bp, mouse
ggtgaatatagccagagaaa

SEQ ID NO: 562678 - DNA, 20 bp, mouse
gcccagagccaccctttctc

SEQ ID NO: 562679 - DNA, 20 bp, mouse
gaaacaggcaagctccctac

SEQ ID NO: 562680 - DNA, 20 bp, mouse
ggcagtatggctccaagaag

SEQ ID NO: 562681 - DNA, 20 bp, mouse
gtgacaagtagcacaggagt

SEQ ID NO: 562682 - DNA, 20 bp, mouse
gcaggtctgacaagtagcac

SEQ ID NO: 562683 - DNA, 20 bp, mouse
gtggagtcctgggagatggc

SEQ ID NO: 562684 - DNA, 20 bp, mouse
gtggctggcttagtccccac

SEQ ID NO: 562685 - DNA, 20 bp, mouse
gcgaaccacaatggaagcat

SEQ ID NO: 562686 - DNA, 20 bp, mouse
gcccccagcagccttcatgg

SEQ ID NO: 562687 - DNA, 20 bp, mouse
gggaggacagactctgatca

SEQ ID NO: 562688 - DNA, 20 bp, mouse
ggggagcacgcaatgaactc

SEQ ID NO: 562689 - DNA, 20 bp, mouse
ggccggcagcacaagcatca

SEQ ID NO: 562690 - DNA, 20 bp, mouse
gaaggctgctgggggctgag

SEQ ID NO: 562691 - DNA, 20 bp, mouse
gggtctacaagctgcaacac

SEQ ID NO: 562692 - DNA, 20 bp, mouse
gagtctggagaacccgagag

SEQ ID NO: 562693 - DNA, 20 bp, mouse
ggccaccatgaaggctgctg

SEQ ID NO: 562694 - DNA, 20 bp, mouse
gctacaagctgcaacacagg

SEQ ID NO: 562695 - DNA, 20 bp, mouse
ggggaacaggcgctgagacc

SEQ ID NO: 562696 - DNA, 20 bp, mouse
ggtgacgacattcaagacag

SEQ ID NO: 562697 - DNA, 20 bp, mouse
gacgaggccggtcctaagca

SEQ ID NO: 562698 - DNA, 20 bp, mouse
gccggtcctaagcagggtcc

SEQ ID NO: 562699 - DNA, 20 bp, mouse
gcgtcacctggaccctgctt

SEQ ID NO: 562700 - DNA, 20 bp, mouse
gcctcagagtcgcagacacg

SEQ ID NO: 562701 - DNA, 20 bp, mouse
gagagtcgcagacacgaggc

SEQ ID NO: 562702 - DNA, 20 bp, mouse
ggccagataggagttaacgg

SEQ ID NO: 562703 - DNA, 20 bp, mouse
ggcggcaacggagaagaatg

SEQ ID NO: 562704 - DNA, 20 bp, mouse
gcagaagccgggagcactca

SEQ ID NO: 562705 - DNA, 20 bp, mouse
gaagccgggagcactcaagg

SEQ ID NO: 562706 - DNA, 20 bp, mouse
gcagcaaccggaggagggga

SEQ ID NO: 562707 - DNA, 20 bp, mouse
gcggggatagaataactcag

SEQ ID NO: 562708 - DNA, 20 bp, mouse
ggaccaggtaagaagcccaa

SEQ ID NO: 562709 - DNA, 20 bp, mouse
gggatagaataactcagagg

SEQ ID NO: 562710 - DNA, 20 bp, mouse
gaggggagggtcgagcctaa

SEQ ID NO: 562711 - DNA, 20 bp, mouse
gtgcacagcaaccggaggag

SEQ ID NO: 562712 - DNA, 20 bp, mouse
gcctcttgcacagcaaccgg

SEQ ID NO: 562713 - DNA, 20 bp, mouse
ggtgtcagtgggctactgcg

SEQ ID NO: 562714 - DNA, 20 bp, mouse
gctcggagctccccagaaac

SEQ ID NO: 562715 - DNA, 20 bp, mouse
gttgctgtgcaagagggaca

SEQ ID NO: 562716 - DNA, 20 bp, mouse
gcacgctgtggcgacaaggg

SEQ ID NO: 562717 - DNA, 20 bp, mouse
ggtacacgctgtggcgacaa

SEQ ID NO: 562718 - DNA, 20 bp, mouse
gggaggcgagttcatctcca

SEQ ID NO: 562719 - DNA, 20 bp, mouse
ggtcccaagtgtacacgctg

SEQ ID NO: 562720 - DNA, 20 bp, mouse
ggcgtggtcctcaagaagag

SEQ ID NO: 562721 - DNA, 20 bp, mouse
gtgctgctggggattcacca

SEQ ID NO: 562722 - DNA, 20 bp, mouse
gcgccacagcgtgtacactt

SEQ ID NO: 562723 - DNA, 20 bp, mouse
gcactcaccacgccactcga

SEQ ID NO: 562724 - DNA, 20 bp, mouse
gcgtgtacacttgggactct

SEQ ID NO: 562725 - DNA, 20 bp, mouse
gccacgccatcccagagccc

SEQ ID NO: 562726 - DNA, 20 bp, mouse
ggagcggcgcctccagatac

SEQ ID NO: 562727 - DNA, 20 bp, mouse
gaggaagagggagagattca

SEQ ID NO: 562728 - DNA, 20 bp, mouse
gcacaggcttgcagacacgt

SEQ ID NO: 562729 - DNA, 20 bp, mouse
gaagagccagtcagccggtg

SEQ ID NO: 562730 - DNA, 20 bp, mouse
gaaaggctcccggcgggtag

SEQ ID NO: 562731 - DNA, 20 bp, mouse
gaggcgggtggtccgatccc

SEQ ID NO: 562732 - DNA, 20 bp, mouse
gcggcccgagacccgcctgc

SEQ ID NO: 562733 - DNA, 20 bp, mouse
gctcgtccacaggcccgagc

SEQ ID NO: 562734 - DNA, 20 bp, mouse
gcagacacaaaggctcccgg

SEQ ID NO: 562735 - DNA, 20 bp, mouse
gagctcgggactcggcaggg

SEQ ID NO: 562736 - DNA, 20 bp, mouse
gctctccgtgtggagcacga

SEQ ID NO: 562737 - DNA, 20 bp, mouse
gccgtgtggagcacgaggga

SEQ ID NO: 562738 - DNA, 20 bp, mouse
gaatcgaagattgaaggcta

SEQ ID NO: 562739 - DNA, 20 bp, mouse
gttcaggaatcgaagattga

SEQ ID NO: 562740 - DNA, 20 bp, mouse
gtagttctgttctctccgtg

SEQ ID NO: 562741 - DNA, 20 bp, mouse
gctcttgtgtgtagagttag

SEQ ID NO: 562742 - DNA, 20 bp, mouse
gatatagaactggagagttc

SEQ ID NO: 562743 - DNA, 20 bp, mouse
gaggccatacagggagtacc

SEQ ID NO: 562744 - DNA, 20 bp, mouse
ggtacctggtactccctgta

SEQ ID NO: 562745 - DNA, 20 bp, mouse
gtggggagaggggactagtc

SEQ ID NO: 562746 - DNA, 20 bp, mouse
gagatggaactccttgacaa

SEQ ID NO: 562747 - DNA, 20 bp, mouse
ggcatgaggagcctttgtca

SEQ ID NO: 562748 - DNA, 20 bp, mouse
gcaataaatattacctaaga

SEQ ID NO: 562749 - DNA, 20 bp, mouse
gctcagagatgtctgaaagg

SEQ ID NO: 562750 - DNA, 20 bp, mouse
gctttcctagagcattcttt

SEQ ID NO: 562751 - DNA, 20 bp, mouse
ggtctttgaagacaagatgg

SEQ ID NO: 562752 - DNA, 20 bp, mouse
gcaaagagtagcatccccaa

SEQ ID NO: 562753 - DNA, 20 bp, mouse
gtgtggaatggtctttatgg

SEQ ID NO: 562754 - DNA, 20 bp, mouse
ggaactaaatgtagaaaata

SEQ ID NO: 562755 - DNA, 20 bp, mouse
gtctgagaggtatttgaata

SEQ ID NO: 562756 - DNA, 20 bp, mouse
gagccatagagacccccatc

SEQ ID NO: 562757 - DNA, 20 bp, mouse
gtgccggatgggggtctcta

SEQ ID NO: 562758 - DNA, 20 bp, mouse
gcgggaagtctgccggatgg

SEQ ID NO: 562759 - DNA, 20 bp, mouse
ggcaacatcacagctctgta

SEQ ID NO: 562760 - DNA, 20 bp, mouse
gcaagacagcaagataaacc

SEQ ID NO: 562761 - DNA, 20 bp, mouse
gtctatggctttagaggtcc

SEQ ID NO: 562762 - DNA, 20 bp, mouse
ggttcgggaagtctgccgga

SEQ ID NO: 562763 - DNA, 20 bp, mouse
gtgctgttcgggaagtctgc

SEQ ID NO: 562764 - DNA, 20 bp, mouse
gggggtctctatggctttag

SEQ ID NO: 562765 - DNA, 20 bp, mouse
gcttgtgcttgggacattga

SEQ ID NO: 562766 - DNA, 20 bp, mouse
gcaaccccagaccacaggac

SEQ ID NO: 562767 - DNA, 20 bp, mouse
gcttacagttcaaaagggtt

SEQ ID NO: 562768 - DNA, 20 bp, mouse
ggaaccggtcctgtggtctg

SEQ ID NO: 562769 - DNA, 20 bp, mouse
gaaatacttacagttcaaaa

SEQ ID NO: 562770 - DNA, 20 bp, mouse
gttgggcagaaccggtcctg

SEQ ID NO: 562771 - DNA, 20 bp, mouse
gagactcaaccccagaccac

SEQ ID NO: 562772 - DNA, 20 bp, mouse
gatagagagactccgaggaa

SEQ ID NO: 562773 - DNA, 20 bp, mouse
gagtggaactcagcaattag

SEQ ID NO: 562774 - DNA, 20 bp, mouse
ggagagactccgaggaaagg

SEQ ID NO: 562775 - DNA, 20 bp, mouse
gctccccgaaagcaagcagt

SEQ ID NO: 562776 - DNA, 20 bp, mouse
gcacacagtaagggaggagt

SEQ ID NO: 562777 - DNA, 20 bp, mouse
gctcgcatcgaagatggctc

SEQ ID NO: 562778 - DNA, 20 bp, mouse
ggcctgaagctgctctggga

SEQ ID NO: 562779 - DNA, 20 bp, mouse
gtgagacctcgcatcgaaga

SEQ ID NO: 562780 - DNA, 20 bp, mouse
ggagtctgtgagtacgggga

SEQ ID NO: 562781 - DNA, 20 bp, mouse
ggttgagtcacgataactgt

SEQ ID NO: 562782 - DNA, 20 bp, mouse
gctgcggagtctgtgagtac

SEQ ID NO: 562783 - DNA, 20 bp, mouse
gactttccacacagtaaggg

SEQ ID NO: 562784 - DNA, 20 bp, mouse
ggatgggtatatcaattata

SEQ ID NO: 562785 - DNA, 20 bp, mouse
gtacagactcctgagaatct

SEQ ID NO: 562786 - DNA, 20 bp, mouse
gtggtctccttattgtccaa

SEQ ID NO: 562787 - DNA, 20 bp, mouse
gtcctttcccttggacaata

SEQ ID NO: 562788 - DNA, 20 bp, mouse
gttgaatctgagtttcaagt

SEQ ID NO: 562789 - DNA, 20 bp, mouse
gtccaagggaaaggatagcc

SEQ ID NO: 562790 - DNA, 20 bp, mouse
gtccttattgtccaagggaa

SEQ ID NO: 562791 - DNA, 20 bp, mouse
gttaaaggcatgcttccctt

SEQ ID NO: 562792 - DNA, 20 bp, mouse
gaactcagattcaaaccaaa

SEQ ID NO: 562793 - DNA, 20 bp, mouse
gctcaggttccagaacacca

SEQ ID NO: 562794 - DNA, 20 bp, mouse
gttaatctcgaacttgaggt

SEQ ID NO: 562795 - DNA, 20 bp, mouse
ggtcaggtgactgtccaccc

SEQ ID NO: 562796 - DNA, 20 bp, mouse
ggcccgggatcccatcccaa

SEQ ID NO: 562797 - DNA, 20 bp, mouse
ggcctttgggatgggatccc

SEQ ID NO: 562798 - DNA, 20 bp, mouse
gacggtggggcttctagagg

SEQ ID NO: 562799 - DNA, 20 bp, mouse
gggcacggtggggcttctag

SEQ ID NO: 562800 - DNA, 20 bp, mouse
ggccttcttgcagggcacgg

SEQ ID NO: 562801 - DNA, 20 bp, mouse
gcccaccgtgccctgcaaga

SEQ ID NO: 562802 - DNA, 20 bp, mouse
gctgcaagaaggcgcagccc

SEQ ID NO: 562803 - DNA, 20 bp, mouse
gtcccagggacacccccgga

SEQ ID NO: 562804 - DNA, 20 bp, mouse
gccgagccaaaattcctggg

SEQ ID NO: 562805 - DNA, 20 bp, mouse
ggagctgttgcctttgggat

SEQ ID NO: 562806 - DNA, 20 bp, mouse
ggcccgggatcccatcccaa

SEQ ID NO: 562807 - DNA, 20 bp, mouse
ggcctttgggatgggatccc

SEQ ID NO: 562808 - DNA, 20 bp, mouse
gacggtggggcttctagagg

SEQ ID NO: 562809 - DNA, 20 bp, mouse
gggcacggtggggcttctag

SEQ ID NO: 562810 - DNA, 20 bp, mouse
ggccttcttgcagggcacgg

SEQ ID NO: 562811 - DNA, 20 bp, mouse
gcccaccgtgccctgcaaga

SEQ ID NO: 562812 - DNA, 20 bp, mouse
gctgcaagaaggcgcagccc

SEQ ID NO: 562813 - DNA, 20 bp, mouse
gtcccagggacacccccgga

SEQ ID NO: 562814 - DNA, 20 bp, mouse
gccgagccaaaattcctggg

SEQ ID NO: 562815 - DNA, 20 bp, mouse
ggagctgttgcctttgggat

SEQ ID NO: 562816 - DNA, 20 bp, mouse
gggcagcgcatacactacaa

SEQ ID NO: 562817 - DNA, 20 bp, mouse
ggctgctggaaagaggcgta

SEQ ID NO: 562818 - DNA, 20 bp, mouse
gtttagcgggaggaatatca

SEQ ID NO: 562819 - DNA, 20 bp, mouse
gacccccggagaactcaccg

SEQ ID NO: 562820 - DNA, 20 bp, mouse
gtatttcgggctggacgcgg

SEQ ID NO: 562821 - DNA, 20 bp, mouse
gattatgggactagccgagg

SEQ ID NO: 562822 - DNA, 20 bp, mouse
gacccgaaggtgaggtcggt

SEQ ID NO: 562823 - DNA, 20 bp, mouse
gtccgcggtgagttctccgg

SEQ ID NO: 562824 - DNA, 20 bp, mouse
gcatacactacaatggctgc

SEQ ID NO: 562825 - DNA, 20 bp, mouse
gtccgcgggcggtgtaaagg

SEQ ID NO: 562826 - DNA, 20 bp, mouse
gggcaggcgggagaacgctc

SEQ ID NO: 562827 - DNA, 20 bp, mouse
gggctcgcggctatcgggac

SEQ ID NO: 562828 - DNA, 20 bp, mouse
gcctgccaggcgagtgaggt

SEQ ID NO: 562829 - DNA, 20 bp, mouse
ggcggcaacccatcccgtcg

SEQ ID NO: 562830 - DNA, 20 bp, mouse
ggcctgagtccggctagggt

SEQ ID NO: 562831 - DNA, 20 bp, mouse
gcaccgggctcgcggctatc

SEQ ID NO: 562832 - DNA, 20 bp, mouse
gcgacgcctgagtccggcta

SEQ ID NO: 562833 - DNA, 20 bp, mouse
gcgaagggcccgggaccccg

SEQ ID NO: 562834 - DNA, 20 bp, mouse
gagccgtgccgcgacgggat

SEQ ID NO: 562835 - DNA, 20 bp, mouse
gagttgcggccgcgggcacc

SEQ ID NO: 562836 - DNA, 20 bp, mouse
gcccgctcaggccccggtag

SEQ ID NO: 562837 - DNA, 20 bp, mouse
ggctcaggccccggtagtgg

SEQ ID NO: 562838 - DNA, 20 bp, mouse
gcggcggtcgggccattgtg

SEQ ID NO: 562839 - DNA, 20 bp, mouse
gaaagggggcccctactcag

SEQ ID NO: 562840 - DNA, 20 bp, mouse
gccgaccgccgccactaccg

SEQ ID NO: 562841 - DNA, 20 bp, mouse
gggcccggctagagcaaagg

SEQ ID NO: 562842 - DNA, 20 bp, mouse
gtccagactaggggaccctc

SEQ ID NO: 562843 - DNA, 20 bp, mouse
gtcactacggggcctatcgg

SEQ ID NO: 562844 - DNA, 20 bp, mouse
ggcctggcggagcccgagcg

SEQ ID NO: 562845 - DNA, 20 bp, mouse
gacacgcccggctctcggag

SEQ ID NO: 562846 - DNA, 20 bp, mouse
ggagaggcccctgcaagagt

SEQ ID NO: 562847 - DNA, 20 bp, mouse
gagagtcagctgttagatac

SEQ ID NO: 562848 - DNA, 20 bp, mouse
gaatgaccctgggtaagctg

SEQ ID NO: 562849 - DNA, 20 bp, mouse
gggaccagccagcatcatcc

SEQ ID NO: 562850 - DNA, 20 bp, mouse
gtctcacctcagcttaccca

SEQ ID NO: 562851 - DNA, 20 bp, mouse
gctgggcagcatgattaact

SEQ ID NO: 562852 - DNA, 20 bp, mouse
gctgagaagccagagttgta

SEQ ID NO: 562853 - DNA, 20 bp, mouse
ggaaggtagccatacaactc

SEQ ID NO: 562854 - DNA, 20 bp, mouse
gcttctttcccactcttgca

SEQ ID NO: 562855 - DNA, 20 bp, mouse
gccagtgaagggatgcttaa

SEQ ID NO: 562856 - DNA, 20 bp, mouse
gaccggtgactgcagcggaa

SEQ ID NO: 562857 - DNA, 20 bp, mouse
gcactcaccggtgactgcag

SEQ ID NO: 562858 - DNA, 20 bp, mouse
ggcccttccgctgcagtcac

SEQ ID NO: 562859 - DNA, 20 bp, mouse
gctggcagacacgcaaggac

SEQ ID NO: 562860 - DNA, 20 bp, mouse
ggggcgctggcagacacgca

SEQ ID NO: 562861 - DNA, 20 bp, mouse
ggactgcagcggaagggcgc

SEQ ID NO: 562862 - DNA, 20 bp, mouse
gggattcagagcccgcagag

SEQ ID NO: 562863 - DNA, 20 bp, mouse
gtagcgggatgaggcagcca

SEQ ID NO: 562864 - DNA, 20 bp, mouse
gactgctgtctagagcccag

SEQ ID NO: 562865 - DNA, 20 bp, mouse
gaagcggagcagcttgaagg

SEQ ID NO: 562866 - DNA, 20 bp, mouse
gaggtgaaggaagaacccat

SEQ ID NO: 562867 - DNA, 20 bp, mouse
gacccatgggactcccaagg

SEQ ID NO: 562868 - DNA, 20 bp, mouse
ggccgccttgggagtcccat

SEQ ID NO: 562869 - DNA, 20 bp, mouse
gagaacccatgggactccca

SEQ ID NO: 562870 - DNA, 20 bp, mouse
gcaccacgcagctcttacct

SEQ ID NO: 562871 - DNA, 20 bp, mouse
gcagctcttacctgggacac

SEQ ID NO: 562872 - DNA, 20 bp, mouse
gctgctctagactgaccgag

SEQ ID NO: 562873 - DNA, 20 bp, mouse
gtgccaggcactgtgcacca

SEQ ID NO: 562874 - DNA, 20 bp, mouse
gggcacactggaggacgcgg

SEQ ID NO: 562875 - DNA, 20 bp, mouse
gaccgggcgtgagctagagg

SEQ ID NO: 562876 - DNA, 20 bp, mouse
gtcccaccggggacacacct

SEQ ID NO: 562877 - DNA, 20 bp, mouse
gagcagcagcagtcccaccg

SEQ ID NO: 562878 - DNA, 20 bp, mouse
gcacctacaacactgaggga

SEQ ID NO: 562879 - DNA, 20 bp, mouse
ggaggtaactcagccatctg

SEQ ID NO: 562880 - DNA, 20 bp, mouse
gacccaggtgtgtccccggt

SEQ ID NO: 562881 - DNA, 20 bp, mouse
gccagacacctacaacactg

SEQ ID NO: 562882 - DNA, 20 bp, mouse
gctgtacccaggtgtgtccc

SEQ ID NO: 562883 - DNA, 20 bp, mouse
gttgcctcttgtgggatggg

SEQ ID NO: 562884 - DNA, 20 bp, mouse
gtaactctcaactgttctat

SEQ ID NO: 562885 - DNA, 20 bp, mouse
gtgctgctactgctgggaca

SEQ ID NO: 562886 - DNA, 20 bp, mouse
gaaccaggccgaggtcacag

SEQ ID NO: 562887 - DNA, 20 bp, mouse
gcagcgccagccgcccaggg

SEQ ID NO: 562888 - DNA, 20 bp, mouse
ggcagggcgctgcgttgcag

SEQ ID NO: 562889 - DNA, 20 bp, mouse
gctgctgcagcctccctggg

SEQ ID NO: 562890 - DNA, 20 bp, mouse
gcaagagccgcacttgagga

SEQ ID NO: 562891 - DNA, 20 bp, mouse
gcagccctgaggtggatcag

SEQ ID NO: 562892 - DNA, 20 bp, mouse
gccacgtgaagcgcccaagc

SEQ ID NO: 562893 - DNA, 20 bp, mouse
ggcgctgcgttgcagaggcc

SEQ ID NO: 562894 - DNA, 20 bp, mouse
gctgctaccatcctcaagtg

SEQ ID NO: 562895 - DNA, 20 bp, mouse
gtggcagcgccagccgccca

SEQ ID NO: 562896 - DNA, 20 bp, mouse
gccggagctcccatccacgg

SEQ ID NO: 562897 - DNA, 20 bp, mouse
gcagtcacgtggcccggctg

SEQ ID NO: 562898 - DNA, 20 bp, mouse
ggcccggctgcggctcgcga

SEQ ID NO: 562899 - DNA, 20 bp, mouse
ggatggcggcccccgtggat

SEQ ID NO: 562900 - DNA, 20 bp, mouse
ggatgggagctccggcggct

SEQ ID NO: 562901 - DNA, 20 bp, mouse
gggcgtccagcagcagcgag

SEQ ID NO: 562902 - DNA, 20 bp, mouse
gcggctgcggctcgcgatgg

SEQ ID NO: 562903 - DNA, 20 bp, mouse
gccctcgggacgcagtcacg

SEQ ID NO: 562904 - DNA, 20 bp, mouse
gagcaaggccagtgtggtca

SEQ ID NO: 562905 - DNA, 20 bp, mouse
gagtgcccgccgtagcgccc

SEQ ID NO: 562906 - DNA, 20 bp, mouse
gtgaatggtgcgcttccagg

SEQ ID NO: 562907 - DNA, 20 bp, mouse
ggccgagcaggatccagcgg

SEQ ID NO: 562908 - DNA, 20 bp, mouse
gatggtgcgcttccaggcgg

SEQ ID NO: 562909 - DNA, 20 bp, mouse
gtgtagagcctcgggagacg

SEQ ID NO: 562910 - DNA, 20 bp, mouse
gagagcctcgggagacgcgg

SEQ ID NO: 562911 - DNA, 20 bp, mouse
ggcggcgcgggccagaggtg

SEQ ID NO: 562912 - DNA, 20 bp, mouse
gtaagcgggacgacacgcga

SEQ ID NO: 562913 - DNA, 20 bp, mouse
gtgtccgacagcctcaagaa

SEQ ID NO: 562914 - DNA, 20 bp, mouse
gggctgtcggacacgcacac

SEQ ID NO: 562915 - DNA, 20 bp, mouse
ggcccgcgccgcttagtaag

SEQ ID NO: 562916 - DNA, 20 bp, mouse
ggttgggcaaacctctccag

SEQ ID NO: 562917 - DNA, 20 bp, mouse
gcaagtgtccctctttggag

SEQ ID NO: 562918 - DNA, 20 bp, mouse
ggttagggggcaatagaaca

SEQ ID NO: 562919 - DNA, 20 bp, mouse
ggatgtcaagtgtccctctt

SEQ ID NO: 562920 - DNA, 20 bp, mouse
gccccggcttcaggaggagg

SEQ ID NO: 562921 - DNA, 20 bp, mouse
gccagcccccgggacggtgg

SEQ ID NO: 562922 - DNA, 20 bp, mouse
gaggaggaggctgatttaca

SEQ ID NO: 562923 - DNA, 20 bp, mouse
gccagcccccaccgtcccgg

SEQ ID NO: 562924 - DNA, 20 bp, mouse
gtgcccaacctctccaaaga

SEQ ID NO: 562925 - DNA, 20 bp, mouse
gtgggagctttgcagaacgg

SEQ ID NO: 562926 - DNA, 20 bp, mouse
ggagccccgacgggaaccga

SEQ ID NO: 562927 - DNA, 20 bp, mouse
gggacctacggagccccgac

SEQ ID NO: 562928 - DNA, 20 bp, mouse
ggacgccgcggggccagagc

SEQ ID NO: 562929 - DNA, 20 bp, mouse
ggagagagcagtggcaccgt

SEQ ID NO: 562930 - DNA, 20 bp, mouse
gtgggacgaggtaagtgagt

SEQ ID NO: 562931 - DNA, 20 bp, mouse
gcggtccgtccgggacagac

SEQ ID NO: 562932 - DNA, 20 bp, mouse
gctggagccgcccaccgtgg

SEQ ID NO: 562933 - DNA, 20 bp, mouse
gccgagtctccggtccgtcc

SEQ ID NO: 562934 - DNA, 20 bp, mouse
gggggcggctcggggaccta

SEQ ID NO: 562935 - DNA, 20 bp, mouse
ggcagggtctccaccacggt

SEQ ID NO: 562936 - DNA, 20 bp, mouse
gaggtactcaccaggcagct

SEQ ID NO: 562937 - DNA, 20 bp, mouse
gtacaaggtaggtactcacc

SEQ ID NO: 562938 - DNA, 20 bp, mouse
ggactgtgcaggatttgatc

SEQ ID NO: 562939 - DNA, 20 bp, mouse
gcgagtgagaggctagtggc

SEQ ID NO: 562940 - DNA, 20 bp, mouse
gtacctggcatcactcccac

SEQ ID NO: 562941 - DNA, 20 bp, mouse
gggggggggcgttacaaggt

SEQ ID NO: 562942 - DNA, 20 bp, mouse
gtagattcccccacccgggg

SEQ ID NO: 562943 - DNA, 20 bp, mouse
gaacacgagtgagaggctag

SEQ ID NO: 562944 - DNA, 20 bp, mouse
gctgcccatccacaaggata

SEQ ID NO: 562945 - DNA, 20 bp, mouse
gctgccttatccttgtggat

SEQ ID NO: 562946 - DNA, 20 bp, mouse
gctgtgtcgagaatcctccc

SEQ ID NO: 562947 - DNA, 20 bp, mouse
gtgcgtgctgtcaactacct

SEQ ID NO: 562948 - DNA, 20 bp, mouse
gtcgcaaaggccccgtaatg

SEQ ID NO: 562949 - DNA, 20 bp, mouse
ggattctcgacacagcagcc

SEQ ID NO: 562950 - DNA, 20 bp, mouse
gcagagcagaaggacattac

SEQ ID NO: 562951 - DNA, 20 bp, mouse
gtatctttaaagactcaccc

SEQ ID NO: 562952 - DNA, 20 bp, mouse
gcagtggggcatgaacaagg

SEQ ID NO: 562953 - DNA, 20 bp, mouse
gtagtatcagacgaagtcaa

SEQ ID NO: 562954 - DNA, 20 bp, mouse
gagtcaaaggctacaaggaa

SEQ ID NO: 562955 - DNA, 20 bp, mouse
ggccccaacaagggtcttgt

SEQ ID NO: 562956 - DNA, 20 bp, mouse
gcggactgcgcaaggacccc

SEQ ID NO: 562957 - DNA, 20 bp, mouse
gttcagttgggtccctgcac

SEQ ID NO: 562958 - DNA, 20 bp, mouse
gccacaaggggacaaggagt

SEQ ID NO: 562959 - DNA, 20 bp, mouse
ggtgagtgtcccgaacgtag

SEQ ID NO: 562960 - DNA, 20 bp, mouse
gaaggtcaggaagtcccgac

SEQ ID NO: 562961 - DNA, 20 bp, mouse
gaagccgaaatacacccggg

SEQ ID NO: 562962 - DNA, 20 bp, mouse
gcccgagccccggccagggt

SEQ ID NO: 562963 - DNA, 20 bp, mouse
ggacccaactgaactgagat

SEQ ID NO: 562964 - DNA, 20 bp, mouse
gccgcgctggacacaacctt

SEQ ID NO: 562965 - DNA, 20 bp, mouse
gtcccgaccggagtccatgc

SEQ ID NO: 562966 - DNA, 20 bp, mouse
gggatctgtgcgtgagaacc

SEQ ID NO: 562967 - DNA, 20 bp, mouse
ggtcaggaggaggagacctc

SEQ ID NO: 562968 - DNA, 20 bp, mouse
ggcaacgggaacacagcccg

SEQ ID NO: 562969 - DNA, 20 bp, mouse
gccggagctaagaaacttag

SEQ ID NO: 562970 - DNA, 20 bp, mouse
gcacagcccgcggcgcggtc

SEQ ID NO: 562971 - DNA, 20 bp, mouse
ggtgcgtgagaaccgggcaa

SEQ ID NO: 562972 - DNA, 20 bp, mouse
gaggaggaggagacctcggg

SEQ ID NO: 562973 - DNA, 20 bp, mouse
gcgcacagcatggtctcgaa

SEQ ID NO: 562974 - DNA, 20 bp, mouse
ggggaacacagcccgcggcg

SEQ ID NO: 562975 - DNA, 20 bp, mouse
gtacgggcactgaagaagat

SEQ ID NO: 562976 - DNA, 20 bp, mouse
gagcagcaaactgcagtgga

SEQ ID NO: 562977 - DNA, 20 bp, mouse
gagcaaactgcagtggaggg

SEQ ID NO: 562978 - DNA, 20 bp, mouse
gtggaagcagtcaagtgcaa

SEQ ID NO: 562979 - DNA, 20 bp, mouse
gttctcagcggagagcactg

SEQ ID NO: 562980 - DNA, 20 bp, mouse
gagctcagggcccttaccgt

SEQ ID NO: 562981 - DNA, 20 bp, mouse
gttctgtgtagcctcagggt

SEQ ID NO: 562982 - DNA, 20 bp, mouse
gggagttctgtgtagcctca

SEQ ID NO: 562983 - DNA, 20 bp, mouse
gacctgtattaggttaaact

SEQ ID NO: 562984 - DNA, 20 bp, mouse
ggcatctgtagagctgagtt

SEQ ID NO: 562985 - DNA, 20 bp, mouse
ggtagcctcagggtgggaaa

SEQ ID NO: 562986 - DNA, 20 bp, mouse
gggacatgatcgccagggaa

SEQ ID NO: 562987 - DNA, 20 bp, mouse
ggtagctgaatgaacgacag

SEQ ID NO: 562988 - DNA, 20 bp, mouse
gtgtctggacatgatcgcca

SEQ ID NO: 562989 - DNA, 20 bp, mouse
gacagtggtcaagatgacgt

SEQ ID NO: 562990 - DNA, 20 bp, mouse
gccctcctaccatctcacag

SEQ ID NO: 562991 - DNA, 20 bp, mouse
gtgttccactgtgagatggt

SEQ ID NO: 562992 - DNA, 20 bp, mouse
gaagatgacgtcggaagaaa

SEQ ID NO: 562993 - DNA, 20 bp, mouse
ggtggcttctgcccagtcgg

SEQ ID NO: 562994 - DNA, 20 bp, mouse
gcctttgagtcacagggatg

SEQ ID NO: 562995 - DNA, 20 bp, mouse
gtcagatgcggggattcctc

SEQ ID NO: 562996 - DNA, 20 bp, mouse
gacgactggctggagatcta

SEQ ID NO: 562997 - DNA, 20 bp, mouse
gcctcccaggaagacagccg

SEQ ID NO: 562998 - DNA, 20 bp, mouse
gtccccgaggaccgcagatc

SEQ ID NO: 562999 - DNA, 20 bp, mouse
gtccggatctgcggtcctcg

SEQ ID NO: 563000 - DNA, 20 bp, mouse
gctctgtcgcttggtccccg

SEQ ID NO: 563001 - DNA, 20 bp, mouse
ggcccagctctccggatctg

SEQ ID NO: 563002 - DNA, 20 bp, mouse
gtacctggtggcccagccag

SEQ ID NO: 563003 - DNA, 20 bp, mouse
gaccgcagatccggagagct

SEQ ID NO: 563004 - DNA, 20 bp, mouse
gctgccccggctgtcttcct

SEQ ID NO: 563005 - DNA, 20 bp, mouse
gtcccgccccgccgcacgac

SEQ ID NO: 563006 - DNA, 20 bp, mouse
gcgccaccgcgggtgtgagg

SEQ ID NO: 563007 - DNA, 20 bp, mouse
gggaggcgagcgggacccgg

SEQ ID NO: 563008 - DNA, 20 bp, mouse
gcctggcctcctcacacccg

SEQ ID NO: 563009 - DNA, 20 bp, mouse
gacctggcaaggctgccggg

SEQ ID NO: 563010 - DNA, 20 bp, mouse
gcccgccgaacccggttacc

SEQ ID NO: 563011 - DNA, 20 bp, mouse
gggacctggacacctcggtt

SEQ ID NO: 563012 - DNA, 20 bp, mouse
gggcctcctcacacccgcgg

SEQ ID NO: 563013 - DNA, 20 bp, mouse
ggccaggtaaccgggttcgg

SEQ ID NO: 563014 - DNA, 20 bp, mouse
gtggcaaggctgccgggcgg

SEQ ID NO: 563015 - DNA, 20 bp, mouse
ggcagccttgccaggtaacc

SEQ ID NO: 563016 - DNA, 20 bp, mouse
gggactgcccgggccccagg

SEQ ID NO: 563017 - DNA, 20 bp, mouse
gccaggcggctgctgcacga

SEQ ID NO: 563018 - DNA, 20 bp, mouse
gactgcgccggagcccaaga

SEQ ID NO: 563019 - DNA, 20 bp, mouse
gccctgggcctgccagccac

SEQ ID NO: 563020 - DNA, 20 bp, mouse
gcctaagcaagggttcccca

SEQ ID NO: 563021 - DNA, 20 bp, mouse
gcgcctccaaagcagaagta

SEQ ID NO: 563022 - DNA, 20 bp, mouse
gctgccagccacgggttggg

SEQ ID NO: 563023 - DNA, 20 bp, mouse
ggccctgcccgcgccctctt

SEQ ID NO: 563024 - DNA, 20 bp, mouse
gtgtgcggggaccctagagc

SEQ ID NO: 563025 - DNA, 20 bp, mouse
gtcccgcgtaggactctcgg

SEQ ID NO: 563026 - DNA, 20 bp, mouse
ggcctgcattcccacagtag

SEQ ID NO: 563027 - DNA, 20 bp, mouse
gcacgtctcctagtctaagt

SEQ ID NO: 563028 - DNA, 20 bp, mouse
ggcattcccacagtagcggc

SEQ ID NO: 563029 - DNA, 20 bp, mouse
gcgctgtgcctacttagact

SEQ ID NO: 563030 - DNA, 20 bp, mouse
gctctgcctgccgctactgt

SEQ ID NO: 563031 - DNA, 20 bp, mouse
ggatgtcatcatgccatcag

SEQ ID NO: 563032 - DNA, 20 bp, mouse
gctaggagacgtgcatgctt

SEQ ID NO: 563033 - DNA, 20 bp, mouse
gtgcttcgagtgtgcttatc

SEQ ID NO: 563034 - DNA, 20 bp, mouse
gacatctccaaaaggggaga

SEQ ID NO: 563035 - DNA, 20 bp, mouse
gtgatacacatctccaaaag

SEQ ID NO: 563036 - DNA, 20 bp, mouse
gccgcacacagcgcccatac

SEQ ID NO: 563037 - DNA, 20 bp, mouse
gttagccaggaccaaggtaa

SEQ ID NO: 563038 - DNA, 20 bp, mouse
gagagcctgggccccctggt

SEQ ID NO: 563039 - DNA, 20 bp, mouse
ggcaagctttgaaccggtat

SEQ ID NO: 563040 - DNA, 20 bp, mouse
ggaccaaggtaagggcgagt

SEQ ID NO: 563041 - DNA, 20 bp, mouse
gcttgctagcgaagaaagac

SEQ ID NO: 563042 - DNA, 20 bp, mouse
gaaagttgtaacctgatcca

SEQ ID NO: 563043 - DNA, 20 bp, mouse
gaccttgcaggaaggctctg

SEQ ID NO: 563044 - DNA, 20 bp, mouse
gtgcaagatgccagacgggg

SEQ ID NO: 563045 - DNA, 20 bp, mouse
gctcctactcgcccttacct

SEQ ID NO: 563046 - DNA, 20 bp, mouse
gcgaggacatcgcttcgcca

SEQ ID NO: 563047 - DNA, 20 bp, mouse
gcgccgcgggccgccagccc

SEQ ID NO: 563048 - DNA, 20 bp, mouse
gctcgcgcggcgcctccacg

SEQ ID NO: 563049 - DNA, 20 bp, mouse
gagtggcctggctctgactg

SEQ ID NO: 563050 - DNA, 20 bp, mouse
ggacatcgcttcgccagggc

SEQ ID NO: 563051 - DNA, 20 bp, mouse
gctgcgcgcacagtccgccg

SEQ ID NO: 563052 - DNA, 20 bp, mouse
ggactgaggctaaggttccg

SEQ ID NO: 563053 - DNA, 20 bp, mouse
gcgccccgcagaagcacagt

SEQ ID NO: 563054 - DNA, 20 bp, mouse
gcgcggactcgggtggtcag

SEQ ID NO: 563055 - DNA, 20 bp, mouse
gatcgcttcgccagggctgg

SEQ ID NO: 563056 - DNA, 20 bp, mouse
gcccgccgaccgcagcacgg

SEQ ID NO: 563057 - DNA, 20 bp, mouse
gtcacaggcgagcggagtgg

SEQ ID NO: 563058 - DNA, 20 bp, mouse
ggcggccccaggaagtgcgg

SEQ ID NO: 563059 - DNA, 20 bp, mouse
gctgtcacaggcgagcggag

SEQ ID NO: 563060 - DNA, 20 bp, mouse
gtagaaaggagacatcgctc

SEQ ID NO: 563061 - DNA, 20 bp, mouse
gcccgccgccgcacttcctg

SEQ ID NO: 563062 - DNA, 20 bp, mouse
gcggagcggcgactgcggat

SEQ ID NO: 563063 - DNA, 20 bp, mouse
gctgcccgccgaccgcagca

SEQ ID NO: 563064 - DNA, 20 bp, mouse
gctgtggtccaggaggtcag

SEQ ID NO: 563065 - DNA, 20 bp, mouse
gcgcgccacggccgctgcag

SEQ ID NO: 563066 - DNA, 20 bp, mouse
gcctagggccgggctcgggg

SEQ ID NO: 563067 - DNA, 20 bp, mouse
gggtcgtggggcgcccatgg

SEQ ID NO: 563068 - DNA, 20 bp, mouse
gcccggccacactccgccat

SEQ ID NO: 563069 - DNA, 20 bp, mouse
gacagcggcggggtttccaa

SEQ ID NO: 563070 - DNA, 20 bp, mouse
gggcgggcgcgctatgacag

SEQ ID NO: 563071 - DNA, 20 bp, mouse
ggccctggcaggggacctct

SEQ ID NO: 563072 - DNA, 20 bp, mouse
ggcctagaggtcccctgcca

SEQ ID NO: 563073 - DNA, 20 bp, mouse
gtttgtgcaggcgggtcgtg

SEQ ID NO: 563074 - DNA, 20 bp, mouse
gggccggggcgccgcaggag

SEQ ID NO: 563075 - DNA, 20 bp, mouse
gctgtccctggggaccggac

SEQ ID NO: 563076 - DNA, 20 bp, mouse
gtcacgtgagacggaggagg

SEQ ID NO: 563077 - DNA, 20 bp, mouse
gtgttcacgtgagacggagg

SEQ ID NO: 563078 - DNA, 20 bp, mouse
ggggtgttcacgtgagacgg

SEQ ID NO: 563079 - DNA, 20 bp, mouse
gagtgggacagcgtggactt

SEQ ID NO: 563080 - DNA, 20 bp, mouse
gcgcgggtgttcacgtgaga

SEQ ID NO: 563081 - DNA, 20 bp, mouse
gcccagggtcacggaggtgg

SEQ ID NO: 563082 - DNA, 20 bp, mouse
gcgggccacagactcgctag

SEQ ID NO: 563083 - DNA, 20 bp, mouse
gtgcggtcccggcaccccgc

SEQ ID NO: 563084 - DNA, 20 bp, mouse
gagtcactgacctgcggtcc

SEQ ID NO: 563085 - DNA, 20 bp, mouse
gactcgctagtgggacagcg

SEQ ID NO: 563086 - DNA, 20 bp, mouse
gaccagcccggggaaaccca

SEQ ID NO: 563087 - DNA, 20 bp, mouse
ggtgtgagtagctccgggtg

SEQ ID NO: 563088 - DNA, 20 bp, mouse
gtggcaaggcgaagagggtg

SEQ ID NO: 563089 - DNA, 20 bp, mouse
gagttcccctctggagacgg

SEQ ID NO: 563090 - DNA, 20 bp, mouse
ggcacgtctctatgccctgt

SEQ ID NO: 563091 - DNA, 20 bp, mouse
ggcctcccccgtctccagag

SEQ ID NO: 563092 - DNA, 20 bp, mouse
gccggagctactcacacgac

SEQ ID NO: 563093 - DNA, 20 bp, mouse
gcagggactgaggagattaa

SEQ ID NO: 563094 - DNA, 20 bp, mouse
gttaaaggagtggatctcag

SEQ ID NO: 563095 - DNA, 20 bp, mouse
gaagagtaaccggcagcccc

SEQ ID NO: 563096 - DNA, 20 bp, mouse
gcgctagtcgccacactcct

SEQ ID NO: 563097 - DNA, 20 bp, mouse
gcagcctgtgcctaggagtg

SEQ ID NO: 563098 - DNA, 20 bp, mouse
gtcgccacactcctaggcac

SEQ ID NO: 563099 - DNA, 20 bp, mouse
gagcgcggcggcaagcagac

SEQ ID NO: 563100 - DNA, 20 bp, mouse
ggcggggccgaagcaaacat

SEQ ID NO: 563101 - DNA, 20 bp, mouse
gagtgtggcgactagcgcgg

SEQ ID NO: 563102 - DNA, 20 bp, mouse
gcaccatggcctcatctcag

SEQ ID NO: 563103 - DNA, 20 bp, mouse
ggggcagtgggcacctacct

SEQ ID NO: 563104 - DNA, 20 bp, mouse
ggaagcaaacattggcttaa

SEQ ID NO: 563105 - DNA, 20 bp, mouse
gggcaagcagaccggcacca

SEQ ID NO: 563106 - DNA, 20 bp, mouse
gtgatagtaacctgacagtg

SEQ ID NO: 563107 - DNA, 20 bp, mouse
gaatagctgccccaccctgg

SEQ ID NO: 563108 - DNA, 20 bp, mouse
gagctgaactccacactgtc

SEQ ID NO: 563109 - DNA, 20 bp, mouse
gggtggggcagctattctaa

SEQ ID NO: 563110 - DNA, 20 bp, mouse
ggctattctaagggcctgag

SEQ ID NO: 563111 - DNA, 20 bp, mouse
gaatgtttacccccagggtg

SEQ ID NO: 563112 - DNA, 20 bp, mouse
gacgtgtgcactgagatcag

SEQ ID NO: 563113 - DNA, 20 bp, mouse
gaagctgagtccaaacccca

SEQ ID NO: 563114 - DNA, 20 bp, mouse
gtgagggttagaaacaaaat

SEQ ID NO: 563115 - DNA, 20 bp, mouse
gggtctcttcaactgtcata

SEQ ID NO: 563116 - DNA, 20 bp, mouse
gctgtttatgtggatttgta

SEQ ID NO: 563117 - DNA, 20 bp, mouse
ggctttggcaggctccctaa

SEQ ID NO: 563118 - DNA, 20 bp, mouse
ggcagttgaaagtcgagggg

SEQ ID NO: 563119 - DNA, 20 bp, mouse
gtggagtgtcagctaggaga

SEQ ID NO: 563120 - DNA, 20 bp, mouse
gcaaagcagttgaaagtcga

SEQ ID NO: 563121 - DNA, 20 bp, mouse
gacggcttcccctgtttatg

SEQ ID NO: 563122 - DNA, 20 bp, mouse
ggggagttggagtgtcagct

SEQ ID NO: 563123 - DNA, 20 bp, mouse
ggtgtcctcccagtatggct

SEQ ID NO: 563124 - DNA, 20 bp, mouse
ggatcctgcggggctgggga

SEQ ID NO: 563125 - DNA, 20 bp, mouse
gagttctgcctagccatact

SEQ ID NO: 563126 - DNA, 20 bp, mouse
gggcgcgggcacacactctg

SEQ ID NO: 563127 - DNA, 20 bp, mouse
ggcgggcacacactctgcgg

SEQ ID NO: 563128 - DNA, 20 bp, mouse
gagctggggccgcggaagaa

SEQ ID NO: 563129 - DNA, 20 bp, mouse
gagaccggccgagttccggg

SEQ ID NO: 563130 - DNA, 20 bp, mouse
gggcacacactctgcggcgg

SEQ ID NO: 563131 - DNA, 20 bp, mouse
gtgcggcggcggcgacttcg

SEQ ID NO: 563132 - DNA, 20 bp, mouse
gtggggccgcggaagaaggg

SEQ ID NO: 563133 - DNA, 20 bp, mouse
gggttcccaagggaacttca

SEQ ID NO: 563134 - DNA, 20 bp, mouse
gagcgcccgcccttcttccg

SEQ ID NO: 563135 - DNA, 20 bp, mouse
gcccgggacccgaggaggtg

SEQ ID NO: 563136 - DNA, 20 bp, mouse
gtagccagcaggtgccccga

SEQ ID NO: 563137 - DNA, 20 bp, mouse
gcccgtgcgggttcgcaagc

SEQ ID NO: 563138 - DNA, 20 bp, mouse
ggcaccctggatgcggaccc

SEQ ID NO: 563139 - DNA, 20 bp, mouse
ggcgccggggtccgcatcca

SEQ ID NO: 563140 - DNA, 20 bp, mouse
ggctcgaagtcaggtcagac

SEQ ID NO: 563141 - DNA, 20 bp, mouse
gggcccccgcaccctggatg

SEQ ID NO: 563142 - DNA, 20 bp, mouse
gtggctggaagcaagggtcc

SEQ ID NO: 563143 - DNA, 20 bp, mouse
gtcagactggctggaagcaa

SEQ ID NO: 563144 - DNA, 20 bp, mouse
gcctctggggtgtaggctcc

SEQ ID NO: 563145 - DNA, 20 bp, mouse
ggagtgggcggcctccggag

SEQ ID NO: 563146 - DNA, 20 bp, mouse
gaccggccttactcagacgt

SEQ ID NO: 563147 - DNA, 20 bp, mouse
ggttggctgctacttcggtg

SEQ ID NO: 563148 - DNA, 20 bp, mouse
gagcagccaacgtctgagta

SEQ ID NO: 563149 - DNA, 20 bp, mouse
gccacaccctaaaacaacac

SEQ ID NO: 563150 - DNA, 20 bp, mouse
gcagacgttggctgctactt

SEQ ID NO: 563151 - DNA, 20 bp, mouse
gctgtctgagcagctgagta

SEQ ID NO: 563152 - DNA, 20 bp, mouse
ggccaacgtctgagtaaggc

SEQ ID NO: 563153 - DNA, 20 bp, mouse
gcagtgggcgtgatccgtgg

SEQ ID NO: 563154 - DNA, 20 bp, mouse
gagtaggggcgggacctcca

SEQ ID NO: 563155 - DNA, 20 bp, mouse
gcaggtaggtacctgggact

SEQ ID NO: 563156 - DNA, 20 bp, mouse
gcgagagggtgacacaggga

SEQ ID NO: 563157 - DNA, 20 bp, mouse
gggaaggcggggctaggttc

SEQ ID NO: 563158 - DNA, 20 bp, mouse
gactgcgcctgcgcacaggt

SEQ ID NO: 563159 - DNA, 20 bp, mouse
gtgcgcacaggtgggcggga

SEQ ID NO: 563160 - DNA, 20 bp, mouse
gggcgatgtgagagaggtca

SEQ ID NO: 563161 - DNA, 20 bp, mouse
gtagacgagagggtgacaca

SEQ ID NO: 563162 - DNA, 20 bp, mouse
ggtgcaggtactgtgcgatc

SEQ ID NO: 563163 - DNA, 20 bp, mouse
ggatctggtgcgcgacacct

SEQ ID NO: 563164 - DNA, 20 bp, mouse
ggtagaagactctgacgtgc

SEQ ID NO: 563165 - DNA, 20 bp, mouse
ggtcatggcgtcagaagggg

SEQ ID NO: 563166 - DNA, 20 bp, mouse
gacagtggctggaaccagga

SEQ ID NO: 563167 - DNA, 20 bp, mouse
ggcagacagtggctggaacc

SEQ ID NO: 563168 - DNA, 20 bp, mouse
gctggctaccacttacctct

SEQ ID NO: 563169 - DNA, 20 bp, mouse
gagacagagggcctcaagag

SEQ ID NO: 563170 - DNA, 20 bp, mouse
gccaggctagagccagacag

SEQ ID NO: 563171 - DNA, 20 bp, mouse
gaaagcctgcagacagtggc

SEQ ID NO: 563172 - DNA, 20 bp, mouse
gataggacaaagctgcccag

SEQ ID NO: 563173 - DNA, 20 bp, mouse
ggctactctgaggtcagggt

SEQ ID NO: 563174 - DNA, 20 bp, mouse
ggctagagggaaacactccc

SEQ ID NO: 563175 - DNA, 20 bp, mouse
ggacatctgccagccaatct

SEQ ID NO: 563176 - DNA, 20 bp, mouse
gctcccgctcgggaccgcag

SEQ ID NO: 563177 - DNA, 20 bp, mouse
ggtggatgcctgctcccgag

SEQ ID NO: 563178 - DNA, 20 bp, mouse
gagaagtcagggtgcagcgg

SEQ ID NO: 563179 - DNA, 20 bp, mouse
gctgccgctgcggtcccgag

SEQ ID NO: 563180 - DNA, 20 bp, mouse
gagtcagggtgcagcggagg

SEQ ID NO: 563181 - DNA, 20 bp, mouse
ggcccgggttccagttggtg

SEQ ID NO: 563182 - DNA, 20 bp, mouse
gggtgcggagcagcctcgag

SEQ ID NO: 563183 - DNA, 20 bp, mouse
ggcagcggcaggcgacgtcg

SEQ ID NO: 563184 - DNA, 20 bp, mouse
gctcccgagtggcagaagtc

SEQ ID NO: 563185 - DNA, 20 bp, mouse
ggtgtcgcagggtagaggat

SEQ ID NO: 563186 - DNA, 20 bp, mouse
gctacggctgaccttagagg

SEQ ID NO: 563187 - DNA, 20 bp, mouse
gcccatggccgccacctcta

SEQ ID NO: 563188 - DNA, 20 bp, mouse
gggccatggggcgctcgagt

SEQ ID NO: 563189 - DNA, 20 bp, mouse
ggctgtgggggaggctacac

SEQ ID NO: 563190 - DNA, 20 bp, mouse
gcatggggcgctcgagttgg

SEQ ID NO: 563191 - DNA, 20 bp, mouse
ggcgcaagcgcttggtgcta

SEQ ID NO: 563192 - DNA, 20 bp, mouse
gcggctgaccttagaggtgg

SEQ ID NO: 563193 - DNA, 20 bp, mouse
gggtctcgcgctggccctag

SEQ ID NO: 563194 - DNA, 20 bp, mouse
gggcccgggaggcaaccctg

SEQ ID NO: 563195 - DNA, 20 bp, mouse
gcgggctggagaaggcgaag

SEQ ID NO: 563196 - DNA, 20 bp, mouse
gcgtgcgtgcggtggtacac

SEQ ID NO: 563197 - DNA, 20 bp, mouse
gtacaagttactgtccagag

SEQ ID NO: 563198 - DNA, 20 bp, mouse
ggagcctccgagggcaagaa

SEQ ID NO: 563199 - DNA, 20 bp, mouse
gtgcccgagccggaaggcct

SEQ ID NO: 563200 - DNA, 20 bp, mouse
gcgaggctgcctagactaga

SEQ ID NO: 563201 - DNA, 20 bp, mouse
gggctgccggcccgccgctc

SEQ ID NO: 563202 - DNA, 20 bp, mouse
gctgtgctcagagcctccga

SEQ ID NO: 563203 - DNA, 20 bp, mouse
gggaggctctgagcacagcc

SEQ ID NO: 563204 - DNA, 20 bp, mouse
ggctgggctccgtctagtct

SEQ ID NO: 563205 - DNA, 20 bp, mouse
gccttaagccagggtatcta

SEQ ID NO: 563206 - DNA, 20 bp, mouse
gcgccgcgcaaggccagccc

SEQ ID NO: 563207 - DNA, 20 bp, mouse
gagcagatgggccatgctgg

SEQ ID NO: 563208 - DNA, 20 bp, mouse
ggtcagcagatgggccatgc

SEQ ID NO: 563209 - DNA, 20 bp, mouse
gctcccgacagggcagacag

SEQ ID NO: 563210 - DNA, 20 bp, mouse
gggcgggagaagaacgcaac

SEQ ID NO: 563211 - DNA, 20 bp, mouse
ggggccagacgtcagcagat

SEQ ID NO: 563212 - DNA, 20 bp, mouse
ggcagggaggcgagcgaagt

SEQ ID NO: 563213 - DNA, 20 bp, mouse
gcaggctggctaacctggag

SEQ ID NO: 563214 - DNA, 20 bp, mouse
gtctgttgggacaacggtcg

SEQ ID NO: 563215 - DNA, 20 bp, mouse
gttctcccgcacctcctcgt

SEQ ID NO: 563216 - DNA, 20 bp, mouse
ggcctggtggggagacacac

SEQ ID NO: 563217 - DNA, 20 bp, mouse
ggctcctcagacgacaagag

SEQ ID NO: 563218 - DNA, 20 bp, mouse
gggtccactcttgtcgtctg

SEQ ID NO: 563219 - DNA, 20 bp, mouse
gggtgtaggggaacacatgg

SEQ ID NO: 563220 - DNA, 20 bp, mouse
gaccaggcatggaaccaaag

SEQ ID NO: 563221 - DNA, 20 bp, mouse
gacccgtgtgtctccccacc

SEQ ID NO: 563222 - DNA, 20 bp, mouse
gcttagagaggggcttacag

SEQ ID NO: 563223 - DNA, 20 bp, mouse
gaaccaaagcggatcaggga

SEQ ID NO: 563224 - DNA, 20 bp, mouse
gacatggagcatccctggaa

SEQ ID NO: 563225 - DNA, 20 bp, mouse
gagagacctccctgtaaaaa

SEQ ID NO: 563226 - DNA, 20 bp, mouse
gggactggcgacatggagga

SEQ ID NO: 563227 - DNA, 20 bp, mouse
gaggacggcgtgctcaagga

SEQ ID NO: 563228 - DNA, 20 bp, mouse
gacctggactggcgacatgg

SEQ ID NO: 563229 - DNA, 20 bp, mouse
ggaaggcttcctcgtcaaga

SEQ ID NO: 563230 - DNA, 20 bp, mouse
gctcacctggactggcgaca

SEQ ID NO: 563231 - DNA, 20 bp, mouse
gagcgcggggacagctcacc

SEQ ID NO: 563232 - DNA, 20 bp, mouse
gcacactcaccctcttgacg

SEQ ID NO: 563233 - DNA, 20 bp, mouse
gcagggcttactctctccgg

SEQ ID NO: 563234 - DNA, 20 bp, mouse
gatggaggacggcgtgctca

SEQ ID NO: 563235 - DNA, 20 bp, mouse
gcagcggggcgagcaagtgt

SEQ ID NO: 563236 - DNA, 20 bp, mouse
gacggcagcgaggacaccag

SEQ ID NO: 563237 - DNA, 20 bp, mouse
gtcgctgtctggtctggtag

SEQ ID NO: 563238 - DNA, 20 bp, mouse
gccgggagcggcgcccacga

SEQ ID NO: 563239 - DNA, 20 bp, mouse
gcggaggccgcggtaaagtg

SEQ ID NO: 563240 - DNA, 20 bp, mouse
ggaaggagccgggaccgcgg

SEQ ID NO: 563241 - DNA, 20 bp, mouse
gtgcgcgggcgggccgtcgt

SEQ ID NO: 563242 - DNA, 20 bp, mouse
gccaccgggatccccgacag

SEQ ID NO: 563243 - DNA, 20 bp, mouse
gcctgaaggagccgggaccg

SEQ ID NO: 563244 - DNA, 20 bp, mouse
gaagcggggcgaggaaggca

SEQ ID NO: 563245 - DNA, 20 bp, mouse
gccttcaggcacccagctgc

SEQ ID NO: 563246 - DNA, 20 bp, mouse
gcgaggttcaagcacagggg

SEQ ID NO: 563247 - DNA, 20 bp, mouse
gcagcggcgaaacttctccg

SEQ ID NO: 563248 - DNA, 20 bp, mouse
gctccgaggttcaagcacag

SEQ ID NO: 563249 - DNA, 20 bp, mouse
gggcctagaatgctaccctg

SEQ ID NO: 563250 - DNA, 20 bp, mouse
gcatggcgggagcagacgaa

SEQ ID NO: 563251 - DNA, 20 bp, mouse
gctgcccgggcagtccttga

SEQ ID NO: 563252 - DNA, 20 bp, mouse
gggcgggagcagacgaaagg

SEQ ID NO: 563253 - DNA, 20 bp, mouse
ggactgcccgggcagcgggt

SEQ ID NO: 563254 - DNA, 20 bp, mouse
gagatggggccaggtcgtgt

SEQ ID NO: 563255 - DNA, 20 bp, mouse
gcaggggtggtagcccctca

SEQ ID NO: 563256 - DNA, 20 bp, mouse
gggaaggcaggcgtgcagga

SEQ ID NO: 563257 - DNA, 20 bp, mouse
gacaagccgggaagcccgag

SEQ ID NO: 563258 - DNA, 20 bp, mouse
ggtgcaggagggcagcgccg

SEQ ID NO: 563259 - DNA, 20 bp, mouse
gagcgccggggctcgtggag

SEQ ID NO: 563260 - DNA, 20 bp, mouse
gccgtaatgggccccacgag

SEQ ID NO: 563261 - DNA, 20 bp, mouse
gagggcagcgccggggctcg

SEQ ID NO: 563262 - DNA, 20 bp, mouse
ggccgggccaggaggatgcg

SEQ ID NO: 563263 - DNA, 20 bp, mouse
gggggctcgtggagcggtgg

SEQ ID NO: 563264 - DNA, 20 bp, mouse
gcgggctctgaagcatggag

SEQ ID NO: 563265 - DNA, 20 bp, mouse
gtctgagggccgccgggtcg

SEQ ID NO: 563266 - DNA, 20 bp, mouse
gagacagcagcagcaaggta

SEQ ID NO: 563267 - DNA, 20 bp, mouse
gggaggggagccggcagcgt

SEQ ID NO: 563268 - DNA, 20 bp, mouse
ggggagaggtgacataggca

SEQ ID NO: 563269 - DNA, 20 bp, mouse
gtcaccaggacaccagaact

SEQ ID NO: 563270 - DNA, 20 bp, mouse
gaaacagatgtgtctggtca

SEQ ID NO: 563271 - DNA, 20 bp, mouse
gaagcagatatcaggtgaag

SEQ ID NO: 563272 - DNA, 20 bp, mouse
gtggcagccgcccacgctgc

SEQ ID NO: 563273 - DNA, 20 bp, mouse
gttacccagttctggtgtcc

SEQ ID NO: 563274 - DNA, 20 bp, mouse
ggggaggaagagaaaaagtg

SEQ ID NO: 563275 - DNA, 20 bp, mouse
gggactgggagaggtgacat

SEQ ID NO: 563276 - DNA, 20 bp, mouse
gggagactccgcgctctgtg

SEQ ID NO: 563277 - DNA, 20 bp, mouse
ggctctctcgattgagccta

SEQ ID NO: 563278 - DNA, 20 bp, mouse
gagcttctcaggcgtgccct

SEQ ID NO: 563279 - DNA, 20 bp, mouse
gggaaattacgtgagatcga

SEQ ID NO: 563280 - DNA, 20 bp, mouse
gggtacgtgactgccagata

SEQ ID NO: 563281 - DNA, 20 bp, mouse
gcggaagtccctgggaaagg

SEQ ID NO: 563282 - DNA, 20 bp, mouse
gaacaacactgaacttctcg

SEQ ID NO: 563283 - DNA, 20 bp, mouse
gtctcggaagtccctgggaa

SEQ ID NO: 563284 - DNA, 20 bp, mouse
gttgcttggagaaaaaaggt

SEQ ID NO: 563285 - DNA, 20 bp, mouse
gactcttgcttggagaaaaa

SEQ ID NO: 563286 - DNA, 20 bp, mouse
gggccggggagcagacatgg

SEQ ID NO: 563287 - DNA, 20 bp, mouse
gcggcggcagcacaaggcgg

SEQ ID NO: 563288 - DNA, 20 bp, mouse
gcggcagcacaaggcggcgg

SEQ ID NO: 563289 - DNA, 20 bp, mouse
gggccgacctgaacctggag

SEQ ID NO: 563290 - DNA, 20 bp, mouse
gcgccgccgctgaggaagga

SEQ ID NO: 563291 - DNA, 20 bp, mouse
gcagcgagcagatccactcc

SEQ ID NO: 563292 - DNA, 20 bp, mouse
gcgccctccttcctcagcgg

SEQ ID NO: 563293 - DNA, 20 bp, mouse
gggacgtacgggatcactag

SEQ ID NO: 563294 - DNA, 20 bp, mouse
gatggcggccgacctgaacc

SEQ ID NO: 563295 - DNA, 20 bp, mouse
gagaagggacaggcgctgag

SEQ ID NO: 563296 - DNA, 20 bp, mouse
gttagaggcagcagagacta

SEQ ID NO: 563297 - DNA, 20 bp, mouse
gactagggagcgcactgagc

SEQ ID NO: 563298 - DNA, 20 bp, mouse
gagtagactggctgttggtt

SEQ ID NO: 563299 - DNA, 20 bp, mouse
gggctagcgtgcttcctcat

SEQ ID NO: 563300 - DNA, 20 bp, mouse
gttcagctgggccagattct

SEQ ID NO: 563301 - DNA, 20 bp, mouse
gtctggctgatgaacacaca

SEQ ID NO: 563302 - DNA, 20 bp, mouse
gtgtggttctggagccgatg

SEQ ID NO: 563303 - DNA, 20 bp, mouse
gcctttcacactcaggaata

SEQ ID NO: 563304 - DNA, 20 bp, mouse
ggagaaagaactcttcagag

SEQ ID NO: 563305 - DNA, 20 bp, mouse
gcagagtggttctcaactaa

SEQ ID NO: 563306 - DNA, 20 bp, mouse
gaggcgctgggcgaacatgg

SEQ ID NO: 563307 - DNA, 20 bp, mouse
gtaggaccagtgctcaggta

SEQ ID NO: 563308 - DNA, 20 bp, mouse
gctcaggcgctgggcgaaca

SEQ ID NO: 563309 - DNA, 20 bp, mouse
ggaacatggcggctgcggtc

SEQ ID NO: 563310 - DNA, 20 bp, mouse
gcgccataggaccagtgctc

SEQ ID NO: 563311 - DNA, 20 bp, mouse
gccgtcccgacagacgccat

SEQ ID NO: 563312 - DNA, 20 bp, mouse
gggacaccctacctgagcac

SEQ ID NO: 563313 - DNA, 20 bp, mouse
gcagcggagctggtcactac

SEQ ID NO: 563314 - DNA, 20 bp, mouse
gtgggcgaacatggcggctg

SEQ ID NO: 563315 - DNA, 20 bp, mouse
gcatggcggctgcggtcggg

SEQ ID NO: 563316 - DNA, 20 bp, mouse
gcagagcggccgccagagag

SEQ ID NO: 563317 - DNA, 20 bp, mouse
gcgccagagagaggcgaggg

SEQ ID NO: 563318 - DNA, 20 bp, mouse
gggaggcgcggcccctgtgg

SEQ ID NO: 563319 - DNA, 20 bp, mouse
gggccgccagagagaggcga

SEQ ID NO: 563320 - DNA, 20 bp, mouse
gagagaggcgagggaggcgc

SEQ ID NO: 563321 - DNA, 20 bp, mouse
ggcgggcgctgtgggctcag

SEQ ID NO: 563322 - DNA, 20 bp, mouse
gggcccgcgggtgccatgga

SEQ ID NO: 563323 - DNA, 20 bp, mouse
gcggtgtggacgccgcagag

SEQ ID NO: 563324 - DNA, 20 bp, mouse
gagtggaccaactacctgag

SEQ ID NO: 563325 - DNA, 20 bp, mouse
gcaccagctccgggtcccgg

SEQ ID NO: 563326 - DNA, 20 bp, mouse
gagtggttccagactctcta

SEQ ID NO: 563327 - DNA, 20 bp, mouse
gggttccagactctctaggg

SEQ ID NO: 563328 - DNA, 20 bp, mouse
gagactctctagggagggca

SEQ ID NO: 563329 - DNA, 20 bp, mouse
ggtcgggtggaacctgtcag

SEQ ID NO: 563330 - DNA, 20 bp, mouse
gttactaacgcagccttgag

SEQ ID NO: 563331 - DNA, 20 bp, mouse
gggagctgcactgaattgtg

SEQ ID NO: 563332 - DNA, 20 bp, mouse
gagccttaggagggggccag

SEQ ID NO: 563333 - DNA, 20 bp, mouse
gcaccgctggccccctccta

SEQ ID NO: 563334 - DNA, 20 bp, mouse
gagtgctaccggggcagaga

SEQ ID NO: 563335 - DNA, 20 bp, mouse
gttagaggaacaactagaga

SEQ ID NO: 563336 - DNA, 20 bp, mouse
gcttacccccagagatccag

SEQ ID NO: 563337 - DNA, 20 bp, mouse
gaatgcctctggatctctgg

SEQ ID NO: 563338 - DNA, 20 bp, mouse
gagcagagcgcaggtgcgac

SEQ ID NO: 563339 - DNA, 20 bp, mouse
gctgggaagtgaaatgcctc

SEQ ID NO: 563340 - DNA, 20 bp, mouse
gagcgcaggtgcgaccggtt

SEQ ID NO: 563341 - DNA, 20 bp, mouse
ggccagcggagaaacacaag

SEQ ID NO: 563342 - DNA, 20 bp, mouse
gggagaaacacaagaggcca

SEQ ID NO: 563343 - DNA, 20 bp, mouse
gtgaaatgcctctggatctc

SEQ ID NO: 563344 - DNA, 20 bp, mouse
gaacaggtgggtgcatcgag

SEQ ID NO: 563345 - DNA, 20 bp, mouse
gacaggtggacgaactgagg

SEQ ID NO: 563346 - DNA, 20 bp, mouse
gtgttcaggccgccaagaca

SEQ ID NO: 563347 - DNA, 20 bp, mouse
gggccgccaagacagggatc

SEQ ID NO: 563348 - DNA, 20 bp, mouse
gggatcaggctgagagcgca

SEQ ID NO: 563349 - DNA, 20 bp, mouse
ggcgcgtccagcggagaagc

SEQ ID NO: 563350 - DNA, 20 bp, mouse
ggaggcggtgacgcaggacc

SEQ ID NO: 563351 - DNA, 20 bp, mouse
ggctgagagcgcaaggtcgc

SEQ ID NO: 563352 - DNA, 20 bp, mouse
ggtggtgtcaccgaggaagt

SEQ ID NO: 563353 - DNA, 20 bp, mouse
gccaggactcgcgcgtccag

SEQ ID NO: 563354 - DNA, 20 bp, mouse
gaagcgggttacccccggag

SEQ ID NO: 563355 - DNA, 20 bp, mouse
gcccgctcacgcccctccgg

SEQ ID NO: 563356 - DNA, 20 bp, mouse
gcgtatcccgacgagcggag

SEQ ID NO: 563357 - DNA, 20 bp, mouse
gcgacgagcggagcggagag

SEQ ID NO: 563358 - DNA, 20 bp, mouse
ggggcgcgtatcccgacgag

SEQ ID NO: 563359 - DNA, 20 bp, mouse
gaagggagtgggcccggcca

SEQ ID NO: 563360 - DNA, 20 bp, mouse
gtggccgggagggaactccg

SEQ ID NO: 563361 - DNA, 20 bp, mouse
gagagcgctgttggccggga

SEQ ID NO: 563362 - DNA, 20 bp, mouse
ggcagctgggaacgccgtcg

SEQ ID NO: 563363 - DNA, 20 bp, mouse
gagggacggcgatggcgaca

SEQ ID NO: 563364 - DNA, 20 bp, mouse
gcgtccgcctgctccaggga

SEQ ID NO: 563365 - DNA, 20 bp, mouse
gggcggagctgccctccccg

SEQ ID NO: 563366 - DNA, 20 bp, mouse
gaggtaagcaggctacggag

SEQ ID NO: 563367 - DNA, 20 bp, mouse
gtagcctgcttacctcccgt

SEQ ID NO: 563368 - DNA, 20 bp, mouse
gcggacgcggaggttcctac

SEQ ID NO: 563369 - DNA, 20 bp, mouse
gacgcggaggttcctacggg

SEQ ID NO: 563370 - DNA, 20 bp, mouse
ggcagggtggagggcggaag

SEQ ID NO: 563371 - DNA, 20 bp, mouse
ggttcctacgggaggtaagc

SEQ ID NO: 563372 - DNA, 20 bp, mouse
gtggaacccggaggcgtggg

SEQ ID NO: 563373 - DNA, 20 bp, mouse
gacatcacgggataaggaga

SEQ ID NO: 563374 - DNA, 20 bp, mouse
gtgcagacctggcagggtgg

SEQ ID NO: 563375 - DNA, 20 bp, mouse
gcgcacagccagtcccgaac

SEQ ID NO: 563376 - DNA, 20 bp, mouse
gtcgggttcgactggagggg

SEQ ID NO: 563377 - DNA, 20 bp, mouse
gctccagtcgaacccgacaa

SEQ ID NO: 563378 - DNA, 20 bp, mouse
gcggtgaagtcacctgcgag

SEQ ID NO: 563379 - DNA, 20 bp, mouse
gggccggcgcgatccggacg

SEQ ID NO: 563380 - DNA, 20 bp, mouse
gagccggagcggccgttgtc

SEQ ID NO: 563381 - DNA, 20 bp, mouse
gggccgttgtcgggttcgac

SEQ ID NO: 563382 - DNA, 20 bp, mouse
gggtcgggtaggtgccatgg

SEQ ID NO: 563383 - DNA, 20 bp, mouse
gcggcgcgatccggacgcgg

SEQ ID NO: 563384 - DNA, 20 bp, mouse
gaacccgacaacggccgctc

SEQ ID NO: 563385 - DNA, 20 bp, mouse
ggggccgggaccatagacgg

SEQ ID NO: 563386 - DNA, 20 bp, mouse
gggcggagcttacgggagag

SEQ ID NO: 563387 - DNA, 20 bp, mouse
gtattccagggaccagacaa

SEQ ID NO: 563388 - DNA, 20 bp, mouse
ggacacgccgggagcagagt

SEQ ID NO: 563389 - DNA, 20 bp, mouse
gtagtctcggcggagcttac

SEQ ID NO: 563390 - DNA, 20 bp, mouse
gctccgccgagactattcca

SEQ ID NO: 563391 - DNA, 20 bp, mouse
ggtccctggaatagtctcgg

SEQ ID NO: 563392 - DNA, 20 bp, mouse
gtcctgggaggggactgatg

SEQ ID NO: 563393 - DNA, 20 bp, mouse
gtgagcgctgctcctgggag

SEQ ID NO: 563394 - DNA, 20 bp, mouse
gtggagccaggcgagctgca

SEQ ID NO: 563395 - DNA, 20 bp, mouse
gcgactgatggggtcgactc

SEQ ID NO: 563396 - DNA, 20 bp, mouse
gctccgggatgagtgtcctg

SEQ ID NO: 563397 - DNA, 20 bp, mouse
gtgcacggccacagatccta

SEQ ID NO: 563398 - DNA, 20 bp, mouse
gccaagactatgaacgcctc

SEQ ID NO: 563399 - DNA, 20 bp, mouse
gacactcatcccggagcccg

SEQ ID NO: 563400 - DNA, 20 bp, mouse
gctcagagttgggaccccgt

SEQ ID NO: 563401 - DNA, 20 bp, mouse
gcatctggggcggggagagt

SEQ ID NO: 563402 - DNA, 20 bp, mouse
gaccccgtgggaaggatgca

SEQ ID NO: 563403 - DNA, 20 bp, mouse
gacccggcttcgaagaccgt

SEQ ID NO: 563404 - DNA, 20 bp, mouse
ggagtcgggtcccagatgtg

SEQ ID NO: 563405 - DNA, 20 bp, mouse
gtccttgcggtccctcccgg

SEQ ID NO: 563406 - DNA, 20 bp, mouse
gtgcgagcaccagacgccgg

SEQ ID NO: 563407 - DNA, 20 bp, mouse
gcccgccgcagcctggactc

SEQ ID NO: 563408 - DNA, 20 bp, mouse
gtggtgctcgcagcgagcag

SEQ ID NO: 563409 - DNA, 20 bp, mouse
ggaagttgcggccggagtcc

SEQ ID NO: 563410 - DNA, 20 bp, mouse
ggcgcacggttccccagcac

SEQ ID NO: 563411 - DNA, 20 bp, mouse
gagggacactcaccaagcgg

SEQ ID NO: 563412 - DNA, 20 bp, mouse
gggaaccgtgcgcatttcgg

SEQ ID NO: 563413 - DNA, 20 bp, mouse
gaacttcctgcccggtgctg

SEQ ID NO: 563414 - DNA, 20 bp, mouse
gagagagaaaggcaaaccta

SEQ ID NO: 563415 - DNA, 20 bp, mouse
gctcgcagcgagcagaggct

SEQ ID NO: 563416 - DNA, 20 bp, mouse
gaagacatgcctaggagctg

SEQ ID NO: 563417 - DNA, 20 bp, mouse
gctggagaaggacaactcca

SEQ ID NO: 563418 - DNA, 20 bp, mouse
ggctcactgaagctagagga

SEQ ID NO: 563419 - DNA, 20 bp, mouse
gagagatggaagacatgcct

SEQ ID NO: 563420 - DNA, 20 bp, mouse
gggcagattctgaagagcaa

SEQ ID NO: 563421 - DNA, 20 bp, mouse
gtatctgtgcaaccagacaa

SEQ ID NO: 563422 - DNA, 20 bp, mouse
gtgagcatcaggtccagtct

SEQ ID NO: 563423 - DNA, 20 bp, mouse
gttagagtcagagatgggtg

SEQ ID NO: 563424 - DNA, 20 bp, mouse
gctgccttagagtcagagat

SEQ ID NO: 563425 - DNA, 20 bp, mouse
gatcgcctgacttagagcca

SEQ ID NO: 563426 - DNA, 20 bp, mouse
ggaggctgcccagattccaa

SEQ ID NO: 563427 - DNA, 20 bp, mouse
ggcaccgcagcctcgaggat

SEQ ID NO: 563428 - DNA, 20 bp, mouse
gctcgctgtacccatcctcg

SEQ ID NO: 563429 - DNA, 20 bp, mouse
ggttagttcgacggctctgg

SEQ ID NO: 563430 - DNA, 20 bp, mouse
gggtggcgcccttggaatct

SEQ ID NO: 563431 - DNA, 20 bp, mouse
gacccctgggacgtgcagtg

SEQ ID NO: 563432 - DNA, 20 bp, mouse
ggcttccgtgaaccactact

SEQ ID NO: 563433 - DNA, 20 bp, mouse
gggggaactctgaagccggg

SEQ ID NO: 563434 - DNA, 20 bp, mouse
ggtacccatcctcgaggctg

SEQ ID NO: 563435 - DNA, 20 bp, mouse
gtccgtgaaccactactggg

SEQ ID NO: 563436 - DNA, 20 bp, mouse
gccatggcgccgagccgcag

SEQ ID NO: 563437 - DNA, 20 bp, mouse
ggcggggccgcactcaccca

SEQ ID NO: 563438 - DNA, 20 bp, mouse
gcccgcgctcggttcccctg

SEQ ID NO: 563439 - DNA, 20 bp, mouse
gcttgagcgccgcagcgagg

SEQ ID NO: 563440 - DNA, 20 bp, mouse
ggccgcaggggaaccgagcg

SEQ ID NO: 563441 - DNA, 20 bp, mouse
gggcagctgcagctagtccc

SEQ ID NO: 563442 - DNA, 20 bp, mouse
gagatagacgaagggaacag

SEQ ID NO: 563443 - DNA, 20 bp, mouse
gcgctcccgcgctcggtcct

SEQ ID NO: 563444 - DNA, 20 bp, mouse
gtagtcccgggtgcagaggc

SEQ ID NO: 563445 - DNA, 20 bp, mouse
gggcgagagcagaccgtcag

SEQ ID NO: 563446 - DNA, 20 bp, mouse
ggccgctcggtcctagtccc

SEQ ID NO: 563447 - DNA, 20 bp, mouse
gagtggggctgccatcgcca

SEQ ID NO: 563448 - DNA, 20 bp, mouse
gggaaggaggctgggtacga

SEQ ID NO: 563449 - DNA, 20 bp, mouse
ggcctgggactaggaccgag

SEQ ID NO: 563450 - DNA, 20 bp, mouse
gggcagcacggggccgggaa

SEQ ID NO: 563451 - DNA, 20 bp, mouse
ggtcgcggggcctcagaagg

SEQ ID NO: 563452 - DNA, 20 bp, mouse
gttgtcagcttccttggcga

SEQ ID NO: 563453 - DNA, 20 bp, mouse
gccgcgggaccaggcagcac

SEQ ID NO: 563454 - DNA, 20 bp, mouse
gggaggctgggtacgaggga

SEQ ID NO: 563455 - DNA, 20 bp, mouse
gtgacgtccgctggatactg

SEQ ID NO: 563456 - DNA, 20 bp, mouse
gctcggggagagccactgtg

SEQ ID NO: 563457 - DNA, 20 bp, mouse
gagcgcggtgcggacacagc

SEQ ID NO: 563458 - DNA, 20 bp, mouse
gccgccgagcgagcgcggtg

SEQ ID NO: 563459 - DNA, 20 bp, mouse
gccacggctcccaggtagag

SEQ ID NO: 563460 - DNA, 20 bp, mouse
gcgctggggcgggctttgtg

SEQ ID NO: 563461 - DNA, 20 bp, mouse
gcaaagcccgccccagcgct

SEQ ID NO: 563462 - DNA, 20 bp, mouse
ggccgaggtcggagcctgga

SEQ ID NO: 563463 - DNA, 20 bp, mouse
gggcgctgctcccagcgctg

SEQ ID NO: 563464 - DNA, 20 bp, mouse
ggctgctcccagcgctgggg

SEQ ID NO: 563465 - DNA, 20 bp, mouse
gccaggacacccgcactggg

SEQ ID NO: 563466 - DNA, 20 bp, mouse
gcggcgcgggctgagagccg

SEQ ID NO: 563467 - DNA, 20 bp, mouse
gcaggcgccgccgcagaggt

SEQ ID NO: 563468 - DNA, 20 bp, mouse
gccgcactcggagctccgag

SEQ ID NO: 563469 - DNA, 20 bp, mouse
ggcccacctgcctacctctg

SEQ ID NO: 563470 - DNA, 20 bp, mouse
gggctgagagccggggaagc

SEQ ID NO: 563471 - DNA, 20 bp, mouse
gcacctgcctacctctgcgg

SEQ ID NO: 563472 - DNA, 20 bp, mouse
ggccagtcacccggctccgc

SEQ ID NO: 563473 - DNA, 20 bp, mouse
gccgggacccggccgagcca

SEQ ID NO: 563474 - DNA, 20 bp, mouse
gttccggctcgccagtcacc

SEQ ID NO: 563475 - DNA, 20 bp, mouse
gcggccgccaatcccgcagg

SEQ ID NO: 563476 - DNA, 20 bp, mouse
gtgtccggtagggcgtccgg

SEQ ID NO: 563477 - DNA, 20 bp, mouse
gaaggagggtggtgtccggt

SEQ ID NO: 563478 - DNA, 20 bp, mouse
gccccaacgcgccagtcccg

SEQ ID NO: 563479 - DNA, 20 bp, mouse
gctgggcccgggcagaggag

SEQ ID NO: 563480 - DNA, 20 bp, mouse
gggttgtccaagctccaagg

SEQ ID NO: 563481 - DNA, 20 bp, mouse
ggcgagcagcctgggaatgg

SEQ ID NO: 563482 - DNA, 20 bp, mouse
gcgccagtcccggggctgca

SEQ ID NO: 563483 - DNA, 20 bp, mouse
gccagacagcgagcccccag

SEQ ID NO: 563484 - DNA, 20 bp, mouse
ggggagccgggagcaatgtc

SEQ ID NO: 563485 - DNA, 20 bp, mouse
gcggccaccggacgccctac

SEQ ID NO: 563486 - DNA, 20 bp, mouse
ggcatgcggggccccaagaa

SEQ ID NO: 563487 - DNA, 20 bp, mouse
gggcagcggtgagccagtcg

SEQ ID NO: 563488 - DNA, 20 bp, mouse
gcgagaggcagggcgcgtgt

SEQ ID NO: 563489 - DNA, 20 bp, mouse
gcgacagccggcagagatgg

SEQ ID NO: 563490 - DNA, 20 bp, mouse
ggccggcgccgctagactta

SEQ ID NO: 563491 - DNA, 20 bp, mouse
ggcaggcgcagtaaccgggt

SEQ ID NO: 563492 - DNA, 20 bp, mouse
gacgcgcaggcgcagtaacc

SEQ ID NO: 563493 - DNA, 20 bp, mouse
gtggttcgcgcggatccgtg

SEQ ID NO: 563494 - DNA, 20 bp, mouse
gcgctccgccctaagtctag

SEQ ID NO: 563495 - DNA, 20 bp, mouse
gggggaggacggcggccgag

SEQ ID NO: 563496 - DNA, 20 bp, mouse
gggcgaagcgagacccccct

SEQ ID NO: 563497 - DNA, 20 bp, mouse
ggcagaagctgcggctccaa

SEQ ID NO: 563498 - DNA, 20 bp, mouse
gcggttccgagcagaagctg

SEQ ID NO: 563499 - DNA, 20 bp, mouse
ggcttctgctcggaaccgag

SEQ ID NO: 563500 - DNA, 20 bp, mouse
gaggcactgacaacaggaag

SEQ ID NO: 563501 - DNA, 20 bp, mouse
ggagcaggtggcggcgctcc

SEQ ID NO: 563502 - DNA, 20 bp, mouse
gagcaggcccgggctgcgaa

SEQ ID NO: 563503 - DNA, 20 bp, mouse
gccttcggtgagtgagtctg

SEQ ID NO: 563504 - DNA, 20 bp, mouse
gcaagtctccaggcgcacag

SEQ ID NO: 563505 - DNA, 20 bp, mouse
gtggctgcggtggagacgga

SEQ ID NO: 563506 - DNA, 20 bp, mouse
ggcgaggcgaggcgagacga

SEQ ID NO: 563507 - DNA, 20 bp, mouse
gccgagccgggaaggagacg

SEQ ID NO: 563508 - DNA, 20 bp, mouse
gaggcgaggcgagacgaggg

SEQ ID NO: 563509 - DNA, 20 bp, mouse
gcccgagcgccgagccggga

SEQ ID NO: 563510 - DNA, 20 bp, mouse
gagggcccgcgtctccttcc

SEQ ID NO: 563511 - DNA, 20 bp, mouse
gtcatggaggcgacccgggg

SEQ ID NO: 563512 - DNA, 20 bp, mouse
ggaaggctgcgggtaggacg

SEQ ID NO: 563513 - DNA, 20 bp, mouse
gagggtcgccaggacgacag

SEQ ID NO: 563514 - DNA, 20 bp, mouse
gaggagacgcgggccctgcg

SEQ ID NO: 563515 - DNA, 20 bp, mouse
gatggagccgcgggaggtga

SEQ ID NO: 563516 - DNA, 20 bp, mouse
gccagcagctgagtcactcc

SEQ ID NO: 563517 - DNA, 20 bp, mouse
ggatgctgccctgatcctgc

SEQ ID NO: 563518 - DNA, 20 bp, mouse
ggtgtccccagcaaaggggt

SEQ ID NO: 563519 - DNA, 20 bp, mouse
gtcctgtcacacggagacag

SEQ ID NO: 563520 - DNA, 20 bp, mouse
gttctgacctgggactccaa

SEQ ID NO: 563521 - DNA, 20 bp, mouse
gagacgcaggtagctctcca

SEQ ID NO: 563522 - DNA, 20 bp, mouse
ggctcagtgtcacctactga

SEQ ID NO: 563523 - DNA, 20 bp, mouse
gttgagggccaggtagagcc

SEQ ID NO: 563524 - DNA, 20 bp, mouse
ggctacagaagtactatgtc

SEQ ID NO: 563525 - DNA, 20 bp, mouse
gcccaaagcctcctgtcaca

SEQ ID NO: 563526 - DNA, 20 bp, mouse
gaaacagagccgggccggga

SEQ ID NO: 563527 - DNA, 20 bp, mouse
gcagtcgctggcggtgagga

SEQ ID NO: 563528 - DNA, 20 bp, mouse
ggctggagcgcagtcgctgg

SEQ ID NO: 563529 - DNA, 20 bp, mouse
gctccagctgccgaccatcc

SEQ ID NO: 563530 - DNA, 20 bp, mouse
ggctgccgaccatcccggcc

SEQ ID NO: 563531 - DNA, 20 bp, mouse
ggcagctggagcgcagtcgc

SEQ ID NO: 563532 - DNA, 20 bp, mouse
gccccggcaggaccccgacc

SEQ ID NO: 563533 - DNA, 20 bp, mouse
ggcccggctctgtttacaag

SEQ ID NO: 563534 - DNA, 20 bp, mouse
gagcgcagtcgctggcggtg

SEQ ID NO: 563535 - DNA, 20 bp, mouse
gtgtgggtggctaagtgagg

SEQ ID NO: 563536 - DNA, 20 bp, mouse
gcgacgtgcaggagcaggtc

SEQ ID NO: 563537 - DNA, 20 bp, mouse
gcagccacagtcctcccctt

SEQ ID NO: 563538 - DNA, 20 bp, mouse
ggaccacgacgtgcaggagc

SEQ ID NO: 563539 - DNA, 20 bp, mouse
gagcaggctgaaagcagaac

SEQ ID NO: 563540 - DNA, 20 bp, mouse
gtgcatgccaatgaagctgg

SEQ ID NO: 563541 - DNA, 20 bp, mouse
ggggtctcctccagcttcat

SEQ ID NO: 563542 - DNA, 20 bp, mouse
gtttcatgtgagtctccgaa

SEQ ID NO: 563543 - DNA, 20 bp, mouse
gcacttctggaggctatgac

SEQ ID NO: 563544 - DNA, 20 bp, mouse
ggggtctagctaataagtcc

SEQ ID NO: 563545 - DNA, 20 bp, mouse
gatgaaagaccacgacgtgc

SEQ ID NO: 563546 - DNA, 20 bp, mouse
ggctagcagctgccatccat

SEQ ID NO: 563547 - DNA, 20 bp, mouse
gagtggctgttccccatgga

SEQ ID NO: 563548 - DNA, 20 bp, mouse
gtagcctcctgggggcctga

SEQ ID NO: 563549 - DNA, 20 bp, mouse
gcgtccctcaggcccccagg

SEQ ID NO: 563550 - DNA, 20 bp, mouse
gcagcgggaggcgttaacag

SEQ ID NO: 563551 - DNA, 20 bp, mouse
ggcagctgctagcttgtgct

SEQ ID NO: 563552 - DNA, 20 bp, mouse
gcaccgtcccagggatgtag

SEQ ID NO: 563553 - DNA, 20 bp, mouse
gacagtgtgagtgatcatgg

SEQ ID NO: 563554 - DNA, 20 bp, mouse
gcctgggacggtgagcggag

SEQ ID NO: 563555 - DNA, 20 bp, mouse
gggtccaggcagcaggtcca

SEQ ID NO: 563556 - DNA, 20 bp, mouse
gtcggagcccgcgacgtcag

SEQ ID NO: 563557 - DNA, 20 bp, mouse
gcccggggcgagacgaggag

SEQ ID NO: 563558 - DNA, 20 bp, mouse
ggcggtggccggggccggtg

SEQ ID NO: 563559 - DNA, 20 bp, mouse
ggtcgcgggctccgaatgaa

SEQ ID NO: 563560 - DNA, 20 bp, mouse
ggcgcggcgcgcggacaatg

SEQ ID NO: 563561 - DNA, 20 bp, mouse
ggggcgggcatgggcgacgg

SEQ ID NO: 563562 - DNA, 20 bp, mouse
ggcgggctccgaatgaaggg

SEQ ID NO: 563563 - DNA, 20 bp, mouse
gctgcggcgcccgagaaggt

SEQ ID NO: 563564 - DNA, 20 bp, mouse
ggcgcccgctgctcgctcgg

SEQ ID NO: 563565 - DNA, 20 bp, mouse
gatcccgccatgaagaagag

SEQ ID NO: 563566 - DNA, 20 bp, mouse
gccatctacgcgcagccggg

SEQ ID NO: 563567 - DNA, 20 bp, mouse
gcaacgcgggcagcagtaag

SEQ ID NO: 563568 - DNA, 20 bp, mouse
gagcggagcccgcgcaacgc

SEQ ID NO: 563569 - DNA, 20 bp, mouse
gagacccgtggaagtaggac

SEQ ID NO: 563570 - DNA, 20 bp, mouse
ggcgagtttgcaaggtccgg

SEQ ID NO: 563571 - DNA, 20 bp, mouse
gtcagaagcagacctggctg

SEQ ID NO: 563572 - DNA, 20 bp, mouse
ggactgtgcagaaagacccg

SEQ ID NO: 563573 - DNA, 20 bp, mouse
gcaggttctgcttgaaggga

SEQ ID NO: 563574 - DNA, 20 bp, mouse
gacctggaccaatggggtag

SEQ ID NO: 563575 - DNA, 20 bp, mouse
gtaactgaggatgctgtcgg

SEQ ID NO: 563576 - DNA, 20 bp, mouse
gcagtaagcaggaggagctc

SEQ ID NO: 563577 - DNA, 20 bp, mouse
gtctctgcacctgcaccgtg

SEQ ID NO: 563578 - DNA, 20 bp, mouse
ggagtacttaccaggtcacc

SEQ ID NO: 563579 - DNA, 20 bp, mouse
gcagtccgcgagtacttacc

SEQ ID NO: 563580 - DNA, 20 bp, mouse
gagagaactacctggtgacc

SEQ ID NO: 563581 - DNA, 20 bp, mouse
gctctggagccacacggtgc

SEQ ID NO: 563582 - DNA, 20 bp, mouse
gcagagagtctggagtccca

SEQ ID NO: 563583 - DNA, 20 bp, mouse
gagagctcacagtaagcagg

SEQ ID NO: 563584 - DNA, 20 bp, mouse
gcccggatcaccacaacctt

SEQ ID NO: 563585 - DNA, 20 bp, mouse
gaccagagctcacagtaagc

SEQ ID NO: 563586 - DNA, 20 bp, mouse
gctgttggccagtcccaaca

SEQ ID NO: 563587 - DNA, 20 bp, mouse
gagtcccaacatggaccata

SEQ ID NO: 563588 - DNA, 20 bp, mouse
gcttccttatggtccatgtt

SEQ ID NO: 563589 - DNA, 20 bp, mouse
gtgcttgggtagggatggac

SEQ ID NO: 563590 - DNA, 20 bp, mouse
gacagttgtccaggtgctgt

SEQ ID NO: 563591 - DNA, 20 bp, mouse
gtcctggtgttgacttaaag

SEQ ID NO: 563592 - DNA, 20 bp, mouse
gacaactgtgtcctagttcc

SEQ ID NO: 563593 - DNA, 20 bp, mouse
gtcccctttaagtcaacacc

SEQ ID NO: 563594 - DNA, 20 bp, mouse
gcctggtggtggtagttagt

SEQ ID NO: 563595 - DNA, 20 bp, mouse
ggtctgactaaagggcaatg

SEQ ID NO: 563596 - DNA, 20 bp, mouse
ggggacggtgaccgcagcag

SEQ ID NO: 563597 - DNA, 20 bp, mouse
ggctctggagctctggctag

SEQ ID NO: 563598 - DNA, 20 bp, mouse
gacactcacgcgacacggtg

SEQ ID NO: 563599 - DNA, 20 bp, mouse
gacgcgacacggtgcgggga

SEQ ID NO: 563600 - DNA, 20 bp, mouse
ggtccctgcgctgatcgctc

SEQ ID NO: 563601 - DNA, 20 bp, mouse
gcaatacctgtcagcctcgg

SEQ ID NO: 563602 - DNA, 20 bp, mouse
gctccagagcgatcagcgca

SEQ ID NO: 563603 - DNA, 20 bp, mouse
gccgaaacactcacgcgaca

SEQ ID NO: 563604 - DNA, 20 bp, mouse
gcagggacagtaccttgctt

SEQ ID NO: 563605 - DNA, 20 bp, mouse
ggagatcacactcacagaac

SEQ ID NO: 563606 - DNA, 20 bp, mouse
ggggctgtctgagactgagg

SEQ ID NO: 563607 - DNA, 20 bp, mouse
gtctagctgggaggtctgag

SEQ ID NO: 563608 - DNA, 20 bp, mouse
gccgagaaagcagctaggta

SEQ ID NO: 563609 - DNA, 20 bp, mouse
gtaggtaaggcagacgccca

SEQ ID NO: 563610 - DNA, 20 bp, mouse
gtggagggcgaatgttacat

SEQ ID NO: 563611 - DNA, 20 bp, mouse
gggcattgcccaagattccc

SEQ ID NO: 563612 - DNA, 20 bp, mouse
ggggaggtctccatccagca

SEQ ID NO: 563613 - DNA, 20 bp, mouse
gaggggtgcagagatctgca

SEQ ID NO: 563614 - DNA, 20 bp, mouse
gtatagaggtctaagaaccg

SEQ ID NO: 563615 - DNA, 20 bp, mouse
gatctgcagggggacccctg

SEQ ID NO: 563616 - DNA, 20 bp, mouse
gggtgcaggacctacctaac

SEQ ID NO: 563617 - DNA, 20 bp, mouse
ggcggcctgagggccagatc

SEQ ID NO: 563618 - DNA, 20 bp, mouse
gagggacgagcaagtccgca

SEQ ID NO: 563619 - DNA, 20 bp, mouse
ggaaggacgtgcaaacagaa

SEQ ID NO: 563620 - DNA, 20 bp, mouse
gctgtttgcacgtccttctg

SEQ ID NO: 563621 - DNA, 20 bp, mouse
gctgcctagtgggacactaa

SEQ ID NO: 563622 - DNA, 20 bp, mouse
gtggctcggaggcttgggcg

SEQ ID NO: 563623 - DNA, 20 bp, mouse
gcaagttgctctaccacaga

SEQ ID NO: 563624 - DNA, 20 bp, mouse
gttctggccgctttgctgtg

SEQ ID NO: 563625 - DNA, 20 bp, mouse
gtgcagcaatgggtcggtgg

SEQ ID NO: 563626 - DNA, 20 bp, mouse
gtccaagctggacttggtag

SEQ ID NO: 563627 - DNA, 20 bp, mouse
gaagctggacttggtagggg

SEQ ID NO: 563628 - DNA, 20 bp, mouse
gtcctcgcttggacgacctg

SEQ ID NO: 563629 - DNA, 20 bp, mouse
gttggacgacctgaggactt

SEQ ID NO: 563630 - DNA, 20 bp, mouse
ggggtggccaggccaagagt

SEQ ID NO: 563631 - DNA, 20 bp, mouse
gccacccggtagatccaagc

SEQ ID NO: 563632 - DNA, 20 bp, mouse
gtcctcaggtcgtccaagcg

SEQ ID NO: 563633 - DNA, 20 bp, mouse
gagtccagcttggatctacc

SEQ ID NO: 563634 - DNA, 20 bp, mouse
gggacgctaaggtcctaggg

SEQ ID NO: 563635 - DNA, 20 bp, mouse
gcgaggacgctaaggtccta

SEQ ID NO: 563636 - DNA, 20 bp, mouse
ggagtcacctggaccagtca

SEQ ID NO: 563637 - DNA, 20 bp, mouse
ggcccagacgctgccagcag

SEQ ID NO: 563638 - DNA, 20 bp, mouse
gcccttcacccacctggagg

SEQ ID NO: 563639 - DNA, 20 bp, mouse
ggagactgccacctccaggt

SEQ ID NO: 563640 - DNA, 20 bp, mouse
gcagcagcggtcctgctctg

SEQ ID NO: 563641 - DNA, 20 bp, mouse
gacccccttcacccacctgg

SEQ ID NO: 563642 - DNA, 20 bp, mouse
gcctggaccagtcagggtaa

SEQ ID NO: 563643 - DNA, 20 bp, mouse
ggggtcccccccaaatccaa

SEQ ID NO: 563644 - DNA, 20 bp, mouse
gagggaccctttaccctgac

SEQ ID NO: 563645 - DNA, 20 bp, mouse
gcacagcagctcgagtcacc

SEQ ID NO: 563646 - DNA, 20 bp, mouse
gttgacgggcaggaaagttg

SEQ ID NO: 563647 - DNA, 20 bp, mouse
ggccatggtggggatacata

SEQ ID NO: 563648 - DNA, 20 bp, mouse
gggtcaccctcagctgtcca

SEQ ID NO: 563649 - DNA, 20 bp, mouse
gtgtcaccgtggacagctga

SEQ ID NO: 563650 - DNA, 20 bp, mouse
ggcccccgttgcagaggtgg

SEQ ID NO: 563651 - DNA, 20 bp, mouse
gagaatcagatccctttgac

SEQ ID NO: 563652 - DNA, 20 bp, mouse
ggattgcacgtggagctccg

SEQ ID NO: 563653 - DNA, 20 bp, mouse
ggacagggacgctgacctca

SEQ ID NO: 563654 - DNA, 20 bp, mouse
gcaggtgagggcgcaggcga

SEQ ID NO: 563655 - DNA, 20 bp, mouse
ggagctctgcacccaggtga

SEQ ID NO: 563656 - DNA, 20 bp, mouse
ggtttgaattcggggaggag

SEQ ID NO: 563657 - DNA, 20 bp, mouse
ggccgcgtttgaattcgggg

SEQ ID NO: 563658 - DNA, 20 bp, mouse
gcagccggcggcagtatgta

SEQ ID NO: 563659 - DNA, 20 bp, mouse
gccggcggcagtatgtacgg

SEQ ID NO: 563660 - DNA, 20 bp, mouse
gggcgctgggaacgttacaa

SEQ ID NO: 563661 - DNA, 20 bp, mouse
gagcgccgcgtttgaattcg

SEQ ID NO: 563662 - DNA, 20 bp, mouse
gcagaaggagaagatgtcta

SEQ ID NO: 563663 - DNA, 20 bp, mouse
gcaccgggaactgcatctcc

SEQ ID NO: 563664 - DNA, 20 bp, mouse
gtagcacaccaacacgtcgt

SEQ ID NO: 563665 - DNA, 20 bp, mouse
gttccgggagatgcagttcc

SEQ ID NO: 563666 - DNA, 20 bp, mouse
gaggatcctgtcagtagctc

SEQ ID NO: 563667 - DNA, 20 bp, mouse
ggtctgcctgagctactgac

SEQ ID NO: 563668 - DNA, 20 bp, mouse
ggagtccagggcggggatag

SEQ ID NO: 563669 - DNA, 20 bp, mouse
gagtgcagccgggacgggag

SEQ ID NO: 563670 - DNA, 20 bp, mouse
gagagtcgaatgagagtcca

SEQ ID NO: 563671 - DNA, 20 bp, mouse
ggcggaagtggccgatcaac

SEQ ID NO: 563672 - DNA, 20 bp, mouse
ggggaccctcgaggactgga

SEQ ID NO: 563673 - DNA, 20 bp, mouse
gcgaatgagagtccagggcg

SEQ ID NO: 563674 - DNA, 20 bp, mouse
ggaaccagtgcagccgggac

SEQ ID NO: 563675 - DNA, 20 bp, mouse
gtgccgccgctggcagtcac

SEQ ID NO: 563676 - DNA, 20 bp, mouse
gccctcgcggcattgccaca

SEQ ID NO: 563677 - DNA, 20 bp, mouse
gcaatgccgcgagggcgcgg

SEQ ID NO: 563678 - DNA, 20 bp, mouse
gtgcggccggaagtgagagt

SEQ ID NO: 563679 - DNA, 20 bp, mouse
gagtagctggggctcgccaa

SEQ ID NO: 563680 - DNA, 20 bp, mouse
gaggctctgcgggacaggta

SEQ ID NO: 563681 - DNA, 20 bp, mouse
gaagggcgcagaggtggcgg

SEQ ID NO: 563682 - DNA, 20 bp, mouse
gcaccgccaccgcgccctcg

SEQ ID NO: 563683 - DNA, 20 bp, mouse
gggacggggcagggagtcag

SEQ ID NO: 563684 - DNA, 20 bp, mouse
gcgtaccccgatgctctcag

SEQ ID NO: 563685 - DNA, 20 bp, mouse
ggcgcctagcggcctgaaga

SEQ ID NO: 563686 - DNA, 20 bp, mouse
ggacgtcagactagagagta

SEQ ID NO: 563687 - DNA, 20 bp, mouse
ggagagagactggtgctcga

SEQ ID NO: 563688 - DNA, 20 bp, mouse
ggactggtgctcgagggaca

SEQ ID NO: 563689 - DNA, 20 bp, mouse
gcgcctcggaggtggcaagt

SEQ ID NO: 563690 - DNA, 20 bp, mouse
ggcagcagccttctgaagat

SEQ ID NO: 563691 - DNA, 20 bp, mouse
gtatagtcgaccccacgacg

SEQ ID NO: 563692 - DNA, 20 bp, mouse
ggcaagtaggcagtgtcggg

SEQ ID NO: 563693 - DNA, 20 bp, mouse
ggagatctcgggtcccgagt

SEQ ID NO: 563694 - DNA, 20 bp, mouse
gtgcctacttgccacctccg

SEQ ID NO: 563695 - DNA, 20 bp, mouse
gaatttgaggaacagagggt

SEQ ID NO: 563696 - DNA, 20 bp, mouse
gatcgcagcgtagagaaacc

SEQ ID NO: 563697 - DNA, 20 bp, mouse
gtcatcaccgaccctctcag

SEQ ID NO: 563698 - DNA, 20 bp, mouse
ggcggccgtacctacaccaa

SEQ ID NO: 563699 - DNA, 20 bp, mouse
ggtacggccgctgagagggt

SEQ ID NO: 563700 - DNA, 20 bp, mouse
gcgatcgcgccagggcaagg

SEQ ID NO: 563701 - DNA, 20 bp, mouse
gtgtaggtacggccgctgag

SEQ ID NO: 563702 - DNA, 20 bp, mouse
gcgcctgccgagctggttct

SEQ ID NO: 563703 - DNA, 20 bp, mouse
gcacgggcgccggatcctcc

SEQ ID NO: 563704 - DNA, 20 bp, mouse
gaaggtgggtcggggctccg

SEQ ID NO: 563705 - DNA, 20 bp, mouse
gtccccgcgatcggaacctg

SEQ ID NO: 563706 - DNA, 20 bp, mouse
gaggcctcgggaggtaccgg

SEQ ID NO: 563707 - DNA, 20 bp, mouse
gcgccaccgaaaggtacccc

SEQ ID NO: 563708 - DNA, 20 bp, mouse
gtggctcgttcggagaccgg

SEQ ID NO: 563709 - DNA, 20 bp, mouse
gtttcaaaatgggagctccg

SEQ ID NO: 563710 - DNA, 20 bp, mouse
gtccgaacgagccagcctgg

SEQ ID NO: 563711 - DNA, 20 bp, mouse
gcgaggcctgggcggcgccc

SEQ ID NO: 563712 - DNA, 20 bp, mouse
ggtacccccggtacctcccg

SEQ ID NO: 563713 - DNA, 20 bp, mouse
gtgcatcggggagaggatcg

SEQ ID NO: 563714 - DNA, 20 bp, mouse
ggagctgagggaaggtccga

SEQ ID NO: 563715 - DNA, 20 bp, mouse
gggctggctcgttcggagac

SEQ ID NO: 563716 - DNA, 20 bp, mouse
ggctgctccccggctcagat

SEQ ID NO: 563717 - DNA, 20 bp, mouse
ggcgctgccgatctgagccg

SEQ ID NO: 563718 - DNA, 20 bp, mouse
ggatggagccccggtcccgg

SEQ ID NO: 563719 - DNA, 20 bp, mouse
ggcagatggagccccggtcc

SEQ ID NO: 563720 - DNA, 20 bp, mouse
gggaacggagagagttgagg

SEQ ID NO: 563721 - DNA, 20 bp, mouse
gggctccatctgcgcaggtt

SEQ ID NO: 563722 - DNA, 20 bp, mouse
ggcgccagctgtgcacccag

SEQ ID NO: 563723 - DNA, 20 bp, mouse
gctcagatcggcagcgctgc

SEQ ID NO: 563724 - DNA, 20 bp, mouse
gaccggggctccatctgcgc

SEQ ID NO: 563725 - DNA, 20 bp, mouse
gcgagttcaaagcgcgggaa

SEQ ID NO: 563726 - DNA, 20 bp, mouse
gtgtatgtggatacagtgtg

SEQ ID NO: 563727 - DNA, 20 bp, mouse
gtgtatgtaagtggtttata

SEQ ID NO: 563728 - DNA, 20 bp, mouse
gatatgggcgctgtatatct

SEQ ID NO: 563729 - DNA, 20 bp, mouse
gctgctctggcaaagtccgt

SEQ ID NO: 563730 - DNA, 20 bp, mouse
gtgtgcctggatactgtatg

SEQ ID NO: 563731 - DNA, 20 bp, mouse
ggtttgtaggtgtatgtaag

SEQ ID NO: 563732 - DNA, 20 bp, mouse
gctcctatacaggacagtga

SEQ ID NO: 563733 - DNA, 20 bp, mouse
gtggtgtgcagctagggtgt

SEQ ID NO: 563734 - DNA, 20 bp, mouse
gttctgtgtggatgctctgt

SEQ ID NO: 563735 - DNA, 20 bp, mouse
ggtccgtgagcttgtagcag

SEQ ID NO: 563736 - DNA, 20 bp, mouse
gagcgcggccagagcgtcgt

SEQ ID NO: 563737 - DNA, 20 bp, mouse
gggagccgcagtcgcagccc

SEQ ID NO: 563738 - DNA, 20 bp, mouse
gcgtaggctcgcgatcgcta

SEQ ID NO: 563739 - DNA, 20 bp, mouse
gagcgcgagcaccccaagag

SEQ ID NO: 563740 - DNA, 20 bp, mouse
gggtcgcagcgcagacacag

SEQ ID NO: 563741 - DNA, 20 bp, mouse
gcacctgtgagttctgtcta

SEQ ID NO: 563742 - DNA, 20 bp, mouse
gtcgcgagcctacgacgctc

SEQ ID NO: 563743 - DNA, 20 bp, mouse
ggccagggcacggtcccaga

SEQ ID NO: 563744 - DNA, 20 bp, mouse
gtggtgagccgggtagctcg

SEQ ID NO: 563745 - DNA, 20 bp, mouse
gaggctcgcgatcgctatgg

SEQ ID NO: 563746 - DNA, 20 bp, mouse
gatgatctcacgtcttacct

SEQ ID NO: 563747 - DNA, 20 bp, mouse
gcagctgctcccataaacct

SEQ ID NO: 563748 - DNA, 20 bp, mouse
gaagctgtatgaagtcttat

SEQ ID NO: 563749 - DNA, 20 bp, mouse
ggtgacgatcaccgaagcca

SEQ ID NO: 563750 - DNA, 20 bp, mouse
gtatatgctaatataatggg

SEQ ID NO: 563751 - DNA, 20 bp, mouse
gttatgggagcagctgcagt

SEQ ID NO: 563752 - DNA, 20 bp, mouse
gttagcatatatggtaggag

SEQ ID NO: 563753 - DNA, 20 bp, mouse
gttatattagcatatatggt

SEQ ID NO: 563754 - DNA, 20 bp, mouse
gggccacttatttacagctg

SEQ ID NO: 563755 - DNA, 20 bp, mouse
gtaaaacacagtgcaggacg

SEQ ID NO: 563756 - DNA, 20 bp, mouse
gagcagcagggaccgcatag

SEQ ID NO: 563757 - DNA, 20 bp, mouse
gagtctcgggaacaacccgc

SEQ ID NO: 563758 - DNA, 20 bp, mouse
ggaccgcatagcggagtctc

SEQ ID NO: 563759 - DNA, 20 bp, mouse
gggaatcccgaccccatgag

SEQ ID NO: 563760 - DNA, 20 bp, mouse
gtgtgctgcgggcagaggag

SEQ ID NO: 563761 - DNA, 20 bp, mouse
gctgctgctcctggccccgt

SEQ ID NO: 563762 - DNA, 20 bp, mouse
gttcccgagactccgctatg

SEQ ID NO: 563763 - DNA, 20 bp, mouse
gatctaccggagtcacccgc

SEQ ID NO: 563764 - DNA, 20 bp, mouse
gctagagggtgaggacgcgg

SEQ ID NO: 563765 - DNA, 20 bp, mouse
gctgcccgcagcacaaacct

SEQ ID NO: 563766 - DNA, 20 bp, mouse
gggtaccgaagagcacggag

SEQ ID NO: 563767 - DNA, 20 bp, mouse
gcggactgggaggactgcgt

SEQ ID NO: 563768 - DNA, 20 bp, mouse
ggcgtgggtaccgaagagca

SEQ ID NO: 563769 - DNA, 20 bp, mouse
gaggagagcagggcgagcat

SEQ ID NO: 563770 - DNA, 20 bp, mouse
gaggattgagcggacttcgg

SEQ ID NO: 563771 - DNA, 20 bp, mouse
gctggagcggagggcggact

SEQ ID NO: 563772 - DNA, 20 bp, mouse
ggagcgctgcgtgtagacag

SEQ ID NO: 563773 - DNA, 20 bp, mouse
ggagcggacgacggaaccgg

SEQ ID NO: 563774 - DNA, 20 bp, mouse
gcggcggtctagagagaact

SEQ ID NO: 563775 - DNA, 20 bp, mouse
ggagaggattgagcggactt

SEQ ID NO: 563776 - DNA, 20 bp, mouse
gcatggctagcagcacgctt

SEQ ID NO: 563777 - DNA, 20 bp, mouse
ggcacgcttaggctacaccc

SEQ ID NO: 563778 - DNA, 20 bp, mouse
gtcccggggcgtcggaatcc

SEQ ID NO: 563779 - DNA, 20 bp, mouse
ggtgctgctagccatggctg

SEQ ID NO: 563780 - DNA, 20 bp, mouse
gtcagcgccggtgcgggcct

SEQ ID NO: 563781 - DNA, 20 bp, mouse
ggcgccccggggtcgatcgg

SEQ ID NO: 563782 - DNA, 20 bp, mouse
gcggaggcagaagttacggg

SEQ ID NO: 563783 - DNA, 20 bp, mouse
gcacgtccgccagcctggaa

SEQ ID NO: 563784 - DNA, 20 bp, mouse
gtccgggcctgccgcagcca

SEQ ID NO: 563785 - DNA, 20 bp, mouse
ggacgccccgggaagattct

SEQ ID NO: 563786 - DNA, 20 bp, mouse
ggtcagagtgccaaagacat

SEQ ID NO: 563787 - DNA, 20 bp, mouse
gatgtactgccaggattcgt

SEQ ID NO: 563788 - DNA, 20 bp, mouse
gtggggctttgggtttccag

SEQ ID NO: 563789 - DNA, 20 bp, mouse
ggcatcaaagatgcaggcac

SEQ ID NO: 563790 - DNA, 20 bp, mouse
gcttttcattgcaggagaag

SEQ ID NO: 563791 - DNA, 20 bp, mouse
gaggcacaggagttcaactt

SEQ ID NO: 563792 - DNA, 20 bp, mouse
gaatcagggccttaagatcg

SEQ ID NO: 563793 - DNA, 20 bp, mouse
gactccagcatcaaagatgc

SEQ ID NO: 563794 - DNA, 20 bp, mouse
gcacaacctgaccataatca

SEQ ID NO: 563795 - DNA, 20 bp, mouse
ggggccttaagatcggggaa

SEQ ID NO: 563796 - DNA, 20 bp, mouse
gaagggggccccccgggcaa

SEQ ID NO: 563797 - DNA, 20 bp, mouse
gggcccccttcccggccaga

SEQ ID NO: 563798 - DNA, 20 bp, mouse
gccggccggaggttgggtag

SEQ ID NO: 563799 - DNA, 20 bp, mouse
gcccgccgtctggccgggaa

SEQ ID NO: 563800 - DNA, 20 bp, mouse
gagatgcagggcgttcggtg

SEQ ID NO: 563801 - DNA, 20 bp, mouse
gactgggtacgggactgtgg

SEQ ID NO: 563802 - DNA, 20 bp, mouse
gttgccagtgggatgcaggt

SEQ ID NO: 563803 - DNA, 20 bp, mouse
gtgttccccggccggaggtt

SEQ ID NO: 563804 - DNA, 20 bp, mouse
gcattccctcctttgcccgg

SEQ ID NO: 563805 - DNA, 20 bp, mouse
gaggctggaccactgggtac

SEQ ID NO: 563806 - DNA, 20 bp, mouse
gggaaagagctgccgaatag

SEQ ID NO: 563807 - DNA, 20 bp, mouse
gaagagctgccgaatagtgg

SEQ ID NO: 563808 - DNA, 20 bp, mouse
gggcgacgggccccaatctc

SEQ ID NO: 563809 - DNA, 20 bp, mouse
gagaaaacgccgccactatt

SEQ ID NO: 563810 - DNA, 20 bp, mouse
ggctggaggggtagactaaa

SEQ ID NO: 563811 - DNA, 20 bp, mouse
gagttccttcgctgctggag

SEQ ID NO: 563812 - DNA, 20 bp, mouse
ggaaccgcacgcctctactg

SEQ ID NO: 563813 - DNA, 20 bp, mouse
gtggtggtctcggcacgtcg

SEQ ID NO: 563814 - DNA, 20 bp, mouse
gctaaacggcggcgacatgg

SEQ ID NO: 563815 - DNA, 20 bp, mouse
gtacctggccgtctcctggg

SEQ ID NO: 563816 - DNA, 20 bp, mouse
ggacaggcacggctcaagac

SEQ ID NO: 563817 - DNA, 20 bp, mouse
gggcacggctcaagacaggt

SEQ ID NO: 563818 - DNA, 20 bp, mouse
ggaccatccaaggacaggca

SEQ ID NO: 563819 - DNA, 20 bp, mouse
gacttagcgcctggcagtca

SEQ ID NO: 563820 - DNA, 20 bp, mouse
gaggcgctaagtaagacctg

SEQ ID NO: 563821 - DNA, 20 bp, mouse
gaggatcagtgactcagacg

SEQ ID NO: 563822 - DNA, 20 bp, mouse
gagccgtgcctgtccttgga

SEQ ID NO: 563823 - DNA, 20 bp, mouse
gcttgagccgtgcctgtcct

SEQ ID NO: 563824 - DNA, 20 bp, mouse
gcttaggttgataagaagga

SEQ ID NO: 563825 - DNA, 20 bp, mouse
gttttgcacatgaccatcca

SEQ ID NO: 563826 - DNA, 20 bp, mouse
ggcggagcggaccagaccag

SEQ ID NO: 563827 - DNA, 20 bp, mouse
gcgcgagcgcaggagcaagg

SEQ ID NO: 563828 - DNA, 20 bp, mouse
gagtggcagccgcagcggag

SEQ ID NO: 563829 - DNA, 20 bp, mouse
gggtctggtccgctccgctg

SEQ ID NO: 563830 - DNA, 20 bp, mouse
gccgggcaggagctgccgaa

SEQ ID NO: 563831 - DNA, 20 bp, mouse
ggggtgagtggcagccgcag

SEQ ID NO: 563832 - DNA, 20 bp, mouse
gcggccgccgcaggtaccgg

SEQ ID NO: 563833 - DNA, 20 bp, mouse
gacccagcccccggtacctg

SEQ ID NO: 563834 - DNA, 20 bp, mouse
gggtacctgcggcggccgtt

SEQ ID NO: 563835 - DNA, 20 bp, mouse
gcagcccccggtacctgcgg

SEQ ID NO: 563836 - DNA, 20 bp, mouse
gcagctgcagagattcctag

SEQ ID NO: 563837 - DNA, 20 bp, mouse
gtccagcggctgaggaggaa

SEQ ID NO: 563838 - DNA, 20 bp, mouse
gctgtggtgggcaacaagtt

SEQ ID NO: 563839 - DNA, 20 bp, mouse
gagtcgcagagtcgctgatc

SEQ ID NO: 563840 - DNA, 20 bp, mouse
gggctgtagctggaaatgga

SEQ ID NO: 563841 - DNA, 20 bp, mouse
ggagctcccacccattccgt

SEQ ID NO: 563842 - DNA, 20 bp, mouse
ggcagttccaagggctcgag

SEQ ID NO: 563843 - DNA, 20 bp, mouse
gtcagacaacttctgcccct

SEQ ID NO: 563844 - DNA, 20 bp, mouse
gccgttggcgaggatcgccc

SEQ ID NO: 563845 - DNA, 20 bp, mouse
gtcctggtgagagcatctcc

SEQ ID NO: 563846 - DNA, 20 bp, mouse
gctagaggattcaggagtgc

SEQ ID NO: 563847 - DNA, 20 bp, mouse
gccctctgcgagggaaagcc

SEQ ID NO: 563848 - DNA, 20 bp, mouse
ggcccggctttccctcgcag

SEQ ID NO: 563849 - DNA, 20 bp, mouse
ggagtgagtcccctctgcga

SEQ ID NO: 563850 - DNA, 20 bp, mouse
gggcctctgggcgcagctag

SEQ ID NO: 563851 - DNA, 20 bp, mouse
gactgcagcgccaccagcaa

SEQ ID NO: 563852 - DNA, 20 bp, mouse
ggcgccaccagcaagggatt

SEQ ID NO: 563853 - DNA, 20 bp, mouse
gaggagccgggtacggtgat

SEQ ID NO: 563854 - DNA, 20 bp, mouse
gagtcccaatcccttgctgg

SEQ ID NO: 563855 - DNA, 20 bp, mouse
gtggtggcgctgcagtagcc

SEQ ID NO: 563856 - DNA, 20 bp, mouse
gagcagctaacaattctcaa

SEQ ID NO: 563857 - DNA, 20 bp, mouse
gaggacttagaactcagaca

SEQ ID NO: 563858 - DNA, 20 bp, mouse
gtctactgagagcctctgcc

SEQ ID NO: 563859 - DNA, 20 bp, mouse
ggagaattgttagctgctcc

SEQ ID NO: 563860 - DNA, 20 bp, mouse
gctccagactcctctcagaa

SEQ ID NO: 563861 - DNA, 20 bp, mouse
gactcctctcagaaaggcat

SEQ ID NO: 563862 - DNA, 20 bp, mouse
gctgctggtgctaggattct

SEQ ID NO: 563863 - DNA, 20 bp, mouse
gctcagtagaaatgaatatc

SEQ ID NO: 563864 - DNA, 20 bp, mouse
gccctgcgaagagaaatctg

SEQ ID NO: 563865 - DNA, 20 bp, mouse
gctgggtccggtgaaggtca

SEQ ID NO: 563866 - DNA, 20 bp, mouse
gtacgggcccagggtctcta

SEQ ID NO: 563867 - DNA, 20 bp, mouse
gggtgagccggaccatagag

SEQ ID NO: 563868 - DNA, 20 bp, mouse
ggcccccagaataagtcggg

SEQ ID NO: 563869 - DNA, 20 bp, mouse
gggccccccgacttattctg

SEQ ID NO: 563870 - DNA, 20 bp, mouse
gtgaagcccccagaataagt

SEQ ID NO: 563871 - DNA, 20 bp, mouse
ggggcggcacctaagactcg

SEQ ID NO: 563872 - DNA, 20 bp, mouse
gcacgcactccggggctcac

SEQ ID NO: 563873 - DNA, 20 bp, mouse
gggtggctccccaggaggaa

SEQ ID NO: 563874 - DNA, 20 bp, mouse
gagtctccttaacccctcta

SEQ ID NO: 563875 - DNA, 20 bp, mouse
gtctggagtgggacaagctc

SEQ ID NO: 563876 - DNA, 20 bp, mouse
ggcgcctctcgccttccccc

SEQ ID NO: 563877 - DNA, 20 bp, mouse
gagctgggacgatccacgcg

SEQ ID NO: 563878 - DNA, 20 bp, mouse
gcccgccaccagcagaggag

SEQ ID NO: 563879 - DNA, 20 bp, mouse
ggcgggctccgtgacagtgg

SEQ ID NO: 563880 - DNA, 20 bp, mouse
gggctccgtgacagtggagg

SEQ ID NO: 563881 - DNA, 20 bp, mouse
gctcactcagaaccacaact

SEQ ID NO: 563882 - DNA, 20 bp, mouse
gcgtgacagtggaggaggcg

SEQ ID NO: 563883 - DNA, 20 bp, mouse
gcagctgcgggcggtgagag

SEQ ID NO: 563884 - DNA, 20 bp, mouse
gatccacgcggggcagccgg

SEQ ID NO: 563885 - DNA, 20 bp, mouse
gtgctgggtgaaggctctat

SEQ ID NO: 563886 - DNA, 20 bp, mouse
ggaggcgggctgcaagcgac

SEQ ID NO: 563887 - DNA, 20 bp, mouse
gtctgcaagctgacatgagg

SEQ ID NO: 563888 - DNA, 20 bp, mouse
gcaaaggcagccaggtgaaa

SEQ ID NO: 563889 - DNA, 20 bp, mouse
gagtctgagtacttcttcaa

SEQ ID NO: 563890 - DNA, 20 bp, mouse
gactactggggtacaatcaa

SEQ ID NO: 563891 - DNA, 20 bp, mouse
gccatggcctcgaaaggtaa

SEQ ID NO: 563892 - DNA, 20 bp, mouse
gtacaagtgcatgactactg

SEQ ID NO: 563893 - DNA, 20 bp, mouse
gagactgccatggcctcgaa

SEQ ID NO: 563894 - DNA, 20 bp, mouse
ggctctcttcgtgttgaaac

SEQ ID NO: 563895 - DNA, 20 bp, mouse
gagaagtactcagactgcca

SEQ ID NO: 563896 - DNA, 20 bp, mouse
gttagtagtgtggtcacgtg

SEQ ID NO: 563897 - DNA, 20 bp, mouse
gagggtctggggatgcgatg

SEQ ID NO: 563898 - DNA, 20 bp, mouse
ggcagcgcgggggatccggg

SEQ ID NO: 563899 - DNA, 20 bp, mouse
gaggggagcggagggactca

SEQ ID NO: 563900 - DNA, 20 bp, mouse
gcggaggcccagacttataa

SEQ ID NO: 563901 - DNA, 20 bp, mouse
gtaggagctaggggagcgga

SEQ ID NO: 563902 - DNA, 20 bp, mouse
gtgagccacacaactcacga

SEQ ID NO: 563903 - DNA, 20 bp, mouse
ggcggagtcttaggagctag

SEQ ID NO: 563904 - DNA, 20 bp, mouse
gcgtggggcgacaggcagcg

SEQ ID NO: 563905 - DNA, 20 bp, mouse
ggaaggagggctccgggatg

SEQ ID NO: 563906 - DNA, 20 bp, mouse
ggtccacagggcgcactgtc

SEQ ID NO: 563907 - DNA, 20 bp, mouse
ggtcccccgtgcgggcgtat

SEQ ID NO: 563908 - DNA, 20 bp, mouse
gcatttgcgcagtgtccaca

SEQ ID NO: 563909 - DNA, 20 bp, mouse
ggcgcaaatggggctctcca

SEQ ID NO: 563910 - DNA, 20 bp, mouse
ggcgtatgggctgcggtcca

SEQ ID NO: 563911 - DNA, 20 bp, mouse
ggcctggcgcagttcagatc

SEQ ID NO: 563912 - DNA, 20 bp, mouse
gctgtcggcgcggatctccg

SEQ ID NO: 563913 - DNA, 20 bp, mouse
gtgaactgcgccaggcaggg

SEQ ID NO: 563914 - DNA, 20 bp, mouse
gcgtgcgggcgtatgggctg

SEQ ID NO: 563915 - DNA, 20 bp, mouse
gaaggcgacctggtaagagg

SEQ ID NO: 563916 - DNA, 20 bp, mouse
gagcgggagcggagcgggca

SEQ ID NO: 563917 - DNA, 20 bp, mouse
ggggcagggcgagcgaagca

SEQ ID NO: 563918 - DNA, 20 bp, mouse
gctcaggacgccagggatag

SEQ ID NO: 563919 - DNA, 20 bp, mouse
gtccttccgacagcagtagg

SEQ ID NO: 563920 - DNA, 20 bp, mouse
ggtgcgcacacagagaaagt

SEQ ID NO: 563921 - DNA, 20 bp, mouse
gggctgggcgagcggggagc

SEQ ID NO: 563922 - DNA, 20 bp, mouse
ggtgggcgcggacgacctcc

SEQ ID NO: 563923 - DNA, 20 bp, mouse
gctcccgcccgcgctcccca

SEQ ID NO: 563924 - DNA, 20 bp, mouse
gagacccgccagcgggacct

SEQ ID NO: 563925 - DNA, 20 bp, mouse
gtaggacgcgcggccagggc

SEQ ID NO: 563926 - DNA, 20 bp, mouse
ggaggtggctccgaacgccg

SEQ ID NO: 563927 - DNA, 20 bp, mouse
gaagagagcccctccgggct

SEQ ID NO: 563928 - DNA, 20 bp, mouse
gacctcctgcctagcccgga

SEQ ID NO: 563929 - DNA, 20 bp, mouse
gcctccgccaccaaactcct

SEQ ID NO: 563930 - DNA, 20 bp, mouse
gccgcggagccccaggagtt

SEQ ID NO: 563931 - DNA, 20 bp, mouse
gcgcccgcagccggagggat

SEQ ID NO: 563932 - DNA, 20 bp, mouse
gccggaggggctctcttacc

SEQ ID NO: 563933 - DNA, 20 bp, mouse
gtggtgttcccgagagaagg

SEQ ID NO: 563934 - DNA, 20 bp, mouse
gcattcccggctctactctc

SEQ ID NO: 563935 - DNA, 20 bp, mouse
gcccgagagaaggaggttag

SEQ ID NO: 563936 - DNA, 20 bp, mouse
gacgcagccacgcagcggag

SEQ ID NO: 563937 - DNA, 20 bp, mouse
gacgcagcggagcggagccc

SEQ ID NO: 563938 - DNA, 20 bp, mouse
ggccgctgcccagcatgaat

SEQ ID NO: 563939 - DNA, 20 bp, mouse
gtcagcgccccattcatgct

SEQ ID NO: 563940 - DNA, 20 bp, mouse
ggggacgcggcagcccatag

SEQ ID NO: 563941 - DNA, 20 bp, mouse
gcccggccactcgggacccc

SEQ ID NO: 563942 - DNA, 20 bp, mouse
ggtccccgcgcacacccccc

SEQ ID NO: 563943 - DNA, 20 bp, mouse
gtgggcggcctgcgcggcgt

SEQ ID NO: 563944 - DNA, 20 bp, mouse
gggcacggcgctccgcgggg

SEQ ID NO: 563945 - DNA, 20 bp, mouse
gcccgccgctcgcccctctg

SEQ ID NO: 563946 - DNA, 20 bp, mouse
ggtccgcgcagagccgagtg

SEQ ID NO: 563947 - DNA, 20 bp, mouse
ggcgcagagccgagtggggg

SEQ ID NO: 563948 - DNA, 20 bp, mouse
gtgctccagccgcccccact

SEQ ID NO: 563949 - DNA, 20 bp, mouse
ggcggttcctggaggaaata

SEQ ID NO: 563950 - DNA, 20 bp, mouse
ggtcccgcagggtccctccg

SEQ ID NO: 563951 - DNA, 20 bp, mouse
gtgcctgacgggagtcacac

SEQ ID NO: 563952 - DNA, 20 bp, mouse
ggacgagcgatcagatctgg

SEQ ID NO: 563953 - DNA, 20 bp, mouse
ggacgcgaggaaccattcgg

SEQ ID NO: 563954 - DNA, 20 bp, mouse
ggacagtgctgcgcgcagcg

SEQ ID NO: 563955 - DNA, 20 bp, mouse
ggaagacgagcgatcagatc

SEQ ID NO: 563956 - DNA, 20 bp, mouse
gaggctgcggggccaagcga

SEQ ID NO: 563957 - DNA, 20 bp, mouse
gtcgcggtggagggacaggt

SEQ ID NO: 563958 - DNA, 20 bp, mouse
gagcctggtctggagaggta

SEQ ID NO: 563959 - DNA, 20 bp, mouse
gctgcggggccaagcgaggg

SEQ ID NO: 563960 - DNA, 20 bp, mouse
ggcgccaatagtctgctgga

SEQ ID NO: 563961 - DNA, 20 bp, mouse
gcgcaggccagcccagtgtg

SEQ ID NO: 563962 - DNA, 20 bp, mouse
gggccaccccgagtcagtcg

SEQ ID NO: 563963 - DNA, 20 bp, mouse
gtcagtcgcggtggagggac

SEQ ID NO: 563964 - DNA, 20 bp, mouse
gctcagggtgcccccattgg

SEQ ID NO: 563965 - DNA, 20 bp, mouse
gatagtctgctggatggcag

SEQ ID NO: 563966 - DNA, 20 bp, mouse
gcagcagcagcgagccgcgg

SEQ ID NO: 563967 - DNA, 20 bp, mouse
ggcacagcagcagcgagccg

SEQ ID NO: 563968 - DNA, 20 bp, mouse
gccggcggcggccgagccag

SEQ ID NO: 563969 - DNA, 20 bp, mouse
gagccgccggcagctccccg

SEQ ID NO: 563970 - DNA, 20 bp, mouse
gagggaggcgcgcagaggat

SEQ ID NO: 563971 - DNA, 20 bp, mouse
ggcagctccgcgcctccccg

SEQ ID NO: 563972 - DNA, 20 bp, mouse
gtggccgtcactgcccaggg

SEQ ID NO: 563973 - DNA, 20 bp, mouse
ggggctgcctgctgccgccg

SEQ ID NO: 563974 - DNA, 20 bp, mouse
gcgccggcagctccccgggg

SEQ ID NO: 563975 - DNA, 20 bp, mouse
gtgctcgcaaagtttgcagg

SEQ ID NO: 563976 - DNA, 20 bp, mouse
gatcccgcaggagggtcggg

SEQ ID NO: 563977 - DNA, 20 bp, mouse
ggctagcccggagctgcggg

SEQ ID NO: 563978 - DNA, 20 bp, mouse
ggcgcatcccgcaggagggt

SEQ ID NO: 563979 - DNA, 20 bp, mouse
ggcggtgagttgcgagactt

SEQ ID NO: 563980 - DNA, 20 bp, mouse
ggcgcgaaggcaaactctgg

SEQ ID NO: 563981 - DNA, 20 bp, mouse
gtcaccgcccgaccctcctg

SEQ ID NO: 563982 - DNA, 20 bp, mouse
gccgcgcgcatcccgcagga

SEQ ID NO: 563983 - DNA, 20 bp, mouse
gctgttacccggagaccgag

SEQ ID NO: 563984 - DNA, 20 bp, mouse
gcgcgcgcgaaggcaaactc

SEQ ID NO: 563985 - DNA, 20 bp, mouse
gctgcctccgctgggaacaa

SEQ ID NO: 563986 - DNA, 20 bp, mouse
gccccggcgccatcgaacga

SEQ ID NO: 563987 - DNA, 20 bp, mouse
ggcctcgtcgccaatcgggg

SEQ ID NO: 563988 - DNA, 20 bp, mouse
gtcggggacgggaactgtgg

SEQ ID NO: 563989 - DNA, 20 bp, mouse
gcgccatcgaacgacggctg

SEQ ID NO: 563990 - DNA, 20 bp, mouse
gcatcgaacgacggctgcgg

SEQ ID NO: 563991 - DNA, 20 bp, mouse
gcggagcgcaacgcagagcg

SEQ ID NO: 563992 - DNA, 20 bp, mouse
gggagcaggtacggcactcg

SEQ ID NO: 563993 - DNA, 20 bp, mouse
gtccctgtcccagaaggtgt

SEQ ID NO: 563994 - DNA, 20 bp, mouse
ggcaggccgaggccgagtgg

SEQ ID NO: 563995 - DNA, 20 bp, mouse
gcaggtacggcactcgggga

SEQ ID NO: 563996 - DNA, 20 bp, mouse
gcctcacatcagctgcctca

SEQ ID NO: 563997 - DNA, 20 bp, mouse
gcagacacttaccaccacta

SEQ ID NO: 563998 - DNA, 20 bp, mouse
gcactacggagtgcagaaat

SEQ ID NO: 563999 - DNA, 20 bp, mouse
gatcagctgcctcagggcag

SEQ ID NO: 564000 - DNA, 20 bp, mouse
ggcctcagggcagtggcgac

SEQ ID NO: 564001 - DNA, 20 bp, mouse
gctctgtcacagcgatacat

SEQ ID NO: 564002 - DNA, 20 bp, mouse
gcagaggtgggtgtgtgtaa

SEQ ID NO: 564003 - DNA, 20 bp, mouse
gagtggcgacgggcacaaga

SEQ ID NO: 564004 - DNA, 20 bp, mouse
gctgggccctatgtccccca

SEQ ID NO: 564005 - DNA, 20 bp, mouse
ggcgtagagctctagaaaga

SEQ ID NO: 564006 - DNA, 20 bp, mouse
ggccgcacagaggaactctc

SEQ ID NO: 564007 - DNA, 20 bp, mouse
gccggcgaaggcggacgagg

SEQ ID NO: 564008 - DNA, 20 bp, mouse
gaggaactctccggcgaagg

SEQ ID NO: 564009 - DNA, 20 bp, mouse
gtctccggcgaaggcggacg

SEQ ID NO: 564010 - DNA, 20 bp, mouse
gccggcagcctgtgccgcgg

SEQ ID NO: 564011 - DNA, 20 bp, mouse
ggctccggcagcctgtgccg

SEQ ID NO: 564012 - DNA, 20 bp, mouse
gcagaggaactctccggcga

SEQ ID NO: 564013 - DNA, 20 bp, mouse
gagcgtctccggagcgcgca

SEQ ID NO: 564014 - DNA, 20 bp, mouse
gccagcagataggcgatcag

SEQ ID NO: 564015 - DNA, 20 bp, mouse
ggcgcgcggcgggctcgctc

SEQ ID NO: 564016 - DNA, 20 bp, mouse
ggcggcgcgacgagccatcc

SEQ ID NO: 564017 - DNA, 20 bp, mouse
gcggcggcccgggcgctagg

SEQ ID NO: 564018 - DNA, 20 bp, mouse
gcagcccgcgctcgcctgga

SEQ ID NO: 564019 - DNA, 20 bp, mouse
ggtgcccgccgtgccgtcca

SEQ ID NO: 564020 - DNA, 20 bp, mouse
gaccagggccccgcgagtga

SEQ ID NO: 564021 - DNA, 20 bp, mouse
ggagccatccaggcgagcgc

SEQ ID NO: 564022 - DNA, 20 bp, mouse
gaaacggcgctggatctcta

SEQ ID NO: 564023 - DNA, 20 bp, mouse
gcgcggcgcggcgagtgcat

SEQ ID NO: 564024 - DNA, 20 bp, mouse
ggcgggcaccgtgtacttgg

SEQ ID NO: 564025 - DNA, 20 bp, mouse
gccgtccagggcgaagttgt

SEQ ID NO: 564026 - DNA, 20 bp, mouse
ggaccgtagcgaaaaagaga

SEQ ID NO: 564027 - DNA, 20 bp, mouse
gctcagatctgagaacaagg

SEQ ID NO: 564028 - DNA, 20 bp, mouse
gaggagcacagctgcccagg

SEQ ID NO: 564029 - DNA, 20 bp, mouse
gcgcgtccctcagcagaggg

SEQ ID NO: 564030 - DNA, 20 bp, mouse
gcttgctagcttgcccgcct

SEQ ID NO: 564031 - DNA, 20 bp, mouse
gcttctagggccagtggatc

SEQ ID NO: 564032 - DNA, 20 bp, mouse
gtccctgcttctagggccag

SEQ ID NO: 564033 - DNA, 20 bp, mouse
ggagcctctaggctaggcaa

SEQ ID NO: 564034 - DNA, 20 bp, mouse
ggagagaagctggagcctct

SEQ ID NO: 564035 - DNA, 20 bp, mouse
gagagggaggtaggccctct

SEQ ID NO: 564036 - DNA, 20 bp, mouse
ggcgccgccgagcctcgcag

SEQ ID NO: 564037 - DNA, 20 bp, mouse
ggcctcgcagagggcggacg

SEQ ID NO: 564038 - DNA, 20 bp, mouse
gcgccgagcctcgcagaggg

SEQ ID NO: 564039 - DNA, 20 bp, mouse
gcgctccaccaccggaccca

SEQ ID NO: 564040 - DNA, 20 bp, mouse
ggcccgcgccatgggtccgg

SEQ ID NO: 564041 - DNA, 20 bp, mouse
gcggccggccgctccaccac

SEQ ID NO: 564042 - DNA, 20 bp, mouse
gcaccaccggacccatggcg

SEQ ID NO: 564043 - DNA, 20 bp, mouse
gcacgcccgcgccatgggtc

SEQ ID NO: 564044 - DNA, 20 bp, mouse
gtgcgcgcggtgctcttcgt

SEQ ID NO: 564045 - DNA, 20 bp, mouse
gttcagcagctccagctcgg

SEQ ID NO: 564046 - DNA, 20 bp, mouse
gagacgcaccgagcttcagt

SEQ ID NO: 564047 - DNA, 20 bp, mouse
gctggggcgcctgaacagag

SEQ ID NO: 564048 - DNA, 20 bp, mouse
gcagtggcgcccgtcaggag

SEQ ID NO: 564049 - DNA, 20 bp, mouse
gggtgctgcctactgaagct

SEQ ID NO: 564050 - DNA, 20 bp, mouse
ggcgccagtgaacccaacgc

SEQ ID NO: 564051 - DNA, 20 bp, mouse
gctgttcaggcgccccagac

SEQ ID NO: 564052 - DNA, 20 bp, mouse
gcgctgcgcacgggagacta

SEQ ID NO: 564053 - DNA, 20 bp, mouse
gttctagcccgagccccgaa

SEQ ID NO: 564054 - DNA, 20 bp, mouse
gtcgccgcggcgccgaccta

SEQ ID NO: 564055 - DNA, 20 bp, mouse
ggcccgcggacacccaggca

SEQ ID NO: 564056 - DNA, 20 bp, mouse
gtccagagaaggggcgacaa

SEQ ID NO: 564057 - DNA, 20 bp, mouse
gttatgcaagcatcaaacta

SEQ ID NO: 564058 - DNA, 20 bp, mouse
gaaagccagcattaacatgt

SEQ ID NO: 564059 - DNA, 20 bp, mouse
gcatccaatgcactcttgtt

SEQ ID NO: 564060 - DNA, 20 bp, mouse
gttgtattgttccagagaag

SEQ ID NO: 564061 - DNA, 20 bp, mouse
ggtggggatcatttagccac

SEQ ID NO: 564062 - DNA, 20 bp, mouse
gtccgttgtcgccccttctc

SEQ ID NO: 564063 - DNA, 20 bp, mouse
gaactttcacactctgccag

SEQ ID NO: 564064 - DNA, 20 bp, mouse
ggataagatggagaaatacc

SEQ ID NO: 564065 - DNA, 20 bp, mouse
gtatttaatacatttcgaat

SEQ ID NO: 564066 - DNA, 20 bp, mouse
ggagcactcagcacaagcac

SEQ ID NO: 564067 - DNA, 20 bp, mouse
gctggcaagaggaccactat

SEQ ID NO: 564068 - DNA, 20 bp, mouse
gactcagcacaagcacggga

SEQ ID NO: 564069 - DNA, 20 bp, mouse
gcactatgggtgtccagaga

SEQ ID NO: 564070 - DNA, 20 bp, mouse
gcagcagccaaaggtaccag

SEQ ID NO: 564071 - DNA, 20 bp, mouse
gtcccaccccctggtacctt

SEQ ID NO: 564072 - DNA, 20 bp, mouse
gtggctgtgggggccctaga

SEQ ID NO: 564073 - DNA, 20 bp, mouse
gcacccacactcaccttcta

SEQ ID NO: 564074 - DNA, 20 bp, mouse
gagccaaaggtaccaggggg

SEQ ID NO: 564075 - DNA, 20 bp, mouse
gacctttggctgctggcaag

SEQ ID NO: 564076 - DNA, 20 bp, mouse
ggacttgaatgaggagcggg

SEQ ID NO: 564077 - DNA, 20 bp, mouse
gcggcgcaacccgatctcct

SEQ ID NO: 564078 - DNA, 20 bp, mouse
gcttggacttgaatgaggag

SEQ ID NO: 564079 - DNA, 20 bp, mouse
gattcaagtccaaggagatc

SEQ ID NO: 564080 - DNA, 20 bp, mouse
gctcgcctcggggacctcgg

SEQ ID NO: 564081 - DNA, 20 bp, mouse
ggcggtcggaggcaggcaga

SEQ ID NO: 564082 - DNA, 20 bp, mouse
gctgacgtcagcgctagacg

SEQ ID NO: 564083 - DNA, 20 bp, mouse
gttgaatgaggagcgggcgg

SEQ ID NO: 564084 - DNA, 20 bp, mouse
gtgcacgcgcaggagacatt

SEQ ID NO: 564085 - DNA, 20 bp, mouse
gcgcgcccgcggtcggaggc

SEQ ID NO: 564086 - DNA, 20 bp, mouse
gtagcgaggctgcggaaagg

SEQ ID NO: 564087 - DNA, 20 bp, mouse
gccgcggcgagaggtttcag

SEQ ID NO: 564088 - DNA, 20 bp, mouse
gctagtcgccgacaggaggt

SEQ ID NO: 564089 - DNA, 20 bp, mouse
gtggcggttcaatttcaaca

SEQ ID NO: 564090 - DNA, 20 bp, mouse
gcctggcacagcttccggag

SEQ ID NO: 564091 - DNA, 20 bp, mouse
gaggtaggtggcgaccaatg

SEQ ID NO: 564092 - DNA, 20 bp, mouse
gagatagcgaggctgcggaa

SEQ ID NO: 564093 - DNA, 20 bp, mouse
gacgcttggcgcagtcacgt

SEQ ID NO: 564094 - DNA, 20 bp, mouse
gtccaatcggaggtcctgtt

SEQ ID NO: 564095 - DNA, 20 bp, mouse
gctgcagggccagtttattt

SEQ ID NO: 564096 - DNA, 20 bp, mouse
gttcttcttggcttatatta

SEQ ID NO: 564097 - DNA, 20 bp, mouse
gtggcttatattagggatgg

SEQ ID NO: 564098 - DNA, 20 bp, mouse
gtcttggcttatattaggga

SEQ ID NO: 564099 - DNA, 20 bp, mouse
gagctatgaggtgtagaact

SEQ ID NO: 564100 - DNA, 20 bp, mouse
ggtgtaagtacggggtgatg

SEQ ID NO: 564101 - DNA, 20 bp, mouse
ggtactggtgtgtaagtacg

SEQ ID NO: 564102 - DNA, 20 bp, mouse
gcagacacttacctgcagaa

SEQ ID NO: 564103 - DNA, 20 bp, mouse
gagcccagcttgccatggtg

SEQ ID NO: 564104 - DNA, 20 bp, mouse
gatgttcttaactagagggt

SEQ ID NO: 564105 - DNA, 20 bp, mouse
ggtcatagtggtcaaatgag

SEQ ID NO: 564106 - DNA, 20 bp, mouse
gggtagggcccggggaagtt

SEQ ID NO: 564107 - DNA, 20 bp, mouse
gagggcccggggaagttcgg

SEQ ID NO: 564108 - DNA, 20 bp, mouse
gcgaacaaggagccccaggt

SEQ ID NO: 564109 - DNA, 20 bp, mouse
gggggaagttcggtggatct

SEQ ID NO: 564110 - DNA, 20 bp, mouse
gtctagtggcttcctacctg

SEQ ID NO: 564111 - DNA, 20 bp, mouse
gggattctgggtagggcccg

SEQ ID NO: 564112 - DNA, 20 bp, mouse
gttcactcaatgacagatcc

SEQ ID NO: 564113 - DNA, 20 bp, mouse
gggagccctatagccactgt

SEQ ID NO: 564114 - DNA, 20 bp, mouse
gcagaggataggatgagcag

SEQ ID NO: 564115 - DNA, 20 bp, mouse
gaggataggatgagcagtgg

SEQ ID NO: 564116 - DNA, 20 bp, mouse
gtgtcgacagggagatccag

SEQ ID NO: 564117 - DNA, 20 bp, mouse
ggccctgcagaggtactact

SEQ ID NO: 564118 - DNA, 20 bp, mouse
ggtctgtgaaggcgggaaat

SEQ ID NO: 564119 - DNA, 20 bp, mouse
gcacagacctaatcaagaaa

SEQ ID NO: 564120 - DNA, 20 bp, mouse
ggaggtactactgggttaga

SEQ ID NO: 564121 - DNA, 20 bp, mouse
gcagtttccatttcttgatt

SEQ ID NO: 564122 - DNA, 20 bp, mouse
gctactgggttagaaggtgt

SEQ ID NO: 564123 - DNA, 20 bp, mouse
gtagaaggtgtagggctatt

SEQ ID NO: 564124 - DNA, 20 bp, mouse
gagaaggtacctgcaccccc

SEQ ID NO: 564125 - DNA, 20 bp, mouse
gacccagtagtacctctgca

SEQ ID NO: 564126 - DNA, 20 bp, mouse
gtcgcacgcgaccctggcgg

SEQ ID NO: 564127 - DNA, 20 bp, mouse
ggcgcgcggagctacagcca

SEQ ID NO: 564128 - DNA, 20 bp, mouse
gttcctgcgggcgccctcga

SEQ ID NO: 564129 - DNA, 20 bp, mouse
gctgtcgcacgcgaccctgg

SEQ ID NO: 564130 - DNA, 20 bp, mouse
gccctcgacggcgactgcca

SEQ ID NO: 564131 - DNA, 20 bp, mouse
gtggctgcagcgacagcgct

SEQ ID NO: 564132 - DNA, 20 bp, mouse
ggccatggcagtcgccgtcg

SEQ ID NO: 564133 - DNA, 20 bp, mouse
gtgcgttgacatggcagtga

SEQ ID NO: 564134 - DNA, 20 bp, mouse
gggcctgggtcccatctcct

SEQ ID NO: 564135 - DNA, 20 bp, mouse
gcctctgtcgcacgcgaccc

SEQ ID NO: 564136 - DNA, 20 bp, mouse
gctgtctcttcgacatggat

SEQ ID NO: 564137 - DNA, 20 bp, mouse
gagggcccgagaagaaactc

SEQ ID NO: 564138 - DNA, 20 bp, mouse
gtgggaccctgactgccccg

SEQ ID NO: 564139 - DNA, 20 bp, mouse
gtgcggtcgaggtttctgac

SEQ ID NO: 564140 - DNA, 20 bp, mouse
ggaagttccgggtagagttc

SEQ ID NO: 564141 - DNA, 20 bp, mouse
gacctgccgcggggcagtca

SEQ ID NO: 564142 - DNA, 20 bp, mouse
gagagttcctggtgcggtcg

SEQ ID NO: 564143 - DNA, 20 bp, mouse
gccaccaccgcgagcctccc

SEQ ID NO: 564144 - DNA, 20 bp, mouse
ggagcggacccggaagttcc

SEQ ID NO: 564145 - DNA, 20 bp, mouse
gactctctgtctcttcgaca

SEQ ID NO: 564146 - DNA, 20 bp, mouse
gcgatgattgagcccttctt

SEQ ID NO: 564147 - DNA, 20 bp, mouse
gacagctttctgggcagacc

SEQ ID NO: 564148 - DNA, 20 bp, mouse
gaccgaaaaccatgaagtgt

SEQ ID NO: 564149 - DNA, 20 bp, mouse
gtcatcgtgcacagctttct

SEQ ID NO: 564150 - DNA, 20 bp, mouse
gctcagatgagtataaccca

SEQ ID NO: 564151 - DNA, 20 bp, mouse
gagtttccaggtgcctaaga

SEQ ID NO: 564152 - DNA, 20 bp, mouse
gagaattacgtgagagaact

SEQ ID NO: 564153 - DNA, 20 bp, mouse
gcagtatgacgaccttccag

SEQ ID NO: 564154 - DNA, 20 bp, mouse
gctcagtgaaatgatctaag

SEQ ID NO: 564155 - DNA, 20 bp, mouse
ggggtgagagacaccattac

SEQ ID NO: 564156 - DNA, 20 bp, mouse
ggcgcgcgcgcaaagcaagg

SEQ ID NO: 564157 - DNA, 20 bp, mouse
gggggacgccagcaacccag

SEQ ID NO: 564158 - DNA, 20 bp, mouse
gtagcctcaggcacaaactc

SEQ ID NO: 564159 - DNA, 20 bp, mouse
gagcaacccagtggacgcac

SEQ ID NO: 564160 - DNA, 20 bp, mouse
gcacaaggcggccctatgga

SEQ ID NO: 564161 - DNA, 20 bp, mouse
gaaactccggtgcgtccact

SEQ ID NO: 564162 - DNA, 20 bp, mouse
gcccgcagcacagctgtctt

SEQ ID NO: 564163 - DNA, 20 bp, mouse
gctcagagcagattagcctc

SEQ ID NO: 564164 - DNA, 20 bp, mouse
gctaccggagggacacacct

SEQ ID NO: 564165 - DNA, 20 bp, mouse
gctccggtaggctaggatgt

SEQ ID NO: 564166 - DNA, 20 bp, mouse
ggagttgggctcgggatcag

SEQ ID NO: 564167 - DNA, 20 bp, mouse
gaacaagagtaggagcatgg

SEQ ID NO: 564168 - DNA, 20 bp, mouse
gcaggatccccaacaagagt

SEQ ID NO: 564169 - DNA, 20 bp, mouse
gagcatggtggctgggagtt

SEQ ID NO: 564170 - DNA, 20 bp, mouse
ggagcggtgcctgctgagag

SEQ ID NO: 564171 - DNA, 20 bp, mouse
gcccaacaagagtaggagca

SEQ ID NO: 564172 - DNA, 20 bp, mouse
gtggcaacctggggaagcac

SEQ ID NO: 564173 - DNA, 20 bp, mouse
gagacagctggacataccag

SEQ ID NO: 564174 - DNA, 20 bp, mouse
gactccagtttggcaacctg

SEQ ID NO: 564175 - DNA, 20 bp, mouse
gaaagttaggccagcatcag

SEQ ID NO: 564176 - DNA, 20 bp, mouse
ggcgatggcgacggcagtgt

SEQ ID NO: 564177 - DNA, 20 bp, mouse
gcggctgcttcggggatctg

SEQ ID NO: 564178 - DNA, 20 bp, mouse
gatggcgacggcagtgtggg

SEQ ID NO: 564179 - DNA, 20 bp, mouse
gcgcggcggcgcgatggcga

SEQ ID NO: 564180 - DNA, 20 bp, mouse
gctcgcaccgagacaggcct

SEQ ID NO: 564181 - DNA, 20 bp, mouse
gggaagtgaccgcagaagcg

SEQ ID NO: 564182 - DNA, 20 bp, mouse
gggtgagccgaggcctgtct

SEQ ID NO: 564183 - DNA, 20 bp, mouse
gcagaagcgcggcggcgcga

SEQ ID NO: 564184 - DNA, 20 bp, mouse
gaccaaagcgaagccctgag

SEQ ID NO: 564185 - DNA, 20 bp, mouse
gcggctgcgcggctgcttcg

SEQ ID NO: 564186 - DNA, 20 bp, mouse
gaacagcgtccgggatagag

SEQ ID NO: 564187 - DNA, 20 bp, mouse
gttctccaccgcagagatgg

SEQ ID NO: 564188 - DNA, 20 bp, mouse
ggctgttgccagaggcccgg

SEQ ID NO: 564189 - DNA, 20 bp, mouse
ggcggccgccgccatctctg

SEQ ID NO: 564190 - DNA, 20 bp, mouse
ggcctctggcaacagcgtcc

SEQ ID NO: 564191 - DNA, 20 bp, mouse
ggcgagactcacctgagcag

SEQ ID NO: 564192 - DNA, 20 bp, mouse
gggcggcggccgctctatcc

SEQ ID NO: 564193 - DNA, 20 bp, mouse
gtcccggacgctgttgccag

SEQ ID NO: 564194 - DNA, 20 bp, mouse
gccttcgtgtaaatccccac

SEQ ID NO: 564195 - DNA, 20 bp, mouse
gacccgcgggaggtaagaaa

SEQ ID NO: 564196 - DNA, 20 bp, mouse
gaagtaggccgtgcaactca

SEQ ID NO: 564197 - DNA, 20 bp, mouse
ggaaggacgtccagcgaagt

SEQ ID NO: 564198 - DNA, 20 bp, mouse
gcgtccttcggaccgaagca

SEQ ID NO: 564199 - DNA, 20 bp, mouse
gcagcaaaccctgagttgca

SEQ ID NO: 564200 - DNA, 20 bp, mouse
ggttgcacggcctacttcgc

SEQ ID NO: 564201 - DNA, 20 bp, mouse
gcagccgtgcttcggtccga

SEQ ID NO: 564202 - DNA, 20 bp, mouse
ggggctggctcggcagtagt

SEQ ID NO: 564203 - DNA, 20 bp, mouse
ggagtgcttgccgctgtggg

SEQ ID NO: 564204 - DNA, 20 bp, mouse
gttcccaccttgaaccccaa

SEQ ID NO: 564205 - DNA, 20 bp, mouse
gagttggagctcagaccctt

SEQ ID NO: 564206 - DNA, 20 bp, mouse
gccgcggtgactgtgactgg

SEQ ID NO: 564207 - DNA, 20 bp, mouse
gggcagcgccaactctcccg

SEQ ID NO: 564208 - DNA, 20 bp, mouse
gctcccgcggtgactgtgac

SEQ ID NO: 564209 - DNA, 20 bp, mouse
gacagtcaccgcgggagagt

SEQ ID NO: 564210 - DNA, 20 bp, mouse
gcatccatggagcaaaccga

SEQ ID NO: 564211 - DNA, 20 bp, mouse
gaggtaaagccctatcatgg

SEQ ID NO: 564212 - DNA, 20 bp, mouse
gctgtggcgggaggatgccg

SEQ ID NO: 564213 - DNA, 20 bp, mouse
gacgcgggccacgtgcaggt

SEQ ID NO: 564214 - DNA, 20 bp, mouse
gacgccttcggtttgctcca

SEQ ID NO: 564215 - DNA, 20 bp, mouse
ggtgcgctgcctccatgata

SEQ ID NO: 564216 - DNA, 20 bp, mouse
gtgtagtgtggagaaggagt

SEQ ID NO: 564217 - DNA, 20 bp, mouse
gcgatgtgggctgtgtagtg

SEQ ID NO: 564218 - DNA, 20 bp, mouse
gctcagtagaagcaaaaagg

SEQ ID NO: 564219 - DNA, 20 bp, mouse
gaaaccagcgcgcagagaat

SEQ ID NO: 564220 - DNA, 20 bp, mouse
gagcagcaccagacgcgggg

SEQ ID NO: 564221 - DNA, 20 bp, mouse
ggaaggacttcgtgaccgag

SEQ ID NO: 564222 - DNA, 20 bp, mouse
gccgctcagtagaagcaaaa

SEQ ID NO: 564223 - DNA, 20 bp, mouse
gcgcgggtgcagggaaaccg

SEQ ID NO: 564224 - DNA, 20 bp, mouse
gctgcgcgctggtttcgatg

SEQ ID NO: 564225 - DNA, 20 bp, mouse
ggagctcgtggagggcaagg

SEQ ID NO: 564226 - DNA, 20 bp, mouse
ggcgctaggagacattgcgg

SEQ ID NO: 564227 - DNA, 20 bp, mouse
gtgcccctagtccagagtgg

SEQ ID NO: 564228 - DNA, 20 bp, mouse
gctaggagacattgcggcgg

SEQ ID NO: 564229 - DNA, 20 bp, mouse
gcctggcgcctcggagtgga

SEQ ID NO: 564230 - DNA, 20 bp, mouse
gcccacgcagctctggacac

SEQ ID NO: 564231 - DNA, 20 bp, mouse
gcaggggccaagcagcgatt

SEQ ID NO: 564232 - DNA, 20 bp, mouse
gcccagcagaccttccacgg

SEQ ID NO: 564233 - DNA, 20 bp, mouse
gcacccccactctggactag

SEQ ID NO: 564234 - DNA, 20 bp, mouse
ggcttgcccctagtccagag

SEQ ID NO: 564235 - DNA, 20 bp, mouse
gctctggacacaggcggccg

SEQ ID NO: 564236 - DNA, 20 bp, mouse
gggactcaggagcagcacga

SEQ ID NO: 564237 - DNA, 20 bp, mouse
gctggctgcgcgtcatgagg

SEQ ID NO: 564238 - DNA, 20 bp, mouse
gagccggagacccacaacca

SEQ ID NO: 564239 - DNA, 20 bp, mouse
gttggcagctgcggggactc

SEQ ID NO: 564240 - DNA, 20 bp, mouse
ggcagctgccaagaacagcg

SEQ ID NO: 564241 - DNA, 20 bp, mouse
ggcgcgtcatgaggaggccg

SEQ ID NO: 564242 - DNA, 20 bp, mouse
gaagaacagcggggtttccg

SEQ ID NO: 564243 - DNA, 20 bp, mouse
gggacgcagaaaggataccg

SEQ ID NO: 564244 - DNA, 20 bp, mouse
gtgtgcaggctcgggaaggt

SEQ ID NO: 564245 - DNA, 20 bp, mouse
gccgctggctgcgcgtcatg

SEQ ID NO: 564246 - DNA, 20 bp, mouse
gatcctcggatgctgtgaag

SEQ ID NO: 564247 - DNA, 20 bp, mouse
ggtgctcccgaaaccaaggt

SEQ ID NO: 564248 - DNA, 20 bp, mouse
gatccaagctgtgacatcct

SEQ ID NO: 564249 - DNA, 20 bp, mouse
gggacccctgacccaagtga

SEQ ID NO: 564250 - DNA, 20 bp, mouse
gccagggcttggccatccga

SEQ ID NO: 564251 - DNA, 20 bp, mouse
ggggaaagcagaacttccgg

SEQ ID NO: 564252 - DNA, 20 bp, mouse
gagaacttccggtggcgggt

SEQ ID NO: 564253 - DNA, 20 bp, mouse
ggctgcagagccccaccggt

SEQ ID NO: 564254 - DNA, 20 bp, mouse
gccggcaacccacccgccac

SEQ ID NO: 564255 - DNA, 20 bp, mouse
gagggggcggcccaccggtg

SEQ ID NO: 564256 - DNA, 20 bp, mouse
ggactagcggctatggacgt

SEQ ID NO: 564257 - DNA, 20 bp, mouse
gcggcgcgccctgggactag

SEQ ID NO: 564258 - DNA, 20 bp, mouse
gtccatagccgctagtccca

SEQ ID NO: 564259 - DNA, 20 bp, mouse
gctgcgcagcggaaacgcgt

SEQ ID NO: 564260 - DNA, 20 bp, mouse
gtcgcgggtgcggacttcgt

SEQ ID NO: 564261 - DNA, 20 bp, mouse
gagagcgtcctaggaaggac

SEQ ID NO: 564262 - DNA, 20 bp, mouse
ggccctgggactagcggcta

SEQ ID NO: 564263 - DNA, 20 bp, mouse
ggagtatgtggtcccagaca

SEQ ID NO: 564264 - DNA, 20 bp, mouse
gtgacaggccctgcaacccc

SEQ ID NO: 564265 - DNA, 20 bp, mouse
gacccgcgacaagctcctgc

SEQ ID NO: 564266 - DNA, 20 bp, mouse
gcgttgtccgtagaacctga

SEQ ID NO: 564267 - DNA, 20 bp, mouse
gccgggtgcaagccaggttg

SEQ ID NO: 564268 - DNA, 20 bp, mouse
gacccggctgtcaccgcctg

SEQ ID NO: 564269 - DNA, 20 bp, mouse
ggatgggagaggtcttcccc

SEQ ID NO: 564270 - DNA, 20 bp, mouse
gagcattagcatctgcacag

SEQ ID NO: 564271 - DNA, 20 bp, mouse
gtgctgctgggagcagtagc

SEQ ID NO: 564272 - DNA, 20 bp, mouse
gtaagtcctcatcctcaacc

SEQ ID NO: 564273 - DNA, 20 bp, mouse
gtgcagcttgcagtgacgtg

SEQ ID NO: 564274 - DNA, 20 bp, mouse
ggcaagccaggttgaggatg

SEQ ID NO: 564275 - DNA, 20 bp, mouse
gcactgatatgcccttttat

SEQ ID NO: 564276 - DNA, 20 bp, mouse
ggctggaaatgcagatgcaa

SEQ ID NO: 564277 - DNA, 20 bp, mouse
gtcctactgggagcagctca

SEQ ID NO: 564278 - DNA, 20 bp, mouse
gtcccaggacagcaggcacc

SEQ ID NO: 564279 - DNA, 20 bp, mouse
gggttcgagcaaagtctctg

SEQ ID NO: 564280 - DNA, 20 bp, mouse
gcctcacctctgccttttag

SEQ ID NO: 564281 - DNA, 20 bp, mouse
ggcaacaccgcagtgcctca

SEQ ID NO: 564282 - DNA, 20 bp, mouse
ggcacacattaacaaccctg

SEQ ID NO: 564283 - DNA, 20 bp, mouse
gtgctgtcctgggacccacc

SEQ ID NO: 564284 - DNA, 20 bp, mouse
ggccaggtgcctgctgtcct

SEQ ID NO: 564285 - DNA, 20 bp, mouse
gtatgaatcatgaggagggg

SEQ ID NO: 564286 - DNA, 20 bp, mouse
ggacatccacggacatccat

SEQ ID NO: 564287 - DNA, 20 bp, mouse
gcatccataggcataggata

SEQ ID NO: 564288 - DNA, 20 bp, mouse
gttggttctggagtgcactg

SEQ ID NO: 564289 - DNA, 20 bp, mouse
gctggacccaaagaggcagt

SEQ ID NO: 564290 - DNA, 20 bp, mouse
ggaagaccggcagcctgtgt

SEQ ID NO: 564291 - DNA, 20 bp, mouse
gccagaaccaactgcctctt

SEQ ID NO: 564292 - DNA, 20 bp, mouse
ggggacagccccacctacac

SEQ ID NO: 564293 - DNA, 20 bp, mouse
ggacaaacctaggaccctca

SEQ ID NO: 564294 - DNA, 20 bp, mouse
gatgtgaacaactagaagac

SEQ ID NO: 564295 - DNA, 20 bp, mouse
gctggccacagtcggaggtg

SEQ ID NO: 564296 - DNA, 20 bp, mouse
gcgagcaccgggaacccaag

SEQ ID NO: 564297 - DNA, 20 bp, mouse
gcccaagcggcaggaagcac

SEQ ID NO: 564298 - DNA, 20 bp, mouse
gagcggcaggaagcacggga

SEQ ID NO: 564299 - DNA, 20 bp, mouse
ggcgcgcggacataagcgct

SEQ ID NO: 564300 - DNA, 20 bp, mouse
ggggggagaaactcggctgg

SEQ ID NO: 564301 - DNA, 20 bp, mouse
gcaagactgatgactccggg

SEQ ID NO: 564302 - DNA, 20 bp, mouse
gtgtccgcgcgctcccgcaa

SEQ ID NO: 564303 - DNA, 20 bp, mouse
gcggcgtgccggggagaggt

SEQ ID NO: 564304 - DNA, 20 bp, mouse
ggctcaagactgatgactcc

SEQ ID NO: 564305 - DNA, 20 bp, mouse
ggatgggggagaaactcggc

SEQ ID NO: 564306 - DNA, 20 bp, mouse
gtcggcgccagggtgagtgt

SEQ ID NO: 564307 - DNA, 20 bp, mouse
gagctatccgacactcaccc

SEQ ID NO: 564308 - DNA, 20 bp, mouse
gccgagagaggtctgtcggg

SEQ ID NO: 564309 - DNA, 20 bp, mouse
gctcaccctggcgccgagag

SEQ ID NO: 564310 - DNA, 20 bp, mouse
gggagaggggctctggacta

SEQ ID NO: 564311 - DNA, 20 bp, mouse
gctgcgccccggaagtaaag

SEQ ID NO: 564312 - DNA, 20 bp, mouse
gccacccgctaatggacgcg

SEQ ID NO: 564313 - DNA, 20 bp, mouse
gcagacctctctcggcgcca

SEQ ID NO: 564314 - DNA, 20 bp, mouse
gctgccgcgcgtccattagc

SEQ ID NO: 564315 - DNA, 20 bp, mouse
ggtgtcggatagctatagcc

SEQ ID NO: 564316 - DNA, 20 bp, mouse
gcccagactgctcagagagg

SEQ ID NO: 564317 - DNA, 20 bp, mouse
gaggagctggcaagagaccc

SEQ ID NO: 564318 - DNA, 20 bp, mouse
ggacaacttgcggggaccag

SEQ ID NO: 564319 - DNA, 20 bp, mouse
ggcagtgggcccaatccggt

SEQ ID NO: 564320 - DNA, 20 bp, mouse
gcccctctgcccaatcgggt

SEQ ID NO: 564321 - DNA, 20 bp, mouse
gagccccctccccatcccaa

SEQ ID NO: 564322 - DNA, 20 bp, mouse
gcagtctgggaacctcgctg

SEQ ID NO: 564323 - DNA, 20 bp, mouse
gtagggagccgagctggagt

SEQ ID NO: 564324 - DNA, 20 bp, mouse
gagaggtaccagattctagg

SEQ ID NO: 564325 - DNA, 20 bp, mouse
gtcgctgtgggactgaattg

SEQ ID NO: 564326 - DNA, 20 bp, mouse
gcctctgctggtatatgagt

SEQ ID NO: 564327 - DNA, 20 bp, mouse
gagggagggaacaatggccg

SEQ ID NO: 564328 - DNA, 20 bp, mouse
gaggagggaagatgaagcta

SEQ ID NO: 564329 - DNA, 20 bp, mouse
gagaaggctgtgctcattgt

SEQ ID NO: 564330 - DNA, 20 bp, mouse
gatggatctggatcccaaga

SEQ ID NO: 564331 - DNA, 20 bp, mouse
gcagtcatctaatagagcca

SEQ ID NO: 564332 - DNA, 20 bp, mouse
ggatgactggtgtaagggga

SEQ ID NO: 564333 - DNA, 20 bp, mouse
gtattagatgactggtgtaa

SEQ ID NO: 564334 - DNA, 20 bp, mouse
gatccccgtgcagtacactg

SEQ ID NO: 564335 - DNA, 20 bp, mouse
gggtgataggcaggatgttc

SEQ ID NO: 564336 - DNA, 20 bp, mouse
ggccagctcggtatagatca

SEQ ID NO: 564337 - DNA, 20 bp, mouse
gtgactggagctgaagcata

SEQ ID NO: 564338 - DNA, 20 bp, mouse
ggcaggctctggccccaaag

SEQ ID NO: 564339 - DNA, 20 bp, mouse
gtggagctgaagcataggga

SEQ ID NO: 564340 - DNA, 20 bp, mouse
gggctgggaaggaggatcct

SEQ ID NO: 564341 - DNA, 20 bp, mouse
gaagcatagggacggagtcc

SEQ ID NO: 564342 - DNA, 20 bp, mouse
gaggaggatcctgggagcgg

SEQ ID NO: 564343 - DNA, 20 bp, mouse
gggtgagttgtcagaagcgg

SEQ ID NO: 564344 - DNA, 20 bp, mouse
ggcggggaggagaggcgcta

SEQ ID NO: 564345 - DNA, 20 bp, mouse
ggcagtgaggtcaaatcccc

SEQ ID NO: 564346 - DNA, 20 bp, mouse
gccagactccgcgggagcac

SEQ ID NO: 564347 - DNA, 20 bp, mouse
ggacgatcaacgcacctggt

SEQ ID NO: 564348 - DNA, 20 bp, mouse
gtggagtgaagcgcgtaccc

SEQ ID NO: 564349 - DNA, 20 bp, mouse
gttgtcagggacaaagggaa

SEQ ID NO: 564350 - DNA, 20 bp, mouse
ggggagcccgagaaaggggt

SEQ ID NO: 564351 - DNA, 20 bp, mouse
gcgcttcactccagactccg

SEQ ID NO: 564352 - DNA, 20 bp, mouse
ggctagcttgccggactcaa

SEQ ID NO: 564353 - DNA, 20 bp, mouse
gcccgggtctagacgctcag

SEQ ID NO: 564354 - DNA, 20 bp, mouse
gcagcggggccgctgcggaa

SEQ ID NO: 564355 - DNA, 20 bp, mouse
ggacggggactagcaggagg

SEQ ID NO: 564356 - DNA, 20 bp, mouse
gtgaagcacgctacagggag

SEQ ID NO: 564357 - DNA, 20 bp, mouse
ggtctcaacagaagcatgaa

SEQ ID NO: 564358 - DNA, 20 bp, mouse
gtcaacagaagcatgaacgg

SEQ ID NO: 564359 - DNA, 20 bp, mouse
gctggccagcgtcggagtca

SEQ ID NO: 564360 - DNA, 20 bp, mouse
gagacctgaagcacgctaca

SEQ ID NO: 564361 - DNA, 20 bp, mouse
gtccgggcggggggacccag

SEQ ID NO: 564362 - DNA, 20 bp, mouse
gcggtgagcaccggaaacgg

SEQ ID NO: 564363 - DNA, 20 bp, mouse
gtcgaagcgctggtaagcca

SEQ ID NO: 564364 - DNA, 20 bp, mouse
gacagctacctggccagcgt

SEQ ID NO: 564365 - DNA, 20 bp, mouse
gccaaggcccgacgccatca

SEQ ID NO: 564366 - DNA, 20 bp, mouse
gcgctgcgcggcctggagag

SEQ ID NO: 564367 - DNA, 20 bp, mouse
gtgctcctgcaaagctctca

SEQ ID NO: 564368 - DNA, 20 bp, mouse
gcgggcgcacccgggacaga

SEQ ID NO: 564369 - DNA, 20 bp, mouse
gggatcggacggaaccccag

SEQ ID NO: 564370 - DNA, 20 bp, mouse
gcccgggaaggccgagacca

SEQ ID NO: 564371 - DNA, 20 bp, mouse
gaccccagtcggcccacaag

SEQ ID NO: 564372 - DNA, 20 bp, mouse
ggtcgccgtgagagctttgc

SEQ ID NO: 564373 - DNA, 20 bp, mouse
gggcttcgcgaccgctctcc

SEQ ID NO: 564374 - DNA, 20 bp, mouse
gtccgggcctgcagcgccaa

SEQ ID NO: 564375 - DNA, 20 bp, mouse
gagacccccgggggaagcag

SEQ ID NO: 564376 - DNA, 20 bp, mouse
ggagacgcaaagcaccggaa

SEQ ID NO: 564377 - DNA, 20 bp, mouse
gtctcggccaagatcaatcc

SEQ ID NO: 564378 - DNA, 20 bp, mouse
gtcccggcaagtacgactag

SEQ ID NO: 564379 - DNA, 20 bp, mouse
gagatggagacgcaaagcac

SEQ ID NO: 564380 - DNA, 20 bp, mouse
gcccaccaggagctgatccc

SEQ ID NO: 564381 - DNA, 20 bp, mouse
gacgcaaagcaccggaacgg

SEQ ID NO: 564382 - DNA, 20 bp, mouse
gtacttgccgggattgatct

SEQ ID NO: 564383 - DNA, 20 bp, mouse
gcgccgggcgaagaaacgac

SEQ ID NO: 564384 - DNA, 20 bp, mouse
gaaagcaccggaacggagga

SEQ ID NO: 564385 - DNA, 20 bp, mouse
gggagctgatccccggagag

SEQ ID NO: 564386 - DNA, 20 bp, mouse
gctgggcagatactgtcgac

SEQ ID NO: 564387 - DNA, 20 bp, mouse
gtgctctccggagaggctct

SEQ ID NO: 564388 - DNA, 20 bp, mouse
gaggctggccatcctcacag

SEQ ID NO: 564389 - DNA, 20 bp, mouse
gccagtagcggccacaactg

SEQ ID NO: 564390 - DNA, 20 bp, mouse
gactgccctgctctccggag

SEQ ID NO: 564391 - DNA, 20 bp, mouse
gtagaggctgcgttgatggg

SEQ ID NO: 564392 - DNA, 20 bp, mouse
gcagggttctctcagatgtg

SEQ ID NO: 564393 - DNA, 20 bp, mouse
ggaaacggacagcgtcaggt

SEQ ID NO: 564394 - DNA, 20 bp, mouse
gtgtggccccagcaaccagc

SEQ ID NO: 564395 - DNA, 20 bp, mouse
ggtcgaccggctggttgctg

SEQ ID NO: 564396 - DNA, 20 bp, mouse
gtgtcgccgtggagcggaaa

SEQ ID NO: 564397 - DNA, 20 bp, mouse
gagacagtgtcgccgtggag

SEQ ID NO: 564398 - DNA, 20 bp, mouse
ggactcagacagtgtcgccg

SEQ ID NO: 564399 - DNA, 20 bp, mouse
gtcctgccctttccgctcca

SEQ ID NO: 564400 - DNA, 20 bp, mouse
gggcacttactcgttctcca

SEQ ID NO: 564401 - DNA, 20 bp, mouse
gaaagggcaggatttcggcg

SEQ ID NO: 564402 - DNA, 20 bp, mouse
gaggatttcggcgtggccgt

SEQ ID NO: 564403 - DNA, 20 bp, mouse
gggcggctggcgcgacaggc

SEQ ID NO: 564404 - DNA, 20 bp, mouse
gctgttagtgcactattcgc

SEQ ID NO: 564405 - DNA, 20 bp, mouse
gagtgcactattcgctgggc

SEQ ID NO: 564406 - DNA, 20 bp, mouse
gtgtcaccatggagcagaaa

SEQ ID NO: 564407 - DNA, 20 bp, mouse
ggagcagaaagggcaagatt

SEQ ID NO: 564408 - DNA, 20 bp, mouse
gggcacttactctttctcta

SEQ ID NO: 564409 - DNA, 20 bp, mouse
gaagatttgggcgcctctgt

SEQ ID NO: 564410 - DNA, 20 bp, mouse
gtgttagtgcactattacct

SEQ ID NO: 564411 - DNA, 20 bp, mouse
gccagcggtccaagtaaccc

SEQ ID NO: 564412 - DNA, 20 bp, mouse
gtctatggtgtcaccgacag

SEQ ID NO: 564413 - DNA, 20 bp, mouse
gagtgcactattacctaggc

SEQ ID NO: 564414 - DNA, 20 bp, mouse
gtttgtgttattaagttgtc

SEQ ID NO: 564415 - DNA, 20 bp, mouse
ggactcagacagtgtcacca

SEQ ID NO: 564416 - DNA, 20 bp, mouse
gtcctaggtgcgctccggat

SEQ ID NO: 564417 - DNA, 20 bp, mouse
gtaggtgcgctccggatggg

SEQ ID NO: 564418 - DNA, 20 bp, mouse
gcggagcgcacctaggagcg

SEQ ID NO: 564419 - DNA, 20 bp, mouse
ggtggacaccgtccagagca

SEQ ID NO: 564420 - DNA, 20 bp, mouse
gcctgacagaagtctagcaa

SEQ ID NO: 564421 - DNA, 20 bp, mouse
gcagggaatgccccgctcct

SEQ ID NO: 564422 - DNA, 20 bp, mouse
gccgtccagagcagggtgca

SEQ ID NO: 564423 - DNA, 20 bp, mouse
ggctctgctgagaggtaccc

SEQ ID NO: 564424 - DNA, 20 bp, mouse
gcagcccagtcaggcatcca

SEQ ID NO: 564425 - DNA, 20 bp, mouse
ggctgagaggtaccccggaa

SEQ ID NO: 564426 - DNA, 20 bp, mouse
gtccgccggcggagacccca

SEQ ID NO: 564427 - DNA, 20 bp, mouse
ggaagggcgcgtgctcacgg

SEQ ID NO: 564428 - DNA, 20 bp, mouse
gcgagtcacgatgttcccga

SEQ ID NO: 564429 - DNA, 20 bp, mouse
gccccaaggtatcgagactg

SEQ ID NO: 564430 - DNA, 20 bp, mouse
ggaggctccgtagatgtgag

SEQ ID NO: 564431 - DNA, 20 bp, mouse
gcgcgcagctcggctcaccc

SEQ ID NO: 564432 - DNA, 20 bp, mouse
gaccttggggtctccgccgg

SEQ ID NO: 564433 - DNA, 20 bp, mouse
gatctacggagcctcggcag

SEQ ID NO: 564434 - DNA, 20 bp, mouse
gcccgcagtctcgatacctt

SEQ ID NO: 564435 - DNA, 20 bp, mouse
gtcgtgactcgatgtcctgc

SEQ ID NO: 564436 - DNA, 20 bp, mouse
gagaaggcagaccaccaccc

SEQ ID NO: 564437 - DNA, 20 bp, mouse
gtacgccatctccagggtgg

SEQ ID NO: 564438 - DNA, 20 bp, mouse
ggacacctatgcccacactg

SEQ ID NO: 564439 - DNA, 20 bp, mouse
ggagagcagggccgggatca

SEQ ID NO: 564440 - DNA, 20 bp, mouse
gtgggggctggctcacaatt

SEQ ID NO: 564441 - DNA, 20 bp, mouse
ggcggcagggagttaactca

SEQ ID NO: 564442 - DNA, 20 bp, mouse
ggatggcgtacagcaggagc

SEQ ID NO: 564443 - DNA, 20 bp, mouse
gttggacacctcaataatgt

SEQ ID NO: 564444 - DNA, 20 bp, mouse
gacctggtgaagaccatccg

SEQ ID NO: 564445 - DNA, 20 bp, mouse
ggttggcacctgcttcacct

SEQ ID NO: 564446 - DNA, 20 bp, mouse
gcggcgctctgggtcataca

SEQ ID NO: 564447 - DNA, 20 bp, mouse
gtgcaaacgacaggctccag

SEQ ID NO: 564448 - DNA, 20 bp, mouse
gagagggagactgcacacga

SEQ ID NO: 564449 - DNA, 20 bp, mouse
gacatggtgcttgaagctcc

SEQ ID NO: 564450 - DNA, 20 bp, mouse
gggccgtggacgcaccgaga

SEQ ID NO: 564451 - DNA, 20 bp, mouse
ggccgcagcctgcaaacgac

SEQ ID NO: 564452 - DNA, 20 bp, mouse
gtctccagctgagtgctcaa

SEQ ID NO: 564453 - DNA, 20 bp, mouse
gacaggctccagcggcgctc

SEQ ID NO: 564454 - DNA, 20 bp, mouse
gcccgacgtggtagaagccc

SEQ ID NO: 564455 - DNA, 20 bp, mouse
gacatagcgtagccccgacg

SEQ ID NO: 564456 - DNA, 20 bp, mouse
gctccaggaagtccataata

SEQ ID NO: 564457 - DNA, 20 bp, mouse
gctcctcagctggagctcaa

SEQ ID NO: 564458 - DNA, 20 bp, mouse
gtcagctggagctcaaagga

SEQ ID NO: 564459 - DNA, 20 bp, mouse
gaggaaggaactgtgcacta

SEQ ID NO: 564460 - DNA, 20 bp, mouse
gactagggccccaatgtgat

SEQ ID NO: 564461 - DNA, 20 bp, mouse
gatagggtgcttgggacgcg

SEQ ID NO: 564462 - DNA, 20 bp, mouse
gtgaggaggagccatagaag

SEQ ID NO: 564463 - DNA, 20 bp, mouse
gggccacagctgacagccta

SEQ ID NO: 564464 - DNA, 20 bp, mouse
gcacagctgacagcctaggg

SEQ ID NO: 564465 - DNA, 20 bp, mouse
gggaggagccatagaagcgg

SEQ ID NO: 564466 - DNA, 20 bp, mouse
gcctggttgcagctcctgaa

SEQ ID NO: 564467 - DNA, 20 bp, mouse
gggtgttggccgaagctggg

SEQ ID NO: 564468 - DNA, 20 bp, mouse
gaggggtgttggccgaagct

SEQ ID NO: 564469 - DNA, 20 bp, mouse
gctgcccgctgcctcagacg

SEQ ID NO: 564470 - DNA, 20 bp, mouse
gtgcgacctggagtacggaa

SEQ ID NO: 564471 - DNA, 20 bp, mouse
gaggcagcgggcagaaaact

SEQ ID NO: 564472 - DNA, 20 bp, mouse
ggctctctaacagtcctcga

SEQ ID NO: 564473 - DNA, 20 bp, mouse
gtcagatgcgacctggagta

SEQ ID NO: 564474 - DNA, 20 bp, mouse
gggcagaaaactaggggtgt

SEQ ID NO: 564475 - DNA, 20 bp, mouse
gcagcgtcccaggagagtcc

SEQ ID NO: 564476 - DNA, 20 bp, mouse
gagttgctccccccacgtag

SEQ ID NO: 564477 - DNA, 20 bp, mouse
gccttcccatccccctacgt

SEQ ID NO: 564478 - DNA, 20 bp, mouse
gtcccatccccctacgtggg

SEQ ID NO: 564479 - DNA, 20 bp, mouse
gagcgggagacctagtctct

SEQ ID NO: 564480 - DNA, 20 bp, mouse
gggagacctagtctctcgga

SEQ ID NO: 564481 - DNA, 20 bp, mouse
gaccaagaggatgagcacgg

SEQ ID NO: 564482 - DNA, 20 bp, mouse
gccagcacctgcggaacgaa

SEQ ID NO: 564483 - DNA, 20 bp, mouse
gtgcagagtgaggattcggg

SEQ ID NO: 564484 - DNA, 20 bp, mouse
ggtgctgggcgtgatgatcg

SEQ ID NO: 564485 - DNA, 20 bp, mouse
gcgtttcccggcatgcatag

SEQ ID NO: 564486 - DNA, 20 bp, mouse
gaggtaggtagaccagacat

SEQ ID NO: 564487 - DNA, 20 bp, mouse
gccacgtgagggctgtttac

SEQ ID NO: 564488 - DNA, 20 bp, mouse
gaagatgcctgccttgaggt

SEQ ID NO: 564489 - DNA, 20 bp, mouse
gttccccttagaccacgtga

SEQ ID NO: 564490 - DNA, 20 bp, mouse
gtctggaaaacaacttgttt

SEQ ID NO: 564491 - DNA, 20 bp, mouse
gtggagggcgaaaaggagac

SEQ ID NO: 564492 - DNA, 20 bp, mouse
gagccctcacgtggtctaag

SEQ ID NO: 564493 - DNA, 20 bp, mouse
gagcctcggtagacacctga

SEQ ID NO: 564494 - DNA, 20 bp, mouse
gggtctacctacctcaaggc

SEQ ID NO: 564495 - DNA, 20 bp, mouse
gagcaatgtggagggcgaaa

SEQ ID NO: 564496 - DNA, 20 bp, mouse
ggcgcccggaccccaaacac

SEQ ID NO: 564497 - DNA, 20 bp, mouse
gccgatgcggacctcagagc

SEQ ID NO: 564498 - DNA, 20 bp, mouse
gggacctcagagctggcggg

SEQ ID NO: 564499 - DNA, 20 bp, mouse
gcagctgcgagcaggccggg

SEQ ID NO: 564500 - DNA, 20 bp, mouse
gtcgcctcccgccagctctg

SEQ ID NO: 564501 - DNA, 20 bp, mouse
gccgcagctgcgagcaggcc

SEQ ID NO: 564502 - DNA, 20 bp, mouse
gggcgtgccactgcagagag

SEQ ID NO: 564503 - DNA, 20 bp, mouse
gcagcgcactgggataggac

SEQ ID NO: 564504 - DNA, 20 bp, mouse
gcaggccgggcgggccgatg

SEQ ID NO: 564505 - DNA, 20 bp, mouse
ggggacgcaggcagtagtca

SEQ ID NO: 564506 - DNA, 20 bp, mouse
gcagcctgtgtgtctagcct

SEQ ID NO: 564507 - DNA, 20 bp, mouse
gaccttggttccgagaactt

SEQ ID NO: 564508 - DNA, 20 bp, mouse
gagttaccgcggggatcgag

SEQ ID NO: 564509 - DNA, 20 bp, mouse
ggactgcaccccgacagcac

SEQ ID NO: 564510 - DNA, 20 bp, mouse
gggagacctgcgaagtggac

SEQ ID NO: 564511 - DNA, 20 bp, mouse
ggttcaggagacctgcgaag

SEQ ID NO: 564512 - DNA, 20 bp, mouse
gcgtcgcctggccctgggtt

SEQ ID NO: 564513 - DNA, 20 bp, mouse
gctgccgccgggacacggaa

SEQ ID NO: 564514 - DNA, 20 bp, mouse
gctttcaggggccacttaca

SEQ ID NO: 564515 - DNA, 20 bp, mouse
gtccgtcacctgtgctgtcg

SEQ ID NO: 564516 - DNA, 20 bp, mouse
ggcccagcggtcggaggcac

SEQ ID NO: 564517 - DNA, 20 bp, mouse
gcccagagcgtggaaggcct

SEQ ID NO: 564518 - DNA, 20 bp, mouse
ggccgcagcccagcggtcgg

SEQ ID NO: 564519 - DNA, 20 bp, mouse
gcacgctctgggtgtcatgg

SEQ ID NO: 564520 - DNA, 20 bp, mouse
gggggccgcagcccagcggt

SEQ ID NO: 564521 - DNA, 20 bp, mouse
gtagagaacttaagagactt

SEQ ID NO: 564522 - DNA, 20 bp, mouse
ggcccgtgcctccgaccgct

SEQ ID NO: 564523 - DNA, 20 bp, mouse
gagcagcaccggatccagag

SEQ ID NO: 564524 - DNA, 20 bp, mouse
gtgagtgcccgattccgccc

SEQ ID NO: 564525 - DNA, 20 bp, mouse
gccccctcggccggcccggg

SEQ ID NO: 564526 - DNA, 20 bp, mouse
ggcggggagcaggagtcacg

SEQ ID NO: 564527 - DNA, 20 bp, mouse
ggggagcaggagtcacgggg

SEQ ID NO: 564528 - DNA, 20 bp, mouse
gggagcaaggaccatgactc

SEQ ID NO: 564529 - DNA, 20 bp, mouse
ggaccatgactcgggcgagg

SEQ ID NO: 564530 - DNA, 20 bp, mouse
ggcgggcggcgcccaagaag

SEQ ID NO: 564531 - DNA, 20 bp, mouse
gggcggcgcccaagaagcgg

SEQ ID NO: 564532 - DNA, 20 bp, mouse
gcgtcccccccgaggaagtg

SEQ ID NO: 564533 - DNA, 20 bp, mouse
gcgccgcctcgcccgagtca

SEQ ID NO: 564534 - DNA, 20 bp, mouse
ggggactcggcagaaaggcg

SEQ ID NO: 564535 - DNA, 20 bp, mouse
ggcgcggggactcggcagaa

SEQ ID NO: 564536 - DNA, 20 bp, mouse
gacagcccacgaacgagtca

SEQ ID NO: 564537 - DNA, 20 bp, mouse
gagaggaagtgaggccggtc

SEQ ID NO: 564538 - DNA, 20 bp, mouse
gcttcagccaggcccaacaa

SEQ ID NO: 564539 - DNA, 20 bp, mouse
gtgatccgtgactcgttcgt

SEQ ID NO: 564540 - DNA, 20 bp, mouse
gcggatcacaactccgtctg

SEQ ID NO: 564541 - DNA, 20 bp, mouse
gcgggtgcgaccgactccct

SEQ ID NO: 564542 - DNA, 20 bp, mouse
gaagcctccttccctctaca

SEQ ID NO: 564543 - DNA, 20 bp, mouse
ggcctttcccgacaaaatgg

SEQ ID NO: 564544 - DNA, 20 bp, mouse
gtgcaagcgcggaagaggac

SEQ ID NO: 564545 - DNA, 20 bp, mouse
gggagtcggtcgcacccgac

SEQ ID NO: 564546 - DNA, 20 bp, mouse
gcagcccgctagccccgcta

SEQ ID NO: 564547 - DNA, 20 bp, mouse
gcagctatctctggcacttg

SEQ ID NO: 564548 - DNA, 20 bp, mouse
ggtcaggtgctcactatcca

SEQ ID NO: 564549 - DNA, 20 bp, mouse
ggctgggagcagccatagcg

SEQ ID NO: 564550 - DNA, 20 bp, mouse
gcactatccagggacttacc

SEQ ID NO: 564551 - DNA, 20 bp, mouse
gaatacgccgtacattccag

SEQ ID NO: 564552 - DNA, 20 bp, mouse
gcagccatagcggggctagc

SEQ ID NO: 564553 - DNA, 20 bp, mouse
gtcgccccaggccacgacaa

SEQ ID NO: 564554 - DNA, 20 bp, mouse
gtcagctctagctcaggtaa

SEQ ID NO: 564555 - DNA, 20 bp, mouse
ggcggggctagcgggctggt

SEQ ID NO: 564556 - DNA, 20 bp, mouse
ggaaccgtcagactggagtg

SEQ ID NO: 564557 - DNA, 20 bp, mouse
ggggacgaggggggaccgtg

SEQ ID NO: 564558 - DNA, 20 bp, mouse
gacggcgcccggggccttgg

SEQ ID NO: 564559 - DNA, 20 bp, mouse
gcgcccgcactccagtctga

SEQ ID NO: 564560 - DNA, 20 bp, mouse
ggcgcccggaaccgtcagac

SEQ ID NO: 564561 - DNA, 20 bp, mouse
ggcctgcgtcagaatcacca

SEQ ID NO: 564562 - DNA, 20 bp, mouse
gcgggcagcgagagaggcgt

SEQ ID NO: 564563 - DNA, 20 bp, mouse
gctcccaggcctgccagact

SEQ ID NO: 564564 - DNA, 20 bp, mouse
gttcccggtcactacaacaa

SEQ ID NO: 564565 - DNA, 20 bp, mouse
gaccggagccgatcatcctt

SEQ ID NO: 564566 - DNA, 20 bp, mouse
gggagccgctgtgcttgctt

SEQ ID NO: 564567 - DNA, 20 bp, mouse
ggtgcttgctttggttgcgg

SEQ ID NO: 564568 - DNA, 20 bp, mouse
gcctgactcgctgcgacaga

SEQ ID NO: 564569 - DNA, 20 bp, mouse
gcgcagcgagtcaggagccg

SEQ ID NO: 564570 - DNA, 20 bp, mouse
gccaccgggatccaccgtct

SEQ ID NO: 564571 - DNA, 20 bp, mouse
gaaactgtcaagtggctgct

SEQ ID NO: 564572 - DNA, 20 bp, mouse
gcaccgtctcggcgaaacct

SEQ ID NO: 564573 - DNA, 20 bp, mouse
gttgggagcatcgtccctgg

SEQ ID NO: 564574 - DNA, 20 bp, mouse
gtcgccgagacggtggatcc

SEQ ID NO: 564575 - DNA, 20 bp, mouse
gcttgcggccagctacacgt

SEQ ID NO: 564576 - DNA, 20 bp, mouse
gcgcagcgggaggagcccga

SEQ ID NO: 564577 - DNA, 20 bp, mouse
gcggtgagccgagggaccac

SEQ ID NO: 564578 - DNA, 20 bp, mouse
gcgctgggcgccgagaggga

SEQ ID NO: 564579 - DNA, 20 bp, mouse
ggccgcgccgtgggcggaac

SEQ ID NO: 564580 - DNA, 20 bp, mouse
ggggccgccaccccatatgg

SEQ ID NO: 564581 - DNA, 20 bp, mouse
gcgtgggcggaacaggctcg

SEQ ID NO: 564582 - DNA, 20 bp, mouse
gcgcagcggcaggtaggacg

SEQ ID NO: 564583 - DNA, 20 bp, mouse
gccgcgcaaggggcacggtt

SEQ ID NO: 564584 - DNA, 20 bp, mouse
gcaccgagaactgggaccca

SEQ ID NO: 564585 - DNA, 20 bp, mouse
ggccacagccgcgatagggg

SEQ ID NO: 564586 - DNA, 20 bp, mouse
gcacccaggcctgcctgatg

SEQ ID NO: 564587 - DNA, 20 bp, mouse
ggggactcaaaggcctcatc

SEQ ID NO: 564588 - DNA, 20 bp, mouse
ggcccactgtgctcccaccc

SEQ ID NO: 564589 - DNA, 20 bp, mouse
gaagttctctagctggttga

SEQ ID NO: 564590 - DNA, 20 bp, mouse
ggttggggaggcaggaaacc

SEQ ID NO: 564591 - DNA, 20 bp, mouse
gcctggcgagcgcaacctgg

SEQ ID NO: 564592 - DNA, 20 bp, mouse
gagtccctagccttcagagt

SEQ ID NO: 564593 - DNA, 20 bp, mouse
gaatcccactctgaaggcta

SEQ ID NO: 564594 - DNA, 20 bp, mouse
gagtgcaggcttctccccaa

SEQ ID NO: 564595 - DNA, 20 bp, mouse
gagtgggattgctagaatgc

SEQ ID NO: 564596 - DNA, 20 bp, mouse
gtagtcacagcagacactgg

SEQ ID NO: 564597 - DNA, 20 bp, mouse
gtgagtgctggacagaagct

SEQ ID NO: 564598 - DNA, 20 bp, mouse
gcactggaggacgtgagtgc

SEQ ID NO: 564599 - DNA, 20 bp, mouse
gatggtgagttaggcaggga

SEQ ID NO: 564600 - DNA, 20 bp, mouse
ggggctgactatggtgagtt

SEQ ID NO: 564601 - DNA, 20 bp, mouse
gctgtcacccaagtgtggga

SEQ ID NO: 564602 - DNA, 20 bp, mouse
ggactatggtgagttaggca

SEQ ID NO: 564603 - DNA, 20 bp, mouse
gaggaccagtgggcagaacc

SEQ ID NO: 564604 - DNA, 20 bp, mouse
gaggagcagcgccaaggaca

SEQ ID NO: 564605 - DNA, 20 bp, mouse
ggcagggagggtctgaaggc

SEQ ID NO: 564606 - DNA, 20 bp, mouse
gagcggcgcagacaccgccc

SEQ ID NO: 564607 - DNA, 20 bp, mouse
gcggagagcgccgtagtggg

SEQ ID NO: 564608 - DNA, 20 bp, mouse
gaaggtgtctgcggcccggg

SEQ ID NO: 564609 - DNA, 20 bp, mouse
gaacgtgcgcggggccgcag

SEQ ID NO: 564610 - DNA, 20 bp, mouse
gcccagcccagctctgcggt

SEQ ID NO: 564611 - DNA, 20 bp, mouse
gccacctgctcggagtcccc

SEQ ID NO: 564612 - DNA, 20 bp, mouse
gagccagcagcgacgagcga

SEQ ID NO: 564613 - DNA, 20 bp, mouse
gggcggaggggaatgaccag

SEQ ID NO: 564614 - DNA, 20 bp, mouse
ggcgaaggtgtctgcggccc

SEQ ID NO: 564615 - DNA, 20 bp, mouse
ggcctaccgcagagctgggc

SEQ ID NO: 564616 - DNA, 20 bp, mouse
ggcatccagcgcccaggaca

SEQ ID NO: 564617 - DNA, 20 bp, mouse
ggggcggcaacgctgcacca

SEQ ID NO: 564618 - DNA, 20 bp, mouse
gttggcccggccccactcac

SEQ ID NO: 564619 - DNA, 20 bp, mouse
gctgcggccaaggagcagag

SEQ ID NO: 564620 - DNA, 20 bp, mouse
ggcccggccccactcaccgg

SEQ ID NO: 564621 - DNA, 20 bp, mouse
gtggcagcgccgcagaacaa

SEQ ID NO: 564622 - DNA, 20 bp, mouse
gaccatggcccggccgctgc

SEQ ID NO: 564623 - DNA, 20 bp, mouse
gcctggcgcggggacccccc

SEQ ID NO: 564624 - DNA, 20 bp, mouse
ggcgcccccgaggccggccc

SEQ ID NO: 564625 - DNA, 20 bp, mouse
ggcgcgcaaagcgaaggcgg

SEQ ID NO: 564626 - DNA, 20 bp, mouse
gaagcaccttgtatccctgg

SEQ ID NO: 564627 - DNA, 20 bp, mouse
gtggtaccaccagggataca

SEQ ID NO: 564628 - DNA, 20 bp, mouse
gggcactgcaggacctctgt

SEQ ID NO: 564629 - DNA, 20 bp, mouse
ggatacaaggtgcttgataa

SEQ ID NO: 564630 - DNA, 20 bp, mouse
gcagggagagcaggcatgca

SEQ ID NO: 564631 - DNA, 20 bp, mouse
ggagttacccgaacagcagc

SEQ ID NO: 564632 - DNA, 20 bp, mouse
gagcacctgggaaaactctg

SEQ ID NO: 564633 - DNA, 20 bp, mouse
gtcttttactggtaccacca

SEQ ID NO: 564634 - DNA, 20 bp, mouse
gatcaagcaccttgtatccc

SEQ ID NO: 564635 - DNA, 20 bp, mouse
gcgggtaactcatcttttac

SEQ ID NO: 564636 - DNA, 20 bp, mouse
gtccgggccgtggcactctg

SEQ ID NO: 564637 - DNA, 20 bp, mouse
ggcggcggcgcccatgtcga

SEQ ID NO: 564638 - DNA, 20 bp, mouse
gtccgggcgcctcagagaag

SEQ ID NO: 564639 - DNA, 20 bp, mouse
gtgtggcggtgcccacgcgg

SEQ ID NO: 564640 - DNA, 20 bp, mouse
ggacatgggcgccgccgcgt

SEQ ID NO: 564641 - DNA, 20 bp, mouse
gaggtgtggcggtgcccacg

SEQ ID NO: 564642 - DNA, 20 bp, mouse
gctctgtacccaggcaagta

SEQ ID NO: 564643 - DNA, 20 bp, mouse
gccgctgaccgcccgcggag

SEQ ID NO: 564644 - DNA, 20 bp, mouse
gggggctctgccgtcgacat

SEQ ID NO: 564645 - DNA, 20 bp, mouse
gagggaagaagaggcgcgag

SEQ ID NO: 564646 - DNA, 20 bp, mouse
ggctggcagcggcatcctgg

SEQ ID NO: 564647 - DNA, 20 bp, mouse
gggatgccgctgccagcagc

SEQ ID NO: 564648 - DNA, 20 bp, mouse
ggagcgaggcatctgggaca

SEQ ID NO: 564649 - DNA, 20 bp, mouse
gggcaacgcggccagaccca

SEQ ID NO: 564650 - DNA, 20 bp, mouse
gacgcaggctgcaggagcga

SEQ ID NO: 564651 - DNA, 20 bp, mouse
ggcatcctggcggccggtct

SEQ ID NO: 564652 - DNA, 20 bp, mouse
gagggtcagcagcgggctgg

SEQ ID NO: 564653 - DNA, 20 bp, mouse
gcgggcggagcgaggcatct

SEQ ID NO: 564654 - DNA, 20 bp, mouse
gcttctcctgaagccgagac

SEQ ID NO: 564655 - DNA, 20 bp, mouse
gagcgtcgtctgcctgctgc

SEQ ID NO: 564656 - DNA, 20 bp, mouse
ggcgggagcggtggagacga

SEQ ID NO: 564657 - DNA, 20 bp, mouse
gctcccgaggggccgcgctg

SEQ ID NO: 564658 - DNA, 20 bp, mouse
gcaaagggcgacgaaggctg

SEQ ID NO: 564659 - DNA, 20 bp, mouse
gggccggcccgcaacaaagg

SEQ ID NO: 564660 - DNA, 20 bp, mouse
gcggcccgcaacaaaggcgg

SEQ ID NO: 564661 - DNA, 20 bp, mouse
gagcggtggagacgatggcg

SEQ ID NO: 564662 - DNA, 20 bp, mouse
gggcgacgaaggctgtggcc

SEQ ID NO: 564663 - DNA, 20 bp, mouse
ggtcctcgctccctcccgag

SEQ ID NO: 564664 - DNA, 20 bp, mouse
gcccggccggcccgcaacaa

SEQ ID NO: 564665 - DNA, 20 bp, mouse
gggtggaccgaggaccttag

SEQ ID NO: 564666 - DNA, 20 bp, mouse
gctgcgggtgatggagcgtc

SEQ ID NO: 564667 - DNA, 20 bp, mouse
gcatcacccgcagaccactg

SEQ ID NO: 564668 - DNA, 20 bp, mouse
gtgcgggtgggaatccgcag

SEQ ID NO: 564669 - DNA, 20 bp, mouse
gccgccagaaggactcaggt

SEQ ID NO: 564670 - DNA, 20 bp, mouse
ggagcacccagggacccgag

SEQ ID NO: 564671 - DNA, 20 bp, mouse
ggggaatccgcagtggtctg

SEQ ID NO: 564672 - DNA, 20 bp, mouse
gagaggcccaccaaacacct

SEQ ID NO: 564673 - DNA, 20 bp, mouse
gtgcaacgcgagctggacag

SEQ ID NO: 564674 - DNA, 20 bp, mouse
ggcgcgcggaggatgctgtg

SEQ ID NO: 564675 - DNA, 20 bp, mouse
gcttccgccggcgtgcgggt

SEQ ID NO: 564676 - DNA, 20 bp, mouse
gccgcgccagctcccataca

SEQ ID NO: 564677 - DNA, 20 bp, mouse
gacccggcgccgggagtagg

SEQ ID NO: 564678 - DNA, 20 bp, mouse
gcggcggcgacgaccacggg

SEQ ID NO: 564679 - DNA, 20 bp, mouse
gggaatgtggctccgtgtat

SEQ ID NO: 564680 - DNA, 20 bp, mouse
gcggaacccccgggaaaagg

SEQ ID NO: 564681 - DNA, 20 bp, mouse
gcctcgggtcagactaccgg

SEQ ID NO: 564682 - DNA, 20 bp, mouse
gcttcctcgggtcagactac

SEQ ID NO: 564683 - DNA, 20 bp, mouse
ggtgggggggccaaggaatg

SEQ ID NO: 564684 - DNA, 20 bp, mouse
gaggcgacggcaccttcctc

SEQ ID NO: 564685 - DNA, 20 bp, mouse
gcggcccagcgaaaagataa

SEQ ID NO: 564686 - DNA, 20 bp, mouse
gatggcgcccatgcacgaag

SEQ ID NO: 564687 - DNA, 20 bp, mouse
gcgcggaatagagagactat

SEQ ID NO: 564688 - DNA, 20 bp, mouse
gtagagagactatcggacca

SEQ ID NO: 564689 - DNA, 20 bp, mouse
gttctgggcggagaccctag

SEQ ID NO: 564690 - DNA, 20 bp, mouse
ggcggtcaaacagacctaag

SEQ ID NO: 564691 - DNA, 20 bp, mouse
ggtcaaacagacctaagggg

SEQ ID NO: 564692 - DNA, 20 bp, mouse
ggccccgtcccacaccccta

SEQ ID NO: 564693 - DNA, 20 bp, mouse
gcacgtggttgggaatgtgg

SEQ ID NO: 564694 - DNA, 20 bp, mouse
ggcgccaaccagcctgaaac

SEQ ID NO: 564695 - DNA, 20 bp, mouse
ggcggagaccctaggggtgt

SEQ ID NO: 564696 - DNA, 20 bp, mouse
gctggatcgagacctctcga

SEQ ID NO: 564697 - DNA, 20 bp, mouse
ggcgcgctaggcaaagcgtt

SEQ ID NO: 564698 - DNA, 20 bp, mouse
gcgtctgcagggtagagctg

SEQ ID NO: 564699 - DNA, 20 bp, mouse
ggagagaaaacttgcttccg

SEQ ID NO: 564700 - DNA, 20 bp, mouse
gcgctaggcaaagcgtttgg

SEQ ID NO: 564701 - DNA, 20 bp, mouse
gacaccttagcttctccgtg

SEQ ID NO: 564702 - DNA, 20 bp, mouse
gggccactcccgggtcacca

SEQ ID NO: 564703 - DNA, 20 bp, mouse
ggactacgaggactccctgt

SEQ ID NO: 564704 - DNA, 20 bp, mouse
gtacttcaaaagccctcgag

SEQ ID NO: 564705 - DNA, 20 bp, mouse
ggctttaccggaaggtgaca

SEQ ID NO: 564706 - DNA, 20 bp, mouse
gaccggtaagacccaggtgt

SEQ ID NO: 564707 - DNA, 20 bp, mouse
gcgccgcaggagaccctcaa

SEQ ID NO: 564708 - DNA, 20 bp, mouse
gcgcaggagaccctcaacgg

SEQ ID NO: 564709 - DNA, 20 bp, mouse
gcttaccggtggaacaatgg

SEQ ID NO: 564710 - DNA, 20 bp, mouse
gggcgccgccattgttccac

SEQ ID NO: 564711 - DNA, 20 bp, mouse
gtgttccaccggtaagaccc

SEQ ID NO: 564712 - DNA, 20 bp, mouse
gacccacacctgggtcttac

SEQ ID NO: 564713 - DNA, 20 bp, mouse
gacaatggcggcgcctgaca

SEQ ID NO: 564714 - DNA, 20 bp, mouse
gcaccgcgctgcgccctgtc

SEQ ID NO: 564715 - DNA, 20 bp, mouse
ggcatcacggacatgctcgt

SEQ ID NO: 564716 - DNA, 20 bp, mouse
gctgcgcgcagagggttcag

SEQ ID NO: 564717 - DNA, 20 bp, mouse
ggagggttcaggggtcacgg

SEQ ID NO: 564718 - DNA, 20 bp, mouse
ggtcacggcggcgtatcttg

SEQ ID NO: 564719 - DNA, 20 bp, mouse
gcacgctagccaggagggag

SEQ ID NO: 564720 - DNA, 20 bp, mouse
gacggcggcgtatcttgtgg

SEQ ID NO: 564721 - DNA, 20 bp, mouse
ggcagagggttcaggggtca

SEQ ID NO: 564722 - DNA, 20 bp, mouse
gcgggaaaagctgtttgagg

SEQ ID NO: 564723 - DNA, 20 bp, mouse
gtgtccgggtgtgggctcag

SEQ ID NO: 564724 - DNA, 20 bp, mouse
ggcgtgcacgctagccagga

SEQ ID NO: 564725 - DNA, 20 bp, mouse
gcccaggtcctaagctccag

SEQ ID NO: 564726 - DNA, 20 bp, mouse
gagagttggcaacccaggtg

SEQ ID NO: 564727 - DNA, 20 bp, mouse
ggtgcctccctgggcagagt

SEQ ID NO: 564728 - DNA, 20 bp, mouse
gcttagtgtagtgcctccct

SEQ ID NO: 564729 - DNA, 20 bp, mouse
gcagcagccaactctgccca

SEQ ID NO: 564730 - DNA, 20 bp, mouse
ggtcaccaatggctgcagag

SEQ ID NO: 564731 - DNA, 20 bp, mouse
ggttggcaacccaggtgggg

SEQ ID NO: 564732 - DNA, 20 bp, mouse
ggcaggggtcagaagcatcc

SEQ ID NO: 564733 - DNA, 20 bp, mouse
gtacactaagtatggcccag

SEQ ID NO: 564734 - DNA, 20 bp, mouse
gcacggccctcacccaggat

SEQ ID NO: 564735 - DNA, 20 bp, mouse
gggtagtactgagtgtcgat

SEQ ID NO: 564736 - DNA, 20 bp, mouse
gacgggcgcgcagagattgg

SEQ ID NO: 564737 - DNA, 20 bp, mouse
gagattggcgggatgcggcg

SEQ ID NO: 564738 - DNA, 20 bp, mouse
ggtaccgccaagtctgaccc

SEQ ID NO: 564739 - DNA, 20 bp, mouse
ggggacgggcgcgcagagat

SEQ ID NO: 564740 - DNA, 20 bp, mouse
ggtggtggcagcggcccaca

SEQ ID NO: 564741 - DNA, 20 bp, mouse
gagccaaaaacgcacggtgg

SEQ ID NO: 564742 - DNA, 20 bp, mouse
gcggggttaacgtgggtcct

SEQ ID NO: 564743 - DNA, 20 bp, mouse
gaacaggctggatgtagtaa

SEQ ID NO: 564744 - DNA, 20 bp, mouse
gtgctccaggccggacccga

SEQ ID NO: 564745 - DNA, 20 bp, mouse
gcagcgggccggggtcttga

SEQ ID NO: 564746 - DNA, 20 bp, mouse
ggctcgaagccgcaccacca

SEQ ID NO: 564747 - DNA, 20 bp, mouse
gcgaagccgcaccaccatgg

SEQ ID NO: 564748 - DNA, 20 bp, mouse
gccggcgggagctacggctg

SEQ ID NO: 564749 - DNA, 20 bp, mouse
ggagaagccacaggcaccgg

SEQ ID NO: 564750 - DNA, 20 bp, mouse
gttcccgccggcgggagcta

SEQ ID NO: 564751 - DNA, 20 bp, mouse
gtacagctgttccgccatgg

SEQ ID NO: 564752 - DNA, 20 bp, mouse
gcgggagctacggctggggc

SEQ ID NO: 564753 - DNA, 20 bp, mouse
ggagcgaagctgtttcccgc

SEQ ID NO: 564754 - DNA, 20 bp, mouse
gggtcacaggtcgtctccca

SEQ ID NO: 564755 - DNA, 20 bp, mouse
gcgggtttcgcggtgaccag

SEQ ID NO: 564756 - DNA, 20 bp, mouse
gttgctggcccatctctctc

SEQ ID NO: 564757 - DNA, 20 bp, mouse
gcgtcattccctggaaccta

SEQ ID NO: 564758 - DNA, 20 bp, mouse
gaggaagtccctaggttcca

SEQ ID NO: 564759 - DNA, 20 bp, mouse
ggagagctggcacccgagct

SEQ ID NO: 564760 - DNA, 20 bp, mouse
gcccaggcaggcggagcagg

SEQ ID NO: 564761 - DNA, 20 bp, mouse
gttcctctctctgcttgtct

SEQ ID NO: 564762 - DNA, 20 bp, mouse
gcagctctaagtccagggta

SEQ ID NO: 564763 - DNA, 20 bp, mouse
ggaagacaggcgtcattccc

SEQ ID NO: 564764 - DNA, 20 bp, mouse
gctgggtggccgccatgggt

SEQ ID NO: 564765 - DNA, 20 bp, mouse
gctgttgtgaagaagaggga

SEQ ID NO: 564766 - DNA, 20 bp, mouse
gcagcgaccgagaccaccag

SEQ ID NO: 564767 - DNA, 20 bp, mouse
ggagccgggcccagaatcta

SEQ ID NO: 564768 - DNA, 20 bp, mouse
gcccgacgggccctagcagt

SEQ ID NO: 564769 - DNA, 20 bp, mouse
gcgctcgggcgggacatggc

SEQ ID NO: 564770 - DNA, 20 bp, mouse
gcagcggctgcccactgcta

SEQ ID NO: 564771 - DNA, 20 bp, mouse
gccctgtgtcagcagccgag

SEQ ID NO: 564772 - DNA, 20 bp, mouse
gtgacacagggcccgacccg

SEQ ID NO: 564773 - DNA, 20 bp, mouse
gccgaggagagagccgacac

SEQ ID NO: 564774 - DNA, 20 bp, mouse
ggcccactgctagggcccgt

SEQ ID NO: 564775 - DNA, 20 bp, mouse
gcgggacatggctggttgtg

SEQ ID NO: 564776 - DNA, 20 bp, mouse
gcgcagctagcggagaacgg

SEQ ID NO: 564777 - DNA, 20 bp, mouse
ggcgcgcagctagcggagaa

SEQ ID NO: 564778 - DNA, 20 bp, mouse
gcgggacggcggccaaggga

SEQ ID NO: 564779 - DNA, 20 bp, mouse
gcgagagatcggccatcttg

SEQ ID NO: 564780 - DNA, 20 bp, mouse
gccgcggccggagtcaagag

SEQ ID NO: 564781 - DNA, 20 bp, mouse
gctagctgcgcgccgcaaga

SEQ ID NO: 564782 - DNA, 20 bp, mouse
gacggaggagaagccgactg

SEQ ID NO: 564783 - DNA, 20 bp, mouse
gctcatccggaagcgcggga

SEQ ID NO: 564784 - DNA, 20 bp, mouse
gagctcgtccagcgagagat

SEQ ID NO: 564785 - DNA, 20 bp, mouse
gccgcgcggccgggccaata

SEQ ID NO: 564786 - DNA, 20 bp, mouse
gcctgaggaacagtggacgg

SEQ ID NO: 564787 - DNA, 20 bp, mouse
gcaatggtcctgaggaacag

SEQ ID NO: 564788 - DNA, 20 bp, mouse
ggagcgtcgcaatggtcctg

SEQ ID NO: 564789 - DNA, 20 bp, mouse
ggcaggacaccggctctcac

SEQ ID NO: 564790 - DNA, 20 bp, mouse
ggagctttggagcgtcgcaa

SEQ ID NO: 564791 - DNA, 20 bp, mouse
ggacgctccaaagctccctc

SEQ ID NO: 564792 - DNA, 20 bp, mouse
gaattctccccggagcctga

SEQ ID NO: 564793 - DNA, 20 bp, mouse
ggagcgcgccaaattctccc

SEQ ID NO: 564794 - DNA, 20 bp, mouse
ggcggtgtccgggggttcag

SEQ ID NO: 564795 - DNA, 20 bp, mouse
gagccgggcgcggatggcga

SEQ ID NO: 564796 - DNA, 20 bp, mouse
gcgcgaacatggcgccggag

SEQ ID NO: 564797 - DNA, 20 bp, mouse
gcttgaaagctgagaccgtg

SEQ ID NO: 564798 - DNA, 20 bp, mouse
gggatcgcggaaacccaggt

SEQ ID NO: 564799 - DNA, 20 bp, mouse
gcatggcgccggagcggctg

SEQ ID NO: 564800 - DNA, 20 bp, mouse
ggctcaggaggtgagtctcg

SEQ ID NO: 564801 - DNA, 20 bp, mouse
gtctagatagggcattgcgg

SEQ ID NO: 564802 - DNA, 20 bp, mouse
ggcgctgacgccgaactgag

SEQ ID NO: 564803 - DNA, 20 bp, mouse
ggcggggcttgctgctcagg

SEQ ID NO: 564804 - DNA, 20 bp, mouse
gtggcgccaaatcgcgaaca

SEQ ID NO: 564805 - DNA, 20 bp, mouse
gaactgagcggggaagttgg

SEQ ID NO: 564806 - DNA, 20 bp, mouse
gtccagacaccagaactgtc

SEQ ID NO: 564807 - DNA, 20 bp, mouse
gtctcctcgcagctcccgga

SEQ ID NO: 564808 - DNA, 20 bp, mouse
gggtaggacggaagcctccg

SEQ ID NO: 564809 - DNA, 20 bp, mouse
ggggtcgagggcggacgtgt

SEQ ID NO: 564810 - DNA, 20 bp, mouse
gcgtaagtcgctctctactg

SEQ ID NO: 564811 - DNA, 20 bp, mouse
gaggctgaagggaggcgcag

SEQ ID NO: 564812 - DNA, 20 bp, mouse
ggggctggcgaatgggtcga

SEQ ID NO: 564813 - DNA, 20 bp, mouse
gggtgtcaacatctccaagg

SEQ ID NO: 564814 - DNA, 20 bp, mouse
gctggcgaatgggtcgaggg

SEQ ID NO: 564815 - DNA, 20 bp, mouse
ggcaatggcggagaggcccg

SEQ ID NO: 564816 - DNA, 20 bp, mouse
ggagaggaagaggctcccgg

SEQ ID NO: 564817 - DNA, 20 bp, mouse
gcgggaggggatggcggcag

SEQ ID NO: 564818 - DNA, 20 bp, mouse
gactcaaacggggcccacag

SEQ ID NO: 564819 - DNA, 20 bp, mouse
ggcacgcgccaggataaaga

SEQ ID NO: 564820 - DNA, 20 bp, mouse
gcacacgtttcgggagggga

SEQ ID NO: 564821 - DNA, 20 bp, mouse
ggcgccacacgtttcgggag

SEQ ID NO: 564822 - DNA, 20 bp, mouse
gcggtgcgacggggaagcaa

SEQ ID NO: 564823 - DNA, 20 bp, mouse
gcgccagaggcagcctcgag

SEQ ID NO: 564824 - DNA, 20 bp, mouse
ggacctaggaaggcctctgt

SEQ ID NO: 564825 - DNA, 20 bp, mouse
gctgcctctggcgagagtaa

SEQ ID NO: 564826 - DNA, 20 bp, mouse
gtcgcgcagacgggaagttg

SEQ ID NO: 564827 - DNA, 20 bp, mouse
ggcagcctcagggtggcgtg

SEQ ID NO: 564828 - DNA, 20 bp, mouse
gcgccaccctgaggctgcgt

SEQ ID NO: 564829 - DNA, 20 bp, mouse
gcacagccccggcgacgacg

SEQ ID NO: 564830 - DNA, 20 bp, mouse
gcagggtggcgtgcggtctc

SEQ ID NO: 564831 - DNA, 20 bp, mouse
gggacccagttcgcgcagac

SEQ ID NO: 564832 - DNA, 20 bp, mouse
gctgcgcgaactgggtcccg

SEQ ID NO: 564833 - DNA, 20 bp, mouse
gggcgacgacgcggcgtccg

SEQ ID NO: 564834 - DNA, 20 bp, mouse
ggccgccgacgccccgacca

SEQ ID NO: 564835 - DNA, 20 bp, mouse
gcccggcccggcttcccgag

SEQ ID NO: 564836 - DNA, 20 bp, mouse
gtgaaactgcggctctgcac

SEQ ID NO: 564837 - DNA, 20 bp, mouse
gggctctgcacgggaggtgc

SEQ ID NO: 564838 - DNA, 20 bp, mouse
gggtagacctctgccggagg

SEQ ID NO: 564839 - DNA, 20 bp, mouse
ggctgaaaaagtgcctcctc

SEQ ID NO: 564840 - DNA, 20 bp, mouse
gaactgcggctctgcacggg

SEQ ID NO: 564841 - DNA, 20 bp, mouse
gcaaacctacaccagcacca

SEQ ID NO: 564842 - DNA, 20 bp, mouse
ggtgcctgcaccccaggccc

SEQ ID NO: 564843 - DNA, 20 bp, mouse
gctgaagcgatgcgctgcgg

SEQ ID NO: 564844 - DNA, 20 bp, mouse
gcgggccaccgcatgctcgg

SEQ ID NO: 564845 - DNA, 20 bp, mouse
gaagcgatgcgctgcggtgg

SEQ ID NO: 564846 - DNA, 20 bp, mouse
ggatccgagtaggtagccct

SEQ ID NO: 564847 - DNA, 20 bp, mouse
gcgaagctgcgggctccggg

SEQ ID NO: 564848 - DNA, 20 bp, mouse
ggcgcgtcaaccgtccctcg

SEQ ID NO: 564849 - DNA, 20 bp, mouse
gggctctaagagtgtctcta

SEQ ID NO: 564850 - DNA, 20 bp, mouse
gccgcgcgcgccgcgaggga

SEQ ID NO: 564851 - DNA, 20 bp, mouse
gtgataacacagatccgagt

SEQ ID NO: 564852 - DNA, 20 bp, mouse
ggacaggtgtcgccttggta

SEQ ID NO: 564853 - DNA, 20 bp, mouse
ggcctcccagaggtatagtt

SEQ ID NO: 564854 - DNA, 20 bp, mouse
ggagcccgcagcttcgctct

SEQ ID NO: 564855 - DNA, 20 bp, mouse
ggagcctagggctacctact

SEQ ID NO: 564856 - DNA, 20 bp, mouse
gcccgcgtgcaagggctcca

SEQ ID NO: 564857 - DNA, 20 bp, mouse
ggaagacgctcctcgtgcca

SEQ ID NO: 564858 - DNA, 20 bp, mouse
gggagacaggtgcaccccga

SEQ ID NO: 564859 - DNA, 20 bp, mouse
gccgccgcccccgcgtgcaa

SEQ ID NO: 564860 - DNA, 20 bp, mouse
gggcctggggagtgccgtgt

SEQ ID NO: 564861 - DNA, 20 bp, mouse
gctggaggtgggaagtgtca

SEQ ID NO: 564862 - DNA, 20 bp, mouse
gcaggcttcagcagccaaca

SEQ ID NO: 564863 - DNA, 20 bp, mouse
ggagtcgcaagaagcatcag

SEQ ID NO: 564864 - DNA, 20 bp, mouse
ggtcggaagtggatcaccta

SEQ ID NO: 564865 - DNA, 20 bp, mouse
gttggcccgaagggaagatg

SEQ ID NO: 564866 - DNA, 20 bp, mouse
ggccttcagaaggttcccct

SEQ ID NO: 564867 - DNA, 20 bp, mouse
ggagttgtagtcgcaatcct

SEQ ID NO: 564868 - DNA, 20 bp, mouse
gctaaaggctggttgcctag

SEQ ID NO: 564869 - DNA, 20 bp, mouse
ggtgtcctgggcgcgcctaa

SEQ ID NO: 564870 - DNA, 20 bp, mouse
gggcaactggtgtgtgtcct

SEQ ID NO: 564871 - DNA, 20 bp, mouse
gagccaggctggacggaaag

SEQ ID NO: 564872 - DNA, 20 bp, mouse
gcctgggcgcgcctaaaggc

SEQ ID NO: 564873 - DNA, 20 bp, mouse
gccgggacgtgagaaccctc

SEQ ID NO: 564874 - DNA, 20 bp, mouse
gtgcctgggcaaaaatgata

SEQ ID NO: 564875 - DNA, 20 bp, mouse
gaagcccacttgccttcaga

SEQ ID NO: 564876 - DNA, 20 bp, mouse
gcccaggaccggtccaaagt

SEQ ID NO: 564877 - DNA, 20 bp, mouse
gagagaaataaactcaccat

SEQ ID NO: 564878 - DNA, 20 bp, mouse
ggtgcagccgcagcagatgt

SEQ ID NO: 564879 - DNA, 20 bp, mouse
gaaagtaggttagaatctcc

SEQ ID NO: 564880 - DNA, 20 bp, mouse
gagggagccctcacagctgg

SEQ ID NO: 564881 - DNA, 20 bp, mouse
gggagccaatgaaaacggat

SEQ ID NO: 564882 - DNA, 20 bp, mouse
gaacggattgggggaggaag

SEQ ID NO: 564883 - DNA, 20 bp, mouse
gcagctgctcacagtggatg

SEQ ID NO: 564884 - DNA, 20 bp, mouse
ggagcagctggtgtgaacca

SEQ ID NO: 564885 - DNA, 20 bp, mouse
gccgttttcattggctccca

SEQ ID NO: 564886 - DNA, 20 bp, mouse
ggaagccgcagaacgaagga

SEQ ID NO: 564887 - DNA, 20 bp, mouse
gcgtcgcttcggaagcatct

SEQ ID NO: 564888 - DNA, 20 bp, mouse
gacaggaagccgcagaacga

SEQ ID NO: 564889 - DNA, 20 bp, mouse
ggcaccaactctggaagcac

SEQ ID NO: 564890 - DNA, 20 bp, mouse
gacgggcccaggctactcta

SEQ ID NO: 564891 - DNA, 20 bp, mouse
gcgcagaacgaaggaaggca

SEQ ID NO: 564892 - DNA, 20 bp, mouse
ggcagggtcatgaaagaagg

SEQ ID NO: 564893 - DNA, 20 bp, mouse
gccgggaagcgcaccaccga

SEQ ID NO: 564894 - DNA, 20 bp, mouse
gcctgtaagcatctaggacg

SEQ ID NO: 564895 - DNA, 20 bp, mouse
gggctcccgggaggccccga

SEQ ID NO: 564896 - DNA, 20 bp, mouse
gtggcagagagcagtgactg

SEQ ID NO: 564897 - DNA, 20 bp, mouse
ggcgtcctggcactcccgtg

SEQ ID NO: 564898 - DNA, 20 bp, mouse
gcctcaagcaggctgtagga

SEQ ID NO: 564899 - DNA, 20 bp, mouse
ggcactcccgtgaggcactg

SEQ ID NO: 564900 - DNA, 20 bp, mouse
gagtgactgcggctttcctg

SEQ ID NO: 564901 - DNA, 20 bp, mouse
gtgcggctttcctgaggtaa

SEQ ID NO: 564902 - DNA, 20 bp, mouse
gggcgcgcgcggttggaggc

SEQ ID NO: 564903 - DNA, 20 bp, mouse
gggctgtaggagggtagcgg

SEQ ID NO: 564904 - DNA, 20 bp, mouse
ggatgcctcaagcaggctgt

SEQ ID NO: 564905 - DNA, 20 bp, mouse
gtaagggtcttgtaagttcg

SEQ ID NO: 564906 - DNA, 20 bp, mouse
gggcctgcatttgaagatgg

SEQ ID NO: 564907 - DNA, 20 bp, mouse
gtcccgcgcgggaggcctat

SEQ ID NO: 564908 - DNA, 20 bp, mouse
gcggtagctgtcactaggtt

SEQ ID NO: 564909 - DNA, 20 bp, mouse
gggaggcctgcatttgaaga

SEQ ID NO: 564910 - DNA, 20 bp, mouse
gacgcggccggaggctcaca

SEQ ID NO: 564911 - DNA, 20 bp, mouse
gggacacgacacagtcccat

SEQ ID NO: 564912 - DNA, 20 bp, mouse
gactcagcaccggtccacac

SEQ ID NO: 564913 - DNA, 20 bp, mouse
gtcccataggcctcccgcgc

SEQ ID NO: 564914 - DNA, 20 bp, mouse
gccggaggtggactcagcac

SEQ ID NO: 564915 - DNA, 20 bp, mouse
gaagagggaagccatcccca

SEQ ID NO: 564916 - DNA, 20 bp, mouse
gactcaagtggcgttctctg

SEQ ID NO: 564917 - DNA, 20 bp, mouse
gctgcgctacaagactcaag

SEQ ID NO: 564918 - DNA, 20 bp, mouse
ggtgggatgcgtgtagaaca

SEQ ID NO: 564919 - DNA, 20 bp, mouse
gcggccgaagagctcaagta

SEQ ID NO: 564920 - DNA, 20 bp, mouse
ggctcaagtaaggagttagt

SEQ ID NO: 564921 - DNA, 20 bp, mouse
gttgagccgagccagtccgg

SEQ ID NO: 564922 - DNA, 20 bp, mouse
gcgcttgcgtgcgagaaccg

SEQ ID NO: 564923 - DNA, 20 bp, mouse
gggcgttctctgcggctgac

SEQ ID NO: 564924 - DNA, 20 bp, mouse
gttctcgcacgcaagcgcag

SEQ ID NO: 564925 - DNA, 20 bp, mouse
gggaccagaggagactaatt

SEQ ID NO: 564926 - DNA, 20 bp, mouse
ggcttctgccagtcccggac

SEQ ID NO: 564927 - DNA, 20 bp, mouse
gccggtctcccgtccgggac

SEQ ID NO: 564928 - DNA, 20 bp, mouse
gtagctccggtctcccgtcc

SEQ ID NO: 564929 - DNA, 20 bp, mouse
gggagctaggacgctactcg

SEQ ID NO: 564930 - DNA, 20 bp, mouse
gggatgtcgacggccggtgg

SEQ ID NO: 564931 - DNA, 20 bp, mouse
gccaggaccccccaggccaa

SEQ ID NO: 564932 - DNA, 20 bp, mouse
ggcagaagcatggatgtcga

SEQ ID NO: 564933 - DNA, 20 bp, mouse
gagctctggagcgcagtgca

SEQ ID NO: 564934 - DNA, 20 bp, mouse
gcaactacgcggcgctggag

SEQ ID NO: 564935 - DNA, 20 bp, mouse
gtactcgtggctggctggaa

SEQ ID NO: 564936 - DNA, 20 bp, mouse
gtcaggcggtggaggagatg

SEQ ID NO: 564937 - DNA, 20 bp, mouse
gcgccactcgctgtaaaagg

SEQ ID NO: 564938 - DNA, 20 bp, mouse
gatggcggcggctcaggcgg

SEQ ID NO: 564939 - DNA, 20 bp, mouse
gtacagcgagtggcggaaga

SEQ ID NO: 564940 - DNA, 20 bp, mouse
gtccatggacgggtcagaca

SEQ ID NO: 564941 - DNA, 20 bp, mouse
gtagttaccgggaaagtccg

SEQ ID NO: 564942 - DNA, 20 bp, mouse
gtcccaggcatcatcataac

SEQ ID NO: 564943 - DNA, 20 bp, mouse
ggacctagagccaacagaaa

SEQ ID NO: 564944 - DNA, 20 bp, mouse
gagaaccgcttcgagaaggt

SEQ ID NO: 564945 - DNA, 20 bp, mouse
gtgcgacccgggtccgaggg

SEQ ID NO: 564946 - DNA, 20 bp, mouse
gcccatgtcgcgaaaggtgc

SEQ ID NO: 564947 - DNA, 20 bp, mouse
gtcgcgaaaggtgcgggaca

SEQ ID NO: 564948 - DNA, 20 bp, mouse
gaaaccaccgacggaagaag

SEQ ID NO: 564949 - DNA, 20 bp, mouse
gagcgaagcgggtggcgaag

SEQ ID NO: 564950 - DNA, 20 bp, mouse
ggatgctagccatccgggag

SEQ ID NO: 564951 - DNA, 20 bp, mouse
gggtgcgtgaccttacaacg

SEQ ID NO: 564952 - DNA, 20 bp, mouse
gctcttccccatgtcgcgaa

SEQ ID NO: 564953 - DNA, 20 bp, mouse
gcgtcatccgcttcttccgt

SEQ ID NO: 564954 - DNA, 20 bp, mouse
ggtcgggccagcgaagcggg

SEQ ID NO: 564955 - DNA, 20 bp, mouse
gccaggcccgccactcggga

SEQ ID NO: 564956 - DNA, 20 bp, mouse
ggctggagacacggagacag

SEQ ID NO: 564957 - DNA, 20 bp, mouse
gggcgagctcatggctactc

SEQ ID NO: 564958 - DNA, 20 bp, mouse
ggtgtgaaccggcgagctca

SEQ ID NO: 564959 - DNA, 20 bp, mouse
gcggagggaaaaggtgatgg

SEQ ID NO: 564960 - DNA, 20 bp, mouse
gctgtggagagcccgacgac

SEQ ID NO: 564961 - DNA, 20 bp, mouse
ggtgcaaggtggctgtactg

SEQ ID NO: 564962 - DNA, 20 bp, mouse
gccctgagacgagtccgaag

SEQ ID NO: 564963 - DNA, 20 bp, mouse
gcacacgcggactcaaaaac

SEQ ID NO: 564964 - DNA, 20 bp, mouse
gggtggcagggaacctgtcc

SEQ ID NO: 564965 - DNA, 20 bp, mouse
gtgcaggcagtgggctaccg

SEQ ID NO: 564966 - DNA, 20 bp, mouse
gaagtaaccgggatcctgaa

SEQ ID NO: 564967 - DNA, 20 bp, mouse
ggccgagagcgcgaccggga

SEQ ID NO: 564968 - DNA, 20 bp, mouse
ggaaggtggctcccggaagg

SEQ ID NO: 564969 - DNA, 20 bp, mouse
gtcctgaacggcagaggtta

SEQ ID NO: 564970 - DNA, 20 bp, mouse
ggcgcttctgaggagagaac

SEQ ID NO: 564971 - DNA, 20 bp, mouse
gagagcgcgaccgggacggt

SEQ ID NO: 564972 - DNA, 20 bp, mouse
gccgggacggttggagaaga

SEQ ID NO: 564973 - DNA, 20 bp, mouse
gaagcgccgagagcgcgacc

SEQ ID NO: 564974 - DNA, 20 bp, mouse
ggaagaaggtggctcccgga

SEQ ID NO: 564975 - DNA, 20 bp, mouse
ggaaggcagaggaacgaaaa

SEQ ID NO: 564976 - DNA, 20 bp, mouse
gctggagacgggaagcgcgg

SEQ ID NO: 564977 - DNA, 20 bp, mouse
gaagctggagacgggaagcg

SEQ ID NO: 564978 - DNA, 20 bp, mouse
gccgaggattctgggaacgt

SEQ ID NO: 564979 - DNA, 20 bp, mouse
ggagcccgcgcgccacggac

SEQ ID NO: 564980 - DNA, 20 bp, mouse
gcgttcccgggctaaatcgt

SEQ ID NO: 564981 - DNA, 20 bp, mouse
gctgagacgccgaggattct

SEQ ID NO: 564982 - DNA, 20 bp, mouse
gcgccacggacgggatgcgg

SEQ ID NO: 564983 - DNA, 20 bp, mouse
gtttagcccgggaacgaagt

SEQ ID NO: 564984 - DNA, 20 bp, mouse
ggtcggagacggacattgct

SEQ ID NO: 564985 - DNA, 20 bp, mouse
gattctgggaacgtcggaga

SEQ ID NO: 564986 - DNA, 20 bp, mouse
gcccgccgacaaactgctgg

SEQ ID NO: 564987 - DNA, 20 bp, mouse
ggcggccaccagcagtttgt

SEQ ID NO: 564988 - DNA, 20 bp, mouse
ggaattggccaccctacagg

SEQ ID NO: 564989 - DNA, 20 bp, mouse
ggcctgtctttcctcctgta

SEQ ID NO: 564990 - DNA, 20 bp, mouse
gcctcgagctcctgaccccg

SEQ ID NO: 564991 - DNA, 20 bp, mouse
gaaggcggcgaggggagagg

SEQ ID NO: 564992 - DNA, 20 bp, mouse
gaaactgctggtggccgcgc

SEQ ID NO: 564993 - DNA, 20 bp, mouse
gcccaccccgggcggagggt

SEQ ID NO: 564994 - DNA, 20 bp, mouse
gtcgcagaggtgcccataat

SEQ ID NO: 564995 - DNA, 20 bp, mouse
gctacaccgcccggatgagg

SEQ ID NO: 564996 - DNA, 20 bp, mouse
ggcggcacgtcctaaagtaa

SEQ ID NO: 564997 - DNA, 20 bp, mouse
ggcacgtcctaaagtaatgg

SEQ ID NO: 564998 - DNA, 20 bp, mouse
gggcgggtggaagcgatcct

SEQ ID NO: 564999 - DNA, 20 bp, mouse
gtcgcggcttccgtctccgg

SEQ ID NO: 565000 - DNA, 20 bp, mouse
gaggcccgaatgctccctgt

SEQ ID NO: 565001 - DNA, 20 bp, mouse
gcgtcctaaagtaatggcgg

SEQ ID NO: 565002 - DNA, 20 bp, mouse
gcacggcgcaggctagcgaa

SEQ ID NO: 565003 - DNA, 20 bp, mouse
gctaaagtaatggcggcggg

SEQ ID NO: 565004 - DNA, 20 bp, mouse
gccacagccaccgccggaga

SEQ ID NO: 565005 - DNA, 20 bp, mouse
gccctcgcggcttccgtctc

SEQ ID NO: 565006 - DNA, 20 bp, mouse
gcgcgacagcatggacgacg

SEQ ID NO: 565007 - DNA, 20 bp, mouse
gcgacgaggaggagacctac

SEQ ID NO: 565008 - DNA, 20 bp, mouse
gtccggcgcaggctccgtgc

SEQ ID NO: 565009 - DNA, 20 bp, mouse
ggacagcatggacgacgagg

SEQ ID NO: 565010 - DNA, 20 bp, mouse
ggcgcgcgtgcacagttgtt

SEQ ID NO: 565011 - DNA, 20 bp, mouse
gcggatcttccacagccggt

SEQ ID NO: 565012 - DNA, 20 bp, mouse
ggctcgtggagctgccagca

SEQ ID NO: 565013 - DNA, 20 bp, mouse
ggcgcaggcgcactgccggg

SEQ ID NO: 565014 - DNA, 20 bp, mouse
gtaagagttgaagccagcgt

SEQ ID NO: 565015 - DNA, 20 bp, mouse
ggccagcacggagcctgcgc

SEQ ID NO: 565016 - DNA, 20 bp, mouse
ggcgcaaactacgcgtggtg

SEQ ID NO: 565017 - DNA, 20 bp, mouse
gctacgcgtggtgcggcgag

SEQ ID NO: 565018 - DNA, 20 bp, mouse
ggtggtgcggcgaggggcaa

SEQ ID NO: 565019 - DNA, 20 bp, mouse
gctaggtgtgatagtagcag

SEQ ID NO: 565020 - DNA, 20 bp, mouse
gagtaactgcgcctgggtca

SEQ ID NO: 565021 - DNA, 20 bp, mouse
gtctgcgccccgggcggaga

SEQ ID NO: 565022 - DNA, 20 bp, mouse
gatgatgccttctccgcccg

SEQ ID NO: 565023 - DNA, 20 bp, mouse
gcctacctcgcggagcaatg

SEQ ID NO: 565024 - DNA, 20 bp, mouse
gcccagctgctgggttggtg

SEQ ID NO: 565025 - DNA, 20 bp, mouse
gggcatcatgtcagacaacg

SEQ ID NO: 565026 - DNA, 20 bp, mouse
gtcccacgcagagacctctc

SEQ ID NO: 565027 - DNA, 20 bp, mouse
gtccggagaggtctctgcgt

SEQ ID NO: 565028 - DNA, 20 bp, mouse
gggaagcgaccgcagagaag

SEQ ID NO: 565029 - DNA, 20 bp, mouse
ggcgaccgcagagaagtggt

SEQ ID NO: 565030 - DNA, 20 bp, mouse
gtctctgcgtgggaagttct

SEQ ID NO: 565031 - DNA, 20 bp, mouse
gtctgcaagtgcttccggag

SEQ ID NO: 565032 - DNA, 20 bp, mouse
gtgggaagttctgggcgctg

SEQ ID NO: 565033 - DNA, 20 bp, mouse
ggtttggaccgaagtatcgt

SEQ ID NO: 565034 - DNA, 20 bp, mouse
ggatgcggggtaactgtgag

SEQ ID NO: 565035 - DNA, 20 bp, mouse
ggacagaaggagttaagaag

SEQ ID NO: 565036 - DNA, 20 bp, mouse
gggatgcccgccatcgcgaa

SEQ ID NO: 565037 - DNA, 20 bp, mouse
ggagcgcgcggccaccactg

SEQ ID NO: 565038 - DNA, 20 bp, mouse
gtcctgagggaggtaccgag

SEQ ID NO: 565039 - DNA, 20 bp, mouse
gcgtggagaaaagtaagaca

SEQ ID NO: 565040 - DNA, 20 bp, mouse
ggctttcgtgcccttcgcga

SEQ ID NO: 565041 - DNA, 20 bp, mouse
gcagctaagggccacccacc

SEQ ID NO: 565042 - DNA, 20 bp, mouse
gagggaggtaccgagagggt

SEQ ID NO: 565043 - DNA, 20 bp, mouse
gtcgtgcccttcgcgatggc

SEQ ID NO: 565044 - DNA, 20 bp, mouse
gtgggtgctggcatacccct

SEQ ID NO: 565045 - DNA, 20 bp, mouse
gtgcagaggatgtgagcgcg

SEQ ID NO: 565046 - DNA, 20 bp, mouse
gcagtcgctatggaacccga

SEQ ID NO: 565047 - DNA, 20 bp, mouse
gcgtacgagcctggcttcgt

SEQ ID NO: 565048 - DNA, 20 bp, mouse
ggcccgggcctcaccattcc

SEQ ID NO: 565049 - DNA, 20 bp, mouse
gaggcccgggcagtaggtgt

SEQ ID NO: 565050 - DNA, 20 bp, mouse
gtattcggttctgccaggaa

SEQ ID NO: 565051 - DNA, 20 bp, mouse
gtgcagacgggagagcatgt

SEQ ID NO: 565052 - DNA, 20 bp, mouse
gtgctgtacgcggtgagtac

SEQ ID NO: 565053 - DNA, 20 bp, mouse
gggttctgccaggaatggtg

SEQ ID NO: 565054 - DNA, 20 bp, mouse
gcaggctcgtacgtcccgtc

SEQ ID NO: 565055 - DNA, 20 bp, mouse
gaggccgaagccgggaagaa

SEQ ID NO: 565056 - DNA, 20 bp, mouse
ggcggaaggagactgtgggt

SEQ ID NO: 565057 - DNA, 20 bp, mouse
gtgttggcggaaggagactg

SEQ ID NO: 565058 - DNA, 20 bp, mouse
gagaacgactcgaaggccgg

SEQ ID NO: 565059 - DNA, 20 bp, mouse
gagactgtgggttggtgtcg

SEQ ID NO: 565060 - DNA, 20 bp, mouse
ggtgtcggggagcgagagcg

SEQ ID NO: 565061 - DNA, 20 bp, mouse
ggcaagaacgactcgaaggc

SEQ ID NO: 565062 - DNA, 20 bp, mouse
ggctaggatgaacgctcctc

SEQ ID NO: 565063 - DNA, 20 bp, mouse
gaagagcaagaacgactcga

SEQ ID NO: 565064 - DNA, 20 bp, mouse
gagtcgttcttgctcttcga

SEQ ID NO: 565065 - DNA, 20 bp, mouse
gggcgagaagaagtaagtgg

SEQ ID NO: 565066 - DNA, 20 bp, mouse
gtcttccagctgtggaggta

SEQ ID NO: 565067 - DNA, 20 bp, mouse
gtaagccaggctcaaagtca

SEQ ID NO: 565068 - DNA, 20 bp, mouse
gtacttccaaaatcatcagc

SEQ ID NO: 565069 - DNA, 20 bp, mouse
gtcaaggcgctggttgaagg

SEQ ID NO: 565070 - DNA, 20 bp, mouse
gctcgagactaactccaccg

SEQ ID NO: 565071 - DNA, 20 bp, mouse
ggcgcgtaaataaagatccc

SEQ ID NO: 565072 - DNA, 20 bp, mouse
gcgtaaataaagatccccgg

SEQ ID NO: 565073 - DNA, 20 bp, mouse
gctttgtgggcagccgggag

SEQ ID NO: 565074 - DNA, 20 bp, mouse
gtcggcgccggaagttggcg

SEQ ID NO: 565075 - DNA, 20 bp, mouse
gacaagagtaatacactaat

SEQ ID NO: 565076 - DNA, 20 bp, mouse
gggccttgaaaagctactgc

SEQ ID NO: 565077 - DNA, 20 bp, mouse
ggccgcttcagggtaatcat

SEQ ID NO: 565078 - DNA, 20 bp, mouse
gatgaagtcgaggggcaatg

SEQ ID NO: 565079 - DNA, 20 bp, mouse
gctgggggcatgaagtcgag

SEQ ID NO: 565080 - DNA, 20 bp, mouse
gttcctatggagaattggca

SEQ ID NO: 565081 - DNA, 20 bp, mouse
ggatgctgccgcgggctcgg

SEQ ID NO: 565082 - DNA, 20 bp, mouse
gatcttacggggcggagcta

SEQ ID NO: 565083 - DNA, 20 bp, mouse
gtttcgaggcaggatttcgg

SEQ ID NO: 565084 - DNA, 20 bp, mouse
gtcttctgggaatacatcac

SEQ ID NO: 565085 - DNA, 20 bp, mouse
gaatggggagggttctgcgg

SEQ ID NO: 565086 - DNA, 20 bp, mouse
gcgcggcgggcagggatccc

SEQ ID NO: 565087 - DNA, 20 bp, mouse
gggcgactctggagcgcgag

SEQ ID NO: 565088 - DNA, 20 bp, mouse
gagctcccgaggacttgggg

SEQ ID NO: 565089 - DNA, 20 bp, mouse
gccgtgctcttccgggaaaa

SEQ ID NO: 565090 - DNA, 20 bp, mouse
gggcgggcagggatccccgg

SEQ ID NO: 565091 - DNA, 20 bp, mouse
ggacttggggcggcagagtt

SEQ ID NO: 565092 - DNA, 20 bp, mouse
gggagaagccgtgctcttcc

SEQ ID NO: 565093 - DNA, 20 bp, mouse
gcccagctcccgaggacttg

SEQ ID NO: 565094 - DNA, 20 bp, mouse
gccagagtcgccgccggccg

SEQ ID NO: 565095 - DNA, 20 bp, mouse
gggagctgcgggagaggttg

SEQ ID NO: 565096 - DNA, 20 bp, mouse
gtaagcaccccgggaaggtg

SEQ ID NO: 565097 - DNA, 20 bp, mouse
gctgtcgccgcaccttcccg

SEQ ID NO: 565098 - DNA, 20 bp, mouse
gcgctctacggtggccgggg

SEQ ID NO: 565099 - DNA, 20 bp, mouse
gatacctaagcaccccggga

SEQ ID NO: 565100 - DNA, 20 bp, mouse
gcccagagtgtcccaggaga

SEQ ID NO: 565101 - DNA, 20 bp, mouse
gcacgtgcggcgctctacgg

SEQ ID NO: 565102 - DNA, 20 bp, mouse
ggtagtcgcagctccgagaa

SEQ ID NO: 565103 - DNA, 20 bp, mouse
gtgtaaggacgcccccgaag

SEQ ID NO: 565104 - DNA, 20 bp, mouse
gcggcacgtgcggcgctcta

SEQ ID NO: 565105 - DNA, 20 bp, mouse
gccggggtgcttaggtattt

SEQ ID NO: 565106 - DNA, 20 bp, mouse
gtacttgcttggagccgcac

SEQ ID NO: 565107 - DNA, 20 bp, mouse
ggctccaagcaagtagcacg

SEQ ID NO: 565108 - DNA, 20 bp, mouse
gttgcttggagccgcacggg

SEQ ID NO: 565109 - DNA, 20 bp, mouse
ggtgccgtgagcgcaggcag

SEQ ID NO: 565110 - DNA, 20 bp, mouse
ggtcaggctcccgaactcct

SEQ ID NO: 565111 - DNA, 20 bp, mouse
ggcaagtagcacgcggagag

SEQ ID NO: 565112 - DNA, 20 bp, mouse
gcgcaggcagcggaagaggt

SEQ ID NO: 565113 - DNA, 20 bp, mouse
gtccattccattcacggtag

SEQ ID NO: 565114 - DNA, 20 bp, mouse
gacaagcgccacggggacac

SEQ ID NO: 565115 - DNA, 20 bp, mouse
gtcctctaccgtgaatggaa

SEQ ID NO: 565116 - DNA, 20 bp, mouse
gaagtagagcaccatccagg

SEQ ID NO: 565117 - DNA, 20 bp, mouse
gtagaagtagagcaccatcc

SEQ ID NO: 565118 - DNA, 20 bp, mouse
ggtgctctacttctaagaag

SEQ ID NO: 565119 - DNA, 20 bp, mouse
gcgcggaagggtcagagcac

SEQ ID NO: 565120 - DNA, 20 bp, mouse
gatgggaagctcatgagctg

SEQ ID NO: 565121 - DNA, 20 bp, mouse
gcatccaggcggacgcggaa

SEQ ID NO: 565122 - DNA, 20 bp, mouse
gacttctaagaaggggcgat

SEQ ID NO: 565123 - DNA, 20 bp, mouse
ggcctcgggaggacaacatt

SEQ ID NO: 565124 - DNA, 20 bp, mouse
gagcaccatccaggcggacg

SEQ ID NO: 565125 - DNA, 20 bp, mouse
gcggaaaccaccgacactgt

SEQ ID NO: 565126 - DNA, 20 bp, mouse
gagtctgcgtggcaaggacc

SEQ ID NO: 565127 - DNA, 20 bp, mouse
gctccgactagagcaaccac

SEQ ID NO: 565128 - DNA, 20 bp, mouse
ggcgctgccatcttaccctg

SEQ ID NO: 565129 - DNA, 20 bp, mouse
gggcaaggcggaagtctgcg

SEQ ID NO: 565130 - DNA, 20 bp, mouse
gcttccgccccagggtaaga

SEQ ID NO: 565131 - DNA, 20 bp, mouse
gggcggaagtgacatcaagg

SEQ ID NO: 565132 - DNA, 20 bp, mouse
gcgcgggtctccgggcaagg

SEQ ID NO: 565133 - DNA, 20 bp, mouse
gtggacgcgaggaccctggg

SEQ ID NO: 565134 - DNA, 20 bp, mouse
gccccggcccccagagagaa

SEQ ID NO: 565135 - DNA, 20 bp, mouse
gggctggacgcgaggaccct

SEQ ID NO: 565136 - DNA, 20 bp, mouse
ggacccgcgggctgcagaga

SEQ ID NO: 565137 - DNA, 20 bp, mouse
gggcggccgggtcttctatc

SEQ ID NO: 565138 - DNA, 20 bp, mouse
gggagaggtgagccccgact

SEQ ID NO: 565139 - DNA, 20 bp, mouse
ggcctcccgggaccagggca

SEQ ID NO: 565140 - DNA, 20 bp, mouse
gcgctgcctgatagaagacc

SEQ ID NO: 565141 - DNA, 20 bp, mouse
gccgcggcctcccgggacca

SEQ ID NO: 565142 - DNA, 20 bp, mouse
gtcccgaggctgccgagtcg

SEQ ID NO: 565143 - DNA, 20 bp, mouse
gaccagggcagggcgcaagg

SEQ ID NO: 565144 - DNA, 20 bp, mouse
gctgcagcccgcgggtccct

SEQ ID NO: 565145 - DNA, 20 bp, mouse
ggagcaccgagcgagtgcga

SEQ ID NO: 565146 - DNA, 20 bp, mouse
gaagtctcgggaaccggtgg

SEQ ID NO: 565147 - DNA, 20 bp, mouse
gggagcgcgctggaagtctc

SEQ ID NO: 565148 - DNA, 20 bp, mouse
gtggaagtctcgggaaccgg

SEQ ID NO: 565149 - DNA, 20 bp, mouse
gaggcgcgcgccggggaccg

SEQ ID NO: 565150 - DNA, 20 bp, mouse
gggaccgaggcttgagagag

SEQ ID NO: 565151 - DNA, 20 bp, mouse
ggcgggactgagagagaagg

SEQ ID NO: 565152 - DNA, 20 bp, mouse
gcgctggaagtctcgggaac

SEQ ID NO: 565153 - DNA, 20 bp, mouse
gacttccagcgcgctccgag

SEQ ID NO: 565154 - DNA, 20 bp, mouse
ggtcccgcggggagaggctg

SEQ ID NO: 565155 - DNA, 20 bp, mouse
ggaggcttgagagagaggcg

SEQ ID NO: 565156 - DNA, 20 bp, mouse
gactccggaggtagaatctg

SEQ ID NO: 565157 - DNA, 20 bp, mouse
gggtgtggggcgcgctactc

SEQ ID NO: 565158 - DNA, 20 bp, mouse
gcgtagccgcgtgcggtgtg

SEQ ID NO: 565159 - DNA, 20 bp, mouse
gctgcggctccttgctggag

SEQ ID NO: 565160 - DNA, 20 bp, mouse
gcagcagctttggggaggta

SEQ ID NO: 565161 - DNA, 20 bp, mouse
ggggcacgtggagaacgtgg

SEQ ID NO: 565162 - DNA, 20 bp, mouse
gtcccaaagtcactccagag

SEQ ID NO: 565163 - DNA, 20 bp, mouse
gcacaggaccgcccccacac

SEQ ID NO: 565164 - DNA, 20 bp, mouse
gcgcagcagcagctttgggg

SEQ ID NO: 565165 - DNA, 20 bp, mouse
ggcagaagctgcggcaactg

SEQ ID NO: 565166 - DNA, 20 bp, mouse
gctgcgtgggccctgagtgg

SEQ ID NO: 565167 - DNA, 20 bp, mouse
gggaggcgggcctagaacga

SEQ ID NO: 565168 - DNA, 20 bp, mouse
gggcaggtaaggcttcgacc

SEQ ID NO: 565169 - DNA, 20 bp, mouse
gaccaatggagagctcgggg

SEQ ID NO: 565170 - DNA, 20 bp, mouse
ggcgggcctagaacgagggc

SEQ ID NO: 565171 - DNA, 20 bp, mouse
gagaaaagcaaatttcaagt

SEQ ID NO: 565172 - DNA, 20 bp, mouse
ggagcccggggaaaaagggg

SEQ ID NO: 565173 - DNA, 20 bp, mouse
gtgagagcccggggaaaaag

SEQ ID NO: 565174 - DNA, 20 bp, mouse
gaggtaaggcttcgacctgg

SEQ ID NO: 565175 - DNA, 20 bp, mouse
gcccaccaatggagagctcg

SEQ ID NO: 565176 - DNA, 20 bp, mouse
gggccagccgtccccaagag

SEQ ID NO: 565177 - DNA, 20 bp, mouse
gcggctggccggatgaagta

SEQ ID NO: 565178 - DNA, 20 bp, mouse
ggattcgggcctccttctgt

SEQ ID NO: 565179 - DNA, 20 bp, mouse
ggccctgagcgtgctagcat

SEQ ID NO: 565180 - DNA, 20 bp, mouse
ggggcactgcccacagaagg

SEQ ID NO: 565181 - DNA, 20 bp, mouse
gagagctgcgcggggccatg

SEQ ID NO: 565182 - DNA, 20 bp, mouse
gctttctactgacctctctt

SEQ ID NO: 565183 - DNA, 20 bp, mouse
gtactgacctctcttgggga

SEQ ID NO: 565184 - DNA, 20 bp, mouse
ggcagctcccctacttcatc

SEQ ID NO: 565185 - DNA, 20 bp, mouse
gtcagtagaaagctagcata

SEQ ID NO: 565186 - DNA, 20 bp, mouse
gagggctctggagaccggag

SEQ ID NO: 565187 - DNA, 20 bp, mouse
ggggcctgcgagctgtgatg

SEQ ID NO: 565188 - DNA, 20 bp, mouse
ggaggccagggtggcatccg

SEQ ID NO: 565189 - DNA, 20 bp, mouse
ggtggctcccgcgcgtggtg

SEQ ID NO: 565190 - DNA, 20 bp, mouse
gactagcagtgggaccggta

SEQ ID NO: 565191 - DNA, 20 bp, mouse
gccagggtggcatccgggga

SEQ ID NO: 565192 - DNA, 20 bp, mouse
gtgcaggtttggcttgtcag

SEQ ID NO: 565193 - DNA, 20 bp, mouse
gagcgccggctccccgtccc

SEQ ID NO: 565194 - DNA, 20 bp, mouse
ggcgtggtgcggacggaacg

SEQ ID NO: 565195 - DNA, 20 bp, mouse
ggccagccttggaggagcgc

SEQ ID NO: 565196 - DNA, 20 bp, mouse
ggccagacagaagcgaggtg

SEQ ID NO: 565197 - DNA, 20 bp, mouse
ggaagcgccagacagaagcg

SEQ ID NO: 565198 - DNA, 20 bp, mouse
gtgcgggaacggactcattg

SEQ ID NO: 565199 - DNA, 20 bp, mouse
gtgggaggcacagcaagcgt

SEQ ID NO: 565200 - DNA, 20 bp, mouse
ggacagcacgaggggagtgt

SEQ ID NO: 565201 - DNA, 20 bp, mouse
ggcaacggagagctagaggg

SEQ ID NO: 565202 - DNA, 20 bp, mouse
gagtgttgcaggcgaagcga

SEQ ID NO: 565203 - DNA, 20 bp, mouse
gacgccaaggacagcacgag

SEQ ID NO: 565204 - DNA, 20 bp, mouse
gcagagaaggcacccgtctg

SEQ ID NO: 565205 - DNA, 20 bp, mouse
ggagccacaagaagaaccca

SEQ ID NO: 565206 - DNA, 20 bp, mouse
gcgcagaacccggccaagcc

SEQ ID NO: 565207 - DNA, 20 bp, mouse
gcggcatgtcggcgctccgg

SEQ ID NO: 565208 - DNA, 20 bp, mouse
gggctgcgcttcgggtccac

SEQ ID NO: 565209 - DNA, 20 bp, mouse
gaggcggcatgtcggcgctc

SEQ ID NO: 565210 - DNA, 20 bp, mouse
ggccaagcccggctgcgctt

SEQ ID NO: 565211 - DNA, 20 bp, mouse
gtgaccgggatcctaaggaa

SEQ ID NO: 565212 - DNA, 20 bp, mouse
gccccaccgcccgccttcgg

SEQ ID NO: 565213 - DNA, 20 bp, mouse
gcatttagctgggcactagt

SEQ ID NO: 565214 - DNA, 20 bp, mouse
gacctatggaggagtttctg

SEQ ID NO: 565215 - DNA, 20 bp, mouse
gaccttcctccgaaggcggg

SEQ ID NO: 565216 - DNA, 20 bp, mouse
ggcagccgccggagacatcg

SEQ ID NO: 565217 - DNA, 20 bp, mouse
gggagccgcgatgtctccgg

SEQ ID NO: 565218 - DNA, 20 bp, mouse
gcggctgcggcggctgacgg

SEQ ID NO: 565219 - DNA, 20 bp, mouse
gatgtctccggcggctgcgg

SEQ ID NO: 565220 - DNA, 20 bp, mouse
gcgcggagccgcgatgtctc

SEQ ID NO: 565221 - DNA, 20 bp, mouse
gcttcccgtccgcccaacgg

SEQ ID NO: 565222 - DNA, 20 bp, mouse
gcggccaagtcaccagtcaa

SEQ ID NO: 565223 - DNA, 20 bp, mouse
gggcggctgacggaggcgag

SEQ ID NO: 565224 - DNA, 20 bp, mouse
gagcggcggcggcccccgtt

SEQ ID NO: 565225 - DNA, 20 bp, mouse
ggaaggacgacagggccctc

SEQ ID NO: 565226 - DNA, 20 bp, mouse
gctccgccgaggttgaaacg

SEQ ID NO: 565227 - DNA, 20 bp, mouse
gggtagctgcccatgctgag

SEQ ID NO: 565228 - DNA, 20 bp, mouse
gcatgctgagaggcgcggac

SEQ ID NO: 565229 - DNA, 20 bp, mouse
gagccccgtttcaacctcgg

SEQ ID NO: 565230 - DNA, 20 bp, mouse
gcaggggcgcgcagactcag

SEQ ID NO: 565231 - DNA, 20 bp, mouse
gtctagccccgtttcaacct

SEQ ID NO: 565232 - DNA, 20 bp, mouse
gggttggcgggatcccagtt

SEQ ID NO: 565233 - DNA, 20 bp, mouse
gagcagcggatgcttggatt

SEQ ID NO: 565234 - DNA, 20 bp, mouse
ggcatccgctgctcgagtga

SEQ ID NO: 565235 - DNA, 20 bp, mouse
ggtggcccgagggtgacgaa

SEQ ID NO: 565236 - DNA, 20 bp, mouse
ggcgacagggaccaaacggg

SEQ ID NO: 565237 - DNA, 20 bp, mouse
gagagcgacagggaccaaac

SEQ ID NO: 565238 - DNA, 20 bp, mouse
ggggaccaaacgggaggcga

SEQ ID NO: 565239 - DNA, 20 bp, mouse
gacccttacctgtcgcggaa

SEQ ID NO: 565240 - DNA, 20 bp, mouse
ggtctgtcaacccatcatcc

SEQ ID NO: 565241 - DNA, 20 bp, mouse
gctccagagagcaggtggtt

SEQ ID NO: 565242 - DNA, 20 bp, mouse
ggcctttccgcgacaggtaa

SEQ ID NO: 565243 - DNA, 20 bp, mouse
gaagaagagagaagagcgac

SEQ ID NO: 565244 - DNA, 20 bp, mouse
gcggaaggagaagcctaaag

SEQ ID NO: 565245 - DNA, 20 bp, mouse
gggtttggcgactccatctg

SEQ ID NO: 565246 - DNA, 20 bp, mouse
ggccagatgggaagagacga

SEQ ID NO: 565247 - DNA, 20 bp, mouse
gcggggcgcgagaggcatgg

SEQ ID NO: 565248 - DNA, 20 bp, mouse
gccgcactgggaggcactta

SEQ ID NO: 565249 - DNA, 20 bp, mouse
gggaggcacttacggctcag

SEQ ID NO: 565250 - DNA, 20 bp, mouse
gctctgagacccgcactggg

SEQ ID NO: 565251 - DNA, 20 bp, mouse
gcgctcgggcccgcacagct

SEQ ID NO: 565252 - DNA, 20 bp, mouse
ggggcggggcgcgagaggca

SEQ ID NO: 565253 - DNA, 20 bp, mouse
gcgcgcggggccgagctgtg

SEQ ID NO: 565254 - DNA, 20 bp, mouse
ggagaggagttgagccagat

SEQ ID NO: 565255 - DNA, 20 bp, mouse
ggagacgagggtggaggatt

SEQ ID NO: 565256 - DNA, 20 bp, mouse
ggagctgtggcttatcctgg

SEQ ID NO: 565257 - DNA, 20 bp, mouse
ggataagccacagctcctag

SEQ ID NO: 565258 - DNA, 20 bp, mouse
gagccaggaagagggaccgt

SEQ ID NO: 565259 - DNA, 20 bp, mouse
gctagggctgaggctaataa

SEQ ID NO: 565260 - DNA, 20 bp, mouse
gcgttggcaagtaagaattc

SEQ ID NO: 565261 - DNA, 20 bp, mouse
gttatcctggtggcagcaac

SEQ ID NO: 565262 - DNA, 20 bp, mouse
gcctggtggcagcaacaggc

SEQ ID NO: 565263 - DNA, 20 bp, mouse
ggtcttggatttccgcccag

SEQ ID NO: 565264 - DNA, 20 bp, mouse
gctgaggctaataagggtct

SEQ ID NO: 565265 - DNA, 20 bp, mouse
gtgccaacggtccctcttcc

SEQ ID NO: 565266 - DNA, 20 bp, mouse
gtgggcagcgcgggcatctg

SEQ ID NO: 565267 - DNA, 20 bp, mouse
gccagcagggcaagcacact

SEQ ID NO: 565268 - DNA, 20 bp, mouse
gaacacctgcgacaccctgt

SEQ ID NO: 565269 - DNA, 20 bp, mouse
gcgacaccctgtcggcaggt

SEQ ID NO: 565270 - DNA, 20 bp, mouse
gcgctgcccacctgccgaca

SEQ ID NO: 565271 - DNA, 20 bp, mouse
ggagtttgagctcgccagca

SEQ ID NO: 565272 - DNA, 20 bp, mouse
ggggcttgccggacccaggg

SEQ ID NO: 565273 - DNA, 20 bp, mouse
gagcaggcgccgaggtggga

SEQ ID NO: 565274 - DNA, 20 bp, mouse
gcctgcgacaccctgtcggc

SEQ ID NO: 565275 - DNA, 20 bp, mouse
gcggcctcccctgcagtcca

SEQ ID NO: 565276 - DNA, 20 bp, mouse
gggtcgccaggtaggctccg

SEQ ID NO: 565277 - DNA, 20 bp, mouse
gctacgccccggagcctacc

SEQ ID NO: 565278 - DNA, 20 bp, mouse
gacctggcgaccaccaaatc

SEQ ID NO: 565279 - DNA, 20 bp, mouse
ggctccggggcgtagtgaag

SEQ ID NO: 565280 - DNA, 20 bp, mouse
gctggaatgcgagccggatt

SEQ ID NO: 565281 - DNA, 20 bp, mouse
ggtcccgcttcactacgccc

SEQ ID NO: 565282 - DNA, 20 bp, mouse
gcatggtgcacccggaggag

SEQ ID NO: 565283 - DNA, 20 bp, mouse
ggaatgcgagccggatttgg

SEQ ID NO: 565284 - DNA, 20 bp, mouse
gaggggtgcgcggtaagcac

SEQ ID NO: 565285 - DNA, 20 bp, mouse
gtccggccgcgcaggcgtcc

SEQ ID NO: 565286 - DNA, 20 bp, mouse
gccgtcgcggcgggtactcg

SEQ ID NO: 565287 - DNA, 20 bp, mouse
ggatggtgagtgagcgcgga

SEQ ID NO: 565288 - DNA, 20 bp, mouse
gggcgtctcggccccggaaa

SEQ ID NO: 565289 - DNA, 20 bp, mouse
gacccgggctgcactctctc

SEQ ID NO: 565290 - DNA, 20 bp, mouse
gcgccccttcccagcagtgg

SEQ ID NO: 565291 - DNA, 20 bp, mouse
gcccggcgggtgtctgacgt

SEQ ID NO: 565292 - DNA, 20 bp, mouse
gcgcctccactgctgggaag

SEQ ID NO: 565293 - DNA, 20 bp, mouse
gttggccggcggactcgagc

SEQ ID NO: 565294 - DNA, 20 bp, mouse
gcggaagtgagcggtttggc

SEQ ID NO: 565295 - DNA, 20 bp, mouse
ggcaggaggagaggccagaa

SEQ ID NO: 565296 - DNA, 20 bp, mouse
gcgcaggcctggctccacat

SEQ ID NO: 565297 - DNA, 20 bp, mouse
gcgagcggcctcgcccccaa

SEQ ID NO: 565298 - DNA, 20 bp, mouse
gaggcaggatcgaccgttgg

SEQ ID NO: 565299 - DNA, 20 bp, mouse
gacatggggagccactctac

SEQ ID NO: 565300 - DNA, 20 bp, mouse
ggccaggcctgcgaaccgcc

SEQ ID NO: 565301 - DNA, 20 bp, mouse
ggccaggcaggatcgaccgt

SEQ ID NO: 565302 - DNA, 20 bp, mouse
gccaggagggctctcaaatc

SEQ ID NO: 565303 - DNA, 20 bp, mouse
gtcggggcacaagcaactct

SEQ ID NO: 565304 - DNA, 20 bp, mouse
ggactcgaagaaacgctcgt

SEQ ID NO: 565305 - DNA, 20 bp, mouse
gtaagaccctgaggagctct

SEQ ID NO: 565306 - DNA, 20 bp, mouse
ggaaagtgtggtggccgccc

SEQ ID NO: 565307 - DNA, 20 bp, mouse
gggccgcccgggcagctaag

SEQ ID NO: 565308 - DNA, 20 bp, mouse
gaggcgtagagcattgcggg

SEQ ID NO: 565309 - DNA, 20 bp, mouse
gcgtagagcattgcgggagg

SEQ ID NO: 565310 - DNA, 20 bp, mouse
gctgggcggggcggaaagtg

SEQ ID NO: 565311 - DNA, 20 bp, mouse
ggcacacagcggcccctacg

SEQ ID NO: 565312 - DNA, 20 bp, mouse
gcctgaggcgtagagcattg

SEQ ID NO: 565313 - DNA, 20 bp, mouse
gggcggggcggaaagtgtgg

SEQ ID NO: 565314 - DNA, 20 bp, mouse
gggatgccgccggccatagg

SEQ ID NO: 565315 - DNA, 20 bp, mouse
gagctcgcggcgcttccagg

SEQ ID NO: 565316 - DNA, 20 bp, mouse
gtggcctgagacagatggac

SEQ ID NO: 565317 - DNA, 20 bp, mouse
ggccaacaccagtcccacga

SEQ ID NO: 565318 - DNA, 20 bp, mouse
gagtgctagcagcttcgcca

SEQ ID NO: 565319 - DNA, 20 bp, mouse
gaccctcgtgggactggtgt

SEQ ID NO: 565320 - DNA, 20 bp, mouse
gcagatggacaggctgagga

SEQ ID NO: 565321 - DNA, 20 bp, mouse
gtggacaagtgcagcaacac

SEQ ID NO: 565322 - DNA, 20 bp, mouse
gcccaacacaacttactgat

SEQ ID NO: 565323 - DNA, 20 bp, mouse
gaagactgacaacatctatg

SEQ ID NO: 565324 - DNA, 20 bp, mouse
ggcactcaccctcgtgggac

SEQ ID NO: 565325 - DNA, 20 bp, mouse
gaaatctataggcactgggt

SEQ ID NO: 565326 - DNA, 20 bp, mouse
gtcaggcccgagccagacgg

SEQ ID NO: 565327 - DNA, 20 bp, mouse
gcgcaccatgggccggatgg

SEQ ID NO: 565328 - DNA, 20 bp, mouse
gcgtccggagctgctcggtc

SEQ ID NO: 565329 - DNA, 20 bp, mouse
gtcccgcaccatgggccgga

SEQ ID NO: 565330 - DNA, 20 bp, mouse
ggggcctgaccgagcagctc

SEQ ID NO: 565331 - DNA, 20 bp, mouse
gagagccaccatccggccca

SEQ ID NO: 565332 - DNA, 20 bp, mouse
gccggtcccgcaccatgggc

SEQ ID NO: 565333 - DNA, 20 bp, mouse
gtcccgggtcgggagtccct

SEQ ID NO: 565334 - DNA, 20 bp, mouse
gcccagcgtccggagctgct

SEQ ID NO: 565335 - DNA, 20 bp, mouse
gactcccgacccgggaccct

SEQ ID NO: 565336 - DNA, 20 bp, mouse
gtaaggcacccagacaccat

SEQ ID NO: 565337 - DNA, 20 bp, mouse
ggccagacaggctcccagca

SEQ ID NO: 565338 - DNA, 20 bp, mouse
gagcgccacaagcttcccca

SEQ ID NO: 565339 - DNA, 20 bp, mouse
gctgagtccgcgccccagag

SEQ ID NO: 565340 - DNA, 20 bp, mouse
ggacaccatggggaagcttg

SEQ ID NO: 565341 - DNA, 20 bp, mouse
gctaccctggcagcctagaa

SEQ ID NO: 565342 - DNA, 20 bp, mouse
gaccttgctgggagcctgtc

SEQ ID NO: 565343 - DNA, 20 bp, mouse
gttgtggcgctgaccttgct

SEQ ID NO: 565344 - DNA, 20 bp, mouse
gtctggccttaataggggaa

SEQ ID NO: 565345 - DNA, 20 bp, mouse
ggaagactggtgccgctctg

SEQ ID NO: 565346 - DNA, 20 bp, mouse
gcccgctcgctcaccctctg

SEQ ID NO: 565347 - DNA, 20 bp, mouse
gttcgccggtaagaatgaca

SEQ ID NO: 565348 - DNA, 20 bp, mouse
ggctcgctcaccctctgtgg

SEQ ID NO: 565349 - DNA, 20 bp, mouse
gaaagttccgagggcttcgc

SEQ ID NO: 565350 - DNA, 20 bp, mouse
gtagaagctcccaccacaga

SEQ ID NO: 565351 - DNA, 20 bp, mouse
gactgcaagagggcccgccc

SEQ ID NO: 565352 - DNA, 20 bp, mouse
gaacctgccaaaagttccga

SEQ ID NO: 565353 - DNA, 20 bp, mouse
ggaggctctggactgcaaga

SEQ ID NO: 565354 - DNA, 20 bp, mouse
gacagggatgggtcattccg

SEQ ID NO: 565355 - DNA, 20 bp, mouse
ggccaggcggaatcccctct

SEQ ID NO: 565356 - DNA, 20 bp, mouse
gtccaccctgcgtcagggga

SEQ ID NO: 565357 - DNA, 20 bp, mouse
ggtcgccatcccctgacgca

SEQ ID NO: 565358 - DNA, 20 bp, mouse
ggccatcccctgacgcaggg

SEQ ID NO: 565359 - DNA, 20 bp, mouse
ggaacctcggaactagaagt

SEQ ID NO: 565360 - DNA, 20 bp, mouse
gctcctcaggggcctctcgg

SEQ ID NO: 565361 - DNA, 20 bp, mouse
gaggcgcccgatccgaaatc

SEQ ID NO: 565362 - DNA, 20 bp, mouse
gcttgctccaccctgcgtca

SEQ ID NO: 565363 - DNA, 20 bp, mouse
gccgacaatgaagggtaagt

SEQ ID NO: 565364 - DNA, 20 bp, mouse
gcctagctaagagactgaga

SEQ ID NO: 565365 - DNA, 20 bp, mouse
gctgtctcaacagagtccta

SEQ ID NO: 565366 - DNA, 20 bp, mouse
gctcgcacagaaggtacctg

SEQ ID NO: 565367 - DNA, 20 bp, mouse
gcggcgcggacgccatggtg

SEQ ID NO: 565368 - DNA, 20 bp, mouse
gaaggtacctgcggcgacag

SEQ ID NO: 565369 - DNA, 20 bp, mouse
ggcggcccgggtcgcgggga

SEQ ID NO: 565370 - DNA, 20 bp, mouse
gctgtgcttgaaccgcacca

SEQ ID NO: 565371 - DNA, 20 bp, mouse
ggagcgcggcccgggtcgcg

SEQ ID NO: 565372 - DNA, 20 bp, mouse
ggcgccgccgcctgctccgt

SEQ ID NO: 565373 - DNA, 20 bp, mouse
ggtgggctttgcaggtacga

SEQ ID NO: 565374 - DNA, 20 bp, mouse
gtgcggggcgcgctttgcca

SEQ ID NO: 565375 - DNA, 20 bp, mouse
gggcggcactaggctcggac

SEQ ID NO: 565376 - DNA, 20 bp, mouse
gggatcggaagaggaacgcc

SEQ ID NO: 565377 - DNA, 20 bp, mouse
gtgcagaagaagaacggaga

SEQ ID NO: 565378 - DNA, 20 bp, mouse
gcgggcaggctcgccagcaa

SEQ ID NO: 565379 - DNA, 20 bp, mouse
gcggaagaggaacgccgggc

SEQ ID NO: 565380 - DNA, 20 bp, mouse
gcgaggctcacgcgagtgaa

SEQ ID NO: 565381 - DNA, 20 bp, mouse
gcctcgccgaccgatccaag

SEQ ID NO: 565382 - DNA, 20 bp, mouse
gcgcagtgcgtagcccttgc

SEQ ID NO: 565383 - DNA, 20 bp, mouse
gggagtggagaaagcggaag

SEQ ID NO: 565384 - DNA, 20 bp, mouse
gggagaaagcggaagtggaa

SEQ ID NO: 565385 - DNA, 20 bp, mouse
gctaagggtgcaaccagaag

SEQ ID NO: 565386 - DNA, 20 bp, mouse
gcccgtgttgctgaagttca

SEQ ID NO: 565387 - DNA, 20 bp, mouse
ggtcgttcccaggcagaacg

SEQ ID NO: 565388 - DNA, 20 bp, mouse
gcagcatacattgtcctgag

SEQ ID NO: 565389 - DNA, 20 bp, mouse
gaccatgaacttcagcaaca

SEQ ID NO: 565390 - DNA, 20 bp, mouse
gtctgctctctgtcgttccc

SEQ ID NO: 565391 - DNA, 20 bp, mouse
gctggcaggaatgcttccgg

SEQ ID NO: 565392 - DNA, 20 bp, mouse
gtccactccgcgttctgcct

SEQ ID NO: 565393 - DNA, 20 bp, mouse
gttaccagagcactgcggga

SEQ ID NO: 565394 - DNA, 20 bp, mouse
ggcctttgcaggctccaaaa

SEQ ID NO: 565395 - DNA, 20 bp, mouse
gtccaaaacggtctccacaa

SEQ ID NO: 565396 - DNA, 20 bp, mouse
gcgctgggagcggctctgat

SEQ ID NO: 565397 - DNA, 20 bp, mouse
ggacgcgtccgggatcccgg

SEQ ID NO: 565398 - DNA, 20 bp, mouse
gctccagggcgcgcacagag

SEQ ID NO: 565399 - DNA, 20 bp, mouse
gtcccgcgcccgctcaagca

SEQ ID NO: 565400 - DNA, 20 bp, mouse
gcccgcacccgccgggatcc

SEQ ID NO: 565401 - DNA, 20 bp, mouse
gccgtccccgccgctgggag

SEQ ID NO: 565402 - DNA, 20 bp, mouse
gtggaggtgagcaccagcac

SEQ ID NO: 565403 - DNA, 20 bp, mouse
gggctgcgccctgcttgagc

SEQ ID NO: 565404 - DNA, 20 bp, mouse
gagcgtcgtgaaggccggga

SEQ ID NO: 565405 - DNA, 20 bp, mouse
ggctgagagccgcgcgggag

SEQ ID NO: 565406 - DNA, 20 bp, mouse
gcagggtgagtgaggaatgg

SEQ ID NO: 565407 - DNA, 20 bp, mouse
ggcgcggtgtgtgatctggt

SEQ ID NO: 565408 - DNA, 20 bp, mouse
ggcgcagggtgagtgaggaa

SEQ ID NO: 565409 - DNA, 20 bp, mouse
ggtcggtaccgaggagcgca

SEQ ID NO: 565410 - DNA, 20 bp, mouse
ggtatcgcggagatcccctg

SEQ ID NO: 565411 - DNA, 20 bp, mouse
gacaccgcgcgcggtcctgt

SEQ ID NO: 565412 - DNA, 20 bp, mouse
gccgcgcgcggtgtgtgatc

SEQ ID NO: 565413 - DNA, 20 bp, mouse
ggcggtcctgtaggtctctg

SEQ ID NO: 565414 - DNA, 20 bp, mouse
gccaggagaagggccgaggt

SEQ ID NO: 565415 - DNA, 20 bp, mouse
gggagtcacaagccggatag

SEQ ID NO: 565416 - DNA, 20 bp, mouse
gtacccacctgtggatctag

SEQ ID NO: 565417 - DNA, 20 bp, mouse
gagagccaagccacacagac

SEQ ID NO: 565418 - DNA, 20 bp, mouse
gcacccctagatccacaggt

SEQ ID NO: 565419 - DNA, 20 bp, mouse
gctcacacccctagatccac

SEQ ID NO: 565420 - DNA, 20 bp, mouse
gacggagaggcttgaatcct

SEQ ID NO: 565421 - DNA, 20 bp, mouse
gcagacaggtcctggattag

SEQ ID NO: 565422 - DNA, 20 bp, mouse
gccactatggcaggatttgg

SEQ ID NO: 565423 - DNA, 20 bp, mouse
gctgagaaaaccactaatcc

SEQ ID NO: 565424 - DNA, 20 bp, mouse
gccctgttcccgcgctgagg

SEQ ID NO: 565425 - DNA, 20 bp, mouse
gggagatgctgtatgcccgg

SEQ ID NO: 565426 - DNA, 20 bp, mouse
ggcaaggccgggaccagcag

SEQ ID NO: 565427 - DNA, 20 bp, mouse
gccagcagtggctcccaggg

SEQ ID NO: 565428 - DNA, 20 bp, mouse
gcaggaggaggtggcgacag

SEQ ID NO: 565429 - DNA, 20 bp, mouse
gccccgcaggccgcaaggcc

SEQ ID NO: 565430 - DNA, 20 bp, mouse
gtgggagccactgctggtcc

SEQ ID NO: 565431 - DNA, 20 bp, mouse
gagcttaaggatgggaacgt

SEQ ID NO: 565432 - DNA, 20 bp, mouse
ggactaggtcccaggacaag

SEQ ID NO: 565433 - DNA, 20 bp, mouse
gcgcaggccagcttaaggat

SEQ ID NO: 565434 - DNA, 20 bp, mouse
ggcccgccccgggatttaaa

SEQ ID NO: 565435 - DNA, 20 bp, mouse
ggggagtcctataggtgatg

SEQ ID NO: 565436 - DNA, 20 bp, mouse
ggcagcagcagagcatataa

SEQ ID NO: 565437 - DNA, 20 bp, mouse
gtcttcctggacggagctca

SEQ ID NO: 565438 - DNA, 20 bp, mouse
gcggagctcagggctgaaga

SEQ ID NO: 565439 - DNA, 20 bp, mouse
gtcagccctgagctccgtcc

SEQ ID NO: 565440 - DNA, 20 bp, mouse
gctccgtccaggaagagatc

SEQ ID NO: 565441 - DNA, 20 bp, mouse
gtgcagggttaatatcacac

SEQ ID NO: 565442 - DNA, 20 bp, mouse
gcatcaggggtcgggatcag

SEQ ID NO: 565443 - DNA, 20 bp, mouse
gaccttgtcatagtaactgt

SEQ ID NO: 565444 - DNA, 20 bp, mouse
gggccagatctcttcctgga

SEQ ID NO: 565445 - DNA, 20 bp, mouse
gccttgtaaatgcaccacag

SEQ ID NO: 565446 - DNA, 20 bp, mouse
gctggtgagtgaatttgggg

SEQ ID NO: 565447 - DNA, 20 bp, mouse
gcactcaccagcaaaacccg

SEQ ID NO: 565448 - DNA, 20 bp, mouse
gcatgacgtcacaggcgcct

SEQ ID NO: 565449 - DNA, 20 bp, mouse
gcccgcggacaactaaagtc

SEQ ID NO: 565450 - DNA, 20 bp, mouse
gcgcgcgtgcatgacgtcac

SEQ ID NO: 565451 - DNA, 20 bp, mouse
ggtgttgaccgatccctatc

SEQ ID NO: 565452 - DNA, 20 bp, mouse
gttgctggtgagtgaatttg

SEQ ID NO: 565453 - DNA, 20 bp, mouse
gagttgtccgcgggttttgc

SEQ ID NO: 565454 - DNA, 20 bp, mouse
gtccagactttagttgtccg

SEQ ID NO: 565455 - DNA, 20 bp, mouse
gaccctgggtaaatataacg

SEQ ID NO: 565456 - DNA, 20 bp, mouse
gcacagaacaccgaggatcc

SEQ ID NO: 565457 - DNA, 20 bp, mouse
gagtacctcacagaacaccg

SEQ ID NO: 565458 - DNA, 20 bp, mouse
gtgtgaggtactgaacgcta

SEQ ID NO: 565459 - DNA, 20 bp, mouse
gaaaaagttgccgggatcct

SEQ ID NO: 565460 - DNA, 20 bp, mouse
gtgcgcatgcgtgtgtccca

SEQ ID NO: 565461 - DNA, 20 bp, mouse
gtgaggtctccctgagagag

SEQ ID NO: 565462 - DNA, 20 bp, mouse
ggagaggatgccgaacacag

SEQ ID NO: 565463 - DNA, 20 bp, mouse
gtgcgtgtgtcccacggctc

SEQ ID NO: 565464 - DNA, 20 bp, mouse
ggtcgaagtcgcgtctctgc

SEQ ID NO: 565465 - DNA, 20 bp, mouse
ggggccctggatgatatgag

SEQ ID NO: 565466 - DNA, 20 bp, mouse
gaactgtataaggccctggt

SEQ ID NO: 565467 - DNA, 20 bp, mouse
gatttgcacagaggacctca

SEQ ID NO: 565468 - DNA, 20 bp, mouse
gataaggccctggttggcag

SEQ ID NO: 565469 - DNA, 20 bp, mouse
gggcagaggtttaagccctg

SEQ ID NO: 565470 - DNA, 20 bp, mouse
gggccttatacagttggtag

SEQ ID NO: 565471 - DNA, 20 bp, mouse
gtgtgcaaatgtggctggtg

SEQ ID NO: 565472 - DNA, 20 bp, mouse
gcttaaacctctgccaacca

SEQ ID NO: 565473 - DNA, 20 bp, mouse
gtttactaagacctaaaatt

SEQ ID NO: 565474 - DNA, 20 bp, mouse
gccgcaaggacaggtaatag

SEQ ID NO: 565475 - DNA, 20 bp, mouse
ggtgaggagaatctccatcc

SEQ ID NO: 565476 - DNA, 20 bp, mouse
ggaggctgggagacactcag

SEQ ID NO: 565477 - DNA, 20 bp, mouse
gcagctctgaggcacccgga

SEQ ID NO: 565478 - DNA, 20 bp, mouse
gattatattactgtatcaaa

SEQ ID NO: 565479 - DNA, 20 bp, mouse
ggtacctgtggacatcacgt

SEQ ID NO: 565480 - DNA, 20 bp, mouse
gccacaggtactgacctcca

SEQ ID NO: 565481 - DNA, 20 bp, mouse
gtgatgtatatatgcaagta

SEQ ID NO: 565482 - DNA, 20 bp, mouse
gccaccaacgtgatgtccac

SEQ ID NO: 565483 - DNA, 20 bp, mouse
gaggacagctctgaggcacc

SEQ ID NO: 565484 - DNA, 20 bp, mouse
gaatactagcctgcaccctc

SEQ ID NO: 565485 - DNA, 20 bp, mouse
gaaagctgtagggccagcca

SEQ ID NO: 565486 - DNA, 20 bp, mouse
ggagtaaacggtggttccac

SEQ ID NO: 565487 - DNA, 20 bp, mouse
gacagcctcagagtaaacgg

SEQ ID NO: 565488 - DNA, 20 bp, mouse
gagtctcgtcagggcctcgg

SEQ ID NO: 565489 - DNA, 20 bp, mouse
gggagcacccagtctcgtca

SEQ ID NO: 565490 - DNA, 20 bp, mouse
gtaaacggtggttccacggg

SEQ ID NO: 565491 - DNA, 20 bp, mouse
ggtcagagccaagtaagcag

SEQ ID NO: 565492 - DNA, 20 bp, mouse
gccagagcatggcttgtgac

SEQ ID NO: 565493 - DNA, 20 bp, mouse
gagggcctcgggggcatgga

SEQ ID NO: 565494 - DNA, 20 bp, mouse
ggaaccagtgtcccaaggtg

SEQ ID NO: 565495 - DNA, 20 bp, mouse
gggaaccaccgtttactctg

SEQ ID NO: 565496 - DNA, 20 bp, mouse
ggatgagagttcagccgcgg

SEQ ID NO: 565497 - DNA, 20 bp, mouse
gtccgctcggcgcccagagg

SEQ ID NO: 565498 - DNA, 20 bp, mouse
gcaagatgagagttcagccg

SEQ ID NO: 565499 - DNA, 20 bp, mouse
gttaacggcgaggagatggg

SEQ ID NO: 565500 - DNA, 20 bp, mouse
gtattcaaaatggcggacgg

SEQ ID NO: 565501 - DNA, 20 bp, mouse
gagaagacccggggcaaagg

SEQ ID NO: 565502 - DNA, 20 bp, mouse
gggagggggaagaagacccg

SEQ ID NO: 565503 - DNA, 20 bp, mouse
gtcaggattattataattaa

SEQ ID NO: 565504 - DNA, 20 bp, mouse
gcgccgagcggagggggaaa

SEQ ID NO: 565505 - DNA, 20 bp, mouse
gccgaatctaagcgggtcca

SEQ ID NO: 565506 - DNA, 20 bp, mouse
ggtcctcgccacccatgaga

SEQ ID NO: 565507 - DNA, 20 bp, mouse
gatggttcattccagcatgg

SEQ ID NO: 565508 - DNA, 20 bp, mouse
gaaggcatcagcctcttacc

SEQ ID NO: 565509 - DNA, 20 bp, mouse
ggctgatgccttctcatggg

SEQ ID NO: 565510 - DNA, 20 bp, mouse
gcatgggggctccaggtaag

SEQ ID NO: 565511 - DNA, 20 bp, mouse
ggaggaggtgcaggaaccgt

SEQ ID NO: 565512 - DNA, 20 bp, mouse
ggaggctgatgccttctcat

SEQ ID NO: 565513 - DNA, 20 bp, mouse
gccatgctgcccgccagcca

SEQ ID NO: 565514 - DNA, 20 bp, mouse
gagcatggttcattccagca

SEQ ID NO: 565515 - DNA, 20 bp, mouse
gcggggcctcccaaacaagg

SEQ ID NO: 565516 - DNA, 20 bp, mouse
ggctgcagcccctacaggag

SEQ ID NO: 565517 - DNA, 20 bp, mouse
ggcggagtgtgcgaccgagg

SEQ ID NO: 565518 - DNA, 20 bp, mouse
ggtggcagccgctcctgtag

SEQ ID NO: 565519 - DNA, 20 bp, mouse
gacaggagcggctgccacct

SEQ ID NO: 565520 - DNA, 20 bp, mouse
gcggccccggcaggactccg

SEQ ID NO: 565521 - DNA, 20 bp, mouse
ggcagcggagtgtgcgaccg

SEQ ID NO: 565522 - DNA, 20 bp, mouse
gtgtccgcggagtcctgccg

SEQ ID NO: 565523 - DNA, 20 bp, mouse
gcacgcgcagtgacacctgt

SEQ ID NO: 565524 - DNA, 20 bp, mouse
gggcagcagcgagggacctg

SEQ ID NO: 565525 - DNA, 20 bp, mouse
gcgcgccgcgtgctcacctg

SEQ ID NO: 565526 - DNA, 20 bp, mouse
ggagtacaaatggagctcgg

SEQ ID NO: 565527 - DNA, 20 bp, mouse
ggaagctagactccagactt

SEQ ID NO: 565528 - DNA, 20 bp, mouse
ggctgctcggagagctgcag

SEQ ID NO: 565529 - DNA, 20 bp, mouse
gaccacaaggacccagggag

SEQ ID NO: 565530 - DNA, 20 bp, mouse
ggagtagagcgagggaggtg

SEQ ID NO: 565531 - DNA, 20 bp, mouse
gtggagctcgggggaagctt

SEQ ID NO: 565532 - DNA, 20 bp, mouse
gaaagagagtagagcgaggg

SEQ ID NO: 565533 - DNA, 20 bp, mouse
ggctcggagagctgcagggg

SEQ ID NO: 565534 - DNA, 20 bp, mouse
gttgcttcaaggccgaagtc

SEQ ID NO: 565535 - DNA, 20 bp, mouse
gcagcctggaggtttaaagg

SEQ ID NO: 565536 - DNA, 20 bp, mouse
ggcccgcagacggagcgagg

SEQ ID NO: 565537 - DNA, 20 bp, mouse
gccccgcggcagatactgcg

SEQ ID NO: 565538 - DNA, 20 bp, mouse
gggctacccacgggaggagg

SEQ ID NO: 565539 - DNA, 20 bp, mouse
ggcgcggcatgggcacaagg

SEQ ID NO: 565540 - DNA, 20 bp, mouse
gcggcggcggggcccgcaga

SEQ ID NO: 565541 - DNA, 20 bp, mouse
ggtgcgctaggcccacgggg

SEQ ID NO: 565542 - DNA, 20 bp, mouse
gagggtgcgctaggcccacg

SEQ ID NO: 565543 - DNA, 20 bp, mouse
ggaagctgatgcaccacgag

SEQ ID NO: 565544 - DNA, 20 bp, mouse
gcgggcgcgggccaccccgt

SEQ ID NO: 565545 - DNA, 20 bp, mouse
gaccctcaatggctacccac

SEQ ID NO: 565546 - DNA, 20 bp, mouse
ggagcagcaacagaaggcgt

SEQ ID NO: 565547 - DNA, 20 bp, mouse
gcgtcggagctgcccgctag

SEQ ID NO: 565548 - DNA, 20 bp, mouse
gagtccggctccgagagtca

SEQ ID NO: 565549 - DNA, 20 bp, mouse
ggcaacagaaggcgtcggag

SEQ ID NO: 565550 - DNA, 20 bp, mouse
gggctcggcatgtacgatgg

SEQ ID NO: 565551 - DNA, 20 bp, mouse
gtacatgccgagccgcctgg

SEQ ID NO: 565552 - DNA, 20 bp, mouse
gaaggcgtcggagcgggcgt

SEQ ID NO: 565553 - DNA, 20 bp, mouse
gggcggctcggcatgtacga

SEQ ID NO: 565554 - DNA, 20 bp, mouse
gtgtacgatggaggcgctgg

SEQ ID NO: 565555 - DNA, 20 bp, mouse
gctgcggtcgccatgactct

SEQ ID NO: 565556 - DNA, 20 bp, mouse
ggccgcttggcagggcgcgg

SEQ ID NO: 565557 - DNA, 20 bp, mouse
gaagcgatcccccctcccca

SEQ ID NO: 565558 - DNA, 20 bp, mouse
ggctgcaaggccgcttggca

SEQ ID NO: 565559 - DNA, 20 bp, mouse
gctgcagctgcaaggccgct

SEQ ID NO: 565560 - DNA, 20 bp, mouse
ggctgctgaccgaggctagc

SEQ ID NO: 565561 - DNA, 20 bp, mouse
gggagcagcgccctggggag

SEQ ID NO: 565562 - DNA, 20 bp, mouse
gacccccgcgccctgccaag

SEQ ID NO: 565563 - DNA, 20 bp, mouse
gcggtaggcgcccgaggtca

SEQ ID NO: 565564 - DNA, 20 bp, mouse
gtaggcgcccgaggtcacgg

SEQ ID NO: 565565 - DNA, 20 bp, mouse
gccgtgagcaggctgttccc

SEQ ID NO: 565566 - DNA, 20 bp, mouse
gagaatgctgtagggattcg

SEQ ID NO: 565567 - DNA, 20 bp, mouse
ggctgtggccatggtcgatg

SEQ ID NO: 565568 - DNA, 20 bp, mouse
ggcggagtccgcatggacaa

SEQ ID NO: 565569 - DNA, 20 bp, mouse
gtggaactgagaatgctgta

SEQ ID NO: 565570 - DNA, 20 bp, mouse
gagaggatcctcatcgacca

SEQ ID NO: 565571 - DNA, 20 bp, mouse
gtagggattcgaggcagctg

SEQ ID NO: 565572 - DNA, 20 bp, mouse
gtcctctactagttataatg

SEQ ID NO: 565573 - DNA, 20 bp, mouse
ggccacattataactagtag

SEQ ID NO: 565574 - DNA, 20 bp, mouse
gttcgaggcagctgtggcca

SEQ ID NO: 565575 - DNA, 20 bp, mouse
gcccgcaccatagatgtcaa

SEQ ID NO: 565576 - DNA, 20 bp, mouse
ggctagagctctcggagaag

SEQ ID NO: 565577 - DNA, 20 bp, mouse
gctcggagaagcgggatcgc

SEQ ID NO: 565578 - DNA, 20 bp, mouse
gtaagaggagcgcagcccgt

SEQ ID NO: 565579 - DNA, 20 bp, mouse
gcccgcggcgagcctccgag

SEQ ID NO: 565580 - DNA, 20 bp, mouse
ggggccggccgcgagaagtg

SEQ ID NO: 565581 - DNA, 20 bp, mouse
gagcgagcgcagcctcggga

SEQ ID NO: 565582 - DNA, 20 bp, mouse
gagtggggctcaggtgtaag

SEQ ID NO: 565583 - DNA, 20 bp, mouse
ggctctgcgcggtcggtccg

SEQ ID NO: 565584 - DNA, 20 bp, mouse
gggcgtggggcgcttaccgg

SEQ ID NO: 565585 - DNA, 20 bp, mouse
gagggcgcgcgccagacaga

SEQ ID NO: 565586 - DNA, 20 bp, mouse
gcggagcagggcaacctctc

SEQ ID NO: 565587 - DNA, 20 bp, mouse
gacctctcgggcagacctag

SEQ ID NO: 565588 - DNA, 20 bp, mouse
gcagacctagcgggagacac

SEQ ID NO: 565589 - DNA, 20 bp, mouse
gcccgctaggtctgcccgag

SEQ ID NO: 565590 - DNA, 20 bp, mouse
gcgctcctgtgtctcccgct

SEQ ID NO: 565591 - DNA, 20 bp, mouse
ggtgccccagctcatcgagg

SEQ ID NO: 565592 - DNA, 20 bp, mouse
gacccggccggagcagcaga

SEQ ID NO: 565593 - DNA, 20 bp, mouse
ggaccctccggagaagtacc

SEQ ID NO: 565594 - DNA, 20 bp, mouse
ggcggagctagcggccacac

SEQ ID NO: 565595 - DNA, 20 bp, mouse
ggacacaggagcggagctag

SEQ ID NO: 565596 - DNA, 20 bp, mouse
gcatcttcgggagtctggca

SEQ ID NO: 565597 - DNA, 20 bp, mouse
gcagccccgcaggtacgtag

SEQ ID NO: 565598 - DNA, 20 bp, mouse
gggcctcagagccggagtgt

SEQ ID NO: 565599 - DNA, 20 bp, mouse
gagagagcgcgggggagaca

SEQ ID NO: 565600 - DNA, 20 bp, mouse
ggtctggcagggaggcagcg

SEQ ID NO: 565601 - DNA, 20 bp, mouse
gaggcgaggggttcagacag

SEQ ID NO: 565602 - DNA, 20 bp, mouse
gacgcgcccgggactcgcag

SEQ ID NO: 565603 - DNA, 20 bp, mouse
gcgttcatggccatcatctt

SEQ ID NO: 565604 - DNA, 20 bp, mouse
gcagcaagcgagagggcgag

SEQ ID NO: 565605 - DNA, 20 bp, mouse
ggagccgcgagagagcgcgg

SEQ ID NO: 565606 - DNA, 20 bp, mouse
gaggtgtccagccatgggga

SEQ ID NO: 565607 - DNA, 20 bp, mouse
ggagaggtgaaaccgtccct

SEQ ID NO: 565608 - DNA, 20 bp, mouse
gaggtgggcaccccgagccg

SEQ ID NO: 565609 - DNA, 20 bp, mouse
gggaatcggaccaggctcag

SEQ ID NO: 565610 - DNA, 20 bp, mouse
gccaccaggcccccggctcg

SEQ ID NO: 565611 - DNA, 20 bp, mouse
gctcccgaggaggtaagtga

SEQ ID NO: 565612 - DNA, 20 bp, mouse
ggtgggcctggaatcggacc

SEQ ID NO: 565613 - DNA, 20 bp, mouse
gtcgtatgcgggcggacatg

SEQ ID NO: 565614 - DNA, 20 bp, mouse
ggtggaaccaactcccgagg

SEQ ID NO: 565615 - DNA, 20 bp, mouse
gcgtctttccaccaggcccc

SEQ ID NO: 565616 - DNA, 20 bp, mouse
gcataaggtgaggagcccag

SEQ ID NO: 565617 - DNA, 20 bp, mouse
ggcccggccatggggtggat

SEQ ID NO: 565618 - DNA, 20 bp, mouse
gaccactattgcctgagaga

SEQ ID NO: 565619 - DNA, 20 bp, mouse
gcctaccagactcctgctgg

SEQ ID NO: 565620 - DNA, 20 bp, mouse
gagacctccgcccggccatg

SEQ ID NO: 565621 - DNA, 20 bp, mouse
gtccctctctcaggcaatag

SEQ ID NO: 565622 - DNA, 20 bp, mouse
gtaggaactgatagctctcg

SEQ ID NO: 565623 - DNA, 20 bp, mouse
ggggacccccagcaggagtc

SEQ ID NO: 565624 - DNA, 20 bp, mouse
gccaccccatggccgggcgg

SEQ ID NO: 565625 - DNA, 20 bp, mouse
gctgtccaggccctgaggta

SEQ ID NO: 565626 - DNA, 20 bp, mouse
gcggggctggcagagcggag

SEQ ID NO: 565627 - DNA, 20 bp, mouse
gtgggttgcgggccacgcac

SEQ ID NO: 565628 - DNA, 20 bp, mouse
ggcacgggccgggacgccgg

SEQ ID NO: 565629 - DNA, 20 bp, mouse
gcccggaccccgctactcac

SEQ ID NO: 565630 - DNA, 20 bp, mouse
gggcagagcggagcggcggt

SEQ ID NO: 565631 - DNA, 20 bp, mouse
ggcagacaaagaagccggag

SEQ ID NO: 565632 - DNA, 20 bp, mouse
gctggagctctgggagtcga

SEQ ID NO: 565633 - DNA, 20 bp, mouse
gcccgcggacactcgaggag

SEQ ID NO: 565634 - DNA, 20 bp, mouse
gcgctctgccagccccggcg

SEQ ID NO: 565635 - DNA, 20 bp, mouse
gttgcgggccacgcacgggc

SEQ ID NO: 565636 - DNA, 20 bp, mouse
gaaggcctgtgaacttgcta

SEQ ID NO: 565637 - DNA, 20 bp, mouse
gccgctgctgcagcagccat

SEQ ID NO: 565638 - DNA, 20 bp, mouse
gggctccatagcaagttcac

SEQ ID NO: 565639 - DNA, 20 bp, mouse
gtgccctctccagccttcag

SEQ ID NO: 565640 - DNA, 20 bp, mouse
ggaccccctgaaggctggag

SEQ ID NO: 565641 - DNA, 20 bp, mouse
ggtcaagaataggagagggt

SEQ ID NO: 565642 - DNA, 20 bp, mouse
gcaacgtcaagaataggaga

SEQ ID NO: 565643 - DNA, 20 bp, mouse
gtgcacaaggacaggtgagt

SEQ ID NO: 565644 - DNA, 20 bp, mouse
gaatgtcccagtctcgagaa

SEQ ID NO: 565645 - DNA, 20 bp, mouse
gttactgcaacgtcaagaat

SEQ ID NO: 565646 - DNA, 20 bp, mouse
gagtgaaggaggtagtaagg

SEQ ID NO: 565647 - DNA, 20 bp, mouse
gagcagtgaaggaggtagta

SEQ ID NO: 565648 - DNA, 20 bp, mouse
gtggttatggcaagcagtga

SEQ ID NO: 565649 - DNA, 20 bp, mouse
gggtgaagcagatgtggtta

SEQ ID NO: 565650 - DNA, 20 bp, mouse
ggatggtcaacactgtaaca

SEQ ID NO: 565651 - DNA, 20 bp, mouse
gaagtgggccttctgattga

SEQ ID NO: 565652 - DNA, 20 bp, mouse
gggaacctccatcaatcaga

SEQ ID NO: 565653 - DNA, 20 bp, mouse
gctgcaaatagagtaaagta

SEQ ID NO: 565654 - DNA, 20 bp, mouse
gtgggccttctgattgatgg

SEQ ID NO: 565655 - DNA, 20 bp, mouse
gagaaaagtattccatccaa

SEQ ID NO: 565656 - DNA, 20 bp, mouse
gcagacccggagccgctgta

SEQ ID NO: 565657 - DNA, 20 bp, mouse
gacccggagccgctgtacgg

SEQ ID NO: 565658 - DNA, 20 bp, mouse
gcaaccacacagcccagacc

SEQ ID NO: 565659 - DNA, 20 bp, mouse
gtcctccgtacagcggctcc

SEQ ID NO: 565660 - DNA, 20 bp, mouse
ggccgcccgccagagggaag

SEQ ID NO: 565661 - DNA, 20 bp, mouse
gacctccgggcaccttctaa

SEQ ID NO: 565662 - DNA, 20 bp, mouse
ggggccagctcgtggtacgc

SEQ ID NO: 565663 - DNA, 20 bp, mouse
ggctcgtggtacgcaggcgc

SEQ ID NO: 565664 - DNA, 20 bp, mouse
gtggagggagcgctcgcggt

SEQ ID NO: 565665 - DNA, 20 bp, mouse
gggcctcacgccactcactg

SEQ ID NO: 565666 - DNA, 20 bp, mouse
gggcccccacgcgccaccct

SEQ ID NO: 565667 - DNA, 20 bp, mouse
ggcggtacagggacatgacg

SEQ ID NO: 565668 - DNA, 20 bp, mouse
gacggtctgcgagaaccgca

SEQ ID NO: 565669 - DNA, 20 bp, mouse
ggcagcgcgcgcatggcgga

SEQ ID NO: 565670 - DNA, 20 bp, mouse
ggtacaggcagggaggaagt

SEQ ID NO: 565671 - DNA, 20 bp, mouse
gtcggccgagggtggcgcgt

SEQ ID NO: 565672 - DNA, 20 bp, mouse
gatggcccagctcctccgtg

SEQ ID NO: 565673 - DNA, 20 bp, mouse
gctgcggtcgctgcagaggg

SEQ ID NO: 565674 - DNA, 20 bp, mouse
gatgacgcggcgcggagggc

SEQ ID NO: 565675 - DNA, 20 bp, mouse
gggacatgacgcggcgcgga

SEQ ID NO: 565676 - DNA, 20 bp, mouse
ggcgccggaagcgaatacag

SEQ ID NO: 565677 - DNA, 20 bp, mouse
gcagcatggggcagtccggg

SEQ ID NO: 565678 - DNA, 20 bp, mouse
gaggcagcatggggcagtcc

SEQ ID NO: 565679 - DNA, 20 bp, mouse
gatacagaggctgcctcgtg

SEQ ID NO: 565680 - DNA, 20 bp, mouse
gtctcctgcacggaagtgag

SEQ ID NO: 565681 - DNA, 20 bp, mouse
ggtggggaagcaggcagcat

SEQ ID NO: 565682 - DNA, 20 bp, mouse
gctgtgcagcgtaggactcg

SEQ ID NO: 565683 - DNA, 20 bp, mouse
gccgagcgggtcgcaatgtc

SEQ ID NO: 565684 - DNA, 20 bp, mouse
gcgggcatggggcactggtg

SEQ ID NO: 565685 - DNA, 20 bp, mouse
ggcgtgaacacgaacgagtg

SEQ ID NO: 565686 - DNA, 20 bp, mouse
gacaggccgggcgagctcta

SEQ ID NO: 565687 - DNA, 20 bp, mouse
gctctaaggatgaggactgg

SEQ ID NO: 565688 - DNA, 20 bp, mouse
gcgggcgagctctaaggatg

SEQ ID NO: 565689 - DNA, 20 bp, mouse
gctgacgggagcagggacca

SEQ ID NO: 565690 - DNA, 20 bp, mouse
ggaccgcgcactggccggag

SEQ ID NO: 565691 - DNA, 20 bp, mouse
gtcacatcgagggccacgta

SEQ ID NO: 565692 - DNA, 20 bp, mouse
ggtgccctctccaacaggcc

SEQ ID NO: 565693 - DNA, 20 bp, mouse
gagccggcgagaccgcgcac

SEQ ID NO: 565694 - DNA, 20 bp, mouse
ggcctgaggcgacagatcgg

SEQ ID NO: 565695 - DNA, 20 bp, mouse
gtggcgggaggaacagaccg

SEQ ID NO: 565696 - DNA, 20 bp, mouse
gatcacagcggcagcccggg

SEQ ID NO: 565697 - DNA, 20 bp, mouse
gtagctgcggaggatcgtgg

SEQ ID NO: 565698 - DNA, 20 bp, mouse
gtggagttgggcagacgctg

SEQ ID NO: 565699 - DNA, 20 bp, mouse
gacaaaccgagcgatcacag

SEQ ID NO: 565700 - DNA, 20 bp, mouse
gtccctgagagtaagaacgg

SEQ ID NO: 565701 - DNA, 20 bp, mouse
gcgccagccggacgcgtccg

SEQ ID NO: 565702 - DNA, 20 bp, mouse
gaggacgctgcggagttgca

SEQ ID NO: 565703 - DNA, 20 bp, mouse
gatgcgggctcgggacgcgg

SEQ ID NO: 565704 - DNA, 20 bp, mouse
gaagtagctgcggaggatcg

SEQ ID NO: 565705 - DNA, 20 bp, mouse
ggaagaggcagaagaggtcc

SEQ ID NO: 565706 - DNA, 20 bp, mouse
gggacagctggggcaagcgg

SEQ ID NO: 565707 - DNA, 20 bp, mouse
gccccaggatcacatggcgg

SEQ ID NO: 565708 - DNA, 20 bp, mouse
gcagctgtcccggcagcccc

SEQ ID NO: 565709 - DNA, 20 bp, mouse
gcactggccagagggaccga

SEQ ID NO: 565710 - DNA, 20 bp, mouse
gtccatgtcgccccggccca

SEQ ID NO: 565711 - DNA, 20 bp, mouse
gtccaccgccatgtgatcct

SEQ ID NO: 565712 - DNA, 20 bp, mouse
gcaagccctgccctttccct

SEQ ID NO: 565713 - DNA, 20 bp, mouse
gtcccgccaggagcccagga

SEQ ID NO: 565714 - DNA, 20 bp, mouse
gggagcgatgtgactcacac

SEQ ID NO: 565715 - DNA, 20 bp, mouse
gccagcggcctgaaccggaa

SEQ ID NO: 565716 - DNA, 20 bp, mouse
ggccggagtagctcccgcag

SEQ ID NO: 565717 - DNA, 20 bp, mouse
ggccgctgcgggagctactc

SEQ ID NO: 565718 - DNA, 20 bp, mouse
gggccgagccgtgggagcca

SEQ ID NO: 565719 - DNA, 20 bp, mouse
ggcgctgtccgtggctccca

SEQ ID NO: 565720 - DNA, 20 bp, mouse
gaggctccggagagccgctc

SEQ ID NO: 565721 - DNA, 20 bp, mouse
ggaatctcgaacccaggccc

SEQ ID NO: 565722 - DNA, 20 bp, mouse
gccccggcaccaaccaagga

SEQ ID NO: 565723 - DNA, 20 bp, mouse
gtccagactaggagctacta

SEQ ID NO: 565724 - DNA, 20 bp, mouse
gagccgctccggccgagccg

SEQ ID NO: 565725 - DNA, 20 bp, mouse
gtccggagcctgggcggtga

SEQ ID NO: 565726 - DNA, 20 bp, mouse
ggatccgccgctggaaggga

SEQ ID NO: 565727 - DNA, 20 bp, mouse
ggatccagcccgaggagctg

SEQ ID NO: 565728 - DNA, 20 bp, mouse
gcggccctgggagccgagct

SEQ ID NO: 565729 - DNA, 20 bp, mouse
gtacaggaacccgtacgtgg

SEQ ID NO: 565730 - DNA, 20 bp, mouse
ggagcagctcggtcaccctg

SEQ ID NO: 565731 - DNA, 20 bp, mouse
gctctacaggaacccgtacg

SEQ ID NO: 565732 - DNA, 20 bp, mouse
gacgtatggcgggatgggga

SEQ ID NO: 565733 - DNA, 20 bp, mouse
gacgcccagctcggctccca

SEQ ID NO: 565734 - DNA, 20 bp, mouse
gccgcacgtatggcgggatg

SEQ ID NO: 565735 - DNA, 20 bp, mouse
ggccctggaactcaaggcag

SEQ ID NO: 565736 - DNA, 20 bp, mouse
gacccgggcagaccggagac

SEQ ID NO: 565737 - DNA, 20 bp, mouse
gtccctcgatggtcctccgg

SEQ ID NO: 565738 - DNA, 20 bp, mouse
ggcccccggaggaccatcga

SEQ ID NO: 565739 - DNA, 20 bp, mouse
gggctcggcatcgcggaggg

SEQ ID NO: 565740 - DNA, 20 bp, mouse
gcgcgatgccgagcccccgg

SEQ ID NO: 565741 - DNA, 20 bp, mouse
gttccgcccgaggagcccag

SEQ ID NO: 565742 - DNA, 20 bp, mouse
ggccctccgggatggcagtg

SEQ ID NO: 565743 - DNA, 20 bp, mouse
gcgcggagggaggccggtcc

SEQ ID NO: 565744 - DNA, 20 bp, mouse
gcgggatggcagtgcggaag

SEQ ID NO: 565745 - DNA, 20 bp, mouse
gcggaagaggctgacgggct

SEQ ID NO: 565746 - DNA, 20 bp, mouse
gcgccaatagagccacggac

SEQ ID NO: 565747 - DNA, 20 bp, mouse
ggccagcgccaatagagcca

SEQ ID NO: 565748 - DNA, 20 bp, mouse
ggcgctggccctgtaagggt

SEQ ID NO: 565749 - DNA, 20 bp, mouse
gattggcgctggccctgtaa

SEQ ID NO: 565750 - DNA, 20 bp, mouse
gaatagagcccacccttaca

SEQ ID NO: 565751 - DNA, 20 bp, mouse
gtgcctgtccgtggctctat

SEQ ID NO: 565752 - DNA, 20 bp, mouse
gctgccacccggctccgttg

SEQ ID NO: 565753 - DNA, 20 bp, mouse
gcgtccccaacggagccggg

SEQ ID NO: 565754 - DNA, 20 bp, mouse
gggagaaggcccttggaact

SEQ ID NO: 565755 - DNA, 20 bp, mouse
ggcagctgttaaatatagag

SEQ ID NO: 565756 - DNA, 20 bp, mouse
gagagggcacacgctaggaa

SEQ ID NO: 565757 - DNA, 20 bp, mouse
gcgctccaggggactcgaag

SEQ ID NO: 565758 - DNA, 20 bp, mouse
ggacccacagccactggaga

SEQ ID NO: 565759 - DNA, 20 bp, mouse
gtagcgtgtgccctctccag

SEQ ID NO: 565760 - DNA, 20 bp, mouse
gtccaggggactcgaagtgg

SEQ ID NO: 565761 - DNA, 20 bp, mouse
gtctggagacccacagccac

SEQ ID NO: 565762 - DNA, 20 bp, mouse
gcctggaggggagggcacac

SEQ ID NO: 565763 - DNA, 20 bp, mouse
gccctccaggggacaaccag

SEQ ID NO: 565764 - DNA, 20 bp, mouse
gcacacgggcggggacatcg

SEQ ID NO: 565765 - DNA, 20 bp, mouse
ggaagtggcggacagttccg

SEQ ID NO: 565766 - DNA, 20 bp, mouse
gggcggacctggggattaat

SEQ ID NO: 565767 - DNA, 20 bp, mouse
gtgcggagcctgcgggacgg

SEQ ID NO: 565768 - DNA, 20 bp, mouse
gcggctccgagcaaccacag

SEQ ID NO: 565769 - DNA, 20 bp, mouse
gttctgcggagcctgcggga

SEQ ID NO: 565770 - DNA, 20 bp, mouse
ggagcatagacgagccgcag

SEQ ID NO: 565771 - DNA, 20 bp, mouse
ggcaggccgcggcggacctg

SEQ ID NO: 565772 - DNA, 20 bp, mouse
gaggagagcactgaccgaca

SEQ ID NO: 565773 - DNA, 20 bp, mouse
gggattaatgggaaaagttt

SEQ ID NO: 565774 - DNA, 20 bp, mouse
ggatggaaggctatcgaggg

SEQ ID NO: 565775 - DNA, 20 bp, mouse
gctgggtagcgggacagcaa

SEQ ID NO: 565776 - DNA, 20 bp, mouse
gtgacggggtctcggttgag

SEQ ID NO: 565777 - DNA, 20 bp, mouse
ggtcaggctgttggtctcac

SEQ ID NO: 565778 - DNA, 20 bp, mouse
gctctagtcgagacagggtt

SEQ ID NO: 565779 - DNA, 20 bp, mouse
ggtctcggttgaggggacgc

SEQ ID NO: 565780 - DNA, 20 bp, mouse
gcgagaccccgtcaggctgt

SEQ ID NO: 565781 - DNA, 20 bp, mouse
gtctcgactagaggggatac

SEQ ID NO: 565782 - DNA, 20 bp, mouse
gatcccctctagtcgagaca

SEQ ID NO: 565783 - DNA, 20 bp, mouse
gtcatcccgagtcccctcag

SEQ ID NO: 565784 - DNA, 20 bp, mouse
gtgactgggtctccgctgag

SEQ ID NO: 565785 - DNA, 20 bp, mouse
ggagaagtcacattctgaca

SEQ ID NO: 565786 - DNA, 20 bp, mouse
gctggggactgtagtaagac

SEQ ID NO: 565787 - DNA, 20 bp, mouse
gtcagttcactctcagtaag

SEQ ID NO: 565788 - DNA, 20 bp, mouse
gttcactctcagtaaggggc

SEQ ID NO: 565789 - DNA, 20 bp, mouse
ggcgtcattcgggagctgga

SEQ ID NO: 565790 - DNA, 20 bp, mouse
ggtgcagccaagactctgta

SEQ ID NO: 565791 - DNA, 20 bp, mouse
gcaagcaggccactgaacac

SEQ ID NO: 565792 - DNA, 20 bp, mouse
ggtcactccatacagagtct

SEQ ID NO: 565793 - DNA, 20 bp, mouse
gggagttgaaaaagcttgac

SEQ ID NO: 565794 - DNA, 20 bp, mouse
ggatgcaatgattcctggag

SEQ ID NO: 565795 - DNA, 20 bp, mouse
ggggctgagtattgcaggac

SEQ ID NO: 565796 - DNA, 20 bp, mouse
gagatggcggggaacgactg

SEQ ID NO: 565797 - DNA, 20 bp, mouse
gtgcagccgcggctggaaga

SEQ ID NO: 565798 - DNA, 20 bp, mouse
gccccgccatcttccagccg

SEQ ID NO: 565799 - DNA, 20 bp, mouse
gggcgcaccggggtgatcgg

SEQ ID NO: 565800 - DNA, 20 bp, mouse
gacaaggcacgtggaagggg

SEQ ID NO: 565801 - DNA, 20 bp, mouse
gagggaacgagcgcagcggt

SEQ ID NO: 565802 - DNA, 20 bp, mouse
ggcagagggaacgagcgcag

SEQ ID NO: 565803 - DNA, 20 bp, mouse
gcgtgtcagagagatagttg

SEQ ID NO: 565804 - DNA, 20 bp, mouse
gtgtaacggagcgcagcaca

SEQ ID NO: 565805 - DNA, 20 bp, mouse
ggaacgcaggccggggacgt

SEQ ID NO: 565806 - DNA, 20 bp, mouse
gctcttgaggcgttcgatag

SEQ ID NO: 565807 - DNA, 20 bp, mouse
ggaggcgttcgatagcggag

SEQ ID NO: 565808 - DNA, 20 bp, mouse
gtggtgcttggaccacgccg

SEQ ID NO: 565809 - DNA, 20 bp, mouse
gcagtagcgcgagcctcttg

SEQ ID NO: 565810 - DNA, 20 bp, mouse
gcctagcccgcccgggaagg

SEQ ID NO: 565811 - DNA, 20 bp, mouse
gcgcctcggaaagcacgtgg

SEQ ID NO: 565812 - DNA, 20 bp, mouse
ggaacctagcccgcccggga

SEQ ID NO: 565813 - DNA, 20 bp, mouse
gactcgtggggctacagcac

SEQ ID NO: 565814 - DNA, 20 bp, mouse
ggtggagggacctgctgccg

SEQ ID NO: 565815 - DNA, 20 bp, mouse
ggcgagaacctagcccgccc

SEQ ID NO: 565816 - DNA, 20 bp, mouse
ggccaggagggaacaacgtg

SEQ ID NO: 565817 - DNA, 20 bp, mouse
gccctggtgcaggacgatgt

SEQ ID NO: 565818 - DNA, 20 bp, mouse
ggcctcacgttgttccctcc

SEQ ID NO: 565819 - DNA, 20 bp, mouse
gaacatagcagcagtgttct

SEQ ID NO: 565820 - DNA, 20 bp, mouse
gcgcttagacacatgatgaa

SEQ ID NO: 565821 - DNA, 20 bp, mouse
ggatctggaggttatgaagt

SEQ ID NO: 565822 - DNA, 20 bp, mouse
gcagggaaagatgagtatga

SEQ ID NO: 565823 - DNA, 20 bp, mouse
gggcttgtggtgctcatggt

SEQ ID NO: 565824 - DNA, 20 bp, mouse
gcagcagcagcaagatctgg

SEQ ID NO: 565825 - DNA, 20 bp, mouse
gaaggggagccagcgcaaca

SEQ ID NO: 565826 - DNA, 20 bp, mouse
gctcccaccgccccacccgg

SEQ ID NO: 565827 - DNA, 20 bp, mouse
ggagtcatttagagccggaa

SEQ ID NO: 565828 - DNA, 20 bp, mouse
gcgcaagtatcgcggtatct

SEQ ID NO: 565829 - DNA, 20 bp, mouse
gaggatacccgcaagtatcg

SEQ ID NO: 565830 - DNA, 20 bp, mouse
ggcggacccacagcgaccag

SEQ ID NO: 565831 - DNA, 20 bp, mouse
gagtctgaggccctgaatga

SEQ ID NO: 565832 - DNA, 20 bp, mouse
gaaaggtaagcgtcaagtgt

SEQ ID NO: 565833 - DNA, 20 bp, mouse
gcttgcgggtatcctggagc

SEQ ID NO: 565834 - DNA, 20 bp, mouse
gggcgggaaagctgtgtcgg

SEQ ID NO: 565835 - DNA, 20 bp, mouse
ggatagagcatgatatctgc

SEQ ID NO: 565836 - DNA, 20 bp, mouse
gctgcactgtagtcacccca

SEQ ID NO: 565837 - DNA, 20 bp, mouse
ggcgcagcacccgcaggacg

SEQ ID NO: 565838 - DNA, 20 bp, mouse
gggcgctgtggttctaccgt

SEQ ID NO: 565839 - DNA, 20 bp, mouse
gcccagcgcgcagcacccgc

SEQ ID NO: 565840 - DNA, 20 bp, mouse
gcgggaagcggtgggcatag

SEQ ID NO: 565841 - DNA, 20 bp, mouse
gacagtgcagatggcggaaa

SEQ ID NO: 565842 - DNA, 20 bp, mouse
gccggcgtgcccgggcgctg

SEQ ID NO: 565843 - DNA, 20 bp, mouse
ggctgggccagaaggccgaa

SEQ ID NO: 565844 - DNA, 20 bp, mouse
ggcagcccaggtatccggaa

SEQ ID NO: 565845 - DNA, 20 bp, mouse
ggcctggggcgggaagcggt

SEQ ID NO: 565846 - DNA, 20 bp, mouse
ggcgcgcgtgggtcctaaag

SEQ ID NO: 565847 - DNA, 20 bp, mouse
ggctgcgtggtgagacaaag

SEQ ID NO: 565848 - DNA, 20 bp, mouse
gcgcgcgccccgcctcccag

SEQ ID NO: 565849 - DNA, 20 bp, mouse
gtcaggacccgggagactcg

SEQ ID NO: 565850 - DNA, 20 bp, mouse
ggaggtgagggcagtgacga

SEQ ID NO: 565851 - DNA, 20 bp, mouse
gggagactcggggaaccctc

SEQ ID NO: 565852 - DNA, 20 bp, mouse
gctcaccacgcagccggacc

SEQ ID NO: 565853 - DNA, 20 bp, mouse
gctggtcaccgcacaccgga

SEQ ID NO: 565854 - DNA, 20 bp, mouse
gcaaaagacgcaccactggg

SEQ ID NO: 565855 - DNA, 20 bp, mouse
gtaagtgcagaaccagccag

SEQ ID NO: 565856 - DNA, 20 bp, mouse
ggtgtgccttccatattgaa

SEQ ID NO: 565857 - DNA, 20 bp, mouse
gagatgcacaatagctagaa

SEQ ID NO: 565858 - DNA, 20 bp, mouse
ggctactgtgcctttcaata

SEQ ID NO: 565859 - DNA, 20 bp, mouse
gaggctccatccgcttctct

SEQ ID NO: 565860 - DNA, 20 bp, mouse
ggcagacagccacgccttag

SEQ ID NO: 565861 - DNA, 20 bp, mouse
gaacatcctagagaagcgga

SEQ ID NO: 565862 - DNA, 20 bp, mouse
gggatggagcctctaaggcg

SEQ ID NO: 565863 - DNA, 20 bp, mouse
ggaagcggatggagcctcta

SEQ ID NO: 565864 - DNA, 20 bp, mouse
ggctacagcgctgctgaacc

SEQ ID NO: 565865 - DNA, 20 bp, mouse
gtattctctcttgccatatg

SEQ ID NO: 565866 - DNA, 20 bp, mouse
gccgtgggcagcaacaccct

SEQ ID NO: 565867 - DNA, 20 bp, mouse
gatgtccaccttcaagccgt

SEQ ID NO: 565868 - DNA, 20 bp, mouse
gcaacaccctgggtcaaagg

SEQ ID NO: 565869 - DNA, 20 bp, mouse
gaaggaggcccggggactgg

SEQ ID NO: 565870 - DNA, 20 bp, mouse
ggaggcaagtctgcagagtg

SEQ ID NO: 565871 - DNA, 20 bp, mouse
gcagcaacaccctgggtcaa

SEQ ID NO: 565872 - DNA, 20 bp, mouse
ggctgcccacggcttgaagg

SEQ ID NO: 565873 - DNA, 20 bp, mouse
gtagctgactctgagacacg

SEQ ID NO: 565874 - DNA, 20 bp, mouse
gaggatgacaccgactaccc

SEQ ID NO: 565875 - DNA, 20 bp, mouse
gagacttgcctccagtcccc

SEQ ID NO: 565876 - DNA, 20 bp, mouse
gctagcgagcgcagagaacc

SEQ ID NO: 565877 - DNA, 20 bp, mouse
gtgcgctcgctagtgtcccg

SEQ ID NO: 565878 - DNA, 20 bp, mouse
ggctcgctagtgtcccgcgg

SEQ ID NO: 565879 - DNA, 20 bp, mouse
ggccttcgtgacgagcgggg

SEQ ID NO: 565880 - DNA, 20 bp, mouse
ggccgccccgctcgtcacga

SEQ ID NO: 565881 - DNA, 20 bp, mouse
gctatgaagcggccttcggg

SEQ ID NO: 565882 - DNA, 20 bp, mouse
ggaaggccggcccgccgccg

SEQ ID NO: 565883 - DNA, 20 bp, mouse
gacgtcgggcacgttgacgc

SEQ ID NO: 565884 - DNA, 20 bp, mouse
gcgccgacgcgccggacgtc

SEQ ID NO: 565885 - DNA, 20 bp, mouse
ggcgcccgccggccaaggtg

SEQ ID NO: 565886 - DNA, 20 bp, mouse
ggaaaggtccatcggaaaaa

SEQ ID NO: 565887 - DNA, 20 bp, mouse
ggcagttcggcatcttcccg

SEQ ID NO: 565888 - DNA, 20 bp, mouse
gctgccacgttaggaagcca

SEQ ID NO: 565889 - DNA, 20 bp, mouse
gtcctaacgtggcagcagtt

SEQ ID NO: 565890 - DNA, 20 bp, mouse
gggctccgtcagcagccaaa

SEQ ID NO: 565891 - DNA, 20 bp, mouse
ggtgccctggcttcctaacg

SEQ ID NO: 565892 - DNA, 20 bp, mouse
gccccaggagagaacgagct

SEQ ID NO: 565893 - DNA, 20 bp, mouse
gtggctgctgacggagccac

SEQ ID NO: 565894 - DNA, 20 bp, mouse
gtctcctccagccgagactg

SEQ ID NO: 565895 - DNA, 20 bp, mouse
ggggctggggaggtggtcaa

SEQ ID NO: 565896 - DNA, 20 bp, mouse
gtccgcgagaaggacctccg

SEQ ID NO: 565897 - DNA, 20 bp, mouse
gaccccggaggtccttctcg

SEQ ID NO: 565898 - DNA, 20 bp, mouse
gaacatctcggctgaatcgg

SEQ ID NO: 565899 - DNA, 20 bp, mouse
gtgaatcgggggttacaccc

SEQ ID NO: 565900 - DNA, 20 bp, mouse
gggagagcctagggctcctg

SEQ ID NO: 565901 - DNA, 20 bp, mouse
ggaacatcttcctccaggat

SEQ ID NO: 565902 - DNA, 20 bp, mouse
ggtaggctagaccagataga

SEQ ID NO: 565903 - DNA, 20 bp, mouse
gaagttggggggtaacatct

SEQ ID NO: 565904 - DNA, 20 bp, mouse
gggaagcccgggagagccta

SEQ ID NO: 565905 - DNA, 20 bp, mouse
gtcgcggaacatcttcctcc

SEQ ID NO: 565906 - DNA, 20 bp, mouse
gccctggaggaggcacaagg

SEQ ID NO: 565907 - DNA, 20 bp, mouse
gggttccagagctccagatc

SEQ ID NO: 565908 - DNA, 20 bp, mouse
gggcggccggggcccggatc

SEQ ID NO: 565909 - DNA, 20 bp, mouse
gctagactgagggatcccct

SEQ ID NO: 565910 - DNA, 20 bp, mouse
ggcccaccctggggacccct

SEQ ID NO: 565911 - DNA, 20 bp, mouse
ggctagcccaggggtcccca

SEQ ID NO: 565912 - DNA, 20 bp, mouse
gcagtcgtcgcggaccaggt

SEQ ID NO: 565913 - DNA, 20 bp, mouse
gaggctgtgagaccgtgagg

SEQ ID NO: 565914 - DNA, 20 bp, mouse
gctgtctacgccgctagcgc

SEQ ID NO: 565915 - DNA, 20 bp, mouse
ggagctccagatccgggccc

SEQ ID NO: 565916 - DNA, 20 bp, mouse
gagagaatgtctgggccctt

SEQ ID NO: 565917 - DNA, 20 bp, mouse
gaggggagggcacagcctaa

SEQ ID NO: 565918 - DNA, 20 bp, mouse
ggaaagcagagagaatgtct

SEQ ID NO: 565919 - DNA, 20 bp, mouse
gccatcccacggagaccaga

SEQ ID NO: 565920 - DNA, 20 bp, mouse
ggcccttcctggctgaagtg

SEQ ID NO: 565921 - DNA, 20 bp, mouse
gagccgtccatactcaggat

SEQ ID NO: 565922 - DNA, 20 bp, mouse
gttccaggggtggttaaggg

SEQ ID NO: 565923 - DNA, 20 bp, mouse
gtgagcccttcgttgtgaag

SEQ ID NO: 565924 - DNA, 20 bp, mouse
gctttccccttcacaacgaa

SEQ ID NO: 565925 - DNA, 20 bp, mouse
gcccactgcatgcaccacag

SEQ ID NO: 565926 - DNA, 20 bp, mouse
gtacacggcgacaggagccg

SEQ ID NO: 565927 - DNA, 20 bp, mouse
ggccgcccccgcgccctaca

SEQ ID NO: 565928 - DNA, 20 bp, mouse
gagcttcggggtgacaggaa

SEQ ID NO: 565929 - DNA, 20 bp, mouse
ggtcgccgtgtagggcgcgg

SEQ ID NO: 565930 - DNA, 20 bp, mouse
gtgacaggaagggctcgtct

SEQ ID NO: 565931 - DNA, 20 bp, mouse
gaggggaggcggcacctggg

SEQ ID NO: 565932 - DNA, 20 bp, mouse
gtctgtgctgtggggagtcc

SEQ ID NO: 565933 - DNA, 20 bp, mouse
gtcgcagaaggaaccgcccg

SEQ ID NO: 565934 - DNA, 20 bp, mouse
gcgcgtcgagagtggcgatc

SEQ ID NO: 565935 - DNA, 20 bp, mouse
gagtccgggtgagggaaccg

SEQ ID NO: 565936 - DNA, 20 bp, mouse
ggagcggagaacccagtgac

SEQ ID NO: 565937 - DNA, 20 bp, mouse
gggaccaactgccaaccaag

SEQ ID NO: 565938 - DNA, 20 bp, mouse
gggcgggtctgccacttggt

SEQ ID NO: 565939 - DNA, 20 bp, mouse
ggggccagtggcctgtcact

SEQ ID NO: 565940 - DNA, 20 bp, mouse
ggaacccagtgacaggccac

SEQ ID NO: 565941 - DNA, 20 bp, mouse
gtggttggcagttggtcctt

SEQ ID NO: 565942 - DNA, 20 bp, mouse
gagtggtccccaggataccg

SEQ ID NO: 565943 - DNA, 20 bp, mouse
ggggttctccgctcttatgt

SEQ ID NO: 565944 - DNA, 20 bp, mouse
gacactttccaacataagag

SEQ ID NO: 565945 - DNA, 20 bp, mouse
gcgtgggtgccgaaccgggt

SEQ ID NO: 565946 - DNA, 20 bp, mouse
ggcttcgcgggtttcaccgg

SEQ ID NO: 565947 - DNA, 20 bp, mouse
ggtttcaccggcggctgagg

SEQ ID NO: 565948 - DNA, 20 bp, mouse
gtgggacgtaggtgagcgag

SEQ ID NO: 565949 - DNA, 20 bp, mouse
gagcgagtggctctccgcag

SEQ ID NO: 565950 - DNA, 20 bp, mouse
gctgccgagaagcggaacct

SEQ ID NO: 565951 - DNA, 20 bp, mouse
gtcctagtggaacctggaga

SEQ ID NO: 565952 - DNA, 20 bp, mouse
gctctccgcagaggcgcgag

SEQ ID NO: 565953 - DNA, 20 bp, mouse
gtgcgcccctcgcgcctctg

SEQ ID NO: 565954 - DNA, 20 bp, mouse
ggtggaggagagtgagaccc

SEQ ID NO: 565955 - DNA, 20 bp, mouse
gcgggtttcaccggcggctg

SEQ ID NO: 565956 - DNA, 20 bp, mouse
gaccctgcctaaggtctcag

SEQ ID NO: 565957 - DNA, 20 bp, mouse
gagcggcacgagcctcgccg

SEQ ID NO: 565958 - DNA, 20 bp, mouse
gggagcagggcggggcccaa

SEQ ID NO: 565959 - DNA, 20 bp, mouse
gccgcgctcgctccaccgga

SEQ ID NO: 565960 - DNA, 20 bp, mouse
ggcgcggcccgaccctccgg

SEQ ID NO: 565961 - DNA, 20 bp, mouse
ggggcccgaaccgggtataa

SEQ ID NO: 565962 - DNA, 20 bp, mouse
gccgggtataaaggaagccg

SEQ ID NO: 565963 - DNA, 20 bp, mouse
gtggagggggaggctctctc

SEQ ID NO: 565964 - DNA, 20 bp, mouse
gccttcgcccctgagacctt

SEQ ID NO: 565965 - DNA, 20 bp, mouse
gccccgagcggaaacgagaa

SEQ ID NO: 565966 - DNA, 20 bp, mouse
gcgagaggcgcagcatccac

SEQ ID NO: 565967 - DNA, 20 bp, mouse
gggcagcagcaagagcggtc

SEQ ID NO: 565968 - DNA, 20 bp, mouse
gctctcggagcgcaatatga

SEQ ID NO: 565969 - DNA, 20 bp, mouse
gacggagcccacgatgaggg

SEQ ID NO: 565970 - DNA, 20 bp, mouse
ggagcccacgatgagggcgg

SEQ ID NO: 565971 - DNA, 20 bp, mouse
gacgacggagcccacgatga

SEQ ID NO: 565972 - DNA, 20 bp, mouse
gtcgccgccgccctcatcgt

SEQ ID NO: 565973 - DNA, 20 bp, mouse
gggcagcaaaaggaagacga

SEQ ID NO: 565974 - DNA, 20 bp, mouse
ggcggtcgggcagcccggac

SEQ ID NO: 565975 - DNA, 20 bp, mouse
gccgctcttgctgctgccgg

SEQ ID NO: 565976 - DNA, 20 bp, mouse
ggcggtggaagtggcaacga

SEQ ID NO: 565977 - DNA, 20 bp, mouse
ggaagtggcaacgatggcac

SEQ ID NO: 565978 - DNA, 20 bp, mouse
gaagcgtccggccacagtcc

SEQ ID NO: 565979 - DNA, 20 bp, mouse
gccgcgggcagcagcagacg

SEQ ID NO: 565980 - DNA, 20 bp, mouse
ggccccaggcagagcaccgc

SEQ ID NO: 565981 - DNA, 20 bp, mouse
ggccacagtcccggagccta

SEQ ID NO: 565982 - DNA, 20 bp, mouse
gtcatggtgcgcggtggaag

SEQ ID NO: 565983 - DNA, 20 bp, mouse
ggaccccgaagaagacacca

SEQ ID NO: 565984 - DNA, 20 bp, mouse
gatggcacgggcgcaacctt

SEQ ID NO: 565985 - DNA, 20 bp, mouse
gccgggctcatggtgcgcgg

SEQ ID NO: 565986 - DNA, 20 bp, mouse
ggccaggttataacgtagag

SEQ ID NO: 565987 - DNA, 20 bp, mouse
gcactgcgggcactgggcag

SEQ ID NO: 565988 - DNA, 20 bp, mouse
gcatcttcactgcgggcact

SEQ ID NO: 565989 - DNA, 20 bp, mouse
gggggcagtagagtttgctc

SEQ ID NO: 565990 - DNA, 20 bp, mouse
gcgagccgccgaacagccag

SEQ ID NO: 565991 - DNA, 20 bp, mouse
gtggcccgctggctgttcgg

SEQ ID NO: 565992 - DNA, 20 bp, mouse
ggccagggctcgctccgtct

SEQ ID NO: 565993 - DNA, 20 bp, mouse
ggcccctctacgttataacc

SEQ ID NO: 565994 - DNA, 20 bp, mouse
gagcggcgcgaacggctcag

SEQ ID NO: 565995 - DNA, 20 bp, mouse
ggccaaggagaaccgcagca

SEQ ID NO: 565996 - DNA, 20 bp, mouse
gccaagcgtgtgctgtacgt

SEQ ID NO: 565997 - DNA, 20 bp, mouse
gtacagcacacgcttggtgg

SEQ ID NO: 565998 - DNA, 20 bp, mouse
ggtacgtgggtgagcaggcg

SEQ ID NO: 565999 - DNA, 20 bp, mouse
gtgagggtgtgagcccgaga

SEQ ID NO: 566000 - DNA, 20 bp, mouse
ggaaacgggcgcgagcaaga

SEQ ID NO: 566001 - DNA, 20 bp, mouse
ggccgagtgccggcttccgg

SEQ ID NO: 566002 - DNA, 20 bp, mouse
gcgaatgggcgggagggatt

SEQ ID NO: 566003 - DNA, 20 bp, mouse
gagcagccggggtctatgga

SEQ ID NO: 566004 - DNA, 20 bp, mouse
gtggatctctgccctaaagg

SEQ ID NO: 566005 - DNA, 20 bp, mouse
gcaccggagccgaagctcaa

SEQ ID NO: 566006 - DNA, 20 bp, mouse
ggccggagagcagaccgagc

SEQ ID NO: 566007 - DNA, 20 bp, mouse
gagcatcgctgtcgcgggtc

SEQ ID NO: 566008 - DNA, 20 bp, mouse
ggctgtcgcgggtcgggcga

SEQ ID NO: 566009 - DNA, 20 bp, mouse
gtacagggcccgggaagtcc

SEQ ID NO: 566010 - DNA, 20 bp, mouse
gggagagcagaccgagcagg

SEQ ID NO: 566011 - DNA, 20 bp, mouse
gccgcgtggtgctggaggtg

SEQ ID NO: 566012 - DNA, 20 bp, mouse
ggcgctagcatcgctgtcgc

SEQ ID NO: 566013 - DNA, 20 bp, mouse
gccagcaccacgcggccgag

SEQ ID NO: 566014 - DNA, 20 bp, mouse
gccgccgtcgctgcaggtac

SEQ ID NO: 566015 - DNA, 20 bp, mouse
gtacacgagcgggttcccgg

SEQ ID NO: 566016 - DNA, 20 bp, mouse
gagcccaggccaggcgtgga

SEQ ID NO: 566017 - DNA, 20 bp, mouse
gagcagcccagagacctcga

SEQ ID NO: 566018 - DNA, 20 bp, mouse
gtcgcgccggaagtacgtca

SEQ ID NO: 566019 - DNA, 20 bp, mouse
gccacagcccaggccaggcg

SEQ ID NO: 566020 - DNA, 20 bp, mouse
gttggggacgagagcgggaa

SEQ ID NO: 566021 - DNA, 20 bp, mouse
gaatctaccgccgtcaggaa

SEQ ID NO: 566022 - DNA, 20 bp, mouse
ggctttagcgcctttcctga

SEQ ID NO: 566023 - DNA, 20 bp, mouse
gccggaagtacgtcagggat

SEQ ID NO: 566024 - DNA, 20 bp, mouse
gggagtgtccctaacaccaa

SEQ ID NO: 566025 - DNA, 20 bp, mouse
gggggagggaggcggttagt

SEQ ID NO: 566026 - DNA, 20 bp, mouse
ggtagaaacccggcttccgg

SEQ ID NO: 566027 - DNA, 20 bp, mouse
gagttcgcgggacctgccac

SEQ ID NO: 566028 - DNA, 20 bp, mouse
ggtctcgggagggctataag

SEQ ID NO: 566029 - DNA, 20 bp, mouse
gggacctgccaccggaagcc

SEQ ID NO: 566030 - DNA, 20 bp, mouse
ggaccggctgggccaggcgg

SEQ ID NO: 566031 - DNA, 20 bp, mouse
gggttggcctcgggtaaggg

SEQ ID NO: 566032 - DNA, 20 bp, mouse
gaagccgggtttctacttcc

SEQ ID NO: 566033 - DNA, 20 bp, mouse
ggaggccaaccagcccgcac

SEQ ID NO: 566034 - DNA, 20 bp, mouse
gcagcattggcggccaggtg

SEQ ID NO: 566035 - DNA, 20 bp, mouse
gaggtcgcccgcacctcacc

SEQ ID NO: 566036 - DNA, 20 bp, mouse
gtagtctccaggtagacgtt

SEQ ID NO: 566037 - DNA, 20 bp, mouse
gctacctggagactaggtga

SEQ ID NO: 566038 - DNA, 20 bp, mouse
gctggagactaggtgagggt

SEQ ID NO: 566039 - DNA, 20 bp, mouse
ggggcggctgccaggtgtct

SEQ ID NO: 566040 - DNA, 20 bp, mouse
ggtagtgattgctagcgggg

SEQ ID NO: 566041 - DNA, 20 bp, mouse
gaccggaagtgtgtgcccag

SEQ ID NO: 566042 - DNA, 20 bp, mouse
gaagttctgaagggacctca

SEQ ID NO: 566043 - DNA, 20 bp, mouse
gcagccgcccaacgtctacc

SEQ ID NO: 566044 - DNA, 20 bp, mouse
ggcccgcacgcacagagctg

SEQ ID NO: 566045 - DNA, 20 bp, mouse
gtagcaatcactacttccgg

SEQ ID NO: 566046 - DNA, 20 bp, mouse
gtggtgctgtcgcttcccca

SEQ ID NO: 566047 - DNA, 20 bp, mouse
ggaagtagttgagaaagcgg

SEQ ID NO: 566048 - DNA, 20 bp, mouse
ggggaagcgacagcaccaga

SEQ ID NO: 566049 - DNA, 20 bp, mouse
gaagcggacaaccaactcag

SEQ ID NO: 566050 - DNA, 20 bp, mouse
gtcgttcgcagaaaggctag

SEQ ID NO: 566051 - DNA, 20 bp, mouse
ggctaggggtagggaaatcc

SEQ ID NO: 566052 - DNA, 20 bp, mouse
gcccgcgtaggctgcactga

SEQ ID NO: 566053 - DNA, 20 bp, mouse
gaccgcgcctgtgagagctg

SEQ ID NO: 566054 - DNA, 20 bp, mouse
gagaacgccctggcccgcgt

SEQ ID NO: 566055 - DNA, 20 bp, mouse
ggactagagccaggacgaag

SEQ ID NO: 566056 - DNA, 20 bp, mouse
gagcccggagccctccgcag

SEQ ID NO: 566057 - DNA, 20 bp, mouse
ggccgctgtatgaagttgct

SEQ ID NO: 566058 - DNA, 20 bp, mouse
gagagactgacgggagagta

SEQ ID NO: 566059 - DNA, 20 bp, mouse
ggcgcagtgggtgagtgtgg

SEQ ID NO: 566060 - DNA, 20 bp, mouse
gcgcctgctgcgccccacgt

SEQ ID NO: 566061 - DNA, 20 bp, mouse
gagagctctcaggggccgag

SEQ ID NO: 566062 - DNA, 20 bp, mouse
gatcctcgtggtgaactctc

SEQ ID NO: 566063 - DNA, 20 bp, mouse
ggctccgggcttcacttctg

SEQ ID NO: 566064 - DNA, 20 bp, mouse
gtgcttcttagtgaggttgt

SEQ ID NO: 566065 - DNA, 20 bp, mouse
gtctagagcactagacctgg

SEQ ID NO: 566066 - DNA, 20 bp, mouse
ggtctccaagagaaccgcca

SEQ ID NO: 566067 - DNA, 20 bp, mouse
gggaggagccggcgccatgg

SEQ ID NO: 566068 - DNA, 20 bp, mouse
gttctcttggagaccactct

SEQ ID NO: 566069 - DNA, 20 bp, mouse
gatgaccacgtcgcccagag

SEQ ID NO: 566070 - DNA, 20 bp, mouse
gtccgcaggaacaaacaccc

SEQ ID NO: 566071 - DNA, 20 bp, mouse
gggcgccatggcggttctct

SEQ ID NO: 566072 - DNA, 20 bp, mouse
ggagaccactctgggcgacg

SEQ ID NO: 566073 - DNA, 20 bp, mouse
gggcctccagtctcaccccg

SEQ ID NO: 566074 - DNA, 20 bp, mouse
gacactgaagagcgtccccg

SEQ ID NO: 566075 - DNA, 20 bp, mouse
ggccggggtgtttgttcctg

SEQ ID NO: 566076 - DNA, 20 bp, mouse
gaccgcacgtgacatgctgg

SEQ ID NO: 566077 - DNA, 20 bp, mouse
ggccagcgcaggcgacaccg

SEQ ID NO: 566078 - DNA, 20 bp, mouse
ggcttcgacttgggccggca

SEQ ID NO: 566079 - DNA, 20 bp, mouse
gctgctgggtggccatggca

SEQ ID NO: 566080 - DNA, 20 bp, mouse
ggcttcaggggcggctcggg

SEQ ID NO: 566081 - DNA, 20 bp, mouse
gccagccctaggacagaacg

SEQ ID NO: 566082 - DNA, 20 bp, mouse
gggccggcacggctgctggg

SEQ ID NO: 566083 - DNA, 20 bp, mouse
ggaggctgaggtggtatctg

SEQ ID NO: 566084 - DNA, 20 bp, mouse
gtgggggcttcgacttgggc

SEQ ID NO: 566085 - DNA, 20 bp, mouse
gatgctgggggcttcgactt

SEQ ID NO: 566086 - DNA, 20 bp, mouse
ggtgtcgctgccggcaggtt

SEQ ID NO: 566087 - DNA, 20 bp, mouse
gacccggcgccgagagagag

SEQ ID NO: 566088 - DNA, 20 bp, mouse
gcggcagcgacacctgacag

SEQ ID NO: 566089 - DNA, 20 bp, mouse
ggagtgcagtctggatggga

SEQ ID NO: 566090 - DNA, 20 bp, mouse
gcgggtgtggaggggtccaa

SEQ ID NO: 566091 - DNA, 20 bp, mouse
ggagggaggcgggtgagtgc

SEQ ID NO: 566092 - DNA, 20 bp, mouse
ggaagatggaaggcttgcag

SEQ ID NO: 566093 - DNA, 20 bp, mouse
gaggcctcaatgtcagcgta

SEQ ID NO: 566094 - DNA, 20 bp, mouse
gggttcggctgcgcgagcgg

SEQ ID NO: 566095 - DNA, 20 bp, mouse
gctcgcgcagccgaacctgc

SEQ ID NO: 566096 - DNA, 20 bp, mouse
gggcgtgtcggaggctcctg

SEQ ID NO: 566097 - DNA, 20 bp, mouse
ggtgccgaggcggctctcgg

SEQ ID NO: 566098 - DNA, 20 bp, mouse
ggccagtgccagcggttccg

SEQ ID NO: 566099 - DNA, 20 bp, mouse
gccgggagaggcgacatctc

SEQ ID NO: 566100 - DNA, 20 bp, mouse
gcagggaagaggcgtgtcgg

SEQ ID NO: 566101 - DNA, 20 bp, mouse
gaaggacgcttgtgccgagg

SEQ ID NO: 566102 - DNA, 20 bp, mouse
ggttccgcggtggccggcga

SEQ ID NO: 566103 - DNA, 20 bp, mouse
gaccgcggaaccgctggcac

SEQ ID NO: 566104 - DNA, 20 bp, mouse
gacgcctccgagagccgcct

SEQ ID NO: 566105 - DNA, 20 bp, mouse
gccggccaccgcggaaccgc

SEQ ID NO: 566106 - DNA, 20 bp, mouse
ggggcgcaggtgaaagaagg

SEQ ID NO: 566107 - DNA, 20 bp, mouse
gcgcaggtgaaagaaggcgg

SEQ ID NO: 566108 - DNA, 20 bp, mouse
gggcgggcgcaggtgaaaga

SEQ ID NO: 566109 - DNA, 20 bp, mouse
gttaggatgagggagaccta

SEQ ID NO: 566110 - DNA, 20 bp, mouse
gtgaaagaaggcggcggagg

SEQ ID NO: 566111 - DNA, 20 bp, mouse
gggcgcgcaccgaaagcggg

SEQ ID NO: 566112 - DNA, 20 bp, mouse
ggccaggagtggggatgcgt

SEQ ID NO: 566113 - DNA, 20 bp, mouse
ggcgcgcagagccccgtgtg

SEQ ID NO: 566114 - DNA, 20 bp, mouse
gcccggcgcgcaccgaaagc

SEQ ID NO: 566115 - DNA, 20 bp, mouse
ggacagagggacctggaacg

SEQ ID NO: 566116 - DNA, 20 bp, mouse
gccggccggcgcggagacca

SEQ ID NO: 566117 - DNA, 20 bp, mouse
gcgcaggagctagaacgccg

SEQ ID NO: 566118 - DNA, 20 bp, mouse
gtccgcagctcgggatcggg

SEQ ID NO: 566119 - DNA, 20 bp, mouse
ggccacccgatcccgagctg

SEQ ID NO: 566120 - DNA, 20 bp, mouse
gcgatcccgagctgcggacc

SEQ ID NO: 566121 - DNA, 20 bp, mouse
ggctcgggatcgggtggctg

SEQ ID NO: 566122 - DNA, 20 bp, mouse
gcgcggggccgcgctagagg

SEQ ID NO: 566123 - DNA, 20 bp, mouse
gaacgccgtggtctccgcgc

SEQ ID NO: 566124 - DNA, 20 bp, mouse
gccggccgggtccgcagctc

SEQ ID NO: 566125 - DNA, 20 bp, mouse
ggctgcggacccggccggcg

SEQ ID NO: 566126 - DNA, 20 bp, mouse
gcggagcggccgctgctcaa

SEQ ID NO: 566127 - DNA, 20 bp, mouse
gagcggccgctgctcaatgg

SEQ ID NO: 566128 - DNA, 20 bp, mouse
gctgaccgcctggtcccccc

SEQ ID NO: 566129 - DNA, 20 bp, mouse
gcctggggcgaaggtagaaa

SEQ ID NO: 566130 - DNA, 20 bp, mouse
gtcccccctggcagttgcgg

SEQ ID NO: 566131 - DNA, 20 bp, mouse
ggcgcaaagcggccttacct

SEQ ID NO: 566132 - DNA, 20 bp, mouse
ggtcggcagcggctctgggt

SEQ ID NO: 566133 - DNA, 20 bp, mouse
gctccagagagatcaggctg

SEQ ID NO: 566134 - DNA, 20 bp, mouse
gctcccccgcaactgccagg

SEQ ID NO: 566135 - DNA, 20 bp, mouse
ggcggcggccgagtcggcag

SEQ ID NO: 566136 - DNA, 20 bp, mouse
ggaagccgagagtgaagagg

SEQ ID NO: 566137 - DNA, 20 bp, mouse
ggtgggaacggcgggatccc

SEQ ID NO: 566138 - DNA, 20 bp, mouse
ggaggaggcggtccccgcgg

SEQ ID NO: 566139 - DNA, 20 bp, mouse
gcagggcgggaggaagtaca

SEQ ID NO: 566140 - DNA, 20 bp, mouse
gagctgggccggtcgagtcg

SEQ ID NO: 566141 - DNA, 20 bp, mouse
gtcgaccggcccagctctcg

SEQ ID NO: 566142 - DNA, 20 bp, mouse
ggaagaggaggcggtccccg

SEQ ID NO: 566143 - DNA, 20 bp, mouse
gccgacgccggcgagagtgg

SEQ ID NO: 566144 - DNA, 20 bp, mouse
gctctcgcccgcgactcgac

SEQ ID NO: 566145 - DNA, 20 bp, mouse
gttgtccgcgagagctgggc

SEQ ID NO: 566146 - DNA, 20 bp, mouse
gggagggggaacggccgcac

SEQ ID NO: 566147 - DNA, 20 bp, mouse
gggagcctcgcctcccgcta

SEQ ID NO: 566148 - DNA, 20 bp, mouse
gctcgcctcccgctacggag

SEQ ID NO: 566149 - DNA, 20 bp, mouse
gcccgagcccgaagacgagg

SEQ ID NO: 566150 - DNA, 20 bp, mouse
ggggcaccggcgatcagcac

SEQ ID NO: 566151 - DNA, 20 bp, mouse
gcccttcccggtggacctcg

SEQ ID NO: 566152 - DNA, 20 bp, mouse
ggtagaggcgaccgaggagg

SEQ ID NO: 566153 - DNA, 20 bp, mouse
gggaacggccgcacgggcac

SEQ ID NO: 566154 - DNA, 20 bp, mouse
gctgatcgccggtgcccgtg

SEQ ID NO: 566155 - DNA, 20 bp, mouse
gtcccgctacggagggggaa

SEQ ID NO: 566156 - DNA, 20 bp, mouse
gcagctcgtggggagcactg

SEQ ID NO: 566157 - DNA, 20 bp, mouse
gagcctgcggcgcctaggac

SEQ ID NO: 566158 - DNA, 20 bp, mouse
ggctgcccagagcagctcgt

SEQ ID NO: 566159 - DNA, 20 bp, mouse
gctaggacgggaagtaggcg

SEQ ID NO: 566160 - DNA, 20 bp, mouse
gtgaggcccgcggggtgcaa

SEQ ID NO: 566161 - DNA, 20 bp, mouse
gggcgcctaggacgggaagt

SEQ ID NO: 566162 - DNA, 20 bp, mouse
ggctccccacgagctgctct

SEQ ID NO: 566163 - DNA, 20 bp, mouse
gtgaagagcgagggtgaggg

SEQ ID NO: 566164 - DNA, 20 bp, mouse
gctggcaggtgaggcccgcg

SEQ ID NO: 566165 - DNA, 20 bp, mouse
ggcaaggcgtcggaaactaa

SEQ ID NO: 566166 - DNA, 20 bp, mouse
ggagaggtaggcacccatgg

SEQ ID NO: 566167 - DNA, 20 bp, mouse
gcgcgaggccggctaggagg

SEQ ID NO: 566168 - DNA, 20 bp, mouse
gccggagccggggcccctgg

SEQ ID NO: 566169 - DNA, 20 bp, mouse
gcgcagtcgacgcaaggtgc

SEQ ID NO: 566170 - DNA, 20 bp, mouse
gggctggcgcgtctccatgg

SEQ ID NO: 566171 - DNA, 20 bp, mouse
gtgagagaggtaggcaccca

SEQ ID NO: 566172 - DNA, 20 bp, mouse
gtaggaggcggtaacgggac

SEQ ID NO: 566173 - DNA, 20 bp, mouse
gaggcgcgaggccggctagg

SEQ ID NO: 566174 - DNA, 20 bp, mouse
gggcggtaacgggacaggag

SEQ ID NO: 566175 - DNA, 20 bp, mouse
gcaccgtgttgggctgagag

SEQ ID NO: 566176 - DNA, 20 bp, mouse
ggcaggagcggcgggtccgt

SEQ ID NO: 566177 - DNA, 20 bp, mouse
ggcgccgagcggagcccacc

SEQ ID NO: 566178 - DNA, 20 bp, mouse
ggtgtcgccgagagaggtgg

SEQ ID NO: 566179 - DNA, 20 bp, mouse
gagcccacccggcgagccca

SEQ ID NO: 566180 - DNA, 20 bp, mouse
ggactccacggccgtagccg

SEQ ID NO: 566181 - DNA, 20 bp, mouse
ggaagtgtcgccgagagagg

SEQ ID NO: 566182 - DNA, 20 bp, mouse
ggtccgtgggctcgccgggt

SEQ ID NO: 566183 - DNA, 20 bp, mouse
gcagggagcacaggaggccg

SEQ ID NO: 566184 - DNA, 20 bp, mouse
gctcggcgcaagcaggaacc

SEQ ID NO: 566185 - DNA, 20 bp, mouse
ggctcctgctgccgcggcta

SEQ ID NO: 566186 - DNA, 20 bp, mouse
ggagctcaccaggtgcgcca

SEQ ID NO: 566187 - DNA, 20 bp, mouse
gcgcacctggtgagctcggg

SEQ ID NO: 566188 - DNA, 20 bp, mouse
gggaggcagcatgctaaacc

SEQ ID NO: 566189 - DNA, 20 bp, mouse
gggcgcgccccagaagaccg

SEQ ID NO: 566190 - DNA, 20 bp, mouse
ggaggcgctgaggtagcgtt

SEQ ID NO: 566191 - DNA, 20 bp, mouse
ggtagcgttgggcagatctg

SEQ ID NO: 566192 - DNA, 20 bp, mouse
gtagtctccgcggtcttctg

SEQ ID NO: 566193 - DNA, 20 bp, mouse
gcggcatagcctgtgctcca

SEQ ID NO: 566194 - DNA, 20 bp, mouse
gagtgccacccgagctcacc

SEQ ID NO: 566195 - DNA, 20 bp, mouse
ggcttctcccgggaactctt

SEQ ID NO: 566196 - DNA, 20 bp, mouse
gccaggagtggaagagactg

SEQ ID NO: 566197 - DNA, 20 bp, mouse
gtggccaaatggagacccgg

SEQ ID NO: 566198 - DNA, 20 bp, mouse
gttccgagaatttccaggag

SEQ ID NO: 566199 - DNA, 20 bp, mouse
gagctggccaaatggagacc

SEQ ID NO: 566200 - DNA, 20 bp, mouse
gtctccagaacaagcaatta

SEQ ID NO: 566201 - DNA, 20 bp, mouse
gttccactcctggaaattct

SEQ ID NO: 566202 - DNA, 20 bp, mouse
gctctcgcctaggcccacgg

SEQ ID NO: 566203 - DNA, 20 bp, mouse
gactcctccgggtctccatt

SEQ ID NO: 566204 - DNA, 20 bp, mouse
gtaggctcttaccttgtgat

SEQ ID NO: 566205 - DNA, 20 bp, mouse
gctcttaccttgtgatgggt

SEQ ID NO: 566206 - DNA, 20 bp, mouse
ggcagggcgcaagagcccgg

SEQ ID NO: 566207 - DNA, 20 bp, mouse
gcggcaggtgaggaagcgca

SEQ ID NO: 566208 - DNA, 20 bp, mouse
gctgggaaacgcagcacgat

SEQ ID NO: 566209 - DNA, 20 bp, mouse
gcgggagcgatcggcaggtg

SEQ ID NO: 566210 - DNA, 20 bp, mouse
gacgatgggtgcggagccgc

SEQ ID NO: 566211 - DNA, 20 bp, mouse
gcgcctgcagcggcgatcga

SEQ ID NO: 566212 - DNA, 20 bp, mouse
gcgcaagagcccggcggcga

SEQ ID NO: 566213 - DNA, 20 bp, mouse
ggaggcagcccgggccgaca

SEQ ID NO: 566214 - DNA, 20 bp, mouse
gaaacgcagcacgatgggtg

SEQ ID NO: 566215 - DNA, 20 bp, mouse
gagcgcagggcgcaagagcc

SEQ ID NO: 566216 - DNA, 20 bp, mouse
gtggaagtggacccccgggt

SEQ ID NO: 566217 - DNA, 20 bp, mouse
gtggacccccgggtaggaag

SEQ ID NO: 566218 - DNA, 20 bp, mouse
gaagcggcgccggaaccagc

SEQ ID NO: 566219 - DNA, 20 bp, mouse
gcgcgcacggcgggacacca

SEQ ID NO: 566220 - DNA, 20 bp, mouse
gcggcgccggaaccagccgg

SEQ ID NO: 566221 - DNA, 20 bp, mouse
ggccggcggacattgcgtgg

SEQ ID NO: 566222 - DNA, 20 bp, mouse
ggacattgcgtggcggccgg

SEQ ID NO: 566223 - DNA, 20 bp, mouse
gggcgccgcttcctacccgg

SEQ ID NO: 566224 - DNA, 20 bp, mouse
gccagccggcggacattgcg

SEQ ID NO: 566225 - DNA, 20 bp, mouse
ggccgccacgcaatgtccgc

SEQ ID NO: 566226 - DNA, 20 bp, mouse
gctgctggagcgactcggat

SEQ ID NO: 566227 - DNA, 20 bp, mouse
ggacaaaggccgccatcctc

SEQ ID NO: 566228 - DNA, 20 bp, mouse
gcgctccagcaggcggacaa

SEQ ID NO: 566229 - DNA, 20 bp, mouse
ggggaaggcggggacaatga

SEQ ID NO: 566230 - DNA, 20 bp, mouse
gtccgcctgctggagcgact

SEQ ID NO: 566231 - DNA, 20 bp, mouse
gtgatctcctggccggagga

SEQ ID NO: 566232 - DNA, 20 bp, mouse
gcgtgcgcgccagccctgaa

SEQ ID NO: 566233 - DNA, 20 bp, mouse
gcagcaggtggtggagcaag

SEQ ID NO: 566234 - DNA, 20 bp, mouse
gcccgggctgccatcaggat

SEQ ID NO: 566235 - DNA, 20 bp, mouse
gccgaagcgcaggccggatg

SEQ ID NO: 566236 - DNA, 20 bp, mouse
gcccgctgccgggtagagga

SEQ ID NO: 566237 - DNA, 20 bp, mouse
gtagaggagggcgagaaggt

SEQ ID NO: 566238 - DNA, 20 bp, mouse
gtcagagcggagccaagatg

SEQ ID NO: 566239 - DNA, 20 bp, mouse
gggcgactgggcgtcgttag

SEQ ID NO: 566240 - DNA, 20 bp, mouse
gggccgcacgtcgacaacag

SEQ ID NO: 566241 - DNA, 20 bp, mouse
ggcagcgggggcagtcagag

SEQ ID NO: 566242 - DNA, 20 bp, mouse
gaggagggcgagaaggtagg

SEQ ID NO: 566243 - DNA, 20 bp, mouse
gttgctgtccaaaggcgact

SEQ ID NO: 566244 - DNA, 20 bp, mouse
gtactgagccagtgggcggt

SEQ ID NO: 566245 - DNA, 20 bp, mouse
gaagggccgacatcaaaggg

SEQ ID NO: 566246 - DNA, 20 bp, mouse
gcccagcacaaacccttcgg

SEQ ID NO: 566247 - DNA, 20 bp, mouse
gctccccagcacaaaccctt

SEQ ID NO: 566248 - DNA, 20 bp, mouse
gtgtgctggggagatagcgt

SEQ ID NO: 566249 - DNA, 20 bp, mouse
ggggtgagcaggttcaagtc

SEQ ID NO: 566250 - DNA, 20 bp, mouse
gtagaattctggcctccgaa

SEQ ID NO: 566251 - DNA, 20 bp, mouse
gtacttggcggaggtatcag

SEQ ID NO: 566252 - DNA, 20 bp, mouse
gagggcgcgcgtgtacgtgc

SEQ ID NO: 566253 - DNA, 20 bp, mouse
ggagggaccctaaaagttag

SEQ ID NO: 566254 - DNA, 20 bp, mouse
ggagataccccaggagaacg

SEQ ID NO: 566255 - DNA, 20 bp, mouse
gcgggttccccctatctcgt

SEQ ID NO: 566256 - DNA, 20 bp, mouse
gccggaaggaggctgtaaga

SEQ ID NO: 566257 - DNA, 20 bp, mouse
gcggagctggtgggccggag

SEQ ID NO: 566258 - DNA, 20 bp, mouse
gagctggtgggccggagcgg

SEQ ID NO: 566259 - DNA, 20 bp, mouse
gttctcgctgtcggacatgg

SEQ ID NO: 566260 - DNA, 20 bp, mouse
ggaggctgtaagagggcggg

SEQ ID NO: 566261 - DNA, 20 bp, mouse
gagcttctcgctgtcggaca

SEQ ID NO: 566262 - DNA, 20 bp, mouse
ggcaggagagggcccggagc

SEQ ID NO: 566263 - DNA, 20 bp, mouse
gcgggcgcctgctggaaggt

SEQ ID NO: 566264 - DNA, 20 bp, mouse
ggaaggagagccaggccgga

SEQ ID NO: 566265 - DNA, 20 bp, mouse
gtccagcaggcgcccgatga

SEQ ID NO: 566266 - DNA, 20 bp, mouse
gaagcaggcccccaggaacc

SEQ ID NO: 566267 - DNA, 20 bp, mouse
gaccgggccgcgtcaggaac

SEQ ID NO: 566268 - DNA, 20 bp, mouse
ggaaacgccgcgtgactcgt

SEQ ID NO: 566269 - DNA, 20 bp, mouse
gtctggtgccgacaagatgg

SEQ ID NO: 566270 - DNA, 20 bp, mouse
gcgctttagggaggagagtc

SEQ ID NO: 566271 - DNA, 20 bp, mouse
ggagctgggcggtgccgagg

SEQ ID NO: 566272 - DNA, 20 bp, mouse
gtggcggctggggtctgacg

SEQ ID NO: 566273 - DNA, 20 bp, mouse
ggagctgaggtcggagagga

SEQ ID NO: 566274 - DNA, 20 bp, mouse
ggacgcggcccggttcctgg

SEQ ID NO: 566275 - DNA, 20 bp, mouse
ggagtctggtgccgacaaga

SEQ ID NO: 566276 - DNA, 20 bp, mouse
gttcttctcgtggttcccag

SEQ ID NO: 566277 - DNA, 20 bp, mouse
gtcctcaggccagcctcggg

SEQ ID NO: 566278 - DNA, 20 bp, mouse
gcgaggctggcctgaggagt

SEQ ID NO: 566279 - DNA, 20 bp, mouse
gagatggccgccgactcctc

SEQ ID NO: 566280 - DNA, 20 bp, mouse
gtccgtgcgccgcccgaggc

SEQ ID NO: 566281 - DNA, 20 bp, mouse
gggccatcttgttcttctcg

SEQ ID NO: 566282 - DNA, 20 bp, mouse
ggggatcaggcccagtggag

SEQ ID NO: 566283 - DNA, 20 bp, mouse
ggcgcgccccagatccaaag

SEQ ID NO: 566284 - DNA, 20 bp, mouse
gcgcatccgtgcgccgcccg

SEQ ID NO: 566285 - DNA, 20 bp, mouse
gtgcgcgcgcgggagtgcag

SEQ ID NO: 566286 - DNA, 20 bp, mouse
gggtgctccgtcgctttgga

SEQ ID NO: 566287 - DNA, 20 bp, mouse
gttcgtttagaggtaagttt

SEQ ID NO: 566288 - DNA, 20 bp, mouse
gcgttcccccggcccgctct

SEQ ID NO: 566289 - DNA, 20 bp, mouse
gcctctcaggatcctttcaa

SEQ ID NO: 566290 - DNA, 20 bp, mouse
gctctaaacgaaccccagaa

SEQ ID NO: 566291 - DNA, 20 bp, mouse
gcggctgctcacatgtctaa

SEQ ID NO: 566292 - DNA, 20 bp, mouse
gtaaacgaaccccagaatgg

SEQ ID NO: 566293 - DNA, 20 bp, mouse
ggacggaagaggggaaccga

SEQ ID NO: 566294 - DNA, 20 bp, mouse
ggccgcattagggaaaaacg

SEQ ID NO: 566295 - DNA, 20 bp, mouse
gctgctcacatgtctaaggg

SEQ ID NO: 566296 - DNA, 20 bp, mouse
gaatctcccctactcctcca

SEQ ID NO: 566297 - DNA, 20 bp, mouse
ggccggaagtggggttggac

SEQ ID NO: 566298 - DNA, 20 bp, mouse
gggtacaagactcggagtag

SEQ ID NO: 566299 - DNA, 20 bp, mouse
gagagaaccggtacaagact

SEQ ID NO: 566300 - DNA, 20 bp, mouse
gaagactcggagtagaggcc

SEQ ID NO: 566301 - DNA, 20 bp, mouse
gttggacaggttttccccag

SEQ ID NO: 566302 - DNA, 20 bp, mouse
gcgtcacaaccggaagtgaa

SEQ ID NO: 566303 - DNA, 20 bp, mouse
gacaggttttccccaggggt

SEQ ID NO: 566304 - DNA, 20 bp, mouse
ggtaaccgttgtctcagtga

SEQ ID NO: 566305 - DNA, 20 bp, mouse
gacaacggttactgagacaa

SEQ ID NO: 566306 - DNA, 20 bp, mouse
ggtctcgagcgtctcctccc

SEQ ID NO: 566307 - DNA, 20 bp, mouse
ggcggagccgcgagccgggg

SEQ ID NO: 566308 - DNA, 20 bp, mouse
gagtatcccacagagcactg

SEQ ID NO: 566309 - DNA, 20 bp, mouse
ggctcgccccagtgctctgt

SEQ ID NO: 566310 - DNA, 20 bp, mouse
gtcttctggcgcttcaccac

SEQ ID NO: 566311 - DNA, 20 bp, mouse
gagcagctgaagcgctggat

SEQ ID NO: 566312 - DNA, 20 bp, mouse
ggcggagcggagccgcgagc

SEQ ID NO: 566313 - DNA, 20 bp, mouse
gggcggctcgaggtccgtct

SEQ ID NO: 566314 - DNA, 20 bp, mouse
ggcgtctcctccccggctcg

SEQ ID NO: 566315 - DNA, 20 bp, mouse
gcgctggatcggctccgaga

SEQ ID NO: 566316 - DNA, 20 bp, mouse
gggcttcagccagggaatga

SEQ ID NO: 566317 - DNA, 20 bp, mouse
ggcgggaggagtaaagatgg

SEQ ID NO: 566318 - DNA, 20 bp, mouse
gcctcggagggcttcagcca

SEQ ID NO: 566319 - DNA, 20 bp, mouse
gcactgccgcctccctcgga

SEQ ID NO: 566320 - DNA, 20 bp, mouse
gggcctccgccttcattccc

SEQ ID NO: 566321 - DNA, 20 bp, mouse
gctagcgggaggagtaaaga

SEQ ID NO: 566322 - DNA, 20 bp, mouse
gtgaagctaagggagcatgt

SEQ ID NO: 566323 - DNA, 20 bp, mouse
gtgaagccctccgagggagg

SEQ ID NO: 566324 - DNA, 20 bp, mouse
gatgtgggcggtgctactag

SEQ ID NO: 566325 - DNA, 20 bp, mouse
gagccagggaatgaaggcgg

SEQ ID NO: 566326 - DNA, 20 bp, mouse
gcaggccgccaggaactcag

SEQ ID NO: 566327 - DNA, 20 bp, mouse
gatgtccggcgaggatggtc

SEQ ID NO: 566328 - DNA, 20 bp, mouse
gcgctcgctcgcttagtagg

SEQ ID NO: 566329 - DNA, 20 bp, mouse
ggctcgctcgctcgcttagt

SEQ ID NO: 566330 - DNA, 20 bp, mouse
ggagcggccggcgcgatgtc

SEQ ID NO: 566331 - DNA, 20 bp, mouse
ggagcagctgcggcagtggg

SEQ ID NO: 566332 - DNA, 20 bp, mouse
gcgcttagtaggcgggcgag

SEQ ID NO: 566333 - DNA, 20 bp, mouse
gggctgggcgagcttctggg

SEQ ID NO: 566334 - DNA, 20 bp, mouse
ggtggagtcgagcacggcac

SEQ ID NO: 566335 - DNA, 20 bp, mouse
gtgcggccgcccgtgagcgg

SEQ ID NO: 566336 - DNA, 20 bp, mouse
gggtggcggcggctgaggga

SEQ ID NO: 566337 - DNA, 20 bp, mouse
gcggctgagggacggcgacg

SEQ ID NO: 566338 - DNA, 20 bp, mouse
gaggcggccggcttcggcag

SEQ ID NO: 566339 - DNA, 20 bp, mouse
gcctgcggggtgagccgagt

SEQ ID NO: 566340 - DNA, 20 bp, mouse
gggcgcgacaggacgagcga

SEQ ID NO: 566341 - DNA, 20 bp, mouse
gggcggaaggcggccggctt

SEQ ID NO: 566342 - DNA, 20 bp, mouse
gcgggcgagagagcgagcgt

SEQ ID NO: 566343 - DNA, 20 bp, mouse
ggcagggcgagcgagcgcag

SEQ ID NO: 566344 - DNA, 20 bp, mouse
ggcacccaccggcatcatcg

SEQ ID NO: 566345 - DNA, 20 bp, mouse
ggacggcgacgcggcacgcg

SEQ ID NO: 566346 - DNA, 20 bp, mouse
gagcccgaggaaaagccccc

SEQ ID NO: 566347 - DNA, 20 bp, mouse
gcacgcgtcggggcagatcc

SEQ ID NO: 566348 - DNA, 20 bp, mouse
gccctggaaagaaggaactg

SEQ ID NO: 566349 - DNA, 20 bp, mouse
gctccagcggcggggagcgg

SEQ ID NO: 566350 - DNA, 20 bp, mouse
ggggcagatcctggcaccgg

SEQ ID NO: 566351 - DNA, 20 bp, mouse
ggtggctggaccctgggtgg

SEQ ID NO: 566352 - DNA, 20 bp, mouse
ggggtggaactcacgcgtcg

SEQ ID NO: 566353 - DNA, 20 bp, mouse
ggcggcggggagcggaggac

SEQ ID NO: 566354 - DNA, 20 bp, mouse
gggctccggctccagcggcg

SEQ ID NO: 566355 - DNA, 20 bp, mouse
gctggggtgccgactttact

SEQ ID NO: 566356 - DNA, 20 bp, mouse
gcagtgactcgcctaggcca

SEQ ID NO: 566357 - DNA, 20 bp, mouse
ggagtctgcagagtcatggg

SEQ ID NO: 566358 - DNA, 20 bp, mouse
ggaggagtctgcagagtcat

SEQ ID NO: 566359 - DNA, 20 bp, mouse
ggggaagcgggaaactgagg

SEQ ID NO: 566360 - DNA, 20 bp, mouse
gacggttccgaggcaggtag

SEQ ID NO: 566361 - DNA, 20 bp, mouse
gccgcggcccaagtaaacag

SEQ ID NO: 566362 - DNA, 20 bp, mouse
gcggagcttctgaagtctag

SEQ ID NO: 566363 - DNA, 20 bp, mouse
gcagagcctggcttgaaacg

SEQ ID NO: 566364 - DNA, 20 bp, mouse
gaaggggcagtgactcgcct

SEQ ID NO: 566365 - DNA, 20 bp, mouse
gaaaagctaggtaagaattc

SEQ ID NO: 566366 - DNA, 20 bp, mouse
ggaggcagggcgcaaagtag

SEQ ID NO: 566367 - DNA, 20 bp, mouse
gcggtacgatggctgcgcag

SEQ ID NO: 566368 - DNA, 20 bp, mouse
ggcagcgggtgacggtacga

SEQ ID NO: 566369 - DNA, 20 bp, mouse
ggcttggaggagctgtaccg

SEQ ID NO: 566370 - DNA, 20 bp, mouse
gcgatggctgcgcagcggct

SEQ ID NO: 566371 - DNA, 20 bp, mouse
ggggcgcaaagtaggggcag

SEQ ID NO: 566372 - DNA, 20 bp, mouse
gaagtaggggcagcgggtga

SEQ ID NO: 566373 - DNA, 20 bp, mouse
ggcggcagggtgagactcag

SEQ ID NO: 566374 - DNA, 20 bp, mouse
gccccagcgggctgcagaag

SEQ ID NO: 566375 - DNA, 20 bp, mouse
ggatcccggagcgcgaggca

SEQ ID NO: 566376 - DNA, 20 bp, mouse
gggcggccgcgggggacaaa

SEQ ID NO: 566377 - DNA, 20 bp, mouse
gacagagaaagcggcagcgg

SEQ ID NO: 566378 - DNA, 20 bp, mouse
gtgcagcatgcggagccccc

SEQ ID NO: 566379 - DNA, 20 bp, mouse
ggcccgccctttgtcccccg

SEQ ID NO: 566380 - DNA, 20 bp, mouse
gctggagacagaccgactta

SEQ ID NO: 566381 - DNA, 20 bp, mouse
ggctaaccggagccagcggc

SEQ ID NO: 566382 - DNA, 20 bp, mouse
gggtctgtctccagagtcaa

SEQ ID NO: 566383 - DNA, 20 bp, mouse
gcatgcggagcccccgggct

SEQ ID NO: 566384 - DNA, 20 bp, mouse
ggcagagctcccattgactc

SEQ ID NO: 566385 - DNA, 20 bp, mouse
gttaagggggtgtggtcggg

SEQ ID NO: 566386 - DNA, 20 bp, mouse
gccgcaaggatccagcgtct

SEQ ID NO: 566387 - DNA, 20 bp, mouse
ggtccccgcggtggaaccgg

SEQ ID NO: 566388 - DNA, 20 bp, mouse
gaggtgcgggccaccgtatg

SEQ ID NO: 566389 - DNA, 20 bp, mouse
gttcccgggtgggcacagag

SEQ ID NO: 566390 - DNA, 20 bp, mouse
gccagcgacagggcctcgag

SEQ ID NO: 566391 - DNA, 20 bp, mouse
gagactggcgtggatcgtct

SEQ ID NO: 566392 - DNA, 20 bp, mouse
gggctcctcaagggaggact

SEQ ID NO: 566393 - DNA, 20 bp, mouse
ggggtggggccgaaggagag

SEQ ID NO: 566394 - DNA, 20 bp, mouse
gcgaggggctgtgtagtcca

SEQ ID NO: 566395 - DNA, 20 bp, mouse
gccggctaggaagtcgtccg

SEQ ID NO: 566396 - DNA, 20 bp, mouse
gccagggctgggagatgtac

SEQ ID NO: 566397 - DNA, 20 bp, mouse
ggccgccctggaagtctctg

SEQ ID NO: 566398 - DNA, 20 bp, mouse
ggtctaggcaagagaataga

SEQ ID NO: 566399 - DNA, 20 bp, mouse
gatcagactgtgcaaggtgc

SEQ ID NO: 566400 - DNA, 20 bp, mouse
gccaggtgggtagcttgagg

SEQ ID NO: 566401 - DNA, 20 bp, mouse
gtggctggagatggagcagt

SEQ ID NO: 566402 - DNA, 20 bp, mouse
ggtctgggttgtctgtgcca

SEQ ID NO: 566403 - DNA, 20 bp, mouse
gcggagacccagccggctga

SEQ ID NO: 566404 - DNA, 20 bp, mouse
gtccaggaactcttccaggt

SEQ ID NO: 566405 - DNA, 20 bp, mouse
ggagcagtgggtagatgctc

SEQ ID NO: 566406 - DNA, 20 bp, mouse
gcggccggcaaagggatgcg

SEQ ID NO: 566407 - DNA, 20 bp, mouse
gtagcaaaggctgtcccggc

SEQ ID NO: 566408 - DNA, 20 bp, mouse
ggggctgcacgtcaccccgg

SEQ ID NO: 566409 - DNA, 20 bp, mouse
ggctgtagcaaaggctgtcc

SEQ ID NO: 566410 - DNA, 20 bp, mouse
ggcagcccgccggtgagtgg

SEQ ID NO: 566411 - DNA, 20 bp, mouse
gaaagccgcgtggacgatgt

SEQ ID NO: 566412 - DNA, 20 bp, mouse
gaggaggttaccagagacag

SEQ ID NO: 566413 - DNA, 20 bp, mouse
gacagagtcaagcagcccag

SEQ ID NO: 566414 - DNA, 20 bp, mouse
gaggctgtcccggccggcaa

SEQ ID NO: 566415 - DNA, 20 bp, mouse
gccagagagtcctccctcaa

SEQ ID NO: 566416 - DNA, 20 bp, mouse
ggaggaggcccagagagcgg

SEQ ID NO: 566417 - DNA, 20 bp, mouse
ggtggctgggtggcaggcga

SEQ ID NO: 566418 - DNA, 20 bp, mouse
gcgaaacgccaaggcggaaa

SEQ ID NO: 566419 - DNA, 20 bp, mouse
ggaggcgcgaaacgccaagg

SEQ ID NO: 566420 - DNA, 20 bp, mouse
gaacgccaaggcggaaaggg

SEQ ID NO: 566421 - DNA, 20 bp, mouse
gacggaggcgcgaaacgcca

SEQ ID NO: 566422 - DNA, 20 bp, mouse
gcaaggcggaaagggtggct

SEQ ID NO: 566423 - DNA, 20 bp, mouse
gcgagggagggtcttctcta

SEQ ID NO: 566424 - DNA, 20 bp, mouse
gcggaagctgcagggcgaga

SEQ ID NO: 566425 - DNA, 20 bp, mouse
ggggcgagacggaggaccga

SEQ ID NO: 566426 - DNA, 20 bp, mouse
gcagcgccgggctccagggt

SEQ ID NO: 566427 - DNA, 20 bp, mouse
ggcgttgccatggcgaggat

SEQ ID NO: 566428 - DNA, 20 bp, mouse
gaacccggcccggccgaccc

SEQ ID NO: 566429 - DNA, 20 bp, mouse
gccgggccgggttcagggag

SEQ ID NO: 566430 - DNA, 20 bp, mouse
gcaccgggccgcagaagaac

SEQ ID NO: 566431 - DNA, 20 bp, mouse
gcaatggagcgggtcgtgag

SEQ ID NO: 566432 - DNA, 20 bp, mouse
gttctcacctggaacctccc

SEQ ID NO: 566433 - DNA, 20 bp, mouse
gcccggccgaccctggagcc

SEQ ID NO: 566434 - DNA, 20 bp, mouse
gcctggccgctccctgaacc

SEQ ID NO: 566435 - DNA, 20 bp, mouse
ggtcggccgggccgggttca

SEQ ID NO: 566436 - DNA, 20 bp, mouse
gctgcagtcgttccccaggt

SEQ ID NO: 566437 - DNA, 20 bp, mouse
gcaccctgaccccaagaggg

SEQ ID NO: 566438 - DNA, 20 bp, mouse
gaggacaagcctgaagggtg

SEQ ID NO: 566439 - DNA, 20 bp, mouse
gtggcagagatgcccatggt

SEQ ID NO: 566440 - DNA, 20 bp, mouse
ggctggacgggcacccttgg

SEQ ID NO: 566441 - DNA, 20 bp, mouse
gagaaaggtgatgcccccaa

SEQ ID NO: 566442 - DNA, 20 bp, mouse
gatgcctgcagtcgttcccc

SEQ ID NO: 566443 - DNA, 20 bp, mouse
gtgaggtgtctgtcctacct

SEQ ID NO: 566444 - DNA, 20 bp, mouse
gtgaccccaagagggaggcg

SEQ ID NO: 566445 - DNA, 20 bp, mouse
gcctgccagctgaacacttg

SEQ ID NO: 566446 - DNA, 20 bp, mouse
ggtcgccgcaccaccagctg

SEQ ID NO: 566447 - DNA, 20 bp, mouse
gctctctcgagccctacccc

SEQ ID NO: 566448 - DNA, 20 bp, mouse
gtctcgagccctaccccggg

SEQ ID NO: 566449 - DNA, 20 bp, mouse
ggtcccagagccgcagctgg

SEQ ID NO: 566450 - DNA, 20 bp, mouse
gggacctgcggatcgagccg

SEQ ID NO: 566451 - DNA, 20 bp, mouse
gagagagcgggtgagttgag

SEQ ID NO: 566452 - DNA, 20 bp, mouse
gggatccgcagagtgcagag

SEQ ID NO: 566453 - DNA, 20 bp, mouse
gcgacagagccagctcggct

SEQ ID NO: 566454 - DNA, 20 bp, mouse
gggccggagccgcccggggt

SEQ ID NO: 566455 - DNA, 20 bp, mouse
gcctccagtacagacagggg

SEQ ID NO: 566456 - DNA, 20 bp, mouse
gcgttgagccgagaaggtaa

SEQ ID NO: 566457 - DNA, 20 bp, mouse
ggccgagtagagccccagcg

SEQ ID NO: 566458 - DNA, 20 bp, mouse
gtgcaggcgttgagccgaga

SEQ ID NO: 566459 - DNA, 20 bp, mouse
gaccgcgctggggctctact

SEQ ID NO: 566460 - DNA, 20 bp, mouse
ggataagaggagctggagta

SEQ ID NO: 566461 - DNA, 20 bp, mouse
gcccggggcgaacaaagtca

SEQ ID NO: 566462 - DNA, 20 bp, mouse
ggctcaacgcctgcactgat

SEQ ID NO: 566463 - DNA, 20 bp, mouse
gagttcttctcaccgcgctg

SEQ ID NO: 566464 - DNA, 20 bp, mouse
ggggctctactcggctgcac

SEQ ID NO: 566465 - DNA, 20 bp, mouse
gagtaagatgtgaggatgta

SEQ ID NO: 566466 - DNA, 20 bp, mouse
ggagaccgggaaacaggcaa

SEQ ID NO: 566467 - DNA, 20 bp, mouse
gtgtagagggcagaggtcca

SEQ ID NO: 566468 - DNA, 20 bp, mouse
gcagaggtccagggtagaag

SEQ ID NO: 566469 - DNA, 20 bp, mouse
gaggtgaggacagatgtaga

SEQ ID NO: 566470 - DNA, 20 bp, mouse
ggggccgagcgcagccggga

SEQ ID NO: 566471 - DNA, 20 bp, mouse
gaggcagccgggagctgcgg

SEQ ID NO: 566472 - DNA, 20 bp, mouse
gggaggccggcgagattgta

SEQ ID NO: 566473 - DNA, 20 bp, mouse
gcgccggcgcctcttcgcac

SEQ ID NO: 566474 - DNA, 20 bp, mouse
ggcgggggccccgtgcgaag

SEQ ID NO: 566475 - DNA, 20 bp, mouse
gaggcgaagggagatccgga

SEQ ID NO: 566476 - DNA, 20 bp, mouse
gggccggagcgcaacagaga

SEQ ID NO: 566477 - DNA, 20 bp, mouse
ggaggcggcggagcaggtac

SEQ ID NO: 566478 - DNA, 20 bp, mouse
gatggctcccggtcaggcag

SEQ ID NO: 566479 - DNA, 20 bp, mouse
ggagctgcaagccgagcgcc

SEQ ID NO: 566480 - DNA, 20 bp, mouse
gagcaggtacaggcagggcg

SEQ ID NO: 566481 - DNA, 20 bp, mouse
gtcaggcagcggcggacctc

SEQ ID NO: 566482 - DNA, 20 bp, mouse
ggagcctcacctggacccgg

SEQ ID NO: 566483 - DNA, 20 bp, mouse
gcctcacctggacccggagg

SEQ ID NO: 566484 - DNA, 20 bp, mouse
gggctccatggctcccggtc

SEQ ID NO: 566485 - DNA, 20 bp, mouse
gcaggactcggcgaaggact

SEQ ID NO: 566486 - DNA, 20 bp, mouse
gtagcggcagaggcgcggag

SEQ ID NO: 566487 - DNA, 20 bp, mouse
ggtgcagccagtagcggcag

SEQ ID NO: 566488 - DNA, 20 bp, mouse
ggccagtagcggcagaggcg

SEQ ID NO: 566489 - DNA, 20 bp, mouse
gcccagggttgggacctgtg

SEQ ID NO: 566490 - DNA, 20 bp, mouse
ggctactggctgcaccccac

SEQ ID NO: 566491 - DNA, 20 bp, mouse
gggtcgggaggactgaacag

SEQ ID NO: 566492 - DNA, 20 bp, mouse
ggccccgcgccccaaaccgg

SEQ ID NO: 566493 - DNA, 20 bp, mouse
ggctggtagagcaaggccga

SEQ ID NO: 566494 - DNA, 20 bp, mouse
gacgcctgggcgccagtccc

SEQ ID NO: 566495 - DNA, 20 bp, mouse
gctgccggcctgagctatct

SEQ ID NO: 566496 - DNA, 20 bp, mouse
gcgggcaagccaggcatcac

SEQ ID NO: 566497 - DNA, 20 bp, mouse
gctctcaacacaacacggaa

SEQ ID NO: 566498 - DNA, 20 bp, mouse
gggatcctctcaacacaaca

SEQ ID NO: 566499 - DNA, 20 bp, mouse
gctatccggagtgtctccag

SEQ ID NO: 566500 - DNA, 20 bp, mouse
gtgatgagaccaagacagag

SEQ ID NO: 566501 - DNA, 20 bp, mouse
gagggtggggagctattcct

SEQ ID NO: 566502 - DNA, 20 bp, mouse
gttgagaggatccaaaagat

SEQ ID NO: 566503 - DNA, 20 bp, mouse
gtgagcaagtgaagatgtcg

SEQ ID NO: 566504 - DNA, 20 bp, mouse
gtcaacacaacacggaaagg

SEQ ID NO: 566505 - DNA, 20 bp, mouse
gggtgcctctggagacactc

SEQ ID NO: 566506 - DNA, 20 bp, mouse
gctaggcgggcctcctccgc

SEQ ID NO: 566507 - DNA, 20 bp, mouse
gtatcgcgagagggagggcc

SEQ ID NO: 566508 - DNA, 20 bp, mouse
gggccgccggtcctccggga

SEQ ID NO: 566509 - DNA, 20 bp, mouse
gggagggccgggcttggctt

SEQ ID NO: 566510 - DNA, 20 bp, mouse
gcggatgccgaagccaagcc

SEQ ID NO: 566511 - DNA, 20 bp, mouse
gcctcgccttcccggaggac

SEQ ID NO: 566512 - DNA, 20 bp, mouse
gcgagagggagggccgggct

SEQ ID NO: 566513 - DNA, 20 bp, mouse
gggctgaggccggcttcccg

SEQ ID NO: 566514 - DNA, 20 bp, mouse
gcctccctctcgcgatatct

SEQ ID NO: 566515 - DNA, 20 bp, mouse
gcccgcggccgccggtcctc

SEQ ID NO: 566516 - DNA, 20 bp, mouse
gcccgggaggagcaagtgtg

SEQ ID NO: 566517 - DNA, 20 bp, mouse
ggcggcggtgctgcagaagc

SEQ ID NO: 566518 - DNA, 20 bp, mouse
gtccatggagctgcaggtgg

SEQ ID NO: 566519 - DNA, 20 bp, mouse
gactcgaaggtacccatcgt

SEQ ID NO: 566520 - DNA, 20 bp, mouse
gctggctcaggagtactcga

SEQ ID NO: 566521 - DNA, 20 bp, mouse
gcacttgctcctcccgggca

SEQ ID NO: 566522 - DNA, 20 bp, mouse
gcctggaaacccggaagtgg

SEQ ID NO: 566523 - DNA, 20 bp, mouse
gccgcctggaaacccggaag

SEQ ID NO: 566524 - DNA, 20 bp, mouse
gtaatggtggaagcaggagg

SEQ ID NO: 566525 - DNA, 20 bp, mouse
ggcaggtggaggcatcgtaa

SEQ ID NO: 566526 - DNA, 20 bp, mouse
gctctcccgccacctacccg

SEQ ID NO: 566527 - DNA, 20 bp, mouse
gggtcgccgccgccgcgggt

SEQ ID NO: 566528 - DNA, 20 bp, mouse
gtcccgccacctacccgcgg

SEQ ID NO: 566529 - DNA, 20 bp, mouse
gcgccgccgcgggtaggtgg

SEQ ID NO: 566530 - DNA, 20 bp, mouse
gcgccgccgccgcgggtagg

SEQ ID NO: 566531 - DNA, 20 bp, mouse
gcgggcgcccgaccgaggga

SEQ ID NO: 566532 - DNA, 20 bp, mouse
gcccatgatgcccagccacc

SEQ ID NO: 566533 - DNA, 20 bp, mouse
ggagagcgtgcgcagcccag

SEQ ID NO: 566534 - DNA, 20 bp, mouse
gtggcgggagagacggcccg

SEQ ID NO: 566535 - DNA, 20 bp, mouse
gtggcacggccgagttccgg

SEQ ID NO: 566536 - DNA, 20 bp, mouse
gtgaggtgggctatctctgt

SEQ ID NO: 566537 - DNA, 20 bp, mouse
gaggagagcttacacagatc

SEQ ID NO: 566538 - DNA, 20 bp, mouse
gagcttacacagatctggtc

SEQ ID NO: 566539 - DNA, 20 bp, mouse
ggggcatcctgggattgagg

SEQ ID NO: 566540 - DNA, 20 bp, mouse
gaaggcgacctggagcaggt

SEQ ID NO: 566541 - DNA, 20 bp, mouse
ggatagcccacctcaatccc

SEQ ID NO: 566542 - DNA, 20 bp, mouse
gcaggtgggacgctttatcc

SEQ ID NO: 566543 - DNA, 20 bp, mouse
ggagggatggatagtgtcta

SEQ ID NO: 566544 - DNA, 20 bp, mouse
gatgcagagcagccagtcct

SEQ ID NO: 566545 - DNA, 20 bp, mouse
gcccaggatgcccagccgaa

SEQ ID NO: 566546 - DNA, 20 bp, mouse
gcaagctctgaggtcggcag

SEQ ID NO: 566547 - DNA, 20 bp, mouse
gccctctgcagcaagctctg

SEQ ID NO: 566548 - DNA, 20 bp, mouse
gttgctgcagagggtaggtg

SEQ ID NO: 566549 - DNA, 20 bp, mouse
ggaagctggccctcctgagg

SEQ ID NO: 566550 - DNA, 20 bp, mouse
ggcttggccatctccacctc

SEQ ID NO: 566551 - DNA, 20 bp, mouse
ggaggtcagaccagaggact

SEQ ID NO: 566552 - DNA, 20 bp, mouse
gtggccatctccacctcagg

SEQ ID NO: 566553 - DNA, 20 bp, mouse
gacctcagagcttgctgcag

SEQ ID NO: 566554 - DNA, 20 bp, mouse
ggggtggggcctactgtgta

SEQ ID NO: 566555 - DNA, 20 bp, mouse
gtgcagagggtaggtgaggg

SEQ ID NO: 566556 - DNA, 20 bp, mouse
gcggtagtggtagccccgga

SEQ ID NO: 566557 - DNA, 20 bp, mouse
gtagtggtagccccggaggg

SEQ ID NO: 566558 - DNA, 20 bp, mouse
gtccggtgggtaagggctaa

SEQ ID NO: 566559 - DNA, 20 bp, mouse
gggtggccccgggacctcca

SEQ ID NO: 566560 - DNA, 20 bp, mouse
gggctaacggtttccggtag

SEQ ID NO: 566561 - DNA, 20 bp, mouse
ggagccccagagcccgagcc

SEQ ID NO: 566562 - DNA, 20 bp, mouse
gctcggggtttcaggacgcg

SEQ ID NO: 566563 - DNA, 20 bp, mouse
ggggcgtgtcttactccggt

SEQ ID NO: 566564 - DNA, 20 bp, mouse
ggtgcaccggccaccagcag

SEQ ID NO: 566565 - DNA, 20 bp, mouse
ggtcttactccggtgggtaa

SEQ ID NO: 566566 - DNA, 20 bp, mouse
gggcggcgtggcggtatccc

SEQ ID NO: 566567 - DNA, 20 bp, mouse
gggactctatagggaggcca

SEQ ID NO: 566568 - DNA, 20 bp, mouse
ggcccagtagggactctata

SEQ ID NO: 566569 - DNA, 20 bp, mouse
gcatcacacccgcgtcacct

SEQ ID NO: 566570 - DNA, 20 bp, mouse
gtctcctggagtaaaactct

SEQ ID NO: 566571 - DNA, 20 bp, mouse
ggcggtatcccaggtgacgc

SEQ ID NO: 566572 - DNA, 20 bp, mouse
gcagtagggactctataggg

SEQ ID NO: 566573 - DNA, 20 bp, mouse
gggcgtgtagcaggcactgg

SEQ ID NO: 566574 - DNA, 20 bp, mouse
gggtgtgatggtcaagagtg

SEQ ID NO: 566575 - DNA, 20 bp, mouse
gctggagtaaaactctggga

SEQ ID NO: 566576 - DNA, 20 bp, mouse
gacgacgacgacgaacggag

SEQ ID NO: 566577 - DNA, 20 bp, mouse
gaggtactcgcggagctcgg

SEQ ID NO: 566578 - DNA, 20 bp, mouse
gcgacgaacggagcggacgg

SEQ ID NO: 566579 - DNA, 20 bp, mouse
gtactcgcggagctcggcgg

SEQ ID NO: 566580 - DNA, 20 bp, mouse
gcgaacggagcggacggagg

SEQ ID NO: 566581 - DNA, 20 bp, mouse
ggctcggcggaggcgcgttg

SEQ ID NO: 566582 - DNA, 20 bp, mouse
ggcccgggcggagcctcctg

SEQ ID NO: 566583 - DNA, 20 bp, mouse
gcgacgacgaacggagcgga

SEQ ID NO: 566584 - DNA, 20 bp, mouse
ggaggcggcgcttgaggcag

SEQ ID NO: 566585 - DNA, 20 bp, mouse
gcgaagcccatgccccggaa

SEQ ID NO: 566586 - DNA, 20 bp, mouse
gtggagcccgctgaagaacc

SEQ ID NO: 566587 - DNA, 20 bp, mouse
gagacgcgggtcaggatctt

SEQ ID NO: 566588 - DNA, 20 bp, mouse
ggaaactctccgggaagctg

SEQ ID NO: 566589 - DNA, 20 bp, mouse
gtaaactgtacagctggtag

SEQ ID NO: 566590 - DNA, 20 bp, mouse
gaatcccaggctgtcagcaa

SEQ ID NO: 566591 - DNA, 20 bp, mouse
gtatctttgctaatctgacc

SEQ ID NO: 566592 - DNA, 20 bp, mouse
gtcagcaaaggaaactctcc

SEQ ID NO: 566593 - DNA, 20 bp, mouse
gtctgaccaggttcttcagc

SEQ ID NO: 566594 - DNA, 20 bp, mouse
ggacccgggaaggtgttcag

SEQ ID NO: 566595 - DNA, 20 bp, mouse
gaagaaggcaagtcaaacag

SEQ ID NO: 566596 - DNA, 20 bp, mouse
gcgctgctcgctggcctcat

SEQ ID NO: 566597 - DNA, 20 bp, mouse
gcgacgctcacgtagttcag

SEQ ID NO: 566598 - DNA, 20 bp, mouse
gggagaggctctgaaccgga

SEQ ID NO: 566599 - DNA, 20 bp, mouse
gctgcacctacctctcccgg

SEQ ID NO: 566600 - DNA, 20 bp, mouse
gggcgggacagcccagatgg

SEQ ID NO: 566601 - DNA, 20 bp, mouse
gggtctgcacctacctctcc

SEQ ID NO: 566602 - DNA, 20 bp, mouse
gaagcccaggccctaccccc

SEQ ID NO: 566603 - DNA, 20 bp, mouse
ggccacccgagcccagctag

SEQ ID NO: 566604 - DNA, 20 bp, mouse
gccggagacgaacaaggagg

SEQ ID NO: 566605 - DNA, 20 bp, mouse
gctcgaggcgagctccaccc

SEQ ID NO: 566606 - DNA, 20 bp, mouse
gtcattggaccgagaggcag

SEQ ID NO: 566607 - DNA, 20 bp, mouse
gcagtcggccggctggaccg

SEQ ID NO: 566608 - DNA, 20 bp, mouse
gctgaccgcaggcaaccggg

SEQ ID NO: 566609 - DNA, 20 bp, mouse
gtgcagctcattggaccgag

SEQ ID NO: 566610 - DNA, 20 bp, mouse
gcgactgaccgcaggcaacc

SEQ ID NO: 566611 - DNA, 20 bp, mouse
gccaatgagctgcaccaggt

SEQ ID NO: 566612 - DNA, 20 bp, mouse
gctgagtgcgaagttgctca

SEQ ID NO: 566613 - DNA, 20 bp, mouse
gctgcagatgggagactccc

SEQ ID NO: 566614 - DNA, 20 bp, mouse
gcagccggccgactgaccgc

SEQ ID NO: 566615 - DNA, 20 bp, mouse
gactctgcgcccgaatggag

SEQ ID NO: 566616 - DNA, 20 bp, mouse
gcccgtaagagctcagagga

SEQ ID NO: 566617 - DNA, 20 bp, mouse
gcgcttggagaagttgcggg

SEQ ID NO: 566618 - DNA, 20 bp, mouse
gagaggcagctgaggctccg

SEQ ID NO: 566619 - DNA, 20 bp, mouse
gcgaggcaccgcacccaaca

SEQ ID NO: 566620 - DNA, 20 bp, mouse
gcgggtggcgctatccaagg

SEQ ID NO: 566621 - DNA, 20 bp, mouse
gcagcgggtggcgctatcca

SEQ ID NO: 566622 - DNA, 20 bp, mouse
ggtagcgccctgcacggtgt

SEQ ID NO: 566623 - DNA, 20 bp, mouse
gtccttcctctgagctctta

SEQ ID NO: 566624 - DNA, 20 bp, mouse
gggtgcctcggggcttccag

SEQ ID NO: 566625 - DNA, 20 bp, mouse
gtatccaaggcggcttcccg

SEQ ID NO: 566626 - DNA, 20 bp, mouse
ggacggagctggacccgcgt

SEQ ID NO: 566627 - DNA, 20 bp, mouse
gggagctggacccgcgtagg

SEQ ID NO: 566628 - DNA, 20 bp, mouse
ggctggacccgcgtaggagg

SEQ ID NO: 566629 - DNA, 20 bp, mouse
ggctgtggcgccaggaacca

SEQ ID NO: 566630 - DNA, 20 bp, mouse
gagttctgggataacaacgg

SEQ ID NO: 566631 - DNA, 20 bp, mouse
ggcgtgcgctggagcgcgga

SEQ ID NO: 566632 - DNA, 20 bp, mouse
ggaatcgcccgcctcctacg

SEQ ID NO: 566633 - DNA, 20 bp, mouse
gccggagccgcggagcccca

SEQ ID NO: 566634 - DNA, 20 bp, mouse
gggaggcgggcgattcccgc

SEQ ID NO: 566635 - DNA, 20 bp, mouse
gacgctcacgcgcttctcgt

SEQ ID NO: 566636 - DNA, 20 bp, mouse
gcgcagcggtggctccacag

SEQ ID NO: 566637 - DNA, 20 bp, mouse
ggagccccgcgcctcggctg

SEQ ID NO: 566638 - DNA, 20 bp, mouse
gtgcgccagaggcagcccca

SEQ ID NO: 566639 - DNA, 20 bp, mouse
gccccgcgcctcggctgagg

SEQ ID NO: 566640 - DNA, 20 bp, mouse
gcgggcggcaacgaaaatgt

SEQ ID NO: 566641 - DNA, 20 bp, mouse
gcagcgggaacggggcacgg

SEQ ID NO: 566642 - DNA, 20 bp, mouse
gcggcggcgaccgggcaaga

SEQ ID NO: 566643 - DNA, 20 bp, mouse
gcccggggcgggcaagatgg

SEQ ID NO: 566644 - DNA, 20 bp, mouse
gagcggcgtagctgcgccag

SEQ ID NO: 566645 - DNA, 20 bp, mouse
ggttcgctgacgaggccctg

SEQ ID NO: 566646 - DNA, 20 bp, mouse
gggacagagcaggaacccac

SEQ ID NO: 566647 - DNA, 20 bp, mouse
gaacccaccgggagctcact

SEQ ID NO: 566648 - DNA, 20 bp, mouse
gtgcctagtgagctcccggt

SEQ ID NO: 566649 - DNA, 20 bp, mouse
gggcagacaagagcacccgg

SEQ ID NO: 566650 - DNA, 20 bp, mouse
ggcaggcagacaagagcacc

SEQ ID NO: 566651 - DNA, 20 bp, mouse
gtgctgctgcgcttgagcag

SEQ ID NO: 566652 - DNA, 20 bp, mouse
ggctaggcgccaatggccac

SEQ ID NO: 566653 - DNA, 20 bp, mouse
gctctagtgctaggcgccaa

SEQ ID NO: 566654 - DNA, 20 bp, mouse
gaagagcacccggtggccat

SEQ ID NO: 566655 - DNA, 20 bp, mouse
gatgcgacctgggactcgag

SEQ ID NO: 566656 - DNA, 20 bp, mouse
ggcaggcagacatactggtg

SEQ ID NO: 566657 - DNA, 20 bp, mouse
ggggcaagaagagtaacact

SEQ ID NO: 566658 - DNA, 20 bp, mouse
gaatataacttcacacaggt

SEQ ID NO: 566659 - DNA, 20 bp, mouse
ggaaaagagcctattagaag

SEQ ID NO: 566660 - DNA, 20 bp, mouse
ggcagagactggagctatct

SEQ ID NO: 566661 - DNA, 20 bp, mouse
gtcagttcttaggggagtta

SEQ ID NO: 566662 - DNA, 20 bp, mouse
gacagaatataacttcacac

SEQ ID NO: 566663 - DNA, 20 bp, mouse
gtattctgttcagttcttag

SEQ ID NO: 566664 - DNA, 20 bp, mouse
ggtgaaacgaaagcagagac

SEQ ID NO: 566665 - DNA, 20 bp, mouse
gattccctgccccttctaat

SEQ ID NO: 566666 - DNA, 20 bp, mouse
ggtccagtcgggtctgtaac

SEQ ID NO: 566667 - DNA, 20 bp, mouse
gtcctggctaggcttttcgg

SEQ ID NO: 566668 - DNA, 20 bp, mouse
gaaccagttacagacccgac

SEQ ID NO: 566669 - DNA, 20 bp, mouse
gcagtctgcaaggagcctag

SEQ ID NO: 566670 - DNA, 20 bp, mouse
ggctcctccaaagccagcgg

SEQ ID NO: 566671 - DNA, 20 bp, mouse
gaagctctctagaagccgga

SEQ ID NO: 566672 - DNA, 20 bp, mouse
gcaaccgccgctggctttgg

SEQ ID NO: 566673 - DNA, 20 bp, mouse
gctctctagaagccggaggg

SEQ ID NO: 566674 - DNA, 20 bp, mouse
gctgcgtgcacgaacattcc

SEQ ID NO: 566675 - DNA, 20 bp, mouse
gtctcaccgctctgtccagt

SEQ ID NO: 566676 - DNA, 20 bp, mouse
gagggaaagagcagccaata

SEQ ID NO: 566677 - DNA, 20 bp, mouse
gccaatatggcggcagagcg

SEQ ID NO: 566678 - DNA, 20 bp, mouse
gcaacagtcgcaggagatga

SEQ ID NO: 566679 - DNA, 20 bp, mouse
gccctcgggacgggactccc

SEQ ID NO: 566680 - DNA, 20 bp, mouse
ggagggtgagcggcccctgt

SEQ ID NO: 566681 - DNA, 20 bp, mouse
gggcctaaggcgacagattc

SEQ ID NO: 566682 - DNA, 20 bp, mouse
gtatggctggacagccaggg

SEQ ID NO: 566683 - DNA, 20 bp, mouse
ggcggggcagcaacagtcgc

SEQ ID NO: 566684 - DNA, 20 bp, mouse
gccgctccccggtcacccac

SEQ ID NO: 566685 - DNA, 20 bp, mouse
gaaggcgacagattccggaa

SEQ ID NO: 566686 - DNA, 20 bp, mouse
ggtcgcccggcccctcacag

SEQ ID NO: 566687 - DNA, 20 bp, mouse
gtcagacccgccaaatggga

SEQ ID NO: 566688 - DNA, 20 bp, mouse
gtggcggcagccgtgaactc

SEQ ID NO: 566689 - DNA, 20 bp, mouse
gcgggcagtcgaacagcggg

SEQ ID NO: 566690 - DNA, 20 bp, mouse
gaagtcgggcagtcgaacag

SEQ ID NO: 566691 - DNA, 20 bp, mouse
gatcaggttggactgaggta

SEQ ID NO: 566692 - DNA, 20 bp, mouse
ggccaaggcctgaagcaccc

SEQ ID NO: 566693 - DNA, 20 bp, mouse
ggccgggaaactaagagctc

SEQ ID NO: 566694 - DNA, 20 bp, mouse
gtgcttcagacccgccaaat

SEQ ID NO: 566695 - DNA, 20 bp, mouse
ggtctggtcagagaacaagg

SEQ ID NO: 566696 - DNA, 20 bp, mouse
gggtaacaggtgcctcacct

SEQ ID NO: 566697 - DNA, 20 bp, mouse
ggctgatgggattaactcta

SEQ ID NO: 566698 - DNA, 20 bp, mouse
ggcctctggcggccaacgaa

SEQ ID NO: 566699 - DNA, 20 bp, mouse
gagcccagcagcgaaatccc

SEQ ID NO: 566700 - DNA, 20 bp, mouse
gaatcccatcagccgaggtg

SEQ ID NO: 566701 - DNA, 20 bp, mouse
ggtgcctcacctcggctgat

SEQ ID NO: 566702 - DNA, 20 bp, mouse
gggagggagagcaaaggcta

SEQ ID NO: 566703 - DNA, 20 bp, mouse
gcaggccgcggggatgagga

SEQ ID NO: 566704 - DNA, 20 bp, mouse
ggccctccgcccgctcgtca

SEQ ID NO: 566705 - DNA, 20 bp, mouse
ggagttaatcccatcagccg

SEQ ID NO: 566706 - DNA, 20 bp, mouse
gagtggtaccagtcccccag

SEQ ID NO: 566707 - DNA, 20 bp, mouse
gtctagctctgcccgaaccg

SEQ ID NO: 566708 - DNA, 20 bp, mouse
gggtaccagtcccccagcgg

SEQ ID NO: 566709 - DNA, 20 bp, mouse
gtctccggcagccgcggttc

SEQ ID NO: 566710 - DNA, 20 bp, mouse
gtcctccgaggcggtgtcag

SEQ ID NO: 566711 - DNA, 20 bp, mouse
gcggctcacatcctccgagg

SEQ ID NO: 566712 - DNA, 20 bp, mouse
ggaagcagcggccacggcac

SEQ ID NO: 566713 - DNA, 20 bp, mouse
gcaccggctcacatcctccg

SEQ ID NO: 566714 - DNA, 20 bp, mouse
gggcccccggccggagtagg

SEQ ID NO: 566715 - DNA, 20 bp, mouse
gcgatccctttaggacccag

SEQ ID NO: 566716 - DNA, 20 bp, mouse
gagtcccgagctagggcgag

SEQ ID NO: 566717 - DNA, 20 bp, mouse
gaaagccgagtcccgagcta

SEQ ID NO: 566718 - DNA, 20 bp, mouse
gcccgagctagggcgagcgg

SEQ ID NO: 566719 - DNA, 20 bp, mouse
ggaggaggcacagcggccgg

SEQ ID NO: 566720 - DNA, 20 bp, mouse
ggagctagggcgagcggagg

SEQ ID NO: 566721 - DNA, 20 bp, mouse
gaagcaccccgggagagcgg

SEQ ID NO: 566722 - DNA, 20 bp, mouse
gtggctcgctccgcagtgct

SEQ ID NO: 566723 - DNA, 20 bp, mouse
ggttcgggcgggcggcatca

SEQ ID NO: 566724 - DNA, 20 bp, mouse
ggtcaagagcctctgcgaga

SEQ ID NO: 566725 - DNA, 20 bp, mouse
gtgctttctgcggccccagg

SEQ ID NO: 566726 - DNA, 20 bp, mouse
ggcgcggagaggcctgcggg

SEQ ID NO: 566727 - DNA, 20 bp, mouse
gccgtggccagagcgcggag

SEQ ID NO: 566728 - DNA, 20 bp, mouse
ggagggccgtggccagagcg

SEQ ID NO: 566729 - DNA, 20 bp, mouse
gagaaagagcgagagggccg

SEQ ID NO: 566730 - DNA, 20 bp, mouse
gcggctcggctccggcccga

SEQ ID NO: 566731 - DNA, 20 bp, mouse
gcagagcgcggagaggcctg

SEQ ID NO: 566732 - DNA, 20 bp, mouse
ggcgatgacggaaacccgga

SEQ ID NO: 566733 - DNA, 20 bp, mouse
ggaggcctgcgggtggcagc

SEQ ID NO: 566734 - DNA, 20 bp, mouse
gcggcgggaccaccgagccg

SEQ ID NO: 566735 - DNA, 20 bp, mouse
gcgcagagcgcggcgcagct

SEQ ID NO: 566736 - DNA, 20 bp, mouse
gaaacgccagggagccaaga

SEQ ID NO: 566737 - DNA, 20 bp, mouse
gggcagcagcgagctccagg

SEQ ID NO: 566738 - DNA, 20 bp, mouse
gtagagcgaatcgtcaccgt

SEQ ID NO: 566739 - DNA, 20 bp, mouse
gctgcctgatagaaacgcca

SEQ ID NO: 566740 - DNA, 20 bp, mouse
gcgggagtggcggaaagcag

SEQ ID NO: 566741 - DNA, 20 bp, mouse
ggctccctggcgtttctatc

SEQ ID NO: 566742 - DNA, 20 bp, mouse
gccaagatggcagctgccga

SEQ ID NO: 566743 - DNA, 20 bp, mouse
ggcctgggcggcccgagata

SEQ ID NO: 566744 - DNA, 20 bp, mouse
gcgagctccaggcggaatcc

SEQ ID NO: 566745 - DNA, 20 bp, mouse
gtccaggcggaatccgggat

SEQ ID NO: 566746 - DNA, 20 bp, mouse
gttcggcggcgaccagccag

SEQ ID NO: 566747 - DNA, 20 bp, mouse
gggcggaagcgcacatggta

SEQ ID NO: 566748 - DNA, 20 bp, mouse
ggcgcagcagggccagggtc

SEQ ID NO: 566749 - DNA, 20 bp, mouse
gccccagccgaaagaaacaa

SEQ ID NO: 566750 - DNA, 20 bp, mouse
ggcagggccagggtccggtc

SEQ ID NO: 566751 - DNA, 20 bp, mouse
gctgggcacggggccttcgg

SEQ ID NO: 566752 - DNA, 20 bp, mouse
gggcgggcgcagcagggcca

SEQ ID NO: 566753 - DNA, 20 bp, mouse
gtacgactctgccaccccgg

SEQ ID NO: 566754 - DNA, 20 bp, mouse
gccacccgctgcccccggac

SEQ ID NO: 566755 - DNA, 20 bp, mouse
gcgccaccaccccagagggt

SEQ ID NO: 566756 - DNA, 20 bp, mouse
ggcggcggctaggacagcga

SEQ ID NO: 566757 - DNA, 20 bp, mouse
ggcggctaggacagcgacgg

SEQ ID NO: 566758 - DNA, 20 bp, mouse
ggcggcggcggtagtagtgg

SEQ ID NO: 566759 - DNA, 20 bp, mouse
ggcggcggtagtagtggcgg

SEQ ID NO: 566760 - DNA, 20 bp, mouse
gctcgcggtggagacggcag

SEQ ID NO: 566761 - DNA, 20 bp, mouse
gggcggatggcacctgaggg

SEQ ID NO: 566762 - DNA, 20 bp, mouse
gggagagcgcgcagaggaag

SEQ ID NO: 566763 - DNA, 20 bp, mouse
ggaccgggaccggggcggaa

SEQ ID NO: 566764 - DNA, 20 bp, mouse
ggaggggaccgggaccgggg

SEQ ID NO: 566765 - DNA, 20 bp, mouse
gacgtcaccggccagccagc

SEQ ID NO: 566766 - DNA, 20 bp, mouse
ggaagcttcagccaatgaag

SEQ ID NO: 566767 - DNA, 20 bp, mouse
gtgaaggtacagatcagagg

SEQ ID NO: 566768 - DNA, 20 bp, mouse
gagaagcccccaagcaagct

SEQ ID NO: 566769 - DNA, 20 bp, mouse
ggggaagcccaaggaatcac

SEQ ID NO: 566770 - DNA, 20 bp, mouse
gaaggctgagagaatcctta

SEQ ID NO: 566771 - DNA, 20 bp, mouse
ggctctatcccagcttgctt

SEQ ID NO: 566772 - DNA, 20 bp, mouse
gttggaggtctgaagatata

SEQ ID NO: 566773 - DNA, 20 bp, mouse
gctgatctgtaccttcagta

SEQ ID NO: 566774 - DNA, 20 bp, mouse
gcaatgccttacatttctgc

SEQ ID NO: 566775 - DNA, 20 bp, mouse
gctgggtgggtgggacaaag

SEQ ID NO: 566776 - DNA, 20 bp, mouse
gggacgcagcgcgaacggag

SEQ ID NO: 566777 - DNA, 20 bp, mouse
gtccgggcgcctggcggtgg

SEQ ID NO: 566778 - DNA, 20 bp, mouse
ggcgtccgggcgcctggcgg

SEQ ID NO: 566779 - DNA, 20 bp, mouse
gcgcccggacgcagcgcgaa

SEQ ID NO: 566780 - DNA, 20 bp, mouse
gggcggcccgagaccctgct

SEQ ID NO: 566781 - DNA, 20 bp, mouse
gagaccctgctaggctgcgg

SEQ ID NO: 566782 - DNA, 20 bp, mouse
gctgcgacacggccccgcca

SEQ ID NO: 566783 - DNA, 20 bp, mouse
ggctgcgtccgggcgcctgg

SEQ ID NO: 566784 - DNA, 20 bp, mouse
ggctcaggcgagcgtaaggc

SEQ ID NO: 566785 - DNA, 20 bp, mouse
gcggcggcggggcatgccca

SEQ ID NO: 566786 - DNA, 20 bp, mouse
ggaaaaaattccctccccgg

SEQ ID NO: 566787 - DNA, 20 bp, mouse
gagccgagcgcggccgaccg

SEQ ID NO: 566788 - DNA, 20 bp, mouse
gaaaattccctccccggcgg

SEQ ID NO: 566789 - DNA, 20 bp, mouse
ggggcggcaacgacttccag

SEQ ID NO: 566790 - DNA, 20 bp, mouse
ggctgtcgacgaggacgtgg

SEQ ID NO: 566791 - DNA, 20 bp, mouse
gagagggaggggtgtccgta

SEQ ID NO: 566792 - DNA, 20 bp, mouse
gcccgcgccatggcaggtga

SEQ ID NO: 566793 - DNA, 20 bp, mouse
ggggatgacgtcatccggcg

SEQ ID NO: 566794 - DNA, 20 bp, mouse
gggacgcgcccagccgagcg

SEQ ID NO: 566795 - DNA, 20 bp, mouse
gcgtcatccggcggggcgac

SEQ ID NO: 566796 - DNA, 20 bp, mouse
ggagcagcgggcactgaggt

SEQ ID NO: 566797 - DNA, 20 bp, mouse
gccacgccagaggactcccg

SEQ ID NO: 566798 - DNA, 20 bp, mouse
gggagcccccggccctccac

SEQ ID NO: 566799 - DNA, 20 bp, mouse
gcgccgcgcgtgaggagccg

SEQ ID NO: 566800 - DNA, 20 bp, mouse
gggcctgtggcgctagtggg

SEQ ID NO: 566801 - DNA, 20 bp, mouse
ggcgggcctgtggcgctagt

SEQ ID NO: 566802 - DNA, 20 bp, mouse
gggcctcgccagcccgtgga

SEQ ID NO: 566803 - DNA, 20 bp, mouse
gtgaggtaggcgcacagacg

SEQ ID NO: 566804 - DNA, 20 bp, mouse
gcggcgcacagagaccgggg

SEQ ID NO: 566805 - DNA, 20 bp, mouse
gcgcgcggtgaagggactcc

SEQ ID NO: 566806 - DNA, 20 bp, mouse
gtctgagcgggagtcaacca

SEQ ID NO: 566807 - DNA, 20 bp, mouse
ggcgggagtcaaccatggac

SEQ ID NO: 566808 - DNA, 20 bp, mouse
gaaatgtagggtcctctgag

SEQ ID NO: 566809 - DNA, 20 bp, mouse
gcctagcagggcatttacca

SEQ ID NO: 566810 - DNA, 20 bp, mouse
gcgccccaggctagaagtgg

SEQ ID NO: 566811 - DNA, 20 bp, mouse
ggcccgccccaggctagaag

SEQ ID NO: 566812 - DNA, 20 bp, mouse
gcggttagcgtcgcccaaca

SEQ ID NO: 566813 - DNA, 20 bp, mouse
ggcggacagggtggataggg

SEQ ID NO: 566814 - DNA, 20 bp, mouse
gcgtcgcggctggcagtggg

SEQ ID NO: 566815 - DNA, 20 bp, mouse
ggctttggagatctaccaag

SEQ ID NO: 566816 - DNA, 20 bp, mouse
gccgcggctacagctgaagg

SEQ ID NO: 566817 - DNA, 20 bp, mouse
gaggatcgccgagccagcgc

SEQ ID NO: 566818 - DNA, 20 bp, mouse
gagaacgacgggacccagga

SEQ ID NO: 566819 - DNA, 20 bp, mouse
ggctgtagccgcggcgtcag

SEQ ID NO: 566820 - DNA, 20 bp, mouse
gcggcccgcgctgagaacga

SEQ ID NO: 566821 - DNA, 20 bp, mouse
ggaaggtggacgagctcttc

SEQ ID NO: 566822 - DNA, 20 bp, mouse
gcgtccctgggtcccggatg

SEQ ID NO: 566823 - DNA, 20 bp, mouse
gcatggcgccgctgacgccg

SEQ ID NO: 566824 - DNA, 20 bp, mouse
gcggcgccatggcaaccaga

SEQ ID NO: 566825 - DNA, 20 bp, mouse
gtgagggacagcccgcaggg

SEQ ID NO: 566826 - DNA, 20 bp, mouse
gcagggagcatgcccaccaa

SEQ ID NO: 566827 - DNA, 20 bp, mouse
gccgcgagacggccgttggt

SEQ ID NO: 566828 - DNA, 20 bp, mouse
gtgccggtgcgaggcactca

SEQ ID NO: 566829 - DNA, 20 bp, mouse
gtcggcgccccgcaccaaga

SEQ ID NO: 566830 - DNA, 20 bp, mouse
gagatggccgctgcctcggt

SEQ ID NO: 566831 - DNA, 20 bp, mouse
gctccctgagtgcctcgcac

SEQ ID NO: 566832 - DNA, 20 bp, mouse
gacagtcactcgcgcgaagg

SEQ ID NO: 566833 - DNA, 20 bp, mouse
gctccaaccgccctacctgg

SEQ ID NO: 566834 - DNA, 20 bp, mouse
gcggcgcggccgccgcgaga

SEQ ID NO: 566835 - DNA, 20 bp, mouse
gctgcggggtgaacattgag

SEQ ID NO: 566836 - DNA, 20 bp, mouse
ggcgatggaagcgccccggg

SEQ ID NO: 566837 - DNA, 20 bp, mouse
gggctcgcgcggacccgcga

SEQ ID NO: 566838 - DNA, 20 bp, mouse
gggcgagcccgaagtttgga

SEQ ID NO: 566839 - DNA, 20 bp, mouse
ggaggaggctcccggccggg

SEQ ID NO: 566840 - DNA, 20 bp, mouse
gcccgcgatggaagcgcccc

SEQ ID NO: 566841 - DNA, 20 bp, mouse
gggccgggagcctcctcccg

SEQ ID NO: 566842 - DNA, 20 bp, mouse
ggccccagccgtccaaactt

SEQ ID NO: 566843 - DNA, 20 bp, mouse
ggttcgggtgaggggggact

SEQ ID NO: 566844 - DNA, 20 bp, mouse
gcgctcggcagcggctcgcg

SEQ ID NO: 566845 - DNA, 20 bp, mouse
gcccgaagtttggacggctg

SEQ ID NO: 566846 - DNA, 20 bp, mouse
gtgcagcgcagcgggagccc

SEQ ID NO: 566847 - DNA, 20 bp, mouse
ggccccggctcgctgcgcac

SEQ ID NO: 566848 - DNA, 20 bp, mouse
ggccggtgcgcagcgagccg

SEQ ID NO: 566849 - DNA, 20 bp, mouse
ggaccctcggcagatatccc

SEQ ID NO: 566850 - DNA, 20 bp, mouse
gcccggcagcacgcgaccct

SEQ ID NO: 566851 - DNA, 20 bp, mouse
ggcctcggtggaagagacga

SEQ ID NO: 566852 - DNA, 20 bp, mouse
ggatgtcatcctgagcagct

SEQ ID NO: 566853 - DNA, 20 bp, mouse
ggatatgaggagagatgcta

SEQ ID NO: 566854 - DNA, 20 bp, mouse
gccgaggcaacctctagggt

SEQ ID NO: 566855 - DNA, 20 bp, mouse
gacggttcaagggtccttag

SEQ ID NO: 566856 - DNA, 20 bp, mouse
gctctgcagctggagggaac

SEQ ID NO: 566857 - DNA, 20 bp, mouse
ggaagctctctgcagctgga

SEQ ID NO: 566858 - DNA, 20 bp, mouse
gaagggcgctgtactcctta

SEQ ID NO: 566859 - DNA, 20 bp, mouse
gactgaccggaaccttccgt

SEQ ID NO: 566860 - DNA, 20 bp, mouse
gatctaggctccagcgggaa

SEQ ID NO: 566861 - DNA, 20 bp, mouse
gggtgtcacctccaatcggt

SEQ ID NO: 566862 - DNA, 20 bp, mouse
gcgaatgtggagaagggcca

SEQ ID NO: 566863 - DNA, 20 bp, mouse
ggctgcttcgtgatgtcact

SEQ ID NO: 566864 - DNA, 20 bp, mouse
gaactacccacggaaggttc

SEQ ID NO: 566865 - DNA, 20 bp, mouse
gtggatgcggccagctccaa

SEQ ID NO: 566866 - DNA, 20 bp, mouse
gacgccgagcgggccgagtg

SEQ ID NO: 566867 - DNA, 20 bp, mouse
gtggcgaagagacgccgagc

SEQ ID NO: 566868 - DNA, 20 bp, mouse
gagccgggccgggtgtggac

SEQ ID NO: 566869 - DNA, 20 bp, mouse
gccaattggaagcgcagcca

SEQ ID NO: 566870 - DNA, 20 bp, mouse
gactcccgcggccagcccca

SEQ ID NO: 566871 - DNA, 20 bp, mouse
gcgcagccacggctcggccc

SEQ ID NO: 566872 - DNA, 20 bp, mouse
gcccggcggcggaggcgcaa

SEQ ID NO: 566873 - DNA, 20 bp, mouse
ggccggggataggagcaaag

SEQ ID NO: 566874 - DNA, 20 bp, mouse
gtggcagtcgcgcggccctg

SEQ ID NO: 566875 - DNA, 20 bp, mouse
gccgcctgcgcgctgcgccc

SEQ ID NO: 566876 - DNA, 20 bp, mouse
ggcccggtgatattgacaat

SEQ ID NO: 566877 - DNA, 20 bp, mouse
gcaccgggcggctgagtcca

SEQ ID NO: 566878 - DNA, 20 bp, mouse
gaccctgcgcgggtagcgaa

SEQ ID NO: 566879 - DNA, 20 bp, mouse
gctgcgcgggtagcgaacgg

SEQ ID NO: 566880 - DNA, 20 bp, mouse
gagagaaaggggcattgacg

SEQ ID NO: 566881 - DNA, 20 bp, mouse
gagcaagcgcgggagtcggg

SEQ ID NO: 566882 - DNA, 20 bp, mouse
gctctgctagccaggaggtt

SEQ ID NO: 566883 - DNA, 20 bp, mouse
gggtccggtgcaacgagcag

SEQ ID NO: 566884 - DNA, 20 bp, mouse
gcaggcgcaaccgaacctcc

SEQ ID NO: 566885 - DNA, 20 bp, mouse
gctcgttgcaccggacccgg

SEQ ID NO: 566886 - DNA, 20 bp, mouse
ggctcggtggacacagtccg

SEQ ID NO: 566887 - DNA, 20 bp, mouse
gctgtgtccaccgagctcag

SEQ ID NO: 566888 - DNA, 20 bp, mouse
gcggcgccgcgaggcagagg

SEQ ID NO: 566889 - DNA, 20 bp, mouse
ggcgaggcagaggaggatcg

SEQ ID NO: 566890 - DNA, 20 bp, mouse
gcagcggcgccgcgaggcag

SEQ ID NO: 566891 - DNA, 20 bp, mouse
gaatcggcgtggggaagcag

SEQ ID NO: 566892 - DNA, 20 bp, mouse
gcggaggcgaggttgtgccc

SEQ ID NO: 566893 - DNA, 20 bp, mouse
gccgctgcttctccacgcac

SEQ ID NO: 566894 - DNA, 20 bp, mouse
gagccggagagggacgaccg

SEQ ID NO: 566895 - DNA, 20 bp, mouse
gcgcggcggcgggacgtcta

SEQ ID NO: 566896 - DNA, 20 bp, mouse
gggctaccagagccaagcgg

SEQ ID NO: 566897 - DNA, 20 bp, mouse
ggcggcgccgccggggaaca

SEQ ID NO: 566898 - DNA, 20 bp, mouse
gggtccgccatgttccccgg

SEQ ID NO: 566899 - DNA, 20 bp, mouse
ggagggtccgccatgttccc

SEQ ID NO: 566900 - DNA, 20 bp, mouse
gcccaggggccactccccaa

SEQ ID NO: 566901 - DNA, 20 bp, mouse
gctaggtgccgggacgggcg

SEQ ID NO: 566902 - DNA, 20 bp, mouse
gcggtcttagcccctctgaa

SEQ ID NO: 566903 - DNA, 20 bp, mouse
gcgccaggcccgctcctgag

SEQ ID NO: 566904 - DNA, 20 bp, mouse
gagaggtacccgaagcctgg

SEQ ID NO: 566905 - DNA, 20 bp, mouse
ggggccgaccgcgtcgtcaa

SEQ ID NO: 566906 - DNA, 20 bp, mouse
gcggctgagggacacaacta

SEQ ID NO: 566907 - DNA, 20 bp, mouse
gacgaccgcgtcgagagcta

SEQ ID NO: 566908 - DNA, 20 bp, mouse
gtcgagagctacggcgaccg

SEQ ID NO: 566909 - DNA, 20 bp, mouse
ggacacaactagggagaccg

SEQ ID NO: 566910 - DNA, 20 bp, mouse
ggtcgccgtagctctcgacg

SEQ ID NO: 566911 - DNA, 20 bp, mouse
gcagcgccgctccctccctg

SEQ ID NO: 566912 - DNA, 20 bp, mouse
gctcggtcgtggagaactga

SEQ ID NO: 566913 - DNA, 20 bp, mouse
gctacggcgaccgcggctga

SEQ ID NO: 566914 - DNA, 20 bp, mouse
gcgcagcccgcctaggagga

SEQ ID NO: 566915 - DNA, 20 bp, mouse
gcgccgctccctccctgcgg

SEQ ID NO: 566916 - DNA, 20 bp, mouse
gatgcgtcggcgggaggaga

SEQ ID NO: 566917 - DNA, 20 bp, mouse
ggcgagccgctgcaacgagt

SEQ ID NO: 566918 - DNA, 20 bp, mouse
gcgcgctgaccgcaacctca

SEQ ID NO: 566919 - DNA, 20 bp, mouse
ggcagcctcacgctcacagg

SEQ ID NO: 566920 - DNA, 20 bp, mouse
gcggccccgactcgttgcag

SEQ ID NO: 566921 - DNA, 20 bp, mouse
ggtcccggttggagatgcgt

SEQ ID NO: 566922 - DNA, 20 bp, mouse
ggttgcagcctcacgctcac

SEQ ID NO: 566923 - DNA, 20 bp, mouse
gtgaccgcaacctcaaggca

SEQ ID NO: 566924 - DNA, 20 bp, mouse
gaggcgggcggagtcccggt

SEQ ID NO: 566925 - DNA, 20 bp, mouse
gcggcggctgtaggatcctc

SEQ ID NO: 566926 - DNA, 20 bp, mouse
gttcccatggcgaggcggta

SEQ ID NO: 566927 - DNA, 20 bp, mouse
gaaggagggaggagacggca

SEQ ID NO: 566928 - DNA, 20 bp, mouse
gcggtagggctggcaaagga

SEQ ID NO: 566929 - DNA, 20 bp, mouse
gtagggctggcaaaggaggg

SEQ ID NO: 566930 - DNA, 20 bp, mouse
ggaggcggtagggctggcaa

SEQ ID NO: 566931 - DNA, 20 bp, mouse
ggtggttgcacagctcagtt

SEQ ID NO: 566932 - DNA, 20 bp, mouse
gcgcctcgccatgggaaatg

SEQ ID NO: 566933 - DNA, 20 bp, mouse
gcgcgtgctgcccaggccaa

SEQ ID NO: 566934 - DNA, 20 bp, mouse
gcatggcgaggcggtagggc

SEQ ID NO: 566935 - DNA, 20 bp, mouse
gcgatcactcggcccaccag

SEQ ID NO: 566936 - DNA, 20 bp, mouse
ggcgaggccggaagtagaag

SEQ ID NO: 566937 - DNA, 20 bp, mouse
gcccaaagcggagggaagtg

SEQ ID NO: 566938 - DNA, 20 bp, mouse
gaggccggaagtagaagcgg

SEQ ID NO: 566939 - DNA, 20 bp, mouse
gccggaagtagaagcggcgg

SEQ ID NO: 566940 - DNA, 20 bp, mouse
gattaccgccgcggagactc

SEQ ID NO: 566941 - DNA, 20 bp, mouse
gtggcggaggcccaaagcgg

SEQ ID NO: 566942 - DNA, 20 bp, mouse
gaggcgagcccgccaatcag

SEQ ID NO: 566943 - DNA, 20 bp, mouse
gacgtcgccagagagaggtc

SEQ ID NO: 566944 - DNA, 20 bp, mouse
gccggcagatcgagcagcta

SEQ ID NO: 566945 - DNA, 20 bp, mouse
gtcagccggagtctccgcgg

SEQ ID NO: 566946 - DNA, 20 bp, mouse
gcgcggcccgcagctctgtt

SEQ ID NO: 566947 - DNA, 20 bp, mouse
ggcgggcggcggccagcggt

SEQ ID NO: 566948 - DNA, 20 bp, mouse
gggcgcctctagccacgggt

SEQ ID NO: 566949 - DNA, 20 bp, mouse
ggcacgagcaggtctgggag

SEQ ID NO: 566950 - DNA, 20 bp, mouse
ggggatcccgggagacgagg

SEQ ID NO: 566951 - DNA, 20 bp, mouse
gcgaggcgcgctcccacccg

SEQ ID NO: 566952 - DNA, 20 bp, mouse
ggcacacgccgcaggtcccc

SEQ ID NO: 566953 - DNA, 20 bp, mouse
gccagggcgcctctagccac

SEQ ID NO: 566954 - DNA, 20 bp, mouse
ggcgtgtgcccgagccgggc

SEQ ID NO: 566955 - DNA, 20 bp, mouse
gcgcagctctgttgggtcac

SEQ ID NO: 566956 - DNA, 20 bp, mouse
ggacgtgccgggcgccatgt

SEQ ID NO: 566957 - DNA, 20 bp, mouse
gcgcgaggacgacagctgtg

SEQ ID NO: 566958 - DNA, 20 bp, mouse
ggtgcgcgcgctgacgtgcc

SEQ ID NO: 566959 - DNA, 20 bp, mouse
gaggaggcgctgaaaggtgg

SEQ ID NO: 566960 - DNA, 20 bp, mouse
gggcgacagctacagcaggg

SEQ ID NO: 566961 - DNA, 20 bp, mouse
gggctgcaggaggcgctgaa

SEQ ID NO: 566962 - DNA, 20 bp, mouse
gggaggggagcgcctagcac

SEQ ID NO: 566963 - DNA, 20 bp, mouse
gccggcgcggggctttgtgt

SEQ ID NO: 566964 - DNA, 20 bp, mouse
gtgcaggaggcgctgaaagg

SEQ ID NO: 566965 - DNA, 20 bp, mouse
ggccggcgacagctacagca

SEQ ID NO: 566966 - DNA, 20 bp, mouse
ggcccaccagaaggactctc

SEQ ID NO: 566967 - DNA, 20 bp, mouse
gctcttgctctgcttccccg

SEQ ID NO: 566968 - DNA, 20 bp, mouse
gccccgcgccgcccaccaga

SEQ ID NO: 566969 - DNA, 20 bp, mouse
gccctcggtgcgctgctctc

SEQ ID NO: 566970 - DNA, 20 bp, mouse
ggactctctggtcccgctct

SEQ ID NO: 566971 - DNA, 20 bp, mouse
gcccagccggctccagtcag

SEQ ID NO: 566972 - DNA, 20 bp, mouse
gggcgacgagaacacgagcg

SEQ ID NO: 566973 - DNA, 20 bp, mouse
gcgggaccagagagtccttc

SEQ ID NO: 566974 - DNA, 20 bp, mouse
gccggctccagtcagaggaa

SEQ ID NO: 566975 - DNA, 20 bp, mouse
gcttccccgcggccgagagc

SEQ ID NO: 566976 - DNA, 20 bp, mouse
ggagtgtgctgagacccccc

SEQ ID NO: 566977 - DNA, 20 bp, mouse
ggagcggccgttgccagggt

SEQ ID NO: 566978 - DNA, 20 bp, mouse
gcaggcccggcggggaacca

SEQ ID NO: 566979 - DNA, 20 bp, mouse
gccgcgagcggccgttgcca

SEQ ID NO: 566980 - DNA, 20 bp, mouse
gcgcaaagcgacccccaccc

SEQ ID NO: 566981 - DNA, 20 bp, mouse
ggcggcatggcgatggcgga

SEQ ID NO: 566982 - DNA, 20 bp, mouse
gaccccccgggacgaacccc

SEQ ID NO: 566983 - DNA, 20 bp, mouse
gctttgcggcatggcgatgg

SEQ ID NO: 566984 - DNA, 20 bp, mouse
gggccgatggcactctgaag

SEQ ID NO: 566985 - DNA, 20 bp, mouse
gtcgctttgcggcatggcga

SEQ ID NO: 566986 - DNA, 20 bp, mouse
ggcagcggctgtagtagcgg

SEQ ID NO: 566987 - DNA, 20 bp, mouse
ggctgtagtagcggaggcag

SEQ ID NO: 566988 - DNA, 20 bp, mouse
gttttaggaagaacaagccg

SEQ ID NO: 566989 - DNA, 20 bp, mouse
gccctcggcgggatccctac

SEQ ID NO: 566990 - DNA, 20 bp, mouse
gggatcccgccgagggagaa

SEQ ID NO: 566991 - DNA, 20 bp, mouse
gggagccccgcagccggaag

SEQ ID NO: 566992 - DNA, 20 bp, mouse
gcaggatcgggcgcccggta

SEQ ID NO: 566993 - DNA, 20 bp, mouse
gcagcggcggaggccgaatc

SEQ ID NO: 566994 - DNA, 20 bp, mouse
gcctccgccgcgccaggatc

SEQ ID NO: 566995 - DNA, 20 bp, mouse
gaaaatggcgccgctggatc

SEQ ID NO: 566996 - DNA, 20 bp, mouse
gcattgtgggacagtggcgg

SEQ ID NO: 566997 - DNA, 20 bp, mouse
ggccccagccgtccacctta

SEQ ID NO: 566998 - DNA, 20 bp, mouse
gtcggaggccttaaggtgga

SEQ ID NO: 566999 - DNA, 20 bp, mouse
gggaggtagccctgcgtcgg

SEQ ID NO: 567000 - DNA, 20 bp, mouse
gctccgaagcagggcgacgg

SEQ ID NO: 567001 - DNA, 20 bp, mouse
gccctgcgtcggaggcctta

SEQ ID NO: 567002 - DNA, 20 bp, mouse
gtcgaggggccggctaagag

SEQ ID NO: 567003 - DNA, 20 bp, mouse
ggccttaaggtggacggctg

SEQ ID NO: 567004 - DNA, 20 bp, mouse
gcggctccggccctgtcgag

SEQ ID NO: 567005 - DNA, 20 bp, mouse
gcgggaggacgcaagaagac

SEQ ID NO: 567006 - DNA, 20 bp, mouse
gtccaggagcttgtcaacgt

SEQ ID NO: 567007 - DNA, 20 bp, mouse
gagcttgtcaacgtgggacg

SEQ ID NO: 567008 - DNA, 20 bp, mouse
ggttgacaagctcctggaca

SEQ ID NO: 567009 - DNA, 20 bp, mouse
gtcccacgttgacaagctcc

SEQ ID NO: 567010 - DNA, 20 bp, mouse
gggtcacatgttccttgtcc

SEQ ID NO: 567011 - DNA, 20 bp, mouse
gaaggaacatgtgaccctgc

SEQ ID NO: 567012 - DNA, 20 bp, mouse
gccccaggacatggaagaga

SEQ ID NO: 567013 - DNA, 20 bp, mouse
gaatttccagaacatgatgg

SEQ ID NO: 567014 - DNA, 20 bp, mouse
gccgattcaagtatgtactg

SEQ ID NO: 567015 - DNA, 20 bp, mouse
ggaggctgttagcgaggctg

SEQ ID NO: 567016 - DNA, 20 bp, mouse
ggcgcctccaggtaactcag

SEQ ID NO: 567017 - DNA, 20 bp, mouse
gcctcccctgagttacctgg

SEQ ID NO: 567018 - DNA, 20 bp, mouse
gagcgaagcgcccaaaatgg

SEQ ID NO: 567019 - DNA, 20 bp, mouse
gtcgcgctcaggcgggaaaa

SEQ ID NO: 567020 - DNA, 20 bp, mouse
ggcctgagcgcgactaactg

SEQ ID NO: 567021 - DNA, 20 bp, mouse
gatcagcgaagcgcccaaaa

SEQ ID NO: 567022 - DNA, 20 bp, mouse
ggaagctgccgattccgggg

SEQ ID NO: 567023 - DNA, 20 bp, mouse
gcccgcagttagtcgcgctc

SEQ ID NO: 567024 - DNA, 20 bp, mouse
gccccctcccctgagttacc

SEQ ID NO: 567025 - DNA, 20 bp, mouse
ggccaagcccagagtcacct

SEQ ID NO: 567026 - DNA, 20 bp, mouse
gtgttcaggggccaagatgg

SEQ ID NO: 567027 - DNA, 20 bp, mouse
gcaggacccgggcccccagt

SEQ ID NO: 567028 - DNA, 20 bp, mouse
gccgggcccccagtcggagg

SEQ ID NO: 567029 - DNA, 20 bp, mouse
gcccgcggctggcagcaaag

SEQ ID NO: 567030 - DNA, 20 bp, mouse
ggcactccaccgccagggtc

SEQ ID NO: 567031 - DNA, 20 bp, mouse
ggccacgcactccaccgcca

SEQ ID NO: 567032 - DNA, 20 bp, mouse
gacagtgtcgggcgtcagaa

SEQ ID NO: 567033 - DNA, 20 bp, mouse
ggctttagagatggcgggag

SEQ ID NO: 567034 - DNA, 20 bp, mouse
gacgtggacgccacaggaaa

SEQ ID NO: 567035 - DNA, 20 bp, mouse
ggactcggtctctccgtccc

SEQ ID NO: 567036 - DNA, 20 bp, mouse
gcccaggcggcgcagcacca

SEQ ID NO: 567037 - DNA, 20 bp, mouse
gggcgtcgtcctgttcgcgg

SEQ ID NO: 567038 - DNA, 20 bp, mouse
ggctagcagcctccgcgaac

SEQ ID NO: 567039 - DNA, 20 bp, mouse
ggatggcgtcgtcctgttcg

SEQ ID NO: 567040 - DNA, 20 bp, mouse
ggccagatcaccagcggtgg

SEQ ID NO: 567041 - DNA, 20 bp, mouse
gtaaatctggaaagacgata

SEQ ID NO: 567042 - DNA, 20 bp, mouse
gacagcacccgcctagtcca

SEQ ID NO: 567043 - DNA, 20 bp, mouse
gcatgccagatcaccagcgg

SEQ ID NO: 567044 - DNA, 20 bp, mouse
gggtcatgtgattgctaaga

SEQ ID NO: 567045 - DNA, 20 bp, mouse
gagagctggactgcacactc

SEQ ID NO: 567046 - DNA, 20 bp, mouse
gatccggtggattacagact

SEQ ID NO: 567047 - DNA, 20 bp, mouse
gcccctatccccgtatccgg

SEQ ID NO: 567048 - DNA, 20 bp, mouse
gggtacaagtaaacagctgg

SEQ ID NO: 567049 - DNA, 20 bp, mouse
ggtccccctatccccgtatc

SEQ ID NO: 567050 - DNA, 20 bp, mouse
gctgtaatccaccggatacg

SEQ ID NO: 567051 - DNA, 20 bp, mouse
gtacctagtctgtaatccac

SEQ ID NO: 567052 - DNA, 20 bp, mouse
ggcatcagcagcggcaggaa

SEQ ID NO: 567053 - DNA, 20 bp, mouse
ggggctgcgggcatcagcag

SEQ ID NO: 567054 - DNA, 20 bp, mouse
ggagagtggaaactcccacc

SEQ ID NO: 567055 - DNA, 20 bp, mouse
gctcccacctggtctgtgtc

SEQ ID NO: 567056 - DNA, 20 bp, mouse
gctagtggagcggaagatgg

SEQ ID NO: 567057 - DNA, 20 bp, mouse
ggccagagcgaggtcagagc

SEQ ID NO: 567058 - DNA, 20 bp, mouse
gagagcgaggtcagagccgg

SEQ ID NO: 567059 - DNA, 20 bp, mouse
gctccgcctcaaccacactg

SEQ ID NO: 567060 - DNA, 20 bp, mouse
gccggaacacgctagtggag

SEQ ID NO: 567061 - DNA, 20 bp, mouse
gacgctagtggagcggaaga

SEQ ID NO: 567062 - DNA, 20 bp, mouse
ggcggcccggaacacgctag

SEQ ID NO: 567063 - DNA, 20 bp, mouse
gcgggaccccagtgtggttg

SEQ ID NO: 567064 - DNA, 20 bp, mouse
gagcagcggcgactacgggt

SEQ ID NO: 567065 - DNA, 20 bp, mouse
ggccctgaggaacgccccgg

SEQ ID NO: 567066 - DNA, 20 bp, mouse
gcgacatggcgaccgagagt

SEQ ID NO: 567067 - DNA, 20 bp, mouse
ggaaggcgccgagacccaga

SEQ ID NO: 567068 - DNA, 20 bp, mouse
gtctaacgcctcggacgaca

SEQ ID NO: 567069 - DNA, 20 bp, mouse
gtgggagcgattcgcagctg

SEQ ID NO: 567070 - DNA, 20 bp, mouse
gtgcgaatcgctcccactct

SEQ ID NO: 567071 - DNA, 20 bp, mouse
gagaagaggaaaggtagcag

SEQ ID NO: 567072 - DNA, 20 bp, mouse
gagcccgcgagcaagctgga

SEQ ID NO: 567073 - DNA, 20 bp, mouse
gtcggtcgccatgtcgtccg

SEQ ID NO: 567074 - DNA, 20 bp, mouse
gggcaacccttgccaagaag

SEQ ID NO: 567075 - DNA, 20 bp, mouse
gtctgacagtcaggaatcaa

SEQ ID NO: 567076 - DNA, 20 bp, mouse
gcaacccaaggagtccccag

SEQ ID NO: 567077 - DNA, 20 bp, mouse
gcagcaggaggtaggtgtct

SEQ ID NO: 567078 - DNA, 20 bp, mouse
ggacactgatggctctgagg

SEQ ID NO: 567079 - DNA, 20 bp, mouse
ggggacagaagtctatgaca

SEQ ID NO: 567080 - DNA, 20 bp, mouse
gagagctggtgggaaccaca

SEQ ID NO: 567081 - DNA, 20 bp, mouse
gctgcctctggggactcctt

SEQ ID NO: 567082 - DNA, 20 bp, mouse
ggctggtgggaaccacaggg

SEQ ID NO: 567083 - DNA, 20 bp, mouse
gcagaagtctatgacacggt

SEQ ID NO: 567084 - DNA, 20 bp, mouse
gaacagggagacagtccagc

SEQ ID NO: 567085 - DNA, 20 bp, mouse
gggtgggaaccacagggtgg

SEQ ID NO: 567086 - DNA, 20 bp, mouse
gttgcacctggggagagtcg

SEQ ID NO: 567087 - DNA, 20 bp, mouse
gaggctcctcgactctcccc

SEQ ID NO: 567088 - DNA, 20 bp, mouse
gcgcacggtgggcggaacca

SEQ ID NO: 567089 - DNA, 20 bp, mouse
gagtgcttaccaacaccgaa

SEQ ID NO: 567090 - DNA, 20 bp, mouse
ggaaccaaggcgctaggatg

SEQ ID NO: 567091 - DNA, 20 bp, mouse
ggaccagttaattgcacctg

SEQ ID NO: 567092 - DNA, 20 bp, mouse
gactctccggacccaggcac

SEQ ID NO: 567093 - DNA, 20 bp, mouse
gaccaacaccgaagggctct

SEQ ID NO: 567094 - DNA, 20 bp, mouse
gaccaagagcccttcggtgt

SEQ ID NO: 567095 - DNA, 20 bp, mouse
gctccccaggtgcaattaac

SEQ ID NO: 567096 - DNA, 20 bp, mouse
gggcgcggcgtggctggtaa

SEQ ID NO: 567097 - DNA, 20 bp, mouse
ggagggacagaaagaccgac

SEQ ID NO: 567098 - DNA, 20 bp, mouse
ggcgtggctggtaagggacg

SEQ ID NO: 567099 - DNA, 20 bp, mouse
gccgggttagagggaaggaa

SEQ ID NO: 567100 - DNA, 20 bp, mouse
ggtcgggcggagcctccctg

SEQ ID NO: 567101 - DNA, 20 bp, mouse
gcacggggcggggcttcctc

SEQ ID NO: 567102 - DNA, 20 bp, mouse
gacagaaagaccgactggcg

SEQ ID NO: 567103 - DNA, 20 bp, mouse
gacgcggattcagctcactt

SEQ ID NO: 567104 - DNA, 20 bp, mouse
gccccgccgggttagaggga

SEQ ID NO: 567105 - DNA, 20 bp, mouse
ggtcttcacgttcctcaggg

SEQ ID NO: 567106 - DNA, 20 bp, mouse
gcggatcctgaagctgacac

SEQ ID NO: 567107 - DNA, 20 bp, mouse
gccggctgtggatcttgaac

SEQ ID NO: 567108 - DNA, 20 bp, mouse
gggaggtcagctgatcccgg

SEQ ID NO: 567109 - DNA, 20 bp, mouse
ggggaagccgagaggccgga

SEQ ID NO: 567110 - DNA, 20 bp, mouse
gtgtggatcttgaactggtg

SEQ ID NO: 567111 - DNA, 20 bp, mouse
gttgaactggtgaggatgaa

SEQ ID NO: 567112 - DNA, 20 bp, mouse
gtcctggggagcgggatcgt

SEQ ID NO: 567113 - DNA, 20 bp, mouse
gaacaaggccgcccagtcca

SEQ ID NO: 567114 - DNA, 20 bp, mouse
gccggatccctggccaggtt

SEQ ID NO: 567115 - DNA, 20 bp, mouse
gccagtccagggaagccgag

SEQ ID NO: 567116 - DNA, 20 bp, mouse
gtcttataggtgagaaccgg

SEQ ID NO: 567117 - DNA, 20 bp, mouse
gtcggacgtgccgggccagg

SEQ ID NO: 567118 - DNA, 20 bp, mouse
ggacccggccggcggcaagg

SEQ ID NO: 567119 - DNA, 20 bp, mouse
gggggggttcaggatcttat

SEQ ID NO: 567120 - DNA, 20 bp, mouse
ggtccgagattgcagaatgg

SEQ ID NO: 567121 - DNA, 20 bp, mouse
gatcctgaacccccctggcc

SEQ ID NO: 567122 - DNA, 20 bp, mouse
gtgggagtccgggaaaccaa

SEQ ID NO: 567123 - DNA, 20 bp, mouse
ggctaggaggtgcttacccg

SEQ ID NO: 567124 - DNA, 20 bp, mouse
gcacgtccgagattgcagaa

SEQ ID NO: 567125 - DNA, 20 bp, mouse
gaaaccaagggttaactcgg

SEQ ID NO: 567126 - DNA, 20 bp, mouse
gcagctgtcaggctaaagtc

SEQ ID NO: 567127 - DNA, 20 bp, mouse
gggaggccgtggcagctgtc

SEQ ID NO: 567128 - DNA, 20 bp, mouse
ggtcgggcgagggatcgcgg

SEQ ID NO: 567129 - DNA, 20 bp, mouse
gaaagtcgggcgagggatcg

SEQ ID NO: 567130 - DNA, 20 bp, mouse
ggcgccacggctcatctcca

SEQ ID NO: 567131 - DNA, 20 bp, mouse
gccgtctagtccctggatct

SEQ ID NO: 567132 - DNA, 20 bp, mouse
ggatcgcggcgggacggcgg

SEQ ID NO: 567133 - DNA, 20 bp, mouse
ggcgagggatcgcggcggga

SEQ ID NO: 567134 - DNA, 20 bp, mouse
gcgccggttggagcacagaa

SEQ ID NO: 567135 - DNA, 20 bp, mouse
gagctgccacggcctccctc

SEQ ID NO: 567136 - DNA, 20 bp, mouse
gcccaggacaaagtcgtcta

SEQ ID NO: 567137 - DNA, 20 bp, mouse
gagtcgtctagggcgcgcag

SEQ ID NO: 567138 - DNA, 20 bp, mouse
gcgtctagggcgcgcagcgg

SEQ ID NO: 567139 - DNA, 20 bp, mouse
ggcaacccgcaggatgtcgg

SEQ ID NO: 567140 - DNA, 20 bp, mouse
gccagcaacccgcaggatgt

SEQ ID NO: 567141 - DNA, 20 bp, mouse
ggctggaccagcccgaaggg

SEQ ID NO: 567142 - DNA, 20 bp, mouse
gtactagcgggacgcagggt

SEQ ID NO: 567143 - DNA, 20 bp, mouse
ggttgctggaccagcccgaa

SEQ ID NO: 567144 - DNA, 20 bp, mouse
gccgcacctccgacatcctg

SEQ ID NO: 567145 - DNA, 20 bp, mouse
gggctggtccagcaacccgc

SEQ ID NO: 567146 - DNA, 20 bp, mouse
gcaggggatgatgaaccaca

SEQ ID NO: 567147 - DNA, 20 bp, mouse
gggggcttgaggactcacca

SEQ ID NO: 567148 - DNA, 20 bp, mouse
gctgaatgaacttccaatgg

SEQ ID NO: 567149 - DNA, 20 bp, mouse
gtcatcatcccctgaagcca

SEQ ID NO: 567150 - DNA, 20 bp, mouse
ggggtcccaagtagaaactg

SEQ ID NO: 567151 - DNA, 20 bp, mouse
gtgagtcctcaagcccccat

SEQ ID NO: 567152 - DNA, 20 bp, mouse
gaagttcattcaggtaacaa

SEQ ID NO: 567153 - DNA, 20 bp, mouse
ggacttggtgtgtcagcccg

SEQ ID NO: 567154 - DNA, 20 bp, mouse
gtacctgaatgaacttccaa

SEQ ID NO: 567155 - DNA, 20 bp, mouse
ggcagctgggatataagcag

SEQ ID NO: 567156 - DNA, 20 bp, mouse
gttgggcagggaccgttgag

SEQ ID NO: 567157 - DNA, 20 bp, mouse
gtctggagaggagttcgagg

SEQ ID NO: 567158 - DNA, 20 bp, mouse
ggagaggagttcgaggtggt

SEQ ID NO: 567159 - DNA, 20 bp, mouse
gcagcttccaccaaagacta

SEQ ID NO: 567160 - DNA, 20 bp, mouse
gatttctggagaggagttcg

SEQ ID NO: 567161 - DNA, 20 bp, mouse
ggtgggcgtgccatagtctt

SEQ ID NO: 567162 - DNA, 20 bp, mouse
gggtggaagctgcccctcaa

SEQ ID NO: 567163 - DNA, 20 bp, mouse
ggactaaatgaccagggtag

SEQ ID NO: 567164 - DNA, 20 bp, mouse
ggtttgggactaaatgacca

SEQ ID NO: 567165 - DNA, 20 bp, mouse
gtctccaagtccgcccacgt

SEQ ID NO: 567166 - DNA, 20 bp, mouse
gagtctccgctgaactccgg

SEQ ID NO: 567167 - DNA, 20 bp, mouse
gtgaagtctccgctgaactc

SEQ ID NO: 567168 - DNA, 20 bp, mouse
gagagatcttctactgaagt

SEQ ID NO: 567169 - DNA, 20 bp, mouse
gcttagtctgccctggtcag

SEQ ID NO: 567170 - DNA, 20 bp, mouse
gggtatttatgaccatccac

SEQ ID NO: 567171 - DNA, 20 bp, mouse
gcttctactgaagtgggcgt

SEQ ID NO: 567172 - DNA, 20 bp, mouse
gtcagcggagacttcattgc

SEQ ID NO: 567173 - DNA, 20 bp, mouse
gggagagtcatgactgcctg

SEQ ID NO: 567174 - DNA, 20 bp, mouse
gagtcatgactgcctgtgga

SEQ ID NO: 567175 - DNA, 20 bp, mouse
gtggctcacaccaatccttt

SEQ ID NO: 567176 - DNA, 20 bp, mouse
ggaggtgaaaagtggattag

SEQ ID NO: 567177 - DNA, 20 bp, mouse
gagaagaatgaggtgaaaag

SEQ ID NO: 567178 - DNA, 20 bp, mouse
gaaacccagatttccatacc

SEQ ID NO: 567179 - DNA, 20 bp, mouse
ggagctgacatgctgggagg

SEQ ID NO: 567180 - DNA, 20 bp, mouse
gggctgcacagtgcacagtg

SEQ ID NO: 567181 - DNA, 20 bp, mouse
gaggttctgcagaacagaga

SEQ ID NO: 567182 - DNA, 20 bp, mouse
gcagcctccttgaatagtgg

SEQ ID NO: 567183 - DNA, 20 bp, mouse
gcaacaagaaggctaggata

SEQ ID NO: 567184 - DNA, 20 bp, mouse
gttacccggtggagacacag

SEQ ID NO: 567185 - DNA, 20 bp, mouse
gaggctatactggagggagt

SEQ ID NO: 567186 - DNA, 20 bp, mouse
gtatagatttataagtgtca

SEQ ID NO: 567187 - DNA, 20 bp, mouse
gttgaattaaaatttttgaa

SEQ ID NO: 567188 - DNA, 20 bp, mouse
gtcagatggggtgtcctgat

SEQ ID NO: 567189 - DNA, 20 bp, mouse
ggatcaggcaatgtcagatg

SEQ ID NO: 567190 - DNA, 20 bp, mouse
gctccaatctcagcaaggtc

SEQ ID NO: 567191 - DNA, 20 bp, mouse
gagaagctccaatctcagca

SEQ ID NO: 567192 - DNA, 20 bp, mouse
gcaaggaagaaacttctata

SEQ ID NO: 567193 - DNA, 20 bp, mouse
gatcctgggctaaatgaggt

SEQ ID NO: 567194 - DNA, 20 bp, mouse
gttcctgaccttgctgagat

SEQ ID NO: 567195 - DNA, 20 bp, mouse
ggacagtaggtgaggatata

SEQ ID NO: 567196 - DNA, 20 bp, mouse
gaggtcaggaatctccatca

SEQ ID NO: 567197 - DNA, 20 bp, mouse
ggatgaaatatttgttcctt

SEQ ID NO: 567198 - DNA, 20 bp, mouse
gttagatatgcagatgataa

SEQ ID NO: 567199 - DNA, 20 bp, mouse
gcagaggcttctgtttatag

SEQ ID NO: 567200 - DNA, 20 bp, mouse
gctttaagggtctccaggtc

SEQ ID NO: 567201 - DNA, 20 bp, mouse
gatgataagggaataaccaa

SEQ ID NO: 567202 - DNA, 20 bp, mouse
ggatgagagcaagtgaatag

SEQ ID NO: 567203 - DNA, 20 bp, mouse
gcttcctgtgggagccctga

SEQ ID NO: 567204 - DNA, 20 bp, mouse
ggagtccaaggtagcatgga

SEQ ID NO: 567205 - DNA, 20 bp, mouse
gccatcaagcacagctttaa

SEQ ID NO: 567206 - DNA, 20 bp, mouse
gcttcccaggaacagatcgc

SEQ ID NO: 567207 - DNA, 20 bp, mouse
gcaggcagtcagtccaagct

SEQ ID NO: 567208 - DNA, 20 bp, mouse
gatgcctgcgatctgttcct

SEQ ID NO: 567209 - DNA, 20 bp, mouse
gcggaagtttgaagtgaaga

SEQ ID NO: 567210 - DNA, 20 bp, mouse
ggccaacctgagctagacta

SEQ ID NO: 567211 - DNA, 20 bp, mouse
gggatgaaaacgcctcaggc

SEQ ID NO: 567212 - DNA, 20 bp, mouse
gcaaaactgtgcccttctgg

SEQ ID NO: 567213 - DNA, 20 bp, mouse
gagcacttggagtccgagct

SEQ ID NO: 567214 - DNA, 20 bp, mouse
gacttgacccaagatgccaa

SEQ ID NO: 567215 - DNA, 20 bp, mouse
ggggcctgggcagcaaagta

SEQ ID NO: 567216 - DNA, 20 bp, mouse
gaggccagcgggggagacag

SEQ ID NO: 567217 - DNA, 20 bp, mouse
ggggagacagagggaccgga

SEQ ID NO: 567218 - DNA, 20 bp, mouse
ggagggaccggagggctccg

SEQ ID NO: 567219 - DNA, 20 bp, mouse
gagagcgagcgcttcctgtc

SEQ ID NO: 567220 - DNA, 20 bp, mouse
gaaactcacagagacctgac

SEQ ID NO: 567221 - DNA, 20 bp, mouse
ggagccgccccggagccctc

SEQ ID NO: 567222 - DNA, 20 bp, mouse
gcgggtgcgctgacaggata

SEQ ID NO: 567223 - DNA, 20 bp, mouse
ggacgtgtctggaagagcac

SEQ ID NO: 567224 - DNA, 20 bp, mouse
gctgctactgagggacaaaa

SEQ ID NO: 567225 - DNA, 20 bp, mouse
gacggggtgatggcacggag

SEQ ID NO: 567226 - DNA, 20 bp, mouse
gtaatttagacaggggaata

SEQ ID NO: 567227 - DNA, 20 bp, mouse
gatgctttacattgcatagt

SEQ ID NO: 567228 - DNA, 20 bp, mouse
gcagtgatgttaatttagac

SEQ ID NO: 567229 - DNA, 20 bp, mouse
ggagcccaaatcctcaggag

SEQ ID NO: 567230 - DNA, 20 bp, mouse
ggactaatacagactcctaa

SEQ ID NO: 567231 - DNA, 20 bp, mouse
gctgggacatcgttgtgaat

SEQ ID NO: 567232 - DNA, 20 bp, mouse
gttccattcacagctactac

SEQ ID NO: 567233 - DNA, 20 bp, mouse
gccaaagagcccaaatcctc

SEQ ID NO: 567234 - DNA, 20 bp, mouse
gggtgaagcaagacctatga

SEQ ID NO: 567235 - DNA, 20 bp, mouse
gttttgcatgaaacagtcac

SEQ ID NO: 567236 - DNA, 20 bp, mouse
gagctcccacaggaaggact

SEQ ID NO: 567237 - DNA, 20 bp, mouse
gctcattgtagctttcaggt

SEQ ID NO: 567238 - DNA, 20 bp, mouse
gtcctgtgggagctctgtgt

SEQ ID NO: 567239 - DNA, 20 bp, mouse
gatgctaaggaaacatccaa

SEQ ID NO: 567240 - DNA, 20 bp, mouse
gtcccacacagagctcccac

SEQ ID NO: 567241 - DNA, 20 bp, mouse
gtgggtccaaggtgaatcag

SEQ ID NO: 567242 - DNA, 20 bp, mouse
gaagatcctgagcctgatgg

SEQ ID NO: 567243 - DNA, 20 bp, mouse
gtgagtctaaggtagcaagg

SEQ ID NO: 567244 - DNA, 20 bp, mouse
gccacaggaaggactgggaa

SEQ ID NO: 567245 - DNA, 20 bp, mouse
gaggaatgtgtgtggatgag

SEQ ID NO: 567246 - DNA, 20 bp, mouse
gtgggacatcgttgtgaatt

SEQ ID NO: 567247 - DNA, 20 bp, mouse
gaaggattcccagacagtga

SEQ ID NO: 567248 - DNA, 20 bp, mouse
gcagggcaagcaggcaaaag

SEQ ID NO: 567249 - DNA, 20 bp, mouse
gtaacttagacaggggaatg

SEQ ID NO: 567250 - DNA, 20 bp, mouse
ggagcccaaatcctcaggag

SEQ ID NO: 567251 - DNA, 20 bp, mouse
gttccattcacagctactac

SEQ ID NO: 567252 - DNA, 20 bp, mouse
ggattcccagacagtgatgg

SEQ ID NO: 567253 - DNA, 20 bp, mouse
ggtgatgttaacttagacag

SEQ ID NO: 567254 - DNA, 20 bp, mouse
ggactaatacagactcctaa

SEQ ID NO: 567255 - DNA, 20 bp, mouse
gccaaagagcccaaatcctc

SEQ ID NO: 567256 - DNA, 20 bp, mouse
ggtccttcctgtgggagctc

SEQ ID NO: 567257 - DNA, 20 bp, mouse
gtagcatggaggaacgtgtg

SEQ ID NO: 567258 - DNA, 20 bp, mouse
gctcattgtagctttcaggt

SEQ ID NO: 567259 - DNA, 20 bp, mouse
gtcctgtgggagctctgggt

SEQ ID NO: 567260 - DNA, 20 bp, mouse
gatgctaaggaaacatccaa

SEQ ID NO: 567261 - DNA, 20 bp, mouse
gtcccacccagagctcccac

SEQ ID NO: 567262 - DNA, 20 bp, mouse
gaagatcctgagcctgatgg

SEQ ID NO: 567263 - DNA, 20 bp, mouse
gtgggtccaaggtgaatcag

SEQ ID NO: 567264 - DNA, 20 bp, mouse
gccacaggaaggactgggaa

SEQ ID NO: 567265 - DNA, 20 bp, mouse
gaggaacgtgtgtggatgag

SEQ ID NO: 567266 - DNA, 20 bp, mouse
gccactgaaagagggtgggt

SEQ ID NO: 567267 - DNA, 20 bp, mouse
gagagacaatctactgaagg

SEQ ID NO: 567268 - DNA, 20 bp, mouse
ggcaagagacaatctactga

SEQ ID NO: 567269 - DNA, 20 bp, mouse
gtctctgggaatagatgaat

SEQ ID NO: 567270 - DNA, 20 bp, mouse
gcttgcccactgaaagaggg

SEQ ID NO: 567271 - DNA, 20 bp, mouse
gtctcttgcccactgaaaga

SEQ ID NO: 567272 - DNA, 20 bp, mouse
gcctgtaggaaccctaatag

SEQ ID NO: 567273 - DNA, 20 bp, mouse
gcaaggtagccttcactgat

SEQ ID NO: 567274 - DNA, 20 bp, mouse
gagatgtgggtcctctatta

SEQ ID NO: 567275 - DNA, 20 bp, mouse
gtaagcaaaaccagctaggg

SEQ ID NO: 567276 - DNA, 20 bp, mouse
gcctggtatggatggtcaag

SEQ ID NO: 567277 - DNA, 20 bp, mouse
gatccataccaggcttaaat

SEQ ID NO: 567278 - DNA, 20 bp, mouse
ggaccaatttaagcctggta

SEQ ID NO: 567279 - DNA, 20 bp, mouse
gctaaatatcagcacaagtt

SEQ ID NO: 567280 - DNA, 20 bp, mouse
gacactatatctggtgatgg

SEQ ID NO: 567281 - DNA, 20 bp, mouse
gggtctgtaactgtgtataa

SEQ ID NO: 567282 - DNA, 20 bp, mouse
gcaagctcaaatgtcatgat

SEQ ID NO: 567283 - DNA, 20 bp, mouse
gataaagggtcctcaaagac

SEQ ID NO: 567284 - DNA, 20 bp, mouse
gatttagaccaatttaagcc

SEQ ID NO: 567285 - DNA, 20 bp, mouse
gccttggcaatgactaatga

SEQ ID NO: 567286 - DNA, 20 bp, mouse
gaggcactccgcatcagaga

SEQ ID NO: 567287 - DNA, 20 bp, mouse
gccacccacactccaggatc

SEQ ID NO: 567288 - DNA, 20 bp, mouse
ggctcctgaaagcctgatcc

SEQ ID NO: 567289 - DNA, 20 bp, mouse
ggtattgaccgtctctgatg

SEQ ID NO: 567290 - DNA, 20 bp, mouse
ggatgcggagtgcctaataa

SEQ ID NO: 567291 - DNA, 20 bp, mouse
gaaagcctgatcctggagtg

SEQ ID NO: 567292 - DNA, 20 bp, mouse
gctggtattcagcttacctg

SEQ ID NO: 567293 - DNA, 20 bp, mouse
gcctacccttgccttcatgt

SEQ ID NO: 567294 - DNA, 20 bp, mouse
gaccattctgacagatcttt

SEQ ID NO: 567295 - DNA, 20 bp, mouse
gtatgatcctggtggagcac

SEQ ID NO: 567296 - DNA, 20 bp, mouse
gaggagccccagtcatgaag

SEQ ID NO: 567297 - DNA, 20 bp, mouse
gggcgaagctgtagatctca

SEQ ID NO: 567298 - DNA, 20 bp, mouse
gttcgcctagagcactgaaa

SEQ ID NO: 567299 - DNA, 20 bp, mouse
ggcatcacctcttcatgact

SEQ ID NO: 567300 - DNA, 20 bp, mouse
gttccaggagagggtcttag

SEQ ID NO: 567301 - DNA, 20 bp, mouse
gtgagatggagtaactctca

SEQ ID NO: 567302 - DNA, 20 bp, mouse
gctcctctaagaccctctcc

SEQ ID NO: 567303 - DNA, 20 bp, mouse
gtcatgaagaggtgatgccg

SEQ ID NO: 567304 - DNA, 20 bp, mouse
gaggaagaggaccaggcacc

SEQ ID NO: 567305 - DNA, 20 bp, mouse
ggctgtagatctcagggtcc

SEQ ID NO: 567306 - DNA, 20 bp, mouse
gggcaagcacaatcgactat

SEQ ID NO: 567307 - DNA, 20 bp, mouse
gtctttttataaatttactc

SEQ ID NO: 567308 - DNA, 20 bp, mouse
gaacatgaaatataaatatc

SEQ ID NO: 567309 - DNA, 20 bp, mouse
gggagatggaaaaggaacag

SEQ ID NO: 567310 - DNA, 20 bp, mouse
ggtgtagaggacagagaaag

SEQ ID NO: 567311 - DNA, 20 bp, mouse
ggtgcttgccttgtgtgtag

SEQ ID NO: 567312 - DNA, 20 bp, mouse
gaaagtgttaaaaacatatt

SEQ ID NO: 567313 - DNA, 20 bp, mouse
gtgggagaaataaaaggaga

SEQ ID NO: 567314 - DNA, 20 bp, mouse
ggttaaaaacatattaggaa

SEQ ID NO: 567315 - DNA, 20 bp, mouse
gaaataaaaggagatggaaa

SEQ ID NO: 567316 - DNA, 20 bp, mouse
gccacgcgcgggacggagaa

SEQ ID NO: 567317 - DNA, 20 bp, mouse
ggggtccaacggctcgagag

SEQ ID NO: 567318 - DNA, 20 bp, mouse
ggcgccccagccacagacat

SEQ ID NO: 567319 - DNA, 20 bp, mouse
ggctcgaagccggctccgga

SEQ ID NO: 567320 - DNA, 20 bp, mouse
gtgaattccgcggggtccaa

SEQ ID NO: 567321 - DNA, 20 bp, mouse
ggaaggtgcgggtctcttag

SEQ ID NO: 567322 - DNA, 20 bp, mouse
ggagagtggagacggactcc

SEQ ID NO: 567323 - DNA, 20 bp, mouse
gccgcaccttctcctcatgg

SEQ ID NO: 567324 - DNA, 20 bp, mouse
ggacatcggtgcctgaagac

SEQ ID NO: 567325 - DNA, 20 bp, mouse
ggacccgcaccttctcctca

SEQ ID NO: 567326 - DNA, 20 bp, mouse
gagtagtaggcggagtgact

SEQ ID NO: 567327 - DNA, 20 bp, mouse
gagtctgtgaggtgagtagt

SEQ ID NO: 567328 - DNA, 20 bp, mouse
gcggcaggaacccatggcta

SEQ ID NO: 567329 - DNA, 20 bp, mouse
gagtaggcggagtgactcgg

SEQ ID NO: 567330 - DNA, 20 bp, mouse
gtgtagcgggaattcttact

SEQ ID NO: 567331 - DNA, 20 bp, mouse
ggacatcccgggtctcaagt

SEQ ID NO: 567332 - DNA, 20 bp, mouse
gctgtgaggtgagtagtagg

SEQ ID NO: 567333 - DNA, 20 bp, mouse
ggctaggagcttaagtgtag

SEQ ID NO: 567334 - DNA, 20 bp, mouse
gtaggccgccgggacatccc

SEQ ID NO: 567335 - DNA, 20 bp, mouse
gcgtgctctagaactatccc

SEQ ID NO: 567336 - DNA, 20 bp, mouse
gaggagagcccggcagccca

SEQ ID NO: 567337 - DNA, 20 bp, mouse
gtcgaacagaaggtaagcag

SEQ ID NO: 567338 - DNA, 20 bp, mouse
gagcccggcagcccatggct

SEQ ID NO: 567339 - DNA, 20 bp, mouse
gtctttagtcgcccacactg

SEQ ID NO: 567340 - DNA, 20 bp, mouse
gtgtggcggccccgagtaat

SEQ ID NO: 567341 - DNA, 20 bp, mouse
gtggctgccatccccagcca

SEQ ID NO: 567342 - DNA, 20 bp, mouse
gaagcagaggctggggagta

SEQ ID NO: 567343 - DNA, 20 bp, mouse
gcagccaagcaaggtatggg

SEQ ID NO: 567344 - DNA, 20 bp, mouse
gtacgggctacagcagggtc

SEQ ID NO: 567345 - DNA, 20 bp, mouse
ggtctttagcctaggcggga

SEQ ID NO: 567346 - DNA, 20 bp, mouse
ggcgtctccgcgacactgga

SEQ ID NO: 567347 - DNA, 20 bp, mouse
ggtactgacgcgcacctcgg

SEQ ID NO: 567348 - DNA, 20 bp, mouse
ggacgcgggaggatgtggac

SEQ ID NO: 567349 - DNA, 20 bp, mouse
gttctcttggaaaaacgtgt

SEQ ID NO: 567350 - DNA, 20 bp, mouse
gtgtgggtacgaccttggta

SEQ ID NO: 567351 - DNA, 20 bp, mouse
gagaagtctgcggcagggca

SEQ ID NO: 567352 - DNA, 20 bp, mouse
gcccgcggccgtagaaaagg

SEQ ID NO: 567353 - DNA, 20 bp, mouse
gagaggcttatctcagatgt

SEQ ID NO: 567354 - DNA, 20 bp, mouse
gcgggaggatgtggactggg

SEQ ID NO: 567355 - DNA, 20 bp, mouse
ggggctcgctccgggcggac

SEQ ID NO: 567356 - DNA, 20 bp, mouse
gttacagccatggcgagctg

SEQ ID NO: 567357 - DNA, 20 bp, mouse
gacagtgccacagctcgcca

SEQ ID NO: 567358 - DNA, 20 bp, mouse
ggaagataaagcatccacat

SEQ ID NO: 567359 - DNA, 20 bp, mouse
gatgtgctgacatcctgggt

SEQ ID NO: 567360 - DNA, 20 bp, mouse
gttaggaccagtagcaagtc

SEQ ID NO: 567361 - DNA, 20 bp, mouse
gagaataaggatgccaaccc

SEQ ID NO: 567362 - DNA, 20 bp, mouse
gcaagattaccttacagcca

SEQ ID NO: 567363 - DNA, 20 bp, mouse
gggcagtgaaagaccgactg

SEQ ID NO: 567364 - DNA, 20 bp, mouse
gtaagacctagagaactaaa

SEQ ID NO: 567365 - DNA, 20 bp, mouse
gagtgaaagaccgactgtgg

SEQ ID NO: 567366 - DNA, 20 bp, mouse
gaagatggtggtcaaagcag

SEQ ID NO: 567367 - DNA, 20 bp, mouse
gatggtggtcaaagcagggg

SEQ ID NO: 567368 - DNA, 20 bp, mouse
gggcaaagtttcagcgccag

SEQ ID NO: 567369 - DNA, 20 bp, mouse
gttcagcgccagcggcagcg

SEQ ID NO: 567370 - DNA, 20 bp, mouse
gtcctgtactaataagatgg

SEQ ID NO: 567371 - DNA, 20 bp, mouse
ggcgagtgcgcggaggaagg

SEQ ID NO: 567372 - DNA, 20 bp, mouse
gggcttcggaagacgctggg

SEQ ID NO: 567373 - DNA, 20 bp, mouse
gggagcccgcgaaggtgagt

SEQ ID NO: 567374 - DNA, 20 bp, mouse
ggccgaggaaaaggctacag

SEQ ID NO: 567375 - DNA, 20 bp, mouse
gtccggccccctgaattggg

SEQ ID NO: 567376 - DNA, 20 bp, mouse
gagtccgcgggtggagacaa

SEQ ID NO: 567377 - DNA, 20 bp, mouse
gcaagggtggataccaggag

SEQ ID NO: 567378 - DNA, 20 bp, mouse
ggtgggaaaccgagagtcct

SEQ ID NO: 567379 - DNA, 20 bp, mouse
gaccaggaggggtgcgggaa

SEQ ID NO: 567380 - DNA, 20 bp, mouse
gtgtagagagacaacgacca

SEQ ID NO: 567381 - DNA, 20 bp, mouse
ggcacagagcccatcatggg

SEQ ID NO: 567382 - DNA, 20 bp, mouse
gccgcgggtggagacaaggg

SEQ ID NO: 567383 - DNA, 20 bp, mouse
gtcctggctgggtgtataga

SEQ ID NO: 567384 - DNA, 20 bp, mouse
gggagggtgacacaacacga

SEQ ID NO: 567385 - DNA, 20 bp, mouse
ggctaaggggaggacggtcc

SEQ ID NO: 567386 - DNA, 20 bp, mouse
gggacagaagacgcacgtcg

SEQ ID NO: 567387 - DNA, 20 bp, mouse
ggagcagccgcatgcagagg

SEQ ID NO: 567388 - DNA, 20 bp, mouse
ggcccgcccacgtcactccg

SEQ ID NO: 567389 - DNA, 20 bp, mouse
ggctcgcggggtcctccacg

SEQ ID NO: 567390 - DNA, 20 bp, mouse
gtctgtccgcggagtgacgt

SEQ ID NO: 567391 - DNA, 20 bp, mouse
gcgggtccctcctctgcatg

SEQ ID NO: 567392 - DNA, 20 bp, mouse
ggaagacgcacgtcggggtg

SEQ ID NO: 567393 - DNA, 20 bp, mouse
ggtggggccggctaacggga

SEQ ID NO: 567394 - DNA, 20 bp, mouse
gcgccgccaggcagacgctg

SEQ ID NO: 567395 - DNA, 20 bp, mouse
gtgtcacttgcgccccgtgg

SEQ ID NO: 567396 - DNA, 20 bp, mouse
gggctgtgcaggctttaaga

SEQ ID NO: 567397 - DNA, 20 bp, mouse
ggcctcagggtacttggaga

SEQ ID NO: 567398 - DNA, 20 bp, mouse
gaagcctgcacagccttcgg

SEQ ID NO: 567399 - DNA, 20 bp, mouse
ggtgcaggctttaagaggga

SEQ ID NO: 567400 - DNA, 20 bp, mouse
gaagagggagggtgcagatc

SEQ ID NO: 567401 - DNA, 20 bp, mouse
ggggtgcagatccggcctca

SEQ ID NO: 567402 - DNA, 20 bp, mouse
gagacttctgaaacccccga

SEQ ID NO: 567403 - DNA, 20 bp, mouse
gaaacccccgaaggctgtgc

SEQ ID NO: 567404 - DNA, 20 bp, mouse
ggatccggcctcagggtact

SEQ ID NO: 567405 - DNA, 20 bp, mouse
gggaggcagtagaagagatc

SEQ ID NO: 567406 - DNA, 20 bp, mouse
gcccgctctgcacattccac

SEQ ID NO: 567407 - DNA, 20 bp, mouse
gtgcagagcggggtcggatc

SEQ ID NO: 567408 - DNA, 20 bp, mouse
gtccggagcggatcgcaacc

SEQ ID NO: 567409 - DNA, 20 bp, mouse
ggcgcagggcgatcccggag

SEQ ID NO: 567410 - DNA, 20 bp, mouse
gggaatgtgcagagcggggt

SEQ ID NO: 567411 - DNA, 20 bp, mouse
gggtggcccagggaccacag

SEQ ID NO: 567412 - DNA, 20 bp, mouse
gggacgagagaggcagtggt

SEQ ID NO: 567413 - DNA, 20 bp, mouse
ggcctgtggaatgtgcagag

SEQ ID NO: 567414 - DNA, 20 bp, mouse
gcgccagggcctgggagcca

SEQ ID NO: 567415 - DNA, 20 bp, mouse
ggtggggcagcggcgagcat

SEQ ID NO: 567416 - DNA, 20 bp, mouse
ggcttctgggctcaaggagg

SEQ ID NO: 567417 - DNA, 20 bp, mouse
gaccatgcgatccaaggcga

SEQ ID NO: 567418 - DNA, 20 bp, mouse
ggccttggatcgcatggtgt

SEQ ID NO: 567419 - DNA, 20 bp, mouse
ggccgacaccatgcgatcca

SEQ ID NO: 567420 - DNA, 20 bp, mouse
ggccagccgggctcagagga

SEQ ID NO: 567421 - DNA, 20 bp, mouse
gcgaatcgcgaggatcacag

SEQ ID NO: 567422 - DNA, 20 bp, mouse
ggagccactcggagagagag

SEQ ID NO: 567423 - DNA, 20 bp, mouse
gggtcgaccgcgcggtccgg

SEQ ID NO: 567424 - DNA, 20 bp, mouse
gaccacgcggggcaccactt

SEQ ID NO: 567425 - DNA, 20 bp, mouse
gatagtgtgtagctgcttct

SEQ ID NO: 567426 - DNA, 20 bp, mouse
ggccgcgggcgccagagcga

SEQ ID NO: 567427 - DNA, 20 bp, mouse
ggcgggcgccagagcgacgg

SEQ ID NO: 567428 - DNA, 20 bp, mouse
gggcgccagagcgacggcgg

SEQ ID NO: 567429 - DNA, 20 bp, mouse
gctccggccggaagtgacgt

SEQ ID NO: 567430 - DNA, 20 bp, mouse
ggtcgcgctctggtgaggag

SEQ ID NO: 567431 - DNA, 20 bp, mouse
gcttccggccggagccaaga

SEQ ID NO: 567432 - DNA, 20 bp, mouse
gccgaacggccgggaaccgg

SEQ ID NO: 567433 - DNA, 20 bp, mouse
gttcggaggaagctcgaagg

SEQ ID NO: 567434 - DNA, 20 bp, mouse
gggcacgtcgcgctctggtg

SEQ ID NO: 567435 - DNA, 20 bp, mouse
ggccgtgccgacgtcacttc

SEQ ID NO: 567436 - DNA, 20 bp, mouse
gcgagggtgcggccccgtga

SEQ ID NO: 567437 - DNA, 20 bp, mouse
gcccagcgcgggcctcaggt

SEQ ID NO: 567438 - DNA, 20 bp, mouse
ggccggaaaggcgcccccga

SEQ ID NO: 567439 - DNA, 20 bp, mouse
gtgagcagggcaggtcccca

SEQ ID NO: 567440 - DNA, 20 bp, mouse
gccggggcagggaaaggcca

SEQ ID NO: 567441 - DNA, 20 bp, mouse
ggccggaaacgggcccggag

SEQ ID NO: 567442 - DNA, 20 bp, mouse
gtcgtcatcgggccgaacgt

SEQ ID NO: 567443 - DNA, 20 bp, mouse
gcaggcccgccgccttcacg

SEQ ID NO: 567444 - DNA, 20 bp, mouse
gttctccacacgcagagagg

SEQ ID NO: 567445 - DNA, 20 bp, mouse
ggaagcgctggcagccggac

SEQ ID NO: 567446 - DNA, 20 bp, mouse
gggcgccgcacgtggagatg

SEQ ID NO: 567447 - DNA, 20 bp, mouse
gtgtggcgagaggctcccat

SEQ ID NO: 567448 - DNA, 20 bp, mouse
gccgagccacggaggatgct

SEQ ID NO: 567449 - DNA, 20 bp, mouse
gcggggagaacgggcctgta

SEQ ID NO: 567450 - DNA, 20 bp, mouse
gcgcaccccatctccacgtg

SEQ ID NO: 567451 - DNA, 20 bp, mouse
gtcctcctcccggccgcccc

SEQ ID NO: 567452 - DNA, 20 bp, mouse
gatggggtgcgggcctgggg

SEQ ID NO: 567453 - DNA, 20 bp, mouse
gacttcagggcgaacctgtc

SEQ ID NO: 567454 - DNA, 20 bp, mouse
gtggacccgggacgacttca

SEQ ID NO: 567455 - DNA, 20 bp, mouse
ggtgcggcgcctccggagcg

SEQ ID NO: 567456 - DNA, 20 bp, mouse
ggcgccctggagccaacccg

SEQ ID NO: 567457 - DNA, 20 bp, mouse
gcgctttccggcacaactcc

SEQ ID NO: 567458 - DNA, 20 bp, mouse
gcagctgggaccctaagagc

SEQ ID NO: 567459 - DNA, 20 bp, mouse
gccgacgcctcgagctggga

SEQ ID NO: 567460 - DNA, 20 bp, mouse
ggagccaacccgaggcgaag

SEQ ID NO: 567461 - DNA, 20 bp, mouse
gtcgcctcgggttggctcca

SEQ ID NO: 567462 - DNA, 20 bp, mouse
gccgagccgccgggatcccc

SEQ ID NO: 567463 - DNA, 20 bp, mouse
ggtgccggatccgagaaggg

SEQ ID NO: 567464 - DNA, 20 bp, mouse
ggcgccacttcgcctcgggt

SEQ ID NO: 567465 - DNA, 20 bp, mouse
ggcggctgcggcgcaggaag

SEQ ID NO: 567466 - DNA, 20 bp, mouse
gagagagatgcagatagatt

SEQ ID NO: 567467 - DNA, 20 bp, mouse
gtacaaagggaggagcgggt

SEQ ID NO: 567468 - DNA, 20 bp, mouse
gaggccacctggaaccaacg

SEQ ID NO: 567469 - DNA, 20 bp, mouse
gggaccgagtcgcccaaata

SEQ ID NO: 567470 - DNA, 20 bp, mouse
gagaacccgggcctagggat

SEQ ID NO: 567471 - DNA, 20 bp, mouse
gtctccatgtcaagaggtgt

SEQ ID NO: 567472 - DNA, 20 bp, mouse
gggagtggagggagagcatc

SEQ ID NO: 567473 - DNA, 20 bp, mouse
gctggagaagctagggactg

SEQ ID NO: 567474 - DNA, 20 bp, mouse
gggagatacactaatgtaat

SEQ ID NO: 567475 - DNA, 20 bp, mouse
ggtgtcggtgtcagtcttgt

SEQ ID NO: 567476 - DNA, 20 bp, mouse
gcagcctcggaactcctcag

SEQ ID NO: 567477 - DNA, 20 bp, mouse
gctcatggtccagaatcccg

SEQ ID NO: 567478 - DNA, 20 bp, mouse
gtcagagggacgaacgccgg

SEQ ID NO: 567479 - DNA, 20 bp, mouse
gaggggatatggggtctcac

SEQ ID NO: 567480 - DNA, 20 bp, mouse
gtcctcagagggacgaacgc

SEQ ID NO: 567481 - DNA, 20 bp, mouse
ggagggacgaacgccggcgg

SEQ ID NO: 567482 - DNA, 20 bp, mouse
gggcggtggcctcagagccg

SEQ ID NO: 567483 - DNA, 20 bp, mouse
gaaagcctcgctggtcctga

SEQ ID NO: 567484 - DNA, 20 bp, mouse
gcgagctacccaggttcctc

SEQ ID NO: 567485 - DNA, 20 bp, mouse
gccagaatcccgcggctctg

SEQ ID NO: 567486 - DNA, 20 bp, mouse
ggggagaaggaaccagtgat

SEQ ID NO: 567487 - DNA, 20 bp, mouse
gctctatcggtgagcgggag

SEQ ID NO: 567488 - DNA, 20 bp, mouse
ggagacctgtggctcgaccc

SEQ ID NO: 567489 - DNA, 20 bp, mouse
gcgcgagccgcgtttctcag

SEQ ID NO: 567490 - DNA, 20 bp, mouse
ggccgctgagaagtctccgt

SEQ ID NO: 567491 - DNA, 20 bp, mouse
ggtatcgccgctgagaaacg

SEQ ID NO: 567492 - DNA, 20 bp, mouse
gcccgctcaccgatagaggg

SEQ ID NO: 567493 - DNA, 20 bp, mouse
ggctcgtcccgggcgatcac

SEQ ID NO: 567494 - DNA, 20 bp, mouse
gtcgaccctggtgagtgtgc

SEQ ID NO: 567495 - DNA, 20 bp, mouse
gtcagggttccaacaggtcc

SEQ ID NO: 567496 - DNA, 20 bp, mouse
gaaccgagagagccctaggc

SEQ ID NO: 567497 - DNA, 20 bp, mouse
gtcaaaaccgagagagccct

SEQ ID NO: 567498 - DNA, 20 bp, mouse
gtaaaaggttctccggccta

SEQ ID NO: 567499 - DNA, 20 bp, mouse
gccacgcataaaaggttctc

SEQ ID NO: 567500 - DNA, 20 bp, mouse
gtgatccagcctgcaagcca

SEQ ID NO: 567501 - DNA, 20 bp, mouse
ggctcgggccttggtttccc

SEQ ID NO: 567502 - DNA, 20 bp, mouse
gttcccgggcaaggacaaag

SEQ ID NO: 567503 - DNA, 20 bp, mouse
gggtttgggccacgcataaa

SEQ ID NO: 567504 - DNA, 20 bp, mouse
gtacctgcgtgagcaagagc

SEQ ID NO: 567505 - DNA, 20 bp, mouse
gcaccaggcagtgcgcgggg

SEQ ID NO: 567506 - DNA, 20 bp, mouse
gagcacgcaagaggcacgat

SEQ ID NO: 567507 - DNA, 20 bp, mouse
ggatggcggcagctgcggga

SEQ ID NO: 567508 - DNA, 20 bp, mouse
ggcgtgctccggctactcct

SEQ ID NO: 567509 - DNA, 20 bp, mouse
gctcttgcgtgctctgaaga

SEQ ID NO: 567510 - DNA, 20 bp, mouse
gccctcccataggagctagt

SEQ ID NO: 567511 - DNA, 20 bp, mouse
gacgataggcggagataccg

SEQ ID NO: 567512 - DNA, 20 bp, mouse
gacgcaagaggcacgatagg

SEQ ID NO: 567513 - DNA, 20 bp, mouse
gtaaaggctgtcctgcgcag

SEQ ID NO: 567514 - DNA, 20 bp, mouse
gacccacggggatagtgtaa

SEQ ID NO: 567515 - DNA, 20 bp, mouse
gctagccgcaggaggcctag

SEQ ID NO: 567516 - DNA, 20 bp, mouse
gggactctgtgctttagcag

SEQ ID NO: 567517 - DNA, 20 bp, mouse
ggccaggcagccagctaaaa

SEQ ID NO: 567518 - DNA, 20 bp, mouse
gcgcgcttgcttggtcatgg

SEQ ID NO: 567519 - DNA, 20 bp, mouse
gctggagaccgcgcgaccaa

SEQ ID NO: 567520 - DNA, 20 bp, mouse
gaagctgctggacgggacca

SEQ ID NO: 567521 - DNA, 20 bp, mouse
ggggtggaccgagaactccc

SEQ ID NO: 567522 - DNA, 20 bp, mouse
gcacagagtcccctgccgcc

SEQ ID NO: 567523 - DNA, 20 bp, mouse
gttgtccaccagcgtagaag

SEQ ID NO: 567524 - DNA, 20 bp, mouse
gaacccgggacgcctccccg

SEQ ID NO: 567525 - DNA, 20 bp, mouse
gggtggacaagtgtaccccg

SEQ ID NO: 567526 - DNA, 20 bp, mouse
gggcgggtatgctacagctg

SEQ ID NO: 567527 - DNA, 20 bp, mouse
ggatgcacggagcacagaac

SEQ ID NO: 567528 - DNA, 20 bp, mouse
ggccatctgcgggtgggctg

SEQ ID NO: 567529 - DNA, 20 bp, mouse
ggccgcagcccacccgcaga

SEQ ID NO: 567530 - DNA, 20 bp, mouse
gtggctctgcccacaggagg

SEQ ID NO: 567531 - DNA, 20 bp, mouse
gagctggggcttcgagtcct

SEQ ID NO: 567532 - DNA, 20 bp, mouse
ggaacccaaagagacgcgat

SEQ ID NO: 567533 - DNA, 20 bp, mouse
ggggcagagccatctgcggg

SEQ ID NO: 567534 - DNA, 20 bp, mouse
gacgtggcatagatgtgaga

SEQ ID NO: 567535 - DNA, 20 bp, mouse
ggtgaccatggccccgatca

SEQ ID NO: 567536 - DNA, 20 bp, mouse
gcgcccgctgctcactgctg

SEQ ID NO: 567537 - DNA, 20 bp, mouse
gacgtgcgggaaccggtgag

SEQ ID NO: 567538 - DNA, 20 bp, mouse
gcgcaacccggaaagaagcg

SEQ ID NO: 567539 - DNA, 20 bp, mouse
ggccgcggccgagcgcaacc

SEQ ID NO: 567540 - DNA, 20 bp, mouse
gacctggcagggcaacgcgg

SEQ ID NO: 567541 - DNA, 20 bp, mouse
gactcggccagcactgatct

SEQ ID NO: 567542 - DNA, 20 bp, mouse
ggcgttgccctgccaggtga

SEQ ID NO: 567543 - DNA, 20 bp, mouse
gaccctgccccacctcccct

SEQ ID NO: 567544 - DNA, 20 bp, mouse
gagccacgctgggtcaggga

SEQ ID NO: 567545 - DNA, 20 bp, mouse
ggtgatgctcggcaggaccc

SEQ ID NO: 567546 - DNA, 20 bp, mouse
gtcactgtcgagtctgatcg

SEQ ID NO: 567547 - DNA, 20 bp, mouse
gggtaaacactgagttgaat

SEQ ID NO: 567548 - DNA, 20 bp, mouse
gagttctgtggtacacacag

SEQ ID NO: 567549 - DNA, 20 bp, mouse
gtaagaagacaagccaaaaa

SEQ ID NO: 567550 - DNA, 20 bp, mouse
gtgatcaacagatactcctc

SEQ ID NO: 567551 - DNA, 20 bp, mouse
gtgtgaatgtacactcggca

SEQ ID NO: 567552 - DNA, 20 bp, mouse
gctgcatgtgaatgtacact

SEQ ID NO: 567553 - DNA, 20 bp, mouse
gaatactcggctcactgctg

SEQ ID NO: 567554 - DNA, 20 bp, mouse
gtacagaccgttggggggga

SEQ ID NO: 567555 - DNA, 20 bp, mouse
gaaataagaaaacgaatact

SEQ ID NO: 567556 - DNA, 20 bp, mouse
gctgcttgcggtggtttgag

SEQ ID NO: 567557 - DNA, 20 bp, mouse
ggcagatcggctgcttgcgg

SEQ ID NO: 567558 - DNA, 20 bp, mouse
gcggccgcgcgggcgcagat

SEQ ID NO: 567559 - DNA, 20 bp, mouse
gtcggatagaccccaagact

SEQ ID NO: 567560 - DNA, 20 bp, mouse
gcttgcggtggtttgagtgg

SEQ ID NO: 567561 - DNA, 20 bp, mouse
gaacgcctgcaagacccagt

SEQ ID NO: 567562 - DNA, 20 bp, mouse
gtgccgacccctctcagcac

SEQ ID NO: 567563 - DNA, 20 bp, mouse
gggcgcagatcggctgcttg

SEQ ID NO: 567564 - DNA, 20 bp, mouse
ggcttgcgcagagagagccc

SEQ ID NO: 567565 - DNA, 20 bp, mouse
ggcgatgagcagcccagtct

SEQ ID NO: 567566 - DNA, 20 bp, mouse
gacggtacccgaatccctat

SEQ ID NO: 567567 - DNA, 20 bp, mouse
ggcgatctccagaagaagag

SEQ ID NO: 567568 - DNA, 20 bp, mouse
gctcgcagctcaatctccgc

SEQ ID NO: 567569 - DNA, 20 bp, mouse
gggcgccggatgcataggat

SEQ ID NO: 567570 - DNA, 20 bp, mouse
gccaacgccacgtacctata

SEQ ID NO: 567571 - DNA, 20 bp, mouse
gtaggactgcacgacgcttc

SEQ ID NO: 567572 - DNA, 20 bp, mouse
ggtgacgcgggcgccggaag

SEQ ID NO: 567573 - DNA, 20 bp, mouse
gactggacagagtccgatgt

SEQ ID NO: 567574 - DNA, 20 bp, mouse
gcttctggagatcgcaccgt

SEQ ID NO: 567575 - DNA, 20 bp, mouse
gtcttcttcgaggactttgg

SEQ ID NO: 567576 - DNA, 20 bp, mouse
gagctcggcgaggagcctga

SEQ ID NO: 567577 - DNA, 20 bp, mouse
gtcggcgaggagcctgaagg

SEQ ID NO: 567578 - DNA, 20 bp, mouse
gaacacctggtgcacgtcca

SEQ ID NO: 567579 - DNA, 20 bp, mouse
gagcgaccacctgctcgaag

SEQ ID NO: 567580 - DNA, 20 bp, mouse
gcacctgctcgaaggggtac

SEQ ID NO: 567581 - DNA, 20 bp, mouse
ggaaggggtactggaacacc

SEQ ID NO: 567582 - DNA, 20 bp, mouse
gcatgacatgggggtcaccg

SEQ ID NO: 567583 - DNA, 20 bp, mouse
gagggactgatacctttcgg

SEQ ID NO: 567584 - DNA, 20 bp, mouse
ggtctgtacccaaccctcat

SEQ ID NO: 567585 - DNA, 20 bp, mouse
gcgctggagggggactcgga

SEQ ID NO: 567586 - DNA, 20 bp, mouse
gacgcagacacgcaccaact

SEQ ID NO: 567587 - DNA, 20 bp, mouse
ggagagccagctagaagttc

SEQ ID NO: 567588 - DNA, 20 bp, mouse
gatctggtagaagaaaagtc

SEQ ID NO: 567589 - DNA, 20 bp, mouse
gccaccctttgctggagctg

SEQ ID NO: 567590 - DNA, 20 bp, mouse
ggctccagcaaagggtgggg

SEQ ID NO: 567591 - DNA, 20 bp, mouse
ggaagttctggtctcccagt

SEQ ID NO: 567592 - DNA, 20 bp, mouse
gagctagagagaacccctgg

SEQ ID NO: 567593 - DNA, 20 bp, mouse
gacgctaggatgcaggatgt

SEQ ID NO: 567594 - DNA, 20 bp, mouse
gagagagaacccctggagga

SEQ ID NO: 567595 - DNA, 20 bp, mouse
gagtgggggagaagactaga

SEQ ID NO: 567596 - DNA, 20 bp, mouse
gcacgggcggactcacggtg

SEQ ID NO: 567597 - DNA, 20 bp, mouse
gctcgtcgcggtacacgtcg

SEQ ID NO: 567598 - DNA, 20 bp, mouse
ggcgtgcacgggcggactca

SEQ ID NO: 567599 - DNA, 20 bp, mouse
ggagagcggggtactcacgg

SEQ ID NO: 567600 - DNA, 20 bp, mouse
gccccaaggacagacccccc

SEQ ID NO: 567601 - DNA, 20 bp, mouse
gtccgggcgcgggctgaagg

SEQ ID NO: 567602 - DNA, 20 bp, mouse
ggccgagcggcgttgaccac

SEQ ID NO: 567603 - DNA, 20 bp, mouse
gtacacgtcggggtactgga

SEQ ID NO: 567604 - DNA, 20 bp, mouse
gactcacggaggtctcgtcg

SEQ ID NO: 567605 - DNA, 20 bp, mouse
gggtgagagcggggtactca

SEQ ID NO: 567606 - DNA, 20 bp, mouse
gggctggcttcggctggaca

SEQ ID NO: 567607 - DNA, 20 bp, mouse
gcttcggctggacaaggctg

SEQ ID NO: 567608 - DNA, 20 bp, mouse
gtgaggaatggctggaaggt

SEQ ID NO: 567609 - DNA, 20 bp, mouse
ggctctgggcggcgcgaggt

SEQ ID NO: 567610 - DNA, 20 bp, mouse
ggctgcaaactagctctggg

SEQ ID NO: 567611 - DNA, 20 bp, mouse
gggacgtgagggaatggtac

SEQ ID NO: 567612 - DNA, 20 bp, mouse
gtggtggccatcttaagtga

SEQ ID NO: 567613 - DNA, 20 bp, mouse
ggaaaccgaagctctccaga

SEQ ID NO: 567614 - DNA, 20 bp, mouse
gagtgagggcgagccggagt

SEQ ID NO: 567615 - DNA, 20 bp, mouse
ggaggatagggagactggtg

SEQ ID NO: 567616 - DNA, 20 bp, mouse
gacctcggcgcgggaagttc

SEQ ID NO: 567617 - DNA, 20 bp, mouse
gagcccggacgcctaagccg

SEQ ID NO: 567618 - DNA, 20 bp, mouse
ggggcgccgcgcggctatgg

SEQ ID NO: 567619 - DNA, 20 bp, mouse
gccgcgccgaggtcgcgccg

SEQ ID NO: 567620 - DNA, 20 bp, mouse
gctatggaggcacccggcag

SEQ ID NO: 567621 - DNA, 20 bp, mouse
gcgggctccgcatcccggac

SEQ ID NO: 567622 - DNA, 20 bp, mouse
ggcggcgcctgtccgggatg

SEQ ID NO: 567623 - DNA, 20 bp, mouse
gaggcacccggcagcggtgg

SEQ ID NO: 567624 - DNA, 20 bp, mouse
ggcgtactcaacgagatcct

SEQ ID NO: 567625 - DNA, 20 bp, mouse
gctgccccgggcccgctgag

SEQ ID NO: 567626 - DNA, 20 bp, mouse
gctcagaacgggacagtccc

SEQ ID NO: 567627 - DNA, 20 bp, mouse
gtccggctgggactcggcag

SEQ ID NO: 567628 - DNA, 20 bp, mouse
ggaggcggctccagccacag

SEQ ID NO: 567629 - DNA, 20 bp, mouse
gccgctgctccggcctcacg

SEQ ID NO: 567630 - DNA, 20 bp, mouse
gctcgggctggagccgcgtg

SEQ ID NO: 567631 - DNA, 20 bp, mouse
ggctgggttcccgctctccg

SEQ ID NO: 567632 - DNA, 20 bp, mouse
gggctgggactcggcagagg

SEQ ID NO: 567633 - DNA, 20 bp, mouse
gacgcgttccggctgggact

SEQ ID NO: 567634 - DNA, 20 bp, mouse
gactttgctggcggcagtgg

SEQ ID NO: 567635 - DNA, 20 bp, mouse
gggccttgaagaactcgcgt

SEQ ID NO: 567636 - DNA, 20 bp, mouse
ggtgtccccctgggcttcag

SEQ ID NO: 567637 - DNA, 20 bp, mouse
ggcttcagtggcgtcttggt

SEQ ID NO: 567638 - DNA, 20 bp, mouse
ggggaggttgagataccctg

SEQ ID NO: 567639 - DNA, 20 bp, mouse
gggtgggacttcaggtaagg

SEQ ID NO: 567640 - DNA, 20 bp, mouse
gacaacgcaggtgtccccct

SEQ ID NO: 567641 - DNA, 20 bp, mouse
gagacgccactgaagcccag

SEQ ID NO: 567642 - DNA, 20 bp, mouse
gacacctgcgttgtcaatgg

SEQ ID NO: 567643 - DNA, 20 bp, mouse
gcttcaggtaaggaggagga

SEQ ID NO: 567644 - DNA, 20 bp, mouse
gtgggttggtgacaactcgg

SEQ ID NO: 567645 - DNA, 20 bp, mouse
ggggacacctgcgttgtcaa

SEQ ID NO: 567646 - DNA, 20 bp, mouse
gagccctcagcctaggtcag

SEQ ID NO: 567647 - DNA, 20 bp, mouse
gaacttgacaagacccagga

SEQ ID NO: 567648 - DNA, 20 bp, mouse
gccactgtgagacagggtaa

SEQ ID NO: 567649 - DNA, 20 bp, mouse
gcagggaagggcacaaggtg

SEQ ID NO: 567650 - DNA, 20 bp, mouse
gaaggagcatcacttctgag

SEQ ID NO: 567651 - DNA, 20 bp, mouse
gtgcaaacttgacaagaccc

SEQ ID NO: 567652 - DNA, 20 bp, mouse
gagcccctgacctaggctga

SEQ ID NO: 567653 - DNA, 20 bp, mouse
gaaacacttacaggccctcc

SEQ ID NO: 567654 - DNA, 20 bp, mouse
gaactttccttgtcagggaa

SEQ ID NO: 567655 - DNA, 20 bp, mouse
gagaccataaggagcagctc

SEQ ID NO: 567656 - DNA, 20 bp, mouse
ggtggaggtcacagaccctt

SEQ ID NO: 567657 - DNA, 20 bp, mouse
ggaacagccaggaagatctt

SEQ ID NO: 567658 - DNA, 20 bp, mouse
gccacagccactgagcgtgg

SEQ ID NO: 567659 - DNA, 20 bp, mouse
ggaccaggatcccaactgga

SEQ ID NO: 567660 - DNA, 20 bp, mouse
gagtctgaaacaggcatcag

SEQ ID NO: 567661 - DNA, 20 bp, mouse
gcatcaggggtgggcaagat

SEQ ID NO: 567662 - DNA, 20 bp, mouse
gctcacacatagcacagacc

SEQ ID NO: 567663 - DNA, 20 bp, mouse
gggccctccagttgggatcc

SEQ ID NO: 567664 - DNA, 20 bp, mouse
ggtggtcctagggaacagcc

SEQ ID NO: 567665 - DNA, 20 bp, mouse
gtaaccacagccactgagcg

SEQ ID NO: 567666 - DNA, 20 bp, mouse
gtataagacttccagcacac

SEQ ID NO: 567667 - DNA, 20 bp, mouse
gatagcagtgcaaatggact

SEQ ID NO: 567668 - DNA, 20 bp, mouse
gtaactcagtataaattcac

SEQ ID NO: 567669 - DNA, 20 bp, mouse
ggatgaaccaattagtccaa

SEQ ID NO: 567670 - DNA, 20 bp, mouse
gtatactgagttaagttgga

SEQ ID NO: 567671 - DNA, 20 bp, mouse
gaccaattagtccaaaggtt

SEQ ID NO: 567672 - DNA, 20 bp, mouse
gtctgaggtattacagtggt

SEQ ID NO: 567673 - DNA, 20 bp, mouse
gctgagttaagttggaaggt

SEQ ID NO: 567674 - DNA, 20 bp, mouse
gagcagcttcaatgaaagtg

SEQ ID NO: 567675 - DNA, 20 bp, mouse
ggcagtctgtactcacagtg

SEQ ID NO: 567676 - DNA, 20 bp, mouse
gacaggatacaacagtgtag

SEQ ID NO: 567677 - DNA, 20 bp, mouse
gacgggcactgataatatat

SEQ ID NO: 567678 - DNA, 20 bp, mouse
ggtgtgtgtaaactattaca

SEQ ID NO: 567679 - DNA, 20 bp, mouse
gatgactcttcttaaataac

SEQ ID NO: 567680 - DNA, 20 bp, mouse
gtttgttgaacagtaaagca

SEQ ID NO: 567681 - DNA, 20 bp, mouse
gcttcttccagcacagactc

SEQ ID NO: 567682 - DNA, 20 bp, mouse
gctgctcaggaaccccgtga

SEQ ID NO: 567683 - DNA, 20 bp, mouse
gcagcagggccactgtaaac

SEQ ID NO: 567684 - DNA, 20 bp, mouse
gctggtggtcctgtttacag

SEQ ID NO: 567685 - DNA, 20 bp, mouse
gtgaaggtatgagaatatgg

SEQ ID NO: 567686 - DNA, 20 bp, mouse
gcgcggggcttgcaaggtgg

SEQ ID NO: 567687 - DNA, 20 bp, mouse
gcggtccaggtcagcgcagg

SEQ ID NO: 567688 - DNA, 20 bp, mouse
gtgcagccgagcagcggccc

SEQ ID NO: 567689 - DNA, 20 bp, mouse
gtccgcctgcagccgagcag

SEQ ID NO: 567690 - DNA, 20 bp, mouse
gcggccacgcgagatcgggg

SEQ ID NO: 567691 - DNA, 20 bp, mouse
gaggcggcgcggggcttgca

SEQ ID NO: 567692 - DNA, 20 bp, mouse
gaggtcagcgcaggcggcgc

SEQ ID NO: 567693 - DNA, 20 bp, mouse
gagccgggcccgtagcgctg

SEQ ID NO: 567694 - DNA, 20 bp, mouse
gctctcgcgcgtggggtgag

SEQ ID NO: 567695 - DNA, 20 bp, mouse
gcaaggtggtggcggctccc

SEQ ID NO: 567696 - DNA, 20 bp, mouse
gcgccgcgctccatcccccg

SEQ ID NO: 567697 - DNA, 20 bp, mouse
gccgcagtcctgtgccacgg

SEQ ID NO: 567698 - DNA, 20 bp, mouse
gagcgcgctgcagacggccc

SEQ ID NO: 567699 - DNA, 20 bp, mouse
gaagtttacagaagcttcca

SEQ ID NO: 567700 - DNA, 20 bp, mouse
gcgtgccggagccgagctgg

SEQ ID NO: 567701 - DNA, 20 bp, mouse
ggctccatcccccgtggcac

SEQ ID NO: 567702 - DNA, 20 bp, mouse
ggtggacacctgccagagga

SEQ ID NO: 567703 - DNA, 20 bp, mouse
gggtagggactgccaccggg

SEQ ID NO: 567704 - DNA, 20 bp, mouse
gcgacgccctggtggcacag

SEQ ID NO: 567705 - DNA, 20 bp, mouse
gagtcctgtgccacggggga

SEQ ID NO: 567706 - DNA, 20 bp, mouse
gagtccacccgccctcccgg

SEQ ID NO: 567707 - DNA, 20 bp, mouse
gcgcgagctccggctgaaca

SEQ ID NO: 567708 - DNA, 20 bp, mouse
gcgcgctgcagccgccggga

SEQ ID NO: 567709 - DNA, 20 bp, mouse
ggctccggctgaacatggcc

SEQ ID NO: 567710 - DNA, 20 bp, mouse
gcccagtccacccgccctcc

SEQ ID NO: 567711 - DNA, 20 bp, mouse
ggtggaggacactcaccgag

SEQ ID NO: 567712 - DNA, 20 bp, mouse
ggaggacactcaccgagcgg

SEQ ID NO: 567713 - DNA, 20 bp, mouse
gttcccgcacgcagcgctgt

SEQ ID NO: 567714 - DNA, 20 bp, mouse
gaaccgacagcgctgcgtgc

SEQ ID NO: 567715 - DNA, 20 bp, mouse
gcccgcggtgccctgaacta

SEQ ID NO: 567716 - DNA, 20 bp, mouse
gatgcggaggatgcaggcat

SEQ ID NO: 567717 - DNA, 20 bp, mouse
gctgctgcctgcctccggaa

SEQ ID NO: 567718 - DNA, 20 bp, mouse
gataactgtcacggagcgcc

SEQ ID NO: 567719 - DNA, 20 bp, mouse
gcaaatctgagcccttccgg

SEQ ID NO: 567720 - DNA, 20 bp, mouse
gcccaggcaggcctagaaca

SEQ ID NO: 567721 - DNA, 20 bp, mouse
gaaaatgcaagcaggactcc

SEQ ID NO: 567722 - DNA, 20 bp, mouse
gattagcatgcggaggatgc

SEQ ID NO: 567723 - DNA, 20 bp, mouse
gtcggcgagtttagaggaga

SEQ ID NO: 567724 - DNA, 20 bp, mouse
ggggcacaagtcgcactctc

SEQ ID NO: 567725 - DNA, 20 bp, mouse
gtgaccagatcaagactcgg

SEQ ID NO: 567726 - DNA, 20 bp, mouse
gggcagccgactccattcgt

SEQ ID NO: 567727 - DNA, 20 bp, mouse
ggcagggcaccgggacagag

SEQ ID NO: 567728 - DNA, 20 bp, mouse
ggccgtgcttgaatctgtct

SEQ ID NO: 567729 - DNA, 20 bp, mouse
gtggttccgacgaatggagt

SEQ ID NO: 567730 - DNA, 20 bp, mouse
gcgggacccacgcgcgaaca

SEQ ID NO: 567731 - DNA, 20 bp, mouse
ggcaccctaagggaggatct

SEQ ID NO: 567732 - DNA, 20 bp, mouse
gcacggctggttccgacgaa

SEQ ID NO: 567733 - DNA, 20 bp, mouse
gcagaggggaggcaccctaa

SEQ ID NO: 567734 - DNA, 20 bp, mouse
gaggggaggcaccctaaggg

SEQ ID NO: 567735 - DNA, 20 bp, mouse
gactaagatccaggcgaggg

SEQ ID NO: 567736 - DNA, 20 bp, mouse
gagaagggcacaggcaccgg

SEQ ID NO: 567737 - DNA, 20 bp, mouse
gctcagggcaagaagggcac

SEQ ID NO: 567738 - DNA, 20 bp, mouse
ggcacaggcaccggtggact

SEQ ID NO: 567739 - DNA, 20 bp, mouse
gatcgcgtagccaagtccac

SEQ ID NO: 567740 - DNA, 20 bp, mouse
gaggcgggtgcttcagaccg

SEQ ID NO: 567741 - DNA, 20 bp, mouse
gtgtgggtctcagggcaaga

SEQ ID NO: 567742 - DNA, 20 bp, mouse
ggaccgaggaaagcgcttgt

SEQ ID NO: 567743 - DNA, 20 bp, mouse
gccaagtggccctgacaagg

SEQ ID NO: 567744 - DNA, 20 bp, mouse
ggacccacaagcgctttcct

SEQ ID NO: 567745 - DNA, 20 bp, mouse
ggacttggctacgcgatgca

SEQ ID NO: 567746 - DNA, 20 bp, mouse
ggcagctccgcaggatcaaa

SEQ ID NO: 567747 - DNA, 20 bp, mouse
gtaaagaactagacccggac

SEQ ID NO: 567748 - DNA, 20 bp, mouse
gtgaagtaaagaactagacc

SEQ ID NO: 567749 - DNA, 20 bp, mouse
gtctcgtgtcagtcctgtcc

SEQ ID NO: 567750 - DNA, 20 bp, mouse
gactatcgctggctcaacta

SEQ ID NO: 567751 - DNA, 20 bp, mouse
gacaggactgacacgagaat

SEQ ID NO: 567752 - DNA, 20 bp, mouse
gttgagccagcgatagtact

SEQ ID NO: 567753 - DNA, 20 bp, mouse
gactttgggcgggatgtcct

SEQ ID NO: 567754 - DNA, 20 bp, mouse
gactatggcggaggtgatgg

SEQ ID NO: 567755 - DNA, 20 bp, mouse
gatggagccatttgatcctg

SEQ ID NO: 567756 - DNA, 20 bp, mouse
ggaaggcgctggggccggaa

SEQ ID NO: 567757 - DNA, 20 bp, mouse
ggagagagcggctgtcagcg

SEQ ID NO: 567758 - DNA, 20 bp, mouse
ggccgctctctcccagtggc

SEQ ID NO: 567759 - DNA, 20 bp, mouse
gggggccggaagggaagtta

SEQ ID NO: 567760 - DNA, 20 bp, mouse
gagtggcgggagagttcatt

SEQ ID NO: 567761 - DNA, 20 bp, mouse
ggcggcccgggaaggcgctg

SEQ ID NO: 567762 - DNA, 20 bp, mouse
ggcgggtgtttctttcagcc

SEQ ID NO: 567763 - DNA, 20 bp, mouse
gggtgggaccgagtgacagg

SEQ ID NO: 567764 - DNA, 20 bp, mouse
gcgggagagttcatttggaa

SEQ ID NO: 567765 - DNA, 20 bp, mouse
gtagattctacctagatgag

SEQ ID NO: 567766 - DNA, 20 bp, mouse
gccgtgtcgacgatcggtgg

SEQ ID NO: 567767 - DNA, 20 bp, mouse
ggtggcgtgaggcatcggag

SEQ ID NO: 567768 - DNA, 20 bp, mouse
ggggtcgccaccaggcaagg

SEQ ID NO: 567769 - DNA, 20 bp, mouse
gcgatcgtcgacacggagaa

SEQ ID NO: 567770 - DNA, 20 bp, mouse
ggtgcgcactgaagtccctg

SEQ ID NO: 567771 - DNA, 20 bp, mouse
gctcacgccaccttgcctgg

SEQ ID NO: 567772 - DNA, 20 bp, mouse
gtgggggtcgccaccaggca

SEQ ID NO: 567773 - DNA, 20 bp, mouse
ggcaaggtggcgtgaggcat

SEQ ID NO: 567774 - DNA, 20 bp, mouse
ggccatgcacaactctgact

SEQ ID NO: 567775 - DNA, 20 bp, mouse
gtctgctctcagcagccgga

SEQ ID NO: 567776 - DNA, 20 bp, mouse
gcgtgtcccccaggatgtag

SEQ ID NO: 567777 - DNA, 20 bp, mouse
gtcctggagaaagatggcga

SEQ ID NO: 567778 - DNA, 20 bp, mouse
ggatcggccactacatcctg

SEQ ID NO: 567779 - DNA, 20 bp, mouse
gcggagcccagacacccgga

SEQ ID NO: 567780 - DNA, 20 bp, mouse
ggcgcccggcgcggacgagg

SEQ ID NO: 567781 - DNA, 20 bp, mouse
ggccgcccggaccggggata

SEQ ID NO: 567782 - DNA, 20 bp, mouse
ggcaccttcgggaaagtgaa

SEQ ID NO: 567783 - DNA, 20 bp, mouse
gtccgtatccccggtccggg

SEQ ID NO: 567784 - DNA, 20 bp, mouse
ggatacggagcccagacacc

SEQ ID NO: 567785 - DNA, 20 bp, mouse
gggctccgtatccccggtcc

SEQ ID NO: 567786 - DNA, 20 bp, mouse
gggagcccgtgcgccgaaca

SEQ ID NO: 567787 - DNA, 20 bp, mouse
ggcgctcagagcccgcggca

SEQ ID NO: 567788 - DNA, 20 bp, mouse
gctgcactgtgggtaggcgg

SEQ ID NO: 567789 - DNA, 20 bp, mouse
gtccccccggacccacgccc

SEQ ID NO: 567790 - DNA, 20 bp, mouse
gtcggaggcaccccccgcca

SEQ ID NO: 567791 - DNA, 20 bp, mouse
gtggcaggtggagcgctcgc

SEQ ID NO: 567792 - DNA, 20 bp, mouse
gctgcgtggagcctcatctg

SEQ ID NO: 567793 - DNA, 20 bp, mouse
gggcaggcgcgagcgaggcc

SEQ ID NO: 567794 - DNA, 20 bp, mouse
gacgtcctgggggacaccct

SEQ ID NO: 567795 - DNA, 20 bp, mouse
gtcagccatgttcggcgcac

SEQ ID NO: 567796 - DNA, 20 bp, mouse
gtcgcccgagccaggtaaag

SEQ ID NO: 567797 - DNA, 20 bp, mouse
gggagtgtcaggttacgctc

SEQ ID NO: 567798 - DNA, 20 bp, mouse
gcaggtaaagcggagctcgg

SEQ ID NO: 567799 - DNA, 20 bp, mouse
gctgttcggagttccagtcg

SEQ ID NO: 567800 - DNA, 20 bp, mouse
ggcgagcgcgcgatccgaga

SEQ ID NO: 567801 - DNA, 20 bp, mouse
ggagttgcgggaggagtgtc

SEQ ID NO: 567802 - DNA, 20 bp, mouse
gtggctcgggcgaccgcgac

SEQ ID NO: 567803 - DNA, 20 bp, mouse
ggttacgctccggctctgtt

SEQ ID NO: 567804 - DNA, 20 bp, mouse
gggaagcggaagtggctaag

SEQ ID NO: 567805 - DNA, 20 bp, mouse
gctggaactccgaacagagc

SEQ ID NO: 567806 - DNA, 20 bp, mouse
ggcccggagcgcatcgcccg

SEQ ID NO: 567807 - DNA, 20 bp, mouse
gacctcgggcgatgcgctcc

SEQ ID NO: 567808 - DNA, 20 bp, mouse
gccgaggtgagcggcgtggg

SEQ ID NO: 567809 - DNA, 20 bp, mouse
gcaggcggggaacacccccg

SEQ ID NO: 567810 - DNA, 20 bp, mouse
gcgcccgaggtgagcggcgt

SEQ ID NO: 567811 - DNA, 20 bp, mouse
ggatgcgctccgggctcgcg

SEQ ID NO: 567812 - DNA, 20 bp, mouse
gtggctgcagctcgagtcgg

SEQ ID NO: 567813 - DNA, 20 bp, mouse
gacgcctcggctcggagaac

SEQ ID NO: 567814 - DNA, 20 bp, mouse
gtgccgcggggaatgacacc

SEQ ID NO: 567815 - DNA, 20 bp, mouse
gaagctgctcgagctgaggg

SEQ ID NO: 567816 - DNA, 20 bp, mouse
gagagagacgcgggaagcag

SEQ ID NO: 567817 - DNA, 20 bp, mouse
gggcgggcgcagagagacgc

SEQ ID NO: 567818 - DNA, 20 bp, mouse
gacgccgccgccgccaagaa

SEQ ID NO: 567819 - DNA, 20 bp, mouse
gccgcacgcagtgaagatca

SEQ ID NO: 567820 - DNA, 20 bp, mouse
ggcgtcacggacagaggact

SEQ ID NO: 567821 - DNA, 20 bp, mouse
gttgggctgaggctcccccg

SEQ ID NO: 567822 - DNA, 20 bp, mouse
gctgaggctcccccgcgggc

SEQ ID NO: 567823 - DNA, 20 bp, mouse
gggaggcctgaaccaatggg

SEQ ID NO: 567824 - DNA, 20 bp, mouse
gggaggggccatgcagtgat

SEQ ID NO: 567825 - DNA, 20 bp, mouse
ggtctctctgcgcccgcccg

SEQ ID NO: 567826 - DNA, 20 bp, mouse
gagccagggagtgatagggt

SEQ ID NO: 567827 - DNA, 20 bp, mouse
gactaatgggtgcagggtag

SEQ ID NO: 567828 - DNA, 20 bp, mouse
gactccctggctccctctac

SEQ ID NO: 567829 - DNA, 20 bp, mouse
gtaaggggcagacagtgtct

SEQ ID NO: 567830 - DNA, 20 bp, mouse
gactcaacctgcagactaat

SEQ ID NO: 567831 - DNA, 20 bp, mouse
gggggagccctgcctgtaga

SEQ ID NO: 567832 - DNA, 20 bp, mouse
gagcccctccctgacttaag

SEQ ID NO: 567833 - DNA, 20 bp, mouse
gttcccaccctatcactccc

SEQ ID NO: 567834 - DNA, 20 bp, mouse
gtccagctccaacgatggtg

SEQ ID NO: 567835 - DNA, 20 bp, mouse
gctgcagactaatgggtgca

SEQ ID NO: 567836 - DNA, 20 bp, mouse
gtagctcttagcgtcttggt

SEQ ID NO: 567837 - DNA, 20 bp, mouse
gagtgtgctcagaggcccga

SEQ ID NO: 567838 - DNA, 20 bp, mouse
ggggcagctctggaagatga

SEQ ID NO: 567839 - DNA, 20 bp, mouse
gaagtgtaaatgcacgcgaa

SEQ ID NO: 567840 - DNA, 20 bp, mouse
gctcacaaagaactgtccag

SEQ ID NO: 567841 - DNA, 20 bp, mouse
gtgcatagctcttagcgtct

SEQ ID NO: 567842 - DNA, 20 bp, mouse
gggagtgcctgtgaaacagg

SEQ ID NO: 567843 - DNA, 20 bp, mouse
gatgggacaaatcaagtaag

SEQ ID NO: 567844 - DNA, 20 bp, mouse
gccagcttctggagggcggt

SEQ ID NO: 567845 - DNA, 20 bp, mouse
ggctgccctgtgctcttgtg

SEQ ID NO: 567846 - DNA, 20 bp, mouse
gcgggcgctagcaatggagt

SEQ ID NO: 567847 - DNA, 20 bp, mouse
gaactggcgggcgctagcaa

SEQ ID NO: 567848 - DNA, 20 bp, mouse
gcgcggtaccctgagagata

SEQ ID NO: 567849 - DNA, 20 bp, mouse
gtagcaatggagtcggtgag

SEQ ID NO: 567850 - DNA, 20 bp, mouse
ggtcggtgagtggcgcagga

SEQ ID NO: 567851 - DNA, 20 bp, mouse
gcagggagctttccaagctg

SEQ ID NO: 567852 - DNA, 20 bp, mouse
ggaggcgcccacccgagcag

SEQ ID NO: 567853 - DNA, 20 bp, mouse
gacgggtgtggcccagacct

SEQ ID NO: 567854 - DNA, 20 bp, mouse
ggcccacccgagcagaggaa

SEQ ID NO: 567855 - DNA, 20 bp, mouse
gtcgggtgggcgcctctcct

SEQ ID NO: 567856 - DNA, 20 bp, mouse
gcctctttgggcgagaggga

SEQ ID NO: 567857 - DNA, 20 bp, mouse
gtaacggcagcagtcctggg

SEQ ID NO: 567858 - DNA, 20 bp, mouse
ggcgaagactcgtcgcaatt

SEQ ID NO: 567859 - DNA, 20 bp, mouse
gagggagcctgggacccgga

SEQ ID NO: 567860 - DNA, 20 bp, mouse
gtcgaggcacagacacgaga

SEQ ID NO: 567861 - DNA, 20 bp, mouse
ggcgcgtggctccagtgtaa

SEQ ID NO: 567862 - DNA, 20 bp, mouse
gaacggtggccagagacact

SEQ ID NO: 567863 - DNA, 20 bp, mouse
gagtctggagctccagggat

SEQ ID NO: 567864 - DNA, 20 bp, mouse
ggtgtaacggcagcagtcct

SEQ ID NO: 567865 - DNA, 20 bp, mouse
gtgtgcctcgatggaaacgg

SEQ ID NO: 567866 - DNA, 20 bp, mouse
gctccagctcgggctccatg

SEQ ID NO: 567867 - DNA, 20 bp, mouse
gctggagcacacattgcctg

SEQ ID NO: 567868 - DNA, 20 bp, mouse
gcctgggaccccggtacccc

SEQ ID NO: 567869 - DNA, 20 bp, mouse
gtacacctggaacctcacac

SEQ ID NO: 567870 - DNA, 20 bp, mouse
ggaggttccaggtgtaccag

SEQ ID NO: 567871 - DNA, 20 bp, mouse
gcgccggccccctgggaccc

SEQ ID NO: 567872 - DNA, 20 bp, mouse
gcctgtcgcgcacttgctaa

SEQ ID NO: 567873 - DNA, 20 bp, mouse
gaagcacgcgggctacacac

SEQ ID NO: 567874 - DNA, 20 bp, mouse
gcacattgcctggggtaccg

SEQ ID NO: 567875 - DNA, 20 bp, mouse
ggtcccagcgccggccccct

SEQ ID NO: 567876 - DNA, 20 bp, mouse
gctatcgcagagtggtagtg

SEQ ID NO: 567877 - DNA, 20 bp, mouse
gccaccgaggaaccgaggag

SEQ ID NO: 567878 - DNA, 20 bp, mouse
ggggctaacgcagggcgagg

SEQ ID NO: 567879 - DNA, 20 bp, mouse
gacgagcaggggctaacgca

SEQ ID NO: 567880 - DNA, 20 bp, mouse
gggggtgaccgagcgtccag

SEQ ID NO: 567881 - DNA, 20 bp, mouse
gaagagccaccgaggaaccg

SEQ ID NO: 567882 - DNA, 20 bp, mouse
ggtgcaagggcggaccccgg

SEQ ID NO: 567883 - DNA, 20 bp, mouse
gccgagccgctatcgcagag

SEQ ID NO: 567884 - DNA, 20 bp, mouse
gcgggcccgcactcacctga

SEQ ID NO: 567885 - DNA, 20 bp, mouse
ggcagacgcaagagccaccg

SEQ ID NO: 567886 - DNA, 20 bp, mouse
ggatgcgcggtgcccgaggc

SEQ ID NO: 567887 - DNA, 20 bp, mouse
ggtcctcgcgcagcctcctc

SEQ ID NO: 567888 - DNA, 20 bp, mouse
gtctacaggtacgcaggctg

SEQ ID NO: 567889 - DNA, 20 bp, mouse
gcagaccctggtgggtacag

SEQ ID NO: 567890 - DNA, 20 bp, mouse
gtcgggcaccgcgcatctac

SEQ ID NO: 567891 - DNA, 20 bp, mouse
gcaggtacgcaggctggggt

SEQ ID NO: 567892 - DNA, 20 bp, mouse
gcatctaggcccggaaggag

SEQ ID NO: 567893 - DNA, 20 bp, mouse
ggagcggcgccagccaggtc

SEQ ID NO: 567894 - DNA, 20 bp, mouse
ggaactgttggcgtccaagg

SEQ ID NO: 567895 - DNA, 20 bp, mouse
gctgcgtacctgtagatgcg

SEQ ID NO: 567896 - DNA, 20 bp, mouse
gtgcccggcggtccccgcgg

SEQ ID NO: 567897 - DNA, 20 bp, mouse
gggccgggtgacaacagcag

SEQ ID NO: 567898 - DNA, 20 bp, mouse
ggtccagcttgcctgcccgg

SEQ ID NO: 567899 - DNA, 20 bp, mouse
ggccgcgtgcgtcacaaccc

SEQ ID NO: 567900 - DNA, 20 bp, mouse
gcaggcaagctggacgggcg

SEQ ID NO: 567901 - DNA, 20 bp, mouse
gctcagacccggccagaata

SEQ ID NO: 567902 - DNA, 20 bp, mouse
gctgctgcagggctacaccg

SEQ ID NO: 567903 - DNA, 20 bp, mouse
ggagtgacaggccggcgtga

SEQ ID NO: 567904 - DNA, 20 bp, mouse
gcgaagtcgacgaggtcggg

SEQ ID NO: 567905 - DNA, 20 bp, mouse
gcgacgtccgaggggcccgg

SEQ ID NO: 567906 - DNA, 20 bp, mouse
gccggcgaggctgctccgtg

SEQ ID NO: 567907 - DNA, 20 bp, mouse
gagcacagcccggggagggt

SEQ ID NO: 567908 - DNA, 20 bp, mouse
ggcgaggctgctccgtgcgg

SEQ ID NO: 567909 - DNA, 20 bp, mouse
gagcgagcacagcccgggga

SEQ ID NO: 567910 - DNA, 20 bp, mouse
ggcagagcgagcacagcccg

SEQ ID NO: 567911 - DNA, 20 bp, mouse
gctgctgcagggcttcacgg

SEQ ID NO: 567912 - DNA, 20 bp, mouse
ggagccgcgcagcccgagac

SEQ ID NO: 567913 - DNA, 20 bp, mouse
gagcaggagaacgagcgcaa

SEQ ID NO: 567914 - DNA, 20 bp, mouse
gagaccggaccgcggatagg

SEQ ID NO: 567915 - DNA, 20 bp, mouse
gtcgcagccggtagcgcccg

SEQ ID NO: 567916 - DNA, 20 bp, mouse
gccccggcggaggcaagagg

SEQ ID NO: 567917 - DNA, 20 bp, mouse
gccgggctgtcagtgagcgt

SEQ ID NO: 567918 - DNA, 20 bp, mouse
gtgagacgccgtggagtcgt

SEQ ID NO: 567919 - DNA, 20 bp, mouse
gtacccggccaacgactcca

SEQ ID NO: 567920 - DNA, 20 bp, mouse
gggcaagaggcggcccggag

SEQ ID NO: 567921 - DNA, 20 bp, mouse
gtactcgcggcggcaagagg

SEQ ID NO: 567922 - DNA, 20 bp, mouse
ggggcgggcgctgcgctact

SEQ ID NO: 567923 - DNA, 20 bp, mouse
ggcgctgcgctactcggagc

SEQ ID NO: 567924 - DNA, 20 bp, mouse
ggccacgtcctgagacgccg

SEQ ID NO: 567925 - DNA, 20 bp, mouse
gtcgcgcttcctactcgcgg

SEQ ID NO: 567926 - DNA, 20 bp, mouse
gccaagcacagctggaccag

SEQ ID NO: 567927 - DNA, 20 bp, mouse
gacctgcctggggccctaga

SEQ ID NO: 567928 - DNA, 20 bp, mouse
gcggccctgcggtccccggg

SEQ ID NO: 567929 - DNA, 20 bp, mouse
gcgggcgacagagtgcaaga

SEQ ID NO: 567930 - DNA, 20 bp, mouse
gtggaccagcggcagcagct

SEQ ID NO: 567931 - DNA, 20 bp, mouse
ggggaggcggggttacactg

SEQ ID NO: 567932 - DNA, 20 bp, mouse
gggaaaggcgcgggactagg

SEQ ID NO: 567933 - DNA, 20 bp, mouse
gtctcctcgccctcgctcgg

SEQ ID NO: 567934 - DNA, 20 bp, mouse
gggtccccgggcggcagcag

SEQ ID NO: 567935 - DNA, 20 bp, mouse
gttgcgcgcgcggggactgg

SEQ ID NO: 567936 - DNA, 20 bp, mouse
ggccgcggcgccagagcagg

SEQ ID NO: 567937 - DNA, 20 bp, mouse
gtcccgggtcccggctcgaa

SEQ ID NO: 567938 - DNA, 20 bp, mouse
gctcgaagggtagatgtcca

SEQ ID NO: 567939 - DNA, 20 bp, mouse
gacggaagtgcaaaggggag

SEQ ID NO: 567940 - DNA, 20 bp, mouse
gaggccagtggggacctccc

SEQ ID NO: 567941 - DNA, 20 bp, mouse
gacgcagggccaggcgccag

SEQ ID NO: 567942 - DNA, 20 bp, mouse
ggctctggcgccgcggcaca

SEQ ID NO: 567943 - DNA, 20 bp, mouse
gggcacacggaagtgcaaag

SEQ ID NO: 567944 - DNA, 20 bp, mouse
ggcctcctgctctggcgccg

SEQ ID NO: 567945 - DNA, 20 bp, mouse
gagcggggaatggagactac

SEQ ID NO: 567946 - DNA, 20 bp, mouse
ggccttgagggagaccaatg

SEQ ID NO: 567947 - DNA, 20 bp, mouse
gttgagggagaccaatgggg

SEQ ID NO: 567948 - DNA, 20 bp, mouse
gtctccctcaaggccaaggg

SEQ ID NO: 567949 - DNA, 20 bp, mouse
ggacaggctggagtctgaac

SEQ ID NO: 567950 - DNA, 20 bp, mouse
ggactcagaacccgccccat

SEQ ID NO: 567951 - DNA, 20 bp, mouse
gtggctctagggccccccct

SEQ ID NO: 567952 - DNA, 20 bp, mouse
gcaccctgcccaccctggac

SEQ ID NO: 567953 - DNA, 20 bp, mouse
gggagtctgaactggctcta

SEQ ID NO: 567954 - DNA, 20 bp, mouse
gcagatccagctgcaggggt

SEQ ID NO: 567955 - DNA, 20 bp, mouse
gtctatgcgtagtgaggagg

SEQ ID NO: 567956 - DNA, 20 bp, mouse
gcggtggtcagagatcatgg

SEQ ID NO: 567957 - DNA, 20 bp, mouse
ggtctcagggagagcaggcc

SEQ ID NO: 567958 - DNA, 20 bp, mouse
gctgctctccctgagaccga

SEQ ID NO: 567959 - DNA, 20 bp, mouse
gatcgcagccatcggtctca

SEQ ID NO: 567960 - DNA, 20 bp, mouse
gggcgtctcaggcacaggtc

SEQ ID NO: 567961 - DNA, 20 bp, mouse
gatcatgggggagagcgcac

SEQ ID NO: 567962 - DNA, 20 bp, mouse
gcagcccagatcgcagccat

SEQ ID NO: 567963 - DNA, 20 bp, mouse
gctgcgggcgtctcaggcac

SEQ ID NO: 567964 - DNA, 20 bp, mouse
gagaccgatggctgcgatct

SEQ ID NO: 567965 - DNA, 20 bp, mouse
ggcggttggaggccaaccac

SEQ ID NO: 567966 - DNA, 20 bp, mouse
gatcgagggaagcagatcgc

SEQ ID NO: 567967 - DNA, 20 bp, mouse
gtcgctcgcacagcgatcga

SEQ ID NO: 567968 - DNA, 20 bp, mouse
gcgcgcggatgtgagatccc

SEQ ID NO: 567969 - DNA, 20 bp, mouse
ggggcggggacgagaaccgg

SEQ ID NO: 567970 - DNA, 20 bp, mouse
gtgcttaacccgggaggtga

SEQ ID NO: 567971 - DNA, 20 bp, mouse
ggatgtgagatcccaggcac

SEQ ID NO: 567972 - DNA, 20 bp, mouse
gcctgcgccccgaacccaag

SEQ ID NO: 567973 - DNA, 20 bp, mouse
gtccgaggcaggcgctgggt

SEQ ID NO: 567974 - DNA, 20 bp, mouse
ggcctcgcgatcgccggcta

SEQ ID NO: 567975 - DNA, 20 bp, mouse
gccggcggcagccgagagcg

SEQ ID NO: 567976 - DNA, 20 bp, mouse
gaaggagccgcaggcacggg

SEQ ID NO: 567977 - DNA, 20 bp, mouse
gatcaaggagccgcaggcac

SEQ ID NO: 567978 - DNA, 20 bp, mouse
ggagccgcaggcacgggcgg

SEQ ID NO: 567979 - DNA, 20 bp, mouse
gacggcagaaagcaacaccc

SEQ ID NO: 567980 - DNA, 20 bp, mouse
gacaggggcaaggcacctaa

SEQ ID NO: 567981 - DNA, 20 bp, mouse
gaccggggagaaagcgggtg

SEQ ID NO: 567982 - DNA, 20 bp, mouse
ggcacgggcagcaccgaccg

SEQ ID NO: 567983 - DNA, 20 bp, mouse
gcgaggaaacaggtggacgg

SEQ ID NO: 567984 - DNA, 20 bp, mouse
ggcaccgaccggggagaaag

SEQ ID NO: 567985 - DNA, 20 bp, mouse
gggcggaggcgactcagagg

SEQ ID NO: 567986 - DNA, 20 bp, mouse
ggccggccagatagtctccc

SEQ ID NO: 567987 - DNA, 20 bp, mouse
gctggccggccccggagaag

SEQ ID NO: 567988 - DNA, 20 bp, mouse
ggggtcgctcctgctctccg

SEQ ID NO: 567989 - DNA, 20 bp, mouse
gagagcaggagcgacccgtc

SEQ ID NO: 567990 - DNA, 20 bp, mouse
gaagctggagctagccggac

SEQ ID NO: 567991 - DNA, 20 bp, mouse
ggctctccggggagactatc

SEQ ID NO: 567992 - DNA, 20 bp, mouse
ggcgctccagaaggacgatc

SEQ ID NO: 567993 - DNA, 20 bp, mouse
gggggctcgccccttctccg

SEQ ID NO: 567994 - DNA, 20 bp, mouse
gtccctccgaggaggcggaa

SEQ ID NO: 567995 - DNA, 20 bp, mouse
gtccggggagactatctggc

SEQ ID NO: 567996 - DNA, 20 bp, mouse
gcgcggcgcggagcgagcaa

SEQ ID NO: 567997 - DNA, 20 bp, mouse
ggaccaacacgcctagcccg

SEQ ID NO: 567998 - DNA, 20 bp, mouse
gagagtgggcgcaaccggag

SEQ ID NO: 567999 - DNA, 20 bp, mouse
ggtaggtcgccaggagtcgg

SEQ ID NO: 568000 - DNA, 20 bp, mouse
gaccctggacgtatgagtgt

SEQ ID NO: 568001 - DNA, 20 bp, mouse
ggcttcccgacaggctcggg

SEQ ID NO: 568002 - DNA, 20 bp, mouse
ggggacccgagcgatcgtgg

SEQ ID NO: 568003 - DNA, 20 bp, mouse
gtcggcctcccgagcctgtc

SEQ ID NO: 568004 - DNA, 20 bp, mouse
gcgggaggccgagaccctcg

SEQ ID NO: 568005 - DNA, 20 bp, mouse
gggagtcggcggaggagagt

SEQ ID NO: 568006 - DNA, 20 bp, mouse
ggcctgagtgccagaaaggg

SEQ ID NO: 568007 - DNA, 20 bp, mouse
gagcctccgggtcccagtcg

SEQ ID NO: 568008 - DNA, 20 bp, mouse
gcgacccaagggtactccgg

SEQ ID NO: 568009 - DNA, 20 bp, mouse
gcgccgcaggcagcgcgaag

SEQ ID NO: 568010 - DNA, 20 bp, mouse
gtggcgacccaagggtactc

SEQ ID NO: 568011 - DNA, 20 bp, mouse
gtgccgcgactgggacccgg

SEQ ID NO: 568012 - DNA, 20 bp, mouse
gcccttcaggccctgatctt

SEQ ID NO: 568013 - DNA, 20 bp, mouse
gggatgaagcagtcaccggg

SEQ ID NO: 568014 - DNA, 20 bp, mouse
gcgcgggcctggcgacccaa

SEQ ID NO: 568015 - DNA, 20 bp, mouse
gcgcggccgcgacaccaggt

SEQ ID NO: 568016 - DNA, 20 bp, mouse
gcatcacctacgcgaggtag

SEQ ID NO: 568017 - DNA, 20 bp, mouse
gtattctactgcaggaaccg

SEQ ID NO: 568018 - DNA, 20 bp, mouse
gctacgcgaggtagaggcaa

SEQ ID NO: 568019 - DNA, 20 bp, mouse
gggtcaatagccaccacacc

SEQ ID NO: 568020 - DNA, 20 bp, mouse
gctgcagtagaataagagaa

SEQ ID NO: 568021 - DNA, 20 bp, mouse
gctctttaccgagagaccta

SEQ ID NO: 568022 - DNA, 20 bp, mouse
gagaccggaagtgtgttatg

SEQ ID NO: 568023 - DNA, 20 bp, mouse
gatcggagttggaagtgcaa

SEQ ID NO: 568024 - DNA, 20 bp, mouse
gctacttcatcacctacgcg

SEQ ID NO: 568025 - DNA, 20 bp, mouse
gtctctccgccccgagccag

SEQ ID NO: 568026 - DNA, 20 bp, mouse
ggccggccgtagcttcccag

SEQ ID NO: 568027 - DNA, 20 bp, mouse
gacccgggcctggagacatg

SEQ ID NO: 568028 - DNA, 20 bp, mouse
gcgggcctggagacatgagg

SEQ ID NO: 568029 - DNA, 20 bp, mouse
gaagctacggccggcagctg

SEQ ID NO: 568030 - DNA, 20 bp, mouse
gggtggtacccggctcccct

SEQ ID NO: 568031 - DNA, 20 bp, mouse
gtcccctgggaagctacggc

SEQ ID NO: 568032 - DNA, 20 bp, mouse
gtccaggcccgggtggtacc

SEQ ID NO: 568033 - DNA, 20 bp, mouse
gggcagagatgtgagaggcg

SEQ ID NO: 568034 - DNA, 20 bp, mouse
gtgaggcacgcgctaaaaca

SEQ ID NO: 568035 - DNA, 20 bp, mouse
gcgaaggtgggcgtgcaagg

SEQ ID NO: 568036 - DNA, 20 bp, mouse
ggcgcgcagcacgggacaga

SEQ ID NO: 568037 - DNA, 20 bp, mouse
gcggaagggagcgcgcggaa

SEQ ID NO: 568038 - DNA, 20 bp, mouse
gcagacggcggaacgcggaa

SEQ ID NO: 568039 - DNA, 20 bp, mouse
gggaagggagcgcgcagcac

SEQ ID NO: 568040 - DNA, 20 bp, mouse
ggcgcaccgcccaagttccg

SEQ ID NO: 568041 - DNA, 20 bp, mouse
gcaactccgcggaacttggg

SEQ ID NO: 568042 - DNA, 20 bp, mouse
gttccgcggagttggcgagg

SEQ ID NO: 568043 - DNA, 20 bp, mouse
gaagttccgcggagttggcg

SEQ ID NO: 568044 - DNA, 20 bp, mouse
gacccgcctcgccaactccg

SEQ ID NO: 568045 - DNA, 20 bp, mouse
gtccctcgggccacattgaa

SEQ ID NO: 568046 - DNA, 20 bp, mouse
ggggaggcgcccagctactg

SEQ ID NO: 568047 - DNA, 20 bp, mouse
gtccgctccggggaccacgg

SEQ ID NO: 568048 - DNA, 20 bp, mouse
ggcgcgaccggagctggtga

SEQ ID NO: 568049 - DNA, 20 bp, mouse
ggagcctgggaccagcgcag

SEQ ID NO: 568050 - DNA, 20 bp, mouse
gcgccgcggccgcagtagct

SEQ ID NO: 568051 - DNA, 20 bp, mouse
gggctaggcggtcgcagcag

SEQ ID NO: 568052 - DNA, 20 bp, mouse
gaggcggtcgcagcagcgga

SEQ ID NO: 568053 - DNA, 20 bp, mouse
gtctccgccgccgcaggcag

SEQ ID NO: 568054 - DNA, 20 bp, mouse
ggccagtgagccccaaagtt

SEQ ID NO: 568055 - DNA, 20 bp, mouse
gcctgggaccagcgcagcgg

SEQ ID NO: 568056 - DNA, 20 bp, mouse
ggcgggtcggggacaaggga

SEQ ID NO: 568057 - DNA, 20 bp, mouse
gagggagggtcgcacagcgc

SEQ ID NO: 568058 - DNA, 20 bp, mouse
gcggcccagaaggaagtctc

SEQ ID NO: 568059 - DNA, 20 bp, mouse
ggacggcaggaccaaagtca

SEQ ID NO: 568060 - DNA, 20 bp, mouse
gcggggcgggtcggggacaa

SEQ ID NO: 568061 - DNA, 20 bp, mouse
gcagggatctagtggatcgt

SEQ ID NO: 568062 - DNA, 20 bp, mouse
gagtctgaccagggatctag

SEQ ID NO: 568063 - DNA, 20 bp, mouse
gtggatcgtaggaacccgac

SEQ ID NO: 568064 - DNA, 20 bp, mouse
gtcggcagcggcggcccaga

SEQ ID NO: 568065 - DNA, 20 bp, mouse
gcccccttcaaagtttaagt

SEQ ID NO: 568066 - DNA, 20 bp, mouse
gacgggtcgggagaacaaag

SEQ ID NO: 568067 - DNA, 20 bp, mouse
gctccagcgactacttacag

SEQ ID NO: 568068 - DNA, 20 bp, mouse
ggcctcgctggctcctgctc

SEQ ID NO: 568069 - DNA, 20 bp, mouse
gtggctcctgctccgggacg

SEQ ID NO: 568070 - DNA, 20 bp, mouse
ggaggcgcgtgaagcctcgc

SEQ ID NO: 568071 - DNA, 20 bp, mouse
gagcgtccgcgtcccggagc

SEQ ID NO: 568072 - DNA, 20 bp, mouse
gcgccggcggcaggattagt

SEQ ID NO: 568073 - DNA, 20 bp, mouse
gtccggcctcgagacgggac

SEQ ID NO: 568074 - DNA, 20 bp, mouse
gggcctcgagacgggacggg

SEQ ID NO: 568075 - DNA, 20 bp, mouse
ggctgggcgggaagtcgggg

SEQ ID NO: 568076 - DNA, 20 bp, mouse
gagcggtgccggcgtgatgg

SEQ ID NO: 568077 - DNA, 20 bp, mouse
gggaggagggaaccggcgta

SEQ ID NO: 568078 - DNA, 20 bp, mouse
gcgaagcggtgccggcgtga

SEQ ID NO: 568079 - DNA, 20 bp, mouse
gccctcctccgccatcacgc

SEQ ID NO: 568080 - DNA, 20 bp, mouse
ggggaaccggcgtacggtgt

SEQ ID NO: 568081 - DNA, 20 bp, mouse
ggagacgcgcatgcgcgaag

SEQ ID NO: 568082 - DNA, 20 bp, mouse
gggtgccggcgtgatggcgg

SEQ ID NO: 568083 - DNA, 20 bp, mouse
gagtagccaacaccgtacgc

SEQ ID NO: 568084 - DNA, 20 bp, mouse
gctgcagtgcagggtgggta

SEQ ID NO: 568085 - DNA, 20 bp, mouse
ggcactgcagcggtctgctg

SEQ ID NO: 568086 - DNA, 20 bp, mouse
ggtactctcaccaagcgact

SEQ ID NO: 568087 - DNA, 20 bp, mouse
ggactgggaaagggggacga

SEQ ID NO: 568088 - DNA, 20 bp, mouse
gaagctcagaggggaggatg

SEQ ID NO: 568089 - DNA, 20 bp, mouse
ggaggaagggcggctctaat

SEQ ID NO: 568090 - DNA, 20 bp, mouse
gaggtcgtggaaggacctgt

SEQ ID NO: 568091 - DNA, 20 bp, mouse
gccgagaggtaggctcaggg

SEQ ID NO: 568092 - DNA, 20 bp, mouse
ggcaggagcgatcgcaggag

SEQ ID NO: 568093 - DNA, 20 bp, mouse
ggccgtcccagccgccgtct

SEQ ID NO: 568094 - DNA, 20 bp, mouse
gcgagggagggggggtctca

SEQ ID NO: 568095 - DNA, 20 bp, mouse
gagcgcagtgagcctgagac

SEQ ID NO: 568096 - DNA, 20 bp, mouse
ggcgctgcgggagggagctg

SEQ ID NO: 568097 - DNA, 20 bp, mouse
ggagggagctgcggcgacgt

SEQ ID NO: 568098 - DNA, 20 bp, mouse
gctgcgtgggagccgggacg

SEQ ID NO: 568099 - DNA, 20 bp, mouse
gcggcccccgcagagcagcc

SEQ ID NO: 568100 - DNA, 20 bp, mouse
gccggcgcgcctccttctcg

SEQ ID NO: 568101 - DNA, 20 bp, mouse
gccgcctggctgctctgcgg

SEQ ID NO: 568102 - DNA, 20 bp, mouse
gtcccacgcagcgcgagcgg

SEQ ID NO: 568103 - DNA, 20 bp, mouse
gacgctgcggccgcgcggag

SEQ ID NO: 568104 - DNA, 20 bp, mouse
gcacctggaaagttacccgg

SEQ ID NO: 568105 - DNA, 20 bp, mouse
gcagccccagaagagcccaa

SEQ ID NO: 568106 - DNA, 20 bp, mouse
gaggcaggcagcgattcgag

SEQ ID NO: 568107 - DNA, 20 bp, mouse
gcctccagctaagggacagg

SEQ ID NO: 568108 - DNA, 20 bp, mouse
ggattcgaggggcgtccaag

SEQ ID NO: 568109 - DNA, 20 bp, mouse
gctccctccagctaagggac

SEQ ID NO: 568110 - DNA, 20 bp, mouse
gacgtcggccagttcccgag

SEQ ID NO: 568111 - DNA, 20 bp, mouse
gctcaaggcccaagacgggt

SEQ ID NO: 568112 - DNA, 20 bp, mouse
ggcgcgggcacgctcctctc

SEQ ID NO: 568113 - DNA, 20 bp, mouse
ggcctgcctccctccagcta

SEQ ID NO: 568114 - DNA, 20 bp, mouse
gctgcctagggtcactagag

SEQ ID NO: 568115 - DNA, 20 bp, mouse
gaggcctcaaggcccaagac

SEQ ID NO: 568116 - DNA, 20 bp, mouse
gaggagtaggagagcggcta

SEQ ID NO: 568117 - DNA, 20 bp, mouse
gccgccggcagctttcgtaa

SEQ ID NO: 568118 - DNA, 20 bp, mouse
gtcgtaaaggagtaggagag

SEQ ID NO: 568119 - DNA, 20 bp, mouse
ggcagctttcgtaaaggagt

SEQ ID NO: 568120 - DNA, 20 bp, mouse
gtccccctagagcaaccctg

SEQ ID NO: 568121 - DNA, 20 bp, mouse
ggccccagggttgctctagg

SEQ ID NO: 568122 - DNA, 20 bp, mouse
gtggggatgaccagcgtctg

SEQ ID NO: 568123 - DNA, 20 bp, mouse
gctgtcgtcatcaatacgag

SEQ ID NO: 568124 - DNA, 20 bp, mouse
ggagagggcggccccgtgga

SEQ ID NO: 568125 - DNA, 20 bp, mouse
ggagcgaggctccctccacg

SEQ ID NO: 568126 - DNA, 20 bp, mouse
gtcccctccccgcctcgtca

SEQ ID NO: 568127 - DNA, 20 bp, mouse
gtcccctccccggccccgcg

SEQ ID NO: 568128 - DNA, 20 bp, mouse
gccgcgctgccctgacgagg

SEQ ID NO: 568129 - DNA, 20 bp, mouse
ggcgcgaaggcggatgaagt

SEQ ID NO: 568130 - DNA, 20 bp, mouse
gcccagtgggtgccacccgg

SEQ ID NO: 568131 - DNA, 20 bp, mouse
gccgccttcgcgcccccggg

SEQ ID NO: 568132 - DNA, 20 bp, mouse
ggccctgacgaggcggggag

SEQ ID NO: 568133 - DNA, 20 bp, mouse
gctcttccgtgtgcagttgg

SEQ ID NO: 568134 - DNA, 20 bp, mouse
gtggcgcgcgaagccgcgag

SEQ ID NO: 568135 - DNA, 20 bp, mouse
gcaaggccgcgcgcggagga

SEQ ID NO: 568136 - DNA, 20 bp, mouse
ggcttccgccgggaatgaag

SEQ ID NO: 568137 - DNA, 20 bp, mouse
gcaaccctcttcattcccgg

SEQ ID NO: 568138 - DNA, 20 bp, mouse
gaagtcgcccgagggctcca

SEQ ID NO: 568139 - DNA, 20 bp, mouse
gcccgcggccgagaggacaa

SEQ ID NO: 568140 - DNA, 20 bp, mouse
gccgcaaccctcttcattcc

SEQ ID NO: 568141 - DNA, 20 bp, mouse
gcgcccagccggcttccgcc

SEQ ID NO: 568142 - DNA, 20 bp, mouse
gttcccggcggaagccggct

SEQ ID NO: 568143 - DNA, 20 bp, mouse
ggaccggcttgtgacggcgg

SEQ ID NO: 568144 - DNA, 20 bp, mouse
gggcccagtaatgagagtgt

SEQ ID NO: 568145 - DNA, 20 bp, mouse
gaccagcgggcggctccatg

SEQ ID NO: 568146 - DNA, 20 bp, mouse
ggccaggggtcagcccagaa

SEQ ID NO: 568147 - DNA, 20 bp, mouse
gacctttctgggctgacccc

SEQ ID NO: 568148 - DNA, 20 bp, mouse
gcatgaccatgaacagccag

SEQ ID NO: 568149 - DNA, 20 bp, mouse
gcatggtcatggtgactgct

SEQ ID NO: 568150 - DNA, 20 bp, mouse
gctacagaacatacctttct

SEQ ID NO: 568151 - DNA, 20 bp, mouse
gtattcctgatatggcatag

SEQ ID NO: 568152 - DNA, 20 bp, mouse
gggaacacacttctccaaga

SEQ ID NO: 568153 - DNA, 20 bp, mouse
gaaggagatgagaacatcat

SEQ ID NO: 568154 - DNA, 20 bp, mouse
gctgtagcttagtgactatg

SEQ ID NO: 568155 - DNA, 20 bp, mouse
gagaaagctgtggttctctc

SEQ ID NO: 568156 - DNA, 20 bp, mouse
gctctgaggagttccacagc

SEQ ID NO: 568157 - DNA, 20 bp, mouse
ggcaggctgactacagcgtc

SEQ ID NO: 568158 - DNA, 20 bp, mouse
gcttaaggtaggactgcatt

SEQ ID NO: 568159 - DNA, 20 bp, mouse
ggggaaccagatcagcatat

SEQ ID NO: 568160 - DNA, 20 bp, mouse
gaggaggaaaaattaactta

SEQ ID NO: 568161 - DNA, 20 bp, mouse
gggaaaaattaacttaaggt

SEQ ID NO: 568162 - DNA, 20 bp, mouse
gaggaacatagttgaactca

SEQ ID NO: 568163 - DNA, 20 bp, mouse
gctgaagaagagttagtgac

SEQ ID NO: 568164 - DNA, 20 bp, mouse
gcacttcactgggcaaggtg

SEQ ID NO: 568165 - DNA, 20 bp, mouse
gagaattacttactgcagca

SEQ ID NO: 568166 - DNA, 20 bp, mouse
gtgaatcagcacacaagctt

SEQ ID NO: 568167 - DNA, 20 bp, mouse
ggatgtggaaagttaagaga

SEQ ID NO: 568168 - DNA, 20 bp, mouse
gacatacaaagtagtagtgg

SEQ ID NO: 568169 - DNA, 20 bp, mouse
gtgtccaattatccaggata

SEQ ID NO: 568170 - DNA, 20 bp, mouse
gtttgttcttacttaaccag

SEQ ID NO: 568171 - DNA, 20 bp, mouse
gaatatttaagcatctgtag

SEQ ID NO: 568172 - DNA, 20 bp, mouse
gcaaagtagtagtggcggca

SEQ ID NO: 568173 - DNA, 20 bp, mouse
gagcaaagacatatagactt

SEQ ID NO: 568174 - DNA, 20 bp, mouse
ggcttaaatattatgttaca

SEQ ID NO: 568175 - DNA, 20 bp, mouse
gggttaatcattgctctaga

SEQ ID NO: 568176 - DNA, 20 bp, mouse
gatcagcagccaagctacag

SEQ ID NO: 568177 - DNA, 20 bp, mouse
ggcggagtcccactgtagct

SEQ ID NO: 568178 - DNA, 20 bp, mouse
gtcagagaagagcaacttac

SEQ ID NO: 568179 - DNA, 20 bp, mouse
gagagcaacttacaggaact

SEQ ID NO: 568180 - DNA, 20 bp, mouse
gagatgttaaagtcaactgg

SEQ ID NO: 568181 - DNA, 20 bp, mouse
ggtagcttggctgctgattc

SEQ ID NO: 568182 - DNA, 20 bp, mouse
gtggaaagttaactggagac

SEQ ID NO: 568183 - DNA, 20 bp, mouse
gtttatctgcttgacttctt

SEQ ID NO: 568184 - DNA, 20 bp, mouse
ggaaatgttcactcttacaa

SEQ ID NO: 568185 - DNA, 20 bp, mouse
gcgacattgacatataatat

SEQ ID NO: 568186 - DNA, 20 bp, mouse
gcaaagggcaaacagctgaa

SEQ ID NO: 568187 - DNA, 20 bp, mouse
gatatgcagataggtccaaa

SEQ ID NO: 568188 - DNA, 20 bp, mouse
gatatcttgtatatgcagat

SEQ ID NO: 568189 - DNA, 20 bp, mouse
gtgattgaaaggatacttac

SEQ ID NO: 568190 - DNA, 20 bp, mouse
gaacatggttgactcaaaac

SEQ ID NO: 568191 - DNA, 20 bp, mouse
gttagagaaacatgattgaa

SEQ ID NO: 568192 - DNA, 20 bp, mouse
gccagatttgctaaggacac

SEQ ID NO: 568193 - DNA, 20 bp, mouse
gtgcattttcttactagaat

SEQ ID NO: 568194 - DNA, 20 bp, mouse
gcagctttccagatttgcta

SEQ ID NO: 568195 - DNA, 20 bp, mouse
gacatgtttattgctgtcat

SEQ ID NO: 568196 - DNA, 20 bp, mouse
gaagtgctgacaacaccaga

SEQ ID NO: 568197 - DNA, 20 bp, mouse
gatgggaggcatagagctga

SEQ ID NO: 568198 - DNA, 20 bp, mouse
gtcggggaacagcagccttc

SEQ ID NO: 568199 - DNA, 20 bp, mouse
ggaatccggtctgagatcaa

SEQ ID NO: 568200 - DNA, 20 bp, mouse
gctgtacagctacttacaga

SEQ ID NO: 568201 - DNA, 20 bp, mouse
ggagatcaatggttctctag

SEQ ID NO: 568202 - DNA, 20 bp, mouse
gcttatatatcagttactca

SEQ ID NO: 568203 - DNA, 20 bp, mouse
gagtaatgaaacaatgtgtc

SEQ ID NO: 568204 - DNA, 20 bp, mouse
gtgtcaggagttgctgaatc

SEQ ID NO: 568205 - DNA, 20 bp, mouse
gagggaatgcaaaatgtcta

SEQ ID NO: 568206 - DNA, 20 bp, mouse
gtgaaggcagcactcaggtt

SEQ ID NO: 568207 - DNA, 20 bp, mouse
gtaggtacaaccctaactga

SEQ ID NO: 568208 - DNA, 20 bp, mouse
gacagataaagttcacttac

SEQ ID NO: 568209 - DNA, 20 bp, mouse
gcttcctcactttgagtcta

SEQ ID NO: 568210 - DNA, 20 bp, mouse
gaagcagaccttaagataag

SEQ ID NO: 568211 - DNA, 20 bp, mouse
gatggataatgtttacttag

SEQ ID NO: 568212 - DNA, 20 bp, mouse
gcatttatcaacagagatga

SEQ ID NO: 568213 - DNA, 20 bp, mouse
gaacattgtgggtgtctaac

SEQ ID NO: 568214 - DNA, 20 bp, mouse
ggttttacttgaagataaat

SEQ ID NO: 568215 - DNA, 20 bp, mouse
gagaaaccattcctttttat

SEQ ID NO: 568216 - DNA, 20 bp, mouse
gagtcttagatagttatctc

SEQ ID NO: 568217 - DNA, 20 bp, mouse
gatctcaggtttctgtttaa

SEQ ID NO: 568218 - DNA, 20 bp, mouse
gcttgttaatggtggagatt

SEQ ID NO: 568219 - DNA, 20 bp, mouse
gttacagtgtttcttgttaa

SEQ ID NO: 568220 - DNA, 20 bp, mouse
gcagtgtttcttgttaatgg

SEQ ID NO: 568221 - DNA, 20 bp, mouse
gactacttgaaaagctactt

SEQ ID NO: 568222 - DNA, 20 bp, mouse
gtggatgaatggcaacgtac

SEQ ID NO: 568223 - DNA, 20 bp, mouse
ggaatatgtctgcaatattg

SEQ ID NO: 568224 - DNA, 20 bp, mouse
gaattgttactgtaatcaat

SEQ ID NO: 568225 - DNA, 20 bp, mouse
gtacattttcagttctctaa

SEQ ID NO: 568226 - DNA, 20 bp, mouse
gtttacagtgttctggttaa

SEQ ID NO: 568227 - DNA, 20 bp, mouse
ggaaacattttacagtgttc

SEQ ID NO: 568228 - DNA, 20 bp, mouse
gagtctcagataattatctg

SEQ ID NO: 568229 - DNA, 20 bp, mouse
gattagagaactgaaaatgt

SEQ ID NO: 568230 - DNA, 20 bp, mouse
gtggaatgtagatttactct

SEQ ID NO: 568231 - DNA, 20 bp, mouse
gatctgaggtttctgtttca

SEQ ID NO: 568232 - DNA, 20 bp, mouse
gagagaggtacatggatgaa

SEQ ID NO: 568233 - DNA, 20 bp, mouse
ggactctttcaggctccggt

SEQ ID NO: 568234 - DNA, 20 bp, mouse
gagaagatccaccacaatgt

SEQ ID NO: 568235 - DNA, 20 bp, mouse
gtcacttggagcctacattg

SEQ ID NO: 568236 - DNA, 20 bp, mouse
gcagtgtttcgggttaatgg

SEQ ID NO: 568237 - DNA, 20 bp, mouse
gttacagtgtttcgggttaa

SEQ ID NO: 568238 - DNA, 20 bp, mouse
gtacattttcatttctctag

SEQ ID NO: 568239 - DNA, 20 bp, mouse
gtaatgttactgtaatcaat

SEQ ID NO: 568240 - DNA, 20 bp, mouse
gtggagtgtagatttactct

SEQ ID NO: 568241 - DNA, 20 bp, mouse
gatctaaggtttctgtttca

SEQ ID NO: 568242 - DNA, 20 bp, mouse
gaaaacattttacagtgttt

SEQ ID NO: 568243 - DNA, 20 bp, mouse
gagaagatccaccacaatgt

SEQ ID NO: 568244 - DNA, 20 bp, mouse
gtcacttggagcctacattg

SEQ ID NO: 568245 - DNA, 20 bp, mouse
gagagaggtacatggatgaa

SEQ ID NO: 568246 - DNA, 20 bp, mouse
ggcagcttggatacccaagg

SEQ ID NO: 568247 - DNA, 20 bp, mouse
gtctgcagcttggataccca

SEQ ID NO: 568248 - DNA, 20 bp, mouse
gagacagatgcatctctgag

SEQ ID NO: 568249 - DNA, 20 bp, mouse
gacttacaggaggaccattg

SEQ ID NO: 568250 - DNA, 20 bp, mouse
ggaggtggaaagttaactga

SEQ ID NO: 568251 - DNA, 20 bp, mouse
gaggatagcttcttcagttg

SEQ ID NO: 568252 - DNA, 20 bp, mouse
ggagtaatagcagtacttac

SEQ ID NO: 568253 - DNA, 20 bp, mouse
gcatggattacctgaagtaa

SEQ ID NO: 568254 - DNA, 20 bp, mouse
gtaatagcagtacttacagg

SEQ ID NO: 568255 - DNA, 20 bp, mouse
gtctgtctttgactccgcaa

SEQ ID NO: 568256 - DNA, 20 bp, mouse
gtcagtcggtacctacactg

SEQ ID NO: 568257 - DNA, 20 bp, mouse
ggctttaaggagcctaggta

SEQ ID NO: 568258 - DNA, 20 bp, mouse
ggaaaatcccaccacagtgt

SEQ ID NO: 568259 - DNA, 20 bp, mouse
ggtcggtacctacactgtgg

SEQ ID NO: 568260 - DNA, 20 bp, mouse
gggtagtacttacattggtg

SEQ ID NO: 568261 - DNA, 20 bp, mouse
gggtaaggtagtacttacat

SEQ ID NO: 568262 - DNA, 20 bp, mouse
ggtgggattttccagagatg

SEQ ID NO: 568263 - DNA, 20 bp, mouse
gtcttagacagccgcatctc

SEQ ID NO: 568264 - DNA, 20 bp, mouse
gtgctgtaagtactacatga

SEQ ID NO: 568265 - DNA, 20 bp, mouse
gcagttaccttatggagcaa

SEQ ID NO: 568266 - DNA, 20 bp, mouse
gattccgtggcccacagacg

SEQ ID NO: 568267 - DNA, 20 bp, mouse
ggggaaatgaccacgtctgt

SEQ ID NO: 568268 - DNA, 20 bp, mouse
gccagcgcagctgcattccg

SEQ ID NO: 568269 - DNA, 20 bp, mouse
ggaatgtcagccaataacct

SEQ ID NO: 568270 - DNA, 20 bp, mouse
ggattcatcttgtatacctg

SEQ ID NO: 568271 - DNA, 20 bp, mouse
gtatttaattgagaaggcct

SEQ ID NO: 568272 - DNA, 20 bp, mouse
gatctagaaaggacttgctc

SEQ ID NO: 568273 - DNA, 20 bp, mouse
gatggtgaaatctcctgctg

SEQ ID NO: 568274 - DNA, 20 bp, mouse
gcacgattcattagtttcct

SEQ ID NO: 568275 - DNA, 20 bp, mouse
gctcctgctgtggttgaagc

SEQ ID NO: 568276 - DNA, 20 bp, mouse
gatggttgagtgaaagacag

SEQ ID NO: 568277 - DNA, 20 bp, mouse
gtggattatttacgggagta

SEQ ID NO: 568278 - DNA, 20 bp, mouse
gagaaaaagacaagtgtgca

SEQ ID NO: 568279 - DNA, 20 bp, mouse
gacacaaccttagatgatca

SEQ ID NO: 568280 - DNA, 20 bp, mouse
gataggaggtggattattta

SEQ ID NO: 568281 - DNA, 20 bp, mouse
gcttctgatactagagtaca

SEQ ID NO: 568282 - DNA, 20 bp, mouse
gtttatgccctgatcatcta

SEQ ID NO: 568283 - DNA, 20 bp, mouse
gaataagctaagacagttca

SEQ ID NO: 568284 - DNA, 20 bp, mouse
gctgttgctcatgcctattc

SEQ ID NO: 568285 - DNA, 20 bp, mouse
gaagaaaatccgtttaagct

SEQ ID NO: 568286 - DNA, 20 bp, mouse
gtagactgcgtgaagcagac

SEQ ID NO: 568287 - DNA, 20 bp, mouse
gtgacatctctgaagagttc

SEQ ID NO: 568288 - DNA, 20 bp, mouse
gaggaggtggaatatttact

SEQ ID NO: 568289 - DNA, 20 bp, mouse
gccacacattcttggatcag

SEQ ID NO: 568290 - DNA, 20 bp, mouse
gaaacaatcttgtacatcag

SEQ ID NO: 568291 - DNA, 20 bp, mouse
gtttcttaaatgacctatat

SEQ ID NO: 568292 - DNA, 20 bp, mouse
gagaaaatgagacatttgac

SEQ ID NO: 568293 - DNA, 20 bp, mouse
gcttttgagactgatcactg

SEQ ID NO: 568294 - DNA, 20 bp, mouse
gaaacttcctcttcctatat

SEQ ID NO: 568295 - DNA, 20 bp, mouse
ggaaaattcacaattgtctg

SEQ ID NO: 568296 - DNA, 20 bp, mouse
gagtgccccacaaactgtgg

SEQ ID NO: 568297 - DNA, 20 bp, mouse
gagttcctccacagtttgtg

SEQ ID NO: 568298 - DNA, 20 bp, mouse
gtatgaagtaaggagacatc

SEQ ID NO: 568299 - DNA, 20 bp, mouse
gctgggacagtagagataga

SEQ ID NO: 568300 - DNA, 20 bp, mouse
gtcagttggcataatgaaag

SEQ ID NO: 568301 - DNA, 20 bp, mouse
gtattatagacagtttacac

SEQ ID NO: 568302 - DNA, 20 bp, mouse
gtttatgtcaagtaaagaga

SEQ ID NO: 568303 - DNA, 20 bp, mouse
gctaattagttactgtcagt

SEQ ID NO: 568304 - DNA, 20 bp, mouse
gaaatagtacatcaccatga

SEQ ID NO: 568305 - DNA, 20 bp, mouse
ggagccagacctagtggttt

SEQ ID NO: 568306 - DNA, 20 bp, mouse
gcagatataagggcctactg

SEQ ID NO: 568307 - DNA, 20 bp, mouse
gaagaaagcaactccacagt

SEQ ID NO: 568308 - DNA, 20 bp, mouse
gagtacttctcagtaccatc

SEQ ID NO: 568309 - DNA, 20 bp, mouse
gtagagaacatcaatgtatg

SEQ ID NO: 568310 - DNA, 20 bp, mouse
gtttcaaaaccacagatata

SEQ ID NO: 568311 - DNA, 20 bp, mouse
gctatgttgaaaaccttgtt

SEQ ID NO: 568312 - DNA, 20 bp, mouse
gtctctaatgagtccagcca

SEQ ID NO: 568313 - DNA, 20 bp, mouse
gagaatcagtaggctagccg

SEQ ID NO: 568314 - DNA, 20 bp, mouse
ggcagatttccagaatcagt

SEQ ID NO: 568315 - DNA, 20 bp, mouse
gagaattacttacagaatga

SEQ ID NO: 568316 - DNA, 20 bp, mouse
gtcaggagataccaataaca

SEQ ID NO: 568317 - DNA, 20 bp, mouse
ggatagatattccatgttat

SEQ ID NO: 568318 - DNA, 20 bp, mouse
gtgcataaccttaaatagtc

SEQ ID NO: 568319 - DNA, 20 bp, mouse
gggtatctcctgactattta

SEQ ID NO: 568320 - DNA, 20 bp, mouse
gcttttcttatcaggaatga

SEQ ID NO: 568321 - DNA, 20 bp, mouse
gctccagtgaagcatctccc

SEQ ID NO: 568322 - DNA, 20 bp, mouse
ggcacggttggatcaaagaa

SEQ ID NO: 568323 - DNA, 20 bp, mouse
gtctctgcagagtcctagcc

SEQ ID NO: 568324 - DNA, 20 bp, mouse
gtcacttacaggagcacggt

SEQ ID NO: 568325 - DNA, 20 bp, mouse
gattcagtacctaagctgtg

SEQ ID NO: 568326 - DNA, 20 bp, mouse
ggctagaactcatcccactt

SEQ ID NO: 568327 - DNA, 20 bp, mouse
gagaagtggggttgaattaa

SEQ ID NO: 568328 - DNA, 20 bp, mouse
gtctttgaggacttcctaag

SEQ ID NO: 568329 - DNA, 20 bp, mouse
ggtgggatgagttctagctc

SEQ ID NO: 568330 - DNA, 20 bp, mouse
gtatttctttatagattacc

SEQ ID NO: 568331 - DNA, 20 bp, mouse
gctctggagatatgctttac

SEQ ID NO: 568332 - DNA, 20 bp, mouse
gtagacactttaacttggag

SEQ ID NO: 568333 - DNA, 20 bp, mouse
gggtaatttacttacagaag

SEQ ID NO: 568334 - DNA, 20 bp, mouse
gtttctattgaagtgagagg

SEQ ID NO: 568335 - DNA, 20 bp, mouse
gtccaatgagtagaatcgat

SEQ ID NO: 568336 - DNA, 20 bp, mouse
ggtagaactagcctaatgta

SEQ ID NO: 568337 - DNA, 20 bp, mouse
gtggccaggactttccaagc

SEQ ID NO: 568338 - DNA, 20 bp, mouse
gtactaggaaacctgagaat

SEQ ID NO: 568339 - DNA, 20 bp, mouse
gttcactggagccgtacatt

SEQ ID NO: 568340 - DNA, 20 bp, mouse
gagtctgaactcatcctgct

SEQ ID NO: 568341 - DNA, 20 bp, mouse
gtggatactttaacttagag

SEQ ID NO: 568342 - DNA, 20 bp, mouse
gtatttgaaggcctattctc

SEQ ID NO: 568343 - DNA, 20 bp, mouse
gaatggcagcattattggcc

SEQ ID NO: 568344 - DNA, 20 bp, mouse
gaagattgggaaggtctgct

SEQ ID NO: 568345 - DNA, 20 bp, mouse
gactcaaagaatccctaaac

SEQ ID NO: 568346 - DNA, 20 bp, mouse
ggcttaggaactcctaacga

SEQ ID NO: 568347 - DNA, 20 bp, mouse
gcataggactcatcctgctt

SEQ ID NO: 568348 - DNA, 20 bp, mouse
gcaatagcagtgccatcgtt

SEQ ID NO: 568349 - DNA, 20 bp, mouse
gtttaataagagaggcacaa

SEQ ID NO: 568350 - DNA, 20 bp, mouse
gtaagagaggcacaagggtg

SEQ ID NO: 568351 - DNA, 20 bp, mouse
ggtctgcagatctgcttcac

SEQ ID NO: 568352 - DNA, 20 bp, mouse
gtgaatacttttaataagag

SEQ ID NO: 568353 - DNA, 20 bp, mouse
gtgttctatctggcgtgaag

SEQ ID NO: 568354 - DNA, 20 bp, mouse
gttaaaagtattcagttcag

SEQ ID NO: 568355 - DNA, 20 bp, mouse
gatccagtgattagaaatga

SEQ ID NO: 568356 - DNA, 20 bp, mouse
gccaagagaggaataggggt

SEQ ID NO: 568357 - DNA, 20 bp, mouse
gtttaccaagagaggaatag

SEQ ID NO: 568358 - DNA, 20 bp, mouse
gctctggagatctgcttcat

SEQ ID NO: 568359 - DNA, 20 bp, mouse
gttgagcagagagaagaacg

SEQ ID NO: 568360 - DNA, 20 bp, mouse
gcttgtaagaaactgcacaa

SEQ ID NO: 568361 - DNA, 20 bp, mouse
gcaagggtacaagagacgat

SEQ ID NO: 568362 - DNA, 20 bp, mouse
gcataccagaaagaatgtca

SEQ ID NO: 568363 - DNA, 20 bp, mouse
ggaatccttgacattctttc

SEQ ID NO: 568364 - DNA, 20 bp, mouse
gggaaggtgtcctatgcatt

SEQ ID NO: 568365 - DNA, 20 bp, mouse
gttactgttcctatatattc

SEQ ID NO: 568366 - DNA, 20 bp, mouse
gagagacagaaattctgctt

SEQ ID NO: 568367 - DNA, 20 bp, mouse
gtatttgtttatagattatc

SEQ ID NO: 568368 - DNA, 20 bp, mouse
gggagtagacttgttgcgta

SEQ ID NO: 568369 - DNA, 20 bp, mouse
gtctaaaggaagaattacat

SEQ ID NO: 568370 - DNA, 20 bp, mouse
gttatcttctctcttgatga

SEQ ID NO: 568371 - DNA, 20 bp, mouse
gatcaaatgagtagaactaa

SEQ ID NO: 568372 - DNA, 20 bp, mouse
gtcttgaaagaaattgtaca

SEQ ID NO: 568373 - DNA, 20 bp, mouse
ggttctactcatttgatacc

SEQ ID NO: 568374 - DNA, 20 bp, mouse
gatgcactgtttgttctgga

SEQ ID NO: 568375 - DNA, 20 bp, mouse
gttcagtagttctatgagtt

SEQ ID NO: 568376 - DNA, 20 bp, mouse
gtcggctggaagctcctggg

SEQ ID NO: 568377 - DNA, 20 bp, mouse
gggctcggctggaagctcct

SEQ ID NO: 568378 - DNA, 20 bp, mouse
ggtctccatggagtgctggt

SEQ ID NO: 568379 - DNA, 20 bp, mouse
gtgctaggcttagtcctccc

SEQ ID NO: 568380 - DNA, 20 bp, mouse
gcactcactgcgggtctcca

SEQ ID NO: 568381 - DNA, 20 bp, mouse
gcgagcccaccagcactcca

SEQ ID NO: 568382 - DNA, 20 bp, mouse
gtggctaacctcccattcag

SEQ ID NO: 568383 - DNA, 20 bp, mouse
ggtgagtgcctggcatatgg

SEQ ID NO: 568384 - DNA, 20 bp, mouse
gaagcatggcaccgaggacc

SEQ ID NO: 568385 - DNA, 20 bp, mouse
gatatgccaggcactcactg

SEQ ID NO: 568386 - DNA, 20 bp, mouse
gaggggtcctcagccaacaa

SEQ ID NO: 568387 - DNA, 20 bp, mouse
gaccgcctgctgttcctcag

SEQ ID NO: 568388 - DNA, 20 bp, mouse
gcaacaatggacgctcgctc

SEQ ID NO: 568389 - DNA, 20 bp, mouse
gacccctgaggaacagcagg

SEQ ID NO: 568390 - DNA, 20 bp, mouse
gaggacccctgaggaacagc

SEQ ID NO: 568391 - DNA, 20 bp, mouse
ggagcgtccattgttggctg

SEQ ID NO: 568392 - DNA, 20 bp, mouse
ggcgagagctatccacgaat

SEQ ID NO: 568393 - DNA, 20 bp, mouse
ggggaaaaggctctcaaagg

SEQ ID NO: 568394 - DNA, 20 bp, mouse
gggttgctctcttctactaa

SEQ ID NO: 568395 - DNA, 20 bp, mouse
ggccagccaagcctgctcac

SEQ ID NO: 568396 - DNA, 20 bp, mouse
gagagacacgcggctggcga

SEQ ID NO: 568397 - DNA, 20 bp, mouse
gcagaagacccggcagtctg

SEQ ID NO: 568398 - DNA, 20 bp, mouse
gtgagtgagacagagcagga

SEQ ID NO: 568399 - DNA, 20 bp, mouse
ggcttcttctcagagacacg

SEQ ID NO: 568400 - DNA, 20 bp, mouse
ggcacagccttgtctgacat

SEQ ID NO: 568401 - DNA, 20 bp, mouse
gtgcgggcgggcgctctcca

SEQ ID NO: 568402 - DNA, 20 bp, mouse
gcttctcagagacacgcggc

SEQ ID NO: 568403 - DNA, 20 bp, mouse
gtctgagaagaagctcaact

SEQ ID NO: 568404 - DNA, 20 bp, mouse
ggcaagaagtgctcaatccc

SEQ ID NO: 568405 - DNA, 20 bp, mouse
gcgggttcgaggccgcgagt

SEQ ID NO: 568406 - DNA, 20 bp, mouse
gaggttggctggctcgaccc

SEQ ID NO: 568407 - DNA, 20 bp, mouse
gttggctggctcgacccagg

SEQ ID NO: 568408 - DNA, 20 bp, mouse
ggaggaggcgaagtaagtag

SEQ ID NO: 568409 - DNA, 20 bp, mouse
gagccagccaacctgtgagc

SEQ ID NO: 568410 - DNA, 20 bp, mouse
gcacctgctcacaggttggc

SEQ ID NO: 568411 - DNA, 20 bp, mouse
gcagcatcggtatctggcca

SEQ ID NO: 568412 - DNA, 20 bp, mouse
ggcgatgctgccggcggagg

SEQ ID NO: 568413 - DNA, 20 bp, mouse
ggaggaggcgatgctgccgg

SEQ ID NO: 568414 - DNA, 20 bp, mouse
gcgacggcagcatcctagaa

SEQ ID NO: 568415 - DNA, 20 bp, mouse
ggcgaagtaagtagagggct

SEQ ID NO: 568416 - DNA, 20 bp, mouse
gagctgacctggattggagg

SEQ ID NO: 568417 - DNA, 20 bp, mouse
gggctgcagctgacctggat

SEQ ID NO: 568418 - DNA, 20 bp, mouse
gactatgggaggacacacag

SEQ ID NO: 568419 - DNA, 20 bp, mouse
gtgacctggattggaggagg

SEQ ID NO: 568420 - DNA, 20 bp, mouse
gatggtgccaggagatcagg

SEQ ID NO: 568421 - DNA, 20 bp, mouse
gaccatggtgccaggagatc

SEQ ID NO: 568422 - DNA, 20 bp, mouse
gagagcgcgtagaggactat

SEQ ID NO: 568423 - DNA, 20 bp, mouse
gccatgaacgcgaggagcag

SEQ ID NO: 568424 - DNA, 20 bp, mouse
ggcgcgtagaggactatggg

SEQ ID NO: 568425 - DNA, 20 bp, mouse
gctggtgcggaccctcactg

SEQ ID NO: 568426 - DNA, 20 bp, mouse
gagagacaggagtgggcgat

SEQ ID NO: 568427 - DNA, 20 bp, mouse
gcctcctagtccagagagac

SEQ ID NO: 568428 - DNA, 20 bp, mouse
ggagagagtgtgagactggt

SEQ ID NO: 568429 - DNA, 20 bp, mouse
gactcctgtctctctggact

SEQ ID NO: 568430 - DNA, 20 bp, mouse
gggagaccaagagagttcca

SEQ ID NO: 568431 - DNA, 20 bp, mouse
gtcatcagagggcgaggaag

SEQ ID NO: 568432 - DNA, 20 bp, mouse
gcatggaggactcgtggcca

SEQ ID NO: 568433 - DNA, 20 bp, mouse
gagtgttctgggctgggcca

SEQ ID NO: 568434 - DNA, 20 bp, mouse
gaggagcaaatcccggtgaa

SEQ ID NO: 568435 - DNA, 20 bp, mouse
ggagagcgccgaggatgggg

SEQ ID NO: 568436 - DNA, 20 bp, mouse
ggaggccgcgaactgcatca

SEQ ID NO: 568437 - DNA, 20 bp, mouse
ggccgcgaactgcatcatgg

SEQ ID NO: 568438 - DNA, 20 bp, mouse
gatcatggaggtgagtagct

SEQ ID NO: 568439 - DNA, 20 bp, mouse
ggcccacggcctgaactgtg

SEQ ID NO: 568440 - DNA, 20 bp, mouse
gagagaggggggggtctcgg

SEQ ID NO: 568441 - DNA, 20 bp, mouse
gcccacggggcccctcgagg

SEQ ID NO: 568442 - DNA, 20 bp, mouse
gatcgtgacgggagagatct

SEQ ID NO: 568443 - DNA, 20 bp, mouse
gacctccatgatgcagttcg

SEQ ID NO: 568444 - DNA, 20 bp, mouse
ggaccacgtgcgacagtcct

SEQ ID NO: 568445 - DNA, 20 bp, mouse
ggacatccacagccgagcca

SEQ ID NO: 568446 - DNA, 20 bp, mouse
ggcagcaactggacgcacag

SEQ ID NO: 568447 - DNA, 20 bp, mouse
gtccgggaaaagagtctcca

SEQ ID NO: 568448 - DNA, 20 bp, mouse
gggcccagggaagcgcgccg

SEQ ID NO: 568449 - DNA, 20 bp, mouse
gactggacgcacagaggcac

SEQ ID NO: 568450 - DNA, 20 bp, mouse
gaaggaggatggcctcgtcc

SEQ ID NO: 568451 - DNA, 20 bp, mouse
gctcgctcggaagcccacga

SEQ ID NO: 568452 - DNA, 20 bp, mouse
gctgggccggtcgcagcaac

SEQ ID NO: 568453 - DNA, 20 bp, mouse
gggaagcccacgaaggagga

SEQ ID NO: 568454 - DNA, 20 bp, mouse
ggatctgagcaggaacaaca

SEQ ID NO: 568455 - DNA, 20 bp, mouse
ggtccgccgctgggaaggcg

SEQ ID NO: 568456 - DNA, 20 bp, mouse
gggcggctcaggcttcgggt

SEQ ID NO: 568457 - DNA, 20 bp, mouse
gcgcttgcgcaggtccaggg

SEQ ID NO: 568458 - DNA, 20 bp, mouse
gttgcgcaggtccagggcgg

SEQ ID NO: 568459 - DNA, 20 bp, mouse
gaggtccagggcggcggctc

SEQ ID NO: 568460 - DNA, 20 bp, mouse
gggagaaacgcggctgaggt

SEQ ID NO: 568461 - DNA, 20 bp, mouse
gattctaggctataccagaa

SEQ ID NO: 568462 - DNA, 20 bp, mouse
gagaattcagcggagaaacg

SEQ ID NO: 568463 - DNA, 20 bp, mouse
ggtgcgcagggggaattgag

SEQ ID NO: 568464 - DNA, 20 bp, mouse
gaggcctccgccccctctgg

SEQ ID NO: 568465 - DNA, 20 bp, mouse
gagggcggcggctcaggctt

SEQ ID NO: 568466 - DNA, 20 bp, mouse
gcaccggagccgggaacgag

SEQ ID NO: 568467 - DNA, 20 bp, mouse
gacgcggagcgtgaaccgtc

SEQ ID NO: 568468 - DNA, 20 bp, mouse
gagcgcgcggccgcacagcg

SEQ ID NO: 568469 - DNA, 20 bp, mouse
gcgcgtgtggatcgctttgg

SEQ ID NO: 568470 - DNA, 20 bp, mouse
gcccggaagcgctctccgga

SEQ ID NO: 568471 - DNA, 20 bp, mouse
ggagcgcttccgggtcacgt

SEQ ID NO: 568472 - DNA, 20 bp, mouse
gacggcctgcagagcacaca

SEQ ID NO: 568473 - DNA, 20 bp, mouse
ggctagcggcggggaacggt

SEQ ID NO: 568474 - DNA, 20 bp, mouse
gaggccgtggcgccgagctg

SEQ ID NO: 568475 - DNA, 20 bp, mouse
gcgctgtccgacagttccag

SEQ ID NO: 568476 - DNA, 20 bp, mouse
gggccgcgcgagggaaaaga

SEQ ID NO: 568477 - DNA, 20 bp, mouse
gtggcagtcggaggtgctgg

SEQ ID NO: 568478 - DNA, 20 bp, mouse
ggtccctcccgctggacacg

SEQ ID NO: 568479 - DNA, 20 bp, mouse
gtatcaaggaatcccggcgt

SEQ ID NO: 568480 - DNA, 20 bp, mouse
ggtggcagccgcgtgtccag

SEQ ID NO: 568481 - DNA, 20 bp, mouse
gcagccgcgtgtccagcggg

SEQ ID NO: 568482 - DNA, 20 bp, mouse
gcgatggcagtcggaggtgc

SEQ ID NO: 568483 - DNA, 20 bp, mouse
gttccccactcaaggagtaa

SEQ ID NO: 568484 - DNA, 20 bp, mouse
gctctagtatcaaggaatcc

SEQ ID NO: 568485 - DNA, 20 bp, mouse
gccttgagtggggaagactt

SEQ ID NO: 568486 - DNA, 20 bp, mouse
gagcttgagtcgggggacag

SEQ ID NO: 568487 - DNA, 20 bp, mouse
gttgagtcgggggacagcgg

SEQ ID NO: 568488 - DNA, 20 bp, mouse
gagggagccgaggaggaaaa

SEQ ID NO: 568489 - DNA, 20 bp, mouse
gtcctcgtggaccgagacgt

SEQ ID NO: 568490 - DNA, 20 bp, mouse
gaaaagaaagcttgagtcgg

SEQ ID NO: 568491 - DNA, 20 bp, mouse
gaccgcgcaacgaatgctgg

SEQ ID NO: 568492 - DNA, 20 bp, mouse
gtaagcggtaggcttcggtg

SEQ ID NO: 568493 - DNA, 20 bp, mouse
ggcttcggtgcggacctggt

SEQ ID NO: 568494 - DNA, 20 bp, mouse
gaagaaaagaaagcttgagt

SEQ ID NO: 568495 - DNA, 20 bp, mouse
ggtggtgcggctcaacgggt

SEQ ID NO: 568496 - DNA, 20 bp, mouse
gaaaatggccgcgggagtgg

SEQ ID NO: 568497 - DNA, 20 bp, mouse
gagtggatcgcttcccacag

SEQ ID NO: 568498 - DNA, 20 bp, mouse
gtcgacgccccacccacagt

SEQ ID NO: 568499 - DNA, 20 bp, mouse
gccaacagctcacccgctgt

SEQ ID NO: 568500 - DNA, 20 bp, mouse
ggctgcggcagacctgctca

SEQ ID NO: 568501 - DNA, 20 bp, mouse
gtcacccacgcggaccgctg

SEQ ID NO: 568502 - DNA, 20 bp, mouse
gctgccgcagcggtccgcgt

SEQ ID NO: 568503 - DNA, 20 bp, mouse
gtgagctgttgggcttgctg

SEQ ID NO: 568504 - DNA, 20 bp, mouse
gccactcgccgccactcccg

SEQ ID NO: 568505 - DNA, 20 bp, mouse
ggtgcttgaaccactccacg

SEQ ID NO: 568506 - DNA, 20 bp, mouse
gcgccgcgccaggagcgcag

SEQ ID NO: 568507 - DNA, 20 bp, mouse
gaggcagcggctccgaagtc

SEQ ID NO: 568508 - DNA, 20 bp, mouse
gaggcggcccccagaccccg

SEQ ID NO: 568509 - DNA, 20 bp, mouse
gaagtccggcaggcgggagg

SEQ ID NO: 568510 - DNA, 20 bp, mouse
gccagcgatcggcagaagtt

SEQ ID NO: 568511 - DNA, 20 bp, mouse
gtcctgctcggcgctcccgg

SEQ ID NO: 568512 - DNA, 20 bp, mouse
gccgggaccgcggggtctgg

SEQ ID NO: 568513 - DNA, 20 bp, mouse
gaagtgtgcgaagggatgcg

SEQ ID NO: 568514 - DNA, 20 bp, mouse
gctctgtggagtccctcctg

SEQ ID NO: 568515 - DNA, 20 bp, mouse
gcggcgcacacctggcgcgg

SEQ ID NO: 568516 - DNA, 20 bp, mouse
gtcagagcataggaatactg

SEQ ID NO: 568517 - DNA, 20 bp, mouse
gcccagtagcatcagagcat

SEQ ID NO: 568518 - DNA, 20 bp, mouse
gctctgatgctactgggaaa

SEQ ID NO: 568519 - DNA, 20 bp, mouse
gggcagggctcacaaggatg

SEQ ID NO: 568520 - DNA, 20 bp, mouse
gtaggaatactgaggcagct

SEQ ID NO: 568521 - DNA, 20 bp, mouse
ggtggtgtcagactaccttg

SEQ ID NO: 568522 - DNA, 20 bp, mouse
gtaggtactttggggctaac

SEQ ID NO: 568523 - DNA, 20 bp, mouse
ggacttagtttcataggcaa

SEQ ID NO: 568524 - DNA, 20 bp, mouse
gggaaatggtaggtactttg

SEQ ID NO: 568525 - DNA, 20 bp, mouse
ggtcttccgaataagcaccg

SEQ ID NO: 568526 - DNA, 20 bp, mouse
ggcgacgcagcgcccagaat

SEQ ID NO: 568527 - DNA, 20 bp, mouse
ggcatcggtggcaggtaagc

SEQ ID NO: 568528 - DNA, 20 bp, mouse
gggatcagcagaccgattct

SEQ ID NO: 568529 - DNA, 20 bp, mouse
ggggcgctgcgtcgcatcgg

SEQ ID NO: 568530 - DNA, 20 bp, mouse
gctggaggaaccgaatccca

SEQ ID NO: 568531 - DNA, 20 bp, mouse
gtgctgatccgacaacgcgg

SEQ ID NO: 568532 - DNA, 20 bp, mouse
gtctgggcgctgcgtcgcat

SEQ ID NO: 568533 - DNA, 20 bp, mouse
ggaaggctgagtgctcgcca

SEQ ID NO: 568534 - DNA, 20 bp, mouse
gggccacggggactaggact

SEQ ID NO: 568535 - DNA, 20 bp, mouse
gcctgctgcgcgactcctgg

SEQ ID NO: 568536 - DNA, 20 bp, mouse
gcgagcgcagtcagcatggt

SEQ ID NO: 568537 - DNA, 20 bp, mouse
gcgccccgctagcccttcct

SEQ ID NO: 568538 - DNA, 20 bp, mouse
ggagtcctgacgccccgctg

SEQ ID NO: 568539 - DNA, 20 bp, mouse
ggtgcaggagccaccagcgg

SEQ ID NO: 568540 - DNA, 20 bp, mouse
gatagtgcaggagccaccag

SEQ ID NO: 568541 - DNA, 20 bp, mouse
ggcagccgccttgagagccc

SEQ ID NO: 568542 - DNA, 20 bp, mouse
gctgcgcgggaggtagtgct

SEQ ID NO: 568543 - DNA, 20 bp, mouse
gagcccaggaagggctagcg

SEQ ID NO: 568544 - DNA, 20 bp, mouse
ggggcgctgacggacaggac

SEQ ID NO: 568545 - DNA, 20 bp, mouse
gggggcgagcgcagtcagca

SEQ ID NO: 568546 - DNA, 20 bp, mouse
gggtagcgccatgtcagtct

SEQ ID NO: 568547 - DNA, 20 bp, mouse
gtcacagtcttgcaatgagg

SEQ ID NO: 568548 - DNA, 20 bp, mouse
gtgcaatgagggggacttac

SEQ ID NO: 568549 - DNA, 20 bp, mouse
gtctatctggaccaaggcgt

SEQ ID NO: 568550 - DNA, 20 bp, mouse
gagtgtcccccagaccaggt

SEQ ID NO: 568551 - DNA, 20 bp, mouse
gagaaactgcaatttcgtcc

SEQ ID NO: 568552 - DNA, 20 bp, mouse
ggatggtcacctggattgta

SEQ ID NO: 568553 - DNA, 20 bp, mouse
gccaggcagactgaaatgtg

SEQ ID NO: 568554 - DNA, 20 bp, mouse
gcttggtccagatagagttt

SEQ ID NO: 568555 - DNA, 20 bp, mouse
gtgagggggacttacaggcg

SEQ ID NO: 568556 - DNA, 20 bp, mouse
gtataaccccctagtagtaa

SEQ ID NO: 568557 - DNA, 20 bp, mouse
gatccacccttactactagg

SEQ ID NO: 568558 - DNA, 20 bp, mouse
gaaccccctagtagtaaggg

SEQ ID NO: 568559 - DNA, 20 bp, mouse
gctccaggagagccaagatc

SEQ ID NO: 568560 - DNA, 20 bp, mouse
ggtaatccacccttactact

SEQ ID NO: 568561 - DNA, 20 bp, mouse
gggaagcctctagaacaata

SEQ ID NO: 568562 - DNA, 20 bp, mouse
gctgagtttcaggtcacctg

SEQ ID NO: 568563 - DNA, 20 bp, mouse
ggggagaaagccggatgtgg

SEQ ID NO: 568564 - DNA, 20 bp, mouse
gaatagccctattgttctag

SEQ ID NO: 568565 - DNA, 20 bp, mouse
gctcatgggactacacattc

SEQ ID NO: 568566 - DNA, 20 bp, mouse
gcgagggctcgaccaagctg

SEQ ID NO: 568567 - DNA, 20 bp, mouse
ggagcttacagctgggccga

SEQ ID NO: 568568 - DNA, 20 bp, mouse
ggtcagcccagttcttccac

SEQ ID NO: 568569 - DNA, 20 bp, mouse
gcgttgaactctgcgaggta

SEQ ID NO: 568570 - DNA, 20 bp, mouse
ggcggagctaggggctggac

SEQ ID NO: 568571 - DNA, 20 bp, mouse
gtggactggagcttacagct

SEQ ID NO: 568572 - DNA, 20 bp, mouse
gactgggctgacagcgatgt

SEQ ID NO: 568573 - DNA, 20 bp, mouse
gttcaacgttgaactctgcg

SEQ ID NO: 568574 - DNA, 20 bp, mouse
gtgggtcaggacgacaataa

SEQ ID NO: 568575 - DNA, 20 bp, mouse
gtcaacgttgaacctcagct

SEQ ID NO: 568576 - DNA, 20 bp, mouse
gaggggccggagcagagcgg

SEQ ID NO: 568577 - DNA, 20 bp, mouse
ggaagggaggctgtccggga

SEQ ID NO: 568578 - DNA, 20 bp, mouse
ggagaacgcgtgcaggaaga

SEQ ID NO: 568579 - DNA, 20 bp, mouse
gaagagaagggaggctgtcc

SEQ ID NO: 568580 - DNA, 20 bp, mouse
ggctctgctccggcccctcc

SEQ ID NO: 568581 - DNA, 20 bp, mouse
gagcctgccccgacccaggt

SEQ ID NO: 568582 - DNA, 20 bp, mouse
gaactctccggagaaggctg

SEQ ID NO: 568583 - DNA, 20 bp, mouse
ggggcaggctcgggttcctc

SEQ ID NO: 568584 - DNA, 20 bp, mouse
ggcgagccaggccccctagt

SEQ ID NO: 568585 - DNA, 20 bp, mouse
gctgggtcccacctgggtcg

SEQ ID NO: 568586 - DNA, 20 bp, mouse
gacgcgcttgagagccatgg

SEQ ID NO: 568587 - DNA, 20 bp, mouse
ggcttgcggtttggttgaga

SEQ ID NO: 568588 - DNA, 20 bp, mouse
ggtcttcttgctgcggtcgg

SEQ ID NO: 568589 - DNA, 20 bp, mouse
ggcctcctgagcgcgtgtat

SEQ ID NO: 568590 - DNA, 20 bp, mouse
gaagacgcgcttgagagcca

SEQ ID NO: 568591 - DNA, 20 bp, mouse
gacatccccgaagagcctca

SEQ ID NO: 568592 - DNA, 20 bp, mouse
gagcaggtgcgcggatgggt

SEQ ID NO: 568593 - DNA, 20 bp, mouse
ggagcctcagggctcgcggg

SEQ ID NO: 568594 - DNA, 20 bp, mouse
gttgagagggcagcgacgcg

SEQ ID NO: 568595 - DNA, 20 bp, mouse
ggacggaggtcggaagtgtc

SEQ ID NO: 568596 - DNA, 20 bp, mouse
gacctgtagagggcttggag

SEQ ID NO: 568597 - DNA, 20 bp, mouse
gccctagtgtggtggtaacc

SEQ ID NO: 568598 - DNA, 20 bp, mouse
ggctgccagccacctgtaga

SEQ ID NO: 568599 - DNA, 20 bp, mouse
ggcccctccaagccctctac

SEQ ID NO: 568600 - DNA, 20 bp, mouse
gcatgctcagagccaggtct

SEQ ID NO: 568601 - DNA, 20 bp, mouse
gccaggcacttgcaatgatc

SEQ ID NO: 568602 - DNA, 20 bp, mouse
gcggtgggtactgccaacag

SEQ ID NO: 568603 - DNA, 20 bp, mouse
gctggccccttcccctagtg

SEQ ID NO: 568604 - DNA, 20 bp, mouse
gaccaccacactaggggaag

SEQ ID NO: 568605 - DNA, 20 bp, mouse
ggccccttcccctagtgtgg

SEQ ID NO: 568606 - DNA, 20 bp, mouse
gagaggcccaagggaagtgg

SEQ ID NO: 568607 - DNA, 20 bp, mouse
gaggcaggcttgcatcgagc

SEQ ID NO: 568608 - DNA, 20 bp, mouse
gctgaccttggtcttcacga

SEQ ID NO: 568609 - DNA, 20 bp, mouse
gccgttcaaactaacacaca

SEQ ID NO: 568610 - DNA, 20 bp, mouse
gaacaggtagagaggcccaa

SEQ ID NO: 568611 - DNA, 20 bp, mouse
ggccagtctggaatagatgt

SEQ ID NO: 568612 - DNA, 20 bp, mouse
gtgaagaccaaggtcagacc

SEQ ID NO: 568613 - DNA, 20 bp, mouse
gaaagccgtcgtgaagacca

SEQ ID NO: 568614 - DNA, 20 bp, mouse
ggtcagaggagggtcttgag

SEQ ID NO: 568615 - DNA, 20 bp, mouse
ggggttgcccgacacagtga

SEQ ID NO: 568616 - DNA, 20 bp, mouse
gggttaggggacgcgttccg

SEQ ID NO: 568617 - DNA, 20 bp, mouse
gggatcgcccaagagacacc

SEQ ID NO: 568618 - DNA, 20 bp, mouse
ggtcccgggtcccaacgccc

SEQ ID NO: 568619 - DNA, 20 bp, mouse
gcgggcggtgtgaacagcag

SEQ ID NO: 568620 - DNA, 20 bp, mouse
gccatggcgtcccggggacg

SEQ ID NO: 568621 - DNA, 20 bp, mouse
gagcctggcggcggttataa

SEQ ID NO: 568622 - DNA, 20 bp, mouse
gaccgggctcagggtgtgta

SEQ ID NO: 568623 - DNA, 20 bp, mouse
gggtcccccatggcgtcccg

SEQ ID NO: 568624 - DNA, 20 bp, mouse
ggcagtagcggggcacagcg

SEQ ID NO: 568625 - DNA, 20 bp, mouse
ggcgttgggacccgggacgt

SEQ ID NO: 568626 - DNA, 20 bp, mouse
gcgtccgccgaagtagtagg

SEQ ID NO: 568627 - DNA, 20 bp, mouse
ggtccgtccgccgaagtagt

SEQ ID NO: 568628 - DNA, 20 bp, mouse
ggccagctgccactcgagca

SEQ ID NO: 568629 - DNA, 20 bp, mouse
gagctggcctcctactactt

SEQ ID NO: 568630 - DNA, 20 bp, mouse
ggggtctttccgtgctcgag

SEQ ID NO: 568631 - DNA, 20 bp, mouse
gcctaggagagagagacggt

SEQ ID NO: 568632 - DNA, 20 bp, mouse
gtgaatgaagagggtccttg

SEQ ID NO: 568633 - DNA, 20 bp, mouse
ggtagaggtacccctcagaa

SEQ ID NO: 568634 - DNA, 20 bp, mouse
ggaccctcttcattcaccta

SEQ ID NO: 568635 - DNA, 20 bp, mouse
ggcagaggacataaggtagt

SEQ ID NO: 568636 - DNA, 20 bp, mouse
gcgacacacgcccaccaagt

SEQ ID NO: 568637 - DNA, 20 bp, mouse
ggctctgggaacactagctc

SEQ ID NO: 568638 - DNA, 20 bp, mouse
gcggtggcgccaccataggt

SEQ ID NO: 568639 - DNA, 20 bp, mouse
gttgaggcttgcctacttgg

SEQ ID NO: 568640 - DNA, 20 bp, mouse
gctccagaaagactgatgcg

SEQ ID NO: 568641 - DNA, 20 bp, mouse
gcccagggttcggaggtagg

SEQ ID NO: 568642 - DNA, 20 bp, mouse
gagactgatgcgaggagagc

SEQ ID NO: 568643 - DNA, 20 bp, mouse
ggaggtaggaggtgatctcc

SEQ ID NO: 568644 - DNA, 20 bp, mouse
gcccctagtccccaatccca

SEQ ID NO: 568645 - DNA, 20 bp, mouse
gtgatctcctggaacagacg

SEQ ID NO: 568646 - DNA, 20 bp, mouse
gtacaaacacgtactcacct

SEQ ID NO: 568647 - DNA, 20 bp, mouse
gcaacaactgactgttccaa

SEQ ID NO: 568648 - DNA, 20 bp, mouse
ggacctggctaactgcacaa

SEQ ID NO: 568649 - DNA, 20 bp, mouse
gaaggacgaagtattttagg

SEQ ID NO: 568650 - DNA, 20 bp, mouse
gaaaggagaatctcctaccc

SEQ ID NO: 568651 - DNA, 20 bp, mouse
ggcatactgaataagatatg

SEQ ID NO: 568652 - DNA, 20 bp, mouse
gaataagatatgagggagag

SEQ ID NO: 568653 - DNA, 20 bp, mouse
gttattatgaagcattctta

SEQ ID NO: 568654 - DNA, 20 bp, mouse
gccatcagattgtaaaaatt

SEQ ID NO: 568655 - DNA, 20 bp, mouse
gtttaaggacgaagtatttt

SEQ ID NO: 568656 - DNA, 20 bp, mouse
gttagaggcgaggggctgga

SEQ ID NO: 568657 - DNA, 20 bp, mouse
gtggaaggagcccagcttag

SEQ ID NO: 568658 - DNA, 20 bp, mouse
gagcccagcttagaggcgag

SEQ ID NO: 568659 - DNA, 20 bp, mouse
gtccggtccagctctcctcc

SEQ ID NO: 568660 - DNA, 20 bp, mouse
gggagggttccgagacccgg

SEQ ID NO: 568661 - DNA, 20 bp, mouse
ggctggagggttccgagacc

SEQ ID NO: 568662 - DNA, 20 bp, mouse
gtcggagcaactcacctctc

SEQ ID NO: 568663 - DNA, 20 bp, mouse
gccgagacccggaggagagc

SEQ ID NO: 568664 - DNA, 20 bp, mouse
gtgtcttcccgaagctggag

SEQ ID NO: 568665 - DNA, 20 bp, mouse
gatgccctggggacacccac

SEQ ID NO: 568666 - DNA, 20 bp, mouse
ggacagtgcggaccagcacg

SEQ ID NO: 568667 - DNA, 20 bp, mouse
ggtagagccacagggacgga

SEQ ID NO: 568668 - DNA, 20 bp, mouse
ggtcatgagttcgggcgggt

SEQ ID NO: 568669 - DNA, 20 bp, mouse
ggttcaggcagcggacagtg

SEQ ID NO: 568670 - DNA, 20 bp, mouse
gcccgacgcgcgaacaagag

SEQ ID NO: 568671 - DNA, 20 bp, mouse
ggcaggggcaccatgaggcc

SEQ ID NO: 568672 - DNA, 20 bp, mouse
ggcgcgtcatgagttcgggc

SEQ ID NO: 568673 - DNA, 20 bp, mouse
ggcccagcaggggcaccatg

SEQ ID NO: 568674 - DNA, 20 bp, mouse
ggtgagcgcgtcatgagttc

SEQ ID NO: 568675 - DNA, 20 bp, mouse
gggcccctgaactccctcta

SEQ ID NO: 568676 - DNA, 20 bp, mouse
ggagcagcatcgggaagtag

SEQ ID NO: 568677 - DNA, 20 bp, mouse
ggaatgagatgtcaattcag

SEQ ID NO: 568678 - DNA, 20 bp, mouse
gagaggaaggatgcagggtt

SEQ ID NO: 568679 - DNA, 20 bp, mouse
gtcggggagtcacagactag

SEQ ID NO: 568680 - DNA, 20 bp, mouse
ggtgagtgaatccccaggat

SEQ ID NO: 568681 - DNA, 20 bp, mouse
gtcgtggctcaggcagggat

SEQ ID NO: 568682 - DNA, 20 bp, mouse
ggccactcgtggctcaggca

SEQ ID NO: 568683 - DNA, 20 bp, mouse
gtcaggcagggatcggccac

SEQ ID NO: 568684 - DNA, 20 bp, mouse
gcagcaggctagaccatctt

SEQ ID NO: 568685 - DNA, 20 bp, mouse
ggagatgtcaattcagagga

SEQ ID NO: 568686 - DNA, 20 bp, mouse
ggcagccagagcagcggtaa

SEQ ID NO: 568687 - DNA, 20 bp, mouse
gaggtgacgcacaaacgtgt

SEQ ID NO: 568688 - DNA, 20 bp, mouse
ggagctctgaggcttatagg

SEQ ID NO: 568689 - DNA, 20 bp, mouse
gtgacatctgggctcgagag

SEQ ID NO: 568690 - DNA, 20 bp, mouse
ggtggggacggcctctctgt

SEQ ID NO: 568691 - DNA, 20 bp, mouse
ggctgacacagttcttgtgg

SEQ ID NO: 568692 - DNA, 20 bp, mouse
gcagagctcctgtctatgga

SEQ ID NO: 568693 - DNA, 20 bp, mouse
gctctctgtgggcaaagctt

SEQ ID NO: 568694 - DNA, 20 bp, mouse
gtgagacgttgctttcccgt

SEQ ID NO: 568695 - DNA, 20 bp, mouse
gtatggagggagaaaaacgg

SEQ ID NO: 568696 - DNA, 20 bp, mouse
ggcgggctgagttagaacag

SEQ ID NO: 568697 - DNA, 20 bp, mouse
gggtaagcctgcccacgtag

SEQ ID NO: 568698 - DNA, 20 bp, mouse
gacctccgtgcgaatggcga

SEQ ID NO: 568699 - DNA, 20 bp, mouse
gacgtagaggggaaaatggc

SEQ ID NO: 568700 - DNA, 20 bp, mouse
gctgagttagaacagaggct

SEQ ID NO: 568701 - DNA, 20 bp, mouse
gtgagactgcggccccagga

SEQ ID NO: 568702 - DNA, 20 bp, mouse
gggaagtgccacggcttcgg

SEQ ID NO: 568703 - DNA, 20 bp, mouse
gcagcctaggcgattctata

SEQ ID NO: 568704 - DNA, 20 bp, mouse
gcccaggacaagtttcctca

SEQ ID NO: 568705 - DNA, 20 bp, mouse
gaggctgtatctggtaccaa

SEQ ID NO: 568706 - DNA, 20 bp, mouse
ggaccgtgcctgcgctaggg

SEQ ID NO: 568707 - DNA, 20 bp, mouse
gggggaccgtgcctgcgcta

SEQ ID NO: 568708 - DNA, 20 bp, mouse
gccctcggccgccctagcgc

SEQ ID NO: 568709 - DNA, 20 bp, mouse
gccagcgtctcagagagtgg

SEQ ID NO: 568710 - DNA, 20 bp, mouse
gctaccagccagggcatgta

SEQ ID NO: 568711 - DNA, 20 bp, mouse
gttgctgagaggatggccgg

SEQ ID NO: 568712 - DNA, 20 bp, mouse
gagaggatggccgggggtca

SEQ ID NO: 568713 - DNA, 20 bp, mouse
ggctgggccgcggcagagct

SEQ ID NO: 568714 - DNA, 20 bp, mouse
gggccgccctagcgcaggca

SEQ ID NO: 568715 - DNA, 20 bp, mouse
gcaggaccctcattgctgag

SEQ ID NO: 568716 - DNA, 20 bp, mouse
gtcctcttgggaatgttgag

SEQ ID NO: 568717 - DNA, 20 bp, mouse
gttgagaggtggcagcatga

SEQ ID NO: 568718 - DNA, 20 bp, mouse
ggtcctccgggcatcctctt

SEQ ID NO: 568719 - DNA, 20 bp, mouse
gggtgagtcgcgggtcctcc

SEQ ID NO: 568720 - DNA, 20 bp, mouse
gtacgtgggacgaggtgtca

SEQ ID NO: 568721 - DNA, 20 bp, mouse
gttcccaagaggatgcccgg

SEQ ID NO: 568722 - DNA, 20 bp, mouse
gcgcagaaggggctcccgga

SEQ ID NO: 568723 - DNA, 20 bp, mouse
ggcagcatgacggcggagct

SEQ ID NO: 568724 - DNA, 20 bp, mouse
gaggtgggctcggtgagtcg

SEQ ID NO: 568725 - DNA, 20 bp, mouse
gtgtcacggtgacgcagaag

SEQ ID NO: 568726 - DNA, 20 bp, mouse
gcgtaacaaaggacctgcgg

SEQ ID NO: 568727 - DNA, 20 bp, mouse
gccgcagctccggcaaccgg

SEQ ID NO: 568728 - DNA, 20 bp, mouse
ggcccgtaacaaaggacctg

SEQ ID NO: 568729 - DNA, 20 bp, mouse
gaccccgggatcgggcggat

SEQ ID NO: 568730 - DNA, 20 bp, mouse
gagctgcgggaccccgggat

SEQ ID NO: 568731 - DNA, 20 bp, mouse
gcacgtgtcccggatcacgg

SEQ ID NO: 568732 - DNA, 20 bp, mouse
gccgggatcgggcggatcgg

SEQ ID NO: 568733 - DNA, 20 bp, mouse
ggcgggaccccgggatcggg

SEQ ID NO: 568734 - DNA, 20 bp, mouse
gcagaaatcagggctccgga

SEQ ID NO: 568735 - DNA, 20 bp, mouse
gctacgaaagcccgtaacaa

SEQ ID NO: 568736 - DNA, 20 bp, mouse
gacgccgactgagaccctcg

SEQ ID NO: 568737 - DNA, 20 bp, mouse
gaggacggcgtgagccccga

SEQ ID NO: 568738 - DNA, 20 bp, mouse
gccaggcagcccgggacgat

SEQ ID NO: 568739 - DNA, 20 bp, mouse
gcagctgtcgggatcatcca

SEQ ID NO: 568740 - DNA, 20 bp, mouse
ggagccccgagggtctcagt

SEQ ID NO: 568741 - DNA, 20 bp, mouse
gcgacttgctggccggagga

SEQ ID NO: 568742 - DNA, 20 bp, mouse
gcaggatggaggccaaccgg

SEQ ID NO: 568743 - DNA, 20 bp, mouse
gtgcacgacttgctggccgg

SEQ ID NO: 568744 - DNA, 20 bp, mouse
gagcgcgctccaggcagccc

SEQ ID NO: 568745 - DNA, 20 bp, mouse
gaagcgcgggacaccgggag

SEQ ID NO: 568746 - DNA, 20 bp, mouse
ggagagcgctgggaaagcga

SEQ ID NO: 568747 - DNA, 20 bp, mouse
ggggagcccggggaaagaag

SEQ ID NO: 568748 - DNA, 20 bp, mouse
gcgaggagcagcgggcacgg

SEQ ID NO: 568749 - DNA, 20 bp, mouse
ggatctgggcgagtgctgag

SEQ ID NO: 568750 - DNA, 20 bp, mouse
gcccagcgctctctcagctg

SEQ ID NO: 568751 - DNA, 20 bp, mouse
ggtgcgggagcgagtgatct

SEQ ID NO: 568752 - DNA, 20 bp, mouse
gagtaaatcttgttgtggag

SEQ ID NO: 568753 - DNA, 20 bp, mouse
ggcgagtgctgagaggcgag

SEQ ID NO: 568754 - DNA, 20 bp, mouse
gagcagcgggcacggcggag

SEQ ID NO: 568755 - DNA, 20 bp, mouse
ggcggtggcccgaggagcag

SEQ ID NO: 568756 - DNA, 20 bp, mouse
ggccacagcacgaggaagaa

SEQ ID NO: 568757 - DNA, 20 bp, mouse
gccttgggcagacagagcga

SEQ ID NO: 568758 - DNA, 20 bp, mouse
gggcagacagagcgagggtc

SEQ ID NO: 568759 - DNA, 20 bp, mouse
gagcctcctgccccttctta

SEQ ID NO: 568760 - DNA, 20 bp, mouse
gcgtgctgtggctgggcgag

SEQ ID NO: 568761 - DNA, 20 bp, mouse
gacttgccttaagaaggggc

SEQ ID NO: 568762 - DNA, 20 bp, mouse
gtagtgacttgccttaagaa

SEQ ID NO: 568763 - DNA, 20 bp, mouse
gtggagagcagacctcgctg

SEQ ID NO: 568764 - DNA, 20 bp, mouse
gtggtgtcttcaccagcctt

SEQ ID NO: 568765 - DNA, 20 bp, mouse
gtcctttcttcctcgtgctg

SEQ ID NO: 568766 - DNA, 20 bp, mouse
gtccacctggtgcaggatga

SEQ ID NO: 568767 - DNA, 20 bp, mouse
ggccatgctaacccagagcc

SEQ ID NO: 568768 - DNA, 20 bp, mouse
ggctgcatcttgctgctccg

SEQ ID NO: 568769 - DNA, 20 bp, mouse
gcctaccggaaagctccacc

SEQ ID NO: 568770 - DNA, 20 bp, mouse
gtgctaacccagagcctggc

SEQ ID NO: 568771 - DNA, 20 bp, mouse
gtggggctccccctttgcag

SEQ ID NO: 568772 - DNA, 20 bp, mouse
gggcatatcaagtaactgaa

SEQ ID NO: 568773 - DNA, 20 bp, mouse
gggaaagctccacctggtgc

SEQ ID NO: 568774 - DNA, 20 bp, mouse
gaccctcatcctgcaccagg

SEQ ID NO: 568775 - DNA, 20 bp, mouse
ggagtgtcccaaggatgaga

SEQ ID NO: 568776 - DNA, 20 bp, mouse
gacaggatacaacagtgtag

SEQ ID NO: 568777 - DNA, 20 bp, mouse
gacgggcactgataatatat

SEQ ID NO: 568778 - DNA, 20 bp, mouse
ggtgtgtgtaaactattaca

SEQ ID NO: 568779 - DNA, 20 bp, mouse
gatgactcttcttaaataac

SEQ ID NO: 568780 - DNA, 20 bp, mouse
gtttgttgaacagtaaagca

SEQ ID NO: 568781 - DNA, 20 bp, mouse
gcttcttccagcacagactc

SEQ ID NO: 568782 - DNA, 20 bp, mouse
gctgctcaggaaccccgtga

SEQ ID NO: 568783 - DNA, 20 bp, mouse
gcagcagggccactgtaaac

SEQ ID NO: 568784 - DNA, 20 bp, mouse
gctggtggtcctgtttacag

SEQ ID NO: 568785 - DNA, 20 bp, mouse
gtgaaggtatgagaatatgg

SEQ ID NO: 568786 - DNA, 20 bp, mouse
gcggtaacctcacccgccag

SEQ ID NO: 568787 - DNA, 20 bp, mouse
gtgactccccagctcctcgg

SEQ ID NO: 568788 - DNA, 20 bp, mouse
gggttaccgccgaggagctg

SEQ ID NO: 568789 - DNA, 20 bp, mouse
gcgccgaagtgagccagact

SEQ ID NO: 568790 - DNA, 20 bp, mouse
ggcaaccagagcccaattat

SEQ ID NO: 568791 - DNA, 20 bp, mouse
ggtggtgagtcccggagctg

SEQ ID NO: 568792 - DNA, 20 bp, mouse
gagcttgcccgggacagtgg

SEQ ID NO: 568793 - DNA, 20 bp, mouse
gagcagcttgcccgggacag

SEQ ID NO: 568794 - DNA, 20 bp, mouse
gttgggctctggttgcttcg

SEQ ID NO: 568795 - DNA, 20 bp, mouse
gacctgctggtggtgagtcc

SEQ ID NO: 568796 - DNA, 20 bp, mouse
gcgttagctgcagaaggctg

SEQ ID NO: 568797 - DNA, 20 bp, mouse
gcacgtggggaggtggccgg

SEQ ID NO: 568798 - DNA, 20 bp, mouse
ggtgcgagcatcgccacgct

SEQ ID NO: 568799 - DNA, 20 bp, mouse
ggaaggctgaggcgcgccac

SEQ ID NO: 568800 - DNA, 20 bp, mouse
gcgcagggccgggagctcca

SEQ ID NO: 568801 - DNA, 20 bp, mouse
gtcggttgcatgctgggaaa

SEQ ID NO: 568802 - DNA, 20 bp, mouse
gaggcctgagcagaagtggg

SEQ ID NO: 568803 - DNA, 20 bp, mouse
gcactcactcgagcagatca

SEQ ID NO: 568804 - DNA, 20 bp, mouse
gctcgagcagatcagggaca

SEQ ID NO: 568805 - DNA, 20 bp, mouse
gctcgagtgagtgctggctg

SEQ ID NO: 568806 - DNA, 20 bp, mouse
gcgttcgggctccgtctcag

SEQ ID NO: 568807 - DNA, 20 bp, mouse
gcggagcccgaacgttacac

SEQ ID NO: 568808 - DNA, 20 bp, mouse
gcggttccggtgtaacgttc

SEQ ID NO: 568809 - DNA, 20 bp, mouse
gcgccacgctgcggtcccta

SEQ ID NO: 568810 - DNA, 20 bp, mouse
gcggtgtgtggcggtagcga

SEQ ID NO: 568811 - DNA, 20 bp, mouse
gtagtggccccgcgcccgaa

SEQ ID NO: 568812 - DNA, 20 bp, mouse
ggtagcgacggcgggccgta

SEQ ID NO: 568813 - DNA, 20 bp, mouse
gccggggaagaagtcagaat

SEQ ID NO: 568814 - DNA, 20 bp, mouse
gtcttccccggacagaacca

SEQ ID NO: 568815 - DNA, 20 bp, mouse
gggctgaaggcaaagggcgg

SEQ ID NO: 568816 - DNA, 20 bp, mouse
ggattgtgagaggatcgaag

SEQ ID NO: 568817 - DNA, 20 bp, mouse
gatcgaagcggtgagtgtga

SEQ ID NO: 568818 - DNA, 20 bp, mouse
gtggccggaagccaagctac

SEQ ID NO: 568819 - DNA, 20 bp, mouse
gtcttggaaacgattgtgag

SEQ ID NO: 568820 - DNA, 20 bp, mouse
gtatggcacgtgggccagac

SEQ ID NO: 568821 - DNA, 20 bp, mouse
gggcacgtgggccagacggg

SEQ ID NO: 568822 - DNA, 20 bp, mouse
gtctggggaagcagatttct

SEQ ID NO: 568823 - DNA, 20 bp, mouse
ggggagcaaagagccgggtt

SEQ ID NO: 568824 - DNA, 20 bp, mouse
gactggaggagaaagtgtag

SEQ ID NO: 568825 - DNA, 20 bp, mouse
gtggatcacagcataacttt

SEQ ID NO: 568826 - DNA, 20 bp, mouse
gcgaagctggtggctttccg

SEQ ID NO: 568827 - DNA, 20 bp, mouse
ggcttccggtacgaagctgg

SEQ ID NO: 568828 - DNA, 20 bp, mouse
gaaaggactaccggaggcta

SEQ ID NO: 568829 - DNA, 20 bp, mouse
gaaagccaccagcttcgtac

SEQ ID NO: 568830 - DNA, 20 bp, mouse
gagcttcgtaccggaagctg

SEQ ID NO: 568831 - DNA, 20 bp, mouse
gtggctttccgcggtcgcaa

SEQ ID NO: 568832 - DNA, 20 bp, mouse
gagttctacgccacagcttc

SEQ ID NO: 568833 - DNA, 20 bp, mouse
gaaggaatcccttgcgaccg

SEQ ID NO: 568834 - DNA, 20 bp, mouse
gaccaaccctcagtatctgg

SEQ ID NO: 568835 - DNA, 20 bp, mouse
ggcacaccccgcaccagaga

SEQ ID NO: 568836 - DNA, 20 bp, mouse
gtccggacgcaaagcagaac

SEQ ID NO: 568837 - DNA, 20 bp, mouse
gaacgaggcggggagaactc

SEQ ID NO: 568838 - DNA, 20 bp, mouse
gaaagcagaacgggcagcag

SEQ ID NO: 568839 - DNA, 20 bp, mouse
gcgggagcccgggcccgaga

SEQ ID NO: 568840 - DNA, 20 bp, mouse
ggagacggacgccaaaaacg

SEQ ID NO: 568841 - DNA, 20 bp, mouse
gacggacgccaaaaacgagg

SEQ ID NO: 568842 - DNA, 20 bp, mouse
gcggtcccggacctactcca

SEQ ID NO: 568843 - DNA, 20 bp, mouse
gcccgccatcttgttcccag

SEQ ID NO: 568844 - DNA, 20 bp, mouse
gactgcccctgggaacaaga

SEQ ID NO: 568845 - DNA, 20 bp, mouse
gtcttccgccaactgcccct

SEQ ID NO: 568846 - DNA, 20 bp, mouse
ggtagctgcgtggagcgagg

SEQ ID NO: 568847 - DNA, 20 bp, mouse
ggcgcagtgtgatcccgaag

SEQ ID NO: 568848 - DNA, 20 bp, mouse
gggccaagatcgccaaaggt

SEQ ID NO: 568849 - DNA, 20 bp, mouse
gcctgggccaagatcgccaa

SEQ ID NO: 568850 - DNA, 20 bp, mouse
gcctcgagccggacaggcgg

SEQ ID NO: 568851 - DNA, 20 bp, mouse
gtccatagtgaggtaactgg

SEQ ID NO: 568852 - DNA, 20 bp, mouse
gaggcctcgagccggacagg

SEQ ID NO: 568853 - DNA, 20 bp, mouse
ggccaggcctcgagccggac

SEQ ID NO: 568854 - DNA, 20 bp, mouse
gcgctcaaggtgcagatccc

SEQ ID NO: 568855 - DNA, 20 bp, mouse
ggcggtggcaggcccacctt

SEQ ID NO: 568856 - DNA, 20 bp, mouse
gctcgtgaggaggccatgcc

SEQ ID NO: 568857 - DNA, 20 bp, mouse
gaccgtggaggaggctcgtg

SEQ ID NO: 568858 - DNA, 20 bp, mouse
gtcctcacgagcctcctcca

SEQ ID NO: 568859 - DNA, 20 bp, mouse
gggaacccccggcctctcta

SEQ ID NO: 568860 - DNA, 20 bp, mouse
gcggtctgaaaagtagaacg

SEQ ID NO: 568861 - DNA, 20 bp, mouse
gccagagctccgtaccgtgg

SEQ ID NO: 568862 - DNA, 20 bp, mouse
ggagctccgtaccgtggagg

SEQ ID NO: 568863 - DNA, 20 bp, mouse
gtagaacgcggatttggcta

SEQ ID NO: 568864 - DNA, 20 bp, mouse
ggatccagagctccgtaccg

SEQ ID NO: 568865 - DNA, 20 bp, mouse
ggctactaaggtccacacta

SEQ ID NO: 568866 - DNA, 20 bp, mouse
gcagtccccggcctcatcgt

SEQ ID NO: 568867 - DNA, 20 bp, mouse
gcacgctcggctccagtccc

SEQ ID NO: 568868 - DNA, 20 bp, mouse
gcagtctgagcccgacgatg

SEQ ID NO: 568869 - DNA, 20 bp, mouse
gttcttgttggtatgtgcag

SEQ ID NO: 568870 - DNA, 20 bp, mouse
ggagcccgacgatgaggccg

SEQ ID NO: 568871 - DNA, 20 bp, mouse
gcgggctcagactgctccgt

SEQ ID NO: 568872 - DNA, 20 bp, mouse
gcagcggcagtggccgccga

SEQ ID NO: 568873 - DNA, 20 bp, mouse
gctacctaggccaagaccac

SEQ ID NO: 568874 - DNA, 20 bp, mouse
ggctcagactgctccgtcgg

SEQ ID NO: 568875 - DNA, 20 bp, mouse
gaggagacggccctcggtaa

SEQ ID NO: 568876 - DNA, 20 bp, mouse
gtggtaacgtccccgcgcgg

SEQ ID NO: 568877 - DNA, 20 bp, mouse
gggagggcgaggggaccgag

SEQ ID NO: 568878 - DNA, 20 bp, mouse
gctgctctgaggctctggca

SEQ ID NO: 568879 - DNA, 20 bp, mouse
gggcgctgtgagacagcccc

SEQ ID NO: 568880 - DNA, 20 bp, mouse
ggcctctccacccccgcgcg

SEQ ID NO: 568881 - DNA, 20 bp, mouse
ggctcgagcccgggccgcag

SEQ ID NO: 568882 - DNA, 20 bp, mouse
gggttgctctcgccgaggag

SEQ ID NO: 568883 - DNA, 20 bp, mouse
ggtctgtggagaaaggtcgg

SEQ ID NO: 568884 - DNA, 20 bp, mouse
gcggagccccggccacgaag

SEQ ID NO: 568885 - DNA, 20 bp, mouse
gtgaggaaaagaagccctgt

SEQ ID NO: 568886 - DNA, 20 bp, mouse
gtggacgccagtggaagcgg

SEQ ID NO: 568887 - DNA, 20 bp, mouse
gccgtggacgccagtggaag

SEQ ID NO: 568888 - DNA, 20 bp, mouse
gggcgaaccgtggacgccag

SEQ ID NO: 568889 - DNA, 20 bp, mouse
gtcctccgcgatgctggcgg

SEQ ID NO: 568890 - DNA, 20 bp, mouse
gcggagcacgtagagaaaag

SEQ ID NO: 568891 - DNA, 20 bp, mouse
ggactcctccgcgatgctgg

SEQ ID NO: 568892 - DNA, 20 bp, mouse
gacaggcagccgcgcatgtg

SEQ ID NO: 568893 - DNA, 20 bp, mouse
ggccgccgccagcatcgcgg

SEQ ID NO: 568894 - DNA, 20 bp, mouse
ggcaggaaggcgcgacctca

SEQ ID NO: 568895 - DNA, 20 bp, mouse
gctccaggccggcaatgcgg

SEQ ID NO: 568896 - DNA, 20 bp, mouse
gttactgctgcgacacccgg

SEQ ID NO: 568897 - DNA, 20 bp, mouse
gagaagactcagagtcctcc

SEQ ID NO: 568898 - DNA, 20 bp, mouse
gctcttactgctgcgacacc

SEQ ID NO: 568899 - DNA, 20 bp, mouse
ggcccgggtacgtagcccag

SEQ ID NO: 568900 - DNA, 20 bp, mouse
ggcggtctctctagctctag

SEQ ID NO: 568901 - DNA, 20 bp, mouse
ggcaccaggcaccctacccg

SEQ ID NO: 568902 - DNA, 20 bp, mouse
gtcgcagcagtaagagatgc

SEQ ID NO: 568903 - DNA, 20 bp, mouse
gcagcggcgcaggcatgccc

SEQ ID NO: 568904 - DNA, 20 bp, mouse
ggcaccggaagtagagagct

SEQ ID NO: 568905 - DNA, 20 bp, mouse
gacgtacccgggctgggcag

SEQ ID NO: 568906 - DNA, 20 bp, mouse
gtagccgctacctgagtgag

SEQ ID NO: 568907 - DNA, 20 bp, mouse
gcacctgtcgcccctcactc

SEQ ID NO: 568908 - DNA, 20 bp, mouse
gtaggctcgcagagcaatgg

SEQ ID NO: 568909 - DNA, 20 bp, mouse
gctaggcccgggcccacaag

SEQ ID NO: 568910 - DNA, 20 bp, mouse
gtacctgagtgaggggcgac

SEQ ID NO: 568911 - DNA, 20 bp, mouse
gggccatgccgggagaatct

SEQ ID NO: 568912 - DNA, 20 bp, mouse
gggtgggtggtgggcgtctg

SEQ ID NO: 568913 - DNA, 20 bp, mouse
ggagcgcaaggtaatcgagt

SEQ ID NO: 568914 - DNA, 20 bp, mouse
gctgatgacctgcctatgga

SEQ ID NO: 568915 - DNA, 20 bp, mouse
gggttacccggccctcggta

SEQ ID NO: 568916 - DNA, 20 bp, mouse
gcaggcccgacgagtgatga

SEQ ID NO: 568917 - DNA, 20 bp, mouse
gttggcagaactaggccggg

SEQ ID NO: 568918 - DNA, 20 bp, mouse
gggctcatgctggcggaaga

SEQ ID NO: 568919 - DNA, 20 bp, mouse
gcgcttggcagaactaggcc

SEQ ID NO: 568920 - DNA, 20 bp, mouse
ggagtgatgatggctcatgc

SEQ ID NO: 568921 - DNA, 20 bp, mouse
gaaggtccggcggtacgagg

SEQ ID NO: 568922 - DNA, 20 bp, mouse
gttcagcgcttggcagaact

SEQ ID NO: 568923 - DNA, 20 bp, mouse
gggagctgcagaccgatgcg

SEQ ID NO: 568924 - DNA, 20 bp, mouse
gtgatgatggctcatgctgg

SEQ ID NO: 568925 - DNA, 20 bp, mouse
gcggcggcccaaaggtccgg

SEQ ID NO: 568926 - DNA, 20 bp, mouse
gcggtagccggagctaatct

SEQ ID NO: 568927 - DNA, 20 bp, mouse
gatccccgttaactcagtaa

SEQ ID NO: 568928 - DNA, 20 bp, mouse
gtaacggggatcccaagcta

SEQ ID NO: 568929 - DNA, 20 bp, mouse
gcggcggcctagattagctc

SEQ ID NO: 568930 - DNA, 20 bp, mouse
ggctagggaggccccaaaat

SEQ ID NO: 568931 - DNA, 20 bp, mouse
ggggaaggactctgcagata

SEQ ID NO: 568932 - DNA, 20 bp, mouse
ggtggaagctgaaccgtggg

SEQ ID NO: 568933 - DNA, 20 bp, mouse
gggagtggaagctgaaccgt

SEQ ID NO: 568934 - DNA, 20 bp, mouse
gggactgtccctccttggct

SEQ ID NO: 568935 - DNA, 20 bp, mouse
ggagtccttcccagccaagg

SEQ ID NO: 568936 - DNA, 20 bp, mouse
gggagatagaaaaccgacag

SEQ ID NO: 568937 - DNA, 20 bp, mouse
ggtgtttgccttgtttgtag

SEQ ID NO: 568938 - DNA, 20 bp, mouse
gtcactgtcctctacaaaca

SEQ ID NO: 568939 - DNA, 20 bp, mouse
gtataaaaagaccttttttg

SEQ ID NO: 568940 - DNA, 20 bp, mouse
gtgttatgaaaaaacaatag

SEQ ID NO: 568941 - DNA, 20 bp, mouse
ggcatcttctaccacaaaaa

SEQ ID NO: 568942 - DNA, 20 bp, mouse
gcaggaatgtttttaggaaa

SEQ ID NO: 568943 - DNA, 20 bp, mouse
gcataattctttgcctctgt

SEQ ID NO: 568944 - DNA, 20 bp, mouse
gacatatcaggaatgttttt

SEQ ID NO: 568945 - DNA, 20 bp, mouse
gcttcctccagcacaacctt

SEQ ID NO: 568946 - DNA, 20 bp, mouse
ggggcgggaatgtaagatgg

SEQ ID NO: 568947 - DNA, 20 bp, mouse
ggctgggcgggaatgtaaga

SEQ ID NO: 568948 - DNA, 20 bp, mouse
gcacgggaacggaagtcagc

SEQ ID NO: 568949 - DNA, 20 bp, mouse
gtccgttcccgtgttggcag

SEQ ID NO: 568950 - DNA, 20 bp, mouse
ggttcccgtgttggcagcgg

SEQ ID NO: 568951 - DNA, 20 bp, mouse
gttggttggacgggtgtgag

SEQ ID NO: 568952 - DNA, 20 bp, mouse
ggccgccgccgctgccaaca

SEQ ID NO: 568953 - DNA, 20 bp, mouse
gggatgaacgcgaccctctc

SEQ ID NO: 568954 - DNA, 20 bp, mouse
ggcgaccactgagcacgttg

SEQ ID NO: 568955 - DNA, 20 bp, mouse
gccaggccatggcaactcgg

SEQ ID NO: 568956 - DNA, 20 bp, mouse
gaagcgcgcgagagcacgcg

SEQ ID NO: 568957 - DNA, 20 bp, mouse
gtaacggcgtggaccgggag

SEQ ID NO: 568958 - DNA, 20 bp, mouse
gggccgcggccggaagtccc

SEQ ID NO: 568959 - DNA, 20 bp, mouse
ggggaggggggagaacctca

SEQ ID NO: 568960 - DNA, 20 bp, mouse
ggctctttttggttactcag

SEQ ID NO: 568961 - DNA, 20 bp, mouse
gcccgcggctcctcaggtaa

SEQ ID NO: 568962 - DNA, 20 bp, mouse
gaggggggagaacctcaggg

SEQ ID NO: 568963 - DNA, 20 bp, mouse
gcgcggccggaagtcccggg

SEQ ID NO: 568964 - DNA, 20 bp, mouse
gcagcgctcctgcacctcca

SEQ ID NO: 568965 - DNA, 20 bp, mouse
gttccggccgcggcccctgg

SEQ ID NO: 568966 - DNA, 20 bp, mouse
gacgcagcagcaggatctag

SEQ ID NO: 568967 - DNA, 20 bp, mouse
gccaggtgggagcctcgctg

SEQ ID NO: 568968 - DNA, 20 bp, mouse
gactactgctaccgttgctg

SEQ ID NO: 568969 - DNA, 20 bp, mouse
gcagcagcaggatctagggg

SEQ ID NO: 568970 - DNA, 20 bp, mouse
ggcctgggctgctggtgaag

SEQ ID NO: 568971 - DNA, 20 bp, mouse
ggatacgcgtagagactcca

SEQ ID NO: 568972 - DNA, 20 bp, mouse
gcacgcgctgcgacaggtcc

SEQ ID NO: 568973 - DNA, 20 bp, mouse
gctgaggagcgcgctggaga

SEQ ID NO: 568974 - DNA, 20 bp, mouse
gttgccgtcccgccccggaa

SEQ ID NO: 568975 - DNA, 20 bp, mouse
ggggcgggacggcaacaacg

SEQ ID NO: 568976 - DNA, 20 bp, mouse
gctcggctgcgccttcggtg

SEQ ID NO: 568977 - DNA, 20 bp, mouse
gctgccgcggggtccgaagg

SEQ ID NO: 568978 - DNA, 20 bp, mouse
gcggggtccgaaggaggctg

SEQ ID NO: 568979 - DNA, 20 bp, mouse
gtcggtgcggcttggagatc

SEQ ID NO: 568980 - DNA, 20 bp, mouse
gggcgcgacacagatgcgtc

SEQ ID NO: 568981 - DNA, 20 bp, mouse
gcagagcacgcggacagcgg

SEQ ID NO: 568982 - DNA, 20 bp, mouse
gggagttggccgagaagact

SEQ ID NO: 568983 - DNA, 20 bp, mouse
ggcccgaggcgcggctacag

SEQ ID NO: 568984 - DNA, 20 bp, mouse
ggtcgcgcctcgtccctctg

SEQ ID NO: 568985 - DNA, 20 bp, mouse
ggtgcaggcggccgtggagt

SEQ ID NO: 568986 - DNA, 20 bp, mouse
gacggcgtcttacagcaaaa

SEQ ID NO: 568987 - DNA, 20 bp, mouse
gggagcccaatcatccacta

SEQ ID NO: 568988 - DNA, 20 bp, mouse
gttgggctccaatcagacgt

SEQ ID NO: 568989 - DNA, 20 bp, mouse
ggagggcaactgactagagt

SEQ ID NO: 568990 - DNA, 20 bp, mouse
gttcgagactgcgaggccag

SEQ ID NO: 568991 - DNA, 20 bp, mouse
ggctggggtcgggaccaggt

SEQ ID NO: 568992 - DNA, 20 bp, mouse
gccagccttagtggatgatt

SEQ ID NO: 568993 - DNA, 20 bp, mouse
gggctggtggagccgaacac

SEQ ID NO: 568994 - DNA, 20 bp, mouse
ggctcgccccggagcaacaa

SEQ ID NO: 568995 - DNA, 20 bp, mouse
gggctccaatcagacgtagg

SEQ ID NO: 568996 - DNA, 20 bp, mouse
gttactagtctaagagcctg

SEQ ID NO: 568997 - DNA, 20 bp, mouse
gtggggattagacgaagttc

SEQ ID NO: 568998 - DNA, 20 bp, mouse
gtggggtcttgagctggaca

SEQ ID NO: 568999 - DNA, 20 bp, mouse
gcgtagacgtggtctctaca

SEQ ID NO: 569000 - DNA, 20 bp, mouse
gtcttgagctggacagggaa

SEQ ID NO: 569001 - DNA, 20 bp, mouse
gagttcgagtaacggaagac

SEQ ID NO: 569002 - DNA, 20 bp, mouse
ggtgtctcagatgttgccag

SEQ ID NO: 569003 - DNA, 20 bp, mouse
gagtaacggaagacgggacc

SEQ ID NO: 569004 - DNA, 20 bp, mouse
gggcaggagaagagctccgc

SEQ ID NO: 569005 - DNA, 20 bp, mouse
gtcatcaacagttcgagtaa

SEQ ID NO: 569006 - DNA, 20 bp, mouse
gaccgtgagcgcagaggagg

SEQ ID NO: 569007 - DNA, 20 bp, mouse
gtgcaccgtgagcgcagagg

SEQ ID NO: 569008 - DNA, 20 bp, mouse
gtcctcctcctctgcgctca

SEQ ID NO: 569009 - DNA, 20 bp, mouse
gggcgcttgcaagagagaag

SEQ ID NO: 569010 - DNA, 20 bp, mouse
gtcccggacggccccggagt

SEQ ID NO: 569011 - DNA, 20 bp, mouse
gggcgggatggagttacgag

SEQ ID NO: 569012 - DNA, 20 bp, mouse
ggcaagcgccggggcaaagg

SEQ ID NO: 569013 - DNA, 20 bp, mouse
gtggccgcggtggaaattgg

SEQ ID NO: 569014 - DNA, 20 bp, mouse
ggacggccccggagtgggtg

SEQ ID NO: 569015 - DNA, 20 bp, mouse
gctttgcacaaggcggcagg

SEQ ID NO: 569016 - DNA, 20 bp, mouse
gccagactgagaaggaggac

SEQ ID NO: 569017 - DNA, 20 bp, mouse
ggcccagctaagaggagaga

SEQ ID NO: 569018 - DNA, 20 bp, mouse
ggcgggctggcgatctggga

SEQ ID NO: 569019 - DNA, 20 bp, mouse
gaagaggagagatggaattt

SEQ ID NO: 569020 - DNA, 20 bp, mouse
gaggagagatggaatttggg

SEQ ID NO: 569021 - DNA, 20 bp, mouse
gggcctccggtccctttcca

SEQ ID NO: 569022 - DNA, 20 bp, mouse
gaaggaggacaggagcgggc

SEQ ID NO: 569023 - DNA, 20 bp, mouse
gcaggtgagatagtgaaagt

SEQ ID NO: 569024 - DNA, 20 bp, mouse
gaggagcgggctggcgatct

SEQ ID NO: 569025 - DNA, 20 bp, mouse
gagtctgaaggttccaggaa

SEQ ID NO: 569026 - DNA, 20 bp, mouse
gggttggacagcgctgcata

SEQ ID NO: 569027 - DNA, 20 bp, mouse
gcggggcggggatccaagta

SEQ ID NO: 569028 - DNA, 20 bp, mouse
ggaagaaggcctctgacggt

SEQ ID NO: 569029 - DNA, 20 bp, mouse
gcacagaagaaggcctctga

SEQ ID NO: 569030 - DNA, 20 bp, mouse
gggtggggcgaggaccacag

SEQ ID NO: 569031 - DNA, 20 bp, mouse
gggcgatctggtaggaggga

SEQ ID NO: 569032 - DNA, 20 bp, mouse
gctttaaagaagccggaggt

SEQ ID NO: 569033 - DNA, 20 bp, mouse
gagcgctgtccaaccgtcag

SEQ ID NO: 569034 - DNA, 20 bp, mouse
gccgcctgcggctcccggta

SEQ ID NO: 569035 - DNA, 20 bp, mouse
gagggcccgagtgatcaagg

SEQ ID NO: 569036 - DNA, 20 bp, mouse
ggcctcggctcccgaagatc

SEQ ID NO: 569037 - DNA, 20 bp, mouse
ggatctggtagagttggcgg

SEQ ID NO: 569038 - DNA, 20 bp, mouse
gtggaagctggagcgccctc

SEQ ID NO: 569039 - DNA, 20 bp, mouse
gagcctttcagggagccgaa

SEQ ID NO: 569040 - DNA, 20 bp, mouse
gaccagatcttcgggagccg

SEQ ID NO: 569041 - DNA, 20 bp, mouse
ggaggcagccgacgccaaag

SEQ ID NO: 569042 - DNA, 20 bp, mouse
ggcagccgacgccaaagtgg

SEQ ID NO: 569043 - DNA, 20 bp, mouse
gggccccggatgaggaagtg

SEQ ID NO: 569044 - DNA, 20 bp, mouse
gatcgaccagagccgaggaa

SEQ ID NO: 569045 - DNA, 20 bp, mouse
gccaactctaccagatcttc

SEQ ID NO: 569046 - DNA, 20 bp, mouse
gtcctacggacgctcaggaa

SEQ ID NO: 569047 - DNA, 20 bp, mouse
gcctcagctagacaggacct

SEQ ID NO: 569048 - DNA, 20 bp, mouse
gtggccaaccaccagcaagt

SEQ ID NO: 569049 - DNA, 20 bp, mouse
gggacctgggctactgactc

SEQ ID NO: 569050 - DNA, 20 bp, mouse
gacccttcctgagcgtccgt

SEQ ID NO: 569051 - DNA, 20 bp, mouse
ggcgcgggctgtctagaaca

SEQ ID NO: 569052 - DNA, 20 bp, mouse
gatgtctcagcgcgttccta

SEQ ID NO: 569053 - DNA, 20 bp, mouse
gctcaggaagggtagtgcgc

SEQ ID NO: 569054 - DNA, 20 bp, mouse
gacactgtcggaacaacctg

SEQ ID NO: 569055 - DNA, 20 bp, mouse
gtgtcggaacaacctggggt

SEQ ID NO: 569056 - DNA, 20 bp, mouse
ggtgggtaggagcagctgca

SEQ ID NO: 569057 - DNA, 20 bp, mouse
gcagggcaggtgtaagagac

SEQ ID NO: 569058 - DNA, 20 bp, mouse
gtgcagctcacgcagcaggc

SEQ ID NO: 569059 - DNA, 20 bp, mouse
gaagagacaggtgcagaagc

SEQ ID NO: 569060 - DNA, 20 bp, mouse
gaggtacaggcagcagggac

SEQ ID NO: 569061 - DNA, 20 bp, mouse
gcagtccggattacaggtac

SEQ ID NO: 569062 - DNA, 20 bp, mouse
gctggccaggatctacatct

SEQ ID NO: 569063 - DNA, 20 bp, mouse
ggagctgcagctcacgcagc

SEQ ID NO: 569064 - DNA, 20 bp, mouse
gctgcccaggcaggtgagac

SEQ ID NO: 569065 - DNA, 20 bp, mouse
gaggaggagagggtgtctcc

SEQ ID NO: 569066 - DNA, 20 bp, mouse
gcctcgtctcggggagttga

SEQ ID NO: 569067 - DNA, 20 bp, mouse
gcggctgcggaggacgagga

SEQ ID NO: 569068 - DNA, 20 bp, mouse
gcgcaccgcgcagccacccg

SEQ ID NO: 569069 - DNA, 20 bp, mouse
gcgcgccgagcgcctcgtct

SEQ ID NO: 569070 - DNA, 20 bp, mouse
ggtcaggacaggcgagcgag

SEQ ID NO: 569071 - DNA, 20 bp, mouse
gccgagcagtcgacatgtgg

SEQ ID NO: 569072 - DNA, 20 bp, mouse
gctgcgcggtgcgctcggcc

SEQ ID NO: 569073 - DNA, 20 bp, mouse
gtggctgacattcttcggtg

SEQ ID NO: 569074 - DNA, 20 bp, mouse
ggacgaggaggggttcccct

SEQ ID NO: 569075 - DNA, 20 bp, mouse
gaggatctggaattagtcct

SEQ ID NO: 569076 - DNA, 20 bp, mouse
gcccagctcggagcacacgg

SEQ ID NO: 569077 - DNA, 20 bp, mouse
ggcacacggagggagctccc

SEQ ID NO: 569078 - DNA, 20 bp, mouse
gagattcaccagcagtgggg

SEQ ID NO: 569079 - DNA, 20 bp, mouse
gcggctgctggcgtgaccga

SEQ ID NO: 569080 - DNA, 20 bp, mouse
gggacccagctcggagcaca

SEQ ID NO: 569081 - DNA, 20 bp, mouse
gccctcgcttcggcaacccc

SEQ ID NO: 569082 - DNA, 20 bp, mouse
gtgctccgagctgggtcctt

SEQ ID NO: 569083 - DNA, 20 bp, mouse
gggttgccgaagcgagggag

SEQ ID NO: 569084 - DNA, 20 bp, mouse
ggcagagagctaggtctcaa

SEQ ID NO: 569085 - DNA, 20 bp, mouse
gagcgcgcggcgatcagcaa

SEQ ID NO: 569086 - DNA, 20 bp, mouse
gacgcggctgtggagagcgg

SEQ ID NO: 569087 - DNA, 20 bp, mouse
ggaacagcttcgaggcttgg

SEQ ID NO: 569088 - DNA, 20 bp, mouse
gcacagccgcgtggagtcca

SEQ ID NO: 569089 - DNA, 20 bp, mouse
gccccgccctggactccacg

SEQ ID NO: 569090 - DNA, 20 bp, mouse
gaagtgctcgaacagcttcg

SEQ ID NO: 569091 - DNA, 20 bp, mouse
ggggctcccagagacatcga

SEQ ID NO: 569092 - DNA, 20 bp, mouse
ggttaggagagaagagggta

SEQ ID NO: 569093 - DNA, 20 bp, mouse
gggtgcagctcagacagttg

SEQ ID NO: 569094 - DNA, 20 bp, mouse
ggagggcaggcgtaaggctg

SEQ ID NO: 569095 - DNA, 20 bp, mouse
gtccagggcgggggtccgtt

SEQ ID NO: 569096 - DNA, 20 bp, mouse
gtgagacaagccaccccggg

SEQ ID NO: 569097 - DNA, 20 bp, mouse
gcacccaggtccccccgggg

SEQ ID NO: 569098 - DNA, 20 bp, mouse
ggatatggctgggggataca

SEQ ID NO: 569099 - DNA, 20 bp, mouse
gctgccacccaggtcccccc

SEQ ID NO: 569100 - DNA, 20 bp, mouse
gtggcagcagaggcaccttg

SEQ ID NO: 569101 - DNA, 20 bp, mouse
gcagagggactctatcccca

SEQ ID NO: 569102 - DNA, 20 bp, mouse
gagccaccccggggggacct

SEQ ID NO: 569103 - DNA, 20 bp, mouse
gcggggcaaacagaacccag

SEQ ID NO: 569104 - DNA, 20 bp, mouse
ggggttttgggatgctgcat

SEQ ID NO: 569105 - DNA, 20 bp, mouse
ggggtgagacaagccacccc

SEQ ID NO: 569106 - DNA, 20 bp, mouse
ggcttcaggcgctgatggag

SEQ ID NO: 569107 - DNA, 20 bp, mouse
gcgggtgcagggtgcagcgc

SEQ ID NO: 569108 - DNA, 20 bp, mouse
ggagcggcttcaggcgctga

SEQ ID NO: 569109 - DNA, 20 bp, mouse
gtgcagggtgcagcgcgggc

SEQ ID NO: 569110 - DNA, 20 bp, mouse
ggcgctgctagcgggctcgg

SEQ ID NO: 569111 - DNA, 20 bp, mouse
ggtctcgtgctctacagctc

SEQ ID NO: 569112 - DNA, 20 bp, mouse
ggaggtgagcgcgctgctag

SEQ ID NO: 569113 - DNA, 20 bp, mouse
gagcgcgctgctagcgggct

SEQ ID NO: 569114 - DNA, 20 bp, mouse
gctggagaggcgcgggtgca

SEQ ID NO: 569115 - DNA, 20 bp, mouse
ggcgcgggcggagcggcttc

SEQ ID NO: 569116 - DNA, 20 bp, mouse
ggggtcggtgcaggctgagt

SEQ ID NO: 569117 - DNA, 20 bp, mouse
gcgagctgcgtgggcagtgg

SEQ ID NO: 569118 - DNA, 20 bp, mouse
gcgagagcccgggtggtacg

SEQ ID NO: 569119 - DNA, 20 bp, mouse
ggtggtggcgagagcccggg

SEQ ID NO: 569120 - DNA, 20 bp, mouse
gcctagaggcgagggatcca

SEQ ID NO: 569121 - DNA, 20 bp, mouse
gtgcggggctcgagctgcgt

SEQ ID NO: 569122 - DNA, 20 bp, mouse
ggctcgagctgcgtgggcag

SEQ ID NO: 569123 - DNA, 20 bp, mouse
gaggaagtaggcgcagacag

SEQ ID NO: 569124 - DNA, 20 bp, mouse
ggcagtggtggcgagagccc

SEQ ID NO: 569125 - DNA, 20 bp, mouse
gaagatgctgctgggagggg

SEQ ID NO: 569126 - DNA, 20 bp, mouse
ggtgccaacggaaggaggaa

SEQ ID NO: 569127 - DNA, 20 bp, mouse
gggctgcagcaagatttgga

SEQ ID NO: 569128 - DNA, 20 bp, mouse
gggcatagcggctgcggcaa

SEQ ID NO: 569129 - DNA, 20 bp, mouse
gcaatggctgcagcaagatt

SEQ ID NO: 569130 - DNA, 20 bp, mouse
gaggaggtgccaacggaagg

SEQ ID NO: 569131 - DNA, 20 bp, mouse
ggggaggaggtgccaacgga

SEQ ID NO: 569132 - DNA, 20 bp, mouse
gggtcctgcttctttcgttt

SEQ ID NO: 569133 - DNA, 20 bp, mouse
gtgccgcaggccagtccacg

SEQ ID NO: 569134 - DNA, 20 bp, mouse
gttctttcgtttcggcatag

SEQ ID NO: 569135 - DNA, 20 bp, mouse
gcgtttcggcatagcggctg

SEQ ID NO: 569136 - DNA, 20 bp, mouse
gcgcggggccctgtgaacca

SEQ ID NO: 569137 - DNA, 20 bp, mouse
gtgtgaaccatggctcgcgg

SEQ ID NO: 569138 - DNA, 20 bp, mouse
gccctgtgaaccatggctcg

SEQ ID NO: 569139 - DNA, 20 bp, mouse
ggcgctgggagtgctgcccc

SEQ ID NO: 569140 - DNA, 20 bp, mouse
gcccctacgacgatagtcgg

SEQ ID NO: 569141 - DNA, 20 bp, mouse
gtaaggcgcgcagcccggag

SEQ ID NO: 569142 - DNA, 20 bp, mouse
gacccgggcgggaccccacg

SEQ ID NO: 569143 - DNA, 20 bp, mouse
gcgcccagcctcagtgacct

SEQ ID NO: 569144 - DNA, 20 bp, mouse
ggcaagcccggcgaccccgt

SEQ ID NO: 569145 - DNA, 20 bp, mouse
ggttcacagggccccgcgct

SEQ ID NO: 569146 - DNA, 20 bp, mouse
ggcacggggaccgaggtgag

SEQ ID NO: 569147 - DNA, 20 bp, mouse
gctgtccgggctctgcgtgg

SEQ ID NO: 569148 - DNA, 20 bp, mouse
ggggctctgcgtggtggagg

SEQ ID NO: 569149 - DNA, 20 bp, mouse
gtccgggctctgcgtggtgg

SEQ ID NO: 569150 - DNA, 20 bp, mouse
gggcggctgcacggggaccg

SEQ ID NO: 569151 - DNA, 20 bp, mouse
gcgcagcctcgcctcgcgaa

SEQ ID NO: 569152 - DNA, 20 bp, mouse
gcgaggctgcgcggtaggga

SEQ ID NO: 569153 - DNA, 20 bp, mouse
gagtgccgccgagcgtccgg

SEQ ID NO: 569154 - DNA, 20 bp, mouse
ggaaccgggaatatcccaag

SEQ ID NO: 569155 - DNA, 20 bp, mouse
ggcgtccggaggtggggtaa

SEQ ID NO: 569156 - DNA, 20 bp, mouse
gctacggcggagagaaacct

SEQ ID NO: 569157 - DNA, 20 bp, mouse
gagcctgactctgagagcta

SEQ ID NO: 569158 - DNA, 20 bp, mouse
gctgactctgagagctacgg

SEQ ID NO: 569159 - DNA, 20 bp, mouse
gcaggacgcgacccggcgta

SEQ ID NO: 569160 - DNA, 20 bp, mouse
gacctgggcaggacgcgacc

SEQ ID NO: 569161 - DNA, 20 bp, mouse
gcacgccggggaccccaagg

SEQ ID NO: 569162 - DNA, 20 bp, mouse
gacccggcgtagggcagagc

SEQ ID NO: 569163 - DNA, 20 bp, mouse
ggagcgctcagagtccgaga

SEQ ID NO: 569164 - DNA, 20 bp, mouse
gcccagctctgccctacgcc

SEQ ID NO: 569165 - DNA, 20 bp, mouse
gcgctcagagtccgagacgg

SEQ ID NO: 569166 - DNA, 20 bp, mouse
gtccagcccaacgctccgag

SEQ ID NO: 569167 - DNA, 20 bp, mouse
gccaagcttggagccggcag

SEQ ID NO: 569168 - DNA, 20 bp, mouse
ggagtggcgataccaggcta

SEQ ID NO: 569169 - DNA, 20 bp, mouse
ggaaagccgctcggagcgtt

SEQ ID NO: 569170 - DNA, 20 bp, mouse
gctcggggcaagcggcccaa

SEQ ID NO: 569171 - DNA, 20 bp, mouse
gcagccgtcgcggtactcac

SEQ ID NO: 569172 - DNA, 20 bp, mouse
ggccgggcgggaacagagcg

SEQ ID NO: 569173 - DNA, 20 bp, mouse
ggccgctcggagcgttgggc

SEQ ID NO: 569174 - DNA, 20 bp, mouse
ggggcccgtgagtaccgcga

SEQ ID NO: 569175 - DNA, 20 bp, mouse
gaacggacagaacccaagct

SEQ ID NO: 569176 - DNA, 20 bp, mouse
ggtagtagaaagtacagtct

SEQ ID NO: 569177 - DNA, 20 bp, mouse
gctgtggagtctaggatggt

SEQ ID NO: 569178 - DNA, 20 bp, mouse
ggatagaaacagaacagtgg

SEQ ID NO: 569179 - DNA, 20 bp, mouse
gtctcagagatggaacatca

SEQ ID NO: 569180 - DNA, 20 bp, mouse
gcaatgaaggatgtggactg

SEQ ID NO: 569181 - DNA, 20 bp, mouse
ggatgtggactgtggagtct

SEQ ID NO: 569182 - DNA, 20 bp, mouse
gatggaacatcagggattaa

SEQ ID NO: 569183 - DNA, 20 bp, mouse
gatcaagggaatctatgata

SEQ ID NO: 569184 - DNA, 20 bp, mouse
gggaatgaataccagagagg

SEQ ID NO: 569185 - DNA, 20 bp, mouse
gaaggactggacaaaagcac

SEQ ID NO: 569186 - DNA, 20 bp, mouse
ggcggggatccggcttacgg

SEQ ID NO: 569187 - DNA, 20 bp, mouse
ggtaagccggatccccgcga

SEQ ID NO: 569188 - DNA, 20 bp, mouse
gatccggcttacggtggacg

SEQ ID NO: 569189 - DNA, 20 bp, mouse
gggcggcgcggaggccatct

SEQ ID NO: 569190 - DNA, 20 bp, mouse
gacgcgggcgagccccaggt

SEQ ID NO: 569191 - DNA, 20 bp, mouse
gccgcgagggacccccgacc

SEQ ID NO: 569192 - DNA, 20 bp, mouse
gcggccggcccgcccacctg

SEQ ID NO: 569193 - DNA, 20 bp, mouse
gggccagcggcggagtgcgg

SEQ ID NO: 569194 - DNA, 20 bp, mouse
gcgcggggcacacgctcctc

SEQ ID NO: 569195 - DNA, 20 bp, mouse
ggacactcgtcgggacaacg

SEQ ID NO: 569196 - DNA, 20 bp, mouse
gccagccgcggagtgagcga

SEQ ID NO: 569197 - DNA, 20 bp, mouse
ggtctccctcgctcactccg

SEQ ID NO: 569198 - DNA, 20 bp, mouse
gggcttcccggggcggatgg

SEQ ID NO: 569199 - DNA, 20 bp, mouse
gtccgactaacggcccatcc

SEQ ID NO: 569200 - DNA, 20 bp, mouse
gcgggctcaaaggcttcccg

SEQ ID NO: 569201 - DNA, 20 bp, mouse
gtagcgccgggtggcagcaa

SEQ ID NO: 569202 - DNA, 20 bp, mouse
ggctcaaaggcttcccgggg

SEQ ID NO: 569203 - DNA, 20 bp, mouse
gcacccggctaggtgagtct

SEQ ID NO: 569204 - DNA, 20 bp, mouse
ggcgacgcgagcaggaaccg

SEQ ID NO: 569205 - DNA, 20 bp, mouse
ggcggctgggctccgactaa

SEQ ID NO: 569206 - DNA, 20 bp, mouse
ggcgcggacgcagaccaggt

SEQ ID NO: 569207 - DNA, 20 bp, mouse
gtccagcgagcgccgaggag

SEQ ID NO: 569208 - DNA, 20 bp, mouse
ggagagggacctagatggag

SEQ ID NO: 569209 - DNA, 20 bp, mouse
gggccgcgaagacacaacaa

SEQ ID NO: 569210 - DNA, 20 bp, mouse
gacgcagaccaggtgggccg

SEQ ID NO: 569211 - DNA, 20 bp, mouse
gcgacgggcccgggcgatgg

SEQ ID NO: 569212 - DNA, 20 bp, mouse
gtcgcgcgcggacgcagacc

SEQ ID NO: 569213 - DNA, 20 bp, mouse
gcagaggggctgcggaagag

SEQ ID NO: 569214 - DNA, 20 bp, mouse
gggcccgggcgatggcggtc

SEQ ID NO: 569215 - DNA, 20 bp, mouse
gcggagacaaagcgcaaccc

SEQ ID NO: 569216 - DNA, 20 bp, mouse
ggtcatgacgtagcacgtag

SEQ ID NO: 569217 - DNA, 20 bp, mouse
gggaggtagcgaaagtgctt

SEQ ID NO: 569218 - DNA, 20 bp, mouse
gctttcgctacctcctgaga

SEQ ID NO: 569219 - DNA, 20 bp, mouse
gtggcgggtaaggagagcga

SEQ ID NO: 569220 - DNA, 20 bp, mouse
gccgtgaagaggcccgatgg

SEQ ID NO: 569221 - DNA, 20 bp, mouse
ggctttggcggtttgtacgg

SEQ ID NO: 569222 - DNA, 20 bp, mouse
gagtgctttggcggtttgta

SEQ ID NO: 569223 - DNA, 20 bp, mouse
gggtagcgaaagtgctttgg

SEQ ID NO: 569224 - DNA, 20 bp, mouse
ggcacgacgccgggagccca

SEQ ID NO: 569225 - DNA, 20 bp, mouse
gggaccgtgaagaggcccga

SEQ ID NO: 569226 - DNA, 20 bp, mouse
gctcctggctccggctctag

SEQ ID NO: 569227 - DNA, 20 bp, mouse
gcagctgctgctgatgcgaa

SEQ ID NO: 569228 - DNA, 20 bp, mouse
gtccttggagagaacgtggt

SEQ ID NO: 569229 - DNA, 20 bp, mouse
gtgcgcgcacccgctagagc

SEQ ID NO: 569230 - DNA, 20 bp, mouse
ggccgtggcgggagacttaa

SEQ ID NO: 569231 - DNA, 20 bp, mouse
gacccgctagagccggagcc

SEQ ID NO: 569232 - DNA, 20 bp, mouse
gtgtggagaggagtgagccg

SEQ ID NO: 569233 - DNA, 20 bp, mouse
ggcagcggtgcgggactcct

SEQ ID NO: 569234 - DNA, 20 bp, mouse
ggcctggccaagctcaagtg

SEQ ID NO: 569235 - DNA, 20 bp, mouse
gaagctaggacaccgctcgg

SEQ ID NO: 569236 - DNA, 20 bp, mouse
ggaagcgcctccgcgactag

SEQ ID NO: 569237 - DNA, 20 bp, mouse
gagtcactcacgtttccggg

SEQ ID NO: 569238 - DNA, 20 bp, mouse
gattctgcccctagtcgcgg

SEQ ID NO: 569239 - DNA, 20 bp, mouse
gcctgtcgggcggaagtagg

SEQ ID NO: 569240 - DNA, 20 bp, mouse
ggactcgggctggacaagta

SEQ ID NO: 569241 - DNA, 20 bp, mouse
gataattctgcccctagtcg

SEQ ID NO: 569242 - DNA, 20 bp, mouse
gtgctccccgagaaactcct

SEQ ID NO: 569243 - DNA, 20 bp, mouse
gggctcgggcctagtaaccc

SEQ ID NO: 569244 - DNA, 20 bp, mouse
gtcgggcctagtaacccagg

SEQ ID NO: 569245 - DNA, 20 bp, mouse
gggttcctagaataactggg

SEQ ID NO: 569246 - DNA, 20 bp, mouse
gcgggctgcgtgcgcaaaca

SEQ ID NO: 569247 - DNA, 20 bp, mouse
ggctgcgtgcgcaaacaggg

SEQ ID NO: 569248 - DNA, 20 bp, mouse
gtggatgcccccagccccga

SEQ ID NO: 569249 - DNA, 20 bp, mouse
gggccggctgaagcgaccta

SEQ ID NO: 569250 - DNA, 20 bp, mouse
gacacgggccctgcttgaag

SEQ ID NO: 569251 - DNA, 20 bp, mouse
ggcgacctagggcttaggtg

SEQ ID NO: 569252 - DNA, 20 bp, mouse
gggtctggcggagcccccag

SEQ ID NO: 569253 - DNA, 20 bp, mouse
ggctggtgtccagcgaaggt

SEQ ID NO: 569254 - DNA, 20 bp, mouse
ggtgttgctgggccagaagc

SEQ ID NO: 569255 - DNA, 20 bp, mouse
gtgggagccgggcactgttg

SEQ ID NO: 569256 - DNA, 20 bp, mouse
gacacaagctgggccccgtg

SEQ ID NO: 569257 - DNA, 20 bp, mouse
ggaactgcgagggtaagtct

SEQ ID NO: 569258 - DNA, 20 bp, mouse
gcgtccggtagcggtgggag

SEQ ID NO: 569259 - DNA, 20 bp, mouse
gatccgcgcaggggcgctcg

SEQ ID NO: 569260 - DNA, 20 bp, mouse
gacacaggtgcggcgaccag

SEQ ID NO: 569261 - DNA, 20 bp, mouse
ggcgcccggggacacaggtg

SEQ ID NO: 569262 - DNA, 20 bp, mouse
gcgacaccaggacgcaaaag

SEQ ID NO: 569263 - DNA, 20 bp, mouse
gtaactcggttcccgcccag

SEQ ID NO: 569264 - DNA, 20 bp, mouse
gtactcccgggaagctgcgg

SEQ ID NO: 569265 - DNA, 20 bp, mouse
ggcggctccaaggcgacacc

SEQ ID NO: 569266 - DNA, 20 bp, mouse
gtcagtccgggatggcgcag

SEQ ID NO: 569267 - DNA, 20 bp, mouse
gctcctgcgccagcagtcag

SEQ ID NO: 569268 - DNA, 20 bp, mouse
ggtctctgaagctggagtca

SEQ ID NO: 569269 - DNA, 20 bp, mouse
gttagtgtctcagtccggga

SEQ ID NO: 569270 - DNA, 20 bp, mouse
gtaccgccgctgcgccatcc

SEQ ID NO: 569271 - DNA, 20 bp, mouse
ggggcaagtggaggttaggt

SEQ ID NO: 569272 - DNA, 20 bp, mouse
ggagtcttagtgtctcagtc

SEQ ID NO: 569273 - DNA, 20 bp, mouse
gtccaagggagctaaactgg

SEQ ID NO: 569274 - DNA, 20 bp, mouse
ggccacacaacatcccagag

SEQ ID NO: 569275 - DNA, 20 bp, mouse
gagcagcagcagcgcggaaa

SEQ ID NO: 569276 - DNA, 20 bp, mouse
gctgcagcagccgcagaccg

SEQ ID NO: 569277 - DNA, 20 bp, mouse
gcagcagccgcagaccgggg

SEQ ID NO: 569278 - DNA, 20 bp, mouse
ggcaggagcagtcccgaggc

SEQ ID NO: 569279 - DNA, 20 bp, mouse
gtgccaggcgaactagaggg

SEQ ID NO: 569280 - DNA, 20 bp, mouse
gttgttccctccccggtctg

SEQ ID NO: 569281 - DNA, 20 bp, mouse
gctcatccgctgccagcctc

SEQ ID NO: 569282 - DNA, 20 bp, mouse
gaagggccgagcaaacccgg

SEQ ID NO: 569283 - DNA, 20 bp, mouse
gaggtggtgcccagagagga

SEQ ID NO: 569284 - DNA, 20 bp, mouse
ggagcaaacccggaggagag

SEQ ID NO: 569285 - DNA, 20 bp, mouse
gcacagacttgttccctccc

SEQ ID NO: 569286 - DNA, 20 bp, mouse
gccaagcctgagcatctcgg

SEQ ID NO: 569287 - DNA, 20 bp, mouse
gtccctgcagccgctcccgg

SEQ ID NO: 569288 - DNA, 20 bp, mouse
ggcctccgggagcggctgca

SEQ ID NO: 569289 - DNA, 20 bp, mouse
ggaggatgcgcctccgggag

SEQ ID NO: 569290 - DNA, 20 bp, mouse
gtggccaagcctgagcatct

SEQ ID NO: 569291 - DNA, 20 bp, mouse
gcaaggtgaacgcatggctg

SEQ ID NO: 569292 - DNA, 20 bp, mouse
ggcgtccctgcagccgctcc

SEQ ID NO: 569293 - DNA, 20 bp, mouse
gcggatgcagcgcgcaggtg

SEQ ID NO: 569294 - DNA, 20 bp, mouse
gcgcgcgcaaggtgaacgca

SEQ ID NO: 569295 - DNA, 20 bp, mouse
gatcagccgcagagactagg

SEQ ID NO: 569296 - DNA, 20 bp, mouse
gctggcagccacaggctcgg

SEQ ID NO: 569297 - DNA, 20 bp, mouse
gcaatcagctgcgggagagt

SEQ ID NO: 569298 - DNA, 20 bp, mouse
gtcgcctgagggtgtttctc

SEQ ID NO: 569299 - DNA, 20 bp, mouse
gctgccggcccgggtagggg

SEQ ID NO: 569300 - DNA, 20 bp, mouse
gcgcctgccggcccgggtag

SEQ ID NO: 569301 - DNA, 20 bp, mouse
gtgagggtgtttctcgggaa

SEQ ID NO: 569302 - DNA, 20 bp, mouse
gcagcgccaggctgagaacg

SEQ ID NO: 569303 - DNA, 20 bp, mouse
gtcgggaatggcgtgcttgt

SEQ ID NO: 569304 - DNA, 20 bp, mouse
gaggggcggaccgcgaacag

SEQ ID NO: 569305 - DNA, 20 bp, mouse
ggacccagccggggacagac

SEQ ID NO: 569306 - DNA, 20 bp, mouse
gtttcggtccgaggaaaagg

SEQ ID NO: 569307 - DNA, 20 bp, mouse
gaacgtcaggcgccgcacaa

SEQ ID NO: 569308 - DNA, 20 bp, mouse
gataggagcctgtaattacg

SEQ ID NO: 569309 - DNA, 20 bp, mouse
gggcacaggctggcatggag

SEQ ID NO: 569310 - DNA, 20 bp, mouse
ggttggatcaagaagctctc

SEQ ID NO: 569311 - DNA, 20 bp, mouse
gacgtggcaaagcctttgtg

SEQ ID NO: 569312 - DNA, 20 bp, mouse
gggagattgtgatggagaaa

SEQ ID NO: 569313 - DNA, 20 bp, mouse
gggagctccgcacggagaag

SEQ ID NO: 569314 - DNA, 20 bp, mouse
gagctctctggcacttcaaa

SEQ ID NO: 569315 - DNA, 20 bp, mouse
gtggagatctgccctcccag

SEQ ID NO: 569316 - DNA, 20 bp, mouse
ggatccggcacagtgagcag

SEQ ID NO: 569317 - DNA, 20 bp, mouse
ggaccgactgacttgagatc

SEQ ID NO: 569318 - DNA, 20 bp, mouse
ggcggtccgcccgtagggga

SEQ ID NO: 569319 - DNA, 20 bp, mouse
gccgggcgctggcgggtcta

SEQ ID NO: 569320 - DNA, 20 bp, mouse
gggcgggtctagggcgaagg

SEQ ID NO: 569321 - DNA, 20 bp, mouse
ggggtctagggcgaaggcgg

SEQ ID NO: 569322 - DNA, 20 bp, mouse
gcggcgcgcgaaccgtccgg

SEQ ID NO: 569323 - DNA, 20 bp, mouse
gacgcggggaggggagccag

SEQ ID NO: 569324 - DNA, 20 bp, mouse
gcgggccgctggctagtgag

SEQ ID NO: 569325 - DNA, 20 bp, mouse
gaaccgtccgggggcagcag

SEQ ID NO: 569326 - DNA, 20 bp, mouse
gctgggccttgggacttcac

SEQ ID NO: 569327 - DNA, 20 bp, mouse
ggcccagcgcagggagccgg

SEQ ID NO: 569328 - DNA, 20 bp, mouse
ggcccgcctcccgcagaggt

SEQ ID NO: 569329 - DNA, 20 bp, mouse
gtagggtcgtggcttgggaa

SEQ ID NO: 569330 - DNA, 20 bp, mouse
gccaggccggagccacgcac

SEQ ID NO: 569331 - DNA, 20 bp, mouse
gagccccgcgtgcggactag

SEQ ID NO: 569332 - DNA, 20 bp, mouse
gcgatcgccggacccagctg

SEQ ID NO: 569333 - DNA, 20 bp, mouse
gtatgccgaaggctgaccgt

SEQ ID NO: 569334 - DNA, 20 bp, mouse
gagcagctcgggccaaaagc

SEQ ID NO: 569335 - DNA, 20 bp, mouse
gtataaaggcgagtgctgag

SEQ ID NO: 569336 - DNA, 20 bp, mouse
gaaagttcatggcttctaga

SEQ ID NO: 569337 - DNA, 20 bp, mouse
ggtctaaaaaagaaggcata

SEQ ID NO: 569338 - DNA, 20 bp, mouse
ggaacagtaagagaaagctg

SEQ ID NO: 569339 - DNA, 20 bp, mouse
ggtaagagaaagctgtggtg

SEQ ID NO: 569340 - DNA, 20 bp, mouse
ggccatgaactttaccacca

SEQ ID NO: 569341 - DNA, 20 bp, mouse
gcagccaaaatccagtcttc

SEQ ID NO: 569342 - DNA, 20 bp, mouse
ggccttggtggtaaagttca

SEQ ID NO: 569343 - DNA, 20 bp, mouse
gtgttctggggccagaagac

SEQ ID NO: 569344 - DNA, 20 bp, mouse
ggtgcactcattgtggcaga

SEQ ID NO: 569345 - DNA, 20 bp, mouse
gacctgatggcttcaggaaa

SEQ ID NO: 569346 - DNA, 20 bp, mouse
ggtgctggctgtgattttag

SEQ ID NO: 569347 - DNA, 20 bp, mouse
gacgcagcgggcgagcgcca

SEQ ID NO: 569348 - DNA, 20 bp, mouse
gaatcacagccagcacgcag

SEQ ID NO: 569349 - DNA, 20 bp, mouse
ggcgctcgcccgctgcgtgc

SEQ ID NO: 569350 - DNA, 20 bp, mouse
gcgggcgagcgccatggctg

SEQ ID NO: 569351 - DNA, 20 bp, mouse
ggcccagcatggaccacact

SEQ ID NO: 569352 - DNA, 20 bp, mouse
gacactcggcgccgcagcca

SEQ ID NO: 569353 - DNA, 20 bp, mouse
gggcagctggaggatcacac

SEQ ID NO: 569354 - DNA, 20 bp, mouse
ggggcagcggggatccgcag

SEQ ID NO: 569355 - DNA, 20 bp, mouse
gagcggcgtggaatcgtcgg

SEQ ID NO: 569356 - DNA, 20 bp, mouse
gttcctaacacagaatactg

SEQ ID NO: 569357 - DNA, 20 bp, mouse
gcagtcaaggctccatggtt

SEQ ID NO: 569358 - DNA, 20 bp, mouse
gctggggagaatggcagtca

SEQ ID NO: 569359 - DNA, 20 bp, mouse
gcacagaatactggggagaa

SEQ ID NO: 569360 - DNA, 20 bp, mouse
gaatggcagtcaaggctcca

SEQ ID NO: 569361 - DNA, 20 bp, mouse
gagagctctagcctacaccc

SEQ ID NO: 569362 - DNA, 20 bp, mouse
gatgcattgaagggatccag

SEQ ID NO: 569363 - DNA, 20 bp, mouse
gagccctgaggacatattat

SEQ ID NO: 569364 - DNA, 20 bp, mouse
gctgcaggtgaggcgagtag

SEQ ID NO: 569365 - DNA, 20 bp, mouse
ggtcaactccaggtaagatg

SEQ ID NO: 569366 - DNA, 20 bp, mouse
gaggatcagaagtgcactca

SEQ ID NO: 569367 - DNA, 20 bp, mouse
gaggctaagtgagaaaaaca

SEQ ID NO: 569368 - DNA, 20 bp, mouse
gagtagggagaaggtttgag

SEQ ID NO: 569369 - DNA, 20 bp, mouse
gcaccaattagaatgaagac

SEQ ID NO: 569370 - DNA, 20 bp, mouse
gggcaagacctaagacatat

SEQ ID NO: 569371 - DNA, 20 bp, mouse
gggtgagactatcagaatat

SEQ ID NO: 569372 - DNA, 20 bp, mouse
ggttcatatatttcattcag

SEQ ID NO: 569373 - DNA, 20 bp, mouse
gtccttaagaacacctgtgg

SEQ ID NO: 569374 - DNA, 20 bp, mouse
gagtcaagcagtggacatgc

SEQ ID NO: 569375 - DNA, 20 bp, mouse
gagagatggacctattaaac

SEQ ID NO: 569376 - DNA, 20 bp, mouse
gtcgccacaaccaccagcag

SEQ ID NO: 569377 - DNA, 20 bp, mouse
gggcgcgcggggcaagacgt

SEQ ID NO: 569378 - DNA, 20 bp, mouse
gacgttggtgccactgctgg

SEQ ID NO: 569379 - DNA, 20 bp, mouse
gtcaggatccacctgcaaat

SEQ ID NO: 569380 - DNA, 20 bp, mouse
gcctgtgaggaggatcagac

SEQ ID NO: 569381 - DNA, 20 bp, mouse
gcctgcagttctgggtggaa

SEQ ID NO: 569382 - DNA, 20 bp, mouse
gaagacgttggtgccactgc

SEQ ID NO: 569383 - DNA, 20 bp, mouse
gaggaacccgacctattgtc

SEQ ID NO: 569384 - DNA, 20 bp, mouse
gaggtggccatgggcgcgcg

SEQ ID NO: 569385 - DNA, 20 bp, mouse
ggcagctcaccgggtttctc

SEQ ID NO: 569386 - DNA, 20 bp, mouse
ggccggctcaaaggacctaa

SEQ ID NO: 569387 - DNA, 20 bp, mouse
gtgcttgagactggcaggac

SEQ ID NO: 569388 - DNA, 20 bp, mouse
gtatgggtggagacccagca

SEQ ID NO: 569389 - DNA, 20 bp, mouse
gcgggtggctgtagtgtgta

SEQ ID NO: 569390 - DNA, 20 bp, mouse
gaaacctggggcaacctgta

SEQ ID NO: 569391 - DNA, 20 bp, mouse
gttccacaggtgagccccaa

SEQ ID NO: 569392 - DNA, 20 bp, mouse
gtcatcattgctggtatggg

SEQ ID NO: 569393 - DNA, 20 bp, mouse
gagatcatcattgctggtat

SEQ ID NO: 569394 - DNA, 20 bp, mouse
gggagacccagcaaggctgc

SEQ ID NO: 569395 - DNA, 20 bp, mouse
ggccggccagcagccttgct

SEQ ID NO: 569396 - DNA, 20 bp, mouse
gctcgcactcggccactctg

SEQ ID NO: 569397 - DNA, 20 bp, mouse
ggcgccgctcagacaggtgt

SEQ ID NO: 569398 - DNA, 20 bp, mouse
ggacaggtgtgggcgcccgg

SEQ ID NO: 569399 - DNA, 20 bp, mouse
gggagccgcgcgcgtcctcc

SEQ ID NO: 569400 - DNA, 20 bp, mouse
gggccgtgcgccgctcagac

SEQ ID NO: 569401 - DNA, 20 bp, mouse
ggcgcccacacctgtctgag

SEQ ID NO: 569402 - DNA, 20 bp, mouse
ggtggctgcgggtaacaccg

SEQ ID NO: 569403 - DNA, 20 bp, mouse
gtccctggagaggtcaaggt

SEQ ID NO: 569404 - DNA, 20 bp, mouse
gtggcttccgcacagactct

SEQ ID NO: 569405 - DNA, 20 bp, mouse
ggcaggctctgctggacctc

SEQ ID NO: 569406 - DNA, 20 bp, mouse
ggcagcagggcagcgatgtg

SEQ ID NO: 569407 - DNA, 20 bp, mouse
gacgtttgagtcctggtcag

SEQ ID NO: 569408 - DNA, 20 bp, mouse
gcaccaagccagagaacatg

SEQ ID NO: 569409 - DNA, 20 bp, mouse
gaggccttgagaggacccca

SEQ ID NO: 569410 - DNA, 20 bp, mouse
gctgaacctctgtagtacta

SEQ ID NO: 569411 - DNA, 20 bp, mouse
gttggtggacgtttgagtcc

SEQ ID NO: 569412 - DNA, 20 bp, mouse
gggggctgcctcatgttctc

SEQ ID NO: 569413 - DNA, 20 bp, mouse
gtgcctcatgttctctggct

SEQ ID NO: 569414 - DNA, 20 bp, mouse
gcccagtcaggtctctgagg

SEQ ID NO: 569415 - DNA, 20 bp, mouse
ggggcctgcctgagcctaaa

SEQ ID NO: 569416 - DNA, 20 bp, mouse
ggagagccccccaagtaggt

SEQ ID NO: 569417 - DNA, 20 bp, mouse
gggtgcatccagattgccta

SEQ ID NO: 569418 - DNA, 20 bp, mouse
gacagatgtatatcttgggt

SEQ ID NO: 569419 - DNA, 20 bp, mouse
gttatgagagccccccaagt

SEQ ID NO: 569420 - DNA, 20 bp, mouse
gcaactctgggcaataggaa

SEQ ID NO: 569421 - DNA, 20 bp, mouse
gtggatgcacccacctactt

SEQ ID NO: 569422 - DNA, 20 bp, mouse
gcctatgagaaccactcaca

SEQ ID NO: 569423 - DNA, 20 bp, mouse
gatttgtgccataggcaatc

SEQ ID NO: 569424 - DNA, 20 bp, mouse
gagacaatttccacaactct

SEQ ID NO: 569425 - DNA, 20 bp, mouse
ggcgccaacagtgtcttcac

SEQ ID NO: 569426 - DNA, 20 bp, mouse
gggtgtgcccaggattgtcc

SEQ ID NO: 569427 - DNA, 20 bp, mouse
gtccaggatacaggttcttg

SEQ ID NO: 569428 - DNA, 20 bp, mouse
gagagccccccaaaagatgt

SEQ ID NO: 569429 - DNA, 20 bp, mouse
gcacccctgagcaggaggaa

SEQ ID NO: 569430 - DNA, 20 bp, mouse
gtccccaagaacctgtatcc

SEQ ID NO: 569431 - DNA, 20 bp, mouse
gggcagctcagagccaaact

SEQ ID NO: 569432 - DNA, 20 bp, mouse
gccaggattgtccaggatac

SEQ ID NO: 569433 - DNA, 20 bp, mouse
gcctcctgctcaggggtgtg

SEQ ID NO: 569434 - DNA, 20 bp, mouse
ggaggtgctgccaaattctg

SEQ ID NO: 569435 - DNA, 20 bp, mouse
gctgggagaaccccagaatt

SEQ ID NO: 569436 - DNA, 20 bp, mouse
gtagaaatctggaccataga

SEQ ID NO: 569437 - DNA, 20 bp, mouse
gcctcagcagccactaatct

SEQ ID NO: 569438 - DNA, 20 bp, mouse
gaatatgaacatcagagcta

SEQ ID NO: 569439 - DNA, 20 bp, mouse
gatgttgatagaggctgaaa

SEQ ID NO: 569440 - DNA, 20 bp, mouse
gcaagtaacgagatgctagt

SEQ ID NO: 569441 - DNA, 20 bp, mouse
gttttagaatcccagattag

SEQ ID NO: 569442 - DNA, 20 bp, mouse
gacatctcaatgttgaattc

SEQ ID NO: 569443 - DNA, 20 bp, mouse
ggtgagtttcatgccttcta

SEQ ID NO: 569444 - DNA, 20 bp, mouse
gcagggctaaatgttgatag

SEQ ID NO: 569445 - DNA, 20 bp, mouse
gttctaattaattagaaatc

SEQ ID NO: 569446 - DNA, 20 bp, mouse
gcaccttgcccgggactcca

SEQ ID NO: 569447 - DNA, 20 bp, mouse
gactgcgttgtggaccggag

SEQ ID NO: 569448 - DNA, 20 bp, mouse
ggatcctccaagaaagacag

SEQ ID NO: 569449 - DNA, 20 bp, mouse
gaccccactgcgttgtggac

SEQ ID NO: 569450 - DNA, 20 bp, mouse
ggccccctccaggttgtcta

SEQ ID NO: 569451 - DNA, 20 bp, mouse
gctccctagacaacctggag

SEQ ID NO: 569452 - DNA, 20 bp, mouse
gcatcatgggaggaaggagt

SEQ ID NO: 569453 - DNA, 20 bp, mouse
gagagcggctaaggatgata

SEQ ID NO: 569454 - DNA, 20 bp, mouse
gtcagtggacacatgaggtt

SEQ ID NO: 569455 - DNA, 20 bp, mouse
gagaaagatgcaccttgccc

SEQ ID NO: 569456 - DNA, 20 bp, mouse
gggaaagaaggtaaatagga

SEQ ID NO: 569457 - DNA, 20 bp, mouse
gggccccagcaggtgtacca

SEQ ID NO: 569458 - DNA, 20 bp, mouse
gagaaggtaaataggatggc

SEQ ID NO: 569459 - DNA, 20 bp, mouse
gggccaaatactccaggaag

SEQ ID NO: 569460 - DNA, 20 bp, mouse
gtccaggaaagaaggtaaat

SEQ ID NO: 569461 - DNA, 20 bp, mouse
gcactccccagaagaactcc

SEQ ID NO: 569462 - DNA, 20 bp, mouse
gagcaggtgtaccatggagc

SEQ ID NO: 569463 - DNA, 20 bp, mouse
gtgctggggccaaatactcc

SEQ ID NO: 569464 - DNA, 20 bp, mouse
gctttcctggagttcttctg

SEQ ID NO: 569465 - DNA, 20 bp, mouse
gcggttcctggatcaggaag

SEQ ID NO: 569466 - DNA, 20 bp, mouse
ggggtgagagctggacccaa

SEQ ID NO: 569467 - DNA, 20 bp, mouse
gagagaacaccaggcttcaa

SEQ ID NO: 569468 - DNA, 20 bp, mouse
gaccagagggtgaagctcca

SEQ ID NO: 569469 - DNA, 20 bp, mouse
gagaggagcagtctagtcta

SEQ ID NO: 569470 - DNA, 20 bp, mouse
ggccctggagcttcaccctc

SEQ ID NO: 569471 - DNA, 20 bp, mouse
gaatgaaagatggggaccag

SEQ ID NO: 569472 - DNA, 20 bp, mouse
gacccaaccctgtacctcag

SEQ ID NO: 569473 - DNA, 20 bp, mouse
gcctaaggtgcccagatctg

SEQ ID NO: 569474 - DNA, 20 bp, mouse
gagctccagggctcctactg

SEQ ID NO: 569475 - DNA, 20 bp, mouse
gaggcttcaagggtgagagc

SEQ ID NO: 569476 - DNA, 20 bp, mouse
gcggcagccaggagacctga

SEQ ID NO: 569477 - DNA, 20 bp, mouse
gctgagggcagaggtgctaa

SEQ ID NO: 569478 - DNA, 20 bp, mouse
gggcagaggtgctaatggat

SEQ ID NO: 569479 - DNA, 20 bp, mouse
gtggtcccaaatactgactt

SEQ ID NO: 569480 - DNA, 20 bp, mouse
gtgagcctgggacaacataa

SEQ ID NO: 569481 - DNA, 20 bp, mouse
ggggaccctgggggcctcaa

SEQ ID NO: 569482 - DNA, 20 bp, mouse
gcaccagacagaggctccca

SEQ ID NO: 569483 - DNA, 20 bp, mouse
gagtcctgctccagatactg

SEQ ID NO: 569484 - DNA, 20 bp, mouse
gggctgccgaagtcagtatt

SEQ ID NO: 569485 - DNA, 20 bp, mouse
gggttggtaggcatcgtcgg

SEQ ID NO: 569486 - DNA, 20 bp, mouse
gaaggtgccaggagcctagt

SEQ ID NO: 569487 - DNA, 20 bp, mouse
ggagtgcagggtcctctcag

SEQ ID NO: 569488 - DNA, 20 bp, mouse
gccgggaccaggcgagagtg

SEQ ID NO: 569489 - DNA, 20 bp, mouse
gtggatgcagacactggcta

SEQ ID NO: 569490 - DNA, 20 bp, mouse
gtcgcctggtcccggactcg

SEQ ID NO: 569491 - DNA, 20 bp, mouse
gtgcagacactggctacgga

SEQ ID NO: 569492 - DNA, 20 bp, mouse
ggtggggctgctgcactgag

SEQ ID NO: 569493 - DNA, 20 bp, mouse
gtcggggaagctccgctgag

SEQ ID NO: 569494 - DNA, 20 bp, mouse
gaggagtggtccagcctcta

SEQ ID NO: 569495 - DNA, 20 bp, mouse
ggctggaccactcctgaaca

SEQ ID NO: 569496 - DNA, 20 bp, mouse
ggaagaggcgggcctatgtt

SEQ ID NO: 569497 - DNA, 20 bp, mouse
gctccagctgggtcctggtc

SEQ ID NO: 569498 - DNA, 20 bp, mouse
ggggaggagctagaacggag

SEQ ID NO: 569499 - DNA, 20 bp, mouse
gtgtcccgcctaccaggagg

SEQ ID NO: 569500 - DNA, 20 bp, mouse
gcccacctccagctgggtcc

SEQ ID NO: 569501 - DNA, 20 bp, mouse
gtcgtggggtgagctgtcag

SEQ ID NO: 569502 - DNA, 20 bp, mouse
gtggaggcgcagctgttgaa

SEQ ID NO: 569503 - DNA, 20 bp, mouse
gaggtccgaagcgaagtccc

SEQ ID NO: 569504 - DNA, 20 bp, mouse
gtctcctcctccggacggga

SEQ ID NO: 569505 - DNA, 20 bp, mouse
ggcgcacgagaacgcttcca

SEQ ID NO: 569506 - DNA, 20 bp, mouse
gttctgagcacagagctgtg

SEQ ID NO: 569507 - DNA, 20 bp, mouse
gggaacaggattctctacct

SEQ ID NO: 569508 - DNA, 20 bp, mouse
ggattctctaccttggctca

SEQ ID NO: 569509 - DNA, 20 bp, mouse
ggcatgaagtgaccattggg

SEQ ID NO: 569510 - DNA, 20 bp, mouse
gggtggagaaaactccagat

SEQ ID NO: 569511 - DNA, 20 bp, mouse
gaggagagtatgcttctact

SEQ ID NO: 569512 - DNA, 20 bp, mouse
gctcagaaactctgcaagaa

SEQ ID NO: 569513 - DNA, 20 bp, mouse
ggtttgggaagaggagctcc

SEQ ID NO: 569514 - DNA, 20 bp, mouse
gggttcagagcaaaccatta

SEQ ID NO: 569515 - DNA, 20 bp, mouse
gagcaggtttggataggtaa

SEQ ID NO: 569516 - DNA, 20 bp, mouse
gagtcgcagcccagcaggag

SEQ ID NO: 569517 - DNA, 20 bp, mouse
ggacgcccaagccggaagtg

SEQ ID NO: 569518 - DNA, 20 bp, mouse
gtatcccaggacgcccaagc

SEQ ID NO: 569519 - DNA, 20 bp, mouse
gagggccgaggttccaccca

SEQ ID NO: 569520 - DNA, 20 bp, mouse
gccgccctcacttccggctt

SEQ ID NO: 569521 - DNA, 20 bp, mouse
ggtggggaggggccaggcca

SEQ ID NO: 569522 - DNA, 20 bp, mouse
gactgatgtgacccaggttg

SEQ ID NO: 569523 - DNA, 20 bp, mouse
gccctgtcccagggtctcgg

SEQ ID NO: 569524 - DNA, 20 bp, mouse
gcttccggcttgggcgtcct

SEQ ID NO: 569525 - DNA, 20 bp, mouse
ggccagagtcgcagcccagc

SEQ ID NO: 569526 - DNA, 20 bp, mouse
gtgtctaggacccatataca

SEQ ID NO: 569527 - DNA, 20 bp, mouse
gtgggccctggaaccccaca

SEQ ID NO: 569528 - DNA, 20 bp, mouse
gctaggacccatatacaggg

SEQ ID NO: 569529 - DNA, 20 bp, mouse
gcatctggccgccctgtata

SEQ ID NO: 569530 - DNA, 20 bp, mouse
ggggcggccagatgccatgt

SEQ ID NO: 569531 - DNA, 20 bp, mouse
ggatgccatgtggggttcca

SEQ ID NO: 569532 - DNA, 20 bp, mouse
gaacaatcaggtccggacag

SEQ ID NO: 569533 - DNA, 20 bp, mouse
gtcactgggtcgagatggaa

SEQ ID NO: 569534 - DNA, 20 bp, mouse
ggttccagggcccaacaatc

SEQ ID NO: 569535 - DNA, 20 bp, mouse
gaatcaggtccggacagggg

SEQ ID NO: 569536 - DNA, 20 bp, mouse
gttggccctgatgccacaca

SEQ ID NO: 569537 - DNA, 20 bp, mouse
gccctctgacagggatagag

SEQ ID NO: 569538 - DNA, 20 bp, mouse
gccgggacccagacacaagc

SEQ ID NO: 569539 - DNA, 20 bp, mouse
ggccggccccgtatccaccc

SEQ ID NO: 569540 - DNA, 20 bp, mouse
gagcagtcgggagaacctaa

SEQ ID NO: 569541 - DNA, 20 bp, mouse
ggcatcagggccaaaaaatc

SEQ ID NO: 569542 - DNA, 20 bp, mouse
gtcgggcctgggtggatacg

SEQ ID NO: 569543 - DNA, 20 bp, mouse
gctatccctgtcagagggta

SEQ ID NO: 569544 - DNA, 20 bp, mouse
gatctggccggcttgtgtct

SEQ ID NO: 569545 - DNA, 20 bp, mouse
ggggtggcctttaaagtcgg

SEQ ID NO: 569546 - DNA, 20 bp, mouse
gaggccgccatgggtataca

SEQ ID NO: 569547 - DNA, 20 bp, mouse
gacttcagagaggccgccat

SEQ ID NO: 569548 - DNA, 20 bp, mouse
gtgggcacccgacttcagag

SEQ ID NO: 569549 - DNA, 20 bp, mouse
gactgggccctgtataccca

SEQ ID NO: 569550 - DNA, 20 bp, mouse
ggggccctgtatacccatgg

SEQ ID NO: 569551 - DNA, 20 bp, mouse
ggcggcaggacgttaaagct

SEQ ID NO: 569552 - DNA, 20 bp, mouse
ggctgctgtgcgtgatgctg

SEQ ID NO: 569553 - DNA, 20 bp, mouse
ggtgaccctgggtggagata

SEQ ID NO: 569554 - DNA, 20 bp, mouse
ggaaagccaggcggcaggtg

SEQ ID NO: 569555 - DNA, 20 bp, mouse
ggtgctcttgagatctgtgg

SEQ ID NO: 569556 - DNA, 20 bp, mouse
gggtggcctacgtgatgaca

SEQ ID NO: 569557 - DNA, 20 bp, mouse
ggtgatgacatggcgtccgg

SEQ ID NO: 569558 - DNA, 20 bp, mouse
gggacgccatgtcatcacgt

SEQ ID NO: 569559 - DNA, 20 bp, mouse
gctttggctgaaggagcaag

SEQ ID NO: 569560 - DNA, 20 bp, mouse
gcgtccggaggtggctccct

SEQ ID NO: 569561 - DNA, 20 bp, mouse
gatgacatggcgtccggagg

SEQ ID NO: 569562 - DNA, 20 bp, mouse
ggagcgggtgccaccttact

SEQ ID NO: 569563 - DNA, 20 bp, mouse
ggaggaagactatgaggccc

SEQ ID NO: 569564 - DNA, 20 bp, mouse
gatcccctgaagccacccag

SEQ ID NO: 569565 - DNA, 20 bp, mouse
gtggacatgcgcacccgggt

SEQ ID NO: 569566 - DNA, 20 bp, mouse
gagctgaagccagaccagga

SEQ ID NO: 569567 - DNA, 20 bp, mouse
gctgaatccaaggctgggat

SEQ ID NO: 569568 - DNA, 20 bp, mouse
gtctgtggcgcggacagggg

SEQ ID NO: 569569 - DNA, 20 bp, mouse
ggcttctgtggcgcggacag

SEQ ID NO: 569570 - DNA, 20 bp, mouse
gcctgggccgactgccccta

SEQ ID NO: 569571 - DNA, 20 bp, mouse
ggacagtgctggtgccgtag

SEQ ID NO: 569572 - DNA, 20 bp, mouse
gaagccacccatcccagcct

SEQ ID NO: 569573 - DNA, 20 bp, mouse
gcttcctagccctcctggtc

SEQ ID NO: 569574 - DNA, 20 bp, mouse
gattgcctgaatccaaggct

SEQ ID NO: 569575 - DNA, 20 bp, mouse
gagaccccggagtgacccag

SEQ ID NO: 569576 - DNA, 20 bp, mouse
ggcggtggcatggccttcca

SEQ ID NO: 569577 - DNA, 20 bp, mouse
gaagcagtcacagccctgga

SEQ ID NO: 569578 - DNA, 20 bp, mouse
gctaggcaacggccacgtgg

SEQ ID NO: 569579 - DNA, 20 bp, mouse
ggaaggccatgccaccgcca

SEQ ID NO: 569580 - DNA, 20 bp, mouse
gaacggccacgtggaggagg

SEQ ID NO: 569581 - DNA, 20 bp, mouse
gcagcaagagccagaccaaa

SEQ ID NO: 569582 - DNA, 20 bp, mouse
ggaggaggaggcgctacaac

SEQ ID NO: 569583 - DNA, 20 bp, mouse
gtgcggggcaacgaggtctc

SEQ ID NO: 569584 - DNA, 20 bp, mouse
gtgaggccttggcggtggca

SEQ ID NO: 569585 - DNA, 20 bp, mouse
gctacaacaggttgaggcct

SEQ ID NO: 569586 - DNA, 20 bp, mouse
gggcctgaggaacctaggag

SEQ ID NO: 569587 - DNA, 20 bp, mouse
gggatccaggcccagcgtcc

SEQ ID NO: 569588 - DNA, 20 bp, mouse
gcgctgggcctggatccttg

SEQ ID NO: 569589 - DNA, 20 bp, mouse
gtagcgccgcaaagcagatt

SEQ ID NO: 569590 - DNA, 20 bp, mouse
gtagggacaatattcatgta

SEQ ID NO: 569591 - DNA, 20 bp, mouse
ggagaggcgacagcgaggtg

SEQ ID NO: 569592 - DNA, 20 bp, mouse
gctgcgaagacagcactcaa

SEQ ID NO: 569593 - DNA, 20 bp, mouse
gccgcggccaaacttaggtc

SEQ ID NO: 569594 - DNA, 20 bp, mouse
gattaggatccagcgcctca

SEQ ID NO: 569595 - DNA, 20 bp, mouse
gctacagcacgacacagcag

SEQ ID NO: 569596 - DNA, 20 bp, mouse
gttgttctgaggagcagtaa

SEQ ID NO: 569597 - DNA, 20 bp, mouse
gctggcagaagcaagtggag

SEQ ID NO: 569598 - DNA, 20 bp, mouse
ggccatggcgtgtggatcag

SEQ ID NO: 569599 - DNA, 20 bp, mouse
gtccactgatccacacgcca

SEQ ID NO: 569600 - DNA, 20 bp, mouse
gtaagtctggcagaagcaag

SEQ ID NO: 569601 - DNA, 20 bp, mouse
gagggctggactctgtgcca

SEQ ID NO: 569602 - DNA, 20 bp, mouse
gtagggcagactattaagtc

SEQ ID NO: 569603 - DNA, 20 bp, mouse
gcggtcctaccttccatata

SEQ ID NO: 569604 - DNA, 20 bp, mouse
ggtggatcagtggatcctca

SEQ ID NO: 569605 - DNA, 20 bp, mouse
gctcaggaggctggtgggat

SEQ ID NO: 569606 - DNA, 20 bp, mouse
gagccggaagtactgcaatg

SEQ ID NO: 569607 - DNA, 20 bp, mouse
gaagcagcagcagaacctta

SEQ ID NO: 569608 - DNA, 20 bp, mouse
gttctcagcggccttccgac

SEQ ID NO: 569609 - DNA, 20 bp, mouse
ggaatcagatgataacgtgt

SEQ ID NO: 569610 - DNA, 20 bp, mouse
ggagcctgagtcccggaagc

SEQ ID NO: 569611 - DNA, 20 bp, mouse
gcccgcgaggttactgtccg

SEQ ID NO: 569612 - DNA, 20 bp, mouse
gtgggtagtaatgtcatgag

SEQ ID NO: 569613 - DNA, 20 bp, mouse
gtgtgggcattacttgtgag

SEQ ID NO: 569614 - DNA, 20 bp, mouse
ggagaggaaaagagcaccta

SEQ ID NO: 569615 - DNA, 20 bp, mouse
ggactcaggctcctgtcgga

SEQ ID NO: 569616 - DNA, 20 bp, mouse
ggtgcggggcagaggtccgt

SEQ ID NO: 569617 - DNA, 20 bp, mouse
gggacctctgccccgcacca

SEQ ID NO: 569618 - DNA, 20 bp, mouse
gtccgtgggcagggccctca

SEQ ID NO: 569619 - DNA, 20 bp, mouse
ggcaatggagccctggtgcg

SEQ ID NO: 569620 - DNA, 20 bp, mouse
gccgctaggttcctccacaa

SEQ ID NO: 569621 - DNA, 20 bp, mouse
ggtctccagcgagtcagagg

SEQ ID NO: 569622 - DNA, 20 bp, mouse
gccatgaggcgcccgatgga

SEQ ID NO: 569623 - DNA, 20 bp, mouse
gatggagggcgccattgtgg

SEQ ID NO: 569624 - DNA, 20 bp, mouse
ggaggaacctagcggcgcaa

SEQ ID NO: 569625 - DNA, 20 bp, mouse
gagcgggagcgggaagcccc

SEQ ID NO: 569626 - DNA, 20 bp, mouse
gcaatgtgggcagggcatca

SEQ ID NO: 569627 - DNA, 20 bp, mouse
ggctgctgttgtatcaatgt

SEQ ID NO: 569628 - DNA, 20 bp, mouse
ggagcagtgcaattagaagt

SEQ ID NO: 569629 - DNA, 20 bp, mouse
gcactgctcatggcttccaa

SEQ ID NO: 569630 - DNA, 20 bp, mouse
gctcatccctggatccccta

SEQ ID NO: 569631 - DNA, 20 bp, mouse
gtgttgtcattccagtgcag

SEQ ID NO: 569632 - DNA, 20 bp, mouse
gcagatcctaaggtgttcag

SEQ ID NO: 569633 - DNA, 20 bp, mouse
gggatcccctagggtggatg

SEQ ID NO: 569634 - DNA, 20 bp, mouse
gcacttgtgatgcacaactg

SEQ ID NO: 569635 - DNA, 20 bp, mouse
gcatgtactgccacctccgg

SEQ ID NO: 569636 - DNA, 20 bp, mouse
gatggggagctccaacactg

SEQ ID NO: 569637 - DNA, 20 bp, mouse
gaggcaagccgatgaaacga

SEQ ID NO: 569638 - DNA, 20 bp, mouse
gggcaggatttagggatctg

SEQ ID NO: 569639 - DNA, 20 bp, mouse
gccatcacctgcctcagtgt

SEQ ID NO: 569640 - DNA, 20 bp, mouse
gaagccgatgaaacgatgga

SEQ ID NO: 569641 - DNA, 20 bp, mouse
ggtactgaatcactatccct

SEQ ID NO: 569642 - DNA, 20 bp, mouse
ggctacatgccccaaacaac

SEQ ID NO: 569643 - DNA, 20 bp, mouse
gcttgcctgcacatcagcaa

SEQ ID NO: 569644 - DNA, 20 bp, mouse
gacccgggaactagttccaa

SEQ ID NO: 569645 - DNA, 20 bp, mouse
gtgtccttccatcgtttcat

SEQ ID NO: 569646 - DNA, 20 bp, mouse
gtgacagccggagcactgag

SEQ ID NO: 569647 - DNA, 20 bp, mouse
ggagctgtggtcgtgataga

SEQ ID NO: 569648 - DNA, 20 bp, mouse
gctcccacaataagcagctc

SEQ ID NO: 569649 - DNA, 20 bp, mouse
gtatgtaagagatcctgagg

SEQ ID NO: 569650 - DNA, 20 bp, mouse
gtccaggccactcagtgctc

SEQ ID NO: 569651 - DNA, 20 bp, mouse
ggccggagcactgagtggcc

SEQ ID NO: 569652 - DNA, 20 bp, mouse
gagtctactggggcagatga

SEQ ID NO: 569653 - DNA, 20 bp, mouse
gtggtatgtaagagatcctg

SEQ ID NO: 569654 - DNA, 20 bp, mouse
gccttcaagtatgagggaca

SEQ ID NO: 569655 - DNA, 20 bp, mouse
gagtgctccggctgtcagaa

SEQ ID NO: 569656 - DNA, 20 bp, mouse
gatgcagcagagctctacag

SEQ ID NO: 569657 - DNA, 20 bp, mouse
gtatgaggtgatgctcccag

SEQ ID NO: 569658 - DNA, 20 bp, mouse
gagttcgtttctcctttagt

SEQ ID NO: 569659 - DNA, 20 bp, mouse
gggtcatggcgcacagtctg

SEQ ID NO: 569660 - DNA, 20 bp, mouse
gtgtgaactattccgactaa

SEQ ID NO: 569661 - DNA, 20 bp, mouse
ggactgtgcgccatgaccca

SEQ ID NO: 569662 - DNA, 20 bp, mouse
gtctgaacccctaagcccct

SEQ ID NO: 569663 - DNA, 20 bp, mouse
gaactcgaagcatcatcctg

SEQ ID NO: 569664 - DNA, 20 bp, mouse
gggtaaccatgacgccacaa

SEQ ID NO: 569665 - DNA, 20 bp, mouse
gcaatggaacattcttcccg

SEQ ID NO: 569666 - DNA, 20 bp, mouse
gcaacaagtagcaggatgga

SEQ ID NO: 569667 - DNA, 20 bp, mouse
ggagggcaggatcatggctc

SEQ ID NO: 569668 - DNA, 20 bp, mouse
gggtgtgggcaacaagtagc

SEQ ID NO: 569669 - DNA, 20 bp, mouse
gacaccctggaagcaaatgt

SEQ ID NO: 569670 - DNA, 20 bp, mouse
gcttggaggtgatctcctgg

SEQ ID NO: 569671 - DNA, 20 bp, mouse
ggacaggtcacccgtaagag

SEQ ID NO: 569672 - DNA, 20 bp, mouse
gtggctgttagctaactcat

SEQ ID NO: 569673 - DNA, 20 bp, mouse
gatattgataggatgaaggg

SEQ ID NO: 569674 - DNA, 20 bp, mouse
gctgacagaatagtgtcaac

SEQ ID NO: 569675 - DNA, 20 bp, mouse
gactcttggaggtgatctcc

SEQ ID NO: 569676 - DNA, 20 bp, mouse
gctcccaggaggtgagggcc

SEQ ID NO: 569677 - DNA, 20 bp, mouse
ggctggtccgagggaaccac

SEQ ID NO: 569678 - DNA, 20 bp, mouse
ggtagtttagtgtaagacaa

SEQ ID NO: 569679 - DNA, 20 bp, mouse
ggtaagacaacgggatcaga

SEQ ID NO: 569680 - DNA, 20 bp, mouse
gagactcccaaactgcccat

SEQ ID NO: 569681 - DNA, 20 bp, mouse
ggggacaggcgcgtgtacag

SEQ ID NO: 569682 - DNA, 20 bp, mouse
gtaatggtccgcacctcacc

SEQ ID NO: 569683 - DNA, 20 bp, mouse
gctaaactactcacttctaa

SEQ ID NO: 569684 - DNA, 20 bp, mouse
gtgaggtcaagggaggacaa

SEQ ID NO: 569685 - DNA, 20 bp, mouse
gggtccgagggaaccacggg

SEQ ID NO: 569686 - DNA, 20 bp, mouse
gctatggtgcctgggacaag

SEQ ID NO: 569687 - DNA, 20 bp, mouse
ggcaccatagctgtagagga

SEQ ID NO: 569688 - DNA, 20 bp, mouse
gccaggcaccatagctgtag

SEQ ID NO: 569689 - DNA, 20 bp, mouse
gagccacatgagctgggtca

SEQ ID NO: 569690 - DNA, 20 bp, mouse
ggccagcctcctcttgtccc

SEQ ID NO: 569691 - DNA, 20 bp, mouse
gagaggaggctggcactgtc

SEQ ID NO: 569692 - DNA, 20 bp, mouse
gatgccatcctctacagcta

SEQ ID NO: 569693 - DNA, 20 bp, mouse
gaggtggctgaagtccctac

SEQ ID NO: 569694 - DNA, 20 bp, mouse
gacctggaggaaccagaagg

SEQ ID NO: 569695 - DNA, 20 bp, mouse
gaggtgcaggaggcacccaa

SEQ ID NO: 569696 - DNA, 20 bp, mouse
ggcacaagtcaaagagcagg

SEQ ID NO: 569697 - DNA, 20 bp, mouse
gtgcaggaaggctgctctct

SEQ ID NO: 569698 - DNA, 20 bp, mouse
gcctgcacaagtcaaagagc

SEQ ID NO: 569699 - DNA, 20 bp, mouse
gatttgccagaggagtccta

SEQ ID NO: 569700 - DNA, 20 bp, mouse
gcagggttgaaagaatgcag

SEQ ID NO: 569701 - DNA, 20 bp, mouse
ggccttccctaggactcctc

SEQ ID NO: 569702 - DNA, 20 bp, mouse
gctagacagcgtgagtgatc

SEQ ID NO: 569703 - DNA, 20 bp, mouse
gtactgatgaattacttcag

SEQ ID NO: 569704 - DNA, 20 bp, mouse
gagaaggcaggtattcttat

SEQ ID NO: 569705 - DNA, 20 bp, mouse
gaccactttatactctgatg

SEQ ID NO: 569706 - DNA, 20 bp, mouse
ggtcactgcagagagactaa

SEQ ID NO: 569707 - DNA, 20 bp, mouse
gaaatggccagggggaagac

SEQ ID NO: 569708 - DNA, 20 bp, mouse
gaggccatggccctaagggt

SEQ ID NO: 569709 - DNA, 20 bp, mouse
gtcggcagaaaatggccagg

SEQ ID NO: 569710 - DNA, 20 bp, mouse
ggtgaggaatcccaggatct

SEQ ID NO: 569711 - DNA, 20 bp, mouse
gtaggctgggaaggtgaagc

SEQ ID NO: 569712 - DNA, 20 bp, mouse
gaggcagaacaggtccacgc

SEQ ID NO: 569713 - DNA, 20 bp, mouse
ggagaagaggggaagacggt

SEQ ID NO: 569714 - DNA, 20 bp, mouse
ggccccccgaaggagcccct

SEQ ID NO: 569715 - DNA, 20 bp, mouse
gtaggacaagggccccccga

SEQ ID NO: 569716 - DNA, 20 bp, mouse
ggcgcgccgcgtccagccgg

SEQ ID NO: 569717 - DNA, 20 bp, mouse
gggctccgtgcgcctgcaag

SEQ ID NO: 569718 - DNA, 20 bp, mouse
gggcggagggaggctgtaga

SEQ ID NO: 569719 - DNA, 20 bp, mouse
gcacctggaaccgagccgag

SEQ ID NO: 569720 - DNA, 20 bp, mouse
gcacgggaggcgccattcag

SEQ ID NO: 569721 - DNA, 20 bp, mouse
gccgcgagtgcgccaggccg

SEQ ID NO: 569722 - DNA, 20 bp, mouse
gcaacccgctgctccggcgt

SEQ ID NO: 569723 - DNA, 20 bp, mouse
gcggtcgcgcacactcgcat

SEQ ID NO: 569724 - DNA, 20 bp, mouse
gccgctgctccggcgtggga

SEQ ID NO: 569725 - DNA, 20 bp, mouse
gctagtggtcagcggatcca

SEQ ID NO: 569726 - DNA, 20 bp, mouse
gaccagggcaagcagcagga

SEQ ID NO: 569727 - DNA, 20 bp, mouse
gaggaagggatggatcccct

SEQ ID NO: 569728 - DNA, 20 bp, mouse
gggaagctacccatccccca

SEQ ID NO: 569729 - DNA, 20 bp, mouse
gtacagtaagaacccatcaa

SEQ ID NO: 569730 - DNA, 20 bp, mouse
gaaccaccagggcaagcagc

SEQ ID NO: 569731 - DNA, 20 bp, mouse
gtgcttgccctggtggttgg

SEQ ID NO: 569732 - DNA, 20 bp, mouse
ggatgggtagcttccagcca

SEQ ID NO: 569733 - DNA, 20 bp, mouse
gggttcagtgggtagagtcg

SEQ ID NO: 569734 - DNA, 20 bp, mouse
ggtagcttccagccatggcc

SEQ ID NO: 569735 - DNA, 20 bp, mouse
gccctgcagtgagagtccgt

SEQ ID NO: 569736 - DNA, 20 bp, mouse
ggagctgcagtgaaggttgt

SEQ ID NO: 569737 - DNA, 20 bp, mouse
gcagaacccgacctacctgg

SEQ ID NO: 569738 - DNA, 20 bp, mouse
gcccgggtcccacactatga

SEQ ID NO: 569739 - DNA, 20 bp, mouse
gttgctgcagaagacacgta

SEQ ID NO: 569740 - DNA, 20 bp, mouse
gcagcttgtgacagtggtgc

SEQ ID NO: 569741 - DNA, 20 bp, mouse
ggaagctaagggacagaccc

SEQ ID NO: 569742 - DNA, 20 bp, mouse
gcatggagccgtcatagtgt

SEQ ID NO: 569743 - DNA, 20 bp, mouse
gacgtgcttctcctccaggt

SEQ ID NO: 569744 - DNA, 20 bp, mouse
gtgggatgttgtttgttgta

SEQ ID NO: 569745 - DNA, 20 bp, mouse
gcggctccatggtcctagca

SEQ ID NO: 569746 - DNA, 20 bp, mouse
ggtctagagccgagagtcag

SEQ ID NO: 569747 - DNA, 20 bp, mouse
gagagccgagagtcaggggg

SEQ ID NO: 569748 - DNA, 20 bp, mouse
gctgggaaggacgaaggtgt

SEQ ID NO: 569749 - DNA, 20 bp, mouse
ggacgaaggtgtgggatctg

SEQ ID NO: 569750 - DNA, 20 bp, mouse
gtctgccgggttacctctcc

SEQ ID NO: 569751 - DNA, 20 bp, mouse
gtctcctggctgaggggcaa

SEQ ID NO: 569752 - DNA, 20 bp, mouse
ggttacctctcctggctgag

SEQ ID NO: 569753 - DNA, 20 bp, mouse
gccctccacaccgaccgtcc

SEQ ID NO: 569754 - DNA, 20 bp, mouse
gggagcccggacggtcggtg

SEQ ID NO: 569755 - DNA, 20 bp, mouse
gtggggtctgggaaggacga

SEQ ID NO: 569756 - DNA, 20 bp, mouse
gtgctaggaactgggaccag

SEQ ID NO: 569757 - DNA, 20 bp, mouse
gctgtcctaataaggaaagt

SEQ ID NO: 569758 - DNA, 20 bp, mouse
gtgtgccgcccgggagccca

SEQ ID NO: 569759 - DNA, 20 bp, mouse
gttccttattaggacagagt

SEQ ID NO: 569760 - DNA, 20 bp, mouse
gcgagagaggagagctgcgg

SEQ ID NO: 569761 - DNA, 20 bp, mouse
gccagttcctagcagagaca

SEQ ID NO: 569762 - DNA, 20 bp, mouse
gctccgactctgtcctaata

SEQ ID NO: 569763 - DNA, 20 bp, mouse
gaggagaggatgcacagtag

SEQ ID NO: 569764 - DNA, 20 bp, mouse
gttgcccagcccacgccccg

SEQ ID NO: 569765 - DNA, 20 bp, mouse
gccgctggagtcgggaggag

SEQ ID NO: 569766 - DNA, 20 bp, mouse
ggaggtgtctggaggcccac

SEQ ID NO: 569767 - DNA, 20 bp, mouse
gtcagctggccactctggag

SEQ ID NO: 569768 - DNA, 20 bp, mouse
gcagacagaccaaggagctc

SEQ ID NO: 569769 - DNA, 20 bp, mouse
gggactaaacagacagacca

SEQ ID NO: 569770 - DNA, 20 bp, mouse
gaaggagctctggaggtgtc

SEQ ID NO: 569771 - DNA, 20 bp, mouse
gccgtagactgggtagatag

SEQ ID NO: 569772 - DNA, 20 bp, mouse
gctgaaccacgagagatcaa

SEQ ID NO: 569773 - DNA, 20 bp, mouse
gaataatcagctggccactc

SEQ ID NO: 569774 - DNA, 20 bp, mouse
gatctctcgtggttcaggat

SEQ ID NO: 569775 - DNA, 20 bp, mouse
gccagctgattatttcttac

SEQ ID NO: 569776 - DNA, 20 bp, mouse
gtcctagagaaggaacgcca

SEQ ID NO: 569777 - DNA, 20 bp, mouse
ggagctgcgagaggactcac

SEQ ID NO: 569778 - DNA, 20 bp, mouse
ggccatggcgttccttctct

SEQ ID NO: 569779 - DNA, 20 bp, mouse
ggaccctcccagagagcgag

SEQ ID NO: 569780 - DNA, 20 bp, mouse
gtcgccatggagctccaaga

SEQ ID NO: 569781 - DNA, 20 bp, mouse
gtcccgctcgctctctggga

SEQ ID NO: 569782 - DNA, 20 bp, mouse
gactcgcccagagctcgcca

SEQ ID NO: 569783 - DNA, 20 bp, mouse
ggagctgtttaaccacaacg

SEQ ID NO: 569784 - DNA, 20 bp, mouse
ggagaccgaggcacagaccg

SEQ ID NO: 569785 - DNA, 20 bp, mouse
gaggcacagaccggggtcag

SEQ ID NO: 569786 - DNA, 20 bp, mouse
gaggctggcgaagagggcga

SEQ ID NO: 569787 - DNA, 20 bp, mouse
gaagagggcgagggcgtaca

SEQ ID NO: 569788 - DNA, 20 bp, mouse
gtgcagcctgcgaagtgaag

SEQ ID NO: 569789 - DNA, 20 bp, mouse
gacccttctaagctcaccgg

SEQ ID NO: 569790 - DNA, 20 bp, mouse
ggggacccttctaagctcac

SEQ ID NO: 569791 - DNA, 20 bp, mouse
gaagctcaccggtggccaga

SEQ ID NO: 569792 - DNA, 20 bp, mouse
gtcaccggtggccagaaggc

SEQ ID NO: 569793 - DNA, 20 bp, mouse
gtgtgcgcaggcgcagatcg

SEQ ID NO: 569794 - DNA, 20 bp, mouse
gcgcagatcggggctggtgg

SEQ ID NO: 569795 - DNA, 20 bp, mouse
ggttcttctctaccagacca

SEQ ID NO: 569796 - DNA, 20 bp, mouse
gctcacggggaactgagatg

SEQ ID NO: 569797 - DNA, 20 bp, mouse
gagcagccgcggccacatcc

SEQ ID NO: 569798 - DNA, 20 bp, mouse
ggctgtgcgctctgattctc

SEQ ID NO: 569799 - DNA, 20 bp, mouse
gcatcctggcacacactgca

SEQ ID NO: 569800 - DNA, 20 bp, mouse
ggaacccttggcacactcac

SEQ ID NO: 569801 - DNA, 20 bp, mouse
ggagtgtgccaagggttcgg

SEQ ID NO: 569802 - DNA, 20 bp, mouse
ggcgcacagcatagtgccca

SEQ ID NO: 569803 - DNA, 20 bp, mouse
gggcgctcaggagactgacc

SEQ ID NO: 569804 - DNA, 20 bp, mouse
gcctctgtgaaccattacag

SEQ ID NO: 569805 - DNA, 20 bp, mouse
ggccgcggctgctggcaatg

SEQ ID NO: 569806 - DNA, 20 bp, mouse
gggtgctaaggcgacagcag

SEQ ID NO: 569807 - DNA, 20 bp, mouse
gggttcggtggaggcgaaga

SEQ ID NO: 569808 - DNA, 20 bp, mouse
gagcaactatctctccacgg

SEQ ID NO: 569809 - DNA, 20 bp, mouse
ggtgcgggcatcgggatgtg

SEQ ID NO: 569810 - DNA, 20 bp, mouse
gggtggcttccatggtgcta

SEQ ID NO: 569811 - DNA, 20 bp, mouse
gcagaggccacgccaccagg

SEQ ID NO: 569812 - DNA, 20 bp, mouse
gcccgcgtctccggatgcaa

SEQ ID NO: 569813 - DNA, 20 bp, mouse
gacttgcttggtggcttcca

SEQ ID NO: 569814 - DNA, 20 bp, mouse
gtgtcccggggagatcgcca

SEQ ID NO: 569815 - DNA, 20 bp, mouse
gatgggctcccggccacgag

SEQ ID NO: 569816 - DNA, 20 bp, mouse
gcaggctaggagggactgaa

SEQ ID NO: 569817 - DNA, 20 bp, mouse
gggatgcagggctaagtagg

SEQ ID NO: 569818 - DNA, 20 bp, mouse
gggtaagcttcagacagcca

SEQ ID NO: 569819 - DNA, 20 bp, mouse
gatggttgcagtgagcacct

SEQ ID NO: 569820 - DNA, 20 bp, mouse
gcctccggaggcacactccc

SEQ ID NO: 569821 - DNA, 20 bp, mouse
gctttctgagccctgtcccg

SEQ ID NO: 569822 - DNA, 20 bp, mouse
ggaagtgtcacagagggagg

SEQ ID NO: 569823 - DNA, 20 bp, mouse
gggctacagggccttagtca

SEQ ID NO: 569824 - DNA, 20 bp, mouse
gagaaagaagacggtcttca

SEQ ID NO: 569825 - DNA, 20 bp, mouse
gggactgaagggcttcagga

SEQ ID NO: 569826 - DNA, 20 bp, mouse
gcgacgcaccgagcgctcgg

SEQ ID NO: 569827 - DNA, 20 bp, mouse
ggagcgctcggtgcgtcggt

SEQ ID NO: 569828 - DNA, 20 bp, mouse
ggcgcggagaccctatgcta

SEQ ID NO: 569829 - DNA, 20 bp, mouse
ggcagctccgcagaaggagg

SEQ ID NO: 569830 - DNA, 20 bp, mouse
gtcggtgcgtcggtgggagc

SEQ ID NO: 569831 - DNA, 20 bp, mouse
ggtgcgtcggtgggagccgg

SEQ ID NO: 569832 - DNA, 20 bp, mouse
gtccgcagctccgcagaagg

SEQ ID NO: 569833 - DNA, 20 bp, mouse
ggctacgggcgcacccaccg

SEQ ID NO: 569834 - DNA, 20 bp, mouse
ggcgcttggcccgagcccgc

SEQ ID NO: 569835 - DNA, 20 bp, mouse
gcaacaaggatggaactcct

SEQ ID NO: 569836 - DNA, 20 bp, mouse
gagttccgcgaggtgctgaa

SEQ ID NO: 569837 - DNA, 20 bp, mouse
gcggggctcaccgcggggag

SEQ ID NO: 569838 - DNA, 20 bp, mouse
gggtgcgaggacgttcgaag

SEQ ID NO: 569839 - DNA, 20 bp, mouse
gagactgggacaagaagcac

SEQ ID NO: 569840 - DNA, 20 bp, mouse
gtgtccccttcagcacctcg

SEQ ID NO: 569841 - DNA, 20 bp, mouse
ggggtggcgcgagttccgcg

SEQ ID NO: 569842 - DNA, 20 bp, mouse
gggtgcgcggggctcaccgc

SEQ ID NO: 569843 - DNA, 20 bp, mouse
gccttggccagggtggaaaa

SEQ ID NO: 569844 - DNA, 20 bp, mouse
ggcgaggacgttcgaagcgg

SEQ ID NO: 569845 - DNA, 20 bp, mouse
gggttcaggacaggactcct

SEQ ID NO: 569846 - DNA, 20 bp, mouse
gcgaggctccaacacctgag

SEQ ID NO: 569847 - DNA, 20 bp, mouse
gtggagcctcggctgtggag

SEQ ID NO: 569848 - DNA, 20 bp, mouse
ggacagaagcgaagcgaacg

SEQ ID NO: 569849 - DNA, 20 bp, mouse
ggaacgcggggagctccaac

SEQ ID NO: 569850 - DNA, 20 bp, mouse
gcaggaggccagctagacac

SEQ ID NO: 569851 - DNA, 20 bp, mouse
gcccagcctctccacagccg

SEQ ID NO: 569852 - DNA, 20 bp, mouse
gcgcggggagctccaacagg

SEQ ID NO: 569853 - DNA, 20 bp, mouse
gggtgttggagcctcggctg

SEQ ID NO: 569854 - DNA, 20 bp, mouse
gcttctgtcccctcaggtgt

SEQ ID NO: 569855 - DNA, 20 bp, mouse
gaggccagctagacactggg

SEQ ID NO: 569856 - DNA, 20 bp, mouse
gctgggtagatgagtagagc

SEQ ID NO: 569857 - DNA, 20 bp, mouse
ggtcaggtccttggaaggct

SEQ ID NO: 569858 - DNA, 20 bp, mouse
ggcaggctctgtaagctgta

SEQ ID NO: 569859 - DNA, 20 bp, mouse
gaagtgaggtgagctaggtt

SEQ ID NO: 569860 - DNA, 20 bp, mouse
gtcacagttagtcaggtcct

SEQ ID NO: 569861 - DNA, 20 bp, mouse
gtcatgaagaagacaaagtg

SEQ ID NO: 569862 - DNA, 20 bp, mouse
gcatgacctcacagttagtc

SEQ ID NO: 569863 - DNA, 20 bp, mouse
gatgtcttagcagttgtcat

SEQ ID NO: 569864 - DNA, 20 bp, mouse
gacaactgctaagacatgtc

SEQ ID NO: 569865 - DNA, 20 bp, mouse
gttgtcttcttcatgagggc

SEQ ID NO: 569866 - DNA, 20 bp, mouse
gctcaattcagcccaggact

SEQ ID NO: 569867 - DNA, 20 bp, mouse
gccaacctaaacctagtcct

SEQ ID NO: 569868 - DNA, 20 bp, mouse
gcatgctgatagcagagggt

SEQ ID NO: 569869 - DNA, 20 bp, mouse
gttgcagctcaattcagccc

SEQ ID NO: 569870 - DNA, 20 bp, mouse
gccgggcctgcccacaacag

SEQ ID NO: 569871 - DNA, 20 bp, mouse
gtaaggctctccacacccag

SEQ ID NO: 569872 - DNA, 20 bp, mouse
ggttagcatgctgatagcag

SEQ ID NO: 569873 - DNA, 20 bp, mouse
gggtgtggcctacagtgaga

SEQ ID NO: 569874 - DNA, 20 bp, mouse
gacacgcagaaggcccgtga

SEQ ID NO: 569875 - DNA, 20 bp, mouse
gcgcagaaggcccgtgatgg

SEQ ID NO: 569876 - DNA, 20 bp, mouse
gcgcagcagttaagttcctg

SEQ ID NO: 569877 - DNA, 20 bp, mouse
ggttaagttcctggggaagg

SEQ ID NO: 569878 - DNA, 20 bp, mouse
ggcccacctagcttaccttc

SEQ ID NO: 569879 - DNA, 20 bp, mouse
gtggtgaggggaacggaagt

SEQ ID NO: 569880 - DNA, 20 bp, mouse
ggcctgaaggtaagctaggt

SEQ ID NO: 569881 - DNA, 20 bp, mouse
ggaccagtgagttaggatca

SEQ ID NO: 569882 - DNA, 20 bp, mouse
gtaaagacagggacaccaca

SEQ ID NO: 569883 - DNA, 20 bp, mouse
gtagaggtcctggtgaaagg

SEQ ID NO: 569884 - DNA, 20 bp, mouse
ggatcgaatcggatcggatc

SEQ ID NO: 569885 - DNA, 20 bp, mouse
gaagggggatcggatcgaat

SEQ ID NO: 569886 - DNA, 20 bp, mouse
ggacaccggtgagacctcta

SEQ ID NO: 569887 - DNA, 20 bp, mouse
ggtgggccgcgagtattcgt

SEQ ID NO: 569888 - DNA, 20 bp, mouse
ggcagctgaggcggaaacct

SEQ ID NO: 569889 - DNA, 20 bp, mouse
gcccgccctagaggtctcac

SEQ ID NO: 569890 - DNA, 20 bp, mouse
gaggcgacggtgaacacgac

SEQ ID NO: 569891 - DNA, 20 bp, mouse
gcctccgccccgcacaccct

SEQ ID NO: 569892 - DNA, 20 bp, mouse
gctaggacgacctgctccgt

SEQ ID NO: 569893 - DNA, 20 bp, mouse
gagatcgaggaaccccgcgt

SEQ ID NO: 569894 - DNA, 20 bp, mouse
gaccggtgagacctctaggg

SEQ ID NO: 569895 - DNA, 20 bp, mouse
ggggcgtctctagggatgag

SEQ ID NO: 569896 - DNA, 20 bp, mouse
ggcgatcggtgacaggtacc

SEQ ID NO: 569897 - DNA, 20 bp, mouse
gtgcggccggcccagaactg

SEQ ID NO: 569898 - DNA, 20 bp, mouse
ggagcaggtgagcggagggc

SEQ ID NO: 569899 - DNA, 20 bp, mouse
ggctacccgcgatcggtgac

SEQ ID NO: 569900 - DNA, 20 bp, mouse
ggaggccgagatcgccgcag

SEQ ID NO: 569901 - DNA, 20 bp, mouse
gagaccctgatgccccggga

SEQ ID NO: 569902 - DNA, 20 bp, mouse
ggctgccggctacccgcgat

SEQ ID NO: 569903 - DNA, 20 bp, mouse
ggaagggcctcgctgcatcc

SEQ ID NO: 569904 - DNA, 20 bp, mouse
gcgaggagaaagtgctgggg

SEQ ID NO: 569905 - DNA, 20 bp, mouse
gcgggcggagcgcctctcct

SEQ ID NO: 569906 - DNA, 20 bp, mouse
gtccaggtcagtactacctg

SEQ ID NO: 569907 - DNA, 20 bp, mouse
gatgcccaccgtccacacca

SEQ ID NO: 569908 - DNA, 20 bp, mouse
gctgccatggtgtggacggt

SEQ ID NO: 569909 - DNA, 20 bp, mouse
ggcccggctccacttcctcc

SEQ ID NO: 569910 - DNA, 20 bp, mouse
ggtagctgccatggtgtgga

SEQ ID NO: 569911 - DNA, 20 bp, mouse
ggcctcaggtagtactgacc

SEQ ID NO: 569912 - DNA, 20 bp, mouse
gagctgcagcgctccttgag

SEQ ID NO: 569913 - DNA, 20 bp, mouse
gtctggggacatagatagcc

SEQ ID NO: 569914 - DNA, 20 bp, mouse
ggcagcgctccttgagagga

SEQ ID NO: 569915 - DNA, 20 bp, mouse
ggtgctctgcaggctttctg

SEQ ID NO: 569916 - DNA, 20 bp, mouse
ggcgcatgcgtacaacgtag

SEQ ID NO: 569917 - DNA, 20 bp, mouse
gtgcgtacaacgtagcggag

SEQ ID NO: 569918 - DNA, 20 bp, mouse
gtacctcggaacaggctcgt

SEQ ID NO: 569919 - DNA, 20 bp, mouse
gggagcgttggctacaggaa

SEQ ID NO: 569920 - DNA, 20 bp, mouse
gggtataccctagctagata

SEQ ID NO: 569921 - DNA, 20 bp, mouse
gtacaacgtagcggaggggg

SEQ ID NO: 569922 - DNA, 20 bp, mouse
ggcgtgcgcagtagtaccac

SEQ ID NO: 569923 - DNA, 20 bp, mouse
ggaagttccctatctagcta

SEQ ID NO: 569924 - DNA, 20 bp, mouse
ggtcccacgagcctgttccg

SEQ ID NO: 569925 - DNA, 20 bp, mouse
gcatatgagcctggattcgt

SEQ ID NO: 569926 - DNA, 20 bp, mouse
ggaatctaatgggctatgag

SEQ ID NO: 569927 - DNA, 20 bp, mouse
gtctaatgggctatgagtgg

SEQ ID NO: 569928 - DNA, 20 bp, mouse
ggcacttcccagaatctaat

SEQ ID NO: 569929 - DNA, 20 bp, mouse
ggaaaagttggagggatgca

SEQ ID NO: 569930 - DNA, 20 bp, mouse
ggcctcctgctcgcaggtaa

SEQ ID NO: 569931 - DNA, 20 bp, mouse
gcagcccaagaggagactca

SEQ ID NO: 569932 - DNA, 20 bp, mouse
gagcaggctgaaggtctcat

SEQ ID NO: 569933 - DNA, 20 bp, mouse
gttggaaaggagctgatgag

SEQ ID NO: 569934 - DNA, 20 bp, mouse
ggctcagaacgaggaaggac

SEQ ID NO: 569935 - DNA, 20 bp, mouse
gcgagcaggaggccctgcca

SEQ ID NO: 569936 - DNA, 20 bp, mouse
gtcttttgtacaataggtgg

SEQ ID NO: 569937 - DNA, 20 bp, mouse
ggtggtggcgcttacaaatg

SEQ ID NO: 569938 - DNA, 20 bp, mouse
gagctcttttgtacaatagg

SEQ ID NO: 569939 - DNA, 20 bp, mouse
gggtggacagggtgaccagt

SEQ ID NO: 569940 - DNA, 20 bp, mouse
ggtatcattatgagagtggg

SEQ ID NO: 569941 - DNA, 20 bp, mouse
gattatgagagtgggtggac

SEQ ID NO: 569942 - DNA, 20 bp, mouse
ggatgaggctggcttcccac

SEQ ID NO: 569943 - DNA, 20 bp, mouse
gggcaagggcggctctgggt

SEQ ID NO: 569944 - DNA, 20 bp, mouse
gtacaaaagagctcaggtgc

SEQ ID NO: 569945 - DNA, 20 bp, mouse
ggaagccagcctcatctacg

SEQ ID NO: 569946 - DNA, 20 bp, mouse
gacagaatcctataggctgt

SEQ ID NO: 569947 - DNA, 20 bp, mouse
gtctcctctacagaatactt

SEQ ID NO: 569948 - DNA, 20 bp, mouse
gagtccaaagtattctgtag

SEQ ID NO: 569949 - DNA, 20 bp, mouse
gagagaaaatgtgagataca

SEQ ID NO: 569950 - DNA, 20 bp, mouse
ggaatcctataggctgtggg

SEQ ID NO: 569951 - DNA, 20 bp, mouse
gtacagggtagcactgagag

SEQ ID NO: 569952 - DNA, 20 bp, mouse
gacacttcacagaatcctat

SEQ ID NO: 569953 - DNA, 20 bp, mouse
gaacattggccttcagacca

SEQ ID NO: 569954 - DNA, 20 bp, mouse
gattggctgccatggtctga

SEQ ID NO: 569955 - DNA, 20 bp, mouse
gcccaccacccacagcctat

SEQ ID NO: 569956 - DNA, 20 bp, mouse
gattgatcttctgaccatgg

SEQ ID NO: 569957 - DNA, 20 bp, mouse
ggttggaacatttacctgtg

SEQ ID NO: 569958 - DNA, 20 bp, mouse
gttagtcacattggccacca

SEQ ID NO: 569959 - DNA, 20 bp, mouse
gggcagagggttctcctcac

SEQ ID NO: 569960 - DNA, 20 bp, mouse
gaagatgtctagagaagaat

SEQ ID NO: 569961 - DNA, 20 bp, mouse
gaacattgatcttctgacca

SEQ ID NO: 569962 - DNA, 20 bp, mouse
gaagtgactgagcacttcta

SEQ ID NO: 569963 - DNA, 20 bp, mouse
gaatgttcctaaccatgaca

SEQ ID NO: 569964 - DNA, 20 bp, mouse
gatatctcttctcactatat

SEQ ID NO: 569965 - DNA, 20 bp, mouse
gatctgaacttttcagcaac

SEQ ID NO: 569966 - DNA, 20 bp, mouse
ggaaaatgtgagaaacatgc

SEQ ID NO: 569967 - DNA, 20 bp, mouse
gctcctcttcagaagacttt

SEQ ID NO: 569968 - DNA, 20 bp, mouse
gagcccaaagtcttctgaag

SEQ ID NO: 569969 - DNA, 20 bp, mouse
gctatgggctgtgagtggtg

SEQ ID NO: 569970 - DNA, 20 bp, mouse
gaacattggccttctgacca

SEQ ID NO: 569971 - DNA, 20 bp, mouse
gattggctgccatggtcaga

SEQ ID NO: 569972 - DNA, 20 bp, mouse
gtgcagggcaacactgagag

SEQ ID NO: 569973 - DNA, 20 bp, mouse
gtgagcttctcagcaatggg

SEQ ID NO: 569974 - DNA, 20 bp, mouse
gtcagctcctgtctgctctg

SEQ ID NO: 569975 - DNA, 20 bp, mouse
ggaatcctatgggctgtgag

SEQ ID NO: 569976 - DNA, 20 bp, mouse
gaagtgactgagcagtgccc

SEQ ID NO: 569977 - DNA, 20 bp, mouse
gggtggtggggtctgtgtcc

SEQ ID NO: 569978 - DNA, 20 bp, mouse
gagacacccaagtcttctct

SEQ ID NO: 569979 - DNA, 20 bp, mouse
gcagtcaggaagatgcagtg

SEQ ID NO: 569980 - DNA, 20 bp, mouse
gaaggtcttctcctagagaa

SEQ ID NO: 569981 - DNA, 20 bp, mouse
gaaaggccagtacagtgaga

SEQ ID NO: 569982 - DNA, 20 bp, mouse
gggtgtctgtagttgcagtc

SEQ ID NO: 569983 - DNA, 20 bp, mouse
gcaaaaatattctgtagtgg

SEQ ID NO: 569984 - DNA, 20 bp, mouse
gttttggacaggggcatctg

SEQ ID NO: 569985 - DNA, 20 bp, mouse
gtagccaatgtgactgattt

SEQ ID NO: 569986 - DNA, 20 bp, mouse
gaggttttctcctcagaaaa

SEQ ID NO: 569987 - DNA, 20 bp, mouse
gtcagctccagcaaggtacc

SEQ ID NO: 569988 - DNA, 20 bp, mouse
gctgtactggcctttttctg

SEQ ID NO: 569989 - DNA, 20 bp, mouse
gtgccaagggataaggacat

SEQ ID NO: 569990 - DNA, 20 bp, mouse
gagtacagttgaagagatat

SEQ ID NO: 569991 - DNA, 20 bp, mouse
ggaacaggaccctctgccaa

SEQ ID NO: 569992 - DNA, 20 bp, mouse
ggaccctctgccaagggata

SEQ ID NO: 569993 - DNA, 20 bp, mouse
gcaccaatgtccttatccct

SEQ ID NO: 569994 - DNA, 20 bp, mouse
gcaggaagctctgagcagaa

SEQ ID NO: 569995 - DNA, 20 bp, mouse
ggaagcccaaagtcttctgt

SEQ ID NO: 569996 - DNA, 20 bp, mouse
ggaagaactttgctcctgca

SEQ ID NO: 569997 - DNA, 20 bp, mouse
gacattggctgccatggcca

SEQ ID NO: 569998 - DNA, 20 bp, mouse
gtgggaacatcggtcttcca

SEQ ID NO: 569999 - DNA, 20 bp, mouse
ggaatcctatgggctgaggg

SEQ ID NO: 570000 - DNA, 20 bp, mouse
gattcatcctcagctctcac

SEQ ID NO: 570001 - DNA, 20 bp, mouse
gtgatatctgtttgtattca

SEQ ID NO: 570002 - DNA, 20 bp, mouse
gcctatgggctgagggtggt

SEQ ID NO: 570003 - DNA, 20 bp, mouse
gtgggtggacctcctggcaa

SEQ ID NO: 570004 - DNA, 20 bp, mouse
gcaggaatctctgaccagac

SEQ ID NO: 570005 - DNA, 20 bp, mouse
gctagacatcttcaattcag

SEQ ID NO: 570006 - DNA, 20 bp, mouse
ggggttttttcctcagagaa

SEQ ID NO: 570007 - DNA, 20 bp, mouse
gactcagttcagaaggagaa

SEQ ID NO: 570008 - DNA, 20 bp, mouse
gagagaaaactcagttcaga

SEQ ID NO: 570009 - DNA, 20 bp, mouse
gtgccaagggataaggacat

SEQ ID NO: 570010 - DNA, 20 bp, mouse
gagtacagttgaagagatat

SEQ ID NO: 570011 - DNA, 20 bp, mouse
ggaacaggaccctctgccaa

SEQ ID NO: 570012 - DNA, 20 bp, mouse
ggaccctctgccaagggata

SEQ ID NO: 570013 - DNA, 20 bp, mouse
gcaccaatgtccttatccct

SEQ ID NO: 570014 - DNA, 20 bp, mouse
ggtgccttgctggagctgaa

SEQ ID NO: 570015 - DNA, 20 bp, mouse
gcaggaagctctgagcagaa

SEQ ID NO: 570016 - DNA, 20 bp, mouse
gtctaagtggaatttctctc

SEQ ID NO: 570017 - DNA, 20 bp, mouse
gccacagcctgtaggattct

SEQ ID NO: 570018 - DNA, 20 bp, mouse
ggacaggagctgatgagggg

SEQ ID NO: 570019 - DNA, 20 bp, mouse
gtgaggggaggataatcctc

SEQ ID NO: 570020 - DNA, 20 bp, mouse
gagtgcagaagatacattga

SEQ ID NO: 570021 - DNA, 20 bp, mouse
gaagaaggaaatcggagacc

SEQ ID NO: 570022 - DNA, 20 bp, mouse
gactatctgattgtatggga

SEQ ID NO: 570023 - DNA, 20 bp, mouse
gttttgaacaggggtacctg

SEQ ID NO: 570024 - DNA, 20 bp, mouse
gtgaaggtcttttcagtgaa

SEQ ID NO: 570025 - DNA, 20 bp, mouse
ggcacttccaagaatcctac

SEQ ID NO: 570026 - DNA, 20 bp, mouse
gaggaccttcagctcctgta

SEQ ID NO: 570027 - DNA, 20 bp, mouse
gggagatacagggtcctgta

SEQ ID NO: 570028 - DNA, 20 bp, mouse
gctaaagacggcctagtgtg

SEQ ID NO: 570029 - DNA, 20 bp, mouse
ggaacttcacagaattttat

SEQ ID NO: 570030 - DNA, 20 bp, mouse
gcagggtagatggagataca

SEQ ID NO: 570031 - DNA, 20 bp, mouse
gcagaggccaggtgccttac

SEQ ID NO: 570032 - DNA, 20 bp, mouse
gaacatcggtcttctgacca

SEQ ID NO: 570033 - DNA, 20 bp, mouse
gatctaccctgtgagagatg

SEQ ID NO: 570034 - DNA, 20 bp, mouse
gctagacatcttcaattcat

SEQ ID NO: 570035 - DNA, 20 bp, mouse
gcagggtgactctctaaaga

SEQ ID NO: 570036 - DNA, 20 bp, mouse
ggaaaatgtgaggaagattt

SEQ ID NO: 570037 - DNA, 20 bp, mouse
gggtgaggaaagtgtagtga

SEQ ID NO: 570038 - DNA, 20 bp, mouse
gatgtgactgatttgaatag

SEQ ID NO: 570039 - DNA, 20 bp, mouse
gatttgaataggggcatctg

SEQ ID NO: 570040 - DNA, 20 bp, mouse
gtacagaatatttttgtttt

SEQ ID NO: 570041 - DNA, 20 bp, mouse
gcataaagagagaaaatgtg

SEQ ID NO: 570042 - DNA, 20 bp, mouse
gtctatttgtagttgaggtg

SEQ ID NO: 570043 - DNA, 20 bp, mouse
gagatgtctagagaaaactt

SEQ ID NO: 570044 - DNA, 20 bp, mouse
gtgagcagaaccctttgcca

SEQ ID NO: 570045 - DNA, 20 bp, mouse
ggggtatctatttgtagttg

SEQ ID NO: 570046 - DNA, 20 bp, mouse
gggttaggaacatcggtctt

SEQ ID NO: 570047 - DNA, 20 bp, mouse
gctgtcatggttaggaacat

SEQ ID NO: 570048 - DNA, 20 bp, mouse
ggttggaatatttacctgtt

SEQ ID NO: 570049 - DNA, 20 bp, mouse
gggtgcagaaggtacagtga

SEQ ID NO: 570050 - DNA, 20 bp, mouse
gacacagcccataggatttt

SEQ ID NO: 570051 - DNA, 20 bp, mouse
gccacatactgggccatctt

SEQ ID NO: 570052 - DNA, 20 bp, mouse
gaacatcggtcttcggacca

SEQ ID NO: 570053 - DNA, 20 bp, mouse
gatatctcttctcactatac

SEQ ID NO: 570054 - DNA, 20 bp, mouse
ggggacagaggctcggcagc

SEQ ID NO: 570055 - DNA, 20 bp, mouse
gaagtgactgagcacttcta

SEQ ID NO: 570056 - DNA, 20 bp, mouse
gctgccaggggtgtgcccca

SEQ ID NO: 570057 - DNA, 20 bp, mouse
ggtcaggagaagctgagaat

SEQ ID NO: 570058 - DNA, 20 bp, mouse
gctccacccccagtcaaagt

SEQ ID NO: 570059 - DNA, 20 bp, mouse
gggggtggagaggaacacaa

SEQ ID NO: 570060 - DNA, 20 bp, mouse
ggtttctgtttgcctttagg

SEQ ID NO: 570061 - DNA, 20 bp, mouse
ggggtgcccactttgactgg

SEQ ID NO: 570062 - DNA, 20 bp, mouse
ggaggcagaaggtacattga

SEQ ID NO: 570063 - DNA, 20 bp, mouse
ggggtgtgccccatggcagg

SEQ ID NO: 570064 - DNA, 20 bp, mouse
gaacagcttcacatccaaca

SEQ ID NO: 570065 - DNA, 20 bp, mouse
gggggttctactcacaggta

SEQ ID NO: 570066 - DNA, 20 bp, mouse
gtgccgcagaggcgtctcaa

SEQ ID NO: 570067 - DNA, 20 bp, mouse
gagcggcgtagcgacatcgg

SEQ ID NO: 570068 - DNA, 20 bp, mouse
gggcgtagcgacatcggcgg

SEQ ID NO: 570069 - DNA, 20 bp, mouse
ggcgccaccagctgccgcag

SEQ ID NO: 570070 - DNA, 20 bp, mouse
ggggagcggcgtagcgacat

SEQ ID NO: 570071 - DNA, 20 bp, mouse
gcacgggccgcagcccacga

SEQ ID NO: 570072 - DNA, 20 bp, mouse
gcgccgcgcccctccctcgt

SEQ ID NO: 570073 - DNA, 20 bp, mouse
gggccgcagcccacgaggga

SEQ ID NO: 570074 - DNA, 20 bp, mouse
gcctgcgcgagcacttggta

SEQ ID NO: 570075 - DNA, 20 bp, mouse
gtcccaccccggcgctccca

SEQ ID NO: 570076 - DNA, 20 bp, mouse
ggcctgggctgggagacggt

SEQ ID NO: 570077 - DNA, 20 bp, mouse
gtgacgcgggaggatggcgg

SEQ ID NO: 570078 - DNA, 20 bp, mouse
gcccagtgcacggggaccga

SEQ ID NO: 570079 - DNA, 20 bp, mouse
ggggctctccggagtctcgg

SEQ ID NO: 570080 - DNA, 20 bp, mouse
gtcctcccgcgtcagcgtgg

SEQ ID NO: 570081 - DNA, 20 bp, mouse
ggcccaccgtctcccagccc

SEQ ID NO: 570082 - DNA, 20 bp, mouse
gggacggctgggccacagac

SEQ ID NO: 570083 - DNA, 20 bp, mouse
ggacgccaccacgctgacgc

SEQ ID NO: 570084 - DNA, 20 bp, mouse
ggccaccacgctgacgcggg

SEQ ID NO: 570085 - DNA, 20 bp, mouse
gggaaggcctcacctcgcgc

SEQ ID NO: 570086 - DNA, 20 bp, mouse
gaggaacacggccccaacta

SEQ ID NO: 570087 - DNA, 20 bp, mouse
gcacggccccaactacggtt

SEQ ID NO: 570088 - DNA, 20 bp, mouse
ggatcaccgaaccgtagttg

SEQ ID NO: 570089 - DNA, 20 bp, mouse
ggcctgcggagtcttgacgg

SEQ ID NO: 570090 - DNA, 20 bp, mouse
gctgtgtccgctgctgggtc

SEQ ID NO: 570091 - DNA, 20 bp, mouse
gtgtcgctgcgccggagcta

SEQ ID NO: 570092 - DNA, 20 bp, mouse
ggcagatgctgaatcactgt

SEQ ID NO: 570093 - DNA, 20 bp, mouse
gggagagggagcttacctca

SEQ ID NO: 570094 - DNA, 20 bp, mouse
gagcgcctggaccccacgta

SEQ ID NO: 570095 - DNA, 20 bp, mouse
ggccgccgtcaagactccgc

SEQ ID NO: 570096 - DNA, 20 bp, mouse
gctgcgacgcatggaacctg

SEQ ID NO: 570097 - DNA, 20 bp, mouse
ggggtaaagatggcagagcg

SEQ ID NO: 570098 - DNA, 20 bp, mouse
gacacacgggaccatgtctg

SEQ ID NO: 570099 - DNA, 20 bp, mouse
gacacggccggcctcagcca

SEQ ID NO: 570100 - DNA, 20 bp, mouse
gactacattcaggtattcgg

SEQ ID NO: 570101 - DNA, 20 bp, mouse
ggtgttgcgggccgagggac

SEQ ID NO: 570102 - DNA, 20 bp, mouse
gcttctcgctgactacattc

SEQ ID NO: 570103 - DNA, 20 bp, mouse
gtccatgcgtcgcagatcac

SEQ ID NO: 570104 - DNA, 20 bp, mouse
gcacaggagcgccccagaca

SEQ ID NO: 570105 - DNA, 20 bp, mouse
gccagccaggtccgacacac

SEQ ID NO: 570106 - DNA, 20 bp, mouse
gcacggcgcaggctagtaac

SEQ ID NO: 570107 - DNA, 20 bp, mouse
ggccgctcctacgccgcaca

SEQ ID NO: 570108 - DNA, 20 bp, mouse
ggccggggtcaccgagacag

SEQ ID NO: 570109 - DNA, 20 bp, mouse
gtggtggagagcgcagccaa

SEQ ID NO: 570110 - DNA, 20 bp, mouse
gggcagcgccggggatccag

SEQ ID NO: 570111 - DNA, 20 bp, mouse
gtactagcctgcgccgtgtg

SEQ ID NO: 570112 - DNA, 20 bp, mouse
ggaacaagccgcaagaggaa

SEQ ID NO: 570113 - DNA, 20 bp, mouse
gcggggctgtcgctgcacgg

SEQ ID NO: 570114 - DNA, 20 bp, mouse
gggacccgcggcctctgtct

SEQ ID NO: 570115 - DNA, 20 bp, mouse
gatgagctccatcggcactg

SEQ ID NO: 570116 - DNA, 20 bp, mouse
gaaggactgagcctcaccag

SEQ ID NO: 570117 - DNA, 20 bp, mouse
gggcaggccggtcaccgagg

SEQ ID NO: 570118 - DNA, 20 bp, mouse
ggccggcggggaccagtccc

SEQ ID NO: 570119 - DNA, 20 bp, mouse
gcgtgcccacggctcctcgg

SEQ ID NO: 570120 - DNA, 20 bp, mouse
gcgtgcgcaggactgcgagg

SEQ ID NO: 570121 - DNA, 20 bp, mouse
ggccccgcggggatacccga

SEQ ID NO: 570122 - DNA, 20 bp, mouse
gtcgactccgcggcccctaa

SEQ ID NO: 570123 - DNA, 20 bp, mouse
gcctggcaggccggtcaccg

SEQ ID NO: 570124 - DNA, 20 bp, mouse
ggcgccggcgctacaagact

SEQ ID NO: 570125 - DNA, 20 bp, mouse
gccggagggtctcagagccc

SEQ ID NO: 570126 - DNA, 20 bp, mouse
gcgcccggagaacctaagtc

SEQ ID NO: 570127 - DNA, 20 bp, mouse
gcccgggtcccgccagactt

SEQ ID NO: 570128 - DNA, 20 bp, mouse
gcgagtacgacaggttcgta

SEQ ID NO: 570129 - DNA, 20 bp, mouse
gcaccggacctgggttaaca

SEQ ID NO: 570130 - DNA, 20 bp, mouse
gcgtacggcgggaagcagca

SEQ ID NO: 570131 - DNA, 20 bp, mouse
gcaggcggcggagagggatc

SEQ ID NO: 570132 - DNA, 20 bp, mouse
ggcagggtcgaaatttgggt

SEQ ID NO: 570133 - DNA, 20 bp, mouse
gcactgcagaacccaggccg

SEQ ID NO: 570134 - DNA, 20 bp, mouse
ggcacgcgcagacggctgca

SEQ ID NO: 570135 - DNA, 20 bp, mouse
ggactccccgcggaagcgag

SEQ ID NO: 570136 - DNA, 20 bp, mouse
gccctggtgtgtgtgctacg

SEQ ID NO: 570137 - DNA, 20 bp, mouse
ggcgctggaaccccgggaca

SEQ ID NO: 570138 - DNA, 20 bp, mouse
ggcaggaacgccatgtcccg

SEQ ID NO: 570139 - DNA, 20 bp, mouse
gcggcccgaggatggttcgg

SEQ ID NO: 570140 - DNA, 20 bp, mouse
gaaaccggcgctggaacccc

SEQ ID NO: 570141 - DNA, 20 bp, mouse
gagcagtagccataacttcc

SEQ ID NO: 570142 - DNA, 20 bp, mouse
ggagcccccgaaccatcctc

SEQ ID NO: 570143 - DNA, 20 bp, mouse
gagtagccataacttccggg

SEQ ID NO: 570144 - DNA, 20 bp, mouse
gagggccgactctaccaagt

SEQ ID NO: 570145 - DNA, 20 bp, mouse
gagggacccaagccccctcc

SEQ ID NO: 570146 - DNA, 20 bp, mouse
gtcgggcgagaagacggtga

SEQ ID NO: 570147 - DNA, 20 bp, mouse
gtggccgtcgggcgagaaga

SEQ ID NO: 570148 - DNA, 20 bp, mouse
gactgcggacgcactagctc

SEQ ID NO: 570149 - DNA, 20 bp, mouse
ggtgagtgtgcgcttttgag

SEQ ID NO: 570150 - DNA, 20 bp, mouse
gcgggtggaccaggaggtga

SEQ ID NO: 570151 - DNA, 20 bp, mouse
gcgagaagacggtgatggcg

SEQ ID NO: 570152 - DNA, 20 bp, mouse
gcgcgtactccacttggaag

SEQ ID NO: 570153 - DNA, 20 bp, mouse
gtccccactgcggagcatct

SEQ ID NO: 570154 - DNA, 20 bp, mouse
gaagcggggcacgcagacct

SEQ ID NO: 570155 - DNA, 20 bp, mouse
gagctgaatggtgacgacgt

SEQ ID NO: 570156 - DNA, 20 bp, mouse
ggcccgtggactcctgtcct

SEQ ID NO: 570157 - DNA, 20 bp, mouse
ggcttctgaggcctgcgtga

SEQ ID NO: 570158 - DNA, 20 bp, mouse
ggcctaggacaggagtccac

SEQ ID NO: 570159 - DNA, 20 bp, mouse
gggcgggcgttagcacgtgg

SEQ ID NO: 570160 - DNA, 20 bp, mouse
gtagggacgcaacctcaggt

SEQ ID NO: 570161 - DNA, 20 bp, mouse
gggagccagggctggaacag

SEQ ID NO: 570162 - DNA, 20 bp, mouse
gatggcttctcggtatgaca

SEQ ID NO: 570163 - DNA, 20 bp, mouse
gtaccgagaagccatcacgc

SEQ ID NO: 570164 - DNA, 20 bp, mouse
gtggaaaaggtgtccatctg

SEQ ID NO: 570165 - DNA, 20 bp, mouse
gaacctcaggttggcagtgg

SEQ ID NO: 570166 - DNA, 20 bp, mouse
gcagctctcgttccacgtct

SEQ ID NO: 570167 - DNA, 20 bp, mouse
gactgctgcttaccgagacg

SEQ ID NO: 570168 - DNA, 20 bp, mouse
gccaggctcgacccaggtga

SEQ ID NO: 570169 - DNA, 20 bp, mouse
gcgcagctgcacagggccgg

SEQ ID NO: 570170 - DNA, 20 bp, mouse
gggcggaagtggaccggtcc

SEQ ID NO: 570171 - DNA, 20 bp, mouse
gtagggcggaagattgaggt

SEQ ID NO: 570172 - DNA, 20 bp, mouse
gcagggccggcggagccgtg

SEQ ID NO: 570173 - DNA, 20 bp, mouse
ggccatagggcggaagattg

SEQ ID NO: 570174 - DNA, 20 bp, mouse
gcgacgggcgggtgtgggaa

SEQ ID NO: 570175 - DNA, 20 bp, mouse
gctggagcaaacggcaccga

SEQ ID NO: 570176 - DNA, 20 bp, mouse
gaggccaagtgagaatgcgg

SEQ ID NO: 570177 - DNA, 20 bp, mouse
gcagacgcctctgctccccc

SEQ ID NO: 570178 - DNA, 20 bp, mouse
gcgatgagtggatcagccag

SEQ ID NO: 570179 - DNA, 20 bp, mouse
gggaaggccaagtgagaatg

SEQ ID NO: 570180 - DNA, 20 bp, mouse
gggagcagaggcgtctgtcc

SEQ ID NO: 570181 - DNA, 20 bp, mouse
ggccactgcggagatcaggt

SEQ ID NO: 570182 - DNA, 20 bp, mouse
gatgcgggggtctcgatgag

SEQ ID NO: 570183 - DNA, 20 bp, mouse
gagcaggcagtggaacccac

SEQ ID NO: 570184 - DNA, 20 bp, mouse
gcaagggagggtccctgaac

SEQ ID NO: 570185 - DNA, 20 bp, mouse
gcagcctctgaactagggtg

SEQ ID NO: 570186 - DNA, 20 bp, mouse
gtcctgaagagccatccctg

SEQ ID NO: 570187 - DNA, 20 bp, mouse
gccggcctgaggcaagtgaa

SEQ ID NO: 570188 - DNA, 20 bp, mouse
gcctgaggcaagtgaatgga

SEQ ID NO: 570189 - DNA, 20 bp, mouse
gcagtcagcagaggtcccag

SEQ ID NO: 570190 - DNA, 20 bp, mouse
gtcttcaggatgtgtgcaag

SEQ ID NO: 570191 - DNA, 20 bp, mouse
gcctgaggctgagtgagaat

SEQ ID NO: 570192 - DNA, 20 bp, mouse
gaggctgagtgagaatcgga

SEQ ID NO: 570193 - DNA, 20 bp, mouse
gctgatactcggtcctcctg

SEQ ID NO: 570194 - DNA, 20 bp, mouse
gcggggtacagcccagccac

SEQ ID NO: 570195 - DNA, 20 bp, mouse
gggcaagtgaatggatggtc

SEQ ID NO: 570196 - DNA, 20 bp, mouse
gacggacagggacacttccc

SEQ ID NO: 570197 - DNA, 20 bp, mouse
ggctgcagaggccacggaca

SEQ ID NO: 570198 - DNA, 20 bp, mouse
ggtcacccccagctcagtcc

SEQ ID NO: 570199 - DNA, 20 bp, mouse
gctggtgaggtcgtgtaccc

SEQ ID NO: 570200 - DNA, 20 bp, mouse
gggaccgtgggcctccctct

SEQ ID NO: 570201 - DNA, 20 bp, mouse
ggcaccatggagtacctcat

SEQ ID NO: 570202 - DNA, 20 bp, mouse
gcagcagggcagagcacact

SEQ ID NO: 570203 - DNA, 20 bp, mouse
gactccatggtgccgggaag

SEQ ID NO: 570204 - DNA, 20 bp, mouse
ggcacacccggactgagctg

SEQ ID NO: 570205 - DNA, 20 bp, mouse
gaccagtgagacagcacacc

SEQ ID NO: 570206 - DNA, 20 bp, mouse
gccccaccgggcccatctca

SEQ ID NO: 570207 - DNA, 20 bp, mouse
gcgcaatcatggtgagatcg

SEQ ID NO: 570208 - DNA, 20 bp, mouse
gggagtaaggaaaggagtct

SEQ ID NO: 570209 - DNA, 20 bp, mouse
ggagatcggggagtaaggaa

SEQ ID NO: 570210 - DNA, 20 bp, mouse
gtataggacataatagactg

SEQ ID NO: 570211 - DNA, 20 bp, mouse
gctggctcctccggagtgga

SEQ ID NO: 570212 - DNA, 20 bp, mouse
gatacccgtgccctccactc

SEQ ID NO: 570213 - DNA, 20 bp, mouse
gtggtcagtagaatgcacat

SEQ ID NO: 570214 - DNA, 20 bp, mouse
gcgtcctggctcctccggag

SEQ ID NO: 570215 - DNA, 20 bp, mouse
gggttgagacaccaaaacgg

SEQ ID NO: 570216 - DNA, 20 bp, mouse
gtcggctgaggtgactaaga

SEQ ID NO: 570217 - DNA, 20 bp, mouse
ggaagcgttttgggagtcac

SEQ ID NO: 570218 - DNA, 20 bp, mouse
gagccggacccccggcccag

SEQ ID NO: 570219 - DNA, 20 bp, mouse
gctagcgctttcatttctgt

SEQ ID NO: 570220 - DNA, 20 bp, mouse
gtcaccgcgccgggaatggg

SEQ ID NO: 570221 - DNA, 20 bp, mouse
gtgccctggagccggacccc

SEQ ID NO: 570222 - DNA, 20 bp, mouse
ggcgcgggcgccagcaatcg

SEQ ID NO: 570223 - DNA, 20 bp, mouse
gctttcatttctgtcggctg

SEQ ID NO: 570224 - DNA, 20 bp, mouse
ggcgctagcgtcaccggaaa

SEQ ID NO: 570225 - DNA, 20 bp, mouse
ggggtccatgaggccgctgg

SEQ ID NO: 570226 - DNA, 20 bp, mouse
gtcccagccggaaccgggtc

SEQ ID NO: 570227 - DNA, 20 bp, mouse
ggagacagtgaacccgccaa

SEQ ID NO: 570228 - DNA, 20 bp, mouse
gcccttgctaaacatggcgc

SEQ ID NO: 570229 - DNA, 20 bp, mouse
gcgtagccttaagaaaggag

SEQ ID NO: 570230 - DNA, 20 bp, mouse
gagtgaacccgccaagggtc

SEQ ID NO: 570231 - DNA, 20 bp, mouse
gcagccggaaccgggtcggg

SEQ ID NO: 570232 - DNA, 20 bp, mouse
gtgggaacagcggaccgtgg

SEQ ID NO: 570233 - DNA, 20 bp, mouse
gacctgggaacagcggaccg

SEQ ID NO: 570234 - DNA, 20 bp, mouse
ggaacccgccaagggtcggg

SEQ ID NO: 570235 - DNA, 20 bp, mouse
gagctgtctgagcaccttga

SEQ ID NO: 570236 - DNA, 20 bp, mouse
gctttgtggcagagtagcag

SEQ ID NO: 570237 - DNA, 20 bp, mouse
ggagcctccggcccaaaggc

SEQ ID NO: 570238 - DNA, 20 bp, mouse
ggtgagagcctccggcccaa

SEQ ID NO: 570239 - DNA, 20 bp, mouse
gcgtcgagcggggtctgcac

SEQ ID NO: 570240 - DNA, 20 bp, mouse
ggtgacggagcgctttacga

SEQ ID NO: 570241 - DNA, 20 bp, mouse
gtgtgttctgcgagagggag

SEQ ID NO: 570242 - DNA, 20 bp, mouse
gtctgcaccggcctttgggc

SEQ ID NO: 570243 - DNA, 20 bp, mouse
ggacatgtactaggcctgac

SEQ ID NO: 570244 - DNA, 20 bp, mouse
gagcgctgtgttctgcgaga

SEQ ID NO: 570245 - DNA, 20 bp, mouse
gaccccagactgggaaaacc

SEQ ID NO: 570246 - DNA, 20 bp, mouse
gcaaaagaaaagcctccgac

SEQ ID NO: 570247 - DNA, 20 bp, mouse
gcactttcttggcaagatgg

SEQ ID NO: 570248 - DNA, 20 bp, mouse
ggcgagagaccgggacgaga

SEQ ID NO: 570249 - DNA, 20 bp, mouse
ggcgcgatcgggacccgagt

SEQ ID NO: 570250 - DNA, 20 bp, mouse
gcccgcggccgtgtgactca

SEQ ID NO: 570251 - DNA, 20 bp, mouse
gggcaagatggcggctgtgt

SEQ ID NO: 570252 - DNA, 20 bp, mouse
gagtgtttccgggccgaggg

SEQ ID NO: 570253 - DNA, 20 bp, mouse
gagacagcattcctaaggga

SEQ ID NO: 570254 - DNA, 20 bp, mouse
gcaggtgtgttcatgcccgg

SEQ ID NO: 570255 - DNA, 20 bp, mouse
gcggcccggaaacactttct

SEQ ID NO: 570256 - DNA, 20 bp, mouse
gtcgggccgctgcccccgag

SEQ ID NO: 570257 - DNA, 20 bp, mouse
gtctgtgcggtgccgctcgg

SEQ ID NO: 570258 - DNA, 20 bp, mouse
gcagagtcgacggatcttcg

SEQ ID NO: 570259 - DNA, 20 bp, mouse
gtggcgttactggatctgtg

SEQ ID NO: 570260 - DNA, 20 bp, mouse
gcttcggggccaagtggtca

SEQ ID NO: 570261 - DNA, 20 bp, mouse
gcccccgcttcccgcatcca

SEQ ID NO: 570262 - DNA, 20 bp, mouse
gcgggggcagcggcccgagt

SEQ ID NO: 570263 - DNA, 20 bp, mouse
ggtccaggagagcagcatcg

SEQ ID NO: 570264 - DNA, 20 bp, mouse
gtgtctgcctgggtctgagg

SEQ ID NO: 570265 - DNA, 20 bp, mouse
gatccgtcgactctgcgaca

SEQ ID NO: 570266 - DNA, 20 bp, mouse
gtccgtccggaacgagccgg

SEQ ID NO: 570267 - DNA, 20 bp, mouse
ggcagcatctcagcagagcg

SEQ ID NO: 570268 - DNA, 20 bp, mouse
gggctcggctttccaatcag

SEQ ID NO: 570269 - DNA, 20 bp, mouse
gtccggaacgagccggcggt

SEQ ID NO: 570270 - DNA, 20 bp, mouse
ggggcaggagcacctaccgc

SEQ ID NO: 570271 - DNA, 20 bp, mouse
gctgctgagatgctgcgggc

SEQ ID NO: 570272 - DNA, 20 bp, mouse
gacctaccgccggctcgttc

SEQ ID NO: 570273 - DNA, 20 bp, mouse
gtcttccgtccggaacgagc

SEQ ID NO: 570274 - DNA, 20 bp, mouse
gatctcagcagagcggggct

SEQ ID NO: 570275 - DNA, 20 bp, mouse
gacggaagaagtccacaccg

SEQ ID NO: 570276 - DNA, 20 bp, mouse
gcggcgcccagggagagacc

SEQ ID NO: 570277 - DNA, 20 bp, mouse
gggctgtgaaccgctcgagt

SEQ ID NO: 570278 - DNA, 20 bp, mouse
gtccggcggtggcgatttgg

SEQ ID NO: 570279 - DNA, 20 bp, mouse
gacttccggcggtggcgatt

SEQ ID NO: 570280 - DNA, 20 bp, mouse
gcgagtaggcaggcgctgaa

SEQ ID NO: 570281 - DNA, 20 bp, mouse
gcggccgacgctggggacag

SEQ ID NO: 570282 - DNA, 20 bp, mouse
gtgaagggctgaagccgagt

SEQ ID NO: 570283 - DNA, 20 bp, mouse
gcaaagcgacccggacagaa

SEQ ID NO: 570284 - DNA, 20 bp, mouse
gcacagcccggtctctccct

SEQ ID NO: 570285 - DNA, 20 bp, mouse
ggccccaaggcgggaggacg

SEQ ID NO: 570286 - DNA, 20 bp, mouse
gcggagaccaaggagctcga

SEQ ID NO: 570287 - DNA, 20 bp, mouse
gctaaaccgaccggagacca

SEQ ID NO: 570288 - DNA, 20 bp, mouse
gcgtaggaactgatgcgtct

SEQ ID NO: 570289 - DNA, 20 bp, mouse
ggagtcacagaggaagtagg

SEQ ID NO: 570290 - DNA, 20 bp, mouse
gggtcggtttagagtcacag

SEQ ID NO: 570291 - DNA, 20 bp, mouse
ggagctccttggtctccggt

SEQ ID NO: 570292 - DNA, 20 bp, mouse
gtgagctaccaccaatctct

SEQ ID NO: 570293 - DNA, 20 bp, mouse
gactgttccttcgagctcct

SEQ ID NO: 570294 - DNA, 20 bp, mouse
gttatgaggtacctagagat

SEQ ID NO: 570295 - DNA, 20 bp, mouse
gcattggcgcgaggccgtgg

SEQ ID NO: 570296 - DNA, 20 bp, mouse
ggagtgttgggagacctgag

SEQ ID NO: 570297 - DNA, 20 bp, mouse
gaccgtgtgggatgaagctg

SEQ ID NO: 570298 - DNA, 20 bp, mouse
ggcccgagagtccagtgact

SEQ ID NO: 570299 - DNA, 20 bp, mouse
gcgcgggtgaagttctccac

SEQ ID NO: 570300 - DNA, 20 bp, mouse
ggagaagatggcgaccgtgt

SEQ ID NO: 570301 - DNA, 20 bp, mouse
ggattcctgacgcgacagaa

SEQ ID NO: 570302 - DNA, 20 bp, mouse
gctgtcgcgtcaggaatcgc

SEQ ID NO: 570303 - DNA, 20 bp, mouse
ggcagattcgctcggagacg

SEQ ID NO: 570304 - DNA, 20 bp, mouse
gatgaagctgaggtgagtgt

SEQ ID NO: 570305 - DNA, 20 bp, mouse
ggactccacgaaccaaaccg

SEQ ID NO: 570306 - DNA, 20 bp, mouse
gaggctgcggctggaggtaa

SEQ ID NO: 570307 - DNA, 20 bp, mouse
gtccagccgcagcctcggcc

SEQ ID NO: 570308 - DNA, 20 bp, mouse
gagcccgcaagacccgggag

SEQ ID NO: 570309 - DNA, 20 bp, mouse
gaaaagccgggccgaggctg

SEQ ID NO: 570310 - DNA, 20 bp, mouse
gtacctcaggatgatcccgg

SEQ ID NO: 570311 - DNA, 20 bp, mouse
gcagctctcgagtttggtgg

SEQ ID NO: 570312 - DNA, 20 bp, mouse
gggcaaagcccgcaagaccc

SEQ ID NO: 570313 - DNA, 20 bp, mouse
gatgagtaaaagccgggccg

SEQ ID NO: 570314 - DNA, 20 bp, mouse
gctaccgcctagcagaggag

SEQ ID NO: 570315 - DNA, 20 bp, mouse
gccagtccagctctcgagtt

SEQ ID NO: 570316 - DNA, 20 bp, mouse
gtggtcactatggaggagat

SEQ ID NO: 570317 - DNA, 20 bp, mouse
gagtgcagcccggccagtca

SEQ ID NO: 570318 - DNA, 20 bp, mouse
ggaggccggcttggtcacta

SEQ ID NO: 570319 - DNA, 20 bp, mouse
ggccggcttggtcactatgg

SEQ ID NO: 570320 - DNA, 20 bp, mouse
gacgggccggataacaggaa

SEQ ID NO: 570321 - DNA, 20 bp, mouse
gcgtcagcggaagccgtgac

SEQ ID NO: 570322 - DNA, 20 bp, mouse
gccgtcaggtcaacccgcag

SEQ ID NO: 570323 - DNA, 20 bp, mouse
gggccgggctgcactgaggc

SEQ ID NO: 570324 - DNA, 20 bp, mouse
ggcgggagctggacatgagt

SEQ ID NO: 570325 - DNA, 20 bp, mouse
gggacttccgttggcgtcag

SEQ ID NO: 570326 - DNA, 20 bp, mouse
gggcgatccctgccgagaga

SEQ ID NO: 570327 - DNA, 20 bp, mouse
gcctgccgagagagggaaga

SEQ ID NO: 570328 - DNA, 20 bp, mouse
gagagggtccagtggatcag

SEQ ID NO: 570329 - DNA, 20 bp, mouse
gcctgaggaaagcaggacag

SEQ ID NO: 570330 - DNA, 20 bp, mouse
gagggaagatggcgcttgat

SEQ ID NO: 570331 - DNA, 20 bp, mouse
gacacagcagatccagtccc

SEQ ID NO: 570332 - DNA, 20 bp, mouse
gcacgagcgagagggtccag

SEQ ID NO: 570333 - DNA, 20 bp, mouse
gggtccagtggatcaggggt

SEQ ID NO: 570334 - DNA, 20 bp, mouse
gcctgcgcgatagagtgact

SEQ ID NO: 570335 - DNA, 20 bp, mouse
gggtaaggattctgccgcgg

SEQ ID NO: 570336 - DNA, 20 bp, mouse
ggagcgacggcttctcatca

SEQ ID NO: 570337 - DNA, 20 bp, mouse
gatggcggaccctagagata

SEQ ID NO: 570338 - DNA, 20 bp, mouse
gcgacggcttctcatcatgg

SEQ ID NO: 570339 - DNA, 20 bp, mouse
gcggcatcccctatgagcga

SEQ ID NO: 570340 - DNA, 20 bp, mouse
gctgaagcgccttatctcta

SEQ ID NO: 570341 - DNA, 20 bp, mouse
gttgggaaggcccgagtcca

SEQ ID NO: 570342 - DNA, 20 bp, mouse
gccggacgcgggactcacgg

SEQ ID NO: 570343 - DNA, 20 bp, mouse
ggagaagccgtcgctcatag

SEQ ID NO: 570344 - DNA, 20 bp, mouse
gagaggagtgaggtacaagt

SEQ ID NO: 570345 - DNA, 20 bp, mouse
gtagagcacaaggagattga

SEQ ID NO: 570346 - DNA, 20 bp, mouse
gagcgcacccgggaccctgg

SEQ ID NO: 570347 - DNA, 20 bp, mouse
gttgctctaccgcacctcca

SEQ ID NO: 570348 - DNA, 20 bp, mouse
gaccgcacctccagggtccc

SEQ ID NO: 570349 - DNA, 20 bp, mouse
gcacagtcctggccaagccc

SEQ ID NO: 570350 - DNA, 20 bp, mouse
ggcgagccggcggcctgtgg

SEQ ID NO: 570351 - DNA, 20 bp, mouse
gccggcgtttagctgagtca

SEQ ID NO: 570352 - DNA, 20 bp, mouse
ggaggtgcggtagagcaagc

SEQ ID NO: 570353 - DNA, 20 bp, mouse
gtgagtcagggcgggtgact

SEQ ID NO: 570354 - DNA, 20 bp, mouse
ggccctggatctgtcagctc

SEQ ID NO: 570355 - DNA, 20 bp, mouse
gctgactgagcagcgcaccc

SEQ ID NO: 570356 - DNA, 20 bp, mouse
gttgggaaggcgaaatggag

SEQ ID NO: 570357 - DNA, 20 bp, mouse
gcggggcttgagtttcacgg

SEQ ID NO: 570358 - DNA, 20 bp, mouse
gaggtcttgggaaggcgaaa

SEQ ID NO: 570359 - DNA, 20 bp, mouse
gaggacccggaagccatgta

SEQ ID NO: 570360 - DNA, 20 bp, mouse
gctgtaacctggcctacagt

SEQ ID NO: 570361 - DNA, 20 bp, mouse
gcggaacaggaaatgcgagt

SEQ ID NO: 570362 - DNA, 20 bp, mouse
gtttcacggaggtcttggga

SEQ ID NO: 570363 - DNA, 20 bp, mouse
gtgagtttcacggaggtctt

SEQ ID NO: 570364 - DNA, 20 bp, mouse
gacccaaggctactagaggg

SEQ ID NO: 570365 - DNA, 20 bp, mouse
gggcgggaggagcgcagaag

SEQ ID NO: 570366 - DNA, 20 bp, mouse
gtcggtgctgagtagagact

SEQ ID NO: 570367 - DNA, 20 bp, mouse
ggagtagagactgggctctc

SEQ ID NO: 570368 - DNA, 20 bp, mouse
gacaatcggggacccttgag

SEQ ID NO: 570369 - DNA, 20 bp, mouse
gctgcctgctgactcacggt

SEQ ID NO: 570370 - DNA, 20 bp, mouse
gctcacaccgtccccggccg

SEQ ID NO: 570371 - DNA, 20 bp, mouse
ggagtcagcagcaccatagc

SEQ ID NO: 570372 - DNA, 20 bp, mouse
gcaggttcgctacccctcaa

SEQ ID NO: 570373 - DNA, 20 bp, mouse
ggtggcggcccgggacagac

SEQ ID NO: 570374 - DNA, 20 bp, mouse
ggtcccggcgcggcctgtgt

SEQ ID NO: 570375 - DNA, 20 bp, mouse
gctcgcgcgggccacaatcg

SEQ ID NO: 570376 - DNA, 20 bp, mouse
gcgagtggtggccgaacctg

SEQ ID NO: 570377 - DNA, 20 bp, mouse
gttccggtgcgagtgacgag

SEQ ID NO: 570378 - DNA, 20 bp, mouse
gcggtgcgagtgacgagtgg

SEQ ID NO: 570379 - DNA, 20 bp, mouse
gggcgccaggggctgagtca

SEQ ID NO: 570380 - DNA, 20 bp, mouse
gagcaggggactcttaggca

SEQ ID NO: 570381 - DNA, 20 bp, mouse
gcccggctaggaagacacca

SEQ ID NO: 570382 - DNA, 20 bp, mouse
gccctgctgtaccccaggtt

SEQ ID NO: 570383 - DNA, 20 bp, mouse
ggagtcccctgctgtacccc

SEQ ID NO: 570384 - DNA, 20 bp, mouse
gcagggaccatggcggacgg

SEQ ID NO: 570385 - DNA, 20 bp, mouse
gcactgcctgagtggatgag

SEQ ID NO: 570386 - DNA, 20 bp, mouse
gcagtcagaaccggcaggga

SEQ ID NO: 570387 - DNA, 20 bp, mouse
ggactctgctgtaagaaggc

SEQ ID NO: 570388 - DNA, 20 bp, mouse
gtaagcagtcagaaccggca

SEQ ID NO: 570389 - DNA, 20 bp, mouse
ggcgggagggagaggactgt

SEQ ID NO: 570390 - DNA, 20 bp, mouse
gccaggggctctgatcagtc

SEQ ID NO: 570391 - DNA, 20 bp, mouse
gtgatcagtccggagggtca

SEQ ID NO: 570392 - DNA, 20 bp, mouse
gcagctctctgcaatcatga

SEQ ID NO: 570393 - DNA, 20 bp, mouse
ggggctctgatcagtccgga

SEQ ID NO: 570394 - DNA, 20 bp, mouse
gctggtaaggctggaacgca

SEQ ID NO: 570395 - DNA, 20 bp, mouse
gttccgtgcgccatccctgc

SEQ ID NO: 570396 - DNA, 20 bp, mouse
gaggacctggctcggagaac

SEQ ID NO: 570397 - DNA, 20 bp, mouse
gcctgggcgactcttttgaa

SEQ ID NO: 570398 - DNA, 20 bp, mouse
gaggcgggcctgggacgtcc

SEQ ID NO: 570399 - DNA, 20 bp, mouse
gaaccctgccggacacccgg

SEQ ID NO: 570400 - DNA, 20 bp, mouse
gcagcgcctcacactcaaca

SEQ ID NO: 570401 - DNA, 20 bp, mouse
gtgagggaagaaaggaccaa

SEQ ID NO: 570402 - DNA, 20 bp, mouse
gatcaggccccggactccac

SEQ ID NO: 570403 - DNA, 20 bp, mouse
gactcaacaaggacctggct

SEQ ID NO: 570404 - DNA, 20 bp, mouse
gcgtcgccacaaggccaggt

SEQ ID NO: 570405 - DNA, 20 bp, mouse
gtctgcagagaagtacttcc

SEQ ID NO: 570406 - DNA, 20 bp, mouse
gagcaggccggcagtagtgg

SEQ ID NO: 570407 - DNA, 20 bp, mouse
gccggcagtagtggcggaga

SEQ ID NO: 570408 - DNA, 20 bp, mouse
gcctccgcgacaacccccag

SEQ ID NO: 570409 - DNA, 20 bp, mouse
gaccggggagactcaggatg

SEQ ID NO: 570410 - DNA, 20 bp, mouse
gcgtggccttctgggaaaag

SEQ ID NO: 570411 - DNA, 20 bp, mouse
ggcgcggacgagaagtcgag

SEQ ID NO: 570412 - DNA, 20 bp, mouse
gcccggtgcggtgggcagta

SEQ ID NO: 570413 - DNA, 20 bp, mouse
gcgggcagggtataaagaaa

SEQ ID NO: 570414 - DNA, 20 bp, mouse
ggcgccgctgggggttgtcg

SEQ ID NO: 570415 - DNA, 20 bp, mouse
gagcccaaggcctcctcctc

SEQ ID NO: 570416 - DNA, 20 bp, mouse
gaccagcgcgggctcgcgtc

SEQ ID NO: 570417 - DNA, 20 bp, mouse
gcagctgctcggtcatcgtg

SEQ ID NO: 570418 - DNA, 20 bp, mouse
gcgggcctgcacaccagcgc

SEQ ID NO: 570419 - DNA, 20 bp, mouse
gagaagccccagcgccggga

SEQ ID NO: 570420 - DNA, 20 bp, mouse
ggctgggagcggctccacgg

SEQ ID NO: 570421 - DNA, 20 bp, mouse
ggtaggtggaggctacgcag

SEQ ID NO: 570422 - DNA, 20 bp, mouse
gtgaccgaaggaaccaaggt

SEQ ID NO: 570423 - DNA, 20 bp, mouse
ggttcttgttcccctcccgg

SEQ ID NO: 570424 - DNA, 20 bp, mouse
gtagtccggggaccgaagca

SEQ ID NO: 570425 - DNA, 20 bp, mouse
gggtacgggagcccacgtcg

SEQ ID NO: 570426 - DNA, 20 bp, mouse
ggaaggaggcaagatggtgt

SEQ ID NO: 570427 - DNA, 20 bp, mouse
ggttggagagcactatggtt

SEQ ID NO: 570428 - DNA, 20 bp, mouse
gtcccggagccggtccgcag

SEQ ID NO: 570429 - DNA, 20 bp, mouse
gcctgggccgggatgactca

SEQ ID NO: 570430 - DNA, 20 bp, mouse
gtggtgaggagcttcggacg

SEQ ID NO: 570431 - DNA, 20 bp, mouse
gcctccttccctctgcggac

SEQ ID NO: 570432 - DNA, 20 bp, mouse
gacttggaggcgagtggagg

SEQ ID NO: 570433 - DNA, 20 bp, mouse
gagcttcggacgtggctggg

SEQ ID NO: 570434 - DNA, 20 bp, mouse
gatgggagacctgaaattca

SEQ ID NO: 570435 - DNA, 20 bp, mouse
gccctctgcggaccggctcc

SEQ ID NO: 570436 - DNA, 20 bp, mouse
gggcgggcagacgggagcca

SEQ ID NO: 570437 - DNA, 20 bp, mouse
gctctgggaacctagtaggt

SEQ ID NO: 570438 - DNA, 20 bp, mouse
gagtaggtgggcgggcagac

SEQ ID NO: 570439 - DNA, 20 bp, mouse
gggcgctctgggaacctagt

SEQ ID NO: 570440 - DNA, 20 bp, mouse
ggctgtgtcgctcctgcggg

SEQ ID NO: 570441 - DNA, 20 bp, mouse
ggggaacctagtaggtgggc

SEQ ID NO: 570442 - DNA, 20 bp, mouse
ggtgtcgctcctgcgggagg

SEQ ID NO: 570443 - DNA, 20 bp, mouse
ggagcttcgcgagcaggcgg

SEQ ID NO: 570444 - DNA, 20 bp, mouse
gaggagaaccgtcaagaccc

SEQ ID NO: 570445 - DNA, 20 bp, mouse
gaagcaaggagaacagcggg

SEQ ID NO: 570446 - DNA, 20 bp, mouse
gcacagccctgggccaccag

SEQ ID NO: 570447 - DNA, 20 bp, mouse
gatggctacagcacaggagc

SEQ ID NO: 570448 - DNA, 20 bp, mouse
gagcggcatggctacagcac

SEQ ID NO: 570449 - DNA, 20 bp, mouse
gccagcgagcgccgagtcag

SEQ ID NO: 570450 - DNA, 20 bp, mouse
ggccgtccgggaaaacagtg

SEQ ID NO: 570451 - DNA, 20 bp, mouse
gggtccaggaggcctcccta

SEQ ID NO: 570452 - DNA, 20 bp, mouse
gggcttcatggagaccccta

SEQ ID NO: 570453 - DNA, 20 bp, mouse
gtgcgcaggtcggggttctt

SEQ ID NO: 570454 - DNA, 20 bp, mouse
gcttcttctaggttttctag

SEQ ID NO: 570455 - DNA, 20 bp, mouse
gcaccccgaccgccccgcct

SEQ ID NO: 570456 - DNA, 20 bp, mouse
gcgcgacacagcccgaccac

SEQ ID NO: 570457 - DNA, 20 bp, mouse
gcacagcccgaccaccggcc

SEQ ID NO: 570458 - DNA, 20 bp, mouse
gccagcaaccgcagcgacac

SEQ ID NO: 570459 - DNA, 20 bp, mouse
gccttctgcaccgccagctc

SEQ ID NO: 570460 - DNA, 20 bp, mouse
gttgggacaagcgaccccag

SEQ ID NO: 570461 - DNA, 20 bp, mouse
gctggtgtttgcgggttgca

SEQ ID NO: 570462 - DNA, 20 bp, mouse
gggcgcgccgggcacaaacg

SEQ ID NO: 570463 - DNA, 20 bp, mouse
ggcggtcaaaccggaagggg

SEQ ID NO: 570464 - DNA, 20 bp, mouse
gagcggcggtcaaaccggaa

SEQ ID NO: 570465 - DNA, 20 bp, mouse
gcgcagggctgctgagtcac

SEQ ID NO: 570466 - DNA, 20 bp, mouse
ggggctgcgaagacaccccg

SEQ ID NO: 570467 - DNA, 20 bp, mouse
gccccgcgggaggagcgccg

SEQ ID NO: 570468 - DNA, 20 bp, mouse
ggacaccccgaggagagccg

SEQ ID NO: 570469 - DNA, 20 bp, mouse
ggctgcggcatgttcattaa

SEQ ID NO: 570470 - DNA, 20 bp, mouse
gagcgccgcggctctcctcg

SEQ ID NO: 570471 - DNA, 20 bp, mouse
gcggcatgttcattaagggt

SEQ ID NO: 570472 - DNA, 20 bp, mouse
gggtccggagctcgagacgg

SEQ ID NO: 570473 - DNA, 20 bp, mouse
gtcgctgccgtaagtcgggt

SEQ ID NO: 570474 - DNA, 20 bp, mouse
gcggaagatggcggccacag

SEQ ID NO: 570475 - DNA, 20 bp, mouse
ggccgcatcacggaagatgg

SEQ ID NO: 570476 - DNA, 20 bp, mouse
ggcttgaggtccgcgatgtc

SEQ ID NO: 570477 - DNA, 20 bp, mouse
ggcggccgcacgggcctcgg

SEQ ID NO: 570478 - DNA, 20 bp, mouse
ggggtgaagacgttccgcac

SEQ ID NO: 570479 - DNA, 20 bp, mouse
gcaccgggcagagtcctccg

SEQ ID NO: 570480 - DNA, 20 bp, mouse
ggagtcctccgaggcccgtg

SEQ ID NO: 570481 - DNA, 20 bp, mouse
gccaagcagtgtcctagagg

SEQ ID NO: 570482 - DNA, 20 bp, mouse
ggacctcaagctagagttct

SEQ ID NO: 570483 - DNA, 20 bp, mouse
gggacccgtagcctcagcct

SEQ ID NO: 570484 - DNA, 20 bp, mouse
gcgcagcaaagaccccctct

SEQ ID NO: 570485 - DNA, 20 bp, mouse
gaacccagaactctagcttg

SEQ ID NO: 570486 - DNA, 20 bp, mouse
ggcgccgcacgaggaacctg

SEQ ID NO: 570487 - DNA, 20 bp, mouse
gccgcacgaggaacctgggg

SEQ ID NO: 570488 - DNA, 20 bp, mouse
ggtgcttctggcagtagcta

SEQ ID NO: 570489 - DNA, 20 bp, mouse
gtccgagggaaagtctgagg

SEQ ID NO: 570490 - DNA, 20 bp, mouse
gaaacccaggaaggccgtgc

SEQ ID NO: 570491 - DNA, 20 bp, mouse
gaaacctgcacggccttcct

SEQ ID NO: 570492 - DNA, 20 bp, mouse
ggggagtagaggctttagag

SEQ ID NO: 570493 - DNA, 20 bp, mouse
gctagggcaagtccctctca

SEQ ID NO: 570494 - DNA, 20 bp, mouse
gacccccactcaggtgaggg

SEQ ID NO: 570495 - DNA, 20 bp, mouse
gctggccctagcagaagcag

SEQ ID NO: 570496 - DNA, 20 bp, mouse
gagagtgaaagcgaaagctg

SEQ ID NO: 570497 - DNA, 20 bp, mouse
gaagctggggctgctagccc

SEQ ID NO: 570498 - DNA, 20 bp, mouse
gcttggcagctctcgagcct

SEQ ID NO: 570499 - DNA, 20 bp, mouse
gatcatcaggggctgtccaa

SEQ ID NO: 570500 - DNA, 20 bp, mouse
ggcctgctcagtgcacagat

SEQ ID NO: 570501 - DNA, 20 bp, mouse
gggaggagctaggaaagcgt

SEQ ID NO: 570502 - DNA, 20 bp, mouse
gagctagttgccactaggaa

SEQ ID NO: 570503 - DNA, 20 bp, mouse
gtagctgggaatggctgagg

SEQ ID NO: 570504 - DNA, 20 bp, mouse
gccactaggaagggcggtgt

SEQ ID NO: 570505 - DNA, 20 bp, mouse
gccttgcgagcgaactccac

SEQ ID NO: 570506 - DNA, 20 bp, mouse
gcttaaagaaatacaggacg

SEQ ID NO: 570507 - DNA, 20 bp, mouse
gggagaagcccgaaaacagg

SEQ ID NO: 570508 - DNA, 20 bp, mouse
gccacccaaggatgacgaga

SEQ ID NO: 570509 - DNA, 20 bp, mouse
gctgagtcagctcttgcagg

SEQ ID NO: 570510 - DNA, 20 bp, mouse
ggtttccatctcgtcatcct

SEQ ID NO: 570511 - DNA, 20 bp, mouse
ggtgcattctggtaatcacg

SEQ ID NO: 570512 - DNA, 20 bp, mouse
ggaagacatccacctgtttt

SEQ ID NO: 570513 - DNA, 20 bp, mouse
gagaaggaagtccctaagtg

SEQ ID NO: 570514 - DNA, 20 bp, mouse
gctcgagagctgccaagtgg

SEQ ID NO: 570515 - DNA, 20 bp, mouse
gtggtagaggaccttaagaa

SEQ ID NO: 570516 - DNA, 20 bp, mouse
gtgagcggcgaaagccggga

SEQ ID NO: 570517 - DNA, 20 bp, mouse
gccggccggcacggagggag

SEQ ID NO: 570518 - DNA, 20 bp, mouse
ggagcacctccggcacccag

SEQ ID NO: 570519 - DNA, 20 bp, mouse
gggtggccggccggcacgga

SEQ ID NO: 570520 - DNA, 20 bp, mouse
ggaagtgaagctcaaggtag

SEQ ID NO: 570521 - DNA, 20 bp, mouse
ggatcaggaagtgaagctca

SEQ ID NO: 570522 - DNA, 20 bp, mouse
ggcggtgagcaagccagcga

SEQ ID NO: 570523 - DNA, 20 bp, mouse
gacgcaacttccggcgtgag

SEQ ID NO: 570524 - DNA, 20 bp, mouse
gccggagcccagagcacctc

SEQ ID NO: 570525 - DNA, 20 bp, mouse
gcattggagaggaccgtata

SEQ ID NO: 570526 - DNA, 20 bp, mouse
gcgtcaccagaagagccgga

SEQ ID NO: 570527 - DNA, 20 bp, mouse
gtgctcggcccggacccctc

SEQ ID NO: 570528 - DNA, 20 bp, mouse
gggttcgttggcggtggcag

SEQ ID NO: 570529 - DNA, 20 bp, mouse
gagaagagccggaggggtcc

SEQ ID NO: 570530 - DNA, 20 bp, mouse
gcgcgcggcacccggttcgt

SEQ ID NO: 570531 - DNA, 20 bp, mouse
ggcggcacccggttcgttgg

SEQ ID NO: 570532 - DNA, 20 bp, mouse
gcgcgctgctggaccccgcg

SEQ ID NO: 570533 - DNA, 20 bp, mouse
gggcggccccgggctaatgg

SEQ ID NO: 570534 - DNA, 20 bp, mouse
ggccgcccgccaggctcggg

SEQ ID NO: 570535 - DNA, 20 bp, mouse
ggctaatggaggctccggag

SEQ ID NO: 570536 - DNA, 20 bp, mouse
gacagagccgaaagcgaagg

SEQ ID NO: 570537 - DNA, 20 bp, mouse
gagagaagcgggaccgcgag

SEQ ID NO: 570538 - DNA, 20 bp, mouse
gccgctccgcctaagagaag

SEQ ID NO: 570539 - DNA, 20 bp, mouse
gtgtagcacggagtattcta

SEQ ID NO: 570540 - DNA, 20 bp, mouse
gcggacagagccgaaagcga

SEQ ID NO: 570541 - DNA, 20 bp, mouse
gcaccaggcgcgctaaagtg

SEQ ID NO: 570542 - DNA, 20 bp, mouse
gcggtcccgcttctcttagg

SEQ ID NO: 570543 - DNA, 20 bp, mouse
ggggcagctcatggatggag

SEQ ID NO: 570544 - DNA, 20 bp, mouse
gaagcgaaggcggcatcaaa

SEQ ID NO: 570545 - DNA, 20 bp, mouse
gaccaggtacgcgggtggag

SEQ ID NO: 570546 - DNA, 20 bp, mouse
ggcgcggagctgagggacca

SEQ ID NO: 570547 - DNA, 20 bp, mouse
gaccacctcgccaaagaacg

SEQ ID NO: 570548 - DNA, 20 bp, mouse
ggaaggcgccgtgcagagct

SEQ ID NO: 570549 - DNA, 20 bp, mouse
gccatggctgccacgttctt

SEQ ID NO: 570550 - DNA, 20 bp, mouse
gttctttggcgaggtggtga

SEQ ID NO: 570551 - DNA, 20 bp, mouse
gtctggccgcgcggagctga

SEQ ID NO: 570552 - DNA, 20 bp, mouse
gcggcgtgacctaaagtgca

SEQ ID NO: 570553 - DNA, 20 bp, mouse
gcctaatcggaaactcgtag

SEQ ID NO: 570554 - DNA, 20 bp, mouse
ggccacgttctttggcgagg

SEQ ID NO: 570555 - DNA, 20 bp, mouse
ggaaggctgcgagcgtcagg

SEQ ID NO: 570556 - DNA, 20 bp, mouse
ggccttctgtcccaaggagg

SEQ ID NO: 570557 - DNA, 20 bp, mouse
gggaggtggcctcgctatcc

SEQ ID NO: 570558 - DNA, 20 bp, mouse
gtagcagacaggccttgata

SEQ ID NO: 570559 - DNA, 20 bp, mouse
ggaacgaacatgactgcagt

SEQ ID NO: 570560 - DNA, 20 bp, mouse
gagcgcccgccgggatagcg

SEQ ID NO: 570561 - DNA, 20 bp, mouse
gtgcgccttctgtcccaagg

SEQ ID NO: 570562 - DNA, 20 bp, mouse
ggtggcctcgctatcccggc

SEQ ID NO: 570563 - DNA, 20 bp, mouse
gaacatgactgcagtgggcg

SEQ ID NO: 570564 - DNA, 20 bp, mouse
gcaggacccgaaggacccga

SEQ ID NO: 570565 - DNA, 20 bp, mouse
ggagcagcttgagcgcccgc

SEQ ID NO: 570566 - DNA, 20 bp, mouse
gcaccagcagcgccagaaag

SEQ ID NO: 570567 - DNA, 20 bp, mouse
gcagttgggaccgaaaccct

SEQ ID NO: 570568 - DNA, 20 bp, mouse
ggcgccagaaagcggtttca

SEQ ID NO: 570569 - DNA, 20 bp, mouse
gggtgagcgctggttgccga

SEQ ID NO: 570570 - DNA, 20 bp, mouse
ggcggtcatcgcaagcagtg

SEQ ID NO: 570571 - DNA, 20 bp, mouse
gcattccaagctgcacgtgg

SEQ ID NO: 570572 - DNA, 20 bp, mouse
ggtcatcgcaagcagtgcgg

SEQ ID NO: 570573 - DNA, 20 bp, mouse
ggaccttaggcccaacggac

SEQ ID NO: 570574 - DNA, 20 bp, mouse
ggacggcgcaggactgggga

SEQ ID NO: 570575 - DNA, 20 bp, mouse
ggctcaccggggagccccga

SEQ ID NO: 570576 - DNA, 20 bp, mouse
ggggccacagcaccgagacc

SEQ ID NO: 570577 - DNA, 20 bp, mouse
gcacagcaccgagaccgggc

SEQ ID NO: 570578 - DNA, 20 bp, mouse
ggagagcgagctccgaaaag

SEQ ID NO: 570579 - DNA, 20 bp, mouse
ggagctcgctctctctggtc

SEQ ID NO: 570580 - DNA, 20 bp, mouse
gctcaggctggagtctccta

SEQ ID NO: 570581 - DNA, 20 bp, mouse
ggcccgcgcctgcccggtct

SEQ ID NO: 570582 - DNA, 20 bp, mouse
gcggcgttgctcccacccac

SEQ ID NO: 570583 - DNA, 20 bp, mouse
gcctcaaggtgaaggatctg

SEQ ID NO: 570584 - DNA, 20 bp, mouse
ggcagccgctacgtgagtgt

SEQ ID NO: 570585 - DNA, 20 bp, mouse
ggaggagtctcgggccgctg

SEQ ID NO: 570586 - DNA, 20 bp, mouse
ggacagccatgatgctcacc

SEQ ID NO: 570587 - DNA, 20 bp, mouse
gggcggggtgctccgagtct

SEQ ID NO: 570588 - DNA, 20 bp, mouse
gtctactggcccccaaggcg

SEQ ID NO: 570589 - DNA, 20 bp, mouse
gcgactcacctcctgcacac

SEQ ID NO: 570590 - DNA, 20 bp, mouse
gtcggagcaccccgccttgg

SEQ ID NO: 570591 - DNA, 20 bp, mouse
ggttctcaagcacctagact

SEQ ID NO: 570592 - DNA, 20 bp, mouse
ggagcatcatggctgtctac

SEQ ID NO: 570593 - DNA, 20 bp, mouse
gagaggaacgcagagcagaa

SEQ ID NO: 570594 - DNA, 20 bp, mouse
gcccctgagcttccccacta

SEQ ID NO: 570595 - DNA, 20 bp, mouse
gtgctcacctggaagctgct

SEQ ID NO: 570596 - DNA, 20 bp, mouse
gagcaaggaaagccaggtaa

SEQ ID NO: 570597 - DNA, 20 bp, mouse
gaggaaagccaggtaacgga

SEQ ID NO: 570598 - DNA, 20 bp, mouse
gcgcgggcgtgattgcgggg

SEQ ID NO: 570599 - DNA, 20 bp, mouse
gggtggccgaacgctcaaaa

SEQ ID NO: 570600 - DNA, 20 bp, mouse
gtctccggccgccgactcca

SEQ ID NO: 570601 - DNA, 20 bp, mouse
gctgcccacagacatcacgg

SEQ ID NO: 570602 - DNA, 20 bp, mouse
gactcagccctgggacacct

SEQ ID NO: 570603 - DNA, 20 bp, mouse
gcaggttacccacgaagagg

SEQ ID NO: 570604 - DNA, 20 bp, mouse
gtccctaggagtggactcta

SEQ ID NO: 570605 - DNA, 20 bp, mouse
ggcgtgattgcggggaggct

SEQ ID NO: 570606 - DNA, 20 bp, mouse
ggccgaaccgtgacgctggg

SEQ ID NO: 570607 - DNA, 20 bp, mouse
gtgggtgtgacaggaagcag

SEQ ID NO: 570608 - DNA, 20 bp, mouse
gcgctggggggcgagcacaa

SEQ ID NO: 570609 - DNA, 20 bp, mouse
ggatccagagtgccgatgac

SEQ ID NO: 570610 - DNA, 20 bp, mouse
gtgctcgccccccagcgtca

SEQ ID NO: 570611 - DNA, 20 bp, mouse
ggccccccagcgtcacggtt

SEQ ID NO: 570612 - DNA, 20 bp, mouse
gaaactggttctcccgtcat

SEQ ID NO: 570613 - DNA, 20 bp, mouse
gagagacaccctgcaactag

SEQ ID NO: 570614 - DNA, 20 bp, mouse
gatcggcactctggatctta

SEQ ID NO: 570615 - DNA, 20 bp, mouse
gtaaaacgaccagggtacag

SEQ ID NO: 570616 - DNA, 20 bp, mouse
gcagggacctgctgtcacaa

SEQ ID NO: 570617 - DNA, 20 bp, mouse
gaagatcaaggacccagccg

SEQ ID NO: 570618 - DNA, 20 bp, mouse
gtggagcctgaccctaccag

SEQ ID NO: 570619 - DNA, 20 bp, mouse
gcaaggtctctcggcatcca

SEQ ID NO: 570620 - DNA, 20 bp, mouse
gggacctggacgccccatca

SEQ ID NO: 570621 - DNA, 20 bp, mouse
gtcagggcaccaaggtctct

SEQ ID NO: 570622 - DNA, 20 bp, mouse
gcaaggacccagccgaggct

SEQ ID NO: 570623 - DNA, 20 bp, mouse
gttgcacccgagcctcggct

SEQ ID NO: 570624 - DNA, 20 bp, mouse
gtagggtcaggctccacagt

SEQ ID NO: 570625 - DNA, 20 bp, mouse
gtcagggtaagaattcctgg

SEQ ID NO: 570626 - DNA, 20 bp, mouse
gtagactgtgaagcgaggtg

SEQ ID NO: 570627 - DNA, 20 bp, mouse
ggagaggccagggcgcaagt

SEQ ID NO: 570628 - DNA, 20 bp, mouse
gctgcgtagactgtgaagcg

SEQ ID NO: 570629 - DNA, 20 bp, mouse
gggtgaagactgaccgactg

SEQ ID NO: 570630 - DNA, 20 bp, mouse
gccctcgggagccctttccc

SEQ ID NO: 570631 - DNA, 20 bp, mouse
gaggccagggcgcaagttgg

SEQ ID NO: 570632 - DNA, 20 bp, mouse
gagtccgttatattagggaa

SEQ ID NO: 570633 - DNA, 20 bp, mouse
ggagtcttgatggggcccta

SEQ ID NO: 570634 - DNA, 20 bp, mouse
ggaccgactgaggagaggcc

SEQ ID NO: 570635 - DNA, 20 bp, mouse
gtcagccagcataagcgagt

SEQ ID NO: 570636 - DNA, 20 bp, mouse
gagcaagggcatgaagaccg

SEQ ID NO: 570637 - DNA, 20 bp, mouse
ggtggggccactcgcagaga

SEQ ID NO: 570638 - DNA, 20 bp, mouse
gaagggcatgaagaccgcgg

SEQ ID NO: 570639 - DNA, 20 bp, mouse
gtttctggagactgcagcaa

SEQ ID NO: 570640 - DNA, 20 bp, mouse
gggacgcacagtcctagttt

SEQ ID NO: 570641 - DNA, 20 bp, mouse
gaagaccgcggcggctcgtg

SEQ ID NO: 570642 - DNA, 20 bp, mouse
gtaggactgtgcgtcctctg

SEQ ID NO: 570643 - DNA, 20 bp, mouse
gggctgtccgtctctgcgag

SEQ ID NO: 570644 - DNA, 20 bp, mouse
gcgcagtccgggagcgcaag

SEQ ID NO: 570645 - DNA, 20 bp, mouse
gagaggcagcacatcgtcgt

SEQ ID NO: 570646 - DNA, 20 bp, mouse
gtcgccagccccactgatgg

SEQ ID NO: 570647 - DNA, 20 bp, mouse
ggcgtcctcctccatcagtg

SEQ ID NO: 570648 - DNA, 20 bp, mouse
gtgcccagtgatggaagggt

SEQ ID NO: 570649 - DNA, 20 bp, mouse
gagccagaggcaactgccgg

SEQ ID NO: 570650 - DNA, 20 bp, mouse
ggccctgcccagtgatggaa

SEQ ID NO: 570651 - DNA, 20 bp, mouse
ggtggggctggcgagagcct

SEQ ID NO: 570652 - DNA, 20 bp, mouse
gcagaggcaactgccggagg

SEQ ID NO: 570653 - DNA, 20 bp, mouse
gctgggccatcatcctccaa

SEQ ID NO: 570654 - DNA, 20 bp, mouse
ggccgtctgaaacgctcaga

SEQ ID NO: 570655 - DNA, 20 bp, mouse
ggagcctaggctggaaatcg

SEQ ID NO: 570656 - DNA, 20 bp, mouse
gacagcgggaggacagcggg

SEQ ID NO: 570657 - DNA, 20 bp, mouse
gggactctcgggacagagag

SEQ ID NO: 570658 - DNA, 20 bp, mouse
gccgagagctcagactgtca

SEQ ID NO: 570659 - DNA, 20 bp, mouse
gcggacagcgggaggacagc

SEQ ID NO: 570660 - DNA, 20 bp, mouse
gcggcttcccggggtgacag

SEQ ID NO: 570661 - DNA, 20 bp, mouse
gggctgaggacggcggacag

SEQ ID NO: 570662 - DNA, 20 bp, mouse
gcacgccggagcgagccctg

SEQ ID NO: 570663 - DNA, 20 bp, mouse
gctccggggagcggactctc

SEQ ID NO: 570664 - DNA, 20 bp, mouse
ggctgggagcggaggacgga

SEQ ID NO: 570665 - DNA, 20 bp, mouse
ggctcagactgtcagggcca

SEQ ID NO: 570666 - DNA, 20 bp, mouse
gttgccaggccacaacacag

SEQ ID NO: 570667 - DNA, 20 bp, mouse
gtgggaccctccttacctgt

SEQ ID NO: 570668 - DNA, 20 bp, mouse
gagaggctcgagctgaggct

SEQ ID NO: 570669 - DNA, 20 bp, mouse
gtcgagctgaggcttggacc

SEQ ID NO: 570670 - DNA, 20 bp, mouse
gtcctgaggagacctgtgta

SEQ ID NO: 570671 - DNA, 20 bp, mouse
gtgagctcctcctacaggta

SEQ ID NO: 570672 - DNA, 20 bp, mouse
ggtaaggagggtcccagccc

SEQ ID NO: 570673 - DNA, 20 bp, mouse
ggaccctccttacctgtagg

SEQ ID NO: 570674 - DNA, 20 bp, mouse
gctcctcctacaggtaagga

SEQ ID NO: 570675 - DNA, 20 bp, mouse
ggttctcctttgcccagcca

SEQ ID NO: 570676 - DNA, 20 bp, mouse
ggagtcgaacgaggaggtgg

SEQ ID NO: 570677 - DNA, 20 bp, mouse
ggccgagtcgaacgaggagg

SEQ ID NO: 570678 - DNA, 20 bp, mouse
gatggccgagtcgaacgagg

SEQ ID NO: 570679 - DNA, 20 bp, mouse
gaacatggccgagtcgaacg

SEQ ID NO: 570680 - DNA, 20 bp, mouse
ggaggcgcgcccgatcgcgg

SEQ ID NO: 570681 - DNA, 20 bp, mouse
gccggaggcgcgcccgatcg

SEQ ID NO: 570682 - DNA, 20 bp, mouse
gatcgcggcggccgccaaca

SEQ ID NO: 570683 - DNA, 20 bp, mouse
ggcccacgcgcgcttccgac

SEQ ID NO: 570684 - DNA, 20 bp, mouse
gctggtgcagagggtggtga

SEQ ID NO: 570685 - DNA, 20 bp, mouse
gttcgactcggccatgttgg

SEQ ID NO: 570686 - DNA, 20 bp, mouse
gggcaggacttacccgtcca

SEQ ID NO: 570687 - DNA, 20 bp, mouse
gggcacacggaagagacccg

SEQ ID NO: 570688 - DNA, 20 bp, mouse
gagcgatggctgggacggag

SEQ ID NO: 570689 - DNA, 20 bp, mouse
gtcttccgtgtgccatggac

SEQ ID NO: 570690 - DNA, 20 bp, mouse
gggaagagacccgcggggaa

SEQ ID NO: 570691 - DNA, 20 bp, mouse
gcttacccgtccatggcaca

SEQ ID NO: 570692 - DNA, 20 bp, mouse
ggacggagtggtgagcggag

SEQ ID NO: 570693 - DNA, 20 bp, mouse
ggcctccgctccgttccccg

SEQ ID NO: 570694 - DNA, 20 bp, mouse
gatagcagaaaccgacccaa

SEQ ID NO: 570695 - DNA, 20 bp, mouse
ggagcggcgtgcgaggggcg

SEQ ID NO: 570696 - DNA, 20 bp, mouse
gagccagcgagccacacaag

SEQ ID NO: 570697 - DNA, 20 bp, mouse
gggttcggcaatggacgggt

SEQ ID NO: 570698 - DNA, 20 bp, mouse
gcgggagcccgtgaggagat

SEQ ID NO: 570699 - DNA, 20 bp, mouse
gttgggagcgaagctttgtc

SEQ ID NO: 570700 - DNA, 20 bp, mouse
gacaagcggcgagaaaatgg

SEQ ID NO: 570701 - DNA, 20 bp, mouse
gttcgagccggtagccggag

SEQ ID NO: 570702 - DNA, 20 bp, mouse
ggagcggccgagggaagccc

SEQ ID NO: 570703 - DNA, 20 bp, mouse
gcacacaagcggcgagaaaa

SEQ ID NO: 570704 - DNA, 20 bp, mouse
gtgtccggttcggcaatgga

SEQ ID NO: 570705 - DNA, 20 bp, mouse
gccgagggaagcccggggag

SEQ ID NO: 570706 - DNA, 20 bp, mouse
ggctccgggaaaccagcgag

SEQ ID NO: 570707 - DNA, 20 bp, mouse
gcgcagctccggccggtcag

SEQ ID NO: 570708 - DNA, 20 bp, mouse
gcgcgggcggagaaagcggg

SEQ ID NO: 570709 - DNA, 20 bp, mouse
gccggccggtcagaggtgga

SEQ ID NO: 570710 - DNA, 20 bp, mouse
gcaccgcgggcggagaaagc

SEQ ID NO: 570711 - DNA, 20 bp, mouse
ggaaggaagagtgggaaaca

SEQ ID NO: 570712 - DNA, 20 bp, mouse
ggcgttgtgcggggattgac

SEQ ID NO: 570713 - DNA, 20 bp, mouse
gacgccggctagcggaggag

SEQ ID NO: 570714 - DNA, 20 bp, mouse
ggcgcaggaagcggagaccg

SEQ ID NO: 570715 - DNA, 20 bp, mouse
gcaggaagcggagaccgcgg

SEQ ID NO: 570716 - DNA, 20 bp, mouse
ggagacgtcctcagagtcga

SEQ ID NO: 570717 - DNA, 20 bp, mouse
gcctcagagtcgagggaccg

SEQ ID NO: 570718 - DNA, 20 bp, mouse
gtctgaggacgtctcactag

SEQ ID NO: 570719 - DNA, 20 bp, mouse
gctgccctcagcacagacta

SEQ ID NO: 570720 - DNA, 20 bp, mouse
gagggcaggaacgctgtctc

SEQ ID NO: 570721 - DNA, 20 bp, mouse
gaacgctgtctctggagccg

SEQ ID NO: 570722 - DNA, 20 bp, mouse
gtcactctgagcgttctaag

SEQ ID NO: 570723 - DNA, 20 bp, mouse
gtctccgtagtctgtgctga

SEQ ID NO: 570724 - DNA, 20 bp, mouse
gcccactaactggcaagtgg

SEQ ID NO: 570725 - DNA, 20 bp, mouse
gggaagcaaggggcgaccta

SEQ ID NO: 570726 - DNA, 20 bp, mouse
gagcccggcccggaacaaca

SEQ ID NO: 570727 - DNA, 20 bp, mouse
gcgggatgcagcgaaggacg

SEQ ID NO: 570728 - DNA, 20 bp, mouse
ggcacccgcaggcgttccag

SEQ ID NO: 570729 - DNA, 20 bp, mouse
gtcaccccgggatgcagcga

SEQ ID NO: 570730 - DNA, 20 bp, mouse
gcgaaggacgcggcacccgc

SEQ ID NO: 570731 - DNA, 20 bp, mouse
gagcctgagcccgtcacccc

SEQ ID NO: 570732 - DNA, 20 bp, mouse
gcgtacctccgagagtgcag

SEQ ID NO: 570733 - DNA, 20 bp, mouse
gtcggcccctggaacgcctg

SEQ ID NO: 570734 - DNA, 20 bp, mouse
gcagatggtgcagcccggcc

SEQ ID NO: 570735 - DNA, 20 bp, mouse
gagagtgcagcggcagcagg

SEQ ID NO: 570736 - DNA, 20 bp, mouse
gcccgctgcgaaaggacagg

SEQ ID NO: 570737 - DNA, 20 bp, mouse
gaagcccgctgcgaaaggac

SEQ ID NO: 570738 - DNA, 20 bp, mouse
gaagagtccaaagatggcgg

SEQ ID NO: 570739 - DNA, 20 bp, mouse
gcttgctgcagaccactcgg

SEQ ID NO: 570740 - DNA, 20 bp, mouse
gccctctcaagggtaacacg

SEQ ID NO: 570741 - DNA, 20 bp, mouse
ggccgcctgtcctttcgcag

SEQ ID NO: 570742 - DNA, 20 bp, mouse
gaagacaagcccgctgcgaa

SEQ ID NO: 570743 - DNA, 20 bp, mouse
gcacacacccgtcccccgag

SEQ ID NO: 570744 - DNA, 20 bp, mouse
ggactcttcgcggagcacgt

SEQ ID NO: 570745 - DNA, 20 bp, mouse
gtcgaggcccggccctctca

SEQ ID NO: 570746 - DNA, 20 bp, mouse
ggcactccgccgaaagcctg

SEQ ID NO: 570747 - DNA, 20 bp, mouse
gggccgccgcaggctttcgg

SEQ ID NO: 570748 - DNA, 20 bp, mouse
gacggaaagtgtaaaaaccc

SEQ ID NO: 570749 - DNA, 20 bp, mouse
gctttcggcggagtgcggcg

SEQ ID NO: 570750 - DNA, 20 bp, mouse
ggggaaaagagaaggcgaca

SEQ ID NO: 570751 - DNA, 20 bp, mouse
ggccacgcagcaccagccaa

SEQ ID NO: 570752 - DNA, 20 bp, mouse
gagacgaagacgaagacggg

SEQ ID NO: 570753 - DNA, 20 bp, mouse
gccgcggcgacagggcctgg

SEQ ID NO: 570754 - DNA, 20 bp, mouse
gaggggcgtccccggagaca

SEQ ID NO: 570755 - DNA, 20 bp, mouse
gggctccggggtgcagaata

SEQ ID NO: 570756 - DNA, 20 bp, mouse
gcaaagagggctccgcgtgt

SEQ ID NO: 570757 - DNA, 20 bp, mouse
ggtgggctgtggtccaaaga

SEQ ID NO: 570758 - DNA, 20 bp, mouse
gcaagccccgctggatctgt

SEQ ID NO: 570759 - DNA, 20 bp, mouse
gagtcgggtccacccacacg

SEQ ID NO: 570760 - DNA, 20 bp, mouse
gagagggctccgcgtgtggg

SEQ ID NO: 570761 - DNA, 20 bp, mouse
ggatctcgggaagcaccagg

SEQ ID NO: 570762 - DNA, 20 bp, mouse
gaggtgcttcgcagccagtc

SEQ ID NO: 570763 - DNA, 20 bp, mouse
gggtggcgactgtggatctc

SEQ ID NO: 570764 - DNA, 20 bp, mouse
gaaggcgccaagctagccta

SEQ ID NO: 570765 - DNA, 20 bp, mouse
gatcctcaggtgaagccggg

SEQ ID NO: 570766 - DNA, 20 bp, mouse
gggatccccgaagccaacga

SEQ ID NO: 570767 - DNA, 20 bp, mouse
gcccgaagccaacgacggga

SEQ ID NO: 570768 - DNA, 20 bp, mouse
ggcctcgggagggacccctc

SEQ ID NO: 570769 - DNA, 20 bp, mouse
ggggatggcgcggagagcgg

SEQ ID NO: 570770 - DNA, 20 bp, mouse
gcggaggccgccaagctggg

SEQ ID NO: 570771 - DNA, 20 bp, mouse
gagccaacgacgggatggcg

SEQ ID NO: 570772 - DNA, 20 bp, mouse
gctccgcgccatcccgtcgt

SEQ ID NO: 570773 - DNA, 20 bp, mouse
gccactgcccgggacactag

SEQ ID NO: 570774 - DNA, 20 bp, mouse
ggacgggatggcgcggagag

SEQ ID NO: 570775 - DNA, 20 bp, mouse
gcgcgccagcctggaacacg

SEQ ID NO: 570776 - DNA, 20 bp, mouse
gcagtcccgatggcgcccag

SEQ ID NO: 570777 - DNA, 20 bp, mouse
ggacgtagttgtcacggacc

SEQ ID NO: 570778 - DNA, 20 bp, mouse
ggtagttgtcacggacctgg

SEQ ID NO: 570779 - DNA, 20 bp, mouse
ggctggggacgtagttgtca

SEQ ID NO: 570780 - DNA, 20 bp, mouse
gcggtctgctcgccagcgag

SEQ ID NO: 570781 - DNA, 20 bp, mouse
ggccagcgagcggagcttgg

SEQ ID NO: 570782 - DNA, 20 bp, mouse
ggccgagctaggctgataca

SEQ ID NO: 570783 - DNA, 20 bp, mouse
ggttgtcacggacctggcgg

SEQ ID NO: 570784 - DNA, 20 bp, mouse
ggatgcgctactctggagag

SEQ ID NO: 570785 - DNA, 20 bp, mouse
ggcagtctcactcacctcgc

SEQ ID NO: 570786 - DNA, 20 bp, mouse
gtccaaggtggcgcccggag

SEQ ID NO: 570787 - DNA, 20 bp, mouse
gtcctctccgggcgccacct

SEQ ID NO: 570788 - DNA, 20 bp, mouse
ggttgcccacagctgttcag

SEQ ID NO: 570789 - DNA, 20 bp, mouse
gtccaaggtggagctcggag

SEQ ID NO: 570790 - DNA, 20 bp, mouse
ggaggtgcctcctgacccag

SEQ ID NO: 570791 - DNA, 20 bp, mouse
ggcctctccgagctccacct

SEQ ID NO: 570792 - DNA, 20 bp, mouse
ggcggtggcaagcgctccag

SEQ ID NO: 570793 - DNA, 20 bp, mouse
gttgccaccgctgggtcagg

SEQ ID NO: 570794 - DNA, 20 bp, mouse
gtggtgtggcagcgacgcgg

SEQ ID NO: 570795 - DNA, 20 bp, mouse
gtagggcccgcctcatcaag

SEQ ID NO: 570796 - DNA, 20 bp, mouse
gaatgaatgggagacgtaaa

SEQ ID NO: 570797 - DNA, 20 bp, mouse
ggggccatcagaacctagga

SEQ ID NO: 570798 - DNA, 20 bp, mouse
ggctccacgcctcctccagg

SEQ ID NO: 570799 - DNA, 20 bp, mouse
gcgtggagccactccctcct

SEQ ID NO: 570800 - DNA, 20 bp, mouse
gtgctggcccattggagcag

SEQ ID NO: 570801 - DNA, 20 bp, mouse
gctgatggcccctgctccaa

SEQ ID NO: 570802 - DNA, 20 bp, mouse
gtgggagacgtaaagggtga

SEQ ID NO: 570803 - DNA, 20 bp, mouse
gctccagcgagggaagccgg

SEQ ID NO: 570804 - DNA, 20 bp, mouse
ggaaggcgctgctggcccat

SEQ ID NO: 570805 - DNA, 20 bp, mouse
gcattccagcccggaggaca

SEQ ID NO: 570806 - DNA, 20 bp, mouse
gggtcggtacctaaaccttg

SEQ ID NO: 570807 - DNA, 20 bp, mouse
gcggcgacgttgccaccaca

SEQ ID NO: 570808 - DNA, 20 bp, mouse
gaggttcgggctcgatcggt

SEQ ID NO: 570809 - DNA, 20 bp, mouse
gtatcggtgacccggagagg

SEQ ID NO: 570810 - DNA, 20 bp, mouse
gtaaggccccgaggatgtcc

SEQ ID NO: 570811 - DNA, 20 bp, mouse
ggaggaggttcgggctcgat

SEQ ID NO: 570812 - DNA, 20 bp, mouse
gtcgccggcttgcgaagcta

SEQ ID NO: 570813 - DNA, 20 bp, mouse
gtgaagctgatgaacaagcc

SEQ ID NO: 570814 - DNA, 20 bp, mouse
gccggcaccgccccccacgt

SEQ ID NO: 570815 - DNA, 20 bp, mouse
ggcttcagactaaggccccg

SEQ ID NO: 570816 - DNA, 20 bp, mouse
gccggcctgcgcagcccagt

SEQ ID NO: 570817 - DNA, 20 bp, mouse
gccagtaggctgcaggcggt

SEQ ID NO: 570818 - DNA, 20 bp, mouse
gggccgggcgccatgcggag

SEQ ID NO: 570819 - DNA, 20 bp, mouse
gcggccccgccccactcccg

SEQ ID NO: 570820 - DNA, 20 bp, mouse
ggtcgcagtgctgcccggcg

SEQ ID NO: 570821 - DNA, 20 bp, mouse
gactcccgcggagaccccgc

SEQ ID NO: 570822 - DNA, 20 bp, mouse
gctgcccggcggggtctccg

SEQ ID NO: 570823 - DNA, 20 bp, mouse
gtgagggtctccccgcgtcg

SEQ ID NO: 570824 - DNA, 20 bp, mouse
gtgcggcggcccttgagcag

SEQ ID NO: 570825 - DNA, 20 bp, mouse
gggtctccgcgggagtgggg

SEQ ID NO: 570826 - DNA, 20 bp, mouse
ggccgggcctggcctcacag

SEQ ID NO: 570827 - DNA, 20 bp, mouse
gcatggctgcagcttccgag

SEQ ID NO: 570828 - DNA, 20 bp, mouse
gcagcttcggagagagacgg

SEQ ID NO: 570829 - DNA, 20 bp, mouse
gaactctcaaacttccatca

SEQ ID NO: 570830 - DNA, 20 bp, mouse
ggttagaacagacgacgagg

SEQ ID NO: 570831 - DNA, 20 bp, mouse
gccaggcccggcgcaggcga

SEQ ID NO: 570832 - DNA, 20 bp, mouse
gtgctcacaggcgctgagag

SEQ ID NO: 570833 - DNA, 20 bp, mouse
gagacggtggaagaagccgt

SEQ ID NO: 570834 - DNA, 20 bp, mouse
ggtgaggccaggcccggcgc

SEQ ID NO: 570835 - DNA, 20 bp, mouse
gccggttagaacagacgacg

SEQ ID NO: 570836 - DNA, 20 bp, mouse
gagttcccagggggagaagg

SEQ ID NO: 570837 - DNA, 20 bp, mouse
gctcaagtcaagttcccagg

SEQ ID NO: 570838 - DNA, 20 bp, mouse
ggagaaggcggcgcacagcg

SEQ ID NO: 570839 - DNA, 20 bp, mouse
gggcgcacagcgcggaatga

SEQ ID NO: 570840 - DNA, 20 bp, mouse
gaagtagctgtggacctggt

SEQ ID NO: 570841 - DNA, 20 bp, mouse
ggctgtggacctggtaggaa

SEQ ID NO: 570842 - DNA, 20 bp, mouse
ggagagagacaacttcccaa

SEQ ID NO: 570843 - DNA, 20 bp, mouse
gaacttgacttgagctaggt

SEQ ID NO: 570844 - DNA, 20 bp, mouse
ggacaacttcccaaagggag

SEQ ID NO: 570845 - DNA, 20 bp, mouse
gagctacttaaccagctccg

SEQ ID NO: 570846 - DNA, 20 bp, mouse
gagcggccgcgcgcactcca

SEQ ID NO: 570847 - DNA, 20 bp, mouse
ggaggcccggaaggacgaat

SEQ ID NO: 570848 - DNA, 20 bp, mouse
gccccgcacgagggcctccc

SEQ ID NO: 570849 - DNA, 20 bp, mouse
gcagcaggcacgccccgtcg

SEQ ID NO: 570850 - DNA, 20 bp, mouse
gtcgtccttccgggcctcgg

SEQ ID NO: 570851 - DNA, 20 bp, mouse
ggggaagtgctccaggagta

SEQ ID NO: 570852 - DNA, 20 bp, mouse
gctccagggaggccctcgtg

SEQ ID NO: 570853 - DNA, 20 bp, mouse
gcggtgagccaggcgagtag

SEQ ID NO: 570854 - DNA, 20 bp, mouse
ggaaggtgtccaggcccccg

SEQ ID NO: 570855 - DNA, 20 bp, mouse
ggagccaggcgagtagggga

SEQ ID NO: 570856 - DNA, 20 bp, mouse
gcccgctgtgaaggagcccc

SEQ ID NO: 570857 - DNA, 20 bp, mouse
ggcagagagagctccactgg

SEQ ID NO: 570858 - DNA, 20 bp, mouse
ggctgctcagggcgcagcta

SEQ ID NO: 570859 - DNA, 20 bp, mouse
gctgcgccctgagcagcctg

SEQ ID NO: 570860 - DNA, 20 bp, mouse
gtcccgtctgactggaagaa

SEQ ID NO: 570861 - DNA, 20 bp, mouse
ggcctggggctccttcacag

SEQ ID NO: 570862 - DNA, 20 bp, mouse
gaataacacccagccaccag

SEQ ID NO: 570863 - DNA, 20 bp, mouse
ggcagccaggcccgctgtga

SEQ ID NO: 570864 - DNA, 20 bp, mouse
gttccagtcagacgggacaa

SEQ ID NO: 570865 - DNA, 20 bp, mouse
ggccatagccaacagctgta

SEQ ID NO: 570866 - DNA, 20 bp, mouse
gtgctccatgagcccctcat

SEQ ID NO: 570867 - DNA, 20 bp, mouse
ggggcctgatgccagcaatg

SEQ ID NO: 570868 - DNA, 20 bp, mouse
gagcagacccaggcatccac

SEQ ID NO: 570869 - DNA, 20 bp, mouse
gagggaagaccagcccacca

SEQ ID NO: 570870 - DNA, 20 bp, mouse
gtctcacctgaggaaggtag

SEQ ID NO: 570871 - DNA, 20 bp, mouse
gctcatgggcagaccctggt

SEQ ID NO: 570872 - DNA, 20 bp, mouse
ggagctagctggaaccaccc

SEQ ID NO: 570873 - DNA, 20 bp, mouse
gtgggaatcccaagagaccc

SEQ ID NO: 570874 - DNA, 20 bp, mouse
gcagcctgctagaaagggag

SEQ ID NO: 570875 - DNA, 20 bp, mouse
gggaagtggctcactcacgg

SEQ ID NO: 570876 - DNA, 20 bp, mouse
gagcggcctgccgggagcca

SEQ ID NO: 570877 - DNA, 20 bp, mouse
gatgcagggtccccatggcc

SEQ ID NO: 570878 - DNA, 20 bp, mouse
gccgggggcggttcaaatag

SEQ ID NO: 570879 - DNA, 20 bp, mouse
gctgcatcctgagcagcact

SEQ ID NO: 570880 - DNA, 20 bp, mouse
gaaactgctggcaacagtca

SEQ ID NO: 570881 - DNA, 20 bp, mouse
ggactggtgagagattgcca

SEQ ID NO: 570882 - DNA, 20 bp, mouse
gaggagccgccccaggaaga

SEQ ID NO: 570883 - DNA, 20 bp, mouse
ggtaagaagctgggacattg

SEQ ID NO: 570884 - DNA, 20 bp, mouse
gggggctgggagccttgagt

SEQ ID NO: 570885 - DNA, 20 bp, mouse
gtcaaataggggtatgggat

SEQ ID NO: 570886 - DNA, 20 bp, mouse
gcagggggcaagtccagtag

SEQ ID NO: 570887 - DNA, 20 bp, mouse
gaagtccagtagtggaatcc

SEQ ID NO: 570888 - DNA, 20 bp, mouse
ggggcagacacacactgaca

SEQ ID NO: 570889 - DNA, 20 bp, mouse
gaagaggccactgtacgtac

SEQ ID NO: 570890 - DNA, 20 bp, mouse
gctccctccagcgccttcag

SEQ ID NO: 570891 - DNA, 20 bp, mouse
gggactgcaagagtcgtcag

SEQ ID NO: 570892 - DNA, 20 bp, mouse
ggagctgctgccgtggggcc

SEQ ID NO: 570893 - DNA, 20 bp, mouse
gtggcaagcaccccctgcta

SEQ ID NO: 570894 - DNA, 20 bp, mouse
gacactgacagggctctaga

SEQ ID NO: 570895 - DNA, 20 bp, mouse
ggcttgcgagctgctgccgt

SEQ ID NO: 570896 - DNA, 20 bp, mouse
gtagtggcggggccacggta

SEQ ID NO: 570897 - DNA, 20 bp, mouse
ggatagcagcagagtgcact

SEQ ID NO: 570898 - DNA, 20 bp, mouse
gcgcagcctagcgcgggagg

SEQ ID NO: 570899 - DNA, 20 bp, mouse
gggcgctcaccgacttagtg

SEQ ID NO: 570900 - DNA, 20 bp, mouse
gtaggctgcggggactggac

SEQ ID NO: 570901 - DNA, 20 bp, mouse
ggacacggagccgcagtcgt

SEQ ID NO: 570902 - DNA, 20 bp, mouse
gaggagctgccccactaagt

SEQ ID NO: 570903 - DNA, 20 bp, mouse
gagtccccgcagcctagcgc

SEQ ID NO: 570904 - DNA, 20 bp, mouse
ggcccacatgctagccatag

SEQ ID NO: 570905 - DNA, 20 bp, mouse
gatgggaaaggccacggaca

SEQ ID NO: 570906 - DNA, 20 bp, mouse
ggagagcgaagctcgaaacc

SEQ ID NO: 570907 - DNA, 20 bp, mouse
gcgaaacccggcagcgggag

SEQ ID NO: 570908 - DNA, 20 bp, mouse
gggcctggggctctgacctg

SEQ ID NO: 570909 - DNA, 20 bp, mouse
ggggcggcacggggtccact

SEQ ID NO: 570910 - DNA, 20 bp, mouse
gtgcaggtggaacagagcgt

SEQ ID NO: 570911 - DNA, 20 bp, mouse
ggcccaaggagcggcctcag

SEQ ID NO: 570912 - DNA, 20 bp, mouse
ggcccccagagcccaaggag

SEQ ID NO: 570913 - DNA, 20 bp, mouse
ggtcggtgaagaccagtctg

SEQ ID NO: 570914 - DNA, 20 bp, mouse
gagaggctagcgggatgggt

SEQ ID NO: 570915 - DNA, 20 bp, mouse
gtggaacagagcgtaggtcc

SEQ ID NO: 570916 - DNA, 20 bp, mouse
gccatcaccaggcccgggga

SEQ ID NO: 570917 - DNA, 20 bp, mouse
gtagccgagatgccttcccc

SEQ ID NO: 570918 - DNA, 20 bp, mouse
gcccgagttgaagtccaggc

SEQ ID NO: 570919 - DNA, 20 bp, mouse
gctggccgctctccatcacc

SEQ ID NO: 570920 - DNA, 20 bp, mouse
gacttcaactcggggacacc

SEQ ID NO: 570921 - DNA, 20 bp, mouse
gacagtctcactctcagtcc

SEQ ID NO: 570922 - DNA, 20 bp, mouse
ggccggcctggacttcaact

SEQ ID NO: 570923 - DNA, 20 bp, mouse
gctctccatcaccaggcccg

SEQ ID NO: 570924 - DNA, 20 bp, mouse
gagtgtgctgcagagcagaa

SEQ ID NO: 570925 - DNA, 20 bp, mouse
gcagaaaggccgggagcacc

SEQ ID NO: 570926 - DNA, 20 bp, mouse
gctggacagaggactcccaa

SEQ ID NO: 570927 - DNA, 20 bp, mouse
ggccacagacagagcaactg

SEQ ID NO: 570928 - DNA, 20 bp, mouse
gaggactcccaagggagcat

SEQ ID NO: 570929 - DNA, 20 bp, mouse
gacagacgtactccactgtc

SEQ ID NO: 570930 - DNA, 20 bp, mouse
gtaggctctcagccacctga

SEQ ID NO: 570931 - DNA, 20 bp, mouse
gcctagggaggcccccgaca

SEQ ID NO: 570932 - DNA, 20 bp, mouse
ggactcaggccgggagacac

SEQ ID NO: 570933 - DNA, 20 bp, mouse
ggtactccactgtctggctg

SEQ ID NO: 570934 - DNA, 20 bp, mouse
gtcctcagttgctctgtctg

SEQ ID NO: 570935 - DNA, 20 bp, mouse
gcggcctgagtcatagagaa

SEQ ID NO: 570936 - DNA, 20 bp, mouse
gcaggcggcgcgcctttcgt

SEQ ID NO: 570937 - DNA, 20 bp, mouse
ggtgagcagcccctcagtca

SEQ ID NO: 570938 - DNA, 20 bp, mouse
gccggtgcgccctgactgag

SEQ ID NO: 570939 - DNA, 20 bp, mouse
gagagacaagcacccacgaa

SEQ ID NO: 570940 - DNA, 20 bp, mouse
gagagcgaacatggcccagg

SEQ ID NO: 570941 - DNA, 20 bp, mouse
gggcagagcgaacatggccc

SEQ ID NO: 570942 - DNA, 20 bp, mouse
gcggctgcgcaggtaagact

SEQ ID NO: 570943 - DNA, 20 bp, mouse
gctggtgccaccgcacggtg

SEQ ID NO: 570944 - DNA, 20 bp, mouse
ggtgggtgcttgtctctagc

SEQ ID NO: 570945 - DNA, 20 bp, mouse
ggctgtaccacaccgtgcgg

SEQ ID NO: 570946 - DNA, 20 bp, mouse
gaggggcgcgaggacggaga

SEQ ID NO: 570947 - DNA, 20 bp, mouse
gaggaaaaggggcgcgagga

SEQ ID NO: 570948 - DNA, 20 bp, mouse
gtgcaggccctcccacccca

SEQ ID NO: 570949 - DNA, 20 bp, mouse
gcgctcctcttaggcgacgg

SEQ ID NO: 570950 - DNA, 20 bp, mouse
gcgcactcacatggtgaacg

SEQ ID NO: 570951 - DNA, 20 bp, mouse
gaaggcgaagggccgagggt

SEQ ID NO: 570952 - DNA, 20 bp, mouse
ggaatgcaccgcgcggagag

SEQ ID NO: 570953 - DNA, 20 bp, mouse
gtctggcacgaggaatccgg

SEQ ID NO: 570954 - DNA, 20 bp, mouse
gctccgggacgaccttccgt

SEQ ID NO: 570955 - DNA, 20 bp, mouse
ggagaaaggcgaagggccga

SEQ ID NO: 570956 - DNA, 20 bp, mouse
gcggcgccccgcgcactacc

SEQ ID NO: 570957 - DNA, 20 bp, mouse
ggtgcgctgggctcccgtgg

SEQ ID NO: 570958 - DNA, 20 bp, mouse
gacgtgaggacagccgcgga

SEQ ID NO: 570959 - DNA, 20 bp, mouse
gcctcgtaacccaggacgtg

SEQ ID NO: 570960 - DNA, 20 bp, mouse
ggccgaggccggtcctgggg

SEQ ID NO: 570961 - DNA, 20 bp, mouse
gcaggacgtgaggacagccg

SEQ ID NO: 570962 - DNA, 20 bp, mouse
ggctacggagctaggaactg

SEQ ID NO: 570963 - DNA, 20 bp, mouse
ggcggctggaagccgagcgg

SEQ ID NO: 570964 - DNA, 20 bp, mouse
gaacgtcgccgccccaggac

SEQ ID NO: 570965 - DNA, 20 bp, mouse
ggtctgcgccaggtagtgcg

SEQ ID NO: 570966 - DNA, 20 bp, mouse
gcctcctaccatataaggag

SEQ ID NO: 570967 - DNA, 20 bp, mouse
gagctggagtcaccatggaa

SEQ ID NO: 570968 - DNA, 20 bp, mouse
gcagcggcttctacaaatgt

SEQ ID NO: 570969 - DNA, 20 bp, mouse
gcacagagacgtggagtctg

SEQ ID NO: 570970 - DNA, 20 bp, mouse
gtcctagaatctaaagatag

SEQ ID NO: 570971 - DNA, 20 bp, mouse
gtgggactccaaaagccacg

SEQ ID NO: 570972 - DNA, 20 bp, mouse
gggtgactccagctgccccg

SEQ ID NO: 570973 - DNA, 20 bp, mouse
gcccttcctcctaccatata

SEQ ID NO: 570974 - DNA, 20 bp, mouse
gtgtaggacctgtatgatgg

SEQ ID NO: 570975 - DNA, 20 bp, mouse
gctgcctctccttatatggt

SEQ ID NO: 570976 - DNA, 20 bp, mouse
gagtgctcagaagtgtccta

SEQ ID NO: 570977 - DNA, 20 bp, mouse
gtcccgctggagagcactat

SEQ ID NO: 570978 - DNA, 20 bp, mouse
gtccggacacaaccactcag

SEQ ID NO: 570979 - DNA, 20 bp, mouse
gtgagcactggatcacccgc

SEQ ID NO: 570980 - DNA, 20 bp, mouse
ggctcagaagtgtcctaggg

SEQ ID NO: 570981 - DNA, 20 bp, mouse
gcaggacacaataggtcctg

SEQ ID NO: 570982 - DNA, 20 bp, mouse
gtggagaatccagggaccgt

SEQ ID NO: 570983 - DNA, 20 bp, mouse
gtcccacggccggattccca

SEQ ID NO: 570984 - DNA, 20 bp, mouse
ggatgctcccagcctctgca

SEQ ID NO: 570985 - DNA, 20 bp, mouse
gcagccagcagggaatctca

SEQ ID NO: 570986 - DNA, 20 bp, mouse
ggccggcctcgccgatccca

SEQ ID NO: 570987 - DNA, 20 bp, mouse
gggttgctgcgccctgggat

SEQ ID NO: 570988 - DNA, 20 bp, mouse
ggctccggctgctccagagt

SEQ ID NO: 570989 - DNA, 20 bp, mouse
gccgcctcccgaaagcaaaa

SEQ ID NO: 570990 - DNA, 20 bp, mouse
gcgcgggcgggcggacgcca

SEQ ID NO: 570991 - DNA, 20 bp, mouse
gctgcgccctgggatcggcg

SEQ ID NO: 570992 - DNA, 20 bp, mouse
gggccgagcgagcccagcgc

SEQ ID NO: 570993 - DNA, 20 bp, mouse
ggctcggccagcggggagag

SEQ ID NO: 570994 - DNA, 20 bp, mouse
ggccctgggatcggcgaggc

SEQ ID NO: 570995 - DNA, 20 bp, mouse
ggggtgccccaggccccgag

SEQ ID NO: 570996 - DNA, 20 bp, mouse
ggagactgagggacttcaga

SEQ ID NO: 570997 - DNA, 20 bp, mouse
gcacagactcgcacacagac

SEQ ID NO: 570998 - DNA, 20 bp, mouse
gcgggcaactgggaattgac

SEQ ID NO: 570999 - DNA, 20 bp, mouse
gcttcagaaggcagaggtgc

SEQ ID NO: 571000 - DNA, 20 bp, mouse
ggggagggcgggccctagga

SEQ ID NO: 571001 - DNA, 20 bp, mouse
gaggtgacagagaagtgtag

SEQ ID NO: 571002 - DNA, 20 bp, mouse
gctgcactgagagggctccc

SEQ ID NO: 571003 - DNA, 20 bp, mouse
ggacaaggacctgacagaga

SEQ ID NO: 571004 - DNA, 20 bp, mouse
gcgctggccatcatcttcat

SEQ ID NO: 571005 - DNA, 20 bp, mouse
ggtgtagaggaaagaacagg

SEQ ID NO: 571006 - DNA, 20 bp, mouse
gcccaaaggccccgactcta

SEQ ID NO: 571007 - DNA, 20 bp, mouse
gccagtcggacccctagagt

SEQ ID NO: 571008 - DNA, 20 bp, mouse
gtccgactggaaaacgtgga

SEQ ID NO: 571009 - DNA, 20 bp, mouse
gctggaaaacgtggatggag

SEQ ID NO: 571010 - DNA, 20 bp, mouse
gggctgggttgagaatcctg

SEQ ID NO: 571011 - DNA, 20 bp, mouse
gccgggctgccgcagaggag

SEQ ID NO: 571012 - DNA, 20 bp, mouse
gggggtccgactggaaaacg

SEQ ID NO: 571013 - DNA, 20 bp, mouse
gcaccgtgcaggctacagag

SEQ ID NO: 571014 - DNA, 20 bp, mouse
gtattccccgtgacccgtca

SEQ ID NO: 571015 - DNA, 20 bp, mouse
gaagtcaccgccaccaacac

SEQ ID NO: 571016 - DNA, 20 bp, mouse
ggcattcagagcggtctccc

SEQ ID NO: 571017 - DNA, 20 bp, mouse
gctcggcggggagaaagaag

SEQ ID NO: 571018 - DNA, 20 bp, mouse
ggagtcgccgagtaccggtg

SEQ ID NO: 571019 - DNA, 20 bp, mouse
gcgggtctcaatctcttcaa

SEQ ID NO: 571020 - DNA, 20 bp, mouse
gctcacagaaactccttccc

SEQ ID NO: 571021 - DNA, 20 bp, mouse
gctttgcgaagcattcagag

SEQ ID NO: 571022 - DNA, 20 bp, mouse
gtaggaagttagggaggccg

SEQ ID NO: 571023 - DNA, 20 bp, mouse
gcccaggagtcgccgagtac

SEQ ID NO: 571024 - DNA, 20 bp, mouse
ggcgctccatgcacccacaa

SEQ ID NO: 571025 - DNA, 20 bp, mouse
gccaggacttgacttatact

SEQ ID NO: 571026 - DNA, 20 bp, mouse
gtgtcgcccggagctcgagg

SEQ ID NO: 571027 - DNA, 20 bp, mouse
gagcttgggacgctagacta

SEQ ID NO: 571028 - DNA, 20 bp, mouse
ggagctccgggcgacaccgg

SEQ ID NO: 571029 - DNA, 20 bp, mouse
ggctcgaggaggacgcccac

SEQ ID NO: 571030 - DNA, 20 bp, mouse
gcctatgcgtggcacacagt

SEQ ID NO: 571031 - DNA, 20 bp, mouse
gacggagagcacctgttacg

SEQ ID NO: 571032 - DNA, 20 bp, mouse
gattaagcccgcagaaaagg

SEQ ID NO: 571033 - DNA, 20 bp, mouse
gggcgtcctcctcgagctcc

SEQ ID NO: 571034 - DNA, 20 bp, mouse
gacagcgaagggtcagctgg

SEQ ID NO: 571035 - DNA, 20 bp, mouse
ggcgtcccaagctataccgc

SEQ ID NO: 571036 - DNA, 20 bp, mouse
gcacccgaggagccagccgt

SEQ ID NO: 571037 - DNA, 20 bp, mouse
ggatctgcgagcaggaccga

SEQ ID NO: 571038 - DNA, 20 bp, mouse
ggcaggaccgagggtgtcgg

SEQ ID NO: 571039 - DNA, 20 bp, mouse
gacgcgtgggggcaccactg

SEQ ID NO: 571040 - DNA, 20 bp, mouse
gcgaattccgggacgcgtgg

SEQ ID NO: 571041 - DNA, 20 bp, mouse
ggtcgtgagtccgaccccag

SEQ ID NO: 571042 - DNA, 20 bp, mouse
gcgagcaggaccgagggtgt

SEQ ID NO: 571043 - DNA, 20 bp, mouse
gtcatgactctgggagtgga

SEQ ID NO: 571044 - DNA, 20 bp, mouse
ggcccactgagatcccgagt

SEQ ID NO: 571045 - DNA, 20 bp, mouse
ggtcctgctcgcagatcctg

SEQ ID NO: 571046 - DNA, 20 bp, mouse
ggtcaggactctgctcacga

SEQ ID NO: 571047 - DNA, 20 bp, mouse
ggctcggaagagcatcgcag

SEQ ID NO: 571048 - DNA, 20 bp, mouse
ggcccacactgctagaaagg

SEQ ID NO: 571049 - DNA, 20 bp, mouse
gcggaagagcatcgcagagg

SEQ ID NO: 571050 - DNA, 20 bp, mouse
gtgacaactggctgctaatg

SEQ ID NO: 571051 - DNA, 20 bp, mouse
gactgcgagctaagagcttc

SEQ ID NO: 571052 - DNA, 20 bp, mouse
ggtgggcaactgaacaagag

SEQ ID NO: 571053 - DNA, 20 bp, mouse
gggagtcccagggcgcctcg

SEQ ID NO: 571054 - DNA, 20 bp, mouse
ggtagtggtggcggtggagc

SEQ ID NO: 571055 - DNA, 20 bp, mouse
gaccccctttctagcagtgt

SEQ ID NO: 571056 - DNA, 20 bp, mouse
gtctcaaaggggatccttcg

SEQ ID NO: 571057 - DNA, 20 bp, mouse
gacagggacccaatgaacat

SEQ ID NO: 571058 - DNA, 20 bp, mouse
gaaaatggcatgatattggt

SEQ ID NO: 571059 - DNA, 20 bp, mouse
gaactgatgctgtagtaagc

SEQ ID NO: 571060 - DNA, 20 bp, mouse
gcatacaatgactctcaaag

SEQ ID NO: 571061 - DNA, 20 bp, mouse
ggcatgatattggtaggaga

SEQ ID NO: 571062 - DNA, 20 bp, mouse
ggggtccctgtactttcagg

SEQ ID NO: 571063 - DNA, 20 bp, mouse
gtgagagtcattgtatggta

SEQ ID NO: 571064 - DNA, 20 bp, mouse
gtcagtttgtgcatccccga

SEQ ID NO: 571065 - DNA, 20 bp, mouse
gaataccacctgaaagtaca

SEQ ID NO: 571066 - DNA, 20 bp, mouse
gaggcagcctgaggccgggc

SEQ ID NO: 571067 - DNA, 20 bp, mouse
gggcgagcgagagaacgaac

SEQ ID NO: 571068 - DNA, 20 bp, mouse
gaaccggcgcaatggagaga

SEQ ID NO: 571069 - DNA, 20 bp, mouse
gggcgccgagcgctgctgag

SEQ ID NO: 571070 - DNA, 20 bp, mouse
gagagaacgaaccggcgcaa

SEQ ID NO: 571071 - DNA, 20 bp, mouse
gcggcctgtctgcctcggag

SEQ ID NO: 571072 - DNA, 20 bp, mouse
gcctagggccgcgtccctcg

SEQ ID NO: 571073 - DNA, 20 bp, mouse
gggccctggtgatggttgga

SEQ ID NO: 571074 - DNA, 20 bp, mouse
ggggttcctgggacgagtgt

SEQ ID NO: 571075 - DNA, 20 bp, mouse
gccgccgccggccctggtga

SEQ ID NO: 571076 - DNA, 20 bp, mouse
gaggccatggaacttcagag

SEQ ID NO: 571077 - DNA, 20 bp, mouse
gtccttgctcaggcctgaat

SEQ ID NO: 571078 - DNA, 20 bp, mouse
ggcctgagcaaggacacagc

SEQ ID NO: 571079 - DNA, 20 bp, mouse
gagcaaggacacagctggtg

SEQ ID NO: 571080 - DNA, 20 bp, mouse
gacgcagcacgaacacacaa

SEQ ID NO: 571081 - DNA, 20 bp, mouse
gcgggttgaggagctgactc

SEQ ID NO: 571082 - DNA, 20 bp, mouse
gaagttccatggcctcccca

SEQ ID NO: 571083 - DNA, 20 bp, mouse
gagagaggtgtctccaattc

SEQ ID NO: 571084 - DNA, 20 bp, mouse
gcaagcccgagctgggactt

SEQ ID NO: 571085 - DNA, 20 bp, mouse
ggttggccatggggaggcca

SEQ ID NO: 571086 - DNA, 20 bp, mouse
ggtgtggaaaggagctggtc

SEQ ID NO: 571087 - DNA, 20 bp, mouse
gggtggtggtacagacagag

SEQ ID NO: 571088 - DNA, 20 bp, mouse
ggctagtactgaagaagggg

SEQ ID NO: 571089 - DNA, 20 bp, mouse
gggtggtacagacagagagg

SEQ ID NO: 571090 - DNA, 20 bp, mouse
gggcagcgcagggccccacc

SEQ ID NO: 571091 - DNA, 20 bp, mouse
gtggccaacaccaactaatt

SEQ ID NO: 571092 - DNA, 20 bp, mouse
ggagggataaaaatagagac

SEQ ID NO: 571093 - DNA, 20 bp, mouse
ggctctgggtcccaattagt

SEQ ID NO: 571094 - DNA, 20 bp, mouse
ggctcctaatgagcgtgggg

SEQ ID NO: 571095 - DNA, 20 bp, mouse
gggcggctcctaatgagcgt

SEQ ID NO: 571096 - DNA, 20 bp, mouse
gtggggagcgaggcaccgct

SEQ ID NO: 571097 - DNA, 20 bp, mouse
ggccagacccccgagagtcc

SEQ ID NO: 571098 - DNA, 20 bp, mouse
gccgcgcctcagctgcccag

SEQ ID NO: 571099 - DNA, 20 bp, mouse
gtcactagccaggactctcg

SEQ ID NO: 571100 - DNA, 20 bp, mouse
gatggaccaaacttgtgatg

SEQ ID NO: 571101 - DNA, 20 bp, mouse
gtggctggggaagcacgctc

SEQ ID NO: 571102 - DNA, 20 bp, mouse
gctcccgcctgaagaggatg

SEQ ID NO: 571103 - DNA, 20 bp, mouse
gggtaatgcacagctggagg

SEQ ID NO: 571104 - DNA, 20 bp, mouse
gtagagcgcaggtaagagct

SEQ ID NO: 571105 - DNA, 20 bp, mouse
gggcgcgggagtcactagcc

SEQ ID NO: 571106 - DNA, 20 bp, mouse
gggcagcactctgggtcgtg

SEQ ID NO: 571107 - DNA, 20 bp, mouse
gcaagtggctgtgcacccag

SEQ ID NO: 571108 - DNA, 20 bp, mouse
ggcaaaaagggacccgagag

SEQ ID NO: 571109 - DNA, 20 bp, mouse
gaacacccgcgtttgaagag

SEQ ID NO: 571110 - DNA, 20 bp, mouse
gtcctgcgcaccgggcctct

SEQ ID NO: 571111 - DNA, 20 bp, mouse
gtcaaacgcgggtgttcctc

SEQ ID NO: 571112 - DNA, 20 bp, mouse
ggcaaccagcccaccgaagg

SEQ ID NO: 571113 - DNA, 20 bp, mouse
ggcgcctgcaacttgttcaa

SEQ ID NO: 571114 - DNA, 20 bp, mouse
gctgcaagagtggaacccga

SEQ ID NO: 571115 - DNA, 20 bp, mouse
gtgcctgtgcggtttgagag

SEQ ID NO: 571116 - DNA, 20 bp, mouse
ggtccggccggcggcggtag

SEQ ID NO: 571117 - DNA, 20 bp, mouse
gccggcggcggtagcggtga

SEQ ID NO: 571118 - DNA, 20 bp, mouse
gcagatagaaggcagcgggg

SEQ ID NO: 571119 - DNA, 20 bp, mouse
gcactgggcgcgcgaggctg

SEQ ID NO: 571120 - DNA, 20 bp, mouse
ggtgcgcccggcgtgcgcgt

SEQ ID NO: 571121 - DNA, 20 bp, mouse
gtcgtcaggccgggccccga

SEQ ID NO: 571122 - DNA, 20 bp, mouse
gccgactcagcacggcccga

SEQ ID NO: 571123 - DNA, 20 bp, mouse
gacggcggtccggccggcgg

SEQ ID NO: 571124 - DNA, 20 bp, mouse
gaggcagatagaaggcagcg

SEQ ID NO: 571125 - DNA, 20 bp, mouse
gggcccgcgccgactcagca

SEQ ID NO: 571126 - DNA, 20 bp, mouse
ggagcgcagccgccgcaggt

SEQ ID NO: 571127 - DNA, 20 bp, mouse
gcctgcagaggctgagtaag

SEQ ID NO: 571128 - DNA, 20 bp, mouse
gacacgcaggacttaccctc

SEQ ID NO: 571129 - DNA, 20 bp, mouse
gcaaggacccagaaagtcgg

SEQ ID NO: 571130 - DNA, 20 bp, mouse
gtcgggcgaggcgcggactc

SEQ ID NO: 571131 - DNA, 20 bp, mouse
gttagggagggcgctagaga

SEQ ID NO: 571132 - DNA, 20 bp, mouse
gagccaaggacccagaaagt

SEQ ID NO: 571133 - DNA, 20 bp, mouse
ggctcagggcggcaagctca

SEQ ID NO: 571134 - DNA, 20 bp, mouse
gctaaccccctagctcaggg

SEQ ID NO: 571135 - DNA, 20 bp, mouse
gttcagagaggggcgactag

SEQ ID NO: 571136 - DNA, 20 bp, mouse
gctcagactgcagctaggac

SEQ ID NO: 571137 - DNA, 20 bp, mouse
gcagtctgagaggatgtccg

SEQ ID NO: 571138 - DNA, 20 bp, mouse
gctcaagggctcagacaccc

SEQ ID NO: 571139 - DNA, 20 bp, mouse
gctgcaggactgcaatgtgc

SEQ ID NO: 571140 - DNA, 20 bp, mouse
gcagacagagatccaggtaa

SEQ ID NO: 571141 - DNA, 20 bp, mouse
ggtctgggcagggcagatgt

SEQ ID NO: 571142 - DNA, 20 bp, mouse
ggaagacgtgcgcatcctca

SEQ ID NO: 571143 - DNA, 20 bp, mouse
gccttgagccgtgtaaaagt

SEQ ID NO: 571144 - DNA, 20 bp, mouse
ggtggtggtaccagtggatg

SEQ ID NO: 571145 - DNA, 20 bp, mouse
gggccccccagagcccatgg

SEQ ID NO: 571146 - DNA, 20 bp, mouse
gcccagaggcccacatactt

SEQ ID NO: 571147 - DNA, 20 bp, mouse
gcttgggacaaggctcacct

SEQ ID NO: 571148 - DNA, 20 bp, mouse
gacctgggtcctaagtatgt

SEQ ID NO: 571149 - DNA, 20 bp, mouse
ggacaccatggcaagcttag

SEQ ID NO: 571150 - DNA, 20 bp, mouse
ggcccacatacttaggaccc

SEQ ID NO: 571151 - DNA, 20 bp, mouse
gttagtggcagagtcagctg

SEQ ID NO: 571152 - DNA, 20 bp, mouse
gaagcttgccatggtgtctt

SEQ ID NO: 571153 - DNA, 20 bp, mouse
gaactccccaggaccactca

SEQ ID NO: 571154 - DNA, 20 bp, mouse
gttcaaggcacggacagatg

SEQ ID NO: 571155 - DNA, 20 bp, mouse
gtctcagccaggtagttgtg

SEQ ID NO: 571156 - DNA, 20 bp, mouse
gagaagcgcgggagtcccgg

SEQ ID NO: 571157 - DNA, 20 bp, mouse
ggggactcaccggccagcag

SEQ ID NO: 571158 - DNA, 20 bp, mouse
gcgcgcggaccggagcgcgg

SEQ ID NO: 571159 - DNA, 20 bp, mouse
gctcgagggcttggatgtac

SEQ ID NO: 571160 - DNA, 20 bp, mouse
gctccagctccggacgcctc

SEQ ID NO: 571161 - DNA, 20 bp, mouse
gagcccgagcccgaggcgtc

SEQ ID NO: 571162 - DNA, 20 bp, mouse
ggagtcccccgagaaccggg

SEQ ID NO: 571163 - DNA, 20 bp, mouse
gaggtggagaggctcgctag

SEQ ID NO: 571164 - DNA, 20 bp, mouse
gagcccgaggcgtccggagc

SEQ ID NO: 571165 - DNA, 20 bp, mouse
ggcggcggcggcgcgctcga

SEQ ID NO: 571166 - DNA, 20 bp, mouse
gcgccgcgtgagtcccccac

SEQ ID NO: 571167 - DNA, 20 bp, mouse
gcggcgcgcagaccccgagg

SEQ ID NO: 571168 - DNA, 20 bp, mouse
gagccagtgggggactcacg

SEQ ID NO: 571169 - DNA, 20 bp, mouse
gaatagcgccgggactaggg

SEQ ID NO: 571170 - DNA, 20 bp, mouse
ggccatcggccagctcccga

SEQ ID NO: 571171 - DNA, 20 bp, mouse
gtgggcaagtgagcttaaag

SEQ ID NO: 571172 - DNA, 20 bp, mouse
gtcggaatcgagccaatgag

SEQ ID NO: 571173 - DNA, 20 bp, mouse
ggcgtccagcctcaccttgg

SEQ ID NO: 571174 - DNA, 20 bp, mouse
gatcggccagctcccgacgg

SEQ ID NO: 571175 - DNA, 20 bp, mouse
gccatcgcgccgctggaggg

SEQ ID NO: 571176 - DNA, 20 bp, mouse
ggctggctcgctgcaagagg

SEQ ID NO: 571177 - DNA, 20 bp, mouse
ggagctgagtgccaaggtac

SEQ ID NO: 571178 - DNA, 20 bp, mouse
gaagcgggttcccttcccgg

SEQ ID NO: 571179 - DNA, 20 bp, mouse
gccgctgccgcccccgggaa

SEQ ID NO: 571180 - DNA, 20 bp, mouse
gggcaggcgggaggacgatg

SEQ ID NO: 571181 - DNA, 20 bp, mouse
gggcaggcagggcacgagag

SEQ ID NO: 571182 - DNA, 20 bp, mouse
gagcgagccagcttgccgag

SEQ ID NO: 571183 - DNA, 20 bp, mouse
gggcggcagcggctggtcgg

SEQ ID NO: 571184 - DNA, 20 bp, mouse
gcggtggtgccgagcgggat

SEQ ID NO: 571185 - DNA, 20 bp, mouse
ggcggaggagccctggacgg

SEQ ID NO: 571186 - DNA, 20 bp, mouse
ggcagggtgtagttgagtga

SEQ ID NO: 571187 - DNA, 20 bp, mouse
ggcgggatatttggacgggt

SEQ ID NO: 571188 - DNA, 20 bp, mouse
ggagcagagcgcagccgccc

SEQ ID NO: 571189 - DNA, 20 bp, mouse
gccttggcgggatatttgga

SEQ ID NO: 571190 - DNA, 20 bp, mouse
gatatttggacgggtaggcg

SEQ ID NO: 571191 - DNA, 20 bp, mouse
gggtgtagttgagtgaaggc

SEQ ID NO: 571192 - DNA, 20 bp, mouse
gactcaactacaccctgccg

SEQ ID NO: 571193 - DNA, 20 bp, mouse
gtagcctgcagtacgtggag

SEQ ID NO: 571194 - DNA, 20 bp, mouse
ggtaagtgcaagataccctg

SEQ ID NO: 571195 - DNA, 20 bp, mouse
gtctatttccctccccggca

SEQ ID NO: 571196 - DNA, 20 bp, mouse
gggccgcggcgacccctcag

SEQ ID NO: 571197 - DNA, 20 bp, mouse
ggaaccactgcagcgaacag

SEQ ID NO: 571198 - DNA, 20 bp, mouse
ggcgcggcttcggggagaag

SEQ ID NO: 571199 - DNA, 20 bp, mouse
gaggccgtgggactcaccat

SEQ ID NO: 571200 - DNA, 20 bp, mouse
ggcttcggggagaagcggag

SEQ ID NO: 571201 - DNA, 20 bp, mouse
gcgccgctgaggggtcgccg

SEQ ID NO: 571202 - DNA, 20 bp, mouse
ggcacggcgcggacgaccag

SEQ ID NO: 571203 - DNA, 20 bp, mouse
gcggagcgggaccgcggcgg

SEQ ID NO: 571204 - DNA, 20 bp, mouse
gcgctgcagtggttcggccg

SEQ ID NO: 571205 - DNA, 20 bp, mouse
gaggccgtgggcctcacggg

SEQ ID NO: 571206 - DNA, 20 bp, mouse
gcgaccgaggagggaaagga

SEQ ID NO: 571207 - DNA, 20 bp, mouse
gcgagcgaccgaggagggaa

SEQ ID NO: 571208 - DNA, 20 bp, mouse
gccgggcccgcggtactcac

SEQ ID NO: 571209 - DNA, 20 bp, mouse
gcggccaccgaggccatctt

SEQ ID NO: 571210 - DNA, 20 bp, mouse
gcggtcgctcgctctaacaa

SEQ ID NO: 571211 - DNA, 20 bp, mouse
gtcgcgaggtccgcaatcac

SEQ ID NO: 571212 - DNA, 20 bp, mouse
gcgcaatcacgggttcacgg

SEQ ID NO: 571213 - DNA, 20 bp, mouse
gggacccggagcgaccggca

SEQ ID NO: 571214 - DNA, 20 bp, mouse
gtagagcgagcgaccgagga

SEQ ID NO: 571215 - DNA, 20 bp, mouse
ggggcggacttgtgacgcag

SEQ ID NO: 571216 - DNA, 20 bp, mouse
gcgtccgggagcggctggag

SEQ ID NO: 571217 - DNA, 20 bp, mouse
ggccgctcccggacgaacga

SEQ ID NO: 571218 - DNA, 20 bp, mouse
gaccgtcgttcgtccgggag

SEQ ID NO: 571219 - DNA, 20 bp, mouse
gcagcggggggggaacacag

SEQ ID NO: 571220 - DNA, 20 bp, mouse
gctgtaaccgtcgttcgtcc

SEQ ID NO: 571221 - DNA, 20 bp, mouse
gggcggcggcgcgatcggcc

SEQ ID NO: 571222 - DNA, 20 bp, mouse
gaggcgacgccagcgggcag

SEQ ID NO: 571223 - DNA, 20 bp, mouse
ggctgcgcgcgcagcggtgg

SEQ ID NO: 571224 - DNA, 20 bp, mouse
ggacgactcccccccagcct

SEQ ID NO: 571225 - DNA, 20 bp, mouse
gcgacgccagcgggcagcgg

SEQ ID NO: 571226 - DNA, 20 bp, mouse
gccgtgcgcgccctccgcag

SEQ ID NO: 571227 - DNA, 20 bp, mouse
ggccggccggcgcatggagg

SEQ ID NO: 571228 - DNA, 20 bp, mouse
ggagccggcgccgctgcgga

SEQ ID NO: 571229 - DNA, 20 bp, mouse
gaccccaaggacccgtagtg

SEQ ID NO: 571230 - DNA, 20 bp, mouse
gcccggagccggcgccgctg

SEQ ID NO: 571231 - DNA, 20 bp, mouse
gccggccggccggcgcatgg

SEQ ID NO: 571232 - DNA, 20 bp, mouse
ggggaagtcccgctgaggtc

SEQ ID NO: 571233 - DNA, 20 bp, mouse
gtgcagggcccatcccagta

SEQ ID NO: 571234 - DNA, 20 bp, mouse
gggagggcgcgcacgggtcc

SEQ ID NO: 571235 - DNA, 20 bp, mouse
gccctccccacgccccacta

SEQ ID NO: 571236 - DNA, 20 bp, mouse
gggcgcggtggagactgacc

SEQ ID NO: 571237 - DNA, 20 bp, mouse
ggcggtggagactgacctgg

SEQ ID NO: 571238 - DNA, 20 bp, mouse
gcgccggcgccggcacgacg

SEQ ID NO: 571239 - DNA, 20 bp, mouse
gggcgccggcacgacgcgga

SEQ ID NO: 571240 - DNA, 20 bp, mouse
gaccggccgggttcacacag

SEQ ID NO: 571241 - DNA, 20 bp, mouse
ggagactgacctggcggtcc

SEQ ID NO: 571242 - DNA, 20 bp, mouse
gcggcacgacgcggagggct

SEQ ID NO: 571243 - DNA, 20 bp, mouse
gccctgcacgtggcaaccac

SEQ ID NO: 571244 - DNA, 20 bp, mouse
gcagggccggagccgcaggg

SEQ ID NO: 571245 - DNA, 20 bp, mouse
ggcggtccgggcgccggcgc

SEQ ID NO: 571246 - DNA, 20 bp, mouse
gaggcgcgggcggagaggac

SEQ ID NO: 571247 - DNA, 20 bp, mouse
ggctgctcgggcgggttccg

SEQ ID NO: 571248 - DNA, 20 bp, mouse
gttacgcggcgggttatcca

SEQ ID NO: 571249 - DNA, 20 bp, mouse
gtccctgctcagaggcgcgg

SEQ ID NO: 571250 - DNA, 20 bp, mouse
ggtctccctgctcagaggcg

SEQ ID NO: 571251 - DNA, 20 bp, mouse
gccgccgagcggtccccaga

SEQ ID NO: 571252 - DNA, 20 bp, mouse
gtctcacgtctagggccggg

SEQ ID NO: 571253 - DNA, 20 bp, mouse
gcccgcccgagcagcgcccg

SEQ ID NO: 571254 - DNA, 20 bp, mouse
ggtcccccgccccgcctcta

SEQ ID NO: 571255 - DNA, 20 bp, mouse
gccagggaggcgttatttgg

SEQ ID NO: 571256 - DNA, 20 bp, mouse
ggcgggcagcggcacttcag

SEQ ID NO: 571257 - DNA, 20 bp, mouse
gatggagcgctggaccgagg

SEQ ID NO: 571258 - DNA, 20 bp, mouse
gcagcgcacaggagcgggag

SEQ ID NO: 571259 - DNA, 20 bp, mouse
gcacatggagcgctggaccg

SEQ ID NO: 571260 - DNA, 20 bp, mouse
ggagcgctggaccgaggcgg

SEQ ID NO: 571261 - DNA, 20 bp, mouse
gacccggaggagcagcgcac

SEQ ID NO: 571262 - DNA, 20 bp, mouse
ggaggagcagcgcacaggag

SEQ ID NO: 571263 - DNA, 20 bp, mouse
gaccgcgcacgcggacccgg

SEQ ID NO: 571264 - DNA, 20 bp, mouse
ggaactgtcaggggtctagg

SEQ ID NO: 571265 - DNA, 20 bp, mouse
gcgcgcgcacggggatggaa

SEQ ID NO: 571266 - DNA, 20 bp, mouse
gcccagcgagggagaggacg

SEQ ID NO: 571267 - DNA, 20 bp, mouse
ggctggagctagcagaacgc

SEQ ID NO: 571268 - DNA, 20 bp, mouse
gcagcccctaagggagaccg

SEQ ID NO: 571269 - DNA, 20 bp, mouse
ggggctgcgcgcaggatcgg

SEQ ID NO: 571270 - DNA, 20 bp, mouse
gtgcggagcgtgcgggtctg

SEQ ID NO: 571271 - DNA, 20 bp, mouse
gctcacaggccgaggtaacg

SEQ ID NO: 571272 - DNA, 20 bp, mouse
gtgcgggctgcggagcgtgc

SEQ ID NO: 571273 - DNA, 20 bp, mouse
gggctgcgccacgtgatcag

SEQ ID NO: 571274 - DNA, 20 bp, mouse
ggctagctccagcggctcac

SEQ ID NO: 571275 - DNA, 20 bp, mouse
gaagcgcgagccgcgagcgt

SEQ ID NO: 571276 - DNA, 20 bp, mouse
ggcagcaccgagggccccat

SEQ ID NO: 571277 - DNA, 20 bp, mouse
ggccaggctggcagcaccga

SEQ ID NO: 571278 - DNA, 20 bp, mouse
gtgcttcccggaggtgccag

SEQ ID NO: 571279 - DNA, 20 bp, mouse
gcagcccaggtaggattagg

SEQ ID NO: 571280 - DNA, 20 bp, mouse
gcactcctgctgcttcccgg

SEQ ID NO: 571281 - DNA, 20 bp, mouse
gcagccccctaatcctacct

SEQ ID NO: 571282 - DNA, 20 bp, mouse
gggagcagactgtggcccat

SEQ ID NO: 571283 - DNA, 20 bp, mouse
gctagggcgcagcaaggaca

SEQ ID NO: 571284 - DNA, 20 bp, mouse
gtgggctgggaaagcggtag

SEQ ID NO: 571285 - DNA, 20 bp, mouse
gagggaggggccagggaact

SEQ ID NO: 571286 - DNA, 20 bp, mouse
gccaactgggctctacgagg

SEQ ID NO: 571287 - DNA, 20 bp, mouse
ggtctgaggtgcaggcgcga

SEQ ID NO: 571288 - DNA, 20 bp, mouse
gctgcacctcagacccaact

SEQ ID NO: 571289 - DNA, 20 bp, mouse
gtagagcccagttgggtctg

SEQ ID NO: 571290 - DNA, 20 bp, mouse
ggcgcttgacatggcggcag

SEQ ID NO: 571291 - DNA, 20 bp, mouse
ggcggcgcgcggaagaagaa

SEQ ID NO: 571292 - DNA, 20 bp, mouse
ggacccaactgggctctacg

SEQ ID NO: 571293 - DNA, 20 bp, mouse
gtggagctccctccccgggg

SEQ ID NO: 571294 - DNA, 20 bp, mouse
gcgcgaggggagcggggttg

SEQ ID NO: 571295 - DNA, 20 bp, mouse
gggcggcagtggccgagtcg

SEQ ID NO: 571296 - DNA, 20 bp, mouse
ggagcttggggctgcggtgg

SEQ ID NO: 571297 - DNA, 20 bp, mouse
ggggccgcgaaccccaagag

SEQ ID NO: 571298 - DNA, 20 bp, mouse
gtgcggtggtggcgggtgac

SEQ ID NO: 571299 - DNA, 20 bp, mouse
gttcgggacgcggagcgacg

SEQ ID NO: 571300 - DNA, 20 bp, mouse
gcggacggccgtgggaactc

SEQ ID NO: 571301 - DNA, 20 bp, mouse
gagggaccgcggagagatag

SEQ ID NO: 571302 - DNA, 20 bp, mouse
gggagtcccccgagccggga

SEQ ID NO: 571303 - DNA, 20 bp, mouse
gtcggctgcccgagttccca

SEQ ID NO: 571304 - DNA, 20 bp, mouse
ggagttcgaggagatcgaca

SEQ ID NO: 571305 - DNA, 20 bp, mouse
gccccgagccgggagggtcg

SEQ ID NO: 571306 - DNA, 20 bp, mouse
gcccgctccggagccgacac

SEQ ID NO: 571307 - DNA, 20 bp, mouse
ggctctgcccgcacccgtgt

SEQ ID NO: 571308 - DNA, 20 bp, mouse
gccggagccgacacgggtgc

SEQ ID NO: 571309 - DNA, 20 bp, mouse
gcccgagcgaggccccgctc

SEQ ID NO: 571310 - DNA, 20 bp, mouse
gggcggcccgcgcagtccag

SEQ ID NO: 571311 - DNA, 20 bp, mouse
gacccgtgtcggctccggag

SEQ ID NO: 571312 - DNA, 20 bp, mouse
gccgcgggagcaggaactcg

SEQ ID NO: 571313 - DNA, 20 bp, mouse
ggggcggccgcgcagtgtcc

SEQ ID NO: 571314 - DNA, 20 bp, mouse
ggagtccccggtgtgacccc

SEQ ID NO: 571315 - DNA, 20 bp, mouse
ggggtaccgtcacatggagg

SEQ ID NO: 571316 - DNA, 20 bp, mouse
ggcggctcgcctcgtagtag

SEQ ID NO: 571317 - DNA, 20 bp, mouse
gaagagtccggatcacaatg

SEQ ID NO: 571318 - DNA, 20 bp, mouse
gtagcggccgcggaaaagag

SEQ ID NO: 571319 - DNA, 20 bp, mouse
ggtcgctttcccctactacg

SEQ ID NO: 571320 - DNA, 20 bp, mouse
ggcaagtggagatcctgagg

SEQ ID NO: 571321 - DNA, 20 bp, mouse
gagccccgaccgaccgggag

SEQ ID NO: 571322 - DNA, 20 bp, mouse
gaccgaccgggagaggcgag

SEQ ID NO: 571323 - DNA, 20 bp, mouse
ggtccaggccatgaagagtc

SEQ ID NO: 571324 - DNA, 20 bp, mouse
gcctgaggaggttcatccag

SEQ ID NO: 571325 - DNA, 20 bp, mouse
gagtccggatcacaatgggg

SEQ ID NO: 571326 - DNA, 20 bp, mouse
gggcagcggcgcggagacct

SEQ ID NO: 571327 - DNA, 20 bp, mouse
gccaggaggctgaggcggac

SEQ ID NO: 571328 - DNA, 20 bp, mouse
gcggcgagggtgacacacca

SEQ ID NO: 571329 - DNA, 20 bp, mouse
gagagccggggagcgctgct

SEQ ID NO: 571330 - DNA, 20 bp, mouse
gggggagcgctgctcggcag

SEQ ID NO: 571331 - DNA, 20 bp, mouse
ggcgcgcggcgctgtccagg

SEQ ID NO: 571332 - DNA, 20 bp, mouse
gccatggtcacagttctccg

SEQ ID NO: 571333 - DNA, 20 bp, mouse
gcgtgcgcagagagggtcgg

SEQ ID NO: 571334 - DNA, 20 bp, mouse
ggggcgtgcgcagagagggt

SEQ ID NO: 571335 - DNA, 20 bp, mouse
gtgaggcggacgggagagcc

SEQ ID NO: 571336 - DNA, 20 bp, mouse
gacctgccctgtggacgaga

SEQ ID NO: 571337 - DNA, 20 bp, mouse
gccgggcgatcagagaggtg

SEQ ID NO: 571338 - DNA, 20 bp, mouse
gggtcgggagcagatactcc

SEQ ID NO: 571339 - DNA, 20 bp, mouse
ggccagctagctgcgctcct

SEQ ID NO: 571340 - DNA, 20 bp, mouse
gcgcagggagggttacgcag

SEQ ID NO: 571341 - DNA, 20 bp, mouse
gaagcgcgagcggccgggga

SEQ ID NO: 571342 - DNA, 20 bp, mouse
ggggacccgggcgatcagag

SEQ ID NO: 571343 - DNA, 20 bp, mouse
gcgcccgggtcccctcgcgt

SEQ ID NO: 571344 - DNA, 20 bp, mouse
gtgtgcagaacttgagcctc

SEQ ID NO: 571345 - DNA, 20 bp, mouse
ggctcctggaagccagtggt

SEQ ID NO: 571346 - DNA, 20 bp, mouse
ggcgcccccgaccctcccca

SEQ ID NO: 571347 - DNA, 20 bp, mouse
gtgcagcgggcaacaagcag

SEQ ID NO: 571348 - DNA, 20 bp, mouse
gtgtcagccatggggagggt

SEQ ID NO: 571349 - DNA, 20 bp, mouse
ggaggacgcacaggggacaa

SEQ ID NO: 571350 - DNA, 20 bp, mouse
ggtaagtgtcagccatgggg

SEQ ID NO: 571351 - DNA, 20 bp, mouse
gagcgtaagtgtcagccatg

SEQ ID NO: 571352 - DNA, 20 bp, mouse
ggtgagttgaggccctccgg

SEQ ID NO: 571353 - DNA, 20 bp, mouse
gccacgtgcccagcgaccgg

SEQ ID NO: 571354 - DNA, 20 bp, mouse
ggcacacacggaggacgcac

SEQ ID NO: 571355 - DNA, 20 bp, mouse
gtcagctccacacccccgga

SEQ ID NO: 571356 - DNA, 20 bp, mouse
ggctcctcaccaagtccgta

SEQ ID NO: 571357 - DNA, 20 bp, mouse
gttgtgggagacctcagagc

SEQ ID NO: 571358 - DNA, 20 bp, mouse
gcggaaggctgggagagtca

SEQ ID NO: 571359 - DNA, 20 bp, mouse
gcatgctgcgacccgctctg

SEQ ID NO: 571360 - DNA, 20 bp, mouse
ggtcagggtgagagaagtgc

SEQ ID NO: 571361 - DNA, 20 bp, mouse
gtggaggccccacctcgcag

SEQ ID NO: 571362 - DNA, 20 bp, mouse
gtcgccatacggacttggtg

SEQ ID NO: 571363 - DNA, 20 bp, mouse
gcgcagcatgagtcgccata

SEQ ID NO: 571364 - DNA, 20 bp, mouse
gagacgccccgggagctgag

SEQ ID NO: 571365 - DNA, 20 bp, mouse
gatgagtcgccatacggact

SEQ ID NO: 571366 - DNA, 20 bp, mouse
ggcgagcggaactaccacag

SEQ ID NO: 571367 - DNA, 20 bp, mouse
gggcccgagcctgtccgctg

SEQ ID NO: 571368 - DNA, 20 bp, mouse
gcggaactaccacagcggac

SEQ ID NO: 571369 - DNA, 20 bp, mouse
gccgcccgagcgggagacgg

SEQ ID NO: 571370 - DNA, 20 bp, mouse
gtcgatggttgccgacatgg

SEQ ID NO: 571371 - DNA, 20 bp, mouse
gtcgggccccgctctatccg

SEQ ID NO: 571372 - DNA, 20 bp, mouse
gggcggcggggcagcgcgag

SEQ ID NO: 571373 - DNA, 20 bp, mouse
ggcgctctccccggatagag

SEQ ID NO: 571374 - DNA, 20 bp, mouse
gtaccacagcggacaggctc

SEQ ID NO: 571375 - DNA, 20 bp, mouse
gggttgccgacatggcggcg

SEQ ID NO: 571376 - DNA, 20 bp, mouse
gaggcccaggtgaggagagg

SEQ ID NO: 571377 - DNA, 20 bp, mouse
ggcccgaggcctacaggccc

SEQ ID NO: 571378 - DNA, 20 bp, mouse
gggctcgggcgcaaacctcc

SEQ ID NO: 571379 - DNA, 20 bp, mouse
gagaggtgggccgggtcagg

SEQ ID NO: 571380 - DNA, 20 bp, mouse
gggagtgagcctgatcatgg

SEQ ID NO: 571381 - DNA, 20 bp, mouse
gcggacaccggtcaccctga

SEQ ID NO: 571382 - DNA, 20 bp, mouse
gcgcaaacctcctggtgagg

SEQ ID NO: 571383 - DNA, 20 bp, mouse
ggggcgcaaacctcctggtg

SEQ ID NO: 571384 - DNA, 20 bp, mouse
gtggactaggcctaccctca

SEQ ID NO: 571385 - DNA, 20 bp, mouse
gccccaaccgcctcaccagg

SEQ ID NO: 571386 - DNA, 20 bp, mouse
gggcccgcgtccctccccta

SEQ ID NO: 571387 - DNA, 20 bp, mouse
gcgcgcccggccctagggga

SEQ ID NO: 571388 - DNA, 20 bp, mouse
gtccgcgcgcccggccctag

SEQ ID NO: 571389 - DNA, 20 bp, mouse
gccgcggcggcactctctgg

SEQ ID NO: 571390 - DNA, 20 bp, mouse
gactctctgggggagctcgg

SEQ ID NO: 571391 - DNA, 20 bp, mouse
ggaaggcgcggagcccaggg

SEQ ID NO: 571392 - DNA, 20 bp, mouse
ggggccgcggcggcactctc

SEQ ID NO: 571393 - DNA, 20 bp, mouse
gcggccctaggggagggacg

SEQ ID NO: 571394 - DNA, 20 bp, mouse
gcgggcgcgcggatccgggg

SEQ ID NO: 571395 - DNA, 20 bp, mouse
gggccgggcgcgcggatccg

SEQ ID NO: 571396 - DNA, 20 bp, mouse
gtctccgagtcccctcctct

SEQ ID NO: 571397 - DNA, 20 bp, mouse
gggcaagcccatgaagtcaa

SEQ ID NO: 571398 - DNA, 20 bp, mouse
gccgcaggcggagggttccg

SEQ ID NO: 571399 - DNA, 20 bp, mouse
gtgaagtcaagggcagcggg

SEQ ID NO: 571400 - DNA, 20 bp, mouse
gctaggagaaaagcacaaat

SEQ ID NO: 571401 - DNA, 20 bp, mouse
gtggggttgcctggccaaca

SEQ ID NO: 571402 - DNA, 20 bp, mouse
gggactcggagaagcgtgaa

SEQ ID NO: 571403 - DNA, 20 bp, mouse
gggcttctgacattccctgt

SEQ ID NO: 571404 - DNA, 20 bp, mouse
gctcggagaagcgtgaacgg

SEQ ID NO: 571405 - DNA, 20 bp, mouse
gtggccactgcgagactcaa

SEQ ID NO: 571406 - DNA, 20 bp, mouse
gctgtgagtaggttaaggga

SEQ ID NO: 571407 - DNA, 20 bp, mouse
gcaggagcacagcgtgctgg

SEQ ID NO: 571408 - DNA, 20 bp, mouse
ggagtctgtgagtaggttaa

SEQ ID NO: 571409 - DNA, 20 bp, mouse
gagagcaagagtctgtgagt

SEQ ID NO: 571410 - DNA, 20 bp, mouse
ggaactcaccagaaattcac

SEQ ID NO: 571411 - DNA, 20 bp, mouse
ggcatgtcaaatatgtgtca

SEQ ID NO: 571412 - DNA, 20 bp, mouse
gtttgtactaatttcctcta

SEQ ID NO: 571413 - DNA, 20 bp, mouse
gtggcttcttggtgctgcct

SEQ ID NO: 571414 - DNA, 20 bp, mouse
gcatggagtttggagtggaa

SEQ ID NO: 571415 - DNA, 20 bp, mouse
gcctagacgcaattgctgta

SEQ ID NO: 571416 - DNA, 20 bp, mouse
gagcagctgctggacctggg

SEQ ID NO: 571417 - DNA, 20 bp, mouse
gtcaggtccagccagatcat

SEQ ID NO: 571418 - DNA, 20 bp, mouse
ggtagcgcctagcggcccta

SEQ ID NO: 571419 - DNA, 20 bp, mouse
ggccagatcatgggcatccg

SEQ ID NO: 571420 - DNA, 20 bp, mouse
gtgggaggggagcggcccta

SEQ ID NO: 571421 - DNA, 20 bp, mouse
gcgctaggcgctacccgcga

SEQ ID NO: 571422 - DNA, 20 bp, mouse
gcggggcacggcctccatcg

SEQ ID NO: 571423 - DNA, 20 bp, mouse
ggaggggtgggccatcctaa

SEQ ID NO: 571424 - DNA, 20 bp, mouse
gtaggcgctacccgcgatgg

SEQ ID NO: 571425 - DNA, 20 bp, mouse
gctgtgacggaacccgggga

SEQ ID NO: 571426 - DNA, 20 bp, mouse
gtcagacggcggccaggtcg

SEQ ID NO: 571427 - DNA, 20 bp, mouse
gactgggcatgctcagacgg

SEQ ID NO: 571428 - DNA, 20 bp, mouse
gggacacgcgggaggactag

SEQ ID NO: 571429 - DNA, 20 bp, mouse
gccatacctgcagcatccgg

SEQ ID NO: 571430 - DNA, 20 bp, mouse
ggcgcccaggtaggtcgcgc

SEQ ID NO: 571431 - DNA, 20 bp, mouse
gccgcccgcgcgacctacct

SEQ ID NO: 571432 - DNA, 20 bp, mouse
gaagcctatagggcccctag

SEQ ID NO: 571433 - DNA, 20 bp, mouse
ggagagctggatccccgcag

SEQ ID NO: 571434 - DNA, 20 bp, mouse
gccgccactaggggccctat

SEQ ID NO: 571435 - DNA, 20 bp, mouse
ggccgcccgcgggctgcact

SEQ ID NO: 571436 - DNA, 20 bp, mouse
ggcggcgggtgactccaggg

SEQ ID NO: 571437 - DNA, 20 bp, mouse
ggaagcggcgggtgactcca

SEQ ID NO: 571438 - DNA, 20 bp, mouse
gaagcgcgcgcggcgtgaag

SEQ ID NO: 571439 - DNA, 20 bp, mouse
gcgcgcgcggcgtgaagcgg

SEQ ID NO: 571440 - DNA, 20 bp, mouse
ggcgggtgactccagggagg

SEQ ID NO: 571441 - DNA, 20 bp, mouse
ggctctgtgtgagagtgcaa

SEQ ID NO: 571442 - DNA, 20 bp, mouse
gaggaggaggagggtgaccg

SEQ ID NO: 571443 - DNA, 20 bp, mouse
gcggagcagggaagcgcgcg

SEQ ID NO: 571444 - DNA, 20 bp, mouse
gaccagtcagagccccggaa

SEQ ID NO: 571445 - DNA, 20 bp, mouse
gatgtcgcgtccgcggagca

SEQ ID NO: 571446 - DNA, 20 bp, mouse
gcgccggcggacaagcaggc

SEQ ID NO: 571447 - DNA, 20 bp, mouse
gcaggcgccggcggacaagc

SEQ ID NO: 571448 - DNA, 20 bp, mouse
gccgctctggccggtaagtg

SEQ ID NO: 571449 - DNA, 20 bp, mouse
ggcaagagcacggggagtgg

SEQ ID NO: 571450 - DNA, 20 bp, mouse
gcggcggacaagcaggctgg

SEQ ID NO: 571451 - DNA, 20 bp, mouse
gagtggggtccccaatgcag

SEQ ID NO: 571452 - DNA, 20 bp, mouse
gcgtagggagccccaaagac

SEQ ID NO: 571453 - DNA, 20 bp, mouse
gaccggccagagcgggctcc

SEQ ID NO: 571454 - DNA, 20 bp, mouse
gtggtacggggtcccctctg

SEQ ID NO: 571455 - DNA, 20 bp, mouse
ggcaaggagagcgggactga

SEQ ID NO: 571456 - DNA, 20 bp, mouse
gtagagatgagcctcaggca

SEQ ID NO: 571457 - DNA, 20 bp, mouse
gctgccccaggccagtagag

SEQ ID NO: 571458 - DNA, 20 bp, mouse
gagcagggcggagacaggaa

SEQ ID NO: 571459 - DNA, 20 bp, mouse
gggcccagccgcaagaacca

SEQ ID NO: 571460 - DNA, 20 bp, mouse
gcatggaggataggaaacaa

SEQ ID NO: 571461 - DNA, 20 bp, mouse
gccccgggctaccactctac

SEQ ID NO: 571462 - DNA, 20 bp, mouse
gtggcctggggcagccagca

SEQ ID NO: 571463 - DNA, 20 bp, mouse
gcaggactgcaggttggctt

SEQ ID NO: 571464 - DNA, 20 bp, mouse
ggcagtgagggaatatcccc

SEQ ID NO: 571465 - DNA, 20 bp, mouse
gcctgggacccatggaggat

SEQ ID NO: 571466 - DNA, 20 bp, mouse
gctggcaagaggcagcctgg

SEQ ID NO: 571467 - DNA, 20 bp, mouse
gctgacagacagctggcaag

SEQ ID NO: 571468 - DNA, 20 bp, mouse
gtgaagaagctatgtccccc

SEQ ID NO: 571469 - DNA, 20 bp, mouse
ggaagcactggatccagtca

SEQ ID NO: 571470 - DNA, 20 bp, mouse
gtaggaaggaatccagaagg

SEQ ID NO: 571471 - DNA, 20 bp, mouse
gtccacagggctctaagctg

SEQ ID NO: 571472 - DNA, 20 bp, mouse
gctcctggggtctctgtcta

SEQ ID NO: 571473 - DNA, 20 bp, mouse
gagagcgccagcgcatggtg

SEQ ID NO: 571474 - DNA, 20 bp, mouse
gacttgcccacaacaggaag

SEQ ID NO: 571475 - DNA, 20 bp, mouse
gatggtgaggctacagctgg

SEQ ID NO: 571476 - DNA, 20 bp, mouse
gttctcaatggagccgtggg

SEQ ID NO: 571477 - DNA, 20 bp, mouse
gctcctcctcaggacaggag

SEQ ID NO: 571478 - DNA, 20 bp, mouse
gctggccctgagccgggagg

SEQ ID NO: 571479 - DNA, 20 bp, mouse
gcctgaggaggagaaagtgc

SEQ ID NO: 571480 - DNA, 20 bp, mouse
gccgagccgcttaacccccg

SEQ ID NO: 571481 - DNA, 20 bp, mouse
gagccgccgcggagacaggg

SEQ ID NO: 571482 - DNA, 20 bp, mouse
gaggcgccgggccacagaag

SEQ ID NO: 571483 - DNA, 20 bp, mouse
gcgcagggcccgcatccccg

SEQ ID NO: 571484 - DNA, 20 bp, mouse
ggagatgctcagtttctcaa

SEQ ID NO: 571485 - DNA, 20 bp, mouse
gcctcgagaccgcccagccc

SEQ ID NO: 571486 - DNA, 20 bp, mouse
gcgctgacagggactcgcgg

SEQ ID NO: 571487 - DNA, 20 bp, mouse
gcctccatggcgaggagaag

SEQ ID NO: 571488 - DNA, 20 bp, mouse
gggcgagtgaggcgctgaca

SEQ ID NO: 571489 - DNA, 20 bp, mouse
gaggcgctgacagggactcg

SEQ ID NO: 571490 - DNA, 20 bp, mouse
gccaggccgcgacgggagag

SEQ ID NO: 571491 - DNA, 20 bp, mouse
gactgggctggaggctgcga

SEQ ID NO: 571492 - DNA, 20 bp, mouse
gttacagcccaggccgcgac

SEQ ID NO: 571493 - DNA, 20 bp, mouse
gccccgagccctcccgacgg

SEQ ID NO: 571494 - DNA, 20 bp, mouse
gggcatcttgcacagacccc

SEQ ID NO: 571495 - DNA, 20 bp, mouse
gagacgccgccgcggtcctg

SEQ ID NO: 571496 - DNA, 20 bp, mouse
gtgagcatcgccagccccga

SEQ ID NO: 571497 - DNA, 20 bp, mouse
gggcgcagcgcgctaccctc

SEQ ID NO: 571498 - DNA, 20 bp, mouse
gtggcgatgctcaagggccg

SEQ ID NO: 571499 - DNA, 20 bp, mouse
gggcgggcagcggacacgac

SEQ ID NO: 571500 - DNA, 20 bp, mouse
ggggcagcggacacgacagg

SEQ ID NO: 571501 - DNA, 20 bp, mouse
gcgtgtccgctgcccgcccg

SEQ ID NO: 571502 - DNA, 20 bp, mouse
ggcagaagcagcggctgcca

SEQ ID NO: 571503 - DNA, 20 bp, mouse
gagcgcgctaccctcggggc

SEQ ID NO: 571504 - DNA, 20 bp, mouse
gagcaggcagagcaaggtct

SEQ ID NO: 571505 - DNA, 20 bp, mouse
gcagcggacacgacaggcgg

SEQ ID NO: 571506 - DNA, 20 bp, mouse
gtagcaagtggtttgttctt

SEQ ID NO: 571507 - DNA, 20 bp, mouse
gagtgcatgtagctagcaag

SEQ ID NO: 571508 - DNA, 20 bp, mouse
ggcactctgtcttatcagat

SEQ ID NO: 571509 - DNA, 20 bp, mouse
ggggagaccctatttcttag

SEQ ID NO: 571510 - DNA, 20 bp, mouse
ggctgtgcccctaagaaata

SEQ ID NO: 571511 - DNA, 20 bp, mouse
gtaaatggtgatgtcagatt

SEQ ID NO: 571512 - DNA, 20 bp, mouse
ggaaatagggtctccctgaa

SEQ ID NO: 571513 - DNA, 20 bp, mouse
gagaaacaaggcctagtgga

SEQ ID NO: 571514 - DNA, 20 bp, mouse
ggtgtatgctgccctccact

SEQ ID NO: 571515 - DNA, 20 bp, mouse
gacaaacccatggtcatatc

SEQ ID NO: 571516 - DNA, 20 bp, mouse
ggtgagctgtgggaccctct

SEQ ID NO: 571517 - DNA, 20 bp, mouse
gcggtgccccaagagcccag

SEQ ID NO: 571518 - DNA, 20 bp, mouse
ggcaaaagccatcggatcaa

SEQ ID NO: 571519 - DNA, 20 bp, mouse
ggcccagggtgaggaactag

SEQ ID NO: 571520 - DNA, 20 bp, mouse
gctcactaaacagtcagagg

SEQ ID NO: 571521 - DNA, 20 bp, mouse
ggtgcccgtgcaaaagccat

SEQ ID NO: 571522 - DNA, 20 bp, mouse
gtcgtgaggggaccaggtgg

SEQ ID NO: 571523 - DNA, 20 bp, mouse
gcttctcactaaacagtcag

SEQ ID NO: 571524 - DNA, 20 bp, mouse
gaggtggaggactgtcccaa

SEQ ID NO: 571525 - DNA, 20 bp, mouse
gtcggatcaatggtgagctg

SEQ ID NO: 571526 - DNA, 20 bp, mouse
gcggcggctgcgggactgag

SEQ ID NO: 571527 - DNA, 20 bp, mouse
ggaggcggcgcggcctcgga

SEQ ID NO: 571528 - DNA, 20 bp, mouse
gggcacggccgggactcccg

SEQ ID NO: 571529 - DNA, 20 bp, mouse
ggtcggcgatctgccccggg

SEQ ID NO: 571530 - DNA, 20 bp, mouse
gggctgaccagggtccggag

SEQ ID NO: 571531 - DNA, 20 bp, mouse
ggcctcggagggctggagcg

SEQ ID NO: 571532 - DNA, 20 bp, mouse
gggtcccaggctccagaacc

SEQ ID NO: 571533 - DNA, 20 bp, mouse
gaaacggccgctgccgcccg

SEQ ID NO: 571534 - DNA, 20 bp, mouse
gtggagcgcggtgctgggag

SEQ ID NO: 571535 - DNA, 20 bp, mouse
gccggaccctggtcagccgg

SEQ ID NO: 571536 - DNA, 20 bp, mouse
gcggcagccctcagccctac

SEQ ID NO: 571537 - DNA, 20 bp, mouse
gtgctctcctgtagggctga

SEQ ID NO: 571538 - DNA, 20 bp, mouse
gtccggccgcctccagctct

SEQ ID NO: 571539 - DNA, 20 bp, mouse
gctgcgagagaagtcaccgg

SEQ ID NO: 571540 - DNA, 20 bp, mouse
ggggctgcgagagaagtcac

SEQ ID NO: 571541 - DNA, 20 bp, mouse
gtgagtggcgcggtgagggt

SEQ ID NO: 571542 - DNA, 20 bp, mouse
gcgcctccagctctgggcta

SEQ ID NO: 571543 - DNA, 20 bp, mouse
gaaatctgtctggcccggtc

SEQ ID NO: 571544 - DNA, 20 bp, mouse
ggcagtggcccaggatatcc

SEQ ID NO: 571545 - DNA, 20 bp, mouse
gcggcgactccgcatctccc

SEQ ID NO: 571546 - DNA, 20 bp, mouse
gagaccgacggcccccggag

SEQ ID NO: 571547 - DNA, 20 bp, mouse
gggcagcggcggactgagaa

SEQ ID NO: 571548 - DNA, 20 bp, mouse
gggaagggccgcgcatcgag

SEQ ID NO: 571549 - DNA, 20 bp, mouse
gcgcatcgaggggcccgaag

SEQ ID NO: 571550 - DNA, 20 bp, mouse
gagcggcggactgagaacgg

SEQ ID NO: 571551 - DNA, 20 bp, mouse
gtcactcaccgcctctccgg

SEQ ID NO: 571552 - DNA, 20 bp, mouse
gctgagaacggcggcctcag

SEQ ID NO: 571553 - DNA, 20 bp, mouse
ggcgggctgcggctcaggtg

SEQ ID NO: 571554 - DNA, 20 bp, mouse
gtcgcgggcgcggcaggtgg

SEQ ID NO: 571555 - DNA, 20 bp, mouse
gggcctcagcggctcgaggg

SEQ ID NO: 571556 - DNA, 20 bp, mouse
ggtggctccggcgcaggctg

SEQ ID NO: 571557 - DNA, 20 bp, mouse
gagggccccggcaaggaagg

SEQ ID NO: 571558 - DNA, 20 bp, mouse
ggcgaggagaagacgcacgg

SEQ ID NO: 571559 - DNA, 20 bp, mouse
gatgtctgcgagcctggaaa

SEQ ID NO: 571560 - DNA, 20 bp, mouse
gactggccatgcctccatac

SEQ ID NO: 571561 - DNA, 20 bp, mouse
ggcggctccgggcttcaggc

SEQ ID NO: 571562 - DNA, 20 bp, mouse
gtccatgctcctgaaagttg

SEQ ID NO: 571563 - DNA, 20 bp, mouse
gcatgttacttcctgtatgg

SEQ ID NO: 571564 - DNA, 20 bp, mouse
ggctccggcgcaggctgggg

SEQ ID NO: 571565 - DNA, 20 bp, mouse
gggatctcagaggggcgccg

SEQ ID NO: 571566 - DNA, 20 bp, mouse
gcagagctggtgggaactgt

SEQ ID NO: 571567 - DNA, 20 bp, mouse
gatgtcccgatactgcgcag

SEQ ID NO: 571568 - DNA, 20 bp, mouse
gacatatggccagagctggt

SEQ ID NO: 571569 - DNA, 20 bp, mouse
gaggctgaggctgcaatggg

SEQ ID NO: 571570 - DNA, 20 bp, mouse
gcgggacatatggccagagc

SEQ ID NO: 571571 - DNA, 20 bp, mouse
ggccagggaaggccattacc

SEQ ID NO: 571572 - DNA, 20 bp, mouse
gcagagacttgaagaagcca

SEQ ID NO: 571573 - DNA, 20 bp, mouse
gaccttcagatcccctaggt

SEQ ID NO: 571574 - DNA, 20 bp, mouse
gggagagaggccttgctaga

SEQ ID NO: 571575 - DNA, 20 bp, mouse
gcaggatagactacaactca

SEQ ID NO: 571576 - DNA, 20 bp, mouse
ggccgcatgacgcgcggagg

SEQ ID NO: 571577 - DNA, 20 bp, mouse
ggaggcagagggagcagccg

SEQ ID NO: 571578 - DNA, 20 bp, mouse
ggacgcgcggaggaggcaga

SEQ ID NO: 571579 - DNA, 20 bp, mouse
ggaccggctggcggagaagg

SEQ ID NO: 571580 - DNA, 20 bp, mouse
gggcggcggcggccacacgg

SEQ ID NO: 571581 - DNA, 20 bp, mouse
gcggctggagacggagacga

SEQ ID NO: 571582 - DNA, 20 bp, mouse
gggagccgcatgacgcgcgg

SEQ ID NO: 571583 - DNA, 20 bp, mouse
ggccggagccgcatgacgcg

SEQ ID NO: 571584 - DNA, 20 bp, mouse
gcgcggccttagactcgcag

SEQ ID NO: 571585 - DNA, 20 bp, mouse
gatgtccccggggaagcccg

SEQ ID NO: 571586 - DNA, 20 bp, mouse
gcgctctccatgctaggcag

SEQ ID NO: 571587 - DNA, 20 bp, mouse
ggcagcggccgccacatcca

SEQ ID NO: 571588 - DNA, 20 bp, mouse
gggccgccgctctccatgct

SEQ ID NO: 571589 - DNA, 20 bp, mouse
gacgtcggccaactacctcg

SEQ ID NO: 571590 - DNA, 20 bp, mouse
gcaagggccgaccccaggag

SEQ ID NO: 571591 - DNA, 20 bp, mouse
ggagcagcctctgcctagca

SEQ ID NO: 571592 - DNA, 20 bp, mouse
gcgcggctggcgggcgacgc

SEQ ID NO: 571593 - DNA, 20 bp, mouse
gacaaaagcaggcaacgcag

SEQ ID NO: 571594 - DNA, 20 bp, mouse
gctttgcaaagagcctccgg

SEQ ID NO: 571595 - DNA, 20 bp, mouse
ggtacccgtggcctctcctg

SEQ ID NO: 571596 - DNA, 20 bp, mouse
ggggcatcgccagtcagtcg

SEQ ID NO: 571597 - DNA, 20 bp, mouse
gccgatggccgagcccgcgc

SEQ ID NO: 571598 - DNA, 20 bp, mouse
gcacggggagagagagcgga

SEQ ID NO: 571599 - DNA, 20 bp, mouse
gggtagcctcgggaagccaa

SEQ ID NO: 571600 - DNA, 20 bp, mouse
gctggaaggagcccacgtca

SEQ ID NO: 571601 - DNA, 20 bp, mouse
ggcttaggcgggctcatcac

SEQ ID NO: 571602 - DNA, 20 bp, mouse
gatcggcgcgccactgccgg

SEQ ID NO: 571603 - DNA, 20 bp, mouse
gcgtggcgccagactctaag

SEQ ID NO: 571604 - DNA, 20 bp, mouse
gctcctgctccgcgactgac

SEQ ID NO: 571605 - DNA, 20 bp, mouse
ggccatcggcgcgccactgc

SEQ ID NO: 571606 - DNA, 20 bp, mouse
gctcagagccgggaaggatg

SEQ ID NO: 571607 - DNA, 20 bp, mouse
gagagagctcagagccggga

SEQ ID NO: 571608 - DNA, 20 bp, mouse
gacgtcgccgagactctggc

SEQ ID NO: 571609 - DNA, 20 bp, mouse
ggcgggcgcctcatccttcc

SEQ ID NO: 571610 - DNA, 20 bp, mouse
gcggagcccccggagccccc

SEQ ID NO: 571611 - DNA, 20 bp, mouse
gagactccgcctaggctcct

SEQ ID NO: 571612 - DNA, 20 bp, mouse
ggagtctcggcgacgttggt

SEQ ID NO: 571613 - DNA, 20 bp, mouse
ggtcagcccaggagcctagg

SEQ ID NO: 571614 - DNA, 20 bp, mouse
gggagtggcagactccgcct

SEQ ID NO: 571615 - DNA, 20 bp, mouse
gaaggatgaggcgcccgcgg

SEQ ID NO: 571616 - DNA, 20 bp, mouse
ggcgggagcaaggaccgata

SEQ ID NO: 571617 - DNA, 20 bp, mouse
gagagcgccgcgaaaggagc

SEQ ID NO: 571618 - DNA, 20 bp, mouse
gcgatagggacttagcgagg

SEQ ID NO: 571619 - DNA, 20 bp, mouse
ggaccgatagggacttagcg

SEQ ID NO: 571620 - DNA, 20 bp, mouse
ggcggcgccagctcctttcg

SEQ ID NO: 571621 - DNA, 20 bp, mouse
gccggttggcgctcagtcca

SEQ ID NO: 571622 - DNA, 20 bp, mouse
ggctctcagcgctcctgcgg

SEQ ID NO: 571623 - DNA, 20 bp, mouse
gcggggcgtggacaaccgta

SEQ ID NO: 571624 - DNA, 20 bp, mouse
ggcgctgagagcgccgcgaa

SEQ ID NO: 571625 - DNA, 20 bp, mouse
ggggccctgcggctgcgcac

SEQ ID NO: 571626 - DNA, 20 bp, mouse
gaggagagcgatccatccgg

SEQ ID NO: 571627 - DNA, 20 bp, mouse
gcaggactcgggcacagaag

SEQ ID NO: 571628 - DNA, 20 bp, mouse
gttgtctgcctgcggagctc

SEQ ID NO: 571629 - DNA, 20 bp, mouse
gcgcggccccctagcaacag

SEQ ID NO: 571630 - DNA, 20 bp, mouse
gctacagcggttgccacggg

SEQ ID NO: 571631 - DNA, 20 bp, mouse
ggcacgttctagcaggactc

SEQ ID NO: 571632 - DNA, 20 bp, mouse
ggcaggcagacaaccctccg

SEQ ID NO: 571633 - DNA, 20 bp, mouse
ggcacaaagagcccgagcag

SEQ ID NO: 571634 - DNA, 20 bp, mouse
gcccgggcgcccgaagtctg

SEQ ID NO: 571635 - DNA, 20 bp, mouse
gggcccccgagcgttcccct

SEQ ID NO: 571636 - DNA, 20 bp, mouse
gcataagagactacagtcgt

SEQ ID NO: 571637 - DNA, 20 bp, mouse
gagaaaaaatgtaataacga

SEQ ID NO: 571638 - DNA, 20 bp, mouse
gtaattgtgtacttgccagg

SEQ ID NO: 571639 - DNA, 20 bp, mouse
ggttgacaaagagctggcat

SEQ ID NO: 571640 - DNA, 20 bp, mouse
gatttaaagtcagatcctcc

SEQ ID NO: 571641 - DNA, 20 bp, mouse
ggactttaaatcattaatgc

SEQ ID NO: 571642 - DNA, 20 bp, mouse
gcagagctattgagtaatcc

SEQ ID NO: 571643 - DNA, 20 bp, mouse
gttccatgttgacaaagagc

SEQ ID NO: 571644 - DNA, 20 bp, mouse
gatttagagtctgataactc

SEQ ID NO: 571645 - DNA, 20 bp, mouse
gcattaattgtgtacttgcc

SEQ ID NO: 571646 - DNA, 20 bp, mouse
ggaggcgctgcctggctcgg

SEQ ID NO: 571647 - DNA, 20 bp, mouse
gcagcagccgagacacaccg

SEQ ID NO: 571648 - DNA, 20 bp, mouse
gtctggaagcccgcagccgg

SEQ ID NO: 571649 - DNA, 20 bp, mouse
ggcagaggcgctgcctggct

SEQ ID NO: 571650 - DNA, 20 bp, mouse
gtcagtgcctcggtgtgtct

SEQ ID NO: 571651 - DNA, 20 bp, mouse
gcggctgctgctagctgcac

SEQ ID NO: 571652 - DNA, 20 bp, mouse
gtagtgccagcctccgagcc

SEQ ID NO: 571653 - DNA, 20 bp, mouse
gagcaggtgctcggttctgt

SEQ ID NO: 571654 - DNA, 20 bp, mouse
gggggcaagacgctcagaag

SEQ ID NO: 571655 - DNA, 20 bp, mouse
gtcccgggcatccgatgaca

SEQ ID NO: 571656 - DNA, 20 bp, mouse
ggccggagcccgggccgacc

SEQ ID NO: 571657 - DNA, 20 bp, mouse
gcggtgccgggagcagcatg

SEQ ID NO: 571658 - DNA, 20 bp, mouse
ggctgctcccggcaccgggt

SEQ ID NO: 571659 - DNA, 20 bp, mouse
gcccgcccgccaggcagctc

SEQ ID NO: 571660 - DNA, 20 bp, mouse
gcccggcaccgggtcggccc

SEQ ID NO: 571661 - DNA, 20 bp, mouse
gctcgggccgcgcgcacacg

SEQ ID NO: 571662 - DNA, 20 bp, mouse
ggggctccgcatgctgctcc

SEQ ID NO: 571663 - DNA, 20 bp, mouse
gccgtgcaccccggtacctg

SEQ ID NO: 571664 - DNA, 20 bp, mouse
gccccttcggagcacaaagg

SEQ ID NO: 571665 - DNA, 20 bp, mouse
ggacccccttcggagcacaa

SEQ ID NO: 571666 - DNA, 20 bp, mouse
ggcgggcatagacagaccca

SEQ ID NO: 571667 - DNA, 20 bp, mouse
gacgccgaggtagatccgag

SEQ ID NO: 571668 - DNA, 20 bp, mouse
gcagcccgaacgactcacca

SEQ ID NO: 571669 - DNA, 20 bp, mouse
gcttggcgcaggcaatagag

SEQ ID NO: 571670 - DNA, 20 bp, mouse
gagagaggcggtcgaggcag

SEQ ID NO: 571671 - DNA, 20 bp, mouse
gggcgcaggcaatagagagg

SEQ ID NO: 571672 - DNA, 20 bp, mouse
gggcaatagagaggcggtcg

SEQ ID NO: 571673 - DNA, 20 bp, mouse
gcaccacggctgcgaagtcc

SEQ ID NO: 571674 - DNA, 20 bp, mouse
ggcgcggttcgtttgtccgt

SEQ ID NO: 571675 - DNA, 20 bp, mouse
gcggagtccatggaccacag

SEQ ID NO: 571676 - DNA, 20 bp, mouse
ggccagccccgggagcccag

SEQ ID NO: 571677 - DNA, 20 bp, mouse
gcccggggctggctcctctc

SEQ ID NO: 571678 - DNA, 20 bp, mouse
ggcctgggctcggagcgcag

SEQ ID NO: 571679 - DNA, 20 bp, mouse
gccaggcgcggcgcgaactg

SEQ ID NO: 571680 - DNA, 20 bp, mouse
gccggctcccgcagccggag

SEQ ID NO: 571681 - DNA, 20 bp, mouse
gcggcgggcgcactcacctg

SEQ ID NO: 571682 - DNA, 20 bp, mouse
ggcagagggcgagcccgcca

SEQ ID NO: 571683 - DNA, 20 bp, mouse
ggctcggagcgcagcggcgc

SEQ ID NO: 571684 - DNA, 20 bp, mouse
gccgccaaggctccccatcc

SEQ ID NO: 571685 - DNA, 20 bp, mouse
gccaaggctccccatccggg

SEQ ID NO: 571686 - DNA, 20 bp, mouse
ggcgcggcactgctccacta

SEQ ID NO: 571687 - DNA, 20 bp, mouse
gaggcgagcgggagccgtag

SEQ ID NO: 571688 - DNA, 20 bp, mouse
ggagcccgaccgggagccca

SEQ ID NO: 571689 - DNA, 20 bp, mouse
gacgcctccggagcccgacc

SEQ ID NO: 571690 - DNA, 20 bp, mouse
gtggagacccgcagctgggg

SEQ ID NO: 571691 - DNA, 20 bp, mouse
gccgggagcccaaggcgagc

SEQ ID NO: 571692 - DNA, 20 bp, mouse
gtcctggagacccgcagctg

SEQ ID NO: 571693 - DNA, 20 bp, mouse
gtcgccttgggctcccggtc

SEQ ID NO: 571694 - DNA, 20 bp, mouse
gactggcgccgagtccagag

SEQ ID NO: 571695 - DNA, 20 bp, mouse
ggctggggaggcgacgcctc

SEQ ID NO: 571696 - DNA, 20 bp, mouse
gtggccgctgcagcccgctc

SEQ ID NO: 571697 - DNA, 20 bp, mouse
ggctgcagcccgctcaggca

SEQ ID NO: 571698 - DNA, 20 bp, mouse
ggctgcgagcgctcagatcc

SEQ ID NO: 571699 - DNA, 20 bp, mouse
gacgctgtcccctgcctgag

SEQ ID NO: 571700 - DNA, 20 bp, mouse
gacaaggctaggcggcgcgt

SEQ ID NO: 571701 - DNA, 20 bp, mouse
gagcttagggtacagagggt

SEQ ID NO: 571702 - DNA, 20 bp, mouse
gggcccctcgccagccgcag

SEQ ID NO: 571703 - DNA, 20 bp, mouse
gggtacagcttagggtacag

SEQ ID NO: 571704 - DNA, 20 bp, mouse
ggccgcaggggtacagctta

SEQ ID NO: 571705 - DNA, 20 bp, mouse
gcgagcctggaccaagcgcc

SEQ ID NO: 571706 - DNA, 20 bp, mouse
gagcgagcaggagcccagag

SEQ ID NO: 571707 - DNA, 20 bp, mouse
ggagcaggagcccagagcgg

SEQ ID NO: 571708 - DNA, 20 bp, mouse
ggtcccggtgcgcacggacg

SEQ ID NO: 571709 - DNA, 20 bp, mouse
gggactctagccagaactgt

SEQ ID NO: 571710 - DNA, 20 bp, mouse
gcgtcggagccggtccccga

SEQ ID NO: 571711 - DNA, 20 bp, mouse
gagcgacaggcggagatgga

SEQ ID NO: 571712 - DNA, 20 bp, mouse
gcccgcgcctccccttgggt

SEQ ID NO: 571713 - DNA, 20 bp, mouse
ggctagagtcccggtgcgca

SEQ ID NO: 571714 - DNA, 20 bp, mouse
gtggaactggagcgggagac

SEQ ID NO: 571715 - DNA, 20 bp, mouse
ggagccgtgcggggccgacc

SEQ ID NO: 571716 - DNA, 20 bp, mouse
ggcggagttgggccttgagc

SEQ ID NO: 571717 - DNA, 20 bp, mouse
gttgagccggcaggtttccg

SEQ ID NO: 571718 - DNA, 20 bp, mouse
gtcggttccccgggaagcgg

SEQ ID NO: 571719 - DNA, 20 bp, mouse
gccgagcctcggaaacctgc

SEQ ID NO: 571720 - DNA, 20 bp, mouse
gttcccggggaaccgagcct

SEQ ID NO: 571721 - DNA, 20 bp, mouse
ggagtcggcacgttgaagtc

SEQ ID NO: 571722 - DNA, 20 bp, mouse
gccagggatgcggcggagtt

SEQ ID NO: 571723 - DNA, 20 bp, mouse
gttccgaggctcggttcccc

SEQ ID NO: 571724 - DNA, 20 bp, mouse
gcagagggcaacttaggaga

SEQ ID NO: 571725 - DNA, 20 bp, mouse
gatccctggactaaaaagac

SEQ ID NO: 571726 - DNA, 20 bp, mouse
gcaggaaacccggaaggagt

SEQ ID NO: 571727 - DNA, 20 bp, mouse
ggaaggagtcgagacttacc

SEQ ID NO: 571728 - DNA, 20 bp, mouse
gtcctctgcaccgtcctaga

SEQ ID NO: 571729 - DNA, 20 bp, mouse
gggtgagcgagacgagctcc

SEQ ID NO: 571730 - DNA, 20 bp, mouse
gaatcccgcgaggaacctcc

SEQ ID NO: 571731 - DNA, 20 bp, mouse
gcccgcgaggaacctcccgg

SEQ ID NO: 571732 - DNA, 20 bp, mouse
gctcgtctcgctcacctcgc

SEQ ID NO: 571733 - DNA, 20 bp, mouse
gtccttctaggacggtgcag

SEQ ID NO: 571734 - DNA, 20 bp, mouse
gtcccggtggccgaaaggag

SEQ ID NO: 571735 - DNA, 20 bp, mouse
gcaatgccacctctaagagg

SEQ ID NO: 571736 - DNA, 20 bp, mouse
gaagatggcatgctctgggg

SEQ ID NO: 571737 - DNA, 20 bp, mouse
gaggcgtggggagtatccgg

SEQ ID NO: 571738 - DNA, 20 bp, mouse
gccggagggaccctaaacgg

SEQ ID NO: 571739 - DNA, 20 bp, mouse
ggcgccggtgggccaggaaa

SEQ ID NO: 571740 - DNA, 20 bp, mouse
gtccggccagtctgatgatc

SEQ ID NO: 571741 - DNA, 20 bp, mouse
ggtgaggcgtggggagtatc

SEQ ID NO: 571742 - DNA, 20 bp, mouse
gcaaggtggttctcgaggtg

SEQ ID NO: 571743 - DNA, 20 bp, mouse
gtagcttccggaagtacgtg

SEQ ID NO: 571744 - DNA, 20 bp, mouse
gtaatactaagtactgtaca

SEQ ID NO: 571745 - DNA, 20 bp, mouse
gatgcgcaaggtggttctcg

SEQ ID NO: 571746 - DNA, 20 bp, mouse
ggctcgcgctgaaggacacg

SEQ ID NO: 571747 - DNA, 20 bp, mouse
gccgaagaccatgagcgcgg

SEQ ID NO: 571748 - DNA, 20 bp, mouse
gggtccgaagaccatgagcg

SEQ ID NO: 571749 - DNA, 20 bp, mouse
ggtgggttagagccgagctg

SEQ ID NO: 571750 - DNA, 20 bp, mouse
ggcactcacccgggagaggg

SEQ ID NO: 571751 - DNA, 20 bp, mouse
gcgcgtgcggtgacacacgt

SEQ ID NO: 571752 - DNA, 20 bp, mouse
gaggtcacccgccgcgctca

SEQ ID NO: 571753 - DNA, 20 bp, mouse
gccgctagcttgtgagtctt

SEQ ID NO: 571754 - DNA, 20 bp, mouse
gaccccacctgtgcagccgg

SEQ ID NO: 571755 - DNA, 20 bp, mouse
ggcactaccggcactcaccc

SEQ ID NO: 571756 - DNA, 20 bp, mouse
gttagctgtgagctcgtcgt

SEQ ID NO: 571757 - DNA, 20 bp, mouse
gcggtgtgccgggtcgttgg

SEQ ID NO: 571758 - DNA, 20 bp, mouse
ggactgcgccaccaacgacc

SEQ ID NO: 571759 - DNA, 20 bp, mouse
gctgcggtgtgccgggtcgt

SEQ ID NO: 571760 - DNA, 20 bp, mouse
gtcgtgggtgagggcgtctt

SEQ ID NO: 571761 - DNA, 20 bp, mouse
ggtgagctcgtcgtgggtga

SEQ ID NO: 571762 - DNA, 20 bp, mouse
gtcgttggtggcgcagtctt

SEQ ID NO: 571763 - DNA, 20 bp, mouse
ggtcttgggcgagcttgggg

SEQ ID NO: 571764 - DNA, 20 bp, mouse
ggggagggcagacccgggac

SEQ ID NO: 571765 - DNA, 20 bp, mouse
gtgcttgagatcctgaagtg

SEQ ID NO: 571766 - DNA, 20 bp, mouse
ggccatggtgagtgcgtcgt

SEQ ID NO: 571767 - DNA, 20 bp, mouse
ggccgacgacgcactcacca

SEQ ID NO: 571768 - DNA, 20 bp, mouse
gccaaggttagcaggcgcca

SEQ ID NO: 571769 - DNA, 20 bp, mouse
gctaggggccgaggagtagg

SEQ ID NO: 571770 - DNA, 20 bp, mouse
gccagtgcggcgtcagccca

SEQ ID NO: 571771 - DNA, 20 bp, mouse
gggcggccgggtcggatcca

SEQ ID NO: 571772 - DNA, 20 bp, mouse
gggaggcggagcgcttactg

SEQ ID NO: 571773 - DNA, 20 bp, mouse
ggcgtcagcccaaggttagc

SEQ ID NO: 571774 - DNA, 20 bp, mouse
ggttggagttgagtcgcctg

SEQ ID NO: 571775 - DNA, 20 bp, mouse
gaaacatcctagctcggcgt

SEQ ID NO: 571776 - DNA, 20 bp, mouse
ggcccgggagagatagtgtg

SEQ ID NO: 571777 - DNA, 20 bp, mouse
gtctctcccgggctcaaact

SEQ ID NO: 571778 - DNA, 20 bp, mouse
gatttgcttcgcagccgcag

SEQ ID NO: 571779 - DNA, 20 bp, mouse
ggctttggagcgtttattaa

SEQ ID NO: 571780 - DNA, 20 bp, mouse
gacaaagcaggatcgcaggg

SEQ ID NO: 571781 - DNA, 20 bp, mouse
gtcgcagggaggtgcattgc

SEQ ID NO: 571782 - DNA, 20 bp, mouse
gtggacaacgaaatagacaa

SEQ ID NO: 571783 - DNA, 20 bp, mouse
ggctctctggtctgcagtag

SEQ ID NO: 571784 - DNA, 20 bp, mouse
ggagcacaaagcaggatcgc

SEQ ID NO: 571785 - DNA, 20 bp, mouse
gatgaacttacggtcctcgg

SEQ ID NO: 571786 - DNA, 20 bp, mouse
ggacagactcaagggaccaa

SEQ ID NO: 571787 - DNA, 20 bp, mouse
gggatacgagacagactcaa

SEQ ID NO: 571788 - DNA, 20 bp, mouse
ggtcgactagaagagcaggt

SEQ ID NO: 571789 - DNA, 20 bp, mouse
gtcttcaagcacctcatgct

SEQ ID NO: 571790 - DNA, 20 bp, mouse
gggagtcctgtgtacattca

SEQ ID NO: 571791 - DNA, 20 bp, mouse
gattcagggacacaaaaatg

SEQ ID NO: 571792 - DNA, 20 bp, mouse
gggtaggtgtactacacttg

SEQ ID NO: 571793 - DNA, 20 bp, mouse
ggtacacaggactccgtcac

SEQ ID NO: 571794 - DNA, 20 bp, mouse
gaaacaggtgagaatatcgt

SEQ ID NO: 571795 - DNA, 20 bp, mouse
gctccgtcgactagaagagc

SEQ ID NO: 571796 - DNA, 20 bp, mouse
gggccgcgacggacgcaaga

SEQ ID NO: 571797 - DNA, 20 bp, mouse
ggacggacgcaagatggcga

SEQ ID NO: 571798 - DNA, 20 bp, mouse
ggcgcgcgcggcggccgcga

SEQ ID NO: 571799 - DNA, 20 bp, mouse
gtgagtccctcgcggccagg

SEQ ID NO: 571800 - DNA, 20 bp, mouse
gctcgtaagtgagtccctcg

SEQ ID NO: 571801 - DNA, 20 bp, mouse
gagatcgcgcgagactgcgg

SEQ ID NO: 571802 - DNA, 20 bp, mouse
gcgagctgagggccgccccc

SEQ ID NO: 571803 - DNA, 20 bp, mouse
ggctcggaggagtgagtcgt

SEQ ID NO: 571804 - DNA, 20 bp, mouse
gatgcttgtggcgcgcgcgg

SEQ ID NO: 571805 - DNA, 20 bp, mouse
ggccccgcggggatccagca

SEQ ID NO: 571806 - DNA, 20 bp, mouse
gccggcgagcgaagatcggg

SEQ ID NO: 571807 - DNA, 20 bp, mouse
gccggggcgcggatactcac

SEQ ID NO: 571808 - DNA, 20 bp, mouse
ggcgccggcgagcgaagatc

SEQ ID NO: 571809 - DNA, 20 bp, mouse
ggtcggagtgaaaggtaagg

SEQ ID NO: 571810 - DNA, 20 bp, mouse
ggttgtcggagtgaaaggta

SEQ ID NO: 571811 - DNA, 20 bp, mouse
gtactcacgggcggagcggt

SEQ ID NO: 571812 - DNA, 20 bp, mouse
ggccatgttgtcggagtgaa

SEQ ID NO: 571813 - DNA, 20 bp, mouse
gcggatactcacgggcggag

SEQ ID NO: 571814 - DNA, 20 bp, mouse
gcggttggcggggcgagaaa

SEQ ID NO: 571815 - DNA, 20 bp, mouse
gcggagcggtaggatgaaga

SEQ ID NO: 571816 - DNA, 20 bp, mouse
gcaccgaagtaccgagggtg

SEQ ID NO: 571817 - DNA, 20 bp, mouse
ggagcgcgggctgacttaca

SEQ ID NO: 571818 - DNA, 20 bp, mouse
gcgaaccaccgaagtaccga

SEQ ID NO: 571819 - DNA, 20 bp, mouse
gttcggtggttcggaggagg

SEQ ID NO: 571820 - DNA, 20 bp, mouse
gtacttcggtggttcggagg

SEQ ID NO: 571821 - DNA, 20 bp, mouse
ggacccgacgaagcgagcgc

SEQ ID NO: 571822 - DNA, 20 bp, mouse
gaccgaccgttgggcaccgg

SEQ ID NO: 571823 - DNA, 20 bp, mouse
gcccaacggtcggtgtcccc

SEQ ID NO: 571824 - DNA, 20 bp, mouse
gcgtcgccgccggtgcccaa

SEQ ID NO: 571825 - DNA, 20 bp, mouse
gaagacgtcgccgccaccgg

SEQ ID NO: 571826 - DNA, 20 bp, mouse
gagtcgtggcagccagacgt

SEQ ID NO: 571827 - DNA, 20 bp, mouse
gcggcgagcggatcccgcta

SEQ ID NO: 571828 - DNA, 20 bp, mouse
gccgccgccacggcgagtcg

SEQ ID NO: 571829 - DNA, 20 bp, mouse
gtggctgccacgactcgccg

SEQ ID NO: 571830 - DNA, 20 bp, mouse
gcggatcccgctagggaagg

SEQ ID NO: 571831 - DNA, 20 bp, mouse
ggagcggatcccgctaggga

SEQ ID NO: 571832 - DNA, 20 bp, mouse
gctgccacgactcgccgtgg

SEQ ID NO: 571833 - DNA, 20 bp, mouse
gcgggttacgcgccgacgtc

SEQ ID NO: 571834 - DNA, 20 bp, mouse
ggccggcccgcgggagtgaa

SEQ ID NO: 571835 - DNA, 20 bp, mouse
ggggccgcgcgcgaggggag

SEQ ID NO: 571836 - DNA, 20 bp, mouse
gggcggcgaccggcgatgag

SEQ ID NO: 571837 - DNA, 20 bp, mouse
ggaggcggcggccgagaaga

SEQ ID NO: 571838 - DNA, 20 bp, mouse
gtgccgcacggaagccgcgg

SEQ ID NO: 571839 - DNA, 20 bp, mouse
gacagcggcagcgagcgcgg

SEQ ID NO: 571840 - DNA, 20 bp, mouse
ggcaggagctggcctcgaag

SEQ ID NO: 571841 - DNA, 20 bp, mouse
gggcgaccggcgatgagcgg

SEQ ID NO: 571842 - DNA, 20 bp, mouse
gagatggcggacggcgacag

SEQ ID NO: 571843 - DNA, 20 bp, mouse
ggcgcggaggcgatgggggg

SEQ ID NO: 571844 - DNA, 20 bp, mouse
gggcgcgcgtgaggagccgg

SEQ ID NO: 571845 - DNA, 20 bp, mouse
gcgcgcccgccgctcatcgc

SEQ ID NO: 571846 - DNA, 20 bp, mouse
gggtgcccgaatccaggcag

SEQ ID NO: 571847 - DNA, 20 bp, mouse
ggcagcggccgcaggaggcg

SEQ ID NO: 571848 - DNA, 20 bp, mouse
gcggcggcggtggtcgtgaa

SEQ ID NO: 571849 - DNA, 20 bp, mouse
ggccccccgccggagcagcg

SEQ ID NO: 571850 - DNA, 20 bp, mouse
gtcgtgaagggcatcggtga

SEQ ID NO: 571851 - DNA, 20 bp, mouse
gcggctggctgggacccccg

SEQ ID NO: 571852 - DNA, 20 bp, mouse
gtccaggcagcggccgcagg

SEQ ID NO: 571853 - DNA, 20 bp, mouse
gacggagatgatgtgagtgt

SEQ ID NO: 571854 - DNA, 20 bp, mouse
gggggcaggggcatcgcctg

SEQ ID NO: 571855 - DNA, 20 bp, mouse
gcgggccggtgcccgaatcc

SEQ ID NO: 571856 - DNA, 20 bp, mouse
ggtcccgccggacccactca

SEQ ID NO: 571857 - DNA, 20 bp, mouse
gcagccggcgcgctcgagga

SEQ ID NO: 571858 - DNA, 20 bp, mouse
ggcgccgtgagtgggtccgg

SEQ ID NO: 571859 - DNA, 20 bp, mouse
gccaagacatctggaagaca

SEQ ID NO: 571860 - DNA, 20 bp, mouse
gtgcacgtggtcagcttcgg

SEQ ID NO: 571861 - DNA, 20 bp, mouse
gccggcgcgctcgaggaggg

SEQ ID NO: 571862 - DNA, 20 bp, mouse
ggacacaggtaagcaaggag

SEQ ID NO: 571863 - DNA, 20 bp, mouse
gctgcggcgccccagatcct

SEQ ID NO: 571864 - DNA, 20 bp, mouse
gggttccgcggcgccgtgag

SEQ ID NO: 571865 - DNA, 20 bp, mouse
gggagggaggaaagtcccgc

SEQ ID NO: 571866 - DNA, 20 bp, mouse
gtaggtgccgagtccgtcgg

SEQ ID NO: 571867 - DNA, 20 bp, mouse
gacctaggtgccgagtccgt

SEQ ID NO: 571868 - DNA, 20 bp, mouse
gccggcaaaggagcctccga

SEQ ID NO: 571869 - DNA, 20 bp, mouse
gactgctagccttaaagggt

SEQ ID NO: 571870 - DNA, 20 bp, mouse
ggtaaggcctaggaagtacg

SEQ ID NO: 571871 - DNA, 20 bp, mouse
ggcagcagctactacgacct

SEQ ID NO: 571872 - DNA, 20 bp, mouse
ggccgaaaagggttaagact

SEQ ID NO: 571873 - DNA, 20 bp, mouse
ggactcggctgcggcatctt

SEQ ID NO: 571874 - DNA, 20 bp, mouse
gtcctctggcatgggagtag

SEQ ID NO: 571875 - DNA, 20 bp, mouse
gttaaagggtcggccggcaa

SEQ ID NO: 571876 - DNA, 20 bp, mouse
gccgcctactgaggaccgga

SEQ ID NO: 571877 - DNA, 20 bp, mouse
gtcctcagtaggcggccatg

SEQ ID NO: 571878 - DNA, 20 bp, mouse
gtcaccttccggtcctcagt

SEQ ID NO: 571879 - DNA, 20 bp, mouse
gcagcaccacggagagatca

SEQ ID NO: 571880 - DNA, 20 bp, mouse
ggccgcatggccgcctactg

SEQ ID NO: 571881 - DNA, 20 bp, mouse
gtgcggctagccggaagcta

SEQ ID NO: 571882 - DNA, 20 bp, mouse
gagagagaaagtgggcacgg

SEQ ID NO: 571883 - DNA, 20 bp, mouse
gcaggtgtgaggttgcacag

SEQ ID NO: 571884 - DNA, 20 bp, mouse
ggcatctttgagttctagag

SEQ ID NO: 571885 - DNA, 20 bp, mouse
gagctaggaaatcccatcgg

SEQ ID NO: 571886 - DNA, 20 bp, mouse
gggccagcgccgaccagcac

SEQ ID NO: 571887 - DNA, 20 bp, mouse
gcaccgcgtggagacgcaca

SEQ ID NO: 571888 - DNA, 20 bp, mouse
ggcgtggagacgcacaggga

SEQ ID NO: 571889 - DNA, 20 bp, mouse
gggcggtgactcgcaggagg

SEQ ID NO: 571890 - DNA, 20 bp, mouse
gagctggcggcggagaaaca

SEQ ID NO: 571891 - DNA, 20 bp, mouse
gcgcacgtgtgcgagcccgg

SEQ ID NO: 571892 - DNA, 20 bp, mouse
gtggccccaggcctccggag

SEQ ID NO: 571893 - DNA, 20 bp, mouse
gcagcacaggctgcaccgcg

SEQ ID NO: 571894 - DNA, 20 bp, mouse
gcgcgggccgagcggagaag

SEQ ID NO: 571895 - DNA, 20 bp, mouse
gtgcgagcccggcggctggt

SEQ ID NO: 571896 - DNA, 20 bp, mouse
gtcggcggaccactttctca

SEQ ID NO: 571897 - DNA, 20 bp, mouse
gtgcgcactgtgtcactcgg

SEQ ID NO: 571898 - DNA, 20 bp, mouse
ggtcaagaggcgggcagaca

SEQ ID NO: 571899 - DNA, 20 bp, mouse
ggcatgcgcactgtgtcact

SEQ ID NO: 571900 - DNA, 20 bp, mouse
gagagctcacagagtctatt

SEQ ID NO: 571901 - DNA, 20 bp, mouse
gtaggatgccgggtcaccgg

SEQ ID NO: 571902 - DNA, 20 bp, mouse
gccagcagtcttggatccac

SEQ ID NO: 571903 - DNA, 20 bp, mouse
gcttggatccaccggtgacc

SEQ ID NO: 571904 - DNA, 20 bp, mouse
gtattaggatgccgggtcac

SEQ ID NO: 571905 - DNA, 20 bp, mouse
gaggcggcggaaaggcttct

SEQ ID NO: 571906 - DNA, 20 bp, mouse
ggccccgcccgctcaaatat

SEQ ID NO: 571907 - DNA, 20 bp, mouse
gtaggagccgaggaacacag

SEQ ID NO: 571908 - DNA, 20 bp, mouse
ggcaggagcccatatttgag

SEQ ID NO: 571909 - DNA, 20 bp, mouse
gaatatgggctcctgcgggg

SEQ ID NO: 571910 - DNA, 20 bp, mouse
ggaggacagagcgcagcgac

SEQ ID NO: 571911 - DNA, 20 bp, mouse
gcggtcgacccagcccagca

SEQ ID NO: 571912 - DNA, 20 bp, mouse
gcaagtactgcaagaacaca

SEQ ID NO: 571913 - DNA, 20 bp, mouse
gtccgcgaggtgaccaggac

SEQ ID NO: 571914 - DNA, 20 bp, mouse
gggccgagtggagaacgcgg

SEQ ID NO: 571915 - DNA, 20 bp, mouse
gcacggccgcaaccccactg

SEQ ID NO: 571916 - DNA, 20 bp, mouse
ggcttaccttggatgagcag

SEQ ID NO: 571917 - DNA, 20 bp, mouse
gcagaggctaccgcttacct

SEQ ID NO: 571918 - DNA, 20 bp, mouse
ggctggtgggagatcctgtt

SEQ ID NO: 571919 - DNA, 20 bp, mouse
gagctgaggtccatccttgg

SEQ ID NO: 571920 - DNA, 20 bp, mouse
ggtgcgtctgagccacatac

SEQ ID NO: 571921 - DNA, 20 bp, mouse
gcggtagcctctgaggttgg

SEQ ID NO: 571922 - DNA, 20 bp, mouse
gtgttgggaaatgagactcg

SEQ ID NO: 571923 - DNA, 20 bp, mouse
gacctctcagctccatctga

SEQ ID NO: 571924 - DNA, 20 bp, mouse
gtgggaaatgagactcgtgg

SEQ ID NO: 571925 - DNA, 20 bp, mouse
gagcctctgaggttggagga

SEQ ID NO: 571926 - DNA, 20 bp, mouse
gatggagacccgatgcgtga

SEQ ID NO: 571927 - DNA, 20 bp, mouse
gaggagctaaccccctagga

SEQ ID NO: 571928 - DNA, 20 bp, mouse
gtgcgtgagggaagaaactg

SEQ ID NO: 571929 - DNA, 20 bp, mouse
gccaagtgcgaagaccaggg

SEQ ID NO: 571930 - DNA, 20 bp, mouse
gggaccaagtgcgaagacca

SEQ ID NO: 571931 - DNA, 20 bp, mouse
gaccaaggagctaaccccct

SEQ ID NO: 571932 - DNA, 20 bp, mouse
ggcatcgggtctccatccta

SEQ ID NO: 571933 - DNA, 20 bp, mouse
gacccttctacacttctcag

SEQ ID NO: 571934 - DNA, 20 bp, mouse
ggtgcattgctcaccagcaa

SEQ ID NO: 571935 - DNA, 20 bp, mouse
gaggacatcaagaaggcgat

SEQ ID NO: 571936 - DNA, 20 bp, mouse
gtcagggtttcggagagata

SEQ ID NO: 571937 - DNA, 20 bp, mouse
ggcgcttggccgttactaac

SEQ ID NO: 571938 - DNA, 20 bp, mouse
gggatcggaccggaaccaca

SEQ ID NO: 571939 - DNA, 20 bp, mouse
gaccggccaccggagtacag

SEQ ID NO: 571940 - DNA, 20 bp, mouse
gacaaagagctggatcggac

SEQ ID NO: 571941 - DNA, 20 bp, mouse
gtttgtagtccagttagtaa

SEQ ID NO: 571942 - DNA, 20 bp, mouse
gcacctcgagaggccctccc

SEQ ID NO: 571943 - DNA, 20 bp, mouse
gggactacaaagagctggat

SEQ ID NO: 571944 - DNA, 20 bp, mouse
gcctagggacggcccattga

SEQ ID NO: 571945 - DNA, 20 bp, mouse
gggcctgtgcgcacctcgag

SEQ ID NO: 571946 - DNA, 20 bp, mouse
gtgccgccggctcagagcct

SEQ ID NO: 571947 - DNA, 20 bp, mouse
gccccatccgagccatcggg

SEQ ID NO: 571948 - DNA, 20 bp, mouse
gtgccgaggctctgagccgg

SEQ ID NO: 571949 - DNA, 20 bp, mouse
ggtcacgcttggataagggg

SEQ ID NO: 571950 - DNA, 20 bp, mouse
gatctgccgaggctctgagc

SEQ ID NO: 571951 - DNA, 20 bp, mouse
ggatccgcgcggccgcaatc

SEQ ID NO: 571952 - DNA, 20 bp, mouse
gccggacccccaccccccga

SEQ ID NO: 571953 - DNA, 20 bp, mouse
ggcgccgctggacgctggtg

SEQ ID NO: 571954 - DNA, 20 bp, mouse
ggactcgtgcaacttactgc

SEQ ID NO: 571955 - DNA, 20 bp, mouse
gtccggtccccggctgccgc

SEQ ID NO: 571956 - DNA, 20 bp, mouse
ggcgtcggtgacaatctgga

SEQ ID NO: 571957 - DNA, 20 bp, mouse
ggatcctgagagccaggcga

SEQ ID NO: 571958 - DNA, 20 bp, mouse
gggccgaacgaactgatccg

SEQ ID NO: 571959 - DNA, 20 bp, mouse
gagccaggcgagggaaagct

SEQ ID NO: 571960 - DNA, 20 bp, mouse
ggtagggccaacctagaagg

SEQ ID NO: 571961 - DNA, 20 bp, mouse
gctggacggcgggaggactg

SEQ ID NO: 571962 - DNA, 20 bp, mouse
gtgatccggggagccgtgag

SEQ ID NO: 571963 - DNA, 20 bp, mouse
gggcgcggatcctgagagcc

SEQ ID NO: 571964 - DNA, 20 bp, mouse
ggcggcaacaacggcagcgt

SEQ ID NO: 571965 - DNA, 20 bp, mouse
gggcagcgtcggtgacaatc

SEQ ID NO: 571966 - DNA, 20 bp, mouse
gatcggcgacggcggagtcg

SEQ ID NO: 571967 - DNA, 20 bp, mouse
gcgagcgctcggccgagtgg

SEQ ID NO: 571968 - DNA, 20 bp, mouse
gtcggcagtggcatcggcga

SEQ ID NO: 571969 - DNA, 20 bp, mouse
gtcagcctcggcagtggcat

SEQ ID NO: 571970 - DNA, 20 bp, mouse
ggtcgccgcccgccgccact

SEQ ID NO: 571971 - DNA, 20 bp, mouse
ggcggctcccgcttcagcct

SEQ ID NO: 571972 - DNA, 20 bp, mouse
gccgcctccaggacacaacg

SEQ ID NO: 571973 - DNA, 20 bp, mouse
ggcgacggcgcaggagccgg

SEQ ID NO: 571974 - DNA, 20 bp, mouse
gcgctcggccgagtggcggc

SEQ ID NO: 571975 - DNA, 20 bp, mouse
ggccgcgggaggaaacgccg

SEQ ID NO: 571976 - DNA, 20 bp, mouse
gacgccgtggccaacaacga

SEQ ID NO: 571977 - DNA, 20 bp, mouse
ggcgtgggaagcagctctgg

SEQ ID NO: 571978 - DNA, 20 bp, mouse
ggctcccagggagaactccg

SEQ ID NO: 571979 - DNA, 20 bp, mouse
gcccgagcacggcttcttgg

SEQ ID NO: 571980 - DNA, 20 bp, mouse
gagctcagggctcccgagca

SEQ ID NO: 571981 - DNA, 20 bp, mouse
gagttctacccacccagccg

SEQ ID NO: 571982 - DNA, 20 bp, mouse
gcagtgactctggagttcca

SEQ ID NO: 571983 - DNA, 20 bp, mouse
gccctagtggagaccccaag

SEQ ID NO: 571984 - DNA, 20 bp, mouse
gctgccttcgttgttggcca

SEQ ID NO: 571985 - DNA, 20 bp, mouse
gagttccacggagttctccc

SEQ ID NO: 571986 - DNA, 20 bp, mouse
gcggcgcaggttggagccct

SEQ ID NO: 571987 - DNA, 20 bp, mouse
gcccagcaggagccacgcga

SEQ ID NO: 571988 - DNA, 20 bp, mouse
ggtgggctcggccccgtctg

SEQ ID NO: 571989 - DNA, 20 bp, mouse
gactcttgagctccgcggag

SEQ ID NO: 571990 - DNA, 20 bp, mouse
ggccaaagagactccagaca

SEQ ID NO: 571991 - DNA, 20 bp, mouse
gagagactccagacaaggtg

SEQ ID NO: 571992 - DNA, 20 bp, mouse
ggtttgaacccggcgcaggt

SEQ ID NO: 571993 - DNA, 20 bp, mouse
gacactactcttgagctccg

SEQ ID NO: 571994 - DNA, 20 bp, mouse
ggtggcatctccccatacac

SEQ ID NO: 571995 - DNA, 20 bp, mouse
ggcggaggggaacaacgcgc

SEQ ID NO: 571996 - DNA, 20 bp, mouse
gtccggaagtggttgcagta

SEQ ID NO: 571997 - DNA, 20 bp, mouse
gcatcctggaaccacacgtg

SEQ ID NO: 571998 - DNA, 20 bp, mouse
gcagtacggtaccccacgtg

SEQ ID NO: 571999 - DNA, 20 bp, mouse
gccgggcaggggcaacggga

SEQ ID NO: 572000 - DNA, 20 bp, mouse
gcggtaagcgaatttcatcc

SEQ ID NO: 572001 - DNA, 20 bp, mouse
ggtacagcccgagacctgtt

SEQ ID NO: 572002 - DNA, 20 bp, mouse
ggcagagctaggctcctaag

SEQ ID NO: 572003 - DNA, 20 bp, mouse
gtgagcggcgggccgggcag

SEQ ID NO: 572004 - DNA, 20 bp, mouse
gctcctacccaacaggtctc

SEQ ID NO: 572005 - DNA, 20 bp, mouse
gtaaggcaggagtcgatctg

SEQ ID NO: 572006 - DNA, 20 bp, mouse
gcgcagcccgagtaggagga

SEQ ID NO: 572007 - DNA, 20 bp, mouse
ggccgccgcctcagcagcca

SEQ ID NO: 572008 - DNA, 20 bp, mouse
ggaaaccagcgagaaaatgg

SEQ ID NO: 572009 - DNA, 20 bp, mouse
gcggcgtcccccggggaagg

SEQ ID NO: 572010 - DNA, 20 bp, mouse
gggagaaaccagcgagaaaa

SEQ ID NO: 572011 - DNA, 20 bp, mouse
gcgccggcgcccccttcccc

SEQ ID NO: 572012 - DNA, 20 bp, mouse
ggcgaccgcggcgtcccccg

SEQ ID NO: 572013 - DNA, 20 bp, mouse
ggatagctccgaggctgagg

SEQ ID NO: 572014 - DNA, 20 bp, mouse
gtatcggccagctcccccgg

SEQ ID NO: 572015 - DNA, 20 bp, mouse
gagcgagaaaatggcggccg

SEQ ID NO: 572016 - DNA, 20 bp, mouse
ggggtggaacaggtcgtcaa

SEQ ID NO: 572017 - DNA, 20 bp, mouse
gcgacctgttccacccgcac

SEQ ID NO: 572018 - DNA, 20 bp, mouse
gttgccggtgcgggtggaac

SEQ ID NO: 572019 - DNA, 20 bp, mouse
gtggtggtcaccgtgagctg

SEQ ID NO: 572020 - DNA, 20 bp, mouse
gctgcgctcgccacagctca

SEQ ID NO: 572021 - DNA, 20 bp, mouse
gttccaatgcaggctccgag

SEQ ID NO: 572022 - DNA, 20 bp, mouse
gatgctcccgccgcctccgg

SEQ ID NO: 572023 - DNA, 20 bp, mouse
ggcaaccggcagccggcccg

SEQ ID NO: 572024 - DNA, 20 bp, mouse
gcggctgccggttgccggtg

SEQ ID NO: 572025 - DNA, 20 bp, mouse
gcggcgggagcatggagccg

SEQ ID NO: 572026 - DNA, 20 bp, mouse
gcagctctgcgctcactctg

SEQ ID NO: 572027 - DNA, 20 bp, mouse
gctctgcgctcactctgggg

SEQ ID NO: 572028 - DNA, 20 bp, mouse
gggagtctgtgggactgaac

SEQ ID NO: 572029 - DNA, 20 bp, mouse
gcggttaagagtccccgtgg

SEQ ID NO: 572030 - DNA, 20 bp, mouse
gggcgccgccaggagtctgt

SEQ ID NO: 572031 - DNA, 20 bp, mouse
ggcctgggcagagtgagtcc

SEQ ID NO: 572032 - DNA, 20 bp, mouse
ggagctgcggcgtattcgcg

SEQ ID NO: 572033 - DNA, 20 bp, mouse
gactctggggcggctacgtg

SEQ ID NO: 572034 - DNA, 20 bp, mouse
ggtccccgtgggggagaagt

SEQ ID NO: 572035 - DNA, 20 bp, mouse
gccccgcctggggtccgcct

SEQ ID NO: 572036 - DNA, 20 bp, mouse
gtggcacgcgtgaacagcag

SEQ ID NO: 572037 - DNA, 20 bp, mouse
ggcagcggaggaggcctcgg

SEQ ID NO: 572038 - DNA, 20 bp, mouse
gacgtgggccggggaccgga

SEQ ID NO: 572039 - DNA, 20 bp, mouse
gctcagttgggagccggcgg

SEQ ID NO: 572040 - DNA, 20 bp, mouse
gagatggcgcggacaggagc

SEQ ID NO: 572041 - DNA, 20 bp, mouse
gcacggtggtacggaaacac

SEQ ID NO: 572042 - DNA, 20 bp, mouse
gcatggcagatggcgcggac

SEQ ID NO: 572043 - DNA, 20 bp, mouse
ggggctcagttgggagccgg

SEQ ID NO: 572044 - DNA, 20 bp, mouse
ggtggtcgcctcgaagcaag

SEQ ID NO: 572045 - DNA, 20 bp, mouse
gggtacggaaacacaggcag

SEQ ID NO: 572046 - DNA, 20 bp, mouse
ggttcctgccccggcttcag

SEQ ID NO: 572047 - DNA, 20 bp, mouse
gtctccatgaaggccatccc

SEQ ID NO: 572048 - DNA, 20 bp, mouse
gcggtgcgcgttgacagcag

SEQ ID NO: 572049 - DNA, 20 bp, mouse
gaaggtgctgctggacgaca

SEQ ID NO: 572050 - DNA, 20 bp, mouse
ggctaggacccagcgaggtc

SEQ ID NO: 572051 - DNA, 20 bp, mouse
ggcagcaccttgccagccgg

SEQ ID NO: 572052 - DNA, 20 bp, mouse
ggccggcaggcagagacgac

SEQ ID NO: 572053 - DNA, 20 bp, mouse
gcctcgacggccgctgtcag

SEQ ID NO: 572054 - DNA, 20 bp, mouse
gccgggcgaaggccggacgg

SEQ ID NO: 572055 - DNA, 20 bp, mouse
ggtcctagcgccgttcttca

SEQ ID NO: 572056 - DNA, 20 bp, mouse
gctcgctgagggcggaggaa

SEQ ID NO: 572057 - DNA, 20 bp, mouse
gattgggcgagcgctcgctt

SEQ ID NO: 572058 - DNA, 20 bp, mouse
gtttaggagcagcaagtatt

SEQ ID NO: 572059 - DNA, 20 bp, mouse
ggcgggtggaatccgagctc

SEQ ID NO: 572060 - DNA, 20 bp, mouse
gacctgcggcgtccaggctg

SEQ ID NO: 572061 - DNA, 20 bp, mouse
gcggaccgcgatggcacctg

SEQ ID NO: 572062 - DNA, 20 bp, mouse
gcaggggaggttaagagagg

SEQ ID NO: 572063 - DNA, 20 bp, mouse
gttagacatccggaccgcga

SEQ ID NO: 572064 - DNA, 20 bp, mouse
gctgcaggggaggttaagag

SEQ ID NO: 572065 - DNA, 20 bp, mouse
ggcacccggcccgggacaca

SEQ ID NO: 572066 - DNA, 20 bp, mouse
gagagcctgtagctgcggtg

SEQ ID NO: 572067 - DNA, 20 bp, mouse
gggtggggcggccatagcac

SEQ ID NO: 572068 - DNA, 20 bp, mouse
gcaccggagcactcggtcaa

SEQ ID NO: 572069 - DNA, 20 bp, mouse
ggccatagcaccggagcact

SEQ ID NO: 572070 - DNA, 20 bp, mouse
gagcactcggtcaagggtcc

SEQ ID NO: 572071 - DNA, 20 bp, mouse
gtaaaggacgggcctaactg

SEQ ID NO: 572072 - DNA, 20 bp, mouse
gtgagtagggccgcagagtg

SEQ ID NO: 572073 - DNA, 20 bp, mouse
gaccgagtgctccggtgcta

SEQ ID NO: 572074 - DNA, 20 bp, mouse
gctcggtcaagggtcctggc

SEQ ID NO: 572075 - DNA, 20 bp, mouse
ggccaagaactgacagccct

SEQ ID NO: 572076 - DNA, 20 bp, mouse
ggtccagcctcggcccggaa

SEQ ID NO: 572077 - DNA, 20 bp, mouse
gcgaggagcagcccggagac

SEQ ID NO: 572078 - DNA, 20 bp, mouse
gctctgagaccgagtcccat

SEQ ID NO: 572079 - DNA, 20 bp, mouse
ggcggcagcgggttccgttc

SEQ ID NO: 572080 - DNA, 20 bp, mouse
ggggtggggaagccaagtga

SEQ ID NO: 572081 - DNA, 20 bp, mouse
gcaggcgccgcagcgaagag

SEQ ID NO: 572082 - DNA, 20 bp, mouse
ggccctcgctgcccgtctcc

SEQ ID NO: 572083 - DNA, 20 bp, mouse
gcagcacagccccgggccgt

SEQ ID NO: 572084 - DNA, 20 bp, mouse
gttccgttccgggccgaggc

SEQ ID NO: 572085 - DNA, 20 bp, mouse
gcccagccgggcgctagggt

SEQ ID NO: 572086 - DNA, 20 bp, mouse
gtgcagcaaaggcaaggcgg

SEQ ID NO: 572087 - DNA, 20 bp, mouse
gaagcccaagctccaaacag

SEQ ID NO: 572088 - DNA, 20 bp, mouse
gacagctcagtaggggggaa

SEQ ID NO: 572089 - DNA, 20 bp, mouse
gggcttctgagcagttaggc

SEQ ID NO: 572090 - DNA, 20 bp, mouse
gtttacacagctcagtaggg

SEQ ID NO: 572091 - DNA, 20 bp, mouse
gtccaaacagcggtcggtag

SEQ ID NO: 572092 - DNA, 20 bp, mouse
gccaagctccaaacagcggt

SEQ ID NO: 572093 - DNA, 20 bp, mouse
ggtttttacacagctcagta

SEQ ID NO: 572094 - DNA, 20 bp, mouse
gaccagaaacagaaggtcga

SEQ ID NO: 572095 - DNA, 20 bp, mouse
gccctggccatgggagaccg

SEQ ID NO: 572096 - DNA, 20 bp, mouse
gctgccagcccgccaagacc

SEQ ID NO: 572097 - DNA, 20 bp, mouse
ggctctggggtgggcagccg

SEQ ID NO: 572098 - DNA, 20 bp, mouse
gctgcagcagggccccgcgt

SEQ ID NO: 572099 - DNA, 20 bp, mouse
ggcatctcgtgcccgcccca

SEQ ID NO: 572100 - DNA, 20 bp, mouse
gctggtgtgcaggaagttga

SEQ ID NO: 572101 - DNA, 20 bp, mouse
gctgcccaccccagagccat

SEQ ID NO: 572102 - DNA, 20 bp, mouse
gcgggcacgagatgccatcc

SEQ ID NO: 572103 - DNA, 20 bp, mouse
ggtgcccgccccatggctct

SEQ ID NO: 572104 - DNA, 20 bp, mouse
ggcctaagcagctgacttcc

SEQ ID NO: 572105 - DNA, 20 bp, mouse
gtgcaactgcgagaaggcta

SEQ ID NO: 572106 - DNA, 20 bp, mouse
gcgcgtggcgaatgcaagaa

SEQ ID NO: 572107 - DNA, 20 bp, mouse
gacccacagcgtggatattc

SEQ ID NO: 572108 - DNA, 20 bp, mouse
gctgtgggtagcgggacttg

SEQ ID NO: 572109 - DNA, 20 bp, mouse
gacccgaatatccacgctgt

SEQ ID NO: 572110 - DNA, 20 bp, mouse
gagctgacgccggctctgta

SEQ ID NO: 572111 - DNA, 20 bp, mouse
gagcacctggctgctaggaa

SEQ ID NO: 572112 - DNA, 20 bp, mouse
gagtcccgctacccacagcg

SEQ ID NO: 572113 - DNA, 20 bp, mouse
gatatccacgctgtgggtag

SEQ ID NO: 572114 - DNA, 20 bp, mouse
ggtagtggtacggggtgtcg

SEQ ID NO: 572115 - DNA, 20 bp, mouse
gtgctaggaacggccagact

SEQ ID NO: 572116 - DNA, 20 bp, mouse
gtggacacgtggccaaccgg

SEQ ID NO: 572117 - DNA, 20 bp, mouse
ggcctctctagcagttcatc

SEQ ID NO: 572118 - DNA, 20 bp, mouse
gtggatgctctgggatactt

SEQ ID NO: 572119 - DNA, 20 bp, mouse
gaagatggacccgaattgct

SEQ ID NO: 572120 - DNA, 20 bp, mouse
gaccagatgaactgctagag

SEQ ID NO: 572121 - DNA, 20 bp, mouse
gccggaggctgcgtatttgg

SEQ ID NO: 572122 - DNA, 20 bp, mouse
ggtccgcgcgtggaaaaaga

SEQ ID NO: 572123 - DNA, 20 bp, mouse
gccctgagcgcagacaccgt

SEQ ID NO: 572124 - DNA, 20 bp, mouse
gctcggaacagctttcaaac

SEQ ID NO: 572125 - DNA, 20 bp, mouse
ggaggctgcgtatttggcgg

SEQ ID NO: 572126 - DNA, 20 bp, mouse
gccacgaagcccacacgccg

SEQ ID NO: 572127 - DNA, 20 bp, mouse
gctgccgcaaggacgagaga

SEQ ID NO: 572128 - DNA, 20 bp, mouse
gggcgacaatgtctgaacct

SEQ ID NO: 572129 - DNA, 20 bp, mouse
ggtgggtgcaggccgcatgg

SEQ ID NO: 572130 - DNA, 20 bp, mouse
gcggtcaaagcagttctagt

SEQ ID NO: 572131 - DNA, 20 bp, mouse
gtgtctgaacctcggcgtgt

SEQ ID NO: 572132 - DNA, 20 bp, mouse
gggtacaccaagggccagta

SEQ ID NO: 572133 - DNA, 20 bp, mouse
gggcgcacgtggtacaccaa

SEQ ID NO: 572134 - DNA, 20 bp, mouse
gtggccttctctcgtccttg

SEQ ID NO: 572135 - DNA, 20 bp, mouse
gggcgggacccgctgccgca

SEQ ID NO: 572136 - DNA, 20 bp, mouse
ggtggtatccagcctttgca

SEQ ID NO: 572137 - DNA, 20 bp, mouse
gtcatagagaaagcacgggg

SEQ ID NO: 572138 - DNA, 20 bp, mouse
gactctttagaggtaagcca

SEQ ID NO: 572139 - DNA, 20 bp, mouse
ggcattcatagagaaagcac

SEQ ID NO: 572140 - DNA, 20 bp, mouse
ggtaagactgactggaaaac

SEQ ID NO: 572141 - DNA, 20 bp, mouse
gtatgaatgcacaagactac

SEQ ID NO: 572142 - DNA, 20 bp, mouse
gtatccagcctttgcagggc

SEQ ID NO: 572143 - DNA, 20 bp, mouse
gtcttattattcacttaccc

SEQ ID NO: 572144 - DNA, 20 bp, mouse
gtataaaatatactctttag

SEQ ID NO: 572145 - DNA, 20 bp, mouse
gctccaccagtaagactgac

SEQ ID NO: 572146 - DNA, 20 bp, mouse
ggtaagactgatccgaaaag

SEQ ID NO: 572147 - DNA, 20 bp, mouse
gtcttactggtggaagaata

SEQ ID NO: 572148 - DNA, 20 bp, mouse
gaggataagtgaataagaag

SEQ ID NO: 572149 - DNA, 20 bp, mouse
gcttggctcataaatatgct

SEQ ID NO: 572150 - DNA, 20 bp, mouse
gacgtttttttaggtaagtc

SEQ ID NO: 572151 - DNA, 20 bp, mouse
gataaaatacacgttttttt

SEQ ID NO: 572152 - DNA, 20 bp, mouse
ggtgttttcagagagagaga

SEQ ID NO: 572153 - DNA, 20 bp, mouse
gatccctgttgatcttttgg

SEQ ID NO: 572154 - DNA, 20 bp, mouse
gctctcagaaggtgatacag

SEQ ID NO: 572155 - DNA, 20 bp, mouse
gctccaccaaaagatcaaca

SEQ ID NO: 572156 - DNA, 20 bp, mouse
gttcgccatggcgccagaag

SEQ ID NO: 572157 - DNA, 20 bp, mouse
ggtcttctctgctcgctcca

SEQ ID NO: 572158 - DNA, 20 bp, mouse
ggatccagcggcccactagg

SEQ ID NO: 572159 - DNA, 20 bp, mouse
gagaggacagggtacggccc

SEQ ID NO: 572160 - DNA, 20 bp, mouse
gcagagaagactctagcgct

SEQ ID NO: 572161 - DNA, 20 bp, mouse
ggccgttgacggacagtgag

SEQ ID NO: 572162 - DNA, 20 bp, mouse
gcagttcgcgaccacctagt

SEQ ID NO: 572163 - DNA, 20 bp, mouse
ggcctctcactgtccgtcaa

SEQ ID NO: 572164 - DNA, 20 bp, mouse
gcagcggaggccggctcata

SEQ ID NO: 572165 - DNA, 20 bp, mouse
gtgggatgctgcggtgtctc

SEQ ID NO: 572166 - DNA, 20 bp, mouse
ggaccgaccaggagaagcga

SEQ ID NO: 572167 - DNA, 20 bp, mouse
ggcttctcctggtcggtcag

SEQ ID NO: 572168 - DNA, 20 bp, mouse
gggagcacagaacggtctcc

SEQ ID NO: 572169 - DNA, 20 bp, mouse
ggcaaagcccctgaccgacc

SEQ ID NO: 572170 - DNA, 20 bp, mouse
ggctttgccatggttgcggg

SEQ ID NO: 572171 - DNA, 20 bp, mouse
gcagtgcgcgaccacctggt

SEQ ID NO: 572172 - DNA, 20 bp, mouse
gctccctccgcccgcaacca

SEQ ID NO: 572173 - DNA, 20 bp, mouse
gtgccgtcgcttctcctggt

SEQ ID NO: 572174 - DNA, 20 bp, mouse
gtcagcatccgaggcatcgt

SEQ ID NO: 572175 - DNA, 20 bp, mouse
gtcggtcaggggctttgcca

SEQ ID NO: 572176 - DNA, 20 bp, mouse
ggacatggctgtgagagggt

SEQ ID NO: 572177 - DNA, 20 bp, mouse
gcctggacatggctgtgaga

SEQ ID NO: 572178 - DNA, 20 bp, mouse
gtccctggttggaggcagct

SEQ ID NO: 572179 - DNA, 20 bp, mouse
gtcctagctgcctccaacca

SEQ ID NO: 572180 - DNA, 20 bp, mouse
gggccgaactggacagatga

SEQ ID NO: 572181 - DNA, 20 bp, mouse
gctgtccgggaccacctcgt

SEQ ID NO: 572182 - DNA, 20 bp, mouse
ggatccagcgtcccacgagg

SEQ ID NO: 572183 - DNA, 20 bp, mouse
gaggtggtcccggacagtgt

SEQ ID NO: 572184 - DNA, 20 bp, mouse
gctacaggaggggacaccct

SEQ ID NO: 572185 - DNA, 20 bp, mouse
gtcctggtctgaaagaggcc

SEQ ID NO: 572186 - DNA, 20 bp, mouse
gaacaggtcaggctgcttgg

SEQ ID NO: 572187 - DNA, 20 bp, mouse
gctgctggcgaggctgcgtg

SEQ ID NO: 572188 - DNA, 20 bp, mouse
gtatgctcatgcaccatgac

SEQ ID NO: 572189 - DNA, 20 bp, mouse
gcaatgtccttgaacaggtc

SEQ ID NO: 572190 - DNA, 20 bp, mouse
gaccatgaccggtgagctgc

SEQ ID NO: 572191 - DNA, 20 bp, mouse
gtacaaggtgaggggtccag

SEQ ID NO: 572192 - DNA, 20 bp, mouse
gaagcagcctgacctgttca

SEQ ID NO: 572193 - DNA, 20 bp, mouse
ggaccggtgagctgctggcg

SEQ ID NO: 572194 - DNA, 20 bp, mouse
gtcaggaacatagccacctc

SEQ ID NO: 572195 - DNA, 20 bp, mouse
gctgcgtggggcgcaggcat

SEQ ID NO: 572196 - DNA, 20 bp, mouse
ggatcaggaggaggacccag

SEQ ID NO: 572197 - DNA, 20 bp, mouse
ggaccgagaggaggacccgg

SEQ ID NO: 572198 - DNA, 20 bp, mouse
gctcggccgggaggactcca

SEQ ID NO: 572199 - DNA, 20 bp, mouse
ggaggactccagggaccgag

SEQ ID NO: 572200 - DNA, 20 bp, mouse
ggccgccgcatcaaagacac

SEQ ID NO: 572201 - DNA, 20 bp, mouse
gcggcggtcggtaatgtcag

SEQ ID NO: 572202 - DNA, 20 bp, mouse
ggagaggagccgggtaggaa

SEQ ID NO: 572203 - DNA, 20 bp, mouse
gcgactttgaaaagtttggg

SEQ ID NO: 572204 - DNA, 20 bp, mouse
gtgggaggcagccgaggcct

SEQ ID NO: 572205 - DNA, 20 bp, mouse
ggctcagggccgcggcctgg

SEQ ID NO: 572206 - DNA, 20 bp, mouse
gagccctagccacgccgagg

SEQ ID NO: 572207 - DNA, 20 bp, mouse
gaggcgcgcagttggtgcaa

SEQ ID NO: 572208 - DNA, 20 bp, mouse
gggcttgctgctgctcgggg

SEQ ID NO: 572209 - DNA, 20 bp, mouse
gcaccggacaagctggaggg

SEQ ID NO: 572210 - DNA, 20 bp, mouse
gccagcaccgggaggaagca

SEQ ID NO: 572211 - DNA, 20 bp, mouse
gatcgcccggaggggagtca

SEQ ID NO: 572212 - DNA, 20 bp, mouse
gggcgacaggcgcacttcgg

SEQ ID NO: 572213 - DNA, 20 bp, mouse
gcgcgccgcccagcaccggg

SEQ ID NO: 572214 - DNA, 20 bp, mouse
gcagccacagcaaccggaac

SEQ ID NO: 572215 - DNA, 20 bp, mouse
gccccaccggacaagctgga

SEQ ID NO: 572216 - DNA, 20 bp, mouse
gagatgcactctgccgggag

SEQ ID NO: 572217 - DNA, 20 bp, mouse
gaaacaggaagttcccctcc

SEQ ID NO: 572218 - DNA, 20 bp, mouse
gggcagaagagctaagaaac

SEQ ID NO: 572219 - DNA, 20 bp, mouse
gttaaagtttgttggggaca

SEQ ID NO: 572220 - DNA, 20 bp, mouse
gtcaggttagactcactcca

SEQ ID NO: 572221 - DNA, 20 bp, mouse
gagactcactccatggactg

SEQ ID NO: 572222 - DNA, 20 bp, mouse
ggtaatctacagaaattctc

SEQ ID NO: 572223 - DNA, 20 bp, mouse
gttctacagggcaggactag

SEQ ID NO: 572224 - DNA, 20 bp, mouse
gttcagcaagcctcagtcca

SEQ ID NO: 572225 - DNA, 20 bp, mouse
gaaagctgagatcttctaca

SEQ ID NO: 572226 - DNA, 20 bp, mouse
gctggcggcagactgaacac

SEQ ID NO: 572227 - DNA, 20 bp, mouse
ggccagcccccggggaacta

SEQ ID NO: 572228 - DNA, 20 bp, mouse
gggcctccatagttccccgg

SEQ ID NO: 572229 - DNA, 20 bp, mouse
gagcccccggggaactatgg

SEQ ID NO: 572230 - DNA, 20 bp, mouse
gactatggaggccccgcgac

SEQ ID NO: 572231 - DNA, 20 bp, mouse
gagtctgccgccagcccccg

SEQ ID NO: 572232 - DNA, 20 bp, mouse
gccggcagggacattcgtgg

SEQ ID NO: 572233 - DNA, 20 bp, mouse
gcgaccggcagggacattcg

SEQ ID NO: 572234 - DNA, 20 bp, mouse
gcattcgtggtggtaggagg

SEQ ID NO: 572235 - DNA, 20 bp, mouse
gagcgccggaagtgatttgt

SEQ ID NO: 572236 - DNA, 20 bp, mouse
gggcggccgaggtctcatca

SEQ ID NO: 572237 - DNA, 20 bp, mouse
gcaggtcgtgcccataggag

SEQ ID NO: 572238 - DNA, 20 bp, mouse
gcaaggccctgatgagacct

SEQ ID NO: 572239 - DNA, 20 bp, mouse
gtgtgcaagcaaattgctgg

SEQ ID NO: 572240 - DNA, 20 bp, mouse
gaggcccctccaaggccggt

SEQ ID NO: 572241 - DNA, 20 bp, mouse
gcctagaggagggggcatgt

SEQ ID NO: 572242 - DNA, 20 bp, mouse
ggaggagtcaagcgagtagg

SEQ ID NO: 572243 - DNA, 20 bp, mouse
gtagtgggctaagggagaag

SEQ ID NO: 572244 - DNA, 20 bp, mouse
gaggcagcagcaaggctcct

SEQ ID NO: 572245 - DNA, 20 bp, mouse
gttgctgctgcctctcctat

SEQ ID NO: 572246 - DNA, 20 bp, mouse
gagcatggcggctcagaaga

SEQ ID NO: 572247 - DNA, 20 bp, mouse
gcagcgccggggcgagcctg

SEQ ID NO: 572248 - DNA, 20 bp, mouse
gacccttcctcgggccaagg

SEQ ID NO: 572249 - DNA, 20 bp, mouse
gacgtgccgcaggctcgccc

SEQ ID NO: 572250 - DNA, 20 bp, mouse
ggccgggcggatggcatcca

SEQ ID NO: 572251 - DNA, 20 bp, mouse
ggctctccaagaagccgctt

SEQ ID NO: 572252 - DNA, 20 bp, mouse
gagatggacgaagcagcgct

SEQ ID NO: 572253 - DNA, 20 bp, mouse
gcagatgagtctcacctaag

SEQ ID NO: 572254 - DNA, 20 bp, mouse
gtgctctgaccagagcgaga

SEQ ID NO: 572255 - DNA, 20 bp, mouse
ggccgccttggcccgaggaa

SEQ ID NO: 572256 - DNA, 20 bp, mouse
ggaaggtgggagaagctcga

SEQ ID NO: 572257 - DNA, 20 bp, mouse
gcgacagctactgaactccg

SEQ ID NO: 572258 - DNA, 20 bp, mouse
gtgagatggagaagccggtg

SEQ ID NO: 572259 - DNA, 20 bp, mouse
ggagtggttgcgagctgggt

SEQ ID NO: 572260 - DNA, 20 bp, mouse
gtgacacccgagtgccccac

SEQ ID NO: 572261 - DNA, 20 bp, mouse
gcgtattagcgggagtgggg

SEQ ID NO: 572262 - DNA, 20 bp, mouse
gtgcaaggcggtagaagact

SEQ ID NO: 572263 - DNA, 20 bp, mouse
gggtgggcagggtttagctg

SEQ ID NO: 572264 - DNA, 20 bp, mouse
gctaggaggaaagctttggt

SEQ ID NO: 572265 - DNA, 20 bp, mouse
gtgaggtgagatggagaagc

SEQ ID NO: 572266 - DNA, 20 bp, mouse
ggacaaggatcagagttcgg

SEQ ID NO: 572267 - DNA, 20 bp, mouse
gggcagctggtttctcctca

SEQ ID NO: 572268 - DNA, 20 bp, mouse
gatcagagttcgggggctga

SEQ ID NO: 572269 - DNA, 20 bp, mouse
gctggacaaggatcagagtt

SEQ ID NO: 572270 - DNA, 20 bp, mouse
ggtttctcctcatggtggag

SEQ ID NO: 572271 - DNA, 20 bp, mouse
gggttttgcagtagctgtgg

SEQ ID NO: 572272 - DNA, 20 bp, mouse
ggtagctgtggtggcatctc

SEQ ID NO: 572273 - DNA, 20 bp, mouse
gaaactaacacacaacacat

SEQ ID NO: 572274 - DNA, 20 bp, mouse
ggaagaatagcttatagacc

SEQ ID NO: 572275 - DNA, 20 bp, mouse
ggattactgcctaggaaacc

SEQ ID NO: 572276 - DNA, 20 bp, mouse
gttctcgctaaggccaaggc

SEQ ID NO: 572277 - DNA, 20 bp, mouse
ggtagccatagcaggcacac

SEQ ID NO: 572278 - DNA, 20 bp, mouse
gtgaacagcgctagcgaatc

SEQ ID NO: 572279 - DNA, 20 bp, mouse
ggtttccggtgtgcctgcta

SEQ ID NO: 572280 - DNA, 20 bp, mouse
gaatctggagtagccatagc

SEQ ID NO: 572281 - DNA, 20 bp, mouse
gctgtgctccagagcaacgt

SEQ ID NO: 572282 - DNA, 20 bp, mouse
gcgcgagacgctcaagaacg

SEQ ID NO: 572283 - DNA, 20 bp, mouse
gtcgggagaccaagtcatat

SEQ ID NO: 572284 - DNA, 20 bp, mouse
gcttggccttagcgagaaca

SEQ ID NO: 572285 - DNA, 20 bp, mouse
gtccagagcaacgtgggact

SEQ ID NO: 572286 - DNA, 20 bp, mouse
gagactcgcgcggtactgaa

SEQ ID NO: 572287 - DNA, 20 bp, mouse
gtctgtcaggagcaggatgg

SEQ ID NO: 572288 - DNA, 20 bp, mouse
gagtaccgcgcgagtctgtc

SEQ ID NO: 572289 - DNA, 20 bp, mouse
gcggcagactctaggagtag

SEQ ID NO: 572290 - DNA, 20 bp, mouse
gcgagcctcgaagtgcgttt

SEQ ID NO: 572291 - DNA, 20 bp, mouse
ggccgggtgctggtgtacgg

SEQ ID NO: 572292 - DNA, 20 bp, mouse
gtgctcctgacagactcgcg

SEQ ID NO: 572293 - DNA, 20 bp, mouse
gaggagtagcggggagatcg

SEQ ID NO: 572294 - DNA, 20 bp, mouse
gcgagcccaaacgcacttcg

SEQ ID NO: 572295 - DNA, 20 bp, mouse
ggctgcaagcggcagactct

SEQ ID NO: 572296 - DNA, 20 bp, mouse
gcgccgccaagtgagtgagg

SEQ ID NO: 572297 - DNA, 20 bp, mouse
ggagcgcagtcggagcgcgg

SEQ ID NO: 572298 - DNA, 20 bp, mouse
gggaagaggaggagcgcagt

SEQ ID NO: 572299 - DNA, 20 bp, mouse
gggcggcgccgcctgaactg

SEQ ID NO: 572300 - DNA, 20 bp, mouse
gctcctcctcactcacttgg

SEQ ID NO: 572301 - DNA, 20 bp, mouse
ggaggagcgcagtcggagcg

SEQ ID NO: 572302 - DNA, 20 bp, mouse
gtgcgccgcgaggagccggg

SEQ ID NO: 572303 - DNA, 20 bp, mouse
ggctcccctcgcgaggccgg

SEQ ID NO: 572304 - DNA, 20 bp, mouse
ggcggtaacgcggagcgccg

SEQ ID NO: 572305 - DNA, 20 bp, mouse
gccgcccgagcggccagggg

SEQ ID NO: 572306 - DNA, 20 bp, mouse
ggcgaagacaagctcgtcgt

SEQ ID NO: 572307 - DNA, 20 bp, mouse
gacactcttgcagagatggc

SEQ ID NO: 572308 - DNA, 20 bp, mouse
gggtcgcctgcagtagcagc

SEQ ID NO: 572309 - DNA, 20 bp, mouse
ggccacaggaggcgactggg

SEQ ID NO: 572310 - DNA, 20 bp, mouse
gctcccgctagtccaagaga

SEQ ID NO: 572311 - DNA, 20 bp, mouse
gtcagagcgcagccaaaggg

SEQ ID NO: 572312 - DNA, 20 bp, mouse
gactagcgggaggcgggtca

SEQ ID NO: 572313 - DNA, 20 bp, mouse
gcacagcgggaggccacagg

SEQ ID NO: 572314 - DNA, 20 bp, mouse
ggtggccgagtcccaggtcc

SEQ ID NO: 572315 - DNA, 20 bp, mouse
ggtgtgggcgtggattcccg

SEQ ID NO: 572316 - DNA, 20 bp, mouse
gtctgaaaccaatcccggta

SEQ ID NO: 572317 - DNA, 20 bp, mouse
gacctcagcgaggcggatct

SEQ ID NO: 572318 - DNA, 20 bp, mouse
gtggaacagctggcaccctg

SEQ ID NO: 572319 - DNA, 20 bp, mouse
gagggctcacccgcagatcc

SEQ ID NO: 572320 - DNA, 20 bp, mouse
ggccaagatccgcctcgctg

SEQ ID NO: 572321 - DNA, 20 bp, mouse
ggaaaccaatcccggtatgg

SEQ ID NO: 572322 - DNA, 20 bp, mouse
gctgcactcgcggcagaaga

SEQ ID NO: 572323 - DNA, 20 bp, mouse
gtggggttgaggagatgtca

SEQ ID NO: 572324 - DNA, 20 bp, mouse
gcatgagtcccgggagccgc

SEQ ID NO: 572325 - DNA, 20 bp, mouse
ggatcctcgagccgctgccg

SEQ ID NO: 572326 - DNA, 20 bp, mouse
gaggtcaccttcagggtcca

SEQ ID NO: 572327 - DNA, 20 bp, mouse
ggaacattcgacctgaactg

SEQ ID NO: 572328 - DNA, 20 bp, mouse
gtgtgttgagccctacggaa

SEQ ID NO: 572329 - DNA, 20 bp, mouse
ggagacttaggtcaccttca

SEQ ID NO: 572330 - DNA, 20 bp, mouse
gagaaccgcgaagcaagagg

SEQ ID NO: 572331 - DNA, 20 bp, mouse
ggaagagggacgggcagtag

SEQ ID NO: 572332 - DNA, 20 bp, mouse
gtaacaagggacagagtcca

SEQ ID NO: 572333 - DNA, 20 bp, mouse
gtagcagccaagagaagcgg

SEQ ID NO: 572334 - DNA, 20 bp, mouse
gatccaaggagaggccacaa

SEQ ID NO: 572335 - DNA, 20 bp, mouse
ggacagagagaagcggactt

SEQ ID NO: 572336 - DNA, 20 bp, mouse
gctgagggctgctctaagaa

SEQ ID NO: 572337 - DNA, 20 bp, mouse
ggggctgctctaagaagggc

SEQ ID NO: 572338 - DNA, 20 bp, mouse
gacgagccacacaccaggaa

SEQ ID NO: 572339 - DNA, 20 bp, mouse
ggcagctctgcctgacaact

SEQ ID NO: 572340 - DNA, 20 bp, mouse
gagggcagggccccccacat

SEQ ID NO: 572341 - DNA, 20 bp, mouse
gccaggaagggcgggtgtgt

SEQ ID NO: 572342 - DNA, 20 bp, mouse
gcagccccaaaggaatcctg

SEQ ID NO: 572343 - DNA, 20 bp, mouse
gggtcccggtccagcaggca

SEQ ID NO: 572344 - DNA, 20 bp, mouse
gcccatagaaggggaggacc

SEQ ID NO: 572345 - DNA, 20 bp, mouse
gacttcctggctggcatcta

SEQ ID NO: 572346 - DNA, 20 bp, mouse
ggtcaccagagccttagact

SEQ ID NO: 572347 - DNA, 20 bp, mouse
gtctggctgttccaagtcta

SEQ ID NO: 572348 - DNA, 20 bp, mouse
gcaggcgctcaacatcaccg

SEQ ID NO: 572349 - DNA, 20 bp, mouse
ggactctgcgcacagcatgc

SEQ ID NO: 572350 - DNA, 20 bp, mouse
gagccgggaaaactgctccg

SEQ ID NO: 572351 - DNA, 20 bp, mouse
gtgttccaagtctaaggctc

SEQ ID NO: 572352 - DNA, 20 bp, mouse
gagtgctccagccagcgcaa

SEQ ID NO: 572353 - DNA, 20 bp, mouse
ggcagagctcaggagaagcg

SEQ ID NO: 572354 - DNA, 20 bp, mouse
gagcgcgcacaacctgactc

SEQ ID NO: 572355 - DNA, 20 bp, mouse
ggattacgcgtgcacactca

SEQ ID NO: 572356 - DNA, 20 bp, mouse
gtggcgcccagggagctgtg

SEQ ID NO: 572357 - DNA, 20 bp, mouse
ggcaggcccaccctacacaa

SEQ ID NO: 572358 - DNA, 20 bp, mouse
gcaaggctctggctcgaagg

SEQ ID NO: 572359 - DNA, 20 bp, mouse
gaatcctgtcggtctcggag

SEQ ID NO: 572360 - DNA, 20 bp, mouse
ggtgagggctgaatgtaaga

SEQ ID NO: 572361 - DNA, 20 bp, mouse
gtgtgaggagaaaatcctgt

SEQ ID NO: 572362 - DNA, 20 bp, mouse
gctgggcccaggcgacctca

SEQ ID NO: 572363 - DNA, 20 bp, mouse
ggaatgtaagatggcgccca

SEQ ID NO: 572364 - DNA, 20 bp, mouse
gtcgccgctccgagaccgac

SEQ ID NO: 572365 - DNA, 20 bp, mouse
gcgcgcgccgcaaaaccggg

SEQ ID NO: 572366 - DNA, 20 bp, mouse
gctaaaggcagcctacccat

SEQ ID NO: 572367 - DNA, 20 bp, mouse
gggcccgcgggacagagaaa

SEQ ID NO: 572368 - DNA, 20 bp, mouse
gacccatgaagcagtcccat

SEQ ID NO: 572369 - DNA, 20 bp, mouse
gacccatgggactgcttcat

SEQ ID NO: 572370 - DNA, 20 bp, mouse
gctcatcctgcagcagcgac

SEQ ID NO: 572371 - DNA, 20 bp, mouse
gccgagtgagcggcatgggt

SEQ ID NO: 572372 - DNA, 20 bp, mouse
ggcgccatcctacaagtcca

SEQ ID NO: 572373 - DNA, 20 bp, mouse
gcaacctcattgaggaccat

SEQ ID NO: 572374 - DNA, 20 bp, mouse
ggtcacattctaagttctaa

SEQ ID NO: 572375 - DNA, 20 bp, mouse
gctcactcggctcactctct

SEQ ID NO: 572376 - DNA, 20 bp, mouse
ggcaccgggtcccggaacag

SEQ ID NO: 572377 - DNA, 20 bp, mouse
gcgggtcccggaacagagga

SEQ ID NO: 572378 - DNA, 20 bp, mouse
gtgcgcccatgtaacgccgg

SEQ ID NO: 572379 - DNA, 20 bp, mouse
gggagtcagccggtagcacc

SEQ ID NO: 572380 - DNA, 20 bp, mouse
gtctgccaccggcgttacat

SEQ ID NO: 572381 - DNA, 20 bp, mouse
gtacatgggcgcagacatct

SEQ ID NO: 572382 - DNA, 20 bp, mouse
gaggagtcaatctctgccac

SEQ ID NO: 572383 - DNA, 20 bp, mouse
ggtctgcgcccatgtaacgc

SEQ ID NO: 572384 - DNA, 20 bp, mouse
gtgctaccggctgactccga

SEQ ID NO: 572385 - DNA, 20 bp, mouse
gggactctccgagaagtgag

SEQ ID NO: 572386 - DNA, 20 bp, mouse
gtcggacgtcaggagagcgg

SEQ ID NO: 572387 - DNA, 20 bp, mouse
gggctcggacgtcaggagag

SEQ ID NO: 572388 - DNA, 20 bp, mouse
gtagtgcgcgtccatggcgg

SEQ ID NO: 572389 - DNA, 20 bp, mouse
gctctcccgggagcaaagaa

SEQ ID NO: 572390 - DNA, 20 bp, mouse
gtccatggcgggggctgagg

SEQ ID NO: 572391 - DNA, 20 bp, mouse
ggccgcctcagcccccgcca

SEQ ID NO: 572392 - DNA, 20 bp, mouse
gggcgcgggaggtgcatcct

SEQ ID NO: 572393 - DNA, 20 bp, mouse
gctgggaaatccaacaacat

SEQ ID NO: 572394 - DNA, 20 bp, mouse
gcccggccgcgccatgtgag

SEQ ID NO: 572395 - DNA, 20 bp, mouse
gcctcaaggccaggtagaga

SEQ ID NO: 572396 - DNA, 20 bp, mouse
gggccgcacctcctcatcct

SEQ ID NO: 572397 - DNA, 20 bp, mouse
gcaagccgcctaggatgagg

SEQ ID NO: 572398 - DNA, 20 bp, mouse
gcagcgatggcggccccgag

SEQ ID NO: 572399 - DNA, 20 bp, mouse
gcgggccccgagaagagcag

SEQ ID NO: 572400 - DNA, 20 bp, mouse
gcgcacctcctcatcctagg

SEQ ID NO: 572401 - DNA, 20 bp, mouse
ggtagtagcagcagcgatgg

SEQ ID NO: 572402 - DNA, 20 bp, mouse
gattcaagccgcctaggatg

SEQ ID NO: 572403 - DNA, 20 bp, mouse
gatgcagtggccacaccagg

SEQ ID NO: 572404 - DNA, 20 bp, mouse
gctgctggagccgagcacag

SEQ ID NO: 572405 - DNA, 20 bp, mouse
ggtggacattcaagccgcct

SEQ ID NO: 572406 - DNA, 20 bp, mouse
ggcgcggctcgaagagacgg

SEQ ID NO: 572407 - DNA, 20 bp, mouse
ggccggcggcactcccaaca

SEQ ID NO: 572408 - DNA, 20 bp, mouse
ggccgcgcggctcgaagaga

SEQ ID NO: 572409 - DNA, 20 bp, mouse
gggatccaggagcttatgcg

SEQ ID NO: 572410 - DNA, 20 bp, mouse
ggcccgggcggcagccatgt

SEQ ID NO: 572411 - DNA, 20 bp, mouse
gcccaacatggctgccgccc

SEQ ID NO: 572412 - DNA, 20 bp, mouse
gtgaaaggtcaacgcgccgg

SEQ ID NO: 572413 - DNA, 20 bp, mouse
ggggctgtggcgcgggatcc

SEQ ID NO: 572414 - DNA, 20 bp, mouse
ggtggccgcaccacgacgag

SEQ ID NO: 572415 - DNA, 20 bp, mouse
ggctgccgcgcataagctcc

SEQ ID NO: 572416 - DNA, 20 bp, mouse
gagcggactcaagcgaacct

SEQ ID NO: 572417 - DNA, 20 bp, mouse
ggtccgctccacgaataatg

SEQ ID NO: 572418 - DNA, 20 bp, mouse
gccgggactgaaaatggcgg

SEQ ID NO: 572419 - DNA, 20 bp, mouse
ggtacacaggccaccatgaa

SEQ ID NO: 572420 - DNA, 20 bp, mouse
gtggcggcggtaggcagccc

SEQ ID NO: 572421 - DNA, 20 bp, mouse
gacctcggcgctgtcctctg

SEQ ID NO: 572422 - DNA, 20 bp, mouse
gcagctccacggccaggtgt

SEQ ID NO: 572423 - DNA, 20 bp, mouse
gaccatgaagggtatcacca

SEQ ID NO: 572424 - DNA, 20 bp, mouse
gcgaccagccgcattattcg

SEQ ID NO: 572425 - DNA, 20 bp, mouse
ggactgaaaatggcggcggt

SEQ ID NO: 572426 - DNA, 20 bp, mouse
gggccaagggttctacgagt

SEQ ID NO: 572427 - DNA, 20 bp, mouse
ggcagaggccaggagaacgg

SEQ ID NO: 572428 - DNA, 20 bp, mouse
gtctcttgcgaagagtttaa

SEQ ID NO: 572429 - DNA, 20 bp, mouse
gaacacaactccgcaccctc

SEQ ID NO: 572430 - DNA, 20 bp, mouse
gccgtggtttagtgggccaa

SEQ ID NO: 572431 - DNA, 20 bp, mouse
ggcaatcacactgggagact

SEQ ID NO: 572432 - DNA, 20 bp, mouse
gacactgggagactcggagc

SEQ ID NO: 572433 - DNA, 20 bp, mouse
gctgtaactggcaatcacac

SEQ ID NO: 572434 - DNA, 20 bp, mouse
gatacgaataggaaagtcta

SEQ ID NO: 572435 - DNA, 20 bp, mouse
gttccgactcgtagaaccct

SEQ ID NO: 572436 - DNA, 20 bp, mouse
gacaccctcaacactcaccg

SEQ ID NO: 572437 - DNA, 20 bp, mouse
gtcctcctgggatcgcgaaa

SEQ ID NO: 572438 - DNA, 20 bp, mouse
gctgccgcggtgagtgttga

SEQ ID NO: 572439 - DNA, 20 bp, mouse
gcactgtggagcgggatggg

SEQ ID NO: 572440 - DNA, 20 bp, mouse
gttggggaccctgagcgcgg

SEQ ID NO: 572441 - DNA, 20 bp, mouse
gctcttggggaccctgagcg

SEQ ID NO: 572442 - DNA, 20 bp, mouse
gtccctttcgcgatcccagg

SEQ ID NO: 572443 - DNA, 20 bp, mouse
gtcccgctccacagtggcca

SEQ ID NO: 572444 - DNA, 20 bp, mouse
gccttccctttcgcgatccc

SEQ ID NO: 572445 - DNA, 20 bp, mouse
gttcgcagccctggccactg

SEQ ID NO: 572446 - DNA, 20 bp, mouse
gaagagcaggcgcttcatgg

SEQ ID NO: 572447 - DNA, 20 bp, mouse
gggcctggcgcgcaccccag

SEQ ID NO: 572448 - DNA, 20 bp, mouse
ggcggagagcgacagcgtcc

SEQ ID NO: 572449 - DNA, 20 bp, mouse
ggagaaagaatcgggttcaa

SEQ ID NO: 572450 - DNA, 20 bp, mouse
gaggcgcttcatggtggcag

SEQ ID NO: 572451 - DNA, 20 bp, mouse
gagccggaggaaagacgcga

SEQ ID NO: 572452 - DNA, 20 bp, mouse
ggctccaacaggtcgaaggg

SEQ ID NO: 572453 - DNA, 20 bp, mouse
gtcaagggttcgtggttacc

SEQ ID NO: 572454 - DNA, 20 bp, mouse
gcggaagagcaggcgcttca

SEQ ID NO: 572455 - DNA, 20 bp, mouse
gggggctccaacaggtcgaa

SEQ ID NO: 572456 - DNA, 20 bp, mouse
ggcccggacaccggctccag

SEQ ID NO: 572457 - DNA, 20 bp, mouse
gaaggtagagtctcacggaa

SEQ ID NO: 572458 - DNA, 20 bp, mouse
gccatcaccagcccggacac

SEQ ID NO: 572459 - DNA, 20 bp, mouse
ggccgctggagccggtgtcc

SEQ ID NO: 572460 - DNA, 20 bp, mouse
gctaacggagcgggagagtg

SEQ ID NO: 572461 - DNA, 20 bp, mouse
ggccagtgcgtggtgggaag

SEQ ID NO: 572462 - DNA, 20 bp, mouse
gaccggtagcgctaacggag

SEQ ID NO: 572463 - DNA, 20 bp, mouse
ggcgggagcgcggcacagcg

SEQ ID NO: 572464 - DNA, 20 bp, mouse
ggcggggccggctggttgca

SEQ ID NO: 572465 - DNA, 20 bp, mouse
gcgggagagtgaggcagccg

SEQ ID NO: 572466 - DNA, 20 bp, mouse
gtccagggaggcccgagcag

SEQ ID NO: 572467 - DNA, 20 bp, mouse
gtcttcaaggactgtgaaca

SEQ ID NO: 572468 - DNA, 20 bp, mouse
gctgctgtgcctggctctgg

SEQ ID NO: 572469 - DNA, 20 bp, mouse
gcgtcaggagacacaggtaa

SEQ ID NO: 572470 - DNA, 20 bp, mouse
gaggaagacgtcgagaagga

SEQ ID NO: 572471 - DNA, 20 bp, mouse
ggggctcatacagaaaccat

SEQ ID NO: 572472 - DNA, 20 bp, mouse
gaccatgggatcattataga

SEQ ID NO: 572473 - DNA, 20 bp, mouse
gcagaactgtcaggatctgc

SEQ ID NO: 572474 - DNA, 20 bp, mouse
gtgggatcattatagaaggc

SEQ ID NO: 572475 - DNA, 20 bp, mouse
gcacagcttattttccaggg

SEQ ID NO: 572476 - DNA, 20 bp, mouse
gtccggccgggctgcaacag

SEQ ID NO: 572477 - DNA, 20 bp, mouse
ggagttgtccagagccacca

SEQ ID NO: 572478 - DNA, 20 bp, mouse
gtggctctggacaactcaga

SEQ ID NO: 572479 - DNA, 20 bp, mouse
gctctggacaactcagaagg

SEQ ID NO: 572480 - DNA, 20 bp, mouse
gtggaggagaccccaacctg

SEQ ID NO: 572481 - DNA, 20 bp, mouse
gtccttcgcggcctccggcc

SEQ ID NO: 572482 - DNA, 20 bp, mouse
gcctagccctgacgaggagg

SEQ ID NO: 572483 - DNA, 20 bp, mouse
ggcccggaggctaccccgag

SEQ ID NO: 572484 - DNA, 20 bp, mouse
ggaccctagccctgacgagg

SEQ ID NO: 572485 - DNA, 20 bp, mouse
gcccgctcggggtagcctcc

SEQ ID NO: 572486 - DNA, 20 bp, mouse
gcaaggagcattctccagac

SEQ ID NO: 572487 - DNA, 20 bp, mouse
gaaggagagttctcagggtt

SEQ ID NO: 572488 - DNA, 20 bp, mouse
gtctcatacccacctcttct

SEQ ID NO: 572489 - DNA, 20 bp, mouse
gggtcggccctggaccagtg

SEQ ID NO: 572490 - DNA, 20 bp, mouse
ggatctctgccaagttccca

SEQ ID NO: 572491 - DNA, 20 bp, mouse
gagaatgctccttgggaact

SEQ ID NO: 572492 - DNA, 20 bp, mouse
gccaacaccacactggtcca

SEQ ID NO: 572493 - DNA, 20 bp, mouse
gcactgtgtgacccatccaa

SEQ ID NO: 572494 - DNA, 20 bp, mouse
gcatgtcccgagcagagatg

SEQ ID NO: 572495 - DNA, 20 bp, mouse
ggccacacagctgtgttctt

SEQ ID NO: 572496 - DNA, 20 bp, mouse
ggcgagaggaacctcggagg

SEQ ID NO: 572497 - DNA, 20 bp, mouse
gtcggaggcggccggagctc

SEQ ID NO: 572498 - DNA, 20 bp, mouse
gagttgcgcgagaggaacct

SEQ ID NO: 572499 - DNA, 20 bp, mouse
gcatggcccgaccggcactg

SEQ ID NO: 572500 - DNA, 20 bp, mouse
gcggccggagctcaggctag

SEQ ID NO: 572501 - DNA, 20 bp, mouse
ggagctgccccgagaccaag

SEQ ID NO: 572502 - DNA, 20 bp, mouse
gcccagcgaggagaaggatg

SEQ ID NO: 572503 - DNA, 20 bp, mouse
ggctcaggctagaggttggc

SEQ ID NO: 572504 - DNA, 20 bp, mouse
gggagtggcgaacctgtcta

SEQ ID NO: 572505 - DNA, 20 bp, mouse
gggctcgcccatggcccgac

SEQ ID NO: 572506 - DNA, 20 bp, mouse
ggaagcggctgtggaggtgt

SEQ ID NO: 572507 - DNA, 20 bp, mouse
gccgacagccccagcccgaa

SEQ ID NO: 572508 - DNA, 20 bp, mouse
gccgccccgaggcaccaagg

SEQ ID NO: 572509 - DNA, 20 bp, mouse
gggctccgggaaagccgttc

SEQ ID NO: 572510 - DNA, 20 bp, mouse
ggccccgccccgaggcacca

SEQ ID NO: 572511 - DNA, 20 bp, mouse
gtgcccggtggtcctgagag

SEQ ID NO: 572512 - DNA, 20 bp, mouse
gggaacgcggagcgccggag

SEQ ID NO: 572513 - DNA, 20 bp, mouse
gccagcccgaacggctttcc

SEQ ID NO: 572514 - DNA, 20 bp, mouse
ggactcccgcagccccggaa

SEQ ID NO: 572515 - DNA, 20 bp, mouse
gttttgtgaagcggctgtgg

SEQ ID NO: 572516 - DNA, 20 bp, mouse
gccatggcgggcgatctgga

SEQ ID NO: 572517 - DNA, 20 bp, mouse
gagggtggcaagtccctgag

SEQ ID NO: 572518 - DNA, 20 bp, mouse
gccttcctggcgaagatgag

SEQ ID NO: 572519 - DNA, 20 bp, mouse
gggcaggccctccttagcca

SEQ ID NO: 572520 - DNA, 20 bp, mouse
ggggcctgaggctgcgagga

SEQ ID NO: 572521 - DNA, 20 bp, mouse
gcagcagcacccgaggctgg

SEQ ID NO: 572522 - DNA, 20 bp, mouse
gagatcgcccgccatggcta

SEQ ID NO: 572523 - DNA, 20 bp, mouse
ggagaggacttctcaaggta

SEQ ID NO: 572524 - DNA, 20 bp, mouse
gaagatgagaggacttctca

SEQ ID NO: 572525 - DNA, 20 bp, mouse
gaggacttctcaaggtacgg

SEQ ID NO: 572526 - DNA, 20 bp, mouse
gagcatagcctacagacttc

SEQ ID NO: 572527 - DNA, 20 bp, mouse
gataggaatgcaaaaaactg

SEQ ID NO: 572528 - DNA, 20 bp, mouse
gagcagctgtgtaaaccatg

SEQ ID NO: 572529 - DNA, 20 bp, mouse
ggaatgcaaaaaactgtggc

SEQ ID NO: 572530 - DNA, 20 bp, mouse
gctattactctctgaaaacg

SEQ ID NO: 572531 - DNA, 20 bp, mouse
gtactctctgaaaacggggc

SEQ ID NO: 572532 - DNA, 20 bp, mouse
gggtttacacagctgctttc

SEQ ID NO: 572533 - DNA, 20 bp, mouse
gagaagtggagcaggattaa

SEQ ID NO: 572534 - DNA, 20 bp, mouse
gatacttgccagaagtctgt

SEQ ID NO: 572535 - DNA, 20 bp, mouse
gaggagaggcatgagggtat

SEQ ID NO: 572536 - DNA, 20 bp, mouse
gtccatgaggtggacagtgt

SEQ ID NO: 572537 - DNA, 20 bp, mouse
ggccggcagcctccatgagg

SEQ ID NO: 572538 - DNA, 20 bp, mouse
ggcctacactgtccacctca

SEQ ID NO: 572539 - DNA, 20 bp, mouse
gagtgccggcagcctccatg

SEQ ID NO: 572540 - DNA, 20 bp, mouse
gcttcttgggaggctctctg

SEQ ID NO: 572541 - DNA, 20 bp, mouse
ggtggacagtgtaggcctgg

SEQ ID NO: 572542 - DNA, 20 bp, mouse
gtggtacctaccaattccct

SEQ ID NO: 572543 - DNA, 20 bp, mouse
gctggcgggagtggtcggaa

SEQ ID NO: 572544 - DNA, 20 bp, mouse
gggaggctgccggcactgtc

SEQ ID NO: 572545 - DNA, 20 bp, mouse
gcggcactgtctggagccca

SEQ ID NO: 572546 - DNA, 20 bp, mouse
gtactcgcccgaaagctcca

SEQ ID NO: 572547 - DNA, 20 bp, mouse
ggcgcgctgttgaagctgag

SEQ ID NO: 572548 - DNA, 20 bp, mouse
gtgaagctgagtggtcgcca

SEQ ID NO: 572549 - DNA, 20 bp, mouse
gtccgggtggcgtttctccg

SEQ ID NO: 572550 - DNA, 20 bp, mouse
gagctttcgggcgagtacgt

SEQ ID NO: 572551 - DNA, 20 bp, mouse
gaggacactcgtagccgctg

SEQ ID NO: 572552 - DNA, 20 bp, mouse
gcggctacgagtgtcctgtg

SEQ ID NO: 572553 - DNA, 20 bp, mouse
gcgggaccgggcagtgtgaa

SEQ ID NO: 572554 - DNA, 20 bp, mouse
ggagaaacgccacccggaag

SEQ ID NO: 572555 - DNA, 20 bp, mouse
gcaaggcttggcggaagatc

SEQ ID NO: 572556 - DNA, 20 bp, mouse
ggttgggcggaaatgatatt

SEQ ID NO: 572557 - DNA, 20 bp, mouse
gagcagggttctgtcttaga

SEQ ID NO: 572558 - DNA, 20 bp, mouse
ggagcgtttgtgggctaggt

SEQ ID NO: 572559 - DNA, 20 bp, mouse
gtcttagagggagcgtttgt

SEQ ID NO: 572560 - DNA, 20 bp, mouse
gcgtttgtgggctaggtggg

SEQ ID NO: 572561 - DNA, 20 bp, mouse
gcagaagggtatttcctaga

SEQ ID NO: 572562 - DNA, 20 bp, mouse
gttcaggaagaagtgtagac

SEQ ID NO: 572563 - DNA, 20 bp, mouse
gtggctgccccactctgacc

SEQ ID NO: 572564 - DNA, 20 bp, mouse
gctggggctctgtgtcaacg

SEQ ID NO: 572565 - DNA, 20 bp, mouse
gggcagcatccaggtcagag

SEQ ID NO: 572566 - DNA, 20 bp, mouse
gatgtcagagatccaaacga

SEQ ID NO: 572567 - DNA, 20 bp, mouse
ggttgtgctgacctaggcta

SEQ ID NO: 572568 - DNA, 20 bp, mouse
gttaacttctccccagagtt

SEQ ID NO: 572569 - DNA, 20 bp, mouse
gctgggcttgttatgagaca

SEQ ID NO: 572570 - DNA, 20 bp, mouse
gtagatagaacacagagtat

SEQ ID NO: 572571 - DNA, 20 bp, mouse
gtccaaacgaaggtttcaac

SEQ ID NO: 572572 - DNA, 20 bp, mouse
gtgcggaagtttgatagcaa

SEQ ID NO: 572573 - DNA, 20 bp, mouse
gatagaacacagagtatagg

SEQ ID NO: 572574 - DNA, 20 bp, mouse
gtcctgttgaaaccttcgtt

SEQ ID NO: 572575 - DNA, 20 bp, mouse
gctgtgcagggtggcgtatc

SEQ ID NO: 572576 - DNA, 20 bp, mouse
gagaaggtgtgagaactcaa

SEQ ID NO: 572577 - DNA, 20 bp, mouse
gccctacccggcatgctctg

SEQ ID NO: 572578 - DNA, 20 bp, mouse
gacccagcttacctcctgca

SEQ ID NO: 572579 - DNA, 20 bp, mouse
ggagaactcaaaggccctgc

SEQ ID NO: 572580 - DNA, 20 bp, mouse
gaccacccccatcccctacc

SEQ ID NO: 572581 - DNA, 20 bp, mouse
gcaacagcttctaatgacat

SEQ ID NO: 572582 - DNA, 20 bp, mouse
ggtgctcagggtttgcagaa

SEQ ID NO: 572583 - DNA, 20 bp, mouse
gagcatgccgggtaggggat

SEQ ID NO: 572584 - DNA, 20 bp, mouse
gcagtcagattctttgaaga

SEQ ID NO: 572585 - DNA, 20 bp, mouse
gagatctgcctcagggacag

SEQ ID NO: 572586 - DNA, 20 bp, mouse
gttccaggtgagttgtactg

SEQ ID NO: 572587 - DNA, 20 bp, mouse
ggctgagtggatagtgtagg

SEQ ID NO: 572588 - DNA, 20 bp, mouse
gggatagtgtaggtggtatg

SEQ ID NO: 572589 - DNA, 20 bp, mouse
gtaagcaggctcctgcatct

SEQ ID NO: 572590 - DNA, 20 bp, mouse
gactcacctggaaaataagc

SEQ ID NO: 572591 - DNA, 20 bp, mouse
gaccgagtgtgccaagatgc

SEQ ID NO: 572592 - DNA, 20 bp, mouse
gtaacacaggagttctttgt

SEQ ID NO: 572593 - DNA, 20 bp, mouse
gccctcagccaagagagact

SEQ ID NO: 572594 - DNA, 20 bp, mouse
gctggggaatgacctcactc

SEQ ID NO: 572595 - DNA, 20 bp, mouse
gagggctatcttggctggag

SEQ ID NO: 572596 - DNA, 20 bp, mouse
ggggcgccggggtcaaggaa

SEQ ID NO: 572597 - DNA, 20 bp, mouse
gcaaggaagggaatttaggg

SEQ ID NO: 572598 - DNA, 20 bp, mouse
gggagaaccttatagggcag

SEQ ID NO: 572599 - DNA, 20 bp, mouse
gaatcatgggagaaccttat

SEQ ID NO: 572600 - DNA, 20 bp, mouse
gtctctgggcgccggggtca

SEQ ID NO: 572601 - DNA, 20 bp, mouse
gtcgggacgctgggagtaga

SEQ ID NO: 572602 - DNA, 20 bp, mouse
gaggccccgggaccgcgtgt

SEQ ID NO: 572603 - DNA, 20 bp, mouse
gctagtcgcaaagggtcggg

SEQ ID NO: 572604 - DNA, 20 bp, mouse
gaggaccgacgggaaggtaa

SEQ ID NO: 572605 - DNA, 20 bp, mouse
gccgggaccgcgtgtgggat

SEQ ID NO: 572606 - DNA, 20 bp, mouse
gggtggaagcgatcactgag

SEQ ID NO: 572607 - DNA, 20 bp, mouse
gggaagcgatcactgagtgg

SEQ ID NO: 572608 - DNA, 20 bp, mouse
gagcgatcactgagtggcgg

SEQ ID NO: 572609 - DNA, 20 bp, mouse
ggccggcgaaccaggaactg

SEQ ID NO: 572610 - DNA, 20 bp, mouse
gtgttctaagggtcggagtg

SEQ ID NO: 572611 - DNA, 20 bp, mouse
gctgattgtgttctaagggt

SEQ ID NO: 572612 - DNA, 20 bp, mouse
ggctgctgattgtgttctaa

SEQ ID NO: 572613 - DNA, 20 bp, mouse
ggtcggccgggcgaaggaga

SEQ ID NO: 572614 - DNA, 20 bp, mouse
gccacaggtaatggaaaggg

SEQ ID NO: 572615 - DNA, 20 bp, mouse
ggcgtctctggaggcagtga

SEQ ID NO: 572616 - DNA, 20 bp, mouse
gcgcgcacgccggcgtgaga

SEQ ID NO: 572617 - DNA, 20 bp, mouse
gaaggtggctctggccgggg

SEQ ID NO: 572618 - DNA, 20 bp, mouse
gtcggccgggacgctcccac

SEQ ID NO: 572619 - DNA, 20 bp, mouse
gccaggaaacagagccgccc

SEQ ID NO: 572620 - DNA, 20 bp, mouse
ggccggcgtgagagggcacg

SEQ ID NO: 572621 - DNA, 20 bp, mouse
gtgagagggcacggggaaaa

SEQ ID NO: 572622 - DNA, 20 bp, mouse
ggccgggacgctcccacggg

SEQ ID NO: 572623 - DNA, 20 bp, mouse
gcggcgcccgtgcctccgag

SEQ ID NO: 572624 - DNA, 20 bp, mouse
ggagcaggagaccttccgaa

SEQ ID NO: 572625 - DNA, 20 bp, mouse
gctcgtcgaggaagccccga

SEQ ID NO: 572626 - DNA, 20 bp, mouse
ggcgcggccgaggagctgag

SEQ ID NO: 572627 - DNA, 20 bp, mouse
ggcaacggcggcgggaccag

SEQ ID NO: 572628 - DNA, 20 bp, mouse
gggagcggcggtggcaacgg

SEQ ID NO: 572629 - DNA, 20 bp, mouse
gccgaggcggactccgacca

SEQ ID NO: 572630 - DNA, 20 bp, mouse
gggctcgtcaggcctcccaa

SEQ ID NO: 572631 - DNA, 20 bp, mouse
gagcggcgggacccccgacg

SEQ ID NO: 572632 - DNA, 20 bp, mouse
gagtgtctcgggccccaaat

SEQ ID NO: 572633 - DNA, 20 bp, mouse
gccagggggcgtcgctgcag

SEQ ID NO: 572634 - DNA, 20 bp, mouse
ggcgcgggaacccggacgag

SEQ ID NO: 572635 - DNA, 20 bp, mouse
gcggcaggaaggaagcgccg

SEQ ID NO: 572636 - DNA, 20 bp, mouse
gtgggagtcggaggaagccg

SEQ ID NO: 572637 - DNA, 20 bp, mouse
gtacaggaacagagagctca

SEQ ID NO: 572638 - DNA, 20 bp, mouse
ggggagaccgagggctagaa

SEQ ID NO: 572639 - DNA, 20 bp, mouse
ggtggaggcccggacttcaa

SEQ ID NO: 572640 - DNA, 20 bp, mouse
gttcgggccctagtacgcag

SEQ ID NO: 572641 - DNA, 20 bp, mouse
gtatccgggctgggagtcgg

SEQ ID NO: 572642 - DNA, 20 bp, mouse
gtcggtctcccggagaaagg

SEQ ID NO: 572643 - DNA, 20 bp, mouse
ggtacagacaggcgaggtgg

SEQ ID NO: 572644 - DNA, 20 bp, mouse
gctgagaaaccgagctcggg

SEQ ID NO: 572645 - DNA, 20 bp, mouse
ggcgtagagcggcggtctaa

SEQ ID NO: 572646 - DNA, 20 bp, mouse
gagggacatggtggcagacg

SEQ ID NO: 572647 - DNA, 20 bp, mouse
gcggtccagaccgaggacag

SEQ ID NO: 572648 - DNA, 20 bp, mouse
ggctgaggccgccagggaca

SEQ ID NO: 572649 - DNA, 20 bp, mouse
gaccaggctaggaagccaga

SEQ ID NO: 572650 - DNA, 20 bp, mouse
gcggtgggcggtccagaccg

SEQ ID NO: 572651 - DNA, 20 bp, mouse
gcggccccggaggacagcag

SEQ ID NO: 572652 - DNA, 20 bp, mouse
gagcggctcgggagcccggt

SEQ ID NO: 572653 - DNA, 20 bp, mouse
gtgcgggccaagggacccgg

SEQ ID NO: 572654 - DNA, 20 bp, mouse
ggaggacagcggctaccttc

SEQ ID NO: 572655 - DNA, 20 bp, mouse
gagcggaggcagctcgaagg

SEQ ID NO: 572656 - DNA, 20 bp, mouse
gaggcctggccagcaacccg

SEQ ID NO: 572657 - DNA, 20 bp, mouse
ggagacggccaacccggaag

SEQ ID NO: 572658 - DNA, 20 bp, mouse
gggccgcgccacttccgggt

SEQ ID NO: 572659 - DNA, 20 bp, mouse
gcgcgcagccccactcaaca

SEQ ID NO: 572660 - DNA, 20 bp, mouse
gcctagcgcccggcgcgcgg

SEQ ID NO: 572661 - DNA, 20 bp, mouse
gaacatggagacggccaacc

SEQ ID NO: 572662 - DNA, 20 bp, mouse
gcggcggccgcgccacttcc

SEQ ID NO: 572663 - DNA, 20 bp, mouse
gggctcctcccccccaagag

SEQ ID NO: 572664 - DNA, 20 bp, mouse
ggctgccgcgaggtccctaa

SEQ ID NO: 572665 - DNA, 20 bp, mouse
ggcctgcgccactcttgggg

SEQ ID NO: 572666 - DNA, 20 bp, mouse
gacaggcaccggccgggcag

SEQ ID NO: 572667 - DNA, 20 bp, mouse
gggagtggacggtgggagac

SEQ ID NO: 572668 - DNA, 20 bp, mouse
ggagcttaggaacccagtga

SEQ ID NO: 572669 - DNA, 20 bp, mouse
gtgatgtaaggacccagtgg

SEQ ID NO: 572670 - DNA, 20 bp, mouse
gggatgatgtaaggacccag

SEQ ID NO: 572671 - DNA, 20 bp, mouse
ggccgggagccgctaaggtg

SEQ ID NO: 572672 - DNA, 20 bp, mouse
gagccagagcgcctgagctt

SEQ ID NO: 572673 - DNA, 20 bp, mouse
gcggcgccggcgtccctcac

SEQ ID NO: 572674 - DNA, 20 bp, mouse
gaggcgcggaaggcagacaa

SEQ ID NO: 572675 - DNA, 20 bp, mouse
gtggcgcgggcccatggcag

SEQ ID NO: 572676 - DNA, 20 bp, mouse
gggcgcgcggcagacacgag

SEQ ID NO: 572677 - DNA, 20 bp, mouse
gtgcgcgccgcagacccggg

SEQ ID NO: 572678 - DNA, 20 bp, mouse
gcacgagcggctgacacgag

SEQ ID NO: 572679 - DNA, 20 bp, mouse
ggcgagcgcgatggcgaagg

SEQ ID NO: 572680 - DNA, 20 bp, mouse
gcacgagcggccgccgcggg

SEQ ID NO: 572681 - DNA, 20 bp, mouse
gctcgcaccgcccgggtctg

SEQ ID NO: 572682 - DNA, 20 bp, mouse
gggctgcgcgccgcagaccc

SEQ ID NO: 572683 - DNA, 20 bp, mouse
gctgcgcttcgggcaaggag

SEQ ID NO: 572684 - DNA, 20 bp, mouse
gtgacacgagcggccgccgc

SEQ ID NO: 572685 - DNA, 20 bp, mouse
gggtgcgagcgcgatggcga

SEQ ID NO: 572686 - DNA, 20 bp, mouse
gccaggccagcccgcagctg

SEQ ID NO: 572687 - DNA, 20 bp, mouse
gtgcgggccagcgggttgag

SEQ ID NO: 572688 - DNA, 20 bp, mouse
ggcggtcggtgcgctgcagg

SEQ ID NO: 572689 - DNA, 20 bp, mouse
ggcagccgcgggatgctgtc

SEQ ID NO: 572690 - DNA, 20 bp, mouse
gggccagcccgcagctgcgg

SEQ ID NO: 572691 - DNA, 20 bp, mouse
gagcccgcagctgcggcggt

SEQ ID NO: 572692 - DNA, 20 bp, mouse
gcggtcacctggacatgcgt

SEQ ID NO: 572693 - DNA, 20 bp, mouse
ggggtcccgcaccagagcca

SEQ ID NO: 572694 - DNA, 20 bp, mouse
gggttgaggggcaagagctc

SEQ ID NO: 572695 - DNA, 20 bp, mouse
ggcaccgaccgccgcagctg

SEQ ID NO: 572696 - DNA, 20 bp, mouse
gtcccttcctctactcccgg

SEQ ID NO: 572697 - DNA, 20 bp, mouse
gcgccgccgggagtagagga

SEQ ID NO: 572698 - DNA, 20 bp, mouse
gtgaagtcggccggcctggg

SEQ ID NO: 572699 - DNA, 20 bp, mouse
gcagcatcccggaccgggag

SEQ ID NO: 572700 - DNA, 20 bp, mouse
gagcagcttctccgcagcag

SEQ ID NO: 572701 - DNA, 20 bp, mouse
gccggaggaagcagcccccc

SEQ ID NO: 572702 - DNA, 20 bp, mouse
gggtatgcccgggcatccgt

SEQ ID NO: 572703 - DNA, 20 bp, mouse
gcggtagcagcatcccggac

SEQ ID NO: 572704 - DNA, 20 bp, mouse
gagctgcaggtcatcatcat

SEQ ID NO: 572705 - DNA, 20 bp, mouse
gcacaggcccggcgtaccca

SEQ ID NO: 572706 - DNA, 20 bp, mouse
gaacttgaagaggtggtcgt

SEQ ID NO: 572707 - DNA, 20 bp, mouse
ggagcagcaacttgaagagg

SEQ ID NO: 572708 - DNA, 20 bp, mouse
gtggccatggcggacactgg

SEQ ID NO: 572709 - DNA, 20 bp, mouse
gaccggctcctgaaagacta

SEQ ID NO: 572710 - DNA, 20 bp, mouse
gggtcgggaagagccaacac

SEQ ID NO: 572711 - DNA, 20 bp, mouse
gggagccggtgtatgagggt

SEQ ID NO: 572712 - DNA, 20 bp, mouse
gggatcccgcctaccagtgt

SEQ ID NO: 572713 - DNA, 20 bp, mouse
gcccgcccaccctcatacac

SEQ ID NO: 572714 - DNA, 20 bp, mouse
gcagcctgtgggctcaccga

SEQ ID NO: 572715 - DNA, 20 bp, mouse
gtaccaagagacggagtggg

SEQ ID NO: 572716 - DNA, 20 bp, mouse
gcagcccgaggaagatcctg

SEQ ID NO: 572717 - DNA, 20 bp, mouse
gctccctcaggatcttcctc

SEQ ID NO: 572718 - DNA, 20 bp, mouse
ggtcaggacgaggaagcgga

SEQ ID NO: 572719 - DNA, 20 bp, mouse
gagcggagcccggaagaggg

SEQ ID NO: 572720 - DNA, 20 bp, mouse
gtaaccaaggccttccgcag

SEQ ID NO: 572721 - DNA, 20 bp, mouse
gcagggagcgccgccatctt

SEQ ID NO: 572722 - DNA, 20 bp, mouse
ggagcgcgagccgcccggga

SEQ ID NO: 572723 - DNA, 20 bp, mouse
gactcgggtggcagtcgcgg

SEQ ID NO: 572724 - DNA, 20 bp, mouse
ggtggtccggcccattgcga

SEQ ID NO: 572725 - DNA, 20 bp, mouse
gaaggccttggttacctggg

SEQ ID NO: 572726 - DNA, 20 bp, mouse
gcgcggtggcgagaaggaag

SEQ ID NO: 572727 - DNA, 20 bp, mouse
gggacgccgcggtggcgaga

SEQ ID NO: 572728 - DNA, 20 bp, mouse
gtcgctggcgcggggaagcg

SEQ ID NO: 572729 - DNA, 20 bp, mouse
gcgcggctggagccagcccc

SEQ ID NO: 572730 - DNA, 20 bp, mouse
gcgccatggcagggactcaa

SEQ ID NO: 572731 - DNA, 20 bp, mouse
gagggagtgcatacacctag

SEQ ID NO: 572732 - DNA, 20 bp, mouse
gagcgggcgaggccagcgcg

SEQ ID NO: 572733 - DNA, 20 bp, mouse
ggcgcgggaggccagggata

SEQ ID NO: 572734 - DNA, 20 bp, mouse
gtcgccaccgcggcgtcctg

SEQ ID NO: 572735 - DNA, 20 bp, mouse
gccgatggtggagatatgcg

SEQ ID NO: 572736 - DNA, 20 bp, mouse
gaggccccctgctcccacca

SEQ ID NO: 572737 - DNA, 20 bp, mouse
gtttacaggaagagtcctgc

SEQ ID NO: 572738 - DNA, 20 bp, mouse
gtggggccttggtgggagca

SEQ ID NO: 572739 - DNA, 20 bp, mouse
gactttgcaccggagtttac

SEQ ID NO: 572740 - DNA, 20 bp, mouse
ggtcagggtcctgccagggg

SEQ ID NO: 572741 - DNA, 20 bp, mouse
gggtgctgtatgactcgtca

SEQ ID NO: 572742 - DNA, 20 bp, mouse
gcaccaaggccccagccggc

SEQ ID NO: 572743 - DNA, 20 bp, mouse
gaggaagagtcctgccggct

SEQ ID NO: 572744 - DNA, 20 bp, mouse
gttctcaggacctgaatcag

SEQ ID NO: 572745 - DNA, 20 bp, mouse
gggactcttcctgtaaactc

SEQ ID NO: 572746 - DNA, 20 bp, mouse
ggcagcgctgacgggcacgg

SEQ ID NO: 572747 - DNA, 20 bp, mouse
gagcgggcgcaggatggacg

SEQ ID NO: 572748 - DNA, 20 bp, mouse
ggacacagggcagcgctgac

SEQ ID NO: 572749 - DNA, 20 bp, mouse
gggccgcctttgccgacaca

SEQ ID NO: 572750 - DNA, 20 bp, mouse
gggctgggtcggagtagagc

SEQ ID NO: 572751 - DNA, 20 bp, mouse
gagggaggcggtggtcacag

SEQ ID NO: 572752 - DNA, 20 bp, mouse
ggagtagagcgggcgcagga

SEQ ID NO: 572753 - DNA, 20 bp, mouse
gagggcagcgctgacgggca

SEQ ID NO: 572754 - DNA, 20 bp, mouse
gcgcggcgaccgttccagga

SEQ ID NO: 572755 - DNA, 20 bp, mouse
gtcatcggcgagagtggggt

SEQ ID NO: 572756 - DNA, 20 bp, mouse
gggacgaaggagacgacgga

SEQ ID NO: 572757 - DNA, 20 bp, mouse
gagacgacggagggctgcag

SEQ ID NO: 572758 - DNA, 20 bp, mouse
gagtgcccgggactctacaa

SEQ ID NO: 572759 - DNA, 20 bp, mouse
gctgcaagacaagaggacga

SEQ ID NO: 572760 - DNA, 20 bp, mouse
gcactgcgctgcaagacaag

SEQ ID NO: 572761 - DNA, 20 bp, mouse
gcggcccctggagtcaagtt

SEQ ID NO: 572762 - DNA, 20 bp, mouse
gccaccgaacttgactccag

SEQ ID NO: 572763 - DNA, 20 bp, mouse
ggaaagcgaaagggaaacaa

SEQ ID NO: 572764 - DNA, 20 bp, mouse
ggagtcccgggcactttgca

SEQ ID NO: 572765 - DNA, 20 bp, mouse
gggagcctttgtagagtccc

SEQ ID NO: 572766 - DNA, 20 bp, mouse
gaggcggagcagagccgact

SEQ ID NO: 572767 - DNA, 20 bp, mouse
gcactattcggggttcatgg

SEQ ID NO: 572768 - DNA, 20 bp, mouse
gccgactgggagcgaccgag

SEQ ID NO: 572769 - DNA, 20 bp, mouse
gcggggcctctagggcggag

SEQ ID NO: 572770 - DNA, 20 bp, mouse
gggcggagtggcaaccatct

SEQ ID NO: 572771 - DNA, 20 bp, mouse
ggcaaccatcttggaacggg

SEQ ID NO: 572772 - DNA, 20 bp, mouse
gaccatcttggaacgggagg

SEQ ID NO: 572773 - DNA, 20 bp, mouse
gtcggggttcatggcggcag

SEQ ID NO: 572774 - DNA, 20 bp, mouse
gagtggcaaccatcttggaa

SEQ ID NO: 572775 - DNA, 20 bp, mouse
gaggacccggatgtaagggg

SEQ ID NO: 572776 - DNA, 20 bp, mouse
gcagggaccccgaactctag

SEQ ID NO: 572777 - DNA, 20 bp, mouse
gctgtggcgcgcttcctctt

SEQ ID NO: 572778 - DNA, 20 bp, mouse
ggagttcggatctcaggcca

SEQ ID NO: 572779 - DNA, 20 bp, mouse
gccagggccactagagttcg

SEQ ID NO: 572780 - DNA, 20 bp, mouse
gcagggctgcgttcacactc

SEQ ID NO: 572781 - DNA, 20 bp, mouse
ggcgcgccacagctctgtac

SEQ ID NO: 572782 - DNA, 20 bp, mouse
ggggtcgaggagtcgtctgt

SEQ ID NO: 572783 - DNA, 20 bp, mouse
gcggacacggtcagcaccgt

SEQ ID NO: 572784 - DNA, 20 bp, mouse
gtgctgggggacatgaacgt

SEQ ID NO: 572785 - DNA, 20 bp, mouse
gtcacccgcccaggatgcca

SEQ ID NO: 572786 - DNA, 20 bp, mouse
gccaccacgtcagggacccg

SEQ ID NO: 572787 - DNA, 20 bp, mouse
ggtcagggacccgaggctag

SEQ ID NO: 572788 - DNA, 20 bp, mouse
gggccccggccaccacgtca

SEQ ID NO: 572789 - DNA, 20 bp, mouse
gaggagacgccattagaggg

SEQ ID NO: 572790 - DNA, 20 bp, mouse
gggaaggagacgccattaga

SEQ ID NO: 572791 - DNA, 20 bp, mouse
ggagaaagtcccagaatgaa

SEQ ID NO: 572792 - DNA, 20 bp, mouse
ggcagctctcccctagcctc

SEQ ID NO: 572793 - DNA, 20 bp, mouse
gcctcgcccgcggaaggacg

SEQ ID NO: 572794 - DNA, 20 bp, mouse
ggtgacgaggggtgtgacgt

SEQ ID NO: 572795 - DNA, 20 bp, mouse
gccgcgggcgaggcctgcga

SEQ ID NO: 572796 - DNA, 20 bp, mouse
ggccatggcccgggaaccag

SEQ ID NO: 572797 - DNA, 20 bp, mouse
gagaaggtggctgccgaagt

SEQ ID NO: 572798 - DNA, 20 bp, mouse
gggaggccaaggcggtgtcc

SEQ ID NO: 572799 - DNA, 20 bp, mouse
gaacagccgggacaccgcct

SEQ ID NO: 572800 - DNA, 20 bp, mouse
ggccgaccccgtcacttgtc

SEQ ID NO: 572801 - DNA, 20 bp, mouse
gcgccgccctaagttgagga

SEQ ID NO: 572802 - DNA, 20 bp, mouse
gccctaagttgaggagggag

SEQ ID NO: 572803 - DNA, 20 bp, mouse
gctccgccggacaagtgacg

SEQ ID NO: 572804 - DNA, 20 bp, mouse
gctgacctccccgcccactt

SEQ ID NO: 572805 - DNA, 20 bp, mouse
gtggcggcggcggtagcgcc

SEQ ID NO: 572806 - DNA, 20 bp, mouse
ggcgtcggcaaggagtagct

SEQ ID NO: 572807 - DNA, 20 bp, mouse
gcgacgccgccggggatgga

SEQ ID NO: 572808 - DNA, 20 bp, mouse
gccggcgcgccctccatccc

SEQ ID NO: 572809 - DNA, 20 bp, mouse
gaggagtagctcggtgaacc

SEQ ID NO: 572810 - DNA, 20 bp, mouse
ggcccacagcgacatcccgg

SEQ ID NO: 572811 - DNA, 20 bp, mouse
gggagcgggaacccgagagt

SEQ ID NO: 572812 - DNA, 20 bp, mouse
gatccccggcggcgtcggca

SEQ ID NO: 572813 - DNA, 20 bp, mouse
gcagcccggaaccctcagcg

SEQ ID NO: 572814 - DNA, 20 bp, mouse
gcgctcctgggaagccacgg

SEQ ID NO: 572815 - DNA, 20 bp, mouse
gtgagcatgcgcagaccagg

SEQ ID NO: 572816 - DNA, 20 bp, mouse
ggggttaccgactgaatctg

SEQ ID NO: 572817 - DNA, 20 bp, mouse
gtgctgggcaaggaatacgt

SEQ ID NO: 572818 - DNA, 20 bp, mouse
ggccgcgcggaccctgaagt

SEQ ID NO: 572819 - DNA, 20 bp, mouse
gctgtttggagttagctacg

SEQ ID NO: 572820 - DNA, 20 bp, mouse
gcggcccagggagcatgagc

SEQ ID NO: 572821 - DNA, 20 bp, mouse
gccgaagctccgctgcgccg

SEQ ID NO: 572822 - DNA, 20 bp, mouse
gaactccaaacagcacctct

SEQ ID NO: 572823 - DNA, 20 bp, mouse
gtctgggactggaagccaag

SEQ ID NO: 572824 - DNA, 20 bp, mouse
gagcggagcttcgggcgcag

SEQ ID NO: 572825 - DNA, 20 bp, mouse
ggcgaggtgcgaggcccttg

SEQ ID NO: 572826 - DNA, 20 bp, mouse
gctactctgtgggagctgag

SEQ ID NO: 572827 - DNA, 20 bp, mouse
gggacaagagggctcagttg

SEQ ID NO: 572828 - DNA, 20 bp, mouse
gggcacgtttagctactctg

SEQ ID NO: 572829 - DNA, 20 bp, mouse
ggggagactccagagagggt

SEQ ID NO: 572830 - DNA, 20 bp, mouse
gagagggctcagttgaggcc

SEQ ID NO: 572831 - DNA, 20 bp, mouse
gcacctggctcctctctcat

SEQ ID NO: 572832 - DNA, 20 bp, mouse
ggagaaaggccatgaggagt

SEQ ID NO: 572833 - DNA, 20 bp, mouse
ggcctctctcccaccctctc

SEQ ID NO: 572834 - DNA, 20 bp, mouse
gggagagaggctatttccag

SEQ ID NO: 572835 - DNA, 20 bp, mouse
gggtggggggagaatgtcca

SEQ ID NO: 572836 - DNA, 20 bp, mouse
gacccgaacccgtcccgcag

SEQ ID NO: 572837 - DNA, 20 bp, mouse
ggtgcccgccaagaccgact

SEQ ID NO: 572838 - DNA, 20 bp, mouse
gacccgtcccgcagcggcag

SEQ ID NO: 572839 - DNA, 20 bp, mouse
ggacgggttcgggtccgagt

SEQ ID NO: 572840 - DNA, 20 bp, mouse
ggggacaacccgggacacag

SEQ ID NO: 572841 - DNA, 20 bp, mouse
gttcgggtccgagtcggtct

SEQ ID NO: 572842 - DNA, 20 bp, mouse
gggtccgagtcggtcttggc

SEQ ID NO: 572843 - DNA, 20 bp, mouse
ggccacgtctggcacatccg

SEQ ID NO: 572844 - DNA, 20 bp, mouse
gactgtgcgccctggcccag

SEQ ID NO: 572845 - DNA, 20 bp, mouse
gacggggcgtgggacaaccc

SEQ ID NO: 572846 - DNA, 20 bp, mouse
gtcgctgtgctctatccctt

SEQ ID NO: 572847 - DNA, 20 bp, mouse
gtttggaagggagtacctaa

SEQ ID NO: 572848 - DNA, 20 bp, mouse
gtcccgagctccatttggaa

SEQ ID NO: 572849 - DNA, 20 bp, mouse
gcggggtcccgagctccatt

SEQ ID NO: 572850 - DNA, 20 bp, mouse
gggcgagcaagtcagcccta

SEQ ID NO: 572851 - DNA, 20 bp, mouse
gatagagcacagcgaggacg

SEQ ID NO: 572852 - DNA, 20 bp, mouse
gtcccttccaaatggagctc

SEQ ID NO: 572853 - DNA, 20 bp, mouse
gcaaaaaaggccagtcgcac

SEQ ID NO: 572854 - DNA, 20 bp, mouse
ggtcagccctagggcaacca

SEQ ID NO: 572855 - DNA, 20 bp, mouse
gagcgccaagcacccaaaaa

SEQ ID NO: 572856 - DNA, 20 bp, mouse
gttgcagtcttgacaggcag

SEQ ID NO: 572857 - DNA, 20 bp, mouse
gtgccacttgcagtcttgac

SEQ ID NO: 572858 - DNA, 20 bp, mouse
gagtcttgacaggcagaggt

SEQ ID NO: 572859 - DNA, 20 bp, mouse
gtggctggagtccgcctagg

SEQ ID NO: 572860 - DNA, 20 bp, mouse
ggagctcgggaagaccggag

SEQ ID NO: 572861 - DNA, 20 bp, mouse
gctgatcccagccgcctagg

SEQ ID NO: 572862 - DNA, 20 bp, mouse
gccgcgcgggcacccggagt

SEQ ID NO: 572863 - DNA, 20 bp, mouse
gctggtagcaccaccctggc

SEQ ID NO: 572864 - DNA, 20 bp, mouse
gtcaccagcccgcggagcgg

SEQ ID NO: 572865 - DNA, 20 bp, mouse
gttcctgatcccagccgcct

SEQ ID NO: 572866 - DNA, 20 bp, mouse
gaagagagcagccggcgcca

SEQ ID NO: 572867 - DNA, 20 bp, mouse
ggcagtgggagccttggcgc

SEQ ID NO: 572868 - DNA, 20 bp, mouse
gcctgtcagaaggactgagc

SEQ ID NO: 572869 - DNA, 20 bp, mouse
gcacagtgctgtaaagaaat

SEQ ID NO: 572870 - DNA, 20 bp, mouse
gcattcatgaggagcaacag

SEQ ID NO: 572871 - DNA, 20 bp, mouse
gcactgaaggagccaatgtg

SEQ ID NO: 572872 - DNA, 20 bp, mouse
gttccagatcacagcctcgg

SEQ ID NO: 572873 - DNA, 20 bp, mouse
gtcttgtgtaacagctaaac

SEQ ID NO: 572874 - DNA, 20 bp, mouse
gacatgtataccttctcctc

SEQ ID NO: 572875 - DNA, 20 bp, mouse
gtgggctagctattcccccg

SEQ ID NO: 572876 - DNA, 20 bp, mouse
ggccagggagaatcactcac

SEQ ID NO: 572877 - DNA, 20 bp, mouse
gggaaagaggaggcctccgg

SEQ ID NO: 572878 - DNA, 20 bp, mouse
gagggagccgggtccgctgg

SEQ ID NO: 572879 - DNA, 20 bp, mouse
gctccgccctgaaggaagcc

SEQ ID NO: 572880 - DNA, 20 bp, mouse
gtgcccccgaggtggaggac

SEQ ID NO: 572881 - DNA, 20 bp, mouse
gttcccgtcctccacctcgg

SEQ ID NO: 572882 - DNA, 20 bp, mouse
gacgagcgggtcccccgccc

SEQ ID NO: 572883 - DNA, 20 bp, mouse
gttcagggcggaggagacgc

SEQ ID NO: 572884 - DNA, 20 bp, mouse
gggccggcgggctgcacgag

SEQ ID NO: 572885 - DNA, 20 bp, mouse
ggggaaggtcagtcctccag

SEQ ID NO: 572886 - DNA, 20 bp, mouse
gcaggggaccgagggaggat

SEQ ID NO: 572887 - DNA, 20 bp, mouse
ggcgcggaggaggcgcacag

SEQ ID NO: 572888 - DNA, 20 bp, mouse
gccgtgagcctggcacggag

SEQ ID NO: 572889 - DNA, 20 bp, mouse
ggtgctggcgctggtgacgt

SEQ ID NO: 572890 - DNA, 20 bp, mouse
ggggcaggcggggcaaacgg

SEQ ID NO: 572891 - DNA, 20 bp, mouse
gcggctgttattgttccgaa

SEQ ID NO: 572892 - DNA, 20 bp, mouse
ggcctcctccgcgccctcac

SEQ ID NO: 572893 - DNA, 20 bp, mouse
ggcacagcggcccagccctt

SEQ ID NO: 572894 - DNA, 20 bp, mouse
gcgggccgcggagacagtcg

SEQ ID NO: 572895 - DNA, 20 bp, mouse
gcagcactgcggaaatggag

SEQ ID NO: 572896 - DNA, 20 bp, mouse
ggagtggctagagaggtcgg

SEQ ID NO: 572897 - DNA, 20 bp, mouse
gtagagaggtcggaggtaag

SEQ ID NO: 572898 - DNA, 20 bp, mouse
gaggagacccgtagattgag

SEQ ID NO: 572899 - DNA, 20 bp, mouse
gagtggctgtagaaatcggg

SEQ ID NO: 572900 - DNA, 20 bp, mouse
gtgtagaaatcgggaggacc

SEQ ID NO: 572901 - DNA, 20 bp, mouse
gagcgtaagtcatggtcccg

SEQ ID NO: 572902 - DNA, 20 bp, mouse
gagccgctggctcccagaca

SEQ ID NO: 572903 - DNA, 20 bp, mouse
gattgagtggctagagaggt

SEQ ID NO: 572904 - DNA, 20 bp, mouse
ggctagaagggctggagcgg

SEQ ID NO: 572905 - DNA, 20 bp, mouse
ggctggagcggaggcaaata

SEQ ID NO: 572906 - DNA, 20 bp, mouse
gctggtcctgctgctactca

SEQ ID NO: 572907 - DNA, 20 bp, mouse
gctgcggtgtcctaagtcca

SEQ ID NO: 572908 - DNA, 20 bp, mouse
gtaagcgggagggataactt

SEQ ID NO: 572909 - DNA, 20 bp, mouse
gggattcgggaggttctcac

SEQ ID NO: 572910 - DNA, 20 bp, mouse
gagggactgactccagtcct

SEQ ID NO: 572911 - DNA, 20 bp, mouse
ggccttgagaactaagcggg

SEQ ID NO: 572912 - DNA, 20 bp, mouse
ggagtcacgcacgcaagaga

SEQ ID NO: 572913 - DNA, 20 bp, mouse
ggactccagtccttggactt

SEQ ID NO: 572914 - DNA, 20 bp, mouse
gcacgaggagggcaaaggtg

SEQ ID NO: 572915 - DNA, 20 bp, mouse
gtttttaaggctaggagagg

SEQ ID NO: 572916 - DNA, 20 bp, mouse
gcgcggccggcgagagtcct

SEQ ID NO: 572917 - DNA, 20 bp, mouse
gtccgggagggagccaccag

SEQ ID NO: 572918 - DNA, 20 bp, mouse
ggcgggcagcgcagagacaa

SEQ ID NO: 572919 - DNA, 20 bp, mouse
gggcgctcgggagaatctgg

SEQ ID NO: 572920 - DNA, 20 bp, mouse
gctgggagacagcaggacgc

SEQ ID NO: 572921 - DNA, 20 bp, mouse
gagacagcaggacgcaggct

SEQ ID NO: 572922 - DNA, 20 bp, mouse
gatggagcgcgcgggacatg

SEQ ID NO: 572923 - DNA, 20 bp, mouse
gtgtctcccaggactctcgc

SEQ ID NO: 572924 - DNA, 20 bp, mouse
gtctgggtcgggcccggccg

SEQ ID NO: 572925 - DNA, 20 bp, mouse
gagaagccgggatcccccgt

SEQ ID NO: 572926 - DNA, 20 bp, mouse
gtagggaacttcttccccaa

SEQ ID NO: 572927 - DNA, 20 bp, mouse
ggaagaagttccctaggccg

SEQ ID NO: 572928 - DNA, 20 bp, mouse
ggcgcagtcacgcgagtcac

SEQ ID NO: 572929 - DNA, 20 bp, mouse
gcatggcgggcgagggacta

SEQ ID NO: 572930 - DNA, 20 bp, mouse
gtcgcccgccatgggtgcca

SEQ ID NO: 572931 - DNA, 20 bp, mouse
gccctaggccgtggcaccca

SEQ ID NO: 572932 - DNA, 20 bp, mouse
gtcatcggcgagctcggcgt

SEQ ID NO: 572933 - DNA, 20 bp, mouse
gtcacgcgagtcaccggacc

SEQ ID NO: 572934 - DNA, 20 bp, mouse
gagcagcgcgcagtaggttc

SEQ ID NO: 572935 - DNA, 20 bp, mouse
gtctgtcaggtcggcctttg

SEQ ID NO: 572936 - DNA, 20 bp, mouse
gcggcgcacgcacacacggg

SEQ ID NO: 572937 - DNA, 20 bp, mouse
gtccgggcagggaggaacct

SEQ ID NO: 572938 - DNA, 20 bp, mouse
gagaagaccgtggaaatcga

SEQ ID NO: 572939 - DNA, 20 bp, mouse
gggctcccatggcccaggat

SEQ ID NO: 572940 - DNA, 20 bp, mouse
ggggtcccaaccccactcga

SEQ ID NO: 572941 - DNA, 20 bp, mouse
gcccgcagaagcggaaggtc

SEQ ID NO: 572942 - DNA, 20 bp, mouse
gttgccggcgcacgcacaca

SEQ ID NO: 572943 - DNA, 20 bp, mouse
gacaagactgaggccactat

SEQ ID NO: 572944 - DNA, 20 bp, mouse
gttgtgtggagccctcgagt

SEQ ID NO: 572945 - DNA, 20 bp, mouse
ggggctccacacaaagaaag

SEQ ID NO: 572946 - DNA, 20 bp, mouse
gccgcgggctgtggggagtt

SEQ ID NO: 572947 - DNA, 20 bp, mouse
ggccggagcacagaagccgc

SEQ ID NO: 572948 - DNA, 20 bp, mouse
gtgatcggcgactcgaacgt

SEQ ID NO: 572949 - DNA, 20 bp, mouse
ggcgtcgtttgtcactgcta

SEQ ID NO: 572950 - DNA, 20 bp, mouse
ggcggtgcccgcgggctgtg

SEQ ID NO: 572951 - DNA, 20 bp, mouse
gcggggcgccacacctgggt

SEQ ID NO: 572952 - DNA, 20 bp, mouse
gtggcgtggcgtcattcccg

SEQ ID NO: 572953 - DNA, 20 bp, mouse
gtgctagggagcgctgtcgc

SEQ ID NO: 572954 - DNA, 20 bp, mouse
ggacacctgccaagaaggag

SEQ ID NO: 572955 - DNA, 20 bp, mouse
gtccagctgtgcggtgtcag

SEQ ID NO: 572956 - DNA, 20 bp, mouse
gagtggtcccggggaagacg

SEQ ID NO: 572957 - DNA, 20 bp, mouse
ggatgctgtgctacaatcac

SEQ ID NO: 572958 - DNA, 20 bp, mouse
gggaagacgcggctccaaca

SEQ ID NO: 572959 - DNA, 20 bp, mouse
gcgttgggtaagtggtcccg

SEQ ID NO: 572960 - DNA, 20 bp, mouse
gcgtcccgaagaccactcgg

SEQ ID NO: 572961 - DNA, 20 bp, mouse
gcctcgaccggtgagaggag

SEQ ID NO: 572962 - DNA, 20 bp, mouse
ggcgagggccgcgctgaagg

SEQ ID NO: 572963 - DNA, 20 bp, mouse
gccccatcaccagttccgtt

SEQ ID NO: 572964 - DNA, 20 bp, mouse
ggcccgggcagcgcgcgagg

SEQ ID NO: 572965 - DNA, 20 bp, mouse
ggagccgccgaggggaaaag

SEQ ID NO: 572966 - DNA, 20 bp, mouse
gcgctgccggagcagccggg

SEQ ID NO: 572967 - DNA, 20 bp, mouse
gccgcagcgaggggactccg

SEQ ID NO: 572968 - DNA, 20 bp, mouse
gcagcgaggggactccgggg

SEQ ID NO: 572969 - DNA, 20 bp, mouse
gcgccgctgccggagcagcc

SEQ ID NO: 572970 - DNA, 20 bp, mouse
gacagcggtgagggccgcag

SEQ ID NO: 572971 - DNA, 20 bp, mouse
gtcatcggcgacagcggtga

SEQ ID NO: 572972 - DNA, 20 bp, mouse
ggagggagctgcggatcgcg

SEQ ID NO: 572973 - DNA, 20 bp, mouse
gtgctcatcatcggcgacag

SEQ ID NO: 572974 - DNA, 20 bp, mouse
ggggcgggcggggtcggtcc

SEQ ID NO: 572975 - DNA, 20 bp, mouse
gcagttccggctgtttgttc

SEQ ID NO: 572976 - DNA, 20 bp, mouse
gctgcagccgggagggtgag

SEQ ID NO: 572977 - DNA, 20 bp, mouse
ggcaggagccaggtcagaag

SEQ ID NO: 572978 - DNA, 20 bp, mouse
gggacgcgtctgcagccggg

SEQ ID NO: 572979 - DNA, 20 bp, mouse
gcctcaggaccataacctcc

SEQ ID NO: 572980 - DNA, 20 bp, mouse
gttgctgtggtgatttgcag

SEQ ID NO: 572981 - DNA, 20 bp, mouse
gcggcctgcgcgccggaacc

SEQ ID NO: 572982 - DNA, 20 bp, mouse
gccaggacgcgtctgcagcc

SEQ ID NO: 572983 - DNA, 20 bp, mouse
gaccccatgcctaggaagag

SEQ ID NO: 572984 - DNA, 20 bp, mouse
gccaggatggacgctcactg

SEQ ID NO: 572985 - DNA, 20 bp, mouse
gagaaggagcccctcttcct

SEQ ID NO: 572986 - DNA, 20 bp, mouse
ggactgtccggggacatgac

SEQ ID NO: 572987 - DNA, 20 bp, mouse
gcatgtccccggacagtcag

SEQ ID NO: 572988 - DNA, 20 bp, mouse
ggagctgctaccgctgggga

SEQ ID NO: 572989 - DNA, 20 bp, mouse
gggggcctcgccatccccag

SEQ ID NO: 572990 - DNA, 20 bp, mouse
gaccaggagctgctaccgct

SEQ ID NO: 572991 - DNA, 20 bp, mouse
gggtgtgccagtcatgtccc

SEQ ID NO: 572992 - DNA, 20 bp, mouse
gcgtagttcgggctgaaggg

SEQ ID NO: 572993 - DNA, 20 bp, mouse
gcccggctcgaagcaagcga

SEQ ID NO: 572994 - DNA, 20 bp, mouse
gcagaagaggggtgtagaca

SEQ ID NO: 572995 - DNA, 20 bp, mouse
ggctcacctctgactgtccg

SEQ ID NO: 572996 - DNA, 20 bp, mouse
gggagaccggagctctatgt

SEQ ID NO: 572997 - DNA, 20 bp, mouse
ggctctgggaagcacagccg

SEQ ID NO: 572998 - DNA, 20 bp, mouse
gatagagctccggtctccgt

SEQ ID NO: 572999 - DNA, 20 bp, mouse
ggcttcccagagcaagctcc

SEQ ID NO: 573000 - DNA, 20 bp, mouse
ggctgggcaccgacggagac

SEQ ID NO: 573001 - DNA, 20 bp, mouse
gggcgtgctggcgcaggata

SEQ ID NO: 573002 - DNA, 20 bp, mouse
gaagcgcccacatagagctc

SEQ ID NO: 573003 - DNA, 20 bp, mouse
ggagccagtgaggagttcgg

SEQ ID NO: 573004 - DNA, 20 bp, mouse
ggggaagcacagccggggct

SEQ ID NO: 573005 - DNA, 20 bp, mouse
gcggagcctggagcttgctc

SEQ ID NO: 573006 - DNA, 20 bp, mouse
gcgcagccgcaggaagatgc

SEQ ID NO: 573007 - DNA, 20 bp, mouse
gccagagggcggctaccagg

SEQ ID NO: 573008 - DNA, 20 bp, mouse
gggaagatgctggaagcggg

SEQ ID NO: 573009 - DNA, 20 bp, mouse
ggagggcggctaccaggcgg

SEQ ID NO: 573010 - DNA, 20 bp, mouse
gccgccctctggggaaggag

SEQ ID NO: 573011 - DNA, 20 bp, mouse
ggcgccgcgtaggtgctgaa

SEQ ID NO: 573012 - DNA, 20 bp, mouse
gtgatcggagactccacggt

SEQ ID NO: 573013 - DNA, 20 bp, mouse
gtccccagagggcggctacc

SEQ ID NO: 573014 - DNA, 20 bp, mouse
gtgtcccttcagcacctacg

SEQ ID NO: 573015 - DNA, 20 bp, mouse
gggcaggagcgcttcaggta

SEQ ID NO: 573016 - DNA, 20 bp, mouse
gcaggcgctgggggaacgaa

SEQ ID NO: 573017 - DNA, 20 bp, mouse
gatggatgctgcgctcgcaa

SEQ ID NO: 573018 - DNA, 20 bp, mouse
gtggtagcctgaagcaaggt

SEQ ID NO: 573019 - DNA, 20 bp, mouse
gaggtaggcccaggcgctgg

SEQ ID NO: 573020 - DNA, 20 bp, mouse
gtacagccagatggcctcca

SEQ ID NO: 573021 - DNA, 20 bp, mouse
gcgctgggggaacgaaggga

SEQ ID NO: 573022 - DNA, 20 bp, mouse
gcctgaagcaaggtaggccc

SEQ ID NO: 573023 - DNA, 20 bp, mouse
gtcggccgcgagaacatcac

SEQ ID NO: 573024 - DNA, 20 bp, mouse
ggcaaggtaggcccaggcgc

SEQ ID NO: 573025 - DNA, 20 bp, mouse
gtcgcggccgatctagaaac

SEQ ID NO: 573026 - DNA, 20 bp, mouse
gacgtcagctaggactgcag

SEQ ID NO: 573027 - DNA, 20 bp, mouse
ggccccagaagaggatgcgg

SEQ ID NO: 573028 - DNA, 20 bp, mouse
gcgggccccagaagaggatg

SEQ ID NO: 573029 - DNA, 20 bp, mouse
gcgggggctgcaggcggcag

SEQ ID NO: 573030 - DNA, 20 bp, mouse
gatgcgggggatgcaggcgg

SEQ ID NO: 573031 - DNA, 20 bp, mouse
gtgacgtcctgcaaagccag

SEQ ID NO: 573032 - DNA, 20 bp, mouse
gaggatgcgggggatgcagg

SEQ ID NO: 573033 - DNA, 20 bp, mouse
ggcgcccgctgggcatggag

SEQ ID NO: 573034 - DNA, 20 bp, mouse
ggctttgcaggacgtcagct

SEQ ID NO: 573035 - DNA, 20 bp, mouse
gccgggctctgcgacagagg

SEQ ID NO: 573036 - DNA, 20 bp, mouse
gcctattaccgaggcgccat

SEQ ID NO: 573037 - DNA, 20 bp, mouse
gtacattaggatgaagccca

SEQ ID NO: 573038 - DNA, 20 bp, mouse
gccaagagtaggcctctggt

SEQ ID NO: 573039 - DNA, 20 bp, mouse
ggatgaagcccatggcgcct

SEQ ID NO: 573040 - DNA, 20 bp, mouse
gattggtgatgtcatacatt

SEQ ID NO: 573041 - DNA, 20 bp, mouse
gacatggcttgtcccaccag

SEQ ID NO: 573042 - DNA, 20 bp, mouse
gtcaccacagcctattaccg

SEQ ID NO: 573043 - DNA, 20 bp, mouse
ggcattaaatgactcctcat

SEQ ID NO: 573044 - DNA, 20 bp, mouse
gtacctgggtagagatcagt

SEQ ID NO: 573045 - DNA, 20 bp, mouse
gcatgctggggacgaaccca

SEQ ID NO: 573046 - DNA, 20 bp, mouse
gtgttgcacttggcgatagt

SEQ ID NO: 573047 - DNA, 20 bp, mouse
gagccctccgtagccgaggt

SEQ ID NO: 573048 - DNA, 20 bp, mouse
gcttggcgatagtgggtgag

SEQ ID NO: 573049 - DNA, 20 bp, mouse
gttcccacctcggctacgga

SEQ ID NO: 573050 - DNA, 20 bp, mouse
gctgcggtgcgggtccctgg

SEQ ID NO: 573051 - DNA, 20 bp, mouse
gctggttcccacctcggcta

SEQ ID NO: 573052 - DNA, 20 bp, mouse
ggcgggtctggttcccacct

SEQ ID NO: 573053 - DNA, 20 bp, mouse
gtgaggctctggctgaagat

SEQ ID NO: 573054 - DNA, 20 bp, mouse
gatcgccaagtgcaacagtc

SEQ ID NO: 573055 - DNA, 20 bp, mouse
gcctcagccctccgtagccg

SEQ ID NO: 573056 - DNA, 20 bp, mouse
ggcttgtgcggagtcaggag

SEQ ID NO: 573057 - DNA, 20 bp, mouse
gacagctccggtgctgatgt

SEQ ID NO: 573058 - DNA, 20 bp, mouse
gtccggtgctgatgttggag

SEQ ID NO: 573059 - DNA, 20 bp, mouse
gcccgctccaacatcagcac

SEQ ID NO: 573060 - DNA, 20 bp, mouse
gacgaggcgcccatgcaggt

SEQ ID NO: 573061 - DNA, 20 bp, mouse
gagtcaggagcggacagctc

SEQ ID NO: 573062 - DNA, 20 bp, mouse
ggcaacactccgcacgcgtg

SEQ ID NO: 573063 - DNA, 20 bp, mouse
gtggtctcggagaaactgag

SEQ ID NO: 573064 - DNA, 20 bp, mouse
gctacagagccccacgcgtg

SEQ ID NO: 573065 - DNA, 20 bp, mouse
gcccctccagctgcactggg

SEQ ID NO: 573066 - DNA, 20 bp, mouse
gtggcagcgccggcagctgt

SEQ ID NO: 573067 - DNA, 20 bp, mouse
gggggccgtagcaacttcgt

SEQ ID NO: 573068 - DNA, 20 bp, mouse
ggttgctacggccccgcaca

SEQ ID NO: 573069 - DNA, 20 bp, mouse
gcggagccggcgcgggatcc

SEQ ID NO: 573070 - DNA, 20 bp, mouse
gggcgaggccgcagaagact

SEQ ID NO: 573071 - DNA, 20 bp, mouse
gaccctcgccccacagctgc

SEQ ID NO: 573072 - DNA, 20 bp, mouse
gtccgcccacgaagttgcta

SEQ ID NO: 573073 - DNA, 20 bp, mouse
gagggtcgcagccctgtgcg

SEQ ID NO: 573074 - DNA, 20 bp, mouse
ggtgtcagtgttggcagcgc

SEQ ID NO: 573075 - DNA, 20 bp, mouse
gacgcgcgtgcactatgaca

SEQ ID NO: 573076 - DNA, 20 bp, mouse
gtctgtgacagaggcaccca

SEQ ID NO: 573077 - DNA, 20 bp, mouse
gtgcgggccactgacgtcgg

SEQ ID NO: 573078 - DNA, 20 bp, mouse
ggctccgctccgcaagatgg

SEQ ID NO: 573079 - DNA, 20 bp, mouse
gaagatggcggcggacagtg

SEQ ID NO: 573080 - DNA, 20 bp, mouse
gagctgcgggccactgacgt

SEQ ID NO: 573081 - DNA, 20 bp, mouse
ggacgctccgctccgcaaga

SEQ ID NO: 573082 - DNA, 20 bp, mouse
ggccccgggcggcatcacac

SEQ ID NO: 573083 - DNA, 20 bp, mouse
gggaagaagagacgaagcgt

SEQ ID NO: 573084 - DNA, 20 bp, mouse
ggaggtgagttctgcgccct

SEQ ID NO: 573085 - DNA, 20 bp, mouse
ggttctgccgccgacgtcag

SEQ ID NO: 573086 - DNA, 20 bp, mouse
gcccgggccactccacccga

SEQ ID NO: 573087 - DNA, 20 bp, mouse
gcgtgctgtcagccttcggg

SEQ ID NO: 573088 - DNA, 20 bp, mouse
gagggtagctgaagctttcg

SEQ ID NO: 573089 - DNA, 20 bp, mouse
ggtggtccctagccacgccc

SEQ ID NO: 573090 - DNA, 20 bp, mouse
gcgggacgccgagggaaggg

SEQ ID NO: 573091 - DNA, 20 bp, mouse
gtgtcagccttcgggtggag

SEQ ID NO: 573092 - DNA, 20 bp, mouse
gagtggcccgggcgtggcta

SEQ ID NO: 573093 - DNA, 20 bp, mouse
gagggaccacgagccccgcg

SEQ ID NO: 573094 - DNA, 20 bp, mouse
gacccccggcgccctgaaga

SEQ ID NO: 573095 - DNA, 20 bp, mouse
gggtctcctcccgcaggtga

SEQ ID NO: 573096 - DNA, 20 bp, mouse
gccctttggagaccaccagg

SEQ ID NO: 573097 - DNA, 20 bp, mouse
gtctgcgctcgacctcctgg

SEQ ID NO: 573098 - DNA, 20 bp, mouse
gggccaggctgaggtccctt

SEQ ID NO: 573099 - DNA, 20 bp, mouse
gtgtgaggctctgcctggtg

SEQ ID NO: 573100 - DNA, 20 bp, mouse
gcacttcctgggctcctcag

SEQ ID NO: 573101 - DNA, 20 bp, mouse
gggctctgcgctcgacctcc

SEQ ID NO: 573102 - DNA, 20 bp, mouse
gtgctcctgagagatagcaa

SEQ ID NO: 573103 - DNA, 20 bp, mouse
ggtcgtgggacactgagggg

SEQ ID NO: 573104 - DNA, 20 bp, mouse
ggaggtcgtgggacactgag

SEQ ID NO: 573105 - DNA, 20 bp, mouse
gtagcaaaggttagtgtgtg

SEQ ID NO: 573106 - DNA, 20 bp, mouse
gcggtggagcgattgacagg

SEQ ID NO: 573107 - DNA, 20 bp, mouse
ggagcgattgacaggcggca

SEQ ID NO: 573108 - DNA, 20 bp, mouse
gtcctgggatgggtgaacag

SEQ ID NO: 573109 - DNA, 20 bp, mouse
ggggcccccggcagagttgg

SEQ ID NO: 573110 - DNA, 20 bp, mouse
gagggcagctctggggcccc

SEQ ID NO: 573111 - DNA, 20 bp, mouse
gtggcggtggagcgattgac

SEQ ID NO: 573112 - DNA, 20 bp, mouse
gcagcgggacagactggcgg

SEQ ID NO: 573113 - DNA, 20 bp, mouse
gcgcgaggacgcggctacgg

SEQ ID NO: 573114 - DNA, 20 bp, mouse
gcgcgccgccaactctgccg

SEQ ID NO: 573115 - DNA, 20 bp, mouse
gttggcggcgcgcgaggacg

SEQ ID NO: 573116 - DNA, 20 bp, mouse
gcgggagacgcggaggacgg

SEQ ID NO: 573117 - DNA, 20 bp, mouse
gtcgcagagagcgccagccg

SEQ ID NO: 573118 - DNA, 20 bp, mouse
ggtgcccagctcgggagacg

SEQ ID NO: 573119 - DNA, 20 bp, mouse
gacgccgctccactccgccg

SEQ ID NO: 573120 - DNA, 20 bp, mouse
gctccgggccggcgggacaa

SEQ ID NO: 573121 - DNA, 20 bp, mouse
gtctctgcgatgggagccga

SEQ ID NO: 573122 - DNA, 20 bp, mouse
ggctgggcacgcgcaccctg

SEQ ID NO: 573123 - DNA, 20 bp, mouse
gggagccccggggacccgaa

SEQ ID NO: 573124 - DNA, 20 bp, mouse
gcagcgctcgcagagccgca

SEQ ID NO: 573125 - DNA, 20 bp, mouse
gcccgggagtgggagaacag

SEQ ID NO: 573126 - DNA, 20 bp, mouse
gcgcagccttgggccggtat

SEQ ID NO: 573127 - DNA, 20 bp, mouse
ggcccaaggctgcgcgcagg

SEQ ID NO: 573128 - DNA, 20 bp, mouse
ggaccggtggagcgttcgag

SEQ ID NO: 573129 - DNA, 20 bp, mouse
gccccgcccataccggccca

SEQ ID NO: 573130 - DNA, 20 bp, mouse
ggggtggccgtaaggagact

SEQ ID NO: 573131 - DNA, 20 bp, mouse
gccggcatgatgagctccct

SEQ ID NO: 573132 - DNA, 20 bp, mouse
ggctgtcaagctcccccgac

SEQ ID NO: 573133 - DNA, 20 bp, mouse
gccagccaccccgcccatac

SEQ ID NO: 573134 - DNA, 20 bp, mouse
gagccttgggccggtatggg

SEQ ID NO: 573135 - DNA, 20 bp, mouse
gggcccctcgaacgctccac

SEQ ID NO: 573136 - DNA, 20 bp, mouse
ggtgcggcgggcgggaggat

SEQ ID NO: 573137 - DNA, 20 bp, mouse
gccttcgcccgcaggtctgg

SEQ ID NO: 573138 - DNA, 20 bp, mouse
gggtaatcgtagctcttcac

SEQ ID NO: 573139 - DNA, 20 bp, mouse
gggcaccgccgccagacctg

SEQ ID NO: 573140 - DNA, 20 bp, mouse
gggtgccgtgcgggaagcgg

SEQ ID NO: 573141 - DNA, 20 bp, mouse
ggtacgcctacagcaacggt

SEQ ID NO: 573142 - DNA, 20 bp, mouse
ggcttgccgacggctcctca

SEQ ID NO: 573143 - DNA, 20 bp, mouse
gtgctcaagttcctgctggt

SEQ ID NO: 573144 - DNA, 20 bp, mouse
gaccgcagcgacacgcgcag

SEQ ID NO: 573145 - DNA, 20 bp, mouse
gagcggggcgggtgcactgg

SEQ ID NO: 573146 - DNA, 20 bp, mouse
gtgctcggggacgcaggggt

SEQ ID NO: 573147 - DNA, 20 bp, mouse
ggggagcccagatcctatgg

SEQ ID NO: 573148 - DNA, 20 bp, mouse
ggcggggagcccagatccta

SEQ ID NO: 573149 - DNA, 20 bp, mouse
ggcgctgctcggggacgcag

SEQ ID NO: 573150 - DNA, 20 bp, mouse
ggagcagcgcgatccgaaat

SEQ ID NO: 573151 - DNA, 20 bp, mouse
gtgcagccggccgcctccat

SEQ ID NO: 573152 - DNA, 20 bp, mouse
gagcccagatcctatggagg

SEQ ID NO: 573153 - DNA, 20 bp, mouse
ggccaagagtgcttcaggtg

SEQ ID NO: 573154 - DNA, 20 bp, mouse
gggccgcctccataggatct

SEQ ID NO: 573155 - DNA, 20 bp, mouse
gcggatcccgaacccactgt

SEQ ID NO: 573156 - DNA, 20 bp, mouse
gagtcctcggggctccggag

SEQ ID NO: 573157 - DNA, 20 bp, mouse
gagagctgcggagggccggg

SEQ ID NO: 573158 - DNA, 20 bp, mouse
ggggcggagccgagtcctcg

SEQ ID NO: 573159 - DNA, 20 bp, mouse
gccggcacggcaccgacggc

SEQ ID NO: 573160 - DNA, 20 bp, mouse
gaggtagccgtgggccggca

SEQ ID NO: 573161 - DNA, 20 bp, mouse
gcgggagtcctgggacgcaa

SEQ ID NO: 573162 - DNA, 20 bp, mouse
gtgaagacgctggagatcca

SEQ ID NO: 573163 - DNA, 20 bp, mouse
gtgggccggcacggcaccga

SEQ ID NO: 573164 - DNA, 20 bp, mouse
gtagtgggcgacgcgagcgt

SEQ ID NO: 573165 - DNA, 20 bp, mouse
gacctgaacgagctgcacgg

SEQ ID NO: 573166 - DNA, 20 bp, mouse
gggacctggagactctcttc

SEQ ID NO: 573167 - DNA, 20 bp, mouse
gtcagaggcaatgctcaaac

SEQ ID NO: 573168 - DNA, 20 bp, mouse
ggtcagagtctcgcctacag

SEQ ID NO: 573169 - DNA, 20 bp, mouse
ggactctcttctggagtgac

SEQ ID NO: 573170 - DNA, 20 bp, mouse
gcaatggacaccattgacag

SEQ ID NO: 573171 - DNA, 20 bp, mouse
ggagtctaagatggtgactg

SEQ ID NO: 573172 - DNA, 20 bp, mouse
gacaccattgacaggggtgg

SEQ ID NO: 573173 - DNA, 20 bp, mouse
gccccttgctcaatactacc

SEQ ID NO: 573174 - DNA, 20 bp, mouse
gccacccccacccctgtcaa

SEQ ID NO: 573175 - DNA, 20 bp, mouse
gagattgctgagggcaagtg

SEQ ID NO: 573176 - DNA, 20 bp, mouse
gagagccgggaacgggccca

SEQ ID NO: 573177 - DNA, 20 bp, mouse
ggagcgtggagagccgggaa

SEQ ID NO: 573178 - DNA, 20 bp, mouse
ggagcgagaggaaccgagcg

SEQ ID NO: 573179 - DNA, 20 bp, mouse
gctcgccgtgggcccgttcc

SEQ ID NO: 573180 - DNA, 20 bp, mouse
gctcgctctgcggagactgg

SEQ ID NO: 573181 - DNA, 20 bp, mouse
gcgcggagccgagtcccgct

SEQ ID NO: 573182 - DNA, 20 bp, mouse
ggctgcggcccagcgggact

SEQ ID NO: 573183 - DNA, 20 bp, mouse
ggccaccggctgcggcccag

SEQ ID NO: 573184 - DNA, 20 bp, mouse
ggcccggcgaaggagcccgg

SEQ ID NO: 573185 - DNA, 20 bp, mouse
gggaaccgagcgtggagagc

SEQ ID NO: 573186 - DNA, 20 bp, mouse
ggctggcagccgctccactc

SEQ ID NO: 573187 - DNA, 20 bp, mouse
ggcggcgccgggtccagaag

SEQ ID NO: 573188 - DNA, 20 bp, mouse
ggccgggtccagaagtggaa

SEQ ID NO: 573189 - DNA, 20 bp, mouse
gaccgctgagggccgcaata

SEQ ID NO: 573190 - DNA, 20 bp, mouse
ggccagccgaggaacaggcg

SEQ ID NO: 573191 - DNA, 20 bp, mouse
gcgcagccgcgcctgttcct

SEQ ID NO: 573192 - DNA, 20 bp, mouse
ggcggtgaaggcggaagtgg

SEQ ID NO: 573193 - DNA, 20 bp, mouse
ggagccatggccgagaccta

SEQ ID NO: 573194 - DNA, 20 bp, mouse
ggccatattgcggccctcag

SEQ ID NO: 573195 - DNA, 20 bp, mouse
gcggggtctgcccggatacg

SEQ ID NO: 573196 - DNA, 20 bp, mouse
gtctgaggggaggagaccga

SEQ ID NO: 573197 - DNA, 20 bp, mouse
ggccggggcggtctgagggg

SEQ ID NO: 573198 - DNA, 20 bp, mouse
gggagccggggcggtctgag

SEQ ID NO: 573199 - DNA, 20 bp, mouse
gtcctcccctcagaccgccc

SEQ ID NO: 573200 - DNA, 20 bp, mouse
gaaaggaaggcggaacggag

SEQ ID NO: 573201 - DNA, 20 bp, mouse
gagcgcggcgactctggagg

SEQ ID NO: 573202 - DNA, 20 bp, mouse
gtcgagcgcggcgactctgg

SEQ ID NO: 573203 - DNA, 20 bp, mouse
gagacgcagcccggcagggg

SEQ ID NO: 573204 - DNA, 20 bp, mouse
gcagagtcccgcgccggcca

SEQ ID NO: 573205 - DNA, 20 bp, mouse
ggctgcgtgcggctacgtgg

SEQ ID NO: 573206 - DNA, 20 bp, mouse
ggagctgatggagcccacaa

SEQ ID NO: 573207 - DNA, 20 bp, mouse
gacaggcttgggcccgacgg

SEQ ID NO: 573208 - DNA, 20 bp, mouse
gtccatcagctcggtacctg

SEQ ID NO: 573209 - DNA, 20 bp, mouse
gttgggcccgacgggggata

SEQ ID NO: 573210 - DNA, 20 bp, mouse
gcagaggcggaggtcccgag

SEQ ID NO: 573211 - DNA, 20 bp, mouse
gctcctggagagggccgaag

SEQ ID NO: 573212 - DNA, 20 bp, mouse
ggccaggcggcgctcctctc

SEQ ID NO: 573213 - DNA, 20 bp, mouse
gcctccgcctctgcccttgt

SEQ ID NO: 573214 - DNA, 20 bp, mouse
ggctgtcccacaggcctagt

SEQ ID NO: 573215 - DNA, 20 bp, mouse
ggccccaggtaccgagctga

SEQ ID NO: 573216 - DNA, 20 bp, mouse
ggagcctgggacaccgccgg

SEQ ID NO: 573217 - DNA, 20 bp, mouse
ggggagaggagcggagtctg

SEQ ID NO: 573218 - DNA, 20 bp, mouse
gtgaagatccggatccggag

SEQ ID NO: 573219 - DNA, 20 bp, mouse
gatccggagcggctgaaagg

SEQ ID NO: 573220 - DNA, 20 bp, mouse
gccacccccggcggtgtccc

SEQ ID NO: 573221 - DNA, 20 bp, mouse
gagcggctgaaaggcggaag

SEQ ID NO: 573222 - DNA, 20 bp, mouse
ggtccccctaagctaaggtt

SEQ ID NO: 573223 - DNA, 20 bp, mouse
gcggatccggagcggctgaa

SEQ ID NO: 573224 - DNA, 20 bp, mouse
gaggaggaaagggtacccca

SEQ ID NO: 573225 - DNA, 20 bp, mouse
gcagggcgtcaggccaaagg

SEQ ID NO: 573226 - DNA, 20 bp, mouse
ggcggagactgaggtgagag

SEQ ID NO: 573227 - DNA, 20 bp, mouse
ggaacgcggcgcggagactg

SEQ ID NO: 573228 - DNA, 20 bp, mouse
gggagagtgcctccaccgac

SEQ ID NO: 573229 - DNA, 20 bp, mouse
gcgcgttctgagggaaggaa

SEQ ID NO: 573230 - DNA, 20 bp, mouse
ggctaggcgactctgcgggg

SEQ ID NO: 573231 - DNA, 20 bp, mouse
gtcccgtgcggtggagaaag

SEQ ID NO: 573232 - DNA, 20 bp, mouse
ggaagagggccgagctgaag

SEQ ID NO: 573233 - DNA, 20 bp, mouse
ggagcgccgcagacgcgtct

SEQ ID NO: 573234 - DNA, 20 bp, mouse
ggaaaccaggaaagcactgg

SEQ ID NO: 573235 - DNA, 20 bp, mouse
gcgcagacgcgtctgggtct

SEQ ID NO: 573236 - DNA, 20 bp, mouse
ggccgcagctggggagtcag

SEQ ID NO: 573237 - DNA, 20 bp, mouse
gcagggaccgagctgggcgg

SEQ ID NO: 573238 - DNA, 20 bp, mouse
ggcgggcagcgaggcacggg

SEQ ID NO: 573239 - DNA, 20 bp, mouse
ggtgcagccaacgccaccca

SEQ ID NO: 573240 - DNA, 20 bp, mouse
ggtgcgtccgggaggaccga

SEQ ID NO: 573241 - DNA, 20 bp, mouse
gcagcgaggcacgggcggag

SEQ ID NO: 573242 - DNA, 20 bp, mouse
ggctgggagggtccctagtg

SEQ ID NO: 573243 - DNA, 20 bp, mouse
gacggcggcgacggcggaaa

SEQ ID NO: 573244 - DNA, 20 bp, mouse
gctggggccgggcgaggagg

SEQ ID NO: 573245 - DNA, 20 bp, mouse
ggacatggtgctggcagctg

SEQ ID NO: 573246 - DNA, 20 bp, mouse
gaccataaagcccaaggcgg

SEQ ID NO: 573247 - DNA, 20 bp, mouse
gttgaccataaagcccaagg

SEQ ID NO: 573248 - DNA, 20 bp, mouse
ggcggaagtggaagcaaggc

SEQ ID NO: 573249 - DNA, 20 bp, mouse
gctgctcaccgcagggtcaa

SEQ ID NO: 573250 - DNA, 20 bp, mouse
gaagcccaaggcggcggcgt

SEQ ID NO: 573251 - DNA, 20 bp, mouse
gggcccggaggcccaagcgg

SEQ ID NO: 573252 - DNA, 20 bp, mouse
gtggcgggtacgggatcctc

SEQ ID NO: 573253 - DNA, 20 bp, mouse
gtcgccgaggacgccaggcc

SEQ ID NO: 573254 - DNA, 20 bp, mouse
gcagacacttccgctcgggg

SEQ ID NO: 573255 - DNA, 20 bp, mouse
gggctttatggtcaaagctc

SEQ ID NO: 573256 - DNA, 20 bp, mouse
ggcaggacggggaccggaca

SEQ ID NO: 573257 - DNA, 20 bp, mouse
ggtgtgtgcggtccgagaaa

SEQ ID NO: 573258 - DNA, 20 bp, mouse
gctgggaagtgcgccgccag

SEQ ID NO: 573259 - DNA, 20 bp, mouse
gcgccgccagtggcaggacg

SEQ ID NO: 573260 - DNA, 20 bp, mouse
gaggcaacctcggtacccag

SEQ ID NO: 573261 - DNA, 20 bp, mouse
ggagaacccgggagccaaag

SEQ ID NO: 573262 - DNA, 20 bp, mouse
ggaccgcacacacaaaattg

SEQ ID NO: 573263 - DNA, 20 bp, mouse
ggaagtgcgccgccagtggc

SEQ ID NO: 573264 - DNA, 20 bp, mouse
ggttgtgcagagtccttgtc

SEQ ID NO: 573265 - DNA, 20 bp, mouse
gaggcatctccaccctcggt

SEQ ID NO: 573266 - DNA, 20 bp, mouse
gagcttgaacaggtaatcgt

SEQ ID NO: 573267 - DNA, 20 bp, mouse
ggagaagcggaacaggacac

SEQ ID NO: 573268 - DNA, 20 bp, mouse
ggacaggcgccaggacccca

SEQ ID NO: 573269 - DNA, 20 bp, mouse
gtcggggagagagtgtaata

SEQ ID NO: 573270 - DNA, 20 bp, mouse
ggatcggggactcgggggta

SEQ ID NO: 573271 - DNA, 20 bp, mouse
gtcgggccgaggatccggga

SEQ ID NO: 573272 - DNA, 20 bp, mouse
gcccaaggccccgctaccta

SEQ ID NO: 573273 - DNA, 20 bp, mouse
gagacgggtccagcgaccag

SEQ ID NO: 573274 - DNA, 20 bp, mouse
gatcgactcaggatccactc

SEQ ID NO: 573275 - DNA, 20 bp, mouse
gccggccgtacttcccgtcg

SEQ ID NO: 573276 - DNA, 20 bp, mouse
gacgggagctgagacgaggg

SEQ ID NO: 573277 - DNA, 20 bp, mouse
ggccaagagcaaggaggcgg

SEQ ID NO: 573278 - DNA, 20 bp, mouse
gcctgggagagggcacgcga

SEQ ID NO: 573279 - DNA, 20 bp, mouse
gttgctcttggcggtcagag

SEQ ID NO: 573280 - DNA, 20 bp, mouse
gagggcagtgagagccggag

SEQ ID NO: 573281 - DNA, 20 bp, mouse
gcgggacgggagctgagacg

SEQ ID NO: 573282 - DNA, 20 bp, mouse
gtccaccgcctccttgctct

SEQ ID NO: 573283 - DNA, 20 bp, mouse
gcggagaaggggaccccgaa

SEQ ID NO: 573284 - DNA, 20 bp, mouse
gggcttggcgaccggagaag

SEQ ID NO: 573285 - DNA, 20 bp, mouse
gctctgagaagcggaacagg

SEQ ID NO: 573286 - DNA, 20 bp, mouse
gttccaagagggagcgactg

SEQ ID NO: 573287 - DNA, 20 bp, mouse
gtgccccagtcgctccctct

SEQ ID NO: 573288 - DNA, 20 bp, mouse
gtggggcagaagaaccaata

SEQ ID NO: 573289 - DNA, 20 bp, mouse
gggcagaagaaccaatatgg

SEQ ID NO: 573290 - DNA, 20 bp, mouse
gcacacactggacgtcctgg

SEQ ID NO: 573291 - DNA, 20 bp, mouse
gccccggccgcccgccatat

SEQ ID NO: 573292 - DNA, 20 bp, mouse
ggcggctcgccaacacgcct

SEQ ID NO: 573293 - DNA, 20 bp, mouse
gggaagcgctctcgacgttc

SEQ ID NO: 573294 - DNA, 20 bp, mouse
ggtagattgctgggcaacag

SEQ ID NO: 573295 - DNA, 20 bp, mouse
gacactggacgtcctggggg

SEQ ID NO: 573296 - DNA, 20 bp, mouse
gtgccccactgaggacgagg

SEQ ID NO: 573297 - DNA, 20 bp, mouse
gtgccacctcgtcctcagtg

SEQ ID NO: 573298 - DNA, 20 bp, mouse
gagcagctgtcaggccaccg

SEQ ID NO: 573299 - DNA, 20 bp, mouse
gagtgcagcttggacctcgg

SEQ ID NO: 573300 - DNA, 20 bp, mouse
gctcctcggcgaccgggtca

SEQ ID NO: 573301 - DNA, 20 bp, mouse
gtgctgccccactgaggacg

SEQ ID NO: 573302 - DNA, 20 bp, mouse
ggcgagtgggctttaagagg

SEQ ID NO: 573303 - DNA, 20 bp, mouse
gggcagcgcgagccgtgacc

SEQ ID NO: 573304 - DNA, 20 bp, mouse
gtatagtcctgggtaggtga

SEQ ID NO: 573305 - DNA, 20 bp, mouse
ggggtaaggtgtctgcgagt

SEQ ID NO: 573306 - DNA, 20 bp, mouse
gtgggcagcagggtcctaat

SEQ ID NO: 573307 - DNA, 20 bp, mouse
gcactgcagtgcagacatgg

SEQ ID NO: 573308 - DNA, 20 bp, mouse
ggagcagagcagctgaaggg

SEQ ID NO: 573309 - DNA, 20 bp, mouse
gttccaaagagtcccggctg

SEQ ID NO: 573310 - DNA, 20 bp, mouse
gaggaggaagggtcctgaga

SEQ ID NO: 573311 - DNA, 20 bp, mouse
gctcctcagaggtcctggga

SEQ ID NO: 573312 - DNA, 20 bp, mouse
gaaagagtcccggctggggt

SEQ ID NO: 573313 - DNA, 20 bp, mouse
ggaaggatgccgaaggggaa

SEQ ID NO: 573314 - DNA, 20 bp, mouse
gagcagggtcctaatgggca

SEQ ID NO: 573315 - DNA, 20 bp, mouse
gcgccggatggaatcagctt

SEQ ID NO: 573316 - DNA, 20 bp, mouse
ggcctcgggcagagacggac

SEQ ID NO: 573317 - DNA, 20 bp, mouse
ggcccagggaggaaccgcta

SEQ ID NO: 573318 - DNA, 20 bp, mouse
gccacagcctcgggcagaga

SEQ ID NO: 573319 - DNA, 20 bp, mouse
gaggccgcgcccgccatggt

SEQ ID NO: 573320 - DNA, 20 bp, mouse
gtgtcaggatgaggaggcgg

SEQ ID NO: 573321 - DNA, 20 bp, mouse
gctgcgccatggccagtggg

SEQ ID NO: 573322 - DNA, 20 bp, mouse
ggcgcctcaccgtcaggctg

SEQ ID NO: 573323 - DNA, 20 bp, mouse
gcggccaccgccgcccaggg

SEQ ID NO: 573324 - DNA, 20 bp, mouse
ggctccccagcctgacggtg

SEQ ID NO: 573325 - DNA, 20 bp, mouse
gcggctgcgccatggccagt

SEQ ID NO: 573326 - DNA, 20 bp, mouse
gatcgtctcagcccaaacgg

SEQ ID NO: 573327 - DNA, 20 bp, mouse
gcagctgcgccagcaaccct

SEQ ID NO: 573328 - DNA, 20 bp, mouse
gaaccctaggtgagaatcgg

SEQ ID NO: 573329 - DNA, 20 bp, mouse
gtgcccccgattctcaccta

SEQ ID NO: 573330 - DNA, 20 bp, mouse
gaggccacgcccaccccggt

SEQ ID NO: 573331 - DNA, 20 bp, mouse
ggccatcgtctcagcccaaa

SEQ ID NO: 573332 - DNA, 20 bp, mouse
gagccgagcggacccggaag

SEQ ID NO: 573333 - DNA, 20 bp, mouse
gcagcgcggaggctcgggaa

SEQ ID NO: 573334 - DNA, 20 bp, mouse
ggtgggcgtggcctacacgg

SEQ ID NO: 573335 - DNA, 20 bp, mouse
gcggcagccggccagcgcgg

SEQ ID NO: 573336 - DNA, 20 bp, mouse
gccacgtccaggacatgcgg

SEQ ID NO: 573337 - DNA, 20 bp, mouse
ggagccacgtccaggacatg

SEQ ID NO: 573338 - DNA, 20 bp, mouse
ggccggcagaggggacgcaa

SEQ ID NO: 573339 - DNA, 20 bp, mouse
gcatgggtggagccacgtcc

SEQ ID NO: 573340 - DNA, 20 bp, mouse
gctgggctggaggtctctta

SEQ ID NO: 573341 - DNA, 20 bp, mouse
gagaggggacgcaaaggagg

SEQ ID NO: 573342 - DNA, 20 bp, mouse
gcgtggctccacccatgggg

SEQ ID NO: 573343 - DNA, 20 bp, mouse
gctccgcgcgaaagaagtcg

SEQ ID NO: 573344 - DNA, 20 bp, mouse
gccaggacatgcgggggctg

SEQ ID NO: 573345 - DNA, 20 bp, mouse
gctgaccggccggagaccat

SEQ ID NO: 573346 - DNA, 20 bp, mouse
ggaatcgggctgcggagggt

SEQ ID NO: 573347 - DNA, 20 bp, mouse
ggccgcgaagaagagagctc

SEQ ID NO: 573348 - DNA, 20 bp, mouse
ggcccgagctctcttcttcg

SEQ ID NO: 573349 - DNA, 20 bp, mouse
ggtggttcttcggtagaagg

SEQ ID NO: 573350 - DNA, 20 bp, mouse
ggaaacaccagtatccacaa

SEQ ID NO: 573351 - DNA, 20 bp, mouse
gggggcgaggccagggaatc

SEQ ID NO: 573352 - DNA, 20 bp, mouse
gccagggaatcgggctgcgg

SEQ ID NO: 573353 - DNA, 20 bp, mouse
ggcagcgagtccacatccct

SEQ ID NO: 573354 - DNA, 20 bp, mouse
gctcaggcccatgcaggcaa

SEQ ID NO: 573355 - DNA, 20 bp, mouse
gccatgcaggcaacggtcag

SEQ ID NO: 573356 - DNA, 20 bp, mouse
gcctccctgacggcgctcgg

SEQ ID NO: 573357 - DNA, 20 bp, mouse
gcgctcggcggcagcaggtc

SEQ ID NO: 573358 - DNA, 20 bp, mouse
gaggggaacggcgactgtac

SEQ ID NO: 573359 - DNA, 20 bp, mouse
gcgaccgaccgagccctgag

SEQ ID NO: 573360 - DNA, 20 bp, mouse
gcctgaggggagcggagatt

SEQ ID NO: 573361 - DNA, 20 bp, mouse
gggcagccggattctaactg

SEQ ID NO: 573362 - DNA, 20 bp, mouse
gagacacccacccagacagg

SEQ ID NO: 573363 - DNA, 20 bp, mouse
gagcagcagtagcaagactt

SEQ ID NO: 573364 - DNA, 20 bp, mouse
ggagcctccctgacggcgct

SEQ ID NO: 573365 - DNA, 20 bp, mouse
gcctccggggaaaggagagc

SEQ ID NO: 573366 - DNA, 20 bp, mouse
gtcggccgcggcggagtgaa

SEQ ID NO: 573367 - DNA, 20 bp, mouse
gccgccgcggccgaagccca

SEQ ID NO: 573368 - DNA, 20 bp, mouse
gcgcggcggagtgaacggga

SEQ ID NO: 573369 - DNA, 20 bp, mouse
gagagctctgggcggcgggt

SEQ ID NO: 573370 - DNA, 20 bp, mouse
ggacccggctggttcagaga

SEQ ID NO: 573371 - DNA, 20 bp, mouse
ggggcccggccgcagagctc

SEQ ID NO: 573372 - DNA, 20 bp, mouse
gagggagggcggagggaacg

SEQ ID NO: 573373 - DNA, 20 bp, mouse
gggagtgaacgggacgggcc

SEQ ID NO: 573374 - DNA, 20 bp, mouse
ggctggttcagagagggtcg

SEQ ID NO: 573375 - DNA, 20 bp, mouse
ggtcaggagggcacacttgg

SEQ ID NO: 573376 - DNA, 20 bp, mouse
ggccgcggagcaggttcgga

SEQ ID NO: 573377 - DNA, 20 bp, mouse
gcggagccgcggagcaggtt

SEQ ID NO: 573378 - DNA, 20 bp, mouse
gtccctccgaacctgctccg

SEQ ID NO: 573379 - DNA, 20 bp, mouse
gagcaggttcggagggacgg

SEQ ID NO: 573380 - DNA, 20 bp, mouse
gagggagccgagtgactgaa

SEQ ID NO: 573381 - DNA, 20 bp, mouse
gccgccgccccgctccgtgt

SEQ ID NO: 573382 - DNA, 20 bp, mouse
gcgccgagctgggaagaact

SEQ ID NO: 573383 - DNA, 20 bp, mouse
ggaactcggccgagctggag

SEQ ID NO: 573384 - DNA, 20 bp, mouse
gagcggcggtcggacgccgg

SEQ ID NO: 573385 - DNA, 20 bp, mouse
gccggaggcgcgttcccaca

SEQ ID NO: 573386 - DNA, 20 bp, mouse
gcggcgaactcacctgctca

SEQ ID NO: 573387 - DNA, 20 bp, mouse
gcgaactcacctgctcaggg

SEQ ID NO: 573388 - DNA, 20 bp, mouse
gtagccacactgggactcgg

SEQ ID NO: 573389 - DNA, 20 bp, mouse
gcggccggagttgcacgtcc

SEQ ID NO: 573390 - DNA, 20 bp, mouse
ggagttcgccggtggaggag

SEQ ID NO: 573391 - DNA, 20 bp, mouse
gccacactgggactcggtgg

SEQ ID NO: 573392 - DNA, 20 bp, mouse
gcaggtgagttcgccggtgg

SEQ ID NO: 573393 - DNA, 20 bp, mouse
gtgctcagggaggaggtgcc

SEQ ID NO: 573394 - DNA, 20 bp, mouse
gagggggtgcaagggtccac

SEQ ID NO: 573395 - DNA, 20 bp, mouse
gtgccagcaggcccaggata

SEQ ID NO: 573396 - DNA, 20 bp, mouse
gccgtcgctgcggtgcgcgg

SEQ ID NO: 573397 - DNA, 20 bp, mouse
gggtgagagcaccgtcgctg

SEQ ID NO: 573398 - DNA, 20 bp, mouse
ggtctttcggcggtcggaca

SEQ ID NO: 573399 - DNA, 20 bp, mouse
ggcgcgcttcagtctttcgg

SEQ ID NO: 573400 - DNA, 20 bp, mouse
gggtccgcggataagatccc

SEQ ID NO: 573401 - DNA, 20 bp, mouse
ggcgggagcacggggagtca

SEQ ID NO: 573402 - DNA, 20 bp, mouse
ggagccatacacagctcaag

SEQ ID NO: 573403 - DNA, 20 bp, mouse
ggtccaagtatggcctaagg

SEQ ID NO: 573404 - DNA, 20 bp, mouse
gctgccgcttgagctgtgta

SEQ ID NO: 573405 - DNA, 20 bp, mouse
gtcaagcggcagtccaagta

SEQ ID NO: 573406 - DNA, 20 bp, mouse
ggccacaccatcagccacaa

SEQ ID NO: 573407 - DNA, 20 bp, mouse
ggccgttgtggctgatggtg

SEQ ID NO: 573408 - DNA, 20 bp, mouse
ggccgagggccggaaccgga

SEQ ID NO: 573409 - DNA, 20 bp, mouse
gggcaaagacgcgcaaggaa

SEQ ID NO: 573410 - DNA, 20 bp, mouse
gcgggtgggccgcctaggac

SEQ ID NO: 573411 - DNA, 20 bp, mouse
ggtcagccgagggccggaac

SEQ ID NO: 573412 - DNA, 20 bp, mouse
ggcgcggtctccggaaacct

SEQ ID NO: 573413 - DNA, 20 bp, mouse
gggacaggcacaccctctga

SEQ ID NO: 573414 - DNA, 20 bp, mouse
gtggtgtggcggcacggcga

SEQ ID NO: 573415 - DNA, 20 bp, mouse
ggatcgcgcgtgcgccgttg

SEQ ID NO: 573416 - DNA, 20 bp, mouse
gcgtagcagcggcagagacg

SEQ ID NO: 573417 - DNA, 20 bp, mouse
gtggtgcggtcgcgtagcag

SEQ ID NO: 573418 - DNA, 20 bp, mouse
gggaacccgcccgagaggtg

SEQ ID NO: 573419 - DNA, 20 bp, mouse
gcacagcccctgggccgcca

SEQ ID NO: 573420 - DNA, 20 bp, mouse
gcatctgtaaacgggtaagg

SEQ ID NO: 573421 - DNA, 20 bp, mouse
gagacgcggccgagctgctg

SEQ ID NO: 573422 - DNA, 20 bp, mouse
gccagctcggggtcctggtg

SEQ ID NO: 573423 - DNA, 20 bp, mouse
gagtcatctgtaaacgggta

SEQ ID NO: 573424 - DNA, 20 bp, mouse
ggagagccgaccgcagatcg

SEQ ID NO: 573425 - DNA, 20 bp, mouse
gtgccggacagcccagctcg

SEQ ID NO: 573426 - DNA, 20 bp, mouse
ggtcccagacgtgggttaag

SEQ ID NO: 573427 - DNA, 20 bp, mouse
gttctggtgttgggagactc

SEQ ID NO: 573428 - DNA, 20 bp, mouse
gaagatggcgtccctggatc

SEQ ID NO: 573429 - DNA, 20 bp, mouse
gtgttggtagtcccagacgt

SEQ ID NO: 573430 - DNA, 20 bp, mouse
ggcgtccctggatcgggtga

SEQ ID NO: 573431 - DNA, 20 bp, mouse
gctggatcgggtgaaggttc

SEQ ID NO: 573432 - DNA, 20 bp, mouse
gcgtggcaagatggcgtccc

SEQ ID NO: 573433 - DNA, 20 bp, mouse
ggtcaacctcaaggaaatcg

SEQ ID NO: 573434 - DNA, 20 bp, mouse
gcgggtgaaggttctggtgt

SEQ ID NO: 573435 - DNA, 20 bp, mouse
gttggtgagaatccaggaac

SEQ ID NO: 573436 - DNA, 20 bp, mouse
gcagagcatgcggcccagac

SEQ ID NO: 573437 - DNA, 20 bp, mouse
gcggcccagactggcggacg

SEQ ID NO: 573438 - DNA, 20 bp, mouse
gctcgcaggggcccacgaag

SEQ ID NO: 573439 - DNA, 20 bp, mouse
gcccagactggcggacgcgg

SEQ ID NO: 573440 - DNA, 20 bp, mouse
ggtccgttaacacgaacccg

SEQ ID NO: 573441 - DNA, 20 bp, mouse
gccagcaaccccactgaggg

SEQ ID NO: 573442 - DNA, 20 bp, mouse
ggcccctgcgaggtaactca

SEQ ID NO: 573443 - DNA, 20 bp, mouse
ggaggtaactcagggctcgg

SEQ ID NO: 573444 - DNA, 20 bp, mouse
gttgcacggaaggttcggag

SEQ ID NO: 573445 - DNA, 20 bp, mouse
ggtaccagcaaccccactga

SEQ ID NO: 573446 - DNA, 20 bp, mouse
gagggccgtggaagccggag

SEQ ID NO: 573447 - DNA, 20 bp, mouse
ggcttccacggccctcggcg

SEQ ID NO: 573448 - DNA, 20 bp, mouse
gagccgcgccggcgccaaga

SEQ ID NO: 573449 - DNA, 20 bp, mouse
gtgcctggctgccgcgccga

SEQ ID NO: 573450 - DNA, 20 bp, mouse
gagcctctgtggctccgctc

SEQ ID NO: 573451 - DNA, 20 bp, mouse
ggctgccgcgccgagggccg

SEQ ID NO: 573452 - DNA, 20 bp, mouse
ggcggccacccagcctacta

SEQ ID NO: 573453 - DNA, 20 bp, mouse
gggcctcgagcgaggttctg

SEQ ID NO: 573454 - DNA, 20 bp, mouse
gccgcgttgaagaagctggt

SEQ ID NO: 573455 - DNA, 20 bp, mouse
gagggtctggaagaatcaga

SEQ ID NO: 573456 - DNA, 20 bp, mouse
ggggccctcagcgcacggga

SEQ ID NO: 573457 - DNA, 20 bp, mouse
gcgccgggccctcagcgcac

SEQ ID NO: 573458 - DNA, 20 bp, mouse
ggcggcgtggacagcagtcc

SEQ ID NO: 573459 - DNA, 20 bp, mouse
gcagccaccacccaaagctg

SEQ ID NO: 573460 - DNA, 20 bp, mouse
ggaaccaggcccgggagggt

SEQ ID NO: 573461 - DNA, 20 bp, mouse
ggcgcgcccggccttctggg

SEQ ID NO: 573462 - DNA, 20 bp, mouse
gctgcgcgcggcaccgggtc

SEQ ID NO: 573463 - DNA, 20 bp, mouse
gtgggagacgggtgagtgca

SEQ ID NO: 573464 - DNA, 20 bp, mouse
gactgcagagaaacaggaaa

SEQ ID NO: 573465 - DNA, 20 bp, mouse
gccgcgcgcagcgccatcgg

SEQ ID NO: 573466 - DNA, 20 bp, mouse
ggcgttgctgtggacaccag

SEQ ID NO: 573467 - DNA, 20 bp, mouse
ggctgtggacaccagtggta

SEQ ID NO: 573468 - DNA, 20 bp, mouse
gggagtggctaggaggtacc

SEQ ID NO: 573469 - DNA, 20 bp, mouse
gcctagccactccataccac

SEQ ID NO: 573470 - DNA, 20 bp, mouse
gctcaagaggcgggaggaaa

SEQ ID NO: 573471 - DNA, 20 bp, mouse
gggcccccaactgtcatccc

SEQ ID NO: 573472 - DNA, 20 bp, mouse
gtaggaggtacccggcagtg

SEQ ID NO: 573473 - DNA, 20 bp, mouse
gctgggagccctgaatctgt

SEQ ID NO: 573474 - DNA, 20 bp, mouse
gggtgctgctcctcactgcc

SEQ ID NO: 573475 - DNA, 20 bp, mouse
gtgtaagcccttacaaggaa

SEQ ID NO: 573476 - DNA, 20 bp, mouse
ggaaatgcccggcgccgcag

SEQ ID NO: 573477 - DNA, 20 bp, mouse
gcgagctgcggagaaatgcc

SEQ ID NO: 573478 - DNA, 20 bp, mouse
ggggctcacaaccctggata

SEQ ID NO: 573479 - DNA, 20 bp, mouse
gcttcgcacccgacactcgg

SEQ ID NO: 573480 - DNA, 20 bp, mouse
gggcggtgctcggctgtctc

SEQ ID NO: 573481 - DNA, 20 bp, mouse
ggccgagcaccgccgagtgt

SEQ ID NO: 573482 - DNA, 20 bp, mouse
ggcgctgtcccgagccgcag

SEQ ID NO: 573483 - DNA, 20 bp, mouse
gccgagccgcaggggcggag

SEQ ID NO: 573484 - DNA, 20 bp, mouse
gcgctcggcgttcgggtccg

SEQ ID NO: 573485 - DNA, 20 bp, mouse
ggacgcgcggggtccaggcg

SEQ ID NO: 573486 - DNA, 20 bp, mouse
gcggccgccgcgccccagga

SEQ ID NO: 573487 - DNA, 20 bp, mouse
gggtagacagcagccctcct

SEQ ID NO: 573488 - DNA, 20 bp, mouse
gcagcgacgcgcctcactaa

SEQ ID NO: 573489 - DNA, 20 bp, mouse
ggcccgcggcgctcactctc

SEQ ID NO: 573490 - DNA, 20 bp, mouse
ggcgcacacgcaaccccgtc

SEQ ID NO: 573491 - DNA, 20 bp, mouse
gcgcaaccccgtccggcccg

SEQ ID NO: 573492 - DNA, 20 bp, mouse
gggccggagagtgagcgccg

SEQ ID NO: 573493 - DNA, 20 bp, mouse
gcagcagccctcctggggcg

SEQ ID NO: 573494 - DNA, 20 bp, mouse
ggtgagcgccgcgggccgga

SEQ ID NO: 573495 - DNA, 20 bp, mouse
ggacctcgaccggcttaccg

SEQ ID NO: 573496 - DNA, 20 bp, mouse
gtggttgcgtatctgaacgg

SEQ ID NO: 573497 - DNA, 20 bp, mouse
gaggtggttgcgtatctgaa

SEQ ID NO: 573498 - DNA, 20 bp, mouse
gagactctctaggcacacgg

SEQ ID NO: 573499 - DNA, 20 bp, mouse
ggtctcgaggtagactctct

SEQ ID NO: 573500 - DNA, 20 bp, mouse
gggcggctcggtggtgacgg

SEQ ID NO: 573501 - DNA, 20 bp, mouse
ggtggtgacggtggcctagg

SEQ ID NO: 573502 - DNA, 20 bp, mouse
gttgcgtatctgaacggtgg

SEQ ID NO: 573503 - DNA, 20 bp, mouse
gggtagactctctaggcaca

SEQ ID NO: 573504 - DNA, 20 bp, mouse
gctatcagtgcggacaggac

SEQ ID NO: 573505 - DNA, 20 bp, mouse
gcacggcggctcggtggtga

SEQ ID NO: 573506 - DNA, 20 bp, mouse
gggaaaaaagcggagaaccg

SEQ ID NO: 573507 - DNA, 20 bp, mouse
gcctcgcgggcggaaaaaag

SEQ ID NO: 573508 - DNA, 20 bp, mouse
ggggtggcgaagtacagccc

SEQ ID NO: 573509 - DNA, 20 bp, mouse
gcgtgaggaaggtccccagg

SEQ ID NO: 573510 - DNA, 20 bp, mouse
gcttcgccacccagccctcc

SEQ ID NO: 573511 - DNA, 20 bp, mouse
gacgcagctcccggaaagta

SEQ ID NO: 573512 - DNA, 20 bp, mouse
gtcagccgcaggctgttgga

SEQ ID NO: 573513 - DNA, 20 bp, mouse
ggtccgtgaggaaggtcccc

SEQ ID NO: 573514 - DNA, 20 bp, mouse
gctggactggtgtaggatgt

SEQ ID NO: 573515 - DNA, 20 bp, mouse
ggagctgacacctcgcacca

SEQ ID NO: 573516 - DNA, 20 bp, mouse
ggagtagaggagctgcgtgg

SEQ ID NO: 573517 - DNA, 20 bp, mouse
ggccgcacgtagctgacgta

SEQ ID NO: 573518 - DNA, 20 bp, mouse
gggtagctggcggtctcatc

SEQ ID NO: 573519 - DNA, 20 bp, mouse
gttcgagtagaggagctgcg

SEQ ID NO: 573520 - DNA, 20 bp, mouse
gccaaccccggaggccatcg

SEQ ID NO: 573521 - DNA, 20 bp, mouse
ggcgtcgcgaggccaggtta

SEQ ID NO: 573522 - DNA, 20 bp, mouse
gtcatcaggtgcggccatgg

SEQ ID NO: 573523 - DNA, 20 bp, mouse
gcgcggggaatttcgagtag

SEQ ID NO: 573524 - DNA, 20 bp, mouse
gctggcggtctcatcaggtg

SEQ ID NO: 573525 - DNA, 20 bp, mouse
gcgttcccggaccgtctcgg

SEQ ID NO: 573526 - DNA, 20 bp, mouse
gagtgaatcggaaaaggagg

SEQ ID NO: 573527 - DNA, 20 bp, mouse
gccgaggctacaccgcacaa

SEQ ID NO: 573528 - DNA, 20 bp, mouse
ggaatcggaaaaggaggcgg

SEQ ID NO: 573529 - DNA, 20 bp, mouse
ggagagggggagcccttgtg

SEQ ID NO: 573530 - DNA, 20 bp, mouse
gccggcggggcagagcaccg

SEQ ID NO: 573531 - DNA, 20 bp, mouse
gcggaagagccgcgccgtaa

SEQ ID NO: 573532 - DNA, 20 bp, mouse
gccgcgccccgggagcaacc

SEQ ID NO: 573533 - DNA, 20 bp, mouse
gatcgggccgacccctcctc

SEQ ID NO: 573534 - DNA, 20 bp, mouse
gcggggcagagcaccgggga

SEQ ID NO: 573535 - DNA, 20 bp, mouse
gggcagcgaggaaccccccc

SEQ ID NO: 573536 - DNA, 20 bp, mouse
gggggccattggccaagata

SEQ ID NO: 573537 - DNA, 20 bp, mouse
gtgagctgcaagccatatct

SEQ ID NO: 573538 - DNA, 20 bp, mouse
gatatggcttgcagctcact

SEQ ID NO: 573539 - DNA, 20 bp, mouse
gtgtgcttatgagtaaacgg

SEQ ID NO: 573540 - DNA, 20 bp, mouse
gcaagccatatcttggccaa

SEQ ID NO: 573541 - DNA, 20 bp, mouse
gtcatgtgcttatgagtaaa

SEQ ID NO: 573542 - DNA, 20 bp, mouse
gtgatagtctgtactaacca

SEQ ID NO: 573543 - DNA, 20 bp, mouse
ggcttcatttaaatctatat

SEQ ID NO: 573544 - DNA, 20 bp, mouse
gtgtacagacaataatttgg

SEQ ID NO: 573545 - DNA, 20 bp, mouse
gatgagtaaacgggggccat

SEQ ID NO: 573546 - DNA, 20 bp, mouse
gcggctgggcgctaagatgg

SEQ ID NO: 573547 - DNA, 20 bp, mouse
gatgtagtacgaggatcccg

SEQ ID NO: 573548 - DNA, 20 bp, mouse
ggcgcggctgggcgctaaga

SEQ ID NO: 573549 - DNA, 20 bp, mouse
ggccgcgccaagcacttccg

SEQ ID NO: 573550 - DNA, 20 bp, mouse
gggagcaatgcggcagcccc

SEQ ID NO: 573551 - DNA, 20 bp, mouse
gtgacacgggagccagacct

SEQ ID NO: 573552 - DNA, 20 bp, mouse
gagcgaccgggtgccggggt

SEQ ID NO: 573553 - DNA, 20 bp, mouse
gtgccgggatccaacgggag

SEQ ID NO: 573554 - DNA, 20 bp, mouse
ggtgagttgcatgtagtacg

SEQ ID NO: 573555 - DNA, 20 bp, mouse
gtgcttggcgcggcgcggct

SEQ ID NO: 573556 - DNA, 20 bp, mouse
gggtatcccggcacccccag

SEQ ID NO: 573557 - DNA, 20 bp, mouse
gagggctccgggacagcagt

SEQ ID NO: 573558 - DNA, 20 bp, mouse
gaaagctggccagggtatcc

SEQ ID NO: 573559 - DNA, 20 bp, mouse
gtccgggacagcagtgggtg

SEQ ID NO: 573560 - DNA, 20 bp, mouse
gctggagggaaaggtgtgga

SEQ ID NO: 573561 - DNA, 20 bp, mouse
gagcagtgggtgaggcctct

SEQ ID NO: 573562 - DNA, 20 bp, mouse
gtgcctgggaccacataggt

SEQ ID NO: 573563 - DNA, 20 bp, mouse
gaaagtgcctgggaccacat

SEQ ID NO: 573564 - DNA, 20 bp, mouse
gatgccaggactggagggaa

SEQ ID NO: 573565 - DNA, 20 bp, mouse
gagggtggcaaggcttgata

SEQ ID NO: 573566 - DNA, 20 bp, mouse
ggaacccgctacctcaccac

SEQ ID NO: 573567 - DNA, 20 bp, mouse
gcggccaccatcctgtggtg

SEQ ID NO: 573568 - DNA, 20 bp, mouse
gccatcctgtggtgaggtag

SEQ ID NO: 573569 - DNA, 20 bp, mouse
ggtcacgtctcggcgagtca

SEQ ID NO: 573570 - DNA, 20 bp, mouse
gtctcggcgagtcacggtga

SEQ ID NO: 573571 - DNA, 20 bp, mouse
gtgggggaggggtcacgtct

SEQ ID NO: 573572 - DNA, 20 bp, mouse
ggggcccgcaggaggcgcga

SEQ ID NO: 573573 - DNA, 20 bp, mouse
gcggcgagtcacggtgatgg

SEQ ID NO: 573574 - DNA, 20 bp, mouse
gcgggttctctgcgtctctc

SEQ ID NO: 573575 - DNA, 20 bp, mouse
gcgccagccactgggcccgc

SEQ ID NO: 573576 - DNA, 20 bp, mouse
gctgcgagcaggagctccgg

SEQ ID NO: 573577 - DNA, 20 bp, mouse
gcgcccctggcactgagtaa

SEQ ID NO: 573578 - DNA, 20 bp, mouse
ggcgctgcgagcaggagctc

SEQ ID NO: 573579 - DNA, 20 bp, mouse
gggagggcgcgggccggtta

SEQ ID NO: 573580 - DNA, 20 bp, mouse
ggggctgtgcagaccctaac

SEQ ID NO: 573581 - DNA, 20 bp, mouse
gacgacctggggtcacgtgg

SEQ ID NO: 573582 - DNA, 20 bp, mouse
ggcgggaatgtgcgagctta

SEQ ID NO: 573583 - DNA, 20 bp, mouse
gccgcgggcttcggtttccc

SEQ ID NO: 573584 - DNA, 20 bp, mouse
gagagcacttccggccccgc

SEQ ID NO: 573585 - DNA, 20 bp, mouse
ggaagctgggcaagccggga

SEQ ID NO: 573586 - DNA, 20 bp, mouse
gaaagccgaggcgctcccac

SEQ ID NO: 573587 - DNA, 20 bp, mouse
gccgcgcctgggcaaagccg

SEQ ID NO: 573588 - DNA, 20 bp, mouse
gaagccgagcggccatggaa

SEQ ID NO: 573589 - DNA, 20 bp, mouse
gcacacctgtgggagcgcct

SEQ ID NO: 573590 - DNA, 20 bp, mouse
ggagcgcctcggctttgccc

SEQ ID NO: 573591 - DNA, 20 bp, mouse
gcgtgcgcagatccgcgcct

SEQ ID NO: 573592 - DNA, 20 bp, mouse
gtcgagccgggtgaagtggg

SEQ ID NO: 573593 - DNA, 20 bp, mouse
gagacccgaggtcacgacct

SEQ ID NO: 573594 - DNA, 20 bp, mouse
gctcagtcgggtaaccagaa

SEQ ID NO: 573595 - DNA, 20 bp, mouse
gaagctggctacgggagcac

SEQ ID NO: 573596 - DNA, 20 bp, mouse
gcagcagtgctctggagctg

SEQ ID NO: 573597 - DNA, 20 bp, mouse
ggcctagagcagcagtgctc

SEQ ID NO: 573598 - DNA, 20 bp, mouse
gcaccaaccactcacctgat

SEQ ID NO: 573599 - DNA, 20 bp, mouse
gcacctgataggacgcacca

SEQ ID NO: 573600 - DNA, 20 bp, mouse
gctggagtggggtgactcag

SEQ ID NO: 573601 - DNA, 20 bp, mouse
gcaccatggtgcgtcctatc

SEQ ID NO: 573602 - DNA, 20 bp, mouse
ggtcatgtgacagggcacca

SEQ ID NO: 573603 - DNA, 20 bp, mouse
ggaggacgagatccgacaga

SEQ ID NO: 573604 - DNA, 20 bp, mouse
ggggcgacagctgcagaagg

SEQ ID NO: 573605 - DNA, 20 bp, mouse
gagcagcgggtggctctcac

SEQ ID NO: 573606 - DNA, 20 bp, mouse
gtccgacagatgctcctggt

SEQ ID NO: 573607 - DNA, 20 bp, mouse
gtcctcaggaggcggttctg

SEQ ID NO: 573608 - DNA, 20 bp, mouse
gccgcagcggggtcctcagg

SEQ ID NO: 573609 - DNA, 20 bp, mouse
ggtctgaaggagcctgacgg

SEQ ID NO: 573610 - DNA, 20 bp, mouse
ggcgccccgcgtggcctgca

SEQ ID NO: 573611 - DNA, 20 bp, mouse
gacgccgcagcggggtcctc

SEQ ID NO: 573612 - DNA, 20 bp, mouse
ggtggtgcctcgcttgtctg

SEQ ID NO: 573613 - DNA, 20 bp, mouse
gtctgaggtagaaaaagtct

SEQ ID NO: 573614 - DNA, 20 bp, mouse
ggaatgaggaacgctgtgaa

SEQ ID NO: 573615 - DNA, 20 bp, mouse
gtcacacgactgcttcccac

SEQ ID NO: 573616 - DNA, 20 bp, mouse
ggagcttccgacttcctcta

SEQ ID NO: 573617 - DNA, 20 bp, mouse
ggcatcactcgcctccctag

SEQ ID NO: 573618 - DNA, 20 bp, mouse
ggtgcgagcagcaacatctg

SEQ ID NO: 573619 - DNA, 20 bp, mouse
gctggtactggagttttctg

SEQ ID NO: 573620 - DNA, 20 bp, mouse
gcagtaccaggtcagcagcg

SEQ ID NO: 573621 - DNA, 20 bp, mouse
gaacagccacaggctccaag

SEQ ID NO: 573622 - DNA, 20 bp, mouse
ggaggcgagtgatgcttgta

SEQ ID NO: 573623 - DNA, 20 bp, mouse
gcgggtaattgtgtgagggt

SEQ ID NO: 573624 - DNA, 20 bp, mouse
gtttctgagggggcagttgt

SEQ ID NO: 573625 - DNA, 20 bp, mouse
gaagttccacgctgctgacc

SEQ ID NO: 573626 - DNA, 20 bp, mouse
gggcggcggaacgaagacgg

SEQ ID NO: 573627 - DNA, 20 bp, mouse
gggcggaacgaagacggagg

SEQ ID NO: 573628 - DNA, 20 bp, mouse
gggaggcggcggaacgaaga

SEQ ID NO: 573629 - DNA, 20 bp, mouse
gacggcggaggacgtcctag

SEQ ID NO: 573630 - DNA, 20 bp, mouse
gcgcagtgacgtagagcaag

SEQ ID NO: 573631 - DNA, 20 bp, mouse
ggcggccgcggtgcatcagc

SEQ ID NO: 573632 - DNA, 20 bp, mouse
gaagatcggcttggcggagg

SEQ ID NO: 573633 - DNA, 20 bp, mouse
ggtggctgcggggtttcaga

SEQ ID NO: 573634 - DNA, 20 bp, mouse
gtcttgagcttggaactgtg

SEQ ID NO: 573635 - DNA, 20 bp, mouse
ggctgccagctgatgcaccg

SEQ ID NO: 573636 - DNA, 20 bp, mouse
ggtgccagcgcgggacgaag

SEQ ID NO: 573637 - DNA, 20 bp, mouse
gcagcgcgggacgaaggggc

SEQ ID NO: 573638 - DNA, 20 bp, mouse
ggaggatgcaagtcgaggtg

SEQ ID NO: 573639 - DNA, 20 bp, mouse
gctacttagggaaaaggtcc

SEQ ID NO: 573640 - DNA, 20 bp, mouse
gagaccgtccagcttctcag

SEQ ID NO: 573641 - DNA, 20 bp, mouse
ggagtcttgcgagttgggaa

SEQ ID NO: 573642 - DNA, 20 bp, mouse
gtcgccgagtcccccactct

SEQ ID NO: 573643 - DNA, 20 bp, mouse
gtaaaaacaggtgacctcat

SEQ ID NO: 573644 - DNA, 20 bp, mouse
gcggcctctgagaagctgga

SEQ ID NO: 573645 - DNA, 20 bp, mouse
gggtcctggcgtgccagcgc

SEQ ID NO: 573646 - DNA, 20 bp, mouse
gccggagagggcctcgcaga

SEQ ID NO: 573647 - DNA, 20 bp, mouse
gcctgccgggaagccggaga

SEQ ID NO: 573648 - DNA, 20 bp, mouse
gaagtcggagggagtcggtg

SEQ ID NO: 573649 - DNA, 20 bp, mouse
gtgcacgcaggagctcggtc

SEQ ID NO: 573650 - DNA, 20 bp, mouse
gcgggtgcctgccgggaagc

SEQ ID NO: 573651 - DNA, 20 bp, mouse
gcagggctcggcctccccgg

SEQ ID NO: 573652 - DNA, 20 bp, mouse
gagatccagcgcaaccgtgg

SEQ ID NO: 573653 - DNA, 20 bp, mouse
gcggttgcgctggatctgga

SEQ ID NO: 573654 - DNA, 20 bp, mouse
gctcggtccgggtgcctgcc

SEQ ID NO: 573655 - DNA, 20 bp, mouse
gtaggacagggtgaagtcgg

SEQ ID NO: 573656 - DNA, 20 bp, mouse
gggaagctcgagctggtcgg

SEQ ID NO: 573657 - DNA, 20 bp, mouse
ggcgggaagctcgagctggt

SEQ ID NO: 573658 - DNA, 20 bp, mouse
ggctggtcggcggcaggcgt

SEQ ID NO: 573659 - DNA, 20 bp, mouse
ggaaggcgggaagctcgagc

SEQ ID NO: 573660 - DNA, 20 bp, mouse
gctgcagagacctaccccgc

SEQ ID NO: 573661 - DNA, 20 bp, mouse
gcccgtggttggctgtagga

SEQ ID NO: 573662 - DNA, 20 bp, mouse
gggcgttggtacctgctgcg

SEQ ID NO: 573663 - DNA, 20 bp, mouse
ggcgggccgagcgatctcgg

SEQ ID NO: 573664 - DNA, 20 bp, mouse
gttcggtcagcctgcggggt

SEQ ID NO: 573665 - DNA, 20 bp, mouse
ggccccgcacgcgcctcccc

SEQ ID NO: 573666 - DNA, 20 bp, mouse
ggagaggcaaagagcgactc

SEQ ID NO: 573667 - DNA, 20 bp, mouse
gagaataaggggaaagatac

SEQ ID NO: 573668 - DNA, 20 bp, mouse
ggcgagacgcctgaattctt

SEQ ID NO: 573669 - DNA, 20 bp, mouse
gtaacgcgcgctttgggaag

SEQ ID NO: 573670 - DNA, 20 bp, mouse
ggttaaaaatccaggttggg

SEQ ID NO: 573671 - DNA, 20 bp, mouse
ggcgcgcgttaagagcctcc

SEQ ID NO: 573672 - DNA, 20 bp, mouse
gggggaggggatgcaatcag

SEQ ID NO: 573673 - DNA, 20 bp, mouse
gacgcctgaattcttaggag

SEQ ID NO: 573674 - DNA, 20 bp, mouse
gagacctaggaacgccttgt

SEQ ID NO: 573675 - DNA, 20 bp, mouse
ggttaaacaggaacccagga

SEQ ID NO: 573676 - DNA, 20 bp, mouse
ggccggagaagaccgaccct

SEQ ID NO: 573677 - DNA, 20 bp, mouse
ggctggctctggccgagggt

SEQ ID NO: 573678 - DNA, 20 bp, mouse
ggccgagggtcggtcttctc

SEQ ID NO: 573679 - DNA, 20 bp, mouse
gcggccccggcagggagtaa

SEQ ID NO: 573680 - DNA, 20 bp, mouse
gtggcgcggaccgcgagcgg

SEQ ID NO: 573681 - DNA, 20 bp, mouse
ggggcgccgcaggctggctc

SEQ ID NO: 573682 - DNA, 20 bp, mouse
ggctgggacccgcaacaatg

SEQ ID NO: 573683 - DNA, 20 bp, mouse
gcatccacccgggacttcag

SEQ ID NO: 573684 - DNA, 20 bp, mouse
gaggctgagagcgccgccgc

SEQ ID NO: 573685 - DNA, 20 bp, mouse
gaagccactgaagtcccggg

SEQ ID NO: 573686 - DNA, 20 bp, mouse
gacacgaaccgggacgggat

SEQ ID NO: 573687 - DNA, 20 bp, mouse
gtttgcacacgaaccgggac

SEQ ID NO: 573688 - DNA, 20 bp, mouse
gtatatgtcctatcccgtcc

SEQ ID NO: 573689 - DNA, 20 bp, mouse
gggcagtcgtagtagctgct

SEQ ID NO: 573690 - DNA, 20 bp, mouse
gtgaagtgcctgatcaccgg

SEQ ID NO: 573691 - DNA, 20 bp, mouse
gcccttaccccgtccttcaa

SEQ ID NO: 573692 - DNA, 20 bp, mouse
ggactgggacgcagggatgg

SEQ ID NO: 573693 - DNA, 20 bp, mouse
gcccgattcgggatagcgaa

SEQ ID NO: 573694 - DNA, 20 bp, mouse
gcttgcccagcactgcgggg

SEQ ID NO: 573695 - DNA, 20 bp, mouse
gctggaacccttgaaggacg

SEQ ID NO: 573696 - DNA, 20 bp, mouse
gtgaagtgcgggatgacggg

SEQ ID NO: 573697 - DNA, 20 bp, mouse
gtgctgaagtgcgggatgac

SEQ ID NO: 573698 - DNA, 20 bp, mouse
gcgggcggccaggtgaaagg

SEQ ID NO: 573699 - DNA, 20 bp, mouse
gcgcacttcagcatggctac

SEQ ID NO: 573700 - DNA, 20 bp, mouse
ggcatggctacgggcagagc

SEQ ID NO: 573701 - DNA, 20 bp, mouse
gggccaggtgaaaggtggag

SEQ ID NO: 573702 - DNA, 20 bp, mouse
ggccctcgcgaggcgcgcta

SEQ ID NO: 573703 - DNA, 20 bp, mouse
ggctatggcagcttcagtcg

SEQ ID NO: 573704 - DNA, 20 bp, mouse
gcagtcgtggcgaagaatgg

SEQ ID NO: 573705 - DNA, 20 bp, mouse
gggccgctccacctttcacc

SEQ ID NO: 573706 - DNA, 20 bp, mouse
ggcgccagctcggctaacgg

SEQ ID NO: 573707 - DNA, 20 bp, mouse
ggccggccgcgcaacggaca

SEQ ID NO: 573708 - DNA, 20 bp, mouse
gggcaggaggcgcttcgagc

SEQ ID NO: 573709 - DNA, 20 bp, mouse
gcgggcgccagctcggctaa

SEQ ID NO: 573710 - DNA, 20 bp, mouse
gcagggcgaggcctccgaag

SEQ ID NO: 573711 - DNA, 20 bp, mouse
gccgcgggctgagacacggg

SEQ ID NO: 573712 - DNA, 20 bp, mouse
gcctcctgccggccgcgcaa

SEQ ID NO: 573713 - DNA, 20 bp, mouse
ggaggatggcccaggaggtg

SEQ ID NO: 573714 - DNA, 20 bp, mouse
ggagaccgcgggctgagaca

SEQ ID NO: 573715 - DNA, 20 bp, mouse
gcgcgggggacgcagctgac

SEQ ID NO: 573716 - DNA, 20 bp, mouse
gagtttccaccggcttgagg

SEQ ID NO: 573717 - DNA, 20 bp, mouse
gcttgaggcggacgactcgg

SEQ ID NO: 573718 - DNA, 20 bp, mouse
ggtcgtccgcctcaagccgg

SEQ ID NO: 573719 - DNA, 20 bp, mouse
gagaggcccggcctacctag

SEQ ID NO: 573720 - DNA, 20 bp, mouse
ggtaacggggcagtttccac

SEQ ID NO: 573721 - DNA, 20 bp, mouse
gcacaccgcccaggccacgg

SEQ ID NO: 573722 - DNA, 20 bp, mouse
gcggtgcttctgtggtaacg

SEQ ID NO: 573723 - DNA, 20 bp, mouse
ggctctggcgcggggcagag

SEQ ID NO: 573724 - DNA, 20 bp, mouse
gcgcgtgcgcggtgcttctg

SEQ ID NO: 573725 - DNA, 20 bp, mouse
ggcggacgactcggcggtct

SEQ ID NO: 573726 - DNA, 20 bp, mouse
gcaccaacagctgggccctc

SEQ ID NO: 573727 - DNA, 20 bp, mouse
gcatctcactcaccaacagc

SEQ ID NO: 573728 - DNA, 20 bp, mouse
ggagctattgcggagggtga

SEQ ID NO: 573729 - DNA, 20 bp, mouse
gttgcggagggtgagggtaa

SEQ ID NO: 573730 - DNA, 20 bp, mouse
gagggtgagggtaacgggat

SEQ ID NO: 573731 - DNA, 20 bp, mouse
ggtgagcagagctattgcgg

SEQ ID NO: 573732 - DNA, 20 bp, mouse
gggtaacgggatggggagaa

SEQ ID NO: 573733 - DNA, 20 bp, mouse
ggcggtgagcagagctattg

SEQ ID NO: 573734 - DNA, 20 bp, mouse
gtcctagaaggatggtccag

SEQ ID NO: 573735 - DNA, 20 bp, mouse
gggaagcgggagggtttgga

SEQ ID NO: 573736 - DNA, 20 bp, mouse
ggctggacccacagaccaaa

SEQ ID NO: 573737 - DNA, 20 bp, mouse
gactctagcaagaagctcaa

SEQ ID NO: 573738 - DNA, 20 bp, mouse
gtgtgtggggactacatagg

SEQ ID NO: 573739 - DNA, 20 bp, mouse
gcaactacttgaacacagct

SEQ ID NO: 573740 - DNA, 20 bp, mouse
gctgagtaaggcatcgttat

SEQ ID NO: 573741 - DNA, 20 bp, mouse
gtataggtgcagctcacagc

SEQ ID NO: 573742 - DNA, 20 bp, mouse
gtatgtgccatttggtctgt

SEQ ID NO: 573743 - DNA, 20 bp, mouse
gaagtccccaagccaatgtg

SEQ ID NO: 573744 - DNA, 20 bp, mouse
gtagatcagcctcagcatgg

SEQ ID NO: 573745 - DNA, 20 bp, mouse
gaggctgatctacctgactg

SEQ ID NO: 573746 - DNA, 20 bp, mouse
gcaggggatggacacaatgg

SEQ ID NO: 573747 - DNA, 20 bp, mouse
gcccgcacgtgttcgcccgg

SEQ ID NO: 573748 - DNA, 20 bp, mouse
gggatggacacaatggcgga

SEQ ID NO: 573749 - DNA, 20 bp, mouse
gtggacacaatggcggaggg

SEQ ID NO: 573750 - DNA, 20 bp, mouse
gcgcggacacctcgacacca

SEQ ID NO: 573751 - DNA, 20 bp, mouse
gaaatctgttcagctggcat

SEQ ID NO: 573752 - DNA, 20 bp, mouse
ggtcgaggtgtccgcgctgt

SEQ ID NO: 573753 - DNA, 20 bp, mouse
ggggggctagaggtcttgcg

SEQ ID NO: 573754 - DNA, 20 bp, mouse
gcgcaagaaatctgttcagc

SEQ ID NO: 573755 - DNA, 20 bp, mouse
ggggcaggggatggacacaa

SEQ ID NO: 573756 - DNA, 20 bp, mouse
gctcccgccatccaagatgg

SEQ ID NO: 573757 - DNA, 20 bp, mouse
gctggtgccgccatcttgga

SEQ ID NO: 573758 - DNA, 20 bp, mouse
ggacgctctcaggctatccc

SEQ ID NO: 573759 - DNA, 20 bp, mouse
gagccctgtggcctacctga

SEQ ID NO: 573760 - DNA, 20 bp, mouse
gtaactcccgccatccaaga

SEQ ID NO: 573761 - DNA, 20 bp, mouse
ggagccgagcggacttgagg

SEQ ID NO: 573762 - DNA, 20 bp, mouse
gccgcgaagaagacgctctc

SEQ ID NO: 573763 - DNA, 20 bp, mouse
gggtggttgagagaacgcgt

SEQ ID NO: 573764 - DNA, 20 bp, mouse
gggcgggagttagagccgag

SEQ ID NO: 573765 - DNA, 20 bp, mouse
ggtgccgccatcttggatgg

SEQ ID NO: 573766 - DNA, 20 bp, mouse
gactatgggacaagagagca

SEQ ID NO: 573767 - DNA, 20 bp, mouse
gcttacaggcaccgaaggag

SEQ ID NO: 573768 - DNA, 20 bp, mouse
ggctgcagaaggggagacag

SEQ ID NO: 573769 - DNA, 20 bp, mouse
ggaacagatggaacacaccg

SEQ ID NO: 573770 - DNA, 20 bp, mouse
gcaggcaagagaagatagtc

SEQ ID NO: 573771 - DNA, 20 bp, mouse
gccttgctccacaggcctcc

SEQ ID NO: 573772 - DNA, 20 bp, mouse
gaggagcacacggttagctc

SEQ ID NO: 573773 - DNA, 20 bp, mouse
gaaggccaagttcagagacg

SEQ ID NO: 573774 - DNA, 20 bp, mouse
gtaatcagaactaagagaga

SEQ ID NO: 573775 - DNA, 20 bp, mouse
gactctggccgggaggcctg

SEQ ID NO: 573776 - DNA, 20 bp, mouse
gtaccctgcagccttcagct

SEQ ID NO: 573777 - DNA, 20 bp, mouse
gccagcacaccagtgctcac

SEQ ID NO: 573778 - DNA, 20 bp, mouse
ggtgccaagctgaaggctgc

SEQ ID NO: 573779 - DNA, 20 bp, mouse
ggtagccagttgctttagtg

SEQ ID NO: 573780 - DNA, 20 bp, mouse
gttagtttgtgccaagctga

SEQ ID NO: 573781 - DNA, 20 bp, mouse
ggaattaaactcggcacttg

SEQ ID NO: 573782 - DNA, 20 bp, mouse
gcagatgttccagtgagcac

SEQ ID NO: 573783 - DNA, 20 bp, mouse
ggcatctgggtaagggagac

SEQ ID NO: 573784 - DNA, 20 bp, mouse
ggcccctctggccttcaggt

SEQ ID NO: 573785 - DNA, 20 bp, mouse
gagttgctttagtgtggcat

SEQ ID NO: 573786 - DNA, 20 bp, mouse
ggcatcaggcaggcccggca

SEQ ID NO: 573787 - DNA, 20 bp, mouse
gccttcctcggacctcgaca

SEQ ID NO: 573788 - DNA, 20 bp, mouse
ggccgcccgggcgggaaaga

SEQ ID NO: 573789 - DNA, 20 bp, mouse
ggagccggcggcgcgcgtag

SEQ ID NO: 573790 - DNA, 20 bp, mouse
gcgagcccaggcgcgagcgg

SEQ ID NO: 573791 - DNA, 20 bp, mouse
gcgtcgtgccggacacccat

SEQ ID NO: 573792 - DNA, 20 bp, mouse
ggctcccgcgggcatcaggc

SEQ ID NO: 573793 - DNA, 20 bp, mouse
gcccggcagggtgcgcggtc

SEQ ID NO: 573794 - DNA, 20 bp, mouse
gcccctccacacaggaagag

SEQ ID NO: 573795 - DNA, 20 bp, mouse
gtccggcacgacggccgccc

SEQ ID NO: 573796 - DNA, 20 bp, mouse
gcggcagccgcactttcctg

SEQ ID NO: 573797 - DNA, 20 bp, mouse
ggccactcaccccatccaag

SEQ ID NO: 573798 - DNA, 20 bp, mouse
gactcaccccatccaagcgg

SEQ ID NO: 573799 - DNA, 20 bp, mouse
gtgaggccgccgcttggatg

SEQ ID NO: 573800 - DNA, 20 bp, mouse
ggccgagcaggaagcgagcc

SEQ ID NO: 573801 - DNA, 20 bp, mouse
gaagcggcggcctcagctcc

SEQ ID NO: 573802 - DNA, 20 bp, mouse
gcgcaccagaccgccagagg

SEQ ID NO: 573803 - DNA, 20 bp, mouse
gactttcctggggaagcggc

SEQ ID NO: 573804 - DNA, 20 bp, mouse
gtcccgcccgccgcttcccc

SEQ ID NO: 573805 - DNA, 20 bp, mouse
gtcctggggaagcggcgggc

SEQ ID NO: 573806 - DNA, 20 bp, mouse
gttggtgacagcagcgacag

SEQ ID NO: 573807 - DNA, 20 bp, mouse
ggcctgaagggggtgcacag

SEQ ID NO: 573808 - DNA, 20 bp, mouse
gtggcaggtccgcctgggga

SEQ ID NO: 573809 - DNA, 20 bp, mouse
gtggcactgggcatagaggg

SEQ ID NO: 573810 - DNA, 20 bp, mouse
gggcccggatcccgaggtag

SEQ ID NO: 573811 - DNA, 20 bp, mouse
ggccgctgggcgcctgaagg

SEQ ID NO: 573812 - DNA, 20 bp, mouse
ggtgaccccgaccagcacta

SEQ ID NO: 573813 - DNA, 20 bp, mouse
gcctccaggaagccacgggg

SEQ ID NO: 573814 - DNA, 20 bp, mouse
gcacacactctcccggacac

SEQ ID NO: 573815 - DNA, 20 bp, mouse
gacggggtggacgctagtgt

SEQ ID NO: 573816 - DNA, 20 bp, mouse
gcggcggaggaggaggactc

SEQ ID NO: 573817 - DNA, 20 bp, mouse
ggagcggccgggaggagggt

SEQ ID NO: 573818 - DNA, 20 bp, mouse
gagggtgggtctccctagag

SEQ ID NO: 573819 - DNA, 20 bp, mouse
ggcggcaagaggagtccgga

SEQ ID NO: 573820 - DNA, 20 bp, mouse
ggcaagaggagtccggaggg

SEQ ID NO: 573821 - DNA, 20 bp, mouse
gagaggagtccggagggcgg

SEQ ID NO: 573822 - DNA, 20 bp, mouse
ggcgggacgtgcaatctcgg

SEQ ID NO: 573823 - DNA, 20 bp, mouse
gcaagagcccgcgggtcgag

SEQ ID NO: 573824 - DNA, 20 bp, mouse
ggggcgcggcaagaggagtc

SEQ ID NO: 573825 - DNA, 20 bp, mouse
gtagaagaggaagggaatgt

SEQ ID NO: 573826 - DNA, 20 bp, mouse
gagccagagcggcggtggga

SEQ ID NO: 573827 - DNA, 20 bp, mouse
ggttgtgcgcatagccagag

SEQ ID NO: 573828 - DNA, 20 bp, mouse
ggcaggggaccgcagacgag

SEQ ID NO: 573829 - DNA, 20 bp, mouse
ggtgcgcatagccagagcgg

SEQ ID NO: 573830 - DNA, 20 bp, mouse
ggcacagcatccttacctgg

SEQ ID NO: 573831 - DNA, 20 bp, mouse
gaggggtgcgccctaggata

SEQ ID NO: 573832 - DNA, 20 bp, mouse
gaggatgctgtgccccgcag

SEQ ID NO: 573833 - DNA, 20 bp, mouse
ggcatagccagagcggcggt

SEQ ID NO: 573834 - DNA, 20 bp, mouse
ggggacggctcccccaggta

SEQ ID NO: 573835 - DNA, 20 bp, mouse
ggcggtgggacggctccccc

SEQ ID NO: 573836 - DNA, 20 bp, mouse
gtaaacaggcgaaggctggg

SEQ ID NO: 573837 - DNA, 20 bp, mouse
gagcaacacaggacacaccc

SEQ ID NO: 573838 - DNA, 20 bp, mouse
gacaatgattgggacagaac

SEQ ID NO: 573839 - DNA, 20 bp, mouse
gggcaggcactggtcagtgg

SEQ ID NO: 573840 - DNA, 20 bp, mouse
gcggaagcgtgagtgcgagg

SEQ ID NO: 573841 - DNA, 20 bp, mouse
gcggggtgcagcgcaggagg

SEQ ID NO: 573842 - DNA, 20 bp, mouse
gggcggcaggcactggtcag

SEQ ID NO: 573843 - DNA, 20 bp, mouse
gcgcgaggccgggcgcccga

SEQ ID NO: 573844 - DNA, 20 bp, mouse
gaagcgtgagtgcgaggagg

SEQ ID NO: 573845 - DNA, 20 bp, mouse
gacgctgcggcggtgtccgt

SEQ ID NO: 573846 - DNA, 20 bp, mouse
gtctagcagcttcaaccccg

SEQ ID NO: 573847 - DNA, 20 bp, mouse
gtctccctgaggccccctta

SEQ ID NO: 573848 - DNA, 20 bp, mouse
gagcagcttcaaccccgcgg

SEQ ID NO: 573849 - DNA, 20 bp, mouse
gaggccaaaaccgagtcgtg

SEQ ID NO: 573850 - DNA, 20 bp, mouse
gtgcagccccggctccaata

SEQ ID NO: 573851 - DNA, 20 bp, mouse
gctgcagcgacgaggagacg

SEQ ID NO: 573852 - DNA, 20 bp, mouse
gggggaccgttcgccaccga

SEQ ID NO: 573853 - DNA, 20 bp, mouse
gagccccggctccaatatgg

SEQ ID NO: 573854 - DNA, 20 bp, mouse
gactccatcaccacacgact

SEQ ID NO: 573855 - DNA, 20 bp, mouse
gcaaccttaagggggcctca

SEQ ID NO: 573856 - DNA, 20 bp, mouse
gcggaggctccaggaaggag

SEQ ID NO: 573857 - DNA, 20 bp, mouse
gcttcctggagcctccgctg

SEQ ID NO: 573858 - DNA, 20 bp, mouse
gtcactgcatagggtcgcga

SEQ ID NO: 573859 - DNA, 20 bp, mouse
ggccgcacgagtcactgcat

SEQ ID NO: 573860 - DNA, 20 bp, mouse
gggagcctccgctgaggctg

SEQ ID NO: 573861 - DNA, 20 bp, mouse
ggcctcaagggtcccgatct

SEQ ID NO: 573862 - DNA, 20 bp, mouse
gtgttctcccgaaggagcca

SEQ ID NO: 573863 - DNA, 20 bp, mouse
ggcccgcaggtgcttcaggc

SEQ ID NO: 573864 - DNA, 20 bp, mouse
ggacccgcctgaagcacctg

SEQ ID NO: 573865 - DNA, 20 bp, mouse
gggctccaggaaggaggggc

SEQ ID NO: 573866 - DNA, 20 bp, mouse
gactctcccagggcgcccag

SEQ ID NO: 573867 - DNA, 20 bp, mouse
gcccaggggacgacgaacac

SEQ ID NO: 573868 - DNA, 20 bp, mouse
gagccggccggccaagcgac

SEQ ID NO: 573869 - DNA, 20 bp, mouse
gcccgtcagtgactctccca

SEQ ID NO: 573870 - DNA, 20 bp, mouse
gcagtcggaagttgcttgaa

SEQ ID NO: 573871 - DNA, 20 bp, mouse
ggccccggccggccctccac

SEQ ID NO: 573872 - DNA, 20 bp, mouse
ggccggccgccgcgtacctg

SEQ ID NO: 573873 - DNA, 20 bp, mouse
gctcagtagctgctgaggag

SEQ ID NO: 573874 - DNA, 20 bp, mouse
ggcgtacctgaggcgacggg

SEQ ID NO: 573875 - DNA, 20 bp, mouse
ggcaggcgcagtagtccctt

SEQ ID NO: 573876 - DNA, 20 bp, mouse
gcggcgggccgcgagacccg

SEQ ID NO: 573877 - DNA, 20 bp, mouse
gctccaggcgcggcagatca

SEQ ID NO: 573878 - DNA, 20 bp, mouse
gcgagacccggggcagcgcg

SEQ ID NO: 573879 - DNA, 20 bp, mouse
ggcgcagagcgcaggcagcg

SEQ ID NO: 573880 - DNA, 20 bp, mouse
gcaccatggacgactcacgg

SEQ ID NO: 573881 - DNA, 20 bp, mouse
gacgccgtgcgcctggaggt

SEQ ID NO: 573882 - DNA, 20 bp, mouse
gctgcaccatggacgactca

SEQ ID NO: 573883 - DNA, 20 bp, mouse
ggtccccgacagctgcccag

SEQ ID NO: 573884 - DNA, 20 bp, mouse
ggccgggaaccgggaaacaa

SEQ ID NO: 573885 - DNA, 20 bp, mouse
ggtactgggatgaattgagg

SEQ ID NO: 573886 - DNA, 20 bp, mouse
gccgagcagcgaggccccaa

SEQ ID NO: 573887 - DNA, 20 bp, mouse
gaacggccaggagagcgacg

SEQ ID NO: 573888 - DNA, 20 bp, mouse
gccgggagctcgggacgggt

SEQ ID NO: 573889 - DNA, 20 bp, mouse
gccaggagagcgacgaggcg

SEQ ID NO: 573890 - DNA, 20 bp, mouse
gcagcgaggccccaacggcc

SEQ ID NO: 573891 - DNA, 20 bp, mouse
gcgagctcccggagctccgg

SEQ ID NO: 573892 - DNA, 20 bp, mouse
gtcccgagctcccggagctc

SEQ ID NO: 573893 - DNA, 20 bp, mouse
ggcggcgcagacaatggaag

SEQ ID NO: 573894 - DNA, 20 bp, mouse
gccggcggaaccgagcagcg

SEQ ID NO: 573895 - DNA, 20 bp, mouse
gagccctgggccgcgccctg

SEQ ID NO: 573896 - DNA, 20 bp, mouse
gcgccgctcaggcccaggag

SEQ ID NO: 573897 - DNA, 20 bp, mouse
gtgaccagcccggactacag

SEQ ID NO: 573898 - DNA, 20 bp, mouse
gaccggctgggctcccgcgt

SEQ ID NO: 573899 - DNA, 20 bp, mouse
ggagtggacggttcctactg

SEQ ID NO: 573900 - DNA, 20 bp, mouse
gactacagcggtgagaggag

SEQ ID NO: 573901 - DNA, 20 bp, mouse
gtgaaacgcgaggccgacgc

SEQ ID NO: 573902 - DNA, 20 bp, mouse
gctgcggctgggcaccggct

SEQ ID NO: 573903 - DNA, 20 bp, mouse
gcgagaccggggccggattg

SEQ ID NO: 573904 - DNA, 20 bp, mouse
gaccttgacgagggccgcag

SEQ ID NO: 573905 - DNA, 20 bp, mouse
gtcctactgcggctgggcac

SEQ ID NO: 573906 - DNA, 20 bp, mouse
gagacgccgactgctcggtt

SEQ ID NO: 573907 - DNA, 20 bp, mouse
gcccctcccccgagcgccgg

SEQ ID NO: 573908 - DNA, 20 bp, mouse
gaggcgccccggccgagagg

SEQ ID NO: 573909 - DNA, 20 bp, mouse
ggctcgcccaaccgagcagt

SEQ ID NO: 573910 - DNA, 20 bp, mouse
ggaagctgcgagctgatagg

SEQ ID NO: 573911 - DNA, 20 bp, mouse
ggcgtctacaccgcacacgg

SEQ ID NO: 573912 - DNA, 20 bp, mouse
ggatcggaggatgaaagcac

SEQ ID NO: 573913 - DNA, 20 bp, mouse
gctcggagccgcgggcgaag

SEQ ID NO: 573914 - DNA, 20 bp, mouse
ggcctgccgccggcgctcgg

SEQ ID NO: 573915 - DNA, 20 bp, mouse
gagacgctggatgctttcgg

SEQ ID NO: 573916 - DNA, 20 bp, mouse
gcggagccgagggaagccga

SEQ ID NO: 573917 - DNA, 20 bp, mouse
ggacgggcgggaggacacga

SEQ ID NO: 573918 - DNA, 20 bp, mouse
gcggcccgcccgaggaggtg

SEQ ID NO: 573919 - DNA, 20 bp, mouse
gccgccccctcggcttccct

SEQ ID NO: 573920 - DNA, 20 bp, mouse
gcgccccgccgcactgacag

SEQ ID NO: 573921 - DNA, 20 bp, mouse
ggaagccgcgcggcaccgaa

SEQ ID NO: 573922 - DNA, 20 bp, mouse
ggctcgcgcctctgtcagtg

SEQ ID NO: 573923 - DNA, 20 bp, mouse
gaggaggtgaggaacgaaaa

SEQ ID NO: 573924 - DNA, 20 bp, mouse
gcggccgagcgaaggactcg

SEQ ID NO: 573925 - DNA, 20 bp, mouse
ggcgcggggtgcggagccga

SEQ ID NO: 573926 - DNA, 20 bp, mouse
ggaagtaattggtttgacca

SEQ ID NO: 573927 - DNA, 20 bp, mouse
gactaccagcagctatcgga

SEQ ID NO: 573928 - DNA, 20 bp, mouse
gaatcacacagtgaaagcca

SEQ ID NO: 573929 - DNA, 20 bp, mouse
gtcctactaccagcagctat

SEQ ID NO: 573930 - DNA, 20 bp, mouse
gcagcgccctgcatgaatga

SEQ ID NO: 573931 - DNA, 20 bp, mouse
gcaattacttcttagaaagt

SEQ ID NO: 573932 - DNA, 20 bp, mouse
gacccgtctctttgtctccg

SEQ ID NO: 573933 - DNA, 20 bp, mouse
gagctgggctgaaactgcat

SEQ ID NO: 573934 - DNA, 20 bp, mouse
gcatgtacaggagcaaacgc

SEQ ID NO: 573935 - DNA, 20 bp, mouse
gttcttggaagtctatggaa

SEQ ID NO: 573936 - DNA, 20 bp, mouse
ggcaaggcgctgggacggtg

SEQ ID NO: 573937 - DNA, 20 bp, mouse
ggctcggcaaggcgctggga

SEQ ID NO: 573938 - DNA, 20 bp, mouse
ggcgggcgcagagctcggca

SEQ ID NO: 573939 - DNA, 20 bp, mouse
ggcagccagaggccgcaccg

SEQ ID NO: 573940 - DNA, 20 bp, mouse
gctccagcgggcgcagagct

SEQ ID NO: 573941 - DNA, 20 bp, mouse
gccagaggccgcaccgcggg

SEQ ID NO: 573942 - DNA, 20 bp, mouse
ggacagtagagtggtgatgg

SEQ ID NO: 573943 - DNA, 20 bp, mouse
gcccccggcgcgtctccagc

SEQ ID NO: 573944 - DNA, 20 bp, mouse
gcatccagcgggccatccga

SEQ ID NO: 573945 - DNA, 20 bp, mouse
gtctccgtggcagcgtaagg

SEQ ID NO: 573946 - DNA, 20 bp, mouse
gtgggtgagatggcgaggag

SEQ ID NO: 573947 - DNA, 20 bp, mouse
gccaagccgagatccacccg

SEQ ID NO: 573948 - DNA, 20 bp, mouse
gcagcagcaacagcggaggg

SEQ ID NO: 573949 - DNA, 20 bp, mouse
gtccgatgcctgggtatctg

SEQ ID NO: 573950 - DNA, 20 bp, mouse
gagatgtgggaggtccggga

SEQ ID NO: 573951 - DNA, 20 bp, mouse
gacccggggcgcgctctacc

SEQ ID NO: 573952 - DNA, 20 bp, mouse
ggagcggggccatcacgcct

SEQ ID NO: 573953 - DNA, 20 bp, mouse
ggaaggggcctgggacatcg

SEQ ID NO: 573954 - DNA, 20 bp, mouse
ggcgcgccccgggtggatct

SEQ ID NO: 573955 - DNA, 20 bp, mouse
gaggcagttgggagctccaa

SEQ ID NO: 573956 - DNA, 20 bp, mouse
gcagcaacagcgacattcgg

SEQ ID NO: 573957 - DNA, 20 bp, mouse
gaagccggctgcatcttagt

SEQ ID NO: 573958 - DNA, 20 bp, mouse
gcgctgtgctggggtcttca

SEQ ID NO: 573959 - DNA, 20 bp, mouse
gggaaggagagagtccgcgt

SEQ ID NO: 573960 - DNA, 20 bp, mouse
gaaggtgcagccgctgtgct

SEQ ID NO: 573961 - DNA, 20 bp, mouse
gcatgtgcccggggcaggat

SEQ ID NO: 573962 - DNA, 20 bp, mouse
gcagggaagggtctttggtg

SEQ ID NO: 573963 - DNA, 20 bp, mouse
ggtggggtagagatattctg

SEQ ID NO: 573964 - DNA, 20 bp, mouse
gagcgacattcggaggtaag

SEQ ID NO: 573965 - DNA, 20 bp, mouse
gagggctgcacagttccctg

SEQ ID NO: 573966 - DNA, 20 bp, mouse
gggtagcgtcgaggccggga

SEQ ID NO: 573967 - DNA, 20 bp, mouse
ggtctccgcgcctgtccgac

SEQ ID NO: 573968 - DNA, 20 bp, mouse
gcggcacgtgcgccccacaa

SEQ ID NO: 573969 - DNA, 20 bp, mouse
gtttccagctccagtcggac

SEQ ID NO: 573970 - DNA, 20 bp, mouse
gcttctggaaggtagcgtcg

SEQ ID NO: 573971 - DNA, 20 bp, mouse
gacgcggcgtgagacggtgg

SEQ ID NO: 573972 - DNA, 20 bp, mouse
ggccatcgcggcggatcctg

SEQ ID NO: 573973 - DNA, 20 bp, mouse
gccgcacgggggccctcgga

SEQ ID NO: 573974 - DNA, 20 bp, mouse
gacggcagcgaggcctccgg

SEQ ID NO: 573975 - DNA, 20 bp, mouse
gagggtggctgcggggaaca

SEQ ID NO: 573976 - DNA, 20 bp, mouse
gggcgccagacgcggaggaa

SEQ ID NO: 573977 - DNA, 20 bp, mouse
ggcgccggcgccagacgcgg

SEQ ID NO: 573978 - DNA, 20 bp, mouse
gggagcgccggcgccagacg

SEQ ID NO: 573979 - DNA, 20 bp, mouse
gggcggagggaagagcggac

SEQ ID NO: 573980 - DNA, 20 bp, mouse
ggctgcgactagccgcccag

SEQ ID NO: 573981 - DNA, 20 bp, mouse
ggtacagcgaggcccgggtg

SEQ ID NO: 573982 - DNA, 20 bp, mouse
gagggcagccggagaggcaa

SEQ ID NO: 573983 - DNA, 20 bp, mouse
gtcaggcgtcgctggctcgg

SEQ ID NO: 573984 - DNA, 20 bp, mouse
gacggtggctcgactagctc

SEQ ID NO: 573985 - DNA, 20 bp, mouse
gggagggaagagcggacggg

SEQ ID NO: 573986 - DNA, 20 bp, mouse
gttctccagagtgctcacgg

SEQ ID NO: 573987 - DNA, 20 bp, mouse
gtgtagaagccggccaacga

SEQ ID NO: 573988 - DNA, 20 bp, mouse
gtaaaagtagacctggagct

SEQ ID NO: 573989 - DNA, 20 bp, mouse
gcaagcagtaaaagtagacc

SEQ ID NO: 573990 - DNA, 20 bp, mouse
gcccgcccccgtgagcactc

SEQ ID NO: 573991 - DNA, 20 bp, mouse
gcgggaatggtagttctcag

SEQ ID NO: 573992 - DNA, 20 bp, mouse
gatgggccgtgagcatccca

SEQ ID NO: 573993 - DNA, 20 bp, mouse
gcggcggcgacggcagaccc

SEQ ID NO: 573994 - DNA, 20 bp, mouse
gtccagagtgctcacggggg

SEQ ID NO: 573995 - DNA, 20 bp, mouse
gtgagcatcccagggtcgta

SEQ ID NO: 573996 - DNA, 20 bp, mouse
gagcggagcgcgccgagcac

SEQ ID NO: 573997 - DNA, 20 bp, mouse
gtcccgctgcgggctccgag

SEQ ID NO: 573998 - DNA, 20 bp, mouse
gtgggagcgagcggcttggg

SEQ ID NO: 573999 - DNA, 20 bp, mouse
gcccgagggccgaggggagg

SEQ ID NO: 574000 - DNA, 20 bp, mouse
gcgccacaggagatgcacag

SEQ ID NO: 574001 - DNA, 20 bp, mouse
ggcttggggggatcccgcgg

SEQ ID NO: 574002 - DNA, 20 bp, mouse
gcactgggagcgagcggctt

SEQ ID NO: 574003 - DNA, 20 bp, mouse
ggcggcttggggggatcccg

SEQ ID NO: 574004 - DNA, 20 bp, mouse
gccttgcctgggaacggtgt

SEQ ID NO: 574005 - DNA, 20 bp, mouse
gccaaccagagcgtactccg

SEQ ID NO: 574006 - DNA, 20 bp, mouse
ggcagtcgctgtaggcccca

SEQ ID NO: 574007 - DNA, 20 bp, mouse
gggaggtgagcgccgaacac

SEQ ID NO: 574008 - DNA, 20 bp, mouse
gagctccgtcgcgaacggat

SEQ ID NO: 574009 - DNA, 20 bp, mouse
gtggagcccgcagtcgctgt

SEQ ID NO: 574010 - DNA, 20 bp, mouse
gccgccgggagccatgacac

SEQ ID NO: 574011 - DNA, 20 bp, mouse
ggagctgcgtcaccggtgtt

SEQ ID NO: 574012 - DNA, 20 bp, mouse
gcccacgacggcctacggag

SEQ ID NO: 574013 - DNA, 20 bp, mouse
gcgcgacggagctgcgtcac

SEQ ID NO: 574014 - DNA, 20 bp, mouse
gggatagctaggccctgtca

SEQ ID NO: 574015 - DNA, 20 bp, mouse
ggaagaagccaggcccgagt

SEQ ID NO: 574016 - DNA, 20 bp, mouse
gacctggcgaacgaaggtag

SEQ ID NO: 574017 - DNA, 20 bp, mouse
gtggcgaacgaaggtagggg

SEQ ID NO: 574018 - DNA, 20 bp, mouse
ggcgcggggcgggaagtcaa

SEQ ID NO: 574019 - DNA, 20 bp, mouse
gagggagccccagagtcgaa

SEQ ID NO: 574020 - DNA, 20 bp, mouse
ggagcctcgaggtcgggagg

SEQ ID NO: 574021 - DNA, 20 bp, mouse
gggccggggaccagactcca

SEQ ID NO: 574022 - DNA, 20 bp, mouse
gtggcggacctggcgaacga

SEQ ID NO: 574023 - DNA, 20 bp, mouse
gtccccggccgggttcctcg

SEQ ID NO: 574024 - DNA, 20 bp, mouse
ggcttaaggaagtaaaatgg

SEQ ID NO: 574025 - DNA, 20 bp, mouse
ggcgcggccgaggagcctcg

SEQ ID NO: 574026 - DNA, 20 bp, mouse
gacaggggcgaactccaacc

SEQ ID NO: 574027 - DNA, 20 bp, mouse
gcagtccctctagtgtagag

SEQ ID NO: 574028 - DNA, 20 bp, mouse
gcagtcctctctacactaga

SEQ ID NO: 574029 - DNA, 20 bp, mouse
gacacatccaactgtcacag

SEQ ID NO: 574030 - DNA, 20 bp, mouse
gctaaaaggggaaaggtcca

SEQ ID NO: 574031 - DNA, 20 bp, mouse
gtaggcaggaggtgcgatac

SEQ ID NO: 574032 - DNA, 20 bp, mouse
gggatgtgtacagttcttaa

SEQ ID NO: 574033 - DNA, 20 bp, mouse
gctgcaggattaaatctgcc

SEQ ID NO: 574034 - DNA, 20 bp, mouse
gctggactttacagcagaga

SEQ ID NO: 574035 - DNA, 20 bp, mouse
gtcttgaccagtagaaaccc

SEQ ID NO: 574036 - DNA, 20 bp, mouse
ggggttgccggcgaccgtgt

SEQ ID NO: 574037 - DNA, 20 bp, mouse
gggcggcggccgggtctgca

SEQ ID NO: 574038 - DNA, 20 bp, mouse
ggccggcaaccctgcagacc

SEQ ID NO: 574039 - DNA, 20 bp, mouse
gctttgacaggacgcgatgg

SEQ ID NO: 574040 - DNA, 20 bp, mouse
gctaccgcgaccgggaagga

SEQ ID NO: 574041 - DNA, 20 bp, mouse
gtagctttgacaggacgcga

SEQ ID NO: 574042 - DNA, 20 bp, mouse
gcggtcgcggtagctttgac

SEQ ID NO: 574043 - DNA, 20 bp, mouse
gaatagaagagcaggttatg

SEQ ID NO: 574044 - DNA, 20 bp, mouse
gccgcgaccgggaaggaggg

SEQ ID NO: 574045 - DNA, 20 bp, mouse
gcatgcagcttggattgatc

SEQ ID NO: 574046 - DNA, 20 bp, mouse
ggaaacagccgcgagagcag

SEQ ID NO: 574047 - DNA, 20 bp, mouse
gtgggcgacgcggtgaagcg

SEQ ID NO: 574048 - DNA, 20 bp, mouse
ggcggggaagagagactgcg

SEQ ID NO: 574049 - DNA, 20 bp, mouse
ggatgcggtgggacagcgag

SEQ ID NO: 574050 - DNA, 20 bp, mouse
ggcgaggggagcgggcggaa

SEQ ID NO: 574051 - DNA, 20 bp, mouse
gagtcgcggccgggatgtcc

SEQ ID NO: 574052 - DNA, 20 bp, mouse
gcgcccgccccggaagcagg

SEQ ID NO: 574053 - DNA, 20 bp, mouse
gcacgcgaccgggagcgatg

SEQ ID NO: 574054 - DNA, 20 bp, mouse
gaggaagcagggacgagtgg

SEQ ID NO: 574055 - DNA, 20 bp, mouse
ggcggcggccgctgctctcg

SEQ ID NO: 574056 - DNA, 20 bp, mouse
ggagccgcggcagcaaggag

SEQ ID NO: 574057 - DNA, 20 bp, mouse
gggtgtgcacgagctaaacg

SEQ ID NO: 574058 - DNA, 20 bp, mouse
gcgagctaaacgaggagccg

SEQ ID NO: 574059 - DNA, 20 bp, mouse
gcgatccccagcgattatgg

SEQ ID NO: 574060 - DNA, 20 bp, mouse
gctggggatcgtggagcagg

SEQ ID NO: 574061 - DNA, 20 bp, mouse
gggtggcccaggcaagtgac

SEQ ID NO: 574062 - DNA, 20 bp, mouse
ggggcgcagcgtgatcaaaa

SEQ ID NO: 574063 - DNA, 20 bp, mouse
gtccgccgccataatcgctg

SEQ ID NO: 574064 - DNA, 20 bp, mouse
ggggccaccagggtctgggt

SEQ ID NO: 574065 - DNA, 20 bp, mouse
gtccccagcgattatggcgg

SEQ ID NO: 574066 - DNA, 20 bp, mouse
ggggcgtgaccagatcttaa

SEQ ID NO: 574067 - DNA, 20 bp, mouse
gtcccattgcttagtaggac

SEQ ID NO: 574068 - DNA, 20 bp, mouse
gggccgggagccgagaaagt

SEQ ID NO: 574069 - DNA, 20 bp, mouse
gccccggaggccgatcgggt

SEQ ID NO: 574070 - DNA, 20 bp, mouse
gagaaagccagcctccccgg

SEQ ID NO: 574071 - DNA, 20 bp, mouse
gtcggctcccggcctcccgt

SEQ ID NO: 574072 - DNA, 20 bp, mouse
gcagaccaggctcgagggtg

SEQ ID NO: 574073 - DNA, 20 bp, mouse
gccaagggcaatagcagacc

SEQ ID NO: 574074 - DNA, 20 bp, mouse
gaaaggtcccattgcttagt

SEQ ID NO: 574075 - DNA, 20 bp, mouse
gaatagcagaccaggctcga

SEQ ID NO: 574076 - DNA, 20 bp, mouse
gctcgggctctgcacggcgg

SEQ ID NO: 574077 - DNA, 20 bp, mouse
gctcgggctcgggctctgca

SEQ ID NO: 574078 - DNA, 20 bp, mouse
gaccgtccgcgagtccgggg

SEQ ID NO: 574079 - DNA, 20 bp, mouse
gccacgcccgcggaccgagg

SEQ ID NO: 574080 - DNA, 20 bp, mouse
gggcaagcggcagaatacag

SEQ ID NO: 574081 - DNA, 20 bp, mouse
ggcgtgcgtgcgcgttccgg

SEQ ID NO: 574082 - DNA, 20 bp, mouse
gagtacggggtgcgagtgag

SEQ ID NO: 574083 - DNA, 20 bp, mouse
gcgggccgcggggtgagtac

SEQ ID NO: 574084 - DNA, 20 bp, mouse
gccccgcggacggagaggtg

SEQ ID NO: 574085 - DNA, 20 bp, mouse
gcctcctctcggccgcggct

SEQ ID NO: 574086 - DNA, 20 bp, mouse
ggcgtggaaagcagcccgag

SEQ ID NO: 574087 - DNA, 20 bp, mouse
gaaagcagcccgagcggcgg

SEQ ID NO: 574088 - DNA, 20 bp, mouse
gtggaaagcagcccgagcgg

SEQ ID NO: 574089 - DNA, 20 bp, mouse
gccgggagcagcgacccgaa

SEQ ID NO: 574090 - DNA, 20 bp, mouse
gcctcgcccagagtcaggcg

SEQ ID NO: 574091 - DNA, 20 bp, mouse
ggctttccacgcctgactct

SEQ ID NO: 574092 - DNA, 20 bp, mouse
gaagcgagcgagggactcgg

SEQ ID NO: 574093 - DNA, 20 bp, mouse
ggtcgccgcgcgttcccttc

SEQ ID NO: 574094 - DNA, 20 bp, mouse
gggctgaacgcctgacgtca

SEQ ID NO: 574095 - DNA, 20 bp, mouse
gcctgactctgggcgaggtt

SEQ ID NO: 574096 - DNA, 20 bp, mouse
gggcggcagagagcgagtcc

SEQ ID NO: 574097 - DNA, 20 bp, mouse
gagtcccggcagagctgcag

SEQ ID NO: 574098 - DNA, 20 bp, mouse
gtaggactcggggcacctaa

SEQ ID NO: 574099 - DNA, 20 bp, mouse
ggcctgggccgggttgtcct

SEQ ID NO: 574100 - DNA, 20 bp, mouse
gtgacggagcctaggactcg

SEQ ID NO: 574101 - DNA, 20 bp, mouse
ggcgcggccaggctagatgg

SEQ ID NO: 574102 - DNA, 20 bp, mouse
ggtcagcccggaatctccaa

SEQ ID NO: 574103 - DNA, 20 bp, mouse
ggactcggggcacctaaggg

SEQ ID NO: 574104 - DNA, 20 bp, mouse
gtcccctccaggggataaca

SEQ ID NO: 574105 - DNA, 20 bp, mouse
gtgccaagcccaggacaacc

SEQ ID NO: 574106 - DNA, 20 bp, mouse
gagcagggtgagcccagaga

SEQ ID NO: 574107 - DNA, 20 bp, mouse
gggacaggagcgcagagctc

SEQ ID NO: 574108 - DNA, 20 bp, mouse
ggcgcagagctcgggctacg

SEQ ID NO: 574109 - DNA, 20 bp, mouse
gagagaaggcagagcggcgg

SEQ ID NO: 574110 - DNA, 20 bp, mouse
gccccggcggcgctgtaagc

SEQ ID NO: 574111 - DNA, 20 bp, mouse
gggcacagactgccagactc

SEQ ID NO: 574112 - DNA, 20 bp, mouse
gaagccgggcatcccacctg

SEQ ID NO: 574113 - DNA, 20 bp, mouse
gctgtgcctgaaccccgtca

SEQ ID NO: 574114 - DNA, 20 bp, mouse
ggtccctacgtctgacccag

SEQ ID NO: 574115 - DNA, 20 bp, mouse
gccggcaacgagcccctccg

SEQ ID NO: 574116 - DNA, 20 bp, mouse
gaccccgcgttgaggaggag

SEQ ID NO: 574117 - DNA, 20 bp, mouse
ggcgcccacagctctccatc

SEQ ID NO: 574118 - DNA, 20 bp, mouse
gttgggctcactgggaggta

SEQ ID NO: 574119 - DNA, 20 bp, mouse
gagccccctcctcctcaacg

SEQ ID NO: 574120 - DNA, 20 bp, mouse
gctgtccacgtcgggagtgt

SEQ ID NO: 574121 - DNA, 20 bp, mouse
gactgagcgtggaattggag

SEQ ID NO: 574122 - DNA, 20 bp, mouse
gcggtcctgatggagagctg

SEQ ID NO: 574123 - DNA, 20 bp, mouse
ggcgagggaaccccgcgttg

SEQ ID NO: 574124 - DNA, 20 bp, mouse
gcgtgtgcgcgccgcggtga

SEQ ID NO: 574125 - DNA, 20 bp, mouse
ggccgcgtgcaccgtcaccg

SEQ ID NO: 574126 - DNA, 20 bp, mouse
ggccagggagggacccgcgg

SEQ ID NO: 574127 - DNA, 20 bp, mouse
gctggctgcgggagacgcgg

SEQ ID NO: 574128 - DNA, 20 bp, mouse
gcactctgtgggaggaacat

SEQ ID NO: 574129 - DNA, 20 bp, mouse
gtgcgggcggcgcggctcag

SEQ ID NO: 574130 - DNA, 20 bp, mouse
ggcgtctcccgcagccaggg

SEQ ID NO: 574131 - DNA, 20 bp, mouse
gcgggagacgcggaggtaga

SEQ ID NO: 574132 - DNA, 20 bp, mouse
gaccctgcagcacgccgagg

SEQ ID NO: 574133 - DNA, 20 bp, mouse
gcacagagtgaggaccggca

SEQ ID NO: 574134 - DNA, 20 bp, mouse
gagtgaggaccggcagggcg

SEQ ID NO: 574135 - DNA, 20 bp, mouse
ggcgggtccctccctggctg

SEQ ID NO: 574136 - DNA, 20 bp, mouse
ggaggacgatgcagccccga

SEQ ID NO: 574137 - DNA, 20 bp, mouse
gtgtgagcgggccaagcggg

SEQ ID NO: 574138 - DNA, 20 bp, mouse
gtcgtgcgcggccctgtgag

SEQ ID NO: 574139 - DNA, 20 bp, mouse
gtgcgggcccgcggttcggg

SEQ ID NO: 574140 - DNA, 20 bp, mouse
gtgagccgacgagtccgtaa

SEQ ID NO: 574141 - DNA, 20 bp, mouse
ggccggagccgcccgaaccg

SEQ ID NO: 574142 - DNA, 20 bp, mouse
gccctgtgagcgggccaagc

SEQ ID NO: 574143 - DNA, 20 bp, mouse
ggttgctgctctcgccctcg

SEQ ID NO: 574144 - DNA, 20 bp, mouse
gcgggcgcaggtctatgtcg

SEQ ID NO: 574145 - DNA, 20 bp, mouse
gcgcaggtctatgtcgcggg

SEQ ID NO: 574146 - DNA, 20 bp, mouse
gggaagccctcgcccagcgg

SEQ ID NO: 574147 - DNA, 20 bp, mouse
gcgcagccggagcaagacaa

SEQ ID NO: 574148 - DNA, 20 bp, mouse
ggtaggaagccctcgcccag

SEQ ID NO: 574149 - DNA, 20 bp, mouse
gcgcgtggcatgagtccccg

SEQ ID NO: 574150 - DNA, 20 bp, mouse
ggagagagagtgatgggtcg

SEQ ID NO: 574151 - DNA, 20 bp, mouse
gtcctcagggtcctccgaca

SEQ ID NO: 574152 - DNA, 20 bp, mouse
gtgggctgcgcgcggcgagt

SEQ ID NO: 574153 - DNA, 20 bp, mouse
ggccctgtcggaggaccctg

SEQ ID NO: 574154 - DNA, 20 bp, mouse
gcgtccggctgagacacgcg

SEQ ID NO: 574155 - DNA, 20 bp, mouse
gcctcgcccagcggaggctg

SEQ ID NO: 574156 - DNA, 20 bp, mouse
ggcaaggccaggcggaaggt

SEQ ID NO: 574157 - DNA, 20 bp, mouse
gcaactccttacccaagggg

SEQ ID NO: 574158 - DNA, 20 bp, mouse
gcaccccgctagctgcgctg

SEQ ID NO: 574159 - DNA, 20 bp, mouse
gtcaccaactccttacccaa

SEQ ID NO: 574160 - DNA, 20 bp, mouse
gcttgccgcagcgcagctag

SEQ ID NO: 574161 - DNA, 20 bp, mouse
gggcggaaatgtgcgaactg

SEQ ID NO: 574162 - DNA, 20 bp, mouse
gggaaatgtgcgaactgggg

SEQ ID NO: 574163 - DNA, 20 bp, mouse
gtaccgcaaagagatcgaag

SEQ ID NO: 574164 - DNA, 20 bp, mouse
gagactcatgagggaataca

SEQ ID NO: 574165 - DNA, 20 bp, mouse
gaggatttccagtactgacg

SEQ ID NO: 574166 - DNA, 20 bp, mouse
ggcggctcgcggccccggag

SEQ ID NO: 574167 - DNA, 20 bp, mouse
ggagcaccggtccagtagag

SEQ ID NO: 574168 - DNA, 20 bp, mouse
gggagtggcaggcccggtgc

SEQ ID NO: 574169 - DNA, 20 bp, mouse
gtgcgcgggaggtggagcgg

SEQ ID NO: 574170 - DNA, 20 bp, mouse
gggcgcagcccggaaatgtc

SEQ ID NO: 574171 - DNA, 20 bp, mouse
gacggcgcgagtgtgaggcg

SEQ ID NO: 574172 - DNA, 20 bp, mouse
ggctcgcggccccggagcgg

SEQ ID NO: 574173 - DNA, 20 bp, mouse
gtctagcgcacgaggccagg

SEQ ID NO: 574174 - DNA, 20 bp, mouse
gccgctgcgggataagaggc

SEQ ID NO: 574175 - DNA, 20 bp, mouse
gcaccggtccagtagagcgg

SEQ ID NO: 574176 - DNA, 20 bp, mouse
gcaggcgctgccggcatcgt

SEQ ID NO: 574177 - DNA, 20 bp, mouse
ggccaggcagcccacgatgc

SEQ ID NO: 574178 - DNA, 20 bp, mouse
gcagcttaaagtgtcactac

SEQ ID NO: 574179 - DNA, 20 bp, mouse
gcgtgggctgcctggctggg

SEQ ID NO: 574180 - DNA, 20 bp, mouse
ggagcgttgctcttctccag

SEQ ID NO: 574181 - DNA, 20 bp, mouse
gacaagtgtgaagggttttt

SEQ ID NO: 574182 - DNA, 20 bp, mouse
gccctccctcctctgagcag

SEQ ID NO: 574183 - DNA, 20 bp, mouse
ggagatcctctgctcagagg

SEQ ID NO: 574184 - DNA, 20 bp, mouse
gctgctaaccatggagttct

SEQ ID NO: 574185 - DNA, 20 bp, mouse
gaaaaggaatctgaacgaca

SEQ ID NO: 574186 - DNA, 20 bp, mouse
gacatctgggacggaggcgg

SEQ ID NO: 574187 - DNA, 20 bp, mouse
gggctgcaggatccctggag

SEQ ID NO: 574188 - DNA, 20 bp, mouse
gcttacatctgggacggagg

SEQ ID NO: 574189 - DNA, 20 bp, mouse
ggctcttacatctgggacgg

SEQ ID NO: 574190 - DNA, 20 bp, mouse
gcggtgctcgccctagcaag

SEQ ID NO: 574191 - DNA, 20 bp, mouse
gccagctggctcttacatct

SEQ ID NO: 574192 - DNA, 20 bp, mouse
gagaggaagccgacacgtgg

SEQ ID NO: 574193 - DNA, 20 bp, mouse
gggccagcccctagtcagac

SEQ ID NO: 574194 - DNA, 20 bp, mouse
gtgggtgaatagagggctgg

SEQ ID NO: 574195 - DNA, 20 bp, mouse
ggtaaggtgggccggagtca

SEQ ID NO: 574196 - DNA, 20 bp, mouse
gcgtgcgcagcgaccatgtt

SEQ ID NO: 574197 - DNA, 20 bp, mouse
gtccaggcaggcgatccact

SEQ ID NO: 574198 - DNA, 20 bp, mouse
ggcggggcggaaggggacca

SEQ ID NO: 574199 - DNA, 20 bp, mouse
gagcccgccgggaggcgcgc

SEQ ID NO: 574200 - DNA, 20 bp, mouse
gccaatgggcactaagacca

SEQ ID NO: 574201 - DNA, 20 bp, mouse
ggactccacgctccattcat

SEQ ID NO: 574202 - DNA, 20 bp, mouse
ggctggcaccttgtccccca

SEQ ID NO: 574203 - DNA, 20 bp, mouse
ggttgggcagcagcgcgcgg

SEQ ID NO: 574204 - DNA, 20 bp, mouse
gcaggctgtccagaccctca

SEQ ID NO: 574205 - DNA, 20 bp, mouse
ggagagcgcccgcgggaaga

SEQ ID NO: 574206 - DNA, 20 bp, mouse
gccttcgccaggcagcgaga

SEQ ID NO: 574207 - DNA, 20 bp, mouse
gcagcgagagggcgcgactg

SEQ ID NO: 574208 - DNA, 20 bp, mouse
gggcgcgcgccaatgggcag

SEQ ID NO: 574209 - DNA, 20 bp, mouse
gggcgccgccgcaaccgtca

SEQ ID NO: 574210 - DNA, 20 bp, mouse
gcagcgcaggcaggtccctg

SEQ ID NO: 574211 - DNA, 20 bp, mouse
gtcgcctccgcgccttcgcc

SEQ ID NO: 574212 - DNA, 20 bp, mouse
gcagccgggcgcgcgccaat

SEQ ID NO: 574213 - DNA, 20 bp, mouse
ggggcccgcggggcagtcga

SEQ ID NO: 574214 - DNA, 20 bp, mouse
ggaaggcgcggaggcgagcg

SEQ ID NO: 574215 - DNA, 20 bp, mouse
ggctgccagccgctgcccat

SEQ ID NO: 574216 - DNA, 20 bp, mouse
gtacgccagccccaccggga

SEQ ID NO: 574217 - DNA, 20 bp, mouse
gggaagtccccggcaggaag

SEQ ID NO: 574218 - DNA, 20 bp, mouse
gtcttcgcaacgcccgccca

SEQ ID NO: 574219 - DNA, 20 bp, mouse
ggcgcgtgggctgaggccct

SEQ ID NO: 574220 - DNA, 20 bp, mouse
gggactcctgaggtaaggcc

SEQ ID NO: 574221 - DNA, 20 bp, mouse
ggccgagcgccggggtccac

SEQ ID NO: 574222 - DNA, 20 bp, mouse
gttacctcaggagtccgctc

SEQ ID NO: 574223 - DNA, 20 bp, mouse
gtttctggccagtcgcgcgt

SEQ ID NO: 574224 - DNA, 20 bp, mouse
gggcagctagacgcaggcta

SEQ ID NO: 574225 - DNA, 20 bp, mouse
gacaagtacaaggaagtccc

SEQ ID NO: 574226 - DNA, 20 bp, mouse
gggccgggctgaggcgacag

SEQ ID NO: 574227 - DNA, 20 bp, mouse
ggccccggagcgctgagacg

SEQ ID NO: 574228 - DNA, 20 bp, mouse
gcgcaaggctgaggacgcgg

SEQ ID NO: 574229 - DNA, 20 bp, mouse
gcgggcggagcgcaaggctg

SEQ ID NO: 574230 - DNA, 20 bp, mouse
ggagcgcaaggctgaggacg

SEQ ID NO: 574231 - DNA, 20 bp, mouse
gccggctgcggccgaagggt

SEQ ID NO: 574232 - DNA, 20 bp, mouse
gtccccgtctcagcgctccg

SEQ ID NO: 574233 - DNA, 20 bp, mouse
gtcggactgcgagcgagagg

SEQ ID NO: 574234 - DNA, 20 bp, mouse
gctgcggccgaagggttggc

SEQ ID NO: 574235 - DNA, 20 bp, mouse
gccggcggcccctaagagag

SEQ ID NO: 574236 - DNA, 20 bp, mouse
gtcgaggtccgggaaaggag

SEQ ID NO: 574237 - DNA, 20 bp, mouse
ggactgaccgacccacagag

SEQ ID NO: 574238 - DNA, 20 bp, mouse
gagaggtctgggtgcccggg

SEQ ID NO: 574239 - DNA, 20 bp, mouse
gggcgccgggcaaatggaga

SEQ ID NO: 574240 - DNA, 20 bp, mouse
gagcgtcgcccctggagagg

SEQ ID NO: 574241 - DNA, 20 bp, mouse
gccgccgacgcccgctctgt

SEQ ID NO: 574242 - DNA, 20 bp, mouse
gggccctcgaggtccgggaa

SEQ ID NO: 574243 - DNA, 20 bp, mouse
gcgacgcccgctctgtgggt

SEQ ID NO: 574244 - DNA, 20 bp, mouse
gccggacctcgagggccagg

SEQ ID NO: 574245 - DNA, 20 bp, mouse
gtgcacggtgcagccccgag

SEQ ID NO: 574246 - DNA, 20 bp, mouse
ggcagggcctggatggacaa

SEQ ID NO: 574247 - DNA, 20 bp, mouse
gaccagccttgttcccaggg

SEQ ID NO: 574248 - DNA, 20 bp, mouse
gggacaacgggcgccaccct

SEQ ID NO: 574249 - DNA, 20 bp, mouse
gtggcgcccgttgtccatcc

SEQ ID NO: 574250 - DNA, 20 bp, mouse
gcaggtgctgtgagaagatt

SEQ ID NO: 574251 - DNA, 20 bp, mouse
gagaagggctctgacctcgt

SEQ ID NO: 574252 - DNA, 20 bp, mouse
gggtgttggacccacggtgt

SEQ ID NO: 574253 - DNA, 20 bp, mouse
gctcactcaggaagatacaa

SEQ ID NO: 574254 - DNA, 20 bp, mouse
gcacggtgtcggctgatctc

SEQ ID NO: 574255 - DNA, 20 bp, mouse
gtcggctgatctctggggag

SEQ ID NO: 574256 - DNA, 20 bp, mouse
gccggggggccgcagctcag

SEQ ID NO: 574257 - DNA, 20 bp, mouse
gccgagaggagccgtccggg

SEQ ID NO: 574258 - DNA, 20 bp, mouse
ggggtgtggggtcctccgag

SEQ ID NO: 574259 - DNA, 20 bp, mouse
gcctccgagaggagccgtcc

SEQ ID NO: 574260 - DNA, 20 bp, mouse
gcatggcgagtcacgtgcag

SEQ ID NO: 574261 - DNA, 20 bp, mouse
gagggttccccagggttcca

SEQ ID NO: 574262 - DNA, 20 bp, mouse
gcgaagtgtgagagaatcga

SEQ ID NO: 574263 - DNA, 20 bp, mouse
ggcccggcgtcaggggtgtg

SEQ ID NO: 574264 - DNA, 20 bp, mouse
gccactctggatgggaactg

SEQ ID NO: 574265 - DNA, 20 bp, mouse
ggagaatcgagggttcccca

SEQ ID NO: 574266 - DNA, 20 bp, mouse
gcggaggcggggccgtacag

SEQ ID NO: 574267 - DNA, 20 bp, mouse
gagattccgggtgcgggtgg

SEQ ID NO: 574268 - DNA, 20 bp, mouse
ggggtgggggaacccctgta

SEQ ID NO: 574269 - DNA, 20 bp, mouse
gccggtggcccaagaactcg

SEQ ID NO: 574270 - DNA, 20 bp, mouse
ggggctcccgggcttctccg

SEQ ID NO: 574271 - DNA, 20 bp, mouse
ggcacccggaatctaagcca

SEQ ID NO: 574272 - DNA, 20 bp, mouse
gtagcaagcggcccgccgcc

SEQ ID NO: 574273 - DNA, 20 bp, mouse
gctcgaggctccggtgtccc

SEQ ID NO: 574274 - DNA, 20 bp, mouse
gggggtggtggcgcgcactc

SEQ ID NO: 574275 - DNA, 20 bp, mouse
gtctccgtggcttagattcc

SEQ ID NO: 574276 - DNA, 20 bp, mouse
gacccgggcagggagcgtct

SEQ ID NO: 574277 - DNA, 20 bp, mouse
gcagaggacgcgagccaccc

SEQ ID NO: 574278 - DNA, 20 bp, mouse
ggcgccgcggccacaagact

SEQ ID NO: 574279 - DNA, 20 bp, mouse
ggagcgtctgggcaccggcg

SEQ ID NO: 574280 - DNA, 20 bp, mouse
gtccgtgtgacagaagtggt

SEQ ID NO: 574281 - DNA, 20 bp, mouse
ggacgcgagccacccgggca

SEQ ID NO: 574282 - DNA, 20 bp, mouse
ggcagggagcgtctgggcac

SEQ ID NO: 574283 - DNA, 20 bp, mouse
ggcccagacgctccctgccc

SEQ ID NO: 574284 - DNA, 20 bp, mouse
gtaggaagtgagctgctccg

SEQ ID NO: 574285 - DNA, 20 bp, mouse
gggcctgggtgaatccactg

SEQ ID NO: 574286 - DNA, 20 bp, mouse
gccctaagtgaggcagactg

SEQ ID NO: 574287 - DNA, 20 bp, mouse
gtgcctaggcaccctaagtg

SEQ ID NO: 574288 - DNA, 20 bp, mouse
gtgcctcacttagggtgcct

SEQ ID NO: 574289 - DNA, 20 bp, mouse
ggcctcagtctgcctcactt

SEQ ID NO: 574290 - DNA, 20 bp, mouse
gcccggcttggagagaaact

SEQ ID NO: 574291 - DNA, 20 bp, mouse
gggagggggatccccagcaa

SEQ ID NO: 574292 - DNA, 20 bp, mouse
gagggcgctgagatgcatgg

SEQ ID NO: 574293 - DNA, 20 bp, mouse
gactgggtgctagaacacca

SEQ ID NO: 574294 - DNA, 20 bp, mouse
gaagggaaaagaactgggcg

SEQ ID NO: 574295 - DNA, 20 bp, mouse
gccgcgacggctgtatgggg

SEQ ID NO: 574296 - DNA, 20 bp, mouse
gctaggctgggacaatcccg

SEQ ID NO: 574297 - DNA, 20 bp, mouse
ggcggagtcagtgtgcggtt

SEQ ID NO: 574298 - DNA, 20 bp, mouse
ggactccgcaggcggggaca

SEQ ID NO: 574299 - DNA, 20 bp, mouse
gctgactcacctggagggga

SEQ ID NO: 574300 - DNA, 20 bp, mouse
gagtgactcgcggtaatggg

SEQ ID NO: 574301 - DNA, 20 bp, mouse
gccgcctgactcacctggag

SEQ ID NO: 574302 - DNA, 20 bp, mouse
gtgggcgggcgggctccgag

SEQ ID NO: 574303 - DNA, 20 bp, mouse
gcgcacactgactccgcagg

SEQ ID NO: 574304 - DNA, 20 bp, mouse
gtattttggggcggtcacgt

SEQ ID NO: 574305 - DNA, 20 bp, mouse
gtttggggcggtcacgtggg

SEQ ID NO: 574306 - DNA, 20 bp, mouse
gcgggcggcaggggcccacg

SEQ ID NO: 574307 - DNA, 20 bp, mouse
ggacggggctgcatggacac

SEQ ID NO: 574308 - DNA, 20 bp, mouse
gcccatccacgcagccccgt

SEQ ID NO: 574309 - DNA, 20 bp, mouse
gctggcatcgggggttgacg

SEQ ID NO: 574310 - DNA, 20 bp, mouse
ggcaacagcgctggcatcgg

SEQ ID NO: 574311 - DNA, 20 bp, mouse
ggcactgcgaaccgggtcca

SEQ ID NO: 574312 - DNA, 20 bp, mouse
ggcatggacacgggcggcag

SEQ ID NO: 574313 - DNA, 20 bp, mouse
gccagctgcaggatcccgcg

SEQ ID NO: 574314 - DNA, 20 bp, mouse
gatcccgcgtggcagcccca

SEQ ID NO: 574315 - DNA, 20 bp, mouse
gaggggcccacggggctgcg

SEQ ID NO: 574316 - DNA, 20 bp, mouse
gctgccagggagctgttcca

SEQ ID NO: 574317 - DNA, 20 bp, mouse
gccagggaccacacagaaaa

SEQ ID NO: 574318 - DNA, 20 bp, mouse
gtgagagggaacaactgcca

SEQ ID NO: 574319 - DNA, 20 bp, mouse
gtggtaccttgaaaatgatc

SEQ ID NO: 574320 - DNA, 20 bp, mouse
gcagcgcaggagcctacagg

SEQ ID NO: 574321 - DNA, 20 bp, mouse
gagcgaggcctttttctgtg

SEQ ID NO: 574322 - DNA, 20 bp, mouse
ggtggcctgacctactccta

SEQ ID NO: 574323 - DNA, 20 bp, mouse
gccagcaggattacttcccg

SEQ ID NO: 574324 - DNA, 20 bp, mouse
ggggcacagtgggcacacgt

SEQ ID NO: 574325 - DNA, 20 bp, mouse
gagggctagttggataccaa

SEQ ID NO: 574326 - DNA, 20 bp, mouse
gtcgctgacgagaggatgga

SEQ ID NO: 574327 - DNA, 20 bp, mouse
ggacgagaggatggacggtc

SEQ ID NO: 574328 - DNA, 20 bp, mouse
gcatgtgagtcgctgacgag

SEQ ID NO: 574329 - DNA, 20 bp, mouse
gtgagtcgctgacgagagga

SEQ ID NO: 574330 - DNA, 20 bp, mouse
ggagaggatggacggtctgg

SEQ ID NO: 574331 - DNA, 20 bp, mouse
ggagccctccgccccgccca

SEQ ID NO: 574332 - DNA, 20 bp, mouse
gacctgctgcagcaaccgcg

SEQ ID NO: 574333 - DNA, 20 bp, mouse
gggtggctcagtgctccgcg

SEQ ID NO: 574334 - DNA, 20 bp, mouse
gctgcagcaggtttgtccct

SEQ ID NO: 574335 - DNA, 20 bp, mouse
gctgtcactcagagaagaga

SEQ ID NO: 574336 - DNA, 20 bp, mouse
gtgtcaggtacagtccagag

SEQ ID NO: 574337 - DNA, 20 bp, mouse
gcggggcgtgcgggaaaggg

SEQ ID NO: 574338 - DNA, 20 bp, mouse
gcatggcgtgtggctttcgt

SEQ ID NO: 574339 - DNA, 20 bp, mouse
gcgtaggtcgatcgcctgtc

SEQ ID NO: 574340 - DNA, 20 bp, mouse
ggaaagggaggcatggcgtg

SEQ ID NO: 574341 - DNA, 20 bp, mouse
gggcgagccagcgggagcca

SEQ ID NO: 574342 - DNA, 20 bp, mouse
ggaggaggcagggtcggcct

SEQ ID NO: 574343 - DNA, 20 bp, mouse
ggaggcgacttccggcgcgg

SEQ ID NO: 574344 - DNA, 20 bp, mouse
gaggcggggcgtgcgggaaa

SEQ ID NO: 574345 - DNA, 20 bp, mouse
ggtccagagcggcgagccag

SEQ ID NO: 574346 - DNA, 20 bp, mouse
ggcataggcagccccactgg

SEQ ID NO: 574347 - DNA, 20 bp, mouse
gggcggagatgaggctacgg

SEQ ID NO: 574348 - DNA, 20 bp, mouse
gactccagccggcggagatg

SEQ ID NO: 574349 - DNA, 20 bp, mouse
ggctacggtggctctggcat

SEQ ID NO: 574350 - DNA, 20 bp, mouse
gtgctcccgactccagccgg

SEQ ID NO: 574351 - DNA, 20 bp, mouse
gcccactggtggctgcggtg

SEQ ID NO: 574352 - DNA, 20 bp, mouse
gtggctacgctaaagaggaa

SEQ ID NO: 574353 - DNA, 20 bp, mouse
ggcagccccactggtggctg

SEQ ID NO: 574354 - DNA, 20 bp, mouse
gggcttacgggaagcgacgc

SEQ ID NO: 574355 - DNA, 20 bp, mouse
gcagcgcctgcagaaacgct

SEQ ID NO: 574356 - DNA, 20 bp, mouse
ggggccgggcggcaccatgg

SEQ ID NO: 574357 - DNA, 20 bp, mouse
gcccggctacgcaggcggta

SEQ ID NO: 574358 - DNA, 20 bp, mouse
gtaggggccgggcggcacca

SEQ ID NO: 574359 - DNA, 20 bp, mouse
gtacgcaggcggtagggctg

SEQ ID NO: 574360 - DNA, 20 bp, mouse
ggggtctgcgctgcccgaga

SEQ ID NO: 574361 - DNA, 20 bp, mouse
ggcggcggcagcgcctgctg

SEQ ID NO: 574362 - DNA, 20 bp, mouse
gaggcggtagggctggggta

SEQ ID NO: 574363 - DNA, 20 bp, mouse
gccgaggcgccggccgtctc

SEQ ID NO: 574364 - DNA, 20 bp, mouse
ggctacagcgaggctcgatc

SEQ ID NO: 574365 - DNA, 20 bp, mouse
gtccggcctaggcctcgctc

SEQ ID NO: 574366 - DNA, 20 bp, mouse
gggcagacggagccgagctg

SEQ ID NO: 574367 - DNA, 20 bp, mouse
ggcagcgcggccgcagaagg

SEQ ID NO: 574368 - DNA, 20 bp, mouse
gggccggataccaagaacag

SEQ ID NO: 574369 - DNA, 20 bp, mouse
gcgcagaagggggacaagac

SEQ ID NO: 574370 - DNA, 20 bp, mouse
gacggagaaccgggcagtct

SEQ ID NO: 574371 - DNA, 20 bp, mouse
gagattggtgaggaccgcgg

SEQ ID NO: 574372 - DNA, 20 bp, mouse
gaggcgcctgggatctggag

SEQ ID NO: 574373 - DNA, 20 bp, mouse
gtgcggtccgcgctctgacc

SEQ ID NO: 574374 - DNA, 20 bp, mouse
gccgcctcgcgcccttccat

SEQ ID NO: 574375 - DNA, 20 bp, mouse
ggagaaccgggcagtctagg

SEQ ID NO: 574376 - DNA, 20 bp, mouse
gccctctcggggtaaggagg

SEQ ID NO: 574377 - DNA, 20 bp, mouse
ggccagagaggggagcgctg

SEQ ID NO: 574378 - DNA, 20 bp, mouse
ggcgggtgcggaggccagag

SEQ ID NO: 574379 - DNA, 20 bp, mouse
ggaagccagggctcataggg

SEQ ID NO: 574380 - DNA, 20 bp, mouse
ggagtggaggggcaagctag

SEQ ID NO: 574381 - DNA, 20 bp, mouse
ggactcatgggtcccctctc

SEQ ID NO: 574382 - DNA, 20 bp, mouse
ggccccagcgctcccctctc

SEQ ID NO: 574383 - DNA, 20 bp, mouse
ggagtggcgctgcaggcagg

SEQ ID NO: 574384 - DNA, 20 bp, mouse
ggacatgtgagtagtgggta

SEQ ID NO: 574385 - DNA, 20 bp, mouse
gtgtgagtagtgggtacggg

SEQ ID NO: 574386 - DNA, 20 bp, mouse
gggcgtgctgggtcccggaa

SEQ ID NO: 574387 - DNA, 20 bp, mouse
gagggaggcgtgctgggtcc

SEQ ID NO: 574388 - DNA, 20 bp, mouse
ggctggatgcagggctagga

SEQ ID NO: 574389 - DNA, 20 bp, mouse
ggctaggagggaggcgtgct

SEQ ID NO: 574390 - DNA, 20 bp, mouse
gccgggtctggggtgcgagt

SEQ ID NO: 574391 - DNA, 20 bp, mouse
gcagcagcgggtcctaaaca

SEQ ID NO: 574392 - DNA, 20 bp, mouse
gtagctgtgcgctgcgatct

SEQ ID NO: 574393 - DNA, 20 bp, mouse
gggatcgggagggacctccc

SEQ ID NO: 574394 - DNA, 20 bp, mouse
gtctgatgcgagtggaggga

SEQ ID NO: 574395 - DNA, 20 bp, mouse
gggagtctgccgaggttctg

SEQ ID NO: 574396 - DNA, 20 bp, mouse
ggggcttgtgggtttctcag

SEQ ID NO: 574397 - DNA, 20 bp, mouse
gggcggcaggcggcatccca

SEQ ID NO: 574398 - DNA, 20 bp, mouse
gcccacaagcccggcagccg

SEQ ID NO: 574399 - DNA, 20 bp, mouse
gtgcttcggcctatcaccct

SEQ ID NO: 574400 - DNA, 20 bp, mouse
ggccgctgcttgggctcctc

SEQ ID NO: 574401 - DNA, 20 bp, mouse
gggcgggagccggtcagagg

SEQ ID NO: 574402 - DNA, 20 bp, mouse
gggcggcatcccagggtgat

SEQ ID NO: 574403 - DNA, 20 bp, mouse
gtcagaggagcgcgagccgg

SEQ ID NO: 574404 - DNA, 20 bp, mouse
gttctcagaggagcgcgagc

SEQ ID NO: 574405 - DNA, 20 bp, mouse
gtgagcccccgaggcgacgg

SEQ ID NO: 574406 - DNA, 20 bp, mouse
gaggaaatcaaggtaaggga

SEQ ID NO: 574407 - DNA, 20 bp, mouse
gaagctaggcacagtacaga

SEQ ID NO: 574408 - DNA, 20 bp, mouse
gacggctgctggttctggac

SEQ ID NO: 574409 - DNA, 20 bp, mouse
ggtaagggagggtgtacgtg

SEQ ID NO: 574410 - DNA, 20 bp, mouse
ggccagcggtaggatgtcag

SEQ ID NO: 574411 - DNA, 20 bp, mouse
ggcctccaggaacatacttg

SEQ ID NO: 574412 - DNA, 20 bp, mouse
gcacgtggagctaggttctg

SEQ ID NO: 574413 - DNA, 20 bp, mouse
gcctaccgctggcacactgg

SEQ ID NO: 574414 - DNA, 20 bp, mouse
gcgaagctgagaagagacca

SEQ ID NO: 574415 - DNA, 20 bp, mouse
gggtaggatgtcagcggaga

SEQ ID NO: 574416 - DNA, 20 bp, mouse
ggcagagaactccggagtga

SEQ ID NO: 574417 - DNA, 20 bp, mouse
gggactgcgcgagctggtct

SEQ ID NO: 574418 - DNA, 20 bp, mouse
gcggatgcgtggccgagaga

SEQ ID NO: 574419 - DNA, 20 bp, mouse
gccggagtgacggaagagct

SEQ ID NO: 574420 - DNA, 20 bp, mouse
gcgagctggtctgggctctt

SEQ ID NO: 574421 - DNA, 20 bp, mouse
gtcctcggctcatccaaagt

SEQ ID NO: 574422 - DNA, 20 bp, mouse
ggggtacagacagcaggctc

SEQ ID NO: 574423 - DNA, 20 bp, mouse
ggctacaggatggtcatcct

SEQ ID NO: 574424 - DNA, 20 bp, mouse
gctcacctgtgaggatagag

SEQ ID NO: 574425 - DNA, 20 bp, mouse
ggacggaagagcttggcttc

SEQ ID NO: 574426 - DNA, 20 bp, mouse
gtcgggcgaggagcaagcgg

SEQ ID NO: 574427 - DNA, 20 bp, mouse
gttcccggctgccctcagtc

SEQ ID NO: 574428 - DNA, 20 bp, mouse
ggggtcggctgcccgactga

SEQ ID NO: 574429 - DNA, 20 bp, mouse
ggcagccgaccctcgcggaa

SEQ ID NO: 574430 - DNA, 20 bp, mouse
gcggtcctttccgcgagggt

SEQ ID NO: 574431 - DNA, 20 bp, mouse
ggagcgcagctagcggcgtc

SEQ ID NO: 574432 - DNA, 20 bp, mouse
gcagctagcggcgtcgggcg

SEQ ID NO: 574433 - DNA, 20 bp, mouse
gctccgcgctgaaggggaag

SEQ ID NO: 574434 - DNA, 20 bp, mouse
gaagcgaaccccggagactc

SEQ ID NO: 574435 - DNA, 20 bp, mouse
gtgagggcagccgggaagga

SEQ ID NO: 574436 - DNA, 20 bp, mouse
gcagccgggtcagctcctca

SEQ ID NO: 574437 - DNA, 20 bp, mouse
ggaggcggacgcggaccctg

SEQ ID NO: 574438 - DNA, 20 bp, mouse
ggtgtcgtaggtggcgaaga

SEQ ID NO: 574439 - DNA, 20 bp, mouse
gggcgccgctggccaccgcg

SEQ ID NO: 574440 - DNA, 20 bp, mouse
gggagccccgcggtggccag

SEQ ID NO: 574441 - DNA, 20 bp, mouse
ggtgtcgagccccctgaaca

SEQ ID NO: 574442 - DNA, 20 bp, mouse
gccacgcgcgaactccggga

SEQ ID NO: 574443 - DNA, 20 bp, mouse
ggagccgttcgtgtcgtagg

SEQ ID NO: 574444 - DNA, 20 bp, mouse
ggcgctcggtcgggacagtg

SEQ ID NO: 574445 - DNA, 20 bp, mouse
ggctcagggcagcagtcggg

SEQ ID NO: 574446 - DNA, 20 bp, mouse
ggacagggcgaggcacagtg

SEQ ID NO: 574447 - DNA, 20 bp, mouse
gggagcactagcaagggaca

SEQ ID NO: 574448 - DNA, 20 bp, mouse
gtcgtgaacaagaccctggg

SEQ ID NO: 574449 - DNA, 20 bp, mouse
gctgggaggagcactagcaa

SEQ ID NO: 574450 - DNA, 20 bp, mouse
gtgaggcgtgagcacccgca

SEQ ID NO: 574451 - DNA, 20 bp, mouse
gagcctcgtgaacaagaccc

SEQ ID NO: 574452 - DNA, 20 bp, mouse
ggcgggttaggagcactcca

SEQ ID NO: 574453 - DNA, 20 bp, mouse
gactgccacaaccctacctg

SEQ ID NO: 574454 - DNA, 20 bp, mouse
ggaagcccgactaccctccg

SEQ ID NO: 574455 - DNA, 20 bp, mouse
gttgggcgaggcccaagtgg

SEQ ID NO: 574456 - DNA, 20 bp, mouse
ggcgagctcaggaccgggaa

SEQ ID NO: 574457 - DNA, 20 bp, mouse
gaaaaggcgagctcaggacc

SEQ ID NO: 574458 - DNA, 20 bp, mouse
gggtcgaacgccagaagaaa

SEQ ID NO: 574459 - DNA, 20 bp, mouse
gacaaggaccccgactggat

SEQ ID NO: 574460 - DNA, 20 bp, mouse
gcgtaccgaggcgccccaaa

SEQ ID NO: 574461 - DNA, 20 bp, mouse
gaggaccccgactggatcgg

SEQ ID NO: 574462 - DNA, 20 bp, mouse
gcctcctggctgccgtaccg

SEQ ID NO: 574463 - DNA, 20 bp, mouse
gcggcgtggcgggagatcct

SEQ ID NO: 574464 - DNA, 20 bp, mouse
gcgccggcgctgctccggaa

SEQ ID NO: 574465 - DNA, 20 bp, mouse
gaaacccgccgatccagtcg

SEQ ID NO: 574466 - DNA, 20 bp, mouse
ggcaggcagcgcccggtcca

SEQ ID NO: 574467 - DNA, 20 bp, mouse
gcagccgctgcaccgtggac

SEQ ID NO: 574468 - DNA, 20 bp, mouse
gcacgcgcggggctgacccg

SEQ ID NO: 574469 - DNA, 20 bp, mouse
gatcgcggcgggctgcgagc

SEQ ID NO: 574470 - DNA, 20 bp, mouse
gtggggcgcggcagcgacgt

SEQ ID NO: 574471 - DNA, 20 bp, mouse
gcgggctgcgtgcgggatcg

SEQ ID NO: 574472 - DNA, 20 bp, mouse
ggctgcgtgcgggatcgcgg

SEQ ID NO: 574473 - DNA, 20 bp, mouse
gacctccctataccagctag

SEQ ID NO: 574474 - DNA, 20 bp, mouse
gtgaccctacagatcctcat

SEQ ID NO: 574475 - DNA, 20 bp, mouse
ggggaaactgagactcatgt

SEQ ID NO: 574476 - DNA, 20 bp, mouse
gcagagcgcgcaccgacgag

SEQ ID NO: 574477 - DNA, 20 bp, mouse
ggcatccgaatgcccctcgt

SEQ ID NO: 574478 - DNA, 20 bp, mouse
gcgagcaggtagagccccga

SEQ ID NO: 574479 - DNA, 20 bp, mouse
gccctcaaaggccttagcag

SEQ ID NO: 574480 - DNA, 20 bp, mouse
ggactgctggcacagaagga

SEQ ID NO: 574481 - DNA, 20 bp, mouse
ggcggctctgcggagagaag

SEQ ID NO: 574482 - DNA, 20 bp, mouse
gaagcgagggacctcctcca

SEQ ID NO: 574483 - DNA, 20 bp, mouse
gaagtgcgtagcagtctctc

SEQ ID NO: 574484 - DNA, 20 bp, mouse
gcgcaccgacgaggggcatt

SEQ ID NO: 574485 - DNA, 20 bp, mouse
ggagtgcggacaacccaaaa

SEQ ID NO: 574486 - DNA, 20 bp, mouse
ggagcgtgcgctacaacgag

SEQ ID NO: 574487 - DNA, 20 bp, mouse
gtgcatggcgagggcgcgga

SEQ ID NO: 574488 - DNA, 20 bp, mouse
ggccagcatggccaggtaca

SEQ ID NO: 574489 - DNA, 20 bp, mouse
gtagcgcacgctcttctgca

SEQ ID NO: 574490 - DNA, 20 bp, mouse
ggagccgctggcacgagaag

SEQ ID NO: 574491 - DNA, 20 bp, mouse
gcgggcatgtaccttctaga

SEQ ID NO: 574492 - DNA, 20 bp, mouse
gcttctgcatggcgagggcg

SEQ ID NO: 574493 - DNA, 20 bp, mouse
ggcaaggagggcaccaaacg

SEQ ID NO: 574494 - DNA, 20 bp, mouse
gacgctcttctgcatggcga

SEQ ID NO: 574495 - DNA, 20 bp, mouse
gacttcgaaggcgagcagag

SEQ ID NO: 574496 - DNA, 20 bp, mouse
ggctcgccgggctccaagag

SEQ ID NO: 574497 - DNA, 20 bp, mouse
ggcccggagccgaccactct

SEQ ID NO: 574498 - DNA, 20 bp, mouse
ggccgggctccaagagtggt

SEQ ID NO: 574499 - DNA, 20 bp, mouse
gcccactggagaggaccaca

SEQ ID NO: 574500 - DNA, 20 bp, mouse
ggggctgcgagggccagcgg

SEQ ID NO: 574501 - DNA, 20 bp, mouse
gccgcgaccatgggaaccct

SEQ ID NO: 574502 - DNA, 20 bp, mouse
gtccgggctgcgagggccag

SEQ ID NO: 574503 - DNA, 20 bp, mouse
gcaaggcgagagaggctccg

SEQ ID NO: 574504 - DNA, 20 bp, mouse
ggagcgctgcacctctactg

SEQ ID NO: 574505 - DNA, 20 bp, mouse
gccgacccaggctcacccgc

SEQ ID NO: 574506 - DNA, 20 bp, mouse
gcgcggcgcggagaccgggt

SEQ ID NO: 574507 - DNA, 20 bp, mouse
gccgcccgccggcctcgctg

SEQ ID NO: 574508 - DNA, 20 bp, mouse
ggggcgggagcgcacggagg

SEQ ID NO: 574509 - DNA, 20 bp, mouse
ggccgcagccgcagcgaggc

SEQ ID NO: 574510 - DNA, 20 bp, mouse
ggcccctagggatctcctag

SEQ ID NO: 574511 - DNA, 20 bp, mouse
gaggtggcgctggccgggca

SEQ ID NO: 574512 - DNA, 20 bp, mouse
gggaatctgcggtcctgggt

SEQ ID NO: 574513 - DNA, 20 bp, mouse
ggcgctggccgggcagggtt

SEQ ID NO: 574514 - DNA, 20 bp, mouse
ggcccctaggagatccctag

SEQ ID NO: 574515 - DNA, 20 bp, mouse
gtagagccacccgcaggagg

SEQ ID NO: 574516 - DNA, 20 bp, mouse
gggtccgaattgagcaccgt

SEQ ID NO: 574517 - DNA, 20 bp, mouse
gccgaattgagcaccgtggg

SEQ ID NO: 574518 - DNA, 20 bp, mouse
gggctctgagagtgtagctt

SEQ ID NO: 574519 - DNA, 20 bp, mouse
gtcccacttctcccaggaca

SEQ ID NO: 574520 - DNA, 20 bp, mouse
gaggtccagagtgctcgtca

SEQ ID NO: 574521 - DNA, 20 bp, mouse
gcaattcggacccctgtcct

SEQ ID NO: 574522 - DNA, 20 bp, mouse
ggcactctggacctggacaa

SEQ ID NO: 574523 - DNA, 20 bp, mouse
gcatggctgccggtgccagt

SEQ ID NO: 574524 - DNA, 20 bp, mouse
gtctaggccagaacctaccc

SEQ ID NO: 574525 - DNA, 20 bp, mouse
gggaccctgaaccagactct

SEQ ID NO: 574526 - DNA, 20 bp, mouse
gtggtttgttgggcacgaat

SEQ ID NO: 574527 - DNA, 20 bp, mouse
gcctagccccttcaaggtag

SEQ ID NO: 574528 - DNA, 20 bp, mouse
gtccgcagtcatgtagtcag

SEQ ID NO: 574529 - DNA, 20 bp, mouse
gcagccgtcagagtcagcaa

SEQ ID NO: 574530 - DNA, 20 bp, mouse
gtggaagttcacaagaggtg

SEQ ID NO: 574531 - DNA, 20 bp, mouse
ggtgcctgaacccctcaaga

SEQ ID NO: 574532 - DNA, 20 bp, mouse
ggtcagtggaagttcacaag

SEQ ID NO: 574533 - DNA, 20 bp, mouse
gcttcaaggtagtggtttgt

SEQ ID NO: 574534 - DNA, 20 bp, mouse
ggtccaattcataagtgaag

SEQ ID NO: 574535 - DNA, 20 bp, mouse
gtccactgactacatgactg

SEQ ID NO: 574536 - DNA, 20 bp, mouse
gagccagacaggccaagcgc

SEQ ID NO: 574537 - DNA, 20 bp, mouse
gcatctctggttacttactg

SEQ ID NO: 574538 - DNA, 20 bp, mouse
gccacacttggcagccagac

SEQ ID NO: 574539 - DNA, 20 bp, mouse
gtactggcatgcgccacact

SEQ ID NO: 574540 - DNA, 20 bp, mouse
gcaccagcgcttggcctgtc

SEQ ID NO: 574541 - DNA, 20 bp, mouse
gtcgcagagtagtgaatcag

SEQ ID NO: 574542 - DNA, 20 bp, mouse
gtcttcctcacaccagcgct

SEQ ID NO: 574543 - DNA, 20 bp, mouse
ggagtagtgaatcagtggat

SEQ ID NO: 574544 - DNA, 20 bp, mouse
gatcagtggataggagctga

SEQ ID NO: 574545 - DNA, 20 bp, mouse
gtactctgcgacttaaatcc

SEQ ID NO: 574546 - DNA, 20 bp, mouse
ggagcctgacaatctggtta

SEQ ID NO: 574547 - DNA, 20 bp, mouse
gtccccggagcctgacaatc

SEQ ID NO: 574548 - DNA, 20 bp, mouse
gaagaccccggggaagacag

SEQ ID NO: 574549 - DNA, 20 bp, mouse
gtcctgacaggagtgtgatc

SEQ ID NO: 574550 - DNA, 20 bp, mouse
gaccagattgtcaggctccg

SEQ ID NO: 574551 - DNA, 20 bp, mouse
gggtggacgctccagctccc

SEQ ID NO: 574552 - DNA, 20 bp, mouse
gcttccctaaccagattgtc

SEQ ID NO: 574553 - DNA, 20 bp, mouse
ggcgtccaccgagtttagga

SEQ ID NO: 574554 - DNA, 20 bp, mouse
gctttccttcctaaactcgg

SEQ ID NO: 574555 - DNA, 20 bp, mouse
gtggagcgtccaccgagttt

SEQ ID NO: 574556 - DNA, 20 bp, mouse
gagggactgggacttaacgg

SEQ ID NO: 574557 - DNA, 20 bp, mouse
gcgggtcccgtagcacccgg

SEQ ID NO: 574558 - DNA, 20 bp, mouse
gagctcctaggtcccaggat

SEQ ID NO: 574559 - DNA, 20 bp, mouse
gcatggccctaagggaagag

SEQ ID NO: 574560 - DNA, 20 bp, mouse
gtgctacgggacccgaagca

SEQ ID NO: 574561 - DNA, 20 bp, mouse
gccagggcctccgggtgcta

SEQ ID NO: 574562 - DNA, 20 bp, mouse
gtcctaggtcccaggatggg

SEQ ID NO: 574563 - DNA, 20 bp, mouse
gctaaggccacagtcgggtg

SEQ ID NO: 574564 - DNA, 20 bp, mouse
ggaatcccagggagtaagag

SEQ ID NO: 574565 - DNA, 20 bp, mouse
gcttcgggtcccgtagcacc

SEQ ID NO: 574566 - DNA, 20 bp, mouse
gccggcgccggagcgagaag

SEQ ID NO: 574567 - DNA, 20 bp, mouse
gcgccggagcgagaagggga

SEQ ID NO: 574568 - DNA, 20 bp, mouse
gaggggacggagctgaaggt

SEQ ID NO: 574569 - DNA, 20 bp, mouse
gtcgcccgcgcggccgactg

SEQ ID NO: 574570 - DNA, 20 bp, mouse
gaggaagagtgcacccggtg

SEQ ID NO: 574571 - DNA, 20 bp, mouse
gagcgagcggggcctcccgg

SEQ ID NO: 574572 - DNA, 20 bp, mouse
ggccaggcctgaggatcgag

SEQ ID NO: 574573 - DNA, 20 bp, mouse
gcagcaccgcgggtcggtag

SEQ ID NO: 574574 - DNA, 20 bp, mouse
ggccctggatcagtacacat

SEQ ID NO: 574575 - DNA, 20 bp, mouse
gggcaagcaaggcgcagaac

SEQ ID NO: 574576 - DNA, 20 bp, mouse
gccctccgccggcgcgagtg

SEQ ID NO: 574577 - DNA, 20 bp, mouse
gcgatcggtggcaggtgtgg

SEQ ID NO: 574578 - DNA, 20 bp, mouse
gccctgaaggacggagtaga

SEQ ID NO: 574579 - DNA, 20 bp, mouse
gcgcccggggggaggatgag

SEQ ID NO: 574580 - DNA, 20 bp, mouse
gtcccaggggagagtcgcgg

SEQ ID NO: 574581 - DNA, 20 bp, mouse
gatctggatgccagcaacca

SEQ ID NO: 574582 - DNA, 20 bp, mouse
gtgaaggacggagtagaggg

SEQ ID NO: 574583 - DNA, 20 bp, mouse
gctcccagtgacccgatcgg

SEQ ID NO: 574584 - DNA, 20 bp, mouse
gacggccccgggtaagcggg

SEQ ID NO: 574585 - DNA, 20 bp, mouse
gtgagcgaccctcggtgctg

SEQ ID NO: 574586 - DNA, 20 bp, mouse
ggtgtccgcgcgtatccagg

SEQ ID NO: 574587 - DNA, 20 bp, mouse
gagagccgcctggatacgcg

SEQ ID NO: 574588 - DNA, 20 bp, mouse
ggcggccgctcaccatgtct

SEQ ID NO: 574589 - DNA, 20 bp, mouse
gcaaagccgcccagggacag

SEQ ID NO: 574590 - DNA, 20 bp, mouse
gtgctgggagcgggttgtgt

SEQ ID NO: 574591 - DNA, 20 bp, mouse
gtctcgtgcaacgcggtctc

SEQ ID NO: 574592 - DNA, 20 bp, mouse
gaggcggctctcgtgcaacg

SEQ ID NO: 574593 - DNA, 20 bp, mouse
gagagcggtaagtgggacaa

SEQ ID NO: 574594 - DNA, 20 bp, mouse
gacacaacagcgccgggatg

SEQ ID NO: 574595 - DNA, 20 bp, mouse
gggcaggaggtagtcagagg

SEQ ID NO: 574596 - DNA, 20 bp, mouse
ggagagcgcgacgagaagag

SEQ ID NO: 574597 - DNA, 20 bp, mouse
gggagaggagggtaccccgt

SEQ ID NO: 574598 - DNA, 20 bp, mouse
gagggcgcgcgggcagaaac

SEQ ID NO: 574599 - DNA, 20 bp, mouse
ggacgagaagagaggctcgg

SEQ ID NO: 574600 - DNA, 20 bp, mouse
gtcgcgctgcaaggagagga

SEQ ID NO: 574601 - DNA, 20 bp, mouse
gaggagggtaccccgtcgga

SEQ ID NO: 574602 - DNA, 20 bp, mouse
gcggctcgcgctgcaaggag

SEQ ID NO: 574603 - DNA, 20 bp, mouse
ggcagcccccaggcagcagt

SEQ ID NO: 574604 - DNA, 20 bp, mouse
gacgccgctggcccctacca

SEQ ID NO: 574605 - DNA, 20 bp, mouse
ggctgccgactgctgcctgg

SEQ ID NO: 574606 - DNA, 20 bp, mouse
gtagccaggttaacttccag

SEQ ID NO: 574607 - DNA, 20 bp, mouse
gtcacaggcaccgagaacag

SEQ ID NO: 574608 - DNA, 20 bp, mouse
gtgttcggcaagccccgagc

SEQ ID NO: 574609 - DNA, 20 bp, mouse
gcttggagagcggaggatga

SEQ ID NO: 574610 - DNA, 20 bp, mouse
ggcaagccccgagctggcag

SEQ ID NO: 574611 - DNA, 20 bp, mouse
gtgcggcccgctgccagctc

SEQ ID NO: 574612 - DNA, 20 bp, mouse
ggcccatcgggccgggagac

SEQ ID NO: 574613 - DNA, 20 bp, mouse
gtgcagcttcgccatgtcgt

SEQ ID NO: 574614 - DNA, 20 bp, mouse
gttgccgaacaccgacgaca

SEQ ID NO: 574615 - DNA, 20 bp, mouse
gaagctgcagatggccacgc

SEQ ID NO: 574616 - DNA, 20 bp, mouse
ggcgatcctgccggagagag

SEQ ID NO: 574617 - DNA, 20 bp, mouse
ggtgcagcagccgctctctc

SEQ ID NO: 574618 - DNA, 20 bp, mouse
ggccatcgcggcgatcctgc

SEQ ID NO: 574619 - DNA, 20 bp, mouse
gctgcacgtgcgccctctaa

SEQ ID NO: 574620 - DNA, 20 bp, mouse
gtccggcaggatcgccgcga

SEQ ID NO: 574621 - DNA, 20 bp, mouse
ggtgcgccctctaaaggcag

SEQ ID NO: 574622 - DNA, 20 bp, mouse
gcccggccgctgcctttaga

SEQ ID NO: 574623 - DNA, 20 bp, mouse
gagcagccgctctctccggc

SEQ ID NO: 574624 - DNA, 20 bp, mouse
ggtgtgggacacagccggtc

SEQ ID NO: 574625 - DNA, 20 bp, mouse
gtctttcggtggaagagaat

SEQ ID NO: 574626 - DNA, 20 bp, mouse
gcacgcagtggactagggat

SEQ ID NO: 574627 - DNA, 20 bp, mouse
gcagtggactagggatcggg

SEQ ID NO: 574628 - DNA, 20 bp, mouse
gctctccacgcagtggacta

SEQ ID NO: 574629 - DNA, 20 bp, mouse
gcgcccgaggcggtggttag

SEQ ID NO: 574630 - DNA, 20 bp, mouse
gatcgggcgggtaaggcgat

SEQ ID NO: 574631 - DNA, 20 bp, mouse
gactagggatcgggcgggta

SEQ ID NO: 574632 - DNA, 20 bp, mouse
gcgcacgcacgcgcccgagg

SEQ ID NO: 574633 - DNA, 20 bp, mouse
gacgcacgcgcccgaggcgg

SEQ ID NO: 574634 - DNA, 20 bp, mouse
ggccgcgtcgggaccaggtg

SEQ ID NO: 574635 - DNA, 20 bp, mouse
gctgctccaggtcatttcga

SEQ ID NO: 574636 - DNA, 20 bp, mouse
gggtcaggccggtgctgtag

SEQ ID NO: 574637 - DNA, 20 bp, mouse
gcctgaccgggccatgtcgg

SEQ ID NO: 574638 - DNA, 20 bp, mouse
gcggcctgaccgggccatgt

SEQ ID NO: 574639 - DNA, 20 bp, mouse
ggcagctagtgagtaccgag

SEQ ID NO: 574640 - DNA, 20 bp, mouse
gtgctagtccgctacagcac

SEQ ID NO: 574641 - DNA, 20 bp, mouse
gccagatgaagtctccacag

SEQ ID NO: 574642 - DNA, 20 bp, mouse
gagttctggctccgccgaca

SEQ ID NO: 574643 - DNA, 20 bp, mouse
gacacgtggtgcgacctctg

SEQ ID NO: 574644 - DNA, 20 bp, mouse
ggaagtcgcggcccgccctg

SEQ ID NO: 574645 - DNA, 20 bp, mouse
gtggctccgccgacatggcc

SEQ ID NO: 574646 - DNA, 20 bp, mouse
gcgcaggggttggaaagtgg

SEQ ID NO: 574647 - DNA, 20 bp, mouse
gagcgggtcccgcggatcac

SEQ ID NO: 574648 - DNA, 20 bp, mouse
ggtgcttggccagtgatccg

SEQ ID NO: 574649 - DNA, 20 bp, mouse
gccaggccggcccaagcgag

SEQ ID NO: 574650 - DNA, 20 bp, mouse
gcccaagcgagcgggtcccg

SEQ ID NO: 574651 - DNA, 20 bp, mouse
ggatcactggccaagcacgc

SEQ ID NO: 574652 - DNA, 20 bp, mouse
gaggtcgacactaagtgcag

SEQ ID NO: 574653 - DNA, 20 bp, mouse
ggcatccgctctcgccgcag

SEQ ID NO: 574654 - DNA, 20 bp, mouse
gcgccgcaggggttggaaag

SEQ ID NO: 574655 - DNA, 20 bp, mouse
gctacccggggaaaaggagt

SEQ ID NO: 574656 - DNA, 20 bp, mouse
ggcgggaggggaccagacgg

SEQ ID NO: 574657 - DNA, 20 bp, mouse
ggaccagacggcggcttgag

SEQ ID NO: 574658 - DNA, 20 bp, mouse
gcagacggcggcttgagcgg

SEQ ID NO: 574659 - DNA, 20 bp, mouse
gcagcaggacggcttgccgg

SEQ ID NO: 574660 - DNA, 20 bp, mouse
gccgcgcgccgggaacctca

SEQ ID NO: 574661 - DNA, 20 bp, mouse
gctcctgaagaaggaggtcc

SEQ ID NO: 574662 - DNA, 20 bp, mouse
gccccgagcacgccactcac

SEQ ID NO: 574663 - DNA, 20 bp, mouse
gggcgctctcctgaagaagg

SEQ ID NO: 574664 - DNA, 20 bp, mouse
ggccgggaggcgcccggaga

SEQ ID NO: 574665 - DNA, 20 bp, mouse
ggagagggcggctgatcctg

SEQ ID NO: 574666 - DNA, 20 bp, mouse
gcagaggccaccagcaagag

SEQ ID NO: 574667 - DNA, 20 bp, mouse
gagggctcttgagtccgtgc

SEQ ID NO: 574668 - DNA, 20 bp, mouse
ggatccctgcagcagatgca

SEQ ID NO: 574669 - DNA, 20 bp, mouse
gcagtcatcgcgcggtccag

SEQ ID NO: 574670 - DNA, 20 bp, mouse
gggaccgcgcgatgactgaa

SEQ ID NO: 574671 - DNA, 20 bp, mouse
gtaggaagctggctgagagg

SEQ ID NO: 574672 - DNA, 20 bp, mouse
gtccagccaagggctgaggg

SEQ ID NO: 574673 - DNA, 20 bp, mouse
gggccccagggtcgaaggta

SEQ ID NO: 574674 - DNA, 20 bp, mouse
gacgcgacctctcttgctgg

SEQ ID NO: 574675 - DNA, 20 bp, mouse
gggaggagactcgcgcactg

SEQ ID NO: 574676 - DNA, 20 bp, mouse
ggaaggtccgagcacccgag

SEQ ID NO: 574677 - DNA, 20 bp, mouse
ggagacgcccagaggggacg

SEQ ID NO: 574678 - DNA, 20 bp, mouse
gcgagcctggccaacagaag

SEQ ID NO: 574679 - DNA, 20 bp, mouse
gcgagctcgcgaagcctctc

SEQ ID NO: 574680 - DNA, 20 bp, mouse
ggcctggccaacagaagggg

SEQ ID NO: 574681 - DNA, 20 bp, mouse
ggaggcttcgcgagctcggt

SEQ ID NO: 574682 - DNA, 20 bp, mouse
gtgactcggcgactaggcgg

SEQ ID NO: 574683 - DNA, 20 bp, mouse
ggagtgactcggcgactagg

SEQ ID NO: 574684 - DNA, 20 bp, mouse
gtaggagtgactcggcgact

SEQ ID NO: 574685 - DNA, 20 bp, mouse
ggcccaccgagaggccggaa

SEQ ID NO: 574686 - DNA, 20 bp, mouse
gccgaggcaggcagtcaggg

SEQ ID NO: 574687 - DNA, 20 bp, mouse
gcgagccgaggcaggcagtc

SEQ ID NO: 574688 - DNA, 20 bp, mouse
gactcacctgctccgagccg

SEQ ID NO: 574689 - DNA, 20 bp, mouse
ggagctgcctgcgggtgaca

SEQ ID NO: 574690 - DNA, 20 bp, mouse
gacctgctccgagccgaggc

SEQ ID NO: 574691 - DNA, 20 bp, mouse
gttaaggccaactcacacta

SEQ ID NO: 574692 - DNA, 20 bp, mouse
gcacacaggcacaccaggta

SEQ ID NO: 574693 - DNA, 20 bp, mouse
gcaaaagcaggtgaacttgg

SEQ ID NO: 574694 - DNA, 20 bp, mouse
gtgctccccgcacccctacc

SEQ ID NO: 574695 - DNA, 20 bp, mouse
gcctgtgtgtggactgagcg

SEQ ID NO: 574696 - DNA, 20 bp, mouse
gctcaggagtctcgagaacc

SEQ ID NO: 574697 - DNA, 20 bp, mouse
gcgaaggccagcaagtaccc

SEQ ID NO: 574698 - DNA, 20 bp, mouse
ggcgctgggacagcaggttg

SEQ ID NO: 574699 - DNA, 20 bp, mouse
gcgaagcgcccaagtcccga

SEQ ID NO: 574700 - DNA, 20 bp, mouse
gggaaacgcccccccaggga

SEQ ID NO: 574701 - DNA, 20 bp, mouse
gagcactgggcgcggcatca

SEQ ID NO: 574702 - DNA, 20 bp, mouse
gccgcctcacggcagatccc

SEQ ID NO: 574703 - DNA, 20 bp, mouse
ggcttctcctcggtcgaaga

SEQ ID NO: 574704 - DNA, 20 bp, mouse
gctcccactggacactcctg

SEQ ID NO: 574705 - DNA, 20 bp, mouse
ggccatggagctgaaggtct

SEQ ID NO: 574706 - DNA, 20 bp, mouse
gccctctgacatgtagccaa

SEQ ID NO: 574707 - DNA, 20 bp, mouse
gtgacatgtagccaaaggta

SEQ ID NO: 574708 - DNA, 20 bp, mouse
gggaaacaactaatttgtgt

SEQ ID NO: 574709 - DNA, 20 bp, mouse
gtgcatatggagaagtatac

SEQ ID NO: 574710 - DNA, 20 bp, mouse
gtgatactcaaattattcat

SEQ ID NO: 574711 - DNA, 20 bp, mouse
gggcttatgaaccctacctt

SEQ ID NO: 574712 - DNA, 20 bp, mouse
gtactacaggttacattatg

SEQ ID NO: 574713 - DNA, 20 bp, mouse
gctgttcacggagacaaaaa

SEQ ID NO: 574714 - DNA, 20 bp, mouse
gctcagagaatcacccacag

SEQ ID NO: 574715 - DNA, 20 bp, mouse
gaaagtgaggtaacccactg

SEQ ID NO: 574716 - DNA, 20 bp, mouse
ggtaatctgggccctgggag

SEQ ID NO: 574717 - DNA, 20 bp, mouse
gcttcttccaggctgaagct

SEQ ID NO: 574718 - DNA, 20 bp, mouse
gttgaactgcgggattgttg

SEQ ID NO: 574719 - DNA, 20 bp, mouse
gaagggagccatggtctgtc

SEQ ID NO: 574720 - DNA, 20 bp, mouse
gaatcccgcagttcaaagtt

SEQ ID NO: 574721 - DNA, 20 bp, mouse
gctggaagaaggtgtgtgtt

SEQ ID NO: 574722 - DNA, 20 bp, mouse
gtgccttgccggacagacca

SEQ ID NO: 574723 - DNA, 20 bp, mouse
gagctcaaaagatagaggag

SEQ ID NO: 574724 - DNA, 20 bp, mouse
gctctctggtgaaaggagga

SEQ ID NO: 574725 - DNA, 20 bp, mouse
gttccaggctgaagctgggc

SEQ ID NO: 574726 - DNA, 20 bp, mouse
gagcggcggccggtgagtaa

SEQ ID NO: 574727 - DNA, 20 bp, mouse
gccagaggcggaggccgaag

SEQ ID NO: 574728 - DNA, 20 bp, mouse
ggccgggtttcccaagatgg

SEQ ID NO: 574729 - DNA, 20 bp, mouse
gcggtgagtaacggacacgt

SEQ ID NO: 574730 - DNA, 20 bp, mouse
gctgatccgaggcctcccgg

SEQ ID NO: 574731 - DNA, 20 bp, mouse
gtcgggcgcccggcgatcga

SEQ ID NO: 574732 - DNA, 20 bp, mouse
ggtgaccaaccaggtatggg

SEQ ID NO: 574733 - DNA, 20 bp, mouse
gtctgggaccagcgagctca

SEQ ID NO: 574734 - DNA, 20 bp, mouse
gagcgtggcgggaaacacca

SEQ ID NO: 574735 - DNA, 20 bp, mouse
ggtctcgggagtttccgctt

SEQ ID NO: 574736 - DNA, 20 bp, mouse
gagcgaagcgggagagaaag

SEQ ID NO: 574737 - DNA, 20 bp, mouse
gcggagaggccggagcgaag

SEQ ID NO: 574738 - DNA, 20 bp, mouse
gccccgctgcagactcggag

SEQ ID NO: 574739 - DNA, 20 bp, mouse
gcgggccggacgcggagcaa

SEQ ID NO: 574740 - DNA, 20 bp, mouse
ggctgcagactcggagaggc

SEQ ID NO: 574741 - DNA, 20 bp, mouse
ggcgctgcacccccaggagg

SEQ ID NO: 574742 - DNA, 20 bp, mouse
gcggcgccccgctgcagact

SEQ ID NO: 574743 - DNA, 20 bp, mouse
ggagcccgcgctgcgcccgg

SEQ ID NO: 574744 - DNA, 20 bp, mouse
gtcccggcgcctaggagaga

SEQ ID NO: 574745 - DNA, 20 bp, mouse
gctaggcgccgggaccatta

SEQ ID NO: 574746 - DNA, 20 bp, mouse
ggcgctgggccagcgattaa

SEQ ID NO: 574747 - DNA, 20 bp, mouse
ggggcaaccggcttgggcaa

SEQ ID NO: 574748 - DNA, 20 bp, mouse
gcaggaggtgggcaagcgct

SEQ ID NO: 574749 - DNA, 20 bp, mouse
gcaaagctccagttaccctg

SEQ ID NO: 574750 - DNA, 20 bp, mouse
ggcttgggcaacggctcagg

SEQ ID NO: 574751 - DNA, 20 bp, mouse
gcagcgggtccgttaatcgc

SEQ ID NO: 574752 - DNA, 20 bp, mouse
gctcggcgggcaaccggctt

SEQ ID NO: 574753 - DNA, 20 bp, mouse
gggctgcgcgccagccatgg

SEQ ID NO: 574754 - DNA, 20 bp, mouse
ggccatcctgggctttacca

SEQ ID NO: 574755 - DNA, 20 bp, mouse
gccggcttgggcaacggctc

SEQ ID NO: 574756 - DNA, 20 bp, mouse
gctctgcgcggggctttggg

SEQ ID NO: 574757 - DNA, 20 bp, mouse
gaacgtcccccgaggaaaac

SEQ ID NO: 574758 - DNA, 20 bp, mouse
gataatgggaacgtcccccg

SEQ ID NO: 574759 - DNA, 20 bp, mouse
gacgggagtcgggtgaggac

SEQ ID NO: 574760 - DNA, 20 bp, mouse
gcgccgcgggccggagagaa

SEQ ID NO: 574761 - DNA, 20 bp, mouse
gcggggtcgtcctcccgagg

SEQ ID NO: 574762 - DNA, 20 bp, mouse
gggccggcgcgagcagccga

SEQ ID NO: 574763 - DNA, 20 bp, mouse
gttgtaacgggagtcgggtg

SEQ ID NO: 574764 - DNA, 20 bp, mouse
gacgaccccgcgcaggacag

SEQ ID NO: 574765 - DNA, 20 bp, mouse
ggagcgcccgggccaaccgc

SEQ ID NO: 574766 - DNA, 20 bp, mouse
gacaataacaaaccccacgg

SEQ ID NO: 574767 - DNA, 20 bp, mouse
ggacccgagtccgccggccg

SEQ ID NO: 574768 - DNA, 20 bp, mouse
ggccgccgccgaggccaggg

SEQ ID NO: 574769 - DNA, 20 bp, mouse
gtcgacaataacaaacccca

SEQ ID NO: 574770 - DNA, 20 bp, mouse
ggcggcggcagaagatggtg

SEQ ID NO: 574771 - DNA, 20 bp, mouse
gggcgtgctctgcggcggaa

SEQ ID NO: 574772 - DNA, 20 bp, mouse
ggcttggcagggctgggtcg

SEQ ID NO: 574773 - DNA, 20 bp, mouse
ggaggcactgagagcttggc

SEQ ID NO: 574774 - DNA, 20 bp, mouse
gagcaggggcggcacttacc

SEQ ID NO: 574775 - DNA, 20 bp, mouse
gggcctcgccgggtactcgg

SEQ ID NO: 574776 - DNA, 20 bp, mouse
ggcaaaggctgcgggaggga

SEQ ID NO: 574777 - DNA, 20 bp, mouse
gcaggcactgaagaactcaa

SEQ ID NO: 574778 - DNA, 20 bp, mouse
gggaagtcaccacggcgcag

SEQ ID NO: 574779 - DNA, 20 bp, mouse
gcgagggcgcagagcgatcg

SEQ ID NO: 574780 - DNA, 20 bp, mouse
gcggaggctgacaggggcag

SEQ ID NO: 574781 - DNA, 20 bp, mouse
ggtgcccgggtgaactgact

SEQ ID NO: 574782 - DNA, 20 bp, mouse
gctcgacacaccagacctgc

SEQ ID NO: 574783 - DNA, 20 bp, mouse
gcctgctcggtgaggcccga

SEQ ID NO: 574784 - DNA, 20 bp, mouse
gcgaacgcaaaggctgcggg

SEQ ID NO: 574785 - DNA, 20 bp, mouse
gagtggcccagcgcaagcgc

SEQ ID NO: 574786 - DNA, 20 bp, mouse
ggggccgcaggaaacaatag

SEQ ID NO: 574787 - DNA, 20 bp, mouse
ggagccggccccctacgcac

SEQ ID NO: 574788 - DNA, 20 bp, mouse
gcggagagcaggcccgactc

SEQ ID NO: 574789 - DNA, 20 bp, mouse
ggcggcaggagagccgggag

SEQ ID NO: 574790 - DNA, 20 bp, mouse
gtctcggcaggcagagggac

SEQ ID NO: 574791 - DNA, 20 bp, mouse
ggacgaggctcgccagagtc

SEQ ID NO: 574792 - DNA, 20 bp, mouse
gagagcggcgccccgagtct

SEQ ID NO: 574793 - DNA, 20 bp, mouse
ggaggccggctcggaaggga

SEQ ID NO: 574794 - DNA, 20 bp, mouse
gtgaggactgagctccccgg

SEQ ID NO: 574795 - DNA, 20 bp, mouse
gccgccatggctgacaagga

SEQ ID NO: 574796 - DNA, 20 bp, mouse
gggccgcctggtctccgcac

SEQ ID NO: 574797 - DNA, 20 bp, mouse
gaagagcctggcgcaagctc

SEQ ID NO: 574798 - DNA, 20 bp, mouse
gtcagaggaagagtgaccta

SEQ ID NO: 574799 - DNA, 20 bp, mouse
gaccgcaggctgcaacctta

SEQ ID NO: 574800 - DNA, 20 bp, mouse
gaggaagagtgacctagggt

SEQ ID NO: 574801 - DNA, 20 bp, mouse
gcctgggcgggagggaccgc

SEQ ID NO: 574802 - DNA, 20 bp, mouse
gcaaccttagggacactctt

SEQ ID NO: 574803 - DNA, 20 bp, mouse
gagtctccggagcttgcgcc

SEQ ID NO: 574804 - DNA, 20 bp, mouse
gtgttgccggtgcggagacc

SEQ ID NO: 574805 - DNA, 20 bp, mouse
gaggcaccggatcccctgac

SEQ ID NO: 574806 - DNA, 20 bp, mouse
gaagacaacgaaggacccta

SEQ ID NO: 574807 - DNA, 20 bp, mouse
gtaaatcgcagagggagata

SEQ ID NO: 574808 - DNA, 20 bp, mouse
gaaggttcagcgaggagacg

SEQ ID NO: 574809 - DNA, 20 bp, mouse
gtggagcccatcaaaagtga

SEQ ID NO: 574810 - DNA, 20 bp, mouse
gaacactcaaaagacaacga

SEQ ID NO: 574811 - DNA, 20 bp, mouse
gcccccccaaccacaagcgg

SEQ ID NO: 574812 - DNA, 20 bp, mouse
gttgtggcaaaagattccta

SEQ ID NO: 574813 - DNA, 20 bp, mouse
gggtcgggtgctgcaatcct

SEQ ID NO: 574814 - DNA, 20 bp, mouse
ggtgatctgcagatcgctat

SEQ ID NO: 574815 - DNA, 20 bp, mouse
gacccccgcttgtggttggg

SEQ ID NO: 574816 - DNA, 20 bp, mouse
gtcgctacccgccagcgggg

SEQ ID NO: 574817 - DNA, 20 bp, mouse
gagacctcgctacccgccag

SEQ ID NO: 574818 - DNA, 20 bp, mouse
gggagatcgcggcgtctggg

SEQ ID NO: 574819 - DNA, 20 bp, mouse
gtctgcctcctccccgctgg

SEQ ID NO: 574820 - DNA, 20 bp, mouse
gtgcgtgacgtgcctgggag

SEQ ID NO: 574821 - DNA, 20 bp, mouse
gcacgcccgcccgccccaca

SEQ ID NO: 574822 - DNA, 20 bp, mouse
gcgttccaagtttggcgaga

SEQ ID NO: 574823 - DNA, 20 bp, mouse
gagaagtccgaggcggccaa

SEQ ID NO: 574824 - DNA, 20 bp, mouse
gggcgctccttgcctctccc

SEQ ID NO: 574825 - DNA, 20 bp, mouse
gtagtcaagagcagcccggc

SEQ ID NO: 574826 - DNA, 20 bp, mouse
gctcctggcggcggaaccca

SEQ ID NO: 574827 - DNA, 20 bp, mouse
ggcagcgctggggacctgag

SEQ ID NO: 574828 - DNA, 20 bp, mouse
gctggcggcggaacccacgg

SEQ ID NO: 574829 - DNA, 20 bp, mouse
gagaggtaggcagtagcgag

SEQ ID NO: 574830 - DNA, 20 bp, mouse
gaggggacgcggcgagaggt

SEQ ID NO: 574831 - DNA, 20 bp, mouse
ggcggaacccacggagggga

SEQ ID NO: 574832 - DNA, 20 bp, mouse
gccggcgtgacgtcacgaga

SEQ ID NO: 574833 - DNA, 20 bp, mouse
gcctccggcctgcctccggg

SEQ ID NO: 574834 - DNA, 20 bp, mouse
gggggacggccagaacctcc

SEQ ID NO: 574835 - DNA, 20 bp, mouse
gttctggccgtcccctccgt

SEQ ID NO: 574836 - DNA, 20 bp, mouse
ggccagccttggacctccag

SEQ ID NO: 574837 - DNA, 20 bp, mouse
gatccccacccgggagagat

SEQ ID NO: 574838 - DNA, 20 bp, mouse
gtgaggaccgaggcccctgg

SEQ ID NO: 574839 - DNA, 20 bp, mouse
gtcctcagtgatccccaccc

SEQ ID NO: 574840 - DNA, 20 bp, mouse
ggctcgctcctatctctccc

SEQ ID NO: 574841 - DNA, 20 bp, mouse
gtggggatcactgaggaccg

SEQ ID NO: 574842 - DNA, 20 bp, mouse
ggctcctatctctcccgggt

SEQ ID NO: 574843 - DNA, 20 bp, mouse
gtccataccacacacagtga

SEQ ID NO: 574844 - DNA, 20 bp, mouse
gatagcaggaggccggagac

SEQ ID NO: 574845 - DNA, 20 bp, mouse
gcttggacctccaggggcct

SEQ ID NO: 574846 - DNA, 20 bp, mouse
gacgccatgaatgtagacgt

SEQ ID NO: 574847 - DNA, 20 bp, mouse
gttcatggcgtcccccaaca

SEQ ID NO: 574848 - DNA, 20 bp, mouse
ggctggtccaagctgggcaa

SEQ ID NO: 574849 - DNA, 20 bp, mouse
gtgattgttcccgggaacgg

SEQ ID NO: 574850 - DNA, 20 bp, mouse
gtggctcggagtgaagagag

SEQ ID NO: 574851 - DNA, 20 bp, mouse
gacccagccgtaccagccgt

SEQ ID NO: 574852 - DNA, 20 bp, mouse
gctgttcgctaggtagtata

SEQ ID NO: 574853 - DNA, 20 bp, mouse
gtctgggccggatgtagtct

SEQ ID NO: 574854 - DNA, 20 bp, mouse
gagagagggaacgaaaggcg

SEQ ID NO: 574855 - DNA, 20 bp, mouse
gtctcccacgtctacattca

SEQ ID NO: 574856 - DNA, 20 bp, mouse
gcccaaaagcgagggacgga

SEQ ID NO: 574857 - DNA, 20 bp, mouse
ggctggggttccggacgcta

SEQ ID NO: 574858 - DNA, 20 bp, mouse
gacacgcacgaggccggcta

SEQ ID NO: 574859 - DNA, 20 bp, mouse
gaacctgggagagagcggga

SEQ ID NO: 574860 - DNA, 20 bp, mouse
ggtccggaaccccagcccgg

SEQ ID NO: 574861 - DNA, 20 bp, mouse
gacgacccaaaagcgaggga

SEQ ID NO: 574862 - DNA, 20 bp, mouse
gaaccacgacccaaaagcga

SEQ ID NO: 574863 - DNA, 20 bp, mouse
ggcagcgcctagctctggga

SEQ ID NO: 574864 - DNA, 20 bp, mouse
ggcgcgggcgccctagcgtc

SEQ ID NO: 574865 - DNA, 20 bp, mouse
gcgagaagaccaagaaaggt

SEQ ID NO: 574866 - DNA, 20 bp, mouse
gcggggcccgcaaacacgag

SEQ ID NO: 574867 - DNA, 20 bp, mouse
gtagtctagggcttacacgc

SEQ ID NO: 574868 - DNA, 20 bp, mouse
gaacacgagtgggcgcagga

SEQ ID NO: 574869 - DNA, 20 bp, mouse
gacacctcggtcgcctcctg

SEQ ID NO: 574870 - DNA, 20 bp, mouse
gcgccggcccacatgcttcg

SEQ ID NO: 574871 - DNA, 20 bp, mouse
gtcgccggccctgcacacct

SEQ ID NO: 574872 - DNA, 20 bp, mouse
ggaagccccggggcgtgtgt

SEQ ID NO: 574873 - DNA, 20 bp, mouse
gcccgcgccccgaagcatgt

SEQ ID NO: 574874 - DNA, 20 bp, mouse
ggtcaggtctttggtagtct

SEQ ID NO: 574875 - DNA, 20 bp, mouse
gcccggggcttcctgttgtc

SEQ ID NO: 574876 - DNA, 20 bp, mouse
gcccagacaaggaagggacg

SEQ ID NO: 574877 - DNA, 20 bp, mouse
ggacgcggcagctgcagggt

SEQ ID NO: 574878 - DNA, 20 bp, mouse
gatcagtcccgggaagtagg

SEQ ID NO: 574879 - DNA, 20 bp, mouse
gcggcagctgcagggtcggt

SEQ ID NO: 574880 - DNA, 20 bp, mouse
ggagccaagtgctcatccac

SEQ ID NO: 574881 - DNA, 20 bp, mouse
gacaggcagcggagagggaa

SEQ ID NO: 574882 - DNA, 20 bp, mouse
gtcggtcggagctaccaaaa

SEQ ID NO: 574883 - DNA, 20 bp, mouse
gtgatgtgttcagccttgga

SEQ ID NO: 574884 - DNA, 20 bp, mouse
gtcggagctaccaaaatgga

SEQ ID NO: 574885 - DNA, 20 bp, mouse
gcatccacaggcagcggaga

SEQ ID NO: 574886 - DNA, 20 bp, mouse
gacagaggtgtgccccgcta

SEQ ID NO: 574887 - DNA, 20 bp, mouse
gcatctgcctgagatatggg

SEQ ID NO: 574888 - DNA, 20 bp, mouse
ggaggtgtgccccgctacgg

SEQ ID NO: 574889 - DNA, 20 bp, mouse
gttggttctgagaagaggga

SEQ ID NO: 574890 - DNA, 20 bp, mouse
gcgtgcgcacagtaaagcac

SEQ ID NO: 574891 - DNA, 20 bp, mouse
gactccagaagcaggcctgc

SEQ ID NO: 574892 - DNA, 20 bp, mouse
ggggggagagactgccagag

SEQ ID NO: 574893 - DNA, 20 bp, mouse
gcagctagctggcgaagggc

SEQ ID NO: 574894 - DNA, 20 bp, mouse
ggctatgcagccgagggagg

SEQ ID NO: 574895 - DNA, 20 bp, mouse
gcagttggaagccgccgtag

SEQ ID NO: 574896 - DNA, 20 bp, mouse
gtccgccggttccggagcaa

SEQ ID NO: 574897 - DNA, 20 bp, mouse
ggagaccacgcgagctgctg

SEQ ID NO: 574898 - DNA, 20 bp, mouse
ggagagagagagagtcggcg

SEQ ID NO: 574899 - DNA, 20 bp, mouse
ggccgttgctccggaaccgg

SEQ ID NO: 574900 - DNA, 20 bp, mouse
gccagggtctggctactcac

SEQ ID NO: 574901 - DNA, 20 bp, mouse
gggagccgttgctccggaac

SEQ ID NO: 574902 - DNA, 20 bp, mouse
gacctcctcggacagcagtc

SEQ ID NO: 574903 - DNA, 20 bp, mouse
ggtcggcgaggcaagcggag

SEQ ID NO: 574904 - DNA, 20 bp, mouse
gaggcagcaggagcacgcgg

SEQ ID NO: 574905 - DNA, 20 bp, mouse
ggcgatggtcgtgaccgagg

SEQ ID NO: 574906 - DNA, 20 bp, mouse
ggaggcagcagcggtggtag

SEQ ID NO: 574907 - DNA, 20 bp, mouse
gggttgagcaggattagtaa

SEQ ID NO: 574908 - DNA, 20 bp, mouse
gagggcaaagggcagcgtca

SEQ ID NO: 574909 - DNA, 20 bp, mouse
gtgagcaggattagtaatgg

SEQ ID NO: 574910 - DNA, 20 bp, mouse
ggcagcgcaaggtctcggga

SEQ ID NO: 574911 - DNA, 20 bp, mouse
gattagtaatggcggcgtgt

SEQ ID NO: 574912 - DNA, 20 bp, mouse
gggcagcgtcagggttgagc

SEQ ID NO: 574913 - DNA, 20 bp, mouse
ggcccgggcctcggatcggt

SEQ ID NO: 574914 - DNA, 20 bp, mouse
gggatgcccgggcctcggat

SEQ ID NO: 574915 - DNA, 20 bp, mouse
gcgcactaacctgaccaggt

SEQ ID NO: 574916 - DNA, 20 bp, mouse
gccccctccggcccgacggg

SEQ ID NO: 574917 - DNA, 20 bp, mouse
gacagcctagaggtgagcgg

SEQ ID NO: 574918 - DNA, 20 bp, mouse
gtatccccctccggcccgac

SEQ ID NO: 574919 - DNA, 20 bp, mouse
gtgtgggtagctcgccggga

SEQ ID NO: 574920 - DNA, 20 bp, mouse
ggacgagccccacgccgagg

SEQ ID NO: 574921 - DNA, 20 bp, mouse
ggccgcccgtcgggccggag

SEQ ID NO: 574922 - DNA, 20 bp, mouse
gactcctcggagaccctcgt

SEQ ID NO: 574923 - DNA, 20 bp, mouse
gggaacccccgcagaaccgg

SEQ ID NO: 574924 - DNA, 20 bp, mouse
gggcggcgcgaccggcttcg

SEQ ID NO: 574925 - DNA, 20 bp, mouse
gccggagggggatatgttcg

SEQ ID NO: 574926 - DNA, 20 bp, mouse
gagcaggacaggctgctgac

SEQ ID NO: 574927 - DNA, 20 bp, mouse
gggcggcacagtagcaggac

SEQ ID NO: 574928 - DNA, 20 bp, mouse
ggagccatcagatccagcag

SEQ ID NO: 574929 - DNA, 20 bp, mouse
gggtgcgccatggcatctgg

SEQ ID NO: 574930 - DNA, 20 bp, mouse
ggatgccatggcgcaccccg

SEQ ID NO: 574931 - DNA, 20 bp, mouse
gctgaagagccgcggcctcg

SEQ ID NO: 574932 - DNA, 20 bp, mouse
ggagcgcatctgaagagccg

SEQ ID NO: 574933 - DNA, 20 bp, mouse
gatggcgcaccccgaggccg

SEQ ID NO: 574934 - DNA, 20 bp, mouse
gctgtgcagccgcctcaaca

SEQ ID NO: 574935 - DNA, 20 bp, mouse
gggacaggctgctgacgggc

SEQ ID NO: 574936 - DNA, 20 bp, mouse
gatggcgacgagaagagagc

SEQ ID NO: 574937 - DNA, 20 bp, mouse
gtaaagagcgggcctcttag

SEQ ID NO: 574938 - DNA, 20 bp, mouse
ggggccggtgtgcatagaag

SEQ ID NO: 574939 - DNA, 20 bp, mouse
ggtcgtgggatcggaggtaa

SEQ ID NO: 574940 - DNA, 20 bp, mouse
gttcggtagcgacacggcgt

SEQ ID NO: 574941 - DNA, 20 bp, mouse
gagctctgtgcgaactccga

SEQ ID NO: 574942 - DNA, 20 bp, mouse
gttgacagcccgggccgaga

SEQ ID NO: 574943 - DNA, 20 bp, mouse
gccgatcccacgacccgcaa

SEQ ID NO: 574944 - DNA, 20 bp, mouse
gttacgagttcggcgaggtg

SEQ ID NO: 574945 - DNA, 20 bp, mouse
ggctattggctacccctaag

SEQ ID NO: 574946 - DNA, 20 bp, mouse
gatgttcccggctcaggagg

SEQ ID NO: 574947 - DNA, 20 bp, mouse
gccgcagccagggatggagg

SEQ ID NO: 574948 - DNA, 20 bp, mouse
gcggaccgcagggatgttcc

SEQ ID NO: 574949 - DNA, 20 bp, mouse
gggagagcggagctccggtg

SEQ ID NO: 574950 - DNA, 20 bp, mouse
gtccctgcggtccgcagcca

SEQ ID NO: 574951 - DNA, 20 bp, mouse
gcagtaaagcggagcgaggg

SEQ ID NO: 574952 - DNA, 20 bp, mouse
ggcgagcctaagcgagggaa

SEQ ID NO: 574953 - DNA, 20 bp, mouse
gtccctggctgcggaccgca

SEQ ID NO: 574954 - DNA, 20 bp, mouse
gagtacgagccgctcatccc

SEQ ID NO: 574955 - DNA, 20 bp, mouse
gcacttgcgagcctaagcga

SEQ ID NO: 574956 - DNA, 20 bp, mouse
ggaagcggctgtggaggtgt

SEQ ID NO: 574957 - DNA, 20 bp, mouse
gccgacagccccagcccgaa

SEQ ID NO: 574958 - DNA, 20 bp, mouse
gccgccccgaggcaccaagg

SEQ ID NO: 574959 - DNA, 20 bp, mouse
gggctccgggaaagccgttc

SEQ ID NO: 574960 - DNA, 20 bp, mouse
ggccccgccccgaggcacca

SEQ ID NO: 574961 - DNA, 20 bp, mouse
gtgcccggtggtcctgagag

SEQ ID NO: 574962 - DNA, 20 bp, mouse
gggaacgcggagcgccggag

SEQ ID NO: 574963 - DNA, 20 bp, mouse
gccagcccgaacggctttcc

SEQ ID NO: 574964 - DNA, 20 bp, mouse
ggactcccgcagccccggaa

SEQ ID NO: 574965 - DNA, 20 bp, mouse
gttttgtgaagcggctgtgg

SEQ ID NO: 574966 - DNA, 20 bp, mouse
gtgcatcggtttgtctggac

SEQ ID NO: 574967 - DNA, 20 bp, mouse
gcggcctaccaggcccaaca

SEQ ID NO: 574968 - DNA, 20 bp, mouse
gtctggaccggaggggagtg

SEQ ID NO: 574969 - DNA, 20 bp, mouse
gcaacacggccggaagaaaa

SEQ ID NO: 574970 - DNA, 20 bp, mouse
gtggagaccacactcccctc

SEQ ID NO: 574971 - DNA, 20 bp, mouse
ggtaggccgtgcggagactg

SEQ ID NO: 574972 - DNA, 20 bp, mouse
gcggtttgtctggaccggag

SEQ ID NO: 574973 - DNA, 20 bp, mouse
gctaccaggcccaacacggc

SEQ ID NO: 574974 - DNA, 20 bp, mouse
gggctgacaggaggaagtcg

SEQ ID NO: 574975 - DNA, 20 bp, mouse
gctcactcgccgccacacgg

SEQ ID NO: 574976 - DNA, 20 bp, mouse
gcgttcagagcgccaagggg

SEQ ID NO: 574977 - DNA, 20 bp, mouse
gcgccaaggggtggctggtt

SEQ ID NO: 574978 - DNA, 20 bp, mouse
gctctgctcatgcgcaatcc

SEQ ID NO: 574979 - DNA, 20 bp, mouse
gacgcgcgttcagagcgcca

SEQ ID NO: 574980 - DNA, 20 bp, mouse
gaggggtggctggttgggcc

SEQ ID NO: 574981 - DNA, 20 bp, mouse
gtgcatcggtttgtccggac

SEQ ID NO: 574982 - DNA, 20 bp, mouse
gcggcctaccaggcccaaca

SEQ ID NO: 574983 - DNA, 20 bp, mouse
gtccggaccggaggggagtg

SEQ ID NO: 574984 - DNA, 20 bp, mouse
gcaacacggccggaagaaaa

SEQ ID NO: 574985 - DNA, 20 bp, mouse
gtggagaccacactcccctc

SEQ ID NO: 574986 - DNA, 20 bp, mouse
gcggtcgccagccattcctg

SEQ ID NO: 574987 - DNA, 20 bp, mouse
gggacctctcctacagcgac

SEQ ID NO: 574988 - DNA, 20 bp, mouse
gccgcagtcctccacaggaa

SEQ ID NO: 574989 - DNA, 20 bp, mouse
gaggtcctgtctctccgaga

SEQ ID NO: 574990 - DNA, 20 bp, mouse
gtggaggactgcgggtcgtt

SEQ ID NO: 574991 - DNA, 20 bp, mouse
gttgcctgtcgctgtaggag

SEQ ID NO: 574992 - DNA, 20 bp, mouse
gctctccgagaaggcggttg

SEQ ID NO: 574993 - DNA, 20 bp, mouse
ggcgtccacggcgctcgaag

SEQ ID NO: 574994 - DNA, 20 bp, mouse
ggccgccgcaaccgccttct

SEQ ID NO: 574995 - DNA, 20 bp, mouse
gtcctgtctctccgagaagg

SEQ ID NO: 574996 - DNA, 20 bp, mouse
ggccctcactcgatccgcct

SEQ ID NO: 574997 - DNA, 20 bp, mouse
gcagctaactaagatggtgt

SEQ ID NO: 574998 - DNA, 20 bp, mouse
ggcctaggcggatcgagtga

SEQ ID NO: 574999 - DNA, 20 bp, mouse
gtccgcctaggcagctgtcc

SEQ ID NO: 575000 - DNA, 20 bp, mouse
gggagtaggcccataaactg

SEQ ID NO: 575001 - DNA, 20 bp, mouse
gttcaggcagctaactaaga

SEQ ID NO: 575002 - DNA, 20 bp, mouse
gtggtgtcggctggactgtc

SEQ ID NO: 575003 - DNA, 20 bp, mouse
ggaacgccgaaagcgcgggg

SEQ ID NO: 575004 - DNA, 20 bp, mouse
gagtcttccaacttctccgg

SEQ ID NO: 575005 - DNA, 20 bp, mouse
gcctgtctgggcgggacaat

SEQ ID NO: 575006 - DNA, 20 bp, mouse
ggcccgcgggtccctcagag

SEQ ID NO: 575007 - DNA, 20 bp, mouse
ggcccaggaggcagcgcccc

SEQ ID NO: 575008 - DNA, 20 bp, mouse
ggggtccctcagagcggcgg

SEQ ID NO: 575009 - DNA, 20 bp, mouse
gccgcgggagcgcgaacgag

SEQ ID NO: 575010 - DNA, 20 bp, mouse
gcagcgcacaaggcctccgg

SEQ ID NO: 575011 - DNA, 20 bp, mouse
gccgaaccggcgcgatgaag

SEQ ID NO: 575012 - DNA, 20 bp, mouse
ggtccttttgtccaagatgg

SEQ ID NO: 575013 - DNA, 20 bp, mouse
gacaaaaggactcggcgcgg

SEQ ID NO: 575014 - DNA, 20 bp, mouse
gccggaggcgggggacgcac

SEQ ID NO: 575015 - DNA, 20 bp, mouse
gggtaccaagcacccggtcc

SEQ ID NO: 575016 - DNA, 20 bp, mouse
gccctttgcggactccgtgg

SEQ ID NO: 575017 - DNA, 20 bp, mouse
ggcctccacggagtccgcaa

SEQ ID NO: 575018 - DNA, 20 bp, mouse
gaccgcgcggggtaagagag

SEQ ID NO: 575019 - DNA, 20 bp, mouse
ggcgcggggtaagagagcgg

SEQ ID NO: 575020 - DNA, 20 bp, mouse
gaggcgcagacgtggactcc

SEQ ID NO: 575021 - DNA, 20 bp, mouse
gcatccctttgcggactccg

SEQ ID NO: 575022 - DNA, 20 bp, mouse
ggcgtccagcgcatccgtga

SEQ ID NO: 575023 - DNA, 20 bp, mouse
gtggaggctcggcgctgcgg

SEQ ID NO: 575024 - DNA, 20 bp, mouse
gtaggtggcccggtggaacg

SEQ ID NO: 575025 - DNA, 20 bp, mouse
gtgatccggaacgtagactc

SEQ ID NO: 575026 - DNA, 20 bp, mouse
gggtccgagcgaaggacctg

SEQ ID NO: 575027 - DNA, 20 bp, mouse
gcaggcggcgagcggtgttt

SEQ ID NO: 575028 - DNA, 20 bp, mouse
gcgcaggcgtagtgcgtcac

SEQ ID NO: 575029 - DNA, 20 bp, mouse
gtgcgtcacgggcggccagg

SEQ ID NO: 575030 - DNA, 20 bp, mouse
gttcgctcggaccccagcgt

SEQ ID NO: 575031 - DNA, 20 bp, mouse
gaggcgtagtgcgtcacggg

SEQ ID NO: 575032 - DNA, 20 bp, mouse
ggcgagcggtgtttcggcag

SEQ ID NO: 575033 - DNA, 20 bp, mouse
gtttcggcagaggtaacctc

SEQ ID NO: 575034 - DNA, 20 bp, mouse
gccagagacaggacaatccg

SEQ ID NO: 575035 - DNA, 20 bp, mouse
gacgtcacgggccagcgcgg

SEQ ID NO: 575036 - DNA, 20 bp, mouse
gatggcggcgcccagtgtgg

SEQ ID NO: 575037 - DNA, 20 bp, mouse
gcgtgactcgctaaaaatgg

SEQ ID NO: 575038 - DNA, 20 bp, mouse
ggtggcggcgtgaaagttgt

SEQ ID NO: 575039 - DNA, 20 bp, mouse
gggaggtccggaatccaagg

SEQ ID NO: 575040 - DNA, 20 bp, mouse
gactttcacgccgccacact

SEQ ID NO: 575041 - DNA, 20 bp, mouse
gccacgtgactcgctaaaaa

SEQ ID NO: 575042 - DNA, 20 bp, mouse
gtgggaagtcgctgtcgccg

SEQ ID NO: 575043 - DNA, 20 bp, mouse
gagcagaggtccgggaatgg

SEQ ID NO: 575044 - DNA, 20 bp, mouse
gacttccggatggaacgcgg

SEQ ID NO: 575045 - DNA, 20 bp, mouse
gcccagaccggagtcactta

SEQ ID NO: 575046 - DNA, 20 bp, mouse
ggccaggacgcggatcccag

SEQ ID NO: 575047 - DNA, 20 bp, mouse
gtgaacaccgggcataacgc

SEQ ID NO: 575048 - DNA, 20 bp, mouse
gaccgctgggatccgcgtcc

SEQ ID NO: 575049 - DNA, 20 bp, mouse
gagcctgggacacacaccag

SEQ ID NO: 575050 - DNA, 20 bp, mouse
gggatccgcgtcctggctca

SEQ ID NO: 575051 - DNA, 20 bp, mouse
ggtgtcgccgcgcatggtgc

SEQ ID NO: 575052 - DNA, 20 bp, mouse
gctggcagtagccatgagcc

SEQ ID NO: 575053 - DNA, 20 bp, mouse
gataacgcaggcatctctgt

SEQ ID NO: 575054 - DNA, 20 bp, mouse
gacggagggcccctgaacac

SEQ ID NO: 575055 - DNA, 20 bp, mouse
gcgtgccccagggccagcaa

SEQ ID NO: 575056 - DNA, 20 bp, mouse
gtgtcccgggactcccgata

SEQ ID NO: 575057 - DNA, 20 bp, mouse
gcggaagccggagctgtccc

SEQ ID NO: 575058 - DNA, 20 bp, mouse
ggtgcctgccgggattgtgg

SEQ ID NO: 575059 - DNA, 20 bp, mouse
gggcggtcggtctctcgagt

SEQ ID NO: 575060 - DNA, 20 bp, mouse
gacaatcccggcaggcacag

SEQ ID NO: 575061 - DNA, 20 bp, mouse
gtcgccatatcgggagtccc

SEQ ID NO: 575062 - DNA, 20 bp, mouse
gagaccgaccgccacaatcc

SEQ ID NO: 575063 - DNA, 20 bp, mouse
gagaagagcgagccctcgtg

SEQ ID NO: 575064 - DNA, 20 bp, mouse
ggccgcggcctagctcggtg

SEQ ID NO: 575065 - DNA, 20 bp, mouse
gccgatatggcgacttctct

SEQ ID NO: 575066 - DNA, 20 bp, mouse
gtggcagctactaagcagaa

SEQ ID NO: 575067 - DNA, 20 bp, mouse
gtcctccgtccgcactggtg

SEQ ID NO: 575068 - DNA, 20 bp, mouse
gagctactaagcagaaggga

SEQ ID NO: 575069 - DNA, 20 bp, mouse
ggctgccacaccagtgcgga

SEQ ID NO: 575070 - DNA, 20 bp, mouse
gggaaaaaggaatagagggt

SEQ ID NO: 575071 - DNA, 20 bp, mouse
gagcggtcctccgtccgcac

SEQ ID NO: 575072 - DNA, 20 bp, mouse
ggccacaccagtgcggacgg

SEQ ID NO: 575073 - DNA, 20 bp, mouse
gagaggctaccgtgtcccgg

SEQ ID NO: 575074 - DNA, 20 bp, mouse
gtgctgggcccggctcggtc

SEQ ID NO: 575075 - DNA, 20 bp, mouse
gctccgtagccgcggactgt

SEQ ID NO: 575076 - DNA, 20 bp, mouse
ggccgcccgactctagagac

SEQ ID NO: 575077 - DNA, 20 bp, mouse
gaccagtctctagagtcggg

SEQ ID NO: 575078 - DNA, 20 bp, mouse
gggaaccagtctctagagtc

SEQ ID NO: 575079 - DNA, 20 bp, mouse
gcctaggcgagtaggcgctt

SEQ ID NO: 575080 - DNA, 20 bp, mouse
ggcgcgcagacacctcgaac

SEQ ID NO: 575081 - DNA, 20 bp, mouse
gctgcgcggggagctcctgg

SEQ ID NO: 575082 - DNA, 20 bp, mouse
ggcctctgggcgtcaggtga

SEQ ID NO: 575083 - DNA, 20 bp, mouse
gcgcagacacctcgaaccgg

SEQ ID NO: 575084 - DNA, 20 bp, mouse
ggctgaggtagcaggtcgag

SEQ ID NO: 575085 - DNA, 20 bp, mouse
gttttgcggcctaggcgagt

SEQ ID NO: 575086 - DNA, 20 bp, mouse
gctcaatgggaacggttcgg

SEQ ID NO: 575087 - DNA, 20 bp, mouse
ggaagaaaagcgacaacgaa

SEQ ID NO: 575088 - DNA, 20 bp, mouse
gcggctcaatgggaacggtt

SEQ ID NO: 575089 - DNA, 20 bp, mouse
ggaaaagcgacaacgaaggg

SEQ ID NO: 575090 - DNA, 20 bp, mouse
gcaacgaagggcggctcaat

SEQ ID NO: 575091 - DNA, 20 bp, mouse
gaacggttcgggggtcttcc

SEQ ID NO: 575092 - DNA, 20 bp, mouse
gctgagaggagagcccgggt

SEQ ID NO: 575093 - DNA, 20 bp, mouse
ggaagctccggggacccggt

SEQ ID NO: 575094 - DNA, 20 bp, mouse
gcttcgggaagattcactgg

SEQ ID NO: 575095 - DNA, 20 bp, mouse
gtccccggagcttctcccct

SEQ ID NO: 575096 - DNA, 20 bp, mouse
gtaagatgcccggtgggtca

SEQ ID NO: 575097 - DNA, 20 bp, mouse
gggagctgtgagggaacgtg

SEQ ID NO: 575098 - DNA, 20 bp, mouse
ggctgtgagggaacgtgagg

SEQ ID NO: 575099 - DNA, 20 bp, mouse
gagtctataagatgcccggt

SEQ ID NO: 575100 - DNA, 20 bp, mouse
gcggcccggcgcactcacat

SEQ ID NO: 575101 - DNA, 20 bp, mouse
gcctgttaggccccggccca

SEQ ID NO: 575102 - DNA, 20 bp, mouse
gcagggcactcggagctgtg

SEQ ID NO: 575103 - DNA, 20 bp, mouse
gggcggcgaacgtagacccg

SEQ ID NO: 575104 - DNA, 20 bp, mouse
ggtgaagtctataagatgcc

SEQ ID NO: 575105 - DNA, 20 bp, mouse
gtagacttcacctactccct

SEQ ID NO: 575106 - DNA, 20 bp, mouse
gggctgcgagcacctcacgc

SEQ ID NO: 575107 - DNA, 20 bp, mouse
gcgagggctgggatgagctc

SEQ ID NO: 575108 - DNA, 20 bp, mouse
gaccgagagacaagcgcgtg

SEQ ID NO: 575109 - DNA, 20 bp, mouse
ggcctcacgcgcttgtctct

SEQ ID NO: 575110 - DNA, 20 bp, mouse
ggcgaatccgaggccagtta

SEQ ID NO: 575111 - DNA, 20 bp, mouse
gtgtctctcggtctcatggc

SEQ ID NO: 575112 - DNA, 20 bp, mouse
gtcccagccctcgctcgcgc

SEQ ID NO: 575113 - DNA, 20 bp, mouse
gacagagaaaggtaaggagt

SEQ ID NO: 575114 - DNA, 20 bp, mouse
gcgcttgtctctcggtctca

SEQ ID NO: 575115 - DNA, 20 bp, mouse
gtgggaacaacccaatttca

SEQ ID NO: 575116 - DNA, 20 bp, mouse
ggatgttcagagggccctca

SEQ ID NO: 575117 - DNA, 20 bp, mouse
gtagggagtaaggcatgccg

SEQ ID NO: 575118 - DNA, 20 bp, mouse
gaaggtagtgatctccttga

SEQ ID NO: 575119 - DNA, 20 bp, mouse
gtgccttgttctagggagta

SEQ ID NO: 575120 - DNA, 20 bp, mouse
gtcgatcttacaaccttcaa

SEQ ID NO: 575121 - DNA, 20 bp, mouse
gatgctggaagatgttcaga

SEQ ID NO: 575122 - DNA, 20 bp, mouse
gagtcacgtagccaaagcct

SEQ ID NO: 575123 - DNA, 20 bp, mouse
ggcctttgtgccttgttcta

SEQ ID NO: 575124 - DNA, 20 bp, mouse
gtgccttactccctagaaca

SEQ ID NO: 575125 - DNA, 20 bp, mouse
gcctctggtgtgctttgaat

SEQ ID NO: 575126 - DNA, 20 bp, mouse
gcatagagggcaaggaagtg

SEQ ID NO: 575127 - DNA, 20 bp, mouse
gctctatgggcgagggacga

SEQ ID NO: 575128 - DNA, 20 bp, mouse
gcaaggcgaaggcgcttacc

SEQ ID NO: 575129 - DNA, 20 bp, mouse
gtccccgcagaacaagatgg

SEQ ID NO: 575130 - DNA, 20 bp, mouse
ggttgtggccgctgatatgt

SEQ ID NO: 575131 - DNA, 20 bp, mouse
gcgggcgtgctgcatcggaa

SEQ ID NO: 575132 - DNA, 20 bp, mouse
ggggttagtcccaggctcga

SEQ ID NO: 575133 - DNA, 20 bp, mouse
gagggacagccggtacaggt

SEQ ID NO: 575134 - DNA, 20 bp, mouse
gaagatggcggcggtcacgt

SEQ ID NO: 575135 - DNA, 20 bp, mouse
ggaacagagagactgcggcg

SEQ ID NO: 575136 - DNA, 20 bp, mouse
gaatactgccagcctcgctg

SEQ ID NO: 575137 - DNA, 20 bp, mouse
ggccagcctcgctgtggaaa

SEQ ID NO: 575138 - DNA, 20 bp, mouse
gttgactgttggataatcac

SEQ ID NO: 575139 - DNA, 20 bp, mouse
gaaacagagcaattccggga

SEQ ID NO: 575140 - DNA, 20 bp, mouse
gaatgaaacagagcaattcc

SEQ ID NO: 575141 - DNA, 20 bp, mouse
gtgtgggtgggctgaaccca

SEQ ID NO: 575142 - DNA, 20 bp, mouse
gtccttttccacagcgaggc

SEQ ID NO: 575143 - DNA, 20 bp, mouse
gtttttcttcagacaaccgt

SEQ ID NO: 575144 - DNA, 20 bp, mouse
gtcgcaagaaatgagcaagc

SEQ ID NO: 575145 - DNA, 20 bp, mouse
gtccactgtgttcagataca

SEQ ID NO: 575146 - DNA, 20 bp, mouse
gggcgcccgcgagcgagcag

SEQ ID NO: 575147 - DNA, 20 bp, mouse
gcgcgcgtcgcggtccgcag

SEQ ID NO: 575148 - DNA, 20 bp, mouse
ggcaggcgctggaggtacgt

SEQ ID NO: 575149 - DNA, 20 bp, mouse
gcggaggcgagggtccgctg

SEQ ID NO: 575150 - DNA, 20 bp, mouse
gccgggcccggggaccacca

SEQ ID NO: 575151 - DNA, 20 bp, mouse
ggtgcacgccgggagcaagg

SEQ ID NO: 575152 - DNA, 20 bp, mouse
ggcgctcccggcctgaacgg

SEQ ID NO: 575153 - DNA, 20 bp, mouse
gaggcgaggcccgcgcgtcg

SEQ ID NO: 575154 - DNA, 20 bp, mouse
ggcgcggccggagacgctaa

SEQ ID NO: 575155 - DNA, 20 bp, mouse
gcggcctgccaggagctcgg

SEQ ID NO: 575156 - DNA, 20 bp, mouse
gaggaacgcaagagaaggaa

SEQ ID NO: 575157 - DNA, 20 bp, mouse
gagcatggctctgggagggg

SEQ ID NO: 575158 - DNA, 20 bp, mouse
gaggggaggaacgcaagaga

SEQ ID NO: 575159 - DNA, 20 bp, mouse
gcagcccggcgactcacctg

SEQ ID NO: 575160 - DNA, 20 bp, mouse
gtccgcggtgctgaagagag

SEQ ID NO: 575161 - DNA, 20 bp, mouse
gcggccagcgactacctggt

SEQ ID NO: 575162 - DNA, 20 bp, mouse
gtcctggaggcgggacgggg

SEQ ID NO: 575163 - DNA, 20 bp, mouse
ggcggcccgcggcctcctgg

SEQ ID NO: 575164 - DNA, 20 bp, mouse
gctctctaccgggatactca

SEQ ID NO: 575165 - DNA, 20 bp, mouse
gggctgcaccctgagtatcc

SEQ ID NO: 575166 - DNA, 20 bp, mouse
gttcgcggcggacggagaag

SEQ ID NO: 575167 - DNA, 20 bp, mouse
gagccggccggcgcatgcgg

SEQ ID NO: 575168 - DNA, 20 bp, mouse
gagcggcgcgggacagcgtg

SEQ ID NO: 575169 - DNA, 20 bp, mouse
gagcgtggggaactcggatt

SEQ ID NO: 575170 - DNA, 20 bp, mouse
ggcgccggccggctcggtag

SEQ ID NO: 575171 - DNA, 20 bp, mouse
gcggagtagacgcttcgcgg

SEQ ID NO: 575172 - DNA, 20 bp, mouse
ggcgcggagtagacgcttcg

SEQ ID NO: 575173 - DNA, 20 bp, mouse
ggatcgggcagcggctgata

SEQ ID NO: 575174 - DNA, 20 bp, mouse
gcaggtgaccatggcagatc

SEQ ID NO: 575175 - DNA, 20 bp, mouse
gaggcggccggcagctcgca

SEQ ID NO: 575176 - DNA, 20 bp, mouse
ggagcccgcgacggagagca

SEQ ID NO: 575177 - DNA, 20 bp, mouse
gtgtgagtacggaggagcag

SEQ ID NO: 575178 - DNA, 20 bp, mouse
gagcagcggccgccatttca

SEQ ID NO: 575179 - DNA, 20 bp, mouse
gtccacccctgcgacagcgt

SEQ ID NO: 575180 - DNA, 20 bp, mouse
gctagccgacgctgtcgcag

SEQ ID NO: 575181 - DNA, 20 bp, mouse
gggctagctccctgaaatgg

SEQ ID NO: 575182 - DNA, 20 bp, mouse
gttggtgactgtgagtacgg

SEQ ID NO: 575183 - DNA, 20 bp, mouse
ggtgttggtgactgtgagta

SEQ ID NO: 575184 - DNA, 20 bp, mouse
gggcggcagccgacttcccg

SEQ ID NO: 575185 - DNA, 20 bp, mouse
ggaagggcacggccgaggag

SEQ ID NO: 575186 - DNA, 20 bp, mouse
gcggtcgccagccattcctg

SEQ ID NO: 575187 - DNA, 20 bp, mouse
gggacctctcctacagcgac

SEQ ID NO: 575188 - DNA, 20 bp, mouse
gccgcagtcctccacaggaa

SEQ ID NO: 575189 - DNA, 20 bp, mouse
gaggtcctgtctctccgaga

SEQ ID NO: 575190 - DNA, 20 bp, mouse
gtggaggactgcgggtcgtt

SEQ ID NO: 575191 - DNA, 20 bp, mouse
gttgcctgtcgctgtaggag

SEQ ID NO: 575192 - DNA, 20 bp, mouse
gctctccgagaaggcggttg

SEQ ID NO: 575193 - DNA, 20 bp, mouse
ggcgtccacggcgctcgaag

SEQ ID NO: 575194 - DNA, 20 bp, mouse
ggccgccgcaaccgccttct

SEQ ID NO: 575195 - DNA, 20 bp, mouse
gtcctgtctctccgagaagg

SEQ ID NO: 575196 - DNA, 20 bp, mouse
gaggctggaccagtctgcgg

SEQ ID NO: 575197 - DNA, 20 bp, mouse
gaggcccctatcactaactt

SEQ ID NO: 575198 - DNA, 20 bp, mouse
gttacccaagttagtgatag

SEQ ID NO: 575199 - DNA, 20 bp, mouse
gttctccagcgggaagacaa

SEQ ID NO: 575200 - DNA, 20 bp, mouse
ggtcatatccgggttgctga

SEQ ID NO: 575201 - DNA, 20 bp, mouse
gggcaggctggaccagtctg

SEQ ID NO: 575202 - DNA, 20 bp, mouse
gcgggggtgaagttctggaa

SEQ ID NO: 575203 - DNA, 20 bp, mouse
gctcaaagcactacccggtg

SEQ ID NO: 575204 - DNA, 20 bp, mouse
gtagccaggcgggtttccac

SEQ ID NO: 575205 - DNA, 20 bp, mouse
gcactggaatgtttccctca

SEQ ID NO: 575206 - DNA, 20 bp, mouse
ggcagccgcagcgggttcta

SEQ ID NO: 575207 - DNA, 20 bp, mouse
ggaaggagcggtgaaggcta

SEQ ID NO: 575208 - DNA, 20 bp, mouse
gtcgaccgtagaacccgctg

SEQ ID NO: 575209 - DNA, 20 bp, mouse
gctcccaccctgagacgaca

SEQ ID NO: 575210 - DNA, 20 bp, mouse
gctgctggaaggagcggtga

SEQ ID NO: 575211 - DNA, 20 bp, mouse
gacccgctgcggctgctgga

SEQ ID NO: 575212 - DNA, 20 bp, mouse
ggtccctgtcgtctcagggt

SEQ ID NO: 575213 - DNA, 20 bp, mouse
gggagccggccgatgacgta

SEQ ID NO: 575214 - DNA, 20 bp, mouse
gtcggcatcccgggcaagag

SEQ ID NO: 575215 - DNA, 20 bp, mouse
gggagcgggacagataccat

SEQ ID NO: 575216 - DNA, 20 bp, mouse
gcgctgctcgaacatctccg

SEQ ID NO: 575217 - DNA, 20 bp, mouse
gagcgggagcgctaaactgg

SEQ ID NO: 575218 - DNA, 20 bp, mouse
gcttcctgcactgcaacccg

SEQ ID NO: 575219 - DNA, 20 bp, mouse
gacacgtgctccgggaccct

SEQ ID NO: 575220 - DNA, 20 bp, mouse
gcctagctctgacggagaga

SEQ ID NO: 575221 - DNA, 20 bp, mouse
gctcgaacatctccgaggcc

SEQ ID NO: 575222 - DNA, 20 bp, mouse
gctcaataggcagggactca

SEQ ID NO: 575223 - DNA, 20 bp, mouse
gagcagcgggagcgctaaac

SEQ ID NO: 575224 - DNA, 20 bp, mouse
ggtgtctgagctgaaggcac

SEQ ID NO: 575225 - DNA, 20 bp, mouse
ggcgggactgcggttaggag

SEQ ID NO: 575226 - DNA, 20 bp, mouse
gaccctgggacactactcct

SEQ ID NO: 575227 - DNA, 20 bp, mouse
gactactccttggaaagtag

SEQ ID NO: 575228 - DNA, 20 bp, mouse
gtccaaggagtagtgtccca

SEQ ID NO: 575229 - DNA, 20 bp, mouse
gtacggtgagcccggaatgg

SEQ ID NO: 575230 - DNA, 20 bp, mouse
gacttacggtgagcccggaa

SEQ ID NO: 575231 - DNA, 20 bp, mouse
gccgttacccgctaaaccct

SEQ ID NO: 575232 - DNA, 20 bp, mouse
gggaggagaggttgacagca

SEQ ID NO: 575233 - DNA, 20 bp, mouse
ggggacacagacgacactta

SEQ ID NO: 575234 - DNA, 20 bp, mouse
ggagcaaattactaccgtgg

SEQ ID NO: 575235 - DNA, 20 bp, mouse
gggtgtctcgcctccattcc

SEQ ID NO: 575236 - DNA, 20 bp, mouse
gaccggcgtggggcgagacg

SEQ ID NO: 575237 - DNA, 20 bp, mouse
gcggaagcggagctgcttac

SEQ ID NO: 575238 - DNA, 20 bp, mouse
gccgcttcccggccgcttcc

SEQ ID NO: 575239 - DNA, 20 bp, mouse
ggagctgccgggaagcggcc

SEQ ID NO: 575240 - DNA, 20 bp, mouse
gacggggagctgccgggaag

SEQ ID NO: 575241 - DNA, 20 bp, mouse
gggcgagacggggagctgcc

SEQ ID NO: 575242 - DNA, 20 bp, mouse
gggagctgcttaccggcgtg

SEQ ID NO: 575243 - DNA, 20 bp, mouse
gtccccgtctcgccccacgc

SEQ ID NO: 575244 - DNA, 20 bp, mouse
gctctcggctcttccggaag

SEQ ID NO: 575245 - DNA, 20 bp, mouse
gagcacactaaggagtccaa

SEQ ID NO: 575246 - DNA, 20 bp, mouse
gcgccgatccgaagctctgg

SEQ ID NO: 575247 - DNA, 20 bp, mouse
ggcgcggcgagcggacacaa

SEQ ID NO: 575248 - DNA, 20 bp, mouse
gcgccgccagagcttcggat

SEQ ID NO: 575249 - DNA, 20 bp, mouse
gcaccccgtcgggtcttcag

SEQ ID NO: 575250 - DNA, 20 bp, mouse
gcagcgccgatccgaagctc

SEQ ID NO: 575251 - DNA, 20 bp, mouse
gtggcctctgaagacccgac

SEQ ID NO: 575252 - DNA, 20 bp, mouse
gcaaaccgccgccagagctt

SEQ ID NO: 575253 - DNA, 20 bp, mouse
gcgcggacaccgcccgacgg

SEQ ID NO: 575254 - DNA, 20 bp, mouse
gcgccccggaccccgcacga

SEQ ID NO: 575255 - DNA, 20 bp, mouse
ggggcggaagcggtggtcag

SEQ ID NO: 575256 - DNA, 20 bp, mouse
gatcgaagcctggaaaggta

SEQ ID NO: 575257 - DNA, 20 bp, mouse
gaggttgctgaagccaagcc

SEQ ID NO: 575258 - DNA, 20 bp, mouse
gcattctccacacctcaatg

SEQ ID NO: 575259 - DNA, 20 bp, mouse
gggcttcgatctggatgtgc

SEQ ID NO: 575260 - DNA, 20 bp, mouse
gctgttctctagtgatgggt

SEQ ID NO: 575261 - DNA, 20 bp, mouse
gcctcctgttctctagtgat

SEQ ID NO: 575262 - DNA, 20 bp, mouse
gaagatttccctacctttcc

SEQ ID NO: 575263 - DNA, 20 bp, mouse
ggctaattgcgaccacagcc

SEQ ID NO: 575264 - DNA, 20 bp, mouse
gttcctggggttaggggcaa

SEQ ID NO: 575265 - DNA, 20 bp, mouse
ggcagagtcacgctgttcct

SEQ ID NO: 575266 - DNA, 20 bp, mouse
gccagtgacgggaaacctgg

SEQ ID NO: 575267 - DNA, 20 bp, mouse
gcatccagtgacgggaaacc

SEQ ID NO: 575268 - DNA, 20 bp, mouse
gacacacagccgtctggacg

SEQ ID NO: 575269 - DNA, 20 bp, mouse
gccaaggcctgcctccataa

SEQ ID NO: 575270 - DNA, 20 bp, mouse
gtagtcccacgagacgtcag

SEQ ID NO: 575271 - DNA, 20 bp, mouse
gccacctccgaagctctagg

SEQ ID NO: 575272 - DNA, 20 bp, mouse
gtggcgcgggggactagagc

SEQ ID NO: 575273 - DNA, 20 bp, mouse
ggccgggcgtgggaagaggg

SEQ ID NO: 575274 - DNA, 20 bp, mouse
gccctgccatgcctttatgg

SEQ ID NO: 575275 - DNA, 20 bp, mouse
gtgactcgcgggccaaatac

SEQ ID NO: 575276 - DNA, 20 bp, mouse
gcaccgccggcaccacccgg

SEQ ID NO: 575277 - DNA, 20 bp, mouse
gcaccacccggaggtaggag

SEQ ID NO: 575278 - DNA, 20 bp, mouse
gcagagagaaccctacaaaa

SEQ ID NO: 575279 - DNA, 20 bp, mouse
gatcctctcctacctccggg

SEQ ID NO: 575280 - DNA, 20 bp, mouse
gccgggaagacaaggaaagg

SEQ ID NO: 575281 - DNA, 20 bp, mouse
gggaaggtcccgggaagaca

SEQ ID NO: 575282 - DNA, 20 bp, mouse
gtgtagggttctctctgacg

SEQ ID NO: 575283 - DNA, 20 bp, mouse
ggaaccctacaaaatggcga

SEQ ID NO: 575284 - DNA, 20 bp, mouse
ggttgggccgctgaggatag

SEQ ID NO: 575285 - DNA, 20 bp, mouse
gactggacccctatcctcag

SEQ ID NO: 575286 - DNA, 20 bp, mouse
gggtaggagaagacggtcgg

SEQ ID NO: 575287 - DNA, 20 bp, mouse
ggtgggtaggagaagacggt

SEQ ID NO: 575288 - DNA, 20 bp, mouse
gtggagcggccgaaccttgt

SEQ ID NO: 575289 - DNA, 20 bp, mouse
gcgccccagaacctcctaca

SEQ ID NO: 575290 - DNA, 20 bp, mouse
gtcgacgcgcgagggactgt

SEQ ID NO: 575291 - DNA, 20 bp, mouse
ggttcggccgctccacaaaa

SEQ ID NO: 575292 - DNA, 20 bp, mouse
gcgcgcgagggactgtgggt

SEQ ID NO: 575293 - DNA, 20 bp, mouse
gcagaacctcctacaaggtt

SEQ ID NO: 575294 - DNA, 20 bp, mouse
ggcagagccagaggcgagga

SEQ ID NO: 575295 - DNA, 20 bp, mouse
ggagacgccattttgtggag

SEQ ID NO: 575296 - DNA, 20 bp, mouse
gtccgtggcggcctctgagg

SEQ ID NO: 575297 - DNA, 20 bp, mouse
gtcctcctcagaggccgcca

SEQ ID NO: 575298 - DNA, 20 bp, mouse
ggcccaccgggaggaagttc

SEQ ID NO: 575299 - DNA, 20 bp, mouse
ggaagccggagcccaccggg

SEQ ID NO: 575300 - DNA, 20 bp, mouse
gcggcaggaacgccccggaa

SEQ ID NO: 575301 - DNA, 20 bp, mouse
gtgtggaagccggagcccac

SEQ ID NO: 575302 - DNA, 20 bp, mouse
gggaggaagttccggtctcc

SEQ ID NO: 575303 - DNA, 20 bp, mouse
ggacccagcgtcccggagac

SEQ ID NO: 575304 - DNA, 20 bp, mouse
gtggcttcgaagacacgggg

SEQ ID NO: 575305 - DNA, 20 bp, mouse
gaccggaacttcctcccggt

SEQ ID NO: 575306 - DNA, 20 bp, mouse
gctgttccagtcccaggcct

SEQ ID NO: 575307 - DNA, 20 bp, mouse
gtgagggtgcgcagtagggt

SEQ ID NO: 575308 - DNA, 20 bp, mouse
ggcctgggactggaacagcg

SEQ ID NO: 575309 - DNA, 20 bp, mouse
gtccgcgctgttccagtccc

SEQ ID NO: 575310 - DNA, 20 bp, mouse
gggtgcgcagtagggtcggt

SEQ ID NO: 575311 - DNA, 20 bp, mouse
ggggtcggtcggccctgagc

SEQ ID NO: 575312 - DNA, 20 bp, mouse
ggcgccgagccggaattccg

SEQ ID NO: 575313 - DNA, 20 bp, mouse
gggcgggcacggtcctaggg

SEQ ID NO: 575314 - DNA, 20 bp, mouse
gaggcctaggctgcctgctc

SEQ ID NO: 575315 - DNA, 20 bp, mouse
gactggaacagcgcggagat

SEQ ID NO: 575316 - DNA, 20 bp, mouse
gcccttgggaaaggaattag

SEQ ID NO: 575317 - DNA, 20 bp, mouse
gttaggggcggaactgggaa

SEQ ID NO: 575318 - DNA, 20 bp, mouse
gccggtgagtgtggggaata

SEQ ID NO: 575319 - DNA, 20 bp, mouse
gtagggtagagtggtctaag

SEQ ID NO: 575320 - DNA, 20 bp, mouse
gggacgtcaccccacgaact

SEQ ID NO: 575321 - DNA, 20 bp, mouse
gggagagtggaggcgactgc

SEQ ID NO: 575322 - DNA, 20 bp, mouse
gcgaagcttccagatagtct

SEQ ID NO: 575323 - DNA, 20 bp, mouse
gaattcctttcccaaggggg

SEQ ID NO: 575324 - DNA, 20 bp, mouse
gaggaattaggggcggaact

SEQ ID NO: 575325 - DNA, 20 bp, mouse
gagttaggctgaccaattaa

SEQ ID NO: 575326 - DNA, 20 bp, mouse
gatacaagtggaaagtacgg

SEQ ID NO: 575327 - DNA, 20 bp, mouse
ggtgcgcccgatagcgagag

SEQ ID NO: 575328 - DNA, 20 bp, mouse
ggcagaggacaccccggaca

SEQ ID NO: 575329 - DNA, 20 bp, mouse
gtcaatacaagtggaaagta

SEQ ID NO: 575330 - DNA, 20 bp, mouse
ggtggaaagtacggcggcag

SEQ ID NO: 575331 - DNA, 20 bp, mouse
gtgccaggcggcatctgggg

SEQ ID NO: 575332 - DNA, 20 bp, mouse
gggtacagtcgggctcccag

SEQ ID NO: 575333 - DNA, 20 bp, mouse
gcggtgccaggcggcatctg

SEQ ID NO: 575334 - DNA, 20 bp, mouse
gtggcagctcgggtacagtc

SEQ ID NO: 575335 - DNA, 20 bp, mouse
gggctgcgctcggtgccagg

SEQ ID NO: 575336 - DNA, 20 bp, mouse
gaaagacgcggtggaaggag

SEQ ID NO: 575337 - DNA, 20 bp, mouse
ggaaggagaggcgctgaagg

SEQ ID NO: 575338 - DNA, 20 bp, mouse
gaggcgctgaagggggacag

SEQ ID NO: 575339 - DNA, 20 bp, mouse
gcatgggcgcagcagcagac

SEQ ID NO: 575340 - DNA, 20 bp, mouse
gcaaaaaggcaggaaagacg

SEQ ID NO: 575341 - DNA, 20 bp, mouse
gtccagaaccaggtgcaaaa

SEQ ID NO: 575342 - DNA, 20 bp, mouse
gagggcgctcctggatccct

SEQ ID NO: 575343 - DNA, 20 bp, mouse
gagactatccccgggaccat

SEQ ID NO: 575344 - DNA, 20 bp, mouse
gaggagaattctaaaaccaa

SEQ ID NO: 575345 - DNA, 20 bp, mouse
gctgcggggaagaatgagct

SEQ ID NO: 575346 - DNA, 20 bp, mouse
ggcagcaactaagcctgcac

SEQ ID NO: 575347 - DNA, 20 bp, mouse
gccgcggtgggaaagagaca

SEQ ID NO: 575348 - DNA, 20 bp, mouse
ggaacacaccatgtcactct

SEQ ID NO: 575349 - DNA, 20 bp, mouse
gaggcttagttgctgctgtc

SEQ ID NO: 575350 - DNA, 20 bp, mouse
ggcgcttgtaaaggcgaagg

SEQ ID NO: 575351 - DNA, 20 bp, mouse
gacggaaaggaaaaaaaacc

SEQ ID NO: 575352 - DNA, 20 bp, mouse
ggaactggggaagcagtctg

SEQ ID NO: 575353 - DNA, 20 bp, mouse
gcaggcgcttgtaaaggcga

SEQ ID NO: 575354 - DNA, 20 bp, mouse
gaagaaaaagaaacccgtgc

SEQ ID NO: 575355 - DNA, 20 bp, mouse
ggattgacaccactagagac

SEQ ID NO: 575356 - DNA, 20 bp, mouse
ggcgcaacgagggcgaacaa

SEQ ID NO: 575357 - DNA, 20 bp, mouse
gtaggacgactgcgcaacga

SEQ ID NO: 575358 - DNA, 20 bp, mouse
ggctgctcgggaggtccggt

SEQ ID NO: 575359 - DNA, 20 bp, mouse
ggtttcccgggagatagtgg

SEQ ID NO: 575360 - DNA, 20 bp, mouse
gtcggtagctgtcactggtg

SEQ ID NO: 575361 - DNA, 20 bp, mouse
ggtccggtcggcgagctcag

SEQ ID NO: 575362 - DNA, 20 bp, mouse
gcagctaccgattttcagaa

SEQ ID NO: 575363 - DNA, 20 bp, mouse
ggaaaatcggtagctgtcac

SEQ ID NO: 575364 - DNA, 20 bp, mouse
gacggaacagaaatgacgct

SEQ ID NO: 575365 - DNA, 20 bp, mouse
gtcccgggagatagtggcgg

SEQ ID NO: 575366 - DNA, 20 bp, mouse
ggggcgggagaagctcggta

SEQ ID NO: 575367 - DNA, 20 bp, mouse
gaagatgcgaatatgaagta

SEQ ID NO: 575368 - DNA, 20 bp, mouse
gtcagacgacaacagcttcc

SEQ ID NO: 575369 - DNA, 20 bp, mouse
gttctccgcggaagggagag

SEQ ID NO: 575370 - DNA, 20 bp, mouse
gggagaagctcggtagggag

SEQ ID NO: 575371 - DNA, 20 bp, mouse
gaagctcggtagggagaggg

SEQ ID NO: 575372 - DNA, 20 bp, mouse
gccgcgcagccctctgacta

SEQ ID NO: 575373 - DNA, 20 bp, mouse
gggacggggcggactctgaa

SEQ ID NO: 575374 - DNA, 20 bp, mouse
ggcactgctggagaaaaatg

SEQ ID NO: 575375 - DNA, 20 bp, mouse
ggtttctctgcggatagggg

SEQ ID NO: 575376 - DNA, 20 bp, mouse
gttctcggcgggagcggcgg

SEQ ID NO: 575377 - DNA, 20 bp, mouse
gcggcggcggcagacgcgtg

SEQ ID NO: 575378 - DNA, 20 bp, mouse
gcgctcccgccgagaaccag

SEQ ID NO: 575379 - DNA, 20 bp, mouse
gagggaagcgttagccccgt

SEQ ID NO: 575380 - DNA, 20 bp, mouse
gcgcggcctctggttctcgg

SEQ ID NO: 575381 - DNA, 20 bp, mouse
gcggtcgggcagaaaggccc

SEQ ID NO: 575382 - DNA, 20 bp, mouse
ggagaaccagaggccgcgaa

SEQ ID NO: 575383 - DNA, 20 bp, mouse
gcccgggcaggccaccgacc

SEQ ID NO: 575384 - DNA, 20 bp, mouse
ggccgagcagacgtccggga

SEQ ID NO: 575385 - DNA, 20 bp, mouse
gaagcgttagccccgtgggt

SEQ ID NO: 575386 - DNA, 20 bp, mouse
ggtggtgaagagccgagaga

SEQ ID NO: 575387 - DNA, 20 bp, mouse
ggcagcagcggcgattgagg

SEQ ID NO: 575388 - DNA, 20 bp, mouse
gcggtcggcttcaaccatgt

SEQ ID NO: 575389 - DNA, 20 bp, mouse
gacggcagcagcggcgattg

SEQ ID NO: 575390 - DNA, 20 bp, mouse
gccgcagcccgagacatgaa

SEQ ID NO: 575391 - DNA, 20 bp, mouse
gggttgaagccgaccgtcca

SEQ ID NO: 575392 - DNA, 20 bp, mouse
gctccccgaccggtaggagg

SEQ ID NO: 575393 - DNA, 20 bp, mouse
ggcgtccgcggggttctcga

SEQ ID NO: 575394 - DNA, 20 bp, mouse
ggccgtcgctgctgccgaca

SEQ ID NO: 575395 - DNA, 20 bp, mouse
ggggttctcgaaggtgacga

SEQ ID NO: 575396 - DNA, 20 bp, mouse
gagtcggagttgttgcagga

SEQ ID NO: 575397 - DNA, 20 bp, mouse
gccccgccaggctactaata

SEQ ID NO: 575398 - DNA, 20 bp, mouse
gtgggcgcgagtggtcattt

SEQ ID NO: 575399 - DNA, 20 bp, mouse
gttggagtcggagttgttgc

SEQ ID NO: 575400 - DNA, 20 bp, mouse
gtcctaaggtataaaattgt

SEQ ID NO: 575401 - DNA, 20 bp, mouse
ggttgcgacttgggcgcgag

SEQ ID NO: 575402 - DNA, 20 bp, mouse
gcgagtggtcattttggagt

SEQ ID NO: 575403 - DNA, 20 bp, mouse
ggaaaaacgaatggctatga

SEQ ID NO: 575404 - DNA, 20 bp, mouse
gtgccatattagtagcctgg

SEQ ID NO: 575405 - DNA, 20 bp, mouse
gataccttaggaaaaacgaa

SEQ ID NO: 575406 - DNA, 20 bp, mouse
gcagtagggacagtaagccc

SEQ ID NO: 575407 - DNA, 20 bp, mouse
gtagtgcttgacacacagta

SEQ ID NO: 575408 - DNA, 20 bp, mouse
gcaagcactacatgagactt

SEQ ID NO: 575409 - DNA, 20 bp, mouse
gtctcaggaggttcatctca

SEQ ID NO: 575410 - DNA, 20 bp, mouse
gctgtgtaaggtaaaggtgt

SEQ ID NO: 575411 - DNA, 20 bp, mouse
gccaggcctgtgtaaggtaa

SEQ ID NO: 575412 - DNA, 20 bp, mouse
gtggaggtttgggtctctgg

SEQ ID NO: 575413 - DNA, 20 bp, mouse
gagcatgccagagcagacaa

SEQ ID NO: 575414 - DNA, 20 bp, mouse
gggttcatctcagggcacaa

SEQ ID NO: 575415 - DNA, 20 bp, mouse
gagagtggatccttatgttc

SEQ ID NO: 575416 - DNA, 20 bp, mouse
gaagtcccgggaactctctg

SEQ ID NO: 575417 - DNA, 20 bp, mouse
gggacgttcggtgactgtga

SEQ ID NO: 575418 - DNA, 20 bp, mouse
ggaggccaccatcatgacga

SEQ ID NO: 575419 - DNA, 20 bp, mouse
gtggtccttcgtcatgatgg

SEQ ID NO: 575420 - DNA, 20 bp, mouse
gtcatgacgaaggaccaaaa

SEQ ID NO: 575421 - DNA, 20 bp, mouse
gggtggcctctggtttgatg

SEQ ID NO: 575422 - DNA, 20 bp, mouse
gctggtttgatgtggacgtt

SEQ ID NO: 575423 - DNA, 20 bp, mouse
gtgtgaaggaacaggctgca

SEQ ID NO: 575424 - DNA, 20 bp, mouse
gacagcctcagagagttccc

SEQ ID NO: 575425 - DNA, 20 bp, mouse
gccctaggtaagagatgaag

SEQ ID NO: 575426 - DNA, 20 bp, mouse
ggaccacagccttgtacaca

SEQ ID NO: 575427 - DNA, 20 bp, mouse
gtaagagctccgtgtgtaca

SEQ ID NO: 575428 - DNA, 20 bp, mouse
gaaggtctggggctcaatgt

SEQ ID NO: 575429 - DNA, 20 bp, mouse
gacacacggagctcttatcc

SEQ ID NO: 575430 - DNA, 20 bp, mouse
gactgctggcccagatacag

SEQ ID NO: 575431 - DNA, 20 bp, mouse
ggatatggccaagatcctcc

SEQ ID NO: 575432 - DNA, 20 bp, mouse
gagggaagcagtagttatcc

SEQ ID NO: 575433 - DNA, 20 bp, mouse
gagggaggtcgtccactcgt

SEQ ID NO: 575434 - DNA, 20 bp, mouse
gtgggccagcagttcttctc

SEQ ID NO: 575435 - DNA, 20 bp, mouse
ggcttgctggggagcctcga

SEQ ID NO: 575436 - DNA, 20 bp, mouse
gagctggcccggggacccag

SEQ ID NO: 575437 - DNA, 20 bp, mouse
gcacgcgcgcgcgaacgcgg

SEQ ID NO: 575438 - DNA, 20 bp, mouse
gcggcggccaggcttgcacg

SEQ ID NO: 575439 - DNA, 20 bp, mouse
gcgcgcggcggctcaccagc

SEQ ID NO: 575440 - DNA, 20 bp, mouse
ggtagaagcaggggccactt

SEQ ID NO: 575441 - DNA, 20 bp, mouse
gacttcgacaaggctcgtgt

SEQ ID NO: 575442 - DNA, 20 bp, mouse
gccgctcagggtggtctcgg

SEQ ID NO: 575443 - DNA, 20 bp, mouse
gtcgcgcgcgcgtggagcga

SEQ ID NO: 575444 - DNA, 20 bp, mouse
ggagctagggactggagtct

SEQ ID NO: 575445 - DNA, 20 bp, mouse
gactccggggtgagatggag

SEQ ID NO: 575446 - DNA, 20 bp, mouse
gccatgccagcagacctcag

SEQ ID NO: 575447 - DNA, 20 bp, mouse
ggccaaagcccaagagtcac

SEQ ID NO: 575448 - DNA, 20 bp, mouse
gtcgctgctgagaagattcc

SEQ ID NO: 575449 - DNA, 20 bp, mouse
gaagattccaggtaccgctg

SEQ ID NO: 575450 - DNA, 20 bp, mouse
gaggtaccgctgaggtctgc

SEQ ID NO: 575451 - DNA, 20 bp, mouse
ggcgagaacataacccacag

SEQ ID NO: 575452 - DNA, 20 bp, mouse
gtcagcagcgacaacttcga

SEQ ID NO: 575453 - DNA, 20 bp, mouse
ggaggtctgctggcatggtt

SEQ ID NO: 575454 - DNA, 20 bp, mouse
ggagactctgggacaaggac

SEQ ID NO: 575455 - DNA, 20 bp, mouse
ggcccaagagtcacaggcag

SEQ ID NO: 575456 - DNA, 20 bp, mouse
gtgacagggtaagtctgagg

SEQ ID NO: 575457 - DNA, 20 bp, mouse
ggatggcgcctgttgtgaca

SEQ ID NO: 575458 - DNA, 20 bp, mouse
gtcccacagagagcctaagg

SEQ ID NO: 575459 - DNA, 20 bp, mouse
gttgtgacagggtaagtctg

SEQ ID NO: 575460 - DNA, 20 bp, mouse
ggcagcgagtgctgggaacc

SEQ ID NO: 575461 - DNA, 20 bp, mouse
gctcgcgagggttggagttt

SEQ ID NO: 575462 - DNA, 20 bp, mouse
gggcgagagtttgtggaaga

SEQ ID NO: 575463 - DNA, 20 bp, mouse
gcgaggcggctggctcccgg

SEQ ID NO: 575464 - DNA, 20 bp, mouse
gcgcgccgcccgcggactaa

SEQ ID NO: 575465 - DNA, 20 bp, mouse
gctgggggcagaatcgcggg

SEQ ID NO: 575466 - DNA, 20 bp, mouse
gacggtatcgaagtcagtgg

SEQ ID NO: 575467 - DNA, 20 bp, mouse
gtggcggtagatgtgcccag

SEQ ID NO: 575468 - DNA, 20 bp, mouse
gtgaacggtatcgaagtcag

SEQ ID NO: 575469 - DNA, 20 bp, mouse
gtgagcagccatggacccca

SEQ ID NO: 575470 - DNA, 20 bp, mouse
gcagtgtgaggatcggatcg

SEQ ID NO: 575471 - DNA, 20 bp, mouse
gcggggcttagatgtgtgaa

SEQ ID NO: 575472 - DNA, 20 bp, mouse
gggtccatggctgctcatcg

SEQ ID NO: 575473 - DNA, 20 bp, mouse
ggccatcgccccttaaccca

SEQ ID NO: 575474 - DNA, 20 bp, mouse
gagggaacacacacactgta

SEQ ID NO: 575475 - DNA, 20 bp, mouse
ggttgtctccctggggtcca

SEQ ID NO: 575476 - DNA, 20 bp, mouse
ggccagcagcgcgtcctcgg

SEQ ID NO: 575477 - DNA, 20 bp, mouse
gcggcgggcgcggttgggac

SEQ ID NO: 575478 - DNA, 20 bp, mouse
ggagccccggagtcgggacg

SEQ ID NO: 575479 - DNA, 20 bp, mouse
gcgcgcggcgacgaaggacc

SEQ ID NO: 575480 - DNA, 20 bp, mouse
gggaccgggaagatgaacgg

SEQ ID NO: 575481 - DNA, 20 bp, mouse
gccccgggggaaggtagcag

SEQ ID NO: 575482 - DNA, 20 bp, mouse
ggcgggcggggacctccgag

SEQ ID NO: 575483 - DNA, 20 bp, mouse
gcgaggcggcgggcgcggtt

SEQ ID NO: 575484 - DNA, 20 bp, mouse
gcggccgcgtcccgactccg

SEQ ID NO: 575485 - DNA, 20 bp, mouse
gtcgtcgccgcgcgggactg

SEQ ID NO: 575486 - DNA, 20 bp, mouse
gcaaggcaccgggaacccga

SEQ ID NO: 575487 - DNA, 20 bp, mouse
gcagctcgcactctcctcgg

SEQ ID NO: 575488 - DNA, 20 bp, mouse
gcaccgggaacccgagggag

SEQ ID NO: 575489 - DNA, 20 bp, mouse
gggccgccctgaaaagccgg

SEQ ID NO: 575490 - DNA, 20 bp, mouse
gccggaggcggtggccgcac

SEQ ID NO: 575491 - DNA, 20 bp, mouse
gggccggaggggcaaggcac

SEQ ID NO: 575492 - DNA, 20 bp, mouse
gcgccctgaaaagccggagg

SEQ ID NO: 575493 - DNA, 20 bp, mouse
gggaggcggccggaggggca

SEQ ID NO: 575494 - DNA, 20 bp, mouse
ggcacgggctccgctccctc

SEQ ID NO: 575495 - DNA, 20 bp, mouse
gctgctgccgcgtcaggcta

SEQ ID NO: 575496 - DNA, 20 bp, mouse
ggggcgggcctagggttgat

SEQ ID NO: 575497 - DNA, 20 bp, mouse
ggcaggcccgaggaagagct

SEQ ID NO: 575498 - DNA, 20 bp, mouse
gcagcatgccgatcaaccct

SEQ ID NO: 575499 - DNA, 20 bp, mouse
gaccaagaacggaagccggg

SEQ ID NO: 575500 - DNA, 20 bp, mouse
gttcctcaaggaagctaggg

SEQ ID NO: 575501 - DNA, 20 bp, mouse
gactcgtgaagagactgcgg

SEQ ID NO: 575502 - DNA, 20 bp, mouse
ggccttcctcaaggaagcta

SEQ ID NO: 575503 - DNA, 20 bp, mouse
gctaatagggccccagacac

SEQ ID NO: 575504 - DNA, 20 bp, mouse
gagggaggcgcggatatggc

SEQ ID NO: 575505 - DNA, 20 bp, mouse
gcaaccctaggcccgccccc

SEQ ID NO: 575506 - DNA, 20 bp, mouse
ggaggacaacgagcgacggg

SEQ ID NO: 575507 - DNA, 20 bp, mouse
gggacgaggacaacgagcga

SEQ ID NO: 575508 - DNA, 20 bp, mouse
gacagagtcagagtcgatgg

SEQ ID NO: 575509 - DNA, 20 bp, mouse
gcagagcggtgagcaagtgg

SEQ ID NO: 575510 - DNA, 20 bp, mouse
ggacaacgagcgacgggcgg

SEQ ID NO: 575511 - DNA, 20 bp, mouse
ggggaggccgaccaacaaga

SEQ ID NO: 575512 - DNA, 20 bp, mouse
gcggggcgggccggagtctg

SEQ ID NO: 575513 - DNA, 20 bp, mouse
ggcagcaggggccatcttgt

SEQ ID NO: 575514 - DNA, 20 bp, mouse
gccggcccgccccgagactg

SEQ ID NO: 575515 - DNA, 20 bp, mouse
gccctccgggaggcacgcgg

SEQ ID NO: 575516 - DNA, 20 bp, mouse
gtcgccggggcagagctcgg

SEQ ID NO: 575517 - DNA, 20 bp, mouse
ggctacagggacagccccgt

SEQ ID NO: 575518 - DNA, 20 bp, mouse
ggtctcgccggggcagagct

SEQ ID NO: 575519 - DNA, 20 bp, mouse
gctgtccctgtagctcccga

SEQ ID NO: 575520 - DNA, 20 bp, mouse
gccggctgccgggtcctcag

SEQ ID NO: 575521 - DNA, 20 bp, mouse
ggccttcgccgccgccaacg

SEQ ID NO: 575522 - DNA, 20 bp, mouse
gggaggaggaggccccgtcg

SEQ ID NO: 575523 - DNA, 20 bp, mouse
gacagggacagccccgttgg

SEQ ID NO: 575524 - DNA, 20 bp, mouse
gtcagggcctcaaactccat

SEQ ID NO: 575525 - DNA, 20 bp, mouse
gtgccgggtcctcagaggtg

SEQ ID NO: 575526 - DNA, 20 bp, mouse
gtcagtcaagcccaagctgg

SEQ ID NO: 575527 - DNA, 20 bp, mouse
ggcaaaggaacctccagctt

SEQ ID NO: 575528 - DNA, 20 bp, mouse
gcggctggagaaaggacccg

SEQ ID NO: 575529 - DNA, 20 bp, mouse
gctctcagtcaagcccaagc

SEQ ID NO: 575530 - DNA, 20 bp, mouse
gagagaacgagcgagaccac

SEQ ID NO: 575531 - DNA, 20 bp, mouse
gaattagccgaaatactcag

SEQ ID NO: 575532 - DNA, 20 bp, mouse
gctcgctcgttctcttgcaa

SEQ ID NO: 575533 - DNA, 20 bp, mouse
gcctcccgcgcaaggaacct

SEQ ID NO: 575534 - DNA, 20 bp, mouse
gtgcattctgctttttcacg

SEQ ID NO: 575535 - DNA, 20 bp, mouse
gagccgaaatactcaggggt

SEQ ID NO: 575536 - DNA, 20 bp, mouse
gcccgctgcaagcgcctctg

SEQ ID NO: 575537 - DNA, 20 bp, mouse
ggcctcagaggcgcttgcag

SEQ ID NO: 575538 - DNA, 20 bp, mouse
gctagggagactcaggcacc

SEQ ID NO: 575539 - DNA, 20 bp, mouse
ggcagcggggagcaggctcc

SEQ ID NO: 575540 - DNA, 20 bp, mouse
gccaatcaggaggttaaggt

SEQ ID NO: 575541 - DNA, 20 bp, mouse
ggtactgccctgctcctggg

SEQ ID NO: 575542 - DNA, 20 bp, mouse
gaccacacaggcgaccagag

SEQ ID NO: 575543 - DNA, 20 bp, mouse
gacctccacatccaccacac

SEQ ID NO: 575544 - DNA, 20 bp, mouse
gggcgcttgcagcggggagc

SEQ ID NO: 575545 - DNA, 20 bp, mouse
gcagcacagcagagtaaaga

SEQ ID NO: 575546 - DNA, 20 bp, mouse
gcgacacgggcggtgaccta

SEQ ID NO: 575547 - DNA, 20 bp, mouse
gcctgggcgcgaggaaccca

SEQ ID NO: 575548 - DNA, 20 bp, mouse
gcgccggcgcacagacagga

SEQ ID NO: 575549 - DNA, 20 bp, mouse
gcctcagccggcgacacggg

SEQ ID NO: 575550 - DNA, 20 bp, mouse
gcgcgcctcgcgccctccct

SEQ ID NO: 575551 - DNA, 20 bp, mouse
gccctcaacgcgggccgcag

SEQ ID NO: 575552 - DNA, 20 bp, mouse
gccgcctcagccggcgacac

SEQ ID NO: 575553 - DNA, 20 bp, mouse
gccacgagcgcggcctgggg

SEQ ID NO: 575554 - DNA, 20 bp, mouse
ggaggggagaggcccgaggg

SEQ ID NO: 575555 - DNA, 20 bp, mouse
gagggcgtggtggctccggg

SEQ ID NO: 575556 - DNA, 20 bp, mouse
gggacagcgcagctcctcag

SEQ ID NO: 575557 - DNA, 20 bp, mouse
gcggcggcgcagcggagtca

SEQ ID NO: 575558 - DNA, 20 bp, mouse
gcaggtagagcgctgcaggg

SEQ ID NO: 575559 - DNA, 20 bp, mouse
ggctacggctaaggcggcgg

SEQ ID NO: 575560 - DNA, 20 bp, mouse
ggagccggctacggctaagg

SEQ ID NO: 575561 - DNA, 20 bp, mouse
gccggctacggctaaggcgg

SEQ ID NO: 575562 - DNA, 20 bp, mouse
gcctggccgggcggcctgac

SEQ ID NO: 575563 - DNA, 20 bp, mouse
ggagtcagggcctggccggg

SEQ ID NO: 575564 - DNA, 20 bp, mouse
ggaggagccggctacggcta

SEQ ID NO: 575565 - DNA, 20 bp, mouse
gtcggctcgccgcacacctg

SEQ ID NO: 575566 - DNA, 20 bp, mouse
ggagcgagaagagaaaccag

SEQ ID NO: 575567 - DNA, 20 bp, mouse
ggcaccaacagaaagtagag

SEQ ID NO: 575568 - DNA, 20 bp, mouse
ggaggtggttactgggacta

SEQ ID NO: 575569 - DNA, 20 bp, mouse
gtagggagaagggagcctgt

SEQ ID NO: 575570 - DNA, 20 bp, mouse
gatacttacggatctcatta

SEQ ID NO: 575571 - DNA, 20 bp, mouse
gatgaggtgggcctcctgga

SEQ ID NO: 575572 - DNA, 20 bp, mouse
gcgatctggaatgaacctgg

SEQ ID NO: 575573 - DNA, 20 bp, mouse
gcatacagcacaaatactta

SEQ ID NO: 575574 - DNA, 20 bp, mouse
gagagagttcaagggagcga

SEQ ID NO: 575575 - DNA, 20 bp, mouse
gcggtcccagggcccgggaa

SEQ ID NO: 575576 - DNA, 20 bp, mouse
ggacctacctcgggacaggg

SEQ ID NO: 575577 - DNA, 20 bp, mouse
gcccagggctccctacgaac

SEQ ID NO: 575578 - DNA, 20 bp, mouse
gcgcgacctacctcgggaca

SEQ ID NO: 575579 - DNA, 20 bp, mouse
gggccgccctgtcccgaggt

SEQ ID NO: 575580 - DNA, 20 bp, mouse
gaccggagcgcgacctacct

SEQ ID NO: 575581 - DNA, 20 bp, mouse
gttgtggccgccctgtcccg

SEQ ID NO: 575582 - DNA, 20 bp, mouse
gaagcaactccggcgctcgg

SEQ ID NO: 575583 - DNA, 20 bp, mouse
gaggtcgcgctccggttcgt

SEQ ID NO: 575584 - DNA, 20 bp, mouse
gcccgcagagcgcatgctcg

SEQ ID NO: 575585 - DNA, 20 bp, mouse
gtgaatctcccgccacggag

SEQ ID NO: 575586 - DNA, 20 bp, mouse
gctctccccggccgggacga

SEQ ID NO: 575587 - DNA, 20 bp, mouse
gttaagtgtatctggtgagt

SEQ ID NO: 575588 - DNA, 20 bp, mouse
ggggaagcgactgaaagacg

SEQ ID NO: 575589 - DNA, 20 bp, mouse
gtaggggctggaaaccgtct

SEQ ID NO: 575590 - DNA, 20 bp, mouse
gtgggctggagccctcgtcc

SEQ ID NO: 575591 - DNA, 20 bp, mouse
gcatcactccaaccaggtag

SEQ ID NO: 575592 - DNA, 20 bp, mouse
gggagccctcgtcccggccg

SEQ ID NO: 575593 - DNA, 20 bp, mouse
gcgaaggcttcttctctccc

SEQ ID NO: 575594 - DNA, 20 bp, mouse
gttctcgggggggaaggggg

SEQ ID NO: 575595 - DNA, 20 bp, mouse
gcgtctgggaccagtttgca

SEQ ID NO: 575596 - DNA, 20 bp, mouse
gagcagcgcatagtaatgta

SEQ ID NO: 575597 - DNA, 20 bp, mouse
gctcctggatccccaaccaa

SEQ ID NO: 575598 - DNA, 20 bp, mouse
gcatagtaatgtatggctcg

SEQ ID NO: 575599 - DNA, 20 bp, mouse
ggggagctcaggctgaaatt

SEQ ID NO: 575600 - DNA, 20 bp, mouse
ggtatggctcggggaacaga

SEQ ID NO: 575601 - DNA, 20 bp, mouse
gtatgcgctgctcactttca

SEQ ID NO: 575602 - DNA, 20 bp, mouse
ggttgagggtacaggctaat

SEQ ID NO: 575603 - DNA, 20 bp, mouse
gggctcttaccgggtttcag

SEQ ID NO: 575604 - DNA, 20 bp, mouse
ggtctcagatctgacttaag

SEQ ID NO: 575605 - DNA, 20 bp, mouse
gggctttcctgatgagttga

SEQ ID NO: 575606 - DNA, 20 bp, mouse
gacgggtccgggcgtgatgg

SEQ ID NO: 575607 - DNA, 20 bp, mouse
ggcctcgcctgctcctacgt

SEQ ID NO: 575608 - DNA, 20 bp, mouse
ggtctggtgaggctgaccaa

SEQ ID NO: 575609 - DNA, 20 bp, mouse
ggccacgggtccgggcgtga

SEQ ID NO: 575610 - DNA, 20 bp, mouse
gccgcagccccgccccacga

SEQ ID NO: 575611 - DNA, 20 bp, mouse
ggacgggctgcgtttactgt

SEQ ID NO: 575612 - DNA, 20 bp, mouse
gtgaccaagggcataggtgt

SEQ ID NO: 575613 - DNA, 20 bp, mouse
ggcgagctgcccaggtgcgg

SEQ ID NO: 575614 - DNA, 20 bp, mouse
gctggacactaccaggacac

SEQ ID NO: 575615 - DNA, 20 bp, mouse
gcgtaggtgacgtcaggcgg

SEQ ID NO: 575616 - DNA, 20 bp, mouse
gcggccaccagagtcaggaa

SEQ ID NO: 575617 - DNA, 20 bp, mouse
gagcagcggccaccagagtc

SEQ ID NO: 575618 - DNA, 20 bp, mouse
gtcggacacccgctcctcct

SEQ ID NO: 575619 - DNA, 20 bp, mouse
gtctggtggccgctgctccg

SEQ ID NO: 575620 - DNA, 20 bp, mouse
ggacagagcttgtctcctca

SEQ ID NO: 575621 - DNA, 20 bp, mouse
gcgaccgcagctcatcgagg

SEQ ID NO: 575622 - DNA, 20 bp, mouse
gacccgaccgcagctcatcg

SEQ ID NO: 575623 - DNA, 20 bp, mouse
gagctgggggaaaggttcag

SEQ ID NO: 575624 - DNA, 20 bp, mouse
gctgcggtcgggtctggcaa

SEQ ID NO: 575625 - DNA, 20 bp, mouse
gggcgtggcttccaagctgg

SEQ ID NO: 575626 - DNA, 20 bp, mouse
ggggagcgcgaccaggacca

SEQ ID NO: 575627 - DNA, 20 bp, mouse
gaaccacgtggacgcgtcgg

SEQ ID NO: 575628 - DNA, 20 bp, mouse
ggggacccgggagcgcgacc

SEQ ID NO: 575629 - DNA, 20 bp, mouse
ggcgccagggacgacaaccc

SEQ ID NO: 575630 - DNA, 20 bp, mouse
gcgtccacgtggtttagaac

SEQ ID NO: 575631 - DNA, 20 bp, mouse
gctaaaccacgtggacgcgt

SEQ ID NO: 575632 - DNA, 20 bp, mouse
gcgcgaggagggaggacccg

SEQ ID NO: 575633 - DNA, 20 bp, mouse
gccctcccaagtcacctcgg

SEQ ID NO: 575634 - DNA, 20 bp, mouse
gcttcctgttctaaaccacg

SEQ ID NO: 575635 - DNA, 20 bp, mouse
gacgacaacccgggcctccg

SEQ ID NO: 575636 - DNA, 20 bp, mouse
gccccagggcgagtcccaag

SEQ ID NO: 575637 - DNA, 20 bp, mouse
gcccggacgagagcaaggag

SEQ ID NO: 575638 - DNA, 20 bp, mouse
gcatggtcgcgagcaaaggg

SEQ ID NO: 575639 - DNA, 20 bp, mouse
gaagcggccaccgcgcgcca

SEQ ID NO: 575640 - DNA, 20 bp, mouse
gtcgcgaccatggcgcgcgg

SEQ ID NO: 575641 - DNA, 20 bp, mouse
gcgccatggtcgcgagcaaa

SEQ ID NO: 575642 - DNA, 20 bp, mouse
gcgagcaaagggaggctgcg

SEQ ID NO: 575643 - DNA, 20 bp, mouse
gtgctcgcgaccatggcgcg

SEQ ID NO: 575644 - DNA, 20 bp, mouse
ggccgcttgggactcgccct

SEQ ID NO: 575645 - DNA, 20 bp, mouse
gccgcccggggaccacgcag

SEQ ID NO: 575646 - DNA, 20 bp, mouse
gacgggcagccacagagggg

SEQ ID NO: 575647 - DNA, 20 bp, mouse
ggaggggcggcgctgcatgt

SEQ ID NO: 575648 - DNA, 20 bp, mouse
ggtcgacagacttcaggctg

SEQ ID NO: 575649 - DNA, 20 bp, mouse
ggcgggacgaccagagagag

SEQ ID NO: 575650 - DNA, 20 bp, mouse
gatgcagcgccgcccctctg

SEQ ID NO: 575651 - DNA, 20 bp, mouse
ggcagtagtcgacagacttc

SEQ ID NO: 575652 - DNA, 20 bp, mouse
gccgcagggcgagcaccggg

SEQ ID NO: 575653 - DNA, 20 bp, mouse
gttgctggcgccagccaccg

SEQ ID NO: 575654 - DNA, 20 bp, mouse
gctgctgctgtacgccgcgg

SEQ ID NO: 575655 - DNA, 20 bp, mouse
gtcgccgagcgggcgcgatg

SEQ ID NO: 575656 - DNA, 20 bp, mouse
gcagcgtagggagctaactc

SEQ ID NO: 575657 - DNA, 20 bp, mouse
gaactcaggccgggtaacag

SEQ ID NO: 575658 - DNA, 20 bp, mouse
gcgggtaacagaggtgtggt

SEQ ID NO: 575659 - DNA, 20 bp, mouse
gcggtcagggataagactgg

SEQ ID NO: 575660 - DNA, 20 bp, mouse
gctgctctgagactcctctg

SEQ ID NO: 575661 - DNA, 20 bp, mouse
gggtggaatccgagcctcag

SEQ ID NO: 575662 - DNA, 20 bp, mouse
ggaggagaggtgaggaccag

SEQ ID NO: 575663 - DNA, 20 bp, mouse
gaagagggaagtccagacag

SEQ ID NO: 575664 - DNA, 20 bp, mouse
gggaaagccaggcccgactt

SEQ ID NO: 575665 - DNA, 20 bp, mouse
gtctgaaccagagataatgt

SEQ ID NO: 575666 - DNA, 20 bp, mouse
ggttagagccagcgaagtgc

SEQ ID NO: 575667 - DNA, 20 bp, mouse
gtagaggaggcccagacggg

SEQ ID NO: 575668 - DNA, 20 bp, mouse
gtcaagcccccgatgccgaa

SEQ ID NO: 575669 - DNA, 20 bp, mouse
ggccgaacggagcgcaactt

SEQ ID NO: 575670 - DNA, 20 bp, mouse
gcggctcccaacgggaacag

SEQ ID NO: 575671 - DNA, 20 bp, mouse
gcggcgagggaggaacacgg

SEQ ID NO: 575672 - DNA, 20 bp, mouse
gaagcggcgagggaggaaca

SEQ ID NO: 575673 - DNA, 20 bp, mouse
ggccaaagttgcgctccgtt

SEQ ID NO: 575674 - DNA, 20 bp, mouse
ggcgctccgttcggcatcgg

SEQ ID NO: 575675 - DNA, 20 bp, mouse
ggggccgggccaaagtgacg

SEQ ID NO: 575676 - DNA, 20 bp, mouse
gtgtgtgcgcgaggagcgag

SEQ ID NO: 575677 - DNA, 20 bp, mouse
gaggatgccccgatccccaa

SEQ ID NO: 575678 - DNA, 20 bp, mouse
gcagccggctggagccccgg

SEQ ID NO: 575679 - DNA, 20 bp, mouse
ggcgcacacaatgaagctgc

SEQ ID NO: 575680 - DNA, 20 bp, mouse
gatgccccgatccccaacgg

SEQ ID NO: 575681 - DNA, 20 bp, mouse
ggctggcagggaagtagtgc

SEQ ID NO: 575682 - DNA, 20 bp, mouse
gcgagcgagcgcgccgggga

SEQ ID NO: 575683 - DNA, 20 bp, mouse
gcgacccccacgggcgagga

SEQ ID NO: 575684 - DNA, 20 bp, mouse
gaggggcgcggagtcagctg

SEQ ID NO: 575685 - DNA, 20 bp, mouse
ggcgccccgactctccccgg

SEQ ID NO: 575686 - DNA, 20 bp, mouse
gggaggaggaggtgttaata

SEQ ID NO: 575687 - DNA, 20 bp, mouse
gggctcgaccggggcggtga

SEQ ID NO: 575688 - DNA, 20 bp, mouse
gctgcgctacggctcgaccg

SEQ ID NO: 575689 - DNA, 20 bp, mouse
ggaaagggcccgagttactg

SEQ ID NO: 575690 - DNA, 20 bp, mouse
ggagaggtggcgtcagggaa

SEQ ID NO: 575691 - DNA, 20 bp, mouse
gtcgaccggggcggtgatgg

SEQ ID NO: 575692 - DNA, 20 bp, mouse
ggccgggcatggtagaggag

SEQ ID NO: 575693 - DNA, 20 bp, mouse
gagagccgatcggccaacgg

SEQ ID NO: 575694 - DNA, 20 bp, mouse
ggtgtggggcgactgcgcta

SEQ ID NO: 575695 - DNA, 20 bp, mouse
ggcagcgacgacgagcacgg

SEQ ID NO: 575696 - DNA, 20 bp, mouse
gggccctgcgccagagaacg

SEQ ID NO: 575697 - DNA, 20 bp, mouse
ggcacagggcgagtgggcgg

SEQ ID NO: 575698 - DNA, 20 bp, mouse
gccagcccgggtcactttcg

SEQ ID NO: 575699 - DNA, 20 bp, mouse
gagagcaggaacggcgacct

SEQ ID NO: 575700 - DNA, 20 bp, mouse
gcggggctgtagcgggcaca

SEQ ID NO: 575701 - DNA, 20 bp, mouse
gcagccggaggaagactacc

SEQ ID NO: 575702 - DNA, 20 bp, mouse
gtgcgggactgccccagctg

SEQ ID NO: 575703 - DNA, 20 bp, mouse
ggctcctcggagacccctgt

SEQ ID NO: 575704 - DNA, 20 bp, mouse
gtcactttcggggctgtagc

SEQ ID NO: 575705 - DNA, 20 bp, mouse
gacccgggctgggagccgag

SEQ ID NO: 575706 - DNA, 20 bp, mouse
gccccatggtgagggagagt

SEQ ID NO: 575707 - DNA, 20 bp, mouse
ggcctactctccctcaccat

SEQ ID NO: 575708 - DNA, 20 bp, mouse
gtgagggagagtaggcgccg

SEQ ID NO: 575709 - DNA, 20 bp, mouse
gtgtggtcgcctggctaaca

SEQ ID NO: 575710 - DNA, 20 bp, mouse
gggagagtaggcgccgcggg

SEQ ID NO: 575711 - DNA, 20 bp, mouse
gttgtccctcccgccccccg

SEQ ID NO: 575712 - DNA, 20 bp, mouse
gccctagcggccgcatcacg

SEQ ID NO: 575713 - DNA, 20 bp, mouse
gctgtccaaggagatcctag

SEQ ID NO: 575714 - DNA, 20 bp, mouse
gttgctgttccccatggtga

SEQ ID NO: 575715 - DNA, 20 bp, mouse
gtcggagtccgggaaaaact

SEQ ID NO: 575716 - DNA, 20 bp, mouse
gtactggaggcaccaactgg

SEQ ID NO: 575717 - DNA, 20 bp, mouse
gtggaggcaccaactggagg

SEQ ID NO: 575718 - DNA, 20 bp, mouse
gttgtactggaggcaccaac

SEQ ID NO: 575719 - DNA, 20 bp, mouse
ggctgggtccctcctccagt

SEQ ID NO: 575720 - DNA, 20 bp, mouse
gaggcagccagcagtggaag

SEQ ID NO: 575721 - DNA, 20 bp, mouse
gcagggccactatcactgta

SEQ ID NO: 575722 - DNA, 20 bp, mouse
gcctctttgagaagttgtac

SEQ ID NO: 575723 - DNA, 20 bp, mouse
gcctgcctccaggttctgca

SEQ ID NO: 575724 - DNA, 20 bp, mouse
gggtggacctaaggtaagag

SEQ ID NO: 575725 - DNA, 20 bp, mouse
gcaggaagctgccacttctg

SEQ ID NO: 575726 - DNA, 20 bp, mouse
gagcatagcctacagacttc

SEQ ID NO: 575727 - DNA, 20 bp, mouse
gataggaatgcaaaaaactg

SEQ ID NO: 575728 - DNA, 20 bp, mouse
gagcagctgtgtaaaccatg

SEQ ID NO: 575729 - DNA, 20 bp, mouse
ggaatgcaaaaaactgtggc

SEQ ID NO: 575730 - DNA, 20 bp, mouse
gctattactctctgaaaacg

SEQ ID NO: 575731 - DNA, 20 bp, mouse
gtactctctgaaaacggggc

SEQ ID NO: 575732 - DNA, 20 bp, mouse
gggtttacacagctgctttc

SEQ ID NO: 575733 - DNA, 20 bp, mouse
gagaagtggagcaggattaa

SEQ ID NO: 575734 - DNA, 20 bp, mouse
gatacttgccagaagtctgt

SEQ ID NO: 575735 - DNA, 20 bp, mouse
gaggagaggcatgagggtat

SEQ ID NO: 575736 - DNA, 20 bp, mouse
gccccgtgcccgagtgacag

SEQ ID NO: 575737 - DNA, 20 bp, mouse
gactcgcgccgctgtcactc

SEQ ID NO: 575738 - DNA, 20 bp, mouse
gtgacagcggcgcgagtgca

SEQ ID NO: 575739 - DNA, 20 bp, mouse
gcggcgcgagtgcagggcag

SEQ ID NO: 575740 - DNA, 20 bp, mouse
gtgtggagctacctcagagc

SEQ ID NO: 575741 - DNA, 20 bp, mouse
gccccgtcttcctaggacag

SEQ ID NO: 575742 - DNA, 20 bp, mouse
gcgagctgccagcgcgactc

SEQ ID NO: 575743 - DNA, 20 bp, mouse
gcaggggacccgagtcgcgc

SEQ ID NO: 575744 - DNA, 20 bp, mouse
gagcggctccccgtcttcct

SEQ ID NO: 575745 - DNA, 20 bp, mouse
ggtcgcgctggcagctcgag

SEQ ID NO: 575746 - DNA, 20 bp, mouse
gtcggtggtgctgagatgtt

SEQ ID NO: 575747 - DNA, 20 bp, mouse
gctggccgtgcccacatcca

SEQ ID NO: 575748 - DNA, 20 bp, mouse
gaacttcaactgcgcttcgg

SEQ ID NO: 575749 - DNA, 20 bp, mouse
gtagggagagggcttcagta

SEQ ID NO: 575750 - DNA, 20 bp, mouse
ggcccccgtaaagaaagact

SEQ ID NO: 575751 - DNA, 20 bp, mouse
gtgaagttgatgctctaaag

SEQ ID NO: 575752 - DNA, 20 bp, mouse
gtaaagcccgccatactcag

SEQ ID NO: 575753 - DNA, 20 bp, mouse
gccctcctgtagtacctcaa

SEQ ID NO: 575754 - DNA, 20 bp, mouse
gtcctagtctttctttacgg

SEQ ID NO: 575755 - DNA, 20 bp, mouse
ggtgctagaggaaataaggt

SEQ ID NO: 575756 - DNA, 20 bp, mouse
ggagccagagaaggatcctc

SEQ ID NO: 575757 - DNA, 20 bp, mouse
gcttctctggctccaattcc

SEQ ID NO: 575758 - DNA, 20 bp, mouse
gctcgggctaggttgagggt

SEQ ID NO: 575759 - DNA, 20 bp, mouse
gagagaaggatcctcgggct

SEQ ID NO: 575760 - DNA, 20 bp, mouse
gctctgggacactcagcaac

SEQ ID NO: 575761 - DNA, 20 bp, mouse
ggcggagtagatgagtcctg

SEQ ID NO: 575762 - DNA, 20 bp, mouse
ggatcctcgggctaggttga

SEQ ID NO: 575763 - DNA, 20 bp, mouse
gagaaacctaaaggaatcag

SEQ ID NO: 575764 - DNA, 20 bp, mouse
gtgtcagatacaagatggag

SEQ ID NO: 575765 - DNA, 20 bp, mouse
ggcctctgcagaaaacgaga

SEQ ID NO: 575766 - DNA, 20 bp, mouse
gtagtgggcacggtgatcgg

SEQ ID NO: 575767 - DNA, 20 bp, mouse
gccccatagccgggttctgg

SEQ ID NO: 575768 - DNA, 20 bp, mouse
gtgcactccaggccactccg

SEQ ID NO: 575769 - DNA, 20 bp, mouse
gcgctcgagtagcgtgaacg

SEQ ID NO: 575770 - DNA, 20 bp, mouse
gacgctactcgagcgcacgt

SEQ ID NO: 575771 - DNA, 20 bp, mouse
ggcagaaagcggctcatccc

SEQ ID NO: 575772 - DNA, 20 bp, mouse
gtcacacagccaccagaacc

SEQ ID NO: 575773 - DNA, 20 bp, mouse
gagccaccagaacccggcta

SEQ ID NO: 575774 - DNA, 20 bp, mouse
gtgggcagcgcgttcgtccg

SEQ ID NO: 575775 - DNA, 20 bp, mouse
gtggggaaaagggtgtccgt

SEQ ID NO: 575776 - DNA, 20 bp, mouse
gctacacgcgaaggactctg

SEQ ID NO: 575777 - DNA, 20 bp, mouse
gccagtgcaccgggcccgga

SEQ ID NO: 575778 - DNA, 20 bp, mouse
gctctgggccaagaaaccag

SEQ ID NO: 575779 - DNA, 20 bp, mouse
gaggtggccccatagcactc

SEQ ID NO: 575780 - DNA, 20 bp, mouse
ggccactgccataaccttcc

SEQ ID NO: 575781 - DNA, 20 bp, mouse
gtgatcaccggagcaaacag

SEQ ID NO: 575782 - DNA, 20 bp, mouse
gagtgcggccaggagcgctg

SEQ ID NO: 575783 - DNA, 20 bp, mouse
gcaggttccggagtgctatg

SEQ ID NO: 575784 - DNA, 20 bp, mouse
gggaagacagtgctgatcac

SEQ ID NO: 575785 - DNA, 20 bp, mouse
ggttatggcagtggctagtg

SEQ ID NO: 575786 - DNA, 20 bp, mouse
gtctgcgcttcttcagggtg

SEQ ID NO: 575787 - DNA, 20 bp, mouse
ggcaccaacaggactctcat

SEQ ID NO: 575788 - DNA, 20 bp, mouse
ggaacaccaacagcaccaac

SEQ ID NO: 575789 - DNA, 20 bp, mouse
gcaattcctggtgggggtca

SEQ ID NO: 575790 - DNA, 20 bp, mouse
ggtagtcttgaaacaattcc

SEQ ID NO: 575791 - DNA, 20 bp, mouse
ggtgttctctatgtgtgtga

SEQ ID NO: 575792 - DNA, 20 bp, mouse
gttgaaacaattcctggtgg

SEQ ID NO: 575793 - DNA, 20 bp, mouse
gaattgtttcaagactacac

SEQ ID NO: 575794 - DNA, 20 bp, mouse
ggtcttgaaacaattcctgg

SEQ ID NO: 575795 - DNA, 20 bp, mouse
ggccatgtggctctacctgg

SEQ ID NO: 575796 - DNA, 20 bp, mouse
gcagtcccaccagtgatact

SEQ ID NO: 575797 - DNA, 20 bp, mouse
gtggctctacctagtatcac

SEQ ID NO: 575798 - DNA, 20 bp, mouse
gtctacctagtatcactggt

SEQ ID NO: 575799 - DNA, 20 bp, mouse
gcaggaaagtgtaaacatcc

SEQ ID NO: 575800 - DNA, 20 bp, mouse
gctctgtgtcaaaatgcggc

SEQ ID NO: 575801 - DNA, 20 bp, mouse
ggaagacatacttgtcttgg

SEQ ID NO: 575802 - DNA, 20 bp, mouse
gtcccagcaggaatcgttcc

SEQ ID NO: 575803 - DNA, 20 bp, mouse
gtcctggaacgattcctgct

SEQ ID NO: 575804 - DNA, 20 bp, mouse
gtgtcagcagggtggtgtcc

SEQ ID NO: 575805 - DNA, 20 bp, mouse
ggacatacttgtcttggagg

SEQ ID NO: 575806 - DNA, 20 bp, mouse
gccttagctgtagctagtgt

SEQ ID NO: 575807 - DNA, 20 bp, mouse
ggtccacccactccagactt

SEQ ID NO: 575808 - DNA, 20 bp, mouse
gtacagctaaggccaaagtc

SEQ ID NO: 575809 - DNA, 20 bp, mouse
gctaaggccaaagtctggag

SEQ ID NO: 575810 - DNA, 20 bp, mouse
gctttgctcctagacttccc

SEQ ID NO: 575811 - DNA, 20 bp, mouse
gtaaggatggcgtatagtgg

SEQ ID NO: 575812 - DNA, 20 bp, mouse
gacacggagatgggtctggt

SEQ ID NO: 575813 - DNA, 20 bp, mouse
ggttgtggagatcaagggga

SEQ ID NO: 575814 - DNA, 20 bp, mouse
gaaacctgagctggtcctgt

SEQ ID NO: 575815 - DNA, 20 bp, mouse
gagtgggtggactctcgctg

SEQ ID NO: 575816 - DNA, 20 bp, mouse
gtataggcactgagaatgtc

SEQ ID NO: 575817 - DNA, 20 bp, mouse
ggatatcagaaaacccatac

SEQ ID NO: 575818 - DNA, 20 bp, mouse
gctgatatctcaatgccctt

SEQ ID NO: 575819 - DNA, 20 bp, mouse
gtaccttcctgtgtaagcag

SEQ ID NO: 575820 - DNA, 20 bp, mouse
gcccattagggatctggcca

SEQ ID NO: 575821 - DNA, 20 bp, mouse
gatctggccagggagtataa

SEQ ID NO: 575822 - DNA, 20 bp, mouse
ggggaggcccccttcaaaca

SEQ ID NO: 575823 - DNA, 20 bp, mouse
gcatgttcctctgaccagta

SEQ ID NO: 575824 - DNA, 20 bp, mouse
ggccagggagtataaagggg

SEQ ID NO: 575825 - DNA, 20 bp, mouse
gtccctggccagatccctaa

SEQ ID NO: 575826 - DNA, 20 bp, mouse
gagcggacggtgctcatctc

SEQ ID NO: 575827 - DNA, 20 bp, mouse
gcagcatggcctctcagcag

SEQ ID NO: 575828 - DNA, 20 bp, mouse
gatggcctctcagcagcgga

SEQ ID NO: 575829 - DNA, 20 bp, mouse
gcatctctggctgctcttcg

SEQ ID NO: 575830 - DNA, 20 bp, mouse
gcagctgaagcgctagttca

SEQ ID NO: 575831 - DNA, 20 bp, mouse
gtcagctggctcatgacccc

SEQ ID NO: 575832 - DNA, 20 bp, mouse
ggttcctgagaggatcagca

SEQ ID NO: 575833 - DNA, 20 bp, mouse
gaccccaggcagcgttacca

SEQ ID NO: 575834 - DNA, 20 bp, mouse
ggagctgagagagtgtagca

SEQ ID NO: 575835 - DNA, 20 bp, mouse
gaggccatgctgatcctctc

SEQ ID NO: 575836 - DNA, 20 bp, mouse
gtgctcacacaggaaggtgt

SEQ ID NO: 575837 - DNA, 20 bp, mouse
gactatgtggctctttctag

SEQ ID NO: 575838 - DNA, 20 bp, mouse
gtgtaggcattgacgattcc

SEQ ID NO: 575839 - DNA, 20 bp, mouse
gaatagttatagggatgcag

SEQ ID NO: 575840 - DNA, 20 bp, mouse
gttggcttctacaaactatg

SEQ ID NO: 575841 - DNA, 20 bp, mouse
ggtagtcctggaaagattcc

SEQ ID NO: 575842 - DNA, 20 bp, mouse
ggagtatctctctctctgct

SEQ ID NO: 575843 - DNA, 20 bp, mouse
gggacttcacatcagaagcc

SEQ ID NO: 575844 - DNA, 20 bp, mouse
gtggctctttctagtggcac

SEQ ID NO: 575845 - DNA, 20 bp, mouse
gtctttctagtggcactggt

SEQ ID NO: 575846 - DNA, 20 bp, mouse
gataggaatgcaaaaaactg

SEQ ID NO: 575847 - DNA, 20 bp, mouse
gagcatagcctacagacttc

SEQ ID NO: 575848 - DNA, 20 bp, mouse
ggaatgcaaaaaactgtggc

SEQ ID NO: 575849 - DNA, 20 bp, mouse
gagcagctgtgtaaaccatg

SEQ ID NO: 575850 - DNA, 20 bp, mouse
gctattactctctgaaaacg

SEQ ID NO: 575851 - DNA, 20 bp, mouse
gtactctctgaaaacggggc

SEQ ID NO: 575852 - DNA, 20 bp, mouse
gggtttacacagctgctttc

SEQ ID NO: 575853 - DNA, 20 bp, mouse
gatacttgccagaagtctgt

SEQ ID NO: 575854 - DNA, 20 bp, mouse
gaggagaggcatgagggtat

SEQ ID NO: 575855 - DNA, 20 bp, mouse
ggtttgtctccctgtttgaa

SEQ ID NO: 575856 - DNA, 20 bp, mouse
gaggcgcactggctttacca

SEQ ID NO: 575857 - DNA, 20 bp, mouse
gggaagcactcccttcactg

SEQ ID NO: 575858 - DNA, 20 bp, mouse
gtagcactggagctaatgtg

SEQ ID NO: 575859 - DNA, 20 bp, mouse
gccgcgtgggcgcagaggaa

SEQ ID NO: 575860 - DNA, 20 bp, mouse
ggtgaagggagtgcttccag

SEQ ID NO: 575861 - DNA, 20 bp, mouse
gaaactttgtcgctctgggt

SEQ ID NO: 575862 - DNA, 20 bp, mouse
gggtggtgtactcaatgaag

SEQ ID NO: 575863 - DNA, 20 bp, mouse
gcgcactggctttaccatgg

SEQ ID NO: 575864 - DNA, 20 bp, mouse
ggagtgcttccagcggagaa

SEQ ID NO: 575865 - DNA, 20 bp, mouse
gtgcagcgttcgggaagact

SEQ ID NO: 575866 - DNA, 20 bp, mouse
gcggcgaacgagcggagagt

SEQ ID NO: 575867 - DNA, 20 bp, mouse
gcgaacgagcggagagtcgg

SEQ ID NO: 575868 - DNA, 20 bp, mouse
gctgcggcgcgtcttctctc

SEQ ID NO: 575869 - DNA, 20 bp, mouse
gcggcgcgtcttctctcagg

SEQ ID NO: 575870 - DNA, 20 bp, mouse
gcatattgccgagctgtctg

SEQ ID NO: 575871 - DNA, 20 bp, mouse
ggagccccgggcccagtcca

SEQ ID NO: 575872 - DNA, 20 bp, mouse
gattgccgagctgtctgcgg

SEQ ID NO: 575873 - DNA, 20 bp, mouse
gtcttctctcaggcggctca

SEQ ID NO: 575874 - DNA, 20 bp, mouse
gccccgccgaggcgctgagg

SEQ ID NO: 575875 - DNA, 20 bp, mouse
gcggcgcggcgggagactcc

SEQ ID NO: 575876 - DNA, 20 bp, mouse
gagctcaacgacgacgacta

SEQ ID NO: 575877 - DNA, 20 bp, mouse
gtcaacgacgacgactacgg

SEQ ID NO: 575878 - DNA, 20 bp, mouse
gcgggcagcagagtcgaaga

SEQ ID NO: 575879 - DNA, 20 bp, mouse
gggagctccaagaaaaaccc

SEQ ID NO: 575880 - DNA, 20 bp, mouse
gtgcctggacagaatcctga

SEQ ID NO: 575881 - DNA, 20 bp, mouse
gttctgtccaggcagagatg

SEQ ID NO: 575882 - DNA, 20 bp, mouse
ggtgcagggaaggtgaaccc

SEQ ID NO: 575883 - DNA, 20 bp, mouse
gaggtcctgtcgccctccag

SEQ ID NO: 575884 - DNA, 20 bp, mouse
gtgcacctgatcccgctgga

SEQ ID NO: 575885 - DNA, 20 bp, mouse
gaaggcctcttgaccagaag

SEQ ID NO: 575886 - DNA, 20 bp, mouse
ggctgggtccgagcatcccg

SEQ ID NO: 575887 - DNA, 20 bp, mouse
ggacccacccggcccggaca

SEQ ID NO: 575888 - DNA, 20 bp, mouse
gctggtgccaggggttgcta

SEQ ID NO: 575889 - DNA, 20 bp, mouse
ggcctggccgtagcaacccc

SEQ ID NO: 575890 - DNA, 20 bp, mouse
gccggacgctcgccatgtcc

SEQ ID NO: 575891 - DNA, 20 bp, mouse
gccgcggcttcggacccacc

SEQ ID NO: 575892 - DNA, 20 bp, mouse
gttcagggagaagaagacga

SEQ ID NO: 575893 - DNA, 20 bp, mouse
gcagagagccaaggcgccgg

SEQ ID NO: 575894 - DNA, 20 bp, mouse
gtccgaagccgcgggatgct

SEQ ID NO: 575895 - DNA, 20 bp, mouse
gccgccgcccgcgggtctgg

SEQ ID NO: 575896 - DNA, 20 bp, mouse
ggcggctgacaggttcgtgg

SEQ ID NO: 575897 - DNA, 20 bp, mouse
gcggacccacgcgccggaac

SEQ ID NO: 575898 - DNA, 20 bp, mouse
gggagcggctgacaggttcg

SEQ ID NO: 575899 - DNA, 20 bp, mouse
gcccgccggctccacagacg

SEQ ID NO: 575900 - DNA, 20 bp, mouse
gagggtgggcgctgcatgcc

SEQ ID NO: 575901 - DNA, 20 bp, mouse
gaaggtttttacgcgcggag

SEQ ID NO: 575902 - DNA, 20 bp, mouse
gttcgtggtggtgccggttc

SEQ ID NO: 575903 - DNA, 20 bp, mouse
gggcgctgcatgccgggcgg

SEQ ID NO: 575904 - DNA, 20 bp, mouse
gtccgcggctgtctgctggg

SEQ ID NO: 575905 - DNA, 20 bp, mouse
gccttccgcactgatgacag

SEQ ID NO: 575906 - DNA, 20 bp, mouse
gcgcgcgcggctacaggagt

SEQ ID NO: 575907 - DNA, 20 bp, mouse
gacggtcgcgagccgctcca

SEQ ID NO: 575908 - DNA, 20 bp, mouse
gcggcacctgaagagacccg

SEQ ID NO: 575909 - DNA, 20 bp, mouse
gggcagaagtcggcggtcag

SEQ ID NO: 575910 - DNA, 20 bp, mouse
gtaaggacaggactttacgg

SEQ ID NO: 575911 - DNA, 20 bp, mouse
gggctggtggaccagggaca

SEQ ID NO: 575912 - DNA, 20 bp, mouse
gtcctgtagccgcgcgcgaa

SEQ ID NO: 575913 - DNA, 20 bp, mouse
gctctcctagggggatgtgg

SEQ ID NO: 575914 - DNA, 20 bp, mouse
ggcgacggccagcgaaggtg

SEQ ID NO: 575915 - DNA, 20 bp, mouse
ggagacccgcggtgagcact

SEQ ID NO: 575916 - DNA, 20 bp, mouse
gacttcgctgacttctcggg

SEQ ID NO: 575917 - DNA, 20 bp, mouse
gggcttctgagttcgagtta

SEQ ID NO: 575918 - DNA, 20 bp, mouse
gtctacttcgctgacttctc

SEQ ID NO: 575919 - DNA, 20 bp, mouse
gggctcagaggaggaacggg

SEQ ID NO: 575920 - DNA, 20 bp, mouse
gtcagcacgggacggaagta

SEQ ID NO: 575921 - DNA, 20 bp, mouse
gaaacgtcatcagcacggga

SEQ ID NO: 575922 - DNA, 20 bp, mouse
gggacggaagtaaggtcttg

SEQ ID NO: 575923 - DNA, 20 bp, mouse
ggctgacttctcgggcggtt

SEQ ID NO: 575924 - DNA, 20 bp, mouse
gggtcggcgtccttgatgaa

SEQ ID NO: 575925 - DNA, 20 bp, mouse
gtggcttcgcttctagaaca

SEQ ID NO: 575926 - DNA, 20 bp, mouse
ggcgggtgcgctcagtctgg

SEQ ID NO: 575927 - DNA, 20 bp, mouse
gctcagtctggcggcagcgg

SEQ ID NO: 575928 - DNA, 20 bp, mouse
gtggcgcggcccggattgct

SEQ ID NO: 575929 - DNA, 20 bp, mouse
ggcgctcagtctggcggcag

SEQ ID NO: 575930 - DNA, 20 bp, mouse
gacagacagacagacgtgcc

SEQ ID NO: 575931 - DNA, 20 bp, mouse
ggctagctattaatacccgg

SEQ ID NO: 575932 - DNA, 20 bp, mouse
gcgcgacgctacagacccat

SEQ ID NO: 575933 - DNA, 20 bp, mouse
ggcgggcggtgctgcgctcc

SEQ ID NO: 575934 - DNA, 20 bp, mouse
gcgggcgggtgcgctcagtc

SEQ ID NO: 575935 - DNA, 20 bp, mouse
gtgcgcccgcggctacccat

SEQ ID NO: 575936 - DNA, 20 bp, mouse
gcaggagccgctgttagcag

SEQ ID NO: 575937 - DNA, 20 bp, mouse
gccgctgccgctgctaacag

SEQ ID NO: 575938 - DNA, 20 bp, mouse
gtgcccgaggccggcggctg

SEQ ID NO: 575939 - DNA, 20 bp, mouse
ggcagctgcatccatacccc

SEQ ID NO: 575940 - DNA, 20 bp, mouse
gggatgcagctgcccgaggc

SEQ ID NO: 575941 - DNA, 20 bp, mouse
ggcagcggctttggggtcag

SEQ ID NO: 575942 - DNA, 20 bp, mouse
ggcagggacctcccctttaa

SEQ ID NO: 575943 - DNA, 20 bp, mouse
ggtatggatgcagctgcccg

SEQ ID NO: 575944 - DNA, 20 bp, mouse
gtgtctggggacaccactta

SEQ ID NO: 575945 - DNA, 20 bp, mouse
gaccaggcgagagatgatcc

SEQ ID NO: 575946 - DNA, 20 bp, mouse
gacaccgggccggctcccga

SEQ ID NO: 575947 - DNA, 20 bp, mouse
gtccccgctcgcgctccccg

SEQ ID NO: 575948 - DNA, 20 bp, mouse
gggcaccgcgcgcacacacc

SEQ ID NO: 575949 - DNA, 20 bp, mouse
ggcgtagccgaggagcggag

SEQ ID NO: 575950 - DNA, 20 bp, mouse
gagggcgcgggcgaacggac

SEQ ID NO: 575951 - DNA, 20 bp, mouse
gccgatgggccgctgaccgc

SEQ ID NO: 575952 - DNA, 20 bp, mouse
gcccgcagcgactgggacac

SEQ ID NO: 575953 - DNA, 20 bp, mouse
gcagtcgctgcggggctccg

SEQ ID NO: 575954 - DNA, 20 bp, mouse
gacggctcgggagatcatcc

SEQ ID NO: 575955 - DNA, 20 bp, mouse
gcgagccgtggtgtaagtac

SEQ ID NO: 575956 - DNA, 20 bp, mouse
gctctcacctgccgcccggg

SEQ ID NO: 575957 - DNA, 20 bp, mouse
ggggcgctctgccacccggg

SEQ ID NO: 575958 - DNA, 20 bp, mouse
gtgctggtctcgggtccggg

SEQ ID NO: 575959 - DNA, 20 bp, mouse
gcccggaaccaggggaccga

SEQ ID NO: 575960 - DNA, 20 bp, mouse
ggagaccggtgcaggtggtc

SEQ ID NO: 575961 - DNA, 20 bp, mouse
ggggaccgagggcctagcag

SEQ ID NO: 575962 - DNA, 20 bp, mouse
ggtcgggcgctctgccaccc

SEQ ID NO: 575963 - DNA, 20 bp, mouse
ggccccgagaccggtgcagg

SEQ ID NO: 575964 - DNA, 20 bp, mouse
gcgcaatggagccctcagag

SEQ ID NO: 575965 - DNA, 20 bp, mouse
gcaggagaacccggaaccag

SEQ ID NO: 575966 - DNA, 20 bp, mouse
gcggtcgaacctctccctca

SEQ ID NO: 575967 - DNA, 20 bp, mouse
gcgcggaacccagctgaccg

SEQ ID NO: 575968 - DNA, 20 bp, mouse
gggctgcggagcatcccggg

SEQ ID NO: 575969 - DNA, 20 bp, mouse
gccaagctcgaggccaagac

SEQ ID NO: 575970 - DNA, 20 bp, mouse
ggcatcccgggcggcgcgaa

SEQ ID NO: 575971 - DNA, 20 bp, mouse
gagcgcagtgagccgggtat

SEQ ID NO: 575972 - DNA, 20 bp, mouse
gggacactcgcggccggcag

SEQ ID NO: 575973 - DNA, 20 bp, mouse
gaaacctcgtgcacgagccg

SEQ ID NO: 575974 - DNA, 20 bp, mouse
ggtcctgggacactcgcggc

SEQ ID NO: 575975 - DNA, 20 bp, mouse
gggccaagaccggagtgaac

SEQ ID NO: 575976 - DNA, 20 bp, mouse
gcgctggcgcagaccgtcca

SEQ ID NO: 575977 - DNA, 20 bp, mouse
gcgcccgccgctgccatgga

SEQ ID NO: 575978 - DNA, 20 bp, mouse
gggtgaaagtgcgctctcgg

SEQ ID NO: 575979 - DNA, 20 bp, mouse
gccatgcggccggggagacg

SEQ ID NO: 575980 - DNA, 20 bp, mouse
gccctctccaggctcacccg

SEQ ID NO: 575981 - DNA, 20 bp, mouse
gagggcagggcggacaaagg

SEQ ID NO: 575982 - DNA, 20 bp, mouse
ggcgccggtgcgcgaggttg

SEQ ID NO: 575983 - DNA, 20 bp, mouse
ggggcgctcgaagcaaggac

SEQ ID NO: 575984 - DNA, 20 bp, mouse
gtctggccaatgggagggca

SEQ ID NO: 575985 - DNA, 20 bp, mouse
gcaggacccaagttctgact

SEQ ID NO: 575986 - DNA, 20 bp, mouse
gtatctgaggatcacaacaa

SEQ ID NO: 575987 - DNA, 20 bp, mouse
gctttcctgacaagacacct

SEQ ID NO: 575988 - DNA, 20 bp, mouse
ggttgtgatcctcagatata

SEQ ID NO: 575989 - DNA, 20 bp, mouse
gcatgagagcaggatgaagt

SEQ ID NO: 575990 - DNA, 20 bp, mouse
ggtcttgtcaggaaaggaaa

SEQ ID NO: 575991 - DNA, 20 bp, mouse
ggttagtctccttatatctg

SEQ ID NO: 575992 - DNA, 20 bp, mouse
gcaccttggtctcagcctgc

SEQ ID NO: 575993 - DNA, 20 bp, mouse
gtgagaatcgatgagcaaag

SEQ ID NO: 575994 - DNA, 20 bp, mouse
gatcgattctcagtgcagga

SEQ ID NO: 575995 - DNA, 20 bp, mouse
gtaggtaaaagtgctcacct

SEQ ID NO: 575996 - DNA, 20 bp, mouse
gatactgcctggctacgtaa

SEQ ID NO: 575997 - DNA, 20 bp, mouse
gtaagtatatggggatacaa

SEQ ID NO: 575998 - DNA, 20 bp, mouse
gagaagtactggtctaccag

SEQ ID NO: 575999 - DNA, 20 bp, mouse
gtgcctggctacgtaatggt

SEQ ID NO: 576000 - DNA, 20 bp, mouse
gcaggcataagaacaggata

SEQ ID NO: 576001 - DNA, 20 bp, mouse
ggcactcttacctgtcagct

SEQ ID NO: 576002 - DNA, 20 bp, mouse
gttcattattcctagctgac

SEQ ID NO: 576003 - DNA, 20 bp, mouse
gcttctcacactaagaactc

SEQ ID NO: 576004 - DNA, 20 bp, mouse
gaggaataatgaatactgcc

SEQ ID NO: 576005 - DNA, 20 bp, mouse
ggctgtatgacaggaacatc

SEQ ID NO: 576006 - DNA, 20 bp, mouse
ggtaagtgggagctgaatga

SEQ ID NO: 576007 - DNA, 20 bp, mouse
gctctacaagagaggtaagt

SEQ ID NO: 576008 - DNA, 20 bp, mouse
gagatggtttgtcaggacaa

SEQ ID NO: 576009 - DNA, 20 bp, mouse
gctcttgtagagatctgaga

SEQ ID NO: 576010 - DNA, 20 bp, mouse
gctctatagtaagagacaca

SEQ ID NO: 576011 - DNA, 20 bp, mouse
gtctgggcaaggaaaaacat

SEQ ID NO: 576012 - DNA, 20 bp, mouse
ggctttatgataggatttga

SEQ ID NO: 576013 - DNA, 20 bp, mouse
gctccatcacagctttggat

SEQ ID NO: 576014 - DNA, 20 bp, mouse
gtcacagctttggattggtc

SEQ ID NO: 576015 - DNA, 20 bp, mouse
gtcttccccagtcattttct

SEQ ID NO: 576016 - DNA, 20 bp, mouse
ggatctctggaagacaggta

SEQ ID NO: 576017 - DNA, 20 bp, mouse
ggatgctgaaaggtaggcat

SEQ ID NO: 576018 - DNA, 20 bp, mouse
gctgaaagatgctgaaaggt

SEQ ID NO: 576019 - DNA, 20 bp, mouse
ggacacaccatccagatctc

SEQ ID NO: 576020 - DNA, 20 bp, mouse
ggaatagccagaataactct

SEQ ID NO: 576021 - DNA, 20 bp, mouse
ggggttcttctctcacacac

SEQ ID NO: 576022 - DNA, 20 bp, mouse
gtgagagttaatcaaagaag

SEQ ID NO: 576023 - DNA, 20 bp, mouse
gttaggaagttctcagggag

SEQ ID NO: 576024 - DNA, 20 bp, mouse
ggagttaatcaaagaagggg

SEQ ID NO: 576025 - DNA, 20 bp, mouse
gagaataactctaggttgtg

SEQ ID NO: 576026 - DNA, 20 bp, mouse
gtaaaacgacatctgaagta

SEQ ID NO: 576027 - DNA, 20 bp, mouse
gctctgtagtgggtagtgct

SEQ ID NO: 576028 - DNA, 20 bp, mouse
gacccactacagagagcagc

SEQ ID NO: 576029 - DNA, 20 bp, mouse
gtcctgctgctctctgtagt

SEQ ID NO: 576030 - DNA, 20 bp, mouse
gtctaaaactcagaaaaact

SEQ ID NO: 576031 - DNA, 20 bp, mouse
gctctggttccggagaaaaa

SEQ ID NO: 576032 - DNA, 20 bp, mouse
gcacttacctgtctatacag

SEQ ID NO: 576033 - DNA, 20 bp, mouse
gagggtcttgtgagacacca

SEQ ID NO: 576034 - DNA, 20 bp, mouse
gtgcagacctctgtatagac

SEQ ID NO: 576035 - DNA, 20 bp, mouse
gtggcacttcttcacttgca

SEQ ID NO: 576036 - DNA, 20 bp, mouse
ggtaagtaggaactttgtag

SEQ ID NO: 576037 - DNA, 20 bp, mouse
gatctgcaagacaggtaagt

SEQ ID NO: 576038 - DNA, 20 bp, mouse
ggtcctgacacaccatccta

SEQ ID NO: 576039 - DNA, 20 bp, mouse
gggttcaaccatcataccac

SEQ ID NO: 576040 - DNA, 20 bp, mouse
gtcctagggatctgcaagac

SEQ ID NO: 576041 - DNA, 20 bp, mouse
gcataccacaggagaaggta

SEQ ID NO: 576042 - DNA, 20 bp, mouse
gaccatcataccacaggaga

SEQ ID NO: 576043 - DNA, 20 bp, mouse
gagaaggggagaattagtgt

SEQ ID NO: 576044 - DNA, 20 bp, mouse
gacctgtcttgcagatccct

SEQ ID NO: 576045 - DNA, 20 bp, mouse
gtctcccataccttctcctg

SEQ ID NO: 576046 - DNA, 20 bp, mouse
gggcccactcaagctgaaga

SEQ ID NO: 576047 - DNA, 20 bp, mouse
gagctgcaggactctaacgt

SEQ ID NO: 576048 - DNA, 20 bp, mouse
gttcgccgtagcagggacag

SEQ ID NO: 576049 - DNA, 20 bp, mouse
gacggcgaagattacctgat

SEQ ID NO: 576050 - DNA, 20 bp, mouse
ggtagctagcagagaataac

SEQ ID NO: 576051 - DNA, 20 bp, mouse
gtgccttcttcagcttgagt

SEQ ID NO: 576052 - DNA, 20 bp, mouse
gcggagtgttgcttccaatc

SEQ ID NO: 576053 - DNA, 20 bp, mouse
gttctctgctagctacccag

SEQ ID NO: 576054 - DNA, 20 bp, mouse
gggtaatcttcgccgtagca

SEQ ID NO: 576055 - DNA, 20 bp, mouse
ggcagtagtgggttccgtgg

SEQ ID NO: 576056 - DNA, 20 bp, mouse
gccggagcgcgaagattcgg

SEQ ID NO: 576057 - DNA, 20 bp, mouse
gacgccaggacactagtgac

SEQ ID NO: 576058 - DNA, 20 bp, mouse
ggtgtgagccgcaaacccag

SEQ ID NO: 576059 - DNA, 20 bp, mouse
gtgaccggagcgcgaagatt

SEQ ID NO: 576060 - DNA, 20 bp, mouse
ggctccggtcactagtgtcc

SEQ ID NO: 576061 - DNA, 20 bp, mouse
gctgccgcggcatcctggca

SEQ ID NO: 576062 - DNA, 20 bp, mouse
gtcgccttgccaggatgccg

SEQ ID NO: 576063 - DNA, 20 bp, mouse
ggaaagaagaggaggcccgg

SEQ ID NO: 576064 - DNA, 20 bp, mouse
gcacggggaggagctgtcgg

SEQ ID NO: 576065 - DNA, 20 bp, mouse
ggagcgcgaagattcggggg

SEQ ID NO: 576066 - DNA, 20 bp, mouse
gtccatggtcagggtcccgg

SEQ ID NO: 576067 - DNA, 20 bp, mouse
gcgcaggccccggagctcta

SEQ ID NO: 576068 - DNA, 20 bp, mouse
gcccgcggcgcagaaagggg

SEQ ID NO: 576069 - DNA, 20 bp, mouse
gaccctgaccatggacggtg

SEQ ID NO: 576070 - DNA, 20 bp, mouse
gcgggttgctgcgcagggag

SEQ ID NO: 576071 - DNA, 20 bp, mouse
gagggcagcctcaccgtcca

SEQ ID NO: 576072 - DNA, 20 bp, mouse
gcatttccgcctctggcgaa

SEQ ID NO: 576073 - DNA, 20 bp, mouse
gggagcggcaggccggatgg

SEQ ID NO: 576074 - DNA, 20 bp, mouse
gaagtaaagccattcgccag

SEQ ID NO: 576075 - DNA, 20 bp, mouse
ggcctcaccgtccatggtca

SEQ ID NO: 576076 - DNA, 20 bp, mouse
gggcaagcggtgcaaggcta

SEQ ID NO: 576077 - DNA, 20 bp, mouse
gggtcggctgggacgatcac

SEQ ID NO: 576078 - DNA, 20 bp, mouse
gggaggagccatacacacag

SEQ ID NO: 576079 - DNA, 20 bp, mouse
gtcagggcgagcgcacacga

SEQ ID NO: 576080 - DNA, 20 bp, mouse
gcagcccgaaggccagctca

SEQ ID NO: 576081 - DNA, 20 bp, mouse
gccgctaaggagtgagaagg

SEQ ID NO: 576082 - DNA, 20 bp, mouse
gggcagtcggacagcccggt

SEQ ID NO: 576083 - DNA, 20 bp, mouse
gtacccaaggcccctagctc

SEQ ID NO: 576084 - DNA, 20 bp, mouse
gaaggctagggccgaaggcc

SEQ ID NO: 576085 - DNA, 20 bp, mouse
gggcggggcaaactcagagg

SEQ ID NO: 576086 - DNA, 20 bp, mouse
gggtagacggtgcagctcga

SEQ ID NO: 576087 - DNA, 20 bp, mouse
gcggccgcggcgtcccgggt

SEQ ID NO: 576088 - DNA, 20 bp, mouse
ggcgcacggaagggagccag

SEQ ID NO: 576089 - DNA, 20 bp, mouse
gaccccgacccgggacgccg

SEQ ID NO: 576090 - DNA, 20 bp, mouse
gcgtcccgggtcggggtaga

SEQ ID NO: 576091 - DNA, 20 bp, mouse
gcagctcgagggctgccggg

SEQ ID NO: 576092 - DNA, 20 bp, mouse
ggcaccgtctaccccgaccc

SEQ ID NO: 576093 - DNA, 20 bp, mouse
gactcaccggcggccaccag

SEQ ID NO: 576094 - DNA, 20 bp, mouse
gctcctgcattcaatccacc

SEQ ID NO: 576095 - DNA, 20 bp, mouse
ggccccggccgcggcgtccc

SEQ ID NO: 576096 - DNA, 20 bp, mouse
gtccggccgggaaaatagag

SEQ ID NO: 576097 - DNA, 20 bp, mouse
gctgggcccgcaacgcgagt

SEQ ID NO: 576098 - DNA, 20 bp, mouse
gttgcgggcccaggaccaag

SEQ ID NO: 576099 - DNA, 20 bp, mouse
ggcgcctccgaaaccgtcct

SEQ ID NO: 576100 - DNA, 20 bp, mouse
gcgggcccaggaccaagggg

SEQ ID NO: 576101 - DNA, 20 bp, mouse
ggaacccaggacggtttcgg

SEQ ID NO: 576102 - DNA, 20 bp, mouse
gagtaggcatttgggaaccc

SEQ ID NO: 576103 - DNA, 20 bp, mouse
ggacaggctccggattactc

SEQ ID NO: 576104 - DNA, 20 bp, mouse
gcaagggatgagctccggga

SEQ ID NO: 576105 - DNA, 20 bp, mouse
gcgctccgccccttggtcct

SEQ ID NO: 576106 - DNA, 20 bp, mouse
gggcgtcgcgtgcacaccgg

SEQ ID NO: 576107 - DNA, 20 bp, mouse
gaggggcgtcgcgtgcacac

SEQ ID NO: 576108 - DNA, 20 bp, mouse
ggtcgcgtgcacaccggcgg

SEQ ID NO: 576109 - DNA, 20 bp, mouse
ggagagcgcggggggaaccg

SEQ ID NO: 576110 - DNA, 20 bp, mouse
gctctctcatccactttcgg

SEQ ID NO: 576111 - DNA, 20 bp, mouse
gtttcccaagcccggccgag

SEQ ID NO: 576112 - DNA, 20 bp, mouse
ggtgccggtgcctccgaaag

SEQ ID NO: 576113 - DNA, 20 bp, mouse
gcggccaggacgagagcccg

SEQ ID NO: 576114 - DNA, 20 bp, mouse
gtaccgggacaggaatacca

SEQ ID NO: 576115 - DNA, 20 bp, mouse
gtccccccgcgctctcgctc

SEQ ID NO: 576116 - DNA, 20 bp, mouse
gcccgctaggcgagcgctcg

SEQ ID NO: 576117 - DNA, 20 bp, mouse
ggggaggacgcgcagcccgg

SEQ ID NO: 576118 - DNA, 20 bp, mouse
gaccaggatgggacgggact

SEQ ID NO: 576119 - DNA, 20 bp, mouse
gtacgcgtcccggagccccc

SEQ ID NO: 576120 - DNA, 20 bp, mouse
ggccccgagcgctcgcctag

SEQ ID NO: 576121 - DNA, 20 bp, mouse
gggacggcggcgcctcggtg

SEQ ID NO: 576122 - DNA, 20 bp, mouse
gtggtgctgcgggccaggta

SEQ ID NO: 576123 - DNA, 20 bp, mouse
gggccggcgattcattcaaa

SEQ ID NO: 576124 - DNA, 20 bp, mouse
ggcccagtcccgtcccatcc

SEQ ID NO: 576125 - DNA, 20 bp, mouse
gccgaggaagttctcctgag

SEQ ID NO: 576126 - DNA, 20 bp, mouse
gtggagaactccgctaggac

SEQ ID NO: 576127 - DNA, 20 bp, mouse
ggggtctggagaactccgct

SEQ ID NO: 576128 - DNA, 20 bp, mouse
gcggaccacactgcatgcaa

SEQ ID NO: 576129 - DNA, 20 bp, mouse
gcacactgcatgcaagggtc

SEQ ID NO: 576130 - DNA, 20 bp, mouse
gagtttaccttgacgcgtgg

SEQ ID NO: 576131 - DNA, 20 bp, mouse
gatttggggcggcgaggact

SEQ ID NO: 576132 - DNA, 20 bp, mouse
ggcggagtacccagcatttg

SEQ ID NO: 576133 - DNA, 20 bp, mouse
gtcggagcctccacgcgtca

SEQ ID NO: 576134 - DNA, 20 bp, mouse
gttctggggcgagggcgcag

SEQ ID NO: 576135 - DNA, 20 bp, mouse
ggtaaacttgcctgtcctag

SEQ ID NO: 576136 - DNA, 20 bp, mouse
ggtgctgctgagtgaggaac

SEQ ID NO: 576137 - DNA, 20 bp, mouse
ggggcaggatccaacgagaa

SEQ ID NO: 576138 - DNA, 20 bp, mouse
gccccagtggggaggcctgg

SEQ ID NO: 576139 - DNA, 20 bp, mouse
gacggaccttgacaccgaca

SEQ ID NO: 576140 - DNA, 20 bp, mouse
gaccggtgctctgagccgct

SEQ ID NO: 576141 - DNA, 20 bp, mouse
gtggcaggctctgcctaaca

SEQ ID NO: 576142 - DNA, 20 bp, mouse
gctggaagaacaaagtgcta

SEQ ID NO: 576143 - DNA, 20 bp, mouse
gcttgacaccgacatggaca

SEQ ID NO: 576144 - DNA, 20 bp, mouse
ggagaagggaagagcaaatg

SEQ ID NO: 576145 - DNA, 20 bp, mouse
gggttaacctcagccctgtt

SEQ ID NO: 576146 - DNA, 20 bp, mouse
ggcaacaagagtgcccagag

SEQ ID NO: 576147 - DNA, 20 bp, mouse
ggaaccagatggacagaagg

SEQ ID NO: 576148 - DNA, 20 bp, mouse
gtgtccatctggttcagcca

SEQ ID NO: 576149 - DNA, 20 bp, mouse
gggtggcagggtacaggaac

SEQ ID NO: 576150 - DNA, 20 bp, mouse
gccttttggccagccagtca

SEQ ID NO: 576151 - DNA, 20 bp, mouse
gttgggagactgaaggtgca

SEQ ID NO: 576152 - DNA, 20 bp, mouse
gcaaaggtagcggtgcgtgt

SEQ ID NO: 576153 - DNA, 20 bp, mouse
gtaattatggccgtccacta

SEQ ID NO: 576154 - DNA, 20 bp, mouse
gaggatcatacatccctgac

SEQ ID NO: 576155 - DNA, 20 bp, mouse
gaagaaggctcagggggtct

SEQ ID NO: 576156 - DNA, 20 bp, mouse
ggtcagctgagtgatagtca

SEQ ID NO: 576157 - DNA, 20 bp, mouse
gtcctccaggaattcagact

SEQ ID NO: 576158 - DNA, 20 bp, mouse
gactctgaagaggatcaggt

SEQ ID NO: 576159 - DNA, 20 bp, mouse
ggaaagcagatgatggacct

SEQ ID NO: 576160 - DNA, 20 bp, mouse
gcctggaggaaagcagatga

SEQ ID NO: 576161 - DNA, 20 bp, mouse
gtgtcctgtgaagtgaatca

SEQ ID NO: 576162 - DNA, 20 bp, mouse
gctctggggcctactcgagt

SEQ ID NO: 576163 - DNA, 20 bp, mouse
ggcgaccaagtctgaattcc

SEQ ID NO: 576164 - DNA, 20 bp, mouse
ggtggaatcaagtagctctg

SEQ ID NO: 576165 - DNA, 20 bp, mouse
gcggaactctgaagaggatc

SEQ ID NO: 576166 - DNA, 20 bp, mouse
ggtggtggctttaacagatg

SEQ ID NO: 576167 - DNA, 20 bp, mouse
ggaagctgaaggagtacctc

SEQ ID NO: 576168 - DNA, 20 bp, mouse
gtatatggctagccacatca

SEQ ID NO: 576169 - DNA, 20 bp, mouse
gagccacatcaaggaagctg

SEQ ID NO: 576170 - DNA, 20 bp, mouse
gctggcagaaggtaacgaag

SEQ ID NO: 576171 - DNA, 20 bp, mouse
gtcagcatgtgaatgtcacc

SEQ ID NO: 576172 - DNA, 20 bp, mouse
gcagcggatactcaaacccg

SEQ ID NO: 576173 - DNA, 20 bp, mouse
gtcacagcaggtagctccga

SEQ ID NO: 576174 - DNA, 20 bp, mouse
ggaaggtaacgaagtggacg

SEQ ID NO: 576175 - DNA, 20 bp, mouse
gacacatggcaagaacctcc

SEQ ID NO: 576176 - DNA, 20 bp, mouse
gcgccccgcagcggcgacag

SEQ ID NO: 576177 - DNA, 20 bp, mouse
gccggttccccgccccgcag

SEQ ID NO: 576178 - DNA, 20 bp, mouse
gaggccggcctggtgctcta

SEQ ID NO: 576179 - DNA, 20 bp, mouse
ggggcacgcgggagaggtat

SEQ ID NO: 576180 - DNA, 20 bp, mouse
gagcaccaggccggcctctg

SEQ ID NO: 576181 - DNA, 20 bp, mouse
gtgggcgctgcgtccctgga

SEQ ID NO: 576182 - DNA, 20 bp, mouse
ggctaggaggtggcctccaa

SEQ ID NO: 576183 - DNA, 20 bp, mouse
gccagccagtgggccatctc

SEQ ID NO: 576184 - DNA, 20 bp, mouse
ggcgcgcgcggaatatgaaa

SEQ ID NO: 576185 - DNA, 20 bp, mouse
gcggcctggtgctctatgga

SEQ ID NO: 576186 - DNA, 20 bp, mouse
ggccggggcgcagtcaatgg

SEQ ID NO: 576187 - DNA, 20 bp, mouse
gggcccggcactgacagcgg

SEQ ID NO: 576188 - DNA, 20 bp, mouse
gtcctcccggcctcacatcc

SEQ ID NO: 576189 - DNA, 20 bp, mouse
gcgggccggggcgcagtcaa

SEQ ID NO: 576190 - DNA, 20 bp, mouse
gagtcaatggcggccgaggg

SEQ ID NO: 576191 - DNA, 20 bp, mouse
ggccgaggcgggaagcccga

SEQ ID NO: 576192 - DNA, 20 bp, mouse
ggggccgaggcgaagatgga

SEQ ID NO: 576193 - DNA, 20 bp, mouse
gcagacccggatgtgaggcc

SEQ ID NO: 576194 - DNA, 20 bp, mouse
gcgctccagacccggatgtg

SEQ ID NO: 576195 - DNA, 20 bp, mouse
ggcgggaagcccgagggacg

SEQ ID NO: 576196 - DNA, 20 bp, mouse
gggcgctctcttggaggaag

SEQ ID NO: 576197 - DNA, 20 bp, mouse
gagcaccagcacctcggcca

SEQ ID NO: 576198 - DNA, 20 bp, mouse
gagggccaccaccgccgcct

SEQ ID NO: 576199 - DNA, 20 bp, mouse
ggcacctcggccagggaagg

SEQ ID NO: 576200 - DNA, 20 bp, mouse
ggctgcagctgcggggcgtg

SEQ ID NO: 576201 - DNA, 20 bp, mouse
gcctggtgcaatgtctctgg

SEQ ID NO: 576202 - DNA, 20 bp, mouse
ggtgcgggcgctgcaagcgg

SEQ ID NO: 576203 - DNA, 20 bp, mouse
gggtccccccgaggctacca

SEQ ID NO: 576204 - DNA, 20 bp, mouse
ggacgctacagaaggcccta

SEQ ID NO: 576205 - DNA, 20 bp, mouse
ggcccgctgccacttccata

SEQ ID NO: 576206 - DNA, 20 bp, mouse
gcgagccgcggtctccctca

SEQ ID NO: 576207 - DNA, 20 bp, mouse
ggaggcgccgcgggacggaa

SEQ ID NO: 576208 - DNA, 20 bp, mouse
ggccttgacagcccagagga

SEQ ID NO: 576209 - DNA, 20 bp, mouse
gcagggcggccgccagagct

SEQ ID NO: 576210 - DNA, 20 bp, mouse
gctgtgcagcttcccggatc

SEQ ID NO: 576211 - DNA, 20 bp, mouse
gacagcccagaggaaggcgg

SEQ ID NO: 576212 - DNA, 20 bp, mouse
gttgcctgcacagatccagg

SEQ ID NO: 576213 - DNA, 20 bp, mouse
ggcggtctccctcacggctg

SEQ ID NO: 576214 - DNA, 20 bp, mouse
gggcgggccgatctccgaga

SEQ ID NO: 576215 - DNA, 20 bp, mouse
gccctcacggctgcggaagg

SEQ ID NO: 576216 - DNA, 20 bp, mouse
ggcggctcgcgagcgtctgt

SEQ ID NO: 576217 - DNA, 20 bp, mouse
gagaggctgcggagcgcggg

SEQ ID NO: 576218 - DNA, 20 bp, mouse
gcggggaccgaggcccggcg

SEQ ID NO: 576219 - DNA, 20 bp, mouse
gctcccaccggaggatggta

SEQ ID NO: 576220 - DNA, 20 bp, mouse
gccggcggggcgagaggctg

SEQ ID NO: 576221 - DNA, 20 bp, mouse
gagcagcggcacctccgcga

SEQ ID NO: 576222 - DNA, 20 bp, mouse
gggctccgccaccatcgcgg

SEQ ID NO: 576223 - DNA, 20 bp, mouse
gcgcggctccgccaccatcg

SEQ ID NO: 576224 - DNA, 20 bp, mouse
gagcggcacctccgcgatgg

SEQ ID NO: 576225 - DNA, 20 bp, mouse
ggagggcgagtggctcccac

SEQ ID NO: 576226 - DNA, 20 bp, mouse
ggagggaagagaccccgtcc

SEQ ID NO: 576227 - DNA, 20 bp, mouse
gactagcagcgcagagactg

SEQ ID NO: 576228 - DNA, 20 bp, mouse
gcaagtgcggtgcccggacg

SEQ ID NO: 576229 - DNA, 20 bp, mouse
gctagtctgagcgagcgcga

SEQ ID NO: 576230 - DNA, 20 bp, mouse
ggtcgctggggctgcaagtg

SEQ ID NO: 576231 - DNA, 20 bp, mouse
gttgcggttgggagtcgctg

SEQ ID NO: 576232 - DNA, 20 bp, mouse
gcccggcctggacagtgaac

SEQ ID NO: 576233 - DNA, 20 bp, mouse
gggctcgtaccctgtcctca

SEQ ID NO: 576234 - DNA, 20 bp, mouse
gacagggtacgagcccctga

SEQ ID NO: 576235 - DNA, 20 bp, mouse
ggtgtccaggtggctccctg

SEQ ID NO: 576236 - DNA, 20 bp, mouse
gtgaacaagctactcaagat

SEQ ID NO: 576237 - DNA, 20 bp, mouse
gaagctactcaagatgggtg

SEQ ID NO: 576238 - DNA, 20 bp, mouse
gttgctgtcttgggtggcaa

SEQ ID NO: 576239 - DNA, 20 bp, mouse
ggcaaaggtacagggaaatc

SEQ ID NO: 576240 - DNA, 20 bp, mouse
gcttgggtggcaaaggtaca

SEQ ID NO: 576241 - DNA, 20 bp, mouse
gtctattgtaaaggtagggt

SEQ ID NO: 576242 - DNA, 20 bp, mouse
gaccagtaaagggccatcca

SEQ ID NO: 576243 - DNA, 20 bp, mouse
gacgactaccagtaataagg

SEQ ID NO: 576244 - DNA, 20 bp, mouse
gtgaccactcgcaggcttgt

SEQ ID NO: 576245 - DNA, 20 bp, mouse
ggccatccatggctttgtag

SEQ ID NO: 576246 - DNA, 20 bp, mouse
gtcctcgagctaggtcgtag

SEQ ID NO: 576247 - DNA, 20 bp, mouse
gagggtgaaaagtgacatcc

SEQ ID NO: 576248 - DNA, 20 bp, mouse
gagtagcaacaatagccagg

SEQ ID NO: 576249 - DNA, 20 bp, mouse
gttggctggatccaaactca

SEQ ID NO: 576250 - DNA, 20 bp, mouse
gtccactacgacctagctcg

SEQ ID NO: 576251 - DNA, 20 bp, mouse
gcatcctggcacaggccccc

SEQ ID NO: 576252 - DNA, 20 bp, mouse
gcacggtcaggagagaactt

SEQ ID NO: 576253 - DNA, 20 bp, mouse
ggacataaacgcccacggtc

SEQ ID NO: 576254 - DNA, 20 bp, mouse
gtagccagggggcctgtgcc

SEQ ID NO: 576255 - DNA, 20 bp, mouse
ggtcgcgtctctagcgctag

SEQ ID NO: 576256 - DNA, 20 bp, mouse
ggcgcagcagcagaagaccg

SEQ ID NO: 576257 - DNA, 20 bp, mouse
gagaccgaggagcgccgccg

SEQ ID NO: 576258 - DNA, 20 bp, mouse
gcgcagcgacggcagaacca

SEQ ID NO: 576259 - DNA, 20 bp, mouse
gaggccgcgggccccagacc

SEQ ID NO: 576260 - DNA, 20 bp, mouse
gtgcggctcccgcgagctcg

SEQ ID NO: 576261 - DNA, 20 bp, mouse
gcagttcagagggtaggacg

SEQ ID NO: 576262 - DNA, 20 bp, mouse
ggcggccgggaccgcagcga

SEQ ID NO: 576263 - DNA, 20 bp, mouse
ggcgacggcagaaccagggc

SEQ ID NO: 576264 - DNA, 20 bp, mouse
gggagcgaggagagcgacgg

SEQ ID NO: 576265 - DNA, 20 bp, mouse
gttcagagggtaggacgcgg

SEQ ID NO: 576266 - DNA, 20 bp, mouse
gcgggcgcgactcccagctg

SEQ ID NO: 576267 - DNA, 20 bp, mouse
gcgactcccagctgcggact

SEQ ID NO: 576268 - DNA, 20 bp, mouse
gagaaggtgagtcctacggg

SEQ ID NO: 576269 - DNA, 20 bp, mouse
ggcgcccggggagcggactg

SEQ ID NO: 576270 - DNA, 20 bp, mouse
gcggctccgagtccgcagct

SEQ ID NO: 576271 - DNA, 20 bp, mouse
gctgcgggcgcgttgcgtcc

SEQ ID NO: 576272 - DNA, 20 bp, mouse
gaggagaaggtgagtcctac

SEQ ID NO: 576273 - DNA, 20 bp, mouse
gtaccgtcccagccgcccgt

SEQ ID NO: 576274 - DNA, 20 bp, mouse
ggcttgcacggctccggttg

SEQ ID NO: 576275 - DNA, 20 bp, mouse
gctctctgctgttgcttgca

SEQ ID NO: 576276 - DNA, 20 bp, mouse
gggatggctatcacttaccg

SEQ ID NO: 576277 - DNA, 20 bp, mouse
gcaggacacaactcagttct

SEQ ID NO: 576278 - DNA, 20 bp, mouse
gacatcagcactctgactgg

SEQ ID NO: 576279 - DNA, 20 bp, mouse
gccgtggcagaggacttagc

SEQ ID NO: 576280 - DNA, 20 bp, mouse
gaagggtctggtctaaggcg

SEQ ID NO: 576281 - DNA, 20 bp, mouse
gcagcactctgactggggga

SEQ ID NO: 576282 - DNA, 20 bp, mouse
gctatcacttaccgtggcag

SEQ ID NO: 576283 - DNA, 20 bp, mouse
gagtctgactcccccagcat

SEQ ID NO: 576284 - DNA, 20 bp, mouse
gccccagcatgggaagggtc

SEQ ID NO: 576285 - DNA, 20 bp, mouse
ggactcccccagcatgggaa

SEQ ID NO: 576286 - DNA, 20 bp, mouse
gacctaggtcagcaatccca

SEQ ID NO: 576287 - DNA, 20 bp, mouse
ggtgagtcggtcagctctgt

SEQ ID NO: 576288 - DNA, 20 bp, mouse
ggccatgggattgctgacct

SEQ ID NO: 576289 - DNA, 20 bp, mouse
gtcctgagattctggtgagt

SEQ ID NO: 576290 - DNA, 20 bp, mouse
gagcttagaccaggatacaa

SEQ ID NO: 576291 - DNA, 20 bp, mouse
gattcaaagttggcatcctg

SEQ ID NO: 576292 - DNA, 20 bp, mouse
gagctcttgggtggctgtga

SEQ ID NO: 576293 - DNA, 20 bp, mouse
gaatccaggtatgaatgaat

SEQ ID NO: 576294 - DNA, 20 bp, mouse
gacagccacccaagagctca

SEQ ID NO: 576295 - DNA, 20 bp, mouse
gttggcatcctggggctgga

SEQ ID NO: 576296 - DNA, 20 bp, mouse
gagagtgaatctgctcttag

SEQ ID NO: 576297 - DNA, 20 bp, mouse
gcagtgggagaagggagacg

SEQ ID NO: 576298 - DNA, 20 bp, mouse
ggtcgtcaaggtaagagaag

SEQ ID NO: 576299 - DNA, 20 bp, mouse
gcgttccctgggactatcag

SEQ ID NO: 576300 - DNA, 20 bp, mouse
gtcctggagctagaagacaa

SEQ ID NO: 576301 - DNA, 20 bp, mouse
gaaaagctagaactgaggta

SEQ ID NO: 576302 - DNA, 20 bp, mouse
gttcactctccagaaagctc

SEQ ID NO: 576303 - DNA, 20 bp, mouse
gattccctaggaccaattag

SEQ ID NO: 576304 - DNA, 20 bp, mouse
gggacgatgtgtaaggtcaa

SEQ ID NO: 576305 - DNA, 20 bp, mouse
gtaaggtcaagggagtaaac

SEQ ID NO: 576306 - DNA, 20 bp, mouse
gacacaggtcagtaatccca

SEQ ID NO: 576307 - DNA, 20 bp, mouse
ggttgaaagtcagcatccta

SEQ ID NO: 576308 - DNA, 20 bp, mouse
ggtgtgcttgtatatagtaa

SEQ ID NO: 576309 - DNA, 20 bp, mouse
gggtcccagtgaatactgag

SEQ ID NO: 576310 - DNA, 20 bp, mouse
gagatcactgagctatggga

SEQ ID NO: 576311 - DNA, 20 bp, mouse
gagctatgggatggctgtaa

SEQ ID NO: 576312 - DNA, 20 bp, mouse
gagcttagaccagggtacag

SEQ ID NO: 576313 - DNA, 20 bp, mouse
gaaagtcagcatcctagggc

SEQ ID NO: 576314 - DNA, 20 bp, mouse
ggtatatagtaagggtacac

SEQ ID NO: 576315 - DNA, 20 bp, mouse
ggagatgctttaatacaccg

SEQ ID NO: 576316 - DNA, 20 bp, mouse
gaaggcccacgtagaccctg

SEQ ID NO: 576317 - DNA, 20 bp, mouse
ggcccacgtagaccctgtgg

SEQ ID NO: 576318 - DNA, 20 bp, mouse
gctgctggtgatcctccaca

SEQ ID NO: 576319 - DNA, 20 bp, mouse
gtcctccacagggtctacgt

SEQ ID NO: 576320 - DNA, 20 bp, mouse
gcccctggtgaccgacaagg

SEQ ID NO: 576321 - DNA, 20 bp, mouse
gctccaaggacgaactagag

SEQ ID NO: 576322 - DNA, 20 bp, mouse
gcggtcaccaggggttcagg

SEQ ID NO: 576323 - DNA, 20 bp, mouse
ggaacccctggtgaccgaca

SEQ ID NO: 576324 - DNA, 20 bp, mouse
gcggggaacttgcagcgtaa

SEQ ID NO: 576325 - DNA, 20 bp, mouse
gtcctcggcgaaggggttcg

SEQ ID NO: 576326 - DNA, 20 bp, mouse
gaggcgggcgcagcgactga

SEQ ID NO: 576327 - DNA, 20 bp, mouse
gccggggaaggcaaccggtc

SEQ ID NO: 576328 - DNA, 20 bp, mouse
ggggaaggcaaccggtcagg

SEQ ID NO: 576329 - DNA, 20 bp, mouse
ggcggctgaggggaacgccg

SEQ ID NO: 576330 - DNA, 20 bp, mouse
gccggcggccggaggcgcag

SEQ ID NO: 576331 - DNA, 20 bp, mouse
gctgaggggaacgccgggga

SEQ ID NO: 576332 - DNA, 20 bp, mouse
gcggcaggcaggaggcctcg

SEQ ID NO: 576333 - DNA, 20 bp, mouse
gcggggaggacactgaacga

SEQ ID NO: 576334 - DNA, 20 bp, mouse
gggctgggcggccgcctgac

SEQ ID NO: 576335 - DNA, 20 bp, mouse
ggaacgccggggaaggcaac

SEQ ID NO: 576336 - DNA, 20 bp, mouse
gccgccgccgggaatcacac

SEQ ID NO: 576337 - DNA, 20 bp, mouse
ggagcccgtgtgattcccgg

SEQ ID NO: 576338 - DNA, 20 bp, mouse
ggagctgcagcctgggaccg

SEQ ID NO: 576339 - DNA, 20 bp, mouse
ggaggagcccgtgtgattcc

SEQ ID NO: 576340 - DNA, 20 bp, mouse
ggcacggacgccgggacgag

SEQ ID NO: 576341 - DNA, 20 bp, mouse
ggtccgtgacatcatcatca

SEQ ID NO: 576342 - DNA, 20 bp, mouse
ggcaacaagagctgcagcct

SEQ ID NO: 576343 - DNA, 20 bp, mouse
gagccgaaccgaggaggaag

SEQ ID NO: 576344 - DNA, 20 bp, mouse
gacacgggctcctcggtccc

SEQ ID NO: 576345 - DNA, 20 bp, mouse
gagcgacctggcagcagcgg

SEQ ID NO: 576346 - DNA, 20 bp, mouse
ggggcctcggggcaagatgg

SEQ ID NO: 576347 - DNA, 20 bp, mouse
ggcgcgagcggaagcctccg

SEQ ID NO: 576348 - DNA, 20 bp, mouse
gctcctcacactcgccccgg

SEQ ID NO: 576349 - DNA, 20 bp, mouse
gagcctccggggcgagtgtg

SEQ ID NO: 576350 - DNA, 20 bp, mouse
gagtgtgaggaggggtcccg

SEQ ID NO: 576351 - DNA, 20 bp, mouse
gccccggcccggagataccc

SEQ ID NO: 576352 - DNA, 20 bp, mouse
gcggagatacccgggacccc

SEQ ID NO: 576353 - DNA, 20 bp, mouse
ggggagctcccgcccagtat

SEQ ID NO: 576354 - DNA, 20 bp, mouse
gggggtccgaaaagcgcgag

SEQ ID NO: 576355 - DNA, 20 bp, mouse
gcctagcgacagcgtcccgg

SEQ ID NO: 576356 - DNA, 20 bp, mouse
gggatacgcctagcatcacc

SEQ ID NO: 576357 - DNA, 20 bp, mouse
gcacccggcacgagccgcca

SEQ ID NO: 576358 - DNA, 20 bp, mouse
ggctcgtgccgggtgatgct

SEQ ID NO: 576359 - DNA, 20 bp, mouse
gcgcaacagcctggcgccca

SEQ ID NO: 576360 - DNA, 20 bp, mouse
gtgatgctaggcgtatccct

SEQ ID NO: 576361 - DNA, 20 bp, mouse
ggaaggtagcgcagccatgg

SEQ ID NO: 576362 - DNA, 20 bp, mouse
gtctcccggcacctccccgt

SEQ ID NO: 576363 - DNA, 20 bp, mouse
ggattcgcgcgtgggaccga

SEQ ID NO: 576364 - DNA, 20 bp, mouse
ggagaggggagacacatgga

SEQ ID NO: 576365 - DNA, 20 bp, mouse
gacgtcgcaaacccacgggg

SEQ ID NO: 576366 - DNA, 20 bp, mouse
gtccgcagtcggaaccacca

SEQ ID NO: 576367 - DNA, 20 bp, mouse
gggagtcgcggtctcttccc

SEQ ID NO: 576368 - DNA, 20 bp, mouse
gtgcgcggttgctggagtcg

SEQ ID NO: 576369 - DNA, 20 bp, mouse
ggttccgggaagccacccgg

SEQ ID NO: 576370 - DNA, 20 bp, mouse
gtccctggtggttccgactg

SEQ ID NO: 576371 - DNA, 20 bp, mouse
gtagaggctcaggactaggg

SEQ ID NO: 576372 - DNA, 20 bp, mouse
ggtcgcggtctcttccctgg

SEQ ID NO: 576373 - DNA, 20 bp, mouse
gggaggacaaccactagtgt

SEQ ID NO: 576374 - DNA, 20 bp, mouse
ggcgttgcaagaggtgagac

SEQ ID NO: 576375 - DNA, 20 bp, mouse
ggcgcaagcacacatttccc

SEQ ID NO: 576376 - DNA, 20 bp, mouse
gcgaccgaacaggagcaggt

SEQ ID NO: 576377 - DNA, 20 bp, mouse
gacttcgcgggagaagttgt

SEQ ID NO: 576378 - DNA, 20 bp, mouse
gatcggggctcgggatccat

SEQ ID NO: 576379 - DNA, 20 bp, mouse
ggagcaggtgggcaggcccg

SEQ ID NO: 576380 - DNA, 20 bp, mouse
ggaagtagcagaagcgcggg

SEQ ID NO: 576381 - DNA, 20 bp, mouse
gcgatgcagagggctccgag

SEQ ID NO: 576382 - DNA, 20 bp, mouse
gagctgcacggcctcccggg

SEQ ID NO: 576383 - DNA, 20 bp, mouse
gctggggtaattcgttatcg

SEQ ID NO: 576384 - DNA, 20 bp, mouse
gtagggtgcggggcgcacca

SEQ ID NO: 576385 - DNA, 20 bp, mouse
gtgtagctgcacggcctccc

SEQ ID NO: 576386 - DNA, 20 bp, mouse
gtggcgggaagagcagccac

SEQ ID NO: 576387 - DNA, 20 bp, mouse
gtcctgaacctccattccgg

SEQ ID NO: 576388 - DNA, 20 bp, mouse
gctgcgccccactctcggat

SEQ ID NO: 576389 - DNA, 20 bp, mouse
gtatggctgcaggctcacca

SEQ ID NO: 576390 - DNA, 20 bp, mouse
ggaatggaggttcaggagag

SEQ ID NO: 576391 - DNA, 20 bp, mouse
gggctcctgcgccccactct

SEQ ID NO: 576392 - DNA, 20 bp, mouse
gtcttgctggggacaggcga

SEQ ID NO: 576393 - DNA, 20 bp, mouse
gtgggtctaggggacagaga

SEQ ID NO: 576394 - DNA, 20 bp, mouse
gctgtgacccatccgagagt

SEQ ID NO: 576395 - DNA, 20 bp, mouse
ggccgagctccaggaaccct

SEQ ID NO: 576396 - DNA, 20 bp, mouse
gccggtacttgtccacccag

SEQ ID NO: 576397 - DNA, 20 bp, mouse
gcgctggtgcgactgtggag

SEQ ID NO: 576398 - DNA, 20 bp, mouse
ggcggtcatgagcctctggg

SEQ ID NO: 576399 - DNA, 20 bp, mouse
ggggtccgctggtgcgactg

SEQ ID NO: 576400 - DNA, 20 bp, mouse
gtgatagtccagccgggcaa

SEQ ID NO: 576401 - DNA, 20 bp, mouse
ggcccggctggactatcata

SEQ ID NO: 576402 - DNA, 20 bp, mouse
gaactctactgtctaagcgg

SEQ ID NO: 576403 - DNA, 20 bp, mouse
gttgctgccgggaacctcaa

SEQ ID NO: 576404 - DNA, 20 bp, mouse
gcgctacagagagcttaggt

SEQ ID NO: 576405 - DNA, 20 bp, mouse
ggtctaagcggcgggtccgc

SEQ ID NO: 576406 - DNA, 20 bp, mouse
ggtccccgccagcctgtaaa

SEQ ID NO: 576407 - DNA, 20 bp, mouse
gcgcggttcccgccacagaa

SEQ ID NO: 576408 - DNA, 20 bp, mouse
gcgggaaccgcggtgccagg

SEQ ID NO: 576409 - DNA, 20 bp, mouse
gggtgacgactgtaagtgat

SEQ ID NO: 576410 - DNA, 20 bp, mouse
gggttcccgccacagaacgg

SEQ ID NO: 576411 - DNA, 20 bp, mouse
gaaccgcggtgccaggggga

SEQ ID NO: 576412 - DNA, 20 bp, mouse
ggaaggcggaggtcacatcc

SEQ ID NO: 576413 - DNA, 20 bp, mouse
gacagtcgtcaccgtccccc

SEQ ID NO: 576414 - DNA, 20 bp, mouse
ggcctttcgccgccgttctg

SEQ ID NO: 576415 - DNA, 20 bp, mouse
gcaccgtccccctggcaccg

SEQ ID NO: 576416 - DNA, 20 bp, mouse
gtgtggggccgctcctacca

SEQ ID NO: 576417 - DNA, 20 bp, mouse
gtagggtcatcggagcgcag

SEQ ID NO: 576418 - DNA, 20 bp, mouse
ggtgcggcgggtcagtggca

SEQ ID NO: 576419 - DNA, 20 bp, mouse
gtgcgcgcggactccgagtg

SEQ ID NO: 576420 - DNA, 20 bp, mouse
gtgctcgaggaccccgagga

SEQ ID NO: 576421 - DNA, 20 bp, mouse
ggcgatgctcgaggaccccg

SEQ ID NO: 576422 - DNA, 20 bp, mouse
gctcagagcccgttcaggta

SEQ ID NO: 576423 - DNA, 20 bp, mouse
ggaacctgccctggtaggag

SEQ ID NO: 576424 - DNA, 20 bp, mouse
ggagcgggaagcgggatgtg

SEQ ID NO: 576425 - DNA, 20 bp, mouse
ggcccggaacctgccctggt

SEQ ID NO: 576426 - DNA, 20 bp, mouse
ggactcggaaccgctgccag

SEQ ID NO: 576427 - DNA, 20 bp, mouse
gctccctgctcagacacccg

SEQ ID NO: 576428 - DNA, 20 bp, mouse
ggctcagacacccgaggact

SEQ ID NO: 576429 - DNA, 20 bp, mouse
gacgcaggaagtgcaggccc

SEQ ID NO: 576430 - DNA, 20 bp, mouse
ggcagcggttccgagtcctc

SEQ ID NO: 576431 - DNA, 20 bp, mouse
gttcctgcgtccgctggcag

SEQ ID NO: 576432 - DNA, 20 bp, mouse
gtcgtcccgacggccatccc

SEQ ID NO: 576433 - DNA, 20 bp, mouse
gtgccaatgccagtccacga

SEQ ID NO: 576434 - DNA, 20 bp, mouse
gtgtctgagcagggagcgtt

SEQ ID NO: 576435 - DNA, 20 bp, mouse
gttccggtcggacaccgccc

SEQ ID NO: 576436 - DNA, 20 bp, mouse
ggcccgaaccacatcctcac

SEQ ID NO: 576437 - DNA, 20 bp, mouse
gctcaggcgtggagttgcgg

SEQ ID NO: 576438 - DNA, 20 bp, mouse
gcccctcaggcgtggagttg

SEQ ID NO: 576439 - DNA, 20 bp, mouse
gccacgcctgaggggcgccc

SEQ ID NO: 576440 - DNA, 20 bp, mouse
gggatgtggttcgggcaccc

SEQ ID NO: 576441 - DNA, 20 bp, mouse
gggggccgcccgtgaggatg

SEQ ID NO: 576442 - DNA, 20 bp, mouse
ggcccgtgaggatgtggttc

SEQ ID NO: 576443 - DNA, 20 bp, mouse
ggacagaaaaccgtctacag

SEQ ID NO: 576444 - DNA, 20 bp, mouse
gcttcaggctgtgctccggg

SEQ ID NO: 576445 - DNA, 20 bp, mouse
gcagctgcgctccgggagtg

SEQ ID NO: 576446 - DNA, 20 bp, mouse
ggccggaactacgacaaccg

SEQ ID NO: 576447 - DNA, 20 bp, mouse
gcccagccgtcagatcccag

SEQ ID NO: 576448 - DNA, 20 bp, mouse
gagcggccgctgggatctga

SEQ ID NO: 576449 - DNA, 20 bp, mouse
gcctggccgcggcagaagaa

SEQ ID NO: 576450 - DNA, 20 bp, mouse
gggctacggcgggagagcaa

SEQ ID NO: 576451 - DNA, 20 bp, mouse
gctcatgacgctgacctcgg

SEQ ID NO: 576452 - DNA, 20 bp, mouse
gacaaccgcggcgaatgcac

SEQ ID NO: 576453 - DNA, 20 bp, mouse
gcggcgaatgcacaggtctg

SEQ ID NO: 576454 - DNA, 20 bp, mouse
gccgagcaggccggtcgcct

SEQ ID NO: 576455 - DNA, 20 bp, mouse
gtgtcgtagttccggccgag

SEQ ID NO: 576456 - DNA, 20 bp, mouse
gtgcagagcccggggaccag

SEQ ID NO: 576457 - DNA, 20 bp, mouse
ggggcgcccgcctgcgaccg

SEQ ID NO: 576458 - DNA, 20 bp, mouse
gcccggagcctgaccctcga

SEQ ID NO: 576459 - DNA, 20 bp, mouse
ggcacaacacccgccgcgca

SEQ ID NO: 576460 - DNA, 20 bp, mouse
gcatgcgatcgccccggccc

SEQ ID NO: 576461 - DNA, 20 bp, mouse
gcgcccgcctgcgaccgcgg

SEQ ID NO: 576462 - DNA, 20 bp, mouse
gacggctcatgcgatcgccc

SEQ ID NO: 576463 - DNA, 20 bp, mouse
gggtgctgtcactcttaaag

SEQ ID NO: 576464 - DNA, 20 bp, mouse
gggccgccgcggtcgcaggc

SEQ ID NO: 576465 - DNA, 20 bp, mouse
gcgatcgcatgagccgtgcg

SEQ ID NO: 576466 - DNA, 20 bp, mouse
gctgccgtcatgaaaagact

SEQ ID NO: 576467 - DNA, 20 bp, mouse
gagttctacagatgtactgg

SEQ ID NO: 576468 - DNA, 20 bp, mouse
gcgcagcactaacggtacag

SEQ ID NO: 576469 - DNA, 20 bp, mouse
gcaacccagtcttttcatga

SEQ ID NO: 576470 - DNA, 20 bp, mouse
gaaaaggcgcgcagcactaa

SEQ ID NO: 576471 - DNA, 20 bp, mouse
ggagtggcttcccctactat

SEQ ID NO: 576472 - DNA, 20 bp, mouse
ggtgagaaccacaatagaaa

SEQ ID NO: 576473 - DNA, 20 bp, mouse
gacattagtgcctatagtag

SEQ ID NO: 576474 - DNA, 20 bp, mouse
ggatccccgccatccatacc

SEQ ID NO: 576475 - DNA, 20 bp, mouse
gagttattcacgttagtggt

SEQ ID NO: 576476 - DNA, 20 bp, mouse
gagagagaccagccgagaag

SEQ ID NO: 576477 - DNA, 20 bp, mouse
gcactctacaattcagctgg

SEQ ID NO: 576478 - DNA, 20 bp, mouse
gtagtcagtcaaaccctggt

SEQ ID NO: 576479 - DNA, 20 bp, mouse
gccctcacttaagcagtaca

SEQ ID NO: 576480 - DNA, 20 bp, mouse
ggtgctcacctcttctcggc

SEQ ID NO: 576481 - DNA, 20 bp, mouse
gtcactacactgcctggtat

SEQ ID NO: 576482 - DNA, 20 bp, mouse
gtctgaagctagcccatacc

SEQ ID NO: 576483 - DNA, 20 bp, mouse
gtagttatcaaagtaaggaa

SEQ ID NO: 576484 - DNA, 20 bp, mouse
gccaggcagtgtagtgacac

SEQ ID NO: 576485 - DNA, 20 bp, mouse
gattctcttgagtccaacca

SEQ ID NO: 576486 - DNA, 20 bp, mouse
ggctggagaccaccaactct

SEQ ID NO: 576487 - DNA, 20 bp, mouse
gagttggtggtctccagcaa

SEQ ID NO: 576488 - DNA, 20 bp, mouse
ggtatcagtttacctagagt

SEQ ID NO: 576489 - DNA, 20 bp, mouse
gtcagtttacctagagttgg

SEQ ID NO: 576490 - DNA, 20 bp, mouse
gttgaagtaatcaggcgcta

SEQ ID NO: 576491 - DNA, 20 bp, mouse
ggggcgcaggagagataaat

SEQ ID NO: 576492 - DNA, 20 bp, mouse
ggttgtagccagagagaaat

SEQ ID NO: 576493 - DNA, 20 bp, mouse
ggctcttggttgaagtaatc

SEQ ID NO: 576494 - DNA, 20 bp, mouse
gagtaatcaggcgctagggc

SEQ ID NO: 576495 - DNA, 20 bp, mouse
gcttactgaagcaacataaa

SEQ ID NO: 576496 - DNA, 20 bp, mouse
gacctgcagcaggagacccg

SEQ ID NO: 576497 - DNA, 20 bp, mouse
gagacccgaggaggccaacc

SEQ ID NO: 576498 - DNA, 20 bp, mouse
gcagagccacagctccgagg

SEQ ID NO: 576499 - DNA, 20 bp, mouse
gcagctccgaggaggaaacg

SEQ ID NO: 576500 - DNA, 20 bp, mouse
ggggcgccgggtctaggagt

SEQ ID NO: 576501 - DNA, 20 bp, mouse
ggagactgcggtcccagtct

SEQ ID NO: 576502 - DNA, 20 bp, mouse
gctaggccaggcggcccggt

SEQ ID NO: 576503 - DNA, 20 bp, mouse
gtctggggctatgggcagcc

SEQ ID NO: 576504 - DNA, 20 bp, mouse
gggggctatgggcagccagg

SEQ ID NO: 576505 - DNA, 20 bp, mouse
gactgcacagggttccacgg

SEQ ID NO: 576506 - DNA, 20 bp, mouse
ggcgcggcggccactggctc

SEQ ID NO: 576507 - DNA, 20 bp, mouse
gctggtcccctaaggtaggt

SEQ ID NO: 576508 - DNA, 20 bp, mouse
gagcaggcgacagctcctcg

SEQ ID NO: 576509 - DNA, 20 bp, mouse
gcctccggcgctggccgcac

SEQ ID NO: 576510 - DNA, 20 bp, mouse
gcaccgctgctggtccccta

SEQ ID NO: 576511 - DNA, 20 bp, mouse
gggaccagcagcggtgaccg

SEQ ID NO: 576512 - DNA, 20 bp, mouse
ggcggacgacgcgaccccgg

SEQ ID NO: 576513 - DNA, 20 bp, mouse
gccgcacgcccacctacctt

SEQ ID NO: 576514 - DNA, 20 bp, mouse
ggctggaatcagagcgcgca

SEQ ID NO: 576515 - DNA, 20 bp, mouse
ggggatggggacagatcgat

SEQ ID NO: 576516 - DNA, 20 bp, mouse
gttctaccgaggaagcagaa

SEQ ID NO: 576517 - DNA, 20 bp, mouse
gtgcttcccggcttctaccg

SEQ ID NO: 576518 - DNA, 20 bp, mouse
gactctggtgtgattatcta

SEQ ID NO: 576519 - DNA, 20 bp, mouse
gtgcggctcagggcaccgac

SEQ ID NO: 576520 - DNA, 20 bp, mouse
gtggtcagtcctgtgcttcc

SEQ ID NO: 576521 - DNA, 20 bp, mouse
gtgcttcctcggtagaagcc

SEQ ID NO: 576522 - DNA, 20 bp, mouse
ggccgcagaactctggtcgg

SEQ ID NO: 576523 - DNA, 20 bp, mouse
gaaagtcagtcaaagtgatg

SEQ ID NO: 576524 - DNA, 20 bp, mouse
gtgggtgagacaaagcccgt

SEQ ID NO: 576525 - DNA, 20 bp, mouse
gggctggctgtaaattgacg

SEQ ID NO: 576526 - DNA, 20 bp, mouse
gactgccgaggaggccgccg

SEQ ID NO: 576527 - DNA, 20 bp, mouse
gccgccggggcagccaaccc

SEQ ID NO: 576528 - DNA, 20 bp, mouse
gcgaggagccatgactgccg

SEQ ID NO: 576529 - DNA, 20 bp, mouse
ggcggcctcctcggcagtca

SEQ ID NO: 576530 - DNA, 20 bp, mouse
gggagccatgactgccgagg

SEQ ID NO: 576531 - DNA, 20 bp, mouse
gcgggcgcgccgaggcggtc

SEQ ID NO: 576532 - DNA, 20 bp, mouse
gcgcctcggcgcgcccgggt

SEQ ID NO: 576533 - DNA, 20 bp, mouse
ggctgccccggcggcctcct

SEQ ID NO: 576534 - DNA, 20 bp, mouse
gggggaaactatcacatccg

SEQ ID NO: 576535 - DNA, 20 bp, mouse
gtgcgcaagcccgaccgcct

SEQ ID NO: 576536 - DNA, 20 bp, mouse
gtcacctgaggggaccaagt

SEQ ID NO: 576537 - DNA, 20 bp, mouse
ggggagcagcctcacctgag

SEQ ID NO: 576538 - DNA, 20 bp, mouse
gccgcatccagaggccccca

SEQ ID NO: 576539 - DNA, 20 bp, mouse
gctcgggaggagctgagacg

SEQ ID NO: 576540 - DNA, 20 bp, mouse
gtcacggggcccagcgaggt

SEQ ID NO: 576541 - DNA, 20 bp, mouse
gaagagctgctgggcgcggg

SEQ ID NO: 576542 - DNA, 20 bp, mouse
gcagaagagctgctgggcgc

SEQ ID NO: 576543 - DNA, 20 bp, mouse
ggcagctcttctggaccctg

SEQ ID NO: 576544 - DNA, 20 bp, mouse
ggtgagcagccgcagagcaa

SEQ ID NO: 576545 - DNA, 20 bp, mouse
gcattcctcaggaaaggagg

SEQ ID NO: 576546 - DNA, 20 bp, mouse
ggccccggtgagggaaacgg

SEQ ID NO: 576547 - DNA, 20 bp, mouse
ggccatagccacggtagtcg

SEQ ID NO: 576548 - DNA, 20 bp, mouse
gggagaagccgaggtaaccg

SEQ ID NO: 576549 - DNA, 20 bp, mouse
gaacggaggcgccatagcca

SEQ ID NO: 576550 - DNA, 20 bp, mouse
ggttgccccggtgagggaaa

SEQ ID NO: 576551 - DNA, 20 bp, mouse
ggcgtgtgacgtagtagggt

SEQ ID NO: 576552 - DNA, 20 bp, mouse
gcagtcaacaacaacaactg

SEQ ID NO: 576553 - DNA, 20 bp, mouse
ggcctccgtttccctcaccg

SEQ ID NO: 576554 - DNA, 20 bp, mouse
gccttccgcggacacaagtg

SEQ ID NO: 576555 - DNA, 20 bp, mouse
ggcgagtgtcgggactgtgg

SEQ ID NO: 576556 - DNA, 20 bp, mouse
gaacgcggagcgacacgcag

SEQ ID NO: 576557 - DNA, 20 bp, mouse
gcggcagggagttccggtag

SEQ ID NO: 576558 - DNA, 20 bp, mouse
gggagttcggcagggagttc

SEQ ID NO: 576559 - DNA, 20 bp, mouse
gcagggctcccccaaatcag

SEQ ID NO: 576560 - DNA, 20 bp, mouse
gacgccgcgggagccgctac

SEQ ID NO: 576561 - DNA, 20 bp, mouse
ggctcacctggagttcggca

SEQ ID NO: 576562 - DNA, 20 bp, mouse
gtccacggctacagtctcta

SEQ ID NO: 576563 - DNA, 20 bp, mouse
ggccatagagactgtagccg

SEQ ID NO: 576564 - DNA, 20 bp, mouse
gcagaggcgcctatcaggat

SEQ ID NO: 576565 - DNA, 20 bp, mouse
ggcaccgctcacctggagtt

SEQ ID NO: 576566 - DNA, 20 bp, mouse
ggccaggactacggtgacta

SEQ ID NO: 576567 - DNA, 20 bp, mouse
gcgcttgattcacaaggcaa

SEQ ID NO: 576568 - DNA, 20 bp, mouse
ggtaacagtcgccaggacta

SEQ ID NO: 576569 - DNA, 20 bp, mouse
gctatggcgcttgattcaca

SEQ ID NO: 576570 - DNA, 20 bp, mouse
gaggagtagttgttgttgat

SEQ ID NO: 576571 - DNA, 20 bp, mouse
ggccgcagccggtgtcagga

SEQ ID NO: 576572 - DNA, 20 bp, mouse
gcaacacccgcgacggacag

SEQ ID NO: 576573 - DNA, 20 bp, mouse
gcgggaccgagcccctcaag

SEQ ID NO: 576574 - DNA, 20 bp, mouse
gggcgcccgcggacctgggg

SEQ ID NO: 576575 - DNA, 20 bp, mouse
gcacccgcgacggacagcgg

SEQ ID NO: 576576 - DNA, 20 bp, mouse
ggaggcgaagaagcgaggga

SEQ ID NO: 576577 - DNA, 20 bp, mouse
gggaaggaagctagagctga

SEQ ID NO: 576578 - DNA, 20 bp, mouse
gcctgtgctagagatgccca

SEQ ID NO: 576579 - DNA, 20 bp, mouse
ggacagtgggatcccaggag

SEQ ID NO: 576580 - DNA, 20 bp, mouse
gggacactcagtaatccagt

SEQ ID NO: 576581 - DNA, 20 bp, mouse
gtcccaccaggactaacctg

SEQ ID NO: 576582 - DNA, 20 bp, mouse
gaaaagaggcgaagaagcga

SEQ ID NO: 576583 - DNA, 20 bp, mouse
gtcctggtgggacttggagg

SEQ ID NO: 576584 - DNA, 20 bp, mouse
gatgtttgcggatgtttcat

SEQ ID NO: 576585 - DNA, 20 bp, mouse
ggggcgtctgtgctgtccat

SEQ ID NO: 576586 - DNA, 20 bp, mouse
gtccagcacggacattagat

SEQ ID NO: 576587 - DNA, 20 bp, mouse
gaggagctgaggtagccaca

SEQ ID NO: 576588 - DNA, 20 bp, mouse
gccgccggctgggcaccgtg

SEQ ID NO: 576589 - DNA, 20 bp, mouse
ggacggttccgaggtaggag

SEQ ID NO: 576590 - DNA, 20 bp, mouse
gagaaagagaaactaccctg

SEQ ID NO: 576591 - DNA, 20 bp, mouse
gaaggcgacggttccgaggt

SEQ ID NO: 576592 - DNA, 20 bp, mouse
ggctaggtctccgaactcag

SEQ ID NO: 576593 - DNA, 20 bp, mouse
gtgtccgtgctggaaggcga

SEQ ID NO: 576594 - DNA, 20 bp, mouse
ggattcgggcacgtgcgcag

SEQ ID NO: 576595 - DNA, 20 bp, mouse
gggctgggcaccgtggggct

SEQ ID NO: 576596 - DNA, 20 bp, mouse
gcggcgtgccgagatccggg

SEQ ID NO: 576597 - DNA, 20 bp, mouse
ggctaaggtccgggaactgg

SEQ ID NO: 576598 - DNA, 20 bp, mouse
gatccgggcggtgggaagga

SEQ ID NO: 576599 - DNA, 20 bp, mouse
ggcggtgggaaggatggcta

SEQ ID NO: 576600 - DNA, 20 bp, mouse
ggggcggcgtgccgagatcc

SEQ ID NO: 576601 - DNA, 20 bp, mouse
ggagctccttcaagcccggg

SEQ ID NO: 576602 - DNA, 20 bp, mouse
gggaaggatggctaaggtcc

SEQ ID NO: 576603 - DNA, 20 bp, mouse
gatggctaaggtccgggaac

SEQ ID NO: 576604 - DNA, 20 bp, mouse
ggcgatctcggagggaagtt

SEQ ID NO: 576605 - DNA, 20 bp, mouse
gcgagatccgggcggtggga

SEQ ID NO: 576606 - DNA, 20 bp, mouse
gggcagggcagcagtggccg

SEQ ID NO: 576607 - DNA, 20 bp, mouse
ggagggagcgagcggcgtgg

SEQ ID NO: 576608 - DNA, 20 bp, mouse
gcaccgcggcagaggcatgg

SEQ ID NO: 576609 - DNA, 20 bp, mouse
gaagctaggcctatacccca

SEQ ID NO: 576610 - DNA, 20 bp, mouse
gtctgcgccgggccgcagtg

SEQ ID NO: 576611 - DNA, 20 bp, mouse
gcgtcaccgcggcagaggca

SEQ ID NO: 576612 - DNA, 20 bp, mouse
gagccccggccgctgacggg

SEQ ID NO: 576613 - DNA, 20 bp, mouse
gcccctcagccccccgtcag

SEQ ID NO: 576614 - DNA, 20 bp, mouse
gccgagggggcgcccgacca

SEQ ID NO: 576615 - DNA, 20 bp, mouse
gcggggccgtaaggagaacc

SEQ ID NO: 576616 - DNA, 20 bp, mouse
gcgctctaaagtaaacacgg

SEQ ID NO: 576617 - DNA, 20 bp, mouse
gtaaacacggcggagaggac

SEQ ID NO: 576618 - DNA, 20 bp, mouse
ggcccagcgggcagcgagcg

SEQ ID NO: 576619 - DNA, 20 bp, mouse
gcccgctgggcgaggcatgg

SEQ ID NO: 576620 - DNA, 20 bp, mouse
gcccaggccactcgcaggag

SEQ ID NO: 576621 - DNA, 20 bp, mouse
gggccactcgcaggagaggc

SEQ ID NO: 576622 - DNA, 20 bp, mouse
gccccgctctaaagtaaaca

SEQ ID NO: 576623 - DNA, 20 bp, mouse
gagaccctggcggagaacga

SEQ ID NO: 576624 - DNA, 20 bp, mouse
ggagccccggaggacgggag

SEQ ID NO: 576625 - DNA, 20 bp, mouse
ggcaggcccaggccactcgc

SEQ ID NO: 576626 - DNA, 20 bp, mouse
gctgctctatgtcccaggag

SEQ ID NO: 576627 - DNA, 20 bp, mouse
gtggcagcgtagggacacag

SEQ ID NO: 576628 - DNA, 20 bp, mouse
gacgcgacgactactcctac

SEQ ID NO: 576629 - DNA, 20 bp, mouse
ggatctcgtaaagagcaagt

SEQ ID NO: 576630 - DNA, 20 bp, mouse
gagtggaggagttttccagt

SEQ ID NO: 576631 - DNA, 20 bp, mouse
gagttgctgctctatgtccc

SEQ ID NO: 576632 - DNA, 20 bp, mouse
gctagcgctttaagactgga

SEQ ID NO: 576633 - DNA, 20 bp, mouse
ggaccaaggctggcagcgta

SEQ ID NO: 576634 - DNA, 20 bp, mouse
ggaatcccccaaaatgactt

SEQ ID NO: 576635 - DNA, 20 bp, mouse
gaagatgtaaggcctcagag

SEQ ID NO: 576636 - DNA, 20 bp, mouse
gggttcggctccgggacgtg

SEQ ID NO: 576637 - DNA, 20 bp, mouse
gggctgccgcttgtcgagta

SEQ ID NO: 576638 - DNA, 20 bp, mouse
gggcagcccgccgcacgtcc

SEQ ID NO: 576639 - DNA, 20 bp, mouse
gcacaaccgtactcgacaag

SEQ ID NO: 576640 - DNA, 20 bp, mouse
gtcggctccgggacgtgcgg

SEQ ID NO: 576641 - DNA, 20 bp, mouse
gcagtgcagtgctggcggtt

SEQ ID NO: 576642 - DNA, 20 bp, mouse
gaagagctgacgggccgcgg

SEQ ID NO: 576643 - DNA, 20 bp, mouse
gagaggctcgcggaccgcta

SEQ ID NO: 576644 - DNA, 20 bp, mouse
gggctcgggcggcagcacgg

SEQ ID NO: 576645 - DNA, 20 bp, mouse
gacgcgcagtgcagtgctgg

SEQ ID NO: 576646 - DNA, 20 bp, mouse
gtgaagcgtagtgaatgtaa

SEQ ID NO: 576647 - DNA, 20 bp, mouse
gggtgctcccatgagaggtg

SEQ ID NO: 576648 - DNA, 20 bp, mouse
ggtctgtccacacctctcat

SEQ ID NO: 576649 - DNA, 20 bp, mouse
ggacagtgtcccagagtctg

SEQ ID NO: 576650 - DNA, 20 bp, mouse
gatggtgaccctcaaaacag

SEQ ID NO: 576651 - DNA, 20 bp, mouse
ggggacaacgtcccagagtg

SEQ ID NO: 576652 - DNA, 20 bp, mouse
gcaaccctgccttgtagcca

SEQ ID NO: 576653 - DNA, 20 bp, mouse
gcatatctgccatggctaca

SEQ ID NO: 576654 - DNA, 20 bp, mouse
gctgccatggctacaaggca

SEQ ID NO: 576655 - DNA, 20 bp, mouse
gcatgggagcaccacactct

SEQ ID NO: 576656 - DNA, 20 bp, mouse
ggcagaggtgacgccaacag

SEQ ID NO: 576657 - DNA, 20 bp, mouse
gaggtgacgccaacagaggc

SEQ ID NO: 576658 - DNA, 20 bp, mouse
gcaggagacagacgagacgc

SEQ ID NO: 576659 - DNA, 20 bp, mouse
ggtgggaggagaccaacgtg

SEQ ID NO: 576660 - DNA, 20 bp, mouse
gactgcggcaggatctgtcg

SEQ ID NO: 576661 - DNA, 20 bp, mouse
gcaggggtcggagagagagc

SEQ ID NO: 576662 - DNA, 20 bp, mouse
ggaaatgaggaggtgggcgt

SEQ ID NO: 576663 - DNA, 20 bp, mouse
gctacgcgcgccccccgcag

SEQ ID NO: 576664 - DNA, 20 bp, mouse
gtcccggaccgagcccctgt

SEQ ID NO: 576665 - DNA, 20 bp, mouse
ggtgcggcgacagggcgacc

SEQ ID NO: 576666 - DNA, 20 bp, mouse
gtcggcaaggagcaaggcag

SEQ ID NO: 576667 - DNA, 20 bp, mouse
gtcaggctcggcaaggagca

SEQ ID NO: 576668 - DNA, 20 bp, mouse
ggagcagactgcagtgcagg

SEQ ID NO: 576669 - DNA, 20 bp, mouse
gaggcgagtagctagcgctc

SEQ ID NO: 576670 - DNA, 20 bp, mouse
ggtgcaggcggcagccacca

SEQ ID NO: 576671 - DNA, 20 bp, mouse
gtgcgaggtgttggccctgg

SEQ ID NO: 576672 - DNA, 20 bp, mouse
gagtaggggcgagagaacag

SEQ ID NO: 576673 - DNA, 20 bp, mouse
gggagaagacacctccaaat

SEQ ID NO: 576674 - DNA, 20 bp, mouse
gtgcaggctccagctctcag

SEQ ID NO: 576675 - DNA, 20 bp, mouse
ggagctggagcctgcaagta

SEQ ID NO: 576676 - DNA, 20 bp, mouse
gcagcggctggcaccgacag

SEQ ID NO: 576677 - DNA, 20 bp, mouse
gcagcccaagaccccccgca

SEQ ID NO: 576678 - DNA, 20 bp, mouse
gtcgggaaggcagcccccgg

SEQ ID NO: 576679 - DNA, 20 bp, mouse
gggcgcacggtccgaatgga

SEQ ID NO: 576680 - DNA, 20 bp, mouse
gaccggaccccaacaaccag

SEQ ID NO: 576681 - DNA, 20 bp, mouse
gccagctcggaactagtgat

SEQ ID NO: 576682 - DNA, 20 bp, mouse
ggtgccaagagtccaagccg

SEQ ID NO: 576683 - DNA, 20 bp, mouse
gcgcgtggggtgcgatggac

SEQ ID NO: 576684 - DNA, 20 bp, mouse
gggtgggaggtccccaagga

SEQ ID NO: 576685 - DNA, 20 bp, mouse
ggtcttgggctggaggctat

SEQ ID NO: 576686 - DNA, 20 bp, mouse
ggctctgacctgctcgggaa

SEQ ID NO: 576687 - DNA, 20 bp, mouse
gtcctcagggactcccacct

SEQ ID NO: 576688 - DNA, 20 bp, mouse
gcccgggcctctgttcttgt

SEQ ID NO: 576689 - DNA, 20 bp, mouse
gcgcctggggagagacgggt

SEQ ID NO: 576690 - DNA, 20 bp, mouse
gctccggctctgacctgctc

SEQ ID NO: 576691 - DNA, 20 bp, mouse
ggaagtgaggacaggagcca

SEQ ID NO: 576692 - DNA, 20 bp, mouse
ggcagggtcacccggtgctc

SEQ ID NO: 576693 - DNA, 20 bp, mouse
gacctaggtgggagtccctg

SEQ ID NO: 576694 - DNA, 20 bp, mouse
gcaggtcagagccggagcac

SEQ ID NO: 576695 - DNA, 20 bp, mouse
ggacggacaagaagggacct

SEQ ID NO: 576696 - DNA, 20 bp, mouse
ggcccttccgcttcactcag

SEQ ID NO: 576697 - DNA, 20 bp, mouse
gccccagcttcctcttacca

SEQ ID NO: 576698 - DNA, 20 bp, mouse
ggggagcaggacgggcaccg

SEQ ID NO: 576699 - DNA, 20 bp, mouse
gaagagctggccctggtaag

SEQ ID NO: 576700 - DNA, 20 bp, mouse
ggcttcactcagcggcgcca

SEQ ID NO: 576701 - DNA, 20 bp, mouse
gcctgggagaagggtatccg

SEQ ID NO: 576702 - DNA, 20 bp, mouse
gaggacagcgggcaaagagc

SEQ ID NO: 576703 - DNA, 20 bp, mouse
gtgaatctgggggtacacta

SEQ ID NO: 576704 - DNA, 20 bp, mouse
gagaggaagctggggatcct

SEQ ID NO: 576705 - DNA, 20 bp, mouse
ggccctggtaagaggaagct

SEQ ID NO: 576706 - DNA, 20 bp, mouse
gcaatcacgctgcggagaag

SEQ ID NO: 576707 - DNA, 20 bp, mouse
gcccgtggcggaggtggacc

SEQ ID NO: 576708 - DNA, 20 bp, mouse
gagaggcagcctcgctccgc

SEQ ID NO: 576709 - DNA, 20 bp, mouse
gagggtcggccacaatccca

SEQ ID NO: 576710 - DNA, 20 bp, mouse
gctgcagagaaggaaggcga

SEQ ID NO: 576711 - DNA, 20 bp, mouse
gggcagcctcgctccgccgg

SEQ ID NO: 576712 - DNA, 20 bp, mouse
gggaggcccgggagtgagac

SEQ ID NO: 576713 - DNA, 20 bp, mouse
gggaggtggaccgggcctcc

SEQ ID NO: 576714 - DNA, 20 bp, mouse
gggacacggggtgcccgtgg

SEQ ID NO: 576715 - DNA, 20 bp, mouse
ggcccgggagtgagaccggt

SEQ ID NO: 576716 - DNA, 20 bp, mouse
gccgagacgcctgcagagta

SEQ ID NO: 576717 - DNA, 20 bp, mouse
gagacgcctgcagagtaggg

SEQ ID NO: 576718 - DNA, 20 bp, mouse
ggcggtggcggcgacaggcc

SEQ ID NO: 576719 - DNA, 20 bp, mouse
gctcgcgacgccgcgctcag

SEQ ID NO: 576720 - DNA, 20 bp, mouse
gctgcagagtagggcggccc

SEQ ID NO: 576721 - DNA, 20 bp, mouse
ggctggtccccgcagctcag

SEQ ID NO: 576722 - DNA, 20 bp, mouse
ggctaacctgctgcctcgcc

SEQ ID NO: 576723 - DNA, 20 bp, mouse
ggcgcgcgaagactaggtgt

SEQ ID NO: 576724 - DNA, 20 bp, mouse
ggaggagcgagcctcaggag

SEQ ID NO: 576725 - DNA, 20 bp, mouse
gaggtaagcgcggacagcgg

SEQ ID NO: 576726 - DNA, 20 bp, mouse
gacggcagccgggagctcaa

SEQ ID NO: 576727 - DNA, 20 bp, mouse
ggtcgagcccacgccagcta

SEQ ID NO: 576728 - DNA, 20 bp, mouse
gggacctcaccagccggagc

SEQ ID NO: 576729 - DNA, 20 bp, mouse
ggcgcagggaggcggcaaca

SEQ ID NO: 576730 - DNA, 20 bp, mouse
gtcgacgtgcgtggatcgga

SEQ ID NO: 576731 - DNA, 20 bp, mouse
ggggctcgacgtgcgtggat

SEQ ID NO: 576732 - DNA, 20 bp, mouse
gtcggaaggacctcaccagc

SEQ ID NO: 576733 - DNA, 20 bp, mouse
ggattggtgggagcctggta

SEQ ID NO: 576734 - DNA, 20 bp, mouse
ggcacgagacctgcatggac

SEQ ID NO: 576735 - DNA, 20 bp, mouse
ggggcgcagagacatcgaga

SEQ ID NO: 576736 - DNA, 20 bp, mouse
gcctgggctgtaatgactcc

SEQ ID NO: 576737 - DNA, 20 bp, mouse
gccaatactggcatacctaa

SEQ ID NO: 576738 - DNA, 20 bp, mouse
gcagcactctgacctccaag

SEQ ID NO: 576739 - DNA, 20 bp, mouse
ggtgctgccataaaaagcac

SEQ ID NO: 576740 - DNA, 20 bp, mouse
gcaagacaggaggtgattgt

SEQ ID NO: 576741 - DNA, 20 bp, mouse
gccagaggggccaccaatga

SEQ ID NO: 576742 - DNA, 20 bp, mouse
gggagctgcccaccccttgg

SEQ ID NO: 576743 - DNA, 20 bp, mouse
gacaaatggaaagctccctt

SEQ ID NO: 576744 - DNA, 20 bp, mouse
ggtaacctgcagacacccag

SEQ ID NO: 576745 - DNA, 20 bp, mouse
ggcaaggtgtacagcaagac

SEQ ID NO: 576746 - DNA, 20 bp, mouse
gctccgagccggtctcgcag

SEQ ID NO: 576747 - DNA, 20 bp, mouse
gcggtctcgcaggggcgggt

SEQ ID NO: 576748 - DNA, 20 bp, mouse
gtgccgcgcgacagactccg

SEQ ID NO: 576749 - DNA, 20 bp, mouse
gcggagctcggtggcatccg

SEQ ID NO: 576750 - DNA, 20 bp, mouse
gatgccaccgagctccgagc

SEQ ID NO: 576751 - DNA, 20 bp, mouse
gcgcccctgcgagaccggct

SEQ ID NO: 576752 - DNA, 20 bp, mouse
gtcgcaggggcgggtaggtg

SEQ ID NO: 576753 - DNA, 20 bp, mouse
gctagacctgagtccgaggg

SEQ ID NO: 576754 - DNA, 20 bp, mouse
ggcgcaaggggcctaaccct

SEQ ID NO: 576755 - DNA, 20 bp, mouse
gagcggtggcacctgagcgt

SEQ ID NO: 576756 - DNA, 20 bp, mouse
gagctgacagagggagtcca

SEQ ID NO: 576757 - DNA, 20 bp, mouse
ggagctgtgtagctgacaga

SEQ ID NO: 576758 - DNA, 20 bp, mouse
gctcctggatccagacacag

SEQ ID NO: 576759 - DNA, 20 bp, mouse
gtcccccaaaccagcaggca

SEQ ID NO: 576760 - DNA, 20 bp, mouse
ggccctgcctgctggtttgg

SEQ ID NO: 576761 - DNA, 20 bp, mouse
gagggccctgcctgctggtt

SEQ ID NO: 576762 - DNA, 20 bp, mouse
gtgcagcaaactacatccta

SEQ ID NO: 576763 - DNA, 20 bp, mouse
gactgggtatcatatcatcg

SEQ ID NO: 576764 - DNA, 20 bp, mouse
gacaatccaggacaaaactg

SEQ ID NO: 576765 - DNA, 20 bp, mouse
gctggattgtgggaaccact

SEQ ID NO: 576766 - DNA, 20 bp, mouse
gggcagccatctccatgcca

SEQ ID NO: 576767 - DNA, 20 bp, mouse
ggagatggctgccgctctca

SEQ ID NO: 576768 - DNA, 20 bp, mouse
gatatagcgtaaggcagaca

SEQ ID NO: 576769 - DNA, 20 bp, mouse
gctggcattttgttcaacct

SEQ ID NO: 576770 - DNA, 20 bp, mouse
gccaaaggagtaggaataag

SEQ ID NO: 576771 - DNA, 20 bp, mouse
gaataagtggacgtgagtgc

SEQ ID NO: 576772 - DNA, 20 bp, mouse
ggtgttctttcgaatccttt

SEQ ID NO: 576773 - DNA, 20 bp, mouse
gcttttatggccaaaggagt

SEQ ID NO: 576774 - DNA, 20 bp, mouse
ggaagcaaacatatctgagg

SEQ ID NO: 576775 - DNA, 20 bp, mouse
gtttgtcgtctagaagagaa

SEQ ID NO: 576776 - DNA, 20 bp, mouse
ggccgcgggcgtccagagga

SEQ ID NO: 576777 - DNA, 20 bp, mouse
gtccagaggacggagcagcc

SEQ ID NO: 576778 - DNA, 20 bp, mouse
gtccgtcctctggacgcccg

SEQ ID NO: 576779 - DNA, 20 bp, mouse
gcgcgggtgaacatcgccgc

SEQ ID NO: 576780 - DNA, 20 bp, mouse
ggcaaccgcttaccagacgg

SEQ ID NO: 576781 - DNA, 20 bp, mouse
ggctcagtcggctcacggcg

SEQ ID NO: 576782 - DNA, 20 bp, mouse
gcggcgggagcgcagagccg

SEQ ID NO: 576783 - DNA, 20 bp, mouse
gttcctgctcagtcggctca

SEQ ID NO: 576784 - DNA, 20 bp, mouse
ggcggctgggacagagcgag

SEQ ID NO: 576785 - DNA, 20 bp, mouse
gcagagccggggagccgccc

SEQ ID NO: 576786 - DNA, 20 bp, mouse
gcccgctgcacaccccacgg

SEQ ID NO: 576787 - DNA, 20 bp, mouse
gttacccgctgcacacccca

SEQ ID NO: 576788 - DNA, 20 bp, mouse
gacgcagggacaacagactg

SEQ ID NO: 576789 - DNA, 20 bp, mouse
gggtgatctggggaacctgg

SEQ ID NO: 576790 - DNA, 20 bp, mouse
gttcgggagcacccgccgtg

SEQ ID NO: 576791 - DNA, 20 bp, mouse
gaggtgggccctcggcctgt

SEQ ID NO: 576792 - DNA, 20 bp, mouse
gtccctgcgtaggtgatctg

SEQ ID NO: 576793 - DNA, 20 bp, mouse
ggcccaaactctatgcccac

SEQ ID NO: 576794 - DNA, 20 bp, mouse
gctctatgcccacaggccga

SEQ ID NO: 576795 - DNA, 20 bp, mouse
ggcctgtgggcatagagttt

SEQ ID NO: 576796 - DNA, 20 bp, mouse
ggcccggcgggagcaagcgg

SEQ ID NO: 576797 - DNA, 20 bp, mouse
ggagcaagcggcggcccggt

SEQ ID NO: 576798 - DNA, 20 bp, mouse
gcggcggcccggtaggtgag

SEQ ID NO: 576799 - DNA, 20 bp, mouse
gcgcccgccgaaagcatcaa

SEQ ID NO: 576800 - DNA, 20 bp, mouse
ggccggctccgctcacctac

SEQ ID NO: 576801 - DNA, 20 bp, mouse
gcccgaactgaggaaatgta

SEQ ID NO: 576802 - DNA, 20 bp, mouse
gagaagaaagacgcgcgagg

SEQ ID NO: 576803 - DNA, 20 bp, mouse
gtgaccgttgatgctttcgg

SEQ ID NO: 576804 - DNA, 20 bp, mouse
ggatcccgcccgagtccggt

SEQ ID NO: 576805 - DNA, 20 bp, mouse
gcccgcccccggcccggcga

SEQ ID NO: 576806 - DNA, 20 bp, mouse
gaaggtaattatacagacag

SEQ ID NO: 576807 - DNA, 20 bp, mouse
gtctgtataattaccttcta

SEQ ID NO: 576808 - DNA, 20 bp, mouse
gtcttgatataattcctaat

SEQ ID NO: 576809 - DNA, 20 bp, mouse
gtactcacaaatatatcccg

SEQ ID NO: 576810 - DNA, 20 bp, mouse
gacatgcactgctacagctc

SEQ ID NO: 576811 - DNA, 20 bp, mouse
ggagaaaataaaatgtagtt

SEQ ID NO: 576812 - DNA, 20 bp, mouse
gatttcatagcacagggacc

SEQ ID NO: 576813 - DNA, 20 bp, mouse
gttcagagcctgatttcaaa

SEQ ID NO: 576814 - DNA, 20 bp, mouse
gtttcaaaaggatcgtaaca

SEQ ID NO: 576815 - DNA, 20 bp, mouse
gttaccttctatggcactcc

SEQ ID NO: 576816 - DNA, 20 bp, mouse
gccacccaccacaaggatcg

SEQ ID NO: 576817 - DNA, 20 bp, mouse
gtgggtggccccccgtggag

SEQ ID NO: 576818 - DNA, 20 bp, mouse
gtgatcacaggtcccctcca

SEQ ID NO: 576819 - DNA, 20 bp, mouse
gtcacaggtcccctccacgg

SEQ ID NO: 576820 - DNA, 20 bp, mouse
gcggaagcactctcttgggg

SEQ ID NO: 576821 - DNA, 20 bp, mouse
gtcaggatgtaagggcccgg

SEQ ID NO: 576822 - DNA, 20 bp, mouse
gcttccgcgatccttgtggt

SEQ ID NO: 576823 - DNA, 20 bp, mouse
gtgtggtgggtggccccccg

SEQ ID NO: 576824 - DNA, 20 bp, mouse
ggatcgcggaagcactctct

SEQ ID NO: 576825 - DNA, 20 bp, mouse
ggcataccgccgttgatcac

SEQ ID NO: 576826 - DNA, 20 bp, mouse
gcacgtcgtggagaggatgg

SEQ ID NO: 576827 - DNA, 20 bp, mouse
ggtaccaggctgcgcagaag

SEQ ID NO: 576828 - DNA, 20 bp, mouse
gaaagcgagtagcaagtacc

SEQ ID NO: 576829 - DNA, 20 bp, mouse
ggacgcaggacagcacgtcg

SEQ ID NO: 576830 - DNA, 20 bp, mouse
gcagcacgtcgtggagagga

SEQ ID NO: 576831 - DNA, 20 bp, mouse
gaggatggtggcggaccgga

SEQ ID NO: 576832 - DNA, 20 bp, mouse
gaggacagcacgtcgtggag

SEQ ID NO: 576833 - DNA, 20 bp, mouse
ggccgggccggtggctacta

SEQ ID NO: 576834 - DNA, 20 bp, mouse
gggagaggatggtggcggac

SEQ ID NO: 576835 - DNA, 20 bp, mouse
gacctgcctggagaggtaag

SEQ ID NO: 576836 - DNA, 20 bp, mouse
ggcacccggcgacggagaga

SEQ ID NO: 576837 - DNA, 20 bp, mouse
gtccgagggtgctcgagagt

SEQ ID NO: 576838 - DNA, 20 bp, mouse
gagcctgctccgctagagga

SEQ ID NO: 576839 - DNA, 20 bp, mouse
ggggctgctccgtcctctag

SEQ ID NO: 576840 - DNA, 20 bp, mouse
gcaacttcagcacccggcga

SEQ ID NO: 576841 - DNA, 20 bp, mouse
gaccgggtagacttagatgt

SEQ ID NO: 576842 - DNA, 20 bp, mouse
gacggagcctgctccgctag

SEQ ID NO: 576843 - DNA, 20 bp, mouse
gaggccaggatagagcagag

SEQ ID NO: 576844 - DNA, 20 bp, mouse
gtccgcccaacttcagcacc

SEQ ID NO: 576845 - DNA, 20 bp, mouse
gctccggggtccgggtccga

SEQ ID NO: 576846 - DNA, 20 bp, mouse
gggagtgctgaaaatgacag

SEQ ID NO: 576847 - DNA, 20 bp, mouse
gctcattttcagacttgcag

SEQ ID NO: 576848 - DNA, 20 bp, mouse
gtggtcactgggacagaata

SEQ ID NO: 576849 - DNA, 20 bp, mouse
gaaaatctgaggaaagattc

SEQ ID NO: 576850 - DNA, 20 bp, mouse
gcagaatatggatatgtcac

SEQ ID NO: 576851 - DNA, 20 bp, mouse
gaagcatcgaggccaaaatc

SEQ ID NO: 576852 - DNA, 20 bp, mouse
gtgaaatagcattcatctgt

SEQ ID NO: 576853 - DNA, 20 bp, mouse
gttttttcaaactaatgcat

SEQ ID NO: 576854 - DNA, 20 bp, mouse
gctgacatctgttggtcact

SEQ ID NO: 576855 - DNA, 20 bp, mouse
gtcgggatagcgctttattc

SEQ ID NO: 576856 - DNA, 20 bp, mouse
ggcgcgggcggcgtgactcg

SEQ ID NO: 576857 - DNA, 20 bp, mouse
gccggcgaccagcaggactt

SEQ ID NO: 576858 - DNA, 20 bp, mouse
gggacttcggagcgcgcggg

SEQ ID NO: 576859 - DNA, 20 bp, mouse
gccagggcccgtccacggtc

SEQ ID NO: 576860 - DNA, 20 bp, mouse
gtatcgccagggcccgtcca

SEQ ID NO: 576861 - DNA, 20 bp, mouse
gctagcggacccaactcgaa

SEQ ID NO: 576862 - DNA, 20 bp, mouse
ggtcctgctggtcgccgggg

SEQ ID NO: 576863 - DNA, 20 bp, mouse
gttggcccggtgagccataa

SEQ ID NO: 576864 - DNA, 20 bp, mouse
ggcaggacttcggagcgcgc

SEQ ID NO: 576865 - DNA, 20 bp, mouse
gcggagtccccgctcagatg

SEQ ID NO: 576866 - DNA, 20 bp, mouse
ggccgagatcgagggaaggt

SEQ ID NO: 576867 - DNA, 20 bp, mouse
gtgctggacagccaggaaca

SEQ ID NO: 576868 - DNA, 20 bp, mouse
gcaaagccgagatcgaggga

SEQ ID NO: 576869 - DNA, 20 bp, mouse
gaagagctcttcgggagaca

SEQ ID NO: 576870 - DNA, 20 bp, mouse
gtcccggcctcaaacagctg

SEQ ID NO: 576871 - DNA, 20 bp, mouse
gcggtcgcagaggggagcta

SEQ ID NO: 576872 - DNA, 20 bp, mouse
gctctgcagagaaagtgtgg

SEQ ID NO: 576873 - DNA, 20 bp, mouse
gcattcaaagccgagatcga

SEQ ID NO: 576874 - DNA, 20 bp, mouse
gcagcacgactgcgtaccca

SEQ ID NO: 576875 - DNA, 20 bp, mouse
gtgcctgcactcttgtccat

SEQ ID NO: 576876 - DNA, 20 bp, mouse
gtaccaggccagggtccgct

SEQ ID NO: 576877 - DNA, 20 bp, mouse
gagggccagagcttcccctt

SEQ ID NO: 576878 - DNA, 20 bp, mouse
gggagtcagagaggaagacg

SEQ ID NO: 576879 - DNA, 20 bp, mouse
gtccgctgggctagccgaag

SEQ ID NO: 576880 - DNA, 20 bp, mouse
ggcatgcgcacggccaacgg

SEQ ID NO: 576881 - DNA, 20 bp, mouse
gtccccttcggctagcccag

SEQ ID NO: 576882 - DNA, 20 bp, mouse
gctagccgaaggggaagctc

SEQ ID NO: 576883 - DNA, 20 bp, mouse
gccctggcctggtaagtacc

SEQ ID NO: 576884 - DNA, 20 bp, mouse
ggacgcatgcgcacggccaa

SEQ ID NO: 576885 - DNA, 20 bp, mouse
gggactctgagactcagcga

SEQ ID NO: 576886 - DNA, 20 bp, mouse
gatagactactgaagcctca

SEQ ID NO: 576887 - DNA, 20 bp, mouse
gtgtatacatgaaacccttg

SEQ ID NO: 576888 - DNA, 20 bp, mouse
gggctagacagtgctgggta

SEQ ID NO: 576889 - DNA, 20 bp, mouse
gaaagtatgtccacaatgtg

SEQ ID NO: 576890 - DNA, 20 bp, mouse
gtacatggctagacagtgct

SEQ ID NO: 576891 - DNA, 20 bp, mouse
gaaaatgacgttacagtgaa

SEQ ID NO: 576892 - DNA, 20 bp, mouse
gaagcagctgtcgcttcctc

SEQ ID NO: 576893 - DNA, 20 bp, mouse
gttattaagaagcttttaca

SEQ ID NO: 576894 - DNA, 20 bp, mouse
gatttatttctagtaaacag

SEQ ID NO: 576895 - DNA, 20 bp, mouse
gttgtggacatactttagaa

SEQ ID NO: 576896 - DNA, 20 bp, mouse
gcaggccgcgtgccgtgggg

SEQ ID NO: 576897 - DNA, 20 bp, mouse
gccgccgagagccgcttctc

SEQ ID NO: 576898 - DNA, 20 bp, mouse
gtccgggtgcccgagcactg

SEQ ID NO: 576899 - DNA, 20 bp, mouse
gttctccggcatcctgtcgg

SEQ ID NO: 576900 - DNA, 20 bp, mouse
gtgcccggccccgctgtctg

SEQ ID NO: 576901 - DNA, 20 bp, mouse
gcgcttctccggcatcctgt

SEQ ID NO: 576902 - DNA, 20 bp, mouse
ggaagcggctctcggcgggt

SEQ ID NO: 576903 - DNA, 20 bp, mouse
ggcagctgggttcccccgac

SEQ ID NO: 576904 - DNA, 20 bp, mouse
gcggctctcggcgggtaggt

SEQ ID NO: 576905 - DNA, 20 bp, mouse
gagtcgctccccagacagcg

SEQ ID NO: 576906 - DNA, 20 bp, mouse
gacgcaggcgaggtgcagaa

SEQ ID NO: 576907 - DNA, 20 bp, mouse
gccccaggcggtggttatgt

SEQ ID NO: 576908 - DNA, 20 bp, mouse
ggcccagaggcacttaccaa

SEQ ID NO: 576909 - DNA, 20 bp, mouse
gccgcccgcccgggagacgc

SEQ ID NO: 576910 - DNA, 20 bp, mouse
gagcctccctgctacagtgg

SEQ ID NO: 576911 - DNA, 20 bp, mouse
gccggctcccgagggagacg

SEQ ID NO: 576912 - DNA, 20 bp, mouse
gcggtgcagagagcgctcca

SEQ ID NO: 576913 - DNA, 20 bp, mouse
gctcgcctgcgtctcccggg

SEQ ID NO: 576914 - DNA, 20 bp, mouse
gcagaggcacttaccaaagg

SEQ ID NO: 576915 - DNA, 20 bp, mouse
gtagaaggacaagttcgggt

SEQ ID NO: 576916 - DNA, 20 bp, mouse
gattcttagcgaggagagaa

SEQ ID NO: 576917 - DNA, 20 bp, mouse
gctcaaaatagaaaccaccg

SEQ ID NO: 576918 - DNA, 20 bp, mouse
gagcaatctggctggtccta

SEQ ID NO: 576919 - DNA, 20 bp, mouse
gaactgagggattcttagcg

SEQ ID NO: 576920 - DNA, 20 bp, mouse
ggccctggtagcgtctccct

SEQ ID NO: 576921 - DNA, 20 bp, mouse
gtctggctttcaagcccggt

SEQ ID NO: 576922 - DNA, 20 bp, mouse
gtacgaagtgataggaggtg

SEQ ID NO: 576923 - DNA, 20 bp, mouse
gtgaattacgaagtgatagg

SEQ ID NO: 576924 - DNA, 20 bp, mouse
ggtcctagggagacgctacc

SEQ ID NO: 576925 - DNA, 20 bp, mouse
ggaaatgctccaacaggaca

SEQ ID NO: 576926 - DNA, 20 bp, mouse
gctcaacagctgaccgtctg

SEQ ID NO: 576927 - DNA, 20 bp, mouse
ggaggttcgtgctcaagttg

SEQ ID NO: 576928 - DNA, 20 bp, mouse
gtggaaacttcaataatctg

SEQ ID NO: 576929 - DNA, 20 bp, mouse
gctcaagggaggatgcccag

SEQ ID NO: 576930 - DNA, 20 bp, mouse
gacctttccaggcatgagtg

SEQ ID NO: 576931 - DNA, 20 bp, mouse
gctacccaggaaatatgtag

SEQ ID NO: 576932 - DNA, 20 bp, mouse
ggccagtcccttacacattt

SEQ ID NO: 576933 - DNA, 20 bp, mouse
ggccaaaatgtgtaagggac

SEQ ID NO: 576934 - DNA, 20 bp, mouse
ggtggtgagccttcactcaa

SEQ ID NO: 576935 - DNA, 20 bp, mouse
gcgccagccaaaatgtgtaa

SEQ ID NO: 576936 - DNA, 20 bp, mouse
ggcctgggctgcgcgactcc

SEQ ID NO: 576937 - DNA, 20 bp, mouse
gtacgaggcggcgaccgcag

SEQ ID NO: 576938 - DNA, 20 bp, mouse
gttggtgccactctacgagg

SEQ ID NO: 576939 - DNA, 20 bp, mouse
gcggtcgccgcctcgtagag

SEQ ID NO: 576940 - DNA, 20 bp, mouse
gggagttcttggccacccgg

SEQ ID NO: 576941 - DNA, 20 bp, mouse
gtccggtccggaccagcgag

SEQ ID NO: 576942 - DNA, 20 bp, mouse
ggcgatcggcccccaccggg

SEQ ID NO: 576943 - DNA, 20 bp, mouse
gtagagtggcaccaagaagg

SEQ ID NO: 576944 - DNA, 20 bp, mouse
ggcgactccgggcagctcct

SEQ ID NO: 576945 - DNA, 20 bp, mouse
gcgatcgccaaggagctgcc

SEQ ID NO: 576946 - DNA, 20 bp, mouse
gcagtccccgggaggagaag

SEQ ID NO: 576947 - DNA, 20 bp, mouse
gactggtcccagtccccggg

SEQ ID NO: 576948 - DNA, 20 bp, mouse
gctcgactggtcccagtccc

SEQ ID NO: 576949 - DNA, 20 bp, mouse
gtggccgaggaggtaaccgg

SEQ ID NO: 576950 - DNA, 20 bp, mouse
gaacgagcgaggcggcccgg

SEQ ID NO: 576951 - DNA, 20 bp, mouse
ggccctcagcacacccggag

SEQ ID NO: 576952 - DNA, 20 bp, mouse
ggagcagcgcgagtgtgatg

SEQ ID NO: 576953 - DNA, 20 bp, mouse
gcgagcggagctgcgaggca

SEQ ID NO: 576954 - DNA, 20 bp, mouse
ggaggagggaacgagcgagg

SEQ ID NO: 576955 - DNA, 20 bp, mouse
gccgggaggagaagcggagg

SEQ ID NO: 576956 - DNA, 20 bp, mouse
gtccgctagcagcgacggag

SEQ ID NO: 576957 - DNA, 20 bp, mouse
ggcattgccggccctgtccc

SEQ ID NO: 576958 - DNA, 20 bp, mouse
gatccatgccgagaggaagg

SEQ ID NO: 576959 - DNA, 20 bp, mouse
ggcgtccagctcccgggaca

SEQ ID NO: 576960 - DNA, 20 bp, mouse
ggcttgcaccgccttcctct

SEQ ID NO: 576961 - DNA, 20 bp, mouse
ggctccgcggcggcgtacag

SEQ ID NO: 576962 - DNA, 20 bp, mouse
gaagcgatgctgcaccgcac

SEQ ID NO: 576963 - DNA, 20 bp, mouse
ggggagaccagggatcaagg

SEQ ID NO: 576964 - DNA, 20 bp, mouse
gtcgcttccgctagcagcga

SEQ ID NO: 576965 - DNA, 20 bp, mouse
gtcagcttgaaggagagccg

SEQ ID NO: 576966 - DNA, 20 bp, mouse
gtggtgcaggagctcttcta

SEQ ID NO: 576967 - DNA, 20 bp, mouse
gagcgtggccgcctcacctc

SEQ ID NO: 576968 - DNA, 20 bp, mouse
gctaggggcccgaggtgagg

SEQ ID NO: 576969 - DNA, 20 bp, mouse
gcagcgcagctggaaagatg

SEQ ID NO: 576970 - DNA, 20 bp, mouse
gagctagcgagcgcagggga

SEQ ID NO: 576971 - DNA, 20 bp, mouse
gcggccctctcctggtacat

SEQ ID NO: 576972 - DNA, 20 bp, mouse
gtccagaccctgcaagaaac

SEQ ID NO: 576973 - DNA, 20 bp, mouse
gcggcccgctgaggcttact

SEQ ID NO: 576974 - DNA, 20 bp, mouse
gtttcatgagatgcaaagtc

SEQ ID NO: 576975 - DNA, 20 bp, mouse
gtccctgggccggcccgctg

SEQ ID NO: 576976 - DNA, 20 bp, mouse
ggctgcctggctcaagtggt

SEQ ID NO: 576977 - DNA, 20 bp, mouse
gacctcccaccacttgagcc

SEQ ID NO: 576978 - DNA, 20 bp, mouse
ggcttgctgcctggctcaag

SEQ ID NO: 576979 - DNA, 20 bp, mouse
ggcagagagaagagcttttg

SEQ ID NO: 576980 - DNA, 20 bp, mouse
gccgggttaaggagctctaa

SEQ ID NO: 576981 - DNA, 20 bp, mouse
gaggctgcttcagtatttac

SEQ ID NO: 576982 - DNA, 20 bp, mouse
ggcctacacccagcaggcgg

SEQ ID NO: 576983 - DNA, 20 bp, mouse
gggagaaggggcataagagg

SEQ ID NO: 576984 - DNA, 20 bp, mouse
gagtcaacgacagtaagtat

SEQ ID NO: 576985 - DNA, 20 bp, mouse
ggtcattcaaggtggagaag

SEQ ID NO: 576986 - DNA, 20 bp, mouse
gagcctgggcgtagaccggg

SEQ ID NO: 576987 - DNA, 20 bp, mouse
gcccagcctgggcgtagacc

SEQ ID NO: 576988 - DNA, 20 bp, mouse
ggcccaggctggggcagacc

SEQ ID NO: 576989 - DNA, 20 bp, mouse
gtgcctcccggtctacgccc

SEQ ID NO: 576990 - DNA, 20 bp, mouse
ggagtgtccaagggaagatt

SEQ ID NO: 576991 - DNA, 20 bp, mouse
gggctggcttgtgaacttgg

SEQ ID NO: 576992 - DNA, 20 bp, mouse
ggtccagatggggattccca

SEQ ID NO: 576993 - DNA, 20 bp, mouse
gcacttgccagggtccagat

SEQ ID NO: 576994 - DNA, 20 bp, mouse
gactgtagtggagaattcga

SEQ ID NO: 576995 - DNA, 20 bp, mouse
gggcctgcagcagaccatca

SEQ ID NO: 576996 - DNA, 20 bp, mouse
gtaaggcgcgcggctcgtct

SEQ ID NO: 576997 - DNA, 20 bp, mouse
ggcgccttagccccggccaa

SEQ ID NO: 576998 - DNA, 20 bp, mouse
gggctcgtcttggagacttg

SEQ ID NO: 576999 - DNA, 20 bp, mouse
gttggggtcgatcaaggatg

SEQ ID NO: 577000 - DNA, 20 bp, mouse
ggagccgcgcgccttagccc

SEQ ID NO: 577001 - DNA, 20 bp, mouse
gatcctgctgcccttggccg

SEQ ID NO: 577002 - DNA, 20 bp, mouse
gcgccggaggcgcacctcaa

SEQ ID NO: 577003 - DNA, 20 bp, mouse
gggagacttggggtcgatca

SEQ ID NO: 577004 - DNA, 20 bp, mouse
gccagccgtggggacgccgg

SEQ ID NO: 577005 - DNA, 20 bp, mouse
gcaagtagggtaccgccgga

SEQ ID NO: 577006 - DNA, 20 bp, mouse
ggtccgtgtcaggaggagca

SEQ ID NO: 577007 - DNA, 20 bp, mouse
gcatggcaacatgagtaacg

SEQ ID NO: 577008 - DNA, 20 bp, mouse
gctcctgacacggaccgctt

SEQ ID NO: 577009 - DNA, 20 bp, mouse
gttcctaagcggtccgtgtc

SEQ ID NO: 577010 - DNA, 20 bp, mouse
gtgctgtgaagaaggagagt

SEQ ID NO: 577011 - DNA, 20 bp, mouse
gtctgctctatcaaggcccc

SEQ ID NO: 577012 - DNA, 20 bp, mouse
gtgccatgctcctcctgaca

SEQ ID NO: 577013 - DNA, 20 bp, mouse
gagaatgtgaacacacggtg

SEQ ID NO: 577014 - DNA, 20 bp, mouse
gagctgcatctgctctatca

SEQ ID NO: 577015 - DNA, 20 bp, mouse
gacaaacgcacactgagtaa

SEQ ID NO: 577016 - DNA, 20 bp, mouse
gcaggcttatggccatgaga

SEQ ID NO: 577017 - DNA, 20 bp, mouse
ggtcctctgctgcagtcatg

SEQ ID NO: 577018 - DNA, 20 bp, mouse
gggtgcaatgagagctccac

SEQ ID NO: 577019 - DNA, 20 bp, mouse
gtgctgggaagcattctggt

SEQ ID NO: 577020 - DNA, 20 bp, mouse
gatcaacactatacagcctg

SEQ ID NO: 577021 - DNA, 20 bp, mouse
gatagcaacttccaggctta

SEQ ID NO: 577022 - DNA, 20 bp, mouse
ggggatacaactgaaaaaat

SEQ ID NO: 577023 - DNA, 20 bp, mouse
gaaaacaaggatgtcctaat

SEQ ID NO: 577024 - DNA, 20 bp, mouse
gtttacttcttatactcctt

SEQ ID NO: 577025 - DNA, 20 bp, mouse
gctggtgggaagcattcttc

SEQ ID NO: 577026 - DNA, 20 bp, mouse
gacgagcgcgggagtacgtg

SEQ ID NO: 577027 - DNA, 20 bp, mouse
gacactcagctgaagagacg

SEQ ID NO: 577028 - DNA, 20 bp, mouse
ggagtacgtgaggacgcaag

SEQ ID NO: 577029 - DNA, 20 bp, mouse
gcggaggggagaagaagacc

SEQ ID NO: 577030 - DNA, 20 bp, mouse
gggagaagaagacccggacc

SEQ ID NO: 577031 - DNA, 20 bp, mouse
gagatctaggctgcccggat

SEQ ID NO: 577032 - DNA, 20 bp, mouse
gccatcccggccggccggag

SEQ ID NO: 577033 - DNA, 20 bp, mouse
ggctcgtgcgtcactacgtc

SEQ ID NO: 577034 - DNA, 20 bp, mouse
gggaagtgctgcttagggac

SEQ ID NO: 577035 - DNA, 20 bp, mouse
gggccgggatggggtcgcag

SEQ ID NO: 577036 - DNA, 20 bp, mouse
gagcagggcggtgaagaatg

SEQ ID NO: 577037 - DNA, 20 bp, mouse
gagggcggtgaagaatgtgg

SEQ ID NO: 577038 - DNA, 20 bp, mouse
gccgaggccgcacgctggaa

SEQ ID NO: 577039 - DNA, 20 bp, mouse
gagggaggcggggagtaccg

SEQ ID NO: 577040 - DNA, 20 bp, mouse
gatgtggcggagggcacctc

SEQ ID NO: 577041 - DNA, 20 bp, mouse
ggagtaccgaggccgcacgc

SEQ ID NO: 577042 - DNA, 20 bp, mouse
ggagcaccagaagcgactcg

SEQ ID NO: 577043 - DNA, 20 bp, mouse
ggccccgagggcgccagagg

SEQ ID NO: 577044 - DNA, 20 bp, mouse
gaggcggaaattgaggaggg

SEQ ID NO: 577045 - DNA, 20 bp, mouse
gcggtgaagaatgtggcgga

SEQ ID NO: 577046 - DNA, 20 bp, mouse
ggggctcggcctggaaccgg

SEQ ID NO: 577047 - DNA, 20 bp, mouse
gcgagggctcggcctggaac

SEQ ID NO: 577048 - DNA, 20 bp, mouse
gccgcgcccgaccccagtaa

SEQ ID NO: 577049 - DNA, 20 bp, mouse
gccgggcggtgtacagagag

SEQ ID NO: 577050 - DNA, 20 bp, mouse
ggctctgaggtctctgacaa

SEQ ID NO: 577051 - DNA, 20 bp, mouse
ggtgtggcgaagcttccggg

SEQ ID NO: 577052 - DNA, 20 bp, mouse
gacaactgctgactaatcgg

SEQ ID NO: 577053 - DNA, 20 bp, mouse
gaccggcggccggacttacc

SEQ ID NO: 577054 - DNA, 20 bp, mouse
gagcgggtttcgggcaccga

SEQ ID NO: 577055 - DNA, 20 bp, mouse
ggagggccgtcggcttggga

SEQ ID NO: 577056 - DNA, 20 bp, mouse
gggcggcgcaggcagggact

SEQ ID NO: 577057 - DNA, 20 bp, mouse
gccgccgctgcgggccggga

SEQ ID NO: 577058 - DNA, 20 bp, mouse
gcgccgtagggtcctcagaa

SEQ ID NO: 577059 - DNA, 20 bp, mouse
gctcggcccgtggcattccc

SEQ ID NO: 577060 - DNA, 20 bp, mouse
gaccctacggcggtgagtgg

SEQ ID NO: 577061 - DNA, 20 bp, mouse
ggacccttctgaggacccta

SEQ ID NO: 577062 - DNA, 20 bp, mouse
gccactcacgggagtaacag

SEQ ID NO: 577063 - DNA, 20 bp, mouse
gcattcccaggcggacgggt

SEQ ID NO: 577064 - DNA, 20 bp, mouse
gcgcaggcagggactaggcg

SEQ ID NO: 577065 - DNA, 20 bp, mouse
ggtggcattcccaggcggac

SEQ ID NO: 577066 - DNA, 20 bp, mouse
ggcctccgagaggtgagcac

SEQ ID NO: 577067 - DNA, 20 bp, mouse
gctcggaggccccacgtccc

SEQ ID NO: 577068 - DNA, 20 bp, mouse
gggccccacgtcccgggaag

SEQ ID NO: 577069 - DNA, 20 bp, mouse
ggaggtgagcacggggaatt

SEQ ID NO: 577070 - DNA, 20 bp, mouse
gagcagagtgggcagcggcg

SEQ ID NO: 577071 - DNA, 20 bp, mouse
gcagccgcttcccgggacgt

SEQ ID NO: 577072 - DNA, 20 bp, mouse
gaggccaaggatctgcggga

SEQ ID NO: 577073 - DNA, 20 bp, mouse
gcgggtggccagggattcac

SEQ ID NO: 577074 - DNA, 20 bp, mouse
ggccccgcagagcgccctag

SEQ ID NO: 577075 - DNA, 20 bp, mouse
gcacggggaattgggtgcgg

SEQ ID NO: 577076 - DNA, 20 bp, mouse
gcagccggtgaggggttcgg

SEQ ID NO: 577077 - DNA, 20 bp, mouse
gaccggctggaagggcgcca

SEQ ID NO: 577078 - DNA, 20 bp, mouse
gtcaggagcaggtgcgtggt

SEQ ID NO: 577079 - DNA, 20 bp, mouse
gggtgacgctgtctgagctc

SEQ ID NO: 577080 - DNA, 20 bp, mouse
gggaccgctccgctccgccc

SEQ ID NO: 577081 - DNA, 20 bp, mouse
gtcggcccggctctatggac

SEQ ID NO: 577082 - DNA, 20 bp, mouse
gaacccctcaccggctggaa

SEQ ID NO: 577083 - DNA, 20 bp, mouse
gccatgctcgcagaaggccc

SEQ ID NO: 577084 - DNA, 20 bp, mouse
gagagcagagcaggcggagc

SEQ ID NO: 577085 - DNA, 20 bp, mouse
gtggtagagcgaatatgagg

SEQ ID NO: 577086 - DNA, 20 bp, mouse
gggctgcggctcgggcctcc

SEQ ID NO: 577087 - DNA, 20 bp, mouse
gaccttacctggggaggccg

SEQ ID NO: 577088 - DNA, 20 bp, mouse
gttagttctgggagggcggg

SEQ ID NO: 577089 - DNA, 20 bp, mouse
gagctggtggcagaaattct

SEQ ID NO: 577090 - DNA, 20 bp, mouse
gctgaccgtcagcgagggga

SEQ ID NO: 577091 - DNA, 20 bp, mouse
gcctgctgaccgtcagcgag

SEQ ID NO: 577092 - DNA, 20 bp, mouse
gccctgcaccttacctgggg

SEQ ID NO: 577093 - DNA, 20 bp, mouse
ggcttccagagtcaaccttc

SEQ ID NO: 577094 - DNA, 20 bp, mouse
ggtggaaggagagccgacct

SEQ ID NO: 577095 - DNA, 20 bp, mouse
gtcttccggaaggttgactc

SEQ ID NO: 577096 - DNA, 20 bp, mouse
gaggctcgcgcgcagagcgg

SEQ ID NO: 577097 - DNA, 20 bp, mouse
gaggagcgcggggagcggta

SEQ ID NO: 577098 - DNA, 20 bp, mouse
gctgtcgcgggcccgaggca

SEQ ID NO: 577099 - DNA, 20 bp, mouse
gccaccccggaggagtccgt

SEQ ID NO: 577100 - DNA, 20 bp, mouse
gtagggcccggctggcccaa

SEQ ID NO: 577101 - DNA, 20 bp, mouse
gcccggaggagtccgtgggg

SEQ ID NO: 577102 - DNA, 20 bp, mouse
gtcctggagcagcacggccg

SEQ ID NO: 577103 - DNA, 20 bp, mouse
gaggaggctcgcgcgcagag

SEQ ID NO: 577104 - DNA, 20 bp, mouse
gcgcggggagcggtagggcc

SEQ ID NO: 577105 - DNA, 20 bp, mouse
gtcgcccatggcccagactg

SEQ ID NO: 577106 - DNA, 20 bp, mouse
ggcacagcagcggcaggacc

SEQ ID NO: 577107 - DNA, 20 bp, mouse
gggaacgcgggccatgaacg

SEQ ID NO: 577108 - DNA, 20 bp, mouse
gcggcaggaccaggcgccgg

SEQ ID NO: 577109 - DNA, 20 bp, mouse
gcactgccctgccggagacc

SEQ ID NO: 577110 - DNA, 20 bp, mouse
gccctcgcccgcactcactt

SEQ ID NO: 577111 - DNA, 20 bp, mouse
ggttctcccggtctccggca

SEQ ID NO: 577112 - DNA, 20 bp, mouse
gctacacacccgggacttag

SEQ ID NO: 577113 - DNA, 20 bp, mouse
gggcccgcgttccccgccac

SEQ ID NO: 577114 - DNA, 20 bp, mouse
gtctatctcaggctgaggag

SEQ ID NO: 577115 - DNA, 20 bp, mouse
gcaggaccaggcgccggtgg

SEQ ID NO: 577116 - DNA, 20 bp, mouse
gctggaacaccaaccttcgg

SEQ ID NO: 577117 - DNA, 20 bp, mouse
ggagcaagcggccagcagtg

SEQ ID NO: 577118 - DNA, 20 bp, mouse
gggcagccgcccccgaaggt

SEQ ID NO: 577119 - DNA, 20 bp, mouse
gggcctggaacaccaacctt

SEQ ID NO: 577120 - DNA, 20 bp, mouse
gacgctgggctccgagacca

SEQ ID NO: 577121 - DNA, 20 bp, mouse
ggcgcccgcccaactagcta

SEQ ID NO: 577122 - DNA, 20 bp, mouse
gcggccagcagtgcggagca

SEQ ID NO: 577123 - DNA, 20 bp, mouse
gcatggtcacttgcaggatc

SEQ ID NO: 577124 - DNA, 20 bp, mouse
gtgcaggatcaggcaggtga

SEQ ID NO: 577125 - DNA, 20 bp, mouse
gcaactagctagggtctatc

SEQ ID NO: 577126 - DNA, 20 bp, mouse
ggtagctccaaggcccacag

SEQ ID NO: 577127 - DNA, 20 bp, mouse
ggcagcagcggagggaccgt

SEQ ID NO: 577128 - DNA, 20 bp, mouse
gaggggcaggcagcagcgga

SEQ ID NO: 577129 - DNA, 20 bp, mouse
ggaggtctgcggctccccaa

SEQ ID NO: 577130 - DNA, 20 bp, mouse
ggatgggctctaagtaccca

SEQ ID NO: 577131 - DNA, 20 bp, mouse
gctccaaggcccacaggggc

SEQ ID NO: 577132 - DNA, 20 bp, mouse
gactgtctccctgcaaccag

SEQ ID NO: 577133 - DNA, 20 bp, mouse
gatcaaggtgaggggcccgg

SEQ ID NO: 577134 - DNA, 20 bp, mouse
ggtgctggcaaatccaggtg

SEQ ID NO: 577135 - DNA, 20 bp, mouse
gagctggaactcctctcctt

SEQ ID NO: 577136 - DNA, 20 bp, mouse
gcggctgcgccgggagaacg

SEQ ID NO: 577137 - DNA, 20 bp, mouse
gcggttgagcgagctagaga

SEQ ID NO: 577138 - DNA, 20 bp, mouse
gcgcggcatacagagcacgg

SEQ ID NO: 577139 - DNA, 20 bp, mouse
ggaacgcggcatacagagca

SEQ ID NO: 577140 - DNA, 20 bp, mouse
gggcatacagagcacggcgg

SEQ ID NO: 577141 - DNA, 20 bp, mouse
gctccggctcagactatcgg

SEQ ID NO: 577142 - DNA, 20 bp, mouse
gctcctccggctcagactat

SEQ ID NO: 577143 - DNA, 20 bp, mouse
gcggctcagactatcggcgg

SEQ ID NO: 577144 - DNA, 20 bp, mouse
gcagatgcggggatccgact

SEQ ID NO: 577145 - DNA, 20 bp, mouse
gtccgggccgcaagactccc

SEQ ID NO: 577146 - DNA, 20 bp, mouse
gggaacccgaagatcagccg

SEQ ID NO: 577147 - DNA, 20 bp, mouse
ggcggggctcgtaggagtgc

SEQ ID NO: 577148 - DNA, 20 bp, mouse
gtcagccgaggtgcaggccg

SEQ ID NO: 577149 - DNA, 20 bp, mouse
gctgcacctcggctgatctt

SEQ ID NO: 577150 - DNA, 20 bp, mouse
gtcgtaggagtgcgggccga

SEQ ID NO: 577151 - DNA, 20 bp, mouse
gtgcaggccgaggtggactc

SEQ ID NO: 577152 - DNA, 20 bp, mouse
gagcaaccgtgctctcggga

SEQ ID NO: 577153 - DNA, 20 bp, mouse
gagcgcaccagcggcatgac

SEQ ID NO: 577154 - DNA, 20 bp, mouse
ggacaggacgccgccccgcg

SEQ ID NO: 577155 - DNA, 20 bp, mouse
ggagggcggggacttaccta

SEQ ID NO: 577156 - DNA, 20 bp, mouse
gcgctcggtgtcctgaggag

SEQ ID NO: 577157 - DNA, 20 bp, mouse
gtcggtgtcctgaggagcgg

SEQ ID NO: 577158 - DNA, 20 bp, mouse
ggacccaggggtaaccgagt

SEQ ID NO: 577159 - DNA, 20 bp, mouse
gagcggggcgggggacccag

SEQ ID NO: 577160 - DNA, 20 bp, mouse
gataagagcggaggatacag

SEQ ID NO: 577161 - DNA, 20 bp, mouse
ggcggccgggagggcgggta

SEQ ID NO: 577162 - DNA, 20 bp, mouse
gccgaacgctcggtgtcctg

SEQ ID NO: 577163 - DNA, 20 bp, mouse
gcgagtgggtagccagcccg

SEQ ID NO: 577164 - DNA, 20 bp, mouse
ggccgggagggcgggtaagg

SEQ ID NO: 577165 - DNA, 20 bp, mouse
gcggagccgcgtggactgag

SEQ ID NO: 577166 - DNA, 20 bp, mouse
ggcgctgtgggagccgtcag

SEQ ID NO: 577167 - DNA, 20 bp, mouse
gtgtctacgaagagcccgtg

SEQ ID NO: 577168 - DNA, 20 bp, mouse
ggctctcgaggctgccccac

SEQ ID NO: 577169 - DNA, 20 bp, mouse
gcgagagccgcagccatgaa

SEQ ID NO: 577170 - DNA, 20 bp, mouse
gtgagctcgccaagcagcct

SEQ ID NO: 577171 - DNA, 20 bp, mouse
ggagcagccgcagtactacc

SEQ ID NO: 577172 - DNA, 20 bp, mouse
ggctcccacagcgcaactcc

SEQ ID NO: 577173 - DNA, 20 bp, mouse
ggagcgtgaggaagttgatg

SEQ ID NO: 577174 - DNA, 20 bp, mouse
ggttccgccaggtagtactg

SEQ ID NO: 577175 - DNA, 20 bp, mouse
ggtactacctggcggaacca

SEQ ID NO: 577176 - DNA, 20 bp, mouse
gggggagcgcgagcgaacga

SEQ ID NO: 577177 - DNA, 20 bp, mouse
ggagcgcgagcgaacgaggg

SEQ ID NO: 577178 - DNA, 20 bp, mouse
gagcccggcgcaaccctgag

SEQ ID NO: 577179 - DNA, 20 bp, mouse
gcaaggacgggcagctccgt

SEQ ID NO: 577180 - DNA, 20 bp, mouse
gtgagaggaagcgacgagga

SEQ ID NO: 577181 - DNA, 20 bp, mouse
ggcccggctggtcggctgat

SEQ ID NO: 577182 - DNA, 20 bp, mouse
gccagccgggcccggagccg

SEQ ID NO: 577183 - DNA, 20 bp, mouse
gggctgtcgggagttggact

SEQ ID NO: 577184 - DNA, 20 bp, mouse
gaccctgagaggaagcgacg

SEQ ID NO: 577185 - DNA, 20 bp, mouse
gcgccccggcccctgacctg

SEQ ID NO: 577186 - DNA, 20 bp, mouse
ggtctgcgcccctgtaccct

SEQ ID NO: 577187 - DNA, 20 bp, mouse
gcgggttcactctagaccta

SEQ ID NO: 577188 - DNA, 20 bp, mouse
ggacgacgacaaccgaactg

SEQ ID NO: 577189 - DNA, 20 bp, mouse
ggacgacaaccgaactgcgg

SEQ ID NO: 577190 - DNA, 20 bp, mouse
gtctagagtgaacccgcccc

SEQ ID NO: 577191 - DNA, 20 bp, mouse
gcggcctagcttctttcccg

SEQ ID NO: 577192 - DNA, 20 bp, mouse
gccgccccgggaaagaagct

SEQ ID NO: 577193 - DNA, 20 bp, mouse
gcactctagacctagggtac

SEQ ID NO: 577194 - DNA, 20 bp, mouse
gtaactgcacctggaccccg

SEQ ID NO: 577195 - DNA, 20 bp, mouse
gctgcacctggaccccgcgg

SEQ ID NO: 577196 - DNA, 20 bp, mouse
gtggcggcgacagcgacctg

SEQ ID NO: 577197 - DNA, 20 bp, mouse
gcccgcccggcgtggcacaa

SEQ ID NO: 577198 - DNA, 20 bp, mouse
ggacctggggacgagtcccg

SEQ ID NO: 577199 - DNA, 20 bp, mouse
gagcatggcccagccgcacc

SEQ ID NO: 577200 - DNA, 20 bp, mouse
gacgcggacgcggccgggtg

SEQ ID NO: 577201 - DNA, 20 bp, mouse
gtgagtgtcccagtgagcag

SEQ ID NO: 577202 - DNA, 20 bp, mouse
gggcaatcgggagctggtga

SEQ ID NO: 577203 - DNA, 20 bp, mouse
gcgtggcctgcgccgggacg

SEQ ID NO: 577204 - DNA, 20 bp, mouse
ggcgcgccacccgcccggcg

SEQ ID NO: 577205 - DNA, 20 bp, mouse
gtctcgctcggctgcagggt

SEQ ID NO: 577206 - DNA, 20 bp, mouse
gcagcggccggaggtcggag

SEQ ID NO: 577207 - DNA, 20 bp, mouse
gaccaaccacacgccgctgt

SEQ ID NO: 577208 - DNA, 20 bp, mouse
gacccgggcgcccaatgtca

SEQ ID NO: 577209 - DNA, 20 bp, mouse
gacgtgccgcggtccgacca

SEQ ID NO: 577210 - DNA, 20 bp, mouse
gcgcgtgcggcggcctcacc

SEQ ID NO: 577211 - DNA, 20 bp, mouse
gggagatgctgatccggaag

SEQ ID NO: 577212 - DNA, 20 bp, mouse
gaaggaaaaaaactgcaccc

SEQ ID NO: 577213 - DNA, 20 bp, mouse
ggtacgatcagaagaaactc

SEQ ID NO: 577214 - DNA, 20 bp, mouse
gaggagccctggtcggaccg

SEQ ID NO: 577215 - DNA, 20 bp, mouse
gcacagagcagcagcgtcgg

SEQ ID NO: 577216 - DNA, 20 bp, mouse
gccgaggccgcgggacacaa

SEQ ID NO: 577217 - DNA, 20 bp, mouse
ggccgcgggacacaaaggag

SEQ ID NO: 577218 - DNA, 20 bp, mouse
gacgtcccggacccagaccg

SEQ ID NO: 577219 - DNA, 20 bp, mouse
gttggcggcgagctgctccc

SEQ ID NO: 577220 - DNA, 20 bp, mouse
gcgggacacaaaggagcggt

SEQ ID NO: 577221 - DNA, 20 bp, mouse
gcgctaccgacgcagaggag

SEQ ID NO: 577222 - DNA, 20 bp, mouse
gcccgcgcgccggactctcg

SEQ ID NO: 577223 - DNA, 20 bp, mouse
gcggccaggagcggcgacca

SEQ ID NO: 577224 - DNA, 20 bp, mouse
ggagcgggtgggtacagcca

SEQ ID NO: 577225 - DNA, 20 bp, mouse
gcttgctgcaggcggattgg

SEQ ID NO: 577226 - DNA, 20 bp, mouse
gggtggagcccaaggtaccg

SEQ ID NO: 577227 - DNA, 20 bp, mouse
ggcactggccgcgcagctgg

SEQ ID NO: 577228 - DNA, 20 bp, mouse
ggctggggccccggtacctt

SEQ ID NO: 577229 - DNA, 20 bp, mouse
gtcgtgggaactgacctcgg

SEQ ID NO: 577230 - DNA, 20 bp, mouse
gtaccggggccccagctggt

SEQ ID NO: 577231 - DNA, 20 bp, mouse
gcagctagggaggtccagaa

SEQ ID NO: 577232 - DNA, 20 bp, mouse
gcctcgccacccaccagctg

SEQ ID NO: 577233 - DNA, 20 bp, mouse
gccgggtcagtctcagcctc

SEQ ID NO: 577234 - DNA, 20 bp, mouse
gtgtgtccctggcccagcta

SEQ ID NO: 577235 - DNA, 20 bp, mouse
ggtgggtggcgaggcgtcgt

SEQ ID NO: 577236 - DNA, 20 bp, mouse
gcggtgcgcggagcagcagg

SEQ ID NO: 577237 - DNA, 20 bp, mouse
gagcagcaggcggtacgcgg

SEQ ID NO: 577238 - DNA, 20 bp, mouse
gcctgggacgcgttcatccc

SEQ ID NO: 577239 - DNA, 20 bp, mouse
gcggagcagcaggcggtacg

SEQ ID NO: 577240 - DNA, 20 bp, mouse
gcagcagacccgcacatggg

SEQ ID NO: 577241 - DNA, 20 bp, mouse
gagcgcagggccaaggatga

SEQ ID NO: 577242 - DNA, 20 bp, mouse
ggcctcttctcccgcaacct

SEQ ID NO: 577243 - DNA, 20 bp, mouse
gttcatccctggctggcgga

SEQ ID NO: 577244 - DNA, 20 bp, mouse
gggacgcgttcatccctggc

SEQ ID NO: 577245 - DNA, 20 bp, mouse
ggccaaaggggccttcccag

SEQ ID NO: 577246 - DNA, 20 bp, mouse
ggctggggccggagcacccg

SEQ ID NO: 577247 - DNA, 20 bp, mouse
gttgggaccgcagggaacaa

SEQ ID NO: 577248 - DNA, 20 bp, mouse
gttcctcgccgagctggggg

SEQ ID NO: 577249 - DNA, 20 bp, mouse
gctccgggctatggacgccc

SEQ ID NO: 577250 - DNA, 20 bp, mouse
gagagcccagtagagcgaca

SEQ ID NO: 577251 - DNA, 20 bp, mouse
gagctgaagatagtgatcgt

SEQ ID NO: 577252 - DNA, 20 bp, mouse
gcgctgcgggctccgggcta

SEQ ID NO: 577253 - DNA, 20 bp, mouse
gtagtgatcgtaggtgacgg

SEQ ID NO: 577254 - DNA, 20 bp, mouse
gatggacgccccgggtgctc

SEQ ID NO: 577255 - DNA, 20 bp, mouse
gacccggggcgtccatagcc

SEQ ID NO: 577256 - DNA, 20 bp, mouse
gtcacctggtgccctccccg

SEQ ID NO: 577257 - DNA, 20 bp, mouse
gggcggctctgggctcaaga

SEQ ID NO: 577258 - DNA, 20 bp, mouse
gtgcccgacgggctcgaccc

SEQ ID NO: 577259 - DNA, 20 bp, mouse
ggagggcaccaggtgaggcc

SEQ ID NO: 577260 - DNA, 20 bp, mouse
gcccaggacccctgcccgac

SEQ ID NO: 577261 - DNA, 20 bp, mouse
ggctcgacccgggcctcacc

SEQ ID NO: 577262 - DNA, 20 bp, mouse
gagctcccccgccgcgggga

SEQ ID NO: 577263 - DNA, 20 bp, mouse
gtggtgccctccccgcggcg

SEQ ID NO: 577264 - DNA, 20 bp, mouse
gaacccggccaccagcgatc

SEQ ID NO: 577265 - DNA, 20 bp, mouse
gggcccgggtcgagcccgtc

SEQ ID NO: 577266 - DNA, 20 bp, mouse
gtcagtgtcggaggtgaccg

SEQ ID NO: 577267 - DNA, 20 bp, mouse
ggagtccagcccaaggtggt

SEQ ID NO: 577268 - DNA, 20 bp, mouse
gaggtggtgggcctcagtgt

SEQ ID NO: 577269 - DNA, 20 bp, mouse
gtcggaggtgaccgaggcag

SEQ ID NO: 577270 - DNA, 20 bp, mouse
gtggtgggcctcagtgtcgg

SEQ ID NO: 577271 - DNA, 20 bp, mouse
gagccacaggaaactcactt

SEQ ID NO: 577272 - DNA, 20 bp, mouse
gaaaagctgcaacaccggac

SEQ ID NO: 577273 - DNA, 20 bp, mouse
gagagaggtagacctcagga

SEQ ID NO: 577274 - DNA, 20 bp, mouse
gagagagagaggtagacctc

SEQ ID NO: 577275 - DNA, 20 bp, mouse
gttgtggagaagccagccac

SEQ ID NO: 577276 - DNA, 20 bp, mouse
gcctagggacaggtgtgaca

SEQ ID NO: 577277 - DNA, 20 bp, mouse
gggccaaggagagactgcgg

SEQ ID NO: 577278 - DNA, 20 bp, mouse
gatcctccgcagtctctcct

SEQ ID NO: 577279 - DNA, 20 bp, mouse
gatttcatctcgacacccta

SEQ ID NO: 577280 - DNA, 20 bp, mouse
gcggcctggtgaaacccaga

SEQ ID NO: 577281 - DNA, 20 bp, mouse
ggaggctgttccccaaacac

SEQ ID NO: 577282 - DNA, 20 bp, mouse
ggatgaaatcagcctggcca

SEQ ID NO: 577283 - DNA, 20 bp, mouse
gcttgctacaggctgcttaa

SEQ ID NO: 577284 - DNA, 20 bp, mouse
gtgtcgagatgaaatcagcc

SEQ ID NO: 577285 - DNA, 20 bp, mouse
gactgcacagaccttgctac

SEQ ID NO: 577286 - DNA, 20 bp, mouse
ggcctggctaatgacacggt

SEQ ID NO: 577287 - DNA, 20 bp, mouse
gagttgtgtggtggaaaacc

SEQ ID NO: 577288 - DNA, 20 bp, mouse
gggtagagtgagattctcac

SEQ ID NO: 577289 - DNA, 20 bp, mouse
ggaaggaaggcactcttggg

SEQ ID NO: 577290 - DNA, 20 bp, mouse
gctaatgacacggtgggatt

SEQ ID NO: 577291 - DNA, 20 bp, mouse
gccgttgggattgggagaaa

SEQ ID NO: 577292 - DNA, 20 bp, mouse
gtcaccatgctggagaagga

SEQ ID NO: 577293 - DNA, 20 bp, mouse
ggtgtggtggaaaaccgggc

SEQ ID NO: 577294 - DNA, 20 bp, mouse
gtggctggccgggctctccc

SEQ ID NO: 577295 - DNA, 20 bp, mouse
gggaagtcccgggaagtcta

SEQ ID NO: 577296 - DNA, 20 bp, mouse
gtaagaccgtccggccccag

SEQ ID NO: 577297 - DNA, 20 bp, mouse
ggccggacggtcttatgatc

SEQ ID NO: 577298 - DNA, 20 bp, mouse
ggatccggcggatcctcctg

SEQ ID NO: 577299 - DNA, 20 bp, mouse
gccggcccggcctccccagg

SEQ ID NO: 577300 - DNA, 20 bp, mouse
gggacggtcttatgatccgg

SEQ ID NO: 577301 - DNA, 20 bp, mouse
gagcggggcagagatcgaag

SEQ ID NO: 577302 - DNA, 20 bp, mouse
gggcgcccgaacccgctccc

SEQ ID NO: 577303 - DNA, 20 bp, mouse
gagcgggttcgggcgccgag

SEQ ID NO: 577304 - DNA, 20 bp, mouse
ggccctgctgcgccgagcgg

SEQ ID NO: 577305 - DNA, 20 bp, mouse
gcgtagtggtcgaagacagt

SEQ ID NO: 577306 - DNA, 20 bp, mouse
gggtagaggaggagtcggtg

SEQ ID NO: 577307 - DNA, 20 bp, mouse
gggagcagagggccacggta

SEQ ID NO: 577308 - DNA, 20 bp, mouse
gtcggtgcggcaggtcctgg

SEQ ID NO: 577309 - DNA, 20 bp, mouse
gccccggctcccaagcggag

SEQ ID NO: 577310 - DNA, 20 bp, mouse
ggagtcggtgcggcaggtcc

SEQ ID NO: 577311 - DNA, 20 bp, mouse
gccaagcggagcggtagagg

SEQ ID NO: 577312 - DNA, 20 bp, mouse
gtcgggcgcagaggccgcta

SEQ ID NO: 577313 - DNA, 20 bp, mouse
gctcccaagcggagcggtag

SEQ ID NO: 577314 - DNA, 20 bp, mouse
ggtcctggcggccgagattc

SEQ ID NO: 577315 - DNA, 20 bp, mouse
ggcttgccccggctcccaag

SEQ ID NO: 577316 - DNA, 20 bp, mouse
gcgggttgaaggagagggtt

SEQ ID NO: 577317 - DNA, 20 bp, mouse
gggccgcgggaagaccggta

SEQ ID NO: 577318 - DNA, 20 bp, mouse
gctgaagacaggaagtgcgg

SEQ ID NO: 577319 - DNA, 20 bp, mouse
gtccccgcgcagcccaggtg

SEQ ID NO: 577320 - DNA, 20 bp, mouse
gtgagggcggtactgaagac

SEQ ID NO: 577321 - DNA, 20 bp, mouse
ggtactgaagacaggaagtg

SEQ ID NO: 577322 - DNA, 20 bp, mouse
ggtagtcaggagcaccgccg

SEQ ID NO: 577323 - DNA, 20 bp, mouse
ggggagagggaacagtagtc

SEQ ID NO: 577324 - DNA, 20 bp, mouse
gaggagcaccgccgaggtca

SEQ ID NO: 577325 - DNA, 20 bp, mouse
gccggaagcttgggtgaggg

SEQ ID NO: 577326 - DNA, 20 bp, mouse
gtgccaccggcggacaaagg

SEQ ID NO: 577327 - DNA, 20 bp, mouse
gcgagaccagctgccaccgg

SEQ ID NO: 577328 - DNA, 20 bp, mouse
gccgcgagaccagctgccac

SEQ ID NO: 577329 - DNA, 20 bp, mouse
gagctgccaccggcggacaa

SEQ ID NO: 577330 - DNA, 20 bp, mouse
gagcaggctcggccacatcg

SEQ ID NO: 577331 - DNA, 20 bp, mouse
ggcacggtccgcactcggct

SEQ ID NO: 577332 - DNA, 20 bp, mouse
gcgccgcctttgtccgccgg

SEQ ID NO: 577333 - DNA, 20 bp, mouse
gtgcccgcgcggccgcgatg

SEQ ID NO: 577334 - DNA, 20 bp, mouse
gttgctgcggggccatcgcg

SEQ ID NO: 577335 - DNA, 20 bp, mouse
gcgtagggatgtactcggtg

SEQ ID NO: 577336 - DNA, 20 bp, mouse
gcagcccggaccaggctccg

SEQ ID NO: 577337 - DNA, 20 bp, mouse
gccaggctccgcggcactcg

SEQ ID NO: 577338 - DNA, 20 bp, mouse
ggtgccgcggagcctggtcc

SEQ ID NO: 577339 - DNA, 20 bp, mouse
gcgctcctggggtagcagag

SEQ ID NO: 577340 - DNA, 20 bp, mouse
ggattgtcagcgtccggctg

SEQ ID NO: 577341 - DNA, 20 bp, mouse
gggtagcagaggggccagcc

SEQ ID NO: 577342 - DNA, 20 bp, mouse
ggcaggtgtagctgacgatg

SEQ ID NO: 577343 - DNA, 20 bp, mouse
gttgatgcccagctccggag

SEQ ID NO: 577344 - DNA, 20 bp, mouse
gtggacagattgtcagcgtc

SEQ ID NO: 577345 - DNA, 20 bp, mouse
ggcggcatggtccgctcctg

SEQ ID NO: 577346 - DNA, 20 bp, mouse
gaccccatggtggtcacaag

SEQ ID NO: 577347 - DNA, 20 bp, mouse
gacactggtgaggcatagta

SEQ ID NO: 577348 - DNA, 20 bp, mouse
gtggtggtcacaaggggcaa

SEQ ID NO: 577349 - DNA, 20 bp, mouse
gcctagggtaatggcccagg

SEQ ID NO: 577350 - DNA, 20 bp, mouse
gggccacagacaactagacc

SEQ ID NO: 577351 - DNA, 20 bp, mouse
gtggaggggtcctagggtaa

SEQ ID NO: 577352 - DNA, 20 bp, mouse
gtgggaagagccctggcatc

SEQ ID NO: 577353 - DNA, 20 bp, mouse
ggagcttgtaattctatccg

SEQ ID NO: 577354 - DNA, 20 bp, mouse
gaatgtctctcgaatcttgt

SEQ ID NO: 577355 - DNA, 20 bp, mouse
gtattcagtgggtctcttag

SEQ ID NO: 577356 - DNA, 20 bp, mouse
gttgcagatggagcctactc

SEQ ID NO: 577357 - DNA, 20 bp, mouse
gggagcacctcctagttcac

SEQ ID NO: 577358 - DNA, 20 bp, mouse
ggcttaccccataataatcg

SEQ ID NO: 577359 - DNA, 20 bp, mouse
gttttagcccgtgaactagg

SEQ ID NO: 577360 - DNA, 20 bp, mouse
gtatggggtaagcttctatg

SEQ ID NO: 577361 - DNA, 20 bp, mouse
gttcgacctcgattattatg

SEQ ID NO: 577362 - DNA, 20 bp, mouse
ggtatcctgatgcacaccaa

SEQ ID NO: 577363 - DNA, 20 bp, mouse
gcagcagagggctgcggcca

SEQ ID NO: 577364 - DNA, 20 bp, mouse
gtaggtttgcgtgtatttaa

SEQ ID NO: 577365 - DNA, 20 bp, mouse
gttctcgggctctttgggac

SEQ ID NO: 577366 - DNA, 20 bp, mouse
gctaaactagagcctcacac

SEQ ID NO: 577367 - DNA, 20 bp, mouse
gtctagtttaggcacacacg

SEQ ID NO: 577368 - DNA, 20 bp, mouse
gaagccagtagcatcggtgg

SEQ ID NO: 577369 - DNA, 20 bp, mouse
gtgaaagccagtagcatcgg

SEQ ID NO: 577370 - DNA, 20 bp, mouse
gccagtagcatcggtggagg

SEQ ID NO: 577371 - DNA, 20 bp, mouse
gacaactgtcttattctata

SEQ ID NO: 577372 - DNA, 20 bp, mouse
ggagccagaggagaccagta

SEQ ID NO: 577373 - DNA, 20 bp, mouse
gagggccaccagagctctat

SEQ ID NO: 577374 - DNA, 20 bp, mouse
gtggcctacacatcaaacag

SEQ ID NO: 577375 - DNA, 20 bp, mouse
gtatgggatgagcttctgtg

SEQ ID NO: 577376 - DNA, 20 bp, mouse
gaccagcagaactgcttgga

SEQ ID NO: 577377 - DNA, 20 bp, mouse
gcctatctcagcatgagtgg

SEQ ID NO: 577378 - DNA, 20 bp, mouse
gagagaccagcagaactgct

SEQ ID NO: 577379 - DNA, 20 bp, mouse
gcaggttacagactctttcc

SEQ ID NO: 577380 - DNA, 20 bp, mouse
gctgagtgcaaaatgttctt

SEQ ID NO: 577381 - DNA, 20 bp, mouse
gcccaaagtaacaattacct

SEQ ID NO: 577382 - DNA, 20 bp, mouse
gaagcctatctcagcatgag

SEQ ID NO: 577383 - DNA, 20 bp, mouse
gagtggtggctcataaaatc

SEQ ID NO: 577384 - DNA, 20 bp, mouse
gttaggaggcaaaaagaaat

SEQ ID NO: 577385 - DNA, 20 bp, mouse
gagtgcaaaatgttcttagg

SEQ ID NO: 577386 - DNA, 20 bp, mouse
gtcaaccgaggaggccccag

SEQ ID NO: 577387 - DNA, 20 bp, mouse
gcctagggccccgaagctgt

SEQ ID NO: 577388 - DNA, 20 bp, mouse
gtaacagacgctgggcttcg

SEQ ID NO: 577389 - DNA, 20 bp, mouse
ggtgggccatgactagaacc

SEQ ID NO: 577390 - DNA, 20 bp, mouse
ggttaccggtccagtccaga

SEQ ID NO: 577391 - DNA, 20 bp, mouse
ggcttccgtctggactggac

SEQ ID NO: 577392 - DNA, 20 bp, mouse
gtggaccggtaacagacgct

SEQ ID NO: 577393 - DNA, 20 bp, mouse
gtggcgagcagccacgacag

SEQ ID NO: 577394 - DNA, 20 bp, mouse
gagggccccgaagctgttgg

SEQ ID NO: 577395 - DNA, 20 bp, mouse
gatggccgccacctcaaccg

SEQ ID NO: 577396 - DNA, 20 bp, mouse
gtatccatgaggcctgctac

SEQ ID NO: 577397 - DNA, 20 bp, mouse
ggcgcctgtagcaggcctca

SEQ ID NO: 577398 - DNA, 20 bp, mouse
gggccggctgcgcctgtagc

SEQ ID NO: 577399 - DNA, 20 bp, mouse
gggcctgctacaggcgcagc

SEQ ID NO: 577400 - DNA, 20 bp, mouse
gtcaattacctgcttgatgt

SEQ ID NO: 577401 - DNA, 20 bp, mouse
gagtgagtgaagggaagggt

SEQ ID NO: 577402 - DNA, 20 bp, mouse
gggtcagtgagtgaagggaa

SEQ ID NO: 577403 - DNA, 20 bp, mouse
gcgaatggtcagtgagtgaa

SEQ ID NO: 577404 - DNA, 20 bp, mouse
gggcacagccagtggcacta

SEQ ID NO: 577405 - DNA, 20 bp, mouse
gctccagttcagttctatat

SEQ ID NO: 577406 - DNA, 20 bp, mouse
gtgtcttctgagacctttaa

SEQ ID NO: 577407 - DNA, 20 bp, mouse
gtgtgtcctgtgaagcctgt

SEQ ID NO: 577408 - DNA, 20 bp, mouse
gtgttgtctcatgtcacata

SEQ ID NO: 577409 - DNA, 20 bp, mouse
gaagctaaacctaagaccta

SEQ ID NO: 577410 - DNA, 20 bp, mouse
gtaattctgccgtaggtctt

SEQ ID NO: 577411 - DNA, 20 bp, mouse
gcaacagttaattctgccgt

SEQ ID NO: 577412 - DNA, 20 bp, mouse
gctccttgttggaaatacaa

SEQ ID NO: 577413 - DNA, 20 bp, mouse
gcgttcacagaaaaaaataa

SEQ ID NO: 577414 - DNA, 20 bp, mouse
gatttgcatggaataagagg

SEQ ID NO: 577415 - DNA, 20 bp, mouse
ggacaacccacaggcttcac

SEQ ID NO: 577416 - DNA, 20 bp, mouse
ggagcttcaagatcagtcta

SEQ ID NO: 577417 - DNA, 20 bp, mouse
gaggtagtatatgaggatga

SEQ ID NO: 577418 - DNA, 20 bp, mouse
gtcgggagtcatgacgggac

SEQ ID NO: 577419 - DNA, 20 bp, mouse
gatcaagtatttgttcatta

SEQ ID NO: 577420 - DNA, 20 bp, mouse
ggtggctcgggagtcatgac

SEQ ID NO: 577421 - DNA, 20 bp, mouse
gcctgttgctatggtgaggg

SEQ ID NO: 577422 - DNA, 20 bp, mouse
gttcattaaggtagtatatg

SEQ ID NO: 577423 - DNA, 20 bp, mouse
gtcacctgttgctatggtga

SEQ ID NO: 577424 - DNA, 20 bp, mouse
ggagatggtcagtatgtagc

SEQ ID NO: 577425 - DNA, 20 bp, mouse
gcaagaaatgaggaagatgg

SEQ ID NO: 577426 - DNA, 20 bp, mouse
gaagctaaacctaagaccta

SEQ ID NO: 577427 - DNA, 20 bp, mouse
gtaattctgccgtaggtctt

SEQ ID NO: 577428 - DNA, 20 bp, mouse
gcaacagttaattctgccgt

SEQ ID NO: 577429 - DNA, 20 bp, mouse
gctccttgttggaaatacaa

SEQ ID NO: 577430 - DNA, 20 bp, mouse
gcgttcacagaaaaaaataa

SEQ ID NO: 577431 - DNA, 20 bp, mouse
gatttgcatggaataagagg

SEQ ID NO: 577432 - DNA, 20 bp, mouse
gaagggtctgtcagagttcc

SEQ ID NO: 577433 - DNA, 20 bp, mouse
ggtctgtcagagttccgggc

SEQ ID NO: 577434 - DNA, 20 bp, mouse
gtaaatttgcatggaataag

SEQ ID NO: 577435 - DNA, 20 bp, mouse
ggtgggttgtctcaaatgaa

SEQ ID NO: 577436 - DNA, 20 bp, mouse
ggtcttccttgactcccagg

SEQ ID NO: 577437 - DNA, 20 bp, mouse
gtcaccaggctactccgcct

SEQ ID NO: 577438 - DNA, 20 bp, mouse
gttcagggtatggaagctga

SEQ ID NO: 577439 - DNA, 20 bp, mouse
gcgcagactgagctaacaat

SEQ ID NO: 577440 - DNA, 20 bp, mouse
gcgagtcttccttgactccc

SEQ ID NO: 577441 - DNA, 20 bp, mouse
gtcatcattgatcctattca

SEQ ID NO: 577442 - DNA, 20 bp, mouse
gactcccaggcggagtagcc

SEQ ID NO: 577443 - DNA, 20 bp, mouse
gagcctggagtgggagcggt

SEQ ID NO: 577444 - DNA, 20 bp, mouse
gagcctggtgaccttgcggc

SEQ ID NO: 577445 - DNA, 20 bp, mouse
gaggagcaccaggaccaaag

SEQ ID NO: 577446 - DNA, 20 bp, mouse
gctcagggtgagtttgatca

SEQ ID NO: 577447 - DNA, 20 bp, mouse
ggtggtctccggggctccag

SEQ ID NO: 577448 - DNA, 20 bp, mouse
gtactgaactggctcgctca

SEQ ID NO: 577449 - DNA, 20 bp, mouse
ggaaagagcttgtactgaac

SEQ ID NO: 577450 - DNA, 20 bp, mouse
gtcttgtctattctttcctc

SEQ ID NO: 577451 - DNA, 20 bp, mouse
ggataaagacctgagcaaca

SEQ ID NO: 577452 - DNA, 20 bp, mouse
gaggacaaggaagaacagcc

SEQ ID NO: 577453 - DNA, 20 bp, mouse
gacctgagcaacatggccca

SEQ ID NO: 577454 - DNA, 20 bp, mouse
gcctccgagtccggcagccg

SEQ ID NO: 577455 - DNA, 20 bp, mouse
gactggacttgggtgaagtt

SEQ ID NO: 577456 - DNA, 20 bp, mouse
gagtccagcgatccttcctc

SEQ ID NO: 577457 - DNA, 20 bp, mouse
gtatccagaggaaggatcgc

SEQ ID NO: 577458 - DNA, 20 bp, mouse
gggaaggatcgctggactct

SEQ ID NO: 577459 - DNA, 20 bp, mouse
gcaatctctactaagcccaa

SEQ ID NO: 577460 - DNA, 20 bp, mouse
gtctactaagcccaaaggac

SEQ ID NO: 577461 - DNA, 20 bp, mouse
gcagctcaatcctgtccttt

SEQ ID NO: 577462 - DNA, 20 bp, mouse
gtcaccgagttctcacggag

SEQ ID NO: 577463 - DNA, 20 bp, mouse
ggggatccccaggtatccag

SEQ ID NO: 577464 - DNA, 20 bp, mouse
gatccttcctctggatacct

SEQ ID NO: 577465 - DNA, 20 bp, mouse
gtcacggagggggtcaaccg

SEQ ID NO: 577466 - DNA, 20 bp, mouse
gttgagaaggcaggcgagtt

SEQ ID NO: 577467 - DNA, 20 bp, mouse
gtctctcagaagagacgact

SEQ ID NO: 577468 - DNA, 20 bp, mouse
gcgatggtgagtatagggat

SEQ ID NO: 577469 - DNA, 20 bp, mouse
ggtcaacagcatccatgcta

SEQ ID NO: 577470 - DNA, 20 bp, mouse
gcagagttcagagtgagtgg

SEQ ID NO: 577471 - DNA, 20 bp, mouse
gcagagtgtgctttcaagaa

SEQ ID NO: 577472 - DNA, 20 bp, mouse
gttctcaatgccatttattg

SEQ ID NO: 577473 - DNA, 20 bp, mouse
gagaaagcgatggtgagtat

SEQ ID NO: 577474 - DNA, 20 bp, mouse
gaggagagagaggagaacgc

SEQ ID NO: 577475 - DNA, 20 bp, mouse
gcaaccagtgacagcagttt

SEQ ID NO: 577476 - DNA, 20 bp, mouse
gtccaaaagcctccgagtcc

SEQ ID NO: 577477 - DNA, 20 bp, mouse
ggtggtctccggggctggag

SEQ ID NO: 577478 - DNA, 20 bp, mouse
ggataaagatctgagcatca

SEQ ID NO: 577479 - DNA, 20 bp, mouse
gatgcagtggtctccggggc

SEQ ID NO: 577480 - DNA, 20 bp, mouse
gaggacaaggaagaacagca

SEQ ID NO: 577481 - DNA, 20 bp, mouse
gcctccgagtccgggagccg

SEQ ID NO: 577482 - DNA, 20 bp, mouse
gctggacttgggtaaagttt

SEQ ID NO: 577483 - DNA, 20 bp, mouse
gtatggtctgtccggagagg

SEQ ID NO: 577484 - DNA, 20 bp, mouse
gtcaggacagaccgcctctc

SEQ ID NO: 577485 - DNA, 20 bp, mouse
gctccggacagaccataatt

SEQ ID NO: 577486 - DNA, 20 bp, mouse
gctcggacgctgactccgag

SEQ ID NO: 577487 - DNA, 20 bp, mouse
gcagcgcggctgatcctccc

SEQ ID NO: 577488 - DNA, 20 bp, mouse
gagggtccgactgaccggtg

SEQ ID NO: 577489 - DNA, 20 bp, mouse
gtcagtcggaccctccagga

SEQ ID NO: 577490 - DNA, 20 bp, mouse
ggcaggcccctcgcgctcca

SEQ ID NO: 577491 - DNA, 20 bp, mouse
gagcgggtcccaggaaggaa

SEQ ID NO: 577492 - DNA, 20 bp, mouse
ggatcctccctggagcgcga

SEQ ID NO: 577493 - DNA, 20 bp, mouse
gcctgctgctcgcagcctct

SEQ ID NO: 577494 - DNA, 20 bp, mouse
gcctccaggagggggacagt

SEQ ID NO: 577495 - DNA, 20 bp, mouse
gcgagcagcgatgatccttg

SEQ ID NO: 577496 - DNA, 20 bp, mouse
gcccagccgctggagaaaga

SEQ ID NO: 577497 - DNA, 20 bp, mouse
gctggcagcgcgggagtcca

SEQ ID NO: 577498 - DNA, 20 bp, mouse
ggccgcgggtagcagcgtat

SEQ ID NO: 577499 - DNA, 20 bp, mouse
gaccgatacgctgctacccg

SEQ ID NO: 577500 - DNA, 20 bp, mouse
gtccagcggctggggagccg

SEQ ID NO: 577501 - DNA, 20 bp, mouse
ggccgaagggcggagaaggg

SEQ ID NO: 577502 - DNA, 20 bp, mouse
gagcagcgtatcggtcatgc

SEQ ID NO: 577503 - DNA, 20 bp, mouse
ggaggtgcagtggctactaa

SEQ ID NO: 577504 - DNA, 20 bp, mouse
gagggagagacccgcagagt

SEQ ID NO: 577505 - DNA, 20 bp, mouse
gcgggccgaagggcggagaa

SEQ ID NO: 577506 - DNA, 20 bp, mouse
gagtggccgccaactaggac

SEQ ID NO: 577507 - DNA, 20 bp, mouse
gagtgctctgatcacttcgg

SEQ ID NO: 577508 - DNA, 20 bp, mouse
gttctgccagagctagtggg

SEQ ID NO: 577509 - DNA, 20 bp, mouse
gtgggaaggcgccctcggaa

SEQ ID NO: 577510 - DNA, 20 bp, mouse
ggttgaagtggccgccaact

SEQ ID NO: 577511 - DNA, 20 bp, mouse
gaaggcgccctcggaagggt

SEQ ID NO: 577512 - DNA, 20 bp, mouse
gcgcttcccgtcctagttgg

SEQ ID NO: 577513 - DNA, 20 bp, mouse
gtaacgcttcccgtcctagt

SEQ ID NO: 577514 - DNA, 20 bp, mouse
ggtagtctagccagcaaggg

SEQ ID NO: 577515 - DNA, 20 bp, mouse
gtacccagcaactgttgaag

SEQ ID NO: 577516 - DNA, 20 bp, mouse
ggagagcaagtctgtcccgg

SEQ ID NO: 577517 - DNA, 20 bp, mouse
gggccaacctagccaagaag

SEQ ID NO: 577518 - DNA, 20 bp, mouse
gagcagggatccaattcccc

SEQ ID NO: 577519 - DNA, 20 bp, mouse
gggcggtccgctttccgcag

SEQ ID NO: 577520 - DNA, 20 bp, mouse
gtgacctgtgcaggcaggga

SEQ ID NO: 577521 - DNA, 20 bp, mouse
gcactagggacgggacagag

SEQ ID NO: 577522 - DNA, 20 bp, mouse
gcctgctccgctgcggaaag

SEQ ID NO: 577523 - DNA, 20 bp, mouse
gggctcctgctggtaaggta

SEQ ID NO: 577524 - DNA, 20 bp, mouse
gtctaaggacctacaacagg

SEQ ID NO: 577525 - DNA, 20 bp, mouse
gcggaggttggcgttgcccg

SEQ ID NO: 577526 - DNA, 20 bp, mouse
gtactccacggtgcagagag

SEQ ID NO: 577527 - DNA, 20 bp, mouse
ggcagccatggcgtactcca

SEQ ID NO: 577528 - DNA, 20 bp, mouse
gtgcaccgtggagtacgcca

SEQ ID NO: 577529 - DNA, 20 bp, mouse
gagcgccactctctgcaccg

SEQ ID NO: 577530 - DNA, 20 bp, mouse
gcagcagcagcgacacggcc

SEQ ID NO: 577531 - DNA, 20 bp, mouse
gttgggcagcagcagcgaca

SEQ ID NO: 577532 - DNA, 20 bp, mouse
ggtcctgcggtacgcagcca

SEQ ID NO: 577533 - DNA, 20 bp, mouse
ggctgcgtaccgcaggaccc

SEQ ID NO: 577534 - DNA, 20 bp, mouse
gaggacccaggagtccgaac

SEQ ID NO: 577535 - DNA, 20 bp, mouse
gcgacacgcaagtcactgag

SEQ ID NO: 577536 - DNA, 20 bp, mouse
gaccgggtgctggaaggctt

SEQ ID NO: 577537 - DNA, 20 bp, mouse
ggctccatggcccctggcac

SEQ ID NO: 577538 - DNA, 20 bp, mouse
gtcttcctctccggtctcca

SEQ ID NO: 577539 - DNA, 20 bp, mouse
gcctggcaccgggtgctgga

SEQ ID NO: 577540 - DNA, 20 bp, mouse
ggatgccttggagaccggag

SEQ ID NO: 577541 - DNA, 20 bp, mouse
ggcaactgcccggggctcca

SEQ ID NO: 577542 - DNA, 20 bp, mouse
gaggcatccgcaactgcccg

SEQ ID NO: 577543 - DNA, 20 bp, mouse
gccaccacagagccacccga

SEQ ID NO: 577544 - DNA, 20 bp, mouse
gcgcaatcggccaaaccccg

SEQ ID NO: 577545 - DNA, 20 bp, mouse
ggtgtatgggaggctagggt

SEQ ID NO: 577546 - DNA, 20 bp, mouse
gctgggaaggagcgaggtag

SEQ ID NO: 577547 - DNA, 20 bp, mouse
gggaaggagcgaggtagcgg

SEQ ID NO: 577548 - DNA, 20 bp, mouse
gcgcgaggcgtttacctggg

SEQ ID NO: 577549 - DNA, 20 bp, mouse
ggggcgcgaggcgtttacct

SEQ ID NO: 577550 - DNA, 20 bp, mouse
ggcggctggggcgcgcacag

SEQ ID NO: 577551 - DNA, 20 bp, mouse
gtacctgggaggcagcggct

SEQ ID NO: 577552 - DNA, 20 bp, mouse
gaggaagctgggaaggagcg

SEQ ID NO: 577553 - DNA, 20 bp, mouse
gccggcccggacgatgtaga

SEQ ID NO: 577554 - DNA, 20 bp, mouse
gtggcgggttggaggctgga

SEQ ID NO: 577555 - DNA, 20 bp, mouse
gagatgcaggatgaacgagt

SEQ ID NO: 577556 - DNA, 20 bp, mouse
gtcggaggttcttcagagag

SEQ ID NO: 577557 - DNA, 20 bp, mouse
gcaccgggtgaggcgagcga

SEQ ID NO: 577558 - DNA, 20 bp, mouse
ggggcttacctcgtattcgg

SEQ ID NO: 577559 - DNA, 20 bp, mouse
gcgatcgccgccatattgac

SEQ ID NO: 577560 - DNA, 20 bp, mouse
gctgaaacccgtcaatatgg

SEQ ID NO: 577561 - DNA, 20 bp, mouse
gatatggcggcgatcggccg

SEQ ID NO: 577562 - DNA, 20 bp, mouse
gtgactgaaacccgtcaata

SEQ ID NO: 577563 - DNA, 20 bp, mouse
gagcgggcttacctcgtatt

SEQ ID NO: 577564 - DNA, 20 bp, mouse
ggttcttcagagagcggccg

SEQ ID NO: 577565 - DNA, 20 bp, mouse
gccgtgacccgcaccgggtg

SEQ ID NO: 577566 - DNA, 20 bp, mouse
gaataagcgcgagccgggag

SEQ ID NO: 577567 - DNA, 20 bp, mouse
gtcctccacgaccaagatgg

SEQ ID NO: 577568 - DNA, 20 bp, mouse
ggaagacacccagtaaccgg

SEQ ID NO: 577569 - DNA, 20 bp, mouse
gcggcccggcgtgcaggtga

SEQ ID NO: 577570 - DNA, 20 bp, mouse
gaggcagcacggccgcgagg

SEQ ID NO: 577571 - DNA, 20 bp, mouse
ggccccggggcggcgagctg

SEQ ID NO: 577572 - DNA, 20 bp, mouse
gctctcccggaggcaccgag

SEQ ID NO: 577573 - DNA, 20 bp, mouse
gatcttggtcgtggaggagc

SEQ ID NO: 577574 - DNA, 20 bp, mouse
gcccgccgccatcttggtcg

SEQ ID NO: 577575 - DNA, 20 bp, mouse
gcgtgctgcctgggaagcgg

SEQ ID NO: 577576 - DNA, 20 bp, mouse
gtggatcccaccatgctctg

SEQ ID NO: 577577 - DNA, 20 bp, mouse
ggtcagtgcctgcccaagtt

SEQ ID NO: 577578 - DNA, 20 bp, mouse
gtcagactgcgggacctggg

SEQ ID NO: 577579 - DNA, 20 bp, mouse
ggagctaggaacctcttcag

SEQ ID NO: 577580 - DNA, 20 bp, mouse
gaatcaccccagagcatggt

SEQ ID NO: 577581 - DNA, 20 bp, mouse
gcgggacctgggtggtactc

SEQ ID NO: 577582 - DNA, 20 bp, mouse
ggacctgggtggtactcggg

SEQ ID NO: 577583 - DNA, 20 bp, mouse
gagaacccagctcccaactt

SEQ ID NO: 577584 - DNA, 20 bp, mouse
gcgagtgggatcaagaagaa

SEQ ID NO: 577585 - DNA, 20 bp, mouse
gtagaggaaaaccactgaag

SEQ ID NO: 577586 - DNA, 20 bp, mouse
ggcctgggcgctgccctcct

SEQ ID NO: 577587 - DNA, 20 bp, mouse
gctgcaccagttaagggtgt

SEQ ID NO: 577588 - DNA, 20 bp, mouse
gcaccagttaagggtgtggg

SEQ ID NO: 577589 - DNA, 20 bp, mouse
gccagcgcccgcacgactag

SEQ ID NO: 577590 - DNA, 20 bp, mouse
gtctgggcactgagctacag

SEQ ID NO: 577591 - DNA, 20 bp, mouse
ggcccaggagggcagcgccc

SEQ ID NO: 577592 - DNA, 20 bp, mouse
gagatggtacacgagctcgg

SEQ ID NO: 577593 - DNA, 20 bp, mouse
ggagtccggagccggcccca

SEQ ID NO: 577594 - DNA, 20 bp, mouse
gagccacccacacccttaac

SEQ ID NO: 577595 - DNA, 20 bp, mouse
gtccggagccggccccacgg

SEQ ID NO: 577596 - DNA, 20 bp, mouse
ggaacgctgcgaggcgacgt

SEQ ID NO: 577597 - DNA, 20 bp, mouse
gcggcgggcggtgaccctag

SEQ ID NO: 577598 - DNA, 20 bp, mouse
gaggcgacgtgggtttggag

SEQ ID NO: 577599 - DNA, 20 bp, mouse
gagcgagtctctgtccccgg

SEQ ID NO: 577600 - DNA, 20 bp, mouse
gctgcgcaccgagacccccg

SEQ ID NO: 577601 - DNA, 20 bp, mouse
ggacgtgggtttggagagga

SEQ ID NO: 577602 - DNA, 20 bp, mouse
gtcggctctggagaagaacg

SEQ ID NO: 577603 - DNA, 20 bp, mouse
ggcggctgcccagaaccgaa

SEQ ID NO: 577604 - DNA, 20 bp, mouse
ggctctggagaagaacgtgg

SEQ ID NO: 577605 - DNA, 20 bp, mouse
gttctccagagccgacaggg

SEQ ID NO: 577606 - DNA, 20 bp, mouse
ggacacgcacaggggaccgt

SEQ ID NO: 577607 - DNA, 20 bp, mouse
ggaccgtgggaaggtaagca

SEQ ID NO: 577608 - DNA, 20 bp, mouse
gggccgtgcaccaaaagtga

SEQ ID NO: 577609 - DNA, 20 bp, mouse
gaagtgagggacacgcacag

SEQ ID NO: 577610 - DNA, 20 bp, mouse
gccaagggcggagcttcgag

SEQ ID NO: 577611 - DNA, 20 bp, mouse
gcgcacaggggaccgtggga

SEQ ID NO: 577612 - DNA, 20 bp, mouse
gccagagtcagtggacgcat

SEQ ID NO: 577613 - DNA, 20 bp, mouse
ggaggcctggtagtctgcga

SEQ ID NO: 577614 - DNA, 20 bp, mouse
gttccctgcttaccttccca

SEQ ID NO: 577615 - DNA, 20 bp, mouse
gaggacggcgaggaagacga

SEQ ID NO: 577616 - DNA, 20 bp, mouse
gctgacacagtgcactgcag

SEQ ID NO: 577617 - DNA, 20 bp, mouse
gccttggagcccgggaggct

SEQ ID NO: 577618 - DNA, 20 bp, mouse
gtgggcaccgagaacatcca

SEQ ID NO: 577619 - DNA, 20 bp, mouse
gcaccgagaacatccaaggt

SEQ ID NO: 577620 - DNA, 20 bp, mouse
gtggagccttggagcccggg

SEQ ID NO: 577621 - DNA, 20 bp, mouse
ggccatcgctgacacagtac

SEQ ID NO: 577622 - DNA, 20 bp, mouse
gtcagtggcaccggtgacag

SEQ ID NO: 577623 - DNA, 20 bp, mouse
gtggtggctgaccaggacgg

SEQ ID NO: 577624 - DNA, 20 bp, mouse
gcagtggtggctgaccagga

SEQ ID NO: 577625 - DNA, 20 bp, mouse
gacacagtacgggtgagaga

SEQ ID NO: 577626 - DNA, 20 bp, mouse
gtggtaggccagttagccaa

SEQ ID NO: 577627 - DNA, 20 bp, mouse
ggagatagtttggtattggt

SEQ ID NO: 577628 - DNA, 20 bp, mouse
gagaagccagagagatagtt

SEQ ID NO: 577629 - DNA, 20 bp, mouse
ggcgcggccaccacccaagg

SEQ ID NO: 577630 - DNA, 20 bp, mouse
gcagagagatagtttggtat

SEQ ID NO: 577631 - DNA, 20 bp, mouse
ggcggaggccgttggctaac

SEQ ID NO: 577632 - DNA, 20 bp, mouse
gcgagcgtgaggccgagatc

SEQ ID NO: 577633 - DNA, 20 bp, mouse
gcacctaggggcgccggaag

SEQ ID NO: 577634 - DNA, 20 bp, mouse
gcgcgcgcggccggtcggaa

SEQ ID NO: 577635 - DNA, 20 bp, mouse
gcgagagctagaaaaactac

SEQ ID NO: 577636 - DNA, 20 bp, mouse
gtcgccggccgggtctgcag

SEQ ID NO: 577637 - DNA, 20 bp, mouse
ggcgtcccaggcgagcaccg

SEQ ID NO: 577638 - DNA, 20 bp, mouse
gcacggcgcaagcaaagccg

SEQ ID NO: 577639 - DNA, 20 bp, mouse
gacccggccggcgaatgctc

SEQ ID NO: 577640 - DNA, 20 bp, mouse
gggcgatccggagcattcgc

SEQ ID NO: 577641 - DNA, 20 bp, mouse
gtgcagaggcggctggcgca

SEQ ID NO: 577642 - DNA, 20 bp, mouse
ggctgctcggagcaggacgt

SEQ ID NO: 577643 - DNA, 20 bp, mouse
gcctaggtggccgccgacga

SEQ ID NO: 577644 - DNA, 20 bp, mouse
gctcggagccgggctcaagg

SEQ ID NO: 577645 - DNA, 20 bp, mouse
gaaagccgcggtgctcgcct

SEQ ID NO: 577646 - DNA, 20 bp, mouse
gcgcgaggccgtgagaaagt

SEQ ID NO: 577647 - DNA, 20 bp, mouse
ggcgcggcgcctcggtctgg

SEQ ID NO: 577648 - DNA, 20 bp, mouse
ggcgacaggcgagtgaggga

SEQ ID NO: 577649 - DNA, 20 bp, mouse
gcccgcggctacccctccgg

SEQ ID NO: 577650 - DNA, 20 bp, mouse
gcgtgagaaagtgggcgagt

SEQ ID NO: 577651 - DNA, 20 bp, mouse
gtcgagcgacaggcgagtga

SEQ ID NO: 577652 - DNA, 20 bp, mouse
gacagcgcacgacgccggcg

SEQ ID NO: 577653 - DNA, 20 bp, mouse
gcctcggtctgggggacgcg

SEQ ID NO: 577654 - DNA, 20 bp, mouse
gcacacacagcgcacgacgc

SEQ ID NO: 577655 - DNA, 20 bp, mouse
gcggtctgggggacgcgggg

SEQ ID NO: 577656 - DNA, 20 bp, mouse
gaggcggaggctcggcgaga

SEQ ID NO: 577657 - DNA, 20 bp, mouse
gaggctcggcgagagggcga

SEQ ID NO: 577658 - DNA, 20 bp, mouse
gcacagcgaagccctcccgg

SEQ ID NO: 577659 - DNA, 20 bp, mouse
ggccagggcgacccaaacaa

SEQ ID NO: 577660 - DNA, 20 bp, mouse
gagcgaagccctcccggcgg

SEQ ID NO: 577661 - DNA, 20 bp, mouse
ggcctcccgcagcccagcct

SEQ ID NO: 577662 - DNA, 20 bp, mouse
ggcccagcctcggccggcgg

SEQ ID NO: 577663 - DNA, 20 bp, mouse
ggggcgggcaggcggaggct

SEQ ID NO: 577664 - DNA, 20 bp, mouse
ggcccccgccggccgaggct

SEQ ID NO: 577665 - DNA, 20 bp, mouse
ggcggccccgagcctcgcca

SEQ ID NO: 577666 - DNA, 20 bp, mouse
ggcggagccgaaccacccta

SEQ ID NO: 577667 - DNA, 20 bp, mouse
gccccctcccccaggaaaga

SEQ ID NO: 577668 - DNA, 20 bp, mouse
gggctgaggtccggcatctc

SEQ ID NO: 577669 - DNA, 20 bp, mouse
gcgccaccggcggggaggaa

SEQ ID NO: 577670 - DNA, 20 bp, mouse
gcgagcggagccgacatgtt

SEQ ID NO: 577671 - DNA, 20 bp, mouse
ggttgagaggccgccggggt

SEQ ID NO: 577672 - DNA, 20 bp, mouse
gatcaatggccttcaatccg

SEQ ID NO: 577673 - DNA, 20 bp, mouse
gtcggctccgccaaacatgt

SEQ ID NO: 577674 - DNA, 20 bp, mouse
gggaggttgagaggccgccg

SEQ ID NO: 577675 - DNA, 20 bp, mouse
gaggccggctgaggtgacgg

SEQ ID NO: 577676 - DNA, 20 bp, mouse
ggcggcgactgagaactgtg

SEQ ID NO: 577677 - DNA, 20 bp, mouse
ggcttgggctttgcacccgg

SEQ ID NO: 577678 - DNA, 20 bp, mouse
gcagcgacagagactcacgg

SEQ ID NO: 577679 - DNA, 20 bp, mouse
ggagaactgtgtggcgactg

SEQ ID NO: 577680 - DNA, 20 bp, mouse
gaggaagcgggccctggcag

SEQ ID NO: 577681 - DNA, 20 bp, mouse
ggcgggcgcggactccgaag

SEQ ID NO: 577682 - DNA, 20 bp, mouse
gctcccgccagccgtggctt

SEQ ID NO: 577683 - DNA, 20 bp, mouse
gcgcttcctcccgccagccg

SEQ ID NO: 577684 - DNA, 20 bp, mouse
gggagtggcgccgcaaggcg

SEQ ID NO: 577685 - DNA, 20 bp, mouse
ggagctgtccggcccggtgg

SEQ ID NO: 577686 - DNA, 20 bp, mouse
gagacgcgaggtgctcgcgg

SEQ ID NO: 577687 - DNA, 20 bp, mouse
ggtactccgcgtcaagaatg

SEQ ID NO: 577688 - DNA, 20 bp, mouse
ggcagagggccggacactgg

SEQ ID NO: 577689 - DNA, 20 bp, mouse
gccgagacgcgaggtgctcg

SEQ ID NO: 577690 - DNA, 20 bp, mouse
gaccgggagacaaccccccg

SEQ ID NO: 577691 - DNA, 20 bp, mouse
ggacccggagcgcccgagag

SEQ ID NO: 577692 - DNA, 20 bp, mouse
gccaggagcctcggccgcgg

SEQ ID NO: 577693 - DNA, 20 bp, mouse
gctccgcgtcaagaatgggg

SEQ ID NO: 577694 - DNA, 20 bp, mouse
ggagagtgcagcggagacag

SEQ ID NO: 577695 - DNA, 20 bp, mouse
gggagacaaccccccggggt

SEQ ID NO: 577696 - DNA, 20 bp, mouse
gtcccagccatggaagaccc

SEQ ID NO: 577697 - DNA, 20 bp, mouse
gccgaaggagctcccagcca

SEQ ID NO: 577698 - DNA, 20 bp, mouse
gagaccggagcacaccctct

SEQ ID NO: 577699 - DNA, 20 bp, mouse
ggtgtgctccggtctcacca

SEQ ID NO: 577700 - DNA, 20 bp, mouse
ggctcccagagggtgtgctc

SEQ ID NO: 577701 - DNA, 20 bp, mouse
gtggaagaccctggtgagac

SEQ ID NO: 577702 - DNA, 20 bp, mouse
ggagtcccaggagaagccga

SEQ ID NO: 577703 - DNA, 20 bp, mouse
gagctccttcggcttctcct

SEQ ID NO: 577704 - DNA, 20 bp, mouse
gccaggtacaaagttcaggt

SEQ ID NO: 577705 - DNA, 20 bp, mouse
ggtgcccaggtacaaagttc

SEQ ID NO: 577706 - DNA, 20 bp, mouse
gctggccgcggcaggaaacc

SEQ ID NO: 577707 - DNA, 20 bp, mouse
ggggctgaaaggagatgtaa

SEQ ID NO: 577708 - DNA, 20 bp, mouse
ggagatgtaagggctttggt

SEQ ID NO: 577709 - DNA, 20 bp, mouse
gctaggaagagtgctggccg

SEQ ID NO: 577710 - DNA, 20 bp, mouse
gggcaggaaaccgggctgaa

SEQ ID NO: 577711 - DNA, 20 bp, mouse
gggctttggtgggaaataaa

SEQ ID NO: 577712 - DNA, 20 bp, mouse
gcacagtctaggaagagtgc

SEQ ID NO: 577713 - DNA, 20 bp, mouse
gaaaggagatgtaagggctt

SEQ ID NO: 577714 - DNA, 20 bp, mouse
gaccatgggcgcccaaggtc

SEQ ID NO: 577715 - DNA, 20 bp, mouse
ggaggctctacaacatgccg

SEQ ID NO: 577716 - DNA, 20 bp, mouse
gcgcgctgcgatccaggaag

SEQ ID NO: 577717 - DNA, 20 bp, mouse
gggccccgcgcttccccact

SEQ ID NO: 577718 - DNA, 20 bp, mouse
gcgcccagtggggaagcgcg

SEQ ID NO: 577719 - DNA, 20 bp, mouse
gtggcgctgtccctcgccga

SEQ ID NO: 577720 - DNA, 20 bp, mouse
gcagcgccagcgccacgcgg

SEQ ID NO: 577721 - DNA, 20 bp, mouse
ggccctatccggagcaccca

SEQ ID NO: 577722 - DNA, 20 bp, mouse
ggccctgggtgctccggata

SEQ ID NO: 577723 - DNA, 20 bp, mouse
gccagcccggccctcggcga

SEQ ID NO: 577724 - DNA, 20 bp, mouse
gggatccgcacgctcgtggg

SEQ ID NO: 577725 - DNA, 20 bp, mouse
gggcaggacgcgggccacct

SEQ ID NO: 577726 - DNA, 20 bp, mouse
ggcaagggttgcggcgtgag

SEQ ID NO: 577727 - DNA, 20 bp, mouse
gctgcggaccgagcggacca

SEQ ID NO: 577728 - DNA, 20 bp, mouse
gggcgcccaggccatggcgg

SEQ ID NO: 577729 - DNA, 20 bp, mouse
gagcctcggcgcccaggcca

SEQ ID NO: 577730 - DNA, 20 bp, mouse
ggtggcagctgcggaccgag

SEQ ID NO: 577731 - DNA, 20 bp, mouse
gcctctccccaggaaccccg

SEQ ID NO: 577732 - DNA, 20 bp, mouse
ggcgcacgcccagggtcagg

SEQ ID NO: 577733 - DNA, 20 bp, mouse
gcgtcgcggggtgggataca

SEQ ID NO: 577734 - DNA, 20 bp, mouse
gaccgagcggaccagggcag

SEQ ID NO: 577735 - DNA, 20 bp, mouse
gcggaagtgacgtcgagcct

SEQ ID NO: 577736 - DNA, 20 bp, mouse
gggaacaggtagggccccca

SEQ ID NO: 577737 - DNA, 20 bp, mouse
gggctcccctcggaacaggt

SEQ ID NO: 577738 - DNA, 20 bp, mouse
ggggccctacctgttccgag

SEQ ID NO: 577739 - DNA, 20 bp, mouse
gctctggctcccctcggaac

SEQ ID NO: 577740 - DNA, 20 bp, mouse
gcccccagggaccaaacatc

SEQ ID NO: 577741 - DNA, 20 bp, mouse
gggagatccggacatgggta

SEQ ID NO: 577742 - DNA, 20 bp, mouse
ggtgaaagtgctctctagag

SEQ ID NO: 577743 - DNA, 20 bp, mouse
gtccggacatgggtagggct

SEQ ID NO: 577744 - DNA, 20 bp, mouse
ggcaaatgggaccagatgtt

SEQ ID NO: 577745 - DNA, 20 bp, mouse
gtgggaggagatccggacat

SEQ ID NO: 577746 - DNA, 20 bp, mouse
gcagcccggcctgcagagtc

SEQ ID NO: 577747 - DNA, 20 bp, mouse
gggcctgcagagtccggcta

SEQ ID NO: 577748 - DNA, 20 bp, mouse
ggcgaccagaccagccttct

SEQ ID NO: 577749 - DNA, 20 bp, mouse
gtcctaggcgcctctcccag

SEQ ID NO: 577750 - DNA, 20 bp, mouse
gagtcggtgataggaagtcg

SEQ ID NO: 577751 - DNA, 20 bp, mouse
gcgctggtgaccctgcgagg

SEQ ID NO: 577752 - DNA, 20 bp, mouse
gctcaaccctgcgtcccaga

SEQ ID NO: 577753 - DNA, 20 bp, mouse
gaggcgtccctggaaacccg

SEQ ID NO: 577754 - DNA, 20 bp, mouse
gggtctggaccacctcccca

SEQ ID NO: 577755 - DNA, 20 bp, mouse
gagtaactcggaccctgggg

SEQ ID NO: 577756 - DNA, 20 bp, mouse
gaccggggtgtcaggataca

SEQ ID NO: 577757 - DNA, 20 bp, mouse
ggcccaagaaggcaacgacc

SEQ ID NO: 577758 - DNA, 20 bp, mouse
gcaacgaccaggcgccaccg

SEQ ID NO: 577759 - DNA, 20 bp, mouse
ggcaaccgccaggcccaaga

SEQ ID NO: 577760 - DNA, 20 bp, mouse
ggactgcagtctggacagga

SEQ ID NO: 577761 - DNA, 20 bp, mouse
gggttgccgagggatttgag

SEQ ID NO: 577762 - DNA, 20 bp, mouse
gccgggacccactgacaggt

SEQ ID NO: 577763 - DNA, 20 bp, mouse
gccggccgcctacctgtctg

SEQ ID NO: 577764 - DNA, 20 bp, mouse
ggactgcagtccatggctag

SEQ ID NO: 577765 - DNA, 20 bp, mouse
gaggctcacacccctagcca

SEQ ID NO: 577766 - DNA, 20 bp, mouse
ggagcgtccgtggtggaact

SEQ ID NO: 577767 - DNA, 20 bp, mouse
gtcccagagagcgtccgtgg

SEQ ID NO: 577768 - DNA, 20 bp, mouse
gtgcttgcccagttccacca

SEQ ID NO: 577769 - DNA, 20 bp, mouse
ggtcgctgggagctgagtga

SEQ ID NO: 577770 - DNA, 20 bp, mouse
gaactgggcaagcatgggga

SEQ ID NO: 577771 - DNA, 20 bp, mouse
gtccaccacggacgctctct

SEQ ID NO: 577772 - DNA, 20 bp, mouse
gggtgaatgtagccaagctt

SEQ ID NO: 577773 - DNA, 20 bp, mouse
gcagaactctgaagtcatcg

SEQ ID NO: 577774 - DNA, 20 bp, mouse
gcggctcatgtacctaagct

SEQ ID NO: 577775 - DNA, 20 bp, mouse
gatctgggtaaagggcacca

SEQ ID NO: 577776 - DNA, 20 bp, mouse
gagggctccgccgaggacac

SEQ ID NO: 577777 - DNA, 20 bp, mouse
gccatctgtcacctcacctc

SEQ ID NO: 577778 - DNA, 20 bp, mouse
ggtcacctcacctccggcac

SEQ ID NO: 577779 - DNA, 20 bp, mouse
ggctccgccgaggacacggg

SEQ ID NO: 577780 - DNA, 20 bp, mouse
ggctgccggtgccggaggtg

SEQ ID NO: 577781 - DNA, 20 bp, mouse
gaacccgctgccggtgccgg

SEQ ID NO: 577782 - DNA, 20 bp, mouse
ggccccgcccgtgtcctcgg

SEQ ID NO: 577783 - DNA, 20 bp, mouse
gagacgagaacagagtcgag

SEQ ID NO: 577784 - DNA, 20 bp, mouse
gggaagaaagggctccgccg

SEQ ID NO: 577785 - DNA, 20 bp, mouse
ggcagcttggggacccagta

SEQ ID NO: 577786 - DNA, 20 bp, mouse
gggaccagcggcccccggaa

SEQ ID NO: 577787 - DNA, 20 bp, mouse
gtcacctcccgggagtccag

SEQ ID NO: 577788 - DNA, 20 bp, mouse
ggcaccgccgctggactccc

SEQ ID NO: 577789 - DNA, 20 bp, mouse
ggcctcgggagcgcgggtgt

SEQ ID NO: 577790 - DNA, 20 bp, mouse
gtcggtgccgctcacctccc

SEQ ID NO: 577791 - DNA, 20 bp, mouse
gccccagtagtccttagagg

SEQ ID NO: 577792 - DNA, 20 bp, mouse
ggtccttagaggaggaccag

SEQ ID NO: 577793 - DNA, 20 bp, mouse
gggccgctggtcctcctcta

SEQ ID NO: 577794 - DNA, 20 bp, mouse
ggctcccgaggccgttccgg

SEQ ID NO: 577795 - DNA, 20 bp, mouse
gcctcccgggagtccagcgg

SEQ ID NO: 577796 - DNA, 20 bp, mouse
ggcgcggccgcagacccgac

SEQ ID NO: 577797 - DNA, 20 bp, mouse
ggccgcggcgctaggtcccg

SEQ ID NO: 577798 - DNA, 20 bp, mouse
ggcagacccgacgggctccc

SEQ ID NO: 577799 - DNA, 20 bp, mouse
ggaccgggccggaactgcag

SEQ ID NO: 577800 - DNA, 20 bp, mouse
gctgtgccagggagcccgtc

SEQ ID NO: 577801 - DNA, 20 bp, mouse
gcagcggcgtgtggatgtgt

SEQ ID NO: 577802 - DNA, 20 bp, mouse
gcggctgaggtagtgcaggt

SEQ ID NO: 577803 - DNA, 20 bp, mouse
ggcagcggccacgcgggaat

SEQ ID NO: 577804 - DNA, 20 bp, mouse
ggcctctggcacggtctcgt

SEQ ID NO: 577805 - DNA, 20 bp, mouse
gctggcacagctgaccgggc

SEQ ID NO: 577806 - DNA, 20 bp, mouse
gaagtccgggggagcgacct

SEQ ID NO: 577807 - DNA, 20 bp, mouse
gtcagtaggtcaaggcacgg

SEQ ID NO: 577808 - DNA, 20 bp, mouse
gacctgggaagcggaattcg

SEQ ID NO: 577809 - DNA, 20 bp, mouse
gcccagggggcggagataga

SEQ ID NO: 577810 - DNA, 20 bp, mouse
ggcttcccaggtcgctcccc

SEQ ID NO: 577811 - DNA, 20 bp, mouse
gcaatcagtaggtcaaggca

SEQ ID NO: 577812 - DNA, 20 bp, mouse
gggcccggggacacactcaa

SEQ ID NO: 577813 - DNA, 20 bp, mouse
ggtcgctcattcaaagtccg

SEQ ID NO: 577814 - DNA, 20 bp, mouse
gagacatcgtcgggagctag

SEQ ID NO: 577815 - DNA, 20 bp, mouse
gtgcaaagggaacaatcagt

SEQ ID NO: 577816 - DNA, 20 bp, mouse
ggcgatacgcacgcgatgga

SEQ ID NO: 577817 - DNA, 20 bp, mouse
gggcatgcacctgagcacct

SEQ ID NO: 577818 - DNA, 20 bp, mouse
gcgcacgcgatggagggcga

SEQ ID NO: 577819 - DNA, 20 bp, mouse
gtggagctgcgagggaccgg

SEQ ID NO: 577820 - DNA, 20 bp, mouse
ggagggaccggtggcctgag

SEQ ID NO: 577821 - DNA, 20 bp, mouse
ggagcccgacgcacctcaca

SEQ ID NO: 577822 - DNA, 20 bp, mouse
gccccagagcccaccggccc

SEQ ID NO: 577823 - DNA, 20 bp, mouse
gtgtcgtcgacgtgcagact

SEQ ID NO: 577824 - DNA, 20 bp, mouse
gcactggagctgcgagggac

SEQ ID NO: 577825 - DNA, 20 bp, mouse
gcgacgacaggtcagctccc

SEQ ID NO: 577826 - DNA, 20 bp, mouse
gaggcagcggggtccatcct

SEQ ID NO: 577827 - DNA, 20 bp, mouse
gtgctgaaggttctgagaac

SEQ ID NO: 577828 - DNA, 20 bp, mouse
gtgtctggcttggtgtccca

SEQ ID NO: 577829 - DNA, 20 bp, mouse
ggagaaccagacaccaccat

SEQ ID NO: 577830 - DNA, 20 bp, mouse
ggaaggtgtgacgcccatgg

SEQ ID NO: 577831 - DNA, 20 bp, mouse
gcctgggttcagactgtcaa

SEQ ID NO: 577832 - DNA, 20 bp, mouse
gagccaaaggtatagaagaa

SEQ ID NO: 577833 - DNA, 20 bp, mouse
gctggaagagctgtctggct

SEQ ID NO: 577834 - DNA, 20 bp, mouse
gctgccctagcacaaatcaa

SEQ ID NO: 577835 - DNA, 20 bp, mouse
gacagtctgaacccaggctt

SEQ ID NO: 577836 - DNA, 20 bp, mouse
gagagcagcgagggcgaccg

SEQ ID NO: 577837 - DNA, 20 bp, mouse
gggggtgcgaaggtctgcaa

SEQ ID NO: 577838 - DNA, 20 bp, mouse
ggcgctctcggtggtatcca

SEQ ID NO: 577839 - DNA, 20 bp, mouse
gtgtttatgcagagcagcga

SEQ ID NO: 577840 - DNA, 20 bp, mouse
ggcccgggcaaaggcaagag

SEQ ID NO: 577841 - DNA, 20 bp, mouse
gctcaactcggacttagtaa

SEQ ID NO: 577842 - DNA, 20 bp, mouse
gtcccggctgataggtaccc

SEQ ID NO: 577843 - DNA, 20 bp, mouse
gctgaagtagagggcgaaca

SEQ ID NO: 577844 - DNA, 20 bp, mouse
gaggcgagggctgaagtaga

SEQ ID NO: 577845 - DNA, 20 bp, mouse
gcatggcaggacgaccgcgt

SEQ ID NO: 577846 - DNA, 20 bp, mouse
gtggcgccgagtgagcgggt

SEQ ID NO: 577847 - DNA, 20 bp, mouse
gacccgcaccatgagaccgg

SEQ ID NO: 577848 - DNA, 20 bp, mouse
gcgacggcgcctggtccccc

SEQ ID NO: 577849 - DNA, 20 bp, mouse
gcgcgaatctctcagcccga

SEQ ID NO: 577850 - DNA, 20 bp, mouse
gggtgagcgcgttcagccag

SEQ ID NO: 577851 - DNA, 20 bp, mouse
gcgcctccggtctcatggtg

SEQ ID NO: 577852 - DNA, 20 bp, mouse
gaaacctggcgccgagtgag

SEQ ID NO: 577853 - DNA, 20 bp, mouse
ggacacccgcaccatgagac

SEQ ID NO: 577854 - DNA, 20 bp, mouse
gacgcgggcccgaaaggtga

SEQ ID NO: 577855 - DNA, 20 bp, mouse
gccggaggcggccggagtcc

SEQ ID NO: 577856 - DNA, 20 bp, mouse
ggcagctgggaaaggaacgc

SEQ ID NO: 577857 - DNA, 20 bp, mouse
ggcgccatcttccaggaccc

SEQ ID NO: 577858 - DNA, 20 bp, mouse
gaaccagctttgaggccggg

SEQ ID NO: 577859 - DNA, 20 bp, mouse
gccatcttccaggacccggg

SEQ ID NO: 577860 - DNA, 20 bp, mouse
gaggaacgcgggttaccacc

SEQ ID NO: 577861 - DNA, 20 bp, mouse
gaggcagcgtgccagtagga

SEQ ID NO: 577862 - DNA, 20 bp, mouse
gtcatccggctccttcctac

SEQ ID NO: 577863 - DNA, 20 bp, mouse
gcctggaagatggcgccggt

SEQ ID NO: 577864 - DNA, 20 bp, mouse
gcagctgcgccccacagccc

SEQ ID NO: 577865 - DNA, 20 bp, mouse
gattgaggcagcgtgccagt

SEQ ID NO: 577866 - DNA, 20 bp, mouse
ggaaggagggatccatatag

SEQ ID NO: 577867 - DNA, 20 bp, mouse
ggacaagaaccatcagcgac

SEQ ID NO: 577868 - DNA, 20 bp, mouse
gggcgggtccagagagtaca

SEQ ID NO: 577869 - DNA, 20 bp, mouse
ggaggcagctgtatagacca

SEQ ID NO: 577870 - DNA, 20 bp, mouse
gggacccgaggaggaaaaaa

SEQ ID NO: 577871 - DNA, 20 bp, mouse
ggggtccagagagtacaagg

SEQ ID NO: 577872 - DNA, 20 bp, mouse
gaactctaaaactgtgtcaa

SEQ ID NO: 577873 - DNA, 20 bp, mouse
ggcaggcagcctgtcgctga

SEQ ID NO: 577874 - DNA, 20 bp, mouse
gtctgagcaagcacctgaca

SEQ ID NO: 577875 - DNA, 20 bp, mouse
ggccctggcagctcatcagg

SEQ ID NO: 577876 - DNA, 20 bp, mouse
ggtgagacagaccgatccac

SEQ ID NO: 577877 - DNA, 20 bp, mouse
gtacctgacagctctttctt

SEQ ID NO: 577878 - DNA, 20 bp, mouse
gccgagctccagaacaattc

SEQ ID NO: 577879 - DNA, 20 bp, mouse
ggtcaggtaagtcagtaaca

SEQ ID NO: 577880 - DNA, 20 bp, mouse
ggtaagtcagtaacaaggcc

SEQ ID NO: 577881 - DNA, 20 bp, mouse
gaagcaagtgaagcaccctg

SEQ ID NO: 577882 - DNA, 20 bp, mouse
gggcgtacgccatttctgca

SEQ ID NO: 577883 - DNA, 20 bp, mouse
gcaattaattaccaatacta

SEQ ID NO: 577884 - DNA, 20 bp, mouse
gtgaagcaccctgagggaga

SEQ ID NO: 577885 - DNA, 20 bp, mouse
ggttcttacccattagctgt

SEQ ID NO: 577886 - DNA, 20 bp, mouse
gctgctgggccgtgggaaga

SEQ ID NO: 577887 - DNA, 20 bp, mouse
ggacggaaagggagacgcca

SEQ ID NO: 577888 - DNA, 20 bp, mouse
gggaagatggcggacggaaa

SEQ ID NO: 577889 - DNA, 20 bp, mouse
gccacggcccagcagcgcgt

SEQ ID NO: 577890 - DNA, 20 bp, mouse
gagggagcaggaggtgtccg

SEQ ID NO: 577891 - DNA, 20 bp, mouse
ggacccaggcaacagcgaca

SEQ ID NO: 577892 - DNA, 20 bp, mouse
gtccgtccgccatcttccca

SEQ ID NO: 577893 - DNA, 20 bp, mouse
gatctagtccacccctcacc

SEQ ID NO: 577894 - DNA, 20 bp, mouse
gcagctggagaccgagctga

SEQ ID NO: 577895 - DNA, 20 bp, mouse
gcccttgcagggagctctct

SEQ ID NO: 577896 - DNA, 20 bp, mouse
gtcagtgctaggtaacaatg

SEQ ID NO: 577897 - DNA, 20 bp, mouse
ggtaacaatggggaagataa

SEQ ID NO: 577898 - DNA, 20 bp, mouse
gagcgcagcggaggtcccag

SEQ ID NO: 577899 - DNA, 20 bp, mouse
gcgagctggcgctgttctag

SEQ ID NO: 577900 - DNA, 20 bp, mouse
gctaacccgcctctaaaccc

SEQ ID NO: 577901 - DNA, 20 bp, mouse
ggaggcgggttagaacgcgg

SEQ ID NO: 577902 - DNA, 20 bp, mouse
gacagccgggagcccaggtc

SEQ ID NO: 577903 - DNA, 20 bp, mouse
gcggcagcacagtagcgcag

SEQ ID NO: 577904 - DNA, 20 bp, mouse
gttagaggcgggttagaacg

SEQ ID NO: 577905 - DNA, 20 bp, mouse
ggcggaggtcccagtggcgg

SEQ ID NO: 577906 - DNA, 20 bp, mouse
gcaggagcccagtcccgcca

SEQ ID NO: 577907 - DNA, 20 bp, mouse
gtagccagaaccccaggagc

SEQ ID NO: 577908 - DNA, 20 bp, mouse
gctgctggacattccggtct

SEQ ID NO: 577909 - DNA, 20 bp, mouse
gatgagaaggcgctcaccag

SEQ ID NO: 577910 - DNA, 20 bp, mouse
gcagcaatagccagaacccc

SEQ ID NO: 577911 - DNA, 20 bp, mouse
gtgcaggacgcgagtctcgg

SEQ ID NO: 577912 - DNA, 20 bp, mouse
gaaagccggattgagcactg

SEQ ID NO: 577913 - DNA, 20 bp, mouse
gaaatctgcggggcctccgt

SEQ ID NO: 577914 - DNA, 20 bp, mouse
gggggcctccgtgggaagat

SEQ ID NO: 577915 - DNA, 20 bp, mouse
ggactcgcgtcctgcaaggc

SEQ ID NO: 577916 - DNA, 20 bp, mouse
gtggtgcagatagagcacct

SEQ ID NO: 577917 - DNA, 20 bp, mouse
ggctgatcatggcaatgctc

SEQ ID NO: 577918 - DNA, 20 bp, mouse
gcaggcatctcagctgatca

SEQ ID NO: 577919 - DNA, 20 bp, mouse
ggcttcctgggctctcctcg

SEQ ID NO: 577920 - DNA, 20 bp, mouse
gcacttgcggaggctcacga

SEQ ID NO: 577921 - DNA, 20 bp, mouse
gtgtataaataggggatcgg

SEQ ID NO: 577922 - DNA, 20 bp, mouse
ggatagagcacctgggtcgc

SEQ ID NO: 577923 - DNA, 20 bp, mouse
ggagccagcctgtataaata

SEQ ID NO: 577924 - DNA, 20 bp, mouse
gcactcacccagagattcgt

SEQ ID NO: 577925 - DNA, 20 bp, mouse
ggataacccaggtcagcggg

SEQ ID NO: 577926 - DNA, 20 bp, mouse
ggggacggcccaatgagctc

SEQ ID NO: 577927 - DNA, 20 bp, mouse
gagccggcaggagcgtacac

SEQ ID NO: 577928 - DNA, 20 bp, mouse
gtctggcgggaaaaagcagc

SEQ ID NO: 577929 - DNA, 20 bp, mouse
gacggcccaatgagctctgg

SEQ ID NO: 577930 - DNA, 20 bp, mouse
gcacagagtggccctaatag

SEQ ID NO: 577931 - DNA, 20 bp, mouse
gctgtgccatagggccggga

SEQ ID NO: 577932 - DNA, 20 bp, mouse
gggcgccgagaggagaggtc

SEQ ID NO: 577933 - DNA, 20 bp, mouse
gccttagggaacttgaccag

SEQ ID NO: 577934 - DNA, 20 bp, mouse
gttcctgtgtacgctcctgc

SEQ ID NO: 577935 - DNA, 20 bp, mouse
ggggtctgtgccatagggcc

SEQ ID NO: 577936 - DNA, 20 bp, mouse
gccatcaagcagggcgtcgg

SEQ ID NO: 577937 - DNA, 20 bp, mouse
ggtcagcagacgaggacctg

SEQ ID NO: 577938 - DNA, 20 bp, mouse
ggctgacagacgcggagtgg

SEQ ID NO: 577939 - DNA, 20 bp, mouse
gtctgctgacagacgcggag

SEQ ID NO: 577940 - DNA, 20 bp, mouse
gatgactgacagcttcccag

SEQ ID NO: 577941 - DNA, 20 bp, mouse
ggcgcgtcgtcagtcccgct

SEQ ID NO: 577942 - DNA, 20 bp, mouse
gaggccagctgtctcagcgg

SEQ ID NO: 577943 - DNA, 20 bp, mouse
ggcgaaagtcagctccggaa

SEQ ID NO: 577944 - DNA, 20 bp, mouse
gtggaggacctgacaaaacg

SEQ ID NO: 577945 - DNA, 20 bp, mouse
gcctccagacctggcgatgg

SEQ ID NO: 577946 - DNA, 20 bp, mouse
gcgagcgggcgagccaggag

SEQ ID NO: 577947 - DNA, 20 bp, mouse
ggccagggaaccgggacccg

SEQ ID NO: 577948 - DNA, 20 bp, mouse
gtgggacccgcaggctgcac

SEQ ID NO: 577949 - DNA, 20 bp, mouse
gcgttgcgcaggcttctctg

SEQ ID NO: 577950 - DNA, 20 bp, mouse
gggccaccacgcaggacctt

SEQ ID NO: 577951 - DNA, 20 bp, mouse
ggcaggaccttgggacccgc

SEQ ID NO: 577952 - DNA, 20 bp, mouse
gaaggcggcggcacttccgg

SEQ ID NO: 577953 - DNA, 20 bp, mouse
ggtcccaaggtcctgcgtgg

SEQ ID NO: 577954 - DNA, 20 bp, mouse
ggcagccccaggtcaccagg

SEQ ID NO: 577955 - DNA, 20 bp, mouse
gggctgcacagggttccact

SEQ ID NO: 577956 - DNA, 20 bp, mouse
ggtggctggtggctgggtaa

SEQ ID NO: 577957 - DNA, 20 bp, mouse
gcagccaccatggcagcagc

SEQ ID NO: 577958 - DNA, 20 bp, mouse
gagacggacgccctgccaag

SEQ ID NO: 577959 - DNA, 20 bp, mouse
gggcccagcgtggcttcggg

SEQ ID NO: 577960 - DNA, 20 bp, mouse
gctggacctgggtgagccgg

SEQ ID NO: 577961 - DNA, 20 bp, mouse
gtcaccgtgcgcggagcagg

SEQ ID NO: 577962 - DNA, 20 bp, mouse
ggagcaggtggcgcggatta

SEQ ID NO: 577963 - DNA, 20 bp, mouse
ggaagccacgctgggcccgc

SEQ ID NO: 577964 - DNA, 20 bp, mouse
gctagactgggggccctggg

SEQ ID NO: 577965 - DNA, 20 bp, mouse
ggaaccgagagagagtcatg

SEQ ID NO: 577966 - DNA, 20 bp, mouse
gggttggcgccccgggatgg

SEQ ID NO: 577967 - DNA, 20 bp, mouse
ggcccaaagggagtcgccgg

SEQ ID NO: 577968 - DNA, 20 bp, mouse
gccagcccaaagggagtcgc

SEQ ID NO: 577969 - DNA, 20 bp, mouse
gtccgccggcgactcccttt

SEQ ID NO: 577970 - DNA, 20 bp, mouse
ggccccgtgagcgcccgatt

SEQ ID NO: 577971 - DNA, 20 bp, mouse
gacctctcgcgagacttcag

SEQ ID NO: 577972 - DNA, 20 bp, mouse
gctacaggccgcaatcgagt

SEQ ID NO: 577973 - DNA, 20 bp, mouse
ggcgcgaacgagaaaggagg

SEQ ID NO: 577974 - DNA, 20 bp, mouse
gccgcgggcctgagaaaact

SEQ ID NO: 577975 - DNA, 20 bp, mouse
ggagtgggagacgagcacga

SEQ ID NO: 577976 - DNA, 20 bp, mouse
gccaccggaggacagcgact

SEQ ID NO: 577977 - DNA, 20 bp, mouse
gacggccccggggccaccgg

SEQ ID NO: 577978 - DNA, 20 bp, mouse
gagagttggcgggaaagcgg

SEQ ID NO: 577979 - DNA, 20 bp, mouse
gcgtccgagtcgctgtcctc

SEQ ID NO: 577980 - DNA, 20 bp, mouse
gcgcacggccccggggccac

SEQ ID NO: 577981 - DNA, 20 bp, mouse
gcggcagccgcacggccccg

SEQ ID NO: 577982 - DNA, 20 bp, mouse
gtcccgccaactctgacgga

SEQ ID NO: 577983 - DNA, 20 bp, mouse
gaagcggtggtggcgcagca

SEQ ID NO: 577984 - DNA, 20 bp, mouse
ggttggcgggaaagcggtgg

SEQ ID NO: 577985 - DNA, 20 bp, mouse
ggtggggagtcacttgacag

SEQ ID NO: 577986 - DNA, 20 bp, mouse
gcccgccgcaggaacctctg

SEQ ID NO: 577987 - DNA, 20 bp, mouse
gcactgacctgtgcgcggag

SEQ ID NO: 577988 - DNA, 20 bp, mouse
gggtcgtcctctccgcgcac

SEQ ID NO: 577989 - DNA, 20 bp, mouse
gcgaagcactgacctgtgcg

SEQ ID NO: 577990 - DNA, 20 bp, mouse
gtcaccagcttctccggctg

SEQ ID NO: 577991 - DNA, 20 bp, mouse
ggcggcgggagcgtgcgcgt

SEQ ID NO: 577992 - DNA, 20 bp, mouse
gtagattcagcgggtaagtg

SEQ ID NO: 577993 - DNA, 20 bp, mouse
ggcggggtgtgtttccgcag

SEQ ID NO: 577994 - DNA, 20 bp, mouse
gccccgccgagttggaagca

SEQ ID NO: 577995 - DNA, 20 bp, mouse
gggtaggcctaggcgtttga

SEQ ID NO: 577996 - DNA, 20 bp, mouse
ggcgttcggccgcccctcgg

SEQ ID NO: 577997 - DNA, 20 bp, mouse
gcccgggagaaccaggtcat

SEQ ID NO: 577998 - DNA, 20 bp, mouse
gtgaaaacaaaaacaatcgg

SEQ ID NO: 577999 - DNA, 20 bp, mouse
gggagaaccaggtcatcggc

SEQ ID NO: 578000 - DNA, 20 bp, mouse
gcgggaaccggccgatgacc

SEQ ID NO: 578001 - DNA, 20 bp, mouse
gaatagccgcggcccgggag

SEQ ID NO: 578002 - DNA, 20 bp, mouse
gcgggcggcgcgggaggcga

SEQ ID NO: 578003 - DNA, 20 bp, mouse
ggtctcgccccgggcccccc

SEQ ID NO: 578004 - DNA, 20 bp, mouse
gggaggctcgaccccctccc

SEQ ID NO: 578005 - DNA, 20 bp, mouse
gggcatggatcagtgcgtga

SEQ ID NO: 578006 - DNA, 20 bp, mouse
gcgtcggccacaccctccaa

SEQ ID NO: 578007 - DNA, 20 bp, mouse
ggcgccccgcaccccgggac

SEQ ID NO: 578008 - DNA, 20 bp, mouse
ggcaccccgggaccgggagc

SEQ ID NO: 578009 - DNA, 20 bp, mouse
gcttccggttccgatgacag

SEQ ID NO: 578010 - DNA, 20 bp, mouse
ggaggtaagcagccagtggg

SEQ ID NO: 578011 - DNA, 20 bp, mouse
gcaaagcctggagcagtcgt

SEQ ID NO: 578012 - DNA, 20 bp, mouse
ggtgtgtggagacctagata

SEQ ID NO: 578013 - DNA, 20 bp, mouse
gcagtcaggtgcactaggac

SEQ ID NO: 578014 - DNA, 20 bp, mouse
gtactatgcgggtcaagtcg

SEQ ID NO: 578015 - DNA, 20 bp, mouse
gccggaaccccgccacccac

SEQ ID NO: 578016 - DNA, 20 bp, mouse
gggatggagctcccaagctg

SEQ ID NO: 578017 - DNA, 20 bp, mouse
gaagaacgagtgggtcgggg

SEQ ID NO: 578018 - DNA, 20 bp, mouse
ggtgctcccttccccagctt

SEQ ID NO: 578019 - DNA, 20 bp, mouse
ggttagaactgagagagtcc

SEQ ID NO: 578020 - DNA, 20 bp, mouse
gtcacacagtctctgtggtg

SEQ ID NO: 578021 - DNA, 20 bp, mouse
gtttgaactccaagacgaat

SEQ ID NO: 578022 - DNA, 20 bp, mouse
gactgacttccaattcgtct

SEQ ID NO: 578023 - DNA, 20 bp, mouse
gtcagatataaagaacgagt

SEQ ID NO: 578024 - DNA, 20 bp, mouse
gataaagaacgagtgggtcg

SEQ ID NO: 578025 - DNA, 20 bp, mouse
ggagcccagcaaacagctgg

SEQ ID NO: 578026 - DNA, 20 bp, mouse
gagagcagaactggggacat

SEQ ID NO: 578027 - DNA, 20 bp, mouse
gtcacagagaaggacgctct

SEQ ID NO: 578028 - DNA, 20 bp, mouse
gtgtatggagagcagtttct

SEQ ID NO: 578029 - DNA, 20 bp, mouse
gaaggagatagctacttgta

SEQ ID NO: 578030 - DNA, 20 bp, mouse
ggtgtaggtaagccacgtca

SEQ ID NO: 578031 - DNA, 20 bp, mouse
ggaggtacccgaccctgacg

SEQ ID NO: 578032 - DNA, 20 bp, mouse
gacctcagagagcaaagccg

SEQ ID NO: 578033 - DNA, 20 bp, mouse
gagtggcaataacattacat

SEQ ID NO: 578034 - DNA, 20 bp, mouse
gaggtaagccacgtcagggt

SEQ ID NO: 578035 - DNA, 20 bp, mouse
gtaaagctgcttacaagtgt

SEQ ID NO: 578036 - DNA, 20 bp, mouse
ggatcaccatacttacaaga

SEQ ID NO: 578037 - DNA, 20 bp, mouse
gtttgcaagaagcagtccaa

SEQ ID NO: 578038 - DNA, 20 bp, mouse
ggactgccatcttgtaagta

SEQ ID NO: 578039 - DNA, 20 bp, mouse
ggctgcaaaacagactctag

SEQ ID NO: 578040 - DNA, 20 bp, mouse
gaattcccaaggccacccga

SEQ ID NO: 578041 - DNA, 20 bp, mouse
gctaagagtctggagaaccg

SEQ ID NO: 578042 - DNA, 20 bp, mouse
gctggagaaccgaggtagac

SEQ ID NO: 578043 - DNA, 20 bp, mouse
gatagttaccctcacaaaaa

SEQ ID NO: 578044 - DNA, 20 bp, mouse
gagggaaatactatgagaga

SEQ ID NO: 578045 - DNA, 20 bp, mouse
gattctgaggctcacatcca

SEQ ID NO: 578046 - DNA, 20 bp, mouse
ggaacaagagcaaaaagggc

SEQ ID NO: 578047 - DNA, 20 bp, mouse
gggtctaggaacagtgagac

SEQ ID NO: 578048 - DNA, 20 bp, mouse
gccaccattaggaccatcag

SEQ ID NO: 578049 - DNA, 20 bp, mouse
gcggaagctgaacccacgca

SEQ ID NO: 578050 - DNA, 20 bp, mouse
gttgcaagtgctgcccaact

SEQ ID NO: 578051 - DNA, 20 bp, mouse
gcggtcagtaataggaaaaa

SEQ ID NO: 578052 - DNA, 20 bp, mouse
ggaacagattacagtctcga

SEQ ID NO: 578053 - DNA, 20 bp, mouse
gccacttcctctccctgcgt

SEQ ID NO: 578054 - DNA, 20 bp, mouse
ggcacttgcaatggggtctt

SEQ ID NO: 578055 - DNA, 20 bp, mouse
gtgaactcctggtaagtaaa

SEQ ID NO: 578056 - DNA, 20 bp, mouse
gcacagaaggagtggagaac

SEQ ID NO: 578057 - DNA, 20 bp, mouse
gtccttatggtagccacaga

SEQ ID NO: 578058 - DNA, 20 bp, mouse
gtgcttcccagcactcctta

SEQ ID NO: 578059 - DNA, 20 bp, mouse
gtccttctgtggctaccata

SEQ ID NO: 578060 - DNA, 20 bp, mouse
gggctaccataaggagtgct

SEQ ID NO: 578061 - DNA, 20 bp, mouse
gcagctggtccttggagaaa

SEQ ID NO: 578062 - DNA, 20 bp, mouse
gcggagactctgggaagcgt

SEQ ID NO: 578063 - DNA, 20 bp, mouse
gtggagtgacagaatctgta

SEQ ID NO: 578064 - DNA, 20 bp, mouse
gagtggagaacaggctgcct

SEQ ID NO: 578065 - DNA, 20 bp, mouse
gggagaagaccggagactct

SEQ ID NO: 578066 - DNA, 20 bp, mouse
gagctggacacattcccagt

SEQ ID NO: 578067 - DNA, 20 bp, mouse
gtggacacattcccagtcgg

SEQ ID NO: 578068 - DNA, 20 bp, mouse
ggtctccaggagcacgcagc

SEQ ID NO: 578069 - DNA, 20 bp, mouse
ggaccaccaccaccagactc

SEQ ID NO: 578070 - DNA, 20 bp, mouse
gaaaaccccgagtctggtgg

SEQ ID NO: 578071 - DNA, 20 bp, mouse
gaggaaaaccccgagtctgg

SEQ ID NO: 578072 - DNA, 20 bp, mouse
gtggcttcctaagcctttgg

SEQ ID NO: 578073 - DNA, 20 bp, mouse
gtgtgattaaaagcccccaa

SEQ ID NO: 578074 - DNA, 20 bp, mouse
gtgccaagccaagcttgtta

SEQ ID NO: 578075 - DNA, 20 bp, mouse
gctccataacaagcttggct

SEQ ID NO: 578076 - DNA, 20 bp, mouse
ggccgacctcacccatatcg

SEQ ID NO: 578077 - DNA, 20 bp, mouse
gatcggggacgagattccaa

SEQ ID NO: 578078 - DNA, 20 bp, mouse
gggaatctcgtccccgatat

SEQ ID NO: 578079 - DNA, 20 bp, mouse
gctcgtccccgatatgggtg

SEQ ID NO: 578080 - DNA, 20 bp, mouse
gtccccgatatgggtgaggt

SEQ ID NO: 578081 - DNA, 20 bp, mouse
gctggacccggaactggagg

SEQ ID NO: 578082 - DNA, 20 bp, mouse
gcacctggacccggaactgg

SEQ ID NO: 578083 - DNA, 20 bp, mouse
gctagaaccagggctcatag

SEQ ID NO: 578084 - DNA, 20 bp, mouse
gattcgccatcccaacagga

SEQ ID NO: 578085 - DNA, 20 bp, mouse
gggacatccacgctggactc

SEQ ID NO: 578086 - DNA, 20 bp, mouse
ggccttcctgtgccccacct

SEQ ID NO: 578087 - DNA, 20 bp, mouse
gggtcacagctgcctaggtg

SEQ ID NO: 578088 - DNA, 20 bp, mouse
gtgggctcctatggtgaaca

SEQ ID NO: 578089 - DNA, 20 bp, mouse
ggggccagatgatccgtccc

SEQ ID NO: 578090 - DNA, 20 bp, mouse
ggagcctgggacggatcatc

SEQ ID NO: 578091 - DNA, 20 bp, mouse
gtggttgtgctgggctccta

SEQ ID NO: 578092 - DNA, 20 bp, mouse
gaagctgcagcgggaggatg

SEQ ID NO: 578093 - DNA, 20 bp, mouse
gcacaaccagcaggtaagag

SEQ ID NO: 578094 - DNA, 20 bp, mouse
gttactgcaggtatcataca

SEQ ID NO: 578095 - DNA, 20 bp, mouse
gaacaaaatattctgagcct

SEQ ID NO: 578096 - DNA, 20 bp, mouse
gttccacagagcgcccgtag

SEQ ID NO: 578097 - DNA, 20 bp, mouse
gggagacgatggcaagagtc

SEQ ID NO: 578098 - DNA, 20 bp, mouse
ggaacaaaagtgctcctcta

SEQ ID NO: 578099 - DNA, 20 bp, mouse
ggatgtccaaggggcacagg

SEQ ID NO: 578100 - DNA, 20 bp, mouse
gcagaagagggatgtccaag

SEQ ID NO: 578101 - DNA, 20 bp, mouse
gctcctctacgggcgctctg

SEQ ID NO: 578102 - DNA, 20 bp, mouse
gcacagggtgatattgatgg

SEQ ID NO: 578103 - DNA, 20 bp, mouse
gagggatgtccaaggggcac

SEQ ID NO: 578104 - DNA, 20 bp, mouse
gcttttgttctacaaagaag

SEQ ID NO: 578105 - DNA, 20 bp, mouse
gtgggagtgtctaggtaaca

SEQ ID NO: 578106 - DNA, 20 bp, mouse
gggctcgcgggcagcaatgt

SEQ ID NO: 578107 - DNA, 20 bp, mouse
gtcgccggcgggaggctcgc

SEQ ID NO: 578108 - DNA, 20 bp, mouse
ggtgtcactgtgcgggacag

SEQ ID NO: 578109 - DNA, 20 bp, mouse
gctgcccgcgagcctcccgc

SEQ ID NO: 578110 - DNA, 20 bp, mouse
gtcctgagccggaagtgtgt

SEQ ID NO: 578111 - DNA, 20 bp, mouse
gcggcgagccgacacacttc

SEQ ID NO: 578112 - DNA, 20 bp, mouse
gcgcatcactcacgccagcg

SEQ ID NO: 578113 - DNA, 20 bp, mouse
gggaggatttgactacaaca

SEQ ID NO: 578114 - DNA, 20 bp, mouse
gacaggaacgatcagaacgt

SEQ ID NO: 578115 - DNA, 20 bp, mouse
ggacggccagtgtcactgtg

SEQ ID NO: 578116 - DNA, 20 bp, mouse
ggagctggagagggacaata

SEQ ID NO: 578117 - DNA, 20 bp, mouse
gggaggcgcgtgggtgaaag

SEQ ID NO: 578118 - DNA, 20 bp, mouse
gtccagggccgcgggctggg

SEQ ID NO: 578119 - DNA, 20 bp, mouse
gcccagcatgatcctcactc

SEQ ID NO: 578120 - DNA, 20 bp, mouse
gtggaagcgcaccaagcaca

SEQ ID NO: 578121 - DNA, 20 bp, mouse
ggggatccggaagcgatagt

SEQ ID NO: 578122 - DNA, 20 bp, mouse
gtgttgttttctacaattgt

SEQ ID NO: 578123 - DNA, 20 bp, mouse
gcgcgggctgggaggcgcgt

SEQ ID NO: 578124 - DNA, 20 bp, mouse
gttcctgggtatgtgcaggg

SEQ ID NO: 578125 - DNA, 20 bp, mouse
gtccggaagcgatagtggga

SEQ ID NO: 578126 - DNA, 20 bp, mouse
gagtaggggacaccagacct

SEQ ID NO: 578127 - DNA, 20 bp, mouse
gagtcagcaacggagccaag

SEQ ID NO: 578128 - DNA, 20 bp, mouse
gtctgggtcgatctgagtag

SEQ ID NO: 578129 - DNA, 20 bp, mouse
gcaccagacctaggagcact

SEQ ID NO: 578130 - DNA, 20 bp, mouse
gtgactcccctagtgctcct

SEQ ID NO: 578131 - DNA, 20 bp, mouse
gttggggtcggttggaatcc

SEQ ID NO: 578132 - DNA, 20 bp, mouse
gccacggggcgcgttggggt

SEQ ID NO: 578133 - DNA, 20 bp, mouse
gggccaagtgaggccttcgg

SEQ ID NO: 578134 - DNA, 20 bp, mouse
gaccgtgcgggccaaagtat

SEQ ID NO: 578135 - DNA, 20 bp, mouse
gcaacggagccaagtggctc

SEQ ID NO: 578136 - DNA, 20 bp, mouse
gcctggccgccaagtccccg

SEQ ID NO: 578137 - DNA, 20 bp, mouse
gcgggaccgcggggacttgg

SEQ ID NO: 578138 - DNA, 20 bp, mouse
ggccggaggtcgggaccgcg

SEQ ID NO: 578139 - DNA, 20 bp, mouse
gcccgcgtttacctggaagt

SEQ ID NO: 578140 - DNA, 20 bp, mouse
gcggtcccgacctccggcca

SEQ ID NO: 578141 - DNA, 20 bp, mouse
gagggcgcgaccatggccgg

SEQ ID NO: 578142 - DNA, 20 bp, mouse
gttccggcagggcgcgacca

SEQ ID NO: 578143 - DNA, 20 bp, mouse
ggcgaccatggccggaggtc

SEQ ID NO: 578144 - DNA, 20 bp, mouse
gtccccgcggtcccgacctc

SEQ ID NO: 578145 - DNA, 20 bp, mouse
gagtaggaacactagctgcc

SEQ ID NO: 578146 - DNA, 20 bp, mouse
gtctgagatgaagaacccgg

SEQ ID NO: 578147 - DNA, 20 bp, mouse
gatgaagaacccggaggaag

SEQ ID NO: 578148 - DNA, 20 bp, mouse
gggcaccacgcagcgagcca

SEQ ID NO: 578149 - DNA, 20 bp, mouse
gtggccacgggaggatgtac

SEQ ID NO: 578150 - DNA, 20 bp, mouse
gcccgtctgccgcttcctcc

SEQ ID NO: 578151 - DNA, 20 bp, mouse
gttcatctcagaagcttgta

SEQ ID NO: 578152 - DNA, 20 bp, mouse
gccacgggaggatgtacggg

SEQ ID NO: 578153 - DNA, 20 bp, mouse
gacccggaggaagcggcaga

SEQ ID NO: 578154 - DNA, 20 bp, mouse
gacgcagcgagccagggcgc

SEQ ID NO: 578155 - DNA, 20 bp, mouse
gtcagaagcttgtaaggttc

SEQ ID NO: 578156 - DNA, 20 bp, mouse
ggccatggagggcggaggta

SEQ ID NO: 578157 - DNA, 20 bp, mouse
gacaggagcgacgccatgga

SEQ ID NO: 578158 - DNA, 20 bp, mouse
gtgagcggagcacagaagcc

SEQ ID NO: 578159 - DNA, 20 bp, mouse
gtggagggcggaggtaggga

SEQ ID NO: 578160 - DNA, 20 bp, mouse
gggaggtagggagggatcgc

SEQ ID NO: 578161 - DNA, 20 bp, mouse
gcagcacaggagcgacgcca

SEQ ID NO: 578162 - DNA, 20 bp, mouse
gaccctggaaatgctaggac

SEQ ID NO: 578163 - DNA, 20 bp, mouse
gtcctgtcctagcatttcca

SEQ ID NO: 578164 - DNA, 20 bp, mouse
gggagcgacgccatggaggg

SEQ ID NO: 578165 - DNA, 20 bp, mouse
ggcctggggagtgatcatgt

SEQ ID NO: 578166 - DNA, 20 bp, mouse
gtgcgcaactggatgctgtt

SEQ ID NO: 578167 - DNA, 20 bp, mouse
gacagtgaaagtgtccttcg

SEQ ID NO: 578168 - DNA, 20 bp, mouse
gagcaagagaaattccgcga

SEQ ID NO: 578169 - DNA, 20 bp, mouse
gcaagctagctgctctgggt

SEQ ID NO: 578170 - DNA, 20 bp, mouse
gaaagactcctagagaacac

SEQ ID NO: 578171 - DNA, 20 bp, mouse
gaggctcagaggtttctggg

SEQ ID NO: 578172 - DNA, 20 bp, mouse
gcggagagccagtgttctct

SEQ ID NO: 578173 - DNA, 20 bp, mouse
gtggggtggcaggaatgatc

SEQ ID NO: 578174 - DNA, 20 bp, mouse
ggtcacgtatgagtcatcga

SEQ ID NO: 578175 - DNA, 20 bp, mouse
ggcaaggctcagaggtttct

SEQ ID NO: 578176 - DNA, 20 bp, mouse
gacccaggctgagagagatt

SEQ ID NO: 578177 - DNA, 20 bp, mouse
gtgctgagaagaggagtaga

SEQ ID NO: 578178 - DNA, 20 bp, mouse
ggctagaggagagctggctg

SEQ ID NO: 578179 - DNA, 20 bp, mouse
gttctcagcaggcattcctt

SEQ ID NO: 578180 - DNA, 20 bp, mouse
gctggcgcagctctgaaccg

SEQ ID NO: 578181 - DNA, 20 bp, mouse
gcgcagctctgaaccgagga

SEQ ID NO: 578182 - DNA, 20 bp, mouse
gtctctctcagcctgggtcg

SEQ ID NO: 578183 - DNA, 20 bp, mouse
gttcatccttgccccgaccc

SEQ ID NO: 578184 - DNA, 20 bp, mouse
gagaaccgtgacagcacccg

SEQ ID NO: 578185 - DNA, 20 bp, mouse
gtgctcctaagcgcttccac

SEQ ID NO: 578186 - DNA, 20 bp, mouse
gcgtggggacttctaggcta

SEQ ID NO: 578187 - DNA, 20 bp, mouse
gtgggagccttcggagcccg

SEQ ID NO: 578188 - DNA, 20 bp, mouse
gggcgccatcgcactgcccc

SEQ ID NO: 578189 - DNA, 20 bp, mouse
gtcaggtccgaagcagttgg

SEQ ID NO: 578190 - DNA, 20 bp, mouse
ggacgccttggccttccgaa

SEQ ID NO: 578191 - DNA, 20 bp, mouse
gcaggtgggtcagagcctta

SEQ ID NO: 578192 - DNA, 20 bp, mouse
gctgtcaggtccgaagcagt

SEQ ID NO: 578193 - DNA, 20 bp, mouse
ggcgtgagagcgtgtctgtc

SEQ ID NO: 578194 - DNA, 20 bp, mouse
gtgatcccttcggaaggcca

SEQ ID NO: 578195 - DNA, 20 bp, mouse
ggcgtcgggaggccaagcaa

SEQ ID NO: 578196 - DNA, 20 bp, mouse
gctggagcagagatcaccag

SEQ ID NO: 578197 - DNA, 20 bp, mouse
ggacaacgcagggacctcag

SEQ ID NO: 578198 - DNA, 20 bp, mouse
gcggggcgggcccactgtgg

SEQ ID NO: 578199 - DNA, 20 bp, mouse
ggtggaggtgagcgccggca

SEQ ID NO: 578200 - DNA, 20 bp, mouse
gactggagcggaaatggtgg

SEQ ID NO: 578201 - DNA, 20 bp, mouse
gtgttccagagagaaccaag

SEQ ID NO: 578202 - DNA, 20 bp, mouse
gccactgtggaggtgagcgc

SEQ ID NO: 578203 - DNA, 20 bp, mouse
ggaggctgctttctagacga

SEQ ID NO: 578204 - DNA, 20 bp, mouse
gaggtgagcgccggcagggc

SEQ ID NO: 578205 - DNA, 20 bp, mouse
gctaatcgactgttacacag

SEQ ID NO: 578206 - DNA, 20 bp, mouse
ggagcctccgcctcagtcgg

SEQ ID NO: 578207 - DNA, 20 bp, mouse
gctcggagggacgtggactc

SEQ ID NO: 578208 - DNA, 20 bp, mouse
ggtgctagtgcggacacttg

SEQ ID NO: 578209 - DNA, 20 bp, mouse
ggaagtgggtcaggtctcta

SEQ ID NO: 578210 - DNA, 20 bp, mouse
gtgcctgcctccgactgagg

SEQ ID NO: 578211 - DNA, 20 bp, mouse
gactgaggcggaggctcgta

SEQ ID NO: 578212 - DNA, 20 bp, mouse
gctgcagcctcggagggacg

SEQ ID NO: 578213 - DNA, 20 bp, mouse
ggcctgcctgcctccgactg

SEQ ID NO: 578214 - DNA, 20 bp, mouse
gccgcgctagtgtgctagtg

SEQ ID NO: 578215 - DNA, 20 bp, mouse
gtcatggctgcagcctcgga

SEQ ID NO: 578216 - DNA, 20 bp, mouse
gccggtgtcggcggcccgag

SEQ ID NO: 578217 - DNA, 20 bp, mouse
gcgtagccgggaccatggag

SEQ ID NO: 578218 - DNA, 20 bp, mouse
ggcccgcgagatgccggtgt

SEQ ID NO: 578219 - DNA, 20 bp, mouse
ggccaaggacgcctaccccg

SEQ ID NO: 578220 - DNA, 20 bp, mouse
gaccggtaccagggtaacca

SEQ ID NO: 578221 - DNA, 20 bp, mouse
ggcggcggctgtgcccggga

SEQ ID NO: 578222 - DNA, 20 bp, mouse
gtctggagagaggggcaccg

SEQ ID NO: 578223 - DNA, 20 bp, mouse
gcgcgagatgccggtgtcgg

SEQ ID NO: 578224 - DNA, 20 bp, mouse
ggcgcgggcccgcgagatgc

SEQ ID NO: 578225 - DNA, 20 bp, mouse
gctaccccggggtgaggaat

SEQ ID NO: 578226 - DNA, 20 bp, mouse
gggacttgggaagagaggcg

SEQ ID NO: 578227 - DNA, 20 bp, mouse
gggaagagaggcgcggagtc

SEQ ID NO: 578228 - DNA, 20 bp, mouse
gaccgatcggaattggactt

SEQ ID NO: 578229 - DNA, 20 bp, mouse
gaagcacagcggagtggagg

SEQ ID NO: 578230 - DNA, 20 bp, mouse
gaaagcagaccgatcggaat

SEQ ID NO: 578231 - DNA, 20 bp, mouse
gtttaagcacagcggagtgg

SEQ ID NO: 578232 - DNA, 20 bp, mouse
gaataaggcaacatcaatga

SEQ ID NO: 578233 - DNA, 20 bp, mouse
gtcccaagtccaattccgat

SEQ ID NO: 578234 - DNA, 20 bp, mouse
gtgaaacaaagcagaccgat

SEQ ID NO: 578235 - DNA, 20 bp, mouse
gacttctgggaagcagtcct

SEQ ID NO: 578236 - DNA, 20 bp, mouse
gcagctcggcctcggcccag

SEQ ID NO: 578237 - DNA, 20 bp, mouse
gggccgagctgctccgggaa

SEQ ID NO: 578238 - DNA, 20 bp, mouse
ggaggcggcggtgaccgaag

SEQ ID NO: 578239 - DNA, 20 bp, mouse
ggcggcggtgaccgaagagg

SEQ ID NO: 578240 - DNA, 20 bp, mouse
gagctctgcggcatcaaagg

SEQ ID NO: 578241 - DNA, 20 bp, mouse
gcgagtgtcggtcgctgtgt

SEQ ID NO: 578242 - DNA, 20 bp, mouse
gtgtcggagaccccggtccc

SEQ ID NO: 578243 - DNA, 20 bp, mouse
gggtctgccgggtcacttgg

SEQ ID NO: 578244 - DNA, 20 bp, mouse
gcggcgctgggggagctctg

SEQ ID NO: 578245 - DNA, 20 bp, mouse
ggcgaccgacactcgcctct

SEQ ID NO: 578246 - DNA, 20 bp, mouse
ggcagaggcggcagggacgg

SEQ ID NO: 578247 - DNA, 20 bp, mouse
gcctgcagaggcggcaggga

SEQ ID NO: 578248 - DNA, 20 bp, mouse
gctgccgcctctgcaggccg

SEQ ID NO: 578249 - DNA, 20 bp, mouse
ggcgagacgacagtcgtgaa

SEQ ID NO: 578250 - DNA, 20 bp, mouse
gactggggccgcggctacag

SEQ ID NO: 578251 - DNA, 20 bp, mouse
gggacgcgccgcgccaaccg

SEQ ID NO: 578252 - DNA, 20 bp, mouse
ggtctcgcgctcctcctcag

SEQ ID NO: 578253 - DNA, 20 bp, mouse
gtacagcgggtccagtgctc

SEQ ID NO: 578254 - DNA, 20 bp, mouse
gcagggacggtggccgcggt

SEQ ID NO: 578255 - DNA, 20 bp, mouse
ggctctgggggcgacggccg

SEQ ID NO: 578256 - DNA, 20 bp, mouse
gcgggccgcggctccagcgt

SEQ ID NO: 578257 - DNA, 20 bp, mouse
ggcggctccagcgtcggcag

SEQ ID NO: 578258 - DNA, 20 bp, mouse
ggccgaggcggagtaggatg

SEQ ID NO: 578259 - DNA, 20 bp, mouse
ggcagctgaggcaaccgaga

SEQ ID NO: 578260 - DNA, 20 bp, mouse
ggcctaatccaggtcaggag

SEQ ID NO: 578261 - DNA, 20 bp, mouse
gcgcgtctggaacctgaggg

SEQ ID NO: 578262 - DNA, 20 bp, mouse
gtgccagcccccgggacagg

SEQ ID NO: 578263 - DNA, 20 bp, mouse
gcaccgccgccgcgccgagg

SEQ ID NO: 578264 - DNA, 20 bp, mouse
gctcgcgccccctgtcccgg

SEQ ID NO: 578265 - DNA, 20 bp, mouse
gggcatgagcggcccctcgg

SEQ ID NO: 578266 - DNA, 20 bp, mouse
gggagggccggcccaggctg

SEQ ID NO: 578267 - DNA, 20 bp, mouse
gcgggcggctctcctcagga

SEQ ID NO: 578268 - DNA, 20 bp, mouse
ggcgcgctcgcgaccctgaa

SEQ ID NO: 578269 - DNA, 20 bp, mouse
gaacagcgctcggccgggtg

SEQ ID NO: 578270 - DNA, 20 bp, mouse
ggctcagggccgaggagtgg

SEQ ID NO: 578271 - DNA, 20 bp, mouse
gcggcccgggtcggcgacag

SEQ ID NO: 578272 - DNA, 20 bp, mouse
gtcgcgcagtcggggagggc

SEQ ID NO: 578273 - DNA, 20 bp, mouse
gcgcgctcgcgcagtcgggg

SEQ ID NO: 578274 - DNA, 20 bp, mouse
gagtcggggagggccggccc

SEQ ID NO: 578275 - DNA, 20 bp, mouse
gaatgaccgcgggtcccgga

SEQ ID NO: 578276 - DNA, 20 bp, mouse
ggagggtccgatgctcagag

SEQ ID NO: 578277 - DNA, 20 bp, mouse
gagctagagaagcaggtgga

SEQ ID NO: 578278 - DNA, 20 bp, mouse
gcagctaggcagagccaccg

SEQ ID NO: 578279 - DNA, 20 bp, mouse
gccgggaaaaaggtctctgt

SEQ ID NO: 578280 - DNA, 20 bp, mouse
gtcggcatgagaggttggaa

SEQ ID NO: 578281 - DNA, 20 bp, mouse
ggggtgggaaagaatcacct

SEQ ID NO: 578282 - DNA, 20 bp, mouse
gagggggatgggctcctcgg

SEQ ID NO: 578283 - DNA, 20 bp, mouse
gggacgggcctcggcatgag

SEQ ID NO: 578284 - DNA, 20 bp, mouse
ggtctgtcctaccgggaaaa

SEQ ID NO: 578285 - DNA, 20 bp, mouse
ggggcctcggcatgagaggt

SEQ ID NO: 578286 - DNA, 20 bp, mouse
gatgcagcggatcagatagg

SEQ ID NO: 578287 - DNA, 20 bp, mouse
gctgatgcagcggatcagat

SEQ ID NO: 578288 - DNA, 20 bp, mouse
ggctgcatcagagaccacca

SEQ ID NO: 578289 - DNA, 20 bp, mouse
ggcgtcgtcacactccgtgg

SEQ ID NO: 578290 - DNA, 20 bp, mouse
gccagcaagcgttcccggac

SEQ ID NO: 578291 - DNA, 20 bp, mouse
ggctgcagcagcagtgatga

SEQ ID NO: 578292 - DNA, 20 bp, mouse
gttcgcgtcgtcacactccg

SEQ ID NO: 578293 - DNA, 20 bp, mouse
ggaagcggtcccggacgtcg

SEQ ID NO: 578294 - DNA, 20 bp, mouse
gaggaacgtgcacacctgac

SEQ ID NO: 578295 - DNA, 20 bp, mouse
gtgacgacgcgaagcggtcc

SEQ ID NO: 578296 - DNA, 20 bp, mouse
gggcgctccggagtcgaaga

SEQ ID NO: 578297 - DNA, 20 bp, mouse
gcgactccggagcgccgaaa

SEQ ID NO: 578298 - DNA, 20 bp, mouse
ggtagctgcggcgtgaaggg

SEQ ID NO: 578299 - DNA, 20 bp, mouse
ggcagtagctgcggcgtgaa

SEQ ID NO: 578300 - DNA, 20 bp, mouse
gtccggagcgccgaaacggc

SEQ ID NO: 578301 - DNA, 20 bp, mouse
ggttctgccatcttcgactc

SEQ ID NO: 578302 - DNA, 20 bp, mouse
gcagctactgccagccgttt

SEQ ID NO: 578303 - DNA, 20 bp, mouse
ggtttctcagggaaagtcgg

SEQ ID NO: 578304 - DNA, 20 bp, mouse
gtgtgcgaccggagaagaag

SEQ ID NO: 578305 - DNA, 20 bp, mouse
gtccagaagacgagtggcag

SEQ ID NO: 578306 - DNA, 20 bp, mouse
gctcctcagcggcaagatgg

SEQ ID NO: 578307 - DNA, 20 bp, mouse
gcgcagccggagtcccgaga

SEQ ID NO: 578308 - DNA, 20 bp, mouse
gtcagcgcgacgctcctcag

SEQ ID NO: 578309 - DNA, 20 bp, mouse
ggactgcgcggctccatctc

SEQ ID NO: 578310 - DNA, 20 bp, mouse
gcggctccatctcgggactc

SEQ ID NO: 578311 - DNA, 20 bp, mouse
gggccggcggcgtctgacga

SEQ ID NO: 578312 - DNA, 20 bp, mouse
gcggctgagggggtccgtct

SEQ ID NO: 578313 - DNA, 20 bp, mouse
gcgcccccagcccccctcgg

SEQ ID NO: 578314 - DNA, 20 bp, mouse
ggcgacgccgaggctcgagg

SEQ ID NO: 578315 - DNA, 20 bp, mouse
ggtctgacgagggagcacag

SEQ ID NO: 578316 - DNA, 20 bp, mouse
ggcggcgggccgcccagagg

SEQ ID NO: 578317 - DNA, 20 bp, mouse
ggtggcgaccgcagcacggg

SEQ ID NO: 578318 - DNA, 20 bp, mouse
gcgcccagaggaggcggcga

SEQ ID NO: 578319 - DNA, 20 bp, mouse
gacccttgcgggcctcggag

SEQ ID NO: 578320 - DNA, 20 bp, mouse
gccgccgaggatgtccgaaa

SEQ ID NO: 578321 - DNA, 20 bp, mouse
gggagcggcgggccgcccag

SEQ ID NO: 578322 - DNA, 20 bp, mouse
ggccggagcgcgggacacac

SEQ ID NO: 578323 - DNA, 20 bp, mouse
gcggcggaggcgaaacatgg

SEQ ID NO: 578324 - DNA, 20 bp, mouse
gtaggagccaaggacctacg

SEQ ID NO: 578325 - DNA, 20 bp, mouse
gcacgggaggtagcggcctg

SEQ ID NO: 578326 - DNA, 20 bp, mouse
gaggaggtgctcttgcggaa

SEQ ID NO: 578327 - DNA, 20 bp, mouse
gttctgtgagggaaatctga

SEQ ID NO: 578328 - DNA, 20 bp, mouse
gaggtccaaggtaggctctg

SEQ ID NO: 578329 - DNA, 20 bp, mouse
gggcggagcagcaagaccgg

SEQ ID NO: 578330 - DNA, 20 bp, mouse
ggggagctagatgaggtaag

SEQ ID NO: 578331 - DNA, 20 bp, mouse
gtaagacggaggtccaaggt

SEQ ID NO: 578332 - DNA, 20 bp, mouse
gaccactgccgccatcttca

SEQ ID NO: 578333 - DNA, 20 bp, mouse
gaccagtccgcactgtggag

SEQ ID NO: 578334 - DNA, 20 bp, mouse
ggaggaaaagggagctgacg

SEQ ID NO: 578335 - DNA, 20 bp, mouse
ggctacaagcgcttgagcgg

SEQ ID NO: 578336 - DNA, 20 bp, mouse
gggcttccgggagcaaaccg

SEQ ID NO: 578337 - DNA, 20 bp, mouse
gcccggaggagtggagtcaa

SEQ ID NO: 578338 - DNA, 20 bp, mouse
gccgagagagccgggatgcc

SEQ ID NO: 578339 - DNA, 20 bp, mouse
gccggcccgggccctcggta

SEQ ID NO: 578340 - DNA, 20 bp, mouse
gccgggatgcccggccgaga

SEQ ID NO: 578341 - DNA, 20 bp, mouse
gcggagcgaagccctaccga

SEQ ID NO: 578342 - DNA, 20 bp, mouse
ggtagccaggacacgaagcc

SEQ ID NO: 578343 - DNA, 20 bp, mouse
gcaagcccggcttcgtgtcc

SEQ ID NO: 578344 - DNA, 20 bp, mouse
gatggagatgcaactcccgg

SEQ ID NO: 578345 - DNA, 20 bp, mouse
gtaacggtgagtccctggac

SEQ ID NO: 578346 - DNA, 20 bp, mouse
gtgttgtgagccggtcgcgg

SEQ ID NO: 578347 - DNA, 20 bp, mouse
ggccgcctctcactcacccc

SEQ ID NO: 578348 - DNA, 20 bp, mouse
gggatgttgtgagccggtcg

SEQ ID NO: 578349 - DNA, 20 bp, mouse
gccgtagccgaaaagctggg

SEQ ID NO: 578350 - DNA, 20 bp, mouse
ggtgccgtagccgaaaagct

SEQ ID NO: 578351 - DNA, 20 bp, mouse
ggagccggtcgcggaggctg

SEQ ID NO: 578352 - DNA, 20 bp, mouse
gatcggccaggggcctcgag

SEQ ID NO: 578353 - DNA, 20 bp, mouse
ggaggccgggggtgagtgag

SEQ ID NO: 578354 - DNA, 20 bp, mouse
gaaccgaaccgactaagact

SEQ ID NO: 578355 - DNA, 20 bp, mouse
ggctatgagccgggcgggtt

SEQ ID NO: 578356 - DNA, 20 bp, mouse
gtgagctagagcgcagcgat

SEQ ID NO: 578357 - DNA, 20 bp, mouse
gcgctccagagtccgcgggg

SEQ ID NO: 578358 - DNA, 20 bp, mouse
gagcagtcgaaggaggtgat

SEQ ID NO: 578359 - DNA, 20 bp, mouse
gtccagagtccgcggggtgg

SEQ ID NO: 578360 - DNA, 20 bp, mouse
ggcccgcctccgccaccccg

SEQ ID NO: 578361 - DNA, 20 bp, mouse
ggccacgtgtgagtgtcggg

SEQ ID NO: 578362 - DNA, 20 bp, mouse
ggcgccgcggggcctctcgg

SEQ ID NO: 578363 - DNA, 20 bp, mouse
gagaggctcgaggtccccgg

SEQ ID NO: 578364 - DNA, 20 bp, mouse
gagagtccgcggggtggcgg

SEQ ID NO: 578365 - DNA, 20 bp, mouse
gctgcgctccagagtccgcg

SEQ ID NO: 578366 - DNA, 20 bp, mouse
gccggcgagggagcagcaaa

SEQ ID NO: 578367 - DNA, 20 bp, mouse
gcgagggagcagcaaacggc

SEQ ID NO: 578368 - DNA, 20 bp, mouse
ggggagcagcaaacggccgg

SEQ ID NO: 578369 - DNA, 20 bp, mouse
ggatctctaccgagcagcag

SEQ ID NO: 578370 - DNA, 20 bp, mouse
gcaggtccaagaacctaggg

SEQ ID NO: 578371 - DNA, 20 bp, mouse
gcctcccgcccaggtctcac

SEQ ID NO: 578372 - DNA, 20 bp, mouse
gcgggcgcgtcggccggcga

SEQ ID NO: 578373 - DNA, 20 bp, mouse
gagtggcagaagtaccgtcc

SEQ ID NO: 578374 - DNA, 20 bp, mouse
gcgctcacgcatggcacgca

SEQ ID NO: 578375 - DNA, 20 bp, mouse
ggcccgcgcacgctcacgca

SEQ ID NO: 578376 - DNA, 20 bp, mouse
gagccggcacgcagcgtcag

SEQ ID NO: 578377 - DNA, 20 bp, mouse
gctcctacaagcaagcgcta

SEQ ID NO: 578378 - DNA, 20 bp, mouse
gccagagcccgacgaggccg

SEQ ID NO: 578379 - DNA, 20 bp, mouse
gagtagaccccgatcccggg

SEQ ID NO: 578380 - DNA, 20 bp, mouse
gggcagtagaccccgatccc

SEQ ID NO: 578381 - DNA, 20 bp, mouse
gagcgtcccagagcccgacg

SEQ ID NO: 578382 - DNA, 20 bp, mouse
gatccctagcgcttgcttgt

SEQ ID NO: 578383 - DNA, 20 bp, mouse
gactaggtgcgaaccaggtg

SEQ ID NO: 578384 - DNA, 20 bp, mouse
gccccggagacgggctccag

SEQ ID NO: 578385 - DNA, 20 bp, mouse
ggcacgcagcgtcagcggcc

SEQ ID NO: 578386 - DNA, 20 bp, mouse
gctccgacttgcttgggtag

SEQ ID NO: 578387 - DNA, 20 bp, mouse
gtcccttctccgacttgctt

SEQ ID NO: 578388 - DNA, 20 bp, mouse
gatactcagtcatgaagtcc

SEQ ID NO: 578389 - DNA, 20 bp, mouse
gggagaagggaccacaacag

SEQ ID NO: 578390 - DNA, 20 bp, mouse
gacccaagcaagtcggagaa

SEQ ID NO: 578391 - DNA, 20 bp, mouse
gaagtccgcccccggaacct

SEQ ID NO: 578392 - DNA, 20 bp, mouse
gcccaagagaagtcgctacc

SEQ ID NO: 578393 - DNA, 20 bp, mouse
gcccgcaggatgggatgcta

SEQ ID NO: 578394 - DNA, 20 bp, mouse
gccgtgagcctaggttccgg

SEQ ID NO: 578395 - DNA, 20 bp, mouse
ggcccgaggtggggacggtc

SEQ ID NO: 578396 - DNA, 20 bp, mouse
gcggccggagggaccatgag

SEQ ID NO: 578397 - DNA, 20 bp, mouse
gccggagcccggtccgcgag

SEQ ID NO: 578398 - DNA, 20 bp, mouse
ggcgccgctcatggtccctc

SEQ ID NO: 578399 - DNA, 20 bp, mouse
ggcgagccaggagtactaca

SEQ ID NO: 578400 - DNA, 20 bp, mouse
gcggtgcaggagcccggccg

SEQ ID NO: 578401 - DNA, 20 bp, mouse
gcgcctctcagcaccggccc

SEQ ID NO: 578402 - DNA, 20 bp, mouse
gccgccccgcctctcagcac

SEQ ID NO: 578403 - DNA, 20 bp, mouse
gtacgggctcgactcaccca

SEQ ID NO: 578404 - DNA, 20 bp, mouse
ggtagcgcccgcggtcgatg

SEQ ID NO: 578405 - DNA, 20 bp, mouse
gcaccgctgcccatccacgg

SEQ ID NO: 578406 - DNA, 20 bp, mouse
gtcagagctgggggagaccg

SEQ ID NO: 578407 - DNA, 20 bp, mouse
gtcctcttcagaccagtact

SEQ ID NO: 578408 - DNA, 20 bp, mouse
ggcagctgtgccggttagtt

SEQ ID NO: 578409 - DNA, 20 bp, mouse
gcgcatgctgtcagagctgg

SEQ ID NO: 578410 - DNA, 20 bp, mouse
ggagcttcttccgaagaccc

SEQ ID NO: 578411 - DNA, 20 bp, mouse
gagctcttgctgaaacatgc

SEQ ID NO: 578412 - DNA, 20 bp, mouse
gaatagccaacccaactaac

SEQ ID NO: 578413 - DNA, 20 bp, mouse
gctgtgccggttagttgggt

SEQ ID NO: 578414 - DNA, 20 bp, mouse
ggagttgttgtgccaccaga

SEQ ID NO: 578415 - DNA, 20 bp, mouse
gaattgattgtcaacagatg

SEQ ID NO: 578416 - DNA, 20 bp, mouse
gtggcaatgcagtccccgtg

SEQ ID NO: 578417 - DNA, 20 bp, mouse
gaggacaaggcggaacctaa

SEQ ID NO: 578418 - DNA, 20 bp, mouse
gggctgtcgcctaattatgg

SEQ ID NO: 578419 - DNA, 20 bp, mouse
gacagccaggaagcaccctt

SEQ ID NO: 578420 - DNA, 20 bp, mouse
gacaaacggccgccataatt

SEQ ID NO: 578421 - DNA, 20 bp, mouse
gcctggctgtcgcctaatta

SEQ ID NO: 578422 - DNA, 20 bp, mouse
gacatatggggcaagcccaa

SEQ ID NO: 578423 - DNA, 20 bp, mouse
gcggggaagttagtaggaca

SEQ ID NO: 578424 - DNA, 20 bp, mouse
ggcccaagggcagccatcca

SEQ ID NO: 578425 - DNA, 20 bp, mouse
ggggacccttccgacatatg

SEQ ID NO: 578426 - DNA, 20 bp, mouse
ggagcacctcctgacagaca

SEQ ID NO: 578427 - DNA, 20 bp, mouse
ggcccggagagggccctgag

SEQ ID NO: 578428 - DNA, 20 bp, mouse
gccccctcagggccctctcc

SEQ ID NO: 578429 - DNA, 20 bp, mouse
ggcgccggcaggagccgagg

SEQ ID NO: 578430 - DNA, 20 bp, mouse
gcgaccaggacgagaccagg

SEQ ID NO: 578431 - DNA, 20 bp, mouse
gaagcggctcgctcaggaag

SEQ ID NO: 578432 - DNA, 20 bp, mouse
ggggcgccgcacgagggaag

SEQ ID NO: 578433 - DNA, 20 bp, mouse
gtcggcggccacgtcctaca

SEQ ID NO: 578434 - DNA, 20 bp, mouse
gacggcgccggcaggagccg

SEQ ID NO: 578435 - DNA, 20 bp, mouse
gccggggctcagggcatctg

SEQ ID NO: 578436 - DNA, 20 bp, mouse
gcaactgatggctgaatagg

SEQ ID NO: 578437 - DNA, 20 bp, mouse
gtattcagccatcagttgag

SEQ ID NO: 578438 - DNA, 20 bp, mouse
gttgggtcaagctctctccg

SEQ ID NO: 578439 - DNA, 20 bp, mouse
ggcttggagaggatccggag

SEQ ID NO: 578440 - DNA, 20 bp, mouse
ggcagttacctctcaactga

SEQ ID NO: 578441 - DNA, 20 bp, mouse
gccgccagacccgaagctca

SEQ ID NO: 578442 - DNA, 20 bp, mouse
gcccgcctccggctctcctg

SEQ ID NO: 578443 - DNA, 20 bp, mouse
gtcgggtctggcgggttctg

SEQ ID NO: 578444 - DNA, 20 bp, mouse
ggcgctgcttggagaggatc

SEQ ID NO: 578445 - DNA, 20 bp, mouse
gctgcagagtggatagccac

SEQ ID NO: 578446 - DNA, 20 bp, mouse
gccctcggtggagcaggggg

SEQ ID NO: 578447 - DNA, 20 bp, mouse
ggcccgctcgcgtccctcgg

SEQ ID NO: 578448 - DNA, 20 bp, mouse
gcgtccctcggtggagcagg

SEQ ID NO: 578449 - DNA, 20 bp, mouse
gggcccgcccagccccggtg

SEQ ID NO: 578450 - DNA, 20 bp, mouse
gcggctgccgggaggcctcg

SEQ ID NO: 578451 - DNA, 20 bp, mouse
ggtgtggcagcggctcatgg

SEQ ID NO: 578452 - DNA, 20 bp, mouse
gctccaccgagggacgcgag

SEQ ID NO: 578453 - DNA, 20 bp, mouse
ggtctgggcggcgctcgaag

SEQ ID NO: 578454 - DNA, 20 bp, mouse
ggccgccccctgctccaccg

SEQ ID NO: 578455 - DNA, 20 bp, mouse
gtggcagcggctcatggcgg

SEQ ID NO: 578456 - DNA, 20 bp, mouse
gtctgccgaggcccagtcaa

SEQ ID NO: 578457 - DNA, 20 bp, mouse
gcccagtcaagggcatcctg

SEQ ID NO: 578458 - DNA, 20 bp, mouse
gacagctctggagacggaag

SEQ ID NO: 578459 - DNA, 20 bp, mouse
gacaggcccggggctagcaa

SEQ ID NO: 578460 - DNA, 20 bp, mouse
ggacggaagaggcggtgctc

SEQ ID NO: 578461 - DNA, 20 bp, mouse
gcgtgggcgcctaggggaca

SEQ ID NO: 578462 - DNA, 20 bp, mouse
ggcggccggaaggtacgacg

SEQ ID NO: 578463 - DNA, 20 bp, mouse
ggccggaaggtacgacgggg

SEQ ID NO: 578464 - DNA, 20 bp, mouse
gagcaacagcggacaggatc

SEQ ID NO: 578465 - DNA, 20 bp, mouse
gcagagctgtcagctgagag

SEQ ID NO: 578466 - DNA, 20 bp, mouse
gcgcaccagggacaccgcct

SEQ ID NO: 578467 - DNA, 20 bp, mouse
ggcaaggctcacccagttca

SEQ ID NO: 578468 - DNA, 20 bp, mouse
ggagagcgatgccttgaact

SEQ ID NO: 578469 - DNA, 20 bp, mouse
ggagcaggtgcgccaaggag

SEQ ID NO: 578470 - DNA, 20 bp, mouse
ggcagccgaggcggtgtccc

SEQ ID NO: 578471 - DNA, 20 bp, mouse
gaagggacacagcgaagggg

SEQ ID NO: 578472 - DNA, 20 bp, mouse
gtaaacccgctaggcggcag

SEQ ID NO: 578473 - DNA, 20 bp, mouse
ggcagccgaggccctgacaa

SEQ ID NO: 578474 - DNA, 20 bp, mouse
gcatcgctctcctcgcacca

SEQ ID NO: 578475 - DNA, 20 bp, mouse
ggagctagggccccttgtca

SEQ ID NO: 578476 - DNA, 20 bp, mouse
gcagggcggggaggcataaa

SEQ ID NO: 578477 - DNA, 20 bp, mouse
gtgcacgcgggaggctgacg

SEQ ID NO: 578478 - DNA, 20 bp, mouse
gaccccgcgcgcagttctca

SEQ ID NO: 578479 - DNA, 20 bp, mouse
gggaccgcgcgggaccaggt

SEQ ID NO: 578480 - DNA, 20 bp, mouse
gactgcgcgcggggtcgacg

SEQ ID NO: 578481 - DNA, 20 bp, mouse
gcccgccgtgacctggacat

SEQ ID NO: 578482 - DNA, 20 bp, mouse
gcataaagggcgctgcgctg

SEQ ID NO: 578483 - DNA, 20 bp, mouse
gagttctcagggcgcagggc

SEQ ID NO: 578484 - DNA, 20 bp, mouse
ggggcgatgccgacacaaag

SEQ ID NO: 578485 - DNA, 20 bp, mouse
gggacgcggccgtcacccag

SEQ ID NO: 578486 - DNA, 20 bp, mouse
gcagccgggcggagcactca

SEQ ID NO: 578487 - DNA, 20 bp, mouse
gcgggcacaccgcggaggaa

SEQ ID NO: 578488 - DNA, 20 bp, mouse
ggggcggagcactcagggag

SEQ ID NO: 578489 - DNA, 20 bp, mouse
gggcagcgggcacaccgcgg

SEQ ID NO: 578490 - DNA, 20 bp, mouse
gtgtaaagctgtcagccggg

SEQ ID NO: 578491 - DNA, 20 bp, mouse
gtgagagagcccttcctccg

SEQ ID NO: 578492 - DNA, 20 bp, mouse
gcaggcgctgcaagccaaga

SEQ ID NO: 578493 - DNA, 20 bp, mouse
gcgggaccgaggctacccgg

SEQ ID NO: 578494 - DNA, 20 bp, mouse
ggtgctagtgcgcaggatac

SEQ ID NO: 578495 - DNA, 20 bp, mouse
gagccaggtaggtctagaag

SEQ ID NO: 578496 - DNA, 20 bp, mouse
gcccggggagcagggtgcaa

SEQ ID NO: 578497 - DNA, 20 bp, mouse
gtctcctagctaccatcccg

SEQ ID NO: 578498 - DNA, 20 bp, mouse
gaggccgctggactgagcca

SEQ ID NO: 578499 - DNA, 20 bp, mouse
gggtaggaacgtacagggta

SEQ ID NO: 578500 - DNA, 20 bp, mouse
gggcgagtcctgcgactcca

SEQ ID NO: 578501 - DNA, 20 bp, mouse
ggagccacgggatggtagct

SEQ ID NO: 578502 - DNA, 20 bp, mouse
gtggctccgagaataaacag

SEQ ID NO: 578503 - DNA, 20 bp, mouse
gagcttggcgccgaagaccc

SEQ ID NO: 578504 - DNA, 20 bp, mouse
gtgagactcccggagggtca

SEQ ID NO: 578505 - DNA, 20 bp, mouse
gctccgagaataaacagcgg

SEQ ID NO: 578506 - DNA, 20 bp, mouse
ggagcgcggggaccaggcca

SEQ ID NO: 578507 - DNA, 20 bp, mouse
gcgccggcaccagcgcccgg

SEQ ID NO: 578508 - DNA, 20 bp, mouse
gcggcgacaaaggcgctccc

SEQ ID NO: 578509 - DNA, 20 bp, mouse
gccatcctccgcggcgacaa

SEQ ID NO: 578510 - DNA, 20 bp, mouse
ggagcgccggcaccagcgcc

SEQ ID NO: 578511 - DNA, 20 bp, mouse
gggaagcggcccgaaccgtg

SEQ ID NO: 578512 - DNA, 20 bp, mouse
gtcggaaccgaagatctcac

SEQ ID NO: 578513 - DNA, 20 bp, mouse
gaccgaagatctcaccggag

SEQ ID NO: 578514 - DNA, 20 bp, mouse
gggtcgccgcagagcgcggg

SEQ ID NO: 578515 - DNA, 20 bp, mouse
gggccgccgggcgctggtgc

SEQ ID NO: 578516 - DNA, 20 bp, mouse
gtaggtcacgactgcagcac

SEQ ID NO: 578517 - DNA, 20 bp, mouse
gtaagggcccgacacagaga

SEQ ID NO: 578518 - DNA, 20 bp, mouse
gatcttgaaccagacccaaa

SEQ ID NO: 578519 - DNA, 20 bp, mouse
gacccaaaaggatgagctgc

SEQ ID NO: 578520 - DNA, 20 bp, mouse
gcaccggcagctcatccttt

SEQ ID NO: 578521 - DNA, 20 bp, mouse
gacaacgctacctctgccat

SEQ ID NO: 578522 - DNA, 20 bp, mouse
gggagatgatgaggaatcac

SEQ ID NO: 578523 - DNA, 20 bp, mouse
ggagccatcgtccaacctaa

SEQ ID NO: 578524 - DNA, 20 bp, mouse
gagttagctagcaacacagt

SEQ ID NO: 578525 - DNA, 20 bp, mouse
gctagcaacacagtgggagt

SEQ ID NO: 578526 - DNA, 20 bp, mouse
gtccgctgcgggctccgaag

SEQ ID NO: 578527 - DNA, 20 bp, mouse
gaggagaaaagactgcgagg

SEQ ID NO: 578528 - DNA, 20 bp, mouse
gtccgcttcggagcccgcag

SEQ ID NO: 578529 - DNA, 20 bp, mouse
gcggcccggagcccacctct

SEQ ID NO: 578530 - DNA, 20 bp, mouse
ggactgcgaggtggctgcgg

SEQ ID NO: 578531 - DNA, 20 bp, mouse
gcggaggagaaaagactgcg

SEQ ID NO: 578532 - DNA, 20 bp, mouse
gggtgggctccgggccggac

SEQ ID NO: 578533 - DNA, 20 bp, mouse
gtcggagcccgcagcggacg

SEQ ID NO: 578534 - DNA, 20 bp, mouse
ggccgcgcccgtcacagtcc

SEQ ID NO: 578535 - DNA, 20 bp, mouse
gtggccagcgcggcccggac

SEQ ID NO: 578536 - DNA, 20 bp, mouse
gataagaaagaaaaagtacc

SEQ ID NO: 578537 - DNA, 20 bp, mouse
gtaatgcacatagatcaaga

SEQ ID NO: 578538 - DNA, 20 bp, mouse
gacctatgaactgaaggagt

SEQ ID NO: 578539 - DNA, 20 bp, mouse
gaacaaggtatctttcatct

SEQ ID NO: 578540 - DNA, 20 bp, mouse
gctgctgtcaaaggagataa

SEQ ID NO: 578541 - DNA, 20 bp, mouse
gtggccctcatcgaaagggg

SEQ ID NO: 578542 - DNA, 20 bp, mouse
gacctactccttcagttcat

SEQ ID NO: 578543 - DNA, 20 bp, mouse
gattctaccatttttactcc

SEQ ID NO: 578544 - DNA, 20 bp, mouse
gctccaaaggaaaagcaata

SEQ ID NO: 578545 - DNA, 20 bp, mouse
gtggctggccctcatcgaaa

SEQ ID NO: 578546 - DNA, 20 bp, mouse
gcacagctttgaggagacgg

SEQ ID NO: 578547 - DNA, 20 bp, mouse
gaagagcgcgagtcagaacg

SEQ ID NO: 578548 - DNA, 20 bp, mouse
ggaacgaggcgactcactcc

SEQ ID NO: 578549 - DNA, 20 bp, mouse
gagctttgaggagacggcgg

SEQ ID NO: 578550 - DNA, 20 bp, mouse
ggcgccccgccgcccacccc

SEQ ID NO: 578551 - DNA, 20 bp, mouse
gccgcccggccgggctactg

SEQ ID NO: 578552 - DNA, 20 bp, mouse
ggacccgcagtcgaacctga

SEQ ID NO: 578553 - DNA, 20 bp, mouse
gcccaccccgggagtacaca

SEQ ID NO: 578554 - DNA, 20 bp, mouse
gctgacggtgtggagcgtgt

SEQ ID NO: 578555 - DNA, 20 bp, mouse
ggagcgagctttctccgaag

SEQ ID NO: 578556 - DNA, 20 bp, mouse
gcacttgccgagggaggggg

SEQ ID NO: 578557 - DNA, 20 bp, mouse
gtgggggagagcgtgaggag

SEQ ID NO: 578558 - DNA, 20 bp, mouse
gggtcccgctgcagacgcgg

SEQ ID NO: 578559 - DNA, 20 bp, mouse
gacactcacttgccgaggga

SEQ ID NO: 578560 - DNA, 20 bp, mouse
ggttatgcgtgggttcccat

SEQ ID NO: 578561 - DNA, 20 bp, mouse
gagactaggtggctacgccc

SEQ ID NO: 578562 - DNA, 20 bp, mouse
gcgcttctggccagactagg

SEQ ID NO: 578563 - DNA, 20 bp, mouse
gggggaggtacggggcagat

SEQ ID NO: 578564 - DNA, 20 bp, mouse
gcgggacactcacttgccga

SEQ ID NO: 578565 - DNA, 20 bp, mouse
ggaccgcgccgcgatcaccc

SEQ ID NO: 578566 - DNA, 20 bp, mouse
gtcagagctggtgaagagac

SEQ ID NO: 578567 - DNA, 20 bp, mouse
ggctgtccagatacagatca

SEQ ID NO: 578568 - DNA, 20 bp, mouse
ggggtctgcacccacttcaa

SEQ ID NO: 578569 - DNA, 20 bp, mouse
gcctgaactcttggtctcag

SEQ ID NO: 578570 - DNA, 20 bp, mouse
gagcttcttcaggcaagagt

SEQ ID NO: 578571 - DNA, 20 bp, mouse
ggctcaccatgatctgtatc

SEQ ID NO: 578572 - DNA, 20 bp, mouse
gcacttcaagggtggatctg

SEQ ID NO: 578573 - DNA, 20 bp, mouse
gacttgtggcaggggcttgg

SEQ ID NO: 578574 - DNA, 20 bp, mouse
ggtccacacgtgctgtcaaa

SEQ ID NO: 578575 - DNA, 20 bp, mouse
gagatagttgggcatctgcc

SEQ ID NO: 578576 - DNA, 20 bp, mouse
gccaggcaccggacactgag

SEQ ID NO: 578577 - DNA, 20 bp, mouse
gttcagtgcttgggtctctg

SEQ ID NO: 578578 - DNA, 20 bp, mouse
gacccaagcactgaagggag

SEQ ID NO: 578579 - DNA, 20 bp, mouse
ggacacccgccgccaggcac

SEQ ID NO: 578580 - DNA, 20 bp, mouse
gggcgggtgtccgatcgtgg

SEQ ID NO: 578581 - DNA, 20 bp, mouse
gctagacgagcgctgagggc

SEQ ID NO: 578582 - DNA, 20 bp, mouse
gcaacgtcggaagcatcccg

SEQ ID NO: 578583 - DNA, 20 bp, mouse
gcgcgctgccccgcaacctg

SEQ ID NO: 578584 - DNA, 20 bp, mouse
gagtgtccggtgcctggcgg

SEQ ID NO: 578585 - DNA, 20 bp, mouse
gcccgctcccttcagtgctt

SEQ ID NO: 578586 - DNA, 20 bp, mouse
ggacatcacgcggtctgagg

SEQ ID NO: 578587 - DNA, 20 bp, mouse
ggcggcgcctctgcctgagg

SEQ ID NO: 578588 - DNA, 20 bp, mouse
gtcagaccgcgtgatgtcag

SEQ ID NO: 578589 - DNA, 20 bp, mouse
gcctccgccgggcaccgcgg

SEQ ID NO: 578590 - DNA, 20 bp, mouse
gagccgccgctgacatcacg

SEQ ID NO: 578591 - DNA, 20 bp, mouse
gcatcctccgccgggcaccg

SEQ ID NO: 578592 - DNA, 20 bp, mouse
gatcacgcggtctgaggcgg

SEQ ID NO: 578593 - DNA, 20 bp, mouse
ggaccgcgtgatgtcagcgg

SEQ ID NO: 578594 - DNA, 20 bp, mouse
gcggccggcgcgctgaggct

SEQ ID NO: 578595 - DNA, 20 bp, mouse
ggcggcggcgcctctgcctg

SEQ ID NO: 578596 - DNA, 20 bp, mouse
gcgcagctgccgccacacaa

SEQ ID NO: 578597 - DNA, 20 bp, mouse
gcgctgcgctccgctcccat

SEQ ID NO: 578598 - DNA, 20 bp, mouse
gggcccctctcgacattcaa

SEQ ID NO: 578599 - DNA, 20 bp, mouse
gggctgcgcgcgcctttgtg

SEQ ID NO: 578600 - DNA, 20 bp, mouse
gcaaaggcgcgcgcagccaa

SEQ ID NO: 578601 - DNA, 20 bp, mouse
gtgcgcgcgcctttgtgtgg

SEQ ID NO: 578602 - DNA, 20 bp, mouse
gcggtccccgctgtcccccg

SEQ ID NO: 578603 - DNA, 20 bp, mouse
gtgtcgagaggggccgggaa

SEQ ID NO: 578604 - DNA, 20 bp, mouse
gggcctcgccggaaccgcgg

SEQ ID NO: 578605 - DNA, 20 bp, mouse
gagacagatggcccatggaa

SEQ ID NO: 578606 - DNA, 20 bp, mouse
ggtctgccggcctggatagg

SEQ ID NO: 578607 - DNA, 20 bp, mouse
gtgccggcctggataggggg

SEQ ID NO: 578608 - DNA, 20 bp, mouse
gcggaacatcgccatccccg

SEQ ID NO: 578609 - DNA, 20 bp, mouse
gggtggcctcggcgcagcag

SEQ ID NO: 578610 - DNA, 20 bp, mouse
ggcggcggcggcctgccccg

SEQ ID NO: 578611 - DNA, 20 bp, mouse
ggcgatgttccgcagcctgg

SEQ ID NO: 578612 - DNA, 20 bp, mouse
gcgggtctgccggcctggat

SEQ ID NO: 578613 - DNA, 20 bp, mouse
gcggcctggatagggggcgg

SEQ ID NO: 578614 - DNA, 20 bp, mouse
gggcccgcgggcggcgacag

SEQ ID NO: 578615 - DNA, 20 bp, mouse
gcggcgcgcgctctcacgtg

SEQ ID NO: 578616 - DNA, 20 bp, mouse
gtaccgtggcggccagacga

SEQ ID NO: 578617 - DNA, 20 bp, mouse
gtggcggccagacgaaggag

SEQ ID NO: 578618 - DNA, 20 bp, mouse
gagggcagctccaggatctc

SEQ ID NO: 578619 - DNA, 20 bp, mouse
gggtaggagaaacctcaaag

SEQ ID NO: 578620 - DNA, 20 bp, mouse
gtactttgaacgtaccgtgg

SEQ ID NO: 578621 - DNA, 20 bp, mouse
gaaggagaggtttgtaaaca

SEQ ID NO: 578622 - DNA, 20 bp, mouse
gccctgggatcctgaaggag

SEQ ID NO: 578623 - DNA, 20 bp, mouse
gtaggacagaataggagcga

SEQ ID NO: 578624 - DNA, 20 bp, mouse
gaccggaaacccttttccag

SEQ ID NO: 578625 - DNA, 20 bp, mouse
ggtccgagggctgattcgag

SEQ ID NO: 578626 - DNA, 20 bp, mouse
gccgcggccagtagaccgat

SEQ ID NO: 578627 - DNA, 20 bp, mouse
gagcaggtacccgggctcca

SEQ ID NO: 578628 - DNA, 20 bp, mouse
gagaccgattggcaggacag

SEQ ID NO: 578629 - DNA, 20 bp, mouse
gcgcggccggagcaggtacc

SEQ ID NO: 578630 - DNA, 20 bp, mouse
ggtcctgccaatcggtctac

SEQ ID NO: 578631 - DNA, 20 bp, mouse
gcggcgagacggaagtcccg

SEQ ID NO: 578632 - DNA, 20 bp, mouse
gacacctcgcggtacccccc

SEQ ID NO: 578633 - DNA, 20 bp, mouse
gcgactgagcggttccttgg

SEQ ID NO: 578634 - DNA, 20 bp, mouse
ggtaccgggtgctctgggag

SEQ ID NO: 578635 - DNA, 20 bp, mouse
gcggggaattgtgacgtccg

SEQ ID NO: 578636 - DNA, 20 bp, mouse
ggcggcaggtccgagcactc

SEQ ID NO: 578637 - DNA, 20 bp, mouse
gcttcaaacgggaaacaaga

SEQ ID NO: 578638 - DNA, 20 bp, mouse
gggccgcggcagctctgagt

SEQ ID NO: 578639 - DNA, 20 bp, mouse
ggcctggctgaagcccacag

SEQ ID NO: 578640 - DNA, 20 bp, mouse
gaccgactctcccttcaaac

SEQ ID NO: 578641 - DNA, 20 bp, mouse
gtcccgtttgaagggagagt

SEQ ID NO: 578642 - DNA, 20 bp, mouse
gggccgctgtgacgagatgg

SEQ ID NO: 578643 - DNA, 20 bp, mouse
ggcggtgggagaggagtaga

SEQ ID NO: 578644 - DNA, 20 bp, mouse
gactcgggcttcttccgctg

SEQ ID NO: 578645 - DNA, 20 bp, mouse
gcggaagaagcccgagtgct

SEQ ID NO: 578646 - DNA, 20 bp, mouse
ggcgctgagaggagcaatgg

SEQ ID NO: 578647 - DNA, 20 bp, mouse
gagaggagcaatggcggcag

SEQ ID NO: 578648 - DNA, 20 bp, mouse
gtgctcctctcagcgctgag

SEQ ID NO: 578649 - DNA, 20 bp, mouse
gggcagaggcttcgtcgacc

SEQ ID NO: 578650 - DNA, 20 bp, mouse
gtccactcttactctccact

SEQ ID NO: 578651 - DNA, 20 bp, mouse
ggctgcccctcagcgctgag

SEQ ID NO: 578652 - DNA, 20 bp, mouse
gtgtgtggagagaaccctgg

SEQ ID NO: 578653 - DNA, 20 bp, mouse
gcggttgggccggccctcca

SEQ ID NO: 578654 - DNA, 20 bp, mouse
ggaggcttcgtcgaccgggc

SEQ ID NO: 578655 - DNA, 20 bp, mouse
gaacagcgggtgaggaagta

SEQ ID NO: 578656 - DNA, 20 bp, mouse
ggagctgcgggaccgcgcga

SEQ ID NO: 578657 - DNA, 20 bp, mouse
gcggactgcgggactcggcg

SEQ ID NO: 578658 - DNA, 20 bp, mouse
gccaggccacgcccccgcac

SEQ ID NO: 578659 - DNA, 20 bp, mouse
gggctccggcgactcaggga

SEQ ID NO: 578660 - DNA, 20 bp, mouse
gtgcgggaccgcgcgagggt

SEQ ID NO: 578661 - DNA, 20 bp, mouse
gtcgcccggagggagactct

SEQ ID NO: 578662 - DNA, 20 bp, mouse
gaaggtggaacggctgacgt

SEQ ID NO: 578663 - DNA, 20 bp, mouse
gacgcccgcggccggagagg

SEQ ID NO: 578664 - DNA, 20 bp, mouse
ggactcggcgcggtggcggt

SEQ ID NO: 578665 - DNA, 20 bp, mouse
gaggtacgcgcccccctctc

SEQ ID NO: 578666 - DNA, 20 bp, mouse
ggcgcggctcgtgggagacg

SEQ ID NO: 578667 - DNA, 20 bp, mouse
ggggagcgcaggcggatgtt

SEQ ID NO: 578668 - DNA, 20 bp, mouse
ggctcgtgggagacgcggag

SEQ ID NO: 578669 - DNA, 20 bp, mouse
gagacgcggagcgggagcgc

SEQ ID NO: 578670 - DNA, 20 bp, mouse
gagccgcgccaggcccagac

SEQ ID NO: 578671 - DNA, 20 bp, mouse
gtctcccacgagccgcgcgt

SEQ ID NO: 578672 - DNA, 20 bp, mouse
ggcgaggccggctccagaga

SEQ ID NO: 578673 - DNA, 20 bp, mouse
gccgcccacgcgcggctcgt

SEQ ID NO: 578674 - DNA, 20 bp, mouse
gggggcgcggacgcaggtaa

SEQ ID NO: 578675 - DNA, 20 bp, mouse
gcgcggacgcaggtaagggc

SEQ ID NO: 578676 - DNA, 20 bp, mouse
ggctggattcggctctccag

SEQ ID NO: 578677 - DNA, 20 bp, mouse
ggggcccgccaggggatcgt

SEQ ID NO: 578678 - DNA, 20 bp, mouse
gaagctgtgtcagacaagcc

SEQ ID NO: 578679 - DNA, 20 bp, mouse
ggagggcgggttaacctggg

SEQ ID NO: 578680 - DNA, 20 bp, mouse
gcgggttaacctgggaggtg

SEQ ID NO: 578681 - DNA, 20 bp, mouse
gagacgaagatagaaagggt

SEQ ID NO: 578682 - DNA, 20 bp, mouse
gggagagggcgggttaacct

SEQ ID NO: 578683 - DNA, 20 bp, mouse
gtgttgcgggcctcacgctc

SEQ ID NO: 578684 - DNA, 20 bp, mouse
gaatgagtagggcccgccag

SEQ ID NO: 578685 - DNA, 20 bp, mouse
ggcgacgcgattagtcgagt

SEQ ID NO: 578686 - DNA, 20 bp, mouse
gggatcgagagccactccgg

SEQ ID NO: 578687 - DNA, 20 bp, mouse
gggaggatcgagagccactc

SEQ ID NO: 578688 - DNA, 20 bp, mouse
ggacggactggaggatcgat

SEQ ID NO: 578689 - DNA, 20 bp, mouse
gggactggaggatcgatggg

SEQ ID NO: 578690 - DNA, 20 bp, mouse
gcggcggcgccagggattga

SEQ ID NO: 578691 - DNA, 20 bp, mouse
ggcgcgccttacctgaccag

SEQ ID NO: 578692 - DNA, 20 bp, mouse
gccgtgggaggacggactgg

SEQ ID NO: 578693 - DNA, 20 bp, mouse
gtcgagagccactccggcgg

SEQ ID NO: 578694 - DNA, 20 bp, mouse
gccgcgcctccctcaatccc

SEQ ID NO: 578695 - DNA, 20 bp, mouse
gagtccgcgcggcccaggaa

SEQ ID NO: 578696 - DNA, 20 bp, mouse
ggtgtgaactctgacctagg

SEQ ID NO: 578697 - DNA, 20 bp, mouse
gggctgaagctggtaaggag

SEQ ID NO: 578698 - DNA, 20 bp, mouse
gagagttccaaagtcatccg

SEQ ID NO: 578699 - DNA, 20 bp, mouse
gaccagcttcagagccggag

SEQ ID NO: 578700 - DNA, 20 bp, mouse
gaagctggctgaagctggta

SEQ ID NO: 578701 - DNA, 20 bp, mouse
gctcagtgtaccacacaggg

SEQ ID NO: 578702 - DNA, 20 bp, mouse
gttccttcctcggatgactt

SEQ ID NO: 578703 - DNA, 20 bp, mouse
gcatgggtctccccagctct

SEQ ID NO: 578704 - DNA, 20 bp, mouse
gtcttggtccactctctggc

SEQ ID NO: 578705 - DNA, 20 bp, mouse
gttccaaagtcatccgagga

SEQ ID NO: 578706 - DNA, 20 bp, mouse
gagttcccggtaggaggggt

SEQ ID NO: 578707 - DNA, 20 bp, mouse
gtcccggtaggaggggtcgg

SEQ ID NO: 578708 - DNA, 20 bp, mouse
gagactggctcggctactcc

SEQ ID NO: 578709 - DNA, 20 bp, mouse
gaccaagttcccggtaggag

SEQ ID NO: 578710 - DNA, 20 bp, mouse
gaggtgaccaagttcccggt

SEQ ID NO: 578711 - DNA, 20 bp, mouse
gtggctcggctactccggga

SEQ ID NO: 578712 - DNA, 20 bp, mouse
gactgacgcgtctctaagac

SEQ ID NO: 578713 - DNA, 20 bp, mouse
gaggtcagactggcatccgt

SEQ ID NO: 578714 - DNA, 20 bp, mouse
ggctgtccgttcccccgtcc

SEQ ID NO: 578715 - DNA, 20 bp, mouse
gcgtcaggtgaccaagttcc

SEQ ID NO: 578716 - DNA, 20 bp, mouse
gggagcaagatgccagacat

SEQ ID NO: 578717 - DNA, 20 bp, mouse
ggaaacaagcagggcaacca

SEQ ID NO: 578718 - DNA, 20 bp, mouse
gcctgctgacaaccgatgtc

SEQ ID NO: 578719 - DNA, 20 bp, mouse
gagactggaagcgtccccac

SEQ ID NO: 578720 - DNA, 20 bp, mouse
gtggtggtacccgctgggat

SEQ ID NO: 578721 - DNA, 20 bp, mouse
gcatgggttccggtcctgtg

SEQ ID NO: 578722 - DNA, 20 bp, mouse
ggagctgccaggacttgcat

SEQ ID NO: 578723 - DNA, 20 bp, mouse
ggtacagaggtggagggaca

SEQ ID NO: 578724 - DNA, 20 bp, mouse
gcataagcggagaaacaagc

SEQ ID NO: 578725 - DNA, 20 bp, mouse
ggggaccgagcacagttgta

SEQ ID NO: 578726 - DNA, 20 bp, mouse
gcagtctgggtctgagtcgt

SEQ ID NO: 578727 - DNA, 20 bp, mouse
ggcgcagaagggccgaggac

SEQ ID NO: 578728 - DNA, 20 bp, mouse
ggaggaccggccggagatca

SEQ ID NO: 578729 - DNA, 20 bp, mouse
ggggcggagagggcgcagaa

SEQ ID NO: 578730 - DNA, 20 bp, mouse
ggtcgtaggctgaggctcgt

SEQ ID NO: 578731 - DNA, 20 bp, mouse
ggctcgtcggccttgatctc

SEQ ID NO: 578732 - DNA, 20 bp, mouse
ggcgcgctgccagcagtcat

SEQ ID NO: 578733 - DNA, 20 bp, mouse
gagaagggccgaggaccggc

SEQ ID NO: 578734 - DNA, 20 bp, mouse
gcgggcggcggcgccgacga

SEQ ID NO: 578735 - DNA, 20 bp, mouse
gagagggcgcagaagggccg

SEQ ID NO: 578736 - DNA, 20 bp, mouse
ggcgagagctgccggtggaa

SEQ ID NO: 578737 - DNA, 20 bp, mouse
gctagggcgagagctgccgg

SEQ ID NO: 578738 - DNA, 20 bp, mouse
ggagtcacagaggggagttc

SEQ ID NO: 578739 - DNA, 20 bp, mouse
gccggctgcgacggtccgac

SEQ ID NO: 578740 - DNA, 20 bp, mouse
gccgcggaggcagaaagcgg

SEQ ID NO: 578741 - DNA, 20 bp, mouse
gccggtggaacggttgcggg

SEQ ID NO: 578742 - DNA, 20 bp, mouse
ggaaagcggaggcagaacgg

SEQ ID NO: 578743 - DNA, 20 bp, mouse
gccccagaccgaggcctgag

SEQ ID NO: 578744 - DNA, 20 bp, mouse
gcgcgtcccagagataaccg

SEQ ID NO: 578745 - DNA, 20 bp, mouse
gcggagcggacgagacccga

SEQ ID NO: 578746 - DNA, 20 bp, mouse
gtctgggaggactgccgagg

SEQ ID NO: 578747 - DNA, 20 bp, mouse
gaggactgccgaggcggtgg

SEQ ID NO: 578748 - DNA, 20 bp, mouse
gggcgctgaggcgggagcta

SEQ ID NO: 578749 - DNA, 20 bp, mouse
ggtctctgggaggactgccg

SEQ ID NO: 578750 - DNA, 20 bp, mouse
ggctgaggcgggagctacgg

SEQ ID NO: 578751 - DNA, 20 bp, mouse
gcgaggcggagaagacgctg

SEQ ID NO: 578752 - DNA, 20 bp, mouse
gctggtcggcttctgtctct

SEQ ID NO: 578753 - DNA, 20 bp, mouse
gcggagggcagagcttccac

SEQ ID NO: 578754 - DNA, 20 bp, mouse
gccgctgcggcacttagggt

SEQ ID NO: 578755 - DNA, 20 bp, mouse
gcgcagaggctgaggagcca

SEQ ID NO: 578756 - DNA, 20 bp, mouse
gccggcgccgccgcacaata

SEQ ID NO: 578757 - DNA, 20 bp, mouse
gcgagactcgccatattgtg

SEQ ID NO: 578758 - DNA, 20 bp, mouse
gagctcgggaaatacaacag

SEQ ID NO: 578759 - DNA, 20 bp, mouse
ggactcgccatattgtgcgg

SEQ ID NO: 578760 - DNA, 20 bp, mouse
gagactcgagaatcaaccgc

SEQ ID NO: 578761 - DNA, 20 bp, mouse
gcgagtctcggcttccgcaa

SEQ ID NO: 578762 - DNA, 20 bp, mouse
gtatttcccgagctccattg

SEQ ID NO: 578763 - DNA, 20 bp, mouse
gcggtgagctaggcagggag

SEQ ID NO: 578764 - DNA, 20 bp, mouse
gggccccgcgagcaagccca

SEQ ID NO: 578765 - DNA, 20 bp, mouse
gccactgccagcgcaccccc

SEQ ID NO: 578766 - DNA, 20 bp, mouse
ggagggactgagctccacgg

SEQ ID NO: 578767 - DNA, 20 bp, mouse
gggcccgagagggactccaa

SEQ ID NO: 578768 - DNA, 20 bp, mouse
gtcttcacgaaggcccgaga

SEQ ID NO: 578769 - DNA, 20 bp, mouse
ggactccaagggattcactt

SEQ ID NO: 578770 - DNA, 20 bp, mouse
gcggaggcggaggcacggag

SEQ ID NO: 578771 - DNA, 20 bp, mouse
gagctcagtccctctcgcag

SEQ ID NO: 578772 - DNA, 20 bp, mouse
gggactgagctccacggagg

SEQ ID NO: 578773 - DNA, 20 bp, mouse
gggatcccaagtgaatccct

SEQ ID NO: 578774 - DNA, 20 bp, mouse
gcttgggatccgctgcgaga

SEQ ID NO: 578775 - DNA, 20 bp, mouse
gagagaggagacgggagctg

SEQ ID NO: 578776 - DNA, 20 bp, mouse
gggcccagcagggacaacaa

SEQ ID NO: 578777 - DNA, 20 bp, mouse
ggtccctgctgggcctctag

SEQ ID NO: 578778 - DNA, 20 bp, mouse
gtagaatgcgaagcccctag

SEQ ID NO: 578779 - DNA, 20 bp, mouse
gccccgcagagccagagcag

SEQ ID NO: 578780 - DNA, 20 bp, mouse
gtacctggctctcctggata

SEQ ID NO: 578781 - DNA, 20 bp, mouse
gtggccactcgcagcatcca

SEQ ID NO: 578782 - DNA, 20 bp, mouse
ggggcacttaggccctccag

SEQ ID NO: 578783 - DNA, 20 bp, mouse
gtcacccagaggacgtcgta

SEQ ID NO: 578784 - DNA, 20 bp, mouse
gccaggagagccaggtaaga

SEQ ID NO: 578785 - DNA, 20 bp, mouse
gaccgtgaggttctgagcct

SEQ ID NO: 578786 - DNA, 20 bp, mouse
gcgggcgcagacagcaccca

SEQ ID NO: 578787 - DNA, 20 bp, mouse
gtggagacctcgggcgatgg

SEQ ID NO: 578788 - DNA, 20 bp, mouse
gctggacgcaaggctcggcg

SEQ ID NO: 578789 - DNA, 20 bp, mouse
gggcgtggtggcggcgacag

SEQ ID NO: 578790 - DNA, 20 bp, mouse
gatagctcccgcggctccag

SEQ ID NO: 578791 - DNA, 20 bp, mouse
ggcggctccagtggagacct

SEQ ID NO: 578792 - DNA, 20 bp, mouse
ggcaaggctcggcgtggtgg

SEQ ID NO: 578793 - DNA, 20 bp, mouse
gcgggtgagagacagcgtga

SEQ ID NO: 578794 - DNA, 20 bp, mouse
gcagtggagacctcgggcga

SEQ ID NO: 578795 - DNA, 20 bp, mouse
gggctccgcggcaacagcaa

SEQ ID NO: 578796 - DNA, 20 bp, mouse
gatggtaagccacaaaaagt

SEQ ID NO: 578797 - DNA, 20 bp, mouse
gtgtccataggtagaagtat

SEQ ID NO: 578798 - DNA, 20 bp, mouse
gctgtcagggagtgaagagt

SEQ ID NO: 578799 - DNA, 20 bp, mouse
gcactccctgacaggtatgt

SEQ ID NO: 578800 - DNA, 20 bp, mouse
ggaactaccaggcacttagt

SEQ ID NO: 578801 - DNA, 20 bp, mouse
gttttgaaggagaaccacat

SEQ ID NO: 578802 - DNA, 20 bp, mouse
gacaggtatgtgggcctggt

SEQ ID NO: 578803 - DNA, 20 bp, mouse
gagaatacaaagatacctga

SEQ ID NO: 578804 - DNA, 20 bp, mouse
gaacgtaagctaagtaccca

SEQ ID NO: 578805 - DNA, 20 bp, mouse
gatggctgcagactataaca

SEQ ID NO: 578806 - DNA, 20 bp, mouse
gaggagacatgcccgcactg

SEQ ID NO: 578807 - DNA, 20 bp, mouse
gcgcactcgctacagaactt

SEQ ID NO: 578808 - DNA, 20 bp, mouse
ggcatggagtgtccacagtg

SEQ ID NO: 578809 - DNA, 20 bp, mouse
gagggctgcggataacagca

SEQ ID NO: 578810 - DNA, 20 bp, mouse
ggcgccccagtgggcacaag

SEQ ID NO: 578811 - DNA, 20 bp, mouse
gggacagcgggactccggta

SEQ ID NO: 578812 - DNA, 20 bp, mouse
gaggcacggggcgccccagt

SEQ ID NO: 578813 - DNA, 20 bp, mouse
gcagaggctgctcactccta

SEQ ID NO: 578814 - DNA, 20 bp, mouse
gggctccttcagctcaccag

SEQ ID NO: 578815 - DNA, 20 bp, mouse
gaaatgagaaagacacaccg

SEQ ID NO: 578816 - DNA, 20 bp, mouse
gcccccggggagccaagcgg

SEQ ID NO: 578817 - DNA, 20 bp, mouse
gacctgagcgggcggagcgg

SEQ ID NO: 578818 - DNA, 20 bp, mouse
ggtgccaagggccagcgtag

SEQ ID NO: 578819 - DNA, 20 bp, mouse
ggggaagggacgcacctgag

SEQ ID NO: 578820 - DNA, 20 bp, mouse
gagggacgcacctgagcggg

SEQ ID NO: 578821 - DNA, 20 bp, mouse
gtcgcgccgccggaagtggg

SEQ ID NO: 578822 - DNA, 20 bp, mouse
ggaactcccacagccctcac

SEQ ID NO: 578823 - DNA, 20 bp, mouse
gagggggcggccaagcctgg

SEQ ID NO: 578824 - DNA, 20 bp, mouse
gcgcagaaggggacaatggg

SEQ ID NO: 578825 - DNA, 20 bp, mouse
gcggaggacacgaggattcg

SEQ ID NO: 578826 - DNA, 20 bp, mouse
gcatgatccgaccggagagg

SEQ ID NO: 578827 - DNA, 20 bp, mouse
gtccccgggaccttagacta

SEQ ID NO: 578828 - DNA, 20 bp, mouse
ggcccatgatccgaccggag

SEQ ID NO: 578829 - DNA, 20 bp, mouse
ggcagagcccatgatccgac

SEQ ID NO: 578830 - DNA, 20 bp, mouse
gtccgaccggagaggtggcg

SEQ ID NO: 578831 - DNA, 20 bp, mouse
gtacggcctcgccacctctc

SEQ ID NO: 578832 - DNA, 20 bp, mouse
ggccgtagtctaaggtcccg

SEQ ID NO: 578833 - DNA, 20 bp, mouse
ggtggcgaggccgtagtcta

SEQ ID NO: 578834 - DNA, 20 bp, mouse
gagccaggccgcgccggaca

SEQ ID NO: 578835 - DNA, 20 bp, mouse
gctgatgggcccgggagcgg

SEQ ID NO: 578836 - DNA, 20 bp, mouse
ggccggaaggaacgcagtag

SEQ ID NO: 578837 - DNA, 20 bp, mouse
gaggaacgcagtagcggcct

SEQ ID NO: 578838 - DNA, 20 bp, mouse
gcgcaggcgcgaggtggacg

SEQ ID NO: 578839 - DNA, 20 bp, mouse
gacgcggtggcgaggccgga

SEQ ID NO: 578840 - DNA, 20 bp, mouse
gtcgcgcgcgcggtctcccg

SEQ ID NO: 578841 - DNA, 20 bp, mouse
gctgctgagagacggttctc

SEQ ID NO: 578842 - DNA, 20 bp, mouse
gaacttgagactgaactccc

SEQ ID NO: 578843 - DNA, 20 bp, mouse
gacgcgctcgcgagccccgg

SEQ ID NO: 578844 - DNA, 20 bp, mouse
gcacctgaagaagcagccgc

SEQ ID NO: 578845 - DNA, 20 bp, mouse
gtcccgccggggcgccaccg

SEQ ID NO: 578846 - DNA, 20 bp, mouse
gggcctgtggcgtcaccgag

SEQ ID NO: 578847 - DNA, 20 bp, mouse
gtggccgagtccgcaagcag

SEQ ID NO: 578848 - DNA, 20 bp, mouse
gctgtggcgtcaccgagagg

SEQ ID NO: 578849 - DNA, 20 bp, mouse
ggcgcagccggcgatcccga

SEQ ID NO: 578850 - DNA, 20 bp, mouse
gtgcggactcggccacctct

SEQ ID NO: 578851 - DNA, 20 bp, mouse
gaccgcctcgaggactccga

SEQ ID NO: 578852 - DNA, 20 bp, mouse
gtaggtgctgcacgaggaga

SEQ ID NO: 578853 - DNA, 20 bp, mouse
ggtgtccctggaggagaagc

SEQ ID NO: 578854 - DNA, 20 bp, mouse
gggacaccagccactgcttg

SEQ ID NO: 578855 - DNA, 20 bp, mouse
gcgagtccgcaagcagtggc

SEQ ID NO: 578856 - DNA, 20 bp, mouse
gcgtggcgaggagctgctgt

SEQ ID NO: 578857 - DNA, 20 bp, mouse
gtgagctgcgagctcctcgg

SEQ ID NO: 578858 - DNA, 20 bp, mouse
gcacgtgatgggcagagtga

SEQ ID NO: 578859 - DNA, 20 bp, mouse
gggcgaggagctgctgtcgg

SEQ ID NO: 578860 - DNA, 20 bp, mouse
gcgtgaggcgcccgatgcca

SEQ ID NO: 578861 - DNA, 20 bp, mouse
gagcaaatgtggcacgtgat

SEQ ID NO: 578862 - DNA, 20 bp, mouse
ggttcagaatcccgccaaca

SEQ ID NO: 578863 - DNA, 20 bp, mouse
gtgggtacggctaggagacg

SEQ ID NO: 578864 - DNA, 20 bp, mouse
ggcgggacttccgtgttggc

SEQ ID NO: 578865 - DNA, 20 bp, mouse
ggcctcgcgcattcccagcg

SEQ ID NO: 578866 - DNA, 20 bp, mouse
gtctccaagtccctgctggg

SEQ ID NO: 578867 - DNA, 20 bp, mouse
gagtccctgctgggaggccc

SEQ ID NO: 578868 - DNA, 20 bp, mouse
gtcagctagaagctgcagct

SEQ ID NO: 578869 - DNA, 20 bp, mouse
gagtcattactacactcctt

SEQ ID NO: 578870 - DNA, 20 bp, mouse
gtctggagcaggtgacaaga

SEQ ID NO: 578871 - DNA, 20 bp, mouse
gctgatctcgatagagggag

SEQ ID NO: 578872 - DNA, 20 bp, mouse
gagaggaagaccagctaaga

SEQ ID NO: 578873 - DNA, 20 bp, mouse
ggaagctgcagctaggaagc

SEQ ID NO: 578874 - DNA, 20 bp, mouse
ggagatgtcaggatccctgt

SEQ ID NO: 578875 - DNA, 20 bp, mouse
gatggtaagaggtatattga

SEQ ID NO: 578876 - DNA, 20 bp, mouse
gtcccatctgtgaaggactt

SEQ ID NO: 578877 - DNA, 20 bp, mouse
gttggcagtacctgagagag

SEQ ID NO: 578878 - DNA, 20 bp, mouse
gacccaagtccttcacagat

SEQ ID NO: 578879 - DNA, 20 bp, mouse
ggtacctgagagagtggcgt

SEQ ID NO: 578880 - DNA, 20 bp, mouse
gagaccgacgccactctctc

SEQ ID NO: 578881 - DNA, 20 bp, mouse
gaggtcgggaggacagcgca

SEQ ID NO: 578882 - DNA, 20 bp, mouse
ggggtgtggggtccttgggt

SEQ ID NO: 578883 - DNA, 20 bp, mouse
gagaagccatcctccacccc

SEQ ID NO: 578884 - DNA, 20 bp, mouse
gtggcttgcaccagagctct

SEQ ID NO: 578885 - DNA, 20 bp, mouse
gggaaccccaggtgtctaga

SEQ ID NO: 578886 - DNA, 20 bp, mouse
ggtcgctaccgccagctcag

SEQ ID NO: 578887 - DNA, 20 bp, mouse
gcggctcggactcacggacg

SEQ ID NO: 578888 - DNA, 20 bp, mouse
ggcccggagtcagcttcttg

SEQ ID NO: 578889 - DNA, 20 bp, mouse
gaccaccgacgcagaggcag

SEQ ID NO: 578890 - DNA, 20 bp, mouse
gtagctgcggccccggcgag

SEQ ID NO: 578891 - DNA, 20 bp, mouse
ggtccccaccaccgacgcag

SEQ ID NO: 578892 - DNA, 20 bp, mouse
ggtatgtggggactaaccca

SEQ ID NO: 578893 - DNA, 20 bp, mouse
gctccgagaccggggtccgt

SEQ ID NO: 578894 - DNA, 20 bp, mouse
gcgacgggcagcgggcgtgc

SEQ ID NO: 578895 - DNA, 20 bp, mouse
gcccagcccgaggtgacctc

SEQ ID NO: 578896 - DNA, 20 bp, mouse
gagttcccggcaccagatcc

SEQ ID NO: 578897 - DNA, 20 bp, mouse
gctactggaccgggaacgga

SEQ ID NO: 578898 - DNA, 20 bp, mouse
gtccggttccggccaagagc

SEQ ID NO: 578899 - DNA, 20 bp, mouse
gcgagctactggaccgggaa

SEQ ID NO: 578900 - DNA, 20 bp, mouse
gagggacgctgatctgagaa

SEQ ID NO: 578901 - DNA, 20 bp, mouse
gcccgtagtagggagcaatg

SEQ ID NO: 578902 - DNA, 20 bp, mouse
ggtctgcgtcgacagctgct

SEQ ID NO: 578903 - DNA, 20 bp, mouse
gggaagattgaggaacgcgt

SEQ ID NO: 578904 - DNA, 20 bp, mouse
ggaagggactgggtctacgg

SEQ ID NO: 578905 - DNA, 20 bp, mouse
ggtcttctccggctcttggc

SEQ ID NO: 578906 - DNA, 20 bp, mouse
ggaagggacgtggcaagcag

SEQ ID NO: 578907 - DNA, 20 bp, mouse
gcgtcccttcgcaaacaaga

SEQ ID NO: 578908 - DNA, 20 bp, mouse
gtcctcccgctcgcggcgag

SEQ ID NO: 578909 - DNA, 20 bp, mouse
gccgccatcttgtttgcgaa

SEQ ID NO: 578910 - DNA, 20 bp, mouse
gagacttttacagaagggaa

SEQ ID NO: 578911 - DNA, 20 bp, mouse
gggggcgggactatagcctg

SEQ ID NO: 578912 - DNA, 20 bp, mouse
ggcggcgcccagtggagtcg

SEQ ID NO: 578913 - DNA, 20 bp, mouse
ggcgcggcctcgactccact

SEQ ID NO: 578914 - DNA, 20 bp, mouse
gcgcaaggatgggacggagt

SEQ ID NO: 578915 - DNA, 20 bp, mouse
gagcctgtggccaatcagtg

SEQ ID NO: 578916 - DNA, 20 bp, mouse
ggcggtggcttaagtgaccc

SEQ ID NO: 578917 - DNA, 20 bp, mouse
gtaagtgacccgggctgctg

SEQ ID NO: 578918 - DNA, 20 bp, mouse
ggcgcggcgccacagcagcc

SEQ ID NO: 578919 - DNA, 20 bp, mouse
ggtaaccctggccgtggatg

SEQ ID NO: 578920 - DNA, 20 bp, mouse
gctaggctcagaggccaggt

SEQ ID NO: 578921 - DNA, 20 bp, mouse
gcacctgcgccagcccctgg

SEQ ID NO: 578922 - DNA, 20 bp, mouse
gtccagctgcaggtagcggg

SEQ ID NO: 578923 - DNA, 20 bp, mouse
gtgcgcagaatcccacctca

SEQ ID NO: 578924 - DNA, 20 bp, mouse
gggcgtccagctgcaggtag

SEQ ID NO: 578925 - DNA, 20 bp, mouse
gcgctgcaacgctcatgggg

SEQ ID NO: 578926 - DNA, 20 bp, mouse
gctgcgggacaaactcacaa

SEQ ID NO: 578927 - DNA, 20 bp, mouse
gacgaggagccgttcagaaa

SEQ ID NO: 578928 - DNA, 20 bp, mouse
gtcagaaaaggtgcagctga

SEQ ID NO: 578929 - DNA, 20 bp, mouse
ggatataacgagggacctca

SEQ ID NO: 578930 - DNA, 20 bp, mouse
gtgcgcacctagaagcgcag

SEQ ID NO: 578931 - DNA, 20 bp, mouse
ggctggttgccgtggcaacg

SEQ ID NO: 578932 - DNA, 20 bp, mouse
gtatacttcagacagcgctg

SEQ ID NO: 578933 - DNA, 20 bp, mouse
gaaagctctggtgcagagaa

SEQ ID NO: 578934 - DNA, 20 bp, mouse
ggaacggctcctcgttgcca

SEQ ID NO: 578935 - DNA, 20 bp, mouse
gcaaggctgtgatataacga

SEQ ID NO: 578936 - DNA, 20 bp, mouse
gggctcggtcggctctaccg

SEQ ID NO: 578937 - DNA, 20 bp, mouse
gtagcagcctcctcacacaa

SEQ ID NO: 578938 - DNA, 20 bp, mouse
gagagccgaccgagccgagg

SEQ ID NO: 578939 - DNA, 20 bp, mouse
ggaagatccgttgtgtgagg

SEQ ID NO: 578940 - DNA, 20 bp, mouse
gaaggaagatccgttgtgtg

SEQ ID NO: 578941 - DNA, 20 bp, mouse
gacgctcagtgggtctcggg

SEQ ID NO: 578942 - DNA, 20 bp, mouse
gtcgcggccatgaaggtgag

SEQ ID NO: 578943 - DNA, 20 bp, mouse
gttcatggccgcgaccgcct

SEQ ID NO: 578944 - DNA, 20 bp, mouse
gattcgccgccttagaagga

SEQ ID NO: 578945 - DNA, 20 bp, mouse
gggccgcgaccgcctcggct

SEQ ID NO: 578946 - DNA, 20 bp, mouse
gtgctcgggcggcgaaggtg

SEQ ID NO: 578947 - DNA, 20 bp, mouse
gccgcgggtggaaacaaagg

SEQ ID NO: 578948 - DNA, 20 bp, mouse
gggcagcgtctcccaacgca

SEQ ID NO: 578949 - DNA, 20 bp, mouse
gtcgggcggcgaaggtgggg

SEQ ID NO: 578950 - DNA, 20 bp, mouse
gcccccgcgggtggaaacaa

SEQ ID NO: 578951 - DNA, 20 bp, mouse
gggctaggcactccctgcgt

SEQ ID NO: 578952 - DNA, 20 bp, mouse
gctcggcgcgggggaagagg

SEQ ID NO: 578953 - DNA, 20 bp, mouse
gcagccaagcgcaggatcgc

SEQ ID NO: 578954 - DNA, 20 bp, mouse
gtcactcgctcggcttgctc

SEQ ID NO: 578955 - DNA, 20 bp, mouse
ggggaagaggcggagctacc

SEQ ID NO: 578956 - DNA, 20 bp, mouse
gggcgtccggaactccgagg

SEQ ID NO: 578957 - DNA, 20 bp, mouse
ggcgggcgtccggaactccg

SEQ ID NO: 578958 - DNA, 20 bp, mouse
ggggaggctgtcgagttctg

SEQ ID NO: 578959 - DNA, 20 bp, mouse
gccgagggcaaggacgatcg

SEQ ID NO: 578960 - DNA, 20 bp, mouse
ggcgcctctccagaaaccca

SEQ ID NO: 578961 - DNA, 20 bp, mouse
gacggcgggcagaaaagatg

SEQ ID NO: 578962 - DNA, 20 bp, mouse
gggcgagcagtcacaatagg

SEQ ID NO: 578963 - DNA, 20 bp, mouse
gggtccgcgagcgctgacaa

SEQ ID NO: 578964 - DNA, 20 bp, mouse
ggagcagtcacaataggagg

SEQ ID NO: 578965 - DNA, 20 bp, mouse
ggagccgtgggtttctggag

SEQ ID NO: 578966 - DNA, 20 bp, mouse
ggggtaaacatataagaacc

SEQ ID NO: 578967 - DNA, 20 bp, mouse
gtgactttcagccctgtgta

SEQ ID NO: 578968 - DNA, 20 bp, mouse
gaagtgagcatcctcttgaa

SEQ ID NO: 578969 - DNA, 20 bp, mouse
gtttaccctttccctacaca

SEQ ID NO: 578970 - DNA, 20 bp, mouse
gggtgctaggaggtacagaa

SEQ ID NO: 578971 - DNA, 20 bp, mouse
ggcgtagtgcccagaacata

SEQ ID NO: 578972 - DNA, 20 bp, mouse
gggcactacgcaagcagtga

SEQ ID NO: 578973 - DNA, 20 bp, mouse
gcttctcagagacttcttga

SEQ ID NO: 578974 - DNA, 20 bp, mouse
gaatatgtagggtgtaggaa

SEQ ID NO: 578975 - DNA, 20 bp, mouse
gtttatgtataggtgctagg

SEQ ID NO: 578976 - DNA, 20 bp, mouse
ggcccgggagaggggtagat

SEQ ID NO: 578977 - DNA, 20 bp, mouse
gggaggtgcgaagtgaatga

SEQ ID NO: 578978 - DNA, 20 bp, mouse
gccgaggcagcccgggagag

SEQ ID NO: 578979 - DNA, 20 bp, mouse
gggtgcgaagtgaatgaggg

SEQ ID NO: 578980 - DNA, 20 bp, mouse
gatgagggaggcgcagcgag

SEQ ID NO: 578981 - DNA, 20 bp, mouse
ggagcctccatggaaagcag

SEQ ID NO: 578982 - DNA, 20 bp, mouse
gagtccgatctgggtaaccg

SEQ ID NO: 578983 - DNA, 20 bp, mouse
gtcctatctacccctctccc

SEQ ID NO: 578984 - DNA, 20 bp, mouse
gcaggactgggtcctcgaag

SEQ ID NO: 578985 - DNA, 20 bp, mouse
ggacgctctgagtccgatct

SEQ ID NO: 578986 - DNA, 20 bp, mouse
ggaagtgggtcttcgtgagg

SEQ ID NO: 578987 - DNA, 20 bp, mouse
gcgcctcggctgatgagctc

SEQ ID NO: 578988 - DNA, 20 bp, mouse
gaggcgggagaggccaataa

SEQ ID NO: 578989 - DNA, 20 bp, mouse
gcggcgacgcgaccacacaa

SEQ ID NO: 578990 - DNA, 20 bp, mouse
gcggtggaggcttgcttgaa

SEQ ID NO: 578991 - DNA, 20 bp, mouse
gcggctgatgagctcgggca

SEQ ID NO: 578992 - DNA, 20 bp, mouse
gcggttgtcggaacatggag

SEQ ID NO: 578993 - DNA, 20 bp, mouse
gcggccccgagagtgacctt

SEQ ID NO: 578994 - DNA, 20 bp, mouse
gggcccaagccggagaagcg

SEQ ID NO: 578995 - DNA, 20 bp, mouse
ggtgccggacgagcggaagt

SEQ ID NO: 578996 - DNA, 20 bp, mouse
gccggtgaaatccaagatgg

SEQ ID NO: 578997 - DNA, 20 bp, mouse
gcgtccggtgaaatccaaga

SEQ ID NO: 578998 - DNA, 20 bp, mouse
gggggtccgcacttaccgta

SEQ ID NO: 578999 - DNA, 20 bp, mouse
gttgctgaggccagacatag

SEQ ID NO: 579000 - DNA, 20 bp, mouse
gctgaggccagacatagcgg

SEQ ID NO: 579001 - DNA, 20 bp, mouse
ggtaagtgcggacccccgtc

SEQ ID NO: 579002 - DNA, 20 bp, mouse
gtctggcggccggtgacgtc

SEQ ID NO: 579003 - DNA, 20 bp, mouse
gcagccaagcgccaccatct

SEQ ID NO: 579004 - DNA, 20 bp, mouse
gccccgcccccgccggacgg

SEQ ID NO: 579005 - DNA, 20 bp, mouse
gggcaactcagggctctccg

SEQ ID NO: 579006 - DNA, 20 bp, mouse
gcgagacagcgaggagtggt

SEQ ID NO: 579007 - DNA, 20 bp, mouse
ggggctaacccgagacagcg

SEQ ID NO: 579008 - DNA, 20 bp, mouse
gtctcagcctttccccgtag

SEQ ID NO: 579009 - DNA, 20 bp, mouse
gacccaggcaccaatccaca

SEQ ID NO: 579010 - DNA, 20 bp, mouse
ggccagcctgaggacccggg

SEQ ID NO: 579011 - DNA, 20 bp, mouse
gaccttccccttcccctacg

SEQ ID NO: 579012 - DNA, 20 bp, mouse
gtgcgtagcagcagtgggcg

SEQ ID NO: 579013 - DNA, 20 bp, mouse
gcccgttgcgtagcagcagt

SEQ ID NO: 579014 - DNA, 20 bp, mouse
gcctttccccgtaggggaag

SEQ ID NO: 579015 - DNA, 20 bp, mouse
gggagagcctcgggaagtgc

SEQ ID NO: 579016 - DNA, 20 bp, mouse
gagcgtgattgcagtcccag

SEQ ID NO: 579017 - DNA, 20 bp, mouse
ggacttggaagttcaggagg

SEQ ID NO: 579018 - DNA, 20 bp, mouse
ggcctctgtacggaatatct

SEQ ID NO: 579019 - DNA, 20 bp, mouse
gaagtgctcgcactacaggt

SEQ ID NO: 579020 - DNA, 20 bp, mouse
gtacaccaattacaaaccac

SEQ ID NO: 579021 - DNA, 20 bp, mouse
gttctccctccgcctctgta

SEQ ID NO: 579022 - DNA, 20 bp, mouse
gtattccgtacagaggcgga

SEQ ID NO: 579023 - DNA, 20 bp, mouse
gtggatcagctccctacagc

SEQ ID NO: 579024 - DNA, 20 bp, mouse
gggtatccctgaatcatgga

SEQ ID NO: 579025 - DNA, 20 bp, mouse
gctacctgctgacaaagtga

SEQ ID NO: 579026 - DNA, 20 bp, mouse
gccgcagccggagccggacc

SEQ ID NO: 579027 - DNA, 20 bp, mouse
gccgcaatggaacctctcag

SEQ ID NO: 579028 - DNA, 20 bp, mouse
gctccaccccgaataggcag

SEQ ID NO: 579029 - DNA, 20 bp, mouse
ggggcagcccggtccggctc

SEQ ID NO: 579030 - DNA, 20 bp, mouse
ggctgggctccaccccgaat

SEQ ID NO: 579031 - DNA, 20 bp, mouse
gcagcggcgcgttgctcccg

SEQ ID NO: 579032 - DNA, 20 bp, mouse
gggttccattgcgggcgcag

SEQ ID NO: 579033 - DNA, 20 bp, mouse
gaggtgcgggagcttcggtg

SEQ ID NO: 579034 - DNA, 20 bp, mouse
gccggcccaggtgacgacta

SEQ ID NO: 579035 - DNA, 20 bp, mouse
gcagggcacaggatcctcgt

SEQ ID NO: 579036 - DNA, 20 bp, mouse
gcagcccgggcccgagagaa

SEQ ID NO: 579037 - DNA, 20 bp, mouse
gcccgggctgagggagtggt

SEQ ID NO: 579038 - DNA, 20 bp, mouse
gtgattcacaacattcggat

SEQ ID NO: 579039 - DNA, 20 bp, mouse
gacgcgcaagcaaacagtag

SEQ ID NO: 579040 - DNA, 20 bp, mouse
ggagcaggctcgcgaaggag

SEQ ID NO: 579041 - DNA, 20 bp, mouse
gacaacattcggatcggcgg

SEQ ID NO: 579042 - DNA, 20 bp, mouse
gcagaagagcggcccggact

SEQ ID NO: 579043 - DNA, 20 bp, mouse
ggagcccgcgtgtggtcgga

SEQ ID NO: 579044 - DNA, 20 bp, mouse
ggacccgcaccccggaacta

SEQ ID NO: 579045 - DNA, 20 bp, mouse
gcagcgcgggaggcggctcg

SEQ ID NO: 579046 - DNA, 20 bp, mouse
gcagcggaggaagaagacgg

SEQ ID NO: 579047 - DNA, 20 bp, mouse
gcgtagccctcagtaccccc

SEQ ID NO: 579048 - DNA, 20 bp, mouse
gccttcggcccaggatcgtt

SEQ ID NO: 579049 - DNA, 20 bp, mouse
gtggtgagaatccgagtcag

SEQ ID NO: 579050 - DNA, 20 bp, mouse
ggggtactgagggctacgtg

SEQ ID NO: 579051 - DNA, 20 bp, mouse
gcgtgtgtggccacctgtat

SEQ ID NO: 579052 - DNA, 20 bp, mouse
gcctccccacatacacgtag

SEQ ID NO: 579053 - DNA, 20 bp, mouse
gtgtgtgcctgggggtactg

SEQ ID NO: 579054 - DNA, 20 bp, mouse
ggtaggggaggcctaaagtg

SEQ ID NO: 579055 - DNA, 20 bp, mouse
gaagtttgcccaacgatcct

SEQ ID NO: 579056 - DNA, 20 bp, mouse
ggcagggtcgctgcagacgg

SEQ ID NO: 579057 - DNA, 20 bp, mouse
gcgcctcggagaactaagac

SEQ ID NO: 579058 - DNA, 20 bp, mouse
gggccagtcttagttctccg

SEQ ID NO: 579059 - DNA, 20 bp, mouse
ggagaggagcgtccgatctc

SEQ ID NO: 579060 - DNA, 20 bp, mouse
ggcggagagaaagctaagag

SEQ ID NO: 579061 - DNA, 20 bp, mouse
ggtgcgagaaggccggagat

SEQ ID NO: 579062 - DNA, 20 bp, mouse
gtctccgaggcggtgcgaga

SEQ ID NO: 579063 - DNA, 20 bp, mouse
ggtttccagacgcaccggca

SEQ ID NO: 579064 - DNA, 20 bp, mouse
ggcgccgtttccagacgcac

SEQ ID NO: 579065 - DNA, 20 bp, mouse
gccggcagggtcgctgcaga

SEQ ID NO: 579066 - DNA, 20 bp, mouse
gccatggcggcggcgcagaa

SEQ ID NO: 579067 - DNA, 20 bp, mouse
ggggccgggccgccagacac

SEQ ID NO: 579068 - DNA, 20 bp, mouse
ggcggaggcgggaggtacgg

SEQ ID NO: 579069 - DNA, 20 bp, mouse
gcgtgaccgggatacccgag

SEQ ID NO: 579070 - DNA, 20 bp, mouse
gcggccagcaaatctcccag

SEQ ID NO: 579071 - DNA, 20 bp, mouse
gggcccggcccagcactcgc

SEQ ID NO: 579072 - DNA, 20 bp, mouse
ggccggctcggcccagctcg

SEQ ID NO: 579073 - DNA, 20 bp, mouse
gtctgcagggtccaggtgat

SEQ ID NO: 579074 - DNA, 20 bp, mouse
gaccgcgagctgggccgagc

SEQ ID NO: 579075 - DNA, 20 bp, mouse
gtgggcaagctctaatcctg

SEQ ID NO: 579076 - DNA, 20 bp, mouse
ggcgagaggaacctcggagg

SEQ ID NO: 579077 - DNA, 20 bp, mouse
gtcggaggcggccggagctc

SEQ ID NO: 579078 - DNA, 20 bp, mouse
gagttgcgcgagaggaacct

SEQ ID NO: 579079 - DNA, 20 bp, mouse
gcatggcccgaccggcactg

SEQ ID NO: 579080 - DNA, 20 bp, mouse
gcggccggagctcaggctag

SEQ ID NO: 579081 - DNA, 20 bp, mouse
ggagctgccccgagaccaag

SEQ ID NO: 579082 - DNA, 20 bp, mouse
gcccagcgaggagaaggatg

SEQ ID NO: 579083 - DNA, 20 bp, mouse
ggctcaggctagaggttggc

SEQ ID NO: 579084 - DNA, 20 bp, mouse
gggagtggcgaacctgtcta

SEQ ID NO: 579085 - DNA, 20 bp, mouse
gggctcgcccatggcccgac

SEQ ID NO: 579086 - DNA, 20 bp, mouse
ggcgctgctggtggcgtccg

SEQ ID NO: 579087 - DNA, 20 bp, mouse
ggcgtccgaggctgaaggct

SEQ ID NO: 579088 - DNA, 20 bp, mouse
gccaggccgagcgctgctgg

SEQ ID NO: 579089 - DNA, 20 bp, mouse
gctcgccaagccttcagcct

SEQ ID NO: 579090 - DNA, 20 bp, mouse
gagagccgaagctcggacgt

SEQ ID NO: 579091 - DNA, 20 bp, mouse
ggctcggcctggccccgcgg

SEQ ID NO: 579092 - DNA, 20 bp, mouse
gccgcgcgtgacgacgtcta

SEQ ID NO: 579093 - DNA, 20 bp, mouse
ggccgaagctcggacgtggg

SEQ ID NO: 579094 - DNA, 20 bp, mouse
gtctcatgaccaggagcggg

SEQ ID NO: 579095 - DNA, 20 bp, mouse
gataccaacagcccgacacg

SEQ ID NO: 579096 - DNA, 20 bp, mouse
gcggggtcacagggtagcag

SEQ ID NO: 579097 - DNA, 20 bp, mouse
gccgtgattgctgcagtgtc

SEQ ID NO: 579098 - DNA, 20 bp, mouse
gccaggctcgcggggtcaca

SEQ ID NO: 579099 - DNA, 20 bp, mouse
gagggaggaccagggtgtgt

SEQ ID NO: 579100 - DNA, 20 bp, mouse
gagcctcctagggaggacca

SEQ ID NO: 579101 - DNA, 20 bp, mouse
gatccagcctagccaatccc

SEQ ID NO: 579102 - DNA, 20 bp, mouse
ggccacgccagggattggct

SEQ ID NO: 579103 - DNA, 20 bp, mouse
ggcaaacgggcggtacaagt

SEQ ID NO: 579104 - DNA, 20 bp, mouse
ggggaccgtgcagcctccta

SEQ ID NO: 579105 - DNA, 20 bp, mouse
gccctggccacgccagggat

SEQ ID NO: 579106 - DNA, 20 bp, mouse
gaaaccagcccggaccccaa

SEQ ID NO: 579107 - DNA, 20 bp, mouse
ggctctacccgggtcctcag

SEQ ID NO: 579108 - DNA, 20 bp, mouse
gggcgcgccgctgaggaccc

SEQ ID NO: 579109 - DNA, 20 bp, mouse
ggccttgcgggagtcccgac

SEQ ID NO: 579110 - DNA, 20 bp, mouse
gtgtggagctatcggcgagg

SEQ ID NO: 579111 - DNA, 20 bp, mouse
gcagccggtggcaggtaccc

SEQ ID NO: 579112 - DNA, 20 bp, mouse
gtgaaagtggcgcgccgctg

SEQ ID NO: 579113 - DNA, 20 bp, mouse
ggccagtcgggactcccgca

SEQ ID NO: 579114 - DNA, 20 bp, mouse
gggtagagctgctgccgttg

SEQ ID NO: 579115 - DNA, 20 bp, mouse
gcctcccgggtacctgccac

SEQ ID NO: 579116 - DNA, 20 bp, mouse
gagcgacctccggactgaag

SEQ ID NO: 579117 - DNA, 20 bp, mouse
gccccacagcgaggacacga

SEQ ID NO: 579118 - DNA, 20 bp, mouse
gggagtgcgacagcgacctc

SEQ ID NO: 579119 - DNA, 20 bp, mouse
gtcgggcagggcagtactgg

SEQ ID NO: 579120 - DNA, 20 bp, mouse
ggaggtacacagggagacgg

SEQ ID NO: 579121 - DNA, 20 bp, mouse
gaggcgagacggatgatctc

SEQ ID NO: 579122 - DNA, 20 bp, mouse
gccccagccggaggtacaca

SEQ ID NO: 579123 - DNA, 20 bp, mouse
gccggaggtacacagggaga

SEQ ID NO: 579124 - DNA, 20 bp, mouse
gttcttccacttcagtccgg

SEQ ID NO: 579125 - DNA, 20 bp, mouse
gcgcttcttccacttcagtc

SEQ ID NO: 579126 - DNA, 20 bp, mouse
ggagcgcggagaacccacag

SEQ ID NO: 579127 - DNA, 20 bp, mouse
gcctgggcagaaagtcgccg

SEQ ID NO: 579128 - DNA, 20 bp, mouse
gaccgggtaaccaagctgcc

SEQ ID NO: 579129 - DNA, 20 bp, mouse
gaccgggcagcttggttacc

SEQ ID NO: 579130 - DNA, 20 bp, mouse
gcgatgggattggggctcac

SEQ ID NO: 579131 - DNA, 20 bp, mouse
gtgtcagcggcctagccgaa

SEQ ID NO: 579132 - DNA, 20 bp, mouse
gaccagaagcggcttttggg

SEQ ID NO: 579133 - DNA, 20 bp, mouse
gggagaggcctgttacgctc

SEQ ID NO: 579134 - DNA, 20 bp, mouse
gagccgcttctggtgtagag

SEQ ID NO: 579135 - DNA, 20 bp, mouse
gaggacagccagagcgtaac

SEQ ID NO: 579136 - DNA, 20 bp, mouse
ggtttccgcaaacagaatcg

SEQ ID NO: 579137 - DNA, 20 bp, mouse
gcccaccaagcaaggaccgg

SEQ ID NO: 579138 - DNA, 20 bp, mouse
gcccatagccggaagcagtg

SEQ ID NO: 579139 - DNA, 20 bp, mouse
gccccggaagtgacgtaaca

SEQ ID NO: 579140 - DNA, 20 bp, mouse
gaggcacgcgtggctccggc

SEQ ID NO: 579141 - DNA, 20 bp, mouse
ggatgggccggagacatgtt

SEQ ID NO: 579142 - DNA, 20 bp, mouse
gggaccctgacccaaaggtt

SEQ ID NO: 579143 - DNA, 20 bp, mouse
gcctttgggtcagggtccta

SEQ ID NO: 579144 - DNA, 20 bp, mouse
gaagtcccgggcgcactccc

SEQ ID NO: 579145 - DNA, 20 bp, mouse
gtccctgggctactgtggtc

SEQ ID NO: 579146 - DNA, 20 bp, mouse
ggcgcgcgccaggggaaaga

SEQ ID NO: 579147 - DNA, 20 bp, mouse
gacccgcagcaatgatccca

SEQ ID NO: 579148 - DNA, 20 bp, mouse
gagatggcagcgccggcgaa

SEQ ID NO: 579149 - DNA, 20 bp, mouse
gctgcgggtggtccagactc

SEQ ID NO: 579150 - DNA, 20 bp, mouse
gagcgccggcgaagggcatg

SEQ ID NO: 579151 - DNA, 20 bp, mouse
gagggcatgtggtgctccct

SEQ ID NO: 579152 - DNA, 20 bp, mouse
gagcaccacatgcccttcgc

SEQ ID NO: 579153 - DNA, 20 bp, mouse
gtcgaccgcgcgctcgggtg

SEQ ID NO: 579154 - DNA, 20 bp, mouse
gaggggaaagatggcagcgc

SEQ ID NO: 579155 - DNA, 20 bp, mouse
ggtgaggtagcgcgcgccag

SEQ ID NO: 579156 - DNA, 20 bp, mouse
gctgcagaagcggccagaga

SEQ ID NO: 579157 - DNA, 20 bp, mouse
gctgcagggaagctagatgg

SEQ ID NO: 579158 - DNA, 20 bp, mouse
gctcgggacagcggcatcgg

SEQ ID NO: 579159 - DNA, 20 bp, mouse
gctgggccgcctcgggacag

SEQ ID NO: 579160 - DNA, 20 bp, mouse
gcgcctcgggacagcggcat

SEQ ID NO: 579161 - DNA, 20 bp, mouse
gtgcgcggaggttccgtctc

SEQ ID NO: 579162 - DNA, 20 bp, mouse
ggcgcgtcctgtcagataag

SEQ ID NO: 579163 - DNA, 20 bp, mouse
gtctagcttccctgcagaag

SEQ ID NO: 579164 - DNA, 20 bp, mouse
ggttcggccggaagcttgcg

SEQ ID NO: 579165 - DNA, 20 bp, mouse
gggcaggtgcctgacgagga

SEQ ID NO: 579166 - DNA, 20 bp, mouse
ggagcgaccgaccttcctgg

SEQ ID NO: 579167 - DNA, 20 bp, mouse
gagcaaccgctcaggagcca

SEQ ID NO: 579168 - DNA, 20 bp, mouse
gcctggtccgccgctctcca

SEQ ID NO: 579169 - DNA, 20 bp, mouse
ggctcacccgccaggaaggt

SEQ ID NO: 579170 - DNA, 20 bp, mouse
ggagtgcagtggccgccggg

SEQ ID NO: 579171 - DNA, 20 bp, mouse
ggaggagcgaccgaccttcc

SEQ ID NO: 579172 - DNA, 20 bp, mouse
gcgggaagccgcggattgag

SEQ ID NO: 579173 - DNA, 20 bp, mouse
gggttgctcacccgccagga

SEQ ID NO: 579174 - DNA, 20 bp, mouse
gcggcttgggccgagtgcag

SEQ ID NO: 579175 - DNA, 20 bp, mouse
gtccagctcgaagcgatcgg

SEQ ID NO: 579176 - DNA, 20 bp, mouse
ggccgaggccacgtccaggg

SEQ ID NO: 579177 - DNA, 20 bp, mouse
gctagcgccggtggtcatgg

SEQ ID NO: 579178 - DNA, 20 bp, mouse
gggccgggcgcgggcacaac

SEQ ID NO: 579179 - DNA, 20 bp, mouse
gggcgctaggtgaaatccat

SEQ ID NO: 579180 - DNA, 20 bp, mouse
ggcgaaacgagaccgagtgt

SEQ ID NO: 579181 - DNA, 20 bp, mouse
ggtgcacggcgactcggaga

SEQ ID NO: 579182 - DNA, 20 bp, mouse
gagcggcggagcagaacgcg

SEQ ID NO: 579183 - DNA, 20 bp, mouse
ggtcagtgggcgaggggccc

SEQ ID NO: 579184 - DNA, 20 bp, mouse
gaggccacgtccagggcggg

SEQ ID NO: 579185 - DNA, 20 bp, mouse
gactgtaggccgcggtcagt

SEQ ID NO: 579186 - DNA, 20 bp, mouse
gtcagaggtgagaagcggga

SEQ ID NO: 579187 - DNA, 20 bp, mouse
gtggtcgaggcggtcaccga

SEQ ID NO: 579188 - DNA, 20 bp, mouse
gactcaggtcgggcccggtg

SEQ ID NO: 579189 - DNA, 20 bp, mouse
gcttgggaagatgtaagtcg

SEQ ID NO: 579190 - DNA, 20 bp, mouse
ggcccgacctgagtagtgag

SEQ ID NO: 579191 - DNA, 20 bp, mouse
gcggcgaggaacagagcccg

SEQ ID NO: 579192 - DNA, 20 bp, mouse
gagagagtgtggttcaggtc

SEQ ID NO: 579193 - DNA, 20 bp, mouse
gggaagatgtaagtcggggt

SEQ ID NO: 579194 - DNA, 20 bp, mouse
gggcgcaactttgtcgtcag

SEQ ID NO: 579195 - DNA, 20 bp, mouse
gggcccggaagtggtcgagg

SEQ ID NO: 579196 - DNA, 20 bp, mouse
ggaggaagaggatgctgccg

SEQ ID NO: 579197 - DNA, 20 bp, mouse
gcaagctcccagcggagctc

SEQ ID NO: 579198 - DNA, 20 bp, mouse
gaggctcgcccgagctccgc

SEQ ID NO: 579199 - DNA, 20 bp, mouse
gcacgagctgtcgagccgaa

SEQ ID NO: 579200 - DNA, 20 bp, mouse
gtagccaccccgggaagttt

SEQ ID NO: 579201 - DNA, 20 bp, mouse
ggcaccaggagggagcgaag

SEQ ID NO: 579202 - DNA, 20 bp, mouse
gccgcgagtgatgggaacaa

SEQ ID NO: 579203 - DNA, 20 bp, mouse
gccgggtcctgcttctactg

SEQ ID NO: 579204 - DNA, 20 bp, mouse
gagggagcgaaggggcggta

SEQ ID NO: 579205 - DNA, 20 bp, mouse
gcgggcggccccgggttggt

SEQ ID NO: 579206 - DNA, 20 bp, mouse
gcctcgctccctcaccacgt

SEQ ID NO: 579207 - DNA, 20 bp, mouse
ggacggcttgggtggagaat

SEQ ID NO: 579208 - DNA, 20 bp, mouse
ggagaatgggaactcctacg

SEQ ID NO: 579209 - DNA, 20 bp, mouse
ggaaggcaggacggcttggg

SEQ ID NO: 579210 - DNA, 20 bp, mouse
gctgctacggaggaaaccaa

SEQ ID NO: 579211 - DNA, 20 bp, mouse
gaaggggagaaaaacccggt

SEQ ID NO: 579212 - DNA, 20 bp, mouse
ggaggcagcactactcccgg

SEQ ID NO: 579213 - DNA, 20 bp, mouse
gggggaaggcaggacggctt

SEQ ID NO: 579214 - DNA, 20 bp, mouse
ggactccgagggaggcgacc

SEQ ID NO: 579215 - DNA, 20 bp, mouse
gccgcgaagtggtgctgcta

SEQ ID NO: 579216 - DNA, 20 bp, mouse
gtccaggaggaagcagacta

SEQ ID NO: 579217 - DNA, 20 bp, mouse
gaggaggacagcccgcgcag

SEQ ID NO: 579218 - DNA, 20 bp, mouse
gagaggcacggccggtaccc

SEQ ID NO: 579219 - DNA, 20 bp, mouse
gtggctgccgcagcgcgcaa

SEQ ID NO: 579220 - DNA, 20 bp, mouse
ggacagcccgcgcagaggca

SEQ ID NO: 579221 - DNA, 20 bp, mouse
gctgcaggacagcggcatcg

SEQ ID NO: 579222 - DNA, 20 bp, mouse
gtgcaggcgtgcctgggtac

SEQ ID NO: 579223 - DNA, 20 bp, mouse
gcagcgcgcaaaggctgtgg

SEQ ID NO: 579224 - DNA, 20 bp, mouse
ggcccgcgcagaggcacggc

SEQ ID NO: 579225 - DNA, 20 bp, mouse
gactccagcgagctactctt

SEQ ID NO: 579226 - DNA, 20 bp, mouse
gcccgttcctccagagccca

SEQ ID NO: 579227 - DNA, 20 bp, mouse
gcaaccggacaaaagtgtat

SEQ ID NO: 579228 - DNA, 20 bp, mouse
ggagcagccatgggctctgg

SEQ ID NO: 579229 - DNA, 20 bp, mouse
ggacaaaagtgtatgggaca

SEQ ID NO: 579230 - DNA, 20 bp, mouse
ggctgtgagctcagaacaac

SEQ ID NO: 579231 - DNA, 20 bp, mouse
gaggccactccgtccccagg

SEQ ID NO: 579232 - DNA, 20 bp, mouse
gtcactgctaactagaagaa

SEQ ID NO: 579233 - DNA, 20 bp, mouse
gcaggagcgtgggttaggag

SEQ ID NO: 579234 - DNA, 20 bp, mouse
ggggcctcctggggacggag

SEQ ID NO: 579235 - DNA, 20 bp, mouse
gcagaggccactccgtcccc

SEQ ID NO: 579236 - DNA, 20 bp, mouse
gaggcccgatgaagtctcag

SEQ ID NO: 579237 - DNA, 20 bp, mouse
gatcagccgcacggccccta

SEQ ID NO: 579238 - DNA, 20 bp, mouse
ggcgaggaagacgaccgtag

SEQ ID NO: 579239 - DNA, 20 bp, mouse
ggacgaccgtaggggccgtg

SEQ ID NO: 579240 - DNA, 20 bp, mouse
gcgctcagaggcgctagagg

SEQ ID NO: 579241 - DNA, 20 bp, mouse
gaggggaagacccgctgcag

SEQ ID NO: 579242 - DNA, 20 bp, mouse
gcagggaaggcgaagaggaa

SEQ ID NO: 579243 - DNA, 20 bp, mouse
gaagacccgctgcagtgggc

SEQ ID NO: 579244 - DNA, 20 bp, mouse
gcagggtggagactccctcg

SEQ ID NO: 579245 - DNA, 20 bp, mouse
ggagtggaaccggggatgca

SEQ ID NO: 579246 - DNA, 20 bp, mouse
ggcgcggccgagtagggacg

SEQ ID NO: 579247 - DNA, 20 bp, mouse
gggcggcgcgcggccgagta

SEQ ID NO: 579248 - DNA, 20 bp, mouse
gcgggcggctcctcagacag

SEQ ID NO: 579249 - DNA, 20 bp, mouse
gggctccgactgcgtgtgag

SEQ ID NO: 579250 - DNA, 20 bp, mouse
ggtgaggggagcgggcgtgt

SEQ ID NO: 579251 - DNA, 20 bp, mouse
gtcggagccgcgtccctact

SEQ ID NO: 579252 - DNA, 20 bp, mouse
gctgcgcgctccaagaacgg

SEQ ID NO: 579253 - DNA, 20 bp, mouse
gccgggagcagcgaggcaca

SEQ ID NO: 579254 - DNA, 20 bp, mouse
gcgctcccctcacacgcagt

SEQ ID NO: 579255 - DNA, 20 bp, mouse
gcggcgcgcgtgcggctgag

SEQ ID NO: 579256 - DNA, 20 bp, mouse
gcggtgcgcggctaggagga

SEQ ID NO: 579257 - DNA, 20 bp, mouse
gaggaggatggcgaccgcga

SEQ ID NO: 579258 - DNA, 20 bp, mouse
gtagccgcgcaccgtctctg

SEQ ID NO: 579259 - DNA, 20 bp, mouse
ggcggcgctcgcagccatcg

SEQ ID NO: 579260 - DNA, 20 bp, mouse
ggagacggtgcgcggctagg

SEQ ID NO: 579261 - DNA, 20 bp, mouse
gcagctgcaggacatcctca

SEQ ID NO: 579262 - DNA, 20 bp, mouse
ggcggagcgggcagtactgg

SEQ ID NO: 579263 - DNA, 20 bp, mouse
gagacctcagagacggtgcg

SEQ ID NO: 579264 - DNA, 20 bp, mouse
gacgggaggaggcgaaaaag

SEQ ID NO: 579265 - DNA, 20 bp, mouse
gggctgcgagcgccgcggag

SEQ ID NO: 579266 - DNA, 20 bp, mouse
gaacggatacggggttggag

SEQ ID NO: 579267 - DNA, 20 bp, mouse
ggttggaggggcagcaccac

SEQ ID NO: 579268 - DNA, 20 bp, mouse
gcactcccttgggcagagat

SEQ ID NO: 579269 - DNA, 20 bp, mouse
gcctgtgccaaacggatacg

SEQ ID NO: 579270 - DNA, 20 bp, mouse
ggccctggcagcgggaacgg

SEQ ID NO: 579271 - DNA, 20 bp, mouse
gagggagtgagaagccgtcg

SEQ ID NO: 579272 - DNA, 20 bp, mouse
gcagagatgggagatggcgc

SEQ ID NO: 579273 - DNA, 20 bp, mouse
ggagcagggaatgaacaaga

SEQ ID NO: 579274 - DNA, 20 bp, mouse
gcagcgggaacggtggctct

SEQ ID NO: 579275 - DNA, 20 bp, mouse
gatggcgccggtgctgcccg

SEQ ID NO: 579276 - DNA, 20 bp, mouse
gcgcagcggagaacgaggtg

SEQ ID NO: 579277 - DNA, 20 bp, mouse
ggcgatcgcagcggagaacg

SEQ ID NO: 579278 - DNA, 20 bp, mouse
gcgcgacgcaggccactgtc

SEQ ID NO: 579279 - DNA, 20 bp, mouse
ggcggagaacgaggtgaggt

SEQ ID NO: 579280 - DNA, 20 bp, mouse
ggtgaggtggggcccgacag

SEQ ID NO: 579281 - DNA, 20 bp, mouse
gccacggccaccggcatctg

SEQ ID NO: 579282 - DNA, 20 bp, mouse
gtctcactccgaatgctagg

SEQ ID NO: 579283 - DNA, 20 bp, mouse
gcactccgaatgctaggcgg

SEQ ID NO: 579284 - DNA, 20 bp, mouse
ggcctccaccaccctcgcga

SEQ ID NO: 579285 - DNA, 20 bp, mouse
ggcgccctccgcctagcatt

SEQ ID NO: 579286 - DNA, 20 bp, mouse
gtggtatcaggcgggagatg

SEQ ID NO: 579287 - DNA, 20 bp, mouse
gccaccaagggtccaggcgt

SEQ ID NO: 579288 - DNA, 20 bp, mouse
ggagagctgtggacctgtta

SEQ ID NO: 579289 - DNA, 20 bp, mouse
gctgtgggcaagggatggtt

SEQ ID NO: 579290 - DNA, 20 bp, mouse
gtcccttgcccacagaacct

SEQ ID NO: 579291 - DNA, 20 bp, mouse
ggctccaacgcctggaccct

SEQ ID NO: 579292 - DNA, 20 bp, mouse
ggccagacagcccctttgga

SEQ ID NO: 579293 - DNA, 20 bp, mouse
gagggaggagctccaacgcc

SEQ ID NO: 579294 - DNA, 20 bp, mouse
gcacgtgcctggtatcaggc

SEQ ID NO: 579295 - DNA, 20 bp, mouse
gaaactgaggtaccccggag

SEQ ID NO: 579296 - DNA, 20 bp, mouse
gaaagcctggaagtctaagt

SEQ ID NO: 579297 - DNA, 20 bp, mouse
gagacagtaagtaagtggag

SEQ ID NO: 579298 - DNA, 20 bp, mouse
gaagtaagtggaggggaatc

SEQ ID NO: 579299 - DNA, 20 bp, mouse
gtgtctcaagaaagtaggga

SEQ ID NO: 579300 - DNA, 20 bp, mouse
gaggagtgaactaaagagag

SEQ ID NO: 579301 - DNA, 20 bp, mouse
ggtgttggacatttctgcaa

SEQ ID NO: 579302 - DNA, 20 bp, mouse
ggctacccacttagacttcc

SEQ ID NO: 579303 - DNA, 20 bp, mouse
gaaagtggatatacagacat

SEQ ID NO: 579304 - DNA, 20 bp, mouse
gttcatgtctcaagaaagta

SEQ ID NO: 579305 - DNA, 20 bp, mouse
gtggatatacagacattggt

SEQ ID NO: 579306 - DNA, 20 bp, mouse
gagaggcagggtcagcgcag

SEQ ID NO: 579307 - DNA, 20 bp, mouse
gcgttctggggagaccgcgg

SEQ ID NO: 579308 - DNA, 20 bp, mouse
ggcgcgcagaacatggtgtc

SEQ ID NO: 579309 - DNA, 20 bp, mouse
ggaggcccaaccgcccagag

SEQ ID NO: 579310 - DNA, 20 bp, mouse
ggatgtccggcagctccggg

SEQ ID NO: 579311 - DNA, 20 bp, mouse
ggggcagcggcatcgttctg

SEQ ID NO: 579312 - DNA, 20 bp, mouse
ggcggacgtgctgcagtggt

SEQ ID NO: 579313 - DNA, 20 bp, mouse
gggcctgggacgttgtgctg

SEQ ID NO: 579314 - DNA, 20 bp, mouse
ggggacgttgtgctgcgggg

SEQ ID NO: 579315 - DNA, 20 bp, mouse
gtgaactgcttgaggatgtc

SEQ ID NO: 579316 - DNA, 20 bp, mouse
gtgggcgagaagagagatcg

SEQ ID NO: 579317 - DNA, 20 bp, mouse
gctcggggctcactaagccg

SEQ ID NO: 579318 - DNA, 20 bp, mouse
gggcggcagagcggagacga

SEQ ID NO: 579319 - DNA, 20 bp, mouse
ggcctggagctgcggtctcg

SEQ ID NO: 579320 - DNA, 20 bp, mouse
gcgcgctcccaggtccaggg

SEQ ID NO: 579321 - DNA, 20 bp, mouse
ggccccgagaccgcagctcc

SEQ ID NO: 579322 - DNA, 20 bp, mouse
gtgcccagtgcctggagctg

SEQ ID NO: 579323 - DNA, 20 bp, mouse
ggaagagcgtgcccagtgcc

SEQ ID NO: 579324 - DNA, 20 bp, mouse
gaagagagatcgtggagagc

SEQ ID NO: 579325 - DNA, 20 bp, mouse
gtgaacagccggctgagtca

SEQ ID NO: 579326 - DNA, 20 bp, mouse
gctctgccggagtgactcaa

SEQ ID NO: 579327 - DNA, 20 bp, mouse
ggccgggaagagcacagggg

SEQ ID NO: 579328 - DNA, 20 bp, mouse
ggccgccgggaagagcacag

SEQ ID NO: 579329 - DNA, 20 bp, mouse
gagacggcccgggcgcacag

SEQ ID NO: 579330 - DNA, 20 bp, mouse
ggcagtgaatcggtgcatcg

SEQ ID NO: 579331 - DNA, 20 bp, mouse
gaccagagtggccctcgaag

SEQ ID NO: 579332 - DNA, 20 bp, mouse
gtccccttcgagggccactc

SEQ ID NO: 579333 - DNA, 20 bp, mouse
ggagcgcgcggtaggcgacc

SEQ ID NO: 579334 - DNA, 20 bp, mouse
gggaaaaagggacaccagag

SEQ ID NO: 579335 - DNA, 20 bp, mouse
ggactctggggctcgggcac

SEQ ID NO: 579336 - DNA, 20 bp, mouse
gggctccggggtcggacggt

SEQ ID NO: 579337 - DNA, 20 bp, mouse
gagagccgaccgtccgaccc

SEQ ID NO: 579338 - DNA, 20 bp, mouse
gccgcggtgcggagagcgca

SEQ ID NO: 579339 - DNA, 20 bp, mouse
gcgggcggcggcggcaagag

SEQ ID NO: 579340 - DNA, 20 bp, mouse
gagctcacgtacagcttgag

SEQ ID NO: 579341 - DNA, 20 bp, mouse
gggctcgggatggctctcgg

SEQ ID NO: 579342 - DNA, 20 bp, mouse
gagaccccgttgggttccag

SEQ ID NO: 579343 - DNA, 20 bp, mouse
ggtggactgacggctccggg

SEQ ID NO: 579344 - DNA, 20 bp, mouse
gggcagccactggaacccaa

SEQ ID NO: 579345 - DNA, 20 bp, mouse
gagctccagtggctacgctg

SEQ ID NO: 579346 - DNA, 20 bp, mouse
ggttcagttgcagagacgaa

SEQ ID NO: 579347 - DNA, 20 bp, mouse
gacattgtggatccgctaac

SEQ ID NO: 579348 - DNA, 20 bp, mouse
gaaatctccgagccccgagg

SEQ ID NO: 579349 - DNA, 20 bp, mouse
ggtgatcacttagactgagg

SEQ ID NO: 579350 - DNA, 20 bp, mouse
gatcacttagactgaggagg

SEQ ID NO: 579351 - DNA, 20 bp, mouse
ggaagagggagaattatcaa

SEQ ID NO: 579352 - DNA, 20 bp, mouse
gacagtgaaaattcacattg

SEQ ID NO: 579353 - DNA, 20 bp, mouse
gagaagaggcttatacgcga

SEQ ID NO: 579354 - DNA, 20 bp, mouse
gtgtcgtggccacagggtga

SEQ ID NO: 579355 - DNA, 20 bp, mouse
gttatacgcgagggcgggtt

SEQ ID NO: 579356 - DNA, 20 bp, mouse
ggcagcaaggacggcaccaa

SEQ ID NO: 579357 - DNA, 20 bp, mouse
gcaccaagggagctacccca

SEQ ID NO: 579358 - DNA, 20 bp, mouse
gctgtggggccctgtccatg

SEQ ID NO: 579359 - DNA, 20 bp, mouse
ggagcagaggggagatggac

SEQ ID NO: 579360 - DNA, 20 bp, mouse
gggcagggagcagggcccaa

SEQ ID NO: 579361 - DNA, 20 bp, mouse
gcttaccccgagatgtccgg

SEQ ID NO: 579362 - DNA, 20 bp, mouse
gagggagctaccccatggac

SEQ ID NO: 579363 - DNA, 20 bp, mouse
gtgtccggtggtgtctctgt

SEQ ID NO: 579364 - DNA, 20 bp, mouse
ggacaccaccggacatctcg

SEQ ID NO: 579365 - DNA, 20 bp, mouse
gactggcagacagagcaaag

SEQ ID NO: 579366 - DNA, 20 bp, mouse
gtggggtgaagccctctcag

SEQ ID NO: 579367 - DNA, 20 bp, mouse
gcacagctggcagtggaggt

SEQ ID NO: 579368 - DNA, 20 bp, mouse
ggagctttgtgcagatctaa

SEQ ID NO: 579369 - DNA, 20 bp, mouse
gccctgcccagaaacactgg

SEQ ID NO: 579370 - DNA, 20 bp, mouse
ggctgaggcacccgctgaga

SEQ ID NO: 579371 - DNA, 20 bp, mouse
gtgtgcagatctaagggctg

SEQ ID NO: 579372 - DNA, 20 bp, mouse
gtaccctactgaggaggaca

SEQ ID NO: 579373 - DNA, 20 bp, mouse
gctcctcagtagggtagccc

SEQ ID NO: 579374 - DNA, 20 bp, mouse
ggtcctgggctaccctactg

SEQ ID NO: 579375 - DNA, 20 bp, mouse
ggaagactgagcatgcccaa

SEQ ID NO: 579376 - DNA, 20 bp, mouse
gaaagcaaggtggagctatg

SEQ ID NO: 579377 - DNA, 20 bp, mouse
ggttagttacacaggacgtt

SEQ ID NO: 579378 - DNA, 20 bp, mouse
gaagagttcttaaagcaagg

SEQ ID NO: 579379 - DNA, 20 bp, mouse
gtgacacaggacacttaggt

SEQ ID NO: 579380 - DNA, 20 bp, mouse
gatgttcttcatcctcagga

SEQ ID NO: 579381 - DNA, 20 bp, mouse
gcaacctcaaagaagtgcgg

SEQ ID NO: 579382 - DNA, 20 bp, mouse
gggccacacaatcctgacac

SEQ ID NO: 579383 - DNA, 20 bp, mouse
ggctggcttcctacacagct

SEQ ID NO: 579384 - DNA, 20 bp, mouse
gagtcaacctcaaagaagtg

SEQ ID NO: 579385 - DNA, 20 bp, mouse
ggaacctgtcagttgcaagt

SEQ ID NO: 579386 - DNA, 20 bp, mouse
gtggtctgtataaacgtcac

SEQ ID NO: 579387 - DNA, 20 bp, mouse
ggcatgctgatattgatata

SEQ ID NO: 579388 - DNA, 20 bp, mouse
gtaaggaaaggttcaacttc

SEQ ID NO: 579389 - DNA, 20 bp, mouse
gagcattatatacttattat

SEQ ID NO: 579390 - DNA, 20 bp, mouse
gatttactcttttcttcgta

SEQ ID NO: 579391 - DNA, 20 bp, mouse
gttgtttacgtgaaacaagc

SEQ ID NO: 579392 - DNA, 20 bp, mouse
ggaacctgcttataattaaa

SEQ ID NO: 579393 - DNA, 20 bp, mouse
gtccagtttagtgaaatata

SEQ ID NO: 579394 - DNA, 20 bp, mouse
gtagggaaaagctttagtgt

SEQ ID NO: 579395 - DNA, 20 bp, mouse
gatagcatgtattgttctaa

SEQ ID NO: 579396 - DNA, 20 bp, mouse
ggccaccgaagaccgtccag

SEQ ID NO: 579397 - DNA, 20 bp, mouse
ggcctctggacggtcttcgg

SEQ ID NO: 579398 - DNA, 20 bp, mouse
gctccatgtgagagggccgg

SEQ ID NO: 579399 - DNA, 20 bp, mouse
gcagatgctgacctccccac

SEQ ID NO: 579400 - DNA, 20 bp, mouse
gagccaccggccctctcaca

SEQ ID NO: 579401 - DNA, 20 bp, mouse
gagtggctcacctcacaggt

SEQ ID NO: 579402 - DNA, 20 bp, mouse
ggtgagtcctccatgtgaga

SEQ ID NO: 579403 - DNA, 20 bp, mouse
gtccctggaggacggtgagt

SEQ ID NO: 579404 - DNA, 20 bp, mouse
ggctaatcaaggtcaggctg

SEQ ID NO: 579405 - DNA, 20 bp, mouse
gtcgcagtggctcacctcac

SEQ ID NO: 579406 - DNA, 20 bp, mouse
gctccccggacaccgcccag

SEQ ID NO: 579407 - DNA, 20 bp, mouse
gctgctgcttcactaagagg

SEQ ID NO: 579408 - DNA, 20 bp, mouse
ggcggggctgctcccctggg

SEQ ID NO: 579409 - DNA, 20 bp, mouse
ggcggcggggctgctcccct

SEQ ID NO: 579410 - DNA, 20 bp, mouse
ggcggtgtccggggagctgt

SEQ ID NO: 579411 - DNA, 20 bp, mouse
gggcctggcgggagtgctga

SEQ ID NO: 579412 - DNA, 20 bp, mouse
gctcccctgggcggtgtccg

SEQ ID NO: 579413 - DNA, 20 bp, mouse
ggactcggccaacagctccc

SEQ ID NO: 579414 - DNA, 20 bp, mouse
ggtcgtcacggagacctagg

SEQ ID NO: 579415 - DNA, 20 bp, mouse
ggctgttggccgagtcaccc

SEQ ID NO: 579416 - DNA, 20 bp, mouse
ggtgccgcagaacgccgaca

SEQ ID NO: 579417 - DNA, 20 bp, mouse
ggcggcgggagcagaaacgg

SEQ ID NO: 579418 - DNA, 20 bp, mouse
ggccggagcacgagctgcag

SEQ ID NO: 579419 - DNA, 20 bp, mouse
ggcgggagcagaaacggcgg

SEQ ID NO: 579420 - DNA, 20 bp, mouse
gaaggttcccgcaggcctca

SEQ ID NO: 579421 - DNA, 20 bp, mouse
ggttccctgtcggcgttctg

SEQ ID NO: 579422 - DNA, 20 bp, mouse
gttgcgctgcggggaggaag

SEQ ID NO: 579423 - DNA, 20 bp, mouse
gctcgagcagagggagccgg

SEQ ID NO: 579424 - DNA, 20 bp, mouse
ggcacgggccggtgggacgt

SEQ ID NO: 579425 - DNA, 20 bp, mouse
gccgaggcgggcttagaagg

SEQ ID NO: 579426 - DNA, 20 bp, mouse
ggcgcgagcgcgggagttag

SEQ ID NO: 579427 - DNA, 20 bp, mouse
gtcgctcaggtgtcccacca

SEQ ID NO: 579428 - DNA, 20 bp, mouse
gttagcggtgcagccatggt

SEQ ID NO: 579429 - DNA, 20 bp, mouse
gcccggcagagaagctcagg

SEQ ID NO: 579430 - DNA, 20 bp, mouse
ggaccccggcagagaagctc

SEQ ID NO: 579431 - DNA, 20 bp, mouse
gggccgccgaagatagacag

SEQ ID NO: 579432 - DNA, 20 bp, mouse
ggtgggacacctgagcgagg

SEQ ID NO: 579433 - DNA, 20 bp, mouse
ggggtctctaagaccatcag

SEQ ID NO: 579434 - DNA, 20 bp, mouse
gctcgatggccccctcgctc

SEQ ID NO: 579435 - DNA, 20 bp, mouse
ggggccatcgagcccgctca

SEQ ID NO: 579436 - DNA, 20 bp, mouse
ggaaggctgccacgccagag

SEQ ID NO: 579437 - DNA, 20 bp, mouse
gacgaaaactaagaacactt

SEQ ID NO: 579438 - DNA, 20 bp, mouse
gggcgacccgaagccaccgg

SEQ ID NO: 579439 - DNA, 20 bp, mouse
ggagagcggcccaagacgct

SEQ ID NO: 579440 - DNA, 20 bp, mouse
ggagaactgcgaccaggatg

SEQ ID NO: 579441 - DNA, 20 bp, mouse
gactctgtgccgctctggcg

SEQ ID NO: 579442 - DNA, 20 bp, mouse
gtcgcaggcggagaagaaat

SEQ ID NO: 579443 - DNA, 20 bp, mouse
gtggcgcaggaaggccggga

SEQ ID NO: 579444 - DNA, 20 bp, mouse
gcgcagttctccggagagag

SEQ ID NO: 579445 - DNA, 20 bp, mouse
gtctccgcctgcgacggtgt

SEQ ID NO: 579446 - DNA, 20 bp, mouse
gtgcgggttgcgagtgttgg

SEQ ID NO: 579447 - DNA, 20 bp, mouse
ggagacggctgcaaaagaca

SEQ ID NO: 579448 - DNA, 20 bp, mouse
ggcttccccacgaagcacac

SEQ ID NO: 579449 - DNA, 20 bp, mouse
gggagggcaatgctgcttaa

SEQ ID NO: 579450 - DNA, 20 bp, mouse
gcgggcggccgcgccaaccc

SEQ ID NO: 579451 - DNA, 20 bp, mouse
gccactcgggaaggactgcg

SEQ ID NO: 579452 - DNA, 20 bp, mouse
gggaccacggccactcggga

SEQ ID NO: 579453 - DNA, 20 bp, mouse
gtcaaggcttccggaagtac

SEQ ID NO: 579454 - DNA, 20 bp, mouse
gctaggcccataaatagaga

SEQ ID NO: 579455 - DNA, 20 bp, mouse
gcgggttcgggcgagaggac

SEQ ID NO: 579456 - DNA, 20 bp, mouse
gttcccgctaagggaggaga

SEQ ID NO: 579457 - DNA, 20 bp, mouse
gaagcggtgcggagaccccg

SEQ ID NO: 579458 - DNA, 20 bp, mouse
gggagatggcagagtcctcg

SEQ ID NO: 579459 - DNA, 20 bp, mouse
ggcttgtacaacaagcggtg

SEQ ID NO: 579460 - DNA, 20 bp, mouse
gcacctgcttgtacaacaag

SEQ ID NO: 579461 - DNA, 20 bp, mouse
gctacgccggccaacagccc

SEQ ID NO: 579462 - DNA, 20 bp, mouse
ggcaggtgggctcgccccac

SEQ ID NO: 579463 - DNA, 20 bp, mouse
gcgccggccaacagcccggg

SEQ ID NO: 579464 - DNA, 20 bp, mouse
ggaggtccttgggaagatta

SEQ ID NO: 579465 - DNA, 20 bp, mouse
gctcgctggccaggcacacc

SEQ ID NO: 579466 - DNA, 20 bp, mouse
ggtccgcacggccaagatgg

SEQ ID NO: 579467 - DNA, 20 bp, mouse
gaggcgggtttggttggagt

SEQ ID NO: 579468 - DNA, 20 bp, mouse
ggcgcccaggcgggtttggt

SEQ ID NO: 579469 - DNA, 20 bp, mouse
gggaagccgaactctagagg

SEQ ID NO: 579470 - DNA, 20 bp, mouse
gccagtccgcacggccaaga

SEQ ID NO: 579471 - DNA, 20 bp, mouse
gcacctgagtaacttgatcg

SEQ ID NO: 579472 - DNA, 20 bp, mouse
gagccgaactctagaggcgg

SEQ ID NO: 579473 - DNA, 20 bp, mouse
gggcggcgcccaggcgggtt

SEQ ID NO: 579474 - DNA, 20 bp, mouse
ggaccccgatcaagttactc

SEQ ID NO: 579475 - DNA, 20 bp, mouse
ggagcctgaggtgcaatctc

SEQ ID NO: 579476 - DNA, 20 bp, mouse
ggggcctagagagcaaggta

SEQ ID NO: 579477 - DNA, 20 bp, mouse
gttccgggcgaagcgtgagg

SEQ ID NO: 579478 - DNA, 20 bp, mouse
gggaaatgcggtcagaagag

SEQ ID NO: 579479 - DNA, 20 bp, mouse
gggtacggcagagtcagcca

SEQ ID NO: 579480 - DNA, 20 bp, mouse
gggagagcgagaactccggg

SEQ ID NO: 579481 - DNA, 20 bp, mouse
gcggttccgggcgaagcgtg

SEQ ID NO: 579482 - DNA, 20 bp, mouse
gcgtaccggtagcatctcgg

SEQ ID NO: 579483 - DNA, 20 bp, mouse
gggtctcagggtcccagcct

SEQ ID NO: 579484 - DNA, 20 bp, mouse
gacgcgcgggcctctttctg

SEQ ID NO: 579485 - DNA, 20 bp, mouse
gttctgaccgcatttcccca

SEQ ID NO: 579486 - DNA, 20 bp, mouse
gcggcggccaccaacctcac

SEQ ID NO: 579487 - DNA, 20 bp, mouse
gccggctccagggagacgca

SEQ ID NO: 579488 - DNA, 20 bp, mouse
gggaaggcgcagacctccgg

SEQ ID NO: 579489 - DNA, 20 bp, mouse
ggtgggaaggcgcagacctc

SEQ ID NO: 579490 - DNA, 20 bp, mouse
gaccaacctcaccggctcca

SEQ ID NO: 579491 - DNA, 20 bp, mouse
gtccctggagccggtgaggt

SEQ ID NO: 579492 - DNA, 20 bp, mouse
gagacctccggcggtggtgt

SEQ ID NO: 579493 - DNA, 20 bp, mouse
ggccgccgtggcgggtgagt

SEQ ID NO: 579494 - DNA, 20 bp, mouse
ggcctactcacccgccacgg

SEQ ID NO: 579495 - DNA, 20 bp, mouse
gaaagcctactcacccgcca

SEQ ID NO: 579496 - DNA, 20 bp, mouse
ggtcgctgttgaggatggac

SEQ ID NO: 579497 - DNA, 20 bp, mouse
ggaaccggcaccatggcgtc

SEQ ID NO: 579498 - DNA, 20 bp, mouse
gctctagggaaccggcacca

SEQ ID NO: 579499 - DNA, 20 bp, mouse
ggccaggtcgctgttgagga

SEQ ID NO: 579500 - DNA, 20 bp, mouse
gagcgacctggccaacctgg

SEQ ID NO: 579501 - DNA, 20 bp, mouse
gaggcactcggcccccaggt

SEQ ID NO: 579502 - DNA, 20 bp, mouse
gcgtgggctcactcgctcta

SEQ ID NO: 579503 - DNA, 20 bp, mouse
gtggcgtcgggctgcaagat

SEQ ID NO: 579504 - DNA, 20 bp, mouse
ggcagcccgtcgtcgcacag

SEQ ID NO: 579505 - DNA, 20 bp, mouse
gggctggcccgggctctcgt

SEQ ID NO: 579506 - DNA, 20 bp, mouse
gtggtaccagctgtaggatg

SEQ ID NO: 579507 - DNA, 20 bp, mouse
gctctctcagagatacttac

SEQ ID NO: 579508 - DNA, 20 bp, mouse
gaactctctctaatcttcac

SEQ ID NO: 579509 - DNA, 20 bp, mouse
ggatttgcaatgggcctgga

SEQ ID NO: 579510 - DNA, 20 bp, mouse
gatttctcaacaatacagta

SEQ ID NO: 579511 - DNA, 20 bp, mouse
gggaagaagtatctccagct

SEQ ID NO: 579512 - DNA, 20 bp, mouse
gttctatcatgactttgtga

SEQ ID NO: 579513 - DNA, 20 bp, mouse
gtttgtttaagacagctctt

SEQ ID NO: 579514 - DNA, 20 bp, mouse
ggacagctcttgggcctagc

SEQ ID NO: 579515 - DNA, 20 bp, mouse
gaggaagcaagttcttagcc

SEQ ID NO: 579516 - DNA, 20 bp, mouse
gaggccggcgagaaaagtgt

SEQ ID NO: 579517 - DNA, 20 bp, mouse
ggcctcttgaggctcttcag

SEQ ID NO: 579518 - DNA, 20 bp, mouse
gcggcaagcgaggcttgaag

SEQ ID NO: 579519 - DNA, 20 bp, mouse
gcgtacagccgtaaacaaca

SEQ ID NO: 579520 - DNA, 20 bp, mouse
ggcgagaaaagtgttggtgg

SEQ ID NO: 579521 - DNA, 20 bp, mouse
gccggcgagaaaagtgttgg

SEQ ID NO: 579522 - DNA, 20 bp, mouse
ggccgctgaagagcctcaag

SEQ ID NO: 579523 - DNA, 20 bp, mouse
gggagattaagaacaagcag

SEQ ID NO: 579524 - DNA, 20 bp, mouse
gtaaacaacatggcgaaggc

SEQ ID NO: 579525 - DNA, 20 bp, mouse
ggccgtaaacaacatggcga

SEQ ID NO: 579526 - DNA, 20 bp, mouse
ggcggcttcccggaagtaat

SEQ ID NO: 579527 - DNA, 20 bp, mouse
ggccgctggggaagccgtgg

SEQ ID NO: 579528 - DNA, 20 bp, mouse
gccgcgagcgccggaagaga

SEQ ID NO: 579529 - DNA, 20 bp, mouse
gggtacacgtgcattcgcta

SEQ ID NO: 579530 - DNA, 20 bp, mouse
gaagccgtggtggcagaccg

SEQ ID NO: 579531 - DNA, 20 bp, mouse
gccccagcggcgattcggga

SEQ ID NO: 579532 - DNA, 20 bp, mouse
gcgcccgcggtctgccacca

SEQ ID NO: 579533 - DNA, 20 bp, mouse
ggacagcgggaagaccgcgt

SEQ ID NO: 579534 - DNA, 20 bp, mouse
gatcgccgctggggaagccg

SEQ ID NO: 579535 - DNA, 20 bp, mouse
gcggtggactggagcgaggg

SEQ ID NO: 579536 - DNA, 20 bp, mouse
gacttccgggagcacagtag

SEQ ID NO: 579537 - DNA, 20 bp, mouse
gcagacgctaggggcaacgg

SEQ ID NO: 579538 - DNA, 20 bp, mouse
gtcgcgatgggggtcccagg

SEQ ID NO: 579539 - DNA, 20 bp, mouse
gtgcttcggaaagatagcag

SEQ ID NO: 579540 - DNA, 20 bp, mouse
gctccgagccggccccgtag

SEQ ID NO: 579541 - DNA, 20 bp, mouse
ggtagtggtctatgccaaga

SEQ ID NO: 579542 - DNA, 20 bp, mouse
gacccccatcgcgaccctct

SEQ ID NO: 579543 - DNA, 20 bp, mouse
gaaggtgctgccctaccccc

SEQ ID NO: 579544 - DNA, 20 bp, mouse
ggccaagagggtcgcgatgg

SEQ ID NO: 579545 - DNA, 20 bp, mouse
gaatctaaggcggttgactg

SEQ ID NO: 579546 - DNA, 20 bp, mouse
ggagacagcagggaatccag

SEQ ID NO: 579547 - DNA, 20 bp, mouse
ggaactctctggaaggagcc

SEQ ID NO: 579548 - DNA, 20 bp, mouse
gagatataaacttacagtcc

SEQ ID NO: 579549 - DNA, 20 bp, mouse
gtcagtaagggtggaggtcc

SEQ ID NO: 579550 - DNA, 20 bp, mouse
ggtggaggtccgggagatgg

SEQ ID NO: 579551 - DNA, 20 bp, mouse
gcagaagagcctgggtaggt

SEQ ID NO: 579552 - DNA, 20 bp, mouse
gatgggtatagaagagacaa

SEQ ID NO: 579553 - DNA, 20 bp, mouse
gaagagacaaaggtgtaggg

SEQ ID NO: 579554 - DNA, 20 bp, mouse
ggacttggtggacacctccc

SEQ ID NO: 579555 - DNA, 20 bp, mouse
gctcccaggctggtaatacg

SEQ ID NO: 579556 - DNA, 20 bp, mouse
gtagctgagggcgaacgcgg

SEQ ID NO: 579557 - DNA, 20 bp, mouse
gagctagctgagggcgaacg

SEQ ID NO: 579558 - DNA, 20 bp, mouse
gccctgggcgctatagcaac

SEQ ID NO: 579559 - DNA, 20 bp, mouse
gagcaaccggtagctagctg

SEQ ID NO: 579560 - DNA, 20 bp, mouse
gaggtgagtactctgtgagg

SEQ ID NO: 579561 - DNA, 20 bp, mouse
gttcgccctcagctagctac

SEQ ID NO: 579562 - DNA, 20 bp, mouse
gtgcaggcccagaggagcac

SEQ ID NO: 579563 - DNA, 20 bp, mouse
gctggctgggcgggcggtca

SEQ ID NO: 579564 - DNA, 20 bp, mouse
gccgtcggcgggtcgcgtag

SEQ ID NO: 579565 - DNA, 20 bp, mouse
ggccgacggcccgcacccta

SEQ ID NO: 579566 - DNA, 20 bp, mouse
gaggggcagccgcttcccgg

SEQ ID NO: 579567 - DNA, 20 bp, mouse
gtgcctacgctgcccagaga

SEQ ID NO: 579568 - DNA, 20 bp, mouse
gaacgcggcacaatgcatcg

SEQ ID NO: 579569 - DNA, 20 bp, mouse
gcggcacaatgcatcgcggt

SEQ ID NO: 579570 - DNA, 20 bp, mouse
ggaaccctgtgtgatccaga

SEQ ID NO: 579571 - DNA, 20 bp, mouse
ggcgttgcctgcgggaggag

SEQ ID NO: 579572 - DNA, 20 bp, mouse
gccctgtgtgatccagaggg

SEQ ID NO: 579573 - DNA, 20 bp, mouse
gcacaatgcatcgcggtggg

SEQ ID NO: 579574 - DNA, 20 bp, mouse
gccctccctctggatcacac

SEQ ID NO: 579575 - DNA, 20 bp, mouse
gacagcaggatcgggcacca

SEQ ID NO: 579576 - DNA, 20 bp, mouse
gagcttgggcggaagaagga

SEQ ID NO: 579577 - DNA, 20 bp, mouse
gggatggagaagtgcctggt

SEQ ID NO: 579578 - DNA, 20 bp, mouse
gagaaggatggagaagtgcc

SEQ ID NO: 579579 - DNA, 20 bp, mouse
gcaataagcagtacccaggt

SEQ ID NO: 579580 - DNA, 20 bp, mouse
gcctggcaggtaaggagagg

SEQ ID NO: 579581 - DNA, 20 bp, mouse
gcttcttccgcccaagctcc

SEQ ID NO: 579582 - DNA, 20 bp, mouse
gcagctgagggttgccttgg

SEQ ID NO: 579583 - DNA, 20 bp, mouse
gggtcagctgagggttgcct

SEQ ID NO: 579584 - DNA, 20 bp, mouse
gggcctccacctggcaggta

SEQ ID NO: 579585 - DNA, 20 bp, mouse
gtggaggccagcagcttgtt

SEQ ID NO: 579586 - DNA, 20 bp, mouse
gcagctgagagagggttcca

SEQ ID NO: 579587 - DNA, 20 bp, mouse
gagaatcagaagcacctacc

SEQ ID NO: 579588 - DNA, 20 bp, mouse
gagctgggcccattgcttcc

SEQ ID NO: 579589 - DNA, 20 bp, mouse
gcaatgggcccagctgagag

SEQ ID NO: 579590 - DNA, 20 bp, mouse
gtacaagggaggccctcctt

SEQ ID NO: 579591 - DNA, 20 bp, mouse
ggggagccccagccaaagga

SEQ ID NO: 579592 - DNA, 20 bp, mouse
ggcacacaaagatagcttca

SEQ ID NO: 579593 - DNA, 20 bp, mouse
gccacgggcgtgtaaaggat

SEQ ID NO: 579594 - DNA, 20 bp, mouse
gtagaatacagcgtctgagg

SEQ ID NO: 579595 - DNA, 20 bp, mouse
gaatacagcgtctgaggcgg

SEQ ID NO: 579596 - DNA, 20 bp, mouse
gagacccgcggcgacaaggg

SEQ ID NO: 579597 - DNA, 20 bp, mouse
gcggagacccgcggcgacaa

SEQ ID NO: 579598 - DNA, 20 bp, mouse
gaagctggcgagccacacgg

SEQ ID NO: 579599 - DNA, 20 bp, mouse
gacgatgtccaaggccgagg

SEQ ID NO: 579600 - DNA, 20 bp, mouse
ggtgcacattcggagacccg

SEQ ID NO: 579601 - DNA, 20 bp, mouse
gtcggccttggacatcgtgg

SEQ ID NO: 579602 - DNA, 20 bp, mouse
ggccccctccacgatgtcca

SEQ ID NO: 579603 - DNA, 20 bp, mouse
ggccttggacatcgtggagg

SEQ ID NO: 579604 - DNA, 20 bp, mouse
ggacaagggaggctcgagcg

SEQ ID NO: 579605 - DNA, 20 bp, mouse
gtggagaaccacgtgaaggt

SEQ ID NO: 579606 - DNA, 20 bp, mouse
gcggtgagtgagttcggtca

SEQ ID NO: 579607 - DNA, 20 bp, mouse
gctggcgcggtgagtgagtt

SEQ ID NO: 579608 - DNA, 20 bp, mouse
gataaggcgtgagcaggcgt

SEQ ID NO: 579609 - DNA, 20 bp, mouse
gcggtcacggttttttacga

SEQ ID NO: 579610 - DNA, 20 bp, mouse
ggcctgctcacgccttatat

SEQ ID NO: 579611 - DNA, 20 bp, mouse
gcacagtaggaagattgcat

SEQ ID NO: 579612 - DNA, 20 bp, mouse
ggtgaccaagaaggcctggt

SEQ ID NO: 579613 - DNA, 20 bp, mouse
gtggtctcgtaatttttctt

SEQ ID NO: 579614 - DNA, 20 bp, mouse
gcaaggccggaaataaaaga

SEQ ID NO: 579615 - DNA, 20 bp, mouse
gcactcaccaccgggcgggg

SEQ ID NO: 579616 - DNA, 20 bp, mouse
gcgtgtgggtgcacggatgg

SEQ ID NO: 579617 - DNA, 20 bp, mouse
ggccgcggaaaccggaaaga

SEQ ID NO: 579618 - DNA, 20 bp, mouse
ggccttctttccggtttccg

SEQ ID NO: 579619 - DNA, 20 bp, mouse
gacgataacaacttacctca

SEQ ID NO: 579620 - DNA, 20 bp, mouse
ggtgggtgcacggatggcgg

SEQ ID NO: 579621 - DNA, 20 bp, mouse
gggggcgtccgcgggcgtgt

SEQ ID NO: 579622 - DNA, 20 bp, mouse
gccgcgggcgtgtgggtgca

SEQ ID NO: 579623 - DNA, 20 bp, mouse
gggagaagcgaaggcgttcg

SEQ ID NO: 579624 - DNA, 20 bp, mouse
gtagagcggtgccaacctga

SEQ ID NO: 579625 - DNA, 20 bp, mouse
ggccccgcggcccgtctcgg

SEQ ID NO: 579626 - DNA, 20 bp, mouse
gtcccgcaccgcctccaaaa

SEQ ID NO: 579627 - DNA, 20 bp, mouse
gtcacgcgatgcccttttgg

SEQ ID NO: 579628 - DNA, 20 bp, mouse
gaaacttgtggcgcttgcac

SEQ ID NO: 579629 - DNA, 20 bp, mouse
gcgcgatgcccttttggagg

SEQ ID NO: 579630 - DNA, 20 bp, mouse
ggtctcacgcgatgcccttt

SEQ ID NO: 579631 - DNA, 20 bp, mouse
gcgactgcgaagttggggtg

SEQ ID NO: 579632 - DNA, 20 bp, mouse
gtgcccttttggaggcggtg

SEQ ID NO: 579633 - DNA, 20 bp, mouse
ggccgtggaaatcccctaca

SEQ ID NO: 579634 - DNA, 20 bp, mouse
ggtccccgactgcgaagttg

SEQ ID NO: 579635 - DNA, 20 bp, mouse
gggtgtggagttaatcgtaa

SEQ ID NO: 579636 - DNA, 20 bp, mouse
gcgagccggacgacgaccca

SEQ ID NO: 579637 - DNA, 20 bp, mouse
gggctggcggtgggcacgca

SEQ ID NO: 579638 - DNA, 20 bp, mouse
gaccgccagccgcaaaatgg

SEQ ID NO: 579639 - DNA, 20 bp, mouse
ggattcccgcaaggcttgat

SEQ ID NO: 579640 - DNA, 20 bp, mouse
gttgatgggtaacagaaatt

SEQ ID NO: 579641 - DNA, 20 bp, mouse
gaaatttggcctccattttg

SEQ ID NO: 579642 - DNA, 20 bp, mouse
gggggacgcctcggcagaaa

SEQ ID NO: 579643 - DNA, 20 bp, mouse
gcttcgcatcggggacgcct

SEQ ID NO: 579644 - DNA, 20 bp, mouse
ggcctccattttgcggctgg

SEQ ID NO: 579645 - DNA, 20 bp, mouse
gttggcctccattttgcggc

SEQ ID NO: 579646 - DNA, 20 bp, mouse
ggcggtgagtaggcgagagt

SEQ ID NO: 579647 - DNA, 20 bp, mouse
gctccaccatggcggtgagt

SEQ ID NO: 579648 - DNA, 20 bp, mouse
gcagtcggcggagcccaggg

SEQ ID NO: 579649 - DNA, 20 bp, mouse
gtctcgcctactcaccgcca

SEQ ID NO: 579650 - DNA, 20 bp, mouse
gcgcgacgtgcggaggtcca

SEQ ID NO: 579651 - DNA, 20 bp, mouse
gcgccgactgcggatggaga

SEQ ID NO: 579652 - DNA, 20 bp, mouse
gtagcacgggtcctgcgagt

SEQ ID NO: 579653 - DNA, 20 bp, mouse
gcgcctactcaccgccatgg

SEQ ID NO: 579654 - DNA, 20 bp, mouse
gccgcagtcggcggagccca

SEQ ID NO: 579655 - DNA, 20 bp, mouse
gctcaggtctgcagccccga

SEQ ID NO: 579656 - DNA, 20 bp, mouse
gcgcccacgccggatatagg

SEQ ID NO: 579657 - DNA, 20 bp, mouse
ggagccgaaagccgaaaaga

SEQ ID NO: 579658 - DNA, 20 bp, mouse
gctccgcccacgccggatat

SEQ ID NO: 579659 - DNA, 20 bp, mouse
gaggccccgggacagcaccc

SEQ ID NO: 579660 - DNA, 20 bp, mouse
gttccgcctatatccggcgt

SEQ ID NO: 579661 - DNA, 20 bp, mouse
ggctgccacgtgtgtaagag

SEQ ID NO: 579662 - DNA, 20 bp, mouse
gggcctggcgggtctccctt

SEQ ID NO: 579663 - DNA, 20 bp, mouse
gcgggacatctgaagcccga

SEQ ID NO: 579664 - DNA, 20 bp, mouse
gggcccaagggagacccgcc

SEQ ID NO: 579665 - DNA, 20 bp, mouse
ggacgacttaccagacccag

SEQ ID NO: 579666 - DNA, 20 bp, mouse
gaccacgatgggaccggcgg

SEQ ID NO: 579667 - DNA, 20 bp, mouse
gtggaccacgatgggaccgg

SEQ ID NO: 579668 - DNA, 20 bp, mouse
gtaaggccgcgagggagagg

SEQ ID NO: 579669 - DNA, 20 bp, mouse
gagagactcacctcctatac

SEQ ID NO: 579670 - DNA, 20 bp, mouse
ggagcccgatggaccacgat

SEQ ID NO: 579671 - DNA, 20 bp, mouse
gcagcacggagccagggcag

SEQ ID NO: 579672 - DNA, 20 bp, mouse
gcgccgacagcacggagcca

SEQ ID NO: 579673 - DNA, 20 bp, mouse
gagaggagggcggcgagtca

SEQ ID NO: 579674 - DNA, 20 bp, mouse
gcggactccctacaagccca

SEQ ID NO: 579675 - DNA, 20 bp, mouse
ggccgatgacagcggatgga

SEQ ID NO: 579676 - DNA, 20 bp, mouse
gtcggggattcctttccgct

SEQ ID NO: 579677 - DNA, 20 bp, mouse
gcctgatggggctggtcgcg

SEQ ID NO: 579678 - DNA, 20 bp, mouse
gagtatcattaataatgtcg

SEQ ID NO: 579679 - DNA, 20 bp, mouse
gagccttctgctcagaagaa

SEQ ID NO: 579680 - DNA, 20 bp, mouse
ggctggcatccacaaaaaaa

SEQ ID NO: 579681 - DNA, 20 bp, mouse
gaaaaaatggttcgcaccat

SEQ ID NO: 579682 - DNA, 20 bp, mouse
gcgcaagatccgcaggcaca

SEQ ID NO: 579683 - DNA, 20 bp, mouse
gggggctggtcgcggggcga

SEQ ID NO: 579684 - DNA, 20 bp, mouse
gctgaagaacttaagctgac

SEQ ID NO: 579685 - DNA, 20 bp, mouse
gggagaacggccgagcggaa

SEQ ID NO: 579686 - DNA, 20 bp, mouse
gggcagccgcctgggaaagg

SEQ ID NO: 579687 - DNA, 20 bp, mouse
gttcggcagccgcctgggaa

SEQ ID NO: 579688 - DNA, 20 bp, mouse
ggccgcggctgcctaggtat

SEQ ID NO: 579689 - DNA, 20 bp, mouse
gtgcgcgcgccgggcggtgt

SEQ ID NO: 579690 - DNA, 20 bp, mouse
gcacaagcggcggggagcag

SEQ ID NO: 579691 - DNA, 20 bp, mouse
gtctggggaagacgggagtg

SEQ ID NO: 579692 - DNA, 20 bp, mouse
gcgccgggcggtgtggggtc

SEQ ID NO: 579693 - DNA, 20 bp, mouse
gccaggcgggagcgcagtga

SEQ ID NO: 579694 - DNA, 20 bp, mouse
gtaacgggcgtaacaagccg

SEQ ID NO: 579695 - DNA, 20 bp, mouse
gacgcgaggggactgtgtaa

SEQ ID NO: 579696 - DNA, 20 bp, mouse
ggcctggtgcgtggggtgaa

SEQ ID NO: 579697 - DNA, 20 bp, mouse
gaccttgggaccgcccctcg

SEQ ID NO: 579698 - DNA, 20 bp, mouse
gcaccaggcttgccccagct

SEQ ID NO: 579699 - DNA, 20 bp, mouse
gggaaacgcacccacatcaa

SEQ ID NO: 579700 - DNA, 20 bp, mouse
gtcccaaggtccccactccc

SEQ ID NO: 579701 - DNA, 20 bp, mouse
gggctttccaagtccccgag

SEQ ID NO: 579702 - DNA, 20 bp, mouse
ggccattcaccccacgcacc

SEQ ID NO: 579703 - DNA, 20 bp, mouse
gggggcaagcctggtgcgtg

SEQ ID NO: 579704 - DNA, 20 bp, mouse
ggccctgccgcccttgatgt

SEQ ID NO: 579705 - DNA, 20 bp, mouse
gaacgcacccacatcaaggg

SEQ ID NO: 579706 - DNA, 20 bp, mouse
gccttccggcccagaagtac

SEQ ID NO: 579707 - DNA, 20 bp, mouse
ggaggggcaggttcttgtat

SEQ ID NO: 579708 - DNA, 20 bp, mouse
ggcctttctccagaagcgga

SEQ ID NO: 579709 - DNA, 20 bp, mouse
ggatcccatccaaaacctcg

SEQ ID NO: 579710 - DNA, 20 bp, mouse
gacgcctcgaggttttggat

SEQ ID NO: 579711 - DNA, 20 bp, mouse
ggctttttcttgtcatagag

SEQ ID NO: 579712 - DNA, 20 bp, mouse
gctggaacgcctcgaggttt

SEQ ID NO: 579713 - DNA, 20 bp, mouse
ggttgctttatggttttcca

SEQ ID NO: 579714 - DNA, 20 bp, mouse
ggctttatggttttccaagg

SEQ ID NO: 579715 - DNA, 20 bp, mouse
ggcagacgacgaccaccttc

SEQ ID NO: 579716 - DNA, 20 bp, mouse
gcccgcccggggcagaagac

SEQ ID NO: 579717 - DNA, 20 bp, mouse
gcggccgcactcggagctct

SEQ ID NO: 579718 - DNA, 20 bp, mouse
ggtgccgagagctccgagtg

SEQ ID NO: 579719 - DNA, 20 bp, mouse
gcagaagacgggcgtcgcga

SEQ ID NO: 579720 - DNA, 20 bp, mouse
ggcgtcgcgacggccgcact

SEQ ID NO: 579721 - DNA, 20 bp, mouse
gtgggcacgctggacgtcgg

SEQ ID NO: 579722 - DNA, 20 bp, mouse
ggcgtgcgcagtggcgggag

SEQ ID NO: 579723 - DNA, 20 bp, mouse
ggcagagccactccacgccg

SEQ ID NO: 579724 - DNA, 20 bp, mouse
gcgcgtggaccgcactaccg

SEQ ID NO: 579725 - DNA, 20 bp, mouse
gccctgccgtgcgcatgtgt

SEQ ID NO: 579726 - DNA, 20 bp, mouse
gtggcggcagccatcaggta

SEQ ID NO: 579727 - DNA, 20 bp, mouse
gcggcagccatcaggtaggg

SEQ ID NO: 579728 - DNA, 20 bp, mouse
gacccgggcggcctgatgag

SEQ ID NO: 579729 - DNA, 20 bp, mouse
ggccatcaggtagggcggcg

SEQ ID NO: 579730 - DNA, 20 bp, mouse
gggaggcttgagagacgcaa

SEQ ID NO: 579731 - DNA, 20 bp, mouse
gggcttgagagacgcaatgg

SEQ ID NO: 579732 - DNA, 20 bp, mouse
ggtctctcaagcctcccgga

SEQ ID NO: 579733 - DNA, 20 bp, mouse
gcgtccaccgggaatgagaa

SEQ ID NO: 579734 - DNA, 20 bp, mouse
gggagcactgctgagagctt

SEQ ID NO: 579735 - DNA, 20 bp, mouse
gtcccggaggccgccagaac

SEQ ID NO: 579736 - DNA, 20 bp, mouse
gggagccacgacaacaacga

SEQ ID NO: 579737 - DNA, 20 bp, mouse
ggccacgacaacaacgatgg

SEQ ID NO: 579738 - DNA, 20 bp, mouse
gccagaggtgagtgctaact

SEQ ID NO: 579739 - DNA, 20 bp, mouse
gaactcggcgccgggctctc

SEQ ID NO: 579740 - DNA, 20 bp, mouse
gaggattcgccccgagagcc

SEQ ID NO: 579741 - DNA, 20 bp, mouse
gacgccccggggctccaagt

SEQ ID NO: 579742 - DNA, 20 bp, mouse
gacgacaacaacgatggcgg

SEQ ID NO: 579743 - DNA, 20 bp, mouse
gcgcagagcacggccacccg

SEQ ID NO: 579744 - DNA, 20 bp, mouse
gccccggggctccaagtcgg

SEQ ID NO: 579745 - DNA, 20 bp, mouse
gtgagatcggcgcccggtgg

SEQ ID NO: 579746 - DNA, 20 bp, mouse
ggcagcggatgggccactcg

SEQ ID NO: 579747 - DNA, 20 bp, mouse
gtcggccaggtccggaaaga

SEQ ID NO: 579748 - DNA, 20 bp, mouse
ggacggaaccgcgccggagt

SEQ ID NO: 579749 - DNA, 20 bp, mouse
gtcatggtaagctcgctgag

SEQ ID NO: 579750 - DNA, 20 bp, mouse
ggaagacgacgagcctcggg

SEQ ID NO: 579751 - DNA, 20 bp, mouse
ggctgaggatggcagcggat

SEQ ID NO: 579752 - DNA, 20 bp, mouse
ggcggtgccaaggggaactg

SEQ ID NO: 579753 - DNA, 20 bp, mouse
gctacgagcgggacttgctg

SEQ ID NO: 579754 - DNA, 20 bp, mouse
gggaactgcgggacaggcta

SEQ ID NO: 579755 - DNA, 20 bp, mouse
gaggccggactggactcact

SEQ ID NO: 579756 - DNA, 20 bp, mouse
ggaaggcctcgggcacggta

SEQ ID NO: 579757 - DNA, 20 bp, mouse
gggcctcgggcacggtaagg

SEQ ID NO: 579758 - DNA, 20 bp, mouse
gggacttccgtcagagacca

SEQ ID NO: 579759 - DNA, 20 bp, mouse
ggggcacggtaaggaggccg

SEQ ID NO: 579760 - DNA, 20 bp, mouse
gcgcggcggggcaaaaggtg

SEQ ID NO: 579761 - DNA, 20 bp, mouse
gcgtcgcgagggtccctcag

SEQ ID NO: 579762 - DNA, 20 bp, mouse
gtggaagcaccgcatcagga

SEQ ID NO: 579763 - DNA, 20 bp, mouse
ggacggagcgggttagatcg

SEQ ID NO: 579764 - DNA, 20 bp, mouse
gttggccgcaaggaggctgt

SEQ ID NO: 579765 - DNA, 20 bp, mouse
gcgtgctgggcggccgagga

SEQ ID NO: 579766 - DNA, 20 bp, mouse
gcggccaagaaccgagagcc

SEQ ID NO: 579767 - DNA, 20 bp, mouse
gtcggccccgtcgacctcat

SEQ ID NO: 579768 - DNA, 20 bp, mouse
gccccttcgcagataatggg

SEQ ID NO: 579769 - DNA, 20 bp, mouse
gcctagggagggtggaacgc

SEQ ID NO: 579770 - DNA, 20 bp, mouse
ggcgcccgcgggagatcttc

SEQ ID NO: 579771 - DNA, 20 bp, mouse
ggcggcgacagggccctgag

SEQ ID NO: 579772 - DNA, 20 bp, mouse
gaggcccgaagatctcccgc

SEQ ID NO: 579773 - DNA, 20 bp, mouse
ggcacggcctgggcctaggg

SEQ ID NO: 579774 - DNA, 20 bp, mouse
gtctccccttcgcagataat

SEQ ID NO: 579775 - DNA, 20 bp, mouse
gcggagagcgcgcacggcct

SEQ ID NO: 579776 - DNA, 20 bp, mouse
gagccacgcgcgtaccaacc

SEQ ID NO: 579777 - DNA, 20 bp, mouse
ggcgccacacgcagcgtgtg

SEQ ID NO: 579778 - DNA, 20 bp, mouse
gaggctgcttaagactacaa

SEQ ID NO: 579779 - DNA, 20 bp, mouse
gccctgggcggtgtatgcta

SEQ ID NO: 579780 - DNA, 20 bp, mouse
gccctaacacgcagtctctg

SEQ ID NO: 579781 - DNA, 20 bp, mouse
ggcggcggccgaaaggagga

SEQ ID NO: 579782 - DNA, 20 bp, mouse
ggccgccgcagccatcttcc

SEQ ID NO: 579783 - DNA, 20 bp, mouse
gcagggcagtgacctccaga

SEQ ID NO: 579784 - DNA, 20 bp, mouse
gtggaggtcactgccctggg

SEQ ID NO: 579785 - DNA, 20 bp, mouse
gctagggagcttctatccgg

SEQ ID NO: 579786 - DNA, 20 bp, mouse
gctaaccacaggcgccatgg

SEQ ID NO: 579787 - DNA, 20 bp, mouse
ggcggagccatactaaccac

SEQ ID NO: 579788 - DNA, 20 bp, mouse
gatggcgcctgtggttagta

SEQ ID NO: 579789 - DNA, 20 bp, mouse
gcgtgccgctcacggaaccg

SEQ ID NO: 579790 - DNA, 20 bp, mouse
gcaggcccacgtgccgctca

SEQ ID NO: 579791 - DNA, 20 bp, mouse
gacggaaccgcggccgcacg

SEQ ID NO: 579792 - DNA, 20 bp, mouse
ggctgggtccagcacgttgt

SEQ ID NO: 579793 - DNA, 20 bp, mouse
ggttagtatggctccgcgtg

SEQ ID NO: 579794 - DNA, 20 bp, mouse
ggcggccgcggttccgtgag

SEQ ID NO: 579795 - DNA, 20 bp, mouse
gacgcttgccaggccactca

SEQ ID NO: 579796 - DNA, 20 bp, mouse
gtgcggggctcgggtattac

SEQ ID NO: 579797 - DNA, 20 bp, mouse
gtgcagccgtgggaagagaa

SEQ ID NO: 579798 - DNA, 20 bp, mouse
gaggccatggagaaacccag

SEQ ID NO: 579799 - DNA, 20 bp, mouse
ggccgcacggcactcacgga

SEQ ID NO: 579800 - DNA, 20 bp, mouse
ggggagcgccgcaggagaga

SEQ ID NO: 579801 - DNA, 20 bp, mouse
gctgcagctcaacatggcgc

SEQ ID NO: 579802 - DNA, 20 bp, mouse
gccgcaggagagaaggcggt

SEQ ID NO: 579803 - DNA, 20 bp, mouse
gacagggtgaccacaggcca

SEQ ID NO: 579804 - DNA, 20 bp, mouse
gaaggcggtgggaagagagt

SEQ ID NO: 579805 - DNA, 20 bp, mouse
gccgttgacagggtgaccac

SEQ ID NO: 579806 - DNA, 20 bp, mouse
gcccgcgcggcagatgccaa

SEQ ID NO: 579807 - DNA, 20 bp, mouse
gaagatgtcgaagcgaggtg

SEQ ID NO: 579808 - DNA, 20 bp, mouse
gcgcccggaaagggtcagaa

SEQ ID NO: 579809 - DNA, 20 bp, mouse
gagaaaggaagttagtacag

SEQ ID NO: 579810 - DNA, 20 bp, mouse
ggggccgaacggagaacgtg

SEQ ID NO: 579811 - DNA, 20 bp, mouse
gtttgagtttggggatccgt

SEQ ID NO: 579812 - DNA, 20 bp, mouse
gggggccgtcgccaagggat

SEQ ID NO: 579813 - DNA, 20 bp, mouse
gaatggtgttgagctggtgt

SEQ ID NO: 579814 - DNA, 20 bp, mouse
gagcggagcatggggccgaa

SEQ ID NO: 579815 - DNA, 20 bp, mouse
gtggtgtaggagcggagcat

SEQ ID NO: 579816 - DNA, 20 bp, mouse
gcgccgaaagcgaagaagga

SEQ ID NO: 579817 - DNA, 20 bp, mouse
ggaagaaggaaggtatgttg

SEQ ID NO: 579818 - DNA, 20 bp, mouse
gtgcggtatgggaatctgtc

SEQ ID NO: 579819 - DNA, 20 bp, mouse
gggaaggtatgttgcggtat

SEQ ID NO: 579820 - DNA, 20 bp, mouse
ggtatgggaatctgtcaggt

SEQ ID NO: 579821 - DNA, 20 bp, mouse
gcgcgtgggccaagccgcat

SEQ ID NO: 579822 - DNA, 20 bp, mouse
gctataagctcatgggaatt

SEQ ID NO: 579823 - DNA, 20 bp, mouse
ggcactggaaccagcccatg

SEQ ID NO: 579824 - DNA, 20 bp, mouse
ggaatctgtcaggtcggtct

SEQ ID NO: 579825 - DNA, 20 bp, mouse
ggacccggagcgccaccctg

SEQ ID NO: 579826 - DNA, 20 bp, mouse
ggactcagtggtgtggtcag

SEQ ID NO: 579827 - DNA, 20 bp, mouse
gttcgctttcgacaccatct

SEQ ID NO: 579828 - DNA, 20 bp, mouse
gttgatgatagatagcatag

SEQ ID NO: 579829 - DNA, 20 bp, mouse
gtgttggccacatcataatc

SEQ ID NO: 579830 - DNA, 20 bp, mouse
gcatatgccttctctccgtc

SEQ ID NO: 579831 - DNA, 20 bp, mouse
gataaggcccgacggagaga

SEQ ID NO: 579832 - DNA, 20 bp, mouse
gggcgaaaaggatggacatg

SEQ ID NO: 579833 - DNA, 20 bp, mouse
gatgatgtggccaacaagat

SEQ ID NO: 579834 - DNA, 20 bp, mouse
gttggctcctgattatgatg

SEQ ID NO: 579835 - DNA, 20 bp, mouse
gagggtcttgggcttccgga

SEQ ID NO: 579836 - DNA, 20 bp, mouse
gcgaccacctggtaaccagg

SEQ ID NO: 579837 - DNA, 20 bp, mouse
ggcctgtcagtggtaaggag

SEQ ID NO: 579838 - DNA, 20 bp, mouse
gccgctggcgactgacaaaa

SEQ ID NO: 579839 - DNA, 20 bp, mouse
gccgccggcagcgccctcgg

SEQ ID NO: 579840 - DNA, 20 bp, mouse
ggttccccctggttaccagg

SEQ ID NO: 579841 - DNA, 20 bp, mouse
ggagagagagcgcccaccac

SEQ ID NO: 579842 - DNA, 20 bp, mouse
gaggggaagaaccgaccacc

SEQ ID NO: 579843 - DNA, 20 bp, mouse
ggaccctctactaccagcgg

SEQ ID NO: 579844 - DNA, 20 bp, mouse
ggcagttccccctggttacc

SEQ ID NO: 579845 - DNA, 20 bp, mouse
gcactgacaggcgcccccga

SEQ ID NO: 579846 - DNA, 20 bp, mouse
gctatcaccatgaagtaagc

SEQ ID NO: 579847 - DNA, 20 bp, mouse
gaggaccgacgggaaggtaa

SEQ ID NO: 579848 - DNA, 20 bp, mouse
gtcgggacgctgggagtaga

SEQ ID NO: 579849 - DNA, 20 bp, mouse
gctagtcgcaaagggtcggg

SEQ ID NO: 579850 - DNA, 20 bp, mouse
gccggcctttaccttcccgt

SEQ ID NO: 579851 - DNA, 20 bp, mouse
gaggccccgggaccgcgtgt

SEQ ID NO: 579852 - DNA, 20 bp, mouse
ggggaaggtaaaggccggct

SEQ ID NO: 579853 - DNA, 20 bp, mouse
gccggggccttcggggagag

SEQ ID NO: 579854 - DNA, 20 bp, mouse
gaatcatgggagaaccttat

SEQ ID NO: 579855 - DNA, 20 bp, mouse
gggagaaccttatagggcag

SEQ ID NO: 579856 - DNA, 20 bp, mouse
gcaacccgccgagaactcac

SEQ ID NO: 579857 - DNA, 20 bp, mouse
gcagccagggagccgaactg

SEQ ID NO: 579858 - DNA, 20 bp, mouse
ggcagccggtgagttctcgg

SEQ ID NO: 579859 - DNA, 20 bp, mouse
gggtaatccgcagccatccg

SEQ ID NO: 579860 - DNA, 20 bp, mouse
gcatccgcggcgaggcgagg

SEQ ID NO: 579861 - DNA, 20 bp, mouse
gcaaccgcacggctgacccg

SEQ ID NO: 579862 - DNA, 20 bp, mouse
gatcgcagccggtgagttct

SEQ ID NO: 579863 - DNA, 20 bp, mouse
gtggcgagagggcaaccgca

SEQ ID NO: 579864 - DNA, 20 bp, mouse
gggagggtcctacacagcgt

SEQ ID NO: 579865 - DNA, 20 bp, mouse
ggccatcggtggatcgcagc

SEQ ID NO: 579866 - DNA, 20 bp, mouse
gcccgaccccgggaccgcga

SEQ ID NO: 579867 - DNA, 20 bp, mouse
ggaccccgggaccgcgatgg

SEQ ID NO: 579868 - DNA, 20 bp, mouse
ggtgagtaaaggcctggaga

SEQ ID NO: 579869 - DNA, 20 bp, mouse
gctgtcggtgagtaaaggcc

SEQ ID NO: 579870 - DNA, 20 bp, mouse
ggcctgctgtcggtgagtaa

SEQ ID NO: 579871 - DNA, 20 bp, mouse
gctccccgtgaagccgccag

SEQ ID NO: 579872 - DNA, 20 bp, mouse
ggcccggaggtcctgctcga

SEQ ID NO: 579873 - DNA, 20 bp, mouse
ggcagtctcaagagccccgg

SEQ ID NO: 579874 - DNA, 20 bp, mouse
gggggctcgcaggtagacgt

SEQ ID NO: 579875 - DNA, 20 bp, mouse
gtgaaggtaccagacccccg

SEQ ID NO: 579876 - DNA, 20 bp, mouse
gaagagaagacctaccatgg

SEQ ID NO: 579877 - DNA, 20 bp, mouse
gagaagacctaccatggcgg

SEQ ID NO: 579878 - DNA, 20 bp, mouse
gaccctccgcgatggagcgg

SEQ ID NO: 579879 - DNA, 20 bp, mouse
ggagccccgaccctccgcga

SEQ ID NO: 579880 - DNA, 20 bp, mouse
gccgaccctccgcgatggag

SEQ ID NO: 579881 - DNA, 20 bp, mouse
gcgcaggctacgcccagcca

SEQ ID NO: 579882 - DNA, 20 bp, mouse
gtggtcctagtgggtctcca

SEQ ID NO: 579883 - DNA, 20 bp, mouse
gagcaagcagctgaaaggct

SEQ ID NO: 579884 - DNA, 20 bp, mouse
ggtccacgcgatcccagctc

SEQ ID NO: 579885 - DNA, 20 bp, mouse
gcttggcctccgctccatcg

SEQ ID NO: 579886 - DNA, 20 bp, mouse
gcggccgccatagggagagg

SEQ ID NO: 579887 - DNA, 20 bp, mouse
gggccacgcgggacggacag

SEQ ID NO: 579888 - DNA, 20 bp, mouse
gcgaggccgtgggagcgaga

SEQ ID NO: 579889 - DNA, 20 bp, mouse
gacggaaagagagacacgag

SEQ ID NO: 579890 - DNA, 20 bp, mouse
ggcaggccgagctaacaccg

SEQ ID NO: 579891 - DNA, 20 bp, mouse
gcactcacctcctctcccta

SEQ ID NO: 579892 - DNA, 20 bp, mouse
gccgaggaaagggtgagcaa

SEQ ID NO: 579893 - DNA, 20 bp, mouse
gaccgcggagacttagaagg

SEQ ID NO: 579894 - DNA, 20 bp, mouse
gagatggcggccacgcggga

SEQ ID NO: 579895 - DNA, 20 bp, mouse
ggctttacacggccgaggaa

SEQ ID NO: 579896 - DNA, 20 bp, mouse
gtccgtgcatctgtaatgga

SEQ ID NO: 579897 - DNA, 20 bp, mouse
gcgtatggaggccatcctca

SEQ ID NO: 579898 - DNA, 20 bp, mouse
ggtggtcctcacgtaagaat

SEQ ID NO: 579899 - DNA, 20 bp, mouse
ggtggggcgggtaccaccac

SEQ ID NO: 579900 - DNA, 20 bp, mouse
gggcctccatacgtagatca

SEQ ID NO: 579901 - DNA, 20 bp, mouse
gagcccgagaccgatggcaa

SEQ ID NO: 579902 - DNA, 20 bp, mouse
gaccgatggcaaaggggttg

SEQ ID NO: 579903 - DNA, 20 bp, mouse
gcccctttgccatcggtctc

SEQ ID NO: 579904 - DNA, 20 bp, mouse
gtatcgccctgatctacgta

SEQ ID NO: 579905 - DNA, 20 bp, mouse
gcagtggactattgcttctg

SEQ ID NO: 579906 - DNA, 20 bp, mouse
ggcgaggcaggcgacacggg

SEQ ID NO: 579907 - DNA, 20 bp, mouse
gctgtagtcacggatgtcat

SEQ ID NO: 579908 - DNA, 20 bp, mouse
ggtcgcgaggcaggcgacac

SEQ ID NO: 579909 - DNA, 20 bp, mouse
gaccgtgagtgttggcctta

SEQ ID NO: 579910 - DNA, 20 bp, mouse
gatgttaccccagctcaggg

SEQ ID NO: 579911 - DNA, 20 bp, mouse
gcaacactcacggtaacccg

SEQ ID NO: 579912 - DNA, 20 bp, mouse
ggccgtaaggccaacactca

SEQ ID NO: 579913 - DNA, 20 bp, mouse
gtgctcgcgtttgagaggtg

SEQ ID NO: 579914 - DNA, 20 bp, mouse
gctctcaaacgcgagcaagg

SEQ ID NO: 579915 - DNA, 20 bp, mouse
gacaccgccggaaagtccaa

SEQ ID NO: 579916 - DNA, 20 bp, mouse
gcctggtcgctctctatctg

SEQ ID NO: 579917 - DNA, 20 bp, mouse
gcacaggagaccaagttaga

SEQ ID NO: 579918 - DNA, 20 bp, mouse
ggaatacaagccaggcccac

SEQ ID NO: 579919 - DNA, 20 bp, mouse
gcagggatggcgccgatggg

SEQ ID NO: 579920 - DNA, 20 bp, mouse
gggcggcgagatggtacgta

SEQ ID NO: 579921 - DNA, 20 bp, mouse
gagccagggatggcgccgat

SEQ ID NO: 579922 - DNA, 20 bp, mouse
gagcgaccaggagccagtgc

SEQ ID NO: 579923 - DNA, 20 bp, mouse
ggaccttaacggccttacgg

SEQ ID NO: 579924 - DNA, 20 bp, mouse
ggccttacggaggatgtgtg

SEQ ID NO: 579925 - DNA, 20 bp, mouse
ggattacgctgatatcaaat

SEQ ID NO: 579926 - DNA, 20 bp, mouse
gctctgcggggtaaacgatt

SEQ ID NO: 579927 - DNA, 20 bp, mouse
gagctcttctaggccgacag

SEQ ID NO: 579928 - DNA, 20 bp, mouse
gcccaacctagcatacacag

SEQ ID NO: 579929 - DNA, 20 bp, mouse
gtgcggggtaaacgattagg

SEQ ID NO: 579930 - DNA, 20 bp, mouse
gacggtgagtgaagccgatc

SEQ ID NO: 579931 - DNA, 20 bp, mouse
gtagatttgagcacactggg

SEQ ID NO: 579932 - DNA, 20 bp, mouse
gtcacgtggagagctgggtc

SEQ ID NO: 579933 - DNA, 20 bp, mouse
gcacaatgcaaagctcttct

SEQ ID NO: 579934 - DNA, 20 bp, mouse
gaccggcttccgggcccgat

SEQ ID NO: 579935 - DNA, 20 bp, mouse
ggtctcaaagtgaatccgag

SEQ ID NO: 579936 - DNA, 20 bp, mouse
ggggcccggcagagtgagta

SEQ ID NO: 579937 - DNA, 20 bp, mouse
gacgcaggcgacagggaggg

SEQ ID NO: 579938 - DNA, 20 bp, mouse
gtagacgcaggcgacaggga

SEQ ID NO: 579939 - DNA, 20 bp, mouse
gcccggccggagcccgaagg

SEQ ID NO: 579940 - DNA, 20 bp, mouse
gcatctagacgcaggcgaca

SEQ ID NO: 579941 - DNA, 20 bp, mouse
ggaggctctaagcaggtagt

SEQ ID NO: 579942 - DNA, 20 bp, mouse
gagggagggaggctctaagc

SEQ ID NO: 579943 - DNA, 20 bp, mouse
gacagactgggtgctctaga

SEQ ID NO: 579944 - DNA, 20 bp, mouse
ggaggctctgcggtccgggg

SEQ ID NO: 579945 - DNA, 20 bp, mouse
ggcgggagccatctagacgc

SEQ ID NO: 579946 - DNA, 20 bp, mouse
gtaggcagcgccgaggaaga

SEQ ID NO: 579947 - DNA, 20 bp, mouse
gagactcaccgtaaaacaga

SEQ ID NO: 579948 - DNA, 20 bp, mouse
ggtcccgtcgaagccgcggg

SEQ ID NO: 579949 - DNA, 20 bp, mouse
ggcggcccgagagtttcgga

SEQ ID NO: 579950 - DNA, 20 bp, mouse
gtgctctgagacgaccggga

SEQ ID NO: 579951 - DNA, 20 bp, mouse
gccggcccccgggcagactc

SEQ ID NO: 579952 - DNA, 20 bp, mouse
ggcctccccacccggagacg

SEQ ID NO: 579953 - DNA, 20 bp, mouse
gtgctccggagtctgcccgg

SEQ ID NO: 579954 - DNA, 20 bp, mouse
ggagcagagaaggcaccctt

SEQ ID NO: 579955 - DNA, 20 bp, mouse
gtacggtgagtctgtatcgg

SEQ ID NO: 579956 - DNA, 20 bp, mouse
gacggtgctcagaggtatgg

SEQ ID NO: 579957 - DNA, 20 bp, mouse
gctgacgcctcggatggcta

SEQ ID NO: 579958 - DNA, 20 bp, mouse
ggatggctacggatcgtaaa

SEQ ID NO: 579959 - DNA, 20 bp, mouse
ggcccgcctgacgcctcgga

SEQ ID NO: 579960 - DNA, 20 bp, mouse
gtacgatccgtagccatccg

SEQ ID NO: 579961 - DNA, 20 bp, mouse
gggaagcccgagatcaaacc

SEQ ID NO: 579962 - DNA, 20 bp, mouse
ggcgacagtcccgaccccaa

SEQ ID NO: 579963 - DNA, 20 bp, mouse
gtcaaacccggcttccgaag

SEQ ID NO: 579964 - DNA, 20 bp, mouse
ggctcgctgactagccacca

SEQ ID NO: 579965 - DNA, 20 bp, mouse
gctccggccactcaccgctt

SEQ ID NO: 579966 - DNA, 20 bp, mouse
ggaacaacgccgaaatggtg

SEQ ID NO: 579967 - DNA, 20 bp, mouse
gacgtgtccccggcgaccga

SEQ ID NO: 579968 - DNA, 20 bp, mouse
gccggccgacccaggaggga

SEQ ID NO: 579969 - DNA, 20 bp, mouse
gtcccgcagcctcaccattt

SEQ ID NO: 579970 - DNA, 20 bp, mouse
gtggtgaggctgcgggaatc

SEQ ID NO: 579971 - DNA, 20 bp, mouse
gggagcgactctatgggtca

SEQ ID NO: 579972 - DNA, 20 bp, mouse
gctggcgcaccgtccctcct

SEQ ID NO: 579973 - DNA, 20 bp, mouse
ggtccccggccgacccagga

SEQ ID NO: 579974 - DNA, 20 bp, mouse
ggggtcggccggggacgaag

SEQ ID NO: 579975 - DNA, 20 bp, mouse
ggcaatgaggagcgactcta

SEQ ID NO: 579976 - DNA, 20 bp, mouse
gcggctcgggaggagagaat

SEQ ID NO: 579977 - DNA, 20 bp, mouse
gttggcgcctgtggaggtga

SEQ ID NO: 579978 - DNA, 20 bp, mouse
ggcgggatggaggcgatgac

SEQ ID NO: 579979 - DNA, 20 bp, mouse
gaaccccaaaaggaacccgg

SEQ ID NO: 579980 - DNA, 20 bp, mouse
gcaggctctgcctctatagg

SEQ ID NO: 579981 - DNA, 20 bp, mouse
gcccgggccagtaagaccgg

SEQ ID NO: 579982 - DNA, 20 bp, mouse
gcagtcggcgtcccaaggat

SEQ ID NO: 579983 - DNA, 20 bp, mouse
gtacgccctgccccctatag

SEQ ID NO: 579984 - DNA, 20 bp, mouse
gtcgtgggcaaaggccgggt

SEQ ID NO: 579985 - DNA, 20 bp, mouse
gccgagacgccaggttgtct

SEQ ID NO: 579986 - DNA, 20 bp, mouse
ggggccgggatgcccgatgg

SEQ ID NO: 579987 - DNA, 20 bp, mouse
ggccccatggggagtccctg

SEQ ID NO: 579988 - DNA, 20 bp, mouse
gtcaggtaagtgggcctcgt

SEQ ID NO: 579989 - DNA, 20 bp, mouse
gcgggcatcccggccccatg

SEQ ID NO: 579990 - DNA, 20 bp, mouse
gatggggagtccctgcgggc

SEQ ID NO: 579991 - DNA, 20 bp, mouse
ggcccgcatgccggcccgca

SEQ ID NO: 579992 - DNA, 20 bp, mouse
gcgacgcggggtgagtgctg

SEQ ID NO: 579993 - DNA, 20 bp, mouse
gtcgtcagagatggggacgg

SEQ ID NO: 579994 - DNA, 20 bp, mouse
ggaccgcctcgtcagagatg

SEQ ID NO: 579995 - DNA, 20 bp, mouse
ggggcagatgagccccgacg

SEQ ID NO: 579996 - DNA, 20 bp, mouse
gagcttcaaggaatattcaa

SEQ ID NO: 579997 - DNA, 20 bp, mouse
gaatattcaaaggcttaggt

SEQ ID NO: 579998 - DNA, 20 bp, mouse
gcaatggacaggattgttaa

SEQ ID NO: 579999 - DNA, 20 bp, mouse
ggattgttaaaggtccttaa

SEQ ID NO: 580000 - DNA, 20 bp, mouse
gtaaattatggcgtggtgta

SEQ ID NO: 580001 - DNA, 20 bp, mouse
gaaaaactgtttcaatggac

SEQ ID NO: 580002 - DNA, 20 bp, mouse
gatgtgtctattccctcctt

SEQ ID NO: 580003 - DNA, 20 bp, mouse
gcagtttttaaattatggcg

SEQ ID NO: 580004 - DNA, 20 bp, mouse
gacacattgatatagcttca

SEQ ID NO: 580005 - DNA, 20 bp, mouse
gaaggaatattcaaaggctt

SEQ ID NO: 580006 - DNA, 20 bp, mouse
ggtcatgacccttattcagg

SEQ ID NO: 580007 - DNA, 20 bp, mouse
ggatgctaccccctgaataa

SEQ ID NO: 580008 - DNA, 20 bp, mouse
gctaggactgtggtcgggac

SEQ ID NO: 580009 - DNA, 20 bp, mouse
gagaccccaagaactcactt

SEQ ID NO: 580010 - DNA, 20 bp, mouse
gctgctctaggactgtggtc

SEQ ID NO: 580011 - DNA, 20 bp, mouse
gagttcgtcaagaagacggt

SEQ ID NO: 580012 - DNA, 20 bp, mouse
gggttcctaagtgagttctt

SEQ ID NO: 580013 - DNA, 20 bp, mouse
gttagtcatgacccttattc

SEQ ID NO: 580014 - DNA, 20 bp, mouse
gtctatggctcaccgctcat

SEQ ID NO: 580015 - DNA, 20 bp, mouse
gctaatattaagaatagctc

SEQ ID NO: 580016 - DNA, 20 bp, mouse
gagagaggctagagccgcaa

SEQ ID NO: 580017 - DNA, 20 bp, mouse
gctccctacagacagctcta

SEQ ID NO: 580018 - DNA, 20 bp, mouse
gcgctcctgcgaacatggta

SEQ ID NO: 580019 - DNA, 20 bp, mouse
ggaccatagagctgtctgta

SEQ ID NO: 580020 - DNA, 20 bp, mouse
gcgcaacggaagtttatagg

SEQ ID NO: 580021 - DNA, 20 bp, mouse
gagccgcaacggaagtttat

SEQ ID NO: 580022 - DNA, 20 bp, mouse
gctatggtcgccgtttccca

SEQ ID NO: 580023 - DNA, 20 bp, mouse
gtagcagagagcgacacaga

SEQ ID NO: 580024 - DNA, 20 bp, mouse
gctcggttaccggaccacaa

SEQ ID NO: 580025 - DNA, 20 bp, mouse
gcatctaagcagcttaccct

SEQ ID NO: 580026 - DNA, 20 bp, mouse
ggcacgcgccgaacaggaaa

SEQ ID NO: 580027 - DNA, 20 bp, mouse
gcggtaagtctggagcagag

SEQ ID NO: 580028 - DNA, 20 bp, mouse
gtccagacttaccgagagac

SEQ ID NO: 580029 - DNA, 20 bp, mouse
gcaggcgaccgcggtcccca

SEQ ID NO: 580030 - DNA, 20 bp, mouse
ggccggtctctcggtaagtc

SEQ ID NO: 580031 - DNA, 20 bp, mouse
gcgggcccgctggagagtga

SEQ ID NO: 580032 - DNA, 20 bp, mouse
gagagaccgctccagcatgg

SEQ ID NO: 580033 - DNA, 20 bp, mouse
gatcgcggcggccggtctct

SEQ ID NO: 580034 - DNA, 20 bp, mouse
gggaagagaccgctccagca

SEQ ID NO: 580035 - DNA, 20 bp, mouse
gggacgaacagagcggaagt

SEQ ID NO: 580036 - DNA, 20 bp, mouse
gctcgccggtagaagcaaga

SEQ ID NO: 580037 - DNA, 20 bp, mouse
gcaacaggcaggacagcccg

SEQ ID NO: 580038 - DNA, 20 bp, mouse
gcaggacagcccgaggaaga

SEQ ID NO: 580039 - DNA, 20 bp, mouse
gtatccacaggaagtggcgg

SEQ ID NO: 580040 - DNA, 20 bp, mouse
gacagcggcgctaggaccgt

SEQ ID NO: 580041 - DNA, 20 bp, mouse
gcgccgctgtgggtctctct

SEQ ID NO: 580042 - DNA, 20 bp, mouse
gcttaggtccgcgcagagta

SEQ ID NO: 580043 - DNA, 20 bp, mouse
gagtaccgcgactgagagac

SEQ ID NO: 580044 - DNA, 20 bp, mouse
gacgcactgcagccccgggt

SEQ ID NO: 580045 - DNA, 20 bp, mouse
gtgggcggaagcttatccac

SEQ ID NO: 580046 - DNA, 20 bp, mouse
ggcccaagtccgaagaggaa

SEQ ID NO: 580047 - DNA, 20 bp, mouse
gcccaagcccaagtccgaag

SEQ ID NO: 580048 - DNA, 20 bp, mouse
gtcccttcctcttcggactt

SEQ ID NO: 580049 - DNA, 20 bp, mouse
gtggatagcgacttccaaag

SEQ ID NO: 580050 - DNA, 20 bp, mouse
gtagcctgttgacagaggaa

SEQ ID NO: 580051 - DNA, 20 bp, mouse
gcgcatgcgcggttttagac

SEQ ID NO: 580052 - DNA, 20 bp, mouse
gccccgtacgcggccggagg

SEQ ID NO: 580053 - DNA, 20 bp, mouse
gagtgtcttcgtaaccgctt

SEQ ID NO: 580054 - DNA, 20 bp, mouse
gtacgcggccggaggcggct

SEQ ID NO: 580055 - DNA, 20 bp, mouse
gccctcaagctcaaccatca

SEQ ID NO: 580056 - DNA, 20 bp, mouse
ggtgctgggcaggtggggaa

SEQ ID NO: 580057 - DNA, 20 bp, mouse
gagtgcgggacgagggaccg

SEQ ID NO: 580058 - DNA, 20 bp, mouse
ggggaagggcgttcaatccg

SEQ ID NO: 580059 - DNA, 20 bp, mouse
gggcgatccgcagccgggga

SEQ ID NO: 580060 - DNA, 20 bp, mouse
gcctcgtcccgcactcacca

SEQ ID NO: 580061 - DNA, 20 bp, mouse
gcagggcgagcccgagggac

SEQ ID NO: 580062 - DNA, 20 bp, mouse
gatgagaaccgaagagaacg

SEQ ID NO: 580063 - DNA, 20 bp, mouse
gggctcggaacagcaggtta

SEQ ID NO: 580064 - DNA, 20 bp, mouse
gggcggagggaggcatcggg

SEQ ID NO: 580065 - DNA, 20 bp, mouse
ggggacgcccaagcccgccc

SEQ ID NO: 580066 - DNA, 20 bp, mouse
gagaagagaaaggccgggac

SEQ ID NO: 580067 - DNA, 20 bp, mouse
ggcggccgatagtcttacca

SEQ ID NO: 580068 - DNA, 20 bp, mouse
gtagaggcggagcttagggg

SEQ ID NO: 580069 - DNA, 20 bp, mouse
ggattagaagaagtcgctag

SEQ ID NO: 580070 - DNA, 20 bp, mouse
gaaagccgctgagggacgga

SEQ ID NO: 580071 - DNA, 20 bp, mouse
gcgctagaggcggagcttag

SEQ ID NO: 580072 - DNA, 20 bp, mouse
gcaggaaagccgctgaggga

SEQ ID NO: 580073 - DNA, 20 bp, mouse
ggccgctgagggacggatgg

SEQ ID NO: 580074 - DNA, 20 bp, mouse
ggccgcgcccacaggccgat

SEQ ID NO: 580075 - DNA, 20 bp, mouse
gtagaagaagtcgctagagg

SEQ ID NO: 580076 - DNA, 20 bp, mouse
ggagcctgcagcagcgtggt

SEQ ID NO: 580077 - DNA, 20 bp, mouse
gcggtgcagggctcacaggt

SEQ ID NO: 580078 - DNA, 20 bp, mouse
gtggtctggtgtgtggtcca

SEQ ID NO: 580079 - DNA, 20 bp, mouse
ggtgtggtccagggctcccg

SEQ ID NO: 580080 - DNA, 20 bp, mouse
gggtaagaggaaacactata

SEQ ID NO: 580081 - DNA, 20 bp, mouse
ggcgtggttggtctggtgtg

SEQ ID NO: 580082 - DNA, 20 bp, mouse
gctcgccgggaagaggtaag

SEQ ID NO: 580083 - DNA, 20 bp, mouse
gcggaaaggcctgggagcta

SEQ ID NO: 580084 - DNA, 20 bp, mouse
gtaggaaacccggcagagtc

SEQ ID NO: 580085 - DNA, 20 bp, mouse
ggaccaccggaaatccggaa

SEQ ID NO: 580086 - DNA, 20 bp, mouse
gagccccagcccactaacca

SEQ ID NO: 580087 - DNA, 20 bp, mouse
ggggatcggccatggttagt

SEQ ID NO: 580088 - DNA, 20 bp, mouse
gtgccaggttaggtacatag

SEQ ID NO: 580089 - DNA, 20 bp, mouse
gaggaaggggcctccccacc

SEQ ID NO: 580090 - DNA, 20 bp, mouse
gggccccttcctaacctgca

SEQ ID NO: 580091 - DNA, 20 bp, mouse
gcctccccaccaggcaccag

SEQ ID NO: 580092 - DNA, 20 bp, mouse
gaaccatggccgatccctgc

SEQ ID NO: 580093 - DNA, 20 bp, mouse
gggccatggttagtgggctg

SEQ ID NO: 580094 - DNA, 20 bp, mouse
ggaacttccggtgggactag

SEQ ID NO: 580095 - DNA, 20 bp, mouse
gaacctggcaagacctgcaa

SEQ ID NO: 580096 - DNA, 20 bp, mouse
gacctccactcaccatgacg

SEQ ID NO: 580097 - DNA, 20 bp, mouse
gtccccgtcatggtgagtgg

SEQ ID NO: 580098 - DNA, 20 bp, mouse
ggccatcttagaggcaacgt

SEQ ID NO: 580099 - DNA, 20 bp, mouse
gtagccgccccccagaccag

SEQ ID NO: 580100 - DNA, 20 bp, mouse
gctctccccgtcatggtgag

SEQ ID NO: 580101 - DNA, 20 bp, mouse
ggctgaggcagccatcttag

SEQ ID NO: 580102 - DNA, 20 bp, mouse
gggcaacagcgccaggtgga

SEQ ID NO: 580103 - DNA, 20 bp, mouse
gatctgcagagaggagacga

SEQ ID NO: 580104 - DNA, 20 bp, mouse
ggcaggatgcggaagacgag

SEQ ID NO: 580105 - DNA, 20 bp, mouse
gctggccggagctgagttgt

SEQ ID NO: 580106 - DNA, 20 bp, mouse
gcgcgactaaccaaggaaga

SEQ ID NO: 580107 - DNA, 20 bp, mouse
ggaagcccgcagaggaacca

SEQ ID NO: 580108 - DNA, 20 bp, mouse
ggtcttagcgccatcttcct

SEQ ID NO: 580109 - DNA, 20 bp, mouse
gaccgtctggaagcccgcag

SEQ ID NO: 580110 - DNA, 20 bp, mouse
gggcgctaagaccgagaggg

SEQ ID NO: 580111 - DNA, 20 bp, mouse
ggtgatgatagtgaatgtgg

SEQ ID NO: 580112 - DNA, 20 bp, mouse
gggtgttcgcagtcagggag

SEQ ID NO: 580113 - DNA, 20 bp, mouse
ggcccgcagaggaaccatgg

SEQ ID NO: 580114 - DNA, 20 bp, mouse
gaaaaccccgcgactaacca

SEQ ID NO: 580115 - DNA, 20 bp, mouse
gggatgttaacggattgcac

SEQ ID NO: 580116 - DNA, 20 bp, mouse
gacgaccccggagacaactg

SEQ ID NO: 580117 - DNA, 20 bp, mouse
gtcggctcgtgcgacccggg

SEQ ID NO: 580118 - DNA, 20 bp, mouse
gtggcgtagggatcgatcag

SEQ ID NO: 580119 - DNA, 20 bp, mouse
gtcgtcaggaggccgtgcca

SEQ ID NO: 580120 - DNA, 20 bp, mouse
ggggcatccgcgagaggagg

SEQ ID NO: 580121 - DNA, 20 bp, mouse
gccattaggccacgctggaa

SEQ ID NO: 580122 - DNA, 20 bp, mouse
ggcacgagccgaccccgagc

SEQ ID NO: 580123 - DNA, 20 bp, mouse
gggaggaagtgagcgccgag

SEQ ID NO: 580124 - DNA, 20 bp, mouse
gcacggaagcccgaatccct

SEQ ID NO: 580125 - DNA, 20 bp, mouse
gtaggccacgctggaacggc

SEQ ID NO: 580126 - DNA, 20 bp, mouse
gggaatggcgggcgtctgtg

SEQ ID NO: 580127 - DNA, 20 bp, mouse
gccgtcttgcaaggtaggaa

SEQ ID NO: 580128 - DNA, 20 bp, mouse
gcttgcaaggtaggaatggc

SEQ ID NO: 580129 - DNA, 20 bp, mouse
gagggcccagcgaccatctc

SEQ ID NO: 580130 - DNA, 20 bp, mouse
gtccaaccctccccaggtta

SEQ ID NO: 580131 - DNA, 20 bp, mouse
gttcggatggacgaggattg

SEQ ID NO: 580132 - DNA, 20 bp, mouse
gggagctggggccatcgtgg

SEQ ID NO: 580133 - DNA, 20 bp, mouse
ggccgtaacctggggagggt

SEQ ID NO: 580134 - DNA, 20 bp, mouse
gcctagggcgacaccagagg

SEQ ID NO: 580135 - DNA, 20 bp, mouse
gggccctgggtagtgatccc

SEQ ID NO: 580136 - DNA, 20 bp, mouse
gggagagaagaatcgactta

SEQ ID NO: 580137 - DNA, 20 bp, mouse
gcagtaccaggagcaaactg

SEQ ID NO: 580138 - DNA, 20 bp, mouse
gacgccgtgtggtactagga

SEQ ID NO: 580139 - DNA, 20 bp, mouse
gggggatggagaaggattct

SEQ ID NO: 580140 - DNA, 20 bp, mouse
ggtactaggagggagtgcgg

SEQ ID NO: 580141 - DNA, 20 bp, mouse
ggcgtcacaaacacccagac

SEQ ID NO: 580142 - DNA, 20 bp, mouse
gatcgaggatcagtgagtcc

SEQ ID NO: 580143 - DNA, 20 bp, mouse
gtactgccaaggcctccgcg

SEQ ID NO: 580144 - DNA, 20 bp, mouse
gtcgcgccctgagaccttta

SEQ ID NO: 580145 - DNA, 20 bp, mouse
gtgagggcagactgcggatc

SEQ ID NO: 580146 - DNA, 20 bp, mouse
ggccgctgacgggcgacggg

SEQ ID NO: 580147 - DNA, 20 bp, mouse
ggagggaccccgaggagaca

SEQ ID NO: 580148 - DNA, 20 bp, mouse
gcccgaggagacagggacgg

SEQ ID NO: 580149 - DNA, 20 bp, mouse
gatggaggcggatagcgcgg

SEQ ID NO: 580150 - DNA, 20 bp, mouse
ggacgggcggcggatggagg

SEQ ID NO: 580151 - DNA, 20 bp, mouse
gggcggagaacgccgctgac

SEQ ID NO: 580152 - DNA, 20 bp, mouse
ggccgcccgtcgcccgtcag

SEQ ID NO: 580153 - DNA, 20 bp, mouse
gcaagatggtgagtgtctct

SEQ ID NO: 580154 - DNA, 20 bp, mouse
gcggatggaggcggatagcg

SEQ ID NO: 580155 - DNA, 20 bp, mouse
gcagtggcggctgctcggga

SEQ ID NO: 580156 - DNA, 20 bp, mouse
gtaggatggccccaatgtac

SEQ ID NO: 580157 - DNA, 20 bp, mouse
gtcctacaccgaaggagacg

SEQ ID NO: 580158 - DNA, 20 bp, mouse
gctctggtggagagagctca

SEQ ID NO: 580159 - DNA, 20 bp, mouse
ggccacgtctccttcggtgt

SEQ ID NO: 580160 - DNA, 20 bp, mouse
gtggggccatcctacaccga

SEQ ID NO: 580161 - DNA, 20 bp, mouse
gggctctgcgaggttcactc

SEQ ID NO: 580162 - DNA, 20 bp, mouse
ggggcatcctgctcctctgg

SEQ ID NO: 580163 - DNA, 20 bp, mouse
gatcaactcctggctctgcg

SEQ ID NO: 580164 - DNA, 20 bp, mouse
gtttattgttccagtacatt

SEQ ID NO: 580165 - DNA, 20 bp, mouse
ggctgttgttaagaaccagg

SEQ ID NO: 580166 - DNA, 20 bp, mouse
gagcgcagtagctgaagcac

SEQ ID NO: 580167 - DNA, 20 bp, mouse
gggctccgcgaccagggatc

SEQ ID NO: 580168 - DNA, 20 bp, mouse
gctctctaccccgcccggtg

SEQ ID NO: 580169 - DNA, 20 bp, mouse
gagcttggtggaagacgcag

SEQ ID NO: 580170 - DNA, 20 bp, mouse
gtgggggctgagatgctgta

SEQ ID NO: 580171 - DNA, 20 bp, mouse
gtgtagagcccgtgccgtag

SEQ ID NO: 580172 - DNA, 20 bp, mouse
gtgtcttcggatctctctat

SEQ ID NO: 580173 - DNA, 20 bp, mouse
ggcatctgcagcttccgcta

SEQ ID NO: 580174 - DNA, 20 bp, mouse
gcgctcccgcaggaggactc

SEQ ID NO: 580175 - DNA, 20 bp, mouse
ggcgcttgcgcagcctcacc

SEQ ID NO: 580176 - DNA, 20 bp, mouse
gagttaacggcggcggatgg

SEQ ID NO: 580177 - DNA, 20 bp, mouse
gaccgccaagtagttaacgg

SEQ ID NO: 580178 - DNA, 20 bp, mouse
gcatgggccgtgtgatccga

SEQ ID NO: 580179 - DNA, 20 bp, mouse
gtaacggcggcggatggcgg

SEQ ID NO: 580180 - DNA, 20 bp, mouse
gagttgtgctctgtccgctg

SEQ ID NO: 580181 - DNA, 20 bp, mouse
gcagaccgccaagtagttaa

SEQ ID NO: 580182 - DNA, 20 bp, mouse
gcggcaagcaaggccgaaag

SEQ ID NO: 580183 - DNA, 20 bp, mouse
gcagagcacaacttacctgc

SEQ ID NO: 580184 - DNA, 20 bp, mouse
gataatttcaaaacccgcag

SEQ ID NO: 580185 - DNA, 20 bp, mouse
gacttacctgccggcaagca

SEQ ID NO: 580186 - DNA, 20 bp, mouse
gcctcacctcgcagtagatg

SEQ ID NO: 580187 - DNA, 20 bp, mouse
gggatgggttcagattcccg

SEQ ID NO: 580188 - DNA, 20 bp, mouse
gactgcgaggtgaggagctt

SEQ ID NO: 580189 - DNA, 20 bp, mouse
gaggtgaggagcttagggac

SEQ ID NO: 580190 - DNA, 20 bp, mouse
gcgccggggtccccaaacag

SEQ ID NO: 580191 - DNA, 20 bp, mouse
gtcggtgcgccatggcggaa

SEQ ID NO: 580192 - DNA, 20 bp, mouse
ggcgacacgcagggccctga

SEQ ID NO: 580193 - DNA, 20 bp, mouse
ggaagggctacgaccgagat

SEQ ID NO: 580194 - DNA, 20 bp, mouse
gcttagggaccgggtgcccc

SEQ ID NO: 580195 - DNA, 20 bp, mouse
gggtcgtagcccttccgcca

SEQ ID NO: 580196 - DNA, 20 bp, mouse
ggtcctcgttggaggttggg

SEQ ID NO: 580197 - DNA, 20 bp, mouse
ggccaggcggtagaccggac

SEQ ID NO: 580198 - DNA, 20 bp, mouse
gaaccccccaacctccaacg

SEQ ID NO: 580199 - DNA, 20 bp, mouse
gaggacgcctggcgagagac

SEQ ID NO: 580200 - DNA, 20 bp, mouse
gcgccaggcgtcctcgttgg

SEQ ID NO: 580201 - DNA, 20 bp, mouse
gaggcgtcctcgttggaggt

SEQ ID NO: 580202 - DNA, 20 bp, mouse
gcgttgcgggtgggagcgat

SEQ ID NO: 580203 - DNA, 20 bp, mouse
gagcccggtaaccccaacac

SEQ ID NO: 580204 - DNA, 20 bp, mouse
gcgaccgccccgggaagacc

SEQ ID NO: 580205 - DNA, 20 bp, mouse
gcaagagcgcggggacgttg

SEQ ID NO: 580206 - DNA, 20 bp, mouse
ggtaagtgcgggataacccc

SEQ ID NO: 580207 - DNA, 20 bp, mouse
ggcccgactcgagacggaag

SEQ ID NO: 580208 - DNA, 20 bp, mouse
gtgagaatgcgaagtccggg

SEQ ID NO: 580209 - DNA, 20 bp, mouse
ggcctgagaatgcgaagtcc

SEQ ID NO: 580210 - DNA, 20 bp, mouse
gcccataagaagctgcgcgc

SEQ ID NO: 580211 - DNA, 20 bp, mouse
ggcctgcgcgcagcttctta

SEQ ID NO: 580212 - DNA, 20 bp, mouse
ggagtcgggcatcgattggt

SEQ ID NO: 580213 - DNA, 20 bp, mouse
gtgacggtcacggtaagtgc

SEQ ID NO: 580214 - DNA, 20 bp, mouse
gccaacccgagacaggtgaa

SEQ ID NO: 580215 - DNA, 20 bp, mouse
gacccgagacaggtgaatgg

SEQ ID NO: 580216 - DNA, 20 bp, mouse
gccgcctgggccgcgaacag

SEQ ID NO: 580217 - DNA, 20 bp, mouse
gggcggccaggctactcact

SEQ ID NO: 580218 - DNA, 20 bp, mouse
gacgtagcgcatgctaaatg

SEQ ID NO: 580219 - DNA, 20 bp, mouse
gcaggctactcactcggctg

SEQ ID NO: 580220 - DNA, 20 bp, mouse
gtgggccgcgaacagtggtg

SEQ ID NO: 580221 - DNA, 20 bp, mouse
gagtggtgaggttatccgag

SEQ ID NO: 580222 - DNA, 20 bp, mouse
gttgctgcttaaaatggagg

SEQ ID NO: 580223 - DNA, 20 bp, mouse
gggatccaaatgtctaccag

SEQ ID NO: 580224 - DNA, 20 bp, mouse
ggttcgcggcccaggcggcc

SEQ ID NO: 580225 - DNA, 20 bp, mouse
gaggaagacgctgacgcagt

SEQ ID NO: 580226 - DNA, 20 bp, mouse
gagcggcggagcctccgagg

SEQ ID NO: 580227 - DNA, 20 bp, mouse
gctgctgctgctatgtctcg

SEQ ID NO: 580228 - DNA, 20 bp, mouse
gtggtcctggtacacccggg

SEQ ID NO: 580229 - DNA, 20 bp, mouse
gctcgcggtcatggagtcgc

SEQ ID NO: 580230 - DNA, 20 bp, mouse
ggacacgcggacaagagaga

SEQ ID NO: 580231 - DNA, 20 bp, mouse
gaggtggtcctggtacaccc

SEQ ID NO: 580232 - DNA, 20 bp, mouse
gagccacctagccaaggtga

SEQ ID NO: 580233 - DNA, 20 bp, mouse
ggaggcgctgccgggcgtcg

SEQ ID NO: 580234 - DNA, 20 bp, mouse
gtcacgtcctcgttgaccag

SEQ ID NO: 580235 - DNA, 20 bp, mouse
gacctaggcgtgcaggtgag

SEQ ID NO: 580236 - DNA, 20 bp, mouse
gtccggtgggacctgctcgg

SEQ ID NO: 580237 - DNA, 20 bp, mouse
gtgcgcaacgcctcacccgg

SEQ ID NO: 580238 - DNA, 20 bp, mouse
gtgggacctgctcggaggaa

SEQ ID NO: 580239 - DNA, 20 bp, mouse
gggaatggcgccgccgggtg

SEQ ID NO: 580240 - DNA, 20 bp, mouse
gtgcctgctcgggctccggt

SEQ ID NO: 580241 - DNA, 20 bp, mouse
gaggctagtgcggaccacac

SEQ ID NO: 580242 - DNA, 20 bp, mouse
ggaagtgctggggacccgaa

SEQ ID NO: 580243 - DNA, 20 bp, mouse
gccatgcgcaacgcctcacc

SEQ ID NO: 580244 - DNA, 20 bp, mouse
ggcccggcagccgcagtgtg

SEQ ID NO: 580245 - DNA, 20 bp, mouse
gggcgtgcgaacctcactca

SEQ ID NO: 580246 - DNA, 20 bp, mouse
ggctagaattcggcatgggt

SEQ ID NO: 580247 - DNA, 20 bp, mouse
gccaggacggagaggatcac

SEQ ID NO: 580248 - DNA, 20 bp, mouse
gcgccgctagaattcggcat

SEQ ID NO: 580249 - DNA, 20 bp, mouse
gcttgcacgccgctagaatt

SEQ ID NO: 580250 - DNA, 20 bp, mouse
gcgcgctgtacagagcccgg

SEQ ID NO: 580251 - DNA, 20 bp, mouse
ggttttccaggtccgaactt

SEQ ID NO: 580252 - DNA, 20 bp, mouse
ggcgacgcgggagcacgagg

SEQ ID NO: 580253 - DNA, 20 bp, mouse
gggagcacgaggtggaagtg

SEQ ID NO: 580254 - DNA, 20 bp, mouse
gagcagcccaagttcggacc

SEQ ID NO: 580255 - DNA, 20 bp, mouse
gctgttatgcgtctgtgggg

SEQ ID NO: 580256 - DNA, 20 bp, mouse
ggcgggcccagtgaaggacc

SEQ ID NO: 580257 - DNA, 20 bp, mouse
gctcatggcgggcccagtga

SEQ ID NO: 580258 - DNA, 20 bp, mouse
gagcgcgtctcacctggtac

SEQ ID NO: 580259 - DNA, 20 bp, mouse
ggaggggcagacactcatgg

SEQ ID NO: 580260 - DNA, 20 bp, mouse
gggtgagacgcgctcggggt

SEQ ID NO: 580261 - DNA, 20 bp, mouse
gaggcttcccggtccttcac

SEQ ID NO: 580262 - DNA, 20 bp, mouse
gccggcagtaaggcacaggg

SEQ ID NO: 580263 - DNA, 20 bp, mouse
gaccaggtgagacgcgctcg

SEQ ID NO: 580264 - DNA, 20 bp, mouse
ggtggggacactagaggaca

SEQ ID NO: 580265 - DNA, 20 bp, mouse
gactctgcggccgcaacacc

SEQ ID NO: 580266 - DNA, 20 bp, mouse
gttcagcccagacttctaca

SEQ ID NO: 580267 - DNA, 20 bp, mouse
gcactaccctgtagaagtct

SEQ ID NO: 580268 - DNA, 20 bp, mouse
gcgagtgaaggttggagggt

SEQ ID NO: 580269 - DNA, 20 bp, mouse
ggcgccgagtgaaggttgga

SEQ ID NO: 580270 - DNA, 20 bp, mouse
ggcggagcacaaggtgccga

SEQ ID NO: 580271 - DNA, 20 bp, mouse
ggccggcgccgagtgaaggt

SEQ ID NO: 580272 - DNA, 20 bp, mouse
ggggtgccggcgccgagtga

SEQ ID NO: 580273 - DNA, 20 bp, mouse
gcgtaaggtgcgctcggagg

SEQ ID NO: 580274 - DNA, 20 bp, mouse
gcgcatggagaacttccgta

SEQ ID NO: 580275 - DNA, 20 bp, mouse
gtacacatgcgggtcaagga

SEQ ID NO: 580276 - DNA, 20 bp, mouse
gagtagacgctcgaccctca

SEQ ID NO: 580277 - DNA, 20 bp, mouse
gcatcttggctactccgtga

SEQ ID NO: 580278 - DNA, 20 bp, mouse
gacgagcacggggtgcatgg

SEQ ID NO: 580279 - DNA, 20 bp, mouse
ggagcgtctactggcgaccg

SEQ ID NO: 580280 - DNA, 20 bp, mouse
gtgggatttggctcttacca

SEQ ID NO: 580281 - DNA, 20 bp, mouse
gcccggtctgcgcgccatct

SEQ ID NO: 580282 - DNA, 20 bp, mouse
gagccaaatcccaggagatg

SEQ ID NO: 580283 - DNA, 20 bp, mouse
gtggcgggctccccaatcgt

SEQ ID NO: 580284 - DNA, 20 bp, mouse
ggtggtccgaagcagctctc

SEQ ID NO: 580285 - DNA, 20 bp, mouse
ggtccccatctcctgggatt

SEQ ID NO: 580286 - DNA, 20 bp, mouse
gtgcctgagggacaacacgg

SEQ ID NO: 580287 - DNA, 20 bp, mouse
gtgctcctgggatgtcagca

SEQ ID NO: 580288 - DNA, 20 bp, mouse
gctggcgcgcgggtgctcct

SEQ ID NO: 580289 - DNA, 20 bp, mouse
ggagtccgcgcagagccttc

SEQ ID NO: 580290 - DNA, 20 bp, mouse
gagtatcacccggatcccct

SEQ ID NO: 580291 - DNA, 20 bp, mouse
gagagcgggctcagacctga

SEQ ID NO: 580292 - DNA, 20 bp, mouse
gatctgcctgacgtccctaa

SEQ ID NO: 580293 - DNA, 20 bp, mouse
gagccaagccagtagactca

SEQ ID NO: 580294 - DNA, 20 bp, mouse
ggccgccatgctgacatccc

SEQ ID NO: 580295 - DNA, 20 bp, mouse
gtcccctgggtgagaaactc

SEQ ID NO: 580296 - DNA, 20 bp, mouse
gccccgcggagaccacgtga

SEQ ID NO: 580297 - DNA, 20 bp, mouse
gcggtctcgggaggacgaag

SEQ ID NO: 580298 - DNA, 20 bp, mouse
gcctgagcagaagcgccccg

SEQ ID NO: 580299 - DNA, 20 bp, mouse
ggacggaaggaaacccccga

SEQ ID NO: 580300 - DNA, 20 bp, mouse
gcagcaactcggtcactacc

SEQ ID NO: 580301 - DNA, 20 bp, mouse
gagtgcaggcgcacgtggag

SEQ ID NO: 580302 - DNA, 20 bp, mouse
gtcgcttcactacagcaact

SEQ ID NO: 580303 - DNA, 20 bp, mouse
gttgggaagagaccctagaa

SEQ ID NO: 580304 - DNA, 20 bp, mouse
gaagctcccgcggtctcggg

SEQ ID NO: 580305 - DNA, 20 bp, mouse
gagtgaagcgatccgtcacg

SEQ ID NO: 580306 - DNA, 20 bp, mouse
gcaggctgcaagaggcgcct

SEQ ID NO: 580307 - DNA, 20 bp, mouse
gcgggaggcgggccaagagg

SEQ ID NO: 580308 - DNA, 20 bp, mouse
gcacagaccagtaagtgccg

SEQ ID NO: 580309 - DNA, 20 bp, mouse
ggaggcgcctcggcacttac

SEQ ID NO: 580310 - DNA, 20 bp, mouse
gcttatggcgagacttatcg

SEQ ID NO: 580311 - DNA, 20 bp, mouse
gccatgttaagcaggagtcc

SEQ ID NO: 580312 - DNA, 20 bp, mouse
gctcgcaagccgaggaggtc

SEQ ID NO: 580313 - DNA, 20 bp, mouse
gtaacatggccacgctgcgc

SEQ ID NO: 580314 - DNA, 20 bp, mouse
gggtctggccgggtgaaacc

SEQ ID NO: 580315 - DNA, 20 bp, mouse
gcagcgtggccatgttaagc

SEQ ID NO: 580316 - DNA, 20 bp, mouse
gtccagcgccgcctcagaga

SEQ ID NO: 580317 - DNA, 20 bp, mouse
ggagaaggcggacatccctc

SEQ ID NO: 580318 - DNA, 20 bp, mouse
gtcggctccacggcgtagga

SEQ ID NO: 580319 - DNA, 20 bp, mouse
gatgtccgccttctctgagg

SEQ ID NO: 580320 - DNA, 20 bp, mouse
gggcgcgaacgtggttccgg

SEQ ID NO: 580321 - DNA, 20 bp, mouse
gcccctcggctccacggcgt

SEQ ID NO: 580322 - DNA, 20 bp, mouse
ggcgtaggacggcgcgaacg

SEQ ID NO: 580323 - DNA, 20 bp, mouse
gaaacctggggaaaagaccg

SEQ ID NO: 580324 - DNA, 20 bp, mouse
gggcgaggcggcgacgaggg

SEQ ID NO: 580325 - DNA, 20 bp, mouse
gaggagtccgagcagaactc

SEQ ID NO: 580326 - DNA, 20 bp, mouse
ggagccctgcagcctgtcag

SEQ ID NO: 580327 - DNA, 20 bp, mouse
gcgagctgtctgtcagtcgg

SEQ ID NO: 580328 - DNA, 20 bp, mouse
gcctccgctgacaggctgca

SEQ ID NO: 580329 - DNA, 20 bp, mouse
gccccgagctgtctgtcagt

SEQ ID NO: 580330 - DNA, 20 bp, mouse
gcggaggcctgggccgagtg

SEQ ID NO: 580331 - DNA, 20 bp, mouse
gcgggccgcccgatgagacg

SEQ ID NO: 580332 - DNA, 20 bp, mouse
gacagctcggggtaccaggt

SEQ ID NO: 580333 - DNA, 20 bp, mouse
gggcccaggcctccgctgac

SEQ ID NO: 580334 - DNA, 20 bp, mouse
gcctggccggctagaagtca

SEQ ID NO: 580335 - DNA, 20 bp, mouse
gagcctgtcagcggaggcct

SEQ ID NO: 580336 - DNA, 20 bp, mouse
ggaggcgcttgtgcaaaccg

SEQ ID NO: 580337 - DNA, 20 bp, mouse
gcctgcggacgaggccgacg

SEQ ID NO: 580338 - DNA, 20 bp, mouse
gccggagccacttcatccaa

SEQ ID NO: 580339 - DNA, 20 bp, mouse
ggcccccacactcacatctc

SEQ ID NO: 580340 - DNA, 20 bp, mouse
gcagtcggtgaccaacacca

SEQ ID NO: 580341 - DNA, 20 bp, mouse
gctagcccagactccatcct

SEQ ID NO: 580342 - DNA, 20 bp, mouse
gcgatccaacgaagactcca

SEQ ID NO: 580343 - DNA, 20 bp, mouse
gcaaggtcacgccaaatgtg

SEQ ID NO: 580344 - DNA, 20 bp, mouse
gacaagcgcctctggtcctc

SEQ ID NO: 580345 - DNA, 20 bp, mouse
gcgtctaccattggatgaag

SEQ ID NO: 580346 - DNA, 20 bp, mouse
gccgggaacgagcactgcct

SEQ ID NO: 580347 - DNA, 20 bp, mouse
ggcgcacaggagccagcttg

SEQ ID NO: 580348 - DNA, 20 bp, mouse
gcttgcggcgcgccctgaag

SEQ ID NO: 580349 - DNA, 20 bp, mouse
gtgggcagaacacagcgcac

SEQ ID NO: 580350 - DNA, 20 bp, mouse
gtgtctcaagaacctcttca

SEQ ID NO: 580351 - DNA, 20 bp, mouse
ggaggttcttgagacactta

SEQ ID NO: 580352 - DNA, 20 bp, mouse
ggggaaggcgaggatcggag

SEQ ID NO: 580353 - DNA, 20 bp, mouse
gctgggcaaccagaccgacg

SEQ ID NO: 580354 - DNA, 20 bp, mouse
gcggacctgggactttgaaa

SEQ ID NO: 580355 - DNA, 20 bp, mouse
gccctcggcgaagccatcgt

SEQ ID NO: 580356 - DNA, 20 bp, mouse
gggcgactgccacgcactgt

SEQ ID NO: 580357 - DNA, 20 bp, mouse
gggtttcccgctggggaggt

SEQ ID NO: 580358 - DNA, 20 bp, mouse
gacccttgcgccaggaggag

SEQ ID NO: 580359 - DNA, 20 bp, mouse
gggacgcgcccgggagctgg

SEQ ID NO: 580360 - DNA, 20 bp, mouse
gccccccccaggcaccacgc

SEQ ID NO: 580361 - DNA, 20 bp, mouse
ggcgttctcagacccccccc

SEQ ID NO: 580362 - DNA, 20 bp, mouse
gagtgcgtggcagtcgccca

SEQ ID NO: 580363 - DNA, 20 bp, mouse
gcagcgggaaaccggcggcc

SEQ ID NO: 580364 - DNA, 20 bp, mouse
gctggcgcaagggtaatcca

SEQ ID NO: 580365 - DNA, 20 bp, mouse
ggtccgcctacctccccagc

SEQ ID NO: 580366 - DNA, 20 bp, mouse
gacgccggaggaactcaccg

SEQ ID NO: 580367 - DNA, 20 bp, mouse
gccggaggaactcaccgcgg

SEQ ID NO: 580368 - DNA, 20 bp, mouse
gggaggacgcgggccctcaa

SEQ ID NO: 580369 - DNA, 20 bp, mouse
gacagatggagcccggacgc

SEQ ID NO: 580370 - DNA, 20 bp, mouse
gaagaccggcgtcccgatgg

SEQ ID NO: 580371 - DNA, 20 bp, mouse
gagctccggacacaactcac

SEQ ID NO: 580372 - DNA, 20 bp, mouse
gcagagaccggagggtagca

SEQ ID NO: 580373 - DNA, 20 bp, mouse
ggcactgccgagggcacccc

SEQ ID NO: 580374 - DNA, 20 bp, mouse
gcggcagtgcctgaggagtg

SEQ ID NO: 580375 - DNA, 20 bp, mouse
gaggtaacgcagagaccgga

SEQ ID NO: 580376 - DNA, 20 bp, mouse
gggtaggtgcaggtagtctc

SEQ ID NO: 580377 - DNA, 20 bp, mouse
ggccggtctcgggacggctg

SEQ ID NO: 580378 - DNA, 20 bp, mouse
gggagctgacaagaaaactg

SEQ ID NO: 580379 - DNA, 20 bp, mouse
gctttttccagcctccgcct

SEQ ID NO: 580380 - DNA, 20 bp, mouse
gcaggtagtctcggggacac

SEQ ID NO: 580381 - DNA, 20 bp, mouse
gatgcctaagcaccccgagc

SEQ ID NO: 580382 - DNA, 20 bp, mouse
gtcgggacggctgcggcgca

SEQ ID NO: 580383 - DNA, 20 bp, mouse
gatttttgtctgccagctcg

SEQ ID NO: 580384 - DNA, 20 bp, mouse
gttaggcatcaacatcgcgg

SEQ ID NO: 580385 - DNA, 20 bp, mouse
gcctctaaactggaactcag

SEQ ID NO: 580386 - DNA, 20 bp, mouse
gtattcaccacgcgaggtcg

SEQ ID NO: 580387 - DNA, 20 bp, mouse
gtcaccacgcgaggtcgggg

SEQ ID NO: 580388 - DNA, 20 bp, mouse
gctccacaccgaagcgtcgg

SEQ ID NO: 580389 - DNA, 20 bp, mouse
gtcaggcggctcggaaatcc

SEQ ID NO: 580390 - DNA, 20 bp, mouse
ggcgggaggagggcatcctg

SEQ ID NO: 580391 - DNA, 20 bp, mouse
gcgggctctacgcagtaatg

SEQ ID NO: 580392 - DNA, 20 bp, mouse
gcgtagagcgcacgaggtcc

SEQ ID NO: 580393 - DNA, 20 bp, mouse
gctgcggcgcgggagtcctg

SEQ ID NO: 580394 - DNA, 20 bp, mouse
gcggcagagccggggacact

SEQ ID NO: 580395 - DNA, 20 bp, mouse
gctgagacgaaggcattcgc

SEQ ID NO: 580396 - DNA, 20 bp, mouse
gcatgcgcacagaagtcgag

SEQ ID NO: 580397 - DNA, 20 bp, mouse
gcaccgccatggccgaggaa

SEQ ID NO: 580398 - DNA, 20 bp, mouse
ggcgcggaggcggaagctcg

SEQ ID NO: 580399 - DNA, 20 bp, mouse
ggccggcggtggccgcatga

SEQ ID NO: 580400 - DNA, 20 bp, mouse
gcaggggaaaaggccggcgg

SEQ ID NO: 580401 - DNA, 20 bp, mouse
gtaggaccctcggcaggcta

SEQ ID NO: 580402 - DNA, 20 bp, mouse
gccggagccacctctttagt

SEQ ID NO: 580403 - DNA, 20 bp, mouse
gacagagacgttaggaccct

SEQ ID NO: 580404 - DNA, 20 bp, mouse
gccctcggcaggctagggat

SEQ ID NO: 580405 - DNA, 20 bp, mouse
ggagccacctctttagtggg

SEQ ID NO: 580406 - DNA, 20 bp, mouse
ggagagaacgaggtaggaaa

SEQ ID NO: 580407 - DNA, 20 bp, mouse
ggcgtccccacggtgagtag

SEQ ID NO: 580408 - DNA, 20 bp, mouse
gcccgcgcgagagcaaacgt

SEQ ID NO: 580409 - DNA, 20 bp, mouse
gactcaccgtggggacgcta

SEQ ID NO: 580410 - DNA, 20 bp, mouse
gagtggcgtcacttcctgtg

SEQ ID NO: 580411 - DNA, 20 bp, mouse
gccagccccgcaaccaaggt

SEQ ID NO: 580412 - DNA, 20 bp, mouse
ggtagaggctgagggttgga

SEQ ID NO: 580413 - DNA, 20 bp, mouse
gacgctcccgggtgagcccg

SEQ ID NO: 580414 - DNA, 20 bp, mouse
gtaccgccgtagcgtcccca

SEQ ID NO: 580415 - DNA, 20 bp, mouse
gttaggatgagagagcacgg

SEQ ID NO: 580416 - DNA, 20 bp, mouse
gtggagacgacgatcaggta

SEQ ID NO: 580417 - DNA, 20 bp, mouse
gagacgacgatcaggtaggg

SEQ ID NO: 580418 - DNA, 20 bp, mouse
ggagtctggagacgacgatc

SEQ ID NO: 580419 - DNA, 20 bp, mouse
gtccaccggaaagagagagg

SEQ ID NO: 580420 - DNA, 20 bp, mouse
gtcctccaccggaaagagag

SEQ ID NO: 580421 - DNA, 20 bp, mouse
gtccgcctctctctttccgg

SEQ ID NO: 580422 - DNA, 20 bp, mouse
gcgatcaggtagggaggctt

SEQ ID NO: 580423 - DNA, 20 bp, mouse
gttgggccttgagaatcgtg

SEQ ID NO: 580424 - DNA, 20 bp, mouse
gagaggccgccaccgggaca

SEQ ID NO: 580425 - DNA, 20 bp, mouse
gggatgccgcacgattctca

SEQ ID NO: 580426 - DNA, 20 bp, mouse
gaggatggcgacggataccc

SEQ ID NO: 580427 - DNA, 20 bp, mouse
gcttgcgaaagggccccggg

SEQ ID NO: 580428 - DNA, 20 bp, mouse
gtactcggaaaaggaagtac

SEQ ID NO: 580429 - DNA, 20 bp, mouse
gagtcttgcgaaagggcccc

SEQ ID NO: 580430 - DNA, 20 bp, mouse
ggccgcgctcctctaagcta

SEQ ID NO: 580431 - DNA, 20 bp, mouse
gcacggcggtctgtgctccc

SEQ ID NO: 580432 - DNA, 20 bp, mouse
gcgcgagtcggggttagcag

SEQ ID NO: 580433 - DNA, 20 bp, mouse
gggtgagtattcgtgcacgg

SEQ ID NO: 580434 - DNA, 20 bp, mouse
gcctctaagctacggcggac

SEQ ID NO: 580435 - DNA, 20 bp, mouse
ggatggtgagtattcgtgca

SEQ ID NO: 580436 - DNA, 20 bp, mouse
gactcaccggcgagggaaga

SEQ ID NO: 580437 - DNA, 20 bp, mouse
ggataccacacggatgaaca

SEQ ID NO: 580438 - DNA, 20 bp, mouse
ggagctcccgcagacaccgg

SEQ ID NO: 580439 - DNA, 20 bp, mouse
gaacactcactcaccggcga

SEQ ID NO: 580440 - DNA, 20 bp, mouse
gcgaacacggggtaaaggga

SEQ ID NO: 580441 - DNA, 20 bp, mouse
gtccctaactcggcagtgag

SEQ ID NO: 580442 - DNA, 20 bp, mouse
gacggccgcgtgggacactc

SEQ ID NO: 580443 - DNA, 20 bp, mouse
ggagttagggaaccacgtcg

SEQ ID NO: 580444 - DNA, 20 bp, mouse
gttctgccatcttccctcgc

SEQ ID NO: 580445 - DNA, 20 bp, mouse
gggcaaacgcacggaattat

SEQ ID NO: 580446 - DNA, 20 bp, mouse
gacgcaaggtgtgccagggg

SEQ ID NO: 580447 - DNA, 20 bp, mouse
gtccgggtggcgagacggaa

SEQ ID NO: 580448 - DNA, 20 bp, mouse
gggaaggccccgggatgata

SEQ ID NO: 580449 - DNA, 20 bp, mouse
gccaggggcggcatagaaag

SEQ ID NO: 580450 - DNA, 20 bp, mouse
gcggacgcaaggtgtgccag

SEQ ID NO: 580451 - DNA, 20 bp, mouse
gtcgcggtagaccttaacct

SEQ ID NO: 580452 - DNA, 20 bp, mouse
gaagggcgagggagacggcg

SEQ ID NO: 580453 - DNA, 20 bp, mouse
ggggcggcatagaaagaggt

SEQ ID NO: 580454 - DNA, 20 bp, mouse
gccgggatgatagggagttg

SEQ ID NO: 580455 - DNA, 20 bp, mouse
gagtacaaggtgttggggtc

SEQ ID NO: 580456 - DNA, 20 bp, mouse
ggccgcgacgagcggaggat

SEQ ID NO: 580457 - DNA, 20 bp, mouse
gggatgggcgaggattgaaa

SEQ ID NO: 580458 - DNA, 20 bp, mouse
gggtaggtgtttggctccca

SEQ ID NO: 580459 - DNA, 20 bp, mouse
ggacttgaggccgcgacgag

SEQ ID NO: 580460 - DNA, 20 bp, mouse
ggcgaacgcggccctgaggg

SEQ ID NO: 580461 - DNA, 20 bp, mouse
ggcggccctgagggtggaga

SEQ ID NO: 580462 - DNA, 20 bp, mouse
gagccaaacacctaccatgt

SEQ ID NO: 580463 - DNA, 20 bp, mouse
gttgaggccgcgacgagcgg

SEQ ID NO: 580464 - DNA, 20 bp, mouse
ggcctcaagtccgcagcgag

SEQ ID NO: 580465 - DNA, 20 bp, mouse
gcggcgccggcccctcgctg

SEQ ID NO: 580466 - DNA, 20 bp, mouse
ggattccgctcttaccatgg

SEQ ID NO: 580467 - DNA, 20 bp, mouse
ggccgccgccatggtaagag

SEQ ID NO: 580468 - DNA, 20 bp, mouse
gtccgctcttaccatggcgg

SEQ ID NO: 580469 - DNA, 20 bp, mouse
ggcggattccgctcttacca

SEQ ID NO: 580470 - DNA, 20 bp, mouse
gccgctctctcttccacagg

SEQ ID NO: 580471 - DNA, 20 bp, mouse
gatgtcgcaggatcccggcg

SEQ ID NO: 580472 - DNA, 20 bp, mouse
gctccgatgtcgcaggatcc

SEQ ID NO: 580473 - DNA, 20 bp, mouse
gaagaggagcgagcattcct

SEQ ID NO: 580474 - DNA, 20 bp, mouse
gtcctgcgacatcggagccg

SEQ ID NO: 580475 - DNA, 20 bp, mouse
ggatggagtgtgacccgaga

SEQ ID NO: 580476 - DNA, 20 bp, mouse
gccaggggaaagggaacgac

SEQ ID NO: 580477 - DNA, 20 bp, mouse
gacgtggccgcggctccaga

SEQ ID NO: 580478 - DNA, 20 bp, mouse
gtttcccgggcgcacaagtc

SEQ ID NO: 580479 - DNA, 20 bp, mouse
ggagtgagggctctgggtcg

SEQ ID NO: 580480 - DNA, 20 bp, mouse
gagtgggacgcccggaacgt

SEQ ID NO: 580481 - DNA, 20 bp, mouse
gcgagagcggctaaaccaga

SEQ ID NO: 580482 - DNA, 20 bp, mouse
gagccgcggccacgtgcgag

SEQ ID NO: 580483 - DNA, 20 bp, mouse
gtgaggctgggtggatgctg

SEQ ID NO: 580484 - DNA, 20 bp, mouse
gacgcccgacttgtgcgccc

SEQ ID NO: 580485 - DNA, 20 bp, mouse
gtgacctggacccacgtcag

SEQ ID NO: 580486 - DNA, 20 bp, mouse
ggcggggctcggaaacatgt

SEQ ID NO: 580487 - DNA, 20 bp, mouse
ggaagtagctcgccgcgtgt

SEQ ID NO: 580488 - DNA, 20 bp, mouse
ggggctcggaaacatgtcgg

SEQ ID NO: 580489 - DNA, 20 bp, mouse
gcgaggagcgaacaccgcca

SEQ ID NO: 580490 - DNA, 20 bp, mouse
gagcttctggcggcgtccga

SEQ ID NO: 580491 - DNA, 20 bp, mouse
gcatgtcggcggcgttagtg

SEQ ID NO: 580492 - DNA, 20 bp, mouse
gctggcggcgtccgagggtg

SEQ ID NO: 580493 - DNA, 20 bp, mouse
ggcgttagtgcggcgcggtt

SEQ ID NO: 580494 - DNA, 20 bp, mouse
gccggcgaagcggacccgga

SEQ ID NO: 580495 - DNA, 20 bp, mouse
gggagcgaacaccgccaggg

SEQ ID NO: 580496 - DNA, 20 bp, mouse
gggatgtccacggattccca

SEQ ID NO: 580497 - DNA, 20 bp, mouse
gagagggaggcgccgcggaa

SEQ ID NO: 580498 - DNA, 20 bp, mouse
gcctgggccgtgggaatccg

SEQ ID NO: 580499 - DNA, 20 bp, mouse
ggtgtctgtccggatgtcca

SEQ ID NO: 580500 - DNA, 20 bp, mouse
ggaagaagagggaggcgccg

SEQ ID NO: 580501 - DNA, 20 bp, mouse
gagtctatgttgctgggacc

SEQ ID NO: 580502 - DNA, 20 bp, mouse
gagcagaacgctaggctgtg

SEQ ID NO: 580503 - DNA, 20 bp, mouse
gcgagaggcagccctttgac

SEQ ID NO: 580504 - DNA, 20 bp, mouse
gggaagaagacaccagtcaa

SEQ ID NO: 580505 - DNA, 20 bp, mouse
gcacgtgagtctatgttgct

SEQ ID NO: 580506 - DNA, 20 bp, mouse
ggaggccacccacctttgga

SEQ ID NO: 580507 - DNA, 20 bp, mouse
ggggtaggtggtcatgaagt

SEQ ID NO: 580508 - DNA, 20 bp, mouse
gaattgaggccacccacctt

SEQ ID NO: 580509 - DNA, 20 bp, mouse
ggtcatgaagtaggttccag

SEQ ID NO: 580510 - DNA, 20 bp, mouse
gacccttagcttccctccaa

SEQ ID NO: 580511 - DNA, 20 bp, mouse
gtagctgtcagccacaacca

SEQ ID NO: 580512 - DNA, 20 bp, mouse
ggcctcaattcagtagtcta

SEQ ID NO: 580513 - DNA, 20 bp, mouse
gtccatagactactgaattg

SEQ ID NO: 580514 - DNA, 20 bp, mouse
gagcggctcctccactgact

SEQ ID NO: 580515 - DNA, 20 bp, mouse
gtctggagcagagctgtgat

SEQ ID NO: 580516 - DNA, 20 bp, mouse
gcctcagcaggagcgaacag

SEQ ID NO: 580517 - DNA, 20 bp, mouse
ggccggggctcagaaaggag

SEQ ID NO: 580518 - DNA, 20 bp, mouse
ggtcagtacgatgctcgggg

SEQ ID NO: 580519 - DNA, 20 bp, mouse
ggcaccgccggggctcagaa

SEQ ID NO: 580520 - DNA, 20 bp, mouse
ggacgccccccacctcacca

SEQ ID NO: 580521 - DNA, 20 bp, mouse
gcgccgggagcgcagagccc

SEQ ID NO: 580522 - DNA, 20 bp, mouse
ggagcgcagagcccgggaga

SEQ ID NO: 580523 - DNA, 20 bp, mouse
gcggtgagtcaggacggagc

SEQ ID NO: 580524 - DNA, 20 bp, mouse
ggagtcaggacggagcaggc

SEQ ID NO: 580525 - DNA, 20 bp, mouse
gtccgtagcgcgcaccgccg

SEQ ID NO: 580526 - DNA, 20 bp, mouse
ggagcaggtaggcctcggtg

SEQ ID NO: 580527 - DNA, 20 bp, mouse
gtcgcacacagcccgcaccg

SEQ ID NO: 580528 - DNA, 20 bp, mouse
ggtgcctccgcagcactatt

SEQ ID NO: 580529 - DNA, 20 bp, mouse
gctgcccaatagtgctgcgg

SEQ ID NO: 580530 - DNA, 20 bp, mouse
gcctgcgtggtaactctgca

SEQ ID NO: 580531 - DNA, 20 bp, mouse
gctcctgcccaatagtgctg

SEQ ID NO: 580532 - DNA, 20 bp, mouse
ggggctgggcgcagttgggg

SEQ ID NO: 580533 - DNA, 20 bp, mouse
gtgcgggctgtgtgcgagcg

SEQ ID NO: 580534 - DNA, 20 bp, mouse
ggcactattgggcaggaggg

SEQ ID NO: 580535 - DNA, 20 bp, mouse
gaccacgcaggtcttgagac

SEQ ID NO: 580536 - DNA, 20 bp, mouse
ggcaagatgggtgagctgtg

SEQ ID NO: 580537 - DNA, 20 bp, mouse
ggagctctagagccctgcgg

SEQ ID NO: 580538 - DNA, 20 bp, mouse
gtcccggcaaggccgcccga

SEQ ID NO: 580539 - DNA, 20 bp, mouse
ggcttcccgcaatgccttgt

SEQ ID NO: 580540 - DNA, 20 bp, mouse
gcggagctgcacacaaaccc

SEQ ID NO: 580541 - DNA, 20 bp, mouse
gtcgggatacggcctatcgt

SEQ ID NO: 580542 - DNA, 20 bp, mouse
gggagatagagcggagagta

SEQ ID NO: 580543 - DNA, 20 bp, mouse
gctatcgtggggagatagag

SEQ ID NO: 580544 - DNA, 20 bp, mouse
gcccagccgaaggccccgtg

SEQ ID NO: 580545 - DNA, 20 bp, mouse
gagggtaatgggtcccggca

SEQ ID NO: 580546 - DNA, 20 bp, mouse
gtccggcgccgtagccatca

SEQ ID NO: 580547 - DNA, 20 bp, mouse
gggatagtgctgagagcccg

SEQ ID NO: 580548 - DNA, 20 bp, mouse
gagactcaccatgatggcta

SEQ ID NO: 580549 - DNA, 20 bp, mouse
gggatggcgcggataagcga

SEQ ID NO: 580550 - DNA, 20 bp, mouse
gcatcatggtgagtctcctc

SEQ ID NO: 580551 - DNA, 20 bp, mouse
gtctagtggggtccccgaac

SEQ ID NO: 580552 - DNA, 20 bp, mouse
ggtccccgaacaggcaggga

SEQ ID NO: 580553 - DNA, 20 bp, mouse
gatgattggtcggcagtgag

SEQ ID NO: 580554 - DNA, 20 bp, mouse
gtgcccctgaagctccacag

SEQ ID NO: 580555 - DNA, 20 bp, mouse
gggatggctgcagctctagt

SEQ ID NO: 580556 - DNA, 20 bp, mouse
gccccggaagtactctctcg

SEQ ID NO: 580557 - DNA, 20 bp, mouse
ggagcacatggacacgatgg

SEQ ID NO: 580558 - DNA, 20 bp, mouse
gaccctcgcgggccttacca

SEQ ID NO: 580559 - DNA, 20 bp, mouse
gaagtactctctcgaggcag

SEQ ID NO: 580560 - DNA, 20 bp, mouse
gctgggattgttgggccacc

SEQ ID NO: 580561 - DNA, 20 bp, mouse
gaggtggaggcgaccctaca

SEQ ID NO: 580562 - DNA, 20 bp, mouse
gccggagcacatggacacga

SEQ ID NO: 580563 - DNA, 20 bp, mouse
ggccatggtaaggcccgcga

SEQ ID NO: 580564 - DNA, 20 bp, mouse
gtggcggcagccgcccggag

SEQ ID NO: 580565 - DNA, 20 bp, mouse
ggcgggcctgcctctccggg

SEQ ID NO: 580566 - DNA, 20 bp, mouse
gcgcgcgggcctgggtactg

SEQ ID NO: 580567 - DNA, 20 bp, mouse
gggcccgcgcgctcaccacg

SEQ ID NO: 580568 - DNA, 20 bp, mouse
gggcggcggccggccaggaa

SEQ ID NO: 580569 - DNA, 20 bp, mouse
ggactcgaaagaggatccgg

SEQ ID NO: 580570 - DNA, 20 bp, mouse
ggtagaagtagatctatgga

SEQ ID NO: 580571 - DNA, 20 bp, mouse
gtggggtagaagtagatcta

SEQ ID NO: 580572 - DNA, 20 bp, mouse
gagtagatctatggacggta

SEQ ID NO: 580573 - DNA, 20 bp, mouse
ggatggtgagtgtcgccgcg

SEQ ID NO: 580574 - DNA, 20 bp, mouse
gagagacgctattggaaagg

SEQ ID NO: 580575 - DNA, 20 bp, mouse
gtacttctaccccagtaccc

SEQ ID NO: 580576 - DNA, 20 bp, mouse
ggaatcgatcccgcgaagcc

SEQ ID NO: 580577 - DNA, 20 bp, mouse
gcggtccttccgggcttcgc

SEQ ID NO: 580578 - DNA, 20 bp, mouse
gcgatcccgcgaagcccgga

SEQ ID NO: 580579 - DNA, 20 bp, mouse
gttttttctctttcgagtct

SEQ ID NO: 580580 - DNA, 20 bp, mouse
gtctatgaattaaaagtaat

SEQ ID NO: 580581 - DNA, 20 bp, mouse
ggggggtgttcggtccttcc

SEQ ID NO: 580582 - DNA, 20 bp, mouse
ggcagcttgacatagagctt

SEQ ID NO: 580583 - DNA, 20 bp, mouse
gcgccagcaggtctgaatcg

SEQ ID NO: 580584 - DNA, 20 bp, mouse
gcaggtctgaatcgtggtgg

SEQ ID NO: 580585 - DNA, 20 bp, mouse
gctaacaaccttgctatgga

SEQ ID NO: 580586 - DNA, 20 bp, mouse
gcgctttcgctcctttccgg

SEQ ID NO: 580587 - DNA, 20 bp, mouse
gtcagccgcgtagacgggag

SEQ ID NO: 580588 - DNA, 20 bp, mouse
gctcacaggcatgttctcgt

SEQ ID NO: 580589 - DNA, 20 bp, mouse
gtctgtcgaaacctggacca

SEQ ID NO: 580590 - DNA, 20 bp, mouse
ggctacgcagacaccagggg

SEQ ID NO: 580591 - DNA, 20 bp, mouse
gttagcgcaagaggaccgtg

SEQ ID NO: 580592 - DNA, 20 bp, mouse
gcgcgtagacgggagcggag

SEQ ID NO: 580593 - DNA, 20 bp, mouse
ggcgcacatgtggaccctgt

SEQ ID NO: 580594 - DNA, 20 bp, mouse
gagacaccaggggcggcgag

SEQ ID NO: 580595 - DNA, 20 bp, mouse
gcctcggtgtgtgccagtgg

SEQ ID NO: 580596 - DNA, 20 bp, mouse
gcgctacgcgtcgctctcac

SEQ ID NO: 580597 - DNA, 20 bp, mouse
ggtggccgcgctctggctag

SEQ ID NO: 580598 - DNA, 20 bp, mouse
gtcgctctcacgggtgtcgt

SEQ ID NO: 580599 - DNA, 20 bp, mouse
gagcatacactcacccacga

SEQ ID NO: 580600 - DNA, 20 bp, mouse
gggaagccaaggcctgactg

SEQ ID NO: 580601 - DNA, 20 bp, mouse
gatacactcacccacgatgg

SEQ ID NO: 580602 - DNA, 20 bp, mouse
gtcccgagtggcgaaatgta

SEQ ID NO: 580603 - DNA, 20 bp, mouse
gcccataccagggcgagcga

SEQ ID NO: 580604 - DNA, 20 bp, mouse
gaacactaagggcctcagtc

SEQ ID NO: 580605 - DNA, 20 bp, mouse
ggagtggcgaaatgtagggt

SEQ ID NO: 580606 - DNA, 20 bp, mouse
gtcgtctcggcgacctggag

SEQ ID NO: 580607 - DNA, 20 bp, mouse
ggaaagcgagcagttcgtct

SEQ ID NO: 580608 - DNA, 20 bp, mouse
gcggggtggagtgaacgtgt

SEQ ID NO: 580609 - DNA, 20 bp, mouse
gcccggggctccacatccaa

SEQ ID NO: 580610 - DNA, 20 bp, mouse
gactcacgcgagcccggaca

SEQ ID NO: 580611 - DNA, 20 bp, mouse
ggctgggagctgcaccccac

SEQ ID NO: 580612 - DNA, 20 bp, mouse
ggcaacttccgggatagagg

SEQ ID NO: 580613 - DNA, 20 bp, mouse
gaaacttacgggcatggtga

SEQ ID NO: 580614 - DNA, 20 bp, mouse
gcagcgctcgggcagcatat

SEQ ID NO: 580615 - DNA, 20 bp, mouse
gtctatcccggaagttgctg

SEQ ID NO: 580616 - DNA, 20 bp, mouse
gcatcaagctggctagggtg

SEQ ID NO: 580617 - DNA, 20 bp, mouse
ggctagggtgaggcgactgc

SEQ ID NO: 580618 - DNA, 20 bp, mouse
ggtgcacgcaggtgagtgat

SEQ ID NO: 580619 - DNA, 20 bp, mouse
gccgctccgaccccaggaag

SEQ ID NO: 580620 - DNA, 20 bp, mouse
gggttacctacaggaaataa

SEQ ID NO: 580621 - DNA, 20 bp, mouse
gagaggagtcacgtgagcag

SEQ ID NO: 580622 - DNA, 20 bp, mouse
gctagtagctaggttcaggg

SEQ ID NO: 580623 - DNA, 20 bp, mouse
gacattcggaccacttcctg

SEQ ID NO: 580624 - DNA, 20 bp, mouse
gttcaaaggcagtcttacta

SEQ ID NO: 580625 - DNA, 20 bp, mouse
gggtcagagccgactataaa

SEQ ID NO: 580626 - DNA, 20 bp, mouse
gggaacgagtcggctcgcgc

SEQ ID NO: 580627 - DNA, 20 bp, mouse
gtaatggagccgccacagta

SEQ ID NO: 580628 - DNA, 20 bp, mouse
gggagtgctgtaccttactg

SEQ ID NO: 580629 - DNA, 20 bp, mouse
gtagagggaagggccattgt

SEQ ID NO: 580630 - DNA, 20 bp, mouse
ggtgctgccgtcgccattac

SEQ ID NO: 580631 - DNA, 20 bp, mouse
gccgtccacgatgcacacag

SEQ ID NO: 580632 - DNA, 20 bp, mouse
gtggagcagacgcggctggg

SEQ ID NO: 580633 - DNA, 20 bp, mouse
ggaaattcaaggcccgcggg

SEQ ID NO: 580634 - DNA, 20 bp, mouse
gggccctgctgcgggtggtg

SEQ ID NO: 580635 - DNA, 20 bp, mouse
gtgtggagaccgcggttaga

SEQ ID NO: 580636 - DNA, 20 bp, mouse
ggcgcgcggctgcaagatgg

SEQ ID NO: 580637 - DNA, 20 bp, mouse
gcgcgcgccgctgaaaggaa

SEQ ID NO: 580638 - DNA, 20 bp, mouse
ggcacttgtagaacccgcgg

SEQ ID NO: 580639 - DNA, 20 bp, mouse
ggcggcgcgcggctgcaaga

SEQ ID NO: 580640 - DNA, 20 bp, mouse
gctggcacttgtagaacccg

SEQ ID NO: 580641 - DNA, 20 bp, mouse
gaagaggaaggtaagcgtct

SEQ ID NO: 580642 - DNA, 20 bp, mouse
ggcagccgcgcgccgctgaa

SEQ ID NO: 580643 - DNA, 20 bp, mouse
gtaagcgtctgggcccggtt

SEQ ID NO: 580644 - DNA, 20 bp, mouse
ggatcacgcgactaagagaa

SEQ ID NO: 580645 - DNA, 20 bp, mouse
gcgcggcggactcccgaacc

SEQ ID NO: 580646 - DNA, 20 bp, mouse
gcggaagggcgaaagagcaa

SEQ ID NO: 580647 - DNA, 20 bp, mouse
ggggctccgcaggagttggt

SEQ ID NO: 580648 - DNA, 20 bp, mouse
gacccggccgggtggcggag

SEQ ID NO: 580649 - DNA, 20 bp, mouse
ggcagggcggagatcacacg

SEQ ID NO: 580650 - DNA, 20 bp, mouse
gagagcaagggtcacgtaga

SEQ ID NO: 580651 - DNA, 20 bp, mouse
gcaactcctgcggagcccaa

SEQ ID NO: 580652 - DNA, 20 bp, mouse
gctgggttgctggaagtccg

SEQ ID NO: 580653 - DNA, 20 bp, mouse
gcggctggcgggtgcgtccc

SEQ ID NO: 580654 - DNA, 20 bp, mouse
ggcgcgaactgtgggctcct

SEQ ID NO: 580655 - DNA, 20 bp, mouse
gagcgactgctagagacgca

SEQ ID NO: 580656 - DNA, 20 bp, mouse
gtcccttttggctctccagt

SEQ ID NO: 580657 - DNA, 20 bp, mouse
gaaattttgatgttcccttt

SEQ ID NO: 580658 - DNA, 20 bp, mouse
ggccgactggagagccaaaa

SEQ ID NO: 580659 - DNA, 20 bp, mouse
gggctctccagtcggcacca

SEQ ID NO: 580660 - DNA, 20 bp, mouse
ggtgctccatggtcaagaag

SEQ ID NO: 580661 - DNA, 20 bp, mouse
gtaatcactgaggacgttca

SEQ ID NO: 580662 - DNA, 20 bp, mouse
gcgggaagacactagtcacg

SEQ ID NO: 580663 - DNA, 20 bp, mouse
ggtctgccacttcttgacca

SEQ ID NO: 580664 - DNA, 20 bp, mouse
gatgttcctaatattgaaca

SEQ ID NO: 580665 - DNA, 20 bp, mouse
gacttgctggtgctgcgcat

SEQ ID NO: 580666 - DNA, 20 bp, mouse
gttgccctgaacgtcctcag

SEQ ID NO: 580667 - DNA, 20 bp, mouse
ggttgtagcttttggctctc

SEQ ID NO: 580668 - DNA, 20 bp, mouse
gaaaatgcagttgtagcttt

SEQ ID NO: 580669 - DNA, 20 bp, mouse
gtagcttttggctctccggt

SEQ ID NO: 580670 - DNA, 20 bp, mouse
gaaattcaagctaaccactg

SEQ ID NO: 580671 - DNA, 20 bp, mouse
ggtgctccatggtcaagaag

SEQ ID NO: 580672 - DNA, 20 bp, mouse
gtaaccactgaggacgttca

SEQ ID NO: 580673 - DNA, 20 bp, mouse
gcgggaagacactagtcacg

SEQ ID NO: 580674 - DNA, 20 bp, mouse
ggtctgccacttcttgacca

SEQ ID NO: 580675 - DNA, 20 bp, mouse
gatgttcctaatattgaaca

SEQ ID NO: 580676 - DNA, 20 bp, mouse
gtcctagcgcagccatggta

SEQ ID NO: 580677 - DNA, 20 bp, mouse
gcgcagccatggtaaggcag

SEQ ID NO: 580678 - DNA, 20 bp, mouse
gacccgggcagcatcggtca

SEQ ID NO: 580679 - DNA, 20 bp, mouse
gctgtacccctgccttacca

SEQ ID NO: 580680 - DNA, 20 bp, mouse
gaggggtacagcgagctctt

SEQ ID NO: 580681 - DNA, 20 bp, mouse
gcgggcagcatcggtcaggg

SEQ ID NO: 580682 - DNA, 20 bp, mouse
gcagcatcggtcagggagga

SEQ ID NO: 580683 - DNA, 20 bp, mouse
gtggcggcaagggagaatac

SEQ ID NO: 580684 - DNA, 20 bp, mouse
ggcgagctcttgggttgcat

SEQ ID NO: 580685 - DNA, 20 bp, mouse
gtactggtctgagctaggat

SEQ ID NO: 580686 - DNA, 20 bp, mouse
ggccatggcggaggagcaag

SEQ ID NO: 580687 - DNA, 20 bp, mouse
gggctcaagtacgccctgac

SEQ ID NO: 580688 - DNA, 20 bp, mouse
gggacggggcgcgaacacac

SEQ ID NO: 580689 - DNA, 20 bp, mouse
gccagctgggtaggccacat

SEQ ID NO: 580690 - DNA, 20 bp, mouse
ggcgggccggcagacggacg

SEQ ID NO: 580691 - DNA, 20 bp, mouse
gctccttcccagagcacaag

SEQ ID NO: 580692 - DNA, 20 bp, mouse
gtcatcagcatcgacaagag

SEQ ID NO: 580693 - DNA, 20 bp, mouse
gtccatgaagccagctgggt

SEQ ID NO: 580694 - DNA, 20 bp, mouse
gctcactccgcttgtgctct

SEQ ID NO: 580695 - DNA, 20 bp, mouse
gcgtcgtgcgtgacgaggtg

SEQ ID NO: 580696 - DNA, 20 bp, mouse
gtcacctgagggcgcagact

SEQ ID NO: 580697 - DNA, 20 bp, mouse
ggcgccgccctgatacagac

SEQ ID NO: 580698 - DNA, 20 bp, mouse
gcctcttcctgtctgtatca

SEQ ID NO: 580699 - DNA, 20 bp, mouse
ggcccgtgccgagtttccct

SEQ ID NO: 580700 - DNA, 20 bp, mouse
ggggacacggagttcagaag

SEQ ID NO: 580701 - DNA, 20 bp, mouse
gcttcctgtctgtatcaggg

SEQ ID NO: 580702 - DNA, 20 bp, mouse
gccctcaggtgaggctgcgg

SEQ ID NO: 580703 - DNA, 20 bp, mouse
gaagggtgcctagggaaact

SEQ ID NO: 580704 - DNA, 20 bp, mouse
gaggaagaggccgcgcgcag

SEQ ID NO: 580705 - DNA, 20 bp, mouse
gcaagaggcgaagactaact

SEQ ID NO: 580706 - DNA, 20 bp, mouse
gcctgggttaagcggaagtc

SEQ ID NO: 580707 - DNA, 20 bp, mouse
gaggtaggcgtccccggcca

SEQ ID NO: 580708 - DNA, 20 bp, mouse
gctatgtgccctgggttaag

SEQ ID NO: 580709 - DNA, 20 bp, mouse
gggcgctacgtccaccgcgg

SEQ ID NO: 580710 - DNA, 20 bp, mouse
gggtggacgtagcgccatag

SEQ ID NO: 580711 - DNA, 20 bp, mouse
gccccggccagggccgagtg

SEQ ID NO: 580712 - DNA, 20 bp, mouse
gttctcgcgagaacagccgg

SEQ ID NO: 580713 - DNA, 20 bp, mouse
ggctctgggagagcggatgg

SEQ ID NO: 580714 - DNA, 20 bp, mouse
gagaaggatccgaggcggga

SEQ ID NO: 580715 - DNA, 20 bp, mouse
gagtggagaaggatccgagg

SEQ ID NO: 580716 - DNA, 20 bp, mouse
gcgaagtgcgagtgccgcgg

SEQ ID NO: 580717 - DNA, 20 bp, mouse
gagcccctcgcgctctggat

SEQ ID NO: 580718 - DNA, 20 bp, mouse
gagccgaagtgcgagtgccg

SEQ ID NO: 580719 - DNA, 20 bp, mouse
gagtgcgagtgccgcggcgg

SEQ ID NO: 580720 - DNA, 20 bp, mouse
gccagagcgcgaggggctca

SEQ ID NO: 580721 - DNA, 20 bp, mouse
gcactcacctccgggtccag

SEQ ID NO: 580722 - DNA, 20 bp, mouse
ggacccggaggtgagtgaga

SEQ ID NO: 580723 - DNA, 20 bp, mouse
gcggcccatccagagcgcga

SEQ ID NO: 580724 - DNA, 20 bp, mouse
gcagtgagctagagaccgga

SEQ ID NO: 580725 - DNA, 20 bp, mouse
gtgtagcagcagggaccccg

SEQ ID NO: 580726 - DNA, 20 bp, mouse
gcggcagggccacagcacca

SEQ ID NO: 580727 - DNA, 20 bp, mouse
gggccacagcaccatggcaa

SEQ ID NO: 580728 - DNA, 20 bp, mouse
ggtgctgtggccctgccggg

SEQ ID NO: 580729 - DNA, 20 bp, mouse
gcctccttggcagccccagt

SEQ ID NO: 580730 - DNA, 20 bp, mouse
ggggtcctgctccatccgcc

SEQ ID NO: 580731 - DNA, 20 bp, mouse
gagggtcctgagccgcagac

SEQ ID NO: 580732 - DNA, 20 bp, mouse
ggccgcagacggggcagctt

SEQ ID NO: 580733 - DNA, 20 bp, mouse
gctgctccatccgcccggca

SEQ ID NO: 580734 - DNA, 20 bp, mouse
gagggtaagcaacaacccac

SEQ ID NO: 580735 - DNA, 20 bp, mouse
ggcctctagaacaggtgttt

SEQ ID NO: 580736 - DNA, 20 bp, mouse
ggcgccgcgggagtgatcca

SEQ ID NO: 580737 - DNA, 20 bp, mouse
gtgcgggctgcaagcacaaa

SEQ ID NO: 580738 - DNA, 20 bp, mouse
gcgcgccggggagcccgacg

SEQ ID NO: 580739 - DNA, 20 bp, mouse
gcacaaagggcaggccgcac

SEQ ID NO: 580740 - DNA, 20 bp, mouse
gggtccctggatcactcccg

SEQ ID NO: 580741 - DNA, 20 bp, mouse
gggctgcaagcacaaagggc

SEQ ID NO: 580742 - DNA, 20 bp, mouse
gtactcctggccggaggcaa

SEQ ID NO: 580743 - DNA, 20 bp, mouse
gtgatccagggacccgggcc

SEQ ID NO: 580744 - DNA, 20 bp, mouse
gtccccgctgcgcctggagt

SEQ ID NO: 580745 - DNA, 20 bp, mouse
gcggccctcggcgcggatgc

SEQ ID NO: 580746 - DNA, 20 bp, mouse
gctctcgcttggagtgcggg

SEQ ID NO: 580747 - DNA, 20 bp, mouse
gggcgagccctggtgcctgg

SEQ ID NO: 580748 - DNA, 20 bp, mouse
ggagccctggtgcctggcgg

SEQ ID NO: 580749 - DNA, 20 bp, mouse
gaggctctcgcttggagtgc

SEQ ID NO: 580750 - DNA, 20 bp, mouse
gtaggcgctgggcgttcggg

SEQ ID NO: 580751 - DNA, 20 bp, mouse
ggcgccgccgccaggcacca

SEQ ID NO: 580752 - DNA, 20 bp, mouse
gtagtccgggcggcggaagg

SEQ ID NO: 580753 - DNA, 20 bp, mouse
gggctaggcgctgggcgttc

SEQ ID NO: 580754 - DNA, 20 bp, mouse
ggcgttcgggtggtcggcgt

SEQ ID NO: 580755 - DNA, 20 bp, mouse
gggtccgccagctgcgccag

SEQ ID NO: 580756 - DNA, 20 bp, mouse
gggcggcgccggttacatgg

SEQ ID NO: 580757 - DNA, 20 bp, mouse
ggcgcggctggggctacggg

SEQ ID NO: 580758 - DNA, 20 bp, mouse
ggccatgggagacgaggatg

SEQ ID NO: 580759 - DNA, 20 bp, mouse
ggccggagccgccatgtaac

SEQ ID NO: 580760 - DNA, 20 bp, mouse
gccgcccgccatgggagacg

SEQ ID NO: 580761 - DNA, 20 bp, mouse
gcccgcgcggctggggctac

SEQ ID NO: 580762 - DNA, 20 bp, mouse
ggcccgctcggccccagagg

SEQ ID NO: 580763 - DNA, 20 bp, mouse
gtcctcatcctcgtctccca

SEQ ID NO: 580764 - DNA, 20 bp, mouse
gtaggctcggaaccctggta

SEQ ID NO: 580765 - DNA, 20 bp, mouse
gcaccaggaagcacccgccc

SEQ ID NO: 580766 - DNA, 20 bp, mouse
gagcggtgcccgctgagggg

SEQ ID NO: 580767 - DNA, 20 bp, mouse
ggcccgctgaggggaggagg

SEQ ID NO: 580768 - DNA, 20 bp, mouse
gggagctgcacggccagagc

SEQ ID NO: 580769 - DNA, 20 bp, mouse
gtcagcgggcaccgctagta

SEQ ID NO: 580770 - DNA, 20 bp, mouse
gcgccacaactccgacactg

SEQ ID NO: 580771 - DNA, 20 bp, mouse
gcggggttgtgccgtactag

SEQ ID NO: 580772 - DNA, 20 bp, mouse
gctggagctgtggagagacg

SEQ ID NO: 580773 - DNA, 20 bp, mouse
gacccgcgcgatcggaaaga

SEQ ID NO: 580774 - DNA, 20 bp, mouse
gggcggcgcgggcaccagcg

SEQ ID NO: 580775 - DNA, 20 bp, mouse
gaagagactcgcctcagtgt

SEQ ID NO: 580776 - DNA, 20 bp, mouse
gctcaaaagagggaccacgg

SEQ ID NO: 580777 - DNA, 20 bp, mouse
gccgcgggtacctcaaaaga

SEQ ID NO: 580778 - DNA, 20 bp, mouse
gctttctgcaaccccagcag

SEQ ID NO: 580779 - DNA, 20 bp, mouse
gcttgtggctgctcgagggg

SEQ ID NO: 580780 - DNA, 20 bp, mouse
gcctagctctggcagatcga

SEQ ID NO: 580781 - DNA, 20 bp, mouse
gctgcaaccccagcagcggg

SEQ ID NO: 580782 - DNA, 20 bp, mouse
gccctgggaccaagaagaca

SEQ ID NO: 580783 - DNA, 20 bp, mouse
gtacccgcggctggcgaggt

SEQ ID NO: 580784 - DNA, 20 bp, mouse
gtgggaccaagaagacatgg

SEQ ID NO: 580785 - DNA, 20 bp, mouse
gttctcgagagcccctgaag

SEQ ID NO: 580786 - DNA, 20 bp, mouse
gggacccgccgcagactcca

SEQ ID NO: 580787 - DNA, 20 bp, mouse
ggcagcagccgtggagtctg

SEQ ID NO: 580788 - DNA, 20 bp, mouse
gcggctgctgccgccatcac

SEQ ID NO: 580789 - DNA, 20 bp, mouse
ggcagccgtggagtctgcgg

SEQ ID NO: 580790 - DNA, 20 bp, mouse
ggagcttaagcagccggtga

SEQ ID NO: 580791 - DNA, 20 bp, mouse
gcgggcccatgaggcgacga

SEQ ID NO: 580792 - DNA, 20 bp, mouse
gcggcgggtccgggcccatg

SEQ ID NO: 580793 - DNA, 20 bp, mouse
gaacttgaggagccagtctg

SEQ ID NO: 580794 - DNA, 20 bp, mouse
ggcctccgtcgtcgcctcat

SEQ ID NO: 580795 - DNA, 20 bp, mouse
gggcgacgacggaggcggga

SEQ ID NO: 580796 - DNA, 20 bp, mouse
gtgtcgcggagaaatgacgt

SEQ ID NO: 580797 - DNA, 20 bp, mouse
gtcccgcgggacccttggcc

SEQ ID NO: 580798 - DNA, 20 bp, mouse
ggaactctgactgacagcac

SEQ ID NO: 580799 - DNA, 20 bp, mouse
gtcagagttctgcctggtcc

SEQ ID NO: 580800 - DNA, 20 bp, mouse
ggtccgggccaagggtcccg

SEQ ID NO: 580801 - DNA, 20 bp, mouse
gctcagagttgggagcgcca

SEQ ID NO: 580802 - DNA, 20 bp, mouse
gtctgcctggtccgggccaa

SEQ ID NO: 580803 - DNA, 20 bp, mouse
gcgcgggaccggcggggcca

SEQ ID NO: 580804 - DNA, 20 bp, mouse
ggagcgagcggctgctgtcg

SEQ ID NO: 580805 - DNA, 20 bp, mouse
gggcccaggggagaggacca

SEQ ID NO: 580806 - DNA, 20 bp, mouse
ggagcaccgcgaagaggggg

SEQ ID NO: 580807 - DNA, 20 bp, mouse
ggcacgagcaccgcgaagag

SEQ ID NO: 580808 - DNA, 20 bp, mouse
gccgccagctggggaccatc

SEQ ID NO: 580809 - DNA, 20 bp, mouse
gcttagtgctgcgtggagtc

SEQ ID NO: 580810 - DNA, 20 bp, mouse
gagccaccgccccctcttcg

SEQ ID NO: 580811 - DNA, 20 bp, mouse
gcagctggcggaagcacggg

SEQ ID NO: 580812 - DNA, 20 bp, mouse
gatccaagcgacagcccccc

SEQ ID NO: 580813 - DNA, 20 bp, mouse
gcaccgcgaagagggggcgg

SEQ ID NO: 580814 - DNA, 20 bp, mouse
ggagggatggagactcggac

SEQ ID NO: 580815 - DNA, 20 bp, mouse
ggacagtacacaggaactcc

SEQ ID NO: 580816 - DNA, 20 bp, mouse
ggcacctgcggaagggtggt

SEQ ID NO: 580817 - DNA, 20 bp, mouse
ggagccttgcagaaggtgaa

SEQ ID NO: 580818 - DNA, 20 bp, mouse
ggaagggtggtaggcacaga

SEQ ID NO: 580819 - DNA, 20 bp, mouse
gcccccaggcacctgcggaa

SEQ ID NO: 580820 - DNA, 20 bp, mouse
ggcgggaaggcccggagctc

SEQ ID NO: 580821 - DNA, 20 bp, mouse
gccaggcacctgcggaaggg

SEQ ID NO: 580822 - DNA, 20 bp, mouse
gacagacggagccttgcaga

SEQ ID NO: 580823 - DNA, 20 bp, mouse
gagggtacccgagacagcaa

SEQ ID NO: 580824 - DNA, 20 bp, mouse
gagggacagcgttggcggga

SEQ ID NO: 580825 - DNA, 20 bp, mouse
gggtgaagggacagcgttgg

SEQ ID NO: 580826 - DNA, 20 bp, mouse
gaacctacctgacggatcgc

SEQ ID NO: 580827 - DNA, 20 bp, mouse
gccgcgccccaggtgaccgg

SEQ ID NO: 580828 - DNA, 20 bp, mouse
gagccggcgatccgtcaggt

SEQ ID NO: 580829 - DNA, 20 bp, mouse
gcaaagccggggccatctac

SEQ ID NO: 580830 - DNA, 20 bp, mouse
gctggggagacagagaacgt

SEQ ID NO: 580831 - DNA, 20 bp, mouse
gaggttcgcgggccgcaatg

SEQ ID NO: 580832 - DNA, 20 bp, mouse
gaacatggcttcaccctgag

SEQ ID NO: 580833 - DNA, 20 bp, mouse
gaggtggggacagcggaagt

SEQ ID NO: 580834 - DNA, 20 bp, mouse
ggtggcggaagaaaagaggt

SEQ ID NO: 580835 - DNA, 20 bp, mouse
gcggcagagcctgctccccg

SEQ ID NO: 580836 - DNA, 20 bp, mouse
ggaggcaggatggagacgga

SEQ ID NO: 580837 - DNA, 20 bp, mouse
gcatgcgtcgggaggcagga

SEQ ID NO: 580838 - DNA, 20 bp, mouse
ggtcgggccgagcatgcgtc

SEQ ID NO: 580839 - DNA, 20 bp, mouse
ggatggagctcgctcccccg

SEQ ID NO: 580840 - DNA, 20 bp, mouse
ggggagtgtgcagcataccc

SEQ ID NO: 580841 - DNA, 20 bp, mouse
gggctgcgagcgggccaaca

SEQ ID NO: 580842 - DNA, 20 bp, mouse
gcacgcggatgatgacacct

SEQ ID NO: 580843 - DNA, 20 bp, mouse
ggcaacactcacccatcgct

SEQ ID NO: 580844 - DNA, 20 bp, mouse
gtgttgctgcgggccgggtc

SEQ ID NO: 580845 - DNA, 20 bp, mouse
ggtcgtggggaagccaacct

SEQ ID NO: 580846 - DNA, 20 bp, mouse
ggtgcagcaaaaccccgcta

SEQ ID NO: 580847 - DNA, 20 bp, mouse
gcaaaaccccgctagggaca

SEQ ID NO: 580848 - DNA, 20 bp, mouse
gtgttgagttcgccttttag

SEQ ID NO: 580849 - DNA, 20 bp, mouse
gaacactcacctacgaactc

SEQ ID NO: 580850 - DNA, 20 bp, mouse
gatgttcatgaagattcgaa

SEQ ID NO: 580851 - DNA, 20 bp, mouse
ggcgtgatgacgtcactaca

SEQ ID NO: 580852 - DNA, 20 bp, mouse
gggtgtcgccgtgtccctag

SEQ ID NO: 580853 - DNA, 20 bp, mouse
gatttctctgagagccgagt

SEQ ID NO: 580854 - DNA, 20 bp, mouse
gaacatgctgagtaagaggg

SEQ ID NO: 580855 - DNA, 20 bp, mouse
gcaaagagagacaaggcggt

SEQ ID NO: 580856 - DNA, 20 bp, mouse
gccgcagaagggccccgcag

SEQ ID NO: 580857 - DNA, 20 bp, mouse
gccacgctcgagggccctgt

SEQ ID NO: 580858 - DNA, 20 bp, mouse
gccgggtagcgcgaaaggac

SEQ ID NO: 580859 - DNA, 20 bp, mouse
ggccaggagccaagccgccc

SEQ ID NO: 580860 - DNA, 20 bp, mouse
gagcttcccgcgccatgggt

SEQ ID NO: 580861 - DNA, 20 bp, mouse
gcgtggcgcgaaccgcagaa

SEQ ID NO: 580862 - DNA, 20 bp, mouse
gctagtaagcgcgcgtcccg

SEQ ID NO: 580863 - DNA, 20 bp, mouse
gcggcgtccggagacgccga

SEQ ID NO: 580864 - DNA, 20 bp, mouse
gcgccctccgcgcccaccca

SEQ ID NO: 580865 - DNA, 20 bp, mouse
ggctggcccgcagttaggtg

SEQ ID NO: 580866 - DNA, 20 bp, mouse
gaggtctctaccatcctccc

SEQ ID NO: 580867 - DNA, 20 bp, mouse
gatagcagtatccacacata

SEQ ID NO: 580868 - DNA, 20 bp, mouse
gtgcatgtcttacctgcttg

SEQ ID NO: 580869 - DNA, 20 bp, mouse
gagcatggcaaatgctagag

SEQ ID NO: 580870 - DNA, 20 bp, mouse
gcatgatgctaagaggtgaa

SEQ ID NO: 580871 - DNA, 20 bp, mouse
gaggattctatcttagagca

SEQ ID NO: 580872 - DNA, 20 bp, mouse
gcttatagcatgatgctaag

SEQ ID NO: 580873 - DNA, 20 bp, mouse
ggttgagtccctgtggtcca

SEQ ID NO: 580874 - DNA, 20 bp, mouse
gcagggactcaacgatagtc

SEQ ID NO: 580875 - DNA, 20 bp, mouse
gccatgtttcacaaatttag

SEQ ID NO: 580876 - DNA, 20 bp, mouse
gtctcatcagcacatcaagg

SEQ ID NO: 580877 - DNA, 20 bp, mouse
gactgtggctccagagcaga

SEQ ID NO: 580878 - DNA, 20 bp, mouse
gttggacgcgccgtagatag

SEQ ID NO: 580879 - DNA, 20 bp, mouse
gtggctgaggagcccggctg

SEQ ID NO: 580880 - DNA, 20 bp, mouse
gcagcatgcaccgctatcta

SEQ ID NO: 580881 - DNA, 20 bp, mouse
gggaggacgccatattgcca

SEQ ID NO: 580882 - DNA, 20 bp, mouse
gatgctgggccttggcaata

SEQ ID NO: 580883 - DNA, 20 bp, mouse
gcagggacactgggcttatt

SEQ ID NO: 580884 - DNA, 20 bp, mouse
gggtcccgcactcgcctgag

SEQ ID NO: 580885 - DNA, 20 bp, mouse
gcactgggcttattaggtca

SEQ ID NO: 580886 - DNA, 20 bp, mouse
gagacctggttcctagtata

SEQ ID NO: 580887 - DNA, 20 bp, mouse
gtagtatagggaagcgaggt

SEQ ID NO: 580888 - DNA, 20 bp, mouse
gaggcgtgagctggacaacc

SEQ ID NO: 580889 - DNA, 20 bp, mouse
gttcctagtatagggaagcg

SEQ ID NO: 580890 - DNA, 20 bp, mouse
gaacctagcgtgaagtgtgt

SEQ ID NO: 580891 - DNA, 20 bp, mouse
gtaggaaccaggtcttggcc

SEQ ID NO: 580892 - DNA, 20 bp, mouse
gttaggacttacctgcaaca

SEQ ID NO: 580893 - DNA, 20 bp, mouse
gcttccctatactaggaacc

SEQ ID NO: 580894 - DNA, 20 bp, mouse
ggagcgcttgaagtcctggg

SEQ ID NO: 580895 - DNA, 20 bp, mouse
gaatgggcagggtgaaaagg

SEQ ID NO: 580896 - DNA, 20 bp, mouse
gcctacgggacattgtgcag

SEQ ID NO: 580897 - DNA, 20 bp, mouse
gccaagtccggacaaagctg

SEQ ID NO: 580898 - DNA, 20 bp, mouse
gaatgtcccgtaggcagccc

SEQ ID NO: 580899 - DNA, 20 bp, mouse
gtagccgtgctgtcatgtgg

SEQ ID NO: 580900 - DNA, 20 bp, mouse
gtcatgtggcggggtgtccc

SEQ ID NO: 580901 - DNA, 20 bp, mouse
ggctccaggcgctccaggag

SEQ ID NO: 580902 - DNA, 20 bp, mouse
gatgctggtagcaacacgag

SEQ ID NO: 580903 - DNA, 20 bp, mouse
ggacattgtgcagtggcagg

SEQ ID NO: 580904 - DNA, 20 bp, mouse
ggcggggaccaggcccaggg

SEQ ID NO: 580905 - DNA, 20 bp, mouse
gtgtgggaaggcgatgactg

SEQ ID NO: 580906 - DNA, 20 bp, mouse
gtcctcagcagccccgggaa

SEQ ID NO: 580907 - DNA, 20 bp, mouse
gaggcagggtgagcaaggga

SEQ ID NO: 580908 - DNA, 20 bp, mouse
ggatctggcggccggagctg

SEQ ID NO: 580909 - DNA, 20 bp, mouse
gggagctggggtcttgcgca

SEQ ID NO: 580910 - DNA, 20 bp, mouse
ggacggacgcctgagaaaca

SEQ ID NO: 580911 - DNA, 20 bp, mouse
gagagactagatcaaggaga

SEQ ID NO: 580912 - DNA, 20 bp, mouse
gacataacgcaaaactctca

SEQ ID NO: 580913 - DNA, 20 bp, mouse
ggcccgggagttctaagaag

SEQ ID NO: 580914 - DNA, 20 bp, mouse
gctcagggctcccattgccg

SEQ ID NO: 580915 - DNA, 20 bp, mouse
ggcgttatgtctctatgatc

SEQ ID NO: 580916 - DNA, 20 bp, mouse
gcgggagtgaacaatctccc

SEQ ID NO: 580917 - DNA, 20 bp, mouse
gcaccaggcgtacgcaagca

SEQ ID NO: 580918 - DNA, 20 bp, mouse
gaagcagggcgcggccatct

SEQ ID NO: 580919 - DNA, 20 bp, mouse
gtactcaaaagctggacacc

SEQ ID NO: 580920 - DNA, 20 bp, mouse
gggccccgccctcgccaaga

SEQ ID NO: 580921 - DNA, 20 bp, mouse
gggcgtacgcaagcagggcg

SEQ ID NO: 580922 - DNA, 20 bp, mouse
ggccggacagcgcggagagg

SEQ ID NO: 580923 - DNA, 20 bp, mouse
ggcgctggaacaaaacgacc

SEQ ID NO: 580924 - DNA, 20 bp, mouse
gactgccagacccaccgcgt

SEQ ID NO: 580925 - DNA, 20 bp, mouse
gatgctctcacggctttctt

SEQ ID NO: 580926 - DNA, 20 bp, mouse
gagccgctgaagctgggacg

SEQ ID NO: 580927 - DNA, 20 bp, mouse
gcatcagagccgctgaagct

SEQ ID NO: 580928 - DNA, 20 bp, mouse
gctcctcccgccggacgcac

SEQ ID NO: 580929 - DNA, 20 bp, mouse
gccgcgcgccaggccaggag

SEQ ID NO: 580930 - DNA, 20 bp, mouse
ggcaggagcagctggactca

SEQ ID NO: 580931 - DNA, 20 bp, mouse
gaacatgcacagcctggcaa

SEQ ID NO: 580932 - DNA, 20 bp, mouse
ggcgggtccggtgcgtccgg

SEQ ID NO: 580933 - DNA, 20 bp, mouse
gtgaagctgggacgcgggtc

SEQ ID NO: 580934 - DNA, 20 bp, mouse
gccctagtcgcaaggtctgg

SEQ ID NO: 580935 - DNA, 20 bp, mouse
gcacagcctggcaacggcag

SEQ ID NO: 580936 - DNA, 20 bp, mouse
gagggtctgagtctgaacag

SEQ ID NO: 580937 - DNA, 20 bp, mouse
ggcagtcgtgacagcgacaa

SEQ ID NO: 580938 - DNA, 20 bp, mouse
gggggctgagaaagcagcag

SEQ ID NO: 580939 - DNA, 20 bp, mouse
ggacgtagagacctcctggt

SEQ ID NO: 580940 - DNA, 20 bp, mouse
ggcgctgggtcgctgttcta

SEQ ID NO: 580941 - DNA, 20 bp, mouse
ggcgacccagcgccagctga

SEQ ID NO: 580942 - DNA, 20 bp, mouse
ggggtggacaacaccatctg

SEQ ID NO: 580943 - DNA, 20 bp, mouse
gctgaacaggggtctacgag

SEQ ID NO: 580944 - DNA, 20 bp, mouse
ggcgggagcaggtaggactc

SEQ ID NO: 580945 - DNA, 20 bp, mouse
gacacgatgaccctgaatgg

SEQ ID NO: 580946 - DNA, 20 bp, mouse
gtgctctcgctagctcggag

SEQ ID NO: 580947 - DNA, 20 bp, mouse
gctgggggcaggaaagaccg

SEQ ID NO: 580948 - DNA, 20 bp, mouse
gggccgtgcacgcgagctgg

SEQ ID NO: 580949 - DNA, 20 bp, mouse
gcggctgtggccattgcctc

SEQ ID NO: 580950 - DNA, 20 bp, mouse
gccgaagctgatcacatcac

SEQ ID NO: 580951 - DNA, 20 bp, mouse
ggaaagaccgcggcgaggcg

SEQ ID NO: 580952 - DNA, 20 bp, mouse
gcgggacaccgagcaccgac

SEQ ID NO: 580953 - DNA, 20 bp, mouse
ggtgcctcaggcccagtccg

SEQ ID NO: 580954 - DNA, 20 bp, mouse
gaaaacagcgcccgaggcaa

SEQ ID NO: 580955 - DNA, 20 bp, mouse
gctgaggcacggcctaacgg

SEQ ID NO: 580956 - DNA, 20 bp, mouse
gaggttcttgcgctcctgaa

SEQ ID NO: 580957 - DNA, 20 bp, mouse
gtcctcaggcggaccgtgac

SEQ ID NO: 580958 - DNA, 20 bp, mouse
ggccagtcacggtccgcctg

SEQ ID NO: 580959 - DNA, 20 bp, mouse
gctgcaggccaggatcacgt

SEQ ID NO: 580960 - DNA, 20 bp, mouse
gcagtagcgtggttgcggtg

SEQ ID NO: 580961 - DNA, 20 bp, mouse
gtcttgcgctcctgaagggc

SEQ ID NO: 580962 - DNA, 20 bp, mouse
gccgacctcgctgccagtca

SEQ ID NO: 580963 - DNA, 20 bp, mouse
ggcgagtgaggcccaaactc

SEQ ID NO: 580964 - DNA, 20 bp, mouse
ggcttctgtacagactgcaa

SEQ ID NO: 580965 - DNA, 20 bp, mouse
gcaaagcggtcactgcctgg

SEQ ID NO: 580966 - DNA, 20 bp, mouse
gtgacaggccaggccaggtt

SEQ ID NO: 580967 - DNA, 20 bp, mouse
ggccccataagcaggatcct

SEQ ID NO: 580968 - DNA, 20 bp, mouse
gatgtccctgcagtacgggg

SEQ ID NO: 580969 - DNA, 20 bp, mouse
ggtgggccgggcaaaaccaa

SEQ ID NO: 580970 - DNA, 20 bp, mouse
gaagtccttggggaacgagt

SEQ ID NO: 580971 - DNA, 20 bp, mouse
gacaagggcagcgaccagaa

SEQ ID NO: 580972 - DNA, 20 bp, mouse
gaccatgtccctgcagtacg

SEQ ID NO: 580973 - DNA, 20 bp, mouse
gtggcctgtcagggcgcggg

SEQ ID NO: 580974 - DNA, 20 bp, mouse
ggttaggccgccgcctcccc

SEQ ID NO: 580975 - DNA, 20 bp, mouse
ggaagggaggagttctaggg

SEQ ID NO: 580976 - DNA, 20 bp, mouse
gccgcgcctggtgagcaagg

SEQ ID NO: 580977 - DNA, 20 bp, mouse
gagccgcagggtgaggacgg

SEQ ID NO: 580978 - DNA, 20 bp, mouse
gttctcgggcagcagcggca

SEQ ID NO: 580979 - DNA, 20 bp, mouse
gctggcttctcgggcagcag

SEQ ID NO: 580980 - DNA, 20 bp, mouse
ggttctccccgggagcgcga

SEQ ID NO: 580981 - DNA, 20 bp, mouse
gggggagaactgccgcgctc

SEQ ID NO: 580982 - DNA, 20 bp, mouse
gaagccgcagccgcagggtg

SEQ ID NO: 580983 - DNA, 20 bp, mouse
gagaactgccgcgctccggc

SEQ ID NO: 580984 - DNA, 20 bp, mouse
gggaccttggaggcaagcgt

SEQ ID NO: 580985 - DNA, 20 bp, mouse
gtcactccctcgcgctcccg

SEQ ID NO: 580986 - DNA, 20 bp, mouse
ggcggtggcgacatgagcag

SEQ ID NO: 580987 - DNA, 20 bp, mouse
gtccccctaggcggtagcgg

SEQ ID NO: 580988 - DNA, 20 bp, mouse
gggcgacatgagcagcgggg

SEQ ID NO: 580989 - DNA, 20 bp, mouse
ggactccccctaggcggtag

SEQ ID NO: 580990 - DNA, 20 bp, mouse
gccaggtagtgggccctcac

SEQ ID NO: 580991 - DNA, 20 bp, mouse
ggccgccgctaccgcctagg

SEQ ID NO: 580992 - DNA, 20 bp, mouse
ggagcggggctagacagact

SEQ ID NO: 580993 - DNA, 20 bp, mouse
gtcaggagagaccaaggggt

SEQ ID NO: 580994 - DNA, 20 bp, mouse
gatctcggggaaaccctccc

SEQ ID NO: 580995 - DNA, 20 bp, mouse
gtagtgggccctcaccgggg

SEQ ID NO: 580996 - DNA, 20 bp, mouse
gtccagggcagaggacgcag

SEQ ID NO: 580997 - DNA, 20 bp, mouse
ggagagccgggaaggctcca

SEQ ID NO: 580998 - DNA, 20 bp, mouse
gcccagacggccatttgtag

SEQ ID NO: 580999 - DNA, 20 bp, mouse
ggcagaggacgcagcggcca

SEQ ID NO: 581000 - DNA, 20 bp, mouse
gcgaagaagagcgcgctccc

SEQ ID NO: 581001 - DNA, 20 bp, mouse
gagacgctggagagccggga

SEQ ID NO: 581002 - DNA, 20 bp, mouse
gcgcagccgaacgcagcctt

SEQ ID NO: 581003 - DNA, 20 bp, mouse
gcggtgccgaaggctgcgtt

SEQ ID NO: 581004 - DNA, 20 bp, mouse
gcagcggcccggcccccaga

SEQ ID NO: 581005 - DNA, 20 bp, mouse
gcccgagacgctggagagcc

SEQ ID NO: 581006 - DNA, 20 bp, mouse
ggtgcgcgtgtgtggagtcg

SEQ ID NO: 581007 - DNA, 20 bp, mouse
gagcgagcggccggagcgga

SEQ ID NO: 581008 - DNA, 20 bp, mouse
gccggagcggacggcggacg

SEQ ID NO: 581009 - DNA, 20 bp, mouse
gtgcagcgggagacgcgaga

SEQ ID NO: 581010 - DNA, 20 bp, mouse
gtagccgcggcccctcgagt

SEQ ID NO: 581011 - DNA, 20 bp, mouse
ggagcggacggcggacgggg

SEQ ID NO: 581012 - DNA, 20 bp, mouse
gcaggaggcggcgatcccgg

SEQ ID NO: 581013 - DNA, 20 bp, mouse
ggacggggcggacggcgcca

SEQ ID NO: 581014 - DNA, 20 bp, mouse
gccgctgcaggtaagaaact

SEQ ID NO: 581015 - DNA, 20 bp, mouse
gctcaggggcggcttctcgg

SEQ ID NO: 581016 - DNA, 20 bp, mouse
gtacttatcagggtgagagg

SEQ ID NO: 581017 - DNA, 20 bp, mouse
ggtgatgtgtctacttatca

SEQ ID NO: 581018 - DNA, 20 bp, mouse
ggagcgagtctccgagtgtg

SEQ ID NO: 581019 - DNA, 20 bp, mouse
ggcttcctcacccgcacact

SEQ ID NO: 581020 - DNA, 20 bp, mouse
gggcatgatgcggtgaggac

SEQ ID NO: 581021 - DNA, 20 bp, mouse
ggggcttcggggagagaacg

SEQ ID NO: 581022 - DNA, 20 bp, mouse
ggctcgcgctgggagctggt

SEQ ID NO: 581023 - DNA, 20 bp, mouse
gtgatgcggtgaggaccggt

SEQ ID NO: 581024 - DNA, 20 bp, mouse
ggtctccgagtgtgcgggtg

SEQ ID NO: 581025 - DNA, 20 bp, mouse
ggacatcctcccccccatgt

SEQ ID NO: 581026 - DNA, 20 bp, mouse
ggctcgggctctaggagcga

SEQ ID NO: 581027 - DNA, 20 bp, mouse
gggtgggagaagaactgagg

SEQ ID NO: 581028 - DNA, 20 bp, mouse
gggagaagaactgaggtggt

SEQ ID NO: 581029 - DNA, 20 bp, mouse
ggaccgatcaccattgctga

SEQ ID NO: 581030 - DNA, 20 bp, mouse
gtgcaggctagctcaaacat

SEQ ID NO: 581031 - DNA, 20 bp, mouse
gctttccaaaatgctgagtg

SEQ ID NO: 581032 - DNA, 20 bp, mouse
ggaagcctcactcagcattt

SEQ ID NO: 581033 - DNA, 20 bp, mouse
gactgagcacagcgtcatag

SEQ ID NO: 581034 - DNA, 20 bp, mouse
gaaggtaaaaaccaaatata

SEQ ID NO: 581035 - DNA, 20 bp, mouse
gacccgtacctgccacaatc

SEQ ID NO: 581036 - DNA, 20 bp, mouse
gggctgctcggacggaggga

SEQ ID NO: 581037 - DNA, 20 bp, mouse
gtgaagggttggactccgag

SEQ ID NO: 581038 - DNA, 20 bp, mouse
ggagaggctgctcggacgga

SEQ ID NO: 581039 - DNA, 20 bp, mouse
ggacgactgtcagatgtgaa

SEQ ID NO: 581040 - DNA, 20 bp, mouse
gcggttagtctgctctggtg

SEQ ID NO: 581041 - DNA, 20 bp, mouse
gccggctgcggagagcccag

SEQ ID NO: 581042 - DNA, 20 bp, mouse
ggcagctccgaggcgaagaa

SEQ ID NO: 581043 - DNA, 20 bp, mouse
gggttggagggagtctggaa

SEQ ID NO: 581044 - DNA, 20 bp, mouse
gtaattcggttagtctgctc

SEQ ID NO: 581045 - DNA, 20 bp, mouse
gcaggcccagctgacagaca

SEQ ID NO: 581046 - DNA, 20 bp, mouse
gcggagagcatggcgaacga

SEQ ID NO: 581047 - DNA, 20 bp, mouse
gtggcgaacgagggcagcgg

SEQ ID NO: 581048 - DNA, 20 bp, mouse
ggcatggcgaacgagggcag

SEQ ID NO: 581049 - DNA, 20 bp, mouse
gcgcgggcgctggcagtcgg

SEQ ID NO: 581050 - DNA, 20 bp, mouse
gacccgagtaggacattctg

SEQ ID NO: 581051 - DNA, 20 bp, mouse
gggacacgcgtggtgaatgg

SEQ ID NO: 581052 - DNA, 20 bp, mouse
gtgggttcccggacccggga

SEQ ID NO: 581053 - DNA, 20 bp, mouse
gggctgggttggatgtgcac

SEQ ID NO: 581054 - DNA, 20 bp, mouse
gccagggtgagtcgcttcag

SEQ ID NO: 581055 - DNA, 20 bp, mouse
gacgcgtggtgaatggcggt

SEQ ID NO: 581056 - DNA, 20 bp, mouse
gaagcggccaggccggagaa

SEQ ID NO: 581057 - DNA, 20 bp, mouse
gggcggagccaccgcagaga

SEQ ID NO: 581058 - DNA, 20 bp, mouse
gcgagagtagcgtgcctggg

SEQ ID NO: 581059 - DNA, 20 bp, mouse
gtccgggcgtgacccagggg

SEQ ID NO: 581060 - DNA, 20 bp, mouse
gaagtccgggcgtgacccag

SEQ ID NO: 581061 - DNA, 20 bp, mouse
gcgcgatgggcgacccggaa

SEQ ID NO: 581062 - DNA, 20 bp, mouse
gcgccgagagtagcgtgcct

SEQ ID NO: 581063 - DNA, 20 bp, mouse
gagcaggaggaggttcgcac

SEQ ID NO: 581064 - DNA, 20 bp, mouse
gagtgttggggagtcgggaa

SEQ ID NO: 581065 - DNA, 20 bp, mouse
gaatgggccggctagaaccc

SEQ ID NO: 581066 - DNA, 20 bp, mouse
gcgcttgtcgggcgatgtga

SEQ ID NO: 581067 - DNA, 20 bp, mouse
gggggacccgagggaaccag

SEQ ID NO: 581068 - DNA, 20 bp, mouse
gctcagttcaggccgaatgg

SEQ ID NO: 581069 - DNA, 20 bp, mouse
gtcgctcagttcaggccgaa

SEQ ID NO: 581070 - DNA, 20 bp, mouse
ggaacagacaaggctcgccc

SEQ ID NO: 581071 - DNA, 20 bp, mouse
gacaagcgcgtgtgaagcag

SEQ ID NO: 581072 - DNA, 20 bp, mouse
gtcgcagcaagaaggcgggt

SEQ ID NO: 581073 - DNA, 20 bp, mouse
gaagcagcggggccgccatt

SEQ ID NO: 581074 - DNA, 20 bp, mouse
gagcttggcggggcaatcgg

SEQ ID NO: 581075 - DNA, 20 bp, mouse
gctcttggccaagacatggg

SEQ ID NO: 581076 - DNA, 20 bp, mouse
gcgcccgacgacacctctca

SEQ ID NO: 581077 - DNA, 20 bp, mouse
gaggacgggatcgccctgag

SEQ ID NO: 581078 - DNA, 20 bp, mouse
ggcaagtgcgccttgttcta

SEQ ID NO: 581079 - DNA, 20 bp, mouse
gcgccctgagaggtgtcgtc

SEQ ID NO: 581080 - DNA, 20 bp, mouse
gtaaggatttgtaataggac

SEQ ID NO: 581081 - DNA, 20 bp, mouse
gcagtggaagtcgtgacgtt

SEQ ID NO: 581082 - DNA, 20 bp, mouse
gtcctcatgcgagaggccat

SEQ ID NO: 581083 - DNA, 20 bp, mouse
gtgttctaaggatttgtaat

SEQ ID NO: 581084 - DNA, 20 bp, mouse
gacggtagtgagctaggacg

SEQ ID NO: 581085 - DNA, 20 bp, mouse
ggtaggcgtccaggatggaa

SEQ ID NO: 581086 - DNA, 20 bp, mouse
gcactccgggaaccatggtg

SEQ ID NO: 581087 - DNA, 20 bp, mouse
ggctgcgccagctggatctc

SEQ ID NO: 581088 - DNA, 20 bp, mouse
ggacaggtacgcgggcggga

SEQ ID NO: 581089 - DNA, 20 bp, mouse
gcgtcgagtgcgtggtctca

SEQ ID NO: 581090 - DNA, 20 bp, mouse
gcgtcactcgagcgccccag

SEQ ID NO: 581091 - DNA, 20 bp, mouse
gcgcctggcgggcaatgaac

SEQ ID NO: 581092 - DNA, 20 bp, mouse
gccggcgggagcggcactcc

SEQ ID NO: 581093 - DNA, 20 bp, mouse
gaagctgcggaagtacatcg

SEQ ID NO: 581094 - DNA, 20 bp, mouse
gccagtagaacagcagacga

SEQ ID NO: 581095 - DNA, 20 bp, mouse
gcagcgggcgacaggtacgc

SEQ ID NO: 581096 - DNA, 20 bp, mouse
gcggctgaggacacacacgt

SEQ ID NO: 581097 - DNA, 20 bp, mouse
gacacacgtgggttctgccg

SEQ ID NO: 581098 - DNA, 20 bp, mouse
gggcccggctacctgacggg

SEQ ID NO: 581099 - DNA, 20 bp, mouse
gacccatgttgaccaaacgg

SEQ ID NO: 581100 - DNA, 20 bp, mouse
gcacggcccggctacctgac

SEQ ID NO: 581101 - DNA, 20 bp, mouse
gtgacgggcggctgaagaag

SEQ ID NO: 581102 - DNA, 20 bp, mouse
gctgaagaagcggctccgag

SEQ ID NO: 581103 - DNA, 20 bp, mouse
gggaagtgacatcagaggaa

SEQ ID NO: 581104 - DNA, 20 bp, mouse
gggccgtgggactccttggg

SEQ ID NO: 581105 - DNA, 20 bp, mouse
gccgagcggcctggcgatgg

SEQ ID NO: 581106 - DNA, 20 bp, mouse
gctcacacgtgagtcctgaa

SEQ ID NO: 581107 - DNA, 20 bp, mouse
gcacttccggcgagccaaga

SEQ ID NO: 581108 - DNA, 20 bp, mouse
gcggcgagccaagatggctg

SEQ ID NO: 581109 - DNA, 20 bp, mouse
gacgcttcagtatctcccct

SEQ ID NO: 581110 - DNA, 20 bp, mouse
gactcgccccacacactcaa

SEQ ID NO: 581111 - DNA, 20 bp, mouse
gtggcctggcggagcttcgg

SEQ ID NO: 581112 - DNA, 20 bp, mouse
gtgaacggccgcagccatct

SEQ ID NO: 581113 - DNA, 20 bp, mouse
gacacgacggaattatcagg

SEQ ID NO: 581114 - DNA, 20 bp, mouse
ggtgtggggcgagtgaggtt

SEQ ID NO: 581115 - DNA, 20 bp, mouse
ggcaacacgacggaattatc

SEQ ID NO: 581116 - DNA, 20 bp, mouse
gcgctgggcgaactggaact

SEQ ID NO: 581117 - DNA, 20 bp, mouse
gtggaactcggaagactgca

SEQ ID NO: 581118 - DNA, 20 bp, mouse
gcactcgcttcagcatcccc

SEQ ID NO: 581119 - DNA, 20 bp, mouse
ggatgctgaagcgagtgcga

SEQ ID NO: 581120 - DNA, 20 bp, mouse
ggtctacagacactatccaa

SEQ ID NO: 581121 - DNA, 20 bp, mouse
ggcggcacgcgcgcagcctg

SEQ ID NO: 581122 - DNA, 20 bp, mouse
gaagcccgccgagtgaatgg

SEQ ID NO: 581123 - DNA, 20 bp, mouse
gcgcagtccggatcgcttgg

SEQ ID NO: 581124 - DNA, 20 bp, mouse
gggccagccgctgggcgaac

SEQ ID NO: 581125 - DNA, 20 bp, mouse
gccaggacgcagagcgacac

SEQ ID NO: 581126 - DNA, 20 bp, mouse
gatgcggaaggctggttcta

SEQ ID NO: 581127 - DNA, 20 bp, mouse
gccggactacggaagacatg

SEQ ID NO: 581128 - DNA, 20 bp, mouse
gctccccgccctccatagca

SEQ ID NO: 581129 - DNA, 20 bp, mouse
gaaggctggttctagggcta

SEQ ID NO: 581130 - DNA, 20 bp, mouse
ggtcctcaccgtgctatgga

SEQ ID NO: 581131 - DNA, 20 bp, mouse
gactacggaagacatgcgga

SEQ ID NO: 581132 - DNA, 20 bp, mouse
gcgccctccatagcacggtg

SEQ ID NO: 581133 - DNA, 20 bp, mouse
gtgactggcgaccggctgaa

SEQ ID NO: 581134 - DNA, 20 bp, mouse
ggaaggtcctcaccgtgcta

SEQ ID NO: 581135 - DNA, 20 bp, mouse
gcaatggaggccgagaggag

SEQ ID NO: 581136 - DNA, 20 bp, mouse
ggaatcagcacccagagtcg

SEQ ID NO: 581137 - DNA, 20 bp, mouse
gtgggagcgcagagacggct

SEQ ID NO: 581138 - DNA, 20 bp, mouse
gacgcagcggcgccggaaca

SEQ ID NO: 581139 - DNA, 20 bp, mouse
gcgtcgtcgtggaaacgcag

SEQ ID NO: 581140 - DNA, 20 bp, mouse
gcgagcccaaggcctttcgg

SEQ ID NO: 581141 - DNA, 20 bp, mouse
ggctgctcacctgaataccc

SEQ ID NO: 581142 - DNA, 20 bp, mouse
ggctgggagggcgacagctg

SEQ ID NO: 581143 - DNA, 20 bp, mouse
gggcaactcgtcaggtatcg

SEQ ID NO: 581144 - DNA, 20 bp, mouse
gcgagacacgagcagaacag

SEQ ID NO: 581145 - DNA, 20 bp, mouse
gcctttcggaggaacagccg

SEQ ID NO: 581146 - DNA, 20 bp, mouse
gcgcgcgtcagggaatccta

SEQ ID NO: 581147 - DNA, 20 bp, mouse
gtgcacgtgggccagagcgt

SEQ ID NO: 581148 - DNA, 20 bp, mouse
ggccggaggagcctacgctc

SEQ ID NO: 581149 - DNA, 20 bp, mouse
gcctgacgcgcgctgcacgt

SEQ ID NO: 581150 - DNA, 20 bp, mouse
gccgtagcccgcagggccgg

SEQ ID NO: 581151 - DNA, 20 bp, mouse
ggccagagcgtaggctcctc

SEQ ID NO: 581152 - DNA, 20 bp, mouse
gaatacgacccccggagggt

SEQ ID NO: 581153 - DNA, 20 bp, mouse
gggaatcctagggctggagt

SEQ ID NO: 581154 - DNA, 20 bp, mouse
gcgtcagggaatcctagggc

SEQ ID NO: 581155 - DNA, 20 bp, mouse
gaggtgaagcctaccctccg

SEQ ID NO: 581156 - DNA, 20 bp, mouse
gcgcttacgagttgccacgg

SEQ ID NO: 581157 - DNA, 20 bp, mouse
ggcccgcttacgagttgcca

SEQ ID NO: 581158 - DNA, 20 bp, mouse
gcatcccagggcccccatcg

SEQ ID NO: 581159 - DNA, 20 bp, mouse
ggcgccgtgggaacctatca

SEQ ID NO: 581160 - DNA, 20 bp, mouse
gcagccatgtgagttcttcg

SEQ ID NO: 581161 - DNA, 20 bp, mouse
gaacagtatgtcgaccgccg

SEQ ID NO: 581162 - DNA, 20 bp, mouse
gacaggggcaagtccaaggg

SEQ ID NO: 581163 - DNA, 20 bp, mouse
ggcggtcgacatactgttca

SEQ ID NO: 581164 - DNA, 20 bp, mouse
gtccggtggccggcaagcgg

SEQ ID NO: 581165 - DNA, 20 bp, mouse
gtgtgagttcttcggggtag

SEQ ID NO: 581166 - DNA, 20 bp, mouse
gcggctcggatccctcactt

SEQ ID NO: 581167 - DNA, 20 bp, mouse
gcctcacttcgggacagcgg

SEQ ID NO: 581168 - DNA, 20 bp, mouse
ggcacgtggttgccggttta

SEQ ID NO: 581169 - DNA, 20 bp, mouse
gccgggatgacactaaagaa

SEQ ID NO: 581170 - DNA, 20 bp, mouse
gcatggctctcgctgcggct

SEQ ID NO: 581171 - DNA, 20 bp, mouse
gcgaagccagcaggttgccc

SEQ ID NO: 581172 - DNA, 20 bp, mouse
gctcttccggattacgggtc

SEQ ID NO: 581173 - DNA, 20 bp, mouse
gggcccggcctggcgcagca

SEQ ID NO: 581174 - DNA, 20 bp, mouse
ggacgtccgcacgtggttgc

SEQ ID NO: 581175 - DNA, 20 bp, mouse
gaccacggccgctcacccgc

SEQ ID NO: 581176 - DNA, 20 bp, mouse
gagaagccttcaatcttgtg

SEQ ID NO: 581177 - DNA, 20 bp, mouse
gtgaagtggagagctggcat

SEQ ID NO: 581178 - DNA, 20 bp, mouse
gaaatgccacacaagattga

SEQ ID NO: 581179 - DNA, 20 bp, mouse
gtctaagtgaagtggagagc

SEQ ID NO: 581180 - DNA, 20 bp, mouse
gcagcaagatctaagtgaag

SEQ ID NO: 581181 - DNA, 20 bp, mouse
gtaataacctgtgaactaat

SEQ ID NO: 581182 - DNA, 20 bp, mouse
ggtatgtactattctactat

SEQ ID NO: 581183 - DNA, 20 bp, mouse
gtaagccggactattactga

SEQ ID NO: 581184 - DNA, 20 bp, mouse
gaacatgccaattagttcac

SEQ ID NO: 581185 - DNA, 20 bp, mouse
gttaaaaggtcactgttgtg

SEQ ID NO: 581186 - DNA, 20 bp, mouse
gcgcaaggcggcagaaagga

SEQ ID NO: 581187 - DNA, 20 bp, mouse
gccccgggtacacccctgct

SEQ ID NO: 581188 - DNA, 20 bp, mouse
gtcgacagcgtgcccagcag

SEQ ID NO: 581189 - DNA, 20 bp, mouse
gcggaccccggagggaacca

SEQ ID NO: 581190 - DNA, 20 bp, mouse
ggccctggcggaagtcagag

SEQ ID NO: 581191 - DNA, 20 bp, mouse
gcgtgcatgtgggctatgaa

SEQ ID NO: 581192 - DNA, 20 bp, mouse
ggtccggaccggcagatggg

SEQ ID NO: 581193 - DNA, 20 bp, mouse
gggcgcgcaaggcggcagaa

SEQ ID NO: 581194 - DNA, 20 bp, mouse
ggccgcgtggatagccctgg

SEQ ID NO: 581195 - DNA, 20 bp, mouse
gatccacgcggcccagcccc

SEQ ID NO: 581196 - DNA, 20 bp, mouse
gggtgtgtgcctatcaccat

SEQ ID NO: 581197 - DNA, 20 bp, mouse
gccagcatccccatggtgat

SEQ ID NO: 581198 - DNA, 20 bp, mouse
gacccagctgctgctggaac

SEQ ID NO: 581199 - DNA, 20 bp, mouse
gtggtagttgacactcacgg

SEQ ID NO: 581200 - DNA, 20 bp, mouse
gcacctgctgctgcctgtaa

SEQ ID NO: 581201 - DNA, 20 bp, mouse
gctcgcttggcctcctccag

SEQ ID NO: 581202 - DNA, 20 bp, mouse
ggttgcactgacgagtgaag

SEQ ID NO: 581203 - DNA, 20 bp, mouse
gggtgagccggaggacaccc

SEQ ID NO: 581204 - DNA, 20 bp, mouse
gggacagttgtgcataggat

SEQ ID NO: 581205 - DNA, 20 bp, mouse
gggcagcacgaaggatgtct

SEQ ID NO: 581206 - DNA, 20 bp, mouse
gggaggagccggacaaagaa

SEQ ID NO: 581207 - DNA, 20 bp, mouse
ggcggttcgcgtagtacggg

SEQ ID NO: 581208 - DNA, 20 bp, mouse
gatggctgcgcaggtcggag

SEQ ID NO: 581209 - DNA, 20 bp, mouse
gggagcggttcgcgtagtac

SEQ ID NO: 581210 - DNA, 20 bp, mouse
gcgcgtagtacgggcggtgg

SEQ ID NO: 581211 - DNA, 20 bp, mouse
ggagccggacaaagaaggga

SEQ ID NO: 581212 - DNA, 20 bp, mouse
ggttcgcgtagtacgggcgg

SEQ ID NO: 581213 - DNA, 20 bp, mouse
ggtgaaatggctgcgcaggt

SEQ ID NO: 581214 - DNA, 20 bp, mouse
ggcggcgaaaccccaacatg

SEQ ID NO: 581215 - DNA, 20 bp, mouse
gaggcagcggcccgggatgt

SEQ ID NO: 581216 - DNA, 20 bp, mouse
gtctctgagaaggaagcatc

SEQ ID NO: 581217 - DNA, 20 bp, mouse
gaaccgccgaacccagctcg

SEQ ID NO: 581218 - DNA, 20 bp, mouse
ggtggctctcctctctgaga

SEQ ID NO: 581219 - DNA, 20 bp, mouse
gaacccagctcgcggcgccg

SEQ ID NO: 581220 - DNA, 20 bp, mouse
gcagctccgagaggtggacg

SEQ ID NO: 581221 - DNA, 20 bp, mouse
gggctgagacgaggaagcgg

SEQ ID NO: 581222 - DNA, 20 bp, mouse
gtggcagacatagagcccgg

SEQ ID NO: 581223 - DNA, 20 bp, mouse
gatacaacaggagcgcaaaa

SEQ ID NO: 581224 - DNA, 20 bp, mouse
gggcggagagtaaatacaac

SEQ ID NO: 581225 - DNA, 20 bp, mouse
gggaggctgaggagacgctc

SEQ ID NO: 581226 - DNA, 20 bp, mouse
gaaaagccaagccctgagga

SEQ ID NO: 581227 - DNA, 20 bp, mouse
gaggcggctacattctgaaa

SEQ ID NO: 581228 - DNA, 20 bp, mouse
gatatagagagcccttcctc

SEQ ID NO: 581229 - DNA, 20 bp, mouse
ggagcctggtcaaatatgag

SEQ ID NO: 581230 - DNA, 20 bp, mouse
gaaggcagacatctgcagac

SEQ ID NO: 581231 - DNA, 20 bp, mouse
gacctaaacttacctctgag

SEQ ID NO: 581232 - DNA, 20 bp, mouse
gttcttctcacacccatcac

SEQ ID NO: 581233 - DNA, 20 bp, mouse
ggtggtacggttccagtgat

SEQ ID NO: 581234 - DNA, 20 bp, mouse
gtatgacatcagttccgagg

SEQ ID NO: 581235 - DNA, 20 bp, mouse
gctcagggcttggcttttgt

SEQ ID NO: 581236 - DNA, 20 bp, mouse
gctgctgaggaagcaaggtc

SEQ ID NO: 581237 - DNA, 20 bp, mouse
gcagggcagagtcctgaggt

SEQ ID NO: 581238 - DNA, 20 bp, mouse
gaagagagacctaaattaaa

SEQ ID NO: 581239 - DNA, 20 bp, mouse
gagagcgagcgagactcgtc

SEQ ID NO: 581240 - DNA, 20 bp, mouse
gccttcagggcagagtcctg

SEQ ID NO: 581241 - DNA, 20 bp, mouse
gtcctcaatagaataaaagc

SEQ ID NO: 581242 - DNA, 20 bp, mouse
gtcgtcgggctaccaacctc

SEQ ID NO: 581243 - DNA, 20 bp, mouse
gctagctatggaggctacga

SEQ ID NO: 581244 - DNA, 20 bp, mouse
gcaggaagaacctgcagagg

SEQ ID NO: 581245 - DNA, 20 bp, mouse
gccgggcttgatggcgcaga

SEQ ID NO: 581246 - DNA, 20 bp, mouse
gaggcgccgccgccagacat

SEQ ID NO: 581247 - DNA, 20 bp, mouse
ggcagtagcgaccccgaagt

SEQ ID NO: 581248 - DNA, 20 bp, mouse
gcagcggcgatggctcctcc

SEQ ID NO: 581249 - DNA, 20 bp, mouse
ggcagactacggcgaagttg

SEQ ID NO: 581250 - DNA, 20 bp, mouse
gacgaacccgggcagcccgg

SEQ ID NO: 581251 - DNA, 20 bp, mouse
gcgccgccagacatcggcaa

SEQ ID NO: 581252 - DNA, 20 bp, mouse
ggctctgggaacggcaactc

SEQ ID NO: 581253 - DNA, 20 bp, mouse
ggacaggaggcgctctcgag

SEQ ID NO: 581254 - DNA, 20 bp, mouse
gatcctccagttcaaaatgg

SEQ ID NO: 581255 - DNA, 20 bp, mouse
gctccgcggaggccaatccc

SEQ ID NO: 581256 - DNA, 20 bp, mouse
gtggggctcggaaggagata

SEQ ID NO: 581257 - DNA, 20 bp, mouse
gtggcggggactgtgaaggt

SEQ ID NO: 581258 - DNA, 20 bp, mouse
gccgggagtcggaattgagg

SEQ ID NO: 581259 - DNA, 20 bp, mouse
gaccttcccaggacaaggat

SEQ ID NO: 581260 - DNA, 20 bp, mouse
gttcacagtccccgccagca

SEQ ID NO: 581261 - DNA, 20 bp, mouse
gagcagagcctgcttccgtc

SEQ ID NO: 581262 - DNA, 20 bp, mouse
gtaaatcgtcaccctgctgg

SEQ ID NO: 581263 - DNA, 20 bp, mouse
ggtcttgacctgacggaagc

SEQ ID NO: 581264 - DNA, 20 bp, mouse
gtcaccgaaccgtgcatggg

SEQ ID NO: 581265 - DNA, 20 bp, mouse
gacctggatccccatcccga

SEQ ID NO: 581266 - DNA, 20 bp, mouse
ggaactggctggggccactg

SEQ ID NO: 581267 - DNA, 20 bp, mouse
gcgtctttcttaaggttggg

SEQ ID NO: 581268 - DNA, 20 bp, mouse
ggagggagcgcttgaggact

SEQ ID NO: 581269 - DNA, 20 bp, mouse
gcgtgcgtctttcttaaggt

SEQ ID NO: 581270 - DNA, 20 bp, mouse
gtactcgtgcgtctttctta

SEQ ID NO: 581271 - DNA, 20 bp, mouse
gtacagacctgaactcagaa

SEQ ID NO: 581272 - DNA, 20 bp, mouse
gggatctgtgtcaaggaggt

SEQ ID NO: 581273 - DNA, 20 bp, mouse
gtgcgggatctgtgtcaagg

SEQ ID NO: 581274 - DNA, 20 bp, mouse
ggctcccggcactgaacccc

SEQ ID NO: 581275 - DNA, 20 bp, mouse
gtgctggaagcgcgcgtccc

SEQ ID NO: 581276 - DNA, 20 bp, mouse
gccacacgaggcgacatgaa

SEQ ID NO: 581277 - DNA, 20 bp, mouse
gtctacaggccttccacacg

SEQ ID NO: 581278 - DNA, 20 bp, mouse
ggcctcagcgaccgaggcac

SEQ ID NO: 581279 - DNA, 20 bp, mouse
gcccagtgcctcggtcgctg

SEQ ID NO: 581280 - DNA, 20 bp, mouse
ggtggtcgcctcagcgaccg

SEQ ID NO: 581281 - DNA, 20 bp, mouse
ggagctccggagagcccacg

SEQ ID NO: 581282 - DNA, 20 bp, mouse
gagtgggcccgcgaccgcgt

SEQ ID NO: 581283 - DNA, 20 bp, mouse
gagaggccagcctcgagctc

SEQ ID NO: 581284 - DNA, 20 bp, mouse
gctgtccagctgtaaaagag

SEQ ID NO: 581285 - DNA, 20 bp, mouse
ggtcacttgcacgtcggtgg

SEQ ID NO: 581286 - DNA, 20 bp, mouse
gagcaacgaggagacctcgc

SEQ ID NO: 581287 - DNA, 20 bp, mouse
gggttctgaacgccgtggag

SEQ ID NO: 581288 - DNA, 20 bp, mouse
gcgccgggttctgaacgccg

SEQ ID NO: 581289 - DNA, 20 bp, mouse
gtgagcgtctgacagcaacg

SEQ ID NO: 581290 - DNA, 20 bp, mouse
ggtggcccgcacgctccgga

SEQ ID NO: 581291 - DNA, 20 bp, mouse
gcatgctctcgtacagtggg

SEQ ID NO: 581292 - DNA, 20 bp, mouse
ggaggtggggttgtctgtag

SEQ ID NO: 581293 - DNA, 20 bp, mouse
ggaccgacttcctgaccctg

SEQ ID NO: 581294 - DNA, 20 bp, mouse
ggaccctgcggcaagccggg

SEQ ID NO: 581295 - DNA, 20 bp, mouse
gcggcaagccgggtggcctg

SEQ ID NO: 581296 - DNA, 20 bp, mouse
gaccacagggagctacatca

SEQ ID NO: 581297 - DNA, 20 bp, mouse
gggaggaagtctcagatcag

SEQ ID NO: 581298 - DNA, 20 bp, mouse
ggcggctacagtaaaccaca

SEQ ID NO: 581299 - DNA, 20 bp, mouse
gtccctgatgtagctccctg

SEQ ID NO: 581300 - DNA, 20 bp, mouse
gtgcagagatggaaatgggc

SEQ ID NO: 581301 - DNA, 20 bp, mouse
gtgctaatggcatcagatgt

SEQ ID NO: 581302 - DNA, 20 bp, mouse
ggtcagaagaaagcaccctg

SEQ ID NO: 581303 - DNA, 20 bp, mouse
gggcatcagatgttggtgag

SEQ ID NO: 581304 - DNA, 20 bp, mouse
gattatcaaaacttacacat

SEQ ID NO: 581305 - DNA, 20 bp, mouse
gagcttctgtcatgacctca

SEQ ID NO: 581306 - DNA, 20 bp, mouse
ggcccaggtccgacatgatc

SEQ ID NO: 581307 - DNA, 20 bp, mouse
gctgggctctgaggagttag

SEQ ID NO: 581308 - DNA, 20 bp, mouse
gaccagatcatgtcggacct

SEQ ID NO: 581309 - DNA, 20 bp, mouse
ggtctgaaaccagatcatgt

SEQ ID NO: 581310 - DNA, 20 bp, mouse
gaccacgccggccacactgg

SEQ ID NO: 581311 - DNA, 20 bp, mouse
gggagggagagaacgacctt

SEQ ID NO: 581312 - DNA, 20 bp, mouse
ggtcaagagctctcacccca

SEQ ID NO: 581313 - DNA, 20 bp, mouse
gccgggccacctcagcacag

SEQ ID NO: 581314 - DNA, 20 bp, mouse
gagaaccacgccggccacac

SEQ ID NO: 581315 - DNA, 20 bp, mouse
gacagtggtgagttgtcagg

SEQ ID NO: 581316 - DNA, 20 bp, mouse
gggttatcagaaatggagga

SEQ ID NO: 581317 - DNA, 20 bp, mouse
gctatgagcttggtcaggat

SEQ ID NO: 581318 - DNA, 20 bp, mouse
gagaaaaaagcggacaagaa

SEQ ID NO: 581319 - DNA, 20 bp, mouse
ggcattgctatcttgtttcg

SEQ ID NO: 581320 - DNA, 20 bp, mouse
ggactgggacaacagcactg

SEQ ID NO: 581321 - DNA, 20 bp, mouse
gtagtggaaaggtaaaagcg

SEQ ID NO: 581322 - DNA, 20 bp, mouse
gaaccgcacgaggattcaca

SEQ ID NO: 581323 - DNA, 20 bp, mouse
ggaccatgtgaatcctcgtg

SEQ ID NO: 581324 - DNA, 20 bp, mouse
gaaaagagactcagtacaaa

SEQ ID NO: 581325 - DNA, 20 bp, mouse
ggaaaggtaaaagcggggca

SEQ ID NO: 581326 - DNA, 20 bp, mouse
gccgctctcggagaaacggg

SEQ ID NO: 581327 - DNA, 20 bp, mouse
gacgccgctctcggagaaac

SEQ ID NO: 581328 - DNA, 20 bp, mouse
gggcagggccgcccaaatgt

SEQ ID NO: 581329 - DNA, 20 bp, mouse
gtacgcgctggggcacaggc

SEQ ID NO: 581330 - DNA, 20 bp, mouse
ggccagctgggtttccggaa

SEQ ID NO: 581331 - DNA, 20 bp, mouse
gatctttcaagggcctcccc

SEQ ID NO: 581332 - DNA, 20 bp, mouse
gctgttacgcgctggggcac

SEQ ID NO: 581333 - DNA, 20 bp, mouse
ggccgccaccaacatttggg

SEQ ID NO: 581334 - DNA, 20 bp, mouse
gaaacgggcggagcgcgagg

SEQ ID NO: 581335 - DNA, 20 bp, mouse
gatggccgccaccaacattt

SEQ ID NO: 581336 - DNA, 20 bp, mouse
ggttcccgagagaaacctga

SEQ ID NO: 581337 - DNA, 20 bp, mouse
ggcaggttgctggtaccctc

SEQ ID NO: 581338 - DNA, 20 bp, mouse
ggtaccctcaggtttctctc

SEQ ID NO: 581339 - DNA, 20 bp, mouse
ggaagcgggcgggacgcgag

SEQ ID NO: 581340 - DNA, 20 bp, mouse
gtttctctcgggaacgtgga

SEQ ID NO: 581341 - DNA, 20 bp, mouse
ggtaccagcaacctgctgct

SEQ ID NO: 581342 - DNA, 20 bp, mouse
gccgcccgcttccccgagag

SEQ ID NO: 581343 - DNA, 20 bp, mouse
gtcgacgctcaacaaggcgt

SEQ ID NO: 581344 - DNA, 20 bp, mouse
gccgagaggacgccgctctc

SEQ ID NO: 581345 - DNA, 20 bp, mouse
ggacgccgctctcggggaag

SEQ ID NO: 581346 - DNA, 20 bp, mouse
gggacgcttgcaacctgtgg

SEQ ID NO: 581347 - DNA, 20 bp, mouse
gaccggacgcttgcaacctg

SEQ ID NO: 581348 - DNA, 20 bp, mouse
gcggagcgtgacgatatgga

SEQ ID NO: 581349 - DNA, 20 bp, mouse
gtgaacggagcgtgacgata

SEQ ID NO: 581350 - DNA, 20 bp, mouse
gcccggtactcaggtgatgg

SEQ ID NO: 581351 - DNA, 20 bp, mouse
gtgccagcctggggttgcta

SEQ ID NO: 581352 - DNA, 20 bp, mouse
gagacaggctgactctagac

SEQ ID NO: 581353 - DNA, 20 bp, mouse
gctaatcaacctgcctccac

SEQ ID NO: 581354 - DNA, 20 bp, mouse
gtccaagaggggctcattct

SEQ ID NO: 581355 - DNA, 20 bp, mouse
ggtttcagtgttgagaggag

SEQ ID NO: 581356 - DNA, 20 bp, mouse
ggcaggcagggtccaggata

SEQ ID NO: 581357 - DNA, 20 bp, mouse
ggcgctggtaaagtaacggt

SEQ ID NO: 581358 - DNA, 20 bp, mouse
gccccgcgctggtaaagtaa

SEQ ID NO: 581359 - DNA, 20 bp, mouse
gagccctccgggtttgagag

SEQ ID NO: 581360 - DNA, 20 bp, mouse
gaagtaacggtaggcaggca

SEQ ID NO: 581361 - DNA, 20 bp, mouse
ggagaggggtcaggattggg

SEQ ID NO: 581362 - DNA, 20 bp, mouse
gcctctgggatggttaacag

SEQ ID NO: 581363 - DNA, 20 bp, mouse
ggggcagcacactttttccg

SEQ ID NO: 581364 - DNA, 20 bp, mouse
gggggcagtcggagcagtca

SEQ ID NO: 581365 - DNA, 20 bp, mouse
ggcgccctcagggtgagaaa

SEQ ID NO: 581366 - DNA, 20 bp, mouse
gagactagcttggaggagaa

SEQ ID NO: 581367 - DNA, 20 bp, mouse
gacccgccagactagcttgg

SEQ ID NO: 581368 - DNA, 20 bp, mouse
gctcctccaagctagtctgg

SEQ ID NO: 581369 - DNA, 20 bp, mouse
gcagtgaggcccgacggtca

SEQ ID NO: 581370 - DNA, 20 bp, mouse
gtctacccgccagactagct

SEQ ID NO: 581371 - DNA, 20 bp, mouse
gctacgcaggaagcacctgt

SEQ ID NO: 581372 - DNA, 20 bp, mouse
ggcctgggcagggtccaagg

SEQ ID NO: 581373 - DNA, 20 bp, mouse
ggctgcaggaggatcccgaa

SEQ ID NO: 581374 - DNA, 20 bp, mouse
ggaggctgtcggcgtccatc

SEQ ID NO: 581375 - DNA, 20 bp, mouse
ggaggcgactctggcagata

SEQ ID NO: 581376 - DNA, 20 bp, mouse
ggagcccgggcggcgcactg

SEQ ID NO: 581377 - DNA, 20 bp, mouse
gacggcaacgcgggacccag

SEQ ID NO: 581378 - DNA, 20 bp, mouse
gcagcaccaatgcaccgggc

SEQ ID NO: 581379 - DNA, 20 bp, mouse
ggggtcctgggtccacgtcc

SEQ ID NO: 581380 - DNA, 20 bp, mouse
ggtgcccccacgcatcccaa

SEQ ID NO: 581381 - DNA, 20 bp, mouse
ggccccgcagtgcgccgccc

SEQ ID NO: 581382 - DNA, 20 bp, mouse
gaaggcattgagcaactggg

SEQ ID NO: 581383 - DNA, 20 bp, mouse
gcggccgccagcgccccgcc

SEQ ID NO: 581384 - DNA, 20 bp, mouse
gcccaggaccccaaggcgga

SEQ ID NO: 581385 - DNA, 20 bp, mouse
gggtgccccgggctgatgtg

SEQ ID NO: 581386 - DNA, 20 bp, mouse
ggagacagaacactgcccgg

SEQ ID NO: 581387 - DNA, 20 bp, mouse
gctacatcccttcggcctcc

SEQ ID NO: 581388 - DNA, 20 bp, mouse
gtgcgctggctacatccctt

SEQ ID NO: 581389 - DNA, 20 bp, mouse
gtagccagcgcactttccga

SEQ ID NO: 581390 - DNA, 20 bp, mouse
gagcttgtctgcatctccat

SEQ ID NO: 581391 - DNA, 20 bp, mouse
gtttctcgctgcctgagcta

SEQ ID NO: 581392 - DNA, 20 bp, mouse
gtgcagacaagctaaggctc

SEQ ID NO: 581393 - DNA, 20 bp, mouse
gtctccatcggaaagtgcgc

SEQ ID NO: 581394 - DNA, 20 bp, mouse
ggtggacgcgcccctcgact

SEQ ID NO: 581395 - DNA, 20 bp, mouse
ggattccgccggctgcagaa

SEQ ID NO: 581396 - DNA, 20 bp, mouse
ggtaccgcagccatggtcaa

SEQ ID NO: 581397 - DNA, 20 bp, mouse
gaccatggctgcggtaccca

SEQ ID NO: 581398 - DNA, 20 bp, mouse
ggcccggcccaacactggag

SEQ ID NO: 581399 - DNA, 20 bp, mouse
gtcctagcccggcccaacac

SEQ ID NO: 581400 - DNA, 20 bp, mouse
gcagggaccccgggagcgca

SEQ ID NO: 581401 - DNA, 20 bp, mouse
gtgcaaccgaggctaacctg

SEQ ID NO: 581402 - DNA, 20 bp, mouse
gagcctcggttgcacagcag

SEQ ID NO: 581403 - DNA, 20 bp, mouse
gaacacagccggctgctctg

SEQ ID NO: 581404 - DNA, 20 bp, mouse
ggcaggagccgctccagtgt

SEQ ID NO: 581405 - DNA, 20 bp, mouse
gtaacctgcggccagccagg

SEQ ID NO: 581406 - DNA, 20 bp, mouse
gcgcaccggcgggtccctgg

SEQ ID NO: 581407 - DNA, 20 bp, mouse
gacggccaccagggacccgc

SEQ ID NO: 581408 - DNA, 20 bp, mouse
gggcgcggtgggtcgagtga

SEQ ID NO: 581409 - DNA, 20 bp, mouse
gctggtcgctacggccacca

SEQ ID NO: 581410 - DNA, 20 bp, mouse
ggcgcgcgttgagcatccgc

SEQ ID NO: 581411 - DNA, 20 bp, mouse
gcgcgggtcgctggtcgcta

SEQ ID NO: 581412 - DNA, 20 bp, mouse
gcaccgcgccctgggcgcac

SEQ ID NO: 581413 - DNA, 20 bp, mouse
gggacctaggaagcactact

SEQ ID NO: 581414 - DNA, 20 bp, mouse
gcgcgccctgggcgcaccgg

SEQ ID NO: 581415 - DNA, 20 bp, mouse
gcagagtggagcccgcatct

SEQ ID NO: 581416 - DNA, 20 bp, mouse
gggtgggcccctgcgcgtaa

SEQ ID NO: 581417 - DNA, 20 bp, mouse
gtgtgacaggtccaagagag

SEQ ID NO: 581418 - DNA, 20 bp, mouse
gcccgggcggtgtgaagcgg

SEQ ID NO: 581419 - DNA, 20 bp, mouse
gtccaagagagcggtaaaga

SEQ ID NO: 581420 - DNA, 20 bp, mouse
gcagccgctgaagcctgggt

SEQ ID NO: 581421 - DNA, 20 bp, mouse
gagctcctgggcccaccgga

SEQ ID NO: 581422 - DNA, 20 bp, mouse
gagagcggtaaagatggacg

SEQ ID NO: 581423 - DNA, 20 bp, mouse
gcctgggcccaccggaggga

SEQ ID NO: 581424 - DNA, 20 bp, mouse
gggtcggagagactggactg

SEQ ID NO: 581425 - DNA, 20 bp, mouse
ggcactgccattacgcgcag

SEQ ID NO: 581426 - DNA, 20 bp, mouse
ggcgccgtggttagaagagg

SEQ ID NO: 581427 - DNA, 20 bp, mouse
ggaaccccctcttctaacca

SEQ ID NO: 581428 - DNA, 20 bp, mouse
ggctgcctggtgctggaacc

SEQ ID NO: 581429 - DNA, 20 bp, mouse
ggtggcgccgtggttagaag

SEQ ID NO: 581430 - DNA, 20 bp, mouse
gtggggcctggcgcagtctg

SEQ ID NO: 581431 - DNA, 20 bp, mouse
gctgctggctctgggcgagg

SEQ ID NO: 581432 - DNA, 20 bp, mouse
gcgggcccaggcccaaccct

SEQ ID NO: 581433 - DNA, 20 bp, mouse
gtcgggaggtgcgaacccga

SEQ ID NO: 581434 - DNA, 20 bp, mouse
gcgaggcccagctctgcggg

SEQ ID NO: 581435 - DNA, 20 bp, mouse
gccaggcttggcctacagtg

SEQ ID NO: 581436 - DNA, 20 bp, mouse
ggcgcaagagattcagtctg

SEQ ID NO: 581437 - DNA, 20 bp, mouse
gtgagtcccggccgctaagg

SEQ ID NO: 581438 - DNA, 20 bp, mouse
gggccagtactgttgagtgc

SEQ ID NO: 581439 - DNA, 20 bp, mouse
gcttgcgcgagagacccgga

SEQ ID NO: 581440 - DNA, 20 bp, mouse
gagtctgtggcgaagcttcg

SEQ ID NO: 581441 - DNA, 20 bp, mouse
gagcagaggcgccgccttag

SEQ ID NO: 581442 - DNA, 20 bp, mouse
gcgagcgcagcgagcggccg

SEQ ID NO: 581443 - DNA, 20 bp, mouse
gttttgagtcccggccgcta

SEQ ID NO: 581444 - DNA, 20 bp, mouse
gggactcaaaaaaataatgg

SEQ ID NO: 581445 - DNA, 20 bp, mouse
gaatggcggtaggtactaag

SEQ ID NO: 581446 - DNA, 20 bp, mouse
gcgggtggagagcgatgaac

SEQ ID NO: 581447 - DNA, 20 bp, mouse
gcctgcaagggaaactcggg

SEQ ID NO: 581448 - DNA, 20 bp, mouse
ggcagcgagcaacacctggt

SEQ ID NO: 581449 - DNA, 20 bp, mouse
gctgcgcgatcgctgggaca

SEQ ID NO: 581450 - DNA, 20 bp, mouse
gcaccgcagcgagcaacacc

SEQ ID NO: 581451 - DNA, 20 bp, mouse
gacacctggtgggtgtgatt

SEQ ID NO: 581452 - DNA, 20 bp, mouse
gaagtggacatgagtgacag

SEQ ID NO: 581453 - DNA, 20 bp, mouse
ggggcaggttaaggcaggaa

SEQ ID NO: 581454 - DNA, 20 bp, mouse
gaactggatcagccgaaaac

SEQ ID NO: 581455 - DNA, 20 bp, mouse
ggtgtgattagggacctgca

SEQ ID NO: 581456 - DNA, 20 bp, mouse
gcagccagctaacaggtgag

SEQ ID NO: 581457 - DNA, 20 bp, mouse
ggttagctggctggagtcta

SEQ ID NO: 581458 - DNA, 20 bp, mouse
gccttggttcggtggttctg

SEQ ID NO: 581459 - DNA, 20 bp, mouse
ggtcaagagccgcaactgaa

SEQ ID NO: 581460 - DNA, 20 bp, mouse
ggaggtgaccgtgaaaggag

SEQ ID NO: 581461 - DNA, 20 bp, mouse
gtgaccgtgaaaggagtgga

SEQ ID NO: 581462 - DNA, 20 bp, mouse
ggcttaggagctttcaccca

SEQ ID NO: 581463 - DNA, 20 bp, mouse
gttgactggccttggttcgg

SEQ ID NO: 581464 - DNA, 20 bp, mouse
gctaacaggtgagtggcagt

SEQ ID NO: 581465 - DNA, 20 bp, mouse
gctagggtccaaaaacttct

SEQ ID NO: 581466 - DNA, 20 bp, mouse
gaaccctagacagaacggga

SEQ ID NO: 581467 - DNA, 20 bp, mouse
gagttacaggctgccaccca

SEQ ID NO: 581468 - DNA, 20 bp, mouse
gtctgaaccctagacagaac

SEQ ID NO: 581469 - DNA, 20 bp, mouse
gaggccttcccgttctgtct

SEQ ID NO: 581470 - DNA, 20 bp, mouse
ggcagcctgtaactgaccca

SEQ ID NO: 581471 - DNA, 20 bp, mouse
gaagaccttgggtcagttac

SEQ ID NO: 581472 - DNA, 20 bp, mouse
gggacaacgggaccacaacg

SEQ ID NO: 581473 - DNA, 20 bp, mouse
gaggcctttctttccttggg

SEQ ID NO: 581474 - DNA, 20 bp, mouse
gaactctgagaagcatggtc

SEQ ID NO: 581475 - DNA, 20 bp, mouse
gggcctcgtgctactgtcca

SEQ ID NO: 581476 - DNA, 20 bp, mouse
gctgcaaccggcaaaagacg

SEQ ID NO: 581477 - DNA, 20 bp, mouse
gcgccctgtagagagcaccg

SEQ ID NO: 581478 - DNA, 20 bp, mouse
gggcccggaagcgcactatc

SEQ ID NO: 581479 - DNA, 20 bp, mouse
gcaccccggtgctctctaca

SEQ ID NO: 581480 - DNA, 20 bp, mouse
ggccggttgcagcagggacg

SEQ ID NO: 581481 - DNA, 20 bp, mouse
ggaggcgcccgcaagcccgc

SEQ ID NO: 581482 - DNA, 20 bp, mouse
gagcgcactatcaggcctgc

SEQ ID NO: 581483 - DNA, 20 bp, mouse
gaccacgtccctgctgcaac

SEQ ID NO: 581484 - DNA, 20 bp, mouse
gccttccggcgagctcggcc

SEQ ID NO: 581485 - DNA, 20 bp, mouse
gacccgctggccctccatgg

SEQ ID NO: 581486 - DNA, 20 bp, mouse
ggcgcctgcgccctgagagg

SEQ ID NO: 581487 - DNA, 20 bp, mouse
ggagcgggtggactgcgggg

SEQ ID NO: 581488 - DNA, 20 bp, mouse
gcgaggccagcgatagctcc

SEQ ID NO: 581489 - DNA, 20 bp, mouse
gtagttacgactcatggtgg

SEQ ID NO: 581490 - DNA, 20 bp, mouse
ggtcgcgcctgcgccctgag

SEQ ID NO: 581491 - DNA, 20 bp, mouse
ggcgtggagcgggtggactg

SEQ ID NO: 581492 - DNA, 20 bp, mouse
gttgtagttacgactcatgg

SEQ ID NO: 581493 - DNA, 20 bp, mouse
gcgtagccaggagctatcgc

SEQ ID NO: 581494 - DNA, 20 bp, mouse
gcacgcagcgccgcctctca

SEQ ID NO: 581495 - DNA, 20 bp, mouse
gaggcggcgctgcgtggagc

SEQ ID NO: 581496 - DNA, 20 bp, mouse
gtcacgcactgaggcaagtg

SEQ ID NO: 581497 - DNA, 20 bp, mouse
gcaggagacttcacgcactg

SEQ ID NO: 581498 - DNA, 20 bp, mouse
gagtgaggcagctgtgaggt

SEQ ID NO: 581499 - DNA, 20 bp, mouse
gatgggccaagcgctctggc

SEQ ID NO: 581500 - DNA, 20 bp, mouse
ggcctggcacagggcatagg

SEQ ID NO: 581501 - DNA, 20 bp, mouse
ggagcgcttggcccattacc

SEQ ID NO: 581502 - DNA, 20 bp, mouse
gcagctgtgaggtgggtgcc

SEQ ID NO: 581503 - DNA, 20 bp, mouse
gtgggctgccctcctataaa

SEQ ID NO: 581504 - DNA, 20 bp, mouse
gcgtgtgaatggaactgggt

SEQ ID NO: 581505 - DNA, 20 bp, mouse
ggccccgtgtgaatggaact

SEQ ID NO: 581506 - DNA, 20 bp, mouse
gggcgcctctagctagacac

SEQ ID NO: 581507 - DNA, 20 bp, mouse
gcccgcgaagttccaatcag

SEQ ID NO: 581508 - DNA, 20 bp, mouse
gccctgggctagttccaaga

SEQ ID NO: 581509 - DNA, 20 bp, mouse
gtagctagaggcgcctccct

SEQ ID NO: 581510 - DNA, 20 bp, mouse
gcgggacccagaatgcaccg

SEQ ID NO: 581511 - DNA, 20 bp, mouse
gcagctcacttgtctcggta

SEQ ID NO: 581512 - DNA, 20 bp, mouse
gtgggctagttccaagacgg

SEQ ID NO: 581513 - DNA, 20 bp, mouse
gcggaccggaagggaggaaa

SEQ ID NO: 581514 - DNA, 20 bp, mouse
gtcaaacaactgtaaagaca

SEQ ID NO: 581515 - DNA, 20 bp, mouse
gagcggactgcggagcacgc

SEQ ID NO: 581516 - DNA, 20 bp, mouse
ggcgggcaagaggggagtca

SEQ ID NO: 581517 - DNA, 20 bp, mouse
ggcggcagtggcggtcccac

SEQ ID NO: 581518 - DNA, 20 bp, mouse
gcgccgctcgacccacacaa

SEQ ID NO: 581519 - DNA, 20 bp, mouse
gctcttgcccgcctgccagt

SEQ ID NO: 581520 - DNA, 20 bp, mouse
ggagaacctggatcaggtga

SEQ ID NO: 581521 - DNA, 20 bp, mouse
gactcggatacggaagacag

SEQ ID NO: 581522 - DNA, 20 bp, mouse
gtgcgcggtcgcctttgtgt

SEQ ID NO: 581523 - DNA, 20 bp, mouse
gcgcctttgtgtgggtcgag

SEQ ID NO: 581524 - DNA, 20 bp, mouse
gttcagcggggagacaggaa

SEQ ID NO: 581525 - DNA, 20 bp, mouse
ggagcgggagggctcagtcc

SEQ ID NO: 581526 - DNA, 20 bp, mouse
gggagcgccggaagtaggta

SEQ ID NO: 581527 - DNA, 20 bp, mouse
gccagagaccccggaagcga

SEQ ID NO: 581528 - DNA, 20 bp, mouse
gcggcttctcgtctttgcta

SEQ ID NO: 581529 - DNA, 20 bp, mouse
gttgcaggcactgaacagta

SEQ ID NO: 581530 - DNA, 20 bp, mouse
gctgcggggctcgggatgaa

SEQ ID NO: 581531 - DNA, 20 bp, mouse
gcggggctcgggatgaacgg

SEQ ID NO: 581532 - DNA, 20 bp, mouse
gatcaaggagcgccggaagt

SEQ ID NO: 581533 - DNA, 20 bp, mouse
gctgatttcggctttgggat

SEQ ID NO: 581534 - DNA, 20 bp, mouse
gcaacacagcgtctgtgggg

SEQ ID NO: 581535 - DNA, 20 bp, mouse
gtgaacagtacggttagact

SEQ ID NO: 581536 - DNA, 20 bp, mouse
ggattcccggctgtactggt

SEQ ID NO: 581537 - DNA, 20 bp, mouse
gcccgcgagagactgatccc

SEQ ID NO: 581538 - DNA, 20 bp, mouse
ggtaggagggcggccgtcga

SEQ ID NO: 581539 - DNA, 20 bp, mouse
gcccggctgtactggtagga

SEQ ID NO: 581540 - DNA, 20 bp, mouse
gagggcggccgtcgagggac

SEQ ID NO: 581541 - DNA, 20 bp, mouse
gctgatcccaggagcgtact

SEQ ID NO: 581542 - DNA, 20 bp, mouse
gttgggctccggtccctcga

SEQ ID NO: 581543 - DNA, 20 bp, mouse
gtcctgggatcagtctctcg

SEQ ID NO: 581544 - DNA, 20 bp, mouse
gccttgcccagtacgctcct

SEQ ID NO: 581545 - DNA, 20 bp, mouse
gctggcgcgcccaggagtcg

SEQ ID NO: 581546 - DNA, 20 bp, mouse
ggccagcgtcggggagtcag

SEQ ID NO: 581547 - DNA, 20 bp, mouse
gccttgggtctaagttgctg

SEQ ID NO: 581548 - DNA, 20 bp, mouse
gggccacgcgcgggttcctt

SEQ ID NO: 581549 - DNA, 20 bp, mouse
gagccatagctgaggagtcg

SEQ ID NO: 581550 - DNA, 20 bp, mouse
gggagtcacactcaacccgg

SEQ ID NO: 581551 - DNA, 20 bp, mouse
gtctgactcagagaaagctt

SEQ ID NO: 581552 - DNA, 20 bp, mouse
gcatagctgaggagtcgggg

SEQ ID NO: 581553 - DNA, 20 bp, mouse
gccacggtcccggagtaggg

SEQ ID NO: 581554 - DNA, 20 bp, mouse
gcccgacgctggccacgcgc

SEQ ID NO: 581555 - DNA, 20 bp, mouse
gcgtggagtcacactcaacc

SEQ ID NO: 581556 - DNA, 20 bp, mouse
ggccttgcaccgagatggag

SEQ ID NO: 581557 - DNA, 20 bp, mouse
ggacgccgcgcaagcgtact

SEQ ID NO: 581558 - DNA, 20 bp, mouse
gctgcagaccagacttggta

SEQ ID NO: 581559 - DNA, 20 bp, mouse
gtaagccctgcggtagcaga

SEQ ID NO: 581560 - DNA, 20 bp, mouse
gggtcttccaaggcttgcag

SEQ ID NO: 581561 - DNA, 20 bp, mouse
ggcagcaggtgagcgaggca

SEQ ID NO: 581562 - DNA, 20 bp, mouse
gcgctcggccgtaccaagtc

SEQ ID NO: 581563 - DNA, 20 bp, mouse
ggccgtgccttgcaccgaga

SEQ ID NO: 581564 - DNA, 20 bp, mouse
gctgggccgagaccgagagc

SEQ ID NO: 581565 - DNA, 20 bp, mouse
ggaagaccggcaggtgggat

SEQ ID NO: 581566 - DNA, 20 bp, mouse
gctcgggcaggcgctaacag

SEQ ID NO: 581567 - DNA, 20 bp, mouse
gcctgcccgagagcgagact

SEQ ID NO: 581568 - DNA, 20 bp, mouse
gacttgctcagaggcaatca

SEQ ID NO: 581569 - DNA, 20 bp, mouse
ggtggcagccctgacaccat

SEQ ID NO: 581570 - DNA, 20 bp, mouse
gggtaggtggcccagctcag

SEQ ID NO: 581571 - DNA, 20 bp, mouse
ggtcccaagtccactcagag

SEQ ID NO: 581572 - DNA, 20 bp, mouse
ggtgaccaagtctcgctctc

SEQ ID NO: 581573 - DNA, 20 bp, mouse
gacctagaggcaagcagaat

SEQ ID NO: 581574 - DNA, 20 bp, mouse
ggcttcggtagaggaggcaa

SEQ ID NO: 581575 - DNA, 20 bp, mouse
ggggaagtgctacaccaggt

SEQ ID NO: 581576 - DNA, 20 bp, mouse
gccgcagccgggcagcgacg

SEQ ID NO: 581577 - DNA, 20 bp, mouse
gtcgcggctgcagactgaag

SEQ ID NO: 581578 - DNA, 20 bp, mouse
ggtgggctctggtggcctcg

SEQ ID NO: 581579 - DNA, 20 bp, mouse
ggcccggctgcggcggcggt

SEQ ID NO: 581580 - DNA, 20 bp, mouse
gaggccagaaaaactcccgg

SEQ ID NO: 581581 - DNA, 20 bp, mouse
gaatggccgtgtccagatcg

SEQ ID NO: 581582 - DNA, 20 bp, mouse
gtgcactccgcgtcgctgcc

SEQ ID NO: 581583 - DNA, 20 bp, mouse
ggaatcggcagtggcctgca

SEQ ID NO: 581584 - DNA, 20 bp, mouse
gccccccgcagaaagctcct

SEQ ID NO: 581585 - DNA, 20 bp, mouse
gcggaaccgcgatctggaca

SEQ ID NO: 581586 - DNA, 20 bp, mouse
gcctcgggtccctctcaagt

SEQ ID NO: 581587 - DNA, 20 bp, mouse
ggagccaagatggggagtaa

SEQ ID NO: 581588 - DNA, 20 bp, mouse
gcatcttggctccaagagag

SEQ ID NO: 581589 - DNA, 20 bp, mouse
gtgcagacgcccggctcctg

SEQ ID NO: 581590 - DNA, 20 bp, mouse
ggacccgagggaaagagcag

SEQ ID NO: 581591 - DNA, 20 bp, mouse
ggcgtctgcaaccgctctct

SEQ ID NO: 581592 - DNA, 20 bp, mouse
gagctggggcggtatatcag

SEQ ID NO: 581593 - DNA, 20 bp, mouse
gcaagatggggagtaaaggt

SEQ ID NO: 581594 - DNA, 20 bp, mouse
gggcaaaatccccaggagcc

SEQ ID NO: 581595 - DNA, 20 bp, mouse
gacctgtcagagaggcctgt

SEQ ID NO: 581596 - DNA, 20 bp, mouse
gaagcagcccgggaggatgg

SEQ ID NO: 581597 - DNA, 20 bp, mouse
gccccgcggagtggagcaga

SEQ ID NO: 581598 - DNA, 20 bp, mouse
gcagcccgggaggatggcgg

SEQ ID NO: 581599 - DNA, 20 bp, mouse
gcactgcagtgggcgaagac

SEQ ID NO: 581600 - DNA, 20 bp, mouse
gaccgcgtggggtcctccta

SEQ ID NO: 581601 - DNA, 20 bp, mouse
gcgccctctgctccactccg

SEQ ID NO: 581602 - DNA, 20 bp, mouse
ggacgccgccgccatcctcc

SEQ ID NO: 581603 - DNA, 20 bp, mouse
gggaagatggagaccctagg

SEQ ID NO: 581604 - DNA, 20 bp, mouse
gaccctaggaggaccccacg

SEQ ID NO: 581605 - DNA, 20 bp, mouse
ggagagccgggaagccggga

SEQ ID NO: 581606 - DNA, 20 bp, mouse
ggactcagccgagctccgca

SEQ ID NO: 581607 - DNA, 20 bp, mouse
ggttcccggcgacgcctgtt

SEQ ID NO: 581608 - DNA, 20 bp, mouse
gagacgtagggcgggagagt

SEQ ID NO: 581609 - DNA, 20 bp, mouse
gcaggcgtcgccgggaactt

SEQ ID NO: 581610 - DNA, 20 bp, mouse
gaagggtgaagagagacgta

SEQ ID NO: 581611 - DNA, 20 bp, mouse
ggccatggcggagtcgtcag

SEQ ID NO: 581612 - DNA, 20 bp, mouse
gaggacgacgaggagactga

SEQ ID NO: 581613 - DNA, 20 bp, mouse
gccgagccgtcagctctcgg

SEQ ID NO: 581614 - DNA, 20 bp, mouse
ggccatggctgtacgagcaa

SEQ ID NO: 581615 - DNA, 20 bp, mouse
gtcggccccggaggacgacg

SEQ ID NO: 581616 - DNA, 20 bp, mouse
gggctgctgcaactgaggac

SEQ ID NO: 581617 - DNA, 20 bp, mouse
gcaactgaggacagggcggg

SEQ ID NO: 581618 - DNA, 20 bp, mouse
gtggcgcatctcgagcgcgg

SEQ ID NO: 581619 - DNA, 20 bp, mouse
gcaagccgaggaacccgcaa

SEQ ID NO: 581620 - DNA, 20 bp, mouse
gacggagcccgaggacgagg

SEQ ID NO: 581621 - DNA, 20 bp, mouse
gcagttgctcatctgggcgg

SEQ ID NO: 581622 - DNA, 20 bp, mouse
gtctcagttgctcatctggg

SEQ ID NO: 581623 - DNA, 20 bp, mouse
ggggtggcgcatctcgagcg

SEQ ID NO: 581624 - DNA, 20 bp, mouse
gccgcaaaggcgacagctcc

SEQ ID NO: 581625 - DNA, 20 bp, mouse
gcgaggagaccagcgacgac

SEQ ID NO: 581626 - DNA, 20 bp, mouse
gcggacaggcaaggagaccg

SEQ ID NO: 581627 - DNA, 20 bp, mouse
gcggattcctgacacgaccc

SEQ ID NO: 581628 - DNA, 20 bp, mouse
gaacaaggctagcaattcct

SEQ ID NO: 581629 - DNA, 20 bp, mouse
gggctagcaattcctaggtc

SEQ ID NO: 581630 - DNA, 20 bp, mouse
gcaagcagggagtcctcaga

SEQ ID NO: 581631 - DNA, 20 bp, mouse
gggcaaggagaccgcggccg

SEQ ID NO: 581632 - DNA, 20 bp, mouse
gccgcggccggggtcgtgtc

SEQ ID NO: 581633 - DNA, 20 bp, mouse
gtagcaattcctaggtcagg

SEQ ID NO: 581634 - DNA, 20 bp, mouse
gtcaggaatccgcctgacct

SEQ ID NO: 581635 - DNA, 20 bp, mouse
ggccggcgaccggaggcgcg

SEQ ID NO: 581636 - DNA, 20 bp, mouse
gctgcgggcgcacagggtga

SEQ ID NO: 581637 - DNA, 20 bp, mouse
gcgcgggctgcgggcgcaca

SEQ ID NO: 581638 - DNA, 20 bp, mouse
ggcgcgtcgggcactggaag

SEQ ID NO: 581639 - DNA, 20 bp, mouse
gcgggaccgggccggagcag

SEQ ID NO: 581640 - DNA, 20 bp, mouse
gctgcagcctgtctccggag

SEQ ID NO: 581641 - DNA, 20 bp, mouse
gggcgacccggctccatctc

SEQ ID NO: 581642 - DNA, 20 bp, mouse
ggggcggcggcgcggactgg

SEQ ID NO: 581643 - DNA, 20 bp, mouse
gcggcgctgacactcacctc

SEQ ID NO: 581644 - DNA, 20 bp, mouse
gcggccgcgggacgaggctc

SEQ ID NO: 581645 - DNA, 20 bp, mouse
gccagcccggcccggtagag

SEQ ID NO: 581646 - DNA, 20 bp, mouse
gggagcaagccactcgcccg

SEQ ID NO: 581647 - DNA, 20 bp, mouse
gcagcagccgctgcccgagg

SEQ ID NO: 581648 - DNA, 20 bp, mouse
ggtacgcacagcctagctcc

SEQ ID NO: 581649 - DNA, 20 bp, mouse
gcggcgcctgctagcaaccg

SEQ ID NO: 581650 - DNA, 20 bp, mouse
ggcggcgctgccaaccaacg

SEQ ID NO: 581651 - DNA, 20 bp, mouse
ggcctaggccgacctcggag

SEQ ID NO: 581652 - DNA, 20 bp, mouse
gctagctccgggaaagcgcc

SEQ ID NO: 581653 - DNA, 20 bp, mouse
gggcatggtgagcccaaacc

SEQ ID NO: 581654 - DNA, 20 bp, mouse
gtccccgccccctcgggcag

SEQ ID NO: 581655 - DNA, 20 bp, mouse
ggcgagcgcaccgcgttggt

SEQ ID NO: 581656 - DNA, 20 bp, mouse
gtgctcgccgagggagagtg

SEQ ID NO: 581657 - DNA, 20 bp, mouse
ggcgcggccccgcagggagt

SEQ ID NO: 581658 - DNA, 20 bp, mouse
gtcagcagcgcggccccgca

SEQ ID NO: 581659 - DNA, 20 bp, mouse
gccgcagggagtcggttagt

SEQ ID NO: 581660 - DNA, 20 bp, mouse
ggggaggacactagagagag

SEQ ID NO: 581661 - DNA, 20 bp, mouse
gctccctcggcgagcagccg

SEQ ID NO: 581662 - DNA, 20 bp, mouse
gcggggccgcgctgctgaag

SEQ ID NO: 581663 - DNA, 20 bp, mouse
gtaaggacccggggagtccc

SEQ ID NO: 581664 - DNA, 20 bp, mouse
ggcgggataagggagcgagt

SEQ ID NO: 581665 - DNA, 20 bp, mouse
gcaccctcgtgcccaaggag

SEQ ID NO: 581666 - DNA, 20 bp, mouse
gagagggtaagtgtaaggca

SEQ ID NO: 581667 - DNA, 20 bp, mouse
gcagggcagcgcagtctcca

SEQ ID NO: 581668 - DNA, 20 bp, mouse
ggggaaagagggtaagtgta

SEQ ID NO: 581669 - DNA, 20 bp, mouse
gtagagaacgtggggaaaga

SEQ ID NO: 581670 - DNA, 20 bp, mouse
gacggtctaaaaatcctcat

SEQ ID NO: 581671 - DNA, 20 bp, mouse
gcctcatcggcaggatcagg

SEQ ID NO: 581672 - DNA, 20 bp, mouse
gtagcctggggcatcttcta

SEQ ID NO: 581673 - DNA, 20 bp, mouse
gacactttatagagaacgtg

SEQ ID NO: 581674 - DNA, 20 bp, mouse
gtgggctactcacctgcctg

SEQ ID NO: 581675 - DNA, 20 bp, mouse
gaggctaagtaaggttccag

SEQ ID NO: 581676 - DNA, 20 bp, mouse
gcctgttggctgggatagaa

SEQ ID NO: 581677 - DNA, 20 bp, mouse
gctggtggacatggtcctgt

SEQ ID NO: 581678 - DNA, 20 bp, mouse
gaggcaggtgagaggctggt

SEQ ID NO: 581679 - DNA, 20 bp, mouse
gagaggaagctggctcttgt

SEQ ID NO: 581680 - DNA, 20 bp, mouse
gacctggtgagacctaccag

SEQ ID NO: 581681 - DNA, 20 bp, mouse
ggtggtcaggctggtggaca

SEQ ID NO: 581682 - DNA, 20 bp, mouse
gacctggagcaacatgcctc

SEQ ID NO: 581683 - DNA, 20 bp, mouse
gcactcacaagtggtcaggc

SEQ ID NO: 581684 - DNA, 20 bp, mouse
gaccaccagaaggaccatct

SEQ ID NO: 581685 - DNA, 20 bp, mouse
gaagctggctcttgtgggta

SEQ ID NO: 581686 - DNA, 20 bp, mouse
ggaaagatctgtggcaagag

SEQ ID NO: 581687 - DNA, 20 bp, mouse
gcaggctggcagtccctctg

SEQ ID NO: 581688 - DNA, 20 bp, mouse
gggctggggcagggtcttct

SEQ ID NO: 581689 - DNA, 20 bp, mouse
gtggctacagtgctgggtcc

SEQ ID NO: 581690 - DNA, 20 bp, mouse
gactcagacagcaaggcttc

SEQ ID NO: 581691 - DNA, 20 bp, mouse
gcccagcactgtagccatga

SEQ ID NO: 581692 - DNA, 20 bp, mouse
gtgggaagaaggttcttgtc

SEQ ID NO: 581693 - DNA, 20 bp, mouse
gatcctggcttcaaaacgtt

SEQ ID NO: 581694 - DNA, 20 bp, mouse
gtacctcccttacctagcaa

SEQ ID NO: 581695 - DNA, 20 bp, mouse
gattgttcactcagacagca

SEQ ID NO: 581696 - DNA, 20 bp, mouse
gtgagctgctgagtaacccg

SEQ ID NO: 581697 - DNA, 20 bp, mouse
gcggggaacagcattctcag

SEQ ID NO: 581698 - DNA, 20 bp, mouse
gtggcaggtgagtggagtct

SEQ ID NO: 581699 - DNA, 20 bp, mouse
gccaagtactgaagtcatcg

SEQ ID NO: 581700 - DNA, 20 bp, mouse
gtggtgcagccctgggatgg

SEQ ID NO: 581701 - DNA, 20 bp, mouse
gcactgtcttcctcaaatct

SEQ ID NO: 581702 - DNA, 20 bp, mouse
ggttaagcctctgcacgtag

SEQ ID NO: 581703 - DNA, 20 bp, mouse
gcacgtagtggggtctttaa

SEQ ID NO: 581704 - DNA, 20 bp, mouse
gtaccagatggtgcagccct

SEQ ID NO: 581705 - DNA, 20 bp, mouse
gttcctcaaatctgggagag

SEQ ID NO: 581706 - DNA, 20 bp, mouse
gcggcggcgactgattgtgg

SEQ ID NO: 581707 - DNA, 20 bp, mouse
gctccggcggcgactgattg

SEQ ID NO: 581708 - DNA, 20 bp, mouse
gccaccaagccaagacccga

SEQ ID NO: 581709 - DNA, 20 bp, mouse
ggcctcaggtgcgctagatg

SEQ ID NO: 581710 - DNA, 20 bp, mouse
gcggagagatggttctggcg

SEQ ID NO: 581711 - DNA, 20 bp, mouse
gcgacagtttaattctccgg

SEQ ID NO: 581712 - DNA, 20 bp, mouse
gactgattgtggcggagaga

SEQ ID NO: 581713 - DNA, 20 bp, mouse
gggttctggcggggctcatc

SEQ ID NO: 581714 - DNA, 20 bp, mouse
gtaactgtcgatgttgccca

SEQ ID NO: 581715 - DNA, 20 bp, mouse
ggccacatctagcgcacctg

SEQ ID NO: 581716 - DNA, 20 bp, mouse
gcgaatcctgccccgcccgg

SEQ ID NO: 581717 - DNA, 20 bp, mouse
gcgcccggcggcattctccg

SEQ ID NO: 581718 - DNA, 20 bp, mouse
ggtcacgtgacctaacaaca

SEQ ID NO: 581719 - DNA, 20 bp, mouse
gagagccaccgggaacctgt

SEQ ID NO: 581720 - DNA, 20 bp, mouse
gggtcgtcggtccagggcag

SEQ ID NO: 581721 - DNA, 20 bp, mouse
gtgcgcgccagcgtcaggat

SEQ ID NO: 581722 - DNA, 20 bp, mouse
gctcgccgacaggttcccgg

SEQ ID NO: 581723 - DNA, 20 bp, mouse
gctaacaacatggccgcccg

SEQ ID NO: 581724 - DNA, 20 bp, mouse
ggcccgcggagaatgccgcc

SEQ ID NO: 581725 - DNA, 20 bp, mouse
gcgagtggccgacagctggt

SEQ ID NO: 581726 - DNA, 20 bp, mouse
gactagcgggaggatatccg

SEQ ID NO: 581727 - DNA, 20 bp, mouse
ggagtcccaggctccttgtg

SEQ ID NO: 581728 - DNA, 20 bp, mouse
ggctaagaagactcagctcg

SEQ ID NO: 581729 - DNA, 20 bp, mouse
gtggtacgacagagggtcag

SEQ ID NO: 581730 - DNA, 20 bp, mouse
gagactgcgtcccaggctaa

SEQ ID NO: 581731 - DNA, 20 bp, mouse
gtccaaaggccagatgatgg

SEQ ID NO: 581732 - DNA, 20 bp, mouse
gcagggtgcggacgcactag

SEQ ID NO: 581733 - DNA, 20 bp, mouse
ggtgcggacgcactagcggg

SEQ ID NO: 581734 - DNA, 20 bp, mouse
gtcccaggctaagggcagac

SEQ ID NO: 581735 - DNA, 20 bp, mouse
gtatgctcctggacaccccc

SEQ ID NO: 581736 - DNA, 20 bp, mouse
gggcggtgcgtgcgggacac

SEQ ID NO: 581737 - DNA, 20 bp, mouse
ggcaccgccgccatgggtaa

SEQ ID NO: 581738 - DNA, 20 bp, mouse
gctgctgcccttacccatgg

SEQ ID NO: 581739 - DNA, 20 bp, mouse
gcgccgagccgggccagacg

SEQ ID NO: 581740 - DNA, 20 bp, mouse
gcgtgcgggacacgggctcg

SEQ ID NO: 581741 - DNA, 20 bp, mouse
gccatggcggcggtgcgtgc

SEQ ID NO: 581742 - DNA, 20 bp, mouse
gctgcccttacccatggcgg

SEQ ID NO: 581743 - DNA, 20 bp, mouse
ggctcctcggcagtccctag

SEQ ID NO: 581744 - DNA, 20 bp, mouse
gccccagccgccaggcccca

SEQ ID NO: 581745 - DNA, 20 bp, mouse
ggggacacgggctcgcggag

SEQ ID NO: 581746 - DNA, 20 bp, mouse
gggatctgctcggatgagcc

SEQ ID NO: 581747 - DNA, 20 bp, mouse
gttccagccgggctatctat

SEQ ID NO: 581748 - DNA, 20 bp, mouse
gtggttgtgcgcagtaagca

SEQ ID NO: 581749 - DNA, 20 bp, mouse
gagcagggtgttgaccaaaa

SEQ ID NO: 581750 - DNA, 20 bp, mouse
gccggctggaataaagaaaa

SEQ ID NO: 581751 - DNA, 20 bp, mouse
gagccagctaaggcagcatt

SEQ ID NO: 581752 - DNA, 20 bp, mouse
gaaggcagcattgggcgtat

SEQ ID NO: 581753 - DNA, 20 bp, mouse
gtcttagcggcaattcctaa

SEQ ID NO: 581754 - DNA, 20 bp, mouse
gagcctatagatagcccggc

SEQ ID NO: 581755 - DNA, 20 bp, mouse
gtaaaggttacaagattaga

SEQ ID NO: 581756 - DNA, 20 bp, mouse
gcccaggcggcggcgaacgg

SEQ ID NO: 581757 - DNA, 20 bp, mouse
ggaacgcggagcccaggcgg

SEQ ID NO: 581758 - DNA, 20 bp, mouse
gtcgccaggcccgaggctca

SEQ ID NO: 581759 - DNA, 20 bp, mouse
gggcgaacggcggacggtgg

SEQ ID NO: 581760 - DNA, 20 bp, mouse
gcgaggctcacggcgaggat

SEQ ID NO: 581761 - DNA, 20 bp, mouse
gggcggcgaacggcggacgg

SEQ ID NO: 581762 - DNA, 20 bp, mouse
gaggcccgaggctcacggcg

SEQ ID NO: 581763 - DNA, 20 bp, mouse
gtccatcgcccgggtagagg

SEQ ID NO: 581764 - DNA, 20 bp, mouse
gtagcaccgcgcggttccag

SEQ ID NO: 581765 - DNA, 20 bp, mouse
ggcggcgaagagcaggagag

SEQ ID NO: 581766 - DNA, 20 bp, mouse
gagtcacaagggacatactc

SEQ ID NO: 581767 - DNA, 20 bp, mouse
gggtgagcacgggagtccct

SEQ ID NO: 581768 - DNA, 20 bp, mouse
ggcttgtctgtttgggatgt

SEQ ID NO: 581769 - DNA, 20 bp, mouse
ggtatgtcccttgtgactgt

SEQ ID NO: 581770 - DNA, 20 bp, mouse
ggaaagtggagcctaagaaa

SEQ ID NO: 581771 - DNA, 20 bp, mouse
gggtagagagaccctagaaa

SEQ ID NO: 581772 - DNA, 20 bp, mouse
gtgtagcagtggatcatggg

SEQ ID NO: 581773 - DNA, 20 bp, mouse
gaagggtgaccagtccagga

SEQ ID NO: 581774 - DNA, 20 bp, mouse
gatcgggagtcagaagataa

SEQ ID NO: 581775 - DNA, 20 bp, mouse
gaaacagacaagcttttctc

SEQ ID NO: 581776 - DNA, 20 bp, mouse
ggctacggagctaggaactg

SEQ ID NO: 581777 - DNA, 20 bp, mouse
ggcgacggtggaagtggcta

SEQ ID NO: 581778 - DNA, 20 bp, mouse
gaagatggcgacggtggaag

SEQ ID NO: 581779 - DNA, 20 bp, mouse
gttcgccttaggcccgacag

SEQ ID NO: 581780 - DNA, 20 bp, mouse
ggggcctaaggcgaaggacg

SEQ ID NO: 581781 - DNA, 20 bp, mouse
gaactgtggtgaccgctgtc

SEQ ID NO: 581782 - DNA, 20 bp, mouse
ggcggctggaagccgagcgg

SEQ ID NO: 581783 - DNA, 20 bp, mouse
gaacgccgcccgcacgtcag

SEQ ID NO: 581784 - DNA, 20 bp, mouse
gggcggcgtttccgggaaga

SEQ ID NO: 581785 - DNA, 20 bp, mouse
gcgttgccatggcagcaagg

SEQ ID NO: 581786 - DNA, 20 bp, mouse
gaggcgtcgaggccgaggga

SEQ ID NO: 581787 - DNA, 20 bp, mouse
ggcgattccggagcaaaaca

SEQ ID NO: 581788 - DNA, 20 bp, mouse
gccggagcaaaacaaggccg

SEQ ID NO: 581789 - DNA, 20 bp, mouse
ggagcaaaacaaggccgggg

SEQ ID NO: 581790 - DNA, 20 bp, mouse
ggtctgcagagcatcctcat

SEQ ID NO: 581791 - DNA, 20 bp, mouse
ggctccggaatcgctgccgg

SEQ ID NO: 581792 - DNA, 20 bp, mouse
gggcccgcctcgcaggatca

SEQ ID NO: 581793 - DNA, 20 bp, mouse
gcggcctcgacgcctaaggc

SEQ ID NO: 581794 - DNA, 20 bp, mouse
gtgccgggggagggagcaaa

SEQ ID NO: 581795 - DNA, 20 bp, mouse
gcctcccccggcagcgattc

SEQ ID NO: 581796 - DNA, 20 bp, mouse
ggtgtggaaggcagtcagtc

SEQ ID NO: 581797 - DNA, 20 bp, mouse
ggcgcgtggagcctgggtac

SEQ ID NO: 581798 - DNA, 20 bp, mouse
gcagtcgggcaccggtaccc

SEQ ID NO: 581799 - DNA, 20 bp, mouse
gaggaggcgcggagtaggca

SEQ ID NO: 581800 - DNA, 20 bp, mouse
ggcacgcgcgcgtggagcct

SEQ ID NO: 581801 - DNA, 20 bp, mouse
gaaggcagtcagtcgggcac

SEQ ID NO: 581802 - DNA, 20 bp, mouse
gccagcggggccctgcagag

SEQ ID NO: 581803 - DNA, 20 bp, mouse
ggcgcgagcgagggtggagg

SEQ ID NO: 581804 - DNA, 20 bp, mouse
ggctcccgctcaggcccccc

SEQ ID NO: 581805 - DNA, 20 bp, mouse
ggcgggaccgctggagacaa

SEQ ID NO: 581806 - DNA, 20 bp, mouse
gccgcggccggacccagcca

SEQ ID NO: 581807 - DNA, 20 bp, mouse
gcagcgggcgcgggcaggac

SEQ ID NO: 581808 - DNA, 20 bp, mouse
gggaggcaccgtagaccagt

SEQ ID NO: 581809 - DNA, 20 bp, mouse
gcgtctcggggagctcagga

SEQ ID NO: 581810 - DNA, 20 bp, mouse
ggcagcgtggtgccctggct

SEQ ID NO: 581811 - DNA, 20 bp, mouse
gaccacgctgcccggccccg

SEQ ID NO: 581812 - DNA, 20 bp, mouse
gctctcattcatagagccag

SEQ ID NO: 581813 - DNA, 20 bp, mouse
gtgtgcgtggcagggtgcgt

SEQ ID NO: 581814 - DNA, 20 bp, mouse
gaggatggaagtgccagccg

SEQ ID NO: 581815 - DNA, 20 bp, mouse
ggccgggcagcgtggtgccc

SEQ ID NO: 581816 - DNA, 20 bp, mouse
ggcagacgcaggctgcgacg

SEQ ID NO: 581817 - DNA, 20 bp, mouse
gcggcggggccagaggacca

SEQ ID NO: 581818 - DNA, 20 bp, mouse
gcccgccggccggcaccgac

SEQ ID NO: 581819 - DNA, 20 bp, mouse
ggcctggcgtccgccacccc

SEQ ID NO: 581820 - DNA, 20 bp, mouse
ggcctagtcttgcggatccc

SEQ ID NO: 581821 - DNA, 20 bp, mouse
gggagcccgcggcggatggt

SEQ ID NO: 581822 - DNA, 20 bp, mouse
ggccggccggcaccgaccgg

SEQ ID NO: 581823 - DNA, 20 bp, mouse
ggccggggatccgcaagact

SEQ ID NO: 581824 - DNA, 20 bp, mouse
gcaacaacagagaggagcgg

SEQ ID NO: 581825 - DNA, 20 bp, mouse
gcgcctcgcacagcgagccg

SEQ ID NO: 581826 - DNA, 20 bp, mouse
gtgtagatccgagcaccagc

SEQ ID NO: 581827 - DNA, 20 bp, mouse
gcgtgcggcggcctcaatcg

SEQ ID NO: 581828 - DNA, 20 bp, mouse
gagcgacgtgagcccggtgg

SEQ ID NO: 581829 - DNA, 20 bp, mouse
gcggccacttcgctaacttg

SEQ ID NO: 581830 - DNA, 20 bp, mouse
gctgctgcgcagccaccacc

SEQ ID NO: 581831 - DNA, 20 bp, mouse
gatgagcgacgtgagcccgg

SEQ ID NO: 581832 - DNA, 20 bp, mouse
gcccctgagtggagccacca

SEQ ID NO: 581833 - DNA, 20 bp, mouse
ggggccgggccaggatctgg

SEQ ID NO: 581834 - DNA, 20 bp, mouse
gcccatgggcaccgagacca

SEQ ID NO: 581835 - DNA, 20 bp, mouse
gtcacgtcgctcatcttgcc

SEQ ID NO: 581836 - DNA, 20 bp, mouse
gtgcggtgcaaactttctcc

SEQ ID NO: 581837 - DNA, 20 bp, mouse
gagccttcttgcagtcttcc

SEQ ID NO: 581838 - DNA, 20 bp, mouse
gcagtccatgcaggaatagt

SEQ ID NO: 581839 - DNA, 20 bp, mouse
ggaaggctctggcgtttaaa

SEQ ID NO: 581840 - DNA, 20 bp, mouse
ggagcactcactgactcggt

SEQ ID NO: 581841 - DNA, 20 bp, mouse
gatactgtacaactaaaaca

SEQ ID NO: 581842 - DNA, 20 bp, mouse
gctgactcggttggtctcgg

SEQ ID NO: 581843 - DNA, 20 bp, mouse
gcggtgtcactgcgctgaag

SEQ ID NO: 581844 - DNA, 20 bp, mouse
gaaagtttgcaccgcacttg

SEQ ID NO: 581845 - DNA, 20 bp, mouse
gtacaactaaaacagggact

SEQ ID NO: 581846 - DNA, 20 bp, mouse
gcgcggccgccgagtccgtg

SEQ ID NO: 581847 - DNA, 20 bp, mouse
gcggatcctagagaatcaag

SEQ ID NO: 581848 - DNA, 20 bp, mouse
gggccgccccacggactcgg

SEQ ID NO: 581849 - DNA, 20 bp, mouse
gcgcggccgccccacggact

SEQ ID NO: 581850 - DNA, 20 bp, mouse
gggccgccgagtccgtgggg

SEQ ID NO: 581851 - DNA, 20 bp, mouse
gttctctaggatccgggctg

SEQ ID NO: 581852 - DNA, 20 bp, mouse
gggcgcgcggccgaccgtcg

SEQ ID NO: 581853 - DNA, 20 bp, mouse
ggcaagatgggcgagaacag

SEQ ID NO: 581854 - DNA, 20 bp, mouse
gcgccgccacttgattctct

SEQ ID NO: 581855 - DNA, 20 bp, mouse
ggcgccggatgcgggactag

SEQ ID NO: 581856 - DNA, 20 bp, mouse
gaggccggagcgattccagg

SEQ ID NO: 581857 - DNA, 20 bp, mouse
gaggaggactgcggtgagga

SEQ ID NO: 581858 - DNA, 20 bp, mouse
gacgcagacgagcccaaggc

SEQ ID NO: 581859 - DNA, 20 bp, mouse
gagcagggaacagagcggag

SEQ ID NO: 581860 - DNA, 20 bp, mouse
gccaaggccggagcgattcc

SEQ ID NO: 581861 - DNA, 20 bp, mouse
gttccaggaggactgcggtg

SEQ ID NO: 581862 - DNA, 20 bp, mouse
gagtcctcctggaatcgctc

SEQ ID NO: 581863 - DNA, 20 bp, mouse
gttgcggtgggtgaggacac

SEQ ID NO: 581864 - DNA, 20 bp, mouse
gggggacgcagacgagccca

SEQ ID NO: 581865 - DNA, 20 bp, mouse
gggaaggctagagctgaaca

SEQ ID NO: 581866 - DNA, 20 bp, mouse
gggcatcccgagctaatgca

SEQ ID NO: 581867 - DNA, 20 bp, mouse
gtcgcgccctacctcgacaa

SEQ ID NO: 581868 - DNA, 20 bp, mouse
gtcctcgagatcgcacaagg

SEQ ID NO: 581869 - DNA, 20 bp, mouse
gtaacagaaatcagatctca

SEQ ID NO: 581870 - DNA, 20 bp, mouse
gagctcgaggctccttgcag

SEQ ID NO: 581871 - DNA, 20 bp, mouse
ggaggctccttgcagaggaa

SEQ ID NO: 581872 - DNA, 20 bp, mouse
gagcctcgagctggacctgg

SEQ ID NO: 581873 - DNA, 20 bp, mouse
gcatgggccgggcaagaaag

SEQ ID NO: 581874 - DNA, 20 bp, mouse
gctgatttctgttagtacaa

SEQ ID NO: 581875 - DNA, 20 bp, mouse
gagcctccctgcattagctc

SEQ ID NO: 581876 - DNA, 20 bp, mouse
gaccaacgcgcggagccgag

SEQ ID NO: 581877 - DNA, 20 bp, mouse
ggtcgcgcggcagcccacgc

SEQ ID NO: 581878 - DNA, 20 bp, mouse
gcggaggggagagccggcgt

SEQ ID NO: 581879 - DNA, 20 bp, mouse
gggcgcctccaggggtcgcg

SEQ ID NO: 581880 - DNA, 20 bp, mouse
ggccgggcgttaccaacgcg

SEQ ID NO: 581881 - DNA, 20 bp, mouse
ggctgcccagagcggaccat

SEQ ID NO: 581882 - DNA, 20 bp, mouse
ggacccctggaggcgccggg

SEQ ID NO: 581883 - DNA, 20 bp, mouse
gtcccctcggctccgcgcgt

SEQ ID NO: 581884 - DNA, 20 bp, mouse
gagggaccagagttgtagag

SEQ ID NO: 581885 - DNA, 20 bp, mouse
gctgcccgcgcggagagacg

SEQ ID NO: 581886 - DNA, 20 bp, mouse
ggaacacaacctgcgtggag

SEQ ID NO: 581887 - DNA, 20 bp, mouse
gcaggagagcggcctagtaa

SEQ ID NO: 581888 - DNA, 20 bp, mouse
gaacggccgcgtggtaaccc

SEQ ID NO: 581889 - DNA, 20 bp, mouse
gaggcgcctgggttaccacg

SEQ ID NO: 581890 - DNA, 20 bp, mouse
gtaccgcacgccaggcgcct

SEQ ID NO: 581891 - DNA, 20 bp, mouse
gagttcctaccactccacgc

SEQ ID NO: 581892 - DNA, 20 bp, mouse
gtctaggaacacaacctgcg

SEQ ID NO: 581893 - DNA, 20 bp, mouse
ggggcttgtgcgcgaggtgt

SEQ ID NO: 581894 - DNA, 20 bp, mouse
gcttgtgcgcgaggtgtggg

SEQ ID NO: 581895 - DNA, 20 bp, mouse
gttaccacgcggccgttact

SEQ ID NO: 581896 - DNA, 20 bp, mouse
gatgcacccaacacttacca

SEQ ID NO: 581897 - DNA, 20 bp, mouse
gggcaaccgtggtaagtgtt

SEQ ID NO: 581898 - DNA, 20 bp, mouse
gaagtgttgggtgcatgtgg

SEQ ID NO: 581899 - DNA, 20 bp, mouse
ggtctgagcaatggatacag

SEQ ID NO: 581900 - DNA, 20 bp, mouse
ggtactcccgagtcagaggg

SEQ ID NO: 581901 - DNA, 20 bp, mouse
ggaggaggctaggtaagagg

SEQ ID NO: 581902 - DNA, 20 bp, mouse
gctctaagaagggtcattgt

SEQ ID NO: 581903 - DNA, 20 bp, mouse
ggtgtgcatcatggcaaccg

SEQ ID NO: 581904 - DNA, 20 bp, mouse
gggacaccgagtctgagcaa

SEQ ID NO: 581905 - DNA, 20 bp, mouse
ggtttccgctgaggcattgg

SEQ ID NO: 581906 - DNA, 20 bp, mouse
gcatcggcgcgactccctgg

SEQ ID NO: 581907 - DNA, 20 bp, mouse
gcgcacgcgcagagtcggag

SEQ ID NO: 581908 - DNA, 20 bp, mouse
ggtgcatcggcgcgactccc

SEQ ID NO: 581909 - DNA, 20 bp, mouse
gcgggctgcagcggacaccg

SEQ ID NO: 581910 - DNA, 20 bp, mouse
ggcgggcgcacgcgcagagt

SEQ ID NO: 581911 - DNA, 20 bp, mouse
ggcgcagagtcggagtggaa

SEQ ID NO: 581912 - DNA, 20 bp, mouse
ggtctggagagcggcaggaa

SEQ ID NO: 581913 - DNA, 20 bp, mouse
ggtcacctgtgaaggagtcg

SEQ ID NO: 581914 - DNA, 20 bp, mouse
ggcggcctcctgctccgggg

SEQ ID NO: 581915 - DNA, 20 bp, mouse
gtgaaatccgaaggtccggg

SEQ ID NO: 581916 - DNA, 20 bp, mouse
gctgcggctgcggttcggag

SEQ ID NO: 581917 - DNA, 20 bp, mouse
ggctcgcgcccgcggaactg

SEQ ID NO: 581918 - DNA, 20 bp, mouse
gggtgaggctaaggcggcta

SEQ ID NO: 581919 - DNA, 20 bp, mouse
ggcggttcggagcgggttcg

SEQ ID NO: 581920 - DNA, 20 bp, mouse
gtgaaagggtgaggctaagg

SEQ ID NO: 581921 - DNA, 20 bp, mouse
gcggaactgcggctgcggtt

SEQ ID NO: 581922 - DNA, 20 bp, mouse
gaggctaaggcggctaaggc

SEQ ID NO: 581923 - DNA, 20 bp, mouse
gggctgggaggtgatctcgg

SEQ ID NO: 581924 - DNA, 20 bp, mouse
ggacgccaccgcagagccag

SEQ ID NO: 581925 - DNA, 20 bp, mouse
gagtgacgcctagggctaag

SEQ ID NO: 581926 - DNA, 20 bp, mouse
gcgctggcttcccgcaagaa

SEQ ID NO: 581927 - DNA, 20 bp, mouse
ggcacgcaggcgcagaatgt

SEQ ID NO: 581928 - DNA, 20 bp, mouse
gcgcgtgaggacgcaagtcc

SEQ ID NO: 581929 - DNA, 20 bp, mouse
gcgcaggcgcagaatgtggg

SEQ ID NO: 581930 - DNA, 20 bp, mouse
ggacggttctgaccaatggg

SEQ ID NO: 581931 - DNA, 20 bp, mouse
gcggcccgcaaagcgctcgc

SEQ ID NO: 581932 - DNA, 20 bp, mouse
gccgcactggcgacaccccg

SEQ ID NO: 581933 - DNA, 20 bp, mouse
ggtgcgggagccccagctct

SEQ ID NO: 581934 - DNA, 20 bp, mouse
ggagaagccacagcccccat

SEQ ID NO: 581935 - DNA, 20 bp, mouse
gccatgggggctcgaatggg

SEQ ID NO: 581936 - DNA, 20 bp, mouse
gtctggtcgcacggatatgg

SEQ ID NO: 581937 - DNA, 20 bp, mouse
gggttctggtcgcacggata

SEQ ID NO: 581938 - DNA, 20 bp, mouse
gagagggcgagctcagggga

SEQ ID NO: 581939 - DNA, 20 bp, mouse
gttgggcccgcagaagatcg

SEQ ID NO: 581940 - DNA, 20 bp, mouse
gggtcgcacggatatggtgg

SEQ ID NO: 581941 - DNA, 20 bp, mouse
gcgcacggatatggtggagg

SEQ ID NO: 581942 - DNA, 20 bp, mouse
gcttctgcgggcccaacgag

SEQ ID NO: 581943 - DNA, 20 bp, mouse
gctccgggaggcggcggaag

SEQ ID NO: 581944 - DNA, 20 bp, mouse
gtgtggccctggacaggagt

SEQ ID NO: 581945 - DNA, 20 bp, mouse
gcgctggccgcgatcttctg

SEQ ID NO: 581946 - DNA, 20 bp, mouse
gagtaactggtcagaggtct

SEQ ID NO: 581947 - DNA, 20 bp, mouse
gcccatcagtaactggtcag

SEQ ID NO: 581948 - DNA, 20 bp, mouse
gggtaccgcccatcagtaac

SEQ ID NO: 581949 - DNA, 20 bp, mouse
ggattgtgggccgggaaccc

SEQ ID NO: 581950 - DNA, 20 bp, mouse
ggatcgcgttatgtgtgatc

SEQ ID NO: 581951 - DNA, 20 bp, mouse
ggggaaccgggatcacgtta

SEQ ID NO: 581952 - DNA, 20 bp, mouse
ggctaccgcgatgaacgggc

SEQ ID NO: 581953 - DNA, 20 bp, mouse
ggagacgcgatcgtgagaag

SEQ ID NO: 581954 - DNA, 20 bp, mouse
ggccaccggcagtcgattgt

SEQ ID NO: 581955 - DNA, 20 bp, mouse
gttatgtgtgatcgggaacc

SEQ ID NO: 581956 - DNA, 20 bp, mouse
gagtcgcgcacagctcacag

SEQ ID NO: 581957 - DNA, 20 bp, mouse
gattaatgaaagataaaacg

SEQ ID NO: 581958 - DNA, 20 bp, mouse
gtgcagtcttagcagctata

SEQ ID NO: 581959 - DNA, 20 bp, mouse
gcactctggggtagagcaac

SEQ ID NO: 581960 - DNA, 20 bp, mouse
ggaaagataaaacgtggtct

SEQ ID NO: 581961 - DNA, 20 bp, mouse
gaaatattaggaccactctg

SEQ ID NO: 581962 - DNA, 20 bp, mouse
ggttgtctgtaataaagcat

SEQ ID NO: 581963 - DNA, 20 bp, mouse
ggaaagaaggaaatgacatc

SEQ ID NO: 581964 - DNA, 20 bp, mouse
gctttagaatcactcttctt

SEQ ID NO: 581965 - DNA, 20 bp, mouse
gaaaatattgtgagtatgtt

SEQ ID NO: 581966 - DNA, 20 bp, mouse
gtgtgcgctcgagaggtgtc

SEQ ID NO: 581967 - DNA, 20 bp, mouse
gcggccggtgtgcgctcgag

SEQ ID NO: 581968 - DNA, 20 bp, mouse
ggcgcacaccggccgcaatg

SEQ ID NO: 581969 - DNA, 20 bp, mouse
gtgaagtaggagccacattg

SEQ ID NO: 581970 - DNA, 20 bp, mouse
ggtaggagccacattgcggc

SEQ ID NO: 581971 - DNA, 20 bp, mouse
gtccttctgacagaggtcaa

SEQ ID NO: 581972 - DNA, 20 bp, mouse
ggtcacttgtagcgagagag

SEQ ID NO: 581973 - DNA, 20 bp, mouse
gctgacagaggtcaaaggta

SEQ ID NO: 581974 - DNA, 20 bp, mouse
ggtttacaagagactctgtg

SEQ ID NO: 581975 - DNA, 20 bp, mouse
ggacatatcaattcgagcag

SEQ ID NO: 581976 - DNA, 20 bp, mouse
gccgcgcgccacgcagggag

SEQ ID NO: 581977 - DNA, 20 bp, mouse
gtctccgtgcgagaagatgg

SEQ ID NO: 581978 - DNA, 20 bp, mouse
ggagccgtgctcctgagtag

SEQ ID NO: 581979 - DNA, 20 bp, mouse
gacggagctccaggaagtga

SEQ ID NO: 581980 - DNA, 20 bp, mouse
gtctgcaacttggaacaaag

SEQ ID NO: 581981 - DNA, 20 bp, mouse
ggactctgcctctccctgcg

SEQ ID NO: 581982 - DNA, 20 bp, mouse
gtatgactcagtcttagagt

SEQ ID NO: 581983 - DNA, 20 bp, mouse
gtaatctccgtgcgagaaga

SEQ ID NO: 581984 - DNA, 20 bp, mouse
gcgcgcggggttcagcactt

SEQ ID NO: 581985 - DNA, 20 bp, mouse
gtagaagagaggatagttct

SEQ ID NO: 581986 - DNA, 20 bp, mouse
gaccaacacccagattccaa

SEQ ID NO: 581987 - DNA, 20 bp, mouse
gtctcctgagacaacagcgg

SEQ ID NO: 581988 - DNA, 20 bp, mouse
gccgccgccgctgttgtctc

SEQ ID NO: 581989 - DNA, 20 bp, mouse
ggcccttggaatctgggtgt

SEQ ID NO: 581990 - DNA, 20 bp, mouse
ggagccattgacccagaaga

SEQ ID NO: 581991 - DNA, 20 bp, mouse
ggagctcttagaagagccct

SEQ ID NO: 581992 - DNA, 20 bp, mouse
gacaaggaactggacaggca

SEQ ID NO: 581993 - DNA, 20 bp, mouse
gtagaagagcccttggaatc

SEQ ID NO: 581994 - DNA, 20 bp, mouse
gtgactcggttgcccagaaa

SEQ ID NO: 581995 - DNA, 20 bp, mouse
gtgcttgccaggccggaagg

SEQ ID NO: 581996 - DNA, 20 bp, mouse
ggcggccagcactcaccgag

SEQ ID NO: 581997 - DNA, 20 bp, mouse
gacaagtagtttacattgtt

SEQ ID NO: 581998 - DNA, 20 bp, mouse
ggcaacaactcgccgcgccg

SEQ ID NO: 581999 - DNA, 20 bp, mouse
gcgggcccggggaggcgagt

SEQ ID NO: 582000 - DNA, 20 bp, mouse
gggcccggcgcgctaactct

SEQ ID NO: 582001 - DNA, 20 bp, mouse
gccaggcgcgcggcgggaga

SEQ ID NO: 582002 - DNA, 20 bp, mouse
gccgctcctcggcaagtcag

SEQ ID NO: 582003 - DNA, 20 bp, mouse
gcattggccccgagccgtgg

SEQ ID NO: 582004 - DNA, 20 bp, mouse
gcttgccgaggagcgggagt

SEQ ID NO: 582005 - DNA, 20 bp, mouse
gctaactcatgcccagccgg

SEQ ID NO: 582006 - DNA, 20 bp, mouse
gcatgccgcggcgggaggaa

SEQ ID NO: 582007 - DNA, 20 bp, mouse
gtcaagagccgcgctcggct

SEQ ID NO: 582008 - DNA, 20 bp, mouse
gcccgtctgtacaaagatgg

SEQ ID NO: 582009 - DNA, 20 bp, mouse
gccgcgggcccgaacctgaa

SEQ ID NO: 582010 - DNA, 20 bp, mouse
gtgagatgacagcaccggcg

SEQ ID NO: 582011 - DNA, 20 bp, mouse
gcgcggaggcgagcaggccg

SEQ ID NO: 582012 - DNA, 20 bp, mouse
gctcagtgccgagccgagcg

SEQ ID NO: 582013 - DNA, 20 bp, mouse
ggcgaaggggcgggagctca

SEQ ID NO: 582014 - DNA, 20 bp, mouse
gaccggcccacactgccccg

SEQ ID NO: 582015 - DNA, 20 bp, mouse
ggaggactctgggcattcga

SEQ ID NO: 582016 - DNA, 20 bp, mouse
gggtgaggcagccctcagac

SEQ ID NO: 582017 - DNA, 20 bp, mouse
ggagcgcagctcccagtctg

SEQ ID NO: 582018 - DNA, 20 bp, mouse
gtggttccggagcccaagcc

SEQ ID NO: 582019 - DNA, 20 bp, mouse
gggagctgcgctccgggctt

SEQ ID NO: 582020 - DNA, 20 bp, mouse
ggcgtgtcatctggttaact

SEQ ID NO: 582021 - DNA, 20 bp, mouse
ggagctggcacagagtggaa

SEQ ID NO: 582022 - DNA, 20 bp, mouse
ggggctgcctcaccagcatt

SEQ ID NO: 582023 - DNA, 20 bp, mouse
ggttctgttgcgcgtggttc

SEQ ID NO: 582024 - DNA, 20 bp, mouse
gtgacctgtgagtacaactc

SEQ ID NO: 582025 - DNA, 20 bp, mouse
gggaagtgcttgctgggtgt

SEQ ID NO: 582026 - DNA, 20 bp, mouse
gacggcggcggcaagaggca

SEQ ID NO: 582027 - DNA, 20 bp, mouse
gattatgcgtgattactgac

SEQ ID NO: 582028 - DNA, 20 bp, mouse
ggccgggcttccgtcaactt

SEQ ID NO: 582029 - DNA, 20 bp, mouse
ggagtccacatagtgttgag

SEQ ID NO: 582030 - DNA, 20 bp, mouse
gcccggctgctagcaagcga

SEQ ID NO: 582031 - DNA, 20 bp, mouse
gcggaagcccggctgtgcct

SEQ ID NO: 582032 - DNA, 20 bp, mouse
gtcggctcccaggcacagcc

SEQ ID NO: 582033 - DNA, 20 bp, mouse
gagacggtgaagcccaagtg

SEQ ID NO: 582034 - DNA, 20 bp, mouse
gctagcagccgggagagcgc

SEQ ID NO: 582035 - DNA, 20 bp, mouse
gtgtggactctcggatctag

SEQ ID NO: 582036 - DNA, 20 bp, mouse
gctcgtccggagactggcgg

SEQ ID NO: 582037 - DNA, 20 bp, mouse
gcccctcgtcagtcactcgg

SEQ ID NO: 582038 - DNA, 20 bp, mouse
gctcgtcagtcactcggcgg

SEQ ID NO: 582039 - DNA, 20 bp, mouse
gcgcccggcaggtacctggt

SEQ ID NO: 582040 - DNA, 20 bp, mouse
gcgctaagatggagacccgg

SEQ ID NO: 582041 - DNA, 20 bp, mouse
gtacctgccgggcgccgaag

SEQ ID NO: 582042 - DNA, 20 bp, mouse
gggcggggactagtctcgtc

SEQ ID NO: 582043 - DNA, 20 bp, mouse
gctgccgggcgccgaagggg

SEQ ID NO: 582044 - DNA, 20 bp, mouse
gccgcccctcgtcagtcact

SEQ ID NO: 582045 - DNA, 20 bp, mouse
gggctgaggaggagccgcca

SEQ ID NO: 582046 - DNA, 20 bp, mouse
gccgggcggcgggtctgaag

SEQ ID NO: 582047 - DNA, 20 bp, mouse
gcctcacagccccgagccgg

SEQ ID NO: 582048 - DNA, 20 bp, mouse
gaccccctcccgttcccggg

SEQ ID NO: 582049 - DNA, 20 bp, mouse
gcagacccgccgcccgggaa

SEQ ID NO: 582050 - DNA, 20 bp, mouse
gggcggcgggtctgaagcgg

SEQ ID NO: 582051 - DNA, 20 bp, mouse
gccgccgcccgggaacggga

SEQ ID NO: 582052 - DNA, 20 bp, mouse
ggccagggccggggaccgcg

SEQ ID NO: 582053 - DNA, 20 bp, mouse
gggcggcgcgatgagctggc

SEQ ID NO: 582054 - DNA, 20 bp, mouse
gctcgtcctcgctcaggtag

SEQ ID NO: 582055 - DNA, 20 bp, mouse
gaagcggcggcgcgatgagc

SEQ ID NO: 582056 - DNA, 20 bp, mouse
ggtctgaggatggcgagagg

SEQ ID NO: 582057 - DNA, 20 bp, mouse
gggcttggcggggaacctga

SEQ ID NO: 582058 - DNA, 20 bp, mouse
gtggcggggaacctgagggc

SEQ ID NO: 582059 - DNA, 20 bp, mouse
gaagccagaggcacccgcga

SEQ ID NO: 582060 - DNA, 20 bp, mouse
ggtgcctctggcttccctag

SEQ ID NO: 582061 - DNA, 20 bp, mouse
gggatttaggaggaccgagt

SEQ ID NO: 582062 - DNA, 20 bp, mouse
gccgggctagggtctgagga

SEQ ID NO: 582063 - DNA, 20 bp, mouse
ggctggggtcggagacctct

SEQ ID NO: 582064 - DNA, 20 bp, mouse
ggaggcacccgcgagggaga

SEQ ID NO: 582065 - DNA, 20 bp, mouse
ggggaacctgagggcgggct

SEQ ID NO: 582066 - DNA, 20 bp, mouse
gagcccggcgtgaggacgca

SEQ ID NO: 582067 - DNA, 20 bp, mouse
gaggagcccgaggcacccgg

SEQ ID NO: 582068 - DNA, 20 bp, mouse
ggatgttctaggggctccaa

SEQ ID NO: 582069 - DNA, 20 bp, mouse
gccggcgtgaggacgcaggg

SEQ ID NO: 582070 - DNA, 20 bp, mouse
ggccgcacggtgcgggagga

SEQ ID NO: 582071 - DNA, 20 bp, mouse
gaggagggcagcccggcgtg

SEQ ID NO: 582072 - DNA, 20 bp, mouse
gaccagcagcgcggcccccc

SEQ ID NO: 582073 - DNA, 20 bp, mouse
gactcgggtcgctgcccctg

SEQ ID NO: 582074 - DNA, 20 bp, mouse
ggctccaacggctgctactc

SEQ ID NO: 582075 - DNA, 20 bp, mouse
ggtgcgggaggagggcagcc

SEQ ID NO: 582076 - DNA, 20 bp, mouse
gcgctgcctaggggaaacag

SEQ ID NO: 582077 - DNA, 20 bp, mouse
ggcttcggccatggctccca

SEQ ID NO: 582078 - DNA, 20 bp, mouse
gacagaggcgcccgaggctg

SEQ ID NO: 582079 - DNA, 20 bp, mouse
gagcgcacgccgctgcctag

SEQ ID NO: 582080 - DNA, 20 bp, mouse
gtgcgctgcgccccagcctc

SEQ ID NO: 582081 - DNA, 20 bp, mouse
ggggcgcctctgtttcccct

SEQ ID NO: 582082 - DNA, 20 bp, mouse
gagcgcggcgcggtgaggag

SEQ ID NO: 582083 - DNA, 20 bp, mouse
ggcgcacgccctgggagcca

SEQ ID NO: 582084 - DNA, 20 bp, mouse
gccgcactcgcaggctgcag

SEQ ID NO: 582085 - DNA, 20 bp, mouse
gagagcgagcagtcccgggt

SEQ ID NO: 582086 - DNA, 20 bp, mouse
ggaacagattctcgacagaa

SEQ ID NO: 582087 - DNA, 20 bp, mouse
ggcaaatgtggccactggac

SEQ ID NO: 582088 - DNA, 20 bp, mouse
gtggccactggaccggtgtg

SEQ ID NO: 582089 - DNA, 20 bp, mouse
gaagacaggtctcctcacac

SEQ ID NO: 582090 - DNA, 20 bp, mouse
ggaagggcacgctgcaaatg

SEQ ID NO: 582091 - DNA, 20 bp, mouse
gtctcctcacaccggtccag

SEQ ID NO: 582092 - DNA, 20 bp, mouse
gtccgggaggagtcggtcaa

SEQ ID NO: 582093 - DNA, 20 bp, mouse
ggttggggaggaggtcggta

SEQ ID NO: 582094 - DNA, 20 bp, mouse
gacgctgcaaatgtggccac

SEQ ID NO: 582095 - DNA, 20 bp, mouse
gaagcagggtaggatactca

SEQ ID NO: 582096 - DNA, 20 bp, mouse
gagctgggcacaccacgatg

SEQ ID NO: 582097 - DNA, 20 bp, mouse
ggcgggtgtggggttcccag

SEQ ID NO: 582098 - DNA, 20 bp, mouse
gcggctccaacgccaggatg

SEQ ID NO: 582099 - DNA, 20 bp, mouse
gagagggcagatattaggtg

SEQ ID NO: 582100 - DNA, 20 bp, mouse
gttaggtgcgggactcacct

SEQ ID NO: 582101 - DNA, 20 bp, mouse
gtccgccccagcgagtctgg

SEQ ID NO: 582102 - DNA, 20 bp, mouse
ggccgaagcaagcgggtgtg

SEQ ID NO: 582103 - DNA, 20 bp, mouse
ggatgcccccagactcgctg

SEQ ID NO: 582104 - DNA, 20 bp, mouse
gttcggcactagcctcatcg

SEQ ID NO: 582105 - DNA, 20 bp, mouse
gcaaggactgctgcgcttcg

SEQ ID NO: 582106 - DNA, 20 bp, mouse
ggcaattagagaagagtgga

SEQ ID NO: 582107 - DNA, 20 bp, mouse
gatcgggaagatgaaactgt

SEQ ID NO: 582108 - DNA, 20 bp, mouse
gacttatgcttaccaagttg

SEQ ID NO: 582109 - DNA, 20 bp, mouse
gagcccctgaacccaaccag

SEQ ID NO: 582110 - DNA, 20 bp, mouse
gtgggacaggagtggcggtc

SEQ ID NO: 582111 - DNA, 20 bp, mouse
gctccccacaggctgttatt

SEQ ID NO: 582112 - DNA, 20 bp, mouse
gcgccactggttgggttcag

SEQ ID NO: 582113 - DNA, 20 bp, mouse
ggaccgccgtttctccccac

SEQ ID NO: 582114 - DNA, 20 bp, mouse
ggcggccgctagactccctg

SEQ ID NO: 582115 - DNA, 20 bp, mouse
gtagcggccgcacccagccc

SEQ ID NO: 582116 - DNA, 20 bp, mouse
gtaaccgatctggagccctg

SEQ ID NO: 582117 - DNA, 20 bp, mouse
gcagcctcagggctccagat

SEQ ID NO: 582118 - DNA, 20 bp, mouse
gggtccccggaggagtatgt

SEQ ID NO: 582119 - DNA, 20 bp, mouse
ggggatgcagctaaccgatc

SEQ ID NO: 582120 - DNA, 20 bp, mouse
gaactcaccgggaaagaagg

SEQ ID NO: 582121 - DNA, 20 bp, mouse
gcccggaggagtatgtgggt

SEQ ID NO: 582122 - DNA, 20 bp, mouse
gcttataaacttcagcctca

SEQ ID NO: 582123 - DNA, 20 bp, mouse
gcagaaatgaggggacgagt

SEQ ID NO: 582124 - DNA, 20 bp, mouse
gtcaggaaaagtaactcacc

SEQ ID NO: 582125 - DNA, 20 bp, mouse
gtggacaccagggccttcgg

SEQ ID NO: 582126 - DNA, 20 bp, mouse
gcagctgggagacaggatgg

SEQ ID NO: 582127 - DNA, 20 bp, mouse
gggagaaggacagcccatcc

SEQ ID NO: 582128 - DNA, 20 bp, mouse
gcagcgccttcaacctggat

SEQ ID NO: 582129 - DNA, 20 bp, mouse
gacttgggcaagagaggcat

SEQ ID NO: 582130 - DNA, 20 bp, mouse
gtagaggagggggagaccta

SEQ ID NO: 582131 - DNA, 20 bp, mouse
gtcaggggctggatcagtga

SEQ ID NO: 582132 - DNA, 20 bp, mouse
ggctggatcagtgaaggtga

SEQ ID NO: 582133 - DNA, 20 bp, mouse
ggacagcccatccaggttga

SEQ ID NO: 582134 - DNA, 20 bp, mouse
ggaaggtgaaggcatatgtt

SEQ ID NO: 582135 - DNA, 20 bp, mouse
gtgttgggtggagccaaacg

SEQ ID NO: 582136 - DNA, 20 bp, mouse
gctggaggaggtggactcac

SEQ ID NO: 582137 - DNA, 20 bp, mouse
gggtgagcccccaggcccag

SEQ ID NO: 582138 - DNA, 20 bp, mouse
ggaggtgcctgccagaaaca

SEQ ID NO: 582139 - DNA, 20 bp, mouse
gtagggtatgagcagtccgg

SEQ ID NO: 582140 - DNA, 20 bp, mouse
gcagcagggctctgaggcct

SEQ ID NO: 582141 - DNA, 20 bp, mouse
gaggtggactcacaggaggc

SEQ ID NO: 582142 - DNA, 20 bp, mouse
ggagcccccaggcccagcgg

SEQ ID NO: 582143 - DNA, 20 bp, mouse
gacctcctccgctgggcctg

SEQ ID NO: 582144 - DNA, 20 bp, mouse
gagttagggtatgagcagtc

SEQ ID NO: 582145 - DNA, 20 bp, mouse
ggagaggacgcaacagctgt

SEQ ID NO: 582146 - DNA, 20 bp, mouse
gcagagtctgactccagctg

SEQ ID NO: 582147 - DNA, 20 bp, mouse
ggcgtgtagcctgtgccagg

SEQ ID NO: 582148 - DNA, 20 bp, mouse
ggagtcagactctgggcctc

SEQ ID NO: 582149 - DNA, 20 bp, mouse
gcacagttgccgcctggcac

SEQ ID NO: 582150 - DNA, 20 bp, mouse
gcattacctaaggaagatcc

SEQ ID NO: 582151 - DNA, 20 bp, mouse
gactccagctggggcagaac

SEQ ID NO: 582152 - DNA, 20 bp, mouse
ggatgcgtgtagcctgtgcc

SEQ ID NO: 582153 - DNA, 20 bp, mouse
gtctggacacagttgccgcc

SEQ ID NO: 582154 - DNA, 20 bp, mouse
gaccccttgcataggctcta

SEQ ID NO: 582155 - DNA, 20 bp, mouse
gggcccagttctgccccagc

SEQ ID NO: 582156 - DNA, 20 bp, mouse
gcgccagtcaagaggacgag

SEQ ID NO: 582157 - DNA, 20 bp, mouse
gagcctctcgtcctcttgac

SEQ ID NO: 582158 - DNA, 20 bp, mouse
gagacctaatgggcacccca

SEQ ID NO: 582159 - DNA, 20 bp, mouse
ggctagtgccagtgccaggg

SEQ ID NO: 582160 - DNA, 20 bp, mouse
gcacaagtacgccagtcaag

SEQ ID NO: 582161 - DNA, 20 bp, mouse
gtgactggcgtacttgtgga

SEQ ID NO: 582162 - DNA, 20 bp, mouse
gcccagggactgtgaaatga

SEQ ID NO: 582163 - DNA, 20 bp, mouse
gcaataggttgtggatgtga

SEQ ID NO: 582164 - DNA, 20 bp, mouse
gctcagtgccaccctggcac

SEQ ID NO: 582165 - DNA, 20 bp, mouse
gggattagacagatagactc

SEQ ID NO: 582166 - DNA, 20 bp, mouse
gatagggacacccagttggt

SEQ ID NO: 582167 - DNA, 20 bp, mouse
gtgcattgggctcggagttg

SEQ ID NO: 582168 - DNA, 20 bp, mouse
ggtggtgagtatggttgctt

SEQ ID NO: 582169 - DNA, 20 bp, mouse
gctgtaggagcctaccaact

SEQ ID NO: 582170 - DNA, 20 bp, mouse
gctctcgagaggctacaaat

SEQ ID NO: 582171 - DNA, 20 bp, mouse
gaaagcacggagctcactaa

SEQ ID NO: 582172 - DNA, 20 bp, mouse
gacaaatagggacacccagt

SEQ ID NO: 582173 - DNA, 20 bp, mouse
gtagcctctcgagagatgaa

SEQ ID NO: 582174 - DNA, 20 bp, mouse
ggagggtcccttgtacacta

SEQ ID NO: 582175 - DNA, 20 bp, mouse
gggaacaggctacctgttga

SEQ ID NO: 582176 - DNA, 20 bp, mouse
ggcactgctagcggcattag

SEQ ID NO: 582177 - DNA, 20 bp, mouse
gactcaccagaccaagagag

SEQ ID NO: 582178 - DNA, 20 bp, mouse
ggaggaagtgctgaatagag

SEQ ID NO: 582179 - DNA, 20 bp, mouse
gggtctgatagcactgctag

SEQ ID NO: 582180 - DNA, 20 bp, mouse
ggctacatctgagctcccgg

SEQ ID NO: 582181 - DNA, 20 bp, mouse
gagtgctgaatagagaggtt

SEQ ID NO: 582182 - DNA, 20 bp, mouse
gagacagtgtgtggacactc

SEQ ID NO: 582183 - DNA, 20 bp, mouse
gggtacaggaagcaaagcga

SEQ ID NO: 582184 - DNA, 20 bp, mouse
gtgtgtggacactcgggtac

SEQ ID NO: 582185 - DNA, 20 bp, mouse
gcggaggttttgagatactg

SEQ ID NO: 582186 - DNA, 20 bp, mouse
gaaggaggtcatctgaagga

SEQ ID NO: 582187 - DNA, 20 bp, mouse
gaatgaaggaggtcatctga

SEQ ID NO: 582188 - DNA, 20 bp, mouse
gtccaggttcacttcttcct

SEQ ID NO: 582189 - DNA, 20 bp, mouse
gttctgctgggtcagtctgg

SEQ ID NO: 582190 - DNA, 20 bp, mouse
ggctgcagaatagattctcc

SEQ ID NO: 582191 - DNA, 20 bp, mouse
ggagaagccgacagtctgag

SEQ ID NO: 582192 - DNA, 20 bp, mouse
ggagcatgctcggggaggac

SEQ ID NO: 582193 - DNA, 20 bp, mouse
gataccctgagatccaacct

SEQ ID NO: 582194 - DNA, 20 bp, mouse
ggacatggagcccctccaca

SEQ ID NO: 582195 - DNA, 20 bp, mouse
gcatttctgctgggtcagtc

SEQ ID NO: 582196 - DNA, 20 bp, mouse
gcagcgaagcgccaaaggag

SEQ ID NO: 582197 - DNA, 20 bp, mouse
gtatgtcaggaggtgcccag

SEQ ID NO: 582198 - DNA, 20 bp, mouse
gggcagggagagccatgatt

SEQ ID NO: 582199 - DNA, 20 bp, mouse
gccagcgagagctcaccgca

SEQ ID NO: 582200 - DNA, 20 bp, mouse
ggtcgacagcgaagcgccaa

SEQ ID NO: 582201 - DNA, 20 bp, mouse
gagcctgcagaggctgacgg

SEQ ID NO: 582202 - DNA, 20 bp, mouse
gggagaccagtgcaagccag

SEQ ID NO: 582203 - DNA, 20 bp, mouse
gagggcttccaagagaacta

SEQ ID NO: 582204 - DNA, 20 bp, mouse
gatcccctcgaccactcctt

SEQ ID NO: 582205 - DNA, 20 bp, mouse
gtgggacgatgacacaccca

SEQ ID NO: 582206 - DNA, 20 bp, mouse
gcccgtggaaagccactcac

SEQ ID NO: 582207 - DNA, 20 bp, mouse
gctggctgtcataaatgggt

SEQ ID NO: 582208 - DNA, 20 bp, mouse
gatgggcaggatgtctagca

SEQ ID NO: 582209 - DNA, 20 bp, mouse
gaaaaggcagacttctgagg

SEQ ID NO: 582210 - DNA, 20 bp, mouse
ggatttccaggattgtacag

SEQ ID NO: 582211 - DNA, 20 bp, mouse
gtccataacatacaagctaa

SEQ ID NO: 582212 - DNA, 20 bp, mouse
gtctggaccagatagatgat

SEQ ID NO: 582213 - DNA, 20 bp, mouse
gctcactggctgtcataaat

SEQ ID NO: 582214 - DNA, 20 bp, mouse
gtgtcataaatgggtgggca

SEQ ID NO: 582215 - DNA, 20 bp, mouse
gtcaagacgatctcaggggg

SEQ ID NO: 582216 - DNA, 20 bp, mouse
gtatcccccaaccctcgcta

SEQ ID NO: 582217 - DNA, 20 bp, mouse
gagcagtgtctagcagaaga

SEQ ID NO: 582218 - DNA, 20 bp, mouse
gggcagggtgacaactgagt

SEQ ID NO: 582219 - DNA, 20 bp, mouse
gtgtaggctctccttagcga

SEQ ID NO: 582220 - DNA, 20 bp, mouse
gtcaagacatcgtgtaagta

SEQ ID NO: 582221 - DNA, 20 bp, mouse
gagctgacaaaggatatgtg

SEQ ID NO: 582222 - DNA, 20 bp, mouse
ggtgtctagcagaagagggc

SEQ ID NO: 582223 - DNA, 20 bp, mouse
gtagagtagcctcctctgag

SEQ ID NO: 582224 - DNA, 20 bp, mouse
gttacacgatgtcttgaaga

SEQ ID NO: 582225 - DNA, 20 bp, mouse
gtttctcgccctctcagagg

SEQ ID NO: 582226 - DNA, 20 bp, mouse
gaggaacaaaagatctagta

SEQ ID NO: 582227 - DNA, 20 bp, mouse
gaggaaagttggccaaggga

SEQ ID NO: 582228 - DNA, 20 bp, mouse
ggctaaagagtcacagatgt

SEQ ID NO: 582229 - DNA, 20 bp, mouse
ggtgtaagcccagtatttat

SEQ ID NO: 582230 - DNA, 20 bp, mouse
gcaggtagggtgctacataa

SEQ ID NO: 582231 - DNA, 20 bp, mouse
ggtggccagagactaggtca

SEQ ID NO: 582232 - DNA, 20 bp, mouse
gtgttaggcaagataaggag

SEQ ID NO: 582233 - DNA, 20 bp, mouse
gaaatgaagcttacttacca

SEQ ID NO: 582234 - DNA, 20 bp, mouse
gttggaggaaagttggccaa

SEQ ID NO: 582235 - DNA, 20 bp, mouse
ggggcttcaagaggaaggct

SEQ ID NO: 582236 - DNA, 20 bp, mouse
gttgctgctggagtcctctc

SEQ ID NO: 582237 - DNA, 20 bp, mouse
gttctcttgggtcctgtcag

SEQ ID NO: 582238 - DNA, 20 bp, mouse
gagcagcaaaggtgaccagg

SEQ ID NO: 582239 - DNA, 20 bp, mouse
gaggtgagaaagccactgac

SEQ ID NO: 582240 - DNA, 20 bp, mouse
gtgtctacactcctgttact

SEQ ID NO: 582241 - DNA, 20 bp, mouse
ggcttcagtgtccgagtaac

SEQ ID NO: 582242 - DNA, 20 bp, mouse
gtccgaggaaagaaaaaagc

SEQ ID NO: 582243 - DNA, 20 bp, mouse
gagtgtcagccgcagtcaca

SEQ ID NO: 582244 - DNA, 20 bp, mouse
ggcgccatctccaaaaacat

SEQ ID NO: 582245 - DNA, 20 bp, mouse
gtctttcctcggagggtgag

SEQ ID NO: 582246 - DNA, 20 bp, mouse
gctgcagcggttgcactgac

SEQ ID NO: 582247 - DNA, 20 bp, mouse
gcaggaacagcaggtgatag

SEQ ID NO: 582248 - DNA, 20 bp, mouse
gtgctcttgtgggcttctgg

SEQ ID NO: 582249 - DNA, 20 bp, mouse
gccctcccttgggaaagacg

SEQ ID NO: 582250 - DNA, 20 bp, mouse
gggtcagggagcataggagg

SEQ ID NO: 582251 - DNA, 20 bp, mouse
gtcccttgggaaagacgagg

SEQ ID NO: 582252 - DNA, 20 bp, mouse
gctgcgatcccccctccctt

SEQ ID NO: 582253 - DNA, 20 bp, mouse
gcaggtgggaatatcatgag

SEQ ID NO: 582254 - DNA, 20 bp, mouse
gaggggtcagggagcatagg

SEQ ID NO: 582255 - DNA, 20 bp, mouse
gtagcggctgaagagccagg

SEQ ID NO: 582256 - DNA, 20 bp, mouse
gaagagcgggcgggacgtaa

SEQ ID NO: 582257 - DNA, 20 bp, mouse
ggaagccgggccaaaagcct

SEQ ID NO: 582258 - DNA, 20 bp, mouse
ggcttccggaggtgaagagc

SEQ ID NO: 582259 - DNA, 20 bp, mouse
ggcgggcgggacgtaagggt

SEQ ID NO: 582260 - DNA, 20 bp, mouse
gtccggaggtgaagagcggg

SEQ ID NO: 582261 - DNA, 20 bp, mouse
ggacccctcgcctagacgac

SEQ ID NO: 582262 - DNA, 20 bp, mouse
ggcttccctactcctcacgg

SEQ ID NO: 582263 - DNA, 20 bp, mouse
ggggtcggcgcccgtcgtct

SEQ ID NO: 582264 - DNA, 20 bp, mouse
gcttttggcccggcttccgg

SEQ ID NO: 582265 - DNA, 20 bp, mouse
gggcagcggggccaacacca

SEQ ID NO: 582266 - DNA, 20 bp, mouse
gtgtgccaggtggaaacccg

SEQ ID NO: 582267 - DNA, 20 bp, mouse
ggaccagagagactcaactg

SEQ ID NO: 582268 - DNA, 20 bp, mouse
gcgatccccgggtttccacc

SEQ ID NO: 582269 - DNA, 20 bp, mouse
gtccacggttgccgatcccc

SEQ ID NO: 582270 - DNA, 20 bp, mouse
gtgggaacaggtgtgccagg

SEQ ID NO: 582271 - DNA, 20 bp, mouse
gctacctgttcagcaagatg

SEQ ID NO: 582272 - DNA, 20 bp, mouse
gtgaaccgctggaggtccac

SEQ ID NO: 582273 - DNA, 20 bp, mouse
ggcgacctgtggacctccag

SEQ ID NO: 582274 - DNA, 20 bp, mouse
ggagcaggacgccaaaccag

SEQ ID NO: 582275 - DNA, 20 bp, mouse
gtgttgggaacaggtgtgcc

SEQ ID NO: 582276 - DNA, 20 bp, mouse
ggctgcgtccgcaggactct

SEQ ID NO: 582277 - DNA, 20 bp, mouse
ggtccggcttgagcgaggta

SEQ ID NO: 582278 - DNA, 20 bp, mouse
gtgctgctgtcggcgactga

SEQ ID NO: 582279 - DNA, 20 bp, mouse
gcagcaagatgcggatcgcg

SEQ ID NO: 582280 - DNA, 20 bp, mouse
gctgcggacgcagcttcgtc

SEQ ID NO: 582281 - DNA, 20 bp, mouse
ggcttcgtccggcttgagcg

SEQ ID NO: 582282 - DNA, 20 bp, mouse
gccccctacctcgctcaagc

SEQ ID NO: 582283 - DNA, 20 bp, mouse
gcccatagccggagcctgcg

SEQ ID NO: 582284 - DNA, 20 bp, mouse
gttcattagaacggagaaaa

SEQ ID NO: 582285 - DNA, 20 bp, mouse
ggggcatcaccaagatgcta

SEQ ID NO: 582286 - DNA, 20 bp, mouse
gccccgggacagccagtggt

SEQ ID NO: 582287 - DNA, 20 bp, mouse
gctgtgctcggtctatgtcc

SEQ ID NO: 582288 - DNA, 20 bp, mouse
gagtctccaaaaccaaccac

SEQ ID NO: 582289 - DNA, 20 bp, mouse
gtgtcctgggtccccaactc

SEQ ID NO: 582290 - DNA, 20 bp, mouse
gcagctcgccacctactcag

SEQ ID NO: 582291 - DNA, 20 bp, mouse
ggcgagctgcctggagtagt

SEQ ID NO: 582292 - DNA, 20 bp, mouse
gaccaaccactggctgtccc

SEQ ID NO: 582293 - DNA, 20 bp, mouse
gggtctatgtcccggagttg

SEQ ID NO: 582294 - DNA, 20 bp, mouse
gaagttggcgctgaagagaa

SEQ ID NO: 582295 - DNA, 20 bp, mouse
ggacagccagtggttggttt

SEQ ID NO: 582296 - DNA, 20 bp, mouse
gaggggcaggcgacaaggtc

SEQ ID NO: 582297 - DNA, 20 bp, mouse
gagttcaggggcaggcgaca

SEQ ID NO: 582298 - DNA, 20 bp, mouse
ggtctgggagaacaagttca

SEQ ID NO: 582299 - DNA, 20 bp, mouse
gctagcgggagagaaacctg

SEQ ID NO: 582300 - DNA, 20 bp, mouse
gggtggctggacaagcctag

SEQ ID NO: 582301 - DNA, 20 bp, mouse
ggagctggtggagaggtata

SEQ ID NO: 582302 - DNA, 20 bp, mouse
gctcctccggaggtcgctcg

SEQ ID NO: 582303 - DNA, 20 bp, mouse
ggggagtcttagctgagaca

SEQ ID NO: 582304 - DNA, 20 bp, mouse
gggagaacaagttcaggggc

SEQ ID NO: 582305 - DNA, 20 bp, mouse
gtttgccttcggattctctg

SEQ ID NO: 582306 - DNA, 20 bp, mouse
ggccgctggctgccagccgg

SEQ ID NO: 582307 - DNA, 20 bp, mouse
gcagccggtggcaggactct

SEQ ID NO: 582308 - DNA, 20 bp, mouse
gcaggcagtagtacacccag

SEQ ID NO: 582309 - DNA, 20 bp, mouse
gatcagtacctggtccacgc

SEQ ID NO: 582310 - DNA, 20 bp, mouse
gtctctcagtctgtccccgg

SEQ ID NO: 582311 - DNA, 20 bp, mouse
gattgtagtgcaggacaatg

SEQ ID NO: 582312 - DNA, 20 bp, mouse
ggactctggggtcaccagcg

SEQ ID NO: 582313 - DNA, 20 bp, mouse
ggtggtgctggagaacgcca

SEQ ID NO: 582314 - DNA, 20 bp, mouse
gactgagagaggcctccgca

SEQ ID NO: 582315 - DNA, 20 bp, mouse
ggcagtagtacacccagcgg

SEQ ID NO: 582316 - DNA, 20 bp, mouse
gcgaccggacccaggcgcaa

SEQ ID NO: 582317 - DNA, 20 bp, mouse
gggtgagtgtccagcactag

SEQ ID NO: 582318 - DNA, 20 bp, mouse
ggcggtgcgcctgggaacac

SEQ ID NO: 582319 - DNA, 20 bp, mouse
gtccggtcgtgtgccctagg

SEQ ID NO: 582320 - DNA, 20 bp, mouse
gagggcacacgaccggaccc

SEQ ID NO: 582321 - DNA, 20 bp, mouse
gtgcgcctgggaacactgga

SEQ ID NO: 582322 - DNA, 20 bp, mouse
gaccgcctagggcacacgac

SEQ ID NO: 582323 - DNA, 20 bp, mouse
gttcccaggcgcaccgccta

SEQ ID NO: 582324 - DNA, 20 bp, mouse
gggttcactcgggagagggt

SEQ ID NO: 582325 - DNA, 20 bp, mouse
gtcacccttgcgcctgggtc

SEQ ID NO: 582326 - DNA, 20 bp, mouse
gagcagtgctctgggaagtg

SEQ ID NO: 582327 - DNA, 20 bp, mouse
gaaattgtggcaccagaatt

SEQ ID NO: 582328 - DNA, 20 bp, mouse
gaattaggaatttggaactg

SEQ ID NO: 582329 - DNA, 20 bp, mouse
ggcacaggccagatagccaa

SEQ ID NO: 582330 - DNA, 20 bp, mouse
gggactggaagtatgcaggg

SEQ ID NO: 582331 - DNA, 20 bp, mouse
gagaggactggaagtatgca

SEQ ID NO: 582332 - DNA, 20 bp, mouse
gtctctctcttaccaaattg

SEQ ID NO: 582333 - DNA, 20 bp, mouse
gcgaattagcatgaaaatga

SEQ ID NO: 582334 - DNA, 20 bp, mouse
gagaactcattgctcttctc

SEQ ID NO: 582335 - DNA, 20 bp, mouse
gtgagcagactccagaggac

SEQ ID NO: 582336 - DNA, 20 bp, mouse
gttgtctggagttttcccaa

SEQ ID NO: 582337 - DNA, 20 bp, mouse
gtctggagttttcccaaggg

SEQ ID NO: 582338 - DNA, 20 bp, mouse
gacagcctggcaccaccctt

SEQ ID NO: 582339 - DNA, 20 bp, mouse
gggtgagggcaaggacagcc

SEQ ID NO: 582340 - DNA, 20 bp, mouse
gccctgctcaggtgagggca

SEQ ID NO: 582341 - DNA, 20 bp, mouse
gggcagatctggtgatctat

SEQ ID NO: 582342 - DNA, 20 bp, mouse
gtctgtctaagaaggcaggc

SEQ ID NO: 582343 - DNA, 20 bp, mouse
gccaggtgagaggcagatcc

SEQ ID NO: 582344 - DNA, 20 bp, mouse
ggatctgcccaggagacacc

SEQ ID NO: 582345 - DNA, 20 bp, mouse
gccaggagacaccaggtgag

SEQ ID NO: 582346 - DNA, 20 bp, mouse
ggtctcctgggcagatctgg

SEQ ID NO: 582347 - DNA, 20 bp, mouse
ggcctccctgctcaggtgag

SEQ ID NO: 582348 - DNA, 20 bp, mouse
gggggtttgtgccaggctga

SEQ ID NO: 582349 - DNA, 20 bp, mouse
gggcagatctggtggtctat

SEQ ID NO: 582350 - DNA, 20 bp, mouse
gccaggtgagaggcagatcc

SEQ ID NO: 582351 - DNA, 20 bp, mouse
ggatctgcccaggagacacc

SEQ ID NO: 582352 - DNA, 20 bp, mouse
gccaggagacaccaggtgag

SEQ ID NO: 582353 - DNA, 20 bp, mouse
gtatgggtgtaggtgagagg

SEQ ID NO: 582354 - DNA, 20 bp, mouse
gcagtagagaggggtctgga

SEQ ID NO: 582355 - DNA, 20 bp, mouse
ggccaggaggttccactgag

SEQ ID NO: 582356 - DNA, 20 bp, mouse
gggacagaagccactcacct

SEQ ID NO: 582357 - DNA, 20 bp, mouse
gttctgggaccccaggtgag

SEQ ID NO: 582358 - DNA, 20 bp, mouse
gcgtgctgcgagctccttct

SEQ ID NO: 582359 - DNA, 20 bp, mouse
gggccacatctcctcagcaa

SEQ ID NO: 582360 - DNA, 20 bp, mouse
gtttccagagggctatgtgg

SEQ ID NO: 582361 - DNA, 20 bp, mouse
gatctgcaaagaggaaatgc

SEQ ID NO: 582362 - DNA, 20 bp, mouse
gtctgtgtgaattcagggaa

SEQ ID NO: 582363 - DNA, 20 bp, mouse
gagaatgcagggagctatgt

SEQ ID NO: 582364 - DNA, 20 bp, mouse
ggtcctttgctgaggagatg

SEQ ID NO: 582365 - DNA, 20 bp, mouse
ggggaaaagaatctgcaaag

SEQ ID NO: 582366 - DNA, 20 bp, mouse
gcagaggaattgggaccgtt

SEQ ID NO: 582367 - DNA, 20 bp, mouse
gcgttaggaccttctctcca

SEQ ID NO: 582368 - DNA, 20 bp, mouse
gcgatggatggccctttctc

SEQ ID NO: 582369 - DNA, 20 bp, mouse
gtggatggccctttctctgg

SEQ ID NO: 582370 - DNA, 20 bp, mouse
gaccccaccccccggagata

SEQ ID NO: 582371 - DNA, 20 bp, mouse
gtggagaagtgtgacatcga

SEQ ID NO: 582372 - DNA, 20 bp, mouse
gataagaccctatctccggg

SEQ ID NO: 582373 - DNA, 20 bp, mouse
ggaagtgtgacatcgatgga

SEQ ID NO: 582374 - DNA, 20 bp, mouse
gcctgctgctttctctctcc

SEQ ID NO: 582375 - DNA, 20 bp, mouse
gaggagtttaggaccctcta

SEQ ID NO: 582376 - DNA, 20 bp, mouse
gcatcctccgaaccacaggt

SEQ ID NO: 582377 - DNA, 20 bp, mouse
gcctccgaaccacaggtagg

SEQ ID NO: 582378 - DNA, 20 bp, mouse
gggtaggcggcggaggagac

SEQ ID NO: 582379 - DNA, 20 bp, mouse
gccgaaccacaggtaggcgg

SEQ ID NO: 582380 - DNA, 20 bp, mouse
gacagtaccggaagccgcgg

SEQ ID NO: 582381 - DNA, 20 bp, mouse
gaagccgcggaggaggcgag

SEQ ID NO: 582382 - DNA, 20 bp, mouse
gcgatgcgcgccaacagtac

SEQ ID NO: 582383 - DNA, 20 bp, mouse
gcgtcctctcgcctcctccg

SEQ ID NO: 582384 - DNA, 20 bp, mouse
gccgtgcccagggagtggac

SEQ ID NO: 582385 - DNA, 20 bp, mouse
gccaacagtaccggaagccg

SEQ ID NO: 582386 - DNA, 20 bp, mouse
gaggcgcgatggattatggg

SEQ ID NO: 582387 - DNA, 20 bp, mouse
ggccaggcgcgatggattat

SEQ ID NO: 582388 - DNA, 20 bp, mouse
gggcggccgggcacatgtct

SEQ ID NO: 582389 - DNA, 20 bp, mouse
gatcatgggacgatttaagg

SEQ ID NO: 582390 - DNA, 20 bp, mouse
gccggacatggtaggggtgt

SEQ ID NO: 582391 - DNA, 20 bp, mouse
gttatgggaggcgtttctaa

SEQ ID NO: 582392 - DNA, 20 bp, mouse
gttgcagccggacatggtag

SEQ ID NO: 582393 - DNA, 20 bp, mouse
gcggcaaatcgagaaagccg

SEQ ID NO: 582394 - DNA, 20 bp, mouse
gctacaaaccgatgcatcat

SEQ ID NO: 582395 - DNA, 20 bp, mouse
ggaggcgtttctaaaggccg

SEQ ID NO: 582396 - DNA, 20 bp, mouse
gtgcgggtggagcgaagagg

SEQ ID NO: 582397 - DNA, 20 bp, mouse
gcactgcgggtggagcgaag

SEQ ID NO: 582398 - DNA, 20 bp, mouse
ggtggcagcgggctacactg

SEQ ID NO: 582399 - DNA, 20 bp, mouse
gcagcgggctacactgcggg

SEQ ID NO: 582400 - DNA, 20 bp, mouse
gagaggaggaagctgcacga

SEQ ID NO: 582401 - DNA, 20 bp, mouse
gggaggaagctgcacgatgg

SEQ ID NO: 582402 - DNA, 20 bp, mouse
ggtgtagcccgctgccaccc

SEQ ID NO: 582403 - DNA, 20 bp, mouse
ggaccaccgcgcctggggag

SEQ ID NO: 582404 - DNA, 20 bp, mouse
gctgcggccgctgacaggaa

SEQ ID NO: 582405 - DNA, 20 bp, mouse
ggcctggggagcggtcgccg

SEQ ID NO: 582406 - DNA, 20 bp, mouse
gtctgccgcagcccgcagaa

SEQ ID NO: 582407 - DNA, 20 bp, mouse
ggcagaggaaggcgccgctg

SEQ ID NO: 582408 - DNA, 20 bp, mouse
ggggctgcaaagggccatgt

SEQ ID NO: 582409 - DNA, 20 bp, mouse
gccgagcgcgcggcgcgcta

SEQ ID NO: 582410 - DNA, 20 bp, mouse
gcctgaggcggggatcctca

SEQ ID NO: 582411 - DNA, 20 bp, mouse
ggaggaaggcgccgctgcgg

SEQ ID NO: 582412 - DNA, 20 bp, mouse
gagtggcggacctctcggag

SEQ ID NO: 582413 - DNA, 20 bp, mouse
gggacaggtgacgagacccc

SEQ ID NO: 582414 - DNA, 20 bp, mouse
ggtgggctgcaggaccgtgg

SEQ ID NO: 582415 - DNA, 20 bp, mouse
ggccctgggaccgttatctg

SEQ ID NO: 582416 - DNA, 20 bp, mouse
ggccggcgccatggtagaga

SEQ ID NO: 582417 - DNA, 20 bp, mouse
ggcctcctccttctctacca

SEQ ID NO: 582418 - DNA, 20 bp, mouse
gggcgccatggtagagaagg

SEQ ID NO: 582419 - DNA, 20 bp, mouse
ggagcgggtgagctgaaagc

SEQ ID NO: 582420 - DNA, 20 bp, mouse
ggtgtgggccctgagggagt

SEQ ID NO: 582421 - DNA, 20 bp, mouse
gtgctggcggttagcgagag

SEQ ID NO: 582422 - DNA, 20 bp, mouse
gccgcctccgctccacaaca

SEQ ID NO: 582423 - DNA, 20 bp, mouse
ggcagcgagtccgtgcaccg

SEQ ID NO: 582424 - DNA, 20 bp, mouse
ggtgcggccctgttgtggag

SEQ ID NO: 582425 - DNA, 20 bp, mouse
ggagctgaaagccggcgcca

SEQ ID NO: 582426 - DNA, 20 bp, mouse
ggaagcggttccctctcagg

SEQ ID NO: 582427 - DNA, 20 bp, mouse
gtcgaggtgcgcctccgggg

SEQ ID NO: 582428 - DNA, 20 bp, mouse
ggctgaagcggttccctctc

SEQ ID NO: 582429 - DNA, 20 bp, mouse
ggtgtcgaggtgcgcctccg

SEQ ID NO: 582430 - DNA, 20 bp, mouse
gcggccctcttaccacaaaa

SEQ ID NO: 582431 - DNA, 20 bp, mouse
gctcaggcggcgccattttg

SEQ ID NO: 582432 - DNA, 20 bp, mouse
gctccgcggcgtcagagacc

SEQ ID NO: 582433 - DNA, 20 bp, mouse
ggaatggcggagactctgtc

SEQ ID NO: 582434 - DNA, 20 bp, mouse
gggaaccgcttcagcctccc

SEQ ID NO: 582435 - DNA, 20 bp, mouse
gaccagggtccctggaatgg

SEQ ID NO: 582436 - DNA, 20 bp, mouse
gtcgctggcaccagctgtgg

SEQ ID NO: 582437 - DNA, 20 bp, mouse
gaccagctgtggcggctcgg

SEQ ID NO: 582438 - DNA, 20 bp, mouse
ggctcggaggtagtacaaaa

SEQ ID NO: 582439 - DNA, 20 bp, mouse
gtggtgccagcgagtggagg

SEQ ID NO: 582440 - DNA, 20 bp, mouse
gcggaaccccctccactcgc

SEQ ID NO: 582441 - DNA, 20 bp, mouse
gcctgcgcagccgcaaaggg

SEQ ID NO: 582442 - DNA, 20 bp, mouse
gagcggaacctggatacggg

SEQ ID NO: 582443 - DNA, 20 bp, mouse
ggcgagtgcgttttcctctt

SEQ ID NO: 582444 - DNA, 20 bp, mouse
gctcggagagtgggacgcgg

SEQ ID NO: 582445 - DNA, 20 bp, mouse
gggagcgagttgggaagtcg

SEQ ID NO: 582446 - DNA, 20 bp, mouse
gtggccagagaagtcacgag

SEQ ID NO: 582447 - DNA, 20 bp, mouse
gtctggccagctcaactggg

SEQ ID NO: 582448 - DNA, 20 bp, mouse
ggctcactgtcgaaaagcac

SEQ ID NO: 582449 - DNA, 20 bp, mouse
gttctctggccagctcaact

SEQ ID NO: 582450 - DNA, 20 bp, mouse
gtaccctctcgtgacttctc

SEQ ID NO: 582451 - DNA, 20 bp, mouse
gtgggtggtgacaaattaca

SEQ ID NO: 582452 - DNA, 20 bp, mouse
gggtccctcagagcgtgggc

SEQ ID NO: 582453 - DNA, 20 bp, mouse
ggcagccagcccacgctctg

SEQ ID NO: 582454 - DNA, 20 bp, mouse
ggataggcaaagccatctca

SEQ ID NO: 582455 - DNA, 20 bp, mouse
gtcctctcagactggcagat

SEQ ID NO: 582456 - DNA, 20 bp, mouse
gtcggcgagcggaaaccccg

SEQ ID NO: 582457 - DNA, 20 bp, mouse
gtgcaggacttcgggaacct

SEQ ID NO: 582458 - DNA, 20 bp, mouse
ggaaaccccgaggcaggagg

SEQ ID NO: 582459 - DNA, 20 bp, mouse
gcgagcggaaaccccgaggc

SEQ ID NO: 582460 - DNA, 20 bp, mouse
gccttcgggtgcaggacttc

SEQ ID NO: 582461 - DNA, 20 bp, mouse
gtagacctcctcctgcctcg

SEQ ID NO: 582462 - DNA, 20 bp, mouse
gcctaggacacggagcacta

SEQ ID NO: 582463 - DNA, 20 bp, mouse
gggaggtctaaactaagccg

SEQ ID NO: 582464 - DNA, 20 bp, mouse
ggactaaactaactaaactt

SEQ ID NO: 582465 - DNA, 20 bp, mouse
gttgggcgcctgcgaacctg

SEQ ID NO: 582466 - DNA, 20 bp, mouse
gcacccagcgacccagactg

SEQ ID NO: 582467 - DNA, 20 bp, mouse
gcccagactgcggaggagat

SEQ ID NO: 582468 - DNA, 20 bp, mouse
ggccggcggcctccccagac

SEQ ID NO: 582469 - DNA, 20 bp, mouse
gccagcgacccagactgcgg

SEQ ID NO: 582470 - DNA, 20 bp, mouse
gctgcggaggagatcggcag

SEQ ID NO: 582471 - DNA, 20 bp, mouse
ggccaggcttgggcagagat

SEQ ID NO: 582472 - DNA, 20 bp, mouse
gatgggtatccggtctgggg

SEQ ID NO: 582473 - DNA, 20 bp, mouse
gggagcgcggaggtgcggta

SEQ ID NO: 582474 - DNA, 20 bp, mouse
gggaccctgcggggagtctg

SEQ ID NO: 582475 - DNA, 20 bp, mouse
gggatgggttaggacacaat

SEQ ID NO: 582476 - DNA, 20 bp, mouse
gggtgcggcgcggaccgtgg

SEQ ID NO: 582477 - DNA, 20 bp, mouse
gccgagcaggctgcaaactt

SEQ ID NO: 582478 - DNA, 20 bp, mouse
gcagcctgctcggcgcggag

SEQ ID NO: 582479 - DNA, 20 bp, mouse
gcggccgcgctagcgaggag

SEQ ID NO: 582480 - DNA, 20 bp, mouse
gcggagccgcacctgagcga

SEQ ID NO: 582481 - DNA, 20 bp, mouse
gctcctccgtcgctcaggtg

SEQ ID NO: 582482 - DNA, 20 bp, mouse
gaggccgctctcgcaattag

SEQ ID NO: 582483 - DNA, 20 bp, mouse
gggccgccggagtccgctgg

SEQ ID NO: 582484 - DNA, 20 bp, mouse
gccgattggccggcctccag

SEQ ID NO: 582485 - DNA, 20 bp, mouse
ggtgagggccggggacctca

SEQ ID NO: 582486 - DNA, 20 bp, mouse
gcaactccaggaattggtgg

SEQ ID NO: 582487 - DNA, 20 bp, mouse
gtgcgcgtttcggccgaagg

SEQ ID NO: 582488 - DNA, 20 bp, mouse
gtcccaactccaggaattgg

SEQ ID NO: 582489 - DNA, 20 bp, mouse
gggaattggtggcggagagg

SEQ ID NO: 582490 - DNA, 20 bp, mouse
gaagtcaccagggctcttcc

SEQ ID NO: 582491 - DNA, 20 bp, mouse
ggacctcgccgaggcgctgg

SEQ ID NO: 582492 - DNA, 20 bp, mouse
gggggcgccgggaagagccc

SEQ ID NO: 582493 - DNA, 20 bp, mouse
gcgctggcggcggaggaacc

SEQ ID NO: 582494 - DNA, 20 bp, mouse
gcggaggaacccggtgagtg

SEQ ID NO: 582495 - DNA, 20 bp, mouse
gatttcccaactccaggaat

SEQ ID NO: 582496 - DNA, 20 bp, mouse
gctcctccgcctccccccgg

SEQ ID NO: 582497 - DNA, 20 bp, mouse
gcagcgcctcggcggagcgg

SEQ ID NO: 582498 - DNA, 20 bp, mouse
gccgaggcgctgcgcccccc

SEQ ID NO: 582499 - DNA, 20 bp, mouse
ggcggcggccgccaccacgg

SEQ ID NO: 582500 - DNA, 20 bp, mouse
gctacccccgccggagacgg

SEQ ID NO: 582501 - DNA, 20 bp, mouse
gtggtagtgcggggaagcgg

SEQ ID NO: 582502 - DNA, 20 bp, mouse
gcgcgagcgcagcgagtcga

SEQ ID NO: 582503 - DNA, 20 bp, mouse
gtgctccgggtcagctacaa

SEQ ID NO: 582504 - DNA, 20 bp, mouse
gggcagatgcgctccaggtc

SEQ ID NO: 582505 - DNA, 20 bp, mouse
gggggaagcggcggacgacg

SEQ ID NO: 582506 - DNA, 20 bp, mouse
ggcacctgccgcccagccct

SEQ ID NO: 582507 - DNA, 20 bp, mouse
gaagcccaagccggtccccg

SEQ ID NO: 582508 - DNA, 20 bp, mouse
gcgcggccggggagtctgcg

SEQ ID NO: 582509 - DNA, 20 bp, mouse
ggagctcggaggtgtatcgg

SEQ ID NO: 582510 - DNA, 20 bp, mouse
ggggcccaaggagagcaccg

SEQ ID NO: 582511 - DNA, 20 bp, mouse
gcgggagctcggaggtgtat

SEQ ID NO: 582512 - DNA, 20 bp, mouse
gggcagccagtgtggccggt

SEQ ID NO: 582513 - DNA, 20 bp, mouse
gccccggcgcgagctcgcgg

SEQ ID NO: 582514 - DNA, 20 bp, mouse
gctttgccgcgcagactccc

SEQ ID NO: 582515 - DNA, 20 bp, mouse
gggtgagctgggatggaccc

SEQ ID NO: 582516 - DNA, 20 bp, mouse
ggacgctctgccagaatcca

SEQ ID NO: 582517 - DNA, 20 bp, mouse
ggccacaggctgctgtcaca

SEQ ID NO: 582518 - DNA, 20 bp, mouse
ggccctgtgacagcagcctg

SEQ ID NO: 582519 - DNA, 20 bp, mouse
ggctgtcacaggtgggccac

SEQ ID NO: 582520 - DNA, 20 bp, mouse
gccacctgtgacagcagccc

SEQ ID NO: 582521 - DNA, 20 bp, mouse
gggacacaccatccatgggt

SEQ ID NO: 582522 - DNA, 20 bp, mouse
gtaggggacacaccatccat

SEQ ID NO: 582523 - DNA, 20 bp, mouse
gagcgtctacgaagtgacct

SEQ ID NO: 582524 - DNA, 20 bp, mouse
gcatccacagagccccatcg

SEQ ID NO: 582525 - DNA, 20 bp, mouse
ggaggagaggatgtgtaagt

SEQ ID NO: 582526 - DNA, 20 bp, mouse
gcggggcaggaggagtacct

SEQ ID NO: 582527 - DNA, 20 bp, mouse
gagctctgagagaatggctg

SEQ ID NO: 582528 - DNA, 20 bp, mouse
gtggagtgcgcgggttaaga

SEQ ID NO: 582529 - DNA, 20 bp, mouse
gctgagagaatggctgtgga

SEQ ID NO: 582530 - DNA, 20 bp, mouse
gtgagcgccaagtggtacaa

SEQ ID NO: 582531 - DNA, 20 bp, mouse
gccggagccgagcttcatca

SEQ ID NO: 582532 - DNA, 20 bp, mouse
gttgccattgagagaggtgt

SEQ ID NO: 582533 - DNA, 20 bp, mouse
ggtaggtgagcaggacttca

SEQ ID NO: 582534 - DNA, 20 bp, mouse
gtcctggcctggcaaggctc

SEQ ID NO: 582535 - DNA, 20 bp, mouse
gtggaaggtaagggacgctt

SEQ ID NO: 582536 - DNA, 20 bp, mouse
gtgggtgggaggtaagtgat

SEQ ID NO: 582537 - DNA, 20 bp, mouse
gggccacccggcggctgggt

SEQ ID NO: 582538 - DNA, 20 bp, mouse
gctcccacccagccgccggg

SEQ ID NO: 582539 - DNA, 20 bp, mouse
ggggcagagctggcgggaca

SEQ ID NO: 582540 - DNA, 20 bp, mouse
gtacctcccacccagccgcc

SEQ ID NO: 582541 - DNA, 20 bp, mouse
gaggtaagtgatgggctcgc

SEQ ID NO: 582542 - DNA, 20 bp, mouse
gtggcggccacccggcggct

SEQ ID NO: 582543 - DNA, 20 bp, mouse
gttcgcgcgtggcggccacc

SEQ ID NO: 582544 - DNA, 20 bp, mouse
gccctcctctccaggatgaa

SEQ ID NO: 582545 - DNA, 20 bp, mouse
ggcgggacagggcaggtcgt

SEQ ID NO: 582546 - DNA, 20 bp, mouse
gcgggagacaaagaacggta

SEQ ID NO: 582547 - DNA, 20 bp, mouse
ggggcgatacgcttatgggg

SEQ ID NO: 582548 - DNA, 20 bp, mouse
gagacaaagaacggtaggga

SEQ ID NO: 582549 - DNA, 20 bp, mouse
ggcagtggctaggtccgtgg

SEQ ID NO: 582550 - DNA, 20 bp, mouse
ggcccgggataaggcgacgg

SEQ ID NO: 582551 - DNA, 20 bp, mouse
gatggggaggccgagcgccc

SEQ ID NO: 582552 - DNA, 20 bp, mouse
gcgactgccgggcaggagag

SEQ ID NO: 582553 - DNA, 20 bp, mouse
gggggggcgatacgcttatg

SEQ ID NO: 582554 - DNA, 20 bp, mouse
gagtcccggaaagaatggag

SEQ ID NO: 582555 - DNA, 20 bp, mouse
gcccgcggtccgagaagtag

SEQ ID NO: 582556 - DNA, 20 bp, mouse
gctgacatgtctgaagtctc

SEQ ID NO: 582557 - DNA, 20 bp, mouse
gagccaaccaggacacgcaa

SEQ ID NO: 582558 - DNA, 20 bp, mouse
gggaagttgaggttgctagg

SEQ ID NO: 582559 - DNA, 20 bp, mouse
ggagacgctgtcggaagttg

SEQ ID NO: 582560 - DNA, 20 bp, mouse
ggaggttgctaggaggcctt

SEQ ID NO: 582561 - DNA, 20 bp, mouse
ggtatccatagagacgctgt

SEQ ID NO: 582562 - DNA, 20 bp, mouse
gaccgagacccaggaaatgt

SEQ ID NO: 582563 - DNA, 20 bp, mouse
ggtcggaagttgaggttgct

SEQ ID NO: 582564 - DNA, 20 bp, mouse
gcccccttgcgtgtcctggt

SEQ ID NO: 582565 - DNA, 20 bp, mouse
ggtgtcctggttggctctag

SEQ ID NO: 582566 - DNA, 20 bp, mouse
gatgcctgcggaaatcaagt

SEQ ID NO: 582567 - DNA, 20 bp, mouse
gagacagccggcacatacaa

SEQ ID NO: 582568 - DNA, 20 bp, mouse
ggcggaaatcaagtaggaga

SEQ ID NO: 582569 - DNA, 20 bp, mouse
gtgaagctgacggatgcctg

SEQ ID NO: 582570 - DNA, 20 bp, mouse
gtgggtaccattgtatgtgc

SEQ ID NO: 582571 - DNA, 20 bp, mouse
gggttggtggaaaaaaactt

SEQ ID NO: 582572 - DNA, 20 bp, mouse
gcaaagactaataatcagag

SEQ ID NO: 582573 - DNA, 20 bp, mouse
gaaatcaaattgttgcttaa

SEQ ID NO: 582574 - DNA, 20 bp, mouse
ggtgttaatggtacagcatt

SEQ ID NO: 582575 - DNA, 20 bp, mouse
ggcgcacccgcacgactgca

SEQ ID NO: 582576 - DNA, 20 bp, mouse
gcttcgcgagccgacactgg

SEQ ID NO: 582577 - DNA, 20 bp, mouse
ggtccttcgcgagccgacac

SEQ ID NO: 582578 - DNA, 20 bp, mouse
gtcccgggcgaggcacccag

SEQ ID NO: 582579 - DNA, 20 bp, mouse
gctcgcccgggacagcagaa

SEQ ID NO: 582580 - DNA, 20 bp, mouse
gaagggtcggaggaaccact

SEQ ID NO: 582581 - DNA, 20 bp, mouse
gtcgccacgggagctgagat

SEQ ID NO: 582582 - DNA, 20 bp, mouse
ggcagggatgagctgcgtgg

SEQ ID NO: 582583 - DNA, 20 bp, mouse
ggaagcccccgggaaagggt

SEQ ID NO: 582584 - DNA, 20 bp, mouse
ggagggcagcgctgcgggtt

SEQ ID NO: 582585 - DNA, 20 bp, mouse
gtaagcgccggaccctctgg

SEQ ID NO: 582586 - DNA, 20 bp, mouse
ggcccgcgtaccgccctcag

SEQ ID NO: 582587 - DNA, 20 bp, mouse
gggcggcgcgagaccgctga

SEQ ID NO: 582588 - DNA, 20 bp, mouse
gcattggggattcaacatgg

SEQ ID NO: 582589 - DNA, 20 bp, mouse
gaccgctgagggcggtacgc

SEQ ID NO: 582590 - DNA, 20 bp, mouse
gaggccccggatgttcattg

SEQ ID NO: 582591 - DNA, 20 bp, mouse
gtggggattcaacatggcgg

SEQ ID NO: 582592 - DNA, 20 bp, mouse
gatggcggcggcagtagccg

SEQ ID NO: 582593 - DNA, 20 bp, mouse
gtagtgggcggcgaggagta

SEQ ID NO: 582594 - DNA, 20 bp, mouse
ggttcattggggattcaaca

SEQ ID NO: 582595 - DNA, 20 bp, mouse
gtacgcgggcacagagttct

SEQ ID NO: 582596 - DNA, 20 bp, mouse
gagtacccaagtgacacggg

SEQ ID NO: 582597 - DNA, 20 bp, mouse
ggaaaacgaggagcgtctag

SEQ ID NO: 582598 - DNA, 20 bp, mouse
ggcgagtacccaagtgacac

SEQ ID NO: 582599 - DNA, 20 bp, mouse
gggagcgtctagcggcgaag

SEQ ID NO: 582600 - DNA, 20 bp, mouse
gggtgcacatggctgagact

SEQ ID NO: 582601 - DNA, 20 bp, mouse
ggagccatagaaagcagccg

SEQ ID NO: 582602 - DNA, 20 bp, mouse
ggcggtggccgcgcatccag

SEQ ID NO: 582603 - DNA, 20 bp, mouse
ggccggagcctaaccactaa

SEQ ID NO: 582604 - DNA, 20 bp, mouse
gggtgccgcccgtgtcactt

SEQ ID NO: 582605 - DNA, 20 bp, mouse
gcatagaaagcagccgggga

SEQ ID NO: 582606 - DNA, 20 bp, mouse
ggcaacagaaggtaggacag

SEQ ID NO: 582607 - DNA, 20 bp, mouse
gcagcttctcaggtgctcgg

SEQ ID NO: 582608 - DNA, 20 bp, mouse
ggagaagctgctgcaacaga

SEQ ID NO: 582609 - DNA, 20 bp, mouse
gggctctggtgatcctcagt

SEQ ID NO: 582610 - DNA, 20 bp, mouse
gtggtttgcaccgcccactg

SEQ ID NO: 582611 - DNA, 20 bp, mouse
gtctggtgatcctcagtggg

SEQ ID NO: 582612 - DNA, 20 bp, mouse
ggtacatcctctctaagggt

SEQ ID NO: 582613 - DNA, 20 bp, mouse
gtgcacgtacatcctctcta

SEQ ID NO: 582614 - DNA, 20 bp, mouse
gactctgacaaaccaaaagt

SEQ ID NO: 582615 - DNA, 20 bp, mouse
ggcattgttatcatagaagt

SEQ ID NO: 582616 - DNA, 20 bp, mouse
gtggcggcacggctccaaag

SEQ ID NO: 582617 - DNA, 20 bp, mouse
gagccggctcggctaccagc

SEQ ID NO: 582618 - DNA, 20 bp, mouse
ggcgcaggcgggagccggct

SEQ ID NO: 582619 - DNA, 20 bp, mouse
gtgcccgctggtagccgagc

SEQ ID NO: 582620 - DNA, 20 bp, mouse
gtcccgaagcagttccggtt

SEQ ID NO: 582621 - DNA, 20 bp, mouse
gcagcagcggccagccgaac

SEQ ID NO: 582622 - DNA, 20 bp, mouse
gggcatcgctccggcccctt

SEQ ID NO: 582623 - DNA, 20 bp, mouse
gagtcagacgcgaaggccgg

SEQ ID NO: 582624 - DNA, 20 bp, mouse
ggctgacccgcgggcaacaa

SEQ ID NO: 582625 - DNA, 20 bp, mouse
ggggcgccgaggctgatgag

SEQ ID NO: 582626 - DNA, 20 bp, mouse
gttgtttgtcacggacatct

SEQ ID NO: 582627 - DNA, 20 bp, mouse
gtttctttactaaaatggac

SEQ ID NO: 582628 - DNA, 20 bp, mouse
ggtatattctaaaacaaagc

SEQ ID NO: 582629 - DNA, 20 bp, mouse
gaactggctgagagacacca

SEQ ID NO: 582630 - DNA, 20 bp, mouse
gttgtcacggacatcttggg

SEQ ID NO: 582631 - DNA, 20 bp, mouse
gttaaggtagacaagcagac

SEQ ID NO: 582632 - DNA, 20 bp, mouse
gcaatagcaacaacaataat

SEQ ID NO: 582633 - DNA, 20 bp, mouse
gccagtttaagctggtgtta

SEQ ID NO: 582634 - DNA, 20 bp, mouse
gaaacaacttcatttagtct

SEQ ID NO: 582635 - DNA, 20 bp, mouse
gtctctcagccagtttaagc

SEQ ID NO: 582636 - DNA, 20 bp, mouse
ggccatgcagagcgcaccct

SEQ ID NO: 582637 - DNA, 20 bp, mouse
gtcgcagccccgggtgtcgg

SEQ ID NO: 582638 - DNA, 20 bp, mouse
gttgcaggaggagtgctcgg

SEQ ID NO: 582639 - DNA, 20 bp, mouse
gtggctacctccgacacccg

SEQ ID NO: 582640 - DNA, 20 bp, mouse
gaagtgctggacatcttcag

SEQ ID NO: 582641 - DNA, 20 bp, mouse
gagtgctcggtggcgtcctt

SEQ ID NO: 582642 - DNA, 20 bp, mouse
gtccaagggtgcgctctgca

SEQ ID NO: 582643 - DNA, 20 bp, mouse
gccgcccagagtgaaccgat

SEQ ID NO: 582644 - DNA, 20 bp, mouse
gtgggcggcgaacctagtag

SEQ ID NO: 582645 - DNA, 20 bp, mouse
gacctccctgggcctctact

SEQ ID NO: 582646 - DNA, 20 bp, mouse
ggaggctcggctacaggtca

SEQ ID NO: 582647 - DNA, 20 bp, mouse
gcctaggtggtacaacatgg

SEQ ID NO: 582648 - DNA, 20 bp, mouse
ggaccctaggtggtacaaca

SEQ ID NO: 582649 - DNA, 20 bp, mouse
gactcagctacaaacacaag

SEQ ID NO: 582650 - DNA, 20 bp, mouse
gacacaagaggctcggctac

SEQ ID NO: 582651 - DNA, 20 bp, mouse
gcgcgcgcctggggcaaggg

SEQ ID NO: 582652 - DNA, 20 bp, mouse
gctgtctgtcgcggtcggga

SEQ ID NO: 582653 - DNA, 20 bp, mouse
ggagtcagggggcggaccct

SEQ ID NO: 582654 - DNA, 20 bp, mouse
gcggagggtcttgagtcagg

SEQ ID NO: 582655 - DNA, 20 bp, mouse
gggccggaggctgtctgtcg

SEQ ID NO: 582656 - DNA, 20 bp, mouse
gcagcaactgtgctcactag

SEQ ID NO: 582657 - DNA, 20 bp, mouse
gccttgtctgaggcattgga

SEQ ID NO: 582658 - DNA, 20 bp, mouse
gagacaactgagagcaggca

SEQ ID NO: 582659 - DNA, 20 bp, mouse
gtacagagacaactgagagc

SEQ ID NO: 582660 - DNA, 20 bp, mouse
gagtagtagggtgatgatgt

SEQ ID NO: 582661 - DNA, 20 bp, mouse
gtatcagatgctgggtatca

SEQ ID NO: 582662 - DNA, 20 bp, mouse
ggagaaacaccaaaaaccga

SEQ ID NO: 582663 - DNA, 20 bp, mouse
gagaattcaaaatgctaaag

SEQ ID NO: 582664 - DNA, 20 bp, mouse
gtctaaattaatttaagtag

SEQ ID NO: 582665 - DNA, 20 bp, mouse
gcctcagtgctatcagatgc

SEQ ID NO: 582666 - DNA, 20 bp, mouse
gggcaaagtattcacacatt

SEQ ID NO: 582667 - DNA, 20 bp, mouse
gaaatgaaatatgttctatt

SEQ ID NO: 582668 - DNA, 20 bp, mouse
gtataaaatgcagggcatga

SEQ ID NO: 582669 - DNA, 20 bp, mouse
gaagactaatgaaacgcacg

SEQ ID NO: 582670 - DNA, 20 bp, mouse
gacaaagtcttgcttactgt

SEQ ID NO: 582671 - DNA, 20 bp, mouse
gtcagttagttataaaatgc

SEQ ID NO: 582672 - DNA, 20 bp, mouse
gtcctagaagagacataaaa

SEQ ID NO: 582673 - DNA, 20 bp, mouse
gacctttttatgtctcttct

SEQ ID NO: 582674 - DNA, 20 bp, mouse
gatgagactgatagcagcat

SEQ ID NO: 582675 - DNA, 20 bp, mouse
gtcaggaagatttactcaag

SEQ ID NO: 582676 - DNA, 20 bp, mouse
gcttctcacaggagtcaaag

SEQ ID NO: 582677 - DNA, 20 bp, mouse
gtaacagttgaacttctcac

SEQ ID NO: 582678 - DNA, 20 bp, mouse
gagcccagggagtaactata

SEQ ID NO: 582679 - DNA, 20 bp, mouse
ggcacaggcgaggaatggaa

SEQ ID NO: 582680 - DNA, 20 bp, mouse
gctaagtgttaggtagccca

SEQ ID NO: 582681 - DNA, 20 bp, mouse
gctgttaagataaactaaca

SEQ ID NO: 582682 - DNA, 20 bp, mouse
ggagtaactataaggtctca

SEQ ID NO: 582683 - DNA, 20 bp, mouse
ggccgagtatcctaagtgtt

SEQ ID NO: 582684 - DNA, 20 bp, mouse
ggaccttatagttactccct

SEQ ID NO: 582685 - DNA, 20 bp, mouse
gatgtgctaacggccctgaa

SEQ ID NO: 582686 - DNA, 20 bp, mouse
gtttggttgtcactaatatt

SEQ ID NO: 582687 - DNA, 20 bp, mouse
ggaatttctagaatcacatt

SEQ ID NO: 582688 - DNA, 20 bp, mouse
gaaaactacaaagaagtaat

SEQ ID NO: 582689 - DNA, 20 bp, mouse
ggaggcaagtattttatatt

SEQ ID NO: 582690 - DNA, 20 bp, mouse
gaatcctcaaaaaatcacac

SEQ ID NO: 582691 - DNA, 20 bp, mouse
ggattttttgaggattcagg

SEQ ID NO: 582692 - DNA, 20 bp, mouse
gggatcattaacatccttca

SEQ ID NO: 582693 - DNA, 20 bp, mouse
gattgtttggatctcattgg

SEQ ID NO: 582694 - DNA, 20 bp, mouse
gttaatgatatcataatgca

SEQ ID NO: 582695 - DNA, 20 bp, mouse
gtaaccattttaattttcaa

SEQ ID NO: 582696 - DNA, 20 bp, mouse
ggccaagctggagtgagggg

SEQ ID NO: 582697 - DNA, 20 bp, mouse
ggcagccaagctggagtgag

SEQ ID NO: 582698 - DNA, 20 bp, mouse
gggacagagtgctagcggcc

SEQ ID NO: 582699 - DNA, 20 bp, mouse
gagtgctagcggccgggctg

SEQ ID NO: 582700 - DNA, 20 bp, mouse
ggtaagcgaaagtctcgtta

SEQ ID NO: 582701 - DNA, 20 bp, mouse
gaggaccgcaagagctgtgg

SEQ ID NO: 582702 - DNA, 20 bp, mouse
gagcgaaagtctcgttacgg

SEQ ID NO: 582703 - DNA, 20 bp, mouse
gatgaggaccgcaagagctg

SEQ ID NO: 582704 - DNA, 20 bp, mouse
ggcggcggaagcagccaagc

SEQ ID NO: 582705 - DNA, 20 bp, mouse
gcccacccctcactccagct

SEQ ID NO: 582706 - DNA, 20 bp, mouse
gagtcgtctctcgcgaggaa

SEQ ID NO: 582707 - DNA, 20 bp, mouse
gcagcggcgagctggcggga

SEQ ID NO: 582708 - DNA, 20 bp, mouse
ggcgcggcctgcggacgggt

SEQ ID NO: 582709 - DNA, 20 bp, mouse
ggagctagtcgtctctcgcg

SEQ ID NO: 582710 - DNA, 20 bp, mouse
gcccgaaaggcgtcacacgg

SEQ ID NO: 582711 - DNA, 20 bp, mouse
ggcaggtctgcggagaagca

SEQ ID NO: 582712 - DNA, 20 bp, mouse
gtctcgcgaggaaaggcacg

SEQ ID NO: 582713 - DNA, 20 bp, mouse
ggcagcagcggcgagctggc

SEQ ID NO: 582714 - DNA, 20 bp, mouse
gatcgaccgcgagaaggtgc

SEQ ID NO: 582715 - DNA, 20 bp, mouse
gggagtggggatgaaacgtt

SEQ ID NO: 582716 - DNA, 20 bp, mouse
gcgcgcaagtgcaagcacgg

SEQ ID NO: 582717 - DNA, 20 bp, mouse
gcgtcgtggcgacacctctg

SEQ ID NO: 582718 - DNA, 20 bp, mouse
gaagtcctagcccacctcag

SEQ ID NO: 582719 - DNA, 20 bp, mouse
gttgggcgctcatgtagtca

SEQ ID NO: 582720 - DNA, 20 bp, mouse
gcgtggcgacacctctgagg

SEQ ID NO: 582721 - DNA, 20 bp, mouse
gcaagtgcaagcacggcggt

SEQ ID NO: 582722 - DNA, 20 bp, mouse
gctgcgactggtgaagcacc

SEQ ID NO: 582723 - DNA, 20 bp, mouse
gccaggaggaggcgaccgag

SEQ ID NO: 582724 - DNA, 20 bp, mouse
gaccggcactggtcacggag

SEQ ID NO: 582725 - DNA, 20 bp, mouse
gaacgctggcgcaggcgtcg

SEQ ID NO: 582726 - DNA, 20 bp, mouse
gagtgaagtggcgcctagaa

SEQ ID NO: 582727 - DNA, 20 bp, mouse
gactgtgatcaggagtgaag

SEQ ID NO: 582728 - DNA, 20 bp, mouse
gtctccatgtgacagtgagt

SEQ ID NO: 582729 - DNA, 20 bp, mouse
ggaccccactcactgtcaca

SEQ ID NO: 582730 - DNA, 20 bp, mouse
gggcgagcggggctctgtag

SEQ ID NO: 582731 - DNA, 20 bp, mouse
gacggccgcccaggggaagg

SEQ ID NO: 582732 - DNA, 20 bp, mouse
gctccctcgcgcaggttctg

SEQ ID NO: 582733 - DNA, 20 bp, mouse
ggtccgacgcccagagtcca

SEQ ID NO: 582734 - DNA, 20 bp, mouse
gaggtcctgtgactgtgatc

SEQ ID NO: 582735 - DNA, 20 bp, mouse
gctccggaggagatgagccg

SEQ ID NO: 582736 - DNA, 20 bp, mouse
gcgctgtgggagtaagatgg

SEQ ID NO: 582737 - DNA, 20 bp, mouse
gccgcgctgtgggagtaaga

SEQ ID NO: 582738 - DNA, 20 bp, mouse
gttactcccacagcgcggtg

SEQ ID NO: 582739 - DNA, 20 bp, mouse
gccagagggtggaccaaggg

SEQ ID NO: 582740 - DNA, 20 bp, mouse
ggactcataagccaatttag

SEQ ID NO: 582741 - DNA, 20 bp, mouse
gggttccaagacccgatacc

SEQ ID NO: 582742 - DNA, 20 bp, mouse
gcctgagccacaccgcgctg

SEQ ID NO: 582743 - DNA, 20 bp, mouse
gaaattggcttatgagtcat

SEQ ID NO: 582744 - DNA, 20 bp, mouse
gtgagacttgagctggaaag

SEQ ID NO: 582745 - DNA, 20 bp, mouse
gaaactggagtcgacgctgt

SEQ ID NO: 582746 - DNA, 20 bp, mouse
ggcggcgccccgagtccccg

SEQ ID NO: 582747 - DNA, 20 bp, mouse
gggagcgcactgttgtggtg

SEQ ID NO: 582748 - DNA, 20 bp, mouse
gccagcgcctggccgctcgg

SEQ ID NO: 582749 - DNA, 20 bp, mouse
gacccctgtaggccactccg

SEQ ID NO: 582750 - DNA, 20 bp, mouse
ggcgggggagcgcactgttg

SEQ ID NO: 582751 - DNA, 20 bp, mouse
gtcggagcgcgcctgaccca

SEQ ID NO: 582752 - DNA, 20 bp, mouse
gtgtggtgcggcgcgtcggg

SEQ ID NO: 582753 - DNA, 20 bp, mouse
gcccgcccgccgcggcacag

SEQ ID NO: 582754 - DNA, 20 bp, mouse
gccccgcgcggggagccacg

SEQ ID NO: 582755 - DNA, 20 bp, mouse
gcgcgcggggagccacgggg

SEQ ID NO: 582756 - DNA, 20 bp, mouse
ggtagcagcagaacagtgta

SEQ ID NO: 582757 - DNA, 20 bp, mouse
gtgtagggcgcttgcaccag

SEQ ID NO: 582758 - DNA, 20 bp, mouse
gagggcgcttgcaccagggg

SEQ ID NO: 582759 - DNA, 20 bp, mouse
gcccagcaggaccctaggta

SEQ ID NO: 582760 - DNA, 20 bp, mouse
gttagagccatggagagccc

SEQ ID NO: 582761 - DNA, 20 bp, mouse
gggacaagccgccaagaccc

SEQ ID NO: 582762 - DNA, 20 bp, mouse
gtcactcccagcaggaccct

SEQ ID NO: 582763 - DNA, 20 bp, mouse
gtgttctgctgctaccactg

SEQ ID NO: 582764 - DNA, 20 bp, mouse
gctctccatggctctaaagt

SEQ ID NO: 582765 - DNA, 20 bp, mouse
ggctgagggagacccagcaa

SEQ ID NO: 582766 - DNA, 20 bp, mouse
gcggtccccgcaagaccaga

SEQ ID NO: 582767 - DNA, 20 bp, mouse
ggatggcagaacctgcaagg

SEQ ID NO: 582768 - DNA, 20 bp, mouse
gaggcggcgcgcgctcccca

SEQ ID NO: 582769 - DNA, 20 bp, mouse
gaagcagggcacgcactcag

SEQ ID NO: 582770 - DNA, 20 bp, mouse
ggcccagcttccacccgcgt

SEQ ID NO: 582771 - DNA, 20 bp, mouse
gggtcttgcggggaccgacg

SEQ ID NO: 582772 - DNA, 20 bp, mouse
gaccgacgcgggtggaagct

SEQ ID NO: 582773 - DNA, 20 bp, mouse
ggcccgctcctagtacagag

SEQ ID NO: 582774 - DNA, 20 bp, mouse
gccatcgctgccacggccat

SEQ ID NO: 582775 - DNA, 20 bp, mouse
ggtgcgcaggctctggagaa

SEQ ID NO: 582776 - DNA, 20 bp, mouse
gccccgactcacggcccgag

SEQ ID NO: 582777 - DNA, 20 bp, mouse
gacggcccgaggggctcctc

SEQ ID NO: 582778 - DNA, 20 bp, mouse
gctcctccggcggtggctgg

SEQ ID NO: 582779 - DNA, 20 bp, mouse
gaccgccggaggagcccctc

SEQ ID NO: 582780 - DNA, 20 bp, mouse
gccgctggggccccgactca

SEQ ID NO: 582781 - DNA, 20 bp, mouse
gtggcggacccggggactgc

SEQ ID NO: 582782 - DNA, 20 bp, mouse
gcgccgccagccaccgccgg

SEQ ID NO: 582783 - DNA, 20 bp, mouse
gtgcccggaagtctcaggga

SEQ ID NO: 582784 - DNA, 20 bp, mouse
ggaggggcgtgacgtacatc

SEQ ID NO: 582785 - DNA, 20 bp, mouse
gtcgcgccgccagccaccgc

SEQ ID NO: 582786 - DNA, 20 bp, mouse
gggcttggagcgtgtaggac

SEQ ID NO: 582787 - DNA, 20 bp, mouse
gggagcgtgtaggacgggca

SEQ ID NO: 582788 - DNA, 20 bp, mouse
gctctgaagtcgcaggtgag

SEQ ID NO: 582789 - DNA, 20 bp, mouse
gccggctgtgcaaagcgcta

SEQ ID NO: 582790 - DNA, 20 bp, mouse
gaggcacccgccgacccgga

SEQ ID NO: 582791 - DNA, 20 bp, mouse
ggtaggacgggcacggagca

SEQ ID NO: 582792 - DNA, 20 bp, mouse
gacaagagctctgggtgagt

SEQ ID NO: 582793 - DNA, 20 bp, mouse
gccctcgtcgggcaagagag

SEQ ID NO: 582794 - DNA, 20 bp, mouse
gcaaagcgctatggctgcca

SEQ ID NO: 582795 - DNA, 20 bp, mouse
gtgagtggcagtgccctcgt

SEQ ID NO: 582796 - DNA, 20 bp, mouse
gcactgggcatagtttgcag

SEQ ID NO: 582797 - DNA, 20 bp, mouse
ggcatggtgtcctaaggtag

SEQ ID NO: 582798 - DNA, 20 bp, mouse
gctggcaaggaaggagcacg

SEQ ID NO: 582799 - DNA, 20 bp, mouse
gtggagtcgggtaccgaggt

SEQ ID NO: 582800 - DNA, 20 bp, mouse
gggccgtcccatctactcca

SEQ ID NO: 582801 - DNA, 20 bp, mouse
gagtcgggtaccgaggtggg

SEQ ID NO: 582802 - DNA, 20 bp, mouse
ggacggccatggataactgt

SEQ ID NO: 582803 - DNA, 20 bp, mouse
ggccctcccacagttatcca

SEQ ID NO: 582804 - DNA, 20 bp, mouse
ggagcacgtggcagctcctt

SEQ ID NO: 582805 - DNA, 20 bp, mouse
gcaaacagtgcctctacctt

SEQ ID NO: 582806 - DNA, 20 bp, mouse
gcgcgggagggtagagacgc

SEQ ID NO: 582807 - DNA, 20 bp, mouse
gggactcagcgacttaggaa

SEQ ID NO: 582808 - DNA, 20 bp, mouse
ggcatggaccagacgcggga

SEQ ID NO: 582809 - DNA, 20 bp, mouse
ggagagaccccggccttggg

SEQ ID NO: 582810 - DNA, 20 bp, mouse
gagagcagcgtcaggaccat

SEQ ID NO: 582811 - DNA, 20 bp, mouse
gagaagcatggaccagacgc

SEQ ID NO: 582812 - DNA, 20 bp, mouse
gactctgctgctcagaggcg

SEQ ID NO: 582813 - DNA, 20 bp, mouse
gtgcccggaccggatcggag

SEQ ID NO: 582814 - DNA, 20 bp, mouse
gtggagcagcgctttgttcc

SEQ ID NO: 582815 - DNA, 20 bp, mouse
gcgacttaggaagggcatga

SEQ ID NO: 582816 - DNA, 20 bp, mouse
gaaggtaggcctaagaaagg

SEQ ID NO: 582817 - DNA, 20 bp, mouse
ggcctaagcgcctgaggtgg

SEQ ID NO: 582818 - DNA, 20 bp, mouse
gttcaaggtaggcctaagaa

SEQ ID NO: 582819 - DNA, 20 bp, mouse
gcgttacgcggggaaggctg

SEQ ID NO: 582820 - DNA, 20 bp, mouse
ggccagcggtgggggtccgg

SEQ ID NO: 582821 - DNA, 20 bp, mouse
ggggtcagcatgggacacgg

SEQ ID NO: 582822 - DNA, 20 bp, mouse
gggctcttcccattagtcag

SEQ ID NO: 582823 - DNA, 20 bp, mouse
gtgctcccacctcacaccaa

SEQ ID NO: 582824 - DNA, 20 bp, mouse
gtgagcctaagcgcctgagg

SEQ ID NO: 582825 - DNA, 20 bp, mouse
gaggtaccgttacgcgggga

SEQ ID NO: 582826 - DNA, 20 bp, mouse
gctcttagtgttaactggtg

SEQ ID NO: 582827 - DNA, 20 bp, mouse
gactaagagaggactgtaag

SEQ ID NO: 582828 - DNA, 20 bp, mouse
gtgttaactggtgaggtaga

SEQ ID NO: 582829 - DNA, 20 bp, mouse
gtgaggtagaaggatggtgc

SEQ ID NO: 582830 - DNA, 20 bp, mouse
ggtcctctcttagtgttaac

SEQ ID NO: 582831 - DNA, 20 bp, mouse
gaagagaggactgtaagcgg

SEQ ID NO: 582832 - DNA, 20 bp, mouse
gatccacccgaaacaaatcc

SEQ ID NO: 582833 - DNA, 20 bp, mouse
ggaagccatgagggattcaa

SEQ ID NO: 582834 - DNA, 20 bp, mouse
gggtagagccggccagtcgc

SEQ ID NO: 582835 - DNA, 20 bp, mouse
ggaagcgcttcaaggacccg

SEQ ID NO: 582836 - DNA, 20 bp, mouse
ggcccctggcgagccaggaa

SEQ ID NO: 582837 - DNA, 20 bp, mouse
gggccaccaaagccgcgcca

SEQ ID NO: 582838 - DNA, 20 bp, mouse
gtcctcgggaccggagcccc

SEQ ID NO: 582839 - DNA, 20 bp, mouse
gtccaagatggctgcgtcca

SEQ ID NO: 582840 - DNA, 20 bp, mouse
ggccatggacgcagccatct

SEQ ID NO: 582841 - DNA, 20 bp, mouse
ggcctttcctggctcgccag

SEQ ID NO: 582842 - DNA, 20 bp, mouse
ggctccctggagctccgcaa

SEQ ID NO: 582843 - DNA, 20 bp, mouse
gtcccccttgcggagctcca

SEQ ID NO: 582844 - DNA, 20 bp, mouse
gggagcgcgcggctttttct

SEQ ID NO: 582845 - DNA, 20 bp, mouse
gtcttgtttccactccaaga

SEQ ID NO: 582846 - DNA, 20 bp, mouse
gaggcggacgcaataatcat

SEQ ID NO: 582847 - DNA, 20 bp, mouse
gcaccgtggcgagaaggagg

SEQ ID NO: 582848 - DNA, 20 bp, mouse
ggtagcggcccggctccagg

SEQ ID NO: 582849 - DNA, 20 bp, mouse
gggtcgtcaaagaagcaccg

SEQ ID NO: 582850 - DNA, 20 bp, mouse
ggtcgtctgggctagggtag

SEQ ID NO: 582851 - DNA, 20 bp, mouse
gaagcaccgtggcgagaagg

SEQ ID NO: 582852 - DNA, 20 bp, mouse
gcagcagcggcggcgaacga

SEQ ID NO: 582853 - DNA, 20 bp, mouse
gaaggaggcggccgggacga

SEQ ID NO: 582854 - DNA, 20 bp, mouse
gcggcggcgaacgacggaag

SEQ ID NO: 582855 - DNA, 20 bp, mouse
gccaagcggagccctcggag

SEQ ID NO: 582856 - DNA, 20 bp, mouse
gcctgaggccgagggagaag

SEQ ID NO: 582857 - DNA, 20 bp, mouse
gctgcgcaagatggcgacga

SEQ ID NO: 582858 - DNA, 20 bp, mouse
gcggcctggggctcaacctc

SEQ ID NO: 582859 - DNA, 20 bp, mouse
gggctcggacgccgaagatg

SEQ ID NO: 582860 - DNA, 20 bp, mouse
gtccccggcggagctctcgg

SEQ ID NO: 582861 - DNA, 20 bp, mouse
ggggaagacccgagagtcgc

SEQ ID NO: 582862 - DNA, 20 bp, mouse
ggacgagtgggagtacgacg

SEQ ID NO: 582863 - DNA, 20 bp, mouse
gtaaccacggaggaccgagg

SEQ ID NO: 582864 - DNA, 20 bp, mouse
gtggggctcaacctccggct

SEQ ID NO: 582865 - DNA, 20 bp, mouse
gtcttcggcgtccgagccgg

SEQ ID NO: 582866 - DNA, 20 bp, mouse
gcgagcaccactgccaggac

SEQ ID NO: 582867 - DNA, 20 bp, mouse
ggaggtgccagtcctggcag

SEQ ID NO: 582868 - DNA, 20 bp, mouse
gcagtggtgctcgtacccag

SEQ ID NO: 582869 - DNA, 20 bp, mouse
ggggatcgaggtgccagtcc

SEQ ID NO: 582870 - DNA, 20 bp, mouse
gtcgtacccagcggagcctg

SEQ ID NO: 582871 - DNA, 20 bp, mouse
ggcatgccccaggctccgct

SEQ ID NO: 582872 - DNA, 20 bp, mouse
ggggtacgagcaccactgcc

SEQ ID NO: 582873 - DNA, 20 bp, mouse
gcccgggcgggatccacctc

SEQ ID NO: 582874 - DNA, 20 bp, mouse
gcctggggcatgcgacgcgg

SEQ ID NO: 582875 - DNA, 20 bp, mouse
gagaagggtgaccaataggt

SEQ ID NO: 582876 - DNA, 20 bp, mouse
gagtaaagagtagcagcccc

SEQ ID NO: 582877 - DNA, 20 bp, mouse
gacagcatagactgagcctg

SEQ ID NO: 582878 - DNA, 20 bp, mouse
gactgctgcagtggcagctt

SEQ ID NO: 582879 - DNA, 20 bp, mouse
gctactctttactgctgcag

SEQ ID NO: 582880 - DNA, 20 bp, mouse
gcagtctatgctgtgccaac

SEQ ID NO: 582881 - DNA, 20 bp, mouse
gactcctgctctgttctcca

SEQ ID NO: 582882 - DNA, 20 bp, mouse
ggccttcatggactcttaga

SEQ ID NO: 582883 - DNA, 20 bp, mouse
ggctgtaagagcaggtcacg

SEQ ID NO: 582884 - DNA, 20 bp, mouse
gtcctctacactctctacca

SEQ ID NO: 582885 - DNA, 20 bp, mouse
gttcatggactcttagaagg

SEQ ID NO: 582886 - DNA, 20 bp, mouse
gcagctcccgcggaggagga

SEQ ID NO: 582887 - DNA, 20 bp, mouse
gaccgaaggccgggcctact

SEQ ID NO: 582888 - DNA, 20 bp, mouse
gtaggcccggccttcggtcc

SEQ ID NO: 582889 - DNA, 20 bp, mouse
gaactcaaactcatcgggac

SEQ ID NO: 582890 - DNA, 20 bp, mouse
gcccgctgagggccagaaca

SEQ ID NO: 582891 - DNA, 20 bp, mouse
gtctttgcagccgggaccga

SEQ ID NO: 582892 - DNA, 20 bp, mouse
gccggcccggccacaaacaa

SEQ ID NO: 582893 - DNA, 20 bp, mouse
ggcggaccgaccgatcccca

SEQ ID NO: 582894 - DNA, 20 bp, mouse
gtgaagaagcccagtaggcc

SEQ ID NO: 582895 - DNA, 20 bp, mouse
ggaccgctgccccgacggga

SEQ ID NO: 582896 - DNA, 20 bp, mouse
gaaagtccgggctctcccta

SEQ ID NO: 582897 - DNA, 20 bp, mouse
ggagcttctgcggacttaaa

SEQ ID NO: 582898 - DNA, 20 bp, mouse
ggaacagccgagcctgaccc

SEQ ID NO: 582899 - DNA, 20 bp, mouse
gtcctgcgactgatcaaggt

SEQ ID NO: 582900 - DNA, 20 bp, mouse
gtctccctagggcagagggt

SEQ ID NO: 582901 - DNA, 20 bp, mouse
ggctcacgggaagagaaatg

SEQ ID NO: 582902 - DNA, 20 bp, mouse
ggtcagaggcagtggctgga

SEQ ID NO: 582903 - DNA, 20 bp, mouse
gtcaaggtaggtaaaagtcc

SEQ ID NO: 582904 - DNA, 20 bp, mouse
gggttggcaggccaagaagg

SEQ ID NO: 582905 - DNA, 20 bp, mouse
gtggggttggcaggccaaga

SEQ ID NO: 582906 - DNA, 20 bp, mouse
gcctcccagctgagaccggt

SEQ ID NO: 582907 - DNA, 20 bp, mouse
gtcaaagtgctgggagcgag

SEQ ID NO: 582908 - DNA, 20 bp, mouse
gtctggcagaagagaccacc

SEQ ID NO: 582909 - DNA, 20 bp, mouse
gtaatcctcccagctgagac

SEQ ID NO: 582910 - DNA, 20 bp, mouse
gctgcagggaggcccggagg

SEQ ID NO: 582911 - DNA, 20 bp, mouse
ggcaccaaccggtctcagct

SEQ ID NO: 582912 - DNA, 20 bp, mouse
gacgcgaatccgagaggcca

SEQ ID NO: 582913 - DNA, 20 bp, mouse
gacaagattctggcaccaac

SEQ ID NO: 582914 - DNA, 20 bp, mouse
gaggccagggagagcgattg

SEQ ID NO: 582915 - DNA, 20 bp, mouse
gatgatccgggtaaagactg

SEQ ID NO: 582916 - DNA, 20 bp, mouse
gcggccgccgcggaagttaa

SEQ ID NO: 582917 - DNA, 20 bp, mouse
gcccagagcgggagcagcac

SEQ ID NO: 582918 - DNA, 20 bp, mouse
ggcggcggccgccagctcgg

SEQ ID NO: 582919 - DNA, 20 bp, mouse
ggccgggcggcggacttccc

SEQ ID NO: 582920 - DNA, 20 bp, mouse
gccgggcaagagacccagag

SEQ ID NO: 582921 - DNA, 20 bp, mouse
gccgcatccgcagaaaacgg

SEQ ID NO: 582922 - DNA, 20 bp, mouse
gaagttgccattaacttccg

SEQ ID NO: 582923 - DNA, 20 bp, mouse
ggcccacttcggatggggag

SEQ ID NO: 582924 - DNA, 20 bp, mouse
gttgccattaacttccgcgg

SEQ ID NO: 582925 - DNA, 20 bp, mouse
gcaagaccccggcacgcgag

SEQ ID NO: 582926 - DNA, 20 bp, mouse
gttaacagagcccggagacg

SEQ ID NO: 582927 - DNA, 20 bp, mouse
ggcgcaggctggcgctcggg

SEQ ID NO: 582928 - DNA, 20 bp, mouse
gcaaagtcgaaagtactcgg

SEQ ID NO: 582929 - DNA, 20 bp, mouse
ggtgtcgcggctcgccgcag

SEQ ID NO: 582930 - DNA, 20 bp, mouse
gcagaggctgcctcgtctcc

SEQ ID NO: 582931 - DNA, 20 bp, mouse
gccgggcgacgaaggacgga

SEQ ID NO: 582932 - DNA, 20 bp, mouse
gaggcgggcgctccgtgtcg

SEQ ID NO: 582933 - DNA, 20 bp, mouse
gccctggacttgctacaagg

SEQ ID NO: 582934 - DNA, 20 bp, mouse
ggcaggctgcggcgactagg

SEQ ID NO: 582935 - DNA, 20 bp, mouse
gctccaaagtcgaaagtact

SEQ ID NO: 582936 - DNA, 20 bp, mouse
gaccttaaacgctaggaccg

SEQ ID NO: 582937 - DNA, 20 bp, mouse
gaacgctaggaccggggaag

SEQ ID NO: 582938 - DNA, 20 bp, mouse
gcgtttaaggtcctgggtca

SEQ ID NO: 582939 - DNA, 20 bp, mouse
ggaagaagacaccctgaccc

SEQ ID NO: 582940 - DNA, 20 bp, mouse
gtaggcgaagccgggaagtg

SEQ ID NO: 582941 - DNA, 20 bp, mouse
gaagttccccggctgttctg

SEQ ID NO: 582942 - DNA, 20 bp, mouse
gatgtagggagtgctcggag

SEQ ID NO: 582943 - DNA, 20 bp, mouse
gacccaggaccttaaacgct

SEQ ID NO: 582944 - DNA, 20 bp, mouse
gcagagccccagaacagccg

SEQ ID NO: 582945 - DNA, 20 bp, mouse
gctgtagttcgggaagccct

SEQ ID NO: 582946 - DNA, 20 bp, mouse
ggtaaggtggtaacactctc

SEQ ID NO: 582947 - DNA, 20 bp, mouse
gtggtcttttcctgccaaca

SEQ ID NO: 582948 - DNA, 20 bp, mouse
gccagccaagcttgtagctg

SEQ ID NO: 582949 - DNA, 20 bp, mouse
gcctcttctgccctgttggc

SEQ ID NO: 582950 - DNA, 20 bp, mouse
gaaagcctctaattcactgg

SEQ ID NO: 582951 - DNA, 20 bp, mouse
gctggatttcagccgccatc

SEQ ID NO: 582952 - DNA, 20 bp, mouse
gagtcagtcatggatcaacc

SEQ ID NO: 582953 - DNA, 20 bp, mouse
ggactgactggcaggtgggt

SEQ ID NO: 582954 - DNA, 20 bp, mouse
ggggttggtaaacaactgac

SEQ ID NO: 582955 - DNA, 20 bp, mouse
gattaaagcctctaattcac

SEQ ID NO: 582956 - DNA, 20 bp, mouse
gcagcggtagcggctccggg

SEQ ID NO: 582957 - DNA, 20 bp, mouse
gacgtaggcggtggccgcag

SEQ ID NO: 582958 - DNA, 20 bp, mouse
gcggccgcggccctgtccca

SEQ ID NO: 582959 - DNA, 20 bp, mouse
gagacccgaggcgaaggcgg

SEQ ID NO: 582960 - DNA, 20 bp, mouse
gccgaggccgccttgggaca

SEQ ID NO: 582961 - DNA, 20 bp, mouse
gggctccgggcggcggacca

SEQ ID NO: 582962 - DNA, 20 bp, mouse
gccgcggccctgtcccaagg

SEQ ID NO: 582963 - DNA, 20 bp, mouse
ggggaaagtttaccggacgt

SEQ ID NO: 582964 - DNA, 20 bp, mouse
ggtttaccggacgtaggcgg

SEQ ID NO: 582965 - DNA, 20 bp, mouse
gcggcgcggggaaagtttac

SEQ ID NO: 582966 - DNA, 20 bp, mouse
ggacaggcctggacacacac

SEQ ID NO: 582967 - DNA, 20 bp, mouse
gacacacaccggcgagcggg

SEQ ID NO: 582968 - DNA, 20 bp, mouse
ggctgcgcaccatggaacag

SEQ ID NO: 582969 - DNA, 20 bp, mouse
ggcgcacggcggccgaggac

SEQ ID NO: 582970 - DNA, 20 bp, mouse
gcgctcgccggtgtgtgtcc

SEQ ID NO: 582971 - DNA, 20 bp, mouse
gagcgggcggctgcgcacca

SEQ ID NO: 582972 - DNA, 20 bp, mouse
gtcggctaaccgctgttcca

SEQ ID NO: 582973 - DNA, 20 bp, mouse
gcacgtgcgcaggcgcacgg

SEQ ID NO: 582974 - DNA, 20 bp, mouse
ggcgaaggcggagccagcgg

SEQ ID NO: 582975 - DNA, 20 bp, mouse
ggtgtgtccaggcctgtcct

SEQ ID NO: 582976 - DNA, 20 bp, mouse
ggctcttccggaacctacca

SEQ ID NO: 582977 - DNA, 20 bp, mouse
gcggtagcttcttccctggt

SEQ ID NO: 582978 - DNA, 20 bp, mouse
gcgtgcggtagcttcttccc

SEQ ID NO: 582979 - DNA, 20 bp, mouse
gagtagggcaatcgggcgtg

SEQ ID NO: 582980 - DNA, 20 bp, mouse
gctcggctgaaacgaccctg

SEQ ID NO: 582981 - DNA, 20 bp, mouse
gttaacgcccaaggagtgcg

SEQ ID NO: 582982 - DNA, 20 bp, mouse
gggccaggccgccgaactct

SEQ ID NO: 582983 - DNA, 20 bp, mouse
gtcctgtgcccagagttcgg

SEQ ID NO: 582984 - DNA, 20 bp, mouse
gaaggagtgcgcggctcttc

SEQ ID NO: 582985 - DNA, 20 bp, mouse
ggtgggggtgaagatcgaca

SEQ ID NO: 582986 - DNA, 20 bp, mouse
gcggcggaagccctggtcag

SEQ ID NO: 582987 - DNA, 20 bp, mouse
gcagcggcgccgcagaggag

SEQ ID NO: 582988 - DNA, 20 bp, mouse
gtctgcggcgccgctgacca

SEQ ID NO: 582989 - DNA, 20 bp, mouse
gaagatggcggcggaagccc

SEQ ID NO: 582990 - DNA, 20 bp, mouse
gccgcagaggagcgggcccg

SEQ ID NO: 582991 - DNA, 20 bp, mouse
gtgcacacttgggacacccc

SEQ ID NO: 582992 - DNA, 20 bp, mouse
gggccctaagctgcacactt

SEQ ID NO: 582993 - DNA, 20 bp, mouse
gggtcccgcctacacgggag

SEQ ID NO: 582994 - DNA, 20 bp, mouse
ggtgagtctcagcgccgagg

SEQ ID NO: 582995 - DNA, 20 bp, mouse
ggcaggctcctgaagcgccc

SEQ ID NO: 582996 - DNA, 20 bp, mouse
ggcggctgtagcggtagcag

SEQ ID NO: 582997 - DNA, 20 bp, mouse
ggcgcctcggttgtcaaaca

SEQ ID NO: 582998 - DNA, 20 bp, mouse
gttcccttcggcggctgtag

SEQ ID NO: 582999 - DNA, 20 bp, mouse
gtaccgctacagccgccgaa

SEQ ID NO: 583000 - DNA, 20 bp, mouse
gccccgccgagcccactgga

SEQ ID NO: 583001 - DNA, 20 bp, mouse
ggcgtgtgtgagggaaccgt

SEQ ID NO: 583002 - DNA, 20 bp, mouse
ggaagccaggtaagggtgtg

SEQ ID NO: 583003 - DNA, 20 bp, mouse
gcccactggacggctgccgg

SEQ ID NO: 583004 - DNA, 20 bp, mouse
gtctaagcgcccggcctcgg

SEQ ID NO: 583005 - DNA, 20 bp, mouse
gcagccatgtttgacaaccg

SEQ ID NO: 583006 - DNA, 20 bp, mouse
gctggagcccgagtgccggg

SEQ ID NO: 583007 - DNA, 20 bp, mouse
gcggcgcccgaaccccccag

SEQ ID NO: 583008 - DNA, 20 bp, mouse
gcgatggagcgcagcccggg

SEQ ID NO: 583009 - DNA, 20 bp, mouse
ggcccgagtgccgggcggag

SEQ ID NO: 583010 - DNA, 20 bp, mouse
gcagccgcgtgcgaggatgg

SEQ ID NO: 583011 - DNA, 20 bp, mouse
gggcgctggagcccgagtgc

SEQ ID NO: 583012 - DNA, 20 bp, mouse
ggaaccccccagcggctgag

SEQ ID NO: 583013 - DNA, 20 bp, mouse
ggtagcaagcagatcttggg

SEQ ID NO: 583014 - DNA, 20 bp, mouse
ggcaggtacgcgccggcggg

SEQ ID NO: 583015 - DNA, 20 bp, mouse
gtccctgtgtgccggagtag

SEQ ID NO: 583016 - DNA, 20 bp, mouse
gtgagcccaggtcagaagta

SEQ ID NO: 583017 - DNA, 20 bp, mouse
gccttggagaaggcgaagtc

SEQ ID NO: 583018 - DNA, 20 bp, mouse
gggttaaccggcctgaggga

SEQ ID NO: 583019 - DNA, 20 bp, mouse
gtaactgcagtaggcagaaa

SEQ ID NO: 583020 - DNA, 20 bp, mouse
ggcaaggcgctaactgcagt

SEQ ID NO: 583021 - DNA, 20 bp, mouse
gcttgccctacttctgacct

SEQ ID NO: 583022 - DNA, 20 bp, mouse
gaaagggatcagacaagcct

SEQ ID NO: 583023 - DNA, 20 bp, mouse
ggctggaaccctgggtctaa

SEQ ID NO: 583024 - DNA, 20 bp, mouse
gttagcgccttgcacttcgg

SEQ ID NO: 583025 - DNA, 20 bp, mouse
ggtctgagccctgaattcga

SEQ ID NO: 583026 - DNA, 20 bp, mouse
gccggaggcgacaggagcgg

SEQ ID NO: 583027 - DNA, 20 bp, mouse
gcgaacgggtgaggagccgg

SEQ ID NO: 583028 - DNA, 20 bp, mouse
gtccgggaggatgaacgtga

SEQ ID NO: 583029 - DNA, 20 bp, mouse
gccccacagacggccccaca

SEQ ID NO: 583030 - DNA, 20 bp, mouse
gcccacaccacggctcctca

SEQ ID NO: 583031 - DNA, 20 bp, mouse
gggacagcgggactccgtca

SEQ ID NO: 583032 - DNA, 20 bp, mouse
ggagaacgccggaaccaacg

SEQ ID NO: 583033 - DNA, 20 bp, mouse
gggcgcggacggccatagag

SEQ ID NO: 583034 - DNA, 20 bp, mouse
ggtgaggagccggaggcgac

SEQ ID NO: 583035 - DNA, 20 bp, mouse
gccgcgaacgggtgaggagc

SEQ ID NO: 583036 - DNA, 20 bp, mouse
gcccagaacccggaagtgag

SEQ ID NO: 583037 - DNA, 20 bp, mouse
gagaacccggaagtgagcgg

SEQ ID NO: 583038 - DNA, 20 bp, mouse
ggagaggctccgggaaaccg

SEQ ID NO: 583039 - DNA, 20 bp, mouse
gcaacatggcgcccagaacc

SEQ ID NO: 583040 - DNA, 20 bp, mouse
gagcgatcaggtctgaggtg

SEQ ID NO: 583041 - DNA, 20 bp, mouse
ggtgcgcgccgccggcaaca

SEQ ID NO: 583042 - DNA, 20 bp, mouse
ggatcgcgaaagggtcacag

SEQ ID NO: 583043 - DNA, 20 bp, mouse
gccgggaaaccgaggcgtcg

SEQ ID NO: 583044 - DNA, 20 bp, mouse
gagagagatggggcgcacag

SEQ ID NO: 583045 - DNA, 20 bp, mouse
gccaccctgcagccaaggaa

SEQ ID NO: 583046 - DNA, 20 bp, mouse
gaggctcggcggctccgtca

SEQ ID NO: 583047 - DNA, 20 bp, mouse
gacggcagccgcaggctcgg

SEQ ID NO: 583048 - DNA, 20 bp, mouse
ggccacctgtgggaactcag

SEQ ID NO: 583049 - DNA, 20 bp, mouse
gtgcggctgccgtggtcatg

SEQ ID NO: 583050 - DNA, 20 bp, mouse
gaccacggcagccgcaggct

SEQ ID NO: 583051 - DNA, 20 bp, mouse
gtggtggccgcgtgtccccc

SEQ ID NO: 583052 - DNA, 20 bp, mouse
ggctgccgtggtcatgaggc

SEQ ID NO: 583053 - DNA, 20 bp, mouse
gggcgcctctgagttcccac

SEQ ID NO: 583054 - DNA, 20 bp, mouse
gccacagctccgccacctgt

SEQ ID NO: 583055 - DNA, 20 bp, mouse
gaactcagaggcgccacagg

SEQ ID NO: 583056 - DNA, 20 bp, mouse
ggagggtttgtggtacaatc

SEQ ID NO: 583057 - DNA, 20 bp, mouse
ggtcaggaaggtcacagtgt

SEQ ID NO: 583058 - DNA, 20 bp, mouse
gtgtgggtgaagccttctgt

SEQ ID NO: 583059 - DNA, 20 bp, mouse
gcagtctggtgcagtcaggg

SEQ ID NO: 583060 - DNA, 20 bp, mouse
gctctctggactgagcccct

SEQ ID NO: 583061 - DNA, 20 bp, mouse
gcagtggcatcaggatataa

SEQ ID NO: 583062 - DNA, 20 bp, mouse
gtataaagggacaagccaag

SEQ ID NO: 583063 - DNA, 20 bp, mouse
gaaggagcccagaaccagtc

SEQ ID NO: 583064 - DNA, 20 bp, mouse
gttctgaggaccagctgacg

SEQ ID NO: 583065 - DNA, 20 bp, mouse
gaaccagtctggtgcagtca

SEQ ID NO: 583066 - DNA, 20 bp, mouse
gagcctggtgcagccagaga

SEQ ID NO: 583067 - DNA, 20 bp, mouse
gctctcctccattcttacct

SEQ ID NO: 583068 - DNA, 20 bp, mouse
ggactcagatcacacagccc

SEQ ID NO: 583069 - DNA, 20 bp, mouse
gggtgcagccagagaaggaa

SEQ ID NO: 583070 - DNA, 20 bp, mouse
gggtataaagggagaagcaa

SEQ ID NO: 583071 - DNA, 20 bp, mouse
gggtggcatcagggtataaa

SEQ ID NO: 583072 - DNA, 20 bp, mouse
gggtggagactgaagcatgg

SEQ ID NO: 583073 - DNA, 20 bp, mouse
gtcagcacagtgacactgtg

SEQ ID NO: 583074 - DNA, 20 bp, mouse
gctatgactgggtggcatca

SEQ ID NO: 583075 - DNA, 20 bp, mouse
gcactgtggggtcacagttt

SEQ ID NO: 583076 - DNA, 20 bp, mouse
gagtccccaggagcactaag

SEQ ID NO: 583077 - DNA, 20 bp, mouse
gccgggcaggcagagtcccc

SEQ ID NO: 583078 - DNA, 20 bp, mouse
gtgttgttgggaaggcaggg

SEQ ID NO: 583079 - DNA, 20 bp, mouse
gttctcaacgggatcctcat

SEQ ID NO: 583080 - DNA, 20 bp, mouse
gctgcctcttagtgctcctg

SEQ ID NO: 583081 - DNA, 20 bp, mouse
gtagcccacgacatcaacag

SEQ ID NO: 583082 - DNA, 20 bp, mouse
gacatgttgttgggaaggca

SEQ ID NO: 583083 - DNA, 20 bp, mouse
gcccttgaaggcatcaataa

SEQ ID NO: 583084 - DNA, 20 bp, mouse
ggccgctggacaggttggga

SEQ ID NO: 583085 - DNA, 20 bp, mouse
gaagatacatgttgttggga

SEQ ID NO: 583086 - DNA, 20 bp, mouse
ggcgcacagcaccatccaca

SEQ ID NO: 583087 - DNA, 20 bp, mouse
gtctggccatgaagaccctg

SEQ ID NO: 583088 - DNA, 20 bp, mouse
gggtccgttcgcaagtgtcg

SEQ ID NO: 583089 - DNA, 20 bp, mouse
gctgccgcgacacttgcgaa

SEQ ID NO: 583090 - DNA, 20 bp, mouse
ggtcccggccaggacagcag

SEQ ID NO: 583091 - DNA, 20 bp, mouse
gtagtcgaagcagcagtccc

SEQ ID NO: 583092 - DNA, 20 bp, mouse
gggagccgagctcttgcccg

SEQ ID NO: 583093 - DNA, 20 bp, mouse
ggcagcagtccccggtgaga

SEQ ID NO: 583094 - DNA, 20 bp, mouse
gcttgcccgaggctctagct

SEQ ID NO: 583095 - DNA, 20 bp, mouse
gagagcctcgggcaagagct

SEQ ID NO: 583096 - DNA, 20 bp, mouse
ggcgtccccgcgacagacag

SEQ ID NO: 583097 - DNA, 20 bp, mouse
ggcggtctaagcgcaagtcc

SEQ ID NO: 583098 - DNA, 20 bp, mouse
ggccggcagaggtagtgagg

SEQ ID NO: 583099 - DNA, 20 bp, mouse
gtgagccggcagaggtagtg

SEQ ID NO: 583100 - DNA, 20 bp, mouse
gggctagagagcgccttacc

SEQ ID NO: 583101 - DNA, 20 bp, mouse
ggcgctctctagcctgatcc

SEQ ID NO: 583102 - DNA, 20 bp, mouse
gtctaagcgcaagtcctggc

SEQ ID NO: 583103 - DNA, 20 bp, mouse
gctctctagcctgatccggg

SEQ ID NO: 583104 - DNA, 20 bp, mouse
ggatgcggtgggaagaacct

SEQ ID NO: 583105 - DNA, 20 bp, mouse
ggtggagggcgactgagacg

SEQ ID NO: 583106 - DNA, 20 bp, mouse
gcagctggacagccgcgagt

SEQ ID NO: 583107 - DNA, 20 bp, mouse
gtccgctggctgtaaagccg

SEQ ID NO: 583108 - DNA, 20 bp, mouse
gccagcagctccgtcagccg

SEQ ID NO: 583109 - DNA, 20 bp, mouse
gctgtccagctgccagcgca

SEQ ID NO: 583110 - DNA, 20 bp, mouse
gggcaggcaacctctagcac

SEQ ID NO: 583111 - DNA, 20 bp, mouse
gctggacagccgcgagtggg

SEQ ID NO: 583112 - DNA, 20 bp, mouse
gccgcgagtgggaggacccg

SEQ ID NO: 583113 - DNA, 20 bp, mouse
gcgcacggaacctacctgcc

SEQ ID NO: 583114 - DNA, 20 bp, mouse
gttagcagggacggccacac

SEQ ID NO: 583115 - DNA, 20 bp, mouse
gtctggctcgtactctccgc

SEQ ID NO: 583116 - DNA, 20 bp, mouse
gcccgagcggcggggtaaga

SEQ ID NO: 583117 - DNA, 20 bp, mouse
gggagccgcagcccgagcgg

SEQ ID NO: 583118 - DNA, 20 bp, mouse
gggctcgggcctatcggggt

SEQ ID NO: 583119 - DNA, 20 bp, mouse
gccgataggcccgagccccg

SEQ ID NO: 583120 - DNA, 20 bp, mouse
gcaaggcagtctctgagtag

SEQ ID NO: 583121 - DNA, 20 bp, mouse
ggaaaggccggcagcaccgg

SEQ ID NO: 583122 - DNA, 20 bp, mouse
gaagatggcggcggcggtcc

SEQ ID NO: 583123 - DNA, 20 bp, mouse
gaggagggccggcctagtcg

SEQ ID NO: 583124 - DNA, 20 bp, mouse
gccgccccgcccaccccgat

SEQ ID NO: 583125 - DNA, 20 bp, mouse
gtaccccgccgctcgggctg

SEQ ID NO: 583126 - DNA, 20 bp, mouse
gggccgggtcgggagcacgc

SEQ ID NO: 583127 - DNA, 20 bp, mouse
ggagcggccggaggagtcca

SEQ ID NO: 583128 - DNA, 20 bp, mouse
gcacggcgggccggagagag

SEQ ID NO: 583129 - DNA, 20 bp, mouse
gagggagccgccagacacgg

SEQ ID NO: 583130 - DNA, 20 bp, mouse
ggggagggagccgccagaca

SEQ ID NO: 583131 - DNA, 20 bp, mouse
gggccgcgcgcgcttccgag

SEQ ID NO: 583132 - DNA, 20 bp, mouse
ggcctaggagcagagcgggg

SEQ ID NO: 583133 - DNA, 20 bp, mouse
gtgcctgcgtgctcccgacc

SEQ ID NO: 583134 - DNA, 20 bp, mouse
gcagccgcgccgccacaggt

SEQ ID NO: 583135 - DNA, 20 bp, mouse
ggagcggacgaggcgccccg

SEQ ID NO: 583136 - DNA, 20 bp, mouse
gcatcctgctggcgaaagag

SEQ ID NO: 583137 - DNA, 20 bp, mouse
gggtcgagcgcaggcagagg

SEQ ID NO: 583138 - DNA, 20 bp, mouse
ggccggtcgagcgcaggcag

SEQ ID NO: 583139 - DNA, 20 bp, mouse
gcgtgcgccggaggagggat

SEQ ID NO: 583140 - DNA, 20 bp, mouse
gggcgcacgggactgagcag

SEQ ID NO: 583141 - DNA, 20 bp, mouse
gtcgccggccgggccagtgt

SEQ ID NO: 583142 - DNA, 20 bp, mouse
gcggtcacctagacctggag

SEQ ID NO: 583143 - DNA, 20 bp, mouse
gtcacctagacctggagcgg

SEQ ID NO: 583144 - DNA, 20 bp, mouse
gagtgtgggccagtgcgtga

SEQ ID NO: 583145 - DNA, 20 bp, mouse
gcagccgccgctccaggtct

SEQ ID NO: 583146 - DNA, 20 bp, mouse
gcgcgcagcgaagacacagg

SEQ ID NO: 583147 - DNA, 20 bp, mouse
ggaggaagcgctgaccgcgg

SEQ ID NO: 583148 - DNA, 20 bp, mouse
gtgacacaggagcccgtggg

SEQ ID NO: 583149 - DNA, 20 bp, mouse
ggcggctgcggcatccaata

SEQ ID NO: 583150 - DNA, 20 bp, mouse
gcaggaggaagcgctgaccg

SEQ ID NO: 583151 - DNA, 20 bp, mouse
gggcgcagtgagcaggacgg

SEQ ID NO: 583152 - DNA, 20 bp, mouse
ggaggcccggggcccgacgg

SEQ ID NO: 583153 - DNA, 20 bp, mouse
gcaggttcccgcggcctagg

SEQ ID NO: 583154 - DNA, 20 bp, mouse
ggctgcggcatccaatatgg

SEQ ID NO: 583155 - DNA, 20 bp, mouse
gaggtgacacaggagcccgt

SEQ ID NO: 583156 - DNA, 20 bp, mouse
gctcgctcgggaagctgaag

SEQ ID NO: 583157 - DNA, 20 bp, mouse
gtccgccgcgggagatgctc

SEQ ID NO: 583158 - DNA, 20 bp, mouse
gaagcggcggaggctggagt

SEQ ID NO: 583159 - DNA, 20 bp, mouse
ggccgccggagcatctcccg

SEQ ID NO: 583160 - DNA, 20 bp, mouse
ggccgcgggagatgctccgg

SEQ ID NO: 583161 - DNA, 20 bp, mouse
gtaggcgccgagccctgaag

SEQ ID NO: 583162 - DNA, 20 bp, mouse
gcgggaagctgaagcggcgg

SEQ ID NO: 583163 - DNA, 20 bp, mouse
gtccggctcctgctccgccg

SEQ ID NO: 583164 - DNA, 20 bp, mouse
gcaagggagagcagctctcg

SEQ ID NO: 583165 - DNA, 20 bp, mouse
gagatgctccggcggccgca

SEQ ID NO: 583166 - DNA, 20 bp, mouse
gcggcgccgagacacagacg

SEQ ID NO: 583167 - DNA, 20 bp, mouse
gagctgcacccggatctgtg

SEQ ID NO: 583168 - DNA, 20 bp, mouse
ggccgccgccgcacagatcc

SEQ ID NO: 583169 - DNA, 20 bp, mouse
gtgcacccggatctgtgcgg

SEQ ID NO: 583170 - DNA, 20 bp, mouse
gccgagacacagacgaggcg

SEQ ID NO: 583171 - DNA, 20 bp, mouse
gcggcgacgtgagcgcgcag

SEQ ID NO: 583172 - DNA, 20 bp, mouse
ggccgtgccgaccggactag

SEQ ID NO: 583173 - DNA, 20 bp, mouse
gcctcccgacagggcctcca

SEQ ID NO: 583174 - DNA, 20 bp, mouse
gtggccgccactagtccggt

SEQ ID NO: 583175 - DNA, 20 bp, mouse
ggccgggcgctcaccttgaa

SEQ ID NO: 583176 - DNA, 20 bp, mouse
ggctgggtctgagtgaccaa

SEQ ID NO: 583177 - DNA, 20 bp, mouse
gccttgctcccggaagtgga

SEQ ID NO: 583178 - DNA, 20 bp, mouse
gaggccgacatggtgatcga

SEQ ID NO: 583179 - DNA, 20 bp, mouse
gcggggcgctgtaaagaagt

SEQ ID NO: 583180 - DNA, 20 bp, mouse
ggctgccttgctcccggaag

SEQ ID NO: 583181 - DNA, 20 bp, mouse
ggtgtaaaccctccacttcc

SEQ ID NO: 583182 - DNA, 20 bp, mouse
gttagtgtcgaaggccgaca

SEQ ID NO: 583183 - DNA, 20 bp, mouse
gggacgtggcgtaggaggga

SEQ ID NO: 583184 - DNA, 20 bp, mouse
gccaaaggcagtagcgctcg

SEQ ID NO: 583185 - DNA, 20 bp, mouse
gcatggtgatcgagggccag

SEQ ID NO: 583186 - DNA, 20 bp, mouse
gccctgccccggcagtacgg

SEQ ID NO: 583187 - DNA, 20 bp, mouse
gagtggaccaagcacaccgg

SEQ ID NO: 583188 - DNA, 20 bp, mouse
gtgccccggcagtacggcgg

SEQ ID NO: 583189 - DNA, 20 bp, mouse
ggcgagtggaccaagcacac

SEQ ID NO: 583190 - DNA, 20 bp, mouse
gcgccaccgccgtactgccg

SEQ ID NO: 583191 - DNA, 20 bp, mouse
gcgcccctgccccggcagta

SEQ ID NO: 583192 - DNA, 20 bp, mouse
ggccctacacgcccctgccc

SEQ ID NO: 583193 - DNA, 20 bp, mouse
gcggcccaaagaactccctc

SEQ ID NO: 583194 - DNA, 20 bp, mouse
gcacaccggagggagttctt

SEQ ID NO: 583195 - DNA, 20 bp, mouse
ggctcgagaccagtgaacat

SEQ ID NO: 583196 - DNA, 20 bp, mouse
gggcgaaagccgaaccccta

SEQ ID NO: 583197 - DNA, 20 bp, mouse
ggaaagccgaacccctacgg

SEQ ID NO: 583198 - DNA, 20 bp, mouse
gaggtgagcagccgccgtag

SEQ ID NO: 583199 - DNA, 20 bp, mouse
gcggcccggttgctaggact

SEQ ID NO: 583200 - DNA, 20 bp, mouse
gggtggataagataaccctg

SEQ ID NO: 583201 - DNA, 20 bp, mouse
gcgcgtgcgccgcaaaccaa

SEQ ID NO: 583202 - DNA, 20 bp, mouse
gccccatggcggattcggaa

SEQ ID NO: 583203 - DNA, 20 bp, mouse
gcacgggagcgtagttccat

SEQ ID NO: 583204 - DNA, 20 bp, mouse
ggctaggacttggataagcg

SEQ ID NO: 583205 - DNA, 20 bp, mouse
ggttcgctcgggtgtccctc

SEQ ID NO: 583206 - DNA, 20 bp, mouse
gtgcgctgcaccgggcgatc

SEQ ID NO: 583207 - DNA, 20 bp, mouse
gcgaccgctcggctgcagaa

SEQ ID NO: 583208 - DNA, 20 bp, mouse
gtgcaccgggcgatcaggcg

SEQ ID NO: 583209 - DNA, 20 bp, mouse
gtgggttggagaggtgtcag

SEQ ID NO: 583210 - DNA, 20 bp, mouse
ggtaggtcgagcttctggag

SEQ ID NO: 583211 - DNA, 20 bp, mouse
gccgcgagcggctcccggat

SEQ ID NO: 583212 - DNA, 20 bp, mouse
gcgagcggctcccggattgg

SEQ ID NO: 583213 - DNA, 20 bp, mouse
gtcgagcttctggagaggtg

SEQ ID NO: 583214 - DNA, 20 bp, mouse
ggctacgagctgggttggag

SEQ ID NO: 583215 - DNA, 20 bp, mouse
gcgctccgcgcctgatcgcc

SEQ ID NO: 583216 - DNA, 20 bp, mouse
gcgggacgcggactcaggac

SEQ ID NO: 583217 - DNA, 20 bp, mouse
ggacccgcgaagctcctcgg

SEQ ID NO: 583218 - DNA, 20 bp, mouse
gggccaccgaggagcttcgc

SEQ ID NO: 583219 - DNA, 20 bp, mouse
gtcgcgggtcgaggtaagct

SEQ ID NO: 583220 - DNA, 20 bp, mouse
gacgtgactggtagaggagg

SEQ ID NO: 583221 - DNA, 20 bp, mouse
gaccggaaggaggtaacaga

SEQ ID NO: 583222 - DNA, 20 bp, mouse
gtgcggcgccgccatgacta

SEQ ID NO: 583223 - DNA, 20 bp, mouse
gcgggcaccccagcgggacg

SEQ ID NO: 583224 - DNA, 20 bp, mouse
gcccagcgggacgcggactc

SEQ ID NO: 583225 - DNA, 20 bp, mouse
gagggcccgggcaccccagc

SEQ ID NO: 583226 - DNA, 20 bp, mouse
gcagcgaggcagctcccggg

SEQ ID NO: 583227 - DNA, 20 bp, mouse
gccgggcggcggcgaccgag

SEQ ID NO: 583228 - DNA, 20 bp, mouse
gtggcagcgaggcagctccc

SEQ ID NO: 583229 - DNA, 20 bp, mouse
gacgcgcgctgaggtacctg

SEQ ID NO: 583230 - DNA, 20 bp, mouse
gggcggcggcgaccgagcgg

SEQ ID NO: 583231 - DNA, 20 bp, mouse
ggcgaccgagcggcggagaa

SEQ ID NO: 583232 - DNA, 20 bp, mouse
ggcgctcctggcccgcggtc

SEQ ID NO: 583233 - DNA, 20 bp, mouse
gaccccaaagcaggatccag

SEQ ID NO: 583234 - DNA, 20 bp, mouse
gtgaggtacctgtggcagcg

SEQ ID NO: 583235 - DNA, 20 bp, mouse
gcctgcgcgctcctggcccg

SEQ ID NO: 583236 - DNA, 20 bp, mouse
gccctcgcggacacttaccc

SEQ ID NO: 583237 - DNA, 20 bp, mouse
gtcgcggacacttacccggg

SEQ ID NO: 583238 - DNA, 20 bp, mouse
gacccggacgggcccaggag

SEQ ID NO: 583239 - DNA, 20 bp, mouse
gaggcgacgcgcgcccctcg

SEQ ID NO: 583240 - DNA, 20 bp, mouse
gcggtcacacgcccaggtga

SEQ ID NO: 583241 - DNA, 20 bp, mouse
gggagccgcgaggtggactg

SEQ ID NO: 583242 - DNA, 20 bp, mouse
ggcctcctcagtccacctcg

SEQ ID NO: 583243 - DNA, 20 bp, mouse
gaggaggccgggccagggtg

SEQ ID NO: 583244 - DNA, 20 bp, mouse
gtcacacgcccaggtgaggg

SEQ ID NO: 583245 - DNA, 20 bp, mouse
gcgccccgcccggtcctccg

SEQ ID NO: 583246 - DNA, 20 bp, mouse
gagcaggagaaggatcccgg

SEQ ID NO: 583247 - DNA, 20 bp, mouse
gcagctcgccgggctccggc

SEQ ID NO: 583248 - DNA, 20 bp, mouse
gcgggcggcgaagcaggaga

SEQ ID NO: 583249 - DNA, 20 bp, mouse
gaacacagctcgccgggctc

SEQ ID NO: 583250 - DNA, 20 bp, mouse
gcacgctgcccgccggagcc

SEQ ID NO: 583251 - DNA, 20 bp, mouse
gcgaagcaggagaaggatcc

SEQ ID NO: 583252 - DNA, 20 bp, mouse
gtcccgggggtcgcaggctg

SEQ ID NO: 583253 - DNA, 20 bp, mouse
ggggacaccacgctgcccgc

SEQ ID NO: 583254 - DNA, 20 bp, mouse
gcggcttcccgctccatcca

SEQ ID NO: 583255 - DNA, 20 bp, mouse
ggcggggcaacacagctcgc

SEQ ID NO: 583256 - DNA, 20 bp, mouse
ggcgatccggagatattctg

SEQ ID NO: 583257 - DNA, 20 bp, mouse
gatctccggatcgctttctg

SEQ ID NO: 583258 - DNA, 20 bp, mouse
gtgactccacagaatatctc

SEQ ID NO: 583259 - DNA, 20 bp, mouse
gagctctgctaggtactgac

SEQ ID NO: 583260 - DNA, 20 bp, mouse
gctgtgggtacaagcttcaa

SEQ ID NO: 583261 - DNA, 20 bp, mouse
ggaataacaggtctgcacgt

SEQ ID NO: 583262 - DNA, 20 bp, mouse
gccgacgctgcaccaagaca

SEQ ID NO: 583263 - DNA, 20 bp, mouse
gtgctaggtactgactgggt

SEQ ID NO: 583264 - DNA, 20 bp, mouse
gtccaggtgggagggtacga

SEQ ID NO: 583265 - DNA, 20 bp, mouse
ggactttctgggtcttcgtg

SEQ ID NO: 583266 - DNA, 20 bp, mouse
gcttgctgctgagggagtct

SEQ ID NO: 583267 - DNA, 20 bp, mouse
ggagacggagacagaggtga

SEQ ID NO: 583268 - DNA, 20 bp, mouse
gtgctgctccggccaccgcc

SEQ ID NO: 583269 - DNA, 20 bp, mouse
gggagcagcagtagccctgc

SEQ ID NO: 583270 - DNA, 20 bp, mouse
gcaaggtgtgtgcctggcgg

SEQ ID NO: 583271 - DNA, 20 bp, mouse
gccgcgcacgcggacatggg

SEQ ID NO: 583272 - DNA, 20 bp, mouse
ggacatgggcggcagctcca

SEQ ID NO: 583273 - DNA, 20 bp, mouse
gcagcagcaaggtgtgtgcc

SEQ ID NO: 583274 - DNA, 20 bp, mouse
gtgagcctgggcctccctgg

SEQ ID NO: 583275 - DNA, 20 bp, mouse
gtgcgcggaaggggctctcg

SEQ ID NO: 583276 - DNA, 20 bp, mouse
gacagccctggagtagatac

SEQ ID NO: 583277 - DNA, 20 bp, mouse
gcattccggtatctactcca

SEQ ID NO: 583278 - DNA, 20 bp, mouse
gggccaggcctgggaccgaa

SEQ ID NO: 583279 - DNA, 20 bp, mouse
gggtgagctgcgcgcagtat

SEQ ID NO: 583280 - DNA, 20 bp, mouse
gccagacgatcgagaaggtg

SEQ ID NO: 583281 - DNA, 20 bp, mouse
gccggctgctgcagccaggg

SEQ ID NO: 583282 - DNA, 20 bp, mouse
ggctcgccagcaagccgcgg

SEQ ID NO: 583283 - DNA, 20 bp, mouse
gggcagcggctgaacacgca

SEQ ID NO: 583284 - DNA, 20 bp, mouse
gagggctgtgcgcactgcgc

SEQ ID NO: 583285 - DNA, 20 bp, mouse
gaggggccccgggctttggg

SEQ ID NO: 583286 - DNA, 20 bp, mouse
gctaccatgctggccgccat

SEQ ID NO: 583287 - DNA, 20 bp, mouse
ggccgccatgggactagagc

SEQ ID NO: 583288 - DNA, 20 bp, mouse
gaacaccagctctagtccca

SEQ ID NO: 583289 - DNA, 20 bp, mouse
gagatggtcacgcagatggt

SEQ ID NO: 583290 - DNA, 20 bp, mouse
ggtggggaccagatcaaacc

SEQ ID NO: 583291 - DNA, 20 bp, mouse
gctggtcagcacgtctgtaa

SEQ ID NO: 583292 - DNA, 20 bp, mouse
gacagacgtgctgaccagca

SEQ ID NO: 583293 - DNA, 20 bp, mouse
gaggagggcctggtttgatc

SEQ ID NO: 583294 - DNA, 20 bp, mouse
gcagcctggcagatgataga

SEQ ID NO: 583295 - DNA, 20 bp, mouse
gcagcagagccccatagcgt

SEQ ID NO: 583296 - DNA, 20 bp, mouse
gctgccccgcgcctcatgga

SEQ ID NO: 583297 - DNA, 20 bp, mouse
ggcgggtgcggccgcggcaa

SEQ ID NO: 583298 - DNA, 20 bp, mouse
ggcggcgccagggagcccga

SEQ ID NO: 583299 - DNA, 20 bp, mouse
ggagggcgcagggtcccggg

SEQ ID NO: 583300 - DNA, 20 bp, mouse
ggacgcgaggcaggcccgag

SEQ ID NO: 583301 - DNA, 20 bp, mouse
gtaggaactgggcctgtccg

SEQ ID NO: 583302 - DNA, 20 bp, mouse
ggcacgcccgggtaggaact

SEQ ID NO: 583303 - DNA, 20 bp, mouse
gggtgcggccgcggcaaggg

SEQ ID NO: 583304 - DNA, 20 bp, mouse
ggatggcccggactgaaatg

SEQ ID NO: 583305 - DNA, 20 bp, mouse
ggtgtgccgcacgcccgggt

SEQ ID NO: 583306 - DNA, 20 bp, mouse
gggcgccgaacaccaccagg

SEQ ID NO: 583307 - DNA, 20 bp, mouse
ggctcgctgtggactcgtca

SEQ ID NO: 583308 - DNA, 20 bp, mouse
gagaggcgccgaacaccacc

SEQ ID NO: 583309 - DNA, 20 bp, mouse
gcgtcatggcgacggagcag

SEQ ID NO: 583310 - DNA, 20 bp, mouse
gcgaacaccaccaggtggaa

SEQ ID NO: 583311 - DNA, 20 bp, mouse
gcacagcgagctgcagcccg

SEQ ID NO: 583312 - DNA, 20 bp, mouse
gaggccgggaccccagtacc

SEQ ID NO: 583313 - DNA, 20 bp, mouse
gccgacggcggccaggacag

SEQ ID NO: 583314 - DNA, 20 bp, mouse
gtgtggactcgtcatggcga

SEQ ID NO: 583315 - DNA, 20 bp, mouse
gtcgatgcaggcgcacgcta

SEQ ID NO: 583316 - DNA, 20 bp, mouse
gcccatcccgagagtcagga

SEQ ID NO: 583317 - DNA, 20 bp, mouse
gcgttggtgtaggcgagtgg

SEQ ID NO: 583318 - DNA, 20 bp, mouse
ggctgtgcacagatctccct

SEQ ID NO: 583319 - DNA, 20 bp, mouse
gatgggtgttcagcccggtc

SEQ ID NO: 583320 - DNA, 20 bp, mouse
gttccggagcccgttggtgt

SEQ ID NO: 583321 - DNA, 20 bp, mouse
gctaggtgactggtcccggg

SEQ ID NO: 583322 - DNA, 20 bp, mouse
ggcccgttggtgtaggcgag

SEQ ID NO: 583323 - DNA, 20 bp, mouse
ggccctcctgactctcggga

SEQ ID NO: 583324 - DNA, 20 bp, mouse
gtcgggatgggtgttcagcc

SEQ ID NO: 583325 - DNA, 20 bp, mouse
gtagctgcgtggccagtgca

SEQ ID NO: 583326 - DNA, 20 bp, mouse
ggcagccgcgggcggagata

SEQ ID NO: 583327 - DNA, 20 bp, mouse
ggataaggatagaaaatgag

SEQ ID NO: 583328 - DNA, 20 bp, mouse
gtctgactcctggacaccgg

SEQ ID NO: 583329 - DNA, 20 bp, mouse
gtattctgactcctggacac

SEQ ID NO: 583330 - DNA, 20 bp, mouse
gaatcgcagcttgcagccac

SEQ ID NO: 583331 - DNA, 20 bp, mouse
gcttgcagccaccggtgtcc

SEQ ID NO: 583332 - DNA, 20 bp, mouse
gtggctggccagggcagccg

SEQ ID NO: 583333 - DNA, 20 bp, mouse
gggatgggacaatgcggtgt

SEQ ID NO: 583334 - DNA, 20 bp, mouse
gatcaaaaactggctggcca

SEQ ID NO: 583335 - DNA, 20 bp, mouse
gtctgcagtattctgactcc

SEQ ID NO: 583336 - DNA, 20 bp, mouse
gccctgggtggaaggcacac

SEQ ID NO: 583337 - DNA, 20 bp, mouse
ggggcacctgctgcaagaag

SEQ ID NO: 583338 - DNA, 20 bp, mouse
gggttatccaagttcaccct

SEQ ID NO: 583339 - DNA, 20 bp, mouse
ggaacttggataaccaccct

SEQ ID NO: 583340 - DNA, 20 bp, mouse
gcttggataaccaccctggg

SEQ ID NO: 583341 - DNA, 20 bp, mouse
gtgcaaaacaagctaggtgt

SEQ ID NO: 583342 - DNA, 20 bp, mouse
gatcctcaaacagtggaagg

SEQ ID NO: 583343 - DNA, 20 bp, mouse
gctggcatgctggttcttgg

SEQ ID NO: 583344 - DNA, 20 bp, mouse
gtttactagaggcccagtct

SEQ ID NO: 583345 - DNA, 20 bp, mouse
gctggaagggatccattgca

SEQ ID NO: 583346 - DNA, 20 bp, mouse
ggtctgcagcgactgaggat

SEQ ID NO: 583347 - DNA, 20 bp, mouse
gcagtacacacagcgcacag

SEQ ID NO: 583348 - DNA, 20 bp, mouse
ggatcctgtgctagagggag

SEQ ID NO: 583349 - DNA, 20 bp, mouse
ggacacctgcacagttagcc

SEQ ID NO: 583350 - DNA, 20 bp, mouse
gtccaggtctgcagcgactg

SEQ ID NO: 583351 - DNA, 20 bp, mouse
ggatgcccggctaactgtgc

SEQ ID NO: 583352 - DNA, 20 bp, mouse
gcagtcagcacagtcccacc

SEQ ID NO: 583353 - DNA, 20 bp, mouse
gaggatctttggtaccaggt

SEQ ID NO: 583354 - DNA, 20 bp, mouse
gcttccaaggagcaagatga

SEQ ID NO: 583355 - DNA, 20 bp, mouse
gtgtgtactgcgttgatgcc

SEQ ID NO: 583356 - DNA, 20 bp, mouse
gggaggtgggaagtgcaccc

SEQ ID NO: 583357 - DNA, 20 bp, mouse
ggtgattccccaagtggatc

SEQ ID NO: 583358 - DNA, 20 bp, mouse
gtgtgcacctggcgcttcct

SEQ ID NO: 583359 - DNA, 20 bp, mouse
gcccgcagtgattccccaag

SEQ ID NO: 583360 - DNA, 20 bp, mouse
gcgcaggaacccgggactct

SEQ ID NO: 583361 - DNA, 20 bp, mouse
gtccacttggggaatcactg

SEQ ID NO: 583362 - DNA, 20 bp, mouse
gtttcagccggatccacttg

SEQ ID NO: 583363 - DNA, 20 bp, mouse
gttaacaggcgagcggaggt

SEQ ID NO: 583364 - DNA, 20 bp, mouse
ggccagttagccaagagtcc

SEQ ID NO: 583365 - DNA, 20 bp, mouse
gttcattaacaggcgagcgg

SEQ ID NO: 583366 - DNA, 20 bp, mouse
ggtgccagccgggcagtgga

SEQ ID NO: 583367 - DNA, 20 bp, mouse
gtggatggtgggaagcaaga

SEQ ID NO: 583368 - DNA, 20 bp, mouse
ggcattcgggagaggcaaac

SEQ ID NO: 583369 - DNA, 20 bp, mouse
ggcggccacggccagcattc

SEQ ID NO: 583370 - DNA, 20 bp, mouse
gggaagcaagatggcggcca

SEQ ID NO: 583371 - DNA, 20 bp, mouse
gccagccgggcagtggatgg

SEQ ID NO: 583372 - DNA, 20 bp, mouse
gggagaggcaaacaggtact

SEQ ID NO: 583373 - DNA, 20 bp, mouse
gctctcccgaatgctggccg

SEQ ID NO: 583374 - DNA, 20 bp, mouse
ggcttcacagcctttaccac

SEQ ID NO: 583375 - DNA, 20 bp, mouse
gggtagggccacgtcatctt

SEQ ID NO: 583376 - DNA, 20 bp, mouse
gggcgtacgggcgggaactc

SEQ ID NO: 583377 - DNA, 20 bp, mouse
ggtcagaacgcagggcttcc

SEQ ID NO: 583378 - DNA, 20 bp, mouse
gaggggtctcaccggcgtac

SEQ ID NO: 583379 - DNA, 20 bp, mouse
ggaactcaggtcagaacgca

SEQ ID NO: 583380 - DNA, 20 bp, mouse
ggtctcaccggcgtacgggc

SEQ ID NO: 583381 - DNA, 20 bp, mouse
gcagtcaacacagtacacgt

SEQ ID NO: 583382 - DNA, 20 bp, mouse
ggcagcgtccaggtagacca

SEQ ID NO: 583383 - DNA, 20 bp, mouse
gggatccagccggcttctgg

SEQ ID NO: 583384 - DNA, 20 bp, mouse
gctcggcgcaggcagcgtcc

SEQ ID NO: 583385 - DNA, 20 bp, mouse
gtgtcaaagtactcagtacc

SEQ ID NO: 583386 - DNA, 20 bp, mouse
gggcccgagccctcactcag

SEQ ID NO: 583387 - DNA, 20 bp, mouse
gccctcactcagcggcagag

SEQ ID NO: 583388 - DNA, 20 bp, mouse
gtataagccgaggagctgtc

SEQ ID NO: 583389 - DNA, 20 bp, mouse
gacctctgtcttatattatg

SEQ ID NO: 583390 - DNA, 20 bp, mouse
ggagctgtccggtgctgaaa

SEQ ID NO: 583391 - DNA, 20 bp, mouse
gacgtgtgtgccgaaatgag

SEQ ID NO: 583392 - DNA, 20 bp, mouse
gtgccgctgagtgagggctc

SEQ ID NO: 583393 - DNA, 20 bp, mouse
gtcagcaccggacagctcct

SEQ ID NO: 583394 - DNA, 20 bp, mouse
ggctcgggccgtttcagcac

SEQ ID NO: 583395 - DNA, 20 bp, mouse
gctgtcttatattatgtgga

SEQ ID NO: 583396 - DNA, 20 bp, mouse
ggcaggtgagcaggtgcggt

SEQ ID NO: 583397 - DNA, 20 bp, mouse
gccaggcccgcgtccgctgg

SEQ ID NO: 583398 - DNA, 20 bp, mouse
ggaagttcctgcgccgccag

SEQ ID NO: 583399 - DNA, 20 bp, mouse
gaacttcagcacccgcgggg

SEQ ID NO: 583400 - DNA, 20 bp, mouse
ggtggagtaaagctacgccc

SEQ ID NO: 583401 - DNA, 20 bp, mouse
ggtaggcgctgtccgccccg

SEQ ID NO: 583402 - DNA, 20 bp, mouse
ggcaggaacttcagcacccg

SEQ ID NO: 583403 - DNA, 20 bp, mouse
gaggagcctgggtgcgggaa

SEQ ID NO: 583404 - DNA, 20 bp, mouse
gcctgcgccgccagcggacg

SEQ ID NO: 583405 - DNA, 20 bp, mouse
gactccactagctccaggag

SEQ ID NO: 583406 - DNA, 20 bp, mouse
gcactgcggaactcaccgtg

SEQ ID NO: 583407 - DNA, 20 bp, mouse
gaagctcgcccgcggccaca

SEQ ID NO: 583408 - DNA, 20 bp, mouse
gtgcaatctaggccaaaaca

SEQ ID NO: 583409 - DNA, 20 bp, mouse
gcgcatcacctgcatcactg

SEQ ID NO: 583410 - DNA, 20 bp, mouse
gattgcaagaagctcgcccg

SEQ ID NO: 583411 - DNA, 20 bp, mouse
ggaactcaccgtgtggccgc

SEQ ID NO: 583412 - DNA, 20 bp, mouse
gagttccgagagcagcgatt

SEQ ID NO: 583413 - DNA, 20 bp, mouse
gcctagctggggtcagacaa

SEQ ID NO: 583414 - DNA, 20 bp, mouse
gatggatgcggggattacag

SEQ ID NO: 583415 - DNA, 20 bp, mouse
gcccagctagggtttctgaa

SEQ ID NO: 583416 - DNA, 20 bp, mouse
gtcttcatggtagaggttgg

SEQ ID NO: 583417 - DNA, 20 bp, mouse
gatggcgatcttcatggtag

SEQ ID NO: 583418 - DNA, 20 bp, mouse
gctttggtgtctgtagatgt

SEQ ID NO: 583419 - DNA, 20 bp, mouse
ggaagtggccagtccctctg

SEQ ID NO: 583420 - DNA, 20 bp, mouse
ggggtgatgttgtaatgtgt

SEQ ID NO: 583421 - DNA, 20 bp, mouse
gatacagtcaccaggttgag

SEQ ID NO: 583422 - DNA, 20 bp, mouse
gacaaggcttccctagtctc

SEQ ID NO: 583423 - DNA, 20 bp, mouse
gtcctagtccaggcttcaaa

SEQ ID NO: 583424 - DNA, 20 bp, mouse
gcagatgtgctggtctagat

SEQ ID NO: 583425 - DNA, 20 bp, mouse
gcagctcaggtgagtgccca

SEQ ID NO: 583426 - DNA, 20 bp, mouse
gaaatgggaccaagctgggt

SEQ ID NO: 583427 - DNA, 20 bp, mouse
gggtgggtattactgcggtg

SEQ ID NO: 583428 - DNA, 20 bp, mouse
gtataaaatgggaccaagct

SEQ ID NO: 583429 - DNA, 20 bp, mouse
ggtgagcttcatggtaattt

SEQ ID NO: 583430 - DNA, 20 bp, mouse
gctcagacaagcttcagtgg

SEQ ID NO: 583431 - DNA, 20 bp, mouse
gtattactgcggtggggtca

SEQ ID NO: 583432 - DNA, 20 bp, mouse
ggcctctccaggcccctacc

SEQ ID NO: 583433 - DNA, 20 bp, mouse
gacaagcttcagtggtgggt

SEQ ID NO: 583434 - DNA, 20 bp, mouse
gcaggtactcctacccagct

SEQ ID NO: 583435 - DNA, 20 bp, mouse
gacgttgacgaaggaaaaca

SEQ ID NO: 583436 - DNA, 20 bp, mouse
gacccctgaatgcaggagca

SEQ ID NO: 583437 - DNA, 20 bp, mouse
gcctgcattcaggggtatgt

SEQ ID NO: 583438 - DNA, 20 bp, mouse
gagcacatcccagagtatag

SEQ ID NO: 583439 - DNA, 20 bp, mouse
gttataaaagatgaccaaac

SEQ ID NO: 583440 - DNA, 20 bp, mouse
ggcaggtactcttaccagtt

SEQ ID NO: 583441 - DNA, 20 bp, mouse
gtgccctgctcctgcattca

SEQ ID NO: 583442 - DNA, 20 bp, mouse
gtgttcatctattctttcac

SEQ ID NO: 583443 - DNA, 20 bp, mouse
gctctcaacctctatactct

SEQ ID NO: 583444 - DNA, 20 bp, mouse
ggtcagagatgcaggctctc

SEQ ID NO: 583445 - DNA, 20 bp, mouse
ggtgtgggggtcagagatgc

SEQ ID NO: 583446 - DNA, 20 bp, mouse
gaggcatcaatacaccccag

SEQ ID NO: 583447 - DNA, 20 bp, mouse
gtagagactcacgatgagac

SEQ ID NO: 583448 - DNA, 20 bp, mouse
gctctgtgaatacagagcag

SEQ ID NO: 583449 - DNA, 20 bp, mouse
ggcagtggcacacctgattg

SEQ ID NO: 583450 - DNA, 20 bp, mouse
gtacgtgtcttgctaagggc

SEQ ID NO: 583451 - DNA, 20 bp, mouse
gcacacctccctctgaaatc

SEQ ID NO: 583452 - DNA, 20 bp, mouse
gtctctgtaaagctgggcaa

SEQ ID NO: 583453 - DNA, 20 bp, mouse
gtcacaccctctatcccctg

SEQ ID NO: 583454 - DNA, 20 bp, mouse
ggtattctgtgtgtgtgtca

SEQ ID NO: 583455 - DNA, 20 bp, mouse
gtcagggatgcaggctcttc

SEQ ID NO: 583456 - DNA, 20 bp, mouse
ggcaagcttcatggtagtag

SEQ ID NO: 583457 - DNA, 20 bp, mouse
gtgaggatgtcaataggatg

SEQ ID NO: 583458 - DNA, 20 bp, mouse
gtattactgtgtgggggcca

SEQ ID NO: 583459 - DNA, 20 bp, mouse
gcctggatagcttgcaaccc

SEQ ID NO: 583460 - DNA, 20 bp, mouse
gctggtactcttatccagct

SEQ ID NO: 583461 - DNA, 20 bp, mouse
gcctgattgaggatgtcaat

SEQ ID NO: 583462 - DNA, 20 bp, mouse
gatcaggtgtatcatatttc

SEQ ID NO: 583463 - DNA, 20 bp, mouse
ggcttcatggtagtagtggc

SEQ ID NO: 583464 - DNA, 20 bp, mouse
gaatatgatacacctgattg

SEQ ID NO: 583465 - DNA, 20 bp, mouse
gggtgggtattactgtgtgg

SEQ ID NO: 583466 - DNA, 20 bp, mouse
gagttggacgtgacaataga

SEQ ID NO: 583467 - DNA, 20 bp, mouse
ggaggtgggtattctgtgtg

SEQ ID NO: 583468 - DNA, 20 bp, mouse
ggtattctgtgtgggggtcg

SEQ ID NO: 583469 - DNA, 20 bp, mouse
gccggatggaaatctatttc

SEQ ID NO: 583470 - DNA, 20 bp, mouse
ggctccatgggtgaagatag

SEQ ID NO: 583471 - DNA, 20 bp, mouse
gcgggccatccaccaaacat

SEQ ID NO: 583472 - DNA, 20 bp, mouse
gcaggtgctcctactcagct

SEQ ID NO: 583473 - DNA, 20 bp, mouse
gaattgtgggaagccattcc

SEQ ID NO: 583474 - DNA, 20 bp, mouse
gaatagagggtgtgagaatc

SEQ ID NO: 583475 - DNA, 20 bp, mouse
gttcaaaaaaatataaaagg

SEQ ID NO: 583476 - DNA, 20 bp, mouse
gctgcgtctgtggtaagtct

SEQ ID NO: 583477 - DNA, 20 bp, mouse
gtgtgactgtcaccatgaaa

SEQ ID NO: 583478 - DNA, 20 bp, mouse
gcagacgcagagcaggctta

SEQ ID NO: 583479 - DNA, 20 bp, mouse
ggttagtgttaggtcagggt

SEQ ID NO: 583480 - DNA, 20 bp, mouse
gctgggctaactggatccag

SEQ ID NO: 583481 - DNA, 20 bp, mouse
ggggagcagcgctcttctgc

SEQ ID NO: 583482 - DNA, 20 bp, mouse
gtggggtctgtgacactggt

SEQ ID NO: 583483 - DNA, 20 bp, mouse
gtcggtggttagttagtgtt

SEQ ID NO: 583484 - DNA, 20 bp, mouse
ggtaggtaaggggccccaag

SEQ ID NO: 583485 - DNA, 20 bp, mouse
gagcagcgctcttctgctgg

SEQ ID NO: 583486 - DNA, 20 bp, mouse
gctggtggttctattcatgt

SEQ ID NO: 583487 - DNA, 20 bp, mouse
gtgcctcaacatgaagctgg

SEQ ID NO: 583488 - DNA, 20 bp, mouse
gtgaggcagcccttatgggt

SEQ ID NO: 583489 - DNA, 20 bp, mouse
gatgttgaggcagcccttat

SEQ ID NO: 583490 - DNA, 20 bp, mouse
gtcccctgggaaacccatat

SEQ ID NO: 583491 - DNA, 20 bp, mouse
gtgacatgtagctccaacaa

SEQ ID NO: 583492 - DNA, 20 bp, mouse
gccatttgctgctatgccaa

SEQ ID NO: 583493 - DNA, 20 bp, mouse
gaaccaccagcttcatgttg

SEQ ID NO: 583494 - DNA, 20 bp, mouse
ggtagaacagaagagtgctt

SEQ ID NO: 583495 - DNA, 20 bp, mouse
gacccatatgggtttcccag

SEQ ID NO: 583496 - DNA, 20 bp, mouse
ggcagaggcttaatgttcct

SEQ ID NO: 583497 - DNA, 20 bp, mouse
ggacatttgtagatgctcca

SEQ ID NO: 583498 - DNA, 20 bp, mouse
gtgctgggcttgctgataac

SEQ ID NO: 583499 - DNA, 20 bp, mouse
ggtgctggtgatgatactca

SEQ ID NO: 583500 - DNA, 20 bp, mouse
ggtgctaaatgctctctcag

SEQ ID NO: 583501 - DNA, 20 bp, mouse
ggccccatggagatataagt

SEQ ID NO: 583502 - DNA, 20 bp, mouse
ggccctacttatatctccat

SEQ ID NO: 583503 - DNA, 20 bp, mouse
gtctgggagtctgaagactt

SEQ ID NO: 583504 - DNA, 20 bp, mouse
gagatgctcagttgaatctg

SEQ ID NO: 583505 - DNA, 20 bp, mouse
gagactcccagaaaaaaaca

SEQ ID NO: 583506 - DNA, 20 bp, mouse
gaccagcaaggccagcagaa

SEQ ID NO: 583507 - DNA, 20 bp, mouse
gagcagaagggtccctttca

SEQ ID NO: 583508 - DNA, 20 bp, mouse
gttgtggggcgtggagacag

SEQ ID NO: 583509 - DNA, 20 bp, mouse
gggtatccttgggaggacaa

SEQ ID NO: 583510 - DNA, 20 bp, mouse
gccttgggaggacaatggca

SEQ ID NO: 583511 - DNA, 20 bp, mouse
gtaaaattgttgggtttgtg

SEQ ID NO: 583512 - DNA, 20 bp, mouse
gtcatcccatctcagtccca

SEQ ID NO: 583513 - DNA, 20 bp, mouse
gaagtgaagttcaaatatca

SEQ ID NO: 583514 - DNA, 20 bp, mouse
gaaaccatgctgttactgtg

SEQ ID NO: 583515 - DNA, 20 bp, mouse
gatcaaggtctgtcaactca

SEQ ID NO: 583516 - DNA, 20 bp, mouse
gaccagcaaggccagcagaa

SEQ ID NO: 583517 - DNA, 20 bp, mouse
gagcagaagggtccctttca

SEQ ID NO: 583518 - DNA, 20 bp, mouse
gttgtggggcgtggagacag

SEQ ID NO: 583519 - DNA, 20 bp, mouse
gggtatccttgggaggacaa

SEQ ID NO: 583520 - DNA, 20 bp, mouse
gccttgggaggacaatggca

SEQ ID NO: 583521 - DNA, 20 bp, mouse
gtaaaattgttgggtttgtg

SEQ ID NO: 583522 - DNA, 20 bp, mouse
gtcatcccatctcagtccca

SEQ ID NO: 583523 - DNA, 20 bp, mouse
gaagtgaagttcaaatatca

SEQ ID NO: 583524 - DNA, 20 bp, mouse
gaaaccatgctgttactgtg

SEQ ID NO: 583525 - DNA, 20 bp, mouse
gatcaaggtctgtcaactca

SEQ ID NO: 583526 - DNA, 20 bp, mouse
ggaagaggatctcctctgag

SEQ ID NO: 583527 - DNA, 20 bp, mouse
gtgctgggcttgctgataac

SEQ ID NO: 583528 - DNA, 20 bp, mouse
ggtgcaggtgatgatactca

SEQ ID NO: 583529 - DNA, 20 bp, mouse
gtgctaaatgctcctctcag

SEQ ID NO: 583530 - DNA, 20 bp, mouse
ggccccatggagatataagt

SEQ ID NO: 583531 - DNA, 20 bp, mouse
ggccctacttatatctccat

SEQ ID NO: 583532 - DNA, 20 bp, mouse
gtctgggagtctgaagactt

SEQ ID NO: 583533 - DNA, 20 bp, mouse
gagatgctcagttgaatctg

SEQ ID NO: 583534 - DNA, 20 bp, mouse
gagactcccagaaaaaaaca

SEQ ID NO: 583535 - DNA, 20 bp, mouse
ggtaaaccatgtttttttct

SEQ ID NO: 583536 - DNA, 20 bp, mouse
gttacctgaaggtcagatat

SEQ ID NO: 583537 - DNA, 20 bp, mouse
gtggaagaggatttgctttg

SEQ ID NO: 583538 - DNA, 20 bp, mouse
gcacccccaaccctggcttc

SEQ ID NO: 583539 - DNA, 20 bp, mouse
gatttggagctcctgaagcc

SEQ ID NO: 583540 - DNA, 20 bp, mouse
gctttgggagagtgggactg

SEQ ID NO: 583541 - DNA, 20 bp, mouse
ggagctcctgaagccagggt

SEQ ID NO: 583542 - DNA, 20 bp, mouse
gctcctgaagccagggttgg

SEQ ID NO: 583543 - DNA, 20 bp, mouse
gtggactcccaaggatccct

SEQ ID NO: 583544 - DNA, 20 bp, mouse
gccttgctagtggactccca

SEQ ID NO: 583545 - DNA, 20 bp, mouse
gactgagatgggatgagcga

SEQ ID NO: 583546 - DNA, 20 bp, mouse
gctgggaggtgaaagccttt

SEQ ID NO: 583547 - DNA, 20 bp, mouse
ggacacctaggtctgactca

SEQ ID NO: 583548 - DNA, 20 bp, mouse
gatttgaatgtcagatacca

SEQ ID NO: 583549 - DNA, 20 bp, mouse
gggcatttgtagatgccgca

SEQ ID NO: 583550 - DNA, 20 bp, mouse
gtggcctcctgaggacacct

SEQ ID NO: 583551 - DNA, 20 bp, mouse
gtccatgagtggacagacct

SEQ ID NO: 583552 - DNA, 20 bp, mouse
ggtcagacctaggtgtcctc

SEQ ID NO: 583553 - DNA, 20 bp, mouse
gtgctaaatgcttctatcag

SEQ ID NO: 583554 - DNA, 20 bp, mouse
gcatagtcaaacactcccaa

SEQ ID NO: 583555 - DNA, 20 bp, mouse
gggctgagatggggtgcaca

SEQ ID NO: 583556 - DNA, 20 bp, mouse
gtgtccccttcatggtggag

SEQ ID NO: 583557 - DNA, 20 bp, mouse
ggaggctgaggcctttgaga

SEQ ID NO: 583558 - DNA, 20 bp, mouse
gagaagaaaaagatacgagt

SEQ ID NO: 583559 - DNA, 20 bp, mouse
gagacagacctagggtcctc

SEQ ID NO: 583560 - DNA, 20 bp, mouse
ggctccaggttacaacactt

SEQ ID NO: 583561 - DNA, 20 bp, mouse
ggtggcctcccgaggaccct

SEQ ID NO: 583562 - DNA, 20 bp, mouse
gcagacctagggtcctcggg

SEQ ID NO: 583563 - DNA, 20 bp, mouse
ggagtgtggagcttatgtga

SEQ ID NO: 583564 - DNA, 20 bp, mouse
gtagatgaaccttgaagcag

SEQ ID NO: 583565 - DNA, 20 bp, mouse
gcaccccaagtgttgtaacc

SEQ ID NO: 583566 - DNA, 20 bp, mouse
ggttcttgcccaaaggtgtt

SEQ ID NO: 583567 - DNA, 20 bp, mouse
ggaaggtgtccacaggtgct

SEQ ID NO: 583568 - DNA, 20 bp, mouse
gataagcacagttgaaggag

SEQ ID NO: 583569 - DNA, 20 bp, mouse
gagacctaggggttcctggg

SEQ ID NO: 583570 - DNA, 20 bp, mouse
gaatagccctactctcacaa

SEQ ID NO: 583571 - DNA, 20 bp, mouse
gcatttggggtgggtgagat

SEQ ID NO: 583572 - DNA, 20 bp, mouse
gccttcaactgtgcttataa

SEQ ID NO: 583573 - DNA, 20 bp, mouse
ggacaccttcccttgcatac

SEQ ID NO: 583574 - DNA, 20 bp, mouse
ggacacacacttcacatgag

SEQ ID NO: 583575 - DNA, 20 bp, mouse
gtgggttacaacatttgggg

SEQ ID NO: 583576 - DNA, 20 bp, mouse
gtcttgctcaaagctcctgg

SEQ ID NO: 583577 - DNA, 20 bp, mouse
ggctctgggttacaatagtt

SEQ ID NO: 583578 - DNA, 20 bp, mouse
gtagttgggtcgggtgagat

SEQ ID NO: 583579 - DNA, 20 bp, mouse
gtgggttacaatagttgggt

SEQ ID NO: 583580 - DNA, 20 bp, mouse
gttttggagggtaggactaa

SEQ ID NO: 583581 - DNA, 20 bp, mouse
ggactgagatggggtaagca

SEQ ID NO: 583582 - DNA, 20 bp, mouse
gctaagggaaaggtcagtta

SEQ ID NO: 583583 - DNA, 20 bp, mouse
gagaggctacagccttttgg

SEQ ID NO: 583584 - DNA, 20 bp, mouse
gctacagccttttggagggt

SEQ ID NO: 583585 - DNA, 20 bp, mouse
ggtttcttgctcaaagctcc

SEQ ID NO: 583586 - DNA, 20 bp, mouse
gccacttagagatctacatg

SEQ ID NO: 583587 - DNA, 20 bp, mouse
gtacagtcccaaactcccaa

SEQ ID NO: 583588 - DNA, 20 bp, mouse
ggatataagtgtgctggtga

SEQ ID NO: 583589 - DNA, 20 bp, mouse
gtgatggtactggtaataaa

SEQ ID NO: 583590 - DNA, 20 bp, mouse
gtgagttacaaagttggagt

SEQ ID NO: 583591 - DNA, 20 bp, mouse
gttctgaagctacttgccgg

SEQ ID NO: 583592 - DNA, 20 bp, mouse
ggatacaacatggttgtatc

SEQ ID NO: 583593 - DNA, 20 bp, mouse
gtggggagatataagtgtgc

SEQ ID NO: 583594 - DNA, 20 bp, mouse
gtcgtgaaggtcatttatcc

SEQ ID NO: 583595 - DNA, 20 bp, mouse
gaagtgtgcagctttcgtga

SEQ ID NO: 583596 - DNA, 20 bp, mouse
gggaggctgaagcctttgga

SEQ ID NO: 583597 - DNA, 20 bp, mouse
gtctgggaggctgaagcctt

SEQ ID NO: 583598 - DNA, 20 bp, mouse
gtgaagctgaggcaagagtt

SEQ ID NO: 583599 - DNA, 20 bp, mouse
gcatagtcaaacccttccaa

SEQ ID NO: 583600 - DNA, 20 bp, mouse
gctgttgggtttgtgtgaca

SEQ ID NO: 583601 - DNA, 20 bp, mouse
gtggcctcctgaggacacct

SEQ ID NO: 583602 - DNA, 20 bp, mouse
gttgtgtgacatggatacag

SEQ ID NO: 583603 - DNA, 20 bp, mouse
gtccatgagtggacagacct

SEQ ID NO: 583604 - DNA, 20 bp, mouse
gggctgagatggggtgcaca

SEQ ID NO: 583605 - DNA, 20 bp, mouse
gttcttaagatccttgccag

SEQ ID NO: 583606 - DNA, 20 bp, mouse
ggccacacagagcactagaa

SEQ ID NO: 583607 - DNA, 20 bp, mouse
gaaggtggtggtaagcttca

SEQ ID NO: 583608 - DNA, 20 bp, mouse
gacacagagcactagaaagg

SEQ ID NO: 583609 - DNA, 20 bp, mouse
gaaccagctggagcagtcag

SEQ ID NO: 583610 - DNA, 20 bp, mouse
gtgagtgagaggcagctcgg

SEQ ID NO: 583611 - DNA, 20 bp, mouse
ggatgggtggcatcaatcca

SEQ ID NO: 583612 - DNA, 20 bp, mouse
gccctggaagggataagcag

SEQ ID NO: 583613 - DNA, 20 bp, mouse
gagtctcagaagatgctccc

SEQ ID NO: 583614 - DNA, 20 bp, mouse
gagattgtcttataggtcct

SEQ ID NO: 583615 - DNA, 20 bp, mouse
gctagcagagttgtctacag

SEQ ID NO: 583616 - DNA, 20 bp, mouse
gaagtcccggaaaacatcac

SEQ ID NO: 583617 - DNA, 20 bp, mouse
gagaaagcccaacaaaatca

SEQ ID NO: 583618 - DNA, 20 bp, mouse
gctgaggaaaagcagccatc

SEQ ID NO: 583619 - DNA, 20 bp, mouse
gttgacaccgtgattttgtt

SEQ ID NO: 583620 - DNA, 20 bp, mouse
gttgcaagtaagcttatagt

SEQ ID NO: 583621 - DNA, 20 bp, mouse
ggaataaccacaaataccaa

SEQ ID NO: 583622 - DNA, 20 bp, mouse
ggttgtgtcacaatagaaac

SEQ ID NO: 583623 - DNA, 20 bp, mouse
gggtgcctgtgatgttttcc

SEQ ID NO: 583624 - DNA, 20 bp, mouse
gagcaatagagtactgtaaa

SEQ ID NO: 583625 - DNA, 20 bp, mouse
gtgattgaatcgcctgaagt

SEQ ID NO: 583626 - DNA, 20 bp, mouse
gtctctagctaggtaccagt

SEQ ID NO: 583627 - DNA, 20 bp, mouse
ggtgggcaaggcaagctcga

SEQ ID NO: 583628 - DNA, 20 bp, mouse
gggcaagctcgagggcgtcc

SEQ ID NO: 583629 - DNA, 20 bp, mouse
gagctaggtaccagtgggca

SEQ ID NO: 583630 - DNA, 20 bp, mouse
gggtacctagctagagaggg

SEQ ID NO: 583631 - DNA, 20 bp, mouse
gcgagggcgtccgggctcgt

SEQ ID NO: 583632 - DNA, 20 bp, mouse
ggcgcctagcgtagacacag

SEQ ID NO: 583633 - DNA, 20 bp, mouse
gctagatgtcaggctccagg

SEQ ID NO: 583634 - DNA, 20 bp, mouse
gggcagcgcttcgacaagga

SEQ ID NO: 583635 - DNA, 20 bp, mouse
gatctggcagcgcttcgaca

SEQ ID NO: 583636 - DNA, 20 bp, mouse
ggagcccctcactgaagact

SEQ ID NO: 583637 - DNA, 20 bp, mouse
gagcaaccaagtcttcagtg

SEQ ID NO: 583638 - DNA, 20 bp, mouse
ggatgccataggtgaatata

SEQ ID NO: 583639 - DNA, 20 bp, mouse
gaataccttatattcaccta

SEQ ID NO: 583640 - DNA, 20 bp, mouse
gttggttgctaagatgccat

SEQ ID NO: 583641 - DNA, 20 bp, mouse
gaccctgtgatcacaggtgg

SEQ ID NO: 583642 - DNA, 20 bp, mouse
gtaaaaggcagaaaggaacg

SEQ ID NO: 583643 - DNA, 20 bp, mouse
ggcctggggtctaagagtcc

SEQ ID NO: 583644 - DNA, 20 bp, mouse
gacctggactcttagacccc

SEQ ID NO: 583645 - DNA, 20 bp, mouse
gggctctcagatttcaaagg

SEQ ID NO: 583646 - DNA, 20 bp, mouse
gggcttcagagcgagctcgg

SEQ ID NO: 583647 - DNA, 20 bp, mouse
gctgctcctccggaaccggg

SEQ ID NO: 583648 - DNA, 20 bp, mouse
gcactgcgcaggttgctcag

SEQ ID NO: 583649 - DNA, 20 bp, mouse
ggagcaaggcctctcccata

SEQ ID NO: 583650 - DNA, 20 bp, mouse
ggaactgctcgtaccaggta

SEQ ID NO: 583651 - DNA, 20 bp, mouse
ggcgagagaacgccctggtt

SEQ ID NO: 583652 - DNA, 20 bp, mouse
gtgctcgtaccaggtaaggt

SEQ ID NO: 583653 - DNA, 20 bp, mouse
ggggagtccctgcctaacca

SEQ ID NO: 583654 - DNA, 20 bp, mouse
ggcctgcctcccggttccgg

SEQ ID NO: 583655 - DNA, 20 bp, mouse
gggaggcttcagagcgagct

SEQ ID NO: 583656 - DNA, 20 bp, mouse
ggtgaacaccccggcagtct

SEQ ID NO: 583657 - DNA, 20 bp, mouse
gctgcttccagtgaacaccc

SEQ ID NO: 583658 - DNA, 20 bp, mouse
gatggacagatgactatggt

SEQ ID NO: 583659 - DNA, 20 bp, mouse
ggcacttacctagactgccg

SEQ ID NO: 583660 - DNA, 20 bp, mouse
gggtacaactggagaaagag

SEQ ID NO: 583661 - DNA, 20 bp, mouse
ggtgttactcaagcacaact

SEQ ID NO: 583662 - DNA, 20 bp, mouse
gctcaagcacaactggggag

SEQ ID NO: 583663 - DNA, 20 bp, mouse
gtggcctggaagagttcact

SEQ ID NO: 583664 - DNA, 20 bp, mouse
ggagtgccaaaggcaccgag

SEQ ID NO: 583665 - DNA, 20 bp, mouse
gcacacgtctaacagcaaca

SEQ ID NO: 583666 - DNA, 20 bp, mouse
gagggcacggatcaagtcct

SEQ ID NO: 583667 - DNA, 20 bp, mouse
ggtggtgtgcagcaccaggt

SEQ ID NO: 583668 - DNA, 20 bp, mouse
gcaaggaagagcccgatgac

SEQ ID NO: 583669 - DNA, 20 bp, mouse
ggctcgctcggccagcatcg

SEQ ID NO: 583670 - DNA, 20 bp, mouse
gacaccaccaagtccagcag

SEQ ID NO: 583671 - DNA, 20 bp, mouse
gaccagcagggaaggaactg

SEQ ID NO: 583672 - DNA, 20 bp, mouse
gacccagccagaaatgcagg

SEQ ID NO: 583673 - DNA, 20 bp, mouse
ggcctgcgcgcgcgaactcg

SEQ ID NO: 583674 - DNA, 20 bp, mouse
gaagcccctgctggacttgg

SEQ ID NO: 583675 - DNA, 20 bp, mouse
gggccagcatcgcggcacca

SEQ ID NO: 583676 - DNA, 20 bp, mouse
ggtctccaaggaacggtctg

SEQ ID NO: 583677 - DNA, 20 bp, mouse
gcgtcaccgtctccaaggaa

SEQ ID NO: 583678 - DNA, 20 bp, mouse
gggacccggccggacgagaa

SEQ ID NO: 583679 - DNA, 20 bp, mouse
ggcgggccgagtggactccg

SEQ ID NO: 583680 - DNA, 20 bp, mouse
gggtccggccgagcgcggaa

SEQ ID NO: 583681 - DNA, 20 bp, mouse
gagcggccgcggagtccact

SEQ ID NO: 583682 - DNA, 20 bp, mouse
gggtgccccagaccgttcct

SEQ ID NO: 583683 - DNA, 20 bp, mouse
gcggctgaggggcgacgcca

SEQ ID NO: 583684 - DNA, 20 bp, mouse
gagcgtccccgccggctgag

SEQ ID NO: 583685 - DNA, 20 bp, mouse
ggagcgcggaacggagtctg

SEQ ID NO: 583686 - DNA, 20 bp, mouse
ggtgacctgccggcgatcag

SEQ ID NO: 583687 - DNA, 20 bp, mouse
ggggagcgcacctgtcgggt

SEQ ID NO: 583688 - DNA, 20 bp, mouse
ggcgatcagggggatggacg

SEQ ID NO: 583689 - DNA, 20 bp, mouse
gtgaagggagcgcacctgtc

SEQ ID NO: 583690 - DNA, 20 bp, mouse
gaggctaccgcccaagctga

SEQ ID NO: 583691 - DNA, 20 bp, mouse
gctgccggcgatcaggggga

SEQ ID NO: 583692 - DNA, 20 bp, mouse
gcagagacttcggggcgctc

SEQ ID NO: 583693 - DNA, 20 bp, mouse
ggcgtccggccacaggaacc

SEQ ID NO: 583694 - DNA, 20 bp, mouse
gaatggcgcgctgggcagtg

SEQ ID NO: 583695 - DNA, 20 bp, mouse
gcgccccgaagtctctgaat

SEQ ID NO: 583696 - DNA, 20 bp, mouse
gctgcgcagcggaaacatgg

SEQ ID NO: 583697 - DNA, 20 bp, mouse
ggcttacctgagggcgacag

SEQ ID NO: 583698 - DNA, 20 bp, mouse
gtccctgcgcagcggaaaca

SEQ ID NO: 583699 - DNA, 20 bp, mouse
gcgagcgaggacgccggcag

SEQ ID NO: 583700 - DNA, 20 bp, mouse
gcgcgcgcgagagaacccaa

SEQ ID NO: 583701 - DNA, 20 bp, mouse
gctggagagcggctcggctg

SEQ ID NO: 583702 - DNA, 20 bp, mouse
gcactgggcccgagcagatg

SEQ ID NO: 583703 - DNA, 20 bp, mouse
gcagtgaggcgcttacctga

SEQ ID NO: 583704 - DNA, 20 bp, mouse
gacggctctggagagcggct

SEQ ID NO: 583705 - DNA, 20 bp, mouse
gcccagcagcggagcaccgg

SEQ ID NO: 583706 - DNA, 20 bp, mouse
gggagtgttgggacaaactg

SEQ ID NO: 583707 - DNA, 20 bp, mouse
gcttctgtcatgctagctca

SEQ ID NO: 583708 - DNA, 20 bp, mouse
gcgcggcttctcaaaaatgg

SEQ ID NO: 583709 - DNA, 20 bp, mouse
ggcgcgcggcttctcaaaaa

SEQ ID NO: 583710 - DNA, 20 bp, mouse
gtctggggtaaagcttccag

SEQ ID NO: 583711 - DNA, 20 bp, mouse
gcgctggcgcggcagtaagg

SEQ ID NO: 583712 - DNA, 20 bp, mouse
gctcgggcggagaagacccg

SEQ ID NO: 583713 - DNA, 20 bp, mouse
gtcatgctagctcagggagc

SEQ ID NO: 583714 - DNA, 20 bp, mouse
ggctttgtgggagattggta

SEQ ID NO: 583715 - DNA, 20 bp, mouse
gacagcagccttggcatctg

SEQ ID NO: 583716 - DNA, 20 bp, mouse
gggcaggcgtagcacacggg

SEQ ID NO: 583717 - DNA, 20 bp, mouse
gtgaggcaggcgtagcacac

SEQ ID NO: 583718 - DNA, 20 bp, mouse
gctgctggcgactagctgtg

SEQ ID NO: 583719 - DNA, 20 bp, mouse
gggctctgtgaccaagctgt

SEQ ID NO: 583720 - DNA, 20 bp, mouse
gtctaatgagatgtttgcag

SEQ ID NO: 583721 - DNA, 20 bp, mouse
gacctcagcaagcaacaccc

SEQ ID NO: 583722 - DNA, 20 bp, mouse
gtgtgctgtggtacattgta

SEQ ID NO: 583723 - DNA, 20 bp, mouse
ggtgaccaagctgtaggtaa

SEQ ID NO: 583724 - DNA, 20 bp, mouse
gttgctgaggtctggagtgg

SEQ ID NO: 583725 - DNA, 20 bp, mouse
ggagcccggtgggtaaactt

SEQ ID NO: 583726 - DNA, 20 bp, mouse
ggcagggtggaactcgtgac

SEQ ID NO: 583727 - DNA, 20 bp, mouse
gcaccatccagcaagcaggg

SEQ ID NO: 583728 - DNA, 20 bp, mouse
gcgtcactcaaggatctaca

SEQ ID NO: 583729 - DNA, 20 bp, mouse
gatgggaatggcacccacga

SEQ ID NO: 583730 - DNA, 20 bp, mouse
gcctttagacggagaacaga

SEQ ID NO: 583731 - DNA, 20 bp, mouse
gagatccttgagtgacggac

SEQ ID NO: 583732 - DNA, 20 bp, mouse
gcggggctcctccacgaagg

SEQ ID NO: 583733 - DNA, 20 bp, mouse
gcaaggaatcacgccttcgt

SEQ ID NO: 583734 - DNA, 20 bp, mouse
ggccatgcgcgaatgctgag

SEQ ID NO: 583735 - DNA, 20 bp, mouse
ggcaagcccagccaccttcg

SEQ ID NO: 583736 - DNA, 20 bp, mouse
gaggtaagccatccaggctg

SEQ ID NO: 583737 - DNA, 20 bp, mouse
gttcctgctagggaggctca

SEQ ID NO: 583738 - DNA, 20 bp, mouse
gcctgaaacgacagaggatg

SEQ ID NO: 583739 - DNA, 20 bp, mouse
gtcagaggtggagaccaggt

SEQ ID NO: 583740 - DNA, 20 bp, mouse
gccccagcctgaaacgacag

SEQ ID NO: 583741 - DNA, 20 bp, mouse
ggccaagagcgagaatctcc

SEQ ID NO: 583742 - DNA, 20 bp, mouse
ggtcaggtgtcagagcccat

SEQ ID NO: 583743 - DNA, 20 bp, mouse
gggtgtcagagcccatcggt

SEQ ID NO: 583744 - DNA, 20 bp, mouse
gtgccctgagcctccctagc

SEQ ID NO: 583745 - DNA, 20 bp, mouse
gtctgtgagaaccgaccgat

SEQ ID NO: 583746 - DNA, 20 bp, mouse
gagccgagaggatactgcag

SEQ ID NO: 583747 - DNA, 20 bp, mouse
gtattaggtaccatagagtg

SEQ ID NO: 583748 - DNA, 20 bp, mouse
gtcatcctcgcctcactcta

SEQ ID NO: 583749 - DNA, 20 bp, mouse
ggacctctgcagtatcctct

SEQ ID NO: 583750 - DNA, 20 bp, mouse
gggtaccatagagtgaggcg

SEQ ID NO: 583751 - DNA, 20 bp, mouse
ggaaggtgcggactcgtcgt

SEQ ID NO: 583752 - DNA, 20 bp, mouse
ggtgaccaagtgcttcacaa

SEQ ID NO: 583753 - DNA, 20 bp, mouse
gcccacggaaataagagttg

SEQ ID NO: 583754 - DNA, 20 bp, mouse
gcaagggctgcagcctcata

SEQ ID NO: 583755 - DNA, 20 bp, mouse
gatcgttgcaacggaaggtg

SEQ ID NO: 583756 - DNA, 20 bp, mouse
gcaacgtccggagccaggca

SEQ ID NO: 583757 - DNA, 20 bp, mouse
ggacaggcgatgggccccgg

SEQ ID NO: 583758 - DNA, 20 bp, mouse
ggcgctggggtgcggaccgc

SEQ ID NO: 583759 - DNA, 20 bp, mouse
gccggacgttgctcgcgctc

SEQ ID NO: 583760 - DNA, 20 bp, mouse
gggctgcggcgacccctgcc

SEQ ID NO: 583761 - DNA, 20 bp, mouse
gcgcgccacagggcgcatcc

SEQ ID NO: 583762 - DNA, 20 bp, mouse
gccggagccgcgccaagtcc

SEQ ID NO: 583763 - DNA, 20 bp, mouse
gctcctgcgcactgcagcgg

SEQ ID NO: 583764 - DNA, 20 bp, mouse
gcccccggcggtaaccggag

SEQ ID NO: 583765 - DNA, 20 bp, mouse
gcgcactgcagcggcggccc

SEQ ID NO: 583766 - DNA, 20 bp, mouse
gctgacactcagtcactcga

SEQ ID NO: 583767 - DNA, 20 bp, mouse
gtgcagtgatcgccctgtct

SEQ ID NO: 583768 - DNA, 20 bp, mouse
gttacctgaaataaagggaa

SEQ ID NO: 583769 - DNA, 20 bp, mouse
gcttgcttacctgaaataaa

SEQ ID NO: 583770 - DNA, 20 bp, mouse
gcctatgctaaaatgatcac

SEQ ID NO: 583771 - DNA, 20 bp, mouse
ggataaagcttgcagagtga

SEQ ID NO: 583772 - DNA, 20 bp, mouse
gcatgctgttttctgacagt

SEQ ID NO: 583773 - DNA, 20 bp, mouse
gaaacattgaaaatacaaca

SEQ ID NO: 583774 - DNA, 20 bp, mouse
ggaattctagaaacctgcgt

SEQ ID NO: 583775 - DNA, 20 bp, mouse
gtcacgattctgccaaatga

SEQ ID NO: 583776 - DNA, 20 bp, mouse
gtacagagttttgggttgat

SEQ ID NO: 583777 - DNA, 20 bp, mouse
gcccatgcctggtgttctag

SEQ ID NO: 583778 - DNA, 20 bp, mouse
gggccctcatgcctagcggt

SEQ ID NO: 583779 - DNA, 20 bp, mouse
gtctgtaacagcttcttcag

SEQ ID NO: 583780 - DNA, 20 bp, mouse
gcatgcctagcggtaggcac

SEQ ID NO: 583781 - DNA, 20 bp, mouse
ggaagctgttacagagtttt

SEQ ID NO: 583782 - DNA, 20 bp, mouse
ggagttttgggttgataggc

SEQ ID NO: 583783 - DNA, 20 bp, mouse
gtccttgggggaatctatag

SEQ ID NO: 583784 - DNA, 20 bp, mouse
gctgacagctggtgcctgaa

SEQ ID NO: 583785 - DNA, 20 bp, mouse
gaaaatccttgcacgttcaa

SEQ ID NO: 583786 - DNA, 20 bp, mouse
gggaccaaggaccacaaggt

SEQ ID NO: 583787 - DNA, 20 bp, mouse
gaatatggccgacttgtatg

SEQ ID NO: 583788 - DNA, 20 bp, mouse
gaaagacatatgcaacattg

SEQ ID NO: 583789 - DNA, 20 bp, mouse
ggtcggccatattagagaga

SEQ ID NO: 583790 - DNA, 20 bp, mouse
ggccctgccttcagtctcac

SEQ ID NO: 583791 - DNA, 20 bp, mouse
gtggctgctaaaaagagagg

SEQ ID NO: 583792 - DNA, 20 bp, mouse
gtatttccatctctctaata

SEQ ID NO: 583793 - DNA, 20 bp, mouse
gtgagggaccaaggaccaca

SEQ ID NO: 583794 - DNA, 20 bp, mouse
ggtcagaagtgcagctgcag

SEQ ID NO: 583795 - DNA, 20 bp, mouse
gccttaggagcatgcagatg

SEQ ID NO: 583796 - DNA, 20 bp, mouse
gatctcagaacaggaagcgg

SEQ ID NO: 583797 - DNA, 20 bp, mouse
gtgaatctcagaacaggaag

SEQ ID NO: 583798 - DNA, 20 bp, mouse
gagcggaggcataagcagaa

SEQ ID NO: 583799 - DNA, 20 bp, mouse
gatctggtggctagattcta

SEQ ID NO: 583800 - DNA, 20 bp, mouse
gaggaatcacagctcaacaa

SEQ ID NO: 583801 - DNA, 20 bp, mouse
gatcagaaaacggccctgga

SEQ ID NO: 583802 - DNA, 20 bp, mouse
ggttttgtcagcttacctga

SEQ ID NO: 583803 - DNA, 20 bp, mouse
ggcatccaagatggttagaa

SEQ ID NO: 583804 - DNA, 20 bp, mouse
gattcctaaggctctccatc

SEQ ID NO: 583805 - DNA, 20 bp, mouse
gcaatacagactaggaatta

SEQ ID NO: 583806 - DNA, 20 bp, mouse
ggagctgcctgcgcatgtca

SEQ ID NO: 583807 - DNA, 20 bp, mouse
gatcaagccgcccctctcca

SEQ ID NO: 583808 - DNA, 20 bp, mouse
gcacgcctggtggacctcat

SEQ ID NO: 583809 - DNA, 20 bp, mouse
ggggtccatagcgaccaaag

SEQ ID NO: 583810 - DNA, 20 bp, mouse
gtggacctcatgggagcccg

SEQ ID NO: 583811 - DNA, 20 bp, mouse
gagcaacacattcagctagg

SEQ ID NO: 583812 - DNA, 20 bp, mouse
ggtgggactggcgatctcag

SEQ ID NO: 583813 - DNA, 20 bp, mouse
gtcttgtacacagcagcccc

SEQ ID NO: 583814 - DNA, 20 bp, mouse
gaagaggcgggagcttcggt

SEQ ID NO: 583815 - DNA, 20 bp, mouse
ggctgtgtacaagactgaag

SEQ ID NO: 583816 - DNA, 20 bp, mouse
ggaccaggggggaccagggt

SEQ ID NO: 583817 - DNA, 20 bp, mouse
ggtcagggaggtgggtgtcc

SEQ ID NO: 583818 - DNA, 20 bp, mouse
gcctgtgcatcagcacactc

SEQ ID NO: 583819 - DNA, 20 bp, mouse
ggggctcaggggccagaggg

SEQ ID NO: 583820 - DNA, 20 bp, mouse
ggtgggtgtcctggtcttgt

SEQ ID NO: 583821 - DNA, 20 bp, mouse
gcagcacactcaggtcttgc

SEQ ID NO: 583822 - DNA, 20 bp, mouse
ggtgctgatgcacaggacac

SEQ ID NO: 583823 - DNA, 20 bp, mouse
gggcatacacagtagaccca

SEQ ID NO: 583824 - DNA, 20 bp, mouse
gagagggtggtaggcaaaga

SEQ ID NO: 583825 - DNA, 20 bp, mouse
gcctgcccaggagttgggtc

SEQ ID NO: 583826 - DNA, 20 bp, mouse
ggcgagagagcgagacgagg

SEQ ID NO: 583827 - DNA, 20 bp, mouse
gtgcagccggctccaagagg

SEQ ID NO: 583828 - DNA, 20 bp, mouse
ggccgcgagagagcgagacg

SEQ ID NO: 583829 - DNA, 20 bp, mouse
gtcctgcagccggctccaag

SEQ ID NO: 583830 - DNA, 20 bp, mouse
gcgagacgagggggagacca

SEQ ID NO: 583831 - DNA, 20 bp, mouse
ggacgagggggagaccaagg

SEQ ID NO: 583832 - DNA, 20 bp, mouse
gaggaggagccggagctgaa

SEQ ID NO: 583833 - DNA, 20 bp, mouse
gtaagggtccggaggaagac

SEQ ID NO: 583834 - DNA, 20 bp, mouse
gaggagccggagctgaaggg

SEQ ID NO: 583835 - DNA, 20 bp, mouse
gcaggagccggggctggaag

SEQ ID NO: 583836 - DNA, 20 bp, mouse
gagcggcggagccgagacgg

SEQ ID NO: 583837 - DNA, 20 bp, mouse
gcggagcggcggagccgaga

SEQ ID NO: 583838 - DNA, 20 bp, mouse
gcgcgatccccacatcccac

SEQ ID NO: 583839 - DNA, 20 bp, mouse
gagacggcggcggcgcccgt

SEQ ID NO: 583840 - DNA, 20 bp, mouse
gggcggagccgagacggcgg

SEQ ID NO: 583841 - DNA, 20 bp, mouse
ggcagcgggcgcaggctcag

SEQ ID NO: 583842 - DNA, 20 bp, mouse
ggcggcggcggcggacagag

SEQ ID NO: 583843 - DNA, 20 bp, mouse
gcggcggcgcccgtgggatg

SEQ ID NO: 583844 - DNA, 20 bp, mouse
gatcggggaggaaagttggg

SEQ ID NO: 583845 - DNA, 20 bp, mouse
ggcgcggcgcgggctcggtt

SEQ ID NO: 583846 - DNA, 20 bp, mouse
gctgtctgtaggtggtctct

SEQ ID NO: 583847 - DNA, 20 bp, mouse
gttgctaggcatctgtctgt

SEQ ID NO: 583848 - DNA, 20 bp, mouse
gtcttctcagatctctacta

SEQ ID NO: 583849 - DNA, 20 bp, mouse
gaacagctacaaggcttgct

SEQ ID NO: 583850 - DNA, 20 bp, mouse
gctaggcatctgtctgtagg

SEQ ID NO: 583851 - DNA, 20 bp, mouse
gtgggtctgtggagctagcc

SEQ ID NO: 583852 - DNA, 20 bp, mouse
gtacggaggttgttgcaatg

SEQ ID NO: 583853 - DNA, 20 bp, mouse
ggacaagcccaggagagcaa

SEQ ID NO: 583854 - DNA, 20 bp, mouse
gtctcagatctctactacgg

SEQ ID NO: 583855 - DNA, 20 bp, mouse
gggaaacaaaaacagctaca

SEQ ID NO: 583856 - DNA, 20 bp, mouse
gtgcagaggcgccgaggctg

SEQ ID NO: 583857 - DNA, 20 bp, mouse
gcgcggggagcgctccaaga

SEQ ID NO: 583858 - DNA, 20 bp, mouse
gagaggcgccgaggctgcgg

SEQ ID NO: 583859 - DNA, 20 bp, mouse
gcaaagccccgggctgagag

SEQ ID NO: 583860 - DNA, 20 bp, mouse
gcctcggcgcctctgcagtc

SEQ ID NO: 583861 - DNA, 20 bp, mouse
gcggcgggcgggactgcggt

SEQ ID NO: 583862 - DNA, 20 bp, mouse
gactgcggtgggcgccatct

SEQ ID NO: 583863 - DNA, 20 bp, mouse
gcgctctgcggcaaagcccc

SEQ ID NO: 583864 - DNA, 20 bp, mouse
ggacgaccaggcaacctgga

SEQ ID NO: 583865 - DNA, 20 bp, mouse
gcctcccgggccccgcgcta

SEQ ID NO: 583866 - DNA, 20 bp, mouse
gacagtgggcaggattgaaa

SEQ ID NO: 583867 - DNA, 20 bp, mouse
ggcaggtgcactcaccgggt

SEQ ID NO: 583868 - DNA, 20 bp, mouse
gagctcagggagcatcgagg

SEQ ID NO: 583869 - DNA, 20 bp, mouse
gagagtcgcaattggagcgc

SEQ ID NO: 583870 - DNA, 20 bp, mouse
gccagaccagcctgcacagt

SEQ ID NO: 583871 - DNA, 20 bp, mouse
gagcgcaggctaggcctgca

SEQ ID NO: 583872 - DNA, 20 bp, mouse
gctaggagtccgggataccc

SEQ ID NO: 583873 - DNA, 20 bp, mouse
gaatccgcaggtgcactcac

SEQ ID NO: 583874 - DNA, 20 bp, mouse
gaccagcctgcacagtgggc

SEQ ID NO: 583875 - DNA, 20 bp, mouse
gcgacgcggttggcagccga

SEQ ID NO: 583876 - DNA, 20 bp, mouse
gagcagcgaagtaggcgtag

SEQ ID NO: 583877 - DNA, 20 bp, mouse
gcctaaaggagcagcgaagt

SEQ ID NO: 583878 - DNA, 20 bp, mouse
gcgatagtgtactctttcta

SEQ ID NO: 583879 - DNA, 20 bp, mouse
gtctggcgacatctagggga

SEQ ID NO: 583880 - DNA, 20 bp, mouse
gttaggggaccagaactgag

SEQ ID NO: 583881 - DNA, 20 bp, mouse
gtctttctacggtggcctaa

SEQ ID NO: 583882 - DNA, 20 bp, mouse
gaagaaaccggaagcagaga

SEQ ID NO: 583883 - DNA, 20 bp, mouse
gacggggctatgcagatcat

SEQ ID NO: 583884 - DNA, 20 bp, mouse
gtgcagatcatagggtagta

SEQ ID NO: 583885 - DNA, 20 bp, mouse
gttgctctggcgacatctag

SEQ ID NO: 583886 - DNA, 20 bp, mouse
gtctctgcctcggggaccgt

SEQ ID NO: 583887 - DNA, 20 bp, mouse
gctgctcccggctccaggtg

SEQ ID NO: 583888 - DNA, 20 bp, mouse
gctgcaacccacggtccccg

SEQ ID NO: 583889 - DNA, 20 bp, mouse
gggagtcagctgggccaaga

SEQ ID NO: 583890 - DNA, 20 bp, mouse
gtgcctgctgtggagaccca

SEQ ID NO: 583891 - DNA, 20 bp, mouse
ggcccagccacacctggagc

SEQ ID NO: 583892 - DNA, 20 bp, mouse
ggtcggccacgggcaaggat

SEQ ID NO: 583893 - DNA, 20 bp, mouse
gccggagagtcaaacagtcc

SEQ ID NO: 583894 - DNA, 20 bp, mouse
gtacctccttctctgcctcg

SEQ ID NO: 583895 - DNA, 20 bp, mouse
gagcctagagaagaggaccc

SEQ ID NO: 583896 - DNA, 20 bp, mouse
ggtgatggcagctaaggtgg

SEQ ID NO: 583897 - DNA, 20 bp, mouse
gagctgccatcacctcacac

SEQ ID NO: 583898 - DNA, 20 bp, mouse
ggaggtgatggcagctaagg

SEQ ID NO: 583899 - DNA, 20 bp, mouse
gtaaggtggtggcgtccgag

SEQ ID NO: 583900 - DNA, 20 bp, mouse
gctggagcagcttcctaaac

SEQ ID NO: 583901 - DNA, 20 bp, mouse
ggtcgctgtcatacctgttt

SEQ ID NO: 583902 - DNA, 20 bp, mouse
gcccgcagtagcaagcatgg

SEQ ID NO: 583903 - DNA, 20 bp, mouse
gctagggacgcaggaagaca

SEQ ID NO: 583904 - DNA, 20 bp, mouse
gagtgggactggacctgcta

SEQ ID NO: 583905 - DNA, 20 bp, mouse
gttgctactgcggggacagt

SEQ ID NO: 583906 - DNA, 20 bp, mouse
ggcgtctccagactgtacac

SEQ ID NO: 583907 - DNA, 20 bp, mouse
gggctggcctgtgtacagtc

SEQ ID NO: 583908 - DNA, 20 bp, mouse
ggaatcgaactgacccgacg

SEQ ID NO: 583909 - DNA, 20 bp, mouse
gcttacctttctgaactgaa

SEQ ID NO: 583910 - DNA, 20 bp, mouse
ggtgacccttcagttcagaa

SEQ ID NO: 583911 - DNA, 20 bp, mouse
gtgaactgaagggtcacggc

SEQ ID NO: 583912 - DNA, 20 bp, mouse
ggactgcagcgagtcagtgg

SEQ ID NO: 583913 - DNA, 20 bp, mouse
ggaactgacccgacgcggct

SEQ ID NO: 583914 - DNA, 20 bp, mouse
gggagatgcttggctttatg

SEQ ID NO: 583915 - DNA, 20 bp, mouse
gatcgcaacgctgcagtcaa

SEQ ID NO: 583916 - DNA, 20 bp, mouse
ggcgcggtctcctaaactca

SEQ ID NO: 583917 - DNA, 20 bp, mouse
gtgtacgcgccgcagtggtg

SEQ ID NO: 583918 - DNA, 20 bp, mouse
gcactgcgacctcaccactg

SEQ ID NO: 583919 - DNA, 20 bp, mouse
gagctcgagcggaaatggag

SEQ ID NO: 583920 - DNA, 20 bp, mouse
ggcacttgtacgcgccgcag

SEQ ID NO: 583921 - DNA, 20 bp, mouse
gaggtggcccaaaggaggcg

SEQ ID NO: 583922 - DNA, 20 bp, mouse
gaaccgcgcggagggagagt

SEQ ID NO: 583923 - DNA, 20 bp, mouse
gccggtccggagcccaaggg

SEQ ID NO: 583924 - DNA, 20 bp, mouse
ggggccggtccggagcccaa

SEQ ID NO: 583925 - DNA, 20 bp, mouse
gcctgagcccatggccgcga

SEQ ID NO: 583926 - DNA, 20 bp, mouse
ggacactgagaacctactgg

SEQ ID NO: 583927 - DNA, 20 bp, mouse
gcaacaatgcctaagggaga

SEQ ID NO: 583928 - DNA, 20 bp, mouse
gagtgtccaccctctccctt

SEQ ID NO: 583929 - DNA, 20 bp, mouse
gcgcactcaacaatgcctaa

SEQ ID NO: 583930 - DNA, 20 bp, mouse
gcctggcacgtgcctccagt

SEQ ID NO: 583931 - DNA, 20 bp, mouse
ggccaggaccaggaaagatc

SEQ ID NO: 583932 - DNA, 20 bp, mouse
gtcacagcgggcgaccggaa

SEQ ID NO: 583933 - DNA, 20 bp, mouse
gccgaggtcgtgcagcacac

SEQ ID NO: 583934 - DNA, 20 bp, mouse
gggaggcacgtgccaggacc

SEQ ID NO: 583935 - DNA, 20 bp, mouse
ggaccaggaaagatcgggag

SEQ ID NO: 583936 - DNA, 20 bp, mouse
ggcgcttcagacgcaaggtg

SEQ ID NO: 583937 - DNA, 20 bp, mouse
gctcagtgggaagagcccgg

SEQ ID NO: 583938 - DNA, 20 bp, mouse
gaaggtgaggcggctcgggg

SEQ ID NO: 583939 - DNA, 20 bp, mouse
gcttcagacgcaaggtgagg

SEQ ID NO: 583940 - DNA, 20 bp, mouse
gcacgctccgtgggcgggaa

SEQ ID NO: 583941 - DNA, 20 bp, mouse
gagaccgccgaggccctgtg

SEQ ID NO: 583942 - DNA, 20 bp, mouse
gcgcaaggtgaggcggctcg

SEQ ID NO: 583943 - DNA, 20 bp, mouse
gtcccggcgcttcagacgca

SEQ ID NO: 583944 - DNA, 20 bp, mouse
gcggtcccatcgcaccccca

SEQ ID NO: 583945 - DNA, 20 bp, mouse
ggctccgtgggcgggaaggg

SEQ ID NO: 583946 - DNA, 20 bp, mouse
ggacggattgagcacagggg

SEQ ID NO: 583947 - DNA, 20 bp, mouse
gggattgagcacaggggagg

SEQ ID NO: 583948 - DNA, 20 bp, mouse
gatggacggattgagcacag

SEQ ID NO: 583949 - DNA, 20 bp, mouse
gcctcaagggtgaacacacg

SEQ ID NO: 583950 - DNA, 20 bp, mouse
gaagttctgggactactagg

SEQ ID NO: 583951 - DNA, 20 bp, mouse
ggtctgagcgtccatccaca

SEQ ID NO: 583952 - DNA, 20 bp, mouse
gctcatgagcaatgccagcg

SEQ ID NO: 583953 - DNA, 20 bp, mouse
gatctgatgaatgtaaccat

SEQ ID NO: 583954 - DNA, 20 bp, mouse
gctgatagccacggttccca

SEQ ID NO: 583955 - DNA, 20 bp, mouse
gtctgtaataaaggcaatag

SEQ ID NO: 583956 - DNA, 20 bp, mouse
gggcggggccgcagcgtcag

SEQ ID NO: 583957 - DNA, 20 bp, mouse
gagttacgggaaccgaccgg

SEQ ID NO: 583958 - DNA, 20 bp, mouse
gtacgggaaccgaccggagg

SEQ ID NO: 583959 - DNA, 20 bp, mouse
ggaaccgaccggaggaggca

SEQ ID NO: 583960 - DNA, 20 bp, mouse
gccgagttacgggaaccgac

SEQ ID NO: 583961 - DNA, 20 bp, mouse
gtcccaaccccaggcgtcgg

SEQ ID NO: 583962 - DNA, 20 bp, mouse
gctaccctgcctcctccggt

SEQ ID NO: 583963 - DNA, 20 bp, mouse
gcaggggcggggccgagtta

SEQ ID NO: 583964 - DNA, 20 bp, mouse
gctccagagaggcgacctga

SEQ ID NO: 583965 - DNA, 20 bp, mouse
gtgcagaaccaaagccgggt

SEQ ID NO: 583966 - DNA, 20 bp, mouse
ggaagatcaaagcaggggat

SEQ ID NO: 583967 - DNA, 20 bp, mouse
gtgcggcagtgccgactctg

SEQ ID NO: 583968 - DNA, 20 bp, mouse
gctcaagcgaagatcaaagc

SEQ ID NO: 583969 - DNA, 20 bp, mouse
gtcttcacagagttagttgt

SEQ ID NO: 583970 - DNA, 20 bp, mouse
gtgatcttcgcttgaggatc

SEQ ID NO: 583971 - DNA, 20 bp, mouse
gctggcaagtttaaagtgag

SEQ ID NO: 583972 - DNA, 20 bp, mouse
gaaagaagtgggagcccaac

SEQ ID NO: 583973 - DNA, 20 bp, mouse
ggcaccattcttgaggtcaa

SEQ ID NO: 583974 - DNA, 20 bp, mouse
gtgatgaagacggtatctgc

SEQ ID NO: 583975 - DNA, 20 bp, mouse
ggacctcaagaatggtgccg

SEQ ID NO: 583976 - DNA, 20 bp, mouse
gcatcatggagctctcgcgg

SEQ ID NO: 583977 - DNA, 20 bp, mouse
gccgccgcaacatcagcaac

SEQ ID NO: 583978 - DNA, 20 bp, mouse
gctgcctgttgctgatgttg

SEQ ID NO: 583979 - DNA, 20 bp, mouse
ggaagcccagtaagaacgat

SEQ ID NO: 583980 - DNA, 20 bp, mouse
ggatctgtctcgtgcgactg

SEQ ID NO: 583981 - DNA, 20 bp, mouse
gtgcggcggggttttcatca

SEQ ID NO: 583982 - DNA, 20 bp, mouse
gtttcatcatggagctctcg

SEQ ID NO: 583983 - DNA, 20 bp, mouse
gagaaagacgcaccaacggt

SEQ ID NO: 583984 - DNA, 20 bp, mouse
gcgcgcaagccgtcacgcga

SEQ ID NO: 583985 - DNA, 20 bp, mouse
gtcactaggcagctaaccac

SEQ ID NO: 583986 - DNA, 20 bp, mouse
gactggggcagtctgggcaa

SEQ ID NO: 583987 - DNA, 20 bp, mouse
gccagactgccccagtgagc

SEQ ID NO: 583988 - DNA, 20 bp, mouse
gcatgctgaacagaggggaa

SEQ ID NO: 583989 - DNA, 20 bp, mouse
gaagtgtgcatgctgaacag

SEQ ID NO: 583990 - DNA, 20 bp, mouse
gcttcaatgctccagctcac

SEQ ID NO: 583991 - DNA, 20 bp, mouse
gcaacttagaagtgaataaa

SEQ ID NO: 583992 - DNA, 20 bp, mouse
gcaaatgtgggtgcttgact

SEQ ID NO: 583993 - DNA, 20 bp, mouse
gaggggaaaggcattaagat

SEQ ID NO: 583994 - DNA, 20 bp, mouse
gtcttttcagtgttattggc

SEQ ID NO: 583995 - DNA, 20 bp, mouse
gccaaaaagggtagcaaatg

SEQ ID NO: 583996 - DNA, 20 bp, mouse
gtgcgggcggatgagctgct

SEQ ID NO: 583997 - DNA, 20 bp, mouse
gcgggcagcggcggcggttc

SEQ ID NO: 583998 - DNA, 20 bp, mouse
ggcggcggcggttccggctg

SEQ ID NO: 583999 - DNA, 20 bp, mouse
ggctgctaggtgagcaggcc

SEQ ID NO: 584000 - DNA, 20 bp, mouse
gtacgagctgtaggctccga

SEQ ID NO: 584001 - DNA, 20 bp, mouse
ggcggctgggcggttgtcgc

SEQ ID NO: 584002 - DNA, 20 bp, mouse
ggatgagctgctaggtgagc

SEQ ID NO: 584003 - DNA, 20 bp, mouse
ggacccggcagcgctttctt

SEQ ID NO: 584004 - DNA, 20 bp, mouse
ggagctgtaggctccgacgg

SEQ ID NO: 584005 - DNA, 20 bp, mouse
gcagctgcgcgagctaccta

SEQ ID NO: 584006 - DNA, 20 bp, mouse
gttctgcgctacggatgcag

SEQ ID NO: 584007 - DNA, 20 bp, mouse
gccgtagcgcagaagaccgc

SEQ ID NO: 584008 - DNA, 20 bp, mouse
ggcgagtgtggaccagggaa

SEQ ID NO: 584009 - DNA, 20 bp, mouse
gcggctccagccgggtccaa

SEQ ID NO: 584010 - DNA, 20 bp, mouse
ggcctcgcgagtgtggacca

SEQ ID NO: 584011 - DNA, 20 bp, mouse
ggagccgcaggagccgccag

SEQ ID NO: 584012 - DNA, 20 bp, mouse
gaaatgtggtgacctcccag

SEQ ID NO: 584013 - DNA, 20 bp, mouse
gccagggaaggggagatcgg

SEQ ID NO: 584014 - DNA, 20 bp, mouse
gtggggcccagagcaccggg

SEQ ID NO: 584015 - DNA, 20 bp, mouse
gtgggaaaccggagcgccgg

SEQ ID NO: 584016 - DNA, 20 bp, mouse
gcctgtaagtcagcctggaa

SEQ ID NO: 584017 - DNA, 20 bp, mouse
gccaccggtggccaagactg

SEQ ID NO: 584018 - DNA, 20 bp, mouse
gggtcacctaccagagaacc

SEQ ID NO: 584019 - DNA, 20 bp, mouse
gtggacccaggttctctggt

SEQ ID NO: 584020 - DNA, 20 bp, mouse
gcagagagggtgagagaccg

SEQ ID NO: 584021 - DNA, 20 bp, mouse
gggaagaggcgcgtgaatgt

SEQ ID NO: 584022 - DNA, 20 bp, mouse
gttggagtcctagcccttcc

SEQ ID NO: 584023 - DNA, 20 bp, mouse
gcgcaggagcgtgggattct

SEQ ID NO: 584024 - DNA, 20 bp, mouse
gctgggagccggcttcaggt

SEQ ID NO: 584025 - DNA, 20 bp, mouse
ggtgagagaccgaggcactg

SEQ ID NO: 584026 - DNA, 20 bp, mouse
ggtccgcgcgtgcgcagcag

SEQ ID NO: 584027 - DNA, 20 bp, mouse
ggagcgagcatcgcgcacag

SEQ ID NO: 584028 - DNA, 20 bp, mouse
gcgcagcagaggtaagcttg

SEQ ID NO: 584029 - DNA, 20 bp, mouse
gcggaagagagcaagagggg

SEQ ID NO: 584030 - DNA, 20 bp, mouse
gttccggcagtcgcttctgg

SEQ ID NO: 584031 - DNA, 20 bp, mouse
gctgccggaagagagcaaga

SEQ ID NO: 584032 - DNA, 20 bp, mouse
gagccaccagaagcgactgc

SEQ ID NO: 584033 - DNA, 20 bp, mouse
gggcgttgccagaaagtgct

SEQ ID NO: 584034 - DNA, 20 bp, mouse
gctctctgcggggtcgcgag

SEQ ID NO: 584035 - DNA, 20 bp, mouse
gtacctctgctgcgcacgcg

SEQ ID NO: 584036 - DNA, 20 bp, mouse
gctcggcgggggtctctagg

SEQ ID NO: 584037 - DNA, 20 bp, mouse
ggagaacacgacagtagcag

SEQ ID NO: 584038 - DNA, 20 bp, mouse
ggtcctcggcgggggtctct

SEQ ID NO: 584039 - DNA, 20 bp, mouse
ggttctgcagtcagagcggg

SEQ ID NO: 584040 - DNA, 20 bp, mouse
ggcggggcgggggtcctcgg

SEQ ID NO: 584041 - DNA, 20 bp, mouse
gcggcgccccatgcccccgg

SEQ ID NO: 584042 - DNA, 20 bp, mouse
ggggcgggggtcctcggcgg

SEQ ID NO: 584043 - DNA, 20 bp, mouse
gattgttctgcagtcagagc

SEQ ID NO: 584044 - DNA, 20 bp, mouse
gcaggtggcccgcccctctc

SEQ ID NO: 584045 - DNA, 20 bp, mouse
gcggcgggcgggggtcctca

SEQ ID NO: 584046 - DNA, 20 bp, mouse
ggcggcggcgcgcacacagg

SEQ ID NO: 584047 - DNA, 20 bp, mouse
ggcggcggcggcgcgcacac

SEQ ID NO: 584048 - DNA, 20 bp, mouse
gtcttcaccaggaaggaacg

SEQ ID NO: 584049 - DNA, 20 bp, mouse
gagcggagggtccccaactt

SEQ ID NO: 584050 - DNA, 20 bp, mouse
gctgcagcagggaaccgcgg

SEQ ID NO: 584051 - DNA, 20 bp, mouse
gagcactggacagctcccag

SEQ ID NO: 584052 - DNA, 20 bp, mouse
gggtcctctggaagtcccgg

SEQ ID NO: 584053 - DNA, 20 bp, mouse
gtcccctgaaccggcggtgg

SEQ ID NO: 584054 - DNA, 20 bp, mouse
gcacgtaggcagtctccagg

SEQ ID NO: 584055 - DNA, 20 bp, mouse
gtcgggctcgggtgccgctc

SEQ ID NO: 584056 - DNA, 20 bp, mouse
gacagcagtagcatcggcgt

SEQ ID NO: 584057 - DNA, 20 bp, mouse
gcagcggaggctccatggtc

SEQ ID NO: 584058 - DNA, 20 bp, mouse
ggtagcatcggcgtgggcag

SEQ ID NO: 584059 - DNA, 20 bp, mouse
gcacacccagagcccgacca

SEQ ID NO: 584060 - DNA, 20 bp, mouse
gggaggtgcagggagcgcgg

SEQ ID NO: 584061 - DNA, 20 bp, mouse
gctcccaggtgagcagggtt

SEQ ID NO: 584062 - DNA, 20 bp, mouse
gggaccccaagacactcaga

SEQ ID NO: 584063 - DNA, 20 bp, mouse
gcctggcactgtcctgcaag

SEQ ID NO: 584064 - DNA, 20 bp, mouse
gaggctccatggtcgggctc

SEQ ID NO: 584065 - DNA, 20 bp, mouse
gctgggaggtgcagggagcg

SEQ ID NO: 584066 - DNA, 20 bp, mouse
gtgctgctccctgaaggagg

SEQ ID NO: 584067 - DNA, 20 bp, mouse
gggagcagcagtccctagcc

SEQ ID NO: 584068 - DNA, 20 bp, mouse
gcagtccctagcctggctgt

SEQ ID NO: 584069 - DNA, 20 bp, mouse
ggcctggctgtgggtctggt

SEQ ID NO: 584070 - DNA, 20 bp, mouse
ggggtctggtcggattgggt

SEQ ID NO: 584071 - DNA, 20 bp, mouse
gctgtgggtctggtcggatt

SEQ ID NO: 584072 - DNA, 20 bp, mouse
ggattgggtaggtccagcca

SEQ ID NO: 584073 - DNA, 20 bp, mouse
ggtccagccatggcttctct

SEQ ID NO: 584074 - DNA, 20 bp, mouse
gagcccagagaagccatggc

SEQ ID NO: 584075 - DNA, 20 bp, mouse
gcacaaaggggatcaacagt

SEQ ID NO: 584076 - DNA, 20 bp, mouse
ggacaggagcgctcgcggag

SEQ ID NO: 584077 - DNA, 20 bp, mouse
ggtaagcgcgaggacccagg

SEQ ID NO: 584078 - DNA, 20 bp, mouse
gctgggagccggagcggtag

SEQ ID NO: 584079 - DNA, 20 bp, mouse
gagcggagctcgctgcagac

SEQ ID NO: 584080 - DNA, 20 bp, mouse
gctgcagacaggagcgctcg

SEQ ID NO: 584081 - DNA, 20 bp, mouse
gccgcgtaggagatacccgg

SEQ ID NO: 584082 - DNA, 20 bp, mouse
gcgcgcgggcggctggtggg

SEQ ID NO: 584083 - DNA, 20 bp, mouse
gtggactgaggccccgggag

SEQ ID NO: 584084 - DNA, 20 bp, mouse
ggcgagctccgctaccgctc

SEQ ID NO: 584085 - DNA, 20 bp, mouse
gcgaggacccagggggatga

SEQ ID NO: 584086 - DNA, 20 bp, mouse
gagccgcgtagagcctgcgg

SEQ ID NO: 584087 - DNA, 20 bp, mouse
gtgccgccgcaggctctacg

SEQ ID NO: 584088 - DNA, 20 bp, mouse
gccgcaacccgcgaccccca

SEQ ID NO: 584089 - DNA, 20 bp, mouse
gtgcgctgcggctgccatgg

SEQ ID NO: 584090 - DNA, 20 bp, mouse
gctctccggatcgagagact

SEQ ID NO: 584091 - DNA, 20 bp, mouse
gtctacgcggctctgcgctg

SEQ ID NO: 584092 - DNA, 20 bp, mouse
gcctggcacggcgcaggaca

SEQ ID NO: 584093 - DNA, 20 bp, mouse
gcttcgatggcagggacaga

SEQ ID NO: 584094 - DNA, 20 bp, mouse
ggcggctgcacactcaccct

SEQ ID NO: 584095 - DNA, 20 bp, mouse
gtcaccaacgggccgtccga

SEQ ID NO: 584096 - DNA, 20 bp, mouse
gctcaggctacagctccccg

SEQ ID NO: 584097 - DNA, 20 bp, mouse
gccgggagacgagaaagcaa

SEQ ID NO: 584098 - DNA, 20 bp, mouse
gggcggggcccgagccacca

SEQ ID NO: 584099 - DNA, 20 bp, mouse
ggcgtcgggtgcgatagccc

SEQ ID NO: 584100 - DNA, 20 bp, mouse
gcactggccgaagagtcggg

SEQ ID NO: 584101 - DNA, 20 bp, mouse
ggctccccgcgggcgaagct

SEQ ID NO: 584102 - DNA, 20 bp, mouse
gagcgcgcggtggggaacgc

SEQ ID NO: 584103 - DNA, 20 bp, mouse
ggcgggcgaagctgggcgtc

SEQ ID NO: 584104 - DNA, 20 bp, mouse
gactggaaggcgccccgcgg

SEQ ID NO: 584105 - DNA, 20 bp, mouse
gaagctgcgcaaggtaaggg

SEQ ID NO: 584106 - DNA, 20 bp, mouse
gccgccaccgcggggcgcag

SEQ ID NO: 584107 - DNA, 20 bp, mouse
gctgtggggacctaaagagg

SEQ ID NO: 584108 - DNA, 20 bp, mouse
gggtacaggtagcgacccgg

SEQ ID NO: 584109 - DNA, 20 bp, mouse
gggcctgtggggacctaaag

SEQ ID NO: 584110 - DNA, 20 bp, mouse
gtgtcggaggatgaggaccg

SEQ ID NO: 584111 - DNA, 20 bp, mouse
gcctgaggtgagcccgctgt

SEQ ID NO: 584112 - DNA, 20 bp, mouse
gaccgcggaagcgagagctc

SEQ ID NO: 584113 - DNA, 20 bp, mouse
gggtcgctacctgtaccctg

SEQ ID NO: 584114 - DNA, 20 bp, mouse
ggaggtgagcccgctgtcgg

SEQ ID NO: 584115 - DNA, 20 bp, mouse
gcacatgtgcccgcctcacc

SEQ ID NO: 584116 - DNA, 20 bp, mouse
ggaggctcccgagcccgtgg

SEQ ID NO: 584117 - DNA, 20 bp, mouse
gggctcgggagcctccactc

SEQ ID NO: 584118 - DNA, 20 bp, mouse
gctcgggcggccggaggacc

SEQ ID NO: 584119 - DNA, 20 bp, mouse
ggtggaggctcccgagcccg

SEQ ID NO: 584120 - DNA, 20 bp, mouse
gaagtcccggaccgggtccc

SEQ ID NO: 584121 - DNA, 20 bp, mouse
gcagctcgaacgggaagtcc

SEQ ID NO: 584122 - DNA, 20 bp, mouse
ggctcccgagcccgtggcgg

SEQ ID NO: 584123 - DNA, 20 bp, mouse
gcgaagccggcatacatagt

SEQ ID NO: 584124 - DNA, 20 bp, mouse
gtggcggcgaccgagaatcc

SEQ ID NO: 584125 - DNA, 20 bp, mouse
gtggcgggcggaaggaccga

SEQ ID NO: 584126 - DNA, 20 bp, mouse
gagggaagaagagcacggta

SEQ ID NO: 584127 - DNA, 20 bp, mouse
gccgagatcgaggagtaaag

SEQ ID NO: 584128 - DNA, 20 bp, mouse
gcgcagccggctacctggag

SEQ ID NO: 584129 - DNA, 20 bp, mouse
gtcgaggagtaaagggggaa

SEQ ID NO: 584130 - DNA, 20 bp, mouse
gaagtgacgtcatgcaggag

SEQ ID NO: 584131 - DNA, 20 bp, mouse
ggggagggagcggatctcag

SEQ ID NO: 584132 - DNA, 20 bp, mouse
gcacagcccggaggcattga

SEQ ID NO: 584133 - DNA, 20 bp, mouse
gacgtcatgcaggagcgggc

SEQ ID NO: 584134 - DNA, 20 bp, mouse
gccgagcagtcacagcccgg

SEQ ID NO: 584135 - DNA, 20 bp, mouse
gccgcagaaccccgagatcg

SEQ ID NO: 584136 - DNA, 20 bp, mouse
ggccggagccgggtcctcgg

SEQ ID NO: 584137 - DNA, 20 bp, mouse
gcccgagacgccaggcacag

SEQ ID NO: 584138 - DNA, 20 bp, mouse
gctctccgagggcccggaag

SEQ ID NO: 584139 - DNA, 20 bp, mouse
gccacccacagacacccccg

SEQ ID NO: 584140 - DNA, 20 bp, mouse
gggctccggcggctctccga

SEQ ID NO: 584141 - DNA, 20 bp, mouse
gacccccgaggacccggctc

SEQ ID NO: 584142 - DNA, 20 bp, mouse
gtctgtgggtggaggagccg

SEQ ID NO: 584143 - DNA, 20 bp, mouse
ggggcaccccgaactccccg

SEQ ID NO: 584144 - DNA, 20 bp, mouse
gacagacacccccgaggacc

SEQ ID NO: 584145 - DNA, 20 bp, mouse
ggtggcgtcggaggaactga

SEQ ID NO: 584146 - DNA, 20 bp, mouse
gcccgggctgcgactgacag

SEQ ID NO: 584147 - DNA, 20 bp, mouse
ggggctgcgactgacagagg

SEQ ID NO: 584148 - DNA, 20 bp, mouse
gagtcgcagcccgggccccg

SEQ ID NO: 584149 - DNA, 20 bp, mouse
gcgcggcagcttagactcgt

SEQ ID NO: 584150 - DNA, 20 bp, mouse
gggacatggtggctgtgggt

SEQ ID NO: 584151 - DNA, 20 bp, mouse
gagcacaccggagcatcccg

SEQ ID NO: 584152 - DNA, 20 bp, mouse
gggcgggcggataaacccgg

SEQ ID NO: 584153 - DNA, 20 bp, mouse
gcaggcccccggaagcacac

SEQ ID NO: 584154 - DNA, 20 bp, mouse
gttccaagcactgctcgcca

SEQ ID NO: 584155 - DNA, 20 bp, mouse
ggacccgccggcctacgtgg

SEQ ID NO: 584156 - DNA, 20 bp, mouse
ggagacagagcctaacgcag

SEQ ID NO: 584157 - DNA, 20 bp, mouse
gagagcctaacgcagaggaa

SEQ ID NO: 584158 - DNA, 20 bp, mouse
ggagctccgcgggagaggtg

SEQ ID NO: 584159 - DNA, 20 bp, mouse
gcgggccacactcaccggga

SEQ ID NO: 584160 - DNA, 20 bp, mouse
ggaggaagggacctggcagt

SEQ ID NO: 584161 - DNA, 20 bp, mouse
ggtcgggagctgactccagc

SEQ ID NO: 584162 - DNA, 20 bp, mouse
ggagctcccgccgccggtct

SEQ ID NO: 584163 - DNA, 20 bp, mouse
gctggcccgcacctctcccg

SEQ ID NO: 584164 - DNA, 20 bp, mouse
gcgagggctgtaggtttcgc

SEQ ID NO: 584165 - DNA, 20 bp, mouse
gattataaggcggagctccg

SEQ ID NO: 584166 - DNA, 20 bp, mouse
gcggggacgcgcggtctgag

SEQ ID NO: 584167 - DNA, 20 bp, mouse
gctggagctccaggagtatc

SEQ ID NO: 584168 - DNA, 20 bp, mouse
gcgaaaggcgaacggcggcg

SEQ ID NO: 584169 - DNA, 20 bp, mouse
gcactctacagctagactgg

SEQ ID NO: 584170 - DNA, 20 bp, mouse
ggacgcgcggtctgaggggc

SEQ ID NO: 584171 - DNA, 20 bp, mouse
ggaagcagcaactctgggtt

SEQ ID NO: 584172 - DNA, 20 bp, mouse
gtctgaggggctggagctcc

SEQ ID NO: 584173 - DNA, 20 bp, mouse
gtcaagtttaggatgccgaa

SEQ ID NO: 584174 - DNA, 20 bp, mouse
gcctcgcgaagcagcaactc

SEQ ID NO: 584175 - DNA, 20 bp, mouse
gcagcactctacagctagac

SEQ ID NO: 584176 - DNA, 20 bp, mouse
ggcgccgcgggaccgcacag

SEQ ID NO: 584177 - DNA, 20 bp, mouse
gcgcggctccgcgcccacag

SEQ ID NO: 584178 - DNA, 20 bp, mouse
gggcggcccgggcttcatgg

SEQ ID NO: 584179 - DNA, 20 bp, mouse
gcagcccgcgccgcgaacaa

SEQ ID NO: 584180 - DNA, 20 bp, mouse
ggaggggaccccatgagacc

SEQ ID NO: 584181 - DNA, 20 bp, mouse
gctgcgggcgcggccgctgt

SEQ ID NO: 584182 - DNA, 20 bp, mouse
gtgagtgatgggccccaaga

SEQ ID NO: 584183 - DNA, 20 bp, mouse
ggccccgggcgcatgggtgg

SEQ ID NO: 584184 - DNA, 20 bp, mouse
ggcgagcgaacgaacgagcg

SEQ ID NO: 584185 - DNA, 20 bp, mouse
gccgcgggccccgggcgcat

SEQ ID NO: 584186 - DNA, 20 bp, mouse
ggaccaaggggaagcctccg

SEQ ID NO: 584187 - DNA, 20 bp, mouse
gagcaggcaggcaggcgcca

SEQ ID NO: 584188 - DNA, 20 bp, mouse
gagcagcggcgcaagcaggc

SEQ ID NO: 584189 - DNA, 20 bp, mouse
gcgactctccggggaccaag

SEQ ID NO: 584190 - DNA, 20 bp, mouse
gccctctggacgccgagaca

SEQ ID NO: 584191 - DNA, 20 bp, mouse
ggggctgctgcctataagaa

SEQ ID NO: 584192 - DNA, 20 bp, mouse
gcagcagcagcggcgcaagc

SEQ ID NO: 584193 - DNA, 20 bp, mouse
gcggcgcgtggaagagtctc

SEQ ID NO: 584194 - DNA, 20 bp, mouse
ggcaaaccagtggcccggag

SEQ ID NO: 584195 - DNA, 20 bp, mouse
gccggatcccgggatttgag

SEQ ID NO: 584196 - DNA, 20 bp, mouse
ggacggaccggaggtgacaa

SEQ ID NO: 584197 - DNA, 20 bp, mouse
gcggccactcacctgccccg

SEQ ID NO: 584198 - DNA, 20 bp, mouse
gcccgggccccggcaggtct

SEQ ID NO: 584199 - DNA, 20 bp, mouse
gcactcggtggcgtcctcag

SEQ ID NO: 584200 - DNA, 20 bp, mouse
ggcagggcgcgacggaccgg

SEQ ID NO: 584201 - DNA, 20 bp, mouse
gacccggccagacccacccg

SEQ ID NO: 584202 - DNA, 20 bp, mouse
ggcaggagcggcgcggtcct

SEQ ID NO: 584203 - DNA, 20 bp, mouse
gccagctccgagacctgccg

SEQ ID NO: 584204 - DNA, 20 bp, mouse
gcagggcgggccccgaggtt

SEQ ID NO: 584205 - DNA, 20 bp, mouse
gctggcagggcgcgacggac

SEQ ID NO: 584206 - DNA, 20 bp, mouse
gtggagaagaggacagcgtg

SEQ ID NO: 584207 - DNA, 20 bp, mouse
gaggtaagaacagtccgtat

SEQ ID NO: 584208 - DNA, 20 bp, mouse
gtcctctatcccagccgata

SEQ ID NO: 584209 - DNA, 20 bp, mouse
gaggaacccaactgggacac

SEQ ID NO: 584210 - DNA, 20 bp, mouse
gcctgccagggagcagaaaa

SEQ ID NO: 584211 - DNA, 20 bp, mouse
gtccgtatcggctgggatag

SEQ ID NO: 584212 - DNA, 20 bp, mouse
gctgtcttctaggacttcct

SEQ ID NO: 584213 - DNA, 20 bp, mouse
gagaccctggagggctcatg

SEQ ID NO: 584214 - DNA, 20 bp, mouse
gcccagagcaggaacccaac

SEQ ID NO: 584215 - DNA, 20 bp, mouse
gtctgctccctggcagggtt

SEQ ID NO: 584216 - DNA, 20 bp, mouse
gcggcccgccgagccggatg

SEQ ID NO: 584217 - DNA, 20 bp, mouse
gtggcccgcaaggcagtcgc

SEQ ID NO: 584218 - DNA, 20 bp, mouse
ggttagggcgcggcgatgtc

SEQ ID NO: 584219 - DNA, 20 bp, mouse
ggcgctcacagtctagctgg

SEQ ID NO: 584220 - DNA, 20 bp, mouse
ggactgccttgcgggccatg

SEQ ID NO: 584221 - DNA, 20 bp, mouse
gtccgcgtccgcgatagagg

SEQ ID NO: 584222 - DNA, 20 bp, mouse
ggcccctgcctcatccggct

SEQ ID NO: 584223 - DNA, 20 bp, mouse
gccgcggccgggttagggcg

SEQ ID NO: 584224 - DNA, 20 bp, mouse
gtggcttcggtaggagacac

SEQ ID NO: 584225 - DNA, 20 bp, mouse
gctgtaagcgacaacgagag

SEQ ID NO: 584226 - DNA, 20 bp, mouse
ggctaggcctgtcctcggag

SEQ ID NO: 584227 - DNA, 20 bp, mouse
gtatccagtgcacccctccg

SEQ ID NO: 584228 - DNA, 20 bp, mouse
gccagcgctaggcctgtcct

SEQ ID NO: 584229 - DNA, 20 bp, mouse
gggcctagcgctggggatga

SEQ ID NO: 584230 - DNA, 20 bp, mouse
gagtgcacccctccgaggac

SEQ ID NO: 584231 - DNA, 20 bp, mouse
ggtggtacctaagagctact

SEQ ID NO: 584232 - DNA, 20 bp, mouse
gcctgtcgctgctgtcacta

SEQ ID NO: 584233 - DNA, 20 bp, mouse
gaggtaccacgggcaatagt

SEQ ID NO: 584234 - DNA, 20 bp, mouse
gtcgccatggggtcagagat

SEQ ID NO: 584235 - DNA, 20 bp, mouse
ggctactaggcactgagatt

SEQ ID NO: 584236 - DNA, 20 bp, mouse
gccgtcaccagacgaaatgg

SEQ ID NO: 584237 - DNA, 20 bp, mouse
gcgcacggagcacccaaccg

SEQ ID NO: 584238 - DNA, 20 bp, mouse
gtcaccagacgaaatggcgg

SEQ ID NO: 584239 - DNA, 20 bp, mouse
ggttccgtcaccagacgaaa

SEQ ID NO: 584240 - DNA, 20 bp, mouse
gagcacccaaccgaggcaca

SEQ ID NO: 584241 - DNA, 20 bp, mouse
gcacggcagcgccttccaca

SEQ ID NO: 584242 - DNA, 20 bp, mouse
ggacgaaatggcggaggctg

SEQ ID NO: 584243 - DNA, 20 bp, mouse
gagtgcctgtcgcagtccag

SEQ ID NO: 584244 - DNA, 20 bp, mouse
gcgccttccacacggtaccg

SEQ ID NO: 584245 - DNA, 20 bp, mouse
gtcgcggccccggtaccgtg

SEQ ID NO: 584246 - DNA, 20 bp, mouse
gggccgggtgagcctagaag

SEQ ID NO: 584247 - DNA, 20 bp, mouse
gctaggcagcccacccagag

SEQ ID NO: 584248 - DNA, 20 bp, mouse
ggctgtgggagcgtccaaca

SEQ ID NO: 584249 - DNA, 20 bp, mouse
ggcggggcctcggagtctga

SEQ ID NO: 584250 - DNA, 20 bp, mouse
gtgtcgcttctgttgttggg

SEQ ID NO: 584251 - DNA, 20 bp, mouse
gcaagtaacgacagccatgt

SEQ ID NO: 584252 - DNA, 20 bp, mouse
gtgtactgggtgctctgtgg

SEQ ID NO: 584253 - DNA, 20 bp, mouse
ggtattgagtagcttcacca

SEQ ID NO: 584254 - DNA, 20 bp, mouse
ggggactcaccgctctgggt

SEQ ID NO: 584255 - DNA, 20 bp, mouse
gtcttgtcgcttctgttgtt

SEQ ID NO: 584256 - DNA, 20 bp, mouse
gggccggctggcgggatgtg

SEQ ID NO: 584257 - DNA, 20 bp, mouse
ggtctagagcagctggaacc

SEQ ID NO: 584258 - DNA, 20 bp, mouse
gtggccccgctaccctgccc

SEQ ID NO: 584259 - DNA, 20 bp, mouse
gggatgtggggcgcgagccg

SEQ ID NO: 584260 - DNA, 20 bp, mouse
ggattggccgctgttgagga

SEQ ID NO: 584261 - DNA, 20 bp, mouse
gcaggccagaccctaagtac

SEQ ID NO: 584262 - DNA, 20 bp, mouse
gctctgacagcgccctccca

SEQ ID NO: 584263 - DNA, 20 bp, mouse
ggttgaggacggaagcgcag

SEQ ID NO: 584264 - DNA, 20 bp, mouse
gggcggagggcttagagact

SEQ ID NO: 584265 - DNA, 20 bp, mouse
gtggggcgcgagccggggca

SEQ ID NO: 584266 - DNA, 20 bp, mouse
gagggacccctcactcaccc

SEQ ID NO: 584267 - DNA, 20 bp, mouse
gcagaagccggggtgagtga

SEQ ID NO: 584268 - DNA, 20 bp, mouse
gcttggcgggcgcccagacc

SEQ ID NO: 584269 - DNA, 20 bp, mouse
gccccttcccggaagaaaga

SEQ ID NO: 584270 - DNA, 20 bp, mouse
gagttctgcgtaagacttgg

SEQ ID NO: 584271 - DNA, 20 bp, mouse
gcactgccgcgggggatctg

SEQ ID NO: 584272 - DNA, 20 bp, mouse
gcttctgatgcgccgggtct

SEQ ID NO: 584273 - DNA, 20 bp, mouse
gcttacgcagaactcggctc

SEQ ID NO: 584274 - DNA, 20 bp, mouse
gccgagttctgcgtaagact

SEQ ID NO: 584275 - DNA, 20 bp, mouse
gccgagcctcagatcccccg

SEQ ID NO: 584276 - DNA, 20 bp, mouse
ggcttgcgggaaggcagaca

SEQ ID NO: 584277 - DNA, 20 bp, mouse
gaggcagacatggccggggt

SEQ ID NO: 584278 - DNA, 20 bp, mouse
gcggcgcttggcgttaactg

SEQ ID NO: 584279 - DNA, 20 bp, mouse
gcgcttggcgttaactgggg

SEQ ID NO: 584280 - DNA, 20 bp, mouse
ggtcgctggggcttgcggga

SEQ ID NO: 584281 - DNA, 20 bp, mouse
ggggaaggcagacatggccg

SEQ ID NO: 584282 - DNA, 20 bp, mouse
gcggggttggcgcagtttcg

SEQ ID NO: 584283 - DNA, 20 bp, mouse
gcagtttcgaggcttcttcg

SEQ ID NO: 584284 - DNA, 20 bp, mouse
gttcgaggcttcttcgcggg

SEQ ID NO: 584285 - DNA, 20 bp, mouse
gcctagcgcctgccatttcg

SEQ ID NO: 584286 - DNA, 20 bp, mouse
gcccggcgcgcagcagctcg

SEQ ID NO: 584287 - DNA, 20 bp, mouse
gctgggccggctcatgaccg

SEQ ID NO: 584288 - DNA, 20 bp, mouse
ggcgcagcagctcgcggtac

SEQ ID NO: 584289 - DNA, 20 bp, mouse
gccggcccagccggttgcag

SEQ ID NO: 584290 - DNA, 20 bp, mouse
gtcgcggtgaggccccacac

SEQ ID NO: 584291 - DNA, 20 bp, mouse
gcgacgccgcggtcatgagc

SEQ ID NO: 584292 - DNA, 20 bp, mouse
ggggcgcacgaaggtaccca

SEQ ID NO: 584293 - DNA, 20 bp, mouse
gcttgcctctgcaaccggct

SEQ ID NO: 584294 - DNA, 20 bp, mouse
gtcatccagcctggtccccg

SEQ ID NO: 584295 - DNA, 20 bp, mouse
gggagacgcgatccgatgga

SEQ ID NO: 584296 - DNA, 20 bp, mouse
gcgcgccagcgtcgggatca

SEQ ID NO: 584297 - DNA, 20 bp, mouse
gtctcactcgagcacaccgt

SEQ ID NO: 584298 - DNA, 20 bp, mouse
gggctggagccgatcatgca

SEQ ID NO: 584299 - DNA, 20 bp, mouse
gccagggaatggtcccctca

SEQ ID NO: 584300 - DNA, 20 bp, mouse
gcacttccgggaattccggg

SEQ ID NO: 584301 - DNA, 20 bp, mouse
gagtctccacggcacagagg

SEQ ID NO: 584302 - DNA, 20 bp, mouse
gtctcacccgcgccagcgtc

SEQ ID NO: 584303 - DNA, 20 bp, mouse
ggtcgatctgaggacttcag

SEQ ID NO: 584304 - DNA, 20 bp, mouse
gctgcagcccgccccgaacc

SEQ ID NO: 584305 - DNA, 20 bp, mouse
ggatctgaggacttcagcgg

SEQ ID NO: 584306 - DNA, 20 bp, mouse
gaggccgactctgccgagaa

SEQ ID NO: 584307 - DNA, 20 bp, mouse
gacgtcaggagccaaaatgg

SEQ ID NO: 584308 - DNA, 20 bp, mouse
gaaggggtggggctgacgtc

SEQ ID NO: 584309 - DNA, 20 bp, mouse
ggcttcccggctgccgttct

SEQ ID NO: 584310 - DNA, 20 bp, mouse
gaaaatggcggcgacggtcg

SEQ ID NO: 584311 - DNA, 20 bp, mouse
ggcccgggtccaggcctcgg

SEQ ID NO: 584312 - DNA, 20 bp, mouse
ggccgggaagccgcgcttca

SEQ ID NO: 584313 - DNA, 20 bp, mouse
gacggctccccactgaacca

SEQ ID NO: 584314 - DNA, 20 bp, mouse
gggagccaaaatggcggcga

SEQ ID NO: 584315 - DNA, 20 bp, mouse
gtagagaggccgcggagagg

SEQ ID NO: 584316 - DNA, 20 bp, mouse
gccggcggagaggctcggaa

SEQ ID NO: 584317 - DNA, 20 bp, mouse
ggatggctgcgttcttgctg

SEQ ID NO: 584318 - DNA, 20 bp, mouse
gggcgtggactcctagcccc

SEQ ID NO: 584319 - DNA, 20 bp, mouse
gctaattcaggttcccccaa

SEQ ID NO: 584320 - DNA, 20 bp, mouse
gctccgccgggggagaagag

SEQ ID NO: 584321 - DNA, 20 bp, mouse
gtcgaagaggctttagaggt

SEQ ID NO: 584322 - DNA, 20 bp, mouse
gcaggttcccccaacggtcg

SEQ ID NO: 584323 - DNA, 20 bp, mouse
gccacgcccgcgaccgttgg

SEQ ID NO: 584324 - DNA, 20 bp, mouse
ggccatcttgagttccggcc

SEQ ID NO: 584325 - DNA, 20 bp, mouse
gccccctcagggactaattc

SEQ ID NO: 584326 - DNA, 20 bp, mouse
ggccctcgaaagcgacatgg

SEQ ID NO: 584327 - DNA, 20 bp, mouse
ggcagtggccaaggagctcg

SEQ ID NO: 584328 - DNA, 20 bp, mouse
gtgagccctcgaaagcgaca

SEQ ID NO: 584329 - DNA, 20 bp, mouse
gcctcgaggcaccacctatg

SEQ ID NO: 584330 - DNA, 20 bp, mouse
gggtggtgggacgtcttgag

SEQ ID NO: 584331 - DNA, 20 bp, mouse
gcccgcgtaaaagaacggtg

SEQ ID NO: 584332 - DNA, 20 bp, mouse
ggaggtgtcttggccatcaa

SEQ ID NO: 584333 - DNA, 20 bp, mouse
ggcgttctctgcagtggcca

SEQ ID NO: 584334 - DNA, 20 bp, mouse
ggccccgtgactgctcccga

SEQ ID NO: 584335 - DNA, 20 bp, mouse
gacctgaagcgtgaaccgga

SEQ ID NO: 584336 - DNA, 20 bp, mouse
ggccccgcagcgctctgtga

SEQ ID NO: 584337 - DNA, 20 bp, mouse
gggagcgcgcagacccgctg

SEQ ID NO: 584338 - DNA, 20 bp, mouse
ggctgtgcggctgcgaggag

SEQ ID NO: 584339 - DNA, 20 bp, mouse
gccgcggagccgccaccccc

SEQ ID NO: 584340 - DNA, 20 bp, mouse
gtgagcagcgagccgggtcg

SEQ ID NO: 584341 - DNA, 20 bp, mouse
gtgggcactcggggtcgcag

SEQ ID NO: 584342 - DNA, 20 bp, mouse
gctcccctcacagagcgctg

SEQ ID NO: 584343 - DNA, 20 bp, mouse
ggaccgccgagacacccccg

SEQ ID NO: 584344 - DNA, 20 bp, mouse
ggcgctcgccgctgcctcag

SEQ ID NO: 584345 - DNA, 20 bp, mouse
ggtcgcagtggtgaccggtc

SEQ ID NO: 584346 - DNA, 20 bp, mouse
gtcggcgcaggcagactctc

SEQ ID NO: 584347 - DNA, 20 bp, mouse
gatcctgaggaggagaccgg

SEQ ID NO: 584348 - DNA, 20 bp, mouse
gaggcagctgctgccgaggt

SEQ ID NO: 584349 - DNA, 20 bp, mouse
gccgggcagcccagagctcc

SEQ ID NO: 584350 - DNA, 20 bp, mouse
gccgcagctggcgcagacat

SEQ ID NO: 584351 - DNA, 20 bp, mouse
ggactcagactacgtctcat

SEQ ID NO: 584352 - DNA, 20 bp, mouse
ggcctgctgctcgcccacct

SEQ ID NO: 584353 - DNA, 20 bp, mouse
gccgagctccatcccgggtg

SEQ ID NO: 584354 - DNA, 20 bp, mouse
gcgaccaggccggatcgcag

SEQ ID NO: 584355 - DNA, 20 bp, mouse
gggagcagccgtggagactc

SEQ ID NO: 584356 - DNA, 20 bp, mouse
gaagtgagcactgctctcta

SEQ ID NO: 584357 - DNA, 20 bp, mouse
gtgctctctagggctagcag

SEQ ID NO: 584358 - DNA, 20 bp, mouse
gagaagcacaggaggctggt

SEQ ID NO: 584359 - DNA, 20 bp, mouse
gttcaggctggggctcggtg

SEQ ID NO: 584360 - DNA, 20 bp, mouse
ggagccccagcctgaacctg

SEQ ID NO: 584361 - DNA, 20 bp, mouse
gtcggtgtggaggaaggcat

SEQ ID NO: 584362 - DNA, 20 bp, mouse
gggaccccaggttcaggctg

SEQ ID NO: 584363 - DNA, 20 bp, mouse
gagcgtcagatcaacctgga

SEQ ID NO: 584364 - DNA, 20 bp, mouse
gagcgtcctctcccatggct

SEQ ID NO: 584365 - DNA, 20 bp, mouse
gagggagaaccagcacaaca

SEQ ID NO: 584366 - DNA, 20 bp, mouse
gcctcaggcacccaagtccc

SEQ ID NO: 584367 - DNA, 20 bp, mouse
ggtggagaagcaggcgtctt

SEQ ID NO: 584368 - DNA, 20 bp, mouse
ggctgcttaaccagggactt

SEQ ID NO: 584369 - DNA, 20 bp, mouse
ggaaccttgctgcttaacca

SEQ ID NO: 584370 - DNA, 20 bp, mouse
ggacgcctgcttctccaccg

SEQ ID NO: 584371 - DNA, 20 bp, mouse
gagcaggcgtcttaggcctc

SEQ ID NO: 584372 - DNA, 20 bp, mouse
gagggctgctcctagagtgg

SEQ ID NO: 584373 - DNA, 20 bp, mouse
ggcggagatcccacattcta

SEQ ID NO: 584374 - DNA, 20 bp, mouse
gcagatgtctatgcctccaa

SEQ ID NO: 584375 - DNA, 20 bp, mouse
gaccgtggtgccaccactct

SEQ ID NO: 584376 - DNA, 20 bp, mouse
gcaagaaaggagttaaaggt

SEQ ID NO: 584377 - DNA, 20 bp, mouse
gcatgaagggaagtcaagaa

SEQ ID NO: 584378 - DNA, 20 bp, mouse
ggataagcaaactaagactt

SEQ ID NO: 584379 - DNA, 20 bp, mouse
ggatactgtgattgataggt

SEQ ID NO: 584380 - DNA, 20 bp, mouse
gttcagatactgtgattgat

SEQ ID NO: 584381 - DNA, 20 bp, mouse
gaatcacagtatctgaaaat

SEQ ID NO: 584382 - DNA, 20 bp, mouse
ggataaaggtcacaagcaaa

SEQ ID NO: 584383 - DNA, 20 bp, mouse
gtaagaatagctttgtagtt

SEQ ID NO: 584384 - DNA, 20 bp, mouse
gagtcagcagtactcgtcca

SEQ ID NO: 584385 - DNA, 20 bp, mouse
gggttacagtccgtcatgaa

SEQ ID NO: 584386 - DNA, 20 bp, mouse
gtgcgggtgcttgtaggtga

SEQ ID NO: 584387 - DNA, 20 bp, mouse
gtcgctatgcgggtgcttgt

SEQ ID NO: 584388 - DNA, 20 bp, mouse
gaagcacccgcatagcgaca

SEQ ID NO: 584389 - DNA, 20 bp, mouse
gtgagggagggcagagtggc

SEQ ID NO: 584390 - DNA, 20 bp, mouse
gagaggcctgatgtcagatg

SEQ ID NO: 584391 - DNA, 20 bp, mouse
gttaggagactgcaccctgt

SEQ ID NO: 584392 - DNA, 20 bp, mouse
gtctcggctacagcctaagc

SEQ ID NO: 584393 - DNA, 20 bp, mouse
gggcccgggtcgaatcacgt

SEQ ID NO: 584394 - DNA, 20 bp, mouse
gcagagtggcgggccggctt

SEQ ID NO: 584395 - DNA, 20 bp, mouse
gccgtaacccagctgctgag

SEQ ID NO: 584396 - DNA, 20 bp, mouse
gcccagaatagggaccccgt

SEQ ID NO: 584397 - DNA, 20 bp, mouse
ggagtggtctggggtcgcaa

SEQ ID NO: 584398 - DNA, 20 bp, mouse
gacagaggcagacgacagcg

SEQ ID NO: 584399 - DNA, 20 bp, mouse
ggggggcagcaaggcaccag

SEQ ID NO: 584400 - DNA, 20 bp, mouse
ggccctgccatcccagaata

SEQ ID NO: 584401 - DNA, 20 bp, mouse
gtgcctctgtgagtggtctg

SEQ ID NO: 584402 - DNA, 20 bp, mouse
gtgtcgtctgcctctgtgag

SEQ ID NO: 584403 - DNA, 20 bp, mouse
gaagggctgtcgtcacccac

SEQ ID NO: 584404 - DNA, 20 bp, mouse
ggtccattgagggtaacagg

SEQ ID NO: 584405 - DNA, 20 bp, mouse
gagcaagacgaaagagcctc

SEQ ID NO: 584406 - DNA, 20 bp, mouse
ggcagcccacaggaacccac

SEQ ID NO: 584407 - DNA, 20 bp, mouse
gacccaggagatggtaggat

SEQ ID NO: 584408 - DNA, 20 bp, mouse
ggatggacccaggagatggt

SEQ ID NO: 584409 - DNA, 20 bp, mouse
gagaagctctcctttcctgt

SEQ ID NO: 584410 - DNA, 20 bp, mouse
gtgagacttgcaacagatac

SEQ ID NO: 584411 - DNA, 20 bp, mouse
gcaagtgggcgagcaaggtg

SEQ ID NO: 584412 - DNA, 20 bp, mouse
gaccaagtcggagaacgtca

SEQ ID NO: 584413 - DNA, 20 bp, mouse
gcgtcaaggaagcagcccag

SEQ ID NO: 584414 - DNA, 20 bp, mouse
gcagtgggtgagggaccaag

SEQ ID NO: 584415 - DNA, 20 bp, mouse
gaggaaggtctgcagctggt

SEQ ID NO: 584416 - DNA, 20 bp, mouse
gcacctgcccaggcttccgt

SEQ ID NO: 584417 - DNA, 20 bp, mouse
ggcccagtggtcccaacgaa

SEQ ID NO: 584418 - DNA, 20 bp, mouse
gggcccctggagctttctca

SEQ ID NO: 584419 - DNA, 20 bp, mouse
ggccgtgtggctatattcgg

SEQ ID NO: 584420 - DNA, 20 bp, mouse
ggatatgctcaagggtgctg

SEQ ID NO: 584421 - DNA, 20 bp, mouse
gagtgagcagatatgctcaa

SEQ ID NO: 584422 - DNA, 20 bp, mouse
ggtgtgctgttcacctgccc

SEQ ID NO: 584423 - DNA, 20 bp, mouse
ggccattcgttgggaccact

SEQ ID NO: 584424 - DNA, 20 bp, mouse
gcccgggctttcttgatcat

SEQ ID NO: 584425 - DNA, 20 bp, mouse
gctggcgtgggcctgcccag

SEQ ID NO: 584426 - DNA, 20 bp, mouse
gtacccggcacaggaggagc

SEQ ID NO: 584427 - DNA, 20 bp, mouse
gaagctgggggccacatacc

SEQ ID NO: 584428 - DNA, 20 bp, mouse
ggccacatacccggcacagg

SEQ ID NO: 584429 - DNA, 20 bp, mouse
gtcctgggagagtacaaagt

SEQ ID NO: 584430 - DNA, 20 bp, mouse
gggggccacatacccggcac

SEQ ID NO: 584431 - DNA, 20 bp, mouse
ggggtacccgggaagtggag

SEQ ID NO: 584432 - DNA, 20 bp, mouse
ggactgttaaccttggggag

SEQ ID NO: 584433 - DNA, 20 bp, mouse
ggtccctgactgttaacctt

SEQ ID NO: 584434 - DNA, 20 bp, mouse
gtctgtaaaatgggacgaag

SEQ ID NO: 584435 - DNA, 20 bp, mouse
gcccagaggccggtcccatc

SEQ ID NO: 584436 - DNA, 20 bp, mouse
gctgtccttcaggaaggtaa

SEQ ID NO: 584437 - DNA, 20 bp, mouse
gagcccagccaggaccaacc

SEQ ID NO: 584438 - DNA, 20 bp, mouse
gaggaccaacctggacgcac

SEQ ID NO: 584439 - DNA, 20 bp, mouse
ggtagccagtgcgtccaggt

SEQ ID NO: 584440 - DNA, 20 bp, mouse
gtctggtagccagtgcgtcc

SEQ ID NO: 584441 - DNA, 20 bp, mouse
gtctgtgaggtgacaagata

SEQ ID NO: 584442 - DNA, 20 bp, mouse
gaaggtaagggaggcattgt

SEQ ID NO: 584443 - DNA, 20 bp, mouse
gtggtagccggaagctgatc

SEQ ID NO: 584444 - DNA, 20 bp, mouse
gggagtggctggggaccgtg

SEQ ID NO: 584445 - DNA, 20 bp, mouse
gtgcccaacacactgcccca

SEQ ID NO: 584446 - DNA, 20 bp, mouse
gacaccgggccacggctcac

SEQ ID NO: 584447 - DNA, 20 bp, mouse
gacgtgagacagaatcagga

SEQ ID NO: 584448 - DNA, 20 bp, mouse
gtcttctgcatgtgcccttg

SEQ ID NO: 584449 - DNA, 20 bp, mouse
gcgtggcccggtgtctcaca

SEQ ID NO: 584450 - DNA, 20 bp, mouse
ggtcccctcaggggcagctt

SEQ ID NO: 584451 - DNA, 20 bp, mouse
gaaacaactctggagtggag

SEQ ID NO: 584452 - DNA, 20 bp, mouse
gggtgtgaggttttctgtca

SEQ ID NO: 584453 - DNA, 20 bp, mouse
gcagaaaacctcacacccca

SEQ ID NO: 584454 - DNA, 20 bp, mouse
ggtggcttcgttcttaggta

SEQ ID NO: 584455 - DNA, 20 bp, mouse
gcttcgttcttaggtaaggt

SEQ ID NO: 584456 - DNA, 20 bp, mouse
ggagccagagggccatgcca

SEQ ID NO: 584457 - DNA, 20 bp, mouse
gcacctggagatgcctccac

SEQ ID NO: 584458 - DNA, 20 bp, mouse
gctggccatggagctgacat

SEQ ID NO: 584459 - DNA, 20 bp, mouse
ggtcctgtggaggcatctcc

SEQ ID NO: 584460 - DNA, 20 bp, mouse
gtggtgcggggaaacagccc

SEQ ID NO: 584461 - DNA, 20 bp, mouse
gcagccctggcatggccctc

SEQ ID NO: 584462 - DNA, 20 bp, mouse
gtgggttgggtccccatcgg

SEQ ID NO: 584463 - DNA, 20 bp, mouse
gcatctccaggtgacctggt

SEQ ID NO: 584464 - DNA, 20 bp, mouse
gctaaggcctgagtctggtg

SEQ ID NO: 584465 - DNA, 20 bp, mouse
gacagcctgtgggccgggat

SEQ ID NO: 584466 - DNA, 20 bp, mouse
gtgggcccagggctccgtgt

SEQ ID NO: 584467 - DNA, 20 bp, mouse
gtgtgggtggcagcaggcct

SEQ ID NO: 584468 - DNA, 20 bp, mouse
gtgcagcagaaggagcgcgg

SEQ ID NO: 584469 - DNA, 20 bp, mouse
gcaggaggtagtcagcgcca

SEQ ID NO: 584470 - DNA, 20 bp, mouse
gcacgtgctgacctaatctg

SEQ ID NO: 584471 - DNA, 20 bp, mouse
ggcccagggctccgtgtggg

SEQ ID NO: 584472 - DNA, 20 bp, mouse
ggcgcaggcagccgcagatt

SEQ ID NO: 584473 - DNA, 20 bp, mouse
gcgcagcacggcccagcagg

SEQ ID NO: 584474 - DNA, 20 bp, mouse
gggtggcagcaggcctcggc

SEQ ID NO: 584475 - DNA, 20 bp, mouse
gcctgggcgtgcagaactga

SEQ ID NO: 584476 - DNA, 20 bp, mouse
ggcgcgatagaaccaccaag

SEQ ID NO: 584477 - DNA, 20 bp, mouse
gagagggaccgctgcaacac

SEQ ID NO: 584478 - DNA, 20 bp, mouse
gcgacaactagcagccaaga

SEQ ID NO: 584479 - DNA, 20 bp, mouse
gagcccggcccgtgttgcag

SEQ ID NO: 584480 - DNA, 20 bp, mouse
ggcggaagtgcaggcatcag

SEQ ID NO: 584481 - DNA, 20 bp, mouse
gacacgggccgggctcaccg

SEQ ID NO: 584482 - DNA, 20 bp, mouse
gttgcagcggtccctcttgg

SEQ ID NO: 584483 - DNA, 20 bp, mouse
gtctcggccggagaaggcta

SEQ ID NO: 584484 - DNA, 20 bp, mouse
gtggttctatcgcgccctct

SEQ ID NO: 584485 - DNA, 20 bp, mouse
gcatcagggggttctgtcca

SEQ ID NO: 584486 - DNA, 20 bp, mouse
gacggcgcccgcacgaacca

SEQ ID NO: 584487 - DNA, 20 bp, mouse
ggcgcccgcacgaaccatgg

SEQ ID NO: 584488 - DNA, 20 bp, mouse
gtccctggtgaagctctgta

SEQ ID NO: 584489 - DNA, 20 bp, mouse
ggcccccagagaccccgcca

SEQ ID NO: 584490 - DNA, 20 bp, mouse
ggccctacagagcttcacca

SEQ ID NO: 584491 - DNA, 20 bp, mouse
gaaccatggcggggtctctg

SEQ ID NO: 584492 - DNA, 20 bp, mouse
gagatgtccaggctggacgt

SEQ ID NO: 584493 - DNA, 20 bp, mouse
ggtggggagatgcgtcccca

SEQ ID NO: 584494 - DNA, 20 bp, mouse
gtgtgacagacagagccggc

SEQ ID NO: 584495 - DNA, 20 bp, mouse
gaccccgccatggttcgtgc

SEQ ID NO: 584496 - DNA, 20 bp, mouse
gcgacccacggcctcggacg

SEQ ID NO: 584497 - DNA, 20 bp, mouse
gctgcagcagcggcgaccca

SEQ ID NO: 584498 - DNA, 20 bp, mouse
gcgctccgagacccagagag

SEQ ID NO: 584499 - DNA, 20 bp, mouse
gggaggacaagacacgagac

SEQ ID NO: 584500 - DNA, 20 bp, mouse
gctgccacgtccgaggccgt

SEQ ID NO: 584501 - DNA, 20 bp, mouse
gcctttgctgaggtagtggg

SEQ ID NO: 584502 - DNA, 20 bp, mouse
ggcgatccctgcgatagtcg

SEQ ID NO: 584503 - DNA, 20 bp, mouse
gcacgagacgggcaggaggt

SEQ ID NO: 584504 - DNA, 20 bp, mouse
gcttaccatagctgcagcag

SEQ ID NO: 584505 - DNA, 20 bp, mouse
ggcaaactttgaggacgtag

SEQ ID NO: 584506 - DNA, 20 bp, mouse
gcccggaaccggcggtcgag

SEQ ID NO: 584507 - DNA, 20 bp, mouse
gcccctgtccccggaaccgg

SEQ ID NO: 584508 - DNA, 20 bp, mouse
ggaagagagagccgtgccac

SEQ ID NO: 584509 - DNA, 20 bp, mouse
gggaaccggcggtcgagcgg

SEQ ID NO: 584510 - DNA, 20 bp, mouse
ggcggcggcagccgagcctg

SEQ ID NO: 584511 - DNA, 20 bp, mouse
gggctccgcagtctccgaga

SEQ ID NO: 584512 - DNA, 20 bp, mouse
gcggcccctgtccccggaac

SEQ ID NO: 584513 - DNA, 20 bp, mouse
gcgggatgcgttcatgccgg

SEQ ID NO: 584514 - DNA, 20 bp, mouse
gtggcgggatgcgttcatgc

SEQ ID NO: 584515 - DNA, 20 bp, mouse
gctcccccggggccgaccct

SEQ ID NO: 584516 - DNA, 20 bp, mouse
ggcggcggcggcaaacgagt

SEQ ID NO: 584517 - DNA, 20 bp, mouse
gccttggggcgcggtgcctg

SEQ ID NO: 584518 - DNA, 20 bp, mouse
gccacgatgagcggcagagt

SEQ ID NO: 584519 - DNA, 20 bp, mouse
ggagctccatcagctgccgc

SEQ ID NO: 584520 - DNA, 20 bp, mouse
ggactttactccagcggctg

SEQ ID NO: 584521 - DNA, 20 bp, mouse
gggtgacctgagccccaaac

SEQ ID NO: 584522 - DNA, 20 bp, mouse
gggggcctcggccaaagact

SEQ ID NO: 584523 - DNA, 20 bp, mouse
gctgggcactagccaagcgg

SEQ ID NO: 584524 - DNA, 20 bp, mouse
ggcggaccgcttctccttca

SEQ ID NO: 584525 - DNA, 20 bp, mouse
gtttactccagcggctgcgg

SEQ ID NO: 584526 - DNA, 20 bp, mouse
gtgggtctggcagacaggtg

SEQ ID NO: 584527 - DNA, 20 bp, mouse
gtctccaactcggccactca

SEQ ID NO: 584528 - DNA, 20 bp, mouse
ggcaccatgagtggccgagt

SEQ ID NO: 584529 - DNA, 20 bp, mouse
gacctagtgggcaggaaggg

SEQ ID NO: 584530 - DNA, 20 bp, mouse
gcccaagcaggcagagaccc

SEQ ID NO: 584531 - DNA, 20 bp, mouse
ggtgagtgactactgaaggc

SEQ ID NO: 584532 - DNA, 20 bp, mouse
gatgcagaatcaacagatgg

SEQ ID NO: 584533 - DNA, 20 bp, mouse
gcctccagctcccacctagt

SEQ ID NO: 584534 - DNA, 20 bp, mouse
ggaatctctcaccttggcca

SEQ ID NO: 584535 - DNA, 20 bp, mouse
gtgagatcgtacagggtggg

SEQ ID NO: 584536 - DNA, 20 bp, mouse
gtagcagagagcaccatgag

SEQ ID NO: 584537 - DNA, 20 bp, mouse
gaccatgagaggacaagtcg

SEQ ID NO: 584538 - DNA, 20 bp, mouse
ggctaagtaaagccctgtga

SEQ ID NO: 584539 - DNA, 20 bp, mouse
gagctgctgccaccttcaca

SEQ ID NO: 584540 - DNA, 20 bp, mouse
gcacaccggcagttgctcag

SEQ ID NO: 584541 - DNA, 20 bp, mouse
gtccccgacttgtcctctca

SEQ ID NO: 584542 - DNA, 20 bp, mouse
gaagtaaagccctgtgaagg

SEQ ID NO: 584543 - DNA, 20 bp, mouse
gaggctctggccagggtaag

SEQ ID NO: 584544 - DNA, 20 bp, mouse
ggcgcctcccgcgcacacct

SEQ ID NO: 584545 - DNA, 20 bp, mouse
gaggtaggcttgatgacctg

SEQ ID NO: 584546 - DNA, 20 bp, mouse
gtacaggccactgtttgtgt

SEQ ID NO: 584547 - DNA, 20 bp, mouse
gggcatgtctgtcaccgctc

SEQ ID NO: 584548 - DNA, 20 bp, mouse
gtctgtcccgggtcctggag

SEQ ID NO: 584549 - DNA, 20 bp, mouse
gtgcccggaccgcagaactc

SEQ ID NO: 584550 - DNA, 20 bp, mouse
gctgagggtgagcggagcag

SEQ ID NO: 584551 - DNA, 20 bp, mouse
gtcctggagcggtccaggct

SEQ ID NO: 584552 - DNA, 20 bp, mouse
gcccccaggtgcacactaat

SEQ ID NO: 584553 - DNA, 20 bp, mouse
gcagcagttctgagggtgag

SEQ ID NO: 584554 - DNA, 20 bp, mouse
gagctcgccaaatcaccagg

SEQ ID NO: 584555 - DNA, 20 bp, mouse
gggatgtccacagcaagtca

SEQ ID NO: 584556 - DNA, 20 bp, mouse
gcgacggcggcggcagtagg

SEQ ID NO: 584557 - DNA, 20 bp, mouse
ggcagcagccgcagccatct

SEQ ID NO: 584558 - DNA, 20 bp, mouse
ggaaacccagccggcgacgg

SEQ ID NO: 584559 - DNA, 20 bp, mouse
gtctccttcggacacgtcgg

SEQ ID NO: 584560 - DNA, 20 bp, mouse
gactgaaacccagccggcga

SEQ ID NO: 584561 - DNA, 20 bp, mouse
gcggcggcggcacctggagc

SEQ ID NO: 584562 - DNA, 20 bp, mouse
gggagacagatacctggtca

SEQ ID NO: 584563 - DNA, 20 bp, mouse
gccttcggacacgtcggcgg

SEQ ID NO: 584564 - DNA, 20 bp, mouse
gctgagtgtatggagcacgg

SEQ ID NO: 584565 - DNA, 20 bp, mouse
ggaggctgcggaggccaagc

SEQ ID NO: 584566 - DNA, 20 bp, mouse
gtgagtaacagcaggctgtc

SEQ ID NO: 584567 - DNA, 20 bp, mouse
gtgtcaggatgggatgtcgc

SEQ ID NO: 584568 - DNA, 20 bp, mouse
ggccagctgtgagtaacagc

SEQ ID NO: 584569 - DNA, 20 bp, mouse
gacatctttgctcctaaatg

SEQ ID NO: 584570 - DNA, 20 bp, mouse
gccaccctcaagttcaatgg

SEQ ID NO: 584571 - DNA, 20 bp, mouse
gcagtcactgtacagagtga

SEQ ID NO: 584572 - DNA, 20 bp, mouse
gaacttgacaggatcctgtt

SEQ ID NO: 584573 - DNA, 20 bp, mouse
gccagggaagacaggcattc

SEQ ID NO: 584574 - DNA, 20 bp, mouse
gccgtgcattccagccaaca

SEQ ID NO: 584575 - DNA, 20 bp, mouse
gaagcatgtagtttgaacca

SEQ ID NO: 584576 - DNA, 20 bp, mouse
gctggagccacgctgaagga

SEQ ID NO: 584577 - DNA, 20 bp, mouse
gagcagtcccggcaggtctc

SEQ ID NO: 584578 - DNA, 20 bp, mouse
ggtggctccagagacctgcc

SEQ ID NO: 584579 - DNA, 20 bp, mouse
gaggtgagtctcggtagatg

SEQ ID NO: 584580 - DNA, 20 bp, mouse
ggggagcaagcagtcccggc

SEQ ID NO: 584581 - DNA, 20 bp, mouse
gactttgtcagtctctaaga

SEQ ID NO: 584582 - DNA, 20 bp, mouse
gtctccaccttccttcagcg

SEQ ID NO: 584583 - DNA, 20 bp, mouse
gctggctgggctatcagagt

SEQ ID NO: 584584 - DNA, 20 bp, mouse
gctgggctatcagagtggga

SEQ ID NO: 584585 - DNA, 20 bp, mouse
gtgatagcccagccagccca

SEQ ID NO: 584586 - DNA, 20 bp, mouse
gggtcccggagcgacaggta

SEQ ID NO: 584587 - DNA, 20 bp, mouse
gcctgtcgctccgggacccg

SEQ ID NO: 584588 - DNA, 20 bp, mouse
gagcaggcctgtcctaggat

SEQ ID NO: 584589 - DNA, 20 bp, mouse
gcccagaggaagctgaaaag

SEQ ID NO: 584590 - DNA, 20 bp, mouse
ggagcagccggccagagctc

SEQ ID NO: 584591 - DNA, 20 bp, mouse
gagccagggagtcaacacta

SEQ ID NO: 584592 - DNA, 20 bp, mouse
gaggcctgtcctaggatggg

SEQ ID NO: 584593 - DNA, 20 bp, mouse
gtccgagtccctgcgaccta

SEQ ID NO: 584594 - DNA, 20 bp, mouse
gggcacgtcactccgagccg

SEQ ID NO: 584595 - DNA, 20 bp, mouse
gcagccgcccatcctaggac

SEQ ID NO: 584596 - DNA, 20 bp, mouse
gcgggaagcggagacgccag

SEQ ID NO: 584597 - DNA, 20 bp, mouse
gggccgccgccggagaagaa

SEQ ID NO: 584598 - DNA, 20 bp, mouse
gactgtcccttcttctccgg

SEQ ID NO: 584599 - DNA, 20 bp, mouse
gtcgtttccggccacctcag

SEQ ID NO: 584600 - DNA, 20 bp, mouse
gggagtctgtgaggtcgcta

SEQ ID NO: 584601 - DNA, 20 bp, mouse
ggtctcactagccgggagca

SEQ ID NO: 584602 - DNA, 20 bp, mouse
gcgggagcagggcgagctcg

SEQ ID NO: 584603 - DNA, 20 bp, mouse
gtcgatgcaggaggacgagc

SEQ ID NO: 584604 - DNA, 20 bp, mouse
ggtcccttcttctccggcgg

SEQ ID NO: 584605 - DNA, 20 bp, mouse
gccggggcttctgtgtagag

SEQ ID NO: 584606 - DNA, 20 bp, mouse
gccaccgcagcccaccccgg

SEQ ID NO: 584607 - DNA, 20 bp, mouse
gcccgcggcccggctgtagg

SEQ ID NO: 584608 - DNA, 20 bp, mouse
ggcggggtgcaggttacccg

SEQ ID NO: 584609 - DNA, 20 bp, mouse
gttacccgcggcccggctgt

SEQ ID NO: 584610 - DNA, 20 bp, mouse
gcacctcgagcggtgagaag

SEQ ID NO: 584611 - DNA, 20 bp, mouse
gccgcggccgacctccgcct

SEQ ID NO: 584612 - DNA, 20 bp, mouse
ggtgcaggttacccgcggcc

SEQ ID NO: 584613 - DNA, 20 bp, mouse
gctccaggccaggcatcgtg

SEQ ID NO: 584614 - DNA, 20 bp, mouse
gaggcgggcgtggagaggtg

SEQ ID NO: 584615 - DNA, 20 bp, mouse
ggtgcgagtctcacctcgag

SEQ ID NO: 584616 - DNA, 20 bp, mouse
ggccgtggcaccgcaatcag

SEQ ID NO: 584617 - DNA, 20 bp, mouse
ggactgacgactgtgcaagg

SEQ ID NO: 584618 - DNA, 20 bp, mouse
gctacctagaagctccgtga

SEQ ID NO: 584619 - DNA, 20 bp, mouse
gtgacgactgtgcaaggcgg

SEQ ID NO: 584620 - DNA, 20 bp, mouse
gcggtgccacggctgctaca

SEQ ID NO: 584621 - DNA, 20 bp, mouse
ggcggaggctgtggccgtca

SEQ ID NO: 584622 - DNA, 20 bp, mouse
ggcggactgacgactgtgca

SEQ ID NO: 584623 - DNA, 20 bp, mouse
gtggccgtcacggagcttct

SEQ ID NO: 584624 - DNA, 20 bp, mouse
ggaccccggtggagcagagg

SEQ ID NO: 584625 - DNA, 20 bp, mouse
gcaaagccctgtagcagccg

SEQ ID NO: 584626 - DNA, 20 bp, mouse
gcctgtccggagccactcac

SEQ ID NO: 584627 - DNA, 20 bp, mouse
gggcgcggaaggttcagtcc

SEQ ID NO: 584628 - DNA, 20 bp, mouse
gggacaccagagctcaactc

SEQ ID NO: 584629 - DNA, 20 bp, mouse
ggtggctccggacaggtgag

SEQ ID NO: 584630 - DNA, 20 bp, mouse
gaaggttcagtcccggtgag

SEQ ID NO: 584631 - DNA, 20 bp, mouse
ggttgagctctggtgtccgt

SEQ ID NO: 584632 - DNA, 20 bp, mouse
gtgtcctggagagcttagag

SEQ ID NO: 584633 - DNA, 20 bp, mouse
ggctgaggtggacttggcgg

SEQ ID NO: 584634 - DNA, 20 bp, mouse
gaggagggccgaagccagac

SEQ ID NO: 584635 - DNA, 20 bp, mouse
gctgaaccttccgcgcccca

SEQ ID NO: 584636 - DNA, 20 bp, mouse
gggctcgcagagccacgtaa

SEQ ID NO: 584637 - DNA, 20 bp, mouse
gcggataggaaggctaacgg

SEQ ID NO: 584638 - DNA, 20 bp, mouse
ggtctgcagccatggcggat

SEQ ID NO: 584639 - DNA, 20 bp, mouse
gttagtgcctgacgaggagg

SEQ ID NO: 584640 - DNA, 20 bp, mouse
gccctcggctcactacctcc

SEQ ID NO: 584641 - DNA, 20 bp, mouse
gagagccacgtaacggccgg

SEQ ID NO: 584642 - DNA, 20 bp, mouse
gcagacccccggccgttacg

SEQ ID NO: 584643 - DNA, 20 bp, mouse
gcctgcgtgacggggatgaa

SEQ ID NO: 584644 - DNA, 20 bp, mouse
ggcagccatggcggatagga

SEQ ID NO: 584645 - DNA, 20 bp, mouse
gttagccttcctatccgcca

SEQ ID NO: 584646 - DNA, 20 bp, mouse
ggcagcagccgaacccggag

SEQ ID NO: 584647 - DNA, 20 bp, mouse
gctgggaacgccgggctcgg

SEQ ID NO: 584648 - DNA, 20 bp, mouse
gacctggccagggcgcggag

SEQ ID NO: 584649 - DNA, 20 bp, mouse
gcagccgaacccggagagga

SEQ ID NO: 584650 - DNA, 20 bp, mouse
gccagggcctccctcctctc

SEQ ID NO: 584651 - DNA, 20 bp, mouse
gagaggctccggagtcaggc

SEQ ID NO: 584652 - DNA, 20 bp, mouse
ggggtggcacgtcaaagtag

SEQ ID NO: 584653 - DNA, 20 bp, mouse
gctccggagtcaggccggct

SEQ ID NO: 584654 - DNA, 20 bp, mouse
gcgcgggcagcggggatccg

SEQ ID NO: 584655 - DNA, 20 bp, mouse
ggctccaacaggaaaaccga

SEQ ID NO: 584656 - DNA, 20 bp, mouse
gctccgcggcgggagatggg

SEQ ID NO: 584657 - DNA, 20 bp, mouse
gcctaggcaggcggaaggga

SEQ ID NO: 584658 - DNA, 20 bp, mouse
ggacatgacggcgcggctgg

SEQ ID NO: 584659 - DNA, 20 bp, mouse
gctcctccgcggcgggagat

SEQ ID NO: 584660 - DNA, 20 bp, mouse
gccggcgggggccgacatga

SEQ ID NO: 584661 - DNA, 20 bp, mouse
gctccgcccatctcccgccg

SEQ ID NO: 584662 - DNA, 20 bp, mouse
gatgacggcgcggctggcgg

SEQ ID NO: 584663 - DNA, 20 bp, mouse
gcccgccgggtcccctcacc

SEQ ID NO: 584664 - DNA, 20 bp, mouse
gggatgccgcccaagctcgg

SEQ ID NO: 584665 - DNA, 20 bp, mouse
ggggggccgacatgacggcg

SEQ ID NO: 584666 - DNA, 20 bp, mouse
ggcctgggagccttgacgtt

SEQ ID NO: 584667 - DNA, 20 bp, mouse
gacgaagtcgaacctggatc

SEQ ID NO: 584668 - DNA, 20 bp, mouse
gtcctaacgtcaaggctccc

SEQ ID NO: 584669 - DNA, 20 bp, mouse
gggaaccggaagttgagcct

SEQ ID NO: 584670 - DNA, 20 bp, mouse
gttaggaacgaagtcgaacc

SEQ ID NO: 584671 - DNA, 20 bp, mouse
ggacttcgttcctaacgtca

SEQ ID NO: 584672 - DNA, 20 bp, mouse
gcgccggccacagatgcgag

SEQ ID NO: 584673 - DNA, 20 bp, mouse
gcgcgatgccactcctcacc

SEQ ID NO: 584674 - DNA, 20 bp, mouse
ggcatcgcgaggttgcgtgg

SEQ ID NO: 584675 - DNA, 20 bp, mouse
ggcgaagcgagccggaacct

SEQ ID NO: 584676 - DNA, 20 bp, mouse
gacccagagcgactcggcgg

SEQ ID NO: 584677 - DNA, 20 bp, mouse
ggcaacccagagcgactcgg

SEQ ID NO: 584678 - DNA, 20 bp, mouse
gctagcaacccagagcgact

SEQ ID NO: 584679 - DNA, 20 bp, mouse
gcgcgcccgggcgcctgacg

SEQ ID NO: 584680 - DNA, 20 bp, mouse
gagcaggtacggcagacgcg

SEQ ID NO: 584681 - DNA, 20 bp, mouse
ggcgcagggcgcagggagga

SEQ ID NO: 584682 - DNA, 20 bp, mouse
gtcccgggtgacagtggaag

SEQ ID NO: 584683 - DNA, 20 bp, mouse
gtgggtgaggaagtttgacg

SEQ ID NO: 584684 - DNA, 20 bp, mouse
gaacttgtcccgggtgacag

SEQ ID NO: 584685 - DNA, 20 bp, mouse
gtcagctgcaagcggcgaca

SEQ ID NO: 584686 - DNA, 20 bp, mouse
gggacaccgaacctggcgag

SEQ ID NO: 584687 - DNA, 20 bp, mouse
gcggcagcggacaccgaacc

SEQ ID NO: 584688 - DNA, 20 bp, mouse
gaggggcaggaaacaaacgg

SEQ ID NO: 584689 - DNA, 20 bp, mouse
gcagggcagcctggaaacgt

SEQ ID NO: 584690 - DNA, 20 bp, mouse
gaaagtggtgcgatccccaa

SEQ ID NO: 584691 - DNA, 20 bp, mouse
gcggggccgaaacgagacgg

SEQ ID NO: 584692 - DNA, 20 bp, mouse
gaaacggcggacacacctgg

SEQ ID NO: 584693 - DNA, 20 bp, mouse
gtccacgctccgctccaacg

SEQ ID NO: 584694 - DNA, 20 bp, mouse
ggggcctcgggcctcggcag

SEQ ID NO: 584695 - DNA, 20 bp, mouse
gcgcgccgtcagcggagaac

SEQ ID NO: 584696 - DNA, 20 bp, mouse
gcgcctgtgacccctgacct

SEQ ID NO: 584697 - DNA, 20 bp, mouse
gctgggcgctcggaacaggt

SEQ ID NO: 584698 - DNA, 20 bp, mouse
gcccttggttgggacaggac

SEQ ID NO: 584699 - DNA, 20 bp, mouse
ggggtcacaggcgaccgcct

SEQ ID NO: 584700 - DNA, 20 bp, mouse
gcgggaccccagacccgcag

SEQ ID NO: 584701 - DNA, 20 bp, mouse
ggcgcggtgcgcccttggtt

SEQ ID NO: 584702 - DNA, 20 bp, mouse
gtgacctgggcgctcggaac

SEQ ID NO: 584703 - DNA, 20 bp, mouse
ggtgcgcccttggttgggac

SEQ ID NO: 584704 - DNA, 20 bp, mouse
gctccccggcgtcctcccgt

SEQ ID NO: 584705 - DNA, 20 bp, mouse
ggccggtcctgtcccaacca

SEQ ID NO: 584706 - DNA, 20 bp, mouse
gcacgtcagtgatagcccgg

SEQ ID NO: 584707 - DNA, 20 bp, mouse
gcgctccacttcgagtgagg

SEQ ID NO: 584708 - DNA, 20 bp, mouse
gcccagaaggctcggtctag

SEQ ID NO: 584709 - DNA, 20 bp, mouse
gtcgaagtggagcgcagtcg

SEQ ID NO: 584710 - DNA, 20 bp, mouse
gccaggatcgggaagcacgg

SEQ ID NO: 584711 - DNA, 20 bp, mouse
gctatcactgacgtgtctct

SEQ ID NO: 584712 - DNA, 20 bp, mouse
gggaaactcactcgccatgg

SEQ ID NO: 584713 - DNA, 20 bp, mouse
ggcgcgggaacgagtccccc

SEQ ID NO: 584714 - DNA, 20 bp, mouse
ggggcgtgcggggacccaga

SEQ ID NO: 584715 - DNA, 20 bp, mouse
gagcgcctcctcactcgaag

SEQ ID NO: 584716 - DNA, 20 bp, mouse
gagagtcgtgaggaacggag

SEQ ID NO: 584717 - DNA, 20 bp, mouse
gaggccagagtcgtgaggaa

SEQ ID NO: 584718 - DNA, 20 bp, mouse
gctcacgactctggcctagg

SEQ ID NO: 584719 - DNA, 20 bp, mouse
gacgactctggcctaggcgg

SEQ ID NO: 584720 - DNA, 20 bp, mouse
gcacacccggcgggcacccg

SEQ ID NO: 584721 - DNA, 20 bp, mouse
gggatgcgcaggcctcgttg

SEQ ID NO: 584722 - DNA, 20 bp, mouse
ggcatgtcacatgactctgt

SEQ ID NO: 584723 - DNA, 20 bp, mouse
ggcccgtggcgaccccaacg

SEQ ID NO: 584724 - DNA, 20 bp, mouse
ggcctcgttggggtcgccac

SEQ ID NO: 584725 - DNA, 20 bp, mouse
gtgtgggcggagcttgtgcg

SEQ ID NO: 584726 - DNA, 20 bp, mouse
gtaggggctagtgcacccca

SEQ ID NO: 584727 - DNA, 20 bp, mouse
ggaaaggaagaccaagatag

SEQ ID NO: 584728 - DNA, 20 bp, mouse
gctagtgcaccccatggaag

SEQ ID NO: 584729 - DNA, 20 bp, mouse
gccgttcttaggcatcagca

SEQ ID NO: 584730 - DNA, 20 bp, mouse
ggagcaatgaggtcccagaa

SEQ ID NO: 584731 - DNA, 20 bp, mouse
gctctcgtagatacaggctc

SEQ ID NO: 584732 - DNA, 20 bp, mouse
gcgttggacccggctgcaga

SEQ ID NO: 584733 - DNA, 20 bp, mouse
gcgcggtccccgcttccatg

SEQ ID NO: 584734 - DNA, 20 bp, mouse
gggaggaggctaggtaccca

SEQ ID NO: 584735 - DNA, 20 bp, mouse
ggcctcctccagccataacc

SEQ ID NO: 584736 - DNA, 20 bp, mouse
gagggacacggagggaccag

SEQ ID NO: 584737 - DNA, 20 bp, mouse
ggacacggagggaccagggg

SEQ ID NO: 584738 - DNA, 20 bp, mouse
ggccagcttccggttccgtt

SEQ ID NO: 584739 - DNA, 20 bp, mouse
ggaaccgagcccaacggaac

SEQ ID NO: 584740 - DNA, 20 bp, mouse
gtctcatgagtggtaggtag

SEQ ID NO: 584741 - DNA, 20 bp, mouse
gttggggccgggatctaagt

SEQ ID NO: 584742 - DNA, 20 bp, mouse
ggggaggccagggacacgga

SEQ ID NO: 584743 - DNA, 20 bp, mouse
gccggccccaatcatcccac

SEQ ID NO: 584744 - DNA, 20 bp, mouse
gtaagtgggcgcgagatgag

SEQ ID NO: 584745 - DNA, 20 bp, mouse
gatccgccatccagtaagta

SEQ ID NO: 584746 - DNA, 20 bp, mouse
gacgcaggcgacacaagaag

SEQ ID NO: 584747 - DNA, 20 bp, mouse
gccgggcggagcggccaaca

SEQ ID NO: 584748 - DNA, 20 bp, mouse
gggccaacatggcggaacgc

SEQ ID NO: 584749 - DNA, 20 bp, mouse
gggatccaggtagctcggcg

SEQ ID NO: 584750 - DNA, 20 bp, mouse
gcgacacaagaagcggatcc

SEQ ID NO: 584751 - DNA, 20 bp, mouse
ggctccacgtcagaaggaac

SEQ ID NO: 584752 - DNA, 20 bp, mouse
gacggccccgccgagctacc

SEQ ID NO: 584753 - DNA, 20 bp, mouse
ggaagcggatccaggtagct

SEQ ID NO: 584754 - DNA, 20 bp, mouse
gtcgggacgccagggagaca

SEQ ID NO: 584755 - DNA, 20 bp, mouse
gggacgccagggagacacgg

SEQ ID NO: 584756 - DNA, 20 bp, mouse
ggtccgtgagagcggcgtgg

SEQ ID NO: 584757 - DNA, 20 bp, mouse
gggcggcgtgtccgtgagag

SEQ ID NO: 584758 - DNA, 20 bp, mouse
gacgatgagccccacgaagg

SEQ ID NO: 584759 - DNA, 20 bp, mouse
gtctcgcggccagaggtagt

SEQ ID NO: 584760 - DNA, 20 bp, mouse
ggagccccacgaaggaggtg

SEQ ID NO: 584761 - DNA, 20 bp, mouse
gccagcgccccggccccgtg

SEQ ID NO: 584762 - DNA, 20 bp, mouse
gtggccgcgagaccagaacg

SEQ ID NO: 584763 - DNA, 20 bp, mouse
gctctcgcgagagttggcga

SEQ ID NO: 584764 - DNA, 20 bp, mouse
gcgagagttggcgacggccg

SEQ ID NO: 584765 - DNA, 20 bp, mouse
gcgcccccacgccgctctca

SEQ ID NO: 584766 - DNA, 20 bp, mouse
ggcccgcgccgtgaagctag

SEQ ID NO: 584767 - DNA, 20 bp, mouse
gtccgacgccatggcggcca

SEQ ID NO: 584768 - DNA, 20 bp, mouse
gcacggcgcgggctcttccg

SEQ ID NO: 584769 - DNA, 20 bp, mouse
gggccgctccgacgccatgg

SEQ ID NO: 584770 - DNA, 20 bp, mouse
gaggcgcgccgctagcttca

SEQ ID NO: 584771 - DNA, 20 bp, mouse
gagccggacggcgaggtaag

SEQ ID NO: 584772 - DNA, 20 bp, mouse
gcggccggcgcgccatctag

SEQ ID NO: 584773 - DNA, 20 bp, mouse
gaaacgctgagtcgttggtt

SEQ ID NO: 584774 - DNA, 20 bp, mouse
gcgcggccgctccgacgcca

SEQ ID NO: 584775 - DNA, 20 bp, mouse
ggcgccgccgcgcaggaagg

SEQ ID NO: 584776 - DNA, 20 bp, mouse
ggccagtggcgtagccgagt

SEQ ID NO: 584777 - DNA, 20 bp, mouse
ggcccggcgggaccgagcgg

SEQ ID NO: 584778 - DNA, 20 bp, mouse
ggtggaccggcggagctcag

SEQ ID NO: 584779 - DNA, 20 bp, mouse
gcgagcccggcgggaccgag

SEQ ID NO: 584780 - DNA, 20 bp, mouse
gcggagtggaccgagcccgg

SEQ ID NO: 584781 - DNA, 20 bp, mouse
gagccggccggacgccgact

SEQ ID NO: 584782 - DNA, 20 bp, mouse
gcggcgtccggccggctgtg

SEQ ID NO: 584783 - DNA, 20 bp, mouse
gccgcgggccgctttctcca

SEQ ID NO: 584784 - DNA, 20 bp, mouse
ggacaggcgccggctctagt

SEQ ID NO: 584785 - DNA, 20 bp, mouse
ggcaggccgccgaagctgaa

SEQ ID NO: 584786 - DNA, 20 bp, mouse
gagcttgctggagaagggac

SEQ ID NO: 584787 - DNA, 20 bp, mouse
ggcagcagtggaggtaacat

SEQ ID NO: 584788 - DNA, 20 bp, mouse
gggacaagttcagtcatcca

SEQ ID NO: 584789 - DNA, 20 bp, mouse
gctcaggcgtagctctggag

SEQ ID NO: 584790 - DNA, 20 bp, mouse
gtgcggaagagaggacttga

SEQ ID NO: 584791 - DNA, 20 bp, mouse
gaagggacaggtgagaggct

SEQ ID NO: 584792 - DNA, 20 bp, mouse
gtgaggcacccgaaacacac

SEQ ID NO: 584793 - DNA, 20 bp, mouse
gagaggacttgagggcaccc

SEQ ID NO: 584794 - DNA, 20 bp, mouse
ggtaacattggagagcttgc

SEQ ID NO: 584795 - DNA, 20 bp, mouse
ggggattcaggaaacacagg

SEQ ID NO: 584796 - DNA, 20 bp, mouse
ggaggtggcacccagagtgt

SEQ ID NO: 584797 - DNA, 20 bp, mouse
gtggggctctaaagcatgtg

SEQ ID NO: 584798 - DNA, 20 bp, mouse
gccagggacaccctgcctga

SEQ ID NO: 584799 - DNA, 20 bp, mouse
gcctcctggagcttggtggg

SEQ ID NO: 584800 - DNA, 20 bp, mouse
gcatgtggggtgagaccctc

SEQ ID NO: 584801 - DNA, 20 bp, mouse
gagttcattgccagagaagc

SEQ ID NO: 584802 - DNA, 20 bp, mouse
gcccagagaggctgcagcca

SEQ ID NO: 584803 - DNA, 20 bp, mouse
gtttgtccagagtaaaggtg

SEQ ID NO: 584804 - DNA, 20 bp, mouse
gactctgctcctgatgtcca

SEQ ID NO: 584805 - DNA, 20 bp, mouse
ggtgcagcagctgggttctt

SEQ ID NO: 584806 - DNA, 20 bp, mouse
gaggcgggcccggcagacgg

SEQ ID NO: 584807 - DNA, 20 bp, mouse
ggaagtcgaaagacacatcg

SEQ ID NO: 584808 - DNA, 20 bp, mouse
gagcatcgcggcggaccaca

SEQ ID NO: 584809 - DNA, 20 bp, mouse
ggtggcgcgcagcatcgcgg

SEQ ID NO: 584810 - DNA, 20 bp, mouse
gtttgtggcgcgcagcatcg

SEQ ID NO: 584811 - DNA, 20 bp, mouse
gcgcaccgccgccctctcgg

SEQ ID NO: 584812 - DNA, 20 bp, mouse
ggccgggcccgcctccgaga

SEQ ID NO: 584813 - DNA, 20 bp, mouse
ggacgccgccacgccggaag

SEQ ID NO: 584814 - DNA, 20 bp, mouse
gatgctgcgcgccacaaaca

SEQ ID NO: 584815 - DNA, 20 bp, mouse
ggtcctgggcagaggaacac

SEQ ID NO: 584816 - DNA, 20 bp, mouse
gctgcgaggcggcggcacag

SEQ ID NO: 584817 - DNA, 20 bp, mouse
gaggaagagcggctgcgagg

SEQ ID NO: 584818 - DNA, 20 bp, mouse
gacagaggcagcggctgagt

SEQ ID NO: 584819 - DNA, 20 bp, mouse
ggcagcggctgagttggtcg

SEQ ID NO: 584820 - DNA, 20 bp, mouse
gaagagcggctgcgaggcgg

SEQ ID NO: 584821 - DNA, 20 bp, mouse
gcaagagcgagtgacagtca

SEQ ID NO: 584822 - DNA, 20 bp, mouse
gcccgaccgcggtggagaca

SEQ ID NO: 584823 - DNA, 20 bp, mouse
gacagggccacggggctcag

SEQ ID NO: 584824 - DNA, 20 bp, mouse
gagcaggaagagcggctgcg

SEQ ID NO: 584825 - DNA, 20 bp, mouse
gacctgcatcctgctctcga

SEQ ID NO: 584826 - DNA, 20 bp, mouse
gtaacacgggctgaattagg

SEQ ID NO: 584827 - DNA, 20 bp, mouse
gctttaacacgggctgaatt

SEQ ID NO: 584828 - DNA, 20 bp, mouse
gctcctttttactttaacac

SEQ ID NO: 584829 - DNA, 20 bp, mouse
gccacaagcttcctcttctc

SEQ ID NO: 584830 - DNA, 20 bp, mouse
gagcccgtgttaaagtaaaa

SEQ ID NO: 584831 - DNA, 20 bp, mouse
gtctctactaacaaagccaa

SEQ ID NO: 584832 - DNA, 20 bp, mouse
gacgggctgaattaggtggc

SEQ ID NO: 584833 - DNA, 20 bp, mouse
gaagtaaaaaggagctgctt

SEQ ID NO: 584834 - DNA, 20 bp, mouse
gtctaactggcttaaagtct

SEQ ID NO: 584835 - DNA, 20 bp, mouse
gttaagacaatactgattgg

SEQ ID NO: 584836 - DNA, 20 bp, mouse
gcccgcgccgcgccactgca

SEQ ID NO: 584837 - DNA, 20 bp, mouse
ggttccggccgggatccggg

SEQ ID NO: 584838 - DNA, 20 bp, mouse
gtgagcgccggaccctatta

SEQ ID NO: 584839 - DNA, 20 bp, mouse
gcagggcccgcgcagaagga

SEQ ID NO: 584840 - DNA, 20 bp, mouse
gagaaggaaggaccctaata

SEQ ID NO: 584841 - DNA, 20 bp, mouse
ggcctcgccatgcagtggcg

SEQ ID NO: 584842 - DNA, 20 bp, mouse
ggaggcccggggagacaccg

SEQ ID NO: 584843 - DNA, 20 bp, mouse
gcgcggggctttggtggcca

SEQ ID NO: 584844 - DNA, 20 bp, mouse
gccgggggaccgaaagcggg

SEQ ID NO: 584845 - DNA, 20 bp, mouse
gacccgggtactcatcccaa

SEQ ID NO: 584846 - DNA, 20 bp, mouse
ggcaggagcaatacacctaa

SEQ ID NO: 584847 - DNA, 20 bp, mouse
gttctggcgttggatccctt

SEQ ID NO: 584848 - DNA, 20 bp, mouse
gagcaaaactgcgagaagaa

SEQ ID NO: 584849 - DNA, 20 bp, mouse
gggaattgttgttctggcgt

SEQ ID NO: 584850 - DNA, 20 bp, mouse
gtttgctgtgtagtcagtcg

SEQ ID NO: 584851 - DNA, 20 bp, mouse
ggcctgtgaaataagggatg

SEQ ID NO: 584852 - DNA, 20 bp, mouse
gctagatgcctgtgaaataa

SEQ ID NO: 584853 - DNA, 20 bp, mouse
gttcagtggaattgttgttc

SEQ ID NO: 584854 - DNA, 20 bp, mouse
gacctcatcccttatttcac

SEQ ID NO: 584855 - DNA, 20 bp, mouse
gagtgcggattccgaaccag

SEQ ID NO: 584856 - DNA, 20 bp, mouse
ggtgcggactgcacaggcaa

SEQ ID NO: 584857 - DNA, 20 bp, mouse
ggcccctaccgaggtcgggt

SEQ ID NO: 584858 - DNA, 20 bp, mouse
gtgctatgcgcatgcctgta

SEQ ID NO: 584859 - DNA, 20 bp, mouse
gaggacagtgacaaaagagt

SEQ ID NO: 584860 - DNA, 20 bp, mouse
gactcttgttcctaccctac

SEQ ID NO: 584861 - DNA, 20 bp, mouse
gctgcacaggcaaggggcaa

SEQ ID NO: 584862 - DNA, 20 bp, mouse
gccctgcccctaccgaggtc

SEQ ID NO: 584863 - DNA, 20 bp, mouse
gtcctgccctgcccctaccg

SEQ ID NO: 584864 - DNA, 20 bp, mouse
gaggaaatgacccggaactg

SEQ ID NO: 584865 - DNA, 20 bp, mouse
gcagaatcgtctatttacga

SEQ ID NO: 584866 - DNA, 20 bp, mouse
gtgcagactgcacaggtaag

SEQ ID NO: 584867 - DNA, 20 bp, mouse
gccaacctcggtaggggaag

SEQ ID NO: 584868 - DNA, 20 bp, mouse
gtcccctaccgaggttgggt

SEQ ID NO: 584869 - DNA, 20 bp, mouse
gcagacagtgacgaaagagt

SEQ ID NO: 584870 - DNA, 20 bp, mouse
gcggggtcaatgggttgggg

SEQ ID NO: 584871 - DNA, 20 bp, mouse
gacaggtaaggggcaaaagg

SEQ ID NO: 584872 - DNA, 20 bp, mouse
gcctgccccttcccctaccg

SEQ ID NO: 584873 - DNA, 20 bp, mouse
gcagaatcatatatttacga

SEQ ID NO: 584874 - DNA, 20 bp, mouse
gctgctatgtgcatgtctgc

SEQ ID NO: 584875 - DNA, 20 bp, mouse
gattcacaaaccaccatttc

SEQ ID NO: 584876 - DNA, 20 bp, mouse
gcccaagtcaggctagaggt

SEQ ID NO: 584877 - DNA, 20 bp, mouse
gcagtggcctgtgacgtaca

SEQ ID NO: 584878 - DNA, 20 bp, mouse
gaccagtggccggaaggagt

SEQ ID NO: 584879 - DNA, 20 bp, mouse
gtggcctgtgacgtacaggg

SEQ ID NO: 584880 - DNA, 20 bp, mouse
ggccccgccctgtacgtcac

SEQ ID NO: 584881 - DNA, 20 bp, mouse
gccactgacagacccaagtc

SEQ ID NO: 584882 - DNA, 20 bp, mouse
gcggcacccggggaccttct

SEQ ID NO: 584883 - DNA, 20 bp, mouse
gacagaagcggcccagggta

SEQ ID NO: 584884 - DNA, 20 bp, mouse
gcggaaggagtgggaagcgg

SEQ ID NO: 584885 - DNA, 20 bp, mouse
gcggcgagtcaggacagaag

SEQ ID NO: 584886 - DNA, 20 bp, mouse
gggctcagagttcttgcaca

SEQ ID NO: 584887 - DNA, 20 bp, mouse
gtcagagttcttgcacaagg

SEQ ID NO: 584888 - DNA, 20 bp, mouse
gaggagggcgtgctgcgctc

SEQ ID NO: 584889 - DNA, 20 bp, mouse
gccatcaaagcaaacaccaa

SEQ ID NO: 584890 - DNA, 20 bp, mouse
gcttgagacagcatgcgtag

SEQ ID NO: 584891 - DNA, 20 bp, mouse
gaatgtgccaatgtcaccag

SEQ ID NO: 584892 - DNA, 20 bp, mouse
gactcaaacaacaaagccat

SEQ ID NO: 584893 - DNA, 20 bp, mouse
gtccttggggttgaagaggc

SEQ ID NO: 584894 - DNA, 20 bp, mouse
gtcactctgtgtcaccgcaa

SEQ ID NO: 584895 - DNA, 20 bp, mouse
gggatgtatatcactcctca

SEQ ID NO: 584896 - DNA, 20 bp, mouse
gcgggccagacgtggcgcag

SEQ ID NO: 584897 - DNA, 20 bp, mouse
gtggcgcagcggccgagttt

SEQ ID NO: 584898 - DNA, 20 bp, mouse
gctgcggaacgtctcctgcc

SEQ ID NO: 584899 - DNA, 20 bp, mouse
gccagcttgcgggccagacg

SEQ ID NO: 584900 - DNA, 20 bp, mouse
gtaggatgctcatctgtgcc

SEQ ID NO: 584901 - DNA, 20 bp, mouse
gtagccagagacccacggta

SEQ ID NO: 584902 - DNA, 20 bp, mouse
gagggccaagcctggagcag

SEQ ID NO: 584903 - DNA, 20 bp, mouse
gccaggcttggccctaccgt

SEQ ID NO: 584904 - DNA, 20 bp, mouse
ggaactgtcgtactaaggtt

SEQ ID NO: 584905 - DNA, 20 bp, mouse
gttgtggaactgtcgtacta

SEQ ID NO: 584906 - DNA, 20 bp, mouse
gcggcgaatggcctctgtca

SEQ ID NO: 584907 - DNA, 20 bp, mouse
ggcgagcgaggccccgaccg

SEQ ID NO: 584908 - DNA, 20 bp, mouse
gccgaccgcggccctgacag

SEQ ID NO: 584909 - DNA, 20 bp, mouse
ggagcaggcttccggcgagg

SEQ ID NO: 584910 - DNA, 20 bp, mouse
gagtcctccggcccaggcgg

SEQ ID NO: 584911 - DNA, 20 bp, mouse
gacgcaccgtggccgggttc

SEQ ID NO: 584912 - DNA, 20 bp, mouse
gcaggcggcggcgtctccac

SEQ ID NO: 584913 - DNA, 20 bp, mouse
gcttccggcgaggcggcgaa

SEQ ID NO: 584914 - DNA, 20 bp, mouse
gggcgagcaggcttccggcg

SEQ ID NO: 584915 - DNA, 20 bp, mouse
ggcgcgagaccgacgcaccg

SEQ ID NO: 584916 - DNA, 20 bp, mouse
gaaagccagacggatcagag

SEQ ID NO: 584917 - DNA, 20 bp, mouse
gccgctgtgtaggcagagaa

SEQ ID NO: 584918 - DNA, 20 bp, mouse
gttctctttatgggaagtag

SEQ ID NO: 584919 - DNA, 20 bp, mouse
gatgtcctctctgatccgtc

SEQ ID NO: 584920 - DNA, 20 bp, mouse
gcagtttcccagggtaccca

SEQ ID NO: 584921 - DNA, 20 bp, mouse
gggtacccaaggcttgtagg

SEQ ID NO: 584922 - DNA, 20 bp, mouse
gagggcaggcacttaagcaa

SEQ ID NO: 584923 - DNA, 20 bp, mouse
gtagctttggtagagttcga

SEQ ID NO: 584924 - DNA, 20 bp, mouse
gaggaccagcaatagccgtg

SEQ ID NO: 584925 - DNA, 20 bp, mouse
gtgccctccttaagccacaa

SEQ ID NO: 584926 - DNA, 20 bp, mouse
gtctgcccgccaacccccaa

SEQ ID NO: 584927 - DNA, 20 bp, mouse
gtgtctggcagtgtggactg

SEQ ID NO: 584928 - DNA, 20 bp, mouse
gccgtgcccaacagagcatg

SEQ ID NO: 584929 - DNA, 20 bp, mouse
ggggcccaggcaccttgcaa

SEQ ID NO: 584930 - DNA, 20 bp, mouse
gccacaagtgtctggcagtg

SEQ ID NO: 584931 - DNA, 20 bp, mouse
gaacccccaacggcagggtg

SEQ ID NO: 584932 - DNA, 20 bp, mouse
ggtgcctgggcccttgtgag

SEQ ID NO: 584933 - DNA, 20 bp, mouse
ggaagggtgggatagtttca

SEQ ID NO: 584934 - DNA, 20 bp, mouse
gagctgccccatgctctgtt

SEQ ID NO: 584935 - DNA, 20 bp, mouse
gccgccaacccccaacggca

SEQ ID NO: 584936 - DNA, 20 bp, mouse
gtgggagtcggaatcatggc

SEQ ID NO: 584937 - DNA, 20 bp, mouse
gtggctcacgtaactgaggg

SEQ ID NO: 584938 - DNA, 20 bp, mouse
gggctggctcacgtaactga

SEQ ID NO: 584939 - DNA, 20 bp, mouse
gtttgtgggagtcggaatca

SEQ ID NO: 584940 - DNA, 20 bp, mouse
gttggttgacttccaggacg

SEQ ID NO: 584941 - DNA, 20 bp, mouse
gcttcacctgctcctcgtcc

SEQ ID NO: 584942 - DNA, 20 bp, mouse
ggccgaggacgcctaaggac

SEQ ID NO: 584943 - DNA, 20 bp, mouse
ggttacgtgagccagcccag

SEQ ID NO: 584944 - DNA, 20 bp, mouse
gaccgggtcagggtcactac

SEQ ID NO: 584945 - DNA, 20 bp, mouse
gtgcgcagcctgggacatag

SEQ ID NO: 584946 - DNA, 20 bp, mouse
gggctgtctcaattacgatg

SEQ ID NO: 584947 - DNA, 20 bp, mouse
gcgcagtggggagcagttcg

SEQ ID NO: 584948 - DNA, 20 bp, mouse
ggccacgaagccgggacctc

SEQ ID NO: 584949 - DNA, 20 bp, mouse
gggaaaggccagccgcccca

SEQ ID NO: 584950 - DNA, 20 bp, mouse
gctccagccggccaagaagc

SEQ ID NO: 584951 - DNA, 20 bp, mouse
ggcgcacagccccggcagga

SEQ ID NO: 584952 - DNA, 20 bp, mouse
gctggagtgctgccgtgggg

SEQ ID NO: 584953 - DNA, 20 bp, mouse
ggttggcagaggcctcgctg

SEQ ID NO: 584954 - DNA, 20 bp, mouse
ggcggagcgcgcctgcgcag

SEQ ID NO: 584955 - DNA, 20 bp, mouse
gaggcgcgctccgccaaggt

SEQ ID NO: 584956 - DNA, 20 bp, mouse
ggtctcttctgtaacagtca

SEQ ID NO: 584957 - DNA, 20 bp, mouse
ggtcagccaccggctatcag

SEQ ID NO: 584958 - DNA, 20 bp, mouse
ggagatgacacaggatcccg

SEQ ID NO: 584959 - DNA, 20 bp, mouse
gagccaggcaccggataatg

SEQ ID NO: 584960 - DNA, 20 bp, mouse
gccgctccgctgatagccgg

SEQ ID NO: 584961 - DNA, 20 bp, mouse
gagccgaatgaagcagggag

SEQ ID NO: 584962 - DNA, 20 bp, mouse
gctggccgcacaatacagga

SEQ ID NO: 584963 - DNA, 20 bp, mouse
gagacgttagtgttgccatg

SEQ ID NO: 584964 - DNA, 20 bp, mouse
gccgcacaatacaggaagga

SEQ ID NO: 584965 - DNA, 20 bp, mouse
gtcagcggagcggagataaa

SEQ ID NO: 584966 - DNA, 20 bp, mouse
gtctgacatggcccactgaa

SEQ ID NO: 584967 - DNA, 20 bp, mouse
ggtgggccatgtcagagctg

SEQ ID NO: 584968 - DNA, 20 bp, mouse
ggcagtgccttaccaccccc

SEQ ID NO: 584969 - DNA, 20 bp, mouse
gctcggtagtgaggcaaggt

SEQ ID NO: 584970 - DNA, 20 bp, mouse
gaggcactgccacgaggact

SEQ ID NO: 584971 - DNA, 20 bp, mouse
gttagtgccagggggtggta

SEQ ID NO: 584972 - DNA, 20 bp, mouse
gctggggctcctagtcctcg

SEQ ID NO: 584973 - DNA, 20 bp, mouse
ggtcatgagactctgagaac

SEQ ID NO: 584974 - DNA, 20 bp, mouse
gggcccaaggctcctggtgg

SEQ ID NO: 584975 - DNA, 20 bp, mouse
gggacccccggcccaccttt

SEQ ID NO: 584976 - DNA, 20 bp, mouse
gtttgtagcagaatcccggg

SEQ ID NO: 584977 - DNA, 20 bp, mouse
gggttgagcgacgtggagaa

SEQ ID NO: 584978 - DNA, 20 bp, mouse
gcgacgtggagaagggctcc

SEQ ID NO: 584979 - DNA, 20 bp, mouse
gccccgcaccgcggagtgaa

SEQ ID NO: 584980 - DNA, 20 bp, mouse
gccgaggtgggaaaagatcc

SEQ ID NO: 584981 - DNA, 20 bp, mouse
gccacttgccattcactccg

SEQ ID NO: 584982 - DNA, 20 bp, mouse
ggtcgctcaaccccgcaccg

SEQ ID NO: 584983 - DNA, 20 bp, mouse
ggagcctgagggcggagcac

SEQ ID NO: 584984 - DNA, 20 bp, mouse
gcttagtgagtccggagggt

SEQ ID NO: 584985 - DNA, 20 bp, mouse
gatctgagtccggcttaccg

SEQ ID NO: 584986 - DNA, 20 bp, mouse
gaggcgcgagttcttcggag

SEQ ID NO: 584987 - DNA, 20 bp, mouse
gggcacaggcgcgagttctt

SEQ ID NO: 584988 - DNA, 20 bp, mouse
gttcttcggagcggcagccg

SEQ ID NO: 584989 - DNA, 20 bp, mouse
gcagcgagcgtggtgaggaa

SEQ ID NO: 584990 - DNA, 20 bp, mouse
gggatggcgaccgcgggcac

SEQ ID NO: 584991 - DNA, 20 bp, mouse
ggagaggaaaggacagccca

SEQ ID NO: 584992 - DNA, 20 bp, mouse
gcggcctcattgctctgcca

SEQ ID NO: 584993 - DNA, 20 bp, mouse
gaggcacgctccaagcagga

SEQ ID NO: 584994 - DNA, 20 bp, mouse
gcccgcggtcgccatcctct

SEQ ID NO: 584995 - DNA, 20 bp, mouse
gcggctacggccaagcggga

SEQ ID NO: 584996 - DNA, 20 bp, mouse
gcaggaggctgacttctggg

SEQ ID NO: 584997 - DNA, 20 bp, mouse
gctgctcggcaagtcagtgc

SEQ ID NO: 584998 - DNA, 20 bp, mouse
gcgtcttgagagccaggtcc

SEQ ID NO: 584999 - DNA, 20 bp, mouse
gttctaattatcgagaggag

SEQ ID NO: 585000 - DNA, 20 bp, mouse
gacccagacgcggagtgagg

SEQ ID NO: 585001 - DNA, 20 bp, mouse
ggacagcaccagcccggacc

SEQ ID NO: 585002 - DNA, 20 bp, mouse
gcggagcaagagaccgtcca

SEQ ID NO: 585003 - DNA, 20 bp, mouse
ggagcgcgggatccacccag

SEQ ID NO: 585004 - DNA, 20 bp, mouse
gcttgcttctaattatcgag

SEQ ID NO: 585005 - DNA, 20 bp, mouse
ggacttctgggaggctggcg

SEQ ID NO: 585006 - DNA, 20 bp, mouse
ggctagggaacaaaccgcag

SEQ ID NO: 585007 - DNA, 20 bp, mouse
gctcgagacctgagcagcta

SEQ ID NO: 585008 - DNA, 20 bp, mouse
gcctagcccgggccatggaa

SEQ ID NO: 585009 - DNA, 20 bp, mouse
ggagcgtcccgtcccgccag

SEQ ID NO: 585010 - DNA, 20 bp, mouse
gcgagcgcagcgtagagcca

SEQ ID NO: 585011 - DNA, 20 bp, mouse
gaacaaaccgcagcggtcca

SEQ ID NO: 585012 - DNA, 20 bp, mouse
ggggtcctcgaagcgtaccc

SEQ ID NO: 585013 - DNA, 20 bp, mouse
gagggcccggagaccgagcg

SEQ ID NO: 585014 - DNA, 20 bp, mouse
gcaggtctcgaggccgctgg

SEQ ID NO: 585015 - DNA, 20 bp, mouse
gggggctccctggaccgctg

SEQ ID NO: 585016 - DNA, 20 bp, mouse
gacgcagatgggtccatgct

SEQ ID NO: 585017 - DNA, 20 bp, mouse
ggcagatggcccacgcagat

SEQ ID NO: 585018 - DNA, 20 bp, mouse
gccgcagacgaggcacactg

SEQ ID NO: 585019 - DNA, 20 bp, mouse
gaccaggccagccacttata

SEQ ID NO: 585020 - DNA, 20 bp, mouse
gtgatgctagggatgactgt

SEQ ID NO: 585021 - DNA, 20 bp, mouse
ggggtctgggcagacatcaa

SEQ ID NO: 585022 - DNA, 20 bp, mouse
gctgagagccatggccaaag

SEQ ID NO: 585023 - DNA, 20 bp, mouse
gtgtaggagagccgcagacg

SEQ ID NO: 585024 - DNA, 20 bp, mouse
gaatcagccagcagcagcat

SEQ ID NO: 585025 - DNA, 20 bp, mouse
gcacactggggctgggacca

SEQ ID NO: 585026 - DNA, 20 bp, mouse
gcaggatctgtcacaactcg

SEQ ID NO: 585027 - DNA, 20 bp, mouse
gcctggcctgaaacccacac

SEQ ID NO: 585028 - DNA, 20 bp, mouse
gacactggctctggcaggat

SEQ ID NO: 585029 - DNA, 20 bp, mouse
ggagggcagccccaccacag

SEQ ID NO: 585030 - DNA, 20 bp, mouse
gggtatgtgagatgaggcgg

SEQ ID NO: 585031 - DNA, 20 bp, mouse
gctcagtgtggctggctcaa

SEQ ID NO: 585032 - DNA, 20 bp, mouse
gtgattgcggagctctgggg

SEQ ID NO: 585033 - DNA, 20 bp, mouse
gcggatggcaccctgattca

SEQ ID NO: 585034 - DNA, 20 bp, mouse
gctcaagggtatgtgagatg

SEQ ID NO: 585035 - DNA, 20 bp, mouse
gccatccgaggcaaagaagg

SEQ ID NO: 585036 - DNA, 20 bp, mouse
ggaagtccgggaagtccgac

SEQ ID NO: 585037 - DNA, 20 bp, mouse
gggtccccagggacgacgac

SEQ ID NO: 585038 - DNA, 20 bp, mouse
ggcgccctcttaggagagag

SEQ ID NO: 585039 - DNA, 20 bp, mouse
gccccagggacgacgaccgg

SEQ ID NO: 585040 - DNA, 20 bp, mouse
ggggccagtcggagtcctgt

SEQ ID NO: 585041 - DNA, 20 bp, mouse
gcccgccggtcgtcgtccct

SEQ ID NO: 585042 - DNA, 20 bp, mouse
gcgacgaccggcgggccagt

SEQ ID NO: 585043 - DNA, 20 bp, mouse
gagtccgacaggactccgac

SEQ ID NO: 585044 - DNA, 20 bp, mouse
gtccgcgcggccccgaagtc

SEQ ID NO: 585045 - DNA, 20 bp, mouse
gcaccgcgctgggtgttcac

SEQ ID NO: 585046 - DNA, 20 bp, mouse
gctcggaccgcagcaggcag

SEQ ID NO: 585047 - DNA, 20 bp, mouse
gagcgcgcgccgcaggacag

SEQ ID NO: 585048 - DNA, 20 bp, mouse
gcggctcgcccggcccatcg

SEQ ID NO: 585049 - DNA, 20 bp, mouse
ggcgccgcaggacagcggag

SEQ ID NO: 585050 - DNA, 20 bp, mouse
gaggcagcggcgtcctcctc

SEQ ID NO: 585051 - DNA, 20 bp, mouse
gaggacgccgctgcctgctg

SEQ ID NO: 585052 - DNA, 20 bp, mouse
gcttgagcaacctgagccgg

SEQ ID NO: 585053 - DNA, 20 bp, mouse
gggtggccacgacaaaggag

SEQ ID NO: 585054 - DNA, 20 bp, mouse
ggagccgctccgctgtcctg

SEQ ID NO: 585055 - DNA, 20 bp, mouse
gggcaacgagatgcttggtg

SEQ ID NO: 585056 - DNA, 20 bp, mouse
ggctgcagcggagaaagaac

SEQ ID NO: 585057 - DNA, 20 bp, mouse
ggcgccgaatccgagctcag

SEQ ID NO: 585058 - DNA, 20 bp, mouse
ggcgcccctgagctcggatt

SEQ ID NO: 585059 - DNA, 20 bp, mouse
ggctccagagagggaccggg

SEQ ID NO: 585060 - DNA, 20 bp, mouse
gaaagaaccggcgcccggcg

SEQ ID NO: 585061 - DNA, 20 bp, mouse
gtggccggagtcaaacgcga

SEQ ID NO: 585062 - DNA, 20 bp, mouse
ggaggtgagtgaggccggag

SEQ ID NO: 585063 - DNA, 20 bp, mouse
gcgaccgggtgtgcaagtgt

SEQ ID NO: 585064 - DNA, 20 bp, mouse
ggaggggagagtccacagta

SEQ ID NO: 585065 - DNA, 20 bp, mouse
gccgtgctgagaccgagggg

SEQ ID NO: 585066 - DNA, 20 bp, mouse
ggagacgcgcggagatgctg

SEQ ID NO: 585067 - DNA, 20 bp, mouse
gccaggagcttgagtcgggg

SEQ ID NO: 585068 - DNA, 20 bp, mouse
ggcgccaggagcttgagtcg

SEQ ID NO: 585069 - DNA, 20 bp, mouse
ggagatgctgcggcgcgaga

SEQ ID NO: 585070 - DNA, 20 bp, mouse
gcagcgacgacagaggcgaa

SEQ ID NO: 585071 - DNA, 20 bp, mouse
gcgcaggagaggctccaaca

SEQ ID NO: 585072 - DNA, 20 bp, mouse
gagcttgagtcggggaggcc

SEQ ID NO: 585073 - DNA, 20 bp, mouse
ggaacgcagagggagtccgg

SEQ ID NO: 585074 - DNA, 20 bp, mouse
gaagctcggagagggatcct

SEQ ID NO: 585075 - DNA, 20 bp, mouse
gagctccgcgccaagaatgg

SEQ ID NO: 585076 - DNA, 20 bp, mouse
gccgcaggaactggatagag

SEQ ID NO: 585077 - DNA, 20 bp, mouse
ggaacaaccccagagactca

SEQ ID NO: 585078 - DNA, 20 bp, mouse
ggaacaagccccgcaggaac

SEQ ID NO: 585079 - DNA, 20 bp, mouse
gtcatctgcttggggcccta

SEQ ID NO: 585080 - DNA, 20 bp, mouse
gtgcagtgaacaagccccgc

SEQ ID NO: 585081 - DNA, 20 bp, mouse
gctgcccagcacctcacttc

SEQ ID NO: 585082 - DNA, 20 bp, mouse
gcccaatggaggcttctaca

SEQ ID NO: 585083 - DNA, 20 bp, mouse
ggacagtccaccagacccaa

SEQ ID NO: 585084 - DNA, 20 bp, mouse
gatagagaggtcatctgctt

SEQ ID NO: 585085 - DNA, 20 bp, mouse
gactaaatacaaactcctta

SEQ ID NO: 585086 - DNA, 20 bp, mouse
gcagtagcggtactgagtag

SEQ ID NO: 585087 - DNA, 20 bp, mouse
ggccgaggcccgcgcagtag

SEQ ID NO: 585088 - DNA, 20 bp, mouse
gggccgagggtacccgagag

SEQ ID NO: 585089 - DNA, 20 bp, mouse
ggcgggaagagagagaccgg

SEQ ID NO: 585090 - DNA, 20 bp, mouse
ggcgggcctcggcccctctc

SEQ ID NO: 585091 - DNA, 20 bp, mouse
gcggccctggccagcatctc

SEQ ID NO: 585092 - DNA, 20 bp, mouse
gtagcagggcaggtgggtgt

SEQ ID NO: 585093 - DNA, 20 bp, mouse
gggttctgggcaccgagcgg

SEQ ID NO: 585094 - DNA, 20 bp, mouse
gggcccctctcgggtaccct

SEQ ID NO: 585095 - DNA, 20 bp, mouse
gcgccccacccggcaccagg

SEQ ID NO: 585096 - DNA, 20 bp, mouse
ggatcccagcgcaaaggtga

SEQ ID NO: 585097 - DNA, 20 bp, mouse
gccatagagacagcgacgtg

SEQ ID NO: 585098 - DNA, 20 bp, mouse
ggccgcagcagtagatactg

SEQ ID NO: 585099 - DNA, 20 bp, mouse
gcccaggcagacggacatca

SEQ ID NO: 585100 - DNA, 20 bp, mouse
gggcgcccccgactccgaga

SEQ ID NO: 585101 - DNA, 20 bp, mouse
gtggcgtccggcgggatcga

SEQ ID NO: 585102 - DNA, 20 bp, mouse
ggacagcgacgtgcggctcg

SEQ ID NO: 585103 - DNA, 20 bp, mouse
gcgcataaaagggtttagag

SEQ ID NO: 585104 - DNA, 20 bp, mouse
gcctccaccccgcctcgctc

SEQ ID NO: 585105 - DNA, 20 bp, mouse
ggtcgctgtctctatggacc

SEQ ID NO: 585106 - DNA, 20 bp, mouse
gaggaaggcggcgtcagcag

SEQ ID NO: 585107 - DNA, 20 bp, mouse
ggggctgaggagcccacccg

SEQ ID NO: 585108 - DNA, 20 bp, mouse
gggtctactcgctaggaagg

SEQ ID NO: 585109 - DNA, 20 bp, mouse
gtggggccaccgtcagccaa

SEQ ID NO: 585110 - DNA, 20 bp, mouse
gcgagagagggcgaccggtg

SEQ ID NO: 585111 - DNA, 20 bp, mouse
gtgtactacgagggaagtcg

SEQ ID NO: 585112 - DNA, 20 bp, mouse
gctgaggagcccacccgcgg

SEQ ID NO: 585113 - DNA, 20 bp, mouse
gacaggctcgcgccgagaga

SEQ ID NO: 585114 - DNA, 20 bp, mouse
gccggtgaggtggcaaagtt

SEQ ID NO: 585115 - DNA, 20 bp, mouse
ggctggtctactcgctagga

SEQ ID NO: 585116 - DNA, 20 bp, mouse
gggagctagttggagcgcgg

SEQ ID NO: 585117 - DNA, 20 bp, mouse
gcgcggggtctggagctagt

SEQ ID NO: 585118 - DNA, 20 bp, mouse
gaccacagcgacgaacccga

SEQ ID NO: 585119 - DNA, 20 bp, mouse
gcggtcggccgcgcatccag

SEQ ID NO: 585120 - DNA, 20 bp, mouse
ggatgcgcggccgaccggcg

SEQ ID NO: 585121 - DNA, 20 bp, mouse
gagccgggaggaggagagtg

SEQ ID NO: 585122 - DNA, 20 bp, mouse
gagctcccggactcacctcc

SEQ ID NO: 585123 - DNA, 20 bp, mouse
gagccgggcccgacaggagt

SEQ ID NO: 585124 - DNA, 20 bp, mouse
gcgacaggagtcggagactg

SEQ ID NO: 585125 - DNA, 20 bp, mouse
gtctggagctagttggagcg

SEQ ID NO: 585126 - DNA, 20 bp, mouse
ggctcctaggcgggcatctc

SEQ ID NO: 585127 - DNA, 20 bp, mouse
gggcgctcgggacgcagcac

SEQ ID NO: 585128 - DNA, 20 bp, mouse
gcagcacaggcgcttttccg

SEQ ID NO: 585129 - DNA, 20 bp, mouse
gctcggctgcctaggcgctc

SEQ ID NO: 585130 - DNA, 20 bp, mouse
ggcggccgcacgctcctagg

SEQ ID NO: 585131 - DNA, 20 bp, mouse
ggccgcggccgcacgctcct

SEQ ID NO: 585132 - DNA, 20 bp, mouse
gcctaggcagccgagtgcgt

SEQ ID NO: 585133 - DNA, 20 bp, mouse
gcagccgagtgcgtggggag

SEQ ID NO: 585134 - DNA, 20 bp, mouse
gtctcgggcaatcggcaccg

SEQ ID NO: 585135 - DNA, 20 bp, mouse
ggagtgcagtgtcccgggtg

SEQ ID NO: 585136 - DNA, 20 bp, mouse
ggcggagctgcgagtcgcag

SEQ ID NO: 585137 - DNA, 20 bp, mouse
ggagctgcgagtcgcagcgg

SEQ ID NO: 585138 - DNA, 20 bp, mouse
gctgcgagtcgcagcggcgg

SEQ ID NO: 585139 - DNA, 20 bp, mouse
gcagcgcggtgtcccggccg

SEQ ID NO: 585140 - DNA, 20 bp, mouse
gagcccgggctcccacgcgc

SEQ ID NO: 585141 - DNA, 20 bp, mouse
gcgcccgcgcgtgggagccc

SEQ ID NO: 585142 - DNA, 20 bp, mouse
ggatgcacgggggacagatg

SEQ ID NO: 585143 - DNA, 20 bp, mouse
gcgcgccggggcactgacag

SEQ ID NO: 585144 - DNA, 20 bp, mouse
gcacgcgcgggcggctcccg

SEQ ID NO: 585145 - DNA, 20 bp, mouse
gccccgcagcgtctcagccc

SEQ ID NO: 585146 - DNA, 20 bp, mouse
ggccctgaccgttagaacag

SEQ ID NO: 585147 - DNA, 20 bp, mouse
gtggagggaatatcagcccc

SEQ ID NO: 585148 - DNA, 20 bp, mouse
gggagatcagaagccacagt

SEQ ID NO: 585149 - DNA, 20 bp, mouse
gaggggctgatgttagcctg

SEQ ID NO: 585150 - DNA, 20 bp, mouse
gacatcagcccctgttctaa

SEQ ID NO: 585151 - DNA, 20 bp, mouse
ggatcagaagccacagtggg

SEQ ID NO: 585152 - DNA, 20 bp, mouse
ggcccctgttctaacggtca

SEQ ID NO: 585153 - DNA, 20 bp, mouse
gacggtcagggccaaaaaac

SEQ ID NO: 585154 - DNA, 20 bp, mouse
ggcttctgagaaacccacgt

SEQ ID NO: 585155 - DNA, 20 bp, mouse
gctccaagacacaaggtcag

SEQ ID NO: 585156 - DNA, 20 bp, mouse
gcgatctgcggcgggaatag

SEQ ID NO: 585157 - DNA, 20 bp, mouse
gtagactccagggcactgtc

SEQ ID NO: 585158 - DNA, 20 bp, mouse
ggggctcgtactcggacccg

SEQ ID NO: 585159 - DNA, 20 bp, mouse
ggtcgggttacaagagcctc

SEQ ID NO: 585160 - DNA, 20 bp, mouse
ggggaataggggctcgtact

SEQ ID NO: 585161 - DNA, 20 bp, mouse
gtcctccgccgatctgcggc

SEQ ID NO: 585162 - DNA, 20 bp, mouse
gtcccgccgcagatcggcgg

SEQ ID NO: 585163 - DNA, 20 bp, mouse
gtccgggtcagcaaggtcca

SEQ ID NO: 585164 - DNA, 20 bp, mouse
gtctcggagcaagtaccttg

SEQ ID NO: 585165 - DNA, 20 bp, mouse
ggtgtcacagggactcgagt

SEQ ID NO: 585166 - DNA, 20 bp, mouse
gtactccagggccggcacat

SEQ ID NO: 585167 - DNA, 20 bp, mouse
gggccggcacatgggtgagg

SEQ ID NO: 585168 - DNA, 20 bp, mouse
gggcgtgagctgccccgcac

SEQ ID NO: 585169 - DNA, 20 bp, mouse
gggtgagggggtaccccctg

SEQ ID NO: 585170 - DNA, 20 bp, mouse
ggggcacggggcatcctgtg

SEQ ID NO: 585171 - DNA, 20 bp, mouse
gagcagcaggggcatggagt

SEQ ID NO: 585172 - DNA, 20 bp, mouse
gccccccaagtgggcaaagt

SEQ ID NO: 585173 - DNA, 20 bp, mouse
ggggcagctcacgccccagg

SEQ ID NO: 585174 - DNA, 20 bp, mouse
gtaccccctcacccatgtgc

SEQ ID NO: 585175 - DNA, 20 bp, mouse
gcccagggatgagaagcgtg

SEQ ID NO: 585176 - DNA, 20 bp, mouse
ggccgctccgcaagccgtca

SEQ ID NO: 585177 - DNA, 20 bp, mouse
ggccccgcagcgaggaaggc

SEQ ID NO: 585178 - DNA, 20 bp, mouse
gaccctgacggcttgcggag

SEQ ID NO: 585179 - DNA, 20 bp, mouse
gccaagccccgcagcgagga

SEQ ID NO: 585180 - DNA, 20 bp, mouse
gtggctgggagacccgcgag

SEQ ID NO: 585181 - DNA, 20 bp, mouse
ggtcttgtagcctggagcag

SEQ ID NO: 585182 - DNA, 20 bp, mouse
ggagcccgccttcctcgctg

SEQ ID NO: 585183 - DNA, 20 bp, mouse
gctggaggagacccggtcta

SEQ ID NO: 585184 - DNA, 20 bp, mouse
gaaagcacgcaaagttgcgg

SEQ ID NO: 585185 - DNA, 20 bp, mouse
gcctctggctgcgaaagacg

SEQ ID NO: 585186 - DNA, 20 bp, mouse
gcgcagccccggagcgacag

SEQ ID NO: 585187 - DNA, 20 bp, mouse
gtcctctgtggaggagagag

SEQ ID NO: 585188 - DNA, 20 bp, mouse
ggcgggagcccgaaccgagc

SEQ ID NO: 585189 - DNA, 20 bp, mouse
gccgggcgctgtctcagtct

SEQ ID NO: 585190 - DNA, 20 bp, mouse
ggggcggcacgtccgggagg

SEQ ID NO: 585191 - DNA, 20 bp, mouse
gctccgccgtctggaaaggt

SEQ ID NO: 585192 - DNA, 20 bp, mouse
ggcttgccgctgtcgctccg

SEQ ID NO: 585193 - DNA, 20 bp, mouse
gcccaaggccactcgaggag

SEQ ID NO: 585194 - DNA, 20 bp, mouse
gagtggcgctccaagtccaa

SEQ ID NO: 585195 - DNA, 20 bp, mouse
gtgggggcggcacgtccggg

SEQ ID NO: 585196 - DNA, 20 bp, mouse
ggcaaagcccgggaacctcc

SEQ ID NO: 585197 - DNA, 20 bp, mouse
gccggttcccggaggttccc

SEQ ID NO: 585198 - DNA, 20 bp, mouse
gaaccggctgctaggcaaag

SEQ ID NO: 585199 - DNA, 20 bp, mouse
gggcgcggaccgcaaagccc

SEQ ID NO: 585200 - DNA, 20 bp, mouse
gccgcgaccgggcagcaggg

SEQ ID NO: 585201 - DNA, 20 bp, mouse
gagaaggttccggttcccgg

SEQ ID NO: 585202 - DNA, 20 bp, mouse
ggttccggttcggtgagtgg

SEQ ID NO: 585203 - DNA, 20 bp, mouse
gctagcagccggttccggtt

SEQ ID NO: 585204 - DNA, 20 bp, mouse
gcgagcggaaaggaggacgg

SEQ ID NO: 585205 - DNA, 20 bp, mouse
gccgccgccactcaccgaac

SEQ ID NO: 585206 - DNA, 20 bp, mouse
gccgcgcctgatcctggcta

SEQ ID NO: 585207 - DNA, 20 bp, mouse
gatcctggctacggctgaag

SEQ ID NO: 585208 - DNA, 20 bp, mouse
ggctacggctgaagcggcga

SEQ ID NO: 585209 - DNA, 20 bp, mouse
ggagcgccgcctcttgagta

SEQ ID NO: 585210 - DNA, 20 bp, mouse
gccgcgccctactcaagagg

SEQ ID NO: 585211 - DNA, 20 bp, mouse
gggcggcggcgacagctctg

SEQ ID NO: 585212 - DNA, 20 bp, mouse
gggcgctccagcaggtaagg

SEQ ID NO: 585213 - DNA, 20 bp, mouse
gacaagtccgcgcctgatcc

SEQ ID NO: 585214 - DNA, 20 bp, mouse
gggcccgcgccctactcaag

SEQ ID NO: 585215 - DNA, 20 bp, mouse
gccgctcgcagctagaggga

SEQ ID NO: 585216 - DNA, 20 bp, mouse
gaattgcgcgccgccatcgg

SEQ ID NO: 585217 - DNA, 20 bp, mouse
gggcctggggctcgcgggag

SEQ ID NO: 585218 - DNA, 20 bp, mouse
gccaggcccaccgccgatgg

SEQ ID NO: 585219 - DNA, 20 bp, mouse
ggctagagccgcgctagagg

SEQ ID NO: 585220 - DNA, 20 bp, mouse
gtgctcgtgccgccccactg

SEQ ID NO: 585221 - DNA, 20 bp, mouse
gcgcctgaggatagcaggag

SEQ ID NO: 585222 - DNA, 20 bp, mouse
ggctagaggcggccgcagtg

SEQ ID NO: 585223 - DNA, 20 bp, mouse
ggaggctagagccgcgctag

SEQ ID NO: 585224 - DNA, 20 bp, mouse
gagaggcggccgcagtgggg

SEQ ID NO: 585225 - DNA, 20 bp, mouse
gtgagccggaaagcctaagt

SEQ ID NO: 585226 - DNA, 20 bp, mouse
gcggccgagcttcctcccag

SEQ ID NO: 585227 - DNA, 20 bp, mouse
ggtgtcgcgctgccgctggg

SEQ ID NO: 585228 - DNA, 20 bp, mouse
gctgctttcggccggcaagg

SEQ ID NO: 585229 - DNA, 20 bp, mouse
gctgccgctgggaggaagct

SEQ ID NO: 585230 - DNA, 20 bp, mouse
gcgaaagcaggccggagccc

SEQ ID NO: 585231 - DNA, 20 bp, mouse
ggctccggcctgctttcggc

SEQ ID NO: 585232 - DNA, 20 bp, mouse
gttgccggccgaaagcaggc

SEQ ID NO: 585233 - DNA, 20 bp, mouse
gtgccgggagcaaagaacgt

SEQ ID NO: 585234 - DNA, 20 bp, mouse
ggagaccagcgcccactagg

SEQ ID NO: 585235 - DNA, 20 bp, mouse
gaggccagccaccggggctc

SEQ ID NO: 585236 - DNA, 20 bp, mouse
gagagcatcagcccaggcct

SEQ ID NO: 585237 - DNA, 20 bp, mouse
gagcggagggagctcctcag

SEQ ID NO: 585238 - DNA, 20 bp, mouse
gtccacatggacagtcgccg

SEQ ID NO: 585239 - DNA, 20 bp, mouse
ggcctcggcgactgtccatg

SEQ ID NO: 585240 - DNA, 20 bp, mouse
gtggacagtcgccgaggcct

SEQ ID NO: 585241 - DNA, 20 bp, mouse
gccactgctggagcagcgag

SEQ ID NO: 585242 - DNA, 20 bp, mouse
gcgactgtccatgtggacgg

SEQ ID NO: 585243 - DNA, 20 bp, mouse
gtgatgctctgacgcctggg

SEQ ID NO: 585244 - DNA, 20 bp, mouse
gctctgacgcctgggcgggg

SEQ ID NO: 585245 - DNA, 20 bp, mouse
gcgtcctccggagccagcgg

SEQ ID NO: 585246 - DNA, 20 bp, mouse
gcccagcccgaggggtcctg

SEQ ID NO: 585247 - DNA, 20 bp, mouse
gggtgacagcgcctggaagt

SEQ ID NO: 585248 - DNA, 20 bp, mouse
ggtgggactggaggagccgg

SEQ ID NO: 585249 - DNA, 20 bp, mouse
ggacccctcgggctggggaa

SEQ ID NO: 585250 - DNA, 20 bp, mouse
ggccgcgcaggtacaatggt

SEQ ID NO: 585251 - DNA, 20 bp, mouse
gttccaggcgctgtcacctc

SEQ ID NO: 585252 - DNA, 20 bp, mouse
ggccagccgcgcaggtacaa

SEQ ID NO: 585253 - DNA, 20 bp, mouse
gctcccttccccagcccgag

SEQ ID NO: 585254 - DNA, 20 bp, mouse
gacctcaggacccctcgggc

SEQ ID NO: 585255 - DNA, 20 bp, mouse
gtcaaggagcgtgtcccggg

SEQ ID NO: 585256 - DNA, 20 bp, mouse
ggagctccctgaaggctggt

SEQ ID NO: 585257 - DNA, 20 bp, mouse
gccttcagggagctctgtac

SEQ ID NO: 585258 - DNA, 20 bp, mouse
gactgagacaaacctaagta

SEQ ID NO: 585259 - DNA, 20 bp, mouse
gttggtgaggcctgaggaat

SEQ ID NO: 585260 - DNA, 20 bp, mouse
ggagacaaacctaagtaggg

SEQ ID NO: 585261 - DNA, 20 bp, mouse
gggcgtcttacctattcctc

SEQ ID NO: 585262 - DNA, 20 bp, mouse
gagacgcctcctccctactt

SEQ ID NO: 585263 - DNA, 20 bp, mouse
gcacgggggcgggaacaagt

SEQ ID NO: 585264 - DNA, 20 bp, mouse
ggcgtgcgtgtgtggaaaag

SEQ ID NO: 585265 - DNA, 20 bp, mouse
gccagctgcagaatgaggaa

SEQ ID NO: 585266 - DNA, 20 bp, mouse
gtcctaaactccccacaccg

SEQ ID NO: 585267 - DNA, 20 bp, mouse
gtgaataagaagccccggtg

SEQ ID NO: 585268 - DNA, 20 bp, mouse
ggaggaggcggggctactga

SEQ ID NO: 585269 - DNA, 20 bp, mouse
gtgtcgtgaataagaagccc

SEQ ID NO: 585270 - DNA, 20 bp, mouse
ggcagtgcagtggacgtccc

SEQ ID NO: 585271 - DNA, 20 bp, mouse
ggtctgccgtcaatcttcag

SEQ ID NO: 585272 - DNA, 20 bp, mouse
ggccccggtgtggggagttt

SEQ ID NO: 585273 - DNA, 20 bp, mouse
gcggcagaccgcagggatgg

SEQ ID NO: 585274 - DNA, 20 bp, mouse
ggtggacgtccccggcacag

SEQ ID NO: 585275 - DNA, 20 bp, mouse
gtgagtgtggaccgcctctg

SEQ ID NO: 585276 - DNA, 20 bp, mouse
gcgcaaagcgagccggtaag

SEQ ID NO: 585277 - DNA, 20 bp, mouse
gcggagggcgcaaagcgagc

SEQ ID NO: 585278 - DNA, 20 bp, mouse
gcgccaggcccgccgcttac

SEQ ID NO: 585279 - DNA, 20 bp, mouse
ggcccgttttcgggaggagg

SEQ ID NO: 585280 - DNA, 20 bp, mouse
gaaagcgagccggtaagcgg

SEQ ID NO: 585281 - DNA, 20 bp, mouse
ggttttcgggaggaggcgga

SEQ ID NO: 585282 - DNA, 20 bp, mouse
gcgaggcagcaggcttaaag

SEQ ID NO: 585283 - DNA, 20 bp, mouse
gtcctcccgaaaacgggccg

SEQ ID NO: 585284 - DNA, 20 bp, mouse
ggccgcggcccgttttcggg

SEQ ID NO: 585285 - DNA, 20 bp, mouse
gccgagcccaggctttggtg

SEQ ID NO: 585286 - DNA, 20 bp, mouse
gaccacgcgagccggaccgg

SEQ ID NO: 585287 - DNA, 20 bp, mouse
gcgcgtggttgatcatctcc

SEQ ID NO: 585288 - DNA, 20 bp, mouse
gtcaaccacgcgagccggac

SEQ ID NO: 585289 - DNA, 20 bp, mouse
gtcccagccacagcgggcca

SEQ ID NO: 585290 - DNA, 20 bp, mouse
gggccgcgcggcgctccgac

SEQ ID NO: 585291 - DNA, 20 bp, mouse
ggcgtaaccttggcccgctg

SEQ ID NO: 585292 - DNA, 20 bp, mouse
gcagcgtggctcgagtcctc

SEQ ID NO: 585293 - DNA, 20 bp, mouse
gccagtgtctggggctcgaa

SEQ ID NO: 585294 - DNA, 20 bp, mouse
gggcgccagcggagaaacca

SEQ ID NO: 585295 - DNA, 20 bp, mouse
gccagacccgaggtaagcgg

SEQ ID NO: 585296 - DNA, 20 bp, mouse
ggcggctccggggatcccgg

SEQ ID NO: 585297 - DNA, 20 bp, mouse
gtgcagggaaggggatcgca

SEQ ID NO: 585298 - DNA, 20 bp, mouse
ggcccgggcagcggcgacag

SEQ ID NO: 585299 - DNA, 20 bp, mouse
gctggcctggcccatggcgg

SEQ ID NO: 585300 - DNA, 20 bp, mouse
gtccccggagccgccgccat

SEQ ID NO: 585301 - DNA, 20 bp, mouse
gaccccgcaccagggaaggg

SEQ ID NO: 585302 - DNA, 20 bp, mouse
gagcgcgcaggcccgggcag

SEQ ID NO: 585303 - DNA, 20 bp, mouse
gagggctccgagcagcgcca

SEQ ID NO: 585304 - DNA, 20 bp, mouse
gatcccggcggctgcaggga

SEQ ID NO: 585305 - DNA, 20 bp, mouse
gggccgcgcggcaggtcgga

SEQ ID NO: 585306 - DNA, 20 bp, mouse
gggacgaagctagtccgaag

SEQ ID NO: 585307 - DNA, 20 bp, mouse
gctaactagagcaaagagac

SEQ ID NO: 585308 - DNA, 20 bp, mouse
gcctacttacgcaacccctt

SEQ ID NO: 585309 - DNA, 20 bp, mouse
gagcagctccccaaagccac

SEQ ID NO: 585310 - DNA, 20 bp, mouse
gcccacgaagggttagagtg

SEQ ID NO: 585311 - DNA, 20 bp, mouse
gtaatgaacaagaagtgtcg

SEQ ID NO: 585312 - DNA, 20 bp, mouse
gtgtactgtagaggtgtcca

SEQ ID NO: 585313 - DNA, 20 bp, mouse
gaaaagtcagtgtcagcctg

SEQ ID NO: 585314 - DNA, 20 bp, mouse
gacacctctacagtacagtg

SEQ ID NO: 585315 - DNA, 20 bp, mouse
ggggaactgtggtgtcatat

SEQ ID NO: 585316 - DNA, 20 bp, mouse
gaagctctccgggttcatga

SEQ ID NO: 585317 - DNA, 20 bp, mouse
ggtgggcgccgtcatgaacc

SEQ ID NO: 585318 - DNA, 20 bp, mouse
ggcccgccgcgaagctctcc

SEQ ID NO: 585319 - DNA, 20 bp, mouse
gatgaacccggagagcttcg

SEQ ID NO: 585320 - DNA, 20 bp, mouse
gggcgagcggcgggtgtctc

SEQ ID NO: 585321 - DNA, 20 bp, mouse
gggtgtctccggcttacgtg

SEQ ID NO: 585322 - DNA, 20 bp, mouse
gacccggagagcttcgcggc

SEQ ID NO: 585323 - DNA, 20 bp, mouse
gagccggatgaggtgctcgt

SEQ ID NO: 585324 - DNA, 20 bp, mouse
ggacagctccgcacacacca

SEQ ID NO: 585325 - DNA, 20 bp, mouse
gcggagctgtcaaagtccaa

SEQ ID NO: 585326 - DNA, 20 bp, mouse
gagccatggtgagttctcgg

SEQ ID NO: 585327 - DNA, 20 bp, mouse
gttgaactggggaccctcga

SEQ ID NO: 585328 - DNA, 20 bp, mouse
gcacaggacaaggaatatgt

SEQ ID NO: 585329 - DNA, 20 bp, mouse
gtgccccaccagaggaagtg

SEQ ID NO: 585330 - DNA, 20 bp, mouse
gggaagtggggagcaacacc

SEQ ID NO: 585331 - DNA, 20 bp, mouse
gggccagctctctccctcga

SEQ ID NO: 585332 - DNA, 20 bp, mouse
gcctgaatgactagattcct

SEQ ID NO: 585333 - DNA, 20 bp, mouse
ggaactcaccatggctctgc

SEQ ID NO: 585334 - DNA, 20 bp, mouse
gcgatgcagctggttgggca

SEQ ID NO: 585335 - DNA, 20 bp, mouse
ggggcctgtcccgtacacag

SEQ ID NO: 585336 - DNA, 20 bp, mouse
gccctcgtagagcagatcgt

SEQ ID NO: 585337 - DNA, 20 bp, mouse
gaggtcgagccagactctgt

SEQ ID NO: 585338 - DNA, 20 bp, mouse
gctgaacctgaggcggatgt

SEQ ID NO: 585339 - DNA, 20 bp, mouse
gtgtcagccagaggcaacat

SEQ ID NO: 585340 - DNA, 20 bp, mouse
gtgggaagccgagttaagaa

SEQ ID NO: 585341 - DNA, 20 bp, mouse
gctgctctacgagggctacc

SEQ ID NO: 585342 - DNA, 20 bp, mouse
gtctttcaagtcctgaaggt

SEQ ID NO: 585343 - DNA, 20 bp, mouse
gactctgtaggcagcgagcc

SEQ ID NO: 585344 - DNA, 20 bp, mouse
gcacctctttcaagtcctga

SEQ ID NO: 585345 - DNA, 20 bp, mouse
gagtgtgggagaggcttagt

SEQ ID NO: 585346 - DNA, 20 bp, mouse
ggtgggacgtagggaaacgg

SEQ ID NO: 585347 - DNA, 20 bp, mouse
gtcaggctggacgcaaacac

SEQ ID NO: 585348 - DNA, 20 bp, mouse
gatagccctggtgggacgta

SEQ ID NO: 585349 - DNA, 20 bp, mouse
gctggtgggacgtagggaaa

SEQ ID NO: 585350 - DNA, 20 bp, mouse
ggtagggaaacggtggtctc

SEQ ID NO: 585351 - DNA, 20 bp, mouse
gtccgcgtgtcgtggagagg

SEQ ID NO: 585352 - DNA, 20 bp, mouse
gggaaacggtggtctcaggc

SEQ ID NO: 585353 - DNA, 20 bp, mouse
gtctctctctgaagcggccc

SEQ ID NO: 585354 - DNA, 20 bp, mouse
ggcgtaactggcgggacaag

SEQ ID NO: 585355 - DNA, 20 bp, mouse
gacccgctgggcgtaactgg

SEQ ID NO: 585356 - DNA, 20 bp, mouse
gctcccccgcgcctccctcg

SEQ ID NO: 585357 - DNA, 20 bp, mouse
ggagcagggcgcagccgcga

SEQ ID NO: 585358 - DNA, 20 bp, mouse
gcagggcgcagccgcgaggg

SEQ ID NO: 585359 - DNA, 20 bp, mouse
gcggcgcgggcgagcagatg

SEQ ID NO: 585360 - DNA, 20 bp, mouse
gcgggagccgggcgcgagca

SEQ ID NO: 585361 - DNA, 20 bp, mouse
gcgcagccgcgagggaggcg

SEQ ID NO: 585362 - DNA, 20 bp, mouse
gctaagggcgcctcacagaa

SEQ ID NO: 585363 - DNA, 20 bp, mouse
gacagtcgcgatggccgtgg

SEQ ID NO: 585364 - DNA, 20 bp, mouse
gccccgaagcggagaccacc

SEQ ID NO: 585365 - DNA, 20 bp, mouse
gagaccgagtgtgagtactg

SEQ ID NO: 585366 - DNA, 20 bp, mouse
gctactcccagctcccccaa

SEQ ID NO: 585367 - DNA, 20 bp, mouse
gtggctcatgtagcacctgg

SEQ ID NO: 585368 - DNA, 20 bp, mouse
gacctggtggatgagtccct

SEQ ID NO: 585369 - DNA, 20 bp, mouse
gctggcaggctgcgctgagg

SEQ ID NO: 585370 - DNA, 20 bp, mouse
gggtcagaggtaggttacat

SEQ ID NO: 585371 - DNA, 20 bp, mouse
gcccaagggactcatccacc

SEQ ID NO: 585372 - DNA, 20 bp, mouse
gcagagggcagggatcggtg

SEQ ID NO: 585373 - DNA, 20 bp, mouse
gggaggaggctgggattctg

SEQ ID NO: 585374 - DNA, 20 bp, mouse
gcagagaagacagcccggga

SEQ ID NO: 585375 - DNA, 20 bp, mouse
gacttggctcatgtagcacc

SEQ ID NO: 585376 - DNA, 20 bp, mouse
gtcatgctggtataagaact

SEQ ID NO: 585377 - DNA, 20 bp, mouse
gactggttttgaaggagtcc

SEQ ID NO: 585378 - DNA, 20 bp, mouse
gggtgaagatgcaggatcaa

SEQ ID NO: 585379 - DNA, 20 bp, mouse
gccttcaagagagaaatacc

SEQ ID NO: 585380 - DNA, 20 bp, mouse
gccagatattggacattgtt

SEQ ID NO: 585381 - DNA, 20 bp, mouse
gtagtcttttatgctctggc

SEQ ID NO: 585382 - DNA, 20 bp, mouse
gaaactagtcttttatgctc

SEQ ID NO: 585383 - DNA, 20 bp, mouse
gggtagtgtaagagtcaccc

SEQ ID NO: 585384 - DNA, 20 bp, mouse
gtgtgttccagaggtgacca

SEQ ID NO: 585385 - DNA, 20 bp, mouse
gccaaggttgtacctcatgc

SEQ ID NO: 585386 - DNA, 20 bp, mouse
ggtgtgagcgggtaagtgtg

SEQ ID NO: 585387 - DNA, 20 bp, mouse
gacgccggagaacgctcgtc

SEQ ID NO: 585388 - DNA, 20 bp, mouse
gcgctggagccccggactaa

SEQ ID NO: 585389 - DNA, 20 bp, mouse
gcggccgcacccttagtccg

SEQ ID NO: 585390 - DNA, 20 bp, mouse
ggagccccggactaagggtg

SEQ ID NO: 585391 - DNA, 20 bp, mouse
gagcaggatcacccagatgg

SEQ ID NO: 585392 - DNA, 20 bp, mouse
gtcgcctgacgagcgttctc

SEQ ID NO: 585393 - DNA, 20 bp, mouse
gtcgcgcgcgctctactggg

SEQ ID NO: 585394 - DNA, 20 bp, mouse
gctcgagcccgcgcgacagt

SEQ ID NO: 585395 - DNA, 20 bp, mouse
gtgttcgcgcgcgctctact

SEQ ID NO: 585396 - DNA, 20 bp, mouse
gcgagcggaggcgaggtccc

SEQ ID NO: 585397 - DNA, 20 bp, mouse
gcccggaggacccgagacaa

SEQ ID NO: 585398 - DNA, 20 bp, mouse
ggcggaggcgaggtcccggg

SEQ ID NO: 585399 - DNA, 20 bp, mouse
gggaggacccgagacaaagg

SEQ ID NO: 585400 - DNA, 20 bp, mouse
gcacgtggtgccggtggcag

SEQ ID NO: 585401 - DNA, 20 bp, mouse
gcgccgagcgagcggaggcg

SEQ ID NO: 585402 - DNA, 20 bp, mouse
gtggacgcacgcacacccgg

SEQ ID NO: 585403 - DNA, 20 bp, mouse
gtgcgccctggacctggtaa

SEQ ID NO: 585404 - DNA, 20 bp, mouse
ggggctagggataggctcta

SEQ ID NO: 585405 - DNA, 20 bp, mouse
gtagccccttaccaggtcca

SEQ ID NO: 585406 - DNA, 20 bp, mouse
gccccgcggtgcaaagaggt

SEQ ID NO: 585407 - DNA, 20 bp, mouse
gaggctagtgggggcccccg

SEQ ID NO: 585408 - DNA, 20 bp, mouse
ggggcccccgcggtgcaaag

SEQ ID NO: 585409 - DNA, 20 bp, mouse
gggtgcgcagctcgcatcac

SEQ ID NO: 585410 - DNA, 20 bp, mouse
ggagcgggccgagaccccca

SEQ ID NO: 585411 - DNA, 20 bp, mouse
gagcggaccgcactcttgca

SEQ ID NO: 585412 - DNA, 20 bp, mouse
gtcgggctgcaaccatggta

SEQ ID NO: 585413 - DNA, 20 bp, mouse
gggtccgctggtggcagggt

SEQ ID NO: 585414 - DNA, 20 bp, mouse
gggaggagctggcccggctc

SEQ ID NO: 585415 - DNA, 20 bp, mouse
gcctcggagcagccccggag

SEQ ID NO: 585416 - DNA, 20 bp, mouse
gacctagagcgtgctgacag

SEQ ID NO: 585417 - DNA, 20 bp, mouse
gtaggtctaactttatctcc

SEQ ID NO: 585418 - DNA, 20 bp, mouse
gttggccttgacaggcatag

SEQ ID NO: 585419 - DNA, 20 bp, mouse
gtccctggcaaagctggagg

SEQ ID NO: 585420 - DNA, 20 bp, mouse
gaggaggtggatagacagat

SEQ ID NO: 585421 - DNA, 20 bp, mouse
ggacaggggtctcaagtgtg

SEQ ID NO: 585422 - DNA, 20 bp, mouse
gggagatgggtagacctaag

SEQ ID NO: 585423 - DNA, 20 bp, mouse
gaggtggtgctcggggagat

SEQ ID NO: 585424 - DNA, 20 bp, mouse
gccttggggcaccaaagact

SEQ ID NO: 585425 - DNA, 20 bp, mouse
gtcttccacttggccttgac

SEQ ID NO: 585426 - DNA, 20 bp, mouse
gggcggggcgcggcgaccag

SEQ ID NO: 585427 - DNA, 20 bp, mouse
gcgcagtcctgtgctcatgg

SEQ ID NO: 585428 - DNA, 20 bp, mouse
ggcgcggcgaccagcggtgg

SEQ ID NO: 585429 - DNA, 20 bp, mouse
gcggcggccaccatgagcac

SEQ ID NO: 585430 - DNA, 20 bp, mouse
gtcatggtggccgccggcgg

SEQ ID NO: 585431 - DNA, 20 bp, mouse
gtccgtagccccaggagcag

SEQ ID NO: 585432 - DNA, 20 bp, mouse
ggaggccgaggccggctgag

SEQ ID NO: 585433 - DNA, 20 bp, mouse
gggggcgcggcgaccagcgg

SEQ ID NO: 585434 - DNA, 20 bp, mouse
ggccggcgggggacgtgtgg

SEQ ID NO: 585435 - DNA, 20 bp, mouse
gcgaccagcggtggaggccg

SEQ ID NO: 585436 - DNA, 20 bp, mouse
ggcttcgggtgcctccgcaa

SEQ ID NO: 585437 - DNA, 20 bp, mouse
ggaggcacccgaagcagccc

SEQ ID NO: 585438 - DNA, 20 bp, mouse
gatcgctccttggtccgcca

SEQ ID NO: 585439 - DNA, 20 bp, mouse
ggcagcagctcccgttgcgg

SEQ ID NO: 585440 - DNA, 20 bp, mouse
gtaccacgaggagggcaatg

SEQ ID NO: 585441 - DNA, 20 bp, mouse
gtgtgcagcagctcccgttg

SEQ ID NO: 585442 - DNA, 20 bp, mouse
ggaccaaggagcgatggcag

SEQ ID NO: 585443 - DNA, 20 bp, mouse
gaagcagccctggcggacca

SEQ ID NO: 585444 - DNA, 20 bp, mouse
ggtagcatccaggagcaaag

SEQ ID NO: 585445 - DNA, 20 bp, mouse
gtcgccaggtggtgagtgta

SEQ ID NO: 585446 - DNA, 20 bp, mouse
gaggagaggagcgtcaactg

SEQ ID NO: 585447 - DNA, 20 bp, mouse
ggcgtcaactgcggcaccat

SEQ ID NO: 585448 - DNA, 20 bp, mouse
gatccgctgctgccgaggag

SEQ ID NO: 585449 - DNA, 20 bp, mouse
ggaacgccctggggctagag

SEQ ID NO: 585450 - DNA, 20 bp, mouse
gacgtgagcggagccagccg

SEQ ID NO: 585451 - DNA, 20 bp, mouse
gaagggaggggaggcggccg

SEQ ID NO: 585452 - DNA, 20 bp, mouse
gacgccgggcggctacgctg

SEQ ID NO: 585453 - DNA, 20 bp, mouse
gcaagagctgggctgggacg

SEQ ID NO: 585454 - DNA, 20 bp, mouse
gtcggaggcgggcaagagct

SEQ ID NO: 585455 - DNA, 20 bp, mouse
ggcgagatccgctgctgccg

SEQ ID NO: 585456 - DNA, 20 bp, mouse
gtgcgggacgcgctccgccc

SEQ ID NO: 585457 - DNA, 20 bp, mouse
gggacccgggagctaacccc

SEQ ID NO: 585458 - DNA, 20 bp, mouse
gcggctgaatggatccaata

SEQ ID NO: 585459 - DNA, 20 bp, mouse
gcgggttgcggggaacgccg

SEQ ID NO: 585460 - DNA, 20 bp, mouse
gggccgcggcggggatgagc

SEQ ID NO: 585461 - DNA, 20 bp, mouse
gagaggtgcaggaacaccct

SEQ ID NO: 585462 - DNA, 20 bp, mouse
gccgggcggctgcggctgaa

SEQ ID NO: 585463 - DNA, 20 bp, mouse
gactctgagacaccctcccg

SEQ ID NO: 585464 - DNA, 20 bp, mouse
gccctgggagagaagagtcg

SEQ ID NO: 585465 - DNA, 20 bp, mouse
gccgggagctaaccccggga

SEQ ID NO: 585466 - DNA, 20 bp, mouse
gccccggagcaaactgtgag

SEQ ID NO: 585467 - DNA, 20 bp, mouse
ggcccgactttcagctgctg

SEQ ID NO: 585468 - DNA, 20 bp, mouse
gccgcagctctccagcgtcc

SEQ ID NO: 585469 - DNA, 20 bp, mouse
gaccccagcagctgaaagtc

SEQ ID NO: 585470 - DNA, 20 bp, mouse
ggctggaagaacaaagagcg

SEQ ID NO: 585471 - DNA, 20 bp, mouse
gccgagccatgtgacccggt

SEQ ID NO: 585472 - DNA, 20 bp, mouse
gctagccggggcaagagcag

SEQ ID NO: 585473 - DNA, 20 bp, mouse
gtggttcccgcgtggagacc

SEQ ID NO: 585474 - DNA, 20 bp, mouse
gttcctgggagaataggcgg

SEQ ID NO: 585475 - DNA, 20 bp, mouse
ggacactcttcaccactcgg

SEQ ID NO: 585476 - DNA, 20 bp, mouse
gcggtcggctgaatgaatgg

SEQ ID NO: 585477 - DNA, 20 bp, mouse
gtggtgcgcagggagtcccg

SEQ ID NO: 585478 - DNA, 20 bp, mouse
ggccagctctgcaccgggag

SEQ ID NO: 585479 - DNA, 20 bp, mouse
gccggcggccagctctgcac

SEQ ID NO: 585480 - DNA, 20 bp, mouse
ggcccctcggcccccacggt

SEQ ID NO: 585481 - DNA, 20 bp, mouse
ggacgggacgggatgagcac

SEQ ID NO: 585482 - DNA, 20 bp, mouse
gttcattcagccgaccgtgg

SEQ ID NO: 585483 - DNA, 20 bp, mouse
gagggagtcccgcggagacc

SEQ ID NO: 585484 - DNA, 20 bp, mouse
ggacgggatgagcacgggag

SEQ ID NO: 585485 - DNA, 20 bp, mouse
gcacgggagaggcaagaccc

SEQ ID NO: 585486 - DNA, 20 bp, mouse
gccagaccctggtagatagg

SEQ ID NO: 585487 - DNA, 20 bp, mouse
gtgaggtccttgttgcttgt

SEQ ID NO: 585488 - DNA, 20 bp, mouse
gccctggtagatagggggag

SEQ ID NO: 585489 - DNA, 20 bp, mouse
gtaccaatacacgactcgaa

SEQ ID NO: 585490 - DNA, 20 bp, mouse
gcgcatccccgcacaacacg

SEQ ID NO: 585491 - DNA, 20 bp, mouse
ggccccacgctcagagcttg

SEQ ID NO: 585492 - DNA, 20 bp, mouse
ggacctcaagctctgagcgt

SEQ ID NO: 585493 - DNA, 20 bp, mouse
ggtactcggttaccagaccc

SEQ ID NO: 585494 - DNA, 20 bp, mouse
gtggtttgctctgactcgtg

SEQ ID NO: 585495 - DNA, 20 bp, mouse
ggtcgtgtattggtaagtcc

SEQ ID NO: 585496 - DNA, 20 bp, mouse
ggggcgcaggttactagtgg

SEQ ID NO: 585497 - DNA, 20 bp, mouse
gttagggcgcaggttactag

SEQ ID NO: 585498 - DNA, 20 bp, mouse
gaacctgcgccctaacccag

SEQ ID NO: 585499 - DNA, 20 bp, mouse
gcgcaggttactagtggtgg

SEQ ID NO: 585500 - DNA, 20 bp, mouse
ggggtgagctctgtagccgg

SEQ ID NO: 585501 - DNA, 20 bp, mouse
ggctcactgccgctgggtta

SEQ ID NO: 585502 - DNA, 20 bp, mouse
gaggttactagtggtggcgg

SEQ ID NO: 585503 - DNA, 20 bp, mouse
gggcggggtcaagccctcag

SEQ ID NO: 585504 - DNA, 20 bp, mouse
gggctcgcggtggactccgc

SEQ ID NO: 585505 - DNA, 20 bp, mouse
gatgactctggcagcccgga

SEQ ID NO: 585506 - DNA, 20 bp, mouse
gctcggcccggccatcttgt

SEQ ID NO: 585507 - DNA, 20 bp, mouse
gcgcggtccgctgcaatccg

SEQ ID NO: 585508 - DNA, 20 bp, mouse
ggttcctccacggattgcag

SEQ ID NO: 585509 - DNA, 20 bp, mouse
gggtccgctgcaatccgtgg

SEQ ID NO: 585510 - DNA, 20 bp, mouse
gtcggcggcgcgttcctcca

SEQ ID NO: 585511 - DNA, 20 bp, mouse
gtgtaggtgcccaggcatga

SEQ ID NO: 585512 - DNA, 20 bp, mouse
gtgcttggcgccggaagaga

SEQ ID NO: 585513 - DNA, 20 bp, mouse
gaggcatgatggtggctcgg

SEQ ID NO: 585514 - DNA, 20 bp, mouse
gagatggccgggccgagaga

SEQ ID NO: 585515 - DNA, 20 bp, mouse
gctcttcccacaagatggcc

SEQ ID NO: 585516 - DNA, 20 bp, mouse
gcccacaagggccctcgatg

SEQ ID NO: 585517 - DNA, 20 bp, mouse
gagactggaagacagcgacc

SEQ ID NO: 585518 - DNA, 20 bp, mouse
ggcccgccacaagcacgagg

SEQ ID NO: 585519 - DNA, 20 bp, mouse
gcgaggcgtcgccacatcga

SEQ ID NO: 585520 - DNA, 20 bp, mouse
gcgggacgcgggctccaggt

SEQ ID NO: 585521 - DNA, 20 bp, mouse
gagcgacctggagaagcaaa

SEQ ID NO: 585522 - DNA, 20 bp, mouse
gcttcagcgcccggcggcaa

SEQ ID NO: 585523 - DNA, 20 bp, mouse
gaagagctggagggcaccct

SEQ ID NO: 585524 - DNA, 20 bp, mouse
gagccgcccacgctcccggt

SEQ ID NO: 585525 - DNA, 20 bp, mouse
gacgcacacccgcacctagg

SEQ ID NO: 585526 - DNA, 20 bp, mouse
gcactcacgggtcatggcga

SEQ ID NO: 585527 - DNA, 20 bp, mouse
gccgaacgagggggacgcaa

SEQ ID NO: 585528 - DNA, 20 bp, mouse
gaacgtcggcccgaacgagg

SEQ ID NO: 585529 - DNA, 20 bp, mouse
gcggcccgcgcccaacacag

SEQ ID NO: 585530 - DNA, 20 bp, mouse
gaacgagggggacgcaacgg

SEQ ID NO: 585531 - DNA, 20 bp, mouse
gaaaaggtcccagcactcac

SEQ ID NO: 585532 - DNA, 20 bp, mouse
gtcccagcactcacgggtca

SEQ ID NO: 585533 - DNA, 20 bp, mouse
gcaggggtctccgcaagtgg

SEQ ID NO: 585534 - DNA, 20 bp, mouse
gtgcaacgtcggcccgaacg

SEQ ID NO: 585535 - DNA, 20 bp, mouse
gagtcccggagggcgaagag

SEQ ID NO: 585536 - DNA, 20 bp, mouse
ggcggcagagacagtctcgg

SEQ ID NO: 585537 - DNA, 20 bp, mouse
ggcagcggcagagacagtct

SEQ ID NO: 585538 - DNA, 20 bp, mouse
gggctagggcagagacgaag

SEQ ID NO: 585539 - DNA, 20 bp, mouse
gtcagccggcgcttccggga

SEQ ID NO: 585540 - DNA, 20 bp, mouse
gccgagctagggtcctggat

SEQ ID NO: 585541 - DNA, 20 bp, mouse
ggggttgcagcaaggaggag

SEQ ID NO: 585542 - DNA, 20 bp, mouse
gcgtctctgccctagcccgg

SEQ ID NO: 585543 - DNA, 20 bp, mouse
gagctagcagtaggcccctc

SEQ ID NO: 585544 - DNA, 20 bp, mouse
gatcctgggttgcagcaagg

SEQ ID NO: 585545 - DNA, 20 bp, mouse
gctgtgggatgaggacccga

SEQ ID NO: 585546 - DNA, 20 bp, mouse
ggcctcaccgaccagagcaa

SEQ ID NO: 585547 - DNA, 20 bp, mouse
gaggctgtcactcctcgctg

SEQ ID NO: 585548 - DNA, 20 bp, mouse
gccaatctaaggggccctga

SEQ ID NO: 585549 - DNA, 20 bp, mouse
gtgggtgaaaatgtccctca

SEQ ID NO: 585550 - DNA, 20 bp, mouse
gtctagcagagccagactcg

SEQ ID NO: 585551 - DNA, 20 bp, mouse
gggaggtcacaggaactgga

SEQ ID NO: 585552 - DNA, 20 bp, mouse
gcccttcccactccaatcta

SEQ ID NO: 585553 - DNA, 20 bp, mouse
gagggccccttagattggag

SEQ ID NO: 585554 - DNA, 20 bp, mouse
gatagcagcctaggactcag

SEQ ID NO: 585555 - DNA, 20 bp, mouse
ggccctctcccaggctcagt

SEQ ID NO: 585556 - DNA, 20 bp, mouse
ggaagctgtctccatcttgt

SEQ ID NO: 585557 - DNA, 20 bp, mouse
gcggggctggagcctagtga

SEQ ID NO: 585558 - DNA, 20 bp, mouse
gacgcgccgagctggtgacg

SEQ ID NO: 585559 - DNA, 20 bp, mouse
gcgccgagctggtgacgcgg

SEQ ID NO: 585560 - DNA, 20 bp, mouse
gggcgatggggagcgttctg

SEQ ID NO: 585561 - DNA, 20 bp, mouse
gctaggctccagccccgaag

SEQ ID NO: 585562 - DNA, 20 bp, mouse
gtcggcgcgtgccgacaaga

SEQ ID NO: 585563 - DNA, 20 bp, mouse
gcgccgccgcgtcaccagct

SEQ ID NO: 585564 - DNA, 20 bp, mouse
ggcggagccgcaaagaccgg

SEQ ID NO: 585565 - DNA, 20 bp, mouse
gggagaaactcagtgcccgt

SEQ ID NO: 585566 - DNA, 20 bp, mouse
gccgagacaggcccccatgg

SEQ ID NO: 585567 - DNA, 20 bp, mouse
gcaagcgcctggagtcccac

SEQ ID NO: 585568 - DNA, 20 bp, mouse
ggccccgagacaggccccca

SEQ ID NO: 585569 - DNA, 20 bp, mouse
gaggcccccatggcggtgag

SEQ ID NO: 585570 - DNA, 20 bp, mouse
gcggcctcggatcccggatc

SEQ ID NO: 585571 - DNA, 20 bp, mouse
gagggagcaggccccgagac

SEQ ID NO: 585572 - DNA, 20 bp, mouse
gctcggatcccggatccggt

SEQ ID NO: 585573 - DNA, 20 bp, mouse
ggccgaagcggagcagctgg

SEQ ID NO: 585574 - DNA, 20 bp, mouse
gcatcggtggggcctctgaa

SEQ ID NO: 585575 - DNA, 20 bp, mouse
gtgggggatgaggataagaa

SEQ ID NO: 585576 - DNA, 20 bp, mouse
gacgccgaggacggccccca

SEQ ID NO: 585577 - DNA, 20 bp, mouse
gagttaggatccgctcggag

SEQ ID NO: 585578 - DNA, 20 bp, mouse
gcgagaccgaccgctccgag

SEQ ID NO: 585579 - DNA, 20 bp, mouse
gggccccggcgtcaccatgg

SEQ ID NO: 585580 - DNA, 20 bp, mouse
gagggagaagacgccgagga

SEQ ID NO: 585581 - DNA, 20 bp, mouse
gggatcctaactgctgactg

SEQ ID NO: 585582 - DNA, 20 bp, mouse
ggagcggtcggtctcggccc

SEQ ID NO: 585583 - DNA, 20 bp, mouse
gcacggcgcgggttcctgag

SEQ ID NO: 585584 - DNA, 20 bp, mouse
gaggatccgctcggagcggt

SEQ ID NO: 585585 - DNA, 20 bp, mouse
gggactcacccagctggcga

SEQ ID NO: 585586 - DNA, 20 bp, mouse
ggaagcttcagctagcaaag

SEQ ID NO: 585587 - DNA, 20 bp, mouse
ggtagtgaacagatagtcga

SEQ ID NO: 585588 - DNA, 20 bp, mouse
ggagactgcagaaaacaagc

SEQ ID NO: 585589 - DNA, 20 bp, mouse
gcttctcaagacaggcacaa

SEQ ID NO: 585590 - DNA, 20 bp, mouse
gagctgaagcttctcaagac

SEQ ID NO: 585591 - DNA, 20 bp, mouse
gcaagacaggcacaaaggtg

SEQ ID NO: 585592 - DNA, 20 bp, mouse
gagttggcctatcaggtcta

SEQ ID NO: 585593 - DNA, 20 bp, mouse
gggactgttattctgagatt

SEQ ID NO: 585594 - DNA, 20 bp, mouse
gcctaatccctagacctgat

SEQ ID NO: 585595 - DNA, 20 bp, mouse
gcctaccccgccccttatct

SEQ ID NO: 585596 - DNA, 20 bp, mouse
gtgcagtggcaggagagcta

SEQ ID NO: 585597 - DNA, 20 bp, mouse
gctcgcggaccaagccgaga

SEQ ID NO: 585598 - DNA, 20 bp, mouse
gcccgtcactcgggccctct

SEQ ID NO: 585599 - DNA, 20 bp, mouse
gcaccgggcagacatcaccg

SEQ ID NO: 585600 - DNA, 20 bp, mouse
gcccgctgggcccgtcactc

SEQ ID NO: 585601 - DNA, 20 bp, mouse
gtatcccacaggcagtgcag

SEQ ID NO: 585602 - DNA, 20 bp, mouse
gggacgcggggaagcccgag

SEQ ID NO: 585603 - DNA, 20 bp, mouse
gacctggccagcacagcacc

SEQ ID NO: 585604 - DNA, 20 bp, mouse
gccagcgggcagcgtccccg

SEQ ID NO: 585605 - DNA, 20 bp, mouse
gctggagctgaggatcccat

SEQ ID NO: 585606 - DNA, 20 bp, mouse
gggttgccggttgcactgtc

SEQ ID NO: 585607 - DNA, 20 bp, mouse
gcgagtccgagaggttcttg

SEQ ID NO: 585608 - DNA, 20 bp, mouse
gccccggcacgccgccccaa

SEQ ID NO: 585609 - DNA, 20 bp, mouse
gacgcggagcgctggaacac

SEQ ID NO: 585610 - DNA, 20 bp, mouse
gcagtggctgtagacggcgt

SEQ ID NO: 585611 - DNA, 20 bp, mouse
gccgaacccgaactagttcg

SEQ ID NO: 585612 - DNA, 20 bp, mouse
ggcggcgtgccggggagagc

SEQ ID NO: 585613 - DNA, 20 bp, mouse
ggcgagcgagcgagtccgag

SEQ ID NO: 585614 - DNA, 20 bp, mouse
gaaccaccggacagtgcaac

SEQ ID NO: 585615 - DNA, 20 bp, mouse
ggacctcggtaagggaaagt

SEQ ID NO: 585616 - DNA, 20 bp, mouse
ggccagccggctccagagag

SEQ ID NO: 585617 - DNA, 20 bp, mouse
gccagagagaggccagcgcg

SEQ ID NO: 585618 - DNA, 20 bp, mouse
gagagaggccagcgcgcgga

SEQ ID NO: 585619 - DNA, 20 bp, mouse
gcgccgcgcgccaagcccaa

SEQ ID NO: 585620 - DNA, 20 bp, mouse
ggacccagcggggctctggg

SEQ ID NO: 585621 - DNA, 20 bp, mouse
ggcctctctctggagccggc

SEQ ID NO: 585622 - DNA, 20 bp, mouse
gagccatggtggccaaacag

SEQ ID NO: 585623 - DNA, 20 bp, mouse
gatggcgaggaagtcggaga

SEQ ID NO: 585624 - DNA, 20 bp, mouse
ggcaggaggcgggaagcgag

SEQ ID NO: 585625 - DNA, 20 bp, mouse
gcggccaccgaggcaggagg

SEQ ID NO: 585626 - DNA, 20 bp, mouse
gggcaccagaggtccaggac

SEQ ID NO: 585627 - DNA, 20 bp, mouse
gtccctggtagacactctag

SEQ ID NO: 585628 - DNA, 20 bp, mouse
gttctcggcaccagaggtcc

SEQ ID NO: 585629 - DNA, 20 bp, mouse
gcaggactggtaagaggtgg

SEQ ID NO: 585630 - DNA, 20 bp, mouse
gaagaggtggtggatggcag

SEQ ID NO: 585631 - DNA, 20 bp, mouse
ggcctctagagtgtctacca

SEQ ID NO: 585632 - DNA, 20 bp, mouse
gatgatcttctcggcaccag

SEQ ID NO: 585633 - DNA, 20 bp, mouse
gagtgtctaccagggagagg

SEQ ID NO: 585634 - DNA, 20 bp, mouse
gcctggctgcctcctatcta

SEQ ID NO: 585635 - DNA, 20 bp, mouse
gtcagggctaagtgtcaggt

SEQ ID NO: 585636 - DNA, 20 bp, mouse
ggatgaggaggatccttcag

SEQ ID NO: 585637 - DNA, 20 bp, mouse
gctgcccggcacacccccag

SEQ ID NO: 585638 - DNA, 20 bp, mouse
ggctgctggagtcagtcaat

SEQ ID NO: 585639 - DNA, 20 bp, mouse
ggtggttaggctccagaggt

SEQ ID NO: 585640 - DNA, 20 bp, mouse
gtgctgtggttaggctccag

SEQ ID NO: 585641 - DNA, 20 bp, mouse
ggaggatccttcaggggaag

SEQ ID NO: 585642 - DNA, 20 bp, mouse
gtgccgggcaggtacagtgg

SEQ ID NO: 585643 - DNA, 20 bp, mouse
gtccaggataaaaggctgaa

SEQ ID NO: 585644 - DNA, 20 bp, mouse
gagtcagtcaatgggcttcc

SEQ ID NO: 585645 - DNA, 20 bp, mouse
gaggacaactccaggataaa

SEQ ID NO: 585646 - DNA, 20 bp, mouse
ggagccaagggggatatggg

SEQ ID NO: 585647 - DNA, 20 bp, mouse
ggcccctccaatatttcctt

SEQ ID NO: 585648 - DNA, 20 bp, mouse
gattttccctaaggaaatat

SEQ ID NO: 585649 - DNA, 20 bp, mouse
ggtgagtataattttcccta

SEQ ID NO: 585650 - DNA, 20 bp, mouse
gccatggcaacaagagacct

SEQ ID NO: 585651 - DNA, 20 bp, mouse
gctagtctgtatttaagcaa

SEQ ID NO: 585652 - DNA, 20 bp, mouse
gggggccaaggtgcagccac

SEQ ID NO: 585653 - DNA, 20 bp, mouse
ggacctcagcctgttgttca

SEQ ID NO: 585654 - DNA, 20 bp, mouse
gttccctaaggaaatattgg

SEQ ID NO: 585655 - DNA, 20 bp, mouse
gaacagccaccgtgaacaac

SEQ ID NO: 585656 - DNA, 20 bp, mouse
gaggttcaagaagaaagctt

SEQ ID NO: 585657 - DNA, 20 bp, mouse
gtctgtatttaagcagtggg

SEQ ID NO: 585658 - DNA, 20 bp, mouse
gttaaatacagactacgaca

SEQ ID NO: 585659 - DNA, 20 bp, mouse
ggatgcagggggtaagagca

SEQ ID NO: 585660 - DNA, 20 bp, mouse
gcctgcatcgtggataatca

SEQ ID NO: 585661 - DNA, 20 bp, mouse
gttaagcagtgggaggcaag

SEQ ID NO: 585662 - DNA, 20 bp, mouse
gtgtgcatctcgggtatagt

SEQ ID NO: 585663 - DNA, 20 bp, mouse
ggtgagaggagacaaagacg

SEQ ID NO: 585664 - DNA, 20 bp, mouse
gagaggagacaaagacgtgg

SEQ ID NO: 585665 - DNA, 20 bp, mouse
ggtggctgttccaagcatag

SEQ ID NO: 585666 - DNA, 20 bp, mouse
ggtgggagccaagatggata

SEQ ID NO: 585667 - DNA, 20 bp, mouse
gaactcccccatatccatct

SEQ ID NO: 585668 - DNA, 20 bp, mouse
gtaagtagtgggagccaaga

SEQ ID NO: 585669 - DNA, 20 bp, mouse
ggggctggaaaaggccacac

SEQ ID NO: 585670 - DNA, 20 bp, mouse
gatccaagatgcaggggcgt

SEQ ID NO: 585671 - DNA, 20 bp, mouse
gatcccacgcccctgcatct

SEQ ID NO: 585672 - DNA, 20 bp, mouse
gtttgctagtctttcctgtg

SEQ ID NO: 585673 - DNA, 20 bp, mouse
gggagccaagatggatatgg

SEQ ID NO: 585674 - DNA, 20 bp, mouse
gatgcaggggcgtgggatca

SEQ ID NO: 585675 - DNA, 20 bp, mouse
gctagtctgtatttaagtag

SEQ ID NO: 585676 - DNA, 20 bp, mouse
gtacaggagacgcacatact

SEQ ID NO: 585677 - DNA, 20 bp, mouse
gtgtgcgtctcctgtatagc

SEQ ID NO: 585678 - DNA, 20 bp, mouse
gtctcccaggccactatgct

SEQ ID NO: 585679 - DNA, 20 bp, mouse
gtcggtcaccacccagttct

SEQ ID NO: 585680 - DNA, 20 bp, mouse
gtccctggggaaatattcga

SEQ ID NO: 585681 - DNA, 20 bp, mouse
gcagcttgctgtcccagaac

SEQ ID NO: 585682 - DNA, 20 bp, mouse
ggaggagacaaagacatgga

SEQ ID NO: 585683 - DNA, 20 bp, mouse
gcactgcttaaattcagact

SEQ ID NO: 585684 - DNA, 20 bp, mouse
gggagccaagggggatatgc

SEQ ID NO: 585685 - DNA, 20 bp, mouse
gaacagctaccatgaactac

SEQ ID NO: 585686 - DNA, 20 bp, mouse
gagtatgtgcatctagggta

SEQ ID NO: 585687 - DNA, 20 bp, mouse
gtgtgcatctagggtatggc

SEQ ID NO: 585688 - DNA, 20 bp, mouse
gcagcttgctgtctcagagc

SEQ ID NO: 585689 - DNA, 20 bp, mouse
ggtcctagtatgtgcatcta

SEQ ID NO: 585690 - DNA, 20 bp, mouse
ggacagccaccgtgacctac

SEQ ID NO: 585691 - DNA, 20 bp, mouse
gtactaggacctcagcctgt

SEQ ID NO: 585692 - DNA, 20 bp, mouse
gtgggagcaggggtaataca

SEQ ID NO: 585693 - DNA, 20 bp, mouse
gccaagcaggcagcccttct

SEQ ID NO: 585694 - DNA, 20 bp, mouse
gtgggcagcaaggttcaaga

SEQ ID NO: 585695 - DNA, 20 bp, mouse
ggcagcccttctgggagcag

SEQ ID NO: 585696 - DNA, 20 bp, mouse
ggcatctggccaggattctc

SEQ ID NO: 585697 - DNA, 20 bp, mouse
ggccattcctgtgaccctgc

SEQ ID NO: 585698 - DNA, 20 bp, mouse
gtgtagatctggggagccgg

SEQ ID NO: 585699 - DNA, 20 bp, mouse
gagtaccctctgtagatctg

SEQ ID NO: 585700 - DNA, 20 bp, mouse
gggcgtggctacccggcatc

SEQ ID NO: 585701 - DNA, 20 bp, mouse
gctctgtagatctggggagc

SEQ ID NO: 585702 - DNA, 20 bp, mouse
gttacaactactccaagttt

SEQ ID NO: 585703 - DNA, 20 bp, mouse
gctccctggcagacagacac

SEQ ID NO: 585704 - DNA, 20 bp, mouse
gttgactcctgagggtgtca

SEQ ID NO: 585705 - DNA, 20 bp, mouse
gctgggaggggcaggagcta

SEQ ID NO: 585706 - DNA, 20 bp, mouse
gcccagggtgacagctacag

SEQ ID NO: 585707 - DNA, 20 bp, mouse
gtactgagtagcgtccgtgg

SEQ ID NO: 585708 - DNA, 20 bp, mouse
gttggcagtgcccagcccat

SEQ ID NO: 585709 - DNA, 20 bp, mouse
ggaccagccggagtactgtg

SEQ ID NO: 585710 - DNA, 20 bp, mouse
gacttactgagtagcgtccg

SEQ ID NO: 585711 - DNA, 20 bp, mouse
gtggagacaggtagtaaggt

SEQ ID NO: 585712 - DNA, 20 bp, mouse
gtcaagggcagatgaccctg

SEQ ID NO: 585713 - DNA, 20 bp, mouse
ggtactccggctggtcctag

SEQ ID NO: 585714 - DNA, 20 bp, mouse
gactggggtggaggggacta

SEQ ID NO: 585715 - DNA, 20 bp, mouse
gcccagcccatgggctcaga

SEQ ID NO: 585716 - DNA, 20 bp, mouse
gacaggagctacttgaaggt

SEQ ID NO: 585717 - DNA, 20 bp, mouse
ggagctacttgaaggtagga

SEQ ID NO: 585718 - DNA, 20 bp, mouse
gggacaagacaagtcatcag

SEQ ID NO: 585719 - DNA, 20 bp, mouse
gcagagccttcagatggagt

SEQ ID NO: 585720 - DNA, 20 bp, mouse
ggtagctcctgtctgatatt

SEQ ID NO: 585721 - DNA, 20 bp, mouse
gtttcttgtcaggacaagta

SEQ ID NO: 585722 - DNA, 20 bp, mouse
gctgggtcccaatatcagac

SEQ ID NO: 585723 - DNA, 20 bp, mouse
gggtaggagggtttgtattt

SEQ ID NO: 585724 - DNA, 20 bp, mouse
gatcagcccactccatctga

SEQ ID NO: 585725 - DNA, 20 bp, mouse
ggcaggaaggagcgaaagtt

SEQ ID NO: 585726 - DNA, 20 bp, mouse
gagttaaaaacattccagaa

SEQ ID NO: 585727 - DNA, 20 bp, mouse
gccagctgctagtatctgtt

SEQ ID NO: 585728 - DNA, 20 bp, mouse
gcctgtggagggtcagaagg

SEQ ID NO: 585729 - DNA, 20 bp, mouse
gaggcagaaaactggcacat

SEQ ID NO: 585730 - DNA, 20 bp, mouse
gggtcacccaatatgaataa

SEQ ID NO: 585731 - DNA, 20 bp, mouse
gtgtgctactggctatgacc

SEQ ID NO: 585732 - DNA, 20 bp, mouse
gcaagactccaggtcaagct

SEQ ID NO: 585733 - DNA, 20 bp, mouse
gaatgtcccttattcatatt

SEQ ID NO: 585734 - DNA, 20 bp, mouse
gtgacctggagtcttgattt

SEQ ID NO: 585735 - DNA, 20 bp, mouse
gccccccaaatcaagactcc

SEQ ID NO: 585736 - DNA, 20 bp, mouse
ggctctgcaggtaatgccca

SEQ ID NO: 585737 - DNA, 20 bp, mouse
gctggggacaacaacatgcc

SEQ ID NO: 585738 - DNA, 20 bp, mouse
gtcatagctagggtgagaca

SEQ ID NO: 585739 - DNA, 20 bp, mouse
gggagggaggagaccttggt

SEQ ID NO: 585740 - DNA, 20 bp, mouse
gcctgtggagtcagagaacc

SEQ ID NO: 585741 - DNA, 20 bp, mouse
ggtggtagatacagctgctg

SEQ ID NO: 585742 - DNA, 20 bp, mouse
gtgcaacctatgtttgtggg

SEQ ID NO: 585743 - DNA, 20 bp, mouse
gtgttgcagagtcactttgg

SEQ ID NO: 585744 - DNA, 20 bp, mouse
gctctaaacttccctccctg

SEQ ID NO: 585745 - DNA, 20 bp, mouse
gagcctgtttatccccacca

SEQ ID NO: 585746 - DNA, 20 bp, mouse
ggagcaaaggccagtgtctg

SEQ ID NO: 585747 - DNA, 20 bp, mouse
gtaaatagttcagcaaacag

SEQ ID NO: 585748 - DNA, 20 bp, mouse
gggccagtgtctgtggtagc

SEQ ID NO: 585749 - DNA, 20 bp, mouse
gaacagaaggagtcttcact

SEQ ID NO: 585750 - DNA, 20 bp, mouse
ggggcagtagattggactcc

SEQ ID NO: 585751 - DNA, 20 bp, mouse
gcacgccttacctgcagagc

SEQ ID NO: 585752 - DNA, 20 bp, mouse
gatgtgggaccagtccttgg

SEQ ID NO: 585753 - DNA, 20 bp, mouse
gtttatctggggcagtagat

SEQ ID NO: 585754 - DNA, 20 bp, mouse
gagtggtgtccctgaacata

SEQ ID NO: 585755 - DNA, 20 bp, mouse
ggaactatttatttccacca

SEQ ID NO: 585756 - DNA, 20 bp, mouse
ggagcaaaggccagtgtctg

SEQ ID NO: 585757 - DNA, 20 bp, mouse
gtaaatagttcagcaaacag

SEQ ID NO: 585758 - DNA, 20 bp, mouse
gggccagtgtctgtggtagc

SEQ ID NO: 585759 - DNA, 20 bp, mouse
gaacagaaggagtcttcact

SEQ ID NO: 585760 - DNA, 20 bp, mouse
ggggcagtagattggactcc

SEQ ID NO: 585761 - DNA, 20 bp, mouse
gcacgccttacctgcagagc

SEQ ID NO: 585762 - DNA, 20 bp, mouse
gatgtgggaccagtccttgg

SEQ ID NO: 585763 - DNA, 20 bp, mouse
gtttatctggggcagtagat

SEQ ID NO: 585764 - DNA, 20 bp, mouse
gagtggtgtccctgaacata

SEQ ID NO: 585765 - DNA, 20 bp, mouse
ggaactatttatttccacca

SEQ ID NO: 585766 - DNA, 20 bp, mouse
gtgggaggagtccttggtgg

SEQ ID NO: 585767 - DNA, 20 bp, mouse
gggcagcaactctgaccacc

SEQ ID NO: 585768 - DNA, 20 bp, mouse
gccttggtgggggcatgcag

SEQ ID NO: 585769 - DNA, 20 bp, mouse
ggataagagtgaagatgttc

SEQ ID NO: 585770 - DNA, 20 bp, mouse
gaagtgggaggagtccttgg

SEQ ID NO: 585771 - DNA, 20 bp, mouse
gggtgccatgagctatgccc

SEQ ID NO: 585772 - DNA, 20 bp, mouse
ggtggtgctgactctgcaaa

SEQ ID NO: 585773 - DNA, 20 bp, mouse
gtttatctggggcatgagtt

SEQ ID NO: 585774 - DNA, 20 bp, mouse
ggggcatgagtttggactcc

SEQ ID NO: 585775 - DNA, 20 bp, mouse
ggctccatggaatttacaag

SEQ ID NO: 585776 - DNA, 20 bp, mouse
gggctggagaacatagaaga

SEQ ID NO: 585777 - DNA, 20 bp, mouse
ggctgtccagaggacacatt

SEQ ID NO: 585778 - DNA, 20 bp, mouse
gggagcaaagggcaacactc

SEQ ID NO: 585779 - DNA, 20 bp, mouse
gcagaggctcagtcagccag

SEQ ID NO: 585780 - DNA, 20 bp, mouse
gtttgctcccagggacaggg

SEQ ID NO: 585781 - DNA, 20 bp, mouse
gatcagcacaggcaattcaa

SEQ ID NO: 585782 - DNA, 20 bp, mouse
ggctttcctaatgtgtcctc

SEQ ID NO: 585783 - DNA, 20 bp, mouse
gggcaattgtgatgctaagt

SEQ ID NO: 585784 - DNA, 20 bp, mouse
gcaactggacagtcttacat

SEQ ID NO: 585785 - DNA, 20 bp, mouse
gcctggtggatgtctgcctc

SEQ ID NO: 585786 - DNA, 20 bp, mouse
ggcactgtcccaggactgta

SEQ ID NO: 585787 - DNA, 20 bp, mouse
ggaattgtaaaccgaacaca

SEQ ID NO: 585788 - DNA, 20 bp, mouse
gttcatcccagtagagtcag

SEQ ID NO: 585789 - DNA, 20 bp, mouse
gagatactaggctacaatca

SEQ ID NO: 585790 - DNA, 20 bp, mouse
gacagaaaaggcactgtccc

SEQ ID NO: 585791 - DNA, 20 bp, mouse
gtcagccacacacatgttgt

SEQ ID NO: 585792 - DNA, 20 bp, mouse
ggtgatagctaggctgagac

SEQ ID NO: 585793 - DNA, 20 bp, mouse
ggctgctcctctgactctac

SEQ ID NO: 585794 - DNA, 20 bp, mouse
gaagaagattcctggtaata

SEQ ID NO: 585795 - DNA, 20 bp, mouse
ggaagttttgagaacttgcg

SEQ ID NO: 585796 - DNA, 20 bp, mouse
gagtttacaactcgtcagac

SEQ ID NO: 585797 - DNA, 20 bp, mouse
gcaatcagggaatatttctg

SEQ ID NO: 585798 - DNA, 20 bp, mouse
gtctactcatggacagtaaa

SEQ ID NO: 585799 - DNA, 20 bp, mouse
gatagaaaaggcactgcccc

SEQ ID NO: 585800 - DNA, 20 bp, mouse
ggcagtgccttttctattca

SEQ ID NO: 585801 - DNA, 20 bp, mouse
gatgctgtggtctctactca

SEQ ID NO: 585802 - DNA, 20 bp, mouse
gttgactccatgaatagaaa

SEQ ID NO: 585803 - DNA, 20 bp, mouse
gagagctttgactgagatag

SEQ ID NO: 585804 - DNA, 20 bp, mouse
gcgtcagacaggaagatttc

SEQ ID NO: 585805 - DNA, 20 bp, mouse
gccacacaaacacatgttgt

SEQ ID NO: 585806 - DNA, 20 bp, mouse
gagtcagctatcacagaggc

SEQ ID NO: 585807 - DNA, 20 bp, mouse
gtatcacagaggctggcagc

SEQ ID NO: 585808 - DNA, 20 bp, mouse
ggcactggggacaacatgcc

SEQ ID NO: 585809 - DNA, 20 bp, mouse
gagctctgtaggtaaagccc

SEQ ID NO: 585810 - DNA, 20 bp, mouse
gcaatcagggaacctttctt

SEQ ID NO: 585811 - DNA, 20 bp, mouse
gagcatctgtatcttccaca

SEQ ID NO: 585812 - DNA, 20 bp, mouse
gatcccctaggcaagcagag

SEQ ID NO: 585813 - DNA, 20 bp, mouse
gcttctctgactccaagggg

SEQ ID NO: 585814 - DNA, 20 bp, mouse
ggattttatgaacccaagaa

SEQ ID NO: 585815 - DNA, 20 bp, mouse
gatgctgtggtctctgctcg

SEQ ID NO: 585816 - DNA, 20 bp, mouse
gagtccacctggcttacaag

SEQ ID NO: 585817 - DNA, 20 bp, mouse
gtcgtggtggctgagtgtca

SEQ ID NO: 585818 - DNA, 20 bp, mouse
gtgtcaaggtatagtccacc

SEQ ID NO: 585819 - DNA, 20 bp, mouse
gaatgaagcagagctggagt

SEQ ID NO: 585820 - DNA, 20 bp, mouse
gtactcactctgtatcgtgg

SEQ ID NO: 585821 - DNA, 20 bp, mouse
ggtgtactcactctgtatcg

SEQ ID NO: 585822 - DNA, 20 bp, mouse
gtgtcctcttgtaagccagg

SEQ ID NO: 585823 - DNA, 20 bp, mouse
gagagcagaggaattgcagc

SEQ ID NO: 585824 - DNA, 20 bp, mouse
gagagtgagtacacctgctg

SEQ ID NO: 585825 - DNA, 20 bp, mouse
gtgcggtcagtgacatttgc

SEQ ID NO: 585826 - DNA, 20 bp, mouse
gaggcacagagtactgtcag

SEQ ID NO: 585827 - DNA, 20 bp, mouse
gggaccctggtaggagcaag

SEQ ID NO: 585828 - DNA, 20 bp, mouse
gggtgactcacgtctgctgt

SEQ ID NO: 585829 - DNA, 20 bp, mouse
ggggctccagctgttccttc

SEQ ID NO: 585830 - DNA, 20 bp, mouse
ggtggctgaaccacagacta

SEQ ID NO: 585831 - DNA, 20 bp, mouse
gtcctagcacacgtacagta

SEQ ID NO: 585832 - DNA, 20 bp, mouse
ggtgtcatgaggcgaccatg

SEQ ID NO: 585833 - DNA, 20 bp, mouse
gtgcagcagatatagagtca

SEQ ID NO: 585834 - DNA, 20 bp, mouse
gcacgtacagtaaggcttcg

SEQ ID NO: 585835 - DNA, 20 bp, mouse
ggatatagagtcagggaccc

SEQ ID NO: 585836 - DNA, 20 bp, mouse
gagagtggacgaaggaaggt

SEQ ID NO: 585837 - DNA, 20 bp, mouse
gcagctcctagcaggacaga

SEQ ID NO: 585838 - DNA, 20 bp, mouse
ggctatctgagagatgcaag

SEQ ID NO: 585839 - DNA, 20 bp, mouse
ggcaatgttcaatgttccca

SEQ ID NO: 585840 - DNA, 20 bp, mouse
gaacattgctaacaagtcag

SEQ ID NO: 585841 - DNA, 20 bp, mouse
ggcctcctaaacaaaatcac

SEQ ID NO: 585842 - DNA, 20 bp, mouse
ggaaggttggagaggataag

SEQ ID NO: 585843 - DNA, 20 bp, mouse
gagaggccctctgtcctgct

SEQ ID NO: 585844 - DNA, 20 bp, mouse
ggcatgttataaagactgaa

SEQ ID NO: 585845 - DNA, 20 bp, mouse
gagacagacccagatcaaaa

SEQ ID NO: 585846 - DNA, 20 bp, mouse
gcttccctgtaggacaacaa

SEQ ID NO: 585847 - DNA, 20 bp, mouse
gcactggcggaaggacaagg

SEQ ID NO: 585848 - DNA, 20 bp, mouse
gcagctgcctaagggctgag

SEQ ID NO: 585849 - DNA, 20 bp, mouse
ggttgtcctacagggaaggc

SEQ ID NO: 585850 - DNA, 20 bp, mouse
gtcgcccttgttgtcctaca

SEQ ID NO: 585851 - DNA, 20 bp, mouse
gcctcacctgccttccctgt

SEQ ID NO: 585852 - DNA, 20 bp, mouse
gactcaatggctgtacatct

SEQ ID NO: 585853 - DNA, 20 bp, mouse
gggacactggcggaaggaca

SEQ ID NO: 585854 - DNA, 20 bp, mouse
gacaaaatccagctgcctaa

SEQ ID NO: 585855 - DNA, 20 bp, mouse
gacaggaccccattaagggg

SEQ ID NO: 585856 - DNA, 20 bp, mouse
gtccattcacaactgacaag

SEQ ID NO: 585857 - DNA, 20 bp, mouse
gagaagtgaattgcttgaac

SEQ ID NO: 585858 - DNA, 20 bp, mouse
ggtaaaagaaaaccttgaaa

SEQ ID NO: 585859 - DNA, 20 bp, mouse
gcacaactctgacaaagcat

SEQ ID NO: 585860 - DNA, 20 bp, mouse
gtccacttgtcagttgtgaa

SEQ ID NO: 585861 - DNA, 20 bp, mouse
ggaagggagataagacaagc

SEQ ID NO: 585862 - DNA, 20 bp, mouse
gaaccttgaaagggatgaga

SEQ ID NO: 585863 - DNA, 20 bp, mouse
gtgacaaagcataggcactc

SEQ ID NO: 585864 - DNA, 20 bp, mouse
gctttaaaggaatttaactc

SEQ ID NO: 585865 - DNA, 20 bp, mouse
gcacttcttagaacttttat

SEQ ID NO: 585866 - DNA, 20 bp, mouse
ggtgatgggaagagtttagc

SEQ ID NO: 585867 - DNA, 20 bp, mouse
gacttgttaagtgtcatctt

SEQ ID NO: 585868 - DNA, 20 bp, mouse
gagagtttagcaggttagac

SEQ ID NO: 585869 - DNA, 20 bp, mouse
ggttgctttctgatggtgat

SEQ ID NO: 585870 - DNA, 20 bp, mouse
gtgagtagaatgttgtcaga

SEQ ID NO: 585871 - DNA, 20 bp, mouse
gcttatcaaaaggtcagcaa

SEQ ID NO: 585872 - DNA, 20 bp, mouse
gttgtaatgagtcagatgag

SEQ ID NO: 585873 - DNA, 20 bp, mouse
gtgctcatacccttatcaaa

SEQ ID NO: 585874 - DNA, 20 bp, mouse
gagaaataccacactgacaa

SEQ ID NO: 585875 - DNA, 20 bp, mouse
gcttattgtttaattgaatg

SEQ ID NO: 585876 - DNA, 20 bp, mouse
gcagcctgcagagactggta

SEQ ID NO: 585877 - DNA, 20 bp, mouse
gtgcagagactggtaaggag

SEQ ID NO: 585878 - DNA, 20 bp, mouse
gtagaaagtagcagaatggg

SEQ ID NO: 585879 - DNA, 20 bp, mouse
ggtaaacatggaaaacatgt

SEQ ID NO: 585880 - DNA, 20 bp, mouse
ggaagtagacaagctcctgt

SEQ ID NO: 585881 - DNA, 20 bp, mouse
gagctagaaagtagcagaat

SEQ ID NO: 585882 - DNA, 20 bp, mouse
gacatacctgcaacctagtg

SEQ ID NO: 585883 - DNA, 20 bp, mouse
gaagctcctgtaggtagtga

SEQ ID NO: 585884 - DNA, 20 bp, mouse
ggttggagacgggcctcact

SEQ ID NO: 585885 - DNA, 20 bp, mouse
gtaggtagtgatggctcttg

SEQ ID NO: 585886 - DNA, 20 bp, mouse
gagaactcaaactggatctg

SEQ ID NO: 585887 - DNA, 20 bp, mouse
ggaatccctataatgaaccg

SEQ ID NO: 585888 - DNA, 20 bp, mouse
gtccctataatgaaccgagg

SEQ ID NO: 585889 - DNA, 20 bp, mouse
gtccacctcggttcattata

SEQ ID NO: 585890 - DNA, 20 bp, mouse
ggctgttagaggttccacct

SEQ ID NO: 585891 - DNA, 20 bp, mouse
gtaaattgcaatgatcattt

SEQ ID NO: 585892 - DNA, 20 bp, mouse
ggatgagacctaaagtgtga

SEQ ID NO: 585893 - DNA, 20 bp, mouse
gttccttactcagaaataaa

SEQ ID NO: 585894 - DNA, 20 bp, mouse
gtctaacagcaaatgcaaga

SEQ ID NO: 585895 - DNA, 20 bp, mouse
gtttatttggtagatattaa

SEQ ID NO: 585896 - DNA, 20 bp, mouse
gcaagaggtaagattctcag

SEQ ID NO: 585897 - DNA, 20 bp, mouse
gctcaggggtcatagcaagg

SEQ ID NO: 585898 - DNA, 20 bp, mouse
gggggtcatagcaaggaggg

SEQ ID NO: 585899 - DNA, 20 bp, mouse
gggcactgtctcccagatca

SEQ ID NO: 585900 - DNA, 20 bp, mouse
gtgaggtaccaggaacgtgc

SEQ ID NO: 585901 - DNA, 20 bp, mouse
ggccgagggaaagaaaaact

SEQ ID NO: 585902 - DNA, 20 bp, mouse
gacttcatcctagctgtaag

SEQ ID NO: 585903 - DNA, 20 bp, mouse
gctccaggccgcgggcccga

SEQ ID NO: 585904 - DNA, 20 bp, mouse
gggaagctggcacctcttcc

SEQ ID NO: 585905 - DNA, 20 bp, mouse
gccgggtagctaaacagcca

SEQ ID NO: 585906 - DNA, 20 bp, mouse
ggccagagctgctacagagg

SEQ ID NO: 585907 - DNA, 20 bp, mouse
gctgcagccttgactctgaa

SEQ ID NO: 585908 - DNA, 20 bp, mouse
gtggtgtcacaactagggtg

SEQ ID NO: 585909 - DNA, 20 bp, mouse
gcagaggaggtaagggccat

SEQ ID NO: 585910 - DNA, 20 bp, mouse
ggctgctacagaggaggtaa

SEQ ID NO: 585911 - DNA, 20 bp, mouse
gttcctaggtctctagcaag

SEQ ID NO: 585912 - DNA, 20 bp, mouse
gggctgcagggatggaggtt

SEQ ID NO: 585913 - DNA, 20 bp, mouse
gaggaaggctgtcccagtca

SEQ ID NO: 585914 - DNA, 20 bp, mouse
gtgtgacaccagaccaagaa

SEQ ID NO: 585915 - DNA, 20 bp, mouse
gaaggtggttggcaagaggg

SEQ ID NO: 585916 - DNA, 20 bp, mouse
gaggtaaggtcaatgcaggg

SEQ ID NO: 585917 - DNA, 20 bp, mouse
gtaaggtcaatgcagggagg

SEQ ID NO: 585918 - DNA, 20 bp, mouse
gaagaggtaaggtcaatgca

SEQ ID NO: 585919 - DNA, 20 bp, mouse
gaagaagcagtggggaggtc

SEQ ID NO: 585920 - DNA, 20 bp, mouse
gtcaatgcagggaggtggct

SEQ ID NO: 585921 - DNA, 20 bp, mouse
gtcctgaagaagcagtgggg

SEQ ID NO: 585922 - DNA, 20 bp, mouse
ggtgagggaaagaaaaacgg

SEQ ID NO: 585923 - DNA, 20 bp, mouse
gctccacttgcagctgacct

SEQ ID NO: 585924 - DNA, 20 bp, mouse
gtggttcctgaagaagcagt

SEQ ID NO: 585925 - DNA, 20 bp, mouse
gctccaggccgcaggccaga

SEQ ID NO: 585926 - DNA, 20 bp, mouse
gattcactagagatgctcgg

SEQ ID NO: 585927 - DNA, 20 bp, mouse
gagccgctcagaagataacg

SEQ ID NO: 585928 - DNA, 20 bp, mouse
gagcatctctagtgaatcca

SEQ ID NO: 585929 - DNA, 20 bp, mouse
gttctgagcggctgacacac

SEQ ID NO: 585930 - DNA, 20 bp, mouse
gggagagaagaaagacgccc

SEQ ID NO: 585931 - DNA, 20 bp, mouse
gagtttggctagtgatacac

SEQ ID NO: 585932 - DNA, 20 bp, mouse
ggtaactattgctatgaagg

SEQ ID NO: 585933 - DNA, 20 bp, mouse
ggtgtggacaaggtaatgac

SEQ ID NO: 585934 - DNA, 20 bp, mouse
gagctggcactgtgtggaca

SEQ ID NO: 585935 - DNA, 20 bp, mouse
gatagtaactattgctatga

SEQ ID NO: 585936 - DNA, 20 bp, mouse
gttctgtagttgccagaagg

SEQ ID NO: 585937 - DNA, 20 bp, mouse
gtctaaaaggaaaggttgag

SEQ ID NO: 585938 - DNA, 20 bp, mouse
gggcaactacagaatctaaa

SEQ ID NO: 585939 - DNA, 20 bp, mouse
ggttagaagtacattgcaga

SEQ ID NO: 585940 - DNA, 20 bp, mouse
gtctcagaatctgataatac

SEQ ID NO: 585941 - DNA, 20 bp, mouse
ggaccaagaacaattgaatt

SEQ ID NO: 585942 - DNA, 20 bp, mouse
gagattctgtagttgccaga

SEQ ID NO: 585943 - DNA, 20 bp, mouse
gaaagttaaatgcctccttc

SEQ ID NO: 585944 - DNA, 20 bp, mouse
gcaatgtacttctaacttga

SEQ ID NO: 585945 - DNA, 20 bp, mouse
gaacccaaaactaacacagc

SEQ ID NO: 585946 - DNA, 20 bp, mouse
gcttccattagtggcaagag

SEQ ID NO: 585947 - DNA, 20 bp, mouse
gtggcctagtcttccattag

SEQ ID NO: 585948 - DNA, 20 bp, mouse
gtgaataggggagtgtgggg

SEQ ID NO: 585949 - DNA, 20 bp, mouse
ggggcctctcttgccactaa

SEQ ID NO: 585950 - DNA, 20 bp, mouse
gttgccactaatggaagact

SEQ ID NO: 585951 - DNA, 20 bp, mouse
gttttgatctgccaaagaaa

SEQ ID NO: 585952 - DNA, 20 bp, mouse
gactgttcatcaataatagc

SEQ ID NO: 585953 - DNA, 20 bp, mouse
gggaagcattaccttttctt

SEQ ID NO: 585954 - DNA, 20 bp, mouse
gtgggtgaataggggagtgt

SEQ ID NO: 585955 - DNA, 20 bp, mouse
gaaggcagaagttagcagga

SEQ ID NO: 585956 - DNA, 20 bp, mouse
gacactgtatcaataatagc

SEQ ID NO: 585957 - DNA, 20 bp, mouse
gaggcctctctttctactga

SEQ ID NO: 585958 - DNA, 20 bp, mouse
gctgcatatgtgttagaaga

SEQ ID NO: 585959 - DNA, 20 bp, mouse
gaaggcagaagttagcagga

SEQ ID NO: 585960 - DNA, 20 bp, mouse
ggatcaagaatagtagaatc

SEQ ID NO: 585961 - DNA, 20 bp, mouse
gagtagaaagagaggcctat

SEQ ID NO: 585962 - DNA, 20 bp, mouse
ggaagcatttaacttttctt

SEQ ID NO: 585963 - DNA, 20 bp, mouse
gaagaaaacaaattaactga

SEQ ID NO: 585964 - DNA, 20 bp, mouse
gcacttacttgtgtttctga

SEQ ID NO: 585965 - DNA, 20 bp, mouse
gaaggatagaagcctgtgtg

SEQ ID NO: 585966 - DNA, 20 bp, mouse
gacactgtatcaataatagc

SEQ ID NO: 585967 - DNA, 20 bp, mouse
gaggcctctctttctactga

SEQ ID NO: 585968 - DNA, 20 bp, mouse
gctgcatatgtgttagaaga

SEQ ID NO: 585969 - DNA, 20 bp, mouse
gaaggcagaagttagcagga

SEQ ID NO: 585970 - DNA, 20 bp, mouse
ggatcaagaatagtagaatc

SEQ ID NO: 585971 - DNA, 20 bp, mouse
gagtagaaagagaggcctat

SEQ ID NO: 585972 - DNA, 20 bp, mouse
ggaagcatttaacttttctt

SEQ ID NO: 585973 - DNA, 20 bp, mouse
gaagaaaacaaattaactga

SEQ ID NO: 585974 - DNA, 20 bp, mouse
gctcaggatcagccacacac

SEQ ID NO: 585975 - DNA, 20 bp, mouse
gaaggatagaagcctgtgtg

SEQ ID NO: 585976 - DNA, 20 bp, mouse
gcaatacagcttgatgcctg

SEQ ID NO: 585977 - DNA, 20 bp, mouse
gtccttcccaaacacggtcc

SEQ ID NO: 585978 - DNA, 20 bp, mouse
gccagcacttaaaggctatc

SEQ ID NO: 585979 - DNA, 20 bp, mouse
gactgaacaacaaattaaga

SEQ ID NO: 585980 - DNA, 20 bp, mouse
ggaagcacctggaccgtgtt

SEQ ID NO: 585981 - DNA, 20 bp, mouse
gtttcttgttggacacttga

SEQ ID NO: 585982 - DNA, 20 bp, mouse
gaacatgtccttcccaaaca

SEQ ID NO: 585983 - DNA, 20 bp, mouse
gcattagcaatgcttctgct

SEQ ID NO: 585984 - DNA, 20 bp, mouse
gtgttgttcagtgtttgctt

SEQ ID NO: 585985 - DNA, 20 bp, mouse
gttgagagtcaagttcaaac

SEQ ID NO: 585986 - DNA, 20 bp, mouse
gaaaagccgaaggagctcag

SEQ ID NO: 585987 - DNA, 20 bp, mouse
ggaaacaagatgcaaaaggg

SEQ ID NO: 585988 - DNA, 20 bp, mouse
gcttgagttgcaggtatccc

SEQ ID NO: 585989 - DNA, 20 bp, mouse
gcgggaaacaagatgcaaaa

SEQ ID NO: 585990 - DNA, 20 bp, mouse
gaggctggaagacctgggtg

SEQ ID NO: 585991 - DNA, 20 bp, mouse
ggcctcggtgccagctccta

SEQ ID NO: 585992 - DNA, 20 bp, mouse
gaccttaggagctggcaccg

SEQ ID NO: 585993 - DNA, 20 bp, mouse
gttgggcacacaaaaacctt

SEQ ID NO: 585994 - DNA, 20 bp, mouse
gtgcaactcaaggtaagcaa

SEQ ID NO: 585995 - DNA, 20 bp, mouse
gactcaaggtaagcaaaggg

SEQ ID NO: 585996 - DNA, 20 bp, mouse
ggagaatctaggagaatcta

SEQ ID NO: 585997 - DNA, 20 bp, mouse
ggaatctagggtatgctctt

SEQ ID NO: 585998 - DNA, 20 bp, mouse
gtctagggtatgctcttcgg

SEQ ID NO: 585999 - DNA, 20 bp, mouse
ggatctgccagagtccttgg

SEQ ID NO: 586000 - DNA, 20 bp, mouse
gagattctcgatttccggac

SEQ ID NO: 586001 - DNA, 20 bp, mouse
ggggcggcgatgtcaccaga

SEQ ID NO: 586002 - DNA, 20 bp, mouse
gtcttcggtgggctgaggcg

SEQ ID NO: 586003 - DNA, 20 bp, mouse
gccgtcgcctccaaggactc

SEQ ID NO: 586004 - DNA, 20 bp, mouse
gacgggcgttgggatctggg

SEQ ID NO: 586005 - DNA, 20 bp, mouse
ggacggctagcgagggatgg

SEQ ID NO: 586006 - DNA, 20 bp, mouse
gcgagctggctgaagatggt

SEQ ID NO: 586007 - DNA, 20 bp, mouse
gtgctgacagcctgaacctg

SEQ ID NO: 586008 - DNA, 20 bp, mouse
gggtaagctctgctacgagc

SEQ ID NO: 586009 - DNA, 20 bp, mouse
gagccaataagaggccacaa

SEQ ID NO: 586010 - DNA, 20 bp, mouse
gggacctagtctgtccaggg

SEQ ID NO: 586011 - DNA, 20 bp, mouse
gcccaggggaggtgtcagag

SEQ ID NO: 586012 - DNA, 20 bp, mouse
gggctgaagatggtggggta

SEQ ID NO: 586013 - DNA, 20 bp, mouse
gctgccgccctggacagact

SEQ ID NO: 586014 - DNA, 20 bp, mouse
gcaataagaggccacaaggg

SEQ ID NO: 586015 - DNA, 20 bp, mouse
gagcaagcagaatctagaga

SEQ ID NO: 586016 - DNA, 20 bp, mouse
gggccctcagtgtaagaaga

SEQ ID NO: 586017 - DNA, 20 bp, mouse
gggctcaaacgacaagtctt

SEQ ID NO: 586018 - DNA, 20 bp, mouse
gagtgtaagaagaaggatac

SEQ ID NO: 586019 - DNA, 20 bp, mouse
gaagaagaaggatactggta

SEQ ID NO: 586020 - DNA, 20 bp, mouse
gatccttcttcttacactga

SEQ ID NO: 586021 - DNA, 20 bp, mouse
gtgcgtgtctaggcagacac

SEQ ID NO: 586022 - DNA, 20 bp, mouse
gtcaaacgacaagtctttgg

SEQ ID NO: 586023 - DNA, 20 bp, mouse
gacaagtggtcctccaaata

SEQ ID NO: 586024 - DNA, 20 bp, mouse
gaaagcatatcaaagtgatc

SEQ ID NO: 586025 - DNA, 20 bp, mouse
gaagataactcaatctaatc

SEQ ID NO: 586026 - DNA, 20 bp, mouse
gggctgcagcagaggatacc

SEQ ID NO: 586027 - DNA, 20 bp, mouse
gccccagtgtcaggcatgtc

SEQ ID NO: 586028 - DNA, 20 bp, mouse
gagctccatattcaagggtg

SEQ ID NO: 586029 - DNA, 20 bp, mouse
gtgctgcagtgggtcacctt

SEQ ID NO: 586030 - DNA, 20 bp, mouse
gttagcctcacccttgaata

SEQ ID NO: 586031 - DNA, 20 bp, mouse
ggagggaccactagctggtc

SEQ ID NO: 586032 - DNA, 20 bp, mouse
gcaggggagggaccactagc

SEQ ID NO: 586033 - DNA, 20 bp, mouse
gtcttgggccagagacacct

SEQ ID NO: 586034 - DNA, 20 bp, mouse
gtgcctgacatgcctgacac

SEQ ID NO: 586035 - DNA, 20 bp, mouse
gacctgggaataattgacaa

SEQ ID NO: 586036 - DNA, 20 bp, mouse
gcacctggctgggaacacaa

SEQ ID NO: 586037 - DNA, 20 bp, mouse
gcccgcagcagagcatatac

SEQ ID NO: 586038 - DNA, 20 bp, mouse
gtcatctccaggtgaaccta

SEQ ID NO: 586039 - DNA, 20 bp, mouse
gagtcccaatgactcctcta

SEQ ID NO: 586040 - DNA, 20 bp, mouse
gacaggaccctaggttcacc

SEQ ID NO: 586041 - DNA, 20 bp, mouse
ggagaagagcatatatctga

SEQ ID NO: 586042 - DNA, 20 bp, mouse
gaaggcactagctgcaccca

SEQ ID NO: 586043 - DNA, 20 bp, mouse
gagtaaagcacagattgtgg

SEQ ID NO: 586044 - DNA, 20 bp, mouse
gacggaaactgacaccctag

SEQ ID NO: 586045 - DNA, 20 bp, mouse
gacaccctagaggagtcatt

SEQ ID NO: 586046 - DNA, 20 bp, mouse
gagaggaagttgcagctggt

SEQ ID NO: 586047 - DNA, 20 bp, mouse
gttcctctatgaagagagta

SEQ ID NO: 586048 - DNA, 20 bp, mouse
gccacggtgtaaagctgaga

SEQ ID NO: 586049 - DNA, 20 bp, mouse
ggcagctggttgggtgagtc

SEQ ID NO: 586050 - DNA, 20 bp, mouse
gtagctgatctcccacactg

SEQ ID NO: 586051 - DNA, 20 bp, mouse
gacgctagtcaaagcgaatc

SEQ ID NO: 586052 - DNA, 20 bp, mouse
gatgacattcaccacagtgt

SEQ ID NO: 586053 - DNA, 20 bp, mouse
gaatagtgagtgacctaaat

SEQ ID NO: 586054 - DNA, 20 bp, mouse
gtaggtcactcactatttgt

SEQ ID NO: 586055 - DNA, 20 bp, mouse
gataatgtaagacagtcata

SEQ ID NO: 586056 - DNA, 20 bp, mouse
ggagagtcttaggaggaagg

SEQ ID NO: 586057 - DNA, 20 bp, mouse
gctcctcccagtgcagctct

SEQ ID NO: 586058 - DNA, 20 bp, mouse
gacaccctctgaagagtgaa

SEQ ID NO: 586059 - DNA, 20 bp, mouse
gctctggggacttcgctgct

SEQ ID NO: 586060 - DNA, 20 bp, mouse
gctggcagtcacacacctca

SEQ ID NO: 586061 - DNA, 20 bp, mouse
gtttcaagaaccatcagtag

SEQ ID NO: 586062 - DNA, 20 bp, mouse
gatgcatgctagctgattct

SEQ ID NO: 586063 - DNA, 20 bp, mouse
gttcaggttaacagtgacag

SEQ ID NO: 586064 - DNA, 20 bp, mouse
gattttggcagaagtgtgca

SEQ ID NO: 586065 - DNA, 20 bp, mouse
gcaattgccatcaagccatg

SEQ ID NO: 586066 - DNA, 20 bp, mouse
gtgccccgatcaggaggatc

SEQ ID NO: 586067 - DNA, 20 bp, mouse
gcaggcgccttgccccgatc

SEQ ID NO: 586068 - DNA, 20 bp, mouse
ggcgccttgccccgatcagg

SEQ ID NO: 586069 - DNA, 20 bp, mouse
ggtcctgatcctcctgatcg

SEQ ID NO: 586070 - DNA, 20 bp, mouse
ggaggactccagtgacagag

SEQ ID NO: 586071 - DNA, 20 bp, mouse
gtcggggcaaggcgcctgtc

SEQ ID NO: 586072 - DNA, 20 bp, mouse
ggagtcctctgctaactcct

SEQ ID NO: 586073 - DNA, 20 bp, mouse
gcaaagctgacagaaggcat

SEQ ID NO: 586074 - DNA, 20 bp, mouse
ggggggcctaggatagatac

SEQ ID NO: 586075 - DNA, 20 bp, mouse
gatactggcactgaagaacc

SEQ ID NO: 586076 - DNA, 20 bp, mouse
gaagcctactgggagcatca

SEQ ID NO: 586077 - DNA, 20 bp, mouse
gatccacagggagaagacag

SEQ ID NO: 586078 - DNA, 20 bp, mouse
ggagaagccgcaactgtggt

SEQ ID NO: 586079 - DNA, 20 bp, mouse
gggccagctggagatcctaa

SEQ ID NO: 586080 - DNA, 20 bp, mouse
gcccgcacctaccacagttg

SEQ ID NO: 586081 - DNA, 20 bp, mouse
gagaagtccctgccttgtac

SEQ ID NO: 586082 - DNA, 20 bp, mouse
ggcatcaaggctgcaaacgc

SEQ ID NO: 586083 - DNA, 20 bp, mouse
ggattgagaagccgcaactg

SEQ ID NO: 586084 - DNA, 20 bp, mouse
gaggatctccagctggccaa

SEQ ID NO: 586085 - DNA, 20 bp, mouse
gtggcgaccacagcaggaag

SEQ ID NO: 586086 - DNA, 20 bp, mouse
ggagcagcagctactcaggt

SEQ ID NO: 586087 - DNA, 20 bp, mouse
gtaagctataggggacatcc

SEQ ID NO: 586088 - DNA, 20 bp, mouse
gtgtcagggaggctgatcct

SEQ ID NO: 586089 - DNA, 20 bp, mouse
gctgctgtgttaagctatag

SEQ ID NO: 586090 - DNA, 20 bp, mouse
gcctgacacttggccagctg

SEQ ID NO: 586091 - DNA, 20 bp, mouse
gggccagctggggttcctct

SEQ ID NO: 586092 - DNA, 20 bp, mouse
gagcctaggtcccagtcccc

SEQ ID NO: 586093 - DNA, 20 bp, mouse
gtttttgcctggctcagatt

SEQ ID NO: 586094 - DNA, 20 bp, mouse
ggtgttagcagcctcttcac

SEQ ID NO: 586095 - DNA, 20 bp, mouse
gttctaaaactgacttatgg

SEQ ID NO: 586096 - DNA, 20 bp, mouse
gaagactcgaatacaatggg

SEQ ID NO: 586097 - DNA, 20 bp, mouse
gcaatgggaggccacaaagt

SEQ ID NO: 586098 - DNA, 20 bp, mouse
gtcaggagtcccacagctct

SEQ ID NO: 586099 - DNA, 20 bp, mouse
gcatcaagactcgaatacaa

SEQ ID NO: 586100 - DNA, 20 bp, mouse
gagagtgggaaggtggtatc

SEQ ID NO: 586101 - DNA, 20 bp, mouse
gcacagctctgggttgagca

SEQ ID NO: 586102 - DNA, 20 bp, mouse
gatctggtgaagatttggag

SEQ ID NO: 586103 - DNA, 20 bp, mouse
gcacaaccattgggcaactg

SEQ ID NO: 586104 - DNA, 20 bp, mouse
gactcagcccagactttcta

SEQ ID NO: 586105 - DNA, 20 bp, mouse
gagagaccccagttgcccaa

SEQ ID NO: 586106 - DNA, 20 bp, mouse
gtcacgggcagagtccagaa

SEQ ID NO: 586107 - DNA, 20 bp, mouse
gagagtccagaatggcgagt

SEQ ID NO: 586108 - DNA, 20 bp, mouse
gaacgcaggaaggttcttca

SEQ ID NO: 586109 - DNA, 20 bp, mouse
gactgcttcatggctaacgc

SEQ ID NO: 586110 - DNA, 20 bp, mouse
gtcctgtcacacctgaagat

SEQ ID NO: 586111 - DNA, 20 bp, mouse
gcttcatggctaacgcagga

SEQ ID NO: 586112 - DNA, 20 bp, mouse
ggttactgtctactgcttca

SEQ ID NO: 586113 - DNA, 20 bp, mouse
gaagggtggtctagaggcaa

SEQ ID NO: 586114 - DNA, 20 bp, mouse
gacccatcttcaggtgtgac

SEQ ID NO: 586115 - DNA, 20 bp, mouse
gttcaggaagggtggtctag

SEQ ID NO: 586116 - DNA, 20 bp, mouse
gaccgtgagaccacaaatat

SEQ ID NO: 586117 - DNA, 20 bp, mouse
gtccaatatttgtggtctca

SEQ ID NO: 586118 - DNA, 20 bp, mouse
gttaagggtcctattgtcct

SEQ ID NO: 586119 - DNA, 20 bp, mouse
gggtggagcagagcttaaat

SEQ ID NO: 586120 - DNA, 20 bp, mouse
gaggtaaccttgctaaaccc

SEQ ID NO: 586121 - DNA, 20 bp, mouse
gaccttacctccaatatttg

SEQ ID NO: 586122 - DNA, 20 bp, mouse
gggtagttaaatgggctcgg

SEQ ID NO: 586123 - DNA, 20 bp, mouse
ggacaacttggagattgatc

SEQ ID NO: 586124 - DNA, 20 bp, mouse
gccagatgcatgtcaagatt

SEQ ID NO: 586125 - DNA, 20 bp, mouse
ggaaggtttagcctgagtac

SEQ ID NO: 586126 - DNA, 20 bp, mouse
gctactggactccaacccta

SEQ ID NO: 586127 - DNA, 20 bp, mouse
gtatactatacactccaatt

SEQ ID NO: 586128 - DNA, 20 bp, mouse
gttcagctttaggaccagag

SEQ ID NO: 586129 - DNA, 20 bp, mouse
gagggtagaagtagtcaaat

SEQ ID NO: 586130 - DNA, 20 bp, mouse
gtacttctaccctctatcca

SEQ ID NO: 586131 - DNA, 20 bp, mouse
ggatgagtcaataatgctac

SEQ ID NO: 586132 - DNA, 20 bp, mouse
gatctgaacattaggaaaag

SEQ ID NO: 586133 - DNA, 20 bp, mouse
gttaggctgattcgaggagg

SEQ ID NO: 586134 - DNA, 20 bp, mouse
gttattgactcatctatgta

SEQ ID NO: 586135 - DNA, 20 bp, mouse
gcctcattgtcagtcctaat

SEQ ID NO: 586136 - DNA, 20 bp, mouse
gttcattggtaggaccagag

SEQ ID NO: 586137 - DNA, 20 bp, mouse
ggattccaggaggtgaacca

SEQ ID NO: 586138 - DNA, 20 bp, mouse
gagatccatggttcacctcc

SEQ ID NO: 586139 - DNA, 20 bp, mouse
gattaggaaaagagactgtg

SEQ ID NO: 586140 - DNA, 20 bp, mouse
ggtcatctgtagttcctctc

SEQ ID NO: 586141 - DNA, 20 bp, mouse
ggactgtgtggaagttgacc

SEQ ID NO: 586142 - DNA, 20 bp, mouse
gggtagtgaaatgggttcat

SEQ ID NO: 586143 - DNA, 20 bp, mouse
ggtgaaatgggttcattggt

SEQ ID NO: 586144 - DNA, 20 bp, mouse
ggatttaggctgattccagg

SEQ ID NO: 586145 - DNA, 20 bp, mouse
ggtgagatcacaaacattgg

SEQ ID NO: 586146 - DNA, 20 bp, mouse
gggttcagtggtaggacgag

SEQ ID NO: 586147 - DNA, 20 bp, mouse
gattaggaaaagagatagta

SEQ ID NO: 586148 - DNA, 20 bp, mouse
ggatccatggttccacttcc

SEQ ID NO: 586149 - DNA, 20 bp, mouse
gttcggctgattccaggaag

SEQ ID NO: 586150 - DNA, 20 bp, mouse
ggcagccacagagcactccc

SEQ ID NO: 586151 - DNA, 20 bp, mouse
gggtagtgaaatgggttcag

SEQ ID NO: 586152 - DNA, 20 bp, mouse
gcattgtcctgagtttcgta

SEQ ID NO: 586153 - DNA, 20 bp, mouse
ggatagtatggaagttgacc

SEQ ID NO: 586154 - DNA, 20 bp, mouse
gaggtaaccttacgaaactc

SEQ ID NO: 586155 - DNA, 20 bp, mouse
ggtgaaatgggttcagtggt

SEQ ID NO: 586156 - DNA, 20 bp, mouse
gttaaggggagaggtgagta

SEQ ID NO: 586157 - DNA, 20 bp, mouse
gtctacctgaagactttaag

SEQ ID NO: 586158 - DNA, 20 bp, mouse
gctctccccttaaagtcttc

SEQ ID NO: 586159 - DNA, 20 bp, mouse
gcagatgtgaagctggacat

SEQ ID NO: 586160 - DNA, 20 bp, mouse
ggagtctcaatgaggcctga

SEQ ID NO: 586161 - DNA, 20 bp, mouse
ggtgccttaaatggaagtca

SEQ ID NO: 586162 - DNA, 20 bp, mouse
gctgagacattttagtgaag

SEQ ID NO: 586163 - DNA, 20 bp, mouse
gaaacgaatgagtctcaatg

SEQ ID NO: 586164 - DNA, 20 bp, mouse
gggttcacatcggaagaagc

SEQ ID NO: 586165 - DNA, 20 bp, mouse
ggaaccctgacttccattta

SEQ ID NO: 586166 - DNA, 20 bp, mouse
ggtacctctgagcagtggtg

SEQ ID NO: 586167 - DNA, 20 bp, mouse
gagaggtacagaggtaagtt

SEQ ID NO: 586168 - DNA, 20 bp, mouse
gctagggtgatagataccca

SEQ ID NO: 586169 - DNA, 20 bp, mouse
gttccagtataaagtatcaa

SEQ ID NO: 586170 - DNA, 20 bp, mouse
gacccaggggctacaagtgc

SEQ ID NO: 586171 - DNA, 20 bp, mouse
gtccagcacttgtagcccct

SEQ ID NO: 586172 - DNA, 20 bp, mouse
gcaggtttcaatgtgaactt

SEQ ID NO: 586173 - DNA, 20 bp, mouse
gacctttaatagtaatgctt

SEQ ID NO: 586174 - DNA, 20 bp, mouse
gacctaagcattactattaa

SEQ ID NO: 586175 - DNA, 20 bp, mouse
gatgcttagagctaaacaat

SEQ ID NO: 586176 - DNA, 20 bp, mouse
gagccccgagagctttgtga

SEQ ID NO: 586177 - DNA, 20 bp, mouse
gaacggagcacagctggatc

SEQ ID NO: 586178 - DNA, 20 bp, mouse
gggctgtgtgctgccggagg

SEQ ID NO: 586179 - DNA, 20 bp, mouse
gctccttcacaaagctctcg

SEQ ID NO: 586180 - DNA, 20 bp, mouse
ggctgccggaggcgggtgtg

SEQ ID NO: 586181 - DNA, 20 bp, mouse
gccagctgtgctccgttccc

SEQ ID NO: 586182 - DNA, 20 bp, mouse
gggcttctgggatacagggt

SEQ ID NO: 586183 - DNA, 20 bp, mouse
gtgctggcttctgggataca

SEQ ID NO: 586184 - DNA, 20 bp, mouse
gctcctacctgagtattcaa

SEQ ID NO: 586185 - DNA, 20 bp, mouse
gccaacaagagccaatcaca

SEQ ID NO: 586186 - DNA, 20 bp, mouse
gggagatcggcgctgcgcgg

SEQ ID NO: 586187 - DNA, 20 bp, mouse
ggcccggccggctagtgcag

SEQ ID NO: 586188 - DNA, 20 bp, mouse
gccgaaaccgggagggagat

SEQ ID NO: 586189 - DNA, 20 bp, mouse
gcgcggcggtgggggacagg

SEQ ID NO: 586190 - DNA, 20 bp, mouse
ggtggcggccgaaaccggga

SEQ ID NO: 586191 - DNA, 20 bp, mouse
gagtggttgcacgggagtgc

SEQ ID NO: 586192 - DNA, 20 bp, mouse
gccaggtggcggccgaaacc

SEQ ID NO: 586193 - DNA, 20 bp, mouse
ggcagcgccgatctccctcc

SEQ ID NO: 586194 - DNA, 20 bp, mouse
gtcggcgctgcgcggcggtg

SEQ ID NO: 586195 - DNA, 20 bp, mouse
ggagccaggagcgctcgcag

SEQ ID NO: 586196 - DNA, 20 bp, mouse
gggtcctgccatgactacca

SEQ ID NO: 586197 - DNA, 20 bp, mouse
gaacacatccctggtagtca

SEQ ID NO: 586198 - DNA, 20 bp, mouse
gcacgtgacctcggaaccca

SEQ ID NO: 586199 - DNA, 20 bp, mouse
gacctcggaacccacggagt

SEQ ID NO: 586200 - DNA, 20 bp, mouse
gtgagtatacaacacatccc

SEQ ID NO: 586201 - DNA, 20 bp, mouse
gtaccatttgattaaagagt

SEQ ID NO: 586202 - DNA, 20 bp, mouse
gacggagtgggaatttgcat

SEQ ID NO: 586203 - DNA, 20 bp, mouse
gagcaaaggcctgggctcag

SEQ ID NO: 586204 - DNA, 20 bp, mouse
gctgcacgaactctcaaagt

SEQ ID NO: 586205 - DNA, 20 bp, mouse
gtggcaggacctgggtcacc

SEQ ID NO: 586206 - DNA, 20 bp, mouse
ggctgccgcaaccacaggta

SEQ ID NO: 586207 - DNA, 20 bp, mouse
ggagaagctgccgcaaccac

SEQ ID NO: 586208 - DNA, 20 bp, mouse
gcaaggtgaacagatgagag

SEQ ID NO: 586209 - DNA, 20 bp, mouse
gagcctggggaagacagata

SEQ ID NO: 586210 - DNA, 20 bp, mouse
gctggagcccctcagagtgc

SEQ ID NO: 586211 - DNA, 20 bp, mouse
gctgctggacgctggttgag

SEQ ID NO: 586212 - DNA, 20 bp, mouse
gcagcgcctggtctagcctg

SEQ ID NO: 586213 - DNA, 20 bp, mouse
gctcacagcctgcactctga

SEQ ID NO: 586214 - DNA, 20 bp, mouse
gccacaggtaaggcagcgcc

SEQ ID NO: 586215 - DNA, 20 bp, mouse
ggagcggctaatagagtcct

SEQ ID NO: 586216 - DNA, 20 bp, mouse
ggcgcagcacacgcagcaca

SEQ ID NO: 586217 - DNA, 20 bp, mouse
gcctgaagaggtaggatgga

SEQ ID NO: 586218 - DNA, 20 bp, mouse
ggtggggagcaagctggtcc

SEQ ID NO: 586219 - DNA, 20 bp, mouse
ggccctgctggctgcactgg

SEQ ID NO: 586220 - DNA, 20 bp, mouse
gggctgcactgggggagcgt

SEQ ID NO: 586221 - DNA, 20 bp, mouse
gaaacctggaggcctactct

SEQ ID NO: 586222 - DNA, 20 bp, mouse
gtcgccaagagtaggcctcc

SEQ ID NO: 586223 - DNA, 20 bp, mouse
ggcttcacagcgtcctgggg

SEQ ID NO: 586224 - DNA, 20 bp, mouse
ggcagcacacggtgttctcc

SEQ ID NO: 586225 - DNA, 20 bp, mouse
gagcccagctggcggaaggg

SEQ ID NO: 586226 - DNA, 20 bp, mouse
ggtcagcctggaggccatct

SEQ ID NO: 586227 - DNA, 20 bp, mouse
gcagcagcaggagggtcagt

SEQ ID NO: 586228 - DNA, 20 bp, mouse
gtgaggctaactggcttcgt

SEQ ID NO: 586229 - DNA, 20 bp, mouse
ggcgttagaccagggtctag

SEQ ID NO: 586230 - DNA, 20 bp, mouse
gcctgagctcctaggctcca

SEQ ID NO: 586231 - DNA, 20 bp, mouse
gaccatcacagcagcaccag

SEQ ID NO: 586232 - DNA, 20 bp, mouse
ggaggcctggaatggaatgg

SEQ ID NO: 586233 - DNA, 20 bp, mouse
gaggttgccccagagggagg

SEQ ID NO: 586234 - DNA, 20 bp, mouse
ggagagaacacaccctggaa

SEQ ID NO: 586235 - DNA, 20 bp, mouse
gagaaggttgccccagaggg

SEQ ID NO: 586236 - DNA, 20 bp, mouse
gggctgctccgggaccgaca

SEQ ID NO: 586237 - DNA, 20 bp, mouse
ggggcaatcgctcctcagac

SEQ ID NO: 586238 - DNA, 20 bp, mouse
ggcgattgccctgtcggtcc

SEQ ID NO: 586239 - DNA, 20 bp, mouse
ggcccagcccggcccaggtg

SEQ ID NO: 586240 - DNA, 20 bp, mouse
gccctcacctgggccgggct

SEQ ID NO: 586241 - DNA, 20 bp, mouse
gtgaggagcgattgccctgt

SEQ ID NO: 586242 - DNA, 20 bp, mouse
gtatatagatccagggcccg

SEQ ID NO: 586243 - DNA, 20 bp, mouse
ggtactagaccgcagctcca

SEQ ID NO: 586244 - DNA, 20 bp, mouse
gcggactgcctggtaaagta

SEQ ID NO: 586245 - DNA, 20 bp, mouse
gttggggtcctgacacaggt

SEQ ID NO: 586246 - DNA, 20 bp, mouse
gcccgctcgggatgctggag

SEQ ID NO: 586247 - DNA, 20 bp, mouse
ggagaggcaagagcagcatc

SEQ ID NO: 586248 - DNA, 20 bp, mouse
gtccagggaaactacagact

SEQ ID NO: 586249 - DNA, 20 bp, mouse
gctgtagtttccctggagag

SEQ ID NO: 586250 - DNA, 20 bp, mouse
ggtgtgaaggaggtaagcgt

SEQ ID NO: 586251 - DNA, 20 bp, mouse
ggcctagtctgtagtttccc

SEQ ID NO: 586252 - DNA, 20 bp, mouse
gacacctgcaatccccgctc

SEQ ID NO: 586253 - DNA, 20 bp, mouse
gaggaacgcctggatactgg

SEQ ID NO: 586254 - DNA, 20 bp, mouse
ggctacagcacagcaacctg

SEQ ID NO: 586255 - DNA, 20 bp, mouse
gactctgcctgggatattaa

SEQ ID NO: 586256 - DNA, 20 bp, mouse
gaataatcagaagttaattt

SEQ ID NO: 586257 - DNA, 20 bp, mouse
gtatgtaattggccaacaat

SEQ ID NO: 586258 - DNA, 20 bp, mouse
gatagcatcaagcaaataac

SEQ ID NO: 586259 - DNA, 20 bp, mouse
ggaccaagactctattttca

SEQ ID NO: 586260 - DNA, 20 bp, mouse
gctataacttattaagtgcc

SEQ ID NO: 586261 - DNA, 20 bp, mouse
gaatgggatgacaaatattt

SEQ ID NO: 586262 - DNA, 20 bp, mouse
gaaaattgcttattgaagaa

SEQ ID NO: 586263 - DNA, 20 bp, mouse
gtaagtgcctggacaattta

SEQ ID NO: 586264 - DNA, 20 bp, mouse
gaaacacagaactggcacat

SEQ ID NO: 586265 - DNA, 20 bp, mouse
ggtctattgaaacacagaac

SEQ ID NO: 586266 - DNA, 20 bp, mouse
ggaacaagctagcgatgcta

SEQ ID NO: 586267 - DNA, 20 bp, mouse
gaaccgacacctgggacggt

SEQ ID NO: 586268 - DNA, 20 bp, mouse
gcagcaaccgacacctggga

SEQ ID NO: 586269 - DNA, 20 bp, mouse
gacctcagctaggtagatgg

SEQ ID NO: 586270 - DNA, 20 bp, mouse
gcacgcagccaatcaggaag

SEQ ID NO: 586271 - DNA, 20 bp, mouse
gcgcctaccgtcccaggtgt

SEQ ID NO: 586272 - DNA, 20 bp, mouse
ggctccagcaaccgacacct

SEQ ID NO: 586273 - DNA, 20 bp, mouse
gccgggcgggcgacacatac

SEQ ID NO: 586274 - DNA, 20 bp, mouse
ggagccacacgcagccaatc

SEQ ID NO: 586275 - DNA, 20 bp, mouse
ggaactgcgcctaccgtccc

SEQ ID NO: 586276 - DNA, 20 bp, mouse
gtggacgcccgggccgagag

SEQ ID NO: 586277 - DNA, 20 bp, mouse
gggcggacgtcactcccgca

SEQ ID NO: 586278 - DNA, 20 bp, mouse
gctcgccagaggctcgcagg

SEQ ID NO: 586279 - DNA, 20 bp, mouse
gaagcaggaggcgggcggag

SEQ ID NO: 586280 - DNA, 20 bp, mouse
ggcacgagctgtacctctct

SEQ ID NO: 586281 - DNA, 20 bp, mouse
ggagctcgccagaggctcgc

SEQ ID NO: 586282 - DNA, 20 bp, mouse
gcctggccggagctcgccag

SEQ ID NO: 586283 - DNA, 20 bp, mouse
ggcgggcggagtggacgccc

SEQ ID NO: 586284 - DNA, 20 bp, mouse
gaggagctaacgcatcggag

SEQ ID NO: 586285 - DNA, 20 bp, mouse
gagtcgggaacattatacaa

SEQ ID NO: 586286 - DNA, 20 bp, mouse
gagcggggcgccgagagcag

SEQ ID NO: 586287 - DNA, 20 bp, mouse
ggacgggagacggcaagaag

SEQ ID NO: 586288 - DNA, 20 bp, mouse
gcagccagccatggatagcg

SEQ ID NO: 586289 - DNA, 20 bp, mouse
gcttgagcgagccgagcggg

SEQ ID NO: 586290 - DNA, 20 bp, mouse
gctcggcgccccgctatcca

SEQ ID NO: 586291 - DNA, 20 bp, mouse
gatgtcttgagcgagccgag

SEQ ID NO: 586292 - DNA, 20 bp, mouse
gcgagagcaggggcggccgg

SEQ ID NO: 586293 - DNA, 20 bp, mouse
gtaccgcacacggactggac

SEQ ID NO: 586294 - DNA, 20 bp, mouse
gggcgataccgcacacggac

SEQ ID NO: 586295 - DNA, 20 bp, mouse
gtgggcgagacaggctaaag

SEQ ID NO: 586296 - DNA, 20 bp, mouse
gggcttgtcggaggtagtcg

SEQ ID NO: 586297 - DNA, 20 bp, mouse
gccagtgctgggtagaagtc

SEQ ID NO: 586298 - DNA, 20 bp, mouse
ggaggtagtcgtggcgaccc

SEQ ID NO: 586299 - DNA, 20 bp, mouse
gtacctccgacaagcctgca

SEQ ID NO: 586300 - DNA, 20 bp, mouse
ggaccctggcagccgaggtg

SEQ ID NO: 586301 - DNA, 20 bp, mouse
gtggtggaacccaaccctgc

SEQ ID NO: 586302 - DNA, 20 bp, mouse
gccagcatcagcaccgaagg

SEQ ID NO: 586303 - DNA, 20 bp, mouse
gagccagacccagaggcccg

SEQ ID NO: 586304 - DNA, 20 bp, mouse
gggttgggttccaccagtgc

SEQ ID NO: 586305 - DNA, 20 bp, mouse
gtcccgagtggagagcagat

SEQ ID NO: 586306 - DNA, 20 bp, mouse
gaggttccctctcgccccgg

SEQ ID NO: 586307 - DNA, 20 bp, mouse
ggctctgctggatgcccccg

SEQ ID NO: 586308 - DNA, 20 bp, mouse
gagccaggctcggaaatccg

SEQ ID NO: 586309 - DNA, 20 bp, mouse
ggtgggcgaagaccccgtgg

SEQ ID NO: 586310 - DNA, 20 bp, mouse
gggatgcccccggggcgaga

SEQ ID NO: 586311 - DNA, 20 bp, mouse
gcgctcctcgccagacacat

SEQ ID NO: 586312 - DNA, 20 bp, mouse
ggcctggggccaagagggta

SEQ ID NO: 586313 - DNA, 20 bp, mouse
gggtaagagccgtgacccca

SEQ ID NO: 586314 - DNA, 20 bp, mouse
gcacgccgactgggcccggg

SEQ ID NO: 586315 - DNA, 20 bp, mouse
gccccgggtagcaggagggt

SEQ ID NO: 586316 - DNA, 20 bp, mouse
ggcgccccacgacgatccta

SEQ ID NO: 586317 - DNA, 20 bp, mouse
gtagggaatgcacctcgcgg

SEQ ID NO: 586318 - DNA, 20 bp, mouse
gcggcgagcgcaatgggagt

SEQ ID NO: 586319 - DNA, 20 bp, mouse
gcgagagcagagcgcacgag

SEQ ID NO: 586320 - DNA, 20 bp, mouse
gcgtccggaggccctctcta

SEQ ID NO: 586321 - DNA, 20 bp, mouse
gatgggagtgggcacccggt

SEQ ID NO: 586322 - DNA, 20 bp, mouse
gggcgcacgtcgtcaagaca

SEQ ID NO: 586323 - DNA, 20 bp, mouse
gtcctagggaatgcacctcg

SEQ ID NO: 586324 - DNA, 20 bp, mouse
ggagcccagcgcagcctacc

SEQ ID NO: 586325 - DNA, 20 bp, mouse
gtccggggccatgcgaccaa

SEQ ID NO: 586326 - DNA, 20 bp, mouse
gggcaccctctcctacacga

SEQ ID NO: 586327 - DNA, 20 bp, mouse
gtccacaaggcggatcaccc

SEQ ID NO: 586328 - DNA, 20 bp, mouse
gcagaagactgccctcgtgt

SEQ ID NO: 586329 - DNA, 20 bp, mouse
ggcacagacaaaaaatcgaa

SEQ ID NO: 586330 - DNA, 20 bp, mouse
gatccgtgcttggtcccaaa

SEQ ID NO: 586331 - DNA, 20 bp, mouse
gactgccctcgtgtaggaga

SEQ ID NO: 586332 - DNA, 20 bp, mouse
gaaggctggtaaacagtaga

SEQ ID NO: 586333 - DNA, 20 bp, mouse
gagctggacacagagtcccg

SEQ ID NO: 586334 - DNA, 20 bp, mouse
ggtgaaagcaggcgtctgga

SEQ ID NO: 586335 - DNA, 20 bp, mouse
gttcaaatcgatccacaagg

SEQ ID NO: 586336 - DNA, 20 bp, mouse
ggtgcctcggaagtccgcag

SEQ ID NO: 586337 - DNA, 20 bp, mouse
gcgagcagcgctggccactg

SEQ ID NO: 586338 - DNA, 20 bp, mouse
gcacaggaggccgggactag

SEQ ID NO: 586339 - DNA, 20 bp, mouse
ggcgagcgctggcagttccg

SEQ ID NO: 586340 - DNA, 20 bp, mouse
gtggccactgcggacttccg

SEQ ID NO: 586341 - DNA, 20 bp, mouse
ggcgctggcagttccgtggt

SEQ ID NO: 586342 - DNA, 20 bp, mouse
gcacccgaggggtctaggtc

SEQ ID NO: 586343 - DNA, 20 bp, mouse
gggcagttccgtggtgggga

SEQ ID NO: 586344 - DNA, 20 bp, mouse
gcgcgcctgggacacccgag

SEQ ID NO: 586345 - DNA, 20 bp, mouse
gttcacggcccggagtgcct

SEQ ID NO: 586346 - DNA, 20 bp, mouse
gtgagaagctgagacggccg

SEQ ID NO: 586347 - DNA, 20 bp, mouse
gatgggggcgggaggaacaa

SEQ ID NO: 586348 - DNA, 20 bp, mouse
gccggcgcgatgaaccgcgg

SEQ ID NO: 586349 - DNA, 20 bp, mouse
ggctccggcgcgatgaaccg

SEQ ID NO: 586350 - DNA, 20 bp, mouse
gagacccggcggcagcccag

SEQ ID NO: 586351 - DNA, 20 bp, mouse
gtcggcggggacggcagccg

SEQ ID NO: 586352 - DNA, 20 bp, mouse
gcaccgcggccgctagcgaa

SEQ ID NO: 586353 - DNA, 20 bp, mouse
gggcgggggtctggcgatgg

SEQ ID NO: 586354 - DNA, 20 bp, mouse
gagcgcggctgccctgaagg

SEQ ID NO: 586355 - DNA, 20 bp, mouse
ggagagcaacacgaatctcc

SEQ ID NO: 586356 - DNA, 20 bp, mouse
gcagctaccggcacacacaa

SEQ ID NO: 586357 - DNA, 20 bp, mouse
ggcgggcgttggggacgacg

SEQ ID NO: 586358 - DNA, 20 bp, mouse
ggggcccagggaccccgcca

SEQ ID NO: 586359 - DNA, 20 bp, mouse
ggtcccgcaccggcagctac

SEQ ID NO: 586360 - DNA, 20 bp, mouse
gcacctggctggcgcgggcc

SEQ ID NO: 586361 - DNA, 20 bp, mouse
ggcactcacctggctggcgc

SEQ ID NO: 586362 - DNA, 20 bp, mouse
gctccgtgcgtcaggctggg

SEQ ID NO: 586363 - DNA, 20 bp, mouse
gcccgcggggctcgcacctc

SEQ ID NO: 586364 - DNA, 20 bp, mouse
ggagctccggggttgccgta

SEQ ID NO: 586365 - DNA, 20 bp, mouse
ggccgcagacaaagcgcccg

SEQ ID NO: 586366 - DNA, 20 bp, mouse
ggctctcgctgaaggcgggg

SEQ ID NO: 586367 - DNA, 20 bp, mouse
ggagcgcggggcgcgagtcg

SEQ ID NO: 586368 - DNA, 20 bp, mouse
gcagaagcgagccggagcgc

SEQ ID NO: 586369 - DNA, 20 bp, mouse
gcaggcaagtgagcgccggg

SEQ ID NO: 586370 - DNA, 20 bp, mouse
gggtccgggccgaaagatgg

SEQ ID NO: 586371 - DNA, 20 bp, mouse
ggcccctcgccgggaagagg

SEQ ID NO: 586372 - DNA, 20 bp, mouse
ggggcaatccagaagcgagc

SEQ ID NO: 586373 - DNA, 20 bp, mouse
ggccgacgagacctcaggtg

SEQ ID NO: 586374 - DNA, 20 bp, mouse
gcagcgagagccccggccgg

SEQ ID NO: 586375 - DNA, 20 bp, mouse
gacggggccgacgagacctc

SEQ ID NO: 586376 - DNA, 20 bp, mouse
gttacggagagagatatcaa

SEQ ID NO: 586377 - DNA, 20 bp, mouse
gggctcggacgagcgaccgg

SEQ ID NO: 586378 - DNA, 20 bp, mouse
gcgctcgtccgagcccccaa

SEQ ID NO: 586379 - DNA, 20 bp, mouse
gatctctctccgtaaatcgg

SEQ ID NO: 586380 - DNA, 20 bp, mouse
gccgccgcgccaccgattta

SEQ ID NO: 586381 - DNA, 20 bp, mouse
gtcggacgagcgaccggagg

SEQ ID NO: 586382 - DNA, 20 bp, mouse
ggccggagccgccgggacat

SEQ ID NO: 586383 - DNA, 20 bp, mouse
gtcgctcacccatgtcccgg

SEQ ID NO: 586384 - DNA, 20 bp, mouse
gccggctggtgggtcgacag

SEQ ID NO: 586385 - DNA, 20 bp, mouse
gcccggcgccccccgagcga

SEQ ID NO: 586386 - DNA, 20 bp, mouse
gctgggcctcgcgcaggtgg

SEQ ID NO: 586387 - DNA, 20 bp, mouse
gcccggccccgcagcggtgg

SEQ ID NO: 586388 - DNA, 20 bp, mouse
gcgatcctccgaaccagagg

SEQ ID NO: 586389 - DNA, 20 bp, mouse
gaccgcgcgcagcacctcag

SEQ ID NO: 586390 - DNA, 20 bp, mouse
gcggagcagctggatcaggg

SEQ ID NO: 586391 - DNA, 20 bp, mouse
gggccggagcagctggatca

SEQ ID NO: 586392 - DNA, 20 bp, mouse
ggcggcggcagcgcgagacc

SEQ ID NO: 586393 - DNA, 20 bp, mouse
gccgctgggcctcgcgcagg

SEQ ID NO: 586394 - DNA, 20 bp, mouse
gtttggtgcgcgcgccgggg

SEQ ID NO: 586395 - DNA, 20 bp, mouse
ggcccagggagcctgaagat

SEQ ID NO: 586396 - DNA, 20 bp, mouse
gagcgcggcgcagggaaggg

SEQ ID NO: 586397 - DNA, 20 bp, mouse
ggtaagcgcggcgcagggaa

SEQ ID NO: 586398 - DNA, 20 bp, mouse
gcaagggcagcggcagctcg

SEQ ID NO: 586399 - DNA, 20 bp, mouse
gggcccggcagccgctaagg

SEQ ID NO: 586400 - DNA, 20 bp, mouse
gcccggcggggatgtaagcg

SEQ ID NO: 586401 - DNA, 20 bp, mouse
gagagagaggccgcggtcag

SEQ ID NO: 586402 - DNA, 20 bp, mouse
gcggggcccggcagccgcta

SEQ ID NO: 586403 - DNA, 20 bp, mouse
gtccgccgccagccgcctcc

SEQ ID NO: 586404 - DNA, 20 bp, mouse
gaggaggagggtgagcactc

SEQ ID NO: 586405 - DNA, 20 bp, mouse
gcggtgtattgtgggatgtg

SEQ ID NO: 586406 - DNA, 20 bp, mouse
gggagcagagacttactcag

SEQ ID NO: 586407 - DNA, 20 bp, mouse
ggccgccgcgatcggaccag

SEQ ID NO: 586408 - DNA, 20 bp, mouse
gcagccgccaccgaagatgg

SEQ ID NO: 586409 - DNA, 20 bp, mouse
gctggagcgaccaacgacag

SEQ ID NO: 586410 - DNA, 20 bp, mouse
ggccgctggtccgatcgcgg

SEQ ID NO: 586411 - DNA, 20 bp, mouse
ggcagcggcttcatgaggag

SEQ ID NO: 586412 - DNA, 20 bp, mouse
gggcggcgcgtcctgaccgg

SEQ ID NO: 586413 - DNA, 20 bp, mouse
gcaacgacagcgggagaccg

SEQ ID NO: 586414 - DNA, 20 bp, mouse
ggcggccgctggtccgatcg

SEQ ID NO: 586415 - DNA, 20 bp, mouse
gtccccgcggcaggccgatg

SEQ ID NO: 586416 - DNA, 20 bp, mouse
ggagccgggttgggcctagg

SEQ ID NO: 586417 - DNA, 20 bp, mouse
gggcaggcccggtccctgag

SEQ ID NO: 586418 - DNA, 20 bp, mouse
gtaggcggcggggctgtctc

SEQ ID NO: 586419 - DNA, 20 bp, mouse
gccgtccagcccctcccgtc

SEQ ID NO: 586420 - DNA, 20 bp, mouse
ggcctcacctccttaaggag

SEQ ID NO: 586421 - DNA, 20 bp, mouse
ggttccaccgctccttaagg

SEQ ID NO: 586422 - DNA, 20 bp, mouse
gccgctgcgcgaagacgaag

SEQ ID NO: 586423 - DNA, 20 bp, mouse
gcaccggaggaaggaaacca

SEQ ID NO: 586424 - DNA, 20 bp, mouse
gggccctgagaactcggtcg

SEQ ID NO: 586425 - DNA, 20 bp, mouse
gacgctcgccagtcccctca

SEQ ID NO: 586426 - DNA, 20 bp, mouse
gccaccagctacggagaaag

SEQ ID NO: 586427 - DNA, 20 bp, mouse
gcagaccgctccaccagcta

SEQ ID NO: 586428 - DNA, 20 bp, mouse
gatgcgcgtgccagaggcgt

SEQ ID NO: 586429 - DNA, 20 bp, mouse
gtgtggaacctctcccggaa

SEQ ID NO: 586430 - DNA, 20 bp, mouse
ggcctgcgcagtagtcgctc

SEQ ID NO: 586431 - DNA, 20 bp, mouse
ggctacggagaaagcggctg

SEQ ID NO: 586432 - DNA, 20 bp, mouse
gagaaaccgcggcgaagccg

SEQ ID NO: 586433 - DNA, 20 bp, mouse
gaggccccggtggcaagcag

SEQ ID NO: 586434 - DNA, 20 bp, mouse
ggcggtctgcgtccgtaccc

SEQ ID NO: 586435 - DNA, 20 bp, mouse
gcaggcaacgccaggcccac

SEQ ID NO: 586436 - DNA, 20 bp, mouse
gggcgcacggcactcccggg

SEQ ID NO: 586437 - DNA, 20 bp, mouse
ggcccgtacccgtgaggtgg

SEQ ID NO: 586438 - DNA, 20 bp, mouse
gtcccggccaggaaacgccg

SEQ ID NO: 586439 - DNA, 20 bp, mouse
gtgcggcgcacggcactccc

SEQ ID NO: 586440 - DNA, 20 bp, mouse
gactcgagttaggcccaacg

SEQ ID NO: 586441 - DNA, 20 bp, mouse
ggtcagtggcgtttccgctc

SEQ ID NO: 586442 - DNA, 20 bp, mouse
ggtctctgagcgcaggcggg

SEQ ID NO: 586443 - DNA, 20 bp, mouse
gggaatggcccgtacccgtg

SEQ ID NO: 586444 - DNA, 20 bp, mouse
gcccgaggagagggaacgca

SEQ ID NO: 586445 - DNA, 20 bp, mouse
gggaatccccgtgcggtcag

SEQ ID NO: 586446 - DNA, 20 bp, mouse
gagggacagggcgcgacgag

SEQ ID NO: 586447 - DNA, 20 bp, mouse
ggcgcgcgcgggtaagtggc

SEQ ID NO: 586448 - DNA, 20 bp, mouse
ggcgcgggcagctctcgggg

SEQ ID NO: 586449 - DNA, 20 bp, mouse
ggagctgagtcctaaggtga

SEQ ID NO: 586450 - DNA, 20 bp, mouse
ggcgctggtgcaggcgagtg

SEQ ID NO: 586451 - DNA, 20 bp, mouse
ggggctggagctgagtccta

SEQ ID NO: 586452 - DNA, 20 bp, mouse
gccagcggcggcgagcccga

SEQ ID NO: 586453 - DNA, 20 bp, mouse
gtcggaggctggcaagggag

SEQ ID NO: 586454 - DNA, 20 bp, mouse
gacggtgagccggcagggca

SEQ ID NO: 586455 - DNA, 20 bp, mouse
gccggctgctcgcagcatgg

SEQ ID NO: 586456 - DNA, 20 bp, mouse
gccaggagcacccagaggga

SEQ ID NO: 586457 - DNA, 20 bp, mouse
gtcatcgtcgctatccatgg

SEQ ID NO: 586458 - DNA, 20 bp, mouse
gtgagaccctacccagcccg

SEQ ID NO: 586459 - DNA, 20 bp, mouse
gcacggccccgggctgggta

SEQ ID NO: 586460 - DNA, 20 bp, mouse
gacctcatcgtcgctatcca

SEQ ID NO: 586461 - DNA, 20 bp, mouse
gcggagatcgcgggcctcaa

SEQ ID NO: 586462 - DNA, 20 bp, mouse
ggcggaaagcgccaaaagag

SEQ ID NO: 586463 - DNA, 20 bp, mouse
gggtcgctcggctcaggcgg

SEQ ID NO: 586464 - DNA, 20 bp, mouse
gcggcgccgggtgatgtcag

SEQ ID NO: 586465 - DNA, 20 bp, mouse
gagcgtcgcaactcccaggg

SEQ ID NO: 586466 - DNA, 20 bp, mouse
gtcgctccgggccccggctg

SEQ ID NO: 586467 - DNA, 20 bp, mouse
gcccggagcgaggccgggga

SEQ ID NO: 586468 - DNA, 20 bp, mouse
gccatggcccgtagcaggcc

SEQ ID NO: 586469 - DNA, 20 bp, mouse
ggcctagccgggctgcaggt

SEQ ID NO: 586470 - DNA, 20 bp, mouse
gaagggccggcggcgcccca

SEQ ID NO: 586471 - DNA, 20 bp, mouse
gctacgggccatgggcgaag

SEQ ID NO: 586472 - DNA, 20 bp, mouse
gcgctccgggaaagggccgg

SEQ ID NO: 586473 - DNA, 20 bp, mouse
gcggcgctccgggaaagggc

SEQ ID NO: 586474 - DNA, 20 bp, mouse
gcggggcccggagcgaggcc

SEQ ID NO: 586475 - DNA, 20 bp, mouse
ggccgtccccggcctcgctc

SEQ ID NO: 586476 - DNA, 20 bp, mouse
gtttcccgggagattccagg

SEQ ID NO: 586477 - DNA, 20 bp, mouse
gcggtgacagagcccggcca

SEQ ID NO: 586478 - DNA, 20 bp, mouse
gagagcccggccatggctag

SEQ ID NO: 586479 - DNA, 20 bp, mouse
ggctcacaggcatcctccta

SEQ ID NO: 586480 - DNA, 20 bp, mouse
gtggggatccggagggacag

SEQ ID NO: 586481 - DNA, 20 bp, mouse
gaatacctctagccatggcc

SEQ ID NO: 586482 - DNA, 20 bp, mouse
gagcagtgcggctctcagct

SEQ ID NO: 586483 - DNA, 20 bp, mouse
gtggagcatggggatccgga

SEQ ID NO: 586484 - DNA, 20 bp, mouse
gcggagggacaggggactct

SEQ ID NO: 586485 - DNA, 20 bp, mouse
gcaacaaggggaatgtactc

SEQ ID NO: 586486 - DNA, 20 bp, mouse
gactgaaggagagacggcgg

SEQ ID NO: 586487 - DNA, 20 bp, mouse
ggaggggaaacagcgtgagg

SEQ ID NO: 586488 - DNA, 20 bp, mouse
gcgacggtccggaagcaata

SEQ ID NO: 586489 - DNA, 20 bp, mouse
gggggaggggaaacagcgtg

SEQ ID NO: 586490 - DNA, 20 bp, mouse
gtgctggtcgcagactccca

SEQ ID NO: 586491 - DNA, 20 bp, mouse
gggggcggggagcaaaccga

SEQ ID NO: 586492 - DNA, 20 bp, mouse
gaaggagagacggcggggga

SEQ ID NO: 586493 - DNA, 20 bp, mouse
gggggagcaaaccgacggtc

SEQ ID NO: 586494 - DNA, 20 bp, mouse
ggcaatagggagcgtccttc

SEQ ID NO: 586495 - DNA, 20 bp, mouse
gggacgctccctattgcttc

SEQ ID NO: 586496 - DNA, 20 bp, mouse
gagagtctgcagtcccgagg

SEQ ID NO: 586497 - DNA, 20 bp, mouse
gactgtgtggagctcccttg

SEQ ID NO: 586498 - DNA, 20 bp, mouse
gggcggcttcacctcagcgg

SEQ ID NO: 586499 - DNA, 20 bp, mouse
gcggggccgcggaaactgtg

SEQ ID NO: 586500 - DNA, 20 bp, mouse
gtatcatgggctgtagacag

SEQ ID NO: 586501 - DNA, 20 bp, mouse
ggctgatgtctcccccgctg

SEQ ID NO: 586502 - DNA, 20 bp, mouse
gggggagacatcagccccaa

SEQ ID NO: 586503 - DNA, 20 bp, mouse
ggctgaggtgaagccgcctc

SEQ ID NO: 586504 - DNA, 20 bp, mouse
ggagtcgccgaccaatcagg

SEQ ID NO: 586505 - DNA, 20 bp, mouse
ggccagtgtaaccttacctg

SEQ ID NO: 586506 - DNA, 20 bp, mouse
gtaaatgtctgcggaaggtg

SEQ ID NO: 586507 - DNA, 20 bp, mouse
gtcctcccggaggcccaaaa

SEQ ID NO: 586508 - DNA, 20 bp, mouse
gccggaggcccaaaatggtc

SEQ ID NO: 586509 - DNA, 20 bp, mouse
ggcgagaccataaatgtctg

SEQ ID NO: 586510 - DNA, 20 bp, mouse
ggagatagcagcatctgagg

SEQ ID NO: 586511 - DNA, 20 bp, mouse
gctcgagatagcagcatctg

SEQ ID NO: 586512 - DNA, 20 bp, mouse
ggccagagggcggcgctaga

SEQ ID NO: 586513 - DNA, 20 bp, mouse
gcagggctaagtggctgaaa

SEQ ID NO: 586514 - DNA, 20 bp, mouse
gagctcaccgatcttagggg

SEQ ID NO: 586515 - DNA, 20 bp, mouse
ggaccataaatgtctgcgga

SEQ ID NO: 586516 - DNA, 20 bp, mouse
ggctagaacagcagacggaa

SEQ ID NO: 586517 - DNA, 20 bp, mouse
gtccgcggcgcgtctcaccc

SEQ ID NO: 586518 - DNA, 20 bp, mouse
gcgtctgctgttctagcggg

SEQ ID NO: 586519 - DNA, 20 bp, mouse
gctgcagccgggcctagccg

SEQ ID NO: 586520 - DNA, 20 bp, mouse
ggccgcgcgcaagttcccaa

SEQ ID NO: 586521 - DNA, 20 bp, mouse
ggcgggcgaacgagcaggag

SEQ ID NO: 586522 - DNA, 20 bp, mouse
gggcttgccgctgctaccaa

SEQ ID NO: 586523 - DNA, 20 bp, mouse
ggtctcaccccggctaggcc

SEQ ID NO: 586524 - DNA, 20 bp, mouse
gcggaagtgacgccactcag

SEQ ID NO: 586525 - DNA, 20 bp, mouse
ggttctagcggggggcatgg

SEQ ID NO: 586526 - DNA, 20 bp, mouse
gggtcccggggagagcagcg

SEQ ID NO: 586527 - DNA, 20 bp, mouse
gtgattctgtcaggcgctgg

SEQ ID NO: 586528 - DNA, 20 bp, mouse
gccaggagcgccagcagcga

SEQ ID NO: 586529 - DNA, 20 bp, mouse
gggcgggcgcggactcccag

SEQ ID NO: 586530 - DNA, 20 bp, mouse
gggagaggcgtgggcgcggg

SEQ ID NO: 586531 - DNA, 20 bp, mouse
gcctgacagaatcagcacca

SEQ ID NO: 586532 - DNA, 20 bp, mouse
ggcggccccgctgctctccc

SEQ ID NO: 586533 - DNA, 20 bp, mouse
gcggggggcagagccggtcc

SEQ ID NO: 586534 - DNA, 20 bp, mouse
gagccccgcgcggcgatccc

SEQ ID NO: 586535 - DNA, 20 bp, mouse
gggcgcggactcccaggggt

SEQ ID NO: 586536 - DNA, 20 bp, mouse
gtgcagctcggccagagcca

SEQ ID NO: 586537 - DNA, 20 bp, mouse
gaatcaggcagtgctatcca

SEQ ID NO: 586538 - DNA, 20 bp, mouse
gggatctgggcagtaggatc

SEQ ID NO: 586539 - DNA, 20 bp, mouse
ggatccgtgcggtggagtcc

SEQ ID NO: 586540 - DNA, 20 bp, mouse
ggctctggccgagctgcacc

SEQ ID NO: 586541 - DNA, 20 bp, mouse
gcgcgggcgacggacgagtg

SEQ ID NO: 586542 - DNA, 20 bp, mouse
gcggcgcagagagatccgtg

SEQ ID NO: 586543 - DNA, 20 bp, mouse
ggattcgagcagccggaatc

SEQ ID NO: 586544 - DNA, 20 bp, mouse
gagatccgtgtggtcggtcc

SEQ ID NO: 586545 - DNA, 20 bp, mouse
gctgcaccgggcgcgggcga

SEQ ID NO: 586546 - DNA, 20 bp, mouse
gcttatctcggagaggaaga

SEQ ID NO: 586547 - DNA, 20 bp, mouse
gaccggggcttatctcggag

SEQ ID NO: 586548 - DNA, 20 bp, mouse
gggccactggagctgcggga

SEQ ID NO: 586549 - DNA, 20 bp, mouse
gggaaagggttgcggaacca

SEQ ID NO: 586550 - DNA, 20 bp, mouse
gcccttatgaggttcaaccg

SEQ ID NO: 586551 - DNA, 20 bp, mouse
ggatccagagggcccttatg

SEQ ID NO: 586552 - DNA, 20 bp, mouse
ggttcaaccggggcttatct

SEQ ID NO: 586553 - DNA, 20 bp, mouse
gtcctctccgagataagccc

SEQ ID NO: 586554 - DNA, 20 bp, mouse
ggaagctgaagctcggccac

SEQ ID NO: 586555 - DNA, 20 bp, mouse
gagctcggccactggagctg

SEQ ID NO: 586556 - DNA, 20 bp, mouse
gagccgcccatggaagcgca

SEQ ID NO: 586557 - DNA, 20 bp, mouse
gagccctgcgcttccatggg

SEQ ID NO: 586558 - DNA, 20 bp, mouse
gactagccctgcgcttccat

SEQ ID NO: 586559 - DNA, 20 bp, mouse
ggaggaagagcagccgccca

SEQ ID NO: 586560 - DNA, 20 bp, mouse
gatctcctaggacatccttg

SEQ ID NO: 586561 - DNA, 20 bp, mouse
gtccgtagcatagactatgg

SEQ ID NO: 586562 - DNA, 20 bp, mouse
gagatcagcagatctggcaa

SEQ ID NO: 586563 - DNA, 20 bp, mouse
gacctccatagtctatgcta

SEQ ID NO: 586564 - DNA, 20 bp, mouse
gatggaggtacagcacacct

SEQ ID NO: 586565 - DNA, 20 bp, mouse
gttctccgtagcatagacta

SEQ ID NO: 586566 - DNA, 20 bp, mouse
ggcccgccgcgtgagaggac

SEQ ID NO: 586567 - DNA, 20 bp, mouse
gggcgccagacgcacaaaga

SEQ ID NO: 586568 - DNA, 20 bp, mouse
ggccagacgcacaaagaggg

SEQ ID NO: 586569 - DNA, 20 bp, mouse
ggggaggggacccgactacg

SEQ ID NO: 586570 - DNA, 20 bp, mouse
ggggagcccgtcctctcacg

SEQ ID NO: 586571 - DNA, 20 bp, mouse
gactacgcggctgaagagcg

SEQ ID NO: 586572 - DNA, 20 bp, mouse
gagcccgtcctctcacgcgg

SEQ ID NO: 586573 - DNA, 20 bp, mouse
gccgccgcccgccgcgtgag

SEQ ID NO: 586574 - DNA, 20 bp, mouse
ggtaggcccagcttacccag

SEQ ID NO: 586575 - DNA, 20 bp, mouse
gtcccgagcgccaataggct

SEQ ID NO: 586576 - DNA, 20 bp, mouse
gcagggctgccagtccacct

SEQ ID NO: 586577 - DNA, 20 bp, mouse
gggctgccagtccacctcgg

SEQ ID NO: 586578 - DNA, 20 bp, mouse
gccacagcgcccgcgcggag

SEQ ID NO: 586579 - DNA, 20 bp, mouse
gagaccccagaggaagccgg

SEQ ID NO: 586580 - DNA, 20 bp, mouse
gttgagttggatacttcgtg

SEQ ID NO: 586581 - DNA, 20 bp, mouse
gtcccgcggcttctctctct

SEQ ID NO: 586582 - DNA, 20 bp, mouse
gccaccccgaaggacatgga

SEQ ID NO: 586583 - DNA, 20 bp, mouse
gggttcacataagaccccag

SEQ ID NO: 586584 - DNA, 20 bp, mouse
ggatacctgtttggactcag

SEQ ID NO: 586585 - DNA, 20 bp, mouse
gtgcatgactgcgacgctca

SEQ ID NO: 586586 - DNA, 20 bp, mouse
gccttggcggagattaaacc

SEQ ID NO: 586587 - DNA, 20 bp, mouse
gcagctcctcaccaacgcta

SEQ ID NO: 586588 - DNA, 20 bp, mouse
ggatagcgaggccttagcgt

SEQ ID NO: 586589 - DNA, 20 bp, mouse
gcgaggccttagcgttggtg

SEQ ID NO: 586590 - DNA, 20 bp, mouse
gcgatcctgaggcaagaggg

SEQ ID NO: 586591 - DNA, 20 bp, mouse
gggtggcggctgctccgtcg

SEQ ID NO: 586592 - DNA, 20 bp, mouse
gcaatcacgcggcgacccaa

SEQ ID NO: 586593 - DNA, 20 bp, mouse
gggcgaaaccgcggccttgg

SEQ ID NO: 586594 - DNA, 20 bp, mouse
gggtgggagcgaaagcccgg

SEQ ID NO: 586595 - DNA, 20 bp, mouse
gacaggagcagtggtcgcca

SEQ ID NO: 586596 - DNA, 20 bp, mouse
gtgagacgctggctgaaagg

SEQ ID NO: 586597 - DNA, 20 bp, mouse
gtggccacggcgtttcaagg

SEQ ID NO: 586598 - DNA, 20 bp, mouse
gccttggccacggcgtttca

SEQ ID NO: 586599 - DNA, 20 bp, mouse
gcagcaacggcgctatcatg

SEQ ID NO: 586600 - DNA, 20 bp, mouse
gggtccgccttgaaacgccg

SEQ ID NO: 586601 - DNA, 20 bp, mouse
gggcggaccactaacactgc

SEQ ID NO: 586602 - DNA, 20 bp, mouse
ggccgagccagcttaggagg

SEQ ID NO: 586603 - DNA, 20 bp, mouse
gcagagtgccgagccagctt

SEQ ID NO: 586604 - DNA, 20 bp, mouse
ggtgtttccggcagtgttag

SEQ ID NO: 586605 - DNA, 20 bp, mouse
gagtgccgagccagcttagg

SEQ ID NO: 586606 - DNA, 20 bp, mouse
ggtcgcgcgtgggaagggaa

SEQ ID NO: 586607 - DNA, 20 bp, mouse
gagatcgccaagactcacga

SEQ ID NO: 586608 - DNA, 20 bp, mouse
gtgtgttcgagtggacaaaa

SEQ ID NO: 586609 - DNA, 20 bp, mouse
gggctgccgaggtcgcgcgt

SEQ ID NO: 586610 - DNA, 20 bp, mouse
gccgaggtcgcgcgtgggaa

SEQ ID NO: 586611 - DNA, 20 bp, mouse
ggcggcgagcggaagtcctt

SEQ ID NO: 586612 - DNA, 20 bp, mouse
gggtgcgcacgctcagagag

SEQ ID NO: 586613 - DNA, 20 bp, mouse
gcgagaggacgccattacgc

SEQ ID NO: 586614 - DNA, 20 bp, mouse
ggtccactcgaacacacaga

SEQ ID NO: 586615 - DNA, 20 bp, mouse
gtcgccgccgccagaaacag

SEQ ID NO: 586616 - DNA, 20 bp, mouse
gagcatcccgaacctcccaa

SEQ ID NO: 586617 - DNA, 20 bp, mouse
gcgcagcccaggctccatag

SEQ ID NO: 586618 - DNA, 20 bp, mouse
gagaaggcgcgagaccaaca

SEQ ID NO: 586619 - DNA, 20 bp, mouse
gaggctccatagtggcctgg

SEQ ID NO: 586620 - DNA, 20 bp, mouse
gactgcaactctcctttggg

SEQ ID NO: 586621 - DNA, 20 bp, mouse
gggcaactgcaactctcctt

SEQ ID NO: 586622 - DNA, 20 bp, mouse
gacccaggagacccacgggg

SEQ ID NO: 586623 - DNA, 20 bp, mouse
ggtcgagaggggccctgcgt

SEQ ID NO: 586624 - DNA, 20 bp, mouse
gcgccttcttgtggctaaga

SEQ ID NO: 586625 - DNA, 20 bp, mouse
gttggtctcgcgccttcttg

SEQ ID NO: 586626 - DNA, 20 bp, mouse
gccgtcttgaaggctaatgg

SEQ ID NO: 586627 - DNA, 20 bp, mouse
gtaggcccgagaggttcggt

SEQ ID NO: 586628 - DNA, 20 bp, mouse
ggacgccggcggatcggcag

SEQ ID NO: 586629 - DNA, 20 bp, mouse
gggatggcttcggtacccga

SEQ ID NO: 586630 - DNA, 20 bp, mouse
ggccggcggatcggcagtgg

SEQ ID NO: 586631 - DNA, 20 bp, mouse
gggcccgtcttgaaggctaa

SEQ ID NO: 586632 - DNA, 20 bp, mouse
gcccgtcgcgcggcacccga

SEQ ID NO: 586633 - DNA, 20 bp, mouse
gggaagtggagagcgctcat

SEQ ID NO: 586634 - DNA, 20 bp, mouse
gacccgaaggcccgtcttga

SEQ ID NO: 586635 - DNA, 20 bp, mouse
gtcggcagtggcggtggctt

SEQ ID NO: 586636 - DNA, 20 bp, mouse
gggagagaagagcccaagat

SEQ ID NO: 586637 - DNA, 20 bp, mouse
gcgatctccgaacggaatca

SEQ ID NO: 586638 - DNA, 20 bp, mouse
ggaagcaggcgatgaggagt

SEQ ID NO: 586639 - DNA, 20 bp, mouse
gtgtaactgaggtcaggggg

SEQ ID NO: 586640 - DNA, 20 bp, mouse
gctggtccggtactcccggg

SEQ ID NO: 586641 - DNA, 20 bp, mouse
gcggccagccaggtgcccag

SEQ ID NO: 586642 - DNA, 20 bp, mouse
gttgctggtccggtactccc

SEQ ID NO: 586643 - DNA, 20 bp, mouse
gtggtagacgagatcccccc

SEQ ID NO: 586644 - DNA, 20 bp, mouse
gcaattaccctgattccgtt

SEQ ID NO: 586645 - DNA, 20 bp, mouse
gagttgtaactgaggtcagg

SEQ ID NO: 586646 - DNA, 20 bp, mouse
ggtaggagcagtaggagtcg

SEQ ID NO: 586647 - DNA, 20 bp, mouse
gcccgcgcctgcacgaactg

SEQ ID NO: 586648 - DNA, 20 bp, mouse
gccggcacacggggaagact

SEQ ID NO: 586649 - DNA, 20 bp, mouse
ggtctactcctgcgtctcgg

SEQ ID NO: 586650 - DNA, 20 bp, mouse
gacctcagttcgtgcaggcg

SEQ ID NO: 586651 - DNA, 20 bp, mouse
gcgacaccaccaagtgggaa

SEQ ID NO: 586652 - DNA, 20 bp, mouse
gtcggagcctacgagcagag

SEQ ID NO: 586653 - DNA, 20 bp, mouse
gaccagccattcccacttgg

SEQ ID NO: 586654 - DNA, 20 bp, mouse
gactgtctactcctgcgtct

SEQ ID NO: 586655 - DNA, 20 bp, mouse
ggcaaaacctcagttcgtgc

SEQ ID NO: 586656 - DNA, 20 bp, mouse
gagcagacgctagacagagg

SEQ ID NO: 586657 - DNA, 20 bp, mouse
gcgggcctcgtacctgaggg

SEQ ID NO: 586658 - DNA, 20 bp, mouse
gggccgggcctcgtacctga

SEQ ID NO: 586659 - DNA, 20 bp, mouse
gagacagaggtggtagcaaa

SEQ ID NO: 586660 - DNA, 20 bp, mouse
gaagctggaggcgctaggcc

SEQ ID NO: 586661 - DNA, 20 bp, mouse
ggagctggagaatcactcag

SEQ ID NO: 586662 - DNA, 20 bp, mouse
gggcgcagggccggaaactc

SEQ ID NO: 586663 - DNA, 20 bp, mouse
gcagcggagctctccaccag

SEQ ID NO: 586664 - DNA, 20 bp, mouse
gcgcgttgccgtggagacgg

SEQ ID NO: 586665 - DNA, 20 bp, mouse
ggcatggaccagagccttgt

SEQ ID NO: 586666 - DNA, 20 bp, mouse
gcgagcagcgcgagcggaaa

SEQ ID NO: 586667 - DNA, 20 bp, mouse
gccggagcgcgggtgcaggg

SEQ ID NO: 586668 - DNA, 20 bp, mouse
ggtgcggcgccctcccaaag

SEQ ID NO: 586669 - DNA, 20 bp, mouse
ggatctgaggcgccaacggg

SEQ ID NO: 586670 - DNA, 20 bp, mouse
gtcccgcgcggcggcctgag

SEQ ID NO: 586671 - DNA, 20 bp, mouse
ggcgcgggcgagcgccaaga

SEQ ID NO: 586672 - DNA, 20 bp, mouse
ggcagcgagcgcgcgatctg

SEQ ID NO: 586673 - DNA, 20 bp, mouse
ggggaagcgccgggagccag

SEQ ID NO: 586674 - DNA, 20 bp, mouse
ggacgcgcccgggcacctcg

SEQ ID NO: 586675 - DNA, 20 bp, mouse
gggcggcctgaggggtggtg

SEQ ID NO: 586676 - DNA, 20 bp, mouse
ggagttgaaggagtgagaag

SEQ ID NO: 586677 - DNA, 20 bp, mouse
gtaaggtcggagactcctga

SEQ ID NO: 586678 - DNA, 20 bp, mouse
ggagtgagaagaggtaagtt

SEQ ID NO: 586679 - DNA, 20 bp, mouse
ggattccagagtgtatgtcc

SEQ ID NO: 586680 - DNA, 20 bp, mouse
gaggatcagctgcgagttga

SEQ ID NO: 586681 - DNA, 20 bp, mouse
ggtctcaggtgaagaatccg

SEQ ID NO: 586682 - DNA, 20 bp, mouse
gtgatccttcagaaagaggt

SEQ ID NO: 586683 - DNA, 20 bp, mouse
gttcccggtgtccaactctt

SEQ ID NO: 586684 - DNA, 20 bp, mouse
gcagctgatccttcagaaag

SEQ ID NO: 586685 - DNA, 20 bp, mouse
gctttcccacctctttctga

SEQ ID NO: 586686 - DNA, 20 bp, mouse
ggggagctggaggacccgag

SEQ ID NO: 586687 - DNA, 20 bp, mouse
ggacccgagcgggcgcgcta

SEQ ID NO: 586688 - DNA, 20 bp, mouse
gagcgggcgcgctagggagg

SEQ ID NO: 586689 - DNA, 20 bp, mouse
gccgagcgggcgcgctaggg

SEQ ID NO: 586690 - DNA, 20 bp, mouse
gattggaatgaggctgtagt

SEQ ID NO: 586691 - DNA, 20 bp, mouse
ggccgggcatgcgcatagag

SEQ ID NO: 586692 - DNA, 20 bp, mouse
gtaggacgccgccccagaca

SEQ ID NO: 586693 - DNA, 20 bp, mouse
gcatagagaggatgccatat

SEQ ID NO: 586694 - DNA, 20 bp, mouse
gcggcccgcgagcagatctc

SEQ ID NO: 586695 - DNA, 20 bp, mouse
gaggatgccatattggaatg

SEQ ID NO: 586696 - DNA, 20 bp, mouse
ggacagacagacgggcgaac

SEQ ID NO: 586697 - DNA, 20 bp, mouse
ggagtccagcaggccgagta

SEQ ID NO: 586698 - DNA, 20 bp, mouse
gttctgcggctcccttgctc

SEQ ID NO: 586699 - DNA, 20 bp, mouse
ggttggctgaacaggccgaa

SEQ ID NO: 586700 - DNA, 20 bp, mouse
gtccgtagcttacaagaacg

SEQ ID NO: 586701 - DNA, 20 bp, mouse
gcttacaagaacgtggtggg

SEQ ID NO: 586702 - DNA, 20 bp, mouse
gaccacgttcttgtaagcta

SEQ ID NO: 586703 - DNA, 20 bp, mouse
ggtgtgtgcgacaccgtact

SEQ ID NO: 586704 - DNA, 20 bp, mouse
gaaaggcagagccagagcaa

SEQ ID NO: 586705 - DNA, 20 bp, mouse
gctctccatgactgcgagga

SEQ ID NO: 586706 - DNA, 20 bp, mouse
gtgtagtcaaggggcggtcg

SEQ ID NO: 586707 - DNA, 20 bp, mouse
gcatagctgtagtcaagggg

SEQ ID NO: 586708 - DNA, 20 bp, mouse
gagaagtcgctcagggaacg

SEQ ID NO: 586709 - DNA, 20 bp, mouse
gggggcggtcgaggcagaag

SEQ ID NO: 586710 - DNA, 20 bp, mouse
ggccagggcccgggcccatg

SEQ ID NO: 586711 - DNA, 20 bp, mouse
gagacatagctgtagtcaag

SEQ ID NO: 586712 - DNA, 20 bp, mouse
gggttgaggcccatgcccgg

SEQ ID NO: 586713 - DNA, 20 bp, mouse
gcggagagcggaagtcgtga

SEQ ID NO: 586714 - DNA, 20 bp, mouse
gtgaggcccatgcccggcgg

SEQ ID NO: 586715 - DNA, 20 bp, mouse
gcggcggtggaggctttcac

SEQ ID NO: 586716 - DNA, 20 bp, mouse
gtgccgctcaggccaacccc

SEQ ID NO: 586717 - DNA, 20 bp, mouse
gtccctggggttggcctgag

SEQ ID NO: 586718 - DNA, 20 bp, mouse
gcgggtgtctgggtatctga

SEQ ID NO: 586719 - DNA, 20 bp, mouse
ggtactgagctttctccctg

SEQ ID NO: 586720 - DNA, 20 bp, mouse
gacaccgtacacacagccag

SEQ ID NO: 586721 - DNA, 20 bp, mouse
gtgtgtcgccgctgtgagca

SEQ ID NO: 586722 - DNA, 20 bp, mouse
gcccccggggcgaggtcagt

SEQ ID NO: 586723 - DNA, 20 bp, mouse
gacggggttgctgaagagaa

SEQ ID NO: 586724 - DNA, 20 bp, mouse
ggtggaggaggagggctacg

SEQ ID NO: 586725 - DNA, 20 bp, mouse
gacccgcaggcctgccgctc

SEQ ID NO: 586726 - DNA, 20 bp, mouse
ggagctgcagcgtcgcaagt

SEQ ID NO: 586727 - DNA, 20 bp, mouse
ggtcccggctcgcagaggcg

SEQ ID NO: 586728 - DNA, 20 bp, mouse
ggcggggccgagtgctgtcc

SEQ ID NO: 586729 - DNA, 20 bp, mouse
ggcgcgcgtgaaggcagcgt

SEQ ID NO: 586730 - DNA, 20 bp, mouse
gccggctcgcagaggcgcgg

SEQ ID NO: 586731 - DNA, 20 bp, mouse
gcgacgtcgccgagcaacat

SEQ ID NO: 586732 - DNA, 20 bp, mouse
gtgcgagccgggacagcact

SEQ ID NO: 586733 - DNA, 20 bp, mouse
gccgctgcagcaggtcgccg

SEQ ID NO: 586734 - DNA, 20 bp, mouse
gactgcgcctttgtccccgg

SEQ ID NO: 586735 - DNA, 20 bp, mouse
gggctccgggaagtttgcag

SEQ ID NO: 586736 - DNA, 20 bp, mouse
gaggtcgtcgagacagacag

SEQ ID NO: 586737 - DNA, 20 bp, mouse
gagcccgcgcgcagctccgg

SEQ ID NO: 586738 - DNA, 20 bp, mouse
gtcactctgctcccccgggt

SEQ ID NO: 586739 - DNA, 20 bp, mouse
gaagccgggcgccgggaggt

SEQ ID NO: 586740 - DNA, 20 bp, mouse
gtggactagcgacccccggg

SEQ ID NO: 586741 - DNA, 20 bp, mouse
ggctccggggggctccgacc

SEQ ID NO: 586742 - DNA, 20 bp, mouse
ggagcccaggcagcagtgcg

SEQ ID NO: 586743 - DNA, 20 bp, mouse
ggcccccacgagcagagcga

SEQ ID NO: 586744 - DNA, 20 bp, mouse
gcgcgaagccgggcgccggg

SEQ ID NO: 586745 - DNA, 20 bp, mouse
gctgggccacgagaccatga

SEQ ID NO: 586746 - DNA, 20 bp, mouse
gagagataaggaggtcaacg

SEQ ID NO: 586747 - DNA, 20 bp, mouse
gagactggagcttcccgcgg

SEQ ID NO: 586748 - DNA, 20 bp, mouse
ggcccctaggtaaagagata

SEQ ID NO: 586749 - DNA, 20 bp, mouse
gccagagcaacgacccccgc

SEQ ID NO: 586750 - DNA, 20 bp, mouse
gcccctgggcgcaccggcac

SEQ ID NO: 586751 - DNA, 20 bp, mouse
gggatcgtgcaggaactcca

SEQ ID NO: 586752 - DNA, 20 bp, mouse
ggcatccgggtgatgttcca

SEQ ID NO: 586753 - DNA, 20 bp, mouse
gagctcactccactgcccct

SEQ ID NO: 586754 - DNA, 20 bp, mouse
gggctgcagtctctgctggg

SEQ ID NO: 586755 - DNA, 20 bp, mouse
gactgatgaggagttctggg

SEQ ID NO: 586756 - DNA, 20 bp, mouse
gctagggtcgtccaagtagg

SEQ ID NO: 586757 - DNA, 20 bp, mouse
gctgaagccggctgctacta

SEQ ID NO: 586758 - DNA, 20 bp, mouse
gggaggcgcctggatcactc

SEQ ID NO: 586759 - DNA, 20 bp, mouse
gctactagggtcgtccaagt

SEQ ID NO: 586760 - DNA, 20 bp, mouse
ggatcactccggcagcggag

SEQ ID NO: 586761 - DNA, 20 bp, mouse
gtcagggaacatcccagccg

SEQ ID NO: 586762 - DNA, 20 bp, mouse
ggccaggagtacgactacta

SEQ ID NO: 586763 - DNA, 20 bp, mouse
gctgggatgttccctgaagc

SEQ ID NO: 586764 - DNA, 20 bp, mouse
gagtaggagcggccgtgcag

SEQ ID NO: 586765 - DNA, 20 bp, mouse
gggacgaccctagtagcagc

SEQ ID NO: 586766 - DNA, 20 bp, mouse
ggagagaattacaggaacgg

SEQ ID NO: 586767 - DNA, 20 bp, mouse
gacaggaacggtggcgacag

SEQ ID NO: 586768 - DNA, 20 bp, mouse
gagtagaagcatcgaaaggt

SEQ ID NO: 586769 - DNA, 20 bp, mouse
gaagaagtagaagcatcgaa

SEQ ID NO: 586770 - DNA, 20 bp, mouse
gcgcagtgggaacccttgag

SEQ ID NO: 586771 - DNA, 20 bp, mouse
gcggtattccggaaccggag

SEQ ID NO: 586772 - DNA, 20 bp, mouse
gggttcccttcgggcgacag

SEQ ID NO: 586773 - DNA, 20 bp, mouse
ggctcgtcgcttacccgctc

SEQ ID NO: 586774 - DNA, 20 bp, mouse
gtcctccggcaggtcccccg

SEQ ID NO: 586775 - DNA, 20 bp, mouse
ggcggacgccggagcttctc

SEQ ID NO: 586776 - DNA, 20 bp, mouse
ggtgccaagccggagaggaa

SEQ ID NO: 586777 - DNA, 20 bp, mouse
gggcctacccactcagtcac

SEQ ID NO: 586778 - DNA, 20 bp, mouse
gcgcctgtgactgagtgggt

SEQ ID NO: 586779 - DNA, 20 bp, mouse
gtgagtgggtaggccaggcg

SEQ ID NO: 586780 - DNA, 20 bp, mouse
gtaggccaggcgaggcatcg

SEQ ID NO: 586781 - DNA, 20 bp, mouse
ggccatagcgagccacaaaa

SEQ ID NO: 586782 - DNA, 20 bp, mouse
gcgggcggcaccggcactgg

SEQ ID NO: 586783 - DNA, 20 bp, mouse
gaggagacgcaacttccggt

SEQ ID NO: 586784 - DNA, 20 bp, mouse
ggcgtccccgacgtccggga

SEQ ID NO: 586785 - DNA, 20 bp, mouse
gctgtgttgaagttgcgaag

SEQ ID NO: 586786 - DNA, 20 bp, mouse
gggattccgggcttccgggt

SEQ ID NO: 586787 - DNA, 20 bp, mouse
gcggccggcgcttgaaggtg

SEQ ID NO: 586788 - DNA, 20 bp, mouse
gagggcgcagagaaaggcca

SEQ ID NO: 586789 - DNA, 20 bp, mouse
ggcttgaaggtgcggattcc

SEQ ID NO: 586790 - DNA, 20 bp, mouse
gtgcgcatgcttgaaggaag

SEQ ID NO: 586791 - DNA, 20 bp, mouse
gcaagcgccggccggaaatc

SEQ ID NO: 586792 - DNA, 20 bp, mouse
gccacgcccacccggaagcc

SEQ ID NO: 586793 - DNA, 20 bp, mouse
ggtgcggattccgggcttcc

SEQ ID NO: 586794 - DNA, 20 bp, mouse
gcgcggcgacagtgggagag

SEQ ID NO: 586795 - DNA, 20 bp, mouse
gggaagtccggatttccggc

SEQ ID NO: 586796 - DNA, 20 bp, mouse
gggcggtcgggaccctgaca

SEQ ID NO: 586797 - DNA, 20 bp, mouse
ggcgcaccccgaagagtggt

SEQ ID NO: 586798 - DNA, 20 bp, mouse
gggctgcgcaccccgaagag

SEQ ID NO: 586799 - DNA, 20 bp, mouse
ggcggagcgaacgccaaagg

SEQ ID NO: 586800 - DNA, 20 bp, mouse
gcaccccgaagagtggtagg

SEQ ID NO: 586801 - DNA, 20 bp, mouse
gcacctcggacagaccgctg

SEQ ID NO: 586802 - DNA, 20 bp, mouse
gtaggcggagcgaacgccaa

SEQ ID NO: 586803 - DNA, 20 bp, mouse
gagctgaagaaagttctgag

SEQ ID NO: 586804 - DNA, 20 bp, mouse
ggagcctcaagcccttcgga

SEQ ID NO: 586805 - DNA, 20 bp, mouse
gaacgccaaaggcggcggtc

SEQ ID NO: 586806 - DNA, 20 bp, mouse
gaggctatttcctttgaaag

SEQ ID NO: 586807 - DNA, 20 bp, mouse
gagctaagaacccgtaacta

SEQ ID NO: 586808 - DNA, 20 bp, mouse
gtagcaataaaaggatccat

SEQ ID NO: 586809 - DNA, 20 bp, mouse
gaagtgtaccacatgcgagg

SEQ ID NO: 586810 - DNA, 20 bp, mouse
ggtgtcactagatgtcccta

SEQ ID NO: 586811 - DNA, 20 bp, mouse
gctccttcattagaattgtg

SEQ ID NO: 586812 - DNA, 20 bp, mouse
gctaaaactgtgataaatgg

SEQ ID NO: 586813 - DNA, 20 bp, mouse
ggagcagctgtagcaataaa

SEQ ID NO: 586814 - DNA, 20 bp, mouse
gaatctgaccccctcgcatg

SEQ ID NO: 586815 - DNA, 20 bp, mouse
gaatgctgacaagacttact

SEQ ID NO: 586816 - DNA, 20 bp, mouse
gttctggcactggagacgtg

SEQ ID NO: 586817 - DNA, 20 bp, mouse
gagacgtggggtagccacca

SEQ ID NO: 586818 - DNA, 20 bp, mouse
gcgcatcaaagactccatgg

SEQ ID NO: 586819 - DNA, 20 bp, mouse
gaggcgcatcaaagactcca

SEQ ID NO: 586820 - DNA, 20 bp, mouse
gcactggtgctaaggagcca

SEQ ID NO: 586821 - DNA, 20 bp, mouse
ggcgtgtgagctgctgagga

SEQ ID NO: 586822 - DNA, 20 bp, mouse
gcagtggaggaaagggagtc

SEQ ID NO: 586823 - DNA, 20 bp, mouse
gcatgttaccccttcctcgg

SEQ ID NO: 586824 - DNA, 20 bp, mouse
gccctgggaacccaagaacg

SEQ ID NO: 586825 - DNA, 20 bp, mouse
gacctgcgtgtgagctgctg

SEQ ID NO: 586826 - DNA, 20 bp, mouse
gatacactggtggataccca

SEQ ID NO: 586827 - DNA, 20 bp, mouse
gctgccagaaacccatacac

SEQ ID NO: 586828 - DNA, 20 bp, mouse
ggcttgcaggctctgtgtgc

SEQ ID NO: 586829 - DNA, 20 bp, mouse
gacagagcctgcaagctgtg

SEQ ID NO: 586830 - DNA, 20 bp, mouse
gagggacaggtagagtaacc

SEQ ID NO: 586831 - DNA, 20 bp, mouse
gcttgtccactttgactcgg

SEQ ID NO: 586832 - DNA, 20 bp, mouse
ggagagctcaggtgagtcag

SEQ ID NO: 586833 - DNA, 20 bp, mouse
gccagaaacccatacactgg

SEQ ID NO: 586834 - DNA, 20 bp, mouse
ggtctgcctccgagtcaaag

SEQ ID NO: 586835 - DNA, 20 bp, mouse
ggagggctgactgggtagaa

SEQ ID NO: 586836 - DNA, 20 bp, mouse
gcaagtcgcacctactgcag

SEQ ID NO: 586837 - DNA, 20 bp, mouse
gcctgcacctgggcagcaga

SEQ ID NO: 586838 - DNA, 20 bp, mouse
gaagtagggtactaagcagt

SEQ ID NO: 586839 - DNA, 20 bp, mouse
gagtaggtgcgacttggcca

SEQ ID NO: 586840 - DNA, 20 bp, mouse
gagtcctagggcctcatcca

SEQ ID NO: 586841 - DNA, 20 bp, mouse
gactaagcagtaggcagcca

SEQ ID NO: 586842 - DNA, 20 bp, mouse
gcggggactcacctgcacct

SEQ ID NO: 586843 - DNA, 20 bp, mouse
gaagagcccatgactcaagt

SEQ ID NO: 586844 - DNA, 20 bp, mouse
ggaggcacagagaagtccta

SEQ ID NO: 586845 - DNA, 20 bp, mouse
gtgctggagaggcctctgtg

SEQ ID NO: 586846 - DNA, 20 bp, mouse
gagtagcaaagaggtcctga

SEQ ID NO: 586847 - DNA, 20 bp, mouse
ggtcctgatggagagtccac

SEQ ID NO: 586848 - DNA, 20 bp, mouse
gacacaatcacactcaccgg

SEQ ID NO: 586849 - DNA, 20 bp, mouse
ggtcgtgcctgcctctacca

SEQ ID NO: 586850 - DNA, 20 bp, mouse
gcaccggtggactctccatc

SEQ ID NO: 586851 - DNA, 20 bp, mouse
gatggacatgagtagcaaag

SEQ ID NO: 586852 - DNA, 20 bp, mouse
gcattaagagtccctggtag

SEQ ID NO: 586853 - DNA, 20 bp, mouse
gagagagaaaccttacaaaa

SEQ ID NO: 586854 - DNA, 20 bp, mouse
gtactcatgtccattttgta

SEQ ID NO: 586855 - DNA, 20 bp, mouse
gactcaattagcttaggatt

SEQ ID NO: 586856 - DNA, 20 bp, mouse
gacaaagccatctccacggg

SEQ ID NO: 586857 - DNA, 20 bp, mouse
gagccgagcctgacaaacag

SEQ ID NO: 586858 - DNA, 20 bp, mouse
gcggggacaagggatttgag

SEQ ID NO: 586859 - DNA, 20 bp, mouse
gctgggtagctccacttaca

SEQ ID NO: 586860 - DNA, 20 bp, mouse
gcatttacctggacctcctg

SEQ ID NO: 586861 - DNA, 20 bp, mouse
gtaaaaccccagcctaggga

SEQ ID NO: 586862 - DNA, 20 bp, mouse
gtcacagattgcttccttgt

SEQ ID NO: 586863 - DNA, 20 bp, mouse
gtctttctctgagtcaagga

SEQ ID NO: 586864 - DNA, 20 bp, mouse
ggtagctccacttacagggc

SEQ ID NO: 586865 - DNA, 20 bp, mouse
gttgcttccttgttggcccc

SEQ ID NO: 586866 - DNA, 20 bp, mouse
gggcgccgaacgggaccgag

SEQ ID NO: 586867 - DNA, 20 bp, mouse
gcggccgggtaggcggtgag

SEQ ID NO: 586868 - DNA, 20 bp, mouse
gccgggtaggcggtgagtgg

SEQ ID NO: 586869 - DNA, 20 bp, mouse
gagctggaggcggcgccgaa

SEQ ID NO: 586870 - DNA, 20 bp, mouse
ggaacgggaccgagcggcgc

SEQ ID NO: 586871 - DNA, 20 bp, mouse
gcgggtggcggccgggtagg

SEQ ID NO: 586872 - DNA, 20 bp, mouse
ggtaggcggtgagtggcggg

SEQ ID NO: 586873 - DNA, 20 bp, mouse
ggaccgagcggcgcgggtgg

SEQ ID NO: 586874 - DNA, 20 bp, mouse
gagcggcgcgggtggcggcc

SEQ ID NO: 586875 - DNA, 20 bp, mouse
gcctcgtggagacagtcccc

SEQ ID NO: 586876 - DNA, 20 bp, mouse
gccaccaggcgaagctgacc

SEQ ID NO: 586877 - DNA, 20 bp, mouse
gtcgcggggtgcatccctct

SEQ ID NO: 586878 - DNA, 20 bp, mouse
gaactcttacctggtcccag

SEQ ID NO: 586879 - DNA, 20 bp, mouse
gtcgcctggtggcagtcgcg

SEQ ID NO: 586880 - DNA, 20 bp, mouse
gtggcacccgaagacaaccg

SEQ ID NO: 586881 - DNA, 20 bp, mouse
gggtgcatccctctgggacc

SEQ ID NO: 586882 - DNA, 20 bp, mouse
ggcaccccgcgactgccacc

SEQ ID NO: 586883 - DNA, 20 bp, mouse
ggcacttgcgaactcttacc

SEQ ID NO: 586884 - DNA, 20 bp, mouse
gaagacaaccggggtcagaa

SEQ ID NO: 586885 - DNA, 20 bp, mouse
gtgagagagggcgagagata

SEQ ID NO: 586886 - DNA, 20 bp, mouse
gcgggtctgagagcttctag

SEQ ID NO: 586887 - DNA, 20 bp, mouse
gaggaaagcggagagcggtg

SEQ ID NO: 586888 - DNA, 20 bp, mouse
gcggagagcggtgaggaagg

SEQ ID NO: 586889 - DNA, 20 bp, mouse
gacgcgtgacgtctcggtga

SEQ ID NO: 586890 - DNA, 20 bp, mouse
gcaggcactcacgctttccg

SEQ ID NO: 586891 - DNA, 20 bp, mouse
gcgtctcggtgatggctggg

SEQ ID NO: 586892 - DNA, 20 bp, mouse
gttctagaggctgaaaaccc

SEQ ID NO: 586893 - DNA, 20 bp, mouse
gggatctgtagggcacaagg

SEQ ID NO: 586894 - DNA, 20 bp, mouse
gcagcaaagtggaggggtga

SEQ ID NO: 586895 - DNA, 20 bp, mouse
gcacaaggaggggttggttg

SEQ ID NO: 586896 - DNA, 20 bp, mouse
gggtttgttcagagaagagg

SEQ ID NO: 586897 - DNA, 20 bp, mouse
gcggggcctgcatcacactc

SEQ ID NO: 586898 - DNA, 20 bp, mouse
gggcgttgccaagggcgtag

SEQ ID NO: 586899 - DNA, 20 bp, mouse
gcgcttgctggcgttgccaa

SEQ ID NO: 586900 - DNA, 20 bp, mouse
gccgatgtagggcctcacta

SEQ ID NO: 586901 - DNA, 20 bp, mouse
gagagcggagaccactgaag

SEQ ID NO: 586902 - DNA, 20 bp, mouse
gagactgggaagtcactgtt

SEQ ID NO: 586903 - DNA, 20 bp, mouse
gtaagcaaacctaggaaccc

SEQ ID NO: 586904 - DNA, 20 bp, mouse
gccgaacgccaagtactccg

SEQ ID NO: 586905 - DNA, 20 bp, mouse
gttgggttccatttggacag

SEQ ID NO: 586906 - DNA, 20 bp, mouse
ggcatctgtggaggcgttcg

SEQ ID NO: 586907 - DNA, 20 bp, mouse
gaggtccccgcactagctgt

SEQ ID NO: 586908 - DNA, 20 bp, mouse
gggtccgagcggctctgaag

SEQ ID NO: 586909 - DNA, 20 bp, mouse
gacagcctcagcggcgtccg

SEQ ID NO: 586910 - DNA, 20 bp, mouse
gcgggtggaagggagacaca

SEQ ID NO: 586911 - DNA, 20 bp, mouse
gcactagctgtaggctctgg

SEQ ID NO: 586912 - DNA, 20 bp, mouse
gtgcacgcggtcccatccta

SEQ ID NO: 586913 - DNA, 20 bp, mouse
gcatcgagcgactaggacgg

SEQ ID NO: 586914 - DNA, 20 bp, mouse
gtcctattgggcaacaggat

SEQ ID NO: 586915 - DNA, 20 bp, mouse
gtcgcggtccagggtccgag

SEQ ID NO: 586916 - DNA, 20 bp, mouse
ggctaggccccgggcaacta

SEQ ID NO: 586917 - DNA, 20 bp, mouse
ggcctagccagtgagtgaca

SEQ ID NO: 586918 - DNA, 20 bp, mouse
gtctcctggcaggcaagttg

SEQ ID NO: 586919 - DNA, 20 bp, mouse
ggtaacttggatacctctcc

SEQ ID NO: 586920 - DNA, 20 bp, mouse
ggagctgggttctggagggt

SEQ ID NO: 586921 - DNA, 20 bp, mouse
gccctgtccctgtcactcac

SEQ ID NO: 586922 - DNA, 20 bp, mouse
gcactcactggctaggcccc

SEQ ID NO: 586923 - DNA, 20 bp, mouse
ggggggagggacagaactag

SEQ ID NO: 586924 - DNA, 20 bp, mouse
gctgctgccatagttgcccg

SEQ ID NO: 586925 - DNA, 20 bp, mouse
gcttggatacctctcctggc

SEQ ID NO: 586926 - DNA, 20 bp, mouse
gtctctgagatggaggatcg

SEQ ID NO: 586927 - DNA, 20 bp, mouse
ggagatggaggatcgaggaa

SEQ ID NO: 586928 - DNA, 20 bp, mouse
gtgtctgtgagcctgagtgg

SEQ ID NO: 586929 - DNA, 20 bp, mouse
gagggtctaactctgagaac

SEQ ID NO: 586930 - DNA, 20 bp, mouse
gggagatatcaaggtgatct

SEQ ID NO: 586931 - DNA, 20 bp, mouse
ggtcaggcctgcaaagactg

SEQ ID NO: 586932 - DNA, 20 bp, mouse
gggtcaggtgggaagcacga

SEQ ID NO: 586933 - DNA, 20 bp, mouse
ggactctcaggggacaccca

SEQ ID NO: 586934 - DNA, 20 bp, mouse
ggtaaggagccctagatgtg

SEQ ID NO: 586935 - DNA, 20 bp, mouse
gttccattcaggtgacgact

SEQ ID NO: 586936 - DNA, 20 bp, mouse
ggggctgcggcgggccaaga

SEQ ID NO: 586937 - DNA, 20 bp, mouse
ggcggcggcagcgaccgagc

SEQ ID NO: 586938 - DNA, 20 bp, mouse
gagagcgcaagcgcgggctg

SEQ ID NO: 586939 - DNA, 20 bp, mouse
ggcaggctcacagacctgct

SEQ ID NO: 586940 - DNA, 20 bp, mouse
gagtgccagagcgcaagcgc

SEQ ID NO: 586941 - DNA, 20 bp, mouse
ggaaggccgggctggatcct

SEQ ID NO: 586942 - DNA, 20 bp, mouse
gctcccggccggccagagag

SEQ ID NO: 586943 - DNA, 20 bp, mouse
ggcccgggcgaccccacaga

SEQ ID NO: 586944 - DNA, 20 bp, mouse
gacccggcttcccaatccct

SEQ ID NO: 586945 - DNA, 20 bp, mouse
gcgggctggatcctgggcag

SEQ ID NO: 586946 - DNA, 20 bp, mouse
ggctttccccgggaccacgg

SEQ ID NO: 586947 - DNA, 20 bp, mouse
gtcaggaagctaggctggta

SEQ ID NO: 586948 - DNA, 20 bp, mouse
gaaacagacaagagaggtag

SEQ ID NO: 586949 - DNA, 20 bp, mouse
gagagtcccccgtggtcccg

SEQ ID NO: 586950 - DNA, 20 bp, mouse
gaggcagggcctgctcacgg

SEQ ID NO: 586951 - DNA, 20 bp, mouse
gggtgaacgaacagcagaca

SEQ ID NO: 586952 - DNA, 20 bp, mouse
ggaaagctgagaggctctga

SEQ ID NO: 586953 - DNA, 20 bp, mouse
gtgagaggctctgatggagg

SEQ ID NO: 586954 - DNA, 20 bp, mouse
gggcggatgagagtcccccg

SEQ ID NO: 586955 - DNA, 20 bp, mouse
gagggctcaggaagctaggc

SEQ ID NO: 586956 - DNA, 20 bp, mouse
gtgcttggacgggaaagggt

SEQ ID NO: 586957 - DNA, 20 bp, mouse
gctttcccgtccaagcacaa

SEQ ID NO: 586958 - DNA, 20 bp, mouse
ggagacccttgtgcttggac

SEQ ID NO: 586959 - DNA, 20 bp, mouse
gtaccccggaacccgagtgg

SEQ ID NO: 586960 - DNA, 20 bp, mouse
ggatcgaggacggttggctt

SEQ ID NO: 586961 - DNA, 20 bp, mouse
gttggacgggaaagggtcgg

SEQ ID NO: 586962 - DNA, 20 bp, mouse
ggctgggagacccttgtgct

SEQ ID NO: 586963 - DNA, 20 bp, mouse
ggcctcacactcccccactc

SEQ ID NO: 586964 - DNA, 20 bp, mouse
gctcgggttccggggtacca

SEQ ID NO: 586965 - DNA, 20 bp, mouse
gacccgagtgggggagtgtg

SEQ ID NO: 586966 - DNA, 20 bp, mouse
ggagggcccaagctctgcag

SEQ ID NO: 586967 - DNA, 20 bp, mouse
gtcatcggcaatcaagtcat

SEQ ID NO: 586968 - DNA, 20 bp, mouse
gggcaatcaagtcatcggtg

SEQ ID NO: 586969 - DNA, 20 bp, mouse
gttccaccactgcagagctt

SEQ ID NO: 586970 - DNA, 20 bp, mouse
gtctcatttcgtgtagtgaa

SEQ ID NO: 586971 - DNA, 20 bp, mouse
gtcacttgttgctacaggag

SEQ ID NO: 586972 - DNA, 20 bp, mouse
gcttgttgctacaggagggg

SEQ ID NO: 586973 - DNA, 20 bp, mouse
gtgcatagcgcagaagtctc

SEQ ID NO: 586974 - DNA, 20 bp, mouse
gggggcggaaacctgagcca

SEQ ID NO: 586975 - DNA, 20 bp, mouse
gctatttaccttagccactc

SEQ ID NO: 586976 - DNA, 20 bp, mouse
gaccagagtatgcctgacgg

SEQ ID NO: 586977 - DNA, 20 bp, mouse
gtcctccgtcaggcatactc

SEQ ID NO: 586978 - DNA, 20 bp, mouse
gctaaaagagttgagagaat

SEQ ID NO: 586979 - DNA, 20 bp, mouse
ggctaccagagtatgcctga

SEQ ID NO: 586980 - DNA, 20 bp, mouse
gcttagtgctggctgtggaa

SEQ ID NO: 586981 - DNA, 20 bp, mouse
gcataaccttcaaaggagaa

SEQ ID NO: 586982 - DNA, 20 bp, mouse
ggacggtaataaagtctgaa

SEQ ID NO: 586983 - DNA, 20 bp, mouse
ggctcagtcgactcaagcaa

SEQ ID NO: 586984 - DNA, 20 bp, mouse
gcttttagcataaccttcaa

SEQ ID NO: 586985 - DNA, 20 bp, mouse
gctaagaggtattctctcag

SEQ ID NO: 586986 - DNA, 20 bp, mouse
ggcttcacctacagtctccc

SEQ ID NO: 586987 - DNA, 20 bp, mouse
gggaagatgctgtgagagaa

SEQ ID NO: 586988 - DNA, 20 bp, mouse
gtaacccgaaagaccggcca

SEQ ID NO: 586989 - DNA, 20 bp, mouse
ggcagcactagctgcatcca

SEQ ID NO: 586990 - DNA, 20 bp, mouse
gggaatcctaccttccatca

SEQ ID NO: 586991 - DNA, 20 bp, mouse
gatcctaccttccatcatgg

SEQ ID NO: 586992 - DNA, 20 bp, mouse
gcgcaggcggtgcagctcgc

SEQ ID NO: 586993 - DNA, 20 bp, mouse
gcactagctgcatccatggc

SEQ ID NO: 586994 - DNA, 20 bp, mouse
ggggcccaggcttagactaa

SEQ ID NO: 586995 - DNA, 20 bp, mouse
gcagctctctgcaaacactt

SEQ ID NO: 586996 - DNA, 20 bp, mouse
gtcccttggggtgaacgact

SEQ ID NO: 586997 - DNA, 20 bp, mouse
gggcgactgaagactgcagg

SEQ ID NO: 586998 - DNA, 20 bp, mouse
gctaggcgactgaagactgc

SEQ ID NO: 586999 - DNA, 20 bp, mouse
gaactgaagccgctgctaca

SEQ ID NO: 587000 - DNA, 20 bp, mouse
ggcccagtcgttcaccccaa

SEQ ID NO: 587001 - DNA, 20 bp, mouse
ggctgcggagcggagtgcgt

SEQ ID NO: 587002 - DNA, 20 bp, mouse
gaagcgaggctccccacctg

SEQ ID NO: 587003 - DNA, 20 bp, mouse
gaaggcaagagtctaagcgt

SEQ ID NO: 587004 - DNA, 20 bp, mouse
ggaagccgctgctacatggc

SEQ ID NO: 587005 - DNA, 20 bp, mouse
gtccagagcccgaatcgggt

SEQ ID NO: 587006 - DNA, 20 bp, mouse
ggagcccaaaagagactgag

SEQ ID NO: 587007 - DNA, 20 bp, mouse
gctcattctggagtaggtaa

SEQ ID NO: 587008 - DNA, 20 bp, mouse
gctgaggggagcagtgaaac

SEQ ID NO: 587009 - DNA, 20 bp, mouse
ggggacgggacaccgaggag

SEQ ID NO: 587010 - DNA, 20 bp, mouse
ggtgtccactcgggaagcac

SEQ ID NO: 587011 - DNA, 20 bp, mouse
gacgatgaccgtcaaagccg

SEQ ID NO: 587012 - DNA, 20 bp, mouse
gcccatagctgcggaccgag

SEQ ID NO: 587013 - DNA, 20 bp, mouse
ggtgcgtggagatcgggata

SEQ ID NO: 587014 - DNA, 20 bp, mouse
gcccgtccctaagagccggg

SEQ ID NO: 587015 - DNA, 20 bp, mouse
gcggtcatcgtcccgatgcc

SEQ ID NO: 587016 - DNA, 20 bp, mouse
gggacctgcactggaacccg

SEQ ID NO: 587017 - DNA, 20 bp, mouse
gccaggtgagcagcttctct

SEQ ID NO: 587018 - DNA, 20 bp, mouse
gtagctgtaagctgagagta

SEQ ID NO: 587019 - DNA, 20 bp, mouse
gttgcagggtgagtcaggat

SEQ ID NO: 587020 - DNA, 20 bp, mouse
gaaaccccgggttccagtgc

SEQ ID NO: 587021 - DNA, 20 bp, mouse
gactggaacccggggtttcc

SEQ ID NO: 587022 - DNA, 20 bp, mouse
ggaaggttgcagggtgagtc

SEQ ID NO: 587023 - DNA, 20 bp, mouse
ggattgggtttcaggtcaga

SEQ ID NO: 587024 - DNA, 20 bp, mouse
gagaaaggggagaagggtta

SEQ ID NO: 587025 - DNA, 20 bp, mouse
gcacttcagaaaggggagaa

SEQ ID NO: 587026 - DNA, 20 bp, mouse
gggacgccgcacagccgggt

SEQ ID NO: 587027 - DNA, 20 bp, mouse
ggagccgccgtgacgcgtca

SEQ ID NO: 587028 - DNA, 20 bp, mouse
gccgcacctacccggctgtg

SEQ ID NO: 587029 - DNA, 20 bp, mouse
gcgcgtcagggaggaaacgc

SEQ ID NO: 587030 - DNA, 20 bp, mouse
gccgccgtgacgcgtcaggg

SEQ ID NO: 587031 - DNA, 20 bp, mouse
ggcccggacgccgcacagcc

SEQ ID NO: 587032 - DNA, 20 bp, mouse
ggtgcggcgtccgggcgccc

SEQ ID NO: 587033 - DNA, 20 bp, mouse
ggagagcccggccgggaccc

SEQ ID NO: 587034 - DNA, 20 bp, mouse
gggcagtttcttcttcccgg

SEQ ID NO: 587035 - DNA, 20 bp, mouse
gggcgacggtgtgaagtggt

SEQ ID NO: 587036 - DNA, 20 bp, mouse
ggaagcccgctgagatcggg

SEQ ID NO: 587037 - DNA, 20 bp, mouse
gtccagcttgccacgcgcaa

SEQ ID NO: 587038 - DNA, 20 bp, mouse
gagctggaagcgccactctc

SEQ ID NO: 587039 - DNA, 20 bp, mouse
ggcaagggcagggttccgga

SEQ ID NO: 587040 - DNA, 20 bp, mouse
gcttgccacgcgcaagggca

SEQ ID NO: 587041 - DNA, 20 bp, mouse
gggcgtgcgcgcttaccttc

SEQ ID NO: 587042 - DNA, 20 bp, mouse
gacgcgcaagggcagggttc

SEQ ID NO: 587043 - DNA, 20 bp, mouse
gcctcaggcaggcgccctag

SEQ ID NO: 587044 - DNA, 20 bp, mouse
gtggagaagcccgctgagat

SEQ ID NO: 587045 - DNA, 20 bp, mouse
gctggacgcagaccactcac

SEQ ID NO: 587046 - DNA, 20 bp, mouse
gacgagcagcccgcccgaac

SEQ ID NO: 587047 - DNA, 20 bp, mouse
gtgccggctggacgggagca

SEQ ID NO: 587048 - DNA, 20 bp, mouse
gggcgggctgccggctggac

SEQ ID NO: 587049 - DNA, 20 bp, mouse
ggagcagggagagccggttc

SEQ ID NO: 587050 - DNA, 20 bp, mouse
gcgcgtggaaagaattccgg

SEQ ID NO: 587051 - DNA, 20 bp, mouse
gctccctgctcccgtccagc

SEQ ID NO: 587052 - DNA, 20 bp, mouse
gcgccgccgagctggcgaga

SEQ ID NO: 587053 - DNA, 20 bp, mouse
ggcgccgcggaacgaaaccg

SEQ ID NO: 587054 - DNA, 20 bp, mouse
gggcctggcccgagagactc

SEQ ID NO: 587055 - DNA, 20 bp, mouse
gcagggagagccggttcggg

SEQ ID NO: 587056 - DNA, 20 bp, mouse
ggaagcacagccagacgcag

SEQ ID NO: 587057 - DNA, 20 bp, mouse
gcagccagacgcagaggaca

SEQ ID NO: 587058 - DNA, 20 bp, mouse
gcagaggacacggagctcaa

SEQ ID NO: 587059 - DNA, 20 bp, mouse
ggtccccacaggccgcctct

SEQ ID NO: 587060 - DNA, 20 bp, mouse
gagtggccagcggtccccac

SEQ ID NO: 587061 - DNA, 20 bp, mouse
gtgtagcagcgccagatggt

SEQ ID NO: 587062 - DNA, 20 bp, mouse
ggtgggactccaggaaaagt

SEQ ID NO: 587063 - DNA, 20 bp, mouse
ggtgcagctggccagcggtt

SEQ ID NO: 587064 - DNA, 20 bp, mouse
gagcggttgggagtggccag

SEQ ID NO: 587065 - DNA, 20 bp, mouse
ggctggccagcggttgggag

SEQ ID NO: 587066 - DNA, 20 bp, mouse
ggatgcatgaccaccaggct

SEQ ID NO: 587067 - DNA, 20 bp, mouse
gcagtcaactaggttggagt

SEQ ID NO: 587068 - DNA, 20 bp, mouse
ggtaccaagaccctagtaga

SEQ ID NO: 587069 - DNA, 20 bp, mouse
ggcttcaaccgaggacagac

SEQ ID NO: 587070 - DNA, 20 bp, mouse
gtcttggatgcatgaccacc

SEQ ID NO: 587071 - DNA, 20 bp, mouse
ggaccctagtagagggagtg

SEQ ID NO: 587072 - DNA, 20 bp, mouse
gcttcctcaggagggatcca

SEQ ID NO: 587073 - DNA, 20 bp, mouse
gaaggcaccgaagagagcat

SEQ ID NO: 587074 - DNA, 20 bp, mouse
ggcctgaccaatgctctctt

SEQ ID NO: 587075 - DNA, 20 bp, mouse
gctgaacatatctaacattc

SEQ ID NO: 587076 - DNA, 20 bp, mouse
gctgctcgtccggacctgag

SEQ ID NO: 587077 - DNA, 20 bp, mouse
ggacctgagtggccgaggta

SEQ ID NO: 587078 - DNA, 20 bp, mouse
gaatgtggcggcggtagctg

SEQ ID NO: 587079 - DNA, 20 bp, mouse
gccgaggtacggagcggtac

SEQ ID NO: 587080 - DNA, 20 bp, mouse
gcgtgctagacagtgcaagt

SEQ ID NO: 587081 - DNA, 20 bp, mouse
gaggtacggagcggtacggg

SEQ ID NO: 587082 - DNA, 20 bp, mouse
gctccgtacctcggccactc

SEQ ID NO: 587083 - DNA, 20 bp, mouse
ggagcaccccgaaatcgaca

SEQ ID NO: 587084 - DNA, 20 bp, mouse
gcgcagaatttcgaatgtgg

SEQ ID NO: 587085 - DNA, 20 bp, mouse
gcggcggtagctgcggagcg

SEQ ID NO: 587086 - DNA, 20 bp, mouse
gtgggtgcccacacttgcca

SEQ ID NO: 587087 - DNA, 20 bp, mouse
gagctgaaggggtcgctggt

SEQ ID NO: 587088 - DNA, 20 bp, mouse
gctaccctggagatgcgtgt

SEQ ID NO: 587089 - DNA, 20 bp, mouse
gtaccgccccgatccgaagg

SEQ ID NO: 587090 - DNA, 20 bp, mouse
gcgcgcggcggcgaggactg

SEQ ID NO: 587091 - DNA, 20 bp, mouse
ggcgacaatccgcgaagacc

SEQ ID NO: 587092 - DNA, 20 bp, mouse
ggcggattgtcgcgcttccc

SEQ ID NO: 587093 - DNA, 20 bp, mouse
gtcgctggtaggcgtggacg

SEQ ID NO: 587094 - DNA, 20 bp, mouse
gcgcgcttccctggcaagtg

SEQ ID NO: 587095 - DNA, 20 bp, mouse
gaaggggtcgctggtaggcg

SEQ ID NO: 587096 - DNA, 20 bp, mouse
ggaaccgaggcgcgtgaggt

SEQ ID NO: 587097 - DNA, 20 bp, mouse
gtgagtcgctcgcagaaccg

SEQ ID NO: 587098 - DNA, 20 bp, mouse
gggccagcggagcctctgcg

SEQ ID NO: 587099 - DNA, 20 bp, mouse
ggagcctctgcggggaaaga

SEQ ID NO: 587100 - DNA, 20 bp, mouse
gaggcgcgtgaggtgggcgg

SEQ ID NO: 587101 - DNA, 20 bp, mouse
gcgcagaaccgaggcgcgtg

SEQ ID NO: 587102 - DNA, 20 bp, mouse
gcctcctcaggctgtggacc

SEQ ID NO: 587103 - DNA, 20 bp, mouse
gtgaggtgggcggcggccag

SEQ ID NO: 587104 - DNA, 20 bp, mouse
ggagctgcgcggagggaacc

SEQ ID NO: 587105 - DNA, 20 bp, mouse
ggagccgggtccacagcctg

SEQ ID NO: 587106 - DNA, 20 bp, mouse
ggtcgagctaggcaccgtgg

SEQ ID NO: 587107 - DNA, 20 bp, mouse
gcgagtcgagctaggcaccg

SEQ ID NO: 587108 - DNA, 20 bp, mouse
ggcctcgagcgagtcgagct

SEQ ID NO: 587109 - DNA, 20 bp, mouse
gtcgccagccacagccgcca

SEQ ID NO: 587110 - DNA, 20 bp, mouse
ggcctagctcgactcgctcg

SEQ ID NO: 587111 - DNA, 20 bp, mouse
gctaggcaccgtggcggctg

SEQ ID NO: 587112 - DNA, 20 bp, mouse
gccgcgccaacaggccgcag

SEQ ID NO: 587113 - DNA, 20 bp, mouse
gagcaaccaggagcaccggg

SEQ ID NO: 587114 - DNA, 20 bp, mouse
gggccactcgggaattgatc

SEQ ID NO: 587115 - DNA, 20 bp, mouse
gcgaagaacagtgcgggtct

SEQ ID NO: 587116 - DNA, 20 bp, mouse
gagggcgcacgctgaggaca

SEQ ID NO: 587117 - DNA, 20 bp, mouse
ggaggccagggcgcacgctg

SEQ ID NO: 587118 - DNA, 20 bp, mouse
ggctgcgggtcggaggaacg

SEQ ID NO: 587119 - DNA, 20 bp, mouse
gcgctgggaagagcccgcag

SEQ ID NO: 587120 - DNA, 20 bp, mouse
gggtcggaggaacggggtca

SEQ ID NO: 587121 - DNA, 20 bp, mouse
ggcgcgggaggtcagtccta

SEQ ID NO: 587122 - DNA, 20 bp, mouse
gacggggtcacggctcacca

SEQ ID NO: 587123 - DNA, 20 bp, mouse
gtgggcgacaggggtcccgg

SEQ ID NO: 587124 - DNA, 20 bp, mouse
gctgaggacacggacgcgcg

SEQ ID NO: 587125 - DNA, 20 bp, mouse
gcgtcctgcgctgggagcat

SEQ ID NO: 587126 - DNA, 20 bp, mouse
gtgtgcagcaggccagtccc

SEQ ID NO: 587127 - DNA, 20 bp, mouse
gagtcccgggcagtgcatgg

SEQ ID NO: 587128 - DNA, 20 bp, mouse
gtgcatggcggcgccggtca

SEQ ID NO: 587129 - DNA, 20 bp, mouse
ggccagtcccgggcagtgca

SEQ ID NO: 587130 - DNA, 20 bp, mouse
ggtgcgcgccgcagagtccc

SEQ ID NO: 587131 - DNA, 20 bp, mouse
gcggaaccgcttaccctgac

SEQ ID NO: 587132 - DNA, 20 bp, mouse
gcaggtggccgtgccaggga

SEQ ID NO: 587133 - DNA, 20 bp, mouse
ggtggccgtgccagggacgg

SEQ ID NO: 587134 - DNA, 20 bp, mouse
gggcgccgccatgcactgcc

SEQ ID NO: 587135 - DNA, 20 bp, mouse
gtgcaacaggaggctcggca

SEQ ID NO: 587136 - DNA, 20 bp, mouse
gcccgcagggaccgaagcca

SEQ ID NO: 587137 - DNA, 20 bp, mouse
gtcgcggctgcagcagggcg

SEQ ID NO: 587138 - DNA, 20 bp, mouse
gagccatggctcaagctggt

SEQ ID NO: 587139 - DNA, 20 bp, mouse
gccccctcgcggctgcagca

SEQ ID NO: 587140 - DNA, 20 bp, mouse
ggcggagcggggacgcgtcc

SEQ ID NO: 587141 - DNA, 20 bp, mouse
gggggacgcgtccgggaacc

SEQ ID NO: 587142 - DNA, 20 bp, mouse
gagaggccgagacccgccag

SEQ ID NO: 587143 - DNA, 20 bp, mouse
gctgcgcactgtgaagaagg

SEQ ID NO: 587144 - DNA, 20 bp, mouse
gtgcagcagggcgcggagcg

SEQ ID NO: 587145 - DNA, 20 bp, mouse
gcaccgaccagcttgagcca

SEQ ID NO: 587146 - DNA, 20 bp, mouse
gcaccgggcagtggctgcgg

SEQ ID NO: 587147 - DNA, 20 bp, mouse
gctgcaggcggggagcgcag

SEQ ID NO: 587148 - DNA, 20 bp, mouse
gctctgcgctgcccatggtg

SEQ ID NO: 587149 - DNA, 20 bp, mouse
gagccgccgcagccactgcc

SEQ ID NO: 587150 - DNA, 20 bp, mouse
gatgggcagcgcagaggacg

SEQ ID NO: 587151 - DNA, 20 bp, mouse
gccgccacctgccgcaccat

SEQ ID NO: 587152 - DNA, 20 bp, mouse
gcagcgccccacacgcgagg

SEQ ID NO: 587153 - DNA, 20 bp, mouse
ggcctgctgcctgacgtctg

SEQ ID NO: 587154 - DNA, 20 bp, mouse
gtccgagccccgcagacgtc

SEQ ID NO: 587155 - DNA, 20 bp, mouse
gcgctggctcgggagcagag

SEQ ID NO: 587156 - DNA, 20 bp, mouse
ggcagtgcgcgccgactagg

SEQ ID NO: 587157 - DNA, 20 bp, mouse
gtggccgcgagacaggtgag

SEQ ID NO: 587158 - DNA, 20 bp, mouse
gctgacctgccgaggtgctg

SEQ ID NO: 587159 - DNA, 20 bp, mouse
ggctgaggtggccgcgagac

SEQ ID NO: 587160 - DNA, 20 bp, mouse
ggcagcagtgcgcgccgact

SEQ ID NO: 587161 - DNA, 20 bp, mouse
gctagcagctgcctcctagt

SEQ ID NO: 587162 - DNA, 20 bp, mouse
ggcaccgctcacctgtctcg

SEQ ID NO: 587163 - DNA, 20 bp, mouse
gagtctccgagtctccgggc

SEQ ID NO: 587164 - DNA, 20 bp, mouse
gcccgcggcctccactcaag

SEQ ID NO: 587165 - DNA, 20 bp, mouse
ggaaactgaggcggacgtgt

SEQ ID NO: 587166 - DNA, 20 bp, mouse
gttcggtcgactgagaggtg

SEQ ID NO: 587167 - DNA, 20 bp, mouse
gcgaagacccgacccaccga

SEQ ID NO: 587168 - DNA, 20 bp, mouse
ggacccccgacgcccatacg

SEQ ID NO: 587169 - DNA, 20 bp, mouse
ggggtcttcggtcgactgag

SEQ ID NO: 587170 - DNA, 20 bp, mouse
ggcgcaggcgcagccgtcgg

SEQ ID NO: 587171 - DNA, 20 bp, mouse
ggctccgccgtgccccgtat

SEQ ID NO: 587172 - DNA, 20 bp, mouse
gacgcccatacggggcacgg

SEQ ID NO: 587173 - DNA, 20 bp, mouse
gggcgcagccgtcggtgggt

SEQ ID NO: 587174 - DNA, 20 bp, mouse
gtcgactgagaggtgaggct

SEQ ID NO: 587175 - DNA, 20 bp, mouse
gggcgtcttggtcctgaggg

SEQ ID NO: 587176 - DNA, 20 bp, mouse
gggcggcggcagcattggag

SEQ ID NO: 587177 - DNA, 20 bp, mouse
gagcagccgggtgggctgag

SEQ ID NO: 587178 - DNA, 20 bp, mouse
gagccttgcgagcagccggg

SEQ ID NO: 587179 - DNA, 20 bp, mouse
gcggtgcaggcctccatctg

SEQ ID NO: 587180 - DNA, 20 bp, mouse
gggcggcagcattggagcgg

SEQ ID NO: 587181 - DNA, 20 bp, mouse
gtggatcgcagagggggcca

SEQ ID NO: 587182 - DNA, 20 bp, mouse
gcggctgctcgcaaggctct

SEQ ID NO: 587183 - DNA, 20 bp, mouse
gaaggacccggggcagaaga

SEQ ID NO: 587184 - DNA, 20 bp, mouse
gctctctgactaaggacccg

SEQ ID NO: 587185 - DNA, 20 bp, mouse
ggcccacccggctgctcgca

SEQ ID NO: 587186 - DNA, 20 bp, mouse
gagcccgtcgcggaggcggg

SEQ ID NO: 587187 - DNA, 20 bp, mouse
ggcgtgctgggagcccgtcg

SEQ ID NO: 587188 - DNA, 20 bp, mouse
gtgctgggagcccgtcgcgg

SEQ ID NO: 587189 - DNA, 20 bp, mouse
ggggtgctcggctcccgaga

SEQ ID NO: 587190 - DNA, 20 bp, mouse
gcctgggccggagcctccga

SEQ ID NO: 587191 - DNA, 20 bp, mouse
gcagatagttggtccctcgg

SEQ ID NO: 587192 - DNA, 20 bp, mouse
ggtgccccccgcctccgcga

SEQ ID NO: 587193 - DNA, 20 bp, mouse
gtgggagcccgtcgcggagg

SEQ ID NO: 587194 - DNA, 20 bp, mouse
gtcgagtccggagaggaaag

SEQ ID NO: 587195 - DNA, 20 bp, mouse
gcgagagggcagcagatagt

SEQ ID NO: 587196 - DNA, 20 bp, mouse
ggagctcgggagcctgaaga

SEQ ID NO: 587197 - DNA, 20 bp, mouse
ggagggagagaacctcaagg

SEQ ID NO: 587198 - DNA, 20 bp, mouse
gcggcgcgcgagtctgggat

SEQ ID NO: 587199 - DNA, 20 bp, mouse
gatcggagcgcgcggagctc

SEQ ID NO: 587200 - DNA, 20 bp, mouse
gtggcctgcagcttgcgagg

SEQ ID NO: 587201 - DNA, 20 bp, mouse
gcgccgccaccggccaccaa

SEQ ID NO: 587202 - DNA, 20 bp, mouse
ggcgcgctgctcaggcaagg

SEQ ID NO: 587203 - DNA, 20 bp, mouse
gggtcttggcggtcctggtg

SEQ ID NO: 587204 - DNA, 20 bp, mouse
gacaagcaggccgtacctac

SEQ ID NO: 587205 - DNA, 20 bp, mouse
gggcgcgcgctgctcaggca

SEQ ID NO: 587206 - DNA, 20 bp, mouse
gctggagagcggccaggcgg

SEQ ID NO: 587207 - DNA, 20 bp, mouse
ggtgtggcccgtgacagtct

SEQ ID NO: 587208 - DNA, 20 bp, mouse
gtaacggcgtggggcggcat

SEQ ID NO: 587209 - DNA, 20 bp, mouse
gtctgggctggagagcggcc

SEQ ID NO: 587210 - DNA, 20 bp, mouse
gagcggccaggcggaggcga

SEQ ID NO: 587211 - DNA, 20 bp, mouse
gcgtggggcggcatgggctc

SEQ ID NO: 587212 - DNA, 20 bp, mouse
gtttacataacggcgtgggg

SEQ ID NO: 587213 - DNA, 20 bp, mouse
gagctcctgacagcagccgg

SEQ ID NO: 587214 - DNA, 20 bp, mouse
gggctgctgtcaggagctgg

SEQ ID NO: 587215 - DNA, 20 bp, mouse
ggggctggagagcggccagg

SEQ ID NO: 587216 - DNA, 20 bp, mouse
ggccgctgcagtggcttact

SEQ ID NO: 587217 - DNA, 20 bp, mouse
gacacaggcagtacacgcca

SEQ ID NO: 587218 - DNA, 20 bp, mouse
ggagacagcgagagtgtccc

SEQ ID NO: 587219 - DNA, 20 bp, mouse
gagaggtacctagggaatac

SEQ ID NO: 587220 - DNA, 20 bp, mouse
gtactcgctaccgggctgga

SEQ ID NO: 587221 - DNA, 20 bp, mouse
ggcctagcaaactctttgat

SEQ ID NO: 587222 - DNA, 20 bp, mouse
ggctctgacgtatggtccca

SEQ ID NO: 587223 - DNA, 20 bp, mouse
gcttttggcagaggtaccta

SEQ ID NO: 587224 - DNA, 20 bp, mouse
gaaaatcagcagggagaccg

SEQ ID NO: 587225 - DNA, 20 bp, mouse
gtgagtatatctcgtggtag

SEQ ID NO: 587226 - DNA, 20 bp, mouse
gcctcttcacagcacctcct

SEQ ID NO: 587227 - DNA, 20 bp, mouse
gtcatgcaggcgaaccctga

SEQ ID NO: 587228 - DNA, 20 bp, mouse
gcaaatgaggttgctctgta

SEQ ID NO: 587229 - DNA, 20 bp, mouse
ggtgatgtggagaaggtcgg

SEQ ID NO: 587230 - DNA, 20 bp, mouse
gatacaactccctgaacata

SEQ ID NO: 587231 - DNA, 20 bp, mouse
gagtatcctcatcttcatgc

SEQ ID NO: 587232 - DNA, 20 bp, mouse
gtctattttggaataggaat

SEQ ID NO: 587233 - DNA, 20 bp, mouse
ggttcagttttacaagacac

SEQ ID NO: 587234 - DNA, 20 bp, mouse
gatgtggagaaggtcggggg

SEQ ID NO: 587235 - DNA, 20 bp, mouse
gtctcattctattttggaat

SEQ ID NO: 587236 - DNA, 20 bp, mouse
gcctcatcacagcgcctcct

SEQ ID NO: 587237 - DNA, 20 bp, mouse
gtcatgcagttgaaccctga

SEQ ID NO: 587238 - DNA, 20 bp, mouse
ggtgatgtggagaaggccgg

SEQ ID NO: 587239 - DNA, 20 bp, mouse
gattgtatctcattctactt

SEQ ID NO: 587240 - DNA, 20 bp, mouse
gatacaattccctgagcata

SEQ ID NO: 587241 - DNA, 20 bp, mouse
ggatggcagccatatgctca

SEQ ID NO: 587242 - DNA, 20 bp, mouse
gttctactttggaatagtaa

SEQ ID NO: 587243 - DNA, 20 bp, mouse
ggatcagtcccaggccaagg

SEQ ID NO: 587244 - DNA, 20 bp, mouse
ggactgatctcagggtgaca

SEQ ID NO: 587245 - DNA, 20 bp, mouse
gtggcctgggactgatctca

SEQ ID NO: 587246 - DNA, 20 bp, mouse
gcaggtgtgggtgctctcaa

SEQ ID NO: 587247 - DNA, 20 bp, mouse
ggtgtgggtgctctcaaagg

SEQ ID NO: 587248 - DNA, 20 bp, mouse
gaactccatggaagcaggtg

SEQ ID NO: 587249 - DNA, 20 bp, mouse
ggcacccacacctgcttcca

SEQ ID NO: 587250 - DNA, 20 bp, mouse
ggtagaagcagtggacacta

SEQ ID NO: 587251 - DNA, 20 bp, mouse
gccgtaaagggagaaccctg

SEQ ID NO: 587252 - DNA, 20 bp, mouse
gatgggagggtgaaagacag

SEQ ID NO: 587253 - DNA, 20 bp, mouse
gagctgtgaagtggaggctg

SEQ ID NO: 587254 - DNA, 20 bp, mouse
gcacatctctgcatccctga

SEQ ID NO: 587255 - DNA, 20 bp, mouse
ggtaccttgggggcatggtt

SEQ ID NO: 587256 - DNA, 20 bp, mouse
gcaacctgaagcccaggaac

SEQ ID NO: 587257 - DNA, 20 bp, mouse
gttagactgagccggttcct

SEQ ID NO: 587258 - DNA, 20 bp, mouse
gtcctagccggagtcttagc

SEQ ID NO: 587259 - DNA, 20 bp, mouse
gtcccgctaagactccggct

SEQ ID NO: 587260 - DNA, 20 bp, mouse
gcgggagtgttagactgagc

SEQ ID NO: 587261 - DNA, 20 bp, mouse
gaacactcccgctaagactc

SEQ ID NO: 587262 - DNA, 20 bp, mouse
gagctcagagtaggacccta

SEQ ID NO: 587263 - DNA, 20 bp, mouse
gatcacgggatgactgcagt

SEQ ID NO: 587264 - DNA, 20 bp, mouse
ggacagcaggagtagaccag

SEQ ID NO: 587265 - DNA, 20 bp, mouse
gaccaaactggctctagaga

SEQ ID NO: 587266 - DNA, 20 bp, mouse
gcagagatgcccaagaaaac

SEQ ID NO: 587267 - DNA, 20 bp, mouse
gcagagacagagatcaccgg

SEQ ID NO: 587268 - DNA, 20 bp, mouse
ggatagcaacaccaacaccg

SEQ ID NO: 587269 - DNA, 20 bp, mouse
gcagagagaccaggatgatc

SEQ ID NO: 587270 - DNA, 20 bp, mouse
ggggctgacttgtagtaaga

SEQ ID NO: 587271 - DNA, 20 bp, mouse
ggacaacatggggtacttgg

SEQ ID NO: 587272 - DNA, 20 bp, mouse
gctgtctctctcctcggtgt

SEQ ID NO: 587273 - DNA, 20 bp, mouse
ggctgcgagagactagtacc

SEQ ID NO: 587274 - DNA, 20 bp, mouse
gagtgggttctggacaacat

SEQ ID NO: 587275 - DNA, 20 bp, mouse
ggctagcatgtggctgctcc

SEQ ID NO: 587276 - DNA, 20 bp, mouse
gcaactgtccgggaagagaa

SEQ ID NO: 587277 - DNA, 20 bp, mouse
ggcgcggctgggtctctggg

SEQ ID NO: 587278 - DNA, 20 bp, mouse
gttgcctacagcaactgtcc

SEQ ID NO: 587279 - DNA, 20 bp, mouse
gagaagggtgagcgaggagt

SEQ ID NO: 587280 - DNA, 20 bp, mouse
ggctgtctggacaaacactc

SEQ ID NO: 587281 - DNA, 20 bp, mouse
gggtgagtctctagagcgaa

SEQ ID NO: 587282 - DNA, 20 bp, mouse
gagcctgaccgcgggaacca

SEQ ID NO: 587283 - DNA, 20 bp, mouse
gccagtgggaggagaatcgg

SEQ ID NO: 587284 - DNA, 20 bp, mouse
gagcgaagggtaaagcacag

SEQ ID NO: 587285 - DNA, 20 bp, mouse
ggaggagggaccagagggac

SEQ ID NO: 587286 - DNA, 20 bp, mouse
ggcagagagctgtctagtcc

SEQ ID NO: 587287 - DNA, 20 bp, mouse
ggcagccagtcagaactcca

SEQ ID NO: 587288 - DNA, 20 bp, mouse
gagtgttgtggcttcacctg

SEQ ID NO: 587289 - DNA, 20 bp, mouse
gccaagcagcaagaaccaag

SEQ ID NO: 587290 - DNA, 20 bp, mouse
gttgggtctgagcagatgtt

SEQ ID NO: 587291 - DNA, 20 bp, mouse
gccacaacactgctgaaatg

SEQ ID NO: 587292 - DNA, 20 bp, mouse
ggactatgcaggactcagat

SEQ ID NO: 587293 - DNA, 20 bp, mouse
gtgaggagctagggcagaat

SEQ ID NO: 587294 - DNA, 20 bp, mouse
gtacatcgacccggagctgt

SEQ ID NO: 587295 - DNA, 20 bp, mouse
gctggagtgactccaaagtg

SEQ ID NO: 587296 - DNA, 20 bp, mouse
ggctcctgggaaccctccgg

SEQ ID NO: 587297 - DNA, 20 bp, mouse
gagcggtggtgagtgctcct

SEQ ID NO: 587298 - DNA, 20 bp, mouse
ggcttcggcccagcccccgg

SEQ ID NO: 587299 - DNA, 20 bp, mouse
gagctgtgagacctgccagg

SEQ ID NO: 587300 - DNA, 20 bp, mouse
gtgagacctgccaggaggcg

SEQ ID NO: 587301 - DNA, 20 bp, mouse
gagtgctcctgggaaccctc

SEQ ID NO: 587302 - DNA, 20 bp, mouse
gcagcgctaggttctcggag

SEQ ID NO: 587303 - DNA, 20 bp, mouse
gccggcttcggcccagcccc

SEQ ID NO: 587304 - DNA, 20 bp, mouse
ggccccggcgccagaaaggg

SEQ ID NO: 587305 - DNA, 20 bp, mouse
ggagtacacaaggctggata

SEQ ID NO: 587306 - DNA, 20 bp, mouse
gagtctcaccatggcaaggt

SEQ ID NO: 587307 - DNA, 20 bp, mouse
gggagtctcagcaggtatat

SEQ ID NO: 587308 - DNA, 20 bp, mouse
gctagaaccaagtctcacca

SEQ ID NO: 587309 - DNA, 20 bp, mouse
gcctagagatccaggactgt

SEQ ID NO: 587310 - DNA, 20 bp, mouse
gccatggcaaggtaggtgag

SEQ ID NO: 587311 - DNA, 20 bp, mouse
gctgggctctagagaggcaa

SEQ ID NO: 587312 - DNA, 20 bp, mouse
gcagcaggtatatgggccca

SEQ ID NO: 587313 - DNA, 20 bp, mouse
gaccaagtctcaccatggca

SEQ ID NO: 587314 - DNA, 20 bp, mouse
gcctgtcctagaaagagcag

SEQ ID NO: 587315 - DNA, 20 bp, mouse
gttggttctagaggatcctt

SEQ ID NO: 587316 - DNA, 20 bp, mouse
ggcccagagcagctccatct

SEQ ID NO: 587317 - DNA, 20 bp, mouse
gcagtgctcaccaggatgga

SEQ ID NO: 587318 - DNA, 20 bp, mouse
gtctgggccgccctccatcc

SEQ ID NO: 587319 - DNA, 20 bp, mouse
ggcccagatggagctgctct

SEQ ID NO: 587320 - DNA, 20 bp, mouse
gccaagagctggctctgaag

SEQ ID NO: 587321 - DNA, 20 bp, mouse
gctccagtgccttgcccaga

SEQ ID NO: 587322 - DNA, 20 bp, mouse
gatgctggtcttgtggtcag

SEQ ID NO: 587323 - DNA, 20 bp, mouse
gccattctgtaggatagagg

SEQ ID NO: 587324 - DNA, 20 bp, mouse
ggaaccacagtggactgagt

SEQ ID NO: 587325 - DNA, 20 bp, mouse
ggctgtgggaagaaccacag

SEQ ID NO: 587326 - DNA, 20 bp, mouse
ggctatggacccagaagatg

SEQ ID NO: 587327 - DNA, 20 bp, mouse
gctagcaggggtgtgttagg

SEQ ID NO: 587328 - DNA, 20 bp, mouse
gccccagacacctaccgcta

SEQ ID NO: 587329 - DNA, 20 bp, mouse
ggggagtcaactgcacactg

SEQ ID NO: 587330 - DNA, 20 bp, mouse
gcttctgggtccatagcggt

SEQ ID NO: 587331 - DNA, 20 bp, mouse
gtccctagcaggggtgtgtt

SEQ ID NO: 587332 - DNA, 20 bp, mouse
gccagcgacttccctagcag

SEQ ID NO: 587333 - DNA, 20 bp, mouse
gtccaacatcacgaagacag

SEQ ID NO: 587334 - DNA, 20 bp, mouse
gcattcaaggccaaaagccg

SEQ ID NO: 587335 - DNA, 20 bp, mouse
gctctttccgactgtcgaaa

SEQ ID NO: 587336 - DNA, 20 bp, mouse
ggtcgctggagtcttgaaaa

SEQ ID NO: 587337 - DNA, 20 bp, mouse
gcgagctaagggccaaacag

SEQ ID NO: 587338 - DNA, 20 bp, mouse
gaacggctggaaccgagcta

SEQ ID NO: 587339 - DNA, 20 bp, mouse
gtggagtcttgaaaagggct

SEQ ID NO: 587340 - DNA, 20 bp, mouse
gctaagggccaaacagaggt

SEQ ID NO: 587341 - DNA, 20 bp, mouse
gaaacagctgcagcaacggc

SEQ ID NO: 587342 - DNA, 20 bp, mouse
gctacggcggtaaggagagt

SEQ ID NO: 587343 - DNA, 20 bp, mouse
ggccaaacagaggttggatg

SEQ ID NO: 587344 - DNA, 20 bp, mouse
gagagccccgcctccaccag

SEQ ID NO: 587345 - DNA, 20 bp, mouse
gaacggttctggggcagaag

SEQ ID NO: 587346 - DNA, 20 bp, mouse
gtcttctccgacggtcgcac

SEQ ID NO: 587347 - DNA, 20 bp, mouse
gccgacggtcgcacgggagt

SEQ ID NO: 587348 - DNA, 20 bp, mouse
gtcgctgcggtcttctccga

SEQ ID NO: 587349 - DNA, 20 bp, mouse
gggagccagacgcgtcgctg

SEQ ID NO: 587350 - DNA, 20 bp, mouse
gacttctgtgaccgagtcag

SEQ ID NO: 587351 - DNA, 20 bp, mouse
gggacccggtggacacgcag

SEQ ID NO: 587352 - DNA, 20 bp, mouse
gaactggcgaggggacccaa

SEQ ID NO: 587353 - DNA, 20 bp, mouse
gcccctggagccgacagctg

SEQ ID NO: 587354 - DNA, 20 bp, mouse
gtgaccgccgggctcggacc

SEQ ID NO: 587355 - DNA, 20 bp, mouse
gctgcccgcgcgtctcctac

SEQ ID NO: 587356 - DNA, 20 bp, mouse
gagaccaactgagggacggt

SEQ ID NO: 587357 - DNA, 20 bp, mouse
gacacagaccaactgaggga

SEQ ID NO: 587358 - DNA, 20 bp, mouse
gggggacacagaccaactga

SEQ ID NO: 587359 - DNA, 20 bp, mouse
ggagcggcagctgcacggct

SEQ ID NO: 587360 - DNA, 20 bp, mouse
ggctcccaccgtccctcagt

SEQ ID NO: 587361 - DNA, 20 bp, mouse
gccactcatgctgcaggcgg

SEQ ID NO: 587362 - DNA, 20 bp, mouse
gcagcccttggaccagacct

SEQ ID NO: 587363 - DNA, 20 bp, mouse
gaaaccgctcccaagcgcgg

SEQ ID NO: 587364 - DNA, 20 bp, mouse
ggccggcgcccggagagggt

SEQ ID NO: 587365 - DNA, 20 bp, mouse
gccgggagccgcccccacga

SEQ ID NO: 587366 - DNA, 20 bp, mouse
gagcgccgcccacccatccg

SEQ ID NO: 587367 - DNA, 20 bp, mouse
gcgcttcgccccggatgggt

SEQ ID NO: 587368 - DNA, 20 bp, mouse
gcgcgcgcttcgccccggat

SEQ ID NO: 587369 - DNA, 20 bp, mouse
gggccgaggagtcaccttgg

SEQ ID NO: 587370 - DNA, 20 bp, mouse
ggagcgagcgcaggagagtg

SEQ ID NO: 587371 - DNA, 20 bp, mouse
gacagaggtcgaagatatct

SEQ ID NO: 587372 - DNA, 20 bp, mouse
gagtggggaactggtcacag

SEQ ID NO: 587373 - DNA, 20 bp, mouse
gccacacgggcagctcggga

SEQ ID NO: 587374 - DNA, 20 bp, mouse
ggggaagcaggctgggccgg

SEQ ID NO: 587375 - DNA, 20 bp, mouse
gaccagccagaggagcgcgc

SEQ ID NO: 587376 - DNA, 20 bp, mouse
gtcccggacgcagggtccct

SEQ ID NO: 587377 - DNA, 20 bp, mouse
ggcccagggaccctgcgtcc

SEQ ID NO: 587378 - DNA, 20 bp, mouse
gcccgccggttcccagccca

SEQ ID NO: 587379 - DNA, 20 bp, mouse
ggcgttcagtctaggagata

SEQ ID NO: 587380 - DNA, 20 bp, mouse
gtccctgggctgggaaccgg

SEQ ID NO: 587381 - DNA, 20 bp, mouse
gaggagccggagggaccgga

SEQ ID NO: 587382 - DNA, 20 bp, mouse
gaaagcggagcaacagagca

SEQ ID NO: 587383 - DNA, 20 bp, mouse
gggctgggaaccggcgggta

SEQ ID NO: 587384 - DNA, 20 bp, mouse
gggcctcactggccgcaaag

SEQ ID NO: 587385 - DNA, 20 bp, mouse
gggcgggtaaggcactgcat

SEQ ID NO: 587386 - DNA, 20 bp, mouse
gtggcgagagacaggctcca

SEQ ID NO: 587387 - DNA, 20 bp, mouse
gcctggggctctacgagcta

SEQ ID NO: 587388 - DNA, 20 bp, mouse
gacgagctatggcgggctca

SEQ ID NO: 587389 - DNA, 20 bp, mouse
ggagacaggctccagggacg

SEQ ID NO: 587390 - DNA, 20 bp, mouse
gggggctctacgagctatgg

SEQ ID NO: 587391 - DNA, 20 bp, mouse
ggagcagcgacagggtcccg

SEQ ID NO: 587392 - DNA, 20 bp, mouse
gagcgacagggtcccgaggt

SEQ ID NO: 587393 - DNA, 20 bp, mouse
gtatggcgggctcagggtcg

SEQ ID NO: 587394 - DNA, 20 bp, mouse
ggggctcagggtcgcggccg

SEQ ID NO: 587395 - DNA, 20 bp, mouse
gccccctggccagccaactc

SEQ ID NO: 587396 - DNA, 20 bp, mouse
gcgaggcagcagaggtggtg

SEQ ID NO: 587397 - DNA, 20 bp, mouse
gtcagcgatcgaggcagcag

SEQ ID NO: 587398 - DNA, 20 bp, mouse
gaccgcggcctcagcgatcg

SEQ ID NO: 587399 - DNA, 20 bp, mouse
gctgggctgtcgcggcgtct

SEQ ID NO: 587400 - DNA, 20 bp, mouse
gccaggtaggagcctagggt

SEQ ID NO: 587401 - DNA, 20 bp, mouse
ggtaggagcctagggtcgga

SEQ ID NO: 587402 - DNA, 20 bp, mouse
gcgagcgctctgggctgtcg

SEQ ID NO: 587403 - DNA, 20 bp, mouse
gcagggaaccgggagctcaa

SEQ ID NO: 587404 - DNA, 20 bp, mouse
ggtcgggctgtgaccacaga

SEQ ID NO: 587405 - DNA, 20 bp, mouse
gcgcgcgactcccggtaccg

SEQ ID NO: 587406 - DNA, 20 bp, mouse
gctgcgcgctcagacctacc

SEQ ID NO: 587407 - DNA, 20 bp, mouse
gcacctcgccgcagccgggt

SEQ ID NO: 587408 - DNA, 20 bp, mouse
gtccgccggcgagtgcggag

SEQ ID NO: 587409 - DNA, 20 bp, mouse
ggctcagacctacccggctg

SEQ ID NO: 587410 - DNA, 20 bp, mouse
gctcgccggcggagcacccg

SEQ ID NO: 587411 - DNA, 20 bp, mouse
gcaaagcgcacggtgggatc

SEQ ID NO: 587412 - DNA, 20 bp, mouse
gtgggatccggacgcaccga

SEQ ID NO: 587413 - DNA, 20 bp, mouse
ggacctacccggctgcggcg

SEQ ID NO: 587414 - DNA, 20 bp, mouse
gcgcgcagcgctgccacccc

SEQ ID NO: 587415 - DNA, 20 bp, mouse
gcgggtcgcaaagcgcacgg

SEQ ID NO: 587416 - DNA, 20 bp, mouse
ggtcttgttgcggagggagg

SEQ ID NO: 587417 - DNA, 20 bp, mouse
ggctttacggggagcgtcta

SEQ ID NO: 587418 - DNA, 20 bp, mouse
gctgaggtaaagccgggaag

SEQ ID NO: 587419 - DNA, 20 bp, mouse
gttgcaaagccggaccgagg

SEQ ID NO: 587420 - DNA, 20 bp, mouse
gacggtcttgttgcggaggg

SEQ ID NO: 587421 - DNA, 20 bp, mouse
gggctggagaggcaaggttg

SEQ ID NO: 587422 - DNA, 20 bp, mouse
gcagtttaccttgctttacg

SEQ ID NO: 587423 - DNA, 20 bp, mouse
gtggttggacggtcttgttg

SEQ ID NO: 587424 - DNA, 20 bp, mouse
gaagcccgtccccctcggtc

SEQ ID NO: 587425 - DNA, 20 bp, mouse
gaagccggaccgagggggac

SEQ ID NO: 587426 - DNA, 20 bp, mouse
gcagctggtaacctcccccc

SEQ ID NO: 587427 - DNA, 20 bp, mouse
gtaaaggtgccacacctggg

SEQ ID NO: 587428 - DNA, 20 bp, mouse
gagatatcgaagacgattaa

SEQ ID NO: 587429 - DNA, 20 bp, mouse
gtgtccagtagacagtgggg

SEQ ID NO: 587430 - DNA, 20 bp, mouse
ggtgctgtccagtagacagt

SEQ ID NO: 587431 - DNA, 20 bp, mouse
gcagctgaggctgcgggtga

SEQ ID NO: 587432 - DNA, 20 bp, mouse
gtctggggaatgggacacat

SEQ ID NO: 587433 - DNA, 20 bp, mouse
gctgcgggtgacggctggag

SEQ ID NO: 587434 - DNA, 20 bp, mouse
gaacctcagaccagtagcta

SEQ ID NO: 587435 - DNA, 20 bp, mouse
gtgaggctgcgggtgacggc

SEQ ID NO: 587436 - DNA, 20 bp, mouse
gagggagccccagaagtcat

SEQ ID NO: 587437 - DNA, 20 bp, mouse
gttcttgaaggaggagtcca

SEQ ID NO: 587438 - DNA, 20 bp, mouse
ggagtccagggtctcagccc

SEQ ID NO: 587439 - DNA, 20 bp, mouse
gagataccgagcgcagacgg

SEQ ID NO: 587440 - DNA, 20 bp, mouse
gtggcctaggttgggagact

SEQ ID NO: 587441 - DNA, 20 bp, mouse
ggccaggaccaggacctcta

SEQ ID NO: 587442 - DNA, 20 bp, mouse
gggctaaagtagagctcttg

SEQ ID NO: 587443 - DNA, 20 bp, mouse
gtagccaagtctcccaacct

SEQ ID NO: 587444 - DNA, 20 bp, mouse
gcacatacccatgacttctg

SEQ ID NO: 587445 - DNA, 20 bp, mouse
gagactggatgtggatgagg

SEQ ID NO: 587446 - DNA, 20 bp, mouse
gctacaaggcgagccaggtg

SEQ ID NO: 587447 - DNA, 20 bp, mouse
gcgagcgggaggcctgacgg

SEQ ID NO: 587448 - DNA, 20 bp, mouse
ggcgcgcggaggaaagaagt

SEQ ID NO: 587449 - DNA, 20 bp, mouse
gcagagctggcaagctgatt

SEQ ID NO: 587450 - DNA, 20 bp, mouse
ggcgcggccgggatattaca

SEQ ID NO: 587451 - DNA, 20 bp, mouse
gtggcaagctgatttggcgg

SEQ ID NO: 587452 - DNA, 20 bp, mouse
gcggaggaaagaagtcggtt

SEQ ID NO: 587453 - DNA, 20 bp, mouse
ggcggcaggcggcatgtcgg

SEQ ID NO: 587454 - DNA, 20 bp, mouse
gaggcgagccaggtgaggcg

SEQ ID NO: 587455 - DNA, 20 bp, mouse
ggccggccgaggtggcttcg

SEQ ID NO: 587456 - DNA, 20 bp, mouse
gcccgcggtcgcacgaccag

SEQ ID NO: 587457 - DNA, 20 bp, mouse
gtgcagatgcagatgcggag

SEQ ID NO: 587458 - DNA, 20 bp, mouse
gagatgcagatgcggagagg

SEQ ID NO: 587459 - DNA, 20 bp, mouse
ggaccacagggactcggagt

SEQ ID NO: 587460 - DNA, 20 bp, mouse
ggcggtcgcacgaccagcgg

SEQ ID NO: 587461 - DNA, 20 bp, mouse
ggaacagggaggggttgcag

SEQ ID NO: 587462 - DNA, 20 bp, mouse
gagatgcggagaggcggctg

SEQ ID NO: 587463 - DNA, 20 bp, mouse
gtgaggtctgagtgctagag

SEQ ID NO: 587464 - DNA, 20 bp, mouse
gagctcccaggtagccgcag

SEQ ID NO: 587465 - DNA, 20 bp, mouse
ggccctgccaccgacatgat

SEQ ID NO: 587466 - DNA, 20 bp, mouse
ggcggagcgggcaccccggg

SEQ ID NO: 587467 - DNA, 20 bp, mouse
gtgagcggagcgggcacccc

SEQ ID NO: 587468 - DNA, 20 bp, mouse
ggggcgcgcggggaccgccc

SEQ ID NO: 587469 - DNA, 20 bp, mouse
gacgcggcccggacgctgag

SEQ ID NO: 587470 - DNA, 20 bp, mouse
gcgggagacccgagactcgg

SEQ ID NO: 587471 - DNA, 20 bp, mouse
ggagccccgagaccaccccc

SEQ ID NO: 587472 - DNA, 20 bp, mouse
ggcgcgcgaggggtttctgg

SEQ ID NO: 587473 - DNA, 20 bp, mouse
gctggaggcggcgtccccaa

SEQ ID NO: 587474 - DNA, 20 bp, mouse
gccacaaagccagccaggta

SEQ ID NO: 587475 - DNA, 20 bp, mouse
ggcggtccccgcgcgcccca

SEQ ID NO: 587476 - DNA, 20 bp, mouse
gcagccgggccgtgcaggta

SEQ ID NO: 587477 - DNA, 20 bp, mouse
gtccccgctagcgcagccgg

SEQ ID NO: 587478 - DNA, 20 bp, mouse
ggcccagcgtgtgagcggag

SEQ ID NO: 587479 - DNA, 20 bp, mouse
gccgggccgtgcaggtacgg

SEQ ID NO: 587480 - DNA, 20 bp, mouse
gctgcgctagcggggaggcg

SEQ ID NO: 587481 - DNA, 20 bp, mouse
gacggcggggcggacgtggt

SEQ ID NO: 587482 - DNA, 20 bp, mouse
gccgcccggcatgaacatca

SEQ ID NO: 587483 - DNA, 20 bp, mouse
gtgcacggcccggctgagga

SEQ ID NO: 587484 - DNA, 20 bp, mouse
gggcagccgggcagagccgc

SEQ ID NO: 587485 - DNA, 20 bp, mouse
gctgaggaaggtgcccgcgt

SEQ ID NO: 587486 - DNA, 20 bp, mouse
ggcgtggcggccctgcgtac

SEQ ID NO: 587487 - DNA, 20 bp, mouse
gctcggggacaagagaacag

SEQ ID NO: 587488 - DNA, 20 bp, mouse
gcacatccgggccccatgag

SEQ ID NO: 587489 - DNA, 20 bp, mouse
gtgcgctctgggtacagcta

SEQ ID NO: 587490 - DNA, 20 bp, mouse
gtgctctggggccggcgtgg

SEQ ID NO: 587491 - DNA, 20 bp, mouse
ggaggtggatgcccactggg

SEQ ID NO: 587492 - DNA, 20 bp, mouse
gtgggttccgggccatagtg

SEQ ID NO: 587493 - DNA, 20 bp, mouse
gagaagctggcgtcggacgc

SEQ ID NO: 587494 - DNA, 20 bp, mouse
gggggctgccggctgctctg

SEQ ID NO: 587495 - DNA, 20 bp, mouse
gtgcacgggtatggagactg

SEQ ID NO: 587496 - DNA, 20 bp, mouse
gccgagcctaggcggatagg

SEQ ID NO: 587497 - DNA, 20 bp, mouse
gcccggctggagctccgcag

SEQ ID NO: 587498 - DNA, 20 bp, mouse
gagtcgccccagggtagcag

SEQ ID NO: 587499 - DNA, 20 bp, mouse
gggccgagccccgcagacag

SEQ ID NO: 587500 - DNA, 20 bp, mouse
gcggccgcccccctcacctc

SEQ ID NO: 587501 - DNA, 20 bp, mouse
ggagccgagcctaggcggat

SEQ ID NO: 587502 - DNA, 20 bp, mouse
ggggagagcaggctccgagg

SEQ ID NO: 587503 - DNA, 20 bp, mouse
gccgccgcggcgaagctcag

SEQ ID NO: 587504 - DNA, 20 bp, mouse
gggtcgccccctatccgcct

SEQ ID NO: 587505 - DNA, 20 bp, mouse
gcagcagaggcagtagcggg

SEQ ID NO: 587506 - DNA, 20 bp, mouse
gaccgagcggcagagagagc

SEQ ID NO: 587507 - DNA, 20 bp, mouse
gcgtcccaggctgctcccgt

SEQ ID NO: 587508 - DNA, 20 bp, mouse
ggcggcggcgcgggagggaa

SEQ ID NO: 587509 - DNA, 20 bp, mouse
gcgtgtaactgcaggaaccg

SEQ ID NO: 587510 - DNA, 20 bp, mouse
gactgtcccggagggcacga

SEQ ID NO: 587511 - DNA, 20 bp, mouse
gtaggcgcccggagcctcgg

SEQ ID NO: 587512 - DNA, 20 bp, mouse
gcgcagggctgtgatctcta

SEQ ID NO: 587513 - DNA, 20 bp, mouse
ggaactggcggcgcagagga

SEQ ID NO: 587514 - DNA, 20 bp, mouse
ggcctacagctgaggctccg

SEQ ID NO: 587515 - DNA, 20 bp, mouse
gggcaggcgactgtcccgga

SEQ ID NO: 587516 - DNA, 20 bp, mouse
gggcggcggcaagtgctcgg

SEQ ID NO: 587517 - DNA, 20 bp, mouse
gccgcggcgcagtatcgtgg

SEQ ID NO: 587518 - DNA, 20 bp, mouse
gccgccgcggcgcagtatcg

SEQ ID NO: 587519 - DNA, 20 bp, mouse
gacagggaccaagggctcgt

SEQ ID NO: 587520 - DNA, 20 bp, mouse
gtcggcggcaaggatcgctt

SEQ ID NO: 587521 - DNA, 20 bp, mouse
gaggccaccctcctacccag

SEQ ID NO: 587522 - DNA, 20 bp, mouse
ggagaacggccatgccgccg

SEQ ID NO: 587523 - DNA, 20 bp, mouse
gtgggcgcctctgggtagga

SEQ ID NO: 587524 - DNA, 20 bp, mouse
gaaaccaggagagaaaccca

SEQ ID NO: 587525 - DNA, 20 bp, mouse
gaggagatggcgaggaccaa

SEQ ID NO: 587526 - DNA, 20 bp, mouse
ggctgcggggccgcgaacaa

SEQ ID NO: 587527 - DNA, 20 bp, mouse
gacgggcagcgggctcggcg

SEQ ID NO: 587528 - DNA, 20 bp, mouse
gaggtcccggagacccaaag

SEQ ID NO: 587529 - DNA, 20 bp, mouse
gggcaccgggagcctcctca

SEQ ID NO: 587530 - DNA, 20 bp, mouse
gggccgagccacacgggcag

SEQ ID NO: 587531 - DNA, 20 bp, mouse
gcgcgaacaaaggcgagcag

SEQ ID NO: 587532 - DNA, 20 bp, mouse
gccggagactgccaccccag

SEQ ID NO: 587533 - DNA, 20 bp, mouse
ggaggctcccggtgccaccg

SEQ ID NO: 587534 - DNA, 20 bp, mouse
ggaacaaaggcgagcagcgg

SEQ ID NO: 587535 - DNA, 20 bp, mouse
ggcttcggaagagacgagag

SEQ ID NO: 587536 - DNA, 20 bp, mouse
ggctagggccctccactcag

SEQ ID NO: 587537 - DNA, 20 bp, mouse
gcttgctgcaagggatcaga

SEQ ID NO: 587538 - DNA, 20 bp, mouse
gagcaggatccacattgtag

SEQ ID NO: 587539 - DNA, 20 bp, mouse
gatggaggcagtgtcttgag

SEQ ID NO: 587540 - DNA, 20 bp, mouse
ggctcgctgcccctacaatg

SEQ ID NO: 587541 - DNA, 20 bp, mouse
gtgctggcaggggagaactt

SEQ ID NO: 587542 - DNA, 20 bp, mouse
gtgtaggggcagcgagccga

SEQ ID NO: 587543 - DNA, 20 bp, mouse
ggctagcctgtagacttctg

SEQ ID NO: 587544 - DNA, 20 bp, mouse
ggaggtgtgtcccacctaca

SEQ ID NO: 587545 - DNA, 20 bp, mouse
gagtcttctaacctgcagca

SEQ ID NO: 587546 - DNA, 20 bp, mouse
ggcgggcggcgcggcagcac

SEQ ID NO: 587547 - DNA, 20 bp, mouse
ggcgagggcgaggacaggca

SEQ ID NO: 587548 - DNA, 20 bp, mouse
ggcgcgcgcgtaggctgatt

SEQ ID NO: 587549 - DNA, 20 bp, mouse
gcaggtgttgcccgcagcgg

SEQ ID NO: 587550 - DNA, 20 bp, mouse
gcccagcagcggggagtgca

SEQ ID NO: 587551 - DNA, 20 bp, mouse
gccggcccgccgaggagagc

SEQ ID NO: 587552 - DNA, 20 bp, mouse
gcagggtgagcagcagaggg

SEQ ID NO: 587553 - DNA, 20 bp, mouse
ggcgcgcgcaccgccgctgc

SEQ ID NO: 587554 - DNA, 20 bp, mouse
gcagtcgccgtcaataaaca

SEQ ID NO: 587555 - DNA, 20 bp, mouse
gtggctgtgcgcgtccaagg

SEQ ID NO: 587556 - DNA, 20 bp, mouse
gcaaggagccgagccagtag

SEQ ID NO: 587557 - DNA, 20 bp, mouse
gcgagccagtagtggccacc

SEQ ID NO: 587558 - DNA, 20 bp, mouse
gccagctggagacagcccgt

SEQ ID NO: 587559 - DNA, 20 bp, mouse
ggcccgtaggccagtcagca

SEQ ID NO: 587560 - DNA, 20 bp, mouse
ggctcaggaatgcaggtgcc

SEQ ID NO: 587561 - DNA, 20 bp, mouse
gtgtctgaagaactgatcac

SEQ ID NO: 587562 - DNA, 20 bp, mouse
gtccttgctgactggcctac

SEQ ID NO: 587563 - DNA, 20 bp, mouse
gggtaagggagtatgaacag

SEQ ID NO: 587564 - DNA, 20 bp, mouse
gcacagcctggaatgaacca

SEQ ID NO: 587565 - DNA, 20 bp, mouse
ggagtatgaacagagggtat

SEQ ID NO: 587566 - DNA, 20 bp, mouse
ggggaggatggtgcacacat

SEQ ID NO: 587567 - DNA, 20 bp, mouse
gccctgggagcgccagtcag

SEQ ID NO: 587568 - DNA, 20 bp, mouse
gcgccagtcagaggaacctt

SEQ ID NO: 587569 - DNA, 20 bp, mouse
gtccctgggccaaggcccct

SEQ ID NO: 587570 - DNA, 20 bp, mouse
ggaggagggacaccaccgat

SEQ ID NO: 587571 - DNA, 20 bp, mouse
gagagtgctcggtccaggga

SEQ ID NO: 587572 - DNA, 20 bp, mouse
ggagggacaccaccgatggg

SEQ ID NO: 587573 - DNA, 20 bp, mouse
gtgacagtcatgggctacag

SEQ ID NO: 587574 - DNA, 20 bp, mouse
gactgcaggccggatatcaa

SEQ ID NO: 587575 - DNA, 20 bp, mouse
gcattctgggcgcaatacaa

SEQ ID NO: 587576 - DNA, 20 bp, mouse
gtcgcacgtctaaggagtga

SEQ ID NO: 587577 - DNA, 20 bp, mouse
gctccttagacgtgcgacct

SEQ ID NO: 587578 - DNA, 20 bp, mouse
gcggcttgcagagcctccta

SEQ ID NO: 587579 - DNA, 20 bp, mouse
gtgcccaggtcgcacgtcta

SEQ ID NO: 587580 - DNA, 20 bp, mouse
gcagtgagtaagggtctgag

SEQ ID NO: 587581 - DNA, 20 bp, mouse
gggcaggcaccagtgagtaa

SEQ ID NO: 587582 - DNA, 20 bp, mouse
gacgtctaaggagtgagggc

SEQ ID NO: 587583 - DNA, 20 bp, mouse
gtcggaggagccaccctagg

SEQ ID NO: 587584 - DNA, 20 bp, mouse
gggcgggtagctccgatcgg

SEQ ID NO: 587585 - DNA, 20 bp, mouse
gtcagagtgaacgctagccc

SEQ ID NO: 587586 - DNA, 20 bp, mouse
gagagcgagccgggtggcag

SEQ ID NO: 587587 - DNA, 20 bp, mouse
gcgaaagagagcgagccggg

SEQ ID NO: 587588 - DNA, 20 bp, mouse
gtggcagtggaggcgccgac

SEQ ID NO: 587589 - DNA, 20 bp, mouse
gaagggcacgggacactaca

SEQ ID NO: 587590 - DNA, 20 bp, mouse
gaaggtagcatggcccctaa

SEQ ID NO: 587591 - DNA, 20 bp, mouse
gggggctgctgagtcccggt

SEQ ID NO: 587592 - DNA, 20 bp, mouse
ggccaggccaaggacatccg

SEQ ID NO: 587593 - DNA, 20 bp, mouse
gcgtgcccttacctgcctgg

SEQ ID NO: 587594 - DNA, 20 bp, mouse
ggtgcgaaagagagcgagcc

SEQ ID NO: 587595 - DNA, 20 bp, mouse
gacactacagggtggttctg

SEQ ID NO: 587596 - DNA, 20 bp, mouse
gccatccagagtgcaggctg

SEQ ID NO: 587597 - DNA, 20 bp, mouse
gctgtagggagccttcctgt

SEQ ID NO: 587598 - DNA, 20 bp, mouse
gctctggatggcgaggaaag

SEQ ID NO: 587599 - DNA, 20 bp, mouse
gtgtgtctgtgacaggacaa

SEQ ID NO: 587600 - DNA, 20 bp, mouse
ggcctgcactctggatggcg

SEQ ID NO: 587601 - DNA, 20 bp, mouse
gccaggttccaacttaccag

SEQ ID NO: 587602 - DNA, 20 bp, mouse
gcctggtgtgctgacccctc

SEQ ID NO: 587603 - DNA, 20 bp, mouse
gaggaaagtggagaagcttc

SEQ ID NO: 587604 - DNA, 20 bp, mouse
gttgtgttaagtctacactg

SEQ ID NO: 587605 - DNA, 20 bp, mouse
gcagaaactaacaatgattc

SEQ ID NO: 587606 - DNA, 20 bp, mouse
gggctccgcaggcgcagcgg

SEQ ID NO: 587607 - DNA, 20 bp, mouse
ggggccagcgcgggggacag

SEQ ID NO: 587608 - DNA, 20 bp, mouse
gccgctagcgggccacacag

SEQ ID NO: 587609 - DNA, 20 bp, mouse
gcgggggacagcggctccgg

SEQ ID NO: 587610 - DNA, 20 bp, mouse
gcatcggccccggcttcgag

SEQ ID NO: 587611 - DNA, 20 bp, mouse
ggggtacggcgagatcgcaa

SEQ ID NO: 587612 - DNA, 20 bp, mouse
gatgccgacgcgcacgacca

SEQ ID NO: 587613 - DNA, 20 bp, mouse
ggccgccgccgctgcgcctg

SEQ ID NO: 587614 - DNA, 20 bp, mouse
ggggcccggactgttcccgg

SEQ ID NO: 587615 - DNA, 20 bp, mouse
gagcgggccacacaggggta

SEQ ID NO: 587616 - DNA, 20 bp, mouse
gccagttcccggaaggaacc

SEQ ID NO: 587617 - DNA, 20 bp, mouse
ggagcaccacaggtgaggca

SEQ ID NO: 587618 - DNA, 20 bp, mouse
gggaatggtcccagatctcc

SEQ ID NO: 587619 - DNA, 20 bp, mouse
gggaccgtgcctggagatct

SEQ ID NO: 587620 - DNA, 20 bp, mouse
ggaagagggttggctcctgg

SEQ ID NO: 587621 - DNA, 20 bp, mouse
gctcttcctagagtggtcca

SEQ ID NO: 587622 - DNA, 20 bp, mouse
gtgtctcgggtcctgctgaa

SEQ ID NO: 587623 - DNA, 20 bp, mouse
ggcgcactaccagagcctga

SEQ ID NO: 587624 - DNA, 20 bp, mouse
ggacaataccagttcccgga

SEQ ID NO: 587625 - DNA, 20 bp, mouse
gaccactctaggaagagggt

SEQ ID NO: 587626 - DNA, 20 bp, mouse
ggcgcccctgcccgtcccgg

SEQ ID NO: 587627 - DNA, 20 bp, mouse
ggcgccgccgggacgggcag

SEQ ID NO: 587628 - DNA, 20 bp, mouse
ggagccaggcgccgccggga

SEQ ID NO: 587629 - DNA, 20 bp, mouse
gcgcgcgcccctgcccgtcc

SEQ ID NO: 587630 - DNA, 20 bp, mouse
gggacccgggccgcctagag

SEQ ID NO: 587631 - DNA, 20 bp, mouse
gggcgagcccggccccactg

SEQ ID NO: 587632 - DNA, 20 bp, mouse
gccgagtgtcacacacgcgg

SEQ ID NO: 587633 - DNA, 20 bp, mouse
gcggccgagtgtcacacacg

SEQ ID NO: 587634 - DNA, 20 bp, mouse
ggggcttctcgagtgcacgg

SEQ ID NO: 587635 - DNA, 20 bp, mouse
gccccgcacgccccccaccg

SEQ ID NO: 587636 - DNA, 20 bp, mouse
gggtggatagctgctaacta

SEQ ID NO: 587637 - DNA, 20 bp, mouse
gttagcagctatccacccag

SEQ ID NO: 587638 - DNA, 20 bp, mouse
gggtacagttccagggtcag

SEQ ID NO: 587639 - DNA, 20 bp, mouse
gagactctgtggccttgcat

SEQ ID NO: 587640 - DNA, 20 bp, mouse
gccaggttacctacccccac

SEQ ID NO: 587641 - DNA, 20 bp, mouse
gagaagcagtcgccaatgca

SEQ ID NO: 587642 - DNA, 20 bp, mouse
ggtaacctggcgcacatggg

SEQ ID NO: 587643 - DNA, 20 bp, mouse
gctcagggcccgtccctggt

SEQ ID NO: 587644 - DNA, 20 bp, mouse
gtacttagcaggagggtcct

SEQ ID NO: 587645 - DNA, 20 bp, mouse
gtaggtaacctggcgcacat

SEQ ID NO: 587646 - DNA, 20 bp, mouse
gaactgtctaggtctgagtt

SEQ ID NO: 587647 - DNA, 20 bp, mouse
gccagctaggaaacctctac

SEQ ID NO: 587648 - DNA, 20 bp, mouse
ggataacagatgacctgggg

SEQ ID NO: 587649 - DNA, 20 bp, mouse
ggaaggtagctcctccggag

SEQ ID NO: 587650 - DNA, 20 bp, mouse
gagatgacctggggaggcga

SEQ ID NO: 587651 - DNA, 20 bp, mouse
gtgtactcctcagccagtag

SEQ ID NO: 587652 - DNA, 20 bp, mouse
gggaggcagaatgggtccca

SEQ ID NO: 587653 - DNA, 20 bp, mouse
ggccgaagtacaacccactt

SEQ ID NO: 587654 - DNA, 20 bp, mouse
gccatggctggggtgagaag

SEQ ID NO: 587655 - DNA, 20 bp, mouse
gttggggggtagaagatcca

SEQ ID NO: 587656 - DNA, 20 bp, mouse
gatcggcccgcggtgcggtg

SEQ ID NO: 587657 - DNA, 20 bp, mouse
gtcctgggagaggggttccg

SEQ ID NO: 587658 - DNA, 20 bp, mouse
gaccagatcggcccgcggtg

SEQ ID NO: 587659 - DNA, 20 bp, mouse
gagaaagtctagacttacca

SEQ ID NO: 587660 - DNA, 20 bp, mouse
gtagacttaccagggtctca

SEQ ID NO: 587661 - DNA, 20 bp, mouse
gtgatcgcgaccacaccctg

SEQ ID NO: 587662 - DNA, 20 bp, mouse
ggagtctccgcaccgcaccg

SEQ ID NO: 587663 - DNA, 20 bp, mouse
gttccggagaggggtctcgg

SEQ ID NO: 587664 - DNA, 20 bp, mouse
gccggaaccagatcggcccg

SEQ ID NO: 587665 - DNA, 20 bp, mouse
gtacagcaagaccggaagta

SEQ ID NO: 587666 - DNA, 20 bp, mouse
gccatgacgcagggtccggg

SEQ ID NO: 587667 - DNA, 20 bp, mouse
gggcagcagtgcgcagaagg

SEQ ID NO: 587668 - DNA, 20 bp, mouse
gagcagtgcgcagaaggtgg

SEQ ID NO: 587669 - DNA, 20 bp, mouse
gcggccgcggccatgacgca

SEQ ID NO: 587670 - DNA, 20 bp, mouse
ggtgggcgcctcgggctcgg

SEQ ID NO: 587671 - DNA, 20 bp, mouse
gcgagcgcgggcagcggaca

SEQ ID NO: 587672 - DNA, 20 bp, mouse
ggagcggtgacatcactcgg

SEQ ID NO: 587673 - DNA, 20 bp, mouse
gtcgcaagcgcccaacacag

SEQ ID NO: 587674 - DNA, 20 bp, mouse
ggcgctgcgaacttccactg

SEQ ID NO: 587675 - DNA, 20 bp, mouse
ggagcgcacggctctggacc

SEQ ID NO: 587676 - DNA, 20 bp, mouse
gatgcggcgagcccacggag

SEQ ID NO: 587677 - DNA, 20 bp, mouse
gtggaagcatgcccctccgt

SEQ ID NO: 587678 - DNA, 20 bp, mouse
gcggcagtccgcgccagggc

SEQ ID NO: 587679 - DNA, 20 bp, mouse
ggggctcgccgcatccaccc

SEQ ID NO: 587680 - DNA, 20 bp, mouse
gctcgcccgacaccaggtag

SEQ ID NO: 587681 - DNA, 20 bp, mouse
ggcggctcgtgtgctatgcg

SEQ ID NO: 587682 - DNA, 20 bp, mouse
gcgagcccctacctggtgtc

SEQ ID NO: 587683 - DNA, 20 bp, mouse
gagcggcggcaaggtctcgg

SEQ ID NO: 587684 - DNA, 20 bp, mouse
ggcctggcggccccggacgg

SEQ ID NO: 587685 - DNA, 20 bp, mouse
gtgcgcggcagtccgcgcca

SEQ ID NO: 587686 - DNA, 20 bp, mouse
gagtcccgtcccccaggctg

SEQ ID NO: 587687 - DNA, 20 bp, mouse
ggctaagactagaggcgtgg

SEQ ID NO: 587688 - DNA, 20 bp, mouse
gcctgggggacgggactccg

SEQ ID NO: 587689 - DNA, 20 bp, mouse
gctgtgcgcagaggaaaagg

SEQ ID NO: 587690 - DNA, 20 bp, mouse
gtctgctaagactagaggcg

SEQ ID NO: 587691 - DNA, 20 bp, mouse
gcctctgccagggcctggaa

SEQ ID NO: 587692 - DNA, 20 bp, mouse
gcaggactcacgctgtatgt

SEQ ID NO: 587693 - DNA, 20 bp, mouse
gagcgggggtgtcttcgccc

SEQ ID NO: 587694 - DNA, 20 bp, mouse
gggagaggtgactgtggcgt

SEQ ID NO: 587695 - DNA, 20 bp, mouse
gcggcctgcaatcagagctg

SEQ ID NO: 587696 - DNA, 20 bp, mouse
gtcggtggaaccatagctat

SEQ ID NO: 587697 - DNA, 20 bp, mouse
gccgccaagtcaggtctcgg

SEQ ID NO: 587698 - DNA, 20 bp, mouse
gccgccgccaagtcaggtct

SEQ ID NO: 587699 - DNA, 20 bp, mouse
gcgcccgcgtaaatttgaaa

SEQ ID NO: 587700 - DNA, 20 bp, mouse
gcctaaggacgcgattacct

SEQ ID NO: 587701 - DNA, 20 bp, mouse
gcagcttccggagaagagaa

SEQ ID NO: 587702 - DNA, 20 bp, mouse
gttgcgggctggtggagttc

SEQ ID NO: 587703 - DNA, 20 bp, mouse
gtcggagtcgggagatactg

SEQ ID NO: 587704 - DNA, 20 bp, mouse
gcccagacggaagggactca

SEQ ID NO: 587705 - DNA, 20 bp, mouse
gtgagcacctcaacccgagt

SEQ ID NO: 587706 - DNA, 20 bp, mouse
gtgcggcgcgaacatggagt

SEQ ID NO: 587707 - DNA, 20 bp, mouse
gggctgcgtggtcccacgag

SEQ ID NO: 587708 - DNA, 20 bp, mouse
ggagctgtcactcccgaccg

SEQ ID NO: 587709 - DNA, 20 bp, mouse
gagagcccaaggcctcggtc

SEQ ID NO: 587710 - DNA, 20 bp, mouse
gacgaggggaaggcggccaa

SEQ ID NO: 587711 - DNA, 20 bp, mouse
ggccttgggctctgaggtcg

SEQ ID NO: 587712 - DNA, 20 bp, mouse
gcactcccgaccgaggcctt

SEQ ID NO: 587713 - DNA, 20 bp, mouse
gaacggctgcggcgcgaaca

SEQ ID NO: 587714 - DNA, 20 bp, mouse
ggcgtggtcccacgagggga

SEQ ID NO: 587715 - DNA, 20 bp, mouse
gcgacggctccagctcccac

SEQ ID NO: 587716 - DNA, 20 bp, mouse
gccagggccgggcagggatt

SEQ ID NO: 587717 - DNA, 20 bp, mouse
gtgcccggccctggtcccaa

SEQ ID NO: 587718 - DNA, 20 bp, mouse
gtcccggaggacgagaccac

SEQ ID NO: 587719 - DNA, 20 bp, mouse
gcgagcatcgcgcagggtcg

SEQ ID NO: 587720 - DNA, 20 bp, mouse
gtgcccttgggaccagggcc

SEQ ID NO: 587721 - DNA, 20 bp, mouse
ggaggcccgagcatcgcgca

SEQ ID NO: 587722 - DNA, 20 bp, mouse
gggttctcagggccaccgga

SEQ ID NO: 587723 - DNA, 20 bp, mouse
gtggggaccgagttgccctt

SEQ ID NO: 587724 - DNA, 20 bp, mouse
gggaccctggaggatcccgg

SEQ ID NO: 587725 - DNA, 20 bp, mouse
gcgagttgcccttgggacca

SEQ ID NO: 587726 - DNA, 20 bp, mouse
ggctcggcccgaagctagac

SEQ ID NO: 587727 - DNA, 20 bp, mouse
gcggtggagcgcagagaaca

SEQ ID NO: 587728 - DNA, 20 bp, mouse
gacgcgcgcgcctggcaggg

SEQ ID NO: 587729 - DNA, 20 bp, mouse
ggcccggcagccccaagcgg

SEQ ID NO: 587730 - DNA, 20 bp, mouse
ggctagacgggcgcagtgat

SEQ ID NO: 587731 - DNA, 20 bp, mouse
gtagacgcgcgcgcctggca

SEQ ID NO: 587732 - DNA, 20 bp, mouse
gacgctcccgggccccctga

SEQ ID NO: 587733 - DNA, 20 bp, mouse
ggccgcggagcagaagagtg

SEQ ID NO: 587734 - DNA, 20 bp, mouse
gtggcagggtggcacccgct

SEQ ID NO: 587735 - DNA, 20 bp, mouse
gggccgggcgcgctccgacg

SEQ ID NO: 587736 - DNA, 20 bp, mouse
gtgagcggagctcctcctac

SEQ ID NO: 587737 - DNA, 20 bp, mouse
gagggccccatgctactgag

SEQ ID NO: 587738 - DNA, 20 bp, mouse
gccgggccggagcccgtagg

SEQ ID NO: 587739 - DNA, 20 bp, mouse
ggccccgggccggagcccgt

SEQ ID NO: 587740 - DNA, 20 bp, mouse
gaggcggccaggatgtccgg

SEQ ID NO: 587741 - DNA, 20 bp, mouse
gcccgcggcgggatccccca

SEQ ID NO: 587742 - DNA, 20 bp, mouse
ggtggggccagggaccgcag

SEQ ID NO: 587743 - DNA, 20 bp, mouse
gaccgcaggggtggaaaggg

SEQ ID NO: 587744 - DNA, 20 bp, mouse
gggacgggcccccggagtag

SEQ ID NO: 587745 - DNA, 20 bp, mouse
ggcggtagtcgggctctggg

SEQ ID NO: 587746 - DNA, 20 bp, mouse
gagacccaagctgctcggac

SEQ ID NO: 587747 - DNA, 20 bp, mouse
gggaagcctcagtactccgg

SEQ ID NO: 587748 - DNA, 20 bp, mouse
gctcggaccggccgcaaagt

SEQ ID NO: 587749 - DNA, 20 bp, mouse
ggcgccggcgttgtcaggat

SEQ ID NO: 587750 - DNA, 20 bp, mouse
gttgtcaggatcggcgcctc

SEQ ID NO: 587751 - DNA, 20 bp, mouse
ggcgcaaccatagagacgag

SEQ ID NO: 587752 - DNA, 20 bp, mouse
ggggcctggggcctccggtg

SEQ ID NO: 587753 - DNA, 20 bp, mouse
gccaagagacccaagtcgac

SEQ ID NO: 587754 - DNA, 20 bp, mouse
gagcagcttgggtcttggcg

SEQ ID NO: 587755 - DNA, 20 bp, mouse
ggcgccgatcctgacaacgc

SEQ ID NO: 587756 - DNA, 20 bp, mouse
ggaacgagccgagcgaggaa

SEQ ID NO: 587757 - DNA, 20 bp, mouse
ggcggcaggcaaggttatat

SEQ ID NO: 587758 - DNA, 20 bp, mouse
gggctgccggtcgctggtaa

SEQ ID NO: 587759 - DNA, 20 bp, mouse
ggggagagccgagcgcaagg

SEQ ID NO: 587760 - DNA, 20 bp, mouse
gaacggaacacatcggagtt

SEQ ID NO: 587761 - DNA, 20 bp, mouse
gagagccaggcagcgccaga

SEQ ID NO: 587762 - DNA, 20 bp, mouse
ggctggagagcttgtgagac

SEQ ID NO: 587763 - DNA, 20 bp, mouse
ggccatcgcagccccagtct

SEQ ID NO: 587764 - DNA, 20 bp, mouse
gccgatccccacccagactg

SEQ ID NO: 587765 - DNA, 20 bp, mouse
gacccagactggggctgcga

SEQ ID NO: 587766 - DNA, 20 bp, mouse
gagccttgccaggcgagcgt

SEQ ID NO: 587767 - DNA, 20 bp, mouse
gctgcagtaggagccgggga

SEQ ID NO: 587768 - DNA, 20 bp, mouse
ggagggactgaaacttccgt

SEQ ID NO: 587769 - DNA, 20 bp, mouse
gatgggagcagaggagcgcg

SEQ ID NO: 587770 - DNA, 20 bp, mouse
gaccccacgctcgcctggca

SEQ ID NO: 587771 - DNA, 20 bp, mouse
gctccggtgggagccgccca

SEQ ID NO: 587772 - DNA, 20 bp, mouse
ggtgcgcgcagtgctcccgg

SEQ ID NO: 587773 - DNA, 20 bp, mouse
ggcagccgggcagtcggagc

SEQ ID NO: 587774 - DNA, 20 bp, mouse
gaccgagcacagagtggcgg

SEQ ID NO: 587775 - DNA, 20 bp, mouse
gaggagcgcggtgcgcagcc

SEQ ID NO: 587776 - DNA, 20 bp, mouse
gccgcctgcgtgacagtcag

SEQ ID NO: 587777 - DNA, 20 bp, mouse
gtgcaggtctcggggaccaa

SEQ ID NO: 587778 - DNA, 20 bp, mouse
gcctgcgtgacagtcagggg

SEQ ID NO: 587779 - DNA, 20 bp, mouse
ggcgggagacagcccagtcg

SEQ ID NO: 587780 - DNA, 20 bp, mouse
gtgacagtcaggggcgggag

SEQ ID NO: 587781 - DNA, 20 bp, mouse
gtaggctgcgactgaagcag

SEQ ID NO: 587782 - DNA, 20 bp, mouse
gtggcagctggagaatccga

SEQ ID NO: 587783 - DNA, 20 bp, mouse
gcagtcgcggccaagtgcag

SEQ ID NO: 587784 - DNA, 20 bp, mouse
gcgacggcccgcaagaatag

SEQ ID NO: 587785 - DNA, 20 bp, mouse
gtggagggcgtcccttaaaa

SEQ ID NO: 587786 - DNA, 20 bp, mouse
ggaaagggcgctgagaggtc

SEQ ID NO: 587787 - DNA, 20 bp, mouse
gcgggcggcatggcgagagg

SEQ ID NO: 587788 - DNA, 20 bp, mouse
ggagcgacacgagatgggtg

SEQ ID NO: 587789 - DNA, 20 bp, mouse
gacaaccgcaagcatctggg

SEQ ID NO: 587790 - DNA, 20 bp, mouse
gtagtcccgccccaagaagg

SEQ ID NO: 587791 - DNA, 20 bp, mouse
gaggggccgcaggacaaagc

SEQ ID NO: 587792 - DNA, 20 bp, mouse
gctgggtgggcgtcgctggt

SEQ ID NO: 587793 - DNA, 20 bp, mouse
gctgttggctgtgcccttaa

SEQ ID NO: 587794 - DNA, 20 bp, mouse
gctctccatcccttacccag

SEQ ID NO: 587795 - DNA, 20 bp, mouse
gaggagccccaagcaccagc

SEQ ID NO: 587796 - DNA, 20 bp, mouse
gggtaccatacactcttctt

SEQ ID NO: 587797 - DNA, 20 bp, mouse
gacactgggatcccaagccg

SEQ ID NO: 587798 - DNA, 20 bp, mouse
gggatgggcagtctacacac

SEQ ID NO: 587799 - DNA, 20 bp, mouse
gtgtgcccaagaagagtgta

SEQ ID NO: 587800 - DNA, 20 bp, mouse
gcacaggacattccgaggat

SEQ ID NO: 587801 - DNA, 20 bp, mouse
ggggcacacaggacattccg

SEQ ID NO: 587802 - DNA, 20 bp, mouse
gtgcgctgtgtcctgtagat

SEQ ID NO: 587803 - DNA, 20 bp, mouse
gaggagacacccgaacatct

SEQ ID NO: 587804 - DNA, 20 bp, mouse
ggagggtcaaaggtcccagt

SEQ ID NO: 587805 - DNA, 20 bp, mouse
gaagtgacaagggctcaggt

SEQ ID NO: 587806 - DNA, 20 bp, mouse
gggcgggacagaccaacgga

SEQ ID NO: 587807 - DNA, 20 bp, mouse
gctggtcgcggaggttgcgg

SEQ ID NO: 587808 - DNA, 20 bp, mouse
gcggaccaagcccaagacca

SEQ ID NO: 587809 - DNA, 20 bp, mouse
gagggccgcgctggtcgcgg

SEQ ID NO: 587810 - DNA, 20 bp, mouse
gggaggttgcggcggcaccg

SEQ ID NO: 587811 - DNA, 20 bp, mouse
ggctagggccgcgctggtcg

SEQ ID NO: 587812 - DNA, 20 bp, mouse
gtgctccctagggaccgggt

SEQ ID NO: 587813 - DNA, 20 bp, mouse
gaccgtgaaggacacaacaa

SEQ ID NO: 587814 - DNA, 20 bp, mouse
gtgacccgacccggtcccta

SEQ ID NO: 587815 - DNA, 20 bp, mouse
gtcattccagagacagctag

SEQ ID NO: 587816 - DNA, 20 bp, mouse
ggccggaccccagcctcagt

SEQ ID NO: 587817 - DNA, 20 bp, mouse
gggtcctgcgggacgagacg

SEQ ID NO: 587818 - DNA, 20 bp, mouse
ggggcagccggggtgcgcgg

SEQ ID NO: 587819 - DNA, 20 bp, mouse
gctgcagtcgcagcccggca

SEQ ID NO: 587820 - DNA, 20 bp, mouse
ggggacggtgctgccgactg

SEQ ID NO: 587821 - DNA, 20 bp, mouse
ggacgcgtggagaacccctg

SEQ ID NO: 587822 - DNA, 20 bp, mouse
ggtgctgccgactgaggctg

SEQ ID NO: 587823 - DNA, 20 bp, mouse
ggtcgggacgcactcctcga

SEQ ID NO: 587824 - DNA, 20 bp, mouse
gcccgaagcgcggctcccgg

SEQ ID NO: 587825 - DNA, 20 bp, mouse
gaggcgcgcggagcccgcag

SEQ ID NO: 587826 - DNA, 20 bp, mouse
gccaagccggcgcgagacac

SEQ ID NO: 587827 - DNA, 20 bp, mouse
gcggcgcgagacacaggcga

SEQ ID NO: 587828 - DNA, 20 bp, mouse
ggcgagacacaggcgagggc

SEQ ID NO: 587829 - DNA, 20 bp, mouse
gcgtgggggccagccagggt

SEQ ID NO: 587830 - DNA, 20 bp, mouse
gaccggccccagtgcagatg

SEQ ID NO: 587831 - DNA, 20 bp, mouse
ggggaccttcagggaatcgg

SEQ ID NO: 587832 - DNA, 20 bp, mouse
gaccttcagggaatcggggg

SEQ ID NO: 587833 - DNA, 20 bp, mouse
ggtcccgcatccggaaagtg

SEQ ID NO: 587834 - DNA, 20 bp, mouse
gtccggatgcgggaccttca

SEQ ID NO: 587835 - DNA, 20 bp, mouse
ggccggcttggagcttggag

SEQ ID NO: 587836 - DNA, 20 bp, mouse
gctgcgagcgagcggacgtg

SEQ ID NO: 587837 - DNA, 20 bp, mouse
gcgcacttggcgtgctagag

SEQ ID NO: 587838 - DNA, 20 bp, mouse
gcgcgacgcgcgccgaggaa

SEQ ID NO: 587839 - DNA, 20 bp, mouse
gggcagctagcgcaactggg

SEQ ID NO: 587840 - DNA, 20 bp, mouse
ggccccggcgcgctcctccc

SEQ ID NO: 587841 - DNA, 20 bp, mouse
ggaatgaagggagggccaga

SEQ ID NO: 587842 - DNA, 20 bp, mouse
gagagcatcctgcgagcgag

SEQ ID NO: 587843 - DNA, 20 bp, mouse
ggctggccgcacatgcaggg

SEQ ID NO: 587844 - DNA, 20 bp, mouse
ggagcgctccagcccgggtt

SEQ ID NO: 587845 - DNA, 20 bp, mouse
ggcttcggccgcgcgtccag

SEQ ID NO: 587846 - DNA, 20 bp, mouse
ggccgtcgcgacgactgcag

SEQ ID NO: 587847 - DNA, 20 bp, mouse
gtcgcgacgactgcagtgga

SEQ ID NO: 587848 - DNA, 20 bp, mouse
gtggagggggtcccgagtcg

SEQ ID NO: 587849 - DNA, 20 bp, mouse
gcccgagtcggggagcaccc

SEQ ID NO: 587850 - DNA, 20 bp, mouse
gagccggccggcttgcgggg

SEQ ID NO: 587851 - DNA, 20 bp, mouse
ggcgccaagcctccagcttg

SEQ ID NO: 587852 - DNA, 20 bp, mouse
gttcagatgaatcacttccc

SEQ ID NO: 587853 - DNA, 20 bp, mouse
ggacatgggccgagttgcag

SEQ ID NO: 587854 - DNA, 20 bp, mouse
gccaagcctccagcttgagg

SEQ ID NO: 587855 - DNA, 20 bp, mouse
gttgctccgcctcaagctgg

SEQ ID NO: 587856 - DNA, 20 bp, mouse
gtccagccggaaccccgcag

SEQ ID NO: 587857 - DNA, 20 bp, mouse
ggagcacgtgctgggctgtt

SEQ ID NO: 587858 - DNA, 20 bp, mouse
gctgttaggacagcccgctg

SEQ ID NO: 587859 - DNA, 20 bp, mouse
gggaggccaccctgcaccaa

SEQ ID NO: 587860 - DNA, 20 bp, mouse
ggccaccctgcaccaagggt

SEQ ID NO: 587861 - DNA, 20 bp, mouse
ggacgtggtgtgtcacgtgg

SEQ ID NO: 587862 - DNA, 20 bp, mouse
gcgcgcgctctccaggaatt

SEQ ID NO: 587863 - DNA, 20 bp, mouse
gcgtgacacaccacgtccgg

SEQ ID NO: 587864 - DNA, 20 bp, mouse
gtccaacccttggtgcaggg

SEQ ID NO: 587865 - DNA, 20 bp, mouse
gacagcccgctgcggggttc

SEQ ID NO: 587866 - DNA, 20 bp, mouse
gtcgctacaggaggcacagg

SEQ ID NO: 587867 - DNA, 20 bp, mouse
gctgtatcggtgtagtaccg

SEQ ID NO: 587868 - DNA, 20 bp, mouse
gaggataccatcgctacagg

SEQ ID NO: 587869 - DNA, 20 bp, mouse
gccatcgctacaggaggcac

SEQ ID NO: 587870 - DNA, 20 bp, mouse
gctagccactaactctgtat

SEQ ID NO: 587871 - DNA, 20 bp, mouse
gtacaccgatacagagttag

SEQ ID NO: 587872 - DNA, 20 bp, mouse
gcgatcagacgacctaggta

SEQ ID NO: 587873 - DNA, 20 bp, mouse
ggaccactcgggtaagaaca

SEQ ID NO: 587874 - DNA, 20 bp, mouse
ggtggtccgaagcaaagaga

SEQ ID NO: 587875 - DNA, 20 bp, mouse
gccctgagacagcacatgtg

SEQ ID NO: 587876 - DNA, 20 bp, mouse
gagcagggatggtggagtcc

SEQ ID NO: 587877 - DNA, 20 bp, mouse
ggtggagtccgggctccgga

SEQ ID NO: 587878 - DNA, 20 bp, mouse
gaagcagagaaccggcccac

SEQ ID NO: 587879 - DNA, 20 bp, mouse
gtggcaggggagcgtcgctc

SEQ ID NO: 587880 - DNA, 20 bp, mouse
gtccggacggcagcctgggg

SEQ ID NO: 587881 - DNA, 20 bp, mouse
ggatggtggagtccgggctc

SEQ ID NO: 587882 - DNA, 20 bp, mouse
gccggcccggcgctgtcagg

SEQ ID NO: 587883 - DNA, 20 bp, mouse
ggccggccgggccccccgac

SEQ ID NO: 587884 - DNA, 20 bp, mouse
gagccggggcgaggcctgag

SEQ ID NO: 587885 - DNA, 20 bp, mouse
gcctggggcgggagcggcac

SEQ ID NO: 587886 - DNA, 20 bp, mouse
ggaacacgcgcactccggca

SEQ ID NO: 587887 - DNA, 20 bp, mouse
gtgagcgcgaggttgaccgg

SEQ ID NO: 587888 - DNA, 20 bp, mouse
gggacatgggagccgcggag

SEQ ID NO: 587889 - DNA, 20 bp, mouse
gcaaccggagcgacagagaa

SEQ ID NO: 587890 - DNA, 20 bp, mouse
gccgtccgggagctggacat

SEQ ID NO: 587891 - DNA, 20 bp, mouse
ggcttgagcgcgaggttgac

SEQ ID NO: 587892 - DNA, 20 bp, mouse
gggggccgccagagggaaat

SEQ ID NO: 587893 - DNA, 20 bp, mouse
ggccgcgatggaagaactta

SEQ ID NO: 587894 - DNA, 20 bp, mouse
gtaaggggaaccgcggccgg

SEQ ID NO: 587895 - DNA, 20 bp, mouse
gtcagatctgaactctccgc

SEQ ID NO: 587896 - DNA, 20 bp, mouse
gtggtgacagcacagctcgg

SEQ ID NO: 587897 - DNA, 20 bp, mouse
gggtcgcgaagccatggcag

SEQ ID NO: 587898 - DNA, 20 bp, mouse
gggtggccgggccccaggtg

SEQ ID NO: 587899 - DNA, 20 bp, mouse
ggtgacaggtcgcgaagcca

SEQ ID NO: 587900 - DNA, 20 bp, mouse
gtccagagtgaagtgttccc

SEQ ID NO: 587901 - DNA, 20 bp, mouse
gctgggtgcagcctccaata

SEQ ID NO: 587902 - DNA, 20 bp, mouse
gactctggagggcagtaagg

SEQ ID NO: 587903 - DNA, 20 bp, mouse
ggccggggaacacttcactc

SEQ ID NO: 587904 - DNA, 20 bp, mouse
gagtcgataccgagagtgac

SEQ ID NO: 587905 - DNA, 20 bp, mouse
gtggcttgaaccgcacgccg

SEQ ID NO: 587906 - DNA, 20 bp, mouse
gcaactcccgcaggtgagtg

SEQ ID NO: 587907 - DNA, 20 bp, mouse
gcaggtgagtgtggcgactg

SEQ ID NO: 587908 - DNA, 20 bp, mouse
ggcgcatgcgcaactcccgc

SEQ ID NO: 587909 - DNA, 20 bp, mouse
ggcgacaggtgcctgcagag

SEQ ID NO: 587910 - DNA, 20 bp, mouse
gcgggcccggccctcctcgc

SEQ ID NO: 587911 - DNA, 20 bp, mouse
gggatctgcagcctgcgagg

SEQ ID NO: 587912 - DNA, 20 bp, mouse
gcgcgtcagggaaactccga

SEQ ID NO: 587913 - DNA, 20 bp, mouse
gggcctcagcacgcaagcgt

SEQ ID NO: 587914 - DNA, 20 bp, mouse
ggtgtggcgactgtgggccc

SEQ ID NO: 587915 - DNA, 20 bp, mouse
gcctcgaagaaggagccgga

SEQ ID NO: 587916 - DNA, 20 bp, mouse
ggtccggaagcgctgtggta

SEQ ID NO: 587917 - DNA, 20 bp, mouse
gaagccaacacagccccgct

SEQ ID NO: 587918 - DNA, 20 bp, mouse
gcctccgtccggaagcgctg

SEQ ID NO: 587919 - DNA, 20 bp, mouse
ggtgcctagcggggctgtgt

SEQ ID NO: 587920 - DNA, 20 bp, mouse
gaagcgctgtggtacggcgt

SEQ ID NO: 587921 - DNA, 20 bp, mouse
ggaactgatcgtgtgcctag

SEQ ID NO: 587922 - DNA, 20 bp, mouse
ggtgggctcccgaatgaaag

SEQ ID NO: 587923 - DNA, 20 bp, mouse
gacggcgtgggtctgtcgcg

SEQ ID NO: 587924 - DNA, 20 bp, mouse
gttcgacgtgtacttcgagg

SEQ ID NO: 587925 - DNA, 20 bp, mouse
gtgctcggtggcgggatcca

SEQ ID NO: 587926 - DNA, 20 bp, mouse
gtgctgcggccggagactgg

SEQ ID NO: 587927 - DNA, 20 bp, mouse
gcgtcgggagctggagccca

SEQ ID NO: 587928 - DNA, 20 bp, mouse
gcagcccgagacgcacttca

SEQ ID NO: 587929 - DNA, 20 bp, mouse
gagggctcggatgtcactga

SEQ ID NO: 587930 - DNA, 20 bp, mouse
gcggagactggaggtggcgt

SEQ ID NO: 587931 - DNA, 20 bp, mouse
ggatgtcactgagggatcgc

SEQ ID NO: 587932 - DNA, 20 bp, mouse
gtctccggccgcagcagggg

SEQ ID NO: 587933 - DNA, 20 bp, mouse
gtccgacccggagtccagac

SEQ ID NO: 587934 - DNA, 20 bp, mouse
ggaaggtccagacagaatga

SEQ ID NO: 587935 - DNA, 20 bp, mouse
ggccggtctggactccgggt

SEQ ID NO: 587936 - DNA, 20 bp, mouse
gccggcggctactgtagtgg

SEQ ID NO: 587937 - DNA, 20 bp, mouse
gccacctaggagcctccagg

SEQ ID NO: 587938 - DNA, 20 bp, mouse
gtgcaaagcaagttcagcgg

SEQ ID NO: 587939 - DNA, 20 bp, mouse
gacgaaccggcccaccacct

SEQ ID NO: 587940 - DNA, 20 bp, mouse
gccaccacctaggagcctcc

SEQ ID NO: 587941 - DNA, 20 bp, mouse
ggcggctactgtagtggcgg

SEQ ID NO: 587942 - DNA, 20 bp, mouse
gtaggagcctccaggcggct

SEQ ID NO: 587943 - DNA, 20 bp, mouse
gtacgcgggccggaccagga

SEQ ID NO: 587944 - DNA, 20 bp, mouse
ggctactgtagtggcggcgg

SEQ ID NO: 587945 - DNA, 20 bp, mouse
gcagctgcacctccaccagg

SEQ ID NO: 587946 - DNA, 20 bp, mouse
gtcttcctagacagggtgaa

SEQ ID NO: 587947 - DNA, 20 bp, mouse
gcagtctgcggagaccctgg

SEQ ID NO: 587948 - DNA, 20 bp, mouse
gggcagaggcagagccgcaa

SEQ ID NO: 587949 - DNA, 20 bp, mouse
gagtgggagaagcatccccg

SEQ ID NO: 587950 - DNA, 20 bp, mouse
gaaccccagtaggaccccca

SEQ ID NO: 587951 - DNA, 20 bp, mouse
gtctggcgcgatgaagactc

SEQ ID NO: 587952 - DNA, 20 bp, mouse
gtacacccgctggaattcag

SEQ ID NO: 587953 - DNA, 20 bp, mouse
gaagactccggagaacttgg

SEQ ID NO: 587954 - DNA, 20 bp, mouse
gaaagcctttcaccctgtct

SEQ ID NO: 587955 - DNA, 20 bp, mouse
gcgaagcctgcggctccccg

SEQ ID NO: 587956 - DNA, 20 bp, mouse
gcagctgcaccgggacgtac

SEQ ID NO: 587957 - DNA, 20 bp, mouse
gtgcaccgggacgtactgga

SEQ ID NO: 587958 - DNA, 20 bp, mouse
gggacgtactggaaggaccc

SEQ ID NO: 587959 - DNA, 20 bp, mouse
ggtactggaaggaccccggc

SEQ ID NO: 587960 - DNA, 20 bp, mouse
ggaggatggagagccggccg

SEQ ID NO: 587961 - DNA, 20 bp, mouse
gtcccggtgcagctgcaagg

SEQ ID NO: 587962 - DNA, 20 bp, mouse
gtggccagccggagcccgag

SEQ ID NO: 587963 - DNA, 20 bp, mouse
ggcctgcccagcccgagccg

SEQ ID NO: 587964 - DNA, 20 bp, mouse
gcggtgtcgaaggtaaggag

SEQ ID NO: 587965 - DNA, 20 bp, mouse
gtccatcctcggctcgggct

SEQ ID NO: 587966 - DNA, 20 bp, mouse
ggcagcactatcccaaacac

SEQ ID NO: 587967 - DNA, 20 bp, mouse
gatcccaaacacaggccccg

SEQ ID NO: 587968 - DNA, 20 bp, mouse
ggggctcttcctgaattcgg

SEQ ID NO: 587969 - DNA, 20 bp, mouse
gtgaattcggcgggttaatc

SEQ ID NO: 587970 - DNA, 20 bp, mouse
gagtaccttgagccagaact

SEQ ID NO: 587971 - DNA, 20 bp, mouse
gtaggggctcttcctgaatt

SEQ ID NO: 587972 - DNA, 20 bp, mouse
gcgacagaagccctccccaa

SEQ ID NO: 587973 - DNA, 20 bp, mouse
gttccccggggcctgtgttt

SEQ ID NO: 587974 - DNA, 20 bp, mouse
ggtcagcagaagtgcaggtg

SEQ ID NO: 587975 - DNA, 20 bp, mouse
ggaggtaccctgcatgaaaa

SEQ ID NO: 587976 - DNA, 20 bp, mouse
ggcgggcgcgctctcgaggg

SEQ ID NO: 587977 - DNA, 20 bp, mouse
ggagaccgacgggacaccct

SEQ ID NO: 587978 - DNA, 20 bp, mouse
ggccgcgcctccacctctcc

SEQ ID NO: 587979 - DNA, 20 bp, mouse
gtcccggcaccgagaccgac

SEQ ID NO: 587980 - DNA, 20 bp, mouse
gcgggcgggcgcgctctcga

SEQ ID NO: 587981 - DNA, 20 bp, mouse
ggtctcggtgccgggagagg

SEQ ID NO: 587982 - DNA, 20 bp, mouse
gtcggtgccgggagaggtgg

SEQ ID NO: 587983 - DNA, 20 bp, mouse
gctcgtggcgacataaacaa

SEQ ID NO: 587984 - DNA, 20 bp, mouse
gaggccgcccgcttacctgt

SEQ ID NO: 587985 - DNA, 20 bp, mouse
ggcggcccagggtgtcccgt

SEQ ID NO: 587986 - DNA, 20 bp, mouse
gcccttgcgcctaagaccac

SEQ ID NO: 587987 - DNA, 20 bp, mouse
gtctaagcgacggatggagg

SEQ ID NO: 587988 - DNA, 20 bp, mouse
gcggaaccggagctaccgga

SEQ ID NO: 587989 - DNA, 20 bp, mouse
ggcgtaagcaagctcctcat

SEQ ID NO: 587990 - DNA, 20 bp, mouse
gtggtctaagcgacggatgg

SEQ ID NO: 587991 - DNA, 20 bp, mouse
gctctacagggagaccgctg

SEQ ID NO: 587992 - DNA, 20 bp, mouse
ggcgtggtctaagcgacgga

SEQ ID NO: 587993 - DNA, 20 bp, mouse
gaaaggcgtggtctaagcga

SEQ ID NO: 587994 - DNA, 20 bp, mouse
gtggtacagcccggaggaaa

SEQ ID NO: 587995 - DNA, 20 bp, mouse
gggttgaattcggtaaggat

SEQ ID NO: 587996 - DNA, 20 bp, mouse
ggccgtgcggtgccctcctc

SEQ ID NO: 587997 - DNA, 20 bp, mouse
gccagaacgccgccggagga

SEQ ID NO: 587998 - DNA, 20 bp, mouse
gaccgcgccgatcctctcgg

SEQ ID NO: 587999 - DNA, 20 bp, mouse
gtcctgaagcgagtgggcca

SEQ ID NO: 588000 - DNA, 20 bp, mouse
gcgcaccagaacgccgccgg

SEQ ID NO: 588001 - DNA, 20 bp, mouse
gacgcccgcaggtccatggt

SEQ ID NO: 588002 - DNA, 20 bp, mouse
gccgagagcgacgaccatcc

SEQ ID NO: 588003 - DNA, 20 bp, mouse
gcgggtgccgccgagaggat

SEQ ID NO: 588004 - DNA, 20 bp, mouse
gaagccggcagcccagggaa

SEQ ID NO: 588005 - DNA, 20 bp, mouse
gcagctgacgcaagccccgg

SEQ ID NO: 588006 - DNA, 20 bp, mouse
gctggaacggagagtctccg

SEQ ID NO: 588007 - DNA, 20 bp, mouse
gtgacacaggaaggcagcgg

SEQ ID NO: 588008 - DNA, 20 bp, mouse
ggaggaagctgtaagtcctt

SEQ ID NO: 588009 - DNA, 20 bp, mouse
gtaagtccttgggctctgaa

SEQ ID NO: 588010 - DNA, 20 bp, mouse
ggtgctccattcagagccca

SEQ ID NO: 588011 - DNA, 20 bp, mouse
gagatggcagaaagcacgag

SEQ ID NO: 588012 - DNA, 20 bp, mouse
ggagactctccgttccagcc

SEQ ID NO: 588013 - DNA, 20 bp, mouse
gaaccccacgcacaacctaa

SEQ ID NO: 588014 - DNA, 20 bp, mouse
gcttgtagtgctgaaaccgg

SEQ ID NO: 588015 - DNA, 20 bp, mouse
gcccctcggaggaccgtgtg

SEQ ID NO: 588016 - DNA, 20 bp, mouse
gtagcggctacctctctgag

SEQ ID NO: 588017 - DNA, 20 bp, mouse
ggccgctagtctggaagaat

SEQ ID NO: 588018 - DNA, 20 bp, mouse
gaacgacaaacccctcagag

SEQ ID NO: 588019 - DNA, 20 bp, mouse
gtcggtgtgaccagctacca

SEQ ID NO: 588020 - DNA, 20 bp, mouse
gggtcacgcgtgtggagtag

SEQ ID NO: 588021 - DNA, 20 bp, mouse
gacacaagcagcccaaggag

SEQ ID NO: 588022 - DNA, 20 bp, mouse
gagagaggtagccgctagtc

SEQ ID NO: 588023 - DNA, 20 bp, mouse
gaccgattcttccagactag

SEQ ID NO: 588024 - DNA, 20 bp, mouse
gctccttcggagaccccagg

SEQ ID NO: 588025 - DNA, 20 bp, mouse
ggcagcctgaggtatctagg

SEQ ID NO: 588026 - DNA, 20 bp, mouse
gccggacgcgggccctttaa

SEQ ID NO: 588027 - DNA, 20 bp, mouse
gcaggagcggctccagggag

SEQ ID NO: 588028 - DNA, 20 bp, mouse
ggcggacgcggcgcagaact

SEQ ID NO: 588029 - DNA, 20 bp, mouse
gccctggcccgaaggcttcc

SEQ ID NO: 588030 - DNA, 20 bp, mouse
gaggcccaggagcggctcca

SEQ ID NO: 588031 - DNA, 20 bp, mouse
gcctttaagggcggcggacg

SEQ ID NO: 588032 - DNA, 20 bp, mouse
gccaccaagagcacgcacaa

SEQ ID NO: 588033 - DNA, 20 bp, mouse
gccgcgtccgggaagccttc

SEQ ID NO: 588034 - DNA, 20 bp, mouse
gaggggacgcgtcctatctg

SEQ ID NO: 588035 - DNA, 20 bp, mouse
ggctgcgccgcggtaaacag

SEQ ID NO: 588036 - DNA, 20 bp, mouse
ggcagcggcgacagacccag

SEQ ID NO: 588037 - DNA, 20 bp, mouse
gttccgcgcgagtctcaggt

SEQ ID NO: 588038 - DNA, 20 bp, mouse
gtcgtgactcagacacgcgg

SEQ ID NO: 588039 - DNA, 20 bp, mouse
gcgcgcgagtctcaggtggg

SEQ ID NO: 588040 - DNA, 20 bp, mouse
gcggaggtgagtagaggtcc

SEQ ID NO: 588041 - DNA, 20 bp, mouse
gcagtcgtgactcagacacg

SEQ ID NO: 588042 - DNA, 20 bp, mouse
gacctgtccgaggtgcgcag

SEQ ID NO: 588043 - DNA, 20 bp, mouse
gcagcttccgcgcgagtctc

SEQ ID NO: 588044 - DNA, 20 bp, mouse
ggccgctgcgcacctcggac

SEQ ID NO: 588045 - DNA, 20 bp, mouse
gctgtcgccgctgcgcacct

SEQ ID NO: 588046 - DNA, 20 bp, mouse
gccaacaggaaggactgctg

SEQ ID NO: 588047 - DNA, 20 bp, mouse
gagaggccagaccctatgag

SEQ ID NO: 588048 - DNA, 20 bp, mouse
gtaggcacctgaatgcacct

SEQ ID NO: 588049 - DNA, 20 bp, mouse
gcactccctgagccaggaac

SEQ ID NO: 588050 - DNA, 20 bp, mouse
gtccagggcccaagtctata

SEQ ID NO: 588051 - DNA, 20 bp, mouse
ggcttctggttccctgctgg

SEQ ID NO: 588052 - DNA, 20 bp, mouse
gctacccacccggcttccct

SEQ ID NO: 588053 - DNA, 20 bp, mouse
ggttggtcaacccaacagga

SEQ ID NO: 588054 - DNA, 20 bp, mouse
gccagggagcagacaagatt

SEQ ID NO: 588055 - DNA, 20 bp, mouse
gtgtggtctggcctagagga

SEQ ID NO: 588056 - DNA, 20 bp, mouse
gtgctgtgacaaaggcaggt

SEQ ID NO: 588057 - DNA, 20 bp, mouse
gtgggctctaagcaaactgg

SEQ ID NO: 588058 - DNA, 20 bp, mouse
ggccgcagccaagtagccag

SEQ ID NO: 588059 - DNA, 20 bp, mouse
gcgctgggctctaagcaaac

SEQ ID NO: 588060 - DNA, 20 bp, mouse
gccaagtctgcagggccgct

SEQ ID NO: 588061 - DNA, 20 bp, mouse
gtcttagtgtgctgtgacaa

SEQ ID NO: 588062 - DNA, 20 bp, mouse
gtggcctgtgtgctccagat

SEQ ID NO: 588063 - DNA, 20 bp, mouse
gagtagccagcggtgtgagt

SEQ ID NO: 588064 - DNA, 20 bp, mouse
gagtgtgctgtgacaaaggc

SEQ ID NO: 588065 - DNA, 20 bp, mouse
gaccgctggctacttggctg

SEQ ID NO: 588066 - DNA, 20 bp, mouse
gagtttgaagtggatccctg

SEQ ID NO: 588067 - DNA, 20 bp, mouse
gattcctggactaggttagt

SEQ ID NO: 588068 - DNA, 20 bp, mouse
gcgtcctactaacctagtcc

SEQ ID NO: 588069 - DNA, 20 bp, mouse
gaagtggatccctggggtga

SEQ ID NO: 588070 - DNA, 20 bp, mouse
ggtgagtgggaacagggacc

SEQ ID NO: 588071 - DNA, 20 bp, mouse
ggggcaggtgagtgggaaca

SEQ ID NO: 588072 - DNA, 20 bp, mouse
gaaaggctctaggttcctgt

SEQ ID NO: 588073 - DNA, 20 bp, mouse
ggaacagggaccgggctagt

SEQ ID NO: 588074 - DNA, 20 bp, mouse
gagggggccaatatattcag

SEQ ID NO: 588075 - DNA, 20 bp, mouse
gggctctaggttcctgtggg

SEQ ID NO: 588076 - DNA, 20 bp, mouse
gtgctgctctgggggataaa

SEQ ID NO: 588077 - DNA, 20 bp, mouse
gcagggtgaaaacctcttgg

SEQ ID NO: 588078 - DNA, 20 bp, mouse
ggtaccagaatccatgaact

SEQ ID NO: 588079 - DNA, 20 bp, mouse
gcaagaagaggttgactgac

SEQ ID NO: 588080 - DNA, 20 bp, mouse
gatggattctggtacaggga

SEQ ID NO: 588081 - DNA, 20 bp, mouse
gctggagagacagttttagc

SEQ ID NO: 588082 - DNA, 20 bp, mouse
gctgactcagacccagttca

SEQ ID NO: 588083 - DNA, 20 bp, mouse
gcttctcctatctcaagaag

SEQ ID NO: 588084 - DNA, 20 bp, mouse
ggtacactgctcccaaccca

SEQ ID NO: 588085 - DNA, 20 bp, mouse
gcctccaagggtctccgagc

SEQ ID NO: 588086 - DNA, 20 bp, mouse
gcacagaccagctgagaagg

SEQ ID NO: 588087 - DNA, 20 bp, mouse
gcaagtccaagatcccccta

SEQ ID NO: 588088 - DNA, 20 bp, mouse
ggtgacatcgtggccttagg

SEQ ID NO: 588089 - DNA, 20 bp, mouse
gaacagcagcagtgacatcg

SEQ ID NO: 588090 - DNA, 20 bp, mouse
gcgtggccttagggggatct

SEQ ID NO: 588091 - DNA, 20 bp, mouse
gccctctctagtggctggga

SEQ ID NO: 588092 - DNA, 20 bp, mouse
gaaacacagaccagctgaga

SEQ ID NO: 588093 - DNA, 20 bp, mouse
gtgtcttgcaccggtaccca

SEQ ID NO: 588094 - DNA, 20 bp, mouse
gcaggtgcagagaattgtga

SEQ ID NO: 588095 - DNA, 20 bp, mouse
gatggagagctacttcctac

SEQ ID NO: 588096 - DNA, 20 bp, mouse
gtgtgagtaagcaaactgga

SEQ ID NO: 588097 - DNA, 20 bp, mouse
gaactggagggctcacagat

SEQ ID NO: 588098 - DNA, 20 bp, mouse
gtgtagccaccagagagtca

SEQ ID NO: 588099 - DNA, 20 bp, mouse
gtcatggaaccagtacccaa

SEQ ID NO: 588100 - DNA, 20 bp, mouse
gctcctgtgagtaagcaaac

SEQ ID NO: 588101 - DNA, 20 bp, mouse
gagtctgtgacggtgcagga

SEQ ID NO: 588102 - DNA, 20 bp, mouse
gggtactcaatgaggtggca

SEQ ID NO: 588103 - DNA, 20 bp, mouse
gtgcttactcacaggagccc

SEQ ID NO: 588104 - DNA, 20 bp, mouse
gcgtacctatgacctctcta

SEQ ID NO: 588105 - DNA, 20 bp, mouse
gcatctgaccacctgttcat

SEQ ID NO: 588106 - DNA, 20 bp, mouse
gccaacgtaagaccgaacta

SEQ ID NO: 588107 - DNA, 20 bp, mouse
ggcggcccacggcattctag

SEQ ID NO: 588108 - DNA, 20 bp, mouse
gaagaccgaactagggccac

SEQ ID NO: 588109 - DNA, 20 bp, mouse
gtatgcgggtgagccggtga

SEQ ID NO: 588110 - DNA, 20 bp, mouse
gctgcccgctagaatgccgt

SEQ ID NO: 588111 - DNA, 20 bp, mouse
gcgggggcgaccgtaggcag

SEQ ID NO: 588112 - DNA, 20 bp, mouse
gaatgccgtgggccgcggga

SEQ ID NO: 588113 - DNA, 20 bp, mouse
gagagtggggtgggccgaca

SEQ ID NO: 588114 - DNA, 20 bp, mouse
gccggcgagccgtaccacgg

SEQ ID NO: 588115 - DNA, 20 bp, mouse
gaccgccgtcccgcggccca

SEQ ID NO: 588116 - DNA, 20 bp, mouse
gacatgcggcgaggcccggg

SEQ ID NO: 588117 - DNA, 20 bp, mouse
ggcggcggggcgctgacatg

SEQ ID NO: 588118 - DNA, 20 bp, mouse
ggcgccgacccgcaacaata

SEQ ID NO: 588119 - DNA, 20 bp, mouse
gcggcgcgaacggcgggcac

SEQ ID NO: 588120 - DNA, 20 bp, mouse
ggccgagcgggtggcatccc

SEQ ID NO: 588121 - DNA, 20 bp, mouse
gagcagagctagcagccgag

SEQ ID NO: 588122 - DNA, 20 bp, mouse
ggtcctgaggagccgagcgt

SEQ ID NO: 588123 - DNA, 20 bp, mouse
gcaggacaggctccacaacc

SEQ ID NO: 588124 - DNA, 20 bp, mouse
gacccgggatgccacccgct

SEQ ID NO: 588125 - DNA, 20 bp, mouse
gccctccgtgagcccgaccc

SEQ ID NO: 588126 - DNA, 20 bp, mouse
gcggcacggagcgggcagga

SEQ ID NO: 588127 - DNA, 20 bp, mouse
gcgaactggccggcaagaag

SEQ ID NO: 588128 - DNA, 20 bp, mouse
gggcaagaagcggcacggag

SEQ ID NO: 588129 - DNA, 20 bp, mouse
gtggcccccgctgcaggaca

SEQ ID NO: 588130 - DNA, 20 bp, mouse
gtgggccctgtggggcggga

SEQ ID NO: 588131 - DNA, 20 bp, mouse
ggagcgggcaggagggcgtc

SEQ ID NO: 588132 - DNA, 20 bp, mouse
ggggctctgggcgacggccg

SEQ ID NO: 588133 - DNA, 20 bp, mouse
gtcgagggcacgctgggcaa

SEQ ID NO: 588134 - DNA, 20 bp, mouse
gcgggcaggagggcgtcggg

SEQ ID NO: 588135 - DNA, 20 bp, mouse
gtgccgtggtgaagctgggg

SEQ ID NO: 588136 - DNA, 20 bp, mouse
gtcactgcacaacaagatgg

SEQ ID NO: 588137 - DNA, 20 bp, mouse
gcacaacaagatggcggcgg

SEQ ID NO: 588138 - DNA, 20 bp, mouse
ggtttcactgcacaacaaga

SEQ ID NO: 588139 - DNA, 20 bp, mouse
ggttgccgtggccggagcag

SEQ ID NO: 588140 - DNA, 20 bp, mouse
gtcgaccgcaccatcggcaa

SEQ ID NO: 588141 - DNA, 20 bp, mouse
gttgtgcagtgaaacctccg

SEQ ID NO: 588142 - DNA, 20 bp, mouse
ggacatcggagaggtcccca

SEQ ID NO: 588143 - DNA, 20 bp, mouse
gggtcgatggccgctcgcat

SEQ ID NO: 588144 - DNA, 20 bp, mouse
gacgagatcgaccgcaccat

SEQ ID NO: 588145 - DNA, 20 bp, mouse
gcagggacctcagagcggag

SEQ ID NO: 588146 - DNA, 20 bp, mouse
gcagctcatagtggccgagg

SEQ ID NO: 588147 - DNA, 20 bp, mouse
gtcgatcgtgcagctcatag

SEQ ID NO: 588148 - DNA, 20 bp, mouse
gaggtctgagcgaagcgcct

SEQ ID NO: 588149 - DNA, 20 bp, mouse
ggccgagccgcgcccagggg

SEQ ID NO: 588150 - DNA, 20 bp, mouse
gcggctgcgcgagcacgatg

SEQ ID NO: 588151 - DNA, 20 bp, mouse
ggcccgcagcgtccacccct

SEQ ID NO: 588152 - DNA, 20 bp, mouse
ggcgccgggcccgctagcct

SEQ ID NO: 588153 - DNA, 20 bp, mouse
ggtgcagctcatagtggccg

SEQ ID NO: 588154 - DNA, 20 bp, mouse
gagcgaagcgcctaggctag

SEQ ID NO: 588155 - DNA, 20 bp, mouse
gcgggcccggcgcgcctcct

SEQ ID NO: 588156 - DNA, 20 bp, mouse
ggctttccacggcagccgag

SEQ ID NO: 588157 - DNA, 20 bp, mouse
ggtgcgcaaacgccgtccag

SEQ ID NO: 588158 - DNA, 20 bp, mouse
gcaattccaggcggctgcag

SEQ ID NO: 588159 - DNA, 20 bp, mouse
gccccccacgccagaagagg

SEQ ID NO: 588160 - DNA, 20 bp, mouse
gggagggaggaggccgctaa

SEQ ID NO: 588161 - DNA, 20 bp, mouse
ggcgggacccggaacactgt

SEQ ID NO: 588162 - DNA, 20 bp, mouse
gcgaggcactgaggtggatg

SEQ ID NO: 588163 - DNA, 20 bp, mouse
ggtccaacagcaccctagac

SEQ ID NO: 588164 - DNA, 20 bp, mouse
gggaaagccgaaggtagggg

SEQ ID NO: 588165 - DNA, 20 bp, mouse
gacacaatccccacaattcc

SEQ ID NO: 588166 - DNA, 20 bp, mouse
ggctggttcacggcaaatcc

SEQ ID NO: 588167 - DNA, 20 bp, mouse
gaatgatggacagggcaatg

SEQ ID NO: 588168 - DNA, 20 bp, mouse
gtccgggaagacacgaatga

SEQ ID NO: 588169 - DNA, 20 bp, mouse
gaatgctgcccgaacgagga

SEQ ID NO: 588170 - DNA, 20 bp, mouse
gtttatacttagagtcccaa

SEQ ID NO: 588171 - DNA, 20 bp, mouse
gatactttcttgaaaacgtg

SEQ ID NO: 588172 - DNA, 20 bp, mouse
gagagtcccaaaggattgcc

SEQ ID NO: 588173 - DNA, 20 bp, mouse
gcaaatccgggcaatccttt

SEQ ID NO: 588174 - DNA, 20 bp, mouse
ggaagacacgaatgatggac

SEQ ID NO: 588175 - DNA, 20 bp, mouse
gtctttctccctcctcgttc

SEQ ID NO: 588176 - DNA, 20 bp, mouse
gaagccggaaccgccgggga

SEQ ID NO: 588177 - DNA, 20 bp, mouse
ggtcgtccggagcccgcgat

SEQ ID NO: 588178 - DNA, 20 bp, mouse
ggctccggacgaccggacta

SEQ ID NO: 588179 - DNA, 20 bp, mouse
ggtccggagcccgcgatcgg

SEQ ID NO: 588180 - DNA, 20 bp, mouse
ggctttcctgccctccccgg

SEQ ID NO: 588181 - DNA, 20 bp, mouse
ggcgccccgccaccgatcgc

SEQ ID NO: 588182 - DNA, 20 bp, mouse
gcggagcccgcgatcggtgg

SEQ ID NO: 588183 - DNA, 20 bp, mouse
ggagggccctcggaaggcaa

SEQ ID NO: 588184 - DNA, 20 bp, mouse
gggttccggcttccttagtc

SEQ ID NO: 588185 - DNA, 20 bp, mouse
gaaggaagccggaaccgccg

SEQ ID NO: 588186 - DNA, 20 bp, mouse
gcagcagctggaaccggagt

SEQ ID NO: 588187 - DNA, 20 bp, mouse
gtccatggctacgggcccgg

SEQ ID NO: 588188 - DNA, 20 bp, mouse
gaccggagtcggagtcgccg

SEQ ID NO: 588189 - DNA, 20 bp, mouse
gcaacgctgaggccccgagg

SEQ ID NO: 588190 - DNA, 20 bp, mouse
gcggcggagccacgcgcgag

SEQ ID NO: 588191 - DNA, 20 bp, mouse
gtcgcttcagcagctggaac

SEQ ID NO: 588192 - DNA, 20 bp, mouse
ggccacgcgcgagcggcgag

SEQ ID NO: 588193 - DNA, 20 bp, mouse
gcgccaaaggcgggaagaca

SEQ ID NO: 588194 - DNA, 20 bp, mouse
ggcgctgccccgccgaaccg

SEQ ID NO: 588195 - DNA, 20 bp, mouse
gtcccgtcgggcgtggcgag

SEQ ID NO: 588196 - DNA, 20 bp, mouse
ggcggtagaggcggcagaga

SEQ ID NO: 588197 - DNA, 20 bp, mouse
gcagcacggaggccccggaa

SEQ ID NO: 588198 - DNA, 20 bp, mouse
ggggagggaaactctaaggg

SEQ ID NO: 588199 - DNA, 20 bp, mouse
gagagtgggcgggatttccc

SEQ ID NO: 588200 - DNA, 20 bp, mouse
gggtaacagagaagcggccg

SEQ ID NO: 588201 - DNA, 20 bp, mouse
gaggcctgggtgcccagact

SEQ ID NO: 588202 - DNA, 20 bp, mouse
gagcctcgcacccagcacgg

SEQ ID NO: 588203 - DNA, 20 bp, mouse
gcacgccgggagcgacgcac

SEQ ID NO: 588204 - DNA, 20 bp, mouse
gtctgccgcctctaccgccg

SEQ ID NO: 588205 - DNA, 20 bp, mouse
gtcccgtgcgtggctgtggg

SEQ ID NO: 588206 - DNA, 20 bp, mouse
gcgaggagtcctgaatgaga

SEQ ID NO: 588207 - DNA, 20 bp, mouse
gatacctccggaaccaggcg

SEQ ID NO: 588208 - DNA, 20 bp, mouse
gggagtcccgcggttgaggt

SEQ ID NO: 588209 - DNA, 20 bp, mouse
gcccccaaaataccgaaatt

SEQ ID NO: 588210 - DNA, 20 bp, mouse
gaagcagggctggaacggtg

SEQ ID NO: 588211 - DNA, 20 bp, mouse
gccaagacagagctacgggg

SEQ ID NO: 588212 - DNA, 20 bp, mouse
gaaagccaatagatactggg

SEQ ID NO: 588213 - DNA, 20 bp, mouse
gcagctgtttaacatacctc

SEQ ID NO: 588214 - DNA, 20 bp, mouse
gccgcggttgaggtaggcta

SEQ ID NO: 588215 - DNA, 20 bp, mouse
gtccccaagacagagctacg

SEQ ID NO: 588216 - DNA, 20 bp, mouse
gccgcgggccggggattcgg

SEQ ID NO: 588217 - DNA, 20 bp, mouse
gacatggcgcatgcaggcag

SEQ ID NO: 588218 - DNA, 20 bp, mouse
gggagcccgaacgaccccag

SEQ ID NO: 588219 - DNA, 20 bp, mouse
ggcgggagccaccgaatccc

SEQ ID NO: 588220 - DNA, 20 bp, mouse
gcgaagaccgaaggattccg

SEQ ID NO: 588221 - DNA, 20 bp, mouse
gcaggcagcggaggctccgc

SEQ ID NO: 588222 - DNA, 20 bp, mouse
gctctgagaagtccgaggag

SEQ ID NO: 588223 - DNA, 20 bp, mouse
ggcgaccagggctcaggcgg

SEQ ID NO: 588224 - DNA, 20 bp, mouse
ggcccggctgcgcagagagg

SEQ ID NO: 588225 - DNA, 20 bp, mouse
ggattcggtggctcccgctg

SEQ ID NO: 588226 - DNA, 20 bp, mouse
gaccttggtgcggaaggcag

SEQ ID NO: 588227 - DNA, 20 bp, mouse
gaggcagcgggaccttggtg

SEQ ID NO: 588228 - DNA, 20 bp, mouse
ggcttgagcccgagaggtac

SEQ ID NO: 588229 - DNA, 20 bp, mouse
gtgagcccgagaggtactgg

SEQ ID NO: 588230 - DNA, 20 bp, mouse
gtggccagcttgagcccgag

SEQ ID NO: 588231 - DNA, 20 bp, mouse
gtgatcccgccagtacctct

SEQ ID NO: 588232 - DNA, 20 bp, mouse
gtactggcgggatcagggat

SEQ ID NO: 588233 - DNA, 20 bp, mouse
gagcgggaccttggtgcgga

SEQ ID NO: 588234 - DNA, 20 bp, mouse
gtgagcaggcagcgggacct

SEQ ID NO: 588235 - DNA, 20 bp, mouse
gtgggtatccagcccgaacc

SEQ ID NO: 588236 - DNA, 20 bp, mouse
gaggtcatatgtcattagtg

SEQ ID NO: 588237 - DNA, 20 bp, mouse
gtgtcttaagtctgtggcca

SEQ ID NO: 588238 - DNA, 20 bp, mouse
ggtgaatgccctgtgaaaag

SEQ ID NO: 588239 - DNA, 20 bp, mouse
gctgtagtggccagcagaat

SEQ ID NO: 588240 - DNA, 20 bp, mouse
gttactgtgttctggtgcca

SEQ ID NO: 588241 - DNA, 20 bp, mouse
gtggcaagccagttgtggac

SEQ ID NO: 588242 - DNA, 20 bp, mouse
gcgctgctgtcttaagtctg

SEQ ID NO: 588243 - DNA, 20 bp, mouse
gtttgtgttcgggatcaggg

SEQ ID NO: 588244 - DNA, 20 bp, mouse
ggtagcaatgttgcaaactt

SEQ ID NO: 588245 - DNA, 20 bp, mouse
gatctgggggctccatcccc

SEQ ID NO: 588246 - DNA, 20 bp, mouse
ggctgtgtgacgaccatgga

SEQ ID NO: 588247 - DNA, 20 bp, mouse
ggtgtgacgaccatggaggg

SEQ ID NO: 588248 - DNA, 20 bp, mouse
gtggtgtgagcctccctcca

SEQ ID NO: 588249 - DNA, 20 bp, mouse
gcagtgctgtgtgacgacca

SEQ ID NO: 588250 - DNA, 20 bp, mouse
gtggccctcacacccatctt

SEQ ID NO: 588251 - DNA, 20 bp, mouse
gagtgatccaaggccgtcac

SEQ ID NO: 588252 - DNA, 20 bp, mouse
gcactcatgtccacaggaac

SEQ ID NO: 588253 - DNA, 20 bp, mouse
gagcctgcatggttctggaa

SEQ ID NO: 588254 - DNA, 20 bp, mouse
ggacccttccagaaccatgc

SEQ ID NO: 588255 - DNA, 20 bp, mouse
gggcactgctggggtaccat

SEQ ID NO: 588256 - DNA, 20 bp, mouse
gcccgcgggctcctcgaccg

SEQ ID NO: 588257 - DNA, 20 bp, mouse
gcgcgccgtgctgaacgccg

SEQ ID NO: 588258 - DNA, 20 bp, mouse
gtcgaccgcggcgttcagca

SEQ ID NO: 588259 - DNA, 20 bp, mouse
ggagacgccgccagctccag

SEQ ID NO: 588260 - DNA, 20 bp, mouse
gcgcgaagcggcttggaagt

SEQ ID NO: 588261 - DNA, 20 bp, mouse
ggagtcccgccgggtatgga

SEQ ID NO: 588262 - DNA, 20 bp, mouse
gccagaccgcagctctatag

SEQ ID NO: 588263 - DNA, 20 bp, mouse
ggccacgtacctaggcgtac

SEQ ID NO: 588264 - DNA, 20 bp, mouse
gtgtgggcatcggctgtggg

SEQ ID NO: 588265 - DNA, 20 bp, mouse
gtaccggccacacgccccgc

SEQ ID NO: 588266 - DNA, 20 bp, mouse
gcccactggagtctaaggac

SEQ ID NO: 588267 - DNA, 20 bp, mouse
ggtgagaggccgagaccagg

SEQ ID NO: 588268 - DNA, 20 bp, mouse
gtcttgcccactggagtcta

SEQ ID NO: 588269 - DNA, 20 bp, mouse
ggcggcggcgcaggtccgag

SEQ ID NO: 588270 - DNA, 20 bp, mouse
gcgcagagccagaggcacgg

SEQ ID NO: 588271 - DNA, 20 bp, mouse
gcgcggctgcagagcaagga

SEQ ID NO: 588272 - DNA, 20 bp, mouse
ggagccaggcgcagagccag

SEQ ID NO: 588273 - DNA, 20 bp, mouse
gaagaggctgcccgcggcag

SEQ ID NO: 588274 - DNA, 20 bp, mouse
ggagcagcagcggccctagg

SEQ ID NO: 588275 - DNA, 20 bp, mouse
gtggagtctaaggactggcc

SEQ ID NO: 588276 - DNA, 20 bp, mouse
ggtaagagtagctctgagac

SEQ ID NO: 588277 - DNA, 20 bp, mouse
gggactaataataatccgca

SEQ ID NO: 588278 - DNA, 20 bp, mouse
gtaattacctgaactgtcac

SEQ ID NO: 588279 - DNA, 20 bp, mouse
gaggaactaaagctcactgg

SEQ ID NO: 588280 - DNA, 20 bp, mouse
gctcttaccattgaaagtaa

SEQ ID NO: 588281 - DNA, 20 bp, mouse
gggagatgatactattgttg

SEQ ID NO: 588282 - DNA, 20 bp, mouse
ggaaaaacctgacaacatac

SEQ ID NO: 588283 - DNA, 20 bp, mouse
gacctctcctgtgacagttc

SEQ ID NO: 588284 - DNA, 20 bp, mouse
gatggtgccagtatgttgtc

SEQ ID NO: 588285 - DNA, 20 bp, mouse
gggatatgtggaaaatatta

SEQ ID NO: 588286 - DNA, 20 bp, mouse
gaatggtaagggtagctctg

SEQ ID NO: 588287 - DNA, 20 bp, mouse
gatggtgccagtatgttctt

SEQ ID NO: 588288 - DNA, 20 bp, mouse
ggaaaaacctaagaacatac

SEQ ID NO: 588289 - DNA, 20 bp, mouse
gtgagacaatgtgacagttc

SEQ ID NO: 588290 - DNA, 20 bp, mouse
gggagattattctgtttttg

SEQ ID NO: 588291 - DNA, 20 bp, mouse
gtaagggtagctctgaggca

SEQ ID NO: 588292 - DNA, 20 bp, mouse
gtcctttgctttcaatggta

SEQ ID NO: 588293 - DNA, 20 bp, mouse
gggactaataataatctgca

SEQ ID NO: 588294 - DNA, 20 bp, mouse
gaggacactatgaggaatgt

SEQ ID NO: 588295 - DNA, 20 bp, mouse
gtcaacagcaggacactatg

SEQ ID NO: 588296 - DNA, 20 bp, mouse
gggactagtaataacctgca

SEQ ID NO: 588297 - DNA, 20 bp, mouse
ggtaagagtagctctgaagc

SEQ ID NO: 588298 - DNA, 20 bp, mouse
gaggacacagtgaggaatgt

SEQ ID NO: 588299 - DNA, 20 bp, mouse
gtcaacagcaggacacagtg

SEQ ID NO: 588300 - DNA, 20 bp, mouse
gatctgaactgtcacaggag

SEQ ID NO: 588301 - DNA, 20 bp, mouse
gtaattatctgaactgtcac

SEQ ID NO: 588302 - DNA, 20 bp, mouse
ggaaaaacctgacaacatac

SEQ ID NO: 588303 - DNA, 20 bp, mouse
gctcttaccattgaaagtaa

SEQ ID NO: 588304 - DNA, 20 bp, mouse
ggagagggtcatgaagagca

SEQ ID NO: 588305 - DNA, 20 bp, mouse
gatggtgccagtatgttgtc

SEQ ID NO: 588306 - DNA, 20 bp, mouse
gagcggagcagaggaggcga

SEQ ID NO: 588307 - DNA, 20 bp, mouse
ggcgtcgagcggagcagagg

SEQ ID NO: 588308 - DNA, 20 bp, mouse
gggagcagaggaggcgaggg

SEQ ID NO: 588309 - DNA, 20 bp, mouse
gggagggccagagaggcagt

SEQ ID NO: 588310 - DNA, 20 bp, mouse
ggccagtgccgcgcgtcgag

SEQ ID NO: 588311 - DNA, 20 bp, mouse
gcagaggaggcgagggcgga

SEQ ID NO: 588312 - DNA, 20 bp, mouse
gcagagaggcagttggaaga

SEQ ID NO: 588313 - DNA, 20 bp, mouse
gggggagccggcggcctgaa

SEQ ID NO: 588314 - DNA, 20 bp, mouse
gggcgagccgagcgcagcag

SEQ ID NO: 588315 - DNA, 20 bp, mouse
gtggaagatggcggacgagg

SEQ ID NO: 588316 - DNA, 20 bp, mouse
gcgactgctctgtcccgtga

SEQ ID NO: 588317 - DNA, 20 bp, mouse
gcagtcggtgacagtcccga

SEQ ID NO: 588318 - DNA, 20 bp, mouse
gcaacagggcccctaactca

SEQ ID NO: 588319 - DNA, 20 bp, mouse
gctcggccatgggaacgggg

SEQ ID NO: 588320 - DNA, 20 bp, mouse
ggggcccctaactcacggtc

SEQ ID NO: 588321 - DNA, 20 bp, mouse
gaagggagtgggattcggag

SEQ ID NO: 588322 - DNA, 20 bp, mouse
gctctgtcccgtgacggcag

SEQ ID NO: 588323 - DNA, 20 bp, mouse
gcccgagggtaggctcggtg

SEQ ID NO: 588324 - DNA, 20 bp, mouse
gtccggctcggccatgggaa

SEQ ID NO: 588325 - DNA, 20 bp, mouse
gcacggtccggctcggccat

SEQ ID NO: 588326 - DNA, 20 bp, mouse
ggggtccgggaggtgagcca

SEQ ID NO: 588327 - DNA, 20 bp, mouse
gtggccgcgctcagactgtg

SEQ ID NO: 588328 - DNA, 20 bp, mouse
gaggctacgtgaccagtcag

SEQ ID NO: 588329 - DNA, 20 bp, mouse
ggccacggcaggggagacac

SEQ ID NO: 588330 - DNA, 20 bp, mouse
ggggaggtgagccacggcag

SEQ ID NO: 588331 - DNA, 20 bp, mouse
gatgatgctctgcaggacga

SEQ ID NO: 588332 - DNA, 20 bp, mouse
gagagcatcatggcgctaag

SEQ ID NO: 588333 - DNA, 20 bp, mouse
gtcagtggctagctgtcccc

SEQ ID NO: 588334 - DNA, 20 bp, mouse
gctcgcagataggctatcag

SEQ ID NO: 588335 - DNA, 20 bp, mouse
gggatggcgcttgaccctct

SEQ ID NO: 588336 - DNA, 20 bp, mouse
ggaaggtaagtgttctgatc

SEQ ID NO: 588337 - DNA, 20 bp, mouse
gtgcggagctatcgagtgat

SEQ ID NO: 588338 - DNA, 20 bp, mouse
gtcagcgggaaaccttcagc

SEQ ID NO: 588339 - DNA, 20 bp, mouse
gacaattctcacccaacagt

SEQ ID NO: 588340 - DNA, 20 bp, mouse
gacgtagctgggaaatctca

SEQ ID NO: 588341 - DNA, 20 bp, mouse
gagtgttctgatccggctga

SEQ ID NO: 588342 - DNA, 20 bp, mouse
gtcctgagctcttcttggat

SEQ ID NO: 588343 - DNA, 20 bp, mouse
gtgttctcgaggggacaagg

SEQ ID NO: 588344 - DNA, 20 bp, mouse
gtacttagcgtccatcccag

SEQ ID NO: 588345 - DNA, 20 bp, mouse
gtacaactagaaaaccagac

SEQ ID NO: 588346 - DNA, 20 bp, mouse
ggacacgcacctgcaaaaag

SEQ ID NO: 588347 - DNA, 20 bp, mouse
gggagcagctgggcccggga

SEQ ID NO: 588348 - DNA, 20 bp, mouse
gagggcttggcaccaggacg

SEQ ID NO: 588349 - DNA, 20 bp, mouse
gaggcagtgaccggaaggaa

SEQ ID NO: 588350 - DNA, 20 bp, mouse
ggcgtgtctggcactggtgg

SEQ ID NO: 588351 - DNA, 20 bp, mouse
gacgcacctgcaaaaagcgg

SEQ ID NO: 588352 - DNA, 20 bp, mouse
gcaaaaagcggtggggaccg

SEQ ID NO: 588353 - DNA, 20 bp, mouse
ggcaggtgcgtgtctggcac

SEQ ID NO: 588354 - DNA, 20 bp, mouse
gaccggaaggaagggcactt

SEQ ID NO: 588355 - DNA, 20 bp, mouse
ggcgtaggagtgaaacctag

SEQ ID NO: 588356 - DNA, 20 bp, mouse
ggcggaagcggcctcaacaa

SEQ ID NO: 588357 - DNA, 20 bp, mouse
ggcagcgccggcgacgatgt

SEQ ID NO: 588358 - DNA, 20 bp, mouse
gacactgcagctctcacctc

SEQ ID NO: 588359 - DNA, 20 bp, mouse
gtgtcgccttacgcggataa

SEQ ID NO: 588360 - DNA, 20 bp, mouse
gcgcggataagggcaagtgc

SEQ ID NO: 588361 - DNA, 20 bp, mouse
ggtcgccggcgctgccgcac

SEQ ID NO: 588362 - DNA, 20 bp, mouse
gtagagtctagacaatggga

SEQ ID NO: 588363 - DNA, 20 bp, mouse
gtgttcccgtgcggcagcgc

SEQ ID NO: 588364 - DNA, 20 bp, mouse
ggtcggtgaattatgcagca

SEQ ID NO: 588365 - DNA, 20 bp, mouse
gacaatgggagggacttccc

SEQ ID NO: 588366 - DNA, 20 bp, mouse
ggagcgatggcagccggtgg

SEQ ID NO: 588367 - DNA, 20 bp, mouse
gaaggagcgatggcagccgg

SEQ ID NO: 588368 - DNA, 20 bp, mouse
ggagcggctcagaccgccac

SEQ ID NO: 588369 - DNA, 20 bp, mouse
gcagagcgcagcgcggagga

SEQ ID NO: 588370 - DNA, 20 bp, mouse
gtcaggatgcgtgacaccta

SEQ ID NO: 588371 - DNA, 20 bp, mouse
ggtgtcacgcatcctgagga

SEQ ID NO: 588372 - DNA, 20 bp, mouse
gggagcgcaaagctgctgag

SEQ ID NO: 588373 - DNA, 20 bp, mouse
gaagccggaagcgcagtcaa

SEQ ID NO: 588374 - DNA, 20 bp, mouse
gagcgcagtcaaaggagcga

SEQ ID NO: 588375 - DNA, 20 bp, mouse
gctcaagcgccgccaggagg

SEQ ID NO: 588376 - DNA, 20 bp, mouse
gtactacaggctatgagcta

SEQ ID NO: 588377 - DNA, 20 bp, mouse
ggctgtgttgtgctggagtt

SEQ ID NO: 588378 - DNA, 20 bp, mouse
gagtatgctccttcttctaa

SEQ ID NO: 588379 - DNA, 20 bp, mouse
gatgatcataattacatact

SEQ ID NO: 588380 - DNA, 20 bp, mouse
gtgatcagagaaaattgctc

SEQ ID NO: 588381 - DNA, 20 bp, mouse
gccaagattagatttctatt

SEQ ID NO: 588382 - DNA, 20 bp, mouse
gtagaaatctaatcttggct

SEQ ID NO: 588383 - DNA, 20 bp, mouse
gacaacacagcagatactac

SEQ ID NO: 588384 - DNA, 20 bp, mouse
ggttgtgctggagttgggca

SEQ ID NO: 588385 - DNA, 20 bp, mouse
gtgagctaaggtaagtcttt

SEQ ID NO: 588386 - DNA, 20 bp, mouse
gggagacattcgggttgtgg

SEQ ID NO: 588387 - DNA, 20 bp, mouse
gaagctgtcaggccataagt

SEQ ID NO: 588388 - DNA, 20 bp, mouse
ggctgtggaggccaggttta

SEQ ID NO: 588389 - DNA, 20 bp, mouse
gactttgacactgtcagtgt

SEQ ID NO: 588390 - DNA, 20 bp, mouse
gggcggggcagggactcctg

SEQ ID NO: 588391 - DNA, 20 bp, mouse
ggccgggatcagatagaaca

SEQ ID NO: 588392 - DNA, 20 bp, mouse
gccaggtttaaggagacatt

SEQ ID NO: 588393 - DNA, 20 bp, mouse
gcttatggaggggatccctg

SEQ ID NO: 588394 - DNA, 20 bp, mouse
gcaggggtcagtcctactta

SEQ ID NO: 588395 - DNA, 20 bp, mouse
gaagttgctggtttccggag

SEQ ID NO: 588396 - DNA, 20 bp, mouse
ggcgtcccgagcgctcacgg

SEQ ID NO: 588397 - DNA, 20 bp, mouse
ggcagggcagcgggagaccg

SEQ ID NO: 588398 - DNA, 20 bp, mouse
ggcgtagcgcgctctaccca

SEQ ID NO: 588399 - DNA, 20 bp, mouse
gcggaggcccgagccgacga

SEQ ID NO: 588400 - DNA, 20 bp, mouse
gggtgagtgtggacttccgt

SEQ ID NO: 588401 - DNA, 20 bp, mouse
gggacccgagtgctgccgag

SEQ ID NO: 588402 - DNA, 20 bp, mouse
gagcgctcgggacgctcccg

SEQ ID NO: 588403 - DNA, 20 bp, mouse
gctcccggagaaatccgagt

SEQ ID NO: 588404 - DNA, 20 bp, mouse
ggcatccaccgtgagcgctc

SEQ ID NO: 588405 - DNA, 20 bp, mouse
gtaggccggagaaaggctgg

SEQ ID NO: 588406 - DNA, 20 bp, mouse
gaccagcagcatccacccgg

SEQ ID NO: 588407 - DNA, 20 bp, mouse
ggggtgagctagactccgag

SEQ ID NO: 588408 - DNA, 20 bp, mouse
ggctcccgcctgccgccggg

SEQ ID NO: 588409 - DNA, 20 bp, mouse
gccgcgccaaggctagggag

SEQ ID NO: 588410 - DNA, 20 bp, mouse
gtggatgctgctggttgccg

SEQ ID NO: 588411 - DNA, 20 bp, mouse
gcggcaggcgggagccagcg

SEQ ID NO: 588412 - DNA, 20 bp, mouse
gtgctgcctaggataagaag

SEQ ID NO: 588413 - DNA, 20 bp, mouse
ggcgttctctacagccttct

SEQ ID NO: 588414 - DNA, 20 bp, mouse
gcatccacccggcggcaggc

SEQ ID NO: 588415 - DNA, 20 bp, mouse
ggcacgggcccgggcgcacg

SEQ ID NO: 588416 - DNA, 20 bp, mouse
ggcaagcgagctagacggga

SEQ ID NO: 588417 - DNA, 20 bp, mouse
gcgaggagccggcgagcgag

SEQ ID NO: 588418 - DNA, 20 bp, mouse
gcaagcccggaggccgcccg

SEQ ID NO: 588419 - DNA, 20 bp, mouse
gcgcccgcgcccaagcccgg

SEQ ID NO: 588420 - DNA, 20 bp, mouse
ggggcgcggagcatgcggag

SEQ ID NO: 588421 - DNA, 20 bp, mouse
gcctgcgtgaagccgaaggt

SEQ ID NO: 588422 - DNA, 20 bp, mouse
ggcgcttcgcggccccgcat

SEQ ID NO: 588423 - DNA, 20 bp, mouse
ggcagggcggcaacatcgag

SEQ ID NO: 588424 - DNA, 20 bp, mouse
ggtgggcagcatggacatgg

SEQ ID NO: 588425 - DNA, 20 bp, mouse
ggcatgcggagcggcgcccc

SEQ ID NO: 588426 - DNA, 20 bp, mouse
ggcgagcccgaggcagagag

SEQ ID NO: 588427 - DNA, 20 bp, mouse
ggaatcgctgaatcttgact

SEQ ID NO: 588428 - DNA, 20 bp, mouse
gatcttgactcggccgtggt

SEQ ID NO: 588429 - DNA, 20 bp, mouse
ggtcattagggcgattgctg

SEQ ID NO: 588430 - DNA, 20 bp, mouse
gatttaggggagatattatg

SEQ ID NO: 588431 - DNA, 20 bp, mouse
gtaccatggactgacctgag

SEQ ID NO: 588432 - DNA, 20 bp, mouse
gctgaatcttgactcggccg

SEQ ID NO: 588433 - DNA, 20 bp, mouse
gggaggaatagagatctagg

SEQ ID NO: 588434 - DNA, 20 bp, mouse
gcgccagaagtagggagcag

SEQ ID NO: 588435 - DNA, 20 bp, mouse
gctcctctcaggtcagtcca

SEQ ID NO: 588436 - DNA, 20 bp, mouse
gtatagtatgcagcaaccgg

SEQ ID NO: 588437 - DNA, 20 bp, mouse
gaggagtcacgttgggggaa

SEQ ID NO: 588438 - DNA, 20 bp, mouse
gcaaccggaggagtcacgtt

SEQ ID NO: 588439 - DNA, 20 bp, mouse
gtagagcaaagtagtgtaaa

SEQ ID NO: 588440 - DNA, 20 bp, mouse
gcaggaggcgcaccgagaag

SEQ ID NO: 588441 - DNA, 20 bp, mouse
gagcgcctcggaaggacagg

SEQ ID NO: 588442 - DNA, 20 bp, mouse
gtcctcccggcttaccctgg

SEQ ID NO: 588443 - DNA, 20 bp, mouse
gtggtgactgcgtggcctgg

SEQ ID NO: 588444 - DNA, 20 bp, mouse
ggcctccagggtaagccggg

SEQ ID NO: 588445 - DNA, 20 bp, mouse
ggatccagccgaaaccggga

SEQ ID NO: 588446 - DNA, 20 bp, mouse
gaacatggctacctcgcctg

SEQ ID NO: 588447 - DNA, 20 bp, mouse
ggcgagaagcgaaggccagt

SEQ ID NO: 588448 - DNA, 20 bp, mouse
gccagtgggcacctcggtca

SEQ ID NO: 588449 - DNA, 20 bp, mouse
ggcgctcggctccgcaggcg

SEQ ID NO: 588450 - DNA, 20 bp, mouse
gactctgcaggcagccgagg

SEQ ID NO: 588451 - DNA, 20 bp, mouse
gccccgctggaaggccacta

SEQ ID NO: 588452 - DNA, 20 bp, mouse
ggggcagcgcgcccaggaag

SEQ ID NO: 588453 - DNA, 20 bp, mouse
gggagaccccgggccactcg

SEQ ID NO: 588454 - DNA, 20 bp, mouse
gccccgggagaccgtgaccg

SEQ ID NO: 588455 - DNA, 20 bp, mouse
gctgttcgggcgagaagcga

SEQ ID NO: 588456 - DNA, 20 bp, mouse
gaatccgcccaccccagtag

SEQ ID NO: 588457 - DNA, 20 bp, mouse
gttcccgcctggaagagctg

SEQ ID NO: 588458 - DNA, 20 bp, mouse
gaccgtgccgctactggggt

SEQ ID NO: 588459 - DNA, 20 bp, mouse
gggccacgggcagcgaccat

SEQ ID NO: 588460 - DNA, 20 bp, mouse
gtgggggttacagagtcggg

SEQ ID NO: 588461 - DNA, 20 bp, mouse
gagtagcggcacggtctagc

SEQ ID NO: 588462 - DNA, 20 bp, mouse
gcgaccataggaagcgacct

SEQ ID NO: 588463 - DNA, 20 bp, mouse
gcccaacccacagctcttcc

SEQ ID NO: 588464 - DNA, 20 bp, mouse
gctcgaagcgcattaccagg

SEQ ID NO: 588465 - DNA, 20 bp, mouse
ggcccaccccagtagcggca

SEQ ID NO: 588466 - DNA, 20 bp, mouse
gtgcgcggccgcggatccgg

SEQ ID NO: 588467 - DNA, 20 bp, mouse
ggagcgaagagcctgcgcta

SEQ ID NO: 588468 - DNA, 20 bp, mouse
gcggccgcgcaggcgcacaa

SEQ ID NO: 588469 - DNA, 20 bp, mouse
gcggcgggctgtttgaattt

SEQ ID NO: 588470 - DNA, 20 bp, mouse
gaaacagcccgccggatccg

SEQ ID NO: 588471 - DNA, 20 bp, mouse
ggcctgcgcggccgcggatc

SEQ ID NO: 588472 - DNA, 20 bp, mouse
gggctctggaagctggcgtc

SEQ ID NO: 588473 - DNA, 20 bp, mouse
ggctccgaagccgcccgaag

SEQ ID NO: 588474 - DNA, 20 bp, mouse
ggcgcaggctggaacgggga

SEQ ID NO: 588475 - DNA, 20 bp, mouse
gaacagcgcagactccgcta

SEQ ID NO: 588476 - DNA, 20 bp, mouse
gagctggaactgatggtgag

SEQ ID NO: 588477 - DNA, 20 bp, mouse
gaggcggcggtagctcccgt

SEQ ID NO: 588478 - DNA, 20 bp, mouse
gagagtgaaggaaacctact

SEQ ID NO: 588479 - DNA, 20 bp, mouse
gtcaccttctaggccatcgg

SEQ ID NO: 588480 - DNA, 20 bp, mouse
gggcggttaagagaccaagg

SEQ ID NO: 588481 - DNA, 20 bp, mouse
gcgcggcggttaagagacca

SEQ ID NO: 588482 - DNA, 20 bp, mouse
gggttaagagaccaaggcgg

SEQ ID NO: 588483 - DNA, 20 bp, mouse
gtacagcttaagcgcctcag

SEQ ID NO: 588484 - DNA, 20 bp, mouse
ggaggcggaggtcgataagc

SEQ ID NO: 588485 - DNA, 20 bp, mouse
ggacattcctcagaccgctg

SEQ ID NO: 588486 - DNA, 20 bp, mouse
gaggtcagcagtcggctcgg

SEQ ID NO: 588487 - DNA, 20 bp, mouse
gtggaggtcagcagtcggct

SEQ ID NO: 588488 - DNA, 20 bp, mouse
ggttcgttcgaggggactgg

SEQ ID NO: 588489 - DNA, 20 bp, mouse
gcagaccccgcagcttacag

SEQ ID NO: 588490 - DNA, 20 bp, mouse
gtacagtggaaactctggat

SEQ ID NO: 588491 - DNA, 20 bp, mouse
ggggactggaggtcagcagt

SEQ ID NO: 588492 - DNA, 20 bp, mouse
gtgtagcgcgttcgttcgag

SEQ ID NO: 588493 - DNA, 20 bp, mouse
gtggatggggttcatgctga

SEQ ID NO: 588494 - DNA, 20 bp, mouse
gcgcgttcgttcgaggggac

SEQ ID NO: 588495 - DNA, 20 bp, mouse
gcgctggacggcgaggacag

SEQ ID NO: 588496 - DNA, 20 bp, mouse
ggcagcagaaggcgggataa

SEQ ID NO: 588497 - DNA, 20 bp, mouse
gagtgggcggccgcagcaga

SEQ ID NO: 588498 - DNA, 20 bp, mouse
gggcggccgcagcagaaggc

SEQ ID NO: 588499 - DNA, 20 bp, mouse
gggacgtgtgcctgctcgga

SEQ ID NO: 588500 - DNA, 20 bp, mouse
ggccgaggtacaggtgcctg

SEQ ID NO: 588501 - DNA, 20 bp, mouse
gatttggcgaagcgagtggg

SEQ ID NO: 588502 - DNA, 20 bp, mouse
gtgcatttggcgaagcgagt

SEQ ID NO: 588503 - DNA, 20 bp, mouse
gcaggcgacagccgaggtac

SEQ ID NO: 588504 - DNA, 20 bp, mouse
gctgcgcccgccgtccgagc

SEQ ID NO: 588505 - DNA, 20 bp, mouse
ggaagcctggaacttatagt

SEQ ID NO: 588506 - DNA, 20 bp, mouse
gggtccgagtaagcaccgag

SEQ ID NO: 588507 - DNA, 20 bp, mouse
ggagctagtgacttccttgt

SEQ ID NO: 588508 - DNA, 20 bp, mouse
gtcactagctctccagccag

SEQ ID NO: 588509 - DNA, 20 bp, mouse
gccgtccgagactgccaaca

SEQ ID NO: 588510 - DNA, 20 bp, mouse
ggaggctacgactccggaca

SEQ ID NO: 588511 - DNA, 20 bp, mouse
gcaccgagaggctacgactc

SEQ ID NO: 588512 - DNA, 20 bp, mouse
gcggggacggcgagccgaca

SEQ ID NO: 588513 - DNA, 20 bp, mouse
gacttccttgttggcagtct

SEQ ID NO: 588514 - DNA, 20 bp, mouse
gggacctagactcgcaatag

SEQ ID NO: 588515 - DNA, 20 bp, mouse
gcccggcgtccagcgaccgc

SEQ ID NO: 588516 - DNA, 20 bp, mouse
gccgcggcctcagagcgccg

SEQ ID NO: 588517 - DNA, 20 bp, mouse
gcggcctcagagcgccgcgg

SEQ ID NO: 588518 - DNA, 20 bp, mouse
gcgcgcggctcccgggacgg

SEQ ID NO: 588519 - DNA, 20 bp, mouse
gcactgggcgcacatctttc

SEQ ID NO: 588520 - DNA, 20 bp, mouse
gccgagccggagcgagccgc

SEQ ID NO: 588521 - DNA, 20 bp, mouse
ggcgcaggaggcctacaaga

SEQ ID NO: 588522 - DNA, 20 bp, mouse
gcccgctcggctcgtcccgg

SEQ ID NO: 588523 - DNA, 20 bp, mouse
ggcgcccgctcggctcgtcc

SEQ ID NO: 588524 - DNA, 20 bp, mouse
gtctttccggcggctcgctc

SEQ ID NO: 588525 - DNA, 20 bp, mouse
gctctgaggccgcgggccag

SEQ ID NO: 588526 - DNA, 20 bp, mouse
gcattggagcactatgataa

SEQ ID NO: 588527 - DNA, 20 bp, mouse
gttgtagctaaagcagcggc

SEQ ID NO: 588528 - DNA, 20 bp, mouse
gagacacacgcagcatctgg

SEQ ID NO: 588529 - DNA, 20 bp, mouse
gcatagtgctccaatggaga

SEQ ID NO: 588530 - DNA, 20 bp, mouse
gacactggcagagctgaaac

SEQ ID NO: 588531 - DNA, 20 bp, mouse
gctctaggcgaattactggg

SEQ ID NO: 588532 - DNA, 20 bp, mouse
gagagtgaagtgagctcgtc

SEQ ID NO: 588533 - DNA, 20 bp, mouse
gtcgatgcggatcagtacct

SEQ ID NO: 588534 - DNA, 20 bp, mouse
gtggcagagctgaaaccgga

SEQ ID NO: 588535 - DNA, 20 bp, mouse
gttggtctgagtcctcgatg

SEQ ID NO: 588536 - DNA, 20 bp, mouse
gagcggcgccggcacagcga

SEQ ID NO: 588537 - DNA, 20 bp, mouse
gggcgccggcacagcgaagg

SEQ ID NO: 588538 - DNA, 20 bp, mouse
ggaaggcggctggcgagcga

SEQ ID NO: 588539 - DNA, 20 bp, mouse
gatgtgtgtggggttcggag

SEQ ID NO: 588540 - DNA, 20 bp, mouse
ggcgggccgggtgacgtcag

SEQ ID NO: 588541 - DNA, 20 bp, mouse
ggcgacggcgggcacaggtg

SEQ ID NO: 588542 - DNA, 20 bp, mouse
gggctggcgagcgacggcga

SEQ ID NO: 588543 - DNA, 20 bp, mouse
gcccgggcggccggagacgg

SEQ ID NO: 588544 - DNA, 20 bp, mouse
gtgagccgtggcacccacag

SEQ ID NO: 588545 - DNA, 20 bp, mouse
ggcgaggcctgtacacccgt

SEQ ID NO: 588546 - DNA, 20 bp, mouse
ggagctgacccaggatcccc

SEQ ID NO: 588547 - DNA, 20 bp, mouse
gtatctctacagaaacaaaa

SEQ ID NO: 588548 - DNA, 20 bp, mouse
ggacatctaggtgatctaac

SEQ ID NO: 588549 - DNA, 20 bp, mouse
gtacttggacctggggatcc

SEQ ID NO: 588550 - DNA, 20 bp, mouse
gaaaaacactgcagacatct

SEQ ID NO: 588551 - DNA, 20 bp, mouse
gtctcacttacttggacctg

SEQ ID NO: 588552 - DNA, 20 bp, mouse
gtggcaggaaggataaagtg

SEQ ID NO: 588553 - DNA, 20 bp, mouse
gtgagatattgtgagtgagg

SEQ ID NO: 588554 - DNA, 20 bp, mouse
gagtgaggaaacaagttcat

SEQ ID NO: 588555 - DNA, 20 bp, mouse
gttccatgaagcataggaag

SEQ ID NO: 588556 - DNA, 20 bp, mouse
gttaattactcaccaaaatg

SEQ ID NO: 588557 - DNA, 20 bp, mouse
gctgtgtgcaaagaaaggaa

SEQ ID NO: 588558 - DNA, 20 bp, mouse
gcatttcacagttaatacag

SEQ ID NO: 588559 - DNA, 20 bp, mouse
gagagagttcgaaaaaatca

SEQ ID NO: 588560 - DNA, 20 bp, mouse
gcactggcatccaggatctt

SEQ ID NO: 588561 - DNA, 20 bp, mouse
gtcattggacaatacacagt

SEQ ID NO: 588562 - DNA, 20 bp, mouse
ggataacatgttgcacctga

SEQ ID NO: 588563 - DNA, 20 bp, mouse
gggtttagtttggaccatgt

SEQ ID NO: 588564 - DNA, 20 bp, mouse
gatttgaaaactactttcat

SEQ ID NO: 588565 - DNA, 20 bp, mouse
gcaatctgataattatagaa

SEQ ID NO: 588566 - DNA, 20 bp, mouse
ggttctcagagacaattctg

SEQ ID NO: 588567 - DNA, 20 bp, mouse
ggcattggttaaactacatt

SEQ ID NO: 588568 - DNA, 20 bp, mouse
ggtaggagccaatgtatagt

SEQ ID NO: 588569 - DNA, 20 bp, mouse
gatacattggctcctactgt

SEQ ID NO: 588570 - DNA, 20 bp, mouse
gagatgctggatgccagtgg

SEQ ID NO: 588571 - DNA, 20 bp, mouse
gcatttgacagttagttcag

SEQ ID NO: 588572 - DNA, 20 bp, mouse
gtcatgctgacattttgcat

SEQ ID NO: 588573 - DNA, 20 bp, mouse
gtagttttcctactatacat

SEQ ID NO: 588574 - DNA, 20 bp, mouse
gctaatgtaaacagaacact

SEQ ID NO: 588575 - DNA, 20 bp, mouse
gaacaagagtagttttctaa

SEQ ID NO: 588576 - DNA, 20 bp, mouse
gcctggaagagagacctgta

SEQ ID NO: 588577 - DNA, 20 bp, mouse
gactttcaggttaggagtag

SEQ ID NO: 588578 - DNA, 20 bp, mouse
gtaaacatgtcagagttaga

SEQ ID NO: 588579 - DNA, 20 bp, mouse
gatcttgggtctcagaagga

SEQ ID NO: 588580 - DNA, 20 bp, mouse
ggtggccagactttcaggtt

SEQ ID NO: 588581 - DNA, 20 bp, mouse
gatacaatattcctcccagg

SEQ ID NO: 588582 - DNA, 20 bp, mouse
gagccctgtaggaagttccc

SEQ ID NO: 588583 - DNA, 20 bp, mouse
gttctagagggaatttccta

SEQ ID NO: 588584 - DNA, 20 bp, mouse
gggacaacagagaactgttg

SEQ ID NO: 588585 - DNA, 20 bp, mouse
gtttagaaaaaccataggat

SEQ ID NO: 588586 - DNA, 20 bp, mouse
gcgcgatagagagctgactt

SEQ ID NO: 588587 - DNA, 20 bp, mouse
gatccatctcaggtaagtga

SEQ ID NO: 588588 - DNA, 20 bp, mouse
gtcaggtaagtgagggaatt

SEQ ID NO: 588589 - DNA, 20 bp, mouse
gtatggcttcaagaaaactg

SEQ ID NO: 588590 - DNA, 20 bp, mouse
gcacaagtctcactagtatg

SEQ ID NO: 588591 - DNA, 20 bp, mouse
ggcactaaaaagatattcca

SEQ ID NO: 588592 - DNA, 20 bp, mouse
ggacaaagtattgtcttctt

SEQ ID NO: 588593 - DNA, 20 bp, mouse
gtaaagattagtaaatcttg

SEQ ID NO: 588594 - DNA, 20 bp, mouse
gatacaagaaagaagttctt

SEQ ID NO: 588595 - DNA, 20 bp, mouse
gataactctgatatacttta

SEQ ID NO: 588596 - DNA, 20 bp, mouse
gtgctagtgcatgagctcgt

SEQ ID NO: 588597 - DNA, 20 bp, mouse
gagctcgtgggcttgtagac

SEQ ID NO: 588598 - DNA, 20 bp, mouse
ggcttcgctaaacaacctga

SEQ ID NO: 588599 - DNA, 20 bp, mouse
ggtgatctgggtgtgtatga

SEQ ID NO: 588600 - DNA, 20 bp, mouse
ggtatgatggttggagacaa

SEQ ID NO: 588601 - DNA, 20 bp, mouse
gtacagagtgattatatgtt

SEQ ID NO: 588602 - DNA, 20 bp, mouse
gagtatcgtttctgatctag

SEQ ID NO: 588603 - DNA, 20 bp, mouse
gtgtttgttcctgaatctca

SEQ ID NO: 588604 - DNA, 20 bp, mouse
gcctgaatctcagggcataa

SEQ ID NO: 588605 - DNA, 20 bp, mouse
gggagctcaagtaagtgatc

SEQ ID NO: 588606 - DNA, 20 bp, mouse
gggacagtattcctctcagt

SEQ ID NO: 588607 - DNA, 20 bp, mouse
ggattagtagttcagataga

SEQ ID NO: 588608 - DNA, 20 bp, mouse
ggagttaaggacttttagtg

SEQ ID NO: 588609 - DNA, 20 bp, mouse
gaacagttgctacttttaca

SEQ ID NO: 588610 - DNA, 20 bp, mouse
gattacaattaaacacaaga

SEQ ID NO: 588611 - DNA, 20 bp, mouse
gcttccttgtgcctactgag

SEQ ID NO: 588612 - DNA, 20 bp, mouse
gcaattaaacacaagaggga

SEQ ID NO: 588613 - DNA, 20 bp, mouse
gttagtaagcttttagactt

SEQ ID NO: 588614 - DNA, 20 bp, mouse
gtttctttacccttatataa

SEQ ID NO: 588615 - DNA, 20 bp, mouse
gatgtatttcccttatataa

SEQ ID NO: 588616 - DNA, 20 bp, mouse
ggagctgacttaggatcaac

SEQ ID NO: 588617 - DNA, 20 bp, mouse
gcacaactgctacttttata

SEQ ID NO: 588618 - DNA, 20 bp, mouse
gggacagtattcttcccagt

SEQ ID NO: 588619 - DNA, 20 bp, mouse
gcagagtcagatagagatcg

SEQ ID NO: 588620 - DNA, 20 bp, mouse
gcccttagaaatacattaca

SEQ ID NO: 588621 - DNA, 20 bp, mouse
gatgtattgcccttatatca

SEQ ID NO: 588622 - DNA, 20 bp, mouse
gttggttgatctcatgggac

SEQ ID NO: 588623 - DNA, 20 bp, mouse
gatttcagagttcagataga

SEQ ID NO: 588624 - DNA, 20 bp, mouse
gttagtaagcttttaggata

SEQ ID NO: 588625 - DNA, 20 bp, mouse
ggagaacttagtaagctttt

SEQ ID NO: 588626 - DNA, 20 bp, mouse
gagggtgataaatatctccc

SEQ ID NO: 588627 - DNA, 20 bp, mouse
gagctcaagtaagtgatctg

SEQ ID NO: 588628 - DNA, 20 bp, mouse
gcaaatacactgagaaaact

SEQ ID NO: 588629 - DNA, 20 bp, mouse
gtgatgatactcatccatag

SEQ ID NO: 588630 - DNA, 20 bp, mouse
ggtgtatttgagaataacaa

SEQ ID NO: 588631 - DNA, 20 bp, mouse
ggtgataaatatctccctgg

SEQ ID NO: 588632 - DNA, 20 bp, mouse
gcctggtccttctgtgcctg

SEQ ID NO: 588633 - DNA, 20 bp, mouse
ggctttgctgaactacccac

SEQ ID NO: 588634 - DNA, 20 bp, mouse
gtctgagctagaggaggtgt

SEQ ID NO: 588635 - DNA, 20 bp, mouse
gaccaactctgagctagagg

SEQ ID NO: 588636 - DNA, 20 bp, mouse
ggaactacctacaggcacag

SEQ ID NO: 588637 - DNA, 20 bp, mouse
gctaactggaaacacctcct

SEQ ID NO: 588638 - DNA, 20 bp, mouse
gtgatgatactcatccaagg

SEQ ID NO: 588639 - DNA, 20 bp, mouse
gtctgttcaccgaaaagact

SEQ ID NO: 588640 - DNA, 20 bp, mouse
gacagagggttttcgaagcc

SEQ ID NO: 588641 - DNA, 20 bp, mouse
gagaaagctcctagtctttt

SEQ ID NO: 588642 - DNA, 20 bp, mouse
ggaaaaccctctgtgcctgt

SEQ ID NO: 588643 - DNA, 20 bp, mouse
ggaggtgtttccagttagtg

SEQ ID NO: 588644 - DNA, 20 bp, mouse
gaactgtaagttatatagta

SEQ ID NO: 588645 - DNA, 20 bp, mouse
gatgacaaatatcaccctgg

SEQ ID NO: 588646 - DNA, 20 bp, mouse
ggttctcagaaacaataacc

SEQ ID NO: 588647 - DNA, 20 bp, mouse
gcacagtagcattggcttcc

SEQ ID NO: 588648 - DNA, 20 bp, mouse
gttcttagataatacacagt

SEQ ID NO: 588649 - DNA, 20 bp, mouse
gagagaaggcaacatacatt

SEQ ID NO: 588650 - DNA, 20 bp, mouse
gcatttcacacttagttctg

SEQ ID NO: 588651 - DNA, 20 bp, mouse
gttgtttcaccactgacatt

SEQ ID NO: 588652 - DNA, 20 bp, mouse
ggagtctggtttaaacattt

SEQ ID NO: 588653 - DNA, 20 bp, mouse
gttaaacattttgggccatg

SEQ ID NO: 588654 - DNA, 20 bp, mouse
gtgagaacaaggaggaagca

SEQ ID NO: 588655 - DNA, 20 bp, mouse
gattgtttctgagaacaagg

SEQ ID NO: 588656 - DNA, 20 bp, mouse
gtgatggagacggagcgact

SEQ ID NO: 588657 - DNA, 20 bp, mouse
gagacggagcgactcggtga

SEQ ID NO: 588658 - DNA, 20 bp, mouse
gggaggagagtggacgggag

SEQ ID NO: 588659 - DNA, 20 bp, mouse
gggctgctcgggagctgccg

SEQ ID NO: 588660 - DNA, 20 bp, mouse
ggtaagttcaggggatctag

SEQ ID NO: 588661 - DNA, 20 bp, mouse
ggcgctatctgggcaaccag

SEQ ID NO: 588662 - DNA, 20 bp, mouse
gccacttccagagctcgaag

SEQ ID NO: 588663 - DNA, 20 bp, mouse
gtccgggctgaggtacccca

SEQ ID NO: 588664 - DNA, 20 bp, mouse
gagcgactcggtgaggggga

SEQ ID NO: 588665 - DNA, 20 bp, mouse
gctcgaaggggtaagttcag

SEQ ID NO: 588666 - DNA, 20 bp, mouse
ggtcgcggggcctcttgggt

SEQ ID NO: 588667 - DNA, 20 bp, mouse
gtcagagttccgaaagatgg

SEQ ID NO: 588668 - DNA, 20 bp, mouse
gtacggtcgcggggcctctt

SEQ ID NO: 588669 - DNA, 20 bp, mouse
gctcgctcccgggagccgag

SEQ ID NO: 588670 - DNA, 20 bp, mouse
gtcggcgtcactgtagggta

SEQ ID NO: 588671 - DNA, 20 bp, mouse
gaggaaacacgactcagacg

SEQ ID NO: 588672 - DNA, 20 bp, mouse
gagaggctaaggagattgag

SEQ ID NO: 588673 - DNA, 20 bp, mouse
ggcctaaggaagccacgctg

SEQ ID NO: 588674 - DNA, 20 bp, mouse
gcccattcggcgtcactgta

SEQ ID NO: 588675 - DNA, 20 bp, mouse
gaagatggcggatgctttcg

SEQ ID NO: 588676 - DNA, 20 bp, mouse
gccgctgcgccatgagctct

SEQ ID NO: 588677 - DNA, 20 bp, mouse
gcctcggtcacaggcgggag

SEQ ID NO: 588678 - DNA, 20 bp, mouse
gagccgaagcctagagctca

SEQ ID NO: 588679 - DNA, 20 bp, mouse
gcaaggagcagtgctcaggg

SEQ ID NO: 588680 - DNA, 20 bp, mouse
gcgtcacccggagagcccgg

SEQ ID NO: 588681 - DNA, 20 bp, mouse
gcgggcacggcctcggtcac

SEQ ID NO: 588682 - DNA, 20 bp, mouse
ggaagtgagggaccctagga

SEQ ID NO: 588683 - DNA, 20 bp, mouse
gtcgcaggtactcaccgtgc

SEQ ID NO: 588684 - DNA, 20 bp, mouse
gtcttcttcgggccagtccc

SEQ ID NO: 588685 - DNA, 20 bp, mouse
gcacggcctcggtcacaggc

SEQ ID NO: 588686 - DNA, 20 bp, mouse
ggtgggtgcgcggaaacccg

SEQ ID NO: 588687 - DNA, 20 bp, mouse
ggcggcaagcgagccccaag

SEQ ID NO: 588688 - DNA, 20 bp, mouse
ggtcagactacgctccactt

SEQ ID NO: 588689 - DNA, 20 bp, mouse
gctgccggcccatcttccga

SEQ ID NO: 588690 - DNA, 20 bp, mouse
gcggaggcgaagcatccaag

SEQ ID NO: 588691 - DNA, 20 bp, mouse
gcgcgcacccacactttctg

SEQ ID NO: 588692 - DNA, 20 bp, mouse
gagcgggtcctcgaatccag

SEQ ID NO: 588693 - DNA, 20 bp, mouse
ggcgccctcggaagatgggc

SEQ ID NO: 588694 - DNA, 20 bp, mouse
gccgagcgccctcggaagat

SEQ ID NO: 588695 - DNA, 20 bp, mouse
gtgagcgaagatcccggtac

SEQ ID NO: 588696 - DNA, 20 bp, mouse
ggaccgcgggaggcacgagg

SEQ ID NO: 588697 - DNA, 20 bp, mouse
gggctgtggagtgcacgagg

SEQ ID NO: 588698 - DNA, 20 bp, mouse
gtctcaagaccgcaggcccg

SEQ ID NO: 588699 - DNA, 20 bp, mouse
gtgtggttgtgaactctgtc

SEQ ID NO: 588700 - DNA, 20 bp, mouse
ggagcgagcgccgaaaggat

SEQ ID NO: 588701 - DNA, 20 bp, mouse
gcagacccccggaccgcggg

SEQ ID NO: 588702 - DNA, 20 bp, mouse
ggagaacaaggccactcgag

SEQ ID NO: 588703 - DNA, 20 bp, mouse
ggacctggcctcgtatcctg

SEQ ID NO: 588704 - DNA, 20 bp, mouse
ggctcgcgggttgctactca

SEQ ID NO: 588705 - DNA, 20 bp, mouse
gggccgagtcaggccttcaa

SEQ ID NO: 588706 - DNA, 20 bp, mouse
gcggcttagagtgatccccg

SEQ ID NO: 588707 - DNA, 20 bp, mouse
gtccccggggccccagcagt

SEQ ID NO: 588708 - DNA, 20 bp, mouse
gtccgcgcgcgcggtggtga

SEQ ID NO: 588709 - DNA, 20 bp, mouse
gtccaactgctggggccccg

SEQ ID NO: 588710 - DNA, 20 bp, mouse
ggcaacggggcgtcagaagg

SEQ ID NO: 588711 - DNA, 20 bp, mouse
gttcgcgggtccaactgctg

SEQ ID NO: 588712 - DNA, 20 bp, mouse
gatggaacgttgctagttcg

SEQ ID NO: 588713 - DNA, 20 bp, mouse
gcagaactccgcgcgcgcgg

SEQ ID NO: 588714 - DNA, 20 bp, mouse
gtcccgtggagggaaaaaga

SEQ ID NO: 588715 - DNA, 20 bp, mouse
ggctaaaacaggagtctgga

SEQ ID NO: 588716 - DNA, 20 bp, mouse
gcaggctgagtgggtcacac

SEQ ID NO: 588717 - DNA, 20 bp, mouse
ggagtgggtcacacaggctc

SEQ ID NO: 588718 - DNA, 20 bp, mouse
ggctttgcctgcgctccctc

SEQ ID NO: 588719 - DNA, 20 bp, mouse
gctgctgctccaggctgagt

SEQ ID NO: 588720 - DNA, 20 bp, mouse
ggggtcacacaggctccgga

SEQ ID NO: 588721 - DNA, 20 bp, mouse
gcaggctccggagggagcgc

SEQ ID NO: 588722 - DNA, 20 bp, mouse
ggactttaggagccctctgg

SEQ ID NO: 588723 - DNA, 20 bp, mouse
gggtgctgtgctaggtgggt

SEQ ID NO: 588724 - DNA, 20 bp, mouse
gaggtacagctgttaggact

SEQ ID NO: 588725 - DNA, 20 bp, mouse
gtaacagctgtacctccaga

SEQ ID NO: 588726 - DNA, 20 bp, mouse
ggcagcctgcttcttaaaag

SEQ ID NO: 588727 - DNA, 20 bp, mouse
gagatgcagttcatgagtgt

SEQ ID NO: 588728 - DNA, 20 bp, mouse
gcacatctccaccttcggag

SEQ ID NO: 588729 - DNA, 20 bp, mouse
gagggaactctgagactggt

SEQ ID NO: 588730 - DNA, 20 bp, mouse
gtggataacggcctctccga

SEQ ID NO: 588731 - DNA, 20 bp, mouse
gctaggtcactctccactca

SEQ ID NO: 588732 - DNA, 20 bp, mouse
ggtcctgtaatagcccactg

SEQ ID NO: 588733 - DNA, 20 bp, mouse
ggcaccatgtgctctgaact

SEQ ID NO: 588734 - DNA, 20 bp, mouse
gaggccgttatccagcagtg

SEQ ID NO: 588735 - DNA, 20 bp, mouse
gtctctccttgagctgtgga

SEQ ID NO: 588736 - DNA, 20 bp, mouse
gtacacgggctcaggtccct

SEQ ID NO: 588737 - DNA, 20 bp, mouse
gggacaaagagcgtggccta

SEQ ID NO: 588738 - DNA, 20 bp, mouse
ggcacctgggtctgtctaca

SEQ ID NO: 588739 - DNA, 20 bp, mouse
gaccagaaaggagtcagagt

SEQ ID NO: 588740 - DNA, 20 bp, mouse
gtgggtgggagggcccaatc

SEQ ID NO: 588741 - DNA, 20 bp, mouse
gtgtccctgctgtgctgggt

SEQ ID NO: 588742 - DNA, 20 bp, mouse
gagctcactcccactctgag

SEQ ID NO: 588743 - DNA, 20 bp, mouse
gagagtagtcctctcagagt

SEQ ID NO: 588744 - DNA, 20 bp, mouse
gttgcaggtcctaaggtagt

SEQ ID NO: 588745 - DNA, 20 bp, mouse
gggaggatcggtcaccagaa

SEQ ID NO: 588746 - DNA, 20 bp, mouse
gagcacggtgcagagctgcg

SEQ ID NO: 588747 - DNA, 20 bp, mouse
gcctaccagcatcagcacca

SEQ ID NO: 588748 - DNA, 20 bp, mouse
gtgcgcggctgcttcttcct

SEQ ID NO: 588749 - DNA, 20 bp, mouse
gagggcccagcctccggccg

SEQ ID NO: 588750 - DNA, 20 bp, mouse
gctgcttcttcctcggccgg

SEQ ID NO: 588751 - DNA, 20 bp, mouse
gccgcggcgaggaggctacg

SEQ ID NO: 588752 - DNA, 20 bp, mouse
ggcaccgtgctctgctctag

SEQ ID NO: 588753 - DNA, 20 bp, mouse
ggtggtgaacgccgagctgg

SEQ ID NO: 588754 - DNA, 20 bp, mouse
gcggctgcttcttcctcggc

SEQ ID NO: 588755 - DNA, 20 bp, mouse
gcggggcctcggctaaaacc

SEQ ID NO: 588756 - DNA, 20 bp, mouse
gcgagccggggagaccctgg

SEQ ID NO: 588757 - DNA, 20 bp, mouse
gggagccggcgcagatgagg

SEQ ID NO: 588758 - DNA, 20 bp, mouse
gcggcgcagatgaggcggtt

SEQ ID NO: 588759 - DNA, 20 bp, mouse
ggaggcgccggcatagagca

SEQ ID NO: 588760 - DNA, 20 bp, mouse
ggggccaggccccaccgcca

SEQ ID NO: 588761 - DNA, 20 bp, mouse
gcgcggagccggcgcagatg

SEQ ID NO: 588762 - DNA, 20 bp, mouse
ggacgccgcgcccgacgaag

SEQ ID NO: 588763 - DNA, 20 bp, mouse
gggcgcttcgcaacccgagc

SEQ ID NO: 588764 - DNA, 20 bp, mouse
gcggggagaccctggcggtg

SEQ ID NO: 588765 - DNA, 20 bp, mouse
ggcgcctcggctagcgtgag

SEQ ID NO: 588766 - DNA, 20 bp, mouse
gtagccagcaatcgcagaca

SEQ ID NO: 588767 - DNA, 20 bp, mouse
ggctggctaatggatcccaa

SEQ ID NO: 588768 - DNA, 20 bp, mouse
gggcactctccttaaagaag

SEQ ID NO: 588769 - DNA, 20 bp, mouse
gggaccctgtctgcgattgc

SEQ ID NO: 588770 - DNA, 20 bp, mouse
gatcagagcttcttccttgg

SEQ ID NO: 588771 - DNA, 20 bp, mouse
gtccaggaaagggatccttt

SEQ ID NO: 588772 - DNA, 20 bp, mouse
gctgcttactgttaccccca

SEQ ID NO: 588773 - DNA, 20 bp, mouse
gaacagcactccccagccct

SEQ ID NO: 588774 - DNA, 20 bp, mouse
gtcccaaaggatccctttcc

SEQ ID NO: 588775 - DNA, 20 bp, mouse
gtagctcaactcaaaagcca

SEQ ID NO: 588776 - DNA, 20 bp, mouse
gcgcctgtcagaggatggtc

SEQ ID NO: 588777 - DNA, 20 bp, mouse
ggactccgcctgtcagagga

SEQ ID NO: 588778 - DNA, 20 bp, mouse
gagccagaccatcctctgac

SEQ ID NO: 588779 - DNA, 20 bp, mouse
gacccgactccgcctgtcag

SEQ ID NO: 588780 - DNA, 20 bp, mouse
ggaagagctctcatcaatag

SEQ ID NO: 588781 - DNA, 20 bp, mouse
gcgacaagcttatgaaagaa

SEQ ID NO: 588782 - DNA, 20 bp, mouse
ggacaggcggagtcgggtgc

SEQ ID NO: 588783 - DNA, 20 bp, mouse
gtgaaagaatggctgtctca

SEQ ID NO: 588784 - DNA, 20 bp, mouse
gaagcagttcgctaggacca

SEQ ID NO: 588785 - DNA, 20 bp, mouse
gtcagtcccgtggcagtctg

SEQ ID NO: 588786 - DNA, 20 bp, mouse
gtgacgacctgaaaacgcta

SEQ ID NO: 588787 - DNA, 20 bp, mouse
gtcctcagctgggattaagt

SEQ ID NO: 588788 - DNA, 20 bp, mouse
gggagtgactgagaggttct

SEQ ID NO: 588789 - DNA, 20 bp, mouse
gcagtcactccttccctgag

SEQ ID NO: 588790 - DNA, 20 bp, mouse
gagtctcttctgaccactca

SEQ ID NO: 588791 - DNA, 20 bp, mouse
gctaatcaccgatacctgga

SEQ ID NO: 588792 - DNA, 20 bp, mouse
gtgaggaaatcaggagaacc

SEQ ID NO: 588793 - DNA, 20 bp, mouse
gacgtctatgaacaacacac

SEQ ID NO: 588794 - DNA, 20 bp, mouse
gtgtataagaataaggtcga

SEQ ID NO: 588795 - DNA, 20 bp, mouse
ggactgagaggttctgggct

SEQ ID NO: 588796 - DNA, 20 bp, mouse
gtgctgagggaatcttccaa

SEQ ID NO: 588797 - DNA, 20 bp, mouse
gaatagggtagcgttaccag

SEQ ID NO: 588798 - DNA, 20 bp, mouse
gatcttccaagggaggacaa

SEQ ID NO: 588799 - DNA, 20 bp, mouse
gaaagagaagaagactccag

SEQ ID NO: 588800 - DNA, 20 bp, mouse
gggcagaggagagttcccta

SEQ ID NO: 588801 - DNA, 20 bp, mouse
gtggtgtcttagacaaaata

SEQ ID NO: 588802 - DNA, 20 bp, mouse
ggctgctctgggccctggaa

SEQ ID NO: 588803 - DNA, 20 bp, mouse
gctgcctagcagtaggatga

SEQ ID NO: 588804 - DNA, 20 bp, mouse
gaaactaggatatccatcct

SEQ ID NO: 588805 - DNA, 20 bp, mouse
gcctaggccagacgagtgca

SEQ ID NO: 588806 - DNA, 20 bp, mouse
ggctggtaaggggtccatag

SEQ ID NO: 588807 - DNA, 20 bp, mouse
gcacagaagggcccccatat

SEQ ID NO: 588808 - DNA, 20 bp, mouse
gtccatagaggcagaatgac

SEQ ID NO: 588809 - DNA, 20 bp, mouse
gggaaacacaagctggtaag

SEQ ID NO: 588810 - DNA, 20 bp, mouse
gtggtgccccatcaacagaa

SEQ ID NO: 588811 - DNA, 20 bp, mouse
gtgaccaagtcactcttccc

SEQ ID NO: 588812 - DNA, 20 bp, mouse
ggtgacttggtcagctggct

SEQ ID NO: 588813 - DNA, 20 bp, mouse
ggaagagtgacttggtcagc

SEQ ID NO: 588814 - DNA, 20 bp, mouse
gacactcatccccaaaggaa

SEQ ID NO: 588815 - DNA, 20 bp, mouse
gctaaggccaagtggaacag

SEQ ID NO: 588816 - DNA, 20 bp, mouse
gagtctgaagggcagctcgg

SEQ ID NO: 588817 - DNA, 20 bp, mouse
gatggcggcagaagtctgaa

SEQ ID NO: 588818 - DNA, 20 bp, mouse
ggccgctgcgcacttaaggg

SEQ ID NO: 588819 - DNA, 20 bp, mouse
gctcggcaacagcactgacg

SEQ ID NO: 588820 - DNA, 20 bp, mouse
gtgcgcacttaagggcggtt

SEQ ID NO: 588821 - DNA, 20 bp, mouse
gcagagcggacggaagggac

SEQ ID NO: 588822 - DNA, 20 bp, mouse
gggacacagactgcggtcag

SEQ ID NO: 588823 - DNA, 20 bp, mouse
gacttaagggcggttgggca

SEQ ID NO: 588824 - DNA, 20 bp, mouse
gaagcgcagagcggacggaa

SEQ ID NO: 588825 - DNA, 20 bp, mouse
gtacagacggcgagaagtcg

SEQ ID NO: 588826 - DNA, 20 bp, mouse
ggcactgggcaaggaagggc

SEQ ID NO: 588827 - DNA, 20 bp, mouse
ggagtgaggtggtgttcact

SEQ ID NO: 588828 - DNA, 20 bp, mouse
gaaaacatccagccagcact

SEQ ID NO: 588829 - DNA, 20 bp, mouse
gccagaaggaaagcactgag

SEQ ID NO: 588830 - DNA, 20 bp, mouse
gtgttcactgggtcggagga

SEQ ID NO: 588831 - DNA, 20 bp, mouse
gctctcgcttggctgcacca

SEQ ID NO: 588832 - DNA, 20 bp, mouse
gagaaactctgtcctgaaag

SEQ ID NO: 588833 - DNA, 20 bp, mouse
gatggagttcagcaagatca

SEQ ID NO: 588834 - DNA, 20 bp, mouse
gataccgtactgggccacta

SEQ ID NO: 588835 - DNA, 20 bp, mouse
gggtaggaccgagggttaag

SEQ ID NO: 588836 - DNA, 20 bp, mouse
gctggcagtagagacagaac

SEQ ID NO: 588837 - DNA, 20 bp, mouse
gtgcacagcacaagcagtga

SEQ ID NO: 588838 - DNA, 20 bp, mouse
ggcatttgggggacagacag

SEQ ID NO: 588839 - DNA, 20 bp, mouse
gagcccacgaagatacccca

SEQ ID NO: 588840 - DNA, 20 bp, mouse
ggaccatggggtatcttcgt

SEQ ID NO: 588841 - DNA, 20 bp, mouse
gcgcagacagttgcatttgg

SEQ ID NO: 588842 - DNA, 20 bp, mouse
gtggaagtccacaagttcct

SEQ ID NO: 588843 - DNA, 20 bp, mouse
gtatatgtcctaggaacttg

SEQ ID NO: 588844 - DNA, 20 bp, mouse
gctgtagtggtgctaattat

SEQ ID NO: 588845 - DNA, 20 bp, mouse
ggcaccactacagcctgtac

SEQ ID NO: 588846 - DNA, 20 bp, mouse
gctacttgtgaggagctctg

SEQ ID NO: 588847 - DNA, 20 bp, mouse
ggcccgggccactacttgtg

SEQ ID NO: 588848 - DNA, 20 bp, mouse
gtcctcacaagtagtggccc

SEQ ID NO: 588849 - DNA, 20 bp, mouse
gggcccgggccggcaaacgc

SEQ ID NO: 588850 - DNA, 20 bp, mouse
gtcaggtggctagagaagtt

SEQ ID NO: 588851 - DNA, 20 bp, mouse
gcgaccaggtaggtgaggat

SEQ ID NO: 588852 - DNA, 20 bp, mouse
gggacgaggcccgggcagga

SEQ ID NO: 588853 - DNA, 20 bp, mouse
gaacccaagactgcccgtgg

SEQ ID NO: 588854 - DNA, 20 bp, mouse
gcagttcagggtctgtcagg

SEQ ID NO: 588855 - DNA, 20 bp, mouse
ggaccctgaactgtcaggtg

SEQ ID NO: 588856 - DNA, 20 bp, mouse
gctgccggcgttgggagaca

SEQ ID NO: 588857 - DNA, 20 bp, mouse
gtcaccctgtctcccaacgc

SEQ ID NO: 588858 - DNA, 20 bp, mouse
ggccagccacgccgaccgtg

SEQ ID NO: 588859 - DNA, 20 bp, mouse
gctcgtgggctctggagtcg

SEQ ID NO: 588860 - DNA, 20 bp, mouse
gcgaaagggtgctggcgctc

SEQ ID NO: 588861 - DNA, 20 bp, mouse
gtaaagccgatgcttggact

SEQ ID NO: 588862 - DNA, 20 bp, mouse
ggatgcttggacttggagcg

SEQ ID NO: 588863 - DNA, 20 bp, mouse
gagcatcggctttagccccg

SEQ ID NO: 588864 - DNA, 20 bp, mouse
gtcccagaatgggggctcgt

SEQ ID NO: 588865 - DNA, 20 bp, mouse
gcgctcgggctgccggcgtt

SEQ ID NO: 588866 - DNA, 20 bp, mouse
ggctctgggagtctgaaggt

SEQ ID NO: 588867 - DNA, 20 bp, mouse
ggtttttactaaaactgggt

SEQ ID NO: 588868 - DNA, 20 bp, mouse
gcagagctgcagggtcacat

SEQ ID NO: 588869 - DNA, 20 bp, mouse
gtttggtttttactaaaact

SEQ ID NO: 588870 - DNA, 20 bp, mouse
gtgtaagaaaaatagtcttt

SEQ ID NO: 588871 - DNA, 20 bp, mouse
gaaagacgtaagtgtgagtt

SEQ ID NO: 588872 - DNA, 20 bp, mouse
gtacctgctcgtgaagttag

SEQ ID NO: 588873 - DNA, 20 bp, mouse
gaatgtgaccaagacctccc

SEQ ID NO: 588874 - DNA, 20 bp, mouse
ggtgacagccagggaggtct

SEQ ID NO: 588875 - DNA, 20 bp, mouse
gtcaacctgaagactttccc

SEQ ID NO: 588876 - DNA, 20 bp, mouse
gttagaacacaggaacacaa

SEQ ID NO: 588877 - DNA, 20 bp, mouse
gtgcacctcagaagaccctg

SEQ ID NO: 588878 - DNA, 20 bp, mouse
gaacatgagtagcaagcact

SEQ ID NO: 588879 - DNA, 20 bp, mouse
ggttattaggaactgtgtct

SEQ ID NO: 588880 - DNA, 20 bp, mouse
ggatgccccagggtcttctg

SEQ ID NO: 588881 - DNA, 20 bp, mouse
gtgccctgtcaacagtacgg

SEQ ID NO: 588882 - DNA, 20 bp, mouse
gagaccctggggcatcgcag

SEQ ID NO: 588883 - DNA, 20 bp, mouse
gacctgccctgtcaacagta

SEQ ID NO: 588884 - DNA, 20 bp, mouse
gttcctccgtactgttgaca

SEQ ID NO: 588885 - DNA, 20 bp, mouse
gggcccactgcgatgcccca

SEQ ID NO: 588886 - DNA, 20 bp, mouse
gtaaactaaagaccgagggg

SEQ ID NO: 588887 - DNA, 20 bp, mouse
gagtagtagtacccagtgac

SEQ ID NO: 588888 - DNA, 20 bp, mouse
gctgaggtgcgtggtagtga

SEQ ID NO: 588889 - DNA, 20 bp, mouse
gtcgtaaactaaagaccgag

SEQ ID NO: 588890 - DNA, 20 bp, mouse
gcgtcggtcggagtgaacgg

SEQ ID NO: 588891 - DNA, 20 bp, mouse
ggaccgaggggtggctcggg

SEQ ID NO: 588892 - DNA, 20 bp, mouse
ggcgaggctttcctgtcact

SEQ ID NO: 588893 - DNA, 20 bp, mouse
gacccgccctaacaaatatg

SEQ ID NO: 588894 - DNA, 20 bp, mouse
gtaaagaccgaggggtggct

SEQ ID NO: 588895 - DNA, 20 bp, mouse
gttcatggtcgggatagtgg

SEQ ID NO: 588896 - DNA, 20 bp, mouse
gcggaccagcacccacagaa

SEQ ID NO: 588897 - DNA, 20 bp, mouse
gggtccgagtgagtaagagt

SEQ ID NO: 588898 - DNA, 20 bp, mouse
gtgtgtgtggtcaccaggcc

SEQ ID NO: 588899 - DNA, 20 bp, mouse
ggagcggaggtcgaggtcgt

SEQ ID NO: 588900 - DNA, 20 bp, mouse
gaggtcgtggaggatccggt

SEQ ID NO: 588901 - DNA, 20 bp, mouse
gtgccagaggcacttcagtc

SEQ ID NO: 588902 - DNA, 20 bp, mouse
gggaccccaggatgctaggt

SEQ ID NO: 588903 - DNA, 20 bp, mouse
gctaatcatgaggacgcagg

SEQ ID NO: 588904 - DNA, 20 bp, mouse
gcggaggtcgaggtcgtggg

SEQ ID NO: 588905 - DNA, 20 bp, mouse
gtcccagcgcagaccaggta

SEQ ID NO: 588906 - DNA, 20 bp, mouse
gtccatatcccaggagccag

SEQ ID NO: 588907 - DNA, 20 bp, mouse
gtggcggagccggtaagccg

SEQ ID NO: 588908 - DNA, 20 bp, mouse
ggccggcgcggcgtgtgtgg

SEQ ID NO: 588909 - DNA, 20 bp, mouse
gcggccggccaatcacggga

SEQ ID NO: 588910 - DNA, 20 bp, mouse
gtcctgggatatggagtcgc

SEQ ID NO: 588911 - DNA, 20 bp, mouse
gcataggcgccgacgatcac

SEQ ID NO: 588912 - DNA, 20 bp, mouse
ggccggcgactccatatccc

SEQ ID NO: 588913 - DNA, 20 bp, mouse
gtgccagcaccccggcttac

SEQ ID NO: 588914 - DNA, 20 bp, mouse
gagccgaggcccgtgatcgt

SEQ ID NO: 588915 - DNA, 20 bp, mouse
gcggggtgctggcagggtca

SEQ ID NO: 588916 - DNA, 20 bp, mouse
gcttggctgcttcttcccca

SEQ ID NO: 588917 - DNA, 20 bp, mouse
gtcggctggccagcgtccct

SEQ ID NO: 588918 - DNA, 20 bp, mouse
gcgccacggatgagctggag

SEQ ID NO: 588919 - DNA, 20 bp, mouse
gcaactgtgagctaagtaag

SEQ ID NO: 588920 - DNA, 20 bp, mouse
ggcggaaggtcccagaagaa

SEQ ID NO: 588921 - DNA, 20 bp, mouse
gagcgtccaggtgtgctcct

SEQ ID NO: 588922 - DNA, 20 bp, mouse
gcatccgtggcgttggagaa

SEQ ID NO: 588923 - DNA, 20 bp, mouse
gcgcctctccagctcatccg

SEQ ID NO: 588924 - DNA, 20 bp, mouse
gacagaaaggcccctggctg

SEQ ID NO: 588925 - DNA, 20 bp, mouse
gggccagcgtccctgggctg

SEQ ID NO: 588926 - DNA, 20 bp, mouse
ggatggggcggtaagtgtct

SEQ ID NO: 588927 - DNA, 20 bp, mouse
ggttactgttgctcagaaga

SEQ ID NO: 588928 - DNA, 20 bp, mouse
ggcgtgtgcgacgctaatgt

SEQ ID NO: 588929 - DNA, 20 bp, mouse
gggctggactgaagacgcca

SEQ ID NO: 588930 - DNA, 20 bp, mouse
ggcctcaacttcatatcatg

SEQ ID NO: 588931 - DNA, 20 bp, mouse
gttgctcagaagaaggctgc

SEQ ID NO: 588932 - DNA, 20 bp, mouse
gcagccacagctctcagtaa

SEQ ID NO: 588933 - DNA, 20 bp, mouse
ggttatttaacgcatttctt

SEQ ID NO: 588934 - DNA, 20 bp, mouse
gaagcctttactgagagctg

SEQ ID NO: 588935 - DNA, 20 bp, mouse
gaattgtgaaaattaccagg

SEQ ID NO: 588936 - DNA, 20 bp, mouse
gcgcgctcgcgggcactcgg

SEQ ID NO: 588937 - DNA, 20 bp, mouse
ggccgcggggcgccagacga

SEQ ID NO: 588938 - DNA, 20 bp, mouse
gcagcgccactacacagccg

SEQ ID NO: 588939 - DNA, 20 bp, mouse
gcgcggagagggaaccccag

SEQ ID NO: 588940 - DNA, 20 bp, mouse
gcgctcccgctaaggagccg

SEQ ID NO: 588941 - DNA, 20 bp, mouse
gagcggcgcgtccccatccc

SEQ ID NO: 588942 - DNA, 20 bp, mouse
gggcaggtccaccccggcgg

SEQ ID NO: 588943 - DNA, 20 bp, mouse
ggtgccgggcaggtccaccc

SEQ ID NO: 588944 - DNA, 20 bp, mouse
ggctcgcgggcactcggcgg

SEQ ID NO: 588945 - DNA, 20 bp, mouse
gctctcccccggctccttag

SEQ ID NO: 588946 - DNA, 20 bp, mouse
gtcgccaggcagctctgtca

SEQ ID NO: 588947 - DNA, 20 bp, mouse
gttgatacccagagccataa

SEQ ID NO: 588948 - DNA, 20 bp, mouse
gcactgcacagagcatcgcc

SEQ ID NO: 588949 - DNA, 20 bp, mouse
ggctctgggtatcaaaggag

SEQ ID NO: 588950 - DNA, 20 bp, mouse
ggagtgggcaagggcactga

SEQ ID NO: 588951 - DNA, 20 bp, mouse
gaatgcaggtcagccagggt

SEQ ID NO: 588952 - DNA, 20 bp, mouse
gtaggccggcaccacgtcta

SEQ ID NO: 588953 - DNA, 20 bp, mouse
ggctctgccattatggctct

SEQ ID NO: 588954 - DNA, 20 bp, mouse
gctgttagcatagtgttcgt

SEQ ID NO: 588955 - DNA, 20 bp, mouse
gtcaccatcagcacactgat

SEQ ID NO: 588956 - DNA, 20 bp, mouse
gcgcgtcgcggcccgtccac

SEQ ID NO: 588957 - DNA, 20 bp, mouse
gggcccgtccaccggcacca

SEQ ID NO: 588958 - DNA, 20 bp, mouse
gcgcggtcccggcctccagc

SEQ ID NO: 588959 - DNA, 20 bp, mouse
ggcgatgcctcacttcaccg

SEQ ID NO: 588960 - DNA, 20 bp, mouse
ggggctgtggccgggacggg

SEQ ID NO: 588961 - DNA, 20 bp, mouse
gccgagcgggaagactcgga

SEQ ID NO: 588962 - DNA, 20 bp, mouse
gggacggggggcatctacac

SEQ ID NO: 588963 - DNA, 20 bp, mouse
gggctcagttgggtggacta

SEQ ID NO: 588964 - DNA, 20 bp, mouse
gcccgttacccggcctccca

SEQ ID NO: 588965 - DNA, 20 bp, mouse
gcgcgccgagcgggaagact

SEQ ID NO: 588966 - DNA, 20 bp, mouse
gcttgctctccgctccacgg

SEQ ID NO: 588967 - DNA, 20 bp, mouse
gagggcagcttcggagtggg

SEQ ID NO: 588968 - DNA, 20 bp, mouse
gtcgcttgctctccgctcca

SEQ ID NO: 588969 - DNA, 20 bp, mouse
gcagaggggcgcgggcgaag

SEQ ID NO: 588970 - DNA, 20 bp, mouse
gagcttcttcctccgtggag

SEQ ID NO: 588971 - DNA, 20 bp, mouse
gactgcagcttcttcctccg

SEQ ID NO: 588972 - DNA, 20 bp, mouse
ggaggagggcagcttcggag

SEQ ID NO: 588973 - DNA, 20 bp, mouse
gccggtaagcagtggtccgg

SEQ ID NO: 588974 - DNA, 20 bp, mouse
gagccaaccccggtaagcag

SEQ ID NO: 588975 - DNA, 20 bp, mouse
ggtaagcagtggtccggggg

SEQ ID NO: 588976 - DNA, 20 bp, mouse
gaaccgtccggagaagtctg

SEQ ID NO: 588977 - DNA, 20 bp, mouse
gctgttgcccggccgcagga

SEQ ID NO: 588978 - DNA, 20 bp, mouse
ggcgcgccgcggctccggaa

SEQ ID NO: 588979 - DNA, 20 bp, mouse
gtctcggcggagggagaaga

SEQ ID NO: 588980 - DNA, 20 bp, mouse
gctccccagacttctccgga

SEQ ID NO: 588981 - DNA, 20 bp, mouse
gggcaggctggtcccggcta

SEQ ID NO: 588982 - DNA, 20 bp, mouse
gctggtcccggctacggagg

SEQ ID NO: 588983 - DNA, 20 bp, mouse
gatgcagcgcgggagacaga

SEQ ID NO: 588984 - DNA, 20 bp, mouse
gcctcgaatgaggaacgaga

SEQ ID NO: 588985 - DNA, 20 bp, mouse
ggcggctccggaacggttag

SEQ ID NO: 588986 - DNA, 20 bp, mouse
ggcaccaccgtaaagttcgt

SEQ ID NO: 588987 - DNA, 20 bp, mouse
gacgagtcagagcggcccag

SEQ ID NO: 588988 - DNA, 20 bp, mouse
gcccctacgccggagtccgg

SEQ ID NO: 588989 - DNA, 20 bp, mouse
gatgcccacgaactttacgg

SEQ ID NO: 588990 - DNA, 20 bp, mouse
ggagcagcgtgtggctgcga

SEQ ID NO: 588991 - DNA, 20 bp, mouse
gtgcaacgggacaaaggcag

SEQ ID NO: 588992 - DNA, 20 bp, mouse
gcgcacctgcaacgggacaa

SEQ ID NO: 588993 - DNA, 20 bp, mouse
ggccatgcccacgaacttta

SEQ ID NO: 588994 - DNA, 20 bp, mouse
gagaccgggagaggattctt

SEQ ID NO: 588995 - DNA, 20 bp, mouse
gcagagcagccgccggactc

SEQ ID NO: 588996 - DNA, 20 bp, mouse
gctagatagggagaccactc

SEQ ID NO: 588997 - DNA, 20 bp, mouse
gaggcaagaagcagcaaggg

SEQ ID NO: 588998 - DNA, 20 bp, mouse
gctgcactgagaaaggtcgt

SEQ ID NO: 588999 - DNA, 20 bp, mouse
gcaggtaagtctggttacag

SEQ ID NO: 589000 - DNA, 20 bp, mouse
gaagcaaacatcactctgtc

SEQ ID NO: 589001 - DNA, 20 bp, mouse
gccagcagagggggggtctg

SEQ ID NO: 589002 - DNA, 20 bp, mouse
gggaagaatgccacgagtgg

SEQ ID NO: 589003 - DNA, 20 bp, mouse
gctgccctccaccccatcat

SEQ ID NO: 589004 - DNA, 20 bp, mouse
gacagacaggtgccagcaga

SEQ ID NO: 589005 - DNA, 20 bp, mouse
gatgggaagaatgccacgag

SEQ ID NO: 589006 - DNA, 20 bp, mouse
gggctccgctataaaccgag

SEQ ID NO: 589007 - DNA, 20 bp, mouse
gtgatcccagcgcgcctgtg

SEQ ID NO: 589008 - DNA, 20 bp, mouse
gtcgccccctcggtttatag

SEQ ID NO: 589009 - DNA, 20 bp, mouse
ggtggtgagtgagcaccctg

SEQ ID NO: 589010 - DNA, 20 bp, mouse
gcaagtggacaagagcgggt

SEQ ID NO: 589011 - DNA, 20 bp, mouse
gggctccgggcctgacatcc

SEQ ID NO: 589012 - DNA, 20 bp, mouse
ggagcagcttcattcctagg

SEQ ID NO: 589013 - DNA, 20 bp, mouse
ggtttatagcggagccccac

SEQ ID NO: 589014 - DNA, 20 bp, mouse
gtggacaagagcgggtgggt

SEQ ID NO: 589015 - DNA, 20 bp, mouse
gtcagccacacaggatcccc

SEQ ID NO: 589016 - DNA, 20 bp, mouse
ggtgaggaggatactgttga

SEQ ID NO: 589017 - DNA, 20 bp, mouse
ggcaagcttggagcacacac

SEQ ID NO: 589018 - DNA, 20 bp, mouse
gcttggtgcggatgatgaga

SEQ ID NO: 589019 - DNA, 20 bp, mouse
gaacatcgaaggacaaccca

SEQ ID NO: 589020 - DNA, 20 bp, mouse
gtacccatgatgctccctgg

SEQ ID NO: 589021 - DNA, 20 bp, mouse
gaagctcctcaattatgctt

SEQ ID NO: 589022 - DNA, 20 bp, mouse
ggagcttcattgtcctgagc

SEQ ID NO: 589023 - DNA, 20 bp, mouse
gtggtctggctcaaagttga

SEQ ID NO: 589024 - DNA, 20 bp, mouse
gaagcttgcttaccttggtg

SEQ ID NO: 589025 - DNA, 20 bp, mouse
gacacacaggcacatggctt

SEQ ID NO: 589026 - DNA, 20 bp, mouse
ggacaggctggtcctcacca

SEQ ID NO: 589027 - DNA, 20 bp, mouse
gtgacgtcagggtcaaagtg

SEQ ID NO: 589028 - DNA, 20 bp, mouse
gagcagctgccgggacaggc

SEQ ID NO: 589029 - DNA, 20 bp, mouse
gacctgctggcaggcactat

SEQ ID NO: 589030 - DNA, 20 bp, mouse
ggcgcacagcaggtggcctg

SEQ ID NO: 589031 - DNA, 20 bp, mouse
ggactcaaggggtgacgtca

SEQ ID NO: 589032 - DNA, 20 bp, mouse
gaggtgaaaaggaaaaccta

SEQ ID NO: 589033 - DNA, 20 bp, mouse
gggctctcagaaagaccagg

SEQ ID NO: 589034 - DNA, 20 bp, mouse
ggcccatagtgcctgccagc

SEQ ID NO: 589035 - DNA, 20 bp, mouse
ggccctgcggaaaccaccct

SEQ ID NO: 589036 - DNA, 20 bp, mouse
gagcgggtgctcctaggggt

SEQ ID NO: 589037 - DNA, 20 bp, mouse
gcggcccgactgcccctcag

SEQ ID NO: 589038 - DNA, 20 bp, mouse
ggcggcagggcgaagagaat

SEQ ID NO: 589039 - DNA, 20 bp, mouse
gggaccgagagaggcagacc

SEQ ID NO: 589040 - DNA, 20 bp, mouse
gcggccgctgaggggcagtc

SEQ ID NO: 589041 - DNA, 20 bp, mouse
gcctgccggcggccgctgag

SEQ ID NO: 589042 - DNA, 20 bp, mouse
gccagcgatcgcgcggatgg

SEQ ID NO: 589043 - DNA, 20 bp, mouse
gtctccagcgatcgcgcgga

SEQ ID NO: 589044 - DNA, 20 bp, mouse
gctggcggcgctggccaaga

SEQ ID NO: 589045 - DNA, 20 bp, mouse
gaggcaggctcaaggcggga

SEQ ID NO: 589046 - DNA, 20 bp, mouse
gagtaggagcccaatttgaa

SEQ ID NO: 589047 - DNA, 20 bp, mouse
gcttcaggaaaagtataagt

SEQ ID NO: 589048 - DNA, 20 bp, mouse
gatgtcttggagattcttca

SEQ ID NO: 589049 - DNA, 20 bp, mouse
gctccgacctggctgactgt

SEQ ID NO: 589050 - DNA, 20 bp, mouse
gttatacttttcctgaagta

SEQ ID NO: 589051 - DNA, 20 bp, mouse
gagatttcttcccttcaaat

SEQ ID NO: 589052 - DNA, 20 bp, mouse
ggtcggaggtaagacaaaac

SEQ ID NO: 589053 - DNA, 20 bp, mouse
gatcgaagaagagccgggaa

SEQ ID NO: 589054 - DNA, 20 bp, mouse
gagattcttcacggctgctt

SEQ ID NO: 589055 - DNA, 20 bp, mouse
gtctctggttaacaagaggg

SEQ ID NO: 589056 - DNA, 20 bp, mouse
gggagggagaaaagattgcg

SEQ ID NO: 589057 - DNA, 20 bp, mouse
ggggtgcccagtgcaataac

SEQ ID NO: 589058 - DNA, 20 bp, mouse
gccctttcacgcgatggatt

SEQ ID NO: 589059 - DNA, 20 bp, mouse
ggacgctccaggcaccagat

SEQ ID NO: 589060 - DNA, 20 bp, mouse
ggtctgagcacgcgtcccag

SEQ ID NO: 589061 - DNA, 20 bp, mouse
ggctccaggcaccagatagg

SEQ ID NO: 589062 - DNA, 20 bp, mouse
ggcttcacgagcttaaaagg

SEQ ID NO: 589063 - DNA, 20 bp, mouse
ggtgaagagcaaaatcgcaa

SEQ ID NO: 589064 - DNA, 20 bp, mouse
ggagggacgcacagacccta

SEQ ID NO: 589065 - DNA, 20 bp, mouse
ggccgaatccatcgcgtgaa

SEQ ID NO: 589066 - DNA, 20 bp, mouse
ggcttagtgctgtggagagg

SEQ ID NO: 589067 - DNA, 20 bp, mouse
gagcctggctgctctttatc

SEQ ID NO: 589068 - DNA, 20 bp, mouse
ggccctcagcaaggactcat

SEQ ID NO: 589069 - DNA, 20 bp, mouse
gaacggcaggcttagtgctg

SEQ ID NO: 589070 - DNA, 20 bp, mouse
ggaggatgctacttacgctc

SEQ ID NO: 589071 - DNA, 20 bp, mouse
gatgctacttacgctcaggc

SEQ ID NO: 589072 - DNA, 20 bp, mouse
gggagccgccttctgccacc

SEQ ID NO: 589073 - DNA, 20 bp, mouse
gataagagtaaagaggacga

SEQ ID NO: 589074 - DNA, 20 bp, mouse
gggagatctggtagactaga

SEQ ID NO: 589075 - DNA, 20 bp, mouse
gccaggctcttttaaacggc

SEQ ID NO: 589076 - DNA, 20 bp, mouse
ggggcttctgactaccccac

SEQ ID NO: 589077 - DNA, 20 bp, mouse
gccactgggcccctgcagtg

SEQ ID NO: 589078 - DNA, 20 bp, mouse
ggtgtgcctagtgagcctaa

SEQ ID NO: 589079 - DNA, 20 bp, mouse
ggaagaccggagggttgtag

SEQ ID NO: 589080 - DNA, 20 bp, mouse
gtggcagctgctctaggaaa

SEQ ID NO: 589081 - DNA, 20 bp, mouse
gaagggaaaattcacccgtg

SEQ ID NO: 589082 - DNA, 20 bp, mouse
ggagcctgccccacggagat

SEQ ID NO: 589083 - DNA, 20 bp, mouse
gttttccctttaggctcact

SEQ ID NO: 589084 - DNA, 20 bp, mouse
gtgcgcctgctacatctcag

SEQ ID NO: 589085 - DNA, 20 bp, mouse
ggcatggaggaagtctcaag

SEQ ID NO: 589086 - DNA, 20 bp, mouse
ggtgagctaccaggagaccc

SEQ ID NO: 589087 - DNA, 20 bp, mouse
gcttgttgaccagggtctcc

SEQ ID NO: 589088 - DNA, 20 bp, mouse
ggtccctctcagattaagaa

SEQ ID NO: 589089 - DNA, 20 bp, mouse
ggaagggtatatgacctaac

SEQ ID NO: 589090 - DNA, 20 bp, mouse
gcctggtcaacaagagttag

SEQ ID NO: 589091 - DNA, 20 bp, mouse
ggtatatgacctaaccggtg

SEQ ID NO: 589092 - DNA, 20 bp, mouse
gccccaaggagacaatgctt

SEQ ID NO: 589093 - DNA, 20 bp, mouse
gatacccttcttaatctgag

SEQ ID NO: 589094 - DNA, 20 bp, mouse
gagtgtctcagtggaaagtc

SEQ ID NO: 589095 - DNA, 20 bp, mouse
ggccacaggtctgccagtgg

SEQ ID NO: 589096 - DNA, 20 bp, mouse
gatagagagagccatcagca

SEQ ID NO: 589097 - DNA, 20 bp, mouse
ggacccagtctaggaactgt

SEQ ID NO: 589098 - DNA, 20 bp, mouse
gtgtgtattagactgctagt

SEQ ID NO: 589099 - DNA, 20 bp, mouse
gacaagctgtgccatgctga

SEQ ID NO: 589100 - DNA, 20 bp, mouse
ggacgattgctgggacactg

SEQ ID NO: 589101 - DNA, 20 bp, mouse
ggtggctgctaggataaggt

SEQ ID NO: 589102 - DNA, 20 bp, mouse
gctagttggcatagtaactg

SEQ ID NO: 589103 - DNA, 20 bp, mouse
ggacaggtaagtgctctctg

SEQ ID NO: 589104 - DNA, 20 bp, mouse
gcacagcgatgcaccagtca

SEQ ID NO: 589105 - DNA, 20 bp, mouse
gccttgccttaagccaggac

SEQ ID NO: 589106 - DNA, 20 bp, mouse
gtggctccaaggctccggac

SEQ ID NO: 589107 - DNA, 20 bp, mouse
ggccttggagccaccacaat

SEQ ID NO: 589108 - DNA, 20 bp, mouse
gacgtgagcacgggcagctg

SEQ ID NO: 589109 - DNA, 20 bp, mouse
gcgtgctcacgtacccattg

SEQ ID NO: 589110 - DNA, 20 bp, mouse
ggctcacgtacccattgtgg

SEQ ID NO: 589111 - DNA, 20 bp, mouse
ggagagtctaagaggtagga

SEQ ID NO: 589112 - DNA, 20 bp, mouse
gcagctggggcggggtcgtc

SEQ ID NO: 589113 - DNA, 20 bp, mouse
gagtcgcccgtccggagcct

SEQ ID NO: 589114 - DNA, 20 bp, mouse
gggcggggtcgtcgggatca

SEQ ID NO: 589115 - DNA, 20 bp, mouse
gacccgagagtctaagaggt

SEQ ID NO: 589116 - DNA, 20 bp, mouse
gtctggaaaggattcatggc

SEQ ID NO: 589117 - DNA, 20 bp, mouse
ggcatctcttcagtagagac

SEQ ID NO: 589118 - DNA, 20 bp, mouse
ggctgattgtgccaaaggta

SEQ ID NO: 589119 - DNA, 20 bp, mouse
gggtgaaaagagcgtttcct

SEQ ID NO: 589120 - DNA, 20 bp, mouse
gaccgaactttgggactcac

SEQ ID NO: 589121 - DNA, 20 bp, mouse
gctctgacagtaatagcata

SEQ ID NO: 589122 - DNA, 20 bp, mouse
ggagcagaacttgaagctat

SEQ ID NO: 589123 - DNA, 20 bp, mouse
gttgaatgtccagggagact

SEQ ID NO: 589124 - DNA, 20 bp, mouse
gagtgaaaagggggactagg

SEQ ID NO: 589125 - DNA, 20 bp, mouse
gttggcttcagtaggcagct

SEQ ID NO: 589126 - DNA, 20 bp, mouse
ggaagagccagaggggacta

SEQ ID NO: 589127 - DNA, 20 bp, mouse
gagccagaggggactaagga

SEQ ID NO: 589128 - DNA, 20 bp, mouse
gggccgggaggataaggtag

SEQ ID NO: 589129 - DNA, 20 bp, mouse
ggagaagcagtcaagcaaaa

SEQ ID NO: 589130 - DNA, 20 bp, mouse
gtggagcaagcaggatgatg

SEQ ID NO: 589131 - DNA, 20 bp, mouse
gttccttccttagtcccctc

SEQ ID NO: 589132 - DNA, 20 bp, mouse
ggaggagagagtctgggtca

SEQ ID NO: 589133 - DNA, 20 bp, mouse
gcgggccaggggagacattg

SEQ ID NO: 589134 - DNA, 20 bp, mouse
gagtgtgtagaggaggtggc

SEQ ID NO: 589135 - DNA, 20 bp, mouse
gtagcaaggagagggacctg

SEQ ID NO: 589136 - DNA, 20 bp, mouse
ggacgccgcgaacccaacag

SEQ ID NO: 589137 - DNA, 20 bp, mouse
gtcagtgaaccggccatgga

SEQ ID NO: 589138 - DNA, 20 bp, mouse
ggtcctcagtgaaccggcca

SEQ ID NO: 589139 - DNA, 20 bp, mouse
gccgaacggcgagcccagat

SEQ ID NO: 589140 - DNA, 20 bp, mouse
gcggcgagccagcccccgaa

SEQ ID NO: 589141 - DNA, 20 bp, mouse
gtcgcggcgtccggcagtgt

SEQ ID NO: 589142 - DNA, 20 bp, mouse
gccggccatggagggcgagc

SEQ ID NO: 589143 - DNA, 20 bp, mouse
gggcgcccgctcgccctcca

SEQ ID NO: 589144 - DNA, 20 bp, mouse
gcggcgtccggcagtgtcgg

SEQ ID NO: 589145 - DNA, 20 bp, mouse
ggcgcgccctcccagtcgaa

SEQ ID NO: 589146 - DNA, 20 bp, mouse
ggaagcctggagccaggaca

SEQ ID NO: 589147 - DNA, 20 bp, mouse
gtggttgcctggatcaaacc

SEQ ID NO: 589148 - DNA, 20 bp, mouse
gcagcacgtgcggagattca

SEQ ID NO: 589149 - DNA, 20 bp, mouse
ggaccagcccggtttgatcc

SEQ ID NO: 589150 - DNA, 20 bp, mouse
gtgagaagcggggacccacg

SEQ ID NO: 589151 - DNA, 20 bp, mouse
gaggcgggtccattcacctc

SEQ ID NO: 589152 - DNA, 20 bp, mouse
gtggtggtgggggaaaccag

SEQ ID NO: 589153 - DNA, 20 bp, mouse
ggcctctttgcggcatccta

SEQ ID NO: 589154 - DNA, 20 bp, mouse
gctggaaagacgcagagtcc

SEQ ID NO: 589155 - DNA, 20 bp, mouse
gattcagggtccgagttccg

SEQ ID NO: 589156 - DNA, 20 bp, mouse
gaatttcctaagtggctcag

SEQ ID NO: 589157 - DNA, 20 bp, mouse
ggcctgttggtagagagaaa

SEQ ID NO: 589158 - DNA, 20 bp, mouse
gatggcttgaatttcctaag

SEQ ID NO: 589159 - DNA, 20 bp, mouse
gaaagccagcatggataaca

SEQ ID NO: 589160 - DNA, 20 bp, mouse
gcagcggagaatttctacag

SEQ ID NO: 589161 - DNA, 20 bp, mouse
gataacaaggcagtgcctgt

SEQ ID NO: 589162 - DNA, 20 bp, mouse
ggactgccacacatatctgg

SEQ ID NO: 589163 - DNA, 20 bp, mouse
gtatgtgtggcagtcaggaa

SEQ ID NO: 589164 - DNA, 20 bp, mouse
gatgctctgctctcgtgaga

SEQ ID NO: 589165 - DNA, 20 bp, mouse
gggaaggttcatggctgtat

SEQ ID NO: 589166 - DNA, 20 bp, mouse
gcagcagccaaggagcccgg

SEQ ID NO: 589167 - DNA, 20 bp, mouse
ggagctgcgacgtgactggt

SEQ ID NO: 589168 - DNA, 20 bp, mouse
gcgtgtaggtgcagcagcca

SEQ ID NO: 589169 - DNA, 20 bp, mouse
gctctccaggcgcctagagt

SEQ ID NO: 589170 - DNA, 20 bp, mouse
gcgtgactggtcggtcgtgt

SEQ ID NO: 589171 - DNA, 20 bp, mouse
gtggcgagctgcgacgtgac

SEQ ID NO: 589172 - DNA, 20 bp, mouse
ggccgagctgggagtatgta

SEQ ID NO: 589173 - DNA, 20 bp, mouse
ggacacgagcgggacccccc

SEQ ID NO: 589174 - DNA, 20 bp, mouse
ggggctccgcgaccccaccg

SEQ ID NO: 589175 - DNA, 20 bp, mouse
gagccaaggagcccggcggc

SEQ ID NO: 589176 - DNA, 20 bp, mouse
gccgcagacaccgcctaagg

SEQ ID NO: 589177 - DNA, 20 bp, mouse
ggtcctctggccgccttagg

SEQ ID NO: 589178 - DNA, 20 bp, mouse
gacaccgcagacaccgccta

SEQ ID NO: 589179 - DNA, 20 bp, mouse
ggccgagcgggagacgaacg

SEQ ID NO: 589180 - DNA, 20 bp, mouse
gcggcgtaatcaggcgcgag

SEQ ID NO: 589181 - DNA, 20 bp, mouse
gcaagtcctctggccgcctt

SEQ ID NO: 589182 - DNA, 20 bp, mouse
gcaccgcctaaggcggccag

SEQ ID NO: 589183 - DNA, 20 bp, mouse
ggaggccgaggcgaggacac

SEQ ID NO: 589184 - DNA, 20 bp, mouse
gtcggcggcgggctcctcct

SEQ ID NO: 589185 - DNA, 20 bp, mouse
ggtcccgaggcggccccgtc

SEQ ID NO: 589186 - DNA, 20 bp, mouse
gcagctagccagcacagaga

SEQ ID NO: 589187 - DNA, 20 bp, mouse
gggagagagcggtccaagtt

SEQ ID NO: 589188 - DNA, 20 bp, mouse
gttccgcagaaagggttctg

SEQ ID NO: 589189 - DNA, 20 bp, mouse
ggcctagggatagaagtcct

SEQ ID NO: 589190 - DNA, 20 bp, mouse
gctccgcagaaccctttctg

SEQ ID NO: 589191 - DNA, 20 bp, mouse
gagggagcgtaagagcccgt

SEQ ID NO: 589192 - DNA, 20 bp, mouse
gagcccgaggctggatctca

SEQ ID NO: 589193 - DNA, 20 bp, mouse
ggtagggaaagggcgaaggt

SEQ ID NO: 589194 - DNA, 20 bp, mouse
ggaaagggcgaaggtgggtt

SEQ ID NO: 589195 - DNA, 20 bp, mouse
gtgcgcgtgaggtcctggga

SEQ ID NO: 589196 - DNA, 20 bp, mouse
gtcgcggcggccccttccca

SEQ ID NO: 589197 - DNA, 20 bp, mouse
gcgccgcgaaggggacatgt

SEQ ID NO: 589198 - DNA, 20 bp, mouse
gacagctgcaacgctggcga

SEQ ID NO: 589199 - DNA, 20 bp, mouse
ggtggctaggaatcgagata

SEQ ID NO: 589200 - DNA, 20 bp, mouse
ggagtccggtcccggctgag

SEQ ID NO: 589201 - DNA, 20 bp, mouse
gcggctctggagtccggtcc

SEQ ID NO: 589202 - DNA, 20 bp, mouse
gccgcgaggtgagcacccgt

SEQ ID NO: 589203 - DNA, 20 bp, mouse
gggaaggggccgccgcgaag

SEQ ID NO: 589204 - DNA, 20 bp, mouse
gcccacatcccgggacccac

SEQ ID NO: 589205 - DNA, 20 bp, mouse
gctggacctagacctcggga

SEQ ID NO: 589206 - DNA, 20 bp, mouse
ggggccacaaccctaacgag

SEQ ID NO: 589207 - DNA, 20 bp, mouse
gaccagactacctctcgtta

SEQ ID NO: 589208 - DNA, 20 bp, mouse
gtagggttgtggcccgaacc

SEQ ID NO: 589209 - DNA, 20 bp, mouse
gaagagcccctgcctgatct

SEQ ID NO: 589210 - DNA, 20 bp, mouse
ggccctcccacctaccctgc

SEQ ID NO: 589211 - DNA, 20 bp, mouse
ggaagcgatccaggagactc

SEQ ID NO: 589212 - DNA, 20 bp, mouse
gggcctgtggtgatgactgg

SEQ ID NO: 589213 - DNA, 20 bp, mouse
ggaccactaaagaaatcatc

SEQ ID NO: 589214 - DNA, 20 bp, mouse
ggtctaacccggccctgtgt

SEQ ID NO: 589215 - DNA, 20 bp, mouse
ggttggatgttggcccactt

SEQ ID NO: 589216 - DNA, 20 bp, mouse
gcggattggaaggaagctct

SEQ ID NO: 589217 - DNA, 20 bp, mouse
ggcacggagcgcaggaaacg

SEQ ID NO: 589218 - DNA, 20 bp, mouse
ggcaggatgcaggtcgacat

SEQ ID NO: 589219 - DNA, 20 bp, mouse
gctggacagatagtgaacag

SEQ ID NO: 589220 - DNA, 20 bp, mouse
ggatctgaaattgcacggat

SEQ ID NO: 589221 - DNA, 20 bp, mouse
gggtccgctcggagaaccca

SEQ ID NO: 589222 - DNA, 20 bp, mouse
gcggagatgctccaaccctg

SEQ ID NO: 589223 - DNA, 20 bp, mouse
gcggagaacccagggtcgct

SEQ ID NO: 589224 - DNA, 20 bp, mouse
ggtgaacagagggcgagtcc

SEQ ID NO: 589225 - DNA, 20 bp, mouse
gtcactgcacgcagcccgag

SEQ ID NO: 589226 - DNA, 20 bp, mouse
ggcggcggcagtgctcggag

SEQ ID NO: 589227 - DNA, 20 bp, mouse
ggggtctcaggcagccgcgg

SEQ ID NO: 589228 - DNA, 20 bp, mouse
ggcagggtctcaggcagccg

SEQ ID NO: 589229 - DNA, 20 bp, mouse
gtgccggaggagctgttgtc

SEQ ID NO: 589230 - DNA, 20 bp, mouse
ggaagctgaggggccctgtc

SEQ ID NO: 589231 - DNA, 20 bp, mouse
gcggcgagcgaggaagctga

SEQ ID NO: 589232 - DNA, 20 bp, mouse
ggctgaggggccctgtcagg

SEQ ID NO: 589233 - DNA, 20 bp, mouse
ggcggctaggggactgactg

SEQ ID NO: 589234 - DNA, 20 bp, mouse
gccggcaggggtgcaggatc

SEQ ID NO: 589235 - DNA, 20 bp, mouse
gggaccgtctgtcgcgggac

SEQ ID NO: 589236 - DNA, 20 bp, mouse
ggggcagccaaggcggacag

SEQ ID NO: 589237 - DNA, 20 bp, mouse
gcggacagaggcagatacag

SEQ ID NO: 589238 - DNA, 20 bp, mouse
ggcggctggcggtaacaggt

SEQ ID NO: 589239 - DNA, 20 bp, mouse
gtggcggtaacaggtaggcg

SEQ ID NO: 589240 - DNA, 20 bp, mouse
ggtaggcgcggcgagatgct

SEQ ID NO: 589241 - DNA, 20 bp, mouse
gcagaggcagatacagcggc

SEQ ID NO: 589242 - DNA, 20 bp, mouse
gaggcagatacagcggctgg

SEQ ID NO: 589243 - DNA, 20 bp, mouse
ggacgaagcccagcccccga

SEQ ID NO: 589244 - DNA, 20 bp, mouse
gccctttggtggagccgcag

SEQ ID NO: 589245 - DNA, 20 bp, mouse
ggagaaccttctcaccactg

SEQ ID NO: 589246 - DNA, 20 bp, mouse
gaggcactgtagtcaagcgg

SEQ ID NO: 589247 - DNA, 20 bp, mouse
gctgcttggtggaaacaacc

SEQ ID NO: 589248 - DNA, 20 bp, mouse
gctcaggaagtaaagtccac

SEQ ID NO: 589249 - DNA, 20 bp, mouse
gaccaggcactgtagtcaag

SEQ ID NO: 589250 - DNA, 20 bp, mouse
gttccaccaagcagcggaat

SEQ ID NO: 589251 - DNA, 20 bp, mouse
gttcccattccgctgcttgg

SEQ ID NO: 589252 - DNA, 20 bp, mouse
gggcttcccattccgctgct

SEQ ID NO: 589253 - DNA, 20 bp, mouse
gaaacgttactctctttcta

SEQ ID NO: 589254 - DNA, 20 bp, mouse
ggctttcacaaggacagatg

SEQ ID NO: 589255 - DNA, 20 bp, mouse
ggttggtcttctcagggacc

SEQ ID NO: 589256 - DNA, 20 bp, mouse
ggcagcctgccaaccacaag

SEQ ID NO: 589257 - DNA, 20 bp, mouse
gttgtgaccgcagcctggaa

SEQ ID NO: 589258 - DNA, 20 bp, mouse
gcccacctgccgcaccacct

SEQ ID NO: 589259 - DNA, 20 bp, mouse
gagagaatgccccttgtggt

SEQ ID NO: 589260 - DNA, 20 bp, mouse
ggcggcaggtgggccagagg

SEQ ID NO: 589261 - DNA, 20 bp, mouse
gctgcgtcaccagggaggat

SEQ ID NO: 589262 - DNA, 20 bp, mouse
ggggaagagaatgccccttg

SEQ ID NO: 589263 - DNA, 20 bp, mouse
gggtgcggcaggtgggccag

SEQ ID NO: 589264 - DNA, 20 bp, mouse
gtacttagggctggagcata

SEQ ID NO: 589265 - DNA, 20 bp, mouse
gggaagaagggtctgttggg

SEQ ID NO: 589266 - DNA, 20 bp, mouse
gcctctggcaaagtaactgg

SEQ ID NO: 589267 - DNA, 20 bp, mouse
gtcccaggaaacacatacaa

SEQ ID NO: 589268 - DNA, 20 bp, mouse
gtgccctctggcaaagtaac

SEQ ID NO: 589269 - DNA, 20 bp, mouse
ggagtctgagagatactgaa

SEQ ID NO: 589270 - DNA, 20 bp, mouse
gagtcaggccctgctctaca

SEQ ID NO: 589271 - DNA, 20 bp, mouse
gacacactttctctgccctc

SEQ ID NO: 589272 - DNA, 20 bp, mouse
gtcacaagcatcctgctccc

SEQ ID NO: 589273 - DNA, 20 bp, mouse
gctgctcctagatatctcac

SEQ ID NO: 589274 - DNA, 20 bp, mouse
ggtgagcctgtgagatatct

SEQ ID NO: 589275 - DNA, 20 bp, mouse
gtccattgtatgtgtttcct

SEQ ID NO: 589276 - DNA, 20 bp, mouse
gccaactcaccaagttagaa

SEQ ID NO: 589277 - DNA, 20 bp, mouse
gcccgagcgcgtcatcccag

SEQ ID NO: 589278 - DNA, 20 bp, mouse
gccccaaaaggcacccaata

SEQ ID NO: 589279 - DNA, 20 bp, mouse
gaaggcacccaataaggcgg

SEQ ID NO: 589280 - DNA, 20 bp, mouse
ggcccagcctccgccttatt

SEQ ID NO: 589281 - DNA, 20 bp, mouse
ggaagagaataaaccccaaa

SEQ ID NO: 589282 - DNA, 20 bp, mouse
gggcccgggaggaggcgaca

SEQ ID NO: 589283 - DNA, 20 bp, mouse
gcaaaaggcacccaataagg

SEQ ID NO: 589284 - DNA, 20 bp, mouse
ggcggcacgcacggcccggg

SEQ ID NO: 589285 - DNA, 20 bp, mouse
ggcgcgagcccggggaagga

SEQ ID NO: 589286 - DNA, 20 bp, mouse
ggctccgagtccccaacaag

SEQ ID NO: 589287 - DNA, 20 bp, mouse
gccccaacaagtggctgatg

SEQ ID NO: 589288 - DNA, 20 bp, mouse
gcagccacttgttggggact

SEQ ID NO: 589289 - DNA, 20 bp, mouse
gagccgcatcagccacttgt

SEQ ID NO: 589290 - DNA, 20 bp, mouse
gatctctaaaaaactcacgt

SEQ ID NO: 589291 - DNA, 20 bp, mouse
gttagagatttaaagttacc

SEQ ID NO: 589292 - DNA, 20 bp, mouse
gtttgaagtggaccgagtta

SEQ ID NO: 589293 - DNA, 20 bp, mouse
gaagtggaccgagttaaggc

SEQ ID NO: 589294 - DNA, 20 bp, mouse
ggttggctttggtagattat

SEQ ID NO: 589295 - DNA, 20 bp, mouse
gttcatttttcagccaggag

SEQ ID NO: 589296 - DNA, 20 bp, mouse
ggtcagcccggccagagaca

SEQ ID NO: 589297 - DNA, 20 bp, mouse
ggaggctcatcctggtgaca

SEQ ID NO: 589298 - DNA, 20 bp, mouse
ggaggattaaagtatcacaa

SEQ ID NO: 589299 - DNA, 20 bp, mouse
gaggggagtccgctgtcggg

SEQ ID NO: 589300 - DNA, 20 bp, mouse
gtcaccaggatgagcctctt

SEQ ID NO: 589301 - DNA, 20 bp, mouse
gtcctctagccgcccgacag

SEQ ID NO: 589302 - DNA, 20 bp, mouse
gggaggaacagtaccattcg

SEQ ID NO: 589303 - DNA, 20 bp, mouse
gggaacagtaccattcgagg

SEQ ID NO: 589304 - DNA, 20 bp, mouse
gacaacggagtgagtcagcc

SEQ ID NO: 589305 - DNA, 20 bp, mouse
ggagtcgactgcaagtgtct

SEQ ID NO: 589306 - DNA, 20 bp, mouse
ggcaggcctcgagagatgtg

SEQ ID NO: 589307 - DNA, 20 bp, mouse
gtgtccaacagccttggcaa

SEQ ID NO: 589308 - DNA, 20 bp, mouse
gccaacagccttggcaatgg

SEQ ID NO: 589309 - DNA, 20 bp, mouse
gagaacctggaactgggaga

SEQ ID NO: 589310 - DNA, 20 bp, mouse
gacctaggccctccatccct

SEQ ID NO: 589311 - DNA, 20 bp, mouse
gaacgacagaacctggaact

SEQ ID NO: 589312 - DNA, 20 bp, mouse
gagagagtgtccaacagcct

SEQ ID NO: 589313 - DNA, 20 bp, mouse
gagcttgctaagtatccctg

SEQ ID NO: 589314 - DNA, 20 bp, mouse
gagttatgcggtgggacagg

SEQ ID NO: 589315 - DNA, 20 bp, mouse
gagcaaggaacgacagaacc

SEQ ID NO: 589316 - DNA, 20 bp, mouse
ggagggtgcagagtgctccg

SEQ ID NO: 589317 - DNA, 20 bp, mouse
gtgagtcccggcctcggctg

SEQ ID NO: 589318 - DNA, 20 bp, mouse
gccaggaactgggaaggtcc

SEQ ID NO: 589319 - DNA, 20 bp, mouse
ggcgcccgcggccccagccg

SEQ ID NO: 589320 - DNA, 20 bp, mouse
gtcccgctgcgcgcaatata

SEQ ID NO: 589321 - DNA, 20 bp, mouse
gccggccgcagctgctgatc

SEQ ID NO: 589322 - DNA, 20 bp, mouse
gctcaggacgctttcagccc

SEQ ID NO: 589323 - DNA, 20 bp, mouse
gcagaaggccgctcccgagg

SEQ ID NO: 589324 - DNA, 20 bp, mouse
gggggccgcgggcgcagctc

SEQ ID NO: 589325 - DNA, 20 bp, mouse
ggggaagtgaggacccactt

SEQ ID NO: 589326 - DNA, 20 bp, mouse
ggtcgagctaaaagtcttcc

SEQ ID NO: 589327 - DNA, 20 bp, mouse
gtgactgctgtggggaacac

SEQ ID NO: 589328 - DNA, 20 bp, mouse
gcgttctgtcttaatcaggt

SEQ ID NO: 589329 - DNA, 20 bp, mouse
ggggccgttctgtcttaatc

SEQ ID NO: 589330 - DNA, 20 bp, mouse
gtgcaagtgggtaccatgtg

SEQ ID NO: 589331 - DNA, 20 bp, mouse
gaggagaagggtagtgtgta

SEQ ID NO: 589332 - DNA, 20 bp, mouse
gaggaatgagtgtgaagtgt

SEQ ID NO: 589333 - DNA, 20 bp, mouse
gaaggaccccaaaagccctc

SEQ ID NO: 589334 - DNA, 20 bp, mouse
ggtgcacatgtagattatag

SEQ ID NO: 589335 - DNA, 20 bp, mouse
gatagagtttaccagcaagt

SEQ ID NO: 589336 - DNA, 20 bp, mouse
gagaaagctaccttgaaaaa

SEQ ID NO: 589337 - DNA, 20 bp, mouse
gagccagacaccattcccaa

SEQ ID NO: 589338 - DNA, 20 bp, mouse
gtacgtttctctgcaaagag

SEQ ID NO: 589339 - DNA, 20 bp, mouse
gcagtggcccttgacaccag

SEQ ID NO: 589340 - DNA, 20 bp, mouse
ggaggtcctcacacagcagt

SEQ ID NO: 589341 - DNA, 20 bp, mouse
ggaaacgtaatgagtcacgt

SEQ ID NO: 589342 - DNA, 20 bp, mouse
gtgaggacctccattgggaa

SEQ ID NO: 589343 - DNA, 20 bp, mouse
ggcgaggccactggtgtcaa

SEQ ID NO: 589344 - DNA, 20 bp, mouse
gcggaggagtatcacactat

SEQ ID NO: 589345 - DNA, 20 bp, mouse
gtagtgaccacgatccacag

SEQ ID NO: 589346 - DNA, 20 bp, mouse
ggacccagtagatccttctg

SEQ ID NO: 589347 - DNA, 20 bp, mouse
gtggggtgctggcaagacac

SEQ ID NO: 589348 - DNA, 20 bp, mouse
ggcaccccagaaggatctac

SEQ ID NO: 589349 - DNA, 20 bp, mouse
gtactgggtctgacacctgc

SEQ ID NO: 589350 - DNA, 20 bp, mouse
gaggaagacggaaaaatgga

SEQ ID NO: 589351 - DNA, 20 bp, mouse
ggtaagagaagcctgtccag

SEQ ID NO: 589352 - DNA, 20 bp, mouse
gcctacctcagtcactaagt

SEQ ID NO: 589353 - DNA, 20 bp, mouse
gtaagtcacttactttcatt

SEQ ID NO: 589354 - DNA, 20 bp, mouse
gattattaatcattaatgac

SEQ ID NO: 589355 - DNA, 20 bp, mouse
ggtccttgaataccagctga

SEQ ID NO: 589356 - DNA, 20 bp, mouse
ggaactggaaagcaaacctg

SEQ ID NO: 589357 - DNA, 20 bp, mouse
gctcttggctgggatcctat

SEQ ID NO: 589358 - DNA, 20 bp, mouse
gctgcagctgtctaacccag

SEQ ID NO: 589359 - DNA, 20 bp, mouse
gtggaaagcaaacctgagga

SEQ ID NO: 589360 - DNA, 20 bp, mouse
gagaaagctgagaaaccgat

SEQ ID NO: 589361 - DNA, 20 bp, mouse
gcctgaggaaggcggagagc

SEQ ID NO: 589362 - DNA, 20 bp, mouse
gggagagccggctcttggct

SEQ ID NO: 589363 - DNA, 20 bp, mouse
gggtctataggaactccaga

SEQ ID NO: 589364 - DNA, 20 bp, mouse
gctgtctgaagcaactagaa

SEQ ID NO: 589365 - DNA, 20 bp, mouse
gataggaactccagaaggag

SEQ ID NO: 589366 - DNA, 20 bp, mouse
gccgccggaccccgaagcag

SEQ ID NO: 589367 - DNA, 20 bp, mouse
ggcaggggcctcataacgcc

SEQ ID NO: 589368 - DNA, 20 bp, mouse
ggtcctgccgagagctaggt

SEQ ID NO: 589369 - DNA, 20 bp, mouse
gctgctctccaggcgttatg

SEQ ID NO: 589370 - DNA, 20 bp, mouse
ggttggccaagcaacgacgc

SEQ ID NO: 589371 - DNA, 20 bp, mouse
ggccggcacatctgctctcc

SEQ ID NO: 589372 - DNA, 20 bp, mouse
gcgtgggcgccttgaaggag

SEQ ID NO: 589373 - DNA, 20 bp, mouse
gccggcgggaaacgacgatg

SEQ ID NO: 589374 - DNA, 20 bp, mouse
ggcccagccagcacggcgaa

SEQ ID NO: 589375 - DNA, 20 bp, mouse
ggtagtgctgtgggtcggga

SEQ ID NO: 589376 - DNA, 20 bp, mouse
gaacagcagccgctcacctg

SEQ ID NO: 589377 - DNA, 20 bp, mouse
ggaggcctaggaagctccca

SEQ ID NO: 589378 - DNA, 20 bp, mouse
gagccgctcacctgaggcct

SEQ ID NO: 589379 - DNA, 20 bp, mouse
gttcctaggcctcaggtgag

SEQ ID NO: 589380 - DNA, 20 bp, mouse
gagcacccgcccaaatacca

SEQ ID NO: 589381 - DNA, 20 bp, mouse
gagaaccctactgtctaaaa

SEQ ID NO: 589382 - DNA, 20 bp, mouse
gttggaaggggaggatccgg

SEQ ID NO: 589383 - DNA, 20 bp, mouse
gcagtgccgtggtatttggg

SEQ ID NO: 589384 - DNA, 20 bp, mouse
gattacgccggcgcgatggg

SEQ ID NO: 589385 - DNA, 20 bp, mouse
gctcctattaggaaacccgt

SEQ ID NO: 589386 - DNA, 20 bp, mouse
gagcctggttcccccccgag

SEQ ID NO: 589387 - DNA, 20 bp, mouse
gtcccccccgagcggagctg

SEQ ID NO: 589388 - DNA, 20 bp, mouse
gctgagtccgctacagcccc

SEQ ID NO: 589389 - DNA, 20 bp, mouse
gggaaccccaccaggctcac

SEQ ID NO: 589390 - DNA, 20 bp, mouse
gctccgctcgggggggaacc

SEQ ID NO: 589391 - DNA, 20 bp, mouse
ggccccgcagctccgctcgg

SEQ ID NO: 589392 - DNA, 20 bp, mouse
gtcctgccggaactccatgg

SEQ ID NO: 589393 - DNA, 20 bp, mouse
ggcctggtggggttcctggg

SEQ ID NO: 589394 - DNA, 20 bp, mouse
ggagatccagagaataggga

SEQ ID NO: 589395 - DNA, 20 bp, mouse
gtcctcctgccggaactcca

SEQ ID NO: 589396 - DNA, 20 bp, mouse
gagcctgtggccgctgtctc

SEQ ID NO: 589397 - DNA, 20 bp, mouse
gtgcccgagacagcggccac

SEQ ID NO: 589398 - DNA, 20 bp, mouse
gcgtgggctggagttgagag

SEQ ID NO: 589399 - DNA, 20 bp, mouse
ggcacctcagagcccttagg

SEQ ID NO: 589400 - DNA, 20 bp, mouse
ggggcaagcgcagtgcccgt

SEQ ID NO: 589401 - DNA, 20 bp, mouse
gatgcccagcgagtctccca

SEQ ID NO: 589402 - DNA, 20 bp, mouse
ggaggcacctcagagccctt

SEQ ID NO: 589403 - DNA, 20 bp, mouse
gaaggagtgaagaatgccgt

SEQ ID NO: 589404 - DNA, 20 bp, mouse
gatgccgtgggagactcgct

SEQ ID NO: 589405 - DNA, 20 bp, mouse
gggcactgcgcttgccctgg

SEQ ID NO: 589406 - DNA, 20 bp, mouse
gggagtcccagggagagtga

SEQ ID NO: 589407 - DNA, 20 bp, mouse
ggggagggcacggtacacag

SEQ ID NO: 589408 - DNA, 20 bp, mouse
ggtcccagggagagtgaagg

SEQ ID NO: 589409 - DNA, 20 bp, mouse
gacccgcaagaccccttctg

SEQ ID NO: 589410 - DNA, 20 bp, mouse
gggcagcagaggatacacgg

SEQ ID NO: 589411 - DNA, 20 bp, mouse
gtgcgggtctcctctgggat

SEQ ID NO: 589412 - DNA, 20 bp, mouse
gtgccgcagaaggggtcttg

SEQ ID NO: 589413 - DNA, 20 bp, mouse
gagggaacaccagactctag

SEQ ID NO: 589414 - DNA, 20 bp, mouse
ggtagacagccgctagagtc

SEQ ID NO: 589415 - DNA, 20 bp, mouse
gtcctctgctgccgcagaag

SEQ ID NO: 589416 - DNA, 20 bp, mouse
gatacccagagaactcggag

SEQ ID NO: 589417 - DNA, 20 bp, mouse
gagagaactcggagcgggta

SEQ ID NO: 589418 - DNA, 20 bp, mouse
gagcgggtagggcaatcatc

SEQ ID NO: 589419 - DNA, 20 bp, mouse
gtctgggtattgtcagacac

SEQ ID NO: 589420 - DNA, 20 bp, mouse
ggacactggtctgtctctga

SEQ ID NO: 589421 - DNA, 20 bp, mouse
gtgacaatacccagagaact

SEQ ID NO: 589422 - DNA, 20 bp, mouse
gccgactggaaccttcccat

SEQ ID NO: 589423 - DNA, 20 bp, mouse
gaggagcccacttagcccat

SEQ ID NO: 589424 - DNA, 20 bp, mouse
gcggccatcggcccaccggt

SEQ ID NO: 589425 - DNA, 20 bp, mouse
gcgagcgtgagagcaccgac

SEQ ID NO: 589426 - DNA, 20 bp, mouse
gtgatgtgaggcactccgag

SEQ ID NO: 589427 - DNA, 20 bp, mouse
ggaggcactccgagaggaac

SEQ ID NO: 589428 - DNA, 20 bp, mouse
gtacagctcgtcttgatgtg

SEQ ID NO: 589429 - DNA, 20 bp, mouse
ggaactggcagctgttggca

SEQ ID NO: 589430 - DNA, 20 bp, mouse
gctagtgtcgtctaagccca

SEQ ID NO: 589431 - DNA, 20 bp, mouse
gtcctggataactctgaacc

SEQ ID NO: 589432 - DNA, 20 bp, mouse
gtcctggttcagagttatcc

SEQ ID NO: 589433 - DNA, 20 bp, mouse
gtactccttgaactatagca

SEQ ID NO: 589434 - DNA, 20 bp, mouse
gtcctccatgctatagttca

SEQ ID NO: 589435 - DNA, 20 bp, mouse
gcttagacgacactagtgcc

SEQ ID NO: 589436 - DNA, 20 bp, mouse
ggacgcacggactgggaccc

SEQ ID NO: 589437 - DNA, 20 bp, mouse
gtaggagacctggagcagcg

SEQ ID NO: 589438 - DNA, 20 bp, mouse
gaccagacctgggtacccgg

SEQ ID NO: 589439 - DNA, 20 bp, mouse
gagcagcggggacggacgca

SEQ ID NO: 589440 - DNA, 20 bp, mouse
ggactgggacccgggcagtg

SEQ ID NO: 589441 - DNA, 20 bp, mouse
ggccgtcggggaccagacct

SEQ ID NO: 589442 - DNA, 20 bp, mouse
gctcagggtgcggctgggaa

SEQ ID NO: 589443 - DNA, 20 bp, mouse
gggggacggacgcacggact

SEQ ID NO: 589444 - DNA, 20 bp, mouse
gtggtccccgacggcaatag

SEQ ID NO: 589445 - DNA, 20 bp, mouse
gaaccctcggggatcctcca

SEQ ID NO: 589446 - DNA, 20 bp, mouse
gactccgcattccggtccag

SEQ ID NO: 589447 - DNA, 20 bp, mouse
gcgccggaagaccccgagag

SEQ ID NO: 589448 - DNA, 20 bp, mouse
gtcacctctggaccggaatg

SEQ ID NO: 589449 - DNA, 20 bp, mouse
gcttggaaccggggacccac

SEQ ID NO: 589450 - DNA, 20 bp, mouse
gtggagcccacgatcagcat

SEQ ID NO: 589451 - DNA, 20 bp, mouse
gtgcacgcccaagctcccgt

SEQ ID NO: 589452 - DNA, 20 bp, mouse
gcagaggtgaagacttgagc

SEQ ID NO: 589453 - DNA, 20 bp, mouse
gccggttccaaggatcagcg

SEQ ID NO: 589454 - DNA, 20 bp, mouse
gtcagcgcgtagctcgccat

SEQ ID NO: 589455 - DNA, 20 bp, mouse
gcgagagcggctcatggacg

SEQ ID NO: 589456 - DNA, 20 bp, mouse
ggaatcagccacaggcctgt

SEQ ID NO: 589457 - DNA, 20 bp, mouse
ggcctgtgggacgcagagct

SEQ ID NO: 589458 - DNA, 20 bp, mouse
gtccccaggcacgcatagaa

SEQ ID NO: 589459 - DNA, 20 bp, mouse
gcactaccccgtggctcccc

SEQ ID NO: 589460 - DNA, 20 bp, mouse
gtgcgtgcctggggagccac

SEQ ID NO: 589461 - DNA, 20 bp, mouse
gcacggggtagtgcaaggta

SEQ ID NO: 589462 - DNA, 20 bp, mouse
gtcctagctctgcgtcccac

SEQ ID NO: 589463 - DNA, 20 bp, mouse
gaacccgcgcgtaggctcaa

SEQ ID NO: 589464 - DNA, 20 bp, mouse
gaagtctttgggatgcatag

SEQ ID NO: 589465 - DNA, 20 bp, mouse
gtgcgcgttgaatcagccac

SEQ ID NO: 589466 - DNA, 20 bp, mouse
gagggtgtccagacgagcgg

SEQ ID NO: 589467 - DNA, 20 bp, mouse
ggccagggtgtccagacgag

SEQ ID NO: 589468 - DNA, 20 bp, mouse
ggtgtccagacgagcggcgg

SEQ ID NO: 589469 - DNA, 20 bp, mouse
gccgcctcgcgccagggtca

SEQ ID NO: 589470 - DNA, 20 bp, mouse
gcagcactcgcgagggacgc

SEQ ID NO: 589471 - DNA, 20 bp, mouse
gacttgaccgagagacaggt

SEQ ID NO: 589472 - DNA, 20 bp, mouse
gtgtcgggtcccagaaggta

SEQ ID NO: 589473 - DNA, 20 bp, mouse
gcaggaaccagcactcgcga

SEQ ID NO: 589474 - DNA, 20 bp, mouse
gaggatggacgtgccagcca

SEQ ID NO: 589475 - DNA, 20 bp, mouse
gagacccggaggcggactta

SEQ ID NO: 589476 - DNA, 20 bp, mouse
ggcaggcgtacggcgtacgg

SEQ ID NO: 589477 - DNA, 20 bp, mouse
gctataggtaagacctccca

SEQ ID NO: 589478 - DNA, 20 bp, mouse
gctgaaagtgctacatatcc

SEQ ID NO: 589479 - DNA, 20 bp, mouse
gtggtcctgcgggactgacc

SEQ ID NO: 589480 - DNA, 20 bp, mouse
ggtagcactttcagctatgt

SEQ ID NO: 589481 - DNA, 20 bp, mouse
gacaggctggcgcaggcgta

SEQ ID NO: 589482 - DNA, 20 bp, mouse
gagcagcactagctttctat

SEQ ID NO: 589483 - DNA, 20 bp, mouse
ggagggctgtataggaatcc

SEQ ID NO: 589484 - DNA, 20 bp, mouse
gtagtgctgctcacttgtcc

SEQ ID NO: 589485 - DNA, 20 bp, mouse
gcggcgatctcaagtaaaga

SEQ ID NO: 589486 - DNA, 20 bp, mouse
ggcagtggcagcgctgacag

SEQ ID NO: 589487 - DNA, 20 bp, mouse
gtgcgggatgcagggcacag

SEQ ID NO: 589488 - DNA, 20 bp, mouse
gatgcgagatgcgggatgca

SEQ ID NO: 589489 - DNA, 20 bp, mouse
gcaccgtgctcggtccccag

SEQ ID NO: 589490 - DNA, 20 bp, mouse
ggccgcgtgcgggaccgggt

SEQ ID NO: 589491 - DNA, 20 bp, mouse
gcagtggagacaacgcgcac

SEQ ID NO: 589492 - DNA, 20 bp, mouse
ggcctggccgatgcgagatg

SEQ ID NO: 589493 - DNA, 20 bp, mouse
ggagctcgtgggcttcccca

SEQ ID NO: 589494 - DNA, 20 bp, mouse
gagtaccacggcggccacgg

SEQ ID NO: 589495 - DNA, 20 bp, mouse
gcgcgactcacctagtacca

SEQ ID NO: 589496 - DNA, 20 bp, mouse
gtacagctgagagaatggtc

SEQ ID NO: 589497 - DNA, 20 bp, mouse
ggttggggcatgatatgggt

SEQ ID NO: 589498 - DNA, 20 bp, mouse
ggatgtgtgagaaccaatgt

SEQ ID NO: 589499 - DNA, 20 bp, mouse
gacttctacagctgagagaa

SEQ ID NO: 589500 - DNA, 20 bp, mouse
gatggtcaggtcagacattt

SEQ ID NO: 589501 - DNA, 20 bp, mouse
gtcaggtcagacatttgggt

SEQ ID NO: 589502 - DNA, 20 bp, mouse
gaatgggaaggaacacggaa

SEQ ID NO: 589503 - DNA, 20 bp, mouse
gtttgggttggggcatgata

SEQ ID NO: 589504 - DNA, 20 bp, mouse
gtcaagaaggagggatgaat

SEQ ID NO: 589505 - DNA, 20 bp, mouse
ggatagtgtgttatatgtgg

SEQ ID NO: 589506 - DNA, 20 bp, mouse
ggacaccccgggctacgtgg

SEQ ID NO: 589507 - DNA, 20 bp, mouse
ggaagacaccccgggctacg

SEQ ID NO: 589508 - DNA, 20 bp, mouse
gaggaccttacctaccaata

SEQ ID NO: 589509 - DNA, 20 bp, mouse
gttcaaacccagagaggact

SEQ ID NO: 589510 - DNA, 20 bp, mouse
gggagtaaagctagccatat

SEQ ID NO: 589511 - DNA, 20 bp, mouse
gtggaggtgaattccccagc

SEQ ID NO: 589512 - DNA, 20 bp, mouse
gagaggaggagcctgtactg

SEQ ID NO: 589513 - DNA, 20 bp, mouse
gggctgctctcggtccgaac

SEQ ID NO: 589514 - DNA, 20 bp, mouse
ggagccccgcgggctacaga

SEQ ID NO: 589515 - DNA, 20 bp, mouse
ggaaaccgccacttactatc

SEQ ID NO: 589516 - DNA, 20 bp, mouse
ggcggctctgaaagaaggct

SEQ ID NO: 589517 - DNA, 20 bp, mouse
gagaagagcggcgagaccaa

SEQ ID NO: 589518 - DNA, 20 bp, mouse
gaacgcaggaggcacgctgg

SEQ ID NO: 589519 - DNA, 20 bp, mouse
ggggttgtgggttggagccc

SEQ ID NO: 589520 - DNA, 20 bp, mouse
gagagcggtgggcaacgaca

SEQ ID NO: 589521 - DNA, 20 bp, mouse
ggctggagatgatgcaacgc

SEQ ID NO: 589522 - DNA, 20 bp, mouse
ggagctctgtgagtccctac

SEQ ID NO: 589523 - DNA, 20 bp, mouse
gctctaagcggtaacactca

SEQ ID NO: 589524 - DNA, 20 bp, mouse
gggagatgatgcaacgcagg

SEQ ID NO: 589525 - DNA, 20 bp, mouse
gccgtgtcgggagtgttggt

SEQ ID NO: 589526 - DNA, 20 bp, mouse
gtagcagcctcagagacacg

SEQ ID NO: 589527 - DNA, 20 bp, mouse
gcaaataggaagcagcccgg

SEQ ID NO: 589528 - DNA, 20 bp, mouse
ggccgcgccgcgtgtctctg

SEQ ID NO: 589529 - DNA, 20 bp, mouse
gcgccaaggagaaacctccc

SEQ ID NO: 589530 - DNA, 20 bp, mouse
gggaagcagcccgggggata

SEQ ID NO: 589531 - DNA, 20 bp, mouse
gtgtctctgaggctgctaga

SEQ ID NO: 589532 - DNA, 20 bp, mouse
ggatatggaaagtggcgcca

SEQ ID NO: 589533 - DNA, 20 bp, mouse
ggccactttccatatccccc

SEQ ID NO: 589534 - DNA, 20 bp, mouse
gtcaggaagctcaacccaag

SEQ ID NO: 589535 - DNA, 20 bp, mouse
gtccttaggaccgagaatgg

SEQ ID NO: 589536 - DNA, 20 bp, mouse
ggaagacagagagagcgacg

SEQ ID NO: 589537 - DNA, 20 bp, mouse
gcacagcgcgggtccctgga

SEQ ID NO: 589538 - DNA, 20 bp, mouse
ggagagagcgacgcggaaca

SEQ ID NO: 589539 - DNA, 20 bp, mouse
gggatgcgctatgcaatcgg

SEQ ID NO: 589540 - DNA, 20 bp, mouse
gacccggccaggtccttcag

SEQ ID NO: 589541 - DNA, 20 bp, mouse
gacgggactggaaagcactg

SEQ ID NO: 589542 - DNA, 20 bp, mouse
gacccgcgctgtgtctgcgt

SEQ ID NO: 589543 - DNA, 20 bp, mouse
gcagaacccgctgaaggacc

SEQ ID NO: 589544 - DNA, 20 bp, mouse
gaggcggccccgctgacccg

SEQ ID NO: 589545 - DNA, 20 bp, mouse
ggtaaggaaactcaccagag

SEQ ID NO: 589546 - DNA, 20 bp, mouse
gtacaggtgaacagagtcct

SEQ ID NO: 589547 - DNA, 20 bp, mouse
gtggctgcaaggctgctgat

SEQ ID NO: 589548 - DNA, 20 bp, mouse
gggtctgtgcagccgtccag

SEQ ID NO: 589549 - DNA, 20 bp, mouse
gtgagaggcgctgggtcctg

SEQ ID NO: 589550 - DNA, 20 bp, mouse
gtaggattgtggcttccctc

SEQ ID NO: 589551 - DNA, 20 bp, mouse
gacccagcgcctctcaccac

SEQ ID NO: 589552 - DNA, 20 bp, mouse
ggggcctgacctgtggtgag

SEQ ID NO: 589553 - DNA, 20 bp, mouse
gtaatgatgcagctggtaat

SEQ ID NO: 589554 - DNA, 20 bp, mouse
ggacccacacctccccgggg

SEQ ID NO: 589555 - DNA, 20 bp, mouse
gcccgggggggcctgacctg

SEQ ID NO: 589556 - DNA, 20 bp, mouse
gccgcggctgcttcacgagt

SEQ ID NO: 589557 - DNA, 20 bp, mouse
gcagccgcgggcgcctcagc

SEQ ID NO: 589558 - DNA, 20 bp, mouse
gaacccaggacggcaacacc

SEQ ID NO: 589559 - DNA, 20 bp, mouse
gtcgcctgctgaggcgcccg

SEQ ID NO: 589560 - DNA, 20 bp, mouse
gacaccgggcacagcacgga

SEQ ID NO: 589561 - DNA, 20 bp, mouse
gcgcagaaccggctataaat

SEQ ID NO: 589562 - DNA, 20 bp, mouse
gcggcatgctctctatatga

SEQ ID NO: 589563 - DNA, 20 bp, mouse
gaggctcggcaggtcacgtg

SEQ ID NO: 589564 - DNA, 20 bp, mouse
gacggtcgcacaacccagga

SEQ ID NO: 589565 - DNA, 20 bp, mouse
gggctataaataggagccgg

SEQ ID NO: 589566 - DNA, 20 bp, mouse
gcggaacagcccgagcggag

SEQ ID NO: 589567 - DNA, 20 bp, mouse
gactcccggaacagcccgag

SEQ ID NO: 589568 - DNA, 20 bp, mouse
gccgatcccgcacagaggga

SEQ ID NO: 589569 - DNA, 20 bp, mouse
gagcgcgggccgagacccag

SEQ ID NO: 589570 - DNA, 20 bp, mouse
gggccggcaggaagtgacga

SEQ ID NO: 589571 - DNA, 20 bp, mouse
ggggctccgatcccgcacag

SEQ ID NO: 589572 - DNA, 20 bp, mouse
gcctcacagccgggaagatg

SEQ ID NO: 589573 - DNA, 20 bp, mouse
gtcggagcccgacgccgcgg

SEQ ID NO: 589574 - DNA, 20 bp, mouse
gggcggctgctgaggtgcgg

SEQ ID NO: 589575 - DNA, 20 bp, mouse
gccccgagaccgccccaccg

SEQ ID NO: 589576 - DNA, 20 bp, mouse
gacgctgcacgaacccccag

SEQ ID NO: 589577 - DNA, 20 bp, mouse
gccaggacatcgtccacggt

SEQ ID NO: 589578 - DNA, 20 bp, mouse
gagagcaggcctggctgagt

SEQ ID NO: 589579 - DNA, 20 bp, mouse
gacgatgtcctggagcacgt

SEQ ID NO: 589580 - DNA, 20 bp, mouse
gacggtgggcatggctgggt

SEQ ID NO: 589581 - DNA, 20 bp, mouse
gaggcctggctgagttggtg

SEQ ID NO: 589582 - DNA, 20 bp, mouse
gacatcgtccacggtgggca

SEQ ID NO: 589583 - DNA, 20 bp, mouse
gggccctcaccaactcagcc

SEQ ID NO: 589584 - DNA, 20 bp, mouse
gtggagcacgttggagagtt

SEQ ID NO: 589585 - DNA, 20 bp, mouse
gcctgctctggactgccact

SEQ ID NO: 589586 - DNA, 20 bp, mouse
gtggctgtcaccatgagacc

SEQ ID NO: 589587 - DNA, 20 bp, mouse
gtcagcgacacagcagagtc

SEQ ID NO: 589588 - DNA, 20 bp, mouse
gaccctctgtggtaatctgg

SEQ ID NO: 589589 - DNA, 20 bp, mouse
gggcctccagattaccacag

SEQ ID NO: 589590 - DNA, 20 bp, mouse
gtgaagtggaagctgcgtgg

SEQ ID NO: 589591 - DNA, 20 bp, mouse
ggagaggcacccaacagcgg

SEQ ID NO: 589592 - DNA, 20 bp, mouse
gaggtgctattgtccaggag

SEQ ID NO: 589593 - DNA, 20 bp, mouse
gggtcaccagagccaccgtc

SEQ ID NO: 589594 - DNA, 20 bp, mouse
gaagctgcgtggtggtaccc

SEQ ID NO: 589595 - DNA, 20 bp, mouse
gtccccagggatactcgcct

SEQ ID NO: 589596 - DNA, 20 bp, mouse
ggaacaccacacaggtataa

SEQ ID NO: 589597 - DNA, 20 bp, mouse
gaaggcacagggtcagacag

SEQ ID NO: 589598 - DNA, 20 bp, mouse
ggagggtaatcaaaggcaca

SEQ ID NO: 589599 - DNA, 20 bp, mouse
gatcaaggaccatgaagact

SEQ ID NO: 589600 - DNA, 20 bp, mouse
gatgggcattcccaatttcc

SEQ ID NO: 589601 - DNA, 20 bp, mouse
gcaggtataaaggctggctt

SEQ ID NO: 589602 - DNA, 20 bp, mouse
gccatcctacctctttcttt

SEQ ID NO: 589603 - DNA, 20 bp, mouse
gttgggacacttgctgctct

SEQ ID NO: 589604 - DNA, 20 bp, mouse
ggccagcctttatacctgtg

SEQ ID NO: 589605 - DNA, 20 bp, mouse
gacagtggtgagcctcatca

SEQ ID NO: 589606 - DNA, 20 bp, mouse
gttgggtctggacaccagtc

SEQ ID NO: 589607 - DNA, 20 bp, mouse
ggagacaggactcacctgac

SEQ ID NO: 589608 - DNA, 20 bp, mouse
gagctaccaatggaacgcta

SEQ ID NO: 589609 - DNA, 20 bp, mouse
gggttctgcttccaaggata

SEQ ID NO: 589610 - DNA, 20 bp, mouse
gttcagctgtgggaacccta

SEQ ID NO: 589611 - DNA, 20 bp, mouse
ggacctttgaggtcagtgga

SEQ ID NO: 589612 - DNA, 20 bp, mouse
ggacagcctgctcttcccat

SEQ ID NO: 589613 - DNA, 20 bp, mouse
gccagacccaaccatatcct

SEQ ID NO: 589614 - DNA, 20 bp, mouse
gccctgcactgaatatccat

SEQ ID NO: 589615 - DNA, 20 bp, mouse
gcagcactctacctgcacac

SEQ ID NO: 589616 - DNA, 20 bp, mouse
gcttctgacaggaagcgggg

SEQ ID NO: 589617 - DNA, 20 bp, mouse
gtggcgcgcggaagggaaag

SEQ ID NO: 589618 - DNA, 20 bp, mouse
gcgagcggcagggaccggga

SEQ ID NO: 589619 - DNA, 20 bp, mouse
gggttggctggcgcgcggaa

SEQ ID NO: 589620 - DNA, 20 bp, mouse
gaccgggaaggaggaccggg

SEQ ID NO: 589621 - DNA, 20 bp, mouse
gtcacttctgacaggaagcg

SEQ ID NO: 589622 - DNA, 20 bp, mouse
ggatgcgatgctggtcgccc

SEQ ID NO: 589623 - DNA, 20 bp, mouse
gaccgggtccggggtcgcgg

SEQ ID NO: 589624 - DNA, 20 bp, mouse
gaattcctgtcacttctgac

SEQ ID NO: 589625 - DNA, 20 bp, mouse
ggggccgagcggcagggacc

SEQ ID NO: 589626 - DNA, 20 bp, mouse
gggcacccaaggccacgggc

SEQ ID NO: 589627 - DNA, 20 bp, mouse
ggtgcggtgctccaagtcca

SEQ ID NO: 589628 - DNA, 20 bp, mouse
ggacccgcctcacctgcccg

SEQ ID NO: 589629 - DNA, 20 bp, mouse
ggtctcagggatgccacgtg

SEQ ID NO: 589630 - DNA, 20 bp, mouse
gaggtgaggcgggtcgggtg

SEQ ID NO: 589631 - DNA, 20 bp, mouse
gaggacatggagccagagtc

SEQ ID NO: 589632 - DNA, 20 bp, mouse
gttgggtgcccctgctgggg

SEQ ID NO: 589633 - DNA, 20 bp, mouse
gcagcaggatgtgcctcacg

SEQ ID NO: 589634 - DNA, 20 bp, mouse
gggccacgggcaggtgaggc

SEQ ID NO: 589635 - DNA, 20 bp, mouse
gctgagacgcttggactgct

SEQ ID NO: 589636 - DNA, 20 bp, mouse
ggagaccgtagagacggagg

SEQ ID NO: 589637 - DNA, 20 bp, mouse
ggcagagaccgtagagacgg

SEQ ID NO: 589638 - DNA, 20 bp, mouse
ggagctaggacgcagagggc

SEQ ID NO: 589639 - DNA, 20 bp, mouse
ggcggagagctaggacgcag

SEQ ID NO: 589640 - DNA, 20 bp, mouse
gagcgcagagaccgtagaga

SEQ ID NO: 589641 - DNA, 20 bp, mouse
ggctgcagagctgcagagcg

SEQ ID NO: 589642 - DNA, 20 bp, mouse
gggcgcctcctccgtctcta

SEQ ID NO: 589643 - DNA, 20 bp, mouse
ggagagaatgagctgctgtc

SEQ ID NO: 589644 - DNA, 20 bp, mouse
ggctgcagagcggggtctcc

SEQ ID NO: 589645 - DNA, 20 bp, mouse
ggggctaggtgcggagagct

SEQ ID NO: 589646 - DNA, 20 bp, mouse
ggcagagcttgcagttgtgg

SEQ ID NO: 589647 - DNA, 20 bp, mouse
gtccatgggggtagaagtga

SEQ ID NO: 589648 - DNA, 20 bp, mouse
gcagttgtgggggaaccggc

SEQ ID NO: 589649 - DNA, 20 bp, mouse
ggtaagaattaaccccatca

SEQ ID NO: 589650 - DNA, 20 bp, mouse
ggaggagacccagttagcca

SEQ ID NO: 589651 - DNA, 20 bp, mouse
gggcttccatgagggatgag

SEQ ID NO: 589652 - DNA, 20 bp, mouse
gaccctccgggagctgggat

SEQ ID NO: 589653 - DNA, 20 bp, mouse
gaagctagaatcattcggcc

SEQ ID NO: 589654 - DNA, 20 bp, mouse
gtcaggtcagctccctgatg

SEQ ID NO: 589655 - DNA, 20 bp, mouse
gtgttctgaacaggctccag

SEQ ID NO: 589656 - DNA, 20 bp, mouse
gagagtgggtgtatttcggg

SEQ ID NO: 589657 - DNA, 20 bp, mouse
gcctctatcaagaaacacct

SEQ ID NO: 589658 - DNA, 20 bp, mouse
gcgggtggatgagccctccc

SEQ ID NO: 589659 - DNA, 20 bp, mouse
ggtgtattcctgctttctcc

SEQ ID NO: 589660 - DNA, 20 bp, mouse
ggaaggcagtggggccctaa

SEQ ID NO: 589661 - DNA, 20 bp, mouse
ggagagagtgggtgtatttc

SEQ ID NO: 589662 - DNA, 20 bp, mouse
gtttccgggtcactaaggaa

SEQ ID NO: 589663 - DNA, 20 bp, mouse
gccccgagctgcacccaggt

SEQ ID NO: 589664 - DNA, 20 bp, mouse
ggcacccaggtaggcatctt

SEQ ID NO: 589665 - DNA, 20 bp, mouse
gggcagtggggccctaacgg

SEQ ID NO: 589666 - DNA, 20 bp, mouse
gggtcctgaaaggccatcta

SEQ ID NO: 589667 - DNA, 20 bp, mouse
gagagtgtgaggagccgaca

SEQ ID NO: 589668 - DNA, 20 bp, mouse
gactcctcttggtatctcta

SEQ ID NO: 589669 - DNA, 20 bp, mouse
ggatacagagctgttcttaa

SEQ ID NO: 589670 - DNA, 20 bp, mouse
gtctaagtaggtgttaggta

SEQ ID NO: 589671 - DNA, 20 bp, mouse
gcctcttctaagtaggtgtt

SEQ ID NO: 589672 - DNA, 20 bp, mouse
ggtgaggagccgacagggca

SEQ ID NO: 589673 - DNA, 20 bp, mouse
gatcatcaggctactcctct

SEQ ID NO: 589674 - DNA, 20 bp, mouse
gctgccttagagataccaag

SEQ ID NO: 589675 - DNA, 20 bp, mouse
gtaactgacctgggtcactg

SEQ ID NO: 589676 - DNA, 20 bp, mouse
gcggtcggcatggttcctgg

SEQ ID NO: 589677 - DNA, 20 bp, mouse
gctggaggcagctgatcctg

SEQ ID NO: 589678 - DNA, 20 bp, mouse
gtcctgaggcttcacctaca

SEQ ID NO: 589679 - DNA, 20 bp, mouse
ggcagcatttgcaaccctgt

SEQ ID NO: 589680 - DNA, 20 bp, mouse
gtgttctagaatatcatcca

SEQ ID NO: 589681 - DNA, 20 bp, mouse
gctagaatatcatccacggt

SEQ ID NO: 589682 - DNA, 20 bp, mouse
gccacggtcggcatggttcc

SEQ ID NO: 589683 - DNA, 20 bp, mouse
gatgctgctgaaggcagctg

SEQ ID NO: 589684 - DNA, 20 bp, mouse
gaggcagctgcggtcagctc

SEQ ID NO: 589685 - DNA, 20 bp, mouse
gatatcatccacggtcggca

SEQ ID NO: 589686 - DNA, 20 bp, mouse
gtggatgccctgggaggcgt

SEQ ID NO: 589687 - DNA, 20 bp, mouse
gcctgggcaggcccgacctg

SEQ ID NO: 589688 - DNA, 20 bp, mouse
ggcctcccagggcatccagc

SEQ ID NO: 589689 - DNA, 20 bp, mouse
gtggccaagggccctacccc

SEQ ID NO: 589690 - DNA, 20 bp, mouse
gccctcggtggccaccccat

SEQ ID NO: 589691 - DNA, 20 bp, mouse
gcaaggctgtatagacaagc

SEQ ID NO: 589692 - DNA, 20 bp, mouse
gaagggccctaccccaggtc

SEQ ID NO: 589693 - DNA, 20 bp, mouse
ggcaggcccgacctggggta

SEQ ID NO: 589694 - DNA, 20 bp, mouse
gacagacctgctggatgccc

SEQ ID NO: 589695 - DNA, 20 bp, mouse
gcagacccctgagacattgg

SEQ ID NO: 589696 - DNA, 20 bp, mouse
gtagtaggcaagggactcct

SEQ ID NO: 589697 - DNA, 20 bp, mouse
gagctcagagtagtaggcaa

SEQ ID NO: 589698 - DNA, 20 bp, mouse
gcagaactgcgcgggtgtga

SEQ ID NO: 589699 - DNA, 20 bp, mouse
gggacagtgcggaagcggga

SEQ ID NO: 589700 - DNA, 20 bp, mouse
gtgggaaggactttacctca

SEQ ID NO: 589701 - DNA, 20 bp, mouse
gtactctgagctgttcgctg

SEQ ID NO: 589702 - DNA, 20 bp, mouse
gcagtcctgaggcgaaccgt

SEQ ID NO: 589703 - DNA, 20 bp, mouse
gggccggccgtgcagtcctg

SEQ ID NO: 589704 - DNA, 20 bp, mouse
ggcctggcttcagaactgcg

SEQ ID NO: 589705 - DNA, 20 bp, mouse
ggactcgcttgctctcgact

SEQ ID NO: 589706 - DNA, 20 bp, mouse
gtgcaacagaagtcctatat

SEQ ID NO: 589707 - DNA, 20 bp, mouse
gctattctctatgtgtgatt

SEQ ID NO: 589708 - DNA, 20 bp, mouse
gaaaatggcatgtaaaataa

SEQ ID NO: 589709 - DNA, 20 bp, mouse
gtaatggttaatatagaata

SEQ ID NO: 589710 - DNA, 20 bp, mouse
gatgccattttaaaaaaaca

SEQ ID NO: 589711 - DNA, 20 bp, mouse
gtgtacttgtgtctcatatc

SEQ ID NO: 589712 - DNA, 20 bp, mouse
gttgatttagatgcaaaata

SEQ ID NO: 589713 - DNA, 20 bp, mouse
gagtacaataaaagctgtta

SEQ ID NO: 589714 - DNA, 20 bp, mouse
gtttgtcaagtaaacaacca

SEQ ID NO: 589715 - DNA, 20 bp, mouse
gcatggaaatttacctatat

SEQ ID NO: 589716 - DNA, 20 bp, mouse
ggagcgcccgaagtccgtgg

SEQ ID NO: 589717 - DNA, 20 bp, mouse
gcgggttgggagatcctcca

SEQ ID NO: 589718 - DNA, 20 bp, mouse
gcgggagcgcccgaagtccg

SEQ ID NO: 589719 - DNA, 20 bp, mouse
ggccgaggtggaggtaaccg

SEQ ID NO: 589720 - DNA, 20 bp, mouse
gcggcggctgaggactcgaa

SEQ ID NO: 589721 - DNA, 20 bp, mouse
gcccggccggcgcgcatcag

SEQ ID NO: 589722 - DNA, 20 bp, mouse
ggggccccgagtcgcgacaa

SEQ ID NO: 589723 - DNA, 20 bp, mouse
gcgcgggccctcctcctcgg

SEQ ID NO: 589724 - DNA, 20 bp, mouse
gcggccccggcggaggagaa

SEQ ID NO: 589725 - DNA, 20 bp, mouse
gggagatcctccacggactt

SEQ ID NO: 589726 - DNA, 20 bp, mouse
ggtgttgttagcactaggga

SEQ ID NO: 589727 - DNA, 20 bp, mouse
gtgtagtgttgttagcacta

SEQ ID NO: 589728 - DNA, 20 bp, mouse
gcatttttgcttcccatcgg

SEQ ID NO: 589729 - DNA, 20 bp, mouse
ggctgaatgactgcctccga

SEQ ID NO: 589730 - DNA, 20 bp, mouse
gtttgttgtgaagtaaggaa

SEQ ID NO: 589731 - DNA, 20 bp, mouse
gttgctattatgtaagatag

SEQ ID NO: 589732 - DNA, 20 bp, mouse
gaaggatctggaatctccca

SEQ ID NO: 589733 - DNA, 20 bp, mouse
gagatcctgaaaggccattg

SEQ ID NO: 589734 - DNA, 20 bp, mouse
gggcagtcattcagcctcaa

SEQ ID NO: 589735 - DNA, 20 bp, mouse
gaagaaggaaagccatctga

SEQ ID NO: 589736 - DNA, 20 bp, mouse
gatccactgtgatcgaggta

SEQ ID NO: 589737 - DNA, 20 bp, mouse
gttcttatccactgtgatcg

SEQ ID NO: 589738 - DNA, 20 bp, mouse
gtatccactatttgtactat

SEQ ID NO: 589739 - DNA, 20 bp, mouse
gtgccttacctcgatcacag

SEQ ID NO: 589740 - DNA, 20 bp, mouse
gggatggatgggtgtgttac

SEQ ID NO: 589741 - DNA, 20 bp, mouse
gacactaagaggtaagaaga

SEQ ID NO: 589742 - DNA, 20 bp, mouse
ggttctcagcacatacatag

SEQ ID NO: 589743 - DNA, 20 bp, mouse
gcttagtgtaccaagcacac

SEQ ID NO: 589744 - DNA, 20 bp, mouse
gtaaattaattcataaactg

SEQ ID NO: 589745 - DNA, 20 bp, mouse
gtgtctggctctgtcacaca

SEQ ID NO: 589746 - DNA, 20 bp, mouse
gtgcagtggagaagcgatga

SEQ ID NO: 589747 - DNA, 20 bp, mouse
gcttaacccattagagagta

SEQ ID NO: 589748 - DNA, 20 bp, mouse
gtagaaaccttactctctaa

SEQ ID NO: 589749 - DNA, 20 bp, mouse
gaggtaccacaaggcctacg

SEQ ID NO: 589750 - DNA, 20 bp, mouse
gcacaaagtcaccctaagta

SEQ ID NO: 589751 - DNA, 20 bp, mouse
gtgaagaacaaccctactta

SEQ ID NO: 589752 - DNA, 20 bp, mouse
gggagttcctgaaaggccat

SEQ ID NO: 589753 - DNA, 20 bp, mouse
gtgttcggtattagactaca

SEQ ID NO: 589754 - DNA, 20 bp, mouse
ggatagtcattcagttccaa

SEQ ID NO: 589755 - DNA, 20 bp, mouse
gctgaatgactatctccgat

SEQ ID NO: 589756 - DNA, 20 bp, mouse
gccaatatgtggtactacaa

SEQ ID NO: 589757 - DNA, 20 bp, mouse
gtactacaatggcattgagg

SEQ ID NO: 589758 - DNA, 20 bp, mouse
ggtagtaccacatattggaa

SEQ ID NO: 589759 - DNA, 20 bp, mouse
gctctgacagcaatgcagaa

SEQ ID NO: 589760 - DNA, 20 bp, mouse
gaaaaaattatgtttcacaa

SEQ ID NO: 589761 - DNA, 20 bp, mouse
gctctagtgagctaaatgtt

SEQ ID NO: 589762 - DNA, 20 bp, mouse
gtcaggatcaacactattta

SEQ ID NO: 589763 - DNA, 20 bp, mouse
ggtgagctaaatgttaggta

SEQ ID NO: 589764 - DNA, 20 bp, mouse
gagttcttgaaaggacattg

SEQ ID NO: 589765 - DNA, 20 bp, mouse
gtggtactacaatggcattg

SEQ ID NO: 589766 - DNA, 20 bp, mouse
gtcagtgcctggtcgaacgt

SEQ ID NO: 589767 - DNA, 20 bp, mouse
gaggccgggcagcagcgaca

SEQ ID NO: 589768 - DNA, 20 bp, mouse
ggcagcagcgacagggcgca

SEQ ID NO: 589769 - DNA, 20 bp, mouse
ggcgcccgcgggtcactctc

SEQ ID NO: 589770 - DNA, 20 bp, mouse
gaccatgcccacgttcgacc

SEQ ID NO: 589771 - DNA, 20 bp, mouse
gcaccgctgcaggacaccag

SEQ ID NO: 589772 - DNA, 20 bp, mouse
gcgagttcgggcgcttccag

SEQ ID NO: 589773 - DNA, 20 bp, mouse
ggggacgtggagctccggtg

SEQ ID NO: 589774 - DNA, 20 bp, mouse
ggcctggtcgaacgtgggca

SEQ ID NO: 589775 - DNA, 20 bp, mouse
gcgacagggcgcagggtagc

SEQ ID NO: 589776 - DNA, 20 bp, mouse
gtgcagtggagaagcgatga

SEQ ID NO: 589777 - DNA, 20 bp, mouse
gcttaacccattagagagta

SEQ ID NO: 589778 - DNA, 20 bp, mouse
gtagaaaccttactctctaa

SEQ ID NO: 589779 - DNA, 20 bp, mouse
gaggtaccacaaggcctacg

SEQ ID NO: 589780 - DNA, 20 bp, mouse
gcacaaagtcaccctaagta

SEQ ID NO: 589781 - DNA, 20 bp, mouse
gtgaagaacaaccctactta

SEQ ID NO: 589782 - DNA, 20 bp, mouse
gggagttcctgaaaggccat

SEQ ID NO: 589783 - DNA, 20 bp, mouse
gtgttcggtattagactaca

SEQ ID NO: 589784 - DNA, 20 bp, mouse
ggatagtcattcagttccaa

SEQ ID NO: 589785 - DNA, 20 bp, mouse
gctgaatgactatctccgat

SEQ ID NO: 589786 - DNA, 20 bp, mouse
ggcgctgaggggatcttcct

SEQ ID NO: 589787 - DNA, 20 bp, mouse
gctgaggggatcttcctagg

SEQ ID NO: 589788 - DNA, 20 bp, mouse
gcagcttgcgtgagggaggt

SEQ ID NO: 589789 - DNA, 20 bp, mouse
gtgtttgcacgcagccacct

SEQ ID NO: 589790 - DNA, 20 bp, mouse
ggcgattgcggcgcgctgag

SEQ ID NO: 589791 - DNA, 20 bp, mouse
gctgcgtgcaaacacgccgt

SEQ ID NO: 589792 - DNA, 20 bp, mouse
ggcgctccgcgccaacccct

SEQ ID NO: 589793 - DNA, 20 bp, mouse
gaccaggcaacggtgctcgg

SEQ ID NO: 589794 - DNA, 20 bp, mouse
ggcacgggggtgtggtccag

SEQ ID NO: 589795 - DNA, 20 bp, mouse
ggggagttttgcagcaccca

SEQ ID NO: 589796 - DNA, 20 bp, mouse
gtgggaataaggggacaccg

SEQ ID NO: 589797 - DNA, 20 bp, mouse
ggcgcccgtatgggaataag

SEQ ID NO: 589798 - DNA, 20 bp, mouse
gtcacgagccttgcacgcag

SEQ ID NO: 589799 - DNA, 20 bp, mouse
gccgagtcggaggcgtcggt

SEQ ID NO: 589800 - DNA, 20 bp, mouse
gacaccgtggcgcgggagac

SEQ ID NO: 589801 - DNA, 20 bp, mouse
ggtggccgagtcggaggcgt

SEQ ID NO: 589802 - DNA, 20 bp, mouse
gcccatacgggcgctgtggg

SEQ ID NO: 589803 - DNA, 20 bp, mouse
gttggcggtggccgagtcgg

SEQ ID NO: 589804 - DNA, 20 bp, mouse
gaggccctatgtaaagttgg

SEQ ID NO: 589805 - DNA, 20 bp, mouse
gctcaggccctatgtaaagt

SEQ ID NO: 589806 - DNA, 20 bp, mouse
gcaagggagggccagaacca

SEQ ID NO: 589807 - DNA, 20 bp, mouse
ggctgcctgcgtaagagtca

SEQ ID NO: 589808 - DNA, 20 bp, mouse
gcccccgaagtgaagaaaag

SEQ ID NO: 589809 - DNA, 20 bp, mouse
gagaaaagaggcgagggcaa

SEQ ID NO: 589810 - DNA, 20 bp, mouse
gaggagtcactcagctgcag

SEQ ID NO: 589811 - DNA, 20 bp, mouse
gggagccctgactcttacgc

SEQ ID NO: 589812 - DNA, 20 bp, mouse
gagtggcagccctactcctc

SEQ ID NO: 589813 - DNA, 20 bp, mouse
gagtaggggagcaaccacca

SEQ ID NO: 589814 - DNA, 20 bp, mouse
ggaggtcattgaaggccatg

SEQ ID NO: 589815 - DNA, 20 bp, mouse
ggggaagccatcagcagtag

SEQ ID NO: 589816 - DNA, 20 bp, mouse
gctatagaggcacacctggt

SEQ ID NO: 589817 - DNA, 20 bp, mouse
gccgatcctaggtactatag

SEQ ID NO: 589818 - DNA, 20 bp, mouse
gaagcaggttgaccgatcct

SEQ ID NO: 589819 - DNA, 20 bp, mouse
gtcccacctccagagtccaa

SEQ ID NO: 589820 - DNA, 20 bp, mouse
gtagaggcacacctggtggg

SEQ ID NO: 589821 - DNA, 20 bp, mouse
gtcaggcagggcacaatgat

SEQ ID NO: 589822 - DNA, 20 bp, mouse
gggtactatagaggcacacc

SEQ ID NO: 589823 - DNA, 20 bp, mouse
gaagagctgctgcacaaggt

SEQ ID NO: 589824 - DNA, 20 bp, mouse
gatctaccccgggagactga

SEQ ID NO: 589825 - DNA, 20 bp, mouse
gacctggtgggtggagggca

SEQ ID NO: 589826 - DNA, 20 bp, mouse
gggaccctaggacagagcac

SEQ ID NO: 589827 - DNA, 20 bp, mouse
gttgcccgtgctctgtccta

SEQ ID NO: 589828 - DNA, 20 bp, mouse
ggttggagctggattcagtt

SEQ ID NO: 589829 - DNA, 20 bp, mouse
ggtatcagaagaatccaagt

SEQ ID NO: 589830 - DNA, 20 bp, mouse
ggcctccttgctgttccctg

SEQ ID NO: 589831 - DNA, 20 bp, mouse
ggcacaggggactcacccca

SEQ ID NO: 589832 - DNA, 20 bp, mouse
gaggcacagggccacatagt

SEQ ID NO: 589833 - DNA, 20 bp, mouse
ggagctggattcagttgggc

SEQ ID NO: 589834 - DNA, 20 bp, mouse
gttataggtcgtagatgtgt

SEQ ID NO: 589835 - DNA, 20 bp, mouse
ggctgtttgtgtctcccctg

SEQ ID NO: 589836 - DNA, 20 bp, mouse
gtatactccaaggccgccaa

SEQ ID NO: 589837 - DNA, 20 bp, mouse
gggtggtaagcgaagaggag

SEQ ID NO: 589838 - DNA, 20 bp, mouse
ggggaggcttgcagcaagct

SEQ ID NO: 589839 - DNA, 20 bp, mouse
gtgaaatctggagtcatcaa

SEQ ID NO: 589840 - DNA, 20 bp, mouse
gttttaggaaggttttgact

SEQ ID NO: 589841 - DNA, 20 bp, mouse
gtaggaaggttttgactggg

SEQ ID NO: 589842 - DNA, 20 bp, mouse
gccttcctaaaacaaccctt

SEQ ID NO: 589843 - DNA, 20 bp, mouse
gacttcagcaggaggatccc

SEQ ID NO: 589844 - DNA, 20 bp, mouse
ggagggtgaacacccagaac

SEQ ID NO: 589845 - DNA, 20 bp, mouse
gaagaggaggggctggaaca

SEQ ID NO: 589846 - DNA, 20 bp, mouse
gaccagagtgggatcagact

SEQ ID NO: 589847 - DNA, 20 bp, mouse
gagcccaaagcaggtgctgg

SEQ ID NO: 589848 - DNA, 20 bp, mouse
ggaaaactccggaggacccc

SEQ ID NO: 589849 - DNA, 20 bp, mouse
gttgggctcccggggtcctc

SEQ ID NO: 589850 - DNA, 20 bp, mouse
gtcagagatgaaaactccgg

SEQ ID NO: 589851 - DNA, 20 bp, mouse
gcacctgctttgggctcccg

SEQ ID NO: 589852 - DNA, 20 bp, mouse
gactgggcaggtctagactg

SEQ ID NO: 589853 - DNA, 20 bp, mouse
ggaccccgggagcccaaagc

SEQ ID NO: 589854 - DNA, 20 bp, mouse
ggacagtcttgagcctcgag

SEQ ID NO: 589855 - DNA, 20 bp, mouse
ggagtggcactcggggaacg

SEQ ID NO: 589856 - DNA, 20 bp, mouse
gaaggcggcggcaggcactg

SEQ ID NO: 589857 - DNA, 20 bp, mouse
ggcgcgagcggtgcgatcgg

SEQ ID NO: 589858 - DNA, 20 bp, mouse
ggcggcgcgagcggtgcgat

SEQ ID NO: 589859 - DNA, 20 bp, mouse
gagcccagcgagctgcaggc

SEQ ID NO: 589860 - DNA, 20 bp, mouse
ggcaggcactgcggcgcgag

SEQ ID NO: 589861 - DNA, 20 bp, mouse
gcagcacggcgagcccacgg

SEQ ID NO: 589862 - DNA, 20 bp, mouse
gcacctgcctgcagctcgct

SEQ ID NO: 589863 - DNA, 20 bp, mouse
ggcgcgctgtcacccacccg

SEQ ID NO: 589864 - DNA, 20 bp, mouse
gcgcaggccgcgccgcgggt

SEQ ID NO: 589865 - DNA, 20 bp, mouse
ggattcagggtcagcccgag

SEQ ID NO: 589866 - DNA, 20 bp, mouse
gccaagacgcaatcaagtca

SEQ ID NO: 589867 - DNA, 20 bp, mouse
gccctcagatagaagtggaa

SEQ ID NO: 589868 - DNA, 20 bp, mouse
gcaggggagcaggggtatcc

SEQ ID NO: 589869 - DNA, 20 bp, mouse
gtccttattcaactagcctg

SEQ ID NO: 589870 - DNA, 20 bp, mouse
gtggctctacaggtaggagg

SEQ ID NO: 589871 - DNA, 20 bp, mouse
gaggtggaggcggtaggagt

SEQ ID NO: 589872 - DNA, 20 bp, mouse
ggccccaggctagttgaata

SEQ ID NO: 589873 - DNA, 20 bp, mouse
gcgagaggcccaagaacggg

SEQ ID NO: 589874 - DNA, 20 bp, mouse
gcacccgagaggcccaagaa

SEQ ID NO: 589875 - DNA, 20 bp, mouse
ggaaggcccacacacccgag

SEQ ID NO: 589876 - DNA, 20 bp, mouse
gtcgaagagtaggtgtgaag

SEQ ID NO: 589877 - DNA, 20 bp, mouse
gtcctgtaggaggtgcacgt

SEQ ID NO: 589878 - DNA, 20 bp, mouse
gcttgaattaggattcctaa

SEQ ID NO: 589879 - DNA, 20 bp, mouse
ggattcctaagggagccggc

SEQ ID NO: 589880 - DNA, 20 bp, mouse
gtcctaagggagccggcagg

SEQ ID NO: 589881 - DNA, 20 bp, mouse
gcctaattcaagggtatgaa

SEQ ID NO: 589882 - DNA, 20 bp, mouse
gggtatgaagggcatgtcag

SEQ ID NO: 589883 - DNA, 20 bp, mouse
gctctcctcccctctcgcag

SEQ ID NO: 589884 - DNA, 20 bp, mouse
gttaggattcctaagggagc

SEQ ID NO: 589885 - DNA, 20 bp, mouse
ggaccctctagaattcctgt

SEQ ID NO: 589886 - DNA, 20 bp, mouse
ggtcctcgcgagcccagctt

SEQ ID NO: 589887 - DNA, 20 bp, mouse
ggcctcgcccgggctcgcga

SEQ ID NO: 589888 - DNA, 20 bp, mouse
gtcggggacgcgcctcgccc

SEQ ID NO: 589889 - DNA, 20 bp, mouse
gtcgcgagcccagcttcggc

SEQ ID NO: 589890 - DNA, 20 bp, mouse
ggcccccgagtggagagagt

SEQ ID NO: 589891 - DNA, 20 bp, mouse
ggcccagcttcggccggcga

SEQ ID NO: 589892 - DNA, 20 bp, mouse
gcgacccacccggggaccag

SEQ ID NO: 589893 - DNA, 20 bp, mouse
gtccatcgcgagcccgggcg

SEQ ID NO: 589894 - DNA, 20 bp, mouse
ggtgccgctggtccccgggt

SEQ ID NO: 589895 - DNA, 20 bp, mouse
gcgacgtccatcgcgagccc

SEQ ID NO: 589896 - DNA, 20 bp, mouse
gacggcgtggagaccggcag

SEQ ID NO: 589897 - DNA, 20 bp, mouse
gagggcgacggcgtggagac

SEQ ID NO: 589898 - DNA, 20 bp, mouse
ggactgagcgatagcgacga

SEQ ID NO: 589899 - DNA, 20 bp, mouse
ggtggagaccggcagcggcc

SEQ ID NO: 589900 - DNA, 20 bp, mouse
ggcgatagcgacgagggcga

SEQ ID NO: 589901 - DNA, 20 bp, mouse
ggagaccggcagcggccggg

SEQ ID NO: 589902 - DNA, 20 bp, mouse
ggagccgcagcgcccactcg

SEQ ID NO: 589903 - DNA, 20 bp, mouse
gctgggctctaggactgcag

SEQ ID NO: 589904 - DNA, 20 bp, mouse
gcgagcctgcgagagcagaa

SEQ ID NO: 589905 - DNA, 20 bp, mouse
gcggccgcccgcgacccgag

SEQ ID NO: 589906 - DNA, 20 bp, mouse
ggccacggcctcgcagacac

SEQ ID NO: 589907 - DNA, 20 bp, mouse
gcccgcgggcgaactgtccc

SEQ ID NO: 589908 - DNA, 20 bp, mouse
gagccagagagaaagttccc

SEQ ID NO: 589909 - DNA, 20 bp, mouse
gcgcagtttgggccctcccg

SEQ ID NO: 589910 - DNA, 20 bp, mouse
ggtcccgggaactttctctc

SEQ ID NO: 589911 - DNA, 20 bp, mouse
gcagcttgcgggaggcgcca

SEQ ID NO: 589912 - DNA, 20 bp, mouse
gtttctctctggctcttagg

SEQ ID NO: 589913 - DNA, 20 bp, mouse
gcgaggaggatgctgcgagt

SEQ ID NO: 589914 - DNA, 20 bp, mouse
ggggcggccggggctaaact

SEQ ID NO: 589915 - DNA, 20 bp, mouse
ggagcgcgctgaagagcagt

SEQ ID NO: 589916 - DNA, 20 bp, mouse
ggcagggagacaccacggac

SEQ ID NO: 589917 - DNA, 20 bp, mouse
gggcccaacttggacaagga

SEQ ID NO: 589918 - DNA, 20 bp, mouse
gatggggcccaacttggaca

SEQ ID NO: 589919 - DNA, 20 bp, mouse
ggaccctccttgtccaagtt

SEQ ID NO: 589920 - DNA, 20 bp, mouse
gcctcccaagggccacaggt

SEQ ID NO: 589921 - DNA, 20 bp, mouse
gtcggagccctgccgaggat

SEQ ID NO: 589922 - DNA, 20 bp, mouse
ggacaaaatggggcccaact

SEQ ID NO: 589923 - DNA, 20 bp, mouse
gtggaaatgcggacaaaatg

SEQ ID NO: 589924 - DNA, 20 bp, mouse
gtagttcagagaccaagggg

SEQ ID NO: 589925 - DNA, 20 bp, mouse
gcagtcccacgtagagatgt

SEQ ID NO: 589926 - DNA, 20 bp, mouse
gcggggttctcgggaagcag

SEQ ID NO: 589927 - DNA, 20 bp, mouse
gcctccggcgcggggttctc

SEQ ID NO: 589928 - DNA, 20 bp, mouse
gcgcgaggcgcagccatagc

SEQ ID NO: 589929 - DNA, 20 bp, mouse
gtcgtggtctcagtagcctc

SEQ ID NO: 589930 - DNA, 20 bp, mouse
gccgcctcccggaccagaat

SEQ ID NO: 589931 - DNA, 20 bp, mouse
gcgccggaggctcggacccg

SEQ ID NO: 589932 - DNA, 20 bp, mouse
gggcgcccggcgtcgacctc

SEQ ID NO: 589933 - DNA, 20 bp, mouse
gccccgcccaacttccggag

SEQ ID NO: 589934 - DNA, 20 bp, mouse
gtctcgggaagcagcggagc

SEQ ID NO: 589935 - DNA, 20 bp, mouse
gggcggagaccaccgggtgg

SEQ ID NO: 589936 - DNA, 20 bp, mouse
gaccggagttgtgctcaccg

SEQ ID NO: 589937 - DNA, 20 bp, mouse
gggccagagcagcagcgacc

SEQ ID NO: 589938 - DNA, 20 bp, mouse
gcgggtgcgcagtcaagcgg

SEQ ID NO: 589939 - DNA, 20 bp, mouse
gaaccgggcgttgagcagct

SEQ ID NO: 589940 - DNA, 20 bp, mouse
gctcggtagcactttgaacc

SEQ ID NO: 589941 - DNA, 20 bp, mouse
ggagttgtgctcaccggggt

SEQ ID NO: 589942 - DNA, 20 bp, mouse
gtaccgggtgcgcagtcaag

SEQ ID NO: 589943 - DNA, 20 bp, mouse
gaggcgccggggaccatccg

SEQ ID NO: 589944 - DNA, 20 bp, mouse
ggccgcagcaggcgccttgt

SEQ ID NO: 589945 - DNA, 20 bp, mouse
gtgctcaccggggtcgggcc

SEQ ID NO: 589946 - DNA, 20 bp, mouse
gaccagcgcgcaacagggtg

SEQ ID NO: 589947 - DNA, 20 bp, mouse
ggtgacaccagcgcgcaaca

SEQ ID NO: 589948 - DNA, 20 bp, mouse
gcccctccgacaggcaaatc

SEQ ID NO: 589949 - DNA, 20 bp, mouse
gaacttgacagacttagggg

SEQ ID NO: 589950 - DNA, 20 bp, mouse
gcaaagccgagggccatcaa

SEQ ID NO: 589951 - DNA, 20 bp, mouse
ggcgcaggctcggagcgcaa

SEQ ID NO: 589952 - DNA, 20 bp, mouse
ggccagatttgcctgtcgga

SEQ ID NO: 589953 - DNA, 20 bp, mouse
gtgcgcgctggtgtcacctt

SEQ ID NO: 589954 - DNA, 20 bp, mouse
gtggagccagatttgcctgt

SEQ ID NO: 589955 - DNA, 20 bp, mouse
ggcccgccccagcttccagc

SEQ ID NO: 589956 - DNA, 20 bp, mouse
ggagcacagcatggcggtca

SEQ ID NO: 589957 - DNA, 20 bp, mouse
ggcttccgagcacagcatgg

SEQ ID NO: 589958 - DNA, 20 bp, mouse
ggagctgggccgagctgtca

SEQ ID NO: 589959 - DNA, 20 bp, mouse
ggagggatcgtgagttggag

SEQ ID NO: 589960 - DNA, 20 bp, mouse
gggagaaccggggataccca

SEQ ID NO: 589961 - DNA, 20 bp, mouse
gccggagcgaagaggatgcc

SEQ ID NO: 589962 - DNA, 20 bp, mouse
gaaccaggcaaagaaagcaa

SEQ ID NO: 589963 - DNA, 20 bp, mouse
gggctcctgaggaccatggt

SEQ ID NO: 589964 - DNA, 20 bp, mouse
gcgaagaggatgcccggctg

SEQ ID NO: 589965 - DNA, 20 bp, mouse
gaggaggagggatcgtgagt

SEQ ID NO: 589966 - DNA, 20 bp, mouse
gtggattgcaccggggaccc

SEQ ID NO: 589967 - DNA, 20 bp, mouse
gcccgtcccgagcagaggtg

SEQ ID NO: 589968 - DNA, 20 bp, mouse
ggctcctggccagaccaagt

SEQ ID NO: 589969 - DNA, 20 bp, mouse
ggcggccgccaaggtaagaa

SEQ ID NO: 589970 - DNA, 20 bp, mouse
gtaccccggccgaagcatgg

SEQ ID NO: 589971 - DNA, 20 bp, mouse
gaccccggctggacccctct

SEQ ID NO: 589972 - DNA, 20 bp, mouse
gctctggttggattgcaccg

SEQ ID NO: 589973 - DNA, 20 bp, mouse
gctcaaagccgcctgtaccc

SEQ ID NO: 589974 - DNA, 20 bp, mouse
gttgagacctgctctctggt

SEQ ID NO: 589975 - DNA, 20 bp, mouse
ggacgggaagtgagtcgccg

SEQ ID NO: 589976 - DNA, 20 bp, mouse
ggcagacgactgggaagcgg

SEQ ID NO: 589977 - DNA, 20 bp, mouse
gtcagcagacgactgggaag

SEQ ID NO: 589978 - DNA, 20 bp, mouse
gctccccaacctggaagtcc

SEQ ID NO: 589979 - DNA, 20 bp, mouse
ggcggtggcgtttcctactg

SEQ ID NO: 589980 - DNA, 20 bp, mouse
ggaaggaggcggcctcccgg

SEQ ID NO: 589981 - DNA, 20 bp, mouse
ggggaagggactcagctgag

SEQ ID NO: 589982 - DNA, 20 bp, mouse
gttccgggttggcgctgcgg

SEQ ID NO: 589983 - DNA, 20 bp, mouse
gctgcacccagagggtgaat

SEQ ID NO: 589984 - DNA, 20 bp, mouse
gtgcttccgggttggcgctg

SEQ ID NO: 589985 - DNA, 20 bp, mouse
gagcgagttcgtagagagaa

SEQ ID NO: 589986 - DNA, 20 bp, mouse
gcccgagggccggacccaca

SEQ ID NO: 589987 - DNA, 20 bp, mouse
gcggacacagccaggcgcgg

SEQ ID NO: 589988 - DNA, 20 bp, mouse
gagccggacacagccaggcg

SEQ ID NO: 589989 - DNA, 20 bp, mouse
gctcaggagggagggcccga

SEQ ID NO: 589990 - DNA, 20 bp, mouse
ggggcgagccggacacagcc

SEQ ID NO: 589991 - DNA, 20 bp, mouse
ggcccagcccgggacaaccg

SEQ ID NO: 589992 - DNA, 20 bp, mouse
gcgggcgggagcgagcgagt

SEQ ID NO: 589993 - DNA, 20 bp, mouse
ggagacgcggaggttcgggc

SEQ ID NO: 589994 - DNA, 20 bp, mouse
gcgcggagcagagcagaatc

SEQ ID NO: 589995 - DNA, 20 bp, mouse
gacacaaccactggttccta

SEQ ID NO: 589996 - DNA, 20 bp, mouse
gaaaacactgggcagcacca

SEQ ID NO: 589997 - DNA, 20 bp, mouse
gtgccaacttacaaaacact

SEQ ID NO: 589998 - DNA, 20 bp, mouse
gagggccgccgcagccacca

SEQ ID NO: 589999 - DNA, 20 bp, mouse
gggctggagccggctctgac

SEQ ID NO: 590000 - DNA, 20 bp, mouse
ggctgggctcctgtcagagc

SEQ ID NO: 590001 - DNA, 20 bp, mouse
ggacgtggcgcaggtcccga

SEQ ID NO: 590002 - DNA, 20 bp, mouse
ggcagcggaggctcgggacg

SEQ ID NO: 590003 - DNA, 20 bp, mouse
gctcacgccgagacttctac

SEQ ID NO: 590004 - DNA, 20 bp, mouse
gacgcagccagtagaagtct

SEQ ID NO: 590005 - DNA, 20 bp, mouse
ggtggcgcaggtcccgatgg

SEQ ID NO: 590006 - DNA, 20 bp, mouse
gggcgcctgagtgaaaagtg

SEQ ID NO: 590007 - DNA, 20 bp, mouse
gcacgaacccgcacactctg

SEQ ID NO: 590008 - DNA, 20 bp, mouse
gcaggcgcctcagagtgtgc

SEQ ID NO: 590009 - DNA, 20 bp, mouse
ggagtgtgcgggttcgtgaa

SEQ ID NO: 590010 - DNA, 20 bp, mouse
ggttgctgctacaagaggga

SEQ ID NO: 590011 - DNA, 20 bp, mouse
gcaactggaacgaaaaggac

SEQ ID NO: 590012 - DNA, 20 bp, mouse
ggaaagtccagaggggactg

SEQ ID NO: 590013 - DNA, 20 bp, mouse
gggtgccacacttttcactc

SEQ ID NO: 590014 - DNA, 20 bp, mouse
ggatagtccagacagtctct

SEQ ID NO: 590015 - DNA, 20 bp, mouse
ggaaagttgctgctacaaga

SEQ ID NO: 590016 - DNA, 20 bp, mouse
gcagggtgaatggtcctatg

SEQ ID NO: 590017 - DNA, 20 bp, mouse
gcgatccctaaggacagcaa

SEQ ID NO: 590018 - DNA, 20 bp, mouse
gaggaccattcaccctggtc

SEQ ID NO: 590019 - DNA, 20 bp, mouse
gcacaacttgctcatcctgt

SEQ ID NO: 590020 - DNA, 20 bp, mouse
gaaactcgtgatacaatctg

SEQ ID NO: 590021 - DNA, 20 bp, mouse
gattctggaaccgatcccta

SEQ ID NO: 590022 - DNA, 20 bp, mouse
ggcaagggcaactgtactta

SEQ ID NO: 590023 - DNA, 20 bp, mouse
ggcgtgacagctctatacat

SEQ ID NO: 590024 - DNA, 20 bp, mouse
gttacggacaaggcgtttag

SEQ ID NO: 590025 - DNA, 20 bp, mouse
ggtgatacaatctgaggagc

SEQ ID NO: 590026 - DNA, 20 bp, mouse
ggagcttgaggagcccggac

SEQ ID NO: 590027 - DNA, 20 bp, mouse
gtgacacttcaggcccgtcc

SEQ ID NO: 590028 - DNA, 20 bp, mouse
gaccggcccccgagagtacc

SEQ ID NO: 590029 - DNA, 20 bp, mouse
ggctgttgggctacactgag

SEQ ID NO: 590030 - DNA, 20 bp, mouse
ggcgcctcagcagatcacat

SEQ ID NO: 590031 - DNA, 20 bp, mouse
gcgcctacgatggtgagtgg

SEQ ID NO: 590032 - DNA, 20 bp, mouse
gttgggctacactgagaggg

SEQ ID NO: 590033 - DNA, 20 bp, mouse
ggcctgaagtgtcaggtgag

SEQ ID NO: 590034 - DNA, 20 bp, mouse
ggaactgagcttgaggagcc

SEQ ID NO: 590035 - DNA, 20 bp, mouse
gttcttcccggtactctcgg

SEQ ID NO: 590036 - DNA, 20 bp, mouse
gtagcggccggagagtgcgg

SEQ ID NO: 590037 - DNA, 20 bp, mouse
gccctagcggccggagagtg

SEQ ID NO: 590038 - DNA, 20 bp, mouse
gccgctagggaataaccccc

SEQ ID NO: 590039 - DNA, 20 bp, mouse
gggtttgagtagccttgaca

SEQ ID NO: 590040 - DNA, 20 bp, mouse
gcggcggcggcccaaggctt

SEQ ID NO: 590041 - DNA, 20 bp, mouse
gtcactgcgggcgcagcagg

SEQ ID NO: 590042 - DNA, 20 bp, mouse
ggccgccatagacctcactg

SEQ ID NO: 590043 - DNA, 20 bp, mouse
gtctgacgacaccctcggga

SEQ ID NO: 590044 - DNA, 20 bp, mouse
ggcgcccgcagtgaggtcta

SEQ ID NO: 590045 - DNA, 20 bp, mouse
gctactcaaaccaaagcctt

SEQ ID NO: 590046 - DNA, 20 bp, mouse
ggccccgcccacctgaatgt

SEQ ID NO: 590047 - DNA, 20 bp, mouse
gaaggtcggcggagccgctc

SEQ ID NO: 590048 - DNA, 20 bp, mouse
gctgaatgtaggtgaaaggt

SEQ ID NO: 590049 - DNA, 20 bp, mouse
gtcagaaaggcagcacctcg

SEQ ID NO: 590050 - DNA, 20 bp, mouse
gtgtcagctccgggcagtct

SEQ ID NO: 590051 - DNA, 20 bp, mouse
gtcctggctggcggcttcgg

SEQ ID NO: 590052 - DNA, 20 bp, mouse
gtcttgctccgctgcccgag

SEQ ID NO: 590053 - DNA, 20 bp, mouse
ggagcaagaccaagactgcc

SEQ ID NO: 590054 - DNA, 20 bp, mouse
gaatgtaggtgaaaggtcgg

SEQ ID NO: 590055 - DNA, 20 bp, mouse
gctttcacctacattcaggt

SEQ ID NO: 590056 - DNA, 20 bp, mouse
gggctcgagcttcaagatag

SEQ ID NO: 590057 - DNA, 20 bp, mouse
gagacttgacctagctcggt

SEQ ID NO: 590058 - DNA, 20 bp, mouse
ggagcctgacccaccgagct

SEQ ID NO: 590059 - DNA, 20 bp, mouse
gttccaccggggcaccggag

SEQ ID NO: 590060 - DNA, 20 bp, mouse
gccttcagaggagctcgctc

SEQ ID NO: 590061 - DNA, 20 bp, mouse
ggacggggcccggtctccat

SEQ ID NO: 590062 - DNA, 20 bp, mouse
gcatcggcggcggccttcag

SEQ ID NO: 590063 - DNA, 20 bp, mouse
gtgacctagctcggtgggtc

SEQ ID NO: 590064 - DNA, 20 bp, mouse
gctccgcagtaggtctcgat

SEQ ID NO: 590065 - DNA, 20 bp, mouse
gttcagccccaggaccgacg

SEQ ID NO: 590066 - DNA, 20 bp, mouse
gcacagcggggaagcgatcc

SEQ ID NO: 590067 - DNA, 20 bp, mouse
ggggcgccacgggaaatgac

SEQ ID NO: 590068 - DNA, 20 bp, mouse
ggcgcgcggggcctgcacct

SEQ ID NO: 590069 - DNA, 20 bp, mouse
ggagacgcgcctccccgcct

SEQ ID NO: 590070 - DNA, 20 bp, mouse
gggcctgcacctaggcgggg

SEQ ID NO: 590071 - DNA, 20 bp, mouse
ggagcccactggacttgcgt

SEQ ID NO: 590072 - DNA, 20 bp, mouse
ggcagagccgggaccgagca

SEQ ID NO: 590073 - DNA, 20 bp, mouse
gggcggagcctgaacctaat

SEQ ID NO: 590074 - DNA, 20 bp, mouse
gcggggcctgcacctaggcg

SEQ ID NO: 590075 - DNA, 20 bp, mouse
ggctagccggtcatttcccg

SEQ ID NO: 590076 - DNA, 20 bp, mouse
ggctcggccccgcactgaag

SEQ ID NO: 590077 - DNA, 20 bp, mouse
gaagaggctgcggtgcgggt

SEQ ID NO: 590078 - DNA, 20 bp, mouse
gcactgaagaggctgcggtg

SEQ ID NO: 590079 - DNA, 20 bp, mouse
ggggaagggaacctagacag

SEQ ID NO: 590080 - DNA, 20 bp, mouse
gctcaagcgacgcggagcgg

SEQ ID NO: 590081 - DNA, 20 bp, mouse
gccgtagccgcggcattaag

SEQ ID NO: 590082 - DNA, 20 bp, mouse
gctttgtggggaccccgggg

SEQ ID NO: 590083 - DNA, 20 bp, mouse
gaagggaacctagacagagg

SEQ ID NO: 590084 - DNA, 20 bp, mouse
ggccagacgcgggtggacag

SEQ ID NO: 590085 - DNA, 20 bp, mouse
gctatgggcagcgaccaccg

SEQ ID NO: 590086 - DNA, 20 bp, mouse
gaagtcaccgtgagctggtg

SEQ ID NO: 590087 - DNA, 20 bp, mouse
gatcgcgccccaccagctca

SEQ ID NO: 590088 - DNA, 20 bp, mouse
gccagcgcagcatggtcccg

SEQ ID NO: 590089 - DNA, 20 bp, mouse
ggtggggcgcgatccgagtg

SEQ ID NO: 590090 - DNA, 20 bp, mouse
gcagctcacggtgacttccc

SEQ ID NO: 590091 - DNA, 20 bp, mouse
gggccgccgccccaccccac

SEQ ID NO: 590092 - DNA, 20 bp, mouse
ggccaggacgcggaggaggt

SEQ ID NO: 590093 - DNA, 20 bp, mouse
gatcccgctgggccaggacg

SEQ ID NO: 590094 - DNA, 20 bp, mouse
gccgagtgcggaggcctgtg

SEQ ID NO: 590095 - DNA, 20 bp, mouse
gtccgcgtcgtggcaggcgg

SEQ ID NO: 590096 - DNA, 20 bp, mouse
gccggacgccgggctgaagg

SEQ ID NO: 590097 - DNA, 20 bp, mouse
gcaggagagcgacccgagcg

SEQ ID NO: 590098 - DNA, 20 bp, mouse
gcccgagcgcggaagcacgc

SEQ ID NO: 590099 - DNA, 20 bp, mouse
ggccggccgactggagggag

SEQ ID NO: 590100 - DNA, 20 bp, mouse
gagcccgcgctcgctgtctg

SEQ ID NO: 590101 - DNA, 20 bp, mouse
gtgtctggaagaggctccac

SEQ ID NO: 590102 - DNA, 20 bp, mouse
gctcgctgtctgaggaaagc

SEQ ID NO: 590103 - DNA, 20 bp, mouse
gcttctgtaggggacccgtg

SEQ ID NO: 590104 - DNA, 20 bp, mouse
ggagaagccggccgactgga

SEQ ID NO: 590105 - DNA, 20 bp, mouse
gttcctcagacagcgagcgc

SEQ ID NO: 590106 - DNA, 20 bp, mouse
ggatgggcacatacaggcac

SEQ ID NO: 590107 - DNA, 20 bp, mouse
gtagtacttgctcctggcgg

SEQ ID NO: 590108 - DNA, 20 bp, mouse
gcccggcgatgggcacatac

SEQ ID NO: 590109 - DNA, 20 bp, mouse
gactagcagaagtcaagagt

SEQ ID NO: 590110 - DNA, 20 bp, mouse
ggctgagtgggtgccatgag

SEQ ID NO: 590111 - DNA, 20 bp, mouse
ggctagtttcctgggaatac

SEQ ID NO: 590112 - DNA, 20 bp, mouse
gtctgagccgccccggcgat

SEQ ID NO: 590113 - DNA, 20 bp, mouse
gagcaggtctgtatgctgag

SEQ ID NO: 590114 - DNA, 20 bp, mouse
gtatctggtgctagtttcct

SEQ ID NO: 590115 - DNA, 20 bp, mouse
gttctgctagtacttgctcc

SEQ ID NO: 590116 - DNA, 20 bp, mouse
gatatcccgccccaacatgg

SEQ ID NO: 590117 - DNA, 20 bp, mouse
gtccatatcccgccccaaca

SEQ ID NO: 590118 - DNA, 20 bp, mouse
gggtgctgacttaaagagct

SEQ ID NO: 590119 - DNA, 20 bp, mouse
gtggcggcgttgggagacca

SEQ ID NO: 590120 - DNA, 20 bp, mouse
gagctgggcgccgccatgtt

SEQ ID NO: 590121 - DNA, 20 bp, mouse
ggcttaaacccggaagaaag

SEQ ID NO: 590122 - DNA, 20 bp, mouse
gtatggagcaactacttccg

SEQ ID NO: 590123 - DNA, 20 bp, mouse
gaccaagcctagagacgtct

SEQ ID NO: 590124 - DNA, 20 bp, mouse
ggtgaagcccggcgcgtcca

SEQ ID NO: 590125 - DNA, 20 bp, mouse
gccagcgaggccgtgaagcc

SEQ ID NO: 590126 - DNA, 20 bp, mouse
ggaccggtccagctaccagg

SEQ ID NO: 590127 - DNA, 20 bp, mouse
gggtccagctaccaggcggg

SEQ ID NO: 590128 - DNA, 20 bp, mouse
gccggaccggtccagctacc

SEQ ID NO: 590129 - DNA, 20 bp, mouse
gtcctgacctgacctctctc

SEQ ID NO: 590130 - DNA, 20 bp, mouse
gtttcagcccgagagaggtc

SEQ ID NO: 590131 - DNA, 20 bp, mouse
gcctttgcagagcgtaataa

SEQ ID NO: 590132 - DNA, 20 bp, mouse
ggctcacgcagagatggccc

SEQ ID NO: 590133 - DNA, 20 bp, mouse
gctctcgggctgaaaagggg

SEQ ID NO: 590134 - DNA, 20 bp, mouse
gcctctctcgggctgaaaag

SEQ ID NO: 590135 - DNA, 20 bp, mouse
ggcagcaagtcaggaccact

SEQ ID NO: 590136 - DNA, 20 bp, mouse
ggcgcggcccagagagcccg

SEQ ID NO: 590137 - DNA, 20 bp, mouse
gctctgggccgcgcctgagg

SEQ ID NO: 590138 - DNA, 20 bp, mouse
ggcgcctgaggcggacgcaa

SEQ ID NO: 590139 - DNA, 20 bp, mouse
ggctctctgggccgcgcctg

SEQ ID NO: 590140 - DNA, 20 bp, mouse
ggccccgttgcgtccgcctc

SEQ ID NO: 590141 - DNA, 20 bp, mouse
gggcctatcagccccctgta

SEQ ID NO: 590142 - DNA, 20 bp, mouse
ggtcggcgctgctggacggg

SEQ ID NO: 590143 - DNA, 20 bp, mouse
gtgctccaggatccctgcca

SEQ ID NO: 590144 - DNA, 20 bp, mouse
gggagtcggcgctgctggac

SEQ ID NO: 590145 - DNA, 20 bp, mouse
gccagagagcccggggcctc

SEQ ID NO: 590146 - DNA, 20 bp, mouse
gccggcaagctggacgccag

SEQ ID NO: 590147 - DNA, 20 bp, mouse
gagcggtgcgaggtgaggcc

SEQ ID NO: 590148 - DNA, 20 bp, mouse
ggtgcgagcggtgcgaggtg

SEQ ID NO: 590149 - DNA, 20 bp, mouse
gtcctagaaaagcactcccc

SEQ ID NO: 590150 - DNA, 20 bp, mouse
gtccagtcgcctccccgacc

SEQ ID NO: 590151 - DNA, 20 bp, mouse
ggctgcgggaagggatcagt

SEQ ID NO: 590152 - DNA, 20 bp, mouse
gtcggcctcagcccccgcgg

SEQ ID NO: 590153 - DNA, 20 bp, mouse
ggcactcagtgcgcacggaa

SEQ ID NO: 590154 - DNA, 20 bp, mouse
ggccgacggggcggtgcgag

SEQ ID NO: 590155 - DNA, 20 bp, mouse
ggcgggggctgaggccgacg

SEQ ID NO: 590156 - DNA, 20 bp, mouse
ggaagctgtgacctcctcaa

SEQ ID NO: 590157 - DNA, 20 bp, mouse
gttcgggccgggaggacatt

SEQ ID NO: 590158 - DNA, 20 bp, mouse
gcagaggccgaatgtcctcc

SEQ ID NO: 590159 - DNA, 20 bp, mouse
gggcggaggtgagagagacc

SEQ ID NO: 590160 - DNA, 20 bp, mouse
gagggcacggatcttcgggc

SEQ ID NO: 590161 - DNA, 20 bp, mouse
ggaacacccaaccgctcgct

SEQ ID NO: 590162 - DNA, 20 bp, mouse
gcacggtgacgccgcgcgaa

SEQ ID NO: 590163 - DNA, 20 bp, mouse
gtgacgccgcgcgaagggca

SEQ ID NO: 590164 - DNA, 20 bp, mouse
gcgcgaagggcacggatctt

SEQ ID NO: 590165 - DNA, 20 bp, mouse
gcggcgccgggcaatgtcac

SEQ ID NO: 590166 - DNA, 20 bp, mouse
gcggccgggaactcaccccg

SEQ ID NO: 590167 - DNA, 20 bp, mouse
gggctccgaggagtagcagg

SEQ ID NO: 590168 - DNA, 20 bp, mouse
gcccgcaccgaggtgctccc

SEQ ID NO: 590169 - DNA, 20 bp, mouse
gcagccgcctgggagcacct

SEQ ID NO: 590170 - DNA, 20 bp, mouse
gggagccagtgcagccgcct

SEQ ID NO: 590171 - DNA, 20 bp, mouse
ggcctgggagcacctcggtg

SEQ ID NO: 590172 - DNA, 20 bp, mouse
gactggctccgaggagtagc

SEQ ID NO: 590173 - DNA, 20 bp, mouse
gccgggaactcaccccgcgg

SEQ ID NO: 590174 - DNA, 20 bp, mouse
gtgctcccaggcggctgcac

SEQ ID NO: 590175 - DNA, 20 bp, mouse
ggagcacctcggtgcgggag

SEQ ID NO: 590176 - DNA, 20 bp, mouse
gcgccagggtaaagctgaag

SEQ ID NO: 590177 - DNA, 20 bp, mouse
gcaacactcaagcgacactg

SEQ ID NO: 590178 - DNA, 20 bp, mouse
ggccctgaggcgcgctacaa

SEQ ID NO: 590179 - DNA, 20 bp, mouse
ggcggtgtcgaagacagctg

SEQ ID NO: 590180 - DNA, 20 bp, mouse
gacatgttggacagaggacc

SEQ ID NO: 590181 - DNA, 20 bp, mouse
gtgtcgcttgagtgttggtg

SEQ ID NO: 590182 - DNA, 20 bp, mouse
ggccttagcatcccatacac

SEQ ID NO: 590183 - DNA, 20 bp, mouse
gcgggcaaccggacacctgc

SEQ ID NO: 590184 - DNA, 20 bp, mouse
gcgttcgacatgttggacag

SEQ ID NO: 590185 - DNA, 20 bp, mouse
gagcgcccgctttcccgcca

SEQ ID NO: 590186 - DNA, 20 bp, mouse
gtgcaggcaagtcacacccg

SEQ ID NO: 590187 - DNA, 20 bp, mouse
gaggacgcgagcccacttcc

SEQ ID NO: 590188 - DNA, 20 bp, mouse
ggtccggtacgagaacctgg

SEQ ID NO: 590189 - DNA, 20 bp, mouse
gttgcctgcagcagcgtccc

SEQ ID NO: 590190 - DNA, 20 bp, mouse
ggagcccgggacgctgctgc

SEQ ID NO: 590191 - DNA, 20 bp, mouse
ggcgagcccacttccgggac

SEQ ID NO: 590192 - DNA, 20 bp, mouse
gtcacacccgcggcaaagcg

SEQ ID NO: 590193 - DNA, 20 bp, mouse
gcgggctccggtcccggaag

SEQ ID NO: 590194 - DNA, 20 bp, mouse
gccgcggcaaagcggggagt

SEQ ID NO: 590195 - DNA, 20 bp, mouse
ggcccggggcctggaaccgc

SEQ ID NO: 590196 - DNA, 20 bp, mouse
ggtcgcgcccggccagtcag

SEQ ID NO: 590197 - DNA, 20 bp, mouse
gggccagtcagcggcctctg

SEQ ID NO: 590198 - DNA, 20 bp, mouse
gacgcagggggagaaggccg

SEQ ID NO: 590199 - DNA, 20 bp, mouse
gtggcttcgctgccttcctc

SEQ ID NO: 590200 - DNA, 20 bp, mouse
gccaaggccacggcacgcag

SEQ ID NO: 590201 - DNA, 20 bp, mouse
gcgccgcagaggccgctgac

SEQ ID NO: 590202 - DNA, 20 bp, mouse
ggtcggcggctgcctgagga

SEQ ID NO: 590203 - DNA, 20 bp, mouse
gcggctggaaagcgccgcag

SEQ ID NO: 590204 - DNA, 20 bp, mouse
ggctgaggcgagagcagctc

SEQ ID NO: 590205 - DNA, 20 bp, mouse
gcgctaggctctctgcctag

SEQ ID NO: 590206 - DNA, 20 bp, mouse
gggccagcaccatgtctaga

SEQ ID NO: 590207 - DNA, 20 bp, mouse
gcagggctggggatcaaagg

SEQ ID NO: 590208 - DNA, 20 bp, mouse
gtcacagggctggggatcaa

SEQ ID NO: 590209 - DNA, 20 bp, mouse
ggatctctgccctctagaca

SEQ ID NO: 590210 - DNA, 20 bp, mouse
gcagccctgtgaccatgcag

SEQ ID NO: 590211 - DNA, 20 bp, mouse
ggctatagatggtagtctct

SEQ ID NO: 590212 - DNA, 20 bp, mouse
gcagagatcctgccactggc

SEQ ID NO: 590213 - DNA, 20 bp, mouse
ggctatggggcctgcagaag

SEQ ID NO: 590214 - DNA, 20 bp, mouse
gtgtacctctgcatggtcac

SEQ ID NO: 590215 - DNA, 20 bp, mouse
gtctaccagggcctcatgaa

SEQ ID NO: 590216 - DNA, 20 bp, mouse
gtacccgaggtagtctgcag

SEQ ID NO: 590217 - DNA, 20 bp, mouse
ggctagagcacctttacccg

SEQ ID NO: 590218 - DNA, 20 bp, mouse
gggcctctgcagactacctc

SEQ ID NO: 590219 - DNA, 20 bp, mouse
gaggccgggcggccactctc

SEQ ID NO: 590220 - DNA, 20 bp, mouse
gcgttccaaggacccgagag

SEQ ID NO: 590221 - DNA, 20 bp, mouse
gaagcgtggcaaagtagctg

SEQ ID NO: 590222 - DNA, 20 bp, mouse
ggctctggtacccccatcct

SEQ ID NO: 590223 - DNA, 20 bp, mouse
ggctcttggagagtccccat

SEQ ID NO: 590224 - DNA, 20 bp, mouse
gggtgggaatgcctaggatg

SEQ ID NO: 590225 - DNA, 20 bp, mouse
gttccggctaagaataagcg

SEQ ID NO: 590226 - DNA, 20 bp, mouse
ggcagtccgacggagctcgc

SEQ ID NO: 590227 - DNA, 20 bp, mouse
gccccagcgaccttaccccc

SEQ ID NO: 590228 - DNA, 20 bp, mouse
gcggtactgcgcgacagcgg

SEQ ID NO: 590229 - DNA, 20 bp, mouse
gctgctccagcgagctccgt

SEQ ID NO: 590230 - DNA, 20 bp, mouse
gcgcaaaccggggcaggcaa

SEQ ID NO: 590231 - DNA, 20 bp, mouse
gccagtcgtgcgggacgggg

SEQ ID NO: 590232 - DNA, 20 bp, mouse
gagtgagagtcgtgaggagt

SEQ ID NO: 590233 - DNA, 20 bp, mouse
ggccagcagcaaaggcgcag

SEQ ID NO: 590234 - DNA, 20 bp, mouse
gctgcgcagtgagagtcgtg

SEQ ID NO: 590235 - DNA, 20 bp, mouse
gcaaggtcgcccgcgaacgt

SEQ ID NO: 590236 - DNA, 20 bp, mouse
ggtcagccgccgcaacccgg

SEQ ID NO: 590237 - DNA, 20 bp, mouse
ggggctggggtggagccgag

SEQ ID NO: 590238 - DNA, 20 bp, mouse
gccaatagctggagaagaag

SEQ ID NO: 590239 - DNA, 20 bp, mouse
gctcctcccccgggttgcgg

SEQ ID NO: 590240 - DNA, 20 bp, mouse
gcggcggctgacgccatggc

SEQ ID NO: 590241 - DNA, 20 bp, mouse
gctgacgccatggcgggctg

SEQ ID NO: 590242 - DNA, 20 bp, mouse
gggccagaagcaccaatagc

SEQ ID NO: 590243 - DNA, 20 bp, mouse
gtagctggagaagaagaggc

SEQ ID NO: 590244 - DNA, 20 bp, mouse
gctgcgggccggaggatgga

SEQ ID NO: 590245 - DNA, 20 bp, mouse
gaagtgggaacctcctcccc

SEQ ID NO: 590246 - DNA, 20 bp, mouse
gcggcgactgagaggctccg

SEQ ID NO: 590247 - DNA, 20 bp, mouse
gtctcgggtaatgagacctg

SEQ ID NO: 590248 - DNA, 20 bp, mouse
gatgagacctgaggccgggc

SEQ ID NO: 590249 - DNA, 20 bp, mouse
gggacgggagcggcattgtg

SEQ ID NO: 590250 - DNA, 20 bp, mouse
gagcggctcgatgtttccgg

SEQ ID NO: 590251 - DNA, 20 bp, mouse
gcccggccccggcgactgag

SEQ ID NO: 590252 - DNA, 20 bp, mouse
gggcagcgcagccaacccga

SEQ ID NO: 590253 - DNA, 20 bp, mouse
gacatcgagccgcttgtctc

SEQ ID NO: 590254 - DNA, 20 bp, mouse
gtcgcaggatgtagaggaca

SEQ ID NO: 590255 - DNA, 20 bp, mouse
gcgcagccaacccgacggaa

SEQ ID NO: 590256 - DNA, 20 bp, mouse
ggctcccggagactgagcct

SEQ ID NO: 590257 - DNA, 20 bp, mouse
gtaaggacagggctgaaggt

SEQ ID NO: 590258 - DNA, 20 bp, mouse
gttgaagtaagttaaggaca

SEQ ID NO: 590259 - DNA, 20 bp, mouse
ggtctccgggagccttgctg

SEQ ID NO: 590260 - DNA, 20 bp, mouse
gtaagagttgaagtaagtta

SEQ ID NO: 590261 - DNA, 20 bp, mouse
gggcaagcccgaggcctgaa

SEQ ID NO: 590262 - DNA, 20 bp, mouse
gaagtcagaatcccccagca

SEQ ID NO: 590263 - DNA, 20 bp, mouse
gccgaggcctgaagggtgac

SEQ ID NO: 590264 - DNA, 20 bp, mouse
gtgccagcaggggctctcag

SEQ ID NO: 590265 - DNA, 20 bp, mouse
gggggcctaggctcagtctc

SEQ ID NO: 590266 - DNA, 20 bp, mouse
ggcacgcgcggaccctgcac

SEQ ID NO: 590267 - DNA, 20 bp, mouse
ggggcctggcgggcccatag

SEQ ID NO: 590268 - DNA, 20 bp, mouse
gcgtggcgcggcgcaaggac

SEQ ID NO: 590269 - DNA, 20 bp, mouse
gcagcggccgcccgggagag

SEQ ID NO: 590270 - DNA, 20 bp, mouse
ggtctcaccgctctcccggg

SEQ ID NO: 590271 - DNA, 20 bp, mouse
gccggtctcaccgctctccc

SEQ ID NO: 590272 - DNA, 20 bp, mouse
gaccggccgcggagccgcta

SEQ ID NO: 590273 - DNA, 20 bp, mouse
ggcggaccctgcaccggccg

SEQ ID NO: 590274 - DNA, 20 bp, mouse
ggggcggccgctgtgcgaag

SEQ ID NO: 590275 - DNA, 20 bp, mouse
gttgcgccgcgccacgccag

SEQ ID NO: 590276 - DNA, 20 bp, mouse
gtgcagggacggattcgggg

SEQ ID NO: 590277 - DNA, 20 bp, mouse
ggcggtgcctggccgggcgt

SEQ ID NO: 590278 - DNA, 20 bp, mouse
gtcgtgcagggacggattcg

SEQ ID NO: 590279 - DNA, 20 bp, mouse
ggtaggcaagagcaaacgag

SEQ ID NO: 590280 - DNA, 20 bp, mouse
gcgagccggggatataagga

SEQ ID NO: 590281 - DNA, 20 bp, mouse
ggatacaggtccagcgtcag

SEQ ID NO: 590282 - DNA, 20 bp, mouse
gccttcgcgtcgtgcaggga

SEQ ID NO: 590283 - DNA, 20 bp, mouse
gacgccgagccggggatata

SEQ ID NO: 590284 - DNA, 20 bp, mouse
gtataaggagggctgcggtc

SEQ ID NO: 590285 - DNA, 20 bp, mouse
gctcttgcctacgcccggcc

SEQ ID NO: 590286 - DNA, 20 bp, mouse
gacactccaagtatgcagag

SEQ ID NO: 590287 - DNA, 20 bp, mouse
gccggaactcgaggaggacg

SEQ ID NO: 590288 - DNA, 20 bp, mouse
gccacgaggtgaagcctccg

SEQ ID NO: 590289 - DNA, 20 bp, mouse
ggggctgcgagagtcggatc

SEQ ID NO: 590290 - DNA, 20 bp, mouse
gcggctccgctctgcatact

SEQ ID NO: 590291 - DNA, 20 bp, mouse
gcaaggtcggcgggagccca

SEQ ID NO: 590292 - DNA, 20 bp, mouse
ggcaggtgatgtcgaccacg

SEQ ID NO: 590293 - DNA, 20 bp, mouse
ggggcgtggtcagcatccgg

SEQ ID NO: 590294 - DNA, 20 bp, mouse
gtggacgcggttagcctcgg

SEQ ID NO: 590295 - DNA, 20 bp, mouse
gaggtcccgggtggccgcgg

SEQ ID NO: 590296 - DNA, 20 bp, mouse
gcccagaggacgctgagact

SEQ ID NO: 590297 - DNA, 20 bp, mouse
gagccagatagacgccccag

SEQ ID NO: 590298 - DNA, 20 bp, mouse
ggtcctctggggcgtctatc

SEQ ID NO: 590299 - DNA, 20 bp, mouse
gactatgggagtccatctcg

SEQ ID NO: 590300 - DNA, 20 bp, mouse
gtctggctcccagctggaag

SEQ ID NO: 590301 - DNA, 20 bp, mouse
gatgctgagttacctcgaga

SEQ ID NO: 590302 - DNA, 20 bp, mouse
gtccagccttgcggtttagg

SEQ ID NO: 590303 - DNA, 20 bp, mouse
gtcccagtctcagcgtcctc

SEQ ID NO: 590304 - DNA, 20 bp, mouse
gtaaccagccacttccagct

SEQ ID NO: 590305 - DNA, 20 bp, mouse
gcatagttgctgaaggatta

SEQ ID NO: 590306 - DNA, 20 bp, mouse
gcagcagcggcgacgcgtcc

SEQ ID NO: 590307 - DNA, 20 bp, mouse
gcttggcgcctgcactcctt

SEQ ID NO: 590308 - DNA, 20 bp, mouse
gagcggcgacgcgtccgggc

SEQ ID NO: 590309 - DNA, 20 bp, mouse
gggcaggtgagcgcgaccca

SEQ ID NO: 590310 - DNA, 20 bp, mouse
gagcgcgacccaaggagtgc

SEQ ID NO: 590311 - DNA, 20 bp, mouse
gacaggggttgtcactctca

SEQ ID NO: 590312 - DNA, 20 bp, mouse
gcagtgtcgcgagcgtggag

SEQ ID NO: 590313 - DNA, 20 bp, mouse
gcgaggacgcgcgaaacaca

SEQ ID NO: 590314 - DNA, 20 bp, mouse
gggccaccttggcctcacag

SEQ ID NO: 590315 - DNA, 20 bp, mouse
gggcagctcggtgtgaaatt

SEQ ID NO: 590316 - DNA, 20 bp, mouse
ggcacgggcctgggtcagga

SEQ ID NO: 590317 - DNA, 20 bp, mouse
ggcccagggcaccagccacg

SEQ ID NO: 590318 - DNA, 20 bp, mouse
gtggtgccctgggctcgcgg

SEQ ID NO: 590319 - DNA, 20 bp, mouse
gctgggtcaggatggctacg

SEQ ID NO: 590320 - DNA, 20 bp, mouse
gaactgcccccgcgagccca

SEQ ID NO: 590321 - DNA, 20 bp, mouse
gtggctacgtggagacggga

SEQ ID NO: 590322 - DNA, 20 bp, mouse
ggcaccagccacgaggtggc

SEQ ID NO: 590323 - DNA, 20 bp, mouse
gacctcgtggctggtgccct

SEQ ID NO: 590324 - DNA, 20 bp, mouse
gggtgcaaagccactccctg

SEQ ID NO: 590325 - DNA, 20 bp, mouse
gagccacgaggtggccggca

SEQ ID NO: 590326 - DNA, 20 bp, mouse
gtcccagcgacagccagact

SEQ ID NO: 590327 - DNA, 20 bp, mouse
gggcaataccgggatcccag

SEQ ID NO: 590328 - DNA, 20 bp, mouse
gggactggaggatagcgcgg

SEQ ID NO: 590329 - DNA, 20 bp, mouse
gggaagatgcgaaccgagtc

SEQ ID NO: 590330 - DNA, 20 bp, mouse
ggctagagaagcctgacgag

SEQ ID NO: 590331 - DNA, 20 bp, mouse
gccaggacgagatgcctcgg

SEQ ID NO: 590332 - DNA, 20 bp, mouse
ggagggaggaggcttagatt

SEQ ID NO: 590333 - DNA, 20 bp, mouse
gggagtcccagtctcagacg

SEQ ID NO: 590334 - DNA, 20 bp, mouse
gctgggactggaggatagcg

SEQ ID NO: 590335 - DNA, 20 bp, mouse
gaaggttcaacctgtcgagg

SEQ ID NO: 590336 - DNA, 20 bp, mouse
gtcggagtaccagttcccac

SEQ ID NO: 590337 - DNA, 20 bp, mouse
gggagcccagaaaatgcccg

SEQ ID NO: 590338 - DNA, 20 bp, mouse
gtctgggctcctgtgggaac

SEQ ID NO: 590339 - DNA, 20 bp, mouse
gtcttccacgggcattttct

SEQ ID NO: 590340 - DNA, 20 bp, mouse
gggacagccggagagatcaa

SEQ ID NO: 590341 - DNA, 20 bp, mouse
ggtgcacccattgacaggta

SEQ ID NO: 590342 - DNA, 20 bp, mouse
ggcattttctgggctcctgt

SEQ ID NO: 590343 - DNA, 20 bp, mouse
gatgcccgtggaagagtttg

SEQ ID NO: 590344 - DNA, 20 bp, mouse
ggtactccgagcaggcccgc

SEQ ID NO: 590345 - DNA, 20 bp, mouse
gcttctgggaatggccaagg

SEQ ID NO: 590346 - DNA, 20 bp, mouse
gaggcggacgaggacgagag

SEQ ID NO: 590347 - DNA, 20 bp, mouse
gtcagtctccggacgcgcag

SEQ ID NO: 590348 - DNA, 20 bp, mouse
ggactgacaaccggaagtca

SEQ ID NO: 590349 - DNA, 20 bp, mouse
ggacgagagaggccggccca

SEQ ID NO: 590350 - DNA, 20 bp, mouse
gtccggacgcgcagcggctg

SEQ ID NO: 590351 - DNA, 20 bp, mouse
ggcgtccggagactgacaac

SEQ ID NO: 590352 - DNA, 20 bp, mouse
ggtggaggcctgggctccgt

SEQ ID NO: 590353 - DNA, 20 bp, mouse
gcatctcggacaggcggacg

SEQ ID NO: 590354 - DNA, 20 bp, mouse
gaggccggcccacggagccc

SEQ ID NO: 590355 - DNA, 20 bp, mouse
gacttccggttgtcagtctc

SEQ ID NO: 590356 - DNA, 20 bp, mouse
ggccccagcaacaaaatcca

SEQ ID NO: 590357 - DNA, 20 bp, mouse
ggtggcattggcagtaacac

SEQ ID NO: 590358 - DNA, 20 bp, mouse
ggagccggccagtgtggcat

SEQ ID NO: 590359 - DNA, 20 bp, mouse
ggacagcacagaaaatgaga

SEQ ID NO: 590360 - DNA, 20 bp, mouse
gttgtaggagccggccagtg

SEQ ID NO: 590361 - DNA, 20 bp, mouse
gagggtttgagcagatccat

SEQ ID NO: 590362 - DNA, 20 bp, mouse
gccctgcgaacagaactcct

SEQ ID NO: 590363 - DNA, 20 bp, mouse
gtaagatctgcaggatttgt

SEQ ID NO: 590364 - DNA, 20 bp, mouse
gaagccaggaatctctagac

SEQ ID NO: 590365 - DNA, 20 bp, mouse
gagcaggaacttgaccctgt

SEQ ID NO: 590366 - DNA, 20 bp, mouse
gggcatggccccaccggatc

SEQ ID NO: 590367 - DNA, 20 bp, mouse
ggtttagagaagaacttgca

SEQ ID NO: 590368 - DNA, 20 bp, mouse
gagcgcgggtggctggaact

SEQ ID NO: 590369 - DNA, 20 bp, mouse
gtgtagcgccggctgcggga

SEQ ID NO: 590370 - DNA, 20 bp, mouse
gtcgctgacagcccgagcgc

SEQ ID NO: 590371 - DNA, 20 bp, mouse
gctgacagcccgagcgcggg

SEQ ID NO: 590372 - DNA, 20 bp, mouse
gtcgggctgtcagcgaatga

SEQ ID NO: 590373 - DNA, 20 bp, mouse
ggtgtcgggcatggccccac

SEQ ID NO: 590374 - DNA, 20 bp, mouse
gcccccacccccgcaccaca

SEQ ID NO: 590375 - DNA, 20 bp, mouse
gaagctgcccatgaccgaca

SEQ ID NO: 590376 - DNA, 20 bp, mouse
gaggcgctcagggccatccc

SEQ ID NO: 590377 - DNA, 20 bp, mouse
ggtaccctagcggaaaagtg

SEQ ID NO: 590378 - DNA, 20 bp, mouse
gaggtacgttctgagatcga

SEQ ID NO: 590379 - DNA, 20 bp, mouse
gtggctgccgctatataagt

SEQ ID NO: 590380 - DNA, 20 bp, mouse
gaaatggccgacttatatag

SEQ ID NO: 590381 - DNA, 20 bp, mouse
gaaggatctgcacagaaagg

SEQ ID NO: 590382 - DNA, 20 bp, mouse
gcggcacagagaactaggat

SEQ ID NO: 590383 - DNA, 20 bp, mouse
gttctgagatcgaggggccc

SEQ ID NO: 590384 - DNA, 20 bp, mouse
gcgcaagtggtcgggaccag

SEQ ID NO: 590385 - DNA, 20 bp, mouse
gctgtctagcccggatttag

SEQ ID NO: 590386 - DNA, 20 bp, mouse
gcgtgggtgagtcctgggtg

SEQ ID NO: 590387 - DNA, 20 bp, mouse
gagcttcgggccagagagaa

SEQ ID NO: 590388 - DNA, 20 bp, mouse
gccgggccgtgggtgagtcc

SEQ ID NO: 590389 - DNA, 20 bp, mouse
gactggtccgacccaggcag

SEQ ID NO: 590390 - DNA, 20 bp, mouse
gccggaccggacgcagtaca

SEQ ID NO: 590391 - DNA, 20 bp, mouse
gccactcggggaggacggag

SEQ ID NO: 590392 - DNA, 20 bp, mouse
gagcgcgccgcagcaccaca

SEQ ID NO: 590393 - DNA, 20 bp, mouse
gggcttgcgccccgggccgt

SEQ ID NO: 590394 - DNA, 20 bp, mouse
gagggaggcgcccacagctc

SEQ ID NO: 590395 - DNA, 20 bp, mouse
ggcgcagactggtccgaccc

SEQ ID NO: 590396 - DNA, 20 bp, mouse
ggctaatgcctgccagaggg

SEQ ID NO: 590397 - DNA, 20 bp, mouse
gtctagcaggttcccccctc

SEQ ID NO: 590398 - DNA, 20 bp, mouse
gggatgctaatgcctgccag

SEQ ID NO: 590399 - DNA, 20 bp, mouse
gtggtcgcaaagcatcggag

SEQ ID NO: 590400 - DNA, 20 bp, mouse
ggccaatcagctgttcgcag

SEQ ID NO: 590401 - DNA, 20 bp, mouse
gcggcctccctgcaaagcct

SEQ ID NO: 590402 - DNA, 20 bp, mouse
gtcctggcccaggctttgca

SEQ ID NO: 590403 - DNA, 20 bp, mouse
gccccttcccccctatacaa

SEQ ID NO: 590404 - DNA, 20 bp, mouse
ggcacctaggcagtatgggt

SEQ ID NO: 590405 - DNA, 20 bp, mouse
gtgccgcagccccctctagc

SEQ ID NO: 590406 - DNA, 20 bp, mouse
gtaagtgctacggtcttcag

SEQ ID NO: 590407 - DNA, 20 bp, mouse
gatcgtccagcaggagaccg

SEQ ID NO: 590408 - DNA, 20 bp, mouse
ggccctgggtgtaagtgcta

SEQ ID NO: 590409 - DNA, 20 bp, mouse
gcggtcttcaggggtcgtgg

SEQ ID NO: 590410 - DNA, 20 bp, mouse
gcattctggcaggcctcgga

SEQ ID NO: 590411 - DNA, 20 bp, mouse
gcacttacacccagggccac

SEQ ID NO: 590412 - DNA, 20 bp, mouse
gaccgtagcacttacaccca

SEQ ID NO: 590413 - DNA, 20 bp, mouse
gctacggtcttcaggggtcg

SEQ ID NO: 590414 - DNA, 20 bp, mouse
gacatcacggagctcaggga

SEQ ID NO: 590415 - DNA, 20 bp, mouse
gtcaggggtcgtggcggcca

SEQ ID NO: 590416 - DNA, 20 bp, mouse
gaaggctttgcaatatccag

SEQ ID NO: 590417 - DNA, 20 bp, mouse
ggttaagccagagtgattgg

SEQ ID NO: 590418 - DNA, 20 bp, mouse
ggctgatcctccaatcactc

SEQ ID NO: 590419 - DNA, 20 bp, mouse
gggggcagcagtttgctggt

SEQ ID NO: 590420 - DNA, 20 bp, mouse
gcacctctgaggctgatctg

SEQ ID NO: 590421 - DNA, 20 bp, mouse
gtaggggctcagatgtgtgg

SEQ ID NO: 590422 - DNA, 20 bp, mouse
ggctcaccccaagtgtctag

SEQ ID NO: 590423 - DNA, 20 bp, mouse
ggtctaggggctcagatgtg

SEQ ID NO: 590424 - DNA, 20 bp, mouse
gagacagagagctggttggc

SEQ ID NO: 590425 - DNA, 20 bp, mouse
gtccaggggcagcagtttgc

SEQ ID NO: 590426 - DNA, 20 bp, mouse
gtctgggacctgctcagatc

SEQ ID NO: 590427 - DNA, 20 bp, mouse
gagctcctggaaccgagcgt

SEQ ID NO: 590428 - DNA, 20 bp, mouse
gacctgctcagatccggaag

SEQ ID NO: 590429 - DNA, 20 bp, mouse
gggttccaggagctcttcgg

SEQ ID NO: 590430 - DNA, 20 bp, mouse
gcagcctgcacaagcagggt

SEQ ID NO: 590431 - DNA, 20 bp, mouse
gggccaaggacaaaatgagt

SEQ ID NO: 590432 - DNA, 20 bp, mouse
gctcagagctgatggaacag

SEQ ID NO: 590433 - DNA, 20 bp, mouse
gctgtggctggagtaaccgt

SEQ ID NO: 590434 - DNA, 20 bp, mouse
ggagcagccaggctcgccag

SEQ ID NO: 590435 - DNA, 20 bp, mouse
ggagtgggccacttgcctct

SEQ ID NO: 590436 - DNA, 20 bp, mouse
gcaccggacgctgagactca

SEQ ID NO: 590437 - DNA, 20 bp, mouse
ggactcagggtcttccgaag

SEQ ID NO: 590438 - DNA, 20 bp, mouse
gtcagggtcttccgaagtgg

SEQ ID NO: 590439 - DNA, 20 bp, mouse
ggactcagctaccgccactt

SEQ ID NO: 590440 - DNA, 20 bp, mouse
gggaatctcagaaacagagt

SEQ ID NO: 590441 - DNA, 20 bp, mouse
ggcgtccggtgggtgaatct

SEQ ID NO: 590442 - DNA, 20 bp, mouse
ggaccctgagtctcagcgtc

SEQ ID NO: 590443 - DNA, 20 bp, mouse
gcggaggctgaggtcccagt

SEQ ID NO: 590444 - DNA, 20 bp, mouse
gtgaatctgggtccttgtga

SEQ ID NO: 590445 - DNA, 20 bp, mouse
gaaggcggcccggactctaa

SEQ ID NO: 590446 - DNA, 20 bp, mouse
gcgcgtcctcccgcaagact

SEQ ID NO: 590447 - DNA, 20 bp, mouse
ggctccgggccgccgtacac

SEQ ID NO: 590448 - DNA, 20 bp, mouse
gcgccgcgggagcccgtgta

SEQ ID NO: 590449 - DNA, 20 bp, mouse
gggagcgttaaggtgaggac

SEQ ID NO: 590450 - DNA, 20 bp, mouse
gcgccgtacacgggctcccg

SEQ ID NO: 590451 - DNA, 20 bp, mouse
gcgcagcccagtcttgcggg

SEQ ID NO: 590452 - DNA, 20 bp, mouse
gacggttgccgggtattaaa

SEQ ID NO: 590453 - DNA, 20 bp, mouse
gtggactgcctgtacccgtg

SEQ ID NO: 590454 - DNA, 20 bp, mouse
gtggcccggccccgaggagg

SEQ ID NO: 590455 - DNA, 20 bp, mouse
gggtacaggcagtccagccg

SEQ ID NO: 590456 - DNA, 20 bp, mouse
ggataaagcagtcctgttct

SEQ ID NO: 590457 - DNA, 20 bp, mouse
ggtggcgcttcagcaacagt

SEQ ID NO: 590458 - DNA, 20 bp, mouse
gcgcttcagcaacagtggga

SEQ ID NO: 590459 - DNA, 20 bp, mouse
gaagacatctataatacata

SEQ ID NO: 590460 - DNA, 20 bp, mouse
gacactgaatatattaaggt

SEQ ID NO: 590461 - DNA, 20 bp, mouse
gagcaatgtgaattcagtat

SEQ ID NO: 590462 - DNA, 20 bp, mouse
gcgccacactgaatatatta

SEQ ID NO: 590463 - DNA, 20 bp, mouse
gctgttagacccagtttagg

SEQ ID NO: 590464 - DNA, 20 bp, mouse
gtgagtttgcaagccttcag

SEQ ID NO: 590465 - DNA, 20 bp, mouse
gccttttcaaagataggagt

SEQ ID NO: 590466 - DNA, 20 bp, mouse
gagaactccggagcccaaac

SEQ ID NO: 590467 - DNA, 20 bp, mouse
ggctctgtcgtaactctcta

SEQ ID NO: 590468 - DNA, 20 bp, mouse
gttctggtcgggcagaactc

SEQ ID NO: 590469 - DNA, 20 bp, mouse
gcacactctgggctgcagca

SEQ ID NO: 590470 - DNA, 20 bp, mouse
gctgcccgaccagaatgcct

SEQ ID NO: 590471 - DNA, 20 bp, mouse
gagttacgacagagcgggca

SEQ ID NO: 590472 - DNA, 20 bp, mouse
gatcacagaagagatgcagt

SEQ ID NO: 590473 - DNA, 20 bp, mouse
gacagctccacgcacactct

SEQ ID NO: 590474 - DNA, 20 bp, mouse
gcgagacaagaggaagctaa

SEQ ID NO: 590475 - DNA, 20 bp, mouse
gggaagctaagggtcagacc

SEQ ID NO: 590476 - DNA, 20 bp, mouse
gtcgcacctggacagtgaag

SEQ ID NO: 590477 - DNA, 20 bp, mouse
ggaagtggagttcactgcag

SEQ ID NO: 590478 - DNA, 20 bp, mouse
gcggccaccagcgctgcccg

SEQ ID NO: 590479 - DNA, 20 bp, mouse
gaggcagtcaggtcattagt

SEQ ID NO: 590480 - DNA, 20 bp, mouse
gcagccccgggcagcgctgg

SEQ ID NO: 590481 - DNA, 20 bp, mouse
gcaggtgcgagctctcgagg

SEQ ID NO: 590482 - DNA, 20 bp, mouse
gggccggtgagtacgcgggt

SEQ ID NO: 590483 - DNA, 20 bp, mouse
gcgcccacccgcgtactcac

SEQ ID NO: 590484 - DNA, 20 bp, mouse
ggtggagttcactgcagcgg

SEQ ID NO: 590485 - DNA, 20 bp, mouse
gctggtggccggtgagtacg

SEQ ID NO: 590486 - DNA, 20 bp, mouse
gtcccccaggaggccactac

SEQ ID NO: 590487 - DNA, 20 bp, mouse
ggccactaccggctagaagg

SEQ ID NO: 590488 - DNA, 20 bp, mouse
gtggcgccaggcccagaact

SEQ ID NO: 590489 - DNA, 20 bp, mouse
ggaggccactaccggctaga

SEQ ID NO: 590490 - DNA, 20 bp, mouse
gttgcggccggccaagttct

SEQ ID NO: 590491 - DNA, 20 bp, mouse
gtagccggtagtggcctcct

SEQ ID NO: 590492 - DNA, 20 bp, mouse
gctgatcttgcacatcctag

SEQ ID NO: 590493 - DNA, 20 bp, mouse
gcctggcgccaccttctagc

SEQ ID NO: 590494 - DNA, 20 bp, mouse
gtcggcaaggcggtaaacta

SEQ ID NO: 590495 - DNA, 20 bp, mouse
gatcttgcacatcctagcgg

SEQ ID NO: 590496 - DNA, 20 bp, mouse
gggaaaagtaataggttcgg

SEQ ID NO: 590497 - DNA, 20 bp, mouse
gagtcaacttcttcaagcaa

SEQ ID NO: 590498 - DNA, 20 bp, mouse
gactgtgtctgggataatgt

SEQ ID NO: 590499 - DNA, 20 bp, mouse
gtaaagggaattactggcaa

SEQ ID NO: 590500 - DNA, 20 bp, mouse
gggagcctggcatcgaaagg

SEQ ID NO: 590501 - DNA, 20 bp, mouse
gccaggctccaaatcgtctg

SEQ ID NO: 590502 - DNA, 20 bp, mouse
gtgaagaagttgactactac

SEQ ID NO: 590503 - DNA, 20 bp, mouse
gtttggagcctggcatcgaa

SEQ ID NO: 590504 - DNA, 20 bp, mouse
ggcggtgcccattccaagat

SEQ ID NO: 590505 - DNA, 20 bp, mouse
gccgagaagacattaagcag

SEQ ID NO: 590506 - DNA, 20 bp, mouse
gcgcaggagcgcagacgctg

SEQ ID NO: 590507 - DNA, 20 bp, mouse
gtgtcccaggcacaaggagt

SEQ ID NO: 590508 - DNA, 20 bp, mouse
gggcagcgctgcggacgcgg

SEQ ID NO: 590509 - DNA, 20 bp, mouse
ggcgctgccgccagccaggc

SEQ ID NO: 590510 - DNA, 20 bp, mouse
ggacagactcggctccagcc

SEQ ID NO: 590511 - DNA, 20 bp, mouse
gctggctggcggcagcgctg

SEQ ID NO: 590512 - DNA, 20 bp, mouse
ggactcggctccagcctggc

SEQ ID NO: 590513 - DNA, 20 bp, mouse
gggcggcagcgctgcggacg

SEQ ID NO: 590514 - DNA, 20 bp, mouse
gcgggctgtcagctcccagg

SEQ ID NO: 590515 - DNA, 20 bp, mouse
gggttctgcagcaacggctc

SEQ ID NO: 590516 - DNA, 20 bp, mouse
gtgcaggtgtgtctgggcag

SEQ ID NO: 590517 - DNA, 20 bp, mouse
gtaggaacctgagtacacat

SEQ ID NO: 590518 - DNA, 20 bp, mouse
ggccggctctgctcacccag

SEQ ID NO: 590519 - DNA, 20 bp, mouse
ggagccctttcacacacctc

SEQ ID NO: 590520 - DNA, 20 bp, mouse
ggcgctccacaaggactgga

SEQ ID NO: 590521 - DNA, 20 bp, mouse
gctgggtggggcttacctct

SEQ ID NO: 590522 - DNA, 20 bp, mouse
ggctctgctcaaataatcca

SEQ ID NO: 590523 - DNA, 20 bp, mouse
ggagggctgctcataggatc

SEQ ID NO: 590524 - DNA, 20 bp, mouse
gaacctgagtacacatggga

SEQ ID NO: 590525 - DNA, 20 bp, mouse
gctgctcaaataatccaggg

SEQ ID NO: 590526 - DNA, 20 bp, mouse
gccccagctggccctgagaa

SEQ ID NO: 590527 - DNA, 20 bp, mouse
gagtgaggaccggagagagg

SEQ ID NO: 590528 - DNA, 20 bp, mouse
ggcagagtgtggaaaggtga

SEQ ID NO: 590529 - DNA, 20 bp, mouse
gggagagaggaggccccagc

SEQ ID NO: 590530 - DNA, 20 bp, mouse
gtctctgttgcagtgaggac

SEQ ID NO: 590531 - DNA, 20 bp, mouse
gctcctggaccagcccccag

SEQ ID NO: 590532 - DNA, 20 bp, mouse
gtgaggggcatcccttctca

SEQ ID NO: 590533 - DNA, 20 bp, mouse
gtaggacttcagggaaccca

SEQ ID NO: 590534 - DNA, 20 bp, mouse
gctgggacattgacaagctt

SEQ ID NO: 590535 - DNA, 20 bp, mouse
gagcttctctcccaccgggt

SEQ ID NO: 590536 - DNA, 20 bp, mouse
gagctggtgggtcccttcag

SEQ ID NO: 590537 - DNA, 20 bp, mouse
gacagggtagaggcactcag

SEQ ID NO: 590538 - DNA, 20 bp, mouse
ggagctcaggcctagctggt

SEQ ID NO: 590539 - DNA, 20 bp, mouse
gaaagggctcatcccctgaa

SEQ ID NO: 590540 - DNA, 20 bp, mouse
ggcgcccaggactctgcaaa

SEQ ID NO: 590541 - DNA, 20 bp, mouse
gatcctaagcgcctatccag

SEQ ID NO: 590542 - DNA, 20 bp, mouse
ggcaggttctcacagaagtc

SEQ ID NO: 590543 - DNA, 20 bp, mouse
gggtcatgtcgagggaggat

SEQ ID NO: 590544 - DNA, 20 bp, mouse
gggagcaacaagagattctg

SEQ ID NO: 590545 - DNA, 20 bp, mouse
gttctcacagaagtctggac

SEQ ID NO: 590546 - DNA, 20 bp, mouse
gtccaggagcccgcatcctg

SEQ ID NO: 590547 - DNA, 20 bp, mouse
gtgtgtgctccgcaggatgc

SEQ ID NO: 590548 - DNA, 20 bp, mouse
gaggtgggaggcggtacctg

SEQ ID NO: 590549 - DNA, 20 bp, mouse
gcctgggcgggatcaggact

SEQ ID NO: 590550 - DNA, 20 bp, mouse
gatcaggactaggtgggagg

SEQ ID NO: 590551 - DNA, 20 bp, mouse
gggcgggatcaggactaggt

SEQ ID NO: 590552 - DNA, 20 bp, mouse
gccgccgcgctccaggtcca

SEQ ID NO: 590553 - DNA, 20 bp, mouse
ggggatcaggactaggtggg

SEQ ID NO: 590554 - DNA, 20 bp, mouse
gagcacacagctgagaccgc

SEQ ID NO: 590555 - DNA, 20 bp, mouse
gaaccaaagcagcgccagtg

SEQ ID NO: 590556 - DNA, 20 bp, mouse
gctcgaggcgtgcagcgcgg

SEQ ID NO: 590557 - DNA, 20 bp, mouse
gagagcaggagctggcgact

SEQ ID NO: 590558 - DNA, 20 bp, mouse
gcacatcttggaggaggtag

SEQ ID NO: 590559 - DNA, 20 bp, mouse
ggtgcagcgcggcggcaggc

SEQ ID NO: 590560 - DNA, 20 bp, mouse
ggtgctcgaggcgtgcagcg

SEQ ID NO: 590561 - DNA, 20 bp, mouse
gcccgcaggatggtacgcac

SEQ ID NO: 590562 - DNA, 20 bp, mouse
ggcgctgcgactgcgggtgg

SEQ ID NO: 590563 - DNA, 20 bp, mouse
gcgtctcggaacagcaggaa

SEQ ID NO: 590564 - DNA, 20 bp, mouse
gttgctgcgccggtccacct

SEQ ID NO: 590565 - DNA, 20 bp, mouse
ggaagtaccgcacatcttgg

SEQ ID NO: 590566 - DNA, 20 bp, mouse
ggccacgttcccgggaagaa

SEQ ID NO: 590567 - DNA, 20 bp, mouse
ggcacgcgcgccacgttccc

SEQ ID NO: 590568 - DNA, 20 bp, mouse
gccacaccgcagaagctggg

SEQ ID NO: 590569 - DNA, 20 bp, mouse
ggcgccacaccgcagaagct

SEQ ID NO: 590570 - DNA, 20 bp, mouse
gccaggagtgcgagagtcgg

SEQ ID NO: 590571 - DNA, 20 bp, mouse
gtcggacaacctttcttccc

SEQ ID NO: 590572 - DNA, 20 bp, mouse
gcggagggcgcgaactgtga

SEQ ID NO: 590573 - DNA, 20 bp, mouse
gagcagcaggagggccgcca

SEQ ID NO: 590574 - DNA, 20 bp, mouse
gagaggcaggagcaagagta

SEQ ID NO: 590575 - DNA, 20 bp, mouse
gacctttcttcccgggaacg

SEQ ID NO: 590576 - DNA, 20 bp, mouse
ggcggggacggcacagaagg

SEQ ID NO: 590577 - DNA, 20 bp, mouse
gtctgcggggacggcacaga

SEQ ID NO: 590578 - DNA, 20 bp, mouse
gctcagaagctcgccctctg

SEQ ID NO: 590579 - DNA, 20 bp, mouse
gccgcaccggctgtgccagc

SEQ ID NO: 590580 - DNA, 20 bp, mouse
ggccgcagccgggtgagcta

SEQ ID NO: 590581 - DNA, 20 bp, mouse
gtgggttgcgctgaggtgca

SEQ ID NO: 590582 - DNA, 20 bp, mouse
gaccgggccgcatcctgacg

SEQ ID NO: 590583 - DNA, 20 bp, mouse
gggtccaagaccgctgagag

SEQ ID NO: 590584 - DNA, 20 bp, mouse
gtcaggatgcggcccggttg

SEQ ID NO: 590585 - DNA, 20 bp, mouse
gctggggctgggttgcgctg

SEQ ID NO: 590586 - DNA, 20 bp, mouse
gccttaaaggcaggtagtta

SEQ ID NO: 590587 - DNA, 20 bp, mouse
gggtagacagatttccttaa

SEQ ID NO: 590588 - DNA, 20 bp, mouse
gaggcaggtagttagggctt

SEQ ID NO: 590589 - DNA, 20 bp, mouse
gcagctcctggatgccccac

SEQ ID NO: 590590 - DNA, 20 bp, mouse
gcccccatggccagcagcta

SEQ ID NO: 590591 - DNA, 20 bp, mouse
ggcctctacagccaccccca

SEQ ID NO: 590592 - DNA, 20 bp, mouse
ggcagccagcgtagccctgg

SEQ ID NO: 590593 - DNA, 20 bp, mouse
gtgccaagccaagcagcaca

SEQ ID NO: 590594 - DNA, 20 bp, mouse
gatagtacttggtcatattt

SEQ ID NO: 590595 - DNA, 20 bp, mouse
ggccctgggggtggctgtag

SEQ ID NO: 590596 - DNA, 20 bp, mouse
ggtttaggcggggttttcag

SEQ ID NO: 590597 - DNA, 20 bp, mouse
gacgctggtgatacgccctg

SEQ ID NO: 590598 - DNA, 20 bp, mouse
gctggtgctcaaaggagttt

SEQ ID NO: 590599 - DNA, 20 bp, mouse
gagcaccaggggatctactt

SEQ ID NO: 590600 - DNA, 20 bp, mouse
gggagccaacaggaaaccgt

SEQ ID NO: 590601 - DNA, 20 bp, mouse
gtagatcccctggtgctcaa

SEQ ID NO: 590602 - DNA, 20 bp, mouse
gagctccaaagtagatcccc

SEQ ID NO: 590603 - DNA, 20 bp, mouse
ggcattgggctagacagttg

SEQ ID NO: 590604 - DNA, 20 bp, mouse
ggctcaaaggagtttaggcg

SEQ ID NO: 590605 - DNA, 20 bp, mouse
gggttttcagaggcagcaag

SEQ ID NO: 590606 - DNA, 20 bp, mouse
gcattcactgctgtacggag

SEQ ID NO: 590607 - DNA, 20 bp, mouse
ggtagtgagaaggcagcgtc

SEQ ID NO: 590608 - DNA, 20 bp, mouse
gtagggaaggcctaaggtgt

SEQ ID NO: 590609 - DNA, 20 bp, mouse
gtgagaaggcagcgtcagga

SEQ ID NO: 590610 - DNA, 20 bp, mouse
gctaaggtgtgggcaagaga

SEQ ID NO: 590611 - DNA, 20 bp, mouse
gggcaagagagggaccgcag

SEQ ID NO: 590612 - DNA, 20 bp, mouse
gtcacagatttgtagtgaga

SEQ ID NO: 590613 - DNA, 20 bp, mouse
gcatgtggagcatgcagcca

SEQ ID NO: 590614 - DNA, 20 bp, mouse
gtacaaccggtgaaaatcat

SEQ ID NO: 590615 - DNA, 20 bp, mouse
gagctgctgttgagtaggga

SEQ ID NO: 590616 - DNA, 20 bp, mouse
gagagtggatatataagaga

SEQ ID NO: 590617 - DNA, 20 bp, mouse
gagggttctccaacatagag

SEQ ID NO: 590618 - DNA, 20 bp, mouse
gttatatatccactctatgt

SEQ ID NO: 590619 - DNA, 20 bp, mouse
gcaacagattgttttaggta

SEQ ID NO: 590620 - DNA, 20 bp, mouse
gaggacctggaatgaatcgt

SEQ ID NO: 590621 - DNA, 20 bp, mouse
gcagatcaacagattgtttt

SEQ ID NO: 590622 - DNA, 20 bp, mouse
gaggtcctggggctctggga

SEQ ID NO: 590623 - DNA, 20 bp, mouse
gcaagaagtgtgggaggacc

SEQ ID NO: 590624 - DNA, 20 bp, mouse
gagggccaacgattcattcc

SEQ ID NO: 590625 - DNA, 20 bp, mouse
gtatgacagacaagaagtgt

SEQ ID NO: 590626 - DNA, 20 bp, mouse
ggagagcctagcagagccgt

SEQ ID NO: 590627 - DNA, 20 bp, mouse
gcgctgttgtgagagaagta

SEQ ID NO: 590628 - DNA, 20 bp, mouse
gtgagtccaggggcaaggaa

SEQ ID NO: 590629 - DNA, 20 bp, mouse
gcagagccgtgggctccctg

SEQ ID NO: 590630 - DNA, 20 bp, mouse
gcaggtgagcagggctaaag

SEQ ID NO: 590631 - DNA, 20 bp, mouse
gaaactgaggtagcagcagg

SEQ ID NO: 590632 - DNA, 20 bp, mouse
gtggaaaggtttccaaactg

SEQ ID NO: 590633 - DNA, 20 bp, mouse
gaacccagacgagtccaagt

SEQ ID NO: 590634 - DNA, 20 bp, mouse
ggggctcggaattctttccc

SEQ ID NO: 590635 - DNA, 20 bp, mouse
gctcacaacagcgggttatt

SEQ ID NO: 590636 - DNA, 20 bp, mouse
gtctccagcaggtgctcgta

SEQ ID NO: 590637 - DNA, 20 bp, mouse
gaagccctacgagcacctgc

SEQ ID NO: 590638 - DNA, 20 bp, mouse
ggtgctcgtagggcttgggt

SEQ ID NO: 590639 - DNA, 20 bp, mouse
ggggcggacccagcagaggg

SEQ ID NO: 590640 - DNA, 20 bp, mouse
gggacatgttggggactccg

SEQ ID NO: 590641 - DNA, 20 bp, mouse
ggacactccactctctaccc

SEQ ID NO: 590642 - DNA, 20 bp, mouse
ggcgcagatttcgtcgccgg

SEQ ID NO: 590643 - DNA, 20 bp, mouse
gcccggggcggacccagcag

SEQ ID NO: 590644 - DNA, 20 bp, mouse
ggcagagcagcgccagcacg

SEQ ID NO: 590645 - DNA, 20 bp, mouse
gggtttgaaagcgctcgggc

SEQ ID NO: 590646 - DNA, 20 bp, mouse
ggtcttatctcccagctaca

SEQ ID NO: 590647 - DNA, 20 bp, mouse
gaaagggccaccctgtagct

SEQ ID NO: 590648 - DNA, 20 bp, mouse
gagacagcagcccaagcaac

SEQ ID NO: 590649 - DNA, 20 bp, mouse
ggagctgacctggctgccac

SEQ ID NO: 590650 - DNA, 20 bp, mouse
gagcaggggatctaagcctg

SEQ ID NO: 590651 - DNA, 20 bp, mouse
gctgggcgttccccaggaag

SEQ ID NO: 590652 - DNA, 20 bp, mouse
ggtgagagccaaaggtacct

SEQ ID NO: 590653 - DNA, 20 bp, mouse
gggaggttgggtcctaggtg

SEQ ID NO: 590654 - DNA, 20 bp, mouse
gccagtgggctagtcctgta

SEQ ID NO: 590655 - DNA, 20 bp, mouse
gaggagataacagcaccagt

SEQ ID NO: 590656 - DNA, 20 bp, mouse
ggcaccaggcccacagaagg

SEQ ID NO: 590657 - DNA, 20 bp, mouse
gcaaggtcggagcgccgtag

SEQ ID NO: 590658 - DNA, 20 bp, mouse
gcaaccccgaccctccgcta

SEQ ID NO: 590659 - DNA, 20 bp, mouse
gtgtccaggaatcccaaggt

SEQ ID NO: 590660 - DNA, 20 bp, mouse
ggcgcctacgcagggctggg

SEQ ID NO: 590661 - DNA, 20 bp, mouse
gggccgaaggagagcgacgc

SEQ ID NO: 590662 - DNA, 20 bp, mouse
ggagcgccgtagcggagggt

SEQ ID NO: 590663 - DNA, 20 bp, mouse
ggtcggagcgccgtagcgga

SEQ ID NO: 590664 - DNA, 20 bp, mouse
ggaaggagagcgacgctggt

SEQ ID NO: 590665 - DNA, 20 bp, mouse
gcggcctcccagccctgcgt

SEQ ID NO: 590666 - DNA, 20 bp, mouse
gagcgccttggacctggtgg

SEQ ID NO: 590667 - DNA, 20 bp, mouse
gcggcagcgacagtaagtgc

SEQ ID NO: 590668 - DNA, 20 bp, mouse
ggctacctccaccaggtcca

SEQ ID NO: 590669 - DNA, 20 bp, mouse
gacaagggcggagcccggcc

SEQ ID NO: 590670 - DNA, 20 bp, mouse
gtcacagtggcccagcgcct

SEQ ID NO: 590671 - DNA, 20 bp, mouse
ggcgggaccagagaagagtg

SEQ ID NO: 590672 - DNA, 20 bp, mouse
gacagtaagtgcgggtgcag

SEQ ID NO: 590673 - DNA, 20 bp, mouse
ggaagacccagccaagcatg

SEQ ID NO: 590674 - DNA, 20 bp, mouse
ggcagctgtggcatccgatc

SEQ ID NO: 590675 - DNA, 20 bp, mouse
gcccgcgtgtggggacaggt

SEQ ID NO: 590676 - DNA, 20 bp, mouse
gagcccagtgcgggtccagg

SEQ ID NO: 590677 - DNA, 20 bp, mouse
ggcagaagtggggtcttgtc

SEQ ID NO: 590678 - DNA, 20 bp, mouse
gcagcgatgtagcagaagtg

SEQ ID NO: 590679 - DNA, 20 bp, mouse
ggaagtggggtcttgtcggg

SEQ ID NO: 590680 - DNA, 20 bp, mouse
gctcacagattggtaacaaa

SEQ ID NO: 590681 - DNA, 20 bp, mouse
gtaccaatctgtgaggctca

SEQ ID NO: 590682 - DNA, 20 bp, mouse
gtcccctcaggcctctacat

SEQ ID NO: 590683 - DNA, 20 bp, mouse
ggagaaggtggtgagctcaa

SEQ ID NO: 590684 - DNA, 20 bp, mouse
ggtctcctctcggatgtcac

SEQ ID NO: 590685 - DNA, 20 bp, mouse
gacccatgtagaggcctgag

SEQ ID NO: 590686 - DNA, 20 bp, mouse
gggccgcgcgccgcagacaa

SEQ ID NO: 590687 - DNA, 20 bp, mouse
ggcggaccgggacaccgagc

SEQ ID NO: 590688 - DNA, 20 bp, mouse
gcagcacgcgctcacggacc

SEQ ID NO: 590689 - DNA, 20 bp, mouse
gtcccctgaggtgtgaccaa

SEQ ID NO: 590690 - DNA, 20 bp, mouse
ggcttctcgaggcttgggac

SEQ ID NO: 590691 - DNA, 20 bp, mouse
gcgggacgcaggctctagaa

SEQ ID NO: 590692 - DNA, 20 bp, mouse
gccgtggcgacactcacctc

SEQ ID NO: 590693 - DNA, 20 bp, mouse
gggtgcctgggagggcggaa

SEQ ID NO: 590694 - DNA, 20 bp, mouse
gaaccatccggtgcctggga

SEQ ID NO: 590695 - DNA, 20 bp, mouse
gcgtctccctgccacctccg

SEQ ID NO: 590696 - DNA, 20 bp, mouse
gagagtgacgatctgagcta

SEQ ID NO: 590697 - DNA, 20 bp, mouse
gtaagtgcgtcagggcgtgg

SEQ ID NO: 590698 - DNA, 20 bp, mouse
gtggcggcggtcctataaaa

SEQ ID NO: 590699 - DNA, 20 bp, mouse
gtcagggcgtggaggtctgg

SEQ ID NO: 590700 - DNA, 20 bp, mouse
gcggggtcttaagtgcgtca

SEQ ID NO: 590701 - DNA, 20 bp, mouse
gccggctgcgagacggagaa

SEQ ID NO: 590702 - DNA, 20 bp, mouse
gagcaagcctctgctcttgg

SEQ ID NO: 590703 - DNA, 20 bp, mouse
ggcgtcagggcgtggaggtc

SEQ ID NO: 590704 - DNA, 20 bp, mouse
gaggaagcggggactcggac

SEQ ID NO: 590705 - DNA, 20 bp, mouse
gagctgtgccggctgcgaga

SEQ ID NO: 590706 - DNA, 20 bp, mouse
gatccccgctgtagcagtgg

SEQ ID NO: 590707 - DNA, 20 bp, mouse
gaccgggctggccaacgtgg

SEQ ID NO: 590708 - DNA, 20 bp, mouse
gcaaatccccgctgtagcag

SEQ ID NO: 590709 - DNA, 20 bp, mouse
gcagaccgggctggccaacg

SEQ ID NO: 590710 - DNA, 20 bp, mouse
gccctggaaggcggatggac

SEQ ID NO: 590711 - DNA, 20 bp, mouse
gctcccctggaccctgcgaa

SEQ ID NO: 590712 - DNA, 20 bp, mouse
gtggaaggcggatggacggg

SEQ ID NO: 590713 - DNA, 20 bp, mouse
gtgcggccaggccactcccc

SEQ ID NO: 590714 - DNA, 20 bp, mouse
gctggaccctgcgaaaggca

SEQ ID NO: 590715 - DNA, 20 bp, mouse
gcgagtagcgctgggcggca

SEQ ID NO: 590716 - DNA, 20 bp, mouse
gctgtcagcgcggtaggtct

SEQ ID NO: 590717 - DNA, 20 bp, mouse
ggtaggtctgggtggtccgg

SEQ ID NO: 590718 - DNA, 20 bp, mouse
gcctaccgcgctgacagcag

SEQ ID NO: 590719 - DNA, 20 bp, mouse
gtcagcgcggtaggtctggg

SEQ ID NO: 590720 - DNA, 20 bp, mouse
gggagagaggcggagaccga

SEQ ID NO: 590721 - DNA, 20 bp, mouse
ggcacacgcacagtccgaag

SEQ ID NO: 590722 - DNA, 20 bp, mouse
gtcaacaggtaccatggtca

SEQ ID NO: 590723 - DNA, 20 bp, mouse
gacagcttctcgctcgccac

SEQ ID NO: 590724 - DNA, 20 bp, mouse
gggacgactgtcccctctag

SEQ ID NO: 590725 - DNA, 20 bp, mouse
ggctcgggtgaccgctagag

SEQ ID NO: 590726 - DNA, 20 bp, mouse
ggcgaggcgggtggctcggg

SEQ ID NO: 590727 - DNA, 20 bp, mouse
ggcagcctgagcagcctgat

SEQ ID NO: 590728 - DNA, 20 bp, mouse
ggcagctggcagagagtgcg

SEQ ID NO: 590729 - DNA, 20 bp, mouse
gctgcggggaagttgcgtgt

SEQ ID NO: 590730 - DNA, 20 bp, mouse
gaggctggcggccgactcgg

SEQ ID NO: 590731 - DNA, 20 bp, mouse
gtgcaggctggcggccgact

SEQ ID NO: 590732 - DNA, 20 bp, mouse
ggagcagcctgatgggcgag

SEQ ID NO: 590733 - DNA, 20 bp, mouse
gttgcgggacatgggacagg

SEQ ID NO: 590734 - DNA, 20 bp, mouse
gaagccgccgagcgccgaga

SEQ ID NO: 590735 - DNA, 20 bp, mouse
gcgcaaggcgagcgaggacg

SEQ ID NO: 590736 - DNA, 20 bp, mouse
ggtacaggacctggattaag

SEQ ID NO: 590737 - DNA, 20 bp, mouse
gccaggtagagtgagcactc

SEQ ID NO: 590738 - DNA, 20 bp, mouse
gccaggtcctgtactgaatg

SEQ ID NO: 590739 - DNA, 20 bp, mouse
gcacacaatgtcagaagaca

SEQ ID NO: 590740 - DNA, 20 bp, mouse
ggtagagtgagcactctggc

SEQ ID NO: 590741 - DNA, 20 bp, mouse
gggaattgtcctcttaatcc

SEQ ID NO: 590742 - DNA, 20 bp, mouse
gattcatccacattcagtac

SEQ ID NO: 590743 - DNA, 20 bp, mouse
ggacaaggtacagcgacctt

SEQ ID NO: 590744 - DNA, 20 bp, mouse
gcccagatcgtgggggtggt

SEQ ID NO: 590745 - DNA, 20 bp, mouse
ggcaggcgaccttggaccat

SEQ ID NO: 590746 - DNA, 20 bp, mouse
gttctgagagcggcttctgt

SEQ ID NO: 590747 - DNA, 20 bp, mouse
ggcggcttctgtaggacccg

SEQ ID NO: 590748 - DNA, 20 bp, mouse
gggtatccagccaatgttct

SEQ ID NO: 590749 - DNA, 20 bp, mouse
gctcggcagcaagtgttcct

SEQ ID NO: 590750 - DNA, 20 bp, mouse
gtccttaagccttctgagag

SEQ ID NO: 590751 - DNA, 20 bp, mouse
gtcctcacggaggtaggtcg

SEQ ID NO: 590752 - DNA, 20 bp, mouse
gagtcttaaggtagatctag

SEQ ID NO: 590753 - DNA, 20 bp, mouse
gagtcaccgagccatccgga

SEQ ID NO: 590754 - DNA, 20 bp, mouse
gcacttgctgccgagaacat

SEQ ID NO: 590755 - DNA, 20 bp, mouse
gtgctgccgagaacattggc

SEQ ID NO: 590756 - DNA, 20 bp, mouse
gacggaaccggagagcacca

SEQ ID NO: 590757 - DNA, 20 bp, mouse
gagcgggtctcactagatcc

SEQ ID NO: 590758 - DNA, 20 bp, mouse
gtgcaaagggcgggtctggt

SEQ ID NO: 590759 - DNA, 20 bp, mouse
gcgatctgctggaaacccga

SEQ ID NO: 590760 - DNA, 20 bp, mouse
gactagatcccggagagcct

SEQ ID NO: 590761 - DNA, 20 bp, mouse
gtagtgagacccgcttgagg

SEQ ID NO: 590762 - DNA, 20 bp, mouse
gcgcttgagggggaaagatg

SEQ ID NO: 590763 - DNA, 20 bp, mouse
gggaagccgtgtgcaaaggg

SEQ ID NO: 590764 - DNA, 20 bp, mouse
gggagagccttggtgctctc

SEQ ID NO: 590765 - DNA, 20 bp, mouse
ggcagatcggctctgacgta

SEQ ID NO: 590766 - DNA, 20 bp, mouse
gctttctcaacagggtaggt

SEQ ID NO: 590767 - DNA, 20 bp, mouse
gtctcaacagggtaggtggg

SEQ ID NO: 590768 - DNA, 20 bp, mouse
gtaccctgttgagaaagttg

SEQ ID NO: 590769 - DNA, 20 bp, mouse
gcactccgaatacttctctc

SEQ ID NO: 590770 - DNA, 20 bp, mouse
ggtggtgtcacttacttcgg

SEQ ID NO: 590771 - DNA, 20 bp, mouse
gttgggagcgtagggaacag

SEQ ID NO: 590772 - DNA, 20 bp, mouse
gtgcctcaactttctcaaca

SEQ ID NO: 590773 - DNA, 20 bp, mouse
gtgggactgaggatgagcgt

SEQ ID NO: 590774 - DNA, 20 bp, mouse
gtcttcccactccaacacgg

SEQ ID NO: 590775 - DNA, 20 bp, mouse
gagtattcggagtgggagtc

SEQ ID NO: 590776 - DNA, 20 bp, mouse
gcgcggatggtcagatacag

SEQ ID NO: 590777 - DNA, 20 bp, mouse
ggtccctcggttcttagcag

SEQ ID NO: 590778 - DNA, 20 bp, mouse
gagatgctttagctctgcag

SEQ ID NO: 590779 - DNA, 20 bp, mouse
gcctgctgtgctgagggctc

SEQ ID NO: 590780 - DNA, 20 bp, mouse
gggttcctgcatggccagcg

SEQ ID NO: 590781 - DNA, 20 bp, mouse
ggaacccctgctaagaaccg

SEQ ID NO: 590782 - DNA, 20 bp, mouse
gcctgcatggccagcgcgga

SEQ ID NO: 590783 - DNA, 20 bp, mouse
gaggagtcgcgggcacctcg

SEQ ID NO: 590784 - DNA, 20 bp, mouse
ggcttcgcctgctgtgctga

SEQ ID NO: 590785 - DNA, 20 bp, mouse
ggcagccaatcgcatctgta

SEQ ID NO: 590786 - DNA, 20 bp, mouse
ggggccccgtagcatcggag

SEQ ID NO: 590787 - DNA, 20 bp, mouse
ggagcagggccccgtagcat

SEQ ID NO: 590788 - DNA, 20 bp, mouse
gggaaacagtagacccagca

SEQ ID NO: 590789 - DNA, 20 bp, mouse
ggtagacccagcagggcagc

SEQ ID NO: 590790 - DNA, 20 bp, mouse
gccgagtgtggcaagggcag

SEQ ID NO: 590791 - DNA, 20 bp, mouse
ggtgcctctccgatgctacg

SEQ ID NO: 590792 - DNA, 20 bp, mouse
gcctctgtgaccatctgggt

SEQ ID NO: 590793 - DNA, 20 bp, mouse
ggaaggtgtagggacaggta

SEQ ID NO: 590794 - DNA, 20 bp, mouse
gcatatgggaggccaacctc

SEQ ID NO: 590795 - DNA, 20 bp, mouse
gtgtgctgaatacctgaata

SEQ ID NO: 590796 - DNA, 20 bp, mouse
gtagcggctgcgtctcctgg

SEQ ID NO: 590797 - DNA, 20 bp, mouse
gaagctgaggggtcccagag

SEQ ID NO: 590798 - DNA, 20 bp, mouse
gcttccggtggccgcaatag

SEQ ID NO: 590799 - DNA, 20 bp, mouse
ggccaggtgaggactcccag

SEQ ID NO: 590800 - DNA, 20 bp, mouse
ggaggccgcgctcgcccgag

SEQ ID NO: 590801 - DNA, 20 bp, mouse
gatgtctcccgaggaccccc

SEQ ID NO: 590802 - DNA, 20 bp, mouse
gctgaggggtcccagagcgg

SEQ ID NO: 590803 - DNA, 20 bp, mouse
ggaaggaagcgaggaagacc

SEQ ID NO: 590804 - DNA, 20 bp, mouse
gccgagcggcgacagttcgc

SEQ ID NO: 590805 - DNA, 20 bp, mouse
ggcagcgcccagggtcacga

SEQ ID NO: 590806 - DNA, 20 bp, mouse
gagatgccctggcaagtcca

SEQ ID NO: 590807 - DNA, 20 bp, mouse
gcaggaccctggacttgcca

SEQ ID NO: 590808 - DNA, 20 bp, mouse
ggggcatctctgcagcgagg

SEQ ID NO: 590809 - DNA, 20 bp, mouse
gtgctctgccctccttcctg

SEQ ID NO: 590810 - DNA, 20 bp, mouse
gccaccggtgtcacacatca

SEQ ID NO: 590811 - DNA, 20 bp, mouse
ggccctggggagctctctgt

SEQ ID NO: 590812 - DNA, 20 bp, mouse
ggaagctaaagcaagctccc

SEQ ID NO: 590813 - DNA, 20 bp, mouse
ggctccacagctgccagaca

SEQ ID NO: 590814 - DNA, 20 bp, mouse
gacccacagagagctcccca

SEQ ID NO: 590815 - DNA, 20 bp, mouse
gctctgtgggtcaccagcag

SEQ ID NO: 590816 - DNA, 20 bp, mouse
gtagactagagtgggcgagg

SEQ ID NO: 590817 - DNA, 20 bp, mouse
gcaggtgagttactgacttt

SEQ ID NO: 590818 - DNA, 20 bp, mouse
gagagtgggcgaggaggctc

SEQ ID NO: 590819 - DNA, 20 bp, mouse
ggactttgggcagctttggg

SEQ ID NO: 590820 - DNA, 20 bp, mouse
gctttgggcacgccgacttt

SEQ ID NO: 590821 - DNA, 20 bp, mouse
gctgctctttagactagagt

SEQ ID NO: 590822 - DNA, 20 bp, mouse
gggaggcttgtgccattgat

SEQ ID NO: 590823 - DNA, 20 bp, mouse
gctttagactagagtgggcg

SEQ ID NO: 590824 - DNA, 20 bp, mouse
gggagaggacaattaagagg

SEQ ID NO: 590825 - DNA, 20 bp, mouse
gggagactttgagaacaaga

SEQ ID NO: 590826 - DNA, 20 bp, mouse
gccgatgctcggcagcccct

SEQ ID NO: 590827 - DNA, 20 bp, mouse
ggcatcggaccgaagcgctc

SEQ ID NO: 590828 - DNA, 20 bp, mouse
ggggccgagcgcagtcgccg

SEQ ID NO: 590829 - DNA, 20 bp, mouse
gcggccccagcagcccatgg

SEQ ID NO: 590830 - DNA, 20 bp, mouse
gaccgtctgcaaaggagggg

SEQ ID NO: 590831 - DNA, 20 bp, mouse
ggaccgaagcgctcgggaga

SEQ ID NO: 590832 - DNA, 20 bp, mouse
gggagggggggcgaagacgg

SEQ ID NO: 590833 - DNA, 20 bp, mouse
ggctgacgcgggaacgggag

SEQ ID NO: 590834 - DNA, 20 bp, mouse
ggacgtgctggcgctcgtag

SEQ ID NO: 590835 - DNA, 20 bp, mouse
gtgcgtggcgtgagtcctcc

SEQ ID NO: 590836 - DNA, 20 bp, mouse
gtcggccacgaagaaggccg

SEQ ID NO: 590837 - DNA, 20 bp, mouse
gcgcagcgggctgtagagat

SEQ ID NO: 590838 - DNA, 20 bp, mouse
gctcaccgcggccttcttcg

SEQ ID NO: 590839 - DNA, 20 bp, mouse
gttcatgctggtgctcaccg

SEQ ID NO: 590840 - DNA, 20 bp, mouse
gtagagatgggccgttactc

SEQ ID NO: 590841 - DNA, 20 bp, mouse
ggcacgtcttgcctgagtaa

SEQ ID NO: 590842 - DNA, 20 bp, mouse
gagctggtgtcgggttacct

SEQ ID NO: 590843 - DNA, 20 bp, mouse
ggagtccgagagcagcgcga

SEQ ID NO: 590844 - DNA, 20 bp, mouse
ggcccgcacgtagccgtagg

SEQ ID NO: 590845 - DNA, 20 bp, mouse
gacgtgcgggccgaggtggt

SEQ ID NO: 590846 - DNA, 20 bp, mouse
gagccaaagggcagtcagtc

SEQ ID NO: 590847 - DNA, 20 bp, mouse
gagagctctgagcagagttc

SEQ ID NO: 590848 - DNA, 20 bp, mouse
gcgcagcggcagggccggag

SEQ ID NO: 590849 - DNA, 20 bp, mouse
ggatcctaagaaggacctgg

SEQ ID NO: 590850 - DNA, 20 bp, mouse
gcgcgggcaggtccacagga

SEQ ID NO: 590851 - DNA, 20 bp, mouse
gttggctggcgggtaagcag

SEQ ID NO: 590852 - DNA, 20 bp, mouse
ggctttgcgaactagccaaa

SEQ ID NO: 590853 - DNA, 20 bp, mouse
gaccgggcctccccacctca

SEQ ID NO: 590854 - DNA, 20 bp, mouse
gtgcagccaatgttacaggg

SEQ ID NO: 590855 - DNA, 20 bp, mouse
ggtcccgcgcgcaacttcga

SEQ ID NO: 590856 - DNA, 20 bp, mouse
gaccagtgtggagggaactg

SEQ ID NO: 590857 - DNA, 20 bp, mouse
ggccgcagttccctccacac

SEQ ID NO: 590858 - DNA, 20 bp, mouse
ggcccagcggggagtccgag

SEQ ID NO: 590859 - DNA, 20 bp, mouse
ggagggaactgcggcgactg

SEQ ID NO: 590860 - DNA, 20 bp, mouse
ggccttgcgccaaatccgag

SEQ ID NO: 590861 - DNA, 20 bp, mouse
ggagcggtccaaggaccact

SEQ ID NO: 590862 - DNA, 20 bp, mouse
gccccgctgggccaccagtg

SEQ ID NO: 590863 - DNA, 20 bp, mouse
gggcctgcgattgaagaggt

SEQ ID NO: 590864 - DNA, 20 bp, mouse
gcgtctaggccgcacagagg

SEQ ID NO: 590865 - DNA, 20 bp, mouse
gcggcggcctgcgattgaag

SEQ ID NO: 590866 - DNA, 20 bp, mouse
gccggcgctcgggctcctca

SEQ ID NO: 590867 - DNA, 20 bp, mouse
ggccggccatggcagcggag

SEQ ID NO: 590868 - DNA, 20 bp, mouse
ggcctcccagcggcacgggg

SEQ ID NO: 590869 - DNA, 20 bp, mouse
gacggggcgggcgggtgcag

SEQ ID NO: 590870 - DNA, 20 bp, mouse
ggctactgcgacccgggcca

SEQ ID NO: 590871 - DNA, 20 bp, mouse
gagtagcgcgagctccgggc

SEQ ID NO: 590872 - DNA, 20 bp, mouse
gggagcccgagcgccggtga

SEQ ID NO: 590873 - DNA, 20 bp, mouse
ggcccgagcgccggtgaagg

SEQ ID NO: 590874 - DNA, 20 bp, mouse
ggctcgcgctactgcgaccc

SEQ ID NO: 590875 - DNA, 20 bp, mouse
gtcgcagtagcgcgagctcc

SEQ ID NO: 590876 - DNA, 20 bp, mouse
gcgttccccggaggccgtac

SEQ ID NO: 590877 - DNA, 20 bp, mouse
gactaggccgcgggctgttc

SEQ ID NO: 590878 - DNA, 20 bp, mouse
gacgcacgctgggcgggact

SEQ ID NO: 590879 - DNA, 20 bp, mouse
gcggcagcgccgttccccgg

SEQ ID NO: 590880 - DNA, 20 bp, mouse
gcctgcccgtacggcctccg

SEQ ID NO: 590881 - DNA, 20 bp, mouse
ggcgctgccggaacagcccg

SEQ ID NO: 590882 - DNA, 20 bp, mouse
gcctgcatggaggagaagta

SEQ ID NO: 590883 - DNA, 20 bp, mouse
ggctgggcgggactaggccg

SEQ ID NO: 590884 - DNA, 20 bp, mouse
gaagcaggcacacgcacgct

SEQ ID NO: 590885 - DNA, 20 bp, mouse
gcaggcacacgcacgctggg

SEQ ID NO: 590886 - DNA, 20 bp, mouse
gtcttccggcgggagctgta

SEQ ID NO: 590887 - DNA, 20 bp, mouse
ggctgtacggctccttacca

SEQ ID NO: 590888 - DNA, 20 bp, mouse
gcggccaactcaccatggta

SEQ ID NO: 590889 - DNA, 20 bp, mouse
gttctcagagcgtcttccgg

SEQ ID NO: 590890 - DNA, 20 bp, mouse
gaagaatcccgcacacccca

SEQ ID NO: 590891 - DNA, 20 bp, mouse
ggagcagctgcggtacagca

SEQ ID NO: 590892 - DNA, 20 bp, mouse
gcagcgctcgggttcttgaa

SEQ ID NO: 590893 - DNA, 20 bp, mouse
gggagccgtacagctcccgc

SEQ ID NO: 590894 - DNA, 20 bp, mouse
gggcgctcgagcgaggaagc

SEQ ID NO: 590895 - DNA, 20 bp, mouse
gggcgttcacttgttctcag

SEQ ID NO: 590896 - DNA, 20 bp, mouse
gcggaagtcctcgaattccc

SEQ ID NO: 590897 - DNA, 20 bp, mouse
gccaaagcgcttgaccgccg

SEQ ID NO: 590898 - DNA, 20 bp, mouse
gagcggtgacgcttcaaacg

SEQ ID NO: 590899 - DNA, 20 bp, mouse
gctgtgtctgtgtctcgcgg

SEQ ID NO: 590900 - DNA, 20 bp, mouse
gaagtgactcggtatggtgg

SEQ ID NO: 590901 - DNA, 20 bp, mouse
gtagaagtgactcggtatgg

SEQ ID NO: 590902 - DNA, 20 bp, mouse
gacacacacccgggaattcg

SEQ ID NO: 590903 - DNA, 20 bp, mouse
gctctagaagtgactcggta

SEQ ID NO: 590904 - DNA, 20 bp, mouse
gtgccgaacagattgaactt

SEQ ID NO: 590905 - DNA, 20 bp, mouse
gtgtccgacaggatggacct

SEQ ID NO: 590906 - DNA, 20 bp, mouse
gcccacaacactgatatagg

SEQ ID NO: 590907 - DNA, 20 bp, mouse
gagagggaaggcgtacatct

SEQ ID NO: 590908 - DNA, 20 bp, mouse
ggttctctcaagaaactcca

SEQ ID NO: 590909 - DNA, 20 bp, mouse
gttacccacaacactgatat

SEQ ID NO: 590910 - DNA, 20 bp, mouse
ggggaaggcgtacatcttgg

SEQ ID NO: 590911 - DNA, 20 bp, mouse
ggcttttctgggagactcaa

SEQ ID NO: 590912 - DNA, 20 bp, mouse
ggcctcattaactcaagtac

SEQ ID NO: 590913 - DNA, 20 bp, mouse
gtgaaaattaacagtctcct

SEQ ID NO: 590914 - DNA, 20 bp, mouse
ggtacgccttccctctagac

SEQ ID NO: 590915 - DNA, 20 bp, mouse
ggcctcctatatcagtgttg

SEQ ID NO: 590916 - DNA, 20 bp, mouse
ggactccatagaccggaccc

SEQ ID NO: 590917 - DNA, 20 bp, mouse
gtccggtctatggagtcagt

SEQ ID NO: 590918 - DNA, 20 bp, mouse
gctcgccggggtccggtcta

SEQ ID NO: 590919 - DNA, 20 bp, mouse
ggccagggtgagtgacggac

SEQ ID NO: 590920 - DNA, 20 bp, mouse
gcccgcgtagggacaccctg

SEQ ID NO: 590921 - DNA, 20 bp, mouse
gtcggcgacccggaagtcat

SEQ ID NO: 590922 - DNA, 20 bp, mouse
ggcgcacaggtgcagctggg

SEQ ID NO: 590923 - DNA, 20 bp, mouse
gcacacatccgtgctcgccg

SEQ ID NO: 590924 - DNA, 20 bp, mouse
gggcgcggcaggcggctcgg

SEQ ID NO: 590925 - DNA, 20 bp, mouse
gatccgtgctcgccggggtc

SEQ ID NO: 590926 - DNA, 20 bp, mouse
gtggatcccctagtccggta

SEQ ID NO: 590927 - DNA, 20 bp, mouse
ggcttggtagaagtccgtac

SEQ ID NO: 590928 - DNA, 20 bp, mouse
gtgggatctgagccgaacag

SEQ ID NO: 590929 - DNA, 20 bp, mouse
ggaatccgcggcctttactg

SEQ ID NO: 590930 - DNA, 20 bp, mouse
gtcgtgggacacgtcgagcc

SEQ ID NO: 590931 - DNA, 20 bp, mouse
gagaactggatcccctagtc

SEQ ID NO: 590932 - DNA, 20 bp, mouse
gtctgagaggaagactaagg

SEQ ID NO: 590933 - DNA, 20 bp, mouse
ggaagtccgtaccggactag

SEQ ID NO: 590934 - DNA, 20 bp, mouse
gggtccagggcgggaatccg

SEQ ID NO: 590935 - DNA, 20 bp, mouse
ggagccgggcagtagtggcg

SEQ ID NO: 590936 - DNA, 20 bp, mouse
ggagtcctgagtagagtccc

SEQ ID NO: 590937 - DNA, 20 bp, mouse
gtcagcccgggactctactc

SEQ ID NO: 590938 - DNA, 20 bp, mouse
gctgagtcccgagcagcgag

SEQ ID NO: 590939 - DNA, 20 bp, mouse
gtctactcaggactctactt

SEQ ID NO: 590940 - DNA, 20 bp, mouse
ggagcggacagacgcgaccc

SEQ ID NO: 590941 - DNA, 20 bp, mouse
gagagctgcgaggatctcca

SEQ ID NO: 590942 - DNA, 20 bp, mouse
ggcacactagacggccgccc

SEQ ID NO: 590943 - DNA, 20 bp, mouse
gcggacagacgcgacccggg

SEQ ID NO: 590944 - DNA, 20 bp, mouse
gccgctgtcacagcaggagt

SEQ ID NO: 590945 - DNA, 20 bp, mouse
gctctacttgggactcgact

SEQ ID NO: 590946 - DNA, 20 bp, mouse
gcgacagtctggctcttggt

SEQ ID NO: 590947 - DNA, 20 bp, mouse
gttggtgggaccggcccgag

SEQ ID NO: 590948 - DNA, 20 bp, mouse
gggccccggtcacgacagtc

SEQ ID NO: 590949 - DNA, 20 bp, mouse
gcggagcagggtggccatgg

SEQ ID NO: 590950 - DNA, 20 bp, mouse
ggagatgctgtccagaccag

SEQ ID NO: 590951 - DNA, 20 bp, mouse
gcactcgtcgcctctcgggc

SEQ ID NO: 590952 - DNA, 20 bp, mouse
gagtgcactcgtcgcctctc

SEQ ID NO: 590953 - DNA, 20 bp, mouse
ggacgagtgcactgcagagc

SEQ ID NO: 590954 - DNA, 20 bp, mouse
gagcgcgaccgaggctggag

SEQ ID NO: 590955 - DNA, 20 bp, mouse
gtgggacttgttggacacgg

SEQ ID NO: 590956 - DNA, 20 bp, mouse
ggcagtgtcagctggtggac

SEQ ID NO: 590957 - DNA, 20 bp, mouse
gctctggtgtctactgagga

SEQ ID NO: 590958 - DNA, 20 bp, mouse
gccgctgcagtgtcagctgg

SEQ ID NO: 590959 - DNA, 20 bp, mouse
gttacctctggtgtctactg

SEQ ID NO: 590960 - DNA, 20 bp, mouse
ggcccacaggagcgacttca

SEQ ID NO: 590961 - DNA, 20 bp, mouse
gctcctgtgggcagcgaccc

SEQ ID NO: 590962 - DNA, 20 bp, mouse
gagcctgggtcgctgcccac

SEQ ID NO: 590963 - DNA, 20 bp, mouse
gtctctctggacccgggtca

SEQ ID NO: 590964 - DNA, 20 bp, mouse
ggcctcaggcccccacacac

SEQ ID NO: 590965 - DNA, 20 bp, mouse
gcgcagagcccggtgtgtgg

SEQ ID NO: 590966 - DNA, 20 bp, mouse
gcacagtcaaggtgagccca

SEQ ID NO: 590967 - DNA, 20 bp, mouse
gtgcttggggaagtctaaag

SEQ ID NO: 590968 - DNA, 20 bp, mouse
gcagaaagagctagggtgaa

SEQ ID NO: 590969 - DNA, 20 bp, mouse
ggccctgctgtgaacactct

SEQ ID NO: 590970 - DNA, 20 bp, mouse
ggctccagcccggctgcttg

SEQ ID NO: 590971 - DNA, 20 bp, mouse
ggacaggtgctctcgagaga

SEQ ID NO: 590972 - DNA, 20 bp, mouse
gggttgggacacaggggccc

SEQ ID NO: 590973 - DNA, 20 bp, mouse
gcttccccaagcagccgggc

SEQ ID NO: 590974 - DNA, 20 bp, mouse
gggggtagggttgggacaca

SEQ ID NO: 590975 - DNA, 20 bp, mouse
gctcgagagaaggaagagca

SEQ ID NO: 590976 - DNA, 20 bp, mouse
gggagcgctggtgagtacac

SEQ ID NO: 590977 - DNA, 20 bp, mouse
gtgagatcagaagcagccgg

SEQ ID NO: 590978 - DNA, 20 bp, mouse
gttacctgcgaagggagcgc

SEQ ID NO: 590979 - DNA, 20 bp, mouse
gcagaagcagccggcggtag

SEQ ID NO: 590980 - DNA, 20 bp, mouse
gcgctggtgagtacaccggt

SEQ ID NO: 590981 - DNA, 20 bp, mouse
ggctgtcccttacctgcgaa

SEQ ID NO: 590982 - DNA, 20 bp, mouse
gaccggtcggccgctaccgc

SEQ ID NO: 590983 - DNA, 20 bp, mouse
gcagacacagctagcaggtg

SEQ ID NO: 590984 - DNA, 20 bp, mouse
gtcaccagcgctcccttcgc

SEQ ID NO: 590985 - DNA, 20 bp, mouse
gagagggccactgcacgtca

SEQ ID NO: 590986 - DNA, 20 bp, mouse
gacctgcatgtatggtgagg

SEQ ID NO: 590987 - DNA, 20 bp, mouse
ggagctcctacctgcatgta

SEQ ID NO: 590988 - DNA, 20 bp, mouse
gagtgtcctagagcttggtc

SEQ ID NO: 590989 - DNA, 20 bp, mouse
ggccccctcaccatacatgc

SEQ ID NO: 590990 - DNA, 20 bp, mouse
ggcaagtgagaagaacctag

SEQ ID NO: 590991 - DNA, 20 bp, mouse
ggactcagtgtcctagagct

SEQ ID NO: 590992 - DNA, 20 bp, mouse
gggcctgagcccaatcactg

SEQ ID NO: 590993 - DNA, 20 bp, mouse
gctaagggtacagggttcta

SEQ ID NO: 590994 - DNA, 20 bp, mouse
gctggcagctctggccccat

SEQ ID NO: 590995 - DNA, 20 bp, mouse
gcctacctgcatgtatggtg

SEQ ID NO: 590996 - DNA, 20 bp, mouse
gcgtgcggagcgacaagtct

SEQ ID NO: 590997 - DNA, 20 bp, mouse
gcacacgcgcgaggaggaag

SEQ ID NO: 590998 - DNA, 20 bp, mouse
gggcccggccagcacacccc

SEQ ID NO: 590999 - DNA, 20 bp, mouse
ggcgggcggtcgctagggaa

SEQ ID NO: 591000 - DNA, 20 bp, mouse
gggcggtcgctagggaacgg

SEQ ID NO: 591001 - DNA, 20 bp, mouse
ggaggaagcgggggctacgg

SEQ ID NO: 591002 - DNA, 20 bp, mouse
ggcgacaagtctgggagact

SEQ ID NO: 591003 - DNA, 20 bp, mouse
gatggctccggcgagaggtg

SEQ ID NO: 591004 - DNA, 20 bp, mouse
gccgcaccacacgcgcgagg

SEQ ID NO: 591005 - DNA, 20 bp, mouse
ggggctgcgggcggtcgcta

SEQ ID NO: 591006 - DNA, 20 bp, mouse
ggccccagccccggccgcag

SEQ ID NO: 591007 - DNA, 20 bp, mouse
ggttgccgaggggacgggac

SEQ ID NO: 591008 - DNA, 20 bp, mouse
gacatggcagcggttggggt

SEQ ID NO: 591009 - DNA, 20 bp, mouse
gtgccaacatggcagcggtt

SEQ ID NO: 591010 - DNA, 20 bp, mouse
ggttggtggatctaccgctg

SEQ ID NO: 591011 - DNA, 20 bp, mouse
gctgctgttgccgaggggac

SEQ ID NO: 591012 - DNA, 20 bp, mouse
ggtgaggtggcctgacgtag

SEQ ID NO: 591013 - DNA, 20 bp, mouse
gcacgtaggtccgttcacac

SEQ ID NO: 591014 - DNA, 20 bp, mouse
gtggatctaccgctgcggcc

SEQ ID NO: 591015 - DNA, 20 bp, mouse
ggccacctcacccgctgtag

SEQ ID NO: 591016 - DNA, 20 bp, mouse
gccgcgacgccgggagaccc

SEQ ID NO: 591017 - DNA, 20 bp, mouse
gcccaggctgccgagcccgt

SEQ ID NO: 591018 - DNA, 20 bp, mouse
ggaggccaccgggaccacag

SEQ ID NO: 591019 - DNA, 20 bp, mouse
gcggcggtgctgcgggtcag

SEQ ID NO: 591020 - DNA, 20 bp, mouse
ggcggtccgggccacagagc

SEQ ID NO: 591021 - DNA, 20 bp, mouse
gtgctgcgggtcagcggacg

SEQ ID NO: 591022 - DNA, 20 bp, mouse
gtgcgggtcagcggacgcgg

SEQ ID NO: 591023 - DNA, 20 bp, mouse
ggtccgggccacagagccgg

SEQ ID NO: 591024 - DNA, 20 bp, mouse
gcgcctgggcctcaccgaag

SEQ ID NO: 591025 - DNA, 20 bp, mouse
gccacagagccggcgggagc

SEQ ID NO: 591026 - DNA, 20 bp, mouse
gcaaggtgagttgaaagcga

SEQ ID NO: 591027 - DNA, 20 bp, mouse
gtagagagcggacccaagtg

SEQ ID NO: 591028 - DNA, 20 bp, mouse
ggcgtgcgcaacaagttcgg

SEQ ID NO: 591029 - DNA, 20 bp, mouse
gtgcgcgtgcgcaacaagtt

SEQ ID NO: 591030 - DNA, 20 bp, mouse
gagggttgcttcagtcggcg

SEQ ID NO: 591031 - DNA, 20 bp, mouse
ggcgaagggttacccttcta

SEQ ID NO: 591032 - DNA, 20 bp, mouse
gagtagcctttgccctgagg

SEQ ID NO: 591033 - DNA, 20 bp, mouse
ggtctggaaggcagacgtca

SEQ ID NO: 591034 - DNA, 20 bp, mouse
gcctttgccctgaggaggcg

SEQ ID NO: 591035 - DNA, 20 bp, mouse
gtgcgcgcacgggtaaaggt

SEQ ID NO: 591036 - DNA, 20 bp, mouse
gagctaagagccgcccgcta

SEQ ID NO: 591037 - DNA, 20 bp, mouse
gtagggaagagcagcctgag

SEQ ID NO: 591038 - DNA, 20 bp, mouse
gcaggctgctcttccctagc

SEQ ID NO: 591039 - DNA, 20 bp, mouse
gctgctgctactacgaactt

SEQ ID NO: 591040 - DNA, 20 bp, mouse
ggcctgcgcaatggccgctc

SEQ ID NO: 591041 - DNA, 20 bp, mouse
gaatgagcgcgcctgcgcaa

SEQ ID NO: 591042 - DNA, 20 bp, mouse
ggcctgagcggccattgcgc

SEQ ID NO: 591043 - DNA, 20 bp, mouse
gacttaggcagtcactatgt

SEQ ID NO: 591044 - DNA, 20 bp, mouse
gctcattccagcgcttccgg

SEQ ID NO: 591045 - DNA, 20 bp, mouse
gcaacgcgcacaggtaggat

SEQ ID NO: 591046 - DNA, 20 bp, mouse
ggagcaggtagcggtaccgg

SEQ ID NO: 591047 - DNA, 20 bp, mouse
gatccgttcagagcaggtag

SEQ ID NO: 591048 - DNA, 20 bp, mouse
gccggcggcagggacctcat

SEQ ID NO: 591049 - DNA, 20 bp, mouse
gtcagagcaggtagcggtac

SEQ ID NO: 591050 - DNA, 20 bp, mouse
gcggcgaaggcgaaagctcc

SEQ ID NO: 591051 - DNA, 20 bp, mouse
ggtagcggtaccggcggcga

SEQ ID NO: 591052 - DNA, 20 bp, mouse
gcgaaggcgaaagctccagg

SEQ ID NO: 591053 - DNA, 20 bp, mouse
gaggagtcctgccccctcaa

SEQ ID NO: 591054 - DNA, 20 bp, mouse
ggtcgcacgcagctcctatg

SEQ ID NO: 591055 - DNA, 20 bp, mouse
gagctccaggcggacatcgc

SEQ ID NO: 591056 - DNA, 20 bp, mouse
gacagtgccacgcggatctg

SEQ ID NO: 591057 - DNA, 20 bp, mouse
gcgcgcgctgaagggaacag

SEQ ID NO: 591058 - DNA, 20 bp, mouse
gcggggaatgtgagtccccc

SEQ ID NO: 591059 - DNA, 20 bp, mouse
gctgctggagcgggcggcag

SEQ ID NO: 591060 - DNA, 20 bp, mouse
ggccgcgtgcccatccacac

SEQ ID NO: 591061 - DNA, 20 bp, mouse
gagccgcgtggggcggaggg

SEQ ID NO: 591062 - DNA, 20 bp, mouse
gttgggagccccgtgtggat

SEQ ID NO: 591063 - DNA, 20 bp, mouse
gccggaccccctgagagaga

SEQ ID NO: 591064 - DNA, 20 bp, mouse
gcttccgctggctggctgac

SEQ ID NO: 591065 - DNA, 20 bp, mouse
ggaagccccgcgaggagcgt

SEQ ID NO: 591066 - DNA, 20 bp, mouse
gggcgtgtgaagaccttccg

SEQ ID NO: 591067 - DNA, 20 bp, mouse
ggtcgcgggagcagacccgg

SEQ ID NO: 591068 - DNA, 20 bp, mouse
ggtgtgaagaccttccgggg

SEQ ID NO: 591069 - DNA, 20 bp, mouse
ggccgtcgcgggagcagacc

SEQ ID NO: 591070 - DNA, 20 bp, mouse
gagaccttccggggaggtgg

SEQ ID NO: 591071 - DNA, 20 bp, mouse
gggaagtggcgcgcagggtc

SEQ ID NO: 591072 - DNA, 20 bp, mouse
ggcgcacagagacgcctagg

SEQ ID NO: 591073 - DNA, 20 bp, mouse
gcggccgccacctccccgga

SEQ ID NO: 591074 - DNA, 20 bp, mouse
gcgtcaggcagaactcgggt

SEQ ID NO: 591075 - DNA, 20 bp, mouse
gtgaagaccttccggggagg

SEQ ID NO: 591076 - DNA, 20 bp, mouse
gtcaagacggccctcaggga

SEQ ID NO: 591077 - DNA, 20 bp, mouse
gtcagggagggaaccgctgg

SEQ ID NO: 591078 - DNA, 20 bp, mouse
gccctcagggagggaaccgc

SEQ ID NO: 591079 - DNA, 20 bp, mouse
gtctagggtagcgaactgaa

SEQ ID NO: 591080 - DNA, 20 bp, mouse
gttgatcaagacggccctca

SEQ ID NO: 591081 - DNA, 20 bp, mouse
gcgcactagggaggcggcca

SEQ ID NO: 591082 - DNA, 20 bp, mouse
ggttgcgcgcggattttcta

SEQ ID NO: 591083 - DNA, 20 bp, mouse
ggcaacatcaccaccgccag

SEQ ID NO: 591084 - DNA, 20 bp, mouse
gcccggtgagtgaccctctc

SEQ ID NO: 591085 - DNA, 20 bp, mouse
ggggagggaaccgctggcgg

SEQ ID NO: 591086 - DNA, 20 bp, mouse
gtgaccggagcaaggccctg

SEQ ID NO: 591087 - DNA, 20 bp, mouse
gtgctgcagggagatcaccg

SEQ ID NO: 591088 - DNA, 20 bp, mouse
gtctcgagggacacggacag

SEQ ID NO: 591089 - DNA, 20 bp, mouse
ggctcaggaaggcgtctcga

SEQ ID NO: 591090 - DNA, 20 bp, mouse
gacacggacaggggcctgac

SEQ ID NO: 591091 - DNA, 20 bp, mouse
ggaaggcgtctcgagggaca

SEQ ID NO: 591092 - DNA, 20 bp, mouse
gctggaagcggtgaaaatag

SEQ ID NO: 591093 - DNA, 20 bp, mouse
ggagcgagcaagatgaggag

SEQ ID NO: 591094 - DNA, 20 bp, mouse
gtcggctcgtggcaaccgca

SEQ ID NO: 591095 - DNA, 20 bp, mouse
ggtgctgcaggtgcacccga

SEQ ID NO: 591096 - DNA, 20 bp, mouse
gagcctgggcggaggtaagt

SEQ ID NO: 591097 - DNA, 20 bp, mouse
gaggccgggcgagaaggcag

SEQ ID NO: 591098 - DNA, 20 bp, mouse
gcggaggtaagtgggcgtgt

SEQ ID NO: 591099 - DNA, 20 bp, mouse
gaggctcccggcgagagcct

SEQ ID NO: 591100 - DNA, 20 bp, mouse
gctcccggcgagagcctggg

SEQ ID NO: 591101 - DNA, 20 bp, mouse
gcctgccggaagctcgaggt

SEQ ID NO: 591102 - DNA, 20 bp, mouse
gaaactgaggccgggcgaga

SEQ ID NO: 591103 - DNA, 20 bp, mouse
gctccgcccaggctctcgcc

SEQ ID NO: 591104 - DNA, 20 bp, mouse
ggcctcctgccggaagctcg

SEQ ID NO: 591105 - DNA, 20 bp, mouse
ggtgggcactgtgcctcagg

SEQ ID NO: 591106 - DNA, 20 bp, mouse
gaggctcgggaaggacccgg

SEQ ID NO: 591107 - DNA, 20 bp, mouse
gcggaggctcgggaaggacc

SEQ ID NO: 591108 - DNA, 20 bp, mouse
gcggcagtgcggggagctgt

SEQ ID NO: 591109 - DNA, 20 bp, mouse
gagcgtggcggcggaggctc

SEQ ID NO: 591110 - DNA, 20 bp, mouse
gggaaggacccggcggctcg

SEQ ID NO: 591111 - DNA, 20 bp, mouse
ggattgcgggcctagcgtgg

SEQ ID NO: 591112 - DNA, 20 bp, mouse
gtgcgggcctagcgtggcgg

SEQ ID NO: 591113 - DNA, 20 bp, mouse
ggcgccggccgaaacgctaa

SEQ ID NO: 591114 - DNA, 20 bp, mouse
gtgtgtggaggatttcgcgg

SEQ ID NO: 591115 - DNA, 20 bp, mouse
ggacccggcggctcgcggca

SEQ ID NO: 591116 - DNA, 20 bp, mouse
gtggccaggcgagagggcaa

SEQ ID NO: 591117 - DNA, 20 bp, mouse
ggcagcctggccaggcgaga

SEQ ID NO: 591118 - DNA, 20 bp, mouse
ggagatggaggagcccaacg

SEQ ID NO: 591119 - DNA, 20 bp, mouse
gagggcaacggcgccgcgtt

SEQ ID NO: 591120 - DNA, 20 bp, mouse
gtgctgtcggcgctcttcta

SEQ ID NO: 591121 - DNA, 20 bp, mouse
gcgcctggccaggctgctgt

SEQ ID NO: 591122 - DNA, 20 bp, mouse
gggcgctgctgaccacatac

SEQ ID NO: 591123 - DNA, 20 bp, mouse
ggggctgggtttgggccggg

SEQ ID NO: 591124 - DNA, 20 bp, mouse
gaagagcgccgacagcagcc

SEQ ID NO: 591125 - DNA, 20 bp, mouse
gatcccaagtggactttgtt

SEQ ID NO: 591126 - DNA, 20 bp, mouse
gtgctctgccactgtgggaa

SEQ ID NO: 591127 - DNA, 20 bp, mouse
gcccgctgctctgccactgt

SEQ ID NO: 591128 - DNA, 20 bp, mouse
gggcggcgggacgaagcgaa

SEQ ID NO: 591129 - DNA, 20 bp, mouse
gcgcagagcgagggcagcgg

SEQ ID NO: 591130 - DNA, 20 bp, mouse
gggtggagcctgcttccctg

SEQ ID NO: 591131 - DNA, 20 bp, mouse
gctaggctcaggccgaaggg

SEQ ID NO: 591132 - DNA, 20 bp, mouse
gcccggagagccgaccccgg

SEQ ID NO: 591133 - DNA, 20 bp, mouse
ggagaccgcgacttggaagt

SEQ ID NO: 591134 - DNA, 20 bp, mouse
gtcccctgcacagctaaaga

SEQ ID NO: 591135 - DNA, 20 bp, mouse
gagcagcggggtgcgtgctg

SEQ ID NO: 591136 - DNA, 20 bp, mouse
gggccgctcgggcaggatgg

SEQ ID NO: 591137 - DNA, 20 bp, mouse
ggcggtcgtccggcgggaag

SEQ ID NO: 591138 - DNA, 20 bp, mouse
gacggtgaccgggaacggga

SEQ ID NO: 591139 - DNA, 20 bp, mouse
gcgcgcacagcgctaggatg

SEQ ID NO: 591140 - DNA, 20 bp, mouse
ggtcgtccggcgggaagggg

SEQ ID NO: 591141 - DNA, 20 bp, mouse
gcggtgtgcgcgtaggagac

SEQ ID NO: 591142 - DNA, 20 bp, mouse
gaggatgtggcacagcgaca

SEQ ID NO: 591143 - DNA, 20 bp, mouse
gcgggaaggggcggccgctc

SEQ ID NO: 591144 - DNA, 20 bp, mouse
gacaggaggaccacccagat

SEQ ID NO: 591145 - DNA, 20 bp, mouse
gcgccgccatcctgcccgag

SEQ ID NO: 591146 - DNA, 20 bp, mouse
gcagagcggtccagagtcaa

SEQ ID NO: 591147 - DNA, 20 bp, mouse
gcctcccacagccctcctaa

SEQ ID NO: 591148 - DNA, 20 bp, mouse
gccctctaggtcagacccag

SEQ ID NO: 591149 - DNA, 20 bp, mouse
gttgggacacacacacgggt

SEQ ID NO: 591150 - DNA, 20 bp, mouse
gcaaatctaaacccttagga

SEQ ID NO: 591151 - DNA, 20 bp, mouse
gctggacgcacaggtagggt

SEQ ID NO: 591152 - DNA, 20 bp, mouse
gcgggctggacgcacaggta

SEQ ID NO: 591153 - DNA, 20 bp, mouse
gcaagactcggagagcacgg

SEQ ID NO: 591154 - DNA, 20 bp, mouse
gggctctgcataaactccag

SEQ ID NO: 591155 - DNA, 20 bp, mouse
gagatttgggacacacacac

SEQ ID NO: 591156 - DNA, 20 bp, mouse
gcggcgcagcgaccgggacc

SEQ ID NO: 591157 - DNA, 20 bp, mouse
gacctcgcggcgcagcgacc

SEQ ID NO: 591158 - DNA, 20 bp, mouse
gccacggtccggccggagac

SEQ ID NO: 591159 - DNA, 20 bp, mouse
ggcatgcgccagccgggtcc

SEQ ID NO: 591160 - DNA, 20 bp, mouse
ggcagcgaccgggacccggc

SEQ ID NO: 591161 - DNA, 20 bp, mouse
gtaggccgccgccctccgag

SEQ ID NO: 591162 - DNA, 20 bp, mouse
gcgctgcgccgcgaggtaat

SEQ ID NO: 591163 - DNA, 20 bp, mouse
gggcggacccgctcggaggg

SEQ ID NO: 591164 - DNA, 20 bp, mouse
gcgtggcggacccgctcgga

SEQ ID NO: 591165 - DNA, 20 bp, mouse
ggggctgggaggagccgtgg

SEQ ID NO: 591166 - DNA, 20 bp, mouse
gagccgggtgaggcctgtgc

SEQ ID NO: 591167 - DNA, 20 bp, mouse
gttgacaacagagccgggtg

SEQ ID NO: 591168 - DNA, 20 bp, mouse
gtccggtaattggatttctg

SEQ ID NO: 591169 - DNA, 20 bp, mouse
gagctcccgctcacctgcac

SEQ ID NO: 591170 - DNA, 20 bp, mouse
gctgctccctaggcattccg

SEQ ID NO: 591171 - DNA, 20 bp, mouse
gcagggcggcgccccctctg

SEQ ID NO: 591172 - DNA, 20 bp, mouse
gagtcacctcggaatgccta

SEQ ID NO: 591173 - DNA, 20 bp, mouse
gcaagaatcaaggtccatcc

SEQ ID NO: 591174 - DNA, 20 bp, mouse
gtccgaggtgactcacagct

SEQ ID NO: 591175 - DNA, 20 bp, mouse
gtctaggcaggttgtcatcc

SEQ ID NO: 591176 - DNA, 20 bp, mouse
gaacccggcgccagctgaag

SEQ ID NO: 591177 - DNA, 20 bp, mouse
gtcactccgtgagacacaga

SEQ ID NO: 591178 - DNA, 20 bp, mouse
gcagtgcctagggcttgtcc

SEQ ID NO: 591179 - DNA, 20 bp, mouse
gtggcagcggcccggagaga

SEQ ID NO: 591180 - DNA, 20 bp, mouse
gtcttctctcccagtgccta

SEQ ID NO: 591181 - DNA, 20 bp, mouse
gcggagctgcaaccaagtcc

SEQ ID NO: 591182 - DNA, 20 bp, mouse
gcgggcccgggaacaagcag

SEQ ID NO: 591183 - DNA, 20 bp, mouse
gctccggcgggaggtggcag

SEQ ID NO: 591184 - DNA, 20 bp, mouse
gctagggcttgtcctggctg

SEQ ID NO: 591185 - DNA, 20 bp, mouse
ggtggtggcgccgcttcagc

SEQ ID NO: 591186 - DNA, 20 bp, mouse
gctcgggcccggaagacagg

SEQ ID NO: 591187 - DNA, 20 bp, mouse
ggagtccgcgccgtactcac

SEQ ID NO: 591188 - DNA, 20 bp, mouse
gccgggcccgagcacttctc

SEQ ID NO: 591189 - DNA, 20 bp, mouse
ggagccccgggcgctgggta

SEQ ID NO: 591190 - DNA, 20 bp, mouse
ggcctgggtggcggggacac

SEQ ID NO: 591191 - DNA, 20 bp, mouse
ggagtcgccggcgagtgcgg

SEQ ID NO: 591192 - DNA, 20 bp, mouse
gggaaccccgagaagtgctc

SEQ ID NO: 591193 - DNA, 20 bp, mouse
gcgctggcccccgcactcgc

SEQ ID NO: 591194 - DNA, 20 bp, mouse
ggcgggcaccgagccaggaa

SEQ ID NO: 591195 - DNA, 20 bp, mouse
ggcggggacacaggcagaac

SEQ ID NO: 591196 - DNA, 20 bp, mouse
ggcagcgagccgggagtagg

SEQ ID NO: 591197 - DNA, 20 bp, mouse
gctgtcgccgcgactcactg

SEQ ID NO: 591198 - DNA, 20 bp, mouse
gcggccaccgcagtgagtcg

SEQ ID NO: 591199 - DNA, 20 bp, mouse
gtttgcagcgagccgggagt

SEQ ID NO: 591200 - DNA, 20 bp, mouse
gtcgccgcgactcactgcgg

SEQ ID NO: 591201 - DNA, 20 bp, mouse
ggcgcacagcctcctactcc

SEQ ID NO: 591202 - DNA, 20 bp, mouse
ggccaggaggatgtgcgcgg

SEQ ID NO: 591203 - DNA, 20 bp, mouse
gccaggatgtaggcgatcgg

SEQ ID NO: 591204 - DNA, 20 bp, mouse
ggcggccaggaggatgtgcg

SEQ ID NO: 591205 - DNA, 20 bp, mouse
gcccgccgcgcacatcctcc

SEQ ID NO: 591206 - DNA, 20 bp, mouse
gaaaggggacgggaccaagg

SEQ ID NO: 591207 - DNA, 20 bp, mouse
gcctggagaaactccaacat

SEQ ID NO: 591208 - DNA, 20 bp, mouse
gtcccgtcccctttgcacgt

SEQ ID NO: 591209 - DNA, 20 bp, mouse
gtgcaaaggggacgggacca

SEQ ID NO: 591210 - DNA, 20 bp, mouse
gtggctgctgtagtgtaact

SEQ ID NO: 591211 - DNA, 20 bp, mouse
gttcccacgtgcaaagggga

SEQ ID NO: 591212 - DNA, 20 bp, mouse
gaagcttcccacgtgcaaag

SEQ ID NO: 591213 - DNA, 20 bp, mouse
gtgtaactgggctgcgtggg

SEQ ID NO: 591214 - DNA, 20 bp, mouse
gcgcctgaggtacttcctaa

SEQ ID NO: 591215 - DNA, 20 bp, mouse
gtacactacagcagccacct

SEQ ID NO: 591216 - DNA, 20 bp, mouse
gagtgacccaggccaccgga

SEQ ID NO: 591217 - DNA, 20 bp, mouse
gcagcactcggccccgacgg

SEQ ID NO: 591218 - DNA, 20 bp, mouse
ggcgctggcagcgagagtcc

SEQ ID NO: 591219 - DNA, 20 bp, mouse
ggggtcactcccctccgtcg

SEQ ID NO: 591220 - DNA, 20 bp, mouse
gtcacagcactcggccccga

SEQ ID NO: 591221 - DNA, 20 bp, mouse
gcgctgccagcgccgtccgg

SEQ ID NO: 591222 - DNA, 20 bp, mouse
gcccctcgatggagtcgtgg

SEQ ID NO: 591223 - DNA, 20 bp, mouse
ggccgcggccttgagccgag

SEQ ID NO: 591224 - DNA, 20 bp, mouse
ggtccgcggccagggaggac

SEQ ID NO: 591225 - DNA, 20 bp, mouse
gccaggccaccggacggcgc

SEQ ID NO: 591226 - DNA, 20 bp, mouse
gtacttagtccaggccatag

SEQ ID NO: 591227 - DNA, 20 bp, mouse
gttagtccaggccatagtgg

SEQ ID NO: 591228 - DNA, 20 bp, mouse
ggtaggagactccacatccc

SEQ ID NO: 591229 - DNA, 20 bp, mouse
gttggagctgctgattcaag

SEQ ID NO: 591230 - DNA, 20 bp, mouse
gtctctcgtgtccaccacta

SEQ ID NO: 591231 - DNA, 20 bp, mouse
gtccacatcccgggtgaccc

SEQ ID NO: 591232 - DNA, 20 bp, mouse
ggggttggagagtagcggac

SEQ ID NO: 591233 - DNA, 20 bp, mouse
gcgcgctggtgtggacgaag

SEQ ID NO: 591234 - DNA, 20 bp, mouse
ggaggccgagctgaagggat

SEQ ID NO: 591235 - DNA, 20 bp, mouse
gagggacctgctgggccggt

SEQ ID NO: 591236 - DNA, 20 bp, mouse
ggggcccccggagagcgcgg

SEQ ID NO: 591237 - DNA, 20 bp, mouse
gggcagctgcgggcgccaga

SEQ ID NO: 591238 - DNA, 20 bp, mouse
gacaggacctcgcagtccag

SEQ ID NO: 591239 - DNA, 20 bp, mouse
gccggaagagccgagcggcc

SEQ ID NO: 591240 - DNA, 20 bp, mouse
gatggggcccccggagagcg

SEQ ID NO: 591241 - DNA, 20 bp, mouse
gcgcacgcccaggctccaca

SEQ ID NO: 591242 - DNA, 20 bp, mouse
ggaggagcacgtggacgtcg

SEQ ID NO: 591243 - DNA, 20 bp, mouse
gagctccgccgcgctctccg

SEQ ID NO: 591244 - DNA, 20 bp, mouse
ggcagtccagtggcagtcag

SEQ ID NO: 591245 - DNA, 20 bp, mouse
ggagcacgtggacgtcgagg

SEQ ID NO: 591246 - DNA, 20 bp, mouse
gctgcagcctggactgccag

SEQ ID NO: 591247 - DNA, 20 bp, mouse
gtggccgcccctggcagtcc

SEQ ID NO: 591248 - DNA, 20 bp, mouse
gtggcctccctagccagctg

SEQ ID NO: 591249 - DNA, 20 bp, mouse
gcagcctggactgccagggg

SEQ ID NO: 591250 - DNA, 20 bp, mouse
gcggcggcctcagctggcta

SEQ ID NO: 591251 - DNA, 20 bp, mouse
gcggtggcaagtgacccgta

SEQ ID NO: 591252 - DNA, 20 bp, mouse
gtggctagggaggccagacc

SEQ ID NO: 591253 - DNA, 20 bp, mouse
gagcgcaccgagccccacgt

SEQ ID NO: 591254 - DNA, 20 bp, mouse
gggagaggggcgccagacgc

SEQ ID NO: 591255 - DNA, 20 bp, mouse
ggaggccgccgcgcgctcgg

SEQ ID NO: 591256 - DNA, 20 bp, mouse
ggtccctcgagaaggttcca

SEQ ID NO: 591257 - DNA, 20 bp, mouse
gggtttggagtgagatctga

SEQ ID NO: 591258 - DNA, 20 bp, mouse
gtctgcaggccaggctattc

SEQ ID NO: 591259 - DNA, 20 bp, mouse
gagtgagatctgagggtgag

SEQ ID NO: 591260 - DNA, 20 bp, mouse
gttccctggaaccttctcga

SEQ ID NO: 591261 - DNA, 20 bp, mouse
gggaccaggcaacctgaccc

SEQ ID NO: 591262 - DNA, 20 bp, mouse
gagttgtccaggctgatttt

SEQ ID NO: 591263 - DNA, 20 bp, mouse
gcaatggctgaagctctgca

SEQ ID NO: 591264 - DNA, 20 bp, mouse
ggaggctctttctgcaggcc

SEQ ID NO: 591265 - DNA, 20 bp, mouse
gtacacacctaaaatcagcc

SEQ ID NO: 591266 - DNA, 20 bp, mouse
gccggaagcggctgtccagg

SEQ ID NO: 591267 - DNA, 20 bp, mouse
gacgtgacagggcccggaag

SEQ ID NO: 591268 - DNA, 20 bp, mouse
gcgctgaggctacgcgaggt

SEQ ID NO: 591269 - DNA, 20 bp, mouse
gcagcgccgacccctagcca

SEQ ID NO: 591270 - DNA, 20 bp, mouse
gtcggcgctgaggctacgcg

SEQ ID NO: 591271 - DNA, 20 bp, mouse
ggctagaaaaccatggctag

SEQ ID NO: 591272 - DNA, 20 bp, mouse
gcatgggagaccccacccca

SEQ ID NO: 591273 - DNA, 20 bp, mouse
gggcccggaagcggctgtcc

SEQ ID NO: 591274 - DNA, 20 bp, mouse
gtcagggacaggtcacccgt

SEQ ID NO: 591275 - DNA, 20 bp, mouse
ggagccagcatcacgtgaca

SEQ ID NO: 591276 - DNA, 20 bp, mouse
gaaagggcaagctcaaggta

SEQ ID NO: 591277 - DNA, 20 bp, mouse
gagggagagggcaatcaagg

SEQ ID NO: 591278 - DNA, 20 bp, mouse
gtgggcccagtagatctgac

SEQ ID NO: 591279 - DNA, 20 bp, mouse
gcaggccagagcaagctctc

SEQ ID NO: 591280 - DNA, 20 bp, mouse
gcaagctcaaggtagggaga

SEQ ID NO: 591281 - DNA, 20 bp, mouse
ggctctccggtcagatctac

SEQ ID NO: 591282 - DNA, 20 bp, mouse
gatcaaggaggtgtatgtgc

SEQ ID NO: 591283 - DNA, 20 bp, mouse
ggtatgtgcaggtgcaagtt

SEQ ID NO: 591284 - DNA, 20 bp, mouse
gctcttggtcacagacatga

SEQ ID NO: 591285 - DNA, 20 bp, mouse
gccggactggaagctgatgg

SEQ ID NO: 591286 - DNA, 20 bp, mouse
gcggggaacactgaccaagg

SEQ ID NO: 591287 - DNA, 20 bp, mouse
gagttctggtgcctagctgt

SEQ ID NO: 591288 - DNA, 20 bp, mouse
gagctaggcaccagaacttc

SEQ ID NO: 591289 - DNA, 20 bp, mouse
ggtgaatcagaggacagtgg

SEQ ID NO: 591290 - DNA, 20 bp, mouse
gcccgtggaccacagcatca

SEQ ID NO: 591291 - DNA, 20 bp, mouse
gtctagggccaggcataccc

SEQ ID NO: 591292 - DNA, 20 bp, mouse
gtcaaggactgatctgggag

SEQ ID NO: 591293 - DNA, 20 bp, mouse
ggaggaaggtatcattagac

SEQ ID NO: 591294 - DNA, 20 bp, mouse
gatcattagaccggaagttc

SEQ ID NO: 591295 - DNA, 20 bp, mouse
gatgataccttcctcctcct

SEQ ID NO: 591296 - DNA, 20 bp, mouse
ggtgcggccggcagagcggg

SEQ ID NO: 591297 - DNA, 20 bp, mouse
gcggcgcttccatccctcgg

SEQ ID NO: 591298 - DNA, 20 bp, mouse
gcctggagacccccgaggga

SEQ ID NO: 591299 - DNA, 20 bp, mouse
gagagcgggcggcggcgacc

SEQ ID NO: 591300 - DNA, 20 bp, mouse
ggccaggcgcgcgagacacc

SEQ ID NO: 591301 - DNA, 20 bp, mouse
gcgccggcgcttccatccct

SEQ ID NO: 591302 - DNA, 20 bp, mouse
ggcgcgcgcactgagcacta

SEQ ID NO: 591303 - DNA, 20 bp, mouse
gcggcgtatgcagagactcc

SEQ ID NO: 591304 - DNA, 20 bp, mouse
gcgcgcactgagcactaggg

SEQ ID NO: 591305 - DNA, 20 bp, mouse
ggggatgcgaggagctcggt

SEQ ID NO: 591306 - DNA, 20 bp, mouse
gggccgctccaggaagtcga

SEQ ID NO: 591307 - DNA, 20 bp, mouse
ggtaggcgcggggacaacgg

SEQ ID NO: 591308 - DNA, 20 bp, mouse
gcgggctgcggagcgcaggt

SEQ ID NO: 591309 - DNA, 20 bp, mouse
gagcagagggagacaaacgg

SEQ ID NO: 591310 - DNA, 20 bp, mouse
ggccttgagagacagtgcgg

SEQ ID NO: 591311 - DNA, 20 bp, mouse
gtgcggagcgcaggtaggcg

SEQ ID NO: 591312 - DNA, 20 bp, mouse
ggcagtgacagccaccgtct

SEQ ID NO: 591313 - DNA, 20 bp, mouse
ggcccacggcaggtgcgtgg

SEQ ID NO: 591314 - DNA, 20 bp, mouse
gggcaggaagcacgcgacgc

SEQ ID NO: 591315 - DNA, 20 bp, mouse
gaagcacgcgacgcgggctg

SEQ ID NO: 591316 - DNA, 20 bp, mouse
gtcgaagctgagactatgga

SEQ ID NO: 591317 - DNA, 20 bp, mouse
ggtgccggcgcctcaagatg

SEQ ID NO: 591318 - DNA, 20 bp, mouse
ggcactcgaagctgagacta

SEQ ID NO: 591319 - DNA, 20 bp, mouse
gcagggaggaccgcatcttg

SEQ ID NO: 591320 - DNA, 20 bp, mouse
gcgcgcgtcccggccagcgg

SEQ ID NO: 591321 - DNA, 20 bp, mouse
gcgcgaaggaaccagacacc

SEQ ID NO: 591322 - DNA, 20 bp, mouse
gtctggcagggctccttcgg

SEQ ID NO: 591323 - DNA, 20 bp, mouse
ggtccctagagaaggcgcga

SEQ ID NO: 591324 - DNA, 20 bp, mouse
gcaccagctgtccctagaga

SEQ ID NO: 591325 - DNA, 20 bp, mouse
gggaccgcatcttgaggcgc

SEQ ID NO: 591326 - DNA, 20 bp, mouse
gcggcgggagcggagtctag

SEQ ID NO: 591327 - DNA, 20 bp, mouse
gagcggagcgggttcttcgg

SEQ ID NO: 591328 - DNA, 20 bp, mouse
gcacatcccgctgggtgagg

SEQ ID NO: 591329 - DNA, 20 bp, mouse
gtctagcggagcgggttctt

SEQ ID NO: 591330 - DNA, 20 bp, mouse
gggagcggagtctagcggag

SEQ ID NO: 591331 - DNA, 20 bp, mouse
gagcaccaggagctccggtg

SEQ ID NO: 591332 - DNA, 20 bp, mouse
gacccccaccgggaccccac

SEQ ID NO: 591333 - DNA, 20 bp, mouse
ggctctggccacatcccgct

SEQ ID NO: 591334 - DNA, 20 bp, mouse
gggacaccagacaccagaga

SEQ ID NO: 591335 - DNA, 20 bp, mouse
gcccatgagccaagatcggt

SEQ ID NO: 591336 - DNA, 20 bp, mouse
gaggagcagtcaagaatctg

SEQ ID NO: 591337 - DNA, 20 bp, mouse
gaccaaggagggcatgacaa

SEQ ID NO: 591338 - DNA, 20 bp, mouse
gcgatctcatccaccaagga

SEQ ID NO: 591339 - DNA, 20 bp, mouse
gaatctgtggtcagaagtac

SEQ ID NO: 591340 - DNA, 20 bp, mouse
gatttgggtaagccatggaa

SEQ ID NO: 591341 - DNA, 20 bp, mouse
gtggtcagaagtactggagt

SEQ ID NO: 591342 - DNA, 20 bp, mouse
ggcacctcctgggcacgtgt

SEQ ID NO: 591343 - DNA, 20 bp, mouse
ggggtgccaggcatatacac

SEQ ID NO: 591344 - DNA, 20 bp, mouse
gggtaagccatggaagggca

SEQ ID NO: 591345 - DNA, 20 bp, mouse
gaagcttgtatcaggtggag

SEQ ID NO: 591346 - DNA, 20 bp, mouse
gaactgtcgccatcccggaa

SEQ ID NO: 591347 - DNA, 20 bp, mouse
gggtgactgcccttccggga

SEQ ID NO: 591348 - DNA, 20 bp, mouse
gctgtgcgctgcagccacga

SEQ ID NO: 591349 - DNA, 20 bp, mouse
gcgggatggcgacagttcca

SEQ ID NO: 591350 - DNA, 20 bp, mouse
ggccgcctgcccatcctgac

SEQ ID NO: 591351 - DNA, 20 bp, mouse
gactacgccggaggctgtcc

SEQ ID NO: 591352 - DNA, 20 bp, mouse
gccgctggagcacaaggcgt

SEQ ID NO: 591353 - DNA, 20 bp, mouse
gcggcgtagtcggaagtcag

SEQ ID NO: 591354 - DNA, 20 bp, mouse
ggagcgctgtccctgggccg

SEQ ID NO: 591355 - DNA, 20 bp, mouse
gtccgggtgactgcccttcc

SEQ ID NO: 591356 - DNA, 20 bp, mouse
ggacaccgagcatccaggaa

SEQ ID NO: 591357 - DNA, 20 bp, mouse
gcccagctgaggccccggga

SEQ ID NO: 591358 - DNA, 20 bp, mouse
gggctcactcgcccaggcgg

SEQ ID NO: 591359 - DNA, 20 bp, mouse
ggtggtacccgagcatacgg

SEQ ID NO: 591360 - DNA, 20 bp, mouse
ggtgctggcgggcagagtgt

SEQ ID NO: 591361 - DNA, 20 bp, mouse
gcctggcgtaccccaagaga

SEQ ID NO: 591362 - DNA, 20 bp, mouse
gtgccgcacccgcaccctcg

SEQ ID NO: 591363 - DNA, 20 bp, mouse
gaagaaggcgcggcgaccag

SEQ ID NO: 591364 - DNA, 20 bp, mouse
ggccccaggtctgtaagact

SEQ ID NO: 591365 - DNA, 20 bp, mouse
gaaccccgagggtgcgggtg

SEQ ID NO: 591366 - DNA, 20 bp, mouse
gggagcctggcagggtctgg

SEQ ID NO: 591367 - DNA, 20 bp, mouse
gctggtagagtaggctccga

SEQ ID NO: 591368 - DNA, 20 bp, mouse
gcgcagcagcctcatagcca

SEQ ID NO: 591369 - DNA, 20 bp, mouse
gacgtggtgaacagcatcgt

SEQ ID NO: 591370 - DNA, 20 bp, mouse
ggctgctgcggagcctggca

SEQ ID NO: 591371 - DNA, 20 bp, mouse
ggggttcccgcttcactctg

SEQ ID NO: 591372 - DNA, 20 bp, mouse
gcgcctccacctccaagtgg

SEQ ID NO: 591373 - DNA, 20 bp, mouse
gagtagccgaagccgaggac

SEQ ID NO: 591374 - DNA, 20 bp, mouse
gaggtgagtcgagggcgcgg

SEQ ID NO: 591375 - DNA, 20 bp, mouse
ggcggaagtttgggtgccgg

SEQ ID NO: 591376 - DNA, 20 bp, mouse
gctcgctggcgaacttaagc

SEQ ID NO: 591377 - DNA, 20 bp, mouse
gacccagggacccgctgcac

SEQ ID NO: 591378 - DNA, 20 bp, mouse
gcaggggagtttggcctggt

SEQ ID NO: 591379 - DNA, 20 bp, mouse
gccggctccttccatctcgc

SEQ ID NO: 591380 - DNA, 20 bp, mouse
gctagtgcccagcgtaccca

SEQ ID NO: 591381 - DNA, 20 bp, mouse
gcagttgggcagcctcaaca

SEQ ID NO: 591382 - DNA, 20 bp, mouse
gcatgtctgcatctgcgcaa

SEQ ID NO: 591383 - DNA, 20 bp, mouse
ggccggtgcagcgggtccct

SEQ ID NO: 591384 - DNA, 20 bp, mouse
ggcgggtccctgggtacgct

SEQ ID NO: 591385 - DNA, 20 bp, mouse
gatcagcagccacagctgag

SEQ ID NO: 591386 - DNA, 20 bp, mouse
gtcctccggcggagattgag

SEQ ID NO: 591387 - DNA, 20 bp, mouse
gtgcgagctggcccacctca

SEQ ID NO: 591388 - DNA, 20 bp, mouse
gaatggcgatcacgatcctc

SEQ ID NO: 591389 - DNA, 20 bp, mouse
gggcggagattgaggggtag

SEQ ID NO: 591390 - DNA, 20 bp, mouse
gggcgatcacgatcctccgg

SEQ ID NO: 591391 - DNA, 20 bp, mouse
gtcacggcagcgtctcccgt

SEQ ID NO: 591392 - DNA, 20 bp, mouse
ggctcgcagggagagcaccg

SEQ ID NO: 591393 - DNA, 20 bp, mouse
ggattgaggggtagcggcgc

SEQ ID NO: 591394 - DNA, 20 bp, mouse
gtcccgagcgcgagttatag

SEQ ID NO: 591395 - DNA, 20 bp, mouse
gcagggagagcaccgaggtg

SEQ ID NO: 591396 - DNA, 20 bp, mouse
gccgtacctggcctcgtggt

SEQ ID NO: 591397 - DNA, 20 bp, mouse
gcggatctcaccctctggaa

SEQ ID NO: 591398 - DNA, 20 bp, mouse
gcagcacactccgttccaga

SEQ ID NO: 591399 - DNA, 20 bp, mouse
gtgcagcagcaggggatgaa

SEQ ID NO: 591400 - DNA, 20 bp, mouse
gctggtggctctatatcccc

SEQ ID NO: 591401 - DNA, 20 bp, mouse
gtatagagccaccagcacag

SEQ ID NO: 591402 - DNA, 20 bp, mouse
ggtgagatccgctctgctcc

SEQ ID NO: 591403 - DNA, 20 bp, mouse
gggtttgtgagcttgcgggt

SEQ ID NO: 591404 - DNA, 20 bp, mouse
ggctgaacgtgcccaccacg

SEQ ID NO: 591405 - DNA, 20 bp, mouse
ggagccaagcagaacagaag

SEQ ID NO: 591406 - DNA, 20 bp, mouse
ggttcctgagggtcctgact

SEQ ID NO: 591407 - DNA, 20 bp, mouse
gaaggggtagtggcacccac

SEQ ID NO: 591408 - DNA, 20 bp, mouse
gtcctcagtccaaagggaac

SEQ ID NO: 591409 - DNA, 20 bp, mouse
gacccacgggcagttcctga

SEQ ID NO: 591410 - DNA, 20 bp, mouse
gagtctcagcctgttccctt

SEQ ID NO: 591411 - DNA, 20 bp, mouse
gtcactcagcatatggacat

SEQ ID NO: 591412 - DNA, 20 bp, mouse
gaccctcaggaactgcccgt

SEQ ID NO: 591413 - DNA, 20 bp, mouse
gagggtcctgactaggctca

SEQ ID NO: 591414 - DNA, 20 bp, mouse
ggcatgagaaacaggtagag

SEQ ID NO: 591415 - DNA, 20 bp, mouse
gcctaaggaaacaggccctg

SEQ ID NO: 591416 - DNA, 20 bp, mouse
gccaaacagttcaggaaaga

SEQ ID NO: 591417 - DNA, 20 bp, mouse
gaggaaagacggcacaggac

SEQ ID NO: 591418 - DNA, 20 bp, mouse
gagttcaggaaagacggcac

SEQ ID NO: 591419 - DNA, 20 bp, mouse
gctgccatcccaaacagttc

SEQ ID NO: 591420 - DNA, 20 bp, mouse
gaagttgactggtgaatggt

SEQ ID NO: 591421 - DNA, 20 bp, mouse
gcaaccgacacagtctaaag

SEQ ID NO: 591422 - DNA, 20 bp, mouse
gtgaaggcactaaatgttag

SEQ ID NO: 591423 - DNA, 20 bp, mouse
gaatgacagaaaatactaca

SEQ ID NO: 591424 - DNA, 20 bp, mouse
ggtctgatgagaaagttgac

SEQ ID NO: 591425 - DNA, 20 bp, mouse
ggaatggtaggcaacggaca

SEQ ID NO: 591426 - DNA, 20 bp, mouse
gtggcggcaagggttagacc

SEQ ID NO: 591427 - DNA, 20 bp, mouse
ggccaatagagaagacggaa

SEQ ID NO: 591428 - DNA, 20 bp, mouse
gtggaatccaatggatgtgg

SEQ ID NO: 591429 - DNA, 20 bp, mouse
gagaagacggaagggtctcc

SEQ ID NO: 591430 - DNA, 20 bp, mouse
gccaatggatgtggcggcaa

SEQ ID NO: 591431 - DNA, 20 bp, mouse
gtcttcgggttggaatccaa

SEQ ID NO: 591432 - DNA, 20 bp, mouse
gctgtctaccctcttcgggt

SEQ ID NO: 591433 - DNA, 20 bp, mouse
gggttggaatccaatggatg

SEQ ID NO: 591434 - DNA, 20 bp, mouse
gacccttccgtcttctctat

SEQ ID NO: 591435 - DNA, 20 bp, mouse
ggcggaggggatagcttgag

SEQ ID NO: 591436 - DNA, 20 bp, mouse
gacagagtctgccctgtggg

SEQ ID NO: 591437 - DNA, 20 bp, mouse
ggagacagagtctgccctgt

SEQ ID NO: 591438 - DNA, 20 bp, mouse
gcagaaaagggcagacggcg

SEQ ID NO: 591439 - DNA, 20 bp, mouse
gtgaaatggccatttgaagt

SEQ ID NO: 591440 - DNA, 20 bp, mouse
gaatagaactttcctcccac

SEQ ID NO: 591441 - DNA, 20 bp, mouse
gagggtcaggagtggagcga

SEQ ID NO: 591442 - DNA, 20 bp, mouse
gagcttcttagacagacctg

SEQ ID NO: 591443 - DNA, 20 bp, mouse
gcaccccacagcgcatgaaa

SEQ ID NO: 591444 - DNA, 20 bp, mouse
gaggagagttagaagggcag

SEQ ID NO: 591445 - DNA, 20 bp, mouse
gagagaggaaagagcgccaa

SEQ ID NO: 591446 - DNA, 20 bp, mouse
ggagcaccatgcaggcgtcc

SEQ ID NO: 591447 - DNA, 20 bp, mouse
gtcccggcacagcatccaag

SEQ ID NO: 591448 - DNA, 20 bp, mouse
gcggtcgcggagcaccatgc

SEQ ID NO: 591449 - DNA, 20 bp, mouse
ggaggagccttggactgcag

SEQ ID NO: 591450 - DNA, 20 bp, mouse
gcgcttggggttaggggaag

SEQ ID NO: 591451 - DNA, 20 bp, mouse
gccggggcgcttggggttag

SEQ ID NO: 591452 - DNA, 20 bp, mouse
gctgtgccgggacgcctgca

SEQ ID NO: 591453 - DNA, 20 bp, mouse
gtggttcgggccccacccca

SEQ ID NO: 591454 - DNA, 20 bp, mouse
gccgactgctaagtaaatca

SEQ ID NO: 591455 - DNA, 20 bp, mouse
ggggcagagacgtaccagcc

SEQ ID NO: 591456 - DNA, 20 bp, mouse
ggtacgggaggtgcaaggtg

SEQ ID NO: 591457 - DNA, 20 bp, mouse
gatgtgaaaggaggtacggg

SEQ ID NO: 591458 - DNA, 20 bp, mouse
gctccggaacaacgcctaca

SEQ ID NO: 591459 - DNA, 20 bp, mouse
gcgcctacaaggtatgtgaa

SEQ ID NO: 591460 - DNA, 20 bp, mouse
gatcctggcctaggactgag

SEQ ID NO: 591461 - DNA, 20 bp, mouse
ggctcacgtgttacttgagt

SEQ ID NO: 591462 - DNA, 20 bp, mouse
gggtgcaaggtggggttgta

SEQ ID NO: 591463 - DNA, 20 bp, mouse
gaggaggtacgggaggtgca

SEQ ID NO: 591464 - DNA, 20 bp, mouse
gagcctggcgaaaaagcggt

SEQ ID NO: 591465 - DNA, 20 bp, mouse
gctcctttcacataccttgt

SEQ ID NO: 591466 - DNA, 20 bp, mouse
gagtcttcctccacaggtct

SEQ ID NO: 591467 - DNA, 20 bp, mouse
ggccccctaatgaaagtctc

SEQ ID NO: 591468 - DNA, 20 bp, mouse
gggctcctgagactttcatt

SEQ ID NO: 591469 - DNA, 20 bp, mouse
gggccctaagggcatttgtt

SEQ ID NO: 591470 - DNA, 20 bp, mouse
ggcactgtgggagctgaatt

SEQ ID NO: 591471 - DNA, 20 bp, mouse
gacactgttgcagtcatgag

SEQ ID NO: 591472 - DNA, 20 bp, mouse
gtttcattagggggccctaa

SEQ ID NO: 591473 - DNA, 20 bp, mouse
gaggtagagtcttcctccac

SEQ ID NO: 591474 - DNA, 20 bp, mouse
gattagggctcagggcactg

SEQ ID NO: 591475 - DNA, 20 bp, mouse
gtgcagtcatgagaggcagg

SEQ ID NO: 591476 - DNA, 20 bp, mouse
gagcccaggcgaggaaggaa

SEQ ID NO: 591477 - DNA, 20 bp, mouse
gtaagccgctgccaactgag

SEQ ID NO: 591478 - DNA, 20 bp, mouse
gctttcacagacctctcagt

SEQ ID NO: 591479 - DNA, 20 bp, mouse
gtagtcctctaaacaggaag

SEQ ID NO: 591480 - DNA, 20 bp, mouse
gcaggccaatccctctacgt

SEQ ID NO: 591481 - DNA, 20 bp, mouse
gtcgggctgtcagcacggag

SEQ ID NO: 591482 - DNA, 20 bp, mouse
ggagcagtgtccctagcccg

SEQ ID NO: 591483 - DNA, 20 bp, mouse
gagagaatagtcctctaaac

SEQ ID NO: 591484 - DNA, 20 bp, mouse
gtacgtcggaaaaccagagc

SEQ ID NO: 591485 - DNA, 20 bp, mouse
gctcctggcaaactcaccct

SEQ ID NO: 591486 - DNA, 20 bp, mouse
gatggagtgagaccctcggg

SEQ ID NO: 591487 - DNA, 20 bp, mouse
gtcgctggtcgcagggtcaa

SEQ ID NO: 591488 - DNA, 20 bp, mouse
gggcctcactcacctcccga

SEQ ID NO: 591489 - DNA, 20 bp, mouse
ggaagtctcggagaccaggt

SEQ ID NO: 591490 - DNA, 20 bp, mouse
gtatagccaaagaggggctt

SEQ ID NO: 591491 - DNA, 20 bp, mouse
gccccagctcctagcctggg

SEQ ID NO: 591492 - DNA, 20 bp, mouse
gagaccccagctcctagcct

SEQ ID NO: 591493 - DNA, 20 bp, mouse
ggtctcggagaccaggtcgg

SEQ ID NO: 591494 - DNA, 20 bp, mouse
ggagctttgcccgcactggg

SEQ ID NO: 591495 - DNA, 20 bp, mouse
gccagcgtcgcaggaagcag

SEQ ID NO: 591496 - DNA, 20 bp, mouse
ggccggggtttggtaccgag

SEQ ID NO: 591497 - DNA, 20 bp, mouse
gtccgctcggtaccaaaccc

SEQ ID NO: 591498 - DNA, 20 bp, mouse
gctttggagaatacacgact

SEQ ID NO: 591499 - DNA, 20 bp, mouse
gcacacggcactcgagtgtg

SEQ ID NO: 591500 - DNA, 20 bp, mouse
ggagcctgggagtcccggga

SEQ ID NO: 591501 - DNA, 20 bp, mouse
gacccggctccgggacccgt

SEQ ID NO: 591502 - DNA, 20 bp, mouse
gcgcacggggccggttctgg

SEQ ID NO: 591503 - DNA, 20 bp, mouse
gagggaatgtaaacaaatcg

SEQ ID NO: 591504 - DNA, 20 bp, mouse
gtccgcgacgcagatagcgc

SEQ ID NO: 591505 - DNA, 20 bp, mouse
ggcgacgcagatagcgcagg

SEQ ID NO: 591506 - DNA, 20 bp, mouse
gggcgagcgagtggcatcgg

SEQ ID NO: 591507 - DNA, 20 bp, mouse
gtgaccgcgagagtggagcc

SEQ ID NO: 591508 - DNA, 20 bp, mouse
ggagaaaaggcgactcacta

SEQ ID NO: 591509 - DNA, 20 bp, mouse
gcaggaagtgaccgcgagag

SEQ ID NO: 591510 - DNA, 20 bp, mouse
gtcgcccggctccactctcg

SEQ ID NO: 591511 - DNA, 20 bp, mouse
gcagcaggggctgtgacagg

SEQ ID NO: 591512 - DNA, 20 bp, mouse
gccgggcgagcgagtggcat

SEQ ID NO: 591513 - DNA, 20 bp, mouse
gtgccctaaggtgcaagtcc

SEQ ID NO: 591514 - DNA, 20 bp, mouse
gatcctagggtggagcagag

SEQ ID NO: 591515 - DNA, 20 bp, mouse
gaagggacctgtggtatcag

SEQ ID NO: 591516 - DNA, 20 bp, mouse
ggatccagtaatgacctcca

SEQ ID NO: 591517 - DNA, 20 bp, mouse
gtcttcttgaggtaagtgat

SEQ ID NO: 591518 - DNA, 20 bp, mouse
gagctctcagcacacagtta

SEQ ID NO: 591519 - DNA, 20 bp, mouse
gttttaaaacggagaactgt

SEQ ID NO: 591520 - DNA, 20 bp, mouse
gctaccctggaggtcattac

SEQ ID NO: 591521 - DNA, 20 bp, mouse
ggatcttgttactaccctgg

SEQ ID NO: 591522 - DNA, 20 bp, mouse
gaatttctgagagcattttg

SEQ ID NO: 591523 - DNA, 20 bp, mouse
ggtcattactggatcgtctc

SEQ ID NO: 591524 - DNA, 20 bp, mouse
gttgtttatctctagctccc

SEQ ID NO: 591525 - DNA, 20 bp, mouse
gtaggatcttgttactaccc

SEQ ID NO: 591526 - DNA, 20 bp, mouse
ggcgatcactcaccgcgcag

SEQ ID NO: 591527 - DNA, 20 bp, mouse
gactcaccgcgcagtggcag

SEQ ID NO: 591528 - DNA, 20 bp, mouse
ggcagagcgtgggacgtcag

SEQ ID NO: 591529 - DNA, 20 bp, mouse
ggcagcagatgcagcgctcc

SEQ ID NO: 591530 - DNA, 20 bp, mouse
ggggctgaggggcagagcgt

SEQ ID NO: 591531 - DNA, 20 bp, mouse
gaaggagaagacaagaagcg

SEQ ID NO: 591532 - DNA, 20 bp, mouse
gaccttagcgggtcatgcag

SEQ ID NO: 591533 - DNA, 20 bp, mouse
gcccagcccggagccacccc

SEQ ID NO: 591534 - DNA, 20 bp, mouse
gaatgagctagaatgtctgg

SEQ ID NO: 591535 - DNA, 20 bp, mouse
gtgccacctctgccactgcg

SEQ ID NO: 591536 - DNA, 20 bp, mouse
gcccaggacacagagcgcag

SEQ ID NO: 591537 - DNA, 20 bp, mouse
gcacgcagcctcactatcca

SEQ ID NO: 591538 - DNA, 20 bp, mouse
gtgtcgcccgctgccttggg

SEQ ID NO: 591539 - DNA, 20 bp, mouse
gggggccggacgtagagagg

SEQ ID NO: 591540 - DNA, 20 bp, mouse
gcacggtggcgaggagaagg

SEQ ID NO: 591541 - DNA, 20 bp, mouse
ggcaggcaggatgggaagtc

SEQ ID NO: 591542 - DNA, 20 bp, mouse
gggcagggagaaggacacat

SEQ ID NO: 591543 - DNA, 20 bp, mouse
ggaccgggcgcaggcaggat

SEQ ID NO: 591544 - DNA, 20 bp, mouse
gcccgggccctgcagctgaa

SEQ ID NO: 591545 - DNA, 20 bp, mouse
gggcctcccgaaaagactct

SEQ ID NO: 591546 - DNA, 20 bp, mouse
gtgtaaacccagacagtcca

SEQ ID NO: 591547 - DNA, 20 bp, mouse
gagacagtccagggacaaga

SEQ ID NO: 591548 - DNA, 20 bp, mouse
gaggaacagagtcagagtgg

SEQ ID NO: 591549 - DNA, 20 bp, mouse
ggcagttgaagtggtcaaag

SEQ ID NO: 591550 - DNA, 20 bp, mouse
gtcacccgcatagcagacga

SEQ ID NO: 591551 - DNA, 20 bp, mouse
gcagtcctgaaattcacgag

SEQ ID NO: 591552 - DNA, 20 bp, mouse
gcaaagatggaggtactact

SEQ ID NO: 591553 - DNA, 20 bp, mouse
gctaggaaaggtctgagata

SEQ ID NO: 591554 - DNA, 20 bp, mouse
gtactactaggagtaaaaat

SEQ ID NO: 591555 - DNA, 20 bp, mouse
gtgagccctcgtctgctatg

SEQ ID NO: 591556 - DNA, 20 bp, mouse
gtagcagctcgcagccccgg

SEQ ID NO: 591557 - DNA, 20 bp, mouse
gcggaccgcggggcagttgg

SEQ ID NO: 591558 - DNA, 20 bp, mouse
gggtctcggctggtccgctg

SEQ ID NO: 591559 - DNA, 20 bp, mouse
gggtccggaccccgccgcag

SEQ ID NO: 591560 - DNA, 20 bp, mouse
gcggaccagccgagaccccc

SEQ ID NO: 591561 - DNA, 20 bp, mouse
ggtccaatagacgctgatgt

SEQ ID NO: 591562 - DNA, 20 bp, mouse
gggtcaggtagggatacctc

SEQ ID NO: 591563 - DNA, 20 bp, mouse
gctcgcagccccgggggtct

SEQ ID NO: 591564 - DNA, 20 bp, mouse
ggctgtcagaggtacaagag

SEQ ID NO: 591565 - DNA, 20 bp, mouse
gcggcggggtccggaccgcg

SEQ ID NO: 591566 - DNA, 20 bp, mouse
gagacagctgggactgtccg

SEQ ID NO: 591567 - DNA, 20 bp, mouse
gagaagtcagcacctctaca

SEQ ID NO: 591568 - DNA, 20 bp, mouse
gggactgtccggggccagac

SEQ ID NO: 591569 - DNA, 20 bp, mouse
gccaaaagcgttccttgtag

SEQ ID NO: 591570 - DNA, 20 bp, mouse
gaagccccccagaaacggaa

SEQ ID NO: 591571 - DNA, 20 bp, mouse
gcccagctccagtctggccc

SEQ ID NO: 591572 - DNA, 20 bp, mouse
gtgggctagctggagacagc

SEQ ID NO: 591573 - DNA, 20 bp, mouse
gtcctgcccgctccaccctg

SEQ ID NO: 591574 - DNA, 20 bp, mouse
gctccaggaggcgggtctgg

SEQ ID NO: 591575 - DNA, 20 bp, mouse
gggtcttggagctagggcca

SEQ ID NO: 591576 - DNA, 20 bp, mouse
gcattacctgacggcaggac

SEQ ID NO: 591577 - DNA, 20 bp, mouse
gtggggttagcattacctga

SEQ ID NO: 591578 - DNA, 20 bp, mouse
gggtcagtgagtggcccggg

SEQ ID NO: 591579 - DNA, 20 bp, mouse
ggctgggtcccccttcctct

SEQ ID NO: 591580 - DNA, 20 bp, mouse
gcagcctgcctcccacaaga

SEQ ID NO: 591581 - DNA, 20 bp, mouse
ggccaggtcagatgtcagag

SEQ ID NO: 591582 - DNA, 20 bp, mouse
gtgacctggcttacaatcag

SEQ ID NO: 591583 - DNA, 20 bp, mouse
gtgggaggcaggctggacaa

SEQ ID NO: 591584 - DNA, 20 bp, mouse
gtgcctcccacaagaaggct

SEQ ID NO: 591585 - DNA, 20 bp, mouse
gttcttacacttcccagggt

SEQ ID NO: 591586 - DNA, 20 bp, mouse
ggagagtgccctgcctacag

SEQ ID NO: 591587 - DNA, 20 bp, mouse
gctgctggcgtggttctctt

SEQ ID NO: 591588 - DNA, 20 bp, mouse
gtggctcacgcgcggagcag

SEQ ID NO: 591589 - DNA, 20 bp, mouse
ggtcctggcgtggagcggaa

SEQ ID NO: 591590 - DNA, 20 bp, mouse
gtgatgcgcgaggcgagcga

SEQ ID NO: 591591 - DNA, 20 bp, mouse
gagccaggcctgaccgctgt

SEQ ID NO: 591592 - DNA, 20 bp, mouse
ggcggtcagagtgatgcgcg

SEQ ID NO: 591593 - DNA, 20 bp, mouse
ggtcaggcctggctcacgcg

SEQ ID NO: 591594 - DNA, 20 bp, mouse
gtccccgcgggaggtccgaa

SEQ ID NO: 591595 - DNA, 20 bp, mouse
gtttacgaggcgtggagcag

SEQ ID NO: 591596 - DNA, 20 bp, mouse
gtcggggcgcaggcaagaaa

SEQ ID NO: 591597 - DNA, 20 bp, mouse
gagcagcagggacctctcac

SEQ ID NO: 591598 - DNA, 20 bp, mouse
gagggagcttccggatctcg

SEQ ID NO: 591599 - DNA, 20 bp, mouse
gctcgagctcccgcgagatc

SEQ ID NO: 591600 - DNA, 20 bp, mouse
gggcgccgccatgttggtaa

SEQ ID NO: 591601 - DNA, 20 bp, mouse
gaccggctccgggatcctct

SEQ ID NO: 591602 - DNA, 20 bp, mouse
gaaggctagagcggtgtcgg

SEQ ID NO: 591603 - DNA, 20 bp, mouse
ggccatgttggtaaaggtat

SEQ ID NO: 591604 - DNA, 20 bp, mouse
gagggacgcggatcccgaat

SEQ ID NO: 591605 - DNA, 20 bp, mouse
gcatggcggcgccccgaggg

SEQ ID NO: 591606 - DNA, 20 bp, mouse
ggggctgacatagacagtag

SEQ ID NO: 591607 - DNA, 20 bp, mouse
gagcgtagacgcgggaacct

SEQ ID NO: 591608 - DNA, 20 bp, mouse
ggagggtccagcgtagacgc

SEQ ID NO: 591609 - DNA, 20 bp, mouse
ggcagaaacgtggaagggtc

SEQ ID NO: 591610 - DNA, 20 bp, mouse
gcatagacagtagaggtgag

SEQ ID NO: 591611 - DNA, 20 bp, mouse
gccgccgcagaaacgtggaa

SEQ ID NO: 591612 - DNA, 20 bp, mouse
ggcagagaaacactccctcg

SEQ ID NO: 591613 - DNA, 20 bp, mouse
gttctctgcagatttttggg

SEQ ID NO: 591614 - DNA, 20 bp, mouse
ggttggggttgcacagtcag

SEQ ID NO: 591615 - DNA, 20 bp, mouse
gacactgtaagcaaatcctg

SEQ ID NO: 591616 - DNA, 20 bp, mouse
gtggctgagggaagtaccat

SEQ ID NO: 591617 - DNA, 20 bp, mouse
ggccatggcagctgtagtat

SEQ ID NO: 591618 - DNA, 20 bp, mouse
gtattggcgactcagggtca

SEQ ID NO: 591619 - DNA, 20 bp, mouse
gctacacccggtgctaccca

SEQ ID NO: 591620 - DNA, 20 bp, mouse
gctgtagtattggcgactca

SEQ ID NO: 591621 - DNA, 20 bp, mouse
ggcgactcagggtcagggcc

SEQ ID NO: 591622 - DNA, 20 bp, mouse
ggtgatacgcccccagggaa

SEQ ID NO: 591623 - DNA, 20 bp, mouse
gagctgccatggccgccaag

SEQ ID NO: 591624 - DNA, 20 bp, mouse
gcgcaggtgatacgccccca

SEQ ID NO: 591625 - DNA, 20 bp, mouse
ggaagtaccatgggtagcac

SEQ ID NO: 591626 - DNA, 20 bp, mouse
ggcaccaggaagagctacac

SEQ ID NO: 591627 - DNA, 20 bp, mouse
gcacagggtagacatggatg

SEQ ID NO: 591628 - DNA, 20 bp, mouse
gtctggagcagggatactca

SEQ ID NO: 591629 - DNA, 20 bp, mouse
ggccagaagaggatctctcg

SEQ ID NO: 591630 - DNA, 20 bp, mouse
ggaggagcctcacctaaagg

SEQ ID NO: 591631 - DNA, 20 bp, mouse
gcggagcaggacccagaccc

SEQ ID NO: 591632 - DNA, 20 bp, mouse
gccagaggagcctcacctaa

SEQ ID NO: 591633 - DNA, 20 bp, mouse
gactggaagagtacttcctt

SEQ ID NO: 591634 - DNA, 20 bp, mouse
gccctatgcagggatgccca

SEQ ID NO: 591635 - DNA, 20 bp, mouse
gttcctggtgctttccagca

SEQ ID NO: 591636 - DNA, 20 bp, mouse
gcccagcggcagaagcagtt

SEQ ID NO: 591637 - DNA, 20 bp, mouse
gcggcggccggggagaagaa

SEQ ID NO: 591638 - DNA, 20 bp, mouse
ggaggcgtcccgtggccgtg

SEQ ID NO: 591639 - DNA, 20 bp, mouse
gcctggatccccgttcagag

SEQ ID NO: 591640 - DNA, 20 bp, mouse
gcgccgccacacccgcccag

SEQ ID NO: 591641 - DNA, 20 bp, mouse
gcgttcagagaggcgtcccg

SEQ ID NO: 591642 - DNA, 20 bp, mouse
ggagctgcctcactgactac

SEQ ID NO: 591643 - DNA, 20 bp, mouse
gggtctggtgaagatcaagg

SEQ ID NO: 591644 - DNA, 20 bp, mouse
gctgctagcctcacggccac

SEQ ID NO: 591645 - DNA, 20 bp, mouse
ggccggggagaagaacggtc

SEQ ID NO: 591646 - DNA, 20 bp, mouse
gcggggaaccgagacaccgt

SEQ ID NO: 591647 - DNA, 20 bp, mouse
gccagacagtcgagctgtat

SEQ ID NO: 591648 - DNA, 20 bp, mouse
gcggtctccagaatgacgta

SEQ ID NO: 591649 - DNA, 20 bp, mouse
gtcaatccgggccaagaaca

SEQ ID NO: 591650 - DNA, 20 bp, mouse
gcgcctcaacgtatggatat

SEQ ID NO: 591651 - DNA, 20 bp, mouse
gaggcggttcttactcactg

SEQ ID NO: 591652 - DNA, 20 bp, mouse
gcgtcggtggagtgttcagt

SEQ ID NO: 591653 - DNA, 20 bp, mouse
gggaaccgagacaccgtcgg

SEQ ID NO: 591654 - DNA, 20 bp, mouse
gcagcgggcgactcaggtac

SEQ ID NO: 591655 - DNA, 20 bp, mouse
gatagagatggatcaacacg

SEQ ID NO: 591656 - DNA, 20 bp, mouse
gagcgggttggaggatccac

SEQ ID NO: 591657 - DNA, 20 bp, mouse
gcggcggcgagagcaggctc

SEQ ID NO: 591658 - DNA, 20 bp, mouse
gtccgaagggtagctagggt

SEQ ID NO: 591659 - DNA, 20 bp, mouse
gaagccttatgggagcgggt

SEQ ID NO: 591660 - DNA, 20 bp, mouse
gcctccaacccgctcccata

SEQ ID NO: 591661 - DNA, 20 bp, mouse
gtggaaagccaaagccttat

SEQ ID NO: 591662 - DNA, 20 bp, mouse
gtgccacaggcactgcaagg

SEQ ID NO: 591663 - DNA, 20 bp, mouse
ggcctgtggagtagccaaag

SEQ ID NO: 591664 - DNA, 20 bp, mouse
ggcattccgaagggtagcta

SEQ ID NO: 591665 - DNA, 20 bp, mouse
gctgcacggggccagaccca

SEQ ID NO: 591666 - DNA, 20 bp, mouse
gcgcgggcaagaggcgattg

SEQ ID NO: 591667 - DNA, 20 bp, mouse
ggagcggcggcctcacagga

SEQ ID NO: 591668 - DNA, 20 bp, mouse
gtgtagcggggaacacgcgg

SEQ ID NO: 591669 - DNA, 20 bp, mouse
ggggtggcaaacgtgatctg

SEQ ID NO: 591670 - DNA, 20 bp, mouse
gggacttggacaagagtgtt

SEQ ID NO: 591671 - DNA, 20 bp, mouse
gtcgaggaggacggctgagg

SEQ ID NO: 591672 - DNA, 20 bp, mouse
gaagagtgtttggctgtggg

SEQ ID NO: 591673 - DNA, 20 bp, mouse
ggcctggagagtggtagcag

SEQ ID NO: 591674 - DNA, 20 bp, mouse
gcactcttgtccaagtccgc

SEQ ID NO: 591675 - DNA, 20 bp, mouse
gggctggtgtggaccggact

SEQ ID NO: 591676 - DNA, 20 bp, mouse
gggaatgaagccgaggacgt

SEQ ID NO: 591677 - DNA, 20 bp, mouse
gggagggcgagcggtcaagt

SEQ ID NO: 591678 - DNA, 20 bp, mouse
gcagccccgggcctcgtcgg

SEQ ID NO: 591679 - DNA, 20 bp, mouse
gaggcccggggctgacggag

SEQ ID NO: 591680 - DNA, 20 bp, mouse
ggcgagctggacccccgacg

SEQ ID NO: 591681 - DNA, 20 bp, mouse
gctccgggcggccacatcag

SEQ ID NO: 591682 - DNA, 20 bp, mouse
gtctgggaggccaaaggacg

SEQ ID NO: 591683 - DNA, 20 bp, mouse
gcgaacgactcccacgtcct

SEQ ID NO: 591684 - DNA, 20 bp, mouse
gcgtcagccccgggcctcgt

SEQ ID NO: 591685 - DNA, 20 bp, mouse
gggagtcgtagctggcagga

SEQ ID NO: 591686 - DNA, 20 bp, mouse
ggccggcggcgaaagcgagg

SEQ ID NO: 591687 - DNA, 20 bp, mouse
gccgccggccgggagaggac

SEQ ID NO: 591688 - DNA, 20 bp, mouse
gcggcgggaggaagcgagaa

SEQ ID NO: 591689 - DNA, 20 bp, mouse
gcgcgcgctggacactgtgg

SEQ ID NO: 591690 - DNA, 20 bp, mouse
gacactgtggaggcctgcgg

SEQ ID NO: 591691 - DNA, 20 bp, mouse
ggcgctctggggttcatcac

SEQ ID NO: 591692 - DNA, 20 bp, mouse
gggagaggaccggtaagcgc

SEQ ID NO: 591693 - DNA, 20 bp, mouse
gttaccggtcctctcccggc

SEQ ID NO: 591694 - DNA, 20 bp, mouse
gccggccggcggcgaaagcg

SEQ ID NO: 591695 - DNA, 20 bp, mouse
gtgtggaggcctgcggcggg

SEQ ID NO: 591696 - DNA, 20 bp, mouse
gccgtcctggcgccacagat

SEQ ID NO: 591697 - DNA, 20 bp, mouse
gtcccggcttcacctatctg

SEQ ID NO: 591698 - DNA, 20 bp, mouse
ggcgccctcgaaagaagcag

SEQ ID NO: 591699 - DNA, 20 bp, mouse
ggtggatctgggaaccgtcc

SEQ ID NO: 591700 - DNA, 20 bp, mouse
ggatcgcgtagtccatgccc

SEQ ID NO: 591701 - DNA, 20 bp, mouse
ggcagacgaggtgagaccgg

SEQ ID NO: 591702 - DNA, 20 bp, mouse
gggcgcagacgaggtgagac

SEQ ID NO: 591703 - DNA, 20 bp, mouse
ggatccactgcttctttcga

SEQ ID NO: 591704 - DNA, 20 bp, mouse
ggccacagataggtgaagcc

SEQ ID NO: 591705 - DNA, 20 bp, mouse
gtctttcgagggcgcagacg

SEQ ID NO: 591706 - DNA, 20 bp, mouse
gcgcagcaccgggctctatg

SEQ ID NO: 591707 - DNA, 20 bp, mouse
gacccctggagccaaagaga

SEQ ID NO: 591708 - DNA, 20 bp, mouse
gccagtggcgcgttcgctcc

SEQ ID NO: 591709 - DNA, 20 bp, mouse
ggagcaccgcggagaagaag

SEQ ID NO: 591710 - DNA, 20 bp, mouse
gatggaggccccatagagcc

SEQ ID NO: 591711 - DNA, 20 bp, mouse
gctctatggggcctccatga

SEQ ID NO: 591712 - DNA, 20 bp, mouse
ggcccagcccaggagcaccg

SEQ ID NO: 591713 - DNA, 20 bp, mouse
ggagctggctccgcgcgctc

SEQ ID NO: 591714 - DNA, 20 bp, mouse
ggaagggtactccatcatgg

SEQ ID NO: 591715 - DNA, 20 bp, mouse
gcgcgagggacggtagaagg

SEQ ID NO: 591716 - DNA, 20 bp, mouse
ggggcgggcccgatacacac

SEQ ID NO: 591717 - DNA, 20 bp, mouse
gggatccgggtctcagacga

SEQ ID NO: 591718 - DNA, 20 bp, mouse
ggggcccgatacacactggt

SEQ ID NO: 591719 - DNA, 20 bp, mouse
ggagctggactcccaggatc

SEQ ID NO: 591720 - DNA, 20 bp, mouse
gctgtcagggtccctgggag

SEQ ID NO: 591721 - DNA, 20 bp, mouse
gcgccacgcgaaccccgcat

SEQ ID NO: 591722 - DNA, 20 bp, mouse
gccccgctggccaagaggaa

SEQ ID NO: 591723 - DNA, 20 bp, mouse
ggggtaacagcccgacacgg

SEQ ID NO: 591724 - DNA, 20 bp, mouse
gagtaaggtcacctgagcag

SEQ ID NO: 591725 - DNA, 20 bp, mouse
gcagagggacgacaccggga

SEQ ID NO: 591726 - DNA, 20 bp, mouse
gagccgggcaaagctcgaca

SEQ ID NO: 591727 - DNA, 20 bp, mouse
gagcccagctcggccagacc

SEQ ID NO: 591728 - DNA, 20 bp, mouse
gtcgacagggaggctctggg

SEQ ID NO: 591729 - DNA, 20 bp, mouse
gggtaggactggaaggatac

SEQ ID NO: 591730 - DNA, 20 bp, mouse
ggctgcggcgacagagatcc

SEQ ID NO: 591731 - DNA, 20 bp, mouse
gagctcgacagggaggctct

SEQ ID NO: 591732 - DNA, 20 bp, mouse
gagttagtgactgtcggtag

SEQ ID NO: 591733 - DNA, 20 bp, mouse
ggtagaggcagcgggagggt

SEQ ID NO: 591734 - DNA, 20 bp, mouse
gcatcgcgggtaggactgga

SEQ ID NO: 591735 - DNA, 20 bp, mouse
gcgggaaaccggcccatcgc

SEQ ID NO: 591736 - DNA, 20 bp, mouse
gacagcggcaagaactcagg

SEQ ID NO: 591737 - DNA, 20 bp, mouse
gcgccggccacatcccccgg

SEQ ID NO: 591738 - DNA, 20 bp, mouse
ggcgacagcggcaagaactc

SEQ ID NO: 591739 - DNA, 20 bp, mouse
gcaggaggctgcgcggtccg

SEQ ID NO: 591740 - DNA, 20 bp, mouse
gggcacggcaggggagcgaa

SEQ ID NO: 591741 - DNA, 20 bp, mouse
gggcctggccccgcacgact

SEQ ID NO: 591742 - DNA, 20 bp, mouse
gcgcatgccgaggggctccg

SEQ ID NO: 591743 - DNA, 20 bp, mouse
gccgcacgactcggcagcga

SEQ ID NO: 591744 - DNA, 20 bp, mouse
gaggtcggcggggaccggag

SEQ ID NO: 591745 - DNA, 20 bp, mouse
ggctcctccggccccgccat

SEQ ID NO: 591746 - DNA, 20 bp, mouse
gtcctcggttgaggccatgg

SEQ ID NO: 591747 - DNA, 20 bp, mouse
ggagccagcgcgggatgcag

SEQ ID NO: 591748 - DNA, 20 bp, mouse
ggaaggacgcagtctatggt

SEQ ID NO: 591749 - DNA, 20 bp, mouse
ggccatggaggacgatcgga

SEQ ID NO: 591750 - DNA, 20 bp, mouse
gtctcccgcccgcttgggtt

SEQ ID NO: 591751 - DNA, 20 bp, mouse
gatcggaaggacgcagtcta

SEQ ID NO: 591752 - DNA, 20 bp, mouse
gctctcctcggttgaggcca

SEQ ID NO: 591753 - DNA, 20 bp, mouse
gcgaccccaacccaagcggg

SEQ ID NO: 591754 - DNA, 20 bp, mouse
gtccttccgatcgtcctcca

SEQ ID NO: 591755 - DNA, 20 bp, mouse
ggcacaggcgacctacaggc

SEQ ID NO: 591756 - DNA, 20 bp, mouse
gaggagggctccgaccgtca

SEQ ID NO: 591757 - DNA, 20 bp, mouse
ggagcagctgcagcgggtgg

SEQ ID NO: 591758 - DNA, 20 bp, mouse
gtcctgcggtgcagccccga

SEQ ID NO: 591759 - DNA, 20 bp, mouse
gccgacggcgccttgacggt

SEQ ID NO: 591760 - DNA, 20 bp, mouse
ggcgggtggcggctgtgtcc

SEQ ID NO: 591761 - DNA, 20 bp, mouse
gagccccgacggcgccttga

SEQ ID NO: 591762 - DNA, 20 bp, mouse
ggggctgcaccgcaggaatg

SEQ ID NO: 591763 - DNA, 20 bp, mouse
gcgctgcagctgctccagga

SEQ ID NO: 591764 - DNA, 20 bp, mouse
gggtggcggctgtgtccagg

SEQ ID NO: 591765 - DNA, 20 bp, mouse
gctctccttaggcacccctg

SEQ ID NO: 591766 - DNA, 20 bp, mouse
gccaagtggcccaggagggg

SEQ ID NO: 591767 - DNA, 20 bp, mouse
gagcgccctggacctctagg

SEQ ID NO: 591768 - DNA, 20 bp, mouse
gcgccttgcacacgggacag

SEQ ID NO: 591769 - DNA, 20 bp, mouse
gagcgcctcctagaggtcca

SEQ ID NO: 591770 - DNA, 20 bp, mouse
gcggtggtcgccttgcacac

SEQ ID NO: 591771 - DNA, 20 bp, mouse
gggacagaggtgcggcgacc

SEQ ID NO: 591772 - DNA, 20 bp, mouse
ggaaggcgcaagggactagg

SEQ ID NO: 591773 - DNA, 20 bp, mouse
gtggcccaggaggggcggca

SEQ ID NO: 591774 - DNA, 20 bp, mouse
gggtacccggcatctgggat

SEQ ID NO: 591775 - DNA, 20 bp, mouse
gcggcatctgggattggcgg

SEQ ID NO: 591776 - DNA, 20 bp, mouse
gaggctcacggtaaggctag

SEQ ID NO: 591777 - DNA, 20 bp, mouse
gtccgtggctccaatcactc

SEQ ID NO: 591778 - DNA, 20 bp, mouse
gactccggagactgagccat

SEQ ID NO: 591779 - DNA, 20 bp, mouse
ggtgagcggctaggtctccg

SEQ ID NO: 591780 - DNA, 20 bp, mouse
gtccggagtgattggagcca

SEQ ID NO: 591781 - DNA, 20 bp, mouse
gctccccatggctcagtctc

SEQ ID NO: 591782 - DNA, 20 bp, mouse
gtacaggaaaacaggagtca

SEQ ID NO: 591783 - DNA, 20 bp, mouse
ggatccaacctcagctgcca

SEQ ID NO: 591784 - DNA, 20 bp, mouse
gcggctcagaccatccttcc

SEQ ID NO: 591785 - DNA, 20 bp, mouse
gtgaggttggatcctgacag

SEQ ID NO: 591786 - DNA, 20 bp, mouse
gtcaggcgacggagctcccg

SEQ ID NO: 591787 - DNA, 20 bp, mouse
gctgcgcggcggacccgggg

SEQ ID NO: 591788 - DNA, 20 bp, mouse
gggcgctgcgcctccagtag

SEQ ID NO: 591789 - DNA, 20 bp, mouse
gcggggctgcgcggcacagg

SEQ ID NO: 591790 - DNA, 20 bp, mouse
gccaagtggcaggtagcagc

SEQ ID NO: 591791 - DNA, 20 bp, mouse
gcaggctgcgataccgccag

SEQ ID NO: 591792 - DNA, 20 bp, mouse
gtgtgcggcgcctctactgg

SEQ ID NO: 591793 - DNA, 20 bp, mouse
gtagaggcgccgcacagcag

SEQ ID NO: 591794 - DNA, 20 bp, mouse
gctcctgaggagaagtgact

SEQ ID NO: 591795 - DNA, 20 bp, mouse
ggagctctttgtggcggtga

SEQ ID NO: 591796 - DNA, 20 bp, mouse
gacctgtacgtccagacggg

SEQ ID NO: 591797 - DNA, 20 bp, mouse
gctgggttcctggttcttcg

SEQ ID NO: 591798 - DNA, 20 bp, mouse
gagctgcagcatcaccccgt

SEQ ID NO: 591799 - DNA, 20 bp, mouse
gagaaccaggaacccagcct

SEQ ID NO: 591800 - DNA, 20 bp, mouse
gcagcaaccgcaggcctaga

SEQ ID NO: 591801 - DNA, 20 bp, mouse
gggatgcagccgtgacgtca

SEQ ID NO: 591802 - DNA, 20 bp, mouse
gctgagaatggaacctccgg

SEQ ID NO: 591803 - DNA, 20 bp, mouse
gcgggaggcatccctttccc

SEQ ID NO: 591804 - DNA, 20 bp, mouse
ggatgctctgcgggacctag

SEQ ID NO: 591805 - DNA, 20 bp, mouse
gatactagtgcccaggctgg

SEQ ID NO: 591806 - DNA, 20 bp, mouse
gacaggctccatgtcagacc

SEQ ID NO: 591807 - DNA, 20 bp, mouse
gctccaaaccgggtctgaca

SEQ ID NO: 591808 - DNA, 20 bp, mouse
gctccatgtcagacccggtt

SEQ ID NO: 591809 - DNA, 20 bp, mouse
gcgggccctgcagtgatcac

SEQ ID NO: 591810 - DNA, 20 bp, mouse
gccagcctgaccatctctgt

SEQ ID NO: 591811 - DNA, 20 bp, mouse
gatctgaggaccacgcaaga

SEQ ID NO: 591812 - DNA, 20 bp, mouse
gtcctcggctaaggattgat

SEQ ID NO: 591813 - DNA, 20 bp, mouse
ggcaacccaagagatccaca

SEQ ID NO: 591814 - DNA, 20 bp, mouse
gtggccagagtcaggatgta

SEQ ID NO: 591815 - DNA, 20 bp, mouse
ggcaaccaacagagatggtc

SEQ ID NO: 591816 - DNA, 20 bp, mouse
gcgcacgccgggccaggtag

SEQ ID NO: 591817 - DNA, 20 bp, mouse
gctaggcacccggtcaccag

SEQ ID NO: 591818 - DNA, 20 bp, mouse
ggcgcgcgttggtgaagcag

SEQ ID NO: 591819 - DNA, 20 bp, mouse
gcggcgtgcggctgtcacct

SEQ ID NO: 591820 - DNA, 20 bp, mouse
gcgccgggccaggtagggga

SEQ ID NO: 591821 - DNA, 20 bp, mouse
gtcgggcgcagcccagacaa

SEQ ID NO: 591822 - DNA, 20 bp, mouse
gcacagcacagcgctccggg

SEQ ID NO: 591823 - DNA, 20 bp, mouse
ggaccagcccctcccctacc

SEQ ID NO: 591824 - DNA, 20 bp, mouse
gtgcggctgtcacctggggc

SEQ ID NO: 591825 - DNA, 20 bp, mouse
ggctcgcacgcgccagcccc

SEQ ID NO: 591826 - DNA, 20 bp, mouse
gtgcgagcgctgcgaggctg

SEQ ID NO: 591827 - DNA, 20 bp, mouse
gtcagtcagcttctcggacg

SEQ ID NO: 591828 - DNA, 20 bp, mouse
gggccccggccggaggagac

SEQ ID NO: 591829 - DNA, 20 bp, mouse
gggtccgtcagtcagcttct

SEQ ID NO: 591830 - DNA, 20 bp, mouse
ggggacaacgccgctttatc

SEQ ID NO: 591831 - DNA, 20 bp, mouse
ggaggctgcggccagcgcgc

SEQ ID NO: 591832 - DNA, 20 bp, mouse
gggcgctgcgtcagcggaag

SEQ ID NO: 591833 - DNA, 20 bp, mouse
gtgtttccgacctgataaag

SEQ ID NO: 591834 - DNA, 20 bp, mouse
gccgggatgcggaccagcaa

SEQ ID NO: 591835 - DNA, 20 bp, mouse
gcgcggtcggggcctcgaac

SEQ ID NO: 591836 - DNA, 20 bp, mouse
gtccatgcgcaaacacggag

SEQ ID NO: 591837 - DNA, 20 bp, mouse
gagcacctcggaaccagctg

SEQ ID NO: 591838 - DNA, 20 bp, mouse
gcctcccgcagctggttccg

SEQ ID NO: 591839 - DNA, 20 bp, mouse
gccgccaccgggagaactgt

SEQ ID NO: 591840 - DNA, 20 bp, mouse
ggcccctccatgcgcaaaca

SEQ ID NO: 591841 - DNA, 20 bp, mouse
gggagcgttgaggaaactgt

SEQ ID NO: 591842 - DNA, 20 bp, mouse
gcacggaggggctagcacct

SEQ ID NO: 591843 - DNA, 20 bp, mouse
gagacagcacagactggtcc

SEQ ID NO: 591844 - DNA, 20 bp, mouse
gagcggtccctgcagaacca

SEQ ID NO: 591845 - DNA, 20 bp, mouse
ggcacggagctcggctacaa

SEQ ID NO: 591846 - DNA, 20 bp, mouse
gtagagggagccggccacct

SEQ ID NO: 591847 - DNA, 20 bp, mouse
ggagatgctcccgaatttgg

SEQ ID NO: 591848 - DNA, 20 bp, mouse
gcagagagccggctgctcca

SEQ ID NO: 591849 - DNA, 20 bp, mouse
gcctgggttgaggccaccac

SEQ ID NO: 591850 - DNA, 20 bp, mouse
ggccctgaccctccaaattc

SEQ ID NO: 591851 - DNA, 20 bp, mouse
gagccagcccagtccatagg

SEQ ID NO: 591852 - DNA, 20 bp, mouse
ggagtagtcctgcgtcgtag

SEQ ID NO: 591853 - DNA, 20 bp, mouse
ggtccataggcggacagcag

SEQ ID NO: 591854 - DNA, 20 bp, mouse
gcgcacctgaaacacactct

SEQ ID NO: 591855 - DNA, 20 bp, mouse
gcagtcgctggtggagtatc

SEQ ID NO: 591856 - DNA, 20 bp, mouse
gggcggccgagtcaccacta

SEQ ID NO: 591857 - DNA, 20 bp, mouse
ggcagagtgatgatgctcgg

SEQ ID NO: 591858 - DNA, 20 bp, mouse
gccaaagaccaagagtgcgg

SEQ ID NO: 591859 - DNA, 20 bp, mouse
gcttggtctttgggccctag

SEQ ID NO: 591860 - DNA, 20 bp, mouse
ggccagctgggaagagccaa

SEQ ID NO: 591861 - DNA, 20 bp, mouse
gttgggccctagtggtgact

SEQ ID NO: 591862 - DNA, 20 bp, mouse
gtgctaggctaggcacaggt

SEQ ID NO: 591863 - DNA, 20 bp, mouse
gcacaggtgggaccgtagtc

SEQ ID NO: 591864 - DNA, 20 bp, mouse
gagggccaacagagtccggg

SEQ ID NO: 591865 - DNA, 20 bp, mouse
gtacgccccgcactgggtaa

SEQ ID NO: 591866 - DNA, 20 bp, mouse
gcagcaggcagcgtagccca

SEQ ID NO: 591867 - DNA, 20 bp, mouse
gccgagccctgacaccacgg

SEQ ID NO: 591868 - DNA, 20 bp, mouse
gggaggccacatggaacgca

SEQ ID NO: 591869 - DNA, 20 bp, mouse
gaagccgcacgaggacccac

SEQ ID NO: 591870 - DNA, 20 bp, mouse
ggcgcacgccaagagtcact

SEQ ID NO: 591871 - DNA, 20 bp, mouse
gtgacaccacggaggccaca

SEQ ID NO: 591872 - DNA, 20 bp, mouse
gctagccagcaccctaatgt

SEQ ID NO: 591873 - DNA, 20 bp, mouse
gcacggaggagtccgctccc

SEQ ID NO: 591874 - DNA, 20 bp, mouse
gctgctgcccggcttcctag

SEQ ID NO: 591875 - DNA, 20 bp, mouse
gcctctgcctggagagagac

SEQ ID NO: 591876 - DNA, 20 bp, mouse
ggcagtggctactcgactca

SEQ ID NO: 591877 - DNA, 20 bp, mouse
gatggcacaggctcagatag

SEQ ID NO: 591878 - DNA, 20 bp, mouse
gtagtggcgcgatccacacg

SEQ ID NO: 591879 - DNA, 20 bp, mouse
gagccggccgaggacagcct

SEQ ID NO: 591880 - DNA, 20 bp, mouse
gcgactcacggctccacgtg

SEQ ID NO: 591881 - DNA, 20 bp, mouse
gtcggccggctccatggcac

SEQ ID NO: 591882 - DNA, 20 bp, mouse
gcagagaggcggtcactctc

SEQ ID NO: 591883 - DNA, 20 bp, mouse
gggacgcggaccagctccgg

SEQ ID NO: 591884 - DNA, 20 bp, mouse
gtcccccgacgtgagacggg

SEQ ID NO: 591885 - DNA, 20 bp, mouse
ggctggtccgcgtcccacgg

SEQ ID NO: 591886 - DNA, 20 bp, mouse
gcagccgggacggggccatg

SEQ ID NO: 591887 - DNA, 20 bp, mouse
gagcaacgccgccgagtcac

SEQ ID NO: 591888 - DNA, 20 bp, mouse
gaccgagctgaagccggagt

SEQ ID NO: 591889 - DNA, 20 bp, mouse
gacaggtgcagggcccgagc

SEQ ID NO: 591890 - DNA, 20 bp, mouse
ggtctcgcaggtatccccgg

SEQ ID NO: 591891 - DNA, 20 bp, mouse
gctgccccatggccccgtcc

SEQ ID NO: 591892 - DNA, 20 bp, mouse
gcgctctagtggacacgggg

SEQ ID NO: 591893 - DNA, 20 bp, mouse
gccgccgagtcacaggtgca

SEQ ID NO: 591894 - DNA, 20 bp, mouse
gggccgagctgcagccggga

SEQ ID NO: 591895 - DNA, 20 bp, mouse
gagagctgtgcgaaccacag

SEQ ID NO: 591896 - DNA, 20 bp, mouse
gacctgctcaggagcctcgg

SEQ ID NO: 591897 - DNA, 20 bp, mouse
gcactggtgccctctgtgac

SEQ ID NO: 591898 - DNA, 20 bp, mouse
gggcaggcaggacttcccga

SEQ ID NO: 591899 - DNA, 20 bp, mouse
gggtttgggagcctccccca

SEQ ID NO: 591900 - DNA, 20 bp, mouse
gaagtcctgcctgccgccac

SEQ ID NO: 591901 - DNA, 20 bp, mouse
gctgtgctgttagagcagtt

SEQ ID NO: 591902 - DNA, 20 bp, mouse
gaagcaggagggacctacac

SEQ ID NO: 591903 - DNA, 20 bp, mouse
gggagcctcgggggtccttc

SEQ ID NO: 591904 - DNA, 20 bp, mouse
gggcaccagtggcggcaggc

SEQ ID NO: 591905 - DNA, 20 bp, mouse
gaccctccactccccgccat

SEQ ID NO: 591906 - DNA, 20 bp, mouse
ggtggcaacagacccaagtt

SEQ ID NO: 591907 - DNA, 20 bp, mouse
gtaccacaggccagtcagag

SEQ ID NO: 591908 - DNA, 20 bp, mouse
ggtggtaagaggctaccagc

SEQ ID NO: 591909 - DNA, 20 bp, mouse
gaggctccctgacagtagta

SEQ ID NO: 591910 - DNA, 20 bp, mouse
gtcactccctgcacacccct

SEQ ID NO: 591911 - DNA, 20 bp, mouse
gccgagtgaagggccacaac

SEQ ID NO: 591912 - DNA, 20 bp, mouse
gctgactggcctgtggtaag

SEQ ID NO: 591913 - DNA, 20 bp, mouse
gtgggagctctgcctaactt

SEQ ID NO: 591914 - DNA, 20 bp, mouse
gcagaggaggggtcagactg

SEQ ID NO: 591915 - DNA, 20 bp, mouse
gggtgtgcagggagtgagtc

SEQ ID NO: 591916 - DNA, 20 bp, mouse
ggagcgagtgcccggctgag

SEQ ID NO: 591917 - DNA, 20 bp, mouse
gcaggtagctctgaagcagg

SEQ ID NO: 591918 - DNA, 20 bp, mouse
gactaagcagagcgagtgcc

SEQ ID NO: 591919 - DNA, 20 bp, mouse
ggtggtacgctgctaggtgc

SEQ ID NO: 591920 - DNA, 20 bp, mouse
gactcgctctgcttagtatt

SEQ ID NO: 591921 - DNA, 20 bp, mouse
gctcttaccgtaggcagcag

SEQ ID NO: 591922 - DNA, 20 bp, mouse
ggatcaggtagctctgaagc

SEQ ID NO: 591923 - DNA, 20 bp, mouse
gtctgcttagtattcggatc

SEQ ID NO: 591924 - DNA, 20 bp, mouse
gtttggtctccggagatggg

SEQ ID NO: 591925 - DNA, 20 bp, mouse
gacatggctcctactcactc

SEQ ID NO: 591926 - DNA, 20 bp, mouse
gcgcaggcctgagagtcgtg

SEQ ID NO: 591927 - DNA, 20 bp, mouse
gactggagcccggagggaag

SEQ ID NO: 591928 - DNA, 20 bp, mouse
gtggcgtacagctaaggtgg

SEQ ID NO: 591929 - DNA, 20 bp, mouse
gccgagggtgtggcagtcag

SEQ ID NO: 591930 - DNA, 20 bp, mouse
ggtggggtgccggcctggga

SEQ ID NO: 591931 - DNA, 20 bp, mouse
gagtcgtggggtgccggcct

SEQ ID NO: 591932 - DNA, 20 bp, mouse
gacactcactggagcccgga

SEQ ID NO: 591933 - DNA, 20 bp, mouse
ggggcggcctgggacaccgt

SEQ ID NO: 591934 - DNA, 20 bp, mouse
gcggcctctcaggcctgggt

SEQ ID NO: 591935 - DNA, 20 bp, mouse
gaaacttcgtagtccctccc

SEQ ID NO: 591936 - DNA, 20 bp, mouse
ggattgcacccggctaagga

SEQ ID NO: 591937 - DNA, 20 bp, mouse
ggcgcatctagctgaggggt

SEQ ID NO: 591938 - DNA, 20 bp, mouse
ggctggcgcatctagctgag

SEQ ID NO: 591939 - DNA, 20 bp, mouse
gctagatgcgccagctcccc

SEQ ID NO: 591940 - DNA, 20 bp, mouse
gaactcgctactgacttcct

SEQ ID NO: 591941 - DNA, 20 bp, mouse
gccggacagccaggagaccg

SEQ ID NO: 591942 - DNA, 20 bp, mouse
gcggaaggcactggtaaaac

SEQ ID NO: 591943 - DNA, 20 bp, mouse
gcaggagaccgggggtccac

SEQ ID NO: 591944 - DNA, 20 bp, mouse
gcccgtactgcggaaggcac

SEQ ID NO: 591945 - DNA, 20 bp, mouse
gcgggaacgtagagagcgag

SEQ ID NO: 591946 - DNA, 20 bp, mouse
gcgcgggggaaagttgagtt

SEQ ID NO: 591947 - DNA, 20 bp, mouse
gtggcctgcccgcagcgcgg

SEQ ID NO: 591948 - DNA, 20 bp, mouse
ggtgggcaccgggaaatcgt

SEQ ID NO: 591949 - DNA, 20 bp, mouse
ggagaagttgggagcggcgg

SEQ ID NO: 591950 - DNA, 20 bp, mouse
gcgggtaagcagttaggtgg

SEQ ID NO: 591951 - DNA, 20 bp, mouse
ggccgagggagtggaactgg

SEQ ID NO: 591952 - DNA, 20 bp, mouse
gtttcccggtgcccaccccg

SEQ ID NO: 591953 - DNA, 20 bp, mouse
ggagggttccggaggatcag

SEQ ID NO: 591954 - DNA, 20 bp, mouse
gtagcgggtaagcagttagg

SEQ ID NO: 591955 - DNA, 20 bp, mouse
ggttaggtggcggagaggga

SEQ ID NO: 591956 - DNA, 20 bp, mouse
gggaacgcgtagtcccggag

SEQ ID NO: 591957 - DNA, 20 bp, mouse
gtcaccaggtggcctaggag

SEQ ID NO: 591958 - DNA, 20 bp, mouse
gattctggaacgcgtagtcc

SEQ ID NO: 591959 - DNA, 20 bp, mouse
ggcgttccagaatacagtga

SEQ ID NO: 591960 - DNA, 20 bp, mouse
gggagaggcccttttctgga

SEQ ID NO: 591961 - DNA, 20 bp, mouse
gccccaccctcactgtattc

SEQ ID NO: 591962 - DNA, 20 bp, mouse
ggctcacagccttccagaaa

SEQ ID NO: 591963 - DNA, 20 bp, mouse
gtcccggagaggcccttttc

SEQ ID NO: 591964 - DNA, 20 bp, mouse
gcagtcctggggtcaccagg

SEQ ID NO: 591965 - DNA, 20 bp, mouse
gtagtgctgaagctgtcagg

SEQ ID NO: 591966 - DNA, 20 bp, mouse
ggcgcggcgagaggccggac

SEQ ID NO: 591967 - DNA, 20 bp, mouse
ggagaggccggacgggaacc

SEQ ID NO: 591968 - DNA, 20 bp, mouse
gaccctgggtgagaagaagg

SEQ ID NO: 591969 - DNA, 20 bp, mouse
gcgccggagcctgcagtcca

SEQ ID NO: 591970 - DNA, 20 bp, mouse
gtccctccccgcaagctccg

SEQ ID NO: 591971 - DNA, 20 bp, mouse
gcggctgccgggttcccgtc

SEQ ID NO: 591972 - DNA, 20 bp, mouse
gggagcccggaggtacttaa

SEQ ID NO: 591973 - DNA, 20 bp, mouse
gaccgggttgggcctcggaa

SEQ ID NO: 591974 - DNA, 20 bp, mouse
gccgggccgggtagggacag

SEQ ID NO: 591975 - DNA, 20 bp, mouse
gggcacagccgagcgctagg

SEQ ID NO: 591976 - DNA, 20 bp, mouse
gcgacgctgcagccgaggcc

SEQ ID NO: 591977 - DNA, 20 bp, mouse
gctaggcggccgaagctgtg

SEQ ID NO: 591978 - DNA, 20 bp, mouse
gcgaggccgggctcggggat

SEQ ID NO: 591979 - DNA, 20 bp, mouse
gcacacgcgggaactgcggg

SEQ ID NO: 591980 - DNA, 20 bp, mouse
gggaaccgacgctgcagccg

SEQ ID NO: 591981 - DNA, 20 bp, mouse
gccgggctcggggatgggct

SEQ ID NO: 591982 - DNA, 20 bp, mouse
gtgcagccgaggccgggctc

SEQ ID NO: 591983 - DNA, 20 bp, mouse
gcgcgctcgccgcacagctt

SEQ ID NO: 591984 - DNA, 20 bp, mouse
ggatcggcgacgcggagcag

SEQ ID NO: 591985 - DNA, 20 bp, mouse
ggagagccgggcgcacacgc

SEQ ID NO: 591986 - DNA, 20 bp, mouse
gagggcaggagaaggacgag

SEQ ID NO: 591987 - DNA, 20 bp, mouse
ggaaagcacaggcagagtag

SEQ ID NO: 591988 - DNA, 20 bp, mouse
ggtttctagttaagcagcaa

SEQ ID NO: 591989 - DNA, 20 bp, mouse
gtggctgctaccctggctgt

SEQ ID NO: 591990 - DNA, 20 bp, mouse
gtgagcgctggagtctccgg

SEQ ID NO: 591991 - DNA, 20 bp, mouse
gccaggagaaggcaaataaa

SEQ ID NO: 591992 - DNA, 20 bp, mouse
ggggtagcagccacagaagc

SEQ ID NO: 591993 - DNA, 20 bp, mouse
gctggaggagacccacagcc

SEQ ID NO: 591994 - DNA, 20 bp, mouse
gcgctggagtctccggaggt

SEQ ID NO: 591995 - DNA, 20 bp, mouse
ggagggaaggtgggggattg

SEQ ID NO: 591996 - DNA, 20 bp, mouse
gcgagcgcgggacgttctcc

SEQ ID NO: 591997 - DNA, 20 bp, mouse
ggagagctggccccggagtg

SEQ ID NO: 591998 - DNA, 20 bp, mouse
ggaacgtcccgcgctcgcag

SEQ ID NO: 591999 - DNA, 20 bp, mouse
gcgtgccgcgaggactgaga

SEQ ID NO: 592000 - DNA, 20 bp, mouse
gctgcccgtctcagtcctcg

SEQ ID NO: 592001 - DNA, 20 bp, mouse
gtactcacgcgggtaaggag

SEQ ID NO: 592002 - DNA, 20 bp, mouse
gctgagacgggcagaggacg

SEQ ID NO: 592003 - DNA, 20 bp, mouse
gcagcggtcgccgcactccg

SEQ ID NO: 592004 - DNA, 20 bp, mouse
gcgaggcccgcagacaaagg

SEQ ID NO: 592005 - DNA, 20 bp, mouse
gggccgaggcccgcagacaa

SEQ ID NO: 592006 - DNA, 20 bp, mouse
gctaccctggatccaaggat

SEQ ID NO: 592007 - DNA, 20 bp, mouse
gggatcggtcaaccatcaac

SEQ ID NO: 592008 - DNA, 20 bp, mouse
gcgcgggctgatggctatga

SEQ ID NO: 592009 - DNA, 20 bp, mouse
gggcggtgggcagaacaccg

SEQ ID NO: 592010 - DNA, 20 bp, mouse
gcgtctcacactggactaca

SEQ ID NO: 592011 - DNA, 20 bp, mouse
gcgcgcagcgacccctaccc

SEQ ID NO: 592012 - DNA, 20 bp, mouse
gtgaaggtggcgccggttga

SEQ ID NO: 592013 - DNA, 20 bp, mouse
gcccgccgggagcaacgagc

SEQ ID NO: 592014 - DNA, 20 bp, mouse
gccgggagcaacgagccgga

SEQ ID NO: 592015 - DNA, 20 bp, mouse
gacgcctggaaccccggctg

SEQ ID NO: 592016 - DNA, 20 bp, mouse
gttccaggatgaagctgcca

SEQ ID NO: 592017 - DNA, 20 bp, mouse
gcactagagtggcgagagac

SEQ ID NO: 592018 - DNA, 20 bp, mouse
gggatgaagctgccagggca

SEQ ID NO: 592019 - DNA, 20 bp, mouse
gcctaggatacacagctccc

SEQ ID NO: 592020 - DNA, 20 bp, mouse
gaaagacttgcacaaatcct

SEQ ID NO: 592021 - DNA, 20 bp, mouse
ggatttgtgcaagtctttcc

SEQ ID NO: 592022 - DNA, 20 bp, mouse
gagagtggcgagagacaggc

SEQ ID NO: 592023 - DNA, 20 bp, mouse
gatcctaggggccctctggc

SEQ ID NO: 592024 - DNA, 20 bp, mouse
ggaacacaggtagggcaatg

SEQ ID NO: 592025 - DNA, 20 bp, mouse
ggtgtatcctaggggccctc

SEQ ID NO: 592026 - DNA, 20 bp, mouse
gctccagagcaggtagtcag

SEQ ID NO: 592027 - DNA, 20 bp, mouse
gagcaccacatccagaccat

SEQ ID NO: 592028 - DNA, 20 bp, mouse
gctgcagggcctgatgccca

SEQ ID NO: 592029 - DNA, 20 bp, mouse
ggatgcccatggtctggatg

SEQ ID NO: 592030 - DNA, 20 bp, mouse
gacagccagggctctcccaa

SEQ ID NO: 592031 - DNA, 20 bp, mouse
gctagggtaggagggtccca

SEQ ID NO: 592032 - DNA, 20 bp, mouse
gaactttggctcagtcctca

SEQ ID NO: 592033 - DNA, 20 bp, mouse
gaaactggtggttacggtaa

SEQ ID NO: 592034 - DNA, 20 bp, mouse
gtttaggggcaggcccacca

SEQ ID NO: 592035 - DNA, 20 bp, mouse
gaccagggcttcctagctag

SEQ ID NO: 592036 - DNA, 20 bp, mouse
gctagggaaccggctccggt

SEQ ID NO: 592037 - DNA, 20 bp, mouse
gccgcccgcctccatcccac

SEQ ID NO: 592038 - DNA, 20 bp, mouse
ggagcacgcaggcactagaa

SEQ ID NO: 592039 - DNA, 20 bp, mouse
gggaactccgcgctgggcta

SEQ ID NO: 592040 - DNA, 20 bp, mouse
gaccggctccggtgggatgg

SEQ ID NO: 592041 - DNA, 20 bp, mouse
gcccagggtgaagagcacgc

SEQ ID NO: 592042 - DNA, 20 bp, mouse
gtgggctagggaaccggctc

SEQ ID NO: 592043 - DNA, 20 bp, mouse
gagctactggaactccgcgc

SEQ ID NO: 592044 - DNA, 20 bp, mouse
gggaaccggctccggtggga

SEQ ID NO: 592045 - DNA, 20 bp, mouse
gccagtggagaacatgccca

SEQ ID NO: 592046 - DNA, 20 bp, mouse
gtgacactggaggcttgagg

SEQ ID NO: 592047 - DNA, 20 bp, mouse
gggtaatgaaacaggcgtgg

SEQ ID NO: 592048 - DNA, 20 bp, mouse
ggtgaaggctaaacagtaag

SEQ ID NO: 592049 - DNA, 20 bp, mouse
gcttgttcagagctgggtga

SEQ ID NO: 592050 - DNA, 20 bp, mouse
gggctctgagagcctcaata

SEQ ID NO: 592051 - DNA, 20 bp, mouse
gggaggtaatgaaacaggcg

SEQ ID NO: 592052 - DNA, 20 bp, mouse
gaggcccagtgagcgagtca

SEQ ID NO: 592053 - DNA, 20 bp, mouse
gcttgaggaggtaatgaaac

SEQ ID NO: 592054 - DNA, 20 bp, mouse
ggaccccaggtaagtaaggg

SEQ ID NO: 592055 - DNA, 20 bp, mouse
gcttgaccccaggtaagtaa

SEQ ID NO: 592056 - DNA, 20 bp, mouse
gaggcctgggtgtgtgctaa

SEQ ID NO: 592057 - DNA, 20 bp, mouse
gtctcggaagagttcctgtg

SEQ ID NO: 592058 - DNA, 20 bp, mouse
gacaccagcaggggcccatt

SEQ ID NO: 592059 - DNA, 20 bp, mouse
ggagttcctgtgaggaagaa

SEQ ID NO: 592060 - DNA, 20 bp, mouse
gaagggcagagttaccaaat

SEQ ID NO: 592061 - DNA, 20 bp, mouse
ggtggcaggaatcacaccaa

SEQ ID NO: 592062 - DNA, 20 bp, mouse
ggtactctcagcctgctgtg

SEQ ID NO: 592063 - DNA, 20 bp, mouse
gtctttggatgtcacttagt

SEQ ID NO: 592064 - DNA, 20 bp, mouse
ggacttcaggctgggtggaa

SEQ ID NO: 592065 - DNA, 20 bp, mouse
gccctggacccgggattcct

SEQ ID NO: 592066 - DNA, 20 bp, mouse
ggcacgccacttagcccgga

SEQ ID NO: 592067 - DNA, 20 bp, mouse
ggagcagcccgcccagcccc

SEQ ID NO: 592068 - DNA, 20 bp, mouse
ggcgtcttactacaaccctt

SEQ ID NO: 592069 - DNA, 20 bp, mouse
gcttgcggaggaccaagtct

SEQ ID NO: 592070 - DNA, 20 bp, mouse
gcggctaatgcgctagactg

SEQ ID NO: 592071 - DNA, 20 bp, mouse
gcgtggatcggcaagaggtg

SEQ ID NO: 592072 - DNA, 20 bp, mouse
gtggcgcggctaaaccagac

SEQ ID NO: 592073 - DNA, 20 bp, mouse
ggctaagtggcgtgctcccg

SEQ ID NO: 592074 - DNA, 20 bp, mouse
gtggtcctccgcaagcatca

SEQ ID NO: 592075 - DNA, 20 bp, mouse
gtcaggcagccggcgtggat

SEQ ID NO: 592076 - DNA, 20 bp, mouse
gtgtgcgacctggccagatg

SEQ ID NO: 592077 - DNA, 20 bp, mouse
gctggccaggtcgcacaaga

SEQ ID NO: 592078 - DNA, 20 bp, mouse
gccaggtcgcacaagaagga

SEQ ID NO: 592079 - DNA, 20 bp, mouse
gtagatcctcgggcaactcg

SEQ ID NO: 592080 - DNA, 20 bp, mouse
gaacctgtccccatctggcc

SEQ ID NO: 592081 - DNA, 20 bp, mouse
gagaccaacctgtccccatc

SEQ ID NO: 592082 - DNA, 20 bp, mouse
gtcctcgggcaactcgaggt

SEQ ID NO: 592083 - DNA, 20 bp, mouse
gaggtggggctcacgttcct

SEQ ID NO: 592084 - DNA, 20 bp, mouse
gaaggttctcgtcacaccac

SEQ ID NO: 592085 - DNA, 20 bp, mouse
gcctgaccgcgccctcgagt

SEQ ID NO: 592086 - DNA, 20 bp, mouse
gcactcaccgagagtcaagg

SEQ ID NO: 592087 - DNA, 20 bp, mouse
gctctcggtgagtggcggtt

SEQ ID NO: 592088 - DNA, 20 bp, mouse
gcgccactcaccgagagtca

SEQ ID NO: 592089 - DNA, 20 bp, mouse
gggcagacctccttgactct

SEQ ID NO: 592090 - DNA, 20 bp, mouse
gtgactccaaaagtctgtgg

SEQ ID NO: 592091 - DNA, 20 bp, mouse
gtcaaggaggtctgcctgca

SEQ ID NO: 592092 - DNA, 20 bp, mouse
gccctcctgtcgggaactag

SEQ ID NO: 592093 - DNA, 20 bp, mouse
ggtgagtggcggttgggcat

SEQ ID NO: 592094 - DNA, 20 bp, mouse
gacgggtgggacctcctagg

SEQ ID NO: 592095 - DNA, 20 bp, mouse
gacttttggagtcaccgtgc

SEQ ID NO: 592096 - DNA, 20 bp, mouse
gccgtcgggaagcagctcct

SEQ ID NO: 592097 - DNA, 20 bp, mouse
gcttaaggcactgcacacct

SEQ ID NO: 592098 - DNA, 20 bp, mouse
ggagctgcttcccgacggtg

SEQ ID NO: 592099 - DNA, 20 bp, mouse
ggctttgctcggtcttctta

SEQ ID NO: 592100 - DNA, 20 bp, mouse
gtgcgctgcaccgcaccgtc

SEQ ID NO: 592101 - DNA, 20 bp, mouse
ggacgggatgggtgcatcgg

SEQ ID NO: 592102 - DNA, 20 bp, mouse
ggtgagcctgtgagccgaga

SEQ ID NO: 592103 - DNA, 20 bp, mouse
gagaggccagggcgactgtg

SEQ ID NO: 592104 - DNA, 20 bp, mouse
ggcacgggctagagaggcca

SEQ ID NO: 592105 - DNA, 20 bp, mouse
gctcaaggtgctactgtcca

SEQ ID NO: 592106 - DNA, 20 bp, mouse
gggaacatgggcatccccag

SEQ ID NO: 592107 - DNA, 20 bp, mouse
gggagaagtgaggtgatgaa

SEQ ID NO: 592108 - DNA, 20 bp, mouse
gcacggcgcttgctgcagga

SEQ ID NO: 592109 - DNA, 20 bp, mouse
gctggggccagcacattcct

SEQ ID NO: 592110 - DNA, 20 bp, mouse
gatggctggcaattccactg

SEQ ID NO: 592111 - DNA, 20 bp, mouse
gtcagtccctgggctcggca

SEQ ID NO: 592112 - DNA, 20 bp, mouse
gaggcacgaggccacactgt

SEQ ID NO: 592113 - DNA, 20 bp, mouse
gtggattctgggcacagcta

SEQ ID NO: 592114 - DNA, 20 bp, mouse
gaagcgccgtgccgagccca

SEQ ID NO: 592115 - DNA, 20 bp, mouse
gtggggtagatgggacacag

SEQ ID NO: 592116 - DNA, 20 bp, mouse
gtgtgcaaagggagacccct

SEQ ID NO: 592117 - DNA, 20 bp, mouse
gcagcagcaggcaagaaggc

SEQ ID NO: 592118 - DNA, 20 bp, mouse
gcaaaggacaggacatccca

SEQ ID NO: 592119 - DNA, 20 bp, mouse
gagggtctcggggacttcag

SEQ ID NO: 592120 - DNA, 20 bp, mouse
gctggcccagccctcaggtg

SEQ ID NO: 592121 - DNA, 20 bp, mouse
ggaggactggataaccactc

SEQ ID NO: 592122 - DNA, 20 bp, mouse
gttagacagtgggtgtctca

SEQ ID NO: 592123 - DNA, 20 bp, mouse
ggctgagaaaggttccacaa

SEQ ID NO: 592124 - DNA, 20 bp, mouse
ggatgagagctaggccagag

SEQ ID NO: 592125 - DNA, 20 bp, mouse
gctactgccctagggtctcg

SEQ ID NO: 592126 - DNA, 20 bp, mouse
ggactcctgaagtttctggg

SEQ ID NO: 592127 - DNA, 20 bp, mouse
gaagaaacgcagacagctag

SEQ ID NO: 592128 - DNA, 20 bp, mouse
ggctgtgaaactgacaccaa

SEQ ID NO: 592129 - DNA, 20 bp, mouse
gagggagtaggctggcccga

SEQ ID NO: 592130 - DNA, 20 bp, mouse
gtctaccccccagaaacttc

SEQ ID NO: 592131 - DNA, 20 bp, mouse
gtctggggggtagagggagt

SEQ ID NO: 592132 - DNA, 20 bp, mouse
gacaaattgggatcagattc

SEQ ID NO: 592133 - DNA, 20 bp, mouse
gcatctcgggaattcttagt

SEQ ID NO: 592134 - DNA, 20 bp, mouse
ggaagaaggatgccccaaag

SEQ ID NO: 592135 - DNA, 20 bp, mouse
ggaagactcctgaagtttct

SEQ ID NO: 592136 - DNA, 20 bp, mouse
gagaatggagcaacacgtag

SEQ ID NO: 592137 - DNA, 20 bp, mouse
gagaggcaggctctgaactt

SEQ ID NO: 592138 - DNA, 20 bp, mouse
gggagacctcagagaggagt

SEQ ID NO: 592139 - DNA, 20 bp, mouse
gggcaggacggagcatggtg

SEQ ID NO: 592140 - DNA, 20 bp, mouse
gccaatgaccagcaggaaat

SEQ ID NO: 592141 - DNA, 20 bp, mouse
gccccttgagggacagatgc

SEQ ID NO: 592142 - DNA, 20 bp, mouse
gcctgggtggccagaaatgg

SEQ ID NO: 592143 - DNA, 20 bp, mouse
gggcaagttaggctgaatct

SEQ ID NO: 592144 - DNA, 20 bp, mouse
gggagaaacctagatttagt

SEQ ID NO: 592145 - DNA, 20 bp, mouse
gtggagcaacacgtagaggc

SEQ ID NO: 592146 - DNA, 20 bp, mouse
ggcgcagaggaagacgagag

SEQ ID NO: 592147 - DNA, 20 bp, mouse
gaggagagccggggtcgcga

SEQ ID NO: 592148 - DNA, 20 bp, mouse
ggccgagtccaggagagccg

SEQ ID NO: 592149 - DNA, 20 bp, mouse
gcggccggtcagctcccgga

SEQ ID NO: 592150 - DNA, 20 bp, mouse
gtcgccgtccgggagctgac

SEQ ID NO: 592151 - DNA, 20 bp, mouse
ggacgagagaggaacacggc

SEQ ID NO: 592152 - DNA, 20 bp, mouse
gaacacggccggtcagctcc

SEQ ID NO: 592153 - DNA, 20 bp, mouse
ggcgggactgggaggcctag

SEQ ID NO: 592154 - DNA, 20 bp, mouse
gagcggggcatcgcccaggt

SEQ ID NO: 592155 - DNA, 20 bp, mouse
gaccccggctctcctggact

SEQ ID NO: 592156 - DNA, 20 bp, mouse
gtaggcaagcgcagtcccta

SEQ ID NO: 592157 - DNA, 20 bp, mouse
ggcagtgctggtactgacac

SEQ ID NO: 592158 - DNA, 20 bp, mouse
gggtgtcaatgcctgccata

SEQ ID NO: 592159 - DNA, 20 bp, mouse
gcaagcgcagtccctatggc

SEQ ID NO: 592160 - DNA, 20 bp, mouse
gctgcgcttgcctacagcca

SEQ ID NO: 592161 - DNA, 20 bp, mouse
ggtgggcactaagattacca

SEQ ID NO: 592162 - DNA, 20 bp, mouse
ggtactgacactggctgtgc

SEQ ID NO: 592163 - DNA, 20 bp, mouse
gggagcccagtgagatttct

SEQ ID NO: 592164 - DNA, 20 bp, mouse
gtctcagctcaccattccat

SEQ ID NO: 592165 - DNA, 20 bp, mouse
gtgttcggcatgccccgtac

SEQ ID NO: 592166 - DNA, 20 bp, mouse
gcaggaggctcctcagtctg

SEQ ID NO: 592167 - DNA, 20 bp, mouse
gagcatcacgcctcagactg

SEQ ID NO: 592168 - DNA, 20 bp, mouse
gtgcgcactggcactacagg

SEQ ID NO: 592169 - DNA, 20 bp, mouse
gggacttaaggtgctagcca

SEQ ID NO: 592170 - DNA, 20 bp, mouse
ggaatgcgcactggcactac

SEQ ID NO: 592171 - DNA, 20 bp, mouse
gggtaaactgagacagtgat

SEQ ID NO: 592172 - DNA, 20 bp, mouse
gccatggcttcaggaggttc

SEQ ID NO: 592173 - DNA, 20 bp, mouse
gcacagtgggctcattccta

SEQ ID NO: 592174 - DNA, 20 bp, mouse
ggggggacagtgtcttaggg

SEQ ID NO: 592175 - DNA, 20 bp, mouse
gcttgggggacagtgtctta

SEQ ID NO: 592176 - DNA, 20 bp, mouse
ggaggatgcggaggacgtcg

SEQ ID NO: 592177 - DNA, 20 bp, mouse
gggagacaggtaactcggaa

SEQ ID NO: 592178 - DNA, 20 bp, mouse
gcaggtaactcggaacggag

SEQ ID NO: 592179 - DNA, 20 bp, mouse
gcccccggtgaagaagtcgt

SEQ ID NO: 592180 - DNA, 20 bp, mouse
gcggaacggagaggatgcgg

SEQ ID NO: 592181 - DNA, 20 bp, mouse
gactcggaacggagaggatg

SEQ ID NO: 592182 - DNA, 20 bp, mouse
gcggccagcgacagccccac

SEQ ID NO: 592183 - DNA, 20 bp, mouse
gcgccgcgcgaaaagcttgt

SEQ ID NO: 592184 - DNA, 20 bp, mouse
ggaacacgccgtagtcccag

SEQ ID NO: 592185 - DNA, 20 bp, mouse
ggtctccatggagggcgcgg

SEQ ID NO: 592186 - DNA, 20 bp, mouse
gcgccacgtgcggagagaag

SEQ ID NO: 592187 - DNA, 20 bp, mouse
gcctcatgtggagatctcaa

SEQ ID NO: 592188 - DNA, 20 bp, mouse
gcggctcgcacctcctgact

SEQ ID NO: 592189 - DNA, 20 bp, mouse
ggtcccgctgtcaccaagtc

SEQ ID NO: 592190 - DNA, 20 bp, mouse
gatgtggagatctcaaaggt

SEQ ID NO: 592191 - DNA, 20 bp, mouse
gggggtgagcctctcggtgt

SEQ ID NO: 592192 - DNA, 20 bp, mouse
gtggaggagtgaagatcgga

SEQ ID NO: 592193 - DNA, 20 bp, mouse
gccccaaagcccacaccgag

SEQ ID NO: 592194 - DNA, 20 bp, mouse
gcctcctgacttggtgacag

SEQ ID NO: 592195 - DNA, 20 bp, mouse
ggagggcgaagggcaaacgc

SEQ ID NO: 592196 - DNA, 20 bp, mouse
gcccgatgaggactccgagg

SEQ ID NO: 592197 - DNA, 20 bp, mouse
gaggctcgaggtgagtggag

SEQ ID NO: 592198 - DNA, 20 bp, mouse
gtgtgagggacacggaggga

SEQ ID NO: 592199 - DNA, 20 bp, mouse
ggggctgtgagggacacgga

SEQ ID NO: 592200 - DNA, 20 bp, mouse
gtccggcaaggagcccgatg

SEQ ID NO: 592201 - DNA, 20 bp, mouse
gccccgggctgtgagggaca

SEQ ID NO: 592202 - DNA, 20 bp, mouse
ggagggaggctcgaggtgag

SEQ ID NO: 592203 - DNA, 20 bp, mouse
ggcgctccagaacatcccgg

SEQ ID NO: 592204 - DNA, 20 bp, mouse
gcgcaccccgggccacacca

SEQ ID NO: 592205 - DNA, 20 bp, mouse
gcctacgggaacaagagcta

SEQ ID NO: 592206 - DNA, 20 bp, mouse
gccgggtcccagggtgtcag

SEQ ID NO: 592207 - DNA, 20 bp, mouse
ggctgcgcccctgacaccct

SEQ ID NO: 592208 - DNA, 20 bp, mouse
gctgccggcgcgacttctcc

SEQ ID NO: 592209 - DNA, 20 bp, mouse
gggacccggagaagtcgcgc

SEQ ID NO: 592210 - DNA, 20 bp, mouse
gctgcgcccagagtgcacgg

SEQ ID NO: 592211 - DNA, 20 bp, mouse
gcgcccagagtgcacggtgg

SEQ ID NO: 592212 - DNA, 20 bp, mouse
ggtcgcagttgggccacccg

SEQ ID NO: 592213 - DNA, 20 bp, mouse
gaggggcgcagctggtgaca

SEQ ID NO: 592214 - DNA, 20 bp, mouse
gctaggcaccagcgactctg

SEQ ID NO: 592215 - DNA, 20 bp, mouse
gtgtggatcctccagaaagt

SEQ ID NO: 592216 - DNA, 20 bp, mouse
gaacacggagcttgtggcaa

SEQ ID NO: 592217 - DNA, 20 bp, mouse
gcatcagtttcagatgaaca

SEQ ID NO: 592218 - DNA, 20 bp, mouse
gcagatgaacacggagcttg

SEQ ID NO: 592219 - DNA, 20 bp, mouse
ggtcataggtatgtagcccc

SEQ ID NO: 592220 - DNA, 20 bp, mouse
gaacaacgaacccaagcctg

SEQ ID NO: 592221 - DNA, 20 bp, mouse
gagtaatgctgaagcctggc

SEQ ID NO: 592222 - DNA, 20 bp, mouse
gtagatgtgaatagaaatgg

SEQ ID NO: 592223 - DNA, 20 bp, mouse
gcatacctatgacatcgtgg

SEQ ID NO: 592224 - DNA, 20 bp, mouse
gaccaccaccacgatgtcat

SEQ ID NO: 592225 - DNA, 20 bp, mouse
ggtatcagctacctttggtt

SEQ ID NO: 592226 - DNA, 20 bp, mouse
gtgcgcgagcccaggagccc

SEQ ID NO: 592227 - DNA, 20 bp, mouse
gccccggccgcaggtaggaa

SEQ ID NO: 592228 - DNA, 20 bp, mouse
gcgcgggcgcctgggctcct

SEQ ID NO: 592229 - DNA, 20 bp, mouse
ggaacgaactaggacataga

SEQ ID NO: 592230 - DNA, 20 bp, mouse
gaggcgcccgcgtccaagcg

SEQ ID NO: 592231 - DNA, 20 bp, mouse
gccgcctccggagcatccct

SEQ ID NO: 592232 - DNA, 20 bp, mouse
ggcaacctctcagctctcta

SEQ ID NO: 592233 - DNA, 20 bp, mouse
ggagtagggcagaggtaact

SEQ ID NO: 592234 - DNA, 20 bp, mouse
gcagctctctagggctccca

SEQ ID NO: 592235 - DNA, 20 bp, mouse
gggatgctccggaggcggga

SEQ ID NO: 592236 - DNA, 20 bp, mouse
gggcagggcggccatgactg

SEQ ID NO: 592237 - DNA, 20 bp, mouse
gcggagcaagcgctgcccct

SEQ ID NO: 592238 - DNA, 20 bp, mouse
gccgctttcccgttgcccag

SEQ ID NO: 592239 - DNA, 20 bp, mouse
gcgcggccactggaacaaca

SEQ ID NO: 592240 - DNA, 20 bp, mouse
gggccactggaacaacaagg

SEQ ID NO: 592241 - DNA, 20 bp, mouse
gctggagagatcatcggact

SEQ ID NO: 592242 - DNA, 20 bp, mouse
gagcgcttgctccgcagtca

SEQ ID NO: 592243 - DNA, 20 bp, mouse
gaccatcccgggattcaagc

SEQ ID NO: 592244 - DNA, 20 bp, mouse
gcatcggactgggcaacgtg

SEQ ID NO: 592245 - DNA, 20 bp, mouse
gggtccgagacgctgggcgg

SEQ ID NO: 592246 - DNA, 20 bp, mouse
ggcctgggcaggatacgtca

SEQ ID NO: 592247 - DNA, 20 bp, mouse
gcctctggcctccagaccag

SEQ ID NO: 592248 - DNA, 20 bp, mouse
gcttgcccagcaccacccag

SEQ ID NO: 592249 - DNA, 20 bp, mouse
gagagagccgagctataatg

SEQ ID NO: 592250 - DNA, 20 bp, mouse
gtctagacagaagggccagc

SEQ ID NO: 592251 - DNA, 20 bp, mouse
ggctctggcagcctctggtc

SEQ ID NO: 592252 - DNA, 20 bp, mouse
gctctgctctcagagttatg

SEQ ID NO: 592253 - DNA, 20 bp, mouse
ggaaatgtcatcaagagctt

SEQ ID NO: 592254 - DNA, 20 bp, mouse
gtcacagctctacccctggg

SEQ ID NO: 592255 - DNA, 20 bp, mouse
gccagagctgctgggttaaa

SEQ ID NO: 592256 - DNA, 20 bp, mouse
gaattctccgacaagacctc

SEQ ID NO: 592257 - DNA, 20 bp, mouse
gcttaagggtgacagaggag

SEQ ID NO: 592258 - DNA, 20 bp, mouse
gtcaggcagaaacttcacca

SEQ ID NO: 592259 - DNA, 20 bp, mouse
gggagcagtggagaaagcac

SEQ ID NO: 592260 - DNA, 20 bp, mouse
gtgagaagcacggggctaag

SEQ ID NO: 592261 - DNA, 20 bp, mouse
gaggggtcgagaattctagt

SEQ ID NO: 592262 - DNA, 20 bp, mouse
gcagaaacttcaccaaggtt

SEQ ID NO: 592263 - DNA, 20 bp, mouse
gttgtcggagaattctccag

SEQ ID NO: 592264 - DNA, 20 bp, mouse
gggggtggctcatgacttaa

SEQ ID NO: 592265 - DNA, 20 bp, mouse
gtgggcctcagaatgtaggt

SEQ ID NO: 592266 - DNA, 20 bp, mouse
ggagaggcgaggcacaccaa

SEQ ID NO: 592267 - DNA, 20 bp, mouse
ggtggcaggtgcacactccc

SEQ ID NO: 592268 - DNA, 20 bp, mouse
gctttggcaggtagcaaccg

SEQ ID NO: 592269 - DNA, 20 bp, mouse
gtcaggaagggaaaacaagg

SEQ ID NO: 592270 - DNA, 20 bp, mouse
gagccaccttgcccaggggt

SEQ ID NO: 592271 - DNA, 20 bp, mouse
gatgctcccagggtcagata

SEQ ID NO: 592272 - DNA, 20 bp, mouse
gctggtggtgtaggggagtc

SEQ ID NO: 592273 - DNA, 20 bp, mouse
gcaaggtggctcactttggc

SEQ ID NO: 592274 - DNA, 20 bp, mouse
gcatggttcactggatccct

SEQ ID NO: 592275 - DNA, 20 bp, mouse
gccaggggtgggaccattta

SEQ ID NO: 592276 - DNA, 20 bp, mouse
gttggcgcccgactcctcca

SEQ ID NO: 592277 - DNA, 20 bp, mouse
gatgagtgagggtgtgacgg

SEQ ID NO: 592278 - DNA, 20 bp, mouse
gactagctggttgggcacgt

SEQ ID NO: 592279 - DNA, 20 bp, mouse
gagcttgccaagggcaggat

SEQ ID NO: 592280 - DNA, 20 bp, mouse
ggacgcagcactagctggtt

SEQ ID NO: 592281 - DNA, 20 bp, mouse
gatggtgcgggaggccgcag

SEQ ID NO: 592282 - DNA, 20 bp, mouse
gcagccaccctggaggagtc

SEQ ID NO: 592283 - DNA, 20 bp, mouse
ggagtcgctgtcctgcaagc

SEQ ID NO: 592284 - DNA, 20 bp, mouse
gaacagaaacagcttgccaa

SEQ ID NO: 592285 - DNA, 20 bp, mouse
ggagagccccaccctacccc

SEQ ID NO: 592286 - DNA, 20 bp, mouse
gaagcctgaggcacatccga

SEQ ID NO: 592287 - DNA, 20 bp, mouse
gcaggcttcagagtccaata

SEQ ID NO: 592288 - DNA, 20 bp, mouse
ggcctgggagaccctcgctt

SEQ ID NO: 592289 - DNA, 20 bp, mouse
ggctgtaagtctgggaacca

SEQ ID NO: 592290 - DNA, 20 bp, mouse
ggatacactttcttccatat

SEQ ID NO: 592291 - DNA, 20 bp, mouse
ggatggagaagctcttgact

SEQ ID NO: 592292 - DNA, 20 bp, mouse
ggccaaagcgagggtctccc

SEQ ID NO: 592293 - DNA, 20 bp, mouse
ggaacaggaatcctcagagt

SEQ ID NO: 592294 - DNA, 20 bp, mouse
gtctccatcggatgtgcctc

SEQ ID NO: 592295 - DNA, 20 bp, mouse
ggagaagctcttgacttgga

SEQ ID NO: 592296 - DNA, 20 bp, mouse
gcgcagagccgacgcggacc

SEQ ID NO: 592297 - DNA, 20 bp, mouse
gggaccgggcacggggacga

SEQ ID NO: 592298 - DNA, 20 bp, mouse
gccgccgcggagggagcgcg

SEQ ID NO: 592299 - DNA, 20 bp, mouse
gcgcgtggctgcgaaggccc

SEQ ID NO: 592300 - DNA, 20 bp, mouse
gccgctccgcagagccgacg

SEQ ID NO: 592301 - DNA, 20 bp, mouse
gccccgtgcccggtccgcgt

SEQ ID NO: 592302 - DNA, 20 bp, mouse
ggccgacgcggaccgggcac

SEQ ID NO: 592303 - DNA, 20 bp, mouse
gcagccacgcgctccctccg

SEQ ID NO: 592304 - DNA, 20 bp, mouse
gtcggctctgcggagcggaa

SEQ ID NO: 592305 - DNA, 20 bp, mouse
gggtgcaccgtccttcccga

SEQ ID NO: 592306 - DNA, 20 bp, mouse
gatgagcagtcaccttgggt

SEQ ID NO: 592307 - DNA, 20 bp, mouse
ggtgggtctggcacaggtag

SEQ ID NO: 592308 - DNA, 20 bp, mouse
ggccttcccagccctaccca

SEQ ID NO: 592309 - DNA, 20 bp, mouse
gccaaggtgactgctcatca

SEQ ID NO: 592310 - DNA, 20 bp, mouse
gacctgtgccagacccacgg

SEQ ID NO: 592311 - DNA, 20 bp, mouse
gagtcaccttgggtagggct

SEQ ID NO: 592312 - DNA, 20 bp, mouse
gtcctccgtgggtctggcac

SEQ ID NO: 592313 - DNA, 20 bp, mouse
gtgcagcacactagtccaga

SEQ ID NO: 592314 - DNA, 20 bp, mouse
gggcagcttacctcctccgt

SEQ ID NO: 592315 - DNA, 20 bp, mouse
gacaagcgggtccatccctg

SEQ ID NO: 592316 - DNA, 20 bp, mouse
ggctcctctaggccagggtt

SEQ ID NO: 592317 - DNA, 20 bp, mouse
gcccagcccagcgaccacca

SEQ ID NO: 592318 - DNA, 20 bp, mouse
ggggcagctcggcagccaaa

SEQ ID NO: 592319 - DNA, 20 bp, mouse
gatggctctggcataggtag

SEQ ID NO: 592320 - DNA, 20 bp, mouse
gccgggtcctacctcctcca

SEQ ID NO: 592321 - DNA, 20 bp, mouse
gtggtcggtgggtgaggtat

SEQ ID NO: 592322 - DNA, 20 bp, mouse
gcctcaccatggtggtcgct

SEQ ID NO: 592323 - DNA, 20 bp, mouse
gtgcccgagtgtgccaggcc

SEQ ID NO: 592324 - DNA, 20 bp, mouse
gtgtggggctgggcaacgtg

SEQ ID NO: 592325 - DNA, 20 bp, mouse
gcccacacaaaagcccacac

SEQ ID NO: 592326 - DNA, 20 bp, mouse
ggctgccaccagcctaggtg

SEQ ID NO: 592327 - DNA, 20 bp, mouse
ggcagggagagcttgagggt

SEQ ID NO: 592328 - DNA, 20 bp, mouse
gtgagtgaccacacctaggc

SEQ ID NO: 592329 - DNA, 20 bp, mouse
gctaggctggtggcagcgct

SEQ ID NO: 592330 - DNA, 20 bp, mouse
gagggtagggagaggcctct

SEQ ID NO: 592331 - DNA, 20 bp, mouse
ggagccgtgtcctcttcgtg

SEQ ID NO: 592332 - DNA, 20 bp, mouse
gtcttcgtgaggctggaggt

SEQ ID NO: 592333 - DNA, 20 bp, mouse
gtgccaagtaggtctccccg

SEQ ID NO: 592334 - DNA, 20 bp, mouse
gtgagagccagagtcaggag

SEQ ID NO: 592335 - DNA, 20 bp, mouse
gagacgagcagagatcgtag

SEQ ID NO: 592336 - DNA, 20 bp, mouse
gcccagacgtcaggatctta

SEQ ID NO: 592337 - DNA, 20 bp, mouse
gtcaggatcttagggctgag

SEQ ID NO: 592338 - DNA, 20 bp, mouse
gacaaactgagaccacccag

SEQ ID NO: 592339 - DNA, 20 bp, mouse
gccaggggagcccagacgtc

SEQ ID NO: 592340 - DNA, 20 bp, mouse
ggaaaaggagcgcctgagtt

SEQ ID NO: 592341 - DNA, 20 bp, mouse
gctggagagagggacttcgg

SEQ ID NO: 592342 - DNA, 20 bp, mouse
gggtccgccccgccgagctc

SEQ ID NO: 592343 - DNA, 20 bp, mouse
gtagtggtgaaggaacgcaa

SEQ ID NO: 592344 - DNA, 20 bp, mouse
gtccacagcgaagcccacca

SEQ ID NO: 592345 - DNA, 20 bp, mouse
ggccctaagatcctgacgtc

SEQ ID NO: 592346 - DNA, 20 bp, mouse
gcgagctcgggacatggaga

SEQ ID NO: 592347 - DNA, 20 bp, mouse
gcagagaccaggccctgacg

SEQ ID NO: 592348 - DNA, 20 bp, mouse
ggcagcggatggccccactg

SEQ ID NO: 592349 - DNA, 20 bp, mouse
gagaaggcacggcctcagtg

SEQ ID NO: 592350 - DNA, 20 bp, mouse
gtcgggacatggagaaggca

SEQ ID NO: 592351 - DNA, 20 bp, mouse
gagctcgctgctccccgtca

SEQ ID NO: 592352 - DNA, 20 bp, mouse
gcccacggcgtaggagatgc

SEQ ID NO: 592353 - DNA, 20 bp, mouse
ggcggcggcggccagagacc

SEQ ID NO: 592354 - DNA, 20 bp, mouse
ggacagaacgccaccccgag

SEQ ID NO: 592355 - DNA, 20 bp, mouse
ggaacacgaactgcagcgga

SEQ ID NO: 592356 - DNA, 20 bp, mouse
ggaggcagcgagggaagcac

SEQ ID NO: 592357 - DNA, 20 bp, mouse
ggggaaccaacacagaattg

SEQ ID NO: 592358 - DNA, 20 bp, mouse
gttctccacaaccccagggt

SEQ ID NO: 592359 - DNA, 20 bp, mouse
gagggaagcactggtcaaga

SEQ ID NO: 592360 - DNA, 20 bp, mouse
ggaggacctggtcagcaccc

SEQ ID NO: 592361 - DNA, 20 bp, mouse
gtctaaactggccacctgtg

SEQ ID NO: 592362 - DNA, 20 bp, mouse
gtcagcacccaggaagaccg

SEQ ID NO: 592363 - DNA, 20 bp, mouse
ggctggagctcctcatcctc

SEQ ID NO: 592364 - DNA, 20 bp, mouse
gctcgctgcctcaacctcac

SEQ ID NO: 592365 - DNA, 20 bp, mouse
gtgtgggcctgggcaatgta

SEQ ID NO: 592366 - DNA, 20 bp, mouse
gagctgaagtctgacgctgg

SEQ ID NO: 592367 - DNA, 20 bp, mouse
gagctgtgaagcgcgactgg

SEQ ID NO: 592368 - DNA, 20 bp, mouse
gctgacgctggaggcaggta

SEQ ID NO: 592369 - DNA, 20 bp, mouse
ggacggctgtccagagtcag

SEQ ID NO: 592370 - DNA, 20 bp, mouse
gcagagctgtgaagcgcgac

SEQ ID NO: 592371 - DNA, 20 bp, mouse
gcccaccctgggcggaacag

SEQ ID NO: 592372 - DNA, 20 bp, mouse
gagccgtccggcggagcgag

SEQ ID NO: 592373 - DNA, 20 bp, mouse
ggatacgtaagaagcgatct

SEQ ID NO: 592374 - DNA, 20 bp, mouse
gcaaagctgaagtctgacgc

SEQ ID NO: 592375 - DNA, 20 bp, mouse
ggctaggcggaccgacccgg

SEQ ID NO: 592376 - DNA, 20 bp, mouse
gcgtcccggcagtgaaatga

SEQ ID NO: 592377 - DNA, 20 bp, mouse
gctgcagaggctctatggga

SEQ ID NO: 592378 - DNA, 20 bp, mouse
gccaggggcacatgagatca

SEQ ID NO: 592379 - DNA, 20 bp, mouse
gtctcatgtgcccctgggga

SEQ ID NO: 592380 - DNA, 20 bp, mouse
gactgccgggacggggcaca

SEQ ID NO: 592381 - DNA, 20 bp, mouse
gggaggggtgctggactcag

SEQ ID NO: 592382 - DNA, 20 bp, mouse
ggtacctgcagaggctctat

SEQ ID NO: 592383 - DNA, 20 bp, mouse
ggctgacaggtggatcccgg

SEQ ID NO: 592384 - DNA, 20 bp, mouse
ggggtcaggccactgaaccc

SEQ ID NO: 592385 - DNA, 20 bp, mouse
gcactgaacccgggcatacc

SEQ ID NO: 592386 - DNA, 20 bp, mouse
gccctgcgcggtgcagacaa

SEQ ID NO: 592387 - DNA, 20 bp, mouse
gggccgcgccggtgcctcga

SEQ ID NO: 592388 - DNA, 20 bp, mouse
gagggaaagcgacccacctg

SEQ ID NO: 592389 - DNA, 20 bp, mouse
gcggtgcctcgagggcgcga

SEQ ID NO: 592390 - DNA, 20 bp, mouse
gaaagcgacccacctgcggg

SEQ ID NO: 592391 - DNA, 20 bp, mouse
ggcgggcggcgccactccag

SEQ ID NO: 592392 - DNA, 20 bp, mouse
gccctcgaaaggaccctgcg

SEQ ID NO: 592393 - DNA, 20 bp, mouse
gctcgaccctcgcgccctcg

SEQ ID NO: 592394 - DNA, 20 bp, mouse
gagggacccgatggaaaccc

SEQ ID NO: 592395 - DNA, 20 bp, mouse
gggccagctctgggtctcca

SEQ ID NO: 592396 - DNA, 20 bp, mouse
gctgttgtccgcatcagaca

SEQ ID NO: 592397 - DNA, 20 bp, mouse
ggccaaacctagatcagtag

SEQ ID NO: 592398 - DNA, 20 bp, mouse
ggcactcaccatgtctgatg

SEQ ID NO: 592399 - DNA, 20 bp, mouse
gggtttggccctggaacaag

SEQ ID NO: 592400 - DNA, 20 bp, mouse
gagtagaggattttactcta

SEQ ID NO: 592401 - DNA, 20 bp, mouse
gacttgggagccttgccgga

SEQ ID NO: 592402 - DNA, 20 bp, mouse
gttgtcactccggtaggagg

SEQ ID NO: 592403 - DNA, 20 bp, mouse
gacggacagtacctaagacc

SEQ ID NO: 592404 - DNA, 20 bp, mouse
gacacgcagccccctcctac

SEQ ID NO: 592405 - DNA, 20 bp, mouse
gtcctctactgatctaggtt

SEQ ID NO: 592406 - DNA, 20 bp, mouse
gcaacagacacgcgaggtca

SEQ ID NO: 592407 - DNA, 20 bp, mouse
gggaagcggtaatttataag

SEQ ID NO: 592408 - DNA, 20 bp, mouse
gtcccggagcacgacgctgg

SEQ ID NO: 592409 - DNA, 20 bp, mouse
gccaggtacccagggcgtgt

SEQ ID NO: 592410 - DNA, 20 bp, mouse
gaggtcccggagcacgacgc

SEQ ID NO: 592411 - DNA, 20 bp, mouse
ggacccgcagggacccggtg

SEQ ID NO: 592412 - DNA, 20 bp, mouse
gccgcagggacccggtgagg

SEQ ID NO: 592413 - DNA, 20 bp, mouse
gctcggcagcaaccaggtcc

SEQ ID NO: 592414 - DNA, 20 bp, mouse
ggagacatccagggacaagg

SEQ ID NO: 592415 - DNA, 20 bp, mouse
ggcgtgtctgttgtctgaac

SEQ ID NO: 592416 - DNA, 20 bp, mouse
gtagggcgctgcgcagggag

SEQ ID NO: 592417 - DNA, 20 bp, mouse
gtccgcaaggtagggcacga

SEQ ID NO: 592418 - DNA, 20 bp, mouse
gagctcacctccgcaaggta

SEQ ID NO: 592419 - DNA, 20 bp, mouse
gcagcctagggcgctgcgca

SEQ ID NO: 592420 - DNA, 20 bp, mouse
gcacgcccgcagcggcctca

SEQ ID NO: 592421 - DNA, 20 bp, mouse
gccgtgcgcgggagccgtgg

SEQ ID NO: 592422 - DNA, 20 bp, mouse
gtccgtcatcggatctgtct

SEQ ID NO: 592423 - DNA, 20 bp, mouse
ggcaaggtagggcacgaggg

SEQ ID NO: 592424 - DNA, 20 bp, mouse
gcccaggaggcgcggacggg

SEQ ID NO: 592425 - DNA, 20 bp, mouse
ggagtgcccaggtgaagcca

SEQ ID NO: 592426 - DNA, 20 bp, mouse
gggtcgcgtcgggaaagaga

SEQ ID NO: 592427 - DNA, 20 bp, mouse
gagggacagttggagtgcca

SEQ ID NO: 592428 - DNA, 20 bp, mouse
gcgccgccgccgggaaggag

SEQ ID NO: 592429 - DNA, 20 bp, mouse
gctagccccctccttcccgg

SEQ ID NO: 592430 - DNA, 20 bp, mouse
gcggactcaaagactcgcct

SEQ ID NO: 592431 - DNA, 20 bp, mouse
ggccgctctccgggccgcgg

SEQ ID NO: 592432 - DNA, 20 bp, mouse
gctagggtgagcctccggca

SEQ ID NO: 592433 - DNA, 20 bp, mouse
ggccgccgcttgcagacagt

SEQ ID NO: 592434 - DNA, 20 bp, mouse
gacgcgctagggtgagcctc

SEQ ID NO: 592435 - DNA, 20 bp, mouse
gagcgcgtcgcgggtggcat

SEQ ID NO: 592436 - DNA, 20 bp, mouse
gggaggagcggcaggcaacg

SEQ ID NO: 592437 - DNA, 20 bp, mouse
gggctgcagagagcctcggg

SEQ ID NO: 592438 - DNA, 20 bp, mouse
gggagcggcaggcaacgcgg

SEQ ID NO: 592439 - DNA, 20 bp, mouse
gacgacggctggacagacct

SEQ ID NO: 592440 - DNA, 20 bp, mouse
gtggcggctgcagagagcct

SEQ ID NO: 592441 - DNA, 20 bp, mouse
gaagttgcatcagcctcccg

SEQ ID NO: 592442 - DNA, 20 bp, mouse
gtcgccgcgaaggtctgggt

SEQ ID NO: 592443 - DNA, 20 bp, mouse
gcaagctctggaggagcggc

SEQ ID NO: 592444 - DNA, 20 bp, mouse
gggcaggcaacgcggcgggg

SEQ ID NO: 592445 - DNA, 20 bp, mouse
gacagaaacgcccagaacga

SEQ ID NO: 592446 - DNA, 20 bp, mouse
gtgagctgtgtggagaccgc

SEQ ID NO: 592447 - DNA, 20 bp, mouse
gaaggatcgcgtactcacgg

SEQ ID NO: 592448 - DNA, 20 bp, mouse
ggatcgcgtactcacggagg

SEQ ID NO: 592449 - DNA, 20 bp, mouse
gctcacacctgctagctgag

SEQ ID NO: 592450 - DNA, 20 bp, mouse
gagcgggagggagtgaacac

SEQ ID NO: 592451 - DNA, 20 bp, mouse
gccgtgtgtaggctccacgt

SEQ ID NO: 592452 - DNA, 20 bp, mouse
gggcgcgcggctgatgaaac

SEQ ID NO: 592453 - DNA, 20 bp, mouse
ggaggaggcgaccggaacac

SEQ ID NO: 592454 - DNA, 20 bp, mouse
gcacaaggatcgcgtactca

SEQ ID NO: 592455 - DNA, 20 bp, mouse
gctgaggggatggcgcacgc

SEQ ID NO: 592456 - DNA, 20 bp, mouse
ggctgcgggccggacagacg

SEQ ID NO: 592457 - DNA, 20 bp, mouse
ggaaccgaccgacggaggac

SEQ ID NO: 592458 - DNA, 20 bp, mouse
gcgacagacgaaccgaccga

SEQ ID NO: 592459 - DNA, 20 bp, mouse
gcagacgaaccgaccgacgg

SEQ ID NO: 592460 - DNA, 20 bp, mouse
gcccgcagccagtcctccgt

SEQ ID NO: 592461 - DNA, 20 bp, mouse
gcagccagtcctccgtcggt

SEQ ID NO: 592462 - DNA, 20 bp, mouse
ggaagaccataagaccacag

SEQ ID NO: 592463 - DNA, 20 bp, mouse
gagcgcagggaactgggatg

SEQ ID NO: 592464 - DNA, 20 bp, mouse
gcatagcgtggaagtactgg

SEQ ID NO: 592465 - DNA, 20 bp, mouse
ggcagggaactgggatgagg

SEQ ID NO: 592466 - DNA, 20 bp, mouse
ggctcctcggagcacctgtg

SEQ ID NO: 592467 - DNA, 20 bp, mouse
gtccacaggtgagaactcag

SEQ ID NO: 592468 - DNA, 20 bp, mouse
gcctggagccggtgccacac

SEQ ID NO: 592469 - DNA, 20 bp, mouse
gaatgatagggcagcagccg

SEQ ID NO: 592470 - DNA, 20 bp, mouse
ggtgccacacaggtgctccg

SEQ ID NO: 592471 - DNA, 20 bp, mouse
gagtgtcacaccagaggagg

SEQ ID NO: 592472 - DNA, 20 bp, mouse
gtgagctggtgtgtaatgat

SEQ ID NO: 592473 - DNA, 20 bp, mouse
gagccagtcggtgatagcaa

SEQ ID NO: 592474 - DNA, 20 bp, mouse
ggtaattatagagccagcga

SEQ ID NO: 592475 - DNA, 20 bp, mouse
gtccagaacacgggcagcgt

SEQ ID NO: 592476 - DNA, 20 bp, mouse
gggcaacaccctgtttgaca

SEQ ID NO: 592477 - DNA, 20 bp, mouse
ggatgctccactcaaagggt

SEQ ID NO: 592478 - DNA, 20 bp, mouse
ggagacagggatatttagtg

SEQ ID NO: 592479 - DNA, 20 bp, mouse
gcaaccacctaccctttgag

SEQ ID NO: 592480 - DNA, 20 bp, mouse
ggctccactcaaagggtagg

SEQ ID NO: 592481 - DNA, 20 bp, mouse
ggtgaaaaaccctgtcaaac

SEQ ID NO: 592482 - DNA, 20 bp, mouse
gagtgctctcaagagttgca

SEQ ID NO: 592483 - DNA, 20 bp, mouse
gcctgtctccttaagtattt

SEQ ID NO: 592484 - DNA, 20 bp, mouse
gaataagatgctccactcaa

SEQ ID NO: 592485 - DNA, 20 bp, mouse
gttagtgccaccctggggac

SEQ ID NO: 592486 - DNA, 20 bp, mouse
gaaagcatccacaaacctat

SEQ ID NO: 592487 - DNA, 20 bp, mouse
ggaatgtaaacttctctcaa

SEQ ID NO: 592488 - DNA, 20 bp, mouse
gcctcaggaatgccacgaga

SEQ ID NO: 592489 - DNA, 20 bp, mouse
gcagacagcccaaacacaca

SEQ ID NO: 592490 - DNA, 20 bp, mouse
gaaggagactccaacattca

SEQ ID NO: 592491 - DNA, 20 bp, mouse
gtgctggagcactcccttgg

SEQ ID NO: 592492 - DNA, 20 bp, mouse
gcagagcagctgggataaaa

SEQ ID NO: 592493 - DNA, 20 bp, mouse
gtgtgaatgtttctgcctat

SEQ ID NO: 592494 - DNA, 20 bp, mouse
gtgagccccactgtatggga

SEQ ID NO: 592495 - DNA, 20 bp, mouse
gatagtgagccccactgtat

SEQ ID NO: 592496 - DNA, 20 bp, mouse
gagagctgagatgagggcgg

SEQ ID NO: 592497 - DNA, 20 bp, mouse
gcggtggtagtgataaagga

SEQ ID NO: 592498 - DNA, 20 bp, mouse
gagggcggtggtagtgataa

SEQ ID NO: 592499 - DNA, 20 bp, mouse
gggagccccagacacctgca

SEQ ID NO: 592500 - DNA, 20 bp, mouse
gtgaactggatgctaatgtc

SEQ ID NO: 592501 - DNA, 20 bp, mouse
gcggagactaagatgaacca

SEQ ID NO: 592502 - DNA, 20 bp, mouse
gactggatgctaatgtccgg

SEQ ID NO: 592503 - DNA, 20 bp, mouse
ggggcatccactcaccagag

SEQ ID NO: 592504 - DNA, 20 bp, mouse
gcctacgggaaggggatctc

SEQ ID NO: 592505 - DNA, 20 bp, mouse
ggcgactgcggagacctggg

SEQ ID NO: 592506 - DNA, 20 bp, mouse
gtgtacctgtcaacaaccag

SEQ ID NO: 592507 - DNA, 20 bp, mouse
ggtctgctgaagtctcgaaa

SEQ ID NO: 592508 - DNA, 20 bp, mouse
gctcgaaatggagcgaagtg

SEQ ID NO: 592509 - DNA, 20 bp, mouse
gagcatggccaggagtccac

SEQ ID NO: 592510 - DNA, 20 bp, mouse
gtggcagcaacaagcccgcg

SEQ ID NO: 592511 - DNA, 20 bp, mouse
gaaggggtcttggtttacat

SEQ ID NO: 592512 - DNA, 20 bp, mouse
gtgttgacaggtacaggctc

SEQ ID NO: 592513 - DNA, 20 bp, mouse
gtatacgtagatgaccagga

SEQ ID NO: 592514 - DNA, 20 bp, mouse
gactgcctctggttgttgac

SEQ ID NO: 592515 - DNA, 20 bp, mouse
ggttgcccagacaataagac

SEQ ID NO: 592516 - DNA, 20 bp, mouse
gtgtctgcgcggacctggaa

SEQ ID NO: 592517 - DNA, 20 bp, mouse
gccccccgaagggaagcgag

SEQ ID NO: 592518 - DNA, 20 bp, mouse
gggagacccagggtcctgag

SEQ ID NO: 592519 - DNA, 20 bp, mouse
gccgccttctgcaagctcgg

SEQ ID NO: 592520 - DNA, 20 bp, mouse
gccttctgcaagctcggcgg

SEQ ID NO: 592521 - DNA, 20 bp, mouse
gcggggacgggaacaggcac

SEQ ID NO: 592522 - DNA, 20 bp, mouse
ggagaggctgcagcgctctg

SEQ ID NO: 592523 - DNA, 20 bp, mouse
ggcgcgcagagactccagga

SEQ ID NO: 592524 - DNA, 20 bp, mouse
gattccaagctcgcgaaggt

SEQ ID NO: 592525 - DNA, 20 bp, mouse
gtcgagtgagagtcagccag

SEQ ID NO: 592526 - DNA, 20 bp, mouse
gcctcctcccggtgaatata

SEQ ID NO: 592527 - DNA, 20 bp, mouse
ggaccctagcccaggagcca

SEQ ID NO: 592528 - DNA, 20 bp, mouse
ggccccttatattcaccggg

SEQ ID NO: 592529 - DNA, 20 bp, mouse
gaagcgccccttatattcac

SEQ ID NO: 592530 - DNA, 20 bp, mouse
gggaggagccagtaacgtca

SEQ ID NO: 592531 - DNA, 20 bp, mouse
gaccgggcgggacccctaat

SEQ ID NO: 592532 - DNA, 20 bp, mouse
gcgctggagctagggagccc

SEQ ID NO: 592533 - DNA, 20 bp, mouse
gtgagtctagggccaccggg

SEQ ID NO: 592534 - DNA, 20 bp, mouse
gtaggcttttcaggcaacca

SEQ ID NO: 592535 - DNA, 20 bp, mouse
ggggaagtgctagcgatctc

SEQ ID NO: 592536 - DNA, 20 bp, mouse
ggacgcgtgtcagggactgt

SEQ ID NO: 592537 - DNA, 20 bp, mouse
gcaggcgttgtaaactagtg

SEQ ID NO: 592538 - DNA, 20 bp, mouse
gctgggctcctaaggagagg

SEQ ID NO: 592539 - DNA, 20 bp, mouse
gacagcaggtgggtcatagc

SEQ ID NO: 592540 - DNA, 20 bp, mouse
ggggtcatagcgggtctgga

SEQ ID NO: 592541 - DNA, 20 bp, mouse
gaggtgggtcatagcgggtc

SEQ ID NO: 592542 - DNA, 20 bp, mouse
ggcggacctgcgaaccaggt

SEQ ID NO: 592543 - DNA, 20 bp, mouse
gagaaggcttgggcgtctag

SEQ ID NO: 592544 - DNA, 20 bp, mouse
gcaggaggccagagctgcaa

SEQ ID NO: 592545 - DNA, 20 bp, mouse
gacgagcaagaagaaatggg

SEQ ID NO: 592546 - DNA, 20 bp, mouse
ggggaacgccgagagcatgg

SEQ ID NO: 592547 - DNA, 20 bp, mouse
gccggctcggcctggatacc

SEQ ID NO: 592548 - DNA, 20 bp, mouse
ggcgcgcacgccgggtatcc

SEQ ID NO: 592549 - DNA, 20 bp, mouse
gacggtgtggccatcatcgt

SEQ ID NO: 592550 - DNA, 20 bp, mouse
gcaggcgcgggagaagatgt

SEQ ID NO: 592551 - DNA, 20 bp, mouse
ggcaatatcacgctgctcaa

SEQ ID NO: 592552 - DNA, 20 bp, mouse
ggccgggaacgccgagagca

SEQ ID NO: 592553 - DNA, 20 bp, mouse
gagacgcacttctcagtacg

SEQ ID NO: 592554 - DNA, 20 bp, mouse
gcccgcgaccgccatgctct

SEQ ID NO: 592555 - DNA, 20 bp, mouse
gcgcgcggttgcgaccccgg

SEQ ID NO: 592556 - DNA, 20 bp, mouse
ggaagctccgggccacgagg

SEQ ID NO: 592557 - DNA, 20 bp, mouse
gcacacggcggtccactcca

SEQ ID NO: 592558 - DNA, 20 bp, mouse
gggagggcgcgggagagacg

SEQ ID NO: 592559 - DNA, 20 bp, mouse
ggtagctggcgaggccgagg

SEQ ID NO: 592560 - DNA, 20 bp, mouse
gacggcgcgaccgagcatcc

SEQ ID NO: 592561 - DNA, 20 bp, mouse
gggagcgtggatccctggag

SEQ ID NO: 592562 - DNA, 20 bp, mouse
ggtggggagagagaccccga

SEQ ID NO: 592563 - DNA, 20 bp, mouse
gctggaagctccgggccacg

SEQ ID NO: 592564 - DNA, 20 bp, mouse
gcgggccacgaggaggtagc

SEQ ID NO: 592565 - DNA, 20 bp, mouse
gtggcgaggccgaggaggtg

SEQ ID NO: 592566 - DNA, 20 bp, mouse
ggccagcacgagcgcctcgg

SEQ ID NO: 592567 - DNA, 20 bp, mouse
gtgcggtgttgcgcgtgaag

SEQ ID NO: 592568 - DNA, 20 bp, mouse
gtactccgcgatcgccgcta

SEQ ID NO: 592569 - DNA, 20 bp, mouse
gcgatcgccgctatggaggc

SEQ ID NO: 592570 - DNA, 20 bp, mouse
gacgccagagggccaggagg

SEQ ID NO: 592571 - DNA, 20 bp, mouse
gcgcaacgcggagcccgccg

SEQ ID NO: 592572 - DNA, 20 bp, mouse
gggcgatcgcggagtactgt

SEQ ID NO: 592573 - DNA, 20 bp, mouse
gcatacctgggatcgcacgg

SEQ ID NO: 592574 - DNA, 20 bp, mouse
ggtgaagcggaagcgcaacg

SEQ ID NO: 592575 - DNA, 20 bp, mouse
gcaggccagcacgagcgcct

SEQ ID NO: 592576 - DNA, 20 bp, mouse
gtgacacggaggagcagaaa

SEQ ID NO: 592577 - DNA, 20 bp, mouse
gggtggtagttagagaatgg

SEQ ID NO: 592578 - DNA, 20 bp, mouse
gagggtgcctgggaccgaaa

SEQ ID NO: 592579 - DNA, 20 bp, mouse
gcccggacaggtaagaggag

SEQ ID NO: 592580 - DNA, 20 bp, mouse
gacctgtccgggagacctct

SEQ ID NO: 592581 - DNA, 20 bp, mouse
gtagacagtgccagggatag

SEQ ID NO: 592582 - DNA, 20 bp, mouse
ggaagtgtagggagcgcagg

SEQ ID NO: 592583 - DNA, 20 bp, mouse
ggggggctagcagcacactg

SEQ ID NO: 592584 - DNA, 20 bp, mouse
gggtctcccggacaggtaag

SEQ ID NO: 592585 - DNA, 20 bp, mouse
gagacctctgggcaagtgca

SEQ ID NO: 592586 - DNA, 20 bp, mouse
gcggagctcggagccgacaa

SEQ ID NO: 592587 - DNA, 20 bp, mouse
gtcacagatggagcgatctg

SEQ ID NO: 592588 - DNA, 20 bp, mouse
gcgacaagggcgagaaggaa

SEQ ID NO: 592589 - DNA, 20 bp, mouse
gggagccgacaagggcgaga

SEQ ID NO: 592590 - DNA, 20 bp, mouse
ggcgatctgcggagtgagca

SEQ ID NO: 592591 - DNA, 20 bp, mouse
gcaccgagcagagcgatcct

SEQ ID NO: 592592 - DNA, 20 bp, mouse
gctctgctcggtgtaccggg

SEQ ID NO: 592593 - DNA, 20 bp, mouse
gttcttagctgagggagcgg

SEQ ID NO: 592594 - DNA, 20 bp, mouse
gaaggggcgaccgcagcagg

SEQ ID NO: 592595 - DNA, 20 bp, mouse
gtcgctccatctgtgagggc

SEQ ID NO: 592596 - DNA, 20 bp, mouse
ggagtatcaccgactcaggt

SEQ ID NO: 592597 - DNA, 20 bp, mouse
gaagcaggacctacctgagt

SEQ ID NO: 592598 - DNA, 20 bp, mouse
gacaattgcgggctgggtgg

SEQ ID NO: 592599 - DNA, 20 bp, mouse
ggagagagtatcaccgactc

SEQ ID NO: 592600 - DNA, 20 bp, mouse
gtagggccaagctccaggaa

SEQ ID NO: 592601 - DNA, 20 bp, mouse
gcctacaattgcgggctggg

SEQ ID NO: 592602 - DNA, 20 bp, mouse
gagcttggccctacaattgc

SEQ ID NO: 592603 - DNA, 20 bp, mouse
gcccagtaccgaggtagctg

SEQ ID NO: 592604 - DNA, 20 bp, mouse
gaaggtactgaaaagtacta

SEQ ID NO: 592605 - DNA, 20 bp, mouse
ggtaccgaggtagctgaggt

SEQ ID NO: 592606 - DNA, 20 bp, mouse
gtcccattgaaacattgggt

SEQ ID NO: 592607 - DNA, 20 bp, mouse
gggatttcgtctggtagctc

SEQ ID NO: 592608 - DNA, 20 bp, mouse
gggagagaccaccaagacga

SEQ ID NO: 592609 - DNA, 20 bp, mouse
ggtttcaatgggatttcgtc

SEQ ID NO: 592610 - DNA, 20 bp, mouse
gctcccacccaatgtttcaa

SEQ ID NO: 592611 - DNA, 20 bp, mouse
gctctatagaggacataaac

SEQ ID NO: 592612 - DNA, 20 bp, mouse
gtgcagttatatggtcaaca

SEQ ID NO: 592613 - DNA, 20 bp, mouse
ggaggtgatgacctctatag

SEQ ID NO: 592614 - DNA, 20 bp, mouse
gctcaggagcagaagatccc

SEQ ID NO: 592615 - DNA, 20 bp, mouse
gtgcaataatagaaactcca

SEQ ID NO: 592616 - DNA, 20 bp, mouse
ggcctccgcccgaggagaaa

SEQ ID NO: 592617 - DNA, 20 bp, mouse
gcccgctgggcccccgcggt

SEQ ID NO: 592618 - DNA, 20 bp, mouse
gtgcacggggaacctggagg

SEQ ID NO: 592619 - DNA, 20 bp, mouse
gcaggttccccgtgcatcag

SEQ ID NO: 592620 - DNA, 20 bp, mouse
ggcggaggcgcccaccgcgg

SEQ ID NO: 592621 - DNA, 20 bp, mouse
gggtccccgctgggcccccg

SEQ ID NO: 592622 - DNA, 20 bp, mouse
gacatggcgcacgctgaaag

SEQ ID NO: 592623 - DNA, 20 bp, mouse
gagagacctgggctaaaatg

SEQ ID NO: 592624 - DNA, 20 bp, mouse
gtggattcccgcaaccccag

SEQ ID NO: 592625 - DNA, 20 bp, mouse
ggcagtgtggactcccccga

SEQ ID NO: 592626 - DNA, 20 bp, mouse
gggcctcgccgcgctcagag

SEQ ID NO: 592627 - DNA, 20 bp, mouse
gtcagaggggacgagcgtag

SEQ ID NO: 592628 - DNA, 20 bp, mouse
gccttgcccactgtcaccac

SEQ ID NO: 592629 - DNA, 20 bp, mouse
gggcgaggccgagacgtctc

SEQ ID NO: 592630 - DNA, 20 bp, mouse
ggtcaccaccggagacgtct

SEQ ID NO: 592631 - DNA, 20 bp, mouse
ggaggccgagacgtctccgg

SEQ ID NO: 592632 - DNA, 20 bp, mouse
gacgtctccggtggtgacag

SEQ ID NO: 592633 - DNA, 20 bp, mouse
ggcgttgtacagaccctcgg

SEQ ID NO: 592634 - DNA, 20 bp, mouse
gcccagcccggggaaagccc

SEQ ID NO: 592635 - DNA, 20 bp, mouse
ggtcccctctgagcgcggcg

SEQ ID NO: 592636 - DNA, 20 bp, mouse
gcggctagaggaagactccg

SEQ ID NO: 592637 - DNA, 20 bp, mouse
ggcgaagctcctcttacctc

SEQ ID NO: 592638 - DNA, 20 bp, mouse
ggttggagcgacgagtgcac

SEQ ID NO: 592639 - DNA, 20 bp, mouse
gctctaggggcggaaggttg

SEQ ID NO: 592640 - DNA, 20 bp, mouse
gaagctcctcttacctcggg

SEQ ID NO: 592641 - DNA, 20 bp, mouse
gcggatccaggccccgcccg

SEQ ID NO: 592642 - DNA, 20 bp, mouse
ggggcctggatccgcgacct

SEQ ID NO: 592643 - DNA, 20 bp, mouse
ggcgctggccatccggctag

SEQ ID NO: 592644 - DNA, 20 bp, mouse
ggaggaagactccgaggtcg

SEQ ID NO: 592645 - DNA, 20 bp, mouse
ggctgcggcgttggtgaagt

SEQ ID NO: 592646 - DNA, 20 bp, mouse
ggtgttccaccccggcccag

SEQ ID NO: 592647 - DNA, 20 bp, mouse
gtccgctaccgcgggacccg

SEQ ID NO: 592648 - DNA, 20 bp, mouse
gcccggggctgtgtcaggtc

SEQ ID NO: 592649 - DNA, 20 bp, mouse
gcgggacccggggctgtgtc

SEQ ID NO: 592650 - DNA, 20 bp, mouse
gggcccagcggcagctcctt

SEQ ID NO: 592651 - DNA, 20 bp, mouse
ggagattccggggaaatgga

SEQ ID NO: 592652 - DNA, 20 bp, mouse
ggcacagcgcagccatttat

SEQ ID NO: 592653 - DNA, 20 bp, mouse
ggccccgggtcccgcggtag

SEQ ID NO: 592654 - DNA, 20 bp, mouse
gtgctgcgcctgctactcgt

SEQ ID NO: 592655 - DNA, 20 bp, mouse
ggcgccgggctgagattccg

SEQ ID NO: 592656 - DNA, 20 bp, mouse
gaacctcgcagggcccggag

SEQ ID NO: 592657 - DNA, 20 bp, mouse
gaggccactgcgcggtccct

SEQ ID NO: 592658 - DNA, 20 bp, mouse
gggcatgggagggcggccgg

SEQ ID NO: 592659 - DNA, 20 bp, mouse
gcggccgagggaccgcgcag

SEQ ID NO: 592660 - DNA, 20 bp, mouse
gcagcagaggacgctggtgt

SEQ ID NO: 592661 - DNA, 20 bp, mouse
ggcgacaggaggccactgcg

SEQ ID NO: 592662 - DNA, 20 bp, mouse
ggaggggagcgcgcagcgac

SEQ ID NO: 592663 - DNA, 20 bp, mouse
ggacagcactactaactcaa

SEQ ID NO: 592664 - DNA, 20 bp, mouse
gggacgctggtgtaggatct

SEQ ID NO: 592665 - DNA, 20 bp, mouse
gggtaatccagggtgaacac

SEQ ID NO: 592666 - DNA, 20 bp, mouse
ggcgcagcaggtactcacca

SEQ ID NO: 592667 - DNA, 20 bp, mouse
gggagccaacacgcatacct

SEQ ID NO: 592668 - DNA, 20 bp, mouse
gagctccgggctcgcgcaga

SEQ ID NO: 592669 - DNA, 20 bp, mouse
gggaggaaccgagcagtgat

SEQ ID NO: 592670 - DNA, 20 bp, mouse
gctcaccaaggtatgcgtgt

SEQ ID NO: 592671 - DNA, 20 bp, mouse
gagcctgcaaggcgcgaggg

SEQ ID NO: 592672 - DNA, 20 bp, mouse
gtccagagcgcaatgatgta

SEQ ID NO: 592673 - DNA, 20 bp, mouse
gccgggctctgggaccaggg

SEQ ID NO: 592674 - DNA, 20 bp, mouse
gcccggagctggcagcagtc

SEQ ID NO: 592675 - DNA, 20 bp, mouse
gagcagtgatgggagcttcc

SEQ ID NO: 592676 - DNA, 20 bp, mouse
gggttgcgaacgcacaggaa

SEQ ID NO: 592677 - DNA, 20 bp, mouse
gcacagggaacaggtgtccc

SEQ ID NO: 592678 - DNA, 20 bp, mouse
ggagccgcagagctcgagtt

SEQ ID NO: 592679 - DNA, 20 bp, mouse
gtctccaggcagcagagccg

SEQ ID NO: 592680 - DNA, 20 bp, mouse
gacaggtgtcccgggaaccg

SEQ ID NO: 592681 - DNA, 20 bp, mouse
gaccgcggttgcgaacgcac

SEQ ID NO: 592682 - DNA, 20 bp, mouse
gcgcacggggcacagggaac

SEQ ID NO: 592683 - DNA, 20 bp, mouse
ggcctggagaagggtccaaa

SEQ ID NO: 592684 - DNA, 20 bp, mouse
ggttcgcaaccgcggttccc

SEQ ID NO: 592685 - DNA, 20 bp, mouse
gtcagcgcgggtgccgtcgg

SEQ ID NO: 592686 - DNA, 20 bp, mouse
gtgcgcggagagcaagggta

SEQ ID NO: 592687 - DNA, 20 bp, mouse
gccacccgcaggctggagtg

SEQ ID NO: 592688 - DNA, 20 bp, mouse
gcctggtgcgcggagagcaa

SEQ ID NO: 592689 - DNA, 20 bp, mouse
ggcaggctggagtgcggagg

SEQ ID NO: 592690 - DNA, 20 bp, mouse
gcccctaggagggaaccggg

SEQ ID NO: 592691 - DNA, 20 bp, mouse
gccagggccagagccgaagc

SEQ ID NO: 592692 - DNA, 20 bp, mouse
gcacgcagaagggtggtcgt

SEQ ID NO: 592693 - DNA, 20 bp, mouse
ggcgccggatgaactggcca

SEQ ID NO: 592694 - DNA, 20 bp, mouse
gcacggctcacaccacccgc

SEQ ID NO: 592695 - DNA, 20 bp, mouse
gcatacggcacgcagaaggg

SEQ ID NO: 592696 - DNA, 20 bp, mouse
gtggagcgagccatgagaag

SEQ ID NO: 592697 - DNA, 20 bp, mouse
ggagaaggggctaggagcgc

SEQ ID NO: 592698 - DNA, 20 bp, mouse
gagtgggaggtagataagtg

SEQ ID NO: 592699 - DNA, 20 bp, mouse
ggcaggcagcatgctagtcc

SEQ ID NO: 592700 - DNA, 20 bp, mouse
ggaacctgggccacagtggg

SEQ ID NO: 592701 - DNA, 20 bp, mouse
gcgagccatgagaaggggct

SEQ ID NO: 592702 - DNA, 20 bp, mouse
gtagctcaatctctggggaa

SEQ ID NO: 592703 - DNA, 20 bp, mouse
ggccccagttgagagttcac

SEQ ID NO: 592704 - DNA, 20 bp, mouse
gttcacaggaggggctcctg

SEQ ID NO: 592705 - DNA, 20 bp, mouse
ggggaagggcagggaactcg

SEQ ID NO: 592706 - DNA, 20 bp, mouse
ggtcagagtcgcacaggcat

SEQ ID NO: 592707 - DNA, 20 bp, mouse
gtgcgaagtcagagtcgcac

SEQ ID NO: 592708 - DNA, 20 bp, mouse
gtgctgggcagtgggattgg

SEQ ID NO: 592709 - DNA, 20 bp, mouse
gagatgcgagcagtatccag

SEQ ID NO: 592710 - DNA, 20 bp, mouse
gatgggtcctgcaatgttta

SEQ ID NO: 592711 - DNA, 20 bp, mouse
gtggaactggttactactgc

SEQ ID NO: 592712 - DNA, 20 bp, mouse
gaactggttactactgctgg

SEQ ID NO: 592713 - DNA, 20 bp, mouse
gtccagagggtgacttcata

SEQ ID NO: 592714 - DNA, 20 bp, mouse
gtgttgcttcggaacgtgta

SEQ ID NO: 592715 - DNA, 20 bp, mouse
gtagctcagaccccgatgaa

SEQ ID NO: 592716 - DNA, 20 bp, mouse
gtccgcctcagagcagaggg

SEQ ID NO: 592717 - DNA, 20 bp, mouse
gggtatgggcgaggctgcag

SEQ ID NO: 592718 - DNA, 20 bp, mouse
ggtagctgggccactctcaa

SEQ ID NO: 592719 - DNA, 20 bp, mouse
gatctttgtaaggattttta

SEQ ID NO: 592720 - DNA, 20 bp, mouse
gctttctttagatttggtat

SEQ ID NO: 592721 - DNA, 20 bp, mouse
gggatcaccagctctctgag

SEQ ID NO: 592722 - DNA, 20 bp, mouse
gcgctccgcctcagagcaga

SEQ ID NO: 592723 - DNA, 20 bp, mouse
gcactctcaagggacgagat

SEQ ID NO: 592724 - DNA, 20 bp, mouse
gttcaatgtggaataagaag

SEQ ID NO: 592725 - DNA, 20 bp, mouse
gaaatctcttcggataatct

SEQ ID NO: 592726 - DNA, 20 bp, mouse
gccggggcccgcagacgcca

SEQ ID NO: 592727 - DNA, 20 bp, mouse
gcgcagacgccacggcgaac

SEQ ID NO: 592728 - DNA, 20 bp, mouse
gacatggctggggctcggcg

SEQ ID NO: 592729 - DNA, 20 bp, mouse
gaccaaaggggccgcatgag

SEQ ID NO: 592730 - DNA, 20 bp, mouse
gtggcccgaccactccccgt

SEQ ID NO: 592731 - DNA, 20 bp, mouse
gctgcgaagagcaaccaaag

SEQ ID NO: 592732 - DNA, 20 bp, mouse
gggccgagcaggaccaggac

SEQ ID NO: 592733 - DNA, 20 bp, mouse
gggctggcgcccgttcgccg

SEQ ID NO: 592734 - DNA, 20 bp, mouse
ggagaaggggagcagaatgt

SEQ ID NO: 592735 - DNA, 20 bp, mouse
gggagtggtcgggccacggg

SEQ ID NO: 592736 - DNA, 20 bp, mouse
gcgccgtcggcagcttccag

SEQ ID NO: 592737 - DNA, 20 bp, mouse
gggccaccggggtaagtccg

SEQ ID NO: 592738 - DNA, 20 bp, mouse
gccagcagcacaggcaacag

SEQ ID NO: 592739 - DNA, 20 bp, mouse
gcggtgccgcggacttaccc

SEQ ID NO: 592740 - DNA, 20 bp, mouse
gcctggccaggcgcgagcag

SEQ ID NO: 592741 - DNA, 20 bp, mouse
gcaccgctggaagctgccga

SEQ ID NO: 592742 - DNA, 20 bp, mouse
gtcggtggcaagctcctcca

SEQ ID NO: 592743 - DNA, 20 bp, mouse
gtcagccgccgccccagagg

SEQ ID NO: 592744 - DNA, 20 bp, mouse
gtgccgcggacttaccccgg

SEQ ID NO: 592745 - DNA, 20 bp, mouse
ggagctgcggctgtggccac

SEQ ID NO: 592746 - DNA, 20 bp, mouse
gctcggaagctcgcaggata

SEQ ID NO: 592747 - DNA, 20 bp, mouse
gataggggagaagatggcgg

SEQ ID NO: 592748 - DNA, 20 bp, mouse
gcggcttcgggtagcggagg

SEQ ID NO: 592749 - DNA, 20 bp, mouse
ggcgcggcttcgggtagcgg

SEQ ID NO: 592750 - DNA, 20 bp, mouse
gagtgcgcggcttcgggtag

SEQ ID NO: 592751 - DNA, 20 bp, mouse
gtgtagtctcggaagctcgc

SEQ ID NO: 592752 - DNA, 20 bp, mouse
gcttccgagactacagagtt

SEQ ID NO: 592753 - DNA, 20 bp, mouse
ggcaatgtcggacctccggg

SEQ ID NO: 592754 - DNA, 20 bp, mouse
gggagcaggaaggacgttcg

SEQ ID NO: 592755 - DNA, 20 bp, mouse
ggggccctgaggcctcccgg

SEQ ID NO: 592756 - DNA, 20 bp, mouse
gagggttgcctaggatagac

SEQ ID NO: 592757 - DNA, 20 bp, mouse
ggggatgagcccttagatga

SEQ ID NO: 592758 - DNA, 20 bp, mouse
gctaggcaaccctcatctaa

SEQ ID NO: 592759 - DNA, 20 bp, mouse
gggtcgagtggagaatggct

SEQ ID NO: 592760 - DNA, 20 bp, mouse
gcagagaaatccctggacaa

SEQ ID NO: 592761 - DNA, 20 bp, mouse
gacttcgcaagcaattcaga

SEQ ID NO: 592762 - DNA, 20 bp, mouse
gcagtcggtcgagtggagaa

SEQ ID NO: 592763 - DNA, 20 bp, mouse
gctcatgcaagaagcggaat

SEQ ID NO: 592764 - DNA, 20 bp, mouse
ggagaggtgccgcagtgtta

SEQ ID NO: 592765 - DNA, 20 bp, mouse
gagcatcacagtcggtcgag

SEQ ID NO: 592766 - DNA, 20 bp, mouse
ggagttgctaaaggaagtgt

SEQ ID NO: 592767 - DNA, 20 bp, mouse
gtcgtcgcgtgcaggaggtc

SEQ ID NO: 592768 - DNA, 20 bp, mouse
gagcgggtgagagttgctaa

SEQ ID NO: 592769 - DNA, 20 bp, mouse
gagcaactctcacccgctca

SEQ ID NO: 592770 - DNA, 20 bp, mouse
gcagaggcttgcattgaggg

SEQ ID NO: 592771 - DNA, 20 bp, mouse
gttgagggaggaaagaaacc

SEQ ID NO: 592772 - DNA, 20 bp, mouse
gtcttctgctccaggccctt

SEQ ID NO: 592773 - DNA, 20 bp, mouse
gagcgctcccttaaagggaa

SEQ ID NO: 592774 - DNA, 20 bp, mouse
gatcctggtcaggggtgtgg

SEQ ID NO: 592775 - DNA, 20 bp, mouse
gaaccgtcgtcgcgtgcagg

SEQ ID NO: 592776 - DNA, 20 bp, mouse
gaggctcaactcccactcaa

SEQ ID NO: 592777 - DNA, 20 bp, mouse
ggcgcagactgccagcaatg

SEQ ID NO: 592778 - DNA, 20 bp, mouse
ggcagtctgcgcaggcctcc

SEQ ID NO: 592779 - DNA, 20 bp, mouse
gagcacgccttggtaaacct

SEQ ID NO: 592780 - DNA, 20 bp, mouse
gccactcaacggaagccagg

SEQ ID NO: 592781 - DNA, 20 bp, mouse
ggtgctactcacctcattgc

SEQ ID NO: 592782 - DNA, 20 bp, mouse
gaccaaggcgtgctaggtta

SEQ ID NO: 592783 - DNA, 20 bp, mouse
ggcaggcatcacattgtcta

SEQ ID NO: 592784 - DNA, 20 bp, mouse
gccgtaccagctatgcgcat

SEQ ID NO: 592785 - DNA, 20 bp, mouse
ggccctaacctagcacgcct

SEQ ID NO: 592786 - DNA, 20 bp, mouse
gatagaagggctcaccatcg

SEQ ID NO: 592787 - DNA, 20 bp, mouse
gacagttctggaatgagagg

SEQ ID NO: 592788 - DNA, 20 bp, mouse
gtggacagttctggaatgag

SEQ ID NO: 592789 - DNA, 20 bp, mouse
gtcggggcacgggagtgtcc

SEQ ID NO: 592790 - DNA, 20 bp, mouse
ggggctcaccatcggggcac

SEQ ID NO: 592791 - DNA, 20 bp, mouse
gtaaggcccaaggacctaaa

SEQ ID NO: 592792 - DNA, 20 bp, mouse
ggaagtcggtatccacgtgg

SEQ ID NO: 592793 - DNA, 20 bp, mouse
ggactcactgaccctgaaca

SEQ ID NO: 592794 - DNA, 20 bp, mouse
gtcagggtcagtgagtcgga

SEQ ID NO: 592795 - DNA, 20 bp, mouse
gcactgaccctgaacaggga

SEQ ID NO: 592796 - DNA, 20 bp, mouse
gaaaaggttgcaacacaaga

SEQ ID NO: 592797 - DNA, 20 bp, mouse
gccccaaaaaatctctctta

SEQ ID NO: 592798 - DNA, 20 bp, mouse
gtccttaagagagatttttt

SEQ ID NO: 592799 - DNA, 20 bp, mouse
gacaatccttaccttcatct

SEQ ID NO: 592800 - DNA, 20 bp, mouse
gaaataactgacaacacatt

SEQ ID NO: 592801 - DNA, 20 bp, mouse
gtcaggaaacagaataattt

SEQ ID NO: 592802 - DNA, 20 bp, mouse
gagaccagtattattcattc

SEQ ID NO: 592803 - DNA, 20 bp, mouse
gacttttaaagcaaagaaac

SEQ ID NO: 592804 - DNA, 20 bp, mouse
gactgttggttttataatga

SEQ ID NO: 592805 - DNA, 20 bp, mouse
gacagaataatttagggcag

SEQ ID NO: 592806 - DNA, 20 bp, mouse
gtggagaggaccgtcttcta

SEQ ID NO: 592807 - DNA, 20 bp, mouse
ggtgagaagtccacacatga

SEQ ID NO: 592808 - DNA, 20 bp, mouse
gctttagtctcagcatggag

SEQ ID NO: 592809 - DNA, 20 bp, mouse
gtctaaggctccttcatgtg

SEQ ID NO: 592810 - DNA, 20 bp, mouse
gtcctgtgggtgctaaagag

SEQ ID NO: 592811 - DNA, 20 bp, mouse
gtggtccttaataacatcgc

SEQ ID NO: 592812 - DNA, 20 bp, mouse
ggagcatgcttattcactta

SEQ ID NO: 592813 - DNA, 20 bp, mouse
gcaaagggtgacaactcctg

SEQ ID NO: 592814 - DNA, 20 bp, mouse
gtcactaagcagaaaccctc

SEQ ID NO: 592815 - DNA, 20 bp, mouse
ggtagcgtttctcagtaggt

SEQ ID NO: 592816 - DNA, 20 bp, mouse
gctgctggtgtataagctca

SEQ ID NO: 592817 - DNA, 20 bp, mouse
ggcctctcagtacatgactt

SEQ ID NO: 592818 - DNA, 20 bp, mouse
gtcctcagcaatcccattga

SEQ ID NO: 592819 - DNA, 20 bp, mouse
gtcctaagtcatgtactgag

SEQ ID NO: 592820 - DNA, 20 bp, mouse
gctgaggagtgctcaggtaa

SEQ ID NO: 592821 - DNA, 20 bp, mouse
gcaccagcagcaaccgtcaa

SEQ ID NO: 592822 - DNA, 20 bp, mouse
ggctctgtctacactctgca

SEQ ID NO: 592823 - DNA, 20 bp, mouse
gtcccattgacggttgctgc

SEQ ID NO: 592824 - DNA, 20 bp, mouse
gggcacaccaaactttgtgg

SEQ ID NO: 592825 - DNA, 20 bp, mouse
gaattggaaaggctgataca

SEQ ID NO: 592826 - DNA, 20 bp, mouse
gtcagtctacacagcagctg

SEQ ID NO: 592827 - DNA, 20 bp, mouse
gagcaacgttgacttcagtg

SEQ ID NO: 592828 - DNA, 20 bp, mouse
gccatagtataactaaaagg

SEQ ID NO: 592829 - DNA, 20 bp, mouse
gcctgctacacaagctctca

SEQ ID NO: 592830 - DNA, 20 bp, mouse
gactgtagaggattgagtgc

SEQ ID NO: 592831 - DNA, 20 bp, mouse
gtagaggaatcaggagctga

SEQ ID NO: 592832 - DNA, 20 bp, mouse
gagcccatagtataactaaa

SEQ ID NO: 592833 - DNA, 20 bp, mouse
gtggctttcagcagcaaatc

SEQ ID NO: 592834 - DNA, 20 bp, mouse
gagttccatcaggtttgttt

SEQ ID NO: 592835 - DNA, 20 bp, mouse
gcttttgtaagtatagcaca

SEQ ID NO: 592836 - DNA, 20 bp, mouse
gcaggcttctacaacaagtg

SEQ ID NO: 592837 - DNA, 20 bp, mouse
gaagcatcttacctgaactc

SEQ ID NO: 592838 - DNA, 20 bp, mouse
gcaatacagagggaatatat

SEQ ID NO: 592839 - DNA, 20 bp, mouse
gaaagtgggactttcagatc

SEQ ID NO: 592840 - DNA, 20 bp, mouse
gtacctggtagaagatggta

SEQ ID NO: 592841 - DNA, 20 bp, mouse
gatgttaaggaggtaaccca

SEQ ID NO: 592842 - DNA, 20 bp, mouse
gggactttcagatcaggtgc

SEQ ID NO: 592843 - DNA, 20 bp, mouse
gctattacttgctataattt

SEQ ID NO: 592844 - DNA, 20 bp, mouse
ggctgggatcagtgaaccat

SEQ ID NO: 592845 - DNA, 20 bp, mouse
gatctatctcctgaaggggt

SEQ ID NO: 592846 - DNA, 20 bp, mouse
ggaattgggcaccctggcaa

SEQ ID NO: 592847 - DNA, 20 bp, mouse
ggcaagtcaagagagctggt

SEQ ID NO: 592848 - DNA, 20 bp, mouse
gtggcagtctgcagggaatt

SEQ ID NO: 592849 - DNA, 20 bp, mouse
gcacagacagggcagattag

SEQ ID NO: 592850 - DNA, 20 bp, mouse
gagagctggtgggcacagac

SEQ ID NO: 592851 - DNA, 20 bp, mouse
gaaagccaaatcctacctgg

SEQ ID NO: 592852 - DNA, 20 bp, mouse
gactgttcacaacttctgtg

SEQ ID NO: 592853 - DNA, 20 bp, mouse
gcctttcagaatgttcgcaa

SEQ ID NO: 592854 - DNA, 20 bp, mouse
gacagagcacagtctgaaac

SEQ ID NO: 592855 - DNA, 20 bp, mouse
gagctaacaagggaagccat

SEQ ID NO: 592856 - DNA, 20 bp, mouse
gcctgaccgggccaaggtgg

SEQ ID NO: 592857 - DNA, 20 bp, mouse
gcggcggtagccgggctatg

SEQ ID NO: 592858 - DNA, 20 bp, mouse
gggctatggggagcgagacg

SEQ ID NO: 592859 - DNA, 20 bp, mouse
gccaagcccggagcacgcca

SEQ ID NO: 592860 - DNA, 20 bp, mouse
gtcccctgaccgggccaagg

SEQ ID NO: 592861 - DNA, 20 bp, mouse
gcgtctggctgggaccgagg

SEQ ID NO: 592862 - DNA, 20 bp, mouse
ggtcaggttctgcgggactt

SEQ ID NO: 592863 - DNA, 20 bp, mouse
gtggcaccggggacagagaa

SEQ ID NO: 592864 - DNA, 20 bp, mouse
gggcaggagggcggcagagt

SEQ ID NO: 592865 - DNA, 20 bp, mouse
gccggagcacgccagggcag

SEQ ID NO: 592866 - DNA, 20 bp, mouse
gggccaccgtgagcaacgct

SEQ ID NO: 592867 - DNA, 20 bp, mouse
gatcaccaggccagttcctg

SEQ ID NO: 592868 - DNA, 20 bp, mouse
gcacccagcgttgctcacgg

SEQ ID NO: 592869 - DNA, 20 bp, mouse
gctccacccagcgttgctca

SEQ ID NO: 592870 - DNA, 20 bp, mouse
gcgctgaggaagagaagccc

SEQ ID NO: 592871 - DNA, 20 bp, mouse
gctctcttgctgaaacgctg

SEQ ID NO: 592872 - DNA, 20 bp, mouse
gcgttgctcacggtggccct

SEQ ID NO: 592873 - DNA, 20 bp, mouse
gtccaagaagaggtgtaaca

SEQ ID NO: 592874 - DNA, 20 bp, mouse
gatgtccctgcctcaggaac

SEQ ID NO: 592875 - DNA, 20 bp, mouse
gctggatcaggctgatcacc

SEQ ID NO: 592876 - DNA, 20 bp, mouse
gtgtcccaaccagagatcag

SEQ ID NO: 592877 - DNA, 20 bp, mouse
gcagcagggaccatcaaggt

SEQ ID NO: 592878 - DNA, 20 bp, mouse
gaaacagacactgcaagggt

SEQ ID NO: 592879 - DNA, 20 bp, mouse
gtgagcctgccagtggacaa

SEQ ID NO: 592880 - DNA, 20 bp, mouse
gctccagccacaggaaaggg

SEQ ID NO: 592881 - DNA, 20 bp, mouse
gtggtccctgctgctctctc

SEQ ID NO: 592882 - DNA, 20 bp, mouse
gccaggaccaggagttgcaa

SEQ ID NO: 592883 - DNA, 20 bp, mouse
gattcctctgatctctggtt

SEQ ID NO: 592884 - DNA, 20 bp, mouse
ggtaagtctgggggacggaa

SEQ ID NO: 592885 - DNA, 20 bp, mouse
gtctgaggtccacagaccag

SEQ ID NO: 592886 - DNA, 20 bp, mouse
ggcaagtagaagctcaccta

SEQ ID NO: 592887 - DNA, 20 bp, mouse
gctcacctaaggcaagtgag

SEQ ID NO: 592888 - DNA, 20 bp, mouse
gctacttgcagcctcactct

SEQ ID NO: 592889 - DNA, 20 bp, mouse
gagcgccactcacttgcctt

SEQ ID NO: 592890 - DNA, 20 bp, mouse
gggcaagtgagtggcgcttt

SEQ ID NO: 592891 - DNA, 20 bp, mouse
gaggctgaggtggaagcttc

SEQ ID NO: 592892 - DNA, 20 bp, mouse
ggggttgttggaagctcaga

SEQ ID NO: 592893 - DNA, 20 bp, mouse
gtctgaagtcacctaagtga

SEQ ID NO: 592894 - DNA, 20 bp, mouse
gtaacctagccaggtcacct

SEQ ID NO: 592895 - DNA, 20 bp, mouse
gcaaccagacaacaggtctg

SEQ ID NO: 592896 - DNA, 20 bp, mouse
gtctagccgcggcaggacgg

SEQ ID NO: 592897 - DNA, 20 bp, mouse
gccgcggctagagaggttga

SEQ ID NO: 592898 - DNA, 20 bp, mouse
gtgctggcgcagggtacggt

SEQ ID NO: 592899 - DNA, 20 bp, mouse
ggcaacggccacgacacccg

SEQ ID NO: 592900 - DNA, 20 bp, mouse
gaggaagggagctagcgcgg

SEQ ID NO: 592901 - DNA, 20 bp, mouse
ggggacagtacgcagcctcg

SEQ ID NO: 592902 - DNA, 20 bp, mouse
ggcacccggactcaccaggt

SEQ ID NO: 592903 - DNA, 20 bp, mouse
gccggagcggcgagctgcag

SEQ ID NO: 592904 - DNA, 20 bp, mouse
gcggcaagcccgagaagcgc

SEQ ID NO: 592905 - DNA, 20 bp, mouse
gttgatgctggcgcagggta

SEQ ID NO: 592906 - DNA, 20 bp, mouse
ggcgcggcagccgggttcgt

SEQ ID NO: 592907 - DNA, 20 bp, mouse
gggcagccgggttcgtggga

SEQ ID NO: 592908 - DNA, 20 bp, mouse
ggcgcgtagtccagagcgca

SEQ ID NO: 592909 - DNA, 20 bp, mouse
gggagtctggcatacctagg

SEQ ID NO: 592910 - DNA, 20 bp, mouse
gctagagcgagagggaagat

SEQ ID NO: 592911 - DNA, 20 bp, mouse
ggaggtctcggaccaggatg

SEQ ID NO: 592912 - DNA, 20 bp, mouse
gaccaatgcggggacagagt

SEQ ID NO: 592913 - DNA, 20 bp, mouse
gcgatgaatgaagcgggagt

SEQ ID NO: 592914 - DNA, 20 bp, mouse
gcgtgggaaggtgagtgctc

SEQ ID NO: 592915 - DNA, 20 bp, mouse
gactcaccttcccacgaacc

SEQ ID NO: 592916 - DNA, 20 bp, mouse
gtgaccatgcagggctccaa

SEQ ID NO: 592917 - DNA, 20 bp, mouse
gtccaaaggaatagagaacc

SEQ ID NO: 592918 - DNA, 20 bp, mouse
gggagggcgaagcagacgca

SEQ ID NO: 592919 - DNA, 20 bp, mouse
gacagcagagacctccacct

SEQ ID NO: 592920 - DNA, 20 bp, mouse
gcgcacggcgtggggtgcct

SEQ ID NO: 592921 - DNA, 20 bp, mouse
ggctggaagggacgaaagcc

SEQ ID NO: 592922 - DNA, 20 bp, mouse
gcgaagcagacgcacggcgt

SEQ ID NO: 592923 - DNA, 20 bp, mouse
ggccgggttctctattcctt

SEQ ID NO: 592924 - DNA, 20 bp, mouse
ggcagagacctccacctggg

SEQ ID NO: 592925 - DNA, 20 bp, mouse
gtcgcagcctcgggaatctg

SEQ ID NO: 592926 - DNA, 20 bp, mouse
gggagctgaaccgtgcagga

SEQ ID NO: 592927 - DNA, 20 bp, mouse
ggtggaccccagagggaccg

SEQ ID NO: 592928 - DNA, 20 bp, mouse
ggtaacctcgtggaccccag

SEQ ID NO: 592929 - DNA, 20 bp, mouse
gctcattgttccgggacttg

SEQ ID NO: 592930 - DNA, 20 bp, mouse
gtagcacctcggtccctctg

SEQ ID NO: 592931 - DNA, 20 bp, mouse
gagcgacctgggcccagtgt

SEQ ID NO: 592932 - DNA, 20 bp, mouse
gagggaccgaggtgctagcc

SEQ ID NO: 592933 - DNA, 20 bp, mouse
ggtgtcacaagccttgcggt

SEQ ID NO: 592934 - DNA, 20 bp, mouse
gacccctggagccacaaagt

SEQ ID NO: 592935 - DNA, 20 bp, mouse
gcaatgagcgagagtcttgg

SEQ ID NO: 592936 - DNA, 20 bp, mouse
ggccccggtggacaatactg

SEQ ID NO: 592937 - DNA, 20 bp, mouse
gcctccagtggacatcactg

SEQ ID NO: 592938 - DNA, 20 bp, mouse
ggaagtaacgttccctgcaa

SEQ ID NO: 592939 - DNA, 20 bp, mouse
gatcactggggaggctccgg

SEQ ID NO: 592940 - DNA, 20 bp, mouse
gaatactgtggagcctccag

SEQ ID NO: 592941 - DNA, 20 bp, mouse
gaagccgaacggcccctcca

SEQ ID NO: 592942 - DNA, 20 bp, mouse
gtgccactctaacctttgca

SEQ ID NO: 592943 - DNA, 20 bp, mouse
gggaacgttacttctagtga

SEQ ID NO: 592944 - DNA, 20 bp, mouse
gccagtggacatcactgggg

SEQ ID NO: 592945 - DNA, 20 bp, mouse
gagacttgcaatatgtaaca

SEQ ID NO: 592946 - DNA, 20 bp, mouse
gtagagtggcagctctctta

SEQ ID NO: 592947 - DNA, 20 bp, mouse
gctgtgtactccctggtctc

SEQ ID NO: 592948 - DNA, 20 bp, mouse
gtgttagtcacctgagacca

SEQ ID NO: 592949 - DNA, 20 bp, mouse
gacactgcaggtatgttttg

SEQ ID NO: 592950 - DNA, 20 bp, mouse
gcttatctgaagcagctctg

SEQ ID NO: 592951 - DNA, 20 bp, mouse
gacaacagttcggcacttgt

SEQ ID NO: 592952 - DNA, 20 bp, mouse
gaaaccaagtggcccctcct

SEQ ID NO: 592953 - DNA, 20 bp, mouse
gatgaggctgacgcactgtg

SEQ ID NO: 592954 - DNA, 20 bp, mouse
gaggctgacgcactgtgggg

SEQ ID NO: 592955 - DNA, 20 bp, mouse
gcatcattctgtagggacgt

SEQ ID NO: 592956 - DNA, 20 bp, mouse
gctcggctcagggattgcac

SEQ ID NO: 592957 - DNA, 20 bp, mouse
ggcagtgacattactcacct

SEQ ID NO: 592958 - DNA, 20 bp, mouse
ggttccctgtagagttctag

SEQ ID NO: 592959 - DNA, 20 bp, mouse
gcattactcacctcggctca

SEQ ID NO: 592960 - DNA, 20 bp, mouse
gatactgtaggagtgttttg

SEQ ID NO: 592961 - DNA, 20 bp, mouse
gtggaggagcagggttgctc

SEQ ID NO: 592962 - DNA, 20 bp, mouse
gcatgaggctgtcacactgt

SEQ ID NO: 592963 - DNA, 20 bp, mouse
ggtcgtggctcatagtaagt

SEQ ID NO: 592964 - DNA, 20 bp, mouse
gtgcagttggaagtgttacc

SEQ ID NO: 592965 - DNA, 20 bp, mouse
gcgagagagcccaaaccata

SEQ ID NO: 592966 - DNA, 20 bp, mouse
gggatgagctacagtgcctg

SEQ ID NO: 592967 - DNA, 20 bp, mouse
ggaaacagtgcaatccacta

SEQ ID NO: 592968 - DNA, 20 bp, mouse
gcagtgcaatccactaaggt

SEQ ID NO: 592969 - DNA, 20 bp, mouse
gtctcagcacttggatttga

SEQ ID NO: 592970 - DNA, 20 bp, mouse
ggtaagtgagccatcctcca

SEQ ID NO: 592971 - DNA, 20 bp, mouse
gagagaggttgcgacagagg

SEQ ID NO: 592972 - DNA, 20 bp, mouse
gttgcgggccagaggaagta

SEQ ID NO: 592973 - DNA, 20 bp, mouse
gcagtgcctgtggttgctct

SEQ ID NO: 592974 - DNA, 20 bp, mouse
gcgggctgtgggatgatgtg

SEQ ID NO: 592975 - DNA, 20 bp, mouse
ggacagagaggttgcgacag

SEQ ID NO: 592976 - DNA, 20 bp, mouse
gagggagccaagggatgggt

SEQ ID NO: 592977 - DNA, 20 bp, mouse
gccagatgagctcaagcacc

SEQ ID NO: 592978 - DNA, 20 bp, mouse
ggaacactgttgtctcatag

SEQ ID NO: 592979 - DNA, 20 bp, mouse
gtcaagttggagagtatgaa

SEQ ID NO: 592980 - DNA, 20 bp, mouse
gagtcactggagggagccaa

SEQ ID NO: 592981 - DNA, 20 bp, mouse
gagcacagtgtatggtctca

SEQ ID NO: 592982 - DNA, 20 bp, mouse
gccttcctggtgactttcgt

SEQ ID NO: 592983 - DNA, 20 bp, mouse
gaagatcaccagtcactgga

SEQ ID NO: 592984 - DNA, 20 bp, mouse
gttggaagatcaccagtcac

SEQ ID NO: 592985 - DNA, 20 bp, mouse
gttggagagtatgaagggtt

SEQ ID NO: 592986 - DNA, 20 bp, mouse
gagaggtgaacacacaacca

SEQ ID NO: 592987 - DNA, 20 bp, mouse
gaggaacaaagaactcacat

SEQ ID NO: 592988 - DNA, 20 bp, mouse
gagaactcacatgggcttag

SEQ ID NO: 592989 - DNA, 20 bp, mouse
gagagttctaactgcagccc

SEQ ID NO: 592990 - DNA, 20 bp, mouse
gtccaagtgccaaagcccac

SEQ ID NO: 592991 - DNA, 20 bp, mouse
gactagactgtacccagggt

SEQ ID NO: 592992 - DNA, 20 bp, mouse
gtgtcttcgccggtgggctt

SEQ ID NO: 592993 - DNA, 20 bp, mouse
gagcagatgtcttcgccggt

SEQ ID NO: 592994 - DNA, 20 bp, mouse
gttaccaagactgctgacat

SEQ ID NO: 592995 - DNA, 20 bp, mouse
gggccagcagatgtcttcgc

SEQ ID NO: 592996 - DNA, 20 bp, mouse
gggcgcgccaaaaatgcctg

SEQ ID NO: 592997 - DNA, 20 bp, mouse
gggatgacagaacttcctgg

SEQ ID NO: 592998 - DNA, 20 bp, mouse
gccagccaggcgatacagaa

SEQ ID NO: 592999 - DNA, 20 bp, mouse
gagggagggtgactaattac

SEQ ID NO: 593000 - DNA, 20 bp, mouse
gccgaggccccaggcatttt

SEQ ID NO: 593001 - DNA, 20 bp, mouse
gaattagtcaccctccctga

SEQ ID NO: 593002 - DNA, 20 bp, mouse
gatgaactagaaagttggtt

SEQ ID NO: 593003 - DNA, 20 bp, mouse
ggacagaacttcctggggga

SEQ ID NO: 593004 - DNA, 20 bp, mouse
ggggtgactaattacaggag

SEQ ID NO: 593005 - DNA, 20 bp, mouse
ggagtcccttctgtatcgcc

SEQ ID NO: 593006 - DNA, 20 bp, mouse
ggctgcgagcattcatacag

SEQ ID NO: 593007 - DNA, 20 bp, mouse
ggggagagcaactgattctg

SEQ ID NO: 593008 - DNA, 20 bp, mouse
gatcagagctcaaccgcgga

SEQ ID NO: 593009 - DNA, 20 bp, mouse
gaatgctcgctgaggtaaaa

SEQ ID NO: 593010 - DNA, 20 bp, mouse
ggcctttcccttgcccagag

SEQ ID NO: 593011 - DNA, 20 bp, mouse
gacagcggctgtatcttgct

SEQ ID NO: 593012 - DNA, 20 bp, mouse
ggctttatgaatgctcgctg

SEQ ID NO: 593013 - DNA, 20 bp, mouse
gccagagccagtaagtagac

SEQ ID NO: 593014 - DNA, 20 bp, mouse
gatcagttgctctccctccg

SEQ ID NO: 593015 - DNA, 20 bp, mouse
gccctcctccatctcaaagt

SEQ ID NO: 593016 - DNA, 20 bp, mouse
gtgatgtcctgggtccagag

SEQ ID NO: 593017 - DNA, 20 bp, mouse
gagggtagaggtctccactc

SEQ ID NO: 593018 - DNA, 20 bp, mouse
ggctctgattccaggagacg

SEQ ID NO: 593019 - DNA, 20 bp, mouse
gttaaggacaagagcacaca

SEQ ID NO: 593020 - DNA, 20 bp, mouse
gcgcagggcgccccgtctcc

SEQ ID NO: 593021 - DNA, 20 bp, mouse
gacaagagcacacagggtag

SEQ ID NO: 593022 - DNA, 20 bp, mouse
gctgtcctccgcagcccgca

SEQ ID NO: 593023 - DNA, 20 bp, mouse
gaggagagggacctatctcg

SEQ ID NO: 593024 - DNA, 20 bp, mouse
gtggggcccataggcttagg

SEQ ID NO: 593025 - DNA, 20 bp, mouse
gaaggtggccgagtgaggag

SEQ ID NO: 593026 - DNA, 20 bp, mouse
gagcagtggtaacagcgaac

SEQ ID NO: 593027 - DNA, 20 bp, mouse
gccaaactcacagtagaacc

SEQ ID NO: 593028 - DNA, 20 bp, mouse
gctgtgagtttggctagcag

SEQ ID NO: 593029 - DNA, 20 bp, mouse
gcctcactcaccacttccag

SEQ ID NO: 593030 - DNA, 20 bp, mouse
gcaggtgactagtccacaag

SEQ ID NO: 593031 - DNA, 20 bp, mouse
ggggatcaagagaactccac

SEQ ID NO: 593032 - DNA, 20 bp, mouse
gtgggaggcccggctccaga

SEQ ID NO: 593033 - DNA, 20 bp, mouse
gaagagaactccactggaag

SEQ ID NO: 593034 - DNA, 20 bp, mouse
gccgggtagtgttccacttg

SEQ ID NO: 593035 - DNA, 20 bp, mouse
gcgggcctcccatctttccc

SEQ ID NO: 593036 - DNA, 20 bp, mouse
ggcagccccgggtctagcat

SEQ ID NO: 593037 - DNA, 20 bp, mouse
gggctgagttcgggaaggaa

SEQ ID NO: 593038 - DNA, 20 bp, mouse
gtggcccggtgccagaggaa

SEQ ID NO: 593039 - DNA, 20 bp, mouse
gacagagctgcgaccttcaa

SEQ ID NO: 593040 - DNA, 20 bp, mouse
gtcctctgaacctcacagac

SEQ ID NO: 593041 - DNA, 20 bp, mouse
gttctccaggccctttcctc

SEQ ID NO: 593042 - DNA, 20 bp, mouse
gcccgggtctagcatgggtt

SEQ ID NO: 593043 - DNA, 20 bp, mouse
gccggaggctgagttcggga

SEQ ID NO: 593044 - DNA, 20 bp, mouse
ggcatgggtttggctagcag

SEQ ID NO: 593045 - DNA, 20 bp, mouse
gagcagtggtcacagcgaat

SEQ ID NO: 593046 - DNA, 20 bp, mouse
ggctcctccaggggcatagg

SEQ ID NO: 593047 - DNA, 20 bp, mouse
gaaggagttgtgggagctcg

SEQ ID NO: 593048 - DNA, 20 bp, mouse
gacaccgcctatgcccctgg

SEQ ID NO: 593049 - DNA, 20 bp, mouse
gtcctggttcaaggagttgt

SEQ ID NO: 593050 - DNA, 20 bp, mouse
gtccttgaaccaggacactt

SEQ ID NO: 593051 - DNA, 20 bp, mouse
gtgcctgccacccaagttgg

SEQ ID NO: 593052 - DNA, 20 bp, mouse
gccggctaggaggttagtgt

SEQ ID NO: 593053 - DNA, 20 bp, mouse
gtggtgcctgccacccaagt

SEQ ID NO: 593054 - DNA, 20 bp, mouse
gctgacaccgcctatgcccc

SEQ ID NO: 593055 - DNA, 20 bp, mouse
ggctgcagtggggatattca

SEQ ID NO: 593056 - DNA, 20 bp, mouse
gggcagcctccgccataaag

SEQ ID NO: 593057 - DNA, 20 bp, mouse
ggcaataggccgaccagtac

SEQ ID NO: 593058 - DNA, 20 bp, mouse
ggcgcactgcgttccagtac

SEQ ID NO: 593059 - DNA, 20 bp, mouse
gactgcgttccagtactggt

SEQ ID NO: 593060 - DNA, 20 bp, mouse
ggagtgatggagatgaggaa

SEQ ID NO: 593061 - DNA, 20 bp, mouse
gggaggctgccatgttaaaa

SEQ ID NO: 593062 - DNA, 20 bp, mouse
ggtccctgagcaaggcgtaa

SEQ ID NO: 593063 - DNA, 20 bp, mouse
gcgcctgaccatgtagacta

SEQ ID NO: 593064 - DNA, 20 bp, mouse
ggattcattccgttttaaca

SEQ ID NO: 593065 - DNA, 20 bp, mouse
gttccggggtcacgactcca

SEQ ID NO: 593066 - DNA, 20 bp, mouse
gcagtcagttgggagctgga

SEQ ID NO: 593067 - DNA, 20 bp, mouse
gtggagggagagggagacgc

SEQ ID NO: 593068 - DNA, 20 bp, mouse
gctgtgcgtagacccaggaa

SEQ ID NO: 593069 - DNA, 20 bp, mouse
gctcctcacagcagtcagtt

SEQ ID NO: 593070 - DNA, 20 bp, mouse
gctgctgtgaggaggaaaat

SEQ ID NO: 593071 - DNA, 20 bp, mouse
gcccggacggggatggtcag

SEQ ID NO: 593072 - DNA, 20 bp, mouse
gggaaaggcgtcttaagcgg

SEQ ID NO: 593073 - DNA, 20 bp, mouse
gccaggaaaggcgtcttaag

SEQ ID NO: 593074 - DNA, 20 bp, mouse
gctcccaactgactgctgtg

SEQ ID NO: 593075 - DNA, 20 bp, mouse
gcagcagccacagctccggt

SEQ ID NO: 593076 - DNA, 20 bp, mouse
gctgtggctgccgcagacgg

SEQ ID NO: 593077 - DNA, 20 bp, mouse
gggcccacaggcgactccag

SEQ ID NO: 593078 - DNA, 20 bp, mouse
ggagctgccgagctttcctg

SEQ ID NO: 593079 - DNA, 20 bp, mouse
gtgaggctgcgggagtactg

SEQ ID NO: 593080 - DNA, 20 bp, mouse
gcagcagccaggcgagactt

SEQ ID NO: 593081 - DNA, 20 bp, mouse
gacttgggcttatttattta

SEQ ID NO: 593082 - DNA, 20 bp, mouse
gcagcgcccagcagccagag

SEQ ID NO: 593083 - DNA, 20 bp, mouse
gccggcggccgctttaactt

SEQ ID NO: 593084 - DNA, 20 bp, mouse
ggagtcgcctgtgggccccc

SEQ ID NO: 593085 - DNA, 20 bp, mouse
gttttttaaaccaccgtctg

SEQ ID NO: 593086 - DNA, 20 bp, mouse
ggctgggctgcggagcacag

SEQ ID NO: 593087 - DNA, 20 bp, mouse
ggctggggcacggagtggtc

SEQ ID NO: 593088 - DNA, 20 bp, mouse
gagtggtccggagagctagc

SEQ ID NO: 593089 - DNA, 20 bp, mouse
ggcgacccagagggacccga

SEQ ID NO: 593090 - DNA, 20 bp, mouse
gggcagcagctccatccgtg

SEQ ID NO: 593091 - DNA, 20 bp, mouse
gaagcgcccgcacccagagg

SEQ ID NO: 593092 - DNA, 20 bp, mouse
ggtctaccctgctcagtgaa

SEQ ID NO: 593093 - DNA, 20 bp, mouse
gccccgggaagtccggctca

SEQ ID NO: 593094 - DNA, 20 bp, mouse
gcaccgtgccccgggaagtc

SEQ ID NO: 593095 - DNA, 20 bp, mouse
ggaatggagaaagcgagcgc

SEQ ID NO: 593096 - DNA, 20 bp, mouse
ggcactggacagcacctcgg

SEQ ID NO: 593097 - DNA, 20 bp, mouse
gggccggagcacagaaaaaa

SEQ ID NO: 593098 - DNA, 20 bp, mouse
ggggctgaagacgaccaaag

SEQ ID NO: 593099 - DNA, 20 bp, mouse
gagagctagtaagcgccggc

SEQ ID NO: 593100 - DNA, 20 bp, mouse
gtacaaagcagggctttcgg

SEQ ID NO: 593101 - DNA, 20 bp, mouse
gtccgacgcacagccatcac

SEQ ID NO: 593102 - DNA, 20 bp, mouse
gggcgtgatttcagcaccgg

SEQ ID NO: 593103 - DNA, 20 bp, mouse
ggcacctcgggggtacttct

SEQ ID NO: 593104 - DNA, 20 bp, mouse
gggagcgagttgtctgaggg

SEQ ID NO: 593105 - DNA, 20 bp, mouse
gctctttcggaattacgtga

SEQ ID NO: 593106 - DNA, 20 bp, mouse
ggcgcgcgctttcaatccag

SEQ ID NO: 593107 - DNA, 20 bp, mouse
gcggactgggtcactgcggg

SEQ ID NO: 593108 - DNA, 20 bp, mouse
gaccagggatgcgattacat

SEQ ID NO: 593109 - DNA, 20 bp, mouse
gctttcggactgggtcactg

SEQ ID NO: 593110 - DNA, 20 bp, mouse
ggctgcgctgtggggaacca

SEQ ID NO: 593111 - DNA, 20 bp, mouse
gaagatgccgcttgcagtgg

SEQ ID NO: 593112 - DNA, 20 bp, mouse
gctggtggactgaagaggag

SEQ ID NO: 593113 - DNA, 20 bp, mouse
ggcgcgcccaggcgccgctg

SEQ ID NO: 593114 - DNA, 20 bp, mouse
ggggatgcgattacataggg

SEQ ID NO: 593115 - DNA, 20 bp, mouse
gctggcggccagagaggaag

SEQ ID NO: 593116 - DNA, 20 bp, mouse
gcgcccgactggtacctagg

SEQ ID NO: 593117 - DNA, 20 bp, mouse
gcagcatccgcgtctctgag

SEQ ID NO: 593118 - DNA, 20 bp, mouse
gatgctgcgggagcctccag

SEQ ID NO: 593119 - DNA, 20 bp, mouse
gcacctcctaggtaccagtc

SEQ ID NO: 593120 - DNA, 20 bp, mouse
ggcccgcccgactggtacct

SEQ ID NO: 593121 - DNA, 20 bp, mouse
ggagccccgagggtaccgag

SEQ ID NO: 593122 - DNA, 20 bp, mouse
gagcctccaggggaagatcg

SEQ ID NO: 593123 - DNA, 20 bp, mouse
ggggagagggcgattcacaa

SEQ ID NO: 593124 - DNA, 20 bp, mouse
gtctgagcctctcagagacg

SEQ ID NO: 593125 - DNA, 20 bp, mouse
gctccaggggaagatcgagg

SEQ ID NO: 593126 - DNA, 20 bp, mouse
gatgcgcggcgagaggactg

SEQ ID NO: 593127 - DNA, 20 bp, mouse
gcgcggcgagaggactgcgg

SEQ ID NO: 593128 - DNA, 20 bp, mouse
gcacagttggcgcggaggag

SEQ ID NO: 593129 - DNA, 20 bp, mouse
ggccaaggagacgctcccgg

SEQ ID NO: 593130 - DNA, 20 bp, mouse
gaactgggagcgccaggtca

SEQ ID NO: 593131 - DNA, 20 bp, mouse
ggccagaggacagggagcgg

SEQ ID NO: 593132 - DNA, 20 bp, mouse
gcgccaggtcagggactaga

SEQ ID NO: 593133 - DNA, 20 bp, mouse
gcctctggctgaagaagtga

SEQ ID NO: 593134 - DNA, 20 bp, mouse
gcctggcgctcccagtttag

SEQ ID NO: 593135 - DNA, 20 bp, mouse
gtggcggaggctccagcgat

SEQ ID NO: 593136 - DNA, 20 bp, mouse
gctgctaaaggctgttctgt

SEQ ID NO: 593137 - DNA, 20 bp, mouse
gtgtgggcttgaccagcgag

SEQ ID NO: 593138 - DNA, 20 bp, mouse
gctgcgcgagctgcaaggaa

SEQ ID NO: 593139 - DNA, 20 bp, mouse
gccgcttgcttgcctgctaa

SEQ ID NO: 593140 - DNA, 20 bp, mouse
gcgagcgggagccaagaagc

SEQ ID NO: 593141 - DNA, 20 bp, mouse
gtccaggacagaaagaatcc

SEQ ID NO: 593142 - DNA, 20 bp, mouse
gtctggagccccaagtcctg

SEQ ID NO: 593143 - DNA, 20 bp, mouse
gaaagcagtgggccctccac

SEQ ID NO: 593144 - DNA, 20 bp, mouse
ggagccccaagtcctgtgga

SEQ ID NO: 593145 - DNA, 20 bp, mouse
gcggaaactgaggagcgagt

SEQ ID NO: 593146 - DNA, 20 bp, mouse
ggcagcttggctcgcaccag

SEQ ID NO: 593147 - DNA, 20 bp, mouse
gcctttgaggggtccaaggg

SEQ ID NO: 593148 - DNA, 20 bp, mouse
gagctgccaggacatgccac

SEQ ID NO: 593149 - DNA, 20 bp, mouse
gctatgcctgtggcatgtcc

SEQ ID NO: 593150 - DNA, 20 bp, mouse
gcagcagacatgatggcccg

SEQ ID NO: 593151 - DNA, 20 bp, mouse
ggaaggcagtcacatctgct

SEQ ID NO: 593152 - DNA, 20 bp, mouse
ggagcccagtggccggtagg

SEQ ID NO: 593153 - DNA, 20 bp, mouse
ggggcgaagcaggagcccag

SEQ ID NO: 593154 - DNA, 20 bp, mouse
gcgtgcgacactgactaggg

SEQ ID NO: 593155 - DNA, 20 bp, mouse
gctgctgggtagcgggtgca

SEQ ID NO: 593156 - DNA, 20 bp, mouse
gacgctttgcggagacccgg

SEQ ID NO: 593157 - DNA, 20 bp, mouse
gaaagactcgaccgagagga

SEQ ID NO: 593158 - DNA, 20 bp, mouse
gagcaagagtgaacaccccc

SEQ ID NO: 593159 - DNA, 20 bp, mouse
gctagaaagactcgaccgag

SEQ ID NO: 593160 - DNA, 20 bp, mouse
gttgcaggcagaacacacac

SEQ ID NO: 593161 - DNA, 20 bp, mouse
gaagacgctttgcggagacc

SEQ ID NO: 593162 - DNA, 20 bp, mouse
ggtgatcagcagcttgtcaa

SEQ ID NO: 593163 - DNA, 20 bp, mouse
ggaagtgtccaaagtcaatc

SEQ ID NO: 593164 - DNA, 20 bp, mouse
gtgctgtgaatattaattgg

SEQ ID NO: 593165 - DNA, 20 bp, mouse
ggtatgctgtgaatattaat

SEQ ID NO: 593166 - DNA, 20 bp, mouse
gctgcgggccgaggctgtgt

SEQ ID NO: 593167 - DNA, 20 bp, mouse
ggccgaggctgtgtgggctg

SEQ ID NO: 593168 - DNA, 20 bp, mouse
ggcggcgccccagagccgag

SEQ ID NO: 593169 - DNA, 20 bp, mouse
gtgggctgaggcgacgagcg

SEQ ID NO: 593170 - DNA, 20 bp, mouse
ggcgcgtcccctcggctctg

SEQ ID NO: 593171 - DNA, 20 bp, mouse
ggctcgggcgcgctgcgaga

SEQ ID NO: 593172 - DNA, 20 bp, mouse
ggcgcgcggccgaggagctc

SEQ ID NO: 593173 - DNA, 20 bp, mouse
gcgacacccgcgcgtcccct

SEQ ID NO: 593174 - DNA, 20 bp, mouse
ggcgcgctgcgagacggcgt

SEQ ID NO: 593175 - DNA, 20 bp, mouse
ggggagacgcgcggtgacac

SEQ ID NO: 593176 - DNA, 20 bp, mouse
gctggcaaggtaagctgagg

SEQ ID NO: 593177 - DNA, 20 bp, mouse
ggcaaggtaagctgaggcgg

SEQ ID NO: 593178 - DNA, 20 bp, mouse
gccgtggcggtgcacccggt

SEQ ID NO: 593179 - DNA, 20 bp, mouse
gtcactatggcggccaacgc

SEQ ID NO: 593180 - DNA, 20 bp, mouse
gcagcttaccttgccagcgt

SEQ ID NO: 593181 - DNA, 20 bp, mouse
gagaggtcgcccgaggtcgg

SEQ ID NO: 593182 - DNA, 20 bp, mouse
gcggagccaggacggaacgt

SEQ ID NO: 593183 - DNA, 20 bp, mouse
gaaaagggtgcgcgttcccg

SEQ ID NO: 593184 - DNA, 20 bp, mouse
gccagtgcggcaagctcagg

SEQ ID NO: 593185 - DNA, 20 bp, mouse
gaggagaggtcgcccgaggt

SEQ ID NO: 593186 - DNA, 20 bp, mouse
gggctgcggcgatgaagatc

SEQ ID NO: 593187 - DNA, 20 bp, mouse
gtgttcgggtgagccagcgg

SEQ ID NO: 593188 - DNA, 20 bp, mouse
ggcttgccgccgacacaaac

SEQ ID NO: 593189 - DNA, 20 bp, mouse
gtcgccgcagccgcaggccc

SEQ ID NO: 593190 - DNA, 20 bp, mouse
gggagctcggagcacgtgtt

SEQ ID NO: 593191 - DNA, 20 bp, mouse
gacgtgttcgggtgagccag

SEQ ID NO: 593192 - DNA, 20 bp, mouse
gatgctgcgcggcgccgtgg

SEQ ID NO: 593193 - DNA, 20 bp, mouse
gggccacgtgacggaggagg

SEQ ID NO: 593194 - DNA, 20 bp, mouse
ggcggcaagctgcgtcgtgg

SEQ ID NO: 593195 - DNA, 20 bp, mouse
gacacaaaccggctgaggat

SEQ ID NO: 593196 - DNA, 20 bp, mouse
gtcagtgtccggggacagtg

SEQ ID NO: 593197 - DNA, 20 bp, mouse
gcggtgtgggaggaattccc

SEQ ID NO: 593198 - DNA, 20 bp, mouse
gcggtgtccctcagtgtccg

SEQ ID NO: 593199 - DNA, 20 bp, mouse
gagcggagctcgggactcgg

SEQ ID NO: 593200 - DNA, 20 bp, mouse
gtcagtggcgacggtgtggg

SEQ ID NO: 593201 - DNA, 20 bp, mouse
gacgaccccgacccgagcta

SEQ ID NO: 593202 - DNA, 20 bp, mouse
gacgccaggaagttccccga

SEQ ID NO: 593203 - DNA, 20 bp, mouse
gcacagagcacgaggcccga

SEQ ID NO: 593204 - DNA, 20 bp, mouse
ggtctgtcaggtatcagtca

SEQ ID NO: 593205 - DNA, 20 bp, mouse
ggatccggaagtgactccag

SEQ ID NO: 593206 - DNA, 20 bp, mouse
ggttacctgaagaggagcag

SEQ ID NO: 593207 - DNA, 20 bp, mouse
ggaggagcaggggcacactc

SEQ ID NO: 593208 - DNA, 20 bp, mouse
gccaggagctcagacagccg

SEQ ID NO: 593209 - DNA, 20 bp, mouse
ggggcacactcaggctacca

SEQ ID NO: 593210 - DNA, 20 bp, mouse
gtaggccctgcccagagtcc

SEQ ID NO: 593211 - DNA, 20 bp, mouse
gagacagccggggagacagc

SEQ ID NO: 593212 - DNA, 20 bp, mouse
gaacaggtaatcacaatata

SEQ ID NO: 593213 - DNA, 20 bp, mouse
gccacctccagctgtctccc

SEQ ID NO: 593214 - DNA, 20 bp, mouse
gtagcagagacatagaacat

SEQ ID NO: 593215 - DNA, 20 bp, mouse
ggaagccacagctcgtgtgt

SEQ ID NO: 593216 - DNA, 20 bp, mouse
gtgcctccttccacagtcca

SEQ ID NO: 593217 - DNA, 20 bp, mouse
ggagcaccgtgaaaggtaaa

SEQ ID NO: 593218 - DNA, 20 bp, mouse
gcacggtgctccttgctctg

SEQ ID NO: 593219 - DNA, 20 bp, mouse
gcaccctggactgtggaagg

SEQ ID NO: 593220 - DNA, 20 bp, mouse
gcctggagtatcagaggtgg

SEQ ID NO: 593221 - DNA, 20 bp, mouse
gtgcggccttttacctttca

SEQ ID NO: 593222 - DNA, 20 bp, mouse
ggctctgatgaccagtcccg

SEQ ID NO: 593223 - DNA, 20 bp, mouse
gtctggggatcctggcaccc

SEQ ID NO: 593224 - DNA, 20 bp, mouse
gagacacagatgtcgccctg

SEQ ID NO: 593225 - DNA, 20 bp, mouse
gaacaaacagaaaggctaaa

SEQ ID NO: 593226 - DNA, 20 bp, mouse
gccttccgccggcccagagg

SEQ ID NO: 593227 - DNA, 20 bp, mouse
ggaggcggccgaggctacca

SEQ ID NO: 593228 - DNA, 20 bp, mouse
ggccggggccgtggtagcct

SEQ ID NO: 593229 - DNA, 20 bp, mouse
gcggaagcgtagcacctaaa

SEQ ID NO: 593230 - DNA, 20 bp, mouse
gccgcgcgccgggcacgcac

SEQ ID NO: 593231 - DNA, 20 bp, mouse
gttcccttccgccggcccag

SEQ ID NO: 593232 - DNA, 20 bp, mouse
gcgctgccgaggcagctagt

SEQ ID NO: 593233 - DNA, 20 bp, mouse
gtgcagcccactagctgcct

SEQ ID NO: 593234 - DNA, 20 bp, mouse
ggccgaggctaccacggccc

SEQ ID NO: 593235 - DNA, 20 bp, mouse
gggaaagcaacgcgctgccg

SEQ ID NO: 593236 - DNA, 20 bp, mouse
gcgccagaaacgaagcgact

SEQ ID NO: 593237 - DNA, 20 bp, mouse
gggcgcgactgggtaagttg

SEQ ID NO: 593238 - DNA, 20 bp, mouse
gtcggtccggctgaacgcga

SEQ ID NO: 593239 - DNA, 20 bp, mouse
gtctggcggatggttttgag

SEQ ID NO: 593240 - DNA, 20 bp, mouse
gtgaggagtcagcctcggtc

SEQ ID NO: 593241 - DNA, 20 bp, mouse
gtctctgcgcagccggaaga

SEQ ID NO: 593242 - DNA, 20 bp, mouse
gagtggtctgcggcgcgact

SEQ ID NO: 593243 - DNA, 20 bp, mouse
ggtccggctgaacgcgaggg

SEQ ID NO: 593244 - DNA, 20 bp, mouse
ggtgatgagccgtcgtggaa

SEQ ID NO: 593245 - DNA, 20 bp, mouse
ggtccggcttacagtgacca

SEQ ID NO: 593246 - DNA, 20 bp, mouse
gctccggctctgagagatag

SEQ ID NO: 593247 - DNA, 20 bp, mouse
ggaagacgaagacaaatatg

SEQ ID NO: 593248 - DNA, 20 bp, mouse
ggaaaaggatcataacagtg

SEQ ID NO: 593249 - DNA, 20 bp, mouse
gtctctcagagccggaggtc

SEQ ID NO: 593250 - DNA, 20 bp, mouse
gtagagtcgaaattctgccc

SEQ ID NO: 593251 - DNA, 20 bp, mouse
gggatgacattgacatgcct

SEQ ID NO: 593252 - DNA, 20 bp, mouse
ggtttgattagtgtaattag

SEQ ID NO: 593253 - DNA, 20 bp, mouse
gattaactaagcatacgtgt

SEQ ID NO: 593254 - DNA, 20 bp, mouse
gctggtttttggatcataat

SEQ ID NO: 593255 - DNA, 20 bp, mouse
gttagaggtacttggaaggc

SEQ ID NO: 593256 - DNA, 20 bp, mouse
gcttggagtgaggctctcag

SEQ ID NO: 593257 - DNA, 20 bp, mouse
gcagccacatggcccagcga

SEQ ID NO: 593258 - DNA, 20 bp, mouse
gcagcctggagcatgggcta

SEQ ID NO: 593259 - DNA, 20 bp, mouse
gtcttggcagcctggagcat

SEQ ID NO: 593260 - DNA, 20 bp, mouse
ggacccaggaagcttaccaa

SEQ ID NO: 593261 - DNA, 20 bp, mouse
gagggacccctggagcgagg

SEQ ID NO: 593262 - DNA, 20 bp, mouse
ggacccttcgctgggccatg

SEQ ID NO: 593263 - DNA, 20 bp, mouse
gggaaggcctcacctagcaa

SEQ ID NO: 593264 - DNA, 20 bp, mouse
ggtctcggaagactctcagg

SEQ ID NO: 593265 - DNA, 20 bp, mouse
ggtccctattggagccaggt

SEQ ID NO: 593266 - DNA, 20 bp, mouse
gagccaggactgcaaaacct

SEQ ID NO: 593267 - DNA, 20 bp, mouse
gggacctcggacctcggaaa

SEQ ID NO: 593268 - DNA, 20 bp, mouse
gcgtaggaggcgggccgcta

SEQ ID NO: 593269 - DNA, 20 bp, mouse
ggaatggtcctgcaaactcc

SEQ ID NO: 593270 - DNA, 20 bp, mouse
gtggtcggaaggctccgcgt

SEQ ID NO: 593271 - DNA, 20 bp, mouse
ggctctactgccagaaccct

SEQ ID NO: 593272 - DNA, 20 bp, mouse
gtcggacctcggaaagggct

SEQ ID NO: 593273 - DNA, 20 bp, mouse
ggcgcagcaagtcgctctgc

SEQ ID NO: 593274 - DNA, 20 bp, mouse
ggtcgctctgccggctttcc

SEQ ID NO: 593275 - DNA, 20 bp, mouse
ggccagaaccctcggcatcg

SEQ ID NO: 593276 - DNA, 20 bp, mouse
gagctgcaccgggtagacgg

SEQ ID NO: 593277 - DNA, 20 bp, mouse
ggttctccgttaagaaggtg

SEQ ID NO: 593278 - DNA, 20 bp, mouse
gctgaagcgcgggaggtagg

SEQ ID NO: 593279 - DNA, 20 bp, mouse
gggtaggaggagctcggcat

SEQ ID NO: 593280 - DNA, 20 bp, mouse
gccccgcaccgggacactct

SEQ ID NO: 593281 - DNA, 20 bp, mouse
gcggctgaagcgcgggaggt

SEQ ID NO: 593282 - DNA, 20 bp, mouse
gttcagccgcaccttcttaa

SEQ ID NO: 593283 - DNA, 20 bp, mouse
ggaaggtgcggctgaagcgc

SEQ ID NO: 593284 - DNA, 20 bp, mouse
ggcctgccgggagggaggta

SEQ ID NO: 593285 - DNA, 20 bp, mouse
gtcccggtgcgggggagtag

SEQ ID NO: 593286 - DNA, 20 bp, mouse
gtactgtccggggtcactgg

SEQ ID NO: 593287 - DNA, 20 bp, mouse
ggactagtatagtacctgaa

SEQ ID NO: 593288 - DNA, 20 bp, mouse
gactagtccaccagtgaccc

SEQ ID NO: 593289 - DNA, 20 bp, mouse
gtaacgtgcgaggggacgct

SEQ ID NO: 593290 - DNA, 20 bp, mouse
gtgttactgtccggggtcac

SEQ ID NO: 593291 - DNA, 20 bp, mouse
ggaccaagcttcagcagctt

SEQ ID NO: 593292 - DNA, 20 bp, mouse
gaggtgaatatagctcccag

SEQ ID NO: 593293 - DNA, 20 bp, mouse
gcgaggggacgctgggaaac

SEQ ID NO: 593294 - DNA, 20 bp, mouse
gcacctcccgccaccatcgt

SEQ ID NO: 593295 - DNA, 20 bp, mouse
gcaattctaatggaaagaga

SEQ ID NO: 593296 - DNA, 20 bp, mouse
gtccaggctcggggagcgag

SEQ ID NO: 593297 - DNA, 20 bp, mouse
ggagcgggcgcaccaaggcg

SEQ ID NO: 593298 - DNA, 20 bp, mouse
ggcgcaccaaggcgaggccg

SEQ ID NO: 593299 - DNA, 20 bp, mouse
gccccgagcctggattgatc

SEQ ID NO: 593300 - DNA, 20 bp, mouse
gagcgcgaccagatcaatcc

SEQ ID NO: 593301 - DNA, 20 bp, mouse
gaccagatcaatccaggctc

SEQ ID NO: 593302 - DNA, 20 bp, mouse
ggcggtgcgcgtgtgagcga

SEQ ID NO: 593303 - DNA, 20 bp, mouse
gcgcagggacgcacgagacc

SEQ ID NO: 593304 - DNA, 20 bp, mouse
gcgtccccgcgcctcggccc

SEQ ID NO: 593305 - DNA, 20 bp, mouse
gagctccagggggggatcct

SEQ ID NO: 593306 - DNA, 20 bp, mouse
gcgccgagcgagcctcccgg

SEQ ID NO: 593307 - DNA, 20 bp, mouse
gccgccgcgcacctacctcc

SEQ ID NO: 593308 - DNA, 20 bp, mouse
gccgcgcacctacctccggg

SEQ ID NO: 593309 - DNA, 20 bp, mouse
ggagcgagcctcccggaggt

SEQ ID NO: 593310 - DNA, 20 bp, mouse
ggagcgccgagcgagcctcc

SEQ ID NO: 593311 - DNA, 20 bp, mouse
gtccgcgctgccggaggagt

SEQ ID NO: 593312 - DNA, 20 bp, mouse
gggcgcgcacggaagacgga

SEQ ID NO: 593313 - DNA, 20 bp, mouse
gagacggagggagcacggca

SEQ ID NO: 593314 - DNA, 20 bp, mouse
ggcgcggagcccgtcggaag

SEQ ID NO: 593315 - DNA, 20 bp, mouse
gctgcgcgcgcccactcctc

SEQ ID NO: 593316 - DNA, 20 bp, mouse
ggcggccgcgagactccaag

SEQ ID NO: 593317 - DNA, 20 bp, mouse
gcgcggaccgacggactgac

SEQ ID NO: 593318 - DNA, 20 bp, mouse
gactgccacttggagtctcg

SEQ ID NO: 593319 - DNA, 20 bp, mouse
ggctgctccacgcggaccga

SEQ ID NO: 593320 - DNA, 20 bp, mouse
gtgcaaggcggcgatcgcag

SEQ ID NO: 593321 - DNA, 20 bp, mouse
gggcctgcccgtcagtccgt

SEQ ID NO: 593322 - DNA, 20 bp, mouse
ggcgcccgagctgctccacg

SEQ ID NO: 593323 - DNA, 20 bp, mouse
gaagggcaggatggacgaca

SEQ ID NO: 593324 - DNA, 20 bp, mouse
ggaagaagctcaagaagacg

SEQ ID NO: 593325 - DNA, 20 bp, mouse
gggcgcactggggacgccgg

SEQ ID NO: 593326 - DNA, 20 bp, mouse
ggcagcggcgacgacgacca

SEQ ID NO: 593327 - DNA, 20 bp, mouse
gggcggacggacgcgaacac

SEQ ID NO: 593328 - DNA, 20 bp, mouse
gcgccgctgcggtaacggag

SEQ ID NO: 593329 - DNA, 20 bp, mouse
gagccgctccgttaccgcag

SEQ ID NO: 593330 - DNA, 20 bp, mouse
ggtcgtcgccgctgcggtaa

SEQ ID NO: 593331 - DNA, 20 bp, mouse
gaacggagcggctcgggtgg

SEQ ID NO: 593332 - DNA, 20 bp, mouse
gcagtgtccttccgacaagt

SEQ ID NO: 593333 - DNA, 20 bp, mouse
gggtaacggagcggctcggg

SEQ ID NO: 593334 - DNA, 20 bp, mouse
gggcagcaacaacacggccc

SEQ ID NO: 593335 - DNA, 20 bp, mouse
ggcgcgggaagggcctccgg

SEQ ID NO: 593336 - DNA, 20 bp, mouse
gaggtgagtgaggggcccca

SEQ ID NO: 593337 - DNA, 20 bp, mouse
gctccccacgcgggacctga

SEQ ID NO: 593338 - DNA, 20 bp, mouse
ggcgccgagcgcttgtcccg

SEQ ID NO: 593339 - DNA, 20 bp, mouse
gtgaggagagcgcgcctggg

SEQ ID NO: 593340 - DNA, 20 bp, mouse
gcgtgaggctggaggcctag

SEQ ID NO: 593341 - DNA, 20 bp, mouse
gttgcggcgcgtgcacagcg

SEQ ID NO: 593342 - DNA, 20 bp, mouse
gaagggaaccaccgggaccg

SEQ ID NO: 593343 - DNA, 20 bp, mouse
gcggggacccggatgatgag

SEQ ID NO: 593344 - DNA, 20 bp, mouse
gacgcgggacctgacggcac

SEQ ID NO: 593345 - DNA, 20 bp, mouse
ggctttgtgtctgggagata

SEQ ID NO: 593346 - DNA, 20 bp, mouse
ggtcccagcgaggtttggcg

SEQ ID NO: 593347 - DNA, 20 bp, mouse
gccgcggtcccagcgaggtt

SEQ ID NO: 593348 - DNA, 20 bp, mouse
ggcgggtgtcaacacatgag

SEQ ID NO: 593349 - DNA, 20 bp, mouse
gcgcccggcggctctttctc

SEQ ID NO: 593350 - DNA, 20 bp, mouse
ggtccagagaaagagccgcc

SEQ ID NO: 593351 - DNA, 20 bp, mouse
gggtttggcgaggcagcgcc

SEQ ID NO: 593352 - DNA, 20 bp, mouse
gcgagagggggaacgagcga

SEQ ID NO: 593353 - DNA, 20 bp, mouse
ggagcgcccgggacctgaga

SEQ ID NO: 593354 - DNA, 20 bp, mouse
gtggccccgcggtcccagcg

SEQ ID NO: 593355 - DNA, 20 bp, mouse
ggggccaccaggaggcactt

SEQ ID NO: 593356 - DNA, 20 bp, mouse
gctcgctgatcggcgcacag

SEQ ID NO: 593357 - DNA, 20 bp, mouse
ggctctgctggcgcagctcg

SEQ ID NO: 593358 - DNA, 20 bp, mouse
ggcggcgagcggaccgagcg

SEQ ID NO: 593359 - DNA, 20 bp, mouse
gggactcgagcgccaggaga

SEQ ID NO: 593360 - DNA, 20 bp, mouse
gcgcggcgagcccccagcgg

SEQ ID NO: 593361 - DNA, 20 bp, mouse
gcaggcagctctctccggcg

SEQ ID NO: 593362 - DNA, 20 bp, mouse
gaccgagcgaggcgcccggc

SEQ ID NO: 593363 - DNA, 20 bp, mouse
ggcgacgaagagagtctccg

SEQ ID NO: 593364 - DNA, 20 bp, mouse
gaggctgcgagaggacaccc

SEQ ID NO: 593365 - DNA, 20 bp, mouse
gggccccgacccgacagtgg

SEQ ID NO: 593366 - DNA, 20 bp, mouse
gaccgagacagcggctccag

SEQ ID NO: 593367 - DNA, 20 bp, mouse
gagctgcagggtcggccggg

SEQ ID NO: 593368 - DNA, 20 bp, mouse
gggctccagaggcgtcagtc

SEQ ID NO: 593369 - DNA, 20 bp, mouse
gtgcagggtcggccgggcgg

SEQ ID NO: 593370 - DNA, 20 bp, mouse
gcgcaaccggagtgcgcggg

SEQ ID NO: 593371 - DNA, 20 bp, mouse
gcggtagctgcagggtcggc

SEQ ID NO: 593372 - DNA, 20 bp, mouse
ggcctctggagccgctgtct

SEQ ID NO: 593373 - DNA, 20 bp, mouse
gctcacgcgggcggccgagg

SEQ ID NO: 593374 - DNA, 20 bp, mouse
ggcgtgccccccgcgcactc

SEQ ID NO: 593375 - DNA, 20 bp, mouse
gcaggctggagcctcctcct

SEQ ID NO: 593376 - DNA, 20 bp, mouse
gtcaggtcgcaggcgcgcgg

SEQ ID NO: 593377 - DNA, 20 bp, mouse
ggcgcgcggcggccgagtgc

SEQ ID NO: 593378 - DNA, 20 bp, mouse
gcccgtgcgggtcaggtcgc

SEQ ID NO: 593379 - DNA, 20 bp, mouse
gcagccgcgcagtacccgtg

SEQ ID NO: 593380 - DNA, 20 bp, mouse
gcgcagtacccgtgcgggtc

SEQ ID NO: 593381 - DNA, 20 bp, mouse
ggcctgggaaagttaagcaa

SEQ ID NO: 593382 - DNA, 20 bp, mouse
gagggacccggatcgctcat

SEQ ID NO: 593383 - DNA, 20 bp, mouse
gccctgcccgcccgtcggac

SEQ ID NO: 593384 - DNA, 20 bp, mouse
gagcgcgctgcgcggaagcc

SEQ ID NO: 593385 - DNA, 20 bp, mouse
ggggtcaggtcgcaggcgcg

SEQ ID NO: 593386 - DNA, 20 bp, mouse
ggactcggcccaggaagcgg

SEQ ID NO: 593387 - DNA, 20 bp, mouse
gacggactcggcccaggaag

SEQ ID NO: 593388 - DNA, 20 bp, mouse
ggcgaggaggcgggacacgt

SEQ ID NO: 593389 - DNA, 20 bp, mouse
gagtccgtccgcggccccag

SEQ ID NO: 593390 - DNA, 20 bp, mouse
ggccgctgccgccgcttcct

SEQ ID NO: 593391 - DNA, 20 bp, mouse
gctgtccaaactgctgaggg

SEQ ID NO: 593392 - DNA, 20 bp, mouse
gggcggctggaaccggagga

SEQ ID NO: 593393 - DNA, 20 bp, mouse
gagggcacctgacgccgctg

SEQ ID NO: 593394 - DNA, 20 bp, mouse
gcccagccggcggcccaagg

SEQ ID NO: 593395 - DNA, 20 bp, mouse
gacgagacgccgcggagggt

SEQ ID NO: 593396 - DNA, 20 bp, mouse
gccgaggcgggaagcacagc

SEQ ID NO: 593397 - DNA, 20 bp, mouse
gaagagctgccggaagtagg

SEQ ID NO: 593398 - DNA, 20 bp, mouse
ggggcagaccctcaacactc

SEQ ID NO: 593399 - DNA, 20 bp, mouse
ggagctggtcgcagctgcca

SEQ ID NO: 593400 - DNA, 20 bp, mouse
gaggcctcagccccggacag

SEQ ID NO: 593401 - DNA, 20 bp, mouse
ggcaaggcagggactcgcgg

SEQ ID NO: 593402 - DNA, 20 bp, mouse
gatggccagggtgccggcgg

SEQ ID NO: 593403 - DNA, 20 bp, mouse
gacttgaccccgagtgttga

SEQ ID NO: 593404 - DNA, 20 bp, mouse
gcgggcaaggcagggactcg

SEQ ID NO: 593405 - DNA, 20 bp, mouse
gcacctccaccgcctacttc

SEQ ID NO: 593406 - DNA, 20 bp, mouse
gacgaggtgggacgaggaag

SEQ ID NO: 593407 - DNA, 20 bp, mouse
gggaggttcctgtgcgacag

SEQ ID NO: 593408 - DNA, 20 bp, mouse
gggttcctgtgcgacagcgg

SEQ ID NO: 593409 - DNA, 20 bp, mouse
gaaagagcttgctagagcag

SEQ ID NO: 593410 - DNA, 20 bp, mouse
gcgttggagcgggaaagacg

SEQ ID NO: 593411 - DNA, 20 bp, mouse
gtggagcgggaaagacgagg

SEQ ID NO: 593412 - DNA, 20 bp, mouse
ggcaccacggccactgagaa

SEQ ID NO: 593413 - DNA, 20 bp, mouse
gggaaagacgaggtgggacg

SEQ ID NO: 593414 - DNA, 20 bp, mouse
ggccgtggtgccttcggtgg

SEQ ID NO: 593415 - DNA, 20 bp, mouse
ggccacagaggcagccaccg

SEQ ID NO: 593416 - DNA, 20 bp, mouse
gactctgggtgactcagaga

SEQ ID NO: 593417 - DNA, 20 bp, mouse
gttgctcgcgagcagtgtgc

SEQ ID NO: 593418 - DNA, 20 bp, mouse
gacccagagtacagaaacag

SEQ ID NO: 593419 - DNA, 20 bp, mouse
gccctctgtttctgtactct

SEQ ID NO: 593420 - DNA, 20 bp, mouse
gtgctgtaaggccggagccg

SEQ ID NO: 593421 - DNA, 20 bp, mouse
gagcggccgccgaacccctt

SEQ ID NO: 593422 - DNA, 20 bp, mouse
ggtgatgcgctgccaactca

SEQ ID NO: 593423 - DNA, 20 bp, mouse
gtctaaccacagctcccggg

SEQ ID NO: 593424 - DNA, 20 bp, mouse
gcggtgcccaaggggttcgg

SEQ ID NO: 593425 - DNA, 20 bp, mouse
gtatcgccacccgggagctg

SEQ ID NO: 593426 - DNA, 20 bp, mouse
gcgcttggcagcggcggaga

SEQ ID NO: 593427 - DNA, 20 bp, mouse
gccgccgctgccaagcgagt

SEQ ID NO: 593428 - DNA, 20 bp, mouse
ggcgcagagagcggaagggt

SEQ ID NO: 593429 - DNA, 20 bp, mouse
gcgaggggtcggggacagag

SEQ ID NO: 593430 - DNA, 20 bp, mouse
ggcccccaaccctccacgag

SEQ ID NO: 593431 - DNA, 20 bp, mouse
gggcggcgccaggaaggtta

SEQ ID NO: 593432 - DNA, 20 bp, mouse
gcagtgcagcgagaccgcgg

SEQ ID NO: 593433 - DNA, 20 bp, mouse
gacggcttctttgtttcctg

SEQ ID NO: 593434 - DNA, 20 bp, mouse
gacctccaggtaaggaatgg

SEQ ID NO: 593435 - DNA, 20 bp, mouse
gcagctgggcgaccaaagcg

SEQ ID NO: 593436 - DNA, 20 bp, mouse
gctaggctagctacaccgag

SEQ ID NO: 593437 - DNA, 20 bp, mouse
gcgggaatcccactccggag

SEQ ID NO: 593438 - DNA, 20 bp, mouse
ggtaagagcgatccgcggtc

SEQ ID NO: 593439 - DNA, 20 bp, mouse
gcaccgaggggaaaaggtaa

SEQ ID NO: 593440 - DNA, 20 bp, mouse
gagctagcctagcccgaccg

SEQ ID NO: 593441 - DNA, 20 bp, mouse
gcgccccgggaatcccactc

SEQ ID NO: 593442 - DNA, 20 bp, mouse
ggtttcgtaagagcgatccg

SEQ ID NO: 593443 - DNA, 20 bp, mouse
gcccctcggccccagtaatc

SEQ ID NO: 593444 - DNA, 20 bp, mouse
gtggaggaaacgggtcccct

SEQ ID NO: 593445 - DNA, 20 bp, mouse
ggaaattgagcgagttctgg

SEQ ID NO: 593446 - DNA, 20 bp, mouse
ggcctggccgggaccttcca

SEQ ID NO: 593447 - DNA, 20 bp, mouse
ggcgctgccttggaaggtcc

SEQ ID NO: 593448 - DNA, 20 bp, mouse
gcgccgcccggaagtagacg

SEQ ID NO: 593449 - DNA, 20 bp, mouse
gtccgccgcgggaacacaaa

SEQ ID NO: 593450 - DNA, 20 bp, mouse
gtgcccagcgctgccttgga

SEQ ID NO: 593451 - DNA, 20 bp, mouse
gcaaagggccgaagcgggag

SEQ ID NO: 593452 - DNA, 20 bp, mouse
gaattctttgagggaggcga

SEQ ID NO: 593453 - DNA, 20 bp, mouse
gggcctcgcgggctttgtgg

SEQ ID NO: 593454 - DNA, 20 bp, mouse
gaggcgacggtagcctggcc

SEQ ID NO: 593455 - DNA, 20 bp, mouse
gaggctcctcgttggaacaa

SEQ ID NO: 593456 - DNA, 20 bp, mouse
gccaatggcccgctccaaga

SEQ ID NO: 593457 - DNA, 20 bp, mouse
gagacggacgagaccaaata

SEQ ID NO: 593458 - DNA, 20 bp, mouse
ggcaagaggagggagcagtg

SEQ ID NO: 593459 - DNA, 20 bp, mouse
gcctcgctaggtaagaaagt

SEQ ID NO: 593460 - DNA, 20 bp, mouse
gcgggccattggcatttgaa

SEQ ID NO: 593461 - DNA, 20 bp, mouse
gagaaagtgggctgcgaagg

SEQ ID NO: 593462 - DNA, 20 bp, mouse
gccagaagcgaaaactgcct

SEQ ID NO: 593463 - DNA, 20 bp, mouse
gttacctagcgaggccagta

SEQ ID NO: 593464 - DNA, 20 bp, mouse
gagcagaacagccctagacc

SEQ ID NO: 593465 - DNA, 20 bp, mouse
gaccaaatacggcaagagga

SEQ ID NO: 593466 - DNA, 20 bp, mouse
ggagcgctcgtgtcactact

SEQ ID NO: 593467 - DNA, 20 bp, mouse
gagggcaagccgggcgaacc

SEQ ID NO: 593468 - DNA, 20 bp, mouse
gctcgttgcagagacggcca

SEQ ID NO: 593469 - DNA, 20 bp, mouse
gcacgcatgcgcaccgaggg

SEQ ID NO: 593470 - DNA, 20 bp, mouse
gtggaggtgaaggtcgggca

SEQ ID NO: 593471 - DNA, 20 bp, mouse
gcgcgtcggaccgaaaggaa

SEQ ID NO: 593472 - DNA, 20 bp, mouse
ggtcggaccgaaaggaacgg

SEQ ID NO: 593473 - DNA, 20 bp, mouse
gaggtcgggcagggcaagcc

SEQ ID NO: 593474 - DNA, 20 bp, mouse
ggagctggaaagaatccggt

SEQ ID NO: 593475 - DNA, 20 bp, mouse
gggcgttgagcaagaccttc

SEQ ID NO: 593476 - DNA, 20 bp, mouse
gggccgggcggtagacacga

SEQ ID NO: 593477 - DNA, 20 bp, mouse
ggggcggtagacacgacgga

SEQ ID NO: 593478 - DNA, 20 bp, mouse
gacacgacggacggtgacta

SEQ ID NO: 593479 - DNA, 20 bp, mouse
gcgcgcgcgcgggtgcgaac

SEQ ID NO: 593480 - DNA, 20 bp, mouse
gcggcctagcctggccctcg

SEQ ID NO: 593481 - DNA, 20 bp, mouse
gtagctgggacaccgtgtcc

SEQ ID NO: 593482 - DNA, 20 bp, mouse
gcgaacgggaaacgccgcga

SEQ ID NO: 593483 - DNA, 20 bp, mouse
ggcgccacgagggacaacaa

SEQ ID NO: 593484 - DNA, 20 bp, mouse
gggaccgaggagccacgcga

SEQ ID NO: 593485 - DNA, 20 bp, mouse
gacggtgtcccagctagatt

SEQ ID NO: 593486 - DNA, 20 bp, mouse
gcccgagcccgagaagatgg

SEQ ID NO: 593487 - DNA, 20 bp, mouse
ggcccgagaagatggcggtg

SEQ ID NO: 593488 - DNA, 20 bp, mouse
gcggtgcggaagaaggacgg

SEQ ID NO: 593489 - DNA, 20 bp, mouse
ggggcccgagcccgagaaga

SEQ ID NO: 593490 - DNA, 20 bp, mouse
gtccgcaccgccatcttctc

SEQ ID NO: 593491 - DNA, 20 bp, mouse
gcccaacgtgaagtactacg

SEQ ID NO: 593492 - DNA, 20 bp, mouse
ggcctcgtagtacttcacgt

SEQ ID NO: 593493 - DNA, 20 bp, mouse
gaagatggcggtgcggaaga

SEQ ID NO: 593494 - DNA, 20 bp, mouse
gacgttgtcgaactgggtca

SEQ ID NO: 593495 - DNA, 20 bp, mouse
gaactgggtcacggtgtccg

SEQ ID NO: 593496 - DNA, 20 bp, mouse
ggccgctcggagccacagac

SEQ ID NO: 593497 - DNA, 20 bp, mouse
gtccagtctgtggctccgag

SEQ ID NO: 593498 - DNA, 20 bp, mouse
gacagactggaaacccgccc

SEQ ID NO: 593499 - DNA, 20 bp, mouse
ggccacgcccgctcctcctg

SEQ ID NO: 593500 - DNA, 20 bp, mouse
gagcggcggctccgggaaga

SEQ ID NO: 593501 - DNA, 20 bp, mouse
gatccggtgagtgggacagg

SEQ ID NO: 593502 - DNA, 20 bp, mouse
gggtattcctggggacacgg

SEQ ID NO: 593503 - DNA, 20 bp, mouse
gctcctcctgtcccactcac

SEQ ID NO: 593504 - DNA, 20 bp, mouse
gcgctctccgatgcccgggg

SEQ ID NO: 593505 - DNA, 20 bp, mouse
gcctatccggtgagtgggac

SEQ ID NO: 593506 - DNA, 20 bp, mouse
gtcgcggagcggactcaaca

SEQ ID NO: 593507 - DNA, 20 bp, mouse
ggactcaacacggagaccgg

SEQ ID NO: 593508 - DNA, 20 bp, mouse
gggcaggagcggagtcagag

SEQ ID NO: 593509 - DNA, 20 bp, mouse
ggcggactcaacacggagac

SEQ ID NO: 593510 - DNA, 20 bp, mouse
ggtcccgcggtgcagcgatc

SEQ ID NO: 593511 - DNA, 20 bp, mouse
gaggccggatcgctgcaccg

SEQ ID NO: 593512 - DNA, 20 bp, mouse
ggcgcagtaccaggtgagga

SEQ ID NO: 593513 - DNA, 20 bp, mouse
gcggaacgtagctcgcggag

SEQ ID NO: 593514 - DNA, 20 bp, mouse
gcgcggcgcagtaccaggtg

SEQ ID NO: 593515 - DNA, 20 bp, mouse
gaccccgagccactaaccaa

SEQ ID NO: 593516 - DNA, 20 bp, mouse
gagcccagcaggactcagag

SEQ ID NO: 593517 - DNA, 20 bp, mouse
gaggactcagaggggagagt

SEQ ID NO: 593518 - DNA, 20 bp, mouse
gctcccctctgagtcctgct

SEQ ID NO: 593519 - DNA, 20 bp, mouse
gacttctactcgagcggagt

SEQ ID NO: 593520 - DNA, 20 bp, mouse
ggcgcggcggccgggaagag

SEQ ID NO: 593521 - DNA, 20 bp, mouse
gagggtgagcgagctggctc

SEQ ID NO: 593522 - DNA, 20 bp, mouse
gtactcgagcggagtgggga

SEQ ID NO: 593523 - DNA, 20 bp, mouse
gtggggagggggccccttca

SEQ ID NO: 593524 - DNA, 20 bp, mouse
gtcccccactcaccacccca

SEQ ID NO: 593525 - DNA, 20 bp, mouse
gtctcacacttctactcgag

SEQ ID NO: 593526 - DNA, 20 bp, mouse
gcaacccggtcggggaaggg

SEQ ID NO: 593527 - DNA, 20 bp, mouse
ggtccggaacagctcctcgg

SEQ ID NO: 593528 - DNA, 20 bp, mouse
ggcctctcccgggagagggt

SEQ ID NO: 593529 - DNA, 20 bp, mouse
gcctcggtgaggcctagcgg

SEQ ID NO: 593530 - DNA, 20 bp, mouse
gcgaccgggttgggcccact

SEQ ID NO: 593531 - DNA, 20 bp, mouse
gggggcgagcgcgggacaaa

SEQ ID NO: 593532 - DNA, 20 bp, mouse
gactgggaaacactcacccg

SEQ ID NO: 593533 - DNA, 20 bp, mouse
ggcccaacccggtcggggaa

SEQ ID NO: 593534 - DNA, 20 bp, mouse
gcccgtccggaacagctcct

SEQ ID NO: 593535 - DNA, 20 bp, mouse
gggacaaagggaagcgaagc

SEQ ID NO: 593536 - DNA, 20 bp, mouse
gaaggccgcgccttactcct

SEQ ID NO: 593537 - DNA, 20 bp, mouse
gcgttcccaggagtaaggcg

SEQ ID NO: 593538 - DNA, 20 bp, mouse
gaacctcgttcccaggagta

SEQ ID NO: 593539 - DNA, 20 bp, mouse
gacgccagcgccgctgtcat

SEQ ID NO: 593540 - DNA, 20 bp, mouse
ggcgggctaacctcgttccc

SEQ ID NO: 593541 - DNA, 20 bp, mouse
gaagccgcgggccaaacaac

SEQ ID NO: 593542 - DNA, 20 bp, mouse
gccctgcgcgcgtcccggtc

SEQ ID NO: 593543 - DNA, 20 bp, mouse
gcctctggcccgaatggtat

SEQ ID NO: 593544 - DNA, 20 bp, mouse
gtactttgcagacaagcagg

SEQ ID NO: 593545 - DNA, 20 bp, mouse
gaagcagggggaaccggacc

SEQ ID NO: 593546 - DNA, 20 bp, mouse
gcctagaacagactaagaca

SEQ ID NO: 593547 - DNA, 20 bp, mouse
ggcccctacctggagattca

SEQ ID NO: 593548 - DNA, 20 bp, mouse
ggccctgaatctccaggtag

SEQ ID NO: 593549 - DNA, 20 bp, mouse
gggcccacgggcttcaaatg

SEQ ID NO: 593550 - DNA, 20 bp, mouse
gctgaaggccagcccctacc

SEQ ID NO: 593551 - DNA, 20 bp, mouse
gagtgcagtctcaggcccac

SEQ ID NO: 593552 - DNA, 20 bp, mouse
gatagtcaggcactgggacg

SEQ ID NO: 593553 - DNA, 20 bp, mouse
gagcatagcagagtatagtc

SEQ ID NO: 593554 - DNA, 20 bp, mouse
gaaacctaggatgatatggg

SEQ ID NO: 593555 - DNA, 20 bp, mouse
ggtgaaacctaggatgatat

SEQ ID NO: 593556 - DNA, 20 bp, mouse
gggcacggcgcgcagccatg

SEQ ID NO: 593557 - DNA, 20 bp, mouse
gcgaggaagcggctgaggca

SEQ ID NO: 593558 - DNA, 20 bp, mouse
ggagcacgaggaagcggctg

SEQ ID NO: 593559 - DNA, 20 bp, mouse
gtcacgggagcacgaggaag

SEQ ID NO: 593560 - DNA, 20 bp, mouse
ggtagacccgaggggaccca

SEQ ID NO: 593561 - DNA, 20 bp, mouse
gggacccagggacccactct

SEQ ID NO: 593562 - DNA, 20 bp, mouse
gccacaggaggcgacaacgg

SEQ ID NO: 593563 - DNA, 20 bp, mouse
ggtcccggcagacccacagg

SEQ ID NO: 593564 - DNA, 20 bp, mouse
ggttaacaagagccgagagt

SEQ ID NO: 593565 - DNA, 20 bp, mouse
gtgctggcctgaggagacgg

SEQ ID NO: 593566 - DNA, 20 bp, mouse
ggcggatgcggtgcccggga

SEQ ID NO: 593567 - DNA, 20 bp, mouse
gggccacccgacctgtactc

SEQ ID NO: 593568 - DNA, 20 bp, mouse
gtagcgcctgagtacaggtc

SEQ ID NO: 593569 - DNA, 20 bp, mouse
ggatgcggtgcccgggatgg

SEQ ID NO: 593570 - DNA, 20 bp, mouse
gcgggcgaacgccaccatcc

SEQ ID NO: 593571 - DNA, 20 bp, mouse
gttgttggctgcagcggatg

SEQ ID NO: 593572 - DNA, 20 bp, mouse
gcccggtagcgcctgagtac

SEQ ID NO: 593573 - DNA, 20 bp, mouse
gggtgtccaggcgggagatg

SEQ ID NO: 593574 - DNA, 20 bp, mouse
gtgctcgcgccgaaattcaa

SEQ ID NO: 593575 - DNA, 20 bp, mouse
gaaattcaaaggaacagttc

SEQ ID NO: 593576 - DNA, 20 bp, mouse
gagcggagcgctgtgaggag

SEQ ID NO: 593577 - DNA, 20 bp, mouse
ggagcgagcggagcgctgtg

SEQ ID NO: 593578 - DNA, 20 bp, mouse
gtggccacagggggagcgag

SEQ ID NO: 593579 - DNA, 20 bp, mouse
gcccggcgctcggctcgtca

SEQ ID NO: 593580 - DNA, 20 bp, mouse
gagcagcgcggccgcaggct

SEQ ID NO: 593581 - DNA, 20 bp, mouse
gaggtaagggccgtgagagg

SEQ ID NO: 593582 - DNA, 20 bp, mouse
gagcaggtaagggccgtgag

SEQ ID NO: 593583 - DNA, 20 bp, mouse
gtacatggctccgcgcccct

SEQ ID NO: 593584 - DNA, 20 bp, mouse
gctcccgctcgctccccctg

SEQ ID NO: 593585 - DNA, 20 bp, mouse
ggccggccctaacccacccg

SEQ ID NO: 593586 - DNA, 20 bp, mouse
gccggagccgagacaccggg

SEQ ID NO: 593587 - DNA, 20 bp, mouse
ggacccggagccgagacacc

SEQ ID NO: 593588 - DNA, 20 bp, mouse
gccgagccgggctgaaatgg

SEQ ID NO: 593589 - DNA, 20 bp, mouse
gactccgagccgggctgaaa

SEQ ID NO: 593590 - DNA, 20 bp, mouse
gcaccgggaggagcgaggcg

SEQ ID NO: 593591 - DNA, 20 bp, mouse
gccgggctgaaatggtggca

SEQ ID NO: 593592 - DNA, 20 bp, mouse
gcattttcgagtgaaggacc

SEQ ID NO: 593593 - DNA, 20 bp, mouse
gggcgggtccactccgagcc

SEQ ID NO: 593594 - DNA, 20 bp, mouse
gagagaaggacttcacctgt

SEQ ID NO: 593595 - DNA, 20 bp, mouse
gctccggcgcctcttcctgg

SEQ ID NO: 593596 - DNA, 20 bp, mouse
gcggttgttgatatctatga

SEQ ID NO: 593597 - DNA, 20 bp, mouse
gggtagagtgtgcttcccct

SEQ ID NO: 593598 - DNA, 20 bp, mouse
gtaggggcgagggcagccta

SEQ ID NO: 593599 - DNA, 20 bp, mouse
gctcgcccctaactgcacat

SEQ ID NO: 593600 - DNA, 20 bp, mouse
gatttcagaatatgatgctg

SEQ ID NO: 593601 - DNA, 20 bp, mouse
gcccaattccaacttttcta

SEQ ID NO: 593602 - DNA, 20 bp, mouse
ggcagtcttgattgctactt

SEQ ID NO: 593603 - DNA, 20 bp, mouse
gctttctgaaaagtgttgct

SEQ ID NO: 593604 - DNA, 20 bp, mouse
gatgataaatcttcattgta

SEQ ID NO: 593605 - DNA, 20 bp, mouse
gatgtatgccttagaaaagt

SEQ ID NO: 593606 - DNA, 20 bp, mouse
ggacgcggaggaagccagga

SEQ ID NO: 593607 - DNA, 20 bp, mouse
gaagccgctgcgggacgcgg

SEQ ID NO: 593608 - DNA, 20 bp, mouse
gctcggaggaagcatctctc

SEQ ID NO: 593609 - DNA, 20 bp, mouse
gccaggatggcgactccgag

SEQ ID NO: 593610 - DNA, 20 bp, mouse
gagaccgcttggaaacctgg

SEQ ID NO: 593611 - DNA, 20 bp, mouse
gatggcgactccgagcggga

SEQ ID NO: 593612 - DNA, 20 bp, mouse
gcggaagccgctgcgggacg

SEQ ID NO: 593613 - DNA, 20 bp, mouse
ggccgggcgcggaggctcct

SEQ ID NO: 593614 - DNA, 20 bp, mouse
gccgggaacggaagccgctg

SEQ ID NO: 593615 - DNA, 20 bp, mouse
gcttcctccgcgtcccgcag

SEQ ID NO: 593616 - DNA, 20 bp, mouse
gaggtccgacgccctcaggg

SEQ ID NO: 593617 - DNA, 20 bp, mouse
gaccgctcgcccgccaagca

SEQ ID NO: 593618 - DNA, 20 bp, mouse
gccgaggtccgacgccctca

SEQ ID NO: 593619 - DNA, 20 bp, mouse
gaaggccaccctgagggcgt

SEQ ID NO: 593620 - DNA, 20 bp, mouse
gggcacacccgcccaaatgc

SEQ ID NO: 593621 - DNA, 20 bp, mouse
gagggctcccgcctgcattt

SEQ ID NO: 593622 - DNA, 20 bp, mouse
gcagcccgcagcttccaaga

SEQ ID NO: 593623 - DNA, 20 bp, mouse
ggcaggcgcggactgtcctg

SEQ ID NO: 593624 - DNA, 20 bp, mouse
gagagcggcgtcccctccga

SEQ ID NO: 593625 - DNA, 20 bp, mouse
gacaagtcgcggtcaccccg

SEQ ID NO: 593626 - DNA, 20 bp, mouse
ggccgcgcagcaccgactgt

SEQ ID NO: 593627 - DNA, 20 bp, mouse
gccgctgaggctcggagccg

SEQ ID NO: 593628 - DNA, 20 bp, mouse
gccctcggctccagccgccg

SEQ ID NO: 593629 - DNA, 20 bp, mouse
gggtgctgcgcggcccgctg

SEQ ID NO: 593630 - DNA, 20 bp, mouse
gcccggccgctgcccacagt

SEQ ID NO: 593631 - DNA, 20 bp, mouse
gctgaggctcggagccgcgg

SEQ ID NO: 593632 - DNA, 20 bp, mouse
gcagcggccgggaagtaacc

SEQ ID NO: 593633 - DNA, 20 bp, mouse
gtgcgcggcccgctgaggct

SEQ ID NO: 593634 - DNA, 20 bp, mouse
ggccgtcgacggctgtagga

SEQ ID NO: 593635 - DNA, 20 bp, mouse
gcggttcccgggttacttcc

SEQ ID NO: 593636 - DNA, 20 bp, mouse
gtccactcggcaacaggcag

SEQ ID NO: 593637 - DNA, 20 bp, mouse
gaaggtggcacagggctcca

SEQ ID NO: 593638 - DNA, 20 bp, mouse
ggccgctgcctgttgccgag

SEQ ID NO: 593639 - DNA, 20 bp, mouse
gttctgggcagtactgagat

SEQ ID NO: 593640 - DNA, 20 bp, mouse
gcttctgagagcagcagact

SEQ ID NO: 593641 - DNA, 20 bp, mouse
gggcaacaggcagcggcgat

SEQ ID NO: 593642 - DNA, 20 bp, mouse
gatggactgggtgaccttct

SEQ ID NO: 593643 - DNA, 20 bp, mouse
gatgggtcatcttctgaagg

SEQ ID NO: 593644 - DNA, 20 bp, mouse
gatcagggttgtggtctcat

SEQ ID NO: 593645 - DNA, 20 bp, mouse
gcttgaaggaagcaatgaaa

SEQ ID NO: 593646 - DNA, 20 bp, mouse
gcgtccccaggagctaggac

SEQ ID NO: 593647 - DNA, 20 bp, mouse
gcctagctcctggggacgag

SEQ ID NO: 593648 - DNA, 20 bp, mouse
ggagcctgtcctagctcctg

SEQ ID NO: 593649 - DNA, 20 bp, mouse
gagttgttccacacctgagg

SEQ ID NO: 593650 - DNA, 20 bp, mouse
gtgcaaggcctctcgtcccc

SEQ ID NO: 593651 - DNA, 20 bp, mouse
ggcaagttgttccacacctg

SEQ ID NO: 593652 - DNA, 20 bp, mouse
gccaccagccaaaagtccca

SEQ ID NO: 593653 - DNA, 20 bp, mouse
gccccgctggataagttggg

SEQ ID NO: 593654 - DNA, 20 bp, mouse
gcagagttccctgggacttt

SEQ ID NO: 593655 - DNA, 20 bp, mouse
gaggaggaaagcttgcagtt

SEQ ID NO: 593656 - DNA, 20 bp, mouse
gcgacaacactgctgagaca

SEQ ID NO: 593657 - DNA, 20 bp, mouse
gcccagaaaggtaagtgatg

SEQ ID NO: 593658 - DNA, 20 bp, mouse
gtgtcgaagggttatcccgt

SEQ ID NO: 593659 - DNA, 20 bp, mouse
gagcttccagatgagcccac

SEQ ID NO: 593660 - DNA, 20 bp, mouse
gtccctgctgccttcaagga

SEQ ID NO: 593661 - DNA, 20 bp, mouse
gatggagccatgctacatgt

SEQ ID NO: 593662 - DNA, 20 bp, mouse
gtttgtccgaggggctctca

SEQ ID NO: 593663 - DNA, 20 bp, mouse
gtccctccttgaaggcagca

SEQ ID NO: 593664 - DNA, 20 bp, mouse
gctcatctggaagcttctgg

SEQ ID NO: 593665 - DNA, 20 bp, mouse
gtctcagcagtgttgtcgaa

SEQ ID NO: 593666 - DNA, 20 bp, mouse
gggttagaggacgttccaga

SEQ ID NO: 593667 - DNA, 20 bp, mouse
gatttctcagcacttgtatc

SEQ ID NO: 593668 - DNA, 20 bp, mouse
ggccacagactggagcaccc

SEQ ID NO: 593669 - DNA, 20 bp, mouse
gtcacagcagagatacttaa

SEQ ID NO: 593670 - DNA, 20 bp, mouse
gggaagctcgggcttgagca

SEQ ID NO: 593671 - DNA, 20 bp, mouse
gtgggcaagcaaaggactcg

SEQ ID NO: 593672 - DNA, 20 bp, mouse
ggcattggggtagtatggtc

SEQ ID NO: 593673 - DNA, 20 bp, mouse
gttgagcagggttcttggtg

SEQ ID NO: 593674 - DNA, 20 bp, mouse
gagatggctccctgctcttc

SEQ ID NO: 593675 - DNA, 20 bp, mouse
ggctttgtacagccagtgct

SEQ ID NO: 593676 - DNA, 20 bp, mouse
gacggtaagggctggatagc

SEQ ID NO: 593677 - DNA, 20 bp, mouse
gcacttagcatgctatccca

SEQ ID NO: 593678 - DNA, 20 bp, mouse
gccttaccgtaaagaagaga

SEQ ID NO: 593679 - DNA, 20 bp, mouse
gtcttctttacggtaagggc

SEQ ID NO: 593680 - DNA, 20 bp, mouse
ggtagttgtgaacctgatat

SEQ ID NO: 593681 - DNA, 20 bp, mouse
gaagcaaacccctggaaccc

SEQ ID NO: 593682 - DNA, 20 bp, mouse
gttcttcaggttacaatcat

SEQ ID NO: 593683 - DNA, 20 bp, mouse
gacctgtgactccagacgca

SEQ ID NO: 593684 - DNA, 20 bp, mouse
ggctcaggtttagggttctt

SEQ ID NO: 593685 - DNA, 20 bp, mouse
gagctggaaaggcttcttcc

SEQ ID NO: 593686 - DNA, 20 bp, mouse
gtggactcactagactgctg

SEQ ID NO: 593687 - DNA, 20 bp, mouse
gctttgacttctgatagcca

SEQ ID NO: 593688 - DNA, 20 bp, mouse
gctgaactaagaagagccca

SEQ ID NO: 593689 - DNA, 20 bp, mouse
gcagcagattgaatagatgc

SEQ ID NO: 593690 - DNA, 20 bp, mouse
gaaaagagctgagagtttag

SEQ ID NO: 593691 - DNA, 20 bp, mouse
gtcaatctgctgaaacatcc

SEQ ID NO: 593692 - DNA, 20 bp, mouse
ggaagcagaaaatcaactgt

SEQ ID NO: 593693 - DNA, 20 bp, mouse
gtaacaccgagaatcaagta

SEQ ID NO: 593694 - DNA, 20 bp, mouse
gacactaacaggttaacatt

SEQ ID NO: 593695 - DNA, 20 bp, mouse
gagacttagctgacgggtca

SEQ ID NO: 593696 - DNA, 20 bp, mouse
ggacagtacggtcctaggag

SEQ ID NO: 593697 - DNA, 20 bp, mouse
gtgtcccagggaagctaccg

SEQ ID NO: 593698 - DNA, 20 bp, mouse
ggagtctccccacgacctaa

SEQ ID NO: 593699 - DNA, 20 bp, mouse
gtagcttccctgggacagta

SEQ ID NO: 593700 - DNA, 20 bp, mouse
gctaggaccgtactgtccca

SEQ ID NO: 593701 - DNA, 20 bp, mouse
ggtgccgcggtagcttccct

SEQ ID NO: 593702 - DNA, 20 bp, mouse
gctgcaggtccagatgacgg

SEQ ID NO: 593703 - DNA, 20 bp, mouse
gaagctgcaggtccagatga

SEQ ID NO: 593704 - DNA, 20 bp, mouse
gtcatgtgataccaagatgg

SEQ ID NO: 593705 - DNA, 20 bp, mouse
gagaaactgtcgccgctcct

SEQ ID NO: 593706 - DNA, 20 bp, mouse
ggagctggagatggcgtcca

SEQ ID NO: 593707 - DNA, 20 bp, mouse
ggccagccgccgagccgccg

SEQ ID NO: 593708 - DNA, 20 bp, mouse
gctggagatggcgtccacgg

SEQ ID NO: 593709 - DNA, 20 bp, mouse
gcgaggggcggagctggaga

SEQ ID NO: 593710 - DNA, 20 bp, mouse
gggcgtccacggcggctcgg

SEQ ID NO: 593711 - DNA, 20 bp, mouse
gccgggtcgaactgcaaccc

SEQ ID NO: 593712 - DNA, 20 bp, mouse
gtctctggagcgggccgagg

SEQ ID NO: 593713 - DNA, 20 bp, mouse
ggggtgtggctcccggcgag

SEQ ID NO: 593714 - DNA, 20 bp, mouse
gggcccgctccagagagccc

SEQ ID NO: 593715 - DNA, 20 bp, mouse
gatgcgtggggtgtggctcc

SEQ ID NO: 593716 - DNA, 20 bp, mouse
ggggagtcccggtccgtcac

SEQ ID NO: 593717 - DNA, 20 bp, mouse
gtctgtgaggaagacggaag

SEQ ID NO: 593718 - DNA, 20 bp, mouse
gacgcgagtcgcgccggtga

SEQ ID NO: 593719 - DNA, 20 bp, mouse
gacctaggcagtagcggcag

SEQ ID NO: 593720 - DNA, 20 bp, mouse
gagtcgcgccggtgacggac

SEQ ID NO: 593721 - DNA, 20 bp, mouse
gcccgcgcgccgcttttgag

SEQ ID NO: 593722 - DNA, 20 bp, mouse
ggcggcgcgcggggccacct

SEQ ID NO: 593723 - DNA, 20 bp, mouse
gcggcggctttggctctgtg

SEQ ID NO: 593724 - DNA, 20 bp, mouse
gagaggcggcggagtaggga

SEQ ID NO: 593725 - DNA, 20 bp, mouse
gttggctcgcccctcaaaag

SEQ ID NO: 593726 - DNA, 20 bp, mouse
gggatctgtagtagtaaccg

SEQ ID NO: 593727 - DNA, 20 bp, mouse
gagagagtcgggttacaaga

SEQ ID NO: 593728 - DNA, 20 bp, mouse
gcgtacgaacctgctggaag

SEQ ID NO: 593729 - DNA, 20 bp, mouse
ggccgccgtagcccctgcta

SEQ ID NO: 593730 - DNA, 20 bp, mouse
gtcttgagagccggtagtgg

SEQ ID NO: 593731 - DNA, 20 bp, mouse
gtagtagtaaccgcggcggg

SEQ ID NO: 593732 - DNA, 20 bp, mouse
gtctgtagtagtaaccgcgg

SEQ ID NO: 593733 - DNA, 20 bp, mouse
gtgcgccgcggtgaagggag

SEQ ID NO: 593734 - DNA, 20 bp, mouse
ggagaggcccgagtttacca

SEQ ID NO: 593735 - DNA, 20 bp, mouse
gacgagcggagggctctcgg

SEQ ID NO: 593736 - DNA, 20 bp, mouse
gcgaggcgacgtctcttcca

SEQ ID NO: 593737 - DNA, 20 bp, mouse
gcgcgacgctggggcccagg

SEQ ID NO: 593738 - DNA, 20 bp, mouse
ggctggggcccaggaggacg

SEQ ID NO: 593739 - DNA, 20 bp, mouse
gcaggaggacgaggacagcg

SEQ ID NO: 593740 - DNA, 20 bp, mouse
gccgggccagatcgcagtgt

SEQ ID NO: 593741 - DNA, 20 bp, mouse
ggctccagcggaacccggaa

SEQ ID NO: 593742 - DNA, 20 bp, mouse
gggccagatcgcagtgtcgg

SEQ ID NO: 593743 - DNA, 20 bp, mouse
gtgaggaggaagccgcggag

SEQ ID NO: 593744 - DNA, 20 bp, mouse
gctccaggcgaggctcgacg

SEQ ID NO: 593745 - DNA, 20 bp, mouse
gcggcggcggccggttcagg

SEQ ID NO: 593746 - DNA, 20 bp, mouse
ggtacagctggagacggcag

SEQ ID NO: 593747 - DNA, 20 bp, mouse
gagccgcctcacagcgatgg

SEQ ID NO: 593748 - DNA, 20 bp, mouse
gcagtggaggcgccagtggt

SEQ ID NO: 593749 - DNA, 20 bp, mouse
gggcccccgccacccaccac

SEQ ID NO: 593750 - DNA, 20 bp, mouse
gcagcgatggcggccgagca

SEQ ID NO: 593751 - DNA, 20 bp, mouse
gacggcagtggaggcgccag

SEQ ID NO: 593752 - DNA, 20 bp, mouse
ggagctgagaagcagtgggt

SEQ ID NO: 593753 - DNA, 20 bp, mouse
gcgcgagatttgataggtgg

SEQ ID NO: 593754 - DNA, 20 bp, mouse
gcgtcacgctaggctcaccg

SEQ ID NO: 593755 - DNA, 20 bp, mouse
gagccaaggccctcctccag

SEQ ID NO: 593756 - DNA, 20 bp, mouse
gccctccgccatcttcgcgg

SEQ ID NO: 593757 - DNA, 20 bp, mouse
ggccgcgccgagcaagaggg

SEQ ID NO: 593758 - DNA, 20 bp, mouse
ggtagcagccgccgcgaaga

SEQ ID NO: 593759 - DNA, 20 bp, mouse
gcgcagccaggaaaccacga

SEQ ID NO: 593760 - DNA, 20 bp, mouse
gaacccctccgccatcttcg

SEQ ID NO: 593761 - DNA, 20 bp, mouse
ggggcaccggagaacaacca

SEQ ID NO: 593762 - DNA, 20 bp, mouse
gggcgccgcgccgagcaaga

SEQ ID NO: 593763 - DNA, 20 bp, mouse
gtgctacagctgcggcgact

SEQ ID NO: 593764 - DNA, 20 bp, mouse
gcgctggcgtgagagggtta

SEQ ID NO: 593765 - DNA, 20 bp, mouse
gccaggaaaccacgacggac

SEQ ID NO: 593766 - DNA, 20 bp, mouse
ggcgccaagcgaggaggagt

SEQ ID NO: 593767 - DNA, 20 bp, mouse
gctcgccgcgaagcctccgt

SEQ ID NO: 593768 - DNA, 20 bp, mouse
gcaccccgcgccaagcgagg

SEQ ID NO: 593769 - DNA, 20 bp, mouse
gggaccggcggactcggaag

SEQ ID NO: 593770 - DNA, 20 bp, mouse
gcggcgaccgccagcacccg

SEQ ID NO: 593771 - DNA, 20 bp, mouse
ggcttcgcggcgagacgcgg

SEQ ID NO: 593772 - DNA, 20 bp, mouse
ggaggcttcgcggcgagacg

SEQ ID NO: 593773 - DNA, 20 bp, mouse
ggagacccacggaggcttcg

SEQ ID NO: 593774 - DNA, 20 bp, mouse
ggcggactcggaagcggtgg

SEQ ID NO: 593775 - DNA, 20 bp, mouse
ggagagtgagtgaggcgagg

SEQ ID NO: 593776 - DNA, 20 bp, mouse
gttgcgcgagctgctcatgg

SEQ ID NO: 593777 - DNA, 20 bp, mouse
gaagctgaccggccccgcca

SEQ ID NO: 593778 - DNA, 20 bp, mouse
ggcagctcgcgcaagctgac

SEQ ID NO: 593779 - DNA, 20 bp, mouse
gctgaccggccccgccatgg

SEQ ID NO: 593780 - DNA, 20 bp, mouse
ggggaccggaagaacgctag

SEQ ID NO: 593781 - DNA, 20 bp, mouse
gatcctgatggtgaaagagt

SEQ ID NO: 593782 - DNA, 20 bp, mouse
gggaagctctttctccgcca

SEQ ID NO: 593783 - DNA, 20 bp, mouse
gggaggagccggagaccccg

SEQ ID NO: 593784 - DNA, 20 bp, mouse
gtctcatcctccctccacgg

SEQ ID NO: 593785 - DNA, 20 bp, mouse
ggagctgctcatgggggcgt

SEQ ID NO: 593786 - DNA, 20 bp, mouse
ggcgcaggccgtgactcgtt

SEQ ID NO: 593787 - DNA, 20 bp, mouse
gctcgttgggctgcgtactg

SEQ ID NO: 593788 - DNA, 20 bp, mouse
gccctaggtaaggggaaggg

SEQ ID NO: 593789 - DNA, 20 bp, mouse
gtacgcagcccaacgagtca

SEQ ID NO: 593790 - DNA, 20 bp, mouse
ggacgccccgagcctgggag

SEQ ID NO: 593791 - DNA, 20 bp, mouse
ggctattccggaacaggcct

SEQ ID NO: 593792 - DNA, 20 bp, mouse
gagtgacgggagtgcagcgt

SEQ ID NO: 593793 - DNA, 20 bp, mouse
gtgagagaggccgagaaaac

SEQ ID NO: 593794 - DNA, 20 bp, mouse
gggaacaggccttggcgtcc

SEQ ID NO: 593795 - DNA, 20 bp, mouse
gccttccggcaccatttaca

SEQ ID NO: 593796 - DNA, 20 bp, mouse
gagactgttcaggcccatcg

SEQ ID NO: 593797 - DNA, 20 bp, mouse
gctgaacagtctctacactt

SEQ ID NO: 593798 - DNA, 20 bp, mouse
gagcttcatggtgacgatct

SEQ ID NO: 593799 - DNA, 20 bp, mouse
gtacagaagtatcagcttca

SEQ ID NO: 593800 - DNA, 20 bp, mouse
gcattcagaggtgatcttgg

SEQ ID NO: 593801 - DNA, 20 bp, mouse
ggtcagagccagtgttgaga

SEQ ID NO: 593802 - DNA, 20 bp, mouse
gagatggcctataaatacgc

SEQ ID NO: 593803 - DNA, 20 bp, mouse
gatacttctgtacctggctg

SEQ ID NO: 593804 - DNA, 20 bp, mouse
gatgttacttacacattcag

SEQ ID NO: 593805 - DNA, 20 bp, mouse
gcgggctagagttgccacga

SEQ ID NO: 593806 - DNA, 20 bp, mouse
gtcgcactcggtagagaccg

SEQ ID NO: 593807 - DNA, 20 bp, mouse
gccggaggacagggaatggt

SEQ ID NO: 593808 - DNA, 20 bp, mouse
gctccttgggctgtgcggga

SEQ ID NO: 593809 - DNA, 20 bp, mouse
ggctctggccccggaggaca

SEQ ID NO: 593810 - DNA, 20 bp, mouse
gggcacaggtgagtcgcact

SEQ ID NO: 593811 - DNA, 20 bp, mouse
ggagaggagcagtcagctag

SEQ ID NO: 593812 - DNA, 20 bp, mouse
ggtctagtctagatgaggag

SEQ ID NO: 593813 - DNA, 20 bp, mouse
gagggaagctctggccccgg

SEQ ID NO: 593814 - DNA, 20 bp, mouse
gaagggccgcccgcacgcca

SEQ ID NO: 593815 - DNA, 20 bp, mouse
gtgcgggcggcccttgcaag

SEQ ID NO: 593816 - DNA, 20 bp, mouse
gttgtgagcagcaagcgagg

SEQ ID NO: 593817 - DNA, 20 bp, mouse
gaagaacgcgggatgaccaa

SEQ ID NO: 593818 - DNA, 20 bp, mouse
gccgtggaggcaatgcctgg

SEQ ID NO: 593819 - DNA, 20 bp, mouse
ggacgggattgtgggagtcg

SEQ ID NO: 593820 - DNA, 20 bp, mouse
gacttacactcagggcggcg

SEQ ID NO: 593821 - DNA, 20 bp, mouse
ggactcacacacttacactc

SEQ ID NO: 593822 - DNA, 20 bp, mouse
gggtttgtgagcagcaagcg

SEQ ID NO: 593823 - DNA, 20 bp, mouse
ggggcactcccaagtatcca

SEQ ID NO: 593824 - DNA, 20 bp, mouse
gccaagggctatgtagccgt

SEQ ID NO: 593825 - DNA, 20 bp, mouse
gtgcctgggggcgagaacct

SEQ ID NO: 593826 - DNA, 20 bp, mouse
gccgctagccgggagcaaca

SEQ ID NO: 593827 - DNA, 20 bp, mouse
gcagcccgcacaccccggac

SEQ ID NO: 593828 - DNA, 20 bp, mouse
ggcagcgcgggacctgtccg

SEQ ID NO: 593829 - DNA, 20 bp, mouse
gcgcgggccactgggaacct

SEQ ID NO: 593830 - DNA, 20 bp, mouse
ggaccgcaggtgagttccca

SEQ ID NO: 593831 - DNA, 20 bp, mouse
ggggagcaacagggacgccg

SEQ ID NO: 593832 - DNA, 20 bp, mouse
gggacctgtccggggtgtgc

SEQ ID NO: 593833 - DNA, 20 bp, mouse
gagtcgtaggaggtccgaga

SEQ ID NO: 593834 - DNA, 20 bp, mouse
gcggctagcgggcgcagcgc

SEQ ID NO: 593835 - DNA, 20 bp, mouse
gggtggccgagtgtggactg

SEQ ID NO: 593836 - DNA, 20 bp, mouse
gggcgtctccgagggaggag

SEQ ID NO: 593837 - DNA, 20 bp, mouse
gcgaggtccccctcctccct

SEQ ID NO: 593838 - DNA, 20 bp, mouse
gcgcggcgaacgccaggccc

SEQ ID NO: 593839 - DNA, 20 bp, mouse
gcatctggcgtctccgaggg

SEQ ID NO: 593840 - DNA, 20 bp, mouse
gcctggctgcagctcactcg

SEQ ID NO: 593841 - DNA, 20 bp, mouse
gtgacatctggcgtctccga

SEQ ID NO: 593842 - DNA, 20 bp, mouse
gtcggggagtggttgacatc

SEQ ID NO: 593843 - DNA, 20 bp, mouse
gcggggaaagagtgatctgg

SEQ ID NO: 593844 - DNA, 20 bp, mouse
gaggcggggaaagagtgatc

SEQ ID NO: 593845 - DNA, 20 bp, mouse
ggagtgatctggaggtggcg

SEQ ID NO: 593846 - DNA, 20 bp, mouse
gggccggcggccagcagcat

SEQ ID NO: 593847 - DNA, 20 bp, mouse
ggtgcgcgcggccacagaag

SEQ ID NO: 593848 - DNA, 20 bp, mouse
gccctaggtagggtcacgag

SEQ ID NO: 593849 - DNA, 20 bp, mouse
gtcgaatccaaacagagggg

SEQ ID NO: 593850 - DNA, 20 bp, mouse
gctcgtggctaagagtgacg

SEQ ID NO: 593851 - DNA, 20 bp, mouse
gactcacccgcccaaaacag

SEQ ID NO: 593852 - DNA, 20 bp, mouse
ggtctatcgaatccaaacag

SEQ ID NO: 593853 - DNA, 20 bp, mouse
ggcgcacccggggaccgctg

SEQ ID NO: 593854 - DNA, 20 bp, mouse
gcggcagcgacagcggcgtc

SEQ ID NO: 593855 - DNA, 20 bp, mouse
ggcggcgtccggaacgctcc

SEQ ID NO: 593856 - DNA, 20 bp, mouse
gtcagtctgaccatacgatg

SEQ ID NO: 593857 - DNA, 20 bp, mouse
gctgaccatacgatgtggag

SEQ ID NO: 593858 - DNA, 20 bp, mouse
gtaaccccctccacatcgta

SEQ ID NO: 593859 - DNA, 20 bp, mouse
gaatatggtgaggacttgag

SEQ ID NO: 593860 - DNA, 20 bp, mouse
ggactcactgatagtcccag

SEQ ID NO: 593861 - DNA, 20 bp, mouse
gaggatcacctggtaaaata

SEQ ID NO: 593862 - DNA, 20 bp, mouse
gagtcccaggggaaaattag

SEQ ID NO: 593863 - DNA, 20 bp, mouse
gaggtcactactctaacata

SEQ ID NO: 593864 - DNA, 20 bp, mouse
gcacctggtaaaatatggtg

SEQ ID NO: 593865 - DNA, 20 bp, mouse
gtcagaattcagacgattgt

SEQ ID NO: 593866 - DNA, 20 bp, mouse
gtgcctgcaagggtctgatt

SEQ ID NO: 593867 - DNA, 20 bp, mouse
ggctgaagctgcaaggactg

SEQ ID NO: 593868 - DNA, 20 bp, mouse
gcgcctgcggggtccctctc

SEQ ID NO: 593869 - DNA, 20 bp, mouse
gtgcaagggtctgattgggg

SEQ ID NO: 593870 - DNA, 20 bp, mouse
gtccgtgtgggagaagacgg

SEQ ID NO: 593871 - DNA, 20 bp, mouse
ggaccccgcaggcgggaagg

SEQ ID NO: 593872 - DNA, 20 bp, mouse
gagactcggaagctgcgggt

SEQ ID NO: 593873 - DNA, 20 bp, mouse
ggggaatggagggtccgtgt

SEQ ID NO: 593874 - DNA, 20 bp, mouse
gagctgcaaggactgcggct

SEQ ID NO: 593875 - DNA, 20 bp, mouse
gctgcagggagcttacactc

SEQ ID NO: 593876 - DNA, 20 bp, mouse
gatctttccagacaagaggt

SEQ ID NO: 593877 - DNA, 20 bp, mouse
gcagcatctttccagacaag

SEQ ID NO: 593878 - DNA, 20 bp, mouse
ggtctgggtggagatcagat

SEQ ID NO: 593879 - DNA, 20 bp, mouse
ggtctggtgcacagccaaga

SEQ ID NO: 593880 - DNA, 20 bp, mouse
gaataaacctacctcttgtc

SEQ ID NO: 593881 - DNA, 20 bp, mouse
gaaagatgctgttgaagcga

SEQ ID NO: 593882 - DNA, 20 bp, mouse
ggggtggagatcagattggt

SEQ ID NO: 593883 - DNA, 20 bp, mouse
gctccacccagaccttaagt

SEQ ID NO: 593884 - DNA, 20 bp, mouse
gtcaaatagcatgaggcagt

SEQ ID NO: 593885 - DNA, 20 bp, mouse
ggtcctacttaaggtctggg

SEQ ID NO: 593886 - DNA, 20 bp, mouse
gcggaacagcccgagcggag

SEQ ID NO: 593887 - DNA, 20 bp, mouse
gactcccggaacagcccgag

SEQ ID NO: 593888 - DNA, 20 bp, mouse
gccgcagagacacccaggtc

SEQ ID NO: 593889 - DNA, 20 bp, mouse
gagcgcgggccgagacccag

SEQ ID NO: 593890 - DNA, 20 bp, mouse
gtccgcccgcagagacaccc

SEQ ID NO: 593891 - DNA, 20 bp, mouse
gtgcgggctccggggaccct

SEQ ID NO: 593892 - DNA, 20 bp, mouse
gggccggcaggaagtgacga

SEQ ID NO: 593893 - DNA, 20 bp, mouse
gggctgttccgggagtcggg

SEQ ID NO: 593894 - DNA, 20 bp, mouse
gtctctgcgggcggagtgag

SEQ ID NO: 593895 - DNA, 20 bp, mouse
ggagcccgcagagacgccgg

SEQ ID NO: 593896 - DNA, 20 bp, mouse
gtcgcgacccagctcggaag

SEQ ID NO: 593897 - DNA, 20 bp, mouse
gccgctgccatggagagaaa

SEQ ID NO: 593898 - DNA, 20 bp, mouse
ggcgaaggcccccgcacgtt

SEQ ID NO: 593899 - DNA, 20 bp, mouse
ggagctgggtcgcgaccttg

SEQ ID NO: 593900 - DNA, 20 bp, mouse
ggggtcgcgaccttgaggcc

SEQ ID NO: 593901 - DNA, 20 bp, mouse
ggccccgcctccgagctcag

SEQ ID NO: 593902 - DNA, 20 bp, mouse
gctacttccggccccttatg

SEQ ID NO: 593903 - DNA, 20 bp, mouse
gaactcgattcccggcctca

SEQ ID NO: 593904 - DNA, 20 bp, mouse
gagaaagggggcagcagagc

SEQ ID NO: 593905 - DNA, 20 bp, mouse
gccttgaacagatagggtag

SEQ ID NO: 593906 - DNA, 20 bp, mouse
gggggaaggggtgccactag

SEQ ID NO: 593907 - DNA, 20 bp, mouse
gggaagcagtgtgagttcct

SEQ ID NO: 593908 - DNA, 20 bp, mouse
gtacctggcctgggggggaa

SEQ ID NO: 593909 - DNA, 20 bp, mouse
gaaggggtgccactagaggc

SEQ ID NO: 593910 - DNA, 20 bp, mouse
ggtggtgcggatcctggatc

SEQ ID NO: 593911 - DNA, 20 bp, mouse
gtaggacctacctggcctgg

SEQ ID NO: 593912 - DNA, 20 bp, mouse
gtgagttcctaggacctacc

SEQ ID NO: 593913 - DNA, 20 bp, mouse
gtagaggcaggtgggggcac

SEQ ID NO: 593914 - DNA, 20 bp, mouse
ggtggcaccccttccccccc

SEQ ID NO: 593915 - DNA, 20 bp, mouse
gcccacactgaccctgacct

SEQ ID NO: 593916 - DNA, 20 bp, mouse
gagtctgcggaagaacggaa

SEQ ID NO: 593917 - DNA, 20 bp, mouse
gtgggcccctaggatcgaaa

SEQ ID NO: 593918 - DNA, 20 bp, mouse
ggaagtagcaaggcaggaga

SEQ ID NO: 593919 - DNA, 20 bp, mouse
ggaggcaagggacccagatg

SEQ ID NO: 593920 - DNA, 20 bp, mouse
gtggagtccgagcacgttct

SEQ ID NO: 593921 - DNA, 20 bp, mouse
ggcaggagagggcacccggg

SEQ ID NO: 593922 - DNA, 20 bp, mouse
gctagggtaagtgagaccaa

SEQ ID NO: 593923 - DNA, 20 bp, mouse
gagcaggctgtggcttgggt

SEQ ID NO: 593924 - DNA, 20 bp, mouse
gctagcgccgagaacgtgct

SEQ ID NO: 593925 - DNA, 20 bp, mouse
gccgggtgggagcaacgctg

SEQ ID NO: 593926 - DNA, 20 bp, mouse
gggcagactggtgttcccgg

SEQ ID NO: 593927 - DNA, 20 bp, mouse
gctcagtccacgggactccg

SEQ ID NO: 593928 - DNA, 20 bp, mouse
gggactccgcggacacgcag

SEQ ID NO: 593929 - DNA, 20 bp, mouse
gggcagtacaaataaccctg

SEQ ID NO: 593930 - DNA, 20 bp, mouse
ggcgtgtccgcggagtcccg

SEQ ID NO: 593931 - DNA, 20 bp, mouse
gggacacgcaggggtccgca

SEQ ID NO: 593932 - DNA, 20 bp, mouse
gagtcttggtgctcagtcca

SEQ ID NO: 593933 - DNA, 20 bp, mouse
ggtggggtagggacggaacc

SEQ ID NO: 593934 - DNA, 20 bp, mouse
gtgcccggcaagcagcgatt

SEQ ID NO: 593935 - DNA, 20 bp, mouse
gacctgcacggcctgactag

SEQ ID NO: 593936 - DNA, 20 bp, mouse
ggagtgagaagcagccgcct

SEQ ID NO: 593937 - DNA, 20 bp, mouse
gacttccaggaggtacatag

SEQ ID NO: 593938 - DNA, 20 bp, mouse
gctggtgaagaagtcaaagg

SEQ ID NO: 593939 - DNA, 20 bp, mouse
gtggccaaaggacttccagg

SEQ ID NO: 593940 - DNA, 20 bp, mouse
gatagtggggagcctcgaag

SEQ ID NO: 593941 - DNA, 20 bp, mouse
gggcaggaaagtggcagcgc

SEQ ID NO: 593942 - DNA, 20 bp, mouse
gctctagtaccaggtcccag

SEQ ID NO: 593943 - DNA, 20 bp, mouse
gagagcctctatgtacctcc

SEQ ID NO: 593944 - DNA, 20 bp, mouse
gagctcggagaggaacgtct

SEQ ID NO: 593945 - DNA, 20 bp, mouse
ggtgaagaagtcaaaggtgg

SEQ ID NO: 593946 - DNA, 20 bp, mouse
gctgggtggaagaggcttcc

SEQ ID NO: 593947 - DNA, 20 bp, mouse
gtctgaggacaaagcaagtc

SEQ ID NO: 593948 - DNA, 20 bp, mouse
gctgagttggggcaaagctg

SEQ ID NO: 593949 - DNA, 20 bp, mouse
gcaccagagcaaacaagggt

SEQ ID NO: 593950 - DNA, 20 bp, mouse
gccaccaccagagcaaacaa

SEQ ID NO: 593951 - DNA, 20 bp, mouse
gcctgaagtctgaggccgga

SEQ ID NO: 593952 - DNA, 20 bp, mouse
ggagatctgagagctctgaa

SEQ ID NO: 593953 - DNA, 20 bp, mouse
gctcaggctgacctctctca

SEQ ID NO: 593954 - DNA, 20 bp, mouse
gctcttctcagagctcgtag

SEQ ID NO: 593955 - DNA, 20 bp, mouse
gaggaggccttgccatatta

SEQ ID NO: 593956 - DNA, 20 bp, mouse
gccttgggtgtaaggatgat

SEQ ID NO: 593957 - DNA, 20 bp, mouse
gcggagagtggcagtcagag

SEQ ID NO: 593958 - DNA, 20 bp, mouse
gggtgttagaggtcggagag

SEQ ID NO: 593959 - DNA, 20 bp, mouse
gcgggactggcggtgaccaa

SEQ ID NO: 593960 - DNA, 20 bp, mouse
gtggcggtgaccaagggtgt

SEQ ID NO: 593961 - DNA, 20 bp, mouse
gtcctgcggagggacagtaa

SEQ ID NO: 593962 - DNA, 20 bp, mouse
gatgcacagggcgggactgg

SEQ ID NO: 593963 - DNA, 20 bp, mouse
gtatgaatgaggggtgttag

SEQ ID NO: 593964 - DNA, 20 bp, mouse
ggttcgggtaatatgaatga

SEQ ID NO: 593965 - DNA, 20 bp, mouse
gtactctctagaccagggaa

SEQ ID NO: 593966 - DNA, 20 bp, mouse
ggtccgagctgaagcttccc

SEQ ID NO: 593967 - DNA, 20 bp, mouse
gcagcagcgggcgttcgcac

SEQ ID NO: 593968 - DNA, 20 bp, mouse
gcgccaggctcagagacttc

SEQ ID NO: 593969 - DNA, 20 bp, mouse
gttgggcaattgggaagccg

SEQ ID NO: 593970 - DNA, 20 bp, mouse
gagccggggaagcttcagct

SEQ ID NO: 593971 - DNA, 20 bp, mouse
gagcctgaccttgggcaatt

SEQ ID NO: 593972 - DNA, 20 bp, mouse
ggctccgccagccctcgaag

SEQ ID NO: 593973 - DNA, 20 bp, mouse
gagaccgcggtcagataccc

SEQ ID NO: 593974 - DNA, 20 bp, mouse
gcggaaggaaagtccagcag

SEQ ID NO: 593975 - DNA, 20 bp, mouse
gtcagatacccaggctccta

SEQ ID NO: 593976 - DNA, 20 bp, mouse
gaaacagtgggattagacta

SEQ ID NO: 593977 - DNA, 20 bp, mouse
gggaattccagagacttaag

SEQ ID NO: 593978 - DNA, 20 bp, mouse
gaggtaaccaacgaaacagt

SEQ ID NO: 593979 - DNA, 20 bp, mouse
gagagacttaagaggatgac

SEQ ID NO: 593980 - DNA, 20 bp, mouse
gtgaaattaactaagaacaa

SEQ ID NO: 593981 - DNA, 20 bp, mouse
gtacataaccaagctagtaa

SEQ ID NO: 593982 - DNA, 20 bp, mouse
ggaagagaaccagagatgta

SEQ ID NO: 593983 - DNA, 20 bp, mouse
gtctaatcccactgtttcgt

SEQ ID NO: 593984 - DNA, 20 bp, mouse
gaatattgttatcagtgaga

SEQ ID NO: 593985 - DNA, 20 bp, mouse
gaccagaaatgtatagctat

SEQ ID NO: 593986 - DNA, 20 bp, mouse
ggatccccaggaccaggaca

SEQ ID NO: 593987 - DNA, 20 bp, mouse
gagtcgcctgtcccgagcag

SEQ ID NO: 593988 - DNA, 20 bp, mouse
gggtccccactgctcgggac

SEQ ID NO: 593989 - DNA, 20 bp, mouse
gattgccagcacggagctca

SEQ ID NO: 593990 - DNA, 20 bp, mouse
gtgtgagaccccacgaggaa

SEQ ID NO: 593991 - DNA, 20 bp, mouse
ggtaagtgtgagaccccacg

SEQ ID NO: 593992 - DNA, 20 bp, mouse
ggggaccatgagctccgtgc

SEQ ID NO: 593993 - DNA, 20 bp, mouse
ggctcatggtccccactgct

SEQ ID NO: 593994 - DNA, 20 bp, mouse
ggaccccacgaggaagggtt

SEQ ID NO: 593995 - DNA, 20 bp, mouse
gcaggaccaggacagggccg

SEQ ID NO: 593996 - DNA, 20 bp, mouse
gggctccgagcaggaagata

SEQ ID NO: 593997 - DNA, 20 bp, mouse
gcgtccgtggtagcaggcca

SEQ ID NO: 593998 - DNA, 20 bp, mouse
gggtagcaggccatggcgat

SEQ ID NO: 593999 - DNA, 20 bp, mouse
ggtgagcccggcagcgtccg

SEQ ID NO: 594000 - DNA, 20 bp, mouse
gggtcccagaagccccatga

SEQ ID NO: 594001 - DNA, 20 bp, mouse
ggaggctgtgagccacgctt

SEQ ID NO: 594002 - DNA, 20 bp, mouse
ggtcacacaggaccaaagcg

SEQ ID NO: 594003 - DNA, 20 bp, mouse
gatacggtgctgttccggcg

SEQ ID NO: 594004 - DNA, 20 bp, mouse
ggcgtggcaccggccaggtg

SEQ ID NO: 594005 - DNA, 20 bp, mouse
gtaaatctggagctttccaa

SEQ ID NO: 594006 - DNA, 20 bp, mouse
gagaaagtccgccagcgagg

SEQ ID NO: 594007 - DNA, 20 bp, mouse
gaagtccgccagcgaggggg

SEQ ID NO: 594008 - DNA, 20 bp, mouse
gtccagcccgaggcccgagg

SEQ ID NO: 594009 - DNA, 20 bp, mouse
gggggagagaagccggcctc

SEQ ID NO: 594010 - DNA, 20 bp, mouse
ggagccccgcaccctcacag

SEQ ID NO: 594011 - DNA, 20 bp, mouse
ggacgagcctcggtcggaaa

SEQ ID NO: 594012 - DNA, 20 bp, mouse
gaggcggaggccggaagcga

SEQ ID NO: 594013 - DNA, 20 bp, mouse
gcaaggtaacgagcccctga

SEQ ID NO: 594014 - DNA, 20 bp, mouse
gaggcctgactctccctcag

SEQ ID NO: 594015 - DNA, 20 bp, mouse
gcgccgcgacgagcctcggt

SEQ ID NO: 594016 - DNA, 20 bp, mouse
ggtcggcagggagagctcag

SEQ ID NO: 594017 - DNA, 20 bp, mouse
gaggagcccggtagtcggca

SEQ ID NO: 594018 - DNA, 20 bp, mouse
ggcgcctggcctccatcgag

SEQ ID NO: 594019 - DNA, 20 bp, mouse
gctccaggccagggagtccg

SEQ ID NO: 594020 - DNA, 20 bp, mouse
gaacaaaggagcccggtagt

SEQ ID NO: 594021 - DNA, 20 bp, mouse
ggctctccctgccgactacc

SEQ ID NO: 594022 - DNA, 20 bp, mouse
gcaaccctgggaaccctccg

SEQ ID NO: 594023 - DNA, 20 bp, mouse
gtaatggtgggagagggaat

SEQ ID NO: 594024 - DNA, 20 bp, mouse
gcggcgcgctcgcgcggagg

SEQ ID NO: 594025 - DNA, 20 bp, mouse
gggtgcgccccgaaagtctg

SEQ ID NO: 594026 - DNA, 20 bp, mouse
gccggggtcacggtcatgaa

SEQ ID NO: 594027 - DNA, 20 bp, mouse
ggggtcacggtcatgaacgg

SEQ ID NO: 594028 - DNA, 20 bp, mouse
ggagccgggcagccacgagc

SEQ ID NO: 594029 - DNA, 20 bp, mouse
gggagtggccgaagagccag

SEQ ID NO: 594030 - DNA, 20 bp, mouse
gaacggcggaggcccggagc

SEQ ID NO: 594031 - DNA, 20 bp, mouse
gtcacggtcatgaacggcgg

SEQ ID NO: 594032 - DNA, 20 bp, mouse
gggcgacagcaggttggatg

SEQ ID NO: 594033 - DNA, 20 bp, mouse
ggccgaagagccagcggcag

SEQ ID NO: 594034 - DNA, 20 bp, mouse
gaggcctgcaagggactaga

SEQ ID NO: 594035 - DNA, 20 bp, mouse
ggcgggcagcatggtgccag

SEQ ID NO: 594036 - DNA, 20 bp, mouse
gaccagcggccataggaccg

SEQ ID NO: 594037 - DNA, 20 bp, mouse
gggaggatccggggaaacta

SEQ ID NO: 594038 - DNA, 20 bp, mouse
ggagcgccggccagagcgca

SEQ ID NO: 594039 - DNA, 20 bp, mouse
gagcgcacggaggggccgtg

SEQ ID NO: 594040 - DNA, 20 bp, mouse
gacttctgcgcgggcaccgg

SEQ ID NO: 594041 - DNA, 20 bp, mouse
ggccgctggtggagaccgca

SEQ ID NO: 594042 - DNA, 20 bp, mouse
gcgccggccagagcgcacgg

SEQ ID NO: 594043 - DNA, 20 bp, mouse
gggctgtttgacagcagcag

SEQ ID NO: 594044 - DNA, 20 bp, mouse
gcagcagcagcggcagttcg

SEQ ID NO: 594045 - DNA, 20 bp, mouse
ggaactgctccgcggtccta

SEQ ID NO: 594046 - DNA, 20 bp, mouse
ggattcgaaagagtgagtgt

SEQ ID NO: 594047 - DNA, 20 bp, mouse
gtttccatgtcagagatagc

SEQ ID NO: 594048 - DNA, 20 bp, mouse
ggagcctgtgaggcgatgcc

SEQ ID NO: 594049 - DNA, 20 bp, mouse
gatgtcagagatagcgggct

SEQ ID NO: 594050 - DNA, 20 bp, mouse
gggctgctccaaggtgatgc

SEQ ID NO: 594051 - DNA, 20 bp, mouse
gctccaaggtgatgctggcc

SEQ ID NO: 594052 - DNA, 20 bp, mouse
gctgggagtcaacagaagtc

SEQ ID NO: 594053 - DNA, 20 bp, mouse
gcgcctcacaggctcccatg

SEQ ID NO: 594054 - DNA, 20 bp, mouse
gatgctacctaagggggtgg

SEQ ID NO: 594055 - DNA, 20 bp, mouse
gatcattttgacagccacat

SEQ ID NO: 594056 - DNA, 20 bp, mouse
ggagtcgggggtatgtggtg

SEQ ID NO: 594057 - DNA, 20 bp, mouse
gtgatgatggggcgggagtc

SEQ ID NO: 594058 - DNA, 20 bp, mouse
gctcatcaaaaacataagag

SEQ ID NO: 594059 - DNA, 20 bp, mouse
gaaacataagaggggcctta

SEQ ID NO: 594060 - DNA, 20 bp, mouse
gagaaaggagagagagagtt

SEQ ID NO: 594061 - DNA, 20 bp, mouse
gagttgggtagagaaaggga

SEQ ID NO: 594062 - DNA, 20 bp, mouse
gacttgtgggccagatacct

SEQ ID NO: 594063 - DNA, 20 bp, mouse
gggcgggagtcgggggtatg

SEQ ID NO: 594064 - DNA, 20 bp, mouse
ggagagagttgggtagagaa

SEQ ID NO: 594065 - DNA, 20 bp, mouse
gagggaggggagagataaaa

SEQ ID NO: 594066 - DNA, 20 bp, mouse
gagtaactttgtgttgtgtg

SEQ ID NO: 594067 - DNA, 20 bp, mouse
gtggaactaggagaagagga

SEQ ID NO: 594068 - DNA, 20 bp, mouse
ggaggtggaactaggagaag

SEQ ID NO: 594069 - DNA, 20 bp, mouse
gctaggagaagaggagggaa

SEQ ID NO: 594070 - DNA, 20 bp, mouse
ggagggaagggggctatgat

SEQ ID NO: 594071 - DNA, 20 bp, mouse
gaaggggagggaattagagg

SEQ ID NO: 594072 - DNA, 20 bp, mouse
ggggcatgtgaggtggaact

SEQ ID NO: 594073 - DNA, 20 bp, mouse
gagaggaggaggggcatgtg

SEQ ID NO: 594074 - DNA, 20 bp, mouse
ggagaaggggagggaattag

SEQ ID NO: 594075 - DNA, 20 bp, mouse
gggaggaggggcatgtgagg

SEQ ID NO: 594076 - DNA, 20 bp, mouse
gagtaactttgtgttgtgtg

SEQ ID NO: 594077 - DNA, 20 bp, mouse
gtggaactaggagaagagga

SEQ ID NO: 594078 - DNA, 20 bp, mouse
ggaggtggaactaggagaag

SEQ ID NO: 594079 - DNA, 20 bp, mouse
gctaggagaagaggagggaa

SEQ ID NO: 594080 - DNA, 20 bp, mouse
ggagggaagggggctatgat

SEQ ID NO: 594081 - DNA, 20 bp, mouse
ggactagatgtcccagggca

SEQ ID NO: 594082 - DNA, 20 bp, mouse
gtagatgtcccagggcatgg

SEQ ID NO: 594083 - DNA, 20 bp, mouse
gaaggggagggaattagagg

SEQ ID NO: 594084 - DNA, 20 bp, mouse
ggagaaggggagggaattag

SEQ ID NO: 594085 - DNA, 20 bp, mouse
gcagggcatggtggcaccta

SEQ ID NO: 594086 - DNA, 20 bp, mouse
gcacctgggcgcagcctccc

SEQ ID NO: 594087 - DNA, 20 bp, mouse
gtctccatgtcagagaaagg

SEQ ID NO: 594088 - DNA, 20 bp, mouse
gtgctgggccagcttcacct

SEQ ID NO: 594089 - DNA, 20 bp, mouse
gctctgcctcagacatgaca

SEQ ID NO: 594090 - DNA, 20 bp, mouse
gcgcctcacaggcacccacg

SEQ ID NO: 594091 - DNA, 20 bp, mouse
ggattgtaaagagggagtgt

SEQ ID NO: 594092 - DNA, 20 bp, mouse
gatttctccatgtcagagaa

SEQ ID NO: 594093 - DNA, 20 bp, mouse
gatcactttgacagccacgt

SEQ ID NO: 594094 - DNA, 20 bp, mouse
ggtcaaagtgattgtaaaga

SEQ ID NO: 594095 - DNA, 20 bp, mouse
gttaagagctgcttgaataa

SEQ ID NO: 594096 - DNA, 20 bp, mouse
ggctgcaggaggaagcccag

SEQ ID NO: 594097 - DNA, 20 bp, mouse
gagccgccgccgggaccgta

SEQ ID NO: 594098 - DNA, 20 bp, mouse
gctcggccctacggtcccgg

SEQ ID NO: 594099 - DNA, 20 bp, mouse
gtggctcggccctacggtcc

SEQ ID NO: 594100 - DNA, 20 bp, mouse
gggaagcccagtggctgcgg

SEQ ID NO: 594101 - DNA, 20 bp, mouse
gcccctcctccgcagccact

SEQ ID NO: 594102 - DNA, 20 bp, mouse
ggacagccaccgagcctcgt

SEQ ID NO: 594103 - DNA, 20 bp, mouse
ggcccagtggctgcggagga

SEQ ID NO: 594104 - DNA, 20 bp, mouse
gggcggctggctcggcccta

SEQ ID NO: 594105 - DNA, 20 bp, mouse
gccggagccaggctgacgaa

SEQ ID NO: 594106 - DNA, 20 bp, mouse
gccaggctcgtagacaggac

SEQ ID NO: 594107 - DNA, 20 bp, mouse
ggggccccgagggccagcca

SEQ ID NO: 594108 - DNA, 20 bp, mouse
gccttaccggcacccagagt

SEQ ID NO: 594109 - DNA, 20 bp, mouse
gacccaaaggcactctggag

SEQ ID NO: 594110 - DNA, 20 bp, mouse
gagcgttacccgggccccga

SEQ ID NO: 594111 - DNA, 20 bp, mouse
gaagccctggctggccctcg

SEQ ID NO: 594112 - DNA, 20 bp, mouse
gctggccggatgatgctctg

SEQ ID NO: 594113 - DNA, 20 bp, mouse
ggtgaggttctgccacccaa

SEQ ID NO: 594114 - DNA, 20 bp, mouse
ggcaggaacccaaagaaccg

SEQ ID NO: 594115 - DNA, 20 bp, mouse
gaccacaacgaagggtaatc

SEQ ID NO: 594116 - DNA, 20 bp, mouse
ggaagccgagccgggaacaa

SEQ ID NO: 594117 - DNA, 20 bp, mouse
ggggaggaacctgtaggccg

SEQ ID NO: 594118 - DNA, 20 bp, mouse
ggaacctgtaggccgcggtg

SEQ ID NO: 594119 - DNA, 20 bp, mouse
gcagtcctggaaggaatctc

SEQ ID NO: 594120 - DNA, 20 bp, mouse
ggattcttaggtccttcggt

SEQ ID NO: 594121 - DNA, 20 bp, mouse
gtctccgcaccgcggcctac

SEQ ID NO: 594122 - DNA, 20 bp, mouse
gggtgcggagaacccaccga

SEQ ID NO: 594123 - DNA, 20 bp, mouse
ggggacctgagtgagttcgt

SEQ ID NO: 594124 - DNA, 20 bp, mouse
gagtaagtgctcccaggcgt

SEQ ID NO: 594125 - DNA, 20 bp, mouse
gacttcaagcctgttgctgg

SEQ ID NO: 594126 - DNA, 20 bp, mouse
ggcgatggttacagcgaccg

SEQ ID NO: 594127 - DNA, 20 bp, mouse
gctagagacggctctcgcgg

SEQ ID NO: 594128 - DNA, 20 bp, mouse
gctccaggtgctgagtccga

SEQ ID NO: 594129 - DNA, 20 bp, mouse
gttcctagagacggctctcg

SEQ ID NO: 594130 - DNA, 20 bp, mouse
gccggtcgcgaggagctggg

SEQ ID NO: 594131 - DNA, 20 bp, mouse
ggttacagcgaccgcggctc

SEQ ID NO: 594132 - DNA, 20 bp, mouse
gagccgtctctaggaagccc

SEQ ID NO: 594133 - DNA, 20 bp, mouse
gaccctctctggtctctcgt

SEQ ID NO: 594134 - DNA, 20 bp, mouse
gcgaccgcggctctggcatc

SEQ ID NO: 594135 - DNA, 20 bp, mouse
gcaggccctgggccacgaag

SEQ ID NO: 594136 - DNA, 20 bp, mouse
ggcgccgagtgtccgaatgg

SEQ ID NO: 594137 - DNA, 20 bp, mouse
gtatcagcacggcaggtgag

SEQ ID NO: 594138 - DNA, 20 bp, mouse
gcgaggaccacgcaggaagg

SEQ ID NO: 594139 - DNA, 20 bp, mouse
ggagccgccattcggacact

SEQ ID NO: 594140 - DNA, 20 bp, mouse
gatctcgagcttctcagaga

SEQ ID NO: 594141 - DNA, 20 bp, mouse
gctcccggccggccccgtac

SEQ ID NO: 594142 - DNA, 20 bp, mouse
ggcagcttgatgacgacatt

SEQ ID NO: 594143 - DNA, 20 bp, mouse
gagagaagggagccgccatt

SEQ ID NO: 594144 - DNA, 20 bp, mouse
gagcacggcaggtgagtggc

SEQ ID NO: 594145 - DNA, 20 bp, mouse
gcggcagaaagccatgaccc

SEQ ID NO: 594146 - DNA, 20 bp, mouse
gagccagcccgtggggcaat

SEQ ID NO: 594147 - DNA, 20 bp, mouse
ggcgctgcaggctgtgcgac

SEQ ID NO: 594148 - DNA, 20 bp, mouse
gtctgtgcctattgccccac

SEQ ID NO: 594149 - DNA, 20 bp, mouse
gcagcgcgccgaggctgtag

SEQ ID NO: 594150 - DNA, 20 bp, mouse
gagtgcggcccctacagcct

SEQ ID NO: 594151 - DNA, 20 bp, mouse
gtaaaatgagccagcccgtg

SEQ ID NO: 594152 - DNA, 20 bp, mouse
gtgaaggccacattacctat

SEQ ID NO: 594153 - DNA, 20 bp, mouse
gtgcctattgccccacgggc

SEQ ID NO: 594154 - DNA, 20 bp, mouse
gaagacgacgagctgcgcgg

SEQ ID NO: 594155 - DNA, 20 bp, mouse
gcaccaggcaccctaggcgg

SEQ ID NO: 594156 - DNA, 20 bp, mouse
gtgagacccgcaggccctag

SEQ ID NO: 594157 - DNA, 20 bp, mouse
ggctccagtctagcgtcctg

SEQ ID NO: 594158 - DNA, 20 bp, mouse
ggcagagccaggcaaccagt

SEQ ID NO: 594159 - DNA, 20 bp, mouse
ggacccgcaggccctagggg

SEQ ID NO: 594160 - DNA, 20 bp, mouse
gggacgctagactggagctt

SEQ ID NO: 594161 - DNA, 20 bp, mouse
gtgggcgtcaacacaaggaa

SEQ ID NO: 594162 - DNA, 20 bp, mouse
gctgccccaggacgctagac

SEQ ID NO: 594163 - DNA, 20 bp, mouse
gaagttgcccagcaacgcca

SEQ ID NO: 594164 - DNA, 20 bp, mouse
gttgcccagcaacgccatgg

SEQ ID NO: 594165 - DNA, 20 bp, mouse
gcgatcgggactgcacagga

SEQ ID NO: 594166 - DNA, 20 bp, mouse
gcatcctctggatcccccca

SEQ ID NO: 594167 - DNA, 20 bp, mouse
gacgtggctggccacaaggt

SEQ ID NO: 594168 - DNA, 20 bp, mouse
gcccgcggcgcagacggact

SEQ ID NO: 594169 - DNA, 20 bp, mouse
ggtagttctgcccagacacg

SEQ ID NO: 594170 - DNA, 20 bp, mouse
gtgtggccagccacgtgtct

SEQ ID NO: 594171 - DNA, 20 bp, mouse
ggcggcgcagacggacttgg

SEQ ID NO: 594172 - DNA, 20 bp, mouse
gccgccgtggggggatccag

SEQ ID NO: 594173 - DNA, 20 bp, mouse
ggacggacttggaggagctt

SEQ ID NO: 594174 - DNA, 20 bp, mouse
gtgggaacccgcggcgcaga

SEQ ID NO: 594175 - DNA, 20 bp, mouse
ggcaggggctcaactaggta

SEQ ID NO: 594176 - DNA, 20 bp, mouse
gcaggagcagctctcaggac

SEQ ID NO: 594177 - DNA, 20 bp, mouse
gtcagccacatgaaaagcac

SEQ ID NO: 594178 - DNA, 20 bp, mouse
gactcccggtgtcctctgag

SEQ ID NO: 594179 - DNA, 20 bp, mouse
gtaggttgctaagtactggg

SEQ ID NO: 594180 - DNA, 20 bp, mouse
gctcctggctcgggctagaa

SEQ ID NO: 594181 - DNA, 20 bp, mouse
gatccccgctcagaggacac

SEQ ID NO: 594182 - DNA, 20 bp, mouse
ggccgcctgggactgtcctc

SEQ ID NO: 594183 - DNA, 20 bp, mouse
gtgagagctgctcctggctc

SEQ ID NO: 594184 - DNA, 20 bp, mouse
ggagtagttactttaagtta

SEQ ID NO: 594185 - DNA, 20 bp, mouse
gttgtaggttgctaagtact

SEQ ID NO: 594186 - DNA, 20 bp, mouse
gctaattttgcatgctttta

SEQ ID NO: 594187 - DNA, 20 bp, mouse
gtttgagtggtggaatacag

SEQ ID NO: 594188 - DNA, 20 bp, mouse
gttaaagaactctaaggtag

SEQ ID NO: 594189 - DNA, 20 bp, mouse
gatattcatgttgaccatgt

SEQ ID NO: 594190 - DNA, 20 bp, mouse
gcattttatctaaaagtata

SEQ ID NO: 594191 - DNA, 20 bp, mouse
gaatgttgcccaaacgtcag

SEQ ID NO: 594192 - DNA, 20 bp, mouse
ggtggattcactagcctaca

SEQ ID NO: 594193 - DNA, 20 bp, mouse
ggcaaaccttgaagaatctt

SEQ ID NO: 594194 - DNA, 20 bp, mouse
gttcaattatttttgagtgg

SEQ ID NO: 594195 - DNA, 20 bp, mouse
gacttctaccactgacgttt

SEQ ID NO: 594196 - DNA, 20 bp, mouse
gcagctaagaagtgtctcca

SEQ ID NO: 594197 - DNA, 20 bp, mouse
gtaagaagtgtctccaaggt

SEQ ID NO: 594198 - DNA, 20 bp, mouse
ggtctccaaggtaggttcct

SEQ ID NO: 594199 - DNA, 20 bp, mouse
gctggcaacacttaatacaa

SEQ ID NO: 594200 - DNA, 20 bp, mouse
gcacttaatacaaaggtata

SEQ ID NO: 594201 - DNA, 20 bp, mouse
gtttgaggggtggaagacta

SEQ ID NO: 594202 - DNA, 20 bp, mouse
gaagaattgtaagaacccta

SEQ ID NO: 594203 - DNA, 20 bp, mouse
gaacattgcttctgagagac

SEQ ID NO: 594204 - DNA, 20 bp, mouse
gagaaccctaaggtagatta

SEQ ID NO: 594205 - DNA, 20 bp, mouse
gggtaggggaacagaggcgg

SEQ ID NO: 594206 - DNA, 20 bp, mouse
gacaggaccaggctcctccg

SEQ ID NO: 594207 - DNA, 20 bp, mouse
gcgcggcaggctgaacaatg

SEQ ID NO: 594208 - DNA, 20 bp, mouse
gggcgcagcgcactccccgc

SEQ ID NO: 594209 - DNA, 20 bp, mouse
gacctgcacgggcgccgcag

SEQ ID NO: 594210 - DNA, 20 bp, mouse
ggcagcagcccggcagacgc

SEQ ID NO: 594211 - DNA, 20 bp, mouse
gtgcacgggcgccgcagcgg

SEQ ID NO: 594212 - DNA, 20 bp, mouse
gccgggggaggccaggagtt

SEQ ID NO: 594213 - DNA, 20 bp, mouse
gggggaggccaggagttagg

SEQ ID NO: 594214 - DNA, 20 bp, mouse
gcgagccccgcaggcgcgga

SEQ ID NO: 594215 - DNA, 20 bp, mouse
ggctgcgggccctcgtgcac

SEQ ID NO: 594216 - DNA, 20 bp, mouse
gtagagaccggcagaccgac

SEQ ID NO: 594217 - DNA, 20 bp, mouse
gagaccggcagaccgacggg

SEQ ID NO: 594218 - DNA, 20 bp, mouse
gcggtagatgcagtagagac

SEQ ID NO: 594219 - DNA, 20 bp, mouse
gtacgttgctgaaccggcct

SEQ ID NO: 594220 - DNA, 20 bp, mouse
gggcgtctgcagcagagtcc

SEQ ID NO: 594221 - DNA, 20 bp, mouse
gccagggtacgttgctgaac

SEQ ID NO: 594222 - DNA, 20 bp, mouse
gaggagtccggatgagtccg

SEQ ID NO: 594223 - DNA, 20 bp, mouse
gcggatgagtccggggaagg

SEQ ID NO: 594224 - DNA, 20 bp, mouse
gaaacctggatgtctggaca

SEQ ID NO: 594225 - DNA, 20 bp, mouse
gctgaaccggcctgggctcc

SEQ ID NO: 594226 - DNA, 20 bp, mouse
gaggcagctcggctagaacg

SEQ ID NO: 594227 - DNA, 20 bp, mouse
ggctgcaggcagaaccccac

SEQ ID NO: 594228 - DNA, 20 bp, mouse
gcaggcagaaccccacaggt

SEQ ID NO: 594229 - DNA, 20 bp, mouse
gtctatgaagagggccagta

SEQ ID NO: 594230 - DNA, 20 bp, mouse
gaaggtcacccaattccatt

SEQ ID NO: 594231 - DNA, 20 bp, mouse
ggactgaagtgggtaaggta

SEQ ID NO: 594232 - DNA, 20 bp, mouse
gccacaggtaggaaaagttg

SEQ ID NO: 594233 - DNA, 20 bp, mouse
gtacgggaagtagttagaaa

SEQ ID NO: 594234 - DNA, 20 bp, mouse
ggaagagggccagtagggag

SEQ ID NO: 594235 - DNA, 20 bp, mouse
gcactctgtacctgacctca

SEQ ID NO: 594236 - DNA, 20 bp, mouse
gtcggacagcgggcagaacg

SEQ ID NO: 594237 - DNA, 20 bp, mouse
gacggctccatggccgagtg

SEQ ID NO: 594238 - DNA, 20 bp, mouse
gccgagtggggcacaccgat

SEQ ID NO: 594239 - DNA, 20 bp, mouse
ggggcacaccgatcggacag

SEQ ID NO: 594240 - DNA, 20 bp, mouse
ggctgcagcgggacaaccag

SEQ ID NO: 594241 - DNA, 20 bp, mouse
ggctgcacgaggacatgcag

SEQ ID NO: 594242 - DNA, 20 bp, mouse
ggagagatccgcagctcctt

SEQ ID NO: 594243 - DNA, 20 bp, mouse
gcggcccgccagtcgtccca

SEQ ID NO: 594244 - DNA, 20 bp, mouse
ggcgctgggccgctacgagg

SEQ ID NO: 594245 - DNA, 20 bp, mouse
gcgcagctccttgggacgac

SEQ ID NO: 594246 - DNA, 20 bp, mouse
gccacgccgcgaacacgcca

SEQ ID NO: 594247 - DNA, 20 bp, mouse
gcgccacggcaggactcact

SEQ ID NO: 594248 - DNA, 20 bp, mouse
gaccggctgtgtgctgagtg

SEQ ID NO: 594249 - DNA, 20 bp, mouse
ggacatagcggtaacgctcc

SEQ ID NO: 594250 - DNA, 20 bp, mouse
gtcgcgggcccatctaaaga

SEQ ID NO: 594251 - DNA, 20 bp, mouse
gcccgcgagagagcagccgt

SEQ ID NO: 594252 - DNA, 20 bp, mouse
gctccagacggcccgcccca

SEQ ID NO: 594253 - DNA, 20 bp, mouse
gcgccgcgcgacacttccgg

SEQ ID NO: 594254 - DNA, 20 bp, mouse
ggcggtaacgctccgggtcc

SEQ ID NO: 594255 - DNA, 20 bp, mouse
gtctaaagagggagccaacc

SEQ ID NO: 594256 - DNA, 20 bp, mouse
gtgtgcaggtgagggagtag

SEQ ID NO: 594257 - DNA, 20 bp, mouse
gtccgcgccaggacgaagaa

SEQ ID NO: 594258 - DNA, 20 bp, mouse
gtctctgggaagggcggtgg

SEQ ID NO: 594259 - DNA, 20 bp, mouse
gggggagcttgtgcaggtga

SEQ ID NO: 594260 - DNA, 20 bp, mouse
gaaggaagcggaagctgcat

SEQ ID NO: 594261 - DNA, 20 bp, mouse
gggctctcggagttccggag

SEQ ID NO: 594262 - DNA, 20 bp, mouse
gggggctggatctctgggaa

SEQ ID NO: 594263 - DNA, 20 bp, mouse
gcacagagcggctacctctc

SEQ ID NO: 594264 - DNA, 20 bp, mouse
gagtagggggctggatctct

SEQ ID NO: 594265 - DNA, 20 bp, mouse
ggctagccgctgtcccttgt

SEQ ID NO: 594266 - DNA, 20 bp, mouse
ggctgtggagtggattatag

SEQ ID NO: 594267 - DNA, 20 bp, mouse
gctccacagcttacagaaca

SEQ ID NO: 594268 - DNA, 20 bp, mouse
ggggttggaggacaccacat

SEQ ID NO: 594269 - DNA, 20 bp, mouse
gcttctgtggtgccgggtgt

SEQ ID NO: 594270 - DNA, 20 bp, mouse
gctactgtggagatattctc

SEQ ID NO: 594271 - DNA, 20 bp, mouse
gtgtggccttcaagtaccac

SEQ ID NO: 594272 - DNA, 20 bp, mouse
ggacagaacaggattaagtg

SEQ ID NO: 594273 - DNA, 20 bp, mouse
gggcactaagccaagcagga

SEQ ID NO: 594274 - DNA, 20 bp, mouse
ggggactgatacccaggtct

SEQ ID NO: 594275 - DNA, 20 bp, mouse
ggacggttaggtggcatgta

SEQ ID NO: 594276 - DNA, 20 bp, mouse
gcgtccggctgcgagcgcgg

SEQ ID NO: 594277 - DNA, 20 bp, mouse
gcgggcgcgcgcagctcggg

SEQ ID NO: 594278 - DNA, 20 bp, mouse
ggcgttgggccggagaccac

SEQ ID NO: 594279 - DNA, 20 bp, mouse
gcgccgccaggagccgcccc

SEQ ID NO: 594280 - DNA, 20 bp, mouse
gggccgggccggcaaggcgg

SEQ ID NO: 594281 - DNA, 20 bp, mouse
gcagggccgggccggcaagg

SEQ ID NO: 594282 - DNA, 20 bp, mouse
ggagccgccgcgctcgcagc

SEQ ID NO: 594283 - DNA, 20 bp, mouse
gcggaagcagcgagggcggc

SEQ ID NO: 594284 - DNA, 20 bp, mouse
gcgtggccgtaaccttgagg

SEQ ID NO: 594285 - DNA, 20 bp, mouse
gggtccctgggacagtctag

SEQ ID NO: 594286 - DNA, 20 bp, mouse
gcggctgcggccccaggacc

SEQ ID NO: 594287 - DNA, 20 bp, mouse
gtctcagacaagagggcggg

SEQ ID NO: 594288 - DNA, 20 bp, mouse
ggacggtgcgaagtctgctg

SEQ ID NO: 594289 - DNA, 20 bp, mouse
gcgggttctctcagacaaga

SEQ ID NO: 594290 - DNA, 20 bp, mouse
gcagacaagagggcgggcgg

SEQ ID NO: 594291 - DNA, 20 bp, mouse
gttctctcagacaagagggc

SEQ ID NO: 594292 - DNA, 20 bp, mouse
gcccgggccacacaacaaag

SEQ ID NO: 594293 - DNA, 20 bp, mouse
gctgagagaacccggtcctg

SEQ ID NO: 594294 - DNA, 20 bp, mouse
gcccaggagccgacgagtgg

SEQ ID NO: 594295 - DNA, 20 bp, mouse
ggcctcgcggcaccgagaag

SEQ ID NO: 594296 - DNA, 20 bp, mouse
gggcagcatggagaacgtgg

SEQ ID NO: 594297 - DNA, 20 bp, mouse
gagagtctgtcaggccttcg

SEQ ID NO: 594298 - DNA, 20 bp, mouse
gataggcagcatggagaacg

SEQ ID NO: 594299 - DNA, 20 bp, mouse
ggcagcaaggacaagaggct

SEQ ID NO: 594300 - DNA, 20 bp, mouse
gcttccgagggcaaaggcag

SEQ ID NO: 594301 - DNA, 20 bp, mouse
gtcttcacttccgagggcaa

SEQ ID NO: 594302 - DNA, 20 bp, mouse
gtggaggtcttcacttccga

SEQ ID NO: 594303 - DNA, 20 bp, mouse
ggagccaagctcttaagttc

SEQ ID NO: 594304 - DNA, 20 bp, mouse
gaaatagcagcaaggacaag

SEQ ID NO: 594305 - DNA, 20 bp, mouse
gaaggctacgaaggagttct

SEQ ID NO: 594306 - DNA, 20 bp, mouse
ggcctcggcgcgcatgctgg

SEQ ID NO: 594307 - DNA, 20 bp, mouse
gcgctgcggcccttccacgt

SEQ ID NO: 594308 - DNA, 20 bp, mouse
gacgcgcgtcacgggaggga

SEQ ID NO: 594309 - DNA, 20 bp, mouse
ggcttctgcagtgcgggcaa

SEQ ID NO: 594310 - DNA, 20 bp, mouse
gggaggtcgcccacgtggaa

SEQ ID NO: 594311 - DNA, 20 bp, mouse
ggggcacgcgcgtcacggga

SEQ ID NO: 594312 - DNA, 20 bp, mouse
gaagcgctccaggccgccgc

SEQ ID NO: 594313 - DNA, 20 bp, mouse
gggcgaagcagcactcgcag

SEQ ID NO: 594314 - DNA, 20 bp, mouse
gccacggagcccagtctcat

SEQ ID NO: 594315 - DNA, 20 bp, mouse
gctgcagtgcgggcaagggc

SEQ ID NO: 594316 - DNA, 20 bp, mouse
ggcagttcggatctgaggtg

SEQ ID NO: 594317 - DNA, 20 bp, mouse
ggatctgaggtgtggatctg

SEQ ID NO: 594318 - DNA, 20 bp, mouse
gtggatctgaggaaggatgg

SEQ ID NO: 594319 - DNA, 20 bp, mouse
ggggacgcagttcggatctg

SEQ ID NO: 594320 - DNA, 20 bp, mouse
gctgtgtgcaaggggagtcg

SEQ ID NO: 594321 - DNA, 20 bp, mouse
ggttccgtacgtaccccagt

SEQ ID NO: 594322 - DNA, 20 bp, mouse
gaacacgagactcaagctga

SEQ ID NO: 594323 - DNA, 20 bp, mouse
gcaagctgagggacgcagtt

SEQ ID NO: 594324 - DNA, 20 bp, mouse
ggtaagccaaggggtcggag

SEQ ID NO: 594325 - DNA, 20 bp, mouse
gctgcctactggggtacgta

SEQ ID NO: 594326 - DNA, 20 bp, mouse
ggtctgtccgccaaaggact

SEQ ID NO: 594327 - DNA, 20 bp, mouse
gaagttccgacagctggcgg

SEQ ID NO: 594328 - DNA, 20 bp, mouse
gctttggcggacagacagaa

SEQ ID NO: 594329 - DNA, 20 bp, mouse
gcagacagaatggcaaccca

SEQ ID NO: 594330 - DNA, 20 bp, mouse
ggcaaagttccgacagctgg

SEQ ID NO: 594331 - DNA, 20 bp, mouse
gccttgcggccacaactctc

SEQ ID NO: 594332 - DNA, 20 bp, mouse
gagtagcaccgcgctgacac

SEQ ID NO: 594333 - DNA, 20 bp, mouse
gctttgcccgcccagtcctt

SEQ ID NO: 594334 - DNA, 20 bp, mouse
gaacagtcggagctctcccc

SEQ ID NO: 594335 - DNA, 20 bp, mouse
gagagctccgactgttccct

SEQ ID NO: 594336 - DNA, 20 bp, mouse
gagaggcgtgcccaagatgg

SEQ ID NO: 594337 - DNA, 20 bp, mouse
ggagaacacgtcgcacatgg

SEQ ID NO: 594338 - DNA, 20 bp, mouse
ggacggggtcaagggtcaga

SEQ ID NO: 594339 - DNA, 20 bp, mouse
gcggacttccacggaacccc

SEQ ID NO: 594340 - DNA, 20 bp, mouse
gtccttctgcgtgggcgtgg

SEQ ID NO: 594341 - DNA, 20 bp, mouse
ggaccgtgcccggggttccg

SEQ ID NO: 594342 - DNA, 20 bp, mouse
ggcccaagcagcaaccagac

SEQ ID NO: 594343 - DNA, 20 bp, mouse
gtccgccacgcccacgcaga

SEQ ID NO: 594344 - DNA, 20 bp, mouse
gttccacggaaccccgggca

SEQ ID NO: 594345 - DNA, 20 bp, mouse
gtccacataacggacttcca

SEQ ID NO: 594346 - DNA, 20 bp, mouse
gagagcgacctaggtagtcg

SEQ ID NO: 594347 - DNA, 20 bp, mouse
gtcaccgggtcgcgcaaggt

SEQ ID NO: 594348 - DNA, 20 bp, mouse
gctaggtagtcggggtcacc

SEQ ID NO: 594349 - DNA, 20 bp, mouse
gggatcccaagggtgctggg

SEQ ID NO: 594350 - DNA, 20 bp, mouse
ggctaggggatcgtagtgtg

SEQ ID NO: 594351 - DNA, 20 bp, mouse
gcggctgggggggatcccaa

SEQ ID NO: 594352 - DNA, 20 bp, mouse
ggggatcgtagtgtgcggcc

SEQ ID NO: 594353 - DNA, 20 bp, mouse
gccgggagttgaagactcga

SEQ ID NO: 594354 - DNA, 20 bp, mouse
gctaccgaccttgcgcgacc

SEQ ID NO: 594355 - DNA, 20 bp, mouse
gctggggggaggtgagaatc

SEQ ID NO: 594356 - DNA, 20 bp, mouse
ggggagccgggtgacttcag

SEQ ID NO: 594357 - DNA, 20 bp, mouse
gcatcgcggtggctcaggtg

SEQ ID NO: 594358 - DNA, 20 bp, mouse
gcggtcctatagcatcgcgg

SEQ ID NO: 594359 - DNA, 20 bp, mouse
gcggcggtcctatagcatcg

SEQ ID NO: 594360 - DNA, 20 bp, mouse
gctcaggtgcggcgggggac

SEQ ID NO: 594361 - DNA, 20 bp, mouse
gagaggagctcagtcgggca

SEQ ID NO: 594362 - DNA, 20 bp, mouse
gaggcgcctctgaagtcacc

SEQ ID NO: 594363 - DNA, 20 bp, mouse
gaaggcgcctccccgcccag

SEQ ID NO: 594364 - DNA, 20 bp, mouse
gcgcgggcggataacggtcc

SEQ ID NO: 594365 - DNA, 20 bp, mouse
gccgcccagaggagctcagt

SEQ ID NO: 594366 - DNA, 20 bp, mouse
ggtaatcccgctgcaggctc

SEQ ID NO: 594367 - DNA, 20 bp, mouse
gatggtcccctcccgagagc

SEQ ID NO: 594368 - DNA, 20 bp, mouse
gactctgcctgctctcggga

SEQ ID NO: 594369 - DNA, 20 bp, mouse
gggcaggtgcgagaagggtc

SEQ ID NO: 594370 - DNA, 20 bp, mouse
gcggccggcaggtgcgagaa

SEQ ID NO: 594371 - DNA, 20 bp, mouse
ggctagactctgcctgctct

SEQ ID NO: 594372 - DNA, 20 bp, mouse
ggagagctccggggagatct

SEQ ID NO: 594373 - DNA, 20 bp, mouse
ggtccgcagggagagctccg

SEQ ID NO: 594374 - DNA, 20 bp, mouse
gtcacagggtccccaactac

SEQ ID NO: 594375 - DNA, 20 bp, mouse
gcagtcggtaatcccgctgc

SEQ ID NO: 594376 - DNA, 20 bp, mouse
gtagagtccgagaactgtgg

SEQ ID NO: 594377 - DNA, 20 bp, mouse
gttccagaagcctcacccgg

SEQ ID NO: 594378 - DNA, 20 bp, mouse
ggactctagaagatcggaca

SEQ ID NO: 594379 - DNA, 20 bp, mouse
gtggccggagccgccgggtg

SEQ ID NO: 594380 - DNA, 20 bp, mouse
gttctagagtccgagaactg

SEQ ID NO: 594381 - DNA, 20 bp, mouse
ggtccgagaactgtggaggc

SEQ ID NO: 594382 - DNA, 20 bp, mouse
ggcgcgagccctcgcaggaa

SEQ ID NO: 594383 - DNA, 20 bp, mouse
gactttccagaagcctcacc

SEQ ID NO: 594384 - DNA, 20 bp, mouse
gcgagccctcgcaggaaggg

SEQ ID NO: 594385 - DNA, 20 bp, mouse
gtgaggggagaagagagctc

SEQ ID NO: 594386 - DNA, 20 bp, mouse
gaggagccgccgggtaggga

SEQ ID NO: 594387 - DNA, 20 bp, mouse
gtgaagaagaaacctcgggg

SEQ ID NO: 594388 - DNA, 20 bp, mouse
gacagctccagacctccccg

SEQ ID NO: 594389 - DNA, 20 bp, mouse
gagtggaggagccgccgggt

SEQ ID NO: 594390 - DNA, 20 bp, mouse
gaagaaacctcggggaggtc

SEQ ID NO: 594391 - DNA, 20 bp, mouse
gcagccccaggcgagagtct

SEQ ID NO: 594392 - DNA, 20 bp, mouse
gcattgaagaagaaacctcg

SEQ ID NO: 594393 - DNA, 20 bp, mouse
gtatttacccaggctcactt

SEQ ID NO: 594394 - DNA, 20 bp, mouse
ggaacggccatctttgatga

SEQ ID NO: 594395 - DNA, 20 bp, mouse
ggcaagagtggaggagccgc

SEQ ID NO: 594396 - DNA, 20 bp, mouse
gccggcgggcggattcactg

SEQ ID NO: 594397 - DNA, 20 bp, mouse
gggagtcgatagcccagcgc

SEQ ID NO: 594398 - DNA, 20 bp, mouse
ggcctccagagccaacccgg

SEQ ID NO: 594399 - DNA, 20 bp, mouse
ggacaaggacctgctggtac

SEQ ID NO: 594400 - DNA, 20 bp, mouse
ggacctgctggtactggcag

SEQ ID NO: 594401 - DNA, 20 bp, mouse
gccccgacgcgcccattgac

SEQ ID NO: 594402 - DNA, 20 bp, mouse
gcccaggctcacctcggaag

SEQ ID NO: 594403 - DNA, 20 bp, mouse
gagccaacccggcggcggag

SEQ ID NO: 594404 - DNA, 20 bp, mouse
gcggcctgcacctaggaagc

SEQ ID NO: 594405 - DNA, 20 bp, mouse
gtcgatagcccagcgccggc

SEQ ID NO: 594406 - DNA, 20 bp, mouse
ggagcacgcagaagacgcaa

SEQ ID NO: 594407 - DNA, 20 bp, mouse
gcgcggtagcagctcacctg

SEQ ID NO: 594408 - DNA, 20 bp, mouse
gagctgctggcgtctctgtc

SEQ ID NO: 594409 - DNA, 20 bp, mouse
gtgctggcgtctctgtctgg

SEQ ID NO: 594410 - DNA, 20 bp, mouse
ggcagctcacctgaggcaag

SEQ ID NO: 594411 - DNA, 20 bp, mouse
gacgcaatggcacgctccac

SEQ ID NO: 594412 - DNA, 20 bp, mouse
gcggagcccgccaccgacac

SEQ ID NO: 594413 - DNA, 20 bp, mouse
gcgtacaagcgctcgccgag

SEQ ID NO: 594414 - DNA, 20 bp, mouse
gccgcgcagctagccagtac

SEQ ID NO: 594415 - DNA, 20 bp, mouse
ggggcggtcaggatccgcgg

SEQ ID NO: 594416 - DNA, 20 bp, mouse
ggccgagcgctagagagacg

SEQ ID NO: 594417 - DNA, 20 bp, mouse
ggcccgactatagggatgga

SEQ ID NO: 594418 - DNA, 20 bp, mouse
ggattcgagggataatccta

SEQ ID NO: 594419 - DNA, 20 bp, mouse
gccaggacccggggattcga

SEQ ID NO: 594420 - DNA, 20 bp, mouse
gaggcgctccagctgaggtg

SEQ ID NO: 594421 - DNA, 20 bp, mouse
gcagccccaggacagaaagg

SEQ ID NO: 594422 - DNA, 20 bp, mouse
gccgcagccccaggacagaa

SEQ ID NO: 594423 - DNA, 20 bp, mouse
gaaagccgcggctccgaggg

SEQ ID NO: 594424 - DNA, 20 bp, mouse
ggggaccgcggagctgagac

SEQ ID NO: 594425 - DNA, 20 bp, mouse
gatccgactggagaagggtg

SEQ ID NO: 594426 - DNA, 20 bp, mouse
ggcgccgggacccgtcccac

SEQ ID NO: 594427 - DNA, 20 bp, mouse
ggttccccacaggagagaca

SEQ ID NO: 594428 - DNA, 20 bp, mouse
gcggtgctacagggccttct

SEQ ID NO: 594429 - DNA, 20 bp, mouse
ggcattggggaagccgggtc

SEQ ID NO: 594430 - DNA, 20 bp, mouse
ggagacagggtaggaggacg

SEQ ID NO: 594431 - DNA, 20 bp, mouse
ggctcactctctcccggacc

SEQ ID NO: 594432 - DNA, 20 bp, mouse
gtgagcatggggactcctgc

SEQ ID NO: 594433 - DNA, 20 bp, mouse
gagttccagcgcccgtggga

SEQ ID NO: 594434 - DNA, 20 bp, mouse
gtgcaggctgcgttccccac

SEQ ID NO: 594435 - DNA, 20 bp, mouse
gcaacagttccagcgcccgt

SEQ ID NO: 594436 - DNA, 20 bp, mouse
ggaagccaccgcagagacgg

SEQ ID NO: 594437 - DNA, 20 bp, mouse
gggaccctccgccgtctctg

SEQ ID NO: 594438 - DNA, 20 bp, mouse
gccctccgccgtctctgcgg

SEQ ID NO: 594439 - DNA, 20 bp, mouse
gctctgcggtggcttcatag

SEQ ID NO: 594440 - DNA, 20 bp, mouse
gtccgtagccccgcccacta

SEQ ID NO: 594441 - DNA, 20 bp, mouse
ggggtcccagcacgctacgt

SEQ ID NO: 594442 - DNA, 20 bp, mouse
ggcttcatagcgggacactg

SEQ ID NO: 594443 - DNA, 20 bp, mouse
gtagatgccgcatctcgcgg

SEQ ID NO: 594444 - DNA, 20 bp, mouse
gggtgaagccctggtgctgg

SEQ ID NO: 594445 - DNA, 20 bp, mouse
ggctacgtaggtgaagctac

SEQ ID NO: 594446 - DNA, 20 bp, mouse
gacatggcggaggacctgca

SEQ ID NO: 594447 - DNA, 20 bp, mouse
ggagcagccgaccgacggag

SEQ ID NO: 594448 - DNA, 20 bp, mouse
ggggatcgtggctgacatgg

SEQ ID NO: 594449 - DNA, 20 bp, mouse
gcagccgagcagccgaccga

SEQ ID NO: 594450 - DNA, 20 bp, mouse
ggaagggatcgtggctgaca

SEQ ID NO: 594451 - DNA, 20 bp, mouse
gatcgtggctgacatggcgg

SEQ ID NO: 594452 - DNA, 20 bp, mouse
gactggggactgggtgctgt

SEQ ID NO: 594453 - DNA, 20 bp, mouse
gctgcagtagccagcgatct

SEQ ID NO: 594454 - DNA, 20 bp, mouse
ggctgctgtggctcgcactg

SEQ ID NO: 594455 - DNA, 20 bp, mouse
gtgtggctcgcactggggac

SEQ ID NO: 594456 - DNA, 20 bp, mouse
gacagctggcatcatcgccc

SEQ ID NO: 594457 - DNA, 20 bp, mouse
gagcagtcgcggaagtcagt

SEQ ID NO: 594458 - DNA, 20 bp, mouse
ggatctgcgtgtggtcgccc

SEQ ID NO: 594459 - DNA, 20 bp, mouse
gccgccaatcctcaccttct

SEQ ID NO: 594460 - DNA, 20 bp, mouse
gtagaagcatgatctgcgtg

SEQ ID NO: 594461 - DNA, 20 bp, mouse
ggttaggccttagaagggac

SEQ ID NO: 594462 - DNA, 20 bp, mouse
gcagctaggggacctcggct

SEQ ID NO: 594463 - DNA, 20 bp, mouse
gcaggcgttgtgtccaggag

SEQ ID NO: 594464 - DNA, 20 bp, mouse
gctcaccagctaggggacct

SEQ ID NO: 594465 - DNA, 20 bp, mouse
ggaagtcagtaggcttgcac

SEQ ID NO: 594466 - DNA, 20 bp, mouse
gagtagaaggcagcgcccta

SEQ ID NO: 594467 - DNA, 20 bp, mouse
gaggcagcgccctaaggaag

SEQ ID NO: 594468 - DNA, 20 bp, mouse
gctgcaggagctccgcaagg

SEQ ID NO: 594469 - DNA, 20 bp, mouse
gaccctgctgcgtctaaagg

SEQ ID NO: 594470 - DNA, 20 bp, mouse
gtcaccgcgcgcctagtaga

SEQ ID NO: 594471 - DNA, 20 bp, mouse
gagcgccctaaggaagtgga

SEQ ID NO: 594472 - DNA, 20 bp, mouse
ggaaaccctgctgcgtctaa

SEQ ID NO: 594473 - DNA, 20 bp, mouse
ggggatgttgagtcgactgc

SEQ ID NO: 594474 - DNA, 20 bp, mouse
gatccctggtcagcactcat

SEQ ID NO: 594475 - DNA, 20 bp, mouse
ggccgcctttagacgcagca

SEQ ID NO: 594476 - DNA, 20 bp, mouse
gcggcaggctgagggcgtca

SEQ ID NO: 594477 - DNA, 20 bp, mouse
ggcgtcagggcagttcgcga

SEQ ID NO: 594478 - DNA, 20 bp, mouse
ggagttcccggcgaccctcg

SEQ ID NO: 594479 - DNA, 20 bp, mouse
gtcaggggccgggaccccag

SEQ ID NO: 594480 - DNA, 20 bp, mouse
gacagcagcggaaccagccg

SEQ ID NO: 594481 - DNA, 20 bp, mouse
ggaccctcgcggcaggctga

SEQ ID NO: 594482 - DNA, 20 bp, mouse
gtagggaactggctttgtag

SEQ ID NO: 594483 - DNA, 20 bp, mouse
gggttccgctgctgtgtcag

SEQ ID NO: 594484 - DNA, 20 bp, mouse
gctctcgcggtgcacagcgg

SEQ ID NO: 594485 - DNA, 20 bp, mouse
gtgcaggaccgggttgctgg

SEQ ID NO: 594486 - DNA, 20 bp, mouse
gcaatgaaagaggcaagggc

SEQ ID NO: 594487 - DNA, 20 bp, mouse
ggggcgacgtgaaggagcca

SEQ ID NO: 594488 - DNA, 20 bp, mouse
gtgtgtgcggagccaggcaa

SEQ ID NO: 594489 - DNA, 20 bp, mouse
ggctccacgcagccagaagt

SEQ ID NO: 594490 - DNA, 20 bp, mouse
ggcggagccaggcaatggag

SEQ ID NO: 594491 - DNA, 20 bp, mouse
gcggtaagtacctgtagatg

SEQ ID NO: 594492 - DNA, 20 bp, mouse
gaggtcgaagaagcaggggg

SEQ ID NO: 594493 - DNA, 20 bp, mouse
gagagggagcacacaccctt

SEQ ID NO: 594494 - DNA, 20 bp, mouse
gtgcaaaggggagccgacta

SEQ ID NO: 594495 - DNA, 20 bp, mouse
gctagccggagcaaagagcc

SEQ ID NO: 594496 - DNA, 20 bp, mouse
ggcgcgggcggggacacccg

SEQ ID NO: 594497 - DNA, 20 bp, mouse
gcgggcggggacacccgggg

SEQ ID NO: 594498 - DNA, 20 bp, mouse
ggcaccccgggccccccaac

SEQ ID NO: 594499 - DNA, 20 bp, mouse
ggcggcgggcgcaggagacc

SEQ ID NO: 594500 - DNA, 20 bp, mouse
ggcgggcgcaggagacccgg

SEQ ID NO: 594501 - DNA, 20 bp, mouse
ggccccgctacgtcacaatg

SEQ ID NO: 594502 - DNA, 20 bp, mouse
gacgtcacaatgcggccggg

SEQ ID NO: 594503 - DNA, 20 bp, mouse
gggacagacggcgagagcgg

SEQ ID NO: 594504 - DNA, 20 bp, mouse
ggacggacagacggcgagag

SEQ ID NO: 594505 - DNA, 20 bp, mouse
gcccgcgcgcgcccgttggg

SEQ ID NO: 594506 - DNA, 20 bp, mouse
ggcgcgagtagcatccttgg

SEQ ID NO: 594507 - DNA, 20 bp, mouse
gactgccctgggagaaacgt

SEQ ID NO: 594508 - DNA, 20 bp, mouse
gagcgcgcgagtagcatcct

SEQ ID NO: 594509 - DNA, 20 bp, mouse
gcggccccgaaacccaggtg

SEQ ID NO: 594510 - DNA, 20 bp, mouse
gggctcctgctccggcgctg

SEQ ID NO: 594511 - DNA, 20 bp, mouse
gtctttccggagcctcacct

SEQ ID NO: 594512 - DNA, 20 bp, mouse
gaccgaactggggatccagg

SEQ ID NO: 594513 - DNA, 20 bp, mouse
gtccccctggatccccagtt

SEQ ID NO: 594514 - DNA, 20 bp, mouse
gcagcccggccccgaaaccc

SEQ ID NO: 594515 - DNA, 20 bp, mouse
gtagaagcgcatggacactc

SEQ ID NO: 594516 - DNA, 20 bp, mouse
gacctggctgctgcaagcta

SEQ ID NO: 594517 - DNA, 20 bp, mouse
ggctgctgcaagctatggac

SEQ ID NO: 594518 - DNA, 20 bp, mouse
ggcagcagagacagcggctg

SEQ ID NO: 594519 - DNA, 20 bp, mouse
gaccaagcagggagtaacgg

SEQ ID NO: 594520 - DNA, 20 bp, mouse
gtgtttgcaaggatggaacc

SEQ ID NO: 594521 - DNA, 20 bp, mouse
ggagtgccacacctacgtgt

SEQ ID NO: 594522 - DNA, 20 bp, mouse
gagggtggaggggtccctaa

SEQ ID NO: 594523 - DNA, 20 bp, mouse
gtgggggaatctgcagaggg

SEQ ID NO: 594524 - DNA, 20 bp, mouse
gggcagaatagagccagtag

SEQ ID NO: 594525 - DNA, 20 bp, mouse
gctccaggttaggagactcc

SEQ ID NO: 594526 - DNA, 20 bp, mouse
ggcaggcgacaggctaccgt

SEQ ID NO: 594527 - DNA, 20 bp, mouse
ggcgcacactagaacaccag

SEQ ID NO: 594528 - DNA, 20 bp, mouse
gcttctgtccagcccaccga

SEQ ID NO: 594529 - DNA, 20 bp, mouse
ggcgacaggctaccgtcggt

SEQ ID NO: 594530 - DNA, 20 bp, mouse
gtaggtggagagtgaggaag

SEQ ID NO: 594531 - DNA, 20 bp, mouse
gtgggctggacagaagcgcc

SEQ ID NO: 594532 - DNA, 20 bp, mouse
gctagaacaccagcgggact

SEQ ID NO: 594533 - DNA, 20 bp, mouse
gcggcgagtagaacgtgtgg

SEQ ID NO: 594534 - DNA, 20 bp, mouse
ggcttgcagcgacaaggagc

SEQ ID NO: 594535 - DNA, 20 bp, mouse
ggccatgtgtggagctggaa

SEQ ID NO: 594536 - DNA, 20 bp, mouse
gagacccgcgcagcttagga

SEQ ID NO: 594537 - DNA, 20 bp, mouse
ggtgccgaacgggtagaagt

SEQ ID NO: 594538 - DNA, 20 bp, mouse
gccccgaagcaggacgacgg

SEQ ID NO: 594539 - DNA, 20 bp, mouse
gggagtgcgacgcgagctag

SEQ ID NO: 594540 - DNA, 20 bp, mouse
gtagaagtcggcgagggcca

SEQ ID NO: 594541 - DNA, 20 bp, mouse
gagtaaccccgagctcgagg

SEQ ID NO: 594542 - DNA, 20 bp, mouse
gaaggcgtgaggcacgactg

SEQ ID NO: 594543 - DNA, 20 bp, mouse
gcggcgccgaagaacggaaa

SEQ ID NO: 594544 - DNA, 20 bp, mouse
gcgcagcttaggaaggcgtg

SEQ ID NO: 594545 - DNA, 20 bp, mouse
ggcggcagcggcaagagttg

SEQ ID NO: 594546 - DNA, 20 bp, mouse
gggcgacagaacctgggacg

SEQ ID NO: 594547 - DNA, 20 bp, mouse
gctgtcgccagctcccaaca

SEQ ID NO: 594548 - DNA, 20 bp, mouse
ggtttctccggagcccaggg

SEQ ID NO: 594549 - DNA, 20 bp, mouse
gcggcacccggcttccgtgt

SEQ ID NO: 594550 - DNA, 20 bp, mouse
gggcgcgctcaaatgacgca

SEQ ID NO: 594551 - DNA, 20 bp, mouse
gagctggggtcggggctgcg

SEQ ID NO: 594552 - DNA, 20 bp, mouse
gggagaattcagtgtctcga

SEQ ID NO: 594553 - DNA, 20 bp, mouse
gcggcttccgtgttgggagc

SEQ ID NO: 594554 - DNA, 20 bp, mouse
gagcgcgaaagaagccggga

SEQ ID NO: 594555 - DNA, 20 bp, mouse
ggccaagaagaaactcgcag

SEQ ID NO: 594556 - DNA, 20 bp, mouse
gcctgctaggcaagtcacct

SEQ ID NO: 594557 - DNA, 20 bp, mouse
gcccaggagccgggaagcta

SEQ ID NO: 594558 - DNA, 20 bp, mouse
gtccggttaaagaagactgg

SEQ ID NO: 594559 - DNA, 20 bp, mouse
gagactggaggtcttggaag

SEQ ID NO: 594560 - DNA, 20 bp, mouse
gtaaagaagactggaggtct

SEQ ID NO: 594561 - DNA, 20 bp, mouse
gcttaggggagggagccggt

SEQ ID NO: 594562 - DNA, 20 bp, mouse
ggcccaccgaccctgcaagg

SEQ ID NO: 594563 - DNA, 20 bp, mouse
gggaggtccatagctctcaa

SEQ ID NO: 594564 - DNA, 20 bp, mouse
gttatccggttaaagaagac

SEQ ID NO: 594565 - DNA, 20 bp, mouse
gttacgcccagccttagggg

SEQ ID NO: 594566 - DNA, 20 bp, mouse
ggtgcaagtgactctcggtc

SEQ ID NO: 594567 - DNA, 20 bp, mouse
gggaccgtgcaagtgactct

SEQ ID NO: 594568 - DNA, 20 bp, mouse
gcggtcgggccgcaggatga

SEQ ID NO: 594569 - DNA, 20 bp, mouse
gtcgggccgcaggatgaagg

SEQ ID NO: 594570 - DNA, 20 bp, mouse
gagctgtccgtcacttccta

SEQ ID NO: 594571 - DNA, 20 bp, mouse
gcttgagccgtaggaagtga

SEQ ID NO: 594572 - DNA, 20 bp, mouse
ggaaggcggggaaaagcgag

SEQ ID NO: 594573 - DNA, 20 bp, mouse
gtttccccgccttcatcctg

SEQ ID NO: 594574 - DNA, 20 bp, mouse
ggctcccgcggtgacccgag

SEQ ID NO: 594575 - DNA, 20 bp, mouse
gaagcgagccggtgattggg

SEQ ID NO: 594576 - DNA, 20 bp, mouse
ggccagagcccgatcagcag

SEQ ID NO: 594577 - DNA, 20 bp, mouse
ggcgtctggcgagggctccg

SEQ ID NO: 594578 - DNA, 20 bp, mouse
ggggctctggcgtctggcga

SEQ ID NO: 594579 - DNA, 20 bp, mouse
ggagggctccgcggccgacc

SEQ ID NO: 594580 - DNA, 20 bp, mouse
gcgacatggtcagcagggat

SEQ ID NO: 594581 - DNA, 20 bp, mouse
gagcgccccgcccccaatca

SEQ ID NO: 594582 - DNA, 20 bp, mouse
ggctccgcggccgacccggc

SEQ ID NO: 594583 - DNA, 20 bp, mouse
gctgatcgggctctggcgtc

SEQ ID NO: 594584 - DNA, 20 bp, mouse
ggcgccagccgggtcggccg

SEQ ID NO: 594585 - DNA, 20 bp, mouse
ggccgacccggctggcgcgc

SEQ ID NO: 594586 - DNA, 20 bp, mouse
gcccgagccccagctgaagg

SEQ ID NO: 594587 - DNA, 20 bp, mouse
gcccagctgaaggtggctag

SEQ ID NO: 594588 - DNA, 20 bp, mouse
gaatccggctgccctcctgg

SEQ ID NO: 594589 - DNA, 20 bp, mouse
gtctcccgagccccagctga

SEQ ID NO: 594590 - DNA, 20 bp, mouse
gggggctcgggagagcaatc

SEQ ID NO: 594591 - DNA, 20 bp, mouse
gcccaggagtgcaactgcgg

SEQ ID NO: 594592 - DNA, 20 bp, mouse
gtcacctgcgaaggcttcca

SEQ ID NO: 594593 - DNA, 20 bp, mouse
gccgcagcccgcaagctcgg

SEQ ID NO: 594594 - DNA, 20 bp, mouse
ggagctgccctagcccgcgg

SEQ ID NO: 594595 - DNA, 20 bp, mouse
gcaggagctgccctagcccg

SEQ ID NO: 594596 - DNA, 20 bp, mouse
gccgcctgccggctgaggta

SEQ ID NO: 594597 - DNA, 20 bp, mouse
gcgcagcgcggccgcacccc

SEQ ID NO: 594598 - DNA, 20 bp, mouse
gccgccggaaccccgcaccc

SEQ ID NO: 594599 - DNA, 20 bp, mouse
gcgggcgacgcgagatccac

SEQ ID NO: 594600 - DNA, 20 bp, mouse
gaatcccgcggcggccgcaa

SEQ ID NO: 594601 - DNA, 20 bp, mouse
ggtgccctgcgcagaggacg

SEQ ID NO: 594602 - DNA, 20 bp, mouse
ggagggagttgtcgacgccg

SEQ ID NO: 594603 - DNA, 20 bp, mouse
gcccggggtgccctgcgcag

SEQ ID NO: 594604 - DNA, 20 bp, mouse
gcggtattatgattagccct

SEQ ID NO: 594605 - DNA, 20 bp, mouse
ggcgtccccgagctatcgtg

SEQ ID NO: 594606 - DNA, 20 bp, mouse
gcaacgcaggacgaacgtaa

SEQ ID NO: 594607 - DNA, 20 bp, mouse
gctgatgctccgggaactca

SEQ ID NO: 594608 - DNA, 20 bp, mouse
ggcaggacgaacgtaaggga

SEQ ID NO: 594609 - DNA, 20 bp, mouse
gcgaaccgccctggcacaac

SEQ ID NO: 594610 - DNA, 20 bp, mouse
ggaaggaccggtgcagacag

SEQ ID NO: 594611 - DNA, 20 bp, mouse
gttcggagcgtgaagaagag

SEQ ID NO: 594612 - DNA, 20 bp, mouse
gccgcttcagcgaaccgccc

SEQ ID NO: 594613 - DNA, 20 bp, mouse
ggcggttcgctgaagcggtt

SEQ ID NO: 594614 - DNA, 20 bp, mouse
gggaccggtgcagacagggg

SEQ ID NO: 594615 - DNA, 20 bp, mouse
gggcacaacaggtacaacgc

SEQ ID NO: 594616 - DNA, 20 bp, mouse
ggcaacactagtctagtagt

SEQ ID NO: 594617 - DNA, 20 bp, mouse
gtagtagtaggcagtcctgg

SEQ ID NO: 594618 - DNA, 20 bp, mouse
ggtctagtagtaggcagtcc

SEQ ID NO: 594619 - DNA, 20 bp, mouse
gccgatccaggtgcgagaca

SEQ ID NO: 594620 - DNA, 20 bp, mouse
gagcgggtcttgcaccacca

SEQ ID NO: 594621 - DNA, 20 bp, mouse
ggatcggccggaggtgccgg

SEQ ID NO: 594622 - DNA, 20 bp, mouse
gccggaggctgaggatcggc

SEQ ID NO: 594623 - DNA, 20 bp, mouse
gcgtcgtcctccggcacctc

SEQ ID NO: 594624 - DNA, 20 bp, mouse
gttttgcttatcaacctgga

SEQ ID NO: 594625 - DNA, 20 bp, mouse
gcaggtgcgagacagggctc

SEQ ID NO: 594626 - DNA, 20 bp, mouse
ggtagccgctccccgcgtag

SEQ ID NO: 594627 - DNA, 20 bp, mouse
gccggggcggtcggaggagg

SEQ ID NO: 594628 - DNA, 20 bp, mouse
gggctacgacttcgacccat

SEQ ID NO: 594629 - DNA, 20 bp, mouse
gctcacccctacgcggggag

SEQ ID NO: 594630 - DNA, 20 bp, mouse
gctggactcacccctacgcg

SEQ ID NO: 594631 - DNA, 20 bp, mouse
gtttccggggcggtcggagg

SEQ ID NO: 594632 - DNA, 20 bp, mouse
gtgtggggttgtttccgggg

SEQ ID NO: 594633 - DNA, 20 bp, mouse
gttgtttccggggcggtcgg

SEQ ID NO: 594634 - DNA, 20 bp, mouse
gaaagtctcacggctaggga

SEQ ID NO: 594635 - DNA, 20 bp, mouse
gcagctgctccggaagttgt

SEQ ID NO: 594636 - DNA, 20 bp, mouse
gggtaaacgggcggtggaaa

SEQ ID NO: 594637 - DNA, 20 bp, mouse
ggcagtttctggtaaacggg

SEQ ID NO: 594638 - DNA, 20 bp, mouse
gtgccgataaagggttccag

SEQ ID NO: 594639 - DNA, 20 bp, mouse
gcgataaagggttccagtgg

SEQ ID NO: 594640 - DNA, 20 bp, mouse
ggagccgggccaaggtgaga

SEQ ID NO: 594641 - DNA, 20 bp, mouse
ggagtggaaggaagcccgaa

SEQ ID NO: 594642 - DNA, 20 bp, mouse
gggagtgagactgagggttg

SEQ ID NO: 594643 - DNA, 20 bp, mouse
gaccttggcccggctccctt

SEQ ID NO: 594644 - DNA, 20 bp, mouse
gtccagtggaggtcggcgtg

SEQ ID NO: 594645 - DNA, 20 bp, mouse
gttgaagcctggcagaaacc

SEQ ID NO: 594646 - DNA, 20 bp, mouse
ggccgcttgacgggaaccag

SEQ ID NO: 594647 - DNA, 20 bp, mouse
gttctgctgctcgatcatgg

SEQ ID NO: 594648 - DNA, 20 bp, mouse
gtcgagcagcagaagcgtaa

SEQ ID NO: 594649 - DNA, 20 bp, mouse
gcagaggcgacatcatccgt

SEQ ID NO: 594650 - DNA, 20 bp, mouse
gtcggcggcgcggttagtgg

SEQ ID NO: 594651 - DNA, 20 bp, mouse
ggtggcggcgccgaggagag

SEQ ID NO: 594652 - DNA, 20 bp, mouse
gaagggcccggagctacccc

SEQ ID NO: 594653 - DNA, 20 bp, mouse
gcgcttctgctgctcgatca

SEQ ID NO: 594654 - DNA, 20 bp, mouse
gacatcatccgtaggaagag

SEQ ID NO: 594655 - DNA, 20 bp, mouse
ggggaaccaggggtagctcc

SEQ ID NO: 594656 - DNA, 20 bp, mouse
gggaggttcggtctccatga

SEQ ID NO: 594657 - DNA, 20 bp, mouse
ggacgccgctcttccagagg

SEQ ID NO: 594658 - DNA, 20 bp, mouse
gcatgatggcagctcacctc

SEQ ID NO: 594659 - DNA, 20 bp, mouse
gtcccacggcgagaagtcag

SEQ ID NO: 594660 - DNA, 20 bp, mouse
gcaccgggatggagagaagt

SEQ ID NO: 594661 - DNA, 20 bp, mouse
gaggcggaggccgaggtgag

SEQ ID NO: 594662 - DNA, 20 bp, mouse
gtccccgggcgcctttccca

SEQ ID NO: 594663 - DNA, 20 bp, mouse
gcagcggcccgggaaaggcc

SEQ ID NO: 594664 - DNA, 20 bp, mouse
gtgcgatgcaggggaggaca

SEQ ID NO: 594665 - DNA, 20 bp, mouse
gaggttgcccggcctttccc

SEQ ID NO: 594666 - DNA, 20 bp, mouse
gccgcgcgggttgtgaggag

SEQ ID NO: 594667 - DNA, 20 bp, mouse
gtcgcgaccagaactgggag

SEQ ID NO: 594668 - DNA, 20 bp, mouse
gtcagctcgcgaccagaact

SEQ ID NO: 594669 - DNA, 20 bp, mouse
gcgggttgtgaggagaggtc

SEQ ID NO: 594670 - DNA, 20 bp, mouse
gacgcagagggagaagtcaa

SEQ ID NO: 594671 - DNA, 20 bp, mouse
gccgcgtcaggtagcttcgg

SEQ ID NO: 594672 - DNA, 20 bp, mouse
gcgccgcgcggtgagtgagt

SEQ ID NO: 594673 - DNA, 20 bp, mouse
ggggttcgggaaccccgcaa

SEQ ID NO: 594674 - DNA, 20 bp, mouse
ggaaccccgcaagggcttgt

SEQ ID NO: 594675 - DNA, 20 bp, mouse
gtcgtctccactcccagttc

SEQ ID NO: 594676 - DNA, 20 bp, mouse
gcccttccgcgagctaatca

SEQ ID NO: 594677 - DNA, 20 bp, mouse
gtaatcacggcgggcaaact

SEQ ID NO: 594678 - DNA, 20 bp, mouse
gaagttcagagtctctcccc

SEQ ID NO: 594679 - DNA, 20 bp, mouse
gtccgcgagctaatcacggc

SEQ ID NO: 594680 - DNA, 20 bp, mouse
ggggaccccaagtgttcctt

SEQ ID NO: 594681 - DNA, 20 bp, mouse
ggagccagttaagaaagtag

SEQ ID NO: 594682 - DNA, 20 bp, mouse
ggcaggcggagcacaccgag

SEQ ID NO: 594683 - DNA, 20 bp, mouse
gtgctaagggagagctagag

SEQ ID NO: 594684 - DNA, 20 bp, mouse
gacgcgggttggagaagcgg

SEQ ID NO: 594685 - DNA, 20 bp, mouse
ggcccgccgtgattagctcg

SEQ ID NO: 594686 - DNA, 20 bp, mouse
gaggcgcaggctggtgtcgg

SEQ ID NO: 594687 - DNA, 20 bp, mouse
gtccgcgggctgcgacagga

SEQ ID NO: 594688 - DNA, 20 bp, mouse
ggtcggaggtgagggtccgc

SEQ ID NO: 594689 - DNA, 20 bp, mouse
gaggctggtgtcggaggtga

SEQ ID NO: 594690 - DNA, 20 bp, mouse
gctgcgggacggtggatcgg

SEQ ID NO: 594691 - DNA, 20 bp, mouse
gcgcggtgcactgtgggaca

SEQ ID NO: 594692 - DNA, 20 bp, mouse
gagggtccgcgggctgcgac

SEQ ID NO: 594693 - DNA, 20 bp, mouse
gtccagttcacggtcccgta

SEQ ID NO: 594694 - DNA, 20 bp, mouse
ggggaggcgcaggctggtgt

SEQ ID NO: 594695 - DNA, 20 bp, mouse
ggcactgtgggacacggcac

SEQ ID NO: 594696 - DNA, 20 bp, mouse
gcccgtggcggaggaggtcg

SEQ ID NO: 594697 - DNA, 20 bp, mouse
gtctgtggcagagaatccgg

SEQ ID NO: 594698 - DNA, 20 bp, mouse
ggcagcatttccgttagcgg

SEQ ID NO: 594699 - DNA, 20 bp, mouse
gggctggctggctggcgact

SEQ ID NO: 594700 - DNA, 20 bp, mouse
ggaagtagcttcactagcgg

SEQ ID NO: 594701 - DNA, 20 bp, mouse
gcaggcagcatttccgttag

SEQ ID NO: 594702 - DNA, 20 bp, mouse
gcgagccgagccgcccgtgg

SEQ ID NO: 594703 - DNA, 20 bp, mouse
gccggaagtagcttcactag

SEQ ID NO: 594704 - DNA, 20 bp, mouse
ggcggcgggaatccagcggc

SEQ ID NO: 594705 - DNA, 20 bp, mouse
gctacccggtcgcagcctca

SEQ ID NO: 594706 - DNA, 20 bp, mouse
gggcttcaggtgagtctctc

SEQ ID NO: 594707 - DNA, 20 bp, mouse
ggtccgcttgaaactaatac

SEQ ID NO: 594708 - DNA, 20 bp, mouse
gggaagggacggcgacccca

SEQ ID NO: 594709 - DNA, 20 bp, mouse
ggactcacctgaagccggcg

SEQ ID NO: 594710 - DNA, 20 bp, mouse
gcggcgcggggaagctcttc

SEQ ID NO: 594711 - DNA, 20 bp, mouse
gcgcggacgtataggaggaa

SEQ ID NO: 594712 - DNA, 20 bp, mouse
gtccccgcgccggaagaggg

SEQ ID NO: 594713 - DNA, 20 bp, mouse
gagtttcaagcggaccgcgc

SEQ ID NO: 594714 - DNA, 20 bp, mouse
ggccaatccacccaacacca

SEQ ID NO: 594715 - DNA, 20 bp, mouse
ggcttccccgcgccggaaga

SEQ ID NO: 594716 - DNA, 20 bp, mouse
ggccaggaactgacgcacac

SEQ ID NO: 594717 - DNA, 20 bp, mouse
ggcctgtgtgcgtcagttcc

SEQ ID NO: 594718 - DNA, 20 bp, mouse
gcacccgccatccctcggag

SEQ ID NO: 594719 - DNA, 20 bp, mouse
gggaaggcgagcccctccga

SEQ ID NO: 594720 - DNA, 20 bp, mouse
ggtctccacccgccatccct

SEQ ID NO: 594721 - DNA, 20 bp, mouse
ggctgcgccgacgcgagcaa

SEQ ID NO: 594722 - DNA, 20 bp, mouse
gagcccctccgagggatggc

SEQ ID NO: 594723 - DNA, 20 bp, mouse
gggatggcgggtggagaccc

SEQ ID NO: 594724 - DNA, 20 bp, mouse
ggtgtggccctgggagcaag

SEQ ID NO: 594725 - DNA, 20 bp, mouse
gggcgagcccctccgaggga

SEQ ID NO: 594726 - DNA, 20 bp, mouse
gttcaggctccagagatcca

SEQ ID NO: 594727 - DNA, 20 bp, mouse
ggctccagagatccacggac

SEQ ID NO: 594728 - DNA, 20 bp, mouse
gaccccagtccgtggatctc

SEQ ID NO: 594729 - DNA, 20 bp, mouse
gcacggactggggttatgaa

SEQ ID NO: 594730 - DNA, 20 bp, mouse
gaagctgccggatactgggt

SEQ ID NO: 594731 - DNA, 20 bp, mouse
ggtgaacagtcgggccagaa

SEQ ID NO: 594732 - DNA, 20 bp, mouse
gcccgccgggcgaggacgac

SEQ ID NO: 594733 - DNA, 20 bp, mouse
gcgcctccctgggagcacag

SEQ ID NO: 594734 - DNA, 20 bp, mouse
gcggtcttccaggaatggag

SEQ ID NO: 594735 - DNA, 20 bp, mouse
gcctctgcccacccagtatc

SEQ ID NO: 594736 - DNA, 20 bp, mouse
gagcccagcccggcctcaca

SEQ ID NO: 594737 - DNA, 20 bp, mouse
ggcccggcctcacatggtgt

SEQ ID NO: 594738 - DNA, 20 bp, mouse
ggcgtacagggcgagaaggg

SEQ ID NO: 594739 - DNA, 20 bp, mouse
ggctggagcaacgcgcttgg

SEQ ID NO: 594740 - DNA, 20 bp, mouse
gttggcgtacagggcgagaa

SEQ ID NO: 594741 - DNA, 20 bp, mouse
gcgccctgtacgccaaaggc

SEQ ID NO: 594742 - DNA, 20 bp, mouse
gacctacaccatgtgaggcc

SEQ ID NO: 594743 - DNA, 20 bp, mouse
gcgttcaaggaaaaaagggg

SEQ ID NO: 594744 - DNA, 20 bp, mouse
gcggatcttgagttccggag

SEQ ID NO: 594745 - DNA, 20 bp, mouse
gggaagtgagccgcaggaga

SEQ ID NO: 594746 - DNA, 20 bp, mouse
ggcgaaggcgagagaacgac

SEQ ID NO: 594747 - DNA, 20 bp, mouse
gcacaaacgttagaaggcga

SEQ ID NO: 594748 - DNA, 20 bp, mouse
ggtattcgtgagagtcgggc

SEQ ID NO: 594749 - DNA, 20 bp, mouse
gccgctgcggaggagctcag

SEQ ID NO: 594750 - DNA, 20 bp, mouse
gcgtggtattcgtgagagtc

SEQ ID NO: 594751 - DNA, 20 bp, mouse
ggcggctaacgggagagagg

SEQ ID NO: 594752 - DNA, 20 bp, mouse
gggcaccgaacgtgcagact

SEQ ID NO: 594753 - DNA, 20 bp, mouse
gttctggcacaaacgttaga

SEQ ID NO: 594754 - DNA, 20 bp, mouse
gcgggagatgagctttggat

SEQ ID NO: 594755 - DNA, 20 bp, mouse
gagagggccactgcaggaat

SEQ ID NO: 594756 - DNA, 20 bp, mouse
gacgagtaggaaggccgcct

SEQ ID NO: 594757 - DNA, 20 bp, mouse
ggaaagcgcgcggagttgaa

SEQ ID NO: 594758 - DNA, 20 bp, mouse
gacgcagcgtaggatacgat

SEQ ID NO: 594759 - DNA, 20 bp, mouse
gagcgcgcggagttgaaggg

SEQ ID NO: 594760 - DNA, 20 bp, mouse
ggttcgccccagggcctcac

SEQ ID NO: 594761 - DNA, 20 bp, mouse
gcggaagtcgctttccgagg

SEQ ID NO: 594762 - DNA, 20 bp, mouse
gcggaagcaagacccggaaa

SEQ ID NO: 594763 - DNA, 20 bp, mouse
gttccggaagtcgctttccg

SEQ ID NO: 594764 - DNA, 20 bp, mouse
gggccctggggcgaacgggg

SEQ ID NO: 594765 - DNA, 20 bp, mouse
gaggatgtgggccatcggga

SEQ ID NO: 594766 - DNA, 20 bp, mouse
gcggcgtgaggtgaaaggtc

SEQ ID NO: 594767 - DNA, 20 bp, mouse
gccgccaaggcctccgacgt

SEQ ID NO: 594768 - DNA, 20 bp, mouse
ggagaaatggccgacaaaag

SEQ ID NO: 594769 - DNA, 20 bp, mouse
gcctcgtggggatgaatggg

SEQ ID NO: 594770 - DNA, 20 bp, mouse
gaaggtggctggggatctcg

SEQ ID NO: 594771 - DNA, 20 bp, mouse
gcagccgcgcggcgcctcgt

SEQ ID NO: 594772 - DNA, 20 bp, mouse
ggtggctggggatctcgggg

SEQ ID NO: 594773 - DNA, 20 bp, mouse
gtccttaccatcgcgaccac

SEQ ID NO: 594774 - DNA, 20 bp, mouse
gcaacgcggcgtgaggtgaa

SEQ ID NO: 594775 - DNA, 20 bp, mouse
gggcgcctcgtggggatgaa

SEQ ID NO: 594776 - DNA, 20 bp, mouse
gcaacggcgaaggagtgagc

SEQ ID NO: 594777 - DNA, 20 bp, mouse
gagtggcgctaaggtccggt

SEQ ID NO: 594778 - DNA, 20 bp, mouse
gtgaggaaccggagactcgt

SEQ ID NO: 594779 - DNA, 20 bp, mouse
gcggaagtggcgctaaggtc

SEQ ID NO: 594780 - DNA, 20 bp, mouse
gcgaccgtcgggaccagcgg

SEQ ID NO: 594781 - DNA, 20 bp, mouse
gctaggagagccccagcttt

SEQ ID NO: 594782 - DNA, 20 bp, mouse
ggccaatattcaggaagctt

SEQ ID NO: 594783 - DNA, 20 bp, mouse
gctgccgccgctggtcccga

SEQ ID NO: 594784 - DNA, 20 bp, mouse
gctcctaggcgggcagccaa

SEQ ID NO: 594785 - DNA, 20 bp, mouse
ggcaacctggttggggacca

SEQ ID NO: 594786 - DNA, 20 bp, mouse
ggactagcgcagagaggaga

SEQ ID NO: 594787 - DNA, 20 bp, mouse
gcggcaagactagcgcagag

SEQ ID NO: 594788 - DNA, 20 bp, mouse
gctcctcagaaccaagcgtc

SEQ ID NO: 594789 - DNA, 20 bp, mouse
gtgcctgggacgcatgcgta

SEQ ID NO: 594790 - DNA, 20 bp, mouse
gcgacaaacctgagccattg

SEQ ID NO: 594791 - DNA, 20 bp, mouse
gggagtgatttgcaacgcaa

SEQ ID NO: 594792 - DNA, 20 bp, mouse
gctccttgggtgtgttagtg

SEQ ID NO: 594793 - DNA, 20 bp, mouse
gtgcgctagtcttgccgcaa

SEQ ID NO: 594794 - DNA, 20 bp, mouse
gtctctggacctacaagtcg

SEQ ID NO: 594795 - DNA, 20 bp, mouse
gctgacttccaggagtccag

SEQ ID NO: 594796 - DNA, 20 bp, mouse
gggtcggagcgggccgggta

SEQ ID NO: 594797 - DNA, 20 bp, mouse
gcccagggcagagggcggcg

SEQ ID NO: 594798 - DNA, 20 bp, mouse
gcctgggcgctgggtcggag

SEQ ID NO: 594799 - DNA, 20 bp, mouse
gggccgggtacggcgggacc

SEQ ID NO: 594800 - DNA, 20 bp, mouse
gcggagcccgcgcagctcaa

SEQ ID NO: 594801 - DNA, 20 bp, mouse
ggcagtgtactgggacttcg

SEQ ID NO: 594802 - DNA, 20 bp, mouse
gcggagcgggccgggtacgg

SEQ ID NO: 594803 - DNA, 20 bp, mouse
gcgggcgagcgcagtgtact

SEQ ID NO: 594804 - DNA, 20 bp, mouse
ggagcgctcaggggtcatgg

SEQ ID NO: 594805 - DNA, 20 bp, mouse
gggtaggtgtggggcaccca

SEQ ID NO: 594806 - DNA, 20 bp, mouse
gcccggcgcagccgcgaaca

SEQ ID NO: 594807 - DNA, 20 bp, mouse
gcgccgggcgccagttgcag

SEQ ID NO: 594808 - DNA, 20 bp, mouse
gacacggggagtggagtccg

SEQ ID NO: 594809 - DNA, 20 bp, mouse
ggcagcgcgcgctcagaccc

SEQ ID NO: 594810 - DNA, 20 bp, mouse
gcagccgcgaacacggggag

SEQ ID NO: 594811 - DNA, 20 bp, mouse
gggaggactcagggtaaccg

SEQ ID NO: 594812 - DNA, 20 bp, mouse
gcacggaagaagcagatgcc

SEQ ID NO: 594813 - DNA, 20 bp, mouse
ggagaggagcctaggagctg

SEQ ID NO: 594814 - DNA, 20 bp, mouse
gagtgctgtagagaatcggt

SEQ ID NO: 594815 - DNA, 20 bp, mouse
ggacggagagccctcgacag

SEQ ID NO: 594816 - DNA, 20 bp, mouse
ggggggagctgcagcaacgg

SEQ ID NO: 594817 - DNA, 20 bp, mouse
ggctgcctgactggaatcgg

SEQ ID NO: 594818 - DNA, 20 bp, mouse
gatcgggggagctgcagcaa

SEQ ID NO: 594819 - DNA, 20 bp, mouse
ggcccgcgtccacaccgcca

SEQ ID NO: 594820 - DNA, 20 bp, mouse
ggacgcgggccaccaaagcg

SEQ ID NO: 594821 - DNA, 20 bp, mouse
gcgccggcggccgccttcaa

SEQ ID NO: 594822 - DNA, 20 bp, mouse
gagctcccccgattccagtc

SEQ ID NO: 594823 - DNA, 20 bp, mouse
ggccatggcggtgtggacgc

SEQ ID NO: 594824 - DNA, 20 bp, mouse
gccttcaacggtcttccgaa

SEQ ID NO: 594825 - DNA, 20 bp, mouse
gggcggctcaggctcgactg

SEQ ID NO: 594826 - DNA, 20 bp, mouse
gtggccgggagccccagaca

SEQ ID NO: 594827 - DNA, 20 bp, mouse
gtacagcctctcggaaacaa

SEQ ID NO: 594828 - DNA, 20 bp, mouse
gaagggccaggaaaaggcta

SEQ ID NO: 594829 - DNA, 20 bp, mouse
gacgtgtccgcgccctggtt

SEQ ID NO: 594830 - DNA, 20 bp, mouse
ggtccctgctgtccctgtct

SEQ ID NO: 594831 - DNA, 20 bp, mouse
gtcgcggcgatacagcctct

SEQ ID NO: 594832 - DNA, 20 bp, mouse
gggatacctttgtttccgag

SEQ ID NO: 594833 - DNA, 20 bp, mouse
gcaagcgcgcacagggacgg

SEQ ID NO: 594834 - DNA, 20 bp, mouse
gagccccagacagggacagc

SEQ ID NO: 594835 - DNA, 20 bp, mouse
gttaggaagcaagatcgcag

SEQ ID NO: 594836 - DNA, 20 bp, mouse
gccccagcccgtccacagag

SEQ ID NO: 594837 - DNA, 20 bp, mouse
gcggcgcccgcgcccctctg

SEQ ID NO: 594838 - DNA, 20 bp, mouse
gggtaggcagggagactgaa

SEQ ID NO: 594839 - DNA, 20 bp, mouse
gcccgcgcccctctgtggac

SEQ ID NO: 594840 - DNA, 20 bp, mouse
gccgtgctggcgctggactt

SEQ ID NO: 594841 - DNA, 20 bp, mouse
gtgaggaagagggcctccag

SEQ ID NO: 594842 - DNA, 20 bp, mouse
ggcgctggacttaggagctc

SEQ ID NO: 594843 - DNA, 20 bp, mouse
ggccctgcttgctagcgcag

SEQ ID NO: 594844 - DNA, 20 bp, mouse
ggccactgcgctagcaagca

SEQ ID NO: 594845 - DNA, 20 bp, mouse
gacaagattgcggtgcccag

SEQ ID NO: 594846 - DNA, 20 bp, mouse
gacaggcaaagcaagagtat

SEQ ID NO: 594847 - DNA, 20 bp, mouse
gctggggcttcagaaggcct

SEQ ID NO: 594848 - DNA, 20 bp, mouse
gggcaaagcaagagtatggg

SEQ ID NO: 594849 - DNA, 20 bp, mouse
gccactcaagaggagagccc

SEQ ID NO: 594850 - DNA, 20 bp, mouse
gaccacgcactccactcaag

SEQ ID NO: 594851 - DNA, 20 bp, mouse
ggagtggagtgcgtggtccc

SEQ ID NO: 594852 - DNA, 20 bp, mouse
gggctgtatgcacagcacct

SEQ ID NO: 594853 - DNA, 20 bp, mouse
gggtgactgttgcttaggaa

SEQ ID NO: 594854 - DNA, 20 bp, mouse
gtcctcttgagtggagtgcg

SEQ ID NO: 594855 - DNA, 20 bp, mouse
gaggtgctgaaatggatgct

SEQ ID NO: 594856 - DNA, 20 bp, mouse
ggagaacgccaaactagaca

SEQ ID NO: 594857 - DNA, 20 bp, mouse
gcagtcggcacaggcactgg

SEQ ID NO: 594858 - DNA, 20 bp, mouse
ggcggcgtgcgcgagtggta

SEQ ID NO: 594859 - DNA, 20 bp, mouse
gtacggacgtgcggtaagtc

SEQ ID NO: 594860 - DNA, 20 bp, mouse
gcgcgagtggtacggacgtg

SEQ ID NO: 594861 - DNA, 20 bp, mouse
gcactggcggcgtgcgcgag

SEQ ID NO: 594862 - DNA, 20 bp, mouse
gagtctggccctgtctagtt

SEQ ID NO: 594863 - DNA, 20 bp, mouse
gctaattggtcagtcggcac

SEQ ID NO: 594864 - DNA, 20 bp, mouse
gggccagcctccccaggtaa

SEQ ID NO: 594865 - DNA, 20 bp, mouse
gcggctgcgaagccagccct

SEQ ID NO: 594866 - DNA, 20 bp, mouse
ggactagcgcagagaggaga

SEQ ID NO: 594867 - DNA, 20 bp, mouse
gcggcaagactagcgcagag

SEQ ID NO: 594868 - DNA, 20 bp, mouse
gctcctcagaaccaagcgtc

SEQ ID NO: 594869 - DNA, 20 bp, mouse
gtgcctgggacgcatgcgta

SEQ ID NO: 594870 - DNA, 20 bp, mouse
gcgacaaacctgagccattg

SEQ ID NO: 594871 - DNA, 20 bp, mouse
gggagtgatttgcaacgcaa

SEQ ID NO: 594872 - DNA, 20 bp, mouse
gctccttgggtgtgttagtg

SEQ ID NO: 594873 - DNA, 20 bp, mouse
gtgcgctagtcttgccgcaa

SEQ ID NO: 594874 - DNA, 20 bp, mouse
gtctctggacctacaagtcg

SEQ ID NO: 594875 - DNA, 20 bp, mouse
gctgacttccaggagtccag

SEQ ID NO: 594876 - DNA, 20 bp, mouse
gtggcctgcgcaggaagaag

SEQ ID NO: 594877 - DNA, 20 bp, mouse
gaagatggcgctcaccaggt

SEQ ID NO: 594878 - DNA, 20 bp, mouse
gtcgcggcgaggccatgtca

SEQ ID NO: 594879 - DNA, 20 bp, mouse
ggtcacagcccgaacagtac

SEQ ID NO: 594880 - DNA, 20 bp, mouse
gcgcggaggaagcccgagag

SEQ ID NO: 594881 - DNA, 20 bp, mouse
gttgggtcctcgatacggaa

SEQ ID NO: 594882 - DNA, 20 bp, mouse
ggactcgcccggcgacgttg

SEQ ID NO: 594883 - DNA, 20 bp, mouse
ggaagaagatggcgctcacc

SEQ ID NO: 594884 - DNA, 20 bp, mouse
gagggctctcggaacagggg

SEQ ID NO: 594885 - DNA, 20 bp, mouse
ggtcagggctctcggaacag

SEQ ID NO: 594886 - DNA, 20 bp, mouse
gccggatccatgccagggaa

SEQ ID NO: 594887 - DNA, 20 bp, mouse
gggaagatggcgtcaggagg

SEQ ID NO: 594888 - DNA, 20 bp, mouse
gagatggcgtcaggaggtgg

SEQ ID NO: 594889 - DNA, 20 bp, mouse
gggaggaagatggcgtcagg

SEQ ID NO: 594890 - DNA, 20 bp, mouse
gcgactccggatccatgcca

SEQ ID NO: 594891 - DNA, 20 bp, mouse
gcatcttcctccacccgtgg

SEQ ID NO: 594892 - DNA, 20 bp, mouse
gttgctgcttccgccacggg

SEQ ID NO: 594893 - DNA, 20 bp, mouse
gccgggcgggaagagacgag

SEQ ID NO: 594894 - DNA, 20 bp, mouse
gcatgccagggaagggcgga

SEQ ID NO: 594895 - DNA, 20 bp, mouse
ggccctcgaacccttaataa

SEQ ID NO: 594896 - DNA, 20 bp, mouse
gcgcccggcccggagcacgg

SEQ ID NO: 594897 - DNA, 20 bp, mouse
ggaacgcccggcccggagca

SEQ ID NO: 594898 - DNA, 20 bp, mouse
gggcggagtttgctgactca

SEQ ID NO: 594899 - DNA, 20 bp, mouse
gccacccgactccctcccta

SEQ ID NO: 594900 - DNA, 20 bp, mouse
gtagaggctgggagggccag

SEQ ID NO: 594901 - DNA, 20 bp, mouse
gttgctgactcaaggcgcgg

SEQ ID NO: 594902 - DNA, 20 bp, mouse
ggctcctcgggttcgctctt

SEQ ID NO: 594903 - DNA, 20 bp, mouse
gtgtattcggaaagaagtgg

SEQ ID NO: 594904 - DNA, 20 bp, mouse
gtcccagcctctaaactcaa

SEQ ID NO: 594905 - DNA, 20 bp, mouse
ggcgcctaagagcgaacccg

SEQ ID NO: 594906 - DNA, 20 bp, mouse
gtgacagactggacatccca

SEQ ID NO: 594907 - DNA, 20 bp, mouse
gacctctcaggagttcttag

SEQ ID NO: 594908 - DNA, 20 bp, mouse
ggcccctaagaactcctgag

SEQ ID NO: 594909 - DNA, 20 bp, mouse
gagaaacactcagcaagcca

SEQ ID NO: 594910 - DNA, 20 bp, mouse
gcatcagtctgatgacagac

SEQ ID NO: 594911 - DNA, 20 bp, mouse
gagttccaaagatcctccaa

SEQ ID NO: 594912 - DNA, 20 bp, mouse
ggttcgtcctgtgaacaggt

SEQ ID NO: 594913 - DNA, 20 bp, mouse
gggtgcccttggaggatctt

SEQ ID NO: 594914 - DNA, 20 bp, mouse
ggccatgtaatgaagcaaaa

SEQ ID NO: 594915 - DNA, 20 bp, mouse
gacaactggtcaatatgaca

SEQ ID NO: 594916 - DNA, 20 bp, mouse
gggtatcggactatatggtg

SEQ ID NO: 594917 - DNA, 20 bp, mouse
gggtgctggtggtgtcgctg

SEQ ID NO: 594918 - DNA, 20 bp, mouse
gaagccggtatcggactata

SEQ ID NO: 594919 - DNA, 20 bp, mouse
gcggaaggagaagccggtat

SEQ ID NO: 594920 - DNA, 20 bp, mouse
gctgctgctgctctcaggtg

SEQ ID NO: 594921 - DNA, 20 bp, mouse
gggcctcggttgacacacta

SEQ ID NO: 594922 - DNA, 20 bp, mouse
gcggttgacacactagggag

SEQ ID NO: 594923 - DNA, 20 bp, mouse
gcaccggcgactcacccgga

SEQ ID NO: 594924 - DNA, 20 bp, mouse
gctatatggtgcggtgctgg

SEQ ID NO: 594925 - DNA, 20 bp, mouse
gcaagtggccggcagtggaa

SEQ ID NO: 594926 - DNA, 20 bp, mouse
gaagatgtcggacaccgcag

SEQ ID NO: 594927 - DNA, 20 bp, mouse
gcgcatgcgaacctcatagg

SEQ ID NO: 594928 - DNA, 20 bp, mouse
gccgaagaagagcccggtac

SEQ ID NO: 594929 - DNA, 20 bp, mouse
gcaccgcagtggctgacact

SEQ ID NO: 594930 - DNA, 20 bp, mouse
gccagccaacccccagacga

SEQ ID NO: 594931 - DNA, 20 bp, mouse
ggagcccggtaccggcgaag

SEQ ID NO: 594932 - DNA, 20 bp, mouse
gccttggaggggtcatgtga

SEQ ID NO: 594933 - DNA, 20 bp, mouse
gctgggcggcccgtaagcgt

SEQ ID NO: 594934 - DNA, 20 bp, mouse
gcgcatgcgggtgagtcacg

SEQ ID NO: 594935 - DNA, 20 bp, mouse
gccggtaccggcgaaggggg

SEQ ID NO: 594936 - DNA, 20 bp, mouse
gcccgggcggcggctttact

SEQ ID NO: 594937 - DNA, 20 bp, mouse
gccggcccggctgctcgcga

SEQ ID NO: 594938 - DNA, 20 bp, mouse
gcccgggccgccgccaacgg

SEQ ID NO: 594939 - DNA, 20 bp, mouse
gccgcctctcaggtaaacag

SEQ ID NO: 594940 - DNA, 20 bp, mouse
gcgtcgctcttccaagatgg

SEQ ID NO: 594941 - DNA, 20 bp, mouse
gtaaagccgccgcccgggac

SEQ ID NO: 594942 - DNA, 20 bp, mouse
gggacgtcgctcttccaaga

SEQ ID NO: 594943 - DNA, 20 bp, mouse
gtcagtcctgtcccgggcgg

SEQ ID NO: 594944 - DNA, 20 bp, mouse
gcgctggcttccccccggcc

SEQ ID NO: 594945 - DNA, 20 bp, mouse
gctgcccgggccgccgccaa

SEQ ID NO: 594946 - DNA, 20 bp, mouse
ggaggacgtgccgccctcag

SEQ ID NO: 594947 - DNA, 20 bp, mouse
ggggcacccccaaaccccgg

SEQ ID NO: 594948 - DNA, 20 bp, mouse
gcacccccaaaccccggcgg

SEQ ID NO: 594949 - DNA, 20 bp, mouse
ggtctagctgtgaagctggg

SEQ ID NO: 594950 - DNA, 20 bp, mouse
ggagcagcgaggcgacgctg

SEQ ID NO: 594951 - DNA, 20 bp, mouse
gtgagtctagctgtgaagct

SEQ ID NO: 594952 - DNA, 20 bp, mouse
gcccatctcagtccacgcag

SEQ ID NO: 594953 - DNA, 20 bp, mouse
gctccgccgccggggtttgg

SEQ ID NO: 594954 - DNA, 20 bp, mouse
gcagcctgcgggctctcgag

SEQ ID NO: 594955 - DNA, 20 bp, mouse
ggcagaacagcggatactga

SEQ ID NO: 594956 - DNA, 20 bp, mouse
gaagggcgcaggccggatcc

SEQ ID NO: 594957 - DNA, 20 bp, mouse
gctcaacacgcggggagcgg

SEQ ID NO: 594958 - DNA, 20 bp, mouse
ggcttggcgcgacatgacag

SEQ ID NO: 594959 - DNA, 20 bp, mouse
gcaggtgaggtgggacccag

SEQ ID NO: 594960 - DNA, 20 bp, mouse
gaccctaggacccaccccaa

SEQ ID NO: 594961 - DNA, 20 bp, mouse
ggtgaggtgggacccagcgg

SEQ ID NO: 594962 - DNA, 20 bp, mouse
gcacttgcgactaggtccct

SEQ ID NO: 594963 - DNA, 20 bp, mouse
gggcagtaggctcaacacgc

SEQ ID NO: 594964 - DNA, 20 bp, mouse
gtactgccactgccaggatc

SEQ ID NO: 594965 - DNA, 20 bp, mouse
ggggtcccacctcacctgag

SEQ ID NO: 594966 - DNA, 20 bp, mouse
gtcgcgggaacctggctggg

SEQ ID NO: 594967 - DNA, 20 bp, mouse
gttcccgcgaaccgagggaa

SEQ ID NO: 594968 - DNA, 20 bp, mouse
gggaagggacggcctcgagt

SEQ ID NO: 594969 - DNA, 20 bp, mouse
gagcgcgccgaggtaggacg

SEQ ID NO: 594970 - DNA, 20 bp, mouse
gccaggttcccgcgaaccga

SEQ ID NO: 594971 - DNA, 20 bp, mouse
gtcgcggagcgcgccgaggt

SEQ ID NO: 594972 - DNA, 20 bp, mouse
gggttcgcgggaacctggct

SEQ ID NO: 594973 - DNA, 20 bp, mouse
gccgagcggctgctccgggg

SEQ ID NO: 594974 - DNA, 20 bp, mouse
gtcgaggccgtcccttccct

SEQ ID NO: 594975 - DNA, 20 bp, mouse
gcgcccgcccgccgtccagg

SEQ ID NO: 594976 - DNA, 20 bp, mouse
ggctgcggagacgcgctgag

SEQ ID NO: 594977 - DNA, 20 bp, mouse
gggcagaggcaagcgagcag

SEQ ID NO: 594978 - DNA, 20 bp, mouse
ggagttcaggcccaccaaaa

SEQ ID NO: 594979 - DNA, 20 bp, mouse
gaaaatggcgagctgggctg

SEQ ID NO: 594980 - DNA, 20 bp, mouse
ggtgggcctgaactccgagg

SEQ ID NO: 594981 - DNA, 20 bp, mouse
gttggtgggcctgaactccg

SEQ ID NO: 594982 - DNA, 20 bp, mouse
gggcagagctccgtactacc

SEQ ID NO: 594983 - DNA, 20 bp, mouse
gtccgaggtgggaaggctgt

SEQ ID NO: 594984 - DNA, 20 bp, mouse
gtagcacctcctcaccacgt

SEQ ID NO: 594985 - DNA, 20 bp, mouse
gcctgaactccgaggtggga

SEQ ID NO: 594986 - DNA, 20 bp, mouse
gcgccgaagggaagcctgga

SEQ ID NO: 594987 - DNA, 20 bp, mouse
ggctgcacggagggcgagag

SEQ ID NO: 594988 - DNA, 20 bp, mouse
ggccgagccgagctgcacgg

SEQ ID NO: 594989 - DNA, 20 bp, mouse
gccgcagggagatctcaccg

SEQ ID NO: 594990 - DNA, 20 bp, mouse
gacggagggcgagagcggag

SEQ ID NO: 594991 - DNA, 20 bp, mouse
ggcagcgagcaggacatcga

SEQ ID NO: 594992 - DNA, 20 bp, mouse
gagcctggagggcagcgcac

SEQ ID NO: 594993 - DNA, 20 bp, mouse
gcagcagcgactgcaactcg

SEQ ID NO: 594994 - DNA, 20 bp, mouse
gactttaagtccgagaaccc

SEQ ID NO: 594995 - DNA, 20 bp, mouse
gctgggcagcgacgatgact

SEQ ID NO: 594996 - DNA, 20 bp, mouse
gagtggacagagcagcgggc

SEQ ID NO: 594997 - DNA, 20 bp, mouse
gacactccgcaactccaaag

SEQ ID NO: 594998 - DNA, 20 bp, mouse
gttggagttgcggagtgtag

SEQ ID NO: 594999 - DNA, 20 bp, mouse
gcagcagccacaacaagctc

SEQ ID NO: 595000 - DNA, 20 bp, mouse
ggggcggccggagcttgttg

SEQ ID NO: 595001 - DNA, 20 bp, mouse
gcagcgggccggctagcagc

SEQ ID NO: 595002 - DNA, 20 bp, mouse
ggctcccgcaggccgcgacc

SEQ ID NO: 595003 - DNA, 20 bp, mouse
gttgcggagtgtagtggcct

SEQ ID NO: 595004 - DNA, 20 bp, mouse
ggcgacccggaagctgtcgc

SEQ ID NO: 595005 - DNA, 20 bp, mouse
gtccgcctgggccatgatgg

SEQ ID NO: 595006 - DNA, 20 bp, mouse
gggccaagaggcgaagatgg

SEQ ID NO: 595007 - DNA, 20 bp, mouse
gtgggcttcacgtcccccag

SEQ ID NO: 595008 - DNA, 20 bp, mouse
gccaggccaagaggcgaaga

SEQ ID NO: 595009 - DNA, 20 bp, mouse
gtcacgtcccccagcggagg

SEQ ID NO: 595010 - DNA, 20 bp, mouse
gtgcagacgtccaggccaag

SEQ ID NO: 595011 - DNA, 20 bp, mouse
gagggagcctcctccgctgg

SEQ ID NO: 595012 - DNA, 20 bp, mouse
gggcctggccaaacccggag

SEQ ID NO: 595013 - DNA, 20 bp, mouse
gacaagtcgcggcaggggag

SEQ ID NO: 595014 - DNA, 20 bp, mouse
gcaaacccggaggggtgggt

SEQ ID NO: 595015 - DNA, 20 bp, mouse
gtggccaaacccggaggggt

SEQ ID NO: 595016 - DNA, 20 bp, mouse
gccaagggtggtgagagtat

SEQ ID NO: 595017 - DNA, 20 bp, mouse
gggttaggagggaccaaggg

SEQ ID NO: 595018 - DNA, 20 bp, mouse
gggccctctaggaactccct

SEQ ID NO: 595019 - DNA, 20 bp, mouse
gaaaggagaactcaggattg

SEQ ID NO: 595020 - DNA, 20 bp, mouse
gtttgcaaggtccaactaga

SEQ ID NO: 595021 - DNA, 20 bp, mouse
gggtttggccccagtttcta

SEQ ID NO: 595022 - DNA, 20 bp, mouse
gggaccttgcaaaaagagat

SEQ ID NO: 595023 - DNA, 20 bp, mouse
gaactccctgggtactggtt

SEQ ID NO: 595024 - DNA, 20 bp, mouse
gccctcctaaccagtaccca

SEQ ID NO: 595025 - DNA, 20 bp, mouse
gagacattcagccatctagt

SEQ ID NO: 595026 - DNA, 20 bp, mouse
ggcgaggccatggcacccag

SEQ ID NO: 595027 - DNA, 20 bp, mouse
gtgtaggagccgcgaggcca

SEQ ID NO: 595028 - DNA, 20 bp, mouse
ggcgtggcgcgctcccccct

SEQ ID NO: 595029 - DNA, 20 bp, mouse
ggcgcgccacgctgggtcca

SEQ ID NO: 595030 - DNA, 20 bp, mouse
gcgcccggagagggacccgg

SEQ ID NO: 595031 - DNA, 20 bp, mouse
ggctgggtccagggctgaag

SEQ ID NO: 595032 - DNA, 20 bp, mouse
gtcgccgccctcaggagacg

SEQ ID NO: 595033 - DNA, 20 bp, mouse
ggaagctgagggtgccactg

SEQ ID NO: 595034 - DNA, 20 bp, mouse
gatgccccgtctcctgaggg

SEQ ID NO: 595035 - DNA, 20 bp, mouse
ggccagcgatggccccgggg

SEQ ID NO: 595036 - DNA, 20 bp, mouse
gcaagcgctcgatccgggag

SEQ ID NO: 595037 - DNA, 20 bp, mouse
gcggcctcgggccccaccga

SEQ ID NO: 595038 - DNA, 20 bp, mouse
gggagaggctgcagccgggt

SEQ ID NO: 595039 - DNA, 20 bp, mouse
gcagcatccgcgccccgacc

SEQ ID NO: 595040 - DNA, 20 bp, mouse
ggtgcccaagcgctcgatcc

SEQ ID NO: 595041 - DNA, 20 bp, mouse
ggcagccaagcagccctaag

SEQ ID NO: 595042 - DNA, 20 bp, mouse
gctggaagttcacattccct

SEQ ID NO: 595043 - DNA, 20 bp, mouse
gttggctgctccagggagtt

SEQ ID NO: 595044 - DNA, 20 bp, mouse
gcttgggcacccgaactccc

SEQ ID NO: 595045 - DNA, 20 bp, mouse
gggcagggcctggagcccga

SEQ ID NO: 595046 - DNA, 20 bp, mouse
ggacgggatgtagacctcca

SEQ ID NO: 595047 - DNA, 20 bp, mouse
ggtcctcgtggcgaaaggac

SEQ ID NO: 595048 - DNA, 20 bp, mouse
gtctacgcggtgcggcggag

SEQ ID NO: 595049 - DNA, 20 bp, mouse
gcgccacgaggacagcgatc

SEQ ID NO: 595050 - DNA, 20 bp, mouse
ggaagggatggagcccaggg

SEQ ID NO: 595051 - DNA, 20 bp, mouse
gatgtagacctccatggccg

SEQ ID NO: 595052 - DNA, 20 bp, mouse
ggatctggagcgcggctaca

SEQ ID NO: 595053 - DNA, 20 bp, mouse
gtcgctgtcctcgtggcgaa

SEQ ID NO: 595054 - DNA, 20 bp, mouse
gctccagatcgctgtcctcg

SEQ ID NO: 595055 - DNA, 20 bp, mouse
gcccagcgcgcgccccccct

SEQ ID NO: 595056 - DNA, 20 bp, mouse
gaccgggcgcgcccaggtag

SEQ ID NO: 595057 - DNA, 20 bp, mouse
gaggtagcgggaccgcgagg

SEQ ID NO: 595058 - DNA, 20 bp, mouse
gcacaggccacggcccgggg

SEQ ID NO: 595059 - DNA, 20 bp, mouse
ggcgatgccaccgacagcag

SEQ ID NO: 595060 - DNA, 20 bp, mouse
ggagatgagcctgtcgccag

SEQ ID NO: 595061 - DNA, 20 bp, mouse
gctgggcgcgcccggtcggc

SEQ ID NO: 595062 - DNA, 20 bp, mouse
gcccgcagctgcccgccgac

SEQ ID NO: 595063 - DNA, 20 bp, mouse
gcgcggcgcagctcaggtac

SEQ ID NO: 595064 - DNA, 20 bp, mouse
ggccgccgctcgcgaggcaa

SEQ ID NO: 595065 - DNA, 20 bp, mouse
ggcgcacaggccacggcccg

SEQ ID NO: 595066 - DNA, 20 bp, mouse
gcagccccgcaccggaatgg

SEQ ID NO: 595067 - DNA, 20 bp, mouse
gtcgcttgctcgcaagatgg

SEQ ID NO: 595068 - DNA, 20 bp, mouse
gccccgcaccggaatggagg

SEQ ID NO: 595069 - DNA, 20 bp, mouse
gcaactgcggagcatcaacg

SEQ ID NO: 595070 - DNA, 20 bp, mouse
gaagatggcggacgaggacg

SEQ ID NO: 595071 - DNA, 20 bp, mouse
gtcacccctcagccccgcac

SEQ ID NO: 595072 - DNA, 20 bp, mouse
ggagcgagggcgggcaactg

SEQ ID NO: 595073 - DNA, 20 bp, mouse
gcccgccgccgcctccattc

SEQ ID NO: 595074 - DNA, 20 bp, mouse
gcccggtcggccgccccccc

SEQ ID NO: 595075 - DNA, 20 bp, mouse
gcaggctctcgagctaagag

SEQ ID NO: 595076 - DNA, 20 bp, mouse
gcggcctgtgtggagctcgg

SEQ ID NO: 595077 - DNA, 20 bp, mouse
gagctcggcggctgcagacg

SEQ ID NO: 595078 - DNA, 20 bp, mouse
gccgggagcagcaacatgag

SEQ ID NO: 595079 - DNA, 20 bp, mouse
gcagccgccgagctccacac

SEQ ID NO: 595080 - DNA, 20 bp, mouse
ggagttggctgtcactggtg

SEQ ID NO: 595081 - DNA, 20 bp, mouse
ggcgccagccccgggatagt

SEQ ID NO: 595082 - DNA, 20 bp, mouse
gagccccgggatagtgggag

SEQ ID NO: 595083 - DNA, 20 bp, mouse
gctgcagtggcgctacgggg

SEQ ID NO: 595084 - DNA, 20 bp, mouse
gcaacatgagcggtgagtgg

SEQ ID NO: 595085 - DNA, 20 bp, mouse
gggagcggtgcaggagactc

SEQ ID NO: 595086 - DNA, 20 bp, mouse
gggcggtggagagaagcccg

SEQ ID NO: 595087 - DNA, 20 bp, mouse
gagcaacccgcagaccgtgg

SEQ ID NO: 595088 - DNA, 20 bp, mouse
gcggtggcgttggcggaagg

SEQ ID NO: 595089 - DNA, 20 bp, mouse
gacgagcacgtaggacgggt

SEQ ID NO: 595090 - DNA, 20 bp, mouse
gcggccccggccgaccccca

SEQ ID NO: 595091 - DNA, 20 bp, mouse
gtgccgcggcgacagcgaaa

SEQ ID NO: 595092 - DNA, 20 bp, mouse
gcgcggcgacagcgaaatgg

SEQ ID NO: 595093 - DNA, 20 bp, mouse
gcggagacgaacgagcacgt

SEQ ID NO: 595094 - DNA, 20 bp, mouse
gagaaggtgctggaagacga

SEQ ID NO: 595095 - DNA, 20 bp, mouse
gcggaagcccgagcagcctg

SEQ ID NO: 595096 - DNA, 20 bp, mouse
gtagcagggcgcagggtcgg

SEQ ID NO: 595097 - DNA, 20 bp, mouse
gtgctagcagggcgcagggt

SEQ ID NO: 595098 - DNA, 20 bp, mouse
gcgcagggtcggaggtgctg

SEQ ID NO: 595099 - DNA, 20 bp, mouse
gcgttacaccacagctccgt

SEQ ID NO: 595100 - DNA, 20 bp, mouse
ggagctgtggtgtaacgctc

SEQ ID NO: 595101 - DNA, 20 bp, mouse
gaggactggggccccgtgga

SEQ ID NO: 595102 - DNA, 20 bp, mouse
ggggcaggagaagcatcggg

SEQ ID NO: 595103 - DNA, 20 bp, mouse
ggagctgcgggagtaagcgg

SEQ ID NO: 595104 - DNA, 20 bp, mouse
gcgcgggcaggagaagcatc

SEQ ID NO: 595105 - DNA, 20 bp, mouse
gagcagcgccacgccgccca

SEQ ID NO: 595106 - DNA, 20 bp, mouse
gacccagcccagactctagg

SEQ ID NO: 595107 - DNA, 20 bp, mouse
gatggctctggcgatgacca

SEQ ID NO: 595108 - DNA, 20 bp, mouse
gtggccgctgctgggacacc

SEQ ID NO: 595109 - DNA, 20 bp, mouse
ggacctgccgcctagagtct

SEQ ID NO: 595110 - DNA, 20 bp, mouse
ggcgatgaccagggacagcg

SEQ ID NO: 595111 - DNA, 20 bp, mouse
gtaggcgaggatgaggactg

SEQ ID NO: 595112 - DNA, 20 bp, mouse
ggacacccgcctgttatcct

SEQ ID NO: 595113 - DNA, 20 bp, mouse
gatgcagaagtgcatcttca

SEQ ID NO: 595114 - DNA, 20 bp, mouse
ggcagaagaggaacccgtcc

SEQ ID NO: 595115 - DNA, 20 bp, mouse
gcctcgcctaggataacagg

SEQ ID NO: 595116 - DNA, 20 bp, mouse
gtgggtgagggaaccttgta

SEQ ID NO: 595117 - DNA, 20 bp, mouse
gctgcgcgttccaagagctt

SEQ ID NO: 595118 - DNA, 20 bp, mouse
ggggcaatgggacccaccca

SEQ ID NO: 595119 - DNA, 20 bp, mouse
gggaatcctacgacaagcca

SEQ ID NO: 595120 - DNA, 20 bp, mouse
gtagctgcggcctccctggg

SEQ ID NO: 595121 - DNA, 20 bp, mouse
gcactagctgcggcctccct

SEQ ID NO: 595122 - DNA, 20 bp, mouse
gtgatgaagtgaggtggagt

SEQ ID NO: 595123 - DNA, 20 bp, mouse
gcagctaaggagcaccatgg

SEQ ID NO: 595124 - DNA, 20 bp, mouse
gtcccagctaaggagcacca

SEQ ID NO: 595125 - DNA, 20 bp, mouse
ggggagagagatctgagcac

SEQ ID NO: 595126 - DNA, 20 bp, mouse
gtccaggagatggcgttccg

SEQ ID NO: 595127 - DNA, 20 bp, mouse
ggatggcgttccgaggaagg

SEQ ID NO: 595128 - DNA, 20 bp, mouse
gtcctcggaacgccatctcc

SEQ ID NO: 595129 - DNA, 20 bp, mouse
gctgcgagtgaggggcaaag

SEQ ID NO: 595130 - DNA, 20 bp, mouse
gggaaggaggctaaagcagt

SEQ ID NO: 595131 - DNA, 20 bp, mouse
gctctcgggtcggatccaga

SEQ ID NO: 595132 - DNA, 20 bp, mouse
gcggagaacgaacctacgga

SEQ ID NO: 595133 - DNA, 20 bp, mouse
ggtgttccggggcacatcag

SEQ ID NO: 595134 - DNA, 20 bp, mouse
gatcgcggagaacgaaccta

SEQ ID NO: 595135 - DNA, 20 bp, mouse
gtcctgctggcagcgctgaa

SEQ ID NO: 595136 - DNA, 20 bp, mouse
gcagcgccagggccacccag

SEQ ID NO: 595137 - DNA, 20 bp, mouse
gagagcttctcggggtccgg

SEQ ID NO: 595138 - DNA, 20 bp, mouse
gaggctgcaagagcttctcg

SEQ ID NO: 595139 - DNA, 20 bp, mouse
gggccacccagcggctccag

SEQ ID NO: 595140 - DNA, 20 bp, mouse
gcgcaggcgcactggactcg

SEQ ID NO: 595141 - DNA, 20 bp, mouse
gcggtcggtgaggagaacga

SEQ ID NO: 595142 - DNA, 20 bp, mouse
gcacccaccagacccagcca

SEQ ID NO: 595143 - DNA, 20 bp, mouse
gctgctccatagctgtagtt

SEQ ID NO: 595144 - DNA, 20 bp, mouse
ggctaggcccggccccagac

SEQ ID NO: 595145 - DNA, 20 bp, mouse
ggacggctcaggggtcgaca

SEQ ID NO: 595146 - DNA, 20 bp, mouse
ggccacgcggacaccagcac

SEQ ID NO: 595147 - DNA, 20 bp, mouse
gcgcggacaccagcaccgga

SEQ ID NO: 595148 - DNA, 20 bp, mouse
gagggccgcgacgggaacgc

SEQ ID NO: 595149 - DNA, 20 bp, mouse
gccgggcgcaggccagcgag

SEQ ID NO: 595150 - DNA, 20 bp, mouse
gcgtggcgcggagcgagggt

SEQ ID NO: 595151 - DNA, 20 bp, mouse
ggcctcgccggcggagggtt

SEQ ID NO: 595152 - DNA, 20 bp, mouse
gccgccggggcgcctttcag

SEQ ID NO: 595153 - DNA, 20 bp, mouse
ggcgaggcacgcctcgagaa

SEQ ID NO: 595154 - DNA, 20 bp, mouse
gtcgaggcgtgcctcgccgg

SEQ ID NO: 595155 - DNA, 20 bp, mouse
gcggtgcgcgtcctttctcg

SEQ ID NO: 595156 - DNA, 20 bp, mouse
gtgatggtgggtgttcacgg

SEQ ID NO: 595157 - DNA, 20 bp, mouse
gtcgaagcagccatgatggt

SEQ ID NO: 595158 - DNA, 20 bp, mouse
gccaccgcgcgccccgagtt

SEQ ID NO: 595159 - DNA, 20 bp, mouse
gtcacggcggcgccgaactc

SEQ ID NO: 595160 - DNA, 20 bp, mouse
ggcccgaccccagggacgaa

SEQ ID NO: 595161 - DNA, 20 bp, mouse
gcatggctgcttcgagtcca

SEQ ID NO: 595162 - DNA, 20 bp, mouse
gtcgggagggcgacccaggg

SEQ ID NO: 595163 - DNA, 20 bp, mouse
ggggttggatcgcccaccta

SEQ ID NO: 595164 - DNA, 20 bp, mouse
gcgcgtcgcggaggtcggga

SEQ ID NO: 595165 - DNA, 20 bp, mouse
gttcctccgagaggaagtcg

SEQ ID NO: 595166 - DNA, 20 bp, mouse
gcgcgcactgccgggatgga

SEQ ID NO: 595167 - DNA, 20 bp, mouse
gaggcgctcgccgtccatcc

SEQ ID NO: 595168 - DNA, 20 bp, mouse
gtcctcggagctggcggtcg

SEQ ID NO: 595169 - DNA, 20 bp, mouse
gtccccgaccgccagctccg

SEQ ID NO: 595170 - DNA, 20 bp, mouse
gtcgggctcctcggagctgg

SEQ ID NO: 595171 - DNA, 20 bp, mouse
gcggtcggggagagcccgcg

SEQ ID NO: 595172 - DNA, 20 bp, mouse
gacggcgagcgcctggcgtc

SEQ ID NO: 595173 - DNA, 20 bp, mouse
gtgggcgcgcactgccggga

SEQ ID NO: 595174 - DNA, 20 bp, mouse
gccgctgccactcgggatcg

SEQ ID NO: 595175 - DNA, 20 bp, mouse
gctccgaggagcccgacgcc

SEQ ID NO: 595176 - DNA, 20 bp, mouse
ggatccgccggcgacaggta

SEQ ID NO: 595177 - DNA, 20 bp, mouse
gctgcagcgactgccggcga

SEQ ID NO: 595178 - DNA, 20 bp, mouse
gacggccgctcgctaacgga

SEQ ID NO: 595179 - DNA, 20 bp, mouse
ggcgcgggaggaagtcacgt

SEQ ID NO: 595180 - DNA, 20 bp, mouse
ggcgagcgggctcacatgac

SEQ ID NO: 595181 - DNA, 20 bp, mouse
ggtgccctacctgtcgccgg

SEQ ID NO: 595182 - DNA, 20 bp, mouse
gacccaggtgcaactccaca

SEQ ID NO: 595183 - DNA, 20 bp, mouse
gctctccgcacagggccatc

SEQ ID NO: 595184 - DNA, 20 bp, mouse
gccacacggccgctcgctaa

SEQ ID NO: 595185 - DNA, 20 bp, mouse
ggctgaagagcagcgtccca

SEQ ID NO: 595186 - DNA, 20 bp, mouse
gcgtgggcctgaaagagaca

SEQ ID NO: 595187 - DNA, 20 bp, mouse
gaacatcccaggtcactgag

SEQ ID NO: 595188 - DNA, 20 bp, mouse
gagtgacctgggatgttcgt

SEQ ID NO: 595189 - DNA, 20 bp, mouse
ggcagcagtgggttcccctg

SEQ ID NO: 595190 - DNA, 20 bp, mouse
gtcaggcccacgaacatccc

SEQ ID NO: 595191 - DNA, 20 bp, mouse
ggccctccactcagtgacct

SEQ ID NO: 595192 - DNA, 20 bp, mouse
gatcccaggtcactgagtgg

SEQ ID NO: 595193 - DNA, 20 bp, mouse
gtgcattcgcccggggtcca

SEQ ID NO: 595194 - DNA, 20 bp, mouse
gagtggagggccctggaccc

SEQ ID NO: 595195 - DNA, 20 bp, mouse
ggcgaatgcagatgccgcag

SEQ ID NO: 595196 - DNA, 20 bp, mouse
gagcgccgagagcaggactg

SEQ ID NO: 595197 - DNA, 20 bp, mouse
ggggagtcgccgagccgcgg

SEQ ID NO: 595198 - DNA, 20 bp, mouse
gcaggaactgcaggcgcggg

SEQ ID NO: 595199 - DNA, 20 bp, mouse
gacggcgccgcggagccgaa

SEQ ID NO: 595200 - DNA, 20 bp, mouse
ggctgccgtacggaggaagg

SEQ ID NO: 595201 - DNA, 20 bp, mouse
ggactccgtctgcggttcgg

SEQ ID NO: 595202 - DNA, 20 bp, mouse
gtggcccgcgcgctgctccg

SEQ ID NO: 595203 - DNA, 20 bp, mouse
ggcagccaccgaaccgcaga

SEQ ID NO: 595204 - DNA, 20 bp, mouse
ggcaggcgccaggctcagtg

SEQ ID NO: 595205 - DNA, 20 bp, mouse
ggtcgactccgtctgcggtt

SEQ ID NO: 595206 - DNA, 20 bp, mouse
gcgcaggacggtcggagact

SEQ ID NO: 595207 - DNA, 20 bp, mouse
gtgggcggccgcaggacggt

SEQ ID NO: 595208 - DNA, 20 bp, mouse
gaggctgggcggccgcagga

SEQ ID NO: 595209 - DNA, 20 bp, mouse
ggtctaggcggtaggctggg

SEQ ID NO: 595210 - DNA, 20 bp, mouse
ggccgccagccgggctacgg

SEQ ID NO: 595211 - DNA, 20 bp, mouse
gcaggcccgcagagccggag

SEQ ID NO: 595212 - DNA, 20 bp, mouse
gcagcagacagcgtccgggt

SEQ ID NO: 595213 - DNA, 20 bp, mouse
ggcagctgcggcggtctagg

SEQ ID NO: 595214 - DNA, 20 bp, mouse
gagcccggctggcggcgtag

SEQ ID NO: 595215 - DNA, 20 bp, mouse
ggcggtctaggcggtaggct

SEQ ID NO: 595216 - DNA, 20 bp, mouse
ggcatggtgccagtgtagag

SEQ ID NO: 595217 - DNA, 20 bp, mouse
gcctcaacggggctccggaa

SEQ ID NO: 595218 - DNA, 20 bp, mouse
gagcaggagaagggagcccg

SEQ ID NO: 595219 - DNA, 20 bp, mouse
gactcaggcgggcctgagat

SEQ ID NO: 595220 - DNA, 20 bp, mouse
gtgtgctgtccgctctacac

SEQ ID NO: 595221 - DNA, 20 bp, mouse
gctgagtgtctggagcgtgg

SEQ ID NO: 595222 - DNA, 20 bp, mouse
gacgctccagacactcaggc

SEQ ID NO: 595223 - DNA, 20 bp, mouse
gccgcgtgctggggggaaaa

SEQ ID NO: 595224 - DNA, 20 bp, mouse
gtccgaagctggggcacctt

SEQ ID NO: 595225 - DNA, 20 bp, mouse
gcggctcaccttctcctcca

SEQ ID NO: 595226 - DNA, 20 bp, mouse
gagaggagcgccggccacgg

SEQ ID NO: 595227 - DNA, 20 bp, mouse
ggcgagaggagcgccggcca

SEQ ID NO: 595228 - DNA, 20 bp, mouse
ggagctctgtctgtccgcat

SEQ ID NO: 595229 - DNA, 20 bp, mouse
ggcggcggcgacggtaggag

SEQ ID NO: 595230 - DNA, 20 bp, mouse
gagagcagctgtctccgccg

SEQ ID NO: 595231 - DNA, 20 bp, mouse
gtagcggcggagaccgtcag

SEQ ID NO: 595232 - DNA, 20 bp, mouse
gggcatccccgagactcccc

SEQ ID NO: 595233 - DNA, 20 bp, mouse
gggtagcccggggagtctcg

SEQ ID NO: 595234 - DNA, 20 bp, mouse
gcgggagagcgcgccagccc

SEQ ID NO: 595235 - DNA, 20 bp, mouse
ggaggggtccgagggagggg

SEQ ID NO: 595236 - DNA, 20 bp, mouse
gagaactgcggccgtggcag

SEQ ID NO: 595237 - DNA, 20 bp, mouse
ggccgcggctgggggctccg

SEQ ID NO: 595238 - DNA, 20 bp, mouse
ggcagagagaactgcggccg

SEQ ID NO: 595239 - DNA, 20 bp, mouse
ggctgccttggctcacctgg

SEQ ID NO: 595240 - DNA, 20 bp, mouse
gcccgcgcgcgtggagaagg

SEQ ID NO: 595241 - DNA, 20 bp, mouse
gccccggcgtggccagtagg

SEQ ID NO: 595242 - DNA, 20 bp, mouse
gcctgccgccaggtgagcca

SEQ ID NO: 595243 - DNA, 20 bp, mouse
ggaacccgggcggaggatca

SEQ ID NO: 595244 - DNA, 20 bp, mouse
gctcacctggcggcaggacg

SEQ ID NO: 595245 - DNA, 20 bp, mouse
ggcatgcgcgacagccgccc

SEQ ID NO: 595246 - DNA, 20 bp, mouse
gggcccgggagccgcagagg

SEQ ID NO: 595247 - DNA, 20 bp, mouse
gaaggaacccgggagagagg

SEQ ID NO: 595248 - DNA, 20 bp, mouse
gactcggctccggggacaga

SEQ ID NO: 595249 - DNA, 20 bp, mouse
gtcccggccactgtcccccc

SEQ ID NO: 595250 - DNA, 20 bp, mouse
gcgagaccgagaaggaaccc

SEQ ID NO: 595251 - DNA, 20 bp, mouse
gccaagtctcgccgcctctg

SEQ ID NO: 595252 - DNA, 20 bp, mouse
ggagacccgcgcagcgttgg

SEQ ID NO: 595253 - DNA, 20 bp, mouse
gcccggggcgccctaaactg

SEQ ID NO: 595254 - DNA, 20 bp, mouse
gcggccactgtccccccggg

SEQ ID NO: 595255 - DNA, 20 bp, mouse
gcccgggagagttcaagtcg

SEQ ID NO: 595256 - DNA, 20 bp, mouse
gcctgggcgagggacctcga

SEQ ID NO: 595257 - DNA, 20 bp, mouse
gagacagcggtcgtaagagc

SEQ ID NO: 595258 - DNA, 20 bp, mouse
gcggagagctgggccgggaa

SEQ ID NO: 595259 - DNA, 20 bp, mouse
gtcgcgctgcgcccagatgt

SEQ ID NO: 595260 - DNA, 20 bp, mouse
gtcgcctcggggaccatagg

SEQ ID NO: 595261 - DNA, 20 bp, mouse
gagagttagagccgcctcgg

SEQ ID NO: 595262 - DNA, 20 bp, mouse
gttacgaccgctgtctctcc

SEQ ID NO: 595263 - DNA, 20 bp, mouse
gctaggaggccagccgggag

SEQ ID NO: 595264 - DNA, 20 bp, mouse
gggccgggaagggggcgtcc

SEQ ID NO: 595265 - DNA, 20 bp, mouse
gtatggtccccgaggcgagg

SEQ ID NO: 595266 - DNA, 20 bp, mouse
ggtccctggagagcaggcgg

SEQ ID NO: 595267 - DNA, 20 bp, mouse
gccgctctgaaagaaaaggt

SEQ ID NO: 595268 - DNA, 20 bp, mouse
ggagccgaacccggaagtgg

SEQ ID NO: 595269 - DNA, 20 bp, mouse
gtgggagccgaacccggaag

SEQ ID NO: 595270 - DNA, 20 bp, mouse
gcctcgaagccgagagctgg

SEQ ID NO: 595271 - DNA, 20 bp, mouse
gaaaaggtgggagccgaacc

SEQ ID NO: 595272 - DNA, 20 bp, mouse
gagggaccgccgccacttcc

SEQ ID NO: 595273 - DNA, 20 bp, mouse
gccgccgccacttccgggtt

SEQ ID NO: 595274 - DNA, 20 bp, mouse
gagcgagcgccgggtgatgg

SEQ ID NO: 595275 - DNA, 20 bp, mouse
gccgcctcgaagccgagagc

SEQ ID NO: 595276 - DNA, 20 bp, mouse
gcccggcaggagcggaggac

SEQ ID NO: 595277 - DNA, 20 bp, mouse
gggcagcgcagtcagcgaca

SEQ ID NO: 595278 - DNA, 20 bp, mouse
gcggggacccgggcaaggag

SEQ ID NO: 595279 - DNA, 20 bp, mouse
ggctccgtccggaggaagcg

SEQ ID NO: 595280 - DNA, 20 bp, mouse
gagcggaggacgggacgcgc

SEQ ID NO: 595281 - DNA, 20 bp, mouse
gcgcgcggcggcctcatcca

SEQ ID NO: 595282 - DNA, 20 bp, mouse
ggccaggcaaggatgggccg

SEQ ID NO: 595283 - DNA, 20 bp, mouse
gtccgctcctgccgggccgg

SEQ ID NO: 595284 - DNA, 20 bp, mouse
gcagcctcgcttcctccgga

SEQ ID NO: 595285 - DNA, 20 bp, mouse
ggtgcggaggcgcccaccgg

SEQ ID NO: 595286 - DNA, 20 bp, mouse
gagccgcggcgaaggagccc

SEQ ID NO: 595287 - DNA, 20 bp, mouse
gctgagggcgcgggcggcca

SEQ ID NO: 595288 - DNA, 20 bp, mouse
gcgcgcggccgcggcccagg

SEQ ID NO: 595289 - DNA, 20 bp, mouse
gtcgcgtgtggcccagggta

SEQ ID NO: 595290 - DNA, 20 bp, mouse
gcgtgtggcccagggtaggg

SEQ ID NO: 595291 - DNA, 20 bp, mouse
gggccagggctccttcgccg

SEQ ID NO: 595292 - DNA, 20 bp, mouse
ggccgcgcgccctcccttcg

SEQ ID NO: 595293 - DNA, 20 bp, mouse
gcgcgggccccgggcaacaa

SEQ ID NO: 595294 - DNA, 20 bp, mouse
gttcctcctccccgaaggga

SEQ ID NO: 595295 - DNA, 20 bp, mouse
ggcctaccgggctgtgctga

SEQ ID NO: 595296 - DNA, 20 bp, mouse
gcccggagcgacagcgctaa

SEQ ID NO: 595297 - DNA, 20 bp, mouse
gggcctctgcctcatagagg

SEQ ID NO: 595298 - DNA, 20 bp, mouse
gacagcgctaacggccgccg

SEQ ID NO: 595299 - DNA, 20 bp, mouse
ggctaggagccgggctgggt

SEQ ID NO: 595300 - DNA, 20 bp, mouse
gcgcggcctctgcctcatag

SEQ ID NO: 595301 - DNA, 20 bp, mouse
gagccgggccgcgcgaggaa

SEQ ID NO: 595302 - DNA, 20 bp, mouse
gggcctctccatagccgagg

SEQ ID NO: 595303 - DNA, 20 bp, mouse
gctcaggacccggtacgaag

SEQ ID NO: 595304 - DNA, 20 bp, mouse
gcgcctcctcggctatggag

SEQ ID NO: 595305 - DNA, 20 bp, mouse
gcgggccgcgcgaggaaggg

SEQ ID NO: 595306 - DNA, 20 bp, mouse
gcgagaagccgacggacgga

SEQ ID NO: 595307 - DNA, 20 bp, mouse
gtgcggcgccttccgtccgt

SEQ ID NO: 595308 - DNA, 20 bp, mouse
gtttgcgcggtcctttcctg

SEQ ID NO: 595309 - DNA, 20 bp, mouse
gatgccaagccggctctccc

SEQ ID NO: 595310 - DNA, 20 bp, mouse
ggcctccccgcgccccggag

SEQ ID NO: 595311 - DNA, 20 bp, mouse
gtaaaagctccgtggcgcca

SEQ ID NO: 595312 - DNA, 20 bp, mouse
gggcgcaggccgcggtgacg

SEQ ID NO: 595313 - DNA, 20 bp, mouse
ggctctgagcctgtgggaca

SEQ ID NO: 595314 - DNA, 20 bp, mouse
ggctaagtgctgagtcaccg

SEQ ID NO: 595315 - DNA, 20 bp, mouse
gcaggtgcgccgcgtcaccg

SEQ ID NO: 595316 - DNA, 20 bp, mouse
gcgtgttctgaggagagcag

SEQ ID NO: 595317 - DNA, 20 bp, mouse
gagcgaacggccgtgttctg

SEQ ID NO: 595318 - DNA, 20 bp, mouse
gacgcgcgcctgcgagcgaa

SEQ ID NO: 595319 - DNA, 20 bp, mouse
ggtcgtaaggcaggtctggg

SEQ ID NO: 595320 - DNA, 20 bp, mouse
ggcccgacacaacattattg

SEQ ID NO: 595321 - DNA, 20 bp, mouse
gtcgcaggcgcgcgtctgct

SEQ ID NO: 595322 - DNA, 20 bp, mouse
gatagtcgtaaggcaggtct

SEQ ID NO: 595323 - DNA, 20 bp, mouse
gctgcacacgaggatcccgg

SEQ ID NO: 595324 - DNA, 20 bp, mouse
gccgcaaggacacagcgaag

SEQ ID NO: 595325 - DNA, 20 bp, mouse
ggcctcgtggtacttctcct

SEQ ID NO: 595326 - DNA, 20 bp, mouse
gcaggccagcacccagctag

SEQ ID NO: 595327 - DNA, 20 bp, mouse
ggcacccagctagaggccgg

SEQ ID NO: 595328 - DNA, 20 bp, mouse
gccagcacccagctagaggc

SEQ ID NO: 595329 - DNA, 20 bp, mouse
gtggcctgaacttcaccaga

SEQ ID NO: 595330 - DNA, 20 bp, mouse
gcttcctccggcctctagct

SEQ ID NO: 595331 - DNA, 20 bp, mouse
gcccaagagctctttccctc

SEQ ID NO: 595332 - DNA, 20 bp, mouse
ggagtggggagtagagtcat

SEQ ID NO: 595333 - DNA, 20 bp, mouse
gagtttggcacgcacctgtc

SEQ ID NO: 595334 - DNA, 20 bp, mouse
gcagccagctggacagctct

SEQ ID NO: 595335 - DNA, 20 bp, mouse
ggccatggctgacagaaccc

SEQ ID NO: 595336 - DNA, 20 bp, mouse
ggcgcgctgagagcaccgag

SEQ ID NO: 595337 - DNA, 20 bp, mouse
gcgctgagagcaccgagtgg

SEQ ID NO: 595338 - DNA, 20 bp, mouse
gagagcaccgagtggcggag

SEQ ID NO: 595339 - DNA, 20 bp, mouse
gtccggtctcctgcgtccgg

SEQ ID NO: 595340 - DNA, 20 bp, mouse
gacgccagcgggagagtcat

SEQ ID NO: 595341 - DNA, 20 bp, mouse
ggcccccggacgcaggagac

SEQ ID NO: 595342 - DNA, 20 bp, mouse
ggccgcgatggagacgccag

SEQ ID NO: 595343 - DNA, 20 bp, mouse
gggagaccggagcgcagtcg

SEQ ID NO: 595344 - DNA, 20 bp, mouse
gggcgaggcccgacaagaag

SEQ ID NO: 595345 - DNA, 20 bp, mouse
gccgcctcggactcccagtc

SEQ ID NO: 595346 - DNA, 20 bp, mouse
ggcccactgccagtccgcgg

SEQ ID NO: 595347 - DNA, 20 bp, mouse
gagcagccgagcagaagccg

SEQ ID NO: 595348 - DNA, 20 bp, mouse
gctgccgatcccccgcggac

SEQ ID NO: 595349 - DNA, 20 bp, mouse
gaggcggcagatgctccggg

SEQ ID NO: 595350 - DNA, 20 bp, mouse
ggtcccctcgctcaggtcaa

SEQ ID NO: 595351 - DNA, 20 bp, mouse
gcgcgggggatcggcagcca

SEQ ID NO: 595352 - DNA, 20 bp, mouse
gccgcactcagccgacccgg

SEQ ID NO: 595353 - DNA, 20 bp, mouse
gctgccagtccgcgggggat

SEQ ID NO: 595354 - DNA, 20 bp, mouse
gttctgctcggctgctccgg

SEQ ID NO: 595355 - DNA, 20 bp, mouse
gcccgcccactgccagtccg

SEQ ID NO: 595356 - DNA, 20 bp, mouse
gctagagactccgctgggtc

SEQ ID NO: 595357 - DNA, 20 bp, mouse
ggggtgcaggatgctccaac

SEQ ID NO: 595358 - DNA, 20 bp, mouse
gctctagacgcagctcttag

SEQ ID NO: 595359 - DNA, 20 bp, mouse
gtgcgtctagagactccgct

SEQ ID NO: 595360 - DNA, 20 bp, mouse
gatgcagcaggcaatacccg

SEQ ID NO: 595361 - DNA, 20 bp, mouse
gaggagagaagtaaccggag

SEQ ID NO: 595362 - DNA, 20 bp, mouse
ggagctgacctcaccggact

SEQ ID NO: 595363 - DNA, 20 bp, mouse
gtcttccccaggaagtgcag

SEQ ID NO: 595364 - DNA, 20 bp, mouse
ggaaagagggcgggattgaa

SEQ ID NO: 595365 - DNA, 20 bp, mouse
gggtgggtcctgggacagat

SEQ ID NO: 595366 - DNA, 20 bp, mouse
gcctggggtaggcacagtgt

SEQ ID NO: 595367 - DNA, 20 bp, mouse
ggagacgcttgcataagagt

SEQ ID NO: 595368 - DNA, 20 bp, mouse
gtgcataagagtgggcaccc

SEQ ID NO: 595369 - DNA, 20 bp, mouse
gctgcatccaaccagcacct

SEQ ID NO: 595370 - DNA, 20 bp, mouse
gggctggtgggcctagctaa

SEQ ID NO: 595371 - DNA, 20 bp, mouse
gtgccccacatggagaacta

SEQ ID NO: 595372 - DNA, 20 bp, mouse
gccattggcacgaagttgga

SEQ ID NO: 595373 - DNA, 20 bp, mouse
gtggttggatgcagagctcc

SEQ ID NO: 595374 - DNA, 20 bp, mouse
gtgggttgacgggctctgag

SEQ ID NO: 595375 - DNA, 20 bp, mouse
gggtgagagggcgggctggt

SEQ ID NO: 595376 - DNA, 20 bp, mouse
ggccgaccggatcagcactg

SEQ ID NO: 595377 - DNA, 20 bp, mouse
gtgcagagcagtagacgcca

SEQ ID NO: 595378 - DNA, 20 bp, mouse
gggagctaggccggaggcct

SEQ ID NO: 595379 - DNA, 20 bp, mouse
gtggcgggcccgcgctgagg

SEQ ID NO: 595380 - DNA, 20 bp, mouse
gtccccagtgctgatccggt

SEQ ID NO: 595381 - DNA, 20 bp, mouse
gctcccgcaagcaggcccca

SEQ ID NO: 595382 - DNA, 20 bp, mouse
gtcccgagctccagggtcag

SEQ ID NO: 595383 - DNA, 20 bp, mouse
ggtgctgatccggtcggcca

SEQ ID NO: 595384 - DNA, 20 bp, mouse
gcactggggagctaggccgg

SEQ ID NO: 595385 - DNA, 20 bp, mouse
ggccggaggcctgggcaggt

SEQ ID NO: 595386 - DNA, 20 bp, mouse
gagtagttgagagaacggag

SEQ ID NO: 595387 - DNA, 20 bp, mouse
gaacggagcggacgccatgg

SEQ ID NO: 595388 - DNA, 20 bp, mouse
gcgaggagtagttgagagaa

SEQ ID NO: 595389 - DNA, 20 bp, mouse
ggagaacggagcggacgcca

SEQ ID NO: 595390 - DNA, 20 bp, mouse
gatggcggccgacatcgagc

SEQ ID NO: 595391 - DNA, 20 bp, mouse
gggagcctggaggactagcg

SEQ ID NO: 595392 - DNA, 20 bp, mouse
gggcctgagccgagaaacga

SEQ ID NO: 595393 - DNA, 20 bp, mouse
gctgaaaacctgctcgatgt

SEQ ID NO: 595394 - DNA, 20 bp, mouse
ggcgaggagcagaaaagtct

SEQ ID NO: 595395 - DNA, 20 bp, mouse
gcgagtagctggagggtagg

SEQ ID NO: 595396 - DNA, 20 bp, mouse
ggtcttcccagatgcagctc

SEQ ID NO: 595397 - DNA, 20 bp, mouse
gcagaactcatgctggaggc

SEQ ID NO: 595398 - DNA, 20 bp, mouse
gtgattggacgtgagaaagg

SEQ ID NO: 595399 - DNA, 20 bp, mouse
ggacttaccagaactcatgc

SEQ ID NO: 595400 - DNA, 20 bp, mouse
gaccttgtatacacagtata

SEQ ID NO: 595401 - DNA, 20 bp, mouse
gtacagttcttcataactgt

SEQ ID NO: 595402 - DNA, 20 bp, mouse
gaactgggggacttatcatt

SEQ ID NO: 595403 - DNA, 20 bp, mouse
gttggttagcccacaatctg

SEQ ID NO: 595404 - DNA, 20 bp, mouse
gagattaagaaatgccacaa

SEQ ID NO: 595405 - DNA, 20 bp, mouse
gtaagtggtaatgctgctgt

SEQ ID NO: 595406 - DNA, 20 bp, mouse
gagcacaaggagggttgtcg

SEQ ID NO: 595407 - DNA, 20 bp, mouse
gcctctcttcttagatacgg

SEQ ID NO: 595408 - DNA, 20 bp, mouse
ggttcatccgcaactgaagg

SEQ ID NO: 595409 - DNA, 20 bp, mouse
gtatgcagaatgagttgctt

SEQ ID NO: 595410 - DNA, 20 bp, mouse
gagcaggatgcgagggttga

SEQ ID NO: 595411 - DNA, 20 bp, mouse
gtgaatgtagcaggatgcga

SEQ ID NO: 595412 - DNA, 20 bp, mouse
ggcatagacgtttgttgcaa

SEQ ID NO: 595413 - DNA, 20 bp, mouse
gaagaggctgtcctaataaa

SEQ ID NO: 595414 - DNA, 20 bp, mouse
ggttgttcatccgcaactga

SEQ ID NO: 595415 - DNA, 20 bp, mouse
ggtgcagtccgcttaggcaa

SEQ ID NO: 595416 - DNA, 20 bp, mouse
gcggctgcagagagctcatt

SEQ ID NO: 595417 - DNA, 20 bp, mouse
gtctctgcagccgcgctgag

SEQ ID NO: 595418 - DNA, 20 bp, mouse
gcgctcgcgggcagcaggaa

SEQ ID NO: 595419 - DNA, 20 bp, mouse
gccccagctgagagaactcg

SEQ ID NO: 595420 - DNA, 20 bp, mouse
gagcaggtgtgtgctcggat

SEQ ID NO: 595421 - DNA, 20 bp, mouse
gagagctcattgggttccac

SEQ ID NO: 595422 - DNA, 20 bp, mouse
gctgcagagatagccgtgca

SEQ ID NO: 595423 - DNA, 20 bp, mouse
gatggctggtcctctcagcg

SEQ ID NO: 595424 - DNA, 20 bp, mouse
ggagaactcggggttctaaa

SEQ ID NO: 595425 - DNA, 20 bp, mouse
gtatggctacgaaaagccag

SEQ ID NO: 595426 - DNA, 20 bp, mouse
gctctgcagagtacacacga

SEQ ID NO: 595427 - DNA, 20 bp, mouse
gatgcttgggtcaaggttgg

SEQ ID NO: 595428 - DNA, 20 bp, mouse
ggtacacacgaaggagcagc

SEQ ID NO: 595429 - DNA, 20 bp, mouse
gacactagcaggccaggtgg

SEQ ID NO: 595430 - DNA, 20 bp, mouse
ggccttgcatgcttgggtca

SEQ ID NO: 595431 - DNA, 20 bp, mouse
gggtcaaggttggaggacgc

SEQ ID NO: 595432 - DNA, 20 bp, mouse
gaccagggatgaaatcatcc

SEQ ID NO: 595433 - DNA, 20 bp, mouse
ggccgtggatcgacaatata

SEQ ID NO: 595434 - DNA, 20 bp, mouse
gtgatgggccagcagttgat

SEQ ID NO: 595435 - DNA, 20 bp, mouse
gatgggttcggaggtgacca

SEQ ID NO: 595436 - DNA, 20 bp, mouse
ggcgagccctcggggaaaga

SEQ ID NO: 595437 - DNA, 20 bp, mouse
gccggacagagggcactcgc

SEQ ID NO: 595438 - DNA, 20 bp, mouse
gcaggaccctgagatgaatg

SEQ ID NO: 595439 - DNA, 20 bp, mouse
ggggctatgctggagtaaag

SEQ ID NO: 595440 - DNA, 20 bp, mouse
gtggcgcgtcgccggacaga

SEQ ID NO: 595441 - DNA, 20 bp, mouse
gctgtgagccggggctatgc

SEQ ID NO: 595442 - DNA, 20 bp, mouse
gggatttgaactgtgagccg

SEQ ID NO: 595443 - DNA, 20 bp, mouse
gcagccgcggcgagccctcg

SEQ ID NO: 595444 - DNA, 20 bp, mouse
gcgcccaacaaggaagagag

SEQ ID NO: 595445 - DNA, 20 bp, mouse
ggggatgctcctgccctcct

SEQ ID NO: 595446 - DNA, 20 bp, mouse
gcggagcgcgcgggttggga

SEQ ID NO: 595447 - DNA, 20 bp, mouse
gcctgccgctcgcccaggct

SEQ ID NO: 595448 - DNA, 20 bp, mouse
gtctctggagcgtagagaag

SEQ ID NO: 595449 - DNA, 20 bp, mouse
gcgagcggcaggcacctgcc

SEQ ID NO: 595450 - DNA, 20 bp, mouse
gcgaggctacaggctgacgg

SEQ ID NO: 595451 - DNA, 20 bp, mouse
gtgtgcggagcgcgcgggtt

SEQ ID NO: 595452 - DNA, 20 bp, mouse
gggagccgaactgaagtcac

SEQ ID NO: 595453 - DNA, 20 bp, mouse
gctccagagatgggaaaagt

SEQ ID NO: 595454 - DNA, 20 bp, mouse
gctgcggagggcagcaagag

SEQ ID NO: 595455 - DNA, 20 bp, mouse
gaggctgctgcagacgccgg

SEQ ID NO: 595456 - DNA, 20 bp, mouse
gcatggtcgctggtaggtaa

SEQ ID NO: 595457 - DNA, 20 bp, mouse
gggcggtgcggacgacaccg

SEQ ID NO: 595458 - DNA, 20 bp, mouse
gacaccgcggccgggagagc

SEQ ID NO: 595459 - DNA, 20 bp, mouse
gtcgctggtaggtaacggcg

SEQ ID NO: 595460 - DNA, 20 bp, mouse
gctggtaggtaacggcgggg

SEQ ID NO: 595461 - DNA, 20 bp, mouse
ggtgcgccatggtcgctggt

SEQ ID NO: 595462 - DNA, 20 bp, mouse
gacgaacgtggccagcacgg

SEQ ID NO: 595463 - DNA, 20 bp, mouse
gcagcgaccatggcgcaccg

SEQ ID NO: 595464 - DNA, 20 bp, mouse
gcagcgccctcccgctctcc

SEQ ID NO: 595465 - DNA, 20 bp, mouse
gggctgcctgcggagcgatg

SEQ ID NO: 595466 - DNA, 20 bp, mouse
gggtagccgcagcgggatgg

SEQ ID NO: 595467 - DNA, 20 bp, mouse
gcgtggtagccgcagcggga

SEQ ID NO: 595468 - DNA, 20 bp, mouse
gcgagccgtggtagccgcag

SEQ ID NO: 595469 - DNA, 20 bp, mouse
gcactcggcagcccgagccg

SEQ ID NO: 595470 - DNA, 20 bp, mouse
gaagagcagcagcccagtcc

SEQ ID NO: 595471 - DNA, 20 bp, mouse
gtcggcgggcgccacacact

SEQ ID NO: 595472 - DNA, 20 bp, mouse
gacgggcagcggagaaccgg

SEQ ID NO: 595473 - DNA, 20 bp, mouse
gcaggcactgagcgccccgc

SEQ ID NO: 595474 - DNA, 20 bp, mouse
gccgctgcccgtggcaagag

SEQ ID NO: 595475 - DNA, 20 bp, mouse
gggcgagccgcggggagata

SEQ ID NO: 595476 - DNA, 20 bp, mouse
ggccccttactccagaccct

SEQ ID NO: 595477 - DNA, 20 bp, mouse
gggtaaacccaggcagtcag

SEQ ID NO: 595478 - DNA, 20 bp, mouse
gcgtccaaccgccaagggtc

SEQ ID NO: 595479 - DNA, 20 bp, mouse
gctggggcggagcctagaga

SEQ ID NO: 595480 - DNA, 20 bp, mouse
gggaaggagtgtgggaactc

SEQ ID NO: 595481 - DNA, 20 bp, mouse
ggggcaaaccggagctgggt

SEQ ID NO: 595482 - DNA, 20 bp, mouse
gcccgcgcttcgccttctct

SEQ ID NO: 595483 - DNA, 20 bp, mouse
gtctatgagcaacagaactt

SEQ ID NO: 595484 - DNA, 20 bp, mouse
gtctgctcgtccaaccgcca

SEQ ID NO: 595485 - DNA, 20 bp, mouse
gtgctcccagagcctagacc

SEQ ID NO: 595486 - DNA, 20 bp, mouse
gcagcgcgaccagggcgaat

SEQ ID NO: 595487 - DNA, 20 bp, mouse
ggaccagggcgaataggaaa

SEQ ID NO: 595488 - DNA, 20 bp, mouse
gggcgacacggagcagcagg

SEQ ID NO: 595489 - DNA, 20 bp, mouse
gcggggtagcagcgcgacca

SEQ ID NO: 595490 - DNA, 20 bp, mouse
ggggagcgttcgcccgaaca

SEQ ID NO: 595491 - DNA, 20 bp, mouse
gcgctccgccgggtcctgag

SEQ ID NO: 595492 - DNA, 20 bp, mouse
ggaagccactcaggacccgg

SEQ ID NO: 595493 - DNA, 20 bp, mouse
ggcccccgccgagagccccg

SEQ ID NO: 595494 - DNA, 20 bp, mouse
gcaggaagccactcaggacc

SEQ ID NO: 595495 - DNA, 20 bp, mouse
ggctgcgagctcacacgtga

SEQ ID NO: 595496 - DNA, 20 bp, mouse
ggccgggtggcaggtgtcag

SEQ ID NO: 595497 - DNA, 20 bp, mouse
gcagcgatggagcggccccg

SEQ ID NO: 595498 - DNA, 20 bp, mouse
gggccccggggagctgcgga

SEQ ID NO: 595499 - DNA, 20 bp, mouse
gcagcagttgaaggagcagg

SEQ ID NO: 595500 - DNA, 20 bp, mouse
gaggccgtccgcagctcccc

SEQ ID NO: 595501 - DNA, 20 bp, mouse
gtgtcagcggcgtctgcatt

SEQ ID NO: 595502 - DNA, 20 bp, mouse
gaggcagcagttgaaggagc

SEQ ID NO: 595503 - DNA, 20 bp, mouse
gagccggtcctggccgacgg

SEQ ID NO: 595504 - DNA, 20 bp, mouse
ggccgaggggccagcgcaaa

SEQ ID NO: 595505 - DNA, 20 bp, mouse
gcgtctgcattcggcagcga

SEQ ID NO: 595506 - DNA, 20 bp, mouse
gtccggcgctacaccggcgg

SEQ ID NO: 595507 - DNA, 20 bp, mouse
gggaagctccggcgctacac

SEQ ID NO: 595508 - DNA, 20 bp, mouse
gagctccggcgctacaccgg

SEQ ID NO: 595509 - DNA, 20 bp, mouse
gggcctggcccgccgagaga

SEQ ID NO: 595510 - DNA, 20 bp, mouse
ggccaagcggccggattccc

SEQ ID NO: 595511 - DNA, 20 bp, mouse
ggagagccaacgcaacccgg

SEQ ID NO: 595512 - DNA, 20 bp, mouse
ggtttgctagtaggaagctc

SEQ ID NO: 595513 - DNA, 20 bp, mouse
ggcgctggcgaggagtctgg

SEQ ID NO: 595514 - DNA, 20 bp, mouse
gacgaagcgggagcaggggt

SEQ ID NO: 595515 - DNA, 20 bp, mouse
gaggtcgctgccggggaatc

SEQ ID NO: 595516 - DNA, 20 bp, mouse
ggcgctgcgcacccagacaa

SEQ ID NO: 595517 - DNA, 20 bp, mouse
gcgcccggtgcctgcagcgg

SEQ ID NO: 595518 - DNA, 20 bp, mouse
gctgcgcacccagacaaagg

SEQ ID NO: 595519 - DNA, 20 bp, mouse
ggcaggcaccgggcgctcgg

SEQ ID NO: 595520 - DNA, 20 bp, mouse
gtggtcttctccagagactc

SEQ ID NO: 595521 - DNA, 20 bp, mouse
ggtgactcgggcggacccgg

SEQ ID NO: 595522 - DNA, 20 bp, mouse
gagactcgggagagcgagcg

SEQ ID NO: 595523 - DNA, 20 bp, mouse
gactcgggcggacccggcgg

SEQ ID NO: 595524 - DNA, 20 bp, mouse
gagccgccgctgcaggcacc

SEQ ID NO: 595525 - DNA, 20 bp, mouse
gcgcacccagacaaaggagg

SEQ ID NO: 595526 - DNA, 20 bp, mouse
gtgaggcacggggctagtga

SEQ ID NO: 595527 - DNA, 20 bp, mouse
gagggctgcatgctgccagg

SEQ ID NO: 595528 - DNA, 20 bp, mouse
ggtgcacaagtaggcagatg

SEQ ID NO: 595529 - DNA, 20 bp, mouse
gagtaggcagatgaggcacg

SEQ ID NO: 595530 - DNA, 20 bp, mouse
gggagggcactcggtagcac

SEQ ID NO: 595531 - DNA, 20 bp, mouse
gccgagtgccctcctccacc

SEQ ID NO: 595532 - DNA, 20 bp, mouse
gccagtgtccagcctagata

SEQ ID NO: 595533 - DNA, 20 bp, mouse
gtgccacagaggtcatccca

SEQ ID NO: 595534 - DNA, 20 bp, mouse
gtggcgtcatagggatggtg

SEQ ID NO: 595535 - DNA, 20 bp, mouse
gagccctgggatgacctctg

SEQ ID NO: 595536 - DNA, 20 bp, mouse
gccacagtgcagaagcaagg

SEQ ID NO: 595537 - DNA, 20 bp, mouse
gcaggaggaagcatgatgag

SEQ ID NO: 595538 - DNA, 20 bp, mouse
ggaggaagcatgatgagtgg

SEQ ID NO: 595539 - DNA, 20 bp, mouse
ggatgagtggaggatttgct

SEQ ID NO: 595540 - DNA, 20 bp, mouse
ggcaagggggaaagaattag

SEQ ID NO: 595541 - DNA, 20 bp, mouse
gactgtggaatcccttccca

SEQ ID NO: 595542 - DNA, 20 bp, mouse
ggctatataaagggaacctt

SEQ ID NO: 595543 - DNA, 20 bp, mouse
gtgagagagagatgaatggc

SEQ ID NO: 595544 - DNA, 20 bp, mouse
gagcaatctggtgcatgtgt

SEQ ID NO: 595545 - DNA, 20 bp, mouse
gagtccacagtgcagaagca

SEQ ID NO: 595546 - DNA, 20 bp, mouse
gtaagccgagcgccgcacag

SEQ ID NO: 595547 - DNA, 20 bp, mouse
gctgccactggaggtgcgga

SEQ ID NO: 595548 - DNA, 20 bp, mouse
gacagctgccactggaggtg

SEQ ID NO: 595549 - DNA, 20 bp, mouse
gtacaggtgacagctgccac

SEQ ID NO: 595550 - DNA, 20 bp, mouse
ggccgtgctgagaagtctcc

SEQ ID NO: 595551 - DNA, 20 bp, mouse
gctgagaggtcctgtccaat

SEQ ID NO: 595552 - DNA, 20 bp, mouse
gcgcccagccgggctcacct

SEQ ID NO: 595553 - DNA, 20 bp, mouse
gactggaggtgcggagggaa

SEQ ID NO: 595554 - DNA, 20 bp, mouse
ggcctggcccccagactggg

SEQ ID NO: 595555 - DNA, 20 bp, mouse
gagcctggcgcccattggac

SEQ ID NO: 595556 - DNA, 20 bp, mouse
gtccccagggcgctccagga

SEQ ID NO: 595557 - DNA, 20 bp, mouse
gggcgccgcccgcatcccca

SEQ ID NO: 595558 - DNA, 20 bp, mouse
gcagtgcgccaggaccccga

SEQ ID NO: 595559 - DNA, 20 bp, mouse
ggtgtcacctgcgcccaggg

SEQ ID NO: 595560 - DNA, 20 bp, mouse
gaggtacagggacctactgg

SEQ ID NO: 595561 - DNA, 20 bp, mouse
gcggcctccgcggctgatgg

SEQ ID NO: 595562 - DNA, 20 bp, mouse
ggccctcctggagcgccctg

SEQ ID NO: 595563 - DNA, 20 bp, mouse
gagagtgtcacctgcgccca

SEQ ID NO: 595564 - DNA, 20 bp, mouse
gcacccgcctccatcagccg

SEQ ID NO: 595565 - DNA, 20 bp, mouse
gccgcctccatcagccgcgg

SEQ ID NO: 595566 - DNA, 20 bp, mouse
ggccttccaagggccccaca

SEQ ID NO: 595567 - DNA, 20 bp, mouse
ggcgttcgttggccttccaa

SEQ ID NO: 595568 - DNA, 20 bp, mouse
ggccaacgaacgctagaccc

SEQ ID NO: 595569 - DNA, 20 bp, mouse
gtcccgcctgggtggctccg

SEQ ID NO: 595570 - DNA, 20 bp, mouse
gctagaccccggagccaccc

SEQ ID NO: 595571 - DNA, 20 bp, mouse
ggaggaactggagctggcgg

SEQ ID NO: 595572 - DNA, 20 bp, mouse
gaggttggcactgtccctga

SEQ ID NO: 595573 - DNA, 20 bp, mouse
ggcaactggactccgaggga

SEQ ID NO: 595574 - DNA, 20 bp, mouse
ggaccccggagccacccagg

SEQ ID NO: 595575 - DNA, 20 bp, mouse
gctccagttcctctccctgt

SEQ ID NO: 595576 - DNA, 20 bp, mouse
gcgaggccgtgcgctcggag

SEQ ID NO: 595577 - DNA, 20 bp, mouse
ggctgtccgctgcctgcccg

SEQ ID NO: 595578 - DNA, 20 bp, mouse
gacttcgagccgacaagagg

SEQ ID NO: 595579 - DNA, 20 bp, mouse
ggagctgtgccgctgtgccc

SEQ ID NO: 595580 - DNA, 20 bp, mouse
gtgcagtcgtggccaagttg

SEQ ID NO: 595581 - DNA, 20 bp, mouse
ggcagcggacagcttgtcct

SEQ ID NO: 595582 - DNA, 20 bp, mouse
gctcggagcggaggcgcacg

SEQ ID NO: 595583 - DNA, 20 bp, mouse
ggaagttgcggtcccagagt

SEQ ID NO: 595584 - DNA, 20 bp, mouse
gtcgcggtgcagccagggag

SEQ ID NO: 595585 - DNA, 20 bp, mouse
ggaggcgcacgcggggccgg

SEQ ID NO: 595586 - DNA, 20 bp, mouse
gctccgtccagacaaggcag

SEQ ID NO: 595587 - DNA, 20 bp, mouse
gttcaggctccgtccagaca

SEQ ID NO: 595588 - DNA, 20 bp, mouse
ggtccagccagggtgtttgg

SEQ ID NO: 595589 - DNA, 20 bp, mouse
gagtctcggctgtccagcca

SEQ ID NO: 595590 - DNA, 20 bp, mouse
gtcctcaccaccaaacaccc

SEQ ID NO: 595591 - DNA, 20 bp, mouse
gagactggaggagaggtcgg

SEQ ID NO: 595592 - DNA, 20 bp, mouse
gctcaggacgagccccagac

SEQ ID NO: 595593 - DNA, 20 bp, mouse
gggtgacccagacccccggt

SEQ ID NO: 595594 - DNA, 20 bp, mouse
gaggacgagccccagactgg

SEQ ID NO: 595595 - DNA, 20 bp, mouse
ggctgtccagccagggtgtt

SEQ ID NO: 595596 - DNA, 20 bp, mouse
gccggaccccaagcactccc

SEQ ID NO: 595597 - DNA, 20 bp, mouse
gcgcgcgcctgggagtgctt

SEQ ID NO: 595598 - DNA, 20 bp, mouse
gtggggtccggcgcttgcgg

SEQ ID NO: 595599 - DNA, 20 bp, mouse
gacgcgctggacaccgagga

SEQ ID NO: 595600 - DNA, 20 bp, mouse
gcttgccggagaaggtggag

SEQ ID NO: 595601 - DNA, 20 bp, mouse
gagaagaagcgcgcgcgcct

SEQ ID NO: 595602 - DNA, 20 bp, mouse
ggctgcggcggcgaccggag

SEQ ID NO: 595603 - DNA, 20 bp, mouse
gcgggacgcgctggacaccg

SEQ ID NO: 595604 - DNA, 20 bp, mouse
gtgcaacttgccggagaagg

SEQ ID NO: 595605 - DNA, 20 bp, mouse
ggccctggacgagagcgacc

SEQ ID NO: 595606 - DNA, 20 bp, mouse
gggccgctagacgccgccgg

SEQ ID NO: 595607 - DNA, 20 bp, mouse
ggggccgtccgcatcctccg

SEQ ID NO: 595608 - DNA, 20 bp, mouse
gcggcccgggcccggcacga

SEQ ID NO: 595609 - DNA, 20 bp, mouse
gccgtccgcatcctccgcgg

SEQ ID NO: 595610 - DNA, 20 bp, mouse
gggtgtggtcgcagcacgag

SEQ ID NO: 595611 - DNA, 20 bp, mouse
gcccgagcggccacattaag

SEQ ID NO: 595612 - DNA, 20 bp, mouse
ggctgctgcaccatcgtgcc

SEQ ID NO: 595613 - DNA, 20 bp, mouse
gcacgagcggagaaaaatca

SEQ ID NO: 595614 - DNA, 20 bp, mouse
ggctggtgcaagaccccgag

SEQ ID NO: 595615 - DNA, 20 bp, mouse
gccgggccgctagacgccgc

SEQ ID NO: 595616 - DNA, 20 bp, mouse
gggccagctgcacagagacg

SEQ ID NO: 595617 - DNA, 20 bp, mouse
gccagacagcgctagcacca

SEQ ID NO: 595618 - DNA, 20 bp, mouse
ggtgggcacactgaccccgg

SEQ ID NO: 595619 - DNA, 20 bp, mouse
gcctgcagaaggagggacag

SEQ ID NO: 595620 - DNA, 20 bp, mouse
gcactctccagggacccccg

SEQ ID NO: 595621 - DNA, 20 bp, mouse
gaactgcaccatcaagtctg

SEQ ID NO: 595622 - DNA, 20 bp, mouse
gggctgggtctccactgcag

SEQ ID NO: 595623 - DNA, 20 bp, mouse
ggagtgctaggcacctgagg

SEQ ID NO: 595624 - DNA, 20 bp, mouse
gtgcaccttggggagcctcg

SEQ ID NO: 595625 - DNA, 20 bp, mouse
gaggtgcctagcactctcca

SEQ ID NO: 595626 - DNA, 20 bp, mouse
gagcagcgcccggaaaccac

SEQ ID NO: 595627 - DNA, 20 bp, mouse
gcctggccgagaatgcgggg

SEQ ID NO: 595628 - DNA, 20 bp, mouse
gcgctcggcctggagtctgt

SEQ ID NO: 595629 - DNA, 20 bp, mouse
gcgcccggaaaccacgggag

SEQ ID NO: 595630 - DNA, 20 bp, mouse
ggcacctggccgagaatgcg

SEQ ID NO: 595631 - DNA, 20 bp, mouse
gccggaaaccacgggagggg

SEQ ID NO: 595632 - DNA, 20 bp, mouse
ggggggccgaagggtaggaa

SEQ ID NO: 595633 - DNA, 20 bp, mouse
gcagagtcccgggctcagga

SEQ ID NO: 595634 - DNA, 20 bp, mouse
ggtacttgggccccaatctc

SEQ ID NO: 595635 - DNA, 20 bp, mouse
ggtctctcccctggcttctc

SEQ ID NO: 595636 - DNA, 20 bp, mouse
gtagcacctgggtgcactcc

SEQ ID NO: 595637 - DNA, 20 bp, mouse
gggaaaggcctgtagcacct

SEQ ID NO: 595638 - DNA, 20 bp, mouse
gagctgccaggagtgcaccc

SEQ ID NO: 595639 - DNA, 20 bp, mouse
ggtgcactcctggcagctgt

SEQ ID NO: 595640 - DNA, 20 bp, mouse
gggctgagtacaggtgggaa

SEQ ID NO: 595641 - DNA, 20 bp, mouse
ggtttcaagcgtgcagctct

SEQ ID NO: 595642 - DNA, 20 bp, mouse
gaggtgaagcctctttgaga

SEQ ID NO: 595643 - DNA, 20 bp, mouse
gcggtaaagggctccagaca

SEQ ID NO: 595644 - DNA, 20 bp, mouse
ggcgatcgattgtcacctct

SEQ ID NO: 595645 - DNA, 20 bp, mouse
ggatcgctgggagcaaagtt

SEQ ID NO: 595646 - DNA, 20 bp, mouse
ggcgaagggttaggtctacc

SEQ ID NO: 595647 - DNA, 20 bp, mouse
gtagatctccagcgcggatt

SEQ ID NO: 595648 - DNA, 20 bp, mouse
gctaccaggagagcagcggg

SEQ ID NO: 595649 - DNA, 20 bp, mouse
ggcggattaggcgaagggtt

SEQ ID NO: 595650 - DNA, 20 bp, mouse
gactgggtagatctccagcg

SEQ ID NO: 595651 - DNA, 20 bp, mouse
gccagcgcggattaggcgaa

SEQ ID NO: 595652 - DNA, 20 bp, mouse
ggccatgagcagcccggatg

SEQ ID NO: 595653 - DNA, 20 bp, mouse
gaggaactcgtaaagctgag

SEQ ID NO: 595654 - DNA, 20 bp, mouse
gccatagcagagctcggggt

SEQ ID NO: 595655 - DNA, 20 bp, mouse
ggcagagctcggggtcggtc

SEQ ID NO: 595656 - DNA, 20 bp, mouse
gtgctggcgggtctgaagtg

SEQ ID NO: 595657 - DNA, 20 bp, mouse
gtgctatctagggactccag

SEQ ID NO: 595658 - DNA, 20 bp, mouse
gacccgccagcagtgtgagt

SEQ ID NO: 595659 - DNA, 20 bp, mouse
gtatctagggactccagggg

SEQ ID NO: 595660 - DNA, 20 bp, mouse
gtatggcccactcacactgc

SEQ ID NO: 595661 - DNA, 20 bp, mouse
gtcttgatagatactttggg

SEQ ID NO: 595662 - DNA, 20 bp, mouse
gtactttgggaggagtgttg

SEQ ID NO: 595663 - DNA, 20 bp, mouse
gggcgggtctgaagtgcggt

SEQ ID NO: 595664 - DNA, 20 bp, mouse
gttctcttgatagatacttt

SEQ ID NO: 595665 - DNA, 20 bp, mouse
gtagatctaggtaagaggac

SEQ ID NO: 595666 - DNA, 20 bp, mouse
ggcgggagcgcaggagacag

SEQ ID NO: 595667 - DNA, 20 bp, mouse
gggcactgcaaagccaagta

SEQ ID NO: 595668 - DNA, 20 bp, mouse
gacgtcgggtggagacactg

SEQ ID NO: 595669 - DNA, 20 bp, mouse
gcggaggtctgatggacgtc

SEQ ID NO: 595670 - DNA, 20 bp, mouse
gactgcaaagccaagtacgg

SEQ ID NO: 595671 - DNA, 20 bp, mouse
ggccaagtacggaggtctga

SEQ ID NO: 595672 - DNA, 20 bp, mouse
gtccatcagacctccgtact

SEQ ID NO: 595673 - DNA, 20 bp, mouse
gaggtctgatggacgtcggg

SEQ ID NO: 595674 - DNA, 20 bp, mouse
ggcaaggcctgggcggaacg

SEQ ID NO: 595675 - DNA, 20 bp, mouse
gacggggaggcgggcgaggt

SEQ ID NO: 595676 - DNA, 20 bp, mouse
gaaagtatcaggagttgtca

SEQ ID NO: 595677 - DNA, 20 bp, mouse
gcccagccctagtcttaaag

SEQ ID NO: 595678 - DNA, 20 bp, mouse
ggccctgcgcggagatctgg

SEQ ID NO: 595679 - DNA, 20 bp, mouse
gcaatcgcggcggcccgagg

SEQ ID NO: 595680 - DNA, 20 bp, mouse
ggatctggcggagaatagtt

SEQ ID NO: 595681 - DNA, 20 bp, mouse
gagacgggcgaagtgcaatt

SEQ ID NO: 595682 - DNA, 20 bp, mouse
gacggccctgcgcggagatc

SEQ ID NO: 595683 - DNA, 20 bp, mouse
gggcccggccgggactgtgg

SEQ ID NO: 595684 - DNA, 20 bp, mouse
gggggaagcggagctcgaga

SEQ ID NO: 595685 - DNA, 20 bp, mouse
gggcggaggaggcaacgcca

SEQ ID NO: 595686 - DNA, 20 bp, mouse
gcggcgccaacactcgcagg

SEQ ID NO: 595687 - DNA, 20 bp, mouse
gtgtcgccacctgcgagtgt

SEQ ID NO: 595688 - DNA, 20 bp, mouse
gtgccggcgccaacactcgc

SEQ ID NO: 595689 - DNA, 20 bp, mouse
gcggagtagccgggacccag

SEQ ID NO: 595690 - DNA, 20 bp, mouse
gggcgactgcagcccggctc

SEQ ID NO: 595691 - DNA, 20 bp, mouse
ggctgcagtcgcctcggaag

SEQ ID NO: 595692 - DNA, 20 bp, mouse
ggatgcagggatccaggtcc

SEQ ID NO: 595693 - DNA, 20 bp, mouse
ggaggcgcgctcaccgagag

SEQ ID NO: 595694 - DNA, 20 bp, mouse
gcgcaggctggaaggatgca

SEQ ID NO: 595695 - DNA, 20 bp, mouse
ggcagtcgcctcggaagcgg

SEQ ID NO: 595696 - DNA, 20 bp, mouse
gccggcagctcaggcgggaa

SEQ ID NO: 595697 - DNA, 20 bp, mouse
ggaagggctccgcgcaaagt

SEQ ID NO: 595698 - DNA, 20 bp, mouse
gaaagtcggcgggaactcgc

SEQ ID NO: 595699 - DNA, 20 bp, mouse
gcagctcgagagaacgcatc

SEQ ID NO: 595700 - DNA, 20 bp, mouse
ggggctccgcgcaaagtcgg

SEQ ID NO: 595701 - DNA, 20 bp, mouse
ggagcgaacgcaggcaacgg

SEQ ID NO: 595702 - DNA, 20 bp, mouse
ggaagggcaggctagccgaa

SEQ ID NO: 595703 - DNA, 20 bp, mouse
gtacctgctcagatccggga

SEQ ID NO: 595704 - DNA, 20 bp, mouse
gagcaggctgtacatcgccg

SEQ ID NO: 595705 - DNA, 20 bp, mouse
gaggaggtgcgccagcgtgg

SEQ ID NO: 595706 - DNA, 20 bp, mouse
ggccgccgcgccaaccgccg

SEQ ID NO: 595707 - DNA, 20 bp, mouse
ggggcgcaacgggcgcggag

SEQ ID NO: 595708 - DNA, 20 bp, mouse
ggcaacgggcgcggaggggt

SEQ ID NO: 595709 - DNA, 20 bp, mouse
gggaaggtggcggcctcgac

SEQ ID NO: 595710 - DNA, 20 bp, mouse
gcgggcggagcggggcgcaa

SEQ ID NO: 595711 - DNA, 20 bp, mouse
gcgcgcctgcgcggacgagg

SEQ ID NO: 595712 - DNA, 20 bp, mouse
ggccgcggcggttggcgcgg

SEQ ID NO: 595713 - DNA, 20 bp, mouse
gtgcctccggctcccgacga

SEQ ID NO: 595714 - DNA, 20 bp, mouse
gccgcccgcgcagcccgtcg

SEQ ID NO: 595715 - DNA, 20 bp, mouse
gtcgccgtcggctcaggcca

SEQ ID NO: 595716 - DNA, 20 bp, mouse
gcgtgcaagaactggaaacc

SEQ ID NO: 595717 - DNA, 20 bp, mouse
gaagagggccgtctccctcc

SEQ ID NO: 595718 - DNA, 20 bp, mouse
ggcaagaactggaaaccggg

SEQ ID NO: 595719 - DNA, 20 bp, mouse
ggaagcgcgaggcggaattg

SEQ ID NO: 595720 - DNA, 20 bp, mouse
gctggctccgggactctctg

SEQ ID NO: 595721 - DNA, 20 bp, mouse
gagaaacagcgtgcaagaac

SEQ ID NO: 595722 - DNA, 20 bp, mouse
gcttagagagtctgcagtgg

SEQ ID NO: 595723 - DNA, 20 bp, mouse
ggaaagacttgccccggagg

SEQ ID NO: 595724 - DNA, 20 bp, mouse
gggaatcggcgctgaggagt

SEQ ID NO: 595725 - DNA, 20 bp, mouse
gcactgcaggaaagggactt

SEQ ID NO: 595726 - DNA, 20 bp, mouse
gggtagtacacttccagcag

SEQ ID NO: 595727 - DNA, 20 bp, mouse
gagagtgtgcggctgtgcag

SEQ ID NO: 595728 - DNA, 20 bp, mouse
gagaatggtcaaggagtcct

SEQ ID NO: 595729 - DNA, 20 bp, mouse
gcacagcggccacctatgat

SEQ ID NO: 595730 - DNA, 20 bp, mouse
gtacacttccagcagcggtc

SEQ ID NO: 595731 - DNA, 20 bp, mouse
gggtgtgcggggatcaatga

SEQ ID NO: 595732 - DNA, 20 bp, mouse
gggagccagccgatcatagg

SEQ ID NO: 595733 - DNA, 20 bp, mouse
gggagtagccagaccgctgc

SEQ ID NO: 595734 - DNA, 20 bp, mouse
gcagcagtctgtgaacccac

SEQ ID NO: 595735 - DNA, 20 bp, mouse
ggttggagccagccgatcat

SEQ ID NO: 595736 - DNA, 20 bp, mouse
ggcttccaatgaggacactg

SEQ ID NO: 595737 - DNA, 20 bp, mouse
ggcaactgaggcttccaatg

SEQ ID NO: 595738 - DNA, 20 bp, mouse
gattcctgaaagagaggtac

SEQ ID NO: 595739 - DNA, 20 bp, mouse
gactccagtacctctctttc

SEQ ID NO: 595740 - DNA, 20 bp, mouse
gtctttgtctatcaaatcat

SEQ ID NO: 595741 - DNA, 20 bp, mouse
gtttccatgatggctccaag

SEQ ID NO: 595742 - DNA, 20 bp, mouse
ggccaactctcaaaattatt

SEQ ID NO: 595743 - DNA, 20 bp, mouse
gccggggatgctgctgttag

SEQ ID NO: 595744 - DNA, 20 bp, mouse
gtagactgtgttgtatgtac

SEQ ID NO: 595745 - DNA, 20 bp, mouse
gttttcttcgtggaagggtg

SEQ ID NO: 595746 - DNA, 20 bp, mouse
ggacgtcgcgacctgagcga

SEQ ID NO: 595747 - DNA, 20 bp, mouse
gggtcagcgccggccccacg

SEQ ID NO: 595748 - DNA, 20 bp, mouse
ggctgacctggccctcgctc

SEQ ID NO: 595749 - DNA, 20 bp, mouse
gagtccctcggtccacggat

SEQ ID NO: 595750 - DNA, 20 bp, mouse
ggcgaggccatggccgaacg

SEQ ID NO: 595751 - DNA, 20 bp, mouse
gcaggtcgcgacgtccaact

SEQ ID NO: 595752 - DNA, 20 bp, mouse
gcacttggcttcgcctcgtg

SEQ ID NO: 595753 - DNA, 20 bp, mouse
ggccgtcccccgaccttcag

SEQ ID NO: 595754 - DNA, 20 bp, mouse
gtaaataagggccaagcccg

SEQ ID NO: 595755 - DNA, 20 bp, mouse
gcgcgacctgagcgagggcc

SEQ ID NO: 595756 - DNA, 20 bp, mouse
gagctgctgctgggcccctg

SEQ ID NO: 595757 - DNA, 20 bp, mouse
gtgagactgagctactgcgg

SEQ ID NO: 595758 - DNA, 20 bp, mouse
gtgcggtgaggacaaagatt

SEQ ID NO: 595759 - DNA, 20 bp, mouse
gaactgagactgagctactg

SEQ ID NO: 595760 - DNA, 20 bp, mouse
ggtcgcgcccggtcactctg

SEQ ID NO: 595761 - DNA, 20 bp, mouse
gaaggacactctagaatcca

SEQ ID NO: 595762 - DNA, 20 bp, mouse
gcgccgccgcgcacaggcat

SEQ ID NO: 595763 - DNA, 20 bp, mouse
gggccgaggggatactgctg

SEQ ID NO: 595764 - DNA, 20 bp, mouse
gtcagtggggatggacgcag

SEQ ID NO: 595765 - DNA, 20 bp, mouse
gcccttaagcacctgcgaca

SEQ ID NO: 595766 - DNA, 20 bp, mouse
ggagagccgagagcgctgct

SEQ ID NO: 595767 - DNA, 20 bp, mouse
gcgctcccacagaagtttcc

SEQ ID NO: 595768 - DNA, 20 bp, mouse
gagcgctgctcggaactgcc

SEQ ID NO: 595769 - DNA, 20 bp, mouse
gcagttccgagcagcgctct

SEQ ID NO: 595770 - DNA, 20 bp, mouse
gacttagcagaggcgctggg

SEQ ID NO: 595771 - DNA, 20 bp, mouse
ggcgcgtcaccgggctgcgg

SEQ ID NO: 595772 - DNA, 20 bp, mouse
gcccgaggtatctaacgtga

SEQ ID NO: 595773 - DNA, 20 bp, mouse
ggagcgaacggctcccgggg

SEQ ID NO: 595774 - DNA, 20 bp, mouse
gcggggaaggcgagtcggag

SEQ ID NO: 595775 - DNA, 20 bp, mouse
gaaagttcctggactgaaac

SEQ ID NO: 595776 - DNA, 20 bp, mouse
gtcacctacactggcagtta

SEQ ID NO: 595777 - DNA, 20 bp, mouse
gatgccgtaactgccagtgt

SEQ ID NO: 595778 - DNA, 20 bp, mouse
gccacccaacggccacccag

SEQ ID NO: 595779 - DNA, 20 bp, mouse
gggcccgcggtcgcaggggt

SEQ ID NO: 595780 - DNA, 20 bp, mouse
gacgtggcccgcggtcgcag

SEQ ID NO: 595781 - DNA, 20 bp, mouse
ggtgggtggccggaacccct

SEQ ID NO: 595782 - DNA, 20 bp, mouse
gggtggccggaacccctggg

SEQ ID NO: 595783 - DNA, 20 bp, mouse
gtaggtgacctggccgtggg

SEQ ID NO: 595784 - DNA, 20 bp, mouse
ggtgtaggtgacctggccgt

SEQ ID NO: 595785 - DNA, 20 bp, mouse
gactgccagtgtaggtgacc

SEQ ID NO: 595786 - DNA, 20 bp, mouse
ggaggcaagcgaacccggac

SEQ ID NO: 595787 - DNA, 20 bp, mouse
gctgaggggcgagctcaagg

SEQ ID NO: 595788 - DNA, 20 bp, mouse
gagctcaagggggtcctgta

SEQ ID NO: 595789 - DNA, 20 bp, mouse
gaaaaacgcggacgctgacg

SEQ ID NO: 595790 - DNA, 20 bp, mouse
ggggggggccgggaaaaacg

SEQ ID NO: 595791 - DNA, 20 bp, mouse
gagcgaacccggaccggaca

SEQ ID NO: 595792 - DNA, 20 bp, mouse
gacccggaccggacagggag

SEQ ID NO: 595793 - DNA, 20 bp, mouse
gaagggggtcctgtacgggg

SEQ ID NO: 595794 - DNA, 20 bp, mouse
gcccccctccctgtccggtc

SEQ ID NO: 595795 - DNA, 20 bp, mouse
gctgacgaggcaagcgaacc

SEQ ID NO: 595796 - DNA, 20 bp, mouse
ggtggagggcggaattggtg

SEQ ID NO: 595797 - DNA, 20 bp, mouse
gagggcggaattggtgtggc

SEQ ID NO: 595798 - DNA, 20 bp, mouse
gcggaattggtgtggctggc

SEQ ID NO: 595799 - DNA, 20 bp, mouse
gcccaccgtggacacttgcg

SEQ ID NO: 595800 - DNA, 20 bp, mouse
ggaacgcacctggatgctga

SEQ ID NO: 595801 - DNA, 20 bp, mouse
gacctcgcaagtgtccacgg

SEQ ID NO: 595802 - DNA, 20 bp, mouse
gtggatgctgagggctgcca

SEQ ID NO: 595803 - DNA, 20 bp, mouse
gacttgcgaggtccaacctc

SEQ ID NO: 595804 - DNA, 20 bp, mouse
gtggacctcgcaagtgtcca

SEQ ID NO: 595805 - DNA, 20 bp, mouse
gataacggcaccgcccaccg

SEQ ID NO: 595806 - DNA, 20 bp, mouse
gctccaagggaccctgttca

SEQ ID NO: 595807 - DNA, 20 bp, mouse
ggccagctggctgttaggat

SEQ ID NO: 595808 - DNA, 20 bp, mouse
gtaccctgaacagggtccct

SEQ ID NO: 595809 - DNA, 20 bp, mouse
ggttcggtctaccctgaaca

SEQ ID NO: 595810 - DNA, 20 bp, mouse
ggctggctgttaggatagga

SEQ ID NO: 595811 - DNA, 20 bp, mouse
gctaaggccagctggctgtt

SEQ ID NO: 595812 - DNA, 20 bp, mouse
gatggttggaaaggccaaaa

SEQ ID NO: 595813 - DNA, 20 bp, mouse
gaggtggaagggtctgtttc

SEQ ID NO: 595814 - DNA, 20 bp, mouse
gactctaaaggcttccattt

SEQ ID NO: 595815 - DNA, 20 bp, mouse
gtcccctacacagactccaa

SEQ ID NO: 595816 - DNA, 20 bp, mouse
gggcggtgtcaggctctcgg

SEQ ID NO: 595817 - DNA, 20 bp, mouse
gggtgtcaggctctcggtgg

SEQ ID NO: 595818 - DNA, 20 bp, mouse
gaagatgtcgtaatgagcgg

SEQ ID NO: 595819 - DNA, 20 bp, mouse
gaggaagatgtcgtaatgag

SEQ ID NO: 595820 - DNA, 20 bp, mouse
ggcgtcttcccggccctcaa

SEQ ID NO: 595821 - DNA, 20 bp, mouse
gcgtaatgagcggtgggtcc

SEQ ID NO: 595822 - DNA, 20 bp, mouse
ggcctgcgtggagcaaactc

SEQ ID NO: 595823 - DNA, 20 bp, mouse
gccacaggacgagcccgagg

SEQ ID NO: 595824 - DNA, 20 bp, mouse
gggtgggtcctggcgtctgc

SEQ ID NO: 595825 - DNA, 20 bp, mouse
ggcgggcggtgtcaggctct

SEQ ID NO: 595826 - DNA, 20 bp, mouse
gaggagaaggctgtactgga

SEQ ID NO: 595827 - DNA, 20 bp, mouse
ggaacagacacagtccccca

SEQ ID NO: 595828 - DNA, 20 bp, mouse
gggcttcagactgcttccac

SEQ ID NO: 595829 - DNA, 20 bp, mouse
gcccccaaggaaagaggtct

SEQ ID NO: 595830 - DNA, 20 bp, mouse
gtgaagggccacagagggct

SEQ ID NO: 595831 - DNA, 20 bp, mouse
gcacagtcccccaaggaaag

SEQ ID NO: 595832 - DNA, 20 bp, mouse
gacccaagacctctttcctt

SEQ ID NO: 595833 - DNA, 20 bp, mouse
gaagaggtcttgggtgagaa

SEQ ID NO: 595834 - DNA, 20 bp, mouse
gctgggctgaacacagccct

SEQ ID NO: 595835 - DNA, 20 bp, mouse
ggggactgtgtctgttcacg

SEQ ID NO: 595836 - DNA, 20 bp, mouse
gtagcggccagcagagcgag

SEQ ID NO: 595837 - DNA, 20 bp, mouse
gcgctacctgcagcaagata

SEQ ID NO: 595838 - DNA, 20 bp, mouse
gccagcagagcgagcggtga

SEQ ID NO: 595839 - DNA, 20 bp, mouse
gcgatgggcgggttcagaga

SEQ ID NO: 595840 - DNA, 20 bp, mouse
gcgtcgtcgtcgcccggcga

SEQ ID NO: 595841 - DNA, 20 bp, mouse
gagatagggccgccatcgcc

SEQ ID NO: 595842 - DNA, 20 bp, mouse
ggaagcgcggcagagccgga

SEQ ID NO: 595843 - DNA, 20 bp, mouse
gcccgctcgcacaggaagta

SEQ ID NO: 595844 - DNA, 20 bp, mouse
gccggcccgggctcccaccg

SEQ ID NO: 595845 - DNA, 20 bp, mouse
gtgagtgtcctacccgcgat

SEQ ID NO: 595846 - DNA, 20 bp, mouse
ggctcggaggaggctgtagc

SEQ ID NO: 595847 - DNA, 20 bp, mouse
ggcccgcggtggctcggagg

SEQ ID NO: 595848 - DNA, 20 bp, mouse
gcggccattcgcggaaaaag

SEQ ID NO: 595849 - DNA, 20 bp, mouse
gctacgccacagcccagcgg

SEQ ID NO: 595850 - DNA, 20 bp, mouse
gcgccgccgctgtcaatcaa

SEQ ID NO: 595851 - DNA, 20 bp, mouse
ggcccagcggcggccattcg

SEQ ID NO: 595852 - DNA, 20 bp, mouse
ggcctcctccgagccaccgc

SEQ ID NO: 595853 - DNA, 20 bp, mouse
gggcggtgaaggagaccgag

SEQ ID NO: 595854 - DNA, 20 bp, mouse
ggggaagcgagcagggtctg

SEQ ID NO: 595855 - DNA, 20 bp, mouse
gtccgcgaatggccgccgct

SEQ ID NO: 595856 - DNA, 20 bp, mouse
gacccgaaggcgaggacgaa

SEQ ID NO: 595857 - DNA, 20 bp, mouse
ggaggactcggaggcacgct

SEQ ID NO: 595858 - DNA, 20 bp, mouse
gccgaggcatggacacccga

SEQ ID NO: 595859 - DNA, 20 bp, mouse
gagcaagcggggcgcgggag

SEQ ID NO: 595860 - DNA, 20 bp, mouse
gcgagccgggcgagcaagcg

SEQ ID NO: 595861 - DNA, 20 bp, mouse
gaagggtgcgagtcagacct

SEQ ID NO: 595862 - DNA, 20 bp, mouse
ggcatggacacccgaaggcg

SEQ ID NO: 595863 - DNA, 20 bp, mouse
gctcgctgtggagcaggacg

SEQ ID NO: 595864 - DNA, 20 bp, mouse
gggccgggcccagagcgggc

SEQ ID NO: 595865 - DNA, 20 bp, mouse
gtggcgtagtcgggtctagg

SEQ ID NO: 595866 - DNA, 20 bp, mouse
ggcagtgagagccggcggga

SEQ ID NO: 595867 - DNA, 20 bp, mouse
gcagagagtgcggtgagtca

SEQ ID NO: 595868 - DNA, 20 bp, mouse
gaggctggcgcgctacagac

SEQ ID NO: 595869 - DNA, 20 bp, mouse
gaggagccgagggcaagccg

SEQ ID NO: 595870 - DNA, 20 bp, mouse
gcgcgctggccggctctcag

SEQ ID NO: 595871 - DNA, 20 bp, mouse
gggaggcagtgagagccggc

SEQ ID NO: 595872 - DNA, 20 bp, mouse
gtgcgcgctgcggagatctg

SEQ ID NO: 595873 - DNA, 20 bp, mouse
gggcgtgggacaggagccga

SEQ ID NO: 595874 - DNA, 20 bp, mouse
ggggtgatccgcgacggtgg

SEQ ID NO: 595875 - DNA, 20 bp, mouse
gcgggctgggtgatccgcga

SEQ ID NO: 595876 - DNA, 20 bp, mouse
ggctgctgctgctaccaccg

SEQ ID NO: 595877 - DNA, 20 bp, mouse
gagagaaccgaggagccagt

SEQ ID NO: 595878 - DNA, 20 bp, mouse
gtacctgggtaggctagggt

SEQ ID NO: 595879 - DNA, 20 bp, mouse
gaggcagatggagagaaccg

SEQ ID NO: 595880 - DNA, 20 bp, mouse
ggaccgggtcccaaggagtc

SEQ ID NO: 595881 - DNA, 20 bp, mouse
gcgtctcctctcaagaggtc

SEQ ID NO: 595882 - DNA, 20 bp, mouse
gtggcctgagggcgctggga

SEQ ID NO: 595883 - DNA, 20 bp, mouse
ggggtgggaaacaggaatat

SEQ ID NO: 595884 - DNA, 20 bp, mouse
gtcaagccagacctcttgag

SEQ ID NO: 595885 - DNA, 20 bp, mouse
ggaatccaataggcatctgt

SEQ ID NO: 595886 - DNA, 20 bp, mouse
gagatcctctgagaggagga

SEQ ID NO: 595887 - DNA, 20 bp, mouse
gataaaaaagatcctctgag

SEQ ID NO: 595888 - DNA, 20 bp, mouse
gatggcaacttcacttctag

SEQ ID NO: 595889 - DNA, 20 bp, mouse
gaaaaagatcctctgagagg

SEQ ID NO: 595890 - DNA, 20 bp, mouse
gagttctcccgagcagggag

SEQ ID NO: 595891 - DNA, 20 bp, mouse
ggcggccaggctctgcgagg

SEQ ID NO: 595892 - DNA, 20 bp, mouse
gagcacaggaaaggttcgta

SEQ ID NO: 595893 - DNA, 20 bp, mouse
gagtcgccccggccaggcca

SEQ ID NO: 595894 - DNA, 20 bp, mouse
gccctccgataggcaataaa

SEQ ID NO: 595895 - DNA, 20 bp, mouse
gtagagagactgatagcccg

SEQ ID NO: 595896 - DNA, 20 bp, mouse
gctcgcgccgagcggactct

SEQ ID NO: 595897 - DNA, 20 bp, mouse
gggagcggtgttaagcctgg

SEQ ID NO: 595898 - DNA, 20 bp, mouse
gcgggagcccagagtccgct

SEQ ID NO: 595899 - DNA, 20 bp, mouse
ggcgggtgctcctcgcactt

SEQ ID NO: 595900 - DNA, 20 bp, mouse
gtcacgattcaggtcccgcg

SEQ ID NO: 595901 - DNA, 20 bp, mouse
gcccggagcggtgttaagcc

SEQ ID NO: 595902 - DNA, 20 bp, mouse
ggtccgctcggcgcgagcgc

SEQ ID NO: 595903 - DNA, 20 bp, mouse
gctgctgggaatcacgattc

SEQ ID NO: 595904 - DNA, 20 bp, mouse
ggttaagcctggcggctgct

SEQ ID NO: 595905 - DNA, 20 bp, mouse
ggtgatgttaaaatcaagaa

SEQ ID NO: 595906 - DNA, 20 bp, mouse
gctccacattggagagggag

SEQ ID NO: 595907 - DNA, 20 bp, mouse
gtggagatgcggagagacta

SEQ ID NO: 595908 - DNA, 20 bp, mouse
gaatggcgaagcctccacat

SEQ ID NO: 595909 - DNA, 20 bp, mouse
ggggaggacaggctgtcgag

SEQ ID NO: 595910 - DNA, 20 bp, mouse
gccccactccctctccaatg

SEQ ID NO: 595911 - DNA, 20 bp, mouse
ggggaagcaggtcaaaccgt

SEQ ID NO: 595912 - DNA, 20 bp, mouse
gcccccaagaagcacaaagg

SEQ ID NO: 595913 - DNA, 20 bp, mouse
gctttctcttcaagctggtg

SEQ ID NO: 595914 - DNA, 20 bp, mouse
gcgaagcctccacattggag

SEQ ID NO: 595915 - DNA, 20 bp, mouse
gcagtacgcgaaaccatcag

SEQ ID NO: 595916 - DNA, 20 bp, mouse
gcgcatgcttctcggcctca

SEQ ID NO: 595917 - DNA, 20 bp, mouse
ggtcgcagccccggctctgg

SEQ ID NO: 595918 - DNA, 20 bp, mouse
gagcctctcctccagagccg

SEQ ID NO: 595919 - DNA, 20 bp, mouse
gaggaggaggctgagaacga

SEQ ID NO: 595920 - DNA, 20 bp, mouse
ggacggccagcagcccagcg

SEQ ID NO: 595921 - DNA, 20 bp, mouse
gatgccgaggaagagggtga

SEQ ID NO: 595922 - DNA, 20 bp, mouse
gaacccgctgtggcccgcga

SEQ ID NO: 595923 - DNA, 20 bp, mouse
gcgagaagcatgcgcgccag

SEQ ID NO: 595924 - DNA, 20 bp, mouse
ggagaggctgcttcgaacag

SEQ ID NO: 595925 - DNA, 20 bp, mouse
gggacaacaggaactcatgt

SEQ ID NO: 595926 - DNA, 20 bp, mouse
ggtggctccaagtcctgatg

SEQ ID NO: 595927 - DNA, 20 bp, mouse
gacactggcacgattacaaa

SEQ ID NO: 595928 - DNA, 20 bp, mouse
gaccagagctgaaccggtgg

SEQ ID NO: 595929 - DNA, 20 bp, mouse
gcggtgggggacgatgacag

SEQ ID NO: 595930 - DNA, 20 bp, mouse
gtgggggacgatgacagcgg

SEQ ID NO: 595931 - DNA, 20 bp, mouse
ggggccagggagttctagaa

SEQ ID NO: 595932 - DNA, 20 bp, mouse
gacgatgacagcggtggctg

SEQ ID NO: 595933 - DNA, 20 bp, mouse
gacgaggcattgagagaaca

SEQ ID NO: 595934 - DNA, 20 bp, mouse
gcctgaaccgcatcaggact

SEQ ID NO: 595935 - DNA, 20 bp, mouse
gcctaccagagctgaaccgg

SEQ ID NO: 595936 - DNA, 20 bp, mouse
gcccccaaggccaggacgag

SEQ ID NO: 595937 - DNA, 20 bp, mouse
gctggcccatctccaacccg

SEQ ID NO: 595938 - DNA, 20 bp, mouse
ggactgaagagcttctgaaa

SEQ ID NO: 595939 - DNA, 20 bp, mouse
gctccaactgctgaccccca

SEQ ID NO: 595940 - DNA, 20 bp, mouse
gtggccagaacagcaggtgg

SEQ ID NO: 595941 - DNA, 20 bp, mouse
gcagtcctcgggttggagat

SEQ ID NO: 595942 - DNA, 20 bp, mouse
ggtcagcagttggagtgttt

SEQ ID NO: 595943 - DNA, 20 bp, mouse
gccacgccgccaggccacca

SEQ ID NO: 595944 - DNA, 20 bp, mouse
gtggggcccatcatcaacaa

SEQ ID NO: 595945 - DNA, 20 bp, mouse
gggccttgggggtcagcagt

SEQ ID NO: 595946 - DNA, 20 bp, mouse
gggcaagggaccatatagaa

SEQ ID NO: 595947 - DNA, 20 bp, mouse
gagccaaaagcccttctata

SEQ ID NO: 595948 - DNA, 20 bp, mouse
gagcattgtggtagtgatct

SEQ ID NO: 595949 - DNA, 20 bp, mouse
ggagctggcaaagaagctgg

SEQ ID NO: 595950 - DNA, 20 bp, mouse
gtccactgatgatcaggaat

SEQ ID NO: 595951 - DNA, 20 bp, mouse
gccctattcctgatcatcag

SEQ ID NO: 595952 - DNA, 20 bp, mouse
gctggcctcgatggcttcaa

SEQ ID NO: 595953 - DNA, 20 bp, mouse
ggggcttttggctgtcatga

SEQ ID NO: 595954 - DNA, 20 bp, mouse
gtggaggaggctggcctcga

SEQ ID NO: 595955 - DNA, 20 bp, mouse
ggcttcaaaggctatactgt

SEQ ID NO: 595956 - DNA, 20 bp, mouse
gcctgtaactggagggacca

SEQ ID NO: 595957 - DNA, 20 bp, mouse
ggctgaagacctaccttcca

SEQ ID NO: 595958 - DNA, 20 bp, mouse
ggcctcctcctgtaactgga

SEQ ID NO: 595959 - DNA, 20 bp, mouse
gtccagcctggaagccgtag

SEQ ID NO: 595960 - DNA, 20 bp, mouse
gggcagcgaatagaggatcg

SEQ ID NO: 595961 - DNA, 20 bp, mouse
gtatccaggagtccaaggct

SEQ ID NO: 595962 - DNA, 20 bp, mouse
gacttggggagtggcgagaa

SEQ ID NO: 595963 - DNA, 20 bp, mouse
gaagacctaccttccaggga

SEQ ID NO: 595964 - DNA, 20 bp, mouse
gctggatacgtggaatgtgg

SEQ ID NO: 595965 - DNA, 20 bp, mouse
gttcgctggaacttggggag

SEQ ID NO: 595966 - DNA, 20 bp, mouse
ggccccgagggtgctcacct

SEQ ID NO: 595967 - DNA, 20 bp, mouse
gacccaggtgagcaccctcg

SEQ ID NO: 595968 - DNA, 20 bp, mouse
gaccggctcgggtctcgggt

SEQ ID NO: 595969 - DNA, 20 bp, mouse
gcctgggtctctgtagccag

SEQ ID NO: 595970 - DNA, 20 bp, mouse
ggggtctctgtagccagcgg

SEQ ID NO: 595971 - DNA, 20 bp, mouse
gcccgagccggtgcccaatg

SEQ ID NO: 595972 - DNA, 20 bp, mouse
gtcgggtcggcatcctccgc

SEQ ID NO: 595973 - DNA, 20 bp, mouse
ggccgacccgagacccgagc

SEQ ID NO: 595974 - DNA, 20 bp, mouse
ggtctccgcccagccgcatt

SEQ ID NO: 595975 - DNA, 20 bp, mouse
gccctcggggcgtggagaag

SEQ ID NO: 595976 - DNA, 20 bp, mouse
gacagagttggaccactctg

SEQ ID NO: 595977 - DNA, 20 bp, mouse
ggctctctgtgcaggaaagc

SEQ ID NO: 595978 - DNA, 20 bp, mouse
gagcgtctggcacacagagt

SEQ ID NO: 595979 - DNA, 20 bp, mouse
gtacggctcgctctctgtgc

SEQ ID NO: 595980 - DNA, 20 bp, mouse
gacagcactgaggtgtgtcc

SEQ ID NO: 595981 - DNA, 20 bp, mouse
ggtgtccaggtataagcgtc

SEQ ID NO: 595982 - DNA, 20 bp, mouse
ggccacgctgtgagcagaga

SEQ ID NO: 595983 - DNA, 20 bp, mouse
gctgatgactgagttaatcc

SEQ ID NO: 595984 - DNA, 20 bp, mouse
gcagtttgtagacagcactg

SEQ ID NO: 595985 - DNA, 20 bp, mouse
gagagggtattcacatctaa

SEQ ID NO: 595986 - DNA, 20 bp, mouse
ggcagtgaagggtccacggt

SEQ ID NO: 595987 - DNA, 20 bp, mouse
gaaagtagactggcaaagaa

SEQ ID NO: 595988 - DNA, 20 bp, mouse
gtgaagggtccacggtgggt

SEQ ID NO: 595989 - DNA, 20 bp, mouse
gggaaggagtcttggtatca

SEQ ID NO: 595990 - DNA, 20 bp, mouse
gagggctgcaaaaagtagac

SEQ ID NO: 595991 - DNA, 20 bp, mouse
gtggtatcatggctgcagag

SEQ ID NO: 595992 - DNA, 20 bp, mouse
gtcaggcagtgaagggtcca

SEQ ID NO: 595993 - DNA, 20 bp, mouse
gagcagctgcccacccaccg

SEQ ID NO: 595994 - DNA, 20 bp, mouse
gctttaggaatggatgtcta

SEQ ID NO: 595995 - DNA, 20 bp, mouse
gtccaggtaaagcagaaaca

SEQ ID NO: 595996 - DNA, 20 bp, mouse
ggcagcggcgggaccccaga

SEQ ID NO: 595997 - DNA, 20 bp, mouse
gcagtcggaggggcaccgag

SEQ ID NO: 595998 - DNA, 20 bp, mouse
ggagtcgcgacgccagtcgg

SEQ ID NO: 595999 - DNA, 20 bp, mouse
gaagcatggctgctccgtct

SEQ ID NO: 596000 - DNA, 20 bp, mouse
gcctccagcacccgcagcgg

SEQ ID NO: 596001 - DNA, 20 bp, mouse
gtgctggaggagctgggcat

SEQ ID NO: 596002 - DNA, 20 bp, mouse
gcccaccggcgaggtgacag

SEQ ID NO: 596003 - DNA, 20 bp, mouse
gcccatggacactccatcaa

SEQ ID NO: 596004 - DNA, 20 bp, mouse
ggcattggcttgtcacccac

SEQ ID NO: 596005 - DNA, 20 bp, mouse
gactgacggggcctgcgtag

SEQ ID NO: 596006 - DNA, 20 bp, mouse
gccaggcctgagcgtctctg

SEQ ID NO: 596007 - DNA, 20 bp, mouse
gtgggtgccatgcgaaggat

SEQ ID NO: 596008 - DNA, 20 bp, mouse
gcaaggcctcagagacgctc

SEQ ID NO: 596009 - DNA, 20 bp, mouse
ggtgccatgcgaaggatggg

SEQ ID NO: 596010 - DNA, 20 bp, mouse
gcgaaggatgggaggttcat

SEQ ID NO: 596011 - DNA, 20 bp, mouse
ggttcattggcctcaaaact

SEQ ID NO: 596012 - DNA, 20 bp, mouse
gtggcctcaaaactgggctg

SEQ ID NO: 596013 - DNA, 20 bp, mouse
gggcgtggtctcggttacca

SEQ ID NO: 596014 - DNA, 20 bp, mouse
gtcaagcacctggcagatct

SEQ ID NO: 596015 - DNA, 20 bp, mouse
gctcaagtccctctagtcca

SEQ ID NO: 596016 - DNA, 20 bp, mouse
ggcgcgaggcagctgaggaa

SEQ ID NO: 596017 - DNA, 20 bp, mouse
gcacgcagggtgctaccctg

SEQ ID NO: 596018 - DNA, 20 bp, mouse
gcaacagcacagcagcggga

SEQ ID NO: 596019 - DNA, 20 bp, mouse
gccctgcgtgagccccgcgg

SEQ ID NO: 596020 - DNA, 20 bp, mouse
ggcaccctgcgtgagccccg

SEQ ID NO: 596021 - DNA, 20 bp, mouse
gggtagcccaggtcaggatg

SEQ ID NO: 596022 - DNA, 20 bp, mouse
gcccctcgtgagccaggtcg

SEQ ID NO: 596023 - DNA, 20 bp, mouse
gtcccacagcgcgacttcgg

SEQ ID NO: 596024 - DNA, 20 bp, mouse
gctcgacacgtgtccctcgg

SEQ ID NO: 596025 - DNA, 20 bp, mouse
ggccgccgcggggctcacgc

SEQ ID NO: 596026 - DNA, 20 bp, mouse
ggccttcgccccaaaaggtg

SEQ ID NO: 596027 - DNA, 20 bp, mouse
gtattgggttcaaatagagg

SEQ ID NO: 596028 - DNA, 20 bp, mouse
gtagaggcggcgggtgaaag

SEQ ID NO: 596029 - DNA, 20 bp, mouse
ggtcagcgcggagatcatag

SEQ ID NO: 596030 - DNA, 20 bp, mouse
gtcccacaaccgctaggccg

SEQ ID NO: 596031 - DNA, 20 bp, mouse
ggaaagtggccatttcgact

SEQ ID NO: 596032 - DNA, 20 bp, mouse
ggggtgaaaacactgaatct

SEQ ID NO: 596033 - DNA, 20 bp, mouse
ggagagaactccggcagaca

SEQ ID NO: 596034 - DNA, 20 bp, mouse
gtaaccagaccaagtcgaaa

SEQ ID NO: 596035 - DNA, 20 bp, mouse
gggttgtgggaaaacactcc

SEQ ID NO: 596036 - DNA, 20 bp, mouse
gcccactaccagctcaacgg

SEQ ID NO: 596037 - DNA, 20 bp, mouse
gttctccaggtccaagtggt

SEQ ID NO: 596038 - DNA, 20 bp, mouse
gcctggagacgcatacacag

SEQ ID NO: 596039 - DNA, 20 bp, mouse
gctgcttctccaggtccaag

SEQ ID NO: 596040 - DNA, 20 bp, mouse
gcaagtggtgggcagctacc

SEQ ID NO: 596041 - DNA, 20 bp, mouse
gactaccagctcaacggtgg

SEQ ID NO: 596042 - DNA, 20 bp, mouse
ggtgcggcgccatgagccag

SEQ ID NO: 596043 - DNA, 20 bp, mouse
gtcaacggtggcggaggtcc

SEQ ID NO: 596044 - DNA, 20 bp, mouse
gtacagctgatgggagtcag

SEQ ID NO: 596045 - DNA, 20 bp, mouse
gaccagctcaacggtggcgg

SEQ ID NO: 596046 - DNA, 20 bp, mouse
gccaagatggcggacctact

SEQ ID NO: 596047 - DNA, 20 bp, mouse
gcctggtcaccgaggctggg

SEQ ID NO: 596048 - DNA, 20 bp, mouse
gccgactctcctggtcaccg

SEQ ID NO: 596049 - DNA, 20 bp, mouse
gcttgggaatgagtgagagg

SEQ ID NO: 596050 - DNA, 20 bp, mouse
gtggagaaaccacccagcct

SEQ ID NO: 596051 - DNA, 20 bp, mouse
gtcactcattcccaagatgg

SEQ ID NO: 596052 - DNA, 20 bp, mouse
gactctgagggtctcagaag

SEQ ID NO: 596053 - DNA, 20 bp, mouse
gaccctaacagaccccccac

SEQ ID NO: 596054 - DNA, 20 bp, mouse
gggccttgcgccgactctcc

SEQ ID NO: 596055 - DNA, 20 bp, mouse
gagagtcggcgcaaggcccg

SEQ ID NO: 596056 - DNA, 20 bp, mouse
ggaccaccgagtctacagag

SEQ ID NO: 596057 - DNA, 20 bp, mouse
ggacccctctgtagactcgg

SEQ ID NO: 596058 - DNA, 20 bp, mouse
gtctatggcaacccgggagg

SEQ ID NO: 596059 - DNA, 20 bp, mouse
gcggcaggggcagtagacct

SEQ ID NO: 596060 - DNA, 20 bp, mouse
gtacagaggggtctttgtcg

SEQ ID NO: 596061 - DNA, 20 bp, mouse
ggggaggtggagtccgaaaa

SEQ ID NO: 596062 - DNA, 20 bp, mouse
gtcccgggttgccatagaga

SEQ ID NO: 596063 - DNA, 20 bp, mouse
gtttgtcgcggtaagagcca

SEQ ID NO: 596064 - DNA, 20 bp, mouse
ggccgtctctatggcaaccc

SEQ ID NO: 596065 - DNA, 20 bp, mouse
gatggcagacctcagctcca

SEQ ID NO: 596066 - DNA, 20 bp, mouse
gccctggccaaggaggggag

SEQ ID NO: 596067 - DNA, 20 bp, mouse
gtataccaggaggagcccgg

SEQ ID NO: 596068 - DNA, 20 bp, mouse
gccagcacggccaccaccag

SEQ ID NO: 596069 - DNA, 20 bp, mouse
gccggcagttggtgcagcgg

SEQ ID NO: 596070 - DNA, 20 bp, mouse
gatggagctggaggacggtg

SEQ ID NO: 596071 - DNA, 20 bp, mouse
ggccccggcagttggtgcag

SEQ ID NO: 596072 - DNA, 20 bp, mouse
ggacggtgtggtataccagg

SEQ ID NO: 596073 - DNA, 20 bp, mouse
ggttggtgcagcggcggttg

SEQ ID NO: 596074 - DNA, 20 bp, mouse
gccgcacgggacgggcccgg

SEQ ID NO: 596075 - DNA, 20 bp, mouse
gcaggaccaggagcaccagg

SEQ ID NO: 596076 - DNA, 20 bp, mouse
ggacaactgtaacacagtag

SEQ ID NO: 596077 - DNA, 20 bp, mouse
gagtagatttagattgacca

SEQ ID NO: 596078 - DNA, 20 bp, mouse
gcactcttagaataagccaa

SEQ ID NO: 596079 - DNA, 20 bp, mouse
gtcttaattcatgtgagcca

SEQ ID NO: 596080 - DNA, 20 bp, mouse
gtgaaagaattgtcactcag

SEQ ID NO: 596081 - DNA, 20 bp, mouse
gttcaaaccatggtaggcta

SEQ ID NO: 596082 - DNA, 20 bp, mouse
ggagatagaacaagaggcga

SEQ ID NO: 596083 - DNA, 20 bp, mouse
gagttgtcataattttcaag

SEQ ID NO: 596084 - DNA, 20 bp, mouse
gctaaggcatgaaagtcaat

SEQ ID NO: 596085 - DNA, 20 bp, mouse
gctgatattccaatcataca

SEQ ID NO: 596086 - DNA, 20 bp, mouse
gcagtacagctataacatgg

SEQ ID NO: 596087 - DNA, 20 bp, mouse
gaacatggaggacacgactg

SEQ ID NO: 596088 - DNA, 20 bp, mouse
gtacctgaactagattcatc

SEQ ID NO: 596089 - DNA, 20 bp, mouse
gcggtagtaaaagaccaata

SEQ ID NO: 596090 - DNA, 20 bp, mouse
gctctcagatgacttttcac

SEQ ID NO: 596091 - DNA, 20 bp, mouse
gatccagatgaatctagttc

SEQ ID NO: 596092 - DNA, 20 bp, mouse
ggaactgtgttcattatatc

SEQ ID NO: 596093 - DNA, 20 bp, mouse
gactcagaagacaagaagaa

SEQ ID NO: 596094 - DNA, 20 bp, mouse
gcttgggatgttccaggtag

SEQ ID NO: 596095 - DNA, 20 bp, mouse
gggtttcgtcgtccagcgaa

SEQ ID NO: 596096 - DNA, 20 bp, mouse
ggacagggaggtgcatacct

SEQ ID NO: 596097 - DNA, 20 bp, mouse
gagagttctggcggtctgaa

SEQ ID NO: 596098 - DNA, 20 bp, mouse
gggcggcagaagagttctgg

SEQ ID NO: 596099 - DNA, 20 bp, mouse
gagaagggcaggggctgaca

SEQ ID NO: 596100 - DNA, 20 bp, mouse
ggaggtgcatacctcggcac

SEQ ID NO: 596101 - DNA, 20 bp, mouse
gtgcatacctcggcacaggc

SEQ ID NO: 596102 - DNA, 20 bp, mouse
gctgcctccgagggtgacag

SEQ ID NO: 596103 - DNA, 20 bp, mouse
gtgtcctctgtcaccctcgg

SEQ ID NO: 596104 - DNA, 20 bp, mouse
gaagcggtccccgcaaacca

SEQ ID NO: 596105 - DNA, 20 bp, mouse
gacctgttgctcactcacag

SEQ ID NO: 596106 - DNA, 20 bp, mouse
gcacggagggagcgagatcc

SEQ ID NO: 596107 - DNA, 20 bp, mouse
gtgcagcagagcagacccag

SEQ ID NO: 596108 - DNA, 20 bp, mouse
ggaattagctctctccctct

SEQ ID NO: 596109 - DNA, 20 bp, mouse
ggccaagctgacgagggagg

SEQ ID NO: 596110 - DNA, 20 bp, mouse
ggacagcctgaaacaccctg

SEQ ID NO: 596111 - DNA, 20 bp, mouse
gcctggctgtgtgcaaggag

SEQ ID NO: 596112 - DNA, 20 bp, mouse
gggtttctgttgcagattcc

SEQ ID NO: 596113 - DNA, 20 bp, mouse
ggcagccaagctgacgaggg

SEQ ID NO: 596114 - DNA, 20 bp, mouse
gaaagcagccaagctgacga

SEQ ID NO: 596115 - DNA, 20 bp, mouse
gtttggaggttggcaccaca

SEQ ID NO: 596116 - DNA, 20 bp, mouse
gcgaggtgccagcggcccag

SEQ ID NO: 596117 - DNA, 20 bp, mouse
gaccgacggcgaccaagcgg

SEQ ID NO: 596118 - DNA, 20 bp, mouse
gcagcggcccaggggacaga

SEQ ID NO: 596119 - DNA, 20 bp, mouse
gggccgctggcacctcgctg

SEQ ID NO: 596120 - DNA, 20 bp, mouse
gcagaccgacggcgaccaag

SEQ ID NO: 596121 - DNA, 20 bp, mouse
gcgccgcagcgaggtgccag

SEQ ID NO: 596122 - DNA, 20 bp, mouse
ggacggcgaccaagcggcgg

SEQ ID NO: 596123 - DNA, 20 bp, mouse
gaaggaggggcaggagccac

SEQ ID NO: 596124 - DNA, 20 bp, mouse
gtgggcagctgaggagcgag

SEQ ID NO: 596125 - DNA, 20 bp, mouse
ggcggccactgccactgcgg

SEQ ID NO: 596126 - DNA, 20 bp, mouse
gcctctggaggggctgggta

SEQ ID NO: 596127 - DNA, 20 bp, mouse
gcccgagggcgcctcacaca

SEQ ID NO: 596128 - DNA, 20 bp, mouse
ggcgccttccgcctctggag

SEQ ID NO: 596129 - DNA, 20 bp, mouse
gcagcccctccagaggcgga

SEQ ID NO: 596130 - DNA, 20 bp, mouse
gccgtcgccaccgcgcccac

SEQ ID NO: 596131 - DNA, 20 bp, mouse
ggtaagaggacgccccgggg

SEQ ID NO: 596132 - DNA, 20 bp, mouse
ggcgccgccggttcacccga

SEQ ID NO: 596133 - DNA, 20 bp, mouse
gctgggtagggcgaggtaag

SEQ ID NO: 596134 - DNA, 20 bp, mouse
ggagggaggtccgcgaccga

SEQ ID NO: 596135 - DNA, 20 bp, mouse
ggcgccctcgggtgaaccgg

SEQ ID NO: 596136 - DNA, 20 bp, mouse
gatccctgctggagccggct

SEQ ID NO: 596137 - DNA, 20 bp, mouse
ggcagagcctggcgagctcg

SEQ ID NO: 596138 - DNA, 20 bp, mouse
gctcgcggctgcatccctgc

SEQ ID NO: 596139 - DNA, 20 bp, mouse
ggagcgcctctgtgacccaa

SEQ ID NO: 596140 - DNA, 20 bp, mouse
ggcaggcggagcgctcacgg

SEQ ID NO: 596141 - DNA, 20 bp, mouse
ggctgcatccctgctggagc

SEQ ID NO: 596142 - DNA, 20 bp, mouse
ggtggctcgtgggacggact

SEQ ID NO: 596143 - DNA, 20 bp, mouse
gggctctcgggtgggtatcg

SEQ ID NO: 596144 - DNA, 20 bp, mouse
gcccagcaagcagggagcgc

SEQ ID NO: 596145 - DNA, 20 bp, mouse
gatgcagccgcgagctcgcc

SEQ ID NO: 596146 - DNA, 20 bp, mouse
gggcctgggattgggaccgt

SEQ ID NO: 596147 - DNA, 20 bp, mouse
ggcacgacagatgctgtagg

SEQ ID NO: 596148 - DNA, 20 bp, mouse
gctgaagctccacagcaggt

SEQ ID NO: 596149 - DNA, 20 bp, mouse
gttggcacgacagatgctgt

SEQ ID NO: 596150 - DNA, 20 bp, mouse
gagcaggttggcctgggatt

SEQ ID NO: 596151 - DNA, 20 bp, mouse
gccatctcacgcaggaacgg

SEQ ID NO: 596152 - DNA, 20 bp, mouse
gtgccaacggtcccaatccc

SEQ ID NO: 596153 - DNA, 20 bp, mouse
gctccacagcaggttggcct

SEQ ID NO: 596154 - DNA, 20 bp, mouse
ggaccctaaaccacacaggt

SEQ ID NO: 596155 - DNA, 20 bp, mouse
gctgtgtggtttagggtcag

SEQ ID NO: 596156 - DNA, 20 bp, mouse
gtcgaaattccaggagaaag

SEQ ID NO: 596157 - DNA, 20 bp, mouse
ggggcgagtcgactcaagtc

SEQ ID NO: 596158 - DNA, 20 bp, mouse
gggaatttcgagctgctgat

SEQ ID NO: 596159 - DNA, 20 bp, mouse
ggctgctgatgggaagggtc

SEQ ID NO: 596160 - DNA, 20 bp, mouse
gtcgactcgcccctttctcc

SEQ ID NO: 596161 - DNA, 20 bp, mouse
gcggtgagtagtgaagagag

SEQ ID NO: 596162 - DNA, 20 bp, mouse
gctccaggagttgaaggaca

SEQ ID NO: 596163 - DNA, 20 bp, mouse
gtggcaactgggctgaacca

SEQ ID NO: 596164 - DNA, 20 bp, mouse
gtttcgagctgctgatggga

SEQ ID NO: 596165 - DNA, 20 bp, mouse
ggtaggctaaggtgagcgaa

SEQ ID NO: 596166 - DNA, 20 bp, mouse
gaacagcgcgccgggcaggg

SEQ ID NO: 596167 - DNA, 20 bp, mouse
gtgcccggtccgacccgagg

SEQ ID NO: 596168 - DNA, 20 bp, mouse
gtccacacaggctcagaacg

SEQ ID NO: 596169 - DNA, 20 bp, mouse
gtccatcctccccctcgggt

SEQ ID NO: 596170 - DNA, 20 bp, mouse
gctccccctcgggtcggacc

SEQ ID NO: 596171 - DNA, 20 bp, mouse
gacctgcccggtccgacccg

SEQ ID NO: 596172 - DNA, 20 bp, mouse
gagtgtccatcctccccctc

SEQ ID NO: 596173 - DNA, 20 bp, mouse
gggagccagaacagcgcgcc

SEQ ID NO: 596174 - DNA, 20 bp, mouse
gcagaacagcgcgccgggca

SEQ ID NO: 596175 - DNA, 20 bp, mouse
gcgcggccctagcaacagaa

SEQ ID NO: 596176 - DNA, 20 bp, mouse
gagtgtagaagggagacgac

SEQ ID NO: 596177 - DNA, 20 bp, mouse
ggcacagcaggagtgtagaa

SEQ ID NO: 596178 - DNA, 20 bp, mouse
gctagactgcagggataaat

SEQ ID NO: 596179 - DNA, 20 bp, mouse
gtcatcttcagacttacaga

SEQ ID NO: 596180 - DNA, 20 bp, mouse
ggcccttggaccctatccca

SEQ ID NO: 596181 - DNA, 20 bp, mouse
gaccttgggatagggtccaa

SEQ ID NO: 596182 - DNA, 20 bp, mouse
gcctatcccaaggtactctt

SEQ ID NO: 596183 - DNA, 20 bp, mouse
ggagcttctaagagattcca

SEQ ID NO: 596184 - DNA, 20 bp, mouse
gggtgggaagggtagcccta

SEQ ID NO: 596185 - DNA, 20 bp, mouse
gcaccgagttcacccttggt

SEQ ID NO: 596186 - DNA, 20 bp, mouse
ggaaccgagaacagtaccgg

SEQ ID NO: 596187 - DNA, 20 bp, mouse
gcgggaaccgagaacagtac

SEQ ID NO: 596188 - DNA, 20 bp, mouse
ggtgtacgcgaggaacggag

SEQ ID NO: 596189 - DNA, 20 bp, mouse
gagcacaggcccacacggcc

SEQ ID NO: 596190 - DNA, 20 bp, mouse
gacggcccggccgctcccgc

SEQ ID NO: 596191 - DNA, 20 bp, mouse
gtacgcgaggaacggagagg

SEQ ID NO: 596192 - DNA, 20 bp, mouse
gggagtgaggtccggttcta

SEQ ID NO: 596193 - DNA, 20 bp, mouse
gttcccggagccggcgggag

SEQ ID NO: 596194 - DNA, 20 bp, mouse
ggaccgcggggaggcacgag

SEQ ID NO: 596195 - DNA, 20 bp, mouse
ggtgtgggcctgtgctttgg

SEQ ID NO: 596196 - DNA, 20 bp, mouse
gaagctgggggagactaacc

SEQ ID NO: 596197 - DNA, 20 bp, mouse
ggaagagctgcccctaatgt

SEQ ID NO: 596198 - DNA, 20 bp, mouse
gaggaatggtggctcattgg

SEQ ID NO: 596199 - DNA, 20 bp, mouse
gccacccccaaaacataagg

SEQ ID NO: 596200 - DNA, 20 bp, mouse
gccccgtggttcagaaaggt

SEQ ID NO: 596201 - DNA, 20 bp, mouse
gacccatctgcccacattag

SEQ ID NO: 596202 - DNA, 20 bp, mouse
gttggacctggcggtaggaa

SEQ ID NO: 596203 - DNA, 20 bp, mouse
ggtagcctagggagtctcag

SEQ ID NO: 596204 - DNA, 20 bp, mouse
gaaggccacggtctcccccg

SEQ ID NO: 596205 - DNA, 20 bp, mouse
gtgggggagactaacctggc

SEQ ID NO: 596206 - DNA, 20 bp, mouse
gccagagaggagggatggtt

SEQ ID NO: 596207 - DNA, 20 bp, mouse
ggagcaggacggctccagag

SEQ ID NO: 596208 - DNA, 20 bp, mouse
gagccgtcctgctccagagg

SEQ ID NO: 596209 - DNA, 20 bp, mouse
ggaagggacaaagccccctc

SEQ ID NO: 596210 - DNA, 20 bp, mouse
gtggttaggggagccttaat

SEQ ID NO: 596211 - DNA, 20 bp, mouse
ggagtcgagcagatatgggt

SEQ ID NO: 596212 - DNA, 20 bp, mouse
gagccttaatgggaaaaagg

SEQ ID NO: 596213 - DNA, 20 bp, mouse
gagacccccatcccacctgt

SEQ ID NO: 596214 - DNA, 20 bp, mouse
gtggcttactgtagggaggt

SEQ ID NO: 596215 - DNA, 20 bp, mouse
gccccccccatcctacccgg

SEQ ID NO: 596216 - DNA, 20 bp, mouse
gaggaggcgaggttaacttg

SEQ ID NO: 596217 - DNA, 20 bp, mouse
ggcctcccgcgggttttcag

SEQ ID NO: 596218 - DNA, 20 bp, mouse
gagaggcgggaagttccgcg

SEQ ID NO: 596219 - DNA, 20 bp, mouse
gtgaggccacggtgatctta

SEQ ID NO: 596220 - DNA, 20 bp, mouse
gggtgttggccggggattca

SEQ ID NO: 596221 - DNA, 20 bp, mouse
ggcctgccctaagatcaccg

SEQ ID NO: 596222 - DNA, 20 bp, mouse
gacaggcgtggtggaagcag

SEQ ID NO: 596223 - DNA, 20 bp, mouse
ggcctgacacagccactcat

SEQ ID NO: 596224 - DNA, 20 bp, mouse
gtgagggctctctttgtaca

SEQ ID NO: 596225 - DNA, 20 bp, mouse
ggcctctgaaaacccgcggg

SEQ ID NO: 596226 - DNA, 20 bp, mouse
gccccctgcgaccacccaag

SEQ ID NO: 596227 - DNA, 20 bp, mouse
gatttccaacgagccagcgg

SEQ ID NO: 596228 - DNA, 20 bp, mouse
ggatggcgacgccccttggg

SEQ ID NO: 596229 - DNA, 20 bp, mouse
gcaggcgctcgtggatgtag

SEQ ID NO: 596230 - DNA, 20 bp, mouse
gacgtcccgcagttgatcga

SEQ ID NO: 596231 - DNA, 20 bp, mouse
ggccccttgggtggtcgcag

SEQ ID NO: 596232 - DNA, 20 bp, mouse
gctggacgcctcaccggtgg

SEQ ID NO: 596233 - DNA, 20 bp, mouse
ggtgaagggggtcatcccag

SEQ ID NO: 596234 - DNA, 20 bp, mouse
ggccatttccaacgagccag

SEQ ID NO: 596235 - DNA, 20 bp, mouse
gaaagatggcgacgcccctt

SEQ ID NO: 596236 - DNA, 20 bp, mouse
gctcacaaacagggactctg

SEQ ID NO: 596237 - DNA, 20 bp, mouse
ggacgagggcaggaggaata

SEQ ID NO: 596238 - DNA, 20 bp, mouse
gtgtagaaaactggggacga

SEQ ID NO: 596239 - DNA, 20 bp, mouse
ggaagacccagatgactttg

SEQ ID NO: 596240 - DNA, 20 bp, mouse
gggctattccctcacaaaca

SEQ ID NO: 596241 - DNA, 20 bp, mouse
gccctctcaccttggccaga

SEQ ID NO: 596242 - DNA, 20 bp, mouse
gctttgtggagacacgaagt

SEQ ID NO: 596243 - DNA, 20 bp, mouse
gtgtctccacaaagtcatct

SEQ ID NO: 596244 - DNA, 20 bp, mouse
gtcctggaactggagatggg

SEQ ID NO: 596245 - DNA, 20 bp, mouse
gaacctctgagcatcctcta

SEQ ID NO: 596246 - DNA, 20 bp, mouse
gggagagacccaggcccaag

SEQ ID NO: 596247 - DNA, 20 bp, mouse
gtcccactgacggtccccgt

SEQ ID NO: 596248 - DNA, 20 bp, mouse
gcggagctctctggaatagc

SEQ ID NO: 596249 - DNA, 20 bp, mouse
gaggcccaagcggagctctc

SEQ ID NO: 596250 - DNA, 20 bp, mouse
gcactgacggtccccgtggg

SEQ ID NO: 596251 - DNA, 20 bp, mouse
gattccagagagctccgctt

SEQ ID NO: 596252 - DNA, 20 bp, mouse
ggggcgggcttgactttctg

SEQ ID NO: 596253 - DNA, 20 bp, mouse
gcacgaccaaggccaagggg

SEQ ID NO: 596254 - DNA, 20 bp, mouse
ggactttctgcggaagagcg

SEQ ID NO: 596255 - DNA, 20 bp, mouse
gtcccggacctgatcaggat

SEQ ID NO: 596256 - DNA, 20 bp, mouse
gcctggctccctccctaggt

SEQ ID NO: 596257 - DNA, 20 bp, mouse
gggagactgcctacctaggg

SEQ ID NO: 596258 - DNA, 20 bp, mouse
gcaggggagactgcctacct

SEQ ID NO: 596259 - DNA, 20 bp, mouse
gatttcctggctccctccct

SEQ ID NO: 596260 - DNA, 20 bp, mouse
ggtaacaccgtggagctaca

SEQ ID NO: 596261 - DNA, 20 bp, mouse
ggatcagagacatacccaca

SEQ ID NO: 596262 - DNA, 20 bp, mouse
gtccttctagagtaacaccg

SEQ ID NO: 596263 - DNA, 20 bp, mouse
gggtaccaggaacggagatg

SEQ ID NO: 596264 - DNA, 20 bp, mouse
gacagctccatgtagctcca

SEQ ID NO: 596265 - DNA, 20 bp, mouse
gtcccagagctaccagaggt

SEQ ID NO: 596266 - DNA, 20 bp, mouse
gaaggaagaactcccaacaa

SEQ ID NO: 596267 - DNA, 20 bp, mouse
gtgcccatatagtggagctg

SEQ ID NO: 596268 - DNA, 20 bp, mouse
gccatctgaatcccattgtt

SEQ ID NO: 596269 - DNA, 20 bp, mouse
ggagagaattctctattaga

SEQ ID NO: 596270 - DNA, 20 bp, mouse
gtggagagtggaggagtaca

SEQ ID NO: 596271 - DNA, 20 bp, mouse
gagtggaggagtacaaggtg

SEQ ID NO: 596272 - DNA, 20 bp, mouse
gagcctcagctccactatat

SEQ ID NO: 596273 - DNA, 20 bp, mouse
gggaaagcatttacaccaca

SEQ ID NO: 596274 - DNA, 20 bp, mouse
gatgtccattgcccatatag

SEQ ID NO: 596275 - DNA, 20 bp, mouse
ggtgttgatgcaggagaagt

SEQ ID NO: 596276 - DNA, 20 bp, mouse
gccaagctcaccccacagcc

SEQ ID NO: 596277 - DNA, 20 bp, mouse
gaaactgcttatacatttgc

SEQ ID NO: 596278 - DNA, 20 bp, mouse
gctaggctgtagttctgtcc

SEQ ID NO: 596279 - DNA, 20 bp, mouse
gtagttctgtcctggctgtg

SEQ ID NO: 596280 - DNA, 20 bp, mouse
gtataagcagtttcaatatc

SEQ ID NO: 596281 - DNA, 20 bp, mouse
ggctgagagaatcttctcca

SEQ ID NO: 596282 - DNA, 20 bp, mouse
gtggctgcctgaggtgtctg

SEQ ID NO: 596283 - DNA, 20 bp, mouse
gcctcagcctcagacacctc

SEQ ID NO: 596284 - DNA, 20 bp, mouse
ggaatggcctcagtgagaca

SEQ ID NO: 596285 - DNA, 20 bp, mouse
gctccatggcagcaacagca

SEQ ID NO: 596286 - DNA, 20 bp, mouse
gaagctcaccccacagccag

SEQ ID NO: 596287 - DNA, 20 bp, mouse
ggaggagaggagagcgatgg

SEQ ID NO: 596288 - DNA, 20 bp, mouse
ggttctgtcctctggctgtg

SEQ ID NO: 596289 - DNA, 20 bp, mouse
gggaaaggggatgggaagaa

SEQ ID NO: 596290 - DNA, 20 bp, mouse
gagaggggaggaaaggggat

SEQ ID NO: 596291 - DNA, 20 bp, mouse
ggggctgtagttctgtcctc

SEQ ID NO: 596292 - DNA, 20 bp, mouse
gggatgggggtggggtagag

SEQ ID NO: 596293 - DNA, 20 bp, mouse
gtataagcagttttaatatc

SEQ ID NO: 596294 - DNA, 20 bp, mouse
ggctgagagaatcttctcca

SEQ ID NO: 596295 - DNA, 20 bp, mouse
gtggctgcctgaggtgtctg

SEQ ID NO: 596296 - DNA, 20 bp, mouse
gtgagtctcatggatgcctg

SEQ ID NO: 596297 - DNA, 20 bp, mouse
gttctaaatagatcatggtt

SEQ ID NO: 596298 - DNA, 20 bp, mouse
gtgactgatatgggacactg

SEQ ID NO: 596299 - DNA, 20 bp, mouse
gtgtcctagggcatgagtcc

SEQ ID NO: 596300 - DNA, 20 bp, mouse
ggcatgggaggaatacagag

SEQ ID NO: 596301 - DNA, 20 bp, mouse
gagggcatgagtcctggcat

SEQ ID NO: 596302 - DNA, 20 bp, mouse
gattgcatgggcctcactgt

SEQ ID NO: 596303 - DNA, 20 bp, mouse
ggcatgagtcctggcatggg

SEQ ID NO: 596304 - DNA, 20 bp, mouse
gaataaaaaatatctcttgg

SEQ ID NO: 596305 - DNA, 20 bp, mouse
gtgagtactggatttagtac

SEQ ID NO: 596306 - DNA, 20 bp, mouse
gttcatagtgtgaatctcag

SEQ ID NO: 596307 - DNA, 20 bp, mouse
gctgtacggagacttcctgg

SEQ ID NO: 596308 - DNA, 20 bp, mouse
ggaatctcaggggctgccta

SEQ ID NO: 596309 - DNA, 20 bp, mouse
gccaaggagtcaggaaggta

SEQ ID NO: 596310 - DNA, 20 bp, mouse
gaccagccaaggagtcagga

SEQ ID NO: 596311 - DNA, 20 bp, mouse
gtccttagcgctagttagaa

SEQ ID NO: 596312 - DNA, 20 bp, mouse
gaactagcgctaaggaatca

SEQ ID NO: 596313 - DNA, 20 bp, mouse
gtggtctgtgtgggtaagaa

SEQ ID NO: 596314 - DNA, 20 bp, mouse
gctccttggctggtctgtgt

SEQ ID NO: 596315 - DNA, 20 bp, mouse
gacagaccagccaaggagtc

SEQ ID NO: 596316 - DNA, 20 bp, mouse
ggctgccggaggctctgtca

SEQ ID NO: 596317 - DNA, 20 bp, mouse
gtagccaaagagcgcactgg

SEQ ID NO: 596318 - DNA, 20 bp, mouse
gaggctctgtcagggaggcg

SEQ ID NO: 596319 - DNA, 20 bp, mouse
gagagcctccggcagcatgg

SEQ ID NO: 596320 - DNA, 20 bp, mouse
gggaatgctgcagtaatcaa

SEQ ID NO: 596321 - DNA, 20 bp, mouse
gccaaagagcgcactggagg

SEQ ID NO: 596322 - DNA, 20 bp, mouse
gagagcgcactggaggcgga

SEQ ID NO: 596323 - DNA, 20 bp, mouse
gggctagccaaagagcgcac

SEQ ID NO: 596324 - DNA, 20 bp, mouse
gtggctagcccggtggaggg

SEQ ID NO: 596325 - DNA, 20 bp, mouse
ggtcacccccatgctgccgg

SEQ ID NO: 596326 - DNA, 20 bp, mouse
gagctcccggagcctagtgt

SEQ ID NO: 596327 - DNA, 20 bp, mouse
ggagcggcggggtcacctat

SEQ ID NO: 596328 - DNA, 20 bp, mouse
gctccgggagctcattacca

SEQ ID NO: 596329 - DNA, 20 bp, mouse
gctccagccgggcggcctcg

SEQ ID NO: 596330 - DNA, 20 bp, mouse
gccgcgggctgtaggtctaa

SEQ ID NO: 596331 - DNA, 20 bp, mouse
gtagcctagcctagagccaa

SEQ ID NO: 596332 - DNA, 20 bp, mouse
ggctataacagggatttcaa

SEQ ID NO: 596333 - DNA, 20 bp, mouse
ggcggcaaggcagcagggat

SEQ ID NO: 596334 - DNA, 20 bp, mouse
gggccgcccggctggagcgg

SEQ ID NO: 596335 - DNA, 20 bp, mouse
ggtgagtcggtcgggttaac

SEQ ID NO: 596336 - DNA, 20 bp, mouse
gcactcctctgcctggccgg

SEQ ID NO: 596337 - DNA, 20 bp, mouse
ggagtgtttaccactgccgg

SEQ ID NO: 596338 - DNA, 20 bp, mouse
ggcacctggtgacattccta

SEQ ID NO: 596339 - DNA, 20 bp, mouse
gtaggggagggtgacacctg

SEQ ID NO: 596340 - DNA, 20 bp, mouse
gaccatggctgccgccggcc

SEQ ID NO: 596341 - DNA, 20 bp, mouse
gatgattctgccgccggcag

SEQ ID NO: 596342 - DNA, 20 bp, mouse
ggggagggtgacacctgagg

SEQ ID NO: 596343 - DNA, 20 bp, mouse
gttcctgcgggaactgctgg

SEQ ID NO: 596344 - DNA, 20 bp, mouse
ggcgcaggtggcctagggga

SEQ ID NO: 596345 - DNA, 20 bp, mouse
gggtgtaggtaaggacgtct

SEQ ID NO: 596346 - DNA, 20 bp, mouse
gagacatgaccgcaggctgt

SEQ ID NO: 596347 - DNA, 20 bp, mouse
gttccaagaagaaccgaaag

SEQ ID NO: 596348 - DNA, 20 bp, mouse
gcgcacgttgagccggctcg

SEQ ID NO: 596349 - DNA, 20 bp, mouse
gtcttggaagacatgaccgc

SEQ ID NO: 596350 - DNA, 20 bp, mouse
ggagaaaagcagccccgagc

SEQ ID NO: 596351 - DNA, 20 bp, mouse
gtgccgctttcggttcttct

SEQ ID NO: 596352 - DNA, 20 bp, mouse
gggcagaaggagggcgcgga

SEQ ID NO: 596353 - DNA, 20 bp, mouse
ggcgccgctgacctctgacc

SEQ ID NO: 596354 - DNA, 20 bp, mouse
gaagcggcagaaggagggcg

SEQ ID NO: 596355 - DNA, 20 bp, mouse
gaaccgaaagcggcagaagg

SEQ ID NO: 596356 - DNA, 20 bp, mouse
gtgctgttcgggcgggaccc

SEQ ID NO: 596357 - DNA, 20 bp, mouse
gcaggagcggaactccgaag

SEQ ID NO: 596358 - DNA, 20 bp, mouse
gcgggacccaggctggaccg

SEQ ID NO: 596359 - DNA, 20 bp, mouse
gagctgtggcccccaggccg

SEQ ID NO: 596360 - DNA, 20 bp, mouse
gagggccggtactcacagag

SEQ ID NO: 596361 - DNA, 20 bp, mouse
ggcgcggatgccgaaggtga

SEQ ID NO: 596362 - DNA, 20 bp, mouse
ggttcgggcgggacccaggc

SEQ ID NO: 596363 - DNA, 20 bp, mouse
ggcatccgcgcagggtaggg

SEQ ID NO: 596364 - DNA, 20 bp, mouse
ggggcgcggactcgttgtca

SEQ ID NO: 596365 - DNA, 20 bp, mouse
gtcggcatccgcgcagggta

SEQ ID NO: 596366 - DNA, 20 bp, mouse
ggtcacagcgacagtcgcca

SEQ ID NO: 596367 - DNA, 20 bp, mouse
ggaaaagaccaggaccgcgg

SEQ ID NO: 596368 - DNA, 20 bp, mouse
gaagccgagctcccccgcag

SEQ ID NO: 596369 - DNA, 20 bp, mouse
gacagcgacagtcgccaggg

SEQ ID NO: 596370 - DNA, 20 bp, mouse
gccccgcagcggaggtgaaa

SEQ ID NO: 596371 - DNA, 20 bp, mouse
gaagcagccggcctgatctg

SEQ ID NO: 596372 - DNA, 20 bp, mouse
gtcgccagggcggttgctaa

SEQ ID NO: 596373 - DNA, 20 bp, mouse
gtaccctgcgacactgaagg

SEQ ID NO: 596374 - DNA, 20 bp, mouse
gcaggaccgcgggggcgcaa

SEQ ID NO: 596375 - DNA, 20 bp, mouse
gaaggaaaagaccaggaccg

SEQ ID NO: 596376 - DNA, 20 bp, mouse
gctactgtaactgggactat

SEQ ID NO: 596377 - DNA, 20 bp, mouse
gagtgaaccagtgaaccaac

SEQ ID NO: 596378 - DNA, 20 bp, mouse
gtaactgggactatgggcat

SEQ ID NO: 596379 - DNA, 20 bp, mouse
gtttagtgagttgtaggcct

SEQ ID NO: 596380 - DNA, 20 bp, mouse
gacagaacctgttggttcac

SEQ ID NO: 596381 - DNA, 20 bp, mouse
gtatgggcatgggcacaact

SEQ ID NO: 596382 - DNA, 20 bp, mouse
gcacacgtttagtgagttgt

SEQ ID NO: 596383 - DNA, 20 bp, mouse
gcaacaggttctgtccttgc

SEQ ID NO: 596384 - DNA, 20 bp, mouse
gcatggaagtcagacctatt

SEQ ID NO: 596385 - DNA, 20 bp, mouse
ggttcactggttcactgctg

SEQ ID NO: 596386 - DNA, 20 bp, mouse
ggagggtgcagcccaagaga

SEQ ID NO: 596387 - DNA, 20 bp, mouse
ggagagggcactgcacctgg

SEQ ID NO: 596388 - DNA, 20 bp, mouse
gaggtgcagtgccctctctt

SEQ ID NO: 596389 - DNA, 20 bp, mouse
gtaagtagagacatgcccca

SEQ ID NO: 596390 - DNA, 20 bp, mouse
gcgggccctgggcagcctcc

SEQ ID NO: 596391 - DNA, 20 bp, mouse
gagggcccggggccttgccc

SEQ ID NO: 596392 - DNA, 20 bp, mouse
gagaccaggcttgcagactc

SEQ ID NO: 596393 - DNA, 20 bp, mouse
gttcaccggagggcttggtg

SEQ ID NO: 596394 - DNA, 20 bp, mouse
gccagcccgggcaaggcccc

SEQ ID NO: 596395 - DNA, 20 bp, mouse
gcatcagcgggttcaccgga

SEQ ID NO: 596396 - DNA, 20 bp, mouse
ggtgtgagtacctgacacca

SEQ ID NO: 596397 - DNA, 20 bp, mouse
ggcctgtggccccatggaga

SEQ ID NO: 596398 - DNA, 20 bp, mouse
ggcaggcctcagggtaggta

SEQ ID NO: 596399 - DNA, 20 bp, mouse
gcaggcagcgtggaactccg

SEQ ID NO: 596400 - DNA, 20 bp, mouse
gacatgggcctgtggcccca

SEQ ID NO: 596401 - DNA, 20 bp, mouse
gtaccctctgccatggtgtc

SEQ ID NO: 596402 - DNA, 20 bp, mouse
gcgggacctactctatccca

SEQ ID NO: 596403 - DNA, 20 bp, mouse
ggccttaggctgtttctgtg

SEQ ID NO: 596404 - DNA, 20 bp, mouse
gccaggagagctgtggtcga

SEQ ID NO: 596405 - DNA, 20 bp, mouse
gcaggcagggtgtgattcca

SEQ ID NO: 596406 - DNA, 20 bp, mouse
gcctccatggagtcttccaa

SEQ ID NO: 596407 - DNA, 20 bp, mouse
gatctgggccacatcctcca

SEQ ID NO: 596408 - DNA, 20 bp, mouse
ggaagactccatggaggatg

SEQ ID NO: 596409 - DNA, 20 bp, mouse
gagcggcctgtactagagag

SEQ ID NO: 596410 - DNA, 20 bp, mouse
gtcccccagggaagtagggt

SEQ ID NO: 596411 - DNA, 20 bp, mouse
gtcttccaagggtagatgaa

SEQ ID NO: 596412 - DNA, 20 bp, mouse
gcccagatcaacgcaccaac

SEQ ID NO: 596413 - DNA, 20 bp, mouse
ggtcccaccctacttccctg

SEQ ID NO: 596414 - DNA, 20 bp, mouse
gtcaacgcaccaactggcag

SEQ ID NO: 596415 - DNA, 20 bp, mouse
gatctcactggacctcctag

SEQ ID NO: 596416 - DNA, 20 bp, mouse
gcggcggctcccgaggacga

SEQ ID NO: 596417 - DNA, 20 bp, mouse
gctccgaggcggggcgagag

SEQ ID NO: 596418 - DNA, 20 bp, mouse
gcgcagagcccggaactggg

SEQ ID NO: 596419 - DNA, 20 bp, mouse
gcgagcggcggcgcgagtgc

SEQ ID NO: 596420 - DNA, 20 bp, mouse
ggcggcggcgcgagtgcggg

SEQ ID NO: 596421 - DNA, 20 bp, mouse
gacgcgcgggctccgaggcg

SEQ ID NO: 596422 - DNA, 20 bp, mouse
gagggtcgctgtggatccgc

SEQ ID NO: 596423 - DNA, 20 bp, mouse
ggctcgaggaaggggaaaga

SEQ ID NO: 596424 - DNA, 20 bp, mouse
ggggaggagcgcggcagcga

SEQ ID NO: 596425 - DNA, 20 bp, mouse
ggggcggacgagggtcgctg

SEQ ID NO: 596426 - DNA, 20 bp, mouse
gctgagggaaagcggcggta

SEQ ID NO: 596427 - DNA, 20 bp, mouse
gaggaatccagcctgcccag

SEQ ID NO: 596428 - DNA, 20 bp, mouse
gctccgggcaggcagatcgg

SEQ ID NO: 596429 - DNA, 20 bp, mouse
gagcgcggagagcgagctga

SEQ ID NO: 596430 - DNA, 20 bp, mouse
gggctggcggcgcggagttg

SEQ ID NO: 596431 - DNA, 20 bp, mouse
gcgggtcgggcggctcacca

SEQ ID NO: 596432 - DNA, 20 bp, mouse
gctcgcaacgaggtaagccc

SEQ ID NO: 596433 - DNA, 20 bp, mouse
ggctggcggcccctgcagcg

SEQ ID NO: 596434 - DNA, 20 bp, mouse
gggacctgcggccccgctcc

SEQ ID NO: 596435 - DNA, 20 bp, mouse
gacagcggcggaaccgatcg

SEQ ID NO: 596436 - DNA, 20 bp, mouse
ggactcggcgcgatcagtca

SEQ ID NO: 596437 - DNA, 20 bp, mouse
ggctttccgcgacatggtgg

SEQ ID NO: 596438 - DNA, 20 bp, mouse
gtcggcgcgatcagtcatgg

SEQ ID NO: 596439 - DNA, 20 bp, mouse
ggctcacctccaccatgtcg

SEQ ID NO: 596440 - DNA, 20 bp, mouse
ggcggctttccgcgacatgg

SEQ ID NO: 596441 - DNA, 20 bp, mouse
gctcggaagaccctcaagaa

SEQ ID NO: 596442 - DNA, 20 bp, mouse
gcatggtggaggtgagcaac

SEQ ID NO: 596443 - DNA, 20 bp, mouse
gatggcggctttccgcgaca

SEQ ID NO: 596444 - DNA, 20 bp, mouse
ggccccgggggacttctcgg

SEQ ID NO: 596445 - DNA, 20 bp, mouse
gccccccgagaagtcccccg

SEQ ID NO: 596446 - DNA, 20 bp, mouse
gggagcagcagacggaagag

SEQ ID NO: 596447 - DNA, 20 bp, mouse
ggcagcagacggaagagcgg

SEQ ID NO: 596448 - DNA, 20 bp, mouse
ggctggaggagcagcagacc

SEQ ID NO: 596449 - DNA, 20 bp, mouse
gctgccggacaggtccagtc

SEQ ID NO: 596450 - DNA, 20 bp, mouse
gcgaactccgcggctaacag

SEQ ID NO: 596451 - DNA, 20 bp, mouse
gtgagcggccaggaacgccg

SEQ ID NO: 596452 - DNA, 20 bp, mouse
ggccgcggtctccaccagac

SEQ ID NO: 596453 - DNA, 20 bp, mouse
gcgccaggacccgaactccg

SEQ ID NO: 596454 - DNA, 20 bp, mouse
gagacggaagagcggcgggc

SEQ ID NO: 596455 - DNA, 20 bp, mouse
ggggctggttcctgccggac

SEQ ID NO: 596456 - DNA, 20 bp, mouse
gtggctccggtgagggtgag

SEQ ID NO: 596457 - DNA, 20 bp, mouse
gtaaggagtaaagtttgcgg

SEQ ID NO: 596458 - DNA, 20 bp, mouse
gggaagcggatgtctccgag

SEQ ID NO: 596459 - DNA, 20 bp, mouse
ggtgaagccaatcttaggag

SEQ ID NO: 596460 - DNA, 20 bp, mouse
gccggagccactcctaagat

SEQ ID NO: 596461 - DNA, 20 bp, mouse
gttaggagtggctccggtga

SEQ ID NO: 596462 - DNA, 20 bp, mouse
gctcgtagggaactcagcgt

SEQ ID NO: 596463 - DNA, 20 bp, mouse
gacggccgaagtgaaacgct

SEQ ID NO: 596464 - DNA, 20 bp, mouse
gaccgataccgacaacgaaa

SEQ ID NO: 596465 - DNA, 20 bp, mouse
gcctagggacgaaaaagaag

SEQ ID NO: 596466 - DNA, 20 bp, mouse
gcgtcgcagggtgggagaag

SEQ ID NO: 596467 - DNA, 20 bp, mouse
ggacacggagggagacaaga

SEQ ID NO: 596468 - DNA, 20 bp, mouse
gagcgtcggcgtcgcagggt

SEQ ID NO: 596469 - DNA, 20 bp, mouse
gcgcagggtgggagaagcgg

SEQ ID NO: 596470 - DNA, 20 bp, mouse
gggagccacagaaaataagg

SEQ ID NO: 596471 - DNA, 20 bp, mouse
gggcttcggacaagtcgtat

SEQ ID NO: 596472 - DNA, 20 bp, mouse
gtcggacaagtcgtatggga

SEQ ID NO: 596473 - DNA, 20 bp, mouse
gtggcagcgtcggcgtcgca

SEQ ID NO: 596474 - DNA, 20 bp, mouse
gtgctacggaggagcgctca

SEQ ID NO: 596475 - DNA, 20 bp, mouse
gcagctcctgggcattcccc

SEQ ID NO: 596476 - DNA, 20 bp, mouse
ggagcctgaagtgcgagtgt

SEQ ID NO: 596477 - DNA, 20 bp, mouse
ggacaggacggtgttcatcg

SEQ ID NO: 596478 - DNA, 20 bp, mouse
gagtgcgagtgtgggagccg

SEQ ID NO: 596479 - DNA, 20 bp, mouse
ggagttcgcgcgcgacagga

SEQ ID NO: 596480 - DNA, 20 bp, mouse
gagacaggagcgtcccagtg

SEQ ID NO: 596481 - DNA, 20 bp, mouse
gctgtgtgcgcggtccccga

SEQ ID NO: 596482 - DNA, 20 bp, mouse
ggctcccacactcgcacttc

SEQ ID NO: 596483 - DNA, 20 bp, mouse
ggcgcacccgatgcgcgggt

SEQ ID NO: 596484 - DNA, 20 bp, mouse
gccgcgggccgtccactccg

SEQ ID NO: 596485 - DNA, 20 bp, mouse
ggtggcgacctttccctccc

SEQ ID NO: 596486 - DNA, 20 bp, mouse
gggcagagcggacagatgga

SEQ ID NO: 596487 - DNA, 20 bp, mouse
ggggctggggtgctaggtgt

SEQ ID NO: 596488 - DNA, 20 bp, mouse
gacagatggacggaaggcag

SEQ ID NO: 596489 - DNA, 20 bp, mouse
gactgcaggaatgtgctgga

SEQ ID NO: 596490 - DNA, 20 bp, mouse
ggacagggaaccccacggaa

SEQ ID NO: 596491 - DNA, 20 bp, mouse
gaatgtgctggaaggaagtc

SEQ ID NO: 596492 - DNA, 20 bp, mouse
gacagaggtggctcttaggt

SEQ ID NO: 596493 - DNA, 20 bp, mouse
gggtctcagtcagacatcag

SEQ ID NO: 596494 - DNA, 20 bp, mouse
ggttctcaccggggcagcag

SEQ ID NO: 596495 - DNA, 20 bp, mouse
gcggtgagaacccccagctt

SEQ ID NO: 596496 - DNA, 20 bp, mouse
gtgctgctgccgagtgaaga

SEQ ID NO: 596497 - DNA, 20 bp, mouse
gctgcaaccggaggcctgtc

SEQ ID NO: 596498 - DNA, 20 bp, mouse
gagcgtgaggagagaggtaa

SEQ ID NO: 596499 - DNA, 20 bp, mouse
gactacaccgacccggaagg

SEQ ID NO: 596500 - DNA, 20 bp, mouse
ggagttagtgtcacgaatct

SEQ ID NO: 596501 - DNA, 20 bp, mouse
gtcgggaagggtgaaccggg

SEQ ID NO: 596502 - DNA, 20 bp, mouse
gtcctggctgctgcaaccgg

SEQ ID NO: 596503 - DNA, 20 bp, mouse
gctggagccgccttccgggt

SEQ ID NO: 596504 - DNA, 20 bp, mouse
gagtccagtgctctccggac

SEQ ID NO: 596505 - DNA, 20 bp, mouse
gaagactacaccgacccgga

SEQ ID NO: 596506 - DNA, 20 bp, mouse
gcgcctgaggtagatcgctg

SEQ ID NO: 596507 - DNA, 20 bp, mouse
gcaggccggcgaagagcgag

SEQ ID NO: 596508 - DNA, 20 bp, mouse
gctgaggtagatcgctgagg

SEQ ID NO: 596509 - DNA, 20 bp, mouse
gtcgaggccgcggggatgtg

SEQ ID NO: 596510 - DNA, 20 bp, mouse
gcccagcacgcaaccgcctg

SEQ ID NO: 596511 - DNA, 20 bp, mouse
gaggtagatcgctgaggcgg

SEQ ID NO: 596512 - DNA, 20 bp, mouse
gtcgctgaggcggaggctgt

SEQ ID NO: 596513 - DNA, 20 bp, mouse
gccctccgcttgaggttctt

SEQ ID NO: 596514 - DNA, 20 bp, mouse
gcaagggccgggcatcccgg

SEQ ID NO: 596515 - DNA, 20 bp, mouse
gtgaaggtacctgcgcaggc

SEQ ID NO: 596516 - DNA, 20 bp, mouse
ggaggagagacactccatgg

SEQ ID NO: 596517 - DNA, 20 bp, mouse
ggcgtcccttcccccatcta

SEQ ID NO: 596518 - DNA, 20 bp, mouse
gaccgagctgcctgccacca

SEQ ID NO: 596519 - DNA, 20 bp, mouse
gagagacactccatggtggc

SEQ ID NO: 596520 - DNA, 20 bp, mouse
gaaggaagggcctaggacgg

SEQ ID NO: 596521 - DNA, 20 bp, mouse
gacctggggtggtggtagat

SEQ ID NO: 596522 - DNA, 20 bp, mouse
gtcttgacttctccctagat

SEQ ID NO: 596523 - DNA, 20 bp, mouse
ggcgggagagatcagagtct

SEQ ID NO: 596524 - DNA, 20 bp, mouse
gccctcagcctggcatcacc

SEQ ID NO: 596525 - DNA, 20 bp, mouse
gtgtctctcctccaatcagg

SEQ ID NO: 596526 - DNA, 20 bp, mouse
gccgagtgcgatcaggacca

SEQ ID NO: 596527 - DNA, 20 bp, mouse
gctttggcgactggactcca

SEQ ID NO: 596528 - DNA, 20 bp, mouse
gggaggggccgagtgcgatc

SEQ ID NO: 596529 - DNA, 20 bp, mouse
gcatgccagaaggagtgcca

SEQ ID NO: 596530 - DNA, 20 bp, mouse
ggccagaaggagtgccaggg

SEQ ID NO: 596531 - DNA, 20 bp, mouse
gccctccctggcactccttc

SEQ ID NO: 596532 - DNA, 20 bp, mouse
ggactcctcgggacatcatg

SEQ ID NO: 596533 - DNA, 20 bp, mouse
gaggacagtggggtaaccca

SEQ ID NO: 596534 - DNA, 20 bp, mouse
gtgtgaggcagggatgaaga

SEQ ID NO: 596535 - DNA, 20 bp, mouse
ggcgactggactccagggct

SEQ ID NO: 596536 - DNA, 20 bp, mouse
ggccctgaggccggactcaa

SEQ ID NO: 596537 - DNA, 20 bp, mouse
gagggcaacagccaacccca

SEQ ID NO: 596538 - DNA, 20 bp, mouse
gaggccggactcaacggacc

SEQ ID NO: 596539 - DNA, 20 bp, mouse
gtgccgcgcggtaagagccg

SEQ ID NO: 596540 - DNA, 20 bp, mouse
gtccgttgagtccggcctca

SEQ ID NO: 596541 - DNA, 20 bp, mouse
gggtccgcccgggcaggaga

SEQ ID NO: 596542 - DNA, 20 bp, mouse
ggggcggcgagctcgcccgg

SEQ ID NO: 596543 - DNA, 20 bp, mouse
gacagggcgggccgagggag

SEQ ID NO: 596544 - DNA, 20 bp, mouse
gcggagggcgggagccgcaa

SEQ ID NO: 596545 - DNA, 20 bp, mouse
gcaagctgtgaggtccgccc

SEQ ID NO: 596546 - DNA, 20 bp, mouse
gtccctctttataaactcct

SEQ ID NO: 596547 - DNA, 20 bp, mouse
gcaggatcacccagtgcttc

SEQ ID NO: 596548 - DNA, 20 bp, mouse
gaacccaggagtttataaag

SEQ ID NO: 596549 - DNA, 20 bp, mouse
gcttgttgaaagcagtgcga

SEQ ID NO: 596550 - DNA, 20 bp, mouse
gttgaaagcagtgcgagggt

SEQ ID NO: 596551 - DNA, 20 bp, mouse
gatatggtttgaggggctgg

SEQ ID NO: 596552 - DNA, 20 bp, mouse
gggagactagaccacaaccc

SEQ ID NO: 596553 - DNA, 20 bp, mouse
ggtctagtctccggaagcac

SEQ ID NO: 596554 - DNA, 20 bp, mouse
gttggaagaacagcatctgc

SEQ ID NO: 596555 - DNA, 20 bp, mouse
ggaggaggcgagggcagata

SEQ ID NO: 596556 - DNA, 20 bp, mouse
gcccaaaaagattgcagagt

SEQ ID NO: 596557 - DNA, 20 bp, mouse
gtagcataagaaattccccg

SEQ ID NO: 596558 - DNA, 20 bp, mouse
ggatcaggaaatggtgtctc

SEQ ID NO: 596559 - DNA, 20 bp, mouse
ggagatggccattcaagtaa

SEQ ID NO: 596560 - DNA, 20 bp, mouse
gttgagctcactggaaggca

SEQ ID NO: 596561 - DNA, 20 bp, mouse
gtgagagtaatgaagaacga

SEQ ID NO: 596562 - DNA, 20 bp, mouse
gtggaaggcatggcctgaga

SEQ ID NO: 596563 - DNA, 20 bp, mouse
gtctgtgtttgctaggcccc

SEQ ID NO: 596564 - DNA, 20 bp, mouse
gtgtagcaacaatctcactt

SEQ ID NO: 596565 - DNA, 20 bp, mouse
ggagagaggaggaaggatgt

SEQ ID NO: 596566 - DNA, 20 bp, mouse
gatgtggaactggaaactcc

SEQ ID NO: 596567 - DNA, 20 bp, mouse
ggtgctttctccgtccccta

SEQ ID NO: 596568 - DNA, 20 bp, mouse
gaagctcactgagatttccc

SEQ ID NO: 596569 - DNA, 20 bp, mouse
gtggaaattttttcactacc

SEQ ID NO: 596570 - DNA, 20 bp, mouse
gaaatggccagataccacct

SEQ ID NO: 596571 - DNA, 20 bp, mouse
gctcctgagtcggacacaca

SEQ ID NO: 596572 - DNA, 20 bp, mouse
ggaccatgtgtgtccgactc

SEQ ID NO: 596573 - DNA, 20 bp, mouse
gtaacacccacaatacccag

SEQ ID NO: 596574 - DNA, 20 bp, mouse
gcacatggtcatctctgaaa

SEQ ID NO: 596575 - DNA, 20 bp, mouse
gggacagaatgagacctatc

SEQ ID NO: 596576 - DNA, 20 bp, mouse
gaatatggctgctcccagaa

SEQ ID NO: 596577 - DNA, 20 bp, mouse
gatacgtttgggtccctatt

SEQ ID NO: 596578 - DNA, 20 bp, mouse
gcgctcgcagttgcgagagg

SEQ ID NO: 596579 - DNA, 20 bp, mouse
gatggtttcggaaaacaata

SEQ ID NO: 596580 - DNA, 20 bp, mouse
gctgcaccagctgtacctct

SEQ ID NO: 596581 - DNA, 20 bp, mouse
ggtcactgaagtcccgggag

SEQ ID NO: 596582 - DNA, 20 bp, mouse
ggagcgttcagatatacgtt

SEQ ID NO: 596583 - DNA, 20 bp, mouse
gagggatattgtctacccag

SEQ ID NO: 596584 - DNA, 20 bp, mouse
gacagacacaaatcccttct

SEQ ID NO: 596585 - DNA, 20 bp, mouse
gcaagtagcgacggttgcta

SEQ ID NO: 596586 - DNA, 20 bp, mouse
gcaggtgctaggaactttcc

SEQ ID NO: 596587 - DNA, 20 bp, mouse
gggctaggtagcactgagga

SEQ ID NO: 596588 - DNA, 20 bp, mouse
ggtgctacctagccacactg

SEQ ID NO: 596589 - DNA, 20 bp, mouse
ggatttccgacatagctcac

SEQ ID NO: 596590 - DNA, 20 bp, mouse
gccagggcaaccagttgcta

SEQ ID NO: 596591 - DNA, 20 bp, mouse
gctaggtcgccggctcagag

SEQ ID NO: 596592 - DNA, 20 bp, mouse
gggtcgccggctcagagagg

SEQ ID NO: 596593 - DNA, 20 bp, mouse
gttccaggaactcagtcagc

SEQ ID NO: 596594 - DNA, 20 bp, mouse
gagggcaggccagcactgcc

SEQ ID NO: 596595 - DNA, 20 bp, mouse
gagtgagtgaactcagccaa

SEQ ID NO: 596596 - DNA, 20 bp, mouse
gttccaggtgagggctccgg

SEQ ID NO: 596597 - DNA, 20 bp, mouse
gccccgccatgaagaagctg

SEQ ID NO: 596598 - DNA, 20 bp, mouse
gtgggtgaagaagcgtttcc

SEQ ID NO: 596599 - DNA, 20 bp, mouse
gctgcaaccggagcctccag

SEQ ID NO: 596600 - DNA, 20 bp, mouse
gggtgacccgccctccctcg

SEQ ID NO: 596601 - DNA, 20 bp, mouse
gacccacagcttcttcatgg

SEQ ID NO: 596602 - DNA, 20 bp, mouse
gaggaggccccagtacgtag

SEQ ID NO: 596603 - DNA, 20 bp, mouse
ggaagaagcgtttccaggtg

SEQ ID NO: 596604 - DNA, 20 bp, mouse
gtcaccgcggctgggcccag

SEQ ID NO: 596605 - DNA, 20 bp, mouse
gcagcgggcgctacatgctg

SEQ ID NO: 596606 - DNA, 20 bp, mouse
gctgggtcagcgagtgagtg

SEQ ID NO: 596607 - DNA, 20 bp, mouse
ggctgatcgcctgttccctg

SEQ ID NO: 596608 - DNA, 20 bp, mouse
gtcagtgcggggcctcagct

SEQ ID NO: 596609 - DNA, 20 bp, mouse
ggcaagagggcctggtgcca

SEQ ID NO: 596610 - DNA, 20 bp, mouse
ggctaaggccagtgggcagt

SEQ ID NO: 596611 - DNA, 20 bp, mouse
gtcactcgctgacccagctg

SEQ ID NO: 596612 - DNA, 20 bp, mouse
ggaagtgagcctaggagcgg

SEQ ID NO: 596613 - DNA, 20 bp, mouse
gggcccctggccagttgtag

SEQ ID NO: 596614 - DNA, 20 bp, mouse
gcctggggagctaaggccag

SEQ ID NO: 596615 - DNA, 20 bp, mouse
gcctgttccctggggagcta

SEQ ID NO: 596616 - DNA, 20 bp, mouse
ggcaggctagtgggcattag

SEQ ID NO: 596617 - DNA, 20 bp, mouse
gatggccatggtggtcccta

SEQ ID NO: 596618 - DNA, 20 bp, mouse
gagtgggcattaggggtagt

SEQ ID NO: 596619 - DNA, 20 bp, mouse
gcggctccagagctaggtat

SEQ ID NO: 596620 - DNA, 20 bp, mouse
gggacatggtgaccacaggt

SEQ ID NO: 596621 - DNA, 20 bp, mouse
gacgaggcccacccaggccg

SEQ ID NO: 596622 - DNA, 20 bp, mouse
gtagtgggctgggggcctaa

SEQ ID NO: 596623 - DNA, 20 bp, mouse
gaggaggacatggtgaccac

SEQ ID NO: 596624 - DNA, 20 bp, mouse
gaagggccctggtggcccta

SEQ ID NO: 596625 - DNA, 20 bp, mouse
ggagcggcctcggcctgggt

SEQ ID NO: 596626 - DNA, 20 bp, mouse
ggcccgagagtcagaacctg

SEQ ID NO: 596627 - DNA, 20 bp, mouse
ggccgccggagcgcgagggt

SEQ ID NO: 596628 - DNA, 20 bp, mouse
gggtgtgccggcgaccgcgg

SEQ ID NO: 596629 - DNA, 20 bp, mouse
ggtcggcttcgggtgtttgg

SEQ ID NO: 596630 - DNA, 20 bp, mouse
gatgcgccgccggagcgcga

SEQ ID NO: 596631 - DNA, 20 bp, mouse
gggagcgcgagggtcggctt

SEQ ID NO: 596632 - DNA, 20 bp, mouse
gggaggggcgagcgagaccc

SEQ ID NO: 596633 - DNA, 20 bp, mouse
gggatggtctctgcaccggg

SEQ ID NO: 596634 - DNA, 20 bp, mouse
ggccgaccctcgcgctccgg

SEQ ID NO: 596635 - DNA, 20 bp, mouse
ggcgtacgaagccggcgagg

SEQ ID NO: 596636 - DNA, 20 bp, mouse
gcccagcctcggagcctcag

SEQ ID NO: 596637 - DNA, 20 bp, mouse
gttctgtaagcaggaaggat

SEQ ID NO: 596638 - DNA, 20 bp, mouse
gtgttctgtgatgtcacctc

SEQ ID NO: 596639 - DNA, 20 bp, mouse
gagagggctgcaggtcttcc

SEQ ID NO: 596640 - DNA, 20 bp, mouse
gtgtttcagagactttaagt

SEQ ID NO: 596641 - DNA, 20 bp, mouse
gttacatggagattattata

SEQ ID NO: 596642 - DNA, 20 bp, mouse
gccgaaacagaagtcaatag

SEQ ID NO: 596643 - DNA, 20 bp, mouse
gctggcatctcacattggta

SEQ ID NO: 596644 - DNA, 20 bp, mouse
gtatacctggcatctcacat

SEQ ID NO: 596645 - DNA, 20 bp, mouse
gggtatataattaatttgta

SEQ ID NO: 596646 - DNA, 20 bp, mouse
gaccaggcctgggtacctca

SEQ ID NO: 596647 - DNA, 20 bp, mouse
gacctcagggccgaaaggag

SEQ ID NO: 596648 - DNA, 20 bp, mouse
gggccctgacgtgggacggt

SEQ ID NO: 596649 - DNA, 20 bp, mouse
gtgggtacctcagggccgaa

SEQ ID NO: 596650 - DNA, 20 bp, mouse
gggcgccaaggccctgacgt

SEQ ID NO: 596651 - DNA, 20 bp, mouse
gggcctaccgtcccacgtca

SEQ ID NO: 596652 - DNA, 20 bp, mouse
gcagtgtgtgacagtgaggt

SEQ ID NO: 596653 - DNA, 20 bp, mouse
gtaggagttgagcatcctgg

SEQ ID NO: 596654 - DNA, 20 bp, mouse
ggccctgaggtacccaggcc

SEQ ID NO: 596655 - DNA, 20 bp, mouse
gccatccgacgggaacgtcc

SEQ ID NO: 596656 - DNA, 20 bp, mouse
gggatccgcaccagcagcat

SEQ ID NO: 596657 - DNA, 20 bp, mouse
gcaagatggctgcccagcca

SEQ ID NO: 596658 - DNA, 20 bp, mouse
gaggaccgcccaggccaaga

SEQ ID NO: 596659 - DNA, 20 bp, mouse
ggcacttccgggccctggct

SEQ ID NO: 596660 - DNA, 20 bp, mouse
ggccccggcacagccggggg

SEQ ID NO: 596661 - DNA, 20 bp, mouse
gatggccccggcacagccgg

SEQ ID NO: 596662 - DNA, 20 bp, mouse
gatgggcaggacccgctcca

SEQ ID NO: 596663 - DNA, 20 bp, mouse
gaggacccgctccatggccc

SEQ ID NO: 596664 - DNA, 20 bp, mouse
gtcctgaggaggctccccag

SEQ ID NO: 596665 - DNA, 20 bp, mouse
gtctaccggaaggaccgccc

SEQ ID NO: 596666 - DNA, 20 bp, mouse
gctccgagcccgagagccca

SEQ ID NO: 596667 - DNA, 20 bp, mouse
gctgaggccggagggtgtgt

SEQ ID NO: 596668 - DNA, 20 bp, mouse
ggctgcggcccgggtccagg

SEQ ID NO: 596669 - DNA, 20 bp, mouse
ggcagttgcgcgctctccgt

SEQ ID NO: 596670 - DNA, 20 bp, mouse
gaccccgggacgcccagcgg

SEQ ID NO: 596671 - DNA, 20 bp, mouse
ggcctttggaaggtcagagt

SEQ ID NO: 596672 - DNA, 20 bp, mouse
gagggatgcgcgggttcctg

SEQ ID NO: 596673 - DNA, 20 bp, mouse
ggcgccaggagccacaacac

SEQ ID NO: 596674 - DNA, 20 bp, mouse
gaaggcgcacgggtagccag

SEQ ID NO: 596675 - DNA, 20 bp, mouse
gccagcgccggggataagaa

SEQ ID NO: 596676 - DNA, 20 bp, mouse
gcgcgcggccgagcagccag

SEQ ID NO: 596677 - DNA, 20 bp, mouse
gtaccaaagctgggaggcgg

SEQ ID NO: 596678 - DNA, 20 bp, mouse
gcagtaccaaagctgggagg

SEQ ID NO: 596679 - DNA, 20 bp, mouse
gaggagccccgcgggagcag

SEQ ID NO: 596680 - DNA, 20 bp, mouse
gggccaccgcctcccagctt

SEQ ID NO: 596681 - DNA, 20 bp, mouse
gccgcggggctcctgatctg

SEQ ID NO: 596682 - DNA, 20 bp, mouse
ggagctcgcagtaccaaagc

SEQ ID NO: 596683 - DNA, 20 bp, mouse
gggaccggcggccgcagatc

SEQ ID NO: 596684 - DNA, 20 bp, mouse
gcgcgggagcagcgggcaga

SEQ ID NO: 596685 - DNA, 20 bp, mouse
gacgagcagagttcacgagt

SEQ ID NO: 596686 - DNA, 20 bp, mouse
gtaacccgctcggagcccgg

SEQ ID NO: 596687 - DNA, 20 bp, mouse
ggcaggccccacagccgtcg

SEQ ID NO: 596688 - DNA, 20 bp, mouse
ggccgctttcggcaccatgg

SEQ ID NO: 596689 - DNA, 20 bp, mouse
ggggagagacgaaccacccg

SEQ ID NO: 596690 - DNA, 20 bp, mouse
gcagaaagaagaggacggaa

SEQ ID NO: 596691 - DNA, 20 bp, mouse
gtgcttcgcgggctccgccc

SEQ ID NO: 596692 - DNA, 20 bp, mouse
ggctccgagcgggttacctg

SEQ ID NO: 596693 - DNA, 20 bp, mouse
gggccggagccgcactgcgc

SEQ ID NO: 596694 - DNA, 20 bp, mouse
ggtctctctcacacacgcca

SEQ ID NO: 596695 - DNA, 20 bp, mouse
gcgccttgctgctgcttcgc

SEQ ID NO: 596696 - DNA, 20 bp, mouse
gcgtggatcccgatcatccg

SEQ ID NO: 596697 - DNA, 20 bp, mouse
gaggcaccgcggaggagcag

SEQ ID NO: 596698 - DNA, 20 bp, mouse
gcccccagggaacactatca

SEQ ID NO: 596699 - DNA, 20 bp, mouse
gctgcctgccgcggatgatc

SEQ ID NO: 596700 - DNA, 20 bp, mouse
gtgggttcctccagtcggtg

SEQ ID NO: 596701 - DNA, 20 bp, mouse
gctccagtcggtgaggatcg

SEQ ID NO: 596702 - DNA, 20 bp, mouse
gtcggccacgcgcagatgag

SEQ ID NO: 596703 - DNA, 20 bp, mouse
gactgctgggttcctccagt

SEQ ID NO: 596704 - DNA, 20 bp, mouse
gcagagtcaggacagcacta

SEQ ID NO: 596705 - DNA, 20 bp, mouse
gatccacgatcctcaccgac

SEQ ID NO: 596706 - DNA, 20 bp, mouse
ggggaggaccgagtaaaccg

SEQ ID NO: 596707 - DNA, 20 bp, mouse
ggggtcccagccctttcctc

SEQ ID NO: 596708 - DNA, 20 bp, mouse
gggctcgcggaggacccggt

SEQ ID NO: 596709 - DNA, 20 bp, mouse
ggagtgttagagcagggacg

SEQ ID NO: 596710 - DNA, 20 bp, mouse
gcctggagagtgttagagca

SEQ ID NO: 596711 - DNA, 20 bp, mouse
gcacgccgaccgcttctcgg

SEQ ID NO: 596712 - DNA, 20 bp, mouse
ggacccggtgggctgtgtgt

SEQ ID NO: 596713 - DNA, 20 bp, mouse
gctcgggtgagagatctagt

SEQ ID NO: 596714 - DNA, 20 bp, mouse
ggggtttctcgatggtatgt

SEQ ID NO: 596715 - DNA, 20 bp, mouse
gttagagcagggacggggaa

SEQ ID NO: 596716 - DNA, 20 bp, mouse
gctgagtgtccgcccctctg

SEQ ID NO: 596717 - DNA, 20 bp, mouse
gcgcaggttgcggggtttgg

SEQ ID NO: 596718 - DNA, 20 bp, mouse
gcggtagtgcagactccgga

SEQ ID NO: 596719 - DNA, 20 bp, mouse
ggacgacgcagcgtgcacgc

SEQ ID NO: 596720 - DNA, 20 bp, mouse
gggggcggtagtgcagactc

SEQ ID NO: 596721 - DNA, 20 bp, mouse
gtggtgggccgggagcctgt

SEQ ID NO: 596722 - DNA, 20 bp, mouse
gtgggtggagccaagatctg

SEQ ID NO: 596723 - DNA, 20 bp, mouse
gggagaccggggacaatcgg

SEQ ID NO: 596724 - DNA, 20 bp, mouse
gcgtcgtccggcagcccctc

SEQ ID NO: 596725 - DNA, 20 bp, mouse
gagcgtgcacgcaggttgcg

SEQ ID NO: 596726 - DNA, 20 bp, mouse
ggctgggcactagagatcat

SEQ ID NO: 596727 - DNA, 20 bp, mouse
gcgcgaggacagagacgtgc

SEQ ID NO: 596728 - DNA, 20 bp, mouse
gttctccgtgggaatctcta

SEQ ID NO: 596729 - DNA, 20 bp, mouse
gaagctgacagcgcaggcga

SEQ ID NO: 596730 - DNA, 20 bp, mouse
gcctcacccccacctctcaa

SEQ ID NO: 596731 - DNA, 20 bp, mouse
gctctccttagagattccca

SEQ ID NO: 596732 - DNA, 20 bp, mouse
gctctcaagggccgatccca

SEQ ID NO: 596733 - DNA, 20 bp, mouse
gctctaaggagagcaaaggg

SEQ ID NO: 596734 - DNA, 20 bp, mouse
ggtcctcgcgcagggcgctc

SEQ ID NO: 596735 - DNA, 20 bp, mouse
gagccgggagttgacatcca

SEQ ID NO: 596736 - DNA, 20 bp, mouse
ggttcccagcccagttctcc

SEQ ID NO: 596737 - DNA, 20 bp, mouse
ggatcgtaacgttcaagggt

SEQ ID NO: 596738 - DNA, 20 bp, mouse
gtctagatcgtaacgttcaa

SEQ ID NO: 596739 - DNA, 20 bp, mouse
gttcaagggttggagaaacc

SEQ ID NO: 596740 - DNA, 20 bp, mouse
gaaaccgggagaactgggct

SEQ ID NO: 596741 - DNA, 20 bp, mouse
ggctgggaacaatgtcctta

SEQ ID NO: 596742 - DNA, 20 bp, mouse
ggtacttagctgggagggga

SEQ ID NO: 596743 - DNA, 20 bp, mouse
gttggagaaaccgggagaac

SEQ ID NO: 596744 - DNA, 20 bp, mouse
gcagatattgcagggcctac

SEQ ID NO: 596745 - DNA, 20 bp, mouse
gcccagctaagtaccacagc

SEQ ID NO: 596746 - DNA, 20 bp, mouse
gtggaggctgcacagtaagt

SEQ ID NO: 596747 - DNA, 20 bp, mouse
ggtcccaagaacaggattgg

SEQ ID NO: 596748 - DNA, 20 bp, mouse
ggaggatgctgtgctgagtg

SEQ ID NO: 596749 - DNA, 20 bp, mouse
ggggtgggggtcccaagaac

SEQ ID NO: 596750 - DNA, 20 bp, mouse
gcagcttctgtggcacccag

SEQ ID NO: 596751 - DNA, 20 bp, mouse
ggccctggctgcccatcctg

SEQ ID NO: 596752 - DNA, 20 bp, mouse
gaccaccatgcttgctctgg

SEQ ID NO: 596753 - DNA, 20 bp, mouse
gcctaggcaggatggggtca

SEQ ID NO: 596754 - DNA, 20 bp, mouse
gaaggacagacggcacacct

SEQ ID NO: 596755 - DNA, 20 bp, mouse
gggaacacctaggcaggatg

SEQ ID NO: 596756 - DNA, 20 bp, mouse
gggcaggcttgaggctgtag

SEQ ID NO: 596757 - DNA, 20 bp, mouse
gaatggaacacttaatacaa

SEQ ID NO: 596758 - DNA, 20 bp, mouse
gacttaccaggaaaaccaag

SEQ ID NO: 596759 - DNA, 20 bp, mouse
gcacttaatacaaaggttca

SEQ ID NO: 596760 - DNA, 20 bp, mouse
ggacgctatcaacaacaccc

SEQ ID NO: 596761 - DNA, 20 bp, mouse
gaataaccttcagcactaca

SEQ ID NO: 596762 - DNA, 20 bp, mouse
gattcatcccaaggagaaaa

SEQ ID NO: 596763 - DNA, 20 bp, mouse
gttcagctttagcttatcaa

SEQ ID NO: 596764 - DNA, 20 bp, mouse
gcagtacagatatcgccact

SEQ ID NO: 596765 - DNA, 20 bp, mouse
gtatcgccacttggttttcc

SEQ ID NO: 596766 - DNA, 20 bp, mouse
gttactgtcccgctagggag

SEQ ID NO: 596767 - DNA, 20 bp, mouse
gaccacagagcccgccacgg

SEQ ID NO: 596768 - DNA, 20 bp, mouse
gccagcggcaaggcaggttg

SEQ ID NO: 596769 - DNA, 20 bp, mouse
ggaggctgaacttttagtcg

SEQ ID NO: 596770 - DNA, 20 bp, mouse
ggcacagtcggccagcggca

SEQ ID NO: 596771 - DNA, 20 bp, mouse
gggcatagggcgaggagaag

SEQ ID NO: 596772 - DNA, 20 bp, mouse
gagaaccacagagcccgcca

SEQ ID NO: 596773 - DNA, 20 bp, mouse
ggctgggtctcagtatgggt

SEQ ID NO: 596774 - DNA, 20 bp, mouse
gagcccgccacgggggaacg

SEQ ID NO: 596775 - DNA, 20 bp, mouse
gtccccggaaccgcactctc

SEQ ID NO: 596776 - DNA, 20 bp, mouse
ggcaggaagactgtgcacgt

SEQ ID NO: 596777 - DNA, 20 bp, mouse
gtgtgcacgtaggagatgtc

SEQ ID NO: 596778 - DNA, 20 bp, mouse
gtgtctggagcccgccgccc

SEQ ID NO: 596779 - DNA, 20 bp, mouse
gtaccttggacgtgccgggg

SEQ ID NO: 596780 - DNA, 20 bp, mouse
gcgccgccccggcacgtcca

SEQ ID NO: 596781 - DNA, 20 bp, mouse
ggcgtaccttggacgtgccg

SEQ ID NO: 596782 - DNA, 20 bp, mouse
ggcaacagcacagcgtacct

SEQ ID NO: 596783 - DNA, 20 bp, mouse
gctgggcagaggcagagcga

SEQ ID NO: 596784 - DNA, 20 bp, mouse
gtcctgggaaccaagcgggt

SEQ ID NO: 596785 - DNA, 20 bp, mouse
gagcgggtgggtggctgaca

SEQ ID NO: 596786 - DNA, 20 bp, mouse
ggaagcgagtgggcctctca

SEQ ID NO: 596787 - DNA, 20 bp, mouse
gggggagcacgagcgaacca

SEQ ID NO: 596788 - DNA, 20 bp, mouse
ggagcacgagcgaaccacgg

SEQ ID NO: 596789 - DNA, 20 bp, mouse
gctggctgcagggccgtgag

SEQ ID NO: 596790 - DNA, 20 bp, mouse
gcgaaccacggcggccccgt

SEQ ID NO: 596791 - DNA, 20 bp, mouse
gagatgcgcaggcaacgtcg

SEQ ID NO: 596792 - DNA, 20 bp, mouse
gctgccggccgggctcggtg

SEQ ID NO: 596793 - DNA, 20 bp, mouse
gctatcgggcgcattcgggg

SEQ ID NO: 596794 - DNA, 20 bp, mouse
gcagtgcgcgtgcgccgtgg

SEQ ID NO: 596795 - DNA, 20 bp, mouse
ggggcgggggcgacgaacaa

SEQ ID NO: 596796 - DNA, 20 bp, mouse
gggtcgatgtctaaagaagg

SEQ ID NO: 596797 - DNA, 20 bp, mouse
gatgatcaggccatccctct

SEQ ID NO: 596798 - DNA, 20 bp, mouse
gatgacggctccaagaggga

SEQ ID NO: 596799 - DNA, 20 bp, mouse
gtggaaaacacaaatgatga

SEQ ID NO: 596800 - DNA, 20 bp, mouse
gaatgatgacggctccaaga

SEQ ID NO: 596801 - DNA, 20 bp, mouse
gacttgatgaggtacactct

SEQ ID NO: 596802 - DNA, 20 bp, mouse
gatgaggtacactctaggtt

SEQ ID NO: 596803 - DNA, 20 bp, mouse
gtctaggtttggtttcaatc

SEQ ID NO: 596804 - DNA, 20 bp, mouse
gatcatcttcatacttgatg

SEQ ID NO: 596805 - DNA, 20 bp, mouse
gttcaatctggtaaatgatc

SEQ ID NO: 596806 - DNA, 20 bp, mouse
gtattcccgagtgtcagagg

SEQ ID NO: 596807 - DNA, 20 bp, mouse
ggtcagaggcggcagtacct

SEQ ID NO: 596808 - DNA, 20 bp, mouse
gactgctggaagctcttaag

SEQ ID NO: 596809 - DNA, 20 bp, mouse
gccttattcccgagtgtcag

SEQ ID NO: 596810 - DNA, 20 bp, mouse
gaagccgcggggcaaaagaa

SEQ ID NO: 596811 - DNA, 20 bp, mouse
gactgccgcctctgacactc

SEQ ID NO: 596812 - DNA, 20 bp, mouse
gaagctacgctaggaaaaga

SEQ ID NO: 596813 - DNA, 20 bp, mouse
gtccaggaagtccccgctct

SEQ ID NO: 596814 - DNA, 20 bp, mouse
ggagcagagccaggagtcta

SEQ ID NO: 596815 - DNA, 20 bp, mouse
gcttcgctccaggctcgcag

SEQ ID NO: 596816 - DNA, 20 bp, mouse
ggacaagcgctgccaagacc

SEQ ID NO: 596817 - DNA, 20 bp, mouse
ggagtccgggaaggcgccag

SEQ ID NO: 596818 - DNA, 20 bp, mouse
ggcgcaaagcgcaaactgct

SEQ ID NO: 596819 - DNA, 20 bp, mouse
gacctggaccggagataaca

SEQ ID NO: 596820 - DNA, 20 bp, mouse
gttcgcggccacgaaagtgc

SEQ ID NO: 596821 - DNA, 20 bp, mouse
ggctttgcgcggcctggtct

SEQ ID NO: 596822 - DNA, 20 bp, mouse
gtccgggaaggcgccagggg

SEQ ID NO: 596823 - DNA, 20 bp, mouse
ggggcggacagaacgaaccc

SEQ ID NO: 596824 - DNA, 20 bp, mouse
gcggattctggctgggacgt

SEQ ID NO: 596825 - DNA, 20 bp, mouse
gcgggagcccgccatctctc

SEQ ID NO: 596826 - DNA, 20 bp, mouse
gggggagccagcgtacatcc

SEQ ID NO: 596827 - DNA, 20 bp, mouse
gttacagagtaccagcacca

SEQ ID NO: 596828 - DNA, 20 bp, mouse
ggttccttgcggctcttccg

SEQ ID NO: 596829 - DNA, 20 bp, mouse
gttttgccaatgaagaagag

SEQ ID NO: 596830 - DNA, 20 bp, mouse
gtgtaatcctggatgtacgc

SEQ ID NO: 596831 - DNA, 20 bp, mouse
gaggcctgtaactaacacgg

SEQ ID NO: 596832 - DNA, 20 bp, mouse
ggttccctaccggaaatacc

SEQ ID NO: 596833 - DNA, 20 bp, mouse
gacccacaccccgaaatcaa

SEQ ID NO: 596834 - DNA, 20 bp, mouse
gacatcgacaagagagctgt

SEQ ID NO: 596835 - DNA, 20 bp, mouse
gacctctgctcataagccaa

SEQ ID NO: 596836 - DNA, 20 bp, mouse
gaacagtaagcacagagtgc

SEQ ID NO: 596837 - DNA, 20 bp, mouse
gggataaggcaagggttggg

SEQ ID NO: 596838 - DNA, 20 bp, mouse
gtgaacgatcatgtgtaacg

SEQ ID NO: 596839 - DNA, 20 bp, mouse
gggacctggaaaagtcctta

SEQ ID NO: 596840 - DNA, 20 bp, mouse
ggcaagacacaatctgagca

SEQ ID NO: 596841 - DNA, 20 bp, mouse
gcccttacaaataaaggacc

SEQ ID NO: 596842 - DNA, 20 bp, mouse
gaaaatctgagattctatta

SEQ ID NO: 596843 - DNA, 20 bp, mouse
gctagcagagttagcaacac

SEQ ID NO: 596844 - DNA, 20 bp, mouse
gtccaggtcctttatttgta

SEQ ID NO: 596845 - DNA, 20 bp, mouse
gtatttccttcaaaaaaagc

SEQ ID NO: 596846 - DNA, 20 bp, mouse
gcatggcgctgagaatcttg

SEQ ID NO: 596847 - DNA, 20 bp, mouse
gaaggcacctgctggcttca

SEQ ID NO: 596848 - DNA, 20 bp, mouse
gcctacagagaggaacaaac

SEQ ID NO: 596849 - DNA, 20 bp, mouse
gagtagagtgacaaatgtat

SEQ ID NO: 596850 - DNA, 20 bp, mouse
ggagaacacagaaatgttag

SEQ ID NO: 596851 - DNA, 20 bp, mouse
ggaaatcaattgcacaataa

SEQ ID NO: 596852 - DNA, 20 bp, mouse
ggggcgttgaacatgcagga

SEQ ID NO: 596853 - DNA, 20 bp, mouse
ggctgtctgtgggccaccac

SEQ ID NO: 596854 - DNA, 20 bp, mouse
gctcatagcacatctaatat

SEQ ID NO: 596855 - DNA, 20 bp, mouse
gatggaaatgaaaagtgttg

SEQ ID NO: 596856 - DNA, 20 bp, mouse
gcctatggaatagagtaagt

SEQ ID NO: 596857 - DNA, 20 bp, mouse
gcatgttgtggggaatatat

SEQ ID NO: 596858 - DNA, 20 bp, mouse
gctgtggggagacattgtga

SEQ ID NO: 596859 - DNA, 20 bp, mouse
gaatgccaaggcttgctgga

SEQ ID NO: 596860 - DNA, 20 bp, mouse
gcttattcattcatgttgtg

SEQ ID NO: 596861 - DNA, 20 bp, mouse
gcaggtagaagtgttggggt

SEQ ID NO: 596862 - DNA, 20 bp, mouse
gcctagatgggagggtatta

SEQ ID NO: 596863 - DNA, 20 bp, mouse
gtctaggaggcaaaagtctc

SEQ ID NO: 596864 - DNA, 20 bp, mouse
gtgtcgtaaagcattttggg

SEQ ID NO: 596865 - DNA, 20 bp, mouse
gagggagtatgtcattcatt

SEQ ID NO: 596866 - DNA, 20 bp, mouse
gttctaaggtgggtcagttg

SEQ ID NO: 596867 - DNA, 20 bp, mouse
ggaatctagagggagatggt

SEQ ID NO: 596868 - DNA, 20 bp, mouse
gaggtgggtcagttgtggca

SEQ ID NO: 596869 - DNA, 20 bp, mouse
gcatcttctctttctaaggt

SEQ ID NO: 596870 - DNA, 20 bp, mouse
gccatccctaaagaatctag

SEQ ID NO: 596871 - DNA, 20 bp, mouse
gtgtctcctgaaacaacctt

SEQ ID NO: 596872 - DNA, 20 bp, mouse
gtctccctctagattcttta

SEQ ID NO: 596873 - DNA, 20 bp, mouse
gtaagacactaaactgtctc

SEQ ID NO: 596874 - DNA, 20 bp, mouse
gtactggagcaatagggaga

SEQ ID NO: 596875 - DNA, 20 bp, mouse
gttcccctgagatggtgata

SEQ ID NO: 596876 - DNA, 20 bp, mouse
gatctcaggacatcattcca

SEQ ID NO: 596877 - DNA, 20 bp, mouse
gtcgggaagcacagatgtag

SEQ ID NO: 596878 - DNA, 20 bp, mouse
gattccacggtaacaccaaa

SEQ ID NO: 596879 - DNA, 20 bp, mouse
gataaccaagtggagcataa

SEQ ID NO: 596880 - DNA, 20 bp, mouse
gcctggatggttggatctaa

SEQ ID NO: 596881 - DNA, 20 bp, mouse
gaccagccaggataaccaag

SEQ ID NO: 596882 - DNA, 20 bp, mouse
gccactggagatctctgtgg

SEQ ID NO: 596883 - DNA, 20 bp, mouse
ggagacagtgaagtctgatc

SEQ ID NO: 596884 - DNA, 20 bp, mouse
gcagagaagagagagcactt

SEQ ID NO: 596885 - DNA, 20 bp, mouse
gtttccttttggtgttaccg

SEQ ID NO: 596886 - DNA, 20 bp, mouse
gtgtgcagcgaacagagcag

SEQ ID NO: 596887 - DNA, 20 bp, mouse
gatggaagccccaactataa

SEQ ID NO: 596888 - DNA, 20 bp, mouse
gtggtcaagtagccacccgc

SEQ ID NO: 596889 - DNA, 20 bp, mouse
gggggcagaaccgccagtaa

SEQ ID NO: 596890 - DNA, 20 bp, mouse
gggttctgccccgtggagag

SEQ ID NO: 596891 - DNA, 20 bp, mouse
gagaaccgccagtaacggca

SEQ ID NO: 596892 - DNA, 20 bp, mouse
gtctgccccgtggagagtgg

SEQ ID NO: 596893 - DNA, 20 bp, mouse
gccgtggagagtggtggcca

SEQ ID NO: 596894 - DNA, 20 bp, mouse
gggccatggaaggtgaatgt

SEQ ID NO: 596895 - DNA, 20 bp, mouse
ggctctgctgaggttaacgg

SEQ ID NO: 596896 - DNA, 20 bp, mouse
gagatcttcgacaatgaagg

SEQ ID NO: 596897 - DNA, 20 bp, mouse
gcccagatcttcgacaatga

SEQ ID NO: 596898 - DNA, 20 bp, mouse
gaaagccagaagaactatac

SEQ ID NO: 596899 - DNA, 20 bp, mouse
gatgtccccagagatagtca

SEQ ID NO: 596900 - DNA, 20 bp, mouse
gctacctgctaaactcagca

SEQ ID NO: 596901 - DNA, 20 bp, mouse
gcaaaggaggaaagattctc

SEQ ID NO: 596902 - DNA, 20 bp, mouse
ggtttctagtacaaattaaa

SEQ ID NO: 596903 - DNA, 20 bp, mouse
gtttctgttattcgactcat

SEQ ID NO: 596904 - DNA, 20 bp, mouse
gattgctattgctaacacaa

SEQ ID NO: 596905 - DNA, 20 bp, mouse
gaccctcctaactgtagaaa

SEQ ID NO: 596906 - DNA, 20 bp, mouse
gccctgtccatgccaaggag

SEQ ID NO: 596907 - DNA, 20 bp, mouse
gaggaggggaaccaaggtca

SEQ ID NO: 596908 - DNA, 20 bp, mouse
gatgccaaggaggggaacca

SEQ ID NO: 596909 - DNA, 20 bp, mouse
gcagcatggctatgcatctg

SEQ ID NO: 596910 - DNA, 20 bp, mouse
gtggctggtcaccctgacct

SEQ ID NO: 596911 - DNA, 20 bp, mouse
gccgggctgacagtgaggtt

SEQ ID NO: 596912 - DNA, 20 bp, mouse
ggtgggccgggctgacagtg

SEQ ID NO: 596913 - DNA, 20 bp, mouse
gctgcagtcaagtgtgggcc

SEQ ID NO: 596914 - DNA, 20 bp, mouse
gatgtgactgcagtcaagtg

SEQ ID NO: 596915 - DNA, 20 bp, mouse
gaccatagtaggcaaaacac

SEQ ID NO: 596916 - DNA, 20 bp, mouse
ggtcagaagcattggcaccg

SEQ ID NO: 596917 - DNA, 20 bp, mouse
ggaactagtataaaattgtt

SEQ ID NO: 596918 - DNA, 20 bp, mouse
ggtgccaatgcttctgaccc

SEQ ID NO: 596919 - DNA, 20 bp, mouse
gaaactggatgcttaatgag

SEQ ID NO: 596920 - DNA, 20 bp, mouse
gaaggtacagaataatctat

SEQ ID NO: 596921 - DNA, 20 bp, mouse
gtggatgcttaatgagggga

SEQ ID NO: 596922 - DNA, 20 bp, mouse
gcattttctaagtggagttg

SEQ ID NO: 596923 - DNA, 20 bp, mouse
gagtcccttccccaggctct

SEQ ID NO: 596924 - DNA, 20 bp, mouse
gttgtgtgagataaaatgcc

SEQ ID NO: 596925 - DNA, 20 bp, mouse
gtagtataaaattgttagga

SEQ ID NO: 596926 - DNA, 20 bp, mouse
gagttagctcactcagatca

SEQ ID NO: 596927 - DNA, 20 bp, mouse
gtgcctgcgtgtgtattcta

SEQ ID NO: 596928 - DNA, 20 bp, mouse
gctggcaccatgaaagtagc

SEQ ID NO: 596929 - DNA, 20 bp, mouse
gaagacacctgctactttca

SEQ ID NO: 596930 - DNA, 20 bp, mouse
gaaccctagaatacacacgc

SEQ ID NO: 596931 - DNA, 20 bp, mouse
gcatgtaggaaacggagaca

SEQ ID NO: 596932 - DNA, 20 bp, mouse
ggatgacggcgataatggta

SEQ ID NO: 596933 - DNA, 20 bp, mouse
gagttctcggcttgtactaa

SEQ ID NO: 596934 - DNA, 20 bp, mouse
ggtatccctgttcttcatgt

SEQ ID NO: 596935 - DNA, 20 bp, mouse
gtagttacatcaaagcaaaa

SEQ ID NO: 596936 - DNA, 20 bp, mouse
gccaccaacaagcttcatgg

SEQ ID NO: 596937 - DNA, 20 bp, mouse
gagaccaccaacaagcttca

SEQ ID NO: 596938 - DNA, 20 bp, mouse
ggaggctagtgatgcgagac

SEQ ID NO: 596939 - DNA, 20 bp, mouse
gccagagcagttgcagacat

SEQ ID NO: 596940 - DNA, 20 bp, mouse
gtgacccctcgctgagtaca

SEQ ID NO: 596941 - DNA, 20 bp, mouse
gagagaaacagatctgatca

SEQ ID NO: 596942 - DNA, 20 bp, mouse
gtgatcagggagagggatcg

SEQ ID NO: 596943 - DNA, 20 bp, mouse
gtctccaccatgaagcttgt

SEQ ID NO: 596944 - DNA, 20 bp, mouse
gggttgctgcgaagagcagc

SEQ ID NO: 596945 - DNA, 20 bp, mouse
gtgtgccatgtactcagcga

SEQ ID NO: 596946 - DNA, 20 bp, mouse
gatggtgacagacctgtgga

SEQ ID NO: 596947 - DNA, 20 bp, mouse
gagctgaggctccttcagtc

SEQ ID NO: 596948 - DNA, 20 bp, mouse
gggaagacactcctgactga

SEQ ID NO: 596949 - DNA, 20 bp, mouse
gcttcatggtgacagacctg

SEQ ID NO: 596950 - DNA, 20 bp, mouse
gctttgcttgctttcacctg

SEQ ID NO: 596951 - DNA, 20 bp, mouse
gcactgagctggccagaaca

SEQ ID NO: 596952 - DNA, 20 bp, mouse
gaacaaacgaatgaatctaa

SEQ ID NO: 596953 - DNA, 20 bp, mouse
gtaatcgatggggatattag

SEQ ID NO: 596954 - DNA, 20 bp, mouse
gtgtaactcaccaactgcaa

SEQ ID NO: 596955 - DNA, 20 bp, mouse
gcagtggttctggattggaa

SEQ ID NO: 596956 - DNA, 20 bp, mouse
gggtgggtagagtcactctg

SEQ ID NO: 596957 - DNA, 20 bp, mouse
gggacatgggaaaatcctta

SEQ ID NO: 596958 - DNA, 20 bp, mouse
gaaattgatgatcatgtttg

SEQ ID NO: 596959 - DNA, 20 bp, mouse
gaaaatctaagattccatta

SEQ ID NO: 596960 - DNA, 20 bp, mouse
ggtatttcatttatcgacaa

SEQ ID NO: 596961 - DNA, 20 bp, mouse
gttagcagagttagcaacat

SEQ ID NO: 596962 - DNA, 20 bp, mouse
gatatttccttcaaaaaagc

SEQ ID NO: 596963 - DNA, 20 bp, mouse
gatcgacaaggggcttttgc

SEQ ID NO: 596964 - DNA, 20 bp, mouse
gttgatgatcatgtttgagg

SEQ ID NO: 596965 - DNA, 20 bp, mouse
gctttacaaataaaggacat

SEQ ID NO: 596966 - DNA, 20 bp, mouse
gctacctgcgcaggtgaacg

SEQ ID NO: 596967 - DNA, 20 bp, mouse
gctgcgcaggtgaacggggt

SEQ ID NO: 596968 - DNA, 20 bp, mouse
gagccgggcgggatcgtcgg

SEQ ID NO: 596969 - DNA, 20 bp, mouse
gtcacctgcgcaggtagctg

SEQ ID NO: 596970 - DNA, 20 bp, mouse
gcggggcactgggaacaagg

SEQ ID NO: 596971 - DNA, 20 bp, mouse
gccagagccgggcggaagcc

SEQ ID NO: 596972 - DNA, 20 bp, mouse
gctctggctgcacggaagat

SEQ ID NO: 596973 - DNA, 20 bp, mouse
gcttccgtgcagccagagcc

SEQ ID NO: 596974 - DNA, 20 bp, mouse
ggtccggtccgagtgtgcgt

SEQ ID NO: 596975 - DNA, 20 bp, mouse
gcctgcgcaggtagctgggg

SEQ ID NO: 596976 - DNA, 20 bp, mouse
gacccgtccgaggagtacta

SEQ ID NO: 596977 - DNA, 20 bp, mouse
ggccgtagtactcctcggac

SEQ ID NO: 596978 - DNA, 20 bp, mouse
gtggaggctttcacagtctg

SEQ ID NO: 596979 - DNA, 20 bp, mouse
ggtactcctcggacgggtgg

SEQ ID NO: 596980 - DNA, 20 bp, mouse
ggaaagcctccacccgtccg

SEQ ID NO: 596981 - DNA, 20 bp, mouse
gggagtactacggcgaatgg

SEQ ID NO: 596982 - DNA, 20 bp, mouse
ggtccagggaccgtgttggg

SEQ ID NO: 596983 - DNA, 20 bp, mouse
ggcagggacacaagagaagg

SEQ ID NO: 596984 - DNA, 20 bp, mouse
ggtgttgccgcgcgagtcca

SEQ ID NO: 596985 - DNA, 20 bp, mouse
gcacggtccctggactcgcg

SEQ ID NO: 596986 - DNA, 20 bp, mouse
gactgaggcagggccacccg

SEQ ID NO: 596987 - DNA, 20 bp, mouse
ggtcggagaagcagcacctc

SEQ ID NO: 596988 - DNA, 20 bp, mouse
gggagaagcagcacctcggg

SEQ ID NO: 596989 - DNA, 20 bp, mouse
gtcagtgtagagaggccctg

SEQ ID NO: 596990 - DNA, 20 bp, mouse
gccagcagtggcccagcctg

SEQ ID NO: 596991 - DNA, 20 bp, mouse
gcgcagaaccaaataatggt

SEQ ID NO: 596992 - DNA, 20 bp, mouse
gaataatggtaggtatggaa

SEQ ID NO: 596993 - DNA, 20 bp, mouse
gtggaggtctcagtgtagag

SEQ ID NO: 596994 - DNA, 20 bp, mouse
gaatggtaggtatggaatgg

SEQ ID NO: 596995 - DNA, 20 bp, mouse
ggtcatcgacagatacggtc

SEQ ID NO: 596996 - DNA, 20 bp, mouse
gagcttagtgggcttcatgg

SEQ ID NO: 596997 - DNA, 20 bp, mouse
gagccttctgacccacccag

SEQ ID NO: 596998 - DNA, 20 bp, mouse
gtctcaacaccgctcagtac

SEQ ID NO: 596999 - DNA, 20 bp, mouse
gggagaaatcccagcttagt

SEQ ID NO: 597000 - DNA, 20 bp, mouse
gtgtaagcaactcccctggg

SEQ ID NO: 597001 - DNA, 20 bp, mouse
ggactcgtgggtgttcaacg

SEQ ID NO: 597002 - DNA, 20 bp, mouse
gcagggtcaatcgtgaatgg

SEQ ID NO: 597003 - DNA, 20 bp, mouse
gccttcagcaccttaactcg

SEQ ID NO: 597004 - DNA, 20 bp, mouse
gatctctgcaaagactacaa

SEQ ID NO: 597005 - DNA, 20 bp, mouse
gacgaggctgaaacaatata

SEQ ID NO: 597006 - DNA, 20 bp, mouse
gggcgctcctgacagcagac

SEQ ID NO: 597007 - DNA, 20 bp, mouse
gaagctcctcctccaaggca

SEQ ID NO: 597008 - DNA, 20 bp, mouse
gacagggcaaggcgaatccc

SEQ ID NO: 597009 - DNA, 20 bp, mouse
gcgaatccctggacccgcca

SEQ ID NO: 597010 - DNA, 20 bp, mouse
ggagcgccatggcgggtcca

SEQ ID NO: 597011 - DNA, 20 bp, mouse
gaagtgccctgccttggagg

SEQ ID NO: 597012 - DNA, 20 bp, mouse
ggcgaaagcgggcaccttgg

SEQ ID NO: 597013 - DNA, 20 bp, mouse
gcgttagaagccacagggca

SEQ ID NO: 597014 - DNA, 20 bp, mouse
gggcaaacgttagaagccac

SEQ ID NO: 597015 - DNA, 20 bp, mouse
gatcagaagccccaacccat

SEQ ID NO: 597016 - DNA, 20 bp, mouse
gcgatgagctgctctagagg

SEQ ID NO: 597017 - DNA, 20 bp, mouse
gttgctcccgtcagcctcca

SEQ ID NO: 597018 - DNA, 20 bp, mouse
ggaccaaatggccaataccg

SEQ ID NO: 597019 - DNA, 20 bp, mouse
gggtcgatgagctgctctag

SEQ ID NO: 597020 - DNA, 20 bp, mouse
ggccaggctgtacaaagtct

SEQ ID NO: 597021 - DNA, 20 bp, mouse
gagcaaggatgaagggtacg

SEQ ID NO: 597022 - DNA, 20 bp, mouse
gacaggcacagagccatgac

SEQ ID NO: 597023 - DNA, 20 bp, mouse
gttgaaggaaaacgaagaaa

SEQ ID NO: 597024 - DNA, 20 bp, mouse
gacgtcctgataggaccgga

SEQ ID NO: 597025 - DNA, 20 bp, mouse
gcctaacacaaccaatgagt

SEQ ID NO: 597026 - DNA, 20 bp, mouse
ggcgcgcgggcggcgatgat

SEQ ID NO: 597027 - DNA, 20 bp, mouse
gcggcgggtctccataacag

SEQ ID NO: 597028 - DNA, 20 bp, mouse
ggtgcggcgcatccgggaca

SEQ ID NO: 597029 - DNA, 20 bp, mouse
ggacgcaccgccgagcgagg

SEQ ID NO: 597030 - DNA, 20 bp, mouse
ggtgcgtcgccccgctgtta

SEQ ID NO: 597031 - DNA, 20 bp, mouse
ggcgcggctggagcccggta

SEQ ID NO: 597032 - DNA, 20 bp, mouse
gcctgggcggtgtgcttcca

SEQ ID NO: 597033 - DNA, 20 bp, mouse
gtgggcggccatggcccggg

SEQ ID NO: 597034 - DNA, 20 bp, mouse
gctcctgcgtagggacggtt

SEQ ID NO: 597035 - DNA, 20 bp, mouse
gcggtaaggcgcaccggagt

SEQ ID NO: 597036 - DNA, 20 bp, mouse
gtggttaaggcacagggcca

SEQ ID NO: 597037 - DNA, 20 bp, mouse
gaccaagcctcaggaagaac

SEQ ID NO: 597038 - DNA, 20 bp, mouse
ggtacctccagttcttcctg

SEQ ID NO: 597039 - DNA, 20 bp, mouse
gccagtcctgaccaagcctc

SEQ ID NO: 597040 - DNA, 20 bp, mouse
gtggcagttggcagggaagt

SEQ ID NO: 597041 - DNA, 20 bp, mouse
gtaagggagtccagagccac

SEQ ID NO: 597042 - DNA, 20 bp, mouse
gaggccagggtgggagtcac

SEQ ID NO: 597043 - DNA, 20 bp, mouse
ggaactggaggtacttgccc

SEQ ID NO: 597044 - DNA, 20 bp, mouse
gtaccctcttaccagattaa

SEQ ID NO: 597045 - DNA, 20 bp, mouse
ggattaatggttaaggcaca

SEQ ID NO: 597046 - DNA, 20 bp, mouse
gctgctcttgggcaacatgg

SEQ ID NO: 597047 - DNA, 20 bp, mouse
ggactgagcaacagcgagtg

SEQ ID NO: 597048 - DNA, 20 bp, mouse
ggacctgctcttgggcaaca

SEQ ID NO: 597049 - DNA, 20 bp, mouse
gcacgctcctaggcgatagt

SEQ ID NO: 597050 - DNA, 20 bp, mouse
ggtgtggcgcgctccttccc

SEQ ID NO: 597051 - DNA, 20 bp, mouse
gtgtcacatgacctgctctt

SEQ ID NO: 597052 - DNA, 20 bp, mouse
gaccatggccgggtccgaca

SEQ ID NO: 597053 - DNA, 20 bp, mouse
gggaggtaggaccgaagcgt

SEQ ID NO: 597054 - DNA, 20 bp, mouse
gcgggtgactttctccggta

SEQ ID NO: 597055 - DNA, 20 bp, mouse
gctgacgcactccaaagccc

SEQ ID NO: 597056 - DNA, 20 bp, mouse
gagtagcagcggcgcagcca

SEQ ID NO: 597057 - DNA, 20 bp, mouse
gccgggccgggatggtgcag

SEQ ID NO: 597058 - DNA, 20 bp, mouse
gactgactgaacagtagcag

SEQ ID NO: 597059 - DNA, 20 bp, mouse
ggcccgagcgcagaagcgga

SEQ ID NO: 597060 - DNA, 20 bp, mouse
gagccgccgctgcaccatcc

SEQ ID NO: 597061 - DNA, 20 bp, mouse
gcccgtccgcttctgcgctc

SEQ ID NO: 597062 - DNA, 20 bp, mouse
gtgcctggaatgcgcctcgg

SEQ ID NO: 597063 - DNA, 20 bp, mouse
ggatgctggggagtccggac

SEQ ID NO: 597064 - DNA, 20 bp, mouse
gggcgcgcgcacgcactgag

SEQ ID NO: 597065 - DNA, 20 bp, mouse
ggtcgtgtccgccgacgaag

SEQ ID NO: 597066 - DNA, 20 bp, mouse
gggcctcctaggcttagact

SEQ ID NO: 597067 - DNA, 20 bp, mouse
gtcgctactgaaggcctcct

SEQ ID NO: 597068 - DNA, 20 bp, mouse
gtgcccagtctaagcctagg

SEQ ID NO: 597069 - DNA, 20 bp, mouse
gtcatgcccagtctaagcct

SEQ ID NO: 597070 - DNA, 20 bp, mouse
gtagcgatatgtgggaagac

SEQ ID NO: 597071 - DNA, 20 bp, mouse
ggccttcagtagcgatatgt

SEQ ID NO: 597072 - DNA, 20 bp, mouse
gtgagaccgaggcaactagt

SEQ ID NO: 597073 - DNA, 20 bp, mouse
gccaggctagccagactcct

SEQ ID NO: 597074 - DNA, 20 bp, mouse
gtccagaagaacacctggag

SEQ ID NO: 597075 - DNA, 20 bp, mouse
gatatttcaggctcatttca

SEQ ID NO: 597076 - DNA, 20 bp, mouse
gtgcagttagcactgctgag

SEQ ID NO: 597077 - DNA, 20 bp, mouse
gagtgtctcaaacctcagac

SEQ ID NO: 597078 - DNA, 20 bp, mouse
gtcccaggtgagcatgggag

SEQ ID NO: 597079 - DNA, 20 bp, mouse
gggccccatactgcccacct

SEQ ID NO: 597080 - DNA, 20 bp, mouse
gagccaaggtgggcagtatg

SEQ ID NO: 597081 - DNA, 20 bp, mouse
gtgctcctagagaggtacga

SEQ ID NO: 597082 - DNA, 20 bp, mouse
gacccctcccatgctcacct

SEQ ID NO: 597083 - DNA, 20 bp, mouse
gcccaccttggctcaggctc

SEQ ID NO: 597084 - DNA, 20 bp, mouse
gagcatgggaggggtagcgt

SEQ ID NO: 597085 - DNA, 20 bp, mouse
gccagcggggcaggctccag

SEQ ID NO: 597086 - DNA, 20 bp, mouse
gcaggggtctggctcagggt

SEQ ID NO: 597087 - DNA, 20 bp, mouse
gggtggctggagggctaggg

SEQ ID NO: 597088 - DNA, 20 bp, mouse
gggtctacagactccaccag

SEQ ID NO: 597089 - DNA, 20 bp, mouse
gtctccaagggacataaaag

SEQ ID NO: 597090 - DNA, 20 bp, mouse
gtcaaaggatctgcaggttt

SEQ ID NO: 597091 - DNA, 20 bp, mouse
gaaccctgagtctctctcaa

SEQ ID NO: 597092 - DNA, 20 bp, mouse
gatcctttgagagagactca

SEQ ID NO: 597093 - DNA, 20 bp, mouse
gtctctctcaaaggatctgc

SEQ ID NO: 597094 - DNA, 20 bp, mouse
ggggaacccaggggcctcca

SEQ ID NO: 597095 - DNA, 20 bp, mouse
ggcgagccggttctccaaga

SEQ ID NO: 597096 - DNA, 20 bp, mouse
ggcctagcctgaagctacac

SEQ ID NO: 597097 - DNA, 20 bp, mouse
gaggtgctgtggactcggta

SEQ ID NO: 597098 - DNA, 20 bp, mouse
gcaggctaggccacatttgg

SEQ ID NO: 597099 - DNA, 20 bp, mouse
ggcaggaggtgctgtggact

SEQ ID NO: 597100 - DNA, 20 bp, mouse
gccatccctgcccccaaatg

SEQ ID NO: 597101 - DNA, 20 bp, mouse
ggagggtgagaccaagctca

SEQ ID NO: 597102 - DNA, 20 bp, mouse
ggtggtccgtgccatgcagg

SEQ ID NO: 597103 - DNA, 20 bp, mouse
ggctggagtgcgatctactg

SEQ ID NO: 597104 - DNA, 20 bp, mouse
gtgtgtggagggtcaagcct

SEQ ID NO: 597105 - DNA, 20 bp, mouse
gggctcgccactggctgtgt

SEQ ID NO: 597106 - DNA, 20 bp, mouse
ggcgctgcgggctcacaaag

SEQ ID NO: 597107 - DNA, 20 bp, mouse
gaaagcggccggacgcgcgg

SEQ ID NO: 597108 - DNA, 20 bp, mouse
gtgtaccgcggtggctggga

SEQ ID NO: 597109 - DNA, 20 bp, mouse
gggcggcggcaggtgcgcaa

SEQ ID NO: 597110 - DNA, 20 bp, mouse
ggtgcgcaagggaacgagcc

SEQ ID NO: 597111 - DNA, 20 bp, mouse
gcacaaagcggccggacgcg

SEQ ID NO: 597112 - DNA, 20 bp, mouse
gcccaggctctggcagacgg

SEQ ID NO: 597113 - DNA, 20 bp, mouse
gccgggagatggcctcagga

SEQ ID NO: 597114 - DNA, 20 bp, mouse
gatgtactggagccccacaa

SEQ ID NO: 597115 - DNA, 20 bp, mouse
gcagcgctctggctcgtctc

SEQ ID NO: 597116 - DNA, 20 bp, mouse
gccagcgctggacgcggaga

SEQ ID NO: 597117 - DNA, 20 bp, mouse
gccagtgactgacggagggt

SEQ ID NO: 597118 - DNA, 20 bp, mouse
ggactccagtgactgacgga

SEQ ID NO: 597119 - DNA, 20 bp, mouse
gaaaagcccagcgctggacg

SEQ ID NO: 597120 - DNA, 20 bp, mouse
gtcgtggctgaaatgtgacc

SEQ ID NO: 597121 - DNA, 20 bp, mouse
gagagaggctgcgccagcgg

SEQ ID NO: 597122 - DNA, 20 bp, mouse
gccttcagccaaggcgacca

SEQ ID NO: 597123 - DNA, 20 bp, mouse
ggcgcgctccaggctccggg

SEQ ID NO: 597124 - DNA, 20 bp, mouse
gtctgggcttggacctgggg

SEQ ID NO: 597125 - DNA, 20 bp, mouse
ggtctgaaaaagcccagcgc

SEQ ID NO: 597126 - DNA, 20 bp, mouse
ggagtggacggctgagacgg

SEQ ID NO: 597127 - DNA, 20 bp, mouse
ggaagcgagttgccagagcc

SEQ ID NO: 597128 - DNA, 20 bp, mouse
ggctgagtggacggctgaga

SEQ ID NO: 597129 - DNA, 20 bp, mouse
gaggcttcacccccaaacca

SEQ ID NO: 597130 - DNA, 20 bp, mouse
gagaccgggtgcgaagatgg

SEQ ID NO: 597131 - DNA, 20 bp, mouse
gcaagcagctagagtcccag

SEQ ID NO: 597132 - DNA, 20 bp, mouse
gtgcatcagcgaggacgggt

SEQ ID NO: 597133 - DNA, 20 bp, mouse
gcacacacacgcagacccaa

SEQ ID NO: 597134 - DNA, 20 bp, mouse
gggcatgcatcagcgaggac

SEQ ID NO: 597135 - DNA, 20 bp, mouse
gtcctgatggaaaagcagcc

SEQ ID NO: 597136 - DNA, 20 bp, mouse
ggaccgtgcccgcctcgctt

SEQ ID NO: 597137 - DNA, 20 bp, mouse
gtctgagcggagccgagcag

SEQ ID NO: 597138 - DNA, 20 bp, mouse
gcgcagccgccaaagcgagg

SEQ ID NO: 597139 - DNA, 20 bp, mouse
ggccgagcagcggagctgag

SEQ ID NO: 597140 - DNA, 20 bp, mouse
gctgcagaggcgaaacctgg

SEQ ID NO: 597141 - DNA, 20 bp, mouse
gctccgcagccgccaaagcg

SEQ ID NO: 597142 - DNA, 20 bp, mouse
ggccctgggcgcgcaagatg

SEQ ID NO: 597143 - DNA, 20 bp, mouse
gcccgggtggcgctggcggt

SEQ ID NO: 597144 - DNA, 20 bp, mouse
gcgtgcccgcctcgctttgg

SEQ ID NO: 597145 - DNA, 20 bp, mouse
gggagatctaggaaccccta

SEQ ID NO: 597146 - DNA, 20 bp, mouse
gcacctggcaaaagcgtcag

SEQ ID NO: 597147 - DNA, 20 bp, mouse
ggcggagagtgagctcaact

SEQ ID NO: 597148 - DNA, 20 bp, mouse
gggcagcagttagcccgagg

SEQ ID NO: 597149 - DNA, 20 bp, mouse
gtcccagaaagtgccagaag

SEQ ID NO: 597150 - DNA, 20 bp, mouse
gggccagaggcactaacctt

SEQ ID NO: 597151 - DNA, 20 bp, mouse
gactaaccttgggcacacat

SEQ ID NO: 597152 - DNA, 20 bp, mouse
gggcttgtcagctggaggat

SEQ ID NO: 597153 - DNA, 20 bp, mouse
gagcagagaacccctgcagc

SEQ ID NO: 597154 - DNA, 20 bp, mouse
gcaaagaaaggggtgcggca

SEQ ID NO: 597155 - DNA, 20 bp, mouse
gagcagttagcccgaggggg

SEQ ID NO: 597156 - DNA, 20 bp, mouse
gcgcccaggccggtgtgtgt

SEQ ID NO: 597157 - DNA, 20 bp, mouse
ggcgtcgacgtgctgacgac

SEQ ID NO: 597158 - DNA, 20 bp, mouse
gtgctgacgacaggacgccc

SEQ ID NO: 597159 - DNA, 20 bp, mouse
gcacactcacctgagaacgg

SEQ ID NO: 597160 - DNA, 20 bp, mouse
ggacgacaggacgcccaggc

SEQ ID NO: 597161 - DNA, 20 bp, mouse
gaggcgagcgcagggggaca

SEQ ID NO: 597162 - DNA, 20 bp, mouse
gggatgttgcgggcagtatg

SEQ ID NO: 597163 - DNA, 20 bp, mouse
gccgcaacatccgggacctg

SEQ ID NO: 597164 - DNA, 20 bp, mouse
gcaccgacacacaccggcct

SEQ ID NO: 597165 - DNA, 20 bp, mouse
ggaaaccaacataggaaatg

SEQ ID NO: 597166 - DNA, 20 bp, mouse
gcaacacctagagcgggctc

SEQ ID NO: 597167 - DNA, 20 bp, mouse
gggctaggcgcactctttgg

SEQ ID NO: 597168 - DNA, 20 bp, mouse
gcctagcccgagcccgctct

SEQ ID NO: 597169 - DNA, 20 bp, mouse
gcgagcctcaacacctagag

SEQ ID NO: 597170 - DNA, 20 bp, mouse
ggcgcacgcgccctgatgac

SEQ ID NO: 597171 - DNA, 20 bp, mouse
gtcgggctaggcgcactctt

SEQ ID NO: 597172 - DNA, 20 bp, mouse
gcacgcgccctgatgactgg

SEQ ID NO: 597173 - DNA, 20 bp, mouse
gtgactggcggggcggaaac

SEQ ID NO: 597174 - DNA, 20 bp, mouse
gggcgtgggccggagcacca

SEQ ID NO: 597175 - DNA, 20 bp, mouse
ggaggcagcccagcaccggc

SEQ ID NO: 597176 - DNA, 20 bp, mouse
gctgcggcaggcattctcgg

SEQ ID NO: 597177 - DNA, 20 bp, mouse
gggccactgcaggcttacct

SEQ ID NO: 597178 - DNA, 20 bp, mouse
gcttctgcggcaggcattct

SEQ ID NO: 597179 - DNA, 20 bp, mouse
gaagcctgcagtggcccatg

SEQ ID NO: 597180 - DNA, 20 bp, mouse
gcagcctcatgggccactgc

SEQ ID NO: 597181 - DNA, 20 bp, mouse
gttctcctggctgaattctg

SEQ ID NO: 597182 - DNA, 20 bp, mouse
gcatgaggctgcagttctcc

SEQ ID NO: 597183 - DNA, 20 bp, mouse
gactgcaggcttaccttggc

SEQ ID NO: 597184 - DNA, 20 bp, mouse
ggtttgcagtcttctgcggc

SEQ ID NO: 597185 - DNA, 20 bp, mouse
gaatctagttggtcctctaa

SEQ ID NO: 597186 - DNA, 20 bp, mouse
ggccagggcagctaggtcac

SEQ ID NO: 597187 - DNA, 20 bp, mouse
gagagggctgtgatcaccta

SEQ ID NO: 597188 - DNA, 20 bp, mouse
ggagagatgaggcaccgaga

SEQ ID NO: 597189 - DNA, 20 bp, mouse
gaggatggcgacccagagtc

SEQ ID NO: 597190 - DNA, 20 bp, mouse
gtgacagctctttcagaggg

SEQ ID NO: 597191 - DNA, 20 bp, mouse
ggagctgtcatccagaagcc

SEQ ID NO: 597192 - DNA, 20 bp, mouse
gtagggcaggtggccagcgg

SEQ ID NO: 597193 - DNA, 20 bp, mouse
ggtaggtgaagtcaagacgg

SEQ ID NO: 597194 - DNA, 20 bp, mouse
gggtcgccatcctctcagta

SEQ ID NO: 597195 - DNA, 20 bp, mouse
ggggtcgcccgaaacaggta

SEQ ID NO: 597196 - DNA, 20 bp, mouse
gtgcagcagccccatcccac

SEQ ID NO: 597197 - DNA, 20 bp, mouse
gggcggcacccggacctcta

SEQ ID NO: 597198 - DNA, 20 bp, mouse
gggaccggaagaggaagtcg

SEQ ID NO: 597199 - DNA, 20 bp, mouse
gagcctagctgcccgcccgt

SEQ ID NO: 597200 - DNA, 20 bp, mouse
ggctgcccgcccgtgggatg

SEQ ID NO: 597201 - DNA, 20 bp, mouse
gtccagagcagggcagccgc

SEQ ID NO: 597202 - DNA, 20 bp, mouse
gagcagccccatcccacggg

SEQ ID NO: 597203 - DNA, 20 bp, mouse
ggcccgggcagtgggagaat

SEQ ID NO: 597204 - DNA, 20 bp, mouse
gtaggctcaggctgcgctgg

SEQ ID NO: 597205 - DNA, 20 bp, mouse
gggctgcaccctagaggtcc

SEQ ID NO: 597206 - DNA, 20 bp, mouse
gtcggccgtggcgctcacct

SEQ ID NO: 597207 - DNA, 20 bp, mouse
gaggctggcaggaacagcgg

SEQ ID NO: 597208 - DNA, 20 bp, mouse
ggtccccccgcagctctagg

SEQ ID NO: 597209 - DNA, 20 bp, mouse
gttccgcctagagctgcggg

SEQ ID NO: 597210 - DNA, 20 bp, mouse
gagagctgcggggggaccgg

SEQ ID NO: 597211 - DNA, 20 bp, mouse
ggagtggaccgcaaggtcaa

SEQ ID NO: 597212 - DNA, 20 bp, mouse
gggaccggcggacatggccg

SEQ ID NO: 597213 - DNA, 20 bp, mouse
ggggtcggtgcagaacgctg

SEQ ID NO: 597214 - DNA, 20 bp, mouse
gctctaggcggaaggtttcc

SEQ ID NO: 597215 - DNA, 20 bp, mouse
gcgggctgcatgcacctcgg

SEQ ID NO: 597216 - DNA, 20 bp, mouse
gggaggaggagtgagcccaa

SEQ ID NO: 597217 - DNA, 20 bp, mouse
gagcaggcgtctgaggagga

SEQ ID NO: 597218 - DNA, 20 bp, mouse
gtgaggaggatggcatgcct

SEQ ID NO: 597219 - DNA, 20 bp, mouse
gagtgagcccaaggggtgga

SEQ ID NO: 597220 - DNA, 20 bp, mouse
gaggaagcaggcgtctgagg

SEQ ID NO: 597221 - DNA, 20 bp, mouse
ggggaggaagcaggcgtctg

SEQ ID NO: 597222 - DNA, 20 bp, mouse
gggcatggtgcaggtcccgg

SEQ ID NO: 597223 - DNA, 20 bp, mouse
ggggcagctgcttccttggg

SEQ ID NO: 597224 - DNA, 20 bp, mouse
gccgaggcccggggagaata

SEQ ID NO: 597225 - DNA, 20 bp, mouse
gtcaagatcaaggcgcccag

SEQ ID NO: 597226 - DNA, 20 bp, mouse
gcgggcgggtgtgcttcgag

SEQ ID NO: 597227 - DNA, 20 bp, mouse
gaagcacacccgcccgccga

SEQ ID NO: 597228 - DNA, 20 bp, mouse
ggcggcggcagcaacggctg

SEQ ID NO: 597229 - DNA, 20 bp, mouse
gcacacccgcccgccgaggg

SEQ ID NO: 597230 - DNA, 20 bp, mouse
gaggggggcgctaggcggtg

SEQ ID NO: 597231 - DNA, 20 bp, mouse
ggagaacaagggccccgaaa

SEQ ID NO: 597232 - DNA, 20 bp, mouse
gccgagaggcagcaccatgg

SEQ ID NO: 597233 - DNA, 20 bp, mouse
gggctccaaacccaacatgg

SEQ ID NO: 597234 - DNA, 20 bp, mouse
gcccccgagaggcagcacca

SEQ ID NO: 597235 - DNA, 20 bp, mouse
gtgcggctccaaacccaaca

SEQ ID NO: 597236 - DNA, 20 bp, mouse
ggcctcggtgcccagatcgg

SEQ ID NO: 597237 - DNA, 20 bp, mouse
ggcgcgaccaaagccccggg

SEQ ID NO: 597238 - DNA, 20 bp, mouse
gcagctactgaaccaggacg

SEQ ID NO: 597239 - DNA, 20 bp, mouse
gcagggcgcgaccaaagccc

SEQ ID NO: 597240 - DNA, 20 bp, mouse
gccagcctcggtgcccagat

SEQ ID NO: 597241 - DNA, 20 bp, mouse
gtgagtctgagttccaggca

SEQ ID NO: 597242 - DNA, 20 bp, mouse
gtgttgaccggggcctcccg

SEQ ID NO: 597243 - DNA, 20 bp, mouse
gctactgaaccaggacgggg

SEQ ID NO: 597244 - DNA, 20 bp, mouse
gcagcagcctgacctgaaag

SEQ ID NO: 597245 - DNA, 20 bp, mouse
ggcccgcctgcctccatgcc

SEQ ID NO: 597246 - DNA, 20 bp, mouse
gcaccgaggccggcatgcag

SEQ ID NO: 597247 - DNA, 20 bp, mouse
gcccgctccacacaccactc

SEQ ID NO: 597248 - DNA, 20 bp, mouse
ggaacccggtaactgcaacc

SEQ ID NO: 597249 - DNA, 20 bp, mouse
gtccagacaaagagtgtggc

SEQ ID NO: 597250 - DNA, 20 bp, mouse
gtagcccggttgcagttacc

SEQ ID NO: 597251 - DNA, 20 bp, mouse
ggccagagtggtgtgtggag

SEQ ID NO: 597252 - DNA, 20 bp, mouse
ggcctgccacactctttgtc

SEQ ID NO: 597253 - DNA, 20 bp, mouse
gctgctacctaaccagcgtg

SEQ ID NO: 597254 - DNA, 20 bp, mouse
ggctccgccccacgctggtt

SEQ ID NO: 597255 - DNA, 20 bp, mouse
gacaccactctggcagctgc

SEQ ID NO: 597256 - DNA, 20 bp, mouse
gagggcacagtgccgagcgg

SEQ ID NO: 597257 - DNA, 20 bp, mouse
gctctcgcgggcgtgaggag

SEQ ID NO: 597258 - DNA, 20 bp, mouse
ggcttccgccgcccccctcg

SEQ ID NO: 597259 - DNA, 20 bp, mouse
gcgagatcagcgctgctcgg

SEQ ID NO: 597260 - DNA, 20 bp, mouse
ggaggcggtgctgctctcag

SEQ ID NO: 597261 - DNA, 20 bp, mouse
gggccgagatcagcgctgct

SEQ ID NO: 597262 - DNA, 20 bp, mouse
gcagggcgcgaggcgagcgt

SEQ ID NO: 597263 - DNA, 20 bp, mouse
gcctcgcggctcccctctcg

SEQ ID NO: 597264 - DNA, 20 bp, mouse
gcggacgcgctccagctgag

SEQ ID NO: 597265 - DNA, 20 bp, mouse
ggtcgagtgcgaagccgaga

SEQ ID NO: 597266 - DNA, 20 bp, mouse
gcggcgctgagaatccaata

SEQ ID NO: 597267 - DNA, 20 bp, mouse
gtcggtggagtggcgagatg

SEQ ID NO: 597268 - DNA, 20 bp, mouse
ggcgagatggggctcggacg

SEQ ID NO: 597269 - DNA, 20 bp, mouse
gcagcgccgccaacaggagg

SEQ ID NO: 597270 - DNA, 20 bp, mouse
gtctcagcgccgccaacagg

SEQ ID NO: 597271 - DNA, 20 bp, mouse
gatggagagccccgagatca

SEQ ID NO: 597272 - DNA, 20 bp, mouse
gtcccagcggccagaggtgg

SEQ ID NO: 597273 - DNA, 20 bp, mouse
gtcccgctagcttccagtca

SEQ ID NO: 597274 - DNA, 20 bp, mouse
gggagtggcgagatggggct

SEQ ID NO: 597275 - DNA, 20 bp, mouse
gctcccaggcgcatctcccc

SEQ ID NO: 597276 - DNA, 20 bp, mouse
ggtccgcagggtgcaagggt

SEQ ID NO: 597277 - DNA, 20 bp, mouse
ggcgccgccggagccagtga

SEQ ID NO: 597278 - DNA, 20 bp, mouse
gttctctcccgctccctcac

SEQ ID NO: 597279 - DNA, 20 bp, mouse
gagacgggcaccgggagccg

SEQ ID NO: 597280 - DNA, 20 bp, mouse
gcccgctccctcactggctc

SEQ ID NO: 597281 - DNA, 20 bp, mouse
gctccggcggcgctggagac

SEQ ID NO: 597282 - DNA, 20 bp, mouse
gcccaggcaggtgcccagag

SEQ ID NO: 597283 - DNA, 20 bp, mouse
gttgtgtccgcagggtgcaa

SEQ ID NO: 597284 - DNA, 20 bp, mouse
gacaagctgggagaacaaga

SEQ ID NO: 597285 - DNA, 20 bp, mouse
ggctgggagaacaagagggg

SEQ ID NO: 597286 - DNA, 20 bp, mouse
gccggccaagcggaaaggtg

SEQ ID NO: 597287 - DNA, 20 bp, mouse
gcttaggcagagctcacgac

SEQ ID NO: 597288 - DNA, 20 bp, mouse
ggcctccgcctgaagattag

SEQ ID NO: 597289 - DNA, 20 bp, mouse
gagcgaggacccttttcctt

SEQ ID NO: 597290 - DNA, 20 bp, mouse
gcagccccgggagacgtgaa

SEQ ID NO: 597291 - DNA, 20 bp, mouse
gcgtgaccggccaagcggaa

SEQ ID NO: 597292 - DNA, 20 bp, mouse
gtgtggaccagccatctcgg

SEQ ID NO: 597293 - DNA, 20 bp, mouse
ggagctctgcctaaggaaaa

SEQ ID NO: 597294 - DNA, 20 bp, mouse
ggcccctaatcttcaggcgg

SEQ ID NO: 597295 - DNA, 20 bp, mouse
gctgcccgcccctaatcttc

SEQ ID NO: 597296 - DNA, 20 bp, mouse
gttgggtctaggaacttgag

SEQ ID NO: 597297 - DNA, 20 bp, mouse
gctaatactcagagaagagc

SEQ ID NO: 597298 - DNA, 20 bp, mouse
ggctactgttcactaactgt

SEQ ID NO: 597299 - DNA, 20 bp, mouse
gcacagctggagacaggtta

SEQ ID NO: 597300 - DNA, 20 bp, mouse
gtcactgtagtagacagcct

SEQ ID NO: 597301 - DNA, 20 bp, mouse
gtattgcagttcttactgat

SEQ ID NO: 597302 - DNA, 20 bp, mouse
gatcaactctgtaatagagt

SEQ ID NO: 597303 - DNA, 20 bp, mouse
gctattacagagttgatgtg

SEQ ID NO: 597304 - DNA, 20 bp, mouse
gagtatggtatgttctatat

SEQ ID NO: 597305 - DNA, 20 bp, mouse
gacttccatgaatatttgaa

SEQ ID NO: 597306 - DNA, 20 bp, mouse
gagacttacctggtatatgg

SEQ ID NO: 597307 - DNA, 20 bp, mouse
gtggtcgctgggatcggatg

SEQ ID NO: 597308 - DNA, 20 bp, mouse
gatatggaggacaggtagtg

SEQ ID NO: 597309 - DNA, 20 bp, mouse
gtacctgtcctccatatacc

SEQ ID NO: 597310 - DNA, 20 bp, mouse
gaagagacttacctggtata

SEQ ID NO: 597311 - DNA, 20 bp, mouse
gccatgtaaagagacttacc

SEQ ID NO: 597312 - DNA, 20 bp, mouse
ggtagtgtggtcgctgggat

SEQ ID NO: 597313 - DNA, 20 bp, mouse
ggcagtgccataagtggcag

SEQ ID NO: 597314 - DNA, 20 bp, mouse
ggacaggtagtgtggtcgct

SEQ ID NO: 597315 - DNA, 20 bp, mouse
gtgtggtatcctcttcacac

SEQ ID NO: 597316 - DNA, 20 bp, mouse
gagggaaatccactccccat

SEQ ID NO: 597317 - DNA, 20 bp, mouse
ggattgcctgcctcacccca

SEQ ID NO: 597318 - DNA, 20 bp, mouse
gatccactccccatggggtg

SEQ ID NO: 597319 - DNA, 20 bp, mouse
gtgcctcaccccatggggag

SEQ ID NO: 597320 - DNA, 20 bp, mouse
gctggtacaggtgttgtgtc

SEQ ID NO: 597321 - DNA, 20 bp, mouse
gaggaatggaggatatcatg

SEQ ID NO: 597322 - DNA, 20 bp, mouse
gaaaaaaagaaagaataggt

SEQ ID NO: 597323 - DNA, 20 bp, mouse
gtgggattctcatcagcttg

SEQ ID NO: 597324 - DNA, 20 bp, mouse
gagctataatttgatatcca

SEQ ID NO: 597325 - DNA, 20 bp, mouse
gcaattattttgcttttccc

SEQ ID NO: 597326 - DNA, 20 bp, mouse
gagggaaatccactccccat

SEQ ID NO: 597327 - DNA, 20 bp, mouse
ggattgcctgcctcacccca

SEQ ID NO: 597328 - DNA, 20 bp, mouse
gatccactccccatggggtg

SEQ ID NO: 597329 - DNA, 20 bp, mouse
gtgcctcaccccatggggag

SEQ ID NO: 597330 - DNA, 20 bp, mouse
gctggtacaggtgttgtgtc

SEQ ID NO: 597331 - DNA, 20 bp, mouse
gaggaatggaggatatcatg

SEQ ID NO: 597332 - DNA, 20 bp, mouse
gaaaaaaagaaagaataggt

SEQ ID NO: 597333 - DNA, 20 bp, mouse
gtgggattctcatcagcttg

SEQ ID NO: 597334 - DNA, 20 bp, mouse
gagctataatttgatatcca

SEQ ID NO: 597335 - DNA, 20 bp, mouse
gcaattattttgcttttccc

SEQ ID NO: 597336 - DNA, 20 bp, mouse
gtgggtaggggagtgggcag

SEQ ID NO: 597337 - DNA, 20 bp, mouse
gggggggagggggggctttt

SEQ ID NO: 597338 - DNA, 20 bp, mouse
gaaaaaaagaaagaataggt

SEQ ID NO: 597339 - DNA, 20 bp, mouse
gaggaatggaggatatcatg

SEQ ID NO: 597340 - DNA, 20 bp, mouse
gagctataatttgatatcca

SEQ ID NO: 597341 - DNA, 20 bp, mouse
gtgggattctcatcagcttg

SEQ ID NO: 597342 - DNA, 20 bp, mouse
gcaattattttgcttttccc

SEQ ID NO: 597343 - DNA, 20 bp, mouse
gtggtctgctccggagaacc

SEQ ID NO: 597344 - DNA, 20 bp, mouse
gtcagactcaccaggttctc

SEQ ID NO: 597345 - DNA, 20 bp, mouse
ggatttcttgagttcttgag

SEQ ID NO: 597346 - DNA, 20 bp, mouse
ggtgaccacccaacaagtga

SEQ ID NO: 597347 - DNA, 20 bp, mouse
gtgggaggccttcacttgtt

SEQ ID NO: 597348 - DNA, 20 bp, mouse
gtgatggctcctcacagaaa

SEQ ID NO: 597349 - DNA, 20 bp, mouse
gtgttgctatggagtcggtg

SEQ ID NO: 597350 - DNA, 20 bp, mouse
ggagcaatgccttttctgtg

SEQ ID NO: 597351 - DNA, 20 bp, mouse
ggtatagccaggaaagcagc

SEQ ID NO: 597352 - DNA, 20 bp, mouse
gacacaggaggaggccggca

SEQ ID NO: 597353 - DNA, 20 bp, mouse
ggccacacttggggaggaca

SEQ ID NO: 597354 - DNA, 20 bp, mouse
gcaaggcccaggccacactt

SEQ ID NO: 597355 - DNA, 20 bp, mouse
gactttgggggtgggcacac

SEQ ID NO: 597356 - DNA, 20 bp, mouse
gagctgttgaaagaataggt

SEQ ID NO: 597357 - DNA, 20 bp, mouse
gtaggatattccaggtggaa

SEQ ID NO: 597358 - DNA, 20 bp, mouse
ggttgtccagccattccacc

SEQ ID NO: 597359 - DNA, 20 bp, mouse
gatattccaggtggaatggc

SEQ ID NO: 597360 - DNA, 20 bp, mouse
gtcaaatgctaggatattcc

SEQ ID NO: 597361 - DNA, 20 bp, mouse
gtgggattctcactagcttg

SEQ ID NO: 597362 - DNA, 20 bp, mouse
gcaattattttgctgttgcc

SEQ ID NO: 597363 - DNA, 20 bp, mouse
gtgagcacagtaagttcggt

SEQ ID NO: 597364 - DNA, 20 bp, mouse
gaatgctaggatattccagg

SEQ ID NO: 597365 - DNA, 20 bp, mouse
gtgtggcataagcgtttgaa

SEQ ID NO: 597366 - DNA, 20 bp, mouse
gctcaaggccgagactactt

SEQ ID NO: 597367 - DNA, 20 bp, mouse
gtgcagactcctggtactca

SEQ ID NO: 597368 - DNA, 20 bp, mouse
ggggttctccaaagtagtct

SEQ ID NO: 597369 - DNA, 20 bp, mouse
ggtgctgtagtgacatttga

SEQ ID NO: 597370 - DNA, 20 bp, mouse
gcaaactgctggaatgatgt

SEQ ID NO: 597371 - DNA, 20 bp, mouse
gttcaagacaggcagtctca

SEQ ID NO: 597372 - DNA, 20 bp, mouse
gctacaagctattgaatgta

SEQ ID NO: 597373 - DNA, 20 bp, mouse
gccagcctcagacaaactgc

SEQ ID NO: 597374 - DNA, 20 bp, mouse
gaagtaatgctgttcacaca

SEQ ID NO: 597375 - DNA, 20 bp, mouse
gaatagtttcccttaagaaa

SEQ ID NO: 597376 - DNA, 20 bp, mouse
gctcctggtactcaggtcct

SEQ ID NO: 597377 - DNA, 20 bp, mouse
gctcaggtcctaggctactt

SEQ ID NO: 597378 - DNA, 20 bp, mouse
gaggttctccaaagtagcct

SEQ ID NO: 597379 - DNA, 20 bp, mouse
gggcaggcagtctcaagtac

SEQ ID NO: 597380 - DNA, 20 bp, mouse
gaggcagtctcaagtactgg

SEQ ID NO: 597381 - DNA, 20 bp, mouse
gaaaggctatgtacctaagt

SEQ ID NO: 597382 - DNA, 20 bp, mouse
gttggtaagttgtagaacag

SEQ ID NO: 597383 - DNA, 20 bp, mouse
gcaggttctcatacctactt

SEQ ID NO: 597384 - DNA, 20 bp, mouse
ggcagtcagaaaattagcag

SEQ ID NO: 597385 - DNA, 20 bp, mouse
gaatagccaattgtgataag

SEQ ID NO: 597386 - DNA, 20 bp, mouse
gcacacgtcctggaatactt

SEQ ID NO: 597387 - DNA, 20 bp, mouse
gactcctggtacacacgtcc

SEQ ID NO: 597388 - DNA, 20 bp, mouse
gaggttctccaaagtattcc

SEQ ID NO: 597389 - DNA, 20 bp, mouse
ggtctgcagtcagtcagcca

SEQ ID NO: 597390 - DNA, 20 bp, mouse
gtacaagtaacgaaatatat

SEQ ID NO: 597391 - DNA, 20 bp, mouse
gaatcctgtcaggtcatctg

SEQ ID NO: 597392 - DNA, 20 bp, mouse
gattccaggacgtgtgtacc

SEQ ID NO: 597393 - DNA, 20 bp, mouse
gtactacctgctgaggtata

SEQ ID NO: 597394 - DNA, 20 bp, mouse
gaatagtgatttgtgatgag

SEQ ID NO: 597395 - DNA, 20 bp, mouse
gcaaccacctaccaagtaaa

SEQ ID NO: 597396 - DNA, 20 bp, mouse
gctcaggtcctacactacgt

SEQ ID NO: 597397 - DNA, 20 bp, mouse
gagcttctccaacgtagtgt

SEQ ID NO: 597398 - DNA, 20 bp, mouse
gctggatgactgcagaatcc

SEQ ID NO: 597399 - DNA, 20 bp, mouse
gggatgatacaggtaatgat

SEQ ID NO: 597400 - DNA, 20 bp, mouse
gaagcacctactaaatgaaa

SEQ ID NO: 597401 - DNA, 20 bp, mouse
gcacttgtcacagtggtatg

SEQ ID NO: 597402 - DNA, 20 bp, mouse
gctacatcacatagaagacc

SEQ ID NO: 597403 - DNA, 20 bp, mouse
gcatcccaacaagctatctg

SEQ ID NO: 597404 - DNA, 20 bp, mouse
gttctgcagtcatccagcca

SEQ ID NO: 597405 - DNA, 20 bp, mouse
gtacaggtaatgatgggtac

SEQ ID NO: 597406 - DNA, 20 bp, mouse
ggtactcaagctctggacta

SEQ ID NO: 597407 - DNA, 20 bp, mouse
gagcagtacaggtcaccatg

SEQ ID NO: 597408 - DNA, 20 bp, mouse
ggcataagcacaaatcaatt

SEQ ID NO: 597409 - DNA, 20 bp, mouse
gatgcccatatggaaaatca

SEQ ID NO: 597410 - DNA, 20 bp, mouse
gtgagcaagtgtaaaatgtt

SEQ ID NO: 597411 - DNA, 20 bp, mouse
gatgccctctcttgatatac

SEQ ID NO: 597412 - DNA, 20 bp, mouse
gaatgcctgtatatcaagag

SEQ ID NO: 597413 - DNA, 20 bp, mouse
gtttacacttgctcagagtt

SEQ ID NO: 597414 - DNA, 20 bp, mouse
gaaaatcacggcaatcagaa

SEQ ID NO: 597415 - DNA, 20 bp, mouse
gaaaaatgttagctactgac

SEQ ID NO: 597416 - DNA, 20 bp, mouse
gtagactacttcggagaagt

SEQ ID NO: 597417 - DNA, 20 bp, mouse
gttcaagttctagactactt

SEQ ID NO: 597418 - DNA, 20 bp, mouse
gagtctagaacttgaatacc

SEQ ID NO: 597419 - DNA, 20 bp, mouse
gtgagtgttgtttcttgatt

SEQ ID NO: 597420 - DNA, 20 bp, mouse
ggtcaagctctggtgccctg

SEQ ID NO: 597421 - DNA, 20 bp, mouse
ggacagctaaggaaaatctc

SEQ ID NO: 597422 - DNA, 20 bp, mouse
gaagataggcagtcaagctc

SEQ ID NO: 597423 - DNA, 20 bp, mouse
ggcagtcagaaatttagcaa

SEQ ID NO: 597424 - DNA, 20 bp, mouse
gaaagcaacactttcaagat

SEQ ID NO: 597425 - DNA, 20 bp, mouse
gttgatttggtctgtcttaa

SEQ ID NO: 597426 - DNA, 20 bp, mouse
gtctataaagttctataaag

SEQ ID NO: 597427 - DNA, 20 bp, mouse
gcatcccagaaggttatctg

SEQ ID NO: 597428 - DNA, 20 bp, mouse
gaatttctctaaagtagatc

SEQ ID NO: 597429 - DNA, 20 bp, mouse
gatacaaagcgatgcagcca

SEQ ID NO: 597430 - DNA, 20 bp, mouse
gtacatgtgaggaaaatccc

SEQ ID NO: 597431 - DNA, 20 bp, mouse
gtgaccccagataaccttct

SEQ ID NO: 597432 - DNA, 20 bp, mouse
gcaggttctaatatctgcta

SEQ ID NO: 597433 - DNA, 20 bp, mouse
gttatgtcattactttactt

SEQ ID NO: 597434 - DNA, 20 bp, mouse
gtctctttcatatacattta

SEQ ID NO: 597435 - DNA, 20 bp, mouse
ggatgatatagttaataaaa

SEQ ID NO: 597436 - DNA, 20 bp, mouse
gccttggactacagagaacc

SEQ ID NO: 597437 - DNA, 20 bp, mouse
gtcagactgtcagacttacc

SEQ ID NO: 597438 - DNA, 20 bp, mouse
gataccaagacaatagggaa

SEQ ID NO: 597439 - DNA, 20 bp, mouse
gacacttggtactcaagcct

SEQ ID NO: 597440 - DNA, 20 bp, mouse
gtgaatgagtgcaacacact

SEQ ID NO: 597441 - DNA, 20 bp, mouse
gcaacccttccctattgtct

SEQ ID NO: 597442 - DNA, 20 bp, mouse
ggctagtcgtgaaaaaaaat

SEQ ID NO: 597443 - DNA, 20 bp, mouse
gttaatccatgataccaatt

SEQ ID NO: 597444 - DNA, 20 bp, mouse
gatagaaataccaagacaat

SEQ ID NO: 597445 - DNA, 20 bp, mouse
gatagggaagggttgctttg

SEQ ID NO: 597446 - DNA, 20 bp, mouse
gcagtgatcttcagcatcta

SEQ ID NO: 597447 - DNA, 20 bp, mouse
gacggtgagacatcacatca

SEQ ID NO: 597448 - DNA, 20 bp, mouse
gttatgctaacataaagtca

SEQ ID NO: 597449 - DNA, 20 bp, mouse
gataaggctaagggtcagaa

SEQ ID NO: 597450 - DNA, 20 bp, mouse
gcagtctgtgttgtttgtcg

SEQ ID NO: 597451 - DNA, 20 bp, mouse
gattatagctataaggctaa

SEQ ID NO: 597452 - DNA, 20 bp, mouse
gtgtgttgtttgtcgtggtt

SEQ ID NO: 597453 - DNA, 20 bp, mouse
gctgaagatcactgggttct

SEQ ID NO: 597454 - DNA, 20 bp, mouse
gttctcaaattatagctata

SEQ ID NO: 597455 - DNA, 20 bp, mouse
gctgttagaaagttctaaat

SEQ ID NO: 597456 - DNA, 20 bp, mouse
gtggtaggaggtggctgaca

SEQ ID NO: 597457 - DNA, 20 bp, mouse
gagcagaagtaaggatagac

SEQ ID NO: 597458 - DNA, 20 bp, mouse
gtcgtgtggtgagaagcagg

SEQ ID NO: 597459 - DNA, 20 bp, mouse
gagaagccttggagtaacaa

SEQ ID NO: 597460 - DNA, 20 bp, mouse
gcatgtttcaggaacagatg

SEQ ID NO: 597461 - DNA, 20 bp, mouse
gcaagggtgcatgtaatgag

SEQ ID NO: 597462 - DNA, 20 bp, mouse
gtgctgattctgatgctgat

SEQ ID NO: 597463 - DNA, 20 bp, mouse
gcctcttgacatttggtagg

SEQ ID NO: 597464 - DNA, 20 bp, mouse
gtcgtcgtgtggtgagaagc

SEQ ID NO: 597465 - DNA, 20 bp, mouse
gactcagaacacaacagggt

SEQ ID NO: 597466 - DNA, 20 bp, mouse
ggtgtgtcgccggacctcag

SEQ ID NO: 597467 - DNA, 20 bp, mouse
gcggaagtcagaggagggtc

SEQ ID NO: 597468 - DNA, 20 bp, mouse
gtgtctcctgacagccgctg

SEQ ID NO: 597469 - DNA, 20 bp, mouse
gcggcgacacacgtcaagtc

SEQ ID NO: 597470 - DNA, 20 bp, mouse
ggacgccggtcgggctcgtg

SEQ ID NO: 597471 - DNA, 20 bp, mouse
gcgctcccaagacgccggtc

SEQ ID NO: 597472 - DNA, 20 bp, mouse
ggtgcgcggacgagccagca

SEQ ID NO: 597473 - DNA, 20 bp, mouse
ggaacgctgggctcgggctg

SEQ ID NO: 597474 - DNA, 20 bp, mouse
gcgtcaagtctggtccgtgc

SEQ ID NO: 597475 - DNA, 20 bp, mouse
gtgcgccgcacgagcccgac

SEQ ID NO: 597476 - DNA, 20 bp, mouse
gagctctgcgggctaaggag

SEQ ID NO: 597477 - DNA, 20 bp, mouse
ggctaaggagcggctgcgag

SEQ ID NO: 597478 - DNA, 20 bp, mouse
ggccagagctctgcgggcta

SEQ ID NO: 597479 - DNA, 20 bp, mouse
ggcccgcagagctctggctg

SEQ ID NO: 597480 - DNA, 20 bp, mouse
gagcctggggccggccctcc

SEQ ID NO: 597481 - DNA, 20 bp, mouse
gagcacgcaggggtttgcgg

SEQ ID NO: 597482 - DNA, 20 bp, mouse
gcggcgtgcatgtgccggga

SEQ ID NO: 597483 - DNA, 20 bp, mouse
gcggcgacgctgaaatgctg

SEQ ID NO: 597484 - DNA, 20 bp, mouse
gggacgggaaaagtcaggtc

SEQ ID NO: 597485 - DNA, 20 bp, mouse
ggggccgaccgcaaagcgcc

SEQ ID NO: 597486 - DNA, 20 bp, mouse
gcgcagcgccagcggaggag

SEQ ID NO: 597487 - DNA, 20 bp, mouse
gagcggaggagaggggccgg

SEQ ID NO: 597488 - DNA, 20 bp, mouse
gcggggctgctcccaagtgg

SEQ ID NO: 597489 - DNA, 20 bp, mouse
ggaggccgaagcggcaacgt

SEQ ID NO: 597490 - DNA, 20 bp, mouse
ggctctcgctcgtgcagact

SEQ ID NO: 597491 - DNA, 20 bp, mouse
gaatgaacaagaggccgaag

SEQ ID NO: 597492 - DNA, 20 bp, mouse
ggttccaacggtggaggact

SEQ ID NO: 597493 - DNA, 20 bp, mouse
gtcgtgcagactgggcgttg

SEQ ID NO: 597494 - DNA, 20 bp, mouse
gtgcagactgggcgttgcgg

SEQ ID NO: 597495 - DNA, 20 bp, mouse
ggaatccgggagggttccaa

SEQ ID NO: 597496 - DNA, 20 bp, mouse
gagtcgcagacgtcagtcgg

SEQ ID NO: 597497 - DNA, 20 bp, mouse
gggttgcaacatcgccgctg

SEQ ID NO: 597498 - DNA, 20 bp, mouse
ggctctgttcgctgcctcag

SEQ ID NO: 597499 - DNA, 20 bp, mouse
gccgaggaggcgcagaccga

SEQ ID NO: 597500 - DNA, 20 bp, mouse
gcccgaggggagccgcgtca

SEQ ID NO: 597501 - DNA, 20 bp, mouse
ggcgaacagagctgacagcg

SEQ ID NO: 597502 - DNA, 20 bp, mouse
ggccgcgtcacggtatcgag

SEQ ID NO: 597503 - DNA, 20 bp, mouse
ggaggcgcagaccgagggaa

SEQ ID NO: 597504 - DNA, 20 bp, mouse
gtaccgcaagggacccgagg

SEQ ID NO: 597505 - DNA, 20 bp, mouse
gagacgtcagtcggaggagc

SEQ ID NO: 597506 - DNA, 20 bp, mouse
gcggccgaagagctacaacg

SEQ ID NO: 597507 - DNA, 20 bp, mouse
gcctatggatgaggaggacg

SEQ ID NO: 597508 - DNA, 20 bp, mouse
ggctacaacgcggagctgag

SEQ ID NO: 597509 - DNA, 20 bp, mouse
ggctgagaggcctatggatg

SEQ ID NO: 597510 - DNA, 20 bp, mouse
gcccggtaggcggggatcgg

SEQ ID NO: 597511 - DNA, 20 bp, mouse
ggcctgacggagcagaggaa

SEQ ID NO: 597512 - DNA, 20 bp, mouse
ggccagggcctgtgacgacg

SEQ ID NO: 597513 - DNA, 20 bp, mouse
ggcggggacccggatgtgtg

SEQ ID NO: 597514 - DNA, 20 bp, mouse
ggctccgcgttgtagctctt

SEQ ID NO: 597515 - DNA, 20 bp, mouse
ggacggagcagaggaagggc

SEQ ID NO: 597516 - DNA, 20 bp, mouse
gggcgtgccccgtgcatctg

SEQ ID NO: 597517 - DNA, 20 bp, mouse
ggttggaagttgtaccgctg

SEQ ID NO: 597518 - DNA, 20 bp, mouse
gctgctgtggaatcccggag

SEQ ID NO: 597519 - DNA, 20 bp, mouse
gtggggcaccaagcgatggg

SEQ ID NO: 597520 - DNA, 20 bp, mouse
gtgtggaatcccggagaggt

SEQ ID NO: 597521 - DNA, 20 bp, mouse
gacttccaacagcgtgcaaa

SEQ ID NO: 597522 - DNA, 20 bp, mouse
gccgctggggcaccaagcga

SEQ ID NO: 597523 - DNA, 20 bp, mouse
ggcagggaccccccatcgct

SEQ ID NO: 597524 - DNA, 20 bp, mouse
ggctgccctttgcacgctgt

SEQ ID NO: 597525 - DNA, 20 bp, mouse
gttggaatcttgctagatca

SEQ ID NO: 597526 - DNA, 20 bp, mouse
gccagggccgggaggcgaag

SEQ ID NO: 597527 - DNA, 20 bp, mouse
gcccgcgcccgagtgcttct

SEQ ID NO: 597528 - DNA, 20 bp, mouse
gagactgaggcgaggtcccc

SEQ ID NO: 597529 - DNA, 20 bp, mouse
gcgcacagcgacgccagggc

SEQ ID NO: 597530 - DNA, 20 bp, mouse
gagcccgcacagcgacgcca

SEQ ID NO: 597531 - DNA, 20 bp, mouse
gccgagggccgagggaaatg

SEQ ID NO: 597532 - DNA, 20 bp, mouse
gggacccaaccgcccaccga

SEQ ID NO: 597533 - DNA, 20 bp, mouse
gagttggacacgcagcacat

SEQ ID NO: 597534 - DNA, 20 bp, mouse
gtgggcggttgggtccagtc

SEQ ID NO: 597535 - DNA, 20 bp, mouse
gcccgagtgcttctgggtcg

SEQ ID NO: 597536 - DNA, 20 bp, mouse
gcagagcgtgggcatagggt

SEQ ID NO: 597537 - DNA, 20 bp, mouse
gcgcaggagtcgcgctcgag

SEQ ID NO: 597538 - DNA, 20 bp, mouse
gcaccgaagaccggttgggt

SEQ ID NO: 597539 - DNA, 20 bp, mouse
gcccaccttagagctgtcgg

SEQ ID NO: 597540 - DNA, 20 bp, mouse
gcattgggtggggacctcag

SEQ ID NO: 597541 - DNA, 20 bp, mouse
gaggaaccagctccaggcgc

SEQ ID NO: 597542 - DNA, 20 bp, mouse
ggttcctgcagcaagcgcgc

SEQ ID NO: 597543 - DNA, 20 bp, mouse
gagagcctccgcagcagaag

SEQ ID NO: 597544 - DNA, 20 bp, mouse
ggaagcggcagcgcactggg

SEQ ID NO: 597545 - DNA, 20 bp, mouse
gtggccccggcgccagcgcc

SEQ ID NO: 597546 - DNA, 20 bp, mouse
ggaggtctctgcgagctagg

SEQ ID NO: 597547 - DNA, 20 bp, mouse
gggaagcagtggctggtcag

SEQ ID NO: 597548 - DNA, 20 bp, mouse
ggggatggttaggggaccaa

SEQ ID NO: 597549 - DNA, 20 bp, mouse
gctagggggacagtgaggtg

SEQ ID NO: 597550 - DNA, 20 bp, mouse
gcaggctggttggcatacac

SEQ ID NO: 597551 - DNA, 20 bp, mouse
gaagggaagaccaggctggt

SEQ ID NO: 597552 - DNA, 20 bp, mouse
ggttagagccagcaagggga

SEQ ID NO: 597553 - DNA, 20 bp, mouse
gaggggaccaagggaagacc

SEQ ID NO: 597554 - DNA, 20 bp, mouse
gcatacaccggtgaacggat

SEQ ID NO: 597555 - DNA, 20 bp, mouse
gtgaacggatgggagtccta

SEQ ID NO: 597556 - DNA, 20 bp, mouse
ggaaagtgggtcagcgccgg

SEQ ID NO: 597557 - DNA, 20 bp, mouse
gcgcggccggaacggaaagt

SEQ ID NO: 597558 - DNA, 20 bp, mouse
gaggttgcttccctcgccaa

SEQ ID NO: 597559 - DNA, 20 bp, mouse
gctacgtccagggacatctc

SEQ ID NO: 597560 - DNA, 20 bp, mouse
ggtcagggacggcatcgctg

SEQ ID NO: 597561 - DNA, 20 bp, mouse
gtgcggccaaaaagctcccc

SEQ ID NO: 597562 - DNA, 20 bp, mouse
gaccgccagggaacaacggg

SEQ ID NO: 597563 - DNA, 20 bp, mouse
gggccggcgcggctcacctg

SEQ ID NO: 597564 - DNA, 20 bp, mouse
ggcctcggagtcaggcgtca

SEQ ID NO: 597565 - DNA, 20 bp, mouse
gccggccgccgggcctgacc

SEQ ID NO: 597566 - DNA, 20 bp, mouse
gcgctcattgccttccccag

SEQ ID NO: 597567 - DNA, 20 bp, mouse
gcggcgcgcccggcgcacaa

SEQ ID NO: 597568 - DNA, 20 bp, mouse
gccgggcgcgccgaccgcca

SEQ ID NO: 597569 - DNA, 20 bp, mouse
gcagagctggccctggcggt

SEQ ID NO: 597570 - DNA, 20 bp, mouse
gtcccgcgctcagggcacac

SEQ ID NO: 597571 - DNA, 20 bp, mouse
gggcaccctgcggagcgaga

SEQ ID NO: 597572 - DNA, 20 bp, mouse
gcgagcggccgtggaggagg

SEQ ID NO: 597573 - DNA, 20 bp, mouse
gtttagggccatcagggcaa

SEQ ID NO: 597574 - DNA, 20 bp, mouse
gcctctcgacttgtatccgg

SEQ ID NO: 597575 - DNA, 20 bp, mouse
gagggctgcagtggtggcca

SEQ ID NO: 597576 - DNA, 20 bp, mouse
ggtaccaggtactagataag

SEQ ID NO: 597577 - DNA, 20 bp, mouse
gtaaaaaatgagatagtacc

SEQ ID NO: 597578 - DNA, 20 bp, mouse
gacatattgttatgcatgtg

SEQ ID NO: 597579 - DNA, 20 bp, mouse
gcttgtcaccatgaagttcc

SEQ ID NO: 597580 - DNA, 20 bp, mouse
gtgtgtgtgtatctgccata

SEQ ID NO: 597581 - DNA, 20 bp, mouse
gtaagtattttcatgtatta

SEQ ID NO: 597582 - DNA, 20 bp, mouse
gcttccttgtctcctggtat

SEQ ID NO: 597583 - DNA, 20 bp, mouse
gtatctgccatatggtgtca

SEQ ID NO: 597584 - DNA, 20 bp, mouse
ggagctgatcccatagttga

SEQ ID NO: 597585 - DNA, 20 bp, mouse
gtattgttatgcatgtgagg

SEQ ID NO: 597586 - DNA, 20 bp, mouse
gtgtccagtccacttcaaat

SEQ ID NO: 597587 - DNA, 20 bp, mouse
ggatggaatggaaggctcag

SEQ ID NO: 597588 - DNA, 20 bp, mouse
gattcctatttgaagtggac

SEQ ID NO: 597589 - DNA, 20 bp, mouse
ggcagagatggaaactccaa

SEQ ID NO: 597590 - DNA, 20 bp, mouse
gagatattcagaaaactact

SEQ ID NO: 597591 - DNA, 20 bp, mouse
gtctcattcctgatgaagtt

SEQ ID NO: 597592 - DNA, 20 bp, mouse
gtttaacgaccctgtgagga

SEQ ID NO: 597593 - DNA, 20 bp, mouse
gcaagagcacaatttttagt

SEQ ID NO: 597594 - DNA, 20 bp, mouse
gaagctttcctaacttcatc

SEQ ID NO: 597595 - DNA, 20 bp, mouse
ggattttaattcttttatga

SEQ ID NO: 597596 - DNA, 20 bp, mouse
gagcgaacggcgtgaggcag

SEQ ID NO: 597597 - DNA, 20 bp, mouse
gctatccgctgcggagcgaa

SEQ ID NO: 597598 - DNA, 20 bp, mouse
ggctccgcagcggatagtga

SEQ ID NO: 597599 - DNA, 20 bp, mouse
gctgcggagcgaacggcgtg

SEQ ID NO: 597600 - DNA, 20 bp, mouse
gccgcagcggatagtgacgg

SEQ ID NO: 597601 - DNA, 20 bp, mouse
ggcccacgcgccacaaaagg

SEQ ID NO: 597602 - DNA, 20 bp, mouse
gtcctcagcagccctcagcg

SEQ ID NO: 597603 - DNA, 20 bp, mouse
gcccaggagccggtaagaaa

SEQ ID NO: 597604 - DNA, 20 bp, mouse
gaccggctcctgggggtgag

SEQ ID NO: 597605 - DNA, 20 bp, mouse
ggcagacaggaggctccgag

SEQ ID NO: 597606 - DNA, 20 bp, mouse
gtgcgctggggctgaagcgg

SEQ ID NO: 597607 - DNA, 20 bp, mouse
gagggggaggagggcagcac

SEQ ID NO: 597608 - DNA, 20 bp, mouse
gtcccaggcgagggtcctgg

SEQ ID NO: 597609 - DNA, 20 bp, mouse
gccgggtgcctagcacgggg

SEQ ID NO: 597610 - DNA, 20 bp, mouse
ggcctagcacggggcgggag

SEQ ID NO: 597611 - DNA, 20 bp, mouse
gagcgcaggtgagtccccga

SEQ ID NO: 597612 - DNA, 20 bp, mouse
gcggcggctaccccgagccc

SEQ ID NO: 597613 - DNA, 20 bp, mouse
ggcccggcggccactgtgcc

SEQ ID NO: 597614 - DNA, 20 bp, mouse
gtgacgcgacagcccggtgg

SEQ ID NO: 597615 - DNA, 20 bp, mouse
gatatctctgggcgggtccg

SEQ ID NO: 597616 - DNA, 20 bp, mouse
gctcgctccgggcagagagg

SEQ ID NO: 597617 - DNA, 20 bp, mouse
gctcacaggacgggaccagt

SEQ ID NO: 597618 - DNA, 20 bp, mouse
ggcgctcgctccgggcagag

SEQ ID NO: 597619 - DNA, 20 bp, mouse
gccgggcagagaggcggccg

SEQ ID NO: 597620 - DNA, 20 bp, mouse
gcaggcagccccgggtgagt

SEQ ID NO: 597621 - DNA, 20 bp, mouse
gcggccgggggagggactgg

SEQ ID NO: 597622 - DNA, 20 bp, mouse
ggaggatgccaactcacccg

SEQ ID NO: 597623 - DNA, 20 bp, mouse
gcagagaggcggccggggga

SEQ ID NO: 597624 - DNA, 20 bp, mouse
gggaggtaggtcaagggccg

SEQ ID NO: 597625 - DNA, 20 bp, mouse
ggacttcgcagggctgtcgg

SEQ ID NO: 597626 - DNA, 20 bp, mouse
ggctgctatctgcctaggag

SEQ ID NO: 597627 - DNA, 20 bp, mouse
gggtgagctgctatctgcct

SEQ ID NO: 597628 - DNA, 20 bp, mouse
gacagagtgggtgctagcag

SEQ ID NO: 597629 - DNA, 20 bp, mouse
gcagcctacctgccagaagg

SEQ ID NO: 597630 - DNA, 20 bp, mouse
gctatctgcctaggagagga

SEQ ID NO: 597631 - DNA, 20 bp, mouse
gctcggaaccgtcatcacag

SEQ ID NO: 597632 - DNA, 20 bp, mouse
gggtttaatggcattaacca

SEQ ID NO: 597633 - DNA, 20 bp, mouse
ggcctggaggtgccccaaaa

SEQ ID NO: 597634 - DNA, 20 bp, mouse
gtgagtggtctacggtttaa

SEQ ID NO: 597635 - DNA, 20 bp, mouse
gtgaggagccgctgtgatga

SEQ ID NO: 597636 - DNA, 20 bp, mouse
gcgacgaacgcccgcaggga

SEQ ID NO: 597637 - DNA, 20 bp, mouse
gcacggtgactggaccacag

SEQ ID NO: 597638 - DNA, 20 bp, mouse
gcgaacgcccgcagggaggg

SEQ ID NO: 597639 - DNA, 20 bp, mouse
gcaggggcccggtgtgtgag

SEQ ID NO: 597640 - DNA, 20 bp, mouse
gaacagagccgggcccggcc

SEQ ID NO: 597641 - DNA, 20 bp, mouse
gcgcccgcgctgtcacacac

SEQ ID NO: 597642 - DNA, 20 bp, mouse
gcggccggcgcccaggtgag

SEQ ID NO: 597643 - DNA, 20 bp, mouse
gcgcagcaccgccctccctg

SEQ ID NO: 597644 - DNA, 20 bp, mouse
gcgagcatccgggaccgcat

SEQ ID NO: 597645 - DNA, 20 bp, mouse
gtgacccacgcctggttcag

SEQ ID NO: 597646 - DNA, 20 bp, mouse
gtggatgatgcccacatcaa

SEQ ID NO: 597647 - DNA, 20 bp, mouse
gagcggctcagggagaaggt

SEQ ID NO: 597648 - DNA, 20 bp, mouse
gcactgcagctcaagaacca

SEQ ID NO: 597649 - DNA, 20 bp, mouse
gtgccgctggcagatggtct

SEQ ID NO: 597650 - DNA, 20 bp, mouse
ggatggtctcggattcctca

SEQ ID NO: 597651 - DNA, 20 bp, mouse
gccttccctataggtcacag

SEQ ID NO: 597652 - DNA, 20 bp, mouse
gatccgagaccatctgccag

SEQ ID NO: 597653 - DNA, 20 bp, mouse
gtcaggtggaagactttcca

SEQ ID NO: 597654 - DNA, 20 bp, mouse
gtcatccactgtgacctata

SEQ ID NO: 597655 - DNA, 20 bp, mouse
ggacaatctatgtatctcca

SEQ ID NO: 597656 - DNA, 20 bp, mouse
gtgcctgaccatggcgacag

SEQ ID NO: 597657 - DNA, 20 bp, mouse
ggaagtcggctgcctgacca

SEQ ID NO: 597658 - DNA, 20 bp, mouse
gggctcgcgggaggctccgg

SEQ ID NO: 597659 - DNA, 20 bp, mouse
gtgtcctcggcacccctccc

SEQ ID NO: 597660 - DNA, 20 bp, mouse
gtgctccgccactgtcgcca

SEQ ID NO: 597661 - DNA, 20 bp, mouse
gtcttgggaaagcagctcct

SEQ ID NO: 597662 - DNA, 20 bp, mouse
gatggtgcaggcgctgtacg

SEQ ID NO: 597663 - DNA, 20 bp, mouse
gtacgaggtgcgttcgccac

SEQ ID NO: 597664 - DNA, 20 bp, mouse
gcaggcagccgacttccggc

SEQ ID NO: 597665 - DNA, 20 bp, mouse
ggtggcggagcagtgggtgc

SEQ ID NO: 597666 - DNA, 20 bp, mouse
gcagcacccggcagcaggac

SEQ ID NO: 597667 - DNA, 20 bp, mouse
ggcatcctcccggcagcacc

SEQ ID NO: 597668 - DNA, 20 bp, mouse
ggagcgggagggagactcaa

SEQ ID NO: 597669 - DNA, 20 bp, mouse
gcaggctctggaggtggcgg

SEQ ID NO: 597670 - DNA, 20 bp, mouse
gcaggtacgatgggatcgag

SEQ ID NO: 597671 - DNA, 20 bp, mouse
ggctgccgggtgctgccggg

SEQ ID NO: 597672 - DNA, 20 bp, mouse
ggagaggctgggcgagatcg

SEQ ID NO: 597673 - DNA, 20 bp, mouse
gagcagcagcctccgggctc

SEQ ID NO: 597674 - DNA, 20 bp, mouse
gtgcggtgcggagcgggagt

SEQ ID NO: 597675 - DNA, 20 bp, mouse
ggccgttcgcccgcatcggg

SEQ ID NO: 597676 - DNA, 20 bp, mouse
ggttcagattggccattggt

SEQ ID NO: 597677 - DNA, 20 bp, mouse
gctccagcacatccgaccaa

SEQ ID NO: 597678 - DNA, 20 bp, mouse
ggcagaaagcgaacctgcct

SEQ ID NO: 597679 - DNA, 20 bp, mouse
gaatgacataaagcactgta

SEQ ID NO: 597680 - DNA, 20 bp, mouse
gacagtgctgcaaagaaata

SEQ ID NO: 597681 - DNA, 20 bp, mouse
gtgtcgttcagattggccat

SEQ ID NO: 597682 - DNA, 20 bp, mouse
ggagtcacaagatcctagtg

SEQ ID NO: 597683 - DNA, 20 bp, mouse
gactggagtagactagtaaa

SEQ ID NO: 597684 - DNA, 20 bp, mouse
gacagcactgtcgttcagat

SEQ ID NO: 597685 - DNA, 20 bp, mouse
gggccattggtcggatgtgc

SEQ ID NO: 597686 - DNA, 20 bp, mouse
ggcctgacgctgctacaccg

SEQ ID NO: 597687 - DNA, 20 bp, mouse
gaccgcgggaggcgcatggc

SEQ ID NO: 597688 - DNA, 20 bp, mouse
gaggtactggtagtagaacc

SEQ ID NO: 597689 - DNA, 20 bp, mouse
ggacgctgctacaccgcggg

SEQ ID NO: 597690 - DNA, 20 bp, mouse
gtacaagacccggatctccg

SEQ ID NO: 597691 - DNA, 20 bp, mouse
ggcccgccatgcgcctcccg

SEQ ID NO: 597692 - DNA, 20 bp, mouse
gcgcatggcgggcatggcgc

SEQ ID NO: 597693 - DNA, 20 bp, mouse
gcgcgcgccgggttggaagg

SEQ ID NO: 597694 - DNA, 20 bp, mouse
gattcccctgcccaaggtgg

SEQ ID NO: 597695 - DNA, 20 bp, mouse
gggtggaaccgcggagatcc

SEQ ID NO: 597696 - DNA, 20 bp, mouse
ggacaagctaacagaagctg

SEQ ID NO: 597697 - DNA, 20 bp, mouse
gaagctcattctaaggcagg

SEQ ID NO: 597698 - DNA, 20 bp, mouse
gctccttttagattggacgt

SEQ ID NO: 597699 - DNA, 20 bp, mouse
gagctgaggctcccagagtt

SEQ ID NO: 597700 - DNA, 20 bp, mouse
gagaattgaacggttcctct

SEQ ID NO: 597701 - DNA, 20 bp, mouse
gactgtgttgggcgcagctg

SEQ ID NO: 597702 - DNA, 20 bp, mouse
gtctaagctcattctaaggc

SEQ ID NO: 597703 - DNA, 20 bp, mouse
gtacctacgtccaatctaaa

SEQ ID NO: 597704 - DNA, 20 bp, mouse
gtgttagcttgtcactgtgt

SEQ ID NO: 597705 - DNA, 20 bp, mouse
gactttaggcagtggcacac

SEQ ID NO: 597706 - DNA, 20 bp, mouse
gggcgagagaagggccacca

SEQ ID NO: 597707 - DNA, 20 bp, mouse
gccggggactcgggacgcgg

SEQ ID NO: 597708 - DNA, 20 bp, mouse
ggagcctaagcgctactgac

SEQ ID NO: 597709 - DNA, 20 bp, mouse
gcgaagagaaaagcccggct

SEQ ID NO: 597710 - DNA, 20 bp, mouse
gaagccagtcagtagcgctt

SEQ ID NO: 597711 - DNA, 20 bp, mouse
gtggtgggtggaacttctcg

SEQ ID NO: 597712 - DNA, 20 bp, mouse
gaagtgtcggtgtcgagggg

SEQ ID NO: 597713 - DNA, 20 bp, mouse
gcggaagtgtcggtgtcgag

SEQ ID NO: 597714 - DNA, 20 bp, mouse
ggaaaagcccggctgggccg

SEQ ID NO: 597715 - DNA, 20 bp, mouse
gcgtagttcaggctttcccg

SEQ ID NO: 597716 - DNA, 20 bp, mouse
gtaccagaagcctagcagaa

SEQ ID NO: 597717 - DNA, 20 bp, mouse
gttacatctcagacagccca

SEQ ID NO: 597718 - DNA, 20 bp, mouse
gggtcctcaggtcccaatgt

SEQ ID NO: 597719 - DNA, 20 bp, mouse
gtaggagatggacaccgggc

SEQ ID NO: 597720 - DNA, 20 bp, mouse
gcggtggaggagatggaacc

SEQ ID NO: 597721 - DNA, 20 bp, mouse
gtggtgatcccagagttcgg

SEQ ID NO: 597722 - DNA, 20 bp, mouse
gctgctctccctggactctc

SEQ ID NO: 597723 - DNA, 20 bp, mouse
ggtctcctgggagtcggtgg

SEQ ID NO: 597724 - DNA, 20 bp, mouse
ggggttaggagatggacacc

SEQ ID NO: 597725 - DNA, 20 bp, mouse
ggagcagatggcagtctcct

SEQ ID NO: 597726 - DNA, 20 bp, mouse
ggggtccccagcatccctcg

SEQ ID NO: 597727 - DNA, 20 bp, mouse
ggggcgcgcagcggttactc

SEQ ID NO: 597728 - DNA, 20 bp, mouse
gctgtccgcgagggatgctg

SEQ ID NO: 597729 - DNA, 20 bp, mouse
gaggaggaatctccaaggga

SEQ ID NO: 597730 - DNA, 20 bp, mouse
gctgggccgagcccgccggg

SEQ ID NO: 597731 - DNA, 20 bp, mouse
gcttgaggaggaatctccaa

SEQ ID NO: 597732 - DNA, 20 bp, mouse
gccgggcggctgaagcgcgt

SEQ ID NO: 597733 - DNA, 20 bp, mouse
gtctcgaggaaggcaagtgt

SEQ ID NO: 597734 - DNA, 20 bp, mouse
ggcccagcccagggaccggg

SEQ ID NO: 597735 - DNA, 20 bp, mouse
gcgggagcgtagaaggatct

SEQ ID NO: 597736 - DNA, 20 bp, mouse
gggagggtaacagcgtcgtg

SEQ ID NO: 597737 - DNA, 20 bp, mouse
gacagcgagcggctatagga

SEQ ID NO: 597738 - DNA, 20 bp, mouse
gggcgcagcagaaactactg

SEQ ID NO: 597739 - DNA, 20 bp, mouse
gtcgtggggtgcgtcttacc

SEQ ID NO: 597740 - DNA, 20 bp, mouse
gacaccgtgggccccagcgc

SEQ ID NO: 597741 - DNA, 20 bp, mouse
ggagcgcggagacagaaccg

SEQ ID NO: 597742 - DNA, 20 bp, mouse
ggcggagacagaaccgaggt

SEQ ID NO: 597743 - DNA, 20 bp, mouse
ggcgccagcgctggggccca

SEQ ID NO: 597744 - DNA, 20 bp, mouse
gcgaggtgggcgacagcgag

SEQ ID NO: 597745 - DNA, 20 bp, mouse
gggcgacagcgagcggctat

SEQ ID NO: 597746 - DNA, 20 bp, mouse
gcataaccgcggtctaggta

SEQ ID NO: 597747 - DNA, 20 bp, mouse
ggtgaacgacgccataaccg

SEQ ID NO: 597748 - DNA, 20 bp, mouse
gtcctccttgcccagaagat

SEQ ID NO: 597749 - DNA, 20 bp, mouse
ggcttccaggcgcactaccg

SEQ ID NO: 597750 - DNA, 20 bp, mouse
ggccagggagtagtaggtct

SEQ ID NO: 597751 - DNA, 20 bp, mouse
gctgaagcggcggatctcgc

SEQ ID NO: 597752 - DNA, 20 bp, mouse
gaggtacggacgaaacagct

SEQ ID NO: 597753 - DNA, 20 bp, mouse
gcggtgaaggcctatcttct

SEQ ID NO: 597754 - DNA, 20 bp, mouse
gccgccccaggccctcaccg

SEQ ID NO: 597755 - DNA, 20 bp, mouse
gttcgtccgtacctagaccg

SEQ ID NO: 597756 - DNA, 20 bp, mouse
gccccagaaagttccagcac

SEQ ID NO: 597757 - DNA, 20 bp, mouse
gcttccgaagagcagctgct

SEQ ID NO: 597758 - DNA, 20 bp, mouse
gcggtgggacagccagaggt

SEQ ID NO: 597759 - DNA, 20 bp, mouse
gtggaactttctggggtagt

SEQ ID NO: 597760 - DNA, 20 bp, mouse
ggaagtcagcaaacctgacg

SEQ ID NO: 597761 - DNA, 20 bp, mouse
gtctacagagttctatcagg

SEQ ID NO: 597762 - DNA, 20 bp, mouse
gtggctgggaacagatagtg

SEQ ID NO: 597763 - DNA, 20 bp, mouse
gcattgatgtggaacatgga

SEQ ID NO: 597764 - DNA, 20 bp, mouse
ggagtcggtgggacagccag

SEQ ID NO: 597765 - DNA, 20 bp, mouse
gggccctccccagccccgtc

SEQ ID NO: 597766 - DNA, 20 bp, mouse
gggcggtgcggaagtggaga

SEQ ID NO: 597767 - DNA, 20 bp, mouse
gcccgccggccgtgctcacc

SEQ ID NO: 597768 - DNA, 20 bp, mouse
gactaacggaggatacactg

SEQ ID NO: 597769 - DNA, 20 bp, mouse
gcggagctgtacgtgaagcc

SEQ ID NO: 597770 - DNA, 20 bp, mouse
gacgggctccagactcagac

SEQ ID NO: 597771 - DNA, 20 bp, mouse
gtgatgcgctgccccgctgg

SEQ ID NO: 597772 - DNA, 20 bp, mouse
ggccgcgaccctcttagtaa

SEQ ID NO: 597773 - DNA, 20 bp, mouse
gacgtgaagcccggtgagca

SEQ ID NO: 597774 - DNA, 20 bp, mouse
gcccgctggcggtgcggaag

SEQ ID NO: 597775 - DNA, 20 bp, mouse
gacactggggttgaggggac

SEQ ID NO: 597776 - DNA, 20 bp, mouse
gcccggaagcattgccgcta

SEQ ID NO: 597777 - DNA, 20 bp, mouse
gccagattcgccaagcccga

SEQ ID NO: 597778 - DNA, 20 bp, mouse
ggcgctaccagccggttcag

SEQ ID NO: 597779 - DNA, 20 bp, mouse
gggaagcattgccgctacgg

SEQ ID NO: 597780 - DNA, 20 bp, mouse
gagctttgtgtccaccgtag

SEQ ID NO: 597781 - DNA, 20 bp, mouse
gcgcggccgaaaagcgaaaa

SEQ ID NO: 597782 - DNA, 20 bp, mouse
gcatagcgcgtcctctgaac

SEQ ID NO: 597783 - DNA, 20 bp, mouse
ggaggcgaccgagccatgga

SEQ ID NO: 597784 - DNA, 20 bp, mouse
gtgtgcccagggcacctctg

SEQ ID NO: 597785 - DNA, 20 bp, mouse
ggaagaatcggagctgaggg

SEQ ID NO: 597786 - DNA, 20 bp, mouse
gtccgggcccggaatccaac

SEQ ID NO: 597787 - DNA, 20 bp, mouse
ggcgcccgggcggaccccag

SEQ ID NO: 597788 - DNA, 20 bp, mouse
gcggcctggccgctccggcg

SEQ ID NO: 597789 - DNA, 20 bp, mouse
ggggcggccggttggattcc

SEQ ID NO: 597790 - DNA, 20 bp, mouse
ggcgggccgcggcgtagagt

SEQ ID NO: 597791 - DNA, 20 bp, mouse
gaaggccccagtgagaccta

SEQ ID NO: 597792 - DNA, 20 bp, mouse
ggccccagtgagacctaagg

SEQ ID NO: 597793 - DNA, 20 bp, mouse
gccgcggcgtagagtgggca

SEQ ID NO: 597794 - DNA, 20 bp, mouse
gatccaaccggccgccccgc

SEQ ID NO: 597795 - DNA, 20 bp, mouse
ggcatcccaacaaaaggccg

SEQ ID NO: 597796 - DNA, 20 bp, mouse
gtcactaccaggtagcagtg

SEQ ID NO: 597797 - DNA, 20 bp, mouse
gccaggaaggctagtaactg

SEQ ID NO: 597798 - DNA, 20 bp, mouse
ggttcgacgccgtggaggac

SEQ ID NO: 597799 - DNA, 20 bp, mouse
gaggtgccaggtcctgtgga

SEQ ID NO: 597800 - DNA, 20 bp, mouse
gtggtcaattcctcactacc

SEQ ID NO: 597801 - DNA, 20 bp, mouse
gccaataccacactgctacc

SEQ ID NO: 597802 - DNA, 20 bp, mouse
gtggtcccctccacaggacc

SEQ ID NO: 597803 - DNA, 20 bp, mouse
gtcagataccccaggtacta

SEQ ID NO: 597804 - DNA, 20 bp, mouse
ggccagcaccctagtacctg

SEQ ID NO: 597805 - DNA, 20 bp, mouse
gtggagactcataggaactc

SEQ ID NO: 597806 - DNA, 20 bp, mouse
gggggtggaccagcttggga

SEQ ID NO: 597807 - DNA, 20 bp, mouse
gcgccggggtggaccagctt

SEQ ID NO: 597808 - DNA, 20 bp, mouse
gcagcttgggagggcgccgg

SEQ ID NO: 597809 - DNA, 20 bp, mouse
ggcatggaggcacattaggg

SEQ ID NO: 597810 - DNA, 20 bp, mouse
gtaagcatggaggcacatta

SEQ ID NO: 597811 - DNA, 20 bp, mouse
gcgccggcggccgggcgtgt

SEQ ID NO: 597812 - DNA, 20 bp, mouse
ggaccagcttgggagggcgc

SEQ ID NO: 597813 - DNA, 20 bp, mouse
ggcgcgcgcacccacacgcc

SEQ ID NO: 597814 - DNA, 20 bp, mouse
gtgggcgcaggtgttacggg

SEQ ID NO: 597815 - DNA, 20 bp, mouse
ggagcgagaagcccgcgagg

SEQ ID NO: 597816 - DNA, 20 bp, mouse
gtctgctgctagtgattggt

SEQ ID NO: 597817 - DNA, 20 bp, mouse
gagtctctgctgctagtgat

SEQ ID NO: 597818 - DNA, 20 bp, mouse
gagacctgccaacctaaggt

SEQ ID NO: 597819 - DNA, 20 bp, mouse
gtcctcggcccagagatggt

SEQ ID NO: 597820 - DNA, 20 bp, mouse
gtggaggaccccctaggtct

SEQ ID NO: 597821 - DNA, 20 bp, mouse
gctagtgattggtaggaagc

SEQ ID NO: 597822 - DNA, 20 bp, mouse
gccagtctcctaccttaggt

SEQ ID NO: 597823 - DNA, 20 bp, mouse
gtgtacaacttgggaaggtt

SEQ ID NO: 597824 - DNA, 20 bp, mouse
gccagtcctcggcccagaga

SEQ ID NO: 597825 - DNA, 20 bp, mouse
gtcctccagtctcctacctt

SEQ ID NO: 597826 - DNA, 20 bp, mouse
gcgggcggagacaggagcac

SEQ ID NO: 597827 - DNA, 20 bp, mouse
ggcgggagggtatcttctgg

SEQ ID NO: 597828 - DNA, 20 bp, mouse
ggtagactagcgcatccagt

SEQ ID NO: 597829 - DNA, 20 bp, mouse
gcgggcgggagggtatcttc

SEQ ID NO: 597830 - DNA, 20 bp, mouse
gaggggcgagccacctgctc

SEQ ID NO: 597831 - DNA, 20 bp, mouse
gggaccactgcgaggagtag

SEQ ID NO: 597832 - DNA, 20 bp, mouse
gtccaaacgagagaacgatt

SEQ ID NO: 597833 - DNA, 20 bp, mouse
gaccatctggagccccacga

SEQ ID NO: 597834 - DNA, 20 bp, mouse
ggtttggattacgggcggga

SEQ ID NO: 597835 - DNA, 20 bp, mouse
ggatgcgctagtctacctgg

SEQ ID NO: 597836 - DNA, 20 bp, mouse
gtgccagcaccgggacctga

SEQ ID NO: 597837 - DNA, 20 bp, mouse
gggacctgatggcacacaat

SEQ ID NO: 597838 - DNA, 20 bp, mouse
gagctaccagctgtgaacac

SEQ ID NO: 597839 - DNA, 20 bp, mouse
gtggcgctacctgccagcac

SEQ ID NO: 597840 - DNA, 20 bp, mouse
gaggatcagggtccccatgg

SEQ ID NO: 597841 - DNA, 20 bp, mouse
ggtccccatggtggccaatg

SEQ ID NO: 597842 - DNA, 20 bp, mouse
ggcccgcgctctccaccagg

SEQ ID NO: 597843 - DNA, 20 bp, mouse
gtggggaggagcgcagagta

SEQ ID NO: 597844 - DNA, 20 bp, mouse
gcgcgtggactaacgtcgag

SEQ ID NO: 597845 - DNA, 20 bp, mouse
ggacccagcagcacattccc

SEQ ID NO: 597846 - DNA, 20 bp, mouse
gagcagcgcgaacaggaagg

SEQ ID NO: 597847 - DNA, 20 bp, mouse
gctcggccctgaaccccctg

SEQ ID NO: 597848 - DNA, 20 bp, mouse
gagcagcagcgcgaacagga

SEQ ID NO: 597849 - DNA, 20 bp, mouse
ggcccacccagccatagccc

SEQ ID NO: 597850 - DNA, 20 bp, mouse
gtcccgggctatggctgggt

SEQ ID NO: 597851 - DNA, 20 bp, mouse
gagcgcgaacaggaaggcgg

SEQ ID NO: 597852 - DNA, 20 bp, mouse
gagcgtccgcagggggttca

SEQ ID NO: 597853 - DNA, 20 bp, mouse
gcagccacagcgtccgcagg

SEQ ID NO: 597854 - DNA, 20 bp, mouse
gcggctcccgggctatggct

SEQ ID NO: 597855 - DNA, 20 bp, mouse
gccccaagaggtaacgtcgg

SEQ ID NO: 597856 - DNA, 20 bp, mouse
gtagcgtctgcacgccctag

SEQ ID NO: 597857 - DNA, 20 bp, mouse
gatcggcgcggaagctgtcg

SEQ ID NO: 597858 - DNA, 20 bp, mouse
gtggtccgcgccccgcccct

SEQ ID NO: 597859 - DNA, 20 bp, mouse
gggcgcggaccacggagcca

SEQ ID NO: 597860 - DNA, 20 bp, mouse
gccttcaaatgtgcaatcca

SEQ ID NO: 597861 - DNA, 20 bp, mouse
ggtctgcacgccctaggggc

SEQ ID NO: 597862 - DNA, 20 bp, mouse
gccttgggctggaaattggt

SEQ ID NO: 597863 - DNA, 20 bp, mouse
gaagcctcgcggggcctgac

SEQ ID NO: 597864 - DNA, 20 bp, mouse
ggacggcccttccccacctt

SEQ ID NO: 597865 - DNA, 20 bp, mouse
gctgacaggtgaaatcggcg

SEQ ID NO: 597866 - DNA, 20 bp, mouse
ggcctagtccgaagccgggt

SEQ ID NO: 597867 - DNA, 20 bp, mouse
gccgaaggccagctcgtcca

SEQ ID NO: 597868 - DNA, 20 bp, mouse
gatctggcgcctgagatcta

SEQ ID NO: 597869 - DNA, 20 bp, mouse
gcatggcgccggcgcccacc

SEQ ID NO: 597870 - DNA, 20 bp, mouse
ggcggctctggaacagacac

SEQ ID NO: 597871 - DNA, 20 bp, mouse
ggcccacccggcttcggact

SEQ ID NO: 597872 - DNA, 20 bp, mouse
gtccagagccgcctcaccga

SEQ ID NO: 597873 - DNA, 20 bp, mouse
gtcggactaggcccacgtta

SEQ ID NO: 597874 - DNA, 20 bp, mouse
ggtgggcctagtccgaagcc

SEQ ID NO: 597875 - DNA, 20 bp, mouse
ggagctggccttcggtgagg

SEQ ID NO: 597876 - DNA, 20 bp, mouse
ggtgaggcggtaccaggtgg

SEQ ID NO: 597877 - DNA, 20 bp, mouse
ggggcgcagctcaaacatgg

SEQ ID NO: 597878 - DNA, 20 bp, mouse
gggctgtcgggtgtcatggg

SEQ ID NO: 597879 - DNA, 20 bp, mouse
gtgactctcggggacatcga

SEQ ID NO: 597880 - DNA, 20 bp, mouse
gtcggggcgcagctcaaaca

SEQ ID NO: 597881 - DNA, 20 bp, mouse
gggacatcgacggtgagtgg

SEQ ID NO: 597882 - DNA, 20 bp, mouse
ggcggtgaggcggtaccagg

SEQ ID NO: 597883 - DNA, 20 bp, mouse
gggtccagctcagggagacg

SEQ ID NO: 597884 - DNA, 20 bp, mouse
gcctgagctggacctcacgg

SEQ ID NO: 597885 - DNA, 20 bp, mouse
gctctggagccagaagaact

SEQ ID NO: 597886 - DNA, 20 bp, mouse
ggcgaggccgggatgaacag

SEQ ID NO: 597887 - DNA, 20 bp, mouse
gaggccgggatgaacagcgg

SEQ ID NO: 597888 - DNA, 20 bp, mouse
ggtccacgacgcgtcagcga

SEQ ID NO: 597889 - DNA, 20 bp, mouse
gcaggtgacgaacctctcgt

SEQ ID NO: 597890 - DNA, 20 bp, mouse
gtggacgttggggagcggga

SEQ ID NO: 597891 - DNA, 20 bp, mouse
gtgacgcgtcgtggacgttg

SEQ ID NO: 597892 - DNA, 20 bp, mouse
gggtgaccagcgagcagatg

SEQ ID NO: 597893 - DNA, 20 bp, mouse
ggcgcccgaggtctggatgg

SEQ ID NO: 597894 - DNA, 20 bp, mouse
gagtcccggaggctcgagag

SEQ ID NO: 597895 - DNA, 20 bp, mouse
gtcggcgcccgaggtctgga

SEQ ID NO: 597896 - DNA, 20 bp, mouse
gcggccactacaacttcacc

SEQ ID NO: 597897 - DNA, 20 bp, mouse
gctgcccggtgaagttgtag

SEQ ID NO: 597898 - DNA, 20 bp, mouse
gcccgatgcacatctagggt

SEQ ID NO: 597899 - DNA, 20 bp, mouse
gaaggcccgatgcacatcta

SEQ ID NO: 597900 - DNA, 20 bp, mouse
ggaggacagcgcattcccaa

SEQ ID NO: 597901 - DNA, 20 bp, mouse
gagggaagcccagagcacgg

SEQ ID NO: 597902 - DNA, 20 bp, mouse
gcgggtgggagagatccctt

SEQ ID NO: 597903 - DNA, 20 bp, mouse
gaacttcaccgggcagggga

SEQ ID NO: 597904 - DNA, 20 bp, mouse
ggaatgcgctgtcctcgcaa

SEQ ID NO: 597905 - DNA, 20 bp, mouse
gcatcgggccttcccctgcc

SEQ ID NO: 597906 - DNA, 20 bp, mouse
gccgagaccgcgggtggagg

SEQ ID NO: 597907 - DNA, 20 bp, mouse
gtggccgcggccgagaccgc

SEQ ID NO: 597908 - DNA, 20 bp, mouse
ggcggccgcggcagcaagag

SEQ ID NO: 597909 - DNA, 20 bp, mouse
gagcagcccctgccccgcgg

SEQ ID NO: 597910 - DNA, 20 bp, mouse
gccgcggccgagaccgcggg

SEQ ID NO: 597911 - DNA, 20 bp, mouse
ggccgtcagcgtcccccgcg

SEQ ID NO: 597912 - DNA, 20 bp, mouse
ggggggccgggaccacgcgc

SEQ ID NO: 597913 - DNA, 20 bp, mouse
gaggggccccgggctcgcag

SEQ ID NO: 597914 - DNA, 20 bp, mouse
gtaacagcgcgagtgccggg

SEQ ID NO: 597915 - DNA, 20 bp, mouse
gcataggggcaggaaagtga

SEQ ID NO: 597916 - DNA, 20 bp, mouse
ggctcacgtgctggagatgg

SEQ ID NO: 597917 - DNA, 20 bp, mouse
gcattgcggacggaggaaga

SEQ ID NO: 597918 - DNA, 20 bp, mouse
gtattgaggttcagagtccc

SEQ ID NO: 597919 - DNA, 20 bp, mouse
gggtgctcacgtgctggaga

SEQ ID NO: 597920 - DNA, 20 bp, mouse
ggctgaaccattgcggacgg

SEQ ID NO: 597921 - DNA, 20 bp, mouse
ggtccccggctgaaccattg

SEQ ID NO: 597922 - DNA, 20 bp, mouse
gccggctgaaccattgcgga

SEQ ID NO: 597923 - DNA, 20 bp, mouse
ggcaatgcgtgacctcccca

SEQ ID NO: 597924 - DNA, 20 bp, mouse
ggcagccgcggtgcaatcgc

SEQ ID NO: 597925 - DNA, 20 bp, mouse
gtggtcgccgcgcggagaca

SEQ ID NO: 597926 - DNA, 20 bp, mouse
gaggcagcggaggaccctcg

SEQ ID NO: 597927 - DNA, 20 bp, mouse
gggcagcagcggccagtggg

SEQ ID NO: 597928 - DNA, 20 bp, mouse
gcccgcgcgggtctcaacaa

SEQ ID NO: 597929 - DNA, 20 bp, mouse
gaactccgcggggctgaccg

SEQ ID NO: 597930 - DNA, 20 bp, mouse
gcgccgggcaggaagggagg

SEQ ID NO: 597931 - DNA, 20 bp, mouse
ggagttcgcggatctggagc

SEQ ID NO: 597932 - DNA, 20 bp, mouse
ggtcagccccgcggagttcg

SEQ ID NO: 597933 - DNA, 20 bp, mouse
gtctggagccggcgccgcga

SEQ ID NO: 597934 - DNA, 20 bp, mouse
gaggccagccgagcaaactc

SEQ ID NO: 597935 - DNA, 20 bp, mouse
gcccgcggccgtagaggaag

SEQ ID NO: 597936 - DNA, 20 bp, mouse
ggtctccttagggaactggg

SEQ ID NO: 597937 - DNA, 20 bp, mouse
gcgaactgcgtagaagaggg

SEQ ID NO: 597938 - DNA, 20 bp, mouse
gggccgaactgcgtagaaga

SEQ ID NO: 597939 - DNA, 20 bp, mouse
gtcggccccccagttcccta

SEQ ID NO: 597940 - DNA, 20 bp, mouse
gtcctcggcagtgcagggat

SEQ ID NO: 597941 - DNA, 20 bp, mouse
gcggggtcttgcggagttgg

SEQ ID NO: 597942 - DNA, 20 bp, mouse
gggggaggagaacgctaagt

SEQ ID NO: 597943 - DNA, 20 bp, mouse
gccggggaggagctcactct

SEQ ID NO: 597944 - DNA, 20 bp, mouse
ggacgccaggagtagaggcg

SEQ ID NO: 597945 - DNA, 20 bp, mouse
gctgcgtagaagagggtggc

SEQ ID NO: 597946 - DNA, 20 bp, mouse
gagtccagccctgggtccag

SEQ ID NO: 597947 - DNA, 20 bp, mouse
ggaggatcaaaaccaggaga

SEQ ID NO: 597948 - DNA, 20 bp, mouse
ggcgcctcgggtctgctgga

SEQ ID NO: 597949 - DNA, 20 bp, mouse
ggacggtgaggatcaaaacc

SEQ ID NO: 597950 - DNA, 20 bp, mouse
gtcgggtctgctggacggtg

SEQ ID NO: 597951 - DNA, 20 bp, mouse
ggctccgctggacccagggc

SEQ ID NO: 597952 - DNA, 20 bp, mouse
gagggtgagcagtccagccc

SEQ ID NO: 597953 - DNA, 20 bp, mouse
gagggaggtggaagttttcc

SEQ ID NO: 597954 - DNA, 20 bp, mouse
gtttagctccgctggaccca

SEQ ID NO: 597955 - DNA, 20 bp, mouse
ggagctaaaacgctacagcc

SEQ ID NO: 597956 - DNA, 20 bp, mouse
gtcaggatgcaggttcccgt

SEQ ID NO: 597957 - DNA, 20 bp, mouse
gggacaagcctgctgccgac

SEQ ID NO: 597958 - DNA, 20 bp, mouse
ggagtggagccgagctggtc

SEQ ID NO: 597959 - DNA, 20 bp, mouse
ggatccccaaaccaggacga

SEQ ID NO: 597960 - DNA, 20 bp, mouse
gtattgtgggaggggaggta

SEQ ID NO: 597961 - DNA, 20 bp, mouse
gctcggctccactcagcctc

SEQ ID NO: 597962 - DNA, 20 bp, mouse
gaactcacacgaggttgttg

SEQ ID NO: 597963 - DNA, 20 bp, mouse
ggtgcagggtgtcctattgt

SEQ ID NO: 597964 - DNA, 20 bp, mouse
gcaggacgaaggcgagagcc

SEQ ID NO: 597965 - DNA, 20 bp, mouse
gcactgaagatccccaaacc

SEQ ID NO: 597966 - DNA, 20 bp, mouse
gggacagcttaagatctcac

SEQ ID NO: 597967 - DNA, 20 bp, mouse
gcacacggccggccgaggag

SEQ ID NO: 597968 - DNA, 20 bp, mouse
gtgtggcccaggcaggtcag

SEQ ID NO: 597969 - DNA, 20 bp, mouse
gcctgcctgggccacacggc

SEQ ID NO: 597970 - DNA, 20 bp, mouse
gttctgtggcgttctccttc

SEQ ID NO: 597971 - DNA, 20 bp, mouse
gggggtctgctggctttctg

SEQ ID NO: 597972 - DNA, 20 bp, mouse
ggcagccatggatgcgtcta

SEQ ID NO: 597973 - DNA, 20 bp, mouse
gcagaacagaggacgtgtat

SEQ ID NO: 597974 - DNA, 20 bp, mouse
gtgggaggtggctctctgag

SEQ ID NO: 597975 - DNA, 20 bp, mouse
ggcagaccccgctcctcggc

SEQ ID NO: 597976 - DNA, 20 bp, mouse
gtccagtctcgggagaccag

SEQ ID NO: 597977 - DNA, 20 bp, mouse
ggggtgcccgggatacgcca

SEQ ID NO: 597978 - DNA, 20 bp, mouse
ggacgggcggagcagcagac

SEQ ID NO: 597979 - DNA, 20 bp, mouse
gcgggcggagggtactaccc

SEQ ID NO: 597980 - DNA, 20 bp, mouse
gccaggcggggtaagtgcag

SEQ ID NO: 597981 - DNA, 20 bp, mouse
gggagggtactacccaggcg

SEQ ID NO: 597982 - DNA, 20 bp, mouse
gaaggcccttggaagagatg

SEQ ID NO: 597983 - DNA, 20 bp, mouse
ggtaccctccgcccgcgcca

SEQ ID NO: 597984 - DNA, 20 bp, mouse
ggagccaaggctggacatca

SEQ ID NO: 597985 - DNA, 20 bp, mouse
gatcccgggcaccctggcgc

SEQ ID NO: 597986 - DNA, 20 bp, mouse
gtcaggggcccgggacacag

SEQ ID NO: 597987 - DNA, 20 bp, mouse
gctcttggcagtcaccatga

SEQ ID NO: 597988 - DNA, 20 bp, mouse
gagcaggagcagcgccttca

SEQ ID NO: 597989 - DNA, 20 bp, mouse
gtgaggtgctagagagaagt

SEQ ID NO: 597990 - DNA, 20 bp, mouse
ggagaagtgggagccagtga

SEQ ID NO: 597991 - DNA, 20 bp, mouse
gatagaggcgaggagcagct

SEQ ID NO: 597992 - DNA, 20 bp, mouse
gtcttcttagaacccctcac

SEQ ID NO: 597993 - DNA, 20 bp, mouse
gtgctggagagaggaccctc

SEQ ID NO: 597994 - DNA, 20 bp, mouse
gcccactcggataaaaactt

SEQ ID NO: 597995 - DNA, 20 bp, mouse
ggggcacattaggggcccaa

SEQ ID NO: 597996 - DNA, 20 bp, mouse
gttgagctccgggtgcccgg

SEQ ID NO: 597997 - DNA, 20 bp, mouse
gaaagtggcctcgaaccgcc

SEQ ID NO: 597998 - DNA, 20 bp, mouse
ggtcggtcggatggtcgtgc

SEQ ID NO: 597999 - DNA, 20 bp, mouse
gccatccgaccgacgaaaag

SEQ ID NO: 598000 - DNA, 20 bp, mouse
gctcaagctccgcagcctgt

SEQ ID NO: 598001 - DNA, 20 bp, mouse
ggtacccagcatacaccctg

SEQ ID NO: 598002 - DNA, 20 bp, mouse
gccggtacgcctcagcacgt

SEQ ID NO: 598003 - DNA, 20 bp, mouse
gggtgtatgctgggtacctt

SEQ ID NO: 598004 - DNA, 20 bp, mouse
gagccacgcgctgctaatgc

SEQ ID NO: 598005 - DNA, 20 bp, mouse
gggaacaatgaaggagccta

SEQ ID NO: 598006 - DNA, 20 bp, mouse
gtagcgggttcgggactgca

SEQ ID NO: 598007 - DNA, 20 bp, mouse
ggggccgacggagcgcgtag

SEQ ID NO: 598008 - DNA, 20 bp, mouse
gccccgagcgggttaggttg

SEQ ID NO: 598009 - DNA, 20 bp, mouse
ggcgcggcgggccatacctg

SEQ ID NO: 598010 - DNA, 20 bp, mouse
gtggtcacgttgtgctgggg

SEQ ID NO: 598011 - DNA, 20 bp, mouse
gtggccgccatggggtccag

SEQ ID NO: 598012 - DNA, 20 bp, mouse
gtaggttgcggcgcgggcag

SEQ ID NO: 598013 - DNA, 20 bp, mouse
gcgccatggggtccaggggt

SEQ ID NO: 598014 - DNA, 20 bp, mouse
ggcggaagacgaggatgtct

SEQ ID NO: 598015 - DNA, 20 bp, mouse
gacggagcgcgtagcgggtt

SEQ ID NO: 598016 - DNA, 20 bp, mouse
ggaagagtatgtagactagg

SEQ ID NO: 598017 - DNA, 20 bp, mouse
gctaggaggagcagcccgtg

SEQ ID NO: 598018 - DNA, 20 bp, mouse
gcctccgtcccaggaccaca

SEQ ID NO: 598019 - DNA, 20 bp, mouse
ggtgagctggatctctgctg

SEQ ID NO: 598020 - DNA, 20 bp, mouse
gctgtaccaaatagggacgt

SEQ ID NO: 598021 - DNA, 20 bp, mouse
gaccatgcaccaggatccca

SEQ ID NO: 598022 - DNA, 20 bp, mouse
ggtgtcccagtaggctacta

SEQ ID NO: 598023 - DNA, 20 bp, mouse
gcttctacagctgtgcggtc

SEQ ID NO: 598024 - DNA, 20 bp, mouse
gggacagccaggcttacccc

SEQ ID NO: 598025 - DNA, 20 bp, mouse
gtgggaagcgacaggtgaca

SEQ ID NO: 598026 - DNA, 20 bp, mouse
gggacctgcggagcccagga

SEQ ID NO: 598027 - DNA, 20 bp, mouse
gtctcgagcaacaccatcct

SEQ ID NO: 598028 - DNA, 20 bp, mouse
gcgtcagcagaagcctccag

SEQ ID NO: 598029 - DNA, 20 bp, mouse
gctcgagagcgagcaggtac

SEQ ID NO: 598030 - DNA, 20 bp, mouse
gatcccgaggaagagttctg

SEQ ID NO: 598031 - DNA, 20 bp, mouse
ggagagcgagcaggtaccgg

SEQ ID NO: 598032 - DNA, 20 bp, mouse
ggagcggaggctgcctaacg

SEQ ID NO: 598033 - DNA, 20 bp, mouse
gtcgagtcccgggccctccg

SEQ ID NO: 598034 - DNA, 20 bp, mouse
gaggcttctgctgacggcgt

SEQ ID NO: 598035 - DNA, 20 bp, mouse
ggaacacgctgcccgacgag

SEQ ID NO: 598036 - DNA, 20 bp, mouse
ggccgcgcaagccatctcca

SEQ ID NO: 598037 - DNA, 20 bp, mouse
gcgcggctgacgggactccg

SEQ ID NO: 598038 - DNA, 20 bp, mouse
ggacaggtgggtcctcggga

SEQ ID NO: 598039 - DNA, 20 bp, mouse
gtgacgggactccgtggaga

SEQ ID NO: 598040 - DNA, 20 bp, mouse
ggtgcggtgtccggcctgct

SEQ ID NO: 598041 - DNA, 20 bp, mouse
gcaccagccggaagttgact

SEQ ID NO: 598042 - DNA, 20 bp, mouse
gccggccgaccaggacaggt

SEQ ID NO: 598043 - DNA, 20 bp, mouse
ggctaggctggcgcggctga

SEQ ID NO: 598044 - DNA, 20 bp, mouse
gggccggacaccgcaccagc

SEQ ID NO: 598045 - DNA, 20 bp, mouse
gtccgtggagatggcttgcg

SEQ ID NO: 598046 - DNA, 20 bp, mouse
gcgtcggtgttccagctggt

SEQ ID NO: 598047 - DNA, 20 bp, mouse
gagagtgcagaactccgcaa

SEQ ID NO: 598048 - DNA, 20 bp, mouse
gccacgggcagtgatcgccg

SEQ ID NO: 598049 - DNA, 20 bp, mouse
gctcccccgaaaggatagaa

SEQ ID NO: 598050 - DNA, 20 bp, mouse
ggcacaaagccccgcgtcta

SEQ ID NO: 598051 - DNA, 20 bp, mouse
gcggcgtggggcctcgctaa

SEQ ID NO: 598052 - DNA, 20 bp, mouse
gcgcaagggcgcgcggccta

SEQ ID NO: 598053 - DNA, 20 bp, mouse
gaccccttctatcctttcgg

SEQ ID NO: 598054 - DNA, 20 bp, mouse
gcgtctacggctcccccgaa

SEQ ID NO: 598055 - DNA, 20 bp, mouse
gcttttgcggtgagtgtggg

SEQ ID NO: 598056 - DNA, 20 bp, mouse
gagagtacagaactccggga

SEQ ID NO: 598057 - DNA, 20 bp, mouse
gcccccgataagggtagaag

SEQ ID NO: 598058 - DNA, 20 bp, mouse
gggccttagtgcctcggaag

SEQ ID NO: 598059 - DNA, 20 bp, mouse
gctatggctccccccgataa

SEQ ID NO: 598060 - DNA, 20 bp, mouse
gtgaaagagtacagaactcc

SEQ ID NO: 598061 - DNA, 20 bp, mouse
gcacagggccggcgagtcct

SEQ ID NO: 598062 - DNA, 20 bp, mouse
ggcactaaggcccgtgtcta

SEQ ID NO: 598063 - DNA, 20 bp, mouse
gagaactccgggagggagcg

SEQ ID NO: 598064 - DNA, 20 bp, mouse
gtcggggggagccatagaca

SEQ ID NO: 598065 - DNA, 20 bp, mouse
gttccgcttccgaggcacta

SEQ ID NO: 598066 - DNA, 20 bp, mouse
gaaaaaactaacggtagatt

SEQ ID NO: 598067 - DNA, 20 bp, mouse
gacctcttcattgataatgg

SEQ ID NO: 598068 - DNA, 20 bp, mouse
gagatggttctagcagatct

SEQ ID NO: 598069 - DNA, 20 bp, mouse
ggccaccattatcaatgaag

SEQ ID NO: 598070 - DNA, 20 bp, mouse
gcatacctcttcattgataa

SEQ ID NO: 598071 - DNA, 20 bp, mouse
gtctctggagctgagttaca

SEQ ID NO: 598072 - DNA, 20 bp, mouse
gtcaaagtcaggtcatctgg

SEQ ID NO: 598073 - DNA, 20 bp, mouse
gagcactcctgactgttact

SEQ ID NO: 598074 - DNA, 20 bp, mouse
gcatcttaaaaccttcaaga

SEQ ID NO: 598075 - DNA, 20 bp, mouse
gactttgattcctagaactt

SEQ ID NO: 598076 - DNA, 20 bp, mouse
gctgagaagcagatcccggg

SEQ ID NO: 598077 - DNA, 20 bp, mouse
ggagcaggcgagacgaccag

SEQ ID NO: 598078 - DNA, 20 bp, mouse
gagaagcagatcccgggtgg

SEQ ID NO: 598079 - DNA, 20 bp, mouse
ggctgctgagaagcagatcc

SEQ ID NO: 598080 - DNA, 20 bp, mouse
gttgcggctcaggggcaaga

SEQ ID NO: 598081 - DNA, 20 bp, mouse
gatcgtgctttgcggctcag

SEQ ID NO: 598082 - DNA, 20 bp, mouse
gctccaactggacatctgag

SEQ ID NO: 598083 - DNA, 20 bp, mouse
gcaaggggtatagagatggt

SEQ ID NO: 598084 - DNA, 20 bp, mouse
ggccgcaaagcacgatggaa

SEQ ID NO: 598085 - DNA, 20 bp, mouse
ggtggtggaagcggcagcgg

SEQ ID NO: 598086 - DNA, 20 bp, mouse
ggagtgaggtgaaccgttat

SEQ ID NO: 598087 - DNA, 20 bp, mouse
ggtcgctgttctgcccataa

SEQ ID NO: 598088 - DNA, 20 bp, mouse
gccgctcgccatcttggagg

SEQ ID NO: 598089 - DNA, 20 bp, mouse
gcacctcactccacagcgca

SEQ ID NO: 598090 - DNA, 20 bp, mouse
gccgccgctcgccatcttgg

SEQ ID NO: 598091 - DNA, 20 bp, mouse
gcgggaggaggacatctcct

SEQ ID NO: 598092 - DNA, 20 bp, mouse
gccctcggcacagcgcggag

SEQ ID NO: 598093 - DNA, 20 bp, mouse
gctcttgttgacagtcttga

SEQ ID NO: 598094 - DNA, 20 bp, mouse
ggccttaagcgaccgagctc

SEQ ID NO: 598095 - DNA, 20 bp, mouse
gccggtctcgcggggacaga

SEQ ID NO: 598096 - DNA, 20 bp, mouse
gcggagtgcagcgctgtggg

SEQ ID NO: 598097 - DNA, 20 bp, mouse
gagagaagccccgggcccca

SEQ ID NO: 598098 - DNA, 20 bp, mouse
ggaagcagacgaagggacag

SEQ ID NO: 598099 - DNA, 20 bp, mouse
gagggacagtggcaccgggt

SEQ ID NO: 598100 - DNA, 20 bp, mouse
ggcagcgccggaccccacag

SEQ ID NO: 598101 - DNA, 20 bp, mouse
gtcagtcggaagcagacgaa

SEQ ID NO: 598102 - DNA, 20 bp, mouse
gcacagcggcctgcacccgg

SEQ ID NO: 598103 - DNA, 20 bp, mouse
gaggcgaccccagcagctac

SEQ ID NO: 598104 - DNA, 20 bp, mouse
gggtgggccgactgtttcct

SEQ ID NO: 598105 - DNA, 20 bp, mouse
gcgtgctcaggccgcgccaa

SEQ ID NO: 598106 - DNA, 20 bp, mouse
gtaccggtctcgccatggag

SEQ ID NO: 598107 - DNA, 20 bp, mouse
gccgcggcgggagcccgagt

SEQ ID NO: 598108 - DNA, 20 bp, mouse
gccgccgtggctcctcgtgg

SEQ ID NO: 598109 - DNA, 20 bp, mouse
gcgagtgcgcaggcgcctgg

SEQ ID NO: 598110 - DNA, 20 bp, mouse
gggaccgccgtggctcctcg

SEQ ID NO: 598111 - DNA, 20 bp, mouse
gcctccgccacgaggagcca

SEQ ID NO: 598112 - DNA, 20 bp, mouse
gggaggacgccgcagccgag

SEQ ID NO: 598113 - DNA, 20 bp, mouse
ggcaggcgcctggcggttac

SEQ ID NO: 598114 - DNA, 20 bp, mouse
gcgctcacctttccgctcca

SEQ ID NO: 598115 - DNA, 20 bp, mouse
ggcggttaccggtctcgcca

SEQ ID NO: 598116 - DNA, 20 bp, mouse
gtcttaggactcggattcaa

SEQ ID NO: 598117 - DNA, 20 bp, mouse
ggattcaatggtgctataaa

SEQ ID NO: 598118 - DNA, 20 bp, mouse
gatggtgctataaagggaaa

SEQ ID NO: 598119 - DNA, 20 bp, mouse
gcagcacttctcttaggact

SEQ ID NO: 598120 - DNA, 20 bp, mouse
gataaagggaaacggctccg

SEQ ID NO: 598121 - DNA, 20 bp, mouse
ggaagtcgtcctcttcagaa

SEQ ID NO: 598122 - DNA, 20 bp, mouse
gttagcaaggcctggtgcct

SEQ ID NO: 598123 - DNA, 20 bp, mouse
gagaagtgctgtgaatcttg

SEQ ID NO: 598124 - DNA, 20 bp, mouse
gtgcatagtttagcaaggcc

SEQ ID NO: 598125 - DNA, 20 bp, mouse
gtagctgtacctttctgaag

SEQ ID NO: 598126 - DNA, 20 bp, mouse
gctgggccccacaggaacag

SEQ ID NO: 598127 - DNA, 20 bp, mouse
ggtggtagtgtggattgtgg

SEQ ID NO: 598128 - DNA, 20 bp, mouse
gctaccactaccaccggcat

SEQ ID NO: 598129 - DNA, 20 bp, mouse
gggatgagtgccaatgccgg

SEQ ID NO: 598130 - DNA, 20 bp, mouse
ggtgccaatgccggtggtag

SEQ ID NO: 598131 - DNA, 20 bp, mouse
gtccagtgcaccagagcttt

SEQ ID NO: 598132 - DNA, 20 bp, mouse
gagcagcagcaggtatgacc

SEQ ID NO: 598133 - DNA, 20 bp, mouse
gtcaggatgagtgccaatgc

SEQ ID NO: 598134 - DNA, 20 bp, mouse
gatgtcgcagcccaaagctc

SEQ ID NO: 598135 - DNA, 20 bp, mouse
gggagtccctgcagcaaacg

SEQ ID NO: 598136 - DNA, 20 bp, mouse
gagaccggggccgggaactc

SEQ ID NO: 598137 - DNA, 20 bp, mouse
gagacttgaggccgagaccg

SEQ ID NO: 598138 - DNA, 20 bp, mouse
gggtggtacctgcagcagta

SEQ ID NO: 598139 - DNA, 20 bp, mouse
gccggaaacgggaggagtgg

SEQ ID NO: 598140 - DNA, 20 bp, mouse
gtgcaggtaccacccccgcg

SEQ ID NO: 598141 - DNA, 20 bp, mouse
gccccgcggggcagaactcc

SEQ ID NO: 598142 - DNA, 20 bp, mouse
gccattaggacgccagaacg

SEQ ID NO: 598143 - DNA, 20 bp, mouse
gcggcccgagttcccggccc

SEQ ID NO: 598144 - DNA, 20 bp, mouse
gtgaggccgagaccggggcc

SEQ ID NO: 598145 - DNA, 20 bp, mouse
ggaaagtgcggagtgactac

SEQ ID NO: 598146 - DNA, 20 bp, mouse
gtcggcgccgcaggccaggg

SEQ ID NO: 598147 - DNA, 20 bp, mouse
gtaaggctggaaggcgccac

SEQ ID NO: 598148 - DNA, 20 bp, mouse
ggtcgtaaggagtcgaggta

SEQ ID NO: 598149 - DNA, 20 bp, mouse
ggagtcgaggtaaggctgga

SEQ ID NO: 598150 - DNA, 20 bp, mouse
gcggcgaacacccggcgagt

SEQ ID NO: 598151 - DNA, 20 bp, mouse
gagaggtgtgtagtcttccc

SEQ ID NO: 598152 - DNA, 20 bp, mouse
gttcgccgaagccatgaaag

SEQ ID NO: 598153 - DNA, 20 bp, mouse
ggccaggagagccaccgcca

SEQ ID NO: 598154 - DNA, 20 bp, mouse
gacacccggcgagttggcga

SEQ ID NO: 598155 - DNA, 20 bp, mouse
ggcctagagccacgtaactt

SEQ ID NO: 598156 - DNA, 20 bp, mouse
gaggaggccaagagaccgag

SEQ ID NO: 598157 - DNA, 20 bp, mouse
ggctgcacagctcacttaag

SEQ ID NO: 598158 - DNA, 20 bp, mouse
ggcagcagcgccagcaacag

SEQ ID NO: 598159 - DNA, 20 bp, mouse
ggcttcccaggtaggagcta

SEQ ID NO: 598160 - DNA, 20 bp, mouse
gagccggcgcttcccccgca

SEQ ID NO: 598161 - DNA, 20 bp, mouse
ggtctcactacacagcccct

SEQ ID NO: 598162 - DNA, 20 bp, mouse
gcagctcgggccgaagtccc

SEQ ID NO: 598163 - DNA, 20 bp, mouse
gtgtgcagcctgccctgcgg

SEQ ID NO: 598164 - DNA, 20 bp, mouse
gcgaagtcccgggctcccca

SEQ ID NO: 598165 - DNA, 20 bp, mouse
ggcaacagcggcagtacttg

SEQ ID NO: 598166 - DNA, 20 bp, mouse
gtgctgtctgctgcagaaga

SEQ ID NO: 598167 - DNA, 20 bp, mouse
gcctctcatcagtcagtcgg

SEQ ID NO: 598168 - DNA, 20 bp, mouse
gccggaggccctgacagacc

SEQ ID NO: 598169 - DNA, 20 bp, mouse
gtagcataggacctccagag

SEQ ID NO: 598170 - DNA, 20 bp, mouse
gctgacagaccaggagccac

SEQ ID NO: 598171 - DNA, 20 bp, mouse
gtattccccaagaaatggtt

SEQ ID NO: 598172 - DNA, 20 bp, mouse
gtaggaatgttaaagtacaa

SEQ ID NO: 598173 - DNA, 20 bp, mouse
gggcagtgttaccagaatcc

SEQ ID NO: 598174 - DNA, 20 bp, mouse
ggtggagtgatgactagcat

SEQ ID NO: 598175 - DNA, 20 bp, mouse
gttaacattcctagaaccag

SEQ ID NO: 598176 - DNA, 20 bp, mouse
ggtccgccgaggctcggagg

SEQ ID NO: 598177 - DNA, 20 bp, mouse
gctccacctccgagcctcgg

SEQ ID NO: 598178 - DNA, 20 bp, mouse
gaagctaggacggtccgccg

SEQ ID NO: 598179 - DNA, 20 bp, mouse
gcagaggtgtaaagctagga

SEQ ID NO: 598180 - DNA, 20 bp, mouse
gtgcgcagaggtgtaaagct

SEQ ID NO: 598181 - DNA, 20 bp, mouse
ggacatgggcgagtcacacc

SEQ ID NO: 598182 - DNA, 20 bp, mouse
ggcgcagcgctctggaggcg

SEQ ID NO: 598183 - DNA, 20 bp, mouse
ggcctacggtaaggagactt

SEQ ID NO: 598184 - DNA, 20 bp, mouse
gaggacggtccgccgaggct

SEQ ID NO: 598185 - DNA, 20 bp, mouse
ggccgaagtctccttaccgt

SEQ ID NO: 598186 - DNA, 20 bp, mouse
gctcgagccctggagcgcgg

SEQ ID NO: 598187 - DNA, 20 bp, mouse
gccgcgcgcttcctcctccg

SEQ ID NO: 598188 - DNA, 20 bp, mouse
gcgtcagagcatggcggcgg

SEQ ID NO: 598189 - DNA, 20 bp, mouse
ggcggagccaccgcgctcca

SEQ ID NO: 598190 - DNA, 20 bp, mouse
gcagccgcagcgaatgggaa

SEQ ID NO: 598191 - DNA, 20 bp, mouse
gcgcggcgggaaggcgaccg

SEQ ID NO: 598192 - DNA, 20 bp, mouse
ggagtgagtgcagcgccgag

SEQ ID NO: 598193 - DNA, 20 bp, mouse
ggtcctccgagcaggcctca

SEQ ID NO: 598194 - DNA, 20 bp, mouse
gcttgctacagtgacaccgg

SEQ ID NO: 598195 - DNA, 20 bp, mouse
ggctctcgagccctggagcg

SEQ ID NO: 598196 - DNA, 20 bp, mouse
ggagcgatctccgagcgagg

SEQ ID NO: 598197 - DNA, 20 bp, mouse
gtccgagcgaggcggcaaga

SEQ ID NO: 598198 - DNA, 20 bp, mouse
ggtccgagcgcggggatccg

SEQ ID NO: 598199 - DNA, 20 bp, mouse
gccccgcgctcggacttacg

SEQ ID NO: 598200 - DNA, 20 bp, mouse
ggcctagcggagcctcaagg

SEQ ID NO: 598201 - DNA, 20 bp, mouse
gcgcggtgcacgctgggata

SEQ ID NO: 598202 - DNA, 20 bp, mouse
gagggagcgatctccgagcg

SEQ ID NO: 598203 - DNA, 20 bp, mouse
gcgaggcggcaagatggacg

SEQ ID NO: 598204 - DNA, 20 bp, mouse
gtagggggggacgatcccgg

SEQ ID NO: 598205 - DNA, 20 bp, mouse
gcaagcctctcgcctctccc

SEQ ID NO: 598206 - DNA, 20 bp, mouse
gggcccctgaggaagcgagg

SEQ ID NO: 598207 - DNA, 20 bp, mouse
ggcgcagtcgaagcccgctg

SEQ ID NO: 598208 - DNA, 20 bp, mouse
gaagcccgctgcggcccctg

SEQ ID NO: 598209 - DNA, 20 bp, mouse
gcggcggcgggtgagagaaa

SEQ ID NO: 598210 - DNA, 20 bp, mouse
gccgcctcctcgcttcctca

SEQ ID NO: 598211 - DNA, 20 bp, mouse
gtgaggcgggcggaccgacg

SEQ ID NO: 598212 - DNA, 20 bp, mouse
gtgcggcccctgaggaagcg

SEQ ID NO: 598213 - DNA, 20 bp, mouse
ggcgcaacgctgcccaggcg

SEQ ID NO: 598214 - DNA, 20 bp, mouse
gtgcccaggcggggtgcgag

SEQ ID NO: 598215 - DNA, 20 bp, mouse
gggcgggcggaccgacgagg

SEQ ID NO: 598216 - DNA, 20 bp, mouse
ggcatttcagcaatcggcag

SEQ ID NO: 598217 - DNA, 20 bp, mouse
gggacagcgcactaccatag

SEQ ID NO: 598218 - DNA, 20 bp, mouse
gacatctgggcccccagctg

SEQ ID NO: 598219 - DNA, 20 bp, mouse
gcaatcggcagcggcgcttg

SEQ ID NO: 598220 - DNA, 20 bp, mouse
gttgtcccgggtcttctgct

SEQ ID NO: 598221 - DNA, 20 bp, mouse
gctcaggcctccccagctgg

SEQ ID NO: 598222 - DNA, 20 bp, mouse
ggcctgcttggcatgctcat

SEQ ID NO: 598223 - DNA, 20 bp, mouse
gagccaccaggcgggccagg

SEQ ID NO: 598224 - DNA, 20 bp, mouse
gcagcgcactaccatagagg

SEQ ID NO: 598225 - DNA, 20 bp, mouse
gctcgcctgaccccacggac

SEQ ID NO: 598226 - DNA, 20 bp, mouse
ggcacgcacggcagacgccc

SEQ ID NO: 598227 - DNA, 20 bp, mouse
gtctgcgcggtagagaaagc

SEQ ID NO: 598228 - DNA, 20 bp, mouse
ggagctcacacgcgcacgca

SEQ ID NO: 598229 - DNA, 20 bp, mouse
gagaacagagaggaggcgac

SEQ ID NO: 598230 - DNA, 20 bp, mouse
ggagagatcggagttcaggg

SEQ ID NO: 598231 - DNA, 20 bp, mouse
gtctcgggttaggcaggcag

SEQ ID NO: 598232 - DNA, 20 bp, mouse
gggcaggcagcggagaaaga

SEQ ID NO: 598233 - DNA, 20 bp, mouse
ggaacgggacgtctcgggtt

SEQ ID NO: 598234 - DNA, 20 bp, mouse
gcaagaggtgaacccagccg

SEQ ID NO: 598235 - DNA, 20 bp, mouse
gtccgcgtgaaacccccaag

SEQ ID NO: 598236 - DNA, 20 bp, mouse
gtctcagcccggagacgaag

SEQ ID NO: 598237 - DNA, 20 bp, mouse
gggaccggaacgagcgacaa

SEQ ID NO: 598238 - DNA, 20 bp, mouse
gtagttggaggccgagctcc

SEQ ID NO: 598239 - DNA, 20 bp, mouse
gcccgaccgctgccaggtgg

SEQ ID NO: 598240 - DNA, 20 bp, mouse
ggaggccggcctgccatccc

SEQ ID NO: 598241 - DNA, 20 bp, mouse
gaatggaccacaaagagggt

SEQ ID NO: 598242 - DNA, 20 bp, mouse
ggatgatgaacaaggaccag

SEQ ID NO: 598243 - DNA, 20 bp, mouse
ggcgcgtcctacgtcactcc

SEQ ID NO: 598244 - DNA, 20 bp, mouse
gtggacgagggggaatccgt

SEQ ID NO: 598245 - DNA, 20 bp, mouse
gcgacaatggaccacaaaga

SEQ ID NO: 598246 - DNA, 20 bp, mouse
gcggcagagcgagccctcag

SEQ ID NO: 598247 - DNA, 20 bp, mouse
gtcctaccaagcctagcgta

SEQ ID NO: 598248 - DNA, 20 bp, mouse
gggagacgtggtgccgctga

SEQ ID NO: 598249 - DNA, 20 bp, mouse
ggccgtacgctaggcttggt

SEQ ID NO: 598250 - DNA, 20 bp, mouse
gcagtgcgccgagctgataa

SEQ ID NO: 598251 - DNA, 20 bp, mouse
gtcccgcggccgctccaaaa

SEQ ID NO: 598252 - DNA, 20 bp, mouse
gagcggcaccacgtctcccg

SEQ ID NO: 598253 - DNA, 20 bp, mouse
ggctcgctctgccgtacgct

SEQ ID NO: 598254 - DNA, 20 bp, mouse
gtaaaggcgccattttggag

SEQ ID NO: 598255 - DNA, 20 bp, mouse
gctctgccgtacgctaggct

SEQ ID NO: 598256 - DNA, 20 bp, mouse
gtctgggccggcggcgctaa

SEQ ID NO: 598257 - DNA, 20 bp, mouse
gggcaaaccgtccgcagctc

SEQ ID NO: 598258 - DNA, 20 bp, mouse
gccagccgccgagcacgcgg

SEQ ID NO: 598259 - DNA, 20 bp, mouse
ggaagaggcagttgccgtag

SEQ ID NO: 598260 - DNA, 20 bp, mouse
gcggcggcgcggcctagagc

SEQ ID NO: 598261 - DNA, 20 bp, mouse
gccgcgtggcgggcattcgg

SEQ ID NO: 598262 - DNA, 20 bp, mouse
gcggagcagctactgcgcgg

SEQ ID NO: 598263 - DNA, 20 bp, mouse
ggagcacgcgggggaggacg

SEQ ID NO: 598264 - DNA, 20 bp, mouse
ggtggacgtcggatccatga

SEQ ID NO: 598265 - DNA, 20 bp, mouse
gggcgagcgagcaggcgtga

SEQ ID NO: 598266 - DNA, 20 bp, mouse
gctgagggcgaggttggtga

SEQ ID NO: 598267 - DNA, 20 bp, mouse
ggttggtgagggcaacggaa

SEQ ID NO: 598268 - DNA, 20 bp, mouse
ggcgaggttggtgagggcaa

SEQ ID NO: 598269 - DNA, 20 bp, mouse
ggggcaacggaagggctcgt

SEQ ID NO: 598270 - DNA, 20 bp, mouse
gtttctcctgagggcgaggt

SEQ ID NO: 598271 - DNA, 20 bp, mouse
gacgtcgcatcagaacgtgg

SEQ ID NO: 598272 - DNA, 20 bp, mouse
ggtcgtcaccgccagctccc

SEQ ID NO: 598273 - DNA, 20 bp, mouse
ggaagggctcgtcggtcctg

SEQ ID NO: 598274 - DNA, 20 bp, mouse
gtcgtcggtcctgcggtccc

SEQ ID NO: 598275 - DNA, 20 bp, mouse
gacatcagcgcgcgcagcta

SEQ ID NO: 598276 - DNA, 20 bp, mouse
ggccgccggccgcacacaaa

SEQ ID NO: 598277 - DNA, 20 bp, mouse
gggcgggcgtgtggaattgt

SEQ ID NO: 598278 - DNA, 20 bp, mouse
gctgcgctgcgcgaggtccg

SEQ ID NO: 598279 - DNA, 20 bp, mouse
ggtccgcggccgtttgtgtg

SEQ ID NO: 598280 - DNA, 20 bp, mouse
ggcccgggcccaggccccag

SEQ ID NO: 598281 - DNA, 20 bp, mouse
gctggcgctcggagacacgt

SEQ ID NO: 598282 - DNA, 20 bp, mouse
gagcgccccggtactcactc

SEQ ID NO: 598283 - DNA, 20 bp, mouse
gcccgccggagtgagtaccg

SEQ ID NO: 598284 - DNA, 20 bp, mouse
ggcgcctcgcctcaccggaa

SEQ ID NO: 598285 - DNA, 20 bp, mouse
gggcggcaccgaggtgatcc

SEQ ID NO: 598286 - DNA, 20 bp, mouse
gacgttcctgacgaacaggg

SEQ ID NO: 598287 - DNA, 20 bp, mouse
gcgaacagggaggtgttggg

SEQ ID NO: 598288 - DNA, 20 bp, mouse
gctgacgaacagggaggtgt

SEQ ID NO: 598289 - DNA, 20 bp, mouse
ggcagacgccaccaggtgag

SEQ ID NO: 598290 - DNA, 20 bp, mouse
gtggagaccggaccccgcgg

SEQ ID NO: 598291 - DNA, 20 bp, mouse
gtagcgagacatgcctctcg

SEQ ID NO: 598292 - DNA, 20 bp, mouse
gaggcatgtctcgctacacc

SEQ ID NO: 598293 - DNA, 20 bp, mouse
gtgcgacgttcctgacgaac

SEQ ID NO: 598294 - DNA, 20 bp, mouse
gatactccgacagcccgcag

SEQ ID NO: 598295 - DNA, 20 bp, mouse
ggaacgtcgcagacgccacc

SEQ ID NO: 598296 - DNA, 20 bp, mouse
gcggtagctacagtcctcgt

SEQ ID NO: 598297 - DNA, 20 bp, mouse
gcagtcctcgtgggtaggga

SEQ ID NO: 598298 - DNA, 20 bp, mouse
ggcagagcacccgaacctga

SEQ ID NO: 598299 - DNA, 20 bp, mouse
gaggttcgggtgctctgcgg

SEQ ID NO: 598300 - DNA, 20 bp, mouse
gctcaggcgtccgtcaggtt

SEQ ID NO: 598301 - DNA, 20 bp, mouse
gggctccctccctacccacg

SEQ ID NO: 598302 - DNA, 20 bp, mouse
gtgctgctcaggcgtccgtc

SEQ ID NO: 598303 - DNA, 20 bp, mouse
ggagggcatgacctccctca

SEQ ID NO: 598304 - DNA, 20 bp, mouse
ggctacaccaaggagtcccg

SEQ ID NO: 598305 - DNA, 20 bp, mouse
ggcttcgcagccatgagcta

SEQ ID NO: 598306 - DNA, 20 bp, mouse
gtcgcggcgtcacgaaatgg

SEQ ID NO: 598307 - DNA, 20 bp, mouse
gaaatagggcgaggggacgg

SEQ ID NO: 598308 - DNA, 20 bp, mouse
gggaccggcgaacggaggga

SEQ ID NO: 598309 - DNA, 20 bp, mouse
ggtggggccgggcgcaatgg

SEQ ID NO: 598310 - DNA, 20 bp, mouse
ggcaccagattgagacaaag

SEQ ID NO: 598311 - DNA, 20 bp, mouse
gggtcccttaccgagatcct

SEQ ID NO: 598312 - DNA, 20 bp, mouse
ggaacccaggatctcggtaa

SEQ ID NO: 598313 - DNA, 20 bp, mouse
gtataaatagggcgagggga

SEQ ID NO: 598314 - DNA, 20 bp, mouse
gagttccgcagactcgaggt

SEQ ID NO: 598315 - DNA, 20 bp, mouse
ggggaccgaaagtcacaaaa

SEQ ID NO: 598316 - DNA, 20 bp, mouse
gcggcgaagggaaaacgcgg

SEQ ID NO: 598317 - DNA, 20 bp, mouse
gggccggcgaagggaaaacg

SEQ ID NO: 598318 - DNA, 20 bp, mouse
gggctacgggaagatcctgg

SEQ ID NO: 598319 - DNA, 20 bp, mouse
gcggcggcggcggtaacggg

SEQ ID NO: 598320 - DNA, 20 bp, mouse
gcgaagggaaaacgcggcgg

SEQ ID NO: 598321 - DNA, 20 bp, mouse
gaacgcggcggcggcggtaa

SEQ ID NO: 598322 - DNA, 20 bp, mouse
ggccggccgccgcctgaggg

SEQ ID NO: 598323 - DNA, 20 bp, mouse
gcccggcccccctcaggcgg

SEQ ID NO: 598324 - DNA, 20 bp, mouse
ggctggccccggcccccctc

SEQ ID NO: 598325 - DNA, 20 bp, mouse
gggccccggcccccctcagg

SEQ ID NO: 598326 - DNA, 20 bp, mouse
ggagagactgtagacgagtt

SEQ ID NO: 598327 - DNA, 20 bp, mouse
gctgctaagtgcgtcagttg

SEQ ID NO: 598328 - DNA, 20 bp, mouse
gcattaagggcggcagggag

SEQ ID NO: 598329 - DNA, 20 bp, mouse
gaccctgtccggtaggtgag

SEQ ID NO: 598330 - DNA, 20 bp, mouse
gctcgggtcgcaagtggccg

SEQ ID NO: 598331 - DNA, 20 bp, mouse
gcctcgatgagagccattaa

SEQ ID NO: 598332 - DNA, 20 bp, mouse
gccctcacgcaacacccaca

SEQ ID NO: 598333 - DNA, 20 bp, mouse
gcgatgagagccattaaggg

SEQ ID NO: 598334 - DNA, 20 bp, mouse
gctggggcacgtctccctgt

SEQ ID NO: 598335 - DNA, 20 bp, mouse
ggacgttgcacaaaatggaa

SEQ ID NO: 598336 - DNA, 20 bp, mouse
ggcgcgcgcgcaccattgtg

SEQ ID NO: 598337 - DNA, 20 bp, mouse
gcacgcgcctcacaccgcag

SEQ ID NO: 598338 - DNA, 20 bp, mouse
ggcgcctcacaccgcagcgg

SEQ ID NO: 598339 - DNA, 20 bp, mouse
gcggccgccgctgcggtgtg

SEQ ID NO: 598340 - DNA, 20 bp, mouse
gctacgctataagtgcccgg

SEQ ID NO: 598341 - DNA, 20 bp, mouse
gccctccgccagcctcccgg

SEQ ID NO: 598342 - DNA, 20 bp, mouse
gggcagggcctctaaaatgg

SEQ ID NO: 598343 - DNA, 20 bp, mouse
gcgtggcagggcctctaaaa

SEQ ID NO: 598344 - DNA, 20 bp, mouse
gcggtgtgaggcgcgtgttc

SEQ ID NO: 598345 - DNA, 20 bp, mouse
ggaggtcgatctcgaggagg

SEQ ID NO: 598346 - DNA, 20 bp, mouse
gagcgcgagtagcacggaag

SEQ ID NO: 598347 - DNA, 20 bp, mouse
gcaatcccggcggcactaca

SEQ ID NO: 598348 - DNA, 20 bp, mouse
gtaagcggccagggccccag

SEQ ID NO: 598349 - DNA, 20 bp, mouse
ggctcacagcgcgagtagca

SEQ ID NO: 598350 - DNA, 20 bp, mouse
gcaagcgcccgggccctaag

SEQ ID NO: 598351 - DNA, 20 bp, mouse
gcggcggcactacaaggaag

SEQ ID NO: 598352 - DNA, 20 bp, mouse
ggcggcgcggcggttagaga

SEQ ID NO: 598353 - DNA, 20 bp, mouse
gctgtccaggagagaccaaa

SEQ ID NO: 598354 - DNA, 20 bp, mouse
ggatggccggcccgtgtact

SEQ ID NO: 598355 - DNA, 20 bp, mouse
ggcgtcgtccaacaattggt

SEQ ID NO: 598356 - DNA, 20 bp, mouse
ggcgcctcgggagcccgcgg

SEQ ID NO: 598357 - DNA, 20 bp, mouse
ggcgttcccacaatgcagtg

SEQ ID NO: 598358 - DNA, 20 bp, mouse
gtgagcgcctcgggagcccg

SEQ ID NO: 598359 - DNA, 20 bp, mouse
ggtgcgcgagaaggacctcg

SEQ ID NO: 598360 - DNA, 20 bp, mouse
ggcgacgggcgcatctacgt

SEQ ID NO: 598361 - DNA, 20 bp, mouse
gacgccgcctcctcagcccg

SEQ ID NO: 598362 - DNA, 20 bp, mouse
gcgaagcgcacgaaggcgaa

SEQ ID NO: 598363 - DNA, 20 bp, mouse
ggccgggcccggcggagatg

SEQ ID NO: 598364 - DNA, 20 bp, mouse
gccgccgcagcctcccccgc

SEQ ID NO: 598365 - DNA, 20 bp, mouse
gtcccgcccccgcttcctca

SEQ ID NO: 598366 - DNA, 20 bp, mouse
gactttctcaacctgcccag

SEQ ID NO: 598367 - DNA, 20 bp, mouse
gacaggttttagaggcccct

SEQ ID NO: 598368 - DNA, 20 bp, mouse
ggttttagaggcccctgggc

SEQ ID NO: 598369 - DNA, 20 bp, mouse
ggttgaaaaagaagtatcca

SEQ ID NO: 598370 - DNA, 20 bp, mouse
gtttcttggtgagatgtcac

SEQ ID NO: 598371 - DNA, 20 bp, mouse
ggagatgtcacaggttttag

SEQ ID NO: 598372 - DNA, 20 bp, mouse
ggaaagttctagactttcct

SEQ ID NO: 598373 - DNA, 20 bp, mouse
gagaagtatccacggtttct

SEQ ID NO: 598374 - DNA, 20 bp, mouse
gctttttcaacagagtttca

SEQ ID NO: 598375 - DNA, 20 bp, mouse
gatgtccccttctgcacaaa

SEQ ID NO: 598376 - DNA, 20 bp, mouse
ggcgggtggagcgctccgga

SEQ ID NO: 598377 - DNA, 20 bp, mouse
gccgagggacagggacccgg

SEQ ID NO: 598378 - DNA, 20 bp, mouse
ggacccggtggcgcccaggg

SEQ ID NO: 598379 - DNA, 20 bp, mouse
gccggggcgcccgagggaca

SEQ ID NO: 598380 - DNA, 20 bp, mouse
ggaggtatggggctacgcgc

SEQ ID NO: 598381 - DNA, 20 bp, mouse
gggccaccaaggaagaggta

SEQ ID NO: 598382 - DNA, 20 bp, mouse
gcgcgcgagggataaagaga

SEQ ID NO: 598383 - DNA, 20 bp, mouse
gacgcgcgggtggagcgctc

SEQ ID NO: 598384 - DNA, 20 bp, mouse
ggcctggtaaagaggccggg

SEQ ID NO: 598385 - DNA, 20 bp, mouse
gcagtccgtcaaggtcacac

SEQ ID NO: 598386 - DNA, 20 bp, mouse
gggtgtggtcccgtggtgag

SEQ ID NO: 598387 - DNA, 20 bp, mouse
gcgtggtgagaggcacaagt

SEQ ID NO: 598388 - DNA, 20 bp, mouse
gtgcatgctgggattctgct

SEQ ID NO: 598389 - DNA, 20 bp, mouse
gattgtctagagagcatgga

SEQ ID NO: 598390 - DNA, 20 bp, mouse
gacactttagccctccgatg

SEQ ID NO: 598391 - DNA, 20 bp, mouse
ggcccagtggggatatcaac

SEQ ID NO: 598392 - DNA, 20 bp, mouse
gtaaatatcagcctcatcgg

SEQ ID NO: 598393 - DNA, 20 bp, mouse
gattcatggggcgcttgaca

SEQ ID NO: 598394 - DNA, 20 bp, mouse
gcatgaatgcatttatggtg

SEQ ID NO: 598395 - DNA, 20 bp, mouse
gctataaatatcagcctcat

SEQ ID NO: 598396 - DNA, 20 bp, mouse
gcccttgccccgctgcctcg

SEQ ID NO: 598397 - DNA, 20 bp, mouse
gtgtggcgttcgcagccccg

SEQ ID NO: 598398 - DNA, 20 bp, mouse
gtcgctgatcgcgggctcgg

SEQ ID NO: 598399 - DNA, 20 bp, mouse
gctcgggactcgctgatcgc

SEQ ID NO: 598400 - DNA, 20 bp, mouse
gccagaaggtgagccgggag

SEQ ID NO: 598401 - DNA, 20 bp, mouse
gggcccgcggggaaatcggg

SEQ ID NO: 598402 - DNA, 20 bp, mouse
ggcgagtcccgagcgctcca

SEQ ID NO: 598403 - DNA, 20 bp, mouse
gcccggcccgcggggaaatc

SEQ ID NO: 598404 - DNA, 20 bp, mouse
ggggcgacgccggagtctcg

SEQ ID NO: 598405 - DNA, 20 bp, mouse
ggggcagagcaggcgccaaa

SEQ ID NO: 598406 - DNA, 20 bp, mouse
ggcgcggccgagaggcaaag

SEQ ID NO: 598407 - DNA, 20 bp, mouse
ggacgcgaaggccacggaca

SEQ ID NO: 598408 - DNA, 20 bp, mouse
gcgcgccgacgcgaaggcca

SEQ ID NO: 598409 - DNA, 20 bp, mouse
gaataaaccccaatgatcac

SEQ ID NO: 598410 - DNA, 20 bp, mouse
gagcagaccatccagaaggt

SEQ ID NO: 598411 - DNA, 20 bp, mouse
gccgcacggagccctgacgg

SEQ ID NO: 598412 - DNA, 20 bp, mouse
gccgccgcacggagccctga

SEQ ID NO: 598413 - DNA, 20 bp, mouse
gggactcagcccgtgatcat

SEQ ID NO: 598414 - DNA, 20 bp, mouse
gcgcgccaccaccatgtccg

SEQ ID NO: 598415 - DNA, 20 bp, mouse
gccagtgcctccagcaaagt

SEQ ID NO: 598416 - DNA, 20 bp, mouse
gcgccggcgctcggaagtcc

SEQ ID NO: 598417 - DNA, 20 bp, mouse
ggaacaacgacagaagcgcc

SEQ ID NO: 598418 - DNA, 20 bp, mouse
ggctggaccgcggcccgagg

SEQ ID NO: 598419 - DNA, 20 bp, mouse
gcaaacgcgcttaaagatgg

SEQ ID NO: 598420 - DNA, 20 bp, mouse
gctggaggccgaagaagtgg

SEQ ID NO: 598421 - DNA, 20 bp, mouse
gcctcggcgaggccacggag

SEQ ID NO: 598422 - DNA, 20 bp, mouse
gactgaggagaaggtacgaa

SEQ ID NO: 598423 - DNA, 20 bp, mouse
gctcaaagattcggatccca

SEQ ID NO: 598424 - DNA, 20 bp, mouse
ggaggctcgccgcatcctca

SEQ ID NO: 598425 - DNA, 20 bp, mouse
ggtcgttgttcttgaagctg

SEQ ID NO: 598426 - DNA, 20 bp, mouse
gtgcgtgtccggtgagggag

SEQ ID NO: 598427 - DNA, 20 bp, mouse
gcgagcagcacagggaacgg

SEQ ID NO: 598428 - DNA, 20 bp, mouse
gggctctgcgtgtccggtga

SEQ ID NO: 598429 - DNA, 20 bp, mouse
gtcagcgctaacggggacga

SEQ ID NO: 598430 - DNA, 20 bp, mouse
ggccggaagcgagccgctgg

SEQ ID NO: 598431 - DNA, 20 bp, mouse
gaagcgagccgctggcggtc

SEQ ID NO: 598432 - DNA, 20 bp, mouse
gggacactcggactccagcg

SEQ ID NO: 598433 - DNA, 20 bp, mouse
gctgtctctacaaacagtgc

SEQ ID NO: 598434 - DNA, 20 bp, mouse
gggcgctcgcgagcagcaca

SEQ ID NO: 598435 - DNA, 20 bp, mouse
gctccccagcctcgccgcgg

SEQ ID NO: 598436 - DNA, 20 bp, mouse
gctctcggcacaagcatgta

SEQ ID NO: 598437 - DNA, 20 bp, mouse
ggcctggctgtcggacggga

SEQ ID NO: 598438 - DNA, 20 bp, mouse
gtgacagtgggagctgctct

SEQ ID NO: 598439 - DNA, 20 bp, mouse
gccgggcctggctgtcggac

SEQ ID NO: 598440 - DNA, 20 bp, mouse
ggaggctgtgatgggttgac

SEQ ID NO: 598441 - DNA, 20 bp, mouse
ggttgacaggtgcgtgacag

SEQ ID NO: 598442 - DNA, 20 bp, mouse
gccgcggccacccacccggg

SEQ ID NO: 598443 - DNA, 20 bp, mouse
gttctcccgggcctggctgt

SEQ ID NO: 598444 - DNA, 20 bp, mouse
gcggccgcctgcctccacgg

SEQ ID NO: 598445 - DNA, 20 bp, mouse
gcactcacttctcccgggcc

SEQ ID NO: 598446 - DNA, 20 bp, mouse
ggtgctgaaggcgcagaggg

SEQ ID NO: 598447 - DNA, 20 bp, mouse
ggctccaagtagaccagcgg

SEQ ID NO: 598448 - DNA, 20 bp, mouse
gagcggtgctgaaggcgcag

SEQ ID NO: 598449 - DNA, 20 bp, mouse
gccaagtagaccagcggcgg

SEQ ID NO: 598450 - DNA, 20 bp, mouse
gagtagaccagcggcggcgg

SEQ ID NO: 598451 - DNA, 20 bp, mouse
gcggcgcgggaggagttcca

SEQ ID NO: 598452 - DNA, 20 bp, mouse
gtcgggagaccggacggtag

SEQ ID NO: 598453 - DNA, 20 bp, mouse
ggccgggagcagggcagctc

SEQ ID NO: 598454 - DNA, 20 bp, mouse
gctcggcggtgccctcggac

SEQ ID NO: 598455 - DNA, 20 bp, mouse
ggcggagcctgcgcctggga

SEQ ID NO: 598456 - DNA, 20 bp, mouse
gcatgtccgcgcgggagctc

SEQ ID NO: 598457 - DNA, 20 bp, mouse
gcgcttcccggaacagcccg

SEQ ID NO: 598458 - DNA, 20 bp, mouse
ggcccgcgccccgatccccg

SEQ ID NO: 598459 - DNA, 20 bp, mouse
gggagatcccgaggagatcg

SEQ ID NO: 598460 - DNA, 20 bp, mouse
ggacaggtgcggagcatgta

SEQ ID NO: 598461 - DNA, 20 bp, mouse
gcgcggccggagctcccgcg

SEQ ID NO: 598462 - DNA, 20 bp, mouse
ggcgagaacccacccgcggc

SEQ ID NO: 598463 - DNA, 20 bp, mouse
gcagcccggggagggcagcg

SEQ ID NO: 598464 - DNA, 20 bp, mouse
gtgtacggcaaggcgagcaa

SEQ ID NO: 598465 - DNA, 20 bp, mouse
gatggtgcgggatttcaggg

SEQ ID NO: 598466 - DNA, 20 bp, mouse
ggcctgctcctagctgtcca

SEQ ID NO: 598467 - DNA, 20 bp, mouse
gtgaggagccctggacagct

SEQ ID NO: 598468 - DNA, 20 bp, mouse
ggccctggacagctaggagc

SEQ ID NO: 598469 - DNA, 20 bp, mouse
ggctgaaggctctgccagga

SEQ ID NO: 598470 - DNA, 20 bp, mouse
gtcatgttcgcagagtccag

SEQ ID NO: 598471 - DNA, 20 bp, mouse
ggctaactgggtcagaggta

SEQ ID NO: 598472 - DNA, 20 bp, mouse
gtacatgacagggcaacaaa

SEQ ID NO: 598473 - DNA, 20 bp, mouse
gtcgcagagtccaggggcag

SEQ ID NO: 598474 - DNA, 20 bp, mouse
gcgctacagagtacatgaca

SEQ ID NO: 598475 - DNA, 20 bp, mouse
ggtaagggtccaggccccta

SEQ ID NO: 598476 - DNA, 20 bp, mouse
ggagcctgcgcgggacacag

SEQ ID NO: 598477 - DNA, 20 bp, mouse
gagcgggcgccgcaggagga

SEQ ID NO: 598478 - DNA, 20 bp, mouse
ggccatgaaccgacccctgt

SEQ ID NO: 598479 - DNA, 20 bp, mouse
gcctgcgcgggacacagcgg

SEQ ID NO: 598480 - DNA, 20 bp, mouse
gccagagcgggcgccgcagg

SEQ ID NO: 598481 - DNA, 20 bp, mouse
ggcttcacgtgaacccggcc

SEQ ID NO: 598482 - DNA, 20 bp, mouse
gcctccgcctccgccgacag

SEQ ID NO: 598483 - DNA, 20 bp, mouse
gatgaaccgacccctgtcgg

SEQ ID NO: 598484 - DNA, 20 bp, mouse
ggagacgacgacgcaggacg

SEQ ID NO: 598485 - DNA, 20 bp, mouse
gtggctccggcaagccgggt

SEQ ID NO: 598486 - DNA, 20 bp, mouse
gggcgtgggagagcgctgaa

SEQ ID NO: 598487 - DNA, 20 bp, mouse
gagggtcaccaaggccatcg

SEQ ID NO: 598488 - DNA, 20 bp, mouse
ggagcgctgaagggtcacca

SEQ ID NO: 598489 - DNA, 20 bp, mouse
gttgcttgcggaggaagacg

SEQ ID NO: 598490 - DNA, 20 bp, mouse
gggccgggcccgcgccgcga

SEQ ID NO: 598491 - DNA, 20 bp, mouse
ggggcctccagcagccggcc

SEQ ID NO: 598492 - DNA, 20 bp, mouse
ggggatgcttccagatcgca

SEQ ID NO: 598493 - DNA, 20 bp, mouse
ggacgcccgcaccccaaggg

SEQ ID NO: 598494 - DNA, 20 bp, mouse
ggcccgcgccgcgatggcct

SEQ ID NO: 598495 - DNA, 20 bp, mouse
gcaccaggaaaggctctggt

SEQ ID NO: 598496 - DNA, 20 bp, mouse
gctgctgtcagagctaatag

SEQ ID NO: 598497 - DNA, 20 bp, mouse
gctgtcagagctaatagtgg

SEQ ID NO: 598498 - DNA, 20 bp, mouse
gctgccagcctccaactaca

SEQ ID NO: 598499 - DNA, 20 bp, mouse
gggctggcagcgatgaagaa

SEQ ID NO: 598500 - DNA, 20 bp, mouse
ggctaatagtggcggctgtg

SEQ ID NO: 598501 - DNA, 20 bp, mouse
gcgccaagtggacttacctg

SEQ ID NO: 598502 - DNA, 20 bp, mouse
gctctctctttccctgtagt

SEQ ID NO: 598503 - DNA, 20 bp, mouse
gggtgaagagcactgttgta

SEQ ID NO: 598504 - DNA, 20 bp, mouse
ggtgattctaggagctgatg

SEQ ID NO: 598505 - DNA, 20 bp, mouse
gtgggcaaaggacacatccc

SEQ ID NO: 598506 - DNA, 20 bp, mouse
gagtaggcgagagagtccgg

SEQ ID NO: 598507 - DNA, 20 bp, mouse
ggtcagtaggcgagagagtc

SEQ ID NO: 598508 - DNA, 20 bp, mouse
gcgggctccgcacccaccac

SEQ ID NO: 598509 - DNA, 20 bp, mouse
gtactgacgcgccgaacggg

SEQ ID NO: 598510 - DNA, 20 bp, mouse
ggcctactgacgcgccgaac

SEQ ID NO: 598511 - DNA, 20 bp, mouse
gaggcgagagagtccggtgg

SEQ ID NO: 598512 - DNA, 20 bp, mouse
gagggacgagggaaacggag

SEQ ID NO: 598513 - DNA, 20 bp, mouse
gctcggtgagtccctccagg

SEQ ID NO: 598514 - DNA, 20 bp, mouse
gggacgatgggtgaggcgta

SEQ ID NO: 598515 - DNA, 20 bp, mouse
gaagccgcgggaacggcctc

SEQ ID NO: 598516 - DNA, 20 bp, mouse
gaggcaggcccggaacacct

SEQ ID NO: 598517 - DNA, 20 bp, mouse
gaaggcagggactgaccgta

SEQ ID NO: 598518 - DNA, 20 bp, mouse
gggactgaccgtaaggctga

SEQ ID NO: 598519 - DNA, 20 bp, mouse
ggaccgtaaggctgagggag

SEQ ID NO: 598520 - DNA, 20 bp, mouse
ggaacacctgggcgaacacc

SEQ ID NO: 598521 - DNA, 20 bp, mouse
ggacccctccctcagcctta

SEQ ID NO: 598522 - DNA, 20 bp, mouse
gtgctccctaaggcctacct

SEQ ID NO: 598523 - DNA, 20 bp, mouse
gtcctggttgtgcgaaggca

SEQ ID NO: 598524 - DNA, 20 bp, mouse
ggcagtgctgcaaggatagg

SEQ ID NO: 598525 - DNA, 20 bp, mouse
ggctcccaggagctcgacgt

SEQ ID NO: 598526 - DNA, 20 bp, mouse
ggggaagttgtcctaggtca

SEQ ID NO: 598527 - DNA, 20 bp, mouse
gaagttgtcctaggtcacgg

SEQ ID NO: 598528 - DNA, 20 bp, mouse
gtctaagcaagaagctatca

SEQ ID NO: 598529 - DNA, 20 bp, mouse
gttgccagggaagttgtcct

SEQ ID NO: 598530 - DNA, 20 bp, mouse
gggcactcggcatcctgact

SEQ ID NO: 598531 - DNA, 20 bp, mouse
gcacggagggaaatcgttcc

SEQ ID NO: 598532 - DNA, 20 bp, mouse
gagcgcgagagaagaacatg

SEQ ID NO: 598533 - DNA, 20 bp, mouse
gtgggcatggtgaaaccgag

SEQ ID NO: 598534 - DNA, 20 bp, mouse
gtgaaaccgagaggtatggg

SEQ ID NO: 598535 - DNA, 20 bp, mouse
gtggtgaaaccgagaggtat

SEQ ID NO: 598536 - DNA, 20 bp, mouse
ggacttagctgtgcaggcgg

SEQ ID NO: 598537 - DNA, 20 bp, mouse
gaccatgacccaacagggcg

SEQ ID NO: 598538 - DNA, 20 bp, mouse
gtgcagcgccgcgccctgtt

SEQ ID NO: 598539 - DNA, 20 bp, mouse
ggccgcgccctgttgggtca

SEQ ID NO: 598540 - DNA, 20 bp, mouse
ggtgcagaccatgacccaac

SEQ ID NO: 598541 - DNA, 20 bp, mouse
gactcctcgatgcctagggt

SEQ ID NO: 598542 - DNA, 20 bp, mouse
gggtgggaagacagagctgt

SEQ ID NO: 598543 - DNA, 20 bp, mouse
gctcgatgcctagggtgggt

SEQ ID NO: 598544 - DNA, 20 bp, mouse
ggcggctacagaatgaggtg

SEQ ID NO: 598545 - DNA, 20 bp, mouse
gtcatggtctgcaccgcgtc

SEQ ID NO: 598546 - DNA, 20 bp, mouse
gaggcagctcctgagccctg

SEQ ID NO: 598547 - DNA, 20 bp, mouse
gcaggcgcaggcaccaccga

SEQ ID NO: 598548 - DNA, 20 bp, mouse
ggcaccaccgagggaacatg

SEQ ID NO: 598549 - DNA, 20 bp, mouse
gagcagcaaggcccaggcgc

SEQ ID NO: 598550 - DNA, 20 bp, mouse
gagcccagtctcagcagact

SEQ ID NO: 598551 - DNA, 20 bp, mouse
ggcgccccatgttccctcgg

SEQ ID NO: 598552 - DNA, 20 bp, mouse
gactgagtcagagccctggg

SEQ ID NO: 598553 - DNA, 20 bp, mouse
gaccgtgctgggcttcctca

SEQ ID NO: 598554 - DNA, 20 bp, mouse
ggggcgcaagccgagcccca

SEQ ID NO: 598555 - DNA, 20 bp, mouse
gcttgcgccccatgttccct

SEQ ID NO: 598556 - DNA, 20 bp, mouse
gcccacccatccaggagtgt

SEQ ID NO: 598557 - DNA, 20 bp, mouse
gctgctggaggagaccagag

SEQ ID NO: 598558 - DNA, 20 bp, mouse
gagggagcctgggtatagac

SEQ ID NO: 598559 - DNA, 20 bp, mouse
gtgtgtgaggggaccacagc

SEQ ID NO: 598560 - DNA, 20 bp, mouse
gtgacagtgtagaaaagcca

SEQ ID NO: 598561 - DNA, 20 bp, mouse
gctcctggatgggtgggatg

SEQ ID NO: 598562 - DNA, 20 bp, mouse
gatagcactgtcccacaatg

SEQ ID NO: 598563 - DNA, 20 bp, mouse
gtgtccaaggctcttcataa

SEQ ID NO: 598564 - DNA, 20 bp, mouse
gctggaggtcagtctgtcca

SEQ ID NO: 598565 - DNA, 20 bp, mouse
ggcctgtgaagggatgctgg

SEQ ID NO: 598566 - DNA, 20 bp, mouse
ggtccggtgcgggtccgcta

SEQ ID NO: 598567 - DNA, 20 bp, mouse
ggagcctccgagagccctag

SEQ ID NO: 598568 - DNA, 20 bp, mouse
gggtccgctagggctctcgg

SEQ ID NO: 598569 - DNA, 20 bp, mouse
gagccctagcggacccgcac

SEQ ID NO: 598570 - DNA, 20 bp, mouse
gaggcgggggaggagtctca

SEQ ID NO: 598571 - DNA, 20 bp, mouse
gggtacggccggtcagcgtc

SEQ ID NO: 598572 - DNA, 20 bp, mouse
gggccggtcagcgtccggtg

SEQ ID NO: 598573 - DNA, 20 bp, mouse
gtcggaggctctggcggtaa

SEQ ID NO: 598574 - DNA, 20 bp, mouse
gggggaggagtctcatggta

SEQ ID NO: 598575 - DNA, 20 bp, mouse
gacccgcaccggacgctgac

SEQ ID NO: 598576 - DNA, 20 bp, mouse
ggggtgctcacggtgagtct

SEQ ID NO: 598577 - DNA, 20 bp, mouse
ggaggcgtttggggtgctca

SEQ ID NO: 598578 - DNA, 20 bp, mouse
ggggagacgcaagagcgctg

SEQ ID NO: 598579 - DNA, 20 bp, mouse
gctcgcggctgcggacctgg

SEQ ID NO: 598580 - DNA, 20 bp, mouse
gtggcccagggaggcgtttg

SEQ ID NO: 598581 - DNA, 20 bp, mouse
gtccctgggccacagacaac

SEQ ID NO: 598582 - DNA, 20 bp, mouse
ggccggccaggcggggtcag

SEQ ID NO: 598583 - DNA, 20 bp, mouse
gagcgcggtacacactgctg

SEQ ID NO: 598584 - DNA, 20 bp, mouse
ggagcaatcgacccaagcat

SEQ ID NO: 598585 - DNA, 20 bp, mouse
ggcaccccaaacgcctccct

SEQ ID NO: 598586 - DNA, 20 bp, mouse
ggctcggccatggctcccaa

SEQ ID NO: 598587 - DNA, 20 bp, mouse
gcggccatggctcccaaagg

SEQ ID NO: 598588 - DNA, 20 bp, mouse
gtgaaggagcaggtcctcct

SEQ ID NO: 598589 - DNA, 20 bp, mouse
gtggccgagctgaagactgg

SEQ ID NO: 598590 - DNA, 20 bp, mouse
gtccaagcagcagtccgagg

SEQ ID NO: 598591 - DNA, 20 bp, mouse
gggctccaagcagcagtccg

SEQ ID NO: 598592 - DNA, 20 bp, mouse
gccatggccgagctgaagac

SEQ ID NO: 598593 - DNA, 20 bp, mouse
ggagccgcctttgggagcca

SEQ ID NO: 598594 - DNA, 20 bp, mouse
ggttgcggctgaaatcctga

SEQ ID NO: 598595 - DNA, 20 bp, mouse
ggtcctcgggaagtcactcg

SEQ ID NO: 598596 - DNA, 20 bp, mouse
gctgctccgcatgtccaggg

SEQ ID NO: 598597 - DNA, 20 bp, mouse
gcgtctgctccgcatgtcca

SEQ ID NO: 598598 - DNA, 20 bp, mouse
gctcggaagagaagaggcga

SEQ ID NO: 598599 - DNA, 20 bp, mouse
gggaagagaagaggcgatgg

SEQ ID NO: 598600 - DNA, 20 bp, mouse
gtagcgacgagccccgggaa

SEQ ID NO: 598601 - DNA, 20 bp, mouse
gtttcccctcggaagagaag

SEQ ID NO: 598602 - DNA, 20 bp, mouse
gacgacacaacacccatcgg

SEQ ID NO: 598603 - DNA, 20 bp, mouse
ggggaggcagatcagagtaa

SEQ ID NO: 598604 - DNA, 20 bp, mouse
gagcccgccgacgcacgatt

SEQ ID NO: 598605 - DNA, 20 bp, mouse
ggctacctgagcagcaagat

SEQ ID NO: 598606 - DNA, 20 bp, mouse
gcctcgcgacggcacagtga

SEQ ID NO: 598607 - DNA, 20 bp, mouse
gaagagctgcagcctcgcga

SEQ ID NO: 598608 - DNA, 20 bp, mouse
gtgggcgcagggggacgcag

SEQ ID NO: 598609 - DNA, 20 bp, mouse
gcgcagggggacgcagggga

SEQ ID NO: 598610 - DNA, 20 bp, mouse
gggctgcagctcttagaggt

SEQ ID NO: 598611 - DNA, 20 bp, mouse
ggtgagggcggtgggcgcag

SEQ ID NO: 598612 - DNA, 20 bp, mouse
gcacgcgggaaaagcttccc

SEQ ID NO: 598613 - DNA, 20 bp, mouse
gtcgcgcacggaccatagag

SEQ ID NO: 598614 - DNA, 20 bp, mouse
gcggggcccatgcacaccag

SEQ ID NO: 598615 - DNA, 20 bp, mouse
gcaggcacggcaacaatcgg

SEQ ID NO: 598616 - DNA, 20 bp, mouse
gtaggtgagccggagagaca

SEQ ID NO: 598617 - DNA, 20 bp, mouse
gacggcaacatggccttgaa

SEQ ID NO: 598618 - DNA, 20 bp, mouse
ggcccagcatgcggtaacca

SEQ ID NO: 598619 - DNA, 20 bp, mouse
ggtatgcgcttgggatgttt

SEQ ID NO: 598620 - DNA, 20 bp, mouse
gagcagtgaccacggcaaca

SEQ ID NO: 598621 - DNA, 20 bp, mouse
gcgcatctcccgtctgatgg

SEQ ID NO: 598622 - DNA, 20 bp, mouse
gctctagggcggaaacgaga

SEQ ID NO: 598623 - DNA, 20 bp, mouse
gcaggtagtcccccatcaga

SEQ ID NO: 598624 - DNA, 20 bp, mouse
gacggtgcaggtatgcgctt

SEQ ID NO: 598625 - DNA, 20 bp, mouse
ggcacgtgtcgcccagcatg

SEQ ID NO: 598626 - DNA, 20 bp, mouse
gaccgtggagagctccatag

SEQ ID NO: 598627 - DNA, 20 bp, mouse
gagtctagtcgcaggtcctc

SEQ ID NO: 598628 - DNA, 20 bp, mouse
gagccaagctggagcgcggt

SEQ ID NO: 598629 - DNA, 20 bp, mouse
gagccagggcgcactggaga

SEQ ID NO: 598630 - DNA, 20 bp, mouse
gagcttggctgcctgaggca

SEQ ID NO: 598631 - DNA, 20 bp, mouse
gggtgggtcagtctagtcgc

SEQ ID NO: 598632 - DNA, 20 bp, mouse
gtgccaccgggaaacaggta

SEQ ID NO: 598633 - DNA, 20 bp, mouse
ggagcgcagccagggcgcac

SEQ ID NO: 598634 - DNA, 20 bp, mouse
ggtccttacctgtttcccgg

SEQ ID NO: 598635 - DNA, 20 bp, mouse
gagagctccatagcggctga

SEQ ID NO: 598636 - DNA, 20 bp, mouse
gaagtgcttgtaaggtctgg

SEQ ID NO: 598637 - DNA, 20 bp, mouse
ggtaggagtcgggtggaaag

SEQ ID NO: 598638 - DNA, 20 bp, mouse
gctggagacatcattgactt

SEQ ID NO: 598639 - DNA, 20 bp, mouse
ggcaaagtgcttgtaaggtc

SEQ ID NO: 598640 - DNA, 20 bp, mouse
ggcactttgcaagggccatc

SEQ ID NO: 598641 - DNA, 20 bp, mouse
gcattgacttggggatctga

SEQ ID NO: 598642 - DNA, 20 bp, mouse
gtgcgtgggcacttgtgcag

SEQ ID NO: 598643 - DNA, 20 bp, mouse
gcattcctaggacagacctg

SEQ ID NO: 598644 - DNA, 20 bp, mouse
gacttagagtaggagtcggg

SEQ ID NO: 598645 - DNA, 20 bp, mouse
gacctgtacctggagatttc

SEQ ID NO: 598646 - DNA, 20 bp, mouse
gcgcctggagcaccagtccg

SEQ ID NO: 598647 - DNA, 20 bp, mouse
gccgcccgggccactgctag

SEQ ID NO: 598648 - DNA, 20 bp, mouse
gggcgcgctcgcgaggccac

SEQ ID NO: 598649 - DNA, 20 bp, mouse
ggatcattgacgcccagccg

SEQ ID NO: 598650 - DNA, 20 bp, mouse
gctgctagcggcgcagccac

SEQ ID NO: 598651 - DNA, 20 bp, mouse
gcgtggggaagtgtgcccag

SEQ ID NO: 598652 - DNA, 20 bp, mouse
gggagcaccagtccgcggct

SEQ ID NO: 598653 - DNA, 20 bp, mouse
gttgacgcccagccgcggac

SEQ ID NO: 598654 - DNA, 20 bp, mouse
gtgtgtcaccgtgagatgga

SEQ ID NO: 598655 - DNA, 20 bp, mouse
ggagtgctcgaggaaaacca

SEQ ID NO: 598656 - DNA, 20 bp, mouse
ggaggagaggcgagaataga

SEQ ID NO: 598657 - DNA, 20 bp, mouse
gggcgagaatagatggactg

SEQ ID NO: 598658 - DNA, 20 bp, mouse
gtcagggccgaggaccagat

SEQ ID NO: 598659 - DNA, 20 bp, mouse
gagatgcctagcaaggagca

SEQ ID NO: 598660 - DNA, 20 bp, mouse
gcagatgggagaggcgacgt

SEQ ID NO: 598661 - DNA, 20 bp, mouse
ggggagaggagacagtgtgt

SEQ ID NO: 598662 - DNA, 20 bp, mouse
gatagatggactgaggagca

SEQ ID NO: 598663 - DNA, 20 bp, mouse
gtcggatggcacccagttgg

SEQ ID NO: 598664 - DNA, 20 bp, mouse
gggcagaatgagggggagta

SEQ ID NO: 598665 - DNA, 20 bp, mouse
ggtgccggacacgggatggg

SEQ ID NO: 598666 - DNA, 20 bp, mouse
gcccgggcagcggaatgcgg

SEQ ID NO: 598667 - DNA, 20 bp, mouse
ggtctcggggtgcccacccc

SEQ ID NO: 598668 - DNA, 20 bp, mouse
gcaccccgggcagcggaatg

SEQ ID NO: 598669 - DNA, 20 bp, mouse
gtgagccaaggaccaagagg

SEQ ID NO: 598670 - DNA, 20 bp, mouse
gcagccgccgaggccacgaa

SEQ ID NO: 598671 - DNA, 20 bp, mouse
gaggatgcgatggggtccga

SEQ ID NO: 598672 - DNA, 20 bp, mouse
gtggtgtcctcgacccccgg

SEQ ID NO: 598673 - DNA, 20 bp, mouse
gagctgggctccggacgagg

SEQ ID NO: 598674 - DNA, 20 bp, mouse
gggcgacggccaggttgagt

SEQ ID NO: 598675 - DNA, 20 bp, mouse
gctggcgcgttcatgtctcg

SEQ ID NO: 598676 - DNA, 20 bp, mouse
gggacaggatgcccacgccg

SEQ ID NO: 598677 - DNA, 20 bp, mouse
ggcctcgtccgccccggcgt

SEQ ID NO: 598678 - DNA, 20 bp, mouse
gcaggatgcccacgccgggg

SEQ ID NO: 598679 - DNA, 20 bp, mouse
ggcccacgccggggcggacg

SEQ ID NO: 598680 - DNA, 20 bp, mouse
gacgaggcggcggtacttcg

SEQ ID NO: 598681 - DNA, 20 bp, mouse
ggagctgcgcgcagagacag

SEQ ID NO: 598682 - DNA, 20 bp, mouse
gggagagacgaggggcgcat

SEQ ID NO: 598683 - DNA, 20 bp, mouse
gcgacagacctgtgcaggac

SEQ ID NO: 598684 - DNA, 20 bp, mouse
gctccgagtctccgagacag

SEQ ID NO: 598685 - DNA, 20 bp, mouse
gctctgctctttgagctcga

SEQ ID NO: 598686 - DNA, 20 bp, mouse
gatggacagggacccgagtg

SEQ ID NO: 598687 - DNA, 20 bp, mouse
ggacagggacccgagtgagg

SEQ ID NO: 598688 - DNA, 20 bp, mouse
ggacgcctcgaccatggaca

SEQ ID NO: 598689 - DNA, 20 bp, mouse
gtggctggacgcctcgacca

SEQ ID NO: 598690 - DNA, 20 bp, mouse
gcagtgagtagagactggga

SEQ ID NO: 598691 - DNA, 20 bp, mouse
gctcactgtcctcctcactc

SEQ ID NO: 598692 - DNA, 20 bp, mouse
ggggtccctgtccatggtcg

SEQ ID NO: 598693 - DNA, 20 bp, mouse
ggtagagactgggatggcgg

SEQ ID NO: 598694 - DNA, 20 bp, mouse
gggagcacagactcgttact

SEQ ID NO: 598695 - DNA, 20 bp, mouse
gccccatgcccattgtccca

SEQ ID NO: 598696 - DNA, 20 bp, mouse
gttccgcgcgaggaagatgg

SEQ ID NO: 598697 - DNA, 20 bp, mouse
gccgcggcccagtcagtaca

SEQ ID NO: 598698 - DNA, 20 bp, mouse
gaggccgacggtgctctcct

SEQ ID NO: 598699 - DNA, 20 bp, mouse
gatcagcctgagagcagccg

SEQ ID NO: 598700 - DNA, 20 bp, mouse
gccacccgcagcggcgatga

SEQ ID NO: 598701 - DNA, 20 bp, mouse
gtgagagcagccgaggccgg

SEQ ID NO: 598702 - DNA, 20 bp, mouse
ggagcagtgggtagttcggt

SEQ ID NO: 598703 - DNA, 20 bp, mouse
ggagcccaggagagcaccgt

SEQ ID NO: 598704 - DNA, 20 bp, mouse
gcgcagcggcgatgacggca

SEQ ID NO: 598705 - DNA, 20 bp, mouse
gcgcgcacggaccccactga

SEQ ID NO: 598706 - DNA, 20 bp, mouse
gaccgtcacggctccgggag

SEQ ID NO: 598707 - DNA, 20 bp, mouse
gaggcaccggggccgactct

SEQ ID NO: 598708 - DNA, 20 bp, mouse
ggcccgcgggcccgcacccg

SEQ ID NO: 598709 - DNA, 20 bp, mouse
ggggcgcccgccgaggaaag

SEQ ID NO: 598710 - DNA, 20 bp, mouse
ggacgtggacgcaggcaccg

SEQ ID NO: 598711 - DNA, 20 bp, mouse
gaggggtaggtggctcatag

SEQ ID NO: 598712 - DNA, 20 bp, mouse
gctcgtcgcggccgttgcag

SEQ ID NO: 598713 - DNA, 20 bp, mouse
gcgacgagcccgcccagagt

SEQ ID NO: 598714 - DNA, 20 bp, mouse
ggaggcgggccgggcggacc

SEQ ID NO: 598715 - DNA, 20 bp, mouse
gatcccgccgctcaccgtca

SEQ ID NO: 598716 - DNA, 20 bp, mouse
gtgcttgaagaagacaagat

SEQ ID NO: 598717 - DNA, 20 bp, mouse
gatcagaggtaatttggaca

SEQ ID NO: 598718 - DNA, 20 bp, mouse
ggaggaaatcagaggtaatt

SEQ ID NO: 598719 - DNA, 20 bp, mouse
gacctctgatttcctccttc

SEQ ID NO: 598720 - DNA, 20 bp, mouse
gtttctaaattacactgaca

SEQ ID NO: 598721 - DNA, 20 bp, mouse
ggtcattctacagtggcctt

SEQ ID NO: 598722 - DNA, 20 bp, mouse
gtctgcaaggtgaggggtcc

SEQ ID NO: 598723 - DNA, 20 bp, mouse
ggaatcaacacaatcagtcc

SEQ ID NO: 598724 - DNA, 20 bp, mouse
gtttgtagtggctctggaaa

SEQ ID NO: 598725 - DNA, 20 bp, mouse
gtcagtcctgggaaatatga

SEQ ID NO: 598726 - DNA, 20 bp, mouse
gggcagatgcctgacgacta

SEQ ID NO: 598727 - DNA, 20 bp, mouse
ggatgcctgacgactaaggt

SEQ ID NO: 598728 - DNA, 20 bp, mouse
gctttagacaagttaaacca

SEQ ID NO: 598729 - DNA, 20 bp, mouse
gtactcagatggcactagaa

SEQ ID NO: 598730 - DNA, 20 bp, mouse
gtaaggtaggttttctcaga

SEQ ID NO: 598731 - DNA, 20 bp, mouse
gaaaagcaggtggccttcat

SEQ ID NO: 598732 - DNA, 20 bp, mouse
gctcataactaaagatatcc

SEQ ID NO: 598733 - DNA, 20 bp, mouse
gaaaacctaccttagtcgtc

SEQ ID NO: 598734 - DNA, 20 bp, mouse
gatttcctcagtggtagagg

SEQ ID NO: 598735 - DNA, 20 bp, mouse
gctagtgccatctgagtacc

SEQ ID NO: 598736 - DNA, 20 bp, mouse
gaggtgagggggccatagtg

SEQ ID NO: 598737 - DNA, 20 bp, mouse
gtcaatcctgggaaataaga

SEQ ID NO: 598738 - DNA, 20 bp, mouse
gtgagggggccatagtgggg

SEQ ID NO: 598739 - DNA, 20 bp, mouse
gtgggaaataagagggttaa

SEQ ID NO: 598740 - DNA, 20 bp, mouse
ggaatcaagacaatcaatcc

SEQ ID NO: 598741 - DNA, 20 bp, mouse
gtttctagtggctgtggaaa

SEQ ID NO: 598742 - DNA, 20 bp, mouse
gctaaggtcctcaccacgaa

SEQ ID NO: 598743 - DNA, 20 bp, mouse
gaccaaatgaatgtcgtact

SEQ ID NO: 598744 - DNA, 20 bp, mouse
ggcttctgtccaccccacta

SEQ ID NO: 598745 - DNA, 20 bp, mouse
gatgtctctccatgcacaaa

SEQ ID NO: 598746 - DNA, 20 bp, mouse
ggaggcttatggaggtcgag

SEQ ID NO: 598747 - DNA, 20 bp, mouse
gactgcaaggtgaggggacc

SEQ ID NO: 598748 - DNA, 20 bp, mouse
gagagaaaacatgaggctta

SEQ ID NO: 598749 - DNA, 20 bp, mouse
ggaatcaagacaatcgatac

SEQ ID NO: 598750 - DNA, 20 bp, mouse
gattagaaagtggaaatcag

SEQ ID NO: 598751 - DNA, 20 bp, mouse
gtgcatggagagaaaacatg

SEQ ID NO: 598752 - DNA, 20 bp, mouse
gagaatgacttattagaaag

SEQ ID NO: 598753 - DNA, 20 bp, mouse
ggaaccaaagaataactgca

SEQ ID NO: 598754 - DNA, 20 bp, mouse
ggtcattctacagtagccct

SEQ ID NO: 598755 - DNA, 20 bp, mouse
gctaaggtcctcaccacaaa

SEQ ID NO: 598756 - DNA, 20 bp, mouse
ggaaaacctgagacttacag

SEQ ID NO: 598757 - DNA, 20 bp, mouse
gctcatggagcatttataca

SEQ ID NO: 598758 - DNA, 20 bp, mouse
gatatagtactacatttatt

SEQ ID NO: 598759 - DNA, 20 bp, mouse
gtcactaatctgaagtgttc

SEQ ID NO: 598760 - DNA, 20 bp, mouse
ggagacttacagaggtccag

SEQ ID NO: 598761 - DNA, 20 bp, mouse
gggtgagggggccaataatg

SEQ ID NO: 598762 - DNA, 20 bp, mouse
ggagggggccaataatgggg

SEQ ID NO: 598763 - DNA, 20 bp, mouse
gtgttcagggaggctgtaga

SEQ ID NO: 598764 - DNA, 20 bp, mouse
gcttctgtccaccccattat

SEQ ID NO: 598765 - DNA, 20 bp, mouse
gaatcaacacaattgatcct

SEQ ID NO: 598766 - DNA, 20 bp, mouse
gacctagtactccattaatt

SEQ ID NO: 598767 - DNA, 20 bp, mouse
gctgagtgtcaccaaattaa

SEQ ID NO: 598768 - DNA, 20 bp, mouse
gtttctagtggctggggaat

SEQ ID NO: 598769 - DNA, 20 bp, mouse
gtgaatggtacacacatcca

SEQ ID NO: 598770 - DNA, 20 bp, mouse
ggaggctgtagaaagactca

SEQ ID NO: 598771 - DNA, 20 bp, mouse
gttctgtgaaaaggtcccca

SEQ ID NO: 598772 - DNA, 20 bp, mouse
gtcgatcctgggaaacatga

SEQ ID NO: 598773 - DNA, 20 bp, mouse
gacagtgagtttctgtgaaa

SEQ ID NO: 598774 - DNA, 20 bp, mouse
gctgaaccctcatgtttccc

SEQ ID NO: 598775 - DNA, 20 bp, mouse
ggttattctacagtggccct

SEQ ID NO: 598776 - DNA, 20 bp, mouse
gacgatgccaggcccgggag

SEQ ID NO: 598777 - DNA, 20 bp, mouse
gggaggctggaagctgaagg

SEQ ID NO: 598778 - DNA, 20 bp, mouse
ggaggcacgatgccaggccc

SEQ ID NO: 598779 - DNA, 20 bp, mouse
ggctggaagctgaaggcggt

SEQ ID NO: 598780 - DNA, 20 bp, mouse
ggcggctcaacgtgaccaag

SEQ ID NO: 598781 - DNA, 20 bp, mouse
gtcaacgtgaccaagtggaa

SEQ ID NO: 598782 - DNA, 20 bp, mouse
gtgcggggatccatggtggg

SEQ ID NO: 598783 - DNA, 20 bp, mouse
ggccactaagagccacgaag

SEQ ID NO: 598784 - DNA, 20 bp, mouse
gcgagctggcgtagggagga

SEQ ID NO: 598785 - DNA, 20 bp, mouse
gtgggccccgtggaccgttg

SEQ ID NO: 598786 - DNA, 20 bp, mouse
gaggcacgggccaagttccg

SEQ ID NO: 598787 - DNA, 20 bp, mouse
gcagcgcgcccggcccgcgg

SEQ ID NO: 598788 - DNA, 20 bp, mouse
gtggggacacgagggacgag

SEQ ID NO: 598789 - DNA, 20 bp, mouse
gggacgagggggacgaggtg

SEQ ID NO: 598790 - DNA, 20 bp, mouse
gtgaaactacctgagctggg

SEQ ID NO: 598791 - DNA, 20 bp, mouse
gacaactcccggctagaggt

SEQ ID NO: 598792 - DNA, 20 bp, mouse
gacgagggacgagggggacg

SEQ ID NO: 598793 - DNA, 20 bp, mouse
gagggggacgaggtgaggca

SEQ ID NO: 598794 - DNA, 20 bp, mouse
gtgcgcgcggatcagaactg

SEQ ID NO: 598795 - DNA, 20 bp, mouse
gtcagacgcgtggtccctcc

SEQ ID NO: 598796 - DNA, 20 bp, mouse
gggcactggatgtcatatca

SEQ ID NO: 598797 - DNA, 20 bp, mouse
gttctctctggtgtgctgac

SEQ ID NO: 598798 - DNA, 20 bp, mouse
gcttatctccgagcagtcaa

SEQ ID NO: 598799 - DNA, 20 bp, mouse
gtccgagcagtcaaaggcac

SEQ ID NO: 598800 - DNA, 20 bp, mouse
gcagaaatatatatgaacaa

SEQ ID NO: 598801 - DNA, 20 bp, mouse
gagtggggggtcgcttctaa

SEQ ID NO: 598802 - DNA, 20 bp, mouse
gcttttgtttctgattgggt

SEQ ID NO: 598803 - DNA, 20 bp, mouse
ggggtcgcttctaaaggctg

SEQ ID NO: 598804 - DNA, 20 bp, mouse
gtctgaactcatcgacatca

SEQ ID NO: 598805 - DNA, 20 bp, mouse
gcagacagtgagcaagtttc

SEQ ID NO: 598806 - DNA, 20 bp, mouse
ggagatctcagaagcagcta

SEQ ID NO: 598807 - DNA, 20 bp, mouse
gacctaggcgtgtctccaac

SEQ ID NO: 598808 - DNA, 20 bp, mouse
gatgtcgagaacacaaacct

SEQ ID NO: 598809 - DNA, 20 bp, mouse
ggcaggaaagggagtccgca

SEQ ID NO: 598810 - DNA, 20 bp, mouse
gggaggtggtgaacatgagg

SEQ ID NO: 598811 - DNA, 20 bp, mouse
ggcctgttggagacacgcct

SEQ ID NO: 598812 - DNA, 20 bp, mouse
gcagaggacccagcaaaggg

SEQ ID NO: 598813 - DNA, 20 bp, mouse
gcgttgtggactgtcagcag

SEQ ID NO: 598814 - DNA, 20 bp, mouse
gagggcaaacttcagcctgt

SEQ ID NO: 598815 - DNA, 20 bp, mouse
gacacagaggacccagcaaa

SEQ ID NO: 598816 - DNA, 20 bp, mouse
gggagggcagggccaggcaa

SEQ ID NO: 598817 - DNA, 20 bp, mouse
gaggctggcggactggagag

SEQ ID NO: 598818 - DNA, 20 bp, mouse
gcccgcacagaagacggtag

SEQ ID NO: 598819 - DNA, 20 bp, mouse
gtggagagcggtgaagctaa

SEQ ID NO: 598820 - DNA, 20 bp, mouse
gtggcccgaggctggcggac

SEQ ID NO: 598821 - DNA, 20 bp, mouse
gtaacgggtccaggcgcggg

SEQ ID NO: 598822 - DNA, 20 bp, mouse
gggccaggcaagggcgggac

SEQ ID NO: 598823 - DNA, 20 bp, mouse
gcggtgaagctaacgggtcc

SEQ ID NO: 598824 - DNA, 20 bp, mouse
gagctaacgggtccaggcgc

SEQ ID NO: 598825 - DNA, 20 bp, mouse
gccgctgcccgcacagaaga

SEQ ID NO: 598826 - DNA, 20 bp, mouse
gccagagggagcccaggacg

SEQ ID NO: 598827 - DNA, 20 bp, mouse
gcacgggcgccgccatggtg

SEQ ID NO: 598828 - DNA, 20 bp, mouse
gcgccatggtggggacgcag

SEQ ID NO: 598829 - DNA, 20 bp, mouse
ggagctgcttcggggacgca

SEQ ID NO: 598830 - DNA, 20 bp, mouse
gacagccgaggggaccccag

SEQ ID NO: 598831 - DNA, 20 bp, mouse
gaggcggaccgcaggattgg

SEQ ID NO: 598832 - DNA, 20 bp, mouse
gaggacgcggcaagctgcac

SEQ ID NO: 598833 - DNA, 20 bp, mouse
gccgaggcggaccgcaggat

SEQ ID NO: 598834 - DNA, 20 bp, mouse
gcgccgctgcgtccccacca

SEQ ID NO: 598835 - DNA, 20 bp, mouse
gggcgggaccaccaatcctg

SEQ ID NO: 598836 - DNA, 20 bp, mouse
gggacagggaccgggccgag

SEQ ID NO: 598837 - DNA, 20 bp, mouse
gcggggcagcactggcgcag

SEQ ID NO: 598838 - DNA, 20 bp, mouse
gccggtccctgtcccgggag

SEQ ID NO: 598839 - DNA, 20 bp, mouse
gcaagggacccagctcccca

SEQ ID NO: 598840 - DNA, 20 bp, mouse
ggcaagtccgcctgaagggg

SEQ ID NO: 598841 - DNA, 20 bp, mouse
gccgactggcggggcagcac

SEQ ID NO: 598842 - DNA, 20 bp, mouse
gcgttaggcgccccgactgg

SEQ ID NO: 598843 - DNA, 20 bp, mouse
gctaggacgcaagagcgaca

SEQ ID NO: 598844 - DNA, 20 bp, mouse
gctcccgccacggctcggag

SEQ ID NO: 598845 - DNA, 20 bp, mouse
gcgcgcagctccgatccgtt

SEQ ID NO: 598846 - DNA, 20 bp, mouse
gacgtggcgcagcccccagt

SEQ ID NO: 598847 - DNA, 20 bp, mouse
gcaccggggagcccagatag

SEQ ID NO: 598848 - DNA, 20 bp, mouse
ggtcggcagagcggacaccg

SEQ ID NO: 598849 - DNA, 20 bp, mouse
gggactgtccggggctgaat

SEQ ID NO: 598850 - DNA, 20 bp, mouse
gcccgcgcggatgctgaggg

SEQ ID NO: 598851 - DNA, 20 bp, mouse
gtgtccgctctgccgactgg

SEQ ID NO: 598852 - DNA, 20 bp, mouse
ggctcgcgccaattcagccc

SEQ ID NO: 598853 - DNA, 20 bp, mouse
ggacgtgaagagggccactc

SEQ ID NO: 598854 - DNA, 20 bp, mouse
gcatgctagggagggagcgc

SEQ ID NO: 598855 - DNA, 20 bp, mouse
gtgggcctggggtatcgcaa

SEQ ID NO: 598856 - DNA, 20 bp, mouse
gagagctgtaaggggaacgt

SEQ ID NO: 598857 - DNA, 20 bp, mouse
gcggcgctgagagctgtaag

SEQ ID NO: 598858 - DNA, 20 bp, mouse
ggctgtaaggggaacgttgg

SEQ ID NO: 598859 - DNA, 20 bp, mouse
gagcggagcgaggcgcagtg

SEQ ID NO: 598860 - DNA, 20 bp, mouse
gagcgaggcgcagtgtggcc

SEQ ID NO: 598861 - DNA, 20 bp, mouse
gcgccgggggacccagagtc

SEQ ID NO: 598862 - DNA, 20 bp, mouse
gtccacccctacccccgatg

SEQ ID NO: 598863 - DNA, 20 bp, mouse
gaccgccccgccctaaaggt

SEQ ID NO: 598864 - DNA, 20 bp, mouse
gtgctccttcgccacatcgg

SEQ ID NO: 598865 - DNA, 20 bp, mouse
gcaccgcagaggcatgcaca

SEQ ID NO: 598866 - DNA, 20 bp, mouse
gcgtgtgtgcagcctaggac

SEQ ID NO: 598867 - DNA, 20 bp, mouse
gcagtcgcttagggagccca

SEQ ID NO: 598868 - DNA, 20 bp, mouse
gcacccggactaccaggtaa

SEQ ID NO: 598869 - DNA, 20 bp, mouse
gccagggcccccagatccac

SEQ ID NO: 598870 - DNA, 20 bp, mouse
gccagtcaggctggttgtca

SEQ ID NO: 598871 - DNA, 20 bp, mouse
gtaggcgctctccctcaacc

SEQ ID NO: 598872 - DNA, 20 bp, mouse
gcttaagccagtggatctgg

SEQ ID NO: 598873 - DNA, 20 bp, mouse
gcccactccattctccacag

SEQ ID NO: 598874 - DNA, 20 bp, mouse
gggaagttcgcagcaggtac

SEQ ID NO: 598875 - DNA, 20 bp, mouse
gctcaaagcaaggggctcag

SEQ ID NO: 598876 - DNA, 20 bp, mouse
gagggtacagaggaccggga

SEQ ID NO: 598877 - DNA, 20 bp, mouse
gtagggctccccgtaatgca

SEQ ID NO: 598878 - DNA, 20 bp, mouse
gagcacagatgagggtacag

SEQ ID NO: 598879 - DNA, 20 bp, mouse
gtcgctagcgagcaggctca

SEQ ID NO: 598880 - DNA, 20 bp, mouse
gggttaaaggtgcctgctta

SEQ ID NO: 598881 - DNA, 20 bp, mouse
gtcggcccggcaagatccag

SEQ ID NO: 598882 - DNA, 20 bp, mouse
gcgagcaggctcaaggttaa

SEQ ID NO: 598883 - DNA, 20 bp, mouse
gctcgctagcgacctccaga

SEQ ID NO: 598884 - DNA, 20 bp, mouse
ggtacagaggaccgggaagg

SEQ ID NO: 598885 - DNA, 20 bp, mouse
ggagtgagtccccttgagaa

SEQ ID NO: 598886 - DNA, 20 bp, mouse
gtaggcgctggggagttgat

SEQ ID NO: 598887 - DNA, 20 bp, mouse
gagcgcaggcggggacgctc

SEQ ID NO: 598888 - DNA, 20 bp, mouse
gctgcgggccggagcgctcg

SEQ ID NO: 598889 - DNA, 20 bp, mouse
gtggccgcggggcaagctgc

SEQ ID NO: 598890 - DNA, 20 bp, mouse
ggggccggagcgctcgcggg

SEQ ID NO: 598891 - DNA, 20 bp, mouse
gacctgctggctaggcgctg

SEQ ID NO: 598892 - DNA, 20 bp, mouse
gagggcatccgagagagagt

SEQ ID NO: 598893 - DNA, 20 bp, mouse
gcggcccgcagcttgccccg

SEQ ID NO: 598894 - DNA, 20 bp, mouse
ggccgcgccgccccacgcag

SEQ ID NO: 598895 - DNA, 20 bp, mouse
ggtggccgcggagcttccca

SEQ ID NO: 598896 - DNA, 20 bp, mouse
gctccctcgctctcacctga

SEQ ID NO: 598897 - DNA, 20 bp, mouse
gccatggctggtgagtagta

SEQ ID NO: 598898 - DNA, 20 bp, mouse
gtcagatcgcctgctccttc

SEQ ID NO: 598899 - DNA, 20 bp, mouse
gagagtcacgctaaagggca

SEQ ID NO: 598900 - DNA, 20 bp, mouse
gaagcacaggtgaaaatgag

SEQ ID NO: 598901 - DNA, 20 bp, mouse
gagctaagagtcacgctaaa

SEQ ID NO: 598902 - DNA, 20 bp, mouse
gacaagggaagtcaccccca

SEQ ID NO: 598903 - DNA, 20 bp, mouse
gccaaggtgcctgagacacc

SEQ ID NO: 598904 - DNA, 20 bp, mouse
gggagtcctgtaaagagccc

SEQ ID NO: 598905 - DNA, 20 bp, mouse
ggctccttcaggtgagagcg

SEQ ID NO: 598906 - DNA, 20 bp, mouse
gccactgggacggtcctctc

SEQ ID NO: 598907 - DNA, 20 bp, mouse
gaccgagcccccggccggag

SEQ ID NO: 598908 - DNA, 20 bp, mouse
gtgctcaccgagcccccggc

SEQ ID NO: 598909 - DNA, 20 bp, mouse
gcgcctccgcgggtcccact

SEQ ID NO: 598910 - DNA, 20 bp, mouse
ggtccatgtgagcctggccg

SEQ ID NO: 598911 - DNA, 20 bp, mouse
gtccgcgggtcccactggga

SEQ ID NO: 598912 - DNA, 20 bp, mouse
gcggcagacggggcgcaccc

SEQ ID NO: 598913 - DNA, 20 bp, mouse
gggtgagcagggcggcagac

SEQ ID NO: 598914 - DNA, 20 bp, mouse
gaccgtcccagtgggacccg

SEQ ID NO: 598915 - DNA, 20 bp, mouse
gaccctggagcgactcgaag

SEQ ID NO: 598916 - DNA, 20 bp, mouse
ggctcgctctgcgggaatgt

SEQ ID NO: 598917 - DNA, 20 bp, mouse
ggcgctatggatcgaccctg

SEQ ID NO: 598918 - DNA, 20 bp, mouse
gaccttgaggatgcaggcca

SEQ ID NO: 598919 - DNA, 20 bp, mouse
gccgaggtgcagcgagccac

SEQ ID NO: 598920 - DNA, 20 bp, mouse
gcctcaaggtaacagctcgg

SEQ ID NO: 598921 - DNA, 20 bp, mouse
gacgccaggaagagacgggc

SEQ ID NO: 598922 - DNA, 20 bp, mouse
gagccagccggcagcagtgc

SEQ ID NO: 598923 - DNA, 20 bp, mouse
gggtatagcaggcggagcag

SEQ ID NO: 598924 - DNA, 20 bp, mouse
gtgctccgagacttgggtca

SEQ ID NO: 598925 - DNA, 20 bp, mouse
gcctcggcgcacccagcagg

SEQ ID NO: 598926 - DNA, 20 bp, mouse
gccagtgcgccgggccagag

SEQ ID NO: 598927 - DNA, 20 bp, mouse
gccgggccccgggtaggagg

SEQ ID NO: 598928 - DNA, 20 bp, mouse
gcagcaccgcctcctacccg

SEQ ID NO: 598929 - DNA, 20 bp, mouse
ggaaccgggccccgggtagg

SEQ ID NO: 598930 - DNA, 20 bp, mouse
gaggcctctccatcaccccg

SEQ ID NO: 598931 - DNA, 20 bp, mouse
gtggcccggcgcactggaca

SEQ ID NO: 598932 - DNA, 20 bp, mouse
ggctagagcagcgcagccgg

SEQ ID NO: 598933 - DNA, 20 bp, mouse
gctaccgcggggtgatggag

SEQ ID NO: 598934 - DNA, 20 bp, mouse
gtagcgcccagcttggggag

SEQ ID NO: 598935 - DNA, 20 bp, mouse
gcaccccgcggtagagagtt

SEQ ID NO: 598936 - DNA, 20 bp, mouse
gggcagtgacggcagctgag

SEQ ID NO: 598937 - DNA, 20 bp, mouse
gggagcaggagccgcgggac

SEQ ID NO: 598938 - DNA, 20 bp, mouse
ggcagcgcttcccggtcccg

SEQ ID NO: 598939 - DNA, 20 bp, mouse
gcccggagaggcttccccaa

SEQ ID NO: 598940 - DNA, 20 bp, mouse
gggctgctcagatgctcacc

SEQ ID NO: 598941 - DNA, 20 bp, mouse
ggtggatcgctaagactcgg

SEQ ID NO: 598942 - DNA, 20 bp, mouse
gcgctaagactcggagggtc

SEQ ID NO: 598943 - DNA, 20 bp, mouse
gcagagatagatacccggag

SEQ ID NO: 598944 - DNA, 20 bp, mouse
gtgtgtggatcgctaagact

SEQ ID NO: 598945 - DNA, 20 bp, mouse
gaacaacagactcaccatca

SEQ ID NO: 598946 - DNA, 20 bp, mouse
gcgccgggagccgagaaccg

SEQ ID NO: 598947 - DNA, 20 bp, mouse
ggccagagcggcgcggaccc

SEQ ID NO: 598948 - DNA, 20 bp, mouse
ggcccccgcaccccgtcaca

SEQ ID NO: 598949 - DNA, 20 bp, mouse
gggctcccggcgccatgtga

SEQ ID NO: 598950 - DNA, 20 bp, mouse
gctgggcggccagagcggcg

SEQ ID NO: 598951 - DNA, 20 bp, mouse
ggccatgtgacggggtgcgg

SEQ ID NO: 598952 - DNA, 20 bp, mouse
ggcagagccggggtcaggat

SEQ ID NO: 598953 - DNA, 20 bp, mouse
gtgggtctcggggagccctg

SEQ ID NO: 598954 - DNA, 20 bp, mouse
ggtggggagccgctgataag

SEQ ID NO: 598955 - DNA, 20 bp, mouse
ggcaagcagagtgggtctcg

SEQ ID NO: 598956 - DNA, 20 bp, mouse
gacgtcagtgggtccctcgg

SEQ ID NO: 598957 - DNA, 20 bp, mouse
gagcacgaggaagaaccaca

SEQ ID NO: 598958 - DNA, 20 bp, mouse
ggttacgtcagtgggtccct

SEQ ID NO: 598959 - DNA, 20 bp, mouse
gggttgtcgttgatcctcag

SEQ ID NO: 598960 - DNA, 20 bp, mouse
gccgcgagctgttacgtcag

SEQ ID NO: 598961 - DNA, 20 bp, mouse
gcgccggaagatggccgagg

SEQ ID NO: 598962 - DNA, 20 bp, mouse
gcagcgccggaagatggccg

SEQ ID NO: 598963 - DNA, 20 bp, mouse
gcaccctcaggatgtagacc

SEQ ID NO: 598964 - DNA, 20 bp, mouse
gccacgaaggccaccggcgg

SEQ ID NO: 598965 - DNA, 20 bp, mouse
gcttgtactagtattttagg

SEQ ID NO: 598966 - DNA, 20 bp, mouse
ggcctgccggagccgcaaga

SEQ ID NO: 598967 - DNA, 20 bp, mouse
ggcggacggagactacttcg

SEQ ID NO: 598968 - DNA, 20 bp, mouse
gggagccgcaagatggcgga

SEQ ID NO: 598969 - DNA, 20 bp, mouse
ggtctccgtccgccatcttg

SEQ ID NO: 598970 - DNA, 20 bp, mouse
gtcctgggccgccgagtcca

SEQ ID NO: 598971 - DNA, 20 bp, mouse
gcgctctgagggtcccgctg

SEQ ID NO: 598972 - DNA, 20 bp, mouse
ggcaggcgccgggacctggg

SEQ ID NO: 598973 - DNA, 20 bp, mouse
gcacccgcgcggaactgaca

SEQ ID NO: 598974 - DNA, 20 bp, mouse
gccttcagcgatctagggag

SEQ ID NO: 598975 - DNA, 20 bp, mouse
gcggaagccgcgcgggccgt

SEQ ID NO: 598976 - DNA, 20 bp, mouse
gtggctcccggacgtctgat

SEQ ID NO: 598977 - DNA, 20 bp, mouse
gtcttccaggaccccagccg

SEQ ID NO: 598978 - DNA, 20 bp, mouse
gtcaccgtcgccctcggctg

SEQ ID NO: 598979 - DNA, 20 bp, mouse
ggtcctggaagaggcgcggc

SEQ ID NO: 598980 - DNA, 20 bp, mouse
ggacggtgatgctgcagtaa

SEQ ID NO: 598981 - DNA, 20 bp, mouse
gcacaacccatcagacgtcc

SEQ ID NO: 598982 - DNA, 20 bp, mouse
gccccacgccacggccccag

SEQ ID NO: 598983 - DNA, 20 bp, mouse
gggagcatctctttctggaa

SEQ ID NO: 598984 - DNA, 20 bp, mouse
ggcagcatcaccgtcgccct

SEQ ID NO: 598985 - DNA, 20 bp, mouse
ggccccagaggtcagctaca

SEQ ID NO: 598986 - DNA, 20 bp, mouse
ggggcacacaccctgcgctc

SEQ ID NO: 598987 - DNA, 20 bp, mouse
gaggactcgcccggagcgca

SEQ ID NO: 598988 - DNA, 20 bp, mouse
gcaacagacaagggttgctc

SEQ ID NO: 598989 - DNA, 20 bp, mouse
ggacaagggttgctctggcg

SEQ ID NO: 598990 - DNA, 20 bp, mouse
ggaactgcagctgcatggtg

SEQ ID NO: 598991 - DNA, 20 bp, mouse
gatggggcacgggctcaggg

SEQ ID NO: 598992 - DNA, 20 bp, mouse
gcccgcgcgcgggtcccgga

SEQ ID NO: 598993 - DNA, 20 bp, mouse
gccgccggccaggactcgcc

SEQ ID NO: 598994 - DNA, 20 bp, mouse
ggggcgcggcgcacacaaag

SEQ ID NO: 598995 - DNA, 20 bp, mouse
gggaagaagagatcccgccg

SEQ ID NO: 598996 - DNA, 20 bp, mouse
ggtgtagatggccccaggag

SEQ ID NO: 598997 - DNA, 20 bp, mouse
gcactcagaccgctccactg

SEQ ID NO: 598998 - DNA, 20 bp, mouse
gatcttaggagctaccacag

SEQ ID NO: 598999 - DNA, 20 bp, mouse
gaggagctaccacagtggag

SEQ ID NO: 599000 - DNA, 20 bp, mouse
gcccggtgctcacatagtag

SEQ ID NO: 599001 - DNA, 20 bp, mouse
gagagcagaagctacatctt

SEQ ID NO: 599002 - DNA, 20 bp, mouse
gcccaggagtggcatgattg

SEQ ID NO: 599003 - DNA, 20 bp, mouse
ggaaaaagaggagggtttga

SEQ ID NO: 599004 - DNA, 20 bp, mouse
gggagcggtctgagtgtaga

SEQ ID NO: 599005 - DNA, 20 bp, mouse
gtctgagtgtagatggcccc

SEQ ID NO: 599006 - DNA, 20 bp, mouse
ggctctgcgccgcctccctg

SEQ ID NO: 599007 - DNA, 20 bp, mouse
gaggtcgctaggatgttcag

SEQ ID NO: 599008 - DNA, 20 bp, mouse
gaggcggcgcagagcgaccc

SEQ ID NO: 599009 - DNA, 20 bp, mouse
gaaaagaaacctgagcccca

SEQ ID NO: 599010 - DNA, 20 bp, mouse
gtgggcagcgctggagaacc

SEQ ID NO: 599011 - DNA, 20 bp, mouse
ggtgacaccttgtgcattgg

SEQ ID NO: 599012 - DNA, 20 bp, mouse
gcttctgcagctgggctcgg

SEQ ID NO: 599013 - DNA, 20 bp, mouse
gtgggtgcccgggaaagtcc

SEQ ID NO: 599014 - DNA, 20 bp, mouse
ggcgcagagcgacccgggcc

SEQ ID NO: 599015 - DNA, 20 bp, mouse
gaactgcgcggcagggagct

SEQ ID NO: 599016 - DNA, 20 bp, mouse
gcagaagccgcagcacgaga

SEQ ID NO: 599017 - DNA, 20 bp, mouse
gccctccacgggcagatccg

SEQ ID NO: 599018 - DNA, 20 bp, mouse
ggcgggcgcaatcccggagg

SEQ ID NO: 599019 - DNA, 20 bp, mouse
gagccgcagcacgagagggc

SEQ ID NO: 599020 - DNA, 20 bp, mouse
gggctcagaggatctccacg

SEQ ID NO: 599021 - DNA, 20 bp, mouse
gatccgcggctgcgggacac

SEQ ID NO: 599022 - DNA, 20 bp, mouse
gcccgcgggcgcaatcccgg

SEQ ID NO: 599023 - DNA, 20 bp, mouse
ggaggcggcagcaaaaggac

SEQ ID NO: 599024 - DNA, 20 bp, mouse
ggagaactgcgtggtcaaga

SEQ ID NO: 599025 - DNA, 20 bp, mouse
gcctgccgtcgcccctccac

SEQ ID NO: 599026 - DNA, 20 bp, mouse
gcagcgaccagagcccgcag

SEQ ID NO: 599027 - DNA, 20 bp, mouse
ggcgcgggcccgcactctgg

SEQ ID NO: 599028 - DNA, 20 bp, mouse
gtcgtcgcttgtcctcccgg

SEQ ID NO: 599029 - DNA, 20 bp, mouse
ggcgaaggcggtgaccggag

SEQ ID NO: 599030 - DNA, 20 bp, mouse
gggctccgagcgcctccggg

SEQ ID NO: 599031 - DNA, 20 bp, mouse
gttcaggtgaccccgcgtgg

SEQ ID NO: 599032 - DNA, 20 bp, mouse
gtgaccccgcgtggcggcgg

SEQ ID NO: 599033 - DNA, 20 bp, mouse
gaagcgagcgagcccgaacg

SEQ ID NO: 599034 - DNA, 20 bp, mouse
gaggcgctcggagccgctgc

SEQ ID NO: 599035 - DNA, 20 bp, mouse
gggctcaggatgagatcggg

SEQ ID NO: 599036 - DNA, 20 bp, mouse
ggcagcgagtgaactccaag

SEQ ID NO: 599037 - DNA, 20 bp, mouse
ggggacagtgattgcagcag

SEQ ID NO: 599038 - DNA, 20 bp, mouse
gcgagtgaactccaagaggc

SEQ ID NO: 599039 - DNA, 20 bp, mouse
gcagtgattgcagcagcggc

SEQ ID NO: 599040 - DNA, 20 bp, mouse
gtgagtgggagccagggtca

SEQ ID NO: 599041 - DNA, 20 bp, mouse
gctgagacaaaagtagtgtg

SEQ ID NO: 599042 - DNA, 20 bp, mouse
gactccaagaggcaggcatg

SEQ ID NO: 599043 - DNA, 20 bp, mouse
gccgagggcagacggtgagt

SEQ ID NO: 599044 - DNA, 20 bp, mouse
gagacggtgagtgggagcca

SEQ ID NO: 599045 - DNA, 20 bp, mouse
gcagggtcagggaacaggga

SEQ ID NO: 599046 - DNA, 20 bp, mouse
gtaggaagggaaagtaggtg

SEQ ID NO: 599047 - DNA, 20 bp, mouse
gtcctttccctggttaggaa

SEQ ID NO: 599048 - DNA, 20 bp, mouse
gttctcctggcactcatcag

SEQ ID NO: 599049 - DNA, 20 bp, mouse
gcaactccactgagctcctg

SEQ ID NO: 599050 - DNA, 20 bp, mouse
gccaggaagatgaggattaa

SEQ ID NO: 599051 - DNA, 20 bp, mouse
gtcttttcctttccctggtt

SEQ ID NO: 599052 - DNA, 20 bp, mouse
gagttctggggcttcagttg

SEQ ID NO: 599053 - DNA, 20 bp, mouse
gatcgtgaggtcaccctgag

SEQ ID NO: 599054 - DNA, 20 bp, mouse
gtggtcaaaaagccctacct

SEQ ID NO: 599055 - DNA, 20 bp, mouse
gcagaggagttgaaatcgtg

SEQ ID NO: 599056 - DNA, 20 bp, mouse
gctggtcaggcgaggcccca

SEQ ID NO: 599057 - DNA, 20 bp, mouse
gtggcgcgatggacatcccg

SEQ ID NO: 599058 - DNA, 20 bp, mouse
gtgtccatcgcgccaggcgg

SEQ ID NO: 599059 - DNA, 20 bp, mouse
gtgctggtggacgcaggaga

SEQ ID NO: 599060 - DNA, 20 bp, mouse
ggtacagcgcgcctacactg

SEQ ID NO: 599061 - DNA, 20 bp, mouse
ggtggcgcccgcgaggacag

SEQ ID NO: 599062 - DNA, 20 bp, mouse
gaactgtgttgggcttctgg

SEQ ID NO: 599063 - DNA, 20 bp, mouse
gaggcgcgcgatctccagtg

SEQ ID NO: 599064 - DNA, 20 bp, mouse
gggatgtccatcgcgccagg

SEQ ID NO: 599065 - DNA, 20 bp, mouse
gtccgggtgccagaagagat

SEQ ID NO: 599066 - DNA, 20 bp, mouse
gcccggggtgtgaggaccaa

SEQ ID NO: 599067 - DNA, 20 bp, mouse
gaagttgggaggctaggact

SEQ ID NO: 599068 - DNA, 20 bp, mouse
ggccgccgggtgcaaggctg

SEQ ID NO: 599069 - DNA, 20 bp, mouse
ggccccagccttgcacccgg

SEQ ID NO: 599070 - DNA, 20 bp, mouse
ggaggaccaagggtctgcag

SEQ ID NO: 599071 - DNA, 20 bp, mouse
ggcggaagctggacgacccg

SEQ ID NO: 599072 - DNA, 20 bp, mouse
gagagggtgcggagacccga

SEQ ID NO: 599073 - DNA, 20 bp, mouse
ggacctcctaaatcaaagtt

SEQ ID NO: 599074 - DNA, 20 bp, mouse
gctcctaaatcaaagttggg

SEQ ID NO: 599075 - DNA, 20 bp, mouse
gccggccccagccttgcacc

SEQ ID NO: 599076 - DNA, 20 bp, mouse
gctacccagacagtattagt

SEQ ID NO: 599077 - DNA, 20 bp, mouse
gttggagcctctcaccgtgg

SEQ ID NO: 599078 - DNA, 20 bp, mouse
ggccttggagcctctcaccg

SEQ ID NO: 599079 - DNA, 20 bp, mouse
gtggcagagctgaagtgaca

SEQ ID NO: 599080 - DNA, 20 bp, mouse
gccagacagtattagtaggt

SEQ ID NO: 599081 - DNA, 20 bp, mouse
gagtattagtaggtaggcct

SEQ ID NO: 599082 - DNA, 20 bp, mouse
gactgtctgggtagctggtg

SEQ ID NO: 599083 - DNA, 20 bp, mouse
ggaagaagcccaacagactc

SEQ ID NO: 599084 - DNA, 20 bp, mouse
gagagctgaagtgacagggc

SEQ ID NO: 599085 - DNA, 20 bp, mouse
gtccagaaggtaccagaaag

SEQ ID NO: 599086 - DNA, 20 bp, mouse
gatcctaacccgccatctgg

SEQ ID NO: 599087 - DNA, 20 bp, mouse
ggcgggggccgcgccttcaa

SEQ ID NO: 599088 - DNA, 20 bp, mouse
gggaaaatgccaccagatgg

SEQ ID NO: 599089 - DNA, 20 bp, mouse
gtgccaccagatggcgggtt

SEQ ID NO: 599090 - DNA, 20 bp, mouse
ggagtctgcagcggcgccat

SEQ ID NO: 599091 - DNA, 20 bp, mouse
gaggattgcagctccgttga

SEQ ID NO: 599092 - DNA, 20 bp, mouse
gcggccgacagcgcccggat

SEQ ID NO: 599093 - DNA, 20 bp, mouse
ggccgggggttcgggagcgg

SEQ ID NO: 599094 - DNA, 20 bp, mouse
ggcaatcctaacccgccatc

SEQ ID NO: 599095 - DNA, 20 bp, mouse
gcacctcgggaataacacac

SEQ ID NO: 599096 - DNA, 20 bp, mouse
gccacgcgctggagatgatg

SEQ ID NO: 599097 - DNA, 20 bp, mouse
gcgcgctggagatgatgggg

SEQ ID NO: 599098 - DNA, 20 bp, mouse
gaacagaggctgcctacctg

SEQ ID NO: 599099 - DNA, 20 bp, mouse
ggcaggcagggcccccttcg

SEQ ID NO: 599100 - DNA, 20 bp, mouse
ggctgatccttgccccaggt

SEQ ID NO: 599101 - DNA, 20 bp, mouse
gcatctccagcgcgtggtgg

SEQ ID NO: 599102 - DNA, 20 bp, mouse
ggggcgggggagagaagccg

SEQ ID NO: 599103 - DNA, 20 bp, mouse
ggttgttccctctctaggaa

SEQ ID NO: 599104 - DNA, 20 bp, mouse
ggtagagcttgccccgaagg

SEQ ID NO: 599105 - DNA, 20 bp, mouse
gcttcctcccttcctagaga

SEQ ID NO: 599106 - DNA, 20 bp, mouse
gctcagtggacatcccacct

SEQ ID NO: 599107 - DNA, 20 bp, mouse
gggcgtctcgcgaccgaggt

SEQ ID NO: 599108 - DNA, 20 bp, mouse
gcttaaccgcccgccaccag

SEQ ID NO: 599109 - DNA, 20 bp, mouse
gagacctgaaaggacctctg

SEQ ID NO: 599110 - DNA, 20 bp, mouse
gagaaaggtcaccacctcag

SEQ ID NO: 599111 - DNA, 20 bp, mouse
gatgtccactgagacctgaa

SEQ ID NO: 599112 - DNA, 20 bp, mouse
ggaagaagagcagctgcggc

SEQ ID NO: 599113 - DNA, 20 bp, mouse
gggcgggcgtctcgcgaccg

SEQ ID NO: 599114 - DNA, 20 bp, mouse
ggatgaacacggctgaagaa

SEQ ID NO: 599115 - DNA, 20 bp, mouse
ggggtttccggcctccatag

SEQ ID NO: 599116 - DNA, 20 bp, mouse
gcccaccccagcaacagagg

SEQ ID NO: 599117 - DNA, 20 bp, mouse
gtcacccaccccagcaacag

SEQ ID NO: 599118 - DNA, 20 bp, mouse
gagagggaccctgcactggc

SEQ ID NO: 599119 - DNA, 20 bp, mouse
ggccgccgcctctgttgctg

SEQ ID NO: 599120 - DNA, 20 bp, mouse
gccccgggagagaagaacgt

SEQ ID NO: 599121 - DNA, 20 bp, mouse
gcgaccccgcggcactctag

SEQ ID NO: 599122 - DNA, 20 bp, mouse
gagagtgccgcggggtcgag

SEQ ID NO: 599123 - DNA, 20 bp, mouse
ggcgggctcgcagtctcggg

SEQ ID NO: 599124 - DNA, 20 bp, mouse
ggccgcctctgttgctgggg

SEQ ID NO: 599125 - DNA, 20 bp, mouse
gtaggggtgacggagaaagg

SEQ ID NO: 599126 - DNA, 20 bp, mouse
ggcggcgggtcgcccagctg

SEQ ID NO: 599127 - DNA, 20 bp, mouse
gccgctgggccaagccgtct

SEQ ID NO: 599128 - DNA, 20 bp, mouse
ggccgtctaggaagccgcgg

SEQ ID NO: 599129 - DNA, 20 bp, mouse
gcaagccgtctaggaagccg

SEQ ID NO: 599130 - DNA, 20 bp, mouse
gaccccggcggagagcgaag

SEQ ID NO: 599131 - DNA, 20 bp, mouse
ggactccgactgccccagct

SEQ ID NO: 599132 - DNA, 20 bp, mouse
gacgggttggcagtgaacag

SEQ ID NO: 599133 - DNA, 20 bp, mouse
gcggagtcccgccagagcgt

SEQ ID NO: 599134 - DNA, 20 bp, mouse
gcccgccgcggcttcctaga

SEQ ID NO: 599135 - DNA, 20 bp, mouse
ggagctgaatcccgacgctc

SEQ ID NO: 599136 - DNA, 20 bp, mouse
gagagtgggcgtgtcatcgg

SEQ ID NO: 599137 - DNA, 20 bp, mouse
gccttcacgaaaggtgggaa

SEQ ID NO: 599138 - DNA, 20 bp, mouse
gaagggtcccgggaatgcag

SEQ ID NO: 599139 - DNA, 20 bp, mouse
ggtcatccttcacgaaaggt

SEQ ID NO: 599140 - DNA, 20 bp, mouse
gccagtcccgctgcattccc

SEQ ID NO: 599141 - DNA, 20 bp, mouse
ggactgtcatccttcacgaa

SEQ ID NO: 599142 - DNA, 20 bp, mouse
ggcgagagtgggcgtgtcat

SEQ ID NO: 599143 - DNA, 20 bp, mouse
gctggcagcgcccatctaga

SEQ ID NO: 599144 - DNA, 20 bp, mouse
ggagtggctcgggacaacat

SEQ ID NO: 599145 - DNA, 20 bp, mouse
gtcctccagaagccatcgag

SEQ ID NO: 599146 - DNA, 20 bp, mouse
gtgctgcggcagagattcag

SEQ ID NO: 599147 - DNA, 20 bp, mouse
gtctctgccgcagcaacgta

SEQ ID NO: 599148 - DNA, 20 bp, mouse
gaaaacaacgcacaggccaa

SEQ ID NO: 599149 - DNA, 20 bp, mouse
ggcagagattcagaggccat

SEQ ID NO: 599150 - DNA, 20 bp, mouse
gcggctgctccgcaaggcac

SEQ ID NO: 599151 - DNA, 20 bp, mouse
gttcattccctacgttgctg

SEQ ID NO: 599152 - DNA, 20 bp, mouse
gcccttgcaaaacaacgcac

SEQ ID NO: 599153 - DNA, 20 bp, mouse
gtctgcagcccgggcggcag

SEQ ID NO: 599154 - DNA, 20 bp, mouse
gttgttttgcaagggagctg

SEQ ID NO: 599155 - DNA, 20 bp, mouse
gaggcaccggcgcttggtga

SEQ ID NO: 599156 - DNA, 20 bp, mouse
gaaatctccgtagtgttgag

SEQ ID NO: 599157 - DNA, 20 bp, mouse
gtaattgtaaccctgaacat

SEQ ID NO: 599158 - DNA, 20 bp, mouse
gtgcgaggggcaggtttcgg

SEQ ID NO: 599159 - DNA, 20 bp, mouse
gaacccaaacagaaacgagg

SEQ ID NO: 599160 - DNA, 20 bp, mouse
gggagatttcggtttttttg

SEQ ID NO: 599161 - DNA, 20 bp, mouse
gttcctggaagatcctgcga

SEQ ID NO: 599162 - DNA, 20 bp, mouse
gtattgtctacacacttacc

SEQ ID NO: 599163 - DNA, 20 bp, mouse
gtgataagtgccaatgttca

SEQ ID NO: 599164 - DNA, 20 bp, mouse
ggtcaaacggtctgatcacc

SEQ ID NO: 599165 - DNA, 20 bp, mouse
ggcccctcgcaggatcttcc

SEQ ID NO: 599166 - DNA, 20 bp, mouse
gggaccccggggtggactca

SEQ ID NO: 599167 - DNA, 20 bp, mouse
ggactgaggctcctactgaa

SEQ ID NO: 599168 - DNA, 20 bp, mouse
gactgaaaggacagggaccc

SEQ ID NO: 599169 - DNA, 20 bp, mouse
gctttgagcttgggaccccg

SEQ ID NO: 599170 - DNA, 20 bp, mouse
gaggtgacctcggttcagag

SEQ ID NO: 599171 - DNA, 20 bp, mouse
gacagtgggacagcacctag

SEQ ID NO: 599172 - DNA, 20 bp, mouse
gcctcagtctggccaggaag

SEQ ID NO: 599173 - DNA, 20 bp, mouse
gaaaggacagggacccaggc

SEQ ID NO: 599174 - DNA, 20 bp, mouse
gcacagccctgagtccaccc

SEQ ID NO: 599175 - DNA, 20 bp, mouse
gtaggagcctcagtctggcc

SEQ ID NO: 599176 - DNA, 20 bp, mouse
gtgagtgctgaggtgctcaa

SEQ ID NO: 599177 - DNA, 20 bp, mouse
gcaggactcaggaccttgaa

SEQ ID NO: 599178 - DNA, 20 bp, mouse
gtcaggaccttgaaaggctc

SEQ ID NO: 599179 - DNA, 20 bp, mouse
gccaggctcccccagttaag

SEQ ID NO: 599180 - DNA, 20 bp, mouse
ggtcctgagtcctgcagctg

SEQ ID NO: 599181 - DNA, 20 bp, mouse
gcctgaggtccagagaagaa

SEQ ID NO: 599182 - DNA, 20 bp, mouse
ggttttgtgggaaagctctt

SEQ ID NO: 599183 - DNA, 20 bp, mouse
gatagctgggatcgaagctg

SEQ ID NO: 599184 - DNA, 20 bp, mouse
gtgggaaagctcttgggcag

SEQ ID NO: 599185 - DNA, 20 bp, mouse
gccagttaagaggcatagct

SEQ ID NO: 599186 - DNA, 20 bp, mouse
gagccccgagcctagcggga

SEQ ID NO: 599187 - DNA, 20 bp, mouse
gccggcagagaagcccgcac

SEQ ID NO: 599188 - DNA, 20 bp, mouse
gcgggagccccgagcctagc

SEQ ID NO: 599189 - DNA, 20 bp, mouse
ggagcctagcgggagggagg

SEQ ID NO: 599190 - DNA, 20 bp, mouse
gaaataccgagcgaggcgag

SEQ ID NO: 599191 - DNA, 20 bp, mouse
ggcctggaaaataccgagcg

SEQ ID NO: 599192 - DNA, 20 bp, mouse
gacctcatacttccctggag

SEQ ID NO: 599193 - DNA, 20 bp, mouse
gagagctcgcacaccggccc

SEQ ID NO: 599194 - DNA, 20 bp, mouse
gggcggaagagctcgcacac

SEQ ID NO: 599195 - DNA, 20 bp, mouse
ggagccgggcgggactctgg

SEQ ID NO: 599196 - DNA, 20 bp, mouse
ggagccaccggcagctgagg

SEQ ID NO: 599197 - DNA, 20 bp, mouse
gcctggggctccattgactg

SEQ ID NO: 599198 - DNA, 20 bp, mouse
gggtctgtggctctctcctg

SEQ ID NO: 599199 - DNA, 20 bp, mouse
gctgccacctcagctgccgg

SEQ ID NO: 599200 - DNA, 20 bp, mouse
ggaagagccaccggcagctg

SEQ ID NO: 599201 - DNA, 20 bp, mouse
ggcacctggctgaacatctc

SEQ ID NO: 599202 - DNA, 20 bp, mouse
gatcctgtagggagagcgtc

SEQ ID NO: 599203 - DNA, 20 bp, mouse
gaggatccggctcatcctgt

SEQ ID NO: 599204 - DNA, 20 bp, mouse
ggggctccattgactgaggc

SEQ ID NO: 599205 - DNA, 20 bp, mouse
ggtgatggcgtgctaggatc

SEQ ID NO: 599206 - DNA, 20 bp, mouse
gaggccgtggagcgggactg

SEQ ID NO: 599207 - DNA, 20 bp, mouse
ggcggaaggagagctcccgg

SEQ ID NO: 599208 - DNA, 20 bp, mouse
gcagccgcagtcccgctcca

SEQ ID NO: 599209 - DNA, 20 bp, mouse
gctgaggagttgccaggccg

SEQ ID NO: 599210 - DNA, 20 bp, mouse
gcgcgcagcagcgagtggag

SEQ ID NO: 599211 - DNA, 20 bp, mouse
gtccgctctgaggagttgcc

SEQ ID NO: 599212 - DNA, 20 bp, mouse
gacgtcctccggaccctctc

SEQ ID NO: 599213 - DNA, 20 bp, mouse
ggaaacagcgggtggcagag

SEQ ID NO: 599214 - DNA, 20 bp, mouse
ggcggaacccggagcgcgag

SEQ ID NO: 599215 - DNA, 20 bp, mouse
gaagcaggtgggttgtgcgg

SEQ ID NO: 599216 - DNA, 20 bp, mouse
gctcgcgccgcggaggaggt

SEQ ID NO: 599217 - DNA, 20 bp, mouse
ggcccgccggcctgcagaca

SEQ ID NO: 599218 - DNA, 20 bp, mouse
gcggagccgtgtctgcaggc

SEQ ID NO: 599219 - DNA, 20 bp, mouse
gagccgtgtctgcaggccgg

SEQ ID NO: 599220 - DNA, 20 bp, mouse
gcttcacgacctgcccagca

SEQ ID NO: 599221 - DNA, 20 bp, mouse
gcggcaaaccctggaacctc

SEQ ID NO: 599222 - DNA, 20 bp, mouse
gtcccggtgagtgtgggtgt

SEQ ID NO: 599223 - DNA, 20 bp, mouse
ggcggctcgcgccgcggagg

SEQ ID NO: 599224 - DNA, 20 bp, mouse
gcggcgggcggctcgcgccg

SEQ ID NO: 599225 - DNA, 20 bp, mouse
ggtgcagccgcggaacgcgg

SEQ ID NO: 599226 - DNA, 20 bp, mouse
gcctctggtacgggacagga

SEQ ID NO: 599227 - DNA, 20 bp, mouse
gcgtaccagaggatgtcagg

SEQ ID NO: 599228 - DNA, 20 bp, mouse
gggctcgcggcccttgaata

SEQ ID NO: 599229 - DNA, 20 bp, mouse
gcgggagctgccctattcaa

SEQ ID NO: 599230 - DNA, 20 bp, mouse
gctggtacgggacaggaagg

SEQ ID NO: 599231 - DNA, 20 bp, mouse
gggtcaacaactccaggaaa

SEQ ID NO: 599232 - DNA, 20 bp, mouse
gtcaggcggtcaacaactcc

SEQ ID NO: 599233 - DNA, 20 bp, mouse
gacgcgcggggttgcaggag

SEQ ID NO: 599234 - DNA, 20 bp, mouse
gacatcctctggtacgggac

SEQ ID NO: 599235 - DNA, 20 bp, mouse
gttgaccgcctgacatcctc

SEQ ID NO: 599236 - DNA, 20 bp, mouse
gcagctgggagcctgcacgt

SEQ ID NO: 599237 - DNA, 20 bp, mouse
gctcttgcgtggcccaggac

SEQ ID NO: 599238 - DNA, 20 bp, mouse
gcagggtgcggataatctcg

SEQ ID NO: 599239 - DNA, 20 bp, mouse
gtccgcaccctggaccccag

SEQ ID NO: 599240 - DNA, 20 bp, mouse
gctgggagcctgcacgttgg

SEQ ID NO: 599241 - DNA, 20 bp, mouse
gagcctgcacgttggcggaa

SEQ ID NO: 599242 - DNA, 20 bp, mouse
gcaccctggaccccagaggt

SEQ ID NO: 599243 - DNA, 20 bp, mouse
ggctcccagctgtgccacac

SEQ ID NO: 599244 - DNA, 20 bp, mouse
gtcgggctggaagaagtgtc

SEQ ID NO: 599245 - DNA, 20 bp, mouse
gggcggaatggacccgtcct

SEQ ID NO: 599246 - DNA, 20 bp, mouse
gtgcggcccggcgccatgtt

SEQ ID NO: 599247 - DNA, 20 bp, mouse
gcaggcgccgggagggatgg

SEQ ID NO: 599248 - DNA, 20 bp, mouse
gcgggcgtccggccttcctg

SEQ ID NO: 599249 - DNA, 20 bp, mouse
ggcgtccggccttcctgcgg

SEQ ID NO: 599250 - DNA, 20 bp, mouse
gataagggcccggcatctga

SEQ ID NO: 599251 - DNA, 20 bp, mouse
gagcccggcgaagagttcag

SEQ ID NO: 599252 - DNA, 20 bp, mouse
gagggcgcatgtgtagtacc

SEQ ID NO: 599253 - DNA, 20 bp, mouse
ggcccggcgccatgttgggt

SEQ ID NO: 599254 - DNA, 20 bp, mouse
gattgcgccgggaagagcag

SEQ ID NO: 599255 - DNA, 20 bp, mouse
ggtagtaccaggcgccggga

SEQ ID NO: 599256 - DNA, 20 bp, mouse
gcagggcgcgggaagcaaag

SEQ ID NO: 599257 - DNA, 20 bp, mouse
gcggcgcgagaggcggacac

SEQ ID NO: 599258 - DNA, 20 bp, mouse
ggcggggccccggagaggaa

SEQ ID NO: 599259 - DNA, 20 bp, mouse
gcaggcgcgggaatccacag

SEQ ID NO: 599260 - DNA, 20 bp, mouse
ggcgcaggcccgtcacgaag

SEQ ID NO: 599261 - DNA, 20 bp, mouse
ggaggcggacacaggcgcac

SEQ ID NO: 599262 - DNA, 20 bp, mouse
ggcgcactcggcgcgagagg

SEQ ID NO: 599263 - DNA, 20 bp, mouse
gctgccgcggggccccggag

SEQ ID NO: 599264 - DNA, 20 bp, mouse
gcacgggaccgcttctgctg

SEQ ID NO: 599265 - DNA, 20 bp, mouse
gccaggcccacccttctcta

SEQ ID NO: 599266 - DNA, 20 bp, mouse
gaagacacgcgtggagccag

SEQ ID NO: 599267 - DNA, 20 bp, mouse
gagcatagtctagttgacaa

SEQ ID NO: 599268 - DNA, 20 bp, mouse
gcgcgtggagccaggggtaa

SEQ ID NO: 599269 - DNA, 20 bp, mouse
gaagggctggagcgccacag

SEQ ID NO: 599270 - DNA, 20 bp, mouse
gaactgccaggagagcagaa

SEQ ID NO: 599271 - DNA, 20 bp, mouse
gggcagccgcgtccacacag

SEQ ID NO: 599272 - DNA, 20 bp, mouse
ggtgcagccggcacaatcag

SEQ ID NO: 599273 - DNA, 20 bp, mouse
gtggctcgcacctttacccc

SEQ ID NO: 599274 - DNA, 20 bp, mouse
gtaggaggcaagcgcgggca

SEQ ID NO: 599275 - DNA, 20 bp, mouse
gccctctctccgaacctgcg

SEQ ID NO: 599276 - DNA, 20 bp, mouse
gagcgaacagacccagccac

SEQ ID NO: 599277 - DNA, 20 bp, mouse
gggtccggcggaagcatccc

SEQ ID NO: 599278 - DNA, 20 bp, mouse
ggacccacacagcggtccgg

SEQ ID NO: 599279 - DNA, 20 bp, mouse
gcgccagtccaccctgagga

SEQ ID NO: 599280 - DNA, 20 bp, mouse
gttccgccggaccgctgtgt

SEQ ID NO: 599281 - DNA, 20 bp, mouse
ggttcgctggacgccggcca

SEQ ID NO: 599282 - DNA, 20 bp, mouse
gtcttgcagtgcctgtggct

SEQ ID NO: 599283 - DNA, 20 bp, mouse
gtccacgccagtccaccctg

SEQ ID NO: 599284 - DNA, 20 bp, mouse
gcggccagggatgcttccgc

SEQ ID NO: 599285 - DNA, 20 bp, mouse
ggtcgggaggcgcgtgggac

SEQ ID NO: 599286 - DNA, 20 bp, mouse
ggcggtcccggaggtctcca

SEQ ID NO: 599287 - DNA, 20 bp, mouse
gtgtcccaagtgggtctgag

SEQ ID NO: 599288 - DNA, 20 bp, mouse
gcacttgggacactgctgag

SEQ ID NO: 599289 - DNA, 20 bp, mouse
ggggatgacaggtcacctgt

SEQ ID NO: 599290 - DNA, 20 bp, mouse
ggcgcccctcagacccactt

SEQ ID NO: 599291 - DNA, 20 bp, mouse
gcacgcaggagctcgagtct

SEQ ID NO: 599292 - DNA, 20 bp, mouse
gcagggagctttgacagact

SEQ ID NO: 599293 - DNA, 20 bp, mouse
gggtctgaggggcgcggtcc

SEQ ID NO: 599294 - DNA, 20 bp, mouse
gagaccccaggtccgaggag

SEQ ID NO: 599295 - DNA, 20 bp, mouse
gccaagcagcgccaagagtt

SEQ ID NO: 599296 - DNA, 20 bp, mouse
gggaccaagatagcgaacag

SEQ ID NO: 599297 - DNA, 20 bp, mouse
gcttggtccgccggagtcgg

SEQ ID NO: 599298 - DNA, 20 bp, mouse
gaacagcggaatgggtcacc

SEQ ID NO: 599299 - DNA, 20 bp, mouse
gtctacaggggcatcacccg

SEQ ID NO: 599300 - DNA, 20 bp, mouse
ggcagaagccttgtctacag

SEQ ID NO: 599301 - DNA, 20 bp, mouse
gttccaccctcccccgactc

SEQ ID NO: 599302 - DNA, 20 bp, mouse
gcaccctcccccgactccgg

SEQ ID NO: 599303 - DNA, 20 bp, mouse
gaagatagcgaacagcggaa

SEQ ID NO: 599304 - DNA, 20 bp, mouse
gcggcgttccgggatcggtg

SEQ ID NO: 599305 - DNA, 20 bp, mouse
gggaatggatcacccggctg

SEQ ID NO: 599306 - DNA, 20 bp, mouse
gagccctaaccggatcgctg

SEQ ID NO: 599307 - DNA, 20 bp, mouse
ggcggtcaggcgacaccgag

SEQ ID NO: 599308 - DNA, 20 bp, mouse
gcggagctgcagtgtagaca

SEQ ID NO: 599309 - DNA, 20 bp, mouse
ggggttgtacctcagcgatc

SEQ ID NO: 599310 - DNA, 20 bp, mouse
gggagggaacgagccctaac

SEQ ID NO: 599311 - DNA, 20 bp, mouse
gtacctcagcgatccggtta

SEQ ID NO: 599312 - DNA, 20 bp, mouse
gtggcctctcctagccgacg

SEQ ID NO: 599313 - DNA, 20 bp, mouse
gtctcctagccgacgcggtc

SEQ ID NO: 599314 - DNA, 20 bp, mouse
gacctggggttccgacgtcg

SEQ ID NO: 599315 - DNA, 20 bp, mouse
gcatggggcaggaggatagg

SEQ ID NO: 599316 - DNA, 20 bp, mouse
gcctagaggaatggcgtcag

SEQ ID NO: 599317 - DNA, 20 bp, mouse
gtctctctccgtccaggtag

SEQ ID NO: 599318 - DNA, 20 bp, mouse
gcagcggctgtggaccctga

SEQ ID NO: 599319 - DNA, 20 bp, mouse
ggcacaggaaagcctcaagt

SEQ ID NO: 599320 - DNA, 20 bp, mouse
gggaatggcgtcagcggctg

SEQ ID NO: 599321 - DNA, 20 bp, mouse
gtgcaaatcccctagaggaa

SEQ ID NO: 599322 - DNA, 20 bp, mouse
gaagtcagaatcggccttca

SEQ ID NO: 599323 - DNA, 20 bp, mouse
ggctctctctctctccgtcc

SEQ ID NO: 599324 - DNA, 20 bp, mouse
gagaaatgcaaatcccctag

SEQ ID NO: 599325 - DNA, 20 bp, mouse
gctgaaggagggagaagtcg

SEQ ID NO: 599326 - DNA, 20 bp, mouse
gggcttctgacggctcctga

SEQ ID NO: 599327 - DNA, 20 bp, mouse
gtcctgacggctcttgacgg

SEQ ID NO: 599328 - DNA, 20 bp, mouse
gggctcctgacggctcttga

SEQ ID NO: 599329 - DNA, 20 bp, mouse
ggcgctccgcagcaccaggt

SEQ ID NO: 599330 - DNA, 20 bp, mouse
gtccgcagcaccaggtgggt

SEQ ID NO: 599331 - DNA, 20 bp, mouse
ggcgcgtggacagaggatct

SEQ ID NO: 599332 - DNA, 20 bp, mouse
gcgcgccgcgggcggagtca

SEQ ID NO: 599333 - DNA, 20 bp, mouse
ggccgccgtcaagagccgtc

SEQ ID NO: 599334 - DNA, 20 bp, mouse
gtcagagggagcagggacaa

SEQ ID NO: 599335 - DNA, 20 bp, mouse
gtcgagggcggaggcaagga

SEQ ID NO: 599336 - DNA, 20 bp, mouse
ggccccggcgggaggagagt

SEQ ID NO: 599337 - DNA, 20 bp, mouse
gccggcgggaggagagtcgg

SEQ ID NO: 599338 - DNA, 20 bp, mouse
ggagaccgctggctctggtg

SEQ ID NO: 599339 - DNA, 20 bp, mouse
ggacgcgcggaggtcctgca

SEQ ID NO: 599340 - DNA, 20 bp, mouse
gcggaggtcctgcacgggga

SEQ ID NO: 599341 - DNA, 20 bp, mouse
gcggcccaagccgtcacccc

SEQ ID NO: 599342 - DNA, 20 bp, mouse
gcggtccccgcccggggtga

SEQ ID NO: 599343 - DNA, 20 bp, mouse
ggctctggtggggcagaacg

SEQ ID NO: 599344 - DNA, 20 bp, mouse
gccgcccggggtgacggctt

SEQ ID NO: 599345 - DNA, 20 bp, mouse
gcggagcctgagcgcgagag

SEQ ID NO: 599346 - DNA, 20 bp, mouse
ggcttgggcagccaggctag

SEQ ID NO: 599347 - DNA, 20 bp, mouse
ggtgaccaggcactgcgcag

SEQ ID NO: 599348 - DNA, 20 bp, mouse
gctcctgcttctaacggctt

SEQ ID NO: 599349 - DNA, 20 bp, mouse
gacactcgttcactgctcac

SEQ ID NO: 599350 - DNA, 20 bp, mouse
gagtgctagaaaggtagcga

SEQ ID NO: 599351 - DNA, 20 bp, mouse
gcttctaacggcttgggctt

SEQ ID NO: 599352 - DNA, 20 bp, mouse
gcagagtcccagtgctagaa

SEQ ID NO: 599353 - DNA, 20 bp, mouse
gctgggactctgccatcaaa

SEQ ID NO: 599354 - DNA, 20 bp, mouse
ggctagaaaggtagcgaagg

SEQ ID NO: 599355 - DNA, 20 bp, mouse
gtcactggctgcgatgttac

SEQ ID NO: 599356 - DNA, 20 bp, mouse
gagccggaaacagcaggccg

SEQ ID NO: 599357 - DNA, 20 bp, mouse
ggcacgcacgcactcgtctc

SEQ ID NO: 599358 - DNA, 20 bp, mouse
gagtagggaaggttatgggg

SEQ ID NO: 599359 - DNA, 20 bp, mouse
ggtttacagtgaagaaggcc

SEQ ID NO: 599360 - DNA, 20 bp, mouse
gtggtagtgccctctgagag

SEQ ID NO: 599361 - DNA, 20 bp, mouse
ggagggagaagatagcagcg

SEQ ID NO: 599362 - DNA, 20 bp, mouse
gacagacctacagacccatg

SEQ ID NO: 599363 - DNA, 20 bp, mouse
gcagcggggctgctgaggtg

SEQ ID NO: 599364 - DNA, 20 bp, mouse
gccttcttcactgtaaaccc

SEQ ID NO: 599365 - DNA, 20 bp, mouse
gactttcgaaggactcgggt

SEQ ID NO: 599366 - DNA, 20 bp, mouse
gaggccggggctcagaagaa

SEQ ID NO: 599367 - DNA, 20 bp, mouse
gggcgggcgccgccaggccg

SEQ ID NO: 599368 - DNA, 20 bp, mouse
gaccgaccagaggagggaag

SEQ ID NO: 599369 - DNA, 20 bp, mouse
gaaagggaccgaccagagga

SEQ ID NO: 599370 - DNA, 20 bp, mouse
gcttctgagccccggcctgg

SEQ ID NO: 599371 - DNA, 20 bp, mouse
gcagcgcaaacgctgaagag

SEQ ID NO: 599372 - DNA, 20 bp, mouse
ggcctggcaggaagtgacgg

SEQ ID NO: 599373 - DNA, 20 bp, mouse
gggaaaaagggaccgaccag

SEQ ID NO: 599374 - DNA, 20 bp, mouse
gccggcacagggcccacgag

SEQ ID NO: 599375 - DNA, 20 bp, mouse
gggaagaggcggagtggcgg

SEQ ID NO: 599376 - DNA, 20 bp, mouse
gccggcagacggctccacat

SEQ ID NO: 599377 - DNA, 20 bp, mouse
ggccgtacaggtgtccgcag

SEQ ID NO: 599378 - DNA, 20 bp, mouse
gaggagggagcaggcggcgt

SEQ ID NO: 599379 - DNA, 20 bp, mouse
gtctggagcgctcgcccatg

SEQ ID NO: 599380 - DNA, 20 bp, mouse
ggtggcccgcaggtaaatcc

SEQ ID NO: 599381 - DNA, 20 bp, mouse
gggcggcgtcggcggagctc

SEQ ID NO: 599382 - DNA, 20 bp, mouse
ggcgcggcgggagcgcaggg

SEQ ID NO: 599383 - DNA, 20 bp, mouse
gcctgcgggccacggacgcc

SEQ ID NO: 599384 - DNA, 20 bp, mouse
gctgcgaactaggaccgtga

SEQ ID NO: 599385 - DNA, 20 bp, mouse
gtagttcgcaggaggctcgg

SEQ ID NO: 599386 - DNA, 20 bp, mouse
gagacccccgccgaccagca

SEQ ID NO: 599387 - DNA, 20 bp, mouse
gtctggtcagccctgctggt

SEQ ID NO: 599388 - DNA, 20 bp, mouse
ggtctccccgcagcagccac

SEQ ID NO: 599389 - DNA, 20 bp, mouse
gagctggagcgctcatcctg

SEQ ID NO: 599390 - DNA, 20 bp, mouse
ggctgaccagacggcgccca

SEQ ID NO: 599391 - DNA, 20 bp, mouse
gcagccctgctggtcggcgg

SEQ ID NO: 599392 - DNA, 20 bp, mouse
gctgctgcggggagactctg

SEQ ID NO: 599393 - DNA, 20 bp, mouse
gttggagaccagctcccgat

SEQ ID NO: 599394 - DNA, 20 bp, mouse
ggactacgagccccagtgca

SEQ ID NO: 599395 - DNA, 20 bp, mouse
gtggtcggcgggggtctagc

SEQ ID NO: 599396 - DNA, 20 bp, mouse
gatgttggcacgcctcacag

SEQ ID NO: 599397 - DNA, 20 bp, mouse
ggcagctgcagcgcacgagg

SEQ ID NO: 599398 - DNA, 20 bp, mouse
gcgccacccgggattttctg

SEQ ID NO: 599399 - DNA, 20 bp, mouse
gagccccagaaaatcccggg

SEQ ID NO: 599400 - DNA, 20 bp, mouse
gggcccaagagctgcaccca

SEQ ID NO: 599401 - DNA, 20 bp, mouse
gagtagagagagccgctgtg

SEQ ID NO: 599402 - DNA, 20 bp, mouse
ggtgagccccagaaaatccc

SEQ ID NO: 599403 - DNA, 20 bp, mouse
gcccggcttgagtgaagatg

SEQ ID NO: 599404 - DNA, 20 bp, mouse
gaaagtgagagaggcaaatg

SEQ ID NO: 599405 - DNA, 20 bp, mouse
gcttcactcaagccgggaga

SEQ ID NO: 599406 - DNA, 20 bp, mouse
gtctccagagagctacggga

SEQ ID NO: 599407 - DNA, 20 bp, mouse
ggcgccctcccgtagctctc

SEQ ID NO: 599408 - DNA, 20 bp, mouse
gctctggagagcatgtgacc

SEQ ID NO: 599409 - DNA, 20 bp, mouse
gtgcccggcgatagcaggga

SEQ ID NO: 599410 - DNA, 20 bp, mouse
gtgctatcgccgggcactcg

SEQ ID NO: 599411 - DNA, 20 bp, mouse
gctcgccgcggctcggatag

SEQ ID NO: 599412 - DNA, 20 bp, mouse
gccctgcgccgggtccaagg

SEQ ID NO: 599413 - DNA, 20 bp, mouse
ggagctgccgggggagaaca

SEQ ID NO: 599414 - DNA, 20 bp, mouse
gcgcggcgcggctaacggcc

SEQ ID NO: 599415 - DNA, 20 bp, mouse
gcagaaccatgtgtgcggag

SEQ ID NO: 599416 - DNA, 20 bp, mouse
gtgggactgggagtccgtcc

SEQ ID NO: 599417 - DNA, 20 bp, mouse
gaacgagactcgggactcac

SEQ ID NO: 599418 - DNA, 20 bp, mouse
ggcttctccgtgggacccga

SEQ ID NO: 599419 - DNA, 20 bp, mouse
gcggcctgcgaacgagactc

SEQ ID NO: 599420 - DNA, 20 bp, mouse
ggcctcgccgtcgggtccca

SEQ ID NO: 599421 - DNA, 20 bp, mouse
ggactcaccggcttctccgt

SEQ ID NO: 599422 - DNA, 20 bp, mouse
gcgagattcgggctccgcgt

SEQ ID NO: 599423 - DNA, 20 bp, mouse
gtccgtgggacccgacggcg

SEQ ID NO: 599424 - DNA, 20 bp, mouse
ggaggcgctcgctgcccgga

SEQ ID NO: 599425 - DNA, 20 bp, mouse
gagattcccaaggcccgcgg

SEQ ID NO: 599426 - DNA, 20 bp, mouse
gggcgggaggagcactccgt

SEQ ID NO: 599427 - DNA, 20 bp, mouse
gtcgggggcaggaggagctt

SEQ ID NO: 599428 - DNA, 20 bp, mouse
ggagggcccgccgagctccc

SEQ ID NO: 599429 - DNA, 20 bp, mouse
ggcggcgcggtccggctcgg

SEQ ID NO: 599430 - DNA, 20 bp, mouse
gcgtaggcccgggagctcgg

SEQ ID NO: 599431 - DNA, 20 bp, mouse
gaggagcactccgtaggccc

SEQ ID NO: 599432 - DNA, 20 bp, mouse
gctcggagaagagggcgtgg

SEQ ID NO: 599433 - DNA, 20 bp, mouse
gcctcggcgcgggggagcca

SEQ ID NO: 599434 - DNA, 20 bp, mouse
ggagcgtggctcggagaaga

SEQ ID NO: 599435 - DNA, 20 bp, mouse
gagctctgggaagaccgacg

SEQ ID NO: 599436 - DNA, 20 bp, mouse
gccgcgacctgcagctgcca

SEQ ID NO: 599437 - DNA, 20 bp, mouse
gtccaagcggccggctgccg

SEQ ID NO: 599438 - DNA, 20 bp, mouse
gaaagcacgcgagcgtgccg

SEQ ID NO: 599439 - DNA, 20 bp, mouse
gacgcgagcgtgccggggca

SEQ ID NO: 599440 - DNA, 20 bp, mouse
gcaaggctcctccaagcggc

SEQ ID NO: 599441 - DNA, 20 bp, mouse
gagttcaggactgccccgga

SEQ ID NO: 599442 - DNA, 20 bp, mouse
ggcatgctacaagggtccta

SEQ ID NO: 599443 - DNA, 20 bp, mouse
gcctagaaccaagccacgtg

SEQ ID NO: 599444 - DNA, 20 bp, mouse
gtcaggactgccccggaggg

SEQ ID NO: 599445 - DNA, 20 bp, mouse
gcacagcaggcatgctacaa

SEQ ID NO: 599446 - DNA, 20 bp, mouse
gggtctggcgcggctgcggt

SEQ ID NO: 599447 - DNA, 20 bp, mouse
gtggagccagcgcagagcac

SEQ ID NO: 599448 - DNA, 20 bp, mouse
gcagtaaagtgacccacctg

SEQ ID NO: 599449 - DNA, 20 bp, mouse
gctgccttctaggcttgcag

SEQ ID NO: 599450 - DNA, 20 bp, mouse
gctgcggcgaggcgcccgga

SEQ ID NO: 599451 - DNA, 20 bp, mouse
gccagctgatacagagatag

SEQ ID NO: 599452 - DNA, 20 bp, mouse
ggcccggaggggcgttggtc

SEQ ID NO: 599453 - DNA, 20 bp, mouse
gcgttggtctggcgcggctg

SEQ ID NO: 599454 - DNA, 20 bp, mouse
ggaggggcgttggtctggcg

SEQ ID NO: 599455 - DNA, 20 bp, mouse
gaagtgacccacctgcggcg

SEQ ID NO: 599456 - DNA, 20 bp, mouse
ggcatcaagatgagtcttgg

SEQ ID NO: 599457 - DNA, 20 bp, mouse
gacactagaggaggagcttt

SEQ ID NO: 599458 - DNA, 20 bp, mouse
gtgttaaaaatttctctgat

SEQ ID NO: 599459 - DNA, 20 bp, mouse
gaaaatttctctgatggggc

SEQ ID NO: 599460 - DNA, 20 bp, mouse
gatccagatgattgctaaca

SEQ ID NO: 599461 - DNA, 20 bp, mouse
gttcccacagtcttaatgca

SEQ ID NO: 599462 - DNA, 20 bp, mouse
gaacgcatcaagatgagtct

SEQ ID NO: 599463 - DNA, 20 bp, mouse
gggccctgcattaagactgt

SEQ ID NO: 599464 - DNA, 20 bp, mouse
gctggatttctggtgtggca

SEQ ID NO: 599465 - DNA, 20 bp, mouse
gcaccttgttagcaatcatc

SEQ ID NO: 599466 - DNA, 20 bp, mouse
gtcaggctctggggaaggta

SEQ ID NO: 599467 - DNA, 20 bp, mouse
gacaccatagaaataattgg

SEQ ID NO: 599468 - DNA, 20 bp, mouse
gaatacaccatagaaataat

SEQ ID NO: 599469 - DNA, 20 bp, mouse
gataattggaggtttgtcag

SEQ ID NO: 599470 - DNA, 20 bp, mouse
gaaacctccaattatttcta

SEQ ID NO: 599471 - DNA, 20 bp, mouse
gctattatacattacagagg

SEQ ID NO: 599472 - DNA, 20 bp, mouse
gataatagccagtctttctg

SEQ ID NO: 599473 - DNA, 20 bp, mouse
gcccagttcctcagaaagac

SEQ ID NO: 599474 - DNA, 20 bp, mouse
ggccagtctttctgaggaac

SEQ ID NO: 599475 - DNA, 20 bp, mouse
ggaaagtgaattcaacattt

SEQ ID NO: 599476 - DNA, 20 bp, mouse
ggaattcagtttcaagctct

SEQ ID NO: 599477 - DNA, 20 bp, mouse
gaatacaccagaaaaataaa

SEQ ID NO: 599478 - DNA, 20 bp, mouse
gacaccagaaaaataaaggg

SEQ ID NO: 599479 - DNA, 20 bp, mouse
gaagcctccctttatttttc

SEQ ID NO: 599480 - DNA, 20 bp, mouse
gtgcagtaaagagtatggct

SEQ ID NO: 599481 - DNA, 20 bp, mouse
gtagtttcacctagtgggat

SEQ ID NO: 599482 - DNA, 20 bp, mouse
gtccatgtatttcagcaaaa

SEQ ID NO: 599483 - DNA, 20 bp, mouse
ggaaactgaattcatcattt

SEQ ID NO: 599484 - DNA, 20 bp, mouse
gataaagggaggcttgtcag

SEQ ID NO: 599485 - DNA, 20 bp, mouse
gggtgtattcagtcattgct

SEQ ID NO: 599486 - DNA, 20 bp, mouse
ggttttcttgactcattgat

SEQ ID NO: 599487 - DNA, 20 bp, mouse
gggcatggcattaagagtgt

SEQ ID NO: 599488 - DNA, 20 bp, mouse
gcttgactcattgatgggca

SEQ ID NO: 599489 - DNA, 20 bp, mouse
gcaactggaagtgaaacatt

SEQ ID NO: 599490 - DNA, 20 bp, mouse
gtcacttccagttgtataaa

SEQ ID NO: 599491 - DNA, 20 bp, mouse
ggaaccaaacctgtatagtt

SEQ ID NO: 599492 - DNA, 20 bp, mouse
gcacagaaaccgaactatac

SEQ ID NO: 599493 - DNA, 20 bp, mouse
gttatctctgcaatatctga

SEQ ID NO: 599494 - DNA, 20 bp, mouse
gaaaccgaactatacaggtt

SEQ ID NO: 599495 - DNA, 20 bp, mouse
ggctgaaggtggattcatgt

SEQ ID NO: 599496 - DNA, 20 bp, mouse
gcacggccgccgccaagcta

SEQ ID NO: 599497 - DNA, 20 bp, mouse
ggcacgcagagtcaggatcc

SEQ ID NO: 599498 - DNA, 20 bp, mouse
ggttgttgggcccgtttgtt

SEQ ID NO: 599499 - DNA, 20 bp, mouse
gttgttgggcacgcagagtc

SEQ ID NO: 599500 - DNA, 20 bp, mouse
gccgccgccaagctagggtt

SEQ ID NO: 599501 - DNA, 20 bp, mouse
gggccgccaggggagaaaga

SEQ ID NO: 599502 - DNA, 20 bp, mouse
ggcggccgtgacaacagcga

SEQ ID NO: 599503 - DNA, 20 bp, mouse
ggtagcgtctcagatgactg

SEQ ID NO: 599504 - DNA, 20 bp, mouse
gctctgcgtgcccaacaaac

SEQ ID NO: 599505 - DNA, 20 bp, mouse
gcgcgaccccaacgtcccag

SEQ ID NO: 599506 - DNA, 20 bp, mouse
ggccgggtccggtacctctg

SEQ ID NO: 599507 - DNA, 20 bp, mouse
ggcgtccgcctgctgcaccg

SEQ ID NO: 599508 - DNA, 20 bp, mouse
gggggcaccaggagccgcag

SEQ ID NO: 599509 - DNA, 20 bp, mouse
ggccgcagaggtaccggacc

SEQ ID NO: 599510 - DNA, 20 bp, mouse
gggtgccccggtgcagcagg

SEQ ID NO: 599511 - DNA, 20 bp, mouse
gccaggagccgcagaggtac

SEQ ID NO: 599512 - DNA, 20 bp, mouse
gacgcgcacgggccaggccc

SEQ ID NO: 599513 - DNA, 20 bp, mouse
gccgggatcctaagactcct

SEQ ID NO: 599514 - DNA, 20 bp, mouse
gtcagcgcccccgccgggtc

SEQ ID NO: 599515 - DNA, 20 bp, mouse
ggcagcaggcggacgcgcac

SEQ ID NO: 599516 - DNA, 20 bp, mouse
gccggaaccaatgaacgcgg

SEQ ID NO: 599517 - DNA, 20 bp, mouse
ggggccgccggtgaagggag

SEQ ID NO: 599518 - DNA, 20 bp, mouse
gtaaccggaaccaatgaacg

SEQ ID NO: 599519 - DNA, 20 bp, mouse
gggagcgggtcagcacccgg

SEQ ID NO: 599520 - DNA, 20 bp, mouse
ggacccgctcccttcaccgg

SEQ ID NO: 599521 - DNA, 20 bp, mouse
gaagggagcgggtcagcacc

SEQ ID NO: 599522 - DNA, 20 bp, mouse
gggcccggccgcctcggaag

SEQ ID NO: 599523 - DNA, 20 bp, mouse
ggcggcgagccgagcttcgc

SEQ ID NO: 599524 - DNA, 20 bp, mouse
gctcgggccgccctctccgg

SEQ ID NO: 599525 - DNA, 20 bp, mouse
gttcgcgggccgccggtgaa

SEQ ID NO: 599526 - DNA, 20 bp, mouse
gtctagtaggttccagaagg

SEQ ID NO: 599527 - DNA, 20 bp, mouse
gggtcccggcagcttctagt

SEQ ID NO: 599528 - DNA, 20 bp, mouse
gggacgaattcgattcaacg

SEQ ID NO: 599529 - DNA, 20 bp, mouse
ggaaggcggcgcgtgcggtt

SEQ ID NO: 599530 - DNA, 20 bp, mouse
gaggctatggagcaggtgaa

SEQ ID NO: 599531 - DNA, 20 bp, mouse
ggcttctagtaggttccaga

SEQ ID NO: 599532 - DNA, 20 bp, mouse
gtccactcggcgggtcgcgg

SEQ ID NO: 599533 - DNA, 20 bp, mouse
gggggttccgggccaggcta

SEQ ID NO: 599534 - DNA, 20 bp, mouse
ggcccccgcgacccgccgag

SEQ ID NO: 599535 - DNA, 20 bp, mouse
gcgggcgtgtgaggggagaa

SEQ ID NO: 599536 - DNA, 20 bp, mouse
gagcgcgacgacaggacccg

SEQ ID NO: 599537 - DNA, 20 bp, mouse
gtgctgcgctgcgaggaggg

SEQ ID NO: 599538 - DNA, 20 bp, mouse
ggggtgctgcgctgcgagga

SEQ ID NO: 599539 - DNA, 20 bp, mouse
gtggccgctggcgcactcgg

SEQ ID NO: 599540 - DNA, 20 bp, mouse
gacgatgtatgggagatcgt

SEQ ID NO: 599541 - DNA, 20 bp, mouse
ggcgaaagccatgctggatg

SEQ ID NO: 599542 - DNA, 20 bp, mouse
ggccttcggcaaagtctaca

SEQ ID NO: 599543 - DNA, 20 bp, mouse
ggagtgcgccagcggccaca

SEQ ID NO: 599544 - DNA, 20 bp, mouse
gggatgaggagcgcgacgac

SEQ ID NO: 599545 - DNA, 20 bp, mouse
gtcgtgggcgagctgggaga

SEQ ID NO: 599546 - DNA, 20 bp, mouse
gtgtcggtctaggaaagggg

SEQ ID NO: 599547 - DNA, 20 bp, mouse
gggcgtgtcggtctaggaaa

SEQ ID NO: 599548 - DNA, 20 bp, mouse
gcgcagggcggtaaacaaga

SEQ ID NO: 599549 - DNA, 20 bp, mouse
gagggcggtaaacaagatgg

SEQ ID NO: 599550 - DNA, 20 bp, mouse
ggcgactcgcgcctcactcg

SEQ ID NO: 599551 - DNA, 20 bp, mouse
ggacaggcaggaggccggag

SEQ ID NO: 599552 - DNA, 20 bp, mouse
gcaagatggcggcggcgtgt

SEQ ID NO: 599553 - DNA, 20 bp, mouse
gggaaaggggaggcggctca

SEQ ID NO: 599554 - DNA, 20 bp, mouse
gggcggcggcgtgtcggtct

SEQ ID NO: 599555 - DNA, 20 bp, mouse
gaggcgcgagtcgccgaggg

SEQ ID NO: 599556 - DNA, 20 bp, mouse
ggcccggctgccaaagtgat

SEQ ID NO: 599557 - DNA, 20 bp, mouse
gcatagccacgggacgctgg

SEQ ID NO: 599558 - DNA, 20 bp, mouse
gtccacactactgaatcccg

SEQ ID NO: 599559 - DNA, 20 bp, mouse
gttgggcctcgggagcccat

SEQ ID NO: 599560 - DNA, 20 bp, mouse
gactactgaatcccgcggag

SEQ ID NO: 599561 - DNA, 20 bp, mouse
ggagcggtcgtcatagccac

SEQ ID NO: 599562 - DNA, 20 bp, mouse
gtggcagccgggctctttta

SEQ ID NO: 599563 - DNA, 20 bp, mouse
gattcgcactccaatcactt

SEQ ID NO: 599564 - DNA, 20 bp, mouse
ggaacacacccagaagacgc

SEQ ID NO: 599565 - DNA, 20 bp, mouse
ggcgaattacgcgggcccat

SEQ ID NO: 599566 - DNA, 20 bp, mouse
ggtcggtgtggagtttgtag

SEQ ID NO: 599567 - DNA, 20 bp, mouse
ggcacaggccggagaccggt

SEQ ID NO: 599568 - DNA, 20 bp, mouse
gtcgctcgggaacgagcaca

SEQ ID NO: 599569 - DNA, 20 bp, mouse
gggtggactcggccagaggt

SEQ ID NO: 599570 - DNA, 20 bp, mouse
gggccggagaccggtcggtg

SEQ ID NO: 599571 - DNA, 20 bp, mouse
gcttcgcacaggccggagac

SEQ ID NO: 599572 - DNA, 20 bp, mouse
gggtccctggcccttcgcac

SEQ ID NO: 599573 - DNA, 20 bp, mouse
gctccacaccgaccggtctc

SEQ ID NO: 599574 - DNA, 20 bp, mouse
gggagggtggactcggccag

SEQ ID NO: 599575 - DNA, 20 bp, mouse
gggcgactccagcgctaaga

SEQ ID NO: 599576 - DNA, 20 bp, mouse
gcctgtgaggcgactcccgg

SEQ ID NO: 599577 - DNA, 20 bp, mouse
ggcccctgtgaggcgactcc

SEQ ID NO: 599578 - DNA, 20 bp, mouse
ggcgtcggtcagcgtctgtg

SEQ ID NO: 599579 - DNA, 20 bp, mouse
gctcgcactcttccccacaa

SEQ ID NO: 599580 - DNA, 20 bp, mouse
gctcacaggggcctggctga

SEQ ID NO: 599581 - DNA, 20 bp, mouse
ggagccccggagccacccgg

SEQ ID NO: 599582 - DNA, 20 bp, mouse
gagacgccgcggaggctatc

SEQ ID NO: 599583 - DNA, 20 bp, mouse
gcctcaactgtaagaagcgt

SEQ ID NO: 599584 - DNA, 20 bp, mouse
gggaccacgtcgagacgccg

SEQ ID NO: 599585 - DNA, 20 bp, mouse
gcgagcccgaaggccagagc

SEQ ID NO: 599586 - DNA, 20 bp, mouse
gaggtccgggtggagagcga

SEQ ID NO: 599587 - DNA, 20 bp, mouse
gggttatgaatcgcaagaga

SEQ ID NO: 599588 - DNA, 20 bp, mouse
ggatttcaggattccgggaa

SEQ ID NO: 599589 - DNA, 20 bp, mouse
gtccgggtggagagcgaggg

SEQ ID NO: 599590 - DNA, 20 bp, mouse
gcaagcgcgtggtcaggtcc

SEQ ID NO: 599591 - DNA, 20 bp, mouse
ggagtcgctgcccagcgcct

SEQ ID NO: 599592 - DNA, 20 bp, mouse
gtattctgtgccggaagacg

SEQ ID NO: 599593 - DNA, 20 bp, mouse
gtggagacagcgcggaggtt

SEQ ID NO: 599594 - DNA, 20 bp, mouse
ggtcttcgggactcctttcc

SEQ ID NO: 599595 - DNA, 20 bp, mouse
ggagggtggagacagcgcgg

SEQ ID NO: 599596 - DNA, 20 bp, mouse
gctcgacctgagcaccgcgg

SEQ ID NO: 599597 - DNA, 20 bp, mouse
gcggctcgacctgagcaccg

SEQ ID NO: 599598 - DNA, 20 bp, mouse
gtggccgcctggagccgagt

SEQ ID NO: 599599 - DNA, 20 bp, mouse
ggactgcggctgcttctcca

SEQ ID NO: 599600 - DNA, 20 bp, mouse
gggcgcagcgacgggatccc

SEQ ID NO: 599601 - DNA, 20 bp, mouse
gagcccgccccgccacccga

SEQ ID NO: 599602 - DNA, 20 bp, mouse
ggccgcgcgcagccctcggg

SEQ ID NO: 599603 - DNA, 20 bp, mouse
gcgcgtcccgggccaggaag

SEQ ID NO: 599604 - DNA, 20 bp, mouse
ggcgcccactcggctccagg

SEQ ID NO: 599605 - DNA, 20 bp, mouse
gtccaggcggccagcgctcg

SEQ ID NO: 599606 - DNA, 20 bp, mouse
ggccgctgcctccacctcac

SEQ ID NO: 599607 - DNA, 20 bp, mouse
gcgcttcgcagtccccacgg

SEQ ID NO: 599608 - DNA, 20 bp, mouse
gccaggcctcccagcccgtg

SEQ ID NO: 599609 - DNA, 20 bp, mouse
ggcccgcttcgcagtcccca

SEQ ID NO: 599610 - DNA, 20 bp, mouse
gggctctgagcagggcgtcg

SEQ ID NO: 599611 - DNA, 20 bp, mouse
ggttccgggagaccgaattg

SEQ ID NO: 599612 - DNA, 20 bp, mouse
gtcggtctcccggaacgccc

SEQ ID NO: 599613 - DNA, 20 bp, mouse
ggtggagggacgccacggaa

SEQ ID NO: 599614 - DNA, 20 bp, mouse
gctgggaggcctgggcgttc

SEQ ID NO: 599615 - DNA, 20 bp, mouse
ggaggcagcggctctgagca

SEQ ID NO: 599616 - DNA, 20 bp, mouse
gagcagccggccgaacgcaa

SEQ ID NO: 599617 - DNA, 20 bp, mouse
gcgaacgcaagggatcacac

SEQ ID NO: 599618 - DNA, 20 bp, mouse
ggaggaaccgcgttgaggag

SEQ ID NO: 599619 - DNA, 20 bp, mouse
gaccgcgttgaggagcggga

SEQ ID NO: 599620 - DNA, 20 bp, mouse
gcgcggagttacgtgaaagt

SEQ ID NO: 599621 - DNA, 20 bp, mouse
gggcgtccaagaggtaacga

SEQ ID NO: 599622 - DNA, 20 bp, mouse
ggcgggagggagatccgccg

SEQ ID NO: 599623 - DNA, 20 bp, mouse
ggggatgaggacggaagcag

SEQ ID NO: 599624 - DNA, 20 bp, mouse
ggaccgtgaaggccgtaggg

SEQ ID NO: 599625 - DNA, 20 bp, mouse
gcaccaggccctcaagacgt

SEQ ID NO: 599626 - DNA, 20 bp, mouse
gaggcgacaggaatacaata

SEQ ID NO: 599627 - DNA, 20 bp, mouse
gggctcgaggaccttcgcgg

SEQ ID NO: 599628 - DNA, 20 bp, mouse
gtccggctcgaggaccttcg

SEQ ID NO: 599629 - DNA, 20 bp, mouse
gcagccagggaccaccgcga

SEQ ID NO: 599630 - DNA, 20 bp, mouse
gcgacaggaatacaatatgg

SEQ ID NO: 599631 - DNA, 20 bp, mouse
ggctggggagcgttaggatc

SEQ ID NO: 599632 - DNA, 20 bp, mouse
gtcctaacgctccccagcca

SEQ ID NO: 599633 - DNA, 20 bp, mouse
gccggaagccacctctggaa

SEQ ID NO: 599634 - DNA, 20 bp, mouse
gccggccttctcccttccag

SEQ ID NO: 599635 - DNA, 20 bp, mouse
gtccctggctggggagcgtt

SEQ ID NO: 599636 - DNA, 20 bp, mouse
gctgaggcgtggaagctcgg

SEQ ID NO: 599637 - DNA, 20 bp, mouse
gcggcggtaagcggcgccaa

SEQ ID NO: 599638 - DNA, 20 bp, mouse
gggtaagcggcgccaagggc

SEQ ID NO: 599639 - DNA, 20 bp, mouse
ggtggaagctcggcggtaag

SEQ ID NO: 599640 - DNA, 20 bp, mouse
ggtggagcgcctggtatgtg

SEQ ID NO: 599641 - DNA, 20 bp, mouse
gaggcgcagtgcgtgccctg

SEQ ID NO: 599642 - DNA, 20 bp, mouse
ggccgctggccccacatacc

SEQ ID NO: 599643 - DNA, 20 bp, mouse
ggcagaggtggagggcacga

SEQ ID NO: 599644 - DNA, 20 bp, mouse
gctgggctgaggcctacttc

SEQ ID NO: 599645 - DNA, 20 bp, mouse
gttggtggcgagggcgacag

SEQ ID NO: 599646 - DNA, 20 bp, mouse
gcgctgggctcaggcacctg

SEQ ID NO: 599647 - DNA, 20 bp, mouse
gggcacctgcggctgcaaag

SEQ ID NO: 599648 - DNA, 20 bp, mouse
gacacctgccgatcaggacg

SEQ ID NO: 599649 - DNA, 20 bp, mouse
gcgcgcagctccccagcgag

SEQ ID NO: 599650 - DNA, 20 bp, mouse
gcatcgtgaggtgagtggaa

SEQ ID NO: 599651 - DNA, 20 bp, mouse
gcgggtcctgcccctcgctg

SEQ ID NO: 599652 - DNA, 20 bp, mouse
gggagctgcgcggttgtgct

SEQ ID NO: 599653 - DNA, 20 bp, mouse
ggcgtagctgagaagttcaa

SEQ ID NO: 599654 - DNA, 20 bp, mouse
gccccggcaggactgcgcgc

SEQ ID NO: 599655 - DNA, 20 bp, mouse
ggactcgcaagaccagatgg

SEQ ID NO: 599656 - DNA, 20 bp, mouse
ggcagctctgctcacaacgg

SEQ ID NO: 599657 - DNA, 20 bp, mouse
gcgtgcagctctgctcacaa

SEQ ID NO: 599658 - DNA, 20 bp, mouse
gacggtggtgaggaaaaagg

SEQ ID NO: 599659 - DNA, 20 bp, mouse
gcagagctgcacggtggtct

SEQ ID NO: 599660 - DNA, 20 bp, mouse
gatacacggatggaaacccg

SEQ ID NO: 599661 - DNA, 20 bp, mouse
gacaacggtggtgaggaaaa

SEQ ID NO: 599662 - DNA, 20 bp, mouse
ggaggccgggcatgtagtag

SEQ ID NO: 599663 - DNA, 20 bp, mouse
gctccatgacgcacaataca

SEQ ID NO: 599664 - DNA, 20 bp, mouse
gtctgctcacaacggtggtg

SEQ ID NO: 599665 - DNA, 20 bp, mouse
ggtgcgtcatggagagaatc

SEQ ID NO: 599666 - DNA, 20 bp, mouse
ggcgagccagagcagatacc

SEQ ID NO: 599667 - DNA, 20 bp, mouse
gtatctgctctggctcgcca

SEQ ID NO: 599668 - DNA, 20 bp, mouse
gagagcagagcgctaagggc

SEQ ID NO: 599669 - DNA, 20 bp, mouse
gctgggagagcagagcgcta

SEQ ID NO: 599670 - DNA, 20 bp, mouse
gtcgcaatccgcgggcgggt

SEQ ID NO: 599671 - DNA, 20 bp, mouse
gcggggcgcgcacgaccggg

SEQ ID NO: 599672 - DNA, 20 bp, mouse
ggttctcctggtatctgctc

SEQ ID NO: 599673 - DNA, 20 bp, mouse
ggcaacgccggccgttctcc

SEQ ID NO: 599674 - DNA, 20 bp, mouse
gcgctaagggccggcaacgc

SEQ ID NO: 599675 - DNA, 20 bp, mouse
gcgctctgctctcccagggt

SEQ ID NO: 599676 - DNA, 20 bp, mouse
gtggagacgctgctgcggta

SEQ ID NO: 599677 - DNA, 20 bp, mouse
gcggctgccccgcctccgag

SEQ ID NO: 599678 - DNA, 20 bp, mouse
gctgcggtacggaggccgga

SEQ ID NO: 599679 - DNA, 20 bp, mouse
gagacgctgctgcggtacgg

SEQ ID NO: 599680 - DNA, 20 bp, mouse
gtggtgcctgagcctctcgg

SEQ ID NO: 599681 - DNA, 20 bp, mouse
gcgccatggagacgctgctg

SEQ ID NO: 599682 - DNA, 20 bp, mouse
gagccgagagcgcagcactg

SEQ ID NO: 599683 - DNA, 20 bp, mouse
gcgcagctcgctggtttgtt

SEQ ID NO: 599684 - DNA, 20 bp, mouse
ggcggtttaccaggtcgcca

SEQ ID NO: 599685 - DNA, 20 bp, mouse
ggcgagctgcgcggtttacc

SEQ ID NO: 599686 - DNA, 20 bp, mouse
gagggtcctggggatgatca

SEQ ID NO: 599687 - DNA, 20 bp, mouse
gcgcaggcaaacgggcctca

SEQ ID NO: 599688 - DNA, 20 bp, mouse
gggccaggcgtcctgcgcgg

SEQ ID NO: 599689 - DNA, 20 bp, mouse
ggtcggccaggcgtcctgcg

SEQ ID NO: 599690 - DNA, 20 bp, mouse
gggcgggctgcccctgacag

SEQ ID NO: 599691 - DNA, 20 bp, mouse
gcctgcgcggaggagggtcc

SEQ ID NO: 599692 - DNA, 20 bp, mouse
ggggatgccgacccaggagg

SEQ ID NO: 599693 - DNA, 20 bp, mouse
gcacagagtggatgctcagg

SEQ ID NO: 599694 - DNA, 20 bp, mouse
gcctgtagcgaacatgggat

SEQ ID NO: 599695 - DNA, 20 bp, mouse
gctccagccagcggtcggcc

SEQ ID NO: 599696 - DNA, 20 bp, mouse
gtacctcggctgcagagagg

SEQ ID NO: 599697 - DNA, 20 bp, mouse
ggaatctccgctgaccagag

SEQ ID NO: 599698 - DNA, 20 bp, mouse
ggcggcggctgggtctacct

SEQ ID NO: 599699 - DNA, 20 bp, mouse
gacagcccggaaccaatcac

SEQ ID NO: 599700 - DNA, 20 bp, mouse
gttgtctgcagagccgggta

SEQ ID NO: 599701 - DNA, 20 bp, mouse
gatgacagcaacgctcccgg

SEQ ID NO: 599702 - DNA, 20 bp, mouse
gtcctggtggcccatccccc

SEQ ID NO: 599703 - DNA, 20 bp, mouse
gggtcagcggagattcctgg

SEQ ID NO: 599704 - DNA, 20 bp, mouse
gcggctgcagagaggcggcg

SEQ ID NO: 599705 - DNA, 20 bp, mouse
gccgccgccgctctggtcag

SEQ ID NO: 599706 - DNA, 20 bp, mouse
gtggctagcaggccccacaa

SEQ ID NO: 599707 - DNA, 20 bp, mouse
gtaaaggacaaagctctcag

SEQ ID NO: 599708 - DNA, 20 bp, mouse
gcgcccattggcactttgta

SEQ ID NO: 599709 - DNA, 20 bp, mouse
gacagatgcgaaccgcccat

SEQ ID NO: 599710 - DNA, 20 bp, mouse
gagcttggagcgtctagact

SEQ ID NO: 599711 - DNA, 20 bp, mouse
gccactctggccccgagcag

SEQ ID NO: 599712 - DNA, 20 bp, mouse
ggagaggggaaagggaacac

SEQ ID NO: 599713 - DNA, 20 bp, mouse
gtgccctacaaagtgccaat

SEQ ID NO: 599714 - DNA, 20 bp, mouse
gtagactgggagcaagttag

SEQ ID NO: 599715 - DNA, 20 bp, mouse
ggtcttcagttgcctagaaa

SEQ ID NO: 599716 - DNA, 20 bp, mouse
gcaactgccggaaaagacgg

SEQ ID NO: 599717 - DNA, 20 bp, mouse
gcagtctgagggggtaccgg

SEQ ID NO: 599718 - DNA, 20 bp, mouse
ggggccgacggctacagaga

SEQ ID NO: 599719 - DNA, 20 bp, mouse
gcccctcagactgtggagag

SEQ ID NO: 599720 - DNA, 20 bp, mouse
gagacactcaccagacccag

SEQ ID NO: 599721 - DNA, 20 bp, mouse
gctgtggagaggggccgccg

SEQ ID NO: 599722 - DNA, 20 bp, mouse
gccccaactgccggaaaaga

SEQ ID NO: 599723 - DNA, 20 bp, mouse
gaaaagacggcggcgcggag

SEQ ID NO: 599724 - DNA, 20 bp, mouse
ggcatgcgcagtctcagccg

SEQ ID NO: 599725 - DNA, 20 bp, mouse
gcgcgacaggacaggacaaa

SEQ ID NO: 599726 - DNA, 20 bp, mouse
gcgacaccggcaggtgagag

SEQ ID NO: 599727 - DNA, 20 bp, mouse
gagacgcgcgccgcgggctg

SEQ ID NO: 599728 - DNA, 20 bp, mouse
gctcgcccgctctcacctgc

SEQ ID NO: 599729 - DNA, 20 bp, mouse
ggaaggccccggtgactgac

SEQ ID NO: 599730 - DNA, 20 bp, mouse
gtgagagcgggcgagggcac

SEQ ID NO: 599731 - DNA, 20 bp, mouse
ggccttcgccgagccgggtg

SEQ ID NO: 599732 - DNA, 20 bp, mouse
ggtgccctctgcgtccggag

SEQ ID NO: 599733 - DNA, 20 bp, mouse
ggcagcctgcgtaccgggag

SEQ ID NO: 599734 - DNA, 20 bp, mouse
gagttgccggtgcacagcga

SEQ ID NO: 599735 - DNA, 20 bp, mouse
ggctttggcaccgcctcacg

SEQ ID NO: 599736 - DNA, 20 bp, mouse
gccctcgtggcaggctccgg

SEQ ID NO: 599737 - DNA, 20 bp, mouse
gtgctgcgggaggagagtga

SEQ ID NO: 599738 - DNA, 20 bp, mouse
gaggggagggagccagccgg

SEQ ID NO: 599739 - DNA, 20 bp, mouse
gggagcctgccacgagggga

SEQ ID NO: 599740 - DNA, 20 bp, mouse
gcaggcggccccggtgacag

SEQ ID NO: 599741 - DNA, 20 bp, mouse
gtgcgccggccgagaggtgt

SEQ ID NO: 599742 - DNA, 20 bp, mouse
gggtgtgggcgacgaggcta

SEQ ID NO: 599743 - DNA, 20 bp, mouse
gccgagaggtgtgggcgacg

SEQ ID NO: 599744 - DNA, 20 bp, mouse
gtcctcccgcagcatcatgg

SEQ ID NO: 599745 - DNA, 20 bp, mouse
gggctggctccctcccctcg

SEQ ID NO: 599746 - DNA, 20 bp, mouse
gtggagcattgaggcagtct

SEQ ID NO: 599747 - DNA, 20 bp, mouse
gccgggaggatggagcattg

SEQ ID NO: 599748 - DNA, 20 bp, mouse
gtgaggggccgtaggctgag

SEQ ID NO: 599749 - DNA, 20 bp, mouse
gtagcacctgccgagagagg

SEQ ID NO: 599750 - DNA, 20 bp, mouse
ggggcggaaagcggaagtgt

SEQ ID NO: 599751 - DNA, 20 bp, mouse
gagctcgggccgggaggaga

SEQ ID NO: 599752 - DNA, 20 bp, mouse
gaagggacccgaggatgtag

SEQ ID NO: 599753 - DNA, 20 bp, mouse
gcagtagcacctgccgagag

SEQ ID NO: 599754 - DNA, 20 bp, mouse
gaagtgtgggagggttcgcg

SEQ ID NO: 599755 - DNA, 20 bp, mouse
gaacccaccgcgcaggtgag

SEQ ID NO: 599756 - DNA, 20 bp, mouse
ggcggcgccgcagccatgga

SEQ ID NO: 599757 - DNA, 20 bp, mouse
gccgccgccgcctccctcca

SEQ ID NO: 599758 - DNA, 20 bp, mouse
gctctggcggctgcgctggg

SEQ ID NO: 599759 - DNA, 20 bp, mouse
gtggcggctgcgctgggagg

SEQ ID NO: 599760 - DNA, 20 bp, mouse
gaaggacagacctccagtgg

SEQ ID NO: 599761 - DNA, 20 bp, mouse
gctggcggggcgggccaccg

SEQ ID NO: 599762 - DNA, 20 bp, mouse
ggccgagcagccccgactct

SEQ ID NO: 599763 - DNA, 20 bp, mouse
ggctgggaggcggcggtgag

SEQ ID NO: 599764 - DNA, 20 bp, mouse
gactctgggctgcggactat

SEQ ID NO: 599765 - DNA, 20 bp, mouse
gctgaccggcgcgaccagaa

SEQ ID NO: 599766 - DNA, 20 bp, mouse
gcggctcggaccgagcaggt

SEQ ID NO: 599767 - DNA, 20 bp, mouse
gtctgagcaccaacagacct

SEQ ID NO: 599768 - DNA, 20 bp, mouse
ggcacaaaagcgccaaacag

SEQ ID NO: 599769 - DNA, 20 bp, mouse
gtctgttggtgctcagagtg

SEQ ID NO: 599770 - DNA, 20 bp, mouse
gaagcctgcacccacctgct

SEQ ID NO: 599771 - DNA, 20 bp, mouse
ggcttaggcggaggctacgg

SEQ ID NO: 599772 - DNA, 20 bp, mouse
gcgccgggcggtagatgcag

SEQ ID NO: 599773 - DNA, 20 bp, mouse
ggggcggtagatgcagagga

SEQ ID NO: 599774 - DNA, 20 bp, mouse
gccagccgggcacaggagat

SEQ ID NO: 599775 - DNA, 20 bp, mouse
ggcggcacgtgacccagacc

SEQ ID NO: 599776 - DNA, 20 bp, mouse
gtggctccgatctcattgtt

SEQ ID NO: 599777 - DNA, 20 bp, mouse
gctcattgttgggttgaatc

SEQ ID NO: 599778 - DNA, 20 bp, mouse
gttcaacccaacaatgagat

SEQ ID NO: 599779 - DNA, 20 bp, mouse
gggcaggacaaaaacattaa

SEQ ID NO: 599780 - DNA, 20 bp, mouse
gtgatgacataggagaaatg

SEQ ID NO: 599781 - DNA, 20 bp, mouse
gaatatcaatctagaaacac

SEQ ID NO: 599782 - DNA, 20 bp, mouse
gctatgtcatcagcacaaag

SEQ ID NO: 599783 - DNA, 20 bp, mouse
gtcacacccttgacaatgtc

SEQ ID NO: 599784 - DNA, 20 bp, mouse
gtgttcgacatggcatcttc

SEQ ID NO: 599785 - DNA, 20 bp, mouse
gcttggaatatcaaaactca

SEQ ID NO: 599786 - DNA, 20 bp, mouse
ggccgcggagagagcgagag

SEQ ID NO: 599787 - DNA, 20 bp, mouse
gggagtggtggcgaaggcaa

SEQ ID NO: 599788 - DNA, 20 bp, mouse
gaagggtccagctgtagccg

SEQ ID NO: 599789 - DNA, 20 bp, mouse
ggggatgtgcacgcacggag

SEQ ID NO: 599790 - DNA, 20 bp, mouse
gcgagagaggagtctgagta

SEQ ID NO: 599791 - DNA, 20 bp, mouse
gtcctctctcgctctctccg

SEQ ID NO: 599792 - DNA, 20 bp, mouse
gacgcacggagtggtggcga

SEQ ID NO: 599793 - DNA, 20 bp, mouse
gctctctccgcggctacagc

SEQ ID NO: 599794 - DNA, 20 bp, mouse
gtgcgtgcacatccctacaa

SEQ ID NO: 599795 - DNA, 20 bp, mouse
ggagctctaagagaccaaag

SEQ ID NO: 599796 - DNA, 20 bp, mouse
ggacaccgcccgcatccctc

SEQ ID NO: 599797 - DNA, 20 bp, mouse
gtcggaggccggagggatgc

SEQ ID NO: 599798 - DNA, 20 bp, mouse
gtggggcttcggaggccgga

SEQ ID NO: 599799 - DNA, 20 bp, mouse
ggccagcaccgtatctggta

SEQ ID NO: 599800 - DNA, 20 bp, mouse
gaggagccgcgccctagaca

SEQ ID NO: 599801 - DNA, 20 bp, mouse
ggctggccctgcaagaaggg

SEQ ID NO: 599802 - DNA, 20 bp, mouse
gcgggagcctaggggatcat

SEQ ID NO: 599803 - DNA, 20 bp, mouse
gcctctggtaagacccactg

SEQ ID NO: 599804 - DNA, 20 bp, mouse
ggtccagagttcttaagggg

SEQ ID NO: 599805 - DNA, 20 bp, mouse
gtcggctagcaggtccccta

SEQ ID NO: 599806 - DNA, 20 bp, mouse
gccagggtaccactaattga

SEQ ID NO: 599807 - DNA, 20 bp, mouse
gagaagagaacagctcgctt

SEQ ID NO: 599808 - DNA, 20 bp, mouse
gatccactcagtgaaaccaa

SEQ ID NO: 599809 - DNA, 20 bp, mouse
gctgagatatggacaatcgg

SEQ ID NO: 599810 - DNA, 20 bp, mouse
ggcagggtgaggcaaaatga

SEQ ID NO: 599811 - DNA, 20 bp, mouse
gcttgaagaggggcgagggt

SEQ ID NO: 599812 - DNA, 20 bp, mouse
gtggagctcggcttcctctg

SEQ ID NO: 599813 - DNA, 20 bp, mouse
ggcaagactgcacagaacta

SEQ ID NO: 599814 - DNA, 20 bp, mouse
gttctcactccttcaattag

SEQ ID NO: 599815 - DNA, 20 bp, mouse
gatatggacaatcggaggtg

SEQ ID NO: 599816 - DNA, 20 bp, mouse
ggcctggaggtatgggagga

SEQ ID NO: 599817 - DNA, 20 bp, mouse
ggccctcctcccatacctcc

SEQ ID NO: 599818 - DNA, 20 bp, mouse
gcagggggcacagcctagag

SEQ ID NO: 599819 - DNA, 20 bp, mouse
gggcgtgctgggccctgact

SEQ ID NO: 599820 - DNA, 20 bp, mouse
ggacaagatagaagctccag

SEQ ID NO: 599821 - DNA, 20 bp, mouse
gccaggcgtgtgctcccaca

SEQ ID NO: 599822 - DNA, 20 bp, mouse
gactggggaacaaggactcc

SEQ ID NO: 599823 - DNA, 20 bp, mouse
gtatgggaggagggcgtgct

SEQ ID NO: 599824 - DNA, 20 bp, mouse
gactgtcagagagagcagaa

SEQ ID NO: 599825 - DNA, 20 bp, mouse
ggagccgcataccctctccc

SEQ ID NO: 599826 - DNA, 20 bp, mouse
ggatccgctgagactggaca

SEQ ID NO: 599827 - DNA, 20 bp, mouse
gccaggaatgaagaagacga

SEQ ID NO: 599828 - DNA, 20 bp, mouse
gggatccctgagtccttcag

SEQ ID NO: 599829 - DNA, 20 bp, mouse
gacggctctcagtaaagctc

SEQ ID NO: 599830 - DNA, 20 bp, mouse
gagagccgttagcaacgaag

SEQ ID NO: 599831 - DNA, 20 bp, mouse
gcgtttgtcagacatagtgc

SEQ ID NO: 599832 - DNA, 20 bp, mouse
gtgcagtggaggcacgccgg

SEQ ID NO: 599833 - DNA, 20 bp, mouse
gcgaagcgcacacagtgcag

SEQ ID NO: 599834 - DNA, 20 bp, mouse
gcgctgagactggacatggc

SEQ ID NO: 599835 - DNA, 20 bp, mouse
gcaccctagcaggcaagaac

SEQ ID NO: 599836 - DNA, 20 bp, mouse
ggtctcccagcagaggatcg

SEQ ID NO: 599837 - DNA, 20 bp, mouse
gaagcagtgggaacgaggag

SEQ ID NO: 599838 - DNA, 20 bp, mouse
gcccagcaccgcggacagag

SEQ ID NO: 599839 - DNA, 20 bp, mouse
gagaggatcggggcgtgtcc

SEQ ID NO: 599840 - DNA, 20 bp, mouse
gaagtcatgcttggaaggtc

SEQ ID NO: 599841 - DNA, 20 bp, mouse
gatcccctaagggcagtgcc

SEQ ID NO: 599842 - DNA, 20 bp, mouse
gtcactctccttcctcctag

SEQ ID NO: 599843 - DNA, 20 bp, mouse
gtaccgggcactgcccttag

SEQ ID NO: 599844 - DNA, 20 bp, mouse
gtccctgcgctgctacccta

SEQ ID NO: 599845 - DNA, 20 bp, mouse
gcagtgggaacgaggagggg

SEQ ID NO: 599846 - DNA, 20 bp, mouse
ggacctccggaaccaacgag

SEQ ID NO: 599847 - DNA, 20 bp, mouse
ggctctgccccacctctcgt

SEQ ID NO: 599848 - DNA, 20 bp, mouse
gccggaaccaacgagaggtg

SEQ ID NO: 599849 - DNA, 20 bp, mouse
gccacagcctcggcgacctc

SEQ ID NO: 599850 - DNA, 20 bp, mouse
ggctctcaccctcagcaaaa

SEQ ID NO: 599851 - DNA, 20 bp, mouse
gttggttccggaggtcgccg

SEQ ID NO: 599852 - DNA, 20 bp, mouse
ggggggggtgtcgagatcta

SEQ ID NO: 599853 - DNA, 20 bp, mouse
gatctcgacaccccccccaa

SEQ ID NO: 599854 - DNA, 20 bp, mouse
gcgcgcgcggcgcggggcac

SEQ ID NO: 599855 - DNA, 20 bp, mouse
gcctgaaggaagacgagagt

SEQ ID NO: 599856 - DNA, 20 bp, mouse
ggcagcaggcatcagctcag

SEQ ID NO: 599857 - DNA, 20 bp, mouse
gctgggtcgggattcgagcc

SEQ ID NO: 599858 - DNA, 20 bp, mouse
ggcatcagctcagtggtgtg

SEQ ID NO: 599859 - DNA, 20 bp, mouse
gagggtgtacgccaaggaga

SEQ ID NO: 599860 - DNA, 20 bp, mouse
gctcctcagggtgtacgcca

SEQ ID NO: 599861 - DNA, 20 bp, mouse
gaaatcttgcaggtgctcct

SEQ ID NO: 599862 - DNA, 20 bp, mouse
gagcacctgcaagatttgaa

SEQ ID NO: 599863 - DNA, 20 bp, mouse
gggctaggtagcattcagag

SEQ ID NO: 599864 - DNA, 20 bp, mouse
ggggattcgagcctggcagc

SEQ ID NO: 599865 - DNA, 20 bp, mouse
gccagggttactactcctca

SEQ ID NO: 599866 - DNA, 20 bp, mouse
ggctccttattatcactcac

SEQ ID NO: 599867 - DNA, 20 bp, mouse
gggccaaggccatccacaca

SEQ ID NO: 599868 - DNA, 20 bp, mouse
ggcgaccccaccctggtgag

SEQ ID NO: 599869 - DNA, 20 bp, mouse
gctgcccgtgagtgataata

SEQ ID NO: 599870 - DNA, 20 bp, mouse
gggagcccctcaccagggtg

SEQ ID NO: 599871 - DNA, 20 bp, mouse
ggcggctggggctccgactc

SEQ ID NO: 599872 - DNA, 20 bp, mouse
gctcacgggcagcgcggctg

SEQ ID NO: 599873 - DNA, 20 bp, mouse
gaataaggagcccctcacca

SEQ ID NO: 599874 - DNA, 20 bp, mouse
gaaatggagcgaccccaccc

SEQ ID NO: 599875 - DNA, 20 bp, mouse
gggaagactgcaggagtcgg

SEQ ID NO: 599876 - DNA, 20 bp, mouse
gagccttggtaagagcccag

SEQ ID NO: 599877 - DNA, 20 bp, mouse
gcagctgtaccccattgtca

SEQ ID NO: 599878 - DNA, 20 bp, mouse
gagcctctgggctcttacca

SEQ ID NO: 599879 - DNA, 20 bp, mouse
ggtacagctgatagcttcca

SEQ ID NO: 599880 - DNA, 20 bp, mouse
gcgctgaagccgtccatccc

SEQ ID NO: 599881 - DNA, 20 bp, mouse
gcagctgaaggcccccgagt

SEQ ID NO: 599882 - DNA, 20 bp, mouse
gtctgcctgaccatgacaat

SEQ ID NO: 599883 - DNA, 20 bp, mouse
gtcactgccggtgtgtggag

SEQ ID NO: 599884 - DNA, 20 bp, mouse
ggacaaagccacaaatgatc

SEQ ID NO: 599885 - DNA, 20 bp, mouse
gagcagaatagagggaccct

SEQ ID NO: 599886 - DNA, 20 bp, mouse
gctcgcgcagagctccgtcc

SEQ ID NO: 599887 - DNA, 20 bp, mouse
gcagagtcgcgagcgggcag

SEQ ID NO: 599888 - DNA, 20 bp, mouse
ggcaagcccagagtcgcgag

SEQ ID NO: 599889 - DNA, 20 bp, mouse
gcggagctctgcgcgagcgg

SEQ ID NO: 599890 - DNA, 20 bp, mouse
gagctctgcgcgagcggcgg

SEQ ID NO: 599891 - DNA, 20 bp, mouse
gagcagagtcccggcatcgg

SEQ ID NO: 599892 - DNA, 20 bp, mouse
gcagtggaggtgcggcggcc

SEQ ID NO: 599893 - DNA, 20 bp, mouse
gcgacttggagctcagggaa

SEQ ID NO: 599894 - DNA, 20 bp, mouse
ggccccccgccgtccacctg

SEQ ID NO: 599895 - DNA, 20 bp, mouse
gcccggtgctcggagatgct

SEQ ID NO: 599896 - DNA, 20 bp, mouse
gaacccggtgccagctgcac

SEQ ID NO: 599897 - DNA, 20 bp, mouse
gctcgagtcccgcgagcggg

SEQ ID NO: 599898 - DNA, 20 bp, mouse
ggcaccaacgccagcgaacc

SEQ ID NO: 599899 - DNA, 20 bp, mouse
gccccctcagagggctcccg

SEQ ID NO: 599900 - DNA, 20 bp, mouse
gcggcccgtgcagctggcac

SEQ ID NO: 599901 - DNA, 20 bp, mouse
gcagctggcaccgggttcgc

SEQ ID NO: 599902 - DNA, 20 bp, mouse
gtgatctcgagtcccgcgag

SEQ ID NO: 599903 - DNA, 20 bp, mouse
gccgcctgcccggcctcccg

SEQ ID NO: 599904 - DNA, 20 bp, mouse
ggtcccgcgagcgggcggca

SEQ ID NO: 599905 - DNA, 20 bp, mouse
ggcgccatgccgcccgctcg

SEQ ID NO: 599906 - DNA, 20 bp, mouse
gagtggaagtcactccccaa

SEQ ID NO: 599907 - DNA, 20 bp, mouse
gcgccctctgcgatcctgag

SEQ ID NO: 599908 - DNA, 20 bp, mouse
gccagcgcaaccaggccatt

SEQ ID NO: 599909 - DNA, 20 bp, mouse
ggctagccctcggagcgagg

SEQ ID NO: 599910 - DNA, 20 bp, mouse
gcttccactcaggatcgcag

SEQ ID NO: 599911 - DNA, 20 bp, mouse
gagcgagggggagggaccat

SEQ ID NO: 599912 - DNA, 20 bp, mouse
ggccgactgccacgcgccaa

SEQ ID NO: 599913 - DNA, 20 bp, mouse
ggcagggcccggcggtgcag

SEQ ID NO: 599914 - DNA, 20 bp, mouse
gaagtcactccccaatggcc

SEQ ID NO: 599915 - DNA, 20 bp, mouse
ggatcagcgcgttcccacga

SEQ ID NO: 599916 - DNA, 20 bp, mouse
gtcctcaagacctcaaggac

SEQ ID NO: 599917 - DNA, 20 bp, mouse
gaggattccgcgcactccat

SEQ ID NO: 599918 - DNA, 20 bp, mouse
ggcacgcacccggagtatgg

SEQ ID NO: 599919 - DNA, 20 bp, mouse
gggtctccgtgggtgtccca

SEQ ID NO: 599920 - DNA, 20 bp, mouse
gcaaggaccggtcccttaac

SEQ ID NO: 599921 - DNA, 20 bp, mouse
gtccgcacgcacccggagta

SEQ ID NO: 599922 - DNA, 20 bp, mouse
gaccggtccttgaggtcttg

SEQ ID NO: 599923 - DNA, 20 bp, mouse
gccctcaaagactgaagtag

SEQ ID NO: 599924 - DNA, 20 bp, mouse
ggggtgtcccatggagtgcg

SEQ ID NO: 599925 - DNA, 20 bp, mouse
gccattcaccgggcccaagg

SEQ ID NO: 599926 - DNA, 20 bp, mouse
gggctcgactgtgccaaccg

SEQ ID NO: 599927 - DNA, 20 bp, mouse
gcagcaccgaggagcacgtg

SEQ ID NO: 599928 - DNA, 20 bp, mouse
ggccaaccgcggcagcaccg

SEQ ID NO: 599929 - DNA, 20 bp, mouse
gggtcatacatagtgatgag

SEQ ID NO: 599930 - DNA, 20 bp, mouse
gccaggccccacgtgctcct

SEQ ID NO: 599931 - DNA, 20 bp, mouse
gtggcacagtcgagccagcg

SEQ ID NO: 599932 - DNA, 20 bp, mouse
gctctgtgccgaggacccga

SEQ ID NO: 599933 - DNA, 20 bp, mouse
gaaggtacctggtaggtccc

SEQ ID NO: 599934 - DNA, 20 bp, mouse
ggtggggcctgggacctacc

SEQ ID NO: 599935 - DNA, 20 bp, mouse
gacgggtcacgccagagacc

SEQ ID NO: 599936 - DNA, 20 bp, mouse
gtggccatggagggaaacag

SEQ ID NO: 599937 - DNA, 20 bp, mouse
gggtgaggcctctggaatag

SEQ ID NO: 599938 - DNA, 20 bp, mouse
ggtgcctgccactattccag

SEQ ID NO: 599939 - DNA, 20 bp, mouse
gggaaacagtggcttccgga

SEQ ID NO: 599940 - DNA, 20 bp, mouse
gcagtggcttccggaaggtg

SEQ ID NO: 599941 - DNA, 20 bp, mouse
gaggcctctggaatagtggc

SEQ ID NO: 599942 - DNA, 20 bp, mouse
gttccagaggcctcaccttc

SEQ ID NO: 599943 - DNA, 20 bp, mouse
gatcgagactgtggccatgg

SEQ ID NO: 599944 - DNA, 20 bp, mouse
gcacatcgagactgtggcca

SEQ ID NO: 599945 - DNA, 20 bp, mouse
gtaacaagctggacgaccag

SEQ ID NO: 599946 - DNA, 20 bp, mouse
gtctgtagccagccccagta

SEQ ID NO: 599947 - DNA, 20 bp, mouse
gttagggcaacaccctactg

SEQ ID NO: 599948 - DNA, 20 bp, mouse
ggatgctgggttctgaagag

SEQ ID NO: 599949 - DNA, 20 bp, mouse
gggggctggctacagagaca

SEQ ID NO: 599950 - DNA, 20 bp, mouse
gtgaggctgaagaggtaaag

SEQ ID NO: 599951 - DNA, 20 bp, mouse
gctcaggagaccatgtggat

SEQ ID NO: 599952 - DNA, 20 bp, mouse
gctgaagaggggctatgctt

SEQ ID NO: 599953 - DNA, 20 bp, mouse
ggactgggggatggtctcaa

SEQ ID NO: 599954 - DNA, 20 bp, mouse
gggggctggaacaagaacag

SEQ ID NO: 599955 - DNA, 20 bp, mouse
gaggtaaaggggctgactaa

SEQ ID NO: 599956 - DNA, 20 bp, mouse
ggtgagtgactgactcgtca

SEQ ID NO: 599957 - DNA, 20 bp, mouse
ggaaggtgcatggttcaccg

SEQ ID NO: 599958 - DNA, 20 bp, mouse
gcgacacttgtggaacacgc

SEQ ID NO: 599959 - DNA, 20 bp, mouse
gcgtcgcagaataagaagag

SEQ ID NO: 599960 - DNA, 20 bp, mouse
gcatacactctaggagtcac

SEQ ID NO: 599961 - DNA, 20 bp, mouse
gatacacactctaggagtcg

SEQ ID NO: 599962 - DNA, 20 bp, mouse
gcggcgacttaagtgcgtgt

SEQ ID NO: 599963 - DNA, 20 bp, mouse
gcatgcaccttcgacacttg

SEQ ID NO: 599964 - DNA, 20 bp, mouse
ggaccctccccatacactct

SEQ ID NO: 599965 - DNA, 20 bp, mouse
gactcctagagtgtatgggg

SEQ ID NO: 599966 - DNA, 20 bp, mouse
gggcggagccgagacggagt

SEQ ID NO: 599967 - DNA, 20 bp, mouse
gcagcgcggctacaaaactg

SEQ ID NO: 599968 - DNA, 20 bp, mouse
gtgaggaggcggagccgaga

SEQ ID NO: 599969 - DNA, 20 bp, mouse
gcgcggctacaaaactgagg

SEQ ID NO: 599970 - DNA, 20 bp, mouse
gtcctagaccaggtacccgg

SEQ ID NO: 599971 - DNA, 20 bp, mouse
gcgcagtaccgactccgtct

SEQ ID NO: 599972 - DNA, 20 bp, mouse
gggctacaaaactgaggagg

SEQ ID NO: 599973 - DNA, 20 bp, mouse
gctcccagcaaccggcctgg

SEQ ID NO: 599974 - DNA, 20 bp, mouse
ggccaccgggtacctggtct

SEQ ID NO: 599975 - DNA, 20 bp, mouse
gtccctgggagcgcaccagg

SEQ ID NO: 599976 - DNA, 20 bp, mouse
gagaagctggaggcgcggtg

SEQ ID NO: 599977 - DNA, 20 bp, mouse
ggcttccagggtgagcctca

SEQ ID NO: 599978 - DNA, 20 bp, mouse
gcaggtcggtaggtgcacag

SEQ ID NO: 599979 - DNA, 20 bp, mouse
gaacactaggccggcttcca

SEQ ID NO: 599980 - DNA, 20 bp, mouse
gcaactccggtaaggagcgg

SEQ ID NO: 599981 - DNA, 20 bp, mouse
gcttcgcgaggcaggtcccg

SEQ ID NO: 599982 - DNA, 20 bp, mouse
ggacagcgggcgctgagggg

SEQ ID NO: 599983 - DNA, 20 bp, mouse
ggaggcaggccagcacggga

SEQ ID NO: 599984 - DNA, 20 bp, mouse
gccgcctaggtaatgagggg

SEQ ID NO: 599985 - DNA, 20 bp, mouse
gtcaccgcctaggtaatgag

SEQ ID NO: 599986 - DNA, 20 bp, mouse
gactcgcggccgccaaggga

SEQ ID NO: 599987 - DNA, 20 bp, mouse
gtaccggtagggaccgtgag

SEQ ID NO: 599988 - DNA, 20 bp, mouse
gcgccactcacggtccctac

SEQ ID NO: 599989 - DNA, 20 bp, mouse
gggcgccgcggcagagaagg

SEQ ID NO: 599990 - DNA, 20 bp, mouse
gacgtcctgccgctaccggt

SEQ ID NO: 599991 - DNA, 20 bp, mouse
gtggcggcaggccggctctc

SEQ ID NO: 599992 - DNA, 20 bp, mouse
ggccggcctgccgccactca

SEQ ID NO: 599993 - DNA, 20 bp, mouse
gaccgtgagtggcggcaggc

SEQ ID NO: 599994 - DNA, 20 bp, mouse
gcgcgactcgcggccgccaa

SEQ ID NO: 599995 - DNA, 20 bp, mouse
ggacgcggagcggggaccga

SEQ ID NO: 599996 - DNA, 20 bp, mouse
gggatccgcgagcgccacca

SEQ ID NO: 599997 - DNA, 20 bp, mouse
gctccggctcctcagcacag

SEQ ID NO: 599998 - DNA, 20 bp, mouse
ggcttcggcagcgaccgcgg

SEQ ID NO: 599999 - DNA, 20 bp, mouse
gcaccgggacgcagaacctg

SEQ ID NO: 600000 - DNA, 20 bp, mouse
ggcggatccgagctcggctt

SEQ ID NO: 600001 - DNA, 20 bp, mouse
gcggcggttgaggcagttgg

SEQ ID NO: 600002 - DNA, 20 bp, mouse
gtgctgaggagccggagacg

SEQ ID NO: 600003 - DNA, 20 bp, mouse
gcggttgaggcagttggcgg

SEQ ID NO: 600004 - DNA, 20 bp, mouse
gtcgctgccgaagccgagct

SEQ ID NO: 600005 - DNA, 20 bp, mouse
ggaccggccgggtaccgcgg

SEQ ID NO: 600006 - DNA, 20 bp, mouse
ggaccacacgacagtgtcag

SEQ ID NO: 600007 - DNA, 20 bp, mouse
gaggtgcacactgggcctag

SEQ ID NO: 600008 - DNA, 20 bp, mouse
gtcacctggctatcccttca

SEQ ID NO: 600009 - DNA, 20 bp, mouse
gtgggcctagaggtgagttc

SEQ ID NO: 600010 - DNA, 20 bp, mouse
gggtgaagacggggcattgt

SEQ ID NO: 600011 - DNA, 20 bp, mouse
gtcaccatgaagggatagcc

SEQ ID NO: 600012 - DNA, 20 bp, mouse
gctggctatgctcaccatga

SEQ ID NO: 600013 - DNA, 20 bp, mouse
gcagtgtgcacctggaaata

SEQ ID NO: 600014 - DNA, 20 bp, mouse
gatagccagaactcacctct

SEQ ID NO: 600015 - DNA, 20 bp, mouse
gcggcaggagcgacaggaga

SEQ ID NO: 600016 - DNA, 20 bp, mouse
gacaatcagagggccgggac

SEQ ID NO: 600017 - DNA, 20 bp, mouse
ggcggctgccggctccatct

SEQ ID NO: 600018 - DNA, 20 bp, mouse
gaccgggcgggtgacagagg

SEQ ID NO: 600019 - DNA, 20 bp, mouse
gccaggaggaggctgcgcgg

SEQ ID NO: 600020 - DNA, 20 bp, mouse
gcgtccgcgaattgagccgg

SEQ ID NO: 600021 - DNA, 20 bp, mouse
ggcttgttgttcacaatcag

SEQ ID NO: 600022 - DNA, 20 bp, mouse
gttgttcacaatcagagggc

SEQ ID NO: 600023 - DNA, 20 bp, mouse
gaaccagcgcaaagactcgg

SEQ ID NO: 600024 - DNA, 20 bp, mouse
ggctgcgcggtggcaggcgg

SEQ ID NO: 600025 - DNA, 20 bp, mouse
gcttggctgctccacacccc

SEQ ID NO: 600026 - DNA, 20 bp, mouse
gagatcttggagctacggta

SEQ ID NO: 600027 - DNA, 20 bp, mouse
ggctgaggcgaaccgctgaa

SEQ ID NO: 600028 - DNA, 20 bp, mouse
gctacggtagggagccgctg

SEQ ID NO: 600029 - DNA, 20 bp, mouse
gctgggaaggttcccttcag

SEQ ID NO: 600030 - DNA, 20 bp, mouse
gcccagcatggacgaccccg

SEQ ID NO: 600031 - DNA, 20 bp, mouse
gtcgccctgggcagagatct

SEQ ID NO: 600032 - DNA, 20 bp, mouse
gtcggaggtgaggaacccgg

SEQ ID NO: 600033 - DNA, 20 bp, mouse
gggaagccggccgtgcccaa

SEQ ID NO: 600034 - DNA, 20 bp, mouse
gaaccagcggcgggagtcgg

SEQ ID NO: 600035 - DNA, 20 bp, mouse
gcccgcagcgggaagggacc

SEQ ID NO: 600036 - DNA, 20 bp, mouse
gctgcctaggcgcccagcag

SEQ ID NO: 600037 - DNA, 20 bp, mouse
gccgccgctgctgggcgcct

SEQ ID NO: 600038 - DNA, 20 bp, mouse
gctaggcagagagctccccg

SEQ ID NO: 600039 - DNA, 20 bp, mouse
ggaagtgcaagatccccggg

SEQ ID NO: 600040 - DNA, 20 bp, mouse
ggcagcggccggagacggag

SEQ ID NO: 600041 - DNA, 20 bp, mouse
gcagcggcggcaaactgcgg

SEQ ID NO: 600042 - DNA, 20 bp, mouse
gtggcggccgcacgaacccc

SEQ ID NO: 600043 - DNA, 20 bp, mouse
gcccgcctgctcgtccatgg

SEQ ID NO: 600044 - DNA, 20 bp, mouse
gggccccgcctgctcgtcca

SEQ ID NO: 600045 - DNA, 20 bp, mouse
ggaatgggcccgcttcgagg

SEQ ID NO: 600046 - DNA, 20 bp, mouse
gtgagacgggcagatggagg

SEQ ID NO: 600047 - DNA, 20 bp, mouse
gagctccctgctctgatccg

SEQ ID NO: 600048 - DNA, 20 bp, mouse
gggaggaggtaccgtaatgg

SEQ ID NO: 600049 - DNA, 20 bp, mouse
ggatggaggaggtaccgtaa

SEQ ID NO: 600050 - DNA, 20 bp, mouse
ggagtgagacgggcagatgg

SEQ ID NO: 600051 - DNA, 20 bp, mouse
ggccggggccccacacacaa

SEQ ID NO: 600052 - DNA, 20 bp, mouse
gggaggtaccgtaatggcgg

SEQ ID NO: 600053 - DNA, 20 bp, mouse
gcttgccgcggatcagagca

SEQ ID NO: 600054 - DNA, 20 bp, mouse
gctgatccgcggcaagcaca

SEQ ID NO: 600055 - DNA, 20 bp, mouse
ggccgcagcagggacccggg

SEQ ID NO: 600056 - DNA, 20 bp, mouse
gcgtgcccgagcccagaggg

SEQ ID NO: 600057 - DNA, 20 bp, mouse
ggccgctcgctcctccatca

SEQ ID NO: 600058 - DNA, 20 bp, mouse
ggaggcggccgatgcgaccg

SEQ ID NO: 600059 - DNA, 20 bp, mouse
ggcaggcgcgcgaggtacag

SEQ ID NO: 600060 - DNA, 20 bp, mouse
ggcggccgatgcgaccgcgg

SEQ ID NO: 600061 - DNA, 20 bp, mouse
gggatccccggcaggctgag

SEQ ID NO: 600062 - DNA, 20 bp, mouse
gagccgtgcccgagcccaga

SEQ ID NO: 600063 - DNA, 20 bp, mouse
gccggcccggtaggaaaagg

SEQ ID NO: 600064 - DNA, 20 bp, mouse
ggaagcgtgcccactcgtgt

SEQ ID NO: 600065 - DNA, 20 bp, mouse
gggcacggctcccaacccga

SEQ ID NO: 600066 - DNA, 20 bp, mouse
gttcctgaggagcatccgtg

SEQ ID NO: 600067 - DNA, 20 bp, mouse
ggagtgcgccgctgaacgga

SEQ ID NO: 600068 - DNA, 20 bp, mouse
ggccgctgaacggatggcag

SEQ ID NO: 600069 - DNA, 20 bp, mouse
gggagcagagtgggttcctg

SEQ ID NO: 600070 - DNA, 20 bp, mouse
gggtagcgctagaggattag

SEQ ID NO: 600071 - DNA, 20 bp, mouse
gccccctgccatccgttcag

SEQ ID NO: 600072 - DNA, 20 bp, mouse
gggttgagtgcgccgctgaa

SEQ ID NO: 600073 - DNA, 20 bp, mouse
gtggggcaccagacgatctg

SEQ ID NO: 600074 - DNA, 20 bp, mouse
gcaccagacgatctgaggaa

SEQ ID NO: 600075 - DNA, 20 bp, mouse
gtccgtgaggtgagaaactc

SEQ ID NO: 600076 - DNA, 20 bp, mouse
gccgccgccggggcacaaca

SEQ ID NO: 600077 - DNA, 20 bp, mouse
gcacccctcgctccaggcgg

SEQ ID NO: 600078 - DNA, 20 bp, mouse
gcgccgccgcctggagcgag

SEQ ID NO: 600079 - DNA, 20 bp, mouse
gccgccggggcacaacatgg

SEQ ID NO: 600080 - DNA, 20 bp, mouse
ggacgagggcgccagaggag

SEQ ID NO: 600081 - DNA, 20 bp, mouse
ggcctggagcgaggggtgct

SEQ ID NO: 600082 - DNA, 20 bp, mouse
ggccgcgaggagcacaaaag

SEQ ID NO: 600083 - DNA, 20 bp, mouse
gagaccgggtgggatccgag

SEQ ID NO: 600084 - DNA, 20 bp, mouse
ggggtctcgctcgtcctccg

SEQ ID NO: 600085 - DNA, 20 bp, mouse
ggccaggaagaggatggtga

SEQ ID NO: 600086 - DNA, 20 bp, mouse
ggcgggctgcgagatctagg

SEQ ID NO: 600087 - DNA, 20 bp, mouse
gtgcgcgggctgcgagatct

SEQ ID NO: 600088 - DNA, 20 bp, mouse
gtgccgcgcggcgccatgaa

SEQ ID NO: 600089 - DNA, 20 bp, mouse
gcccacaccggaagttccgg

SEQ ID NO: 600090 - DNA, 20 bp, mouse
ggcgccgcgcggcacggctt

SEQ ID NO: 600091 - DNA, 20 bp, mouse
gggccgcaagtacccggagg

SEQ ID NO: 600092 - DNA, 20 bp, mouse
gctgcgagatctaggtggcc

SEQ ID NO: 600093 - DNA, 20 bp, mouse
ggcccctcccgcactcacga

SEQ ID NO: 600094 - DNA, 20 bp, mouse
gagctgcctgcggccattaa

SEQ ID NO: 600095 - DNA, 20 bp, mouse
gcggaggcggcggcctgcta

SEQ ID NO: 600096 - DNA, 20 bp, mouse
gggccagcaagaagcggagg

SEQ ID NO: 600097 - DNA, 20 bp, mouse
gagcccgggccagcaagaag

SEQ ID NO: 600098 - DNA, 20 bp, mouse
gggacgccgggaggacaccg

SEQ ID NO: 600099 - DNA, 20 bp, mouse
ggacgcggccctgcggctca

SEQ ID NO: 600100 - DNA, 20 bp, mouse
gcggctgagaagcgcagccc

SEQ ID NO: 600101 - DNA, 20 bp, mouse
gccgggccagcaagaagcgg

SEQ ID NO: 600102 - DNA, 20 bp, mouse
ggtccgagccctgagccgca

SEQ ID NO: 600103 - DNA, 20 bp, mouse
gtcgtcctgaaggtacctag

SEQ ID NO: 600104 - DNA, 20 bp, mouse
gacaccgcggcgtgtccccg

SEQ ID NO: 600105 - DNA, 20 bp, mouse
ggagccgcggggacacgccg

SEQ ID NO: 600106 - DNA, 20 bp, mouse
gagctgctgggcccggtcag

SEQ ID NO: 600107 - DNA, 20 bp, mouse
ggtcagtggcagcttccggt

SEQ ID NO: 600108 - DNA, 20 bp, mouse
gcgcttcgcggcgctcctac

SEQ ID NO: 600109 - DNA, 20 bp, mouse
gatgacagtgagcagagacc

SEQ ID NO: 600110 - DNA, 20 bp, mouse
gcggcctgagggacagacgg

SEQ ID NO: 600111 - DNA, 20 bp, mouse
gtacatgtctaagggaccgt

SEQ ID NO: 600112 - DNA, 20 bp, mouse
gcccggtcagtggcagcttc

SEQ ID NO: 600113 - DNA, 20 bp, mouse
gagcgccgcgaagcgcgacc

SEQ ID NO: 600114 - DNA, 20 bp, mouse
gtggtgaagctgccaagtcg

SEQ ID NO: 600115 - DNA, 20 bp, mouse
gatgcagtggcaacatccag

SEQ ID NO: 600116 - DNA, 20 bp, mouse
gagcctgatcccgggatgga

SEQ ID NO: 600117 - DNA, 20 bp, mouse
gagggttgcagcctgatccc

SEQ ID NO: 600118 - DNA, 20 bp, mouse
gagagcccgggaccactgca

SEQ ID NO: 600119 - DNA, 20 bp, mouse
gcaccggcaccctccatccc

SEQ ID NO: 600120 - DNA, 20 bp, mouse
gttgcagcctgatcccggga

SEQ ID NO: 600121 - DNA, 20 bp, mouse
ggccgagcccacaacgacaa

SEQ ID NO: 600122 - DNA, 20 bp, mouse
gatggagggtgccggtgaag

SEQ ID NO: 600123 - DNA, 20 bp, mouse
gggcctccacgaggacctca

SEQ ID NO: 600124 - DNA, 20 bp, mouse
gggtgggagaccctgagagg

SEQ ID NO: 600125 - DNA, 20 bp, mouse
gacggaagcggccttgggca

SEQ ID NO: 600126 - DNA, 20 bp, mouse
gcagcccagcgaccccgtgg

SEQ ID NO: 600127 - DNA, 20 bp, mouse
gcgcctaggcgggaggtaag

SEQ ID NO: 600128 - DNA, 20 bp, mouse
gtcgacggcctcgagcgcct

SEQ ID NO: 600129 - DNA, 20 bp, mouse
gagccccttacctcccgcct

SEQ ID NO: 600130 - DNA, 20 bp, mouse
gacggcctcgagcgcctagg

SEQ ID NO: 600131 - DNA, 20 bp, mouse
gcctcgagcgcctaggcggg

SEQ ID NO: 600132 - DNA, 20 bp, mouse
gtcgcagcccagcgaccccg

SEQ ID NO: 600133 - DNA, 20 bp, mouse
gggccgggctgtggacgcaa

SEQ ID NO: 600134 - DNA, 20 bp, mouse
gggctgtggacgcaagggag

SEQ ID NO: 600135 - DNA, 20 bp, mouse
gctgccgccacggggtcgct

SEQ ID NO: 600136 - DNA, 20 bp, mouse
gcatagcgacccgcaaccca

SEQ ID NO: 600137 - DNA, 20 bp, mouse
gcgtcagcagctagcgaccc

SEQ ID NO: 600138 - DNA, 20 bp, mouse
gagcgaccccggcaagaact

SEQ ID NO: 600139 - DNA, 20 bp, mouse
gccagggcctgaagccggcc

SEQ ID NO: 600140 - DNA, 20 bp, mouse
ggcaacccagggcctgaagc

SEQ ID NO: 600141 - DNA, 20 bp, mouse
gagcaaccgagttcttgccg

SEQ ID NO: 600142 - DNA, 20 bp, mouse
gggctggagaagtctccctt

SEQ ID NO: 600143 - DNA, 20 bp, mouse
ggcagaagccctcggcccaa

SEQ ID NO: 600144 - DNA, 20 bp, mouse
gtccagccgggcccgtgaag

SEQ ID NO: 600145 - DNA, 20 bp, mouse
gctgctgacgtgtgcctggc

SEQ ID NO: 600146 - DNA, 20 bp, mouse
ggctgtaactatgaagtgag

SEQ ID NO: 600147 - DNA, 20 bp, mouse
gaggcagaacctgattctcc

SEQ ID NO: 600148 - DNA, 20 bp, mouse
gggactctcacaccccaggt

SEQ ID NO: 600149 - DNA, 20 bp, mouse
gggccaggcattacactcca

SEQ ID NO: 600150 - DNA, 20 bp, mouse
gaaatataattcacttacct

SEQ ID NO: 600151 - DNA, 20 bp, mouse
gcacctgttcctcacattaa

SEQ ID NO: 600152 - DNA, 20 bp, mouse
gactgtatgagaaccataaa

SEQ ID NO: 600153 - DNA, 20 bp, mouse
gtggcacttggattttctct

SEQ ID NO: 600154 - DNA, 20 bp, mouse
gctaaatcagtctaagccac

SEQ ID NO: 600155 - DNA, 20 bp, mouse
gcttatttgacttcactgtt

SEQ ID NO: 600156 - DNA, 20 bp, mouse
gagcatgaaggaccgaaccc

SEQ ID NO: 600157 - DNA, 20 bp, mouse
gggcgcctactgccactccc

SEQ ID NO: 600158 - DNA, 20 bp, mouse
gctcaccgtgcggagctcct

SEQ ID NO: 600159 - DNA, 20 bp, mouse
ggaggatcggactcaccgtg

SEQ ID NO: 600160 - DNA, 20 bp, mouse
ggccactcccgggagcatga

SEQ ID NO: 600161 - DNA, 20 bp, mouse
ggtgagcggcgcacgaggat

SEQ ID NO: 600162 - DNA, 20 bp, mouse
gtccttcatgctcccgggag

SEQ ID NO: 600163 - DNA, 20 bp, mouse
gcgtgcggagctcctgggtt

SEQ ID NO: 600164 - DNA, 20 bp, mouse
gttcggtccttcatgctccc

SEQ ID NO: 600165 - DNA, 20 bp, mouse
gcgcgcatgcgggacttact

SEQ ID NO: 600166 - DNA, 20 bp, mouse
gagggggataggagaagaca

SEQ ID NO: 600167 - DNA, 20 bp, mouse
gccccacctcatagagacaa

SEQ ID NO: 600168 - DNA, 20 bp, mouse
ggacatcgcctaggggagga

SEQ ID NO: 600169 - DNA, 20 bp, mouse
gtcaggacctcacgtaggct

SEQ ID NO: 600170 - DNA, 20 bp, mouse
gcgcttgcctagcctacgtg

SEQ ID NO: 600171 - DNA, 20 bp, mouse
gaaagagtaagtcgccctgg

SEQ ID NO: 600172 - DNA, 20 bp, mouse
gtgtgaacagagacaagcta

SEQ ID NO: 600173 - DNA, 20 bp, mouse
ggctaaagagtaagtcgccc

SEQ ID NO: 600174 - DNA, 20 bp, mouse
ggccgaggcgacatagcttg

SEQ ID NO: 600175 - DNA, 20 bp, mouse
ggggacatgttctacagcgg

SEQ ID NO: 600176 - DNA, 20 bp, mouse
gacaggggcctgggccgact

SEQ ID NO: 600177 - DNA, 20 bp, mouse
gctaggctgcggtggcgatg

SEQ ID NO: 600178 - DNA, 20 bp, mouse
gtgcggctgcggcacagggt

SEQ ID NO: 600179 - DNA, 20 bp, mouse
gaggcgggaggacgaagaag

SEQ ID NO: 600180 - DNA, 20 bp, mouse
ggctgcggcacagggttgga

SEQ ID NO: 600181 - DNA, 20 bp, mouse
gcaggtgccaggagatgtga

SEQ ID NO: 600182 - DNA, 20 bp, mouse
gcggagtgtgagctaagggg

SEQ ID NO: 600183 - DNA, 20 bp, mouse
gcgggaggacgaagaagggg

SEQ ID NO: 600184 - DNA, 20 bp, mouse
gccgtcgcaggatgaaggat

SEQ ID NO: 600185 - DNA, 20 bp, mouse
gcctggaggccggggtctgg

SEQ ID NO: 600186 - DNA, 20 bp, mouse
gccaggaccccggcaggcag

SEQ ID NO: 600187 - DNA, 20 bp, mouse
gggaccccggcaggcagagg

SEQ ID NO: 600188 - DNA, 20 bp, mouse
gcccgccgcacactctccgg

SEQ ID NO: 600189 - DNA, 20 bp, mouse
ggcggccaccggagagtgtg

SEQ ID NO: 600190 - DNA, 20 bp, mouse
gtgccccgccgcacactctc

SEQ ID NO: 600191 - DNA, 20 bp, mouse
gggtggagagacgcaaggag

SEQ ID NO: 600192 - DNA, 20 bp, mouse
ggccaccggagagtgtgcgg

SEQ ID NO: 600193 - DNA, 20 bp, mouse
ggaggcggcgacgcggccac

SEQ ID NO: 600194 - DNA, 20 bp, mouse
gcggctgcccgacctcacgg

SEQ ID NO: 600195 - DNA, 20 bp, mouse
gagtccagaagcaagacctt

SEQ ID NO: 600196 - DNA, 20 bp, mouse
gagagagctgctagagcggg

SEQ ID NO: 600197 - DNA, 20 bp, mouse
ggcgagagagctgctagagc

SEQ ID NO: 600198 - DNA, 20 bp, mouse
gccaagtgagcggcctggag

SEQ ID NO: 600199 - DNA, 20 bp, mouse
ggagctgctagagcgggcgg

SEQ ID NO: 600200 - DNA, 20 bp, mouse
gagtgagcggcctggagcgg

SEQ ID NO: 600201 - DNA, 20 bp, mouse
gtgagcgcgtcccaagtgag

SEQ ID NO: 600202 - DNA, 20 bp, mouse
ggcggcggccgctctcgagg

SEQ ID NO: 600203 - DNA, 20 bp, mouse
gggacgctcctcctcgagag

SEQ ID NO: 600204 - DNA, 20 bp, mouse
ggcggcgcggcggacctcgg

SEQ ID NO: 600205 - DNA, 20 bp, mouse
ggacgcgctcacctgagaca

SEQ ID NO: 600206 - DNA, 20 bp, mouse
ggcagctgcgggagcaggat

SEQ ID NO: 600207 - DNA, 20 bp, mouse
gtggggaagaacccgatcat

SEQ ID NO: 600208 - DNA, 20 bp, mouse
gctcggagtcatcccccgag

SEQ ID NO: 600209 - DNA, 20 bp, mouse
gcccccaaagttctacaggt

SEQ ID NO: 600210 - DNA, 20 bp, mouse
gaggacccccaaagttctac

SEQ ID NO: 600211 - DNA, 20 bp, mouse
gggcaggtgagaaaccggga

SEQ ID NO: 600212 - DNA, 20 bp, mouse
gctcgccccgcaggaaccat

SEQ ID NO: 600213 - DNA, 20 bp, mouse
gggagtcatcccccgagggg

SEQ ID NO: 600214 - DNA, 20 bp, mouse
gccgagcccaaagggcctca

SEQ ID NO: 600215 - DNA, 20 bp, mouse
gccctttgggctcgggtcca

SEQ ID NO: 600216 - DNA, 20 bp, mouse
gggaagccggaccaaagaac

SEQ ID NO: 600217 - DNA, 20 bp, mouse
gggagtacgtctaggtgacg

SEQ ID NO: 600218 - DNA, 20 bp, mouse
ggtacgtctaggtgacgtgg

SEQ ID NO: 600219 - DNA, 20 bp, mouse
gccgagttaggagtacgtct

SEQ ID NO: 600220 - DNA, 20 bp, mouse
gtcgaaggacttgtaagcag

SEQ ID NO: 600221 - DNA, 20 bp, mouse
ggcagccacgtcaccgagtt

SEQ ID NO: 600222 - DNA, 20 bp, mouse
gccgggcagcggcttgacgg

SEQ ID NO: 600223 - DNA, 20 bp, mouse
gacacttcggagggcggagg

SEQ ID NO: 600224 - DNA, 20 bp, mouse
ggcttacaagtccttcgagg

SEQ ID NO: 600225 - DNA, 20 bp, mouse
ggaggtggacacacttcgga

SEQ ID NO: 600226 - DNA, 20 bp, mouse
gcgcagacccgggtgcccgt

SEQ ID NO: 600227 - DNA, 20 bp, mouse
gcggccgtcggtccagcagt

SEQ ID NO: 600228 - DNA, 20 bp, mouse
gtggagtgggattcgacccg

SEQ ID NO: 600229 - DNA, 20 bp, mouse
gcgacggccgacgggcaccc

SEQ ID NO: 600230 - DNA, 20 bp, mouse
gcactccaagccggccccca

SEQ ID NO: 600231 - DNA, 20 bp, mouse
gtgaccgactgctggaccga

SEQ ID NO: 600232 - DNA, 20 bp, mouse
gcagcagtgcgcgcagaccc

SEQ ID NO: 600233 - DNA, 20 bp, mouse
ggtagtgaaggggtgagtgt

SEQ ID NO: 600234 - DNA, 20 bp, mouse
ggcgcggtgtccgagcacag

SEQ ID NO: 600235 - DNA, 20 bp, mouse
gtgctggaccgacggccgac

SEQ ID NO: 600236 - DNA, 20 bp, mouse
ggtgggcccccgggtgacag

SEQ ID NO: 600237 - DNA, 20 bp, mouse
gtccagccgctgtcacccgg

SEQ ID NO: 600238 - DNA, 20 bp, mouse
gcgccaggcagtgggccccc

SEQ ID NO: 600239 - DNA, 20 bp, mouse
ggaggaagccggcgaggtca

SEQ ID NO: 600240 - DNA, 20 bp, mouse
ggccgcccatcagctgagac

SEQ ID NO: 600241 - DNA, 20 bp, mouse
ggccggtctcagctgatggg

SEQ ID NO: 600242 - DNA, 20 bp, mouse
gccggcgaggtcagggtaag

SEQ ID NO: 600243 - DNA, 20 bp, mouse
gcgcagagcggggctcccca

SEQ ID NO: 600244 - DNA, 20 bp, mouse
ggggtgacagcggctggagg

SEQ ID NO: 600245 - DNA, 20 bp, mouse
ggcagccggtctcagctgat

SEQ ID NO: 600246 - DNA, 20 bp, mouse
ggaagtgtcccagctgcggg

SEQ ID NO: 600247 - DNA, 20 bp, mouse
gcatcaccggcaactcacca

SEQ ID NO: 600248 - DNA, 20 bp, mouse
gcatactctgctgccatcac

SEQ ID NO: 600249 - DNA, 20 bp, mouse
ggcgggcggagactgcacca

SEQ ID NO: 600250 - DNA, 20 bp, mouse
ggcaccgagtaggcagtacg

SEQ ID NO: 600251 - DNA, 20 bp, mouse
gcacagagttagcaccgagt

SEQ ID NO: 600252 - DNA, 20 bp, mouse
gcaccatggccccggacccc

SEQ ID NO: 600253 - DNA, 20 bp, mouse
gggagactgcaccatggccc

SEQ ID NO: 600254 - DNA, 20 bp, mouse
gaactctgtggtcctagggt

SEQ ID NO: 600255 - DNA, 20 bp, mouse
ggtagtcagctgctacgagc

SEQ ID NO: 600256 - DNA, 20 bp, mouse
gcccgagcgcgactgcgggg

SEQ ID NO: 600257 - DNA, 20 bp, mouse
gcggcgggctgcagacagcg

SEQ ID NO: 600258 - DNA, 20 bp, mouse
gctgggtgaagcgtgagtca

SEQ ID NO: 600259 - DNA, 20 bp, mouse
gcgacaccgtcgcctccccc

SEQ ID NO: 600260 - DNA, 20 bp, mouse
gggtcccgagcgcgactgcg

SEQ ID NO: 600261 - DNA, 20 bp, mouse
gggtgtcgcgggaggagcat

SEQ ID NO: 600262 - DNA, 20 bp, mouse
gggaggaccgaggtgaagag

SEQ ID NO: 600263 - DNA, 20 bp, mouse
gaggcgccgccctcccggga

SEQ ID NO: 600264 - DNA, 20 bp, mouse
ggagggcggcgcctgaataa

SEQ ID NO: 600265 - DNA, 20 bp, mouse
gaggggcatccctcccggga

SEQ ID NO: 600266 - DNA, 20 bp, mouse
gccaccgccttcagccccaa

SEQ ID NO: 600267 - DNA, 20 bp, mouse
gcgggtcggtcccaaggtgg

SEQ ID NO: 600268 - DNA, 20 bp, mouse
ggaagcagcgctattcctca

SEQ ID NO: 600269 - DNA, 20 bp, mouse
ggggctgaaggcggtggtag

SEQ ID NO: 600270 - DNA, 20 bp, mouse
ggctattcctcaggggaaga

SEQ ID NO: 600271 - DNA, 20 bp, mouse
gaggtccccagatcccccaa

SEQ ID NO: 600272 - DNA, 20 bp, mouse
ggaaagtgagtgtcaccccg

SEQ ID NO: 600273 - DNA, 20 bp, mouse
gaatagcgctgcttccgggt

SEQ ID NO: 600274 - DNA, 20 bp, mouse
ggatctggggacctcgggag

SEQ ID NO: 600275 - DNA, 20 bp, mouse
gggggaagatggcgcccttg

SEQ ID NO: 600276 - DNA, 20 bp, mouse
ggtccccgctccgataccgg

SEQ ID NO: 600277 - DNA, 20 bp, mouse
gaagatggcgccgccggtat

SEQ ID NO: 600278 - DNA, 20 bp, mouse
ggccggaaggagtcaagcca

SEQ ID NO: 600279 - DNA, 20 bp, mouse
gtggcacgaaacccgactct

SEQ ID NO: 600280 - DNA, 20 bp, mouse
gtcgtgtggcggagtgagtg

SEQ ID NO: 600281 - DNA, 20 bp, mouse
gttgcggaagaacctcaccg

SEQ ID NO: 600282 - DNA, 20 bp, mouse
gtggcggagtgagtgcggag

SEQ ID NO: 600283 - DNA, 20 bp, mouse
gcccgagtcaggtcgcccaa

SEQ ID NO: 600284 - DNA, 20 bp, mouse
gccagacgcggccttctccg

SEQ ID NO: 600285 - DNA, 20 bp, mouse
gtggccaccccgcccatccc

SEQ ID NO: 600286 - DNA, 20 bp, mouse
ggagatggcgctgcaggtat

SEQ ID NO: 600287 - DNA, 20 bp, mouse
gctgtagctccacggctggg

SEQ ID NO: 600288 - DNA, 20 bp, mouse
gccctagcttccgagtctgg

SEQ ID NO: 600289 - DNA, 20 bp, mouse
ggggtcctacacatcgaaca

SEQ ID NO: 600290 - DNA, 20 bp, mouse
gattagagctttgttcgggt

SEQ ID NO: 600291 - DNA, 20 bp, mouse
gtggggggagatggcgctgc

SEQ ID NO: 600292 - DNA, 20 bp, mouse
gacagccatgttcgatgtgt

SEQ ID NO: 600293 - DNA, 20 bp, mouse
gctactttggccctgaaagc

SEQ ID NO: 600294 - DNA, 20 bp, mouse
gactcggcgccaagaggtaa

SEQ ID NO: 600295 - DNA, 20 bp, mouse
gaagacgcatgaggtttatt

SEQ ID NO: 600296 - DNA, 20 bp, mouse
gaggccgggtggcccgaaga

SEQ ID NO: 600297 - DNA, 20 bp, mouse
ggtagcgccactgctaactg

SEQ ID NO: 600298 - DNA, 20 bp, mouse
gtcgacctagcggcccccag

SEQ ID NO: 600299 - DNA, 20 bp, mouse
gcagtggcgctacggaggcc

SEQ ID NO: 600300 - DNA, 20 bp, mouse
gcagattccacagttagcag

SEQ ID NO: 600301 - DNA, 20 bp, mouse
gggccgctaggtcgagacaa

SEQ ID NO: 600302 - DNA, 20 bp, mouse
gctgtggaatctggtagtca

SEQ ID NO: 600303 - DNA, 20 bp, mouse
ggttagcagtggcgctacgg

SEQ ID NO: 600304 - DNA, 20 bp, mouse
gaccccaagtgagagccccg

SEQ ID NO: 600305 - DNA, 20 bp, mouse
gtcagcggcggaaagcaacg

SEQ ID NO: 600306 - DNA, 20 bp, mouse
gcaacgctcggtagagcagg

SEQ ID NO: 600307 - DNA, 20 bp, mouse
gagggtccgaggctcacggg

SEQ ID NO: 600308 - DNA, 20 bp, mouse
ggcggccggcgctggaaccg

SEQ ID NO: 600309 - DNA, 20 bp, mouse
gcgctgcgaggcccaggtag

SEQ ID NO: 600310 - DNA, 20 bp, mouse
ggcggggagcgaaggagcag

SEQ ID NO: 600311 - DNA, 20 bp, mouse
gccggggagagagcgacagg

SEQ ID NO: 600312 - DNA, 20 bp, mouse
gtaccgagcgttgagggcca

SEQ ID NO: 600313 - DNA, 20 bp, mouse
ggggctgcgggccatggatg

SEQ ID NO: 600314 - DNA, 20 bp, mouse
ggggcggctgcgctgaacgg

SEQ ID NO: 600315 - DNA, 20 bp, mouse
gaggcgacagcgagcatccg

SEQ ID NO: 600316 - DNA, 20 bp, mouse
gaccagagggacccgagaag

SEQ ID NO: 600317 - DNA, 20 bp, mouse
ggccaggcaccaggaccaga

SEQ ID NO: 600318 - DNA, 20 bp, mouse
gccgagaagcggccggatcc

SEQ ID NO: 600319 - DNA, 20 bp, mouse
gcgaaggtccagcccggatc

SEQ ID NO: 600320 - DNA, 20 bp, mouse
gagccgccggccagcccgtg

SEQ ID NO: 600321 - DNA, 20 bp, mouse
ggagggacccgagaagcggc

SEQ ID NO: 600322 - DNA, 20 bp, mouse
gggccagcccgtgaggcgga

SEQ ID NO: 600323 - DNA, 20 bp, mouse
gggcgtgcgcacaggtgtga

SEQ ID NO: 600324 - DNA, 20 bp, mouse
ggaagcggccggatccgggc

SEQ ID NO: 600325 - DNA, 20 bp, mouse
gtccgcgccctccgcctcac

SEQ ID NO: 600326 - DNA, 20 bp, mouse
ggaggggtcggggaaactcc

SEQ ID NO: 600327 - DNA, 20 bp, mouse
gctgccccgcgcggagatcg

SEQ ID NO: 600328 - DNA, 20 bp, mouse
gctcctggcaactccaactc

SEQ ID NO: 600329 - DNA, 20 bp, mouse
gcgaagacagggctcccccg

SEQ ID NO: 600330 - DNA, 20 bp, mouse
gtggagggcggcaggagaag

SEQ ID NO: 600331 - DNA, 20 bp, mouse
gtttgctagctcgcactcgg

SEQ ID NO: 600332 - DNA, 20 bp, mouse
gcggggcaggcggagagggt

SEQ ID NO: 600333 - DNA, 20 bp, mouse
ggcactcggcggcagcgggc

SEQ ID NO: 600334 - DNA, 20 bp, mouse
gcgcgtcccaaccgaagaca

SEQ ID NO: 600335 - DNA, 20 bp, mouse
ggagctctggcgcccggagt

SEQ ID NO: 600336 - DNA, 20 bp, mouse
ggttcagtgggactttgtgg

SEQ ID NO: 600337 - DNA, 20 bp, mouse
gatcagcagtcaggatggtt

SEQ ID NO: 600338 - DNA, 20 bp, mouse
gacaatggtttggataaagg

SEQ ID NO: 600339 - DNA, 20 bp, mouse
gagcagtcaggatggttcgg

SEQ ID NO: 600340 - DNA, 20 bp, mouse
gtgcttcaagattgtagcag

SEQ ID NO: 600341 - DNA, 20 bp, mouse
gatgtgatcatgctgaagta

SEQ ID NO: 600342 - DNA, 20 bp, mouse
gaaagtcccactgaacttat

SEQ ID NO: 600343 - DNA, 20 bp, mouse
gaatttccaataagttcagt

SEQ ID NO: 600344 - DNA, 20 bp, mouse
gtcctacattatatttcagt

SEQ ID NO: 600345 - DNA, 20 bp, mouse
gtagatatttatcagcagtc

SEQ ID NO: 600346 - DNA, 20 bp, mouse
ggagagccgggatccgaccc

SEQ ID NO: 600347 - DNA, 20 bp, mouse
gggcgggaggagacggttat

SEQ ID NO: 600348 - DNA, 20 bp, mouse
gtcgtgcctgggtcggatcc

SEQ ID NO: 600349 - DNA, 20 bp, mouse
gtatgggctcgtgcctgggt

SEQ ID NO: 600350 - DNA, 20 bp, mouse
gtgcttggccggagacccgg

SEQ ID NO: 600351 - DNA, 20 bp, mouse
gggccgccgggcactcacct

SEQ ID NO: 600352 - DNA, 20 bp, mouse
ggggattggctgggccgcgt

SEQ ID NO: 600353 - DNA, 20 bp, mouse
gtcccgcgggaccctatcgg

SEQ ID NO: 600354 - DNA, 20 bp, mouse
gtcctcccgcgggaccctat

SEQ ID NO: 600355 - DNA, 20 bp, mouse
ggcgggccgtcggcgagcgt

SEQ ID NO: 600356 - DNA, 20 bp, mouse
gacagacggtcaccaggatt

SEQ ID NO: 600357 - DNA, 20 bp, mouse
ggacggtcaccaggattagg

SEQ ID NO: 600358 - DNA, 20 bp, mouse
gagtaccgggttgctagggg

SEQ ID NO: 600359 - DNA, 20 bp, mouse
gtctagtaccgggttgctag

SEQ ID NO: 600360 - DNA, 20 bp, mouse
ggacctagcgctaggacaga

SEQ ID NO: 600361 - DNA, 20 bp, mouse
gagcgctaggtcccggaagt

SEQ ID NO: 600362 - DNA, 20 bp, mouse
gcaggattaggcggaatctt

SEQ ID NO: 600363 - DNA, 20 bp, mouse
ggagcgctcgcccggaggac

SEQ ID NO: 600364 - DNA, 20 bp, mouse
gccggtactagaaggactct

SEQ ID NO: 600365 - DNA, 20 bp, mouse
ggaagcctggaacctcaaca

SEQ ID NO: 600366 - DNA, 20 bp, mouse
gaggcgagcgagcgaggcag

SEQ ID NO: 600367 - DNA, 20 bp, mouse
gtcggctcggctccccagag

SEQ ID NO: 600368 - DNA, 20 bp, mouse
ggagcggagcgtgagtgcgt

SEQ ID NO: 600369 - DNA, 20 bp, mouse
gaccccgggcccattcctcg

SEQ ID NO: 600370 - DNA, 20 bp, mouse
gcgaggcagaggtttttggt

SEQ ID NO: 600371 - DNA, 20 bp, mouse
ggacagagagccggaaatga

SEQ ID NO: 600372 - DNA, 20 bp, mouse
gccggcaaggagagcgaagg

SEQ ID NO: 600373 - DNA, 20 bp, mouse
gtggccgcagccccgaggaa

SEQ ID NO: 600374 - DNA, 20 bp, mouse
gcggtggtccggacaggggt

SEQ ID NO: 600375 - DNA, 20 bp, mouse
gcgtgagtgcgtgggacccc

SEQ ID NO: 600376 - DNA, 20 bp, mouse
ggacgggtcggactcagaaa

SEQ ID NO: 600377 - DNA, 20 bp, mouse
gtgcggccggtggctcctca

SEQ ID NO: 600378 - DNA, 20 bp, mouse
gtggcggcgtccatgttcta

SEQ ID NO: 600379 - DNA, 20 bp, mouse
ggggtcggactcagaaatgg

SEQ ID NO: 600380 - DNA, 20 bp, mouse
gaactgccggccgtagaaca

SEQ ID NO: 600381 - DNA, 20 bp, mouse
gcggctcgcagcgtagtctg

SEQ ID NO: 600382 - DNA, 20 bp, mouse
gccagctccggggctctcag

SEQ ID NO: 600383 - DNA, 20 bp, mouse
gggccgccctgaggagccac

SEQ ID NO: 600384 - DNA, 20 bp, mouse
gtgcgcggtgcccaggggac

SEQ ID NO: 600385 - DNA, 20 bp, mouse
gggcggccgcggccaactgc

SEQ ID NO: 600386 - DNA, 20 bp, mouse
gaaggtgcgcgacaacaggc

SEQ ID NO: 600387 - DNA, 20 bp, mouse
gcgccagtggcagacctcgg

SEQ ID NO: 600388 - DNA, 20 bp, mouse
ggggccggcacgactcacgg

SEQ ID NO: 600389 - DNA, 20 bp, mouse
ggccgggccggcacgactca

SEQ ID NO: 600390 - DNA, 20 bp, mouse
gaccgcaacagtagttgctg

SEQ ID NO: 600391 - DNA, 20 bp, mouse
ggcggctgccactgcaacca

SEQ ID NO: 600392 - DNA, 20 bp, mouse
gcgcgacaacaggcgggcgg

SEQ ID NO: 600393 - DNA, 20 bp, mouse
ggtgcgcgacaacaggcggg

SEQ ID NO: 600394 - DNA, 20 bp, mouse
gtccgggcgggccctcggaa

SEQ ID NO: 600395 - DNA, 20 bp, mouse
gccaccggtccaaacgccag

SEQ ID NO: 600396 - DNA, 20 bp, mouse
gctgtgaaggaagtaagtaa

SEQ ID NO: 600397 - DNA, 20 bp, mouse
gagggtggccagaagcacct

SEQ ID NO: 600398 - DNA, 20 bp, mouse
gcgtgggaggaaccactcca

SEQ ID NO: 600399 - DNA, 20 bp, mouse
gctgccctgctgcttcttct

SEQ ID NO: 600400 - DNA, 20 bp, mouse
ggaaccactccagggaaggg

SEQ ID NO: 600401 - DNA, 20 bp, mouse
gcttccgagaagaagcagca

SEQ ID NO: 600402 - DNA, 20 bp, mouse
gagtacggcaccaaactcgt

SEQ ID NO: 600403 - DNA, 20 bp, mouse
gagacaggcatcctctgggt

SEQ ID NO: 600404 - DNA, 20 bp, mouse
ggcatcctgggctgccataa

SEQ ID NO: 600405 - DNA, 20 bp, mouse
gggtatgcaaggcctggctg

SEQ ID NO: 600406 - DNA, 20 bp, mouse
gcccgggcagagccagtaag

SEQ ID NO: 600407 - DNA, 20 bp, mouse
gacctgaagagaggcggcga

SEQ ID NO: 600408 - DNA, 20 bp, mouse
gcgcggagcatggggcacca

SEQ ID NO: 600409 - DNA, 20 bp, mouse
ggggagcaccggatcgccag

SEQ ID NO: 600410 - DNA, 20 bp, mouse
ggggcgagttcccaaaagtt

SEQ ID NO: 600411 - DNA, 20 bp, mouse
gtagaacgatccgggtcgtg

SEQ ID NO: 600412 - DNA, 20 bp, mouse
ggtggctgccgagcgagctc

SEQ ID NO: 600413 - DNA, 20 bp, mouse
ggagtgcacaccccacgacc

SEQ ID NO: 600414 - DNA, 20 bp, mouse
ggcgcactgttggaacgcag

SEQ ID NO: 600415 - DNA, 20 bp, mouse
gggagcatggggcaccacgg

SEQ ID NO: 600416 - DNA, 20 bp, mouse
ggccgacagcagaatggtaa

SEQ ID NO: 600417 - DNA, 20 bp, mouse
gagaagctgtctccagctcc

SEQ ID NO: 600418 - DNA, 20 bp, mouse
gacagaagccgacagcagaa

SEQ ID NO: 600419 - DNA, 20 bp, mouse
gtgtccagcaacacagcact

SEQ ID NO: 600420 - DNA, 20 bp, mouse
ggctcacagaacccttccaa

SEQ ID NO: 600421 - DNA, 20 bp, mouse
gtactgaagaacagttccct

SEQ ID NO: 600422 - DNA, 20 bp, mouse
gctcgacagaaaactctgcc

SEQ ID NO: 600423 - DNA, 20 bp, mouse
gaagccctaagcagaaagct

SEQ ID NO: 600424 - DNA, 20 bp, mouse
ggtgagctaaatgctgccta

SEQ ID NO: 600425 - DNA, 20 bp, mouse
gctttcacatctatttcatg

SEQ ID NO: 600426 - DNA, 20 bp, mouse
ggagcgggcagacagagcgg

SEQ ID NO: 600427 - DNA, 20 bp, mouse
gggcgagcgggcagacagag

SEQ ID NO: 600428 - DNA, 20 bp, mouse
gcgggcagacagagcggcgg

SEQ ID NO: 600429 - DNA, 20 bp, mouse
gtggcggcgaaggccggagg

SEQ ID NO: 600430 - DNA, 20 bp, mouse
gaggcagtggcggcgaaggc

SEQ ID NO: 600431 - DNA, 20 bp, mouse
gcgcgagccgagagggacgt

SEQ ID NO: 600432 - DNA, 20 bp, mouse
gacgcttcacaggagcgctc

SEQ ID NO: 600433 - DNA, 20 bp, mouse
gcagtggcggcgaaggccgg

SEQ ID NO: 600434 - DNA, 20 bp, mouse
ggagagtccgaagagcagtg

SEQ ID NO: 600435 - DNA, 20 bp, mouse
ggcccacggcaacgggaata

SEQ ID NO: 600436 - DNA, 20 bp, mouse
gcgggcaccgggactcccct

SEQ ID NO: 600437 - DNA, 20 bp, mouse
ggcgaggttgcggggctccg

SEQ ID NO: 600438 - DNA, 20 bp, mouse
ggccccggagtactacccgg

SEQ ID NO: 600439 - DNA, 20 bp, mouse
ggccgccccggagtactacc

SEQ ID NO: 600440 - DNA, 20 bp, mouse
ggagtactacccggaggacg

SEQ ID NO: 600441 - DNA, 20 bp, mouse
gtcctccgggtagtactccg

SEQ ID NO: 600442 - DNA, 20 bp, mouse
ggctgggagcgagaaagcca

SEQ ID NO: 600443 - DNA, 20 bp, mouse
gctccggggacgcagccagg

SEQ ID NO: 600444 - DNA, 20 bp, mouse
ggccggtcccgcggagatcg

SEQ ID NO: 600445 - DNA, 20 bp, mouse
gggaaccgcgcgaggttgcg

SEQ ID NO: 600446 - DNA, 20 bp, mouse
gagactccccgaggcgatgg

SEQ ID NO: 600447 - DNA, 20 bp, mouse
gtagggcgcgcggagaaccc

SEQ ID NO: 600448 - DNA, 20 bp, mouse
gcggctggtcagggtagagg

SEQ ID NO: 600449 - DNA, 20 bp, mouse
gagtgaagcaaaggccggag

SEQ ID NO: 600450 - DNA, 20 bp, mouse
gggagaacccgggagggtag

SEQ ID NO: 600451 - DNA, 20 bp, mouse
ggccggagccttcaagacgt

SEQ ID NO: 600452 - DNA, 20 bp, mouse
gctgtggatgagactccccg

SEQ ID NO: 600453 - DNA, 20 bp, mouse
gcgggactgcacgccatcta

SEQ ID NO: 600454 - DNA, 20 bp, mouse
gcctctggccgacgtcttga

SEQ ID NO: 600455 - DNA, 20 bp, mouse
gggagggaaagcgcccctat

SEQ ID NO: 600456 - DNA, 20 bp, mouse
gggcggcgaagggaagtcgg

SEQ ID NO: 600457 - DNA, 20 bp, mouse
ggtctcggcagaccagagaa

SEQ ID NO: 600458 - DNA, 20 bp, mouse
gcagtcgcgagaacccaggc

SEQ ID NO: 600459 - DNA, 20 bp, mouse
gtcgcgagaacccaggcggg

SEQ ID NO: 600460 - DNA, 20 bp, mouse
ggcgggcggcgaagggaagt

SEQ ID NO: 600461 - DNA, 20 bp, mouse
ggcgccacctgagaagaggg

SEQ ID NO: 600462 - DNA, 20 bp, mouse
gaagccaaaggggaccggag

SEQ ID NO: 600463 - DNA, 20 bp, mouse
gggtggcgccggagcattgt

SEQ ID NO: 600464 - DNA, 20 bp, mouse
gagtctcaagatggacaacc

SEQ ID NO: 600465 - DNA, 20 bp, mouse
gaggtccgtgacagaaagta

SEQ ID NO: 600466 - DNA, 20 bp, mouse
ggagcctctcggctgaagga

SEQ ID NO: 600467 - DNA, 20 bp, mouse
ggagggacgccgaggcgagg

SEQ ID NO: 600468 - DNA, 20 bp, mouse
gggctgaaggagggacgccg

SEQ ID NO: 600469 - DNA, 20 bp, mouse
gcgccctcgttgccccggaa

SEQ ID NO: 600470 - DNA, 20 bp, mouse
gcgagggcgaccgcgagcac

SEQ ID NO: 600471 - DNA, 20 bp, mouse
gctcagggccgagtctacct

SEQ ID NO: 600472 - DNA, 20 bp, mouse
gcgcatgaggacctaggcgg

SEQ ID NO: 600473 - DNA, 20 bp, mouse
ggcgcgctgctcacttctca

SEQ ID NO: 600474 - DNA, 20 bp, mouse
ggcgcaccaaggcaaggcag

SEQ ID NO: 600475 - DNA, 20 bp, mouse
ggtggataaggggcccgagg

SEQ ID NO: 600476 - DNA, 20 bp, mouse
gaaccaaggtagaaacgctc

SEQ ID NO: 600477 - DNA, 20 bp, mouse
ggtaatgccgggaagaggag

SEQ ID NO: 600478 - DNA, 20 bp, mouse
gctccgccgccgcccaggaa

SEQ ID NO: 600479 - DNA, 20 bp, mouse
ggatccccaggcagcattag

SEQ ID NO: 600480 - DNA, 20 bp, mouse
gaggacctgcatcgtcccag

SEQ ID NO: 600481 - DNA, 20 bp, mouse
gctgatcgacggggatcccc

SEQ ID NO: 600482 - DNA, 20 bp, mouse
ggaagctttcttgactccta

SEQ ID NO: 600483 - DNA, 20 bp, mouse
gtgcctgagcgtttctacct

SEQ ID NO: 600484 - DNA, 20 bp, mouse
gctccacaagctcccgatga

SEQ ID NO: 600485 - DNA, 20 bp, mouse
gctcccacgaaggtaatgcc

SEQ ID NO: 600486 - DNA, 20 bp, mouse
gtcgagtggggattaagaga

SEQ ID NO: 600487 - DNA, 20 bp, mouse
ggtggggattaagagaagga

SEQ ID NO: 600488 - DNA, 20 bp, mouse
ggtgtcatcacattcgagtg

SEQ ID NO: 600489 - DNA, 20 bp, mouse
ggtgtttcaacagatggttg

SEQ ID NO: 600490 - DNA, 20 bp, mouse
gcacagtgctgtgtcaagac

SEQ ID NO: 600491 - DNA, 20 bp, mouse
gttgatggaacggcgaggac

SEQ ID NO: 600492 - DNA, 20 bp, mouse
gcagccccagcaattggatt

SEQ ID NO: 600493 - DNA, 20 bp, mouse
ggaggacgtgtttcaacaga

SEQ ID NO: 600494 - DNA, 20 bp, mouse
gaatagcagcattgatggaa

SEQ ID NO: 600495 - DNA, 20 bp, mouse
gtttgcctgcaactctcact

SEQ ID NO: 600496 - DNA, 20 bp, mouse
gccattcccggcccatgtct

SEQ ID NO: 600497 - DNA, 20 bp, mouse
ggagagcttcggagacgcgt

SEQ ID NO: 600498 - DNA, 20 bp, mouse
gagaagcgttgcccagacat

SEQ ID NO: 600499 - DNA, 20 bp, mouse
gagacgcgtgggaaggtccc

SEQ ID NO: 600500 - DNA, 20 bp, mouse
ggggaaggtcccaggcgcgt

SEQ ID NO: 600501 - DNA, 20 bp, mouse
ggccgggtgtttgcaaacca

SEQ ID NO: 600502 - DNA, 20 bp, mouse
gcccgagccggcgtctccaa

SEQ ID NO: 600503 - DNA, 20 bp, mouse
gccccggcccgaagtcccgg

SEQ ID NO: 600504 - DNA, 20 bp, mouse
gtgtgtgccactcggaccgg

SEQ ID NO: 600505 - DNA, 20 bp, mouse
gcccggctgcggcagagacg

SEQ ID NO: 600506 - DNA, 20 bp, mouse
gtaccactgagcaccgaggg

SEQ ID NO: 600507 - DNA, 20 bp, mouse
gaggcatggctcagaacccc

SEQ ID NO: 600508 - DNA, 20 bp, mouse
gccctaccactgagcaccga

SEQ ID NO: 600509 - DNA, 20 bp, mouse
gccagtatctgggcaggaca

SEQ ID NO: 600510 - DNA, 20 bp, mouse
ggagcagtggaaccagtatc

SEQ ID NO: 600511 - DNA, 20 bp, mouse
gcacctcagaagagcaactg

SEQ ID NO: 600512 - DNA, 20 bp, mouse
gttaagcttgttgcaaggta

SEQ ID NO: 600513 - DNA, 20 bp, mouse
gctaaaacaagccagagcgg

SEQ ID NO: 600514 - DNA, 20 bp, mouse
gaatgtggggaatgcagaat

SEQ ID NO: 600515 - DNA, 20 bp, mouse
ggcagactaatcaaagtgta

SEQ ID NO: 600516 - DNA, 20 bp, mouse
ggagtgcctcagaagacgtt

SEQ ID NO: 600517 - DNA, 20 bp, mouse
gtttctccaaacgtcttctg

SEQ ID NO: 600518 - DNA, 20 bp, mouse
gttgcagcaggctgaacaga

SEQ ID NO: 600519 - DNA, 20 bp, mouse
gaatagaaggagtaaaaatc

SEQ ID NO: 600520 - DNA, 20 bp, mouse
gaagatctgaagatgatcca

SEQ ID NO: 600521 - DNA, 20 bp, mouse
ggtgcaaaagcatagatcat

SEQ ID NO: 600522 - DNA, 20 bp, mouse
gagaatttagagggagggat

SEQ ID NO: 600523 - DNA, 20 bp, mouse
gggaggggcaaatgatgtca

SEQ ID NO: 600524 - DNA, 20 bp, mouse
ggaaggactcacctgattta

SEQ ID NO: 600525 - DNA, 20 bp, mouse
gtatcttcagagctggtatg

SEQ ID NO: 600526 - DNA, 20 bp, mouse
gacctgcaagggaagcctgt

SEQ ID NO: 600527 - DNA, 20 bp, mouse
ggtctttagacggatcttcc

SEQ ID NO: 600528 - DNA, 20 bp, mouse
gaagacagtgaagtcatcaa

SEQ ID NO: 600529 - DNA, 20 bp, mouse
gcagaactcaaaagctatcc

SEQ ID NO: 600530 - DNA, 20 bp, mouse
ggacagaagttcaggaagag

SEQ ID NO: 600531 - DNA, 20 bp, mouse
gttaattagaaactacccac

SEQ ID NO: 600532 - DNA, 20 bp, mouse
gacccacaggcttcccttgc

SEQ ID NO: 600533 - DNA, 20 bp, mouse
gtggctcctaggacagaatg

SEQ ID NO: 600534 - DNA, 20 bp, mouse
gggtcaacaaacagggaaca

SEQ ID NO: 600535 - DNA, 20 bp, mouse
gcggatgcatgccacctgca

SEQ ID NO: 600536 - DNA, 20 bp, mouse
ggaacatacaccaaaaagtt

SEQ ID NO: 600537 - DNA, 20 bp, mouse
gtacgtatggagcaggccca

SEQ ID NO: 600538 - DNA, 20 bp, mouse
gagctctagttgtctgtaat

SEQ ID NO: 600539 - DNA, 20 bp, mouse
gttgtctgtaattggaaagc

SEQ ID NO: 600540 - DNA, 20 bp, mouse
gtgggagctctaagggaggg

SEQ ID NO: 600541 - DNA, 20 bp, mouse
gcaaagagtacgtatggagc

SEQ ID NO: 600542 - DNA, 20 bp, mouse
gcccatggctccagtcacat

SEQ ID NO: 600543 - DNA, 20 bp, mouse
gagtgggtaaataggtgagt

SEQ ID NO: 600544 - DNA, 20 bp, mouse
gacagacaactagagcttga

SEQ ID NO: 600545 - DNA, 20 bp, mouse
gcagggaggatgagatacag

SEQ ID NO: 600546 - DNA, 20 bp, mouse
gttacgttgtgagctaccca

SEQ ID NO: 600547 - DNA, 20 bp, mouse
ggaaccgaaaagtctttaaa

SEQ ID NO: 600548 - DNA, 20 bp, mouse
gtaaagctccgagaatttaa

SEQ ID NO: 600549 - DNA, 20 bp, mouse
gcttaaattattagtaaggt

SEQ ID NO: 600550 - DNA, 20 bp, mouse
gcatgagtataaactcccca

SEQ ID NO: 600551 - DNA, 20 bp, mouse
gtatcttacctttaaattct

SEQ ID NO: 600552 - DNA, 20 bp, mouse
ggtcacagctgatatattta

SEQ ID NO: 600553 - DNA, 20 bp, mouse
gtttaaaggtaagataaact

SEQ ID NO: 600554 - DNA, 20 bp, mouse
ggtcttataattatcaccct

SEQ ID NO: 600555 - DNA, 20 bp, mouse
gattacttaaattattagta

SEQ ID NO: 600556 - DNA, 20 bp, mouse
gcggtttagttctcttcgaa

SEQ ID NO: 600557 - DNA, 20 bp, mouse
gacctgtccagatgttcccg

SEQ ID NO: 600558 - DNA, 20 bp, mouse
gtccacgggaacatctggac

SEQ ID NO: 600559 - DNA, 20 bp, mouse
gatgatacacattatcaatt

SEQ ID NO: 600560 - DNA, 20 bp, mouse
gcttcttccacgggaacatc

SEQ ID NO: 600561 - DNA, 20 bp, mouse
ggacataaaaaagatagtaa

SEQ ID NO: 600562 - DNA, 20 bp, mouse
ggatcatttcacttcttcca

SEQ ID NO: 600563 - DNA, 20 bp, mouse
gtgagaactggttgtacact

SEQ ID NO: 600564 - DNA, 20 bp, mouse
gacttaatacaacaaaaatt

SEQ ID NO: 600565 - DNA, 20 bp, mouse
gaatagaatttaagtgttac

SEQ ID NO: 600566 - DNA, 20 bp, mouse
gaatcctaagagaacctaca

SEQ ID NO: 600567 - DNA, 20 bp, mouse
gactccttgtaggttctctt

SEQ ID NO: 600568 - DNA, 20 bp, mouse
gtctcttaggattccagccg

SEQ ID NO: 600569 - DNA, 20 bp, mouse
gataatgatagtgctccctg

SEQ ID NO: 600570 - DNA, 20 bp, mouse
gttgaataggtgtcctcggc

SEQ ID NO: 600571 - DNA, 20 bp, mouse
gccctactcatcacacaaaa

SEQ ID NO: 600572 - DNA, 20 bp, mouse
gaattagtccttacctgact

SEQ ID NO: 600573 - DNA, 20 bp, mouse
gaccattttgtgtgatgagt

SEQ ID NO: 600574 - DNA, 20 bp, mouse
gcatttgttataagttgaat

SEQ ID NO: 600575 - DNA, 20 bp, mouse
gattctgaagtgtataaggg

SEQ ID NO: 600576 - DNA, 20 bp, mouse
gaatcctaagagaacctaca

SEQ ID NO: 600577 - DNA, 20 bp, mouse
gactccttgtaggttctctt

SEQ ID NO: 600578 - DNA, 20 bp, mouse
gtctcttaggattccagccg

SEQ ID NO: 600579 - DNA, 20 bp, mouse
gcatttgttatgagttgaat

SEQ ID NO: 600580 - DNA, 20 bp, mouse
gataatgatagtgctccctg

SEQ ID NO: 600581 - DNA, 20 bp, mouse
gttgaataggtgtcctcggc

SEQ ID NO: 600582 - DNA, 20 bp, mouse
gccctactcatcacacaaaa

SEQ ID NO: 600583 - DNA, 20 bp, mouse
gaattagtccttacctgact

SEQ ID NO: 600584 - DNA, 20 bp, mouse
gaccattttgtgtgatgagt

SEQ ID NO: 600585 - DNA, 20 bp, mouse
gattctgaagtgtataaggg

SEQ ID NO: 600586 - DNA, 20 bp, mouse
ggggcagaggagacaagcta

SEQ ID NO: 600587 - DNA, 20 bp, mouse
gcactcagtctgacctaagt

SEQ ID NO: 600588 - DNA, 20 bp, mouse
gctgaataggtgtcttcggc

SEQ ID NO: 600589 - DNA, 20 bp, mouse
gctttaatcctaattcattt

SEQ ID NO: 600590 - DNA, 20 bp, mouse
gttgtctcctctgcccactt

SEQ ID NO: 600591 - DNA, 20 bp, mouse
gaaataacattaagagataa

SEQ ID NO: 600592 - DNA, 20 bp, mouse
gctttttgatatgctatggc

SEQ ID NO: 600593 - DNA, 20 bp, mouse
ggtctgacctaagtgggcag

SEQ ID NO: 600594 - DNA, 20 bp, mouse
gcatgatgtcagactattat

SEQ ID NO: 600595 - DNA, 20 bp, mouse
gccattggtccctctctctg

SEQ ID NO: 600596 - DNA, 20 bp, mouse
gcaagtatagtctgacatca

SEQ ID NO: 600597 - DNA, 20 bp, mouse
gacaatgattgtgctccatg

SEQ ID NO: 600598 - DNA, 20 bp, mouse
gtgccattggtttttctctc

SEQ ID NO: 600599 - DNA, 20 bp, mouse
gctccagagagaaaaaccaa

SEQ ID NO: 600600 - DNA, 20 bp, mouse
gagatagaagagtgagagtg

SEQ ID NO: 600601 - DNA, 20 bp, mouse
gtgatctcctctgtccacat

SEQ ID NO: 600602 - DNA, 20 bp, mouse
gatctgacctatgtggacag

SEQ ID NO: 600603 - DNA, 20 bp, mouse
ggtttcaggtaaaatttcta

SEQ ID NO: 600604 - DNA, 20 bp, mouse
gtggagcacaatcattgttc

SEQ ID NO: 600605 - DNA, 20 bp, mouse
ggtgaggatatgtgtaggag

SEQ ID NO: 600606 - DNA, 20 bp, mouse
gttgaagaggtgtcctggac

SEQ ID NO: 600607 - DNA, 20 bp, mouse
ggctgttaggattccagtcc

SEQ ID NO: 600608 - DNA, 20 bp, mouse
gtactcagtctgacatatgt

SEQ ID NO: 600609 - DNA, 20 bp, mouse
gtcatcacccaaaattattt

SEQ ID NO: 600610 - DNA, 20 bp, mouse
gctttaatcctaaataattt

SEQ ID NO: 600611 - DNA, 20 bp, mouse
gataagttgaagaggtgtcc

SEQ ID NO: 600612 - DNA, 20 bp, mouse
gcatttgttataagttgaag

SEQ ID NO: 600613 - DNA, 20 bp, mouse
ggtctgacatatgtgggcag

SEQ ID NO: 600614 - DNA, 20 bp, mouse
ggaggtaagatttatagtac

SEQ ID NO: 600615 - DNA, 20 bp, mouse
gactccttgtaggtgctgtt

SEQ ID NO: 600616 - DNA, 20 bp, mouse
gtatgctgaactggtggtca

SEQ ID NO: 600617 - DNA, 20 bp, mouse
gctccttgtaggtgctgtta

SEQ ID NO: 600618 - DNA, 20 bp, mouse
ggaacccacatatcaggaag

SEQ ID NO: 600619 - DNA, 20 bp, mouse
gttgcaatatgctgaactgg

SEQ ID NO: 600620 - DNA, 20 bp, mouse
ggggataaggtgatcatcta

SEQ ID NO: 600621 - DNA, 20 bp, mouse
gagggttacgaattgtatat

SEQ ID NO: 600622 - DNA, 20 bp, mouse
ggtaaggaccatcagtaaga

SEQ ID NO: 600623 - DNA, 20 bp, mouse
gcttatcccacatagttcag

SEQ ID NO: 600624 - DNA, 20 bp, mouse
gctttttgaacccacatatc

SEQ ID NO: 600625 - DNA, 20 bp, mouse
gatacctcttcctgatatgt

SEQ ID NO: 600626 - DNA, 20 bp, mouse
gtgggttctactccaggctt

SEQ ID NO: 600627 - DNA, 20 bp, mouse
gctgcagacatgcccaagcc

SEQ ID NO: 600628 - DNA, 20 bp, mouse
ggcttgtagcaaatgatgag

SEQ ID NO: 600629 - DNA, 20 bp, mouse
ggatactgaactctatgagg

SEQ ID NO: 600630 - DNA, 20 bp, mouse
gggtttaacaaagaaatcat

SEQ ID NO: 600631 - DNA, 20 bp, mouse
gaatgatactgaactctatg

SEQ ID NO: 600632 - DNA, 20 bp, mouse
gatacacatgtgcagggtag

SEQ ID NO: 600633 - DNA, 20 bp, mouse
gaatgtcatcagactacgtt

SEQ ID NO: 600634 - DNA, 20 bp, mouse
gtactgtcttatcctaagtc

SEQ ID NO: 600635 - DNA, 20 bp, mouse
ggttccactcaccacacaaa

SEQ ID NO: 600636 - DNA, 20 bp, mouse
ggctgcggcccgtccatggc

SEQ ID NO: 600637 - DNA, 20 bp, mouse
gtgccctgcccgccatggac

SEQ ID NO: 600638 - DNA, 20 bp, mouse
gttctcagacgagctccaca

SEQ ID NO: 600639 - DNA, 20 bp, mouse
gcggggctgcggcccgtcca

SEQ ID NO: 600640 - DNA, 20 bp, mouse
gctcccctgggccggctggt

SEQ ID NO: 600641 - DNA, 20 bp, mouse
gacgagctccacagggcgcg

SEQ ID NO: 600642 - DNA, 20 bp, mouse
ggcaggaggtagccgggcgt

SEQ ID NO: 600643 - DNA, 20 bp, mouse
gggcccgtccatggcgggca

SEQ ID NO: 600644 - DNA, 20 bp, mouse
gcgcacctggccccgacgcc

SEQ ID NO: 600645 - DNA, 20 bp, mouse
gtgcctaccagccggcccag

SEQ ID NO: 600646 - DNA, 20 bp, mouse
gtctttttgaagggcactag

SEQ ID NO: 600647 - DNA, 20 bp, mouse
ggtgcccttcaaaaagaaac

SEQ ID NO: 600648 - DNA, 20 bp, mouse
ggagacatagtgaaactgac

SEQ ID NO: 600649 - DNA, 20 bp, mouse
gtgttttccattgtctttgt

SEQ ID NO: 600650 - DNA, 20 bp, mouse
gtatccagtttctttttgaa

SEQ ID NO: 600651 - DNA, 20 bp, mouse
gccttgttctcagcaccgca

SEQ ID NO: 600652 - DNA, 20 bp, mouse
gatatagtcagttttggagc

SEQ ID NO: 600653 - DNA, 20 bp, mouse
gtaaattccaacaaagacaa

SEQ ID NO: 600654 - DNA, 20 bp, mouse
gtggaaaacacaaatacaca

SEQ ID NO: 600655 - DNA, 20 bp, mouse
ggatcactacagactagggc

SEQ ID NO: 600656 - DNA, 20 bp, mouse
gggcatggcggagagcgaag

SEQ ID NO: 600657 - DNA, 20 bp, mouse
ggccgcgcgagcgaccggta

SEQ ID NO: 600658 - DNA, 20 bp, mouse
ggctccagggcgtgacgtca

SEQ ID NO: 600659 - DNA, 20 bp, mouse
ggagagcgaagcggagaccc

SEQ ID NO: 600660 - DNA, 20 bp, mouse
gggggagccggacaggacta

SEQ ID NO: 600661 - DNA, 20 bp, mouse
ggcctgtaaacagcatacag

SEQ ID NO: 600662 - DNA, 20 bp, mouse
ggaactcgcccggggtgccc

SEQ ID NO: 600663 - DNA, 20 bp, mouse
gcgtcacgccctggagctgc

SEQ ID NO: 600664 - DNA, 20 bp, mouse
gtcttcccgcggcagaaggg

SEQ ID NO: 600665 - DNA, 20 bp, mouse
ggcgccgtgacgtcacgccc

SEQ ID NO: 600666 - DNA, 20 bp, mouse
ggcgcacagccaggtaccac

SEQ ID NO: 600667 - DNA, 20 bp, mouse
ggcgcacgcagcccagacct

SEQ ID NO: 600668 - DNA, 20 bp, mouse
gccagggccctgcaacgcta

SEQ ID NO: 600669 - DNA, 20 bp, mouse
gcgctagggtggagcctctt

SEQ ID NO: 600670 - DNA, 20 bp, mouse
gagccacatttcctaggtct

SEQ ID NO: 600671 - DNA, 20 bp, mouse
gtacttgggcacctccaaag

SEQ ID NO: 600672 - DNA, 20 bp, mouse
gctctacagctgcccagact

SEQ ID NO: 600673 - DNA, 20 bp, mouse
gggcagctgtagagcaagac

SEQ ID NO: 600674 - DNA, 20 bp, mouse
ggggccctgcaacgctaggg

SEQ ID NO: 600675 - DNA, 20 bp, mouse
ggctgtagagcaagactgga

SEQ ID NO: 600676 - DNA, 20 bp, mouse
gtggtaggtgagaaataact

SEQ ID NO: 600677 - DNA, 20 bp, mouse
gggtcagggtgcagaggtca

SEQ ID NO: 600678 - DNA, 20 bp, mouse
gggtgggagagggcgaaggt

SEQ ID NO: 600679 - DNA, 20 bp, mouse
gggagagggcgaaggtggga

SEQ ID NO: 600680 - DNA, 20 bp, mouse
ggctttaccacacttcgggt

SEQ ID NO: 600681 - DNA, 20 bp, mouse
gcggcagatgatggaatgag

SEQ ID NO: 600682 - DNA, 20 bp, mouse
gtagcatcctacccgaagtg

SEQ ID NO: 600683 - DNA, 20 bp, mouse
gcctgagtgcacatggtgac

SEQ ID NO: 600684 - DNA, 20 bp, mouse
gcctctgcaccctgacctcc

SEQ ID NO: 600685 - DNA, 20 bp, mouse
gtcgatgtagtcgataaact

SEQ ID NO: 600686 - DNA, 20 bp, mouse
gcatgactccgggaacaaca

SEQ ID NO: 600687 - DNA, 20 bp, mouse
gcgccagtctgatgcagcag

SEQ ID NO: 600688 - DNA, 20 bp, mouse
gtgatgcagcagcggagagc

SEQ ID NO: 600689 - DNA, 20 bp, mouse
ggcgcagcgctactcccggg

SEQ ID NO: 600690 - DNA, 20 bp, mouse
gggagagccggctctcgcgc

SEQ ID NO: 600691 - DNA, 20 bp, mouse
ggctgcgcccgcgcgagagc

SEQ ID NO: 600692 - DNA, 20 bp, mouse
gccatgggtcacatgactcc

SEQ ID NO: 600693 - DNA, 20 bp, mouse
gacaggtcacgtgatctcca

SEQ ID NO: 600694 - DNA, 20 bp, mouse
gcagccgcacgagcccgcaa

SEQ ID NO: 600695 - DNA, 20 bp, mouse
gcggtcgcgggcctgaggtc

SEQ ID NO: 600696 - DNA, 20 bp, mouse
ggccacagcagcaacaccgg

SEQ ID NO: 600697 - DNA, 20 bp, mouse
gctgacctagctgaagcctg

SEQ ID NO: 600698 - DNA, 20 bp, mouse
gagttctggttccccagcat

SEQ ID NO: 600699 - DNA, 20 bp, mouse
gagcaacaccggagggagca

SEQ ID NO: 600700 - DNA, 20 bp, mouse
gatgggttccttgctccctc

SEQ ID NO: 600701 - DNA, 20 bp, mouse
gcttcagctaggtcagtgtg

SEQ ID NO: 600702 - DNA, 20 bp, mouse
gtcaaggataagggtgatat

SEQ ID NO: 600703 - DNA, 20 bp, mouse
ggtggctcctgtcctgcccc

SEQ ID NO: 600704 - DNA, 20 bp, mouse
ggggagcaaggaacccatgc

SEQ ID NO: 600705 - DNA, 20 bp, mouse
gacgcatgcgctctgagttc

SEQ ID NO: 600706 - DNA, 20 bp, mouse
ggaagtgacgcaagacgtag

SEQ ID NO: 600707 - DNA, 20 bp, mouse
gcccggtacctggtcagaca

SEQ ID NO: 600708 - DNA, 20 bp, mouse
ggaggaagtccctgcagccg

SEQ ID NO: 600709 - DNA, 20 bp, mouse
ggcgagcccgcgagaaacct

SEQ ID NO: 600710 - DNA, 20 bp, mouse
ggccctggactgaggcgcgg

SEQ ID NO: 600711 - DNA, 20 bp, mouse
ggcacaacaccgcggctgca

SEQ ID NO: 600712 - DNA, 20 bp, mouse
gggcgccggggctctctcga

SEQ ID NO: 600713 - DNA, 20 bp, mouse
gctggtcagacatggtgacg

SEQ ID NO: 600714 - DNA, 20 bp, mouse
gcctaggcccagttatgtaa

SEQ ID NO: 600715 - DNA, 20 bp, mouse
gtgtccccgagagcaagctg

SEQ ID NO: 600716 - DNA, 20 bp, mouse
ggggcaggcagggaagcccg

SEQ ID NO: 600717 - DNA, 20 bp, mouse
ggccccgagagggaaacccc

SEQ ID NO: 600718 - DNA, 20 bp, mouse
gcaggcagggaagcccgcgg

SEQ ID NO: 600719 - DNA, 20 bp, mouse
ggccgccgcgagctcacctt

SEQ ID NO: 600720 - DNA, 20 bp, mouse
gcctcaccgtgcggaccggt

SEQ ID NO: 600721 - DNA, 20 bp, mouse
gacccaaggtgagctcgcgg

SEQ ID NO: 600722 - DNA, 20 bp, mouse
gcaccctggcgggaaccatg

SEQ ID NO: 600723 - DNA, 20 bp, mouse
gccgccgctggccccgtggg

SEQ ID NO: 600724 - DNA, 20 bp, mouse
gcgcggccccagccccgaga

SEQ ID NO: 600725 - DNA, 20 bp, mouse
gccgccgaggagccagcgcg

SEQ ID NO: 600726 - DNA, 20 bp, mouse
gcaagcgcagcgggaaccgg

SEQ ID NO: 600727 - DNA, 20 bp, mouse
gggaaccggtggcactggag

SEQ ID NO: 600728 - DNA, 20 bp, mouse
gcggcaagcgcagcgggaac

SEQ ID NO: 600729 - DNA, 20 bp, mouse
gcagcgggaaccggtggcac

SEQ ID NO: 600730 - DNA, 20 bp, mouse
gacggcggcggcaagcgcag

SEQ ID NO: 600731 - DNA, 20 bp, mouse
gttgcggcgggagagcggcg

SEQ ID NO: 600732 - DNA, 20 bp, mouse
gcgacatggttgcgcagcga

SEQ ID NO: 600733 - DNA, 20 bp, mouse
gcatggttgcgcagcgacgg

SEQ ID NO: 600734 - DNA, 20 bp, mouse
gtcgcccgctccagtgccac

SEQ ID NO: 600735 - DNA, 20 bp, mouse
gtggcgggaggcacagccgg

SEQ ID NO: 600736 - DNA, 20 bp, mouse
gcggacgaggcctgaggcgg

SEQ ID NO: 600737 - DNA, 20 bp, mouse
gtgcggccagcgggctgtag

SEQ ID NO: 600738 - DNA, 20 bp, mouse
gaggggacgagtaggcgggt

SEQ ID NO: 600739 - DNA, 20 bp, mouse
ggcaggtgagctgcggccag

SEQ ID NO: 600740 - DNA, 20 bp, mouse
gggcctgggcggtgcggacg

SEQ ID NO: 600741 - DNA, 20 bp, mouse
ggctgtaggggacgagtagg

SEQ ID NO: 600742 - DNA, 20 bp, mouse
gggcgctgcggactcctctc

SEQ ID NO: 600743 - DNA, 20 bp, mouse
gaaggggaaccagagtgccc

SEQ ID NO: 600744 - DNA, 20 bp, mouse
gacagtccctagtacccgag

SEQ ID NO: 600745 - DNA, 20 bp, mouse
gcgcggcctggcaacgcgaa

SEQ ID NO: 600746 - DNA, 20 bp, mouse
gcgcgcgcggagcggagacg

SEQ ID NO: 600747 - DNA, 20 bp, mouse
gggaccgcgctgcgcgagtg

SEQ ID NO: 600748 - DNA, 20 bp, mouse
gggtgagcggacaatgcggc

SEQ ID NO: 600749 - DNA, 20 bp, mouse
gggctgaaacgcgcgcggag

SEQ ID NO: 600750 - DNA, 20 bp, mouse
gcggacaatgcggccggcag

SEQ ID NO: 600751 - DNA, 20 bp, mouse
gacgcgggacggcgcggggt

SEQ ID NO: 600752 - DNA, 20 bp, mouse
gacggcgcggggtcggtgag

SEQ ID NO: 600753 - DNA, 20 bp, mouse
gcggagacgcgggacggcgc

SEQ ID NO: 600754 - DNA, 20 bp, mouse
ggcgctgcgcgagtggggca

SEQ ID NO: 600755 - DNA, 20 bp, mouse
ggcgcagcgcggtcctctgc

SEQ ID NO: 600756 - DNA, 20 bp, mouse
gttgcaagttagttgaccaa

SEQ ID NO: 600757 - DNA, 20 bp, mouse
gttagttgaccaaagggtgt

SEQ ID NO: 600758 - DNA, 20 bp, mouse
gactcacttccgacaccctt

SEQ ID NO: 600759 - DNA, 20 bp, mouse
gatgttgggacaggtatcac

SEQ ID NO: 600760 - DNA, 20 bp, mouse
gaaagctgagagttacactg

SEQ ID NO: 600761 - DNA, 20 bp, mouse
gcatacttgttaaggtggtt

SEQ ID NO: 600762 - DNA, 20 bp, mouse
gggtggcaagtagatgctac

SEQ ID NO: 600763 - DNA, 20 bp, mouse
gtggaatgatgtgacatgtt

SEQ ID NO: 600764 - DNA, 20 bp, mouse
gtgatgtgacatgttgggac

SEQ ID NO: 600765 - DNA, 20 bp, mouse
gcatctacttgccacctaca

SEQ ID NO: 600766 - DNA, 20 bp, mouse
gggagctggcaggtccactg

SEQ ID NO: 600767 - DNA, 20 bp, mouse
gacgcctcacgcccaggagc

SEQ ID NO: 600768 - DNA, 20 bp, mouse
gcacgctggatacccagcag

SEQ ID NO: 600769 - DNA, 20 bp, mouse
gtgctgtcctgtgaccgcag

SEQ ID NO: 600770 - DNA, 20 bp, mouse
gctgcagacgcctcacgccc

SEQ ID NO: 600771 - DNA, 20 bp, mouse
gctcacgcccaggagctggc

SEQ ID NO: 600772 - DNA, 20 bp, mouse
gtaagcggggtaaacagcaa

SEQ ID NO: 600773 - DNA, 20 bp, mouse
ggtgtgctataggtcatcac

SEQ ID NO: 600774 - DNA, 20 bp, mouse
gtgtgtcagctggaagcggg

SEQ ID NO: 600775 - DNA, 20 bp, mouse
ggcaagggcacgtgcacgca

SEQ ID NO: 600776 - DNA, 20 bp, mouse
gtctatgggagtcaatgagg

SEQ ID NO: 600777 - DNA, 20 bp, mouse
gccttccagggaatactcaa

SEQ ID NO: 600778 - DNA, 20 bp, mouse
gtccagggaatactcaatgg

SEQ ID NO: 600779 - DNA, 20 bp, mouse
ggccaaggatggaggtctat

SEQ ID NO: 600780 - DNA, 20 bp, mouse
gtccccaaggaactctgtat

SEQ ID NO: 600781 - DNA, 20 bp, mouse
gtataaagggccaaggatgg

SEQ ID NO: 600782 - DNA, 20 bp, mouse
gtcacagtggcaggcctagg

SEQ ID NO: 600783 - DNA, 20 bp, mouse
gccccggacgaggaacatcg

SEQ ID NO: 600784 - DNA, 20 bp, mouse
gtcccatagacctccatcct

SEQ ID NO: 600785 - DNA, 20 bp, mouse
gctgaagacacaactcacag

SEQ ID NO: 600786 - DNA, 20 bp, mouse
gcccttacccggctggatgt

SEQ ID NO: 600787 - DNA, 20 bp, mouse
ggactgcgaccgggagagaa

SEQ ID NO: 600788 - DNA, 20 bp, mouse
ggggtaaggggactgcgacc

SEQ ID NO: 600789 - DNA, 20 bp, mouse
gaaggagggagggcaacggt

SEQ ID NO: 600790 - DNA, 20 bp, mouse
gagagcggcccagagcggag

SEQ ID NO: 600791 - DNA, 20 bp, mouse
ggctctagccctgcacgggg

SEQ ID NO: 600792 - DNA, 20 bp, mouse
gggcaacggtgggaccaagg

SEQ ID NO: 600793 - DNA, 20 bp, mouse
ggccgctctagccctgcacg

SEQ ID NO: 600794 - DNA, 20 bp, mouse
gcccggctggatgtcggcag

SEQ ID NO: 600795 - DNA, 20 bp, mouse
ggccgacatccagccgggta

SEQ ID NO: 600796 - DNA, 20 bp, mouse
gctggacgccgcttcccgtc

SEQ ID NO: 600797 - DNA, 20 bp, mouse
ggggctccgagaatcacgcg

SEQ ID NO: 600798 - DNA, 20 bp, mouse
gacagagagtgcgggattcc

SEQ ID NO: 600799 - DNA, 20 bp, mouse
gtccgggtcacagagagtgc

SEQ ID NO: 600800 - DNA, 20 bp, mouse
ggtgattctcggagcccgac

SEQ ID NO: 600801 - DNA, 20 bp, mouse
gagcggaaggggataccggg

SEQ ID NO: 600802 - DNA, 20 bp, mouse
ggaagcggcgtccagggcaa

SEQ ID NO: 600803 - DNA, 20 bp, mouse
gctcggagcccgacgggaag

SEQ ID NO: 600804 - DNA, 20 bp, mouse
gtgggatgtggggctcccgg

SEQ ID NO: 600805 - DNA, 20 bp, mouse
gtgggacctcgcgtgattct

SEQ ID NO: 600806 - DNA, 20 bp, mouse
gcggccgcagaactcaccta

SEQ ID NO: 600807 - DNA, 20 bp, mouse
ggttctgcggccggaggtgg

SEQ ID NO: 600808 - DNA, 20 bp, mouse
gtgagttctgcggccggagg

SEQ ID NO: 600809 - DNA, 20 bp, mouse
gggtggtgggtgacttaggt

SEQ ID NO: 600810 - DNA, 20 bp, mouse
gaagtggcggttggaggtgt

SEQ ID NO: 600811 - DNA, 20 bp, mouse
ggcgcggccgcaggaagtgg

SEQ ID NO: 600812 - DNA, 20 bp, mouse
ggggcgttacagcaggcctt

SEQ ID NO: 600813 - DNA, 20 bp, mouse
gggcgccgcggagtgcggag

SEQ ID NO: 600814 - DNA, 20 bp, mouse
gggccgggatctgaagtgac

SEQ ID NO: 600815 - DNA, 20 bp, mouse
gcgagcggcgccgcggagtg

SEQ ID NO: 600816 - DNA, 20 bp, mouse
gggcggccccgggacacgac

SEQ ID NO: 600817 - DNA, 20 bp, mouse
ggactgagctaggctggagg

SEQ ID NO: 600818 - DNA, 20 bp, mouse
gcgggacacgacgggcaggg

SEQ ID NO: 600819 - DNA, 20 bp, mouse
gtcccgcgtggagaatgaga

SEQ ID NO: 600820 - DNA, 20 bp, mouse
ggggaacttgagggacgtcg

SEQ ID NO: 600821 - DNA, 20 bp, mouse
ggaaccagagattgtagaaa

SEQ ID NO: 600822 - DNA, 20 bp, mouse
gctctgcttaagacacgtgg

SEQ ID NO: 600823 - DNA, 20 bp, mouse
ggcgagagcgccactatgag

SEQ ID NO: 600824 - DNA, 20 bp, mouse
ggatggcgcggtgtctgcgg

SEQ ID NO: 600825 - DNA, 20 bp, mouse
gcccgccccgcccctcatag

SEQ ID NO: 600826 - DNA, 20 bp, mouse
ggccctggagacggtaccaa

SEQ ID NO: 600827 - DNA, 20 bp, mouse
gatggtctgtttacttcctg

SEQ ID NO: 600828 - DNA, 20 bp, mouse
gggaacctgtgttgtcgtat

SEQ ID NO: 600829 - DNA, 20 bp, mouse
ggttccgtggacggaaacaa

SEQ ID NO: 600830 - DNA, 20 bp, mouse
gagggtacctgaccccaaag

SEQ ID NO: 600831 - DNA, 20 bp, mouse
gaggaaggctctgagattcg

SEQ ID NO: 600832 - DNA, 20 bp, mouse
gctgcaacgcagcccccagt

SEQ ID NO: 600833 - DNA, 20 bp, mouse
gatggggccagacacaggaa

SEQ ID NO: 600834 - DNA, 20 bp, mouse
gccgagagagtagcaggaga

SEQ ID NO: 600835 - DNA, 20 bp, mouse
ggggaagcccgaaagcctaa

SEQ ID NO: 600836 - DNA, 20 bp, mouse
gctggcgcggaagcttcagg

SEQ ID NO: 600837 - DNA, 20 bp, mouse
ggtggcaagcgatcggtgag

SEQ ID NO: 600838 - DNA, 20 bp, mouse
ggcttcaggtggcaagcgat

SEQ ID NO: 600839 - DNA, 20 bp, mouse
gcagctggcgcggaagcttc

SEQ ID NO: 600840 - DNA, 20 bp, mouse
ggagagcgctcaggccagct

SEQ ID NO: 600841 - DNA, 20 bp, mouse
gtccccgcaaggtaaaccgg

SEQ ID NO: 600842 - DNA, 20 bp, mouse
gtcggtgagcgggcgtggga

SEQ ID NO: 600843 - DNA, 20 bp, mouse
ggtgtgatccgcagctggcg

SEQ ID NO: 600844 - DNA, 20 bp, mouse
ggcgatcggtgagcgggcgt

SEQ ID NO: 600845 - DNA, 20 bp, mouse
gctgcagctgcggaagatgt

SEQ ID NO: 600846 - DNA, 20 bp, mouse
gtagtccggacccaccgcaa

SEQ ID NO: 600847 - DNA, 20 bp, mouse
gcggctgcggagggcccttg

SEQ ID NO: 600848 - DNA, 20 bp, mouse
gctgcggagggcccttgcgg

SEQ ID NO: 600849 - DNA, 20 bp, mouse
gctggggcctggtcccgtaa

SEQ ID NO: 600850 - DNA, 20 bp, mouse
ggttaacgcagcagcggcga

SEQ ID NO: 600851 - DNA, 20 bp, mouse
gtactacgttaacgcagcag

SEQ ID NO: 600852 - DNA, 20 bp, mouse
gcccactgcgggaaggaagg

SEQ ID NO: 600853 - DNA, 20 bp, mouse
ggtggtaccgcgtggagaaa

SEQ ID NO: 600854 - DNA, 20 bp, mouse
gccccggaaccggaagccga

SEQ ID NO: 600855 - DNA, 20 bp, mouse
gcagacgccgcggagaagat

SEQ ID NO: 600856 - DNA, 20 bp, mouse
gcgaggactaggtcaagcct

SEQ ID NO: 600857 - DNA, 20 bp, mouse
gcaggtcggagtcgaggact

SEQ ID NO: 600858 - DNA, 20 bp, mouse
ggccccaggagtggtatacg

SEQ ID NO: 600859 - DNA, 20 bp, mouse
ggcggctgcctgactctgac

SEQ ID NO: 600860 - DNA, 20 bp, mouse
gctctgacaggtcggagtcg

SEQ ID NO: 600861 - DNA, 20 bp, mouse
gcaccgccctgccccaggag

SEQ ID NO: 600862 - DNA, 20 bp, mouse
ggcgccgaccacaggatcct

SEQ ID NO: 600863 - DNA, 20 bp, mouse
ggccgcgtataccactcctg

SEQ ID NO: 600864 - DNA, 20 bp, mouse
gcctgtggcagagggcgatt

SEQ ID NO: 600865 - DNA, 20 bp, mouse
ggtccattaatcaataaaca

SEQ ID NO: 600866 - DNA, 20 bp, mouse
gcccacagcaaggtacaccg

SEQ ID NO: 600867 - DNA, 20 bp, mouse
ggggagccgagcccacagca

SEQ ID NO: 600868 - DNA, 20 bp, mouse
gcaccgaggcaaggacattg

SEQ ID NO: 600869 - DNA, 20 bp, mouse
gcatcggcgctgggaccctg

SEQ ID NO: 600870 - DNA, 20 bp, mouse
gccggagctacgtcaccgag

SEQ ID NO: 600871 - DNA, 20 bp, mouse
gcctgaggcttcaccgtcag

SEQ ID NO: 600872 - DNA, 20 bp, mouse
gagcaaggtacaccgaggca

SEQ ID NO: 600873 - DNA, 20 bp, mouse
ggaccccacgagagcgcgaa

SEQ ID NO: 600874 - DNA, 20 bp, mouse
gccagcgccgatggcgacgt

SEQ ID NO: 600875 - DNA, 20 bp, mouse
gggcaaggacattgaggccg

SEQ ID NO: 600876 - DNA, 20 bp, mouse
gaccaccgcgtcatccgtcg

SEQ ID NO: 600877 - DNA, 20 bp, mouse
gtcccggaagtgctcaaaga

SEQ ID NO: 600878 - DNA, 20 bp, mouse
ggctgccgcgacggatgacg

SEQ ID NO: 600879 - DNA, 20 bp, mouse
ggccgcgacggatgacgcgg

SEQ ID NO: 600880 - DNA, 20 bp, mouse
gacgcgggacgggtaagcgg

SEQ ID NO: 600881 - DNA, 20 bp, mouse
gcctgggtggagcggtgcca

SEQ ID NO: 600882 - DNA, 20 bp, mouse
ggacagagcgccgtcccgga

SEQ ID NO: 600883 - DNA, 20 bp, mouse
gaagagaacttagccctggg

SEQ ID NO: 600884 - DNA, 20 bp, mouse
ggtgagacagagcgccgtcc

SEQ ID NO: 600885 - DNA, 20 bp, mouse
ggtcggaagagaaccgtgac

SEQ ID NO: 600886 - DNA, 20 bp, mouse
gatgcaagcacatcagaggg

SEQ ID NO: 600887 - DNA, 20 bp, mouse
ggggcagtagtctcaagctg

SEQ ID NO: 600888 - DNA, 20 bp, mouse
gggtggctgcggcgtcagat

SEQ ID NO: 600889 - DNA, 20 bp, mouse
gagatgggcatctccgatca

SEQ ID NO: 600890 - DNA, 20 bp, mouse
gggcgctctgtctcacgtgg

SEQ ID NO: 600891 - DNA, 20 bp, mouse
gtagtctcaagctggggtgc

SEQ ID NO: 600892 - DNA, 20 bp, mouse
gagctccaggaatacacccg

SEQ ID NO: 600893 - DNA, 20 bp, mouse
ggacagtggccagaaaggag

SEQ ID NO: 600894 - DNA, 20 bp, mouse
gggaggacagtgcagggaag

SEQ ID NO: 600895 - DNA, 20 bp, mouse
gtattgtgcctggaaagcgt

SEQ ID NO: 600896 - DNA, 20 bp, mouse
gctccacaggaagtacccgg

SEQ ID NO: 600897 - DNA, 20 bp, mouse
gggccgccgggtacttcctg

SEQ ID NO: 600898 - DNA, 20 bp, mouse
ggcagccgctagagcagccg

SEQ ID NO: 600899 - DNA, 20 bp, mouse
gcgcctgctgcggcctccac

SEQ ID NO: 600900 - DNA, 20 bp, mouse
gtgagccgcggctgctctag

SEQ ID NO: 600901 - DNA, 20 bp, mouse
gtccgtagagctaggcagga

SEQ ID NO: 600902 - DNA, 20 bp, mouse
gggcagcgtggacccagatc

SEQ ID NO: 600903 - DNA, 20 bp, mouse
gtaggcaggacggcgaggac

SEQ ID NO: 600904 - DNA, 20 bp, mouse
gtgggacagaacgacctgat

SEQ ID NO: 600905 - DNA, 20 bp, mouse
gctctacggagaaatccgag

SEQ ID NO: 600906 - DNA, 20 bp, mouse
gccaaggctgggaccagaat

SEQ ID NO: 600907 - DNA, 20 bp, mouse
ggaataggaagctcccgcgg

SEQ ID NO: 600908 - DNA, 20 bp, mouse
gttccggcggggctccaccg

SEQ ID NO: 600909 - DNA, 20 bp, mouse
gggtcacgccgctctactgg

SEQ ID NO: 600910 - DNA, 20 bp, mouse
gcatgctgccaaccaaggct

SEQ ID NO: 600911 - DNA, 20 bp, mouse
gctctgggccctgaaggagt

SEQ ID NO: 600912 - DNA, 20 bp, mouse
ggcaggtaccaccagtagag

SEQ ID NO: 600913 - DNA, 20 bp, mouse
ggtgtacggagcttccggcg

SEQ ID NO: 600914 - DNA, 20 bp, mouse
gtcccgcggtggagccccgc

SEQ ID NO: 600915 - DNA, 20 bp, mouse
ggcctggccctgaacgacag

SEQ ID NO: 600916 - DNA, 20 bp, mouse
ggcccctgtgcaaggagata

SEQ ID NO: 600917 - DNA, 20 bp, mouse
gggcgcccgccactccccgg

SEQ ID NO: 600918 - DNA, 20 bp, mouse
gcatgccgctggctccctcc

SEQ ID NO: 600919 - DNA, 20 bp, mouse
gcagaggcgcgaggaagggg

SEQ ID NO: 600920 - DNA, 20 bp, mouse
gccttgcacaggggcctccg

SEQ ID NO: 600921 - DNA, 20 bp, mouse
gcacaggggcctccggggag

SEQ ID NO: 600922 - DNA, 20 bp, mouse
gtgcaaggagataaggccag

SEQ ID NO: 600923 - DNA, 20 bp, mouse
ggggcgtggaaggatcatgg

SEQ ID NO: 600924 - DNA, 20 bp, mouse
ggacgggtcagagagttggg

SEQ ID NO: 600925 - DNA, 20 bp, mouse
ggccttatctccttgcacag

SEQ ID NO: 600926 - DNA, 20 bp, mouse
gggcaggagggccagcttca

SEQ ID NO: 600927 - DNA, 20 bp, mouse
gcctgctggttgcagacaca

SEQ ID NO: 600928 - DNA, 20 bp, mouse
gcctaagcagacacccctct

SEQ ID NO: 600929 - DNA, 20 bp, mouse
ggactacactggggagtact

SEQ ID NO: 600930 - DNA, 20 bp, mouse
gctgatcaggcagatgaaca

SEQ ID NO: 600931 - DNA, 20 bp, mouse
gcatacctgctgtgaacccg

SEQ ID NO: 600932 - DNA, 20 bp, mouse
gagtactgggaagaaactgg

SEQ ID NO: 600933 - DNA, 20 bp, mouse
ggtgattgcacccttcacag

SEQ ID NO: 600934 - DNA, 20 bp, mouse
gcacttctggtggagatggg

SEQ ID NO: 600935 - DNA, 20 bp, mouse
ggccgagaaggaccagcaca

SEQ ID NO: 600936 - DNA, 20 bp, mouse
gccgaagggtcgcagacgtt

SEQ ID NO: 600937 - DNA, 20 bp, mouse
gtgttctgtggagcttgcgg

SEQ ID NO: 600938 - DNA, 20 bp, mouse
gttcgttctcgagaaggccc

SEQ ID NO: 600939 - DNA, 20 bp, mouse
gcagtgaaccagacaggtga

SEQ ID NO: 600940 - DNA, 20 bp, mouse
gtgttcccagcacgccaccg

SEQ ID NO: 600941 - DNA, 20 bp, mouse
gcgagcggcccgaaaccagg

SEQ ID NO: 600942 - DNA, 20 bp, mouse
gtggggaccctgtccaggaa

SEQ ID NO: 600943 - DNA, 20 bp, mouse
gctgtcccagtgaaccagac

SEQ ID NO: 600944 - DNA, 20 bp, mouse
gtgtggagcttgcggaggtg

SEQ ID NO: 600945 - DNA, 20 bp, mouse
gagcgctccgcagtgttctg

SEQ ID NO: 600946 - DNA, 20 bp, mouse
gttgcttgctcgcgcagagg

SEQ ID NO: 600947 - DNA, 20 bp, mouse
ggcctgcgcacgcctccccg

SEQ ID NO: 600948 - DNA, 20 bp, mouse
gaagagccggagcccggaag

SEQ ID NO: 600949 - DNA, 20 bp, mouse
gcagaggtcgcgcacagatg

SEQ ID NO: 600950 - DNA, 20 bp, mouse
gcagccagcgccggtagcag

SEQ ID NO: 600951 - DNA, 20 bp, mouse
gagcgagacggaagcctcgg

SEQ ID NO: 600952 - DNA, 20 bp, mouse
gtgtagcccggcagccgccg

SEQ ID NO: 600953 - DNA, 20 bp, mouse
ggctggtccccgggattcag

SEQ ID NO: 600954 - DNA, 20 bp, mouse
gcgcttgcttgctcgcgcag

SEQ ID NO: 600955 - DNA, 20 bp, mouse
gcgctcccgagctcaggtag

SEQ ID NO: 600956 - DNA, 20 bp, mouse
gcgcggccagagaggtccgg

SEQ ID NO: 600957 - DNA, 20 bp, mouse
gggactgagcgcggccagag

SEQ ID NO: 600958 - DNA, 20 bp, mouse
gctcatggtggaggcgtccg

SEQ ID NO: 600959 - DNA, 20 bp, mouse
gagcatcccccggacctctc

SEQ ID NO: 600960 - DNA, 20 bp, mouse
gcccagtaggggaagttcga

SEQ ID NO: 600961 - DNA, 20 bp, mouse
gccgcggtaccagcatcccc

SEQ ID NO: 600962 - DNA, 20 bp, mouse
gaccgcggccggggatgcta

SEQ ID NO: 600963 - DNA, 20 bp, mouse
gagtggccccgcgctcatgg

SEQ ID NO: 600964 - DNA, 20 bp, mouse
gcccgtagcatccccggccg

SEQ ID NO: 600965 - DNA, 20 bp, mouse
gagctctctccggggaaggg

SEQ ID NO: 600966 - DNA, 20 bp, mouse
gtgttagctgtggagaaaga

SEQ ID NO: 600967 - DNA, 20 bp, mouse
ggccggcgcggcaaacgtgg

SEQ ID NO: 600968 - DNA, 20 bp, mouse
gtcttctcgcgaggccggtt

SEQ ID NO: 600969 - DNA, 20 bp, mouse
ggcgtgagagagagtcctga

SEQ ID NO: 600970 - DNA, 20 bp, mouse
gggccacgcgcgggaaaagg

SEQ ID NO: 600971 - DNA, 20 bp, mouse
gcccggccgagtagaatgga

SEQ ID NO: 600972 - DNA, 20 bp, mouse
ggcccgaatgttgttagctg

SEQ ID NO: 600973 - DNA, 20 bp, mouse
gagggatcgaggcgagatgg

SEQ ID NO: 600974 - DNA, 20 bp, mouse
gagatggcggaaaatttaaa

SEQ ID NO: 600975 - DNA, 20 bp, mouse
gtctcccgtggaaaccgaaa

SEQ ID NO: 600976 - DNA, 20 bp, mouse
ggccaaggcacggggcagtg

SEQ ID NO: 600977 - DNA, 20 bp, mouse
ggcggccagggccaaggcac

SEQ ID NO: 600978 - DNA, 20 bp, mouse
gtgaaagctccgcaagatgg

SEQ ID NO: 600979 - DNA, 20 bp, mouse
gcacgaggtgccttattcaa

SEQ ID NO: 600980 - DNA, 20 bp, mouse
ggcaggagcgcggtgtcacc

SEQ ID NO: 600981 - DNA, 20 bp, mouse
gcccgccagggactccggag

SEQ ID NO: 600982 - DNA, 20 bp, mouse
gaggcacggggcagtgaggc

SEQ ID NO: 600983 - DNA, 20 bp, mouse
ggcctggccttgggcctcgg

SEQ ID NO: 600984 - DNA, 20 bp, mouse
gcagcggagaccgacccctg

SEQ ID NO: 600985 - DNA, 20 bp, mouse
gaggcccaaggccaggcgaa

SEQ ID NO: 600986 - DNA, 20 bp, mouse
gtgtccgggtggctcaccgg

SEQ ID NO: 600987 - DNA, 20 bp, mouse
ggcgcggcagcgaggctcgg

SEQ ID NO: 600988 - DNA, 20 bp, mouse
gcgcagtcgcgggatctgag

SEQ ID NO: 600989 - DNA, 20 bp, mouse
gctgccgcggcacccgacag

SEQ ID NO: 600990 - DNA, 20 bp, mouse
gcggtgtccgggtggctcac

SEQ ID NO: 600991 - DNA, 20 bp, mouse
gtccttccaccgagcccggg

SEQ ID NO: 600992 - DNA, 20 bp, mouse
gcggcgacgcgtctgcggcg

SEQ ID NO: 600993 - DNA, 20 bp, mouse
gggacgcgaagccccgaagt

SEQ ID NO: 600994 - DNA, 20 bp, mouse
ggcgaggctcgggggctatg

SEQ ID NO: 600995 - DNA, 20 bp, mouse
ggcagacgcgtcgccgcccc

SEQ ID NO: 600996 - DNA, 20 bp, mouse
ggagagccggaggaggcggt

SEQ ID NO: 600997 - DNA, 20 bp, mouse
ggtcggacgagagccggagg

SEQ ID NO: 600998 - DNA, 20 bp, mouse
ggctgcaacgcgggttcctg

SEQ ID NO: 600999 - DNA, 20 bp, mouse
gacgcgggttcctgaggaga

SEQ ID NO: 601000 - DNA, 20 bp, mouse
gtgtgtcggacgagagccgg

SEQ ID NO: 601001 - DNA, 20 bp, mouse
ggctccaagggtgcagggaa

SEQ ID NO: 601002 - DNA, 20 bp, mouse
ggaggtggcggctgcaacgc

SEQ ID NO: 601003 - DNA, 20 bp, mouse
gggaggcgcggcggctgtgt

SEQ ID NO: 601004 - DNA, 20 bp, mouse
gggctgtgtcggacgagagc

SEQ ID NO: 601005 - DNA, 20 bp, mouse
ggggccaagagggggctcag

SEQ ID NO: 601006 - DNA, 20 bp, mouse
ggcggagcgaggccagggta

SEQ ID NO: 601007 - DNA, 20 bp, mouse
ggggtgagcggcctccgaag

SEQ ID NO: 601008 - DNA, 20 bp, mouse
gagcgccgggcggggaaagt

SEQ ID NO: 601009 - DNA, 20 bp, mouse
ggaggaggcaggaaccgcga

SEQ ID NO: 601010 - DNA, 20 bp, mouse
gggctccagcggaccgaggg

SEQ ID NO: 601011 - DNA, 20 bp, mouse
gagcggcctccgaagcggag

SEQ ID NO: 601012 - DNA, 20 bp, mouse
gtggcgcctcagaagcacgg

SEQ ID NO: 601013 - DNA, 20 bp, mouse
gcgatggcgcctcagaagca

SEQ ID NO: 601014 - DNA, 20 bp, mouse
gtccgaagcggagcggggct

SEQ ID NO: 601015 - DNA, 20 bp, mouse
gcttcgggcggcaaatccgg

SEQ ID NO: 601016 - DNA, 20 bp, mouse
gcacagggctgaggcggcag

SEQ ID NO: 601017 - DNA, 20 bp, mouse
ggagtccccgggtgagggag

SEQ ID NO: 601018 - DNA, 20 bp, mouse
ggggagggggtccagccaca

SEQ ID NO: 601019 - DNA, 20 bp, mouse
gcagcggcgactgctcctcc

SEQ ID NO: 601020 - DNA, 20 bp, mouse
gctgctcctcccggtaccag

SEQ ID NO: 601021 - DNA, 20 bp, mouse
gtcagggagtccccgggtga

SEQ ID NO: 601022 - DNA, 20 bp, mouse
gccccgggtcagggagtccc

SEQ ID NO: 601023 - DNA, 20 bp, mouse
gcgcttcccctggtaccggg

SEQ ID NO: 601024 - DNA, 20 bp, mouse
gtgccgcttcccctggtacc

SEQ ID NO: 601025 - DNA, 20 bp, mouse
gtctgcagtgccgcttcccc

SEQ ID NO: 601026 - DNA, 20 bp, mouse
gtccctccgcagcagaccag

SEQ ID NO: 601027 - DNA, 20 bp, mouse
ggtccagagccagcaggtgt

SEQ ID NO: 601028 - DNA, 20 bp, mouse
gagactcaggagccccggga

SEQ ID NO: 601029 - DNA, 20 bp, mouse
gatcagccagagcctagtcc

SEQ ID NO: 601030 - DNA, 20 bp, mouse
gcagaggctctgcacagcgg

SEQ ID NO: 601031 - DNA, 20 bp, mouse
gctgggagcgcgctgcacag

SEQ ID NO: 601032 - DNA, 20 bp, mouse
gcgaacaccgtaagtctggg

SEQ ID NO: 601033 - DNA, 20 bp, mouse
gctgtttggaaggtgaatgt

SEQ ID NO: 601034 - DNA, 20 bp, mouse
gggtagatttctcatctgtc

SEQ ID NO: 601035 - DNA, 20 bp, mouse
gcaaagaagcgcgcagcccg

SEQ ID NO: 601036 - DNA, 20 bp, mouse
gagagagtggcagaccgagg

SEQ ID NO: 601037 - DNA, 20 bp, mouse
gtagtcggcagcgagaggag

SEQ ID NO: 601038 - DNA, 20 bp, mouse
gaggagagagtggcagaccg

SEQ ID NO: 601039 - DNA, 20 bp, mouse
gtcgctgccgactagctcaa

SEQ ID NO: 601040 - DNA, 20 bp, mouse
gccccgggctgcaagcggag

SEQ ID NO: 601041 - DNA, 20 bp, mouse
gtctcctgcagcgcgcgcag

SEQ ID NO: 601042 - DNA, 20 bp, mouse
gaggggtgctcgcaaggcga

SEQ ID NO: 601043 - DNA, 20 bp, mouse
gttgcagcccggggccgcct

SEQ ID NO: 601044 - DNA, 20 bp, mouse
gccccgggtttactaggcag

SEQ ID NO: 601045 - DNA, 20 bp, mouse
gcgctagttgcgcttctgga

SEQ ID NO: 601046 - DNA, 20 bp, mouse
ggaagccatgctgtatgggt

SEQ ID NO: 601047 - DNA, 20 bp, mouse
gaagagaagccatgctgtat

SEQ ID NO: 601048 - DNA, 20 bp, mouse
gtatgccaacccatacagca

SEQ ID NO: 601049 - DNA, 20 bp, mouse
gcctggtttgcagatggtca

SEQ ID NO: 601050 - DNA, 20 bp, mouse
gggagatatatgactgctcc

SEQ ID NO: 601051 - DNA, 20 bp, mouse
gttggtgtggaagcaaatga

SEQ ID NO: 601052 - DNA, 20 bp, mouse
ggagagacctggtttgcaga

SEQ ID NO: 601053 - DNA, 20 bp, mouse
gggtgatgatactataatct

SEQ ID NO: 601054 - DNA, 20 bp, mouse
gtatattttaggataaacta

SEQ ID NO: 601055 - DNA, 20 bp, mouse
gtctaaggctaaacttggtg

SEQ ID NO: 601056 - DNA, 20 bp, mouse
gggaagtgtgtaacagcttg

SEQ ID NO: 601057 - DNA, 20 bp, mouse
gctggtcaggataataggta

SEQ ID NO: 601058 - DNA, 20 bp, mouse
gtgtgtaacagcttggggct

SEQ ID NO: 601059 - DNA, 20 bp, mouse
ggccattagtatcaggacat

SEQ ID NO: 601060 - DNA, 20 bp, mouse
gagtgtcaactcttacagca

SEQ ID NO: 601061 - DNA, 20 bp, mouse
ggcctatgtcctgatactaa

SEQ ID NO: 601062 - DNA, 20 bp, mouse
gtctgggtttcagacggcca

SEQ ID NO: 601063 - DNA, 20 bp, mouse
gtgcctctggtcaggataat

SEQ ID NO: 601064 - DNA, 20 bp, mouse
gagttgacacttgtgagcct

SEQ ID NO: 601065 - DNA, 20 bp, mouse
gatatgttcctacttaaagg

SEQ ID NO: 601066 - DNA, 20 bp, mouse
gagagatgcataagagctcc

SEQ ID NO: 601067 - DNA, 20 bp, mouse
gacatttagtcacagaatat

SEQ ID NO: 601068 - DNA, 20 bp, mouse
gcagttggtgatgatacata

SEQ ID NO: 601069 - DNA, 20 bp, mouse
gaaaaataatactataatct

SEQ ID NO: 601070 - DNA, 20 bp, mouse
gatggtcaggaaaattggta

SEQ ID NO: 601071 - DNA, 20 bp, mouse
gcaactgggaagacatttct

SEQ ID NO: 601072 - DNA, 20 bp, mouse
gattctgtgactaaatgtct

SEQ ID NO: 601073 - DNA, 20 bp, mouse
gttaatatggcaagtatgag

SEQ ID NO: 601074 - DNA, 20 bp, mouse
gttcaaatgttctatcagcc

SEQ ID NO: 601075 - DNA, 20 bp, mouse
gacactatttctcattaata

SEQ ID NO: 601076 - DNA, 20 bp, mouse
gcagaagtaggctcagaatc

SEQ ID NO: 601077 - DNA, 20 bp, mouse
gtacctattgtcttgaccat

SEQ ID NO: 601078 - DNA, 20 bp, mouse
gtgcctatggtcaagacaat

SEQ ID NO: 601079 - DNA, 20 bp, mouse
gttcaaattctccagcagac

SEQ ID NO: 601080 - DNA, 20 bp, mouse
ggtgggagcagattttagga

SEQ ID NO: 601081 - DNA, 20 bp, mouse
gggcatcaattcttacagca

SEQ ID NO: 601082 - DNA, 20 bp, mouse
gcatgactcctccagtctgc

SEQ ID NO: 601083 - DNA, 20 bp, mouse
gatgtcgagtatagaagcaa

SEQ ID NO: 601084 - DNA, 20 bp, mouse
gtcatagcttatccccaaaa

SEQ ID NO: 601085 - DNA, 20 bp, mouse
gtttcatcatcataattatg

SEQ ID NO: 601086 - DNA, 20 bp, mouse
ggcagctcggggactcggga

SEQ ID NO: 601087 - DNA, 20 bp, mouse
ggacacgatccagactcctc

SEQ ID NO: 601088 - DNA, 20 bp, mouse
gactaagcggaggggacccg

SEQ ID NO: 601089 - DNA, 20 bp, mouse
gccgagctgccagaggagtc

SEQ ID NO: 601090 - DNA, 20 bp, mouse
gtcggggactcgggagggac

SEQ ID NO: 601091 - DNA, 20 bp, mouse
gtctggcagctcggggactc

SEQ ID NO: 601092 - DNA, 20 bp, mouse
gccaaatagccgagagtcag

SEQ ID NO: 601093 - DNA, 20 bp, mouse
gggcgactgcgggagctcag

SEQ ID NO: 601094 - DNA, 20 bp, mouse
ggcgtccttgcatgtgacac

SEQ ID NO: 601095 - DNA, 20 bp, mouse
gagaggcctcggggaacagg

SEQ ID NO: 601096 - DNA, 20 bp, mouse
gcctggcagaggacacccgg

SEQ ID NO: 601097 - DNA, 20 bp, mouse
ggcgcctggcagaggacacc

SEQ ID NO: 601098 - DNA, 20 bp, mouse
ggcgctctgagtggctctga

SEQ ID NO: 601099 - DNA, 20 bp, mouse
gacgctacgtccatccggag

SEQ ID NO: 601100 - DNA, 20 bp, mouse
gcaggagagcgaggtgagta

SEQ ID NO: 601101 - DNA, 20 bp, mouse
gactcctgaagagcgagctg

SEQ ID NO: 601102 - DNA, 20 bp, mouse
ggagcgaggtgagtagggtc

SEQ ID NO: 601103 - DNA, 20 bp, mouse
ggggcgccgggtattaattg

SEQ ID NO: 601104 - DNA, 20 bp, mouse
gggcgccgggaccttgtcga

SEQ ID NO: 601105 - DNA, 20 bp, mouse
gtccttccaagacaacagtc

SEQ ID NO: 601106 - DNA, 20 bp, mouse
gagggaagcacagccccatg

SEQ ID NO: 601107 - DNA, 20 bp, mouse
gtgcggactccgcgggacaa

SEQ ID NO: 601108 - DNA, 20 bp, mouse
ggcctcctgaccctccccta

SEQ ID NO: 601109 - DNA, 20 bp, mouse
ggacgcaggcacccagggcc

SEQ ID NO: 601110 - DNA, 20 bp, mouse
gatccgaggagggtccttag

SEQ ID NO: 601111 - DNA, 20 bp, mouse
gatggggacgcaggcaccca

SEQ ID NO: 601112 - DNA, 20 bp, mouse
ggaacccgaatcctcgctgg

SEQ ID NO: 601113 - DNA, 20 bp, mouse
gctcctcggatggcataggt

SEQ ID NO: 601114 - DNA, 20 bp, mouse
gtgcagtgcagtcggaggga

SEQ ID NO: 601115 - DNA, 20 bp, mouse
ggaggagggtccttagggga

SEQ ID NO: 601116 - DNA, 20 bp, mouse
gccgggagaccgacaggagt

SEQ ID NO: 601117 - DNA, 20 bp, mouse
gtagctgcccagcgaggaag

SEQ ID NO: 601118 - DNA, 20 bp, mouse
gggtctcccggcggtggcag

SEQ ID NO: 601119 - DNA, 20 bp, mouse
gccaccgccgggagaccgac

SEQ ID NO: 601120 - DNA, 20 bp, mouse
ggtcctccgcccactcctgt

SEQ ID NO: 601121 - DNA, 20 bp, mouse
ggccagccgctgccaccgcc

SEQ ID NO: 601122 - DNA, 20 bp, mouse
gtggcgcaccgcggacatgg

SEQ ID NO: 601123 - DNA, 20 bp, mouse
gtcgccccccgcggtactca

SEQ ID NO: 601124 - DNA, 20 bp, mouse
gggcagctagctgctggggg

SEQ ID NO: 601125 - DNA, 20 bp, mouse
ggaccgacaggagtgggcgg

SEQ ID NO: 601126 - DNA, 20 bp, mouse
ggtgctgccagagggctgtg

SEQ ID NO: 601127 - DNA, 20 bp, mouse
ggcgcacagggacctggaat

SEQ ID NO: 601128 - DNA, 20 bp, mouse
ggacagccagccagcgcaca

SEQ ID NO: 601129 - DNA, 20 bp, mouse
gagccctctggcagcactgg

SEQ ID NO: 601130 - DNA, 20 bp, mouse
gggcccccagtgctgccaga

SEQ ID NO: 601131 - DNA, 20 bp, mouse
gctggaatcggaaagttcca

SEQ ID NO: 601132 - DNA, 20 bp, mouse
gcaggtccctgtgcgctggc

SEQ ID NO: 601133 - DNA, 20 bp, mouse
gtagagggccacaaccatac

SEQ ID NO: 601134 - DNA, 20 bp, mouse
ggaagtcagatgaggacccc

SEQ ID NO: 601135 - DNA, 20 bp, mouse
gctctttctcaagggagtaa

SEQ ID NO: 601136 - DNA, 20 bp, mouse
ggagcaaggtgggagttcta

SEQ ID NO: 601137 - DNA, 20 bp, mouse
ggaggagccatcctggaagt

SEQ ID NO: 601138 - DNA, 20 bp, mouse
gcttgtgtggagccttggag

SEQ ID NO: 601139 - DNA, 20 bp, mouse
gcccaccttgctcacaaact

SEQ ID NO: 601140 - DNA, 20 bp, mouse
gggatggctcctctgatctg

SEQ ID NO: 601141 - DNA, 20 bp, mouse
ggccaacgccacccaatggt

SEQ ID NO: 601142 - DNA, 20 bp, mouse
gatgagccaacgccacccaa

SEQ ID NO: 601143 - DNA, 20 bp, mouse
ggccagggatggaggcgatg

SEQ ID NO: 601144 - DNA, 20 bp, mouse
gggtcatccccaccattggg

SEQ ID NO: 601145 - DNA, 20 bp, mouse
gtcctggaagtaggacttcc

SEQ ID NO: 601146 - DNA, 20 bp, mouse
gctcagagcccctagttctt

SEQ ID NO: 601147 - DNA, 20 bp, mouse
ggagttcacctaagaactag

SEQ ID NO: 601148 - DNA, 20 bp, mouse
ggcttcatctggacaaagga

SEQ ID NO: 601149 - DNA, 20 bp, mouse
gtctggcttcatctggacaa

SEQ ID NO: 601150 - DNA, 20 bp, mouse
gtcaagtcccacagcatctg

SEQ ID NO: 601151 - DNA, 20 bp, mouse
gtggatgactaccatcttgg

SEQ ID NO: 601152 - DNA, 20 bp, mouse
gagcctggtaggaaggacct

SEQ ID NO: 601153 - DNA, 20 bp, mouse
ggacatgtgtaccaccaaga

SEQ ID NO: 601154 - DNA, 20 bp, mouse
gaccaagccccagatgctgt

SEQ ID NO: 601155 - DNA, 20 bp, mouse
gctgatgcccaagaagtatg

SEQ ID NO: 601156 - DNA, 20 bp, mouse
gagagaaaggacgaagacag

SEQ ID NO: 601157 - DNA, 20 bp, mouse
gcagctgtggttggacaata

SEQ ID NO: 601158 - DNA, 20 bp, mouse
gggacttcatcttgtcaaga

SEQ ID NO: 601159 - DNA, 20 bp, mouse
gtatggtgagtgtataggga

SEQ ID NO: 601160 - DNA, 20 bp, mouse
gtccctctgaggagctgctc

SEQ ID NO: 601161 - DNA, 20 bp, mouse
gtgtaagcagatcctttcat

SEQ ID NO: 601162 - DNA, 20 bp, mouse
gacaatatggtgagtgtata

SEQ ID NO: 601163 - DNA, 20 bp, mouse
gtcttatcatcaattaccag

SEQ ID NO: 601164 - DNA, 20 bp, mouse
gtcagggagaacgtcttaaa

SEQ ID NO: 601165 - DNA, 20 bp, mouse
gtcagtttcgggatcaaagg

SEQ ID NO: 601166 - DNA, 20 bp, mouse
gagatcagctgaggtctcag

SEQ ID NO: 601167 - DNA, 20 bp, mouse
gatgctgatgctgacatggg

SEQ ID NO: 601168 - DNA, 20 bp, mouse
gtttcccaataaacatgagt

SEQ ID NO: 601169 - DNA, 20 bp, mouse
gggaggggcactcagttcac

SEQ ID NO: 601170 - DNA, 20 bp, mouse
gttctttgctaggtgaagaa

SEQ ID NO: 601171 - DNA, 20 bp, mouse
gtttgctaggtgaagaaagg

SEQ ID NO: 601172 - DNA, 20 bp, mouse
gtcagctgaggtctcagtgg

SEQ ID NO: 601173 - DNA, 20 bp, mouse
gtcagggagcagccgcagag

SEQ ID NO: 601174 - DNA, 20 bp, mouse
gagcatcctggccatattca

SEQ ID NO: 601175 - DNA, 20 bp, mouse
gccaataaacatgagtgggg

SEQ ID NO: 601176 - DNA, 20 bp, mouse
gttttctgggtgcagaaagg

SEQ ID NO: 601177 - DNA, 20 bp, mouse
gtcatttatatgttcttttc

SEQ ID NO: 601178 - DNA, 20 bp, mouse
gttcttttctgggtgcagaa

SEQ ID NO: 601179 - DNA, 20 bp, mouse
gtcagctgaggtctcagtga

SEQ ID NO: 601180 - DNA, 20 bp, mouse
gccaataaacatgagtggtg

SEQ ID NO: 601181 - DNA, 20 bp, mouse
gaaactaagcaccatgcata

SEQ ID NO: 601182 - DNA, 20 bp, mouse
gcagctgggatagaactcta

SEQ ID NO: 601183 - DNA, 20 bp, mouse
gtcagggagcagccacagag

SEQ ID NO: 601184 - DNA, 20 bp, mouse
gtctcagtgaaggcccttcc

SEQ ID NO: 601185 - DNA, 20 bp, mouse
gtgctttcttctccagaagg

SEQ ID NO: 601186 - DNA, 20 bp, mouse
gaatggctcctgtcaccaga

SEQ ID NO: 601187 - DNA, 20 bp, mouse
gtataaggagagtgtatcaa

SEQ ID NO: 601188 - DNA, 20 bp, mouse
gaagaaaactaagggtgagt

SEQ ID NO: 601189 - DNA, 20 bp, mouse
ggatacccacacaaaagcta

SEQ ID NO: 601190 - DNA, 20 bp, mouse
gcccttagttttcttcccaa

SEQ ID NO: 601191 - DNA, 20 bp, mouse
gttccaaacagattaagtgt

SEQ ID NO: 601192 - DNA, 20 bp, mouse
gtgagtaggaagagttgatg

SEQ ID NO: 601193 - DNA, 20 bp, mouse
gactgcaagggaacagttgg

SEQ ID NO: 601194 - DNA, 20 bp, mouse
gaatgacagggttctttaaa

SEQ ID NO: 601195 - DNA, 20 bp, mouse
gatcagagatgtagactgca

SEQ ID NO: 601196 - DNA, 20 bp, mouse
gcagaagcaaggggagcccg

SEQ ID NO: 601197 - DNA, 20 bp, mouse
gtgcttctgtcaccagaacg

SEQ ID NO: 601198 - DNA, 20 bp, mouse
gacccttctagtagtcacat

SEQ ID NO: 601199 - DNA, 20 bp, mouse
gaaggggagcccgtggtgag

SEQ ID NO: 601200 - DNA, 20 bp, mouse
gttgaaggctagaagctctg

SEQ ID NO: 601201 - DNA, 20 bp, mouse
ggtcacaagtattcaaggta

SEQ ID NO: 601202 - DNA, 20 bp, mouse
gcttacattgctcctcgttc

SEQ ID NO: 601203 - DNA, 20 bp, mouse
gagattcgggcgggaggcag

SEQ ID NO: 601204 - DNA, 20 bp, mouse
ggaaaggttctctcagtcgg

SEQ ID NO: 601205 - DNA, 20 bp, mouse
gtgcaggtaagtggatcacg

SEQ ID NO: 601206 - DNA, 20 bp, mouse
gcagaacaaggagcattgta

SEQ ID NO: 601207 - DNA, 20 bp, mouse
gcagctgcaaagaggccccg

SEQ ID NO: 601208 - DNA, 20 bp, mouse
gtgtttctgtcaccagaaca

SEQ ID NO: 601209 - DNA, 20 bp, mouse
ggcagaatgctgtctcccca

SEQ ID NO: 601210 - DNA, 20 bp, mouse
ggtcacaggtattcacggta

SEQ ID NO: 601211 - DNA, 20 bp, mouse
gcccctcagccctcaaccat

SEQ ID NO: 601212 - DNA, 20 bp, mouse
gccttcaggatagaagccct

SEQ ID NO: 601213 - DNA, 20 bp, mouse
ggaaattgccactcaccacg

SEQ ID NO: 601214 - DNA, 20 bp, mouse
ggcaaattgttggtagccaa

SEQ ID NO: 601215 - DNA, 20 bp, mouse
ggttggtagccaatggttga

SEQ ID NO: 601216 - DNA, 20 bp, mouse
ggcgcggccgcggccatgag

SEQ ID NO: 601217 - DNA, 20 bp, mouse
ggggctgaccaggtctgtta

SEQ ID NO: 601218 - DNA, 20 bp, mouse
gaggcgctgagttgccgact

SEQ ID NO: 601219 - DNA, 20 bp, mouse
gcagacctggtcagcccagt

SEQ ID NO: 601220 - DNA, 20 bp, mouse
gtagggcacgggacccgcgg

SEQ ID NO: 601221 - DNA, 20 bp, mouse
gtccaggtcgagcgcggtga

SEQ ID NO: 601222 - DNA, 20 bp, mouse
gctgtagggcacgggacccg

SEQ ID NO: 601223 - DNA, 20 bp, mouse
ggcggcggtgtccgcaggga

SEQ ID NO: 601224 - DNA, 20 bp, mouse
gcaggtctgttagggcagcg

SEQ ID NO: 601225 - DNA, 20 bp, mouse
ggggctgcttgggaatgtgg

SEQ ID NO: 601226 - DNA, 20 bp, mouse
ggcgtgcgcagcctgacgtg

SEQ ID NO: 601227 - DNA, 20 bp, mouse
ggggaactagaaaccgacga

SEQ ID NO: 601228 - DNA, 20 bp, mouse
gggtgggcttaaactcggaa

SEQ ID NO: 601229 - DNA, 20 bp, mouse
gggttggtggtctccgtcgt

SEQ ID NO: 601230 - DNA, 20 bp, mouse
gtggagaacgggttacggag

SEQ ID NO: 601231 - DNA, 20 bp, mouse
gcagcctgacgtggggcggt

SEQ ID NO: 601232 - DNA, 20 bp, mouse
ggggtcggggtgcgcatcgt

SEQ ID NO: 601233 - DNA, 20 bp, mouse
gcctggtgaggaggcgtgag

SEQ ID NO: 601234 - DNA, 20 bp, mouse
gagtggggtgggcttaaact

SEQ ID NO: 601235 - DNA, 20 bp, mouse
gccaccaaccgccccacgtc

SEQ ID NO: 601236 - DNA, 20 bp, mouse
gtgcgcggcaaggccaggag

SEQ ID NO: 601237 - DNA, 20 bp, mouse
gggcactcagcaaatggcgg

SEQ ID NO: 601238 - DNA, 20 bp, mouse
ggcggctccaggtaaacgga

SEQ ID NO: 601239 - DNA, 20 bp, mouse
gcgtctgtggaagtggtggg

SEQ ID NO: 601240 - DNA, 20 bp, mouse
gatgccgcccgaccacagga

SEQ ID NO: 601241 - DNA, 20 bp, mouse
ggaatgccggctgcgcggca

SEQ ID NO: 601242 - DNA, 20 bp, mouse
gctggcaatgcgttacccaa

SEQ ID NO: 601243 - DNA, 20 bp, mouse
gagaggcggagtagggtcgt

SEQ ID NO: 601244 - DNA, 20 bp, mouse
ggcctgagtgacagttcgat

SEQ ID NO: 601245 - DNA, 20 bp, mouse
ggtaaacggagggctggacc

SEQ ID NO: 601246 - DNA, 20 bp, mouse
gggaatcgccactgtcgctg

SEQ ID NO: 601247 - DNA, 20 bp, mouse
gtgggtgtccgactggtccg

SEQ ID NO: 601248 - DNA, 20 bp, mouse
gcctaacttacctgagtccg

SEQ ID NO: 601249 - DNA, 20 bp, mouse
gccagtgtgcagcgggctct

SEQ ID NO: 601250 - DNA, 20 bp, mouse
gggcgattccccggaccagt

SEQ ID NO: 601251 - DNA, 20 bp, mouse
gctgctgctgccgcggactc

SEQ ID NO: 601252 - DNA, 20 bp, mouse
ggggctctgggaaggcgctt

SEQ ID NO: 601253 - DNA, 20 bp, mouse
ggctccagctggacctgagg

SEQ ID NO: 601254 - DNA, 20 bp, mouse
gaggtccagctggagcaacc

SEQ ID NO: 601255 - DNA, 20 bp, mouse
gaggtaagttagggtattcc

SEQ ID NO: 601256 - DNA, 20 bp, mouse
gccctggcacccttaaccac

SEQ ID NO: 601257 - DNA, 20 bp, mouse
gtaagggtgccagggctctt

SEQ ID NO: 601258 - DNA, 20 bp, mouse
gcgactccgctggtcttcga

SEQ ID NO: 601259 - DNA, 20 bp, mouse
gctcttgggcgaggggaccg

SEQ ID NO: 601260 - DNA, 20 bp, mouse
gagtctccctcgaagaccag

SEQ ID NO: 601261 - DNA, 20 bp, mouse
ggcggagtcggatcagccag

SEQ ID NO: 601262 - DNA, 20 bp, mouse
gtcccctcgcccaagagccc

SEQ ID NO: 601263 - DNA, 20 bp, mouse
gagccgccgtcagagagggt

SEQ ID NO: 601264 - DNA, 20 bp, mouse
gcggcccgtggagcccactg

SEQ ID NO: 601265 - DNA, 20 bp, mouse
ggaggggaccgcggcagagg

SEQ ID NO: 601266 - DNA, 20 bp, mouse
gacatcgggtcactgagaga

SEQ ID NO: 601267 - DNA, 20 bp, mouse
ggctgtcttggactcaatca

SEQ ID NO: 601268 - DNA, 20 bp, mouse
ggcttgctcgcacagctgat

SEQ ID NO: 601269 - DNA, 20 bp, mouse
gtgtgcagatcacccaacat

SEQ ID NO: 601270 - DNA, 20 bp, mouse
gggtgatctgcacagcaaca

SEQ ID NO: 601271 - DNA, 20 bp, mouse
gtgagggaaagggcatgtgt

SEQ ID NO: 601272 - DNA, 20 bp, mouse
gacacgcaggtgagacctga

SEQ ID NO: 601273 - DNA, 20 bp, mouse
gagtccaagacagccccggc

SEQ ID NO: 601274 - DNA, 20 bp, mouse
ggaagtcagatgaatgataa

SEQ ID NO: 601275 - DNA, 20 bp, mouse
gagccccggcaggcacacgc

SEQ ID NO: 601276 - DNA, 20 bp, mouse
ggctgcggcagctgaggaag

SEQ ID NO: 601277 - DNA, 20 bp, mouse
gatacccaacggctgcggtc

SEQ ID NO: 601278 - DNA, 20 bp, mouse
gcgttgggtatggagcccga

SEQ ID NO: 601279 - DNA, 20 bp, mouse
gaggtctgaggagatcacgc

SEQ ID NO: 601280 - DNA, 20 bp, mouse
gccaccagaccgcagccgtt

SEQ ID NO: 601281 - DNA, 20 bp, mouse
gctgactgggatcctgactg

SEQ ID NO: 601282 - DNA, 20 bp, mouse
ggcgggcggacgcgaacccc

SEQ ID NO: 601283 - DNA, 20 bp, mouse
gggacgcgaaccccgggaga

SEQ ID NO: 601284 - DNA, 20 bp, mouse
gggtgcagtgtctaacagcc

SEQ ID NO: 601285 - DNA, 20 bp, mouse
ggggcgactgcagctcggta

SEQ ID NO: 601286 - DNA, 20 bp, mouse
gggagcctttgatggcggag

SEQ ID NO: 601287 - DNA, 20 bp, mouse
ggataccccacgttgggaaa

SEQ ID NO: 601288 - DNA, 20 bp, mouse
ggcggagctggagcctttga

SEQ ID NO: 601289 - DNA, 20 bp, mouse
ggaggtagtgaaggccaaca

SEQ ID NO: 601290 - DNA, 20 bp, mouse
gggtatctgcgcatgagcct

SEQ ID NO: 601291 - DNA, 20 bp, mouse
gagaaagctgaagacacccg

SEQ ID NO: 601292 - DNA, 20 bp, mouse
ggcagccatttcccaacgtg

SEQ ID NO: 601293 - DNA, 20 bp, mouse
gtgcgcagataccccacgtt

SEQ ID NO: 601294 - DNA, 20 bp, mouse
ggaaggccaacagggtagat

SEQ ID NO: 601295 - DNA, 20 bp, mouse
gtcgctgcacagctgaggga

SEQ ID NO: 601296 - DNA, 20 bp, mouse
ggcgctgaggcgggaaaaga

SEQ ID NO: 601297 - DNA, 20 bp, mouse
gccgcaccgcactcactccg

SEQ ID NO: 601298 - DNA, 20 bp, mouse
ggagcgccacggagtgagtg

SEQ ID NO: 601299 - DNA, 20 bp, mouse
gaagacggaatggagcgcca

SEQ ID NO: 601300 - DNA, 20 bp, mouse
gcctcccgccgcccgcacac

SEQ ID NO: 601301 - DNA, 20 bp, mouse
gtggtggacgaggctgtgag

SEQ ID NO: 601302 - DNA, 20 bp, mouse
ggcgcgctaacaccttcccg

SEQ ID NO: 601303 - DNA, 20 bp, mouse
gcctgactaacgagacggtg

SEQ ID NO: 601304 - DNA, 20 bp, mouse
ggagcgcagccagctctgag

SEQ ID NO: 601305 - DNA, 20 bp, mouse
ggctggtcgaagacagcaca

SEQ ID NO: 601306 - DNA, 20 bp, mouse
gcgctccacagcccacgcgg

SEQ ID NO: 601307 - DNA, 20 bp, mouse
gcgagcgcgggcccagccag

SEQ ID NO: 601308 - DNA, 20 bp, mouse
gcaccggcctcgctcacctc

SEQ ID NO: 601309 - DNA, 20 bp, mouse
gccttcctctgccaccgcgt

SEQ ID NO: 601310 - DNA, 20 bp, mouse
ggtccgctccacagcccacg

SEQ ID NO: 601311 - DNA, 20 bp, mouse
gagaggcagctgccatgtga

SEQ ID NO: 601312 - DNA, 20 bp, mouse
ggcccagccagaggtgagcg

SEQ ID NO: 601313 - DNA, 20 bp, mouse
gacagcccacgcggtggcag

SEQ ID NO: 601314 - DNA, 20 bp, mouse
gaggtgaaaggtgtcaaaag

SEQ ID NO: 601315 - DNA, 20 bp, mouse
gcaagaaccccctaaggtct

SEQ ID NO: 601316 - DNA, 20 bp, mouse
ggcaccagggacagccacca

SEQ ID NO: 601317 - DNA, 20 bp, mouse
gaccagcccgagggcagata

SEQ ID NO: 601318 - DNA, 20 bp, mouse
ggatagggcaggtcagtacc

SEQ ID NO: 601319 - DNA, 20 bp, mouse
gaggtgcacttatgacccat

SEQ ID NO: 601320 - DNA, 20 bp, mouse
gggcaccgggcaattgccat

SEQ ID NO: 601321 - DNA, 20 bp, mouse
gatgaaccatgagaggtctg

SEQ ID NO: 601322 - DNA, 20 bp, mouse
gtagagggcagagatggagt

SEQ ID NO: 601323 - DNA, 20 bp, mouse
gcagtgttagaccagcccga

SEQ ID NO: 601324 - DNA, 20 bp, mouse
gctgctgctggctttagccc

SEQ ID NO: 601325 - DNA, 20 bp, mouse
ggcctggaagagtaccgcaa

SEQ ID NO: 601326 - DNA, 20 bp, mouse
gttatgaagacgacatggaa

SEQ ID NO: 601327 - DNA, 20 bp, mouse
ggggccgcggagcctgacaa

SEQ ID NO: 601328 - DNA, 20 bp, mouse
gtggaagcccgagaactcgc

SEQ ID NO: 601329 - DNA, 20 bp, mouse
gcccagtcccgcgagttctc

SEQ ID NO: 601330 - DNA, 20 bp, mouse
gggcccagcccgaacctcga

SEQ ID NO: 601331 - DNA, 20 bp, mouse
gctcctttatgaagacgaca

SEQ ID NO: 601332 - DNA, 20 bp, mouse
gacctggacacgcgtgacag

SEQ ID NO: 601333 - DNA, 20 bp, mouse
gagtgagccaggtccctcag

SEQ ID NO: 601334 - DNA, 20 bp, mouse
gggacgctgggcccctctga

SEQ ID NO: 601335 - DNA, 20 bp, mouse
gctgggcctcaggcagtcgc

SEQ ID NO: 601336 - DNA, 20 bp, mouse
gcgcaagggccgtcgagtaa

SEQ ID NO: 601337 - DNA, 20 bp, mouse
gggtgtgctgcgctgtaggt

SEQ ID NO: 601338 - DNA, 20 bp, mouse
gaggaggcgccattactcga

SEQ ID NO: 601339 - DNA, 20 bp, mouse
gagcgcagcacaccgcaacc

SEQ ID NO: 601340 - DNA, 20 bp, mouse
gactcgacggcccttgcggg

SEQ ID NO: 601341 - DNA, 20 bp, mouse
gcaaccgcctccgcccgcaa

SEQ ID NO: 601342 - DNA, 20 bp, mouse
gtggctgcgcctggagtcgg

SEQ ID NO: 601343 - DNA, 20 bp, mouse
gtaggtggggcaggtcagcg

SEQ ID NO: 601344 - DNA, 20 bp, mouse
gcggcccttgcgggcggagg

SEQ ID NO: 601345 - DNA, 20 bp, mouse
gacaccgcgtgtcctcatca

SEQ ID NO: 601346 - DNA, 20 bp, mouse
gagagtgagccaccgggcca

SEQ ID NO: 601347 - DNA, 20 bp, mouse
gagaacagctcggctcctga

SEQ ID NO: 601348 - DNA, 20 bp, mouse
ggtgcgagctcagaacagct

SEQ ID NO: 601349 - DNA, 20 bp, mouse
gcacactcaccggcagagga

SEQ ID NO: 601350 - DNA, 20 bp, mouse
gctgtctcttgaccaaacaa

SEQ ID NO: 601351 - DNA, 20 bp, mouse
gacaaaggcgccctgggaag

SEQ ID NO: 601352 - DNA, 20 bp, mouse
gcgggcacactcaccggcag

SEQ ID NO: 601353 - DNA, 20 bp, mouse
ggaccaaacaaaggcgccct

SEQ ID NO: 601354 - DNA, 20 bp, mouse
gttctgagctcgcacccttg

SEQ ID NO: 601355 - DNA, 20 bp, mouse
ggcggatctatgaccatcgg

SEQ ID NO: 601356 - DNA, 20 bp, mouse
gccgctgaggtaaggagatg

SEQ ID NO: 601357 - DNA, 20 bp, mouse
gcaccggagccgctgaggta

SEQ ID NO: 601358 - DNA, 20 bp, mouse
gggggacagcgacagctcac

SEQ ID NO: 601359 - DNA, 20 bp, mouse
gcagatgcttcgagggtgtg

SEQ ID NO: 601360 - DNA, 20 bp, mouse
gccgaggcccaggcccacga

SEQ ID NO: 601361 - DNA, 20 bp, mouse
ggtttcctcagatgcttcga

SEQ ID NO: 601362 - DNA, 20 bp, mouse
gctccttacctcagcggctc

SEQ ID NO: 601363 - DNA, 20 bp, mouse
ggtgggctcgggcaattagg

SEQ ID NO: 601364 - DNA, 20 bp, mouse
gctgagggagttggagtcgt

SEQ ID NO: 601365 - DNA, 20 bp, mouse
gactgaggggagcggaggtc

SEQ ID NO: 601366 - DNA, 20 bp, mouse
ggtacgcagcgggacctagt

SEQ ID NO: 601367 - DNA, 20 bp, mouse
gcgaccccgcaggcgggaga

SEQ ID NO: 601368 - DNA, 20 bp, mouse
ggccggccgcggcccaagca

SEQ ID NO: 601369 - DNA, 20 bp, mouse
gtccccggtagggtacgcag

SEQ ID NO: 601370 - DNA, 20 bp, mouse
gcagcggctcggccatgctt

SEQ ID NO: 601371 - DNA, 20 bp, mouse
gttctcacgaccccgcaggc

SEQ ID NO: 601372 - DNA, 20 bp, mouse
gggccttgcaaggatccctg

SEQ ID NO: 601373 - DNA, 20 bp, mouse
gcgaaggggcgcccagagag

SEQ ID NO: 601374 - DNA, 20 bp, mouse
ggatccccaggtccccggta

SEQ ID NO: 601375 - DNA, 20 bp, mouse
ggcgagccctgatgcaagag

SEQ ID NO: 601376 - DNA, 20 bp, mouse
gctgcacgcggactccgtgg

SEQ ID NO: 601377 - DNA, 20 bp, mouse
gagtcccgcgcgggcggagg

SEQ ID NO: 601378 - DNA, 20 bp, mouse
ggtgaggagctggcgaggac

SEQ ID NO: 601379 - DNA, 20 bp, mouse
gcggcggctctccatgacca

SEQ ID NO: 601380 - DNA, 20 bp, mouse
gggccgagcgtcctccgcag

SEQ ID NO: 601381 - DNA, 20 bp, mouse
ggcaagcgcgcggcccagag

SEQ ID NO: 601382 - DNA, 20 bp, mouse
ggagctcgcgggccccggta

SEQ ID NO: 601383 - DNA, 20 bp, mouse
gtggcggcctcgctctccga

SEQ ID NO: 601384 - DNA, 20 bp, mouse
gcgaggaccggccgtggtca

SEQ ID NO: 601385 - DNA, 20 bp, mouse
gctgagggcggcgctcatgg

SEQ ID NO: 601386 - DNA, 20 bp, mouse
gaagttgtggtgagtatcac

SEQ ID NO: 601387 - DNA, 20 bp, mouse
gagagagaaggctgtaatgg

SEQ ID NO: 601388 - DNA, 20 bp, mouse
ggcggctgtgactgaagttg

SEQ ID NO: 601389 - DNA, 20 bp, mouse
gagtatcaccggcttcgcgt

SEQ ID NO: 601390 - DNA, 20 bp, mouse
ggtcagtccgggagacgccg

SEQ ID NO: 601391 - DNA, 20 bp, mouse
gttcgcgtaggtgtcagtcc

SEQ ID NO: 601392 - DNA, 20 bp, mouse
gacgccggggctgaggacat

SEQ ID NO: 601393 - DNA, 20 bp, mouse
gccagctcctcggccgccaa

SEQ ID NO: 601394 - DNA, 20 bp, mouse
gcggggctgaggacatgggt

SEQ ID NO: 601395 - DNA, 20 bp, mouse
ggccaggctggcagtagggc

SEQ ID NO: 601396 - DNA, 20 bp, mouse
ggctctctaatgcccaccca

SEQ ID NO: 601397 - DNA, 20 bp, mouse
ggatctgtagcaatcaataa

SEQ ID NO: 601398 - DNA, 20 bp, mouse
gcatgatgtagcccagggga

SEQ ID NO: 601399 - DNA, 20 bp, mouse
gttaagtggtgtctgtaact

SEQ ID NO: 601400 - DNA, 20 bp, mouse
ggactggcagtcttgaaaat

SEQ ID NO: 601401 - DNA, 20 bp, mouse
gtcccgggcaccaggcagca

SEQ ID NO: 601402 - DNA, 20 bp, mouse
gggccaggaaagcacatact

SEQ ID NO: 601403 - DNA, 20 bp, mouse
gctggagtcacagaaggcct

SEQ ID NO: 601404 - DNA, 20 bp, mouse
ggatacagctgtgaagtctc

SEQ ID NO: 601405 - DNA, 20 bp, mouse
gtcatggctctctgcaccat

SEQ ID NO: 601406 - DNA, 20 bp, mouse
ggcggcggcggagaaacagg

SEQ ID NO: 601407 - DNA, 20 bp, mouse
gcgggcggacgggagaactg

SEQ ID NO: 601408 - DNA, 20 bp, mouse
gacgggagaactggggaccc

SEQ ID NO: 601409 - DNA, 20 bp, mouse
gggacccgggtgtgccaggc

SEQ ID NO: 601410 - DNA, 20 bp, mouse
gggcggagtggctcctacct

SEQ ID NO: 601411 - DNA, 20 bp, mouse
ggccgccttctcctccagcc

SEQ ID NO: 601412 - DNA, 20 bp, mouse
gctggggacccgggtgtgcc

SEQ ID NO: 601413 - DNA, 20 bp, mouse
gtcctccagcctggcacacc

SEQ ID NO: 601414 - DNA, 20 bp, mouse
gggactctgcagcaactcac

SEQ ID NO: 601415 - DNA, 20 bp, mouse
gagcggccagccgggcggac

SEQ ID NO: 601416 - DNA, 20 bp, mouse
gcgcctgcgccgtgtcacgg

SEQ ID NO: 601417 - DNA, 20 bp, mouse
gcagcgcctgcgccgtgtca

SEQ ID NO: 601418 - DNA, 20 bp, mouse
gcacggcggcgggcggaaga

SEQ ID NO: 601419 - DNA, 20 bp, mouse
ggcggagaggcgctgctgag

SEQ ID NO: 601420 - DNA, 20 bp, mouse
ggcagtgtgggaagaagcgg

SEQ ID NO: 601421 - DNA, 20 bp, mouse
gcgcaggcgctgcactagta

SEQ ID NO: 601422 - DNA, 20 bp, mouse
gtccgcccgccgccgtgaca

SEQ ID NO: 601423 - DNA, 20 bp, mouse
gagccaaagaaggcaaggat

SEQ ID NO: 601424 - DNA, 20 bp, mouse
ggccgtgtcacggcggcggg

SEQ ID NO: 601425 - DNA, 20 bp, mouse
ggggacagaggccggagtcg

SEQ ID NO: 601426 - DNA, 20 bp, mouse
ggaggggctcaggagcacgg

SEQ ID NO: 601427 - DNA, 20 bp, mouse
gagtctgcagcgggcagcag

SEQ ID NO: 601428 - DNA, 20 bp, mouse
ggtggggcaggggatccaag

SEQ ID NO: 601429 - DNA, 20 bp, mouse
gcgcgaggggctcaggagca

SEQ ID NO: 601430 - DNA, 20 bp, mouse
gcaaggggcagtgggtctgt

SEQ ID NO: 601431 - DNA, 20 bp, mouse
gcccgaggacccaggactag

SEQ ID NO: 601432 - DNA, 20 bp, mouse
gggagcacggcggtgctctc

SEQ ID NO: 601433 - DNA, 20 bp, mouse
gacctgctcgctgaaggtgg

SEQ ID NO: 601434 - DNA, 20 bp, mouse
gctctcggcagaggctgtcg

SEQ ID NO: 601435 - DNA, 20 bp, mouse
gccgcgggggcggagcgcga

SEQ ID NO: 601436 - DNA, 20 bp, mouse
gccccagacccagagcgccg

SEQ ID NO: 601437 - DNA, 20 bp, mouse
gggcgcggggacaccgaagg

SEQ ID NO: 601438 - DNA, 20 bp, mouse
gtgctgggctcccggagacg

SEQ ID NO: 601439 - DNA, 20 bp, mouse
gccaagcggcgcggggagga

SEQ ID NO: 601440 - DNA, 20 bp, mouse
gggagcgagcctgttagcga

SEQ ID NO: 601441 - DNA, 20 bp, mouse
gttagcgagggagcagtggg

SEQ ID NO: 601442 - DNA, 20 bp, mouse
ggaaggtggtccgcgtctcc

SEQ ID NO: 601443 - DNA, 20 bp, mouse
gcagacagccgcggcgctct

SEQ ID NO: 601444 - DNA, 20 bp, mouse
gctgttagcgagggagcagt

SEQ ID NO: 601445 - DNA, 20 bp, mouse
ggccgcggcgctctgggtct

SEQ ID NO: 601446 - DNA, 20 bp, mouse
ggccagtccgaggtacacac

SEQ ID NO: 601447 - DNA, 20 bp, mouse
ggcccgtgtgtacctcggac

SEQ ID NO: 601448 - DNA, 20 bp, mouse
gccgccaattacaggatctg

SEQ ID NO: 601449 - DNA, 20 bp, mouse
gaattggcggcgccagtccg

SEQ ID NO: 601450 - DNA, 20 bp, mouse
gcggtggcccgtgtgtacct

SEQ ID NO: 601451 - DNA, 20 bp, mouse
gggcgctcacgtactgtgca

SEQ ID NO: 601452 - DNA, 20 bp, mouse
ggactggcgccgccaattac

SEQ ID NO: 601453 - DNA, 20 bp, mouse
gctcccgcagatcctgtaat

SEQ ID NO: 601454 - DNA, 20 bp, mouse
gttaccgacagtgccagcta

SEQ ID NO: 601455 - DNA, 20 bp, mouse
ggtacgtgagcgcctcctct

SEQ ID NO: 601456 - DNA, 20 bp, mouse
ggctgtcctgagagttccaa

SEQ ID NO: 601457 - DNA, 20 bp, mouse
gcgagtaggcagaggaacaa

SEQ ID NO: 601458 - DNA, 20 bp, mouse
gggcatccagctgtccgagt

SEQ ID NO: 601459 - DNA, 20 bp, mouse
ggctcttcaggagtggccca

SEQ ID NO: 601460 - DNA, 20 bp, mouse
gcaggagtggcccacggcag

SEQ ID NO: 601461 - DNA, 20 bp, mouse
gcagctgtccgagtaggcag

SEQ ID NO: 601462 - DNA, 20 bp, mouse
gtcgctcagtccaggagtga

SEQ ID NO: 601463 - DNA, 20 bp, mouse
gaaaacccaaggacgaacca

SEQ ID NO: 601464 - DNA, 20 bp, mouse
gggaagagttagcctcctgg

SEQ ID NO: 601465 - DNA, 20 bp, mouse
gagccatgccagccccacta

SEQ ID NO: 601466 - DNA, 20 bp, mouse
gagcagtgctctgggaagtg

SEQ ID NO: 601467 - DNA, 20 bp, mouse
gaaattgtggcaccagaatt

SEQ ID NO: 601468 - DNA, 20 bp, mouse
gaattaggaatttggaactg

SEQ ID NO: 601469 - DNA, 20 bp, mouse
ggcacaggccagatagccaa

SEQ ID NO: 601470 - DNA, 20 bp, mouse
gggactggaagtatgcaggg

SEQ ID NO: 601471 - DNA, 20 bp, mouse
gagaggactggaagtatgca

SEQ ID NO: 601472 - DNA, 20 bp, mouse
gtctctctcttaccaaattg

SEQ ID NO: 601473 - DNA, 20 bp, mouse
gcgaattagcatgaaaatga

SEQ ID NO: 601474 - DNA, 20 bp, mouse
gagaactcattgctcttctc

SEQ ID NO: 601475 - DNA, 20 bp, mouse
gtgagcagactccagaggac

SEQ ID NO: 601476 - DNA, 20 bp, mouse
ggtgcggcgggcgccggcac

SEQ ID NO: 601477 - DNA, 20 bp, mouse
ggcaccggcacaatcgccga

SEQ ID NO: 601478 - DNA, 20 bp, mouse
gtgcagcggacaccagatcc

SEQ ID NO: 601479 - DNA, 20 bp, mouse
gctcgaggtaggatcctcta

SEQ ID NO: 601480 - DNA, 20 bp, mouse
gacgccgtcggcgattgtgc

SEQ ID NO: 601481 - DNA, 20 bp, mouse
gcgccgcccagtaggacagg

SEQ ID NO: 601482 - DNA, 20 bp, mouse
gagcggacaccagatcccgg

SEQ ID NO: 601483 - DNA, 20 bp, mouse
gtagtggtcatgcccgggtg

SEQ ID NO: 601484 - DNA, 20 bp, mouse
gctggcagtgcggcgggcgc

SEQ ID NO: 601485 - DNA, 20 bp, mouse
gtccgccccgtgccacaccc

SEQ ID NO: 601486 - DNA, 20 bp, mouse
gagcgactcggcagggactg

SEQ ID NO: 601487 - DNA, 20 bp, mouse
gagaaggaggagctgtcgga

SEQ ID NO: 601488 - DNA, 20 bp, mouse
ggagaaagagcgactcggca

SEQ ID NO: 601489 - DNA, 20 bp, mouse
gtgcgtcgtcacgtcagcgc

SEQ ID NO: 601490 - DNA, 20 bp, mouse
gctcgcgggcgcgcgtcccg

SEQ ID NO: 601491 - DNA, 20 bp, mouse
gcagggcggctagcggccgg

SEQ ID NO: 601492 - DNA, 20 bp, mouse
ggacgacgcagacgacgccg

SEQ ID NO: 601493 - DNA, 20 bp, mouse
gttacctccccgcggggctg

SEQ ID NO: 601494 - DNA, 20 bp, mouse
gcggccccagccccgcgggg

SEQ ID NO: 601495 - DNA, 20 bp, mouse
gcgcggtcgttacctccccg

SEQ ID NO: 601496 - DNA, 20 bp, mouse
ggagagccgggaagcgtgag

SEQ ID NO: 601497 - DNA, 20 bp, mouse
gcctccgggacaaggtgacc

SEQ ID NO: 601498 - DNA, 20 bp, mouse
ggtgctcgggacttacctcc

SEQ ID NO: 601499 - DNA, 20 bp, mouse
ggccacgagcccagaagcag

SEQ ID NO: 601500 - DNA, 20 bp, mouse
gggccgcggtaagtcctgaa

SEQ ID NO: 601501 - DNA, 20 bp, mouse
gcagccgggtcaccttgtcc

SEQ ID NO: 601502 - DNA, 20 bp, mouse
gaagtcctgaagggtcgcag

SEQ ID NO: 601503 - DNA, 20 bp, mouse
gcagcgcgcagaccaggcgg

SEQ ID NO: 601504 - DNA, 20 bp, mouse
gcccggctctcgagacgcgc

SEQ ID NO: 601505 - DNA, 20 bp, mouse
gtcgcagcgcgcagaccagg

SEQ ID NO: 601506 - DNA, 20 bp, mouse
gaagggagcacggaggcgag

SEQ ID NO: 601507 - DNA, 20 bp, mouse
gctctcagcccggcccgagg

SEQ ID NO: 601508 - DNA, 20 bp, mouse
gggagtgcgaggacctgtag

SEQ ID NO: 601509 - DNA, 20 bp, mouse
gtgggtccggagtgcctggt

SEQ ID NO: 601510 - DNA, 20 bp, mouse
gggcatgggccggcgagcaa

SEQ ID NO: 601511 - DNA, 20 bp, mouse
gcctcgccgctcccccaagt

SEQ ID NO: 601512 - DNA, 20 bp, mouse
ggtccgcagagcgacaggta

SEQ ID NO: 601513 - DNA, 20 bp, mouse
gcacggttctgaagcagcgg

SEQ ID NO: 601514 - DNA, 20 bp, mouse
gctaggcaccgagagagctg

SEQ ID NO: 601515 - DNA, 20 bp, mouse
ggggctcccgggaccgtgta

SEQ ID NO: 601516 - DNA, 20 bp, mouse
gctgccgcgcacagccggag

SEQ ID NO: 601517 - DNA, 20 bp, mouse
gagaccgggctactaagcca

SEQ ID NO: 601518 - DNA, 20 bp, mouse
gaaggatctgtccctcctcc

SEQ ID NO: 601519 - DNA, 20 bp, mouse
ggcggacagcgccggagacc

SEQ ID NO: 601520 - DNA, 20 bp, mouse
gggatcaaggtaaatagcag

SEQ ID NO: 601521 - DNA, 20 bp, mouse
gcgcgaaccacagggagagg

SEQ ID NO: 601522 - DNA, 20 bp, mouse
gctgctgctcctgccgccag

SEQ ID NO: 601523 - DNA, 20 bp, mouse
ggctagcgaacgcctcttcc

SEQ ID NO: 601524 - DNA, 20 bp, mouse
gctgctcctgccgccagcgg

SEQ ID NO: 601525 - DNA, 20 bp, mouse
ggcggcacgcagccgggaag

SEQ ID NO: 601526 - DNA, 20 bp, mouse
gggccgcacggaagagcgag

SEQ ID NO: 601527 - DNA, 20 bp, mouse
ggagcgggagagcgatcgag

SEQ ID NO: 601528 - DNA, 20 bp, mouse
gtgtagcctccagtccagag

SEQ ID NO: 601529 - DNA, 20 bp, mouse
gtcccgctcgctcttccgtg

SEQ ID NO: 601530 - DNA, 20 bp, mouse
gctcccggccgggcagacaa

SEQ ID NO: 601531 - DNA, 20 bp, mouse
gcgatcgaggggcgccatcg

SEQ ID NO: 601532 - DNA, 20 bp, mouse
gccgcaagccttcggccgca

SEQ ID NO: 601533 - DNA, 20 bp, mouse
gtagggcgcggagccccccg

SEQ ID NO: 601534 - DNA, 20 bp, mouse
gtcgaggcagcgaggcgagg

SEQ ID NO: 601535 - DNA, 20 bp, mouse
gggcatccagagactcccgt

SEQ ID NO: 601536 - DNA, 20 bp, mouse
gtggagccacgcctagctgt

SEQ ID NO: 601537 - DNA, 20 bp, mouse
gtgaagatacgccctcagtc

SEQ ID NO: 601538 - DNA, 20 bp, mouse
gggggtcccacagctaggcg

SEQ ID NO: 601539 - DNA, 20 bp, mouse
gtaggctggagtctctaaat

SEQ ID NO: 601540 - DNA, 20 bp, mouse
gggaggaccagcattgttga

SEQ ID NO: 601541 - DNA, 20 bp, mouse
ggttgaggggtcccacagct

SEQ ID NO: 601542 - DNA, 20 bp, mouse
gggtgctgtgaagcgaacac

SEQ ID NO: 601543 - DNA, 20 bp, mouse
gaacactggagataaatctc

SEQ ID NO: 601544 - DNA, 20 bp, mouse
gtgggacccctcaacaatgc

SEQ ID NO: 601545 - DNA, 20 bp, mouse
gctggtcctccaagactgcc

SEQ ID NO: 601546 - DNA, 20 bp, mouse
gtaagtccgaggctactgag

SEQ ID NO: 601547 - DNA, 20 bp, mouse
gagtcctgctgagaaagcat

SEQ ID NO: 601548 - DNA, 20 bp, mouse
gaggctactgaggggcccag

SEQ ID NO: 601549 - DNA, 20 bp, mouse
gtctggactgtctaagaaag

SEQ ID NO: 601550 - DNA, 20 bp, mouse
ggactcacagcctaagtccg

SEQ ID NO: 601551 - DNA, 20 bp, mouse
gaggaagagacaagcaggtg

SEQ ID NO: 601552 - DNA, 20 bp, mouse
gctgccaggggacaattcac

SEQ ID NO: 601553 - DNA, 20 bp, mouse
gaccatctgccctgcacctg

SEQ ID NO: 601554 - DNA, 20 bp, mouse
gagtggttccgaaggaggga

SEQ ID NO: 601555 - DNA, 20 bp, mouse
gcgtgcacttggggatcgtc

SEQ ID NO: 601556 - DNA, 20 bp, mouse
gaccaccgtacctctgaagg

SEQ ID NO: 601557 - DNA, 20 bp, mouse
gtcgagcctccatccatcgg

SEQ ID NO: 601558 - DNA, 20 bp, mouse
gatgctcccccgatggatgg

SEQ ID NO: 601559 - DNA, 20 bp, mouse
gtgtcctatgcccccttcag

SEQ ID NO: 601560 - DNA, 20 bp, mouse
ggtgggaaaggagggattag

SEQ ID NO: 601561 - DNA, 20 bp, mouse
gcagaggtacggtggtggta

SEQ ID NO: 601562 - DNA, 20 bp, mouse
ggagggccggggccaccgag

SEQ ID NO: 601563 - DNA, 20 bp, mouse
ggcccccttcagaggtacgg

SEQ ID NO: 601564 - DNA, 20 bp, mouse
gaggcagaggtgggaacagt

SEQ ID NO: 601565 - DNA, 20 bp, mouse
gaaggagcggctgaaatgga

SEQ ID NO: 601566 - DNA, 20 bp, mouse
ggtgcagccacgatggaagg

SEQ ID NO: 601567 - DNA, 20 bp, mouse
gtacgcacccccttccatcg

SEQ ID NO: 601568 - DNA, 20 bp, mouse
gctgcctcaccagggtgtag

SEQ ID NO: 601569 - DNA, 20 bp, mouse
ggcggtgcagccacgatgga

SEQ ID NO: 601570 - DNA, 20 bp, mouse
gggcggcgcgcgccgagcgg

SEQ ID NO: 601571 - DNA, 20 bp, mouse
ggccgcgcacgcgcacgggt

SEQ ID NO: 601572 - DNA, 20 bp, mouse
ggcgcacgcgcacgggtcgg

SEQ ID NO: 601573 - DNA, 20 bp, mouse
gaccagggtgtaggggtcga

SEQ ID NO: 601574 - DNA, 20 bp, mouse
gtaggggtcgaaggcgcccc

SEQ ID NO: 601575 - DNA, 20 bp, mouse
ggaagggggtgcgtacggag

SEQ ID NO: 601576 - DNA, 20 bp, mouse
gcctatggcgcggccaacgc

SEQ ID NO: 601577 - DNA, 20 bp, mouse
gtcgaaggagccgcccgcgt

SEQ ID NO: 601578 - DNA, 20 bp, mouse
gctcggtggcgaaagcgaca

SEQ ID NO: 601579 - DNA, 20 bp, mouse
gcgcagagcgcgacaggtgg

SEQ ID NO: 601580 - DNA, 20 bp, mouse
gcgaggcgcgtcaccacctg

SEQ ID NO: 601581 - DNA, 20 bp, mouse
ggcgaaagcgacatggagag

SEQ ID NO: 601582 - DNA, 20 bp, mouse
gacatggagagcggggccta

SEQ ID NO: 601583 - DNA, 20 bp, mouse
gaggggacagagacgcggag

SEQ ID NO: 601584 - DNA, 20 bp, mouse
gaggaagcgccgcaggtcga

SEQ ID NO: 601585 - DNA, 20 bp, mouse
gatggcgcggccaacgcggg

SEQ ID NO: 601586 - DNA, 20 bp, mouse
gccgcccggggatgaagctg

SEQ ID NO: 601587 - DNA, 20 bp, mouse
gtccccgccggagaccgccc

SEQ ID NO: 601588 - DNA, 20 bp, mouse
ggccgacgcgcgctcccggg

SEQ ID NO: 601589 - DNA, 20 bp, mouse
gccccgggcggtctccggcg

SEQ ID NO: 601590 - DNA, 20 bp, mouse
ggggatgctaagagaggcgg

SEQ ID NO: 601591 - DNA, 20 bp, mouse
gggaaggccggtgggacaaa

SEQ ID NO: 601592 - DNA, 20 bp, mouse
gtcccaccggccttccccgc

SEQ ID NO: 601593 - DNA, 20 bp, mouse
gcaggacacgacccgcaaca

SEQ ID NO: 601594 - DNA, 20 bp, mouse
gggtctccggcggggaaggc

SEQ ID NO: 601595 - DNA, 20 bp, mouse
gttcatccccgggcggtctc

SEQ ID NO: 601596 - DNA, 20 bp, mouse
gtggctcccgggaccaggag

SEQ ID NO: 601597 - DNA, 20 bp, mouse
gtcctcggccctcggagaag

SEQ ID NO: 601598 - DNA, 20 bp, mouse
gtcggccctcggagaagagg

SEQ ID NO: 601599 - DNA, 20 bp, mouse
gggaagtgctgagaccccaa

SEQ ID NO: 601600 - DNA, 20 bp, mouse
ggaagaggaacgcaggtcct

SEQ ID NO: 601601 - DNA, 20 bp, mouse
gagaaccacctcttctccga

SEQ ID NO: 601602 - DNA, 20 bp, mouse
gagaggtggctcccgggacc

SEQ ID NO: 601603 - DNA, 20 bp, mouse
gcgtaacaccaggcttgctt

SEQ ID NO: 601604 - DNA, 20 bp, mouse
gcgcccccaggtccttagaa

SEQ ID NO: 601605 - DNA, 20 bp, mouse
gaagggaagcccctagtcta

SEQ ID NO: 601606 - DNA, 20 bp, mouse
gcggcccgggctctacccag

SEQ ID NO: 601607 - DNA, 20 bp, mouse
gcgggtggacgcttcctgag

SEQ ID NO: 601608 - DNA, 20 bp, mouse
ggtggacgcttcctgagcgg

SEQ ID NO: 601609 - DNA, 20 bp, mouse
gggtcgcaagcggtgagagg

SEQ ID NO: 601610 - DNA, 20 bp, mouse
ggtcgcagccgggtcgcaag

SEQ ID NO: 601611 - DNA, 20 bp, mouse
ggggcgggaaaggaccccgt

SEQ ID NO: 601612 - DNA, 20 bp, mouse
gctgcccctgggtagagccc

SEQ ID NO: 601613 - DNA, 20 bp, mouse
gccgggtcgcaagcggtgag

SEQ ID NO: 601614 - DNA, 20 bp, mouse
ggacgcttcctgagcggtgg

SEQ ID NO: 601615 - DNA, 20 bp, mouse
ggcgacggccgccaccgctc

SEQ ID NO: 601616 - DNA, 20 bp, mouse
gctggtagccgcacaccctc

SEQ ID NO: 601617 - DNA, 20 bp, mouse
gcggggagcagaggagagcg

SEQ ID NO: 601618 - DNA, 20 bp, mouse
ggtagccgcacaccctcggg

SEQ ID NO: 601619 - DNA, 20 bp, mouse
gggtcccgcccgagggtgtg

SEQ ID NO: 601620 - DNA, 20 bp, mouse
gcggcacaaagtgaaactcc

SEQ ID NO: 601621 - DNA, 20 bp, mouse
ggggaccaggtcccgcccga

SEQ ID NO: 601622 - DNA, 20 bp, mouse
gcgcccatggctctaagcaa

SEQ ID NO: 601623 - DNA, 20 bp, mouse
gggagggcgggaattagtga

SEQ ID NO: 601624 - DNA, 20 bp, mouse
ggccctttgcttagagccat

SEQ ID NO: 601625 - DNA, 20 bp, mouse
gcgcggagacctgagaacta

SEQ ID NO: 601626 - DNA, 20 bp, mouse
gctctccggccggaaacccc

SEQ ID NO: 601627 - DNA, 20 bp, mouse
gcccggctccgccaaagcaa

SEQ ID NO: 601628 - DNA, 20 bp, mouse
gctggccacccgctgacccg

SEQ ID NO: 601629 - DNA, 20 bp, mouse
ggacgagaggaccttcgggt

SEQ ID NO: 601630 - DNA, 20 bp, mouse
ggaaaccccgggtcagcggg

SEQ ID NO: 601631 - DNA, 20 bp, mouse
gcaggcaggccccgaccgag

SEQ ID NO: 601632 - DNA, 20 bp, mouse
gcacggagcaaagagtccat

SEQ ID NO: 601633 - DNA, 20 bp, mouse
ggaccggaaaaggaaaccgc

SEQ ID NO: 601634 - DNA, 20 bp, mouse
gggcttcccagaacgctatc

SEQ ID NO: 601635 - DNA, 20 bp, mouse
ggtttcctcagcggtcagac

SEQ ID NO: 601636 - DNA, 20 bp, mouse
ggccagtccaagggcctccg

SEQ ID NO: 601637 - DNA, 20 bp, mouse
gagtcggtgcgccagtccaa

SEQ ID NO: 601638 - DNA, 20 bp, mouse
ggcctcggaggcccttggac

SEQ ID NO: 601639 - DNA, 20 bp, mouse
gccaagggcctccgaggcag

SEQ ID NO: 601640 - DNA, 20 bp, mouse
gcgccgcgccgctgcctcgg

SEQ ID NO: 601641 - DNA, 20 bp, mouse
ggcgaccgggccactaagtg

SEQ ID NO: 601642 - DNA, 20 bp, mouse
ggggcggaggggacaagatc

SEQ ID NO: 601643 - DNA, 20 bp, mouse
gcgcgagaacctgctactgg

SEQ ID NO: 601644 - DNA, 20 bp, mouse
ggagcgcgagaacctgctac

SEQ ID NO: 601645 - DNA, 20 bp, mouse
ggagaacctgctactggagg

SEQ ID NO: 601646 - DNA, 20 bp, mouse
ggccaggtgagccaaggcgg

SEQ ID NO: 601647 - DNA, 20 bp, mouse
ggacgtagccaggtgagcca

SEQ ID NO: 601648 - DNA, 20 bp, mouse
ggaccgcgcacggctgctgg

SEQ ID NO: 601649 - DNA, 20 bp, mouse
ggcgcggtccccgagctccc

SEQ ID NO: 601650 - DNA, 20 bp, mouse
gacggctgctggaggtgagt

SEQ ID NO: 601651 - DNA, 20 bp, mouse
ggcagctgcgcaggtggcaa

SEQ ID NO: 601652 - DNA, 20 bp, mouse
gtggcaagggcgaggctcac

SEQ ID NO: 601653 - DNA, 20 bp, mouse
gagcacccaggctcactcat

SEQ ID NO: 601654 - DNA, 20 bp, mouse
gccagaggggcttagagcta

SEQ ID NO: 601655 - DNA, 20 bp, mouse
gaaggtggtaccccggaaca

SEQ ID NO: 601656 - DNA, 20 bp, mouse
gtatgcccggcctctgtcca

SEQ ID NO: 601657 - DNA, 20 bp, mouse
gagcaggctgccgtggacag

SEQ ID NO: 601658 - DNA, 20 bp, mouse
gtgctagagacagcagagag

SEQ ID NO: 601659 - DNA, 20 bp, mouse
ggactctgcacacaccggag

SEQ ID NO: 601660 - DNA, 20 bp, mouse
gctagcaggctgaacgggat

SEQ ID NO: 601661 - DNA, 20 bp, mouse
gcacacaccggagaggaagt

SEQ ID NO: 601662 - DNA, 20 bp, mouse
gagtgggcagcaggctgccg

SEQ ID NO: 601663 - DNA, 20 bp, mouse
gagaggaagtcggctatgcc

SEQ ID NO: 601664 - DNA, 20 bp, mouse
gctgtctctagcaggctgaa

SEQ ID NO: 601665 - DNA, 20 bp, mouse
gtggcgtgcggtatgctcca

SEQ ID NO: 601666 - DNA, 20 bp, mouse
gggaagccgcggtgcaggag

SEQ ID NO: 601667 - DNA, 20 bp, mouse
gctttccccgcagccggcag

SEQ ID NO: 601668 - DNA, 20 bp, mouse
ggcgtcttaagctgggctgg

SEQ ID NO: 601669 - DNA, 20 bp, mouse
ggacgcgtcttaagctgggc

SEQ ID NO: 601670 - DNA, 20 bp, mouse
ggagaggacgcgtcttaagc

SEQ ID NO: 601671 - DNA, 20 bp, mouse
gcaagagcttgagaaagcca

SEQ ID NO: 601672 - DNA, 20 bp, mouse
gcctgcaccgcggcttcccc

SEQ ID NO: 601673 - DNA, 20 bp, mouse
ggaggaccgagagaggctgt

SEQ ID NO: 601674 - DNA, 20 bp, mouse
gctgcggggaaagtgcgcgg

SEQ ID NO: 601675 - DNA, 20 bp, mouse
gtgactggaggggcgccctg

SEQ ID NO: 601676 - DNA, 20 bp, mouse
gtggccgaggggctcttgga

SEQ ID NO: 601677 - DNA, 20 bp, mouse
gccgaggggctcttggatgg

SEQ ID NO: 601678 - DNA, 20 bp, mouse
gatggcaaaacagagagtac

SEQ ID NO: 601679 - DNA, 20 bp, mouse
gggcttggccgaggggctct

SEQ ID NO: 601680 - DNA, 20 bp, mouse
gtcacagctggcttggccga

SEQ ID NO: 601681 - DNA, 20 bp, mouse
gggtagtacctgcatagaac

SEQ ID NO: 601682 - DNA, 20 bp, mouse
gcactctctcgagtgggata

SEQ ID NO: 601683 - DNA, 20 bp, mouse
gtgtcacagcagtgggagaa

SEQ ID NO: 601684 - DNA, 20 bp, mouse
gtcctgaaagaacaagggga

SEQ ID NO: 601685 - DNA, 20 bp, mouse
gccagcttgagctaccccca

SEQ ID NO: 601686 - DNA, 20 bp, mouse
gaggagcaggacagccggac

SEQ ID NO: 601687 - DNA, 20 bp, mouse
gcggacaggcaggctggacg

SEQ ID NO: 601688 - DNA, 20 bp, mouse
ggttgggagtaggcctgggt

SEQ ID NO: 601689 - DNA, 20 bp, mouse
gcatgctcaagggtataggg

SEQ ID NO: 601690 - DNA, 20 bp, mouse
ggcaggacagccggacaggc

SEQ ID NO: 601691 - DNA, 20 bp, mouse
ggacactgtccaaactccgg

SEQ ID NO: 601692 - DNA, 20 bp, mouse
ggactctcccaacttccctt

SEQ ID NO: 601693 - DNA, 20 bp, mouse
gggcctgggttggcaggagc

SEQ ID NO: 601694 - DNA, 20 bp, mouse
ggagagagaagttgaggtgc

SEQ ID NO: 601695 - DNA, 20 bp, mouse
ggcctgtggcccccggagtt

SEQ ID NO: 601696 - DNA, 20 bp, mouse
ggcggctcacccgggacccg

SEQ ID NO: 601697 - DNA, 20 bp, mouse
gcccgggacccggggtgagt

SEQ ID NO: 601698 - DNA, 20 bp, mouse
ggcgagctggaacctacagc

SEQ ID NO: 601699 - DNA, 20 bp, mouse
gagtggggagcgccggctgt

SEQ ID NO: 601700 - DNA, 20 bp, mouse
gggtggtgagcggctcaccc

SEQ ID NO: 601701 - DNA, 20 bp, mouse
gtgcccgcagaggccaccta

SEQ ID NO: 601702 - DNA, 20 bp, mouse
ggggttgctggcctaggatt

SEQ ID NO: 601703 - DNA, 20 bp, mouse
gctctgacctacgctcccca

SEQ ID NO: 601704 - DNA, 20 bp, mouse
ggagttggtgagtagctggg

SEQ ID NO: 601705 - DNA, 20 bp, mouse
gttctgaccctggggagcgt

SEQ ID NO: 601706 - DNA, 20 bp, mouse
ggcggcggccccgagcaaga

SEQ ID NO: 601707 - DNA, 20 bp, mouse
gcccgagcaagatggcgctg

SEQ ID NO: 601708 - DNA, 20 bp, mouse
ggcagctgtcagccgaagac

SEQ ID NO: 601709 - DNA, 20 bp, mouse
gctgacagctgctggcgcgg

SEQ ID NO: 601710 - DNA, 20 bp, mouse
ggccggagccagcggcgcgg

SEQ ID NO: 601711 - DNA, 20 bp, mouse
gcaagcctagcagggactcg

SEQ ID NO: 601712 - DNA, 20 bp, mouse
gcggctgacagctgctggcg

SEQ ID NO: 601713 - DNA, 20 bp, mouse
gggacaggacgctctatgag

SEQ ID NO: 601714 - DNA, 20 bp, mouse
ggccgcagcgccatcttgct

SEQ ID NO: 601715 - DNA, 20 bp, mouse
gacagctgctggcgcggcgg

SEQ ID NO: 601716 - DNA, 20 bp, mouse
gctgctggcagacatggacg

SEQ ID NO: 601717 - DNA, 20 bp, mouse
ggacatggacgtggtgaatc

SEQ ID NO: 601718 - DNA, 20 bp, mouse
gcatctggaggccccctctg

SEQ ID NO: 601719 - DNA, 20 bp, mouse
gggtacgcgctccagcaccg

SEQ ID NO: 601720 - DNA, 20 bp, mouse
ggcgcttgcagaaatctggg

SEQ ID NO: 601721 - DNA, 20 bp, mouse
gggaaggtgcctggtagcaa

SEQ ID NO: 601722 - DNA, 20 bp, mouse
ggcagcatcagcaatgcggg

SEQ ID NO: 601723 - DNA, 20 bp, mouse
gccggcgcttgcagaaatct

SEQ ID NO: 601724 - DNA, 20 bp, mouse
ggccctcgaaccctgagagg

SEQ ID NO: 601725 - DNA, 20 bp, mouse
gaccacctctcagggttcga

SEQ ID NO: 601726 - DNA, 20 bp, mouse
gagagagtcaggacgcgggg

SEQ ID NO: 601727 - DNA, 20 bp, mouse
gggaagagagtcaggacgcg

SEQ ID NO: 601728 - DNA, 20 bp, mouse
gcgggagaagccgcccacac

SEQ ID NO: 601729 - DNA, 20 bp, mouse
ggccgagcggctccttgagc

SEQ ID NO: 601730 - DNA, 20 bp, mouse
gggatcttgatgaagccgag

SEQ ID NO: 601731 - DNA, 20 bp, mouse
gacgcctccgcggctagggg

SEQ ID NO: 601732 - DNA, 20 bp, mouse
gaggaggggagcggcgagac

SEQ ID NO: 601733 - DNA, 20 bp, mouse
gcgagtcgagtcgccggtgt

SEQ ID NO: 601734 - DNA, 20 bp, mouse
gtctcgccgcggagtcgctc

SEQ ID NO: 601735 - DNA, 20 bp, mouse
ggctccactgccatccgcaa

SEQ ID NO: 601736 - DNA, 20 bp, mouse
gctgctgctcgcgctctcgg

SEQ ID NO: 601737 - DNA, 20 bp, mouse
gaagtttgaatcggactcgg

SEQ ID NO: 601738 - DNA, 20 bp, mouse
ggcgtcggggcgcagtgcaa

SEQ ID NO: 601739 - DNA, 20 bp, mouse
gggagcaggcggtccacctg

SEQ ID NO: 601740 - DNA, 20 bp, mouse
gtggcgcggagacttgtccg

SEQ ID NO: 601741 - DNA, 20 bp, mouse
gcgcgccagcatgtcctcga

SEQ ID NO: 601742 - DNA, 20 bp, mouse
gcggagacttgtccgaggtg

SEQ ID NO: 601743 - DNA, 20 bp, mouse
gtgtcctcgacggagagccc

SEQ ID NO: 601744 - DNA, 20 bp, mouse
gcggcccggagggaaagcgt

SEQ ID NO: 601745 - DNA, 20 bp, mouse
gtccacaggccgggtactcg

SEQ ID NO: 601746 - DNA, 20 bp, mouse
gaggacccgccggcctagag

SEQ ID NO: 601747 - DNA, 20 bp, mouse
gagacaggaccatggagcgg

SEQ ID NO: 601748 - DNA, 20 bp, mouse
gcatggagcggaggacccgc

SEQ ID NO: 601749 - DNA, 20 bp, mouse
gtagagaggccgaatagctg

SEQ ID NO: 601750 - DNA, 20 bp, mouse
gtcggagcgcgaccggacct

SEQ ID NO: 601751 - DNA, 20 bp, mouse
ggccgtgggccgcagctatt

SEQ ID NO: 601752 - DNA, 20 bp, mouse
gtgacacagcgctgacagac

SEQ ID NO: 601753 - DNA, 20 bp, mouse
gtccggggacggcaaccgag

SEQ ID NO: 601754 - DNA, 20 bp, mouse
gctgcggcccacggcttcct

SEQ ID NO: 601755 - DNA, 20 bp, mouse
gatacctgcgggaagacaca

SEQ ID NO: 601756 - DNA, 20 bp, mouse
ggttagcagtgggcaacttg

SEQ ID NO: 601757 - DNA, 20 bp, mouse
gcaacttgaggctgtaaccg

SEQ ID NO: 601758 - DNA, 20 bp, mouse
ggctgcccctctgagagcgg

SEQ ID NO: 601759 - DNA, 20 bp, mouse
ggctgcctccgctctcagag

SEQ ID NO: 601760 - DNA, 20 bp, mouse
gagttgcccactgctaactg

SEQ ID NO: 601761 - DNA, 20 bp, mouse
gggaggaggaggaaagacac

SEQ ID NO: 601762 - DNA, 20 bp, mouse
gtaaccggggcaagccccca

SEQ ID NO: 601763 - DNA, 20 bp, mouse
ggtcctgctcacccaacagg

SEQ ID NO: 601764 - DNA, 20 bp, mouse
gcggatgctgtcgctgcagg

SEQ ID NO: 601765 - DNA, 20 bp, mouse
ggggacctgagccccctgtt

SEQ ID NO: 601766 - DNA, 20 bp, mouse
gtggcacgggcgcaggaggg

SEQ ID NO: 601767 - DNA, 20 bp, mouse
gggagggcggcgcgcgccaa

SEQ ID NO: 601768 - DNA, 20 bp, mouse
gacctggcagcagcgtccgt

SEQ ID NO: 601769 - DNA, 20 bp, mouse
ggggccaactcgcaactctt

SEQ ID NO: 601770 - DNA, 20 bp, mouse
ggagttgcgagttggcccca

SEQ ID NO: 601771 - DNA, 20 bp, mouse
gttggccccatggttggcac

SEQ ID NO: 601772 - DNA, 20 bp, mouse
gctgcgcccgtgccaaccat

SEQ ID NO: 601773 - DNA, 20 bp, mouse
gcctccctggccgctcctat

SEQ ID NO: 601774 - DNA, 20 bp, mouse
ggggctctgcctcagaccaa

SEQ ID NO: 601775 - DNA, 20 bp, mouse
gttcgcgggtcaggtggagt

SEQ ID NO: 601776 - DNA, 20 bp, mouse
gagggccgttcgggaagagg

SEQ ID NO: 601777 - DNA, 20 bp, mouse
gcttctgccgagggccgttc

SEQ ID NO: 601778 - DNA, 20 bp, mouse
gccgagggccgttcgggaag

SEQ ID NO: 601779 - DNA, 20 bp, mouse
gggctccgcctcttcccgaa

SEQ ID NO: 601780 - DNA, 20 bp, mouse
gagtgccaccgaggataggt

SEQ ID NO: 601781 - DNA, 20 bp, mouse
gaccgaggataggtaggtcc

SEQ ID NO: 601782 - DNA, 20 bp, mouse
gaggcggagtcttctgccga

SEQ ID NO: 601783 - DNA, 20 bp, mouse
gagaaatggcaagcttgcgg

SEQ ID NO: 601784 - DNA, 20 bp, mouse
gcatcaaggttttagcatcc

SEQ ID NO: 601785 - DNA, 20 bp, mouse
gactggtcctgatgagagat

SEQ ID NO: 601786 - DNA, 20 bp, mouse
gggccccgcggagcccccat

SEQ ID NO: 601787 - DNA, 20 bp, mouse
gcgcggagcccccatcggtg

SEQ ID NO: 601788 - DNA, 20 bp, mouse
ggagcctcgcctcaccgatg

SEQ ID NO: 601789 - DNA, 20 bp, mouse
gaagcgccctgggcatggac

SEQ ID NO: 601790 - DNA, 20 bp, mouse
gtgggagcgtgcccggactg

SEQ ID NO: 601791 - DNA, 20 bp, mouse
gcggtgtgcgagctcagggg

SEQ ID NO: 601792 - DNA, 20 bp, mouse
gagcccccatcggtgaggcg

SEQ ID NO: 601793 - DNA, 20 bp, mouse
ggcgccccgctacactgcag

SEQ ID NO: 601794 - DNA, 20 bp, mouse
gaactgcgggaggccagcgt

SEQ ID NO: 601795 - DNA, 20 bp, mouse
ggcggggcccggcggccgaa

SEQ ID NO: 601796 - DNA, 20 bp, mouse
ggccctcggagtctagagag

SEQ ID NO: 601797 - DNA, 20 bp, mouse
gccatggtgcctgcttcccg

SEQ ID NO: 601798 - DNA, 20 bp, mouse
gcgggagcgcgaggtgcagg

SEQ ID NO: 601799 - DNA, 20 bp, mouse
ggccgctctctagactccga

SEQ ID NO: 601800 - DNA, 20 bp, mouse
gtggcgcccagcgcgatcac

SEQ ID NO: 601801 - DNA, 20 bp, mouse
gcgtgagcccgacccggaga

SEQ ID NO: 601802 - DNA, 20 bp, mouse
gcagtggccccgaggaatgg

SEQ ID NO: 601803 - DNA, 20 bp, mouse
gcgggaccgtgagcccgacc

SEQ ID NO: 601804 - DNA, 20 bp, mouse
gaggtgagtgaaggccaggt

SEQ ID NO: 601805 - DNA, 20 bp, mouse
gaggcgggagcgcgaggtgc

SEQ ID NO: 601806 - DNA, 20 bp, mouse
gaaccacgcagggagagcgg

SEQ ID NO: 601807 - DNA, 20 bp, mouse
ggtccatggcgagcgcatca

SEQ ID NO: 601808 - DNA, 20 bp, mouse
ggcgtggttggtgcggtcca

SEQ ID NO: 601809 - DNA, 20 bp, mouse
gagcgcatcatggcgatcga

SEQ ID NO: 601810 - DNA, 20 bp, mouse
gtgtaggccagtgctcgcga

SEQ ID NO: 601811 - DNA, 20 bp, mouse
gcttaggcctcgggccagag

SEQ ID NO: 601812 - DNA, 20 bp, mouse
gttgcgggtccggactgtaa

SEQ ID NO: 601813 - DNA, 20 bp, mouse
gtctccctgcgtggttggtg

SEQ ID NO: 601814 - DNA, 20 bp, mouse
ggctggagcttgctcttctt

SEQ ID NO: 601815 - DNA, 20 bp, mouse
gcatggcgatcgaaggtaag

SEQ ID NO: 601816 - DNA, 20 bp, mouse
ggctgcagtgcggagactct

SEQ ID NO: 601817 - DNA, 20 bp, mouse
gctcccgtgctctaagactt

SEQ ID NO: 601818 - DNA, 20 bp, mouse
gatcagtcttcactttctgg

SEQ ID NO: 601819 - DNA, 20 bp, mouse
ggccctaagacagggatagg

SEQ ID NO: 601820 - DNA, 20 bp, mouse
gccgcccaggagctaccgga

SEQ ID NO: 601821 - DNA, 20 bp, mouse
ggactccacgccctaagaca

SEQ ID NO: 601822 - DNA, 20 bp, mouse
gggctgctgcctggacagcg

SEQ ID NO: 601823 - DNA, 20 bp, mouse
gtctcggcgcccgcctgccc

SEQ ID NO: 601824 - DNA, 20 bp, mouse
gacctcggaaatggagtaaa

SEQ ID NO: 601825 - DNA, 20 bp, mouse
gggacccatacacatcataa

SEQ ID NO: 601826 - DNA, 20 bp, mouse
ggtgatgggcacggtaacaa

SEQ ID NO: 601827 - DNA, 20 bp, mouse
ggtcgcgtcggggggttgca

SEQ ID NO: 601828 - DNA, 20 bp, mouse
gtcgccatggtcgcgtcggg

SEQ ID NO: 601829 - DNA, 20 bp, mouse
ggcgtgggtaccccagccgc

SEQ ID NO: 601830 - DNA, 20 bp, mouse
gtaagtgcggggttccccgg

SEQ ID NO: 601831 - DNA, 20 bp, mouse
ggtcagccatagcaggtgat

SEQ ID NO: 601832 - DNA, 20 bp, mouse
gtcagtcgccatggtcgcgt

SEQ ID NO: 601833 - DNA, 20 bp, mouse
gctttgtgcccagctcgcgg

SEQ ID NO: 601834 - DNA, 20 bp, mouse
gcaaccccccgacgcgacca

SEQ ID NO: 601835 - DNA, 20 bp, mouse
gatgcagcacccgactggag

SEQ ID NO: 601836 - DNA, 20 bp, mouse
gaagctggagcgcctggcca

SEQ ID NO: 601837 - DNA, 20 bp, mouse
ggcagggctgggcaaggacg

SEQ ID NO: 601838 - DNA, 20 bp, mouse
gcagccggcaagatatcagt

SEQ ID NO: 601839 - DNA, 20 bp, mouse
gcggctctcccggggctccc

SEQ ID NO: 601840 - DNA, 20 bp, mouse
gggcgaccccggcgcaggcg

SEQ ID NO: 601841 - DNA, 20 bp, mouse
gcaggttctgcgctccaggg

SEQ ID NO: 601842 - DNA, 20 bp, mouse
gccagggaggcggccccgca

SEQ ID NO: 601843 - DNA, 20 bp, mouse
ggcacccacatccacacctt

SEQ ID NO: 601844 - DNA, 20 bp, mouse
ggcagtccccgcggctctcc

SEQ ID NO: 601845 - DNA, 20 bp, mouse
gcacaccttggggtgctccc

SEQ ID NO: 601846 - DNA, 20 bp, mouse
gcgctggccggcgcgggagt

SEQ ID NO: 601847 - DNA, 20 bp, mouse
gcccgggtaagagggagccc

SEQ ID NO: 601848 - DNA, 20 bp, mouse
ggggagcccgatctcaccaa

SEQ ID NO: 601849 - DNA, 20 bp, mouse
gcccgcgccggccagcgctg

SEQ ID NO: 601850 - DNA, 20 bp, mouse
gagaggggacctggacttcg

SEQ ID NO: 601851 - DNA, 20 bp, mouse
gctgcagagcgcgcgagcga

SEQ ID NO: 601852 - DNA, 20 bp, mouse
gcaggcagggagccctgcga

SEQ ID NO: 601853 - DNA, 20 bp, mouse
ggtctgccgccccgaagtcc

SEQ ID NO: 601854 - DNA, 20 bp, mouse
gtggtgatccagcctcccag

SEQ ID NO: 601855 - DNA, 20 bp, mouse
gtcagcactagaacaggtct

SEQ ID NO: 601856 - DNA, 20 bp, mouse
gtgccaggtggcaagaaggg

SEQ ID NO: 601857 - DNA, 20 bp, mouse
ggcccccttgggatgaggtt

SEQ ID NO: 601858 - DNA, 20 bp, mouse
ggctggacgctccaggggag

SEQ ID NO: 601859 - DNA, 20 bp, mouse
gacgtggccctggaaaaagg

SEQ ID NO: 601860 - DNA, 20 bp, mouse
gggcggactcaccggagccc

SEQ ID NO: 601861 - DNA, 20 bp, mouse
gccttgggatgaggttgggg

SEQ ID NO: 601862 - DNA, 20 bp, mouse
gtcggctgccacccaggaca

SEQ ID NO: 601863 - DNA, 20 bp, mouse
ggagagaagtgaagccaggg

SEQ ID NO: 601864 - DNA, 20 bp, mouse
gagccgaggagctgcgacag

SEQ ID NO: 601865 - DNA, 20 bp, mouse
ggaagtgcacccaggtgtat

SEQ ID NO: 601866 - DNA, 20 bp, mouse
gagccaacaggaacagggca

SEQ ID NO: 601867 - DNA, 20 bp, mouse
gcaccctgccctgttcctgt

SEQ ID NO: 601868 - DNA, 20 bp, mouse
gaccagcaccggcagcggga

SEQ ID NO: 601869 - DNA, 20 bp, mouse
gcagaagagccaacaggaac

SEQ ID NO: 601870 - DNA, 20 bp, mouse
ggtctctgagactccagacg

SEQ ID NO: 601871 - DNA, 20 bp, mouse
gtggggaccagcaccggcag

SEQ ID NO: 601872 - DNA, 20 bp, mouse
ggaggtgctgaaagaactcc

SEQ ID NO: 601873 - DNA, 20 bp, mouse
gacattgctgatagagagcg

SEQ ID NO: 601874 - DNA, 20 bp, mouse
gacagagcacgcagaaaaca

SEQ ID NO: 601875 - DNA, 20 bp, mouse
gttgctcaccgaattccacg

SEQ ID NO: 601876 - DNA, 20 bp, mouse
gggggtagaagagaatggat

SEQ ID NO: 601877 - DNA, 20 bp, mouse
ggcgcaggtgagaagaccct

SEQ ID NO: 601878 - DNA, 20 bp, mouse
gcccttgggaagagcaagga

SEQ ID NO: 601879 - DNA, 20 bp, mouse
gacttccggttcaagccctt

SEQ ID NO: 601880 - DNA, 20 bp, mouse
gcttgagaggctgtccacta

SEQ ID NO: 601881 - DNA, 20 bp, mouse
gtcttcccaagggcttgaac

SEQ ID NO: 601882 - DNA, 20 bp, mouse
gagtgggcgcaggcaggcgt

SEQ ID NO: 601883 - DNA, 20 bp, mouse
gggacccaattccatcacaa

SEQ ID NO: 601884 - DNA, 20 bp, mouse
ggcctgccactggcgtgaag

SEQ ID NO: 601885 - DNA, 20 bp, mouse
gcagtagcaaagactcgggt

SEQ ID NO: 601886 - DNA, 20 bp, mouse
gggttcccgcctggcaaagt

SEQ ID NO: 601887 - DNA, 20 bp, mouse
ggcctggcaaagtcggtgag

SEQ ID NO: 601888 - DNA, 20 bp, mouse
gcaaagtcggtgagaggcac

SEQ ID NO: 601889 - DNA, 20 bp, mouse
gggagtcgcgacaagagggg

SEQ ID NO: 601890 - DNA, 20 bp, mouse
gggcagccgccaagtctagg

SEQ ID NO: 601891 - DNA, 20 bp, mouse
ggcaggaccgggtccccgag

SEQ ID NO: 601892 - DNA, 20 bp, mouse
ggcgggagtcgcgacaagag

SEQ ID NO: 601893 - DNA, 20 bp, mouse
ggattcgaagaggacctgag

SEQ ID NO: 601894 - DNA, 20 bp, mouse
gctcggagggaagggcccgg

SEQ ID NO: 601895 - DNA, 20 bp, mouse
gcccggcagccgccaagtct

SEQ ID NO: 601896 - DNA, 20 bp, mouse
ggagagtgtgtgcgcgcccg

SEQ ID NO: 601897 - DNA, 20 bp, mouse
gcagtggccgtggcgctcca

SEQ ID NO: 601898 - DNA, 20 bp, mouse
gccgacagtgggcgcagcag

SEQ ID NO: 601899 - DNA, 20 bp, mouse
gtggccgtggcgctccacgg

SEQ ID NO: 601900 - DNA, 20 bp, mouse
gacgcggcgcgcaggccaga

SEQ ID NO: 601901 - DNA, 20 bp, mouse
gtgcgcgcccggggcaccgc

SEQ ID NO: 601902 - DNA, 20 bp, mouse
ggtggcgctccacggcgggc

SEQ ID NO: 601903 - DNA, 20 bp, mouse
ggcagcgcgcggccgacagt

SEQ ID NO: 601904 - DNA, 20 bp, mouse
ggcagcagcggcagtggccg

SEQ ID NO: 601905 - DNA, 20 bp, mouse
gaccatgtaccgggacccgg

SEQ ID NO: 601906 - DNA, 20 bp, mouse
gaggctggttgtccactctc

SEQ ID NO: 601907 - DNA, 20 bp, mouse
gcactagcaacaggcaccac

SEQ ID NO: 601908 - DNA, 20 bp, mouse
gtcagaccctagtcactggg

SEQ ID NO: 601909 - DNA, 20 bp, mouse
ggcaccacgggctctgctgt

SEQ ID NO: 601910 - DNA, 20 bp, mouse
gatgcccacagcagagcccg

SEQ ID NO: 601911 - DNA, 20 bp, mouse
ggtctggttaggctgagggt

SEQ ID NO: 601912 - DNA, 20 bp, mouse
gatcaggtgctgcctgagag

SEQ ID NO: 601913 - DNA, 20 bp, mouse
gctgctccaggacctcagag

SEQ ID NO: 601914 - DNA, 20 bp, mouse
gaccagcctcccagtgacta

SEQ ID NO: 601915 - DNA, 20 bp, mouse
gggttaggctgagggtaggt

SEQ ID NO: 601916 - DNA, 20 bp, mouse
gagagctgcatgcaaccggt

SEQ ID NO: 601917 - DNA, 20 bp, mouse
gagccgggtcggcctcccac

SEQ ID NO: 601918 - DNA, 20 bp, mouse
gcggagaaagcccgagcgag

SEQ ID NO: 601919 - DNA, 20 bp, mouse
gaaccggtgggaggccgacc

SEQ ID NO: 601920 - DNA, 20 bp, mouse
gccgcgccgagggagggacg

SEQ ID NO: 601921 - DNA, 20 bp, mouse
gctcggagagccgctcgctc

SEQ ID NO: 601922 - DNA, 20 bp, mouse
gtcgtgctccagggcccctc

SEQ ID NO: 601923 - DNA, 20 bp, mouse
ggagggacgaggggccgcgc

SEQ ID NO: 601924 - DNA, 20 bp, mouse
gtccctccctcggcgcggag

SEQ ID NO: 601925 - DNA, 20 bp, mouse
gcaggtggtagatgaaatct

SEQ ID NO: 601926 - DNA, 20 bp, mouse
ggtagggacgacaacttcaa

SEQ ID NO: 601927 - DNA, 20 bp, mouse
gagagactagaaaggctgtg

SEQ ID NO: 601928 - DNA, 20 bp, mouse
gaaggcgactccagctctcc

SEQ ID NO: 601929 - DNA, 20 bp, mouse
gtgctgccccagtcccgagg

SEQ ID NO: 601930 - DNA, 20 bp, mouse
gatgtggtcaggacaccagg

SEQ ID NO: 601931 - DNA, 20 bp, mouse
gacccagtggtctaagggac

SEQ ID NO: 601932 - DNA, 20 bp, mouse
gctcctgaggtaccagaatg

SEQ ID NO: 601933 - DNA, 20 bp, mouse
ggtcccgcagtgttagtaca

SEQ ID NO: 601934 - DNA, 20 bp, mouse
gtgccccagtcccgaggagg

SEQ ID NO: 601935 - DNA, 20 bp, mouse
gctgggtgtgttacctgtaa

SEQ ID NO: 601936 - DNA, 20 bp, mouse
gaggcactcacggatcggag

SEQ ID NO: 601937 - DNA, 20 bp, mouse
gacctctgagctgcgagtac

SEQ ID NO: 601938 - DNA, 20 bp, mouse
ggccataggcactcacggat

SEQ ID NO: 601939 - DNA, 20 bp, mouse
gtagcgcagcgagaagagca

SEQ ID NO: 601940 - DNA, 20 bp, mouse
gggatcggagcggcgtcgcc

SEQ ID NO: 601941 - DNA, 20 bp, mouse
gagcggccaggccctggcac

SEQ ID NO: 601942 - DNA, 20 bp, mouse
ggccaaggcagttaagtggt

SEQ ID NO: 601943 - DNA, 20 bp, mouse
gagctgggcaagggatgtga

SEQ ID NO: 601944 - DNA, 20 bp, mouse
gcctgtgccataggcactca

SEQ ID NO: 601945 - DNA, 20 bp, mouse
ggctggacaaagctctggaa

SEQ ID NO: 601946 - DNA, 20 bp, mouse
gctacagccaggatgattac

SEQ ID NO: 601947 - DNA, 20 bp, mouse
gttctgctgggagcacagta

SEQ ID NO: 601948 - DNA, 20 bp, mouse
ggtcttgctcctcctctgtc

SEQ ID NO: 601949 - DNA, 20 bp, mouse
ggacttaagtttcctgacag

SEQ ID NO: 601950 - DNA, 20 bp, mouse
gttgcatcctgtaatcatcc

SEQ ID NO: 601951 - DNA, 20 bp, mouse
gtacaggatgcaaaagtaaa

SEQ ID NO: 601952 - DNA, 20 bp, mouse
ggaaaggtgctcgggtgtga

SEQ ID NO: 601953 - DNA, 20 bp, mouse
gggagcacagcttccacaaa

SEQ ID NO: 601954 - DNA, 20 bp, mouse
gaggtctcaatgaaaaactt

SEQ ID NO: 601955 - DNA, 20 bp, mouse
ggagcaagacgccatcttaa

SEQ ID NO: 601956 - DNA, 20 bp, mouse
gaggcaggaagaagacacac

SEQ ID NO: 601957 - DNA, 20 bp, mouse
gtctggagtgtgtcctgatg

SEQ ID NO: 601958 - DNA, 20 bp, mouse
gggtggtactcaggaggcac

SEQ ID NO: 601959 - DNA, 20 bp, mouse
gcaggacacactccagatta

SEQ ID NO: 601960 - DNA, 20 bp, mouse
gggaagcccggagtctacat

SEQ ID NO: 601961 - DNA, 20 bp, mouse
gacacactccagattaaggt

SEQ ID NO: 601962 - DNA, 20 bp, mouse
ggagctcccatgtagactcc

SEQ ID NO: 601963 - DNA, 20 bp, mouse
gacacacaggtcaatggtga

SEQ ID NO: 601964 - DNA, 20 bp, mouse
ggcttcctcctaccttaatc

SEQ ID NO: 601965 - DNA, 20 bp, mouse
ggcctcagccagtgcctggc

SEQ ID NO: 601966 - DNA, 20 bp, mouse
gctcctgggagggttgagta

SEQ ID NO: 601967 - DNA, 20 bp, mouse
gggtccgggtgccgaatggt

SEQ ID NO: 601968 - DNA, 20 bp, mouse
gaccgcctggagcagacggg

SEQ ID NO: 601969 - DNA, 20 bp, mouse
gtgagtagggccggccgcct

SEQ ID NO: 601970 - DNA, 20 bp, mouse
gagacttagaccagcaaccc

SEQ ID NO: 601971 - DNA, 20 bp, mouse
gcgggtgccgaatggttgga

SEQ ID NO: 601972 - DNA, 20 bp, mouse
gggtgctactaggtgaccaa

SEQ ID NO: 601973 - DNA, 20 bp, mouse
gacacacgcccccgaagtgg

SEQ ID NO: 601974 - DNA, 20 bp, mouse
gcaaaggtccgggtgccgaa

SEQ ID NO: 601975 - DNA, 20 bp, mouse
gagcccgagagaaggataag

SEQ ID NO: 601976 - DNA, 20 bp, mouse
gcagcagctctgtgtagcag

SEQ ID NO: 601977 - DNA, 20 bp, mouse
gatgagaaggaaatgatact

SEQ ID NO: 601978 - DNA, 20 bp, mouse
gagtaccatgtctaagaact

SEQ ID NO: 601979 - DNA, 20 bp, mouse
gtggagacagatattgatca

SEQ ID NO: 601980 - DNA, 20 bp, mouse
gtggaatttgatagtctcat

SEQ ID NO: 601981 - DNA, 20 bp, mouse
gagagttggtactcaaaaat

SEQ ID NO: 601982 - DNA, 20 bp, mouse
gatagaaagcagttgaataa

SEQ ID NO: 601983 - DNA, 20 bp, mouse
gatggagatcagctgataat

SEQ ID NO: 601984 - DNA, 20 bp, mouse
ggccatctagctaaagagga

SEQ ID NO: 601985 - DNA, 20 bp, mouse
gatattgatcagggacttta

SEQ ID NO: 601986 - DNA, 20 bp, mouse
gtccagggatagctacgaca

SEQ ID NO: 601987 - DNA, 20 bp, mouse
gggagcggctgccgcagtcg

SEQ ID NO: 601988 - DNA, 20 bp, mouse
gaggaccaggcccactcacc

SEQ ID NO: 601989 - DNA, 20 bp, mouse
gcgctcaatcaccgcgactg

SEQ ID NO: 601990 - DNA, 20 bp, mouse
gcggtgattgagcgtgctcg

SEQ ID NO: 601991 - DNA, 20 bp, mouse
gcagagggcacagcttgaga

SEQ ID NO: 601992 - DNA, 20 bp, mouse
gctgcgaaccggaacttcgg

SEQ ID NO: 601993 - DNA, 20 bp, mouse
ggcgtctgcgctgaccaccc

SEQ ID NO: 601994 - DNA, 20 bp, mouse
ggcttctcggaaaaaaatag

SEQ ID NO: 601995 - DNA, 20 bp, mouse
gggcccggcctctggaacgg

SEQ ID NO: 601996 - DNA, 20 bp, mouse
ggggaggaggcggcagacag

SEQ ID NO: 601997 - DNA, 20 bp, mouse
ggaggaggtcgctgagagct

SEQ ID NO: 601998 - DNA, 20 bp, mouse
gggcggcagacagcggggta

SEQ ID NO: 601999 - DNA, 20 bp, mouse
ggggaaagcggcgagtaaga

SEQ ID NO: 602000 - DNA, 20 bp, mouse
ggagaggcacccggcaaagg

SEQ ID NO: 602001 - DNA, 20 bp, mouse
ggcggagaggcacccggcaa

SEQ ID NO: 602002 - DNA, 20 bp, mouse
gcgcacaccgctgggcggag

SEQ ID NO: 602003 - DNA, 20 bp, mouse
gcgaagcgcacaccgctggg

SEQ ID NO: 602004 - DNA, 20 bp, mouse
gcacggcgatccgggaccgg

SEQ ID NO: 602005 - DNA, 20 bp, mouse
gaggaggagctgccgccccg

SEQ ID NO: 602006 - DNA, 20 bp, mouse
gaggagtggagcaacctccc

SEQ ID NO: 602007 - DNA, 20 bp, mouse
gacagaactagccgggtcag

SEQ ID NO: 602008 - DNA, 20 bp, mouse
gtgggcgacgaagatcagga

SEQ ID NO: 602009 - DNA, 20 bp, mouse
gtcggagcgccccgagccag

SEQ ID NO: 602010 - DNA, 20 bp, mouse
ggactggccagagggttgta

SEQ ID NO: 602011 - DNA, 20 bp, mouse
gaccctccggagcctcaagg

SEQ ID NO: 602012 - DNA, 20 bp, mouse
gtgcccggtacagaactagc

SEQ ID NO: 602013 - DNA, 20 bp, mouse
gcccgcccatccctcacctc

SEQ ID NO: 602014 - DNA, 20 bp, mouse
gcgctaacaagtctgtggat

SEQ ID NO: 602015 - DNA, 20 bp, mouse
gtccctggcccgggccggcg

SEQ ID NO: 602016 - DNA, 20 bp, mouse
gcgccttgcgggagttcaag

SEQ ID NO: 602017 - DNA, 20 bp, mouse
ggcggtggcgagagaagtga

SEQ ID NO: 602018 - DNA, 20 bp, mouse
ggggagttcaagtggagcca

SEQ ID NO: 602019 - DNA, 20 bp, mouse
gaccgagatcgggatgaggg

SEQ ID NO: 602020 - DNA, 20 bp, mouse
ggactcctggaaggtggaga

SEQ ID NO: 602021 - DNA, 20 bp, mouse
gctccacttgaactcccgca

SEQ ID NO: 602022 - DNA, 20 bp, mouse
ggcgacaagagtaagtctct

SEQ ID NO: 602023 - DNA, 20 bp, mouse
ggggagtcaagactcctgga

SEQ ID NO: 602024 - DNA, 20 bp, mouse
ggtggcgagagaagtgaagg

SEQ ID NO: 602025 - DNA, 20 bp, mouse
gccaaaggagcaccgagatc

SEQ ID NO: 602026 - DNA, 20 bp, mouse
gaaggtctcggccagctcac

SEQ ID NO: 602027 - DNA, 20 bp, mouse
gagctggccgagaccttcgg

SEQ ID NO: 602028 - DNA, 20 bp, mouse
gttcggaggacgcttcctgg

SEQ ID NO: 602029 - DNA, 20 bp, mouse
gggaggaggccggaacatgg

SEQ ID NO: 602030 - DNA, 20 bp, mouse
gacctggcgcgctgcggact

SEQ ID NO: 602031 - DNA, 20 bp, mouse
ggcgctggccgcgaacggta

SEQ ID NO: 602032 - DNA, 20 bp, mouse
ggatgggacctggcgcgctg

SEQ ID NO: 602033 - DNA, 20 bp, mouse
ggttgcgtgcggagtcggat

SEQ ID NO: 602034 - DNA, 20 bp, mouse
gtgcggagtcggatgggacc

SEQ ID NO: 602035 - DNA, 20 bp, mouse
gcctggaggaggccggaaca

SEQ ID NO: 602036 - DNA, 20 bp, mouse
gactgcagagaactagacac

SEQ ID NO: 602037 - DNA, 20 bp, mouse
gagagaactagacacaggct

SEQ ID NO: 602038 - DNA, 20 bp, mouse
gacaggctgggctttccctc

SEQ ID NO: 602039 - DNA, 20 bp, mouse
ggcattgctcaacagccaga

SEQ ID NO: 602040 - DNA, 20 bp, mouse
ggaccagtcgctgtttctgt

SEQ ID NO: 602041 - DNA, 20 bp, mouse
gtaatcctggccactctggt

SEQ ID NO: 602042 - DNA, 20 bp, mouse
gtaagctgtacagggaagct

SEQ ID NO: 602043 - DNA, 20 bp, mouse
gagaaagtcgacaatggcca

SEQ ID NO: 602044 - DNA, 20 bp, mouse
ggctggtgtgaactttacag

SEQ ID NO: 602045 - DNA, 20 bp, mouse
gggaaatgtttgtgatagcg

SEQ ID NO: 602046 - DNA, 20 bp, mouse
gcatggagacgggatgtgaa

SEQ ID NO: 602047 - DNA, 20 bp, mouse
gcccagcaggtacatggaga

SEQ ID NO: 602048 - DNA, 20 bp, mouse
gttgaagcccagcaggtaca

SEQ ID NO: 602049 - DNA, 20 bp, mouse
gatggttagagagtcagtca

SEQ ID NO: 602050 - DNA, 20 bp, mouse
gacaggtgtccccctaggtg

SEQ ID NO: 602051 - DNA, 20 bp, mouse
gcactgctttacagtagtgg

SEQ ID NO: 602052 - DNA, 20 bp, mouse
gggtgaggcagagggacctc

SEQ ID NO: 602053 - DNA, 20 bp, mouse
gttccacaaagcagtcacga

SEQ ID NO: 602054 - DNA, 20 bp, mouse
gggtccctctgcctcaccta

SEQ ID NO: 602055 - DNA, 20 bp, mouse
gcccgtctccatgtacctgc

SEQ ID NO: 602056 - DNA, 20 bp, mouse
gcctttccaggatgaagtca

SEQ ID NO: 602057 - DNA, 20 bp, mouse
ggacagctggataagtcttc

SEQ ID NO: 602058 - DNA, 20 bp, mouse
gcttgaaggataaaacacca

SEQ ID NO: 602059 - DNA, 20 bp, mouse
ggaaagagcgattggtggga

SEQ ID NO: 602060 - DNA, 20 bp, mouse
gatggagaggatcagaaagt

SEQ ID NO: 602061 - DNA, 20 bp, mouse
gagaggatcagaaagttggt

SEQ ID NO: 602062 - DNA, 20 bp, mouse
gaaacccagcaggaagtccg

SEQ ID NO: 602063 - DNA, 20 bp, mouse
gcacggaaagagcgattggt

SEQ ID NO: 602064 - DNA, 20 bp, mouse
gctgatctcaccatactgta

SEQ ID NO: 602065 - DNA, 20 bp, mouse
ggtcgatcgcgatggagcac

SEQ ID NO: 602066 - DNA, 20 bp, mouse
gcgcaggcctcgccttcctt

SEQ ID NO: 602067 - DNA, 20 bp, mouse
gtggaccggatcatactgaa

SEQ ID NO: 602068 - DNA, 20 bp, mouse
gcaactcaacaggaagtctg

SEQ ID NO: 602069 - DNA, 20 bp, mouse
gaacagttcttgcccaagga

SEQ ID NO: 602070 - DNA, 20 bp, mouse
gggtagccatggagagaata

SEQ ID NO: 602071 - DNA, 20 bp, mouse
ggagtggagctgcttgaagt

SEQ ID NO: 602072 - DNA, 20 bp, mouse
gttcttgcccaaggaaggcg

SEQ ID NO: 602073 - DNA, 20 bp, mouse
gagggtcgcagacggcatag

SEQ ID NO: 602074 - DNA, 20 bp, mouse
ggatgaatacacccgacccc

SEQ ID NO: 602075 - DNA, 20 bp, mouse
gaagcaaaactgtacttctg

SEQ ID NO: 602076 - DNA, 20 bp, mouse
gtgagagctgtcctcctccc

SEQ ID NO: 602077 - DNA, 20 bp, mouse
gcctggtagcagaacgctgt

SEQ ID NO: 602078 - DNA, 20 bp, mouse
gagagcagcaggaagttggt

SEQ ID NO: 602079 - DNA, 20 bp, mouse
ggttattattattgtagaca

SEQ ID NO: 602080 - DNA, 20 bp, mouse
gaacatgtctgccagggcca

SEQ ID NO: 602081 - DNA, 20 bp, mouse
gacttggagggatagagcag

SEQ ID NO: 602082 - DNA, 20 bp, mouse
ggacctggatggccagcggg

SEQ ID NO: 602083 - DNA, 20 bp, mouse
ggtgtggagcactttaaagt

SEQ ID NO: 602084 - DNA, 20 bp, mouse
gtgtgctgatcacagtcctg

SEQ ID NO: 602085 - DNA, 20 bp, mouse
ggttctgctaccaggtgaat

SEQ ID NO: 602086 - DNA, 20 bp, mouse
gagcagagctgcaggacggt

SEQ ID NO: 602087 - DNA, 20 bp, mouse
gctcgacccaggagagtagg

SEQ ID NO: 602088 - DNA, 20 bp, mouse
gaccctcgacccaggagagt

SEQ ID NO: 602089 - DNA, 20 bp, mouse
gagagctgcaggacggtggg

SEQ ID NO: 602090 - DNA, 20 bp, mouse
gagaggatgaccctcgaccc

SEQ ID NO: 602091 - DNA, 20 bp, mouse
ggtgcaaatagcagcagcat

SEQ ID NO: 602092 - DNA, 20 bp, mouse
gctgctatgagaatgtgacc

SEQ ID NO: 602093 - DNA, 20 bp, mouse
ggaaaaccccctactctcct

SEQ ID NO: 602094 - DNA, 20 bp, mouse
gatgcaatgaggaaattggt

SEQ ID NO: 602095 - DNA, 20 bp, mouse
gccttggcctgtgctgactt

SEQ ID NO: 602096 - DNA, 20 bp, mouse
ggtaatatacatggacaaat

SEQ ID NO: 602097 - DNA, 20 bp, mouse
ggaaacagaagcagtgaacc

SEQ ID NO: 602098 - DNA, 20 bp, mouse
gaaaactggagtaatataca

SEQ ID NO: 602099 - DNA, 20 bp, mouse
gagattgatcactgagaaaa

SEQ ID NO: 602100 - DNA, 20 bp, mouse
ggagaacagatcttcattca

SEQ ID NO: 602101 - DNA, 20 bp, mouse
gcagaagcagtgaacctggt

SEQ ID NO: 602102 - DNA, 20 bp, mouse
ggatgcccttcagcacggtg

SEQ ID NO: 602103 - DNA, 20 bp, mouse
gcctgtgctgatttcttagt

SEQ ID NO: 602104 - DNA, 20 bp, mouse
ggaacctggtggggtaggtc

SEQ ID NO: 602105 - DNA, 20 bp, mouse
gtgacccttcaaaacaagaa

SEQ ID NO: 602106 - DNA, 20 bp, mouse
gagagaacatatcactgctc

SEQ ID NO: 602107 - DNA, 20 bp, mouse
gacaggccaaggacaccacc

SEQ ID NO: 602108 - DNA, 20 bp, mouse
gaacttcctggtggtgtcct

SEQ ID NO: 602109 - DNA, 20 bp, mouse
ggcgagggcctggggaatat

SEQ ID NO: 602110 - DNA, 20 bp, mouse
gggatgctgtcttgatccca

SEQ ID NO: 602111 - DNA, 20 bp, mouse
gtcaggagcccatattcccc

SEQ ID NO: 602112 - DNA, 20 bp, mouse
ggataatgacagttttccct

SEQ ID NO: 602113 - DNA, 20 bp, mouse
gttggcctgtgctgatttct

SEQ ID NO: 602114 - DNA, 20 bp, mouse
gatctttggagtagcataca

SEQ ID NO: 602115 - DNA, 20 bp, mouse
gcaaatgcagtaaacctggt

SEQ ID NO: 602116 - DNA, 20 bp, mouse
ggcgagggcctggagagtat

SEQ ID NO: 602117 - DNA, 20 bp, mouse
gcctgacacaggatctgttc

SEQ ID NO: 602118 - DNA, 20 bp, mouse
gaggatgctgtcttggtccc

SEQ ID NO: 602119 - DNA, 20 bp, mouse
gtcaggagcccatactctcc

SEQ ID NO: 602120 - DNA, 20 bp, mouse
gattccattcttgctttgaa

SEQ ID NO: 602121 - DNA, 20 bp, mouse
gaagcacaagtggaagagag

SEQ ID NO: 602122 - DNA, 20 bp, mouse
gcagacctcaccatgctaaa

SEQ ID NO: 602123 - DNA, 20 bp, mouse
gatggtgatgccttttagca

SEQ ID NO: 602124 - DNA, 20 bp, mouse
gatctttggagtagcataca

SEQ ID NO: 602125 - DNA, 20 bp, mouse
ggagtagcatacatggctac

SEQ ID NO: 602126 - DNA, 20 bp, mouse
gactgcactgctgtacacca

SEQ ID NO: 602127 - DNA, 20 bp, mouse
gtacaccaggggcagaatcc

SEQ ID NO: 602128 - DNA, 20 bp, mouse
gatctcctggattctgcccc

SEQ ID NO: 602129 - DNA, 20 bp, mouse
ggaatctgctttttgatgct

SEQ ID NO: 602130 - DNA, 20 bp, mouse
gcccggggccctggagaata

SEQ ID NO: 602131 - DNA, 20 bp, mouse
gaagtcagcactggccagag

SEQ ID NO: 602132 - DNA, 20 bp, mouse
gtctgctatgagaacacgaa

SEQ ID NO: 602133 - DNA, 20 bp, mouse
gccatgtacaggatgacccg

SEQ ID NO: 602134 - DNA, 20 bp, mouse
ggcagagctgcagggctggt

SEQ ID NO: 602135 - DNA, 20 bp, mouse
gagagaggcgatgagaaaat

SEQ ID NO: 602136 - DNA, 20 bp, mouse
gcccaccaagaagtcagcgc

SEQ ID NO: 602137 - DNA, 20 bp, mouse
gtcatcctgtacatggtctt

SEQ ID NO: 602138 - DNA, 20 bp, mouse
gtctgctttttgatgcttga

SEQ ID NO: 602139 - DNA, 20 bp, mouse
ggagatgaagcacaggtgga

SEQ ID NO: 602140 - DNA, 20 bp, mouse
gcccggggccctggagaata

SEQ ID NO: 602141 - DNA, 20 bp, mouse
gaagtcagcgctggccagag

SEQ ID NO: 602142 - DNA, 20 bp, mouse
ggcagagctgcagggctggt

SEQ ID NO: 602143 - DNA, 20 bp, mouse
gagagaggcgatgagaaaat

SEQ ID NO: 602144 - DNA, 20 bp, mouse
gtctgctatgagaacacgaa

SEQ ID NO: 602145 - DNA, 20 bp, mouse
gccatgtacaggatgacccg

SEQ ID NO: 602146 - DNA, 20 bp, mouse
ggagatgaagcacaggtgga

SEQ ID NO: 602147 - DNA, 20 bp, mouse
ggaatctgctttttgatgct

SEQ ID NO: 602148 - DNA, 20 bp, mouse
gcccggggccctggagaata

SEQ ID NO: 602149 - DNA, 20 bp, mouse
gaagtcagcactggccagag

SEQ ID NO: 602150 - DNA, 20 bp, mouse
ggcagagctgcagggctggt

SEQ ID NO: 602151 - DNA, 20 bp, mouse
gagagaggcgatgagaaaat

SEQ ID NO: 602152 - DNA, 20 bp, mouse
gtctgctatgagaacacgaa

SEQ ID NO: 602153 - DNA, 20 bp, mouse
gccatgtacaggatgacccg

SEQ ID NO: 602154 - DNA, 20 bp, mouse
ggctggttgggaaaagttgc

SEQ ID NO: 602155 - DNA, 20 bp, mouse
ggtccactgagatgaagcac

SEQ ID NO: 602156 - DNA, 20 bp, mouse
gcatagcagagctccatggg

SEQ ID NO: 602157 - DNA, 20 bp, mouse
gagctccatgggcggttctg

SEQ ID NO: 602158 - DNA, 20 bp, mouse
gaggccaccaggaagttcgt

SEQ ID NO: 602159 - DNA, 20 bp, mouse
gttctccccagaaccgccca

SEQ ID NO: 602160 - DNA, 20 bp, mouse
gacgcctacgaacttcctgg

SEQ ID NO: 602161 - DNA, 20 bp, mouse
gagtttacaattaccaagac

SEQ ID NO: 602162 - DNA, 20 bp, mouse
gcaaaccgaggaccccatag

SEQ ID NO: 602163 - DNA, 20 bp, mouse
ggattgctagaatggaaacc

SEQ ID NO: 602164 - DNA, 20 bp, mouse
gtggtaattgtaaacttccc

SEQ ID NO: 602165 - DNA, 20 bp, mouse
ggcctcgagccatcctctat

SEQ ID NO: 602166 - DNA, 20 bp, mouse
ggcggggtcctccaagatgg

SEQ ID NO: 602167 - DNA, 20 bp, mouse
ggagcctgctccagagtgtg

SEQ ID NO: 602168 - DNA, 20 bp, mouse
ggccgcggggtcctccaaga

SEQ ID NO: 602169 - DNA, 20 bp, mouse
gctccaagatggcggcgcag

SEQ ID NO: 602170 - DNA, 20 bp, mouse
gcccagcccggagagcgggt

SEQ ID NO: 602171 - DNA, 20 bp, mouse
gggtcggtttcctcacactc

SEQ ID NO: 602172 - DNA, 20 bp, mouse
gaccctcccagcccggagag

SEQ ID NO: 602173 - DNA, 20 bp, mouse
gctcggagtggcgggatgag

SEQ ID NO: 602174 - DNA, 20 bp, mouse
gtcgcaggctggggcctcta

SEQ ID NO: 602175 - DNA, 20 bp, mouse
gcgcacgcgcagaacaggcg

SEQ ID NO: 602176 - DNA, 20 bp, mouse
ggccgccgcctctcccactt

SEQ ID NO: 602177 - DNA, 20 bp, mouse
ggcggccgcggtgacgacgg

SEQ ID NO: 602178 - DNA, 20 bp, mouse
gcccagtccgcatcaaaata

SEQ ID NO: 602179 - DNA, 20 bp, mouse
ggccgcgccgccatattgtg

SEQ ID NO: 602180 - DNA, 20 bp, mouse
gacggctgcccaagtgggag

SEQ ID NO: 602181 - DNA, 20 bp, mouse
ggcccaagtgggagaggcgg

SEQ ID NO: 602182 - DNA, 20 bp, mouse
gatacggccacacaatatgg

SEQ ID NO: 602183 - DNA, 20 bp, mouse
gcggccatcgctttgatccg

SEQ ID NO: 602184 - DNA, 20 bp, mouse
gggccgccgccaactccctc

SEQ ID NO: 602185 - DNA, 20 bp, mouse
gatcaaagcgatggccgggg

SEQ ID NO: 602186 - DNA, 20 bp, mouse
ggcacggcgcgcagtcaagg

SEQ ID NO: 602187 - DNA, 20 bp, mouse
ggccgtgccgagggcagatc

SEQ ID NO: 602188 - DNA, 20 bp, mouse
gaccggatctgccctcggca

SEQ ID NO: 602189 - DNA, 20 bp, mouse
ggcccgcccggaccccccgt

SEQ ID NO: 602190 - DNA, 20 bp, mouse
ggtccgcaggctcccacggg

SEQ ID NO: 602191 - DNA, 20 bp, mouse
gtccgtccgcaggctcccac

SEQ ID NO: 602192 - DNA, 20 bp, mouse
gtgactgcgcgccgtgccga

SEQ ID NO: 602193 - DNA, 20 bp, mouse
gggtcactaggacgacccca

SEQ ID NO: 602194 - DNA, 20 bp, mouse
gtcccacggggggtccgggc

SEQ ID NO: 602195 - DNA, 20 bp, mouse
gctcacaccggatctgccct

SEQ ID NO: 602196 - DNA, 20 bp, mouse
gcacctgcggagcatccccg

SEQ ID NO: 602197 - DNA, 20 bp, mouse
gcttggccgcggtgcaggag

SEQ ID NO: 602198 - DNA, 20 bp, mouse
gagcggagcaggtccgagtg

SEQ ID NO: 602199 - DNA, 20 bp, mouse
gagcctgaagactctgcagg

SEQ ID NO: 602200 - DNA, 20 bp, mouse
gtaccgcaaagcaggagctg

SEQ ID NO: 602201 - DNA, 20 bp, mouse
gccgcaggtgcgcacttgct

SEQ ID NO: 602202 - DNA, 20 bp, mouse
gtccgggtctgagaatggag

SEQ ID NO: 602203 - DNA, 20 bp, mouse
gtctttgctctccttggccg

SEQ ID NO: 602204 - DNA, 20 bp, mouse
gactcactgcggtcagaccg

SEQ ID NO: 602205 - DNA, 20 bp, mouse
gggcagacaaagagaggcgt

SEQ ID NO: 602206 - DNA, 20 bp, mouse
gtggatagctgacaggatca

SEQ ID NO: 602207 - DNA, 20 bp, mouse
ggctatccagctccacaggt

SEQ ID NO: 602208 - DNA, 20 bp, mouse
ggtggagctggatagctgac

SEQ ID NO: 602209 - DNA, 20 bp, mouse
ggtgcaggggctctggaagg

SEQ ID NO: 602210 - DNA, 20 bp, mouse
ggctgacaggatcagggagc

SEQ ID NO: 602211 - DNA, 20 bp, mouse
gaggttcagggaggacattg

SEQ ID NO: 602212 - DNA, 20 bp, mouse
gggcaagcagggcaccagaa

SEQ ID NO: 602213 - DNA, 20 bp, mouse
gtccacaggtaggttcaggg

SEQ ID NO: 602214 - DNA, 20 bp, mouse
gagctccacaggtaggttca

SEQ ID NO: 602215 - DNA, 20 bp, mouse
gagggacagtagcctctgat

SEQ ID NO: 602216 - DNA, 20 bp, mouse
gcagcaggctccggtcccca

SEQ ID NO: 602217 - DNA, 20 bp, mouse
gggtggggtgaggcatagga

SEQ ID NO: 602218 - DNA, 20 bp, mouse
gcacatacaagtggccccgt

SEQ ID NO: 602219 - DNA, 20 bp, mouse
ggaccggagcctgctggagg

SEQ ID NO: 602220 - DNA, 20 bp, mouse
gcaagtggccccgtggggac

SEQ ID NO: 602221 - DNA, 20 bp, mouse
gatgaagcagtgcaaaggtg

SEQ ID NO: 602222 - DNA, 20 bp, mouse
gtgggtgaccgtgaacctga

SEQ ID NO: 602223 - DNA, 20 bp, mouse
ggtcccatgaagcagtgcaa

SEQ ID NO: 602224 - DNA, 20 bp, mouse
ggatggtgacccatgatgga

SEQ ID NO: 602225 - DNA, 20 bp, mouse
ggcaggtgcctctctgtcca

SEQ ID NO: 602226 - DNA, 20 bp, mouse
gccagtagttcggtccgagg

SEQ ID NO: 602227 - DNA, 20 bp, mouse
gtccgagggggcggctccag

SEQ ID NO: 602228 - DNA, 20 bp, mouse
gcaggggcgcggctccgcgg

SEQ ID NO: 602229 - DNA, 20 bp, mouse
gcagaggacgaaaagcacac

SEQ ID NO: 602230 - DNA, 20 bp, mouse
gcggccgaggctgctccagg

SEQ ID NO: 602231 - DNA, 20 bp, mouse
gacgaagccggaggtcccga

SEQ ID NO: 602232 - DNA, 20 bp, mouse
gcgggcgacaggatctgcca

SEQ ID NO: 602233 - DNA, 20 bp, mouse
gaccccagagcccagcgacg

SEQ ID NO: 602234 - DNA, 20 bp, mouse
gtccacttggcccactgcac

SEQ ID NO: 602235 - DNA, 20 bp, mouse
gacgcagcggcaccgggtag

SEQ ID NO: 602236 - DNA, 20 bp, mouse
ggcgtcaggccgcttggtgg

SEQ ID NO: 602237 - DNA, 20 bp, mouse
gtcatcaagtcccaacacag

SEQ ID NO: 602238 - DNA, 20 bp, mouse
gtggcggcgactgggagcag

SEQ ID NO: 602239 - DNA, 20 bp, mouse
gcagctgctggcatccgtgg

SEQ ID NO: 602240 - DNA, 20 bp, mouse
ggcagtgtgagcccaagcac

SEQ ID NO: 602241 - DNA, 20 bp, mouse
gaacacagaggctgaaccgg

SEQ ID NO: 602242 - DNA, 20 bp, mouse
ggcccggggggcgagcacca

SEQ ID NO: 602243 - DNA, 20 bp, mouse
ggagcagctgctggcatccg

SEQ ID NO: 602244 - DNA, 20 bp, mouse
gcaggcgtcaggccgcttgg

SEQ ID NO: 602245 - DNA, 20 bp, mouse
gagcactggcgaggtcggaa

SEQ ID NO: 602246 - DNA, 20 bp, mouse
ggtgactagaaaaaacgaaa

SEQ ID NO: 602247 - DNA, 20 bp, mouse
gtgagcagaagagaaaacct

SEQ ID NO: 602248 - DNA, 20 bp, mouse
gctcatctccccaaactcag

SEQ ID NO: 602249 - DNA, 20 bp, mouse
gggcataaacacctggaaag

SEQ ID NO: 602250 - DNA, 20 bp, mouse
ggcgagcgagcgagaggcaa

SEQ ID NO: 602251 - DNA, 20 bp, mouse
gtaaacacctggaaagggga

SEQ ID NO: 602252 - DNA, 20 bp, mouse
ggacctgcacagcaggaggt

SEQ ID NO: 602253 - DNA, 20 bp, mouse
ggggcaccctgagtcaccat

SEQ ID NO: 602254 - DNA, 20 bp, mouse
ggcacctcggaccaccaggt

SEQ ID NO: 602255 - DNA, 20 bp, mouse
gagggctgctgaggtactaa

SEQ ID NO: 602256 - DNA, 20 bp, mouse
ggcaggagaaacccagccga

SEQ ID NO: 602257 - DNA, 20 bp, mouse
ggcgcggacgcccaccgcaa

SEQ ID NO: 602258 - DNA, 20 bp, mouse
ggcgagagcggaccttgttg

SEQ ID NO: 602259 - DNA, 20 bp, mouse
gccgcttcgcgctaagaaaa

SEQ ID NO: 602260 - DNA, 20 bp, mouse
gcgttccgggactgcgagag

SEQ ID NO: 602261 - DNA, 20 bp, mouse
gtgttggggttccttcggct

SEQ ID NO: 602262 - DNA, 20 bp, mouse
gtgggtcagaccgagatcac

SEQ ID NO: 602263 - DNA, 20 bp, mouse
ggaatctggggcgggcgtag

SEQ ID NO: 602264 - DNA, 20 bp, mouse
gaggggtgggtcctcaacaa

SEQ ID NO: 602265 - DNA, 20 bp, mouse
gcggacgcccaccgcaaggg

SEQ ID NO: 602266 - DNA, 20 bp, mouse
gcagctctccagaaactcag

SEQ ID NO: 602267 - DNA, 20 bp, mouse
gctcaaggcagtgcagcgtc

SEQ ID NO: 602268 - DNA, 20 bp, mouse
ggctccttcgcggtcactca

SEQ ID NO: 602269 - DNA, 20 bp, mouse
gctccagaaactcagaggtt

SEQ ID NO: 602270 - DNA, 20 bp, mouse
gcccgcgcccggctccttcg

SEQ ID NO: 602271 - DNA, 20 bp, mouse
ggtccggccccggaacaacc

SEQ ID NO: 602272 - DNA, 20 bp, mouse
gaggacccacgcggaacccg

SEQ ID NO: 602273 - DNA, 20 bp, mouse
gctgccttgagtgaccgcga

SEQ ID NO: 602274 - DNA, 20 bp, mouse
gcgggacagcggtcattctc

SEQ ID NO: 602275 - DNA, 20 bp, mouse
gggcgccccaaggacccacg

SEQ ID NO: 602276 - DNA, 20 bp, mouse
gtggcagggtgagcactact

SEQ ID NO: 602277 - DNA, 20 bp, mouse
ggaccaagacctggaagctg

SEQ ID NO: 602278 - DNA, 20 bp, mouse
gaggaggtgggaagtttcct

SEQ ID NO: 602279 - DNA, 20 bp, mouse
ggaggctctaagtgaagcaa

SEQ ID NO: 602280 - DNA, 20 bp, mouse
ggctgggtgggagcttgatg

SEQ ID NO: 602281 - DNA, 20 bp, mouse
ggagttagcagagccttggc

SEQ ID NO: 602282 - DNA, 20 bp, mouse
gaacatgcgtgcagcaggaa

SEQ ID NO: 602283 - DNA, 20 bp, mouse
ggagcctagcatgaaagtgg

SEQ ID NO: 602284 - DNA, 20 bp, mouse
gaccagcgagtagacagtcc

SEQ ID NO: 602285 - DNA, 20 bp, mouse
gcccgctgcagagacgtcac

SEQ ID NO: 602286 - DNA, 20 bp, mouse
ggagcttgtagactgcacag

SEQ ID NO: 602287 - DNA, 20 bp, mouse
ggactgcacagtggacttat

SEQ ID NO: 602288 - DNA, 20 bp, mouse
gtctctcttaaggctactca

SEQ ID NO: 602289 - DNA, 20 bp, mouse
gaggcatcctgataacacgt

SEQ ID NO: 602290 - DNA, 20 bp, mouse
gtgggtgtgtagatttacgg

SEQ ID NO: 602291 - DNA, 20 bp, mouse
gacgctggcgtgggccccca

SEQ ID NO: 602292 - DNA, 20 bp, mouse
gactgtgcacatctctcatc

SEQ ID NO: 602293 - DNA, 20 bp, mouse
gagcagacacgtgtagccag

SEQ ID NO: 602294 - DNA, 20 bp, mouse
ggctcaagcagaaatgagtc

SEQ ID NO: 602295 - DNA, 20 bp, mouse
ggttggtgacaagccagaat

SEQ ID NO: 602296 - DNA, 20 bp, mouse
gctgcctgggagctcctccc

SEQ ID NO: 602297 - DNA, 20 bp, mouse
gctgccagggaggagctccc

SEQ ID NO: 602298 - DNA, 20 bp, mouse
gcctcgcttgggtcctgcca

SEQ ID NO: 602299 - DNA, 20 bp, mouse
ggagctggagcctcactcct

SEQ ID NO: 602300 - DNA, 20 bp, mouse
gtcactcctgggagtttgct

SEQ ID NO: 602301 - DNA, 20 bp, mouse
gagaaccagactcctcgctt

SEQ ID NO: 602302 - DNA, 20 bp, mouse
ggagctgagatctgcgctga

SEQ ID NO: 602303 - DNA, 20 bp, mouse
gaggacccaagcgaggagtc

SEQ ID NO: 602304 - DNA, 20 bp, mouse
gctggggacctgtcacactc

SEQ ID NO: 602305 - DNA, 20 bp, mouse
gcagggagtgaagaacttca

SEQ ID NO: 602306 - DNA, 20 bp, mouse
gacctccaactacagaccag

SEQ ID NO: 602307 - DNA, 20 bp, mouse
gccagaggcagggattctga

SEQ ID NO: 602308 - DNA, 20 bp, mouse
ggattctgaaggatcaggct

SEQ ID NO: 602309 - DNA, 20 bp, mouse
gcaagcccctcgccatggtg

SEQ ID NO: 602310 - DNA, 20 bp, mouse
gaggctgggtaggacactgc

SEQ ID NO: 602311 - DNA, 20 bp, mouse
ggcagggattctgaaggatc

SEQ ID NO: 602312 - DNA, 20 bp, mouse
gcctgcctctggtctgtagt

SEQ ID NO: 602313 - DNA, 20 bp, mouse
gtccaccccaccatggcgag

SEQ ID NO: 602314 - DNA, 20 bp, mouse
gagatccaagcccctcgcca

SEQ ID NO: 602315 - DNA, 20 bp, mouse
ggcaatgggctcacaggtat

SEQ ID NO: 602316 - DNA, 20 bp, mouse
gggccgcgcggtctacggtc

SEQ ID NO: 602317 - DNA, 20 bp, mouse
ggcctccagctcgctcacaa

SEQ ID NO: 602318 - DNA, 20 bp, mouse
ggaagagagtccagggacta

SEQ ID NO: 602319 - DNA, 20 bp, mouse
ggggaggtgaagagagtcca

SEQ ID NO: 602320 - DNA, 20 bp, mouse
gagcaaccgaaagatcaacg

SEQ ID NO: 602321 - DNA, 20 bp, mouse
gacctttgtgagcgagctgg

SEQ ID NO: 602322 - DNA, 20 bp, mouse
gtgggtgtgccccaagctcg

SEQ ID NO: 602323 - DNA, 20 bp, mouse
ggcccgcacgggagccgtgg

SEQ ID NO: 602324 - DNA, 20 bp, mouse
gccgtgggccgcgcggtcta

SEQ ID NO: 602325 - DNA, 20 bp, mouse
ggacgcctacggcctccggg

SEQ ID NO: 602326 - DNA, 20 bp, mouse
ggtctgcacagcgcgcgcag

SEQ ID NO: 602327 - DNA, 20 bp, mouse
gtgcgggacgtggcgaggtg

SEQ ID NO: 602328 - DNA, 20 bp, mouse
gctcgccacgtcccgcacct

SEQ ID NO: 602329 - DNA, 20 bp, mouse
gcgcgcagcggcgggctctt

SEQ ID NO: 602330 - DNA, 20 bp, mouse
gagccgggaatacggagctg

SEQ ID NO: 602331 - DNA, 20 bp, mouse
gggcgcggagacccacgtgg

SEQ ID NO: 602332 - DNA, 20 bp, mouse
ggacgtggcgaggtgaggcg

SEQ ID NO: 602333 - DNA, 20 bp, mouse
gacccgccgaacccccacgt

SEQ ID NO: 602334 - DNA, 20 bp, mouse
gcaccgcccagccgggaata

SEQ ID NO: 602335 - DNA, 20 bp, mouse
gggcgggctcttcggcgccg

SEQ ID NO: 602336 - DNA, 20 bp, mouse
gcgatgcggcggggagacag

SEQ ID NO: 602337 - DNA, 20 bp, mouse
gtgcgtgctgaggcgggacg

SEQ ID NO: 602338 - DNA, 20 bp, mouse
gcccgcctggccggctccgg

SEQ ID NO: 602339 - DNA, 20 bp, mouse
gtcagcacgcaggcgccctc

SEQ ID NO: 602340 - DNA, 20 bp, mouse
gggcgcctgcgtgctgaggc

SEQ ID NO: 602341 - DNA, 20 bp, mouse
ggccggccgagaagcactcg

SEQ ID NO: 602342 - DNA, 20 bp, mouse
gacgcaggcgccctccggcc

SEQ ID NO: 602343 - DNA, 20 bp, mouse
ggggctacggctagaaggga

SEQ ID NO: 602344 - DNA, 20 bp, mouse
ggctaccagctggtagacgg

SEQ ID NO: 602345 - DNA, 20 bp, mouse
ggccgccggagccggccagg

SEQ ID NO: 602346 - DNA, 20 bp, mouse
ggctacccggccgaacccta

SEQ ID NO: 602347 - DNA, 20 bp, mouse
gggaggagcccggagaggat

SEQ ID NO: 602348 - DNA, 20 bp, mouse
gcccagagcccaaatctcaa

SEQ ID NO: 602349 - DNA, 20 bp, mouse
gccctacggttgcaaatggg

SEQ ID NO: 602350 - DNA, 20 bp, mouse
gtagaggacgaggaccctgg

SEQ ID NO: 602351 - DNA, 20 bp, mouse
ggtgctcccctatcctctcc

SEQ ID NO: 602352 - DNA, 20 bp, mouse
ggaggataggggagcaccac

SEQ ID NO: 602353 - DNA, 20 bp, mouse
ggaaccctacggttgcaaat

SEQ ID NO: 602354 - DNA, 20 bp, mouse
ggtaggaggccgcagagagg

SEQ ID NO: 602355 - DNA, 20 bp, mouse
gaatggagtgagacaagagg

SEQ ID NO: 602356 - DNA, 20 bp, mouse
gtctgtgtcggacatgacga

SEQ ID NO: 602357 - DNA, 20 bp, mouse
ggtcggacatgacgacggaa

SEQ ID NO: 602358 - DNA, 20 bp, mouse
ggcgagagggctcaactcgg

SEQ ID NO: 602359 - DNA, 20 bp, mouse
gcgctccctgacccaaccag

SEQ ID NO: 602360 - DNA, 20 bp, mouse
gccaccccgggcccatgggc

SEQ ID NO: 602361 - DNA, 20 bp, mouse
gacagacagcgacgaagagt

SEQ ID NO: 602362 - DNA, 20 bp, mouse
gactcggaggaaggacgaag

SEQ ID NO: 602363 - DNA, 20 bp, mouse
gagcgcgagagggctcaact

SEQ ID NO: 602364 - DNA, 20 bp, mouse
gcatgggcccggggtgggct

SEQ ID NO: 602365 - DNA, 20 bp, mouse
gtcttcgtcgctgtctgtgt

SEQ ID NO: 602366 - DNA, 20 bp, mouse
gcagcgggagccgacaccag

SEQ ID NO: 602367 - DNA, 20 bp, mouse
gatggggccggtgggaaagg

SEQ ID NO: 602368 - DNA, 20 bp, mouse
gagcggcgcgggccaggtga

SEQ ID NO: 602369 - DNA, 20 bp, mouse
gccgttggccgcgctcggta

SEQ ID NO: 602370 - DNA, 20 bp, mouse
gccatgagctgcagcggctc

SEQ ID NO: 602371 - DNA, 20 bp, mouse
gcaggtgggaagcgcaccgt

SEQ ID NO: 602372 - DNA, 20 bp, mouse
gacgggccccgtggcggcac

SEQ ID NO: 602373 - DNA, 20 bp, mouse
gggtccggcacccctggtgt

SEQ ID NO: 602374 - DNA, 20 bp, mouse
ggcgcctgggcgagcggaag

SEQ ID NO: 602375 - DNA, 20 bp, mouse
gcaggtggccttgttcaggt

SEQ ID NO: 602376 - DNA, 20 bp, mouse
gccacagctccttctcccgg

SEQ ID NO: 602377 - DNA, 20 bp, mouse
gtggcagcaccgccgggaga

SEQ ID NO: 602378 - DNA, 20 bp, mouse
gaggcgatggcagcaccgcc

SEQ ID NO: 602379 - DNA, 20 bp, mouse
ggggagtcgcccacagacaa

SEQ ID NO: 602380 - DNA, 20 bp, mouse
gctcgcgatggacaacctcg

SEQ ID NO: 602381 - DNA, 20 bp, mouse
ggtctgtgggcgactccccg

SEQ ID NO: 602382 - DNA, 20 bp, mouse
ggtacaagcaggcctgaata

SEQ ID NO: 602383 - DNA, 20 bp, mouse
gagagggaacgggaaggtgt

SEQ ID NO: 602384 - DNA, 20 bp, mouse
ggccgcggcggaggaaagcg

SEQ ID NO: 602385 - DNA, 20 bp, mouse
gtaacgctgcaggactaccc

SEQ ID NO: 602386 - DNA, 20 bp, mouse
gggctcggctccgcacaccg

SEQ ID NO: 602387 - DNA, 20 bp, mouse
ggtgagcccgcttggcggag

SEQ ID NO: 602388 - DNA, 20 bp, mouse
gtgcaggtgagcccgcttgg

SEQ ID NO: 602389 - DNA, 20 bp, mouse
gagcgggctcacctgcacgg

SEQ ID NO: 602390 - DNA, 20 bp, mouse
ggcccccttgcccacctagt

SEQ ID NO: 602391 - DNA, 20 bp, mouse
gcgagccccgcccactaggt

SEQ ID NO: 602392 - DNA, 20 bp, mouse
ggccaggtggcggagatcgg

SEQ ID NO: 602393 - DNA, 20 bp, mouse
ggcttggcggaggggagcct

SEQ ID NO: 602394 - DNA, 20 bp, mouse
gaccgcgcctgcgccaggct

SEQ ID NO: 602395 - DNA, 20 bp, mouse
ggcgccgagccccgcccact

SEQ ID NO: 602396 - DNA, 20 bp, mouse
ggagggccgcgcagtcggac

SEQ ID NO: 602397 - DNA, 20 bp, mouse
gggcagtctccgcatatcat

SEQ ID NO: 602398 - DNA, 20 bp, mouse
gtctatctccccatgatatg

SEQ ID NO: 602399 - DNA, 20 bp, mouse
gctaggctgtggaagagacg

SEQ ID NO: 602400 - DNA, 20 bp, mouse
ggctgagacgaaagcttcac

SEQ ID NO: 602401 - DNA, 20 bp, mouse
gtgccggaagtgcttgggga

SEQ ID NO: 602402 - DNA, 20 bp, mouse
gttcgggctcgcagaagcag

SEQ ID NO: 602403 - DNA, 20 bp, mouse
gctcttgggacgggacttga

SEQ ID NO: 602404 - DNA, 20 bp, mouse
gtgctggaagaactaggctg

SEQ ID NO: 602405 - DNA, 20 bp, mouse
gagcggtgccggaagtgctt

SEQ ID NO: 602406 - DNA, 20 bp, mouse
gtgagacaggcgctcactca

SEQ ID NO: 602407 - DNA, 20 bp, mouse
gacaggcgctcactcacggt

SEQ ID NO: 602408 - DNA, 20 bp, mouse
ggccggtgggcgggttcaga

SEQ ID NO: 602409 - DNA, 20 bp, mouse
gtgcgtgggacaagacggga

SEQ ID NO: 602410 - DNA, 20 bp, mouse
gaaactcgccagccgccggt

SEQ ID NO: 602411 - DNA, 20 bp, mouse
ggccttctgaacccgcccac

SEQ ID NO: 602412 - DNA, 20 bp, mouse
gtgaggaaccaggctgagac

SEQ ID NO: 602413 - DNA, 20 bp, mouse
gctctcggcgggaatcccta

SEQ ID NO: 602414 - DNA, 20 bp, mouse
gcgggaaggaagagtagaaa

SEQ ID NO: 602415 - DNA, 20 bp, mouse
ggtcagtgcgtgggacaaga

SEQ ID NO: 602416 - DNA, 20 bp, mouse
gccacggcccgcggagaaca

SEQ ID NO: 602417 - DNA, 20 bp, mouse
gaggaaaacgaaaagccagg

SEQ ID NO: 602418 - DNA, 20 bp, mouse
ggctgctggagctgctctga

SEQ ID NO: 602419 - DNA, 20 bp, mouse
ggcggcgcggagccccgcca

SEQ ID NO: 602420 - DNA, 20 bp, mouse
gaaagactccggcctgaggg

SEQ ID NO: 602421 - DNA, 20 bp, mouse
gtccctcgcggccctccggt

SEQ ID NO: 602422 - DNA, 20 bp, mouse
gtcatctccccaggttccaa

SEQ ID NO: 602423 - DNA, 20 bp, mouse
gtgcctccggtccaacatgg

SEQ ID NO: 602424 - DNA, 20 bp, mouse
ggctgttagtcatgtcgggt

SEQ ID NO: 602425 - DNA, 20 bp, mouse
gggccgcgagggaaagactc

SEQ ID NO: 602426 - DNA, 20 bp, mouse
gtccggggcggcgaacaacg

SEQ ID NO: 602427 - DNA, 20 bp, mouse
gacgtggagtcgggcgactc

SEQ ID NO: 602428 - DNA, 20 bp, mouse
gcggcgaacaacgtggagtc

SEQ ID NO: 602429 - DNA, 20 bp, mouse
gctctggagcttggatttag

SEQ ID NO: 602430 - DNA, 20 bp, mouse
gttccggacagggttttccg

SEQ ID NO: 602431 - DNA, 20 bp, mouse
gactgaaagcgcaaggcgta

SEQ ID NO: 602432 - DNA, 20 bp, mouse
gcgttaactgcttccggaca

SEQ ID NO: 602433 - DNA, 20 bp, mouse
ggtcgggcgactctggagct

SEQ ID NO: 602434 - DNA, 20 bp, mouse
gcggacagggttttccgggg

SEQ ID NO: 602435 - DNA, 20 bp, mouse
gaaccgcagaaggaacaagc

SEQ ID NO: 602436 - DNA, 20 bp, mouse
gggaggtggtaaggacctag

SEQ ID NO: 602437 - DNA, 20 bp, mouse
ggtctgcagcggagcctcga

SEQ ID NO: 602438 - DNA, 20 bp, mouse
gtccctggcccattgagtta

SEQ ID NO: 602439 - DNA, 20 bp, mouse
gggaggaggagcagcgccca

SEQ ID NO: 602440 - DNA, 20 bp, mouse
gcatagggggcggagcgaag

SEQ ID NO: 602441 - DNA, 20 bp, mouse
ggacaagcagccaggttccg

SEQ ID NO: 602442 - DNA, 20 bp, mouse
gtcctcctcctggctatccc

SEQ ID NO: 602443 - DNA, 20 bp, mouse
gggggccgtgggccagaaag

SEQ ID NO: 602444 - DNA, 20 bp, mouse
gtggtgtccgtaccctagac

SEQ ID NO: 602445 - DNA, 20 bp, mouse
gccacttgggccccggaacc

SEQ ID NO: 602446 - DNA, 20 bp, mouse
gctgctccaacagttgtggg

SEQ ID NO: 602447 - DNA, 20 bp, mouse
ggcggccccggggtcaggtg

SEQ ID NO: 602448 - DNA, 20 bp, mouse
gcctgaccccggggccgcaa

SEQ ID NO: 602449 - DNA, 20 bp, mouse
gcccgctggacaagacgtga

SEQ ID NO: 602450 - DNA, 20 bp, mouse
gagtctgctccaacagttgt

SEQ ID NO: 602451 - DNA, 20 bp, mouse
ggggtggcggcgttgaggtt

SEQ ID NO: 602452 - DNA, 20 bp, mouse
gacagcctcacctgaccccg

SEQ ID NO: 602453 - DNA, 20 bp, mouse
gcgccgccacccacaactgt

SEQ ID NO: 602454 - DNA, 20 bp, mouse
ggcgttgaggttcggcactc

SEQ ID NO: 602455 - DNA, 20 bp, mouse
gctccaacagttgtgggtgg

SEQ ID NO: 602456 - DNA, 20 bp, mouse
gacgcggcggaagaggtaag

SEQ ID NO: 602457 - DNA, 20 bp, mouse
gcagcacgcgaccccttaca

SEQ ID NO: 602458 - DNA, 20 bp, mouse
gggtaagcggttgttcactg

SEQ ID NO: 602459 - DNA, 20 bp, mouse
gcagcagccggactaggaca

SEQ ID NO: 602460 - DNA, 20 bp, mouse
gctccaggcccagaacacct

SEQ ID NO: 602461 - DNA, 20 bp, mouse
gaggtctgctgcgggcgacg

SEQ ID NO: 602462 - DNA, 20 bp, mouse
gtccgggtcgctgttgggag

SEQ ID NO: 602463 - DNA, 20 bp, mouse
gtggccgctcaggtctgctg

SEQ ID NO: 602464 - DNA, 20 bp, mouse
ggggagcgctcttttcgacg

SEQ ID NO: 602465 - DNA, 20 bp, mouse
gggagaggccgaggtgttct

SEQ ID NO: 602466 - DNA, 20 bp, mouse
ggcgctacaggagctctaag

SEQ ID NO: 602467 - DNA, 20 bp, mouse
gagatgtccgcaggcggcgg

SEQ ID NO: 602468 - DNA, 20 bp, mouse
gctctgacgtcaccggtcag

SEQ ID NO: 602469 - DNA, 20 bp, mouse
gccggcaagatgtccgcagg

SEQ ID NO: 602470 - DNA, 20 bp, mouse
gtgaccggcaagatgtccgc

SEQ ID NO: 602471 - DNA, 20 bp, mouse
gaggactctaagccggtggg

SEQ ID NO: 602472 - DNA, 20 bp, mouse
gggcatgaagagctcctgcg

SEQ ID NO: 602473 - DNA, 20 bp, mouse
gcttgccggtcacctctgac

SEQ ID NO: 602474 - DNA, 20 bp, mouse
ggtcaccggtcagaggtgac

SEQ ID NO: 602475 - DNA, 20 bp, mouse
gcacagatgagccgcgctac

SEQ ID NO: 602476 - DNA, 20 bp, mouse
gaggcggagcgagtccaaaa

SEQ ID NO: 602477 - DNA, 20 bp, mouse
gccggcggccgtccagcggg

SEQ ID NO: 602478 - DNA, 20 bp, mouse
gtgctgctgaggctttgagg

SEQ ID NO: 602479 - DNA, 20 bp, mouse
gtgaggtggtcgctccgggt

SEQ ID NO: 602480 - DNA, 20 bp, mouse
gtggtcgctccgggtcggag

SEQ ID NO: 602481 - DNA, 20 bp, mouse
gtcgttgttgagggtctcgg

SEQ ID NO: 602482 - DNA, 20 bp, mouse
ggtccaaaatggcggctctc

SEQ ID NO: 602483 - DNA, 20 bp, mouse
ggatgtgcgagagttactct

SEQ ID NO: 602484 - DNA, 20 bp, mouse
gtgcccaaaggggtccggag

SEQ ID NO: 602485 - DNA, 20 bp, mouse
gaatcgtcccccctccgacc

SEQ ID NO: 602486 - DNA, 20 bp, mouse
gggcgcgctcggccgagcgg

SEQ ID NO: 602487 - DNA, 20 bp, mouse
gggctcggatctgctggacg

SEQ ID NO: 602488 - DNA, 20 bp, mouse
gagcgaggtggacgagaaag

SEQ ID NO: 602489 - DNA, 20 bp, mouse
gccctgcggggacaagcaag

SEQ ID NO: 602490 - DNA, 20 bp, mouse
gaagtggtgagcgatctggt

SEQ ID NO: 602491 - DNA, 20 bp, mouse
ggcaggaggaggttccagcg

SEQ ID NO: 602492 - DNA, 20 bp, mouse
gtcgggaaccatgttgtgag

SEQ ID NO: 602493 - DNA, 20 bp, mouse
ggtcttcttcaacagcgagg

SEQ ID NO: 602494 - DNA, 20 bp, mouse
gcgggctgccgctcacaaca

SEQ ID NO: 602495 - DNA, 20 bp, mouse
ggcggcgggctcggatctgc

SEQ ID NO: 602496 - DNA, 20 bp, mouse
ggtttgtgcggagcgcgtgt

SEQ ID NO: 602497 - DNA, 20 bp, mouse
gggcgagcggcaggagactc

SEQ ID NO: 602498 - DNA, 20 bp, mouse
gagcgcgtgtgggtcgcctg

SEQ ID NO: 602499 - DNA, 20 bp, mouse
gccgctgagggagtgcccgg

SEQ ID NO: 602500 - DNA, 20 bp, mouse
gagccgcgccggggtttgtg

SEQ ID NO: 602501 - DNA, 20 bp, mouse
gcacccggggagctttaact

SEQ ID NO: 602502 - DNA, 20 bp, mouse
gggtcgcctgcggactctgc

SEQ ID NO: 602503 - DNA, 20 bp, mouse
gcggaccggcagctccctca

SEQ ID NO: 602504 - DNA, 20 bp, mouse
gacgcgctccgcacaaaccc

SEQ ID NO: 602505 - DNA, 20 bp, mouse
gcatgccctcggaggctcag

SEQ ID NO: 602506 - DNA, 20 bp, mouse
ggcagcgtcggcggtccctc

SEQ ID NO: 602507 - DNA, 20 bp, mouse
gcggtcaagctagagcctga

SEQ ID NO: 602508 - DNA, 20 bp, mouse
gcctgcggaggtagcagcgt

SEQ ID NO: 602509 - DNA, 20 bp, mouse
gcggcggagacagccacccc

SEQ ID NO: 602510 - DNA, 20 bp, mouse
gcacgcttgacggcgcgagg

SEQ ID NO: 602511 - DNA, 20 bp, mouse
ggcggaggtagcagcgtcgg

SEQ ID NO: 602512 - DNA, 20 bp, mouse
gcgccgtcgccagcctgcgg

SEQ ID NO: 602513 - DNA, 20 bp, mouse
ggcggcggcactcccaacaa

SEQ ID NO: 602514 - DNA, 20 bp, mouse
gccaacaacggccccaacgg

SEQ ID NO: 602515 - DNA, 20 bp, mouse
gctcccaacaacggccccaa

SEQ ID NO: 602516 - DNA, 20 bp, mouse
ggcgagcgcgggaggacgta

SEQ ID NO: 602517 - DNA, 20 bp, mouse
gctacggcgggcaaccgata

SEQ ID NO: 602518 - DNA, 20 bp, mouse
gccatgaccgcctgacggag

SEQ ID NO: 602519 - DNA, 20 bp, mouse
gggcacgccgggctaggccg

SEQ ID NO: 602520 - DNA, 20 bp, mouse
gccgcgctcgcggttctcgg

SEQ ID NO: 602521 - DNA, 20 bp, mouse
ggccaactgcgagctcacga

SEQ ID NO: 602522 - DNA, 20 bp, mouse
gcagggccgggactgcgcag

SEQ ID NO: 602523 - DNA, 20 bp, mouse
gccggcgtgcccgctccgtc

SEQ ID NO: 602524 - DNA, 20 bp, mouse
ggagggcgctcggcggaagt

SEQ ID NO: 602525 - DNA, 20 bp, mouse
ggtcgtcgtacggagtccta

SEQ ID NO: 602526 - DNA, 20 bp, mouse
ggcgctttggcagcggtgag

SEQ ID NO: 602527 - DNA, 20 bp, mouse
gccctgacaggagtaggtcc

SEQ ID NO: 602528 - DNA, 20 bp, mouse
gctgcactggaaggatggtg

SEQ ID NO: 602529 - DNA, 20 bp, mouse
gacccgggcagcgctacagg

SEQ ID NO: 602530 - DNA, 20 bp, mouse
gcgccgggtgagcggcgctt

SEQ ID NO: 602531 - DNA, 20 bp, mouse
gggatggtggggcgatgtag

SEQ ID NO: 602532 - DNA, 20 bp, mouse
gcccggtgcttggctggcgg

SEQ ID NO: 602533 - DNA, 20 bp, mouse
gagtctgaggtgtatccgtg

SEQ ID NO: 602534 - DNA, 20 bp, mouse
gcgtgactgcactggaagga

SEQ ID NO: 602535 - DNA, 20 bp, mouse
gagaggactgggacccgacc

SEQ ID NO: 602536 - DNA, 20 bp, mouse
gggaagcgatccctggatcg

SEQ ID NO: 602537 - DNA, 20 bp, mouse
ggagcctgggcgcggagaga

SEQ ID NO: 602538 - DNA, 20 bp, mouse
ggacggctgcttccactcac

SEQ ID NO: 602539 - DNA, 20 bp, mouse
gtgctcacctgcagactccg

SEQ ID NO: 602540 - DNA, 20 bp, mouse
gacctgcagactccggggtt

SEQ ID NO: 602541 - DNA, 20 bp, mouse
gattaccgtgagccggtgag

SEQ ID NO: 602542 - DNA, 20 bp, mouse
ggggtcgagtggggagatca

SEQ ID NO: 602543 - DNA, 20 bp, mouse
gtcccaaccccggagtctgc

SEQ ID NO: 602544 - DNA, 20 bp, mouse
gcaggtcctgccccgatcca

SEQ ID NO: 602545 - DNA, 20 bp, mouse
gaagggtgcagggtcgagtg

SEQ ID NO: 602546 - DNA, 20 bp, mouse
gctctcagagaaccgaacac

SEQ ID NO: 602547 - DNA, 20 bp, mouse
gtgagacggctaaggacccg

SEQ ID NO: 602548 - DNA, 20 bp, mouse
ggacgtgggaaagttgtctc

SEQ ID NO: 602549 - DNA, 20 bp, mouse
ggctggtgaactgtaagtac

SEQ ID NO: 602550 - DNA, 20 bp, mouse
ggtcagagcggaagcagacg

SEQ ID NO: 602551 - DNA, 20 bp, mouse
gcacagaccggaagcagaca

SEQ ID NO: 602552 - DNA, 20 bp, mouse
gctatgcgctaacaatgaga

SEQ ID NO: 602553 - DNA, 20 bp, mouse
gacctgaacagcaaaagaaa

SEQ ID NO: 602554 - DNA, 20 bp, mouse
gcgaaagtgctccgtcagag

SEQ ID NO: 602555 - DNA, 20 bp, mouse
ggcggcgctacgtcacagac

SEQ ID NO: 602556 - DNA, 20 bp, mouse
gaagaagccccggccagcag

SEQ ID NO: 602557 - DNA, 20 bp, mouse
gctggctgagatcctaactc

SEQ ID NO: 602558 - DNA, 20 bp, mouse
ggattctaagctcctgagtt

SEQ ID NO: 602559 - DNA, 20 bp, mouse
gcacctgccgctgctggccg

SEQ ID NO: 602560 - DNA, 20 bp, mouse
gagagatgtccaagaagccc

SEQ ID NO: 602561 - DNA, 20 bp, mouse
gcaccaggccccgggagtgt

SEQ ID NO: 602562 - DNA, 20 bp, mouse
ggagataagccagatgtgag

SEQ ID NO: 602563 - DNA, 20 bp, mouse
gagtgtgggaagtgtctccg

SEQ ID NO: 602564 - DNA, 20 bp, mouse
gagccccggccagcagcggc

SEQ ID NO: 602565 - DNA, 20 bp, mouse
gcgcagagaggtccgagcac

SEQ ID NO: 602566 - DNA, 20 bp, mouse
ggcgaggaagcacccactga

SEQ ID NO: 602567 - DNA, 20 bp, mouse
gcaggcggagctccctcagt

SEQ ID NO: 602568 - DNA, 20 bp, mouse
ggagggagctccgcctgagg

SEQ ID NO: 602569 - DNA, 20 bp, mouse
gcctccaccaaagccccctc

SEQ ID NO: 602570 - DNA, 20 bp, mouse
gccaccaaagccccctcagg

SEQ ID NO: 602571 - DNA, 20 bp, mouse
gctcagaagaccccccgcca

SEQ ID NO: 602572 - DNA, 20 bp, mouse
ggcgggggcttcaggaataa

SEQ ID NO: 602573 - DNA, 20 bp, mouse
gctcgaggcccaccgactcc

SEQ ID NO: 602574 - DNA, 20 bp, mouse
gtgagtcatggagcgcggcg

SEQ ID NO: 602575 - DNA, 20 bp, mouse
gccccaagtattctgagtca

SEQ ID NO: 602576 - DNA, 20 bp, mouse
gggtggctccggaacggtaa

SEQ ID NO: 602577 - DNA, 20 bp, mouse
gggctccggaacggtaaggg

SEQ ID NO: 602578 - DNA, 20 bp, mouse
gagcaagatggctgacacgg

SEQ ID NO: 602579 - DNA, 20 bp, mouse
ggggcctggtggctccggaa

SEQ ID NO: 602580 - DNA, 20 bp, mouse
gacactacgcaagagcaaga

SEQ ID NO: 602581 - DNA, 20 bp, mouse
gagaccgtggcccaaaccgt

SEQ ID NO: 602582 - DNA, 20 bp, mouse
gaggcccgctctgagacccg

SEQ ID NO: 602583 - DNA, 20 bp, mouse
gtaggcatcaccgcagagaa

SEQ ID NO: 602584 - DNA, 20 bp, mouse
gctctccacccttaccgttc

SEQ ID NO: 602585 - DNA, 20 bp, mouse
gaagcagcggggaccgccta

SEQ ID NO: 602586 - DNA, 20 bp, mouse
gggcgcgtgagcggaggctt

SEQ ID NO: 602587 - DNA, 20 bp, mouse
gagcgtccggcggagcgacg

SEQ ID NO: 602588 - DNA, 20 bp, mouse
gctccctggcaagcgcgtcg

SEQ ID NO: 602589 - DNA, 20 bp, mouse
ggcgcttgccagggaggaac

SEQ ID NO: 602590 - DNA, 20 bp, mouse
ggtcggggcgggcgcgtgag

SEQ ID NO: 602591 - DNA, 20 bp, mouse
gcagacgccgcgccgaggag

SEQ ID NO: 602592 - DNA, 20 bp, mouse
ggagggctgtgaggtcccgg

SEQ ID NO: 602593 - DNA, 20 bp, mouse
gcggctggcgcgtcaggacc

SEQ ID NO: 602594 - DNA, 20 bp, mouse
ggccagggaggaaccggaaa

SEQ ID NO: 602595 - DNA, 20 bp, mouse
ggtgatctggagctgatcgt

SEQ ID NO: 602596 - DNA, 20 bp, mouse
gctctcggagcgttcttgat

SEQ ID NO: 602597 - DNA, 20 bp, mouse
gtccccgcgcgcgcttacca

SEQ ID NO: 602598 - DNA, 20 bp, mouse
ggagcaaggacggagcccca

SEQ ID NO: 602599 - DNA, 20 bp, mouse
gaacgctccgagagatgcct

SEQ ID NO: 602600 - DNA, 20 bp, mouse
gaaaatggagccggccaaga

SEQ ID NO: 602601 - DNA, 20 bp, mouse
gccagcgagacaaagccccg

SEQ ID NO: 602602 - DNA, 20 bp, mouse
gccgcggcagccctttggag

SEQ ID NO: 602603 - DNA, 20 bp, mouse
gggctttccaggcagaggta

SEQ ID NO: 602604 - DNA, 20 bp, mouse
gttcttgataggcgccatct

SEQ ID NO: 602605 - DNA, 20 bp, mouse
gaggacggagccccagggac

SEQ ID NO: 602606 - DNA, 20 bp, mouse
gctctgtgggtggactccta

SEQ ID NO: 602607 - DNA, 20 bp, mouse
gaacatgacactctgaccct

SEQ ID NO: 602608 - DNA, 20 bp, mouse
gctggcgaactgtggaaaac

SEQ ID NO: 602609 - DNA, 20 bp, mouse
ggcccagtgccttgtctctg

SEQ ID NO: 602610 - DNA, 20 bp, mouse
gtccattcagagtccttcta

SEQ ID NO: 602611 - DNA, 20 bp, mouse
gccagaggtaaaaagagctc

SEQ ID NO: 602612 - DNA, 20 bp, mouse
gagtgccttgtctctgtggg

SEQ ID NO: 602613 - DNA, 20 bp, mouse
gctctgaatggagaatgcta

SEQ ID NO: 602614 - DNA, 20 bp, mouse
ggtgtcagctgccagcttgg

SEQ ID NO: 602615 - DNA, 20 bp, mouse
gactcagcacacgaggctga

SEQ ID NO: 602616 - DNA, 20 bp, mouse
gtgctgaaccgcatcaaggg

SEQ ID NO: 602617 - DNA, 20 bp, mouse
ggcgtgctgaaccgcatcaa

SEQ ID NO: 602618 - DNA, 20 bp, mouse
gtcggggcttcgcggggcgc

SEQ ID NO: 602619 - DNA, 20 bp, mouse
gcggggctcggggcttcgcg

SEQ ID NO: 602620 - DNA, 20 bp, mouse
gcgcatcaagggcggcgggg

SEQ ID NO: 602621 - DNA, 20 bp, mouse
ggcgggcagcgagcgacgga

SEQ ID NO: 602622 - DNA, 20 bp, mouse
gtgaaccgcatcaagggcgg

SEQ ID NO: 602623 - DNA, 20 bp, mouse
ggtggtggccgaggaagaca

SEQ ID NO: 602624 - DNA, 20 bp, mouse
gtcttggagaagcaagatgg

SEQ ID NO: 602625 - DNA, 20 bp, mouse
gtcctcggccaccaccgcgg

SEQ ID NO: 602626 - DNA, 20 bp, mouse
gcccatgacttgcacttaca

SEQ ID NO: 602627 - DNA, 20 bp, mouse
ggcaagtcatgggagcagaa

SEQ ID NO: 602628 - DNA, 20 bp, mouse
gtagccctggggaccatcag

SEQ ID NO: 602629 - DNA, 20 bp, mouse
gggcttggtcgtttgtggac

SEQ ID NO: 602630 - DNA, 20 bp, mouse
gcagggctaatgcaactcgg

SEQ ID NO: 602631 - DNA, 20 bp, mouse
gagcttcggtgtctgggctg

SEQ ID NO: 602632 - DNA, 20 bp, mouse
ggccccagtcaaatcatcct

SEQ ID NO: 602633 - DNA, 20 bp, mouse
ggagagtagcttcggtgtct

SEQ ID NO: 602634 - DNA, 20 bp, mouse
gtgtctgggctggggcagac

SEQ ID NO: 602635 - DNA, 20 bp, mouse
gagcccatacacctatgggt

SEQ ID NO: 602636 - DNA, 20 bp, mouse
ggagagcgcacgcacgacag

SEQ ID NO: 602637 - DNA, 20 bp, mouse
gtcctgctcaccgtccaaga

SEQ ID NO: 602638 - DNA, 20 bp, mouse
gctcatccagccctcttgga

SEQ ID NO: 602639 - DNA, 20 bp, mouse
gcgcacgacaggggctgcag

SEQ ID NO: 602640 - DNA, 20 bp, mouse
gggacggtgagcaggactga

SEQ ID NO: 602641 - DNA, 20 bp, mouse
ggctcaccgtccaagagggc

SEQ ID NO: 602642 - DNA, 20 bp, mouse
gcgctctcatccagccctct

SEQ ID NO: 602643 - DNA, 20 bp, mouse
ggcgagtggagctcaagacc

SEQ ID NO: 602644 - DNA, 20 bp, mouse
gtggagctcaagacccggcc

SEQ ID NO: 602645 - DNA, 20 bp, mouse
gacgtccgcaggctgctgag

SEQ ID NO: 602646 - DNA, 20 bp, mouse
gagcagccacaggagccccc

SEQ ID NO: 602647 - DNA, 20 bp, mouse
gagagaagagaggacacacg

SEQ ID NO: 602648 - DNA, 20 bp, mouse
ggggttctcaggaaacccgg

SEQ ID NO: 602649 - DNA, 20 bp, mouse
gtgagaacccggctgggatg

SEQ ID NO: 602650 - DNA, 20 bp, mouse
gtcctgtggctgctattgtg

SEQ ID NO: 602651 - DNA, 20 bp, mouse
ggccagccctggagaaataa

SEQ ID NO: 602652 - DNA, 20 bp, mouse
gttccagagatggctaacag

SEQ ID NO: 602653 - DNA, 20 bp, mouse
gtccacacaatagcagccac

SEQ ID NO: 602654 - DNA, 20 bp, mouse
ggccctggccagcccacggg

SEQ ID NO: 602655 - DNA, 20 bp, mouse
gcccggtgagacccagacct

SEQ ID NO: 602656 - DNA, 20 bp, mouse
gcagaccgcgcaggacctca

SEQ ID NO: 602657 - DNA, 20 bp, mouse
ggctggagaggggtcgaggt

SEQ ID NO: 602658 - DNA, 20 bp, mouse
gccactcctccgctggagag

SEQ ID NO: 602659 - DNA, 20 bp, mouse
ggaggtaggaccccgaagct

SEQ ID NO: 602660 - DNA, 20 bp, mouse
gaggtcctaaccagccgagt

SEQ ID NO: 602661 - DNA, 20 bp, mouse
gcggcaagctaagtaactgc

SEQ ID NO: 602662 - DNA, 20 bp, mouse
ggagccgggaaacccagctt

SEQ ID NO: 602663 - DNA, 20 bp, mouse
gccaggccgcaactaacctg

SEQ ID NO: 602664 - DNA, 20 bp, mouse
gtggtctctcagcgagagcc

SEQ ID NO: 602665 - DNA, 20 bp, mouse
gtgctcggaaccgggaccat

SEQ ID NO: 602666 - DNA, 20 bp, mouse
gagtgggcggcagctctgtc

SEQ ID NO: 602667 - DNA, 20 bp, mouse
gggggacccccgcaacacca

SEQ ID NO: 602668 - DNA, 20 bp, mouse
gagccagtgttggctcggat

SEQ ID NO: 602669 - DNA, 20 bp, mouse
gcgcccatccgagccaacac

SEQ ID NO: 602670 - DNA, 20 bp, mouse
ggggcggcagctctgtccgg

SEQ ID NO: 602671 - DNA, 20 bp, mouse
gccaaggcacagacagcctc

SEQ ID NO: 602672 - DNA, 20 bp, mouse
gttccccccgcacacaccag

SEQ ID NO: 602673 - DNA, 20 bp, mouse
gcgtccgcggtggttgggag

SEQ ID NO: 602674 - DNA, 20 bp, mouse
gcgcgaaactgaccagaaat

SEQ ID NO: 602675 - DNA, 20 bp, mouse
ggggcagctaacctgctagg

SEQ ID NO: 602676 - DNA, 20 bp, mouse
gctgggaaccggcgcagtca

SEQ ID NO: 602677 - DNA, 20 bp, mouse
gagaccctgcgtccaggcga

SEQ ID NO: 602678 - DNA, 20 bp, mouse
gtggcagagaccctgcgtcc

SEQ ID NO: 602679 - DNA, 20 bp, mouse
gagtgggagcagctaccgag

SEQ ID NO: 602680 - DNA, 20 bp, mouse
ggtcaacgcaccttcttgct

SEQ ID NO: 602681 - DNA, 20 bp, mouse
ggggtcgctaacagatctgg

SEQ ID NO: 602682 - DNA, 20 bp, mouse
gaacagatctggaggtggta

SEQ ID NO: 602683 - DNA, 20 bp, mouse
gagacctgcaaagtcttgga

SEQ ID NO: 602684 - DNA, 20 bp, mouse
gttcccagctcctagcaaga

SEQ ID NO: 602685 - DNA, 20 bp, mouse
gggagggtcgctaacagatc

SEQ ID NO: 602686 - DNA, 20 bp, mouse
gtttaccggggaccccgaca

SEQ ID NO: 602687 - DNA, 20 bp, mouse
gggcgaaacgcgaacagctg

SEQ ID NO: 602688 - DNA, 20 bp, mouse
ggaaacgcgaacagctgagg

SEQ ID NO: 602689 - DNA, 20 bp, mouse
gattgtgggttagcacgcac

SEQ ID NO: 602690 - DNA, 20 bp, mouse
gcccgtgtcggccaccacgg

SEQ ID NO: 602691 - DNA, 20 bp, mouse
gccgcccctgacacccacac

SEQ ID NO: 602692 - DNA, 20 bp, mouse
gcgtagggaattgggagtag

SEQ ID NO: 602693 - DNA, 20 bp, mouse
gtcacccgtgtcggccacca

SEQ ID NO: 602694 - DNA, 20 bp, mouse
gttggaaccagcaccggtgt

SEQ ID NO: 602695 - DNA, 20 bp, mouse
gcccggcgcgaagcctcggt

SEQ ID NO: 602696 - DNA, 20 bp, mouse
gggaattgcgagcacagggt

SEQ ID NO: 602697 - DNA, 20 bp, mouse
ggcaccgtctgtcccaccgg

SEQ ID NO: 602698 - DNA, 20 bp, mouse
gaagcgcggtccgcacgacc

SEQ ID NO: 602699 - DNA, 20 bp, mouse
gcgggctccgcaggaatgaa

SEQ ID NO: 602700 - DNA, 20 bp, mouse
ggaccgggaattgcgagcac

SEQ ID NO: 602701 - DNA, 20 bp, mouse
ggactggtcggggaactagg

SEQ ID NO: 602702 - DNA, 20 bp, mouse
gctccgactcacctcctggt

SEQ ID NO: 602703 - DNA, 20 bp, mouse
ggcgaacaggtgccaggcat

SEQ ID NO: 602704 - DNA, 20 bp, mouse
gggcatgcgaggaacggcga

SEQ ID NO: 602705 - DNA, 20 bp, mouse
gtccagtactgtgagttcga

SEQ ID NO: 602706 - DNA, 20 bp, mouse
gcagagggctgggcgcttgg

SEQ ID NO: 602707 - DNA, 20 bp, mouse
gccgagcctcagggcgcaga

SEQ ID NO: 602708 - DNA, 20 bp, mouse
gcctcagggcgcagagggct

SEQ ID NO: 602709 - DNA, 20 bp, mouse
gcagctgcgggagcccggct

SEQ ID NO: 602710 - DNA, 20 bp, mouse
gggcgcggttcccaccccgg

SEQ ID NO: 602711 - DNA, 20 bp, mouse
ggctgggcgcttggcggctg

SEQ ID NO: 602712 - DNA, 20 bp, mouse
gttggcggctgcggctcctg

SEQ ID NO: 602713 - DNA, 20 bp, mouse
ggctcccgcagctgccaccg

SEQ ID NO: 602714 - DNA, 20 bp, mouse
gccccgggggccgagcctca

SEQ ID NO: 602715 - DNA, 20 bp, mouse
gcggagcgctgcctccgcgg

SEQ ID NO: 602716 - DNA, 20 bp, mouse
gccgccgccgcggtgctgag

SEQ ID NO: 602717 - DNA, 20 bp, mouse
gcccttagaacggcaggtaa

SEQ ID NO: 602718 - DNA, 20 bp, mouse
gtcgcccctcagcaccgcgg

SEQ ID NO: 602719 - DNA, 20 bp, mouse
ggccgagcccgactgaggtg

SEQ ID NO: 602720 - DNA, 20 bp, mouse
ggctgacaggaggaccgcag

SEQ ID NO: 602721 - DNA, 20 bp, mouse
gggtcctcaccggagaccac

SEQ ID NO: 602722 - DNA, 20 bp, mouse
gctgccgggcgcgggttgct

SEQ ID NO: 602723 - DNA, 20 bp, mouse
gcgggcggcgcggtcctcac

SEQ ID NO: 602724 - DNA, 20 bp, mouse
gggctgtgccgcgcgcgagg

SEQ ID NO: 602725 - DNA, 20 bp, mouse
gggcgcgcgctgctccggcg

SEQ ID NO: 602726 - DNA, 20 bp, mouse
ggcggggctgacccaaggtc

SEQ ID NO: 602727 - DNA, 20 bp, mouse
gtcctggcggggctgaccca

SEQ ID NO: 602728 - DNA, 20 bp, mouse
gggcacccggaagtcggcgg

SEQ ID NO: 602729 - DNA, 20 bp, mouse
gagtgtgcagcgggtggctg

SEQ ID NO: 602730 - DNA, 20 bp, mouse
gggaggcggtgagtgtgcag

SEQ ID NO: 602731 - DNA, 20 bp, mouse
ggagcccggcgcccgacctt
